United States Patent 11,369,692 (MATERIALS AND METHODS FOR TREATMENT OF DUCHENNE MUSCULAR DYSTROPHY) - sequence listing, part 4

SEQ ID NO: 99722 - DNA, 20 bp, Artificial Sequence
  chemically synthesized
tttctgtttcatgatttgga

SEQ ID NO: 99723 - DNA, 20 bp, Artificial Sequence
  chemically synthesized
ttctgtttcatgatttggat

SEQ ID NO: 99724 - DNA, 20 bp, Artificial Sequence
  chemically synthesized
catgatttggataggctgcc

SEQ ID NO: 99725 - DNA, 20 bp, Artificial Sequence
  chemically synthesized
gatttggataggctgcctgg

SEQ ID NO: 99726 - DNA, 20 bp, Artificial Sequence
  chemically synthesized
ccttcaagtatactaccagg

SEQ ID NO: 99727 - DNA, 20 bp, Artificial Sequence
  chemically synthesized
tggccttcaagtatactacc

SEQ ID NO: 99728 - DNA, 20 bp, Artificial Sequence
  chemically synthesized
atggccttcaagtatactac

SEQ ID NO: 99729 - DNA, 20 bp, Artificial Sequence
  chemically synthesized
gctgcctggtagtatacttg

SEQ ID NO: 99730 - DNA, 20 bp, Artificial Sequence
  chemically synthesized
ctgcctggtagtatacttga

SEQ ID NO: 99731 - DNA, 20 bp, Artificial Sequence
  chemically synthesized
taaatgcaatgatggccttc

SEQ ID NO: 99732 - DNA, 20 bp, Artificial Sequence
  chemically synthesized
gaattacttaaatgcaatga

SEQ ID NO: 99733 - DNA, 20 bp, Artificial Sequence
  chemically synthesized
tgaaggccatcattgcattt

SEQ ID NO: 99734 - DNA, 20 bp, Artificial Sequence
  chemically synthesized
attgcatttaagtaattccc

SEQ ID NO: 99735 - DNA, 20 bp, Artificial Sequence
  chemically synthesized
ttaagtaattccccagatga

SEQ ID NO: 99736 - DNA, 20 bp, Artificial Sequence
  chemically synthesized
taaacttcctctgtcatctg

SEQ ID NO: 99737 - DNA, 20 bp, Artificial Sequence
  chemically synthesized
ataaacttcctctgtcatct

SEQ ID NO: 99738 - DNA, 20 bp, Artificial Sequence
  chemically synthesized
aagtaattccccagatgaca

SEQ ID NO: 99739 - DNA, 20 bp, Artificial Sequence
  chemically synthesized
gataaacttcctctgtcatc

SEQ ID NO: 99740 - DNA, 20 bp, Artificial Sequence
  chemically synthesized
agtaattccccagatgacag

SEQ ID NO: 99741 - DNA, 20 bp, Artificial Sequence
  chemically synthesized
aattccccagatgacagagg

SEQ ID NO: 99742 - DNA, 20 bp, Artificial Sequence
  chemically synthesized
atgacagaggaagtttatca

SEQ ID NO: 99743 - DNA, 20 bp, Artificial Sequence
  chemically synthesized
tgacagaggaagtttatcat

SEQ ID NO: 99744 - DNA, 20 bp, Artificial Sequence
  chemically synthesized
tatcataggtgaaattttaa

SEQ ID NO: 99745 - DNA, 20 bp, Artificial Sequence
  chemically synthesized
aaattttaaaagatttatga

SEQ ID NO: 99746 - DNA, 20 bp, Artificial Sequence
  chemically synthesized
aattttaaaagatttatgat

SEQ ID NO: 99747 - DNA, 20 bp, Artificial Sequence
  chemically synthesized
taaaagatttatgataggtg

SEQ ID NO: 99748 - DNA, 20 bp, Artificial Sequence
  chemically synthesized
ttaaaaaaaataataataat

SEQ ID NO: 99749 - DNA, 20 bp, Artificial Sequence
  chemically synthesized
aaaaaataataataattggc

SEQ ID NO: 99750 - DNA, 20 bp, Artificial Sequence
  chemically synthesized
aaaaataataataattggcc

SEQ ID NO: 99751 - DNA, 20 bp, Artificial Sequence
  chemically synthesized
taataataattggccgggcg

SEQ ID NO: 99752 - DNA, 20 bp, Artificial Sequence
  chemically synthesized
taataattggccgggcgcag

SEQ ID NO: 99753 - DNA, 20 bp, Artificial Sequence
  chemically synthesized
caggcgtgagccactgcgcc

SEQ ID NO: 99754 - DNA, 20 bp, Artificial Sequence
  chemically synthesized
agtgctgggattacaggcgt

SEQ ID NO: 99755 - DNA, 20 bp, Artificial Sequence
  chemically synthesized
gtggctcacgcctgtaatcc

SEQ ID NO: 99756 - DNA, 20 bp, Artificial Sequence
  chemically synthesized
tcccaaagtgctgggattac

SEQ ID NO: 99757 - DNA, 20 bp, Artificial Sequence
  chemically synthesized
ctcccaaagtgctgggatta

SEQ ID NO: 99758 - DNA, 20 bp, Artificial Sequence
  chemically synthesized
cgcctgtaatcccagcactt

SEQ ID NO: 99759 - DNA, 20 bp, Artificial Sequence
  chemically synthesized
cctcggcctcccaaagtgct

SEQ ID NO: 99760 - DNA, 20 bp, Artificial Sequence
  chemically synthesized
gcctgtaatcccagcacttt

SEQ ID NO: 99761 - DNA, 20 bp, Artificial Sequence
  chemically synthesized
acctcggcctcccaaagtgc

SEQ ID NO: 99762 - DNA, 20 bp, Artificial Sequence
  chemically synthesized
ctgtaatcccagcactttgg

SEQ ID NO: 99763 - DNA, 20 bp, Artificial Sequence
  chemically synthesized
tgtaatcccagcactttggg

SEQ ID NO: 99764 - DNA, 20 bp, Artificial Sequence
  chemically synthesized
ccacccacctcggcctccca

SEQ ID NO: 99765 - DNA, 20 bp, Artificial Sequence
  chemically synthesized
tcccagcactttgggaggcc

SEQ ID NO: 99766 - DNA, 20 bp, Artificial Sequence
  chemically synthesized
cccagcactttgggaggccg

SEQ ID NO: 99767 - DNA, 20 bp, Artificial Sequence
  chemically synthesized
agcactttgggaggccgagg

SEQ ID NO: 99768 - DNA, 20 bp, Artificial Sequence
  chemically synthesized
gcactttgggaggccgaggt

SEQ ID NO: 99769 - DNA, 20 bp, Artificial Sequence
  chemically synthesized
ctttgggaggccgaggtggg

SEQ ID NO: 99770 - DNA, 20 bp, Artificial Sequence
  chemically synthesized
acctcgtgatccacccacct

SEQ ID NO: 99771 - DNA, 20 bp, Artificial Sequence
  chemically synthesized
ggccgaggtgggtggatcac

SEQ ID NO: 99772 - DNA, 20 bp, Artificial Sequence
  chemically synthesized
gccgaggtgggtggatcacg

SEQ ID NO: 99773 - DNA, 20 bp, Artificial Sequence
  chemically synthesized
aggtgggtggatcacgaggt

SEQ ID NO: 99774 - DNA, 20 bp, Artificial Sequence
  chemically synthesized
ggtgggtggatcacgaggtc

SEQ ID NO: 99775 - DNA, 20 bp, Artificial Sequence
  chemically synthesized
tgggtggatcacgaggtcag

SEQ ID NO: 99776 - DNA, 20 bp, Artificial Sequence
  chemically synthesized
gatcacgaggtcaggagatc

SEQ ID NO: 99777 - DNA, 20 bp, Artificial Sequence
  chemically synthesized
tcaggagatcgagaccatcc

SEQ ID NO: 99778 - DNA, 20 bp, Artificial Sequence
  chemically synthesized
tttctccttgttagccagga

SEQ ID NO: 99779 - DNA, 20 bp, Artificial Sequence
  chemically synthesized
tcgagaccatcctggctaac

SEQ ID NO: 99780 - DNA, 20 bp, Artificial Sequence
  chemically synthesized
ggggtttctccttgttagcc

SEQ ID NO: 99781 - DNA, 20 bp, Artificial Sequence
  chemically synthesized
cgagaccatcctggctaaca

SEQ ID NO: 99782 - DNA, 20 bp, Artificial Sequence
  chemically synthesized
tggggtttctccttgttagc

SEQ ID NO: 99783 - DNA, 20 bp, Artificial Sequence
  chemically synthesized
agaccatcctggctaacaag

SEQ ID NO: 99784 - DNA, 20 bp, Artificial Sequence
  chemically synthesized
gagatggggtttctccttgt

SEQ ID NO: 99785 - DNA, 20 bp, Artificial Sequence
  chemically synthesized
gtgcatttttagtagagatg

SEQ ID NO: 99786 - DNA, 20 bp, Artificial Sequence
  chemically synthesized
tgtgcatttttagtagagat

SEQ ID NO: 99787 - DNA, 20 bp, Artificial Sequence
  chemically synthesized
ttgtgcatttttagtagaga

SEQ ID NO: 99788 - DNA, 20 bp, Artificial Sequence
  chemically synthesized
aattttgtgcatttttagta

SEQ ID NO: 99789 - DNA, 20 bp, Artificial Sequence
  chemically synthesized
ctaattttgtgcatttttag

SEQ ID NO: 99790 - DNA, 20 bp, Artificial Sequence
  chemically synthesized
tggctaattttgtgcatttt

SEQ ID NO: 99791 - DNA, 20 bp, Artificial Sequence
  chemically synthesized
ctactaaaaatgcacaaaat

SEQ ID NO: 99792 - DNA, 20 bp, Artificial Sequence
  chemically synthesized
taaaaatgcacaaaattagc

SEQ ID NO: 99793 - DNA, 20 bp, Artificial Sequence
  chemically synthesized
tgcacaaaattagccagaca

SEQ ID NO: 99794 - DNA, 20 bp, Artificial Sequence
  chemically synthesized
acaaaattagccagacatgg

SEQ ID NO: 99795 - DNA, 20 bp, Artificial Sequence
  chemically synthesized
caggcgcctgccaccatgtc

SEQ ID NO: 99796 - DNA, 20 bp, Artificial Sequence
  chemically synthesized
aaattagccagacatggtgg

SEQ ID NO: 99797 - DNA, 20 bp, Artificial Sequence
  chemically synthesized
aattagccagacatggtggc

SEQ ID NO: 99798 - DNA, 20 bp, Artificial Sequence
  chemically synthesized
gacatggtggcaggcgcctg

SEQ ID NO: 99799 - DNA, 20 bp, Artificial Sequence
  chemically synthesized
gtggcaggcgcctgtggtac

SEQ ID NO: 99800 - DNA, 20 bp, Artificial Sequence
  chemically synthesized
tcccgagcagctggtaccac

SEQ ID NO: 99801 - DNA, 20 bp, Artificial Sequence
  chemically synthesized
ctcccgagcagctggtacca

SEQ ID NO: 99802 - DNA, 20 bp, Artificial Sequence
  chemically synthesized
cgcctgtggtaccagctgct

SEQ ID NO: 99803 - DNA, 20 bp, Artificial Sequence
  chemically synthesized
gcctgtggtaccagctgctc

SEQ ID NO: 99804 - DNA, 20 bp, Artificial Sequence
  chemically synthesized
gcctcagcctcccgagcagc

SEQ ID NO: 99805 - DNA, 20 bp, Artificial Sequence
  chemically synthesized
ctgtggtaccagctgctcgg

SEQ ID NO: 99806 - DNA, 20 bp, Artificial Sequence
  chemically synthesized
tgtggtaccagctgctcggg

SEQ ID NO: 99807 - DNA, 20 bp, Artificial Sequence
  chemically synthesized
tcctgcctcagcctcccgag

SEQ ID NO: 99808 - DNA, 20 bp, Artificial Sequence
  chemically synthesized
ttctcctgcctcagcctccc

SEQ ID NO: 99809 - DNA, 20 bp, Artificial Sequence
  chemically synthesized
taccagctgctcgggaggct

SEQ ID NO: 99810 - DNA, 20 bp, Artificial Sequence
  chemically synthesized
accagctgctcgggaggctg

SEQ ID NO: 99811 - DNA, 20 bp, Artificial Sequence
  chemically synthesized
agctgctcgggaggctgagg

SEQ ID NO: 99812 - DNA, 20 bp, Artificial Sequence
  chemically synthesized
gctgctcgggaggctgaggc

SEQ ID NO: 99813 - DNA, 20 bp, Artificial Sequence
  chemically synthesized
tgctcgggaggctgaggcag

SEQ ID NO: 99814 - DNA, 20 bp, Artificial Sequence
  chemically synthesized
ttcacgccattctcctgcct

SEQ ID NO: 99815 - DNA, 20 bp, Artificial Sequence
  chemically synthesized
gggaggctgaggcaggagaa

SEQ ID NO: 99816 - DNA, 20 bp, Artificial Sequence
  chemically synthesized
gcaggagaatggcgtgaacc

SEQ ID NO: 99817 - DNA, 20 bp, Artificial Sequence
  chemically synthesized
caggagaatggcgtgaaccc

SEQ ID NO: 99818 - DNA, 20 bp, Artificial Sequence
  chemically synthesized
ggagaatggcgtgaacccag

SEQ ID NO: 99819 - DNA, 20 bp, Artificial Sequence
  chemically synthesized
gagaatggcgtgaacccagg

SEQ ID NO: 99820 - DNA, 20 bp, Artificial Sequence
  chemically synthesized
aatggcgtgaacccaggagg

SEQ ID NO: 99821 - DNA, 20 bp, Artificial Sequence
  chemically synthesized
cactgcaagctccacctcct

SEQ ID NO: 99822 - DNA, 20 bp, Artificial Sequence
  chemically synthesized
tggcgtgaacccaggaggtg

SEQ ID NO: 99823 - DNA, 20 bp, Artificial Sequence
  chemically synthesized
tcactgcaagctccacctcc

SEQ ID NO: 99824 - DNA, 20 bp, Artificial Sequence
  chemically synthesized
aacccaggaggtggagcttg

SEQ ID NO: 99825 - DNA, 20 bp, Artificial Sequence
  chemically synthesized
caggaggtggagcttgcagt

SEQ ID NO: 99826 - DNA, 20 bp, Artificial Sequence
  chemically synthesized
gtgtgatctcggctcactgc

SEQ ID NO: 99827 - DNA, 20 bp, Artificial Sequence
  chemically synthesized
ggtggagcttgcagtgagcc

SEQ ID NO: 99828 - DNA, 20 bp, Artificial Sequence
  chemically synthesized
agagtgcagtggtgtgatct

SEQ ID NO: 99829 - DNA, 20 bp, Artificial Sequence
  chemically synthesized
ttacccaggctagagtgcag

SEQ ID NO: 99830 - DNA, 20 bp, Artificial Sequence
  chemically synthesized
gagatcacaccactgcactc

SEQ ID NO: 99831 - DNA, 20 bp, Artificial Sequence
  chemically synthesized
ctgttacccaggctagagtg

SEQ ID NO: 99832 - DNA, 20 bp, Artificial Sequence
  chemically synthesized
cacaccactgcactctagcc

SEQ ID NO: 99833 - DNA, 20 bp, Artificial Sequence
  chemically synthesized
acaccactgcactctagcct

SEQ ID NO: 99834 - DNA, 20 bp, Artificial Sequence
  chemically synthesized
tcactctgttacccaggcta

SEQ ID NO: 99835 - DNA, 20 bp, Artificial Sequence
  chemically synthesized
tctcactctgttacccaggc

SEQ ID NO: 99836 - DNA, 20 bp, Artificial Sequence
  chemically synthesized
ctgcactctagcctgggtaa

SEQ ID NO: 99837 - DNA, 20 bp, Artificial Sequence
  chemically synthesized
agagtctcactctgttaccc

SEQ ID NO: 99838 - DNA, 20 bp, Artificial Sequence
  chemically synthesized
gcactctagcctgggtaaca

SEQ ID NO: 99839 - DNA, 20 bp, Artificial Sequence
  chemically synthesized
cagagtctcactctgttacc

SEQ ID NO: 99840 - DNA, 20 bp, Artificial Sequence
  chemically synthesized
tctagcctgggtaacagagt

SEQ ID NO: 99841 - DNA, 20 bp, Artificial Sequence
  chemically synthesized
ttttttttttttttgataca

SEQ ID NO: 99842 - DNA, 20 bp, Artificial Sequence
  chemically synthesized
ctttttttttttttttgata

SEQ ID NO: 99843 - DNA, 20 bp, Artificial Sequence
  chemically synthesized
ctgtatcaaaaaaaaaaaaa

SEQ ID NO: 99844 - DNA, 20 bp, Artificial Sequence
  chemically synthesized
aaaaaaagaaaaaaaaataa

SEQ ID NO: 99845 - DNA, 20 bp, Artificial Sequence
  chemically synthesized
ttttcccccttgaaaaattt

SEQ ID NO: 99846 - DNA, 20 bp, Artificial Sequence
  chemically synthesized
aatagtaacttaaatttttc

SEQ ID NO: 99847 - DNA, 20 bp, Artificial Sequence
  chemically synthesized
atagtaacttaaatttttca

SEQ ID NO: 99848 - DNA, 20 bp, Artificial Sequence
  chemically synthesized
tagtaacttaaatttttcaa

SEQ ID NO: 99849 - DNA, 20 bp, Artificial Sequence
  chemically synthesized
agtaacttaaatttttcaag

SEQ ID NO: 99850 - DNA, 20 bp, Artificial Sequence
  chemically synthesized
gtaacttaaatttttcaagg

SEQ ID NO: 99851 - DNA, 20 bp, Artificial Sequence
  chemically synthesized
ttcaagggggaaaaacacct

SEQ ID NO: 99852 - DNA, 20 bp, Artificial Sequence
  chemically synthesized
caagggggaaaaacacctcg

SEQ ID NO: 99853 - DNA, 20 bp, Artificial Sequence
  chemically synthesized
aatgatcttcatcaactccg

SEQ ID NO: 99854 - DNA, 20 bp, Artificial Sequence
  chemically synthesized
gaatgatcttcatcaactcc

SEQ ID NO: 99855 - DNA, 20 bp, Artificial Sequence
  chemically synthesized
aaaacacctcggagttgatg

SEQ ID NO: 99856 - DNA, 20 bp, Artificial Sequence
  chemically synthesized
ttaaaatgtagcaaatgatt

SEQ ID NO: 99857 - DNA, 20 bp, Artificial Sequence
  chemically synthesized
taatcatttgctacatttta

SEQ ID NO: 99858 - DNA, 20 bp, Artificial Sequence
  chemically synthesized
caagttcattctttaaaatg

SEQ ID NO: 99859 - DNA, 20 bp, Artificial Sequence
  chemically synthesized
ttttcacttcacaggaagtc

SEQ ID NO: 99860 - DNA, 20 bp, Artificial Sequence
  chemically synthesized
aatgaacttgacttcctgtg

SEQ ID NO: 99861 - DNA, 20 bp, Artificial Sequence
  chemically synthesized
tgcttttttcacttcacagg

SEQ ID NO: 99862 - DNA, 20 bp, Artificial Sequence
  chemically synthesized
ttttgcttttttcacttcac

SEQ ID NO: 99863 - DNA, 20 bp, Artificial Sequence
  chemically synthesized
tttttgcttttttcacttca

SEQ ID NO: 99864 - DNA, 20 bp, Artificial Sequence
  chemically synthesized
gacttcctgtgaagtgaaaa

SEQ ID NO: 99865 - DNA, 20 bp, Artificial Sequence
  chemically synthesized
aaaaaaaaaaaatcttgaaa

SEQ ID NO: 99866 - DNA, 20 bp, Artificial Sequence
  chemically synthesized
ttcagaagtcaatccatttc

SEQ ID NO: 99867 - DNA, 20 bp, Artificial Sequence
  chemically synthesized
ggcctcacaaatcatttcag

SEQ ID NO: 99868 - DNA, 20 bp, Artificial Sequence
  chemically synthesized
tgtggcctcacaaatcattt

SEQ ID NO: 99869 - DNA, 20 bp, Artificial Sequence
  chemically synthesized
tgacttctgaaatgatttgt

SEQ ID NO: 99870 - DNA, 20 bp, Artificial Sequence
  chemically synthesized
gacttctgaaatgatttgtg

SEQ ID NO: 99871 - DNA, 20 bp, Artificial Sequence
  chemically synthesized
atgatttgtgaggccacatc

SEQ ID NO: 99872 - DNA, 20 bp, Artificial Sequence
  chemically synthesized
tctcaattcctttctggatg

SEQ ID NO: 99873 - DNA, 20 bp, Artificial Sequence
  chemically synthesized
tttgtgaggccacatccaga

SEQ ID NO: 99874 - DNA, 20 bp, Artificial Sequence
  chemically synthesized
ttgtgaggccacatccagaa

SEQ ID NO: 99875 - DNA, 20 bp, Artificial Sequence
  chemically synthesized
actttttctcaattcctttc

SEQ ID NO: 99876 - DNA, 20 bp, Artificial Sequence
  chemically synthesized
gccacatccagaaaggaatt

SEQ ID NO: 99877 - DNA, 20 bp, Artificial Sequence
  chemically synthesized
tccagaaaggaattgagaaa

SEQ ID NO: 99878 - DNA, 20 bp, Artificial Sequence
  chemically synthesized
tttctttgatcatatattta

SEQ ID NO: 99879 - DNA, 20 bp, Artificial Sequence
  chemically synthesized
agtctttaaatatatgatca

SEQ ID NO: 99880 - DNA, 20 bp, Artificial Sequence
  chemically synthesized
atgttgaattaaaaaaaccc

SEQ ID NO: 99881 - DNA, 20 bp, Artificial Sequence
  chemically synthesized
gtcatcagaatatgatgctt

SEQ ID NO: 99882 - DNA, 20 bp, Artificial Sequence
  chemically synthesized
tgtcatcagaatatgatgct

SEQ ID NO: 99883 - DNA, 20 bp, Artificial Sequence
  chemically synthesized
tgaaaatgagcaagtgtcat

SEQ ID NO: 99884 - DNA, 20 bp, Artificial Sequence
  chemically synthesized
acgaacgtgtgaaaatgagc

SEQ ID NO: 99885 - DNA, 20 bp, Artificial Sequence
  chemically synthesized
tggaacgaacgtgtgaaaat

SEQ ID NO: 99886 - DNA, 20 bp, Artificial Sequence
  chemically synthesized
cttgtgttttttaatatttt

SEQ ID NO: 99887 - DNA, 20 bp, Artificial Sequence
  chemically synthesized
ccaaaaatattaaaaaacac

SEQ ID NO: 99888 - DNA, 20 bp, Artificial Sequence
  chemically synthesized
aaaaatattaaaaaacacaa

SEQ ID NO: 99889 - DNA, 20 bp, Artificial Sequence
  chemically synthesized
aaacaatgcaaaaataaatt

SEQ ID NO: 99890 - DNA, 20 bp, Artificial Sequence
  chemically synthesized
caaaaataaatttagatcta

SEQ ID NO: 99891 - DNA, 20 bp, Artificial Sequence
  chemically synthesized
taggtctttcaatgacactt

SEQ ID NO: 99892 - DNA, 20 bp, Artificial Sequence
  chemically synthesized
tagatctaaagtgtcattga

SEQ ID NO: 99893 - DNA, 20 bp, Artificial Sequence
  chemically synthesized
gtgtcattgaaagacctaat

SEQ ID NO: 99894 - DNA, 20 bp, Artificial Sequence
  chemically synthesized
attaactttctaatccaatt

SEQ ID NO: 99895 - DNA, 20 bp, Artificial Sequence
  chemically synthesized
attgaaagacctaattggat

SEQ ID NO: 99896 - DNA, 20 bp, Artificial Sequence
  chemically synthesized
tattaactttctaatccaat

SEQ ID NO: 99897 - DNA, 20 bp, Artificial Sequence
  chemically synthesized
aaagacctaattggattaga

SEQ ID NO: 99898 - DNA, 20 bp, Artificial Sequence
  chemically synthesized
atatttaaataaataatatt

SEQ ID NO: 99899 - DNA, 20 bp, Artificial Sequence
  chemically synthesized
aaataaataatattcagaaa

SEQ ID NO: 99900 - DNA, 20 bp, Artificial Sequence
  chemically synthesized
ataaataatattcagaaaca

SEQ ID NO: 99901 - DNA, 20 bp, Artificial Sequence
  chemically synthesized
aaataatattcagaaacaga

SEQ ID NO: 99902 - DNA, 20 bp, Artificial Sequence
  chemically synthesized
aataatattcagaaacagag

SEQ ID NO: 99903 - DNA, 20 bp, Artificial Sequence
  chemically synthesized
aaacagagaggattatgctc

SEQ ID NO: 99904 - DNA, 20 bp, Artificial Sequence
  chemically synthesized
atacattgaaataaaggcca

SEQ ID NO: 99905 - DNA, 20 bp, Artificial Sequence
  chemically synthesized
acatacattgaaataaaggc

SEQ ID NO: 99906 - DNA, 20 bp, Artificial Sequence
  chemically synthesized
gataacatacattgaaataa

SEQ ID NO: 99907 - DNA, 20 bp, Artificial Sequence
  chemically synthesized
tgataacatacattgaaata

SEQ ID NO: 99908 - DNA, 20 bp, Artificial Sequence
  chemically synthesized
tttatttcaatgtatgttat

SEQ ID NO: 99909 - DNA, 20 bp, Artificial Sequence
  chemically synthesized
ttgcatatttaattttatag

SEQ ID NO: 99910 - DNA, 20 bp, Artificial Sequence
  chemically synthesized
aaattgcatatttaatttta

SEQ ID NO: 99911 - DNA, 20 bp, Artificial Sequence
  chemically synthesized
ataaaattaaatatgcaatt

SEQ ID NO: 99912 - DNA, 20 bp, Artificial Sequence
  chemically synthesized
aaaattaaatatgcaatttg

SEQ ID NO: 99913 - DNA, 20 bp, Artificial Sequence
  chemically synthesized
aatttggagaaatttaattt

SEQ ID NO: 99914 - DNA, 20 bp, Artificial Sequence
  chemically synthesized
gaaatttaatttaagtttgt

SEQ ID NO: 99915 - DNA, 20 bp, Artificial Sequence
  chemically synthesized
aaatttaatttaagtttgtt

SEQ ID NO: 99916 - DNA, 20 bp, Artificial Sequence
  chemically synthesized
aatgcctttaaacaaatggg

SEQ ID NO: 99917 - DNA, 20 bp, Artificial Sequence
  chemically synthesized
cagaatgcctttaaacaaat

SEQ ID NO: 99918 - DNA, 20 bp, Artificial Sequence
  chemically synthesized
gcagaatgcctttaaacaaa

SEQ ID NO: 99919 - DNA, 20 bp, Artificial Sequence
  chemically synthesized
atttactgcccatttgttta

SEQ ID NO: 99920 - DNA, 20 bp, Artificial Sequence
  chemically synthesized
tttactgcccatttgtttaa

SEQ ID NO: 99921 - DNA, 20 bp, Artificial Sequence
  chemically synthesized
tttgtttaaaggcattctgc

SEQ ID NO: 99922 - DNA, 20 bp, Artificial Sequence
  chemically synthesized
tagccccctgcagtatctag

SEQ ID NO: 99923 - DNA, 20 bp, Artificial Sequence
  chemically synthesized
aggcattctgctagatactg

SEQ ID NO: 99924 - DNA, 20 bp, Artificial Sequence
  chemically synthesized
tcgtagccccctgcagtatc

SEQ ID NO: 99925 - DNA, 20 bp, Artificial Sequence
  chemically synthesized
ggcattctgctagatactgc

SEQ ID NO: 99926 - DNA, 20 bp, Artificial Sequence
  chemically synthesized
gcattctgctagatactgca

SEQ ID NO: 99927 - DNA, 20 bp, Artificial Sequence
  chemically synthesized
cattctgctagatactgcag

SEQ ID NO: 99928 - DNA, 20 bp, Artificial Sequence
  chemically synthesized
attctgctagatactgcagg

SEQ ID NO: 99929 - DNA, 20 bp, Artificial Sequence
  chemically synthesized
ttcatcttcgtagccccctg

SEQ ID NO: 99930 - DNA, 20 bp, Artificial Sequence
  chemically synthesized
agatactgcagggggctacg

SEQ ID NO: 99931 - DNA, 20 bp, Artificial Sequence
  chemically synthesized
gaatgtatttttcatcttcg

SEQ ID NO: 99932 - DNA, 20 bp, Artificial Sequence
  chemically synthesized
gaagatgaaaaatacattct

SEQ ID NO: 99933 - DNA, 20 bp, Artificial Sequence
  chemically synthesized
aagatgaaaaatacattctc

SEQ ID NO: 99934 - DNA, 20 bp, Artificial Sequence
  chemically synthesized
taattagactgtaaagtcct

SEQ ID NO: 99935 - DNA, 20 bp, Artificial Sequence
  chemically synthesized
aatacattctcaggacttta

SEQ ID NO: 99936 - DNA, 20 bp, Artificial Sequence
  chemically synthesized
atagttgtaattagactgta

SEQ ID NO: 99937 - DNA, 20 bp, Artificial Sequence
  chemically synthesized
acattcttcatagttgtaat

SEQ ID NO: 99938 - DNA, 20 bp, Artificial Sequence
  chemically synthesized
acagtctaattacaactatg

SEQ ID NO: 99939 - DNA, 20 bp, Artificial Sequence
  chemically synthesized
gctttggagaacattcttca

SEQ ID NO: 99940 - DNA, 20 bp, Artificial Sequence
  chemically synthesized
actatgaagaatgttctcca

SEQ ID NO: 99941 - DNA, 20 bp, Artificial Sequence
  chemically synthesized
aaattgtatttagagctttg

SEQ ID NO: 99942 - DNA, 20 bp, Artificial Sequence
  chemically synthesized
ctaaattgtatttagagctt

SEQ ID NO: 99943 - DNA, 20 bp, Artificial Sequence
  chemically synthesized
tttgtactaaattgtattta

SEQ ID NO: 99944 - DNA, 20 bp, Artificial Sequence
  chemically synthesized
tatttgtactaaattgtatt

SEQ ID NO: 99945 - DNA, 20 bp, Artificial Sequence
  chemically synthesized
ccaaagctctaaatacaatt

SEQ ID NO: 99946 - DNA, 20 bp, Artificial Sequence
  chemically synthesized
aatacaatttagtacaaata

SEQ ID NO: 99947 - DNA, 20 bp, Artificial Sequence
  chemically synthesized
acaaataaagtacaaataaa

SEQ ID NO: 99948 - DNA, 20 bp, Artificial Sequence
  chemically synthesized
aaagtacaaataaaaagcta

SEQ ID NO: 99949 - DNA, 20 bp, Artificial Sequence
  chemically synthesized
agtacaaataaaaagctaaa

SEQ ID NO: 99950 - DNA, 20 bp, Artificial Sequence
  chemically synthesized
gtacaaataaaaagctaaag

SEQ ID NO: 99951 - DNA, 20 bp, Artificial Sequence
  chemically synthesized
ctcctttcttcaaacctctt

SEQ ID NO: 99952 - DNA, 20 bp, Artificial Sequence
  chemically synthesized
taaaaagctaaagaggtttg

SEQ ID NO: 99953 - DNA, 20 bp, Artificial Sequence
  chemically synthesized
aagctaaagaggtttgaaga

SEQ ID NO: 99954 - DNA, 20 bp, Artificial Sequence
  chemically synthesized
agctaaagaggtttgaagaa

SEQ ID NO: 99955 - DNA, 20 bp, Artificial Sequence
  chemically synthesized
ctaaagaggtttgaagaaag

SEQ ID NO: 99956 - DNA, 20 bp, Artificial Sequence
  chemically synthesized
gtttgaagaaaggagaaaca

SEQ ID NO: 99957 - DNA, 20 bp, Artificial Sequence
  chemically synthesized
gaaaggagaaacatagctgc

SEQ ID NO: 99958 - DNA, 20 bp, Artificial Sequence
  chemically synthesized
aaaggagaaacatagctgct

SEQ ID NO: 99959 - DNA, 20 bp, Artificial Sequence
  chemically synthesized
aggagaaacatagctgctgg

SEQ ID NO: 99960 - DNA, 20 bp, Artificial Sequence
  chemically synthesized
ggagaaacatagctgctggg

SEQ ID NO: 99961 - DNA, 20 bp, Artificial Sequence
  chemically synthesized
gctgttcccgatcctcccag

SEQ ID NO: 99962 - DNA, 20 bp, Artificial Sequence
  chemically synthesized
aacatagctgctgggaggat

SEQ ID NO: 99963 - DNA, 20 bp, Artificial Sequence
  chemically synthesized
tgagctgttcccgatcctcc

SEQ ID NO: 99964 - DNA, 20 bp, Artificial Sequence
  chemically synthesized
acatagctgctgggaggatc

SEQ ID NO: 99965 - DNA, 20 bp, Artificial Sequence
  chemically synthesized
gctgctgggaggatcgggaa

SEQ ID NO: 99966 - DNA, 20 bp, Artificial Sequence
  chemically synthesized
ggaggatcgggaacagctca

SEQ ID NO: 99967 - DNA, 20 bp, Artificial Sequence
  chemically synthesized
atcgggaacagctcatggtt

SEQ ID NO: 99968 - DNA, 20 bp, Artificial Sequence
  chemically synthesized
tcgggaacagctcatggttg

SEQ ID NO: 99969 - DNA, 20 bp, Artificial Sequence
  chemically synthesized
tcccgcagctcctcaaccat

SEQ ID NO: 99970 - DNA, 20 bp, Artificial Sequence
  chemically synthesized
gggaacagctcatggttgag

SEQ ID NO: 99971 - DNA, 20 bp, Artificial Sequence
  chemically synthesized
agctcatggttgaggagctg

SEQ ID NO: 99972 - DNA, 20 bp, Artificial Sequence
  chemically synthesized
gctcatggttgaggagctgc

SEQ ID NO: 99973 - DNA, 20 bp, Artificial Sequence
  chemically synthesized
tcatggttgaggagctgcgg

SEQ ID NO: 99974 - DNA, 20 bp, Artificial Sequence
  chemically synthesized
ggttgaggagctgcgggaga

SEQ ID NO: 99975 - DNA, 20 bp, Artificial Sequence
  chemically synthesized
tattgaagtactgtctcccg

SEQ ID NO: 99976 - DNA, 20 bp, Artificial Sequence
  chemically synthesized
ggagacagtacttcaataat

SEQ ID NO: 99977 - DNA, 20 bp, Artificial Sequence
  chemically synthesized
tgccaataccctaattattg

SEQ ID NO: 99978 - DNA, 20 bp, Artificial Sequence
  chemically synthesized
gagacagtacttcaataatt

SEQ ID NO: 99979 - DNA, 20 bp, Artificial Sequence
  chemically synthesized
agacagtacttcaataatta

SEQ ID NO: 99980 - DNA, 20 bp, Artificial Sequence
  chemically synthesized
tacttcaataattagggtat

SEQ ID NO: 99981 - DNA, 20 bp, Artificial Sequence
  chemically synthesized
ttcaataattagggtattgg

SEQ ID NO: 99982 - DNA, 20 bp, Artificial Sequence
  chemically synthesized
tcaataattagggtattggc

SEQ ID NO: 99983 - DNA, 20 bp, Artificial Sequence
  chemically synthesized
aattagggtattggcaggca

SEQ ID NO: 99984 - DNA, 20 bp, Artificial Sequence
  chemically synthesized
ttagggtattggcaggcaaa

SEQ ID NO: 99985 - DNA, 20 bp, Artificial Sequence
  chemically synthesized
gtattggcaggcaaagagca

SEQ ID NO: 99986 - DNA, 20 bp, Artificial Sequence
  chemically synthesized
attggcaggcaaagagcaca

SEQ ID NO: 99987 - DNA, 20 bp, Artificial Sequence
  chemically synthesized
gcaggcaaagagcacagaga

SEQ ID NO: 99988 - DNA, 20 bp, Artificial Sequence
  chemically synthesized
caaagagcacagagaaagcc

SEQ ID NO: 99989 - DNA, 20 bp, Artificial Sequence
  chemically synthesized
agagcacagagaaagccaag

SEQ ID NO: 99990 - DNA, 20 bp, Artificial Sequence
  chemically synthesized
gagcacagagaaagccaaga

SEQ ID NO: 99991 - DNA, 20 bp, Artificial Sequence
  chemically synthesized
tataatggccttggccttct

SEQ ID NO: 99992 - DNA, 20 bp, Artificial Sequence
  chemically synthesized
cagagaaagccaagaaggcc

SEQ ID NO: 99993 - DNA, 20 bp, Artificial Sequence
  chemically synthesized
agagaaagccaagaaggcca

SEQ ID NO: 99994 - DNA, 20 bp, Artificial Sequence
  chemically synthesized
tccgtgtcatataatggcct

SEQ ID NO: 99995 - DNA, 20 bp, Artificial Sequence
  chemically synthesized
ctaagttccgtgtcatataa

SEQ ID NO: 99996 - DNA, 20 bp, Artificial Sequence
  chemically synthesized
gccaaggccattatatgaca

SEQ ID NO: 99997 - DNA, 20 bp, Artificial Sequence
  chemically synthesized
ccattatatgacacggaact

SEQ ID NO: 99998 - DNA, 20 bp, Artificial Sequence
  chemically synthesized
ccttttataggatcacatct

SEQ ID NO: 99999 - DNA, 20 bp, Artificial Sequence
  chemically synthesized
acttagatgtgatcctataa

SEQ ID NO: 100000 - DNA, 20 bp, Artificial Sequence
  chemically synthesized
cttagatgtgatcctataaa

SEQ ID NO: 100001 - DNA, 20 bp, Artificial Sequence
  chemically synthesized
gccactgtcttgccttttat

SEQ ID NO: 100002 - DNA, 20 bp, Artificial Sequence
  chemically synthesized
agccactgtcttgcctttta

SEQ ID NO: 100003 - DNA, 20 bp, Artificial Sequence
  chemically synthesized
gatgtgatcctataaaaggc

SEQ ID NO: 100004 - DNA, 20 bp, Artificial Sequence
  chemically synthesized
tgatcctataaaaggcaaga

SEQ ID NO: 100005 - DNA, 20 bp, Artificial Sequence
  chemically synthesized
tcctataaaaggcaagacag

SEQ ID NO: 100006 - DNA, 20 bp, Artificial Sequence
  chemically synthesized
aggcaagacagtggctcatg

SEQ ID NO: 100007 - DNA, 20 bp, Artificial Sequence
  chemically synthesized
aaagagtttacaggccacat

SEQ ID NO: 100008 - DNA, 20 bp, Artificial Sequence
  chemically synthesized
ctttattcaaaagagtttac

SEQ ID NO: 100009 - DNA, 20 bp, Artificial Sequence
  chemically synthesized
tctttattcaaaagagttta

SEQ ID NO: 100010 - DNA, 20 bp, Artificial Sequence
  chemically synthesized
tttggggtctttattcaaaa

SEQ ID NO: 100011 - DNA, 20 bp, Artificial Sequence
  chemically synthesized
cctgtaaactcttttgaata

SEQ ID NO: 100012 - DNA, 20 bp, Artificial Sequence
  chemically synthesized
agtttggggtctttattcaa

SEQ ID NO: 100013 - DNA, 20 bp, Artificial Sequence
  chemically synthesized
taattacccatagaagtttg

SEQ ID NO: 100014 - DNA, 20 bp, Artificial Sequence
  chemically synthesized
gtaattacccatagaagttt

SEQ ID NO: 100015 - DNA, 20 bp, Artificial Sequence
  chemically synthesized
agtaattacccatagaagtt

SEQ ID NO: 100016 - DNA, 20 bp, Artificial Sequence
  chemically synthesized
ataaagaccccaaacttcta

SEQ ID NO: 100017 - DNA, 20 bp, Artificial Sequence
  chemically synthesized
taaagaccccaaacttctat

SEQ ID NO: 100018 - DNA, 20 bp, Artificial Sequence
  chemically synthesized
agcatagtaattacccatag

SEQ ID NO: 100019 - DNA, 20 bp, Artificial Sequence
  chemically synthesized
tctagcatagtaattaccca

SEQ ID NO: 100020 - DNA, 20 bp, Artificial Sequence
  chemically synthesized
tctatgggtaattactatgc

SEQ ID NO: 100021 - DNA, 20 bp, Artificial Sequence
  chemically synthesized
atgggtaattactatgctag

SEQ ID NO: 100022 - DNA, 20 bp, Artificial Sequence
  chemically synthesized
gagacagtttgcttctagca

SEQ ID NO: 100023 - DNA, 20 bp, Artificial Sequence
  chemically synthesized
atactgagacagtttgcttc

SEQ ID NO: 100024 - DNA, 20 bp, Artificial Sequence
  chemically synthesized
atgctagaagcaaactgtct

SEQ ID NO: 100025 - DNA, 20 bp, Artificial Sequence
  chemically synthesized
ggggtgagaggatactgaga

SEQ ID NO: 100026 - DNA, 20 bp, Artificial Sequence
  chemically synthesized
gtttggggtgagaggatact

SEQ ID NO: 100027 - DNA, 20 bp, Artificial Sequence
  chemically synthesized
ataatgatgtttggggtgag

SEQ ID NO: 100028 - DNA, 20 bp, Artificial Sequence
  chemically synthesized
aataatgatgtttggggtga

SEQ ID NO: 100029 - DNA, 20 bp, Artificial Sequence
  chemically synthesized
ttaataatgatgtttggggt

SEQ ID NO: 100030 - DNA, 20 bp, Artificial Sequence
  chemically synthesized
cagtttaataatgatgtttg

SEQ ID NO: 100031 - DNA, 20 bp, Artificial Sequence
  chemically synthesized
tcagtttaataatgatgttt

SEQ ID NO: 100032 - DNA, 20 bp, Artificial Sequence
  chemically synthesized
atcagtttaataatgatgtt

SEQ ID NO: 100033 - DNA, 20 bp, Artificial Sequence
  chemically synthesized
atcattattaaactgatcat

SEQ ID NO: 100034 - DNA, 20 bp, Artificial Sequence
  chemically synthesized
tcattattaaactgatcatg

SEQ ID NO: 100035 - DNA, 20 bp, Artificial Sequence
  chemically synthesized
gccctgggaaacctcatgat

SEQ ID NO: 100036 - DNA, 20 bp, Artificial Sequence
  chemically synthesized
aaactgatcatgaggtttcc

SEQ ID NO: 100037 - DNA, 20 bp, Artificial Sequence
  chemically synthesized
aactgatcatgaggtttccc

SEQ ID NO: 100038 - DNA, 20 bp, Artificial Sequence
  chemically synthesized
actgatcatgaggtttccca

SEQ ID NO: 100039 - DNA, 20 bp, Artificial Sequence
  chemically synthesized
tctgtttccaatgttgccct

SEQ ID NO: 100040 - DNA, 20 bp, Artificial Sequence
  chemically synthesized
ctctgtttccaatgttgccc

SEQ ID NO: 100041 - DNA, 20 bp, Artificial Sequence
  chemically synthesized
gaggtttcccagggcaacat

SEQ ID NO: 100042 - DNA, 20 bp, Artificial Sequence
  chemically synthesized
tcccagggcaacattggaaa

SEQ ID NO: 100043 - DNA, 20 bp, Artificial Sequence
  chemically synthesized
ccagggcaacattggaaaca

SEQ ID NO: 100044 - DNA, 20 bp, Artificial Sequence
  chemically synthesized
attggaaacagagtcatctc

SEQ ID NO: 100045 - DNA, 20 bp, Artificial Sequence
  chemically synthesized
aaacagagtcatctccagtc

SEQ ID NO: 100046 - DNA, 20 bp, Artificial Sequence
  chemically synthesized
aacagagtcatctccagtct

SEQ ID NO: 100047 - DNA, 20 bp, Artificial Sequence
  chemically synthesized
aagtctgtatacccagactg

SEQ ID NO: 100048 - DNA, 20 bp, Artificial Sequence
  chemically synthesized
ataagtctgtatacccagac

SEQ ID NO: 100049 - DNA, 20 bp, Artificial Sequence
  chemically synthesized
tcatctccagtctgggtata

SEQ ID NO: 100050 - DNA, 20 bp, Artificial Sequence
  chemically synthesized
tgtgcataagtctgtatacc

SEQ ID NO: 100051 - DNA, 20 bp, Artificial Sequence
  chemically synthesized
taaaacagacagttgtgcat

SEQ ID NO: 100052 - DNA, 20 bp, Artificial Sequence
  chemically synthesized
atattccttgttaaaacaga

SEQ ID NO: 100053 - DNA, 20 bp, Artificial Sequence
  chemically synthesized
gcacaactgtctgttttaac

SEQ ID NO: 100054 - DNA, 20 bp, Artificial Sequence
  chemically synthesized
caacatattccttgttaaaa

SEQ ID NO: 100055 - DNA, 20 bp, Artificial Sequence
  chemically synthesized
cacaactgtctgttttaaca

SEQ ID NO: 100056 - DNA, 20 bp, Artificial Sequence
  chemically synthesized
ggggagacaaatgggcaaat

SEQ ID NO: 100057 - DNA, 20 bp, Artificial Sequence
  chemically synthesized
gtgtagttggggagacaaat

SEQ ID NO: 100058 - DNA, 20 bp, Artificial Sequence
  chemically synthesized
agtgtagttggggagacaaa

SEQ ID NO: 100059 - DNA, 20 bp, Artificial Sequence
  chemically synthesized
gagcctagagtgtagttggg

SEQ ID NO: 100060 - DNA, 20 bp, Artificial Sequence
  chemically synthesized
tagagcctagagtgtagttg

SEQ ID NO: 100061 - DNA, 20 bp, Artificial Sequence
  chemically synthesized
ctagagcctagagtgtagtt

SEQ ID NO: 100062 - DNA, 20 bp, Artificial Sequence
  chemically synthesized
tctagagcctagagtgtagt

SEQ ID NO: 100063 - DNA, 20 bp, Artificial Sequence
  chemically synthesized
ttgtctccccaactacactc

SEQ ID NO: 100064 - DNA, 20 bp, Artificial Sequence
  chemically synthesized
tgtctccccaactacactct

SEQ ID NO: 100065 - DNA, 20 bp, Artificial Sequence
  chemically synthesized
ggcctctagagcctagagtg

SEQ ID NO: 100066 - DNA, 20 bp, Artificial Sequence
  chemically synthesized
cccaactacactctaggctc

SEQ ID NO: 100067 - DNA, 20 bp, Artificial Sequence
  chemically synthesized
cccttggcctctagagccta

SEQ ID NO: 100068 - DNA, 20 bp, Artificial Sequence
  chemically synthesized
caactacactctaggctcta

SEQ ID NO: 100069 - DNA, 20 bp, Artificial Sequence
  chemically synthesized
aacccttggcctctagagcc

SEQ ID NO: 100070 - DNA, 20 bp, Artificial Sequence
  chemically synthesized
aactacactctaggctctag

SEQ ID NO: 100071 - DNA, 20 bp, Artificial Sequence
  chemically synthesized
gataaaacccttggcctcta

SEQ ID NO: 100072 - DNA, 20 bp, Artificial Sequence
  chemically synthesized
cactctaggctctagaggcc

SEQ ID NO: 100073 - DNA, 20 bp, Artificial Sequence
  chemically synthesized
actctaggctctagaggcca

SEQ ID NO: 100074 - DNA, 20 bp, Artificial Sequence
  chemically synthesized
atgataaaacccttggcctc

SEQ ID NO: 100075 - DNA, 20 bp, Artificial Sequence
  chemically synthesized
ctctaggctctagaggccaa

SEQ ID NO: 100076 - DNA, 20 bp, Artificial Sequence
  chemically synthesized
gatgaaaatgataaaaccct

SEQ ID NO: 100077 - DNA, 20 bp, Artificial Sequence
  chemically synthesized
atcattttcatccttaaatc

SEQ ID NO: 100078 - DNA, 20 bp, Artificial Sequence
  chemically synthesized
tgtactaattgctagattta

SEQ ID NO: 100079 - DNA, 20 bp, Artificial Sequence
  chemically synthesized
atgtactaattgctagattt

SEQ ID NO: 100080 - DNA, 20 bp, Artificial Sequence
  chemically synthesized
tcatccttaaatctagcaat

SEQ ID NO: 100081 - DNA, 20 bp, Artificial Sequence
  chemically synthesized
ttaaacaatgtactaattgc

SEQ ID NO: 100082 - DNA, 20 bp, Artificial Sequence
  chemically synthesized
ttagtacattgtttaacact

SEQ ID NO: 100083 - DNA, 20 bp, Artificial Sequence
  chemically synthesized
tacattgtttaacacttagc

SEQ ID NO: 100084 - DNA, 20 bp, Artificial Sequence
  chemically synthesized
gcattaattgagcacttgct

SEQ ID NO: 100085 - DNA, 20 bp, Artificial Sequence
  chemically synthesized
tcattcaataagcattaatt

SEQ ID NO: 100086 - DNA, 20 bp, Artificial Sequence
  chemically synthesized
gatttgttggttcattcaat

SEQ ID NO: 100087 - DNA, 20 bp, Artificial Sequence
  chemically synthesized
ctattgtttgatagatttgt

SEQ ID NO: 100088 - DNA, 20 bp, Artificial Sequence
  chemically synthesized
tttgatgcactattgtttga

SEQ ID NO: 100089 - DNA, 20 bp, Artificial Sequence
  chemically synthesized
ccaacaaatctatcaaacaa

SEQ ID NO: 100090 - DNA, 20 bp, Artificial Sequence
  chemically synthesized
agttattaataagcagattg

SEQ ID NO: 100091 - DNA, 20 bp, Artificial Sequence
  chemically synthesized
tgagttattaataagcagat

SEQ ID NO: 100092 - DNA, 20 bp, Artificial Sequence
  chemically synthesized
gacactgagttattaataag

SEQ ID NO: 100093 - DNA, 20 bp, Artificial Sequence
  chemically synthesized
caagacactgagttattaat

SEQ ID NO: 100094 - DNA, 20 bp, Artificial Sequence
  chemically synthesized
caatctgcttattaataact

SEQ ID NO: 100095 - DNA, 20 bp, Artificial Sequence
  chemically synthesized
ttattaataactcagtgtct

SEQ ID NO: 100096 - DNA, 20 bp, Artificial Sequence
  chemically synthesized
cctttggcaaccaagacact

SEQ ID NO: 100097 - DNA, 20 bp, Artificial Sequence
  chemically synthesized
tttcccctcctttggcaacc

SEQ ID NO: 100098 - DNA, 20 bp, Artificial Sequence
  chemically synthesized
actcagtgtcttggttgcca

SEQ ID NO: 100099 - DNA, 20 bp, Artificial Sequence
  chemically synthesized
ctcagtgtcttggttgccaa

SEQ ID NO: 100100 - DNA, 20 bp, Artificial Sequence
  chemically synthesized
cagtgtcttggttgccaaag

SEQ ID NO: 100101 - DNA, 20 bp, Artificial Sequence
  chemically synthesized
agtgtcttggttgccaaagg

SEQ ID NO: 100102 - DNA, 20 bp, Artificial Sequence
  chemically synthesized
gtgtcttggttgccaaagga

SEQ ID NO: 100103 - DNA, 20 bp, Artificial Sequence
  chemically synthesized
tgtcttggttgccaaaggag

SEQ ID NO: 100104 - DNA, 20 bp, Artificial Sequence
  chemically synthesized
cctttctctttcccctcctt

SEQ ID NO: 100105 - DNA, 20 bp, Artificial Sequence
  chemically synthesized
ttggttgccaaaggagggga

SEQ ID NO: 100106 - DNA, 20 bp, Artificial Sequence
  chemically synthesized
ggttgccaaaggaggggaaa

SEQ ID NO: 100107 - DNA, 20 bp, Artificial Sequence
  chemically synthesized
gccaaaggaggggaaagaga

SEQ ID NO: 100108 - DNA, 20 bp, Artificial Sequence
  chemically synthesized
ccaaaggaggggaaagagaa

SEQ ID NO: 100109 - DNA, 20 bp, Artificial Sequence
  chemically synthesized
caaaggaggggaaagagaaa

SEQ ID NO: 100110 - DNA, 20 bp, Artificial Sequence
  chemically synthesized
aggaggggaaagagaaaggg

SEQ ID NO: 100111 - DNA, 20 bp, Artificial Sequence
  chemically synthesized
gaggggaaagagaaagggta

SEQ ID NO: 100112 - DNA, 20 bp, Artificial Sequence
  chemically synthesized
gaaagagaaagggtagagtg

SEQ ID NO: 100113 - DNA, 20 bp, Artificial Sequence
  chemically synthesized
agagaaagggtagagtgtag

SEQ ID NO: 100114 - DNA, 20 bp, Artificial Sequence
  chemically synthesized
gaaagggtagagtgtagtag

SEQ ID NO: 100115 - DNA, 20 bp, Artificial Sequence
  chemically synthesized
aagggtagagtgtagtagaa

SEQ ID NO: 100116 - DNA, 20 bp, Artificial Sequence
  chemically synthesized
agggtagagtgtagtagaag

SEQ ID NO: 100117 - DNA, 20 bp, Artificial Sequence
  chemically synthesized
gggtagagtgtagtagaaga

SEQ ID NO: 100118 - DNA, 20 bp, Artificial Sequence
  chemically synthesized
ggtagagtgtagtagaagag

SEQ ID NO: 100119 - DNA, 20 bp, Artificial Sequence
  chemically synthesized
gtagagtgtagtagaagagg

SEQ ID NO: 100120 - DNA, 20 bp, Artificial Sequence
  chemically synthesized
gtagtagaagagggggaaat

SEQ ID NO: 100121 - DNA, 20 bp, Artificial Sequence
  chemically synthesized
gggggaaataagattctaac

SEQ ID NO: 100122 - DNA, 20 bp, Artificial Sequence
  chemically synthesized
aatctgttcattgtgctagt

SEQ ID NO: 100123 - DNA, 20 bp, Artificial Sequence
  chemically synthesized
ctcaaatctgttcattgtgc

SEQ ID NO: 100124 - DNA, 20 bp, Artificial Sequence
  chemically synthesized
attctaactagcacaatgaa

SEQ ID NO: 100125 - DNA, 20 bp, Artificial Sequence
  chemically synthesized
ctagcacaatgaacagattt

SEQ ID NO: 100126 - DNA, 20 bp, Artificial Sequence
  chemically synthesized
tacatatgtacacataaaat

SEQ ID NO: 100127 - DNA, 20 bp, Artificial Sequence
  chemically synthesized
atgtacacataaaatcggca

SEQ ID NO: 100128 - DNA, 20 bp, Artificial Sequence
  chemically synthesized
tccaatctgtatttgtatgt

SEQ ID NO: 100129 - DNA, 20 bp, Artificial Sequence
  chemically synthesized
gtgatactcacatacaaata

SEQ ID NO: 100130 - DNA, 20 bp, Artificial Sequence
  chemically synthesized
actcacatacaaatacagat

SEQ ID NO: 100131 - DNA, 20 bp, Artificial Sequence
  chemically synthesized
ggaaaaaaaaaaaaccccac

SEQ ID NO: 100132 - DNA, 20 bp, Artificial Sequence
  chemically synthesized
gaaaaaaaaaaaaccccact

SEQ ID NO: 100133 - DNA, 20 bp, Artificial Sequence
  chemically synthesized
ccactcctcgtagcccagtg

SEQ ID NO: 100134 - DNA, 20 bp, Artificial Sequence
  chemically synthesized
tccactcctcgtagcccagt

SEQ ID NO: 100135 - DNA, 20 bp, Artificial Sequence
  chemically synthesized
ctccactcctcgtagcccag

SEQ ID NO: 100136 - DNA, 20 bp, Artificial Sequence
  chemically synthesized
aaaaaaccccactgggctac

SEQ ID NO: 100137 - DNA, 20 bp, Artificial Sequence
  chemically synthesized
aaaaaccccactgggctacg

SEQ ID NO: 100138 - DNA, 20 bp, Artificial Sequence
  chemically synthesized
caactccactcctcgtagcc

SEQ ID NO: 100139 - DNA, 20 bp, Artificial Sequence
  chemically synthesized
aaaccccactgggctacgag

SEQ ID NO: 100140 - DNA, 20 bp, Artificial Sequence
  chemically synthesized
ccccactgggctacgaggag

SEQ ID NO: 100141 - DNA, 20 bp, Artificial Sequence
  chemically synthesized
ggtggcaactccactcctcg

SEQ ID NO: 100142 - DNA, 20 bp, Artificial Sequence
  chemically synthesized
ccactgggctacgaggagtg

SEQ ID NO: 100143 - DNA, 20 bp, Artificial Sequence
  chemically synthesized
ggatatatagcagggaatgg

SEQ ID NO: 100144 - DNA, 20 bp, Artificial Sequence
  chemically synthesized
aggggatatatagcagggaa

SEQ ID NO: 100145 - DNA, 20 bp, Artificial Sequence
  chemically synthesized
gctagaggggatatatagca

SEQ ID NO: 100146 - DNA, 20 bp, Artificial Sequence
  chemically synthesized
agctagaggggatatatagc

SEQ ID NO: 100147 - DNA, 20 bp, Artificial Sequence
  chemically synthesized
cagctagaggggatatatag

SEQ ID NO: 100148 - DNA, 20 bp, Artificial Sequence
  chemically synthesized
ggccagctagaggggatata

SEQ ID NO: 100149 - DNA, 20 bp, Artificial Sequence
  chemically synthesized
tccctgctatatatcccctc

SEQ ID NO: 100150 - DNA, 20 bp, Artificial Sequence
  chemically synthesized
tgctatatatcccctctagc

SEQ ID NO: 100151 - DNA, 20 bp, Artificial Sequence
  chemically synthesized
tcacctaaggccagctagag

SEQ ID NO: 100152 - DNA, 20 bp, Artificial Sequence
  chemically synthesized
gtcacctaaggccagctaga

SEQ ID NO: 100153 - DNA, 20 bp, Artificial Sequence
  chemically synthesized
agtcacctaaggccagctag

SEQ ID NO: 100154 - DNA, 20 bp, Artificial Sequence
  chemically synthesized
aagtcacctaaggccagcta

SEQ ID NO: 100155 - DNA, 20 bp, Artificial Sequence
  chemically synthesized
agaagtcacctaaggccagc

SEQ ID NO: 100156 - DNA, 20 bp, Artificial Sequence
  chemically synthesized
atatcccctctagctggcct

SEQ ID NO: 100157 - DNA, 20 bp, Artificial Sequence
  chemically synthesized
tatcccctctagctggcctt

SEQ ID NO: 100158 - DNA, 20 bp, Artificial Sequence
  chemically synthesized
gaggagaagtcacctaaggc

SEQ ID NO: 100159 - DNA, 20 bp, Artificial Sequence
  chemically synthesized
aagagaggagaagtcaccta

SEQ ID NO: 100160 - DNA, 20 bp, Artificial Sequence
  chemically synthesized
aaagagaggagaagtcacct

SEQ ID NO: 100161 - DNA, 20 bp, Artificial Sequence
  chemically synthesized
ggagccttgaaagagaggag

SEQ ID NO: 100162 - DNA, 20 bp, Artificial Sequence
  chemically synthesized
aaaggagccttgaaagagag

SEQ ID NO: 100163 - DNA, 20 bp, Artificial Sequence
  chemically synthesized
ggtgacttctcctctctttc

SEQ ID NO: 100164 - DNA, 20 bp, Artificial Sequence
  chemically synthesized
ctaaaggagccttgaaagag

SEQ ID NO: 100165 - DNA, 20 bp, Artificial Sequence
  chemically synthesized
gtgacttctcctctctttca

SEQ ID NO: 100166 - DNA, 20 bp, Artificial Sequence
  chemically synthesized
tctaaaggagccttgaaaga

SEQ ID NO: 100167 - DNA, 20 bp, Artificial Sequence
  chemically synthesized
tgtctaaaggagccttgaaa

SEQ ID NO: 100168 - DNA, 20 bp, Artificial Sequence
  chemically synthesized
aatgtctaaaggagccttga

SEQ ID NO: 100169 - DNA, 20 bp, Artificial Sequence
  chemically synthesized
cctctctttcaaggctcctt

SEQ ID NO: 100170 - DNA, 20 bp, Artificial Sequence
  chemically synthesized
tcattctagaatgtctaaag

SEQ ID NO: 100171 - DNA, 20 bp, Artificial Sequence
  chemically synthesized
tttcattctagaatgtctaa

SEQ ID NO: 100172 - DNA, 20 bp, Artificial Sequence
  chemically synthesized
ttttcattctagaatgtcta

SEQ ID NO: 100173 - DNA, 20 bp, Artificial Sequence
  chemically synthesized
caaggctcctttagacattc

SEQ ID NO: 100174 - DNA, 20 bp, Artificial Sequence
  chemically synthesized
attctgcaatattttcattc

SEQ ID NO: 100175 - DNA, 20 bp, Artificial Sequence
  chemically synthesized
attctagaatgaaaatattg

SEQ ID NO: 100176 - DNA, 20 bp, Artificial Sequence
  chemically synthesized
gaatgaaaatattgcagaat

SEQ ID NO: 100177 - DNA, 20 bp, Artificial Sequence
  chemically synthesized
aaatattgcagaattggaat

SEQ ID NO: 100178 - DNA, 20 bp, Artificial Sequence
  chemically synthesized
atattgcagaattggaatga

SEQ ID NO: 100179 - DNA, 20 bp, Artificial Sequence
  chemically synthesized
attgcagaattggaatgaga

SEQ ID NO: 100180 - DNA, 20 bp, Artificial Sequence
  chemically synthesized
ttgcagaattggaatgagag

SEQ ID NO: 100181 - DNA, 20 bp, Artificial Sequence
  chemically synthesized
atctaagagagtaaatcaaa

SEQ ID NO: 100182 - DNA, 20 bp, Artificial Sequence
  chemically synthesized
tactgtttgatttactctct

SEQ ID NO: 100183 - DNA, 20 bp, Artificial Sequence
  chemically synthesized
tattcaggctttatctaaga

SEQ ID NO: 100184 - DNA, 20 bp, Artificial Sequence
  chemically synthesized
ttgatttactctcttagata

SEQ ID NO: 100185 - DNA, 20 bp, Artificial Sequence
  chemically synthesized
attattcaggctttatctaa

SEQ ID NO: 100186 - DNA, 20 bp, Artificial Sequence
  chemically synthesized
aaattattcaggctttatct

SEQ ID NO: 100187 - DNA, 20 bp, Artificial Sequence
  chemically synthesized
tgttataagcgaaattattc

SEQ ID NO: 100188 - DNA, 20 bp, Artificial Sequence
  chemically synthesized
ttgttataagcgaaattatt

SEQ ID NO: 100189 - DNA, 20 bp, Artificial Sequence
  chemically synthesized
ataatttctgtcattgttat

SEQ ID NO: 100190 - DNA, 20 bp, Artificial Sequence
  chemically synthesized
aatttcgcttataacaatga

SEQ ID NO: 100191 - DNA, 20 bp, Artificial Sequence
  chemically synthesized
ataacaatgacagaaattat

SEQ ID NO: 100192 - DNA, 20 bp, Artificial Sequence
  chemically synthesized
acaatgacagaaattattgg

SEQ ID NO: 100193 - DNA, 20 bp, Artificial Sequence
  chemically synthesized
gaaattattggaagataaca

SEQ ID NO: 100194 - DNA, 20 bp, Artificial Sequence
  chemically synthesized
aagtgtcatgtgaattatct

SEQ ID NO: 100195 - DNA, 20 bp, Artificial Sequence
  chemically synthesized
gtcatgtgaattatctaaga

SEQ ID NO: 100196 - DNA, 20 bp, Artificial Sequence
  chemically synthesized
caccctaatgttatctttct

SEQ ID NO: 100197 - DNA, 20 bp, Artificial Sequence
  chemically synthesized
ttatctaagaaagataacat

SEQ ID NO: 100198 - DNA, 20 bp, Artificial Sequence
  chemically synthesized
tatctaagaaagataacatt

SEQ ID NO: 100199 - DNA, 20 bp, Artificial Sequence
  chemically synthesized
atctaagaaagataacatta

SEQ ID NO: 100200 - DNA, 20 bp, Artificial Sequence
  chemically synthesized
taagaaagataacattaggg

SEQ ID NO: 100201 - DNA, 20 bp, Artificial Sequence
  chemically synthesized
gataacattagggtggaatg

SEQ ID NO: 100202 - DNA, 20 bp, Artificial Sequence
  chemically synthesized
taacattagggtggaatgaa

SEQ ID NO: 100203 - DNA, 20 bp, Artificial Sequence
  chemically synthesized
gggtggaatgaagagctctg

SEQ ID NO: 100204 - DNA, 20 bp, Artificial Sequence
  chemically synthesized
gtggaatgaagagctctgaa

SEQ ID NO: 100205 - DNA, 20 bp, Artificial Sequence
  chemically synthesized
tcatatattggcactcttca

SEQ ID NO: 100206 - DNA, 20 bp, Artificial Sequence
  chemically synthesized
attcatatattggcactctt

SEQ ID NO: 100207 - DNA, 20 bp, Artificial Sequence
  chemically synthesized
aatgtgtattattcatatat

SEQ ID NO: 100208 - DNA, 20 bp, Artificial Sequence
  chemically synthesized
tatgaataatacacattata

SEQ ID NO: 100209 - DNA, 20 bp, Artificial Sequence
  chemically synthesized
tgaataatacacattatatg

SEQ ID NO: 100210 - DNA, 20 bp, Artificial Sequence
  chemically synthesized
taatacacattatatggaga

SEQ ID NO: 100211 - DNA, 20 bp, Artificial Sequence
  chemically synthesized
tgtattcaccaaaaaagaaa

SEQ ID NO: 100212 - DNA, 20 bp, Artificial Sequence
  chemically synthesized
atgtattcaccaaaaaagaa

SEQ ID NO: 100213 - DNA, 20 bp, Artificial Sequence
  chemically synthesized
ggagaaagccttttcttttt

SEQ ID NO: 100214 - DNA, 20 bp, Artificial Sequence
  chemically synthesized
caatcatgtattcaccaaaa

SEQ ID NO: 100215 - DNA, 20 bp, Artificial Sequence
  chemically synthesized
tttttggtgaatacatgatt

SEQ ID NO: 100216 - DNA, 20 bp, Artificial Sequence
  chemically synthesized
ttggtgaatacatgattgag

SEQ ID NO: 100217 - DNA, 20 bp, Artificial Sequence
  chemically synthesized
tgagtagaattttacgttgc

SEQ ID NO: 100218 - DNA, 20 bp, Artificial Sequence
  chemically synthesized
gtagaattttacgttgctgg

SEQ ID NO: 100219 - DNA, 20 bp, Artificial Sequence
  chemically synthesized
tagaattttacgttgctgga

SEQ ID NO: 100220 - DNA, 20 bp, Artificial Sequence
  chemically synthesized
aattttacgttgctggaagg

SEQ ID NO: 100221 - DNA, 20 bp, Artificial Sequence
  chemically synthesized
ttttacgttgctggaaggta

SEQ ID NO: 100222 - DNA, 20 bp, Artificial Sequence
  chemically synthesized
gaagaacaaactctaccttc

SEQ ID NO: 100223 - DNA, 20 bp, Artificial Sequence
  chemically synthesized
atgtatatatgcatagagag

SEQ ID NO: 100224 - DNA, 20 bp, Artificial Sequence
  chemically synthesized
tccatgtatatatgcataga

SEQ ID NO: 100225 - DNA, 20 bp, Artificial Sequence
  chemically synthesized
gttccatgtatatatgcata

SEQ ID NO: 100226 - DNA, 20 bp, Artificial Sequence
  chemically synthesized
tagttccatgtatatatgca

SEQ ID NO: 100227 - DNA, 20 bp, Artificial Sequence
  chemically synthesized
tctctctatgcatatataca

SEQ ID NO: 100228 - DNA, 20 bp, Artificial Sequence
  chemically synthesized
tatgcatatatacatggaac

SEQ ID NO: 100229 - DNA, 20 bp, Artificial Sequence
  chemically synthesized
ataagctctcaggtggagac

SEQ ID NO: 100230 - DNA, 20 bp, Artificial Sequence
  chemically synthesized
catggaactagtctccacct

SEQ ID NO: 100231 - DNA, 20 bp, Artificial Sequence
  chemically synthesized
tggaactagtctccacctga

SEQ ID NO: 100232 - DNA, 20 bp, Artificial Sequence
  chemically synthesized
aggtcataagctctcaggtg

SEQ ID NO: 100233 - DNA, 20 bp, Artificial Sequence
  chemically synthesized
agaggtcataagctctcagg

SEQ ID NO: 100234 - DNA, 20 bp, Artificial Sequence
  chemically synthesized
gaaagaggtcataagctctc

SEQ ID NO: 100235 - DNA, 20 bp, Artificial Sequence
  chemically synthesized
agaaagaggtcataagctct

SEQ ID NO: 100236 - DNA, 20 bp, Artificial Sequence
  chemically synthesized
aagagagagaaagaggtcat

SEQ ID NO: 100237 - DNA, 20 bp, Artificial Sequence
  chemically synthesized
aacaccaaagagagagaaag

SEQ ID NO: 100238 - DNA, 20 bp, Artificial Sequence
  chemically synthesized
caacaccaaagagagagaaa

SEQ ID NO: 100239 - DNA, 20 bp, Artificial Sequence
  chemically synthesized
ttcaacaccaaagagagaga

SEQ ID NO: 100240 - DNA, 20 bp, Artificial Sequence
  chemically synthesized
atgacctctttctctctctt

SEQ ID NO: 100241 - DNA, 20 bp, Artificial Sequence
  chemically synthesized
catattcaacaccaaagaga

SEQ ID NO: 100242 - DNA, 20 bp, Artificial Sequence
  chemically synthesized
cacatattcaacaccaaaga

SEQ ID NO: 100243 - DNA, 20 bp, Artificial Sequence
  chemically synthesized
cacacatattcaacaccaaa

SEQ ID NO: 100244 - DNA, 20 bp, Artificial Sequence
  chemically synthesized
tacacacatattcaacacca

SEQ ID NO: 100245 - DNA, 20 bp, Artificial Sequence
  chemically synthesized
tgtgtatatgtgtgatactg

SEQ ID NO: 100246 - DNA, 20 bp, Artificial Sequence
  chemically synthesized
ttgcagcttgagaagcactg

SEQ ID NO: 100247 - DNA, 20 bp, Artificial Sequence
  chemically synthesized
gtgatactgcagtgcttctc

SEQ ID NO: 100248 - DNA, 20 bp, Artificial Sequence
  chemically synthesized
cacgcacgttgcagcttgag

SEQ ID NO: 100249 - DNA, 20 bp, Artificial Sequence
  chemically synthesized
ctgcacgcacgttgcagctt

SEQ ID NO: 100250 - DNA, 20 bp, Artificial Sequence
  chemically synthesized
agggatctgcacgcacgttg

SEQ ID NO: 100251 - DNA, 20 bp, Artificial Sequence
  chemically synthesized
ctcaagctgcaacgtgcgtg

SEQ ID NO: 100252 - DNA, 20 bp, Artificial Sequence
  chemically synthesized
caacgtgcgtgcagatccct

SEQ ID NO: 100253 - DNA, 20 bp, Artificial Sequence
  chemically synthesized
aacgtgcgtgcagatccctt

SEQ ID NO: 100254 - DNA, 20 bp, Artificial Sequence
  chemically synthesized
acgtgcgtgcagatcccttg

SEQ ID NO: 100255 - DNA, 20 bp, Artificial Sequence
  chemically synthesized
cattgtaagacaatccccaa

SEQ ID NO: 100256 - DNA, 20 bp, Artificial Sequence
  chemically synthesized
ccattgtaagacaatcccca

SEQ ID NO: 100257 - DNA, 20 bp, Artificial Sequence
  chemically synthesized
gccattgtaagacaatcccc

SEQ ID NO: 100258 - DNA, 20 bp, Artificial Sequence
  chemically synthesized
ccttggggattgtcttacaa

SEQ ID NO: 100259 - DNA, 20 bp, Artificial Sequence
  chemically synthesized
tggggattgtcttacaatgg

SEQ ID NO: 100260 - DNA, 20 bp, Artificial Sequence
  chemically synthesized
gaatcagaatccgccattgt

SEQ ID NO: 100261 - DNA, 20 bp, Artificial Sequence
  chemically synthesized
aatggcggattctgattcaa

SEQ ID NO: 100262 - DNA, 20 bp, Artificial Sequence
  chemically synthesized
ccacttcagaactgttgaat

SEQ ID NO: 100263 - DNA, 20 bp, Artificial Sequence
  chemically synthesized
attctgattcaacagttctg

SEQ ID NO: 100264 - DNA, 20 bp, Artificial Sequence
  chemically synthesized
ctgattcaacagttctgaag

SEQ ID NO: 100265 - DNA, 20 bp, Artificial Sequence
  chemically synthesized
tgattcaacagttctgaagt

SEQ ID NO: 100266 - DNA, 20 bp, Artificial Sequence
  chemically synthesized
gattcaacagttctgaagtg

SEQ ID NO: 100267 - DNA, 20 bp, Artificial Sequence
  chemically synthesized
tgaaatcccaggccccactt

SEQ ID NO: 100268 - DNA, 20 bp, Artificial Sequence
  chemically synthesized
aacagttctgaagtggggcc

SEQ ID NO: 100269 - DNA, 20 bp, Artificial Sequence
  chemically synthesized
acagttctgaagtggggcct

SEQ ID NO: 100270 - DNA, 20 bp, Artificial Sequence
  chemically synthesized
ttttagaattttgaaatccc

SEQ ID NO: 100271 - DNA, 20 bp, Artificial Sequence
  chemically synthesized
tttttagaattttgaaatcc

SEQ ID NO: 100272 - DNA, 20 bp, Artificial Sequence
  chemically synthesized
acatctcttgggagtttttt

SEQ ID NO: 100273 - DNA, 20 bp, Artificial Sequence
  chemically synthesized
aaaattctaaaaaaactccc

SEQ ID NO: 100274 - DNA, 20 bp, Artificial Sequence
  chemically synthesized
aattctaaaaaaactcccaa

SEQ ID NO: 100275 - DNA, 20 bp, Artificial Sequence
  chemically synthesized
gaagcctcaacatctcttgg

SEQ ID NO: 100276 - DNA, 20 bp, Artificial Sequence
  chemically synthesized
ttgaagcctcaacatctctt

SEQ ID NO: 100277 - DNA, 20 bp, Artificial Sequence
  chemically synthesized
attgaagcctcaacatctct

SEQ ID NO: 100278 - DNA, 20 bp, Artificial Sequence
  chemically synthesized
aaaaactcccaagagatgtt

SEQ ID NO: 100279 - DNA, 20 bp, Artificial Sequence
  chemically synthesized
aaaactcccaagagatgttg

SEQ ID NO: 100280 - DNA, 20 bp, Artificial Sequence
  chemically synthesized
tgctgtgcaaagtgtgattg

SEQ ID NO: 100281 - DNA, 20 bp, Artificial Sequence
  chemically synthesized
ggcttcaatcacactttgca

SEQ ID NO: 100282 - DNA, 20 bp, Artificial Sequence
  chemically synthesized
gagcatcaccttgctgtgca

SEQ ID NO: 100283 - DNA, 20 bp, Artificial Sequence
  chemically synthesized
tcaatcacactttgcacagc

SEQ ID NO: 100284 - DNA, 20 bp, Artificial Sequence
  chemically synthesized
caatcacactttgcacagca

SEQ ID NO: 100285 - DNA, 20 bp, Artificial Sequence
  chemically synthesized
cagcaaggtgatgctctttt

SEQ ID NO: 100286 - DNA, 20 bp, Artificial Sequence
  chemically synthesized
attgcttcagtttcttaaaa

SEQ ID NO: 100287 - DNA, 20 bp, Artificial Sequence
  chemically synthesized
taattgcttcagtttcttaa

SEQ ID NO: 100288 - DNA, 20 bp, Artificial Sequence
  chemically synthesized
gatgctcttttaagaaactg

SEQ ID NO: 100289 - DNA, 20 bp, Artificial Sequence
  chemically synthesized
ctatttgttagtaattgctt

SEQ ID NO: 100290 - DNA, 20 bp, Artificial Sequence
  chemically synthesized
ctgaagcaattactaacaaa

SEQ ID NO: 100291 - DNA, 20 bp, Artificial Sequence
  chemically synthesized
tgaagcaattactaacaaat

SEQ ID NO: 100292 - DNA, 20 bp, Artificial Sequence
  chemically synthesized
tacttatgtgacctatttgt

SEQ ID NO: 100293 - DNA, 20 bp, Artificial Sequence
  chemically synthesized
tactaacaaataggtcacat

SEQ ID NO: 100294 - DNA, 20 bp, Artificial Sequence
  chemically synthesized
acataagtatgtaattataa

SEQ ID NO: 100295 - DNA, 20 bp, Artificial Sequence
  chemically synthesized
taagtatgtaattataacag

SEQ ID NO: 100296 - DNA, 20 bp, Artificial Sequence
  chemically synthesized
agaagtgaatctgtgcacaa

SEQ ID NO: 100297 - DNA, 20 bp, Artificial Sequence
  chemically synthesized
atagttctttcttttgtgca

SEQ ID NO: 100298 - DNA, 20 bp, Artificial Sequence
  chemically synthesized
gtgaatctgtgcacaaaaga

SEQ ID NO: 100299 - DNA, 20 bp, Artificial Sequence
  chemically synthesized
cacaaaagaaagaactatga

SEQ ID NO: 100300 - DNA, 20 bp, Artificial Sequence
  chemically synthesized
actcagacataattctttca

SEQ ID NO: 100301 - DNA, 20 bp, Artificial Sequence
  chemically synthesized
actatgaaagaattatgtct

SEQ ID NO: 100302 - DNA, 20 bp, Artificial Sequence
  chemically synthesized
atatatatacacatataact

SEQ ID NO: 100303 - DNA, 20 bp, Artificial Sequence
  chemically synthesized
tatatacgcacacatatata

SEQ ID NO: 100304 - DNA, 20 bp, Artificial Sequence
  chemically synthesized
tgtgtgcgtatatatatata

SEQ ID NO: 100305 - DNA, 20 bp, Artificial Sequence
  chemically synthesized
tatatatatggacatataat

SEQ ID NO: 100306 - DNA, 20 bp, Artificial Sequence
  chemically synthesized
tggcattattattactgtga

SEQ ID NO: 100307 - DNA, 20 bp, Artificial Sequence
  chemically synthesized
attattattactgtgataga

SEQ ID NO: 100308 - DNA, 20 bp, Artificial Sequence
  chemically synthesized
gaagagaggtctttctatca

SEQ ID NO: 100309 - DNA, 20 bp, Artificial Sequence
  chemically synthesized
taatttggcttgcagaagag

SEQ ID NO: 100310 - DNA, 20 bp, Artificial Sequence
  chemically synthesized
ataatttggcttgcagaaga

SEQ ID NO: 100311 - DNA, 20 bp, Artificial Sequence
  chemically synthesized
tagaaagacctctcttctgc

SEQ ID NO: 100312 - DNA, 20 bp, Artificial Sequence
  chemically synthesized
agataatttggcttgcagaa

SEQ ID NO: 100313 - DNA, 20 bp, Artificial Sequence
  chemically synthesized
aaagataatttggcttgcag

SEQ ID NO: 100314 - DNA, 20 bp, Artificial Sequence
  chemically synthesized
gtgaaagataatttggcttg

SEQ ID NO: 100315 - DNA, 20 bp, Artificial Sequence
  chemically synthesized
caacaaagtgaaagataatt

SEQ ID NO: 100316 - DNA, 20 bp, Artificial Sequence
  chemically synthesized
ttcaagaagcaacaaagtga

SEQ ID NO: 100317 - DNA, 20 bp, Artificial Sequence
  chemically synthesized
aaagaattcaagaagcaaca

SEQ ID NO: 100318 - DNA, 20 bp, Artificial Sequence
  chemically synthesized
aaagaagaaaagaattcaag

SEQ ID NO: 100319 - DNA, 20 bp, Artificial Sequence
  chemically synthesized
aaaaaagaagaaaagaattc

SEQ ID NO: 100320 - DNA, 20 bp, Artificial Sequence
  chemically synthesized
tgtaggggaaaaaagaagaa

SEQ ID NO: 100321 - DNA, 20 bp, Artificial Sequence
  chemically synthesized
gcaattgtaggggaaaaaag

SEQ ID NO: 100322 - DNA, 20 bp, Artificial Sequence
  chemically synthesized
gatgcaattgtaggggaaaa

SEQ ID NO: 100323 - DNA, 20 bp, Artificial Sequence
  chemically synthesized
atctggagatgcaattgtag

SEQ ID NO: 100324 - DNA, 20 bp, Artificial Sequence
  chemically synthesized
gatctggagatgcaattgta

SEQ ID NO: 100325 - DNA, 20 bp, Artificial Sequence
  chemically synthesized
agatctggagatgcaattgt

SEQ ID NO: 100326 - DNA, 20 bp, Artificial Sequence
  chemically synthesized
gagatctggagatgcaattg

SEQ ID NO: 100327 - DNA, 20 bp, Artificial Sequence
  chemically synthesized
ttcccctacaattgcatctc

SEQ ID NO: 100328 - DNA, 20 bp, Artificial Sequence
  chemically synthesized
gaccctttcaaggagatctg

SEQ ID NO: 100329 - DNA, 20 bp, Artificial Sequence
  chemically synthesized
ttgaccctttcaaggagatc

SEQ ID NO: 100330 - DNA, 20 bp, Artificial Sequence
  chemically synthesized
gcatctccagatctccttga

SEQ ID NO: 100331 - DNA, 20 bp, Artificial Sequence
  chemically synthesized
catctccagatctccttgaa

SEQ ID NO: 100332 - DNA, 20 bp, Artificial Sequence
  chemically synthesized
atctccagatctccttgaaa

SEQ ID NO: 100333 - DNA, 20 bp, Artificial Sequence
  chemically synthesized
ttctacttgaccctttcaag

SEQ ID NO: 100334 - DNA, 20 bp, Artificial Sequence
  chemically synthesized
cattctacttgaccctttca

SEQ ID NO: 100335 - DNA, 20 bp, Artificial Sequence
  chemically synthesized
gcattctacttgaccctttc

SEQ ID NO: 100336 - DNA, 20 bp, Artificial Sequence
  chemically synthesized
cagatctccttgaaagggtc

SEQ ID NO: 100337 - DNA, 20 bp, Artificial Sequence
  chemically synthesized
atctccttgaaagggtcaag

SEQ ID NO: 100338 - DNA, 20 bp, Artificial Sequence
  chemically synthesized
agggtcaagtagaatgccta

SEQ ID NO: 100339 - DNA, 20 bp, Artificial Sequence
  chemically synthesized
gggtcaagtagaatgcctat

SEQ ID NO: 100340 - DNA, 20 bp, Artificial Sequence
  chemically synthesized
aacatagttagatagcccat

SEQ ID NO: 100341 - DNA, 20 bp, Artificial Sequence
  chemically synthesized
caacatagttagatagccca

SEQ ID NO: 100342 - DNA, 20 bp, Artificial Sequence
  chemically synthesized
tccttaccaacatagttaga

SEQ ID NO: 100343 - DNA, 20 bp, Artificial Sequence
  chemically synthesized
tatgggctatctaactatgt

SEQ ID NO: 100344 - DNA, 20 bp, Artificial Sequence
  chemically synthesized
aaactccttaccaacatagt

SEQ ID NO: 100345 - DNA, 20 bp, Artificial Sequence
  chemically synthesized
ggctatctaactatgttggt

SEQ ID NO: 100346 - DNA, 20 bp, Artificial Sequence
  chemically synthesized
attcaaactccttaccaaca

SEQ ID NO: 100347 - DNA, 20 bp, Artificial Sequence
  chemically synthesized
gctatctaactatgttggta

SEQ ID NO: 100348 - DNA, 20 bp, Artificial Sequence
  chemically synthesized
tatctaactatgttggtaag

SEQ ID NO: 100349 - DNA, 20 bp, Artificial Sequence
  chemically synthesized
atgacattcaatgcatatct

SEQ ID NO: 100350 - DNA, 20 bp, Artificial Sequence
  chemically synthesized
attcaatgcatatctaagcc

SEQ ID NO: 100351 - DNA, 20 bp, Artificial Sequence
  chemically synthesized
tgtgttgtgacagcttggct

SEQ ID NO: 100352 - DNA, 20 bp, Artificial Sequence
  chemically synthesized
ttgagtgtgttgtgacagct

SEQ ID NO: 100353 - DNA, 20 bp, Artificial Sequence
  chemically synthesized
caggcttgagtgtgttgtga

SEQ ID NO: 100354 - DNA, 20 bp, Artificial Sequence
  chemically synthesized
caagctgtcacaacacactc

SEQ ID NO: 100355 - DNA, 20 bp, Artificial Sequence
  chemically synthesized
cgaactcctttggcaggctt

SEQ ID NO: 100356 - DNA, 20 bp, Artificial Sequence
  chemically synthesized
caacacactcaagcctgcca

SEQ ID NO: 100357 - DNA, 20 bp, Artificial Sequence
  chemically synthesized
aacacactcaagcctgccaa

SEQ ID NO: 100358 - DNA, 20 bp, Artificial Sequence
  chemically synthesized
cacactcaagcctgccaaag

SEQ ID NO: 100359 - DNA, 20 bp, Artificial Sequence
  chemically synthesized
tttgtacgaactcctttggc

SEQ ID NO: 100360 - DNA, 20 bp, Artificial Sequence
  chemically synthesized
atttgtacgaactcctttgg

SEQ ID NO: 100361 - DNA, 20 bp, Artificial Sequence
  chemically synthesized
aagatttgtacgaactcctt

SEQ ID NO: 100362 - DNA, 20 bp, Artificial Sequence
  chemically synthesized
ctctcctgtaaattatttta

SEQ ID NO: 100363 - DNA, 20 bp, Artificial Sequence
  chemically synthesized
caaatctttaaaataattta

SEQ ID NO: 100364 - DNA, 20 bp, Artificial Sequence
  chemically synthesized
aaatctttaaaataatttac

SEQ ID NO: 100365 - DNA, 20 bp, Artificial Sequence
  chemically synthesized
atctttaaaataatttacag

SEQ ID NO: 100366 - DNA, 20 bp, Artificial Sequence
  chemically synthesized
ctttaaaataatttacagga

SEQ ID NO: 100367 - DNA, 20 bp, Artificial Sequence
  chemically synthesized
ttctgataatgggaatgatg

SEQ ID NO: 100368 - DNA, 20 bp, Artificial Sequence
  chemically synthesized
taccacatcattcccattat

SEQ ID NO: 100369 - DNA, 20 bp, Artificial Sequence
  chemically synthesized
gaattatttcttctgataat

SEQ ID NO: 100370 - DNA, 20 bp, Artificial Sequence
  chemically synthesized
cacatcattcccattatcag

SEQ ID NO: 100371 - DNA, 20 bp, Artificial Sequence
  chemically synthesized
tgaattatttcttctgataa

SEQ ID NO: 100372 - DNA, 20 bp, Artificial Sequence
  chemically synthesized
cagaagaaataattcaaatt

SEQ ID NO: 100373 - DNA, 20 bp, Artificial Sequence
  chemically synthesized
taattcaaattaagaaaaat

SEQ ID NO: 100374 - DNA, 20 bp, Artificial Sequence
  chemically synthesized
aaaaattagaaataaaaatg

SEQ ID NO: 100375 - DNA, 20 bp, Artificial Sequence
  chemically synthesized
aaattagaaataaaaatgaa

SEQ ID NO: 100376 - DNA, 20 bp, Artificial Sequence
  chemically synthesized
aaaatgaagagatgacactg

SEQ ID NO: 100377 - DNA, 20 bp, Artificial Sequence
  chemically synthesized
tccagtggtgagatattctt

SEQ ID NO: 100378 - DNA, 20 bp, Artificial Sequence
  chemically synthesized
actgaagaatatctcaccac

SEQ ID NO: 100379 - DNA, 20 bp, Artificial Sequence
  chemically synthesized
gaaagtcatcttccagtggt

SEQ ID NO: 100380 - DNA, 20 bp, Artificial Sequence
  chemically synthesized
gaagaatatctcaccactgg

SEQ ID NO: 100381 - DNA, 20 bp, Artificial Sequence
  chemically synthesized
agatgaaagtcatcttccag

SEQ ID NO: 100382 - DNA, 20 bp, Artificial Sequence
  chemically synthesized
tgtagatgaaagtcatcttc

SEQ ID NO: 100383 - DNA, 20 bp, Artificial Sequence
  chemically synthesized
tggaagatgactttcatcta

SEQ ID NO: 100384 - DNA, 20 bp, Artificial Sequence
  chemically synthesized
agagagatcactgtagatga

SEQ ID NO: 100385 - DNA, 20 bp, Artificial Sequence
  chemically synthesized
gctttatagagagatcactg

SEQ ID NO: 100386 - DNA, 20 bp, Artificial Sequence
  chemically synthesized
tctacagtgatctctctata

SEQ ID NO: 100387 - DNA, 20 bp, Artificial Sequence
  chemically synthesized
aagtatctttgctttataga

SEQ ID NO: 100388 - DNA, 20 bp, Artificial Sequence
  chemically synthesized
aaaagtatctttgctttata

SEQ ID NO: 100389 - DNA, 20 bp, Artificial Sequence
  chemically synthesized
agtgatctctctataaagca

SEQ ID NO: 100390 - DNA, 20 bp, Artificial Sequence
  chemically synthesized
tgaaaagtatctttgcttta

SEQ ID NO: 100391 - DNA, 20 bp, Artificial Sequence
  chemically synthesized
tataaagcaaagatactttt

SEQ ID NO: 100392 - DNA, 20 bp, Artificial Sequence
  chemically synthesized
cttactgaataatagctgaa

SEQ ID NO: 100393 - DNA, 20 bp, Artificial Sequence
  chemically synthesized
gatacttttcagctattatt

SEQ ID NO: 100394 - DNA, 20 bp, Artificial Sequence
  chemically synthesized
tggactcacttactgaataa

SEQ ID NO: 100395 - DNA, 20 bp, Artificial Sequence
  chemically synthesized
cttttcagctattattcagt

SEQ ID NO: 100396 - DNA, 20 bp, Artificial Sequence
  chemically synthesized
tcagctattattcagtaagt

SEQ ID NO: 100397 - DNA, 20 bp, Artificial Sequence
  chemically synthesized
tattcagtaagtgagtccaa

SEQ ID NO: 100398 - DNA, 20 bp, Artificial Sequence
  chemically synthesized
acaatatcagaggaaactgt

SEQ ID NO: 100399 - DNA, 20 bp, Artificial Sequence
  chemically synthesized
aattaaattcacaatatcag

SEQ ID NO: 100400 - DNA, 20 bp, Artificial Sequence
  chemically synthesized
taattaaattcacaatatca

SEQ ID NO: 100401 - DNA, 20 bp, Artificial Sequence
  chemically synthesized
actaattaaattcacaatat

SEQ ID NO: 100402 - DNA, 20 bp, Artificial Sequence
  chemically synthesized
tctgatattgtgaatttaat

SEQ ID NO: 100403 - DNA, 20 bp, Artificial Sequence
  chemically synthesized
gatattgtgaatttaattag

SEQ ID NO: 100404 - DNA, 20 bp, Artificial Sequence
  chemically synthesized
atattgtgaatttaattagt

SEQ ID NO: 100405 - DNA, 20 bp, Artificial Sequence
  chemically synthesized
aggcaatttgctcatgaaat

SEQ ID NO: 100406 - DNA, 20 bp, Artificial Sequence
  chemically synthesized
gggctagattctgatttcat

SEQ ID NO: 100407 - DNA, 20 bp, Artificial Sequence
  chemically synthesized
ttgctcatgaaatcagaatc

SEQ ID NO: 100408 - DNA, 20 bp, Artificial Sequence
  chemically synthesized
caacccagcaagggaagggc

SEQ ID NO: 100409 - DNA, 20 bp, Artificial Sequence
  chemically synthesized
ccagcaacccagcaagggaa

SEQ ID NO: 100410 - DNA, 20 bp, Artificial Sequence
  chemically synthesized
tccagcaacccagcaaggga

SEQ ID NO: 100411 - DNA, 20 bp, Artificial Sequence
  chemically synthesized
gaatctagcccttcccttgc

SEQ ID NO: 100412 - DNA, 20 bp, Artificial Sequence
  chemically synthesized
atccagcaacccagcaaggg

SEQ ID NO: 100413 - DNA, 20 bp, Artificial Sequence
  chemically synthesized
aatctagcccttcccttgct

SEQ ID NO: 100414 - DNA, 20 bp, Artificial Sequence
  chemically synthesized
cagatccagcaacccagcaa

SEQ ID NO: 100415 - DNA, 20 bp, Artificial Sequence
  chemically synthesized
acagatccagcaacccagca

SEQ ID NO: 100416 - DNA, 20 bp, Artificial Sequence
  chemically synthesized
cacagatccagcaacccagc

SEQ ID NO: 100417 - DNA, 20 bp, Artificial Sequence
  chemically synthesized
cccttcccttgctgggttgc

SEQ ID NO: 100418 - DNA, 20 bp, Artificial Sequence
  chemically synthesized
aatacacagatccagcaacc

SEQ ID NO: 100419 - DNA, 20 bp, Artificial Sequence
  chemically synthesized
aatataggaatacacagatc

SEQ ID NO: 100420 - DNA, 20 bp, Artificial Sequence
  chemically synthesized
gagaagaatataggaataca

SEQ ID NO: 100421 - DNA, 20 bp, Artificial Sequence
  chemically synthesized
caatagctagagaagaatat

SEQ ID NO: 100422 - DNA, 20 bp, Artificial Sequence
  chemically synthesized
gcaatagctagagaagaata

SEQ ID NO: 100423 - DNA, 20 bp, Artificial Sequence
  chemically synthesized
tgtattcctatattcttctc

SEQ ID NO: 100424 - DNA, 20 bp, Artificial Sequence
  chemically synthesized
aaatgaggcaatagctagag

SEQ ID NO: 100425 - DNA, 20 bp, Artificial Sequence
  chemically synthesized
gagaaatgaggcaatagcta

SEQ ID NO: 100426 - DNA, 20 bp, Artificial Sequence
  chemically synthesized
ttgagaaatgaggcaatagc

SEQ ID NO: 100427 - DNA, 20 bp, Artificial Sequence
  chemically synthesized
gaatttgagaaatgaggcaa

SEQ ID NO: 100428 - DNA, 20 bp, Artificial Sequence
  chemically synthesized
tgaaaggaatttgagaaatg

SEQ ID NO: 100429 - DNA, 20 bp, Artificial Sequence
  chemically synthesized
atgaaaggaatttgagaaat

SEQ ID NO: 100430 - DNA, 20 bp, Artificial Sequence
  chemically synthesized
tgaagacatgaaaggaattt

SEQ ID NO: 100431 - DNA, 20 bp, Artificial Sequence
  chemically synthesized
aatggagatgaagacatgaa

SEQ ID NO: 100432 - DNA, 20 bp, Artificial Sequence
  chemically synthesized
gaatggagatgaagacatga

SEQ ID NO: 100433 - DNA, 20 bp, Artificial Sequence
  chemically synthesized
ggaaataaggaatggagatg

SEQ ID NO: 100434 - DNA, 20 bp, Artificial Sequence
  chemically synthesized
ggaggtggaaataaggaatg

SEQ ID NO: 100435 - DNA, 20 bp, Artificial Sequence
  chemically synthesized
agggaggtggaaataaggaa

SEQ ID NO: 100436 - DNA, 20 bp, Artificial Sequence
  chemically synthesized
gaagtagggaggtggaaata

SEQ ID NO: 100437 - DNA, 20 bp, Artificial Sequence
  chemically synthesized
agaagtagggaggtggaaat

SEQ ID NO: 100438 - DNA, 20 bp, Artificial Sequence
  chemically synthesized
tgagttgagaagtagggagg

SEQ ID NO: 100439 - DNA, 20 bp, Artificial Sequence
  chemically synthesized
tggtgagttgagaagtaggg

SEQ ID NO: 100440 - DNA, 20 bp, Artificial Sequence
  chemically synthesized
gtggtgagttgagaagtagg

SEQ ID NO: 100441 - DNA, 20 bp, Artificial Sequence
  chemically synthesized
tggtggtgagttgagaagta

SEQ ID NO: 100442 - DNA, 20 bp, Artificial Sequence
  chemically synthesized
atggtggtgagttgagaagt

SEQ ID NO: 100443 - DNA, 20 bp, Artificial Sequence
  chemically synthesized
tatggtggtgagttgagaag

SEQ ID NO: 100444 - DNA, 20 bp, Artificial Sequence
  chemically synthesized
tcttatggtggtgagttgag

SEQ ID NO: 100445 - DNA, 20 bp, Artificial Sequence
  chemically synthesized
aagtcttatggtggtgagtt

SEQ ID NO: 100446 - DNA, 20 bp, Artificial Sequence
  chemically synthesized
ccaagaagtcttatggtggt

SEQ ID NO: 100447 - DNA, 20 bp, Artificial Sequence
  chemically synthesized
acttctcaactcaccaccat

SEQ ID NO: 100448 - DNA, 20 bp, Artificial Sequence
  chemically synthesized
gcagccaagaagtcttatgg

SEQ ID NO: 100449 - DNA, 20 bp, Artificial Sequence
  chemically synthesized
ccggcagccaagaagtctta

SEQ ID NO: 100450 - DNA, 20 bp, Artificial Sequence
  chemically synthesized
ctcaccaccataagacttct

SEQ ID NO: 100451 - DNA, 20 bp, Artificial Sequence
  chemically synthesized
caccgcgcccggcagccaag

SEQ ID NO: 100452 - DNA, 20 bp, Artificial Sequence
  chemically synthesized
ccataagacttcttggctgc

SEQ ID NO: 100453 - DNA, 20 bp, Artificial Sequence
  chemically synthesized
cataagacttcttggctgcc

SEQ ID NO: 100454 - DNA, 20 bp, Artificial Sequence
  chemically synthesized
agccaccgcgcccggcagcc

SEQ ID NO: 100455 - DNA, 20 bp, Artificial Sequence
  chemically synthesized
gacttcttggctgccgggcg

SEQ ID NO: 100456 - DNA, 20 bp, Artificial Sequence
  chemically synthesized
gcgtgagccaccgcgcccgg

SEQ ID NO: 100457 - DNA, 20 bp, Artificial Sequence
  chemically synthesized
ttcttggctgccgggcgcgg

SEQ ID NO: 100458 - DNA, 20 bp, Artificial Sequence
  chemically synthesized
caggcgtgagccaccgcgcc

SEQ ID NO: 100459 - DNA, 20 bp, Artificial Sequence
  chemically synthesized
agtgctgggattacaggcgt

SEQ ID NO: 100460 - DNA, 20 bp, Artificial Sequence
  chemically synthesized
gtggctcacgcctgtaatcc

SEQ ID NO: 100461 - DNA, 20 bp, Artificial Sequence
  chemically synthesized
tcccaaagtgctgggattac

SEQ ID NO: 100462 - DNA, 20 bp, Artificial Sequence
  chemically synthesized
ctcccaaagtgctgggatta

SEQ ID NO: 100463 - DNA, 20 bp, Artificial Sequence
  chemically synthesized
cgcctgtaatcccagcactt

SEQ ID NO: 100464 - DNA, 20 bp, Artificial Sequence
  chemically synthesized
tctcggcctcccaaagtgct

SEQ ID NO: 100465 - DNA, 20 bp, Artificial Sequence
  chemically synthesized
gcctgtaatcccagcacttt

SEQ ID NO: 100466 - DNA, 20 bp, Artificial Sequence
  chemically synthesized
gtctcggcctcccaaagtgc

SEQ ID NO: 100467 - DNA, 20 bp, Artificial Sequence
  chemically synthesized
ctgtaatcccagcactttgg

SEQ ID NO: 100468 - DNA, 20 bp, Artificial Sequence
  chemically synthesized
tgtaatcccagcactttggg

SEQ ID NO: 100469 - DNA, 20 bp, Artificial Sequence
  chemically synthesized
ccgcccgtctcggcctccca

SEQ ID NO: 100470 - DNA, 20 bp, Artificial Sequence
  chemically synthesized
tcccagcactttgggaggcc

SEQ ID NO: 100471 - DNA, 20 bp, Artificial Sequence
  chemically synthesized
agcactttgggaggccgaga

SEQ ID NO: 100472 - DNA, 20 bp, Artificial Sequence
  chemically synthesized
gcactttgggaggccgagac

SEQ ID NO: 100473 - DNA, 20 bp, Artificial Sequence
  chemically synthesized
ctttgggaggccgagacggg

SEQ ID NO: 100474 - DNA, 20 bp, Artificial Sequence
  chemically synthesized
acctcgtgatccgcccgtct

SEQ ID NO: 100475 - DNA, 20 bp, Artificial Sequence
  chemically synthesized
ggccgagacgggcggatcac

SEQ ID NO: 100476 - DNA, 20 bp, Artificial Sequence
  chemically synthesized
gccgagacgggcggatcacg

SEQ ID NO: 100477 - DNA, 20 bp, Artificial Sequence
  chemically synthesized
agacgggcggatcacgaggt

SEQ ID NO: 100478 - DNA, 20 bp, Artificial Sequence
  chemically synthesized
gacgggcggatcacgaggtc

SEQ ID NO: 100479 - DNA, 20 bp, Artificial Sequence
  chemically synthesized
cgggcggatcacgaggtcag

SEQ ID NO: 100480 - DNA, 20 bp, Artificial Sequence
  chemically synthesized
gatcacgaggtcaggagatc

SEQ ID NO: 100481 - DNA, 20 bp, Artificial Sequence
  chemically synthesized
tcaggagatcgagaccatcc

SEQ ID NO: 100482 - DNA, 20 bp, Artificial Sequence
  chemically synthesized
tttcaccgtgttagccagga

SEQ ID NO: 100483 - DNA, 20 bp, Artificial Sequence
  chemically synthesized
ggggtttcaccgtgttagcc

SEQ ID NO: 100484 - DNA, 20 bp, Artificial Sequence
  chemically synthesized
cgagaccatcctggctaaca

SEQ ID NO: 100485 - DNA, 20 bp, Artificial Sequence
  chemically synthesized
cggggtttcaccgtgttagc

SEQ ID NO: 100486 - DNA, 20 bp, Artificial Sequence
  chemically synthesized
gagacggggtttcaccgtgt

SEQ ID NO: 100487 - DNA, 20 bp, Artificial Sequence
  chemically synthesized
ttgtatttttagtagagacg

SEQ ID NO: 100488 - DNA, 20 bp, Artificial Sequence
  chemically synthesized
tttgtatttttagtagagac

SEQ ID NO: 100489 - DNA, 20 bp, Artificial Sequence
  chemically synthesized
ttttgtatttttagtagaga

SEQ ID NO: 100490 - DNA, 20 bp, Artificial Sequence
  chemically synthesized
taatttttgtatttttagta

SEQ ID NO: 100491 - DNA, 20 bp, Artificial Sequence
  chemically synthesized
gctaatttttgtatttttag

SEQ ID NO: 100492 - DNA, 20 bp, Artificial Sequence
  chemically synthesized
ccagctaatttttgtatttt

SEQ ID NO: 100493 - DNA, 20 bp, Artificial Sequence
  chemically synthesized
tctactaaaaatacaaaaat

SEQ ID NO: 100494 - DNA, 20 bp, Artificial Sequence
  chemically synthesized
ctaaaaatacaaaaattagc

SEQ ID NO: 100495 - DNA, 20 bp, Artificial Sequence
  chemically synthesized
taaaaatacaaaaattagct

SEQ ID NO: 100496 - DNA, 20 bp, Artificial Sequence
  chemically synthesized
atacaaaaattagctgggca

SEQ ID NO: 100497 - DNA, 20 bp, Artificial Sequence
  chemically synthesized
caaaaattagctgggcatgg

SEQ ID NO: 100498 - DNA, 20 bp, Artificial Sequence
  chemically synthesized
caggcgcgcgccaccatgcc

SEQ ID NO: 100499 - DNA, 20 bp, Artificial Sequence
  chemically synthesized
ggcatggtggcgcgcgcctg

SEQ ID NO: 100500 - DNA, 20 bp, Artificial Sequence
  chemically synthesized
gtggcgcgcgcctgtagtcc

SEQ ID NO: 100501 - DNA, 20 bp, Artificial Sequence
  chemically synthesized
tcccgtgtagctgggactac

SEQ ID NO: 100502 - DNA, 20 bp, Artificial Sequence
  chemically synthesized
ctcccgtgtagctgggacta

SEQ ID NO: 100503 - DNA, 20 bp, Artificial Sequence
  chemically synthesized
cgcctgtagtcccagctaca

SEQ ID NO: 100504 - DNA, 20 bp, Artificial Sequence
  chemically synthesized
cctcagcctcccgtgtagct

SEQ ID NO: 100505 - DNA, 20 bp, Artificial Sequence
  chemically synthesized
gcctgtagtcccagctacac

SEQ ID NO: 100506 - DNA, 20 bp, Artificial Sequence
  chemically synthesized
gcctcagcctcccgtgtagc

SEQ ID NO: 100507 - DNA, 20 bp, Artificial Sequence
  chemically synthesized
ctgtagtcccagctacacgg

SEQ ID NO: 100508 - DNA, 20 bp, Artificial Sequence
  chemically synthesized
tgtagtcccagctacacggg

SEQ ID NO: 100509 - DNA, 20 bp, Artificial Sequence
  chemically synthesized
tcctgcctcagcctcccgtg

SEQ ID NO: 100510 - DNA, 20 bp, Artificial Sequence
  chemically synthesized
tcccagctacacgggaggct

SEQ ID NO: 100511 - DNA, 20 bp, Artificial Sequence
  chemically synthesized
cccagctacacgggaggctg

SEQ ID NO: 100512 - DNA, 20 bp, Artificial Sequence
  chemically synthesized
agctacacgggaggctgagg

SEQ ID NO: 100513 - DNA, 20 bp, Artificial Sequence
  chemically synthesized
gctacacgggaggctgaggc

SEQ ID NO: 100514 - DNA, 20 bp, Artificial Sequence
  chemically synthesized
tacacgggaggctgaggcag

SEQ ID NO: 100515 - DNA, 20 bp, Artificial Sequence
  chemically synthesized
ttcacgccattctcctgcct

SEQ ID NO: 100516 - DNA, 20 bp, Artificial Sequence
  chemically synthesized
gggaggctgaggcaggagaa

SEQ ID NO: 100517 - DNA, 20 bp, Artificial Sequence
  chemically synthesized
gcaggagaatggcgtgaacc

SEQ ID NO: 100518 - DNA, 20 bp, Artificial Sequence
  chemically synthesized
caggagaatggcgtgaaccc

SEQ ID NO: 100519 - DNA, 20 bp, Artificial Sequence
  chemically synthesized
ggagaatggcgtgaacccgg

SEQ ID NO: 100520 - DNA, 20 bp, Artificial Sequence
  chemically synthesized
gagaatggcgtgaacccggg

SEQ ID NO: 100521 - DNA, 20 bp, Artificial Sequence
  chemically synthesized
aatggcgtgaacccgggagg

SEQ ID NO: 100522 - DNA, 20 bp, Artificial Sequence
  chemically synthesized
cactgcaagctccgcctccc

SEQ ID NO: 100523 - DNA, 20 bp, Artificial Sequence
  chemically synthesized
tggcgtgaacccgggaggcg

SEQ ID NO: 100524 - DNA, 20 bp, Artificial Sequence
  chemically synthesized
tcactgcaagctccgcctcc

SEQ ID NO: 100525 - DNA, 20 bp, Artificial Sequence
  chemically synthesized
aacccgggaggcggagcttg

SEQ ID NO: 100526 - DNA, 20 bp, Artificial Sequence
  chemically synthesized
cgggaggcggagcttgcagt

SEQ ID NO: 100527 - DNA, 20 bp, Artificial Sequence
  chemically synthesized
gcgcgatctcgactcactgc

SEQ ID NO: 100528 - DNA, 20 bp, Artificial Sequence
  chemically synthesized
ggcggagcttgcagtgagtc

SEQ ID NO: 100529 - DNA, 20 bp, Artificial Sequence
  chemically synthesized
tcgcccaggctggagtgcag

SEQ ID NO: 100530 - DNA, 20 bp, Artificial Sequence
  chemically synthesized
gagatcgcgccactgcactc

SEQ ID NO: 100531 - DNA, 20 bp, Artificial Sequence
  chemically synthesized
ctgtcgcccaggctggagtg

SEQ ID NO: 100532 - DNA, 20 bp, Artificial Sequence
  chemically synthesized
cgcgccactgcactccagcc

SEQ ID NO: 100533 - DNA, 20 bp, Artificial Sequence
  chemically synthesized
gcgccactgcactccagcct

SEQ ID NO: 100534 - DNA, 20 bp, Artificial Sequence
  chemically synthesized
tcgctctgtcgcccaggctg

SEQ ID NO: 100535 - DNA, 20 bp, Artificial Sequence
  chemically synthesized
tttcgctctgtcgcccaggc

SEQ ID NO: 100536 - DNA, 20 bp, Artificial Sequence
  chemically synthesized
ctgcactccagcctgggcga

SEQ ID NO: 100537 - DNA, 20 bp, Artificial Sequence
  chemically synthesized
ggagtttcgctctgtcgccc

SEQ ID NO: 100538 - DNA, 20 bp, Artificial Sequence
  chemically synthesized
gcactccagcctgggcgaca

SEQ ID NO: 100539 - DNA, 20 bp, Artificial Sequence
  chemically synthesized
cggagtttcgctctgtcgcc

SEQ ID NO: 100540 - DNA, 20 bp, Artificial Sequence
  chemically synthesized
ttttttttttttttgagacg

SEQ ID NO: 100541 - DNA, 20 bp, Artificial Sequence
  chemically synthesized
ttttttttttttttttgaga

SEQ ID NO: 100542 - DNA, 20 bp, Artificial Sequence
  chemically synthesized
tttttttttttttttttttt

SEQ ID NO: 100543 - DNA, 20 bp, Artificial Sequence
  chemically synthesized
aaaaaaaaaaaaaaaaaaaa

SEQ ID NO: 100544 - DNA, 20 bp, Artificial Sequence
  chemically synthesized
aaaaaaaaaaaaagacttct

SEQ ID NO: 100545 - DNA, 20 bp, Artificial Sequence
  chemically synthesized
acactggaaccagagccaag

SEQ ID NO: 100546 - DNA, 20 bp, Artificial Sequence
  chemically synthesized
aaaaaaagacttcttggctc

SEQ ID NO: 100547 - DNA, 20 bp, Artificial Sequence
  chemically synthesized
tttacactggaaccagagcc

SEQ ID NO: 100548 - DNA, 20 bp, Artificial Sequence
  chemically synthesized
agacttcttggctctggttc

SEQ ID NO: 100549 - DNA, 20 bp, Artificial Sequence
  chemically synthesized
aagaatttacactggaacca

SEQ ID NO: 100550 - DNA, 20 bp, Artificial Sequence
  chemically synthesized
caaagaatttacactggaac

SEQ ID NO: 100551 - DNA, 20 bp, Artificial Sequence
  chemically synthesized
tgcaatcaaagaatttacac

SEQ ID NO: 100552 - DNA, 20 bp, Artificial Sequence
  chemically synthesized
ggttcatgatgatgcaatca

SEQ ID NO: 100553 - DNA, 20 bp, Artificial Sequence
  chemically synthesized
tcatcatgaacctcttactt

SEQ ID NO: 100554 - DNA, 20 bp, Artificial Sequence
  chemically synthesized
gagccctaacctcaagtaag

SEQ ID NO: 100555 - DNA, 20 bp, Artificial Sequence
  chemically synthesized
catcatgaacctcttacttg

SEQ ID NO: 100556 - DNA, 20 bp, Artificial Sequence
  chemically synthesized
tgagccctaacctcaagtaa

SEQ ID NO: 100557 - DNA, 20 bp, Artificial Sequence
  chemically synthesized
gctgagccctaacctcaagt

SEQ ID NO: 100558 - DNA, 20 bp, Artificial Sequence
  chemically synthesized
atgaacctcttacttgaggt

SEQ ID NO: 100559 - DNA, 20 bp, Artificial Sequence
  chemically synthesized
tgaacctcttacttgaggtt

SEQ ID NO: 100560 - DNA, 20 bp, Artificial Sequence
  chemically synthesized
gaacctcttacttgaggtta

SEQ ID NO: 100561 - DNA, 20 bp, Artificial Sequence
  chemically synthesized
gggcgctgagccctaacctc

SEQ ID NO: 100562 - DNA, 20 bp, Artificial Sequence
  chemically synthesized
tcttacttgaggttagggct

SEQ ID NO: 100563 - DNA, 20 bp, Artificial Sequence
  chemically synthesized
gtgtgagggttcggggcgct

SEQ ID NO: 100564 - DNA, 20 bp, Artificial Sequence
  chemically synthesized
tcaaacagtgtgagggttcg

SEQ ID NO: 100565 - DNA, 20 bp, Artificial Sequence
  chemically synthesized
ctcaaacagtgtgagggttc

SEQ ID NO: 100566 - DNA, 20 bp, Artificial Sequence
  chemically synthesized
cctcaaacagtgtgagggtt

SEQ ID NO: 100567 - DNA, 20 bp, Artificial Sequence
  chemically synthesized
ttgaccctcaaacagtgtga

SEQ ID NO: 100568 - DNA, 20 bp, Artificial Sequence
  chemically synthesized
gttgaccctcaaacagtgtg

SEQ ID NO: 100569 - DNA, 20 bp, Artificial Sequence
  chemically synthesized
agttgaccctcaaacagtgt

SEQ ID NO: 100570 - DNA, 20 bp, Artificial Sequence
  chemically synthesized
cccgaaccctcacactgttt

SEQ ID NO: 100571 - DNA, 20 bp, Artificial Sequence
  chemically synthesized
ccgaaccctcacactgtttg

SEQ ID NO: 100572 - DNA, 20 bp, Artificial Sequence
  chemically synthesized
cgaaccctcacactgtttga

SEQ ID NO: 100573 - DNA, 20 bp, Artificial Sequence
  chemically synthesized
ttatacagttgaccctcaaa

SEQ ID NO: 100574 - DNA, 20 bp, Artificial Sequence
  chemically synthesized
gaattagggaaagtgttata

SEQ ID NO: 100575 - DNA, 20 bp, Artificial Sequence
  chemically synthesized
ggtgagttgggaattaggga

SEQ ID NO: 100576 - DNA, 20 bp, Artificial Sequence
  chemically synthesized
ttgtggtgagttgggaatta

SEQ ID NO: 100577 - DNA, 20 bp, Artificial Sequence
  chemically synthesized
attgtggtgagttgggaatt

SEQ ID NO: 100578 - DNA, 20 bp, Artificial Sequence
  chemically synthesized
tattgtggtgagttgggaat

SEQ ID NO: 100579 - DNA, 20 bp, Artificial Sequence
  chemically synthesized
aagtcttattgtggtgagtt

SEQ ID NO: 100580 - DNA, 20 bp, Artificial Sequence
  chemically synthesized
gaagtcttattgtggtgagt

SEQ ID NO: 100581 - DNA, 20 bp, Artificial Sequence
  chemically synthesized
ccaagaagtcttattgtggt

SEQ ID NO: 100582 - DNA, 20 bp, Artificial Sequence
  chemically synthesized
aattcccaactcaccacaat

SEQ ID NO: 100583 - DNA, 20 bp, Artificial Sequence
  chemically synthesized
agagccaagaagtcttattg

SEQ ID NO: 100584 - DNA, 20 bp, Artificial Sequence
  chemically synthesized
ctcaccacaataagacttct

SEQ ID NO: 100585 - DNA, 20 bp, Artificial Sequence
  chemically synthesized
acagtggaaccagagccaag

SEQ ID NO: 100586 - DNA, 20 bp, Artificial Sequence
  chemically synthesized
acaataagacttcttggctc

SEQ ID NO: 100587 - DNA, 20 bp, Artificial Sequence
  chemically synthesized
tttacagtggaaccagagcc

SEQ ID NO: 100588 - DNA, 20 bp, Artificial Sequence
  chemically synthesized
aagaatttacagtggaacca

SEQ ID NO: 100589 - DNA, 20 bp, Artificial Sequence
  chemically synthesized
caaagaatttacagtggaac

SEQ ID NO: 100590 - DNA, 20 bp, Artificial Sequence
  chemically synthesized
atgcctcaaagaatttacag

SEQ ID NO: 100591 - DNA, 20 bp, Artificial Sequence
  chemically synthesized
atgatgcctcaaagaattta

SEQ ID NO: 100592 - DNA, 20 bp, Artificial Sequence
  chemically synthesized
ggttccactgtaaattcttt

SEQ ID NO: 100593 - DNA, 20 bp, Artificial Sequence
  chemically synthesized
gttccactgtaaattctttg

SEQ ID NO: 100594 - DNA, 20 bp, Artificial Sequence
  chemically synthesized
aggttcatgatgatgcctca

SEQ ID NO: 100595 - DNA, 20 bp, Artificial Sequence
  chemically synthesized
tggagttttcagcaagtaag

SEQ ID NO: 100596 - DNA, 20 bp, Artificial Sequence
  chemically synthesized
ttggagttttcagcaagtaa

SEQ ID NO: 100597 - DNA, 20 bp, Artificial Sequence
  chemically synthesized
tcttggagttttcagcaagt

SEQ ID NO: 100598 - DNA, 20 bp, Artificial Sequence
  chemically synthesized
tatttcttggagttttcagc

SEQ ID NO: 100599 - DNA, 20 bp, Artificial Sequence
  chemically synthesized
acactatttcttggagtttt

SEQ ID NO: 100600 - DNA, 20 bp, Artificial Sequence
  chemically synthesized
tcttacttgctgaaaactcc

SEQ ID NO: 100601 - DNA, 20 bp, Artificial Sequence
  chemically synthesized
ttgctgaaaactccaagaaa

SEQ ID NO: 100602 - DNA, 20 bp, Artificial Sequence
  chemically synthesized
ggtgtgaacactatttcttg

SEQ ID NO: 100603 - DNA, 20 bp, Artificial Sequence
  chemically synthesized
taggtgtgaacactatttct

SEQ ID NO: 100604 - DNA, 20 bp, Artificial Sequence
  chemically synthesized
caagaaatagtgttcacacc

SEQ ID NO: 100605 - DNA, 20 bp, Artificial Sequence
  chemically synthesized
accaggcagctgaaaaagct

SEQ ID NO: 100606 - DNA, 20 bp, Artificial Sequence
  chemically synthesized
gtgttcacacctagcttttt

SEQ ID NO: 100607 - DNA, 20 bp, Artificial Sequence
  chemically synthesized
taccaggcagctgaaaaagc

SEQ ID NO: 100608 - DNA, 20 bp, Artificial Sequence
  chemically synthesized
ggactaccaggcagctgaaa

SEQ ID NO: 100609 - DNA, 20 bp, Artificial Sequence
  chemically synthesized
acctagctttttcagctgcc

SEQ ID NO: 100610 - DNA, 20 bp, Artificial Sequence
  chemically synthesized
tagctttttcagctgcctgg

SEQ ID NO: 100611 - DNA, 20 bp, Artificial Sequence
  chemically synthesized
cagtgtcagggactaccagg

SEQ ID NO: 100612 - DNA, 20 bp, Artificial Sequence
  chemically synthesized
tggcagtgtcagggactacc

SEQ ID NO: 100613 - DNA, 20 bp, Artificial Sequence
  chemically synthesized
ctggcagtgtcagggactac

SEQ ID NO: 100614 - DNA, 20 bp, Artificial Sequence
  chemically synthesized
ggaagtggctggcagtgtca

SEQ ID NO: 100615 - DNA, 20 bp, Artificial Sequence
  chemically synthesized
aggaagtggctggcagtgtc

SEQ ID NO: 100616 - DNA, 20 bp, Artificial Sequence
  chemically synthesized
ctggtagtccctgacactgc

SEQ ID NO: 100617 - DNA, 20 bp, Artificial Sequence
  chemically synthesized
aaggaagtggctggcagtgt

SEQ ID NO: 100618 - DNA, 20 bp, Artificial Sequence
  chemically synthesized
aaagacaaggaagtggctgg

SEQ ID NO: 100619 - DNA, 20 bp, Artificial Sequence
  chemically synthesized
ctcaaagacaaggaagtggc

SEQ ID NO: 100620 - DNA, 20 bp, Artificial Sequence
  chemically synthesized
aagtctcaaagacaaggaag

SEQ ID NO: 100621 - DNA, 20 bp, Artificial Sequence
  chemically synthesized
agaaagtctcaaagacaagg

SEQ ID NO: 100622 - DNA, 20 bp, Artificial Sequence
  chemically synthesized
ccagccacttccttgtcttt

SEQ ID NO: 100623 - DNA, 20 bp, Artificial Sequence
  chemically synthesized
aggagaaagtctcaaagaca

SEQ ID NO: 100624 - DNA, 20 bp, Artificial Sequence
  chemically synthesized
aaggagaaagtctcaaagac

SEQ ID NO: 100625 - DNA, 20 bp, Artificial Sequence
  chemically synthesized
tgagcaaggagaaagtctca

SEQ ID NO: 100626 - DNA, 20 bp, Artificial Sequence
  chemically synthesized
taggaacctgagcaaggaga

SEQ ID NO: 100627 - DNA, 20 bp, Artificial Sequence
  chemically synthesized
tttgagactttctccttgct

SEQ ID NO: 100628 - DNA, 20 bp, Artificial Sequence
  chemically synthesized
ttgagactttctccttgctc

SEQ ID NO: 100629 - DNA, 20 bp, Artificial Sequence
  chemically synthesized
tgactaggaacctgagcaag

SEQ ID NO: 100630 - DNA, 20 bp, Artificial Sequence
  chemically synthesized
aatgactaggaacctgagca

SEQ ID NO: 100631 - DNA, 20 bp, Artificial Sequence
  chemically synthesized
gaatgactaggaacctgagc

SEQ ID NO: 100632 - DNA, 20 bp, Artificial Sequence
  chemically synthesized
tttctccttgctcaggttcc

SEQ ID NO: 100633 - DNA, 20 bp, Artificial Sequence
  chemically synthesized
agaagaatgactaggaacct

SEQ ID NO: 100634 - DNA, 20 bp, Artificial Sequence
  chemically synthesized
tacaaaggagaagaatgact

SEQ ID NO: 100635 - DNA, 20 bp, Artificial Sequence
  chemically synthesized
ctacaaaggagaagaatgac

SEQ ID NO: 100636 - DNA, 20 bp, Artificial Sequence
  chemically synthesized
aatggcaggctacaaaggag

SEQ ID NO: 100637 - DNA, 20 bp, Artificial Sequence
  chemically synthesized
ctagtcattcttctcctttg

SEQ ID NO: 100638 - DNA, 20 bp, Artificial Sequence
  chemically synthesized
gaaaatggcaggctacaaag

SEQ ID NO: 100639 - DNA, 20 bp, Artificial Sequence
  chemically synthesized
cagaaaatggcaggctacaa

SEQ ID NO: 100640 - DNA, 20 bp, Artificial Sequence
  chemically synthesized
ccagaaaatggcaggctaca

SEQ ID NO: 100641 - DNA, 20 bp, Artificial Sequence
  chemically synthesized
gcaggtggccagaaaatggc

SEQ ID NO: 100642 - DNA, 20 bp, Artificial Sequence
  chemically synthesized
agcaggtggccagaaaatgg

SEQ ID NO: 100643 - DNA, 20 bp, Artificial Sequence
  chemically synthesized
ctttgtagcctgccattttc

SEQ ID NO: 100644 - DNA, 20 bp, Artificial Sequence
  chemically synthesized
ctaagcaggtggccagaaaa

SEQ ID NO: 100645 - DNA, 20 bp, Artificial Sequence
  chemically synthesized
gtaggagctaagcaggtggc

SEQ ID NO: 100646 - DNA, 20 bp, Artificial Sequence
  chemically synthesized
ccattttctggccacctgct

SEQ ID NO: 100647 - DNA, 20 bp, Artificial Sequence
  chemically synthesized
tcctgtaggagctaagcagg

SEQ ID NO: 100648 - DNA, 20 bp, Artificial Sequence
  chemically synthesized
gtttcctgtaggagctaagc

SEQ ID NO: 100649 - DNA, 20 bp, Artificial Sequence
  chemically synthesized
tgtttcctgtaggagctaag

SEQ ID NO: 100650 - DNA, 20 bp, Artificial Sequence
  chemically synthesized
aagtgtttcctgtaggagct

SEQ ID NO: 100651 - DNA, 20 bp, Artificial Sequence
  chemically synthesized
ggccacctgcttagctccta

SEQ ID NO: 100652 - DNA, 20 bp, Artificial Sequence
  chemically synthesized
gccacctgcttagctcctac

SEQ ID NO: 100653 - DNA, 20 bp, Artificial Sequence
  chemically synthesized
ttatgaagtgtttcctgtag

SEQ ID NO: 100654 - DNA, 20 bp, Artificial Sequence
  chemically synthesized
acttatgaagtgtttcctgt

SEQ ID NO: 100655 - DNA, 20 bp, Artificial Sequence
  chemically synthesized
cacttatgaagtgtttcctg

SEQ ID NO: 100656 - DNA, 20 bp, Artificial Sequence
  chemically synthesized
tcctacaggaaacacttcat

SEQ ID NO: 100657 - DNA, 20 bp, Artificial Sequence
  chemically synthesized
aacagaaaacaacacttatg

SEQ ID NO: 100658 - DNA, 20 bp, Artificial Sequence
  chemically synthesized
tcataagtgttgttttctgt

SEQ ID NO: 100659 - DNA, 20 bp, Artificial Sequence
  chemically synthesized
ttctcaggcaggatatctaa

SEQ ID NO: 100660 - DNA, 20 bp, Artificial Sequence
  chemically synthesized
ttctgttagatatcctgcct

SEQ ID NO: 100661 - DNA, 20 bp, Artificial Sequence
  chemically synthesized
aggggtgtgatttctcaggc

SEQ ID NO: 100662 - DNA, 20 bp, Artificial Sequence
  chemically synthesized
taggggtgtgatttctcagg

SEQ ID NO: 100663 - DNA, 20 bp, Artificial Sequence
  chemically synthesized
gagtaggggtgtgatttctc

SEQ ID NO: 100664 - DNA, 20 bp, Artificial Sequence
  chemically synthesized
agagtaggggtgtgatttct

SEQ ID NO: 100665 - DNA, 20 bp, Artificial Sequence
  chemically synthesized
tcccacttatgcaagagtag

SEQ ID NO: 100666 - DNA, 20 bp, Artificial Sequence
  chemically synthesized
ttcccacttatgcaagagta

SEQ ID NO: 100667 - DNA, 20 bp, Artificial Sequence
  chemically synthesized
tttcccacttatgcaagagt

SEQ ID NO: 100668 - DNA, 20 bp, Artificial Sequence
  chemically synthesized
atttcccacttatgcaagag

SEQ ID NO: 100669 - DNA, 20 bp, Artificial Sequence
  chemically synthesized
tcacacccctactcttgcat

SEQ ID NO: 100670 - DNA, 20 bp, Artificial Sequence
  chemically synthesized
agaatttcccacttatgcaa

SEQ ID NO: 100671 - DNA, 20 bp, Artificial Sequence
  chemically synthesized
cacccctactcttgcataag

SEQ ID NO: 100672 - DNA, 20 bp, Artificial Sequence
  chemically synthesized
gaagaatttcccacttatgc

SEQ ID NO: 100673 - DNA, 20 bp, Artificial Sequence
  chemically synthesized
acccctactcttgcataagt

SEQ ID NO: 100674 - DNA, 20 bp, Artificial Sequence
  chemically synthesized
gtgggaaattcttcaaatct

SEQ ID NO: 100675 - DNA, 20 bp, Artificial Sequence
  chemically synthesized
cattcctcacctaagatttg

SEQ ID NO: 100676 - DNA, 20 bp, Artificial Sequence
  chemically synthesized
tgggaaattcttcaaatctt

SEQ ID NO: 100677 - DNA, 20 bp, Artificial Sequence
  chemically synthesized
aaattcttcaaatcttaggt

SEQ ID NO: 100678 - DNA, 20 bp, Artificial Sequence
  chemically synthesized
aattcttcaaatcttaggtg

SEQ ID NO: 100679 - DNA, 20 bp, Artificial Sequence
  chemically synthesized
ccatctaacattcctcacct

SEQ ID NO: 100680 - DNA, 20 bp, Artificial Sequence
  chemically synthesized
aaatcttaggtgaggaatgt

SEQ ID NO: 100681 - DNA, 20 bp, Artificial Sequence
  chemically synthesized
cttaggtgaggaatgttaga

SEQ ID NO: 100682 - DNA, 20 bp, Artificial Sequence
  chemically synthesized
caagccttgaaagagaagag

SEQ ID NO: 100683 - DNA, 20 bp, Artificial Sequence
  chemically synthesized
gcacaagccttgaaagagaa

SEQ ID NO: 100684 - DNA, 20 bp, Artificial Sequence
  chemically synthesized
gatggcttctcttctctttc

SEQ ID NO: 100685 - DNA, 20 bp, Artificial Sequence
  chemically synthesized
atgcacaagccttgaaagag

SEQ ID NO: 100686 - DNA, 20 bp, Artificial Sequence
  chemically synthesized
atggcttctcttctctttca

SEQ ID NO: 100687 - DNA, 20 bp, Artificial Sequence
  chemically synthesized
tgcatgcacaagccttgaaa

SEQ ID NO: 100688 - DNA, 20 bp, Artificial Sequence
  chemically synthesized
tctgcatgcacaagccttga

SEQ ID NO: 100689 - DNA, 20 bp, Artificial Sequence
  chemically synthesized
tctttcaaggcttgtgcatg

SEQ ID NO: 100690 - DNA, 20 bp, Artificial Sequence
  chemically synthesized
cccaaaagatctgcatgcac

SEQ ID NO: 100691 - DNA, 20 bp, Artificial Sequence
  chemically synthesized
gcttgtgcatgcagatcttt

SEQ ID NO: 100692 - DNA, 20 bp, Artificial Sequence
  chemically synthesized
cttgtgcatgcagatctttt

SEQ ID NO: 100693 - DNA, 20 bp, Artificial Sequence
  chemically synthesized
ttgtgcatgcagatcttttg

SEQ ID NO: 100694 - DNA, 20 bp, Artificial Sequence
  chemically synthesized
cattgtaagaagatccccaa

SEQ ID NO: 100695 - DNA, 20 bp, Artificial Sequence
  chemically synthesized
atcagaatctgcattgtaag

SEQ ID NO: 100696 - DNA, 20 bp, Artificial Sequence
  chemically synthesized
ttggggatcttcttacaatg

SEQ ID NO: 100697 - DNA, 20 bp, Artificial Sequence
  chemically synthesized
tgaatcagaatctgcattgt

SEQ ID NO: 100698 - DNA, 20 bp, Artificial Sequence
  chemically synthesized
caatgcagattctgattcaa

SEQ ID NO: 100699 - DNA, 20 bp, Artificial Sequence
  chemically synthesized
ccacttcaaaactgttgaat

SEQ ID NO: 100700 - DNA, 20 bp, Artificial Sequence
  chemically synthesized
attctgattcaacagttttg

SEQ ID NO: 100701 - DNA, 20 bp, Artificial Sequence
  chemically synthesized
ctgattcaacagttttgaag

SEQ ID NO: 100702 - DNA, 20 bp, Artificial Sequence
  chemically synthesized
tgattcaacagttttgaagt

SEQ ID NO: 100703 - DNA, 20 bp, Artificial Sequence
  chemically synthesized
gattcaacagttttgaagtg

SEQ ID NO: 100704 - DNA, 20 bp, Artificial Sequence
  chemically synthesized
aacagttttgaagtggggcc

SEQ ID NO: 100705 - DNA, 20 bp, Artificial Sequence
  chemically synthesized
acagttttgaagtggggcct

SEQ ID NO: 100706 - DNA, 20 bp, Artificial Sequence
  chemically synthesized
tgttggcattttgaaatccc

SEQ ID NO: 100707 - DNA, 20 bp, Artificial Sequence
  chemically synthesized
ttgttggcattttgaaatcc

SEQ ID NO: 100708 - DNA, 20 bp, Artificial Sequence
  chemically synthesized
gacataacttgggggtttgt

SEQ ID NO: 100709 - DNA, 20 bp, Artificial Sequence
  chemically synthesized
caaaatgccaacaaaccccc

SEQ ID NO: 100710 - DNA, 20 bp, Artificial Sequence
  chemically synthesized
gaagccttgacataacttgg

SEQ ID NO: 100711 - DNA, 20 bp, Artificial Sequence
  chemically synthesized
tgaagccttgacataacttg

SEQ ID NO: 100712 - DNA, 20 bp, Artificial Sequence
  chemically synthesized
ttgaagccttgacataactt

SEQ ID NO: 100713 - DNA, 20 bp, Artificial Sequence
  chemically synthesized
attgaagccttgacataact

SEQ ID NO: 100714 - DNA, 20 bp, Artificial Sequence
  chemically synthesized
acaaacccccaagttatgtc

SEQ ID NO: 100715 - DNA, 20 bp, Artificial Sequence
  chemically synthesized
caaacccccaagttatgtca

SEQ ID NO: 100716 - DNA, 20 bp, Artificial Sequence
  chemically synthesized
cttgctatacagtgtgattg

SEQ ID NO: 100717 - DNA, 20 bp, Artificial Sequence
  chemically synthesized
aaggcttcaatcacactgta

SEQ ID NO: 100718 - DNA, 20 bp, Artificial Sequence
  chemically synthesized
cttcaatcacactgtatagc

SEQ ID NO: 100719 - DNA, 20 bp, Artificial Sequence
  chemically synthesized
ttcaatcacactgtatagca

SEQ ID NO: 100720 - DNA, 20 bp, Artificial Sequence
  chemically synthesized
acagtgtcaaccttgctata

SEQ ID NO: 100721 - DNA, 20 bp, Artificial Sequence
  chemically synthesized
caaggttgacactgtcttta

SEQ ID NO: 100722 - DNA, 20 bp, Artificial Sequence
  chemically synthesized
attgcatcattctttaaaga

SEQ ID NO: 100723 - DNA, 20 bp, Artificial Sequence
  chemically synthesized
agtaattgcatcattcttta

SEQ ID NO: 100724 - DNA, 20 bp, Artificial Sequence
  chemically synthesized
aagaatgatgcaattactaa

SEQ ID NO: 100725 - DNA, 20 bp, Artificial Sequence
  chemically synthesized
agaatgatgcaattactaat

SEQ ID NO: 100726 - DNA, 20 bp, Artificial Sequence
  chemically synthesized
tagagatttatgtgtcctat

SEQ ID NO: 100727 - DNA, 20 bp, Artificial Sequence
  chemically synthesized
attcagttctgtaataatta

SEQ ID NO: 100728 - DNA, 20 bp, Artificial Sequence
  chemically synthesized
acataaatctctaattatta

SEQ ID NO: 100729 - DNA, 20 bp, Artificial Sequence
  chemically synthesized
agattcagttctgtaataat

SEQ ID NO: 100730 - DNA, 20 bp, Artificial Sequence
  chemically synthesized
ttttttagtgatcatagatt

SEQ ID NO: 100731 - DNA, 20 bp, Artificial Sequence
  chemically synthesized
ggttccttttttagtgatca

SEQ ID NO: 100732 - DNA, 20 bp, Artificial Sequence
  chemically synthesized
tgaatctatgatcactaaaa

SEQ ID NO: 100733 - DNA, 20 bp, Artificial Sequence
  chemically synthesized
gaatctatgatcactaaaaa

SEQ ID NO: 100734 - DNA, 20 bp, Artificial Sequence
  chemically synthesized
ttctttcatggttccttttt

SEQ ID NO: 100735 - DNA, 20 bp, Artificial Sequence
  chemically synthesized
cactaaaaaaggaaccatga

SEQ ID NO: 100736 - DNA, 20 bp, Artificial Sequence
  chemically synthesized
acataatgtcttttctttca

SEQ ID NO: 100737 - DNA, 20 bp, Artificial Sequence
  chemically synthesized
aaaaaggaaccatgaaagaa

SEQ ID NO: 100738 - DNA, 20 bp, Artificial Sequence
  chemically synthesized
aaagaaaagacattatgtct

SEQ ID NO: 100739 - DNA, 20 bp, Artificial Sequence
  chemically synthesized
ttagccaaggtatgataact

SEQ ID NO: 100740 - DNA, 20 bp, Artificial Sequence
  chemically synthesized
atgtctgagttatcatacct

SEQ ID NO: 100741 - DNA, 20 bp, Artificial Sequence
  chemically synthesized
tgagttatcataccttggct

SEQ ID NO: 100742 - DNA, 20 bp, Artificial Sequence
  chemically synthesized
gagttatcataccttggcta

SEQ ID NO: 100743 - DNA, 20 bp, Artificial Sequence
  chemically synthesized
tcttggtactaccttagcca

SEQ ID NO: 100744 - DNA, 20 bp, Artificial Sequence
  chemically synthesized
atcttggtactaccttagcc

SEQ ID NO: 100745 - DNA, 20 bp, Artificial Sequence
  chemically synthesized
ttatcataccttggctaagg

SEQ ID NO: 100746 - DNA, 20 bp, Artificial Sequence
  chemically synthesized
agcttatcttggtactacct

SEQ ID NO: 100747 - DNA, 20 bp, Artificial Sequence
  chemically synthesized
accttggctaaggtagtacc

SEQ ID NO: 100748 - DNA, 20 bp, Artificial Sequence
  chemically synthesized
ggctaaggtagtaccaagat

SEQ ID NO: 100749 - DNA, 20 bp, Artificial Sequence
  chemically synthesized
gctttgtgaagagcttatct

SEQ ID NO: 100750 - DNA, 20 bp, Artificial Sequence
  chemically synthesized
accaagataagctcttcaca

SEQ ID NO: 100751 - DNA, 20 bp, Artificial Sequence
  chemically synthesized
agcccattcagctttgtgaa

SEQ ID NO: 100752 - DNA, 20 bp, Artificial Sequence
  chemically synthesized
gaagcccattcagctttgtg

SEQ ID NO: 100753 - DNA, 20 bp, Artificial Sequence
  chemically synthesized
aagctcttcacaaagctgaa

SEQ ID NO: 100754 - DNA, 20 bp, Artificial Sequence
  chemically synthesized
agctcttcacaaagctgaat

SEQ ID NO: 100755 - DNA, 20 bp, Artificial Sequence
  chemically synthesized
tgatcattgtgaagcccatt

SEQ ID NO: 100756 - DNA, 20 bp, Artificial Sequence
  chemically synthesized
ctaccaccctgatcattgtg

SEQ ID NO: 100757 - DNA, 20 bp, Artificial Sequence
  chemically synthesized
tgaatgggcttcacaatgat

SEQ ID NO: 100758 - DNA, 20 bp, Artificial Sequence
  chemically synthesized
gaatgggcttcacaatgatc

SEQ ID NO: 100759 - DNA, 20 bp, Artificial Sequence
  chemically synthesized
aatgggcttcacaatgatca

SEQ ID NO: 100760 - DNA, 20 bp, Artificial Sequence
  chemically synthesized
gggcttcacaatgatcaggg

SEQ ID NO: 100761 - DNA, 20 bp, Artificial Sequence
  chemically synthesized
cttcacaatgatcagggtgg

SEQ ID NO: 100762 - DNA, 20 bp, Artificial Sequence
  chemically synthesized
atgatcagggtggtagaatt

SEQ ID NO: 100763 - DNA, 20 bp, Artificial Sequence
  chemically synthesized
atcagggtggtagaattcag

SEQ ID NO: 100764 - DNA, 20 bp, Artificial Sequence
  chemically synthesized
tcagggtggtagaattcagt

SEQ ID NO: 100765 - DNA, 20 bp, Artificial Sequence
  chemically synthesized
taagttgcaaaggagtttgt

SEQ ID NO: 100766 - DNA, 20 bp, Artificial Sequence
  chemically synthesized
ataagttgcaaaggagtttg

SEQ ID NO: 100767 - DNA, 20 bp, Artificial Sequence
  chemically synthesized
ccgtaatataagttgcaaag

SEQ ID NO: 100768 - DNA, 20 bp, Artificial Sequence
  chemically synthesized
atccgtaatataagttgcaa

SEQ ID NO: 100769 - DNA, 20 bp, Artificial Sequence
  chemically synthesized
tatccgtaatataagttgca

SEQ ID NO: 100770 - DNA, 20 bp, Artificial Sequence
  chemically synthesized
ctcctttgcaacttatatta

SEQ ID NO: 100771 - DNA, 20 bp, Artificial Sequence
  chemically synthesized
aatgtccctatccgtaatat

SEQ ID NO: 100772 - DNA, 20 bp, Artificial Sequence
  chemically synthesized
tttgcaacttatattacgga

SEQ ID NO: 100773 - DNA, 20 bp, Artificial Sequence
  chemically synthesized
ttgcaacttatattacggat

SEQ ID NO: 100774 - DNA, 20 bp, Artificial Sequence
  chemically synthesized
tgcaacttatattacggata

SEQ ID NO: 100775 - DNA, 20 bp, Artificial Sequence
  chemically synthesized
cggatagggacatttcaaaa

SEQ ID NO: 100776 - DNA, 20 bp, Artificial Sequence
  chemically synthesized
tttcaaaatagacactcgaa

SEQ ID NO: 100777 - DNA, 20 bp, Artificial Sequence
  chemically synthesized
aaaatagacactcgaacaga

SEQ ID NO: 100778 - DNA, 20 bp, Artificial Sequence
  chemically synthesized
gatcacggcactgtctgttc

SEQ ID NO: 100779 - DNA, 20 bp, Artificial Sequence
  chemically synthesized
tggtgaacccttacagatca

SEQ ID NO: 100780 - DNA, 20 bp, Artificial Sequence
  chemically synthesized
cagacagtgccgtgatctgt

SEQ ID NO: 100781 - DNA, 20 bp, Artificial Sequence
  chemically synthesized
agacagtgccgtgatctgta

SEQ ID NO: 100782 - DNA, 20 bp, Artificial Sequence
  chemically synthesized
gacagtgccgtgatctgtaa

SEQ ID NO: 100783 - DNA, 20 bp, Artificial Sequence
  chemically synthesized
cacatattggtgaaccctta

SEQ ID NO: 100784 - DNA, 20 bp, Artificial Sequence
  chemically synthesized
agttttaagtgtgcacatat

SEQ ID NO: 100785 - DNA, 20 bp, Artificial Sequence
  chemically synthesized
agccaatgggtataagtttt

SEQ ID NO: 100786 - DNA, 20 bp, Artificial Sequence
  chemically synthesized
tgggcccagccaatgggtat

SEQ ID NO: 100787 - DNA, 20 bp, Artificial Sequence
  chemically synthesized
cacttaaaacttatacccat

SEQ ID NO: 100788 - DNA, 20 bp, Artificial Sequence
  chemically synthesized
taaaacttatacccattggc

SEQ ID NO: 100789 - DNA, 20 bp, Artificial Sequence
  chemically synthesized
aaaacttatacccattggct

SEQ ID NO: 100790 - DNA, 20 bp, Artificial Sequence
  chemically synthesized
aaatgctgggcccagccaat

SEQ ID NO: 100791 - DNA, 20 bp, Artificial Sequence
  chemically synthesized
taaatgctgggcccagccaa

SEQ ID NO: 100792 - DNA, 20 bp, Artificial Sequence
  chemically synthesized
ttatacccattggctgggcc

SEQ ID NO: 100793 - DNA, 20 bp, Artificial Sequence
  chemically synthesized
gccaatctaaatgctgggcc

SEQ ID NO: 100794 - DNA, 20 bp, Artificial Sequence
  chemically synthesized
cattggctgggcccagcatt

SEQ ID NO: 100795 - DNA, 20 bp, Artificial Sequence
  chemically synthesized
ttgctgccaatctaaatgct

SEQ ID NO: 100796 - DNA, 20 bp, Artificial Sequence
  chemically synthesized
cttgctgccaatctaaatgc

SEQ ID NO: 100797 - DNA, 20 bp, Artificial Sequence
  chemically synthesized
gctgggcccagcatttagat

SEQ ID NO: 100798 - DNA, 20 bp, Artificial Sequence
  chemically synthesized
gggcccagcatttagattgg

SEQ ID NO: 100799 - DNA, 20 bp, Artificial Sequence
  chemically synthesized
ccagcatttagattggcagc

SEQ ID NO: 100800 - DNA, 20 bp, Artificial Sequence
  chemically synthesized
ggtggagggagaggaggggt

SEQ ID NO: 100801 - DNA, 20 bp, Artificial Sequence
  chemically synthesized
aggaggtggagggagaggag

SEQ ID NO: 100802 - DNA, 20 bp, Artificial Sequence
  chemically synthesized
gaggaggtggagggagagga

SEQ ID NO: 100803 - DNA, 20 bp, Artificial Sequence
  chemically synthesized
tgaggaggtggagggagagg

SEQ ID NO: 100804 - DNA, 20 bp, Artificial Sequence
  chemically synthesized
ctgaggaggtggagggagag

SEQ ID NO: 100805 - DNA, 20 bp, Artificial Sequence
  chemically synthesized
ggctgaggaggtggagggag

SEQ ID NO: 100806 - DNA, 20 bp, Artificial Sequence
  chemically synthesized
aggctgaggaggtggaggga

SEQ ID NO: 100807 - DNA, 20 bp, Artificial Sequence
  chemically synthesized
gtaggctgaggaggtggagg

SEQ ID NO: 100808 - DNA, 20 bp, Artificial Sequence
  chemically synthesized
aagtaggctgaggaggtgga

SEQ ID NO: 100809 - DNA, 20 bp, Artificial Sequence
  chemically synthesized
taagtaggctgaggaggtgg

SEQ ID NO: 100810 - DNA, 20 bp, Artificial Sequence
  chemically synthesized
ttaagtaggctgaggaggtg

SEQ ID NO: 100811 - DNA, 20 bp, Artificial Sequence
  chemically synthesized
ctcctctccctccacctcct

SEQ ID NO: 100812 - DNA, 20 bp, Artificial Sequence
  chemically synthesized
cgttaagtaggctgaggagg

SEQ ID NO: 100813 - DNA, 20 bp, Artificial Sequence
  chemically synthesized
tcacgttaagtaggctgagg

SEQ ID NO: 100814 - DNA, 20 bp, Artificial Sequence
  chemically synthesized
ttcacgttaagtaggctgag

SEQ ID NO: 100815 - DNA, 20 bp, Artificial Sequence
  chemically synthesized
tcttcacgttaagtaggctg

SEQ ID NO: 100816 - DNA, 20 bp, Artificial Sequence
  chemically synthesized
atcttcacgttaagtaggct

SEQ ID NO: 100817 - DNA, 20 bp, Artificial Sequence
  chemically synthesized
tcattatcttcacgttaagt

SEQ ID NO: 100818 - DNA, 20 bp, Artificial Sequence
  chemically synthesized
ctcattatcttcacgttaag

SEQ ID NO: 100819 - DNA, 20 bp, Artificial Sequence
  chemically synthesized
tcctcagcctacttaacgtg

SEQ ID NO: 100820 - DNA, 20 bp, Artificial Sequence
  chemically synthesized
attctcattatcttcacgtt

SEQ ID NO: 100821 - DNA, 20 bp, Artificial Sequence
  chemically synthesized
ctacttaacgtgaagataat

SEQ ID NO: 100822 - DNA, 20 bp, Artificial Sequence
  chemically synthesized
acgtgaagataatgagaatg

SEQ ID NO: 100823 - DNA, 20 bp, Artificial Sequence
  chemically synthesized
gtggaagtggatcatcatat

SEQ ID NO: 100824 - DNA, 20 bp, Artificial Sequence
  chemically synthesized
agtggaagtggatcatcata

SEQ ID NO: 100825 - DNA, 20 bp, Artificial Sequence
  chemically synthesized
tactattaattaagtggaag

SEQ ID NO: 100826 - DNA, 20 bp, Artificial Sequence
  chemically synthesized
atttactattaattaagtgg

SEQ ID NO: 100827 - DNA, 20 bp, Artificial Sequence
  chemically synthesized
tatatttactattaattaag

SEQ ID NO: 100828 - DNA, 20 bp, Artificial Sequence
  chemically synthesized
atccacttccacttaattaa

SEQ ID NO: 100829 - DNA, 20 bp, Artificial Sequence
  chemically synthesized
aaatatatttactattaatt

SEQ ID NO: 100830 - DNA, 20 bp, Artificial Sequence
  chemically synthesized
actaagaaaatcataaggaa

SEQ ID NO: 100831 - DNA, 20 bp, Artificial Sequence
  chemically synthesized
ttactaagaaaatcataagg

SEQ ID NO: 100832 - DNA, 20 bp, Artificial Sequence
  chemically synthesized
atgttactaagaaaatcata

SEQ ID NO: 100833 - DNA, 20 bp, Artificial Sequence
  chemically synthesized
gatgttactaagaaaatcat

SEQ ID NO: 100834 - DNA, 20 bp, Artificial Sequence
  chemically synthesized
tctcttccttatgattttct

SEQ ID NO: 100835 - DNA, 20 bp, Artificial Sequence
  chemically synthesized
agagaaaatacgatgttact

SEQ ID NO: 100836 - DNA, 20 bp, Artificial Sequence
  chemically synthesized
tcttgcaataaagtaagtta

SEQ ID NO: 100837 - DNA, 20 bp, Artificial Sequence
  chemically synthesized
attcttgcaataaagtaagt

SEQ ID NO: 100838 - DNA, 20 bp, Artificial Sequence
  chemically synthesized
ctgtattcttgcaataaagt

SEQ ID NO: 100839 - DNA, 20 bp, Artificial Sequence
  chemically synthesized
tctctaacttactttattgc

SEQ ID NO: 100840 - DNA, 20 bp, Artificial Sequence
  chemically synthesized
tatactgtattcttgcaata

SEQ ID NO: 100841 - DNA, 20 bp, Artificial Sequence
  chemically synthesized
cttactttattgcaagaata

SEQ ID NO: 100842 - DNA, 20 bp, Artificial Sequence
  chemically synthesized
atattacatataacaatgca

SEQ ID NO: 100843 - DNA, 20 bp, Artificial Sequence
  chemically synthesized
ctgataacataaagagtgat

SEQ ID NO: 100844 - DNA, 20 bp, Artificial Sequence
  chemically synthesized
agccatactgataacataaa

SEQ ID NO: 100845 - DNA, 20 bp, Artificial Sequence
  chemically synthesized
gaagccatactgataacata

SEQ ID NO: 100846 - DNA, 20 bp, Artificial Sequence
  chemically synthesized
ctaatcactctttatgttat

SEQ ID NO: 100847 - DNA, 20 bp, Artificial Sequence
  chemically synthesized
cactctttatgttatcagta

SEQ ID NO: 100848 - DNA, 20 bp, Artificial Sequence
  chemically synthesized
atcagtatggcttctgtcaa

SEQ ID NO: 100849 - DNA, 20 bp, Artificial Sequence
  chemically synthesized
taataggctactgttgacag

SEQ ID NO: 100850 - DNA, 20 bp, Artificial Sequence
  chemically synthesized
agtatggcttctgtcaacag

SEQ ID NO: 100851 - DNA, 20 bp, Artificial Sequence
  chemically synthesized
tactaataggctactgttga

SEQ ID NO: 100852 - DNA, 20 bp, Artificial Sequence
  chemically synthesized
ttctgtcaacagtagcctat

SEQ ID NO: 100853 - DNA, 20 bp, Artificial Sequence
  chemically synthesized
tgtcaacagtagcctattag

SEQ ID NO: 100854 - DNA, 20 bp, Artificial Sequence
  chemically synthesized
cccaaaacgtaactactaat

SEQ ID NO: 100855 - DNA, 20 bp, Artificial Sequence
  chemically synthesized
ccccaaaacgtaactactaa

SEQ ID NO: 100856 - DNA, 20 bp, Artificial Sequence
  chemically synthesized
gcctattagtagttacgttt

SEQ ID NO: 100857 - DNA, 20 bp, Artificial Sequence
  chemically synthesized
cctattagtagttacgtttt

SEQ ID NO: 100858 - DNA, 20 bp, Artificial Sequence
  chemically synthesized
ctattagtagttacgttttg

SEQ ID NO: 100859 - DNA, 20 bp, Artificial Sequence
  chemically synthesized
tattagtagttacgttttgg

SEQ ID NO: 100860 - DNA, 20 bp, Artificial Sequence
  chemically synthesized
ttagtagttacgttttgggg

SEQ ID NO: 100861 - DNA, 20 bp, Artificial Sequence
  chemically synthesized
ttacgttttgggggagtgaa

SEQ ID NO: 100862 - DNA, 20 bp, Artificial Sequence
  chemically synthesized
ggggagtgaaaagttctact

SEQ ID NO: 100863 - DNA, 20 bp, Artificial Sequence
  chemically synthesized
aacacattgaaaaatctaag

SEQ ID NO: 100864 - DNA, 20 bp, Artificial Sequence
  chemically synthesized
cccaacacattgaaaaatct

SEQ ID NO: 100865 - DNA, 20 bp, Artificial Sequence
  chemically synthesized
acttagatttttcaatgtgt

SEQ ID NO: 100866 - DNA, 20 bp, Artificial Sequence
  chemically synthesized
cttagatttttcaatgtgtt

SEQ ID NO: 100867 - DNA, 20 bp, Artificial Sequence
  chemically synthesized
atttttcaatgtgttgggct

SEQ ID NO: 100868 - DNA, 20 bp, Artificial Sequence
  chemically synthesized
atgtgagggttaggggcgct

SEQ ID NO: 100869 - DNA, 20 bp, Artificial Sequence
  chemically synthesized
tcaaacaatgtgagggttag

SEQ ID NO: 100870 - DNA, 20 bp, Artificial Sequence
  chemically synthesized
ctcaaacaatgtgagggtta

SEQ ID NO: 100871 - DNA, 20 bp, Artificial Sequence
  chemically synthesized
cctcaaacaatgtgagggtt

SEQ ID NO: 100872 - DNA, 20 bp, Artificial Sequence
  chemically synthesized
ccctcaaacaatgtgagggt

SEQ ID NO: 100873 - DNA, 20 bp, Artificial Sequence
  chemically synthesized
ttgaccctcaaacaatgtga

SEQ ID NO: 100874 - DNA, 20 bp, Artificial Sequence
  chemically synthesized
gttgaccctcaaacaatgtg

SEQ ID NO: 100875 - DNA, 20 bp, Artificial Sequence
  chemically synthesized
agttgaccctcaaacaatgt

SEQ ID NO: 100876 - DNA, 20 bp, Artificial Sequence
  chemically synthesized
ccctaaccctcacattgttt

SEQ ID NO: 100877 - DNA, 20 bp, Artificial Sequence
  chemically synthesized
cctaaccctcacattgtttg

SEQ ID NO: 100878 - DNA, 20 bp, Artificial Sequence
  chemically synthesized
ctaaccctcacattgtttga

SEQ ID NO: 100879 - DNA, 20 bp, Artificial Sequence
  chemically synthesized
agcctttggaaagtgttata

SEQ ID NO: 100880 - DNA, 20 bp, Artificial Sequence
  chemically synthesized
caactgtataacactttcca

SEQ ID NO: 100881 - DNA, 20 bp, Artificial Sequence
  chemically synthesized
aactgtataacactttccaa

SEQ ID NO: 100882 - DNA, 20 bp, Artificial Sequence
  chemically synthesized
gggcaaagggagcctttgga

SEQ ID NO: 100883 - DNA, 20 bp, Artificial Sequence
  chemically synthesized
aacagggcaaagggagcctt

SEQ ID NO: 100884 - DNA, 20 bp, Artificial Sequence
  chemically synthesized
gtctaagaacagggcaaagg

SEQ ID NO: 100885 - DNA, 20 bp, Artificial Sequence
  chemically synthesized
gtgtctaagaacagggcaaa

SEQ ID NO: 100886 - DNA, 20 bp, Artificial Sequence
  chemically synthesized
cgtgtctaagaacagggcaa

SEQ ID NO: 100887 - DNA, 20 bp, Artificial Sequence
  chemically synthesized
ccgtgtctaagaacagggca

SEQ ID NO: 100888 - DNA, 20 bp, Artificial Sequence
  chemically synthesized
ggctccctttgccctgttct

SEQ ID NO: 100889 - DNA, 20 bp, Artificial Sequence
  chemically synthesized
ctgggccgtgtctaagaaca

SEQ ID NO: 100890 - DNA, 20 bp, Artificial Sequence
  chemically synthesized
gctgggccgtgtctaagaac

SEQ ID NO: 100891 - DNA, 20 bp, Artificial Sequence
  chemically synthesized
tgctgggccgtgtctaagaa

SEQ ID NO: 100892 - DNA, 20 bp, Artificial Sequence
  chemically synthesized
ctttgccctgttcttagaca

SEQ ID NO: 100893 - DNA, 20 bp, Artificial Sequence
  chemically synthesized
attcatgctgggccgtgtct

SEQ ID NO: 100894 - DNA, 20 bp, Artificial Sequence
  chemically synthesized
ccctgttcttagacacggcc

SEQ ID NO: 100895 - DNA, 20 bp, Artificial Sequence
  chemically synthesized
gattgccacaaattcatgct

SEQ ID NO: 100896 - DNA, 20 bp, Artificial Sequence
  chemically synthesized
agattgccacaaattcatgc

SEQ ID NO: 100897 - DNA, 20 bp, Artificial Sequence
  chemically synthesized
cacggcccagcatgaatttg

SEQ ID NO: 100898 - DNA, 20 bp, Artificial Sequence
  chemically synthesized
atttgtggcaatcttgtaat

SEQ ID NO: 100899 - DNA, 20 bp, Artificial Sequence
  chemically synthesized
gacagtatgtggctcattac

SEQ ID NO: 100900 - DNA, 20 bp, Artificial Sequence
  chemically synthesized
ccaacttgttagacagtatg

SEQ ID NO: 100901 - DNA, 20 bp, Artificial Sequence
  chemically synthesized
tgagccacatactgtctaac

SEQ ID NO: 100902 - DNA, 20 bp, Artificial Sequence
  chemically synthesized
ttagcatccaacttgttaga

SEQ ID NO: 100903 - DNA, 20 bp, Artificial Sequence
  chemically synthesized
ccacatactgtctaacaagt

SEQ ID NO: 100904 - DNA, 20 bp, Artificial Sequence
  chemically synthesized
ataattagcatccaacttgt

SEQ ID NO: 100905 - DNA, 20 bp, Artificial Sequence
  chemically synthesized
tttcaaaagttttgtataat

SEQ ID NO: 100906 - DNA, 20 bp, Artificial Sequence
  chemically synthesized
ttatacaaaacttttgaaaa

SEQ ID NO: 100907 - DNA, 20 bp, Artificial Sequence
  chemically synthesized
actttgatcccttttttcaa

SEQ ID NO: 100908 - DNA, 20 bp, Artificial Sequence
  chemically synthesized
tatacaaaacttttgaaaaa

SEQ ID NO: 100909 - DNA, 20 bp, Artificial Sequence
  chemically synthesized
atacaaaacttttgaaaaaa

SEQ ID NO: 100910 - DNA, 20 bp, Artificial Sequence
  chemically synthesized
acttttgaaaaaagggatca

SEQ ID NO: 100911 - DNA, 20 bp, Artificial Sequence
  chemically synthesized
gatcaaagttcctacttcac

SEQ ID NO: 100912 - DNA, 20 bp, Artificial Sequence
  chemically synthesized
gctgttcaagcttgtgaagt

SEQ ID NO: 100913 - DNA, 20 bp, Artificial Sequence
  chemically synthesized
agctgttcaagcttgtgaag

SEQ ID NO: 100914 - DNA, 20 bp, Artificial Sequence
  chemically synthesized
tacagctgttcaagcttgtg

SEQ ID NO: 100915 - DNA, 20 bp, Artificial Sequence
  chemically synthesized
tcctacttcacaagcttgaa

SEQ ID NO: 100916 - DNA, 20 bp, Artificial Sequence
  chemically synthesized
tcctgaggctacagctgttc

SEQ ID NO: 100917 - DNA, 20 bp, Artificial Sequence
  chemically synthesized
ttcacaagcttgaacagctg

SEQ ID NO: 100918 - DNA, 20 bp, Artificial Sequence
  chemically synthesized
agcttgaacagctgtagcct

SEQ ID NO: 100919 - DNA, 20 bp, Artificial Sequence
  chemically synthesized
gcttgaacagctgtagcctc

SEQ ID NO: 100920 - DNA, 20 bp, Artificial Sequence
  chemically synthesized
ggagaaagttcctgaggcta

SEQ ID NO: 100921 - DNA, 20 bp, Artificial Sequence
  chemically synthesized
caatctggagaaagttcctg

SEQ ID NO: 100922 - DNA, 20 bp, Artificial Sequence
  chemically synthesized
tcaatctggagaaagttcct

SEQ ID NO: 100923 - DNA, 20 bp, Artificial Sequence
  chemically synthesized
gtagcctcaggaactttctc

SEQ ID NO: 100924 - DNA, 20 bp, Artificial Sequence
  chemically synthesized
ttttgccctcaatctggaga

SEQ ID NO: 100925 - DNA, 20 bp, Artificial Sequence
  chemically synthesized
tcaggaactttctccagatt

SEQ ID NO: 100926 - DNA, 20 bp, Artificial Sequence
  chemically synthesized
caggaactttctccagattg

SEQ ID NO: 100927 - DNA, 20 bp, Artificial Sequence
  chemically synthesized
ggatttttgccctcaatctg

SEQ ID NO: 100928 - DNA, 20 bp, Artificial Sequence
  chemically synthesized
aggaactttctccagattga

SEQ ID NO: 100929 - DNA, 20 bp, Artificial Sequence
  chemically synthesized
taggatttttgccctcaatc

SEQ ID NO: 100930 - DNA, 20 bp, Artificial Sequence
  chemically synthesized
gagggcaaaaatcctatctc

SEQ ID NO: 100931 - DNA, 20 bp, Artificial Sequence
  chemically synthesized
agggcaaaaatcctatctcc

SEQ ID NO: 100932 - DNA, 20 bp, Artificial Sequence
  chemically synthesized
aaatttggcttcctggagat

SEQ ID NO: 100933 - DNA, 20 bp, Artificial Sequence
  chemically synthesized
caaatttggcttcctggaga

SEQ ID NO: 100934 - DNA, 20 bp, Artificial Sequence
  chemically synthesized
gcaaaaatcctatctccagg

SEQ ID NO: 100935 - DNA, 20 bp, Artificial Sequence
  chemically synthesized
gctgcaaatttggcttcctg

SEQ ID NO: 100936 - DNA, 20 bp, Artificial Sequence
  chemically synthesized
cagctgcaaatttggcttcc

SEQ ID NO: 100937 - DNA, 20 bp, Artificial Sequence
  chemically synthesized
tctccaggaagccaaatttg

SEQ ID NO: 100938 - DNA, 20 bp, Artificial Sequence
  chemically synthesized
gagtgtggcagctgcaaatt

SEQ ID NO: 100939 - DNA, 20 bp, Artificial Sequence
  chemically synthesized
gggattttgggagagtgtgg

SEQ ID NO: 100940 - DNA, 20 bp, Artificial Sequence
  chemically synthesized
actgggattttgggagagtg

SEQ ID NO: 100941 - DNA, 20 bp, Artificial Sequence
  chemically synthesized
ggtgaactgggattttggga

SEQ ID NO: 100942 - DNA, 20 bp, Artificial Sequence
  chemically synthesized
gaggtgaactgggattttgg

SEQ ID NO: 100943 - DNA, 20 bp, Artificial Sequence
  chemically synthesized
gccacactctcccaaaatcc

SEQ ID NO: 100944 - DNA, 20 bp, Artificial Sequence
  chemically synthesized
ctgaggtgaactgggatttt

SEQ ID NO: 100945 - DNA, 20 bp, Artificial Sequence
  chemically synthesized
cctgaggtgaactgggattt

SEQ ID NO: 100946 - DNA, 20 bp, Artificial Sequence
  chemically synthesized
atcagtccctgaggtgaact

SEQ ID NO: 100947 - DNA, 20 bp, Artificial Sequence
  chemically synthesized
catcagtccctgaggtgaac

SEQ ID NO: 100948 - DNA, 20 bp, Artificial Sequence
  chemically synthesized
cccaaaatcccagttcacct

SEQ ID NO: 100949 - DNA, 20 bp, Artificial Sequence
  chemically synthesized
ccaaaatcccagttcacctc

SEQ ID NO: 100950 - DNA, 20 bp, Artificial Sequence
  chemically synthesized
caaaatcccagttcacctca

SEQ ID NO: 100951 - DNA, 20 bp, Artificial Sequence
  chemically synthesized
tgactccccatcagtccctg

SEQ ID NO: 100952 - DNA, 20 bp, Artificial Sequence
  chemically synthesized
ctgactccccatcagtccct

SEQ ID NO: 100953 - DNA, 20 bp, Artificial Sequence
  chemically synthesized
cagttcacctcagggactga

SEQ ID NO: 100954 - DNA, 20 bp, Artificial Sequence
  chemically synthesized
agttcacctcagggactgat

SEQ ID NO: 100955 - DNA, 20 bp, Artificial Sequence
  chemically synthesized
gttcacctcagggactgatg

SEQ ID NO: 100956 - DNA, 20 bp, Artificial Sequence
  chemically synthesized
tcacctcagggactgatggg

SEQ ID NO: 100957 - DNA, 20 bp, Artificial Sequence
  chemically synthesized
tatgatgactgactccccat

SEQ ID NO: 100958 - DNA, 20 bp, Artificial Sequence
  chemically synthesized
ctcagggactgatggggagt

SEQ ID NO: 100959 - DNA, 20 bp, Artificial Sequence
  chemically synthesized
tttcagcccaaaggggaagg

SEQ ID NO: 100960 - DNA, 20 bp, Artificial Sequence
  chemically synthesized
catcatacttccttcccctt

SEQ ID NO: 100961 - DNA, 20 bp, Artificial Sequence
  chemically synthesized
cagtttcagcccaaagggga

SEQ ID NO: 100962 - DNA, 20 bp, Artificial Sequence
  chemically synthesized
atcatacttccttccccttt

SEQ ID NO: 100963 - DNA, 20 bp, Artificial Sequence
  chemically synthesized
tcagtttcagcccaaagggg

SEQ ID NO: 100964 - DNA, 20 bp, Artificial Sequence
  chemically synthesized
ttttcagtttcagcccaaag

SEQ ID NO: 100965 - DNA, 20 bp, Artificial Sequence
  chemically synthesized
tttttcagtttcagcccaaa

SEQ ID NO: 100966 - DNA, 20 bp, Artificial Sequence
  chemically synthesized
ctttttcagtttcagcccaa

SEQ ID NO: 100967 - DNA, 20 bp, Artificial Sequence
  chemically synthesized
gctttttcagtttcagccca

SEQ ID NO: 100968 - DNA, 20 bp, Artificial Sequence
  chemically synthesized
gttttttgctttttcagttt

SEQ ID NO: 100969 - DNA, 20 bp, Artificial Sequence
  chemically synthesized
cctttgggctgaaactgaaa

SEQ ID NO: 100970 - DNA, 20 bp, Artificial Sequence
  chemically synthesized
caccccgttttttgcttttt

SEQ ID NO: 100971 - DNA, 20 bp, Artificial Sequence
  chemically synthesized
gaaactgaaaaagcaaaaaa

SEQ ID NO: 100972 - DNA, 20 bp, Artificial Sequence
  chemically synthesized
aaactgaaaaagcaaaaaac

SEQ ID NO: 100973 - DNA, 20 bp, Artificial Sequence
  chemically synthesized
aactgaaaaagcaaaaaacg

SEQ ID NO: 100974 - DNA, 20 bp, Artificial Sequence
  chemically synthesized
tgaaaaagcaaaaaacgggg

SEQ ID NO: 100975 - DNA, 20 bp, Artificial Sequence
  chemically synthesized
gaaaaagcaaaaaacggggt

SEQ ID NO: 100976 - DNA, 20 bp, Artificial Sequence
  chemically synthesized
aaaagcaaaaaacggggtgg

SEQ ID NO: 100977 - DNA, 20 bp, Artificial Sequence
  chemically synthesized
aaagcaaaaaacggggtggg

SEQ ID NO: 100978 - DNA, 20 bp, Artificial Sequence
  chemically synthesized
aagcaaaaaacggggtggga

SEQ ID NO: 100979 - DNA, 20 bp, Artificial Sequence
  chemically synthesized
caaaaaacggggtgggaggg

SEQ ID NO: 100980 - DNA, 20 bp, Artificial Sequence
  chemically synthesized
aaacggggtgggagggtaga

SEQ ID NO: 100981 - DNA, 20 bp, Artificial Sequence
  chemically synthesized
gggtgggagggtagaaagaa

SEQ ID NO: 100982 - DNA, 20 bp, Artificial Sequence
  chemically synthesized
ggtgggagggtagaaagaac

SEQ ID NO: 100983 - DNA, 20 bp, Artificial Sequence
  chemically synthesized
gggagggtagaaagaacagg

SEQ ID NO: 100984 - DNA, 20 bp, Artificial Sequence
  chemically synthesized
ggagggtagaaagaacagga

SEQ ID NO: 100985 - DNA, 20 bp, Artificial Sequence
  chemically synthesized
gagggtagaaagaacaggaa

SEQ ID NO: 100986 - DNA, 20 bp, Artificial Sequence
  chemically synthesized
gggtagaaagaacaggaagg

SEQ ID NO: 100987 - DNA, 20 bp, Artificial Sequence
  chemically synthesized
ggtagaaagaacaggaaggg

SEQ ID NO: 100988 - DNA, 20 bp, Artificial Sequence
  chemically synthesized
aagggaggtatcctgttcat

SEQ ID NO: 100989 - DNA, 20 bp, Artificial Sequence
  chemically synthesized
ttaggacctctccaatgaac

SEQ ID NO: 100990 - DNA, 20 bp, Artificial Sequence
  chemically synthesized
gggaggtatcctgttcattg

SEQ ID NO: 100991 - DNA, 20 bp, Artificial Sequence
  chemically synthesized
cttaggacctctccaatgaa

SEQ ID NO: 100992 - DNA, 20 bp, Artificial Sequence
  chemically synthesized
gaggtatcctgttcattgga

SEQ ID NO: 100993 - DNA, 20 bp, Artificial Sequence
  chemically synthesized
aggtatcctgttcattggag

SEQ ID NO: 100994 - DNA, 20 bp, Artificial Sequence
  chemically synthesized
ctgttcattggagaggtcct

SEQ ID NO: 100995 - DNA, 20 bp, Artificial Sequence
  chemically synthesized
tgttcattggagaggtccta

SEQ ID NO: 100996 - DNA, 20 bp, Artificial Sequence
  chemically synthesized
cactccagccaggtttcctt

SEQ ID NO: 100997 - DNA, 20 bp, Artificial Sequence
  chemically synthesized
tcactccagccaggtttcct

SEQ ID NO: 100998 - DNA, 20 bp, Artificial Sequence
  chemically synthesized
ggagaggtcctaaggaaacc

SEQ ID NO: 100999 - DNA, 20 bp, Artificial Sequence
  chemically synthesized
aggtcctaaggaaacctggc

SEQ ID NO: 101000 - DNA, 20 bp, Artificial Sequence
  chemically synthesized
gtcctaaggaaacctggctg

SEQ ID NO: 101001 - DNA, 20 bp, Artificial Sequence
  chemically synthesized
agcagattttcactccagcc

SEQ ID NO: 101002 - DNA, 20 bp, Artificial Sequence
  chemically synthesized
cagcagattttcactccagc

SEQ ID NO: 101003 - DNA, 20 bp, Artificial Sequence
  chemically synthesized
ggcacagcagattttcactc

SEQ ID NO: 101004 - DNA, 20 bp, Artificial Sequence
  chemically synthesized
gggtggtgcttaaggcacag

SEQ ID NO: 101005 - DNA, 20 bp, Artificial Sequence
  chemically synthesized
gtgaaaatctgctgtgcctt

SEQ ID NO: 101006 - DNA, 20 bp, Artificial Sequence
  chemically synthesized
gaagggtggtgcttaaggca

SEQ ID NO: 101007 - DNA, 20 bp, Artificial Sequence
  chemically synthesized
ggatggaagggtggtgctta

SEQ ID NO: 101008 - DNA, 20 bp, Artificial Sequence
  chemically synthesized
gggatggaagggtggtgctt

SEQ ID NO: 101009 - DNA, 20 bp, Artificial Sequence
  chemically synthesized
ttggcctggggatggaaggg

SEQ ID NO: 101010 - DNA, 20 bp, Artificial Sequence
  chemically synthesized
gtattggcctggggatggaa

SEQ ID NO: 101011 - DNA, 20 bp, Artificial Sequence
  chemically synthesized
tgtattggcctggggatgga

SEQ ID NO: 101012 - DNA, 20 bp, Artificial Sequence
  chemically synthesized
aagcaccacccttccatccc

SEQ ID NO: 101013 - DNA, 20 bp, Artificial Sequence
  chemically synthesized
gtgtattggcctggggatgg

SEQ ID NO: 101014 - DNA, 20 bp, Artificial Sequence
  chemically synthesized
agcaccacccttccatcccc

SEQ ID NO: 101015 - DNA, 20 bp, Artificial Sequence
  chemically synthesized
gatgtgtattggcctgggga

SEQ ID NO: 101016 - DNA, 20 bp, Artificial Sequence
  chemically synthesized
atatgatgtgtattggcctg

SEQ ID NO: 101017 - DNA, 20 bp, Artificial Sequence
  chemically synthesized
aatatgatgtgtattggcct

SEQ ID NO: 101018 - DNA, 20 bp, Artificial Sequence
  chemically synthesized
taatatgatgtgtattggcc

SEQ ID NO: 101019 - DNA, 20 bp, Artificial Sequence
  chemically synthesized
cagagtaatatgatgtgtat

SEQ ID NO: 101020 - DNA, 20 bp, Artificial Sequence
  chemically synthesized
actgttgaaggaggacaaca

SEQ ID NO: 101021 - DNA, 20 bp, Artificial Sequence
  chemically synthesized
gcactgttgaaggaggacaa

SEQ ID NO: 101022 - DNA, 20 bp, Artificial Sequence
  chemically synthesized
actctgttgtcctccttcaa

SEQ ID NO: 101023 - DNA, 20 bp, Artificial Sequence
  chemically synthesized
gtaactagcactgttgaagg

SEQ ID NO: 101024 - DNA, 20 bp, Artificial Sequence
  chemically synthesized
tgtaactagcactgttgaag

SEQ ID NO: 101025 - DNA, 20 bp, Artificial Sequence
  chemically synthesized
tctgtaactagcactgttga

SEQ ID NO: 101026 - DNA, 20 bp, Artificial Sequence
  chemically synthesized
gtctgtaactagcactgttg

SEQ ID NO: 101027 - DNA, 20 bp, Artificial Sequence
  chemically synthesized
ttgtcctccttcaacagtgc

SEQ ID NO: 101028 - DNA, 20 bp, Artificial Sequence
  chemically synthesized
tccttcaacagtgctagtta

SEQ ID NO: 101029 - DNA, 20 bp, Artificial Sequence
  chemically synthesized
ggtaaacttgagtctgtaac

SEQ ID NO: 101030 - DNA, 20 bp, Artificial Sequence
  chemically synthesized
acagtgctagttacagactc

SEQ ID NO: 101031 - DNA, 20 bp, Artificial Sequence
  chemically synthesized
tatatactaatggtaaactt

SEQ ID NO: 101032 - DNA, 20 bp, Artificial Sequence
  chemically synthesized
tacagactcaagtttaccat

SEQ ID NO: 101033 - DNA, 20 bp, Artificial Sequence
  chemically synthesized
ttatagctattatatactaa

SEQ ID NO: 101034 - DNA, 20 bp, Artificial Sequence
  chemically synthesized
agtttaccattagtatataa

SEQ ID NO: 101035 - DNA, 20 bp, Artificial Sequence
  chemically synthesized
cattttaaggacaagtgtta

SEQ ID NO: 101036 - DNA, 20 bp, Artificial Sequence
  chemically synthesized
ttaacccgcattttaaggac

SEQ ID NO: 101037 - DNA, 20 bp, Artificial Sequence
  chemically synthesized
taacacttgtccttaaaatg

SEQ ID NO: 101038 - DNA, 20 bp, Artificial Sequence
  chemically synthesized
ttgagttaacccgcatttta

SEQ ID NO: 101039 - DNA, 20 bp, Artificial Sequence
  chemically synthesized
aacacttgtccttaaaatgc

SEQ ID NO: 101040 - DNA, 20 bp, Artificial Sequence
  chemically synthesized
attgagttaacccgcatttt

SEQ ID NO: 101041 - DNA, 20 bp, Artificial Sequence
  chemically synthesized
gattgatgcccagcagcatt

SEQ ID NO: 101042 - DNA, 20 bp, Artificial Sequence
  chemically synthesized
gcgggttaactcaatgctgc

SEQ ID NO: 101043 - DNA, 20 bp, Artificial Sequence
  chemically synthesized
cgggttaactcaatgctgct

SEQ ID NO: 101044 - DNA, 20 bp, Artificial Sequence
  chemically synthesized
atatttagattgatgcccag

SEQ ID NO: 101045 - DNA, 20 bp, Artificial Sequence
  chemically synthesized
aatatatttagattgatgcc

SEQ ID NO: 101046 - DNA, 20 bp, Artificial Sequence
  chemically synthesized
agtgcctaccttaatatatt

SEQ ID NO: 101047 - DNA, 20 bp, Artificial Sequence
  chemically synthesized
ggcatcaatctaaatatatt

SEQ ID NO: 101048 - DNA, 20 bp, Artificial Sequence
  chemically synthesized
gcatcaatctaaatatatta

SEQ ID NO: 101049 - DNA, 20 bp, Artificial Sequence
  chemically synthesized
tcaatctaaatatattaagg

SEQ ID NO: 101050 - DNA, 20 bp, Artificial Sequence
  chemically synthesized
caatctaaatatattaaggt

SEQ ID NO: 101051 - DNA, 20 bp, Artificial Sequence
  chemically synthesized
ttattagagttgtagtacag

SEQ ID NO: 101052 - DNA, 20 bp, Artificial Sequence
  chemically synthesized
ttattattagagttgtagta

SEQ ID NO: 101053 - DNA, 20 bp, Artificial Sequence
  chemically synthesized
gattattattattagagttg

SEQ ID NO: 101054 - DNA, 20 bp, Artificial Sequence
  chemically synthesized
gttattgattattattatta

SEQ ID NO: 101055 - DNA, 20 bp, Artificial Sequence
  chemically synthesized
tagttattgattattattat

SEQ ID NO: 101056 - DNA, 20 bp, Artificial Sequence
  chemically synthesized
tgtggccattcaataaatga

SEQ ID NO: 101057 - DNA, 20 bp, Artificial Sequence
  chemically synthesized
aataactatcatttattgaa

SEQ ID NO: 101058 - DNA, 20 bp, Artificial Sequence
  chemically synthesized
tcatttattgaatggccaca

SEQ ID NO: 101059 - DNA, 20 bp, Artificial Sequence
  chemically synthesized
tttattgaatggccacatgg

SEQ ID NO: 101060 - DNA, 20 bp, Artificial Sequence
  chemically synthesized
ttattgaatggccacatggc

SEQ ID NO: 101061 - DNA, 20 bp, Artificial Sequence
  chemically synthesized
taagcatagtacctgccatg

SEQ ID NO: 101062 - DNA, 20 bp, Artificial Sequence
  chemically synthesized
atggcaggtactatgcttat

SEQ ID NO: 101063 - DNA, 20 bp, Artificial Sequence
  chemically synthesized
cagggaagccctgataagca

SEQ ID NO: 101064 - DNA, 20 bp, Artificial Sequence
  chemically synthesized
tggcaggtactatgcttatc

SEQ ID NO: 101065 - DNA, 20 bp, Artificial Sequence
  chemically synthesized
ggcaggtactatgcttatca

SEQ ID NO: 101066 - DNA, 20 bp, Artificial Sequence
  chemically synthesized
gcagacagggaagccctgat

SEQ ID NO: 101067 - DNA, 20 bp, Artificial Sequence
  chemically synthesized
catgggctgagcagacaggg

SEQ ID NO: 101068 - DNA, 20 bp, Artificial Sequence
  chemically synthesized
aaacatgggctgagcagaca

SEQ ID NO: 101069 - DNA, 20 bp, Artificial Sequence
  chemically synthesized
tcagggcttccctgtctgct

SEQ ID NO: 101070 - DNA, 20 bp, Artificial Sequence
  chemically synthesized
gaaacatgggctgagcagac

SEQ ID NO: 101071 - DNA, 20 bp, Artificial Sequence
  chemically synthesized
agaaacatgggctgagcaga

SEQ ID NO: 101072 - DNA, 20 bp, Artificial Sequence
  chemically synthesized
acaaagaaacatgggctgag

SEQ ID NO: 101073 - DNA, 20 bp, Artificial Sequence
  chemically synthesized
tttacaaagaaacatgggct

SEQ ID NO: 101074 - DNA, 20 bp, Artificial Sequence
  chemically synthesized
tgtgttttacaaagaaacat

SEQ ID NO: 101075 - DNA, 20 bp, Artificial Sequence
  chemically synthesized
ttgtgttttacaaagaaaca

SEQ ID NO: 101076 - DNA, 20 bp, Artificial Sequence
  chemically synthesized
ttaatatgttgtgttttaca

SEQ ID NO: 101077 - DNA, 20 bp, Artificial Sequence
  chemically synthesized
aacacaacatattaaaacaa

SEQ ID NO: 101078 - DNA, 20 bp, Artificial Sequence
  chemically synthesized
catattaaaacaacagtatt

SEQ ID NO: 101079 - DNA, 20 bp, Artificial Sequence
  chemically synthesized
tattaaaacaacagtatttg

SEQ ID NO: 101080 - DNA, 20 bp, Artificial Sequence
  chemically synthesized
attatgaggtggttggattg

SEQ ID NO: 101081 - DNA, 20 bp, Artificial Sequence
  chemically synthesized
tggttttattatgaggtggt

SEQ ID NO: 101082 - DNA, 20 bp, Artificial Sequence
  chemically synthesized
atgttggttttattatgagg

SEQ ID NO: 101083 - DNA, 20 bp, Artificial Sequence
  chemically synthesized
aatatgttggttttattatg

SEQ ID NO: 101084 - DNA, 20 bp, Artificial Sequence
  chemically synthesized
gaatatgttggttttattat

SEQ ID NO: 101085 - DNA, 20 bp, Artificial Sequence
  chemically synthesized
cataataaaaccaacatatt

SEQ ID NO: 101086 - DNA, 20 bp, Artificial Sequence
  chemically synthesized
atatagaaaactgaatatgt

SEQ ID NO: 101087 - DNA, 20 bp, Artificial Sequence
  chemically synthesized
acaaggacgataagataata

SEQ ID NO: 101088 - DNA, 20 bp, Artificial Sequence
  chemically synthesized
tgtatatggacaaggacgat

SEQ ID NO: 101089 - DNA, 20 bp, Artificial Sequence
  chemically synthesized
attgaatatgtatatggaca

SEQ ID NO: 101090 - DNA, 20 bp, Artificial Sequence
  chemically synthesized
cattgaatatgtatatggac

SEQ ID NO: 101091 - DNA, 20 bp, Artificial Sequence
  chemically synthesized
ataaccattgaatatgtata

SEQ ID NO: 101092 - DNA, 20 bp, Artificial Sequence
  chemically synthesized
ttgtccatatacatattcaa

SEQ ID NO: 101093 - DNA, 20 bp, Artificial Sequence
  chemically synthesized
attcaatggttatatatttg

SEQ ID NO: 101094 - DNA, 20 bp, Artificial Sequence
  chemically synthesized
tttcacaaaaagtgaaaagg

SEQ ID NO: 101095 - DNA, 20 bp, Artificial Sequence
  chemically synthesized
aagtttcacaaaaagtgaaa

SEQ ID NO: 101096 - DNA, 20 bp, Artificial Sequence
  chemically synthesized
caagtttcacaaaaagtgaa

SEQ ID NO: 101097 - DNA, 20 bp, Artificial Sequence
  chemically synthesized
aatgtatcaagtttcacaaa

SEQ ID NO: 101098 - DNA, 20 bp, Artificial Sequence
  chemically synthesized
agaggaacaaataatgtatc

SEQ ID NO: 101099 - DNA, 20 bp, Artificial Sequence
  chemically synthesized
ttttcaaaggagaatgaaag

SEQ ID NO: 101100 - DNA, 20 bp, Artificial Sequence
  chemically synthesized
attttcaaaggagaatgaaa

SEQ ID NO: 101101 - DNA, 20 bp, Artificial Sequence
  chemically synthesized
ggattttcaaaggagaatga

SEQ ID NO: 101102 - DNA, 20 bp, Artificial Sequence
  chemically synthesized
gttaccttggattttcaaag

SEQ ID NO: 101103 - DNA, 20 bp, Artificial Sequence
  chemically synthesized
ttgttaccttggattttcaa

SEQ ID NO: 101104 - DNA, 20 bp, Artificial Sequence
  chemically synthesized
tttgttaccttggattttca

SEQ ID NO: 101105 - DNA, 20 bp, Artificial Sequence
  chemically synthesized
tcattctcctttgaaaatcc

SEQ ID NO: 101106 - DNA, 20 bp, Artificial Sequence
  chemically synthesized
cattctcctttgaaaatcca

SEQ ID NO: 101107 - DNA, 20 bp, Artificial Sequence
  chemically synthesized
gttatcagtatttgttacct

SEQ ID NO: 101108 - DNA, 20 bp, Artificial Sequence
  chemically synthesized
ggtaacaaatactgataacc

SEQ ID NO: 101109 - DNA, 20 bp, Artificial Sequence
  chemically synthesized
agagatatatactaggttat

SEQ ID NO: 101110 - DNA, 20 bp, Artificial Sequence
  chemically synthesized
ggaatggagagatatatact

SEQ ID NO: 101111 - DNA, 20 bp, Artificial Sequence
  chemically synthesized
aggaatggagagatatatac

SEQ ID NO: 101112 - DNA, 20 bp, Artificial Sequence
  chemically synthesized
aaccatgaaggaggaatgga

SEQ ID NO: 101113 - DNA, 20 bp, Artificial Sequence
  chemically synthesized
ataaccatgaaggaggaatg

SEQ ID NO: 101114 - DNA, 20 bp, Artificial Sequence
  chemically synthesized
acataaccatgaaggaggaa

SEQ ID NO: 101115 - DNA, 20 bp, Artificial Sequence
  chemically synthesized
atctctccattcctccttca

SEQ ID NO: 101116 - DNA, 20 bp, Artificial Sequence
  chemically synthesized
ggattacataaccatgaagg

SEQ ID NO: 101117 - DNA, 20 bp, Artificial Sequence
  chemically synthesized
gggattacataaccatgaag

SEQ ID NO: 101118 - DNA, 20 bp, Artificial Sequence
  chemically synthesized
atgggattacataaccatga

SEQ ID NO: 101119 - DNA, 20 bp, Artificial Sequence
  chemically synthesized
tatgggattacataaccatg

SEQ ID NO: 101120 - DNA, 20 bp, Artificial Sequence
  chemically synthesized
tcatggttatgtaatcccat

SEQ ID NO: 101121 - DNA, 20 bp, Artificial Sequence
  chemically synthesized
aaagataaaattaatcttat

SEQ ID NO: 101122 - DNA, 20 bp, Artificial Sequence
  chemically synthesized
aaaagataaaattaatctta

SEQ ID NO: 101123 - DNA, 20 bp, Artificial Sequence
  chemically synthesized
attccatttttaaaataaaa

SEQ ID NO: 101124 - DNA, 20 bp, Artificial Sequence
  chemically synthesized
tatcttttttattttaaaaa

SEQ ID NO: 101125 - DNA, 20 bp, Artificial Sequence
  chemically synthesized
tatctttcaaaaatcaaaac

SEQ ID NO: 101126 - DNA, 20 bp, Artificial Sequence
  chemically synthesized
aaacttgttttgatttttga

SEQ ID NO: 101127 - DNA, 20 bp, Artificial Sequence
  chemically synthesized
agatatcatcaccattcttt

SEQ ID NO: 101128 - DNA, 20 bp, Artificial Sequence
  chemically synthesized
gatatcatcaccattctttc

SEQ ID NO: 101129 - DNA, 20 bp, Artificial Sequence
  chemically synthesized
tgtctactgtcctgaaagaa

SEQ ID NO: 101130 - DNA, 20 bp, Artificial Sequence
  chemically synthesized
tcatcaccattctttcagga

SEQ ID NO: 101131 - DNA, 20 bp, Artificial Sequence
  chemically synthesized
agctgtgtctactgtcctga

SEQ ID NO: 101132 - DNA, 20 bp, Artificial Sequence
  chemically synthesized
tcaccattctttcaggacag

SEQ ID NO: 101133 - DNA, 20 bp, Artificial Sequence
  chemically synthesized
ttctttcaggacagtagaca

SEQ ID NO: 101134 - DNA, 20 bp, Artificial Sequence
  chemically synthesized
acagtagacacagctctaac

SEQ ID NO: 101135 - DNA, 20 bp, Artificial Sequence
  chemically synthesized
attattatttagtctagtta

SEQ ID NO: 101136 - DNA, 20 bp, Artificial Sequence
  chemically synthesized
gaattattatttagtctagt

SEQ ID NO: 101137 - DNA, 20 bp, Artificial Sequence
  chemically synthesized
gaatgaattattatttagtc

SEQ ID NO: 101138 - DNA, 20 bp, Artificial Sequence
  chemically synthesized
tcccagaatgaattattatt

SEQ ID NO: 101139 - DNA, 20 bp, Artificial Sequence
  chemically synthesized
gactaaataataattcattc

SEQ ID NO: 101140 - DNA, 20 bp, Artificial Sequence
  chemically synthesized
actaaataataattcattct

SEQ ID NO: 101141 - DNA, 20 bp, Artificial Sequence
  chemically synthesized
atggaattatttgggcatcc

SEQ ID NO: 101142 - DNA, 20 bp, Artificial Sequence
  chemically synthesized
aatatgttatggaattattt

SEQ ID NO: 101143 - DNA, 20 bp, Artificial Sequence
  chemically synthesized
gaatatgttatggaattatt

SEQ ID NO: 101144 - DNA, 20 bp, Artificial Sequence
  chemically synthesized
ggaaattattgaatatgtta

SEQ ID NO: 101145 - DNA, 20 bp, Artificial Sequence
  chemically synthesized
attcaataatttccacactg

SEQ ID NO: 101146 - DNA, 20 bp, Artificial Sequence
  chemically synthesized
ttcaataatttccacactga

SEQ ID NO: 101147 - DNA, 20 bp, Artificial Sequence
  chemically synthesized
tcaataatttccacactgaa

SEQ ID NO: 101148 - DNA, 20 bp, Artificial Sequence
  chemically synthesized
caagcaaatacccttcagtg

SEQ ID NO: 101149 - DNA, 20 bp, Artificial Sequence
  chemically synthesized
gaaatcaagcaaataccctt

SEQ ID NO: 101150 - DNA, 20 bp, Artificial Sequence
  chemically synthesized
atggtcaaaaagtagaaatc

SEQ ID NO: 101151 - DNA, 20 bp, Artificial Sequence
  chemically synthesized
tgtctatgatggtcaaaaag

SEQ ID NO: 101152 - DNA, 20 bp, Artificial Sequence
  chemically synthesized
cattgtctatgatggtcaaa

SEQ ID NO: 101153 - DNA, 20 bp, Artificial Sequence
  chemically synthesized
tttctactttttgaccatca

SEQ ID NO: 101154 - DNA, 20 bp, Artificial Sequence
  chemically synthesized
tattttggcattgtctatga

SEQ ID NO: 101155 - DNA, 20 bp, Artificial Sequence
  chemically synthesized
tatgtagaggatgtgtattt

SEQ ID NO: 101156 - DNA, 20 bp, Artificial Sequence
  chemically synthesized
aaatacacatcctctacata

SEQ ID NO: 101157 - DNA, 20 bp, Artificial Sequence
  chemically synthesized
gtatgaaaggctgtatgtag

SEQ ID NO: 101158 - DNA, 20 bp, Artificial Sequence
  chemically synthesized
agtatgaaaggctgtatgta

SEQ ID NO: 101159 - DNA, 20 bp, Artificial Sequence
  chemically synthesized
ccagtatgaaaggctgtatg

SEQ ID NO: 101160 - DNA, 20 bp, Artificial Sequence
  chemically synthesized
ctacatacagcctttcatac

SEQ ID NO: 101161 - DNA, 20 bp, Artificial Sequence
  chemically synthesized
aataaaagtaccagtatgaa

SEQ ID NO: 101162 - DNA, 20 bp, Artificial Sequence
  chemically synthesized
aaataaaagtaccagtatga

SEQ ID NO: 101163 - DNA, 20 bp, Artificial Sequence
  chemically synthesized
tactacagaaataaaagtac

SEQ ID NO: 101164 - DNA, 20 bp, Artificial Sequence
  chemically synthesized
aatcaatactacagaaataa

SEQ ID NO: 101165 - DNA, 20 bp, Artificial Sequence
  chemically synthesized
tactggtacttttatttctg

SEQ ID NO: 101166 - DNA, 20 bp, Artificial Sequence
  chemically synthesized
atttctgagaatcaatacta

SEQ ID NO: 101167 - DNA, 20 bp, Artificial Sequence
  chemically synthesized
atttctgtagtattgattct

SEQ ID NO: 101168 - DNA, 20 bp, Artificial Sequence
  chemically synthesized
gtagtattgattctcagaaa

SEQ ID NO: 101169 - DNA, 20 bp, Artificial Sequence
  chemically synthesized
agtattgattctcagaaatg

SEQ ID NO: 101170 - DNA, 20 bp, Artificial Sequence
  chemically synthesized
tgatcagtcactccatttct

SEQ ID NO: 101171 - DNA, 20 bp, Artificial Sequence
  chemically synthesized
gaaatggagtgactgatcaa

SEQ ID NO: 101172 - DNA, 20 bp, Artificial Sequence
  chemically synthesized
aaatggagtgactgatcaaa

SEQ ID NO: 101173 - DNA, 20 bp, Artificial Sequence
  chemically synthesized
aaatgcacttaccttttgat

SEQ ID NO: 101174 - DNA, 20 bp, Artificial Sequence
  chemically synthesized
ggagtgactgatcaaaaggt

SEQ ID NO: 101175 - DNA, 20 bp, Artificial Sequence
  chemically synthesized
aagtgcatttaaaatttttg

SEQ ID NO: 101176 - DNA, 20 bp, Artificial Sequence
  chemically synthesized
ggtctttgaggaaagaaatg

SEQ ID NO: 101177 - DNA, 20 bp, Artificial Sequence
  chemically synthesized
ataccacatttctttcctca

SEQ ID NO: 101178 - DNA, 20 bp, Artificial Sequence
  chemically synthesized
attgctgtggtctttgagga

SEQ ID NO: 101179 - DNA, 20 bp, Artificial Sequence
  chemically synthesized
gcaaattgctgtggtctttg

SEQ ID NO: 101180 - DNA, 20 bp, Artificial Sequence
  chemically synthesized
cgcaaattgctgtggtcttt

SEQ ID NO: 101181 - DNA, 20 bp, Artificial Sequence
  chemically synthesized
atttctttcctcaaagacca

SEQ ID NO: 101182 - DNA, 20 bp, Artificial Sequence
  chemically synthesized
agatgaaacgcaaattgctg

SEQ ID NO: 101183 - DNA, 20 bp, Artificial Sequence
  chemically synthesized
gagagcactctcagatattg

SEQ ID NO: 101184 - DNA, 20 bp, Artificial Sequence
  chemically synthesized
gcgtttcatctgcaatatct

SEQ ID NO: 101185 - DNA, 20 bp, Artificial Sequence
  chemically synthesized
gtttcatctgcaatatctga

SEQ ID NO: 101186 - DNA, 20 bp, Artificial Sequence
  chemically synthesized
ttaatggaagagagcactct

SEQ ID NO: 101187 - DNA, 20 bp, Artificial Sequence
  chemically synthesized
tgataatttttaatggaaga

SEQ ID NO: 101188 - DNA, 20 bp, Artificial Sequence
  chemically synthesized
aatgataatttttaatggaa

SEQ ID NO: 101189 - DNA, 20 bp, Artificial Sequence
  chemically synthesized
agaatgataatttttaatgg

SEQ ID NO: 101190 - DNA, 20 bp, Artificial Sequence
  chemically synthesized
ttaagaatgataatttttaa

SEQ ID NO: 101191 - DNA, 20 bp, Artificial Sequence
  chemically synthesized
ctaacaaatagacagaaatt

SEQ ID NO: 101192 - DNA, 20 bp, Artificial Sequence
  chemically synthesized
atgtctatctaacaaataga

SEQ ID NO: 101193 - DNA, 20 bp, Artificial Sequence
  chemically synthesized
cttaatttctgtctatttgt

SEQ ID NO: 101194 - DNA, 20 bp, Artificial Sequence
  chemically synthesized
caccatgtctatctaacaaa

SEQ ID NO: 101195 - DNA, 20 bp, Artificial Sequence
  chemically synthesized
atttctgtctatttgttaga

SEQ ID NO: 101196 - DNA, 20 bp, Artificial Sequence
  chemically synthesized
gtctatttgttagatagaca

SEQ ID NO: 101197 - DNA, 20 bp, Artificial Sequence
  chemically synthesized
ggataggaaaataaagaaat

SEQ ID NO: 101198 - DNA, 20 bp, Artificial Sequence
  chemically synthesized
tagtaagggataggaaaata

SEQ ID NO: 101199 - DNA, 20 bp, Artificial Sequence
  chemically synthesized
tcctcatagtagtaagggat

SEQ ID NO: 101200 - DNA, 20 bp, Artificial Sequence
  chemically synthesized
ttcctcatagtagtaaggga

SEQ ID NO: 101201 - DNA, 20 bp, Artificial Sequence
  chemically synthesized
atgcttcctcatagtagtaa

SEQ ID NO: 101202 - DNA, 20 bp, Artificial Sequence
  chemically synthesized
tatgcttcctcatagtagta

SEQ ID NO: 101203 - DNA, 20 bp, Artificial Sequence
  chemically synthesized
atatgcttcctcatagtagt

SEQ ID NO: 101204 - DNA, 20 bp, Artificial Sequence
  chemically synthesized
ttcctatcccttactactat

SEQ ID NO: 101205 - DNA, 20 bp, Artificial Sequence
  chemically synthesized
tcctatcccttactactatg

SEQ ID NO: 101206 - DNA, 20 bp, Artificial Sequence
  chemically synthesized
gataatatgcttcctcatag

SEQ ID NO: 101207 - DNA, 20 bp, Artificial Sequence
  chemically synthesized
tatcccttactactatgagg

SEQ ID NO: 101208 - DNA, 20 bp, Artificial Sequence
  chemically synthesized
tatgataatatgcttcctca

SEQ ID NO: 101209 - DNA, 20 bp, Artificial Sequence
  chemically synthesized
tatgaggaagcatattatca

SEQ ID NO: 101210 - DNA, 20 bp, Artificial Sequence
  chemically synthesized
ttatcatagttttatttttc

SEQ ID NO: 101211 - DNA, 20 bp, Artificial Sequence
  chemically synthesized
gttttatttttccagctatc

SEQ ID NO: 101212 - DNA, 20 bp, Artificial Sequence
  chemically synthesized
gaagaggatatccagatagc

SEQ ID NO: 101213 - DNA, 20 bp, Artificial Sequence
  chemically synthesized
cccagaagaggatatccaga

SEQ ID NO: 101214 - DNA, 20 bp, Artificial Sequence
  chemically synthesized
aattcccagaagaggatatc

SEQ ID NO: 101215 - DNA, 20 bp, Artificial Sequence
  chemically synthesized
gctatctggatatcctcttc

SEQ ID NO: 101216 - DNA, 20 bp, Artificial Sequence
  chemically synthesized
ctatctggatatcctcttct

SEQ ID NO: 101217 - DNA, 20 bp, Artificial Sequence
  chemically synthesized
gaatatgcaattcccagaag

SEQ ID NO: 101218 - DNA, 20 bp, Artificial Sequence
  chemically synthesized
ggaatatgcaattcccagaa

SEQ ID NO: 101219 - DNA, 20 bp, Artificial Sequence
  chemically synthesized
taggaatatgcaattcccag

SEQ ID NO: 101220 - DNA, 20 bp, Artificial Sequence
  chemically synthesized
gtataggaatatgcaattcc

SEQ ID NO: 101221 - DNA, 20 bp, Artificial Sequence
  chemically synthesized
aattgcatattcctatactt

SEQ ID NO: 101222 - DNA, 20 bp, Artificial Sequence
  chemically synthesized
tacaaaactggccgaagtat

SEQ ID NO: 101223 - DNA, 20 bp, Artificial Sequence
  chemically synthesized
gtacaaaactggccgaagta

SEQ ID NO: 101224 - DNA, 20 bp, Artificial Sequence
  chemically synthesized
gcatattcctatacttcggc

SEQ ID NO: 101225 - DNA, 20 bp, Artificial Sequence
  chemically synthesized
acccagtacaaaactggccg

SEQ ID NO: 101226 - DNA, 20 bp, Artificial Sequence
  chemically synthesized
caaacaacccagtacaaaac

SEQ ID NO: 101227 - DNA, 20 bp, Artificial Sequence
  chemically synthesized
tacttcggccagttttgtac

SEQ ID NO: 101228 - DNA, 20 bp, Artificial Sequence
  chemically synthesized
acttcggccagttttgtact

SEQ ID NO: 101229 - DNA, 20 bp, Artificial Sequence
  chemically synthesized
tttttaaaattcaaacaacc

SEQ ID NO: 101230 - DNA, 20 bp, Artificial Sequence
  chemically synthesized
taatttaattaacaaatttg

SEQ ID NO: 101231 - DNA, 20 bp, Artificial Sequence
  chemically synthesized
aatttaattaacaaatttgt

SEQ ID NO: 101232 - DNA, 20 bp, Artificial Sequence
  chemically synthesized
tttaattaacaaatttgtag

SEQ ID NO: 101233 - DNA, 20 bp, Artificial Sequence
  chemically synthesized
tgtaggagaaatttgtatat

SEQ ID NO: 101234 - DNA, 20 bp, Artificial Sequence
  chemically synthesized
gtaggagaaatttgtatatt

SEQ ID NO: 101235 - DNA, 20 bp, Artificial Sequence
  chemically synthesized
ttcgcaacatgtgacataaa

SEQ ID NO: 101236 - DNA, 20 bp, Artificial Sequence
  chemically synthesized
tattcgcaacatgtgacata

SEQ ID NO: 101237 - DNA, 20 bp, Artificial Sequence
  chemically synthesized
aagaaaaacagcaaatagag

SEQ ID NO: 101238 - DNA, 20 bp, Artificial Sequence
  chemically synthesized
caaaagaaaaacagcaaata

SEQ ID NO: 101239 - DNA, 20 bp, Artificial Sequence
  chemically synthesized
gtcaaaagaaaaacagcaaa

SEQ ID NO: 101240 - DNA, 20 bp, Artificial Sequence
  chemically synthesized
agacaaagtcaaaagaaaaa

SEQ ID NO: 101241 - DNA, 20 bp, Artificial Sequence
  chemically synthesized
ataacagaagacaaagtcaa

SEQ ID NO: 101242 - DNA, 20 bp, Artificial Sequence
  chemically synthesized
gcttaaaataacagaagaca

SEQ ID NO: 101243 - DNA, 20 bp, Artificial Sequence
  chemically synthesized
gttactgcttaaaataacag

SEQ ID NO: 101244 - DNA, 20 bp, Artificial Sequence
  chemically synthesized
actttgtcttctgttatttt

SEQ ID NO: 101245 - DNA, 20 bp, Artificial Sequence
  chemically synthesized
cttgttactgcttaaaataa

SEQ ID NO: 101246 - DNA, 20 bp, Artificial Sequence
  chemically synthesized
ttgtcttctgttattttaag

SEQ ID NO: 101247 - DNA, 20 bp, Artificial Sequence
  chemically synthesized
ctgttattttaagcagtaac

SEQ ID NO: 101248 - DNA, 20 bp, Artificial Sequence
  chemically synthesized
tgttattttaagcagtaaca

SEQ ID NO: 101249 - DNA, 20 bp, Artificial Sequence
  chemically synthesized
caaggtatattttttcctta

SEQ ID NO: 101250 - DNA, 20 bp, Artificial Sequence
  chemically synthesized
cacaaaactcaaaagctata

SEQ ID NO: 101251 - DNA, 20 bp, Artificial Sequence
  chemically synthesized
acacaaaactcaaaagctat

SEQ ID NO: 101252 - DNA, 20 bp, Artificial Sequence
  chemically synthesized
attttttccttatagctttt

SEQ ID NO: 101253 - DNA, 20 bp, Artificial Sequence
  chemically synthesized
aaacaagacacaaaactcaa

SEQ ID NO: 101254 - DNA, 20 bp, Artificial Sequence
  chemically synthesized
tttgagttttgtgtcttgtt

SEQ ID NO: 101255 - DNA, 20 bp, Artificial Sequence
  chemically synthesized
gaggaagacgttttctaaac

SEQ ID NO: 101256 - DNA, 20 bp, Artificial Sequence
  chemically synthesized
caaaaattcttggaatgagg

SEQ ID NO: 101257 - DNA, 20 bp, Artificial Sequence
  chemically synthesized
gaaaacgtcttcctcattcc

SEQ ID NO: 101258 - DNA, 20 bp, Artificial Sequence
  chemically synthesized
aaacaaaaattcttggaatg

SEQ ID NO: 101259 - DNA, 20 bp, Artificial Sequence
  chemically synthesized
aaaacaaaaattcttggaat

SEQ ID NO: 101260 - DNA, 20 bp, Artificial Sequence
  chemically synthesized
aatgtaaaaacaaaaattct

SEQ ID NO: 101261 - DNA, 20 bp, Artificial Sequence
  chemically synthesized
aatacatttcaaatgcatta

SEQ ID NO: 101262 - DNA, 20 bp, Artificial Sequence
  chemically synthesized
cctcctagcttatgcaatgt

SEQ ID NO: 101263 - DNA, 20 bp, Artificial Sequence
  chemically synthesized
aatgtattcttacattgcat

SEQ ID NO: 101264 - DNA, 20 bp, Artificial Sequence
  chemically synthesized
tattcttacattgcataagc

SEQ ID NO: 101265 - DNA, 20 bp, Artificial Sequence
  chemically synthesized
attcttacattgcataagct

SEQ ID NO: 101266 - DNA, 20 bp, Artificial Sequence
  chemically synthesized
tcttacattgcataagctag

SEQ ID NO: 101267 - DNA, 20 bp, Artificial Sequence
  chemically synthesized
cttacattgcataagctagg

SEQ ID NO: 101268 - DNA, 20 bp, Artificial Sequence
  chemically synthesized
agaaaacacagattgcctcc

SEQ ID NO: 101269 - DNA, 20 bp, Artificial Sequence
  chemically synthesized
gcaattcctcttagaaaaca

SEQ ID NO: 101270 - DNA, 20 bp, Artificial Sequence
  chemically synthesized
ggaggcaatctgtgttttct

SEQ ID NO: 101271 - DNA, 20 bp, Artificial Sequence
  chemically synthesized
aggcaatctgtgttttctaa

SEQ ID NO: 101272 - DNA, 20 bp, Artificial Sequence
  chemically synthesized
ggcaatctgtgttttctaag

SEQ ID NO: 101273 - DNA, 20 bp, Artificial Sequence
  chemically synthesized
gcactctttgcaattcctct

SEQ ID NO: 101274 - DNA, 20 bp, Artificial Sequence
  chemically synthesized
gttttctaagaggaattgca

SEQ ID NO: 101275 - DNA, 20 bp, Artificial Sequence
  chemically synthesized
tttctaagaggaattgcaaa

SEQ ID NO: 101276 - DNA, 20 bp, Artificial Sequence
  chemically synthesized
agaggaattgcaaagagtgc

SEQ ID NO: 101277 - DNA, 20 bp, Artificial Sequence
  chemically synthesized
ttttattcaataaatggtgc

SEQ ID NO: 101278 - DNA, 20 bp, Artificial Sequence
  chemically synthesized
aaggtgttttattcaataaa

SEQ ID NO: 101279 - DNA, 20 bp, Artificial Sequence
  chemically synthesized
tattttaattcaaggaataa

SEQ ID NO: 101280 - DNA, 20 bp, Artificial Sequence
  chemically synthesized
ttattttaattcaaggaata

SEQ ID NO: 101281 - DNA, 20 bp, Artificial Sequence
  chemically synthesized
aaatgtgttattttaattca

SEQ ID NO: 101282 - DNA, 20 bp, Artificial Sequence
  chemically synthesized
caaatgtgttattttaattc

SEQ ID NO: 101283 - DNA, 20 bp, Artificial Sequence
  chemically synthesized
ttgtttttggaaacattata

SEQ ID NO: 101284 - DNA, 20 bp, Artificial Sequence
  chemically synthesized
aaatagatacaaattgtttt

SEQ ID NO: 101285 - DNA, 20 bp, Artificial Sequence
  chemically synthesized
taaataaataaataaataaa

SEQ ID NO: 101286 - DNA, 20 bp, Artificial Sequence
  chemically synthesized
tatttatttatttatttttt

SEQ ID NO: 101287 - DNA, 20 bp, Artificial Sequence
  chemically synthesized
tatttatttattttttgaga

SEQ ID NO: 101288 - DNA, 20 bp, Artificial Sequence
  chemically synthesized
tttatttattttttgagatg

SEQ ID NO: 101289 - DNA, 20 bp, Artificial Sequence
  chemically synthesized
tactccagcctgggcaacaa

SEQ ID NO: 101290 - DNA, 20 bp, Artificial Sequence
  chemically synthesized
ggagtttcgctcttgttgcc

SEQ ID NO: 101291 - DNA, 20 bp, Artificial Sequence
  chemically synthesized
gagtttcgctcttgttgccc

SEQ ID NO: 101292 - DNA, 20 bp, Artificial Sequence
  chemically synthesized
tgtactccagcctgggcaac

SEQ ID NO: 101293 - DNA, 20 bp, Artificial Sequence
  chemically synthesized
ttcgctcttgttgcccaggc

SEQ ID NO: 101294 - DNA, 20 bp, Artificial Sequence
  chemically synthesized
cgctcttgttgcccaggctg

SEQ ID NO: 101295 - DNA, 20 bp, Artificial Sequence
  chemically synthesized
gcaccattgtactccagcct

SEQ ID NO: 101296 - DNA, 20 bp, Artificial Sequence
  chemically synthesized
cgcaccattgtactccagcc

SEQ ID NO: 101297 - DNA, 20 bp, Artificial Sequence
  chemically synthesized
aagatcgcaccattgtactc

SEQ ID NO: 101298 - DNA, 20 bp, Artificial Sequence
  chemically synthesized
ttgcccaggctggagtacaa

SEQ ID NO: 101299 - DNA, 20 bp, Artificial Sequence
  chemically synthesized
ggagtacaatggtgcgatct

SEQ ID NO: 101300 - DNA, 20 bp, Artificial Sequence
  chemically synthesized
ggcggaggttgcagtgagcc

SEQ ID NO: 101301 - DNA, 20 bp, Artificial Sequence
  chemically synthesized
caggaggcggaggttgcagt

SEQ ID NO: 101302 - DNA, 20 bp, Artificial Sequence
  chemically synthesized
aacccaggaggcggaggttg

SEQ ID NO: 101303 - DNA, 20 bp, Artificial Sequence
  chemically synthesized
cgcttgaacccaggaggcgg

SEQ ID NO: 101304 - DNA, 20 bp, Artificial Sequence
  chemically synthesized
tcactgcaacctccgcctcc

SEQ ID NO: 101305 - DNA, 20 bp, Artificial Sequence
  chemically synthesized
tcgcttgaacccaggaggcg

SEQ ID NO: 101306 - DNA, 20 bp, Artificial Sequence
  chemically synthesized
cactgcaacctccgcctcct

SEQ ID NO: 101307 - DNA, 20 bp, Artificial Sequence
  chemically synthesized
aatcgcttgaacccaggagg

SEQ ID NO: 101308 - DNA, 20 bp, Artificial Sequence
  chemically synthesized
gagaatcgcttgaacccagg

SEQ ID NO: 101309 - DNA, 20 bp, Artificial Sequence
  chemically synthesized
ggagaatcgcttgaacccag

SEQ ID NO: 101310 - DNA, 20 bp, Artificial Sequence
  chemically synthesized
aacctccgcctcctgggttc

SEQ ID NO: 101311 - DNA, 20 bp, Artificial Sequence
  chemically synthesized
caggagaatcgcttgaaccc

SEQ ID NO: 101312 - DNA, 20 bp, Artificial Sequence
  chemically synthesized
gcaggagaatcgcttgaacc

SEQ ID NO: 101313 - DNA, 20 bp, Artificial Sequence
  chemically synthesized
ttcaagcgattctcctgcct

SEQ ID NO: 101314 - DNA, 20 bp, Artificial Sequence
  chemically synthesized
tacttgggaggctgaggcag

SEQ ID NO: 101315 - DNA, 20 bp, Artificial Sequence
  chemically synthesized
gctacttgggaggctgaggc

SEQ ID NO: 101316 - DNA, 20 bp, Artificial Sequence
  chemically synthesized
agctacttgggaggctgagg

SEQ ID NO: 101317 - DNA, 20 bp, Artificial Sequence
  chemically synthesized
cccagctacttgggaggctg

SEQ ID NO: 101318 - DNA, 20 bp, Artificial Sequence
  chemically synthesized
tcccagctacttgggaggct

SEQ ID NO: 101319 - DNA, 20 bp, Artificial Sequence
  chemically synthesized
ttctcctgcctcagcctccc

SEQ ID NO: 101320 - DNA, 20 bp, Artificial Sequence
  chemically synthesized
tcctgcctcagcctcccaag

SEQ ID NO: 101321 - DNA, 20 bp, Artificial Sequence
  chemically synthesized
tgtagtcccagctacttggg

SEQ ID NO: 101322 - DNA, 20 bp, Artificial Sequence
  chemically synthesized
ctgtagtcccagctacttgg

SEQ ID NO: 101323 - DNA, 20 bp, Artificial Sequence
  chemically synthesized
gcctcagcctcccaagtagc

SEQ ID NO: 101324 - DNA, 20 bp, Artificial Sequence
  chemically synthesized
gcctgtagtcccagctactt

SEQ ID NO: 101325 - DNA, 20 bp, Artificial Sequence
  chemically synthesized
cctcagcctcccaagtagct

SEQ ID NO: 101326 - DNA, 20 bp, Artificial Sequence
  chemically synthesized
cgcctgtagtcccagctact

SEQ ID NO: 101327 - DNA, 20 bp, Artificial Sequence
  chemically synthesized
ctcccaagtagctgggacta

SEQ ID NO: 101328 - DNA, 20 bp, Artificial Sequence
  chemically synthesized
tcccaagtagctgggactac

SEQ ID NO: 101329 - DNA, 20 bp, Artificial Sequence
  chemically synthesized
gtggtgggcgcctgtagtcc

SEQ ID NO: 101330 - DNA, 20 bp, Artificial Sequence
  chemically synthesized
ggcgtggtggtgggcgcctg

SEQ ID NO: 101331 - DNA, 20 bp, Artificial Sequence
  chemically synthesized
aattagctgggcgtggtggt

SEQ ID NO: 101332 - DNA, 20 bp, Artificial Sequence
  chemically synthesized
aaattagctgggcgtggtgg

SEQ ID NO: 101333 - DNA, 20 bp, Artificial Sequence
  chemically synthesized
caggcgcccaccaccacgcc

SEQ ID NO: 101334 - DNA, 20 bp, Artificial Sequence
  chemically synthesized
caaaaattagctgggcgtgg

SEQ ID NO: 101335 - DNA, 20 bp, Artificial Sequence
  chemically synthesized
atacaaaaattagctgggcg

SEQ ID NO: 101336 - DNA, 20 bp, Artificial Sequence
  chemically synthesized
taaaaatacaaaaattagct

SEQ ID NO: 101337 - DNA, 20 bp, Artificial Sequence
  chemically synthesized
ctaaaaatacaaaaattagc

SEQ ID NO: 101338 - DNA, 20 bp, Artificial Sequence
  chemically synthesized
tctactaaaaatacaaaaat

SEQ ID NO: 101339 - DNA, 20 bp, Artificial Sequence
  chemically synthesized
ccagctaatttttgtatttt

SEQ ID NO: 101340 - DNA, 20 bp, Artificial Sequence
  chemically synthesized
gctaatttttgtatttttag

SEQ ID NO: 101341 - DNA, 20 bp, Artificial Sequence
  chemically synthesized
taatttttgtatttttagta

SEQ ID NO: 101342 - DNA, 20 bp, Artificial Sequence
  chemically synthesized
ttttgtatttttagtagaga

SEQ ID NO: 101343 - DNA, 20 bp, Artificial Sequence
  chemically synthesized
tttgtatttttagtagagac

SEQ ID NO: 101344 - DNA, 20 bp, Artificial Sequence
  chemically synthesized
ttgtatttttagtagagacg

SEQ ID NO: 101345 - DNA, 20 bp, Artificial Sequence
  chemically synthesized
agtagagacggggtttcacc

SEQ ID NO: 101346 - DNA, 20 bp, Artificial Sequence
  chemically synthesized
gagacggggtttcaccaagt

SEQ ID NO: 101347 - DNA, 20 bp, Artificial Sequence
  chemically synthesized
cggggtttcaccaagttggc

SEQ ID NO: 101348 - DNA, 20 bp, Artificial Sequence
  chemically synthesized
caagaccagcctagccaact

SEQ ID NO: 101349 - DNA, 20 bp, Artificial Sequence
  chemically synthesized
ggggtttcaccaagttggct

SEQ ID NO: 101350 - DNA, 20 bp, Artificial Sequence
  chemically synthesized
tttcaccaagttggctaggc

SEQ ID NO: 101351 - DNA, 20 bp, Artificial Sequence
  chemically synthesized
tgaggagttcaagaccagcc

SEQ ID NO: 101352 - DNA, 20 bp, Artificial Sequence
  chemically synthesized
ttacctgaggagttcaagac

SEQ ID NO: 101353 - DNA, 20 bp, Artificial Sequence
  chemically synthesized
gtggattacctgaggagttc

SEQ ID NO: 101354 - DNA, 20 bp, Artificial Sequence
  chemically synthesized
taggctggtcttgaactcct

SEQ ID NO: 101355 - DNA, 20 bp, Artificial Sequence
  chemically synthesized
aggctggtcttgaactcctc

SEQ ID NO: 101356 - DNA, 20 bp, Artificial Sequence
  chemically synthesized
aggtgggtggattacctgag

SEQ ID NO: 101357 - DNA, 20 bp, Artificial Sequence
  chemically synthesized
tgaggtgggtggattacctg

SEQ ID NO: 101358 - DNA, 20 bp, Artificial Sequence
  chemically synthesized
ctgaggtgggtggattacct

SEQ ID NO: 101359 - DNA, 20 bp, Artificial Sequence
  chemically synthesized
ctcaggtaatccacccacct

SEQ ID NO: 101360 - DNA, 20 bp, Artificial Sequence
  chemically synthesized
ctttgggagtctgaggtggg

SEQ ID NO: 101361 - DNA, 20 bp, Artificial Sequence
  chemically synthesized
gcactttgggagtctgaggt

SEQ ID NO: 101362 - DNA, 20 bp, Artificial Sequence
  chemically synthesized
agcactttgggagtctgagg

SEQ ID NO: 101363 - DNA, 20 bp, Artificial Sequence
  chemically synthesized
cccagcactttgggagtctg

SEQ ID NO: 101364 - DNA, 20 bp, Artificial Sequence
  chemically synthesized
tcccagcactttgggagtct

SEQ ID NO: 101365 - DNA, 20 bp, Artificial Sequence
  chemically synthesized
ccacccacctcagactccca

SEQ ID NO: 101366 - DNA, 20 bp, Artificial Sequence
  chemically synthesized
ctgtaatcccagcactttgg

SEQ ID NO: 101367 - DNA, 20 bp, Artificial Sequence
  chemically synthesized
acctcagactcccaaagtgc

SEQ ID NO: 101368 - DNA, 20 bp, Artificial Sequence
  chemically synthesized
gcctgtaatcccagcacttt

SEQ ID NO: 101369 - DNA, 20 bp, Artificial Sequence
  chemically synthesized
cctcagactcccaaagtgct

SEQ ID NO: 101370 - DNA, 20 bp, Artificial Sequence
  chemically synthesized
cgcctgtaatcccagcactt

SEQ ID NO: 101371 - DNA, 20 bp, Artificial Sequence
  chemically synthesized
ctcccaaagtgctgggatta

SEQ ID NO: 101372 - DNA, 20 bp, Artificial Sequence
  chemically synthesized
tcccaaagtgctgggattac

SEQ ID NO: 101373 - DNA, 20 bp, Artificial Sequence
  chemically synthesized
gtggcttacgcctgtaatcc

SEQ ID NO: 101374 - DNA, 20 bp, Artificial Sequence
  chemically synthesized
agtgctgggattacaggcgt

SEQ ID NO: 101375 - DNA, 20 bp, Artificial Sequence
  chemically synthesized
caggcgtaagccaccatgcc

SEQ ID NO: 101376 - DNA, 20 bp, Artificial Sequence
  chemically synthesized
tttttggaggccgggcatgg

SEQ ID NO: 101377 - DNA, 20 bp, Artificial Sequence
  chemically synthesized
ttgtttttggaggccgggca

SEQ ID NO: 101378 - DNA, 20 bp, Artificial Sequence
  chemically synthesized
tcagattgtttttggaggcc

SEQ ID NO: 101379 - DNA, 20 bp, Artificial Sequence
  chemically synthesized
atcagattgtttttggaggc

SEQ ID NO: 101380 - DNA, 20 bp, Artificial Sequence
  chemically synthesized
gcagatcagattgtttttgg

SEQ ID NO: 101381 - DNA, 20 bp, Artificial Sequence
  chemically synthesized
agcagatcagattgtttttg

SEQ ID NO: 101382 - DNA, 20 bp, Artificial Sequence
  chemically synthesized
gaagcagatcagattgtttt

SEQ ID NO: 101383 - DNA, 20 bp, Artificial Sequence
  chemically synthesized
ttgagagtccagaagcagat

SEQ ID NO: 101384 - DNA, 20 bp, Artificial Sequence
  chemically synthesized
aaaacaatctgatctgcttc

SEQ ID NO: 101385 - DNA, 20 bp, Artificial Sequence
  chemically synthesized
caaaattgagagtccagaag

SEQ ID NO: 101386 - DNA, 20 bp, Artificial Sequence
  chemically synthesized
aagcaaaattgagagtccag

SEQ ID NO: 101387 - DNA, 20 bp, Artificial Sequence
  chemically synthesized
ctgaagcaaaattgagagtc

SEQ ID NO: 101388 - DNA, 20 bp, Artificial Sequence
  chemically synthesized
gatcactgaagcaaaattga

SEQ ID NO: 101389 - DNA, 20 bp, Artificial Sequence
  chemically synthesized
tagatcactgaagcaaaatt

SEQ ID NO: 101390 - DNA, 20 bp, Artificial Sequence
  chemically synthesized
ctggactctcaattttgctt

SEQ ID NO: 101391 - DNA, 20 bp, Artificial Sequence
  chemically synthesized
acaagacaagtagatcactg

SEQ ID NO: 101392 - DNA, 20 bp, Artificial Sequence
  chemically synthesized
ttagcacaaaacaagacaag

SEQ ID NO: 101393 - DNA, 20 bp, Artificial Sequence
  chemically synthesized
gtattagcacaaaacaagac

SEQ ID NO: 101394 - DNA, 20 bp, Artificial Sequence
  chemically synthesized
gtatagtattagcacaaaac

SEQ ID NO: 101395 - DNA, 20 bp, Artificial Sequence
  chemically synthesized
taatccaaatagtatagtat

SEQ ID NO: 101396 - DNA, 20 bp, Artificial Sequence
  chemically synthesized
tgtgctaatactatactatt

SEQ ID NO: 101397 - DNA, 20 bp, Artificial Sequence
  chemically synthesized
ctactgtaatccaaatagta

SEQ ID NO: 101398 - DNA, 20 bp, Artificial Sequence
  chemically synthesized
taaagctactgtaatccaaa

SEQ ID NO: 101399 - DNA, 20 bp, Artificial Sequence
  chemically synthesized
atactatactatttggatta

SEQ ID NO: 101400 - DNA, 20 bp, Artificial Sequence
  chemically synthesized
ctatactatttggattacag

SEQ ID NO: 101401 - DNA, 20 bp, Artificial Sequence
  chemically synthesized
tttggattacagtagcttta

SEQ ID NO: 101402 - DNA, 20 bp, Artificial Sequence
  chemically synthesized
gattacagtagctttacagc

SEQ ID NO: 101403 - DNA, 20 bp, Artificial Sequence
  chemically synthesized
ccaatattaaacttgctgta

SEQ ID NO: 101404 - DNA, 20 bp, Artificial Sequence
  chemically synthesized
ctttacagcaagtttaatat

SEQ ID NO: 101405 - DNA, 20 bp, Artificial Sequence
  chemically synthesized
cagcaagtttaatattggat

SEQ ID NO: 101406 - DNA, 20 bp, Artificial Sequence
  chemically synthesized
agcaagtttaatattggata

SEQ ID NO: 101407 - DNA, 20 bp, Artificial Sequence
  chemically synthesized
agtttaatattggataaggc

SEQ ID NO: 101408 - DNA, 20 bp, Artificial Sequence
  chemically synthesized
tgcatcaataataagggagg

SEQ ID NO: 101409 - DNA, 20 bp, Artificial Sequence
  chemically synthesized
ctgcatcaataataagggag

SEQ ID NO: 101410 - DNA, 20 bp, Artificial Sequence
  chemically synthesized
tctgcatcaataataaggga

SEQ ID NO: 101411 - DNA, 20 bp, Artificial Sequence
  chemically synthesized
ctctgcatcaataataaggg

SEQ ID NO: 101412 - DNA, 20 bp, Artificial Sequence
  chemically synthesized
tctctgcatcaataataagg

SEQ ID NO: 101413 - DNA, 20 bp, Artificial Sequence
  chemically synthesized
tgtctctgcatcaataataa

SEQ ID NO: 101414 - DNA, 20 bp, Artificial Sequence
  chemically synthesized
atgtctctgcatcaataata

SEQ ID NO: 101415 - DNA, 20 bp, Artificial Sequence
  chemically synthesized
aatgtctctgcatcaataat

SEQ ID NO: 101416 - DNA, 20 bp, Artificial Sequence
  chemically synthesized
cccctcccttattattgatg

SEQ ID NO: 101417 - DNA, 20 bp, Artificial Sequence
  chemically synthesized
cctcccttattattgatgca

SEQ ID NO: 101418 - DNA, 20 bp, Artificial Sequence
  chemically synthesized
attatttttcatgcattcct

SEQ ID NO: 101419 - DNA, 20 bp, Artificial Sequence
  chemically synthesized
taaataatcgcaagtatctc

SEQ ID NO: 101420 - DNA, 20 bp, Artificial Sequence
  chemically synthesized
ataaataatcgcaagtatct

SEQ ID NO: 101421 - DNA, 20 bp, Artificial Sequence
  chemically synthesized
atgaaataataaataatcgc

SEQ ID NO: 101422 - DNA, 20 bp, Artificial Sequence
  chemically synthesized
ttatttcatatgaactttaa

SEQ ID NO: 101423 - DNA, 20 bp, Artificial Sequence
  chemically synthesized
ttgaggaggggagactttta

SEQ ID NO: 101424 - DNA, 20 bp, Artificial Sequence
  chemically synthesized
gcaagatatattgaggaggg

SEQ ID NO: 101425 - DNA, 20 bp, Artificial Sequence
  chemically synthesized
aggcaagatatattgaggag

SEQ ID NO: 101426 - DNA, 20 bp, Artificial Sequence
  chemically synthesized
aaggcaagatatattgagga

SEQ ID NO: 101427 - DNA, 20 bp, Artificial Sequence
  chemically synthesized
gaaggcaagatatattgagg

SEQ ID NO: 101428 - DNA, 20 bp, Artificial Sequence
  chemically synthesized
tgaaggcaagatatattgag

SEQ ID NO: 101429 - DNA, 20 bp, Artificial Sequence
  chemically synthesized
cttgaaggcaagatatattg

SEQ ID NO: 101430 - DNA, 20 bp, Artificial Sequence
  chemically synthesized
ccttgaaggcaagatatatt

SEQ ID NO: 101431 - DNA, 20 bp, Artificial Sequence
  chemically synthesized
cctcaatatatcttgccttc

SEQ ID NO: 101432 - DNA, 20 bp, Artificial Sequence
  chemically synthesized
ctcaatatatcttgccttca

SEQ ID NO: 101433 - DNA, 20 bp, Artificial Sequence
  chemically synthesized
atttcaagtgccttgaaggc

SEQ ID NO: 101434 - DNA, 20 bp, Artificial Sequence
  chemically synthesized
gtaaatttcaagtgccttga

SEQ ID NO: 101435 - DNA, 20 bp, Artificial Sequence
  chemically synthesized
tgtaaatttcaagtgccttg

SEQ ID NO: 101436 - DNA, 20 bp, Artificial Sequence
  chemically synthesized
ttaaattccctgtaaatttc

SEQ ID NO: 101437 - DNA, 20 bp, Artificial Sequence
  chemically synthesized
ttcaaggcacttgaaattta

SEQ ID NO: 101438 - DNA, 20 bp, Artificial Sequence
  chemically synthesized
tcaaggcacttgaaatttac

SEQ ID NO: 101439 - DNA, 20 bp, Artificial Sequence
  chemically synthesized
caaggcacttgaaatttaca

SEQ ID NO: 101440 - DNA, 20 bp, Artificial Sequence
  chemically synthesized
ttacagggaatttaaattcc

SEQ ID NO: 101441 - DNA, 20 bp, Artificial Sequence
  chemically synthesized
tcaagattttatttaaatct

SEQ ID NO: 101442 - DNA, 20 bp, Artificial Sequence
  chemically synthesized
gatttaaataaaatcttgat

SEQ ID NO: 101443 - DNA, 20 bp, Artificial Sequence
  chemically synthesized
tatagtattttaggcttatc

SEQ ID NO: 101444 - DNA, 20 bp, Artificial Sequence
  chemically synthesized
gaatagatttatagtatttt

SEQ ID NO: 101445 - DNA, 20 bp, Artificial Sequence
  chemically synthesized
agaatagatttatagtattt

SEQ ID NO: 101446 - DNA, 20 bp, Artificial Sequence
  chemically synthesized
tgtttcatagaatagattta

SEQ ID NO: 101447 - DNA, 20 bp, Artificial Sequence
  chemically synthesized
ttggtgtctgtttcatagaa

SEQ ID NO: 101448 - DNA, 20 bp, Artificial Sequence
  chemically synthesized
tataaatctattctatgaaa

SEQ ID NO: 101449 - DNA, 20 bp, Artificial Sequence
  chemically synthesized
taatattggtgtctgtttca

SEQ ID NO: 101450 - DNA, 20 bp, Artificial Sequence
  chemically synthesized
atgaaacagacaccaatatt

SEQ ID NO: 101451 - DNA, 20 bp, Artificial Sequence
  chemically synthesized
tgaaacagacaccaatatta

SEQ ID NO: 101452 - DNA, 20 bp, Artificial Sequence
  chemically synthesized
tcattgttttgccttaatat

SEQ ID NO: 101453 - DNA, 20 bp, Artificial Sequence
  chemically synthesized
atattaaggcaaaacaatga

SEQ ID NO: 101454 - DNA, 20 bp, Artificial Sequence
  chemically synthesized
cagtgctctgaacattttat

SEQ ID NO: 101455 - DNA, 20 bp, Artificial Sequence
  chemically synthesized
gtgaaaaccaataaaatgtt

SEQ ID NO: 101456 - DNA, 20 bp, Artificial Sequence
  chemically synthesized
gaaaaccaataaaatgttca

SEQ ID NO: 101457 - DNA, 20 bp, Artificial Sequence
  chemically synthesized
tgttcagagcactgcttaaa

SEQ ID NO: 101458 - DNA, 20 bp, Artificial Sequence
  chemically synthesized
tgtatcataatctatttaag

SEQ ID NO: 101459 - DNA, 20 bp, Artificial Sequence
  chemically synthesized
ggatgtatcataatctattt

SEQ ID NO: 101460 - DNA, 20 bp, Artificial Sequence
  chemically synthesized
attatgatacatccacaaaa

SEQ ID NO: 101461 - DNA, 20 bp, Artificial Sequence
  chemically synthesized
ctacatattgttccattttg

SEQ ID NO: 101462 - DNA, 20 bp, Artificial Sequence
  chemically synthesized
ccacaaaatggaacaatatg

SEQ ID NO: 101463 - DNA, 20 bp, Artificial Sequence
  chemically synthesized
atatgtagtcattaaactaa

SEQ ID NO: 101464 - DNA, 20 bp, Artificial Sequence
  chemically synthesized
tagtcattaaactaacggtt

SEQ ID NO: 101465 - DNA, 20 bp, Artificial Sequence
  chemically synthesized
atagcaaagaacttaaccgt

SEQ ID NO: 101466 - DNA, 20 bp, Artificial Sequence
  chemically synthesized
aacggttaagttctttgcta

SEQ ID NO: 101467 - DNA, 20 bp, Artificial Sequence
  chemically synthesized
acggttaagttctttgctat

SEQ ID NO: 101468 - DNA, 20 bp, Artificial Sequence
  chemically synthesized
acagaattcaacccatagca

SEQ ID NO: 101469 - DNA, 20 bp, Artificial Sequence
  chemically synthesized
tttggacagaattcaaccca

SEQ ID NO: 101470 - DNA, 20 bp, Artificial Sequence
  chemically synthesized
aaatttggagaaaatttgga

SEQ ID NO: 101471 - DNA, 20 bp, Artificial Sequence
  chemically synthesized
atttaaatttggagaaaatt

SEQ ID NO: 101472 - DNA, 20 bp, Artificial Sequence
  chemically synthesized
gacttcaacatttaaatttg

SEQ ID NO: 101473 - DNA, 20 bp, Artificial Sequence
  chemically synthesized
aggacttcaacatttaaatt

SEQ ID NO: 101474 - DNA, 20 bp, Artificial Sequence
  chemically synthesized
ttctccaaatttaaatgttg

SEQ ID NO: 101475 - DNA, 20 bp, Artificial Sequence
  chemically synthesized
aatgttgaagtcctaacccc

SEQ ID NO: 101476 - DNA, 20 bp, Artificial Sequence
  chemically synthesized
attctgaggtaccaggggtt

SEQ ID NO: 101477 - DNA, 20 bp, Artificial Sequence
  chemically synthesized
cattctgaggtaccaggggt

SEQ ID NO: 101478 - DNA, 20 bp, Artificial Sequence
  chemically synthesized
gtcacattctgaggtaccag

SEQ ID NO: 101479 - DNA, 20 bp, Artificial Sequence
  chemically synthesized
ggtcacattctgaggtacca

SEQ ID NO: 101480 - DNA, 20 bp, Artificial Sequence
  chemically synthesized
agtcctaacccctggtacct

SEQ ID NO: 101481 - DNA, 20 bp, Artificial Sequence
  chemically synthesized
gggtcacattctgaggtacc

SEQ ID NO: 101482 - DNA, 20 bp, Artificial Sequence
  chemically synthesized
agggtcacattctgaggtac

SEQ ID NO: 101483 - DNA, 20 bp, Artificial Sequence
  chemically synthesized
ccaaatagggtcacattctg

SEQ ID NO: 101484 - DNA, 20 bp, Artificial Sequence
  chemically synthesized
tccaaatagggtcacattct

SEQ ID NO: 101485 - DNA, 20 bp, Artificial Sequence
  chemically synthesized
cctcagaatgtgaccctatt

SEQ ID NO: 101486 - DNA, 20 bp, Artificial Sequence
  chemically synthesized
tcagaatgtgaccctatttg

SEQ ID NO: 101487 - DNA, 20 bp, Artificial Sequence
  chemically synthesized
aatgaccctatctccaaata

SEQ ID NO: 101488 - DNA, 20 bp, Artificial Sequence
  chemically synthesized
taatgaccctatctccaaat

SEQ ID NO: 101489 - DNA, 20 bp, Artificial Sequence
  chemically synthesized
gtaatgaccctatctccaaa

SEQ ID NO: 101490 - DNA, 20 bp, Artificial Sequence
  chemically synthesized
aatgtgaccctatttggaga

SEQ ID NO: 101491 - DNA, 20 bp, Artificial Sequence
  chemically synthesized
atgtgaccctatttggagat

SEQ ID NO: 101492 - DNA, 20 bp, Artificial Sequence
  chemically synthesized
tgtgaccctatttggagata

SEQ ID NO: 101493 - DNA, 20 bp, Artificial Sequence
  chemically synthesized
atttggagatagggtcatta

SEQ ID NO: 101494 - DNA, 20 bp, Artificial Sequence
  chemically synthesized
ttggagatagggtcattaca

SEQ ID NO: 101495 - DNA, 20 bp, Artificial Sequence
  chemically synthesized
agagataatcaacttaaaat

SEQ ID NO: 101496 - DNA, 20 bp, Artificial Sequence
  chemically synthesized
gagataatcaacttaaaatg

SEQ ID NO: 101497 - DNA, 20 bp, Artificial Sequence
  chemically synthesized
caaccaaatgacctcatttt

SEQ ID NO: 101498 - DNA, 20 bp, Artificial Sequence
  chemically synthesized
caacttaaaatgaggtcatt

SEQ ID NO: 101499 - DNA, 20 bp, Artificial Sequence
  chemically synthesized
ttaaaatgaggtcatttggt

SEQ ID NO: 101500 - DNA, 20 bp, Artificial Sequence
  chemically synthesized
taaaatgaggtcatttggtt

SEQ ID NO: 101501 - DNA, 20 bp, Artificial Sequence
  chemically synthesized
gaggtcatttggttgggcct

SEQ ID NO: 101502 - DNA, 20 bp, Artificial Sequence
  chemically synthesized
gacagagtcatattggactc

SEQ ID NO: 101503 - DNA, 20 bp, Artificial Sequence
  chemically synthesized
ggacagagtcatattggact

SEQ ID NO: 101504 - DNA, 20 bp, Artificial Sequence
  chemically synthesized
ttttaaggacagagtcatat

SEQ ID NO: 101505 - DNA, 20 bp, Artificial Sequence
  chemically synthesized
aacttccccttttaaggaca

SEQ ID NO: 101506 - DNA, 20 bp, Artificial Sequence
  chemically synthesized
caatatgactctgtccttaa

SEQ ID NO: 101507 - DNA, 20 bp, Artificial Sequence
  chemically synthesized
ccaacttccccttttaagga

SEQ ID NO: 101508 - DNA, 20 bp, Artificial Sequence
  chemically synthesized
aatatgactctgtccttaaa

SEQ ID NO: 101509 - DNA, 20 bp, Artificial Sequence
  chemically synthesized
atatgactctgtccttaaaa

SEQ ID NO: 101510 - DNA, 20 bp, Artificial Sequence
  chemically synthesized
tatgactctgtccttaaaag

SEQ ID NO: 101511 - DNA, 20 bp, Artificial Sequence
  chemically synthesized
gtctccaacttcccctttta

SEQ ID NO: 101512 - DNA, 20 bp, Artificial Sequence
  chemically synthesized
tgtctccaacttcccctttt

SEQ ID NO: 101513 - DNA, 20 bp, Artificial Sequence
  chemically synthesized
gactctgtccttaaaagggg

SEQ ID NO: 101514 - DNA, 20 bp, Artificial Sequence
  chemically synthesized
ctgtccttaaaaggggaagt

SEQ ID NO: 101515 - DNA, 20 bp, Artificial Sequence
  chemically synthesized
gtccttaaaaggggaagttg

SEQ ID NO: 101516 - DNA, 20 bp, Artificial Sequence
  chemically synthesized
ttaaaaggggaagttggaga

SEQ ID NO: 101517 - DNA, 20 bp, Artificial Sequence
  chemically synthesized
gttggagacagacacgtaca

SEQ ID NO: 101518 - DNA, 20 bp, Artificial Sequence
  chemically synthesized
ttggagacagacacgtacac

SEQ ID NO: 101519 - DNA, 20 bp, Artificial Sequence
  chemically synthesized
tggagacagacacgtacaca

SEQ ID NO: 101520 - DNA, 20 bp, Artificial Sequence
  chemically synthesized
ggagacagacacgtacacag

SEQ ID NO: 101521 - DNA, 20 bp, Artificial Sequence
  chemically synthesized
gagacagacacgtacacagg

SEQ ID NO: 101522 - DNA, 20 bp, Artificial Sequence
  chemically synthesized
tgtctgccttcattttcaca

SEQ ID NO: 101523 - DNA, 20 bp, Artificial Sequence
  chemically synthesized
gggcatgccatgtgaaaatg

SEQ ID NO: 101524 - DNA, 20 bp, Artificial Sequence
  chemically synthesized
ggcatgccatgtgaaaatga

SEQ ID NO: 101525 - DNA, 20 bp, Artificial Sequence
  chemically synthesized
atgccatgtgaaaatgaagg

SEQ ID NO: 101526 - DNA, 20 bp, Artificial Sequence
  chemically synthesized
aaaatgaaggcagacatcta

SEQ ID NO: 101527 - DNA, 20 bp, Artificial Sequence
  chemically synthesized
aaatgaaggcagacatctac

SEQ ID NO: 101528 - DNA, 20 bp, Artificial Sequence
  chemically synthesized
aaggcagacatctacaggac

SEQ ID NO: 101529 - DNA, 20 bp, Artificial Sequence
  chemically synthesized
aggcagacatctacaggaca

SEQ ID NO: 101530 - DNA, 20 bp, Artificial Sequence
  chemically synthesized
ctttggtgctccttgtcctg

SEQ ID NO: 101531 - DNA, 20 bp, Artificial Sequence
  chemically synthesized
gcagacatctacaggacaag

SEQ ID NO: 101532 - DNA, 20 bp, Artificial Sequence
  chemically synthesized
ctacaggacaaggagcacca

SEQ ID NO: 101533 - DNA, 20 bp, Artificial Sequence
  chemically synthesized
gatggtttgttggcaatctt

SEQ ID NO: 101534 - DNA, 20 bp, Artificial Sequence
  chemically synthesized
cctagtttctgatggtttgt

SEQ ID NO: 101535 - DNA, 20 bp, Artificial Sequence
  chemically synthesized
aaagattgccaacaaaccat

SEQ ID NO: 101536 - DNA, 20 bp, Artificial Sequence
  chemically synthesized
tccattcccctagtttctga

SEQ ID NO: 101537 - DNA, 20 bp, Artificial Sequence
  chemically synthesized
gccaacaaaccatcagaaac

SEQ ID NO: 101538 - DNA, 20 bp, Artificial Sequence
  chemically synthesized
ccaacaaaccatcagaaact

SEQ ID NO: 101539 - DNA, 20 bp, Artificial Sequence
  chemically synthesized
caacaaaccatcagaaacta

SEQ ID NO: 101540 - DNA, 20 bp, Artificial Sequence
  chemically synthesized
aacaaaccatcagaaactag

SEQ ID NO: 101541 - DNA, 20 bp, Artificial Sequence
  chemically synthesized
accatcagaaactaggggaa

SEQ ID NO: 101542 - DNA, 20 bp, Artificial Sequence
  chemically synthesized
tctgttccattccattcccc

SEQ ID NO: 101543 - DNA, 20 bp, Artificial Sequence
  chemically synthesized
cagaaactaggggaatggaa

SEQ ID NO: 101544 - DNA, 20 bp, Artificial Sequence
  chemically synthesized
actaggggaatggaatggaa

SEQ ID NO: 101545 - DNA, 20 bp, Artificial Sequence
  chemically synthesized
atggaacagattctccttcc

SEQ ID NO: 101546 - DNA, 20 bp, Artificial Sequence
  chemically synthesized
tccttctgagggctcggaag

SEQ ID NO: 101547 - DNA, 20 bp, Artificial Sequence
  chemically synthesized
gttccttctgagggctcgga

SEQ ID NO: 101548 - DNA, 20 bp, Artificial Sequence
  chemically synthesized
ggttccttctgagggctcgg

SEQ ID NO: 101549 - DNA, 20 bp, Artificial Sequence
  chemically synthesized
agattctccttccgagccct

SEQ ID NO: 101550 - DNA, 20 bp, Artificial Sequence
  chemically synthesized
gttggttccttctgagggct

SEQ ID NO: 101551 - DNA, 20 bp, Artificial Sequence
  chemically synthesized
ttctccttccgagccctcag

SEQ ID NO: 101552 - DNA, 20 bp, Artificial Sequence
  chemically synthesized
tctccttccgagccctcaga

SEQ ID NO: 101553 - DNA, 20 bp, Artificial Sequence
  chemically synthesized
ggagggttggttccttctga

SEQ ID NO: 101554 - DNA, 20 bp, Artificial Sequence
  chemically synthesized
aggagggttggttccttctg

SEQ ID NO: 101555 - DNA, 20 bp, Artificial Sequence
  chemically synthesized
caggagggttggttccttct

SEQ ID NO: 101556 - DNA, 20 bp, Artificial Sequence
  chemically synthesized
gatcaaggtgtcaggagggt

SEQ ID NO: 101557 - DNA, 20 bp, Artificial Sequence
  chemically synthesized
ctgagatcaaggtgtcagga

SEQ ID NO: 101558 - DNA, 20 bp, Artificial Sequence
  chemically synthesized
tctgagatcaaggtgtcagg

SEQ ID NO: 101559 - DNA, 20 bp, Artificial Sequence
  chemically synthesized
gtctgagatcaaggtgtcag

SEQ ID NO: 101560 - DNA, 20 bp, Artificial Sequence
  chemically synthesized
aagtctgagatcaaggtgtc

SEQ ID NO: 101561 - DNA, 20 bp, Artificial Sequence
  chemically synthesized
gaagtctgagatcaaggtgt

SEQ ID NO: 101562 - DNA, 20 bp, Artificial Sequence
  chemically synthesized
ccctcctgacaccttgatct

SEQ ID NO: 101563 - DNA, 20 bp, Artificial Sequence
  chemically synthesized
aggatagaagtctgagatca

SEQ ID NO: 101564 - DNA, 20 bp, Artificial Sequence
  chemically synthesized
gaggatagaagtctgagatc

SEQ ID NO: 101565 - DNA, 20 bp, Artificial Sequence
  chemically synthesized
gttctggaggatagaagtct

SEQ ID NO: 101566 - DNA, 20 bp, Artificial Sequence
  chemically synthesized
cttacagttctggaggatag

SEQ ID NO: 101567 - DNA, 20 bp, Artificial Sequence
  chemically synthesized
gatctcagacttctatcctc

SEQ ID NO: 101568 - DNA, 20 bp, Artificial Sequence
  chemically synthesized
tgtcttacagttctggagga

SEQ ID NO: 101569 - DNA, 20 bp, Artificial Sequence
  chemically synthesized
ctgttgtcttacagttctgg

SEQ ID NO: 101570 - DNA, 20 bp, Artificial Sequence
  chemically synthesized
tctgttgtcttacagttctg

SEQ ID NO: 101571 - DNA, 20 bp, Artificial Sequence
  chemically synthesized
cttctatcctccagaactgt

SEQ ID NO: 101572 - DNA, 20 bp, Artificial Sequence
  chemically synthesized
agtctgttgtcttacagttc

SEQ ID NO: 101573 - DNA, 20 bp, Artificial Sequence
  chemically synthesized
aaaagaagtctgttgtctta

SEQ ID NO: 101574 - DNA, 20 bp, Artificial Sequence
  chemically synthesized
cctccagaactgtaagacaa

SEQ ID NO: 101575 - DNA, 20 bp, Artificial Sequence
  chemically synthesized
gtaagacaacagacttcttt

SEQ ID NO: 101576 - DNA, 20 bp, Artificial Sequence
  chemically synthesized
ctggatgacttaaccaaaag

SEQ ID NO: 101577 - DNA, 20 bp, Artificial Sequence
  chemically synthesized
acaacagacttcttttggtt

SEQ ID NO: 101578 - DNA, 20 bp, Artificial Sequence
  chemically synthesized
aaactggatgacttaaccaa

SEQ ID NO: 101579 - DNA, 20 bp, Artificial Sequence
  chemically synthesized
cttcttttggttaagtcatc

SEQ ID NO: 101580 - DNA, 20 bp, Artificial Sequence
  chemically synthesized
tggttaagtcatccagtttg

SEQ ID NO: 101581 - DNA, 20 bp, Artificial Sequence
  chemically synthesized
aatagtgaaataccacaaac

SEQ ID NO: 101582 - DNA, 20 bp, Artificial Sequence
  chemically synthesized
tttgtggtatttcactattg

SEQ ID NO: 101583 - DNA, 20 bp, Artificial Sequence
  chemically synthesized
tttgtttcctatgactgcaa

SEQ ID NO: 101584 - DNA, 20 bp, Artificial Sequence
  chemically synthesized
gtatttcactattgcagtca

SEQ ID NO: 101585 - DNA, 20 bp, Artificial Sequence
  chemically synthesized
tatttcactattgcagtcat

SEQ ID NO: 101586 - DNA, 20 bp, Artificial Sequence
  chemically synthesized
ttttcctgtatcagtacata

SEQ ID NO: 101587 - DNA, 20 bp, Artificial Sequence
  chemically synthesized
acattctttatgtactgata

SEQ ID NO: 101588 - DNA, 20 bp, Artificial Sequence
  chemically synthesized
cattctttatgtactgatac

SEQ ID NO: 101589 - DNA, 20 bp, Artificial Sequence
  chemically synthesized
tcttggacattttcctgtat

SEQ ID NO: 101590 - DNA, 20 bp, Artificial Sequence
  chemically synthesized
actgatacaggaaaatgtcc

SEQ ID NO: 101591 - DNA, 20 bp, Artificial Sequence
  chemically synthesized
tctctctcaacaatgtttct

SEQ ID NO: 101592 - DNA, 20 bp, Artificial Sequence
  chemically synthesized
aatgtccaagaaacattgtt

SEQ ID NO: 101593 - DNA, 20 bp, Artificial Sequence
  chemically synthesized
tgtccaagaaacattgttga

SEQ ID NO: 101594 - DNA, 20 bp, Artificial Sequence
  chemically synthesized
tccaagaaacattgttgaga

SEQ ID NO: 101595 - DNA, 20 bp, Artificial Sequence
  chemically synthesized
aagaaacattgttgagagag

SEQ ID NO: 101596 - DNA, 20 bp, Artificial Sequence
  chemically synthesized
gttgagagagaagcataatt

SEQ ID NO: 101597 - DNA, 20 bp, Artificial Sequence
  chemically synthesized
gagagagaagcataattcag

SEQ ID NO: 101598 - DNA, 20 bp, Artificial Sequence
  chemically synthesized
atgcatctttacattaatgg

SEQ ID NO: 101599 - DNA, 20 bp, Artificial Sequence
  chemically synthesized
tatatgcatctttacattaa

SEQ ID NO: 101600 - DNA, 20 bp, Artificial Sequence
  chemically synthesized
cgtatgctaccattaatgta

SEQ ID NO: 101601 - DNA, 20 bp, Artificial Sequence
  chemically synthesized
aatgtaaagatgcatatata

SEQ ID NO: 101602 - DNA, 20 bp, Artificial Sequence
  chemically synthesized
agatgcatatatatagaaaa

SEQ ID NO: 101603 - DNA, 20 bp, Artificial Sequence
  chemically synthesized
aatttcaagcgaatatgcat

SEQ ID NO: 101604 - DNA, 20 bp, Artificial Sequence
  chemically synthesized
aggagatatgtacgaatttc

SEQ ID NO: 101605 - DNA, 20 bp, Artificial Sequence
  chemically synthesized
aaattcgtacatatctcctg

SEQ ID NO: 101606 - DNA, 20 bp, Artificial Sequence
  chemically synthesized
aattcgtacatatctcctga

SEQ ID NO: 101607 - DNA, 20 bp, Artificial Sequence
  chemically synthesized
gctgtttgtatatccttcag

SEQ ID NO: 101608 - DNA, 20 bp, Artificial Sequence
  chemically synthesized
cagctgtttgtatatccttc

SEQ ID NO: 101609 - DNA, 20 bp, Artificial Sequence
  chemically synthesized
tcagctgtttgtatatcctt

SEQ ID NO: 101610 - DNA, 20 bp, Artificial Sequence
  chemically synthesized
tctcctgaaggatatacaaa

SEQ ID NO: 101611 - DNA, 20 bp, Artificial Sequence
  chemically synthesized
ccaccaccaatcagtattgt

SEQ ID NO: 101612 - DNA, 20 bp, Artificial Sequence
  chemically synthesized
aaacagctgacaatactgat

SEQ ID NO: 101613 - DNA, 20 bp, Artificial Sequence
  chemically synthesized
cagctgacaatactgattgg

SEQ ID NO: 101614 - DNA, 20 bp, Artificial Sequence
  chemically synthesized
ttcccctacccaccaccaat

SEQ ID NO: 101615 - DNA, 20 bp, Artificial Sequence
  chemically synthesized
ctgacaatactgattggtgg

SEQ ID NO: 101616 - DNA, 20 bp, Artificial Sequence
  chemically synthesized
tgacaatactgattggtggt

SEQ ID NO: 101617 - DNA, 20 bp, Artificial Sequence
  chemically synthesized
caatactgattggtggtggg

SEQ ID NO: 101618 - DNA, 20 bp, Artificial Sequence
  chemically synthesized
aatactgattggtggtgggt

SEQ ID NO: 101619 - DNA, 20 bp, Artificial Sequence
  chemically synthesized
atactgattggtggtgggta

SEQ ID NO: 101620 - DNA, 20 bp, Artificial Sequence
  chemically synthesized
tactgattggtggtgggtag

SEQ ID NO: 101621 - DNA, 20 bp, Artificial Sequence
  chemically synthesized
gggtaggggaattgattcga

SEQ ID NO: 101622 - DNA, 20 bp, Artificial Sequence
  chemically synthesized
ggaattgattcgacagtgca

SEQ ID NO: 101623 - DNA, 20 bp, Artificial Sequence
  chemically synthesized
aattgattcgacagtgcata

SEQ ID NO: 101624 - DNA, 20 bp, Artificial Sequence
  chemically synthesized
attgattcgacagtgcatag

SEQ ID NO: 101625 - DNA, 20 bp, Artificial Sequence
  chemically synthesized
gattcgacagtgcatagagg

SEQ ID NO: 101626 - DNA, 20 bp, Artificial Sequence
  chemically synthesized
attcgacagtgcatagaggt

SEQ ID NO: 101627 - DNA, 20 bp, Artificial Sequence
  chemically synthesized
tcgacagtgcatagaggtag

SEQ ID NO: 101628 - DNA, 20 bp, Artificial Sequence
  chemically synthesized
aaaaatgaaaatttacaaaa

SEQ ID NO: 101629 - DNA, 20 bp, Artificial Sequence
  chemically synthesized
caaaaatgaaaatttacaaa

SEQ ID NO: 101630 - DNA, 20 bp, Artificial Sequence
  chemically synthesized
gaatcatcaaaatgatcacc

SEQ ID NO: 101631 - DNA, 20 bp, Artificial Sequence
  chemically synthesized
tcatcaaaatgatcacctag

SEQ ID NO: 101632 - DNA, 20 bp, Artificial Sequence
  chemically synthesized
aattttacttattttccact

SEQ ID NO: 101633 - DNA, 20 bp, Artificial Sequence
  chemically synthesized
taattttacttattttccac

SEQ ID NO: 101634 - DNA, 20 bp, Artificial Sequence
  chemically synthesized
atgatcacctagtggaaaat

SEQ ID NO: 101635 - DNA, 20 bp, Artificial Sequence
  chemically synthesized
aaaattaaaaacaatcaaat

SEQ ID NO: 101636 - DNA, 20 bp, Artificial Sequence
  chemically synthesized
aagaaagctgataatttagg

SEQ ID NO: 101637 - DNA, 20 bp, Artificial Sequence
  chemically synthesized
aaagaaagctgataatttag

SEQ ID NO: 101638 - DNA, 20 bp, Artificial Sequence
  chemically synthesized
aaaagaaagctgataattta

SEQ ID NO: 101639 - DNA, 20 bp, Artificial Sequence
  chemically synthesized
aataagaccccctaaattat

SEQ ID NO: 101640 - DNA, 20 bp, Artificial Sequence
  chemically synthesized
aaaaagaaagctgataattt

SEQ ID NO: 101641 - DNA, 20 bp, Artificial Sequence
  chemically synthesized
taaaaagaaagctgataatt

SEQ ID NO: 101642 - DNA, 20 bp, Artificial Sequence
  chemically synthesized
taattaagatagtaaaaaga

SEQ ID NO: 101643 - DNA, 20 bp, Artificial Sequence
  chemically synthesized
gatttaattaagatagtaaa

SEQ ID NO: 101644 - DNA, 20 bp, Artificial Sequence
  chemically synthesized
gttatctgatttaattaaga

SEQ ID NO: 101645 - DNA, 20 bp, Artificial Sequence
  chemically synthesized
tcaagttatctgatttaatt

SEQ ID NO: 101646 - DNA, 20 bp, Artificial Sequence
  chemically synthesized
ttttactatcttaattaaat

SEQ ID NO: 101647 - DNA, 20 bp, Artificial Sequence
  chemically synthesized
attaaatcagataacttgaa

SEQ ID NO: 101648 - DNA, 20 bp, Artificial Sequence
  chemically synthesized
gtacaaaagaagatctgttc

SEQ ID NO: 101649 - DNA, 20 bp, Artificial Sequence
  chemically synthesized
ccacacagaaagtacaaaag

SEQ ID NO: 101650 - DNA, 20 bp, Artificial Sequence
  chemically synthesized
tttccacacagaaagtacaa

SEQ ID NO: 101651 - DNA, 20 bp, Artificial Sequence
  chemically synthesized
cttcttttgtactttctgtg

SEQ ID NO: 101652 - DNA, 20 bp, Artificial Sequence
  chemically synthesized
gatataactttccacacaga

SEQ ID NO: 101653 - DNA, 20 bp, Artificial Sequence
  chemically synthesized
ttttgtactttctgtgtgga

SEQ ID NO: 101654 - DNA, 20 bp, Artificial Sequence
  chemically synthesized
gtctgatataactttccaca

SEQ ID NO: 101655 - DNA, 20 bp, Artificial Sequence
  chemically synthesized
ttctgtgtggaaagttatat

SEQ ID NO: 101656 - DNA, 20 bp, Artificial Sequence
  chemically synthesized
tactttgtattaacatgttt

SEQ ID NO: 101657 - DNA, 20 bp, Artificial Sequence
  chemically synthesized
gactgaaacatgttaataca

SEQ ID NO: 101658 - DNA, 20 bp, Artificial Sequence
  chemically synthesized
taatacaaagtatttgcata

SEQ ID NO: 101659 - DNA, 20 bp, Artificial Sequence
  chemically synthesized
aaagtatttgcatatagaca

SEQ ID NO: 101660 - DNA, 20 bp, Artificial Sequence
  chemically synthesized
tgagtaaatgggaaagatag

SEQ ID NO: 101661 - DNA, 20 bp, Artificial Sequence
  chemically synthesized
ctgagtaaatgggaaagata

SEQ ID NO: 101662 - DNA, 20 bp, Artificial Sequence
  chemically synthesized
gtctgagtaaatgggaaaga

SEQ ID NO: 101663 - DNA, 20 bp, Artificial Sequence
  chemically synthesized
tgttgtctgagtaaatggga

SEQ ID NO: 101664 - DNA, 20 bp, Artificial Sequence
  chemically synthesized
ctctatctttcccatttact

SEQ ID NO: 101665 - DNA, 20 bp, Artificial Sequence
  chemically synthesized
aagttgttgtctgagtaaat

SEQ ID NO: 101666 - DNA, 20 bp, Artificial Sequence
  chemically synthesized
aaagttgttgtctgagtaaa

SEQ ID NO: 101667 - DNA, 20 bp, Artificial Sequence
  chemically synthesized
cattgtaaaagttgttgtct

SEQ ID NO: 101668 - DNA, 20 bp, Artificial Sequence
  chemically synthesized
aacacatgttaacattgtaa

SEQ ID NO: 101669 - DNA, 20 bp, Artificial Sequence
  chemically synthesized
catgtgttcaacattgcttg

SEQ ID NO: 101670 - DNA, 20 bp, Artificial Sequence
  chemically synthesized
tttaactcccatattacttc

SEQ ID NO: 101671 - DNA, 20 bp, Artificial Sequence
  chemically synthesized
caacattgcttgaagtaata

SEQ ID NO: 101672 - DNA, 20 bp, Artificial Sequence
  chemically synthesized
aacattgcttgaagtaatat

SEQ ID NO: 101673 - DNA, 20 bp, Artificial Sequence
  chemically synthesized
cattgcttgaagtaatatgg

SEQ ID NO: 101674 - DNA, 20 bp, Artificial Sequence
  chemically synthesized
tgaagtaatatgggagttaa

SEQ ID NO: 101675 - DNA, 20 bp, Artificial Sequence
  chemically synthesized
tatgggagttaaaagaatac

SEQ ID NO: 101676 - DNA, 20 bp, Artificial Sequence
  chemically synthesized
aagagcttctgtaatacaga

SEQ ID NO: 101677 - DNA, 20 bp, Artificial Sequence
  chemically synthesized
aagacatactttctgtatta

SEQ ID NO: 101678 - DNA, 20 bp, Artificial Sequence
  chemically synthesized
agttaagagcttctgtaata

SEQ ID NO: 101679 - DNA, 20 bp, Artificial Sequence
  chemically synthesized
acatactttctgtattacag

SEQ ID NO: 101680 - DNA, 20 bp, Artificial Sequence
  chemically synthesized
tattacagaagctcttaact

SEQ ID NO: 101681 - DNA, 20 bp, Artificial Sequence
  chemically synthesized
tttctccatcactcagttaa

SEQ ID NO: 101682 - DNA, 20 bp, Artificial Sequence
  chemically synthesized
cttttctccatcactcagtt

SEQ ID NO: 101683 - DNA, 20 bp, Artificial Sequence
  chemically synthesized
agaagctcttaactgagtga

SEQ ID NO: 101684 - DNA, 20 bp, Artificial Sequence
  chemically synthesized
aagctcttaactgagtgatg

SEQ ID NO: 101685 - DNA, 20 bp, Artificial Sequence
  chemically synthesized
tttttcttttctccatcact

SEQ ID NO: 101686 - DNA, 20 bp, Artificial Sequence
  chemically synthesized
cttaactgagtgatggagaa

SEQ ID NO: 101687 - DNA, 20 bp, Artificial Sequence
  chemically synthesized
agtgatggagaaaagaaaaa

SEQ ID NO: 101688 - DNA, 20 bp, Artificial Sequence
  chemically synthesized
ggagaaaagaaaaaaagact

SEQ ID NO: 101689 - DNA, 20 bp, Artificial Sequence
  chemically synthesized
gagaaaagaaaaaaagactt

SEQ ID NO: 101690 - DNA, 20 bp, Artificial Sequence
  chemically synthesized
aagaaaaaaagacttaggtg

SEQ ID NO: 101691 - DNA, 20 bp, Artificial Sequence
  chemically synthesized
cttactttcatgcttcacct

SEQ ID NO: 101692 - DNA, 20 bp, Artificial Sequence
  chemically synthesized
aagacttaggtgaagcatga

SEQ ID NO: 101693 - DNA, 20 bp, Artificial Sequence
  chemically synthesized
cttaggtgaagcatgaaagt

SEQ ID NO: 101694 - DNA, 20 bp, Artificial Sequence
  chemically synthesized
agcatgaaagtaagtcactt

SEQ ID NO: 101695 - DNA, 20 bp, Artificial Sequence
  chemically synthesized
aaacaggcacaaagaaactg

SEQ ID NO: 101696 - DNA, 20 bp, Artificial Sequence
  chemically synthesized
ctgttgagaaaacaggcaca

SEQ ID NO: 101697 - DNA, 20 bp, Artificial Sequence
  chemically synthesized
tattttactgttgagaaaac

SEQ ID NO: 101698 - DNA, 20 bp, Artificial Sequence
  chemically synthesized
ttattttactgttgagaaaa

SEQ ID NO: 101699 - DNA, 20 bp, Artificial Sequence
  chemically synthesized
ctttgtgcctgttttctcaa

SEQ ID NO: 101700 - DNA, 20 bp, Artificial Sequence
  chemically synthesized
tcatttgttattttactgtt

SEQ ID NO: 101701 - DNA, 20 bp, Artificial Sequence
  chemically synthesized
tcaacagtaaaataacaaat

SEQ ID NO: 101702 - DNA, 20 bp, Artificial Sequence
  chemically synthesized
aatgagataaatgactgttg

SEQ ID NO: 101703 - DNA, 20 bp, Artificial Sequence
  chemically synthesized
cagaaattttaagacttcaa

SEQ ID NO: 101704 - DNA, 20 bp, Artificial Sequence
  chemically synthesized
taaaacaattcagaaatttt

SEQ ID NO: 101705 - DNA, 20 bp, Artificial Sequence
  chemically synthesized
aaaaaacaaataaaacaatt

SEQ ID NO: 101706 - DNA, 20 bp, Artificial Sequence
  chemically synthesized
gttttttgaaattacacttt

SEQ ID NO: 101707 - DNA, 20 bp, Artificial Sequence
  chemically synthesized
tacaattatctcaaaactaa

SEQ ID NO: 101708 - DNA, 20 bp, Artificial Sequence
  chemically synthesized
gaaattacacttttagtttt

SEQ ID NO: 101709 - DNA, 20 bp, Artificial Sequence
  chemically synthesized
gataattgtatgttcacatg

SEQ ID NO: 101710 - DNA, 20 bp, Artificial Sequence
  chemically synthesized
gtatgttcacatgtagttgt

SEQ ID NO: 101711 - DNA, 20 bp, Artificial Sequence
  chemically synthesized
tgtagttgtgagaaataata

SEQ ID NO: 101712 - DNA, 20 bp, Artificial Sequence
  chemically synthesized
tagttgtgagaaataataca

SEQ ID NO: 101713 - DNA, 20 bp, Artificial Sequence
  chemically synthesized
agaaataatacagagaaaac

SEQ ID NO: 101714 - DNA, 20 bp, Artificial Sequence
  chemically synthesized
agacggggtcaggggtatac

SEQ ID NO: 101715 - DNA, 20 bp, Artificial Sequence
  chemically synthesized
cttcagggagacggggtcag

SEQ ID NO: 101716 - DNA, 20 bp, Artificial Sequence
  chemically synthesized
ccttcagggagacggggtca

SEQ ID NO: 101717 - DNA, 20 bp, Artificial Sequence
  chemically synthesized
accttcagggagacggggtc

SEQ ID NO: 101718 - DNA, 20 bp, Artificial Sequence
  chemically synthesized
taccttcagggagacggggt

SEQ ID NO: 101719 - DNA, 20 bp, Artificial Sequence
  chemically synthesized
gttttaccttcagggagacg

SEQ ID NO: 101720 - DNA, 20 bp, Artificial Sequence
  chemically synthesized
ggttttaccttcagggagac

SEQ ID NO: 101721 - DNA, 20 bp, Artificial Sequence
  chemically synthesized
aggttttaccttcagggaga

SEQ ID NO: 101722 - DNA, 20 bp, Artificial Sequence
  chemically synthesized
cccctgaccccgtctccctg

SEQ ID NO: 101723 - DNA, 20 bp, Artificial Sequence
  chemically synthesized
ccctgaccccgtctccctga

SEQ ID NO: 101724 - DNA, 20 bp, Artificial Sequence
  chemically synthesized
tgcaaggttttaccttcagg

SEQ ID NO: 101725 - DNA, 20 bp, Artificial Sequence
  chemically synthesized
tttgcaaggttttaccttca

SEQ ID NO: 101726 - DNA, 20 bp, Artificial Sequence
  chemically synthesized
ttttgcaaggttttaccttc

SEQ ID NO: 101727 - DNA, 20 bp, Artificial Sequence
  chemically synthesized
tttttgcaaggttttacctt

SEQ ID NO: 101728 - DNA, 20 bp, Artificial Sequence
  chemically synthesized
tattgtactatatttttgca

SEQ ID NO: 101729 - DNA, 20 bp, Artificial Sequence
  chemically synthesized
atattgtactatatttttgc

SEQ ID NO: 101730 - DNA, 20 bp, Artificial Sequence
  chemically synthesized
ggtaaaaccttgcaaaaata

SEQ ID NO: 101731 - DNA, 20 bp, Artificial Sequence
  chemically synthesized
atatagtacaatatcataac

SEQ ID NO: 101732 - DNA, 20 bp, Artificial Sequence
  chemically synthesized
tatagtacaatatcataacc

SEQ ID NO: 101733 - DNA, 20 bp, Artificial Sequence
  chemically synthesized
ttgtgtcaatgtcaatatcc

SEQ ID NO: 101734 - DNA, 20 bp, Artificial Sequence
  chemically synthesized
atattgacattgacacaatc

SEQ ID NO: 101735 - DNA, 20 bp, Artificial Sequence
  chemically synthesized
tattgacattgacacaatca

SEQ ID NO: 101736 - DNA, 20 bp, Artificial Sequence
  chemically synthesized
acattgacacaatcaaggta

SEQ ID NO: 101737 - DNA, 20 bp, Artificial Sequence
  chemically synthesized
gacacaatcaaggtaaagaa

SEQ ID NO: 101738 - DNA, 20 bp, Artificial Sequence
  chemically synthesized
aagaacagttccaacactac

SEQ ID NO: 101739 - DNA, 20 bp, Artificial Sequence
  chemically synthesized
aggaggcatccttgtagtgt

SEQ ID NO: 101740 - DNA, 20 bp, Artificial Sequence
  chemically synthesized
agaacagttccaacactaca

SEQ ID NO: 101741 - DNA, 20 bp, Artificial Sequence
  chemically synthesized
caacacaggaggcatccttg

SEQ ID NO: 101742 - DNA, 20 bp, Artificial Sequence
  chemically synthesized
ctccaaaagggcaacacagg

SEQ ID NO: 101743 - DNA, 20 bp, Artificial Sequence
  chemically synthesized
actccaaaagggcaacacag

SEQ ID NO: 101744 - DNA, 20 bp, Artificial Sequence
  chemically synthesized
tgactccaaaagggcaacac

SEQ ID NO: 101745 - DNA, 20 bp, Artificial Sequence
  chemically synthesized
gtgactccaaaagggcaaca

SEQ ID NO: 101746 - DNA, 20 bp, Artificial Sequence
  chemically synthesized
tgcctcctgtgttgcccttt

SEQ ID NO: 101747 - DNA, 20 bp, Artificial Sequence
  chemically synthesized
cctcctgtgttgcccttttg

SEQ ID NO: 101748 - DNA, 20 bp, Artificial Sequence
  chemically synthesized
agatggatgtgactccaaaa

SEQ ID NO: 101749 - DNA, 20 bp, Artificial Sequence
  chemically synthesized
gagatggatgtgactccaaa

SEQ ID NO: 101750 - DNA, 20 bp, Artificial Sequence
  chemically synthesized
agagatggatgtgactccaa

SEQ ID NO: 101751 - DNA, 20 bp, Artificial Sequence
  chemically synthesized
gggaaagagagagagagaga

SEQ ID NO: 101752 - DNA, 20 bp, Artificial Sequence
  chemically synthesized
acaggggaaagagagagaga

SEQ ID NO: 101753 - DNA, 20 bp, Artificial Sequence
  chemically synthesized
caacaggggaaagagagaga

SEQ ID NO: 101754 - DNA, 20 bp, Artificial Sequence
  chemically synthesized
gacaacaggggaaagagaga

SEQ ID NO: 101755 - DNA, 20 bp, Artificial Sequence
  chemically synthesized
gggacaacaggggaaagaga

SEQ ID NO: 101756 - DNA, 20 bp, Artificial Sequence
  chemically synthesized
ccgggacaacaggggaaaga

SEQ ID NO: 101757 - DNA, 20 bp, Artificial Sequence
  chemically synthesized
gtccgggacaacaggggaaa

SEQ ID NO: 101758 - DNA, 20 bp, Artificial Sequence
  chemically synthesized
gagtccgggacaacagggga

SEQ ID NO: 101759 - DNA, 20 bp, Artificial Sequence
  chemically synthesized
caaggagtccgggacaacag

SEQ ID NO: 101760 - DNA, 20 bp, Artificial Sequence
  chemically synthesized
gcaaggagtccgggacaaca

SEQ ID NO: 101761 - DNA, 20 bp, Artificial Sequence
  chemically synthesized
ctctctttcccctgttgtcc

SEQ ID NO: 101762 - DNA, 20 bp, Artificial Sequence
  chemically synthesized
tgcaaggagtccgggacaac

SEQ ID NO: 101763 - DNA, 20 bp, Artificial Sequence
  chemically synthesized
ttgcaaggagtccgggacaa

SEQ ID NO: 101764 - DNA, 20 bp, Artificial Sequence
  chemically synthesized
ttggtgattgcaaggagtcc

SEQ ID NO: 101765 - DNA, 20 bp, Artificial Sequence
  chemically synthesized
attggtgattgcaaggagtc

SEQ ID NO: 101766 - DNA, 20 bp, Artificial Sequence
  chemically synthesized
aacagattggtgattgcaag

SEQ ID NO: 101767 - DNA, 20 bp, Artificial Sequence
  chemically synthesized
agaacagattggtgattgca

SEQ ID NO: 101768 - DNA, 20 bp, Artificial Sequence
  chemically synthesized
aagaacagattggtgattgc

SEQ ID NO: 101769 - DNA, 20 bp, Artificial Sequence
  chemically synthesized
ttaaagaatgaagaacagat

SEQ ID NO: 101770 - DNA, 20 bp, Artificial Sequence
  chemically synthesized
cagaattaaagaatgaagaa

SEQ ID NO: 101771 - DNA, 20 bp, Artificial Sequence
  chemically synthesized
agtgacagaattaaagaatg

SEQ ID NO: 101772 - DNA, 20 bp, Artificial Sequence
  chemically synthesized
gtcttgaagtgacagaatta

SEQ ID NO: 101773 - DNA, 20 bp, Artificial Sequence
  chemically synthesized
ttctttaattctgtcacttc

SEQ ID NO: 101774 - DNA, 20 bp, Artificial Sequence
  chemically synthesized
atatagccgtcttgaagtga

SEQ ID NO: 101775 - DNA, 20 bp, Artificial Sequence
  chemically synthesized
ttaattctgtcacttcaaga

SEQ ID NO: 101776 - DNA, 20 bp, Artificial Sequence
  chemically synthesized
ctgtttatatagccgtcttg

SEQ ID NO: 101777 - DNA, 20 bp, Artificial Sequence
  chemically synthesized
cttcaagacggctatataaa

SEQ ID NO: 101778 - DNA, 20 bp, Artificial Sequence
  chemically synthesized
aatgaatgattctgtttata

SEQ ID NO: 101779 - DNA, 20 bp, Artificial Sequence
  chemically synthesized
cattcattatgtaacctttt

SEQ ID NO: 101780 - DNA, 20 bp, Artificial Sequence
  chemically synthesized
taaaaacagctcatctgaaa

SEQ ID NO: 101781 - DNA, 20 bp, Artificial Sequence
  chemically synthesized
attatgtaaccttttcagat

SEQ ID NO: 101782 - DNA, 20 bp, Artificial Sequence
  chemically synthesized
gtaaaaacagctcatctgaa

SEQ ID NO: 101783 - DNA, 20 bp, Artificial Sequence
  chemically synthesized
agaattatgctgagtaaaaa

SEQ ID NO: 101784 - DNA, 20 bp, Artificial Sequence
  chemically synthesized
tcagatgagctgtttttact

SEQ ID NO: 101785 - DNA, 20 bp, Artificial Sequence
  chemically synthesized
aatctccacagaattatgct

SEQ ID NO: 101786 - DNA, 20 bp, Artificial Sequence
  chemically synthesized
ttttactcagcataattctg

SEQ ID NO: 101787 - DNA, 20 bp, Artificial Sequence
  chemically synthesized
ttactcagcataattctgtg

SEQ ID NO: 101788 - DNA, 20 bp, Artificial Sequence
  chemically synthesized
aacttttagatcaatctcca

SEQ ID NO: 101789 - DNA, 20 bp, Artificial Sequence
  chemically synthesized
ttctgtggagattgatctaa

SEQ ID NO: 101790 - DNA, 20 bp, Artificial Sequence
  chemically synthesized
tttatacatgcaacaacttt

SEQ ID NO: 101791 - DNA, 20 bp, Artificial Sequence
  chemically synthesized
aatactattcagcaataaaa

SEQ ID NO: 101792 - DNA, 20 bp, Artificial Sequence
  chemically synthesized
cattccattttattgctgaa

SEQ ID NO: 101793 - DNA, 20 bp, Artificial Sequence
  chemically synthesized
acataccaggcaatactatt

SEQ ID NO: 101794 - DNA, 20 bp, Artificial Sequence
  chemically synthesized
tattgctgaatagtattgcc

SEQ ID NO: 101795 - DNA, 20 bp, Artificial Sequence
  chemically synthesized
acggtacatccatacatacc

SEQ ID NO: 101796 - DNA, 20 bp, Artificial Sequence
  chemically synthesized
atagtattgcctggtatgta

SEQ ID NO: 101797 - DNA, 20 bp, Artificial Sequence
  chemically synthesized
tacggtacatccatacatac

SEQ ID NO: 101798 - DNA, 20 bp, Artificial Sequence
  chemically synthesized
tggtatgtatggatgtaccg

SEQ ID NO: 101799 - DNA, 20 bp, Artificial Sequence
  chemically synthesized
atgaatggttgtacaaacta

SEQ ID NO: 101800 - DNA, 20 bp, Artificial Sequence
  chemically synthesized
cccagacggtcaacaatgaa

SEQ ID NO: 101801 - DNA, 20 bp, Artificial Sequence
  chemically synthesized
accattcattgttgaccgtc

SEQ ID NO: 101802 - DNA, 20 bp, Artificial Sequence
  chemically synthesized
ccattcattgttgaccgtct

SEQ ID NO: 101803 - DNA, 20 bp, Artificial Sequence
  chemically synthesized
aaaactggaaagaacccaga

SEQ ID NO: 101804 - DNA, 20 bp, Artificial Sequence
  chemically synthesized
gccaaaaactggaaagaacc

SEQ ID NO: 101805 - DNA, 20 bp, Artificial Sequence
  chemically synthesized
ttgaccgtctgggttctttc

SEQ ID NO: 101806 - DNA, 20 bp, Artificial Sequence
  chemically synthesized
cattatagccaaaaactgga

SEQ ID NO: 101807 - DNA, 20 bp, Artificial Sequence
  chemically synthesized
tctgggttctttccagtttt

SEQ ID NO: 101808 - DNA, 20 bp, Artificial Sequence
  chemically synthesized
tattcattatagccaaaaac

SEQ ID NO: 101809 - DNA, 20 bp, Artificial Sequence
  chemically synthesized
cataccaccattattcatta

SEQ ID NO: 101810 - DNA, 20 bp, Artificial Sequence
  chemically synthesized
tttttggctataatgaataa

SEQ ID NO: 101811 - DNA, 20 bp, Artificial Sequence
  chemically synthesized
ttggctataatgaataatgg

SEQ ID NO: 101812 - DNA, 20 bp, Artificial Sequence
  chemically synthesized
gtggtatgaatatttttgta

SEQ ID NO: 101813 - DNA, 20 bp, Artificial Sequence
  chemically synthesized
tggtatgaatatttttgtac

SEQ ID NO: 101814 - DNA, 20 bp, Artificial Sequence
  chemically synthesized
aatatttttgtacaggttgt

SEQ ID NO: 101815 - DNA, 20 bp, Artificial Sequence
  chemically synthesized
aggttgtaagataaatgtcc

SEQ ID NO: 101816 - DNA, 20 bp, Artificial Sequence
  chemically synthesized
gttgtaagataaatgtccaa

SEQ ID NO: 101817 - DNA, 20 bp, Artificial Sequence
  chemically synthesized
caacccagcaattgcactct

SEQ ID NO: 101818 - DNA, 20 bp, Artificial Sequence
  chemically synthesized
atgtccaagagtgcaattgc

SEQ ID NO: 101819 - DNA, 20 bp, Artificial Sequence
  chemically synthesized
tgtccaagagtgcaattgct

SEQ ID NO: 101820 - DNA, 20 bp, Artificial Sequence
  chemically synthesized
agtgcaattgctgggttgta

SEQ ID NO: 101821 - DNA, 20 bp, Artificial Sequence
  chemically synthesized
catgcagctaccatacaacc

SEQ ID NO: 101822 - DNA, 20 bp, Artificial Sequence
  chemically synthesized
gcaattgctgggttgtatgg

SEQ ID NO: 101823 - DNA, 20 bp, Artificial Sequence
  chemically synthesized
ttgtatggtagctgcatgtt

SEQ ID NO: 101824 - DNA, 20 bp, Artificial Sequence
  chemically synthesized
tttctgtaaaactaaacatg

SEQ ID NO: 101825 - DNA, 20 bp, Artificial Sequence
  chemically synthesized
tagctgcatgtttagtttta

SEQ ID NO: 101826 - DNA, 20 bp, Artificial Sequence
  chemically synthesized
ttttacagaaaattgataaa

SEQ ID NO: 101827 - DNA, 20 bp, Artificial Sequence
  chemically synthesized
aattgataaacagtttgcta

SEQ ID NO: 101828 - DNA, 20 bp, Artificial Sequence
  chemically synthesized
tgataaacagtttgctacag

SEQ ID NO: 101829 - DNA, 20 bp, Artificial Sequence
  chemically synthesized
gtaaaatggtacagccactg

SEQ ID NO: 101830 - DNA, 20 bp, Artificial Sequence
  chemically synthesized
ggtggaaatgtaaaatggta

SEQ ID NO: 101831 - DNA, 20 bp, Artificial Sequence
  chemically synthesized
ttgctggtggaaatgtaaaa

SEQ ID NO: 101832 - DNA, 20 bp, Artificial Sequence
  chemically synthesized
gtaccattttacatttccac

SEQ ID NO: 101833 - DNA, 20 bp, Artificial Sequence
  chemically synthesized
gatcattcacatattgctgg

SEQ ID NO: 101834 - DNA, 20 bp, Artificial Sequence
  chemically synthesized
atggatcattcacatattgc

SEQ ID NO: 101835 - DNA, 20 bp, Artificial Sequence
  chemically synthesized
tagcaaggatgtggagaaaa

SEQ ID NO: 101836 - DNA, 20 bp, Artificial Sequence
  chemically synthesized
cagatgctagcaaggatgtg

SEQ ID NO: 101837 - DNA, 20 bp, Artificial Sequence
  chemically synthesized
accagatgctagcaaggatg

SEQ ID NO: 101838 - DNA, 20 bp, Artificial Sequence
  chemically synthesized
cattttctccacatccttgc

SEQ ID NO: 101839 - DNA, 20 bp, Artificial Sequence
  chemically synthesized
tacaacaccagatgctagca

SEQ ID NO: 101840 - DNA, 20 bp, Artificial Sequence
  chemically synthesized
ttacaacaccagatgctagc

SEQ ID NO: 101841 - DNA, 20 bp, Artificial Sequence
  chemically synthesized
tccacatccttgctagcatc

SEQ ID NO: 101842 - DNA, 20 bp, Artificial Sequence
  chemically synthesized
gtagttacaacaccagatgc

SEQ ID NO: 101843 - DNA, 20 bp, Artificial Sequence
  chemically synthesized
aaacaaagtagttacaacac

SEQ ID NO: 101844 - DNA, 20 bp, Artificial Sequence
  chemically synthesized
tcagaatggctaaaacaaag

SEQ ID NO: 101845 - DNA, 20 bp, Artificial Sequence
  chemically synthesized
gtgttgtaactactttgttt

SEQ ID NO: 101846 - DNA, 20 bp, Artificial Sequence
  chemically synthesized
ctatcagaatggctaaaaca

SEQ ID NO: 101847 - DNA, 20 bp, Artificial Sequence
  chemically synthesized
ctttgttttagccattctga

SEQ ID NO: 101848 - DNA, 20 bp, Artificial Sequence
  chemically synthesized
ttcctacacatctatcagaa

SEQ ID NO: 101849 - DNA, 20 bp, Artificial Sequence
  chemically synthesized
atatattcctacacatctat

SEQ ID NO: 101850 - DNA, 20 bp, Artificial Sequence
  chemically synthesized
tagccattctgatagatgtg

SEQ ID NO: 101851 - DNA, 20 bp, Artificial Sequence
  chemically synthesized
agccattctgatagatgtgt

SEQ ID NO: 101852 - DNA, 20 bp, Artificial Sequence
  chemically synthesized
tttaatttgcatttctctaa

SEQ ID NO: 101853 - DNA, 20 bp, Artificial Sequence
  chemically synthesized
atcaaaaacattagccatta

SEQ ID NO: 101854 - DNA, 20 bp, Artificial Sequence
  chemically synthesized
ttatcaaaaacattagccat

SEQ ID NO: 101855 - DNA, 20 bp, Artificial Sequence
  chemically synthesized
gaaaagattatcaaaaacat

SEQ ID NO: 101856 - DNA, 20 bp, Artificial Sequence
  chemically synthesized
atagcaaataggtgcatgaa

SEQ ID NO: 101857 - DNA, 20 bp, Artificial Sequence
  chemically synthesized
aggatatacagatagcaaat

SEQ ID NO: 101858 - DNA, 20 bp, Artificial Sequence
  chemically synthesized
aaggatatacagatagcaaa

SEQ ID NO: 101859 - DNA, 20 bp, Artificial Sequence
  chemically synthesized
caccaaaaaggatatacaga

SEQ ID NO: 101860 - DNA, 20 bp, Artificial Sequence
  chemically synthesized
gtttcaccaaaaaggatata

SEQ ID NO: 101861 - DNA, 20 bp, Artificial Sequence
  chemically synthesized
tgctatctgtatatcctttt

SEQ ID NO: 101862 - DNA, 20 bp, Artificial Sequence
  chemically synthesized
caagaaacgtttcaccaaaa

SEQ ID NO: 101863 - DNA, 20 bp, Artificial Sequence
  chemically synthesized
tcaagaaacgtttcaccaaa

SEQ ID NO: 101864 - DNA, 20 bp, Artificial Sequence
  chemically synthesized
ggaaatgggcaagacacatc

SEQ ID NO: 101865 - DNA, 20 bp, Artificial Sequence
  chemically synthesized
aatgcaattaggaaatgggc

SEQ ID NO: 101866 - DNA, 20 bp, Artificial Sequence
  chemically synthesized
aaacaatgcaattaggaaat

SEQ ID NO: 101867 - DNA, 20 bp, Artificial Sequence
  chemically synthesized
caaacaatgcaattaggaaa

SEQ ID NO: 101868 - DNA, 20 bp, Artificial Sequence
  chemically synthesized
aagaaacaaacaatgcaatt

SEQ ID NO: 101869 - DNA, 20 bp, Artificial Sequence
  chemically synthesized
caagaaacaaacaatgcaat

SEQ ID NO: 101870 - DNA, 20 bp, Artificial Sequence
  chemically synthesized
tcaaaactgcaaggtaaaac

SEQ ID NO: 101871 - DNA, 20 bp, Artificial Sequence
  chemically synthesized
ttgtttcttgttttaccttg

SEQ ID NO: 101872 - DNA, 20 bp, Artificial Sequence
  chemically synthesized
aaagaactctcaaaactgca

SEQ ID NO: 101873 - DNA, 20 bp, Artificial Sequence
  chemically synthesized
taaagaactctcaaaactgc

SEQ ID NO: 101874 - DNA, 20 bp, Artificial Sequence
  chemically synthesized
ttgttttaccttgcagtttt

SEQ ID NO: 101875 - DNA, 20 bp, Artificial Sequence
  chemically synthesized
gttttaccttgcagttttga

SEQ ID NO: 101876 - DNA, 20 bp, Artificial Sequence
  chemically synthesized
atggatgtctagaatatata

SEQ ID NO: 101877 - DNA, 20 bp, Artificial Sequence
  chemically synthesized
tgagagttctttatatattc

SEQ ID NO: 101878 - DNA, 20 bp, Artificial Sequence
  chemically synthesized
atagccaaaagatggatgtc

SEQ ID NO: 101879 - DNA, 20 bp, Artificial Sequence
  chemically synthesized
tattctagacatccatcttt

SEQ ID NO: 101880 - DNA, 20 bp, Artificial Sequence
  chemically synthesized
caagccatatagccaaaaga

SEQ ID NO: 101881 - DNA, 20 bp, Artificial Sequence
  chemically synthesized
ttttcaagccatatagccaa

SEQ ID NO: 101882 - DNA, 20 bp, Artificial Sequence
  chemically synthesized
acatccatcttttggctata

SEQ ID NO: 101883 - DNA, 20 bp, Artificial Sequence
  chemically synthesized
gaaaatattttcaagccata

SEQ ID NO: 101884 - DNA, 20 bp, Artificial Sequence
  chemically synthesized
gactgatagaaaatattttc

SEQ ID NO: 101885 - DNA, 20 bp, Artificial Sequence
  chemically synthesized
ggcttgaaaatattttctat

SEQ ID NO: 101886 - DNA, 20 bp, Artificial Sequence
  chemically synthesized
aaagacaagctacagactga

SEQ ID NO: 101887 - DNA, 20 bp, Artificial Sequence
  chemically synthesized
aaatattttctatcagtctg

SEQ ID NO: 101888 - DNA, 20 bp, Artificial Sequence
  chemically synthesized
gaggatgaaaagacaagcta

SEQ ID NO: 101889 - DNA, 20 bp, Artificial Sequence
  chemically synthesized
gtgagggaggatgaaaagac

SEQ ID NO: 101890 - DNA, 20 bp, Artificial Sequence
  chemically synthesized
gacctgtgagggaggatgaa

SEQ ID NO: 101891 - DNA, 20 bp, Artificial Sequence
  chemically synthesized
tgtcttttcatcctccctca

SEQ ID NO: 101892 - DNA, 20 bp, Artificial Sequence
  chemically synthesized
gtcttttcatcctccctcac

SEQ ID NO: 101893 - DNA, 20 bp, Artificial Sequence
  chemically synthesized
ctgcaaaagacctgtgaggg

SEQ ID NO: 101894 - DNA, 20 bp, Artificial Sequence
  chemically synthesized
actgcaaaagacctgtgagg

SEQ ID NO: 101895 - DNA, 20 bp, Artificial Sequence
  chemically synthesized
gcactgcaaaagacctgtga

SEQ ID NO: 101896 - DNA, 20 bp, Artificial Sequence
  chemically synthesized
tgcactgcaaaagacctgtg

SEQ ID NO: 101897 - DNA, 20 bp, Artificial Sequence
  chemically synthesized
ttgcactgcaaaagacctgt

SEQ ID NO: 101898 - DNA, 20 bp, Artificial Sequence
  chemically synthesized
cctccctcacaggtcttttg

SEQ ID NO: 101899 - DNA, 20 bp, Artificial Sequence
  chemically synthesized
ttaaaacctttgcactgcaa

SEQ ID NO: 101900 - DNA, 20 bp, Artificial Sequence
  chemically synthesized
cacaggtcttttgcagtgca

SEQ ID NO: 101901 - DNA, 20 bp, Artificial Sequence
  chemically synthesized
acaggtcttttgcagtgcaa

SEQ ID NO: 101902 - DNA, 20 bp, Artificial Sequence
  chemically synthesized
aaaggttttaaatcttgatg

SEQ ID NO: 101903 - DNA, 20 bp, Artificial Sequence
  chemically synthesized
aaaatcagttggactgcatc

SEQ ID NO: 101904 - DNA, 20 bp, Artificial Sequence
  chemically synthesized
acacacagaaaaaaatcagt

SEQ ID NO: 101905 - DNA, 20 bp, Artificial Sequence
  chemically synthesized
atccacacacagaaaaaaat

SEQ ID NO: 101906 - DNA, 20 bp, Artificial Sequence
  chemically synthesized
aactgatttttttctgtgtg

SEQ ID NO: 101907 - DNA, 20 bp, Artificial Sequence
  chemically synthesized
ttgaaagcatgatccacaca

SEQ ID NO: 101908 - DNA, 20 bp, Artificial Sequence
  chemically synthesized
agggctagaattggcattga

SEQ ID NO: 101909 - DNA, 20 bp, Artificial Sequence
  chemically synthesized
catgctttcaatgccaattc

SEQ ID NO: 101910 - DNA, 20 bp, Artificial Sequence
  chemically synthesized
tcaggctctagggctagaat

SEQ ID NO: 101911 - DNA, 20 bp, Artificial Sequence
  chemically synthesized
ttcaatgccaattctagccc

SEQ ID NO: 101912 - DNA, 20 bp, Artificial Sequence
  chemically synthesized
caatgccaattctagcccta

SEQ ID NO: 101913 - DNA, 20 bp, Artificial Sequence
  chemically synthesized
aaatcttcaggctctagggc

SEQ ID NO: 101914 - DNA, 20 bp, Artificial Sequence
  chemically synthesized
gagaaaatcttcaggctcta

SEQ ID NO: 101915 - DNA, 20 bp, Artificial Sequence
  chemically synthesized
tgagaaaatcttcaggctct

SEQ ID NO: 101916 - DNA, 20 bp, Artificial Sequence
  chemically synthesized
aattctagccctagagcctg

SEQ ID NO: 101917 - DNA, 20 bp, Artificial Sequence
  chemically synthesized
atgagaaaatcttcaggctc

SEQ ID NO: 101918 - DNA, 20 bp, Artificial Sequence
  chemically synthesized
ggaaaaatgagaaaatcttc

SEQ ID NO: 101919 - DNA, 20 bp, Artificial Sequence
  chemically synthesized
gggaaaaatgagaaaatctt

SEQ ID NO: 101920 - DNA, 20 bp, Artificial Sequence
  chemically synthesized
atcaaaatttagggaaaaat

SEQ ID NO: 101921 - DNA, 20 bp, Artificial Sequence
  chemically synthesized
cataaaactatcaaaattta

SEQ ID NO: 101922 - DNA, 20 bp, Artificial Sequence
  chemically synthesized
acataaaactatcaaaattt

SEQ ID NO: 101923 - DNA, 20 bp, Artificial Sequence
  chemically synthesized
aacataaaactatcaaaatt

SEQ ID NO: 101924 - DNA, 20 bp, Artificial Sequence
  chemically synthesized
catttttccctaaattttga

SEQ ID NO: 101925 - DNA, 20 bp, Artificial Sequence
  chemically synthesized
tagttttatgttttacattt

SEQ ID NO: 101926 - DNA, 20 bp, Artificial Sequence
  chemically synthesized
acttaattcaaaatagatca

SEQ ID NO: 101927 - DNA, 20 bp, Artificial Sequence
  chemically synthesized
tgtaaaaacttaattcaaaa

SEQ ID NO: 101928 - DNA, 20 bp, Artificial Sequence
  chemically synthesized
tccatgatctattttgaatt

SEQ ID NO: 101929 - DNA, 20 bp, Artificial Sequence
  chemically synthesized
attttgaattaagtttttac

SEQ ID NO: 101930 - DNA, 20 bp, Artificial Sequence
  chemically synthesized
ttttgaattaagtttttaca

SEQ ID NO: 101931 - DNA, 20 bp, Artificial Sequence
  chemically synthesized
attaagtttttacaaggtgt

SEQ ID NO: 101932 - DNA, 20 bp, Artificial Sequence
  chemically synthesized
tttttacaaggtgtgagatt

SEQ ID NO: 101933 - DNA, 20 bp, Artificial Sequence
  chemically synthesized
ttttacaaggtgtgagattt

SEQ ID NO: 101934 - DNA, 20 bp, Artificial Sequence
  chemically synthesized
aaggtgtgagatttaggttg

SEQ ID NO: 101935 - DNA, 20 bp, Artificial Sequence
  chemically synthesized
tccctagagtgggaaaaaaa

SEQ ID NO: 101936 - DNA, 20 bp, Artificial Sequence
  chemically synthesized
gttctttttttttcccactc

SEQ ID NO: 101937 - DNA, 20 bp, Artificial Sequence
  chemically synthesized
ttctttttttttcccactct

SEQ ID NO: 101938 - DNA, 20 bp, Artificial Sequence
  chemically synthesized
tctttttttttcccactcta

SEQ ID NO: 101939 - DNA, 20 bp, Artificial Sequence
  chemically synthesized
aaattggacatccctagagt

SEQ ID NO: 101940 - DNA, 20 bp, Artificial Sequence
  chemically synthesized
gaaattggacatccctagag

SEQ ID NO: 101941 - DNA, 20 bp, Artificial Sequence
  chemically synthesized
gcagaaattggacatcccta

SEQ ID NO: 101942 - DNA, 20 bp, Artificial Sequence
  chemically synthesized
ctgcagaaattggacatccc

SEQ ID NO: 101943 - DNA, 20 bp, Artificial Sequence
  chemically synthesized
ctagggatgtccaatttctg

SEQ ID NO: 101944 - DNA, 20 bp, Artificial Sequence
  chemically synthesized
acaaatggtcctgcagaaat

SEQ ID NO: 101945 - DNA, 20 bp, Artificial Sequence
  chemically synthesized
tagggatgtccaatttctgc

SEQ ID NO: 101946 - DNA, 20 bp, Artificial Sequence
  chemically synthesized
cttttcaacaaatggtcctg

SEQ ID NO: 101947 - DNA, 20 bp, Artificial Sequence
  chemically synthesized
aagctcaccttttcaacaaa

SEQ ID NO: 101948 - DNA, 20 bp, Artificial Sequence
  chemically synthesized
ctgcaggaccatttgttgaa

SEQ ID NO: 101949 - DNA, 20 bp, Artificial Sequence
  chemically synthesized
tgcaggaccatttgttgaaa

SEQ ID NO: 101950 - DNA, 20 bp, Artificial Sequence
  chemically synthesized
ggaccatttgttgaaaaggt

SEQ ID NO: 101951 - DNA, 20 bp, Artificial Sequence
  chemically synthesized
caaaagcaattcaatagaga

SEQ ID NO: 101952 - DNA, 20 bp, Artificial Sequence
  chemically synthesized
gttgcaaaagcaattcaata

SEQ ID NO: 101953 - DNA, 20 bp, Artificial Sequence
  chemically synthesized
aagttgcaaaagcaattcaa

SEQ ID NO: 101954 - DNA, 20 bp, Artificial Sequence
  chemically synthesized
gatttttgataaagttgcaa

SEQ ID NO: 101955 - DNA, 20 bp, Artificial Sequence
  chemically synthesized
tgcccaacagatttttgata

SEQ ID NO: 101956 - DNA, 20 bp, Artificial Sequence
  chemically synthesized
caactttatcaaaaatctgt

SEQ ID NO: 101957 - DNA, 20 bp, Artificial Sequence
  chemically synthesized
aactttatcaaaaatctgtt

SEQ ID NO: 101958 - DNA, 20 bp, Artificial Sequence
  chemically synthesized
acccatgcaaatgtgcccaa

SEQ ID NO: 101959 - DNA, 20 bp, Artificial Sequence
  chemically synthesized
atctgttgggcacatttgca

SEQ ID NO: 101960 - DNA, 20 bp, Artificial Sequence
  chemically synthesized
tctgttgggcacatttgcat

SEQ ID NO: 101961 - DNA, 20 bp, Artificial Sequence
  chemically synthesized
catttgcatgggtctgtttt

SEQ ID NO: 101962 - DNA, 20 bp, Artificial Sequence
  chemically synthesized
atttgcatgggtctgttttt

SEQ ID NO: 101963 - DNA, 20 bp, Artificial Sequence
  chemically synthesized
cagaatagagaacccaaaaa

SEQ ID NO: 101964 - DNA, 20 bp, Artificial Sequence
  chemically synthesized
agaccaaatgaaacagaata

SEQ ID NO: 101965 - DNA, 20 bp, Artificial Sequence
  chemically synthesized
atagaccaaatgaaacagaa

SEQ ID NO: 101966 - DNA, 20 bp, Artificial Sequence
  chemically synthesized
gttctctattctgtttcatt

SEQ ID NO: 101967 - DNA, 20 bp, Artificial Sequence
  chemically synthesized
gactcatagaccaaatgaaa

SEQ ID NO: 101968 - DNA, 20 bp, Artificial Sequence
  chemically synthesized
ttctgtttcatttggtctat

SEQ ID NO: 101969 - DNA, 20 bp, Artificial Sequence
  chemically synthesized
ttgctggagggatagactca

SEQ ID NO: 101970 - DNA, 20 bp, Artificial Sequence
  chemically synthesized
ggtctatgagtctatccctc

SEQ ID NO: 101971 - DNA, 20 bp, Artificial Sequence
  chemically synthesized
gtatgatgttgctggaggga

SEQ ID NO: 101972 - DNA, 20 bp, Artificial Sequence
  chemically synthesized
tacagtatgatgttgctgga

SEQ ID NO: 101973 - DNA, 20 bp, Artificial Sequence
  chemically synthesized
atacagtatgatgttgctgg

SEQ ID NO: 101974 - DNA, 20 bp, Artificial Sequence
  chemically synthesized
aatacagtatgatgttgctg

SEQ ID NO: 101975 - DNA, 20 bp, Artificial Sequence
  chemically synthesized
tcaatacagtatgatgttgc

SEQ ID NO: 101976 - DNA, 20 bp, Artificial Sequence
  chemically synthesized
gcaacatcatactgtattga

SEQ ID NO: 101977 - DNA, 20 bp, Artificial Sequence
  chemically synthesized
atatagtaaggctatcaata

SEQ ID NO: 101978 - DNA, 20 bp, Artificial Sequence
  chemically synthesized
ttatggctaacaatatagta

SEQ ID NO: 101979 - DNA, 20 bp, Artificial Sequence
  chemically synthesized
attatggctaacaatatagt

SEQ ID NO: 101980 - DNA, 20 bp, Artificial Sequence
  chemically synthesized
tgatagccttactatattgt

SEQ ID NO: 101981 - DNA, 20 bp, Artificial Sequence
  chemically synthesized
caatattatggctaacaata

SEQ ID NO: 101982 - DNA, 20 bp, Artificial Sequence
  chemically synthesized
tatattgttagccataatat

SEQ ID NO: 101983 - DNA, 20 bp, Artificial Sequence
  chemically synthesized
atattgttagccataatatt

SEQ ID NO: 101984 - DNA, 20 bp, Artificial Sequence
  chemically synthesized
aacctctctacccaatatta

SEQ ID NO: 101985 - DNA, 20 bp, Artificial Sequence
  chemically synthesized
ttgttagccataatattggg

SEQ ID NO: 101986 - DNA, 20 bp, Artificial Sequence
  chemically synthesized
gttagccataatattgggta

SEQ ID NO: 101987 - DNA, 20 bp, Artificial Sequence
  chemically synthesized
tagccataatattgggtaga

SEQ ID NO: 101988 - DNA, 20 bp, Artificial Sequence
  chemically synthesized
agccataatattgggtagag

SEQ ID NO: 101989 - DNA, 20 bp, Artificial Sequence
  chemically synthesized
taaaaaggtaaataaagtgg

SEQ ID NO: 101990 - DNA, 20 bp, Artificial Sequence
  chemically synthesized
tttaaaaaggtaaataaagt

SEQ ID NO: 101991 - DNA, 20 bp, Artificial Sequence
  chemically synthesized
ttttaaaaaggtaaataaag

SEQ ID NO: 101992 - DNA, 20 bp, Artificial Sequence
  chemically synthesized
gtcttttaaaaaggtaaata

SEQ ID NO: 101993 - DNA, 20 bp, Artificial Sequence
  chemically synthesized
cactttatttacctttttaa

SEQ ID NO: 101994 - DNA, 20 bp, Artificial Sequence
  chemically synthesized
actaaaacagtcttttaaaa

SEQ ID NO: 101995 - DNA, 20 bp, Artificial Sequence
  chemically synthesized
aactaaaacagtcttttaaa

SEQ ID NO: 101996 - DNA, 20 bp, Artificial Sequence
  chemically synthesized
acctttttaaaagactgttt

SEQ ID NO: 101997 - DNA, 20 bp, Artificial Sequence
  chemically synthesized
aggccacagaataactaaaa

SEQ ID NO: 101998 - DNA, 20 bp, Artificial Sequence
  chemically synthesized
agactgttttagttattctg

SEQ ID NO: 101999 - DNA, 20 bp, Artificial Sequence
  chemically synthesized
ataagaaaagtcacaggcca

SEQ ID NO: 102000 - DNA, 20 bp, Artificial Sequence
  chemically synthesized
aaatctataagaaaagtcac

SEQ ID NO: 102001 - DNA, 20 bp, Artificial Sequence
  chemically synthesized
aaaatctataagaaaagtca

SEQ ID NO: 102002 - DNA, 20 bp, Artificial Sequence
  chemically synthesized
gtggcctgtgacttttctta

SEQ ID NO: 102003 - DNA, 20 bp, Artificial Sequence
  chemically synthesized
tactctaaaatctataagaa

SEQ ID NO: 102004 - DNA, 20 bp, Artificial Sequence
  chemically synthesized
aagcatactctaaaatctat

SEQ ID NO: 102005 - DNA, 20 bp, Artificial Sequence
  chemically synthesized
gtgacttttcttatagattt

SEQ ID NO: 102006 - DNA, 20 bp, Artificial Sequence
  chemically synthesized
gacttttcttatagatttta

SEQ ID NO: 102007 - DNA, 20 bp, Artificial Sequence
  chemically synthesized
ggatttctgtacacatagac

SEQ ID NO: 102008 - DNA, 20 bp, Artificial Sequence
  chemically synthesized
agtatgcttgtctatgtgta

SEQ ID NO: 102009 - DNA, 20 bp, Artificial Sequence
  chemically synthesized
atcaaggatttctgtacaca

SEQ ID NO: 102010 - DNA, 20 bp, Artificial Sequence
  chemically synthesized
tgtgtacagaaatccttgat

SEQ ID NO: 102011 - DNA, 20 bp, Artificial Sequence
  chemically synthesized
tttctatcaaaatcttatca

SEQ ID NO: 102012 - DNA, 20 bp, Artificial Sequence
  chemically synthesized
gtttctatcaaaatcttatc

SEQ ID NO: 102013 - DNA, 20 bp, Artificial Sequence
  chemically synthesized
aatccttgataagattttga

SEQ ID NO: 102014 - DNA, 20 bp, Artificial Sequence
  chemically synthesized
atcaatctaaaggtttaatt

SEQ ID NO: 102015 - DNA, 20 bp, Artificial Sequence
  chemically synthesized
tagaaactaaattaaacctt

SEQ ID NO: 102016 - DNA, 20 bp, Artificial Sequence
  chemically synthesized
ttcttctcaaatcaatctaa

SEQ ID NO: 102017 - DNA, 20 bp, Artificial Sequence
  chemically synthesized
gttcttctcaaatcaatcta

SEQ ID NO: 102018 - DNA, 20 bp, Artificial Sequence
  chemically synthesized
ttaaacctttagattgattt

SEQ ID NO: 102019 - DNA, 20 bp, Artificial Sequence
  chemically synthesized
aacctttagattgatttgag

SEQ ID NO: 102020 - DNA, 20 bp, Artificial Sequence
  chemically synthesized
agtcagcatagcaaatatgt

SEQ ID NO: 102021 - DNA, 20 bp, Artificial Sequence
  chemically synthesized
atagactggaagagtcagca

SEQ ID NO: 102022 - DNA, 20 bp, Artificial Sequence
  chemically synthesized
atttgctatgctgactcttc

SEQ ID NO: 102023 - DNA, 20 bp, Artificial Sequence
  chemically synthesized
tgtttatagactggaagagt

SEQ ID NO: 102024 - DNA, 20 bp, Artificial Sequence
  chemically synthesized
ggcatgtttatagactggaa

SEQ ID NO: 102025 - DNA, 20 bp, Artificial Sequence
  chemically synthesized
atggcatgtttatagactgg

SEQ ID NO: 102026 - DNA, 20 bp, Artificial Sequence
  chemically synthesized
tatatggcatgtttatagac

SEQ ID NO: 102027 - DNA, 20 bp, Artificial Sequence
  chemically synthesized
tggattatatggcatgttta

SEQ ID NO: 102028 - DNA, 20 bp, Artificial Sequence
  chemically synthesized
acctaaataagtggattata

SEQ ID NO: 102029 - DNA, 20 bp, Artificial Sequence
  chemically synthesized
tgccatataatccacttatt

SEQ ID NO: 102030 - DNA, 20 bp, Artificial Sequence
  chemically synthesized
gccatataatccacttattt

SEQ ID NO: 102031 - DNA, 20 bp, Artificial Sequence
  chemically synthesized
ttaaaaacaacctaaataag

SEQ ID NO: 102032 - DNA, 20 bp, Artificial Sequence
  chemically synthesized
gcattaaaaacaacctaaat

SEQ ID NO: 102033 - DNA, 20 bp, Artificial Sequence
  chemically synthesized
ttgtttttaatgcctttcat

SEQ ID NO: 102034 - DNA, 20 bp, Artificial Sequence
  chemically synthesized
aattataaaatgctgatgaa

SEQ ID NO: 102035 - DNA, 20 bp, Artificial Sequence
  chemically synthesized
aaattataaaatgctgatga

SEQ ID NO: 102036 - DNA, 20 bp, Artificial Sequence
  chemically synthesized
acatgtacaggatcggtatg

SEQ ID NO: 102037 - DNA, 20 bp, Artificial Sequence
  chemically synthesized
ctatcatacatgtacaggat

SEQ ID NO: 102038 - DNA, 20 bp, Artificial Sequence
  chemically synthesized
taaatctatcatacatgtac

SEQ ID NO: 102039 - DNA, 20 bp, Artificial Sequence
  chemically synthesized
ataaatctatcatacatgta

SEQ ID NO: 102040 - DNA, 20 bp, Artificial Sequence
  chemically synthesized
ccgatcctgtacatgtatga

SEQ ID NO: 102041 - DNA, 20 bp, Artificial Sequence
  chemically synthesized
tatccaaaaatgaaatacgt

SEQ ID NO: 102042 - DNA, 20 bp, Artificial Sequence
  chemically synthesized
ttatccaaaaatgaaatacg

SEQ ID NO: 102043 - DNA, 20 bp, Artificial Sequence
  chemically synthesized
atacctacgtatttcatttt

SEQ ID NO: 102044 - DNA, 20 bp, Artificial Sequence
  chemically synthesized
tacgtatttcatttttggat

SEQ ID NO: 102045 - DNA, 20 bp, Artificial Sequence
  chemically synthesized
tttggataagcaattataaa

SEQ ID NO: 102046 - DNA, 20 bp, Artificial Sequence
  chemically synthesized
gttggaaatgaagatgtgaa

SEQ ID NO: 102047 - DNA, 20 bp, Artificial Sequence
  chemically synthesized
gattatctatgttggaaatg

SEQ ID NO: 102048 - DNA, 20 bp, Artificial Sequence
  chemically synthesized
tcacatcttcatttccaaca

SEQ ID NO: 102049 - DNA, 20 bp, Artificial Sequence
  chemically synthesized
aacttacggattatctatgt

SEQ ID NO: 102050 - DNA, 20 bp, Artificial Sequence
  chemically synthesized
ttccaacatagataatccgt

SEQ ID NO: 102051 - DNA, 20 bp, Artificial Sequence
  chemically synthesized
aggcaagccatcacaactta

SEQ ID NO: 102052 - DNA, 20 bp, Artificial Sequence
  chemically synthesized
agataatccgtaagttgtga

SEQ ID NO: 102053 - DNA, 20 bp, Artificial Sequence
  chemically synthesized
aagtcaaaaaatcataaggc

SEQ ID NO: 102054 - DNA, 20 bp, Artificial Sequence
  chemically synthesized
cataaagtcaaaaaatcata

SEQ ID NO: 102055 - DNA, 20 bp, Artificial Sequence
  chemically synthesized
tcataaagtcaaaaaatcat

SEQ ID NO: 102056 - DNA, 20 bp, Artificial Sequence
  chemically synthesized
atgattttttgactttatga

SEQ ID NO: 102057 - DNA, 20 bp, Artificial Sequence
  chemically synthesized
tgattttttgactttatgat

SEQ ID NO: 102058 - DNA, 20 bp, Artificial Sequence
  chemically synthesized
atttagataaacccatcata

SEQ ID NO: 102059 - DNA, 20 bp, Artificial Sequence
  chemically synthesized
tgatgggtttatctaaatgt

SEQ ID NO: 102060 - DNA, 20 bp, Artificial Sequence
  chemically synthesized
tcttatgatgggcttacatt

SEQ ID NO: 102061 - DNA, 20 bp, Artificial Sequence
  chemically synthesized
tctaaatgtaagcccatcat

SEQ ID NO: 102062 - DNA, 20 bp, Artificial Sequence
  chemically synthesized
gatgctcctcatcttatgat

SEQ ID NO: 102063 - DNA, 20 bp, Artificial Sequence
  chemically synthesized
agatgctcctcatcttatga

SEQ ID NO: 102064 - DNA, 20 bp, Artificial Sequence
  chemically synthesized
atgtaagcccatcataagat

SEQ ID NO: 102065 - DNA, 20 bp, Artificial Sequence
  chemically synthesized
tgtaagcccatcataagatg

SEQ ID NO: 102066 - DNA, 20 bp, Artificial Sequence
  chemically synthesized
taagcccatcataagatgag

SEQ ID NO: 102067 - DNA, 20 bp, Artificial Sequence
  chemically synthesized
gctagtcacatttttatata

SEQ ID NO: 102068 - DNA, 20 bp, Artificial Sequence
  chemically synthesized
tctgtatataaaaatgtgac

SEQ ID NO: 102069 - DNA, 20 bp, Artificial Sequence
  chemically synthesized
tataaaaatgtgactagctt

SEQ ID NO: 102070 - DNA, 20 bp, Artificial Sequence
  chemically synthesized
caagatcaacacaccaaagc

SEQ ID NO: 102071 - DNA, 20 bp, Artificial Sequence
  chemically synthesized
aatacaagatcaacacacca

SEQ ID NO: 102072 - DNA, 20 bp, Artificial Sequence
  chemically synthesized
gtgtgttgatcttgtatttt

SEQ ID NO: 102073 - DNA, 20 bp, Artificial Sequence
  chemically synthesized
ttaacaagatccaaaaatac

SEQ ID NO: 102074 - DNA, 20 bp, Artificial Sequence
  chemically synthesized
agctgagaagagaggttaac

SEQ ID NO: 102075 - DNA, 20 bp, Artificial Sequence
  chemically synthesized
atcttgttaacctctcttct

SEQ ID NO: 102076 - DNA, 20 bp, Artificial Sequence
  chemically synthesized
gctcatggagctgagaagag

SEQ ID NO: 102077 - DNA, 20 bp, Artificial Sequence
  chemically synthesized
tgctcatggagctgagaaga

SEQ ID NO: 102078 - DNA, 20 bp, Artificial Sequence
  chemically synthesized
aatgctcatggagctgagaa

SEQ ID NO: 102079 - DNA, 20 bp, Artificial Sequence
  chemically synthesized
aaaatgctcatggagctgag

SEQ ID NO: 102080 - DNA, 20 bp, Artificial Sequence
  chemically synthesized
ccaaaaatgctcatggagct

SEQ ID NO: 102081 - DNA, 20 bp, Artificial Sequence
  chemically synthesized
acctctcttctcagctccat

SEQ ID NO: 102082 - DNA, 20 bp, Artificial Sequence
  chemically synthesized
aataaccaaaaatgctcatg

SEQ ID NO: 102083 - DNA, 20 bp, Artificial Sequence
  chemically synthesized
aaaataaccaaaaatgctca

SEQ ID NO: 102084 - DNA, 20 bp, Artificial Sequence
  chemically synthesized
ctcagctccatgagcatttt

SEQ ID NO: 102085 - DNA, 20 bp, Artificial Sequence
  chemically synthesized
caaatattctacaaaaacaa

SEQ ID NO: 102086 - DNA, 20 bp, Artificial Sequence
  chemically synthesized
tatttttgcttttgtttttg

SEQ ID NO: 102087 - DNA, 20 bp, Artificial Sequence
  chemically synthesized
tttgatattttctacgtaca

SEQ ID NO: 102088 - DNA, 20 bp, Artificial Sequence
  chemically synthesized
ggatggcatgactgtgtacg

SEQ ID NO: 102089 - DNA, 20 bp, Artificial Sequence
  chemically synthesized
aaattatttctatttgtgga

SEQ ID NO: 102090 - DNA, 20 bp, Artificial Sequence
  chemically synthesized
acagtcatgccatccacaaa

SEQ ID NO: 102091 - DNA, 20 bp, Artificial Sequence
  chemically synthesized
aataaaattatttctatttg

SEQ ID NO: 102092 - DNA, 20 bp, Artificial Sequence
  chemically synthesized
aataaagcatgcatattgaa

SEQ ID NO: 102093 - DNA, 20 bp, Artificial Sequence
  chemically synthesized
taaagcaaggaaaaacaata

SEQ ID NO: 102094 - DNA, 20 bp, Artificial Sequence
  chemically synthesized
ccagacactacaataaagca

SEQ ID NO: 102095 - DNA, 20 bp, Artificial Sequence
  chemically synthesized
tccagacactacaataaagc

SEQ ID NO: 102096 - DNA, 20 bp, Artificial Sequence
  chemically synthesized
tgtttttccttgctttattg

SEQ ID NO: 102097 - DNA, 20 bp, Artificial Sequence
  chemically synthesized
aagttccagacactacaata

SEQ ID NO: 102098 - DNA, 20 bp, Artificial Sequence
  chemically synthesized
ccttgctttattgtagtgtc

SEQ ID NO: 102099 - DNA, 20 bp, Artificial Sequence
  chemically synthesized
attgtagtgtctggaacttc

SEQ ID NO: 102100 - DNA, 20 bp, Artificial Sequence
  chemically synthesized
taacatagttctggaagttc

SEQ ID NO: 102101 - DNA, 20 bp, Artificial Sequence
  chemically synthesized
cttttttaacatagttctgg

SEQ ID NO: 102102 - DNA, 20 bp, Artificial Sequence
  chemically synthesized
actcttttttaacatagttc

SEQ ID NO: 102103 - DNA, 20 bp, Artificial Sequence
  chemically synthesized
ttcactactcttttttaaca

SEQ ID NO: 102104 - DNA, 20 bp, Artificial Sequence
  chemically synthesized
cttccagaactatgttaaaa

SEQ ID NO: 102105 - DNA, 20 bp, Artificial Sequence
  chemically synthesized
tccagaactatgttaaaaaa

SEQ ID NO: 102106 - DNA, 20 bp, Artificial Sequence
  chemically synthesized
agaactatgttaaaaaagag

SEQ ID NO: 102107 - DNA, 20 bp, Artificial Sequence
  chemically synthesized
ttaaaaaagagtagtgaaat

SEQ ID NO: 102108 - DNA, 20 bp, Artificial Sequence
  chemically synthesized
taaaaaagagtagtgaaatt

SEQ ID NO: 102109 - DNA, 20 bp, Artificial Sequence
  chemically synthesized
ccatgattgctaattaggga

SEQ ID NO: 102110 - DNA, 20 bp, Artificial Sequence
  chemically synthesized
attgggcatccttccctaat

SEQ ID NO: 102111 - DNA, 20 bp, Artificial Sequence
  chemically synthesized
cccatgattgctaattaggg

SEQ ID NO: 102112 - DNA, 20 bp, Artificial Sequence
  chemically synthesized
ccacccatgattgctaatta

SEQ ID NO: 102113 - DNA, 20 bp, Artificial Sequence
  chemically synthesized
tccacccatgattgctaatt

SEQ ID NO: 102114 - DNA, 20 bp, Artificial Sequence
  chemically synthesized
ttccacccatgattgctaat

SEQ ID NO: 102115 - DNA, 20 bp, Artificial Sequence
  chemically synthesized
ccttccctaattagcaatca

SEQ ID NO: 102116 - DNA, 20 bp, Artificial Sequence
  chemically synthesized
cttccctaattagcaatcat

SEQ ID NO: 102117 - DNA, 20 bp, Artificial Sequence
  chemically synthesized
ccctaattagcaatcatggg

SEQ ID NO: 102118 - DNA, 20 bp, Artificial Sequence
  chemically synthesized
caatcatgggtggaaacatt

SEQ ID NO: 102119 - DNA, 20 bp, Artificial Sequence
  chemically synthesized
agcataattttaataatgga

SEQ ID NO: 102120 - DNA, 20 bp, Artificial Sequence
  chemically synthesized
tagcataattttaataatgg

SEQ ID NO: 102121 - DNA, 20 bp, Artificial Sequence
  chemically synthesized
taatagcataattttaataa

SEQ ID NO: 102122 - DNA, 20 bp, Artificial Sequence
  chemically synthesized
taaaattatgctattaactg

SEQ ID NO: 102123 - DNA, 20 bp, Artificial Sequence
  chemically synthesized
ctacagaaaactacagttaa

SEQ ID NO: 102124 - DNA, 20 bp, Artificial Sequence
  chemically synthesized
agggtatctacagaaaacta

SEQ ID NO: 102125 - DNA, 20 bp, Artificial Sequence
  chemically synthesized
ctattaactgtagttttctg

SEQ ID NO: 102126 - DNA, 20 bp, Artificial Sequence
  chemically synthesized
atcttaataaagggtatcta

SEQ ID NO: 102127 - DNA, 20 bp, Artificial Sequence
  chemically synthesized
ttctgtagataccctttatt

SEQ ID NO: 102128 - DNA, 20 bp, Artificial Sequence
  chemically synthesized
aacttccacatcttaataaa

SEQ ID NO: 102129 - DNA, 20 bp, Artificial Sequence
  chemically synthesized
taacttccacatcttaataa

SEQ ID NO: 102130 - DNA, 20 bp, Artificial Sequence
  chemically synthesized
ataacttccacatcttaata

SEQ ID NO: 102131 - DNA, 20 bp, Artificial Sequence
  chemically synthesized
agataccctttattaagatg

SEQ ID NO: 102132 - DNA, 20 bp, Artificial Sequence
  chemically synthesized
taccctttattaagatgtgg

SEQ ID NO: 102133 - DNA, 20 bp, Artificial Sequence
  chemically synthesized
tggaagttatcctctattcc

SEQ ID NO: 102134 - DNA, 20 bp, Artificial Sequence
  chemically synthesized
tatgagaaaactgggaatag

SEQ ID NO: 102135 - DNA, 20 bp, Artificial Sequence
  chemically synthesized
ctatgagaaaactgggaata

SEQ ID NO: 102136 - DNA, 20 bp, Artificial Sequence
  chemically synthesized
aactatgagaaaactgggaa

SEQ ID NO: 102137 - DNA, 20 bp, Artificial Sequence
  chemically synthesized
ataaaaactatgagaaaact

SEQ ID NO: 102138 - DNA, 20 bp, Artificial Sequence
  chemically synthesized
gataaaaactatgagaaaac

SEQ ID NO: 102139 - DNA, 20 bp, Artificial Sequence
  chemically synthesized
ctctattcccagttttctca

SEQ ID NO: 102140 - DNA, 20 bp, Artificial Sequence
  chemically synthesized
ccattcatgataaaaactat

SEQ ID NO: 102141 - DNA, 20 bp, Artificial Sequence
  chemically synthesized
ctcatagtttttatcatgaa

SEQ ID NO: 102142 - DNA, 20 bp, Artificial Sequence
  chemically synthesized
tttttatcatgaatggatgc

SEQ ID NO: 102143 - DNA, 20 bp, Artificial Sequence
  chemically synthesized
ttttatcatgaatggatgct

SEQ ID NO: 102144 - DNA, 20 bp, Artificial Sequence
  chemically synthesized
cagaagcatctgacaacacc

SEQ ID NO: 102145 - DNA, 20 bp, Artificial Sequence
  chemically synthesized
gaatggatgctgggtgttgt

SEQ ID NO: 102146 - DNA, 20 bp, Artificial Sequence
  chemically synthesized
gattatattgattgatgcag

SEQ ID NO: 102147 - DNA, 20 bp, Artificial Sequence
  chemically synthesized
tatgattatattgattgatg

SEQ ID NO: 102148 - DNA, 20 bp, Artificial Sequence
  chemically synthesized
tcatatgattttttcttctt

SEQ ID NO: 102149 - DNA, 20 bp, Artificial Sequence
  chemically synthesized
accatatcaacaaactaaag

SEQ ID NO: 102150 - DNA, 20 bp, Artificial Sequence
  chemically synthesized
tctaccatatcaacaaacta

SEQ ID NO: 102151 - DNA, 20 bp, Artificial Sequence
  chemically synthesized
tcttctttagtttgttgata

SEQ ID NO: 102152 - DNA, 20 bp, Artificial Sequence
  chemically synthesized
tctttagtttgttgatatgg

SEQ ID NO: 102153 - DNA, 20 bp, Artificial Sequence
  chemically synthesized
ctcaacatttgaaagttaat

SEQ ID NO: 102154 - DNA, 20 bp, Artificial Sequence
  chemically synthesized
aaggctggctcaacatttga

SEQ ID NO: 102155 - DNA, 20 bp, Artificial Sequence
  chemically synthesized
ctaattaactttcaaatgtt

SEQ ID NO: 102156 - DNA, 20 bp, Artificial Sequence
  chemically synthesized
ttaactttcaaatgttgagc

SEQ ID NO: 102157 - DNA, 20 bp, Artificial Sequence
  chemically synthesized
tgggatttagtattgaaggc

SEQ ID NO: 102158 - DNA, 20 bp, Artificial Sequence
  chemically synthesized
taactgggatttagtattga

SEQ ID NO: 102159 - DNA, 20 bp, Artificial Sequence
  chemically synthesized
ctaactgggatttagtattg

SEQ ID NO: 102160 - DNA, 20 bp, Artificial Sequence
  chemically synthesized
cagccttcaatactaaatcc

SEQ ID NO: 102161 - DNA, 20 bp, Artificial Sequence
  chemically synthesized
taccataactaactgggatt

SEQ ID NO: 102162 - DNA, 20 bp, Artificial Sequence
  chemically synthesized
cttcaatactaaatcccagt

SEQ ID NO: 102163 - DNA, 20 bp, Artificial Sequence
  chemically synthesized
gtgtcataccataactaact

SEQ ID NO: 102164 - DNA, 20 bp, Artificial Sequence
  chemically synthesized
agtgtcataccataactaac

SEQ ID NO: 102165 - DNA, 20 bp, Artificial Sequence
  chemically synthesized
tactaaatcccagttagtta

SEQ ID NO: 102166 - DNA, 20 bp, Artificial Sequence
  chemically synthesized
tgcgtcaaagtttaaaaaaa

SEQ ID NO: 102167 - DNA, 20 bp, Artificial Sequence
  chemically synthesized
catgcgtcaaagtttaaaaa

SEQ ID NO: 102168 - DNA, 20 bp, Artificial Sequence
  chemically synthesized
atattaaataacatgcgtca

SEQ ID NO: 102169 - DNA, 20 bp, Artificial Sequence
  chemically synthesized
gttatttaatattttgttga

SEQ ID NO: 102170 - DNA, 20 bp, Artificial Sequence
  chemically synthesized
ttgttgatggtttttgtctc

SEQ ID NO: 102171 - DNA, 20 bp, Artificial Sequence
  chemically synthesized
tgttgatggtttttgtctct

SEQ ID NO: 102172 - DNA, 20 bp, Artificial Sequence
  chemically synthesized
aaaataaataaatgagccta

SEQ ID NO: 102173 - DNA, 20 bp, Artificial Sequence
  chemically synthesized
ctaaaataaataaatgagcc

SEQ ID NO: 102174 - DNA, 20 bp, Artificial Sequence
  chemically synthesized
aaggtctaaaataaataaat

SEQ ID NO: 102175 - DNA, 20 bp, Artificial Sequence
  chemically synthesized
ctaggctcatttatttattt

SEQ ID NO: 102176 - DNA, 20 bp, Artificial Sequence
  chemically synthesized
atttagttagaagacaggaa

SEQ ID NO: 102177 - DNA, 20 bp, Artificial Sequence
  chemically synthesized
tatttagttagaagacagga

SEQ ID NO: 102178 - DNA, 20 bp, Artificial Sequence
  chemically synthesized
agattatttagttagaagac

SEQ ID NO: 102179 - DNA, 20 bp, Artificial Sequence
  chemically synthesized
tagattatttagttagaaga

SEQ ID NO: 102180 - DNA, 20 bp, Artificial Sequence
  chemically synthesized
gcattagattatttagttag

SEQ ID NO: 102181 - DNA, 20 bp, Artificial Sequence
  chemically synthesized
atagcattagattatttagt

SEQ ID NO: 102182 - DNA, 20 bp, Artificial Sequence
  chemically synthesized
atgtatagcattagattatt

SEQ ID NO: 102183 - DNA, 20 bp, Artificial Sequence
  chemically synthesized
gagaataaaatgtatagcat

SEQ ID NO: 102184 - DNA, 20 bp, Artificial Sequence
  chemically synthesized
agtattgagaataaaatgta

SEQ ID NO: 102185 - DNA, 20 bp, Artificial Sequence
  chemically synthesized
gatgtcataaaagcagtatt

SEQ ID NO: 102186 - DNA, 20 bp, Artificial Sequence
  chemically synthesized
aaagtgagatgtcataaaag

SEQ ID NO: 102187 - DNA, 20 bp, Artificial Sequence
  chemically synthesized
aataaagtgagatgtcataa

SEQ ID NO: 102188 - DNA, 20 bp, Artificial Sequence
  chemically synthesized
ctggcaaaaaaaaataaagt

SEQ ID NO: 102189 - DNA, 20 bp, Artificial Sequence
  chemically synthesized
ttctctggcaaaaaaaaata

SEQ ID NO: 102190 - DNA, 20 bp, Artificial Sequence
  chemically synthesized
ctcactttatttttttttgc

SEQ ID NO: 102191 - DNA, 20 bp, Artificial Sequence
  chemically synthesized
cactttatttttttttgcca

SEQ ID NO: 102192 - DNA, 20 bp, Artificial Sequence
  chemically synthesized
atttttttttgccagagaaa

SEQ ID NO: 102193 - DNA, 20 bp, Artificial Sequence
  chemically synthesized
agtaatctagtctttttctc

SEQ ID NO: 102194 - DNA, 20 bp, Artificial Sequence
  chemically synthesized
tttttgccagagaaaaagac

SEQ ID NO: 102195 - DNA, 20 bp, Artificial Sequence
  chemically synthesized
ctgctttgctgtgagtaatc

SEQ ID NO: 102196 - DNA, 20 bp, Artificial Sequence
  chemically synthesized
gaaaaagactagattactca

SEQ ID NO: 102197 - DNA, 20 bp, Artificial Sequence
  chemically synthesized
agactagattactcacagca

SEQ ID NO: 102198 - DNA, 20 bp, Artificial Sequence
  chemically synthesized
tttgactactgctttgctgt

SEQ ID NO: 102199 - DNA, 20 bp, Artificial Sequence
  chemically synthesized
ctagattactcacagcaaag

SEQ ID NO: 102200 - DNA, 20 bp, Artificial Sequence
  chemically synthesized
gattactcacagcaaagcag

SEQ ID NO: 102201 - DNA, 20 bp, Artificial Sequence
  chemically synthesized
tcacagcaaagcagtagtca

SEQ ID NO: 102202 - DNA, 20 bp, Artificial Sequence
  chemically synthesized
gaactggctcaataaaatgt

SEQ ID NO: 102203 - DNA, 20 bp, Artificial Sequence
  chemically synthesized
caaagaaccaacattttatt

SEQ ID NO: 102204 - DNA, 20 bp, Artificial Sequence
  chemically synthesized
gaaccaacattttattgagc

SEQ ID NO: 102205 - DNA, 20 bp, Artificial Sequence
  chemically synthesized
ttttattgagccagttccca

SEQ ID NO: 102206 - DNA, 20 bp, Artificial Sequence
  chemically synthesized
tgggattactctgtgggaac

SEQ ID NO: 102207 - DNA, 20 bp, Artificial Sequence
  chemically synthesized
ttattgagccagttcccaca

SEQ ID NO: 102208 - DNA, 20 bp, Artificial Sequence
  chemically synthesized
cttctttgggattactctgt

SEQ ID NO: 102209 - DNA, 20 bp, Artificial Sequence
  chemically synthesized
acttctttgggattactctg

SEQ ID NO: 102210 - DNA, 20 bp, Artificial Sequence
  chemically synthesized
gttcccacagagtaatccca

SEQ ID NO: 102211 - DNA, 20 bp, Artificial Sequence
  chemically synthesized
cccacagagtaatcccaaag

SEQ ID NO: 102212 - DNA, 20 bp, Artificial Sequence
  chemically synthesized
ggtgtctcctgaacttcttt

SEQ ID NO: 102213 - DNA, 20 bp, Artificial Sequence
  chemically synthesized
aggtgtctcctgaacttctt

SEQ ID NO: 102214 - DNA, 20 bp, Artificial Sequence
  chemically synthesized
agagtaatcccaaagaagtt

SEQ ID NO: 102215 - DNA, 20 bp, Artificial Sequence
  chemically synthesized
gagtaatcccaaagaagttc

SEQ ID NO: 102216 - DNA, 20 bp, Artificial Sequence
  chemically synthesized
gtaatcccaaagaagttcag

SEQ ID NO: 102217 - DNA, 20 bp, Artificial Sequence
  chemically synthesized
tcaggagacacctgtacaca

SEQ ID NO: 102218 - DNA, 20 bp, Artificial Sequence
  chemically synthesized
atgcaatccactgtgtgtac

SEQ ID NO: 102219 - DNA, 20 bp, Artificial Sequence
  chemically synthesized
gatgcaatccactgtgtgta

SEQ ID NO: 102220 - DNA, 20 bp, Artificial Sequence
  chemically synthesized
ggagacacctgtacacacag

SEQ ID NO: 102221 - DNA, 20 bp, Artificial Sequence
  chemically synthesized
acacacagtggattgcatca

SEQ ID NO: 102222 - DNA, 20 bp, Artificial Sequence
  chemically synthesized
cacacagtggattgcatcac

SEQ ID NO: 102223 - DNA, 20 bp, Artificial Sequence
  chemically synthesized
cacagtggattgcatcacag

SEQ ID NO: 102224 - DNA, 20 bp, Artificial Sequence
  chemically synthesized
cagtggattgcatcacagga

SEQ ID NO: 102225 - DNA, 20 bp, Artificial Sequence
  chemically synthesized
catcacaggagagaaaccct

SEQ ID NO: 102226 - DNA, 20 bp, Artificial Sequence
  chemically synthesized
aggagagaaaccctgagctt

SEQ ID NO: 102227 - DNA, 20 bp, Artificial Sequence
  chemically synthesized
attaagcttccttaagctca

SEQ ID NO: 102228 - DNA, 20 bp, Artificial Sequence
  chemically synthesized
ggagagaaaccctgagctta

SEQ ID NO: 102229 - DNA, 20 bp, Artificial Sequence
  chemically synthesized
gattaagcttccttaagctc

SEQ ID NO: 102230 - DNA, 20 bp, Artificial Sequence
  chemically synthesized
agattaagcttccttaagct

SEQ ID NO: 102231 - DNA, 20 bp, Artificial Sequence
  chemically synthesized
gagaaaccctgagcttaagg

SEQ ID NO: 102232 - DNA, 20 bp, Artificial Sequence
  chemically synthesized
tttaaagattaagcttcctt

SEQ ID NO: 102233 - DNA, 20 bp, Artificial Sequence
  chemically synthesized
actgtctatttttaaagatt

SEQ ID NO: 102234 - DNA, 20 bp, Artificial Sequence
  chemically synthesized
ggaagcttaatctttaaaaa

SEQ ID NO: 102235 - DNA, 20 bp, Artificial Sequence
  chemically synthesized
atatctactgtctattttta

SEQ ID NO: 102236 - DNA, 20 bp, Artificial Sequence
  chemically synthesized
gcttaatctttaaaaataga

SEQ ID NO: 102237 - DNA, 20 bp, Artificial Sequence
  chemically synthesized
taatctttaaaaatagacag

SEQ ID NO: 102238 - DNA, 20 bp, Artificial Sequence
  chemically synthesized
gagattctgaagcaaagggc

SEQ ID NO: 102239 - DNA, 20 bp, Artificial Sequence
  chemically synthesized
gatatgcttgccctttgctt

SEQ ID NO: 102240 - DNA, 20 bp, Artificial Sequence
  chemically synthesized
gagtgagattctgaagcaaa

SEQ ID NO: 102241 - DNA, 20 bp, Artificial Sequence
  chemically synthesized
tgagtgagattctgaagcaa

SEQ ID NO: 102242 - DNA, 20 bp, Artificial Sequence
  chemically synthesized
atgagtgagattctgaagca

SEQ ID NO: 102243 - DNA, 20 bp, Artificial Sequence
  chemically synthesized
tcaacatgagtgagattctg

SEQ ID NO: 102244 - DNA, 20 bp, Artificial Sequence
  chemically synthesized
aataaaacatcaacatgagt

SEQ ID NO: 102245 - DNA, 20 bp, Artificial Sequence
  chemically synthesized
tgaaaataaaacatcaacat

SEQ ID NO: 102246 - DNA, 20 bp, Artificial Sequence
  chemically synthesized
tgttttattttcattttatt

SEQ ID NO: 102247 - DNA, 20 bp, Artificial Sequence
  chemically synthesized
agaaaaattttttaaacaca

SEQ ID NO: 102248 - DNA, 20 bp, Artificial Sequence
  chemically synthesized
aggtcaaggaggaggttgca

SEQ ID NO: 102249 - DNA, 20 bp, Artificial Sequence
  chemically synthesized
ttttccccaggtcaaggagg

SEQ ID NO: 102250 - DNA, 20 bp, Artificial Sequence
  chemically synthesized
attttccccaggtcaaggag

SEQ ID NO: 102251 - DNA, 20 bp, Artificial Sequence
  chemically synthesized
tcattttccccaggtcaagg

SEQ ID NO: 102252 - DNA, 20 bp, Artificial Sequence
  chemically synthesized
ttgcaacctcctccttgacc

SEQ ID NO: 102253 - DNA, 20 bp, Artificial Sequence
  chemically synthesized
atcattttccccaggtcaag

SEQ ID NO: 102254 - DNA, 20 bp, Artificial Sequence
  chemically synthesized
tgcaacctcctccttgacct

SEQ ID NO: 102255 - DNA, 20 bp, Artificial Sequence
  chemically synthesized
gcaacctcctccttgacctg

SEQ ID NO: 102256 - DNA, 20 bp, Artificial Sequence
  chemically synthesized
aaatcattttccccaggtca

SEQ ID NO: 102257 - DNA, 20 bp, Artificial Sequence
  chemically synthesized
taaatcattttccccaggtc

SEQ ID NO: 102258 - DNA, 20 bp, Artificial Sequence
  chemically synthesized
acctttaaatcattttcccc

SEQ ID NO: 102259 - DNA, 20 bp, Artificial Sequence
  chemically synthesized
cacctttaaatcattttccc

SEQ ID NO: 102260 - DNA, 20 bp, Artificial Sequence
  chemically synthesized
gacctggggaaaatgattta

SEQ ID NO: 102261 - DNA, 20 bp, Artificial Sequence
  chemically synthesized
acctggggaaaatgatttaa

SEQ ID NO: 102262 - DNA, 20 bp, Artificial Sequence
  chemically synthesized
caaaacacttggaaatgaag

SEQ ID NO: 102263 - DNA, 20 bp, Artificial Sequence
  chemically synthesized
aggtgtgctgcttcatttcc

SEQ ID NO: 102264 - DNA, 20 bp, Artificial Sequence
  chemically synthesized
cctcaaaacacttggaaatg

SEQ ID NO: 102265 - DNA, 20 bp, Artificial Sequence
  chemically synthesized
aagaaaaacctcaaaacact

SEQ ID NO: 102266 - DNA, 20 bp, Artificial Sequence
  chemically synthesized
gcttcatttccaagtgtttt

SEQ ID NO: 102267 - DNA, 20 bp, Artificial Sequence
  chemically synthesized
cttcatttccaagtgttttg

SEQ ID NO: 102268 - DNA, 20 bp, Artificial Sequence
  chemically synthesized
aatcaataagagaaagacaa

SEQ ID NO: 102269 - DNA, 20 bp, Artificial Sequence
  chemically synthesized
agctagaaatcaataagaga

SEQ ID NO: 102270 - DNA, 20 bp, Artificial Sequence
  chemically synthesized
accaagctagaaatcaataa

SEQ ID NO: 102271 - DNA, 20 bp, Artificial Sequence
  chemically synthesized
aaaccaagctagaaatcaat

SEQ ID NO: 102272 - DNA, 20 bp, Artificial Sequence
  chemically synthesized
gtctttctcttattgatttc

SEQ ID NO: 102273 - DNA, 20 bp, Artificial Sequence
  chemically synthesized
tctcttattgatttctagct

SEQ ID NO: 102274 - DNA, 20 bp, Artificial Sequence
  chemically synthesized
agaacataatgaaaccaagc

SEQ ID NO: 102275 - DNA, 20 bp, Artificial Sequence
  chemically synthesized
tcccagaacataatgaaacc

SEQ ID NO: 102276 - DNA, 20 bp, Artificial Sequence
  chemically synthesized
agcttggtttcattatgttc

SEQ ID NO: 102277 - DNA, 20 bp, Artificial Sequence
  chemically synthesized
gcttggtttcattatgttct

SEQ ID NO: 102278 - DNA, 20 bp, Artificial Sequence
  chemically synthesized
gaattcaacttatatgttcc

SEQ ID NO: 102279 - DNA, 20 bp, Artificial Sequence
  chemically synthesized
attatgttctgggaacatat

SEQ ID NO: 102280 - DNA, 20 bp, Artificial Sequence
  chemically synthesized
aagcaacttcagcaaattta

SEQ ID NO: 102281 - DNA, 20 bp, Artificial Sequence
  chemically synthesized
ccaagcaacttcagcaaatt

SEQ ID NO: 102282 - DNA, 20 bp, Artificial Sequence
  chemically synthesized
tgaattctctaaatttgctg

SEQ ID NO: 102283 - DNA, 20 bp, Artificial Sequence
  chemically synthesized
ttctggactccaagcaactt

SEQ ID NO: 102284 - DNA, 20 bp, Artificial Sequence
  chemically synthesized
ctaaatttgctgaagttgct

SEQ ID NO: 102285 - DNA, 20 bp, Artificial Sequence
  chemically synthesized
aaatttgctgaagttgcttg

SEQ ID NO: 102286 - DNA, 20 bp, Artificial Sequence
  chemically synthesized
tgctgaagttgcttggagtc

SEQ ID NO: 102287 - DNA, 20 bp, Artificial Sequence
  chemically synthesized
taagccatattctggactcc

SEQ ID NO: 102288 - DNA, 20 bp, Artificial Sequence
  chemically synthesized
gttgcttggagtccagaata

SEQ ID NO: 102289 - DNA, 20 bp, Artificial Sequence
  chemically synthesized
cactgatataagccatattc

SEQ ID NO: 102290 - DNA, 20 bp, Artificial Sequence
  chemically synthesized
gtccagaatatggcttatat

SEQ ID NO: 102291 - DNA, 20 bp, Artificial Sequence
  chemically synthesized
catgaaacattcactgatat

SEQ ID NO: 102292 - DNA, 20 bp, Artificial Sequence
  chemically synthesized
tatatcagtgaatgtttcat

SEQ ID NO: 102293 - DNA, 20 bp, Artificial Sequence
  chemically synthesized
tatcagtgaatgtttcatga

SEQ ID NO: 102294 - DNA, 20 bp, Artificial Sequence
  chemically synthesized
aatgtttcatgagagcttta

SEQ ID NO: 102295 - DNA, 20 bp, Artificial Sequence
  chemically synthesized
gcagaatacacattacttta

SEQ ID NO: 102296 - DNA, 20 bp, Artificial Sequence
  chemically synthesized
aatgtgtattctgctactgt

SEQ ID NO: 102297 - DNA, 20 bp, Artificial Sequence
  chemically synthesized
agcactcctcccaacagtag

SEQ ID NO: 102298 - DNA, 20 bp, Artificial Sequence
  chemically synthesized
atgtgtattctgctactgtt

SEQ ID NO: 102299 - DNA, 20 bp, Artificial Sequence
  chemically synthesized
gtgtattctgctactgttgg

SEQ ID NO: 102300 - DNA, 20 bp, Artificial Sequence
  chemically synthesized
tgaagcactcctcccaacag

SEQ ID NO: 102301 - DNA, 20 bp, Artificial Sequence
  chemically synthesized
tgtattctgctactgttggg

SEQ ID NO: 102302 - DNA, 20 bp, Artificial Sequence
  chemically synthesized
tattctgctactgttgggag

SEQ ID NO: 102303 - DNA, 20 bp, Artificial Sequence
  chemically synthesized
aattgaagcactcctcccaa

SEQ ID NO: 102304 - DNA, 20 bp, Artificial Sequence
  chemically synthesized
gttgggaggagtgcttcaat

SEQ ID NO: 102305 - DNA, 20 bp, Artificial Sequence
  chemically synthesized
caaccaataggatctaattg

SEQ ID NO: 102306 - DNA, 20 bp, Artificial Sequence
  chemically synthesized
gtgcttcaattagatcctat

SEQ ID NO: 102307 - DNA, 20 bp, Artificial Sequence
  chemically synthesized
gaacaacaccatcaaccaat

SEQ ID NO: 102308 - DNA, 20 bp, Artificial Sequence
  chemically synthesized
tgaacaacaccatcaaccaa

SEQ ID NO: 102309 - DNA, 20 bp, Artificial Sequence
  chemically synthesized
aattagatcctattggttga

SEQ ID NO: 102310 - DNA, 20 bp, Artificial Sequence
  chemically synthesized
tattggttgatggtgttgtt

SEQ ID NO: 102311 - DNA, 20 bp, Artificial Sequence
  chemically synthesized
ggaaaataagcaagggtaaa

SEQ ID NO: 102312 - DNA, 20 bp, Artificial Sequence
  chemically synthesized
atggaaaataagcaagggta

SEQ ID NO: 102313 - DNA, 20 bp, Artificial Sequence
  chemically synthesized
actaaatggaaaataagcaa

SEQ ID NO: 102314 - DNA, 20 bp, Artificial Sequence
  chemically synthesized
tactaaatggaaaataagca

SEQ ID NO: 102315 - DNA, 20 bp, Artificial Sequence
  chemically synthesized
ctactaaatggaaaataagc

SEQ ID NO: 102316 - DNA, 20 bp, Artificial Sequence
  chemically synthesized
agaactactaaatggaaaat

SEQ ID NO: 102317 - DNA, 20 bp, Artificial Sequence
  chemically synthesized
acccttgcttattttccatt

SEQ ID NO: 102318 - DNA, 20 bp, Artificial Sequence
  chemically synthesized
cttgcttattttccatttag

SEQ ID NO: 102319 - DNA, 20 bp, Artificial Sequence
  chemically synthesized
cagttgatagaactactaaa

SEQ ID NO: 102320 - DNA, 20 bp, Artificial Sequence
  chemically synthesized
tttagtagttctatcaactg

SEQ ID NO: 102321 - DNA, 20 bp, Artificial Sequence
  chemically synthesized
actcctctctcttcagttga

SEQ ID NO: 102322 - DNA, 20 bp, Artificial Sequence
  chemically synthesized
tagtagttctatcaactgaa

SEQ ID NO: 102323 - DNA, 20 bp, Artificial Sequence
  chemically synthesized
gtagttctatcaactgaaga

SEQ ID NO: 102324 - DNA, 20 bp, Artificial Sequence
  chemically synthesized
agttctatcaactgaagaga

SEQ ID NO: 102325 - DNA, 20 bp, Artificial Sequence
  chemically synthesized
gttctatcaactgaagagag

SEQ ID NO: 102326 - DNA, 20 bp, Artificial Sequence
  chemically synthesized
cttcaacactcctctctctt

SEQ ID NO: 102327 - DNA, 20 bp, Artificial Sequence
  chemically synthesized
tctatcaactgaagagagag

SEQ ID NO: 102328 - DNA, 20 bp, Artificial Sequence
  chemically synthesized
ctgaagagagaggagtgttg

SEQ ID NO: 102329 - DNA, 20 bp, Artificial Sequence
  chemically synthesized
ggagtgttgaagtccctaac

SEQ ID NO: 102330 - DNA, 20 bp, Artificial Sequence
  chemically synthesized
caaatccatatttctagtta

SEQ ID NO: 102331 - DNA, 20 bp, Artificial Sequence
  chemically synthesized
acaaatccatatttctagtt

SEQ ID NO: 102332 - DNA, 20 bp, Artificial Sequence
  chemically synthesized
gacaaatccatatttctagt

SEQ ID NO: 102333 - DNA, 20 bp, Artificial Sequence
  chemically synthesized
gaagtccctaactagaaata

SEQ ID NO: 102334 - DNA, 20 bp, Artificial Sequence
  chemically synthesized
aacagacaaatccatatttc

SEQ ID NO: 102335 - DNA, 20 bp, Artificial Sequence
  chemically synthesized
aatagagctgaaaaaagaaa

SEQ ID NO: 102336 - DNA, 20 bp, Artificial Sequence
  chemically synthesized
gatttgtctgtttctttttt

SEQ ID NO: 102337 - DNA, 20 bp, Artificial Sequence
  chemically synthesized
aaaatgaatagagctgaaaa

SEQ ID NO: 102338 - DNA, 20 bp, Artificial Sequence
  chemically synthesized
acatgaagcaaaaatgaata

SEQ ID NO: 102339 - DNA, 20 bp, Artificial Sequence
  chemically synthesized
atacatgaagcaaaaatgaa

SEQ ID NO: 102340 - DNA, 20 bp, Artificial Sequence
  chemically synthesized
acagagcttccaaatacatg

SEQ ID NO: 102341 - DNA, 20 bp, Artificial Sequence
  chemically synthesized
tcatttttgcttcatgtatt

SEQ ID NO: 102342 - DNA, 20 bp, Artificial Sequence
  chemically synthesized
tttttgcttcatgtatttgg

SEQ ID NO: 102343 - DNA, 20 bp, Artificial Sequence
  chemically synthesized
gtatttggaagctctgttgt

SEQ ID NO: 102344 - DNA, 20 bp, Artificial Sequence
  chemically synthesized
tatttggaagctctgttgtt

SEQ ID NO: 102345 - DNA, 20 bp, Artificial Sequence
  chemically synthesized
tgtgtttgcacctaacaaca

SEQ ID NO: 102346 - DNA, 20 bp, Artificial Sequence
  chemically synthesized
aatgtgtttgcacctaacaa

SEQ ID NO: 102347 - DNA, 20 bp, Artificial Sequence
  chemically synthesized
ttgttaggtgcaaacacatt

SEQ ID NO: 102348 - DNA, 20 bp, Artificial Sequence
  chemically synthesized
tgttaggtgcaaacacattt

SEQ ID NO: 102349 - DNA, 20 bp, Artificial Sequence
  chemically synthesized
ttaggattattatgtcttcc

SEQ ID NO: 102350 - DNA, 20 bp, Artificial Sequence
  chemically synthesized
ttaagtgttaattcactggg

SEQ ID NO: 102351 - DNA, 20 bp, Artificial Sequence
  chemically synthesized
agattaagtgttaattcact

SEQ ID NO: 102352 - DNA, 20 bp, Artificial Sequence
  chemically synthesized
aagattaagtgttaattcac

SEQ ID NO: 102353 - DNA, 20 bp, Artificial Sequence
  chemically synthesized
agggacattacataaagatt

SEQ ID NO: 102354 - DNA, 20 bp, Artificial Sequence
  chemically synthesized
acaaacagggacattacata

SEQ ID NO: 102355 - DNA, 20 bp, Artificial Sequence
  chemically synthesized
aaaattactagtgacaaaca

SEQ ID NO: 102356 - DNA, 20 bp, Artificial Sequence
  chemically synthesized
gaaaattactagtgacaaac

SEQ ID NO: 102357 - DNA, 20 bp, Artificial Sequence
  chemically synthesized
agaaaattactagtgacaaa

SEQ ID NO: 102358 - DNA, 20 bp, Artificial Sequence
  chemically synthesized
gtaatgtccctgtttgtcac

SEQ ID NO: 102359 - DNA, 20 bp, Artificial Sequence
  chemically synthesized
ttcattgcaaagaaaattac

SEQ ID NO: 102360 - DNA, 20 bp, Artificial Sequence
  chemically synthesized
tagtaattttctttgcaatg

SEQ ID NO: 102361 - DNA, 20 bp, Artificial Sequence
  chemically synthesized
ataaagtaggcttcattgca

SEQ ID NO: 102362 - DNA, 20 bp, Artificial Sequence
  chemically synthesized
atgttaatatcagataaagt

SEQ ID NO: 102363 - DNA, 20 bp, Artificial Sequence
  chemically synthesized
aatgttaatatcagataaag

SEQ ID NO: 102364 - DNA, 20 bp, Artificial Sequence
  chemically synthesized
agtaatgttaatatcagata

SEQ ID NO: 102365 - DNA, 20 bp, Artificial Sequence
  chemically synthesized
agcagcagtaatgttaatat

SEQ ID NO: 102366 - DNA, 20 bp, Artificial Sequence
  chemically synthesized
taatcaaaagaaagcagcag

SEQ ID NO: 102367 - DNA, 20 bp, Artificial Sequence
  chemically synthesized
aattaatcaaaagaaagcag

SEQ ID NO: 102368 - DNA, 20 bp, Artificial Sequence
  chemically synthesized
aacaattaatcaaaagaaag

SEQ ID NO: 102369 - DNA, 20 bp, Artificial Sequence
  chemically synthesized
tgcaacaattaatcaaaaga

SEQ ID NO: 102370 - DNA, 20 bp, Artificial Sequence
  chemically synthesized
attatgcaacaattaatcaa

SEQ ID NO: 102371 - DNA, 20 bp, Artificial Sequence
  chemically synthesized
taaaattaaaagaatcgaaa

SEQ ID NO: 102372 - DNA, 20 bp, Artificial Sequence
  chemically synthesized
cctaggtaggttaaaattaa

SEQ ID NO: 102373 - DNA, 20 bp, Artificial Sequence
  chemically synthesized
tcttttaattttaacctacc

SEQ ID NO: 102374 - DNA, 20 bp, Artificial Sequence
  chemically synthesized
cttttaattttaacctacct

SEQ ID NO: 102375 - DNA, 20 bp, Artificial Sequence
  chemically synthesized
atttcaaatacaacctaggt

SEQ ID NO: 102376 - DNA, 20 bp, Artificial Sequence
  chemically synthesized
tatttcaaatacaacctagg

SEQ ID NO: 102377 - DNA, 20 bp, Artificial Sequence
  chemically synthesized
gtttatttcaaatacaacct

SEQ ID NO: 102378 - DNA, 20 bp, Artificial Sequence
  chemically synthesized
agtttatttcaaatacaacc

SEQ ID NO: 102379 - DNA, 20 bp, Artificial Sequence
  chemically synthesized
tatttgaaataaacttcttt

SEQ ID NO: 102380 - DNA, 20 bp, Artificial Sequence
  chemically synthesized
cacaatatgccgtctaaaag

SEQ ID NO: 102381 - DNA, 20 bp, Artificial Sequence
  chemically synthesized
tgaaataaacttcttttaga

SEQ ID NO: 102382 - DNA, 20 bp, Artificial Sequence
  chemically synthesized
gcacacaatatgccgtctaa

SEQ ID NO: 102383 - DNA, 20 bp, Artificial Sequence
  chemically synthesized
tagacggcatattgtgtgct

SEQ ID NO: 102384 - DNA, 20 bp, Artificial Sequence
  chemically synthesized
tgagtggattgataaaagct

SEQ ID NO: 102385 - DNA, 20 bp, Artificial Sequence
  chemically synthesized
ttagctgagtggattgataa

SEQ ID NO: 102386 - DNA, 20 bp, Artificial Sequence
  chemically synthesized
tcagcttttatcaatccact

SEQ ID NO: 102387 - DNA, 20 bp, Artificial Sequence
  chemically synthesized
ttaaaagagatttagctgag

SEQ ID NO: 102388 - DNA, 20 bp, Artificial Sequence
  chemically synthesized
caattaaaagagatttagct

SEQ ID NO: 102389 - DNA, 20 bp, Artificial Sequence
  chemically synthesized
tataccaattaaaagagatt

SEQ ID NO: 102390 - DNA, 20 bp, Artificial Sequence
  chemically synthesized
tcagctaaatctcttttaat

SEQ ID NO: 102391 - DNA, 20 bp, Artificial Sequence
  chemically synthesized
tctaaatataccaattaaaa

SEQ ID NO: 102392 - DNA, 20 bp, Artificial Sequence
  chemically synthesized
ggtctaaatataccaattaa

SEQ ID NO: 102393 - DNA, 20 bp, Artificial Sequence
  chemically synthesized
tctcttttaattggtatatt

SEQ ID NO: 102394 - DNA, 20 bp, Artificial Sequence
  chemically synthesized
ataattaccttaaatgcaaa

SEQ ID NO: 102395 - DNA, 20 bp, Artificial Sequence
  chemically synthesized
tatttagaccatttgcattt

SEQ ID NO: 102396 - DNA, 20 bp, Artificial Sequence
  chemically synthesized
atttagaccatttgcattta

SEQ ID NO: 102397 - DNA, 20 bp, Artificial Sequence
  chemically synthesized
atttgcatttaaggtaatta

SEQ ID NO: 102398 - DNA, 20 bp, Artificial Sequence
  chemically synthesized
taaggtaattatggatatat

SEQ ID NO: 102399 - DNA, 20 bp, Artificial Sequence
  chemically synthesized
aaggtaattatggatatatt

SEQ ID NO: 102400 - DNA, 20 bp, Artificial Sequence
  chemically synthesized
aggtaattatggatatatta

SEQ ID NO: 102401 - DNA, 20 bp, Artificial Sequence
  chemically synthesized
ccaaataaggtggcagattg

SEQ ID NO: 102402 - DNA, 20 bp, Artificial Sequence
  chemically synthesized
acagaaaccaaataaggtgg

SEQ ID NO: 102403 - DNA, 20 bp, Artificial Sequence
  chemically synthesized
cttcaatctgccaccttatt

SEQ ID NO: 102404 - DNA, 20 bp, Artificial Sequence
  chemically synthesized
caaacagaaaccaaataagg

SEQ ID NO: 102405 - DNA, 20 bp, Artificial Sequence
  chemically synthesized
aaacaaacagaaaccaaata

SEQ ID NO: 102406 - DNA, 20 bp, Artificial Sequence
  chemically synthesized
aaaacaaacagaaaccaaat

SEQ ID NO: 102407 - DNA, 20 bp, Artificial Sequence
  chemically synthesized
tgagaaataaagaaaacaaa

SEQ ID NO: 102408 - DNA, 20 bp, Artificial Sequence
  chemically synthesized
aaagagaagaatgagaaata

SEQ ID NO: 102409 - DNA, 20 bp, Artificial Sequence
  chemically synthesized
gaaaaaagaaagagaagaat

SEQ ID NO: 102410 - DNA, 20 bp, Artificial Sequence
  chemically synthesized
aggtaagaaaaaagaaagag

SEQ ID NO: 102411 - DNA, 20 bp, Artificial Sequence
  chemically synthesized
agaaggtaagaaaaaagaaa

SEQ ID NO: 102412 - DNA, 20 bp, Artificial Sequence
  chemically synthesized
caagaaggtaagaaaaaaga

SEQ ID NO: 102413 - DNA, 20 bp, Artificial Sequence
  chemically synthesized
cccacaagaaggtaagaaaa

SEQ ID NO: 102414 - DNA, 20 bp, Artificial Sequence
  chemically synthesized
caaataacccacaagaaggt

SEQ ID NO: 102415 - DNA, 20 bp, Artificial Sequence
  chemically synthesized
tcttttttcttaccttcttg

SEQ ID NO: 102416 - DNA, 20 bp, Artificial Sequence
  chemically synthesized
cttttttcttaccttcttgt

SEQ ID NO: 102417 - DNA, 20 bp, Artificial Sequence
  chemically synthesized
tgttcaaataacccacaaga

SEQ ID NO: 102418 - DNA, 20 bp, Artificial Sequence
  chemically synthesized
atgttcaaataacccacaag

SEQ ID NO: 102419 - DNA, 20 bp, Artificial Sequence
  chemically synthesized
gaaatgttcaaataacccac

SEQ ID NO: 102420 - DNA, 20 bp, Artificial Sequence
  chemically synthesized
gggttatttgaacatttctt

SEQ ID NO: 102421 - DNA, 20 bp, Artificial Sequence
  chemically synthesized
ataaattttgatggaatctt

SEQ ID NO: 102422 - DNA, 20 bp, Artificial Sequence
  chemically synthesized
atacaacaaataaattttga

SEQ ID NO: 102423 - DNA, 20 bp, Artificial Sequence
  chemically synthesized
actatacaaagtgatacgtt

SEQ ID NO: 102424 - DNA, 20 bp, Artificial Sequence
  chemically synthesized
tcttaacgtatcactttgta

SEQ ID NO: 102425 - DNA, 20 bp, Artificial Sequence
  chemically synthesized
gaccactaaaaaactataca

SEQ ID NO: 102426 - DNA, 20 bp, Artificial Sequence
  chemically synthesized
tatcactttgtatagttttt

SEQ ID NO: 102427 - DNA, 20 bp, Artificial Sequence
  chemically synthesized
cactttgtatagttttttag

SEQ ID NO: 102428 - DNA, 20 bp, Artificial Sequence
  chemically synthesized
tagttttttagtggtctttc

SEQ ID NO: 102429 - DNA, 20 bp, Artificial Sequence
  chemically synthesized
agttttttagtggtctttcc

SEQ ID NO: 102430 - DNA, 20 bp, Artificial Sequence
  chemically synthesized
tgcgtatcgtaatgcctgga

SEQ ID NO: 102431 - DNA, 20 bp, Artificial Sequence
  chemically synthesized
ttaatgcgtatcgtaatgcc

SEQ ID NO: 102432 - DNA, 20 bp, Artificial Sequence
  chemically synthesized
gcattaacattgcaatctac

SEQ ID NO: 102433 - DNA, 20 bp, Artificial Sequence
  chemically synthesized
tcacctgaagtcaattccag

SEQ ID NO: 102434 - DNA, 20 bp, Artificial Sequence
  chemically synthesized
acgtcacctgaagtcaattc

SEQ ID NO: 102435 - DNA, 20 bp, Artificial Sequence
  chemically synthesized
caatctactggaattgactt

SEQ ID NO: 102436 - DNA, 20 bp, Artificial Sequence
  chemically synthesized
aatctactggaattgacttc

SEQ ID NO: 102437 - DNA, 20 bp, Artificial Sequence
  chemically synthesized
gtccttctacacgtcacctg

SEQ ID NO: 102438 - DNA, 20 bp, Artificial Sequence
  chemically synthesized
aattgacttcaggtgacgtg

SEQ ID NO: 102439 - DNA, 20 bp, Artificial Sequence
  chemically synthesized
tgacttcaggtgacgtgtag

SEQ ID NO: 102440 - DNA, 20 bp, Artificial Sequence
  chemically synthesized
gacttcaggtgacgtgtaga

SEQ ID NO: 102441 - DNA, 20 bp, Artificial Sequence
  chemically synthesized
acatacctaagtggaagtaa

SEQ ID NO: 102442 - DNA, 20 bp, Artificial Sequence
  chemically synthesized
agacatacctaagtggaagt

SEQ ID NO: 102443 - DNA, 20 bp, Artificial Sequence
  chemically synthesized
gaaggactcttacttccact

SEQ ID NO: 102444 - DNA, 20 bp, Artificial Sequence
  chemically synthesized
aaggactcttacttccactt

SEQ ID NO: 102445 - DNA, 20 bp, Artificial Sequence
  chemically synthesized
aagaagacatacctaagtgg

SEQ ID NO: 102446 - DNA, 20 bp, Artificial Sequence
  chemically synthesized
taaaagaagacatacctaag

SEQ ID NO: 102447 - DNA, 20 bp, Artificial Sequence
  chemically synthesized
ttttaaaagaagacatacct

SEQ ID NO: 102448 - DNA, 20 bp, Artificial Sequence
  chemically synthesized
taagagttatattttaaaag

SEQ ID NO: 102449 - DNA, 20 bp, Artificial Sequence
  chemically synthesized
acttaagagttatattttaa

SEQ ID NO: 102450 - DNA, 20 bp, Artificial Sequence
  chemically synthesized
tcttttaaaatataactctt

SEQ ID NO: 102451 - DNA, 20 bp, Artificial Sequence
  chemically synthesized
tatgtagagaaaatacttaa

SEQ ID NO: 102452 - DNA, 20 bp, Artificial Sequence
  chemically synthesized
tgtatgtagagaaaatactt

SEQ ID NO: 102453 - DNA, 20 bp, Artificial Sequence
  chemically synthesized
tgtggttctcaatgtatgta

SEQ ID NO: 102454 - DNA, 20 bp, Artificial Sequence
  chemically synthesized
gatgtggttctcaatgtatg

SEQ ID NO: 102455 - DNA, 20 bp, Artificial Sequence
  chemically synthesized
gtattttctctacatacatt

SEQ ID NO: 102456 - DNA, 20 bp, Artificial Sequence
  chemically synthesized
acatacattgagaaccacat

SEQ ID NO: 102457 - DNA, 20 bp, Artificial Sequence
  chemically synthesized
catacattgagaaccacatc

SEQ ID NO: 102458 - DNA, 20 bp, Artificial Sequence
  chemically synthesized
acattgagaaccacatcagg

SEQ ID NO: 102459 - DNA, 20 bp, Artificial Sequence
  chemically synthesized
aactttaacaccacctgatg

SEQ ID NO: 102460 - DNA, 20 bp, Artificial Sequence
  chemically synthesized
aaccacatcaggtggtgtta

SEQ ID NO: 102461 - DNA, 20 bp, Artificial Sequence
  chemically synthesized
tcctatttaccataagtttg

SEQ ID NO: 102462 - DNA, 20 bp, Artificial Sequence
  chemically synthesized
aagttttcacttcaaactta

SEQ ID NO: 102463 - DNA, 20 bp, Artificial Sequence
  chemically synthesized
tagactatcctatttaccat

SEQ ID NO: 102464 - DNA, 20 bp, Artificial Sequence
  chemically synthesized
cacttcaaacttatggtaaa

SEQ ID NO: 102465 - DNA, 20 bp, Artificial Sequence
  chemically synthesized
acttcaaacttatggtaaat

SEQ ID NO: 102466 - DNA, 20 bp, Artificial Sequence
  chemically synthesized
caaacttatggtaaatagga

SEQ ID NO: 102467 - DNA, 20 bp, Artificial Sequence
  chemically synthesized
taaaaatgagagtaaaataa

SEQ ID NO: 102468 - DNA, 20 bp, Artificial Sequence
  chemically synthesized
agtagaatgggtaaaaatga

SEQ ID NO: 102469 - DNA, 20 bp, Artificial Sequence
  chemically synthesized
atagtagaatgggtaaaaat

SEQ ID NO: 102470 - DNA, 20 bp, Artificial Sequence
  chemically synthesized
cagaaagaaaatagtagaat

SEQ ID NO: 102471 - DNA, 20 bp, Artificial Sequence
  chemically synthesized
tcagaaagaaaatagtagaa

SEQ ID NO: 102472 - DNA, 20 bp, Artificial Sequence
  chemically synthesized
acatttcagaaagaaaatag

SEQ ID NO: 102473 - DNA, 20 bp, Artificial Sequence
  chemically synthesized
ttgacatttcagaaagaaaa

SEQ ID NO: 102474 - DNA, 20 bp, Artificial Sequence
  chemically synthesized
cgaagtcttgacatttcaga

SEQ ID NO: 102475 - DNA, 20 bp, Artificial Sequence
  chemically synthesized
tattttctttctgaaatgtc

SEQ ID NO: 102476 - DNA, 20 bp, Artificial Sequence
  chemically synthesized
ataacgaagtcttgacattt

SEQ ID NO: 102477 - DNA, 20 bp, Artificial Sequence
  chemically synthesized
acagaaaggaaattataacg

SEQ ID NO: 102478 - DNA, 20 bp, Artificial Sequence
  chemically synthesized
gttataatttcctttctgtt

SEQ ID NO: 102479 - DNA, 20 bp, Artificial Sequence
  chemically synthesized
aagacattctctaaacagaa

SEQ ID NO: 102480 - DNA, 20 bp, Artificial Sequence
  chemically synthesized
aaagacattctctaaacaga

SEQ ID NO: 102481 - DNA, 20 bp, Artificial Sequence
  chemically synthesized
tataatttcctttctgttta

SEQ ID NO: 102482 - DNA, 20 bp, Artificial Sequence
  chemically synthesized
acaaaaagacattctctaaa

SEQ ID NO: 102483 - DNA, 20 bp, Artificial Sequence
  chemically synthesized
tgctcttaaagaatgacaaa

SEQ ID NO: 102484 - DNA, 20 bp, Artificial Sequence
  chemically synthesized
atgtctttttgtcattcttt

SEQ ID NO: 102485 - DNA, 20 bp, Artificial Sequence
  chemically synthesized
gtctttttgtcattctttaa

SEQ ID NO: 102486 - DNA, 20 bp, Artificial Sequence
  chemically synthesized
tttttgtcattctttaagag

SEQ ID NO: 102487 - DNA, 20 bp, Artificial Sequence
  chemically synthesized
tgctagcaaatctgctctta

SEQ ID NO: 102488 - DNA, 20 bp, Artificial Sequence
  chemically synthesized
ttctttaagagcagatttgc

SEQ ID NO: 102489 - DNA, 20 bp, Artificial Sequence
  chemically synthesized
ttaagagcagatttgctagc

SEQ ID NO: 102490 - DNA, 20 bp, Artificial Sequence
  chemically synthesized
gaaaacaaagaatttcttgc

SEQ ID NO: 102491 - DNA, 20 bp, Artificial Sequence
  chemically synthesized
ttctcagattaaggaaaaca

SEQ ID NO: 102492 - DNA, 20 bp, Artificial Sequence
  chemically synthesized
ttctttgttttccttaatct

SEQ ID NO: 102493 - DNA, 20 bp, Artificial Sequence
  chemically synthesized
aaagagacattctcagatta

SEQ ID NO: 102494 - DNA, 20 bp, Artificial Sequence
  chemically synthesized
gaaagagacattctcagatt

SEQ ID NO: 102495 - DNA, 20 bp, Artificial Sequence
  chemically synthesized
taaagggaaagagacattct

SEQ ID NO: 102496 - DNA, 20 bp, Artificial Sequence
  chemically synthesized
cctaaggaattaaagggaaa

SEQ ID NO: 102497 - DNA, 20 bp, Artificial Sequence
  chemically synthesized
ttcctaaggaattaaaggga

SEQ ID NO: 102498 - DNA, 20 bp, Artificial Sequence
  chemically synthesized
ggttttcctaaggaattaaa

SEQ ID NO: 102499 - DNA, 20 bp, Artificial Sequence
  chemically synthesized
aggttttcctaaggaattaa

SEQ ID NO: 102500 - DNA, 20 bp, Artificial Sequence
  chemically synthesized
aaggttttcctaaggaatta

SEQ ID NO: 102501 - DNA, 20 bp, Artificial Sequence
  chemically synthesized
tctctttccctttaattcct

SEQ ID NO: 102502 - DNA, 20 bp, Artificial Sequence
  chemically synthesized
ctctttccctttaattcctt

SEQ ID NO: 102503 - DNA, 20 bp, Artificial Sequence
  chemically synthesized
taactcctaaggttttccta

SEQ ID NO: 102504 - DNA, 20 bp, Artificial Sequence
  chemically synthesized
ataactcctaaggttttcct

SEQ ID NO: 102505 - DNA, 20 bp, Artificial Sequence
  chemically synthesized
ttaattccttaggaaaacct

SEQ ID NO: 102506 - DNA, 20 bp, Artificial Sequence
  chemically synthesized
taattccttaggaaaacctt

SEQ ID NO: 102507 - DNA, 20 bp, Artificial Sequence
  chemically synthesized
attccttaggaaaaccttag

SEQ ID NO: 102508 - DNA, 20 bp, Artificial Sequence
  chemically synthesized
agataatcagataactccta

SEQ ID NO: 102509 - DNA, 20 bp, Artificial Sequence
  chemically synthesized
tagataatcagataactcct

SEQ ID NO: 102510 - DNA, 20 bp, Artificial Sequence
  chemically synthesized
taggagttatctgattatct

SEQ ID NO: 102511 - DNA, 20 bp, Artificial Sequence
  chemically synthesized
ggtacagactcttagataat

SEQ ID NO: 102512 - DNA, 20 bp, Artificial Sequence
  chemically synthesized
ggagttatctgattatctaa

SEQ ID NO: 102513 - DNA, 20 bp, Artificial Sequence
  chemically synthesized
aagtctaaggtacagactct

SEQ ID NO: 102514 - DNA, 20 bp, Artificial Sequence
  chemically synthesized
ttatctaagagtctgtacct

SEQ ID NO: 102515 - DNA, 20 bp, Artificial Sequence
  chemically synthesized
cataaccaaagtctaaggta

SEQ ID NO: 102516 - DNA, 20 bp, Artificial Sequence
  chemically synthesized
agagtctgtaccttagactt

SEQ ID NO: 102517 - DNA, 20 bp, Artificial Sequence
  chemically synthesized
aatagcataaccaaagtcta

SEQ ID NO: 102518 - DNA, 20 bp, Artificial Sequence
  chemically synthesized
aaatagcataaccaaagtct

SEQ ID NO: 102519 - DNA, 20 bp, Artificial Sequence
  chemically synthesized
attgcaaaatagcataacca

SEQ ID NO: 102520 - DNA, 20 bp, Artificial Sequence
  chemically synthesized
aaacgtacagaattgcaaaa

SEQ ID NO: 102521 - DNA, 20 bp, Artificial Sequence
  chemically synthesized
caaattgacttttaaacgta

SEQ ID NO: 102522 - DNA, 20 bp, Artificial Sequence
  chemically synthesized
ttgcaattctgtacgtttaa

SEQ ID NO: 102523 - DNA, 20 bp, Artificial Sequence
  chemically synthesized
tacgtttaaaagtcaatttg

SEQ ID NO: 102524 - DNA, 20 bp, Artificial Sequence
  chemically synthesized
cgtttaaaagtcaatttgtg

SEQ ID NO: 102525 - DNA, 20 bp, Artificial Sequence
  chemically synthesized
gtttaaaagtcaatttgtgg

SEQ ID NO: 102526 - DNA, 20 bp, Artificial Sequence
  chemically synthesized
tttaaaagtcaatttgtgga

SEQ ID NO: 102527 - DNA, 20 bp, Artificial Sequence
  chemically synthesized
gtcaatttgtggagggctga

SEQ ID NO: 102528 - DNA, 20 bp, Artificial Sequence
  chemically synthesized
agaatcatttgtgtcaccat

SEQ ID NO: 102529 - DNA, 20 bp, Artificial Sequence
  chemically synthesized
cacaaatgattcttgttcac

SEQ ID NO: 102530 - DNA, 20 bp, Artificial Sequence
  chemically synthesized
tttactggcatctagtgaac

SEQ ID NO: 102531 - DNA, 20 bp, Artificial Sequence
  chemically synthesized
gattcttgttcactagatgc

SEQ ID NO: 102532 - DNA, 20 bp, Artificial Sequence
  chemically synthesized
gagaaaattttactggcatc

SEQ ID NO: 102533 - DNA, 20 bp, Artificial Sequence
  chemically synthesized
gttccatgagaaaattttac

SEQ ID NO: 102534 - DNA, 20 bp, Artificial Sequence
  chemically synthesized
atgccagtaaaattttctca

SEQ ID NO: 102535 - DNA, 20 bp, Artificial Sequence
  chemically synthesized
aggaatctattgcgttccat

SEQ ID NO: 102536 - DNA, 20 bp, Artificial Sequence
  chemically synthesized
aattttctcatggaacgcaa

SEQ ID NO: 102537 - DNA, 20 bp, Artificial Sequence
  chemically synthesized
cgcaatagattcctgcccta

SEQ ID NO: 102538 - DNA, 20 bp, Artificial Sequence
  chemically synthesized
ctgatcactaactgtagggc

SEQ ID NO: 102539 - DNA, 20 bp, Artificial Sequence
  chemically synthesized
actgatcactaactgtaggg

SEQ ID NO: 102540 - DNA, 20 bp, Artificial Sequence
  chemically synthesized
atagattcctgccctacagt

SEQ ID NO: 102541 - DNA, 20 bp, Artificial Sequence
  chemically synthesized
aatactgatcactaactgta

SEQ ID NO: 102542 - DNA, 20 bp, Artificial Sequence
  chemically synthesized
caatactgatcactaactgt

SEQ ID NO: 102543 - DNA, 20 bp, Artificial Sequence
  chemically synthesized
acaatactgatcactaactg

SEQ ID NO: 102544 - DNA, 20 bp, Artificial Sequence
  chemically synthesized
cctgccctacagttagtgat

SEQ ID NO: 102545 - DNA, 20 bp, Artificial Sequence
  chemically synthesized
tgctgataggaattttataa

SEQ ID NO: 102546 - DNA, 20 bp, Artificial Sequence
  chemically synthesized
atctgttataaaattcctat

SEQ ID NO: 102547 - DNA, 20 bp, Artificial Sequence
  chemically synthesized
aaacactctagaatgctgat

SEQ ID NO: 102548 - DNA, 20 bp, Artificial Sequence
  chemically synthesized
aaaacactctagaatgctga

SEQ ID NO: 102549 - DNA, 20 bp, Artificial Sequence
  chemically synthesized
taaaattcctatcagcattc

SEQ ID NO: 102550 - DNA, 20 bp, Artificial Sequence
  chemically synthesized
aaattcctatcagcattcta

SEQ ID NO: 102551 - DNA, 20 bp, Artificial Sequence
  chemically synthesized
tatatatataaaaaacactc

SEQ ID NO: 102552 - DNA, 20 bp, Artificial Sequence
  chemically synthesized
atatatatatgccaattctt

SEQ ID NO: 102553 - DNA, 20 bp, Artificial Sequence
  chemically synthesized
caaaggagagtctgaagaat

SEQ ID NO: 102554 - DNA, 20 bp, Artificial Sequence
  chemically synthesized
ttggttcaaaggagagtctg

SEQ ID NO: 102555 - DNA, 20 bp, Artificial Sequence
  chemically synthesized
gttacagttggttcaaagga

SEQ ID NO: 102556 - DNA, 20 bp, Artificial Sequence
  chemically synthesized
tagttacagttggttcaaag

SEQ ID NO: 102557 - DNA, 20 bp, Artificial Sequence
  chemically synthesized
gttagttacagttggttcaa

SEQ ID NO: 102558 - DNA, 20 bp, Artificial Sequence
  chemically synthesized
tgttagttacagttggttca

SEQ ID NO: 102559 - DNA, 20 bp, Artificial Sequence
  chemically synthesized
agtaagatgttagttacagt

SEQ ID NO: 102560 - DNA, 20 bp, Artificial Sequence
  chemically synthesized
aattagtaagatgttagtta

SEQ ID NO: 102561 - DNA, 20 bp, Artificial Sequence
  chemically synthesized
tgaaggaattagtaagatgt

SEQ ID NO: 102562 - DNA, 20 bp, Artificial Sequence
  chemically synthesized
taactgatgaaggaattagt

SEQ ID NO: 102563 - DNA, 20 bp, Artificial Sequence
  chemically synthesized
tcattaactgatgaaggaat

SEQ ID NO: 102564 - DNA, 20 bp, Artificial Sequence
  chemically synthesized
catcttactaattccttcat

SEQ ID NO: 102565 - DNA, 20 bp, Artificial Sequence
  chemically synthesized
attagatcattaactgatga

SEQ ID NO: 102566 - DNA, 20 bp, Artificial Sequence
  chemically synthesized
tattagatcattaactgatg

SEQ ID NO: 102567 - DNA, 20 bp, Artificial Sequence
  chemically synthesized
atatgtgtaaaacattttat

SEQ ID NO: 102568 - DNA, 20 bp, Artificial Sequence
  chemically synthesized
atattcattttatattttta

SEQ ID NO: 102569 - DNA, 20 bp, Artificial Sequence
  chemically synthesized
tattcattttatatttttat

SEQ ID NO: 102570 - DNA, 20 bp, Artificial Sequence
  chemically synthesized
ttctaaagagacaaaattgt

SEQ ID NO: 102571 - DNA, 20 bp, Artificial Sequence
  chemically synthesized
gactcacaattttgtctctt

SEQ ID NO: 102572 - DNA, 20 bp, Artificial Sequence
  chemically synthesized
tataaggctacatttctaaa

SEQ ID NO: 102573 - DNA, 20 bp, Artificial Sequence
  chemically synthesized
tatataaggctacatttcta

SEQ ID NO: 102574 - DNA, 20 bp, Artificial Sequence
  chemically synthesized
attttgtctctttagaaatg

SEQ ID NO: 102575 - DNA, 20 bp, Artificial Sequence
  chemically synthesized
ttatgtctgtattttatata

SEQ ID NO: 102576 - DNA, 20 bp, Artificial Sequence
  chemically synthesized
tttatgtctgtattttatat

SEQ ID NO: 102577 - DNA, 20 bp, Artificial Sequence
  chemically synthesized
atgtagccttatataaaata

SEQ ID NO: 102578 - DNA, 20 bp, Artificial Sequence
  chemically synthesized
aagtaaaataatgaattaat

SEQ ID NO: 102579 - DNA, 20 bp, Artificial Sequence
  chemically synthesized
taagtaaaataatgaattaa

SEQ ID NO: 102580 - DNA, 20 bp, Artificial Sequence
  chemically synthesized
attcattattttacttacaa

SEQ ID NO: 102581 - DNA, 20 bp, Artificial Sequence
  chemically synthesized
ttcattattttacttacaaa

SEQ ID NO: 102582 - DNA, 20 bp, Artificial Sequence
  chemically synthesized
gatacataggtaccttttgt

SEQ ID NO: 102583 - DNA, 20 bp, Artificial Sequence
  chemically synthesized
tagaaaactttcagatacat

SEQ ID NO: 102584 - DNA, 20 bp, Artificial Sequence
  chemically synthesized
ttagaaaactttcagataca

SEQ ID NO: 102585 - DNA, 20 bp, Artificial Sequence
  chemically synthesized
aaaggtacctatgtatctga

SEQ ID NO: 102586 - DNA, 20 bp, Artificial Sequence
  chemically synthesized
tcaggcacttagaaaacttt

SEQ ID NO: 102587 - DNA, 20 bp, Artificial Sequence
  chemically synthesized
tatgtatctgaaagttttct

SEQ ID NO: 102588 - DNA, 20 bp, Artificial Sequence
  chemically synthesized
gaagctgtgtgtcaggcact

SEQ ID NO: 102589 - DNA, 20 bp, Artificial Sequence
  chemically synthesized
ttttctaagtgcctgacaca

SEQ ID NO: 102590 - DNA, 20 bp, Artificial Sequence
  chemically synthesized
attaggggaagctgtgtgtc

SEQ ID NO: 102591 - DNA, 20 bp, Artificial Sequence
  chemically synthesized
cattaggggaagctgtgtgt

SEQ ID NO: 102592 - DNA, 20 bp, Artificial Sequence
  chemically synthesized
agaagagttatcattagggg

SEQ ID NO: 102593 - DNA, 20 bp, Artificial Sequence
  chemically synthesized
tacagaagagttatcattag

SEQ ID NO: 102594 - DNA, 20 bp, Artificial Sequence
  chemically synthesized
gtacagaagagttatcatta

SEQ ID NO: 102595 - DNA, 20 bp, Artificial Sequence
  chemically synthesized
cgtacagaagagttatcatt

SEQ ID NO: 102596 - DNA, 20 bp, Artificial Sequence
  chemically synthesized
gcgtacagaagagttatcat

SEQ ID NO: 102597 - DNA, 20 bp, Artificial Sequence
  chemically synthesized
aatctctcatgcgtacagaa

SEQ ID NO: 102598 - DNA, 20 bp, Artificial Sequence
  chemically synthesized
taaatctctcatgcgtacag

SEQ ID NO: 102599 - DNA, 20 bp, Artificial Sequence
  chemically synthesized
gataactcttctgtacgcat

SEQ ID NO: 102600 - DNA, 20 bp, Artificial Sequence
  chemically synthesized
agataaatctctcatgcgta

SEQ ID NO: 102601 - DNA, 20 bp, Artificial Sequence
  chemically synthesized
taactcttctgtacgcatga

SEQ ID NO: 102602 - DNA, 20 bp, Artificial Sequence
  chemically synthesized
tcagtgtttgtttaaatgtt

SEQ ID NO: 102603 - DNA, 20 bp, Artificial Sequence
  chemically synthesized
ttttgttaatagtgttgtat

SEQ ID NO: 102604 - DNA, 20 bp, Artificial Sequence
  chemically synthesized
aaagtctgtagttttgttaa

SEQ ID NO: 102605 - DNA, 20 bp, Artificial Sequence
  chemically synthesized
caacactattaacaaaacta

SEQ ID NO: 102606 - DNA, 20 bp, Artificial Sequence
  chemically synthesized
tgaaatctgaataaagtctg

SEQ ID NO: 102607 - DNA, 20 bp, Artificial Sequence
  chemically synthesized
acaaaactacagactttatt

SEQ ID NO: 102608 - DNA, 20 bp, Artificial Sequence
  chemically synthesized
aaactggtgaaatctgaata

SEQ ID NO: 102609 - DNA, 20 bp, Artificial Sequence
  chemically synthesized
agactttattcagatttcac

SEQ ID NO: 102610 - DNA, 20 bp, Artificial Sequence
  chemically synthesized
aatgacatgagtggaaaaac

SEQ ID NO: 102611 - DNA, 20 bp, Artificial Sequence
  chemically synthesized
aaacagaaaaatgacatgag

SEQ ID NO: 102612 - DNA, 20 bp, Artificial Sequence
  chemically synthesized
ctgaaacagaaaaatgacat

SEQ ID NO: 102613 - DNA, 20 bp, Artificial Sequence
  chemically synthesized
ctcatgtcatttttctgttt

SEQ ID NO: 102614 - DNA, 20 bp, Artificial Sequence
  chemically synthesized
tcatgtcatttttctgtttc

SEQ ID NO: 102615 - DNA, 20 bp, Artificial Sequence
  chemically synthesized
ttctggattggatcctgaaa

SEQ ID NO: 102616 - DNA, 20 bp, Artificial Sequence
  chemically synthesized
ttctgtttcaggatccaatc

SEQ ID NO: 102617 - DNA, 20 bp, Artificial Sequence
  chemically synthesized
tgcagtaggagattctggat

SEQ ID NO: 102618 - DNA, 20 bp, Artificial Sequence
  chemically synthesized
ccaaatgcagtaggagattc

SEQ ID NO: 102619 - DNA, 20 bp, Artificial Sequence
  chemically synthesized
ccaaggaccaaatgcagtag

SEQ ID NO: 102620 - DNA, 20 bp, Artificial Sequence
  chemically synthesized
acccaaggaccaaatgcagt

SEQ ID NO: 102621 - DNA, 20 bp, Artificial Sequence
  chemically synthesized
ccagaatctcctactgcatt

SEQ ID NO: 102622 - DNA, 20 bp, Artificial Sequence
  chemically synthesized
gacccaaggaccaaatgcag

SEQ ID NO: 102623 - DNA, 20 bp, Artificial Sequence
  chemically synthesized
aaagacccaaggaccaaatg

SEQ ID NO: 102624 - DNA, 20 bp, Artificial Sequence
  chemically synthesized
ctcctactgcatttggtcct

SEQ ID NO: 102625 - DNA, 20 bp, Artificial Sequence
  chemically synthesized
tcctactgcatttggtcctt

SEQ ID NO: 102626 - DNA, 20 bp, Artificial Sequence
  chemically synthesized
gaggagaccaaaaagaccca

SEQ ID NO: 102627 - DNA, 20 bp, Artificial Sequence
  chemically synthesized
agaggagaccaaaaagaccc

SEQ ID NO: 102628 - DNA, 20 bp, Artificial Sequence
  chemically synthesized
atttggtccttgggtctttt

SEQ ID NO: 102629 - DNA, 20 bp, Artificial Sequence
  chemically synthesized
acagactagaggagaccaaa

SEQ ID NO: 102630 - DNA, 20 bp, Artificial Sequence
  chemically synthesized
tgggtctttttggtctcctc

SEQ ID NO: 102631 - DNA, 20 bp, Artificial Sequence
  chemically synthesized
gagactgtcacagactagag

SEQ ID NO: 102632 - DNA, 20 bp, Artificial Sequence
  chemically synthesized
gagagactgtcacagactag

SEQ ID NO: 102633 - DNA, 20 bp, Artificial Sequence
  chemically synthesized
tgagagactgtcacagacta

SEQ ID NO: 102634 - DNA, 20 bp, Artificial Sequence
  chemically synthesized
actgagagactgtcacagac

SEQ ID NO: 102635 - DNA, 20 bp, Artificial Sequence
  chemically synthesized
tggtctcctctagtctgtga

SEQ ID NO: 102636 - DNA, 20 bp, Artificial Sequence
  chemically synthesized
aagaaactgagagactgtca

SEQ ID NO: 102637 - DNA, 20 bp, Artificial Sequence
  chemically synthesized
tctagtctgtgacagtctct

SEQ ID NO: 102638 - DNA, 20 bp, Artificial Sequence
  chemically synthesized
gaagaacaagaagaaactga

SEQ ID NO: 102639 - DNA, 20 bp, Artificial Sequence
  chemically synthesized
atgaagaacaagaagaaact

SEQ ID NO: 102640 - DNA, 20 bp, Artificial Sequence
  chemically synthesized
tcaaggtcatgaagaacaag

SEQ ID NO: 102641 - DNA, 20 bp, Artificial Sequence
  chemically synthesized
gtttcaaggtcatgaagaac

SEQ ID NO: 102642 - DNA, 20 bp, Artificial Sequence
  chemically synthesized
tcaaaagtttcaaggtcatg

SEQ ID NO: 102643 - DNA, 20 bp, Artificial Sequence
  chemically synthesized
agtcctattcaaaagtttca

SEQ ID NO: 102644 - DNA, 20 bp, Artificial Sequence
  chemically synthesized
tagtcctattcaaaagtttc

SEQ ID NO: 102645 - DNA, 20 bp, Artificial Sequence
  chemically synthesized
atgaccttgaaacttttgaa

SEQ ID NO: 102646 - DNA, 20 bp, Artificial Sequence
  chemically synthesized
tgaccttgaaacttttgaat

SEQ ID NO: 102647 - DNA, 20 bp, Artificial Sequence
  chemically synthesized
acctgactagtcctattcaa

SEQ ID NO: 102648 - DNA, 20 bp, Artificial Sequence
  chemically synthesized
ttgaaacttttgaataggac

SEQ ID NO: 102649 - DNA, 20 bp, Artificial Sequence
  chemically synthesized
aacttttgaataggactagt

SEQ ID NO: 102650 - DNA, 20 bp, Artificial Sequence
  chemically synthesized
acttttgaataggactagtc

SEQ ID NO: 102651 - DNA, 20 bp, Artificial Sequence
  chemically synthesized
acttctagaatatacctgac

SEQ ID NO: 102652 - DNA, 20 bp, Artificial Sequence
  chemically synthesized
aggactagtcaggtatattc

SEQ ID NO: 102653 - DNA, 20 bp, Artificial Sequence
  chemically synthesized
actagtcaggtatattctag

SEQ ID NO: 102654 - DNA, 20 bp, Artificial Sequence
  chemically synthesized
gtcaaatcttaagagacttc

SEQ ID NO: 102655 - DNA, 20 bp, Artificial Sequence
  chemically synthesized
gtatattctagaagtctctt

SEQ ID NO: 102656 - DNA, 20 bp, Artificial Sequence
  chemically synthesized
atacttcagtcaaatcttaa

SEQ ID NO: 102657 - DNA, 20 bp, Artificial Sequence
  chemically synthesized
aaatacttcagtcaaatctt

SEQ ID NO: 102658 - DNA, 20 bp, Artificial Sequence
  chemically synthesized
agtctcttaagatttgactg

SEQ ID NO: 102659 - DNA, 20 bp, Artificial Sequence
  chemically synthesized
ttctaatagggaaaatactt

SEQ ID NO: 102660 - DNA, 20 bp, Artificial Sequence
  chemically synthesized
gactgaagtattttccctat

SEQ ID NO: 102661 - DNA, 20 bp, Artificial Sequence
  chemically synthesized
tgaagtattttccctattag

SEQ ID NO: 102662 - DNA, 20 bp, Artificial Sequence
  chemically synthesized
acctgtaacttcttctaata

SEQ ID NO: 102663 - DNA, 20 bp, Artificial Sequence
  chemically synthesized
aacctgtaacttcttctaat

SEQ ID NO: 102664 - DNA, 20 bp, Artificial Sequence
  chemically synthesized
agtattttccctattagaag

SEQ ID NO: 102665 - DNA, 20 bp, Artificial Sequence
  chemically synthesized
aaacctgtaacttcttctaa

SEQ ID NO: 102666 - DNA, 20 bp, Artificial Sequence
  chemically synthesized
ttccctattagaagaagtta

SEQ ID NO: 102667 - DNA, 20 bp, Artificial Sequence
  chemically synthesized
tccctattagaagaagttac

SEQ ID NO: 102668 - DNA, 20 bp, Artificial Sequence
  chemically synthesized
ttagaagaagttacaggttt

SEQ ID NO: 102669 - DNA, 20 bp, Artificial Sequence
  chemically synthesized
tagaagaagttacaggtttt

SEQ ID NO: 102670 - DNA, 20 bp, Artificial Sequence
  chemically synthesized
agaagaagttacaggttttg

SEQ ID NO: 102671 - DNA, 20 bp, Artificial Sequence
  chemically synthesized
agaagttacaggttttgggg

SEQ ID NO: 102672 - DNA, 20 bp, Artificial Sequence
  chemically synthesized
caggttttggggaagaatac

SEQ ID NO: 102673 - DNA, 20 bp, Artificial Sequence
  chemically synthesized
ggttttggggaagaatacca

SEQ ID NO: 102674 - DNA, 20 bp, Artificial Sequence
  chemically synthesized
ttttggggaagaataccaga

SEQ ID NO: 102675 - DNA, 20 bp, Artificial Sequence
  chemically synthesized
aaaaggacatgttatctctc

SEQ ID NO: 102676 - DNA, 20 bp, Artificial Sequence
  chemically synthesized
tgtgatatgatgtcatgaaa

SEQ ID NO: 102677 - DNA, 20 bp, Artificial Sequence
  chemically synthesized
ctgtgatatgatgtcatgaa

SEQ ID NO: 102678 - DNA, 20 bp, Artificial Sequence
  chemically synthesized
cttttcatgacatcatatca

SEQ ID NO: 102679 - DNA, 20 bp, Artificial Sequence
  chemically synthesized
ttttcatgacatcatatcac

SEQ ID NO: 102680 - DNA, 20 bp, Artificial Sequence
  chemically synthesized
ttcatgacatcatatcacag

SEQ ID NO: 102681 - DNA, 20 bp, Artificial Sequence
  chemically synthesized
gatatcaatattattatcac

SEQ ID NO: 102682 - DNA, 20 bp, Artificial Sequence
  chemically synthesized
gtagtcaagtataacatcgc

SEQ ID NO: 102683 - DNA, 20 bp, Artificial Sequence
  chemically synthesized
cgatgttatacttgactact

SEQ ID NO: 102684 - DNA, 20 bp, Artificial Sequence
  chemically synthesized
accaagttaactaagtagtc

SEQ ID NO: 102685 - DNA, 20 bp, Artificial Sequence
  chemically synthesized
caggcaccaagttaactaag

SEQ ID NO: 102686 - DNA, 20 bp, Artificial Sequence
  chemically synthesized
aggcaggcaccaagttaact

SEQ ID NO: 102687 - DNA, 20 bp, Artificial Sequence
  chemically synthesized
acttgactacttagttaact

SEQ ID NO: 102688 - DNA, 20 bp, Artificial Sequence
  chemically synthesized
gaagaaaccaggcaggcacc

SEQ ID NO: 102689 - DNA, 20 bp, Artificial Sequence
  chemically synthesized
tagttaacttggtgcctgcc

SEQ ID NO: 102690 - DNA, 20 bp, Artificial Sequence
  chemically synthesized
caatggagaagaaaccaggc

SEQ ID NO: 102691 - DNA, 20 bp, Artificial Sequence
  chemically synthesized
acaatggagaagaaaccagg

SEQ ID NO: 102692 - DNA, 20 bp, Artificial Sequence
  chemically synthesized
ataacaatggagaagaaacc

SEQ ID NO: 102693 - DNA, 20 bp, Artificial Sequence
  chemically synthesized
aataacaatggagaagaaac

SEQ ID NO: 102694 - DNA, 20 bp, Artificial Sequence
  chemically synthesized
aagtaggaataacaatggag

SEQ ID NO: 102695 - DNA, 20 bp, Artificial Sequence
  chemically synthesized
gaaaagtaggaataacaatg

SEQ ID NO: 102696 - DNA, 20 bp, Artificial Sequence
  chemically synthesized
tggaaaagtaggaataacaa

SEQ ID NO: 102697 - DNA, 20 bp, Artificial Sequence
  chemically synthesized
ataatagaatatggaaaagt

SEQ ID NO: 102698 - DNA, 20 bp, Artificial Sequence
  chemically synthesized
gataatagaatatggaaaag

SEQ ID NO: 102699 - DNA, 20 bp, Artificial Sequence
  chemically synthesized
ccagataatagaatatggaa

SEQ ID NO: 102700 - DNA, 20 bp, Artificial Sequence
  chemically synthesized
tacttccagataatagaata

SEQ ID NO: 102701 - DNA, 20 bp, Artificial Sequence
  chemically synthesized
cttttccatattctattatc

SEQ ID NO: 102702 - DNA, 20 bp, Artificial Sequence
  chemically synthesized
ggtaacttacttccagataa

SEQ ID NO: 102703 - DNA, 20 bp, Artificial Sequence
  chemically synthesized
ttccatattctattatctgg

SEQ ID NO: 102704 - DNA, 20 bp, Artificial Sequence
  chemically synthesized
atattctattatctggaagt

SEQ ID NO: 102705 - DNA, 20 bp, Artificial Sequence
  chemically synthesized
tgaacttggtaacttacttc

SEQ ID NO: 102706 - DNA, 20 bp, Artificial Sequence
  chemically synthesized
ttatctggaagtaagttacc

SEQ ID NO: 102707 - DNA, 20 bp, Artificial Sequence
  chemically synthesized
gaagtaagttaccaagttca

SEQ ID NO: 102708 - DNA, 20 bp, Artificial Sequence
  chemically synthesized
cctaagcccctccatgaact

SEQ ID NO: 102709 - DNA, 20 bp, Artificial Sequence
  chemically synthesized
agtaagttaccaagttcatg

SEQ ID NO: 102710 - DNA, 20 bp, Artificial Sequence
  chemically synthesized
gtaagttaccaagttcatgg

SEQ ID NO: 102711 - DNA, 20 bp, Artificial Sequence
  chemically synthesized
taagttaccaagttcatgga

SEQ ID NO: 102712 - DNA, 20 bp, Artificial Sequence
  chemically synthesized
aagttaccaagttcatggag

SEQ ID NO: 102713 - DNA, 20 bp, Artificial Sequence
  chemically synthesized
accaagttcatggaggggct

SEQ ID NO: 102714 - DNA, 20 bp, Artificial Sequence
  chemically synthesized
ccaagttcatggaggggctt

SEQ ID NO: 102715 - DNA, 20 bp, Artificial Sequence
  chemically synthesized
caagttcatggaggggctta

SEQ ID NO: 102716 - DNA, 20 bp, Artificial Sequence
  chemically synthesized
aagttcatggaggggcttag

SEQ ID NO: 102717 - DNA, 20 bp, Artificial Sequence
  chemically synthesized
gttcatggaggggcttaggg

SEQ ID NO: 102718 - DNA, 20 bp, Artificial Sequence
  chemically synthesized
ttcatggaggggcttagggg

SEQ ID NO: 102719 - DNA, 20 bp, Artificial Sequence
  chemically synthesized
gtagagtttaatcctcccct

SEQ ID NO: 102720 - DNA, 20 bp, Artificial Sequence
  chemically synthesized
gaggattaaactctacatcc

SEQ ID NO: 102721 - DNA, 20 bp, Artificial Sequence
  chemically synthesized
tactcctttcctgggatgta

SEQ ID NO: 102722 - DNA, 20 bp, Artificial Sequence
  chemically synthesized
aggattaaactctacatccc

SEQ ID NO: 102723 - DNA, 20 bp, Artificial Sequence
  chemically synthesized
gatactcctttcctgggatg

SEQ ID NO: 102724 - DNA, 20 bp, Artificial Sequence
  chemically synthesized
ttaaactctacatcccagga

SEQ ID NO: 102725 - DNA, 20 bp, Artificial Sequence
  chemically synthesized
taaactctacatcccaggaa

SEQ ID NO: 102726 - DNA, 20 bp, Artificial Sequence
  chemically synthesized
aactctacatcccaggaaag

SEQ ID NO: 102727 - DNA, 20 bp, Artificial Sequence
  chemically synthesized
tacatagatactcctttcct

SEQ ID NO: 102728 - DNA, 20 bp, Artificial Sequence
  chemically synthesized
atacatagatactcctttcc

SEQ ID NO: 102729 - DNA, 20 bp, Artificial Sequence
  chemically synthesized
acaattcttaataatataca

SEQ ID NO: 102730 - DNA, 20 bp, Artificial Sequence
  chemically synthesized
gagtatctatgtatattatt

SEQ ID NO: 102731 - DNA, 20 bp, Artificial Sequence
  chemically synthesized
attattaagaattgttctat

SEQ ID NO: 102732 - DNA, 20 bp, Artificial Sequence
  chemically synthesized
ttattaagaattgttctata

SEQ ID NO: 102733 - DNA, 20 bp, Artificial Sequence
  chemically synthesized
tattaagaattgttctataa

SEQ ID NO: 102734 - DNA, 20 bp, Artificial Sequence
  chemically synthesized
tgagagaaaattttccctta

SEQ ID NO: 102735 - DNA, 20 bp, Artificial Sequence
  chemically synthesized
tagtaaaaaagcatatttga

SEQ ID NO: 102736 - DNA, 20 bp, Artificial Sequence
  chemically synthesized
tttagtaaaaaagcatattt

SEQ ID NO: 102737 - DNA, 20 bp, Artificial Sequence
  chemically synthesized
gttttctctgtttagtaaaa

SEQ ID NO: 102738 - DNA, 20 bp, Artificial Sequence
  chemically synthesized
aaatatgcttttttactaaa

SEQ ID NO: 102739 - DNA, 20 bp, Artificial Sequence
  chemically synthesized
atatgcttttttactaaaca

SEQ ID NO: 102740 - DNA, 20 bp, Artificial Sequence
  chemically synthesized
aataatgtgttttctctgtt

SEQ ID NO: 102741 - DNA, 20 bp, Artificial Sequence
  chemically synthesized
gagaaaacacattattatct

SEQ ID NO: 102742 - DNA, 20 bp, Artificial Sequence
  chemically synthesized
aaaacacattattatctgag

SEQ ID NO: 102743 - DNA, 20 bp, Artificial Sequence
  chemically synthesized
ttagccatatagcaaccact

SEQ ID NO: 102744 - DNA, 20 bp, Artificial Sequence
  chemically synthesized
ttatctgagtggttgctata

SEQ ID NO: 102745 - DNA, 20 bp, Artificial Sequence
  chemically synthesized
ggtaaatgagattagccata

SEQ ID NO: 102746 - DNA, 20 bp, Artificial Sequence
  chemically synthesized
caaaagaaggtaaatgagat

SEQ ID NO: 102747 - DNA, 20 bp, Artificial Sequence
  chemically synthesized
attgacaaaagaaggtaaat

SEQ ID NO: 102748 - DNA, 20 bp, Artificial Sequence
  chemically synthesized
gtttatgaattgacaaaaga

SEQ ID NO: 102749 - DNA, 20 bp, Artificial Sequence
  chemically synthesized
agtttatgaattgacaaaag

SEQ ID NO: 102750 - DNA, 20 bp, Artificial Sequence
  chemically synthesized
accagtttatgaattgacaa

SEQ ID NO: 102751 - DNA, 20 bp, Artificial Sequence
  chemically synthesized
tcttttgtcaattcataaac

SEQ ID NO: 102752 - DNA, 20 bp, Artificial Sequence
  chemically synthesized
cccgaaaagggaaaaaagac

SEQ ID NO: 102753 - DNA, 20 bp, Artificial Sequence
  chemically synthesized
actggcccgaaaagggaaaa

SEQ ID NO: 102754 - DNA, 20 bp, Artificial Sequence
  chemically synthesized
actggtcttttttccctttt

SEQ ID NO: 102755 - DNA, 20 bp, Artificial Sequence
  chemically synthesized
ctggtcttttttcccttttc

SEQ ID NO: 102756 - DNA, 20 bp, Artificial Sequence
  chemically synthesized
aagttatactggcccgaaaa

SEQ ID NO: 102757 - DNA, 20 bp, Artificial Sequence
  chemically synthesized
taagttatactggcccgaaa

SEQ ID NO: 102758 - DNA, 20 bp, Artificial Sequence
  chemically synthesized
tcttttttcccttttcgggc

SEQ ID NO: 102759 - DNA, 20 bp, Artificial Sequence
  chemically synthesized
ttaagttatactggcccgaa

SEQ ID NO: 102760 - DNA, 20 bp, Artificial Sequence
  chemically synthesized
acaatcctattaagttatac

SEQ ID NO: 102761 - DNA, 20 bp, Artificial Sequence
  chemically synthesized
ttcgggccagtataacttaa

SEQ ID NO: 102762 - DNA, 20 bp, Artificial Sequence
  chemically synthesized
tcgggccagtataacttaat

SEQ ID NO: 102763 - DNA, 20 bp, Artificial Sequence
  chemically synthesized
ataagataaacaatcctatt

SEQ ID NO: 102764 - DNA, 20 bp, Artificial Sequence
  chemically synthesized
tacaaataaattaataacat

SEQ ID NO: 102765 - DNA, 20 bp, Artificial Sequence
  chemically synthesized
ttatgttattaatttatttg

SEQ ID NO: 102766 - DNA, 20 bp, Artificial Sequence
  chemically synthesized
taatttatttgtagatgaca

SEQ ID NO: 102767 - DNA, 20 bp, Artificial Sequence
  chemically synthesized
tagatgacaaagattccttt

SEQ ID NO: 102768 - DNA, 20 bp, Artificial Sequence
  chemically synthesized
atgacaaagattccttttgg

SEQ ID NO: 102769 - DNA, 20 bp, Artificial Sequence
  chemically synthesized
tgacaaagattccttttggt

SEQ ID NO: 102770 - DNA, 20 bp, Artificial Sequence
  chemically synthesized
gagtgccagaacctaccaaa

SEQ ID NO: 102771 - DNA, 20 bp, Artificial Sequence
  chemically synthesized
tgagtgccagaacctaccaa

SEQ ID NO: 102772 - DNA, 20 bp, Artificial Sequence
  chemically synthesized
agattccttttggtaggttc

SEQ ID NO: 102773 - DNA, 20 bp, Artificial Sequence
  chemically synthesized
tttggtaggttctggcactc

SEQ ID NO: 102774 - DNA, 20 bp, Artificial Sequence
  chemically synthesized
aacctattagtcttgagtgc

SEQ ID NO: 102775 - DNA, 20 bp, Artificial Sequence
  chemically synthesized
tggaaaaacctattagtctt

SEQ ID NO: 102776 - DNA, 20 bp, Artificial Sequence
  chemically synthesized
gttctggcactcaagactaa

SEQ ID NO: 102777 - DNA, 20 bp, Artificial Sequence
  chemically synthesized
ttctggcactcaagactaat

SEQ ID NO: 102778 - DNA, 20 bp, Artificial Sequence
  chemically synthesized
aaatatatggaaaaacctat

SEQ ID NO: 102779 - DNA, 20 bp, Artificial Sequence
  chemically synthesized
tttgtatccatagaaatata

SEQ ID NO: 102780 - DNA, 20 bp, Artificial Sequence
  chemically synthesized
ggtttttccatatatttcta

SEQ ID NO: 102781 - DNA, 20 bp, Artificial Sequence
  chemically synthesized
gctggtacaatttgtatcca

SEQ ID NO: 102782 - DNA, 20 bp, Artificial Sequence
  chemically synthesized
tctatggatacaaattgtac

SEQ ID NO: 102783 - DNA, 20 bp, Artificial Sequence
  chemically synthesized
tacaaattgtaccagcatgc

SEQ ID NO: 102784 - DNA, 20 bp, Artificial Sequence
  chemically synthesized
acaaattgtaccagcatgct

SEQ ID NO: 102785 - DNA, 20 bp, Artificial Sequence
  chemically synthesized
cattttccttcccagcatgc

SEQ ID NO: 102786 - DNA, 20 bp, Artificial Sequence
  chemically synthesized
aattgtaccagcatgctggg

SEQ ID NO: 102787 - DNA, 20 bp, Artificial Sequence
  chemically synthesized
attgtaccagcatgctggga

SEQ ID NO: 102788 - DNA, 20 bp, Artificial Sequence
  chemically synthesized
tgtcagctcattttccttcc

SEQ ID NO: 102789 - DNA, 20 bp, Artificial Sequence
  chemically synthesized
agcatgctgggaaggaaaat

SEQ ID NO: 102790 - DNA, 20 bp, Artificial Sequence
  chemically synthesized
tgggaaggaaaatgagctga

SEQ ID NO: 102791 - DNA, 20 bp, Artificial Sequence
  chemically synthesized
caaagtgacacatatactgt

SEQ ID NO: 102792 - DNA, 20 bp, Artificial Sequence
  chemically synthesized
gtaggatacccagtgattca

SEQ ID NO: 102793 - DNA, 20 bp, Artificial Sequence
  chemically synthesized
tatgtgtcactttgaatcac

SEQ ID NO: 102794 - DNA, 20 bp, Artificial Sequence
  chemically synthesized
atgtgtcactttgaatcact

SEQ ID NO: 102795 - DNA, 20 bp, Artificial Sequence
  chemically synthesized
gatattccctgtaggatacc

SEQ ID NO: 102796 - DNA, 20 bp, Artificial Sequence
  chemically synthesized
ttgaatcactgggtatccta

SEQ ID NO: 102797 - DNA, 20 bp, Artificial Sequence
  chemically synthesized
tgaatcactgggtatcctac

SEQ ID NO: 102798 - DNA, 20 bp, Artificial Sequence
  chemically synthesized
gaatcactgggtatcctaca

SEQ ID NO: 102799 - DNA, 20 bp, Artificial Sequence
  chemically synthesized
agtaactcgatattccctgt

SEQ ID NO: 102800 - DNA, 20 bp, Artificial Sequence
  chemically synthesized
aagtaactcgatattccctg

SEQ ID NO: 102801 - DNA, 20 bp, Artificial Sequence
  chemically synthesized
ggtatcctacagggaatatc

SEQ ID NO: 102802 - DNA, 20 bp, Artificial Sequence
  chemically synthesized
cagggaatatcgagttactt

SEQ ID NO: 102803 - DNA, 20 bp, Artificial Sequence
  chemically synthesized
cacatctttctttgaagctt

SEQ ID NO: 102804 - DNA, 20 bp, Artificial Sequence
  chemically synthesized
atcgagttacttaagcttca

SEQ ID NO: 102805 - DNA, 20 bp, Artificial Sequence
  chemically synthesized
agttacttaagcttcaaaga

SEQ ID NO: 102806 - DNA, 20 bp, Artificial Sequence
  chemically synthesized
cattgtcacatctttctttg

SEQ ID NO: 102807 - DNA, 20 bp, Artificial Sequence
  chemically synthesized
ttcaaagaaagatgtgacaa

SEQ ID NO: 102808 - DNA, 20 bp, Artificial Sequence
  chemically synthesized
gacaatggttaaccataatt

SEQ ID NO: 102809 - DNA, 20 bp, Artificial Sequence
  chemically synthesized
taaaatccaaatctaaatta

SEQ ID NO: 102810 - DNA, 20 bp, Artificial Sequence
  chemically synthesized
ggttaaccataatttagatt

SEQ ID NO: 102811 - DNA, 20 bp, Artificial Sequence
  chemically synthesized
tttggattttaatattctca

SEQ ID NO: 102812 - DNA, 20 bp, Artificial Sequence
  chemically synthesized
attttaatattctcacagcc

SEQ ID NO: 102813 - DNA, 20 bp, Artificial Sequence
  chemically synthesized
tgatgggccagccaggctgt

SEQ ID NO: 102814 - DNA, 20 bp, Artificial Sequence
  chemically synthesized
taatattctcacagcctggc

SEQ ID NO: 102815 - DNA, 20 bp, Artificial Sequence
  chemically synthesized
aaaaaattgatgggccagcc

SEQ ID NO: 102816 - DNA, 20 bp, Artificial Sequence
  chemically synthesized
taaaaaattgatgggccagc

SEQ ID NO: 102817 - DNA, 20 bp, Artificial Sequence
  chemically synthesized
atcataaaaaattgatgggc

SEQ ID NO: 102818 - DNA, 20 bp, Artificial Sequence
  chemically synthesized
aaacatcataaaaaattgat

SEQ ID NO: 102819 - DNA, 20 bp, Artificial Sequence
  chemically synthesized
aaaacatcataaaaaattga

SEQ ID NO: 102820 - DNA, 20 bp, Artificial Sequence
  chemically synthesized
ttttatgatgtttttctctt

SEQ ID NO: 102821 - DNA, 20 bp, Artificial Sequence
  chemically synthesized
gaaattgttgagaaacttaa

SEQ ID NO: 102822 - DNA, 20 bp, Artificial Sequence
  chemically synthesized
gagaaattgttgagaaactt

SEQ ID NO: 102823 - DNA, 20 bp, Artificial Sequence
  chemically synthesized
acttgcccagagaaattgtt

SEQ ID NO: 102824 - DNA, 20 bp, Artificial Sequence
  chemically synthesized
aagtttctcaacaatttctc

SEQ ID NO: 102825 - DNA, 20 bp, Artificial Sequence
  chemically synthesized
agtttctcaacaatttctct

SEQ ID NO: 102826 - DNA, 20 bp, Artificial Sequence
  chemically synthesized
tctcaacaatttctctgggc

SEQ ID NO: 102827 - DNA, 20 bp, Artificial Sequence
  chemically synthesized
atttgaaacaaacttgccca

SEQ ID NO: 102828 - DNA, 20 bp, Artificial Sequence
  chemically synthesized
gcatttgaaacaaacttgcc

SEQ ID NO: 102829 - DNA, 20 bp, Artificial Sequence
  chemically synthesized
ggcaagtttgtttcaaatgc

SEQ ID NO: 102830 - DNA, 20 bp, Artificial Sequence
  chemically synthesized
tcaaatgcaagactaatttt

SEQ ID NO: 102831 - DNA, 20 bp, Artificial Sequence
  chemically synthesized
attttaatcaagcttaaaat

SEQ ID NO: 102832 - DNA, 20 bp, Artificial Sequence
  chemically synthesized
gtctgtttaacattttaatc

SEQ ID NO: 102833 - DNA, 20 bp, Artificial Sequence
  chemically synthesized
agcttgattaaaatgttaaa

SEQ ID NO: 102834 - DNA, 20 bp, Artificial Sequence
  chemically synthesized
aaggataatacaaatggcat

SEQ ID NO: 102835 - DNA, 20 bp, Artificial Sequence
  chemically synthesized
ttcataaaggataatacaaa

SEQ ID NO: 102836 - DNA, 20 bp, Artificial Sequence
  chemically synthesized
aagtattgattttttcataa

SEQ ID NO: 102837 - DNA, 20 bp, Artificial Sequence
  chemically synthesized
aaagtattgattttttcata

SEQ ID NO: 102838 - DNA, 20 bp, Artificial Sequence
  chemically synthesized
tgaaaaaatcaatactttaa

SEQ ID NO: 102839 - DNA, 20 bp, Artificial Sequence
  chemically synthesized
tttcctaagaaagtctatta

SEQ ID NO: 102840 - DNA, 20 bp, Artificial Sequence
  chemically synthesized
aatactttaatagactttct

SEQ ID NO: 102841 - DNA, 20 bp, Artificial Sequence
  chemically synthesized
atactttaatagactttctt

SEQ ID NO: 102842 - DNA, 20 bp, Artificial Sequence
  chemically synthesized
ctcaaaatagtttcctaaga

SEQ ID NO: 102843 - DNA, 20 bp, Artificial Sequence
  chemically synthesized
gtttctcaaaatagtttcct

SEQ ID NO: 102844 - DNA, 20 bp, Artificial Sequence
  chemically synthesized
ctttcttaggaaactatttt

SEQ ID NO: 102845 - DNA, 20 bp, Artificial Sequence
  chemically synthesized
tgctattgagtttctcaaaa

SEQ ID NO: 102846 - DNA, 20 bp, Artificial Sequence
  chemically synthesized
aactattttgagaaactcaa

SEQ ID NO: 102847 - DNA, 20 bp, Artificial Sequence
  chemically synthesized
ctttatttaacaatgctatt

SEQ ID NO: 102848 - DNA, 20 bp, Artificial Sequence
  chemically synthesized
ctcaatagcattgttaaata

SEQ ID NO: 102849 - DNA, 20 bp, Artificial Sequence
  chemically synthesized
aatagcattgttaaataaag

SEQ ID NO: 102850 - DNA, 20 bp, Artificial Sequence
  chemically synthesized
aataaagtagaatgtcccat

SEQ ID NO: 102851 - DNA, 20 bp, Artificial Sequence
  chemically synthesized
ataaaatactggaatctgat

SEQ ID NO: 102852 - DNA, 20 bp, Artificial Sequence
  chemically synthesized
tataaaatactggaatctga

SEQ ID NO: 102853 - DNA, 20 bp, Artificial Sequence
  chemically synthesized
tagaatgtcccatcagattc

SEQ ID NO: 102854 - DNA, 20 bp, Artificial Sequence
  chemically synthesized
agagaatacatataaaatac

SEQ ID NO: 102855 - DNA, 20 bp, Artificial Sequence
  chemically synthesized
ttatatgtattctctgacaa

SEQ ID NO: 102856 - DNA, 20 bp, Artificial Sequence
  chemically synthesized
tatatgtattctctgacaaa

SEQ ID NO: 102857 - DNA, 20 bp, Artificial Sequence
  chemically synthesized
cttattttacccttttgtca

SEQ ID NO: 102858 - DNA, 20 bp, Artificial Sequence
  chemically synthesized
atatgtattctctgacaaaa

SEQ ID NO: 102859 - DNA, 20 bp, Artificial Sequence
  chemically synthesized
ttcttattttacccttttgt

SEQ ID NO: 102860 - DNA, 20 bp, Artificial Sequence
  chemically synthesized
ctctgacaaaagggtaaaat

SEQ ID NO: 102861 - DNA, 20 bp, Artificial Sequence
  chemically synthesized
tgacaaaagggtaaaataag

SEQ ID NO: 102862 - DNA, 20 bp, Artificial Sequence
  chemically synthesized
agggtaaaataagaagcaat

SEQ ID NO: 102863 - DNA, 20 bp, Artificial Sequence
  chemically synthesized
agcaatgagttacatgataa

SEQ ID NO: 102864 - DNA, 20 bp, Artificial Sequence
  chemically synthesized
gttacatgataaaagattta

SEQ ID NO: 102865 - DNA, 20 bp, Artificial Sequence
  chemically synthesized
ttacatgataaaagatttaa

SEQ ID NO: 102866 - DNA, 20 bp, Artificial Sequence
  chemically synthesized
tacatgataaaagatttaaa

SEQ ID NO: 102867 - DNA, 20 bp, Artificial Sequence
  chemically synthesized
acatgataaaagatttaaag

SEQ ID NO: 102868 - DNA, 20 bp, Artificial Sequence
  chemically synthesized
tgtgtgtgtgtgtgtgtgta

SEQ ID NO: 102869 - DNA, 20 bp, Artificial Sequence
  chemically synthesized
gtgtgtgtgtgtatagaaaa

SEQ ID NO: 102870 - DNA, 20 bp, Artificial Sequence
  chemically synthesized
cagaatactgtaatgtttaa

SEQ ID NO: 102871 - DNA, 20 bp, Artificial Sequence
  chemically synthesized
aaaacagcttttaaacatta

SEQ ID NO: 102872 - DNA, 20 bp, Artificial Sequence
  chemically synthesized
tttaaacattacagtattct

SEQ ID NO: 102873 - DNA, 20 bp, Artificial Sequence
  chemically synthesized
acattacagtattctgagct

SEQ ID NO: 102874 - DNA, 20 bp, Artificial Sequence
  chemically synthesized
cattacagtattctgagcta

SEQ ID NO: 102875 - DNA, 20 bp, Artificial Sequence
  chemically synthesized
attacagtattctgagctaa

SEQ ID NO: 102876 - DNA, 20 bp, Artificial Sequence
  chemically synthesized
gtgaatttccacccttagct

SEQ ID NO: 102877 - DNA, 20 bp, Artificial Sequence
  chemically synthesized
acagtattctgagctaaggg

SEQ ID NO: 102878 - DNA, 20 bp, Artificial Sequence
  chemically synthesized
ctgaggtgaatttccaccct

SEQ ID NO: 102879 - DNA, 20 bp, Artificial Sequence
  chemically synthesized
ctaagggtggaaattcacct

SEQ ID NO: 102880 - DNA, 20 bp, Artificial Sequence
  chemically synthesized
aagggtggaaattcacctca

SEQ ID NO: 102881 - DNA, 20 bp, Artificial Sequence
  chemically synthesized
agacaattaaaaattctctg

SEQ ID NO: 102882 - DNA, 20 bp, Artificial Sequence
  chemically synthesized
cagacaattaaaaattctct

SEQ ID NO: 102883 - DNA, 20 bp, Artificial Sequence
  chemically synthesized
gaatttttaattgtctgtct

SEQ ID NO: 102884 - DNA, 20 bp, Artificial Sequence
  chemically synthesized
ttgaggcatcaggactcaga

SEQ ID NO: 102885 - DNA, 20 bp, Artificial Sequence
  chemically synthesized
aaatttgaggcatcaggact

SEQ ID NO: 102886 - DNA, 20 bp, Artificial Sequence
  chemically synthesized
catgctaaatttgaggcatc

SEQ ID NO: 102887 - DNA, 20 bp, Artificial Sequence
  chemically synthesized
acatgctaaatttgaggcat

SEQ ID NO: 102888 - DNA, 20 bp, Artificial Sequence
  chemically synthesized
gagtcctgatgcctcaaatt

SEQ ID NO: 102889 - DNA, 20 bp, Artificial Sequence
  chemically synthesized
ttaataacatgctaaatttg

SEQ ID NO: 102890 - DNA, 20 bp, Artificial Sequence
  chemically synthesized
attaataacatgctaaattt

SEQ ID NO: 102891 - DNA, 20 bp, Artificial Sequence
  chemically synthesized
atagaacatggtaatgttag

SEQ ID NO: 102892 - DNA, 20 bp, Artificial Sequence
  chemically synthesized
gcaatagaacatggtaatgt

SEQ ID NO: 102893 - DNA, 20 bp, Artificial Sequence
  chemically synthesized
aaaaatattgcaatagaaca

SEQ ID NO: 102894 - DNA, 20 bp, Artificial Sequence
  chemically synthesized
atattttaaaaatattgcaa

SEQ ID NO: 102895 - DNA, 20 bp, Artificial Sequence
  chemically synthesized
tcacaatctagtagcggaga

SEQ ID NO: 102896 - DNA, 20 bp, Artificial Sequence
  chemically synthesized
taaaaatctgtctccgctac

SEQ ID NO: 102897 - DNA, 20 bp, Artificial Sequence
  chemically synthesized
gagctcacaatctagtagcg

SEQ ID NO: 102898 - DNA, 20 bp, Artificial Sequence
  chemically synthesized
cagagctcacaatctagtag

SEQ ID NO: 102899 - DNA, 20 bp, Artificial Sequence
  chemically synthesized
agtcagagctcacaatctag

SEQ ID NO: 102900 - DNA, 20 bp, Artificial Sequence
  chemically synthesized
tgtctccgctactagattgt

SEQ ID NO: 102901 - DNA, 20 bp, Artificial Sequence
  chemically synthesized
tgaagtcagagctcacaatc

SEQ ID NO: 102902 - DNA, 20 bp, Artificial Sequence
  chemically synthesized
agatatagtctttgaagtca

SEQ ID NO: 102903 - DNA, 20 bp, Artificial Sequence
  chemically synthesized
gattgtgagctctgacttca

SEQ ID NO: 102904 - DNA, 20 bp, Artificial Sequence
  chemically synthesized
taagatatagtctttgaagt

SEQ ID NO: 102905 - DNA, 20 bp, Artificial Sequence
  chemically synthesized
gaaataagatatagtctttg

SEQ ID NO: 102906 - DNA, 20 bp, Artificial Sequence
  chemically synthesized
aaagaagtagaaataagata

SEQ ID NO: 102907 - DNA, 20 bp, Artificial Sequence
  chemically synthesized
ccgaggaaagaagtagaaat

SEQ ID NO: 102908 - DNA, 20 bp, Artificial Sequence
  chemically synthesized
ttccataccgaggaaagaag

SEQ ID NO: 102909 - DNA, 20 bp, Artificial Sequence
  chemically synthesized
cttatttctacttctttcct

SEQ ID NO: 102910 - DNA, 20 bp, Artificial Sequence
  chemically synthesized
atgttccataccgaggaaag

SEQ ID NO: 102911 - DNA, 20 bp, Artificial Sequence
  chemically synthesized
gtgatgttccataccgagga

SEQ ID NO: 102912 - DNA, 20 bp, Artificial Sequence
  chemically synthesized
ttctacttctttcctcggta

SEQ ID NO: 102913 - DNA, 20 bp, Artificial Sequence
  chemically synthesized
aggtgtgatgttccataccg

SEQ ID NO: 102914 - DNA, 20 bp, Artificial Sequence
  chemically synthesized
caggtgtgatgttccatacc

SEQ ID NO: 102915 - DNA, 20 bp, Artificial Sequence
  chemically synthesized
tcggtatggaacatcacacc

SEQ ID NO: 102916 - DNA, 20 bp, Artificial Sequence
  chemically synthesized
ggaacatcacacctggtgta

SEQ ID NO: 102917 - DNA, 20 bp, Artificial Sequence
  chemically synthesized
agctagtgtgactgtacacc

SEQ ID NO: 102918 - DNA, 20 bp, Artificial Sequence
  chemically synthesized
tagctagtgtgactgtacac

SEQ ID NO: 102919 - DNA, 20 bp, Artificial Sequence
  chemically synthesized
cacctggtgtacagtcacac

SEQ ID NO: 102920 - DNA, 20 bp, Artificial Sequence
  chemically synthesized
ctgagcaattgaaatatagc

SEQ ID NO: 102921 - DNA, 20 bp, Artificial Sequence
  chemically synthesized
gctactgagcaattgaaata

SEQ ID NO: 102922 - DNA, 20 bp, Artificial Sequence
  chemically synthesized
ctagctatatttcaattgct

SEQ ID NO: 102923 - DNA, 20 bp, Artificial Sequence
  chemically synthesized
gctatatttcaattgctcag

SEQ ID NO: 102924 - DNA, 20 bp, Artificial Sequence
  chemically synthesized
tactgtagcatatggctact

SEQ ID NO: 102925 - DNA, 20 bp, Artificial Sequence
  chemically synthesized
tgctcagtagccatatgcta

SEQ ID NO: 102926 - DNA, 20 bp, Artificial Sequence
  chemically synthesized
atgtgcagtactgtagcata

SEQ ID NO: 102927 - DNA, 20 bp, Artificial Sequence
  chemically synthesized
atccgtgatgtgcagtactg

SEQ ID NO: 102928 - DNA, 20 bp, Artificial Sequence
  chemically synthesized
tgctacagtactgcacatca

SEQ ID NO: 102929 - DNA, 20 bp, Artificial Sequence
  chemically synthesized
tattttatatccgtgatgtg

SEQ ID NO: 102930 - DNA, 20 bp, Artificial Sequence
  chemically synthesized
gtgaattctctgcgatgatg

SEQ ID NO: 102931 - DNA, 20 bp, Artificial Sequence
  chemically synthesized
ataaaatatcttcatcatcg

SEQ ID NO: 102932 - DNA, 20 bp, Artificial Sequence
  chemically synthesized
aaaatatcttcatcatcgca

SEQ ID NO: 102933 - DNA, 20 bp, Artificial Sequence
  chemically synthesized
atcgcagagaattcacatca

SEQ ID NO: 102934 - DNA, 20 bp, Artificial Sequence
  chemically synthesized
ttcacatcacagtcctgatt

SEQ ID NO: 102935 - DNA, 20 bp, Artificial Sequence
  chemically synthesized
cacatcacagtcctgattta

SEQ ID NO: 102936 - DNA, 20 bp, Artificial Sequence
  chemically synthesized
cagacatcctgctctaaatc

SEQ ID NO: 102937 - DNA, 20 bp, Artificial Sequence
  chemically synthesized
tcagacatcctgctctaaat

SEQ ID NO: 102938 - DNA, 20 bp, Artificial Sequence
  chemically synthesized
atcacagtcctgatttagag

SEQ ID NO: 102939 - DNA, 20 bp, Artificial Sequence
  chemically synthesized
tcacagtcctgatttagagc

SEQ ID NO: 102940 - DNA, 20 bp, Artificial Sequence
  chemically synthesized
agagcaggatgtctgaaact

SEQ ID NO: 102941 - DNA, 20 bp, Artificial Sequence
  chemically synthesized
atgtcagtagtgccaagttt

SEQ ID NO: 102942 - DNA, 20 bp, Artificial Sequence
  chemically synthesized
tccaatatgtcagtagtgcc

SEQ ID NO: 102943 - DNA, 20 bp, Artificial Sequence
  chemically synthesized
tatttggtccaatatgtcag

SEQ ID NO: 102944 - DNA, 20 bp, Artificial Sequence
  chemically synthesized
acttggcactactgacatat

SEQ ID NO: 102945 - DNA, 20 bp, Artificial Sequence
  chemically synthesized
aattatttggtccaatatgt

SEQ ID NO: 102946 - DNA, 20 bp, Artificial Sequence
  chemically synthesized
ccccacaacaaagaattatt

SEQ ID NO: 102947 - DNA, 20 bp, Artificial Sequence
  chemically synthesized
gaccaaataattctttgttg

SEQ ID NO: 102948 - DNA, 20 bp, Artificial Sequence
  chemically synthesized
accaaataattctttgttgt

SEQ ID NO: 102949 - DNA, 20 bp, Artificial Sequence
  chemically synthesized
ccaaataattctttgttgtg

SEQ ID NO: 102950 - DNA, 20 bp, Artificial Sequence
  chemically synthesized
caagacagccccccacaaca

SEQ ID NO: 102951 - DNA, 20 bp, Artificial Sequence
  chemically synthesized
caaataattctttgttgtgg

SEQ ID NO: 102952 - DNA, 20 bp, Artificial Sequence
  chemically synthesized
aaataattctttgttgtggg

SEQ ID NO: 102953 - DNA, 20 bp, Artificial Sequence
  chemically synthesized
acatgttgtaatgcacaaga

SEQ ID NO: 102954 - DNA, 20 bp, Artificial Sequence
  chemically synthesized
ctcaacatgttgtaatgcac

SEQ ID NO: 102955 - DNA, 20 bp, Artificial Sequence
  chemically synthesized
cttgtgcattacaacatgtt

SEQ ID NO: 102956 - DNA, 20 bp, Artificial Sequence
  chemically synthesized
gtgcattacaacatgttgag

SEQ ID NO: 102957 - DNA, 20 bp, Artificial Sequence
  chemically synthesized
aacatgttgagcagcatccc

SEQ ID NO: 102958 - DNA, 20 bp, Artificial Sequence
  chemically synthesized
catcaagtgggcagaggcca

SEQ ID NO: 102959 - DNA, 20 bp, Artificial Sequence
  chemically synthesized
tcatcaagtgggcagaggcc

SEQ ID NO: 102960 - DNA, 20 bp, Artificial Sequence
  chemically synthesized
gtcatcaagtgggcagaggc

SEQ ID NO: 102961 - DNA, 20 bp, Artificial Sequence
  chemically synthesized
tgctgtcatcaagtgggcag

SEQ ID NO: 102962 - DNA, 20 bp, Artificial Sequence
  chemically synthesized
ctgctgtcatcaagtgggca

SEQ ID NO: 102963 - DNA, 20 bp, Artificial Sequence
  chemically synthesized
tactgctgtcatcaagtggg

SEQ ID NO: 102964 - DNA, 20 bp, Artificial Sequence
  chemically synthesized
ggatactgctgtcatcaagt

SEQ ID NO: 102965 - DNA, 20 bp, Artificial Sequence
  chemically synthesized
gggatactgctgtcatcaag

SEQ ID NO: 102966 - DNA, 20 bp, Artificial Sequence
  chemically synthesized
ggcctctgcccacttgatga

SEQ ID NO: 102967 - DNA, 20 bp, Artificial Sequence
  chemically synthesized
gcggggatactgctgtcatc

SEQ ID NO: 102968 - DNA, 20 bp, Artificial Sequence
  chemically synthesized
ctctgcccacttgatgacag

SEQ ID NO: 102969 - DNA, 20 bp, Artificial Sequence
  chemically synthesized
tggttgtcacattgggggcg

SEQ ID NO: 102970 - DNA, 20 bp, Artificial Sequence
  chemically synthesized
ttggttgtcacattgggggc

SEQ ID NO: 102971 - DNA, 20 bp, Artificial Sequence
  chemically synthesized
cttggttgtcacattggggg

SEQ ID NO: 102972 - DNA, 20 bp, Artificial Sequence
  chemically synthesized
attcttggttgtcacattgg

SEQ ID NO: 102973 - DNA, 20 bp, Artificial Sequence
  chemically synthesized
aattcttggttgtcacattg

SEQ ID NO: 102974 - DNA, 20 bp, Artificial Sequence
  chemically synthesized
aaattcttggttgtcacatt

SEQ ID NO: 102975 - DNA, 20 bp, Artificial Sequence
  chemically synthesized
gaaattcttggttgtcacat

SEQ ID NO: 102976 - DNA, 20 bp, Artificial Sequence
  chemically synthesized
ccgcccccaatgtgacaacc

SEQ ID NO: 102977 - DNA, 20 bp, Artificial Sequence
  chemically synthesized
acagtatctcaagaaattct

SEQ ID NO: 102978 - DNA, 20 bp, Artificial Sequence
  chemically synthesized
gtgacaaccaagaatttctt

SEQ ID NO: 102979 - DNA, 20 bp, Artificial Sequence
  chemically synthesized
agaacatttgacagtatctc

SEQ ID NO: 102980 - DNA, 20 bp, Artificial Sequence
  chemically synthesized
catccccagagaacatttga

SEQ ID NO: 102981 - DNA, 20 bp, Artificial Sequence
  chemically synthesized
agatactgtcaaatgttctc

SEQ ID NO: 102982 - DNA, 20 bp, Artificial Sequence
  chemically synthesized
gatactgtcaaatgttctct

SEQ ID NO: 102983 - DNA, 20 bp, Artificial Sequence
  chemically synthesized
atactgtcaaatgttctctg

SEQ ID NO: 102984 - DNA, 20 bp, Artificial Sequence
  chemically synthesized
ctgatataatttcatcccca

SEQ ID NO: 102985 - DNA, 20 bp, Artificial Sequence
  chemically synthesized
acctgatataatttcatccc

SEQ ID NO: 102986 - DNA, 20 bp, Artificial Sequence
  chemically synthesized
ctctggggatgaaattatat

SEQ ID NO: 102987 - DNA, 20 bp, Artificial Sequence
  chemically synthesized
tctggggatgaaattatatc

SEQ ID NO: 102988 - DNA, 20 bp, Artificial Sequence
  chemically synthesized
ggatgaaattatatcaggtt

SEQ ID NO: 102989 - DNA, 20 bp, Artificial Sequence
  chemically synthesized
caggttaagaactactgact

SEQ ID NO: 102990 - DNA, 20 bp, Artificial Sequence
  chemically synthesized
ggagtatttatctaagtcag

SEQ ID NO: 102991 - DNA, 20 bp, Artificial Sequence
  chemically synthesized
cagggagtatttatctaagt

SEQ ID NO: 102992 - DNA, 20 bp, Artificial Sequence
  chemically synthesized
agttcagggagtatttatct

SEQ ID NO: 102993 - DNA, 20 bp, Artificial Sequence
  chemically synthesized
tagataaatactccctgaac

SEQ ID NO: 102994 - DNA, 20 bp, Artificial Sequence
  chemically synthesized
ttccaggactctagttcagg

SEQ ID NO: 102995 - DNA, 20 bp, Artificial Sequence
  chemically synthesized
gataaatactccctgaacta

SEQ ID NO: 102996 - DNA, 20 bp, Artificial Sequence
  chemically synthesized
gtttccaggactctagttca

SEQ ID NO: 102997 - DNA, 20 bp, Artificial Sequence
  chemically synthesized
ggtttccaggactctagttc

SEQ ID NO: 102998 - DNA, 20 bp, Artificial Sequence
  chemically synthesized
aggtttccaggactctagtt

SEQ ID NO: 102999 - DNA, 20 bp, Artificial Sequence
  chemically synthesized
tactccctgaactagagtcc

SEQ ID NO: 103000 - DNA, 20 bp, Artificial Sequence
  chemically synthesized
cctaaaggtttccaggactc

SEQ ID NO: 103001 - DNA, 20 bp, Artificial Sequence
  chemically synthesized
ttggccacctaaaggtttcc

SEQ ID NO: 103002 - DNA, 20 bp, Artificial Sequence
  chemically synthesized
cttggccacctaaaggtttc

SEQ ID NO: 103003 - DNA, 20 bp, Artificial Sequence
  chemically synthesized
actagagtcctggaaacctt

SEQ ID NO: 103004 - DNA, 20 bp, Artificial Sequence
  chemically synthesized
ctagagtcctggaaaccttt

SEQ ID NO: 103005 - DNA, 20 bp, Artificial Sequence
  chemically synthesized
gagtcctggaaacctttagg

SEQ ID NO: 103006 - DNA, 20 bp, Artificial Sequence
  chemically synthesized
aataagtcttggccacctaa

SEQ ID NO: 103007 - DNA, 20 bp, Artificial Sequence
  chemically synthesized
gaataagtcttggccaccta

SEQ ID NO: 103008 - DNA, 20 bp, Artificial Sequence
  chemically synthesized
ctggaaacctttaggtggcc

SEQ ID NO: 103009 - DNA, 20 bp, Artificial Sequence
  chemically synthesized
caattctttagaataagtct

SEQ ID NO: 103010 - DNA, 20 bp, Artificial Sequence
  chemically synthesized
ggtggccaagacttattcta

SEQ ID NO: 103011 - DNA, 20 bp, Artificial Sequence
  chemically synthesized
ttttagcaattctttagaat

SEQ ID NO: 103012 - DNA, 20 bp, Artificial Sequence
  chemically synthesized
aataatttttagcaattctt

SEQ ID NO: 103013 - DNA, 20 bp, Artificial Sequence
  chemically synthesized
ttttaaaagaaaataatttt

SEQ ID NO: 103014 - DNA, 20 bp, Artificial Sequence
  chemically synthesized
taaaaattattttcttttaa

SEQ ID NO: 103015 - DNA, 20 bp, Artificial Sequence
  chemically synthesized
aaaattattttcttttaaaa

SEQ ID NO: 103016 - DNA, 20 bp, Artificial Sequence
  chemically synthesized
cctcccggcatctcttttaa

SEQ ID NO: 103017 - DNA, 20 bp, Artificial Sequence
  chemically synthesized
ttttcttttaaaagagatgc

SEQ ID NO: 103018 - DNA, 20 bp, Artificial Sequence
  chemically synthesized
tttcttttaaaagagatgcc

SEQ ID NO: 103019 - DNA, 20 bp, Artificial Sequence
  chemically synthesized
tcttttaaaagagatgccgg

SEQ ID NO: 103020 - DNA, 20 bp, Artificial Sequence
  chemically synthesized
cttttaaaagagatgccggg

SEQ ID NO: 103021 - DNA, 20 bp, Artificial Sequence
  chemically synthesized
tttaaaagagatgccgggag

SEQ ID NO: 103022 - DNA, 20 bp, Artificial Sequence
  chemically synthesized
taaaagagatgccgggagga

SEQ ID NO: 103023 - DNA, 20 bp, Artificial Sequence
  chemically synthesized
tctgctcctctctctcctcc

SEQ ID NO: 103024 - DNA, 20 bp, Artificial Sequence
  chemically synthesized
aaagagatgccgggaggaga

SEQ ID NO: 103025 - DNA, 20 bp, Artificial Sequence
  chemically synthesized
agagatgccgggaggagaga

SEQ ID NO: 103026 - DNA, 20 bp, Artificial Sequence
  chemically synthesized
gagatgccgggaggagagag

SEQ ID NO: 103027 - DNA, 20 bp, Artificial Sequence
  chemically synthesized
gatgccgggaggagagagag

SEQ ID NO: 103028 - DNA, 20 bp, Artificial Sequence
  chemically synthesized
gccgggaggagagagaggag

SEQ ID NO: 103029 - DNA, 20 bp, Artificial Sequence
  chemically synthesized
gaggagagagaggagcagaa

SEQ ID NO: 103030 - DNA, 20 bp, Artificial Sequence
  chemically synthesized
gagcagaaaagataactact

SEQ ID NO: 103031 - DNA, 20 bp, Artificial Sequence
  chemically synthesized
cagaaaagataactactgag

SEQ ID NO: 103032 - DNA, 20 bp, Artificial Sequence
  chemically synthesized
gtattaagccaactactcag

SEQ ID NO: 103033 - DNA, 20 bp, Artificial Sequence
  chemically synthesized
aaagataactactgagtagt

SEQ ID NO: 103034 - DNA, 20 bp, Artificial Sequence
  chemically synthesized
gaggtattaagccaactact

SEQ ID NO: 103035 - DNA, 20 bp, Artificial Sequence
  chemically synthesized
gagtagttggcttaatacct

SEQ ID NO: 103036 - DNA, 20 bp, Artificial Sequence
  chemically synthesized
tatttcaccaccgaggtatt

SEQ ID NO: 103037 - DNA, 20 bp, Artificial Sequence
  chemically synthesized
tagttggcttaatacctcgg

SEQ ID NO: 103038 - DNA, 20 bp, Artificial Sequence
  chemically synthesized
tacattttatttcaccaccg

SEQ ID NO: 103039 - DNA, 20 bp, Artificial Sequence
  chemically synthesized
ttacattttatttcaccacc

SEQ ID NO: 103040 - DNA, 20 bp, Artificial Sequence
  chemically synthesized
tggtgaaataaaatgtaaaa

SEQ ID NO: 103041 - DNA, 20 bp, Artificial Sequence
  chemically synthesized
taggcaaaccggtgtcacag

SEQ ID NO: 103042 - DNA, 20 bp, Artificial Sequence
  chemically synthesized
ataggcaaaccggtgtcaca

SEQ ID NO: 103043 - DNA, 20 bp, Artificial Sequence
  chemically synthesized
aaaacggacccctgtgacac

SEQ ID NO: 103044 - DNA, 20 bp, Artificial Sequence
  chemically synthesized
cataggcaaaccggtgtcac

SEQ ID NO: 103045 - DNA, 20 bp, Artificial Sequence
  chemically synthesized
acataggcaaaccggtgtca

SEQ ID NO: 103046 - DNA, 20 bp, Artificial Sequence
  chemically synthesized
ggtttattacataggcaaac

SEQ ID NO: 103047 - DNA, 20 bp, Artificial Sequence
  chemically synthesized
catgtgaaggtttattacat

SEQ ID NO: 103048 - DNA, 20 bp, Artificial Sequence
  chemically synthesized
acatgtgaaggtttattaca

SEQ ID NO: 103049 - DNA, 20 bp, Artificial Sequence
  chemically synthesized
ggtttgtggggtacatgtga

SEQ ID NO: 103050 - DNA, 20 bp, Artificial Sequence
  chemically synthesized
aggtttgtggggtacatgtg

SEQ ID NO: 103051 - DNA, 20 bp, Artificial Sequence
  chemically synthesized
acttttattttaggtttgtg

SEQ ID NO: 103052 - DNA, 20 bp, Artificial Sequence
  chemically synthesized
aacttttattttaggtttgt

SEQ ID NO: 103053 - DNA, 20 bp, Artificial Sequence
  chemically synthesized
taacttttattttaggtttg

SEQ ID NO: 103054 - DNA, 20 bp, Artificial Sequence
  chemically synthesized
accccacaaacctaaaataa

SEQ ID NO: 103055 - DNA, 20 bp, Artificial Sequence
  chemically synthesized
atttttttaacttttatttt

SEQ ID NO: 103056 - DNA, 20 bp, Artificial Sequence
  chemically synthesized
catttttttaacttttattt

SEQ ID NO: 103057 - DNA, 20 bp, Artificial Sequence
  chemically synthesized
ataaaagttaaaaaaatgaa

SEQ ID NO: 103058 - DNA, 20 bp, Artificial Sequence
  chemically synthesized
agttaaaaaaatgaaaagaa

SEQ ID NO: 103059 - DNA, 20 bp, Artificial Sequence
  chemically synthesized
gttaaaaaaatgaaaagaat

SEQ ID NO: 103060 - DNA, 20 bp, Artificial Sequence
  chemically synthesized
aaaaatgaaaagaataggaa

SEQ ID NO: 103061 - DNA, 20 bp, Artificial Sequence
  chemically synthesized
agattaaaaaataaaaataa

SEQ ID NO: 103062 - DNA, 20 bp, Artificial Sequence
  chemically synthesized
gcattgccttatgcaatgat

SEQ ID NO: 103063 - DNA, 20 bp, Artificial Sequence
  chemically synthesized
agcattgccttatgcaatga

SEQ ID NO: 103064 - DNA, 20 bp, Artificial Sequence
  chemically synthesized
aatgtttcctatcattgcat

SEQ ID NO: 103065 - DNA, 20 bp, Artificial Sequence
  chemically synthesized
atgtttcctatcattgcata

SEQ ID NO: 103066 - DNA, 20 bp, Artificial Sequence
  chemically synthesized
taaatttttcttttattaag

SEQ ID NO: 103067 - DNA, 20 bp, Artificial Sequence
  chemically synthesized
aaggcaatgctgcttaataa

SEQ ID NO: 103068 - DNA, 20 bp, Artificial Sequence
  chemically synthesized
tactaaatttttcttttatt

SEQ ID NO: 103069 - DNA, 20 bp, Artificial Sequence
  chemically synthesized
tgcttaataaaagaaaaatt

SEQ ID NO: 103070 - DNA, 20 bp, Artificial Sequence
  chemically synthesized
aataaaagaaaaatttagta

SEQ ID NO: 103071 - DNA, 20 bp, Artificial Sequence
  chemically synthesized
aaaagaaaaatttagtatag

SEQ ID NO: 103072 - DNA, 20 bp, Artificial Sequence
  chemically synthesized
agtatagtagaatcgtgccg

SEQ ID NO: 103073 - DNA, 20 bp, Artificial Sequence
  chemically synthesized
tagaatcgtgccgcagtcat

SEQ ID NO: 103074 - DNA, 20 bp, Artificial Sequence
  chemically synthesized
agggttgcttctcatgactg

SEQ ID NO: 103075 - DNA, 20 bp, Artificial Sequence
  chemically synthesized
aatcgtgccgcagtcatgag

SEQ ID NO: 103076 - DNA, 20 bp, Artificial Sequence
  chemically synthesized
tggttaagagaaatggggaa

SEQ ID NO: 103077 - DNA, 20 bp, Artificial Sequence
  chemically synthesized
ttggttaagagaaatgggga

SEQ ID NO: 103078 - DNA, 20 bp, Artificial Sequence
  chemically synthesized
gttggttaagagaaatgggg

SEQ ID NO: 103079 - DNA, 20 bp, Artificial Sequence
  chemically synthesized
tgtgttggttaagagaaatg

SEQ ID NO: 103080 - DNA, 20 bp, Artificial Sequence
  chemically synthesized
gtgtgttggttaagagaaat

SEQ ID NO: 103081 - DNA, 20 bp, Artificial Sequence
  chemically synthesized
ggtgtgttggttaagagaaa

SEQ ID NO: 103082 - DNA, 20 bp, Artificial Sequence
  chemically synthesized
attcaaggtgtgttggttaa

SEQ ID NO: 103083 - DNA, 20 bp, Artificial Sequence
  chemically synthesized
ggattcaaggtgtgttggtt

SEQ ID NO: 103084 - DNA, 20 bp, Artificial Sequence
  chemically synthesized
ttgatggattcaaggtgtgt

SEQ ID NO: 103085 - DNA, 20 bp, Artificial Sequence
  chemically synthesized
aatttaatttgatggattca

SEQ ID NO: 103086 - DNA, 20 bp, Artificial Sequence
  chemically synthesized
gaatttaatttgatggattc

SEQ ID NO: 103087 - DNA, 20 bp, Artificial Sequence
  chemically synthesized
tatgcaagaatttaatttga

SEQ ID NO: 103088 - DNA, 20 bp, Artificial Sequence
  chemically synthesized
atcaaattaaattcttgcat

SEQ ID NO: 103089 - DNA, 20 bp, Artificial Sequence
  chemically synthesized
caaattaaattcttgcataa

SEQ ID NO: 103090 - DNA, 20 bp, Artificial Sequence
  chemically synthesized
aaattaaattcttgcataag

SEQ ID NO: 103091 - DNA, 20 bp, Artificial Sequence
  chemically synthesized
aaggtggttacctcttatgc

SEQ ID NO: 103092 - DNA, 20 bp, Artificial Sequence
  chemically synthesized
gcataagaggtaaccacctt

SEQ ID NO: 103093 - DNA, 20 bp, Artificial Sequence
  chemically synthesized
ctaagaaagaaatctgaagg

SEQ ID NO: 103094 - DNA, 20 bp, Artificial Sequence
  chemically synthesized
ggtctaagaaagaaatctga

SEQ ID NO: 103095 - DNA, 20 bp, Artificial Sequence
  chemically synthesized
aggtctaagaaagaaatctg

SEQ ID NO: 103096 - DNA, 20 bp, Artificial Sequence
  chemically synthesized
ccaccttcagatttctttct

SEQ ID NO: 103097 - DNA, 20 bp, Artificial Sequence
  chemically synthesized
ttagagatacaggtctaaga

SEQ ID NO: 103098 - DNA, 20 bp, Artificial Sequence
  chemically synthesized
tcttttagagatacaggtct

SEQ ID NO: 103099 - DNA, 20 bp, Artificial Sequence
  chemically synthesized
atgttttcttttagagatac

SEQ ID NO: 103100 - DNA, 20 bp, Artificial Sequence
  chemically synthesized
gatgttttcttttagagata

SEQ ID NO: 103101 - DNA, 20 bp, Artificial Sequence
  chemically synthesized
tcttagacctgtatctctaa

SEQ ID NO: 103102 - DNA, 20 bp, Artificial Sequence
  chemically synthesized
ggtaaggatgttttctttta

SEQ ID NO: 103103 - DNA, 20 bp, Artificial Sequence
  chemically synthesized
gtggtaaggatgttttcttt

SEQ ID NO: 103104 - DNA, 20 bp, Artificial Sequence
  chemically synthesized
cagtctgcactaaagtggta

SEQ ID NO: 103105 - DNA, 20 bp, Artificial Sequence
  chemically synthesized
agaaaacatccttaccactt

SEQ ID NO: 103106 - DNA, 20 bp, Artificial Sequence
  chemically synthesized
ccagtctgcactaaagtggt

SEQ ID NO: 103107 - DNA, 20 bp, Artificial Sequence
  chemically synthesized
caggccagtctgcactaaag

SEQ ID NO: 103108 - DNA, 20 bp, Artificial Sequence
  chemically synthesized
acatccttaccactttagtg

SEQ ID NO: 103109 - DNA, 20 bp, Artificial Sequence
  chemically synthesized
agccaggccagtctgcacta

SEQ ID NO: 103110 - DNA, 20 bp, Artificial Sequence
  chemically synthesized
cttaccactttagtgcagac

SEQ ID NO: 103111 - DNA, 20 bp, Artificial Sequence
  chemically synthesized
cactttagtgcagactggcc

SEQ ID NO: 103112 - DNA, 20 bp, Artificial Sequence
  chemically synthesized
ctcatagttgaaagccaggc

SEQ ID NO: 103113 - DNA, 20 bp, Artificial Sequence
  chemically synthesized
gatcctcatagttgaaagcc

SEQ ID NO: 103114 - DNA, 20 bp, Artificial Sequence
  chemically synthesized
ggatcctcatagttgaaagc

SEQ ID NO: 103115 - DNA, 20 bp, Artificial Sequence
  chemically synthesized
atgtggatcctcatagttga

SEQ ID NO: 103116 - DNA, 20 bp, Artificial Sequence
  chemically synthesized
ctggcctggctttcaactat

SEQ ID NO: 103117 - DNA, 20 bp, Artificial Sequence
  chemically synthesized
tggcctggctttcaactatg

SEQ ID NO: 103118 - DNA, 20 bp, Artificial Sequence
  chemically synthesized
aaaaaaaatgtggatcctca

SEQ ID NO: 103119 - DNA, 20 bp, Artificial Sequence
  chemically synthesized
gccattagggaaaaaaaatg

SEQ ID NO: 103120 - DNA, 20 bp, Artificial Sequence
  chemically synthesized
tccacattttttttccctaa

SEQ ID NO: 103121 - DNA, 20 bp, Artificial Sequence
  chemically synthesized
gagtatgtctaaagccatta

SEQ ID NO: 103122 - DNA, 20 bp, Artificial Sequence
  chemically synthesized
agagtatgtctaaagccatt

SEQ ID NO: 103123 - DNA, 20 bp, Artificial Sequence
  chemically synthesized
ttttttttccctaatggctt

SEQ ID NO: 103124 - DNA, 20 bp, Artificial Sequence
  chemically synthesized
cagagtatgtctaaagccat

SEQ ID NO: 103125 - DNA, 20 bp, Artificial Sequence
  chemically synthesized
ttgtgtccagagtatgtcta

SEQ ID NO: 103126 - DNA, 20 bp, Artificial Sequence
  chemically synthesized
taatggctttagacatactc

SEQ ID NO: 103127 - DNA, 20 bp, Artificial Sequence
  chemically synthesized
gaaaaattattttgtgtcca

SEQ ID NO: 103128 - DNA, 20 bp, Artificial Sequence
  chemically synthesized
aagaaaaattattttgtgtc

SEQ ID NO: 103129 - DNA, 20 bp, Artificial Sequence
  chemically synthesized
acaaaataatttttcttgcc

SEQ ID NO: 103130 - DNA, 20 bp, Artificial Sequence
  chemically synthesized
caaaataatttttcttgcca

SEQ ID NO: 103131 - DNA, 20 bp, Artificial Sequence
  chemically synthesized
aataatttttcttgccaagg

SEQ ID NO: 103132 - DNA, 20 bp, Artificial Sequence
  chemically synthesized
ttctggcataccaccttggc

SEQ ID NO: 103133 - DNA, 20 bp, Artificial Sequence
  chemically synthesized
gcatttctggcataccacct

SEQ ID NO: 103134 - DNA, 20 bp, Artificial Sequence
  chemically synthesized
ttcttgccaaggtggtatgc

SEQ ID NO: 103135 - DNA, 20 bp, Artificial Sequence
  chemically synthesized
aggtggtatgccagaaatgc

SEQ ID NO: 103136 - DNA, 20 bp, Artificial Sequence
  chemically synthesized
aattattttcctagcatttc

SEQ ID NO: 103137 - DNA, 20 bp, Artificial Sequence
  chemically synthesized
ggtggtatgccagaaatgct

SEQ ID NO: 103138 - DNA, 20 bp, Artificial Sequence
  chemically synthesized
caacgggggaattattttcc

SEQ ID NO: 103139 - DNA, 20 bp, Artificial Sequence
  chemically synthesized
taggaaaataattcccccgt

SEQ ID NO: 103140 - DNA, 20 bp, Artificial Sequence
  chemically synthesized
gaaaataattcccccgttgg

SEQ ID NO: 103141 - DNA, 20 bp, Artificial Sequence
  chemically synthesized
tttaggactgcttccaacgg

SEQ ID NO: 103142 - DNA, 20 bp, Artificial Sequence
  chemically synthesized
gtttaggactgcttccaacg

SEQ ID NO: 103143 - DNA, 20 bp, Artificial Sequence
  chemically synthesized
ggtttaggactgcttccaac

SEQ ID NO: 103144 - DNA, 20 bp, Artificial Sequence
  chemically synthesized
aataattcccccgttggaag

SEQ ID NO: 103145 - DNA, 20 bp, Artificial Sequence
  chemically synthesized
tggtttaggactgcttccaa

SEQ ID NO: 103146 - DNA, 20 bp, Artificial Sequence
  chemically synthesized
atcctgctagtcattggttt

SEQ ID NO: 103147 - DNA, 20 bp, Artificial Sequence
  chemically synthesized
aatcctgctagtcattggtt

SEQ ID NO: 103148 - DNA, 20 bp, Artificial Sequence
  chemically synthesized
agcagtcctaaaccaatgac

SEQ ID NO: 103149 - DNA, 20 bp, Artificial Sequence
  chemically synthesized
cacaaaatcctgctagtcat

SEQ ID NO: 103150 - DNA, 20 bp, Artificial Sequence
  chemically synthesized
agtcctaaaccaatgactag

SEQ ID NO: 103151 - DNA, 20 bp, Artificial Sequence
  chemically synthesized
gtcctaaaccaatgactagc

SEQ ID NO: 103152 - DNA, 20 bp, Artificial Sequence
  chemically synthesized
atttatacacaaaatcctgc

SEQ ID NO: 103153 - DNA, 20 bp, Artificial Sequence
  chemically synthesized
gattttgtgtataaataccc

SEQ ID NO: 103154 - DNA, 20 bp, Artificial Sequence
  chemically synthesized
tcaaaggggcaagggagctg

SEQ ID NO: 103155 - DNA, 20 bp, Artificial Sequence
  chemically synthesized
ttcaaaggggcaagggagct

SEQ ID NO: 103156 - DNA, 20 bp, Artificial Sequence
  chemically synthesized
tttcaaaggggcaagggagc

SEQ ID NO: 103157 - DNA, 20 bp, Artificial Sequence
  chemically synthesized
attctttcaaaggggcaagg

SEQ ID NO: 103158 - DNA, 20 bp, Artificial Sequence
  chemically synthesized
ttattctttcaaaggggcaa

SEQ ID NO: 103159 - DNA, 20 bp, Artificial Sequence
  chemically synthesized
gttattctttcaaaggggca

SEQ ID NO: 103160 - DNA, 20 bp, Artificial Sequence
  chemically synthesized
agttattctttcaaaggggc

SEQ ID NO: 103161 - DNA, 20 bp, Artificial Sequence
  chemically synthesized
cagctcccttgcccctttga

SEQ ID NO: 103162 - DNA, 20 bp, Artificial Sequence
  chemically synthesized
agttagttattctttcaaag

SEQ ID NO: 103163 - DNA, 20 bp, Artificial Sequence
  chemically synthesized
gagttagttattctttcaaa

SEQ ID NO: 103164 - DNA, 20 bp, Artificial Sequence
  chemically synthesized
agagttagttattctttcaa

SEQ ID NO: 103165 - DNA, 20 bp, Artificial Sequence
  chemically synthesized
aagagttagttattctttca

SEQ ID NO: 103166 - DNA, 20 bp, Artificial Sequence
  chemically synthesized
gaagacatgtgtttaagagt

SEQ ID NO: 103167 - DNA, 20 bp, Artificial Sequence
  chemically synthesized
gattgaagacatgtgtttaa

SEQ ID NO: 103168 - DNA, 20 bp, Artificial Sequence
  chemically synthesized
tggattgaagacatgtgttt

SEQ ID NO: 103169 - DNA, 20 bp, Artificial Sequence
  chemically synthesized
gggaaattctaaatggattg

SEQ ID NO: 103170 - DNA, 20 bp, Artificial Sequence
  chemically synthesized
acacatgtcttcaatccatt

SEQ ID NO: 103171 - DNA, 20 bp, Artificial Sequence
  chemically synthesized
cccactggggaaattctaaa

SEQ ID NO: 103172 - DNA, 20 bp, Artificial Sequence
  chemically synthesized
caatccatttagaatttccc

SEQ ID NO: 103173 - DNA, 20 bp, Artificial Sequence
  chemically synthesized
tccatttagaatttccccag

SEQ ID NO: 103174 - DNA, 20 bp, Artificial Sequence
  chemically synthesized
ccatttagaatttccccagt

SEQ ID NO: 103175 - DNA, 20 bp, Artificial Sequence
  chemically synthesized
agtggagtttaatcccactg

SEQ ID NO: 103176 - DNA, 20 bp, Artificial Sequence
  chemically synthesized
tagtggagtttaatcccact

SEQ ID NO: 103177 - DNA, 20 bp, Artificial Sequence
  chemically synthesized
ctagtggagtttaatcccac

SEQ ID NO: 103178 - DNA, 20 bp, Artificial Sequence
  chemically synthesized
ccagtgggattaaactccac

SEQ ID NO: 103179 - DNA, 20 bp, Artificial Sequence
  chemically synthesized
caactgccactggtctagtg

SEQ ID NO: 103180 - DNA, 20 bp, Artificial Sequence
  chemically synthesized
gggattaaactccactagac

SEQ ID NO: 103181 - DNA, 20 bp, Artificial Sequence
  chemically synthesized
gccaactgccactggtctag

SEQ ID NO: 103182 - DNA, 20 bp, Artificial Sequence
  chemically synthesized
attaaactccactagaccag

SEQ ID NO: 103183 - DNA, 20 bp, Artificial Sequence
  chemically synthesized
caagccaactgccactggtc

SEQ ID NO: 103184 - DNA, 20 bp, Artificial Sequence
  chemically synthesized
aaactccactagaccagtgg

SEQ ID NO: 103185 - DNA, 20 bp, Artificial Sequence
  chemically synthesized
attatcaagccaactgccac

SEQ ID NO: 103186 - DNA, 20 bp, Artificial Sequence
  chemically synthesized
tccactagaccagtggcagt

SEQ ID NO: 103187 - DNA, 20 bp, Artificial Sequence
  chemically synthesized
tcagtaaaaaatgcattatc

SEQ ID NO: 103188 - DNA, 20 bp, Artificial Sequence
  chemically synthesized
gactgtgaagagaaatcatt

SEQ ID NO: 103189 - DNA, 20 bp, Artificial Sequence
  chemically synthesized
tactgaatgatttctcttca

SEQ ID NO: 103190 - DNA, 20 bp, Artificial Sequence
  chemically synthesized
taagatagtgagactgtgaa

SEQ ID NO: 103191 - DNA, 20 bp, Artificial Sequence
  chemically synthesized
ggtaagatagtgagactgtg

SEQ ID NO: 103192 - DNA, 20 bp, Artificial Sequence
  chemically synthesized
tgaatgtgaggtaagatagt

SEQ ID NO: 103193 - DNA, 20 bp, Artificial Sequence
  chemically synthesized
gagatgaatgtgaggtaaga

SEQ ID NO: 103194 - DNA, 20 bp, Artificial Sequence
  chemically synthesized
ggcagagatgaatgtgaggt

SEQ ID NO: 103195 - DNA, 20 bp, Artificial Sequence
  chemically synthesized
agaaggcagagatgaatgtg

SEQ ID NO: 103196 - DNA, 20 bp, Artificial Sequence
  chemically synthesized
cagaaggcagagatgaatgt

SEQ ID NO: 103197 - DNA, 20 bp, Artificial Sequence
  chemically synthesized
accagctactgcagaaggca

SEQ ID NO: 103198 - DNA, 20 bp, Artificial Sequence
  chemically synthesized
acattcatctctgccttctg

SEQ ID NO: 103199 - DNA, 20 bp, Artificial Sequence
  chemically synthesized
gcaccagctactgcagaagg

SEQ ID NO: 103200 - DNA, 20 bp, Artificial Sequence
  chemically synthesized
ttcatctctgccttctgcag

SEQ ID NO: 103201 - DNA, 20 bp, Artificial Sequence
  chemically synthesized
gaagcaccagctactgcaga

SEQ ID NO: 103202 - DNA, 20 bp, Artificial Sequence
  chemically synthesized
tgaagcaccagctactgcag

SEQ ID NO: 103203 - DNA, 20 bp, Artificial Sequence
  chemically synthesized
tctctgccttctgcagtagc

SEQ ID NO: 103204 - DNA, 20 bp, Artificial Sequence
  chemically synthesized
atgtgaagcaccagctactg

SEQ ID NO: 103205 - DNA, 20 bp, Artificial Sequence
  chemically synthesized
gtcctagaaatgtgaagcac

SEQ ID NO: 103206 - DNA, 20 bp, Artificial Sequence
  chemically synthesized
tgggaagtcctagaaatgtg

SEQ ID NO: 103207 - DNA, 20 bp, Artificial Sequence
  chemically synthesized
tagctggtgcttcacatttc

SEQ ID NO: 103208 - DNA, 20 bp, Artificial Sequence
  chemically synthesized
agctggtgcttcacatttct

SEQ ID NO: 103209 - DNA, 20 bp, Artificial Sequence
  chemically synthesized
acttagaacttgggaagtcc

SEQ ID NO: 103210 - DNA, 20 bp, Artificial Sequence
  chemically synthesized
tcacatttctaggacttccc

SEQ ID NO: 103211 - DNA, 20 bp, Artificial Sequence
  chemically synthesized
ccaagtacttagaacttggg

SEQ ID NO: 103212 - DNA, 20 bp, Artificial Sequence
  chemically synthesized
tctaggacttcccaagttct

SEQ ID NO: 103213 - DNA, 20 bp, Artificial Sequence
  chemically synthesized
attccaagtacttagaactt

SEQ ID NO: 103214 - DNA, 20 bp, Artificial Sequence
  chemically synthesized
aattccaagtacttagaact

SEQ ID NO: 103215 - DNA, 20 bp, Artificial Sequence
  chemically synthesized
cttcccaagttctaagtact

SEQ ID NO: 103216 - DNA, 20 bp, Artificial Sequence
  chemically synthesized
aaacctgaattccaagtact

SEQ ID NO: 103217 - DNA, 20 bp, Artificial Sequence
  chemically synthesized
agttctaagtacttggaatt

SEQ ID NO: 103218 - DNA, 20 bp, Artificial Sequence
  chemically synthesized
gttctaagtacttggaattc

SEQ ID NO: 103219 - DNA, 20 bp, Artificial Sequence
  chemically synthesized
atcttggaaacctgaattcc

SEQ ID NO: 103220 - DNA, 20 bp, Artificial Sequence
  chemically synthesized
tacttggaattcaggtttcc

SEQ ID NO: 103221 - DNA, 20 bp, Artificial Sequence
  chemically synthesized
atggaggagttagcatatct

SEQ ID NO: 103222 - DNA, 20 bp, Artificial Sequence
  chemically synthesized
tatgcagagaatggaggagt

SEQ ID NO: 103223 - DNA, 20 bp, Artificial Sequence
  chemically synthesized
ggaatatgcagagaatggag

SEQ ID NO: 103224 - DNA, 20 bp, Artificial Sequence
  chemically synthesized
taggaatatgcagagaatgg

SEQ ID NO: 103225 - DNA, 20 bp, Artificial Sequence
  chemically synthesized
ttaggaatatgcagagaatg

SEQ ID NO: 103226 - DNA, 20 bp, Artificial Sequence
  chemically synthesized
atttaggaatatgcagagaa

SEQ ID NO: 103227 - DNA, 20 bp, Artificial Sequence
  chemically synthesized
aaaaaatttaggaatatgca

SEQ ID NO: 103228 - DNA, 20 bp, Artificial Sequence
  chemically synthesized
ataaaaaatttaggaatatg

SEQ ID NO: 103229 - DNA, 20 bp, Artificial Sequence
  chemically synthesized
ataaaaaagataaaaaattt

SEQ ID NO: 103230 - DNA, 20 bp, Artificial Sequence
  chemically synthesized
aataaaaaagataaaaaatt

SEQ ID NO: 103231 - DNA, 20 bp, Artificial Sequence
  chemically synthesized
ggaaaaacaataaaataaaa

SEQ ID NO: 103232 - DNA, 20 bp, Artificial Sequence
  chemically synthesized
tattttattgtttttcctcc

SEQ ID NO: 103233 - DNA, 20 bp, Artificial Sequence
  chemically synthesized
caaagagaaaaaaatctggg

SEQ ID NO: 103234 - DNA, 20 bp, Artificial Sequence
  chemically synthesized
acaaagagaaaaaaatctgg

SEQ ID NO: 103235 - DNA, 20 bp, Artificial Sequence
  chemically synthesized
ccacaaagagaaaaaaatct

SEQ ID NO: 103236 - DNA, 20 bp, Artificial Sequence
  chemically synthesized
accacaaagagaaaaaaatc

SEQ ID NO: 103237 - DNA, 20 bp, Artificial Sequence
  chemically synthesized
cccagatttttttctctttg

SEQ ID NO: 103238 - DNA, 20 bp, Artificial Sequence
  chemically synthesized
aaaatgatatttaccacaaa

SEQ ID NO: 103239 - DNA, 20 bp, Artificial Sequence
  chemically synthesized
ttaaaatgatatttaccaca

SEQ ID NO: 103240 - DNA, 20 bp, Artificial Sequence
  chemically synthesized
cttcactaaaatgagaatag

SEQ ID NO: 103241 - DNA, 20 bp, Artificial Sequence
  chemically synthesized
ccttcactaaaatgagaata

SEQ ID NO: 103242 - DNA, 20 bp, Artificial Sequence
  chemically synthesized
accttcactaaaatgagaat

SEQ ID NO: 103243 - DNA, 20 bp, Artificial Sequence
  chemically synthesized
aaccttcactaaaatgagaa

SEQ ID NO: 103244 - DNA, 20 bp, Artificial Sequence
  chemically synthesized
taattcccctattctcattt

SEQ ID NO: 103245 - DNA, 20 bp, Artificial Sequence
  chemically synthesized
tctttaaccttcactaaaat

SEQ ID NO: 103246 - DNA, 20 bp, Artificial Sequence
  chemically synthesized
cccctattctcattttagtg

SEQ ID NO: 103247 - DNA, 20 bp, Artificial Sequence
  chemically synthesized
ccctattctcattttagtga

SEQ ID NO: 103248 - DNA, 20 bp, Artificial Sequence
  chemically synthesized
tctcattttagtgaaggtta

SEQ ID NO: 103249 - DNA, 20 bp, Artificial Sequence
  chemically synthesized
tcattttagtgaaggttaaa

SEQ ID NO: 103250 - DNA, 20 bp, Artificial Sequence
  chemically synthesized
aaagagacatcatttttaac

SEQ ID NO: 103251 - DNA, 20 bp, Artificial Sequence
  chemically synthesized
agatcacttatagggagttc

SEQ ID NO: 103252 - DNA, 20 bp, Artificial Sequence
  chemically synthesized
ttttaaccagaactccctat

SEQ ID NO: 103253 - DNA, 20 bp, Artificial Sequence
  chemically synthesized
ttccatagatcacttatagg

SEQ ID NO: 103254 - DNA, 20 bp, Artificial Sequence
  chemically synthesized
ctttccatagatcacttata

SEQ ID NO: 103255 - DNA, 20 bp, Artificial Sequence
  chemically synthesized
tctttccatagatcacttat

SEQ ID NO: 103256 - DNA, 20 bp, Artificial Sequence
  chemically synthesized
ttctttccatagatcactta

SEQ ID NO: 103257 - DNA, 20 bp, Artificial Sequence
  chemically synthesized
aactccctataagtgatcta

SEQ ID NO: 103258 - DNA, 20 bp, Artificial Sequence
  chemically synthesized
ccctataagtgatctatgga

SEQ ID NO: 103259 - DNA, 20 bp, Artificial Sequence
  chemically synthesized
ttgctaattttttctttcca

SEQ ID NO: 103260 - DNA, 20 bp, Artificial Sequence
  chemically synthesized
gatctatggaaagaaaaaat

SEQ ID NO: 103261 - DNA, 20 bp, Artificial Sequence
  chemically synthesized
tatggaaagaaaaaattagc

SEQ ID NO: 103262 - DNA, 20 bp, Artificial Sequence
  chemically synthesized
aagaaaaaattagcaagaaa

SEQ ID NO: 103263 - DNA, 20 bp, Artificial Sequence
  chemically synthesized
gcaagaaaaagacatttgac

SEQ ID NO: 103264 - DNA, 20 bp, Artificial Sequence
  chemically synthesized
agacatttgactagttgcat

SEQ ID NO: 103265 - DNA, 20 bp, Artificial Sequence
  chemically synthesized
taacccttgactcatgcaac

SEQ ID NO: 103266 - DNA, 20 bp, Artificial Sequence
  chemically synthesized
tttgactagttgcatgagtc

SEQ ID NO: 103267 - DNA, 20 bp, Artificial Sequence
  chemically synthesized
ttgactagttgcatgagtca

SEQ ID NO: 103268 - DNA, 20 bp, Artificial Sequence
  chemically synthesized
tgactagttgcatgagtcaa

SEQ ID NO: 103269 - DNA, 20 bp, Artificial Sequence
  chemically synthesized
agttgcatgagtcaagggtt

SEQ ID NO: 103270 - DNA, 20 bp, Artificial Sequence
  chemically synthesized
catgagtcaagggttaagta

SEQ ID NO: 103271 - DNA, 20 bp, Artificial Sequence
  chemically synthesized
atgagtcaagggttaagtaa

SEQ ID NO: 103272 - DNA, 20 bp, Artificial Sequence
  chemically synthesized
gagtcaagggttaagtaaag

SEQ ID NO: 103273 - DNA, 20 bp, Artificial Sequence
  chemically synthesized
gtcaagggttaagtaaagga

SEQ ID NO: 103274 - DNA, 20 bp, Artificial Sequence
  chemically synthesized
tcaagggttaagtaaaggag

SEQ ID NO: 103275 - DNA, 20 bp, Artificial Sequence
  chemically synthesized
aatttgtgataatttaaatt

SEQ ID NO: 103276 - DNA, 20 bp, Artificial Sequence
  chemically synthesized
tgtgataatttaaatttagc

SEQ ID NO: 103277 - DNA, 20 bp, Artificial Sequence
  chemically synthesized
gataatttaaatttagctag

SEQ ID NO: 103278 - DNA, 20 bp, Artificial Sequence
  chemically synthesized
ataatttaaatttagctagt

SEQ ID NO: 103279 - DNA, 20 bp, Artificial Sequence
  chemically synthesized
aatttaaatttagctagtgg

SEQ ID NO: 103280 - DNA, 20 bp, Artificial Sequence
  chemically synthesized
atttaaatttagctagtggg

SEQ ID NO: 103281 - DNA, 20 bp, Artificial Sequence
  chemically synthesized
ctttgtttgcaacctcccac

SEQ ID NO: 103282 - DNA, 20 bp, Artificial Sequence
  chemically synthesized
ctagtgggaggttgcaaaca

SEQ ID NO: 103283 - DNA, 20 bp, Artificial Sequence
  chemically synthesized
attctagcttacagagagag

SEQ ID NO: 103284 - DNA, 20 bp, Artificial Sequence
  chemically synthesized
gaattctagcttacagagag

SEQ ID NO: 103285 - DNA, 20 bp, Artificial Sequence
  chemically synthesized
acaaagactcctctctctgt

SEQ ID NO: 103286 - DNA, 20 bp, Artificial Sequence
  chemically synthesized
agaattctagcttacagaga

SEQ ID NO: 103287 - DNA, 20 bp, Artificial Sequence
  chemically synthesized
aaagaattctagcttacaga

SEQ ID NO: 103288 - DNA, 20 bp, Artificial Sequence
  chemically synthesized
agactcctctctctgtaagc

SEQ ID NO: 103289 - DNA, 20 bp, Artificial Sequence
  chemically synthesized
ataaagaattctagcttaca

SEQ ID NO: 103290 - DNA, 20 bp, Artificial Sequence
  chemically synthesized
ctataaagaattctagctta

SEQ ID NO: 103291 - DNA, 20 bp, Artificial Sequence
  chemically synthesized
tttaaggctataaagaattc

SEQ ID NO: 103292 - DNA, 20 bp, Artificial Sequence
  chemically synthesized
ctgtaagctagaattcttta

SEQ ID NO: 103293 - DNA, 20 bp, Artificial Sequence
  chemically synthesized
ctgggaaatttaaggctata

SEQ ID NO: 103294 - DNA, 20 bp, Artificial Sequence
  chemically synthesized
aactagacctgggaaattta

SEQ ID NO: 103295 - DNA, 20 bp, Artificial Sequence
  chemically synthesized
aaactagacctgggaaattt

SEQ ID NO: 103296 - DNA, 20 bp, Artificial Sequence
  chemically synthesized
ctttatagccttaaatttcc

SEQ ID NO: 103297 - DNA, 20 bp, Artificial Sequence
  chemically synthesized
tttatagccttaaatttccc

SEQ ID NO: 103298 - DNA, 20 bp, Artificial Sequence
  chemically synthesized
agccttaaatttcccaggtc

SEQ ID NO: 103299 - DNA, 20 bp, Artificial Sequence
  chemically synthesized
ataaatactaaactagacct

SEQ ID NO: 103300 - DNA, 20 bp, Artificial Sequence
  chemically synthesized
tataaatactaaactagacc

SEQ ID NO: 103301 - DNA, 20 bp, Artificial Sequence
  chemically synthesized
taaatttcccaggtctagtt

SEQ ID NO: 103302 - DNA, 20 bp, Artificial Sequence
  chemically synthesized
aataaatataaatactaaac

SEQ ID NO: 103303 - DNA, 20 bp, Artificial Sequence
  chemically synthesized
tttgcagtaaaaaagtagtg

SEQ ID NO: 103304 - DNA, 20 bp, Artificial Sequence
  chemically synthesized
ttttgcagtaaaaaagtagt

SEQ ID NO: 103305 - DNA, 20 bp, Artificial Sequence
  chemically synthesized
aatattttgcagtaaaaaag

SEQ ID NO: 103306 - DNA, 20 bp, Artificial Sequence
  chemically synthesized
ccgaatattttgcagtaaaa

SEQ ID NO: 103307 - DNA, 20 bp, Artificial Sequence
  chemically synthesized
aatggtttccgaatattttg

SEQ ID NO: 103308 - DNA, 20 bp, Artificial Sequence
  chemically synthesized
cttttttactgcaaaatatt

SEQ ID NO: 103309 - DNA, 20 bp, Artificial Sequence
  chemically synthesized
gtgtgacttaaagttacaaa

SEQ ID NO: 103310 - DNA, 20 bp, Artificial Sequence
  chemically synthesized
cggaaaccatttgtaacttt

SEQ ID NO: 103311 - DNA, 20 bp, Artificial Sequence
  chemically synthesized
aattagaattgtgtgactta

SEQ ID NO: 103312 - DNA, 20 bp, Artificial Sequence
  chemically synthesized
ctttaacctaatcattaaat

SEQ ID NO: 103313 - DNA, 20 bp, Artificial Sequence
  chemically synthesized
cacaattctaatttaatgat

SEQ ID NO: 103314 - DNA, 20 bp, Artificial Sequence
  chemically synthesized
acaattctaatttaatgatt

SEQ ID NO: 103315 - DNA, 20 bp, Artificial Sequence
  chemically synthesized
ctaatttaatgattaggtta

SEQ ID NO: 103316 - DNA, 20 bp, Artificial Sequence
  chemically synthesized
tatagagctacaaaattagt

SEQ ID NO: 103317 - DNA, 20 bp, Artificial Sequence
  chemically synthesized
ttatagagctacaaaattag

SEQ ID NO: 103318 - DNA, 20 bp, Artificial Sequence
  chemically synthesized
aaaatttcctactaattttg

SEQ ID NO: 103319 - DNA, 20 bp, Artificial Sequence
  chemically synthesized
gtgttatagagctacaaaat

SEQ ID NO: 103320 - DNA, 20 bp, Artificial Sequence
  chemically synthesized
gccaatatctgagtgttata

SEQ ID NO: 103321 - DNA, 20 bp, Artificial Sequence
  chemically synthesized
ttttgtagctctataacact

SEQ ID NO: 103322 - DNA, 20 bp, Artificial Sequence
  chemically synthesized
ttgccaatatctgagtgtta

SEQ ID NO: 103323 - DNA, 20 bp, Artificial Sequence
  chemically synthesized
gctctataacactcagatat

SEQ ID NO: 103324 - DNA, 20 bp, Artificial Sequence
  chemically synthesized
atataggattgccaatatct

SEQ ID NO: 103325 - DNA, 20 bp, Artificial Sequence
  chemically synthesized
cagatattggcaatcctata

SEQ ID NO: 103326 - DNA, 20 bp, Artificial Sequence
  chemically synthesized
agtattagtttgagccatat

SEQ ID NO: 103327 - DNA, 20 bp, Artificial Sequence
  chemically synthesized
aagtattagtttgagccata

SEQ ID NO: 103328 - DNA, 20 bp, Artificial Sequence
  chemically synthesized
atatgttaaagtattagttt

SEQ ID NO: 103329 - DNA, 20 bp, Artificial Sequence
  chemically synthesized
taaacaatatgttaaagtat

SEQ ID NO: 103330 - DNA, 20 bp, Artificial Sequence
  chemically synthesized
tgtccataaacaatatgtta

SEQ ID NO: 103331 - DNA, 20 bp, Artificial Sequence
  chemically synthesized
atactttaacatattgttta

SEQ ID NO: 103332 - DNA, 20 bp, Artificial Sequence
  chemically synthesized
catattgtttatggacatac

SEQ ID NO: 103333 - DNA, 20 bp, Artificial Sequence
  chemically synthesized
agcatacacagtacaatttc

SEQ ID NO: 103334 - DNA, 20 bp, Artificial Sequence
  chemically synthesized
agtgtagaagttagcataca

SEQ ID NO: 103335 - DNA, 20 bp, Artificial Sequence
  chemically synthesized
ctagatcccagtgtagaagt

SEQ ID NO: 103336 - DNA, 20 bp, Artificial Sequence
  chemically synthesized
gtgtatgctaacttctacac

SEQ ID NO: 103337 - DNA, 20 bp, Artificial Sequence
  chemically synthesized
tgtatgctaacttctacact

SEQ ID NO: 103338 - DNA, 20 bp, Artificial Sequence
  chemically synthesized
aaatctagatcccagtgtag

SEQ ID NO: 103339 - DNA, 20 bp, Artificial Sequence
  chemically synthesized
acaaaatctagatcccagtg

SEQ ID NO: 103340 - DNA, 20 bp, Artificial Sequence
  chemically synthesized
ctaacttctacactgggatc

SEQ ID NO: 103341 - DNA, 20 bp, Artificial Sequence
  chemically synthesized
gaggtacaaaatctagatcc

SEQ ID NO: 103342 - DNA, 20 bp, Artificial Sequence
  chemically synthesized
agatccagaggtacaaaatc

SEQ ID NO: 103343 - DNA, 20 bp, Artificial Sequence
  chemically synthesized
ggatctagattttgtacctc

SEQ ID NO: 103344 - DNA, 20 bp, Artificial Sequence
  chemically synthesized
tcagcttagaaaagatccag

SEQ ID NO: 103345 - DNA, 20 bp, Artificial Sequence
  chemically synthesized
ttcagcttagaaaagatcca

SEQ ID NO: 103346 - DNA, 20 bp, Artificial Sequence
  chemically synthesized
tattcagcttagaaaagatc

SEQ ID NO: 103347 - DNA, 20 bp, Artificial Sequence
  chemically synthesized
tgtacctctggatcttttct

SEQ ID NO: 103348 - DNA, 20 bp, Artificial Sequence
  chemically synthesized
catatttattcagcttagaa

SEQ ID NO: 103349 - DNA, 20 bp, Artificial Sequence
  chemically synthesized
atgaacatatttattcagct

SEQ ID NO: 103350 - DNA, 20 bp, Artificial Sequence
  chemically synthesized
cttgtatgaacatatttatt

SEQ ID NO: 103351 - DNA, 20 bp, Artificial Sequence
  chemically synthesized
ctgaataaatatgttcatac

SEQ ID NO: 103352 - DNA, 20 bp, Artificial Sequence
  chemically synthesized
tgaataaatatgttcataca

SEQ ID NO: 103353 - DNA, 20 bp, Artificial Sequence
  chemically synthesized
gttcatacaaggttgtactc

SEQ ID NO: 103354 - DNA, 20 bp, Artificial Sequence
  chemically synthesized
gataaacagaatgttaacca

SEQ ID NO: 103355 - DNA, 20 bp, Artificial Sequence
  chemically synthesized
ttgataaacagaatgttaac

SEQ ID NO: 103356 - DNA, 20 bp, Artificial Sequence
  chemically synthesized
ttatcatgtcttttgataaa

SEQ ID NO: 103357 - DNA, 20 bp, Artificial Sequence
  chemically synthesized
gttaacattctgtttatcaa

SEQ ID NO: 103358 - DNA, 20 bp, Artificial Sequence
  chemically synthesized
taatcatgtatatgaaacat

SEQ ID NO: 103359 - DNA, 20 bp, Artificial Sequence
  chemically synthesized
aaacatgagaaaatttgaat

SEQ ID NO: 103360 - DNA, 20 bp, Artificial Sequence
  chemically synthesized
atttgaatcagttaaactga

SEQ ID NO: 103361 - DNA, 20 bp, Artificial Sequence
  chemically synthesized
gtttttctaagtagatcttt

SEQ ID NO: 103362 - DNA, 20 bp, Artificial Sequence
  chemically synthesized
gttaaactgaaagatctact

SEQ ID NO: 103363 - DNA, 20 bp, Artificial Sequence
  chemically synthesized
gaagtagatgtttttctaag

SEQ ID NO: 103364 - DNA, 20 bp, Artificial Sequence
  chemically synthesized
gaagaagtagatgtttttct

SEQ ID NO: 103365 - DNA, 20 bp, Artificial Sequence
  chemically synthesized
aatgtgactcggagaagaag

SEQ ID NO: 103366 - DNA, 20 bp, Artificial Sequence
  chemically synthesized
aaaacatctacttcttctcc

SEQ ID NO: 103367 - DNA, 20 bp, Artificial Sequence
  chemically synthesized
aagaatgtgactcggagaag

SEQ ID NO: 103368 - DNA, 20 bp, Artificial Sequence
  chemically synthesized
cacaagaatgtgactcggag

SEQ ID NO: 103369 - DNA, 20 bp, Artificial Sequence
  chemically synthesized
attcacaagaatgtgactcg

SEQ ID NO: 103370 - DNA, 20 bp, Artificial Sequence
  chemically synthesized
gaattcacaagaatgtgact

SEQ ID NO: 103371 - DNA, 20 bp, Artificial Sequence
  chemically synthesized
tttaaaaagccagaattcac

SEQ ID NO: 103372 - DNA, 20 bp, Artificial Sequence
  chemically synthesized
agtcacattcttgtgaattc

SEQ ID NO: 103373 - DNA, 20 bp, Artificial Sequence
  chemically synthesized
caaaaataattttaaaaagc

SEQ ID NO: 103374 - DNA, 20 bp, Artificial Sequence
  chemically synthesized
atttcaaaaataattttaaa

SEQ ID NO: 103375 - DNA, 20 bp, Artificial Sequence
  chemically synthesized
taaaattatttttgaaattt

SEQ ID NO: 103376 - DNA, 20 bp, Artificial Sequence
  chemically synthesized
attatttttgaaattttagt

SEQ ID NO: 103377 - DNA, 20 bp, Artificial Sequence
  chemically synthesized
tttagtaagattacataaaa

SEQ ID NO: 103378 - DNA, 20 bp, Artificial Sequence
  chemically synthesized
atgatcctttatagtttaca

SEQ ID NO: 103379 - DNA, 20 bp, Artificial Sequence
  chemically synthesized
acagcgccatgtaaactata

SEQ ID NO: 103380 - DNA, 20 bp, Artificial Sequence
  chemically synthesized
cagcgccatgtaaactataa

SEQ ID NO: 103381 - DNA, 20 bp, Artificial Sequence
  chemically synthesized
catttgtatatgatccttta

SEQ ID NO: 103382 - DNA, 20 bp, Artificial Sequence
  chemically synthesized
taaaggatcatatacaaatg

SEQ ID NO: 103383 - DNA, 20 bp, Artificial Sequence
  chemically synthesized
caaatgaagcacattactat

SEQ ID NO: 103384 - DNA, 20 bp, Artificial Sequence
  chemically synthesized
tggtgcattataattactaa

SEQ ID NO: 103385 - DNA, 20 bp, Artificial Sequence
  chemically synthesized
tagtaattataatgcaccac

SEQ ID NO: 103386 - DNA, 20 bp, Artificial Sequence
  chemically synthesized
cttctatctcttatttctgg

SEQ ID NO: 103387 - DNA, 20 bp, Artificial Sequence
  chemically synthesized
tataatgcaccaccagaaat

SEQ ID NO: 103388 - DNA, 20 bp, Artificial Sequence
  chemically synthesized
taatgcaccaccagaaataa

SEQ ID NO: 103389 - DNA, 20 bp, Artificial Sequence
  chemically synthesized
ggccttctatctcttatttc

SEQ ID NO: 103390 - DNA, 20 bp, Artificial Sequence
  chemically synthesized
gcaccaccagaaataagaga

SEQ ID NO: 103391 - DNA, 20 bp, Artificial Sequence
  chemically synthesized
ccaccagaaataagagatag

SEQ ID NO: 103392 - DNA, 20 bp, Artificial Sequence
  chemically synthesized
caccagaaataagagataga

SEQ ID NO: 103393 - DNA, 20 bp, Artificial Sequence
  chemically synthesized
catagtcaaaataggttaaa

SEQ ID NO: 103394 - DNA, 20 bp, Artificial Sequence
  chemically synthesized
tcatagtcaaaataggttaa

SEQ ID NO: 103395 - DNA, 20 bp, Artificial Sequence
  chemically synthesized
ctcatagtcaaaataggtta

SEQ ID NO: 103396 - DNA, 20 bp, Artificial Sequence
  chemically synthesized
tcctgtctcatagtcaaaat

SEQ ID NO: 103397 - DNA, 20 bp, Artificial Sequence
  chemically synthesized
ctcctgtctcatagtcaaaa

SEQ ID NO: 103398 - DNA, 20 bp, Artificial Sequence
  chemically synthesized
ctttaacctattttgactat

SEQ ID NO: 103399 - DNA, 20 bp, Artificial Sequence
  chemically synthesized
aacctattttgactatgaga

SEQ ID NO: 103400 - DNA, 20 bp, Artificial Sequence
  chemically synthesized
acctattttgactatgagac

SEQ ID NO: 103401 - DNA, 20 bp, Artificial Sequence
  chemically synthesized
ggttctatcctcctgtctca

SEQ ID NO: 103402 - DNA, 20 bp, Artificial Sequence
  chemically synthesized
ctattttgactatgagacag

SEQ ID NO: 103403 - DNA, 20 bp, Artificial Sequence
  chemically synthesized
tattttgactatgagacagg

SEQ ID NO: 103404 - DNA, 20 bp, Artificial Sequence
  chemically synthesized
ttgactatgagacaggagga

SEQ ID NO: 103405 - DNA, 20 bp, Artificial Sequence
  chemically synthesized
accctggctgttgggggaat

SEQ ID NO: 103406 - DNA, 20 bp, Artificial Sequence
  chemically synthesized
gatagaaccaattcccccaa

SEQ ID NO: 103407 - DNA, 20 bp, Artificial Sequence
  chemically synthesized
tactgaaccctggctgttgg

SEQ ID NO: 103408 - DNA, 20 bp, Artificial Sequence
  chemically synthesized
gaaccaattcccccaacagc

SEQ ID NO: 103409 - DNA, 20 bp, Artificial Sequence
  chemically synthesized
atactgaaccctggctgttg

SEQ ID NO: 103410 - DNA, 20 bp, Artificial Sequence
  chemically synthesized
aaccaattcccccaacagcc

SEQ ID NO: 103411 - DNA, 20 bp, Artificial Sequence
  chemically synthesized
aatactgaaccctggctgtt

SEQ ID NO: 103412 - DNA, 20 bp, Artificial Sequence
  chemically synthesized
accaattcccccaacagcca

SEQ ID NO: 103413 - DNA, 20 bp, Artificial Sequence
  chemically synthesized
taatactgaaccctggctgt

SEQ ID NO: 103414 - DNA, 20 bp, Artificial Sequence
  chemically synthesized
ttcccccaacagccagggtt

SEQ ID NO: 103415 - DNA, 20 bp, Artificial Sequence
  chemically synthesized
ttattaataatactgaaccc

SEQ ID NO: 103416 - DNA, 20 bp, Artificial Sequence
  chemically synthesized
aaggcttggtatgttgttag

SEQ ID NO: 103417 - DNA, 20 bp, Artificial Sequence
  chemically synthesized
gtgaaggcttggtatgttgt

SEQ ID NO: 103418 - DNA, 20 bp, Artificial Sequence
  chemically synthesized
gaatctactaacaacatacc

SEQ ID NO: 103419 - DNA, 20 bp, Artificial Sequence
  chemically synthesized
ccctgcatattgtgaaggct

SEQ ID NO: 103420 - DNA, 20 bp, Artificial Sequence
  chemically synthesized
cggtgccctgcatattgtga

SEQ ID NO: 103421 - DNA, 20 bp, Artificial Sequence
  chemically synthesized
acggtgccctgcatattgtg

SEQ ID NO: 103422 - DNA, 20 bp, Artificial Sequence
  chemically synthesized
taccaagccttcacaatatg

SEQ ID NO: 103423 - DNA, 20 bp, Artificial Sequence
  chemically synthesized
accaagccttcacaatatgc

SEQ ID NO: 103424 - DNA, 20 bp, Artificial Sequence
  chemically synthesized
ccaagccttcacaatatgca

SEQ ID NO: 103425 - DNA, 20 bp, Artificial Sequence
  chemically synthesized
aatatgcagggcaccgtact

SEQ ID NO: 103426 - DNA, 20 bp, Artificial Sequence
  chemically synthesized
cttatataaagcacttagta

SEQ ID NO: 103427 - DNA, 20 bp, Artificial Sequence
  chemically synthesized
gaaaacttatataaagcact

SEQ ID NO: 103428 - DNA, 20 bp, Artificial Sequence
  chemically synthesized
ccgtactaagtgctttatat

SEQ ID NO: 103429 - DNA, 20 bp, Artificial Sequence
  chemically synthesized
taaatgagaaaacttatata

SEQ ID NO: 103430 - DNA, 20 bp, Artificial Sequence
  chemically synthesized
taatattgtgaagattaaat

SEQ ID NO: 103431 - DNA, 20 bp, Artificial Sequence
  chemically synthesized
gagtagagattaatattgtg

SEQ ID NO: 103432 - DNA, 20 bp, Artificial Sequence
  chemically synthesized
taaatagaggaataggagta

SEQ ID NO: 103433 - DNA, 20 bp, Artificial Sequence
  chemically synthesized
tctaaatagaggaataggag

SEQ ID NO: 103434 - DNA, 20 bp, Artificial Sequence
  chemically synthesized
gtttctaaatagaggaatag

SEQ ID NO: 103435 - DNA, 20 bp, Artificial Sequence
  chemically synthesized
tggtttctaaatagaggaat

SEQ ID NO: 103436 - DNA, 20 bp, Artificial Sequence
  chemically synthesized
ctggtttctaaatagaggaa

SEQ ID NO: 103437 - DNA, 20 bp, Artificial Sequence
  chemically synthesized
tctactcctattcctctatt

SEQ ID NO: 103438 - DNA, 20 bp, Artificial Sequence
  chemically synthesized
caggtctggtttctaaatag

SEQ ID NO: 103439 - DNA, 20 bp, Artificial Sequence
  chemically synthesized
ccaggtctggtttctaaata

SEQ ID NO: 103440 - DNA, 20 bp, Artificial Sequence
  chemically synthesized
ctccaggtctggtttctaaa

SEQ ID NO: 103441 - DNA, 20 bp, Artificial Sequence
  chemically synthesized
ctattcctctatttagaaac

SEQ ID NO: 103442 - DNA, 20 bp, Artificial Sequence
  chemically synthesized
ctctatttagaaaccagacc

SEQ ID NO: 103443 - DNA, 20 bp, Artificial Sequence
  chemically synthesized
ctatttagaaaccagacctg

SEQ ID NO: 103444 - DNA, 20 bp, Artificial Sequence
  chemically synthesized
tttctcaatcactccaggtc

SEQ ID NO: 103445 - DNA, 20 bp, Artificial Sequence
  chemically synthesized
tcaagtttctcaatcactcc

SEQ ID NO: 103446 - DNA, 20 bp, Artificial Sequence
  chemically synthesized
ttcaagtttctcaatcactc

SEQ ID NO: 103447 - DNA, 20 bp, Artificial Sequence
  chemically synthesized
aaaccagacctggagtgatt

SEQ ID NO: 103448 - DNA, 20 bp, Artificial Sequence
  chemically synthesized
tggagtgattgagaaacttg

SEQ ID NO: 103449 - DNA, 20 bp, Artificial Sequence
  chemically synthesized
ggagtgattgagaaacttga

SEQ ID NO: 103450 - DNA, 20 bp, Artificial Sequence
  chemically synthesized
aaactgtgtgattttccttc

SEQ ID NO: 103451 - DNA, 20 bp, Artificial Sequence
  chemically synthesized
aaacttgaaggaaaatcaca

SEQ ID NO: 103452 - DNA, 20 bp, Artificial Sequence
  chemically synthesized
aggaaaatcacacagtttga

SEQ ID NO: 103453 - DNA, 20 bp, Artificial Sequence
  chemically synthesized
cacacagtttgaaagtgaca

SEQ ID NO: 103454 - DNA, 20 bp, Artificial Sequence
  chemically synthesized
cagtttgaaagtgacatagc

SEQ ID NO: 103455 - DNA, 20 bp, Artificial Sequence
  chemically synthesized
aaagtgacatagctagtgtt

SEQ ID NO: 103456 - DNA, 20 bp, Artificial Sequence
  chemically synthesized
tagactctgtttctgaacac

SEQ ID NO: 103457 - DNA, 20 bp, Artificial Sequence
  chemically synthesized
acatagctagtgttcagaaa

SEQ ID NO: 103458 - DNA, 20 bp, Artificial Sequence
  chemically synthesized
atagctagtgttcagaaaca

SEQ ID NO: 103459 - DNA, 20 bp, Artificial Sequence
  chemically synthesized
ggaggatagtaatgaaagtg

SEQ ID NO: 103460 - DNA, 20 bp, Artificial Sequence
  chemically synthesized
gcagtggaggatagtaatga

SEQ ID NO: 103461 - DNA, 20 bp, Artificial Sequence
  chemically synthesized
aattatcctgcagtggagga

SEQ ID NO: 103462 - DNA, 20 bp, Artificial Sequence
  chemically synthesized
ttcattactatcctccactg

SEQ ID NO: 103463 - DNA, 20 bp, Artificial Sequence
  chemically synthesized
tcattactatcctccactgc

SEQ ID NO: 103464 - DNA, 20 bp, Artificial Sequence
  chemically synthesized
ctggaattatcctgcagtgg

SEQ ID NO: 103465 - DNA, 20 bp, Artificial Sequence
  chemically synthesized
actggaattatcctgcagtg

SEQ ID NO: 103466 - DNA, 20 bp, Artificial Sequence
  chemically synthesized
gcactggaattatcctgcag

SEQ ID NO: 103467 - DNA, 20 bp, Artificial Sequence
  chemically synthesized
tttgcactggaattatcctg

SEQ ID NO: 103468 - DNA, 20 bp, Artificial Sequence
  chemically synthesized
cctccactgcaggataattc

SEQ ID NO: 103469 - DNA, 20 bp, Artificial Sequence
  chemically synthesized
tgcaggataattccagtgca

SEQ ID NO: 103470 - DNA, 20 bp, Artificial Sequence
  chemically synthesized
gcaggataattccagtgcaa

SEQ ID NO: 103471 - DNA, 20 bp, Artificial Sequence
  chemically synthesized
aaacagatcatcctttgcac

SEQ ID NO: 103472 - DNA, 20 bp, Artificial Sequence
  chemically synthesized
aaaacaaaaaaaaaaacaaa

SEQ ID NO: 103473 - DNA, 20 bp, Artificial Sequence
  chemically synthesized
ttttgttttttttttttttt

SEQ ID NO: 103474 - DNA, 20 bp, Artificial Sequence
  chemically synthesized
tttgtttttttttttttttg

SEQ ID NO: 103475 - DNA, 20 bp, Artificial Sequence
  chemically synthesized
gtttttttttttttttgagg

SEQ ID NO: 103476 - DNA, 20 bp, Artificial Sequence
  chemically synthesized
ttttttttttttttgaggca

SEQ ID NO: 103477 - DNA, 20 bp, Artificial Sequence
  chemically synthesized
tttttttttgaggcagagtc

SEQ ID NO: 103478 - DNA, 20 bp, Artificial Sequence
  chemically synthesized
tccagcccgggcaacagagc

SEQ ID NO: 103479 - DNA, 20 bp, Artificial Sequence
  chemically synthesized
cagagtctggctctgttgcc

SEQ ID NO: 103480 - DNA, 20 bp, Artificial Sequence
  chemically synthesized
gcactccagcccgggcaaca

SEQ ID NO: 103481 - DNA, 20 bp, Artificial Sequence
  chemically synthesized
agagtctggctctgttgccc

SEQ ID NO: 103482 - DNA, 20 bp, Artificial Sequence
  chemically synthesized
ctgcactccagcccgggcaa

SEQ ID NO: 103483 - DNA, 20 bp, Artificial Sequence
  chemically synthesized
tctggctctgttgcccgggc

SEQ ID NO: 103484 - DNA, 20 bp, Artificial Sequence
  chemically synthesized
tggctctgttgcccgggctg

SEQ ID NO: 103485 - DNA, 20 bp, Artificial Sequence
  chemically synthesized
gagtcactgcactccagccc

SEQ ID NO: 103486 - DNA, 20 bp, Artificial Sequence
  chemically synthesized
cgagtcactgcactccagcc

SEQ ID NO: 103487 - DNA, 20 bp, Artificial Sequence
  chemically synthesized
ctgttgcccgggctggagtg

SEQ ID NO: 103488 - DNA, 20 bp, Artificial Sequence
  chemically synthesized
gagatcgagtcactgcactc

SEQ ID NO: 103489 - DNA, 20 bp, Artificial Sequence
  chemically synthesized
ggagtgcagtgactcgatct

SEQ ID NO: 103490 - DNA, 20 bp, Artificial Sequence
  chemically synthesized
gcttgcggtgagccgagatc

SEQ ID NO: 103491 - DNA, 20 bp, Artificial Sequence
  chemically synthesized
ggtggagcttgcggtgagcc

SEQ ID NO: 103492 - DNA, 20 bp, Artificial Sequence
  chemically synthesized
actcgatctcggctcaccgc

SEQ ID NO: 103493 - DNA, 20 bp, Artificial Sequence
  chemically synthesized
cgggaggtggagcttgcggt

SEQ ID NO: 103494 - DNA, 20 bp, Artificial Sequence
  chemically synthesized
aatccgggaggtggagcttg

SEQ ID NO: 103495 - DNA, 20 bp, Artificial Sequence
  chemically synthesized
tcaccgcaagctccacctcc

SEQ ID NO: 103496 - DNA, 20 bp, Artificial Sequence
  chemically synthesized
tggcatgaatccgggaggtg

SEQ ID NO: 103497 - DNA, 20 bp, Artificial Sequence
  chemically synthesized
gatggcatgaatccgggagg

SEQ ID NO: 103498 - DNA, 20 bp, Artificial Sequence
  chemically synthesized
gaggatggcatgaatccggg

SEQ ID NO: 103499 - DNA, 20 bp, Artificial Sequence
  chemically synthesized
ggaggatggcatgaatccgg

SEQ ID NO: 103500 - DNA, 20 bp, Artificial Sequence
  chemically synthesized
caggaggatggcatgaatcc

SEQ ID NO: 103501 - DNA, 20 bp, Artificial Sequence
  chemically synthesized
gcaggaggatggcatgaatc

SEQ ID NO: 103502 - DNA, 20 bp, Artificial Sequence
  chemically synthesized
aggaggctgaggcaggagga

SEQ ID NO: 103503 - DNA, 20 bp, Artificial Sequence
  chemically synthesized
ttcatgccatcctcctgcct

SEQ ID NO: 103504 - DNA, 20 bp, Artificial Sequence
  chemically synthesized
actcaggaggctgaggcagg

SEQ ID NO: 103505 - DNA, 20 bp, Artificial Sequence
  chemically synthesized
tactcaggaggctgaggcag

SEQ ID NO: 103506 - DNA, 20 bp, Artificial Sequence
  chemically synthesized
gctactcaggaggctgaggc

SEQ ID NO: 103507 - DNA, 20 bp, Artificial Sequence
  chemically synthesized
agctactcaggaggctgagg

SEQ ID NO: 103508 - DNA, 20 bp, Artificial Sequence
  chemically synthesized
cccagctactcaggaggctg

SEQ ID NO: 103509 - DNA, 20 bp, Artificial Sequence
  chemically synthesized
tcccagctactcaggaggct

SEQ ID NO: 103510 - DNA, 20 bp, Artificial Sequence
  chemically synthesized
tcctcctgcctcagcctcct

SEQ ID NO: 103511 - DNA, 20 bp, Artificial Sequence
  chemically synthesized
tcctgcctcagcctcctgag

SEQ ID NO: 103512 - DNA, 20 bp, Artificial Sequence
  chemically synthesized
tgtggtcccagctactcagg

SEQ ID NO: 103513 - DNA, 20 bp, Artificial Sequence
  chemically synthesized
ctgtggtcccagctactcag

SEQ ID NO: 103514 - DNA, 20 bp, Artificial Sequence
  chemically synthesized
gcctcagcctcctgagtagc

SEQ ID NO: 103515 - DNA, 20 bp, Artificial Sequence
  chemically synthesized
gcctgtggtcccagctactc

SEQ ID NO: 103516 - DNA, 20 bp, Artificial Sequence
  chemically synthesized
cctcagcctcctgagtagct

SEQ ID NO: 103517 - DNA, 20 bp, Artificial Sequence
  chemically synthesized
cgcctgtggtcccagctact

SEQ ID NO: 103518 - DNA, 20 bp, Artificial Sequence
  chemically synthesized
ctcctgagtagctgggacca

SEQ ID NO: 103519 - DNA, 20 bp, Artificial Sequence
  chemically synthesized
tcctgagtagctgggaccac

SEQ ID NO: 103520 - DNA, 20 bp, Artificial Sequence
  chemically synthesized
gtggtgggcgcctgtggtcc

SEQ ID NO: 103521 - DNA, 20 bp, Artificial Sequence
  chemically synthesized
ggtgttgtggtgggcgcctg

SEQ ID NO: 103522 - DNA, 20 bp, Artificial Sequence
  chemically synthesized
aatcagccgggtgttgtggt

SEQ ID NO: 103523 - DNA, 20 bp, Artificial Sequence
  chemically synthesized
aaatcagccgggtgttgtgg

SEQ ID NO: 103524 - DNA, 20 bp, Artificial Sequence
  chemically synthesized
caggcgcccaccacaacacc

SEQ ID NO: 103525 - DNA, 20 bp, Artificial Sequence
  chemically synthesized
aaaaaatcagccgggtgttg

SEQ ID NO: 103526 - DNA, 20 bp, Artificial Sequence
  chemically synthesized
gaaaatacaaaaaatcagcc

SEQ ID NO: 103527 - DNA, 20 bp, Artificial Sequence
  chemically synthesized
tgaaaatacaaaaaatcagc

SEQ ID NO: 103528 - DNA, 20 bp, Artificial Sequence
  chemically synthesized
ctactgaaaatacaaaaaat

SEQ ID NO: 103529 - DNA, 20 bp, Artificial Sequence
  chemically synthesized
cggctgattttttgtatttt

SEQ ID NO: 103530 - DNA, 20 bp, Artificial Sequence
  chemically synthesized
ctgattttttgtattttcag

SEQ ID NO: 103531 - DNA, 20 bp, Artificial Sequence
  chemically synthesized
gattttttgtattttcagta

SEQ ID NO: 103532 - DNA, 20 bp, Artificial Sequence
  chemically synthesized
ttttgtattttcagtagaga

SEQ ID NO: 103533 - DNA, 20 bp, Artificial Sequence
  chemically synthesized
tttgtattttcagtagagat

SEQ ID NO: 103534 - DNA, 20 bp, Artificial Sequence
  chemically synthesized
ttgtattttcagtagagatg

SEQ ID NO: 103535 - DNA, 20 bp, Artificial Sequence
  chemically synthesized
gagatggggtttcaccatgt

SEQ ID NO: 103536 - DNA, 20 bp, Artificial Sequence
  chemically synthesized
tggggtttcaccatgttagc

SEQ ID NO: 103537 - DNA, 20 bp, Artificial Sequence
  chemically synthesized
cgagaccatcctggctaaca

SEQ ID NO: 103538 - DNA, 20 bp, Artificial Sequence
  chemically synthesized
ggggtttcaccatgttagcc

SEQ ID NO: 103539 - DNA, 20 bp, Artificial Sequence
  chemically synthesized
tttcaccatgttagccagga

SEQ ID NO: 103540 - DNA, 20 bp, Artificial Sequence
  chemically synthesized
tcaggagatcgagaccatcc

SEQ ID NO: 103541 - DNA, 20 bp, Artificial Sequence
  chemically synthesized
gatcacgaggtcaggagatc

SEQ ID NO: 103542 - DNA, 20 bp, Artificial Sequence
  chemically synthesized
caggcggatcacgaggtcag

SEQ ID NO: 103543 - DNA, 20 bp, Artificial Sequence
  chemically synthesized
ggcaggcggatcacgaggtc

SEQ ID NO: 103544 - DNA, 20 bp, Artificial Sequence
  chemically synthesized
aggcaggcggatcacgaggt

SEQ ID NO: 103545 - DNA, 20 bp, Artificial Sequence
  chemically synthesized
gccgaggcaggcggatcacg

SEQ ID NO: 103546 - DNA, 20 bp, Artificial Sequence
  chemically synthesized
ggccgaggcaggcggatcac

SEQ ID NO: 103547 - DNA, 20 bp, Artificial Sequence
  chemically synthesized
acctcgtgatccgcctgcct

SEQ ID NO: 103548 - DNA, 20 bp, Artificial Sequence
  chemically synthesized
ctttgggaggccgaggcagg

SEQ ID NO: 103549 - DNA, 20 bp, Artificial Sequence
  chemically synthesized
gcactttgggaggccgaggc

SEQ ID NO: 103550 - DNA, 20 bp, Artificial Sequence
  chemically synthesized
agcactttgggaggccgagg

SEQ ID NO: 103551 - DNA, 20 bp, Artificial Sequence
  chemically synthesized
cccagcactttgggaggccg

SEQ ID NO: 103552 - DNA, 20 bp, Artificial Sequence
  chemically synthesized
tcccagcactttgggaggcc

SEQ ID NO: 103553 - DNA, 20 bp, Artificial Sequence
  chemically synthesized
ccgcctgcctcggcctccca

SEQ ID NO: 103554 - DNA, 20 bp, Artificial Sequence
  chemically synthesized
tgtaatcccagcactttggg

SEQ ID NO: 103555 - DNA, 20 bp, Artificial Sequence
  chemically synthesized
ctgtaatcccagcactttgg

SEQ ID NO: 103556 - DNA, 20 bp, Artificial Sequence
  chemically synthesized
gcctcggcctcccaaagtgc

SEQ ID NO: 103557 - DNA, 20 bp, Artificial Sequence
  chemically synthesized
acctgtaatcccagcacttt

SEQ ID NO: 103558 - DNA, 20 bp, Artificial Sequence
  chemically synthesized
cctcggcctcccaaagtgct

SEQ ID NO: 103559 - DNA, 20 bp, Artificial Sequence
  chemically synthesized
cacctgtaatcccagcactt

SEQ ID NO: 103560 - DNA, 20 bp, Artificial Sequence
  chemically synthesized
ctcccaaagtgctgggatta

SEQ ID NO: 103561 - DNA, 20 bp, Artificial Sequence
  chemically synthesized
tcccaaagtgctgggattac

SEQ ID NO: 103562 - DNA, 20 bp, Artificial Sequence
  chemically synthesized
gtggctcacacctgtaatcc

SEQ ID NO: 103563 - DNA, 20 bp, Artificial Sequence
  chemically synthesized
agtgctgggattacaggtgt

SEQ ID NO: 103564 - DNA, 20 bp, Artificial Sequence
  chemically synthesized
caggtgtgagccactgtgcc

SEQ ID NO: 103565 - DNA, 20 bp, Artificial Sequence
  chemically synthesized
tcctttgcagccgggcacag

SEQ ID NO: 103566 - DNA, 20 bp, Artificial Sequence
  chemically synthesized
taatcctttgcagccgggca

SEQ ID NO: 103567 - DNA, 20 bp, Artificial Sequence
  chemically synthesized
agccactgtgcccggctgca

SEQ ID NO: 103568 - DNA, 20 bp, Artificial Sequence
  chemically synthesized
aaagataatcctttgcagcc

SEQ ID NO: 103569 - DNA, 20 bp, Artificial Sequence
  chemically synthesized
gccactgtgcccggctgcaa

SEQ ID NO: 103570 - DNA, 20 bp, Artificial Sequence
  chemically synthesized
taaagataatcctttgcagc

SEQ ID NO: 103571 - DNA, 20 bp, Artificial Sequence
  chemically synthesized
aacttaaagataatcctttg

SEQ ID NO: 103572 - DNA, 20 bp, Artificial Sequence
  chemically synthesized
ggctgcaaaggattatcttt

SEQ ID NO: 103573 - DNA, 20 bp, Artificial Sequence
  chemically synthesized
ttatttctatgtttaactta

SEQ ID NO: 103574 - DNA, 20 bp, Artificial Sequence
  chemically synthesized
gattatctttaagttaaaca

SEQ ID NO: 103575 - DNA, 20 bp, Artificial Sequence
  chemically synthesized
tttaagttaaacatagaaat

SEQ ID NO: 103576 - DNA, 20 bp, Artificial Sequence
  chemically synthesized
ttaagttaaacatagaaata

SEQ ID NO: 103577 - DNA, 20 bp, Artificial Sequence
  chemically synthesized
atagaaataaggatgtaaaa

SEQ ID NO: 103578 - DNA, 20 bp, Artificial Sequence
  chemically synthesized
taaggatgtaaaatggaatt

SEQ ID NO: 103579 - DNA, 20 bp, Artificial Sequence
  chemically synthesized
aaatggaatttagaattctg

SEQ ID NO: 103580 - DNA, 20 bp, Artificial Sequence
  chemically synthesized
gtttccttgttgatagactt

SEQ ID NO: 103581 - DNA, 20 bp, Artificial Sequence
  chemically synthesized
gaattctgaagtctatcaac

SEQ ID NO: 103582 - DNA, 20 bp, Artificial Sequence
  chemically synthesized
aattctgaagtctatcaaca

SEQ ID NO: 103583 - DNA, 20 bp, Artificial Sequence
  chemically synthesized
agcactagtttccttgttga

SEQ ID NO: 103584 - DNA, 20 bp, Artificial Sequence
  chemically synthesized
aagtctatcaacaaggaaac

SEQ ID NO: 103585 - DNA, 20 bp, Artificial Sequence
  chemically synthesized
tacctagcttttcatagcac

SEQ ID NO: 103586 - DNA, 20 bp, Artificial Sequence
  chemically synthesized
aaggaaactagtgctatgaa

SEQ ID NO: 103587 - DNA, 20 bp, Artificial Sequence
  chemically synthesized
acaaattacctagcttttca

SEQ ID NO: 103588 - DNA, 20 bp, Artificial Sequence
  chemically synthesized
aaactagtgctatgaaaagc

SEQ ID NO: 103589 - DNA, 20 bp, Artificial Sequence
  chemically synthesized
aactagtgctatgaaaagct

SEQ ID NO: 103590 - DNA, 20 bp, Artificial Sequence
  chemically synthesized
gtatttgtggacaaattacc

SEQ ID NO: 103591 - DNA, 20 bp, Artificial Sequence
  chemically synthesized
caggtagcactgggtatttg

SEQ ID NO: 103592 - DNA, 20 bp, Artificial Sequence
  chemically synthesized
gtaatttgtccacaaatacc

SEQ ID NO: 103593 - DNA, 20 bp, Artificial Sequence
  chemically synthesized
ctctgtccgcaggtagcact

SEQ ID NO: 103594 - DNA, 20 bp, Artificial Sequence
  chemically synthesized
gctctgtccgcaggtagcac

SEQ ID NO: 103595 - DNA, 20 bp, Artificial Sequence
  chemically synthesized
caaatacccagtgctacctg

SEQ ID NO: 103596 - DNA, 20 bp, Artificial Sequence
  chemically synthesized
tttctagctctgtccgcagg

SEQ ID NO: 103597 - DNA, 20 bp, Artificial Sequence
  chemically synthesized
tacccagtgctacctgcgga

SEQ ID NO: 103598 - DNA, 20 bp, Artificial Sequence
  chemically synthesized
cccagtgctacctgcggaca

SEQ ID NO: 103599 - DNA, 20 bp, Artificial Sequence
  chemically synthesized
acttttctagctctgtccgc

SEQ ID NO: 103600 - DNA, 20 bp, Artificial Sequence
  chemically synthesized
cacttttctagctctgtccg

SEQ ID NO: 103601 - DNA, 20 bp, Artificial Sequence
  chemically synthesized
gtgctacctgcggacagagc

SEQ ID NO: 103602 - DNA, 20 bp, Artificial Sequence
  chemically synthesized
acctgcggacagagctagaa

SEQ ID NO: 103603 - DNA, 20 bp, Artificial Sequence
  chemically synthesized
tgaccatatgggcacttttc

SEQ ID NO: 103604 - DNA, 20 bp, Artificial Sequence
  chemically synthesized
gagctagaaaagtgcccata

SEQ ID NO: 103605 - DNA, 20 bp, Artificial Sequence
  chemically synthesized
ggtgaagtaaatgaccatat

SEQ ID NO: 103606 - DNA, 20 bp, Artificial Sequence
  chemically synthesized
tggtgaagtaaatgaccata

SEQ ID NO: 103607 - DNA, 20 bp, Artificial Sequence
  chemically synthesized
tgcatttcactttggtggtg

SEQ ID NO: 103608 - DNA, 20 bp, Artificial Sequence
  chemically synthesized
ggtcatttacttcaccacca

SEQ ID NO: 103609 - DNA, 20 bp, Artificial Sequence
  chemically synthesized
tttggtgcatttcactttgg

SEQ ID NO: 103610 - DNA, 20 bp, Artificial Sequence
  chemically synthesized
tggtttggtgcatttcactt

SEQ ID NO: 103611 - DNA, 20 bp, Artificial Sequence
  chemically synthesized
aaagtgaaatgcaccaaacc

SEQ ID NO: 103612 - DNA, 20 bp, Artificial Sequence
  chemically synthesized
aagtgaaatgcaccaaacca

SEQ ID NO: 103613 - DNA, 20 bp, Artificial Sequence
  chemically synthesized
agtgaaatgcaccaaaccaa

SEQ ID NO: 103614 - DNA, 20 bp, Artificial Sequence
  chemically synthesized
gtgaaatgcaccaaaccaag

SEQ ID NO: 103615 - DNA, 20 bp, Artificial Sequence
  chemically synthesized
gaagtcatttccccttggtt

SEQ ID NO: 103616 - DNA, 20 bp, Artificial Sequence
  chemically synthesized
ccagagaagtcatttcccct

SEQ ID NO: 103617 - DNA, 20 bp, Artificial Sequence
  chemically synthesized
ccaaggggaaatgacttctc

SEQ ID NO: 103618 - DNA, 20 bp, Artificial Sequence
  chemically synthesized
caaggggaaatgacttctct

SEQ ID NO: 103619 - DNA, 20 bp, Artificial Sequence
  chemically synthesized
aggggaaatgacttctctgg

SEQ ID NO: 103620 - DNA, 20 bp, Artificial Sequence
  chemically synthesized
gagttgttaaactcccagag

SEQ ID NO: 103621 - DNA, 20 bp, Artificial Sequence
  chemically synthesized
gtagagttgttaaactccca

SEQ ID NO: 103622 - DNA, 20 bp, Artificial Sequence
  chemically synthesized
aagtagagttgttaaactcc

SEQ ID NO: 103623 - DNA, 20 bp, Artificial Sequence
  chemically synthesized
aaatgagggaaaaaaaagta

SEQ ID NO: 103624 - DNA, 20 bp, Artificial Sequence
  chemically synthesized
ttaaatgagggaaaaaaaag

SEQ ID NO: 103625 - DNA, 20 bp, Artificial Sequence
  chemically synthesized
taattaaatgagggaaaaaa

SEQ ID NO: 103626 - DNA, 20 bp, Artificial Sequence
  chemically synthesized
accatgttataattaaatga

SEQ ID NO: 103627 - DNA, 20 bp, Artificial Sequence
  chemically synthesized
gaccatgttataattaaatg

SEQ ID NO: 103628 - DNA, 20 bp, Artificial Sequence
  chemically synthesized
agaccatgttataattaaat

SEQ ID NO: 103629 - DNA, 20 bp, Artificial Sequence
  chemically synthesized
tccctcatttaattataaca

SEQ ID NO: 103630 - DNA, 20 bp, Artificial Sequence
  chemically synthesized
aatagagggttgcaagttaa

SEQ ID NO: 103631 - DNA, 20 bp, Artificial Sequence
  chemically synthesized
gacatcaaatagagggttgc

SEQ ID NO: 103632 - DNA, 20 bp, Artificial Sequence
  chemically synthesized
aagaagagacatcaaataga

SEQ ID NO: 103633 - DNA, 20 bp, Artificial Sequence
  chemically synthesized
aaagaagagacatcaaatag

SEQ ID NO: 103634 - DNA, 20 bp, Artificial Sequence
  chemically synthesized
aaaagaagagacatcaaata

SEQ ID NO: 103635 - DNA, 20 bp, Artificial Sequence
  chemically synthesized
aaaaaagaagagacatcaaa

SEQ ID NO: 103636 - DNA, 20 bp, Artificial Sequence
  chemically synthesized
gctaaagactgaaaaaagaa

SEQ ID NO: 103637 - DNA, 20 bp, Artificial Sequence
  chemically synthesized
tttgatgtctcttctttttt

SEQ ID NO: 103638 - DNA, 20 bp, Artificial Sequence
  chemically synthesized
ttgctaaagactgaaaaaag

SEQ ID NO: 103639 - DNA, 20 bp, Artificial Sequence
  chemically synthesized
aatttgctaaagactgaaaa

SEQ ID NO: 103640 - DNA, 20 bp, Artificial Sequence
  chemically synthesized
tctcttcttttttcagtctt

SEQ ID NO: 103641 - DNA, 20 bp, Artificial Sequence
  chemically synthesized
atacgatgtggaatttgcta

SEQ ID NO: 103642 - DNA, 20 bp, Artificial Sequence
  chemically synthesized
tgatttggccaaatacgatg

SEQ ID NO: 103643 - DNA, 20 bp, Artificial Sequence
  chemically synthesized
agcaaattccacatcgtatt

SEQ ID NO: 103644 - DNA, 20 bp, Artificial Sequence
  chemically synthesized
cacatcgtatttggccaaat

SEQ ID NO: 103645 - DNA, 20 bp, Artificial Sequence
  chemically synthesized
tgttaattttatgtctgatt

SEQ ID NO: 103646 - DNA, 20 bp, Artificial Sequence
  chemically synthesized
attaacatcaattcattctc

SEQ ID NO: 103647 - DNA, 20 bp, Artificial Sequence
  chemically synthesized
taacatcaattcattctcaa

SEQ ID NO: 103648 - DNA, 20 bp, Artificial Sequence
  chemically synthesized
gtagttttattttgtctctt

SEQ ID NO: 103649 - DNA, 20 bp, Artificial Sequence
  chemically synthesized
taactacgattagaaaatcg

SEQ ID NO: 103650 - DNA, 20 bp, Artificial Sequence
  chemically synthesized
aaactacgattttctaatcg

SEQ ID NO: 103651 - DNA, 20 bp, Artificial Sequence
  chemically synthesized
aggagaaaagtaactacgat

SEQ ID NO: 103652 - DNA, 20 bp, Artificial Sequence
  chemically synthesized
tttgcaaaagattaggagaa

SEQ ID NO: 103653 - DNA, 20 bp, Artificial Sequence
  chemically synthesized
tgacatttgcaaaagattag

SEQ ID NO: 103654 - DNA, 20 bp, Artificial Sequence
  chemically synthesized
ggtgacatttgcaaaagatt

SEQ ID NO: 103655 - DNA, 20 bp, Artificial Sequence
  chemically synthesized
aggtgacatttgcaaaagat

SEQ ID NO: 103656 - DNA, 20 bp, Artificial Sequence
  chemically synthesized
agagaaggtgacatttgcaa

SEQ ID NO: 103657 - DNA, 20 bp, Artificial Sequence
  chemically synthesized
acatagcattttcatagaga

SEQ ID NO: 103658 - DNA, 20 bp, Artificial Sequence
  chemically synthesized
aacatagcattttcatagag

SEQ ID NO: 103659 - DNA, 20 bp, Artificial Sequence
  chemically synthesized
ttgaacatagcattttcata

SEQ ID NO: 103660 - DNA, 20 bp, Artificial Sequence
  chemically synthesized
atttgaacatagcattttca

SEQ ID NO: 103661 - DNA, 20 bp, Artificial Sequence
  chemically synthesized
ttacacaggtcatttgaaca

SEQ ID NO: 103662 - DNA, 20 bp, Artificial Sequence
  chemically synthesized
agagccatgaaatattacac

SEQ ID NO: 103663 - DNA, 20 bp, Artificial Sequence
  chemically synthesized
tagagccatgaaatattaca

SEQ ID NO: 103664 - DNA, 20 bp, Artificial Sequence
  chemically synthesized
atgacctgtgtaatatttca

SEQ ID NO: 103665 - DNA, 20 bp, Artificial Sequence
  chemically synthesized
tatattttgtgattgcatta

SEQ ID NO: 103666 - DNA, 20 bp, Artificial Sequence
  chemically synthesized
tatatattttgtgattgcat

SEQ ID NO: 103667 - DNA, 20 bp, Artificial Sequence
  chemically synthesized
gcaatcacaaaatatatatt

SEQ ID NO: 103668 - DNA, 20 bp, Artificial Sequence
  chemically synthesized
caaaatatatattcggtatc

SEQ ID NO: 103669 - DNA, 20 bp, Artificial Sequence
  chemically synthesized
tattcggtatcaagatatat

SEQ ID NO: 103670 - DNA, 20 bp, Artificial Sequence
  chemically synthesized
tatataagatacatgttaat

SEQ ID NO: 103671 - DNA, 20 bp, Artificial Sequence
  chemically synthesized
catgttaataagtccctcta

SEQ ID NO: 103672 - DNA, 20 bp, Artificial Sequence
  chemically synthesized
gtaaatttgacaactttaga

SEQ ID NO: 103673 - DNA, 20 bp, Artificial Sequence
  chemically synthesized
tgtaaatttgacaactttag

SEQ ID NO: 103674 - DNA, 20 bp, Artificial Sequence
  chemically synthesized
gtgtaaatttgacaacttta

SEQ ID NO: 103675 - DNA, 20 bp, Artificial Sequence
  chemically synthesized
tagtgtaaatttgacaactt

SEQ ID NO: 103676 - DNA, 20 bp, Artificial Sequence
  chemically synthesized
agttgtcaaatttacactat

SEQ ID NO: 103677 - DNA, 20 bp, Artificial Sequence
  chemically synthesized
tcaggaatctttcattctga

SEQ ID NO: 103678 - DNA, 20 bp, Artificial Sequence
  chemically synthesized
aatttacactatcagaatga

SEQ ID NO: 103679 - DNA, 20 bp, Artificial Sequence
  chemically synthesized
tatcagaatgaaagattcct

SEQ ID NO: 103680 - DNA, 20 bp, Artificial Sequence
  chemically synthesized
atcagaatgaaagattcctg

SEQ ID NO: 103681 - DNA, 20 bp, Artificial Sequence
  chemically synthesized
tcagaatgaaagattcctga

SEQ ID NO: 103682 - DNA, 20 bp, Artificial Sequence
  chemically synthesized
acaaaatttatttagccctc

SEQ ID NO: 103683 - DNA, 20 bp, Artificial Sequence
  chemically synthesized
gacaaaatttatttagccct

SEQ ID NO: 103684 - DNA, 20 bp, Artificial Sequence
  chemically synthesized
aggtagagacaaaatttatt

SEQ ID NO: 103685 - DNA, 20 bp, Artificial Sequence
  chemically synthesized
gtaaaagaggaggaaaggta

SEQ ID NO: 103686 - DNA, 20 bp, Artificial Sequence
  chemically synthesized
ttgtaaaagaggaggaaagg

SEQ ID NO: 103687 - DNA, 20 bp, Artificial Sequence
  chemically synthesized
gcattgtaaaagaggaggaa

SEQ ID NO: 103688 - DNA, 20 bp, Artificial Sequence
  chemically synthesized
ggcattgtaaaagaggagga

SEQ ID NO: 103689 - DNA, 20 bp, Artificial Sequence
  chemically synthesized
accaggcattgtaaaagagg

SEQ ID NO: 103690 - DNA, 20 bp, Artificial Sequence
  chemically synthesized
gaccaggcattgtaaaagag

SEQ ID NO: 103691 - DNA, 20 bp, Artificial Sequence
  chemically synthesized
aagaccaggcattgtaaaag

SEQ ID NO: 103692 - DNA, 20 bp, Artificial Sequence
  chemically synthesized
caagaccaggcattgtaaaa

SEQ ID NO: 103693 - DNA, 20 bp, Artificial Sequence
  chemically synthesized
aacaagaccaggcattgtaa

SEQ ID NO: 103694 - DNA, 20 bp, Artificial Sequence
  chemically synthesized
tcctcctcttttacaatgcc

SEQ ID NO: 103695 - DNA, 20 bp, Artificial Sequence
  chemically synthesized
cgtgtttatacaacaagacc

SEQ ID NO: 103696 - DNA, 20 bp, Artificial Sequence
  chemically synthesized
ccgtgtttatacaacaagac

SEQ ID NO: 103697 - DNA, 20 bp, Artificial Sequence
  chemically synthesized
aaacaccgtgtttatacaac

SEQ ID NO: 103698 - DNA, 20 bp, Artificial Sequence
  chemically synthesized
ctggtcttgttgtataaaca

SEQ ID NO: 103699 - DNA, 20 bp, Artificial Sequence
  chemically synthesized
gttgtataaacacggtgttt

SEQ ID NO: 103700 - DNA, 20 bp, Artificial Sequence
  chemically synthesized
tccacctcattatcatcaag

SEQ ID NO: 103701 - DNA, 20 bp, Artificial Sequence
  chemically synthesized
aaatccacctcattatcatc

SEQ ID NO: 103702 - DNA, 20 bp, Artificial Sequence
  chemically synthesized
agtatcttcttgatgataat

SEQ ID NO: 103703 - DNA, 20 bp, Artificial Sequence
  chemically synthesized
gtatcttcttgatgataatg

SEQ ID NO: 103704 - DNA, 20 bp, Artificial Sequence
  chemically synthesized
tcttcttgatgataatgagg

SEQ ID NO: 103705 - DNA, 20 bp, Artificial Sequence
  chemically synthesized
tgatgataatgaggtggatt

SEQ ID NO: 103706 - DNA, 20 bp, Artificial Sequence
  chemically synthesized
tgaggtggatttggccaatc

SEQ ID NO: 103707 - DNA, 20 bp, Artificial Sequence
  chemically synthesized
gactttttaaatagctagat

SEQ ID NO: 103708 - DNA, 20 bp, Artificial Sequence
  chemically synthesized
gagcagactttttaaatagc

SEQ ID NO: 103709 - DNA, 20 bp, Artificial Sequence
  chemically synthesized
ggccaatctagctatttaaa

SEQ ID NO: 103710 - DNA, 20 bp, Artificial Sequence
  chemically synthesized
aacagagcagactttttaaa

SEQ ID NO: 103711 - DNA, 20 bp, Artificial Sequence
  chemically synthesized
actaagttaaaagaacagag

SEQ ID NO: 103712 - DNA, 20 bp, Artificial Sequence
  chemically synthesized
aaaactaagttaaaagaaca

SEQ ID NO: 103713 - DNA, 20 bp, Artificial Sequence
  chemically synthesized
acaaaactaagttaaaagaa

SEQ ID NO: 103714 - DNA, 20 bp, Artificial Sequence
  chemically synthesized
tctgctctgttcttttaact

SEQ ID NO: 103715 - DNA, 20 bp, Artificial Sequence
  chemically synthesized
catctacaaaactaagttaa

SEQ ID NO: 103716 - DNA, 20 bp, Artificial Sequence
  chemically synthesized
gttcttttaacttagttttg

SEQ ID NO: 103717 - DNA, 20 bp, Artificial Sequence
  chemically synthesized
tgttatacatctacaaaact

SEQ ID NO: 103718 - DNA, 20 bp, Artificial Sequence
  chemically synthesized
ttgtagatgtataacaaaac

SEQ ID NO: 103719 - DNA, 20 bp, Artificial Sequence
  chemically synthesized
atgtataacaaaactagtta

SEQ ID NO: 103720 - DNA, 20 bp, Artificial Sequence
  chemically synthesized
tctcagagaatttccataac

SEQ ID NO: 103721 - DNA, 20 bp, Artificial Sequence
  chemically synthesized
actagttatggaaattctct

SEQ ID NO: 103722 - DNA, 20 bp, Artificial Sequence
  chemically synthesized
tatggaaattctctgagatt

SEQ ID NO: 103723 - DNA, 20 bp, Artificial Sequence
  chemically synthesized
aatgatttatctaaatctca

SEQ ID NO: 103724 - DNA, 20 bp, Artificial Sequence
  chemically synthesized
aaaatgatttatctaaatct

SEQ ID NO: 103725 - DNA, 20 bp, Artificial Sequence
  chemically synthesized
atcattttttcacataaaat

SEQ ID NO: 103726 - DNA, 20 bp, Artificial Sequence
  chemically synthesized
ttcacataaaattggtgcta

SEQ ID NO: 103727 - DNA, 20 bp, Artificial Sequence
  chemically synthesized
tagtccacatattatttctg

SEQ ID NO: 103728 - DNA, 20 bp, Artificial Sequence
  chemically synthesized
ggtgctacagaaataatatg

SEQ ID NO: 103729 - DNA, 20 bp, Artificial Sequence
  chemically synthesized
agaaataatatgtggactat

SEQ ID NO: 103730 - DNA, 20 bp, Artificial Sequence
  chemically synthesized
tcaataatagtgaaagctta

SEQ ID NO: 103731 - DNA, 20 bp, Artificial Sequence
  chemically synthesized
caaatgttcaataatagtga

SEQ ID NO: 103732 - DNA, 20 bp, Artificial Sequence
  chemically synthesized
tatggccaaatgttcaataa

SEQ ID NO: 103733 - DNA, 20 bp, Artificial Sequence
  chemically synthesized
tttcactattattgaacatt

SEQ ID NO: 103734 - DNA, 20 bp, Artificial Sequence
  chemically synthesized
gtctcaatagttcatagata

SEQ ID NO: 103735 - DNA, 20 bp, Artificial Sequence
  chemically synthesized
tcaactgtctcaatagttca

SEQ ID NO: 103736 - DNA, 20 bp, Artificial Sequence
  chemically synthesized
ggccatatctatgaactatt

SEQ ID NO: 103737 - DNA, 20 bp, Artificial Sequence
  chemically synthesized
atatctatgaactattgaga

SEQ ID NO: 103738 - DNA, 20 bp, Artificial Sequence
  chemically synthesized
ttttttttcaactgtctcaa

SEQ ID NO: 103739 - DNA, 20 bp, Artificial Sequence
  chemically synthesized
tattgagacagttgaaaaaa

SEQ ID NO: 103740 - DNA, 20 bp, Artificial Sequence
  chemically synthesized
gacagttgaaaaaaaagcca

SEQ ID NO: 103741 - DNA, 20 bp, Artificial Sequence
  chemically synthesized
gttgaaaaaaaagccacagc

SEQ ID NO: 103742 - DNA, 20 bp, Artificial Sequence
  chemically synthesized
gctcgatatagttccagctg

SEQ ID NO: 103743 - DNA, 20 bp, Artificial Sequence
  chemically synthesized
agttgagctcgatatagttc

SEQ ID NO: 103744 - DNA, 20 bp, Artificial Sequence
  chemically synthesized
gccacagctggaactatatc

SEQ ID NO: 103745 - DNA, 20 bp, Artificial Sequence
  chemically synthesized
ttgcagagttgagctcgata

SEQ ID NO: 103746 - DNA, 20 bp, Artificial Sequence
  chemically synthesized
cacaattaagttgcagagtt

SEQ ID NO: 103747 - DNA, 20 bp, Artificial Sequence
  chemically synthesized
tatttcacaattaagttgca

SEQ ID NO: 103748 - DNA, 20 bp, Artificial Sequence
  chemically synthesized
tttatttcacaattaagttg

SEQ ID NO: 103749 - DNA, 20 bp, Artificial Sequence
  chemically synthesized
attgtatttatttcacaatt

SEQ ID NO: 103750 - DNA, 20 bp, Artificial Sequence
  chemically synthesized
tacaataataataattgtaa

SEQ ID NO: 103751 - DNA, 20 bp, Artificial Sequence
  chemically synthesized
aataataataattgtaacag

SEQ ID NO: 103752 - DNA, 20 bp, Artificial Sequence
  chemically synthesized
ataataataattgtaacagc

SEQ ID NO: 103753 - DNA, 20 bp, Artificial Sequence
  chemically synthesized
cagttacaccagcatgattt

SEQ ID NO: 103754 - DNA, 20 bp, Artificial Sequence
  chemically synthesized
gcagttacaccagcatgatt

SEQ ID NO: 103755 - DNA, 20 bp, Artificial Sequence
  chemically synthesized
cagcaggacctaaatcatgc

SEQ ID NO: 103756 - DNA, 20 bp, Artificial Sequence
  chemically synthesized
gacaaacccagcagttacac

SEQ ID NO: 103757 - DNA, 20 bp, Artificial Sequence
  chemically synthesized
aatcatgctggtgtaactgc

SEQ ID NO: 103758 - DNA, 20 bp, Artificial Sequence
  chemically synthesized
atcatgctggtgtaactgct

SEQ ID NO: 103759 - DNA, 20 bp, Artificial Sequence
  chemically synthesized
atatctgaggacaaacccag

SEQ ID NO: 103760 - DNA, 20 bp, Artificial Sequence
  chemically synthesized
ttaatatctgaggacaaacc

SEQ ID NO: 103761 - DNA, 20 bp, Artificial Sequence
  chemically synthesized
gtaactgctgggtttgtcct

SEQ ID NO: 103762 - DNA, 20 bp, Artificial Sequence
  chemically synthesized
acctttagagttaatatctg

SEQ ID NO: 103763 - DNA, 20 bp, Artificial Sequence
  chemically synthesized
aacctttagagttaatatct

SEQ ID NO: 103764 - DNA, 20 bp, Artificial Sequence
  chemically synthesized
gtcctcagatattaactcta

SEQ ID NO: 103765 - DNA, 20 bp, Artificial Sequence
  chemically synthesized
tcctcagatattaactctaa

SEQ ID NO: 103766 - DNA, 20 bp, Artificial Sequence
  chemically synthesized
cacaatgaatataaccttta

SEQ ID NO: 103767 - DNA, 20 bp, Artificial Sequence
  chemically synthesized
accacaatgaatataacctt

SEQ ID NO: 103768 - DNA, 20 bp, Artificial Sequence
  chemically synthesized
tctaaaggttatattcattg

SEQ ID NO: 103769 - DNA, 20 bp, Artificial Sequence
  chemically synthesized
tcattgtggtgccacctgtt

SEQ ID NO: 103770 - DNA, 20 bp, Artificial Sequence
  chemically synthesized
tgcccttctttccaaacagg

SEQ ID NO: 103771 - DNA, 20 bp, Artificial Sequence
  chemically synthesized
tgtggtgccacctgtttgga

SEQ ID NO: 103772 - DNA, 20 bp, Artificial Sequence
  chemically synthesized
atgtgcccttctttccaaac

SEQ ID NO: 103773 - DNA, 20 bp, Artificial Sequence
  chemically synthesized
gatgtgcccttctttccaaa

SEQ ID NO: 103774 - DNA, 20 bp, Artificial Sequence
  chemically synthesized
ggtgccacctgtttggaaag

SEQ ID NO: 103775 - DNA, 20 bp, Artificial Sequence
  chemically synthesized
gtgccacctgtttggaaaga

SEQ ID NO: 103776 - DNA, 20 bp, Artificial Sequence
  chemically synthesized
tgccacctgtttggaaagaa

SEQ ID NO: 103777 - DNA, 20 bp, Artificial Sequence
  chemically synthesized
gtttggaaagaagggcacat

SEQ ID NO: 103778 - DNA, 20 bp, Artificial Sequence
  chemically synthesized
tttggaaagaagggcacatc

SEQ ID NO: 103779 - DNA, 20 bp, Artificial Sequence
  chemically synthesized
gaagggcacatcaggatttt

SEQ ID NO: 103780 - DNA, 20 bp, Artificial Sequence
  chemically synthesized
aggattttgagtacatattt

SEQ ID NO: 103781 - DNA, 20 bp, Artificial Sequence
  chemically synthesized
gattttgagtacatatttta

SEQ ID NO: 103782 - DNA, 20 bp, Artificial Sequence
  chemically synthesized
catattttagagttttcctt

SEQ ID NO: 103783 - DNA, 20 bp, Artificial Sequence
  chemically synthesized
attatatggtacagtaccaa

SEQ ID NO: 103784 - DNA, 20 bp, Artificial Sequence
  chemically synthesized
tattatatggtacagtacca

SEQ ID NO: 103785 - DNA, 20 bp, Artificial Sequence
  chemically synthesized
gtgttccatattatatggta

SEQ ID NO: 103786 - DNA, 20 bp, Artificial Sequence
  chemically synthesized
tggtactgtaccatataata

SEQ ID NO: 103787 - DNA, 20 bp, Artificial Sequence
  chemically synthesized
ttttagtgttccatattata

SEQ ID NO: 103788 - DNA, 20 bp, Artificial Sequence
  chemically synthesized
gacacattttattgtgattt

SEQ ID NO: 103789 - DNA, 20 bp, Artificial Sequence
  chemically synthesized
ttacttaccttcacacaaag

SEQ ID NO: 103790 - DNA, 20 bp, Artificial Sequence
  chemically synthesized
aaatgtgtctgctttgtgtg

SEQ ID NO: 103791 - DNA, 20 bp, Artificial Sequence
  chemically synthesized
aatgtgtctgctttgtgtga

SEQ ID NO: 103792 - DNA, 20 bp, Artificial Sequence
  chemically synthesized
cacttacttaccttcacaca

SEQ ID NO: 103793 - DNA, 20 bp, Artificial Sequence
  chemically synthesized
tgtctgctttgtgtgaaggt

SEQ ID NO: 103794 - DNA, 20 bp, Artificial Sequence
  chemically synthesized
tgctttgtgtgaaggtaagt

SEQ ID NO: 103795 - DNA, 20 bp, Artificial Sequence
  chemically synthesized
tgtgaaggtaagtaagtgcc

SEQ ID NO: 103796 - DNA, 20 bp, Artificial Sequence
  chemically synthesized
gaaatgccttacaataagct

SEQ ID NO: 103797 - DNA, 20 bp, Artificial Sequence
  chemically synthesized
gtaagtgccaagcttattgt

SEQ ID NO: 103798 - DNA, 20 bp, Artificial Sequence
  chemically synthesized
taagtgccaagcttattgta

SEQ ID NO: 103799 - DNA, 20 bp, Artificial Sequence
  chemically synthesized
gatttgaaatgccttacaat

SEQ ID NO: 103800 - DNA, 20 bp, Artificial Sequence
  chemically synthesized
ttgtaaggcatttcaaatct

SEQ ID NO: 103801 - DNA, 20 bp, Artificial Sequence
  chemically synthesized
atataaaaggcgttgtgtcc

SEQ ID NO: 103802 - DNA, 20 bp, Artificial Sequence
  chemically synthesized
tatattagttgaaatataaa

SEQ ID NO: 103803 - DNA, 20 bp, Artificial Sequence
  chemically synthesized
gtatattagttgaaatataa

SEQ ID NO: 103804 - DNA, 20 bp, Artificial Sequence
  chemically synthesized
ttatatttcaactaatatac

SEQ ID NO: 103805 - DNA, 20 bp, Artificial Sequence
  chemically synthesized
tatatttcaactaatatact

SEQ ID NO: 103806 - DNA, 20 bp, Artificial Sequence
  chemically synthesized
agcccaacagcccagtatat

SEQ ID NO: 103807 - DNA, 20 bp, Artificial Sequence
  chemically synthesized
caactaatatactgggctgt

SEQ ID NO: 103808 - DNA, 20 bp, Artificial Sequence
  chemically synthesized
aactaatatactgggctgtt

SEQ ID NO: 103809 - DNA, 20 bp, Artificial Sequence
  chemically synthesized
atgagcacagcccaacagcc

SEQ ID NO: 103810 - DNA, 20 bp, Artificial Sequence
  chemically synthesized
taaaaatgagcacagcccaa

SEQ ID NO: 103811 - DNA, 20 bp, Artificial Sequence
  chemically synthesized
tgtaattataaaaatgagca

SEQ ID NO: 103812 - DNA, 20 bp, Artificial Sequence
  chemically synthesized
actactgtaattataaaaat

SEQ ID NO: 103813 - DNA, 20 bp, Artificial Sequence
  chemically synthesized
tgtgctcatttttataatta

SEQ ID NO: 103814 - DNA, 20 bp, Artificial Sequence
  chemically synthesized
gctcatttttataattacag

SEQ ID NO: 103815 - DNA, 20 bp, Artificial Sequence
  chemically synthesized
acagtagtttcctacataaa

SEQ ID NO: 103816 - DNA, 20 bp, Artificial Sequence
  chemically synthesized
ccatttaaaactgtttatgt

SEQ ID NO: 103817 - DNA, 20 bp, Artificial Sequence
  chemically synthesized
tccatttaaaactgtttatg

SEQ ID NO: 103818 - DNA, 20 bp, Artificial Sequence
  chemically synthesized
cctacataaacagttttaaa

SEQ ID NO: 103819 - DNA, 20 bp, Artificial Sequence
  chemically synthesized
atttcttggcatgttgcagt

SEQ ID NO: 103820 - DNA, 20 bp, Artificial Sequence
  chemically synthesized
tatttcttggcatgttgcag

SEQ ID NO: 103821 - DNA, 20 bp, Artificial Sequence
  chemically synthesized
aattatttcttggcatgttg

SEQ ID NO: 103822 - DNA, 20 bp, Artificial Sequence
  chemically synthesized
tggacccactgcaacatgcc

SEQ ID NO: 103823 - DNA, 20 bp, Artificial Sequence
  chemically synthesized
gataggagctaattatttct

SEQ ID NO: 103824 - DNA, 20 bp, Artificial Sequence
  chemically synthesized
gcaacatgccaagaaataat

SEQ ID NO: 103825 - DNA, 20 bp, Artificial Sequence
  chemically synthesized
tatataagattaaatgatag

SEQ ID NO: 103826 - DNA, 20 bp, Artificial Sequence
  chemically synthesized
aatatataagattaaatgat

SEQ ID NO: 103827 - DNA, 20 bp, Artificial Sequence
  chemically synthesized
aaatatataagattaaatga

SEQ ID NO: 103828 - DNA, 20 bp, Artificial Sequence
  chemically synthesized
tatgatacatataaatatat

SEQ ID NO: 103829 - DNA, 20 bp, Artificial Sequence
  chemically synthesized
ttatatatttatatgtatca

SEQ ID NO: 103830 - DNA, 20 bp, Artificial Sequence
  chemically synthesized
atatgtatcatagcatatgt

SEQ ID NO: 103831 - DNA, 20 bp, Artificial Sequence
  chemically synthesized
ttgatgatgcttgaattagt

SEQ ID NO: 103832 - DNA, 20 bp, Artificial Sequence
  chemically synthesized
taacattcacttactaattc

SEQ ID NO: 103833 - DNA, 20 bp, Artificial Sequence
  chemically synthesized
ttacttgatgatgcttgaat

SEQ ID NO: 103834 - DNA, 20 bp, Artificial Sequence
  chemically synthesized
ttactaattcaagcatcatc

SEQ ID NO: 103835 - DNA, 20 bp, Artificial Sequence
  chemically synthesized
taattcaagcatcatcaagt

SEQ ID NO: 103836 - DNA, 20 bp, Artificial Sequence
  chemically synthesized
caagcatcatcaagtaagtc

SEQ ID NO: 103837 - DNA, 20 bp, Artificial Sequence
  chemically synthesized
atcatcaagtaagtctagat

SEQ ID NO: 103838 - DNA, 20 bp, Artificial Sequence
  chemically synthesized
tgctaaatatatttctgatc

SEQ ID NO: 103839 - DNA, 20 bp, Artificial Sequence
  chemically synthesized
gtctagatcagaaatatatt

SEQ ID NO: 103840 - DNA, 20 bp, Artificial Sequence
  chemically synthesized
tagatcagaaatatatttag

SEQ ID NO: 103841 - DNA, 20 bp, Artificial Sequence
  chemically synthesized
tctgaaagagtatgtagagg

SEQ ID NO: 103842 - DNA, 20 bp, Artificial Sequence
  chemically synthesized
cagtctgaaagagtatgtag

SEQ ID NO: 103843 - DNA, 20 bp, Artificial Sequence
  chemically synthesized
tcagtctgaaagagtatgta

SEQ ID NO: 103844 - DNA, 20 bp, Artificial Sequence
  chemically synthesized
gctcagtctgaaagagtatg

SEQ ID NO: 103845 - DNA, 20 bp, Artificial Sequence
  chemically synthesized
tccacctctacatactcttt

SEQ ID NO: 103846 - DNA, 20 bp, Artificial Sequence
  chemically synthesized
ctaattagctcagtctgaaa

SEQ ID NO: 103847 - DNA, 20 bp, Artificial Sequence
  chemically synthesized
tctacatactctttcagact

SEQ ID NO: 103848 - DNA, 20 bp, Artificial Sequence
  chemically synthesized
ggctaattagctcagtctga

SEQ ID NO: 103849 - DNA, 20 bp, Artificial Sequence
  chemically synthesized
ctctttcagactgagctaat

SEQ ID NO: 103850 - DNA, 20 bp, Artificial Sequence
  chemically synthesized
taactagtggctaattagct

SEQ ID NO: 103851 - DNA, 20 bp, Artificial Sequence
  chemically synthesized
ctctgtaactagtggctaat

SEQ ID NO: 103852 - DNA, 20 bp, Artificial Sequence
  chemically synthesized
agactgagctaattagccac

SEQ ID NO: 103853 - DNA, 20 bp, Artificial Sequence
  chemically synthesized
agctaattagccactagtta

SEQ ID NO: 103854 - DNA, 20 bp, Artificial Sequence
  chemically synthesized
atctttttctctgtaactag

SEQ ID NO: 103855 - DNA, 20 bp, Artificial Sequence
  chemically synthesized
ctaattagccactagttaca

SEQ ID NO: 103856 - DNA, 20 bp, Artificial Sequence
  chemically synthesized
attatctttttctctgtaac

SEQ ID NO: 103857 - DNA, 20 bp, Artificial Sequence
  chemically synthesized
agccactagttacagagaaa

SEQ ID NO: 103858 - DNA, 20 bp, Artificial Sequence
  chemically synthesized
atctaaatatatattttaga

SEQ ID NO: 103859 - DNA, 20 bp, Artificial Sequence
  chemically synthesized
aaatatctaaatatatattt

SEQ ID NO: 103860 - DNA, 20 bp, Artificial Sequence
  chemically synthesized
tactttctaaaatatatatt

SEQ ID NO: 103861 - DNA, 20 bp, Artificial Sequence
  chemically synthesized
atttcaaagtaaagttattt

SEQ ID NO: 103862 - DNA, 20 bp, Artificial Sequence
  chemically synthesized
tcttaaaccatttcaaagta

SEQ ID NO: 103863 - DNA, 20 bp, Artificial Sequence
  chemically synthesized
aaaataactttactttgaaa

SEQ ID NO: 103864 - DNA, 20 bp, Artificial Sequence
  chemically synthesized
tgtggtcttaaaccatttca

SEQ ID NO: 103865 - DNA, 20 bp, Artificial Sequence
  chemically synthesized
actttactttgaaatggttt

SEQ ID NO: 103866 - DNA, 20 bp, Artificial Sequence
  chemically synthesized
tactatatttgcaagttttg

SEQ ID NO: 103867 - DNA, 20 bp, Artificial Sequence
  chemically synthesized
gaccacaaaacttgcaaata

SEQ ID NO: 103868 - DNA, 20 bp, Artificial Sequence
  chemically synthesized
agtctctgtactatatttgc

SEQ ID NO: 103869 - DNA, 20 bp, Artificial Sequence
  chemically synthesized
caaaacttgcaaatatagta

SEQ ID NO: 103870 - DNA, 20 bp, Artificial Sequence
  chemically synthesized
aaacttgcaaatatagtaca

SEQ ID NO: 103871 - DNA, 20 bp, Artificial Sequence
  chemically synthesized
ctgggtaaaaggtgcgtgag

SEQ ID NO: 103872 - DNA, 20 bp, Artificial Sequence
  chemically synthesized
aagctgggtaaaaggtgcgt

SEQ ID NO: 103873 - DNA, 20 bp, Artificial Sequence
  chemically synthesized
cttctcacgcaccttttacc

SEQ ID NO: 103874 - DNA, 20 bp, Artificial Sequence
  chemically synthesized
attgggagaagctgggtaaa

SEQ ID NO: 103875 - DNA, 20 bp, Artificial Sequence
  chemically synthesized
cattgggagaagctgggtaa

SEQ ID NO: 103876 - DNA, 20 bp, Artificial Sequence
  chemically synthesized
tgctatcattgggagaagct

SEQ ID NO: 103877 - DNA, 20 bp, Artificial Sequence
  chemically synthesized
atgctatcattgggagaagc

SEQ ID NO: 103878 - DNA, 20 bp, Artificial Sequence
  chemically synthesized
taaaatgctatcattgggag

SEQ ID NO: 103879 - DNA, 20 bp, Artificial Sequence
  chemically synthesized
tacccagcttctcccaatga

SEQ ID NO: 103880 - DNA, 20 bp, Artificial Sequence
  chemically synthesized
atttaaaatgctatcattgg

SEQ ID NO: 103881 - DNA, 20 bp, Artificial Sequence
  chemically synthesized
gtatttaaaatgctatcatt

SEQ ID NO: 103882 - DNA, 20 bp, Artificial Sequence
  chemically synthesized
ggtatttaaaatgctatcat

SEQ ID NO: 103883 - DNA, 20 bp, Artificial Sequence
  chemically synthesized
gatagcattttaaataccca

SEQ ID NO: 103884 - DNA, 20 bp, Artificial Sequence
  chemically synthesized
ctttgatgataatgtactat

SEQ ID NO: 103885 - DNA, 20 bp, Artificial Sequence
  chemically synthesized
gctttgatgataatgtacta

SEQ ID NO: 103886 - DNA, 20 bp, Artificial Sequence
  chemically synthesized
cccatagtacattatcatca

SEQ ID NO: 103887 - DNA, 20 bp, Artificial Sequence
  chemically synthesized
tagtacattatcatcaaagc

SEQ ID NO: 103888 - DNA, 20 bp, Artificial Sequence
  chemically synthesized
agtacattatcatcaaagct

SEQ ID NO: 103889 - DNA, 20 bp, Artificial Sequence
  chemically synthesized
ttgtgccaatgtcagtttcc

SEQ ID NO: 103890 - DNA, 20 bp, Artificial Sequence
  chemically synthesized
caaagctaggaaactgacat

SEQ ID NO: 103891 - DNA, 20 bp, Artificial Sequence
  chemically synthesized
taatagtattgtgccaatgt

SEQ ID NO: 103892 - DNA, 20 bp, Artificial Sequence
  chemically synthesized
gaggtctgtatttgagttaa

SEQ ID NO: 103893 - DNA, 20 bp, Artificial Sequence
  chemically synthesized
caatactattaactcaaata

SEQ ID NO: 103894 - DNA, 20 bp, Artificial Sequence
  chemically synthesized
tataaatgaggtctgtattt

SEQ ID NO: 103895 - DNA, 20 bp, Artificial Sequence
  chemically synthesized
gaactggtgaaatataaatg

SEQ ID NO: 103896 - DNA, 20 bp, Artificial Sequence
  chemically synthesized
agaactggtgaaatataaat

SEQ ID NO: 103897 - DNA, 20 bp, Artificial Sequence
  chemically synthesized
agacctcatttatatttcac

SEQ ID NO: 103898 - DNA, 20 bp, Artificial Sequence
  chemically synthesized
agaaggatgtatgtaagaac

SEQ ID NO: 103899 - DNA, 20 bp, Artificial Sequence
  chemically synthesized
ttatttagaaggatgtatgt

SEQ ID NO: 103900 - DNA, 20 bp, Artificial Sequence
  chemically synthesized
aaaataaatatttatttaga

SEQ ID NO: 103901 - DNA, 20 bp, Artificial Sequence
  chemically synthesized
taaaataaatatttatttag

SEQ ID NO: 103902 - DNA, 20 bp, Artificial Sequence
  chemically synthesized
gattaaaataaatatttatt

SEQ ID NO: 103903 - DNA, 20 bp, Artificial Sequence
  chemically synthesized
aataaatatttattttaatc

SEQ ID NO: 103904 - DNA, 20 bp, Artificial Sequence
  chemically synthesized
ataagacttaggatttaagc

SEQ ID NO: 103905 - DNA, 20 bp, Artificial Sequence
  chemically synthesized
tttaatctggcttaaatcct

SEQ ID NO: 103906 - DNA, 20 bp, Artificial Sequence
  chemically synthesized
taccataagacttaggattt

SEQ ID NO: 103907 - DNA, 20 bp, Artificial Sequence
  chemically synthesized
acttgcctaccataagactt

SEQ ID NO: 103908 - DNA, 20 bp, Artificial Sequence
  chemically synthesized
ggcttaaatcctaagtctta

SEQ ID NO: 103909 - DNA, 20 bp, Artificial Sequence
  chemically synthesized
tacttgcctaccataagact

SEQ ID NO: 103910 - DNA, 20 bp, Artificial Sequence
  chemically synthesized
ttaaatcctaagtcttatgg

SEQ ID NO: 103911 - DNA, 20 bp, Artificial Sequence
  chemically synthesized
taaatcctaagtcttatggt

SEQ ID NO: 103912 - DNA, 20 bp, Artificial Sequence
  chemically synthesized
aaaacatacttgcctaccat

SEQ ID NO: 103913 - DNA, 20 bp, Artificial Sequence
  chemically synthesized
tcctaagtcttatggtaggc

SEQ ID NO: 103914 - DNA, 20 bp, Artificial Sequence
  chemically synthesized
tggtaggcaagtatgtttta

SEQ ID NO: 103915 - DNA, 20 bp, Artificial Sequence
  chemically synthesized
taggcaagtatgttttatag

SEQ ID NO: 103916 - DNA, 20 bp, Artificial Sequence
  chemically synthesized
ttactacactgaacattatt

SEQ ID NO: 103917 - DNA, 20 bp, Artificial Sequence
  chemically synthesized
aaaattttctaaataatgtt

SEQ ID NO: 103918 - DNA, 20 bp, Artificial Sequence
  chemically synthesized
tttctaaataatgttcagtg

SEQ ID NO: 103919 - DNA, 20 bp, Artificial Sequence
  chemically synthesized
gttcagtgtagtaaaattat

SEQ ID NO: 103920 - DNA, 20 bp, Artificial Sequence
  chemically synthesized
agagttttgaattaagtgat

SEQ ID NO: 103921 - DNA, 20 bp, Artificial Sequence
  chemically synthesized
aaagcaaagagttttgaatt

SEQ ID NO: 103922 - DNA, 20 bp, Artificial Sequence
  chemically synthesized
gtcccatagcagaaagcaaa

SEQ ID NO: 103923 - DNA, 20 bp, Artificial Sequence
  chemically synthesized
cagtcccatagcagaaagca

SEQ ID NO: 103924 - DNA, 20 bp, Artificial Sequence
  chemically synthesized
aaactctttgctttctgcta

SEQ ID NO: 103925 - DNA, 20 bp, Artificial Sequence
  chemically synthesized
ggcaacagtcccatagcaga

SEQ ID NO: 103926 - DNA, 20 bp, Artificial Sequence
  chemically synthesized
aactctttgctttctgctat

SEQ ID NO: 103927 - DNA, 20 bp, Artificial Sequence
  chemically synthesized
ctgtggcaacagtcccatag

SEQ ID NO: 103928 - DNA, 20 bp, Artificial Sequence
  chemically synthesized
tttctgtggcaacagtccca

SEQ ID NO: 103929 - DNA, 20 bp, Artificial Sequence
  chemically synthesized
ctgctatgggactgttgcca

SEQ ID NO: 103930 - DNA, 20 bp, Artificial Sequence
  chemically synthesized
tttgaaattttctgtggcaa

SEQ ID NO: 103931 - DNA, 20 bp, Artificial Sequence
  chemically synthesized
gtaatttttgaaattttctg

SEQ ID NO: 103932 - DNA, 20 bp, Artificial Sequence
  chemically synthesized
ctgtctttaaaaaaaaaaaa

SEQ ID NO: 103933 - DNA, 20 bp, Artificial Sequence
  chemically synthesized
attactttttttttttttta

SEQ ID NO: 103934 - DNA, 20 bp, Artificial Sequence
  chemically synthesized
cttttttttttttttaaaga

SEQ ID NO: 103935 - DNA, 20 bp, Artificial Sequence
  chemically synthesized
tttttttttttaaagacaga

SEQ ID NO: 103936 - DNA, 20 bp, Artificial Sequence
  chemically synthesized
agacagaaagcatcttgaat

SEQ ID NO: 103937 - DNA, 20 bp, Artificial Sequence
  chemically synthesized
acagaaagcatcttgaatga

SEQ ID NO: 103938 - DNA, 20 bp, Artificial Sequence
  chemically synthesized
cagaaagcatcttgaatgag

SEQ ID NO: 103939 - DNA, 20 bp, Artificial Sequence
  chemically synthesized
aaagtcaggccctctcattc

SEQ ID NO: 103940 - DNA, 20 bp, Artificial Sequence
  chemically synthesized
agaaagcatcttgaatgaga

SEQ ID NO: 103941 - DNA, 20 bp, Artificial Sequence
  chemically synthesized
attaacagggatacaaagtc

SEQ ID NO: 103942 - DNA, 20 bp, Artificial Sequence
  chemically synthesized
tattaacagggatacaaagt

SEQ ID NO: 103943 - DNA, 20 bp, Artificial Sequence
  chemically synthesized
tacatattaacagggataca

SEQ ID NO: 103944 - DNA, 20 bp, Artificial Sequence
  chemically synthesized
tgagaacgtacatattaaca

SEQ ID NO: 103945 - DNA, 20 bp, Artificial Sequence
  chemically synthesized
ttgagaacgtacatattaac

SEQ ID NO: 103946 - DNA, 20 bp, Artificial Sequence
  chemically synthesized
attgagaacgtacatattaa

SEQ ID NO: 103947 - DNA, 20 bp, Artificial Sequence
  chemically synthesized
atggtttctatggagtaatt

SEQ ID NO: 103948 - DNA, 20 bp, Artificial Sequence
  chemically synthesized
gtacgttctcaattactcca

SEQ ID NO: 103949 - DNA, 20 bp, Artificial Sequence
  chemically synthesized
tttcatatatggtttctatg

SEQ ID NO: 103950 - DNA, 20 bp, Artificial Sequence
  chemically synthesized
cttttcatatatggtttcta

SEQ ID NO: 103951 - DNA, 20 bp, Artificial Sequence
  chemically synthesized
agaactaaacttttcatata

SEQ ID NO: 103952 - DNA, 20 bp, Artificial Sequence
  chemically synthesized
ccatagaaaccatatatgaa

SEQ ID NO: 103953 - DNA, 20 bp, Artificial Sequence
  chemically synthesized
gaaaccatatatgaaaagtt

SEQ ID NO: 103954 - DNA, 20 bp, Artificial Sequence
  chemically synthesized
gagacttgggagcaaagaag

SEQ ID NO: 103955 - DNA, 20 bp, Artificial Sequence
  chemically synthesized
aatgagacttgggagcaaag

SEQ ID NO: 103956 - DNA, 20 bp, Artificial Sequence
  chemically synthesized
agttctgcttctttgctccc

SEQ ID NO: 103957 - DNA, 20 bp, Artificial Sequence
  chemically synthesized
agaaatgagacttgggagca

SEQ ID NO: 103958 - DNA, 20 bp, Artificial Sequence
  chemically synthesized
tagtaagaaatgagacttgg

SEQ ID NO: 103959 - DNA, 20 bp, Artificial Sequence
  chemically synthesized
gctagtaagaaatgagactt

SEQ ID NO: 103960 - DNA, 20 bp, Artificial Sequence
  chemically synthesized
tgctagtaagaaatgagact

SEQ ID NO: 103961 - DNA, 20 bp, Artificial Sequence
  chemically synthesized
gaaaaatgctagtaagaaat

SEQ ID NO: 103962 - DNA, 20 bp, Artificial Sequence
  chemically synthesized
tcccaagtctcatttcttac

SEQ ID NO: 103963 - DNA, 20 bp, Artificial Sequence
  chemically synthesized
atgttaagaaaaatgctagt

SEQ ID NO: 103964 - DNA, 20 bp, Artificial Sequence
  chemically synthesized
ccagatgttaagaaaaatgc

SEQ ID NO: 103965 - DNA, 20 bp, Artificial Sequence
  chemically synthesized
ctagcatttttcttaacatc

SEQ ID NO: 103966 - DNA, 20 bp, Artificial Sequence
  chemically synthesized
tgaacattgaaccagatgtt

SEQ ID NO: 103967 - DNA, 20 bp, Artificial Sequence
  chemically synthesized
atctgctgtgaacattgaac

SEQ ID NO: 103968 - DNA, 20 bp, Artificial Sequence
  chemically synthesized
aacatctggttcaatgttca

SEQ ID NO: 103969 - DNA, 20 bp, Artificial Sequence
  chemically synthesized
atctggttcaatgttcacag

SEQ ID NO: 103970 - DNA, 20 bp, Artificial Sequence
  chemically synthesized
gttcaatgttcacagcagat

SEQ ID NO: 103971 - DNA, 20 bp, Artificial Sequence
  chemically synthesized
ttttaaaaaaaagtatttga

SEQ ID NO: 103972 - DNA, 20 bp, Artificial Sequence
  chemically synthesized
aatttctgggttttaaaaaa

SEQ ID NO: 103973 - DNA, 20 bp, Artificial Sequence
  chemically synthesized
aaatacttttttttaaaacc

SEQ ID NO: 103974 - DNA, 20 bp, Artificial Sequence
  chemically synthesized
tttttttaaaacccagaaat

SEQ ID NO: 103975 - DNA, 20 bp, Artificial Sequence
  chemically synthesized
tgtaaaattgactaatttct

SEQ ID NO: 103976 - DNA, 20 bp, Artificial Sequence
  chemically synthesized
atgtaaaattgactaatttc

SEQ ID NO: 103977 - DNA, 20 bp, Artificial Sequence
  chemically synthesized
caattttacatttacaatta

SEQ ID NO: 103978 - DNA, 20 bp, Artificial Sequence
  chemically synthesized
aattttacatttacaattat

SEQ ID NO: 103979 - DNA, 20 bp, Artificial Sequence
  chemically synthesized
atttacaattataggtcctt

SEQ ID NO: 103980 - DNA, 20 bp, Artificial Sequence
  chemically synthesized
tttacaattataggtccttt

SEQ ID NO: 103981 - DNA, 20 bp, Artificial Sequence
  chemically synthesized
tacttgttagaatatcctaa

SEQ ID NO: 103982 - DNA, 20 bp, Artificial Sequence
  chemically synthesized
ttacttgttagaatatccta

SEQ ID NO: 103983 - DNA, 20 bp, Artificial Sequence
  chemically synthesized
gtcctttaggatattctaac

SEQ ID NO: 103984 - DNA, 20 bp, Artificial Sequence
  chemically synthesized
cctttaggatttttacttgt

SEQ ID NO: 103985 - DNA, 20 bp, Artificial Sequence
  chemically synthesized
tctaacaagtaaaaatccta

SEQ ID NO: 103986 - DNA, 20 bp, Artificial Sequence
  chemically synthesized
ctaacaagtaaaaatcctaa

SEQ ID NO: 103987 - DNA, 20 bp, Artificial Sequence
  chemically synthesized
aaaacatacattttgccttt

SEQ ID NO: 103988 - DNA, 20 bp, Artificial Sequence
  chemically synthesized
gaaaacatacattttgcctt

SEQ ID NO: 103989 - DNA, 20 bp, Artificial Sequence
  chemically synthesized
aaggcaaaatgtatgttttc

SEQ ID NO: 103990 - DNA, 20 bp, Artificial Sequence
  chemically synthesized
gttttcaagtaaaaatatat

SEQ ID NO: 103991 - DNA, 20 bp, Artificial Sequence
  chemically synthesized
ttttcaagtaaaaatatatg

SEQ ID NO: 103992 - DNA, 20 bp, Artificial Sequence
  chemically synthesized
atgaggttgtttttttttga

SEQ ID NO: 103993 - DNA, 20 bp, Artificial Sequence
  chemically synthesized
gaggttgtttttttttgaca

SEQ ID NO: 103994 - DNA, 20 bp, Artificial Sequence
  chemically synthesized
tccagcctgggtgacagagt

SEQ ID NO: 103995 - DNA, 20 bp, Artificial Sequence
  chemically synthesized
cagagtctcactctgtcacc

SEQ ID NO: 103996 - DNA, 20 bp, Artificial Sequence
  chemically synthesized
gcactccagcctgggtgaca

SEQ ID NO: 103997 - DNA, 20 bp, Artificial Sequence
  chemically synthesized
agagtctcactctgtcaccc

SEQ ID NO: 103998 - DNA, 20 bp, Artificial Sequence
  chemically synthesized
ctgcactccagcctgggtga

SEQ ID NO: 103999 - DNA, 20 bp, Artificial Sequence
  chemically synthesized
tctcactctgtcacccaggc

SEQ ID NO: 104000 - DNA, 20 bp, Artificial Sequence
  chemically synthesized
tcactctgtcacccaggctg

SEQ ID NO: 104001 - DNA, 20 bp, Artificial Sequence
  chemically synthesized
gcaccactgcactccagcct

SEQ ID NO: 104002 - DNA, 20 bp, Artificial Sequence
  chemically synthesized
tgcaccactgcactccagcc

SEQ ID NO: 104003 - DNA, 20 bp, Artificial Sequence
  chemically synthesized
ctgtcacccaggctggagtg

SEQ ID NO: 104004 - DNA, 20 bp, Artificial Sequence
  chemically synthesized
aagattgcaccactgcactc

SEQ ID NO: 104005 - DNA, 20 bp, Artificial Sequence
  chemically synthesized
tcacccaggctggagtgcag

SEQ ID NO: 104006 - DNA, 20 bp, Artificial Sequence
  chemically synthesized
ggagtgcagtggtgcaatct

SEQ ID NO: 104007 - DNA, 20 bp, Artificial Sequence
  chemically synthesized
ggcagagcttgcagtgagcc

SEQ ID NO: 104008 - DNA, 20 bp, Artificial Sequence
  chemically synthesized
gtgcaatcttggctcactgc

SEQ ID NO: 104009 - DNA, 20 bp, Artificial Sequence
  chemically synthesized
caggaggcagagcttgcagt

SEQ ID NO: 104010 - DNA, 20 bp, Artificial Sequence
  chemically synthesized
tactcaggaggcagagcttg

SEQ ID NO: 104011 - DNA, 20 bp, Artificial Sequence
  chemically synthesized
gtcccactactcaggaggca

SEQ ID NO: 104012 - DNA, 20 bp, Artificial Sequence
  chemically synthesized
cactgcaagctctgcctcct

SEQ ID NO: 104013 - DNA, 20 bp, Artificial Sequence
  chemically synthesized
tagtcccactactcaggagg

SEQ ID NO: 104014 - DNA, 20 bp, Artificial Sequence
  chemically synthesized
tgcaagctctgcctcctgag

SEQ ID NO: 104015 - DNA, 20 bp, Artificial Sequence
  chemically synthesized
ctgtagtcccactactcagg

SEQ ID NO: 104016 - DNA, 20 bp, Artificial Sequence
  chemically synthesized
cctgtagtcccactactcag

SEQ ID NO: 104017 - DNA, 20 bp, Artificial Sequence
  chemically synthesized
aagctctgcctcctgagtag

SEQ ID NO: 104018 - DNA, 20 bp, Artificial Sequence
  chemically synthesized
agctctgcctcctgagtagt

SEQ ID NO: 104019 - DNA, 20 bp, Artificial Sequence
  chemically synthesized
cgcctgtagtcccactactc

SEQ ID NO: 104020 - DNA, 20 bp, Artificial Sequence
  chemically synthesized
gcgcctgtagtcccactact

SEQ ID NO: 104021 - DNA, 20 bp, Artificial Sequence
  chemically synthesized
cctcctgagtagtgggacta

SEQ ID NO: 104022 - DNA, 20 bp, Artificial Sequence
  chemically synthesized
ctcctgagtagtgggactac

SEQ ID NO: 104023 - DNA, 20 bp, Artificial Sequence
  chemically synthesized
ggcgtggtggtgggcgcctg

SEQ ID NO: 104024 - DNA, 20 bp, Artificial Sequence
  chemically synthesized
aattagccgggcgtggtggt

SEQ ID NO: 104025 - DNA, 20 bp, Artificial Sequence
  chemically synthesized
aaattagccgggcgtggtgg

SEQ ID NO: 104026 - DNA, 20 bp, Artificial Sequence
  chemically synthesized
caggcgcccaccaccacgcc

SEQ ID NO: 104027 - DNA, 20 bp, Artificial Sequence
  chemically synthesized
aaaaaattagccgggcgtgg

SEQ ID NO: 104028 - DNA, 20 bp, Artificial Sequence
  chemically synthesized
cacaaaaaattagccgggcg

SEQ ID NO: 104029 - DNA, 20 bp, Artificial Sequence
  chemically synthesized
aaaaacacaaaaaattagcc

SEQ ID NO: 104030 - DNA, 20 bp, Artificial Sequence
  chemically synthesized
taaaaacacaaaaaattagc

SEQ ID NO: 104031 - DNA, 20 bp, Artificial Sequence
  chemically synthesized
ctactaaaaacacaaaaaat

SEQ ID NO: 104032 - DNA, 20 bp, Artificial Sequence
  chemically synthesized
cggctaattttttgtgtttt

SEQ ID NO: 104033 - DNA, 20 bp, Artificial Sequence
  chemically synthesized
ctaattttttgtgtttttag

SEQ ID NO: 104034 - DNA, 20 bp, Artificial Sequence
  chemically synthesized
aattttttgtgtttttagta

SEQ ID NO: 104035 - DNA, 20 bp, Artificial Sequence
  chemically synthesized
ttttgtgtttttagtagaga

SEQ ID NO: 104036 - DNA, 20 bp, Artificial Sequence
  chemically synthesized
tttgtgtttttagtagagac

SEQ ID NO: 104037 - DNA, 20 bp, Artificial Sequence
  chemically synthesized
ttgtgtttttagtagagaca

SEQ ID NO: 104038 - DNA, 20 bp, Artificial Sequence
  chemically synthesized
gagacagggtttcaccgtgt

SEQ ID NO: 104039 - DNA, 20 bp, Artificial Sequence
  chemically synthesized
cagggtttcaccgtgttagc

SEQ ID NO: 104040 - DNA, 20 bp, Artificial Sequence
  chemically synthesized
cgacaccatcctggctaaca

SEQ ID NO: 104041 - DNA, 20 bp, Artificial Sequence
  chemically synthesized
agggtttcaccgtgttagcc

SEQ ID NO: 104042 - DNA, 20 bp, Artificial Sequence
  chemically synthesized
tttcaccgtgttagccagga

SEQ ID NO: 104043 - DNA, 20 bp, Artificial Sequence
  chemically synthesized
tcaggagatcgacaccatcc

SEQ ID NO: 104044 - DNA, 20 bp, Artificial Sequence
  chemically synthesized
cgggcggatcacgaggtcag

SEQ ID NO: 104045 - DNA, 20 bp, Artificial Sequence
  chemically synthesized
ggcgggcggatcacgaggtc

SEQ ID NO: 104046 - DNA, 20 bp, Artificial Sequence
  chemically synthesized
aggcgggcggatcacgaggt

SEQ ID NO: 104047 - DNA, 20 bp, Artificial Sequence
  chemically synthesized
gccgaggcgggcggatcacg

SEQ ID NO: 104048 - DNA, 20 bp, Artificial Sequence
  chemically synthesized
ggccgaggcgggcggatcac

SEQ ID NO: 104049 - DNA, 20 bp, Artificial Sequence
  chemically synthesized
acctcgtgatccgcccgcct

SEQ ID NO: 104050 - DNA, 20 bp, Artificial Sequence
  chemically synthesized
ctttgggaggccgaggcggg

SEQ ID NO: 104051 - DNA, 20 bp, Artificial Sequence
  chemically synthesized
gcactttgggaggccgaggc

SEQ ID NO: 104052 - DNA, 20 bp, Artificial Sequence
  chemically synthesized
agcactttgggaggccgagg

SEQ ID NO: 104053 - DNA, 20 bp, Artificial Sequence
  chemically synthesized
cccagcactttgggaggccg

SEQ ID NO: 104054 - DNA, 20 bp, Artificial Sequence
  chemically synthesized
tcccagcactttgggaggcc

SEQ ID NO: 104055 - DNA, 20 bp, Artificial Sequence
  chemically synthesized
ccgcccgcctcggcctccca

SEQ ID NO: 104056 - DNA, 20 bp, Artificial Sequence
  chemically synthesized
tgtaatcccagcactttggg

SEQ ID NO: 104057 - DNA, 20 bp, Artificial Sequence
  chemically synthesized
ctgtaatcccagcactttgg

SEQ ID NO: 104058 - DNA, 20 bp, Artificial Sequence
  chemically synthesized
gcctcggcctcccaaagtgc

SEQ ID NO: 104059 - DNA, 20 bp, Artificial Sequence
  chemically synthesized
gcctgtaatcccagcacttt

SEQ ID NO: 104060 - DNA, 20 bp, Artificial Sequence
  chemically synthesized
cctcggcctcccaaagtgct

SEQ ID NO: 104061 - DNA, 20 bp, Artificial Sequence
  chemically synthesized
cgcctgtaatcccagcactt

SEQ ID NO: 104062 - DNA, 20 bp, Artificial Sequence
  chemically synthesized
ctcccaaagtgctgggatta

SEQ ID NO: 104063 - DNA, 20 bp, Artificial Sequence
  chemically synthesized
tcccaaagtgctgggattac

SEQ ID NO: 104064 - DNA, 20 bp, Artificial Sequence
  chemically synthesized
gtggctcacgcctgtaatcc

SEQ ID NO: 104065 - DNA, 20 bp, Artificial Sequence
  chemically synthesized
agtgctgggattacaggcgt

SEQ ID NO: 104066 - DNA, 20 bp, Artificial Sequence
  chemically synthesized
caggcgtgagccaccgcgcc

SEQ ID NO: 104067 - DNA, 20 bp, Artificial Sequence
  chemically synthesized
aactcatcggccgggcgcgg

SEQ ID NO: 104068 - DNA, 20 bp, Artificial Sequence
  chemically synthesized
aataactcatcggccgggcg

SEQ ID NO: 104069 - DNA, 20 bp, Artificial Sequence
  chemically synthesized
agccaccgcgcccggccgat

SEQ ID NO: 104070 - DNA, 20 bp, Artificial Sequence
  chemically synthesized
tatataataactcatcggcc

SEQ ID NO: 104071 - DNA, 20 bp, Artificial Sequence
  chemically synthesized
atatataataactcatcggc

SEQ ID NO: 104072 - DNA, 20 bp, Artificial Sequence
  chemically synthesized
cactatatataataactcat

SEQ ID NO: 104073 - DNA, 20 bp, Artificial Sequence
  chemically synthesized
ggccgatgagttattatata

SEQ ID NO: 104074 - DNA, 20 bp, Artificial Sequence
  chemically synthesized
gaacagtgatggataatatg

SEQ ID NO: 104075 - DNA, 20 bp, Artificial Sequence
  chemically synthesized
ttctagcataggaacagtga

SEQ ID NO: 104076 - DNA, 20 bp, Artificial Sequence
  chemically synthesized
agtgacttctagcataggaa

SEQ ID NO: 104077 - DNA, 20 bp, Artificial Sequence
  chemically synthesized
atccatcactgttcctatgc

SEQ ID NO: 104078 - DNA, 20 bp, Artificial Sequence
  chemically synthesized
catcactgttcctatgctag

SEQ ID NO: 104079 - DNA, 20 bp, Artificial Sequence
  chemically synthesized
ttgtgagtgacttctagcat

SEQ ID NO: 104080 - DNA, 20 bp, Artificial Sequence
  chemically synthesized
tttgtgagtgacttctagca

SEQ ID NO: 104081 - DNA, 20 bp, Artificial Sequence
  chemically synthesized
tagcttttgtgagtgacttc

SEQ ID NO: 104082 - DNA, 20 bp, Artificial Sequence
  chemically synthesized
atgctagaagtcactcacaa

SEQ ID NO: 104083 - DNA, 20 bp, Artificial Sequence
  chemically synthesized
gccaactctttagcttttgt

SEQ ID NO: 104084 - DNA, 20 bp, Artificial Sequence
  chemically synthesized
gaagtcactcacaaaagcta

SEQ ID NO: 104085 - DNA, 20 bp, Artificial Sequence
  chemically synthesized
agtcactcacaaaagctaaa

SEQ ID NO: 104086 - DNA, 20 bp, Artificial Sequence
  chemically synthesized
actcacaaaagctaaagagt

SEQ ID NO: 104087 - DNA, 20 bp, Artificial Sequence
  chemically synthesized
aaatagctatgccaactctt

SEQ ID NO: 104088 - DNA, 20 bp, Artificial Sequence
  chemically synthesized
caaaagctaaagagttggca

SEQ ID NO: 104089 - DNA, 20 bp, Artificial Sequence
  chemically synthesized
aaagagttggcatagctatt

SEQ ID NO: 104090 - DNA, 20 bp, Artificial Sequence
  chemically synthesized
atttgtttatatttgctaaa

SEQ ID NO: 104091 - DNA, 20 bp, Artificial Sequence
  chemically synthesized
cctttaaaatatttaggaag

SEQ ID NO: 104092 - DNA, 20 bp, Artificial Sequence
  chemically synthesized
aaccctttaaaatatttagg

SEQ ID NO: 104093 - DNA, 20 bp, Artificial Sequence
  chemically synthesized
actaaccctttaaaatattt

SEQ ID NO: 104094 - DNA, 20 bp, Artificial Sequence
  chemically synthesized
gactaaccctttaaaatatt

SEQ ID NO: 104095 - DNA, 20 bp, Artificial Sequence
  chemically synthesized
tctgcttcctaaatatttta

SEQ ID NO: 104096 - DNA, 20 bp, Artificial Sequence
  chemically synthesized
ctgcttcctaaatattttaa

SEQ ID NO: 104097 - DNA, 20 bp, Artificial Sequence
  chemically synthesized
tgcttcctaaatattttaaa

SEQ ID NO: 104098 - DNA, 20 bp, Artificial Sequence
  chemically synthesized
tcctaaatattttaaagggt

SEQ ID NO: 104099 - DNA, 20 bp, Artificial Sequence
  chemically synthesized
cacattacaaagatattata

SEQ ID NO: 104100 - DNA, 20 bp, Artificial Sequence
  chemically synthesized
catataatatctttgtaatg

SEQ ID NO: 104101 - DNA, 20 bp, Artificial Sequence
  chemically synthesized
taacttatatccacattaca

SEQ ID NO: 104102 - DNA, 20 bp, Artificial Sequence
  chemically synthesized
tatctttgtaatgtggatat

SEQ ID NO: 104103 - DNA, 20 bp, Artificial Sequence
  chemically synthesized
tgtggatataagttattcaa

SEQ ID NO: 104104 - DNA, 20 bp, Artificial Sequence
  chemically synthesized
gtggatataagttattcaat

SEQ ID NO: 104105 - DNA, 20 bp, Artificial Sequence
  chemically synthesized
caaaaaacaagtattaatta

SEQ ID NO: 104106 - DNA, 20 bp, Artificial Sequence
  chemically synthesized
ggtaatactttacaaaaaac

SEQ ID NO: 104107 - DNA, 20 bp, Artificial Sequence
  chemically synthesized
attaatacttgttttttgta

SEQ ID NO: 104108 - DNA, 20 bp, Artificial Sequence
  chemically synthesized
aggacatgccatcaaaaggc

SEQ ID NO: 104109 - DNA, 20 bp, Artificial Sequence
  chemically synthesized
aaggacatgccatcaaaagg

SEQ ID NO: 104110 - DNA, 20 bp, Artificial Sequence
  chemically synthesized
aagtattacccgccttttga

SEQ ID NO: 104111 - DNA, 20 bp, Artificial Sequence
  chemically synthesized
attaaggacatgccatcaaa

SEQ ID NO: 104112 - DNA, 20 bp, Artificial Sequence
  chemically synthesized
cattaaggacatgccatcaa

SEQ ID NO: 104113 - DNA, 20 bp, Artificial Sequence
  chemically synthesized
caaaagaggggtagtcatta

SEQ ID NO: 104114 - DNA, 20 bp, Artificial Sequence
  chemically synthesized
ccaaaagaggggtagtcatt

SEQ ID NO: 104115 - DNA, 20 bp, Artificial Sequence
  chemically synthesized
ggcactcaccaaaagagggg

SEQ ID NO: 104116 - DNA, 20 bp, Artificial Sequence
  chemically synthesized
cttaatgactacccctcttt

SEQ ID NO: 104117 - DNA, 20 bp, Artificial Sequence
  chemically synthesized
tctggcactcaccaaaagag

SEQ ID NO: 104118 - DNA, 20 bp, Artificial Sequence
  chemically synthesized
atctggcactcaccaaaaga

SEQ ID NO: 104119 - DNA, 20 bp, Artificial Sequence
  chemically synthesized
gatctggcactcaccaaaag

SEQ ID NO: 104120 - DNA, 20 bp, Artificial Sequence
  chemically synthesized
atgactacccctcttttggt

SEQ ID NO: 104121 - DNA, 20 bp, Artificial Sequence
  chemically synthesized
tgatctggcactcaccaaaa

SEQ ID NO: 104122 - DNA, 20 bp, Artificial Sequence
  chemically synthesized
agtgatctggcactcaccaa

SEQ ID NO: 104123 - DNA, 20 bp, Artificial Sequence
  chemically synthesized
acccctcttttggtgagtgc

SEQ ID NO: 104124 - DNA, 20 bp, Artificial Sequence
  chemically synthesized
aaaaggaattaatagtgatc

SEQ ID NO: 104125 - DNA, 20 bp, Artificial Sequence
  chemically synthesized
atgaatacaaaaggaattaa

SEQ ID NO: 104126 - DNA, 20 bp, Artificial Sequence
  chemically synthesized
gttgttataatgaatacaaa

SEQ ID NO: 104127 - DNA, 20 bp, Artificial Sequence
  chemically synthesized
tgttgttataatgaatacaa

SEQ ID NO: 104128 - DNA, 20 bp, Artificial Sequence
  chemically synthesized
ttcattataacaacatcaat

SEQ ID NO: 104129 - DNA, 20 bp, Artificial Sequence
  chemically synthesized
tcattataacaacatcaatc

SEQ ID NO: 104130 - DNA, 20 bp, Artificial Sequence
  chemically synthesized
cattataacaacatcaatca

SEQ ID NO: 104131 - DNA, 20 bp, Artificial Sequence
  chemically synthesized
ataacaacatcaatcaggga

SEQ ID NO: 104132 - DNA, 20 bp, Artificial Sequence
  chemically synthesized
tattcacattaatagcaaat

SEQ ID NO: 104133 - DNA, 20 bp, Artificial Sequence
  chemically synthesized
acctgttatattcacattaa

SEQ ID NO: 104134 - DNA, 20 bp, Artificial Sequence
  chemically synthesized
tgctattaatgtgaatataa

SEQ ID NO: 104135 - DNA, 20 bp, Artificial Sequence
  chemically synthesized
gctattaatgtgaatataac

SEQ ID NO: 104136 - DNA, 20 bp, Artificial Sequence
  chemically synthesized
taatcactactagattagaa

SEQ ID NO: 104137 - DNA, 20 bp, Artificial Sequence
  chemically synthesized
caggtaattccattctaatc

SEQ ID NO: 104138 - DNA, 20 bp, Artificial Sequence
  chemically synthesized
gtaattccattctaatctag

SEQ ID NO: 104139 - DNA, 20 bp, Artificial Sequence
  chemically synthesized
aacattaatcactactagat

SEQ ID NO: 104140 - DNA, 20 bp, Artificial Sequence
  chemically synthesized
aagtgaacattaatcactac

SEQ ID NO: 104141 - DNA, 20 bp, Artificial Sequence
  chemically synthesized
agtagtgattaatgttcact

SEQ ID NO: 104142 - DNA, 20 bp, Artificial Sequence
  chemically synthesized
agtgattaatgttcacttgg

SEQ ID NO: 104143 - DNA, 20 bp, Artificial Sequence
  chemically synthesized
gtgatattgtaattactacc

SEQ ID NO: 104144 - DNA, 20 bp, Artificial Sequence
  chemically synthesized
gtaattacaatatcacattt

SEQ ID NO: 104145 - DNA, 20 bp, Artificial Sequence
  chemically synthesized
aattacaatatcacatttca

SEQ ID NO: 104146 - DNA, 20 bp, Artificial Sequence
  chemically synthesized
aatatcacatttcagagtgt

SEQ ID NO: 104147 - DNA, 20 bp, Artificial Sequence
  chemically synthesized
acatttcagagtgttagcac

SEQ ID NO: 104148 - DNA, 20 bp, Artificial Sequence
  chemically synthesized
cacacaaaataagtattgtc

SEQ ID NO: 104149 - DNA, 20 bp, Artificial Sequence
  chemically synthesized
tttaaaaggccacacaaaat

SEQ ID NO: 104150 - DNA, 20 bp, Artificial Sequence
  chemically synthesized
tggacaatacttattttgtg

SEQ ID NO: 104151 - DNA, 20 bp, Artificial Sequence
  chemically synthesized
ttattttgtgtggcctttta

SEQ ID NO: 104152 - DNA, 20 bp, Artificial Sequence
  chemically synthesized
agctgctgtggttctttaaa

SEQ ID NO: 104153 - DNA, 20 bp, Artificial Sequence
  chemically synthesized
aagctgctgtggttctttaa

SEQ ID NO: 104154 - DNA, 20 bp, Artificial Sequence
  chemically synthesized
tgtggccttttaaagaacca

SEQ ID NO: 104155 - DNA, 20 bp, Artificial Sequence
  chemically synthesized
ggccttttaaagaaccacag

SEQ ID NO: 104156 - DNA, 20 bp, Artificial Sequence
  chemically synthesized
taagtccagacaagctgctg

SEQ ID NO: 104157 - DNA, 20 bp, Artificial Sequence
  chemically synthesized
aagaaccacagcagcttgtc

SEQ ID NO: 104158 - DNA, 20 bp, Artificial Sequence
  chemically synthesized
tttcaattctaagtccagac

SEQ ID NO: 104159 - DNA, 20 bp, Artificial Sequence
  chemically synthesized
cacagcagcttgtctggact

SEQ ID NO: 104160 - DNA, 20 bp, Artificial Sequence
  chemically synthesized
aaccttttcaattctaagtc

SEQ ID NO: 104161 - DNA, 20 bp, Artificial Sequence
  chemically synthesized
tctttaaccttttcaattct

SEQ ID NO: 104162 - DNA, 20 bp, Artificial Sequence
  chemically synthesized
tgtctggacttagaattgaa

SEQ ID NO: 104163 - DNA, 20 bp, Artificial Sequence
  chemically synthesized
gtctggacttagaattgaaa

SEQ ID NO: 104164 - DNA, 20 bp, Artificial Sequence
  chemically synthesized
acttagaattgaaaaggtta

SEQ ID NO: 104165 - DNA, 20 bp, Artificial Sequence
  chemically synthesized
agaattgaaaaggttaaaga

SEQ ID NO: 104166 - DNA, 20 bp, Artificial Sequence
  chemically synthesized
gaattgaaaaggttaaagaa

SEQ ID NO: 104167 - DNA, 20 bp, Artificial Sequence
  chemically synthesized
taaagaaaggcaattaatct

SEQ ID NO: 104168 - DNA, 20 bp, Artificial Sequence
  chemically synthesized
aaagaaaggcaattaatcta

SEQ ID NO: 104169 - DNA, 20 bp, Artificial Sequence
  chemically synthesized
aggcaattaatctaaggaca

SEQ ID NO: 104170 - DNA, 20 bp, Artificial Sequence
  chemically synthesized
gaatcctttctctttgtcct

SEQ ID NO: 104171 - DNA, 20 bp, Artificial Sequence
  chemically synthesized
gcaattaatctaaggacaaa

SEQ ID NO: 104172 - DNA, 20 bp, Artificial Sequence
  chemically synthesized
ttaatctaaggacaaagaga

SEQ ID NO: 104173 - DNA, 20 bp, Artificial Sequence
  chemically synthesized
taatctaaggacaaagagaa

SEQ ID NO: 104174 - DNA, 20 bp, Artificial Sequence
  chemically synthesized
aaagagaaaggattcttatg

SEQ ID NO: 104175 - DNA, 20 bp, Artificial Sequence
  chemically synthesized
agaaaggattcttatgtggc

SEQ ID NO: 104176 - DNA, 20 bp, Artificial Sequence
  chemically synthesized
ttcacctttcccagccacat

SEQ ID NO: 104177 - DNA, 20 bp, Artificial Sequence
  chemically synthesized
gaaaggattcttatgtggct

SEQ ID NO: 104178 - DNA, 20 bp, Artificial Sequence
  chemically synthesized
ggattcttatgtggctggga

SEQ ID NO: 104179 - DNA, 20 bp, Artificial Sequence
  chemically synthesized
gattcttatgtggctgggaa

SEQ ID NO: 104180 - DNA, 20 bp, Artificial Sequence
  chemically synthesized
taaccattattcacctttcc

SEQ ID NO: 104181 - DNA, 20 bp, Artificial Sequence
  chemically synthesized
tggctgggaaaggtgaataa

SEQ ID NO: 104182 - DNA, 20 bp, Artificial Sequence
  chemically synthesized
gggaaaggtgaataatggtt

SEQ ID NO: 104183 - DNA, 20 bp, Artificial Sequence
  chemically synthesized
aggtgaataatggttaagtg

SEQ ID NO: 104184 - DNA, 20 bp, Artificial Sequence
  chemically synthesized
ggtgaataatggttaagtga

SEQ ID NO: 104185 - DNA, 20 bp, Artificial Sequence
  chemically synthesized
gtgaataatggttaagtgaa

SEQ ID NO: 104186 - DNA, 20 bp, Artificial Sequence
  chemically synthesized
caaaatttgttactattttt

SEQ ID NO: 104187 - DNA, 20 bp, Artificial Sequence
  chemically synthesized
catactgattgaccaaaaaa

SEQ ID NO: 104188 - DNA, 20 bp, Artificial Sequence
  chemically synthesized
gttactattttttggtcaat

SEQ ID NO: 104189 - DNA, 20 bp, Artificial Sequence
  chemically synthesized
gatattactgggtacatatg

SEQ ID NO: 104190 - DNA, 20 bp, Artificial Sequence
  chemically synthesized
cagtatgcttcatatgtacc

SEQ ID NO: 104191 - DNA, 20 bp, Artificial Sequence
  chemically synthesized
agtcaagtagtgatattact

SEQ ID NO: 104192 - DNA, 20 bp, Artificial Sequence
  chemically synthesized
aagtcaagtagtgatattac

SEQ ID NO: 104193 - DNA, 20 bp, Artificial Sequence
  chemically synthesized
tctttgttttacaagtcaag

SEQ ID NO: 104194 - DNA, 20 bp, Artificial Sequence
  chemically synthesized
ttttctttgttttacaagtc

SEQ ID NO: 104195 - DNA, 20 bp, Artificial Sequence
  chemically synthesized
ttcagttttctttgttttac

SEQ ID NO: 104196 - DNA, 20 bp, Artificial Sequence
  chemically synthesized
actacttgacttgtaaaaca

SEQ ID NO: 104197 - DNA, 20 bp, Artificial Sequence
  chemically synthesized
ctttttaaacatgtcgattt

SEQ ID NO: 104198 - DNA, 20 bp, Artificial Sequence
  chemically synthesized
ctgaaatcgacatgtttaaa

SEQ ID NO: 104199 - DNA, 20 bp, Artificial Sequence
  chemically synthesized
tgtttaaaaagccactgttt

SEQ ID NO: 104200 - DNA, 20 bp, Artificial Sequence
  chemically synthesized
gcatcatggagctaaaacag

SEQ ID NO: 104201 - DNA, 20 bp, Artificial Sequence
  chemically synthesized
ttggcatcatggagctaaaa

SEQ ID NO: 104202 - DNA, 20 bp, Artificial Sequence
  chemically synthesized
gaaaattcattggcatcatg

SEQ ID NO: 104203 - DNA, 20 bp, Artificial Sequence
  chemically synthesized
ttgaaaattcattggcatca

SEQ ID NO: 104204 - DNA, 20 bp, Artificial Sequence
  chemically synthesized
catgtagtttgaaaattcat

SEQ ID NO: 104205 - DNA, 20 bp, Artificial Sequence
  chemically synthesized
caatgaattttcaaactaca

SEQ ID NO: 104206 - DNA, 20 bp, Artificial Sequence
  chemically synthesized
tttaggacagggaatccatg

SEQ ID NO: 104207 - DNA, 20 bp, Artificial Sequence
  chemically synthesized
gtaatctgtcatttaggaca

SEQ ID NO: 104208 - DNA, 20 bp, Artificial Sequence
  chemically synthesized
agtaatctgtcatttaggac

SEQ ID NO: 104209 - DNA, 20 bp, Artificial Sequence
  chemically synthesized
tagtaatctgtcatttagga

SEQ ID NO: 104210 - DNA, 20 bp, Artificial Sequence
  chemically synthesized
ggattccctgtcctaaatga

SEQ ID NO: 104211 - DNA, 20 bp, Artificial Sequence
  chemically synthesized
ttgatagtaatctgtcattt

SEQ ID NO: 104212 - DNA, 20 bp, Artificial Sequence
  chemically synthesized
attgatagtaatctgtcatt

SEQ ID NO: 104213 - DNA, 20 bp, Artificial Sequence
  chemically synthesized
tgacagattactatcaatgt

SEQ ID NO: 104214 - DNA, 20 bp, Artificial Sequence
  chemically synthesized
agttgtaactctcacattga

SEQ ID NO: 104215 - DNA, 20 bp, Artificial Sequence
  chemically synthesized
acagattactatcaatgtga

SEQ ID NO: 104216 - DNA, 20 bp, Artificial Sequence
  chemically synthesized
gggccccttcttttaaagat

SEQ ID NO: 104217 - DNA, 20 bp, Artificial Sequence
  chemically synthesized
gagttacaacttatctttaa

SEQ ID NO: 104218 - DNA, 20 bp, Artificial Sequence
  chemically synthesized
ttacaacttatctttaaaag

SEQ ID NO: 104219 - DNA, 20 bp, Artificial Sequence
  chemically synthesized
tacaacttatctttaaaaga

SEQ ID NO: 104220 - DNA, 20 bp, Artificial Sequence
  chemically synthesized
caaaagggccccttctttta

SEQ ID NO: 104221 - DNA, 20 bp, Artificial Sequence
  chemically synthesized
acaacttatctttaaaagaa

SEQ ID NO: 104222 - DNA, 20 bp, Artificial Sequence
  chemically synthesized
caacttatctttaaaagaag

SEQ ID NO: 104223 - DNA, 20 bp, Artificial Sequence
  chemically synthesized
ataaaatgataacatcaaaa

SEQ ID NO: 104224 - DNA, 20 bp, Artificial Sequence
  chemically synthesized
aataaaatgataacatcaaa

SEQ ID NO: 104225 - DNA, 20 bp, Artificial Sequence
  chemically synthesized
aaataaaatgataacatcaa

SEQ ID NO: 104226 - DNA, 20 bp, Artificial Sequence
  chemically synthesized
ttatcattttatttgtaaat

SEQ ID NO: 104227 - DNA, 20 bp, Artificial Sequence
  chemically synthesized
aattttggttcaaaattagg

SEQ ID NO: 104228 - DNA, 20 bp, Artificial Sequence
  chemically synthesized
ggcaattttggttcaaaatt

SEQ ID NO: 104229 - DNA, 20 bp, Artificial Sequence
  chemically synthesized
aggcaattttggttcaaaat

SEQ ID NO: 104230 - DNA, 20 bp, Artificial Sequence
  chemically synthesized
tttcaatataaaggcaattt

SEQ ID NO: 104231 - DNA, 20 bp, Artificial Sequence
  chemically synthesized
ggtgatttttttcaatataa

SEQ ID NO: 104232 - DNA, 20 bp, Artificial Sequence
  chemically synthesized
aggtgatttttttcaatata

SEQ ID NO: 104233 - DNA, 20 bp, Artificial Sequence
  chemically synthesized
atatatcatcgatgtgtttt

SEQ ID NO: 104234 - DNA, 20 bp, Artificial Sequence
  chemically synthesized
tatatatcatcgatgtgttt

SEQ ID NO: 104235 - DNA, 20 bp, Artificial Sequence
  chemically synthesized
gatgatatatattaatatta

SEQ ID NO: 104236 - DNA, 20 bp, Artificial Sequence
  chemically synthesized
agtttacctaaaatagaata

SEQ ID NO: 104237 - DNA, 20 bp, Artificial Sequence
  chemically synthesized
attatagctttattctattt

SEQ ID NO: 104238 - DNA, 20 bp, Artificial Sequence
  chemically synthesized
ttatagctttattctatttt

SEQ ID NO: 104239 - DNA, 20 bp, Artificial Sequence
  chemically synthesized
tttgtatagtttacctaaaa

SEQ ID NO: 104240 - DNA, 20 bp, Artificial Sequence
  chemically synthesized
gatgttaatggaagtttgta

SEQ ID NO: 104241 - DNA, 20 bp, Artificial Sequence
  chemically synthesized
tctctggttgatgttaatgg

SEQ ID NO: 104242 - DNA, 20 bp, Artificial Sequence
  chemically synthesized
gtctctctggttgatgttaa

SEQ ID NO: 104243 - DNA, 20 bp, Artificial Sequence
  chemically synthesized
aaacttccattaacatcaac

SEQ ID NO: 104244 - DNA, 20 bp, Artificial Sequence
  chemically synthesized
acttccattaacatcaacca

SEQ ID NO: 104245 - DNA, 20 bp, Artificial Sequence
  chemically synthesized
ttccattaacatcaaccaga

SEQ ID NO: 104246 - DNA, 20 bp, Artificial Sequence
  chemically synthesized
aatatgtgtgggagtctctc

SEQ ID NO: 104247 - DNA, 20 bp, Artificial Sequence
  chemically synthesized
tattgtgtcaatatgtgtgg

SEQ ID NO: 104248 - DNA, 20 bp, Artificial Sequence
  chemically synthesized
catattgtgtcaatatgtgt

SEQ ID NO: 104249 - DNA, 20 bp, Artificial Sequence
  chemically synthesized
acatattgtgtcaatatgtg

SEQ ID NO: 104250 - DNA, 20 bp, Artificial Sequence
  chemically synthesized
attgacacaatatgttatgt

SEQ ID NO: 104251 - DNA, 20 bp, Artificial Sequence
  chemically synthesized
cacaatatgttatgttagat

SEQ ID NO: 104252 - DNA, 20 bp, Artificial Sequence
  chemically synthesized
caatatgttatgttagatca

SEQ ID NO: 104253 - DNA, 20 bp, Artificial Sequence
  chemically synthesized
tatgttatgttagatcagag

SEQ ID NO: 104254 - DNA, 20 bp, Artificial Sequence
  chemically synthesized
atgttagatcagagcagtgc

SEQ ID NO: 104255 - DNA, 20 bp, Artificial Sequence
  chemically synthesized
tcagagcagtgctagtcatt

SEQ ID NO: 104256 - DNA, 20 bp, Artificial Sequence
  chemically synthesized
ggattttaaaactcaatgac

SEQ ID NO: 104257 - DNA, 20 bp, Artificial Sequence
  chemically synthesized
gtcattgagttttaaaatcc

SEQ ID NO: 104258 - DNA, 20 bp, Artificial Sequence
  chemically synthesized
ccagtaagtttaatatttcc

SEQ ID NO: 104259 - DNA, 20 bp, Artificial Sequence
  chemically synthesized
tccagtaagtttaatatttc

SEQ ID NO: 104260 - DNA, 20 bp, Artificial Sequence
  chemically synthesized
cctggaaatattaaacttac

SEQ ID NO: 104261 - DNA, 20 bp, Artificial Sequence
  chemically synthesized
tggaaatattaaacttactg

SEQ ID NO: 104262 - DNA, 20 bp, Artificial Sequence
  chemically synthesized
aacctataatgttctccagt

SEQ ID NO: 104263 - DNA, 20 bp, Artificial Sequence
  chemically synthesized
agataacctataatgttctc

SEQ ID NO: 104264 - DNA, 20 bp, Artificial Sequence
  chemically synthesized
aaacttactggagaacatta

SEQ ID NO: 104265 - DNA, 20 bp, Artificial Sequence
  chemically synthesized
aacttactggagaacattat

SEQ ID NO: 104266 - DNA, 20 bp, Artificial Sequence
  chemically synthesized
agaacattataggttatctg

SEQ ID NO: 104267 - DNA, 20 bp, Artificial Sequence
  chemically synthesized
gaacattataggttatctgt

SEQ ID NO: 104268 - DNA, 20 bp, Artificial Sequence
  chemically synthesized
tataggttatctgtaggcat

SEQ ID NO: 104269 - DNA, 20 bp, Artificial Sequence
  chemically synthesized
ctataaatctctgatgccta

SEQ ID NO: 104270 - DNA, 20 bp, Artificial Sequence
  chemically synthesized
taggttatctgtaggcatca

SEQ ID NO: 104271 - DNA, 20 bp, Artificial Sequence
  chemically synthesized
ctgtaggcatcagagattta

SEQ ID NO: 104272 - DNA, 20 bp, Artificial Sequence
  chemically synthesized
tgtaggcatcagagatttat

SEQ ID NO: 104273 - DNA, 20 bp, Artificial Sequence
  chemically synthesized
tcagagatttataggctata

SEQ ID NO: 104274 - DNA, 20 bp, Artificial Sequence
  chemically synthesized
cagagatttataggctatat

SEQ ID NO: 104275 - DNA, 20 bp, Artificial Sequence
  chemically synthesized
agagatttataggctatatg

SEQ ID NO: 104276 - DNA, 20 bp, Artificial Sequence
  chemically synthesized
gatttataggctatatgggg

SEQ ID NO: 104277 - DNA, 20 bp, Artificial Sequence
  chemically synthesized
catgcattttccaccccata

SEQ ID NO: 104278 - DNA, 20 bp, Artificial Sequence
  chemically synthesized
tatacttcaaggttgttttg

SEQ ID NO: 104279 - DNA, 20 bp, Artificial Sequence
  chemically synthesized
ctatacttcaaggttgtttt

SEQ ID NO: 104280 - DNA, 20 bp, Artificial Sequence
  chemically synthesized
tgaacctcaaaacaaccttg

SEQ ID NO: 104281 - DNA, 20 bp, Artificial Sequence
  chemically synthesized
ctcaaaacaaccttgaagta

SEQ ID NO: 104282 - DNA, 20 bp, Artificial Sequence
  chemically synthesized
cctgtcttgcctatacttca

SEQ ID NO: 104283 - DNA, 20 bp, Artificial Sequence
  chemically synthesized
tcaaaacaaccttgaagtat

SEQ ID NO: 104284 - DNA, 20 bp, Artificial Sequence
  chemically synthesized
acctgtcttgcctatacttc

SEQ ID NO: 104285 - DNA, 20 bp, Artificial Sequence
  chemically synthesized
aacaaccttgaagtataggc

SEQ ID NO: 104286 - DNA, 20 bp, Artificial Sequence
  chemically synthesized
accttgaagtataggcaaga

SEQ ID NO: 104287 - DNA, 20 bp, Artificial Sequence
  chemically synthesized
ccttgaagtataggcaagac

SEQ ID NO: 104288 - DNA, 20 bp, Artificial Sequence
  chemically synthesized
gtgtcattaatcttatttca

SEQ ID NO: 104289 - DNA, 20 bp, Artificial Sequence
  chemically synthesized
aatctccgcatctgtgaaat

SEQ ID NO: 104290 - DNA, 20 bp, Artificial Sequence
  chemically synthesized
ttaatcttatttcacagatg

SEQ ID NO: 104291 - DNA, 20 bp, Artificial Sequence
  chemically synthesized
aatcttatttcacagatgcg

SEQ ID NO: 104292 - DNA, 20 bp, Artificial Sequence
  chemically synthesized
cagatgcggagattgatgct

SEQ ID NO: 104293 - DNA, 20 bp, Artificial Sequence
  chemically synthesized
gatgcggagattgatgctga

SEQ ID NO: 104294 - DNA, 20 bp, Artificial Sequence
  chemically synthesized
gcggagattgatgctgagag

SEQ ID NO: 104295 - DNA, 20 bp, Artificial Sequence
  chemically synthesized
gcaagtctcttaacttctct

SEQ ID NO: 104296 - DNA, 20 bp, Artificial Sequence
  chemically synthesized
gattgatgctgagagaagtt

SEQ ID NO: 104297 - DNA, 20 bp, Artificial Sequence
  chemically synthesized
ttgatgctgagagaagttaa

SEQ ID NO: 104298 - DNA, 20 bp, Artificial Sequence
  chemically synthesized
tctgtagtgggatttagggc

SEQ ID NO: 104299 - DNA, 20 bp, Artificial Sequence
  chemically synthesized
atgctctgtagtgggattta

SEQ ID NO: 104300 - DNA, 20 bp, Artificial Sequence
  chemically synthesized
aatgctctgtagtgggattt

SEQ ID NO: 104301 - DNA, 20 bp, Artificial Sequence
  chemically synthesized
aaatgctctgtagtgggatt

SEQ ID NO: 104302 - DNA, 20 bp, Artificial Sequence
  chemically synthesized
acttgccctaaatcccacta

SEQ ID NO: 104303 - DNA, 20 bp, Artificial Sequence
  chemically synthesized
ttgccctaaatcccactaca

SEQ ID NO: 104304 - DNA, 20 bp, Artificial Sequence
  chemically synthesized
tccagtaaatgctctgtagt

SEQ ID NO: 104305 - DNA, 20 bp, Artificial Sequence
  chemically synthesized
ttccagtaaatgctctgtag

SEQ ID NO: 104306 - DNA, 20 bp, Artificial Sequence
  chemically synthesized
gggttccagtaaatgctctg

SEQ ID NO: 104307 - DNA, 20 bp, Artificial Sequence
  chemically synthesized
tcccactacagagcatttac

SEQ ID NO: 104308 - DNA, 20 bp, Artificial Sequence
  chemically synthesized
acagagcatttactggaacc

SEQ ID NO: 104309 - DNA, 20 bp, Artificial Sequence
  chemically synthesized
cagagcatttactggaaccc

SEQ ID NO: 104310 - DNA, 20 bp, Artificial Sequence
  chemically synthesized
agagcatttactggaaccca

SEQ ID NO: 104311 - DNA, 20 bp, Artificial Sequence
  chemically synthesized
aagttaaaagccctgggttc

SEQ ID NO: 104312 - DNA, 20 bp, Artificial Sequence
  chemically synthesized
gaaaataagttaaaagccct

SEQ ID NO: 104313 - DNA, 20 bp, Artificial Sequence
  chemically synthesized
agaaaataagttaaaagccc

SEQ ID NO: 104314 - DNA, 20 bp, Artificial Sequence
  chemically synthesized
agaccaagaaaataagttaa

SEQ ID NO: 104315 - DNA, 20 bp, Artificial Sequence
  chemically synthesized
gggcttttaacttattttct

SEQ ID NO: 104316 - DNA, 20 bp, Artificial Sequence
  chemically synthesized
agtggaaagaccaagaaaat

SEQ ID NO: 104317 - DNA, 20 bp, Artificial Sequence
  chemically synthesized
tgggctgcagtggaaagacc

SEQ ID NO: 104318 - DNA, 20 bp, Artificial Sequence
  chemically synthesized
ttttcttggtctttccactg

SEQ ID NO: 104319 - DNA, 20 bp, Artificial Sequence
  chemically synthesized
atggcatgggctgcagtgga

SEQ ID NO: 104320 - DNA, 20 bp, Artificial Sequence
  chemically synthesized
caggatggcatgggctgcag

SEQ ID NO: 104321 - DNA, 20 bp, Artificial Sequence
  chemically synthesized
aggcaggatggcatgggctg

SEQ ID NO: 104322 - DNA, 20 bp, Artificial Sequence
  chemically synthesized
gagtggaggcaggatggcat

SEQ ID NO: 104323 - DNA, 20 bp, Artificial Sequence
  chemically synthesized
tgagtggaggcaggatggca

SEQ ID NO: 104324 - DNA, 20 bp, Artificial Sequence
  chemically synthesized
acaagtgagtggaggcagga

SEQ ID NO: 104325 - DNA, 20 bp, Artificial Sequence
  chemically synthesized
tgtcacaagtgagtggaggc

SEQ ID NO: 104326 - DNA, 20 bp, Artificial Sequence
  chemically synthesized
ctgtcacaagtgagtggagg

SEQ ID NO: 104327 - DNA, 20 bp, Artificial Sequence
  chemically synthesized
aggctgtcacaagtgagtgg

SEQ ID NO: 104328 - DNA, 20 bp, Artificial Sequence
  chemically synthesized
caggctgtcacaagtgagtg

SEQ ID NO: 104329 - DNA, 20 bp, Artificial Sequence
  chemically synthesized
tacaggctgtcacaagtgag

SEQ ID NO: 104330 - DNA, 20 bp, Artificial Sequence
  chemically synthesized
ctctacaggctgtcacaagt

SEQ ID NO: 104331 - DNA, 20 bp, Artificial Sequence
  chemically synthesized
ctgcctccactcacttgtga

SEQ ID NO: 104332 - DNA, 20 bp, Artificial Sequence
  chemically synthesized
tgttctctacaggctgtcac

SEQ ID NO: 104333 - DNA, 20 bp, Artificial Sequence
  chemically synthesized
cactcacttgtgacagcctg

SEQ ID NO: 104334 - DNA, 20 bp, Artificial Sequence
  chemically synthesized
ctcacttgtgacagcctgta

SEQ ID NO: 104335 - DNA, 20 bp, Artificial Sequence
  chemically synthesized
ttcttacatctgttctctac

SEQ ID NO: 104336 - DNA, 20 bp, Artificial Sequence
  chemically synthesized
ttgtgacagcctgtagagaa

SEQ ID NO: 104337 - DNA, 20 bp, Artificial Sequence
  chemically synthesized
tttcttacatctgttctcta

SEQ ID NO: 104338 - DNA, 20 bp, Artificial Sequence
  chemically synthesized
agcctgtagagaacagatgt

SEQ ID NO: 104339 - DNA, 20 bp, Artificial Sequence
  chemically synthesized
cagatgtaagaaaaattgcc

SEQ ID NO: 104340 - DNA, 20 bp, Artificial Sequence
  chemically synthesized
gatgtaagaaaaattgccaa

SEQ ID NO: 104341 - DNA, 20 bp, Artificial Sequence
  chemically synthesized
aagaaaaattgccaagagtt

SEQ ID NO: 104342 - DNA, 20 bp, Artificial Sequence
  chemically synthesized
agaaaaattgccaagagttt

SEQ ID NO: 104343 - DNA, 20 bp, Artificial Sequence
  chemically synthesized
tttggatactcctaaactct

SEQ ID NO: 104344 - DNA, 20 bp, Artificial Sequence
  chemically synthesized
aaaaattgccaagagtttag

SEQ ID NO: 104345 - DNA, 20 bp, Artificial Sequence
  chemically synthesized
gtctgatagtttttgttatt

SEQ ID NO: 104346 - DNA, 20 bp, Artificial Sequence
  chemically synthesized
atccaaataacaaaaactat

SEQ ID NO: 104347 - DNA, 20 bp, Artificial Sequence
  chemically synthesized
tggccaccctaatagtctga

SEQ ID NO: 104348 - DNA, 20 bp, Artificial Sequence
  chemically synthesized
aacaaaaactatcagactat

SEQ ID NO: 104349 - DNA, 20 bp, Artificial Sequence
  chemically synthesized
acaaaaactatcagactatt

SEQ ID NO: 104350 - DNA, 20 bp, Artificial Sequence
  chemically synthesized
caaaaactatcagactatta

SEQ ID NO: 104351 - DNA, 20 bp, Artificial Sequence
  chemically synthesized
aaactatcagactattaggg

SEQ ID NO: 104352 - DNA, 20 bp, Artificial Sequence
  chemically synthesized
ttctcccctggccaccctaa

SEQ ID NO: 104353 - DNA, 20 bp, Artificial Sequence
  chemically synthesized
tatcagactattagggtggc

SEQ ID NO: 104354 - DNA, 20 bp, Artificial Sequence
  chemically synthesized
atcagactattagggtggcc

SEQ ID NO: 104355 - DNA, 20 bp, Artificial Sequence
  chemically synthesized
tcagactattagggtggcca

SEQ ID NO: 104356 - DNA, 20 bp, Artificial Sequence
  chemically synthesized
cagactattagggtggccag

SEQ ID NO: 104357 - DNA, 20 bp, Artificial Sequence
  chemically synthesized
gactattagggtggccaggg

SEQ ID NO: 104358 - DNA, 20 bp, Artificial Sequence
  chemically synthesized
attagggtggccaggggaga

SEQ ID NO: 104359 - DNA, 20 bp, Artificial Sequence
  chemically synthesized
cctctcttctctttctcccc

SEQ ID NO: 104360 - DNA, 20 bp, Artificial Sequence
  chemically synthesized
tagggtggccaggggagaaa

SEQ ID NO: 104361 - DNA, 20 bp, Artificial Sequence
  chemically synthesized
ggtggccaggggagaaagag

SEQ ID NO: 104362 - DNA, 20 bp, Artificial Sequence
  chemically synthesized
tggccaggggagaaagagaa

SEQ ID NO: 104363 - DNA, 20 bp, Artificial Sequence
  chemically synthesized
gccaggggagaaagagaaga

SEQ ID NO: 104364 - DNA, 20 bp, Artificial Sequence
  chemically synthesized
ccaggggagaaagagaagag

SEQ ID NO: 104365 - DNA, 20 bp, Artificial Sequence
  chemically synthesized
agaaagagaagagaggaaat

SEQ ID NO: 104366 - DNA, 20 bp, Artificial Sequence
  chemically synthesized
gaaagagaagagaggaaatc

SEQ ID NO: 104367 - DNA, 20 bp, Artificial Sequence
  chemically synthesized
agagaagagaggaaatcagg

SEQ ID NO: 104368 - DNA, 20 bp, Artificial Sequence
  chemically synthesized
gagaagagaggaaatcagga

SEQ ID NO: 104369 - DNA, 20 bp, Artificial Sequence
  chemically synthesized
agagaggaaatcaggaaggc

SEQ ID NO: 104370 - DNA, 20 bp, Artificial Sequence
  chemically synthesized
gagaggaaatcaggaaggct

SEQ ID NO: 104371 - DNA, 20 bp, Artificial Sequence
  chemically synthesized
ccaaatggtttgaaaaatcc

SEQ ID NO: 104372 - DNA, 20 bp, Artificial Sequence
  chemically synthesized
ctgggatttttcaaaccatt

SEQ ID NO: 104373 - DNA, 20 bp, Artificial Sequence
  chemically synthesized
tgggatttttcaaaccattt

SEQ ID NO: 104374 - DNA, 20 bp, Artificial Sequence
  chemically synthesized
aaacctggggtgtgcccaaa

SEQ ID NO: 104375 - DNA, 20 bp, Artificial Sequence
  chemically synthesized
caaaccatttgggcacaccc

SEQ ID NO: 104376 - DNA, 20 bp, Artificial Sequence
  chemically synthesized
aaaccatttgggcacacccc

SEQ ID NO: 104377 - DNA, 20 bp, Artificial Sequence
  chemically synthesized
atatgtcaggaataaacctg

SEQ ID NO: 104378 - DNA, 20 bp, Artificial Sequence
  chemically synthesized
aatatgtcaggaataaacct

SEQ ID NO: 104379 - DNA, 20 bp, Artificial Sequence
  chemically synthesized
caatatgtcaggaataaacc

SEQ ID NO: 104380 - DNA, 20 bp, Artificial Sequence
  chemically synthesized
gacttggtattcaatatgtc

SEQ ID NO: 104381 - DNA, 20 bp, Artificial Sequence
  chemically synthesized
agacttggtattcaatatgt

SEQ ID NO: 104382 - DNA, 20 bp, Artificial Sequence
  chemically synthesized
ttcctgacatattgaatacc

SEQ ID NO: 104383 - DNA, 20 bp, Artificial Sequence
  chemically synthesized
atattgaataccaagtctgt

SEQ ID NO: 104384 - DNA, 20 bp, Artificial Sequence
  chemically synthesized
aattctgtgacttacagact

SEQ ID NO: 104385 - DNA, 20 bp, Artificial Sequence
  chemically synthesized
aataccaagtctgtaagtca

SEQ ID NO: 104386 - DNA, 20 bp, Artificial Sequence
  chemically synthesized
aatttgaattctgtgactta

SEQ ID NO: 104387 - DNA, 20 bp, Artificial Sequence
  chemically synthesized
gtcacagaattcaaattaca

SEQ ID NO: 104388 - DNA, 20 bp, Artificial Sequence
  chemically synthesized
attcaaattacaaagaccat

SEQ ID NO: 104389 - DNA, 20 bp, Artificial Sequence
  chemically synthesized
aaattacaaagaccatcaga

SEQ ID NO: 104390 - DNA, 20 bp, Artificial Sequence
  chemically synthesized
tcaaaaatcttgctttctga

SEQ ID NO: 104391 - DNA, 20 bp, Artificial Sequence
  chemically synthesized
tacaaagaccatcagaaagc

SEQ ID NO: 104392 - DNA, 20 bp, Artificial Sequence
  chemically synthesized
caagatttttgatgcgctac

SEQ ID NO: 104393 - DNA, 20 bp, Artificial Sequence
  chemically synthesized
agatttttgatgcgctacca

SEQ ID NO: 104394 - DNA, 20 bp, Artificial Sequence
  chemically synthesized
attagtctaagtggctctgg

SEQ ID NO: 104395 - DNA, 20 bp, Artificial Sequence
  chemically synthesized
tgaattagtctaagtggctc

SEQ ID NO: 104396 - DNA, 20 bp, Artificial Sequence
  chemically synthesized
gatgcgctaccagagccact

SEQ ID NO: 104397 - DNA, 20 bp, Artificial Sequence
  chemically synthesized
agtttctgaattagtctaag

SEQ ID NO: 104398 - DNA, 20 bp, Artificial Sequence
  chemically synthesized
cttagtttctgaattagtct

SEQ ID NO: 104399 - DNA, 20 bp, Artificial Sequence
  chemically synthesized
cagagccacttagactaatt

SEQ ID NO: 104400 - DNA, 20 bp, Artificial Sequence
  chemically synthesized
cctcatcttagtttctgaat

SEQ ID NO: 104401 - DNA, 20 bp, Artificial Sequence
  chemically synthesized
cttagactaattcagaaact

SEQ ID NO: 104402 - DNA, 20 bp, Artificial Sequence
  chemically synthesized
actaattcagaaactaagat

SEQ ID NO: 104403 - DNA, 20 bp, Artificial Sequence
  chemically synthesized
ctaattcagaaactaagatg

SEQ ID NO: 104404 - DNA, 20 bp, Artificial Sequence
  chemically synthesized
tttataggccagcctcatct

SEQ ID NO: 104405 - DNA, 20 bp, Artificial Sequence
  chemically synthesized
ttcagaaactaagatgaggc

SEQ ID NO: 104406 - DNA, 20 bp, Artificial Sequence
  chemically synthesized
aataagcttcatttataggc

SEQ ID NO: 104407 - DNA, 20 bp, Artificial Sequence
  chemically synthesized
atgaggctggcctataaatg

SEQ ID NO: 104408 - DNA, 20 bp, Artificial Sequence
  chemically synthesized
taccaataagcttcatttat

SEQ ID NO: 104409 - DNA, 20 bp, Artificial Sequence
  chemically synthesized
ctaccaataagcttcattta

SEQ ID NO: 104410 - DNA, 20 bp, Artificial Sequence
  chemically synthesized
ggcctataaatgaagcttat

SEQ ID NO: 104411 - DNA, 20 bp, Artificial Sequence
  chemically synthesized
ctataaatgaagcttattgg

SEQ ID NO: 104412 - DNA, 20 bp, Artificial Sequence
  chemically synthesized
taccagttgtatctaccaat

SEQ ID NO: 104413 - DNA, 20 bp, Artificial Sequence
  chemically synthesized
agcttattggtagatacaac

SEQ ID NO: 104414 - DNA, 20 bp, Artificial Sequence
  chemically synthesized
ggtagatacaactggtactc

SEQ ID NO: 104415 - DNA, 20 bp, Artificial Sequence
  chemically synthesized
gtagatacaactggtactcc

SEQ ID NO: 104416 - DNA, 20 bp, Artificial Sequence
  chemically synthesized
cctttgctgccctggagtac

SEQ ID NO: 104417 - DNA, 20 bp, Artificial Sequence
  chemically synthesized
tagatacaactggtactcca

SEQ ID NO: 104418 - DNA, 20 bp, Artificial Sequence
  chemically synthesized
atacaactggtactccaggg

SEQ ID NO: 104419 - DNA, 20 bp, Artificial Sequence
  chemically synthesized
atcttccctttgctgccctg

SEQ ID NO: 104420 - DNA, 20 bp, Artificial Sequence
  chemically synthesized
ttatcttccctttgctgccc

SEQ ID NO: 104421 - DNA, 20 bp, Artificial Sequence
  chemically synthesized
actggtactccagggcagca

SEQ ID NO: 104422 - DNA, 20 bp, Artificial Sequence
  chemically synthesized
ctggtactccagggcagcaa

SEQ ID NO: 104423 - DNA, 20 bp, Artificial Sequence
  chemically synthesized
tggtactccagggcagcaaa

SEQ ID NO: 104424 - DNA, 20 bp, Artificial Sequence
  chemically synthesized
tactccagggcagcaaaggg

SEQ ID NO: 104425 - DNA, 20 bp, Artificial Sequence
  chemically synthesized
ttccaaggtgacgcattgca

SEQ ID NO: 104426 - DNA, 20 bp, Artificial Sequence
  chemically synthesized
atctgtgcaatgcgtcacct

SEQ ID NO: 104427 - DNA, 20 bp, Artificial Sequence
  chemically synthesized
tgcaatgcgtcaccttggaa

SEQ ID NO: 104428 - DNA, 20 bp, Artificial Sequence
  chemically synthesized
aatagcaattgacttttcca

SEQ ID NO: 104429 - DNA, 20 bp, Artificial Sequence
  chemically synthesized
aaatagcaattgacttttcc

SEQ ID NO: 104430 - DNA, 20 bp, Artificial Sequence
  chemically synthesized
ttgaaatgaagttaaataaa

SEQ ID NO: 104431 - DNA, 20 bp, Artificial Sequence
  chemically synthesized
aataattgttggttgaaatg

SEQ ID NO: 104432 - DNA, 20 bp, Artificial Sequence
  chemically synthesized
ttgttgttaataataattgt

SEQ ID NO: 104433 - DNA, 20 bp, Artificial Sequence
  chemically synthesized
ataattttcaacaagatacg

SEQ ID NO: 104434 - DNA, 20 bp, Artificial Sequence
  chemically synthesized
ttctattcataattttcaac

SEQ ID NO: 104435 - DNA, 20 bp, Artificial Sequence
  chemically synthesized
atcttgttgaaaattatgaa

SEQ ID NO: 104436 - DNA, 20 bp, Artificial Sequence
  chemically synthesized
attatgaatagaatgattaa

SEQ ID NO: 104437 - DNA, 20 bp, Artificial Sequence
  chemically synthesized
ttatgaatagaatgattaac

SEQ ID NO: 104438 - DNA, 20 bp, Artificial Sequence
  chemically synthesized
acaaaatcattgccttcaat

SEQ ID NO: 104439 - DNA, 20 bp, Artificial Sequence
  chemically synthesized
atcagctgtgaacttattga

SEQ ID NO: 104440 - DNA, 20 bp, Artificial Sequence
  chemically synthesized
tatcagctgtgaacttattg

SEQ ID NO: 104441 - DNA, 20 bp, Artificial Sequence
  chemically synthesized
cattgccttcaataagttca

SEQ ID NO: 104442 - DNA, 20 bp, Artificial Sequence
  chemically synthesized
caataagttcacagctgata

SEQ ID NO: 104443 - DNA, 20 bp, Artificial Sequence
  chemically synthesized
aataagttcacagctgataa

SEQ ID NO: 104444 - DNA, 20 bp, Artificial Sequence
  chemically synthesized
ccctgttttagagcctttat

SEQ ID NO: 104445 - DNA, 20 bp, Artificial Sequence
  chemically synthesized
agctgataaaggctctaaaa

SEQ ID NO: 104446 - DNA, 20 bp, Artificial Sequence
  chemically synthesized
gctgataaaggctctaaaac

SEQ ID NO: 104447 - DNA, 20 bp, Artificial Sequence
  chemically synthesized
ctgataaaggctctaaaaca

SEQ ID NO: 104448 - DNA, 20 bp, Artificial Sequence
  chemically synthesized
cattggaaagccctgtttta

SEQ ID NO: 104449 - DNA, 20 bp, Artificial Sequence
  chemically synthesized
cccattggaaagccctgttt

SEQ ID NO: 104450 - DNA, 20 bp, Artificial Sequence
  chemically synthesized
tctaaaacagggctttccaa

SEQ ID NO: 104451 - DNA, 20 bp, Artificial Sequence
  chemically synthesized
ctaaaacagggctttccaat

SEQ ID NO: 104452 - DNA, 20 bp, Artificial Sequence
  chemically synthesized
gccttagcatacccattgga

SEQ ID NO: 104453 - DNA, 20 bp, Artificial Sequence
  chemically synthesized
atgtgccttagcatacccat

SEQ ID NO: 104454 - DNA, 20 bp, Artificial Sequence
  chemically synthesized
ggctttccaatgggtatgct

SEQ ID NO: 104455 - DNA, 20 bp, Artificial Sequence
  chemically synthesized
gctttccaatgggtatgcta

SEQ ID NO: 104456 - DNA, 20 bp, Artificial Sequence
  chemically synthesized
cccaatcagggcatgtgcct

SEQ ID NO: 104457 - DNA, 20 bp, Artificial Sequence
  chemically synthesized
gctaaggcacatgccctgat

SEQ ID NO: 104458 - DNA, 20 bp, Artificial Sequence
  chemically synthesized
ctaaggcacatgccctgatt

SEQ ID NO: 104459 - DNA, 20 bp, Artificial Sequence
  chemically synthesized
aagtacctataacccaatca

SEQ ID NO: 104460 - DNA, 20 bp, Artificial Sequence
  chemically synthesized
gaagtacctataacccaatc

SEQ ID NO: 104461 - DNA, 20 bp, Artificial Sequence
  chemically synthesized
tgaagtacctataacccaat

SEQ ID NO: 104462 - DNA, 20 bp, Artificial Sequence
  chemically synthesized
cacatgccctgattgggtta

SEQ ID NO: 104463 - DNA, 20 bp, Artificial Sequence
  chemically synthesized
acatgccctgattgggttat

SEQ ID NO: 104464 - DNA, 20 bp, Artificial Sequence
  chemically synthesized
tgattgggttataggtactt

SEQ ID NO: 104465 - DNA, 20 bp, Artificial Sequence
  chemically synthesized
ctgagagggatcgatatctg

SEQ ID NO: 104466 - DNA, 20 bp, Artificial Sequence
  chemically synthesized
cttcagatatcgatccctct

SEQ ID NO: 104467 - DNA, 20 bp, Artificial Sequence
  chemically synthesized
taaccatcccagggctgaga

SEQ ID NO: 104468 - DNA, 20 bp, Artificial Sequence
  chemically synthesized
ctaaccatcccagggctgag

SEQ ID NO: 104469 - DNA, 20 bp, Artificial Sequence
  chemically synthesized
atatcgatccctctcagccc

SEQ ID NO: 104470 - DNA, 20 bp, Artificial Sequence
  chemically synthesized
cctaaccatcccagggctga

SEQ ID NO: 104471 - DNA, 20 bp, Artificial Sequence
  chemically synthesized
tatcgatccctctcagccct

SEQ ID NO: 104472 - DNA, 20 bp, Artificial Sequence
  chemically synthesized
tgcctaaccatcccagggct

SEQ ID NO: 104473 - DNA, 20 bp, Artificial Sequence
  chemically synthesized
gatccctctcagccctggga

SEQ ID NO: 104474 - DNA, 20 bp, Artificial Sequence
  chemically synthesized
taagctgcctaaccatccca

SEQ ID NO: 104475 - DNA, 20 bp, Artificial Sequence
  chemically synthesized
ctaagctgcctaaccatccc

SEQ ID NO: 104476 - DNA, 20 bp, Artificial Sequence
  chemically synthesized
cctctcagccctgggatggt

SEQ ID NO: 104477 - DNA, 20 bp, Artificial Sequence
  chemically synthesized
tctaagctgcctaaccatcc

SEQ ID NO: 104478 - DNA, 20 bp, Artificial Sequence
  chemically synthesized
ctctcagccctgggatggtt

SEQ ID NO: 104479 - DNA, 20 bp, Artificial Sequence
  chemically synthesized
tcagccctgggatggttagg

SEQ ID NO: 104480 - DNA, 20 bp, Artificial Sequence
  chemically synthesized
cctgggatggttaggcagct

SEQ ID NO: 104481 - DNA, 20 bp, Artificial Sequence
  chemically synthesized
tgggatggttaggcagctta

SEQ ID NO: 104482 - DNA, 20 bp, Artificial Sequence
  chemically synthesized
gtaagctggccgaagactct

SEQ ID NO: 104483 - DNA, 20 bp, Artificial Sequence
  chemically synthesized
gttaggcagcttagagtctt

SEQ ID NO: 104484 - DNA, 20 bp, Artificial Sequence
  chemically synthesized
ggcagcttagagtcttcggc

SEQ ID NO: 104485 - DNA, 20 bp, Artificial Sequence
  chemically synthesized
gatatcaggtaagctggccg

SEQ ID NO: 104486 - DNA, 20 bp, Artificial Sequence
  chemically synthesized
catcatgatatcaggtaagc

SEQ ID NO: 104487 - DNA, 20 bp, Artificial Sequence
  chemically synthesized
tgttcatcatgatatcaggt

SEQ ID NO: 104488 - DNA, 20 bp, Artificial Sequence
  chemically synthesized
gatgtgttcatcatgatatc

SEQ ID NO: 104489 - DNA, 20 bp, Artificial Sequence
  chemically synthesized
tgatgtgttcatcatgatat

SEQ ID NO: 104490 - DNA, 20 bp, Artificial Sequence
  chemically synthesized
gatatcatgatgaacagatt

SEQ ID NO: 104491 - DNA, 20 bp, Artificial Sequence
  chemically synthesized
ctttttgatatcatgatgaa

SEQ ID NO: 104492 - DNA, 20 bp, Artificial Sequence
  chemically synthesized
ctgttcatcatgatatcaaa

SEQ ID NO: 104493 - DNA, 20 bp, Artificial Sequence
  chemically synthesized
atcatgatatcaaaaagact

SEQ ID NO: 104494 - DNA, 20 bp, Artificial Sequence
  chemically synthesized
tcatgatatcaaaaagactg

SEQ ID NO: 104495 - DNA, 20 bp, Artificial Sequence
  chemically synthesized
aacttctctgcagtgttcct

SEQ ID NO: 104496 - DNA, 20 bp, Artificial Sequence
  chemically synthesized
aaaaagactgaggaacactg

SEQ ID NO: 104497 - DNA, 20 bp, Artificial Sequence
  chemically synthesized
aaagactgaggaacactgca

SEQ ID NO: 104498 - DNA, 20 bp, Artificial Sequence
  chemically synthesized
gactgaggaacactgcagag

SEQ ID NO: 104499 - DNA, 20 bp, Artificial Sequence
  chemically synthesized
agaaagcccaaacttctctg

SEQ ID NO: 104500 - DNA, 20 bp, Artificial Sequence
  chemically synthesized
aggaacactgcagagaagtt

SEQ ID NO: 104501 - DNA, 20 bp, Artificial Sequence
  chemically synthesized
ggaacactgcagagaagttt

SEQ ID NO: 104502 - DNA, 20 bp, Artificial Sequence
  chemically synthesized
gagaagtttgggctttctta

SEQ ID NO: 104503 - DNA, 20 bp, Artificial Sequence
  chemically synthesized
agtcagtctgttctgtaaga

SEQ ID NO: 104504 - DNA, 20 bp, Artificial Sequence
  chemically synthesized
gtttgggctttcttacagaa

SEQ ID NO: 104505 - DNA, 20 bp, Artificial Sequence
  chemically synthesized
atacagtcagtctgttctgt

SEQ ID NO: 104506 - DNA, 20 bp, Artificial Sequence
  chemically synthesized
tacagaacagactgactgta

SEQ ID NO: 104507 - DNA, 20 bp, Artificial Sequence
  chemically synthesized
cctcagctaagctatacagt

SEQ ID NO: 104508 - DNA, 20 bp, Artificial Sequence
  chemically synthesized
aacagactgactgtatagct

SEQ ID NO: 104509 - DNA, 20 bp, Artificial Sequence
  chemically synthesized
tctccctcagctaagctata

SEQ ID NO: 104510 - DNA, 20 bp, Artificial Sequence
  chemically synthesized
actgactgtatagcttagct

SEQ ID NO: 104511 - DNA, 20 bp, Artificial Sequence
  chemically synthesized
ctgactgtatagcttagctg

SEQ ID NO: 104512 - DNA, 20 bp, Artificial Sequence
  chemically synthesized
tgactgtatagcttagctga

SEQ ID NO: 104513 - DNA, 20 bp, Artificial Sequence
  chemically synthesized
tctccagatctccctcagct

SEQ ID NO: 104514 - DNA, 20 bp, Artificial Sequence
  chemically synthesized
actgtatagcttagctgagg

SEQ ID NO: 104515 - DNA, 20 bp, Artificial Sequence
  chemically synthesized
tctggtctccagatctccct

SEQ ID NO: 104516 - DNA, 20 bp, Artificial Sequence
  chemically synthesized
tagcttagctgagggagatc

SEQ ID NO: 104517 - DNA, 20 bp, Artificial Sequence
  chemically synthesized
gcttagctgagggagatctg

SEQ ID NO: 104518 - DNA, 20 bp, Artificial Sequence
  chemically synthesized
gctgagggagatctggagac

SEQ ID NO: 104519 - DNA, 20 bp, Artificial Sequence
  chemically synthesized
tggaaacatcttctggtctc

SEQ ID NO: 104520 - DNA, 20 bp, Artificial Sequence
  chemically synthesized
gagggagatctggagaccag

SEQ ID NO: 104521 - DNA, 20 bp, Artificial Sequence
  chemically synthesized
cacttcttggaaacatcttc

SEQ ID NO: 104522 - DNA, 20 bp, Artificial Sequence
  chemically synthesized
ggagaccagaagatgtttcc

SEQ ID NO: 104523 - DNA, 20 bp, Artificial Sequence
  chemically synthesized
gaccagaagatgtttccaag

SEQ ID NO: 104524 - DNA, 20 bp, Artificial Sequence
  chemically synthesized
ctgagatttatcacacttct

SEQ ID NO: 104525 - DNA, 20 bp, Artificial Sequence
  chemically synthesized
ccaagaagtgtgataaatct

SEQ ID NO: 104526 - DNA, 20 bp, Artificial Sequence
  chemically synthesized
agtgtgataaatctcagctt

SEQ ID NO: 104527 - DNA, 20 bp, Artificial Sequence
  chemically synthesized
cctgtcttctggcttaagct

SEQ ID NO: 104528 - DNA, 20 bp, Artificial Sequence
  chemically synthesized
tgataaatctcagcttaagc

SEQ ID NO: 104529 - DNA, 20 bp, Artificial Sequence
  chemically synthesized
taaatctcagcttaagccag

SEQ ID NO: 104530 - DNA, 20 bp, Artificial Sequence
  chemically synthesized
tctcacctgtcttctggctt

SEQ ID NO: 104531 - DNA, 20 bp, Artificial Sequence
  chemically synthesized
tctcagcttaagccagaaga

SEQ ID NO: 104532 - DNA, 20 bp, Artificial Sequence
  chemically synthesized
ctcagcttaagccagaagac

SEQ ID NO: 104533 - DNA, 20 bp, Artificial Sequence
  chemically synthesized
aaagactctcacctgtcttc

SEQ ID NO: 104534 - DNA, 20 bp, Artificial Sequence
  chemically synthesized
gcttaagccagaagacaggt

SEQ ID NO: 104535 - DNA, 20 bp, Artificial Sequence
  chemically synthesized
ttaagccagaagacaggtga

SEQ ID NO: 104536 - DNA, 20 bp, Artificial Sequence
  chemically synthesized
aactggctgaaatgttcaca

SEQ ID NO: 104537 - DNA, 20 bp, Artificial Sequence
  chemically synthesized
gagagtctttgtgaacattt

SEQ ID NO: 104538 - DNA, 20 bp, Artificial Sequence
  chemically synthesized
gtctttgtgaacatttcagc

SEQ ID NO: 104539 - DNA, 20 bp, Artificial Sequence
  chemically synthesized
aacatttcagccagtttaat

SEQ ID NO: 104540 - DNA, 20 bp, Artificial Sequence
  chemically synthesized
tgttggattgctcattaaac

SEQ ID NO: 104541 - DNA, 20 bp, Artificial Sequence
  chemically synthesized
ttgacatgtcttaatgttgt

SEQ ID NO: 104542 - DNA, 20 bp, Artificial Sequence
  chemically synthesized
atgagcaatccaacaacatt

SEQ ID NO: 104543 - DNA, 20 bp, Artificial Sequence
  chemically synthesized
caacaacattaagacatgtc

SEQ ID NO: 104544 - DNA, 20 bp, Artificial Sequence
  chemically synthesized
acattaagacatgtcaagat

SEQ ID NO: 104545 - DNA, 20 bp, Artificial Sequence
  chemically synthesized
taagacatgtcaagattagc

SEQ ID NO: 104546 - DNA, 20 bp, Artificial Sequence
  chemically synthesized
atgtcaagattagcaagctt

SEQ ID NO: 104547 - DNA, 20 bp, Artificial Sequence
  chemically synthesized
cacttttatcacacaatctg

SEQ ID NO: 104548 - DNA, 20 bp, Artificial Sequence
  chemically synthesized
agcttcagattgtgtgataa

SEQ ID NO: 104549 - DNA, 20 bp, Artificial Sequence
  chemically synthesized
gattgtgtgataaaagtgca

SEQ ID NO: 104550 - DNA, 20 bp, Artificial Sequence
  chemically synthesized
ttgtgtgataaaagtgcaaa

SEQ ID NO: 104551 - DNA, 20 bp, Artificial Sequence
  chemically synthesized
taaaagtgcaaagagttcgc

SEQ ID NO: 104552 - DNA, 20 bp, Artificial Sequence
  chemically synthesized
aaagtgcaaagagttcgcta

SEQ ID NO: 104553 - DNA, 20 bp, Artificial Sequence
  chemically synthesized
caaattattcagtatggctc

SEQ ID NO: 104554 - DNA, 20 bp, Artificial Sequence
  chemically synthesized
gaaagacaaattattcagta

SEQ ID NO: 104555 - DNA, 20 bp, Artificial Sequence
  chemically synthesized
gaagagaaagacaaattatt

SEQ ID NO: 104556 - DNA, 20 bp, Artificial Sequence
  chemically synthesized
gcagacaaaggtagaagaga

SEQ ID NO: 104557 - DNA, 20 bp, Artificial Sequence
  chemically synthesized
gttggcagacaaaggtagaa

SEQ ID NO: 104558 - DNA, 20 bp, Artificial Sequence
  chemically synthesized
ttgttggcagacaaaggtag

SEQ ID NO: 104559 - DNA, 20 bp, Artificial Sequence
  chemically synthesized
gaattgttggcagacaaagg

SEQ ID NO: 104560 - DNA, 20 bp, Artificial Sequence
  chemically synthesized
gtagaattgttggcagacaa

SEQ ID NO: 104561 - DNA, 20 bp, Artificial Sequence
  chemically synthesized
ggtagaattgttggcagaca

SEQ ID NO: 104562 - DNA, 20 bp, Artificial Sequence
  chemically synthesized
ccaatgggtagaattgttgg

SEQ ID NO: 104563 - DNA, 20 bp, Artificial Sequence
  chemically synthesized
tggccaatgggtagaattgt

SEQ ID NO: 104564 - DNA, 20 bp, Artificial Sequence
  chemically synthesized
ctgccaacaattctacccat

SEQ ID NO: 104565 - DNA, 20 bp, Artificial Sequence
  chemically synthesized
agaagcatttggccaatggg

SEQ ID NO: 104566 - DNA, 20 bp, Artificial Sequence
  chemically synthesized
gaaagaagcatttggccaat

SEQ ID NO: 104567 - DNA, 20 bp, Artificial Sequence
  chemically synthesized
agaaagaagcatttggccaa

SEQ ID NO: 104568 - DNA, 20 bp, Artificial Sequence
  chemically synthesized
ttattagagaaagaagcatt

SEQ ID NO: 104569 - DNA, 20 bp, Artificial Sequence
  chemically synthesized
caagaatttattagagaaag

SEQ ID NO: 104570 - DNA, 20 bp, Artificial Sequence
  chemically synthesized
gaacaagaatttattagaga

SEQ ID NO: 104571 - DNA, 20 bp, Artificial Sequence
  chemically synthesized
gcaagaacaagaatttatta

SEQ ID NO: 104572 - DNA, 20 bp, Artificial Sequence
  chemically synthesized
gtgcaagaacaagaatttat

SEQ ID NO: 104573 - DNA, 20 bp, Artificial Sequence
  chemically synthesized
gcaagtgattgtgcaagaac

SEQ ID NO: 104574 - DNA, 20 bp, Artificial Sequence
  chemically synthesized
aaaggagcaagtgattgtgc

SEQ ID NO: 104575 - DNA, 20 bp, Artificial Sequence
  chemically synthesized
tttaggtggttcaaaggagc

SEQ ID NO: 104576 - DNA, 20 bp, Artificial Sequence
  chemically synthesized
gcgatttaggtggttcaaag

SEQ ID NO: 104577 - DNA, 20 bp, Artificial Sequence
  chemically synthesized
cagcgatttaggtggttcaa

SEQ ID NO: 104578 - DNA, 20 bp, Artificial Sequence
  chemically synthesized
acagcgatttaggtggttca

SEQ ID NO: 104579 - DNA, 20 bp, Artificial Sequence
  chemically synthesized
ttgggaaacagcgatttagg

SEQ ID NO: 104580 - DNA, 20 bp, Artificial Sequence
  chemically synthesized
attttgggaaacagcgattt

SEQ ID NO: 104581 - DNA, 20 bp, Artificial Sequence
  chemically synthesized
cattttgggaaacagcgatt

SEQ ID NO: 104582 - DNA, 20 bp, Artificial Sequence
  chemically synthesized
gcaaaccacattttgggaaa

SEQ ID NO: 104583 - DNA, 20 bp, Artificial Sequence
  chemically synthesized
aatcgctgtttcccaaaatg

SEQ ID NO: 104584 - DNA, 20 bp, Artificial Sequence
  chemically synthesized
tgttcagcaaaccacatttt

SEQ ID NO: 104585 - DNA, 20 bp, Artificial Sequence
  chemically synthesized
ctgttcagcaaaccacattt

SEQ ID NO: 104586 - DNA, 20 bp, Artificial Sequence
  chemically synthesized
ccaaaatgtggtttgctgaa

SEQ ID NO: 104587 - DNA, 20 bp, Artificial Sequence
  chemically synthesized
aaatgtggtttgctgaacag

SEQ ID NO: 104588 - DNA, 20 bp, Artificial Sequence
  chemically synthesized
ggctccctaccactactgtt

SEQ ID NO: 104589 - DNA, 20 bp, Artificial Sequence
  chemically synthesized
tgtggtttgctgaacagtag

SEQ ID NO: 104590 - DNA, 20 bp, Artificial Sequence
  chemically synthesized
ggtttgctgaacagtagtgg

SEQ ID NO: 104591 - DNA, 20 bp, Artificial Sequence
  chemically synthesized
gtttgctgaacagtagtggt

SEQ ID NO: 104592 - DNA, 20 bp, Artificial Sequence
  chemically synthesized
tttgctgaacagtagtggta

SEQ ID NO: 104593 - DNA, 20 bp, Artificial Sequence
  chemically synthesized
tgctgaacagtagtggtagg

SEQ ID NO: 104594 - DNA, 20 bp, Artificial Sequence
  chemically synthesized
atctgtgtaacatggtaaat

SEQ ID NO: 104595 - DNA, 20 bp, Artificial Sequence
  chemically synthesized
agccaatttaccatgttaca

SEQ ID NO: 104596 - DNA, 20 bp, Artificial Sequence
  chemically synthesized
agctgtttatctgtgtaaca

SEQ ID NO: 104597 - DNA, 20 bp, Artificial Sequence
  chemically synthesized
taccatgttacacagataaa

SEQ ID NO: 104598 - DNA, 20 bp, Artificial Sequence
  chemically synthesized
ttacacagataaacagctta

SEQ ID NO: 104599 - DNA, 20 bp, Artificial Sequence
  chemically synthesized
aatattaaaatttaaactat

SEQ ID NO: 104600 - DNA, 20 bp, Artificial Sequence
  chemically synthesized
tttaaattttaatattcatt

SEQ ID NO: 104601 - DNA, 20 bp, Artificial Sequence
  chemically synthesized
catttagttttatctgtatt

SEQ ID NO: 104602 - DNA, 20 bp, Artificial Sequence
  chemically synthesized
atttagttttatctgtatta

SEQ ID NO: 104603 - DNA, 20 bp, Artificial Sequence
  chemically synthesized
cagtgtttttttccttaata

SEQ ID NO: 104604 - DNA, 20 bp, Artificial Sequence
  chemically synthesized
ggaaaaaaacactgcaacat

SEQ ID NO: 104605 - DNA, 20 bp, Artificial Sequence
  chemically synthesized
aaaactgtagtctgatgttg

SEQ ID NO: 104606 - DNA, 20 bp, Artificial Sequence
  chemically synthesized
aacactgcaacatcagacta

SEQ ID NO: 104607 - DNA, 20 bp, Artificial Sequence
  chemically synthesized
tgataattcccacaaaactg

SEQ ID NO: 104608 - DNA, 20 bp, Artificial Sequence
  chemically synthesized
aacatcagactacagttttg

SEQ ID NO: 104609 - DNA, 20 bp, Artificial Sequence
  chemically synthesized
acatcagactacagttttgt

SEQ ID NO: 104610 - DNA, 20 bp, Artificial Sequence
  chemically synthesized
ttttgtgggaattatcactt

SEQ ID NO: 104611 - DNA, 20 bp, Artificial Sequence
  chemically synthesized
tttgtgggaattatcactta

SEQ ID NO: 104612 - DNA, 20 bp, Artificial Sequence
  chemically synthesized
tgttttctgcttttagcctt

SEQ ID NO: 104613 - DNA, 20 bp, Artificial Sequence
  chemically synthesized
gaattatcacttaaggctaa

SEQ ID NO: 104614 - DNA, 20 bp, Artificial Sequence
  chemically synthesized
ttatcacttaaggctaaaag

SEQ ID NO: 104615 - DNA, 20 bp, Artificial Sequence
  chemically synthesized
ctcattttgttttctgcttt

SEQ ID NO: 104616 - DNA, 20 bp, Artificial Sequence
  chemically synthesized
ctaaaagcagaaaacaaaat

SEQ ID NO: 104617 - DNA, 20 bp, Artificial Sequence
  chemically synthesized
aaacaaaatgagctgatttt

SEQ ID NO: 104618 - DNA, 20 bp, Artificial Sequence
  chemically synthesized
cttaatgtttttcttaaaat

SEQ ID NO: 104619 - DNA, 20 bp, Artificial Sequence
  chemically synthesized
ctgattttaagaaaaacatt

SEQ ID NO: 104620 - DNA, 20 bp, Artificial Sequence
  chemically synthesized
gaaaaacattaagtaaataa

SEQ ID NO: 104621 - DNA, 20 bp, Artificial Sequence
  chemically synthesized
atagtatatgtgttattcaa

SEQ ID NO: 104622 - DNA, 20 bp, Artificial Sequence
  chemically synthesized
ttattcaaaagattgaacaa

SEQ ID NO: 104623 - DNA, 20 bp, Artificial Sequence
  chemically synthesized
attcaaaagattgaacaatg

SEQ ID NO: 104624 - DNA, 20 bp, Artificial Sequence
  chemically synthesized
aaaattgtcacagaagcaat

SEQ ID NO: 104625 - DNA, 20 bp, Artificial Sequence
  chemically synthesized
gaaaattgtcacagaagcaa

SEQ ID NO: 104626 - DNA, 20 bp, Artificial Sequence
  chemically synthesized
tttatggaaaattgtcacag

SEQ ID NO: 104627 - DNA, 20 bp, Artificial Sequence
  chemically synthesized
aagtttatggaaaattgtca

SEQ ID NO: 104628 - DNA, 20 bp, Artificial Sequence
  chemically synthesized
gttttaggccagtaagttta

SEQ ID NO: 104629 - DNA, 20 bp, Artificial Sequence
  chemically synthesized
acaattttccataaacttac

SEQ ID NO: 104630 - DNA, 20 bp, Artificial Sequence
  chemically synthesized
ttgtgttgttttaggccagt

SEQ ID NO: 104631 - DNA, 20 bp, Artificial Sequence
  chemically synthesized
caatttgtgttgttttaggc

SEQ ID NO: 104632 - DNA, 20 bp, Artificial Sequence
  chemically synthesized
taatcaatttgtgttgtttt

SEQ ID NO: 104633 - DNA, 20 bp, Artificial Sequence
  chemically synthesized
ataatcaatttgtgttgttt

SEQ ID NO: 104634 - DNA, 20 bp, Artificial Sequence
  chemically synthesized
aacacaaattgattatctta

SEQ ID NO: 104635 - DNA, 20 bp, Artificial Sequence
  chemically synthesized
aattgattatcttatagttt

SEQ ID NO: 104636 - DNA, 20 bp, Artificial Sequence
  chemically synthesized
cttctgacttccaaaactat

SEQ ID NO: 104637 - DNA, 20 bp, Artificial Sequence
  chemically synthesized
tgattatcttatagttttgg

SEQ ID NO: 104638 - DNA, 20 bp, Artificial Sequence
  chemically synthesized
tatcttatagttttggaagt

SEQ ID NO: 104639 - DNA, 20 bp, Artificial Sequence
  chemically synthesized
cttatagttttggaagtcag

SEQ ID NO: 104640 - DNA, 20 bp, Artificial Sequence
  chemically synthesized
tggaagtcagaagtttgaaa

SEQ ID NO: 104641 - DNA, 20 bp, Artificial Sequence
  chemically synthesized
ggaagtcagaagtttgaaat

SEQ ID NO: 104642 - DNA, 20 bp, Artificial Sequence
  chemically synthesized
gaagtttgaaatgggtttca

SEQ ID NO: 104643 - DNA, 20 bp, Artificial Sequence
  chemically synthesized
ggtttcatggattaaaatga

SEQ ID NO: 104644 - DNA, 20 bp, Artificial Sequence
  chemically synthesized
atggattaaaatgaaagtgt

SEQ ID NO: 104645 - DNA, 20 bp, Artificial Sequence
  chemically synthesized
gattaaaatgaaagtgttgg

SEQ ID NO: 104646 - DNA, 20 bp, Artificial Sequence
  chemically synthesized
attaaaatgaaagtgttggc

SEQ ID NO: 104647 - DNA, 20 bp, Artificial Sequence
  chemically synthesized
ttaaaatgaaagtgttggca

SEQ ID NO: 104648 - DNA, 20 bp, Artificial Sequence
  chemically synthesized
aagcttcttcagaaggagta

SEQ ID NO: 104649 - DNA, 20 bp, Artificial Sequence
  chemically synthesized
gcagggctatactccttctg

SEQ ID NO: 104650 - DNA, 20 bp, Artificial Sequence
  chemically synthesized
cctctaagcttcttcagaag

SEQ ID NO: 104651 - DNA, 20 bp, Artificial Sequence
  chemically synthesized
gggctatactccttctgaag

SEQ ID NO: 104652 - DNA, 20 bp, Artificial Sequence
  chemically synthesized
gtcctctaagcttcttcaga

SEQ ID NO: 104653 - DNA, 20 bp, Artificial Sequence
  chemically synthesized
tgtcctctaagcttcttcag

SEQ ID NO: 104654 - DNA, 20 bp, Artificial Sequence
  chemically synthesized
gattgtcctctaagcttctt

SEQ ID NO: 104655 - DNA, 20 bp, Artificial Sequence
  chemically synthesized
atactccttctgaagaagct

SEQ ID NO: 104656 - DNA, 20 bp, Artificial Sequence
  chemically synthesized
actccttctgaagaagctta

SEQ ID NO: 104657 - DNA, 20 bp, Artificial Sequence
  chemically synthesized
ctccttctgaagaagcttag

SEQ ID NO: 104658 - DNA, 20 bp, Artificial Sequence
  chemically synthesized
agggaaatagattgtcctct

SEQ ID NO: 104659 - DNA, 20 bp, Artificial Sequence
  chemically synthesized
tgctggaaaaggcagggaaa

SEQ ID NO: 104660 - DNA, 20 bp, Artificial Sequence
  chemically synthesized
atctaatgctggaaaaggca

SEQ ID NO: 104661 - DNA, 20 bp, Artificial Sequence
  chemically synthesized
catctaatgctggaaaaggc

SEQ ID NO: 104662 - DNA, 20 bp, Artificial Sequence
  chemically synthesized
atctatttccctgccttttc

SEQ ID NO: 104663 - DNA, 20 bp, Artificial Sequence
  chemically synthesized
gcatctaatgctggaaaagg

SEQ ID NO: 104664 - DNA, 20 bp, Artificial Sequence
  chemically synthesized
gtagcatctaatgctggaaa

SEQ ID NO: 104665 - DNA, 20 bp, Artificial Sequence
  chemically synthesized
ggtagcatctaatgctggaa

SEQ ID NO: 104666 - DNA, 20 bp, Artificial Sequence
  chemically synthesized
ttccctgccttttccagcat

SEQ ID NO: 104667 - DNA, 20 bp, Artificial Sequence
  chemically synthesized
atgttggtagcatctaatgc

SEQ ID NO: 104668 - DNA, 20 bp, Artificial Sequence
  chemically synthesized
cattagccaaacaatgttgg

SEQ ID NO: 104669 - DNA, 20 bp, Artificial Sequence
  chemically synthesized
ggccattagccaaacaatgt

SEQ ID NO: 104670 - DNA, 20 bp, Artificial Sequence
  chemically synthesized
tagatgctaccaacattgtt

SEQ ID NO: 104671 - DNA, 20 bp, Artificial Sequence
  chemically synthesized
taccaacattgtttggctaa

SEQ ID NO: 104672 - DNA, 20 bp, Artificial Sequence
  chemically synthesized
aagatagagaaaggggccat

SEQ ID NO: 104673 - DNA, 20 bp, Artificial Sequence
  chemically synthesized
ggctttgaagatagagaaag

SEQ ID NO: 104674 - DNA, 20 bp, Artificial Sequence
  chemically synthesized
tggctttgaagatagagaaa

SEQ ID NO: 104675 - DNA, 20 bp, Artificial Sequence
  chemically synthesized
ctggctttgaagatagagaa

SEQ ID NO: 104676 - DNA, 20 bp, Artificial Sequence
  chemically synthesized
gctggctttgaagatagaga

SEQ ID NO: 104677 - DNA, 20 bp, Artificial Sequence
  chemically synthesized
ccctgctggctttgaagata

SEQ ID NO: 104678 - DNA, 20 bp, Artificial Sequence
  chemically synthesized
ggcccctttctctatcttca

SEQ ID NO: 104679 - DNA, 20 bp, Artificial Sequence
  chemically synthesized
gcccctgctggctttgaaga

SEQ ID NO: 104680 - DNA, 20 bp, Artificial Sequence
  chemically synthesized
cctttctctatcttcaaagc

SEQ ID NO: 104681 - DNA, 20 bp, Artificial Sequence
  chemically synthesized
gatagcccctgctggctttg

SEQ ID NO: 104682 - DNA, 20 bp, Artificial Sequence
  chemically synthesized
ttctctatcttcaaagccag

SEQ ID NO: 104683 - DNA, 20 bp, Artificial Sequence
  chemically synthesized
tctctatcttcaaagccagc

SEQ ID NO: 104684 - DNA, 20 bp, Artificial Sequence
  chemically synthesized
ctctatcttcaaagccagca

SEQ ID NO: 104685 - DNA, 20 bp, Artificial Sequence
  chemically synthesized
tctatcttcaaagccagcag

SEQ ID NO: 104686 - DNA, 20 bp, Artificial Sequence
  chemically synthesized
gagatgaagatagcccctgc

SEQ ID NO: 104687 - DNA, 20 bp, Artificial Sequence
  chemically synthesized
gggagtcagagagatgaaga

SEQ ID NO: 104688 - DNA, 20 bp, Artificial Sequence
  chemically synthesized
gagtgggagtcagagagatg

SEQ ID NO: 104689 - DNA, 20 bp, Artificial Sequence
  chemically synthesized
gcaggagagtgggagtcaga

SEQ ID NO: 104690 - DNA, 20 bp, Artificial Sequence
  chemically synthesized
aagcaggagagtgggagtca

SEQ ID NO: 104691 - DNA, 20 bp, Artificial Sequence
  chemically synthesized
ggaagcaggagagtgggagt

SEQ ID NO: 104692 - DNA, 20 bp, Artificial Sequence
  chemically synthesized
aaatggaagcaggagagtgg

SEQ ID NO: 104693 - DNA, 20 bp, Artificial Sequence
  chemically synthesized
gaaaatggaagcaggagagt

SEQ ID NO: 104694 - DNA, 20 bp, Artificial Sequence
  chemically synthesized
tgaaaatggaagcaggagag

SEQ ID NO: 104695 - DNA, 20 bp, Artificial Sequence
  chemically synthesized
aagtgaaaatggaagcagga

SEQ ID NO: 104696 - DNA, 20 bp, Artificial Sequence
  chemically synthesized
ataagtgaaaatggaagcag

SEQ ID NO: 104697 - DNA, 20 bp, Artificial Sequence
  chemically synthesized
atataagtgaaaatggaagc

SEQ ID NO: 104698 - DNA, 20 bp, Artificial Sequence
  chemically synthesized
catataagtgaaaatggaag

SEQ ID NO: 104699 - DNA, 20 bp, Artificial Sequence
  chemically synthesized
gttcatataagtgaaaatgg

SEQ ID NO: 104700 - DNA, 20 bp, Artificial Sequence
  chemically synthesized
agggttcatataagtgaaaa

SEQ ID NO: 104701 - DNA, 20 bp, Artificial Sequence
  chemically synthesized
tctaaccacagggttcatat

SEQ ID NO: 104702 - DNA, 20 bp, Artificial Sequence
  chemically synthesized
tttcacttatatgaaccctg

SEQ ID NO: 104703 - DNA, 20 bp, Artificial Sequence
  chemically synthesized
acttatatgaaccctgtggt

SEQ ID NO: 104704 - DNA, 20 bp, Artificial Sequence
  chemically synthesized
atgggcctaatctaaccaca

SEQ ID NO: 104705 - DNA, 20 bp, Artificial Sequence
  chemically synthesized
gatgggcctaatctaaccac

SEQ ID NO: 104706 - DNA, 20 bp, Artificial Sequence
  chemically synthesized
agatgggcctaatctaacca

SEQ ID NO: 104707 - DNA, 20 bp, Artificial Sequence
  chemically synthesized
tatgaaccctgtggttagat

SEQ ID NO: 104708 - DNA, 20 bp, Artificial Sequence
  chemically synthesized
atgaaccctgtggttagatt

SEQ ID NO: 104709 - DNA, 20 bp, Artificial Sequence
  chemically synthesized
ttagattaggcccatctgaa

SEQ ID NO: 104710 - DNA, 20 bp, Artificial Sequence
  chemically synthesized
attttatggactattcagat

SEQ ID NO: 104711 - DNA, 20 bp, Artificial Sequence
  chemically synthesized
gattttatggactattcaga

SEQ ID NO: 104712 - DNA, 20 bp, Artificial Sequence
  chemically synthesized
gggagattttatggactatt

SEQ ID NO: 104713 - DNA, 20 bp, Artificial Sequence
  chemically synthesized
tttgagatggggagatttta

SEQ ID NO: 104714 - DNA, 20 bp, Artificial Sequence
  chemically synthesized
gcaggtgactttgagatggg

SEQ ID NO: 104715 - DNA, 20 bp, Artificial Sequence
  chemically synthesized
cataaaatctccccatctca

SEQ ID NO: 104716 - DNA, 20 bp, Artificial Sequence
  chemically synthesized
aagcaggtgactttgagatg

SEQ ID NO: 104717 - DNA, 20 bp, Artificial Sequence
  chemically synthesized
taagcaggtgactttgagat

SEQ ID NO: 104718 - DNA, 20 bp, Artificial Sequence
  chemically synthesized
ctaagcaggtgactttgaga

SEQ ID NO: 104719 - DNA, 20 bp, Artificial Sequence
  chemically synthesized
gttgctaagcaggtgacttt

SEQ ID NO: 104720 - DNA, 20 bp, Artificial Sequence
  chemically synthesized
ccatctcaaagtcacctgct

SEQ ID NO: 104721 - DNA, 20 bp, Artificial Sequence
  chemically synthesized
cggaattaaggttgctaagc

SEQ ID NO: 104722 - DNA, 20 bp, Artificial Sequence
  chemically synthesized
acggaattaaggttgctaag

SEQ ID NO: 104723 - DNA, 20 bp, Artificial Sequence
  chemically synthesized
cagacggaattaaggttgct

SEQ ID NO: 104724 - DNA, 20 bp, Artificial Sequence
  chemically synthesized
taatattccagacggaatta

SEQ ID NO: 104725 - DNA, 20 bp, Artificial Sequence
  chemically synthesized
ttaatattccagacggaatt

SEQ ID NO: 104726 - DNA, 20 bp, Artificial Sequence
  chemically synthesized
ttagcaaccttaattccgtc

SEQ ID NO: 104727 - DNA, 20 bp, Artificial Sequence
  chemically synthesized
tagggaattaatattccaga

SEQ ID NO: 104728 - DNA, 20 bp, Artificial Sequence
  chemically synthesized
gcagtagggaattaatattc

SEQ ID NO: 104729 - DNA, 20 bp, Artificial Sequence
  chemically synthesized
gaatattaattccctactgc

SEQ ID NO: 104730 - DNA, 20 bp, Artificial Sequence
  chemically synthesized
aatattaattccctactgcc

SEQ ID NO: 104731 - DNA, 20 bp, Artificial Sequence
  chemically synthesized
tgctgtgctccctggcagta

SEQ ID NO: 104732 - DNA, 20 bp, Artificial Sequence
  chemically synthesized
atattaattccctactgcca

SEQ ID NO: 104733 - DNA, 20 bp, Artificial Sequence
  chemically synthesized
atgctgtgctccctggcagt

SEQ ID NO: 104734 - DNA, 20 bp, Artificial Sequence
  chemically synthesized
tatgctgtgctccctggcag

SEQ ID NO: 104735 - DNA, 20 bp, Artificial Sequence
  chemically synthesized
attaattccctactgccagg

SEQ ID NO: 104736 - DNA, 20 bp, Artificial Sequence
  chemically synthesized
gaatatgctgtgctccctgg

SEQ ID NO: 104737 - DNA, 20 bp, Artificial Sequence
  chemically synthesized
ttccctactgccagggagca

SEQ ID NO: 104738 - DNA, 20 bp, Artificial Sequence
  chemically synthesized
tgtgaatatgctgtgctccc

SEQ ID NO: 104739 - DNA, 20 bp, Artificial Sequence
  chemically synthesized
cagggagcacagcatattca

SEQ ID NO: 104740 - DNA, 20 bp, Artificial Sequence
  chemically synthesized
agggagcacagcatattcac

SEQ ID NO: 104741 - DNA, 20 bp, Artificial Sequence
  chemically synthesized
cacagcatattcacaggttc

SEQ ID NO: 104742 - DNA, 20 bp, Artificial Sequence
  chemically synthesized
acagcatattcacaggttct

SEQ ID NO: 104743 - DNA, 20 bp, Artificial Sequence
  chemically synthesized
cagcatattcacaggttctg

SEQ ID NO: 104744 - DNA, 20 bp, Artificial Sequence
  chemically synthesized
ccctcgaagatgttaatccc

SEQ ID NO: 104745 - DNA, 20 bp, Artificial Sequence
  chemically synthesized
ttctggggattaacatcttc

SEQ ID NO: 104746 - DNA, 20 bp, Artificial Sequence
  chemically synthesized
tctggggattaacatcttcg

SEQ ID NO: 104747 - DNA, 20 bp, Artificial Sequence
  chemically synthesized
ctggggattaacatcttcga

SEQ ID NO: 104748 - DNA, 20 bp, Artificial Sequence
  chemically synthesized
tggggattaacatcttcgag

SEQ ID NO: 104749 - DNA, 20 bp, Artificial Sequence
  chemically synthesized
gcagaatcatgggcccctcg

SEQ ID NO: 104750 - DNA, 20 bp, Artificial Sequence
  chemically synthesized
cctgtggtaggcagaatcat

SEQ ID NO: 104751 - DNA, 20 bp, Artificial Sequence
  chemically synthesized
ccctgtggtaggcagaatca

SEQ ID NO: 104752 - DNA, 20 bp, Artificial Sequence
  chemically synthesized
gcccatgattctgcctacca

SEQ ID NO: 104753 - DNA, 20 bp, Artificial Sequence
  chemically synthesized
ttatttccccctgtggtagg

SEQ ID NO: 104754 - DNA, 20 bp, Artificial Sequence
  chemically synthesized
cccatgattctgcctaccac

SEQ ID NO: 104755 - DNA, 20 bp, Artificial Sequence
  chemically synthesized
ccatgattctgcctaccaca

SEQ ID NO: 104756 - DNA, 20 bp, Artificial Sequence
  chemically synthesized
catgattctgcctaccacag

SEQ ID NO: 104757 - DNA, 20 bp, Artificial Sequence
  chemically synthesized
gttttatttccccctgtggt

SEQ ID NO: 104758 - DNA, 20 bp, Artificial Sequence
  chemically synthesized
atgattctgcctaccacagg

SEQ ID NO: 104759 - DNA, 20 bp, Artificial Sequence
  chemically synthesized
agttttatttccccctgtgg

SEQ ID NO: 104760 - DNA, 20 bp, Artificial Sequence
  chemically synthesized
gcaagttttatttccccctg

SEQ ID NO: 104761 - DNA, 20 bp, Artificial Sequence
  chemically synthesized
gggggaaataaaacttgctt

SEQ ID NO: 104762 - DNA, 20 bp, Artificial Sequence
  chemically synthesized
aatatccgattggctaaagc

SEQ ID NO: 104763 - DNA, 20 bp, Artificial Sequence
  chemically synthesized
ctgcaatatccgattggcta

SEQ ID NO: 104764 - DNA, 20 bp, Artificial Sequence
  chemically synthesized
taaaacttgctttagccaat

SEQ ID NO: 104765 - DNA, 20 bp, Artificial Sequence
  chemically synthesized
ttaagcctgcaatatccgat

SEQ ID NO: 104766 - DNA, 20 bp, Artificial Sequence
  chemically synthesized
ctttagccaatcggatattg

SEQ ID NO: 104767 - DNA, 20 bp, Artificial Sequence
  chemically synthesized
tttagccaatcggatattgc

SEQ ID NO: 104768 - DNA, 20 bp, Artificial Sequence
  chemically synthesized
atcggatattgcaggcttaa

SEQ ID NO: 104769 - DNA, 20 bp, Artificial Sequence
  chemically synthesized
ggatattgcaggcttaatgg

SEQ ID NO: 104770 - DNA, 20 bp, Artificial Sequence
  chemically synthesized
gttgagcccctgcttccatt

SEQ ID NO: 104771 - DNA, 20 bp, Artificial Sequence
  chemically synthesized
tattgcaggcttaatggaag

SEQ ID NO: 104772 - DNA, 20 bp, Artificial Sequence
  chemically synthesized
attgcaggcttaatggaagc

SEQ ID NO: 104773 - DNA, 20 bp, Artificial Sequence
  chemically synthesized
ttgcaggcttaatggaagca

SEQ ID NO: 104774 - DNA, 20 bp, Artificial Sequence
  chemically synthesized
tgcaggcttaatggaagcag

SEQ ID NO: 104775 - DNA, 20 bp, Artificial Sequence
  chemically synthesized
aaacatgtaaacaatttgtt

SEQ ID NO: 104776 - DNA, 20 bp, Artificial Sequence
  chemically synthesized
aaggctgaggtgaagagtgg

SEQ ID NO: 104777 - DNA, 20 bp, Artificial Sequence
  chemically synthesized
gtgaaggctgaggtgaagag

SEQ ID NO: 104778 - DNA, 20 bp, Artificial Sequence
  chemically synthesized
tgcacttccactcttcacct

SEQ ID NO: 104779 - DNA, 20 bp, Artificial Sequence
  chemically synthesized
tttgtgaaggctgaggtgaa

SEQ ID NO: 104780 - DNA, 20 bp, Artificial Sequence
  chemically synthesized
tttttgtgaaggctgaggtg

SEQ ID NO: 104781 - DNA, 20 bp, Artificial Sequence
  chemically synthesized
agtcctttttgtgaaggctg

SEQ ID NO: 104782 - DNA, 20 bp, Artificial Sequence
  chemically synthesized
aagtcctttttgtgaaggct

SEQ ID NO: 104783 - DNA, 20 bp, Artificial Sequence
  chemically synthesized
ttcacctcagccttcacaaa

SEQ ID NO: 104784 - DNA, 20 bp, Artificial Sequence
  chemically synthesized
cgagcaagtcctttttgtga

SEQ ID NO: 104785 - DNA, 20 bp, Artificial Sequence
  chemically synthesized
tcacctcagccttcacaaaa

SEQ ID NO: 104786 - DNA, 20 bp, Artificial Sequence
  chemically synthesized
ccgagcaagtcctttttgtg

SEQ ID NO: 104787 - DNA, 20 bp, Artificial Sequence
  chemically synthesized
cttcacaaaaaggacttgct

SEQ ID NO: 104788 - DNA, 20 bp, Artificial Sequence
  chemically synthesized
ttcacaaaaaggacttgctc

SEQ ID NO: 104789 - DNA, 20 bp, Artificial Sequence
  chemically synthesized
gcaggctaaccagcccgagc

SEQ ID NO: 104790 - DNA, 20 bp, Artificial Sequence
  chemically synthesized
caaaaaggacttgctcgggc

SEQ ID NO: 104791 - DNA, 20 bp, Artificial Sequence
  chemically synthesized
tccagcaggctaaccagccc

SEQ ID NO: 104792 - DNA, 20 bp, Artificial Sequence
  chemically synthesized
aaggacttgctcgggctggt

SEQ ID NO: 104793 - DNA, 20 bp, Artificial Sequence
  chemically synthesized
catccctccagcaggctaac

SEQ ID NO: 104794 - DNA, 20 bp, Artificial Sequence
  chemically synthesized
gctcgggctggttagcctgc

SEQ ID NO: 104795 - DNA, 20 bp, Artificial Sequence
  chemically synthesized
tcgggctggttagcctgctg

SEQ ID NO: 104796 - DNA, 20 bp, Artificial Sequence
  chemically synthesized
cgggctggttagcctgctgg

SEQ ID NO: 104797 - DNA, 20 bp, Artificial Sequence
  chemically synthesized
gggctggttagcctgctgga

SEQ ID NO: 104798 - DNA, 20 bp, Artificial Sequence
  chemically synthesized
atcttgaacatccctccagc

SEQ ID NO: 104799 - DNA, 20 bp, Artificial Sequence
  chemically synthesized
catcttgaacatccctccag

SEQ ID NO: 104800 - DNA, 20 bp, Artificial Sequence
  chemically synthesized
tcacatcttgaacatccctc

SEQ ID NO: 104801 - DNA, 20 bp, Artificial Sequence
  chemically synthesized
agcctgctggagggatgttc

SEQ ID NO: 104802 - DNA, 20 bp, Artificial Sequence
  chemically synthesized
tggagggatgttcaagatgt

SEQ ID NO: 104803 - DNA, 20 bp, Artificial Sequence
  chemically synthesized
gatgttcaagatgtgagcga

SEQ ID NO: 104804 - DNA, 20 bp, Artificial Sequence
  chemically synthesized
tgttcaagatgtgagcgata

SEQ ID NO: 104805 - DNA, 20 bp, Artificial Sequence
  chemically synthesized
tgaaagtggctgggtcaaca

SEQ ID NO: 104806 - DNA, 20 bp, Artificial Sequence
  chemically synthesized
gcgatagagctgtgttgacc

SEQ ID NO: 104807 - DNA, 20 bp, Artificial Sequence
  chemically synthesized
ttaagtgtctgaaagtggct

SEQ ID NO: 104808 - DNA, 20 bp, Artificial Sequence
  chemically synthesized
cttaagtgtctgaaagtggc

SEQ ID NO: 104809 - DNA, 20 bp, Artificial Sequence
  chemically synthesized
tgtgttgacccagccacttt

SEQ ID NO: 104810 - DNA, 20 bp, Artificial Sequence
  chemically synthesized
agagcttaagtgtctgaaag

SEQ ID NO: 104811 - DNA, 20 bp, Artificial Sequence
  chemically synthesized
ctgagagcttaagtgtctga

SEQ ID NO: 104812 - DNA, 20 bp, Artificial Sequence
  chemically synthesized
ccagccactttcagacactt

SEQ ID NO: 104813 - DNA, 20 bp, Artificial Sequence
  chemically synthesized
ctttcagacacttaagctct

SEQ ID NO: 104814 - DNA, 20 bp, Artificial Sequence
  chemically synthesized
tggagggtagctgagagctt

SEQ ID NO: 104815 - DNA, 20 bp, Artificial Sequence
  chemically synthesized
ggaatctggagggtagctga

SEQ ID NO: 104816 - DNA, 20 bp, Artificial Sequence
  chemically synthesized
tgggaatctggagggtagct

SEQ ID NO: 104817 - DNA, 20 bp, Artificial Sequence
  chemically synthesized
ttaagctctcagctaccctc

SEQ ID NO: 104818 - DNA, 20 bp, Artificial Sequence
  chemically synthesized
tcccttgggaatctggaggg

SEQ ID NO: 104819 - DNA, 20 bp, Artificial Sequence
  chemically synthesized
ggctcccttgggaatctgga

SEQ ID NO: 104820 - DNA, 20 bp, Artificial Sequence
  chemically synthesized
gggctcccttgggaatctgg

SEQ ID NO: 104821 - DNA, 20 bp, Artificial Sequence
  chemically synthesized
tgggctcccttgggaatctg

SEQ ID NO: 104822 - DNA, 20 bp, Artificial Sequence
  chemically synthesized
cagctaccctccagattccc

SEQ ID NO: 104823 - DNA, 20 bp, Artificial Sequence
  chemically synthesized
actgggctcccttgggaatc

SEQ ID NO: 104824 - DNA, 20 bp, Artificial Sequence
  chemically synthesized
agctaccctccagattccca

SEQ ID NO: 104825 - DNA, 20 bp, Artificial Sequence
  chemically synthesized
gctaccctccagattcccaa

SEQ ID NO: 104826 - DNA, 20 bp, Artificial Sequence
  chemically synthesized
taccctccagattcccaagg

SEQ ID NO: 104827 - DNA, 20 bp, Artificial Sequence
  chemically synthesized
tgctctgactgggctccctt

SEQ ID NO: 104828 - DNA, 20 bp, Artificial Sequence
  chemically synthesized
ctgctctgactgggctccct

SEQ ID NO: 104829 - DNA, 20 bp, Artificial Sequence
  chemically synthesized
tccagattcccaagggagcc

SEQ ID NO: 104830 - DNA, 20 bp, Artificial Sequence
  chemically synthesized
gattcccaagggagcccagt

SEQ ID NO: 104831 - DNA, 20 bp, Artificial Sequence
  chemically synthesized
ttcccaagggagcccagtca

SEQ ID NO: 104832 - DNA, 20 bp, Artificial Sequence
  chemically synthesized
gtagtttatctgctctgact

SEQ ID NO: 104833 - DNA, 20 bp, Artificial Sequence
  chemically synthesized
ccaagggagcccagtcagag

SEQ ID NO: 104834 - DNA, 20 bp, Artificial Sequence
  chemically synthesized
ggtagtttatctgctctgac

SEQ ID NO: 104835 - DNA, 20 bp, Artificial Sequence
  chemically synthesized
ggctgatggtttacattggg

SEQ ID NO: 104836 - DNA, 20 bp, Artificial Sequence
  chemically synthesized
gtgggctgatggtttacatt

SEQ ID NO: 104837 - DNA, 20 bp, Artificial Sequence
  chemically synthesized
tgtgggctgatggtttacat

SEQ ID NO: 104838 - DNA, 20 bp, Artificial Sequence
  chemically synthesized
aactacccaatgtaaaccat

SEQ ID NO: 104839 - DNA, 20 bp, Artificial Sequence
  chemically synthesized
ttcactaatttgtgggctga

SEQ ID NO: 104840 - DNA, 20 bp, Artificial Sequence
  chemically synthesized
taaaccatcagcccacaaat

SEQ ID NO: 104841 - DNA, 20 bp, Artificial Sequence
  chemically synthesized
tcttgagttcactaatttgt

SEQ ID NO: 104842 - DNA, 20 bp, Artificial Sequence
  chemically synthesized
ttcttgagttcactaatttg

SEQ ID NO: 104843 - DNA, 20 bp, Artificial Sequence
  chemically synthesized
gcccacaaattagtgaactc

SEQ ID NO: 104844 - DNA, 20 bp, Artificial Sequence
  chemically synthesized
cacaaattagtgaactcaag

SEQ ID NO: 104845 - DNA, 20 bp, Artificial Sequence
  chemically synthesized
taaaacagtaggtacttctt

SEQ ID NO: 104846 - DNA, 20 bp, Artificial Sequence
  chemically synthesized
actcagtagcttaaaacagt

SEQ ID NO: 104847 - DNA, 20 bp, Artificial Sequence
  chemically synthesized
caagaagtacctactgtttt

SEQ ID NO: 104848 - DNA, 20 bp, Artificial Sequence
  chemically synthesized
aactcagtagcttaaaacag

SEQ ID NO: 104849 - DNA, 20 bp, Artificial Sequence
  chemically synthesized
caaaactcagtagcttaaaa

SEQ ID NO: 104850 - DNA, 20 bp, Artificial Sequence
  chemically synthesized
acctactgttttaagctact

SEQ ID NO: 104851 - DNA, 20 bp, Artificial Sequence
  chemically synthesized
caaaccgcctcaaaactcag

SEQ ID NO: 104852 - DNA, 20 bp, Artificial Sequence
  chemically synthesized
gttttaagctactgagtttt

SEQ ID NO: 104853 - DNA, 20 bp, Artificial Sequence
  chemically synthesized
ttttaagctactgagttttg

SEQ ID NO: 104854 - DNA, 20 bp, Artificial Sequence
  chemically synthesized
taccaaaccgcctcaaaact

SEQ ID NO: 104855 - DNA, 20 bp, Artificial Sequence
  chemically synthesized
taagctactgagttttgagg

SEQ ID NO: 104856 - DNA, 20 bp, Artificial Sequence
  chemically synthesized
tactgagttttgaggcggtt

SEQ ID NO: 104857 - DNA, 20 bp, Artificial Sequence
  chemically synthesized
gttttgaggcggtttggtaa

SEQ ID NO: 104858 - DNA, 20 bp, Artificial Sequence
  chemically synthesized
agttatatataatagtatat

SEQ ID NO: 104859 - DNA, 20 bp, Artificial Sequence
  chemically synthesized
tctgtatcagttatatataa

SEQ ID NO: 104860 - DNA, 20 bp, Artificial Sequence
  chemically synthesized
actattatatataactgata

SEQ ID NO: 104861 - DNA, 20 bp, Artificial Sequence
  chemically synthesized
gtatcattttatgtctgtat

SEQ ID NO: 104862 - DNA, 20 bp, Artificial Sequence
  chemically synthesized
acataaaatgatacttttgc

SEQ ID NO: 104863 - DNA, 20 bp, Artificial Sequence
  chemically synthesized
cataaaatgatacttttgcc

SEQ ID NO: 104864 - DNA, 20 bp, Artificial Sequence
  chemically synthesized
tttaatagtttacctggcaa

SEQ ID NO: 104865 - DNA, 20 bp, Artificial Sequence
  chemically synthesized
ttttgttttaatagtttacc

SEQ ID NO: 104866 - DNA, 20 bp, Artificial Sequence
  chemically synthesized
taaatcttgttttgttttaa

SEQ ID NO: 104867 - DNA, 20 bp, Artificial Sequence
  chemically synthesized
gtaaactattaaaacaaaac

SEQ ID NO: 104868 - DNA, 20 bp, Artificial Sequence
  chemically synthesized
aatatgatggtaacagtgga

SEQ ID NO: 104869 - DNA, 20 bp, Artificial Sequence
  chemically synthesized
taacaatatgatggtaacag

SEQ ID NO: 104870 - DNA, 20 bp, Artificial Sequence
  chemically synthesized
ccttaacaatatgatggtaa

SEQ ID NO: 104871 - DNA, 20 bp, Artificial Sequence
  chemically synthesized
ccccttccttaacaatatga

SEQ ID NO: 104872 - DNA, 20 bp, Artificial Sequence
  chemically synthesized
actgttaccatcatattgtt

SEQ ID NO: 104873 - DNA, 20 bp, Artificial Sequence
  chemically synthesized
ctgttaccatcatattgtta

SEQ ID NO: 104874 - DNA, 20 bp, Artificial Sequence
  chemically synthesized
ttaccatcatattgttaagg

SEQ ID NO: 104875 - DNA, 20 bp, Artificial Sequence
  chemically synthesized
taccatcatattgttaagga

SEQ ID NO: 104876 - DNA, 20 bp, Artificial Sequence
  chemically synthesized
accatcatattgttaaggaa

SEQ ID NO: 104877 - DNA, 20 bp, Artificial Sequence
  chemically synthesized
ccatcatattgttaaggaag

SEQ ID NO: 104878 - DNA, 20 bp, Artificial Sequence
  chemically synthesized
ggaaggggtatttcaaccac

SEQ ID NO: 104879 - DNA, 20 bp, Artificial Sequence
  chemically synthesized
gtctttctgattatttcttg

SEQ ID NO: 104880 - DNA, 20 bp, Artificial Sequence
  chemically synthesized
tttcaaccacaagaaataat

SEQ ID NO: 104881 - DNA, 20 bp, Artificial Sequence
  chemically synthesized
aaccacaagaaataatcaga

SEQ ID NO: 104882 - DNA, 20 bp, Artificial Sequence
  chemically synthesized
aagaaataatcagaaagaca

SEQ ID NO: 104883 - DNA, 20 bp, Artificial Sequence
  chemically synthesized
taatcagaaagacatagtct

SEQ ID NO: 104884 - DNA, 20 bp, Artificial Sequence
  chemically synthesized
gacagcctaccatttaggct

SEQ ID NO: 104885 - DNA, 20 bp, Artificial Sequence
  chemically synthesized
agacatagtctcagcctaaa

SEQ ID NO: 104886 - DNA, 20 bp, Artificial Sequence
  chemically synthesized
catagtctcagcctaaatgg

SEQ ID NO: 104887 - DNA, 20 bp, Artificial Sequence
  chemically synthesized
atagtctcagcctaaatggt

SEQ ID NO: 104888 - DNA, 20 bp, Artificial Sequence
  chemically synthesized
cttaggacagcctaccattt

SEQ ID NO: 104889 - DNA, 20 bp, Artificial Sequence
  chemically synthesized
tcttaggacagcctaccatt

SEQ ID NO: 104890 - DNA, 20 bp, Artificial Sequence
  chemically synthesized
cctaaatggtaggctgtcct

SEQ ID NO: 104891 - DNA, 20 bp, Artificial Sequence
  chemically synthesized
gtcatcctcctttcttagga

SEQ ID NO: 104892 - DNA, 20 bp, Artificial Sequence
  chemically synthesized
aatggtaggctgtcctaaga

SEQ ID NO: 104893 - DNA, 20 bp, Artificial Sequence
  chemically synthesized
atggtaggctgtcctaagaa

SEQ ID NO: 104894 - DNA, 20 bp, Artificial Sequence
  chemically synthesized
ggtaggctgtcctaagaaag

SEQ ID NO: 104895 - DNA, 20 bp, Artificial Sequence
  chemically synthesized
gcttgtcatcctcctttctt

SEQ ID NO: 104896 - DNA, 20 bp, Artificial Sequence
  chemically synthesized
gtaggctgtcctaagaaagg

SEQ ID NO: 104897 - DNA, 20 bp, Artificial Sequence
  chemically synthesized
agcttgtcatcctcctttct

SEQ ID NO: 104898 - DNA, 20 bp, Artificial Sequence
  chemically synthesized
tcctaagaaaggaggatgac

SEQ ID NO: 104899 - DNA, 20 bp, Artificial Sequence
  chemically synthesized
aaaggaggatgacaagctac

SEQ ID NO: 104900 - DNA, 20 bp, Artificial Sequence
  chemically synthesized
agagaaattatttaagcttg

SEQ ID NO: 104901 - DNA, 20 bp, Artificial Sequence
  chemically synthesized
gagagaaagagaaattattt

SEQ ID NO: 104902 - DNA, 20 bp, Artificial Sequence
  chemically synthesized
gaaagagagagagagagaaa

SEQ ID NO: 104903 - DNA, 20 bp, Artificial Sequence
  chemically synthesized
cagaaagagagagagagaga

SEQ ID NO: 104904 - DNA, 20 bp, Artificial Sequence
  chemically synthesized
aggacagaaagagagagaga

SEQ ID NO: 104905 - DNA, 20 bp, Artificial Sequence
  chemically synthesized
taaggacagaaagagagaga

SEQ ID NO: 104906 - DNA, 20 bp, Artificial Sequence
  chemically synthesized
tataaggacagaaagagaga

SEQ ID NO: 104907 - DNA, 20 bp, Artificial Sequence
  chemically synthesized
actataaggacagaaagaga

SEQ ID NO: 104908 - DNA, 20 bp, Artificial Sequence
  chemically synthesized
gaactataaggacagaaaga

SEQ ID NO: 104909 - DNA, 20 bp, Artificial Sequence
  chemically synthesized
gagaactataaggacagaaa

SEQ ID NO: 104910 - DNA, 20 bp, Artificial Sequence
  chemically synthesized
atgagaactataaggacaga

SEQ ID NO: 104911 - DNA, 20 bp, Artificial Sequence
  chemically synthesized
tctctctctttctgtcctta

SEQ ID NO: 104912 - DNA, 20 bp, Artificial Sequence
  chemically synthesized
agaaatgagaactataagga

SEQ ID NO: 104913 - DNA, 20 bp, Artificial Sequence
  chemically synthesized
gcagagaaatgagaactata

SEQ ID NO: 104914 - DNA, 20 bp, Artificial Sequence
  chemically synthesized
agcagagaaatgagaactat

SEQ ID NO: 104915 - DNA, 20 bp, Artificial Sequence
  chemically synthesized
tcctcaataagcagagaaat

SEQ ID NO: 104916 - DNA, 20 bp, Artificial Sequence
  chemically synthesized
gaagatttcctcaataagca

SEQ ID NO: 104917 - DNA, 20 bp, Artificial Sequence
  chemically synthesized
ttctcatttctctgcttatt

SEQ ID NO: 104918 - DNA, 20 bp, Artificial Sequence
  chemically synthesized
tctcatttctctgcttattg

SEQ ID NO: 104919 - DNA, 20 bp, Artificial Sequence
  chemically synthesized
aagaagatttcctcaataag

SEQ ID NO: 104920 - DNA, 20 bp, Artificial Sequence
  chemically synthesized
gtgaagaagatttcctcaat

SEQ ID NO: 104921 - DNA, 20 bp, Artificial Sequence
  chemically synthesized
tattgaggaaatcttcttca

SEQ ID NO: 104922 - DNA, 20 bp, Artificial Sequence
  chemically synthesized
aatgcagatgatctgtgaag

SEQ ID NO: 104923 - DNA, 20 bp, Artificial Sequence
  chemically synthesized
tcaaatgcagatgatctgtg

SEQ ID NO: 104924 - DNA, 20 bp, Artificial Sequence
  chemically synthesized
ttcacagatcatctgcattt

SEQ ID NO: 104925 - DNA, 20 bp, Artificial Sequence
  chemically synthesized
gtggcagaggttctcaaatg

SEQ ID NO: 104926 - DNA, 20 bp, Artificial Sequence
  chemically synthesized
cattaagtcgtgtgtggcag

SEQ ID NO: 104927 - DNA, 20 bp, Artificial Sequence
  chemically synthesized
acattaagtcgtgtgtggca

SEQ ID NO: 104928 - DNA, 20 bp, Artificial Sequence
  chemically synthesized
ttacattaagtcgtgtgtgg

SEQ ID NO: 104929 - DNA, 20 bp, Artificial Sequence
  chemically synthesized
gcattacattaagtcgtgtg

SEQ ID NO: 104930 - DNA, 20 bp, Artificial Sequence
  chemically synthesized
aatgtgcaaagcattacatt

SEQ ID NO: 104931 - DNA, 20 bp, Artificial Sequence
  chemically synthesized
ttgagggtttacaatgtgca

SEQ ID NO: 104932 - DNA, 20 bp, Artificial Sequence
  chemically synthesized
tttgcacattgtaaaccctc

SEQ ID NO: 104933 - DNA, 20 bp, Artificial Sequence
  chemically synthesized
tcatttaacaacattcttga

SEQ ID NO: 104934 - DNA, 20 bp, Artificial Sequence
  chemically synthesized
ctcatttaacaacattcttg

SEQ ID NO: 104935 - DNA, 20 bp, Artificial Sequence
  chemically synthesized
actcatttaacaacattctt

SEQ ID NO: 104936 - DNA, 20 bp, Artificial Sequence
  chemically synthesized
cctcaagaatgttgttaaat

SEQ ID NO: 104937 - DNA, 20 bp, Artificial Sequence
  chemically synthesized
gagtaatcacaatgtgaatt

SEQ ID NO: 104938 - DNA, 20 bp, Artificial Sequence
  chemically synthesized
gtgaattaagtcattcacaa

SEQ ID NO: 104939 - DNA, 20 bp, Artificial Sequence
  chemically synthesized
caatggaatgctgctaattc

SEQ ID NO: 104940 - DNA, 20 bp, Artificial Sequence
  chemically synthesized
ttactcagttccagaattag

SEQ ID NO: 104941 - DNA, 20 bp, Artificial Sequence
  chemically synthesized
acattactcagttccagaat

SEQ ID NO: 104942 - DNA, 20 bp, Artificial Sequence
  chemically synthesized
atgctgctaattctggaact

SEQ ID NO: 104943 - DNA, 20 bp, Artificial Sequence
  chemically synthesized
atgaccacattactcagttc

SEQ ID NO: 104944 - DNA, 20 bp, Artificial Sequence
  chemically synthesized
aattctggaactgagtaatg

SEQ ID NO: 104945 - DNA, 20 bp, Artificial Sequence
  chemically synthesized
actgcaatgaccacattact

SEQ ID NO: 104946 - DNA, 20 bp, Artificial Sequence
  chemically synthesized
actgagtaatgtggtcattg

SEQ ID NO: 104947 - DNA, 20 bp, Artificial Sequence
  chemically synthesized
tgtggtcattgcagtatact

SEQ ID NO: 104948 - DNA, 20 bp, Artificial Sequence
  chemically synthesized
ctagaagttttcacgcagct

SEQ ID NO: 104949 - DNA, 20 bp, Artificial Sequence
  chemically synthesized
tttttctagaagttttcacg

SEQ ID NO: 104950 - DNA, 20 bp, Artificial Sequence
  chemically synthesized
ctaagctgcgtgaaaacttc

SEQ ID NO: 104951 - DNA, 20 bp, Artificial Sequence
  chemically synthesized
tctctataatttttttctag

SEQ ID NO: 104952 - DNA, 20 bp, Artificial Sequence
  chemically synthesized
ttttctctataatttttttc

SEQ ID NO: 104953 - DNA, 20 bp, Artificial Sequence
  chemically synthesized
aaacttctagaaaaaaatta

SEQ ID NO: 104954 - DNA, 20 bp, Artificial Sequence
  chemically synthesized
acttctagaaaaaaattata

SEQ ID NO: 104955 - DNA, 20 bp, Artificial Sequence
  chemically synthesized
tagaaaaaaattatagagaa

SEQ ID NO: 104956 - DNA, 20 bp, Artificial Sequence
  chemically synthesized
tattgctaaaataaaggaga

SEQ ID NO: 104957 - DNA, 20 bp, Artificial Sequence
  chemically synthesized
gtattgctaaaataaaggag

SEQ ID NO: 104958 - DNA, 20 bp, Artificial Sequence
  chemically synthesized
atagtattgctaaaataaag

SEQ ID NO: 104959 - DNA, 20 bp, Artificial Sequence
  chemically synthesized
agttgccttctcctttattt

SEQ ID NO: 104960 - DNA, 20 bp, Artificial Sequence
  chemically synthesized
caatagtattgctaaaataa

SEQ ID NO: 104961 - DNA, 20 bp, Artificial Sequence
  chemically synthesized
gcaatagtattgctaaaata

SEQ ID NO: 104962 - DNA, 20 bp, Artificial Sequence
  chemically synthesized
ttattttagcaatactattg

SEQ ID NO: 104963 - DNA, 20 bp, Artificial Sequence
  chemically synthesized
cttgattttatatgctgcaa

SEQ ID NO: 104964 - DNA, 20 bp, Artificial Sequence
  chemically synthesized
ctattgcagcatataaaatc

SEQ ID NO: 104965 - DNA, 20 bp, Artificial Sequence
  chemically synthesized
tgcagcatataaaatcaagc

SEQ ID NO: 104966 - DNA, 20 bp, Artificial Sequence
  chemically synthesized
gcagcatataaaatcaagct

SEQ ID NO: 104967 - DNA, 20 bp, Artificial Sequence
  chemically synthesized
cgcagcttcccataaagtcc

SEQ ID NO: 104968 - DNA, 20 bp, Artificial Sequence
  chemically synthesized
aaaatcaagctgggacttta

SEQ ID NO: 104969 - DNA, 20 bp, Artificial Sequence
  chemically synthesized
aaatcaagctgggactttat

SEQ ID NO: 104970 - DNA, 20 bp, Artificial Sequence
  chemically synthesized
tcaagctgggactttatggg

SEQ ID NO: 104971 - DNA, 20 bp, Artificial Sequence
  chemically synthesized
gcaaggcgcagcttcccata

SEQ ID NO: 104972 - DNA, 20 bp, Artificial Sequence
  chemically synthesized
ccttttaaattagcaaggcg

SEQ ID NO: 104973 - DNA, 20 bp, Artificial Sequence
  chemically synthesized
tgtgtccttttaaattagca

SEQ ID NO: 104974 - DNA, 20 bp, Artificial Sequence
  chemically synthesized
gtgtgtccttttaaattagc

SEQ ID NO: 104975 - DNA, 20 bp, Artificial Sequence
  chemically synthesized
gctgcgccttgctaatttaa

SEQ ID NO: 104976 - DNA, 20 bp, Artificial Sequence
  chemically synthesized
ctgcgccttgctaatttaaa

SEQ ID NO: 104977 - DNA, 20 bp, Artificial Sequence
  chemically synthesized
gtcagtgtgtccttttaaat

SEQ ID NO: 104978 - DNA, 20 bp, Artificial Sequence
  chemically synthesized
caagccaatcagcatgtagt

SEQ ID NO: 104979 - DNA, 20 bp, Artificial Sequence
  chemically synthesized
cccccaagccaatcagcatg

SEQ ID NO: 104980 - DNA, 20 bp, Artificial Sequence
  chemically synthesized
cacactgactacatgctgat

SEQ ID NO: 104981 - DNA, 20 bp, Artificial Sequence
  chemically synthesized
tgactacatgctgattggct

SEQ ID NO: 104982 - DNA, 20 bp, Artificial Sequence
  chemically synthesized
atccttccccccaagccaat

SEQ ID NO: 104983 - DNA, 20 bp, Artificial Sequence
  chemically synthesized
gactacatgctgattggctt

SEQ ID NO: 104984 - DNA, 20 bp, Artificial Sequence
  chemically synthesized
actacatgctgattggcttg

SEQ ID NO: 104985 - DNA, 20 bp, Artificial Sequence
  chemically synthesized
ctacatgctgattggcttgg

SEQ ID NO: 104986 - DNA, 20 bp, Artificial Sequence
  chemically synthesized
tacatgctgattggcttggg

SEQ ID NO: 104987 - DNA, 20 bp, Artificial Sequence
  chemically synthesized
atgctgattggcttgggggg

SEQ ID NO: 104988 - DNA, 20 bp, Artificial Sequence
  chemically synthesized
tgctgattggcttgggggga

SEQ ID NO: 104989 - DNA, 20 bp, Artificial Sequence
  chemically synthesized
ggtaagcaatccttcccccc

SEQ ID NO: 104990 - DNA, 20 bp, Artificial Sequence
  chemically synthesized
tagaaacaaaacaacatggt

SEQ ID NO: 104991 - DNA, 20 bp, Artificial Sequence
  chemically synthesized
aaaatagaaacaaaacaaca

SEQ ID NO: 104992 - DNA, 20 bp, Artificial Sequence
  chemically synthesized
caggcaggtgaaaattaaaa

SEQ ID NO: 104993 - DNA, 20 bp, Artificial Sequence
  chemically synthesized
aggaaaattcgcagacaggc

SEQ ID NO: 104994 - DNA, 20 bp, Artificial Sequence
  chemically synthesized
aaggaaaattcgcagacagg

SEQ ID NO: 104995 - DNA, 20 bp, Artificial Sequence
  chemically synthesized
ggtaaggaaaattcgcagac

SEQ ID NO: 104996 - DNA, 20 bp, Artificial Sequence
  chemically synthesized
tggtaaggaaaattcgcaga

SEQ ID NO: 104997 - DNA, 20 bp, Artificial Sequence
  chemically synthesized
accatggtaaggaaaattcg

SEQ ID NO: 104998 - DNA, 20 bp, Artificial Sequence
  chemically synthesized
tctgcgaattttccttacca

SEQ ID NO: 104999 - DNA, 20 bp, Artificial Sequence
  chemically synthesized
ttaaatccattaccatggta

SEQ ID NO: 105000 - DNA, 20 bp, Artificial Sequence
  chemically synthesized
tttaaatccattaccatggt

SEQ ID NO: 105001 - DNA, 20 bp, Artificial Sequence
  chemically synthesized
aattttccttaccatggtaa

SEQ ID NO: 105002 - DNA, 20 bp, Artificial Sequence
  chemically synthesized
ttaatttaaatccattacca

SEQ ID NO: 105003 - DNA, 20 bp, Artificial Sequence
  chemically synthesized
atggatttaaattaatcaat

SEQ ID NO: 105004 - DNA, 20 bp, Artificial Sequence
  chemically synthesized
tggatttaaattaatcaata

SEQ ID NO: 105005 - DNA, 20 bp, Artificial Sequence
  chemically synthesized
ttaatcaataaggtgttatg

SEQ ID NO: 105006 - DNA, 20 bp, Artificial Sequence
  chemically synthesized
gttttcaaactaggttttta

SEQ ID NO: 105007 - DNA, 20 bp, Artificial Sequence
  chemically synthesized
tcaaatacactttaaaaacc

SEQ ID NO: 105008 - DNA, 20 bp, Artificial Sequence
  chemically synthesized
gacctggaagttttcaaact

SEQ ID NO: 105009 - DNA, 20 bp, Artificial Sequence
  chemically synthesized
agacctggaagttttcaaac

SEQ ID NO: 105010 - DNA, 20 bp, Artificial Sequence
  chemically synthesized
aaacctagtttgaaaacttc

SEQ ID NO: 105011 - DNA, 20 bp, Artificial Sequence
  chemically synthesized
aacctagtttgaaaacttcc

SEQ ID NO: 105012 - DNA, 20 bp, Artificial Sequence
  chemically synthesized
catgtgctaaatagacctgg

SEQ ID NO: 105013 - DNA, 20 bp, Artificial Sequence
  chemically synthesized
cgacatgtgctaaatagacc

SEQ ID NO: 105014 - DNA, 20 bp, Artificial Sequence
  chemically synthesized
tgaaaacttccaggtctatt

SEQ ID NO: 105015 - DNA, 20 bp, Artificial Sequence
  chemically synthesized
acactacgacatgtgctaaa

SEQ ID NO: 105016 - DNA, 20 bp, Artificial Sequence
  chemically synthesized
ggtctatttagcacatgtcg

SEQ ID NO: 105017 - DNA, 20 bp, Artificial Sequence
  chemically synthesized
atttagcacatgtcgtagtg

SEQ ID NO: 105018 - DNA, 20 bp, Artificial Sequence
  chemically synthesized
tcgtagtgtggcttaaccca

SEQ ID NO: 105019 - DNA, 20 bp, Artificial Sequence
  chemically synthesized
ttgttaatgcaccatgggtt

SEQ ID NO: 105020 - DNA, 20 bp, Artificial Sequence
  chemically synthesized
ttattttgttaatgcaccat

SEQ ID NO: 105021 - DNA, 20 bp, Artificial Sequence
  chemically synthesized
tttattttgttaatgcacca

SEQ ID NO: 105022 - DNA, 20 bp, Artificial Sequence
  chemically synthesized
catggtgcattaacaaaata

SEQ ID NO: 105023 - DNA, 20 bp, Artificial Sequence
  chemically synthesized
atggtgcattaacaaaataa

SEQ ID NO: 105024 - DNA, 20 bp, Artificial Sequence
  chemically synthesized
cattaacaaaataaaggtca

SEQ ID NO: 105025 - DNA, 20 bp, Artificial Sequence
  chemically synthesized
taaaggtcaaagttaaattt

SEQ ID NO: 105026 - DNA, 20 bp, Artificial Sequence
  chemically synthesized
tcaaagttaaattttagaaa

SEQ ID NO: 105027 - DNA, 20 bp, Artificial Sequence
  chemically synthesized
caaagttaaattttagaaaa

SEQ ID NO: 105028 - DNA, 20 bp, Artificial Sequence
  chemically synthesized
aaagttaaattttagaaaaa

SEQ ID NO: 105029 - DNA, 20 bp, Artificial Sequence
  chemically synthesized
aagttaaattttagaaaaag

SEQ ID NO: 105030 - DNA, 20 bp, Artificial Sequence
  chemically synthesized
aggggaacaatattcctcac

SEQ ID NO: 105031 - DNA, 20 bp, Artificial Sequence
  chemically synthesized
tcccactggaatgtcttgtg

SEQ ID NO: 105032 - DNA, 20 bp, Artificial Sequence
  chemically synthesized
atcccactggaatgtcttgt

SEQ ID NO: 105033 - DNA, 20 bp, Artificial Sequence
  chemically synthesized
atattcctcacaagacattc

SEQ ID NO: 105034 - DNA, 20 bp, Artificial Sequence
  chemically synthesized
ttcctcacaagacattccag

SEQ ID NO: 105035 - DNA, 20 bp, Artificial Sequence
  chemically synthesized
tcctcacaagacattccagt

SEQ ID NO: 105036 - DNA, 20 bp, Artificial Sequence
  chemically synthesized
acctgtgttttttatcccac

SEQ ID NO: 105037 - DNA, 20 bp, Artificial Sequence
  chemically synthesized
ttccagtgggataaaaaaca

SEQ ID NO: 105038 - DNA, 20 bp, Artificial Sequence
  chemically synthesized
tccagtgggataaaaaacac

SEQ ID NO: 105039 - DNA, 20 bp, Artificial Sequence
  chemically synthesized
agaatctaggtttgtcaata

SEQ ID NO: 105040 - DNA, 20 bp, Artificial Sequence
  chemically synthesized
tttttctatattgacaaacc

SEQ ID NO: 105041 - DNA, 20 bp, Artificial Sequence
  chemically synthesized
gttattataattaagaatct

SEQ ID NO: 105042 - DNA, 20 bp, Artificial Sequence
  chemically synthesized
agttattataattaagaatc

SEQ ID NO: 105043 - DNA, 20 bp, Artificial Sequence
  chemically synthesized
taggaagagttattataatt

SEQ ID NO: 105044 - DNA, 20 bp, Artificial Sequence
  chemically synthesized
attataataactcttcctaa

SEQ ID NO: 105045 - DNA, 20 bp, Artificial Sequence
  chemically synthesized
tagatatagaccattaggaa

SEQ ID NO: 105046 - DNA, 20 bp, Artificial Sequence
  chemically synthesized
attagatatagaccattagg

SEQ ID NO: 105047 - DNA, 20 bp, Artificial Sequence
  chemically synthesized
ctgattagatatagaccatt

SEQ ID NO: 105048 - DNA, 20 bp, Artificial Sequence
  chemically synthesized
cctgattagatatagaccat

SEQ ID NO: 105049 - DNA, 20 bp, Artificial Sequence
  chemically synthesized
ccactgtacctgattagata

SEQ ID NO: 105050 - DNA, 20 bp, Artificial Sequence
  chemically synthesized
cctaatggtctatatctaat

SEQ ID NO: 105051 - DNA, 20 bp, Artificial Sequence
  chemically synthesized
ctaatggtctatatctaatc

SEQ ID NO: 105052 - DNA, 20 bp, Artificial Sequence
  chemically synthesized
aatattccactgtacctgat

SEQ ID NO: 105053 - DNA, 20 bp, Artificial Sequence
  chemically synthesized
ggtctatatctaatcaggta

SEQ ID NO: 105054 - DNA, 20 bp, Artificial Sequence
  chemically synthesized
ctatatctaatcaggtacag

SEQ ID NO: 105055 - DNA, 20 bp, Artificial Sequence
  chemically synthesized
taaacatgttttatattctc

SEQ ID NO: 105056 - DNA, 20 bp, Artificial Sequence
  chemically synthesized
atccattaacaatataacca

SEQ ID NO: 105057 - DNA, 20 bp, Artificial Sequence
  chemically synthesized
gtatccattaacaatataac

SEQ ID NO: 105058 - DNA, 20 bp, Artificial Sequence
  chemically synthesized
ttctctggttatattgttaa

SEQ ID NO: 105059 - DNA, 20 bp, Artificial Sequence
  chemically synthesized
ccttctaattcagtgcattg

SEQ ID NO: 105060 - DNA, 20 bp, Artificial Sequence
  chemically synthesized
gatacttcaatgcactgaat

SEQ ID NO: 105061 - DNA, 20 bp, Artificial Sequence
  chemically synthesized
acttcaatgcactgaattag

SEQ ID NO: 105062 - DNA, 20 bp, Artificial Sequence
  chemically synthesized
cttcaatgcactgaattaga

SEQ ID NO: 105063 - DNA, 20 bp, Artificial Sequence
  chemically synthesized
cactgtagtgccttctaatt

SEQ ID NO: 105064 - DNA, 20 bp, Artificial Sequence
  chemically synthesized
cactgaattagaaggcacta

SEQ ID NO: 105065 - DNA, 20 bp, Artificial Sequence
  chemically synthesized
tgataaaacaatatgcactg

SEQ ID NO: 105066 - DNA, 20 bp, Artificial Sequence
  chemically synthesized
acagtgcatattgttttatc

SEQ ID NO: 105067 - DNA, 20 bp, Artificial Sequence
  chemically synthesized
cagtgcatattgttttatca

SEQ ID NO: 105068 - DNA, 20 bp, Artificial Sequence
  chemically synthesized
agtgcatattgttttatcaa

SEQ ID NO: 105069 - DNA, 20 bp, Artificial Sequence
  chemically synthesized
catattgttttatcaagggc

SEQ ID NO: 105070 - DNA, 20 bp, Artificial Sequence
  chemically synthesized
aatgtgtttttacatagatg

SEQ ID NO: 105071 - DNA, 20 bp, Artificial Sequence
  chemically synthesized
aaaaataatgtgtttttaca

SEQ ID NO: 105072 - DNA, 20 bp, Artificial Sequence
  chemically synthesized
aaaacacattattttttgaa

SEQ ID NO: 105073 - DNA, 20 bp, Artificial Sequence
  chemically synthesized
gaaaagataacttattattt

SEQ ID NO: 105074 - DNA, 20 bp, Artificial Sequence
  chemically synthesized
tactcttacccttaaataat

SEQ ID NO: 105075 - DNA, 20 bp, Artificial Sequence
  chemically synthesized
aaaagataacttattattta

SEQ ID NO: 105076 - DNA, 20 bp, Artificial Sequence
  chemically synthesized
aaagataacttattatttaa

SEQ ID NO: 105077 - DNA, 20 bp, Artificial Sequence
  chemically synthesized
ataacttattatttaagggt

SEQ ID NO: 105078 - DNA, 20 bp, Artificial Sequence
  chemically synthesized
aacttattatttaagggtaa

SEQ ID NO: 105079 - DNA, 20 bp, Artificial Sequence
  chemically synthesized
ttatttaagggtaagagtat

SEQ ID NO: 105080 - DNA, 20 bp, Artificial Sequence
  chemically synthesized
agaatattaaaaattgatca

SEQ ID NO: 105081 - DNA, 20 bp, Artificial Sequence
  chemically synthesized
tattaaaaattgatcacaga

SEQ ID NO: 105082 - DNA, 20 bp, Artificial Sequence
  chemically synthesized
ttaaaaattgatcacagaaa

SEQ ID NO: 105083 - DNA, 20 bp, Artificial Sequence
  chemically synthesized
taaaaattgatcacagaaag

SEQ ID NO: 105084 - DNA, 20 bp, Artificial Sequence
  chemically synthesized
aaaaattgatcacagaaaga

SEQ ID NO: 105085 - DNA, 20 bp, Artificial Sequence
  chemically synthesized
attgatcacagaaagaggga

SEQ ID NO: 105086 - DNA, 20 bp, Artificial Sequence
  chemically synthesized
atcacagaaagagggatgga

SEQ ID NO: 105087 - DNA, 20 bp, Artificial Sequence
  chemically synthesized
agatgaatatgtaataaatc

SEQ ID NO: 105088 - DNA, 20 bp, Artificial Sequence
  chemically synthesized
aatatgtaataaatcaagta

SEQ ID NO: 105089 - DNA, 20 bp, Artificial Sequence
  chemically synthesized
caagtatagtaaaatttcaa

SEQ ID NO: 105090 - DNA, 20 bp, Artificial Sequence
  chemically synthesized
atagtaaaatttcaatggca

SEQ ID NO: 105091 - DNA, 20 bp, Artificial Sequence
  chemically synthesized
aaaatttcaatggcaaagta

SEQ ID NO: 105092 - DNA, 20 bp, Artificial Sequence
  chemically synthesized
aaatttcaatggcaaagtat

SEQ ID NO: 105093 - DNA, 20 bp, Artificial Sequence
  chemically synthesized
caatggcaaagtataggtgc

SEQ ID NO: 105094 - DNA, 20 bp, Artificial Sequence
  chemically synthesized
aatggcaaagtataggtgct

SEQ ID NO: 105095 - DNA, 20 bp, Artificial Sequence
  chemically synthesized
aagtataggtgctgggtata

SEQ ID NO: 105096 - DNA, 20 bp, Artificial Sequence
  chemically synthesized
acggtcaacatctgtatacc

SEQ ID NO: 105097 - DNA, 20 bp, Artificial Sequence
  chemically synthesized
gcaaagtcgaaagaaattta

SEQ ID NO: 105098 - DNA, 20 bp, Artificial Sequence
  chemically synthesized
taatcatacagcaaagtcga

SEQ ID NO: 105099 - DNA, 20 bp, Artificial Sequence
  chemically synthesized
aaatggctaatcatacagca

SEQ ID NO: 105100 - DNA, 20 bp, Artificial Sequence
  chemically synthesized
tttcgactttgctgtatgat

SEQ ID NO: 105101 - DNA, 20 bp, Artificial Sequence
  chemically synthesized
tattaaaatggctaatcata

SEQ ID NO: 105102 - DNA, 20 bp, Artificial Sequence
  chemically synthesized
tcgatgttttaatattaaaa

SEQ ID NO: 105103 - DNA, 20 bp, Artificial Sequence
  chemically synthesized
caacaataatcctaaattgt

SEQ ID NO: 105104 - DNA, 20 bp, Artificial Sequence
  chemically synthesized
agatacagtgcttacaattt

SEQ ID NO: 105105 - DNA, 20 bp, Artificial Sequence
  chemically synthesized
aagatacagtgcttacaatt

SEQ ID NO: 105106 - DNA, 20 bp, Artificial Sequence
  chemically synthesized
tatacaagtatgtaaagata

SEQ ID NO: 105107 - DNA, 20 bp, Artificial Sequence
  chemically synthesized
cactggtatacaagtatgta

SEQ ID NO: 105108 - DNA, 20 bp, Artificial Sequence
  chemically synthesized
atctttacatacttgtatac

SEQ ID NO: 105109 - DNA, 20 bp, Artificial Sequence
  chemically synthesized
aaatggtggcactggtatac

SEQ ID NO: 105110 - DNA, 20 bp, Artificial Sequence
  chemically synthesized
tagctacaaaatggtggcac

SEQ ID NO: 105111 - DNA, 20 bp, Artificial Sequence
  chemically synthesized
aggaattagctacaaaatgg

SEQ ID NO: 105112 - DNA, 20 bp, Artificial Sequence
  chemically synthesized
ataccagtgccaccattttg

SEQ ID NO: 105113 - DNA, 20 bp, Artificial Sequence
  chemically synthesized
aaaaggaattagctacaaaa

SEQ ID NO: 105114 - DNA, 20 bp, Artificial Sequence
  chemically synthesized
cacatttacagaaaaggaat

SEQ ID NO: 105115 - DNA, 20 bp, Artificial Sequence
  chemically synthesized
aataatcacatttacagaaa

SEQ ID NO: 105116 - DNA, 20 bp, Artificial Sequence
  chemically synthesized
taataatcacatttacagaa

SEQ ID NO: 105117 - DNA, 20 bp, Artificial Sequence
  chemically synthesized
aggtttaataatcacattta

SEQ ID NO: 105118 - DNA, 20 bp, Artificial Sequence
  chemically synthesized
gccagatatttcagtgttaa

SEQ ID NO: 105119 - DNA, 20 bp, Artificial Sequence
  chemically synthesized
tgccagatatttcagtgtta

SEQ ID NO: 105120 - DNA, 20 bp, Artificial Sequence
  chemically synthesized
acctttaacactgaaatatc

SEQ ID NO: 105121 - DNA, 20 bp, Artificial Sequence
  chemically synthesized
tatacatgtgccagatattt

SEQ ID NO: 105122 - DNA, 20 bp, Artificial Sequence
  chemically synthesized
ttacatatgtatacatgtgc

SEQ ID NO: 105123 - DNA, 20 bp, Artificial Sequence
  chemically synthesized
catgtgcacaatgtgcaggt

SEQ ID NO: 105124 - DNA, 20 bp, Artificial Sequence
  chemically synthesized
ggtacatgtgcacaatgtgc

SEQ ID NO: 105125 - DNA, 20 bp, Artificial Sequence
  chemically synthesized
gggtacatgtgcacaatgtg

SEQ ID NO: 105126 - DNA, 20 bp, Artificial Sequence
  chemically synthesized
ttattatactttaagtttta

SEQ ID NO: 105127 - DNA, 20 bp, Artificial Sequence
  chemically synthesized
attattatactttaagtttt

SEQ ID NO: 105128 - DNA, 20 bp, Artificial Sequence
  chemically synthesized
cacatgtaccctaaaactta

SEQ ID NO: 105129 - DNA, 20 bp, Artificial Sequence
  chemically synthesized
tattattatactttaagttt

SEQ ID NO: 105130 - DNA, 20 bp, Artificial Sequence
  chemically synthesized
ttttattattattatacttt

SEQ ID NO: 105131 - DNA, 20 bp, Artificial Sequence
  chemically synthesized
aaattgaaatatctgaaaca

SEQ ID NO: 105132 - DNA, 20 bp, Artificial Sequence
  chemically synthesized
cgccccctaaaactttgttt

SEQ ID NO: 105133 - DNA, 20 bp, Artificial Sequence
  chemically synthesized
aaatatctgaaacaaagttt

SEQ ID NO: 105134 - DNA, 20 bp, Artificial Sequence
  chemically synthesized
aatatctgaaacaaagtttt

SEQ ID NO: 105135 - DNA, 20 bp, Artificial Sequence
  chemically synthesized
atatctgaaacaaagtttta

SEQ ID NO: 105136 - DNA, 20 bp, Artificial Sequence
  chemically synthesized
tatctgaaacaaagttttag

SEQ ID NO: 105137 - DNA, 20 bp, Artificial Sequence
  chemically synthesized
atctgaaacaaagttttagg

SEQ ID NO: 105138 - DNA, 20 bp, Artificial Sequence
  chemically synthesized
aatctctcagtaagttgtac

SEQ ID NO: 105139 - DNA, 20 bp, Artificial Sequence
  chemically synthesized
aaatctctcagtaagttgta

SEQ ID NO: 105140 - DNA, 20 bp, Artificial Sequence
  chemically synthesized
ttcatcctgtacaacttact

SEQ ID NO: 105141 - DNA, 20 bp, Artificial Sequence
  chemically synthesized
catcctgtacaacttactga

SEQ ID NO: 105142 - DNA, 20 bp, Artificial Sequence
  chemically synthesized
ggcattacaaatctctcagt

SEQ ID NO: 105143 - DNA, 20 bp, Artificial Sequence
  chemically synthesized
atagggcattacaaatctct

SEQ ID NO: 105144 - DNA, 20 bp, Artificial Sequence
  chemically synthesized
gagagatttgtaatgcccta

SEQ ID NO: 105145 - DNA, 20 bp, Artificial Sequence
  chemically synthesized
atttgtaatgccctatggac

SEQ ID NO: 105146 - DNA, 20 bp, Artificial Sequence
  chemically synthesized
gactagacctctggtccata

SEQ ID NO: 105147 - DNA, 20 bp, Artificial Sequence
  chemically synthesized
agactagacctctggtccat

SEQ ID NO: 105148 - DNA, 20 bp, Artificial Sequence
  chemically synthesized
ttgtaatgccctatggacca

SEQ ID NO: 105149 - DNA, 20 bp, Artificial Sequence
  chemically synthesized
cagactagacctctggtcca

SEQ ID NO: 105150 - DNA, 20 bp, Artificial Sequence
  chemically synthesized
tgtaatgccctatggaccag

SEQ ID NO: 105151 - DNA, 20 bp, Artificial Sequence
  chemically synthesized
tgccctatggaccagaggtc

SEQ ID NO: 105152 - DNA, 20 bp, Artificial Sequence
  chemically synthesized
caaacttcagactagacctc

SEQ ID NO: 105153 - DNA, 20 bp, Artificial Sequence
  chemically synthesized
tggaccagaggtctagtctg

SEQ ID NO: 105154 - DNA, 20 bp, Artificial Sequence
  chemically synthesized
aataacctcaaacttcagac

SEQ ID NO: 105155 - DNA, 20 bp, Artificial Sequence
  chemically synthesized
agaggtctagtctgaagttt

SEQ ID NO: 105156 - DNA, 20 bp, Artificial Sequence
  chemically synthesized
gaggtctagtctgaagtttg

SEQ ID NO: 105157 - DNA, 20 bp, Artificial Sequence
  chemically synthesized
ttaaaaataacctcaaactt

SEQ ID NO: 105158 - DNA, 20 bp, Artificial Sequence
  chemically synthesized
gaagtttgaggttattttta

SEQ ID NO: 105159 - DNA, 20 bp, Artificial Sequence
  chemically synthesized
tttgaggttatttttaaaga

SEQ ID NO: 105160 - DNA, 20 bp, Artificial Sequence
  chemically synthesized
gttatttttaaagaaagaat

SEQ ID NO: 105161 - DNA, 20 bp, Artificial Sequence
  chemically synthesized
agaaagaataagaattcgtt

SEQ ID NO: 105162 - DNA, 20 bp, Artificial Sequence
  chemically synthesized
gaaagaataagaattcgttg

SEQ ID NO: 105163 - DNA, 20 bp, Artificial Sequence
  chemically synthesized
gaataagaattcgttgagga

SEQ ID NO: 105164 - DNA, 20 bp, Artificial Sequence
  chemically synthesized
aataagaattcgttgaggat

SEQ ID NO: 105165 - DNA, 20 bp, Artificial Sequence
  chemically synthesized
aagaattcgttgaggatggg

SEQ ID NO: 105166 - DNA, 20 bp, Artificial Sequence
  chemically synthesized
attcgttgaggatgggaagt

SEQ ID NO: 105167 - DNA, 20 bp, Artificial Sequence
  chemically synthesized
ttcgttgaggatgggaagtt

SEQ ID NO: 105168 - DNA, 20 bp, Artificial Sequence
  chemically synthesized
gttgaggatgggaagttggg

SEQ ID NO: 105169 - DNA, 20 bp, Artificial Sequence
  chemically synthesized
gaggatgggaagttgggtag

SEQ ID NO: 105170 - DNA, 20 bp, Artificial Sequence
  chemically synthesized
aggatgggaagttgggtaga

SEQ ID NO: 105171 - DNA, 20 bp, Artificial Sequence
  chemically synthesized
agttgggtagaaggtctttg

SEQ ID NO: 105172 - DNA, 20 bp, Artificial Sequence
  chemically synthesized
tgggtagaaggtctttgcgg

SEQ ID NO: 105173 - DNA, 20 bp, Artificial Sequence
  chemically synthesized
caatacttccatctgccgca

SEQ ID NO: 105174 - DNA, 20 bp, Artificial Sequence
  chemically synthesized
tagaaggtctttgcggcaga

SEQ ID NO: 105175 - DNA, 20 bp, Artificial Sequence
  chemically synthesized
aaggtctttgcggcagatgg

SEQ ID NO: 105176 - DNA, 20 bp, Artificial Sequence
  chemically synthesized
tttgcggcagatggaagtat

SEQ ID NO: 105177 - DNA, 20 bp, Artificial Sequence
  chemically synthesized
ttgcggcagatggaagtatt

SEQ ID NO: 105178 - DNA, 20 bp, Artificial Sequence
  chemically synthesized
agatggaagtattgggacgt

SEQ ID NO: 105179 - DNA, 20 bp, Artificial Sequence
  chemically synthesized
gatggaagtattgggacgta

SEQ ID NO: 105180 - DNA, 20 bp, Artificial Sequence
  chemically synthesized
ggaagtattgggacgtaagg

SEQ ID NO: 105181 - DNA, 20 bp, Artificial Sequence
  chemically synthesized
gacgtaaggtggataatatc

SEQ ID NO: 105182 - DNA, 20 bp, Artificial Sequence
  chemically synthesized
acgtaaggtggataatatcc

SEQ ID NO: 105183 - DNA, 20 bp, Artificial Sequence
  chemically synthesized
taaggtggataatatccagg

SEQ ID NO: 105184 - DNA, 20 bp, Artificial Sequence
  chemically synthesized
gcagaaaatttaaggctgcc

SEQ ID NO: 105185 - DNA, 20 bp, Artificial Sequence
  chemically synthesized
tatatgtggcagaaaattta

SEQ ID NO: 105186 - DNA, 20 bp, Artificial Sequence
  chemically synthesized
atatatgtggcagaaaattt

SEQ ID NO: 105187 - DNA, 20 bp, Artificial Sequence
  chemically synthesized
tccttgagtgatatatgtgg

SEQ ID NO: 105188 - DNA, 20 bp, Artificial Sequence
  chemically synthesized
ctctccttgagtgatatatg

SEQ ID NO: 105189 - DNA, 20 bp, Artificial Sequence
  chemically synthesized
ttctgccacatatatcactc

SEQ ID NO: 105190 - DNA, 20 bp, Artificial Sequence
  chemically synthesized
tctgccacatatatcactca

SEQ ID NO: 105191 - DNA, 20 bp, Artificial Sequence
  chemically synthesized
tgccacatatatcactcaag

SEQ ID NO: 105192 - DNA, 20 bp, Artificial Sequence
  chemically synthesized
ccacatatatcactcaagga

SEQ ID NO: 105193 - DNA, 20 bp, Artificial Sequence
  chemically synthesized
ccatttcttccactctcctt

SEQ ID NO: 105194 - DNA, 20 bp, Artificial Sequence
  chemically synthesized
catatatcactcaaggagag

SEQ ID NO: 105195 - DNA, 20 bp, Artificial Sequence
  chemically synthesized
atatcactcaaggagagtgg

SEQ ID NO: 105196 - DNA, 20 bp, Artificial Sequence
  chemically synthesized
ctcaaggagagtggaagaaa

SEQ ID NO: 105197 - DNA, 20 bp, Artificial Sequence
  chemically synthesized
tcaaggagagtggaagaaat

SEQ ID NO: 105198 - DNA, 20 bp, Artificial Sequence
  chemically synthesized
caaggagagtggaagaaatg

SEQ ID NO: 105199 - DNA, 20 bp, Artificial Sequence
  chemically synthesized
gagtggaagaaatggggcct

SEQ ID NO: 105200 - DNA, 20 bp, Artificial Sequence
  chemically synthesized
gtggaagaaatggggccttg

SEQ ID NO: 105201 - DNA, 20 bp, Artificial Sequence
  chemically synthesized
ggaagaaatggggccttgga

SEQ ID NO: 105202 - DNA, 20 bp, Artificial Sequence
  chemically synthesized
cacatgacataatctctcca

SEQ ID NO: 105203 - DNA, 20 bp, Artificial Sequence
  chemically synthesized
acacatgacataatctctcc

SEQ ID NO: 105204 - DNA, 20 bp, Artificial Sequence
  chemically synthesized
cctccttggtgtagcatgca

SEQ ID NO: 105205 - DNA, 20 bp, Artificial Sequence
  chemically synthesized
acctccttggtgtagcatgc

SEQ ID NO: 105206 - DNA, 20 bp, Artificial Sequence
  chemically synthesized
gtgaccttgcatgctacacc

SEQ ID NO: 105207 - DNA, 20 bp, Artificial Sequence
  chemically synthesized
tgaccttgcatgctacacca

SEQ ID NO: 105208 - DNA, 20 bp, Artificial Sequence
  chemically synthesized
accttgcatgctacaccaag

SEQ ID NO: 105209 - DNA, 20 bp, Artificial Sequence
  chemically synthesized
aaattcccacctccttggtg

SEQ ID NO: 105210 - DNA, 20 bp, Artificial Sequence
  chemically synthesized
ccttgcatgctacaccaagg

SEQ ID NO: 105211 - DNA, 20 bp, Artificial Sequence
  chemically synthesized
tgcatgctacaccaaggagg

SEQ ID NO: 105212 - DNA, 20 bp, Artificial Sequence
  chemically synthesized
gcatgctacaccaaggaggt

SEQ ID NO: 105213 - DNA, 20 bp, Artificial Sequence
  chemically synthesized
aagataaattcccacctcct

SEQ ID NO: 105214 - DNA, 20 bp, Artificial Sequence
  chemically synthesized
ggaggtgggaatttatctta

SEQ ID NO: 105215 - DNA, 20 bp, Artificial Sequence
  chemically synthesized
gaggtgggaatttatcttaa

SEQ ID NO: 105216 - DNA, 20 bp, Artificial Sequence
  chemically synthesized
tgaaattcttcaataccttt

SEQ ID NO: 105217 - DNA, 20 bp, Artificial Sequence
  chemically synthesized
aatttatcttaaaggtattg

SEQ ID NO: 105218 - DNA, 20 bp, Artificial Sequence
  chemically synthesized
tattgaagaatttcaaacat

SEQ ID NO: 105219 - DNA, 20 bp, Artificial Sequence
  chemically synthesized
aagaatttcaaacatgagta

SEQ ID NO: 105220 - DNA, 20 bp, Artificial Sequence
  chemically synthesized
agaatttcaaacatgagtat

SEQ ID NO: 105221 - DNA, 20 bp, Artificial Sequence
  chemically synthesized
gaatttcaaacatgagtatg

SEQ ID NO: 105222 - DNA, 20 bp, Artificial Sequence
  chemically synthesized
aatttcaaacatgagtatgg

SEQ ID NO: 105223 - DNA, 20 bp, Artificial Sequence
  chemically synthesized
aaacatgagtatgggggtga

SEQ ID NO: 105224 - DNA, 20 bp, Artificial Sequence
  chemically synthesized
gagtatgggggtgacggcat

SEQ ID NO: 105225 - DNA, 20 bp, Artificial Sequence
  chemically synthesized
gacggcatcagccttcatgt

SEQ ID NO: 105226 - DNA, 20 bp, Artificial Sequence
  chemically synthesized
agagttatcttctgacatga

SEQ ID NO: 105227 - DNA, 20 bp, Artificial Sequence
  chemically synthesized
cagagttatcttctgacatg

SEQ ID NO: 105228 - DNA, 20 bp, Artificial Sequence
  chemically synthesized
ggcatcagccttcatgtcag

SEQ ID NO: 105229 - DNA, 20 bp, Artificial Sequence
  chemically synthesized
ttcatgtcagaagataactc

SEQ ID NO: 105230 - DNA, 20 bp, Artificial Sequence
  chemically synthesized
gtcagaagataactctggct

SEQ ID NO: 105231 - DNA, 20 bp, Artificial Sequence
  chemically synthesized
tcagaagataactctggctg

SEQ ID NO: 105232 - DNA, 20 bp, Artificial Sequence
  chemically synthesized
tagcatcacttcctcagcca

SEQ ID NO: 105233 - DNA, 20 bp, Artificial Sequence
  chemically synthesized
gaagataactctggctgagg

SEQ ID NO: 105234 - DNA, 20 bp, Artificial Sequence
  chemically synthesized
tctagcatcacttcctcagc

SEQ ID NO: 105235 - DNA, 20 bp, Artificial Sequence
  chemically synthesized
tgcatctagcatcacttcct

SEQ ID NO: 105236 - DNA, 20 bp, Artificial Sequence
  chemically synthesized
tctggctgaggaagtgatgc

SEQ ID NO: 105237 - DNA, 20 bp, Artificial Sequence
  chemically synthesized
tgaggaagtgatgctagatg

SEQ ID NO: 105238 - DNA, 20 bp, Artificial Sequence
  chemically synthesized
ttcactggtctttctgcatc

SEQ ID NO: 105239 - DNA, 20 bp, Artificial Sequence
  chemically synthesized
gaagtgatgctagatgcaga

SEQ ID NO: 105240 - DNA, 20 bp, Artificial Sequence
  chemically synthesized
gatgctagatgcagaaagac

SEQ ID NO: 105241 - DNA, 20 bp, Artificial Sequence
  chemically synthesized
atgcagaaagaccagtgaac

SEQ ID NO: 105242 - DNA, 20 bp, Artificial Sequence
  chemically synthesized
aactccggtaacttgttcac

SEQ ID NO: 105243 - DNA, 20 bp, Artificial Sequence
  chemically synthesized
aagaccagtgaacaagttac

SEQ ID NO: 105244 - DNA, 20 bp, Artificial Sequence
  chemically synthesized
gaccagtgaacaagttaccg

SEQ ID NO: 105245 - DNA, 20 bp, Artificial Sequence
  chemically synthesized
attcgtatcctagaaaactc

SEQ ID NO: 105246 - DNA, 20 bp, Artificial Sequence
  chemically synthesized
aacaagttaccggagttttc

SEQ ID NO: 105247 - DNA, 20 bp, Artificial Sequence
  chemically synthesized
acaagttaccggagttttct

SEQ ID NO: 105248 - DNA, 20 bp, Artificial Sequence
  chemically synthesized
tgctattactattcgtatcc

SEQ ID NO: 105249 - DNA, 20 bp, Artificial Sequence
  chemically synthesized
ggagttttctaggatacgaa

SEQ ID NO: 105250 - DNA, 20 bp, Artificial Sequence
  chemically synthesized
ttctaggatacgaatagtaa

SEQ ID NO: 105251 - DNA, 20 bp, Artificial Sequence
  chemically synthesized
aatagtaatagcatcatcat

SEQ ID NO: 105252 - DNA, 20 bp, Artificial Sequence
  chemically synthesized
agtaatagcatcatcatcag

SEQ ID NO: 105253 - DNA, 20 bp, Artificial Sequence
  chemically synthesized
agcatcatcatcagcagtta

SEQ ID NO: 105254 - DNA, 20 bp, Artificial Sequence
  chemically synthesized
aaaatgcaattaataaagaa

SEQ ID NO: 105255 - DNA, 20 bp, Artificial Sequence
  chemically synthesized
tacataaaatgcaattaata

SEQ ID NO: 105256 - DNA, 20 bp, Artificial Sequence
  chemically synthesized
agattaccatacagagagta

SEQ ID NO: 105257 - DNA, 20 bp, Artificial Sequence
  chemically synthesized
gagattaccatacagagagt

SEQ ID NO: 105258 - DNA, 20 bp, Artificial Sequence
  chemically synthesized
tatgtaccttactctctgta

SEQ ID NO: 105259 - DNA, 20 bp, Artificial Sequence
  chemically synthesized
aaatgagattaccatacaga

SEQ ID NO: 105260 - DNA, 20 bp, Artificial Sequence
  chemically synthesized
ttaaatgagattaccataca

SEQ ID NO: 105261 - DNA, 20 bp, Artificial Sequence
  chemically synthesized
gcttaaatgagattaccata

SEQ ID NO: 105262 - DNA, 20 bp, Artificial Sequence
  chemically synthesized
tctgtatggtaatctcattt

SEQ ID NO: 105263 - DNA, 20 bp, Artificial Sequence
  chemically synthesized
ggtgactaaagggcttaaat

SEQ ID NO: 105264 - DNA, 20 bp, Artificial Sequence
  chemically synthesized
gtaatctcatttaagccctt

SEQ ID NO: 105265 - DNA, 20 bp, Artificial Sequence
  chemically synthesized
tgtttcttagggtgactaaa

SEQ ID NO: 105266 - DNA, 20 bp, Artificial Sequence
  chemically synthesized
ctgtttcttagggtgactaa

SEQ ID NO: 105267 - DNA, 20 bp, Artificial Sequence
  chemically synthesized
tctgtttcttagggtgacta

SEQ ID NO: 105268 - DNA, 20 bp, Artificial Sequence
  chemically synthesized
ttaagccctttagtcaccct

SEQ ID NO: 105269 - DNA, 20 bp, Artificial Sequence
  chemically synthesized
cctttagtcaccctaagaaa

SEQ ID NO: 105270 - DNA, 20 bp, Artificial Sequence
  chemically synthesized
ataaagttttctgtttctta

SEQ ID NO: 105271 - DNA, 20 bp, Artificial Sequence
  chemically synthesized
cataaagttttctgtttctt

SEQ ID NO: 105272 - DNA, 20 bp, Artificial Sequence
  chemically synthesized
tcataaagttttctgtttct

SEQ ID NO: 105273 - DNA, 20 bp, Artificial Sequence
  chemically synthesized
taagaaacagaaaactttat

SEQ ID NO: 105274 - DNA, 20 bp, Artificial Sequence
  chemically synthesized
aagaaacagaaaactttatg

SEQ ID NO: 105275 - DNA, 20 bp, Artificial Sequence
  chemically synthesized
ctagcctcagtttcctcata

SEQ ID NO: 105276 - DNA, 20 bp, Artificial Sequence
  chemically synthesized
gaaaactttatgaggaaact

SEQ ID NO: 105277 - DNA, 20 bp, Artificial Sequence
  chemically synthesized
aaaactttatgaggaaactg

SEQ ID NO: 105278 - DNA, 20 bp, Artificial Sequence
  chemically synthesized
ctttatgaggaaactgaggc

SEQ ID NO: 105279 - DNA, 20 bp, Artificial Sequence
  chemically synthesized
tatgaggaaactgaggctag

SEQ ID NO: 105280 - DNA, 20 bp, Artificial Sequence
  chemically synthesized
ttttaaatctcttctagcct

SEQ ID NO: 105281 - DNA, 20 bp, Artificial Sequence
  chemically synthesized
tgaggaaactgaggctagaa

SEQ ID NO: 105282 - DNA, 20 bp, Artificial Sequence
  chemically synthesized
gcaaatttttaaatctcttc

SEQ ID NO: 105283 - DNA, 20 bp, Artificial Sequence
  chemically synthesized
gagatttaaaaatttgccaa

SEQ ID NO: 105284 - DNA, 20 bp, Artificial Sequence
  chemically synthesized
gattcgaatcttgtcaccgt

SEQ ID NO: 105285 - DNA, 20 bp, Artificial Sequence
  chemically synthesized
aaaaatttgccaacggtgac

SEQ ID NO: 105286 - DNA, 20 bp, Artificial Sequence
  chemically synthesized
aacggtgacaagattcgaat

SEQ ID NO: 105287 - DNA, 20 bp, Artificial Sequence
  chemically synthesized
acggtgacaagattcgaatc

SEQ ID NO: 105288 - DNA, 20 bp, Artificial Sequence
  chemically synthesized
atcaggtatgcttgacttca

SEQ ID NO: 105289 - DNA, 20 bp, Artificial Sequence
  chemically synthesized
gcccttatcactgtgaagtc

SEQ ID NO: 105290 - DNA, 20 bp, Artificial Sequence
  chemically synthesized
ttcaggcccttatcactgtg

SEQ ID NO: 105291 - DNA, 20 bp, Artificial Sequence
  chemically synthesized
atgcttgacttcacagtgat

SEQ ID NO: 105292 - DNA, 20 bp, Artificial Sequence
  chemically synthesized
tgcttgacttcacagtgata

SEQ ID NO: 105293 - DNA, 20 bp, Artificial Sequence
  chemically synthesized
gcttgacttcacagtgataa

SEQ ID NO: 105294 - DNA, 20 bp, Artificial Sequence
  chemically synthesized
gtgataagggcctgaaacca

SEQ ID NO: 105295 - DNA, 20 bp, Artificial Sequence
  chemically synthesized
ctatgattctctatggtttc

SEQ ID NO: 105296 - DNA, 20 bp, Artificial Sequence
  chemically synthesized
tctatgattctctatggttt

SEQ ID NO: 105297 - DNA, 20 bp, Artificial Sequence
  chemically synthesized
gataagggcctgaaaccata

SEQ ID NO: 105298 - DNA, 20 bp, Artificial Sequence
  chemically synthesized
tttttctctatgattctcta

SEQ ID NO: 105299 - DNA, 20 bp, Artificial Sequence
  chemically synthesized
cctgaaaccatagagaatca

SEQ ID NO: 105300 - DNA, 20 bp, Artificial Sequence
  chemically synthesized
tgaaaccatagagaatcata

SEQ ID NO: 105301 - DNA, 20 bp, Artificial Sequence
  chemically synthesized
catagagaaaaatctgcttt

SEQ ID NO: 105302 - DNA, 20 bp, Artificial Sequence
  chemically synthesized
ctcctaagtctgtcttaaag

SEQ ID NO: 105303 - DNA, 20 bp, Artificial Sequence
  chemically synthesized
gagaaaaatctgctttaaga

SEQ ID NO: 105304 - DNA, 20 bp, Artificial Sequence
  chemically synthesized
tacctcctaagtctgtctta

SEQ ID NO: 105305 - DNA, 20 bp, Artificial Sequence
  chemically synthesized
aatctgctttaagacagact

SEQ ID NO: 105306 - DNA, 20 bp, Artificial Sequence
  chemically synthesized
atctgctttaagacagactt

SEQ ID NO: 105307 - DNA, 20 bp, Artificial Sequence
  chemically synthesized
ctgctttaagacagacttag

SEQ ID NO: 105308 - DNA, 20 bp, Artificial Sequence
  chemically synthesized
tgctttaagacagacttagg

SEQ ID NO: 105309 - DNA, 20 bp, Artificial Sequence
  chemically synthesized
gactgcaaattttacctcct

SEQ ID NO: 105310 - DNA, 20 bp, Artificial Sequence
  chemically synthesized
gacttaggaggtaaaatttg

SEQ ID NO: 105311 - DNA, 20 bp, Artificial Sequence
  chemically synthesized
aaatttgcagtcttttgtgt

SEQ ID NO: 105312 - DNA, 20 bp, Artificial Sequence
  chemically synthesized
atatgtctacactgacacaa

SEQ ID NO: 105313 - DNA, 20 bp, Artificial Sequence
  chemically synthesized
tgcagtcttttgtgtcagtg

SEQ ID NO: 105314 - DNA, 20 bp, Artificial Sequence
  chemically synthesized
cagtgtagacatatgcataa

SEQ ID NO: 105315 - DNA, 20 bp, Artificial Sequence
  chemically synthesized
gtgtagacatatgcataaaa

SEQ ID NO: 105316 - DNA, 20 bp, Artificial Sequence
  chemically synthesized
gtagacatatgcataaaaga

SEQ ID NO: 105317 - DNA, 20 bp, Artificial Sequence
  chemically synthesized
gacatatgcataaaagagag

SEQ ID NO: 105318 - DNA, 20 bp, Artificial Sequence
  chemically synthesized
ataaaagagagaagtctcac

SEQ ID NO: 105319 - DNA, 20 bp, Artificial Sequence
  chemically synthesized
tagaaacttctgattctggt

SEQ ID NO: 105320 - DNA, 20 bp, Artificial Sequence
  chemically synthesized
gagagaagtctcaccagaat

SEQ ID NO: 105321 - DNA, 20 bp, Artificial Sequence
  chemically synthesized
agaagtctcaccagaatcag

SEQ ID NO: 105322 - DNA, 20 bp, Artificial Sequence
  chemically synthesized
aagctagaaacttctgattc

SEQ ID NO: 105323 - DNA, 20 bp, Artificial Sequence
  chemically synthesized
tcaccagaatcagaagtttc

SEQ ID NO: 105324 - DNA, 20 bp, Artificial Sequence
  chemically synthesized
atctacccaattatttaagc

SEQ ID NO: 105325 - DNA, 20 bp, Artificial Sequence
  chemically synthesized
aagtttctagcttaaataat

SEQ ID NO: 105326 - DNA, 20 bp, Artificial Sequence
  chemically synthesized
caccatctacccaattattt

SEQ ID NO: 105327 - DNA, 20 bp, Artificial Sequence
  chemically synthesized
agtttctagcttaaataatt

SEQ ID NO: 105328 - DNA, 20 bp, Artificial Sequence
  chemically synthesized
ttctagcttaaataattggg

SEQ ID NO: 105329 - DNA, 20 bp, Artificial Sequence
  chemically synthesized
agcttaaataattgggtaga

SEQ ID NO: 105330 - DNA, 20 bp, Artificial Sequence
  chemically synthesized
ttaaataattgggtagatgg

SEQ ID NO: 105331 - DNA, 20 bp, Artificial Sequence
  chemically synthesized
ctattctctatttcagaaga

SEQ ID NO: 105332 - DNA, 20 bp, Artificial Sequence
  chemically synthesized
ggtggtgccatcttctgaaa

SEQ ID NO: 105333 - DNA, 20 bp, Artificial Sequence
  chemically synthesized
gcctctattctctatttcag

SEQ ID NO: 105334 - DNA, 20 bp, Artificial Sequence
  chemically synthesized
tggtgccatcttctgaaata

SEQ ID NO: 105335 - DNA, 20 bp, Artificial Sequence
  chemically synthesized
actgcctctattctctattt

SEQ ID NO: 105336 - DNA, 20 bp, Artificial Sequence
  chemically synthesized
ccatcttctgaaatagagaa

SEQ ID NO: 105337 - DNA, 20 bp, Artificial Sequence
  chemically synthesized
atcttctgaaatagagaata

SEQ ID NO: 105338 - DNA, 20 bp, Artificial Sequence
  chemically synthesized
tcttctgaaatagagaatag

SEQ ID NO: 105339 - DNA, 20 bp, Artificial Sequence
  chemically synthesized
tctgaaatagagaatagagg

SEQ ID NO: 105340 - DNA, 20 bp, Artificial Sequence
  chemically synthesized
gaaatagagaatagaggcag

SEQ ID NO: 105341 - DNA, 20 bp, Artificial Sequence
  chemically synthesized
aaatagagaatagaggcagt

SEQ ID NO: 105342 - DNA, 20 bp, Artificial Sequence
  chemically synthesized
aatagagaatagaggcagta

SEQ ID NO: 105343 - DNA, 20 bp, Artificial Sequence
  chemically synthesized
atagagaatagaggcagtag

SEQ ID NO: 105344 - DNA, 20 bp, Artificial Sequence
  chemically synthesized
atagaggcagtaggggattt

SEQ ID NO: 105345 - DNA, 20 bp, Artificial Sequence
  chemically synthesized
ggcagtaggggatttcagtt

SEQ ID NO: 105346 - DNA, 20 bp, Artificial Sequence
  chemically synthesized
gcagtaggggatttcagttt

SEQ ID NO: 105347 - DNA, 20 bp, Artificial Sequence
  chemically synthesized
ggccacagacattttaacat

SEQ ID NO: 105348 - DNA, 20 bp, Artificial Sequence
  chemically synthesized
tgctaatgttaaaatgtctg

SEQ ID NO: 105349 - DNA, 20 bp, Artificial Sequence
  chemically synthesized
gttaaaatgtctgtggccat

SEQ ID NO: 105350 - DNA, 20 bp, Artificial Sequence
  chemically synthesized
ttgagtcttactcatggcca

SEQ ID NO: 105351 - DNA, 20 bp, Artificial Sequence
  chemically synthesized
aaatgtctgtggccatgagt

SEQ ID NO: 105352 - DNA, 20 bp, Artificial Sequence
  chemically synthesized
aatattttgagtcttactca

SEQ ID NO: 105353 - DNA, 20 bp, Artificial Sequence
  chemically synthesized
aagcagttgtcaaatatttt

SEQ ID NO: 105354 - DNA, 20 bp, Artificial Sequence
  chemically synthesized
aaaatatttgacaactgctt

SEQ ID NO: 105355 - DNA, 20 bp, Artificial Sequence
  chemically synthesized
tggttgggcttttgctaaag

SEQ ID NO: 105356 - DNA, 20 bp, Artificial Sequence
  chemically synthesized
tttgacaactgctttagcaa

SEQ ID NO: 105357 - DNA, 20 bp, Artificial Sequence
  chemically synthesized
atttggttgggcttttgcta

SEQ ID NO: 105358 - DNA, 20 bp, Artificial Sequence
  chemically synthesized
ttagcaaaagcccaaccaaa

SEQ ID NO: 105359 - DNA, 20 bp, Artificial Sequence
  chemically synthesized
agtgttttctctatttggtt

SEQ ID NO: 105360 - DNA, 20 bp, Artificial Sequence
  chemically synthesized
tagtgttttctctatttggt

SEQ ID NO: 105361 - DNA, 20 bp, Artificial Sequence
  chemically synthesized
agcaaaagcccaaccaaata

SEQ ID NO: 105362 - DNA, 20 bp, Artificial Sequence
  chemically synthesized
tgagtagtgttttctctatt

SEQ ID NO: 105363 - DNA, 20 bp, Artificial Sequence
  chemically synthesized
caaatagagaaaacactact

SEQ ID NO: 105364 - DNA, 20 bp, Artificial Sequence
  chemically synthesized
cacaggtagggtgtactgag

SEQ ID NO: 105365 - DNA, 20 bp, Artificial Sequence
  chemically synthesized
aagcacaggtagggtgtact

SEQ ID NO: 105366 - DNA, 20 bp, Artificial Sequence
  chemically synthesized
cctgctgataagcacaggta

SEQ ID NO: 105367 - DNA, 20 bp, Artificial Sequence
  chemically synthesized
acctgctgataagcacaggt

SEQ ID NO: 105368 - DNA, 20 bp, Artificial Sequence
  chemically synthesized
tacctgctgataagcacagg

SEQ ID NO: 105369 - DNA, 20 bp, Artificial Sequence
  chemically synthesized
tggtacctgctgataagcac

SEQ ID NO: 105370 - DNA, 20 bp, Artificial Sequence
  chemically synthesized
tacaccctacctgtgcttat

SEQ ID NO: 105371 - DNA, 20 bp, Artificial Sequence
  chemically synthesized
ctggtacctgctgataagca

SEQ ID NO: 105372 - DNA, 20 bp, Artificial Sequence
  chemically synthesized
accctacctgtgcttatcag

SEQ ID NO: 105373 - DNA, 20 bp, Artificial Sequence
  chemically synthesized
ccctacctgtgcttatcagc

SEQ ID NO: 105374 - DNA, 20 bp, Artificial Sequence
  chemically synthesized
caggactggtacctgctgat

SEQ ID NO: 105375 - DNA, 20 bp, Artificial Sequence
  chemically synthesized
ctgtgcttatcagcaggtac

SEQ ID NO: 105376 - DNA, 20 bp, Artificial Sequence
  chemically synthesized
atcagcaggtaccagtcctg

SEQ ID NO: 105377 - DNA, 20 bp, Artificial Sequence
  chemically synthesized
ctatatttagaccacaggac

SEQ ID NO: 105378 - DNA, 20 bp, Artificial Sequence
  chemically synthesized
aacttctatatttagaccac

SEQ ID NO: 105379 - DNA, 20 bp, Artificial Sequence
  chemically synthesized
gaacttctatatttagacca

SEQ ID NO: 105380 - DNA, 20 bp, Artificial Sequence
  chemically synthesized
ccagtcctgtggtctaaata

SEQ ID NO: 105381 - DNA, 20 bp, Artificial Sequence
  chemically synthesized
gtcctgtggtctaaatatag

SEQ ID NO: 105382 - DNA, 20 bp, Artificial Sequence
  chemically synthesized
ccccagtgaacttctatatt

SEQ ID NO: 105383 - DNA, 20 bp, Artificial Sequence
  chemically synthesized
gtctaaatatagaagttcac

SEQ ID NO: 105384 - DNA, 20 bp, Artificial Sequence
  chemically synthesized
tctaaatatagaagttcact

SEQ ID NO: 105385 - DNA, 20 bp, Artificial Sequence
  chemically synthesized
ctaaatatagaagttcactg

SEQ ID NO: 105386 - DNA, 20 bp, Artificial Sequence
  chemically synthesized
aaatatagaagttcactggg

SEQ ID NO: 105387 - DNA, 20 bp, Artificial Sequence
  chemically synthesized
cattgacatctgcaactccc

SEQ ID NO: 105388 - DNA, 20 bp, Artificial Sequence
  chemically synthesized
agaagttcactggggagttg

SEQ ID NO: 105389 - DNA, 20 bp, Artificial Sequence
  chemically synthesized
gggagttgcagatgtcaatg

SEQ ID NO: 105390 - DNA, 20 bp, Artificial Sequence
  chemically synthesized
ttgcagatgtcaatgtagaa

SEQ ID NO: 105391 - DNA, 20 bp, Artificial Sequence
  chemically synthesized
gatgtcaatgtagaatggcc

SEQ ID NO: 105392 - DNA, 20 bp, Artificial Sequence
  chemically synthesized
tgtcaatgtagaatggccaa

SEQ ID NO: 105393 - DNA, 20 bp, Artificial Sequence
  chemically synthesized
gtcaatgtagaatggccaag

SEQ ID NO: 105394 - DNA, 20 bp, Artificial Sequence
  chemically synthesized
tcaatgtagaatggccaaga

SEQ ID NO: 105395 - DNA, 20 bp, Artificial Sequence
  chemically synthesized
caatgtagaatggccaagag

SEQ ID NO: 105396 - DNA, 20 bp, Artificial Sequence
  chemically synthesized
tgctgcctatgtacccctct

SEQ ID NO: 105397 - DNA, 20 bp, Artificial Sequence
  chemically synthesized
gaatggccaagaggggtaca

SEQ ID NO: 105398 - DNA, 20 bp, Artificial Sequence
  chemically synthesized
aatggccaagaggggtacat

SEQ ID NO: 105399 - DNA, 20 bp, Artificial Sequence
  chemically synthesized
ggccaagaggggtacatagg

SEQ ID NO: 105400 - DNA, 20 bp, Artificial Sequence
  chemically synthesized
acataggcagcatatgcttt

SEQ ID NO: 105401 - DNA, 20 bp, Artificial Sequence
  chemically synthesized
ataggcagcatatgctttga

SEQ ID NO: 105402 - DNA, 20 bp, Artificial Sequence
  chemically synthesized
ctataagcagatgactctca

SEQ ID NO: 105403 - DNA, 20 bp, Artificial Sequence
  chemically synthesized
ctttgagagtcatctgctta

SEQ ID NO: 105404 - DNA, 20 bp, Artificial Sequence
  chemically synthesized
ctctaattagtatctataag

SEQ ID NO: 105405 - DNA, 20 bp, Artificial Sequence
  chemically synthesized
cggctctaattagtatctat

SEQ ID NO: 105406 - DNA, 20 bp, Artificial Sequence
  chemically synthesized
atctgcttatagatactaat

SEQ ID NO: 105407 - DNA, 20 bp, Artificial Sequence
  chemically synthesized
ctgcttatagatactaatta

SEQ ID NO: 105408 - DNA, 20 bp, Artificial Sequence
  chemically synthesized
tcttcatccacggctctaat

SEQ ID NO: 105409 - DNA, 20 bp, Artificial Sequence
  chemically synthesized
atagatactaattagagccg

SEQ ID NO: 105410 - DNA, 20 bp, Artificial Sequence
  chemically synthesized
actaattagagccgtggatg

SEQ ID NO: 105411 - DNA, 20 bp, Artificial Sequence
  chemically synthesized
tgtgatctcatcttcatcca

SEQ ID NO: 105412 - DNA, 20 bp, Artificial Sequence
  chemically synthesized
ttagagccgtggatgaagat

SEQ ID NO: 105413 - DNA, 20 bp, Artificial Sequence
  chemically synthesized
cgtggatgaagatgagatca

SEQ ID NO: 105414 - DNA, 20 bp, Artificial Sequence
  chemically synthesized
ggatgaagatgagatcacag

SEQ ID NO: 105415 - DNA, 20 bp, Artificial Sequence
  chemically synthesized
atgaagatgagatcacagaa

SEQ ID NO: 105416 - DNA, 20 bp, Artificial Sequence
  chemically synthesized
atgagatcacagaagagatg

SEQ ID NO: 105417 - DNA, 20 bp, Artificial Sequence
  chemically synthesized
atcacagaagagatgtggca

SEQ ID NO: 105418 - DNA, 20 bp, Artificial Sequence
  chemically synthesized
cagaagagatgtggcatgga

SEQ ID NO: 105419 - DNA, 20 bp, Artificial Sequence
  chemically synthesized
gagatgtggcatggaaagtg

SEQ ID NO: 105420 - DNA, 20 bp, Artificial Sequence
  chemically synthesized
atgtggcatggaaagtgaag

SEQ ID NO: 105421 - DNA, 20 bp, Artificial Sequence
  chemically synthesized
atggaaagtgaagaagtgct

SEQ ID NO: 105422 - DNA, 20 bp, Artificial Sequence
  chemically synthesized
tggaaagtgaagaagtgctg

SEQ ID NO: 105423 - DNA, 20 bp, Artificial Sequence
  chemically synthesized
ggaaagtgaagaagtgctga

SEQ ID NO: 105424 - DNA, 20 bp, Artificial Sequence
  chemically synthesized
aagtgaagaagtgctgaggg

SEQ ID NO: 105425 - DNA, 20 bp, Artificial Sequence
  chemically synthesized
agtgaagaagtgctgagggt

SEQ ID NO: 105426 - DNA, 20 bp, Artificial Sequence
  chemically synthesized
tgctccccagatcctaccct

SEQ ID NO: 105427 - DNA, 20 bp, Artificial Sequence
  chemically synthesized
gaagtgctgagggtaggatc

SEQ ID NO: 105428 - DNA, 20 bp, Artificial Sequence
  chemically synthesized
aagtgctgagggtaggatct

SEQ ID NO: 105429 - DNA, 20 bp, Artificial Sequence
  chemically synthesized
agtgctgagggtaggatctg

SEQ ID NO: 105430 - DNA, 20 bp, Artificial Sequence
  chemically synthesized
tgctgagggtaggatctggg

SEQ ID NO: 105431 - DNA, 20 bp, Artificial Sequence
  chemically synthesized
tgagggtaggatctggggag

SEQ ID NO: 105432 - DNA, 20 bp, Artificial Sequence
  chemically synthesized
taataagtatggctgctccc

SEQ ID NO: 105433 - DNA, 20 bp, Artificial Sequence
  chemically synthesized
agcctcttccataataagta

SEQ ID NO: 105434 - DNA, 20 bp, Artificial Sequence
  chemically synthesized
gggagcagccatacttatta

SEQ ID NO: 105435 - DNA, 20 bp, Artificial Sequence
  chemically synthesized
agcagccatacttattatgg

SEQ ID NO: 105436 - DNA, 20 bp, Artificial Sequence
  chemically synthesized
tcctcagcctcttccataat

SEQ ID NO: 105437 - DNA, 20 bp, Artificial Sequence
  chemically synthesized
cagccatacttattatggaa

SEQ ID NO: 105438 - DNA, 20 bp, Artificial Sequence
  chemically synthesized
agccatacttattatggaag

SEQ ID NO: 105439 - DNA, 20 bp, Artificial Sequence
  chemically synthesized
tacttattatggaagaggct

SEQ ID NO: 105440 - DNA, 20 bp, Artificial Sequence
  chemically synthesized
acttattatggaagaggctg

SEQ ID NO: 105441 - DNA, 20 bp, Artificial Sequence
  chemically synthesized
ctttcctgatgattcatcct

SEQ ID NO: 105442 - DNA, 20 bp, Artificial Sequence
  chemically synthesized
agaggctgaggatgaatcat

SEQ ID NO: 105443 - DNA, 20 bp, Artificial Sequence
  chemically synthesized
gaggctgaggatgaatcatc

SEQ ID NO: 105444 - DNA, 20 bp, Artificial Sequence
  chemically synthesized
ctgaggatgaatcatcagga

SEQ ID NO: 105445 - DNA, 20 bp, Artificial Sequence
  chemically synthesized
gaggatgaatcatcaggaaa

SEQ ID NO: 105446 - DNA, 20 bp, Artificial Sequence
  chemically synthesized
cctgtctccataggacattt

SEQ ID NO: 105447 - DNA, 20 bp, Artificial Sequence
  chemically synthesized
aaagagactcaaatgtccta

SEQ ID NO: 105448 - DNA, 20 bp, Artificial Sequence
  chemically synthesized
agagactcaaatgtcctatg

SEQ ID NO: 105449 - DNA, 20 bp, Artificial Sequence
  chemically synthesized
actcaaatgtcctatggaga

SEQ ID NO: 105450 - DNA, 20 bp, Artificial Sequence
  chemically synthesized
ttcacctgacctgtctccat

SEQ ID NO: 105451 - DNA, 20 bp, Artificial Sequence
  chemically synthesized
ctcaaatgtcctatggagac

SEQ ID NO: 105452 - DNA, 20 bp, Artificial Sequence
  chemically synthesized
tttcacctgacctgtctcca

SEQ ID NO: 105453 - DNA, 20 bp, Artificial Sequence
  chemically synthesized
aatgtcctatggagacaggt

SEQ ID NO: 105454 - DNA, 20 bp, Artificial Sequence
  chemically synthesized
atgtcctatggagacaggtc

SEQ ID NO: 105455 - DNA, 20 bp, Artificial Sequence
  chemically synthesized
agacaggtcaggtgaaaacc

SEQ ID NO: 105456 - DNA, 20 bp, Artificial Sequence
  chemically synthesized
gacaggtcaggtgaaaacct

SEQ ID NO: 105457 - DNA, 20 bp, Artificial Sequence
  chemically synthesized
acaggtcaggtgaaaacctg

SEQ ID NO: 105458 - DNA, 20 bp, Artificial Sequence
  chemically synthesized
ggtcaggtgaaaacctgggg

SEQ ID NO: 105459 - DNA, 20 bp, Artificial Sequence
  chemically synthesized
tcaggtgaaaacctggggaa

SEQ ID NO: 105460 - DNA, 20 bp, Artificial Sequence
  chemically synthesized
caggtgaaaacctggggaag

SEQ ID NO: 105461 - DNA, 20 bp, Artificial Sequence
  chemically synthesized
tctctaacaccctcttcccc

SEQ ID NO: 105462 - DNA, 20 bp, Artificial Sequence
  chemically synthesized
aggtgaaaacctggggaaga

SEQ ID NO: 105463 - DNA, 20 bp, Artificial Sequence
  chemically synthesized
ttctctaacaccctcttccc

SEQ ID NO: 105464 - DNA, 20 bp, Artificial Sequence
  chemically synthesized
aaacctggggaagagggtgt

SEQ ID NO: 105465 - DNA, 20 bp, Artificial Sequence
  chemically synthesized
acctggggaagagggtgtta

SEQ ID NO: 105466 - DNA, 20 bp, Artificial Sequence
  chemically synthesized
aagagggtgttagagaacta

SEQ ID NO: 105467 - DNA, 20 bp, Artificial Sequence
  chemically synthesized
agagggtgttagagaactaa

SEQ ID NO: 105468 - DNA, 20 bp, Artificial Sequence
  chemically synthesized
agggtgttagagaactaaag

SEQ ID NO: 105469 - DNA, 20 bp, Artificial Sequence
  chemically synthesized
ctccttgtaattttctcctt

SEQ ID NO: 105470 - DNA, 20 bp, Artificial Sequence
  chemically synthesized
gaactaaaggagaaaattac

SEQ ID NO: 105471 - DNA, 20 bp, Artificial Sequence
  chemically synthesized
aactaaaggagaaaattaca

SEQ ID NO: 105472 - DNA, 20 bp, Artificial Sequence
  chemically synthesized
ctaaaggagaaaattacaag

SEQ ID NO: 105473 - DNA, 20 bp, Artificial Sequence
  chemically synthesized
aaggagaaaattacaaggag

SEQ ID NO: 105474 - DNA, 20 bp, Artificial Sequence
  chemically synthesized
gaaaattacaaggagaagct

SEQ ID NO: 105475 - DNA, 20 bp, Artificial Sequence
  chemically synthesized
attacaaggagaagctgagt

SEQ ID NO: 105476 - DNA, 20 bp, Artificial Sequence
  chemically synthesized
ttacaaggagaagctgagtc

SEQ ID NO: 105477 - DNA, 20 bp, Artificial Sequence
  chemically synthesized
ccctgccaaattgcctgact

SEQ ID NO: 105478 - DNA, 20 bp, Artificial Sequence
  chemically synthesized
agaagctgagtcaggcaatt

SEQ ID NO: 105479 - DNA, 20 bp, Artificial Sequence
  chemically synthesized
agctgagtcaggcaatttgg

SEQ ID NO: 105480 - DNA, 20 bp, Artificial Sequence
  chemically synthesized
gctgagtcaggcaatttggc

SEQ ID NO: 105481 - DNA, 20 bp, Artificial Sequence
  chemically synthesized
ctgagtcaggcaatttggca

SEQ ID NO: 105482 - DNA, 20 bp, Artificial Sequence
  chemically synthesized
tgagtcaggcaatttggcag

SEQ ID NO: 105483 - DNA, 20 bp, Artificial Sequence
  chemically synthesized
gagtcaggcaatttggcagg

SEQ ID NO: 105484 - DNA, 20 bp, Artificial Sequence
  chemically synthesized
tcaggcaatttggcaggggg

SEQ ID NO: 105485 - DNA, 20 bp, Artificial Sequence
  chemically synthesized
caggcaatttggcagggggt

SEQ ID NO: 105486 - DNA, 20 bp, Artificial Sequence
  chemically synthesized
gctctcactaagaaaatcaa

SEQ ID NO: 105487 - DNA, 20 bp, Artificial Sequence
  chemically synthesized
gggtaggctattgattttct

SEQ ID NO: 105488 - DNA, 20 bp, Artificial Sequence
  chemically synthesized
aggctattgattttcttagt

SEQ ID NO: 105489 - DNA, 20 bp, Artificial Sequence
  chemically synthesized
gctattgattttcttagtga

SEQ ID NO: 105490 - DNA, 20 bp, Artificial Sequence
  chemically synthesized
ccaggcaaactgctctcact

SEQ ID NO: 105491 - DNA, 20 bp, Artificial Sequence
  chemically synthesized
attgattttcttagtgagag

SEQ ID NO: 105492 - DNA, 20 bp, Artificial Sequence
  chemically synthesized
cttagtgagagcagtttgcc

SEQ ID NO: 105493 - DNA, 20 bp, Artificial Sequence
  chemically synthesized
tgagagcagtttgcctggca

SEQ ID NO: 105494 - DNA, 20 bp, Artificial Sequence
  chemically synthesized
gagcagtttgcctggcacgg

SEQ ID NO: 105495 - DNA, 20 bp, Artificial Sequence
  chemically synthesized
gctattactcctaccgtgcc

SEQ ID NO: 105496 - DNA, 20 bp, Artificial Sequence
  chemically synthesized
agcagtttgcctggcacggt

SEQ ID NO: 105497 - DNA, 20 bp, Artificial Sequence
  chemically synthesized
ggctattactcctaccgtgc

SEQ ID NO: 105498 - DNA, 20 bp, Artificial Sequence
  chemically synthesized
cagtttgcctggcacggtag

SEQ ID NO: 105499 - DNA, 20 bp, Artificial Sequence
  chemically synthesized
gcctggcacggtaggagtaa

SEQ ID NO: 105500 - DNA, 20 bp, Artificial Sequence
  chemically synthesized
ggcacggtaggagtaatagc

SEQ ID NO: 105501 - DNA, 20 bp, Artificial Sequence
  chemically synthesized
aggagtaatagccagataaa

SEQ ID NO: 105502 - DNA, 20 bp, Artificial Sequence
  chemically synthesized
cacttttcagtccatttatc

SEQ ID NO: 105503 - DNA, 20 bp, Artificial Sequence
  chemically synthesized
agccagataaatggactgaa

SEQ ID NO: 105504 - DNA, 20 bp, Artificial Sequence
  chemically synthesized
agataaatggactgaaaagt

SEQ ID NO: 105505 - DNA, 20 bp, Artificial Sequence
  chemically synthesized
tttacccacagctcactttt

SEQ ID NO: 105506 - DNA, 20 bp, Artificial Sequence
  chemically synthesized
atggactgaaaagtgagctg

SEQ ID NO: 105507 - DNA, 20 bp, Artificial Sequence
  chemically synthesized
tggactgaaaagtgagctgt

SEQ ID NO: 105508 - DNA, 20 bp, Artificial Sequence
  chemically synthesized
tgaaaagtgagctgtgggta

SEQ ID NO: 105509 - DNA, 20 bp, Artificial Sequence
  chemically synthesized
tagctcaccttctttaccca

SEQ ID NO: 105510 - DNA, 20 bp, Artificial Sequence
  chemically synthesized
aaagtgagctgtgggtaaag

SEQ ID NO: 105511 - DNA, 20 bp, Artificial Sequence
  chemically synthesized
aagtgagctgtgggtaaaga

SEQ ID NO: 105512 - DNA, 20 bp, Artificial Sequence
  chemically synthesized
gagctgtgggtaaagaaggt

SEQ ID NO: 105513 - DNA, 20 bp, Artificial Sequence
  chemically synthesized
tgtgggtaaagaaggtgagc

SEQ ID NO: 105514 - DNA, 20 bp, Artificial Sequence
  chemically synthesized
gtgggtaaagaaggtgagct

SEQ ID NO: 105515 - DNA, 20 bp, Artificial Sequence
  chemically synthesized
ggtaaagaaggtgagctagg

SEQ ID NO: 105516 - DNA, 20 bp, Artificial Sequence
  chemically synthesized
gaaaatgtagcagagctgcc

SEQ ID NO: 105517 - DNA, 20 bp, Artificial Sequence
  chemically synthesized
aaagaaaagaaaatgtagca

SEQ ID NO: 105518 - DNA, 20 bp, Artificial Sequence
  chemically synthesized
aaaaagaaaagaaaatgtag

SEQ ID NO: 105519 - DNA, 20 bp, Artificial Sequence
  chemically synthesized
taaaaaaagaaaagaaaatg

SEQ ID NO: 105520 - DNA, 20 bp, Artificial Sequence
  chemically synthesized
atagaactttaaaaaaagaa

SEQ ID NO: 105521 - DNA, 20 bp, Artificial Sequence
  chemically synthesized
cattttcttttcttttttta

SEQ ID NO: 105522 - DNA, 20 bp, Artificial Sequence
  chemically synthesized
taatcatagaactttaaaaa

SEQ ID NO: 105523 - DNA, 20 bp, Artificial Sequence
  chemically synthesized
cttaaaataaaaattaatca

SEQ ID NO: 105524 - DNA, 20 bp, Artificial Sequence
  chemically synthesized
ctatgattaatttttatttt

SEQ ID NO: 105525 - DNA, 20 bp, Artificial Sequence
  chemically synthesized
aatttttattttaagttccg

SEQ ID NO: 105526 - DNA, 20 bp, Artificial Sequence
  chemically synthesized
cacatcctgcacatgtacca

SEQ ID NO: 105527 - DNA, 20 bp, Artificial Sequence
  chemically synthesized
taagttccgtggtacatgtg

SEQ ID NO: 105528 - DNA, 20 bp, Artificial Sequence
  chemically synthesized
aagttccgtggtacatgtgc

SEQ ID NO: 105529 - DNA, 20 bp, Artificial Sequence
  chemically synthesized
tggtacatgtgcaggatgtg

SEQ ID NO: 105530 - DNA, 20 bp, Artificial Sequence
  chemically synthesized
ggtacatgtgcaggatgtgc

SEQ ID NO: 105531 - DNA, 20 bp, Artificial Sequence
  chemically synthesized
ggatgtgcaggtttgttaca

SEQ ID NO: 105532 - DNA, 20 bp, Artificial Sequence
  chemically synthesized
gatgtgcaggtttgttacat

SEQ ID NO: 105533 - DNA, 20 bp, Artificial Sequence
  chemically synthesized
acataggtaaacatgtgcca

SEQ ID NO: 105534 - DNA, 20 bp, Artificial Sequence
  chemically synthesized
taggtaaacatgtgccatgg

SEQ ID NO: 105535 - DNA, 20 bp, Artificial Sequence
  chemically synthesized
ataggtgcagcaaaccacca

SEQ ID NO: 105536 - DNA, 20 bp, Artificial Sequence
  chemically synthesized
aggtgatgggttaataggtg

SEQ ID NO: 105537 - DNA, 20 bp, Artificial Sequence
  chemically synthesized
tctctaggtgatgggttaat

SEQ ID NO: 105538 - DNA, 20 bp, Artificial Sequence
  chemically synthesized
atctctaggtgatgggttaa

SEQ ID NO: 105539 - DNA, 20 bp, Artificial Sequence
  chemically synthesized
gcacctattaacccatcacc

SEQ ID NO: 105540 - DNA, 20 bp, Artificial Sequence
  chemically synthesized
tatatatatctctaggtgat

SEQ ID NO: 105541 - DNA, 20 bp, Artificial Sequence
  chemically synthesized
acctattaacccatcaccta

SEQ ID NO: 105542 - DNA, 20 bp, Artificial Sequence
  chemically synthesized
atatatatatctctaggtga

SEQ ID NO: 105543 - DNA, 20 bp, Artificial Sequence
  chemically synthesized
atatatatatatatatctct

SEQ ID NO: 105544 - DNA, 20 bp, Artificial Sequence
  chemically synthesized
aatatatatatatatatctc

SEQ ID NO: 105545 - DNA, 20 bp, Artificial Sequence
  chemically synthesized
atattttattattatacttt

SEQ ID NO: 105546 - DNA, 20 bp, Artificial Sequence
  chemically synthesized
tattattatactttaagttt

SEQ ID NO: 105547 - DNA, 20 bp, Artificial Sequence
  chemically synthesized
catatggaccctaaaactta

SEQ ID NO: 105548 - DNA, 20 bp, Artificial Sequence
  chemically synthesized
attattatactttaagtttt

SEQ ID NO: 105549 - DNA, 20 bp, Artificial Sequence
  chemically synthesized
ttattatactttaagtttta

SEQ ID NO: 105550 - DNA, 20 bp, Artificial Sequence
  chemically synthesized
taaccttcacgttgtgcata

SEQ ID NO: 105551 - DNA, 20 bp, Artificial Sequence
  chemically synthesized
gggtccatatgcacaacgtg

SEQ ID NO: 105552 - DNA, 20 bp, Artificial Sequence
  chemically synthesized
ggtccatatgcacaacgtga

SEQ ID NO: 105553 - DNA, 20 bp, Artificial Sequence
  chemically synthesized
catatgcacaacgtgaaggt

SEQ ID NO: 105554 - DNA, 20 bp, Artificial Sequence
  chemically synthesized
tatgtatacatgtgccatgt

SEQ ID NO: 105555 - DNA, 20 bp, Artificial Sequence
  chemically synthesized
ctgggtgcagcacaccaaca

SEQ ID NO: 105556 - DNA, 20 bp, Artificial Sequence
  chemically synthesized
ccatgttggtgtgctgcacc

SEQ ID NO: 105557 - DNA, 20 bp, Artificial Sequence
  chemically synthesized
aactgacgagttactgggtg

SEQ ID NO: 105558 - DNA, 20 bp, Artificial Sequence
  chemically synthesized
atgttaactgacgagttact

SEQ ID NO: 105559 - DNA, 20 bp, Artificial Sequence
  chemically synthesized
aatgttaactgacgagttac

SEQ ID NO: 105560 - DNA, 20 bp, Artificial Sequence
  chemically synthesized
tgctgcacccagtaactcgt

SEQ ID NO: 105561 - DNA, 20 bp, Artificial Sequence
  chemically synthesized
tacacctaatgttaactgac

SEQ ID NO: 105562 - DNA, 20 bp, Artificial Sequence
  chemically synthesized
agtaactcgtcagttaacat

SEQ ID NO: 105563 - DNA, 20 bp, Artificial Sequence
  chemically synthesized
gtaactcgtcagttaacatt

SEQ ID NO: 105564 - DNA, 20 bp, Artificial Sequence
  chemically synthesized
ggggggagggatagcatttg

SEQ ID NO: 105565 - DNA, 20 bp, Artificial Sequence
  chemically synthesized
gaggggggagggatagcatt

SEQ ID NO: 105566 - DNA, 20 bp, Artificial Sequence
  chemically synthesized
gtcgggggaggggggaggga

SEQ ID NO: 105567 - DNA, 20 bp, Artificial Sequence
  chemically synthesized
tggggtcgggggagggggga

SEQ ID NO: 105568 - DNA, 20 bp, Artificial Sequence
  chemically synthesized
gtggggtcgggggagggggg

SEQ ID NO: 105569 - DNA, 20 bp, Artificial Sequence
  chemically synthesized
tgtggggtcgggggaggggg

SEQ ID NO: 105570 - DNA, 20 bp, Artificial Sequence
  chemically synthesized
gttgtggggtcgggggaggg

SEQ ID NO: 105571 - DNA, 20 bp, Artificial Sequence
  chemically synthesized
tgttgtggggtcgggggagg

SEQ ID NO: 105572 - DNA, 20 bp, Artificial Sequence
  chemically synthesized
ctgttgtggggtcgggggag

SEQ ID NO: 105573 - DNA, 20 bp, Artificial Sequence
  chemically synthesized
cctgttgtggggtcggggga

SEQ ID NO: 105574 - DNA, 20 bp, Artificial Sequence
  chemically synthesized
gcctgttgtggggtcggggg

SEQ ID NO: 105575 - DNA, 20 bp, Artificial Sequence
  chemically synthesized
ggcctgttgtggggtcgggg

SEQ ID NO: 105576 - DNA, 20 bp, Artificial Sequence
  chemically synthesized
agggcctgttgtggggtcgg

SEQ ID NO: 105577 - DNA, 20 bp, Artificial Sequence
  chemically synthesized
cagggcctgttgtggggtcg

SEQ ID NO: 105578 - DNA, 20 bp, Artificial Sequence
  chemically synthesized
ccagggcctgttgtggggtc

SEQ ID NO: 105579 - DNA, 20 bp, Artificial Sequence
  chemically synthesized
accagggcctgttgtggggt

SEQ ID NO: 105580 - DNA, 20 bp, Artificial Sequence
  chemically synthesized
cccctcccccgaccccacaa

SEQ ID NO: 105581 - DNA, 20 bp, Artificial Sequence
  chemically synthesized
ccctcccccgaccccacaac

SEQ ID NO: 105582 - DNA, 20 bp, Artificial Sequence
  chemically synthesized
acacaccagggcctgttgtg

SEQ ID NO: 105583 - DNA, 20 bp, Artificial Sequence
  chemically synthesized
cacacaccagggcctgttgt

SEQ ID NO: 105584 - DNA, 20 bp, Artificial Sequence
  chemically synthesized
tcacacaccagggcctgttg

SEQ ID NO: 105585 - DNA, 20 bp, Artificial Sequence
  chemically synthesized
cccgaccccacaacaggccc

SEQ ID NO: 105586 - DNA, 20 bp, Artificial Sequence
  chemically synthesized
aaggggaacatcacacacca

SEQ ID NO: 105587 - DNA, 20 bp, Artificial Sequence
  chemically synthesized
gaaggggaacatcacacacc

SEQ ID NO: 105588 - DNA, 20 bp, Artificial Sequence
  chemically synthesized
ggaaggggaacatcacacac

SEQ ID NO: 105589 - DNA, 20 bp, Artificial Sequence
  chemically synthesized
gaacacatggacacaggaag

SEQ ID NO: 105590 - DNA, 20 bp, Artificial Sequence
  chemically synthesized
agaacacatggacacaggaa

SEQ ID NO: 105591 - DNA, 20 bp, Artificial Sequence
  chemically synthesized
gagaacacatggacacagga

SEQ ID NO: 105592 - DNA, 20 bp, Artificial Sequence
  chemically synthesized
tgagaacacatggacacagg

SEQ ID NO: 105593 - DNA, 20 bp, Artificial Sequence
  chemically synthesized
caatgagaacacatggacac

SEQ ID NO: 105594 - DNA, 20 bp, Artificial Sequence
  chemically synthesized
acaatgagaacacatggaca

SEQ ID NO: 105595 - DNA, 20 bp, Artificial Sequence
  chemically synthesized
aattgaacaatgagaacaca

SEQ ID NO: 105596 - DNA, 20 bp, Artificial Sequence
  chemically synthesized
acaggtgggaattgaacaat

SEQ ID NO: 105597 - DNA, 20 bp, Artificial Sequence
  chemically synthesized
attgttcaattcccacctgt

SEQ ID NO: 105598 - DNA, 20 bp, Artificial Sequence
  chemically synthesized
acatgttctcactcacaggt

SEQ ID NO: 105599 - DNA, 20 bp, Artificial Sequence
  chemically synthesized
cacatgttctcactcacagg

SEQ ID NO: 105600 - DNA, 20 bp, Artificial Sequence
  chemically synthesized
ttcaattcccacctgtgagt

SEQ ID NO: 105601 - DNA, 20 bp, Artificial Sequence
  chemically synthesized
caccacatgttctcactcac

SEQ ID NO: 105602 - DNA, 20 bp, Artificial Sequence
  chemically synthesized
acaccacatgttctcactca

SEQ ID NO: 105603 - DNA, 20 bp, Artificial Sequence
  chemically synthesized
cacctgtgagtgagaacatg

SEQ ID NO: 105604 - DNA, 20 bp, Artificial Sequence
  chemically synthesized
gagtgagaacatgtggtgtt

SEQ ID NO: 105605 - DNA, 20 bp, Artificial Sequence
  chemically synthesized
ttggttttttgtccttgcca

SEQ ID NO: 105606 - DNA, 20 bp, Artificial Sequence
  chemically synthesized
attctcagcaaactatggca

SEQ ID NO: 105607 - DNA, 20 bp, Artificial Sequence
  chemically synthesized
cattctcagcaaactatggc

SEQ ID NO: 105608 - DNA, 20 bp, Artificial Sequence
  chemically synthesized
ccatcattctcagcaaacta

SEQ ID NO: 105609 - DNA, 20 bp, Artificial Sequence
  chemically synthesized
tgtccttgccatagtttgct

SEQ ID NO: 105610 - DNA, 20 bp, Artificial Sequence
  chemically synthesized
ccatagtttgctgagaatga

SEQ ID NO: 105611 - DNA, 20 bp, Artificial Sequence
  chemically synthesized
aagctggaaaccatcattct

SEQ ID NO: 105612 - DNA, 20 bp, Artificial Sequence
  chemically synthesized
ttgctgagaatgatggtttc

SEQ ID NO: 105613 - DNA, 20 bp, Artificial Sequence
  chemically synthesized
tgtagggacatggatgaagc

SEQ ID NO: 105614 - DNA, 20 bp, Artificial Sequence
  chemically synthesized
cctttgtagggacatggatg

SEQ ID NO: 105615 - DNA, 20 bp, Artificial Sequence
  chemically synthesized
tcatgtcctttgtagggaca

SEQ ID NO: 105616 - DNA, 20 bp, Artificial Sequence
  chemically synthesized
gcttcatccatgtccctaca

SEQ ID NO: 105617 - DNA, 20 bp, Artificial Sequence
  chemically synthesized
cttcatccatgtccctacaa

SEQ ID NO: 105618 - DNA, 20 bp, Artificial Sequence
  chemically synthesized
atgagttcatgtcctttgta

SEQ ID NO: 105619 - DNA, 20 bp, Artificial Sequence
  chemically synthesized
gatgagttcatgtcctttgt

SEQ ID NO: 105620 - DNA, 20 bp, Artificial Sequence
  chemically synthesized
ggatgagttcatgtcctttg

SEQ ID NO: 105621 - DNA, 20 bp, Artificial Sequence
  chemically synthesized
atgcagccataaaaaaggat

SEQ ID NO: 105622 - DNA, 20 bp, Artificial Sequence
  chemically synthesized
catgaactcatcctttttta

SEQ ID NO: 105623 - DNA, 20 bp, Artificial Sequence
  chemically synthesized
atactatgcagccataaaaa

SEQ ID NO: 105624 - DNA, 20 bp, Artificial Sequence
  chemically synthesized
aatactatgcagccataaaa

SEQ ID NO: 105625 - DNA, 20 bp, Artificial Sequence
  chemically synthesized
catccttttttatggctgca

SEQ ID NO: 105626 - DNA, 20 bp, Artificial Sequence
  chemically synthesized
atacaccatggaatactatg

SEQ ID NO: 105627 - DNA, 20 bp, Artificial Sequence
  chemically synthesized
tatggctgcatagtattcca

SEQ ID NO: 105628 - DNA, 20 bp, Artificial Sequence
  chemically synthesized
aatgtggcacatatacacca

SEQ ID NO: 105629 - DNA, 20 bp, Artificial Sequence
  chemically synthesized
tagactggattgagaaaatg

SEQ ID NO: 105630 - DNA, 20 bp, Artificial Sequence
  chemically synthesized
tgtgccacattttctcaatc

SEQ ID NO: 105631 - DNA, 20 bp, Artificial Sequence
  chemically synthesized
caacaatgatagactggatt

SEQ ID NO: 105632 - DNA, 20 bp, Artificial Sequence
  chemically synthesized
aatgtccaacaatgatagac

SEQ ID NO: 105633 - DNA, 20 bp, Artificial Sequence
  chemically synthesized
tcaatccagtctatcattgt

SEQ ID NO: 105634 - DNA, 20 bp, Artificial Sequence
  chemically synthesized
acccaaatgtccaacaatga

SEQ ID NO: 105635 - DNA, 20 bp, Artificial Sequence
  chemically synthesized
gtctatcattgttggacatt

SEQ ID NO: 105636 - DNA, 20 bp, Artificial Sequence
  chemically synthesized
tctatcattgttggacattt

SEQ ID NO: 105637 - DNA, 20 bp, Artificial Sequence
  chemically synthesized
tcattgttggacatttgggt

SEQ ID NO: 105638 - DNA, 20 bp, Artificial Sequence
  chemically synthesized
tggacatttgggttggttcc

SEQ ID NO: 105639 - DNA, 20 bp, Artificial Sequence
  chemically synthesized
gatgggcaatagcaaagact

SEQ ID NO: 105640 - DNA, 20 bp, Artificial Sequence
  chemically synthesized
ctaggtgatgggcaatagca

SEQ ID NO: 105641 - DNA, 20 bp, Artificial Sequence
  chemically synthesized
aatatctaggtgatgggcaa

SEQ ID NO: 105642 - DNA, 20 bp, Artificial Sequence
  chemically synthesized
ctttgctattgcccatcacc

SEQ ID NO: 105643 - DNA, 20 bp, Artificial Sequence
  chemically synthesized
gggcttaatatctaggtgat

SEQ ID NO: 105644 - DNA, 20 bp, Artificial Sequence
  chemically synthesized
tgggcttaatatctaggtga

SEQ ID NO: 105645 - DNA, 20 bp, Artificial Sequence
  chemically synthesized
ttgcccatcacctagatatt

SEQ ID NO: 105646 - DNA, 20 bp, Artificial Sequence
  chemically synthesized
gcatgctgggcttaatatct

SEQ ID NO: 105647 - DNA, 20 bp, Artificial Sequence
  chemically synthesized
tgcatgctgggcttaatatc

SEQ ID NO: 105648 - DNA, 20 bp, Artificial Sequence
  chemically synthesized
catcacctagatattaagcc

SEQ ID NO: 105649 - DNA, 20 bp, Artificial Sequence
  chemically synthesized
aaaaatagctaatgcatgct

SEQ ID NO: 105650 - DNA, 20 bp, Artificial Sequence
  chemically synthesized
gaaaaatagctaatgcatgc

SEQ ID NO: 105651 - DNA, 20 bp, Artificial Sequence
  chemically synthesized
atattaagcccagcatgcat

SEQ ID NO: 105652 - DNA, 20 bp, Artificial Sequence
  chemically synthesized
agggagagcattgggaaaaa

SEQ ID NO: 105653 - DNA, 20 bp, Artificial Sequence
  chemically synthesized
gcgaggggagggagagcatt

SEQ ID NO: 105654 - DNA, 20 bp, Artificial Sequence
  chemically synthesized
ggcgaggggagggagagcat

SEQ ID NO: 105655 - DNA, 20 bp, Artificial Sequence
  chemically synthesized
gggtggggcgaggggaggga

SEQ ID NO: 105656 - DNA, 20 bp, Artificial Sequence
  chemically synthesized
gggggtggggcgaggggagg

SEQ ID NO: 105657 - DNA, 20 bp, Artificial Sequence
  chemically synthesized
cggggggtggggcgagggga

SEQ ID NO: 105658 - DNA, 20 bp, Artificial Sequence
  chemically synthesized
tcggggggtggggcgagggg

SEQ ID NO: 105659 - DNA, 20 bp, Artificial Sequence
  chemically synthesized
gtcggggggtggggcgaggg

SEQ ID NO: 105660 - DNA, 20 bp, Artificial Sequence
  chemically synthesized
ctgtcggggggtggggcgag

SEQ ID NO: 105661 - DNA, 20 bp, Artificial Sequence
  chemically synthesized
cctgtcggggggtggggcga

SEQ ID NO: 105662 - DNA, 20 bp, Artificial Sequence
  chemically synthesized
gcctgtcggggggtggggcg

SEQ ID NO: 105663 - DNA, 20 bp, Artificial Sequence
  chemically synthesized
ggcctgtcggggggtggggc

SEQ ID NO: 105664 - DNA, 20 bp, Artificial Sequence
  chemically synthesized
ctgaggcctgtcggggggtg

SEQ ID NO: 105665 - DNA, 20 bp, Artificial Sequence
  chemically synthesized
actgaggcctgtcggggggt

SEQ ID NO: 105666 - DNA, 20 bp, Artificial Sequence
  chemically synthesized
cactgaggcctgtcgggggg

SEQ ID NO: 105667 - DNA, 20 bp, Artificial Sequence
  chemically synthesized
cccctcgccccaccccccga

SEQ ID NO: 105668 - DNA, 20 bp, Artificial Sequence
  chemically synthesized
ccctcgccccaccccccgac

SEQ ID NO: 105669 - DNA, 20 bp, Artificial Sequence
  chemically synthesized
acacactgaggcctgtcggg

SEQ ID NO: 105670 - DNA, 20 bp, Artificial Sequence
  chemically synthesized
cacacactgaggcctgtcgg

SEQ ID NO: 105671 - DNA, 20 bp, Artificial Sequence
  chemically synthesized
acacacactgaggcctgtcg

SEQ ID NO: 105672 - DNA, 20 bp, Artificial Sequence
  chemically synthesized
aacacacactgaggcctgtc

SEQ ID NO: 105673 - DNA, 20 bp, Artificial Sequence
  chemically synthesized
caacacacactgaggcctgt

SEQ ID NO: 105674 - DNA, 20 bp, Artificial Sequence
  chemically synthesized
ccccaccccccgacaggcct

SEQ ID NO: 105675 - DNA, 20 bp, Artificial Sequence
  chemically synthesized
gaggggaacaacacacactg

SEQ ID NO: 105676 - DNA, 20 bp, Artificial Sequence
  chemically synthesized
ggaggggaacaacacacact

SEQ ID NO: 105677 - DNA, 20 bp, Artificial Sequence
  chemically synthesized
tgtgtgttgttcccctccat

SEQ ID NO: 105678 - DNA, 20 bp, Artificial Sequence
  chemically synthesized
gaacacatggactcatggag

SEQ ID NO: 105679 - DNA, 20 bp, Artificial Sequence
  chemically synthesized
agaacacatggactcatgga

SEQ ID NO: 105680 - DNA, 20 bp, Artificial Sequence
  chemically synthesized
gagaacacatggactcatgg

SEQ ID NO: 105681 - DNA, 20 bp, Artificial Sequence
  chemically synthesized
tgagaacacatggactcatg

SEQ ID NO: 105682 - DNA, 20 bp, Artificial Sequence
  chemically synthesized
aatgagaacacatggactca

SEQ ID NO: 105683 - DNA, 20 bp, Artificial Sequence
  chemically synthesized
agctgaacaatgagaacaca

SEQ ID NO: 105684 - DNA, 20 bp, Artificial Sequence
  chemically synthesized
gtccatgtgttctcattgtt

SEQ ID NO: 105685 - DNA, 20 bp, Artificial Sequence
  chemically synthesized
aaaagtgggagctgaacaat

SEQ ID NO: 105686 - DNA, 20 bp, Artificial Sequence
  chemically synthesized
atgttctcacttaaaagtgg

SEQ ID NO: 105687 - DNA, 20 bp, Artificial Sequence
  chemically synthesized
attgttcagctcccactttt

SEQ ID NO: 105688 - DNA, 20 bp, Artificial Sequence
  chemically synthesized
acatgttctcacttaaaagt

SEQ ID NO: 105689 - DNA, 20 bp, Artificial Sequence
  chemically synthesized
cacatgttctcacttaaaag

SEQ ID NO: 105690 - DNA, 20 bp, Artificial Sequence
  chemically synthesized
ttcagctcccacttttaagt

SEQ ID NO: 105691 - DNA, 20 bp, Artificial Sequence
  chemically synthesized
tatcacatgttctcacttaa

SEQ ID NO: 105692 - DNA, 20 bp, Artificial Sequence
  chemically synthesized
aaactaacacaggaacagaa

SEQ ID NO: 105693 - DNA, 20 bp, Artificial Sequence
  chemically synthesized
tcagcaaactaacacaggaa

SEQ ID NO: 105694 - DNA, 20 bp, Artificial Sequence
  chemically synthesized
ttgcttttctgttcctgtgt

SEQ ID NO: 105695 - DNA, 20 bp, Artificial Sequence
  chemically synthesized
tatcctcagcaaactaacac

SEQ ID NO: 105696 - DNA, 20 bp, Artificial Sequence
  chemically synthesized
ttatcctcagcaaactaaca

SEQ ID NO: 105697 - DNA, 20 bp, Artificial Sequence
  chemically synthesized
tgttcctgtgttagtttgct

SEQ ID NO: 105698 - DNA, 20 bp, Artificial Sequence
  chemically synthesized
gttcctgtgttagtttgctg

SEQ ID NO: 105699 - DNA, 20 bp, Artificial Sequence
  chemically synthesized
tgttagtttgctgaggataa

SEQ ID NO: 105700 - DNA, 20 bp, Artificial Sequence
  chemically synthesized
gagctggaagccattatcct

SEQ ID NO: 105701 - DNA, 20 bp, Artificial Sequence
  chemically synthesized
ttgctgaggataatggcttc

SEQ ID NO: 105702 - DNA, 20 bp, Artificial Sequence
  chemically synthesized
ctagatctttgaggagctgg

SEQ ID NO: 105703 - DNA, 20 bp, Artificial Sequence
  chemically synthesized
gttctagatctttgaggagc

SEQ ID NO: 105704 - DNA, 20 bp, Artificial Sequence
  chemically synthesized
taatggcttccagctcctca

SEQ ID NO: 105705 - DNA, 20 bp, Artificial Sequence
  chemically synthesized
tctggttctagatctttgag

SEQ ID NO: 105706 - DNA, 20 bp, Artificial Sequence
  chemically synthesized
tttctggttctagatctttg

SEQ ID NO: 105707 - DNA, 20 bp, Artificial Sequence
  chemically synthesized
cttccagctcctcaaagatc

SEQ ID NO: 105708 - DNA, 20 bp, Artificial Sequence
  chemically synthesized
atttctggttctagatcttt

SEQ ID NO: 105709 - DNA, 20 bp, Artificial Sequence
  chemically synthesized
gctcctcaaagatctagaac

SEQ ID NO: 105710 - DNA, 20 bp, Artificial Sequence
  chemically synthesized
tcaaatggtatttctggttc

SEQ ID NO: 105711 - DNA, 20 bp, Artificial Sequence
  chemically synthesized
gctgggtcaaatggtatttc

SEQ ID NO: 105712 - DNA, 20 bp, Artificial Sequence
  chemically synthesized
accagaaataccatttgacc

SEQ ID NO: 105713 - DNA, 20 bp, Artificial Sequence
  chemically synthesized
aatgggattgctgggtcaaa

SEQ ID NO: 105714 - DNA, 20 bp, Artificial Sequence
  chemically synthesized
taaccaataatgggattgct

SEQ ID NO: 105715 - DNA, 20 bp, Artificial Sequence
  chemically synthesized
ataaccaataatgggattgc

SEQ ID NO: 105716 - DNA, 20 bp, Artificial Sequence
  chemically synthesized
tgacccagcaatcccattat

SEQ ID NO: 105717 - DNA, 20 bp, Artificial Sequence
  chemically synthesized
ttgggtatataaccaataat

SEQ ID NO: 105718 - DNA, 20 bp, Artificial Sequence
  chemically synthesized
tttgggtatataaccaataa

SEQ ID NO: 105719 - DNA, 20 bp, Artificial Sequence
  chemically synthesized
cattattggttatataccca

SEQ ID NO: 105720 - DNA, 20 bp, Artificial Sequence
  chemically synthesized
attattggttatatacccaa

SEQ ID NO: 105721 - DNA, 20 bp, Artificial Sequence
  chemically synthesized
agaatggtttatattccttt

SEQ ID NO: 105722 - DNA, 20 bp, Artificial Sequence
  chemically synthesized
tagaatggtttatattcctt

SEQ ID NO: 105723 - DNA, 20 bp, Artificial Sequence
  chemically synthesized
catgtatctttaaaatagaa

SEQ ID NO: 105724 - DNA, 20 bp, Artificial Sequence
  chemically synthesized
atataaaccattctatttta

SEQ ID NO: 105725 - DNA, 20 bp, Artificial Sequence
  chemically synthesized
gtgtgcatgtatctttaaaa

SEQ ID NO: 105726 - DNA, 20 bp, Artificial Sequence
  chemically synthesized
atgcacacgtatgttcactg

SEQ ID NO: 105727 - DNA, 20 bp, Artificial Sequence
  chemically synthesized
tgctattgtgaatagtgctg

SEQ ID NO: 105728 - DNA, 20 bp, Artificial Sequence
  chemically synthesized
cactgcagcactattcacaa

SEQ ID NO: 105729 - DNA, 20 bp, Artificial Sequence
  chemically synthesized
catgtctttgctattgtgaa

SEQ ID NO: 105730 - DNA, 20 bp, Artificial Sequence
  chemically synthesized
cagcactattcacaatagca

SEQ ID NO: 105731 - DNA, 20 bp, Artificial Sequence
  chemically synthesized
tattcacaatagcaaagaca

SEQ ID NO: 105732 - DNA, 20 bp, Artificial Sequence
  chemically synthesized
tctatcactgatgggcattt

SEQ ID NO: 105733 - DNA, 20 bp, Artificial Sequence
  chemically synthesized
gtctatcactgatgggcatt

SEQ ID NO: 105734 - DNA, 20 bp, Artificial Sequence
  chemically synthesized
gaatcaacccaaatgcccat

SEQ ID NO: 105735 - DNA, 20 bp, Artificial Sequence
  chemically synthesized
ttatccagtctatcactgat

SEQ ID NO: 105736 - DNA, 20 bp, Artificial Sequence
  chemically synthesized
acccaaatgcccatcagtga

SEQ ID NO: 105737 - DNA, 20 bp, Artificial Sequence
  chemically synthesized
tttatccagtctatcactga

SEQ ID NO: 105738 - DNA, 20 bp, Artificial Sequence
  chemically synthesized
aatgcccatcagtgatagac

SEQ ID NO: 105739 - DNA, 20 bp, Artificial Sequence
  chemically synthesized
catcagtgatagactggata

SEQ ID NO: 105740 - DNA, 20 bp, Artificial Sequence
  chemically synthesized
tgtaccacattttctttatc

SEQ ID NO: 105741 - DNA, 20 bp, Artificial Sequence
  chemically synthesized
tagactggataaagaaaatg

SEQ ID NO: 105742 - DNA, 20 bp, Artificial Sequence
  chemically synthesized
aatgtggtacatatacactg

SEQ ID NO: 105743 - DNA, 20 bp, Artificial Sequence
  chemically synthesized
tatggctgcagagtattcca

SEQ ID NO: 105744 - DNA, 20 bp, Artificial Sequence
  chemically synthesized
atacactgtggaatactctg

SEQ ID NO: 105745 - DNA, 20 bp, Artificial Sequence
  chemically synthesized
cattcctttttatggctgca

SEQ ID NO: 105746 - DNA, 20 bp, Artificial Sequence
  chemically synthesized
ctcattcctttttatggctg

SEQ ID NO: 105747 - DNA, 20 bp, Artificial Sequence
  chemically synthesized
gaatactctgcagccataaa

SEQ ID NO: 105748 - DNA, 20 bp, Artificial Sequence
  chemically synthesized
aatactctgcagccataaaa

SEQ ID NO: 105749 - DNA, 20 bp, Artificial Sequence
  chemically synthesized
catgatctcattccttttta

SEQ ID NO: 105750 - DNA, 20 bp, Artificial Sequence
  chemically synthesized
ctgcagccataaaaaggaat

SEQ ID NO: 105751 - DNA, 20 bp, Artificial Sequence
  chemically synthesized
gaatgagatcatgtcctttg

SEQ ID NO: 105752 - DNA, 20 bp, Artificial Sequence
  chemically synthesized
aatgagatcatgtcctttgc

SEQ ID NO: 105753 - DNA, 20 bp, Artificial Sequence
  chemically synthesized
ctccatatgtgttcctgcaa

SEQ ID NO: 105754 - DNA, 20 bp, Artificial Sequence
  chemically synthesized
gctccatatgtgttcctgca

SEQ ID NO: 105755 - DNA, 20 bp, Artificial Sequence
  chemically synthesized
gtcctttgcaggaacacata

SEQ ID NO: 105756 - DNA, 20 bp, Artificial Sequence
  chemically synthesized
cctttgcaggaacacatatg

SEQ ID NO: 105757 - DNA, 20 bp, Artificial Sequence
  chemically synthesized
acacatatggagctgtgcta

SEQ ID NO: 105758 - DNA, 20 bp, Artificial Sequence
  chemically synthesized
aactttgtgaaactgtagca

SEQ ID NO: 105759 - DNA, 20 bp, Artificial Sequence
  chemically synthesized
ggccaaactttgtgaaactg

SEQ ID NO: 105760 - DNA, 20 bp, Artificial Sequence
  chemically synthesized
agctgtgctacagtttcaca

SEQ ID NO: 105761 - DNA, 20 bp, Artificial Sequence
  chemically synthesized
tgctacagtttcacaaagtt

SEQ ID NO: 105762 - DNA, 20 bp, Artificial Sequence
  chemically synthesized
gtttcacaaagtttggccat

SEQ ID NO: 105763 - DNA, 20 bp, Artificial Sequence
  chemically synthesized
tcacaaagtttggccatcag

SEQ ID NO: 105764 - DNA, 20 bp, Artificial Sequence
  chemically synthesized
acaaagtttggccatcagaa

SEQ ID NO: 105765 - DNA, 20 bp, Artificial Sequence
  chemically synthesized
caaagtttggccatcagaag

SEQ ID NO: 105766 - DNA, 20 bp, Artificial Sequence
  chemically synthesized
caattctctccctcttctga

SEQ ID NO: 105767 - DNA, 20 bp, Artificial Sequence
  chemically synthesized
aaagtttggccatcagaaga

SEQ ID NO: 105768 - DNA, 20 bp, Artificial Sequence
  chemically synthesized
agtttggccatcagaagagg

SEQ ID NO: 105769 - DNA, 20 bp, Artificial Sequence
  chemically synthesized
tttggccatcagaagaggga

SEQ ID NO: 105770 - DNA, 20 bp, Artificial Sequence
  chemically synthesized
aagagggagagaattgacac

SEQ ID NO: 105771 - DNA, 20 bp, Artificial Sequence
  chemically synthesized
agagggagagaattgacact

SEQ ID NO: 105772 - DNA, 20 bp, Artificial Sequence
  chemically synthesized
gagagaattgacactaggta

SEQ ID NO: 105773 - DNA, 20 bp, Artificial Sequence
  chemically synthesized
agagaattgacactaggtac

SEQ ID NO: 105774 - DNA, 20 bp, Artificial Sequence
  chemically synthesized
ttcacccctccacctgtacc

SEQ ID NO: 105775 - DNA, 20 bp, Artificial Sequence
  chemically synthesized
gaattgacactaggtacagg

SEQ ID NO: 105776 - DNA, 20 bp, Artificial Sequence
  chemically synthesized
attgacactaggtacaggtg

SEQ ID NO: 105777 - DNA, 20 bp, Artificial Sequence
  chemically synthesized
ttgacactaggtacaggtgg

SEQ ID NO: 105778 - DNA, 20 bp, Artificial Sequence
  chemically synthesized
tgacactaggtacaggtgga

SEQ ID NO: 105779 - DNA, 20 bp, Artificial Sequence
  chemically synthesized
gacactaggtacaggtggag

SEQ ID NO: 105780 - DNA, 20 bp, Artificial Sequence
  chemically synthesized
taggtacaggtggaggggtg

SEQ ID NO: 105781 - DNA, 20 bp, Artificial Sequence
  chemically synthesized
aggtacaggtggaggggtga

SEQ ID NO: 105782 - DNA, 20 bp, Artificial Sequence
  chemically synthesized
gtacaggtggaggggtgaag

SEQ ID NO: 105783 - DNA, 20 bp, Artificial Sequence
  chemically synthesized
caggtggaggggtgaaggag

SEQ ID NO: 105784 - DNA, 20 bp, Artificial Sequence
  chemically synthesized
gaggggtgaaggagcagcac

SEQ ID NO: 105785 - DNA, 20 bp, Artificial Sequence
  chemically synthesized
ggtgaaggagcagcaccggt

SEQ ID NO: 105786 - DNA, 20 bp, Artificial Sequence
  chemically synthesized
aggagcagcaccggtaagct

SEQ ID NO: 105787 - DNA, 20 bp, Artificial Sequence
  chemically synthesized
aaacaattgtccaagcttac

SEQ ID NO: 105788 - DNA, 20 bp, Artificial Sequence
  chemically synthesized
taacaaacaaacaattgtcc

SEQ ID NO: 105789 - DNA, 20 bp, Artificial Sequence
  chemically synthesized
attgtttgtttgttaaaatg

SEQ ID NO: 105790 - DNA, 20 bp, Artificial Sequence
  chemically synthesized
ttgtttgtttgttaaaatga

SEQ ID NO: 105791 - DNA, 20 bp, Artificial Sequence
  chemically synthesized
tgtttgtttgttaaaatgaa

SEQ ID NO: 105792 - DNA, 20 bp, Artificial Sequence
  chemically synthesized
tttgttaaaatgaagggtac

SEQ ID NO: 105793 - DNA, 20 bp, Artificial Sequence
  chemically synthesized
tgttaaaatgaagggtacca

SEQ ID NO: 105794 - DNA, 20 bp, Artificial Sequence
  chemically synthesized
taaaatgaagggtaccagag

SEQ ID NO: 105795 - DNA, 20 bp, Artificial Sequence
  chemically synthesized
atgaagggtaccagagtggt

SEQ ID NO: 105796 - DNA, 20 bp, Artificial Sequence
  chemically synthesized
ttgctgtcagcttaccactc

SEQ ID NO: 105797 - DNA, 20 bp, Artificial Sequence
  chemically synthesized
gtaccagagtggtaagctga

SEQ ID NO: 105798 - DNA, 20 bp, Artificial Sequence
  chemically synthesized
agagtggtaagctgacagca

SEQ ID NO: 105799 - DNA, 20 bp, Artificial Sequence
  chemically synthesized
gagtggtaagctgacagcaa

SEQ ID NO: 105800 - DNA, 20 bp, Artificial Sequence
  chemically synthesized
tcctactgatcctttgctgt

SEQ ID NO: 105801 - DNA, 20 bp, Artificial Sequence
  chemically synthesized
gtaagctgacagcaaaggat

SEQ ID NO: 105802 - DNA, 20 bp, Artificial Sequence
  chemically synthesized
agctgacagcaaaggatcag

SEQ ID NO: 105803 - DNA, 20 bp, Artificial Sequence
  chemically synthesized
gctgacagcaaaggatcagt

SEQ ID NO: 105804 - DNA, 20 bp, Artificial Sequence
  chemically synthesized
gacagcaaaggatcagtagg

SEQ ID NO: 105805 - DNA, 20 bp, Artificial Sequence
  chemically synthesized
acagcaaaggatcagtagga

SEQ ID NO: 105806 - DNA, 20 bp, Artificial Sequence
  chemically synthesized
cagtaggaaggtgacttaaa

SEQ ID NO: 105807 - DNA, 20 bp, Artificial Sequence
  chemically synthesized
ctcctccttctatacttttt

SEQ ID NO: 105808 - DNA, 20 bp, Artificial Sequence
  chemically synthesized
ggaaggtgacttaaaaagta

SEQ ID NO: 105809 - DNA, 20 bp, Artificial Sequence
  chemically synthesized
aggtgacttaaaaagtatag

SEQ ID NO: 105810 - DNA, 20 bp, Artificial Sequence
  chemically synthesized
ggtgacttaaaaagtataga

SEQ ID NO: 105811 - DNA, 20 bp, Artificial Sequence
  chemically synthesized
tgacttaaaaagtatagaag

SEQ ID NO: 105812 - DNA, 20 bp, Artificial Sequence
  chemically synthesized
gacttaaaaagtatagaagg

SEQ ID NO: 105813 - DNA, 20 bp, Artificial Sequence
  chemically synthesized
cttaaaaagtatagaaggag

SEQ ID NO: 105814 - DNA, 20 bp, Artificial Sequence
  chemically synthesized
tagaaggaggagattcttga

SEQ ID NO: 105815 - DNA, 20 bp, Artificial Sequence
  chemically synthesized
cctctgagccttgttctgtc

SEQ ID NO: 105816 - DNA, 20 bp, Artificial Sequence
  chemically synthesized
gaggagattcttgacagaac

SEQ ID NO: 105817 - DNA, 20 bp, Artificial Sequence
  chemically synthesized
aggagattcttgacagaaca

SEQ ID NO: 105818 - DNA, 20 bp, Artificial Sequence
  chemically synthesized
attcttgacagaacaaggct

SEQ ID NO: 105819 - DNA, 20 bp, Artificial Sequence
  chemically synthesized
tcttgacagaacaaggctca

SEQ ID NO: 105820 - DNA, 20 bp, Artificial Sequence
  chemically synthesized
cttgacagaacaaggctcag

SEQ ID NO: 105821 - DNA, 20 bp, Artificial Sequence
  chemically synthesized
tgacagaacaaggctcagag

SEQ ID NO: 105822 - DNA, 20 bp, Artificial Sequence
  chemically synthesized
ttctaaattccgtctcctct

SEQ ID NO: 105823 - DNA, 20 bp, Artificial Sequence
  chemically synthesized
agaacaaggctcagaggaga

SEQ ID NO: 105824 - DNA, 20 bp, Artificial Sequence
  chemically synthesized
ggctcagaggagacggaatt

SEQ ID NO: 105825 - DNA, 20 bp, Artificial Sequence
  chemically synthesized
agaggagacggaatttagaa

SEQ ID NO: 105826 - DNA, 20 bp, Artificial Sequence
  chemically synthesized
gaggagacggaatttagaac

SEQ ID NO: 105827 - DNA, 20 bp, Artificial Sequence
  chemically synthesized
aggagacggaatttagaaca

SEQ ID NO: 105828 - DNA, 20 bp, Artificial Sequence
  chemically synthesized
cggaatttagaacagggtgt

SEQ ID NO: 105829 - DNA, 20 bp, Artificial Sequence
  chemically synthesized
atggaaggtgcaagagtatg

SEQ ID NO: 105830 - DNA, 20 bp, Artificial Sequence
  chemically synthesized
tatggaaggtgcaagagtat

SEQ ID NO: 105831 - DNA, 20 bp, Artificial Sequence
  chemically synthesized
ataggatatggaaggtgcaa

SEQ ID NO: 105832 - DNA, 20 bp, Artificial Sequence
  chemically synthesized
ctataggatatggaaggtgc

SEQ ID NO: 105833 - DNA, 20 bp, Artificial Sequence
  chemically synthesized
gtgtgactataggatatgga

SEQ ID NO: 105834 - DNA, 20 bp, Artificial Sequence
  chemically synthesized
tgtgtgactataggatatgg

SEQ ID NO: 105835 - DNA, 20 bp, Artificial Sequence
  chemically synthesized
cttgcaccttccatatccta

SEQ ID NO: 105836 - DNA, 20 bp, Artificial Sequence
  chemically synthesized
tattgtgtgactataggata

SEQ ID NO: 105837 - DNA, 20 bp, Artificial Sequence
  chemically synthesized
tctggctattgtgtgactat

SEQ ID NO: 105838 - DNA, 20 bp, Artificial Sequence
  chemically synthesized
ttctggctattgtgtgacta

SEQ ID NO: 105839 - DNA, 20 bp, Artificial Sequence
  chemically synthesized
catatcctatagtcacacaa

SEQ ID NO: 105840 - DNA, 20 bp, Artificial Sequence
  chemically synthesized
tcctatagtcacacaatagc

SEQ ID NO: 105841 - DNA, 20 bp, Artificial Sequence
  chemically synthesized
agtcacacaatagccagaat

SEQ ID NO: 105842 - DNA, 20 bp, Artificial Sequence
  chemically synthesized
tttaaaaaaaaaacttattc

SEQ ID NO: 105843 - DNA, 20 bp, Artificial Sequence
  chemically synthesized
cagaataagtttttttttta

SEQ ID NO: 105844 - DNA, 20 bp, Artificial Sequence
  chemically synthesized
agaataagttttttttttaa

SEQ ID NO: 105845 - DNA, 20 bp, Artificial Sequence
  chemically synthesized
ttttttttttaaaggaaaat

SEQ ID NO: 105846 - DNA, 20 bp, Artificial Sequence
  chemically synthesized
aaaataagtcacaaatttat

SEQ ID NO: 105847 - DNA, 20 bp, Artificial Sequence
  chemically synthesized
ttgcattctagttgggaaaa

SEQ ID NO: 105848 - DNA, 20 bp, Artificial Sequence
  chemically synthesized
ttattggctattttcccaac

SEQ ID NO: 105849 - DNA, 20 bp, Artificial Sequence
  chemically synthesized
ttggagtttgcattctagtt

SEQ ID NO: 105850 - DNA, 20 bp, Artificial Sequence
  chemically synthesized
attggagtttgcattctagt

SEQ ID NO: 105851 - DNA, 20 bp, Artificial Sequence
  chemically synthesized
cctcattggagtttgcattc

SEQ ID NO: 105852 - DNA, 20 bp, Artificial Sequence
  chemically synthesized
actagaatgcaaactccaat

SEQ ID NO: 105853 - DNA, 20 bp, Artificial Sequence
  chemically synthesized
ctagaatgcaaactccaatg

SEQ ID NO: 105854 - DNA, 20 bp, Artificial Sequence
  chemically synthesized
tgagccaccgcgcctcattg

SEQ ID NO: 105855 - DNA, 20 bp, Artificial Sequence
  chemically synthesized
tgtgagccaccgcgcctcat

SEQ ID NO: 105856 - DNA, 20 bp, Artificial Sequence
  chemically synthesized
atgcaaactccaatgaggcg

SEQ ID NO: 105857 - DNA, 20 bp, Artificial Sequence
  chemically synthesized
caaactccaatgaggcgcgg

SEQ ID NO: 105858 - DNA, 20 bp, Artificial Sequence
  chemically synthesized
agtgctgggattacaggtgt

SEQ ID NO: 105859 - DNA, 20 bp, Artificial Sequence
  chemically synthesized
gtggctcacacctgtaatcc

SEQ ID NO: 105860 - DNA, 20 bp, Artificial Sequence
  chemically synthesized
tcccaaagtgctgggattac

SEQ ID NO: 105861 - DNA, 20 bp, Artificial Sequence
  chemically synthesized
ctcccaaagtgctgggatta

SEQ ID NO: 105862 - DNA, 20 bp, Artificial Sequence
  chemically synthesized
cacctgtaatcccagcactt

SEQ ID NO: 105863 - DNA, 20 bp, Artificial Sequence
  chemically synthesized
cctcagcctcccaaagtgct

SEQ ID NO: 105864 - DNA, 20 bp, Artificial Sequence
  chemically synthesized
acctgtaatcccagcacttt

SEQ ID NO: 105865 - DNA, 20 bp, Artificial Sequence
  chemically synthesized
acctcagcctcccaaagtgc

SEQ ID NO: 105866 - DNA, 20 bp, Artificial Sequence
  chemically synthesized
ctgtaatcccagcactttgg

SEQ ID NO: 105867 - DNA, 20 bp, Artificial Sequence
  chemically synthesized
tgtaatcccagcactttggg

SEQ ID NO: 105868 - DNA, 20 bp, Artificial Sequence
  chemically synthesized
ctgcccacctcagcctccca

SEQ ID NO: 105869 - DNA, 20 bp, Artificial Sequence
  chemically synthesized
tcccagcactttgggaggct

SEQ ID NO: 105870 - DNA, 20 bp, Artificial Sequence
  chemically synthesized
cccagcactttgggaggctg

SEQ ID NO: 105871 - DNA, 20 bp, Artificial Sequence
  chemically synthesized
agcactttgggaggctgagg

SEQ ID NO: 105872 - DNA, 20 bp, Artificial Sequence
  chemically synthesized
gcactttgggaggctgaggt

SEQ ID NO: 105873 - DNA, 20 bp, Artificial Sequence
  chemically synthesized
ctttgggaggctgaggtggg

SEQ ID NO: 105874 - DNA, 20 bp, Artificial Sequence
  chemically synthesized
ctcaagtgatctgcccacct

SEQ ID NO: 105875 - DNA, 20 bp, Artificial Sequence
  chemically synthesized
ctgaggtgggcagatcactt

SEQ ID NO: 105876 - DNA, 20 bp, Artificial Sequence
  chemically synthesized
gtgggcagatcacttgagcc

SEQ ID NO: 105877 - DNA, 20 bp, Artificial Sequence
  chemically synthesized
tgggcagatcacttgagcct

SEQ ID NO: 105878 - DNA, 20 bp, Artificial Sequence
  chemically synthesized
ggtctcaatctcctaggctc

SEQ ID NO: 105879 - DNA, 20 bp, Artificial Sequence
  chemically synthesized
ggcagatcacttgagcctag

SEQ ID NO: 105880 - DNA, 20 bp, Artificial Sequence
  chemically synthesized
taggctggtctcaatctcct

SEQ ID NO: 105881 - DNA, 20 bp, Artificial Sequence
  chemically synthesized
tcacttgagcctaggagatt

SEQ ID NO: 105882 - DNA, 20 bp, Artificial Sequence
  chemically synthesized
ctaggctggtctcaatctcc

SEQ ID NO: 105883 - DNA, 20 bp, Artificial Sequence
  chemically synthesized
tgagcctaggagattgagac

SEQ ID NO: 105884 - DNA, 20 bp, Artificial Sequence
  chemically synthesized
ctaggagattgagaccagcc

SEQ ID NO: 105885 - DNA, 20 bp, Artificial Sequence
  chemically synthesized
taggagattgagaccagcct

SEQ ID NO: 105886 - DNA, 20 bp, Artificial Sequence
  chemically synthesized
gtttcaccagttgcctaggc

SEQ ID NO: 105887 - DNA, 20 bp, Artificial Sequence
  chemically synthesized
ttgagaccagcctaggcaac

SEQ ID NO: 105888 - DNA, 20 bp, Artificial Sequence
  chemically synthesized
tggggtttcaccagttgcct

SEQ ID NO: 105889 - DNA, 20 bp, Artificial Sequence
  chemically synthesized
atggggtttcaccagttgcc

SEQ ID NO: 105890 - DNA, 20 bp, Artificial Sequence
  chemically synthesized
ttgcagagatggggtttcac

SEQ ID NO: 105891 - DNA, 20 bp, Artificial Sequence
  chemically synthesized
tgtatttttttgcagagatg

SEQ ID NO: 105892 - DNA, 20 bp, Artificial Sequence
  chemically synthesized
ttgtatttttttgcagagat

SEQ ID NO: 105893 - DNA, 20 bp, Artificial Sequence
  chemically synthesized
tttgtatttttttgcagaga

SEQ ID NO: 105894 - DNA, 20 bp, Artificial Sequence
  chemically synthesized
attttttgtatttttttgca

SEQ ID NO: 105895 - DNA, 20 bp, Artificial Sequence
  chemically synthesized
taattttttgtatttttttg

SEQ ID NO: 105896 - DNA, 20 bp, Artificial Sequence
  chemically synthesized
tgcaaaaaaatacaaaaaat

SEQ ID NO: 105897 - DNA, 20 bp, Artificial Sequence
  chemically synthesized
aaaaaatacaaaaaattagc

SEQ ID NO: 105898 - DNA, 20 bp, Artificial Sequence
  chemically synthesized
tacaaaaaattagctggaca

SEQ ID NO: 105899 - DNA, 20 bp, Artificial Sequence
  chemically synthesized
aaaaaattagctggacatgg

SEQ ID NO: 105900 - DNA, 20 bp, Artificial Sequence
  chemically synthesized
caggcaagtgccaccatgtc

SEQ ID NO: 105901 - DNA, 20 bp, Artificial Sequence
  chemically synthesized
gacatggtggcacttgcctg

SEQ ID NO: 105902 - DNA, 20 bp, Artificial Sequence
  chemically synthesized
aagtagcagagactacaggc

SEQ ID NO: 105903 - DNA, 20 bp, Artificial Sequence
  chemically synthesized
tcccaagtagcagagactac

SEQ ID NO: 105904 - DNA, 20 bp, Artificial Sequence
  chemically synthesized
ctcccaagtagcagagacta

SEQ ID NO: 105905 - DNA, 20 bp, Artificial Sequence
  chemically synthesized
tgcctgtagtctctgctact

SEQ ID NO: 105906 - DNA, 20 bp, Artificial Sequence
  chemically synthesized
cctcagcctcccaagtagca

SEQ ID NO: 105907 - DNA, 20 bp, Artificial Sequence
  chemically synthesized
gcctgtagtctctgctactt

SEQ ID NO: 105908 - DNA, 20 bp, Artificial Sequence
  chemically synthesized
aacctcagcctcccaagtag

SEQ ID NO: 105909 - DNA, 20 bp, Artificial Sequence
  chemically synthesized
ctgtagtctctgctacttgg

SEQ ID NO: 105910 - DNA, 20 bp, Artificial Sequence
  chemically synthesized
tgtagtctctgctacttggg

SEQ ID NO: 105911 - DNA, 20 bp, Artificial Sequence
  chemically synthesized
cccaacctcagcctcccaag

SEQ ID NO: 105912 - DNA, 20 bp, Artificial Sequence
  chemically synthesized
ccccccaacctcagcctccc

SEQ ID NO: 105913 - DNA, 20 bp, Artificial Sequence
  chemically synthesized
tctctgctacttgggaggct

SEQ ID NO: 105914 - DNA, 20 bp, Artificial Sequence
  chemically synthesized
ctctgctacttgggaggctg

SEQ ID NO: 105915 - DNA, 20 bp, Artificial Sequence
  chemically synthesized
gctacttgggaggctgaggt

SEQ ID NO: 105916 - DNA, 20 bp, Artificial Sequence
  chemically synthesized
ctacttgggaggctgaggtt

SEQ ID NO: 105917 - DNA, 20 bp, Artificial Sequence
  chemically synthesized
tacttgggaggctgaggttg

SEQ ID NO: 105918 - DNA, 20 bp, Artificial Sequence
  chemically synthesized
acttgggaggctgaggttgg

SEQ ID NO: 105919 - DNA, 20 bp, Artificial Sequence
  chemically synthesized
tcgggtgatccccccaacct

SEQ ID NO: 105920 - DNA, 20 bp, Artificial Sequence
  chemically synthesized
cttgggaggctgaggttggg

SEQ ID NO: 105921 - DNA, 20 bp, Artificial Sequence
  chemically synthesized
tgaggttggggggatcaccc

SEQ ID NO: 105922 - DNA, 20 bp, Artificial Sequence
  chemically synthesized
ttggggggatcacccgagcc

SEQ ID NO: 105923 - DNA, 20 bp, Artificial Sequence
  chemically synthesized
tggggggatcacccgagccc

SEQ ID NO: 105924 - DNA, 20 bp, Artificial Sequence
  chemically synthesized
aacctccacctcctgggctc

SEQ ID NO: 105925 - DNA, 20 bp, Artificial Sequence
  chemically synthesized
gggggatcacccgagcccag

SEQ ID NO: 105926 - DNA, 20 bp, Artificial Sequence
  chemically synthesized
caacctccacctcctgggct

SEQ ID NO: 105927 - DNA, 20 bp, Artificial Sequence
  chemically synthesized
ggggatcacccgagcccagg

SEQ ID NO: 105928 - DNA, 20 bp, Artificial Sequence
  chemically synthesized
gatcacccgagcccaggagg

SEQ ID NO: 105929 - DNA, 20 bp, Artificial Sequence
  chemically synthesized
cactgcaacctccacctcct

SEQ ID NO: 105930 - DNA, 20 bp, Artificial Sequence
  chemically synthesized
tcacccgagcccaggaggtg

SEQ ID NO: 105931 - DNA, 20 bp, Artificial Sequence
  chemically synthesized
tcactgcaacctccacctcc

SEQ ID NO: 105932 - DNA, 20 bp, Artificial Sequence
  chemically synthesized
cacccgagcccaggaggtgg

SEQ ID NO: 105933 - DNA, 20 bp, Artificial Sequence
  chemically synthesized
agcccaggaggtggaggttg

SEQ ID NO: 105934 - DNA, 20 bp, Artificial Sequence
  chemically synthesized
caggaggtggaggttgcagt

SEQ ID NO: 105935 - DNA, 20 bp, Artificial Sequence
  chemically synthesized
ggagtgcaatggtatgatca

SEQ ID NO: 105936 - DNA, 20 bp, Artificial Sequence
  chemically synthesized
ttgcctaggctggagtgcaa

SEQ ID NO: 105937 - DNA, 20 bp, Artificial Sequence
  chemically synthesized
gtgatcataccattgcactc

SEQ ID NO: 105938 - DNA, 20 bp, Artificial Sequence
  chemically synthesized
cataccattgcactccagcc

SEQ ID NO: 105939 - DNA, 20 bp, Artificial Sequence
  chemically synthesized
ataccattgcactccagcct

SEQ ID NO: 105940 - DNA, 20 bp, Artificial Sequence
  chemically synthesized
tcactctgttgcctaggctg

SEQ ID NO: 105941 - DNA, 20 bp, Artificial Sequence
  chemically synthesized
tctcactctgttgcctaggc

SEQ ID NO: 105942 - DNA, 20 bp, Artificial Sequence
  chemically synthesized
ttgcactccagcctaggcaa

SEQ ID NO: 105943 - DNA, 20 bp, Artificial Sequence
  chemically synthesized
agggtctcactctgttgcct

SEQ ID NO: 105944 - DNA, 20 bp, Artificial Sequence
  chemically synthesized
gcactccagcctaggcaaca

SEQ ID NO: 105945 - DNA, 20 bp, Artificial Sequence
  chemically synthesized
cagggtctcactctgttgcc

SEQ ID NO: 105946 - DNA, 20 bp, Artificial Sequence
  chemically synthesized
tccagcctaggcaacagagt

SEQ ID NO: 105947 - DNA, 20 bp, Artificial Sequence
  chemically synthesized
ttttttttttttttgagaca

SEQ ID NO: 105948 - DNA, 20 bp, Artificial Sequence
  chemically synthesized
tttttttttttttttgagac

SEQ ID NO: 105949 - DNA, 20 bp, Artificial Sequence
  chemically synthesized
ttttttttttttttttgaga

SEQ ID NO: 105950 - DNA, 20 bp, Artificial Sequence
  chemically synthesized
tttttttttttttttttttt

SEQ ID NO: 105951 - DNA, 20 bp, Artificial Sequence
  chemically synthesized
aaaaaaaaaaaaaaaaaaaa

SEQ ID NO: 105952 - DNA, 20 bp, Artificial Sequence
  chemically synthesized
gaatgtaaacatataaactc

SEQ ID NO: 105953 - DNA, 20 bp, Artificial Sequence
  chemically synthesized
atgtaaacatataaactcca

SEQ ID NO: 105954 - DNA, 20 bp, Artificial Sequence
  chemically synthesized
tgtaaacatataaactccag

SEQ ID NO: 105955 - DNA, 20 bp, Artificial Sequence
  chemically synthesized
gtaaacatataaactccaga

SEQ ID NO: 105956 - DNA, 20 bp, Artificial Sequence
  chemically synthesized
aacatataaactccagaggg

SEQ ID NO: 105957 - DNA, 20 bp, Artificial Sequence
  chemically synthesized
aacagtggtcccaccctctg

SEQ ID NO: 105958 - DNA, 20 bp, Artificial Sequence
  chemically synthesized
acatataaactccagagggt

SEQ ID NO: 105959 - DNA, 20 bp, Artificial Sequence
  chemically synthesized
ctaacagtggtcccaccctc

SEQ ID NO: 105960 - DNA, 20 bp, Artificial Sequence
  chemically synthesized
ccagagggtgggaccactgt

SEQ ID NO: 105961 - DNA, 20 bp, Artificial Sequence
  chemically synthesized
gggtccctcgcagctaacag

SEQ ID NO: 105962 - DNA, 20 bp, Artificial Sequence
  chemically synthesized
gtcgggtccctcgcagctaa

SEQ ID NO: 105963 - DNA, 20 bp, Artificial Sequence
  chemically synthesized
gtgggaccactgttagctgc

SEQ ID NO: 105964 - DNA, 20 bp, Artificial Sequence
  chemically synthesized
tgggaccactgttagctgcg

SEQ ID NO: 105965 - DNA, 20 bp, Artificial Sequence
  chemically synthesized
gggaccactgttagctgcga

SEQ ID NO: 105966 - DNA, 20 bp, Artificial Sequence
  chemically synthesized
tcggcaagtcgggtccctcg

SEQ ID NO: 105967 - DNA, 20 bp, Artificial Sequence
  chemically synthesized
ttagactggttcggcaagtc

SEQ ID NO: 105968 - DNA, 20 bp, Artificial Sequence
  chemically synthesized
cttagactggttcggcaagt

SEQ ID NO: 105969 - DNA, 20 bp, Artificial Sequence
  chemically synthesized
agggacccgacttgccgaac

SEQ ID NO: 105970 - DNA, 20 bp, Artificial Sequence
  chemically synthesized
atatcttagactggttcggc

SEQ ID NO: 105971 - DNA, 20 bp, Artificial Sequence
  chemically synthesized
agaaatatcttagactggtt

SEQ ID NO: 105972 - DNA, 20 bp, Artificial Sequence
  chemically synthesized
ccgacttgccgaaccagtct

SEQ ID NO: 105973 - DNA, 20 bp, Artificial Sequence
  chemically synthesized
taactagaaatatcttagac

SEQ ID NO: 105974 - DNA, 20 bp, Artificial Sequence
  chemically synthesized
aggagtaactagaaatatct

SEQ ID NO: 105975 - DNA, 20 bp, Artificial Sequence
  chemically synthesized
gaaccagtctaagatatttc

SEQ ID NO: 105976 - DNA, 20 bp, Artificial Sequence
  chemically synthesized
aaaaagagaaaaggagtaac

SEQ ID NO: 105977 - DNA, 20 bp, Artificial Sequence
  chemically synthesized
agggcgaaaaaagagaaaag

SEQ ID NO: 105978 - DNA, 20 bp, Artificial Sequence
  chemically synthesized
acagggcgaaaaaagagaaa

SEQ ID NO: 105979 - DNA, 20 bp, Artificial Sequence
  chemically synthesized
cacagggcgaaaaaagagaa

SEQ ID NO: 105980 - DNA, 20 bp, Artificial Sequence
  chemically synthesized
ttgttcacagggcgaaaaaa

SEQ ID NO: 105981 - DNA, 20 bp, Artificial Sequence
  chemically synthesized
aattgttcacagggcgaaaa

SEQ ID NO: 105982 - DNA, 20 bp, Artificial Sequence
  chemically synthesized
caaatattaaattgttcaca

SEQ ID NO: 105983 - DNA, 20 bp, Artificial Sequence
  chemically synthesized
ccaaatattaaattgttcac

SEQ ID NO: 105984 - DNA, 20 bp, Artificial Sequence
  chemically synthesized
gccaaatattaaattgttca

SEQ ID NO: 105985 - DNA, 20 bp, Artificial Sequence
  chemically synthesized
cctgtgaacaatttaatatt

SEQ ID NO: 105986 - DNA, 20 bp, Artificial Sequence
  chemically synthesized
aaaaaaaaaaaaaaaggaag

SEQ ID NO: 105987 - DNA, 20 bp, Artificial Sequence
  chemically synthesized
ttaaaaaaaaaaaaaaaagg

SEQ ID NO: 105988 - DNA, 20 bp, Artificial Sequence
  chemically synthesized
aatttaaaaaaaaaaaaaaa

SEQ ID NO: 105989 - DNA, 20 bp, Artificial Sequence
  chemically synthesized
aaatttaaaaaaaaaaaaaa

SEQ ID NO: 105990 - DNA, 20 bp, Artificial Sequence
  chemically synthesized
agtgggaatgagtagggagg

SEQ ID NO: 105991 - DNA, 20 bp, Artificial Sequence
  chemically synthesized
gggagtgggaatgagtaggg

SEQ ID NO: 105992 - DNA, 20 bp, Artificial Sequence
  chemically synthesized
tgggagtgggaatgagtagg

SEQ ID NO: 105993 - DNA, 20 bp, Artificial Sequence
  chemically synthesized
tttgggagtgggaatgagta

SEQ ID NO: 105994 - DNA, 20 bp, Artificial Sequence
  chemically synthesized
gtttgggagtgggaatgagt

SEQ ID NO: 105995 - DNA, 20 bp, Artificial Sequence
  chemically synthesized
ggtttgggagtgggaatgag

SEQ ID NO: 105996 - DNA, 20 bp, Artificial Sequence
  chemically synthesized
gttggtttgggagtgggaat

SEQ ID NO: 105997 - DNA, 20 bp, Artificial Sequence
  chemically synthesized
tttgtggttggtttgggagt

SEQ ID NO: 105998 - DNA, 20 bp, Artificial Sequence
  chemically synthesized
ctttgtggttggtttgggag

SEQ ID NO: 105999 - DNA, 20 bp, Artificial Sequence
  chemically synthesized
tagctttgtggttggtttgg

SEQ ID NO: 106000 - DNA, 20 bp, Artificial Sequence
  chemically synthesized
gttagctttgtggttggttt

SEQ ID NO: 106001 - DNA, 20 bp, Artificial Sequence
  chemically synthesized
ggttagctttgtggttggtt

SEQ ID NO: 106002 - DNA, 20 bp, Artificial Sequence
  chemically synthesized
ccactcccaaaccaaccaca

SEQ ID NO: 106003 - DNA, 20 bp, Artificial Sequence
  chemically synthesized
gctgaggttagctttgtggt

SEQ ID NO: 106004 - DNA, 20 bp, Artificial Sequence
  chemically synthesized
aaaagctgaggttagctttg

SEQ ID NO: 106005 - DNA, 20 bp, Artificial Sequence
  chemically synthesized
accaaccacaaagctaacct

SEQ ID NO: 106006 - DNA, 20 bp, Artificial Sequence
  chemically synthesized
tttggaaaaaaagctgaggt

SEQ ID NO: 106007 - DNA, 20 bp, Artificial Sequence
  chemically synthesized
ataatttggaaaaaaagctg

SEQ ID NO: 106008 - DNA, 20 bp, Artificial Sequence
  chemically synthesized
gataatttggaaaaaaagct

SEQ ID NO: 106009 - DNA, 20 bp, Artificial Sequence
  chemically synthesized
aaagggataatttggaaaaa

SEQ ID NO: 106010 - DNA, 20 bp, Artificial Sequence
  chemically synthesized
agcaagcaaaagggataatt

SEQ ID NO: 106011 - DNA, 20 bp, Artificial Sequence
  chemically synthesized
tgtgttcatagcaagcaaaa

SEQ ID NO: 106012 - DNA, 20 bp, Artificial Sequence
  chemically synthesized
ttgtgttcatagcaagcaaa

SEQ ID NO: 106013 - DNA, 20 bp, Artificial Sequence
  chemically synthesized
cttgtgttcatagcaagcaa

SEQ ID NO: 106014 - DNA, 20 bp, Artificial Sequence
  chemically synthesized
ttcaaacttgtgttcatagc

SEQ ID NO: 106015 - DNA, 20 bp, Artificial Sequence
  chemically synthesized
cttttgcttgctatgaacac

SEQ ID NO: 106016 - DNA, 20 bp, Artificial Sequence
  chemically synthesized
gaggttcaaacttgtgttca

SEQ ID NO: 106017 - DNA, 20 bp, Artificial Sequence
  chemically synthesized
atgaacacaagtttgaacct

SEQ ID NO: 106018 - DNA, 20 bp, Artificial Sequence
  chemically synthesized
aattatcaccaacagagctg

SEQ ID NO: 106019 - DNA, 20 bp, Artificial Sequence
  chemically synthesized
aaattatcaccaacagagct

SEQ ID NO: 106020 - DNA, 20 bp, Artificial Sequence
  chemically synthesized
agtttgaacctcagctctgt

SEQ ID NO: 106021 - DNA, 20 bp, Artificial Sequence
  chemically synthesized
gggcaaaattatcaccaaca

SEQ ID NO: 106022 - DNA, 20 bp, Artificial Sequence
  chemically synthesized
atgggcaaaattatcaccaa

SEQ ID NO: 106023 - DNA, 20 bp, Artificial Sequence
  chemically synthesized
ttggtgataattttgcccat

SEQ ID NO: 106024 - DNA, 20 bp, Artificial Sequence
  chemically synthesized
gtgataattttgcccataag

SEQ ID NO: 106025 - DNA, 20 bp, Artificial Sequence
  chemically synthesized
ttttgccagaagcttcttat

SEQ ID NO: 106026 - DNA, 20 bp, Artificial Sequence
  chemically synthesized
tttttgccagaagcttctta

SEQ ID NO: 106027 - DNA, 20 bp, Artificial Sequence
  chemically synthesized
ttttgcccataagaagcttc

SEQ ID NO: 106028 - DNA, 20 bp, Artificial Sequence
  chemically synthesized
ttttgttttatttttgccag

SEQ ID NO: 106029 - DNA, 20 bp, Artificial Sequence
  chemically synthesized
ttattttgttttatttttgc

SEQ ID NO: 106030 - DNA, 20 bp, Artificial Sequence
  chemically synthesized
tggcaaaaataaaacaaaat

SEQ ID NO: 106031 - DNA, 20 bp, Artificial Sequence
  chemically synthesized
aataaaacaaaataagtctt

SEQ ID NO: 106032 - DNA, 20 bp, Artificial Sequence
  chemically synthesized
ataaaacaaaataagtcttt

SEQ ID NO: 106033 - DNA, 20 bp, Artificial Sequence
  chemically synthesized
ctcctaaagaatgaggccta

SEQ ID NO: 106034 - DNA, 20 bp, Artificial Sequence
  chemically synthesized
agtctttaggcctcattctt

SEQ ID NO: 106035 - DNA, 20 bp, Artificial Sequence
  chemically synthesized
gcaaaacctcctaaagaatg

SEQ ID NO: 106036 - DNA, 20 bp, Artificial Sequence
  chemically synthesized
gtctttaggcctcattcttt

SEQ ID NO: 106037 - DNA, 20 bp, Artificial Sequence
  chemically synthesized
agcaaaacctcctaaagaat

SEQ ID NO: 106038 - DNA, 20 bp, Artificial Sequence
  chemically synthesized
ctttaggcctcattctttag

SEQ ID NO: 106039 - DNA, 20 bp, Artificial Sequence
  chemically synthesized
tttaggcctcattctttagg

SEQ ID NO: 106040 - DNA, 20 bp, Artificial Sequence
  chemically synthesized
taggccagcaaaacctccta

SEQ ID NO: 106041 - DNA, 20 bp, Artificial Sequence
  chemically synthesized
cattctttaggaggttttgc

SEQ ID NO: 106042 - DNA, 20 bp, Artificial Sequence
  chemically synthesized
aaagcaaaaacaatttaggc

SEQ ID NO: 106043 - DNA, 20 bp, Artificial Sequence
  chemically synthesized
ttaaaaagcaaaaacaattt

SEQ ID NO: 106044 - DNA, 20 bp, Artificial Sequence
  chemically synthesized
attaaaaagcaaaaacaatt

SEQ ID NO: 106045 - DNA, 20 bp, Artificial Sequence
  chemically synthesized
aaattgtttttgctttttaa

SEQ ID NO: 106046 - DNA, 20 bp, Artificial Sequence
  chemically synthesized
ctaattaaaataccattaaa

SEQ ID NO: 106047 - DNA, 20 bp, Artificial Sequence
  chemically synthesized
ctttttaatggtattttaat

SEQ ID NO: 106048 - DNA, 20 bp, Artificial Sequence
  chemically synthesized
attttaattagtgtttcacc

SEQ ID NO: 106049 - DNA, 20 bp, Artificial Sequence
  chemically synthesized
aattagtgtttcaccaagtg

SEQ ID NO: 106050 - DNA, 20 bp, Artificial Sequence
  chemically synthesized
tgctgattgagaaccacact

SEQ ID NO: 106051 - DNA, 20 bp, Artificial Sequence
  chemically synthesized
caccaagtgtggttctcaat

SEQ ID NO: 106052 - DNA, 20 bp, Artificial Sequence
  chemically synthesized
ggatactattgttgctgatt

SEQ ID NO: 106053 - DNA, 20 bp, Artificial Sequence
  chemically synthesized
tggttctcaatcagcaacaa

SEQ ID NO: 106054 - DNA, 20 bp, Artificial Sequence
  chemically synthesized
tcagcaacaatagtatcccc

SEQ ID NO: 106055 - DNA, 20 bp, Artificial Sequence
  chemically synthesized
cagcaacaatagtatcccct

SEQ ID NO: 106056 - DNA, 20 bp, Artificial Sequence
  chemically synthesized
catttctatcaaattcccag

SEQ ID NO: 106057 - DNA, 20 bp, Artificial Sequence
  chemically synthesized
gcatttctatcaaattccca

SEQ ID NO: 106058 - DNA, 20 bp, Artificial Sequence
  chemically synthesized
tgcatttctatcaaattccc

SEQ ID NO: 106059 - DNA, 20 bp, Artificial Sequence
  chemically synthesized
ttgcatttctatcaaattcc

SEQ ID NO: 106060 - DNA, 20 bp, Artificial Sequence
  chemically synthesized
agtatcccctgggaatttga

SEQ ID NO: 106061 - DNA, 20 bp, Artificial Sequence
  chemically synthesized
ttgatagaaatgcaaattat

SEQ ID NO: 106062 - DNA, 20 bp, Artificial Sequence
  chemically synthesized
tgatagaaatgcaaattatc

SEQ ID NO: 106063 - DNA, 20 bp, Artificial Sequence
  chemically synthesized
taatcatttagttatgagag

SEQ ID NO: 106064 - DNA, 20 bp, Artificial Sequence
  chemically synthesized
gtaatcatttagttatgaga

SEQ ID NO: 106065 - DNA, 20 bp, Artificial Sequence
  chemically synthesized
tgtaatcatttagttatgag

SEQ ID NO: 106066 - DNA, 20 bp, Artificial Sequence
  chemically synthesized
gtgtaatcatttagttatga

SEQ ID NO: 106067 - DNA, 20 bp, Artificial Sequence
  chemically synthesized
aagtgtaatcatttagttat

SEQ ID NO: 106068 - DNA, 20 bp, Artificial Sequence
  chemically synthesized
ctccacaaagtgtaatcatt

SEQ ID NO: 106069 - DNA, 20 bp, Artificial Sequence
  chemically synthesized
aactaaatgattacactttg

SEQ ID NO: 106070 - DNA, 20 bp, Artificial Sequence
  chemically synthesized
ctaaatgattacactttgtg

SEQ ID NO: 106071 - DNA, 20 bp, Artificial Sequence
  chemically synthesized
ttagatgaagagactccaca

SEQ ID NO: 106072 - DNA, 20 bp, Artificial Sequence
  chemically synthesized
actgaagacatttagatgaa

SEQ ID NO: 106073 - DNA, 20 bp, Artificial Sequence
  chemically synthesized
ccactgaagacatttagatg

SEQ ID NO: 106074 - DNA, 20 bp, Artificial Sequence
  chemically synthesized
cttttgccactgaagacatt

SEQ ID NO: 106075 - DNA, 20 bp, Artificial Sequence
  chemically synthesized
tctcttcatctaaatgtctt

SEQ ID NO: 106076 - DNA, 20 bp, Artificial Sequence
  chemically synthesized
cttcatctaaatgtcttcag

SEQ ID NO: 106077 - DNA, 20 bp, Artificial Sequence
  chemically synthesized
ttcattggcttttgccactg

SEQ ID NO: 106078 - DNA, 20 bp, Artificial Sequence
  chemically synthesized
ctaaatgtcttcagtggcaa

SEQ ID NO: 106079 - DNA, 20 bp, Artificial Sequence
  chemically synthesized
ttcagtggcaaaagccaatg

SEQ ID NO: 106080 - DNA, 20 bp, Artificial Sequence
  chemically synthesized
tatacagagattttcttcat

SEQ ID NO: 106081 - DNA, 20 bp, Artificial Sequence
  chemically synthesized
atgaagaaaatctctgtata

SEQ ID NO: 106082 - DNA, 20 bp, Artificial Sequence
  chemically synthesized
caaaaaaaaaactatataca

SEQ ID NO: 106083 - DNA, 20 bp, Artificial Sequence
  chemically synthesized
accaaaaaaaaaactatata

SEQ ID NO: 106084 - DNA, 20 bp, Artificial Sequence
  chemically synthesized
tctgtatatagttttttttt

SEQ ID NO: 106085 - DNA, 20 bp, Artificial Sequence
  chemically synthesized
tttgtttgtttgttttttaa

SEQ ID NO: 106086 - DNA, 20 bp, Artificial Sequence
  chemically synthesized
gtttgttttttaatggttct

SEQ ID NO: 106087 - DNA, 20 bp, Artificial Sequence
  chemically synthesized
tttgttttttaatggttctc

SEQ ID NO: 106088 - DNA, 20 bp, Artificial Sequence
  chemically synthesized
ttgttttttaatggttctca

SEQ ID NO: 106089 - DNA, 20 bp, Artificial Sequence
  chemically synthesized
ttttaatggttctcagggtt

SEQ ID NO: 106090 - DNA, 20 bp, Artificial Sequence
  chemically synthesized
tggtctagagaccaaaccct

SEQ ID NO: 106091 - DNA, 20 bp, Artificial Sequence
  chemically synthesized
ggttctcagggtttggtctc

SEQ ID NO: 106092 - DNA, 20 bp, Artificial Sequence
  chemically synthesized
attttgatggcattggtcta

SEQ ID NO: 106093 - DNA, 20 bp, Artificial Sequence
  chemically synthesized
tgattttgatggcattggtc

SEQ ID NO: 106094 - DNA, 20 bp, Artificial Sequence
  chemically synthesized
ccagttgattttgatggcat

SEQ ID NO: 106095 - DNA, 20 bp, Artificial Sequence
  chemically synthesized
aaatttccagttgattttga

SEQ ID NO: 106096 - DNA, 20 bp, Artificial Sequence
  chemically synthesized
ccaatgccatcaaaatcaac

SEQ ID NO: 106097 - DNA, 20 bp, Artificial Sequence
  chemically synthesized
tcacattgctcacaaatttc

SEQ ID NO: 106098 - DNA, 20 bp, Artificial Sequence
  chemically synthesized
aaaatcaactggaaatttgt

SEQ ID NO: 106099 - DNA, 20 bp, Artificial Sequence
  chemically synthesized
ttgtgagcaatgtgaattct

SEQ ID NO: 106100 - DNA, 20 bp, Artificial Sequence
  chemically synthesized
tgtgagcaatgtgaattctc

SEQ ID NO: 106101 - DNA, 20 bp, Artificial Sequence
  chemically synthesized
ttacagatagggtaggacct

SEQ ID NO: 106102 - DNA, 20 bp, Artificial Sequence
  chemically synthesized
cattcagttacagatagggt

SEQ ID NO: 106103 - DNA, 20 bp, Artificial Sequence
  chemically synthesized
acattcagttacagataggg

SEQ ID NO: 106104 - DNA, 20 bp, Artificial Sequence
  chemically synthesized
tttacattcagttacagata

SEQ ID NO: 106105 - DNA, 20 bp, Artificial Sequence
  chemically synthesized
ttttacattcagttacagat

SEQ ID NO: 106106 - DNA, 20 bp, Artificial Sequence
  chemically synthesized
gttttacattcagttacaga

SEQ ID NO: 106107 - DNA, 20 bp, Artificial Sequence
  chemically synthesized
tagagttttacattcagtta

SEQ ID NO: 106108 - DNA, 20 bp, Artificial Sequence
  chemically synthesized
catgcctagagttttacatt

SEQ ID NO: 106109 - DNA, 20 bp, Artificial Sequence
  chemically synthesized
tgtaactgaatgtaaaactc

SEQ ID NO: 106110 - DNA, 20 bp, Artificial Sequence
  chemically synthesized
gtaactgaatgtaaaactct

SEQ ID NO: 106111 - DNA, 20 bp, Artificial Sequence
  chemically synthesized
tgaatgtaaaactctaggca

SEQ ID NO: 106112 - DNA, 20 bp, Artificial Sequence
  chemically synthesized
gaatgtaaaactctaggcat

SEQ ID NO: 106113 - DNA, 20 bp, Artificial Sequence
  chemically synthesized
attgaatggtcccatgccta

SEQ ID NO: 106114 - DNA, 20 bp, Artificial Sequence
  chemically synthesized
agattgaatggtcccatgcc

SEQ ID NO: 106115 - DNA, 20 bp, Artificial Sequence
  chemically synthesized
ttgtagaaatacagattgaa

SEQ ID NO: 106116 - DNA, 20 bp, Artificial Sequence
  chemically synthesized
ctagaggacttgtagaaata

SEQ ID NO: 106117 - DNA, 20 bp, Artificial Sequence
  chemically synthesized
cattcaatctgtatttctac

SEQ ID NO: 106118 - DNA, 20 bp, Artificial Sequence
  chemically synthesized
caaagctactagaggacttg

SEQ ID NO: 106119 - DNA, 20 bp, Artificial Sequence
  chemically synthesized
ctgtatttctacaagtcctc

SEQ ID NO: 106120 - DNA, 20 bp, Artificial Sequence
  chemically synthesized
tatttctacaagtcctctag

SEQ ID NO: 106121 - DNA, 20 bp, Artificial Sequence
  chemically synthesized
acatgcatcaaagctactag

SEQ ID NO: 106122 - DNA, 20 bp, Artificial Sequence
  chemically synthesized
aacatgcatcaaagctacta

SEQ ID NO: 106123 - DNA, 20 bp, Artificial Sequence
  chemically synthesized
tgaacatgcatcaaagctac

SEQ ID NO: 106124 - DNA, 20 bp, Artificial Sequence
  chemically synthesized
gccgacttgaacatgcatca

SEQ ID NO: 106125 - DNA, 20 bp, Artificial Sequence
  chemically synthesized
agtagctttgatgcatgttc

SEQ ID NO: 106126 - DNA, 20 bp, Artificial Sequence
  chemically synthesized
gctttgatgcatgttcaagt

SEQ ID NO: 106127 - DNA, 20 bp, Artificial Sequence
  chemically synthesized
gcatgttcaagtcggcccta

SEQ ID NO: 106128 - DNA, 20 bp, Artificial Sequence
  chemically synthesized
gttataaatccaacacttta

SEQ ID NO: 106129 - DNA, 20 bp, Artificial Sequence
  chemically synthesized
tcaagtcggccctaaagtgt

SEQ ID NO: 106130 - DNA, 20 bp, Artificial Sequence
  chemically synthesized
ggttataaatccaacacttt

SEQ ID NO: 106131 - DNA, 20 bp, Artificial Sequence
  chemically synthesized
aggttataaatccaacactt

SEQ ID NO: 106132 - DNA, 20 bp, Artificial Sequence
  chemically synthesized
ttctagaaagaaacagttat

SEQ ID NO: 106133 - DNA, 20 bp, Artificial Sequence
  chemically synthesized
tttctagaaagaaacagtta

SEQ ID NO: 106134 - DNA, 20 bp, Artificial Sequence
  chemically synthesized
agttgttttctagaaagaaa

SEQ ID NO: 106135 - DNA, 20 bp, Artificial Sequence
  chemically synthesized
aacctataactgtttctttc

SEQ ID NO: 106136 - DNA, 20 bp, Artificial Sequence
  chemically synthesized
cgacatagttgttttctaga

SEQ ID NO: 106137 - DNA, 20 bp, Artificial Sequence
  chemically synthesized
cccccgacatagttgttttc

SEQ ID NO: 106138 - DNA, 20 bp, Artificial Sequence
  chemically synthesized
tttctagaaaacaactatgt

SEQ ID NO: 106139 - DNA, 20 bp, Artificial Sequence
  chemically synthesized
ttctagaaaacaactatgtc

SEQ ID NO: 106140 - DNA, 20 bp, Artificial Sequence
  chemically synthesized
tctagaaaacaactatgtcg

SEQ ID NO: 106141 - DNA, 20 bp, Artificial Sequence
  chemically synthesized
ctagaaaacaactatgtcgg

SEQ ID NO: 106142 - DNA, 20 bp, Artificial Sequence
  chemically synthesized
tttttatttttcccccgaca

SEQ ID NO: 106143 - DNA, 20 bp, Artificial Sequence
  chemically synthesized
tatgtcgggggaaaaataaa

SEQ ID NO: 106144 - DNA, 20 bp, Artificial Sequence
  chemically synthesized
tcgggggaaaaataaaaaga

SEQ ID NO: 106145 - DNA, 20 bp, Artificial Sequence
  chemically synthesized
aattctacgtttttaattaa

SEQ ID NO: 106146 - DNA, 20 bp, Artificial Sequence
  chemically synthesized
ttttctattaattaaaaacg

SEQ ID NO: 106147 - DNA, 20 bp, Artificial Sequence
  chemically synthesized
taattaaaaacgtagaattc

SEQ ID NO: 106148 - DNA, 20 bp, Artificial Sequence
  chemically synthesized
attaaaaacgtagaattcaa

SEQ ID NO: 106149 - DNA, 20 bp, Artificial Sequence
  chemically synthesized
aacgtagaattcaagagcta

SEQ ID NO: 106150 - DNA, 20 bp, Artificial Sequence
  chemically synthesized
acgtagaattcaagagctaa

SEQ ID NO: 106151 - DNA, 20 bp, Artificial Sequence
  chemically synthesized
tcattgtcctgagattcctt

SEQ ID NO: 106152 - DNA, 20 bp, Artificial Sequence
  chemically synthesized
ttcaagagctaaaggaatct

SEQ ID NO: 106153 - DNA, 20 bp, Artificial Sequence
  chemically synthesized
tcaagagctaaaggaatctc

SEQ ID NO: 106154 - DNA, 20 bp, Artificial Sequence
  chemically synthesized
tctttgctaatcattgtcct

SEQ ID NO: 106155 - DNA, 20 bp, Artificial Sequence
  chemically synthesized
aggaatctcaggacaatgat

SEQ ID NO: 106156 - DNA, 20 bp, Artificial Sequence
  chemically synthesized
tctcaggacaatgattagca

SEQ ID NO: 106157 - DNA, 20 bp, Artificial Sequence
  chemically synthesized
ttagcaaagataaatataca

SEQ ID NO: 106158 - DNA, 20 bp, Artificial Sequence
  chemically synthesized
tagcaaagataaatatacaa

SEQ ID NO: 106159 - DNA, 20 bp, Artificial Sequence
  chemically synthesized
taaatatacaaaggaatata

SEQ ID NO: 106160 - DNA, 20 bp, Artificial Sequence
  chemically synthesized
agtaaaaatgcaactgaaaa

SEQ ID NO: 106161 - DNA, 20 bp, Artificial Sequence
  chemically synthesized
acgttctcttcagccatttt

SEQ ID NO: 106162 - DNA, 20 bp, Artificial Sequence
  chemically synthesized
aatgcaactgaaaatggctg

SEQ ID NO: 106163 - DNA, 20 bp, Artificial Sequence
  chemically synthesized
tgcaactgaaaatggctgaa

SEQ ID NO: 106164 - DNA, 20 bp, Artificial Sequence
  chemically synthesized
gtgttagtccacgttctctt

SEQ ID NO: 106165 - DNA, 20 bp, Artificial Sequence
  chemically synthesized
gaaaatggctgaagagaacg

SEQ ID NO: 106166 - DNA, 20 bp, Artificial Sequence
  chemically synthesized
ctgtttcaaacattatgtgt

SEQ ID NO: 106167 - DNA, 20 bp, Artificial Sequence
  chemically synthesized
ctaacacataatgtttgaaa

SEQ ID NO: 106168 - DNA, 20 bp, Artificial Sequence
  chemically synthesized
aacacataatgtttgaaaca

SEQ ID NO: 106169 - DNA, 20 bp, Artificial Sequence
  chemically synthesized
aaacagagtatactatttaa

SEQ ID NO: 106170 - DNA, 20 bp, Artificial Sequence
  chemically synthesized
gcacatatgtagcttttaaa

SEQ ID NO: 106171 - DNA, 20 bp, Artificial Sequence
  chemically synthesized
tctgagatttagcacatatg

SEQ ID NO: 106172 - DNA, 20 bp, Artificial Sequence
  chemically synthesized
gctacatatgtgctaaatct

SEQ ID NO: 106173 - DNA, 20 bp, Artificial Sequence
  chemically synthesized
gaaagaagaattctgagatt

SEQ ID NO: 106174 - DNA, 20 bp, Artificial Sequence
  chemically synthesized
cacatggaaagaagaattct

SEQ ID NO: 106175 - DNA, 20 bp, Artificial Sequence
  chemically synthesized
tcaaactagcacatggaaag

SEQ ID NO: 106176 - DNA, 20 bp, Artificial Sequence
  chemically synthesized
ctctcaaactagcacatgga

SEQ ID NO: 106177 - DNA, 20 bp, Artificial Sequence
  chemically synthesized
gaattcttctttccatgtgc

SEQ ID NO: 106178 - DNA, 20 bp, Artificial Sequence
  chemically synthesized
ttgcctctcaaactagcaca

SEQ ID NO: 106179 - DNA, 20 bp, Artificial Sequence
  chemically synthesized
ttctttccatgtgctagttt

SEQ ID NO: 106180 - DNA, 20 bp, Artificial Sequence
  chemically synthesized
ctttccatgtgctagtttga

SEQ ID NO: 106181 - DNA, 20 bp, Artificial Sequence
  chemically synthesized
tttccatgtgctagtttgag

SEQ ID NO: 106182 - DNA, 20 bp, Artificial Sequence
  chemically synthesized
aaataaattgcctctcaaac

SEQ ID NO: 106183 - DNA, 20 bp, Artificial Sequence
  chemically synthesized
tttgagaggcaatttatttc

SEQ ID NO: 106184 - DNA, 20 bp, Artificial Sequence
  chemically synthesized
aatgcatatggcagttgtgc

SEQ ID NO: 106185 - DNA, 20 bp, Artificial Sequence
  chemically synthesized
attagtataaatgcatatgg

SEQ ID NO: 106186 - DNA, 20 bp, Artificial Sequence
  chemically synthesized
cacattagtataaatgcata

SEQ ID NO: 106187 - DNA, 20 bp, Artificial Sequence
  chemically synthesized
atgcatttatactaatgtga

SEQ ID NO: 106188 - DNA, 20 bp, Artificial Sequence
  chemically synthesized
ttacaagaagtctttcacat

SEQ ID NO: 106189 - DNA, 20 bp, Artificial Sequence
  chemically synthesized
tattaccttctcattacaag

SEQ ID NO: 106190 - DNA, 20 bp, Artificial Sequence
  chemically synthesized
tgtgaaagacttcttgtaat

SEQ ID NO: 106191 - DNA, 20 bp, Artificial Sequence
  chemically synthesized
gtgtattaccttctcattac

SEQ ID NO: 106192 - DNA, 20 bp, Artificial Sequence
  chemically synthesized
gaaagacttcttgtaatgag

SEQ ID NO: 106193 - DNA, 20 bp, Artificial Sequence
  chemically synthesized
aaagacttcttgtaatgaga

SEQ ID NO: 106194 - DNA, 20 bp, Artificial Sequence
  chemically synthesized
agaaggtaatacactgcatt

SEQ ID NO: 106195 - DNA, 20 bp, Artificial Sequence
  chemically synthesized
gaaaactagtttactaaatg

SEQ ID NO: 106196 - DNA, 20 bp, Artificial Sequence
  chemically synthesized
atacactgcatttagtaaac

SEQ ID NO: 106197 - DNA, 20 bp, Artificial Sequence
  chemically synthesized
atttttctcacattgaaaac

SEQ ID NO: 106198 - DNA, 20 bp, Artificial Sequence
  chemically synthesized
agtaaactagttttcaatgt

SEQ ID NO: 106199 - DNA, 20 bp, Artificial Sequence
  chemically synthesized
aaagggcaacattttcatgt

SEQ ID NO: 106200 - DNA, 20 bp, Artificial Sequence
  chemically synthesized
taaagggcaacattttcatg

SEQ ID NO: 106201 - DNA, 20 bp, Artificial Sequence
  chemically synthesized
tgaaaatgttgccctttaaa

SEQ ID NO: 106202 - DNA, 20 bp, Artificial Sequence
  chemically synthesized
gtcaagggaagctttttaaa

SEQ ID NO: 106203 - DNA, 20 bp, Artificial Sequence
  chemically synthesized
agtcaagggaagctttttaa

SEQ ID NO: 106204 - DNA, 20 bp, Artificial Sequence
  chemically synthesized
tagtcaagggaagcttttta

SEQ ID NO: 106205 - DNA, 20 bp, Artificial Sequence
  chemically synthesized
taaacaggaatagtcaaggg

SEQ ID NO: 106206 - DNA, 20 bp, Artificial Sequence
  chemically synthesized
atataaacaggaatagtcaa

SEQ ID NO: 106207 - DNA, 20 bp, Artificial Sequence
  chemically synthesized
aatataaacaggaatagtca

SEQ ID NO: 106208 - DNA, 20 bp, Artificial Sequence
  chemically synthesized
gaatataaacaggaatagtc

SEQ ID NO: 106209 - DNA, 20 bp, Artificial Sequence
  chemically synthesized
atcaagaatataaacaggaa

SEQ ID NO: 106210 - DNA, 20 bp, Artificial Sequence
  chemically synthesized
ctgctatcaagaatataaac

SEQ ID NO: 106211 - DNA, 20 bp, Artificial Sequence
  chemically synthesized
tctgctatcaagaatataaa

SEQ ID NO: 106212 - DNA, 20 bp, Artificial Sequence
  chemically synthesized
attcctgtttatattcttga

SEQ ID NO: 106213 - DNA, 20 bp, Artificial Sequence
  chemically synthesized
cctgtttatattcttgatag

SEQ ID NO: 106214 - DNA, 20 bp, Artificial Sequence
  chemically synthesized
cccaaagctattctgctatc

SEQ ID NO: 106215 - DNA, 20 bp, Artificial Sequence
  chemically synthesized
ttatattcttgatagcagaa

SEQ ID NO: 106216 - DNA, 20 bp, Artificial Sequence
  chemically synthesized
tcttgatagcagaatagctt

SEQ ID NO: 106217 - DNA, 20 bp, Artificial Sequence
  chemically synthesized
cttgatagcagaatagcttt

SEQ ID NO: 106218 - DNA, 20 bp, Artificial Sequence
  chemically synthesized
tctattcagaacatttccca

SEQ ID NO: 106219 - DNA, 20 bp, Artificial Sequence
  chemically synthesized
gctttgggaaatgttctgaa

SEQ ID NO: 106220 - DNA, 20 bp, Artificial Sequence
  chemically synthesized
gagtagctttggattctatt

SEQ ID NO: 106221 - DNA, 20 bp, Artificial Sequence
  chemically synthesized
aatgttctgaatagaatcca

SEQ ID NO: 106222 - DNA, 20 bp, Artificial Sequence
  chemically synthesized
gcctatctttagagtagctt

SEQ ID NO: 106223 - DNA, 20 bp, Artificial Sequence
  chemically synthesized
tagaatccaaagctactcta

SEQ ID NO: 106224 - DNA, 20 bp, Artificial Sequence
  chemically synthesized
ttgtcagcctatctttagag

SEQ ID NO: 106225 - DNA, 20 bp, Artificial Sequence
  chemically synthesized
atccaaagctactctaaaga

SEQ ID NO: 106226 - DNA, 20 bp, Artificial Sequence
  chemically synthesized
tccaaagctactctaaagat

SEQ ID NO: 106227 - DNA, 20 bp, Artificial Sequence
  chemically synthesized
accttgtcagcctatcttta

SEQ ID NO: 106228 - DNA, 20 bp, Artificial Sequence
  chemically synthesized
caaccttgtcagcctatctt

SEQ ID NO: 106229 - DNA, 20 bp, Artificial Sequence
  chemically synthesized
tactctaaagataggctgac

SEQ ID NO: 106230 - DNA, 20 bp, Artificial Sequence
  chemically synthesized
actctaaagataggctgaca

SEQ ID NO: 106231 - DNA, 20 bp, Artificial Sequence
  chemically synthesized
ctgtatggtgacaaccttgt

SEQ ID NO: 106232 - DNA, 20 bp, Artificial Sequence
  chemically synthesized
ctgacaaggttgtcaccata

SEQ ID NO: 106233 - DNA, 20 bp, Artificial Sequence
  chemically synthesized
catggtacataggaactgta

SEQ ID NO: 106234 - DNA, 20 bp, Artificial Sequence
  chemically synthesized
ttctaagattcatggtacat

SEQ ID NO: 106235 - DNA, 20 bp, Artificial Sequence
  chemically synthesized
attctaagattcatggtaca

SEQ ID NO: 106236 - DNA, 20 bp, Artificial Sequence
  chemically synthesized
ttcctatgtaccatgaatct

SEQ ID NO: 106237 - DNA, 20 bp, Artificial Sequence
  chemically synthesized
gttcttgattctaagattca

SEQ ID NO: 106238 - DNA, 20 bp, Artificial Sequence
  chemically synthesized
gtaccatgaatcttagaatc

SEQ ID NO: 106239 - DNA, 20 bp, Artificial Sequence
  chemically synthesized
attcaaacgttcttgattct

SEQ ID NO: 106240 - DNA, 20 bp, Artificial Sequence
  chemically synthesized
gaatcaagaacgtttgaatc

SEQ ID NO: 106241 - DNA, 20 bp, Artificial Sequence
  chemically synthesized
gtttgaatcaagacatttct

SEQ ID NO: 106242 - DNA, 20 bp, Artificial Sequence
  chemically synthesized
ttgaatcaagacatttctca

SEQ ID NO: 106243 - DNA, 20 bp, Artificial Sequence
  chemically synthesized
acatatctcagattggctct

SEQ ID NO: 106244 - DNA, 20 bp, Artificial Sequence
  chemically synthesized
acatttctcagagccaatct

SEQ ID NO: 106245 - DNA, 20 bp, Artificial Sequence
  chemically synthesized
aatatacacatatctcagat

SEQ ID NO: 106246 - DNA, 20 bp, Artificial Sequence
  chemically synthesized
atataaatatacacatatct

SEQ ID NO: 106247 - DNA, 20 bp, Artificial Sequence
  chemically synthesized
atatttatatgtatctattt

SEQ ID NO: 106248 - DNA, 20 bp, Artificial Sequence
  chemically synthesized
tccctgagagttgtctcaaa

SEQ ID NO: 106249 - DNA, 20 bp, Artificial Sequence
  chemically synthesized
tatctatttgagacaactct

SEQ ID NO: 106250 - DNA, 20 bp, Artificial Sequence
  chemically synthesized
atctatttgagacaactctc

SEQ ID NO: 106251 - DNA, 20 bp, Artificial Sequence
  chemically synthesized
tctatttgagacaactctca

SEQ ID NO: 106252 - DNA, 20 bp, Artificial Sequence
  chemically synthesized
tttgatgtcttgttccctga

SEQ ID NO: 106253 - DNA, 20 bp, Artificial Sequence
  chemically synthesized
tgagacaactctcagggaac

SEQ ID NO: 106254 - DNA, 20 bp, Artificial Sequence
  chemically synthesized
tttttgatgtcttgttccct

SEQ ID NO: 106255 - DNA, 20 bp, Artificial Sequence
  chemically synthesized
atcaaaaacaaattgatcaa

SEQ ID NO: 106256 - DNA, 20 bp, Artificial Sequence
  chemically synthesized
tcaaaaacaaattgatcaaa

SEQ ID NO: 106257 - DNA, 20 bp, Artificial Sequence
  chemically synthesized
ttaaaatgcaacattcattt

SEQ ID NO: 106258 - DNA, 20 bp, Artificial Sequence
  chemically synthesized
atgaatgttgcattttaacg

SEQ ID NO: 106259 - DNA, 20 bp, Artificial Sequence
  chemically synthesized
atgttgcattttaacgcagt

SEQ ID NO: 106260 - DNA, 20 bp, Artificial Sequence
  chemically synthesized
cattttaacgcagtgagtaa

SEQ ID NO: 106261 - DNA, 20 bp, Artificial Sequence
  chemically synthesized
cagtgagtaatggtacaatt

SEQ ID NO: 106262 - DNA, 20 bp, Artificial Sequence
  chemically synthesized
agtgagtaatggtacaattt

SEQ ID NO: 106263 - DNA, 20 bp, Artificial Sequence
  chemically synthesized
aggcagtttcaaaaagagtt

SEQ ID NO: 106264 - DNA, 20 bp, Artificial Sequence
  chemically synthesized
ttgaaaggcagtttcaaaaa

SEQ ID NO: 106265 - DNA, 20 bp, Artificial Sequence
  chemically synthesized
tcttgaaaggcagtttcaaa

SEQ ID NO: 106266 - DNA, 20 bp, Artificial Sequence
  chemically synthesized
tctttttgaaactgcctttc

SEQ ID NO: 106267 - DNA, 20 bp, Artificial Sequence
  chemically synthesized
ttgcaaactgtcttgaaagg

SEQ ID NO: 106268 - DNA, 20 bp, Artificial Sequence
  chemically synthesized
tttgaaactgcctttcaaga

SEQ ID NO: 106269 - DNA, 20 bp, Artificial Sequence
  chemically synthesized
taattgcaaactgtcttgaa

SEQ ID NO: 106270 - DNA, 20 bp, Artificial Sequence
  chemically synthesized
gtaattgcaaactgtcttga

SEQ ID NO: 106271 - DNA, 20 bp, Artificial Sequence
  chemically synthesized
aagacagtttgcaattacaa

SEQ ID NO: 106272 - DNA, 20 bp, Artificial Sequence
  chemically synthesized
aattacaaaagaaatgttca

SEQ ID NO: 106273 - DNA, 20 bp, Artificial Sequence
  chemically synthesized
attacaaaagaaatgttcat

SEQ ID NO: 106274 - DNA, 20 bp, Artificial Sequence
  chemically synthesized
aatttttcaaataaaaaaag

SEQ ID NO: 106275 - DNA, 20 bp, Artificial Sequence
  chemically synthesized
atcaatttttcaaataaaaa

SEQ ID NO: 106276 - DNA, 20 bp, Artificial Sequence
  chemically synthesized
tttgaaaaattgattgcatc

SEQ ID NO: 106277 - DNA, 20 bp, Artificial Sequence
  chemically synthesized
ttgaaaaattgattgcatct

SEQ ID NO: 106278 - DNA, 20 bp, Artificial Sequence
  chemically synthesized
aaatgcatgaatggtaaacc

SEQ ID NO: 106279 - DNA, 20 bp, Artificial Sequence
  chemically synthesized
tgttgaacaaaatgcatgaa

SEQ ID NO: 106280 - DNA, 20 bp, Artificial Sequence
  chemically synthesized
tgttcaacataaaaatattt

SEQ ID NO: 106281 - DNA, 20 bp, Artificial Sequence
  chemically synthesized
aagtagaatttattttttgt

SEQ ID NO: 106282 - DNA, 20 bp, Artificial Sequence
  chemically synthesized
aaatttttatattttgaaag

SEQ ID NO: 106283 - DNA, 20 bp, Artificial Sequence
  chemically synthesized
atcaaatttttatattttga

SEQ ID NO: 106284 - DNA, 20 bp, Artificial Sequence
  chemically synthesized
ataaaaatttgataccttta

SEQ ID NO: 106285 - DNA, 20 bp, Artificial Sequence
  chemically synthesized
ttcttttttaacatctttaa

SEQ ID NO: 106286 - DNA, 20 bp, Artificial Sequence
  chemically synthesized
tttcttttttaacatcttta

SEQ ID NO: 106287 - DNA, 20 bp, Artificial Sequence
  chemically synthesized
tacctttaaagatgttaaaa

SEQ ID NO: 106288 - DNA, 20 bp, Artificial Sequence
  chemically synthesized
taaagatgttaaaaaagaaa

SEQ ID NO: 106289 - DNA, 20 bp, Artificial Sequence
  chemically synthesized
tgttaaaaaagaaaaagaca

SEQ ID NO: 106290 - DNA, 20 bp, Artificial Sequence
  chemically synthesized
aaaaagaaaaagacacagaa

SEQ ID NO: 106291 - DNA, 20 bp, Artificial Sequence
  chemically synthesized
acagaatagtaacaacaacg

SEQ ID NO: 106292 - DNA, 20 bp, Artificial Sequence
  chemically synthesized
cagaatagtaacaacaacgt

SEQ ID NO: 106293 - DNA, 20 bp, Artificial Sequence
  chemically synthesized
acaacgtaggaataattgta

SEQ ID NO: 106294 - DNA, 20 bp, Artificial Sequence
  chemically synthesized
caacgtaggaataattgtat

SEQ ID NO: 106295 - DNA, 20 bp, Artificial Sequence
  chemically synthesized
gaataattgtataggctcct

SEQ ID NO: 106296 - DNA, 20 bp, Artificial Sequence
  chemically synthesized
aataattgtataggctccta

SEQ ID NO: 106297 - DNA, 20 bp, Artificial Sequence
  chemically synthesized
attcttaatggtcaccttag

SEQ ID NO: 106298 - DNA, 20 bp, Artificial Sequence
  chemically synthesized
gaattcttaatggtcacctt

SEQ ID NO: 106299 - DNA, 20 bp, Artificial Sequence
  chemically synthesized
agaattcttaatggtcacct

SEQ ID NO: 106300 - DNA, 20 bp, Artificial Sequence
  chemically synthesized
aggctcctaaggtgaccatt

SEQ ID NO: 106301 - DNA, 20 bp, Artificial Sequence
  chemically synthesized
ctgtaagttagaattcttaa

SEQ ID NO: 106302 - DNA, 20 bp, Artificial Sequence
  chemically synthesized
ccattaagaattctaactta

SEQ ID NO: 106303 - DNA, 20 bp, Artificial Sequence
  chemically synthesized
cattaagaattctaacttac

SEQ ID NO: 106304 - DNA, 20 bp, Artificial Sequence
  chemically synthesized
aaaacttaatacctgtaagt

SEQ ID NO: 106305 - DNA, 20 bp, Artificial Sequence
  chemically synthesized
ataaaaaacttaatacctgt

SEQ ID NO: 106306 - DNA, 20 bp, Artificial Sequence
  chemically synthesized
aattctaacttacaggtatt

SEQ ID NO: 106307 - DNA, 20 bp, Artificial Sequence
  chemically synthesized
agttttttatttaaaaaaat

SEQ ID NO: 106308 - DNA, 20 bp, Artificial Sequence
  chemically synthesized
ttaaaaaaatcagttgttcg

SEQ ID NO: 106309 - DNA, 20 bp, Artificial Sequence
  chemically synthesized
taaaaaaatcagttgttcga

SEQ ID NO: 106310 - DNA, 20 bp, Artificial Sequence
  chemically synthesized
gaaggaaacacaatttcaat

SEQ ID NO: 106311 - DNA, 20 bp, Artificial Sequence
  chemically synthesized
gaaacacaatttcaattaga

SEQ ID NO: 106312 - DNA, 20 bp, Artificial Sequence
  chemically synthesized
aaacacaatttcaattagac

SEQ ID NO: 106313 - DNA, 20 bp, Artificial Sequence
  chemically synthesized
acacaatttcaattagacag

SEQ ID NO: 106314 - DNA, 20 bp, Artificial Sequence
  chemically synthesized
cacaatttcaattagacagg

SEQ ID NO: 106315 - DNA, 20 bp, Artificial Sequence
  chemically synthesized
caatttcaattagacaggag

SEQ ID NO: 106316 - DNA, 20 bp, Artificial Sequence
  chemically synthesized
tagacaggaggagtatgttc

SEQ ID NO: 106317 - DNA, 20 bp, Artificial Sequence
  chemically synthesized
gacaggaggagtatgttcaa

SEQ ID NO: 106318 - DNA, 20 bp, Artificial Sequence
  chemically synthesized
tagtatccatgttgtacaat

SEQ ID NO: 106319 - DNA, 20 bp, Artificial Sequence
  chemically synthesized
atagtatccatgttgtacaa

SEQ ID NO: 106320 - DNA, 20 bp, Artificial Sequence
  chemically synthesized
aagagacctattgtacaaca

SEQ ID NO: 106321 - DNA, 20 bp, Artificial Sequence
  chemically synthesized
attgtacaacatggatacta

SEQ ID NO: 106322 - DNA, 20 bp, Artificial Sequence
  chemically synthesized
aacatggatactatagttaa

SEQ ID NO: 106323 - DNA, 20 bp, Artificial Sequence
  chemically synthesized
taatacattgctgttaacta

SEQ ID NO: 106324 - DNA, 20 bp, Artificial Sequence
  chemically synthesized
gtatactcttagcaagtatc

SEQ ID NO: 106325 - DNA, 20 bp, Artificial Sequence
  chemically synthesized
ttatatacttgatacttgct

SEQ ID NO: 106326 - DNA, 20 bp, Artificial Sequence
  chemically synthesized
atatacttgatacttgctaa

SEQ ID NO: 106327 - DNA, 20 bp, Artificial Sequence
  chemically synthesized
acttagagtatactcttagc

SEQ ID NO: 106328 - DNA, 20 bp, Artificial Sequence
  chemically synthesized
gaacacttagagtatactct

SEQ ID NO: 106329 - DNA, 20 bp, Artificial Sequence
  chemically synthesized
acttgctaagagtatactct

SEQ ID NO: 106330 - DNA, 20 bp, Artificial Sequence
  chemically synthesized
atttgtggtgagaacactta

SEQ ID NO: 106331 - DNA, 20 bp, Artificial Sequence
  chemically synthesized
ttatttgtggtgagaacact

SEQ ID NO: 106332 - DNA, 20 bp, Artificial Sequence
  chemically synthesized
acatacactttatttgtggt

SEQ ID NO: 106333 - DNA, 20 bp, Artificial Sequence
  chemically synthesized
aagtgttctcaccacaaata

SEQ ID NO: 106334 - DNA, 20 bp, Artificial Sequence
  chemically synthesized
cctcacatacactttatttg

SEQ ID NO: 106335 - DNA, 20 bp, Artificial Sequence
  chemically synthesized
accacaaataaagtgtatgt

SEQ ID NO: 106336 - DNA, 20 bp, Artificial Sequence
  chemically synthesized
ccacaaataaagtgtatgtg

SEQ ID NO: 106337 - DNA, 20 bp, Artificial Sequence
  chemically synthesized
gaggtaatgcatacgataat

SEQ ID NO: 106338 - DNA, 20 bp, Artificial Sequence
  chemically synthesized
atacgataattggcttgatt

SEQ ID NO: 106339 - DNA, 20 bp, Artificial Sequence
  chemically synthesized
cattgtggaatggctaaatc

SEQ ID NO: 106340 - DNA, 20 bp, Artificial Sequence
  chemically synthesized
tatacccatacattgtggaa

SEQ ID NO: 106341 - DNA, 20 bp, Artificial Sequence
  chemically synthesized
tttagccattccacaatgta

SEQ ID NO: 106342 - DNA, 20 bp, Artificial Sequence
  chemically synthesized
tttgatatacccatacattg

SEQ ID NO: 106343 - DNA, 20 bp, Artificial Sequence
  chemically synthesized
ttagccattccacaatgtat

SEQ ID NO: 106344 - DNA, 20 bp, Artificial Sequence
  chemically synthesized
ataaaggttgtatatattca

SEQ ID NO: 106345 - DNA, 20 bp, Artificial Sequence
  chemically synthesized
tatcttgtttaaattgataa

SEQ ID NO: 106346 - DNA, 20 bp, Artificial Sequence
  chemically synthesized
ttatcttgtttaaattgata

SEQ ID NO: 106347 - DNA, 20 bp, Artificial Sequence
  chemically synthesized
caacctttatcaatttaaac

SEQ ID NO: 106348 - DNA, 20 bp, Artificial Sequence
  chemically synthesized
taaacaagataattaaaaat

SEQ ID NO: 106349 - DNA, 20 bp, Artificial Sequence
  chemically synthesized
aaaaatcagttgtattactt

SEQ ID NO: 106350 - DNA, 20 bp, Artificial Sequence
  chemically synthesized
catattttaacaagcaactt

SEQ ID NO: 106351 - DNA, 20 bp, Artificial Sequence
  chemically synthesized
taacagatacatattttaac

SEQ ID NO: 106352 - DNA, 20 bp, Artificial Sequence
  chemically synthesized
atttgtattgattacagtaa

SEQ ID NO: 106353 - DNA, 20 bp, Artificial Sequence
  chemically synthesized
ataattatttgtattgatta

SEQ ID NO: 106354 - DNA, 20 bp, Artificial Sequence
  chemically synthesized
aatcaatacaaataattatg

SEQ ID NO: 106355 - DNA, 20 bp, Artificial Sequence
  chemically synthesized
caatacaaataattatgaag

SEQ ID NO: 106356 - DNA, 20 bp, Artificial Sequence
  chemically synthesized
atgaagcagttcatgcatgc

SEQ ID NO: 106357 - DNA, 20 bp, Artificial Sequence
  chemically synthesized
gcagttcatgcatgctggca

SEQ ID NO: 106358 - DNA, 20 bp, Artificial Sequence
  chemically synthesized
ttcatgcatgctggcaaagc

SEQ ID NO: 106359 - DNA, 20 bp, Artificial Sequence
  chemically synthesized
aatggcttgactggctttgc

SEQ ID NO: 106360 - DNA, 20 bp, Artificial Sequence
  chemically synthesized
gcatgctggcaaagccagtc

SEQ ID NO: 106361 - DNA, 20 bp, Artificial Sequence
  chemically synthesized
gcacttacgaatggcttgac

SEQ ID NO: 106362 - DNA, 20 bp, Artificial Sequence
  chemically synthesized
aagccagtcaagccattcgt

SEQ ID NO: 106363 - DNA, 20 bp, Artificial Sequence
  chemically synthesized
caacgagaggcacttacgaa

SEQ ID NO: 106364 - DNA, 20 bp, Artificial Sequence
  chemically synthesized
cattcgtaagtgcctctcgt

SEQ ID NO: 106365 - DNA, 20 bp, Artificial Sequence
  chemically synthesized
atacattcactgccaacgag

SEQ ID NO: 106366 - DNA, 20 bp, Artificial Sequence
  chemically synthesized
tcgtaagtgcctctcgttgg

SEQ ID NO: 106367 - DNA, 20 bp, Artificial Sequence
  chemically synthesized
aatacattcactgccaacga

SEQ ID NO: 106368 - DNA, 20 bp, Artificial Sequence
  chemically synthesized
aaaatacattcactgccaac

SEQ ID NO: 106369 - DNA, 20 bp, Artificial Sequence
  chemically synthesized
gtgaatgtattttttttcct

SEQ ID NO: 106370 - DNA, 20 bp, Artificial Sequence
  chemically synthesized
ataagggccttaggaggcca

SEQ ID NO: 106371 - DNA, 20 bp, Artificial Sequence
  chemically synthesized
cataagggccttaggaggcc

SEQ ID NO: 106372 - DNA, 20 bp, Artificial Sequence
  chemically synthesized
ttttttttccttggcctcct

SEQ ID NO: 106373 - DNA, 20 bp, Artificial Sequence
  chemically synthesized
tttttttccttggcctccta

SEQ ID NO: 106374 - DNA, 20 bp, Artificial Sequence
  chemically synthesized
aaagtcataagggccttagg

SEQ ID NO: 106375 - DNA, 20 bp, Artificial Sequence
  chemically synthesized
aaaagtcataagggccttag

SEQ ID NO: 106376 - DNA, 20 bp, Artificial Sequence
  chemically synthesized
gaaaaagtcataagggcctt

SEQ ID NO: 106377 - DNA, 20 bp, Artificial Sequence
  chemically synthesized
agaaaaagtcataagggcct

SEQ ID NO: 106378 - DNA, 20 bp, Artificial Sequence
  chemically synthesized
tgacccagaaaaagtcataa

SEQ ID NO: 106379 - DNA, 20 bp, Artificial Sequence
  chemically synthesized
ctgacccagaaaaagtcata

SEQ ID NO: 106380 - DNA, 20 bp, Artificial Sequence
  chemically synthesized
gctgacccagaaaaagtcat

SEQ ID NO: 106381 - DNA, 20 bp, Artificial Sequence
  chemically synthesized
aaggcccttatgactttttc

SEQ ID NO: 106382 - DNA, 20 bp, Artificial Sequence
  chemically synthesized
aggcccttatgactttttct

SEQ ID NO: 106383 - DNA, 20 bp, Artificial Sequence
  chemically synthesized
taacaaagctgacccagaaa

SEQ ID NO: 106384 - DNA, 20 bp, Artificial Sequence
  chemically synthesized
ccttatgactttttctgggt

SEQ ID NO: 106385 - DNA, 20 bp, Artificial Sequence
  chemically synthesized
aggagttaacaaagctgacc

SEQ ID NO: 106386 - DNA, 20 bp, Artificial Sequence
  chemically synthesized
ctaagtgagaggagttaaca

SEQ ID NO: 106387 - DNA, 20 bp, Artificial Sequence
  chemically synthesized
agaatggagctaagtgagag

SEQ ID NO: 106388 - DNA, 20 bp, Artificial Sequence
  chemically synthesized
ctttgttaactcctctcact

SEQ ID NO: 106389 - DNA, 20 bp, Artificial Sequence
  chemically synthesized
tgagaatggagctaagtgag

SEQ ID NO: 106390 - DNA, 20 bp, Artificial Sequence
  chemically synthesized
ttgagaatggagctaagtga

SEQ ID NO: 106391 - DNA, 20 bp, Artificial Sequence
  chemically synthesized
cattgagaatggagctaagt

SEQ ID NO: 106392 - DNA, 20 bp, Artificial Sequence
  chemically synthesized
tgaccattgagaatggagct

SEQ ID NO: 106393 - DNA, 20 bp, Artificial Sequence
  chemically synthesized
ctcgctgaccattgagaatg

SEQ ID NO: 106394 - DNA, 20 bp, Artificial Sequence
  chemically synthesized
tcacttagctccattctcaa

SEQ ID NO: 106395 - DNA, 20 bp, Artificial Sequence
  chemically synthesized
gcctcgctgaccattgagaa

SEQ ID NO: 106396 - DNA, 20 bp, Artificial Sequence
  chemically synthesized
ttagctccattctcaatggt

SEQ ID NO: 106397 - DNA, 20 bp, Artificial Sequence
  chemically synthesized
cccaagcctcgctgaccatt

SEQ ID NO: 106398 - DNA, 20 bp, Artificial Sequence
  chemically synthesized
ctccattctcaatggtcagc

SEQ ID NO: 106399 - DNA, 20 bp, Artificial Sequence
  chemically synthesized
tccattctcaatggtcagcg

SEQ ID NO: 106400 - DNA, 20 bp, Artificial Sequence
  chemically synthesized
tctcaatggtcagcgaggct

SEQ ID NO: 106401 - DNA, 20 bp, Artificial Sequence
  chemically synthesized
ctcaatggtcagcgaggctt

SEQ ID NO: 106402 - DNA, 20 bp, Artificial Sequence
  chemically synthesized
tggtcagcgaggcttgggat

SEQ ID NO: 106403 - DNA, 20 bp, Artificial Sequence
  chemically synthesized
aagtgaaaatgactaatccc

SEQ ID NO: 106404 - DNA, 20 bp, Artificial Sequence
  chemically synthesized
ttagtcattttcacttttct

SEQ ID NO: 106405 - DNA, 20 bp, Artificial Sequence
  chemically synthesized
agaggtccatgtaccaagaa

SEQ ID NO: 106406 - DNA, 20 bp, Artificial Sequence
  chemically synthesized
ttttcacttttcttggtaca

SEQ ID NO: 106407 - DNA, 20 bp, Artificial Sequence
  chemically synthesized
gggagagaggtccatgtacc

SEQ ID NO: 106408 - DNA, 20 bp, Artificial Sequence
  chemically synthesized
ctgagagtacggggggagag

SEQ ID NO: 106409 - DNA, 20 bp, Artificial Sequence
  chemically synthesized
actgagagtacggggggaga

SEQ ID NO: 106410 - DNA, 20 bp, Artificial Sequence
  chemically synthesized
atactgagagtacgggggga

SEQ ID NO: 106411 - DNA, 20 bp, Artificial Sequence
  chemically synthesized
aaatactgagagtacggggg

SEQ ID NO: 106412 - DNA, 20 bp, Artificial Sequence
  chemically synthesized
tgaaatactgagagtacggg

SEQ ID NO: 106413 - DNA, 20 bp, Artificial Sequence
  chemically synthesized
ttgaaatactgagagtacgg

SEQ ID NO: 106414 - DNA, 20 bp, Artificial Sequence
  chemically synthesized
attgaaatactgagagtacg

SEQ ID NO: 106415 - DNA, 20 bp, Artificial Sequence
  chemically synthesized
cctctctccccccgtactct

SEQ ID NO: 106416 - DNA, 20 bp, Artificial Sequence
  chemically synthesized
aattgaaatactgagagtac

SEQ ID NO: 106417 - DNA, 20 bp, Artificial Sequence
  chemically synthesized
taattgaaatactgagagta

SEQ ID NO: 106418 - DNA, 20 bp, Artificial Sequence
  chemically synthesized
aatgataattgaaatactga

SEQ ID NO: 106419 - DNA, 20 bp, Artificial Sequence
  chemically synthesized
caaatgataattgaaatact

SEQ ID NO: 106420 - DNA, 20 bp, Artificial Sequence
  chemically synthesized
tttcaattatcatttgactg

SEQ ID NO: 106421 - DNA, 20 bp, Artificial Sequence
  chemically synthesized
attatcatttgactgtagat

SEQ ID NO: 106422 - DNA, 20 bp, Artificial Sequence
  chemically synthesized
aagatttgggagcttatcta

SEQ ID NO: 106423 - DNA, 20 bp, Artificial Sequence
  chemically synthesized
aagctgaaataaagatttgg

SEQ ID NO: 106424 - DNA, 20 bp, Artificial Sequence
  chemically synthesized
ttaagctgaaataaagattt

SEQ ID NO: 106425 - DNA, 20 bp, Artificial Sequence
  chemically synthesized
attaagctgaaataaagatt

SEQ ID NO: 106426 - DNA, 20 bp, Artificial Sequence
  chemically synthesized
aagctcccaaatctttattt

SEQ ID NO: 106427 - DNA, 20 bp, Artificial Sequence
  chemically synthesized
tagaatattaagctgaaata

SEQ ID NO: 106428 - DNA, 20 bp, Artificial Sequence
  chemically synthesized
gaaattcaggatagaatatt

SEQ ID NO: 106429 - DNA, 20 bp, Artificial Sequence
  chemically synthesized
tgtgagtctgaaattcagga

SEQ ID NO: 106430 - DNA, 20 bp, Artificial Sequence
  chemically synthesized
taatattctatcctgaattt

SEQ ID NO: 106431 - DNA, 20 bp, Artificial Sequence
  chemically synthesized
gctgtgtgagtctgaaattc

SEQ ID NO: 106432 - DNA, 20 bp, Artificial Sequence
  chemically synthesized
ggctgtgtgagtctgaaatt

SEQ ID NO: 106433 - DNA, 20 bp, Artificial Sequence
  chemically synthesized
tcctgaatttcagactcaca

SEQ ID NO: 106434 - DNA, 20 bp, Artificial Sequence
  chemically synthesized
tcttgggcagttggctgtgt

SEQ ID NO: 106435 - DNA, 20 bp, Artificial Sequence
  chemically synthesized
actcacacagccaactgccc

SEQ ID NO: 106436 - DNA, 20 bp, Artificial Sequence
  chemically synthesized
agggaatattcttgggcagt

SEQ ID NO: 106437 - DNA, 20 bp, Artificial Sequence
  chemically synthesized
gttcagggaatattcttggg

SEQ ID NO: 106438 - DNA, 20 bp, Artificial Sequence
  chemically synthesized
caagttcagggaatattctt

SEQ ID NO: 106439 - DNA, 20 bp, Artificial Sequence
  chemically synthesized
acaagttcagggaatattct

SEQ ID NO: 106440 - DNA, 20 bp, Artificial Sequence
  chemically synthesized
ccaaaaggcggacaagttca

SEQ ID NO: 106441 - DNA, 20 bp, Artificial Sequence
  chemically synthesized
tccaaaaggcggacaagttc

SEQ ID NO: 106442 - DNA, 20 bp, Artificial Sequence
  chemically synthesized
atccaaaaggcggacaagtt

SEQ ID NO: 106443 - DNA, 20 bp, Artificial Sequence
  chemically synthesized
ggaatatccaaaaggcggac

SEQ ID NO: 106444 - DNA, 20 bp, Artificial Sequence
  chemically synthesized
ccctgaacttgtccgccttt

SEQ ID NO: 106445 - DNA, 20 bp, Artificial Sequence
  chemically synthesized
tttagggaatatccaaaagg

SEQ ID NO: 106446 - DNA, 20 bp, Artificial Sequence
  chemically synthesized
ctgtttagggaatatccaaa

SEQ ID NO: 106447 - DNA, 20 bp, Artificial Sequence
  chemically synthesized
cctgtttagggaatatccaa

SEQ ID NO: 106448 - DNA, 20 bp, Artificial Sequence
  chemically synthesized
ccttttggatattccctaaa

SEQ ID NO: 106449 - DNA, 20 bp, Artificial Sequence
  chemically synthesized
cttttggatattccctaaac

SEQ ID NO: 106450 - DNA, 20 bp, Artificial Sequence
  chemically synthesized
tttaggacgtgtcctgttta

SEQ ID NO: 106451 - DNA, 20 bp, Artificial Sequence
  chemically synthesized
atttaggacgtgtcctgttt

SEQ ID NO: 106452 - DNA, 20 bp, Artificial Sequence
  chemically synthesized
gatttaggacgtgtcctgtt

SEQ ID NO: 106453 - DNA, 20 bp, Artificial Sequence
  chemically synthesized
aaacaggacacgtcctaaat

SEQ ID NO: 106454 - DNA, 20 bp, Artificial Sequence
  chemically synthesized
ggctttgagaacactgattt

SEQ ID NO: 106455 - DNA, 20 bp, Artificial Sequence
  chemically synthesized
aggctttgagaacactgatt

SEQ ID NO: 106456 - DNA, 20 bp, Artificial Sequence
  chemically synthesized
gtcctaaatcagtgttctca

SEQ ID NO: 106457 - DNA, 20 bp, Artificial Sequence
  chemically synthesized
aaatcagtgttctcaaagcc

SEQ ID NO: 106458 - DNA, 20 bp, Artificial Sequence
  chemically synthesized
ctggtgagggaccaggcttt

SEQ ID NO: 106459 - DNA, 20 bp, Artificial Sequence
  chemically synthesized
gatgccgctggtgagggacc

SEQ ID NO: 106460 - DNA, 20 bp, Artificial Sequence
  chemically synthesized
tgatgccgctggtgagggac

SEQ ID NO: 106461 - DNA, 20 bp, Artificial Sequence
  chemically synthesized
ctcaaagcctggtccctcac

SEQ ID NO: 106462 - DNA, 20 bp, Artificial Sequence
  chemically synthesized
aaagcctggtccctcaccag

SEQ ID NO: 106463 - DNA, 20 bp, Artificial Sequence
  chemically synthesized
gattttgatgccgctggtga

SEQ ID NO: 106464 - DNA, 20 bp, Artificial Sequence
  chemically synthesized
tgattttgatgccgctggtg

SEQ ID NO: 106465 - DNA, 20 bp, Artificial Sequence
  chemically synthesized
atgattttgatgccgctggt

SEQ ID NO: 106466 - DNA, 20 bp, Artificial Sequence
  chemically synthesized
ttccatgattttgatgccgc

SEQ ID NO: 106467 - DNA, 20 bp, Artificial Sequence
  chemically synthesized
caccagcggcatcaaaatca

SEQ ID NO: 106468 - DNA, 20 bp, Artificial Sequence
  chemically synthesized
cagcggcatcaaaatcatgg

SEQ ID NO: 106469 - DNA, 20 bp, Artificial Sequence
  chemically synthesized
aaaatcatggaagaactttg

SEQ ID NO: 106470 - DNA, 20 bp, Artificial Sequence
  chemically synthesized
agataatttgcatttctaca

SEQ ID NO: 106471 - DNA, 20 bp, Artificial Sequence
  chemically synthesized
ggggaggtctggggagggca

SEQ ID NO: 106472 - DNA, 20 bp, Artificial Sequence
  chemically synthesized
caaattatctgtgccctccc

SEQ ID NO: 106473 - DNA, 20 bp, Artificial Sequence
  chemically synthesized
taattggggaggtctgggga

SEQ ID NO: 106474 - DNA, 20 bp, Artificial Sequence
  chemically synthesized
ctaattggggaggtctgggg

SEQ ID NO: 106475 - DNA, 20 bp, Artificial Sequence
  chemically synthesized
tctaattggggaggtctggg

SEQ ID NO: 106476 - DNA, 20 bp, Artificial Sequence
  chemically synthesized
cttctaattggggaggtctg

SEQ ID NO: 106477 - DNA, 20 bp, Artificial Sequence
  chemically synthesized
gcttctaattggggaggtct

SEQ ID NO: 106478 - DNA, 20 bp, Artificial Sequence
  chemically synthesized
agcttctaattggggaggtc

SEQ ID NO: 106479 - DNA, 20 bp, Artificial Sequence
  chemically synthesized
cctccccagacctccccaat

SEQ ID NO: 106480 - DNA, 20 bp, Artificial Sequence
  chemically synthesized
ccttaagcttctaattgggg

SEQ ID NO: 106481 - DNA, 20 bp, Artificial Sequence
  chemically synthesized
cccttaagcttctaattggg

SEQ ID NO: 106482 - DNA, 20 bp, Artificial Sequence
  chemically synthesized
ccccagacctccccaattag

SEQ ID NO: 106483 - DNA, 20 bp, Artificial Sequence
  chemically synthesized
tacccttaagcttctaattg

SEQ ID NO: 106484 - DNA, 20 bp, Artificial Sequence
  chemically synthesized
ttacccttaagcttctaatt

SEQ ID NO: 106485 - DNA, 20 bp, Artificial Sequence
  chemically synthesized
tttacccttaagcttctaat

SEQ ID NO: 106486 - DNA, 20 bp, Artificial Sequence
  chemically synthesized
acctccccaattagaagctt

SEQ ID NO: 106487 - DNA, 20 bp, Artificial Sequence
  chemically synthesized
cctccccaattagaagctta

SEQ ID NO: 106488 - DNA, 20 bp, Artificial Sequence
  chemically synthesized
ctccccaattagaagcttaa

SEQ ID NO: 106489 - DNA, 20 bp, Artificial Sequence
  chemically synthesized
cagatgaccgttttaccctt

SEQ ID NO: 106490 - DNA, 20 bp, Artificial Sequence
  chemically synthesized
ttagaagcttaagggtaaaa

SEQ ID NO: 106491 - DNA, 20 bp, Artificial Sequence
  chemically synthesized
ctggaaaacttgttaatatg

SEQ ID NO: 106492 - DNA, 20 bp, Artificial Sequence
  chemically synthesized
acggtcatctgcatattaac

SEQ ID NO: 106493 - DNA, 20 bp, Artificial Sequence
  chemically synthesized
ctgcatattaacaagttttc

SEQ ID NO: 106494 - DNA, 20 bp, Artificial Sequence
  chemically synthesized
tgcatattaacaagttttcc

SEQ ID NO: 106495 - DNA, 20 bp, Artificial Sequence
  chemically synthesized
catattaacaagttttccag

SEQ ID NO: 106496 - DNA, 20 bp, Artificial Sequence
  chemically synthesized
ttagctccactggaatctcc

SEQ ID NO: 106497 - DNA, 20 bp, Artificial Sequence
  chemically synthesized
acaagttttccaggagattc

SEQ ID NO: 106498 - DNA, 20 bp, Artificial Sequence
  chemically synthesized
agttttccaggagattccag

SEQ ID NO: 106499 - DNA, 20 bp, Artificial Sequence
  chemically synthesized
ttttccaggagattccagtg

SEQ ID NO: 106500 - DNA, 20 bp, Artificial Sequence
  chemically synthesized
ttctcaaactttagctccac

SEQ ID NO: 106501 - DNA, 20 bp, Artificial Sequence
  chemically synthesized
aggagattccagtggagcta

SEQ ID NO: 106502 - DNA, 20 bp, Artificial Sequence
  chemically synthesized
ttccagtggagctaaagttt

SEQ ID NO: 106503 - DNA, 20 bp, Artificial Sequence
  chemically synthesized
ggacagtggttctcaaactt

SEQ ID NO: 106504 - DNA, 20 bp, Artificial Sequence
  chemically synthesized
ctgggcatgatataggacag

SEQ ID NO: 106505 - DNA, 20 bp, Artificial Sequence
  chemically synthesized
acgctgggcatgatatagga

SEQ ID NO: 106506 - DNA, 20 bp, Artificial Sequence
  chemically synthesized
gtaaacgctgggcatgatat

SEQ ID NO: 106507 - DNA, 20 bp, Artificial Sequence
  chemically synthesized
agtaaacgctgggcatgata

SEQ ID NO: 106508 - DNA, 20 bp, Artificial Sequence
  chemically synthesized
ccactgtcctatatcatgcc

SEQ ID NO: 106509 - DNA, 20 bp, Artificial Sequence
  chemically synthesized
aaatacacagagtaaacgct

SEQ ID NO: 106510 - DNA, 20 bp, Artificial Sequence
  chemically synthesized
taaatacacagagtaaacgc

SEQ ID NO: 106511 - DNA, 20 bp, Artificial Sequence
  chemically synthesized
aaaaacattataaatacaca

SEQ ID NO: 106512 - DNA, 20 bp, Artificial Sequence
  chemically synthesized
ttaaaaacattataaataca

SEQ ID NO: 106513 - DNA, 20 bp, Artificial Sequence
  chemically synthesized
taaaaaatttccatatttta

SEQ ID NO: 106514 - DNA, 20 bp, Artificial Sequence
  chemically synthesized
gttcaagcatccataaaata

SEQ ID NO: 106515 - DNA, 20 bp, Artificial Sequence
  chemically synthesized
ccaaggacctcaagatgttc

SEQ ID NO: 106516 - DNA, 20 bp, Artificial Sequence
  chemically synthesized
tatggatgcttgaacatctt

SEQ ID NO: 106517 - DNA, 20 bp, Artificial Sequence
  chemically synthesized
atggatgcttgaacatcttg

SEQ ID NO: 106518 - DNA, 20 bp, Artificial Sequence
  chemically synthesized
cctggccttccaaggacctc

SEQ ID NO: 106519 - DNA, 20 bp, Artificial Sequence
  chemically synthesized
cttgaacatcttgaggtcct

SEQ ID NO: 106520 - DNA, 20 bp, Artificial Sequence
  chemically synthesized
gaacatcttgaggtccttgg

SEQ ID NO: 106521 - DNA, 20 bp, Artificial Sequence
  chemically synthesized
aacatcttgaggtccttgga

SEQ ID NO: 106522 - DNA, 20 bp, Artificial Sequence
  chemically synthesized
agtctctccctggccttcca

SEQ ID NO: 106523 - DNA, 20 bp, Artificial Sequence
  chemically synthesized
tcttgaggtccttggaaggc

SEQ ID NO: 106524 - DNA, 20 bp, Artificial Sequence
  chemically synthesized
cagtctctccctggccttcc

SEQ ID NO: 106525 - DNA, 20 bp, Artificial Sequence
  chemically synthesized
cttgaggtccttggaaggcc

SEQ ID NO: 106526 - DNA, 20 bp, Artificial Sequence
  chemically synthesized
ttgaggtccttggaaggcca

SEQ ID NO: 106527 - DNA, 20 bp, Artificial Sequence
  chemically synthesized
gaggtccttggaaggccagg

SEQ ID NO: 106528 - DNA, 20 bp, Artificial Sequence
  chemically synthesized
ggtccttggaaggccaggga

SEQ ID NO: 106529 - DNA, 20 bp, Artificial Sequence
  chemically synthesized
tgggaggggcagtctctccc

SEQ ID NO: 106530 - DNA, 20 bp, Artificial Sequence
  chemically synthesized
cagggagagactgcccctcc

SEQ ID NO: 106531 - DNA, 20 bp, Artificial Sequence
  chemically synthesized
ttagctagccctgggagggg

SEQ ID NO: 106532 - DNA, 20 bp, Artificial Sequence
  chemically synthesized
agggagagactgcccctccc

SEQ ID NO: 106533 - DNA, 20 bp, Artificial Sequence
  chemically synthesized
gggagagactgcccctccca

SEQ ID NO: 106534 - DNA, 20 bp, Artificial Sequence
  chemically synthesized
gaattagctagccctgggag

SEQ ID NO: 106535 - DNA, 20 bp, Artificial Sequence
  chemically synthesized
ggaattagctagccctggga

SEQ ID NO: 106536 - DNA, 20 bp, Artificial Sequence
  chemically synthesized
aggaattagctagccctggg

SEQ ID NO: 106537 - DNA, 20 bp, Artificial Sequence
  chemically synthesized
gagactgcccctcccagggc

SEQ ID NO: 106538 - DNA, 20 bp, Artificial Sequence
  chemically synthesized
taggaattagctagccctgg

SEQ ID NO: 106539 - DNA, 20 bp, Artificial Sequence
  chemically synthesized
tttaggaattagctagccct

SEQ ID NO: 106540 - DNA, 20 bp, Artificial Sequence
  chemically synthesized
ctttaggaattagctagccc

SEQ ID NO: 106541 - DNA, 20 bp, Artificial Sequence
  chemically synthesized
tgctatctttaggaattagc

SEQ ID NO: 106542 - DNA, 20 bp, Artificial Sequence
  chemically synthesized
ccagggctagctaattccta

SEQ ID NO: 106543 - DNA, 20 bp, Artificial Sequence
  chemically synthesized
tatttgctatctttaggaat

SEQ ID NO: 106544 - DNA, 20 bp, Artificial Sequence
  chemically synthesized
ggctagctaattcctaaaga

SEQ ID NO: 106545 - DNA, 20 bp, Artificial Sequence
  chemically synthesized
acaagttatttgctatcttt

SEQ ID NO: 106546 - DNA, 20 bp, Artificial Sequence
  chemically synthesized
tacaagttatttgctatctt

SEQ ID NO: 106547 - DNA, 20 bp, Artificial Sequence
  chemically synthesized
ccacaagggagcaagtttac

SEQ ID NO: 106548 - DNA, 20 bp, Artificial Sequence
  chemically synthesized
caacaaatccacaagggagc

SEQ ID NO: 106549 - DNA, 20 bp, Artificial Sequence
  chemically synthesized
cttgtaaacttgctcccttg

SEQ ID NO: 106550 - DNA, 20 bp, Artificial Sequence
  chemically synthesized
aatccaacaaatccacaagg

SEQ ID NO: 106551 - DNA, 20 bp, Artificial Sequence
  chemically synthesized
gcaatccaacaaatccacaa

SEQ ID NO: 106552 - DNA, 20 bp, Artificial Sequence
  chemically synthesized
agcaatccaacaaatccaca

SEQ ID NO: 106553 - DNA, 20 bp, Artificial Sequence
  chemically synthesized
aagcaatccaacaaatccac

SEQ ID NO: 106554 - DNA, 20 bp, Artificial Sequence
  chemically synthesized
ttgctcccttgtggatttgt

SEQ ID NO: 106555 - DNA, 20 bp, Artificial Sequence
  chemically synthesized
tagttggtttgtataacgaa

SEQ ID NO: 106556 - DNA, 20 bp, Artificial Sequence
  chemically synthesized
gatacggactttggattagt

SEQ ID NO: 106557 - DNA, 20 bp, Artificial Sequence
  chemically synthesized
tatacaaaccaactaatcca

SEQ ID NO: 106558 - DNA, 20 bp, Artificial Sequence
  chemically synthesized
tggggatacggactttggat

SEQ ID NO: 106559 - DNA, 20 bp, Artificial Sequence
  chemically synthesized
gtagttggggatacggactt

SEQ ID NO: 106560 - DNA, 20 bp, Artificial Sequence
  chemically synthesized
gaagaaggtagttggggata

SEQ ID NO: 106561 - DNA, 20 bp, Artificial Sequence
  chemically synthesized
ttagatgaagaaggtagttg

SEQ ID NO: 106562 - DNA, 20 bp, Artificial Sequence
  chemically synthesized
gttagatgaagaaggtagtt

SEQ ID NO: 106563 - DNA, 20 bp, Artificial Sequence
  chemically synthesized
agttagatgaagaaggtagt

SEQ ID NO: 106564 - DNA, 20 bp, Artificial Sequence
  chemically synthesized
caacagttagatgaagaagg

SEQ ID NO: 106565 - DNA, 20 bp, Artificial Sequence
  chemically synthesized
taacaacagttagatgaaga

SEQ ID NO: 106566 - DNA, 20 bp, Artificial Sequence
  chemically synthesized
gtaacaacagttagatgaag

SEQ ID NO: 106567 - DNA, 20 bp, Artificial Sequence
  chemically synthesized
ggtgtaacaacagttagatg

SEQ ID NO: 106568 - DNA, 20 bp, Artificial Sequence
  chemically synthesized
tggtttggtgtaacaacagt

SEQ ID NO: 106569 - DNA, 20 bp, Artificial Sequence
  chemically synthesized
atattggtttggtgtaacaa

SEQ ID NO: 106570 - DNA, 20 bp, Artificial Sequence
  chemically synthesized
gggtgggggaaatattggtt

SEQ ID NO: 106571 - DNA, 20 bp, Artificial Sequence
  chemically synthesized
agttagggtgggggaaatat

SEQ ID NO: 106572 - DNA, 20 bp, Artificial Sequence
  chemically synthesized
aggggaaaaagttagggtgg

SEQ ID NO: 106573 - DNA, 20 bp, Artificial Sequence
  chemically synthesized
gaggggaaaaagttagggtg

SEQ ID NO: 106574 - DNA, 20 bp, Artificial Sequence
  chemically synthesized
tgaggggaaaaagttagggt

SEQ ID NO: 106575 - DNA, 20 bp, Artificial Sequence
  chemically synthesized
gtgaggggaaaaagttaggg

SEQ ID NO: 106576 - DNA, 20 bp, Artificial Sequence
  chemically synthesized
agggtgaggggaaaaagtta

SEQ ID NO: 106577 - DNA, 20 bp, Artificial Sequence
  chemically synthesized
tagggtgaggggaaaaagtt

SEQ ID NO: 106578 - DNA, 20 bp, Artificial Sequence
  chemically synthesized
ctagggtgaggggaaaaagt

SEQ ID NO: 106579 - DNA, 20 bp, Artificial Sequence
  chemically synthesized
agccctagggtgaggggaaa

SEQ ID NO: 106580 - DNA, 20 bp, Artificial Sequence
  chemically synthesized
ctaactttttcccctcaccc

SEQ ID NO: 106581 - DNA, 20 bp, Artificial Sequence
  chemically synthesized
gtaccaagccctagggtgag

SEQ ID NO: 106582 - DNA, 20 bp, Artificial Sequence
  chemically synthesized
taactttttcccctcaccct

SEQ ID NO: 106583 - DNA, 20 bp, Artificial Sequence
  chemically synthesized
ggtaccaagccctagggtga

SEQ ID NO: 106584 - DNA, 20 bp, Artificial Sequence
  chemically synthesized
aactttttcccctcacccta

SEQ ID NO: 106585 - DNA, 20 bp, Artificial Sequence
  chemically synthesized
tggtaccaagccctagggtg

SEQ ID NO: 106586 - DNA, 20 bp, Artificial Sequence
  chemically synthesized
ctggtaccaagccctagggt

SEQ ID NO: 106587 - DNA, 20 bp, Artificial Sequence
  chemically synthesized
tttcccctcaccctagggct

SEQ ID NO: 106588 - DNA, 20 bp, Artificial Sequence
  chemically synthesized
ttgtctggtaccaagcccta

SEQ ID NO: 106589 - DNA, 20 bp, Artificial Sequence
  chemically synthesized
gttgtctggtaccaagccct

SEQ ID NO: 106590 - DNA, 20 bp, Artificial Sequence
  chemically synthesized
ggttgtctggtaccaagccc

SEQ ID NO: 106591 - DNA, 20 bp, Artificial Sequence
  chemically synthesized
ctcaccctagggcttggtac

SEQ ID NO: 106592 - DNA, 20 bp, Artificial Sequence
  chemically synthesized
gtctctggttgtctggtacc

SEQ ID NO: 106593 - DNA, 20 bp, Artificial Sequence
  chemically synthesized
agggcttggtaccagacaac

SEQ ID NO: 106594 - DNA, 20 bp, Artificial Sequence
  chemically synthesized
aaaagtggtctctggttgtc

SEQ ID NO: 106595 - DNA, 20 bp, Artificial Sequence
  chemically synthesized
ggcttggtaccagacaacca

SEQ ID NO: 106596 - DNA, 20 bp, Artificial Sequence
  chemically synthesized
ctggctgtaaaagtggtctc

SEQ ID NO: 106597 - DNA, 20 bp, Artificial Sequence
  chemically synthesized
acaaccagagaccactttta

SEQ ID NO: 106598 - DNA, 20 bp, Artificial Sequence
  chemically synthesized
aaatttcctggctgtaaaag

SEQ ID NO: 106599 - DNA, 20 bp, Artificial Sequence
  chemically synthesized
ccagagaccacttttacagc

SEQ ID NO: 106600 - DNA, 20 bp, Artificial Sequence
  chemically synthesized
ccaaaatttcctggctgtaa

SEQ ID NO: 106601 - DNA, 20 bp, Artificial Sequence
  chemically synthesized
cagagaccacttttacagcc

SEQ ID NO: 106602 - DNA, 20 bp, Artificial Sequence
  chemically synthesized
aaataatttccaaaatttcc

SEQ ID NO: 106603 - DNA, 20 bp, Artificial Sequence
  chemically synthesized
cttttacagccaggaaattt

SEQ ID NO: 106604 - DNA, 20 bp, Artificial Sequence
  chemically synthesized
tggaaattatttgaactatc

SEQ ID NO: 106605 - DNA, 20 bp, Artificial Sequence
  chemically synthesized
tgagcaagtttaggactgga

SEQ ID NO: 106606 - DNA, 20 bp, Artificial Sequence
  chemically synthesized
agtctgagcaagtttaggac

SEQ ID NO: 106607 - DNA, 20 bp, Artificial Sequence
  chemically synthesized
aggcaagtctgagcaagttt

SEQ ID NO: 106608 - DNA, 20 bp, Artificial Sequence
  chemically synthesized
taggcaagtctgagcaagtt

SEQ ID NO: 106609 - DNA, 20 bp, Artificial Sequence
  chemically synthesized
tatccagtcctaaacttgct

SEQ ID NO: 106610 - DNA, 20 bp, Artificial Sequence
  chemically synthesized
tagaataggcaagtctgagc

SEQ ID NO: 106611 - DNA, 20 bp, Artificial Sequence
  chemically synthesized
gaggtagaataggcaagtct

SEQ ID NO: 106612 - DNA, 20 bp, Artificial Sequence
  chemically synthesized
atgagtgaggtagaataggc

SEQ ID NO: 106613 - DNA, 20 bp, Artificial Sequence
  chemically synthesized
agaaatgagtgaggtagaat

SEQ ID NO: 106614 - DNA, 20 bp, Artificial Sequence
  chemically synthesized
aagaaatgagtgaggtagaa

SEQ ID NO: 106615 - DNA, 20 bp, Artificial Sequence
  chemically synthesized
aggaaaagaaatgagtgagg

SEQ ID NO: 106616 - DNA, 20 bp, Artificial Sequence
  chemically synthesized
ccaaggaaaagaaatgagtg

SEQ ID NO: 106617 - DNA, 20 bp, Artificial Sequence
  chemically synthesized
tccaaggaaaagaaatgagt

SEQ ID NO: 106618 - DNA, 20 bp, Artificial Sequence
  chemically synthesized
ggtttccaaggaaaagaaat

SEQ ID NO: 106619 - DNA, 20 bp, Artificial Sequence
  chemically synthesized
cctcactcatttcttttcct

SEQ ID NO: 106620 - DNA, 20 bp, Artificial Sequence
  chemically synthesized
ttattgtggtttccaaggaa

SEQ ID NO: 106621 - DNA, 20 bp, Artificial Sequence
  chemically synthesized
accctttattgtggtttcca

SEQ ID NO: 106622 - DNA, 20 bp, Artificial Sequence
  chemically synthesized
aaccctttattgtggtttcc

SEQ ID NO: 106623 - DNA, 20 bp, Artificial Sequence
  chemically synthesized
tttccttggaaaccacaata

SEQ ID NO: 106624 - DNA, 20 bp, Artificial Sequence
  chemically synthesized
ttccttggaaaccacaataa

SEQ ID NO: 106625 - DNA, 20 bp, Artificial Sequence
  chemically synthesized
tccttggaaaccacaataaa

SEQ ID NO: 106626 - DNA, 20 bp, Artificial Sequence
  chemically synthesized
acagcccaaaccctttattg

SEQ ID NO: 106627 - DNA, 20 bp, Artificial Sequence
  chemically synthesized
ggaaaccacaataaagggtt

SEQ ID NO: 106628 - DNA, 20 bp, Artificial Sequence
  chemically synthesized
gaaaccacaataaagggttt

SEQ ID NO: 106629 - DNA, 20 bp, Artificial Sequence
  chemically synthesized
gcaggcagaaaaggaaagca

SEQ ID NO: 106630 - DNA, 20 bp, Artificial Sequence
  chemically synthesized
ggtcagcaggcagaaaagga

SEQ ID NO: 106631 - DNA, 20 bp, Artificial Sequence
  chemically synthesized
agtcggtcagcaggcagaaa

SEQ ID NO: 106632 - DNA, 20 bp, Artificial Sequence
  chemically synthesized
gagtcggtcagcaggcagaa

SEQ ID NO: 106633 - DNA, 20 bp, Artificial Sequence
  chemically synthesized
ttccagagtcggtcagcagg

SEQ ID NO: 106634 - DNA, 20 bp, Artificial Sequence
  chemically synthesized
aagttccagagtcggtcagc

SEQ ID NO: 106635 - DNA, 20 bp, Artificial Sequence
  chemically synthesized
aaagttccagagtcggtcag

SEQ ID NO: 106636 - DNA, 20 bp, Artificial Sequence
  chemically synthesized
aaaaaagttccagagtcggt

SEQ ID NO: 106637 - DNA, 20 bp, Artificial Sequence
  chemically synthesized
ttctgcctgctgaccgactc

SEQ ID NO: 106638 - DNA, 20 bp, Artificial Sequence
  chemically synthesized
caggaaaaaagttccagagt

SEQ ID NO: 106639 - DNA, 20 bp, Artificial Sequence
  chemically synthesized
catgcaggaaaaaagttcca

SEQ ID NO: 106640 - DNA, 20 bp, Artificial Sequence
  chemically synthesized
gccatgcaggaaaaaagttc

SEQ ID NO: 106641 - DNA, 20 bp, Artificial Sequence
  chemically synthesized
tgcaaagccatgcaggaaaa

SEQ ID NO: 106642 - DNA, 20 bp, Artificial Sequence
  chemically synthesized
tctggaacttttttcctgca

SEQ ID NO: 106643 - DNA, 20 bp, Artificial Sequence
  chemically synthesized
tacgccatgcaaagccatgc

SEQ ID NO: 106644 - DNA, 20 bp, Artificial Sequence
  chemically synthesized
ctacgccatgcaaagccatg

SEQ ID NO: 106645 - DNA, 20 bp, Artificial Sequence
  chemically synthesized
ttttcctgcatggctttgca

SEQ ID NO: 106646 - DNA, 20 bp, Artificial Sequence
  chemically synthesized
agtacatactacgccatgca

SEQ ID NO: 106647 - DNA, 20 bp, Artificial Sequence
  chemically synthesized
ctgcatggctttgcatggcg

SEQ ID NO: 106648 - DNA, 20 bp, Artificial Sequence
  chemically synthesized
gtagtatgtactcttccctt

SEQ ID NO: 106649 - DNA, 20 bp, Artificial Sequence
  chemically synthesized
actcacagttctcaagggaa

SEQ ID NO: 106650 - DNA, 20 bp, Artificial Sequence
  chemically synthesized
ttactcacagttctcaaggg

SEQ ID NO: 106651 - DNA, 20 bp, Artificial Sequence
  chemically synthesized
tgattactcacagttctcaa

SEQ ID NO: 106652 - DNA, 20 bp, Artificial Sequence
  chemically synthesized
ttgattactcacagttctca

SEQ ID NO: 106653 - DNA, 20 bp, Artificial Sequence
  chemically synthesized
tttgattactcacagttctc

SEQ ID NO: 106654 - DNA, 20 bp, Artificial Sequence
  chemically synthesized
actcttcccttgagaactgt

SEQ ID NO: 106655 - DNA, 20 bp, Artificial Sequence
  chemically synthesized
aaaagaagtttgattactca

SEQ ID NO: 106656 - DNA, 20 bp, Artificial Sequence
  chemically synthesized
agtaatcaaacttcttttaa

SEQ ID NO: 106657 - DNA, 20 bp, Artificial Sequence
  chemically synthesized
gagatcaattccattaaaag

SEQ ID NO: 106658 - DNA, 20 bp, Artificial Sequence
  chemically synthesized
agagagatcaattccattaa

SEQ ID NO: 106659 - DNA, 20 bp, Artificial Sequence
  chemically synthesized
tgactgaatgacaatataga

SEQ ID NO: 106660 - DNA, 20 bp, Artificial Sequence
  chemically synthesized
aatgactgaatgacaatata

SEQ ID NO: 106661 - DNA, 20 bp, Artificial Sequence
  chemically synthesized
gaaatgactgaatgacaata

SEQ ID NO: 106662 - DNA, 20 bp, Artificial Sequence
  chemically synthesized
gatctctctatattgtcatt

SEQ ID NO: 106663 - DNA, 20 bp, Artificial Sequence
  chemically synthesized
gtcattcagtcatttctgta

SEQ ID NO: 106664 - DNA, 20 bp, Artificial Sequence
  chemically synthesized
ttgcacagggatttgcttta

SEQ ID NO: 106665 - DNA, 20 bp, Artificial Sequence
  chemically synthesized
cagggtattttagttgcaca

SEQ ID NO: 106666 - DNA, 20 bp, Artificial Sequence
  chemically synthesized
gcagggtattttagttgcac

SEQ ID NO: 106667 - DNA, 20 bp, Artificial Sequence
  chemically synthesized
ggcagggtattttagttgca

SEQ ID NO: 106668 - DNA, 20 bp, Artificial Sequence
  chemically synthesized
ttgggaggggcagggtattt

SEQ ID NO: 106669 - DNA, 20 bp, Artificial Sequence
  chemically synthesized
agattatgttgggaggggca

SEQ ID NO: 106670 - DNA, 20 bp, Artificial Sequence
  chemically synthesized
tagattatgttgggaggggc

SEQ ID NO: 106671 - DNA, 20 bp, Artificial Sequence
  chemically synthesized
ttagattatgttgggagggg

SEQ ID NO: 106672 - DNA, 20 bp, Artificial Sequence
  chemically synthesized
gacttagattatgttgggag

SEQ ID NO: 106673 - DNA, 20 bp, Artificial Sequence
  chemically synthesized
agacttagattatgttggga

SEQ ID NO: 106674 - DNA, 20 bp, Artificial Sequence
  chemically synthesized
aagacttagattatgttggg

SEQ ID NO: 106675 - DNA, 20 bp, Artificial Sequence
  chemically synthesized
caagacttagattatgttgg

SEQ ID NO: 106676 - DNA, 20 bp, Artificial Sequence
  chemically synthesized
cccaagacttagattatgtt

SEQ ID NO: 106677 - DNA, 20 bp, Artificial Sequence
  chemically synthesized
acccaagacttagattatgt

SEQ ID NO: 106678 - DNA, 20 bp, Artificial Sequence
  chemically synthesized
tgcccctcccaacataatct

SEQ ID NO: 106679 - DNA, 20 bp, Artificial Sequence
  chemically synthesized
tcccaacataatctaagtct

SEQ ID NO: 106680 - DNA, 20 bp, Artificial Sequence
  chemically synthesized
cccaacataatctaagtctt

SEQ ID NO: 106681 - DNA, 20 bp, Artificial Sequence
  chemically synthesized
gaagtagggaacccaagact

SEQ ID NO: 106682 - DNA, 20 bp, Artificial Sequence
  chemically synthesized
ttcaccgaagtagggaaccc

SEQ ID NO: 106683 - DNA, 20 bp, Artificial Sequence
  chemically synthesized
aagtcttgggttccctactt

SEQ ID NO: 106684 - DNA, 20 bp, Artificial Sequence
  chemically synthesized
tagaaaccttcaccgaagta

SEQ ID NO: 106685 - DNA, 20 bp, Artificial Sequence
  chemically synthesized
ctagaaaccttcaccgaagt

SEQ ID NO: 106686 - DNA, 20 bp, Artificial Sequence
  chemically synthesized
gctagaaaccttcaccgaag

SEQ ID NO: 106687 - DNA, 20 bp, Artificial Sequence
  chemically synthesized
ttgggttccctacttcggtg

SEQ ID NO: 106688 - DNA, 20 bp, Artificial Sequence
  chemically synthesized
tgggttccctacttcggtga

SEQ ID NO: 106689 - DNA, 20 bp, Artificial Sequence
  chemically synthesized
acagctagaaaccttcaccg

SEQ ID NO: 106690 - DNA, 20 bp, Artificial Sequence
  chemically synthesized
cctacttcggtgaaggtttc

SEQ ID NO: 106691 - DNA, 20 bp, Artificial Sequence
  chemically synthesized
gtttctactttttggacagc

SEQ ID NO: 106692 - DNA, 20 bp, Artificial Sequence
  chemically synthesized
aaggtttctagctgtccaaa

SEQ ID NO: 106693 - DNA, 20 bp, Artificial Sequence
  chemically synthesized
taaagtttctactttttgga

SEQ ID NO: 106694 - DNA, 20 bp, Artificial Sequence
  chemically synthesized
gtttctagctgtccaaaaag

SEQ ID NO: 106695 - DNA, 20 bp, Artificial Sequence
  chemically synthesized
aaagtaaagtttctactttt

SEQ ID NO: 106696 - DNA, 20 bp, Artificial Sequence
  chemically synthesized
atatacaaaaggaaaaagta

SEQ ID NO: 106697 - DNA, 20 bp, Artificial Sequence
  chemically synthesized
gattaatatacaaaaggaaa

SEQ ID NO: 106698 - DNA, 20 bp, Artificial Sequence
  chemically synthesized
gtaatggattaatatacaaa

SEQ ID NO: 106699 - DNA, 20 bp, Artificial Sequence
  chemically synthesized
agtaatggattaatatacaa

SEQ ID NO: 106700 - DNA, 20 bp, Artificial Sequence
  chemically synthesized
tttgtatattaatccattac

SEQ ID NO: 106701 - DNA, 20 bp, Artificial Sequence
  chemically synthesized
tagactttgctatctagtaa

SEQ ID NO: 106702 - DNA, 20 bp, Artificial Sequence
  chemically synthesized
tatattaatccattactaga

SEQ ID NO: 106703 - DNA, 20 bp, Artificial Sequence
  chemically synthesized
taatccattactagatagca

SEQ ID NO: 106704 - DNA, 20 bp, Artificial Sequence
  chemically synthesized
aaaacatagactttgctatc

SEQ ID NO: 106705 - DNA, 20 bp, Artificial Sequence
  chemically synthesized
gaaaaaaaaaaaaaaaaaca

SEQ ID NO: 106706 - DNA, 20 bp, Artificial Sequence
  chemically synthesized
tttttttttttttttcaact

SEQ ID NO: 106707 - DNA, 20 bp, Artificial Sequence
  chemically synthesized
gaaagaggttaatagattcc

SEQ ID NO: 106708 - DNA, 20 bp, Artificial Sequence
  chemically synthesized
aagtgggggaaagaggttaa

SEQ ID NO: 106709 - DNA, 20 bp, Artificial Sequence
  chemically synthesized
ttggtataagtgggggaaag

SEQ ID NO: 106710 - DNA, 20 bp, Artificial Sequence
  chemically synthesized
attggtataagtgggggaaa

SEQ ID NO: 106711 - DNA, 20 bp, Artificial Sequence
  chemically synthesized
gtattggtataagtggggga

SEQ ID NO: 106712 - DNA, 20 bp, Artificial Sequence
  chemically synthesized
tggagtattggtataagtgg

SEQ ID NO: 106713 - DNA, 20 bp, Artificial Sequence
  chemically synthesized
ctggagtattggtataagtg

SEQ ID NO: 106714 - DNA, 20 bp, Artificial Sequence
  chemically synthesized
actggagtattggtataagt

SEQ ID NO: 106715 - DNA, 20 bp, Artificial Sequence
  chemically synthesized
aactggagtattggtataag

SEQ ID NO: 106716 - DNA, 20 bp, Artificial Sequence
  chemically synthesized
ttaaactggagtattggtat

SEQ ID NO: 106717 - DNA, 20 bp, Artificial Sequence
  chemically synthesized
ccccacttataccaatactc

SEQ ID NO: 106718 - DNA, 20 bp, Artificial Sequence
  chemically synthesized
ggtggcttaaactggagtat

SEQ ID NO: 106719 - DNA, 20 bp, Artificial Sequence
  chemically synthesized
ttataccaatactccagttt

SEQ ID NO: 106720 - DNA, 20 bp, Artificial Sequence
  chemically synthesized
cacactggtggcttaaactg

SEQ ID NO: 106721 - DNA, 20 bp, Artificial Sequence
  chemically synthesized
aacacactggtggcttaaac

SEQ ID NO: 106722 - DNA, 20 bp, Artificial Sequence
  chemically synthesized
aatactccagtttaagccac

SEQ ID NO: 106723 - DNA, 20 bp, Artificial Sequence
  chemically synthesized
agcccagttgaacacactgg

SEQ ID NO: 106724 - DNA, 20 bp, Artificial Sequence
  chemically synthesized
tgaagcccagttgaacacac

SEQ ID NO: 106725 - DNA, 20 bp, Artificial Sequence
  chemically synthesized
aagccaccagtgtgttcaac

SEQ ID NO: 106726 - DNA, 20 bp, Artificial Sequence
  chemically synthesized
agccaccagtgtgttcaact

SEQ ID NO: 106727 - DNA, 20 bp, Artificial Sequence
  chemically synthesized
ttcgttaagttattgaagcc

SEQ ID NO: 106728 - DNA, 20 bp, Artificial Sequence
  chemically synthesized
tatccttcgttaagttattg

SEQ ID NO: 106729 - DNA, 20 bp, Artificial Sequence
  chemically synthesized
tgggcttcaataacttaacg

SEQ ID NO: 106730 - DNA, 20 bp, Artificial Sequence
  chemically synthesized
gggcttcaataacttaacga

SEQ ID NO: 106731 - DNA, 20 bp, Artificial Sequence
  chemically synthesized
aggcaaaaatatccttcgtt

SEQ ID NO: 106732 - DNA, 20 bp, Artificial Sequence
  chemically synthesized
aacgaaggatatttttgcct

SEQ ID NO: 106733 - DNA, 20 bp, Artificial Sequence
  chemically synthesized
gaaatgaagggcataaactg

SEQ ID NO: 106734 - DNA, 20 bp, Artificial Sequence
  chemically synthesized
tgaaatgaagggcataaact

SEQ ID NO: 106735 - DNA, 20 bp, Artificial Sequence
  chemically synthesized
gtaaattggattgaaatgaa

SEQ ID NO: 106736 - DNA, 20 bp, Artificial Sequence
  chemically synthesized
ggtaaattggattgaaatga

SEQ ID NO: 106737 - DNA, 20 bp, Artificial Sequence
  chemically synthesized
aggtaaattggattgaaatg

SEQ ID NO: 106738 - DNA, 20 bp, Artificial Sequence
  chemically synthesized
cttcatttaaaaaggtaaat

SEQ ID NO: 106739 - DNA, 20 bp, Artificial Sequence
  chemically synthesized
aggagtgacttcatttaaaa

SEQ ID NO: 106740 - DNA, 20 bp, Artificial Sequence
  chemically synthesized
gaggagtgacttcatttaaa

SEQ ID NO: 106741 - DNA, 20 bp, Artificial Sequence
  chemically synthesized
ccaatttacctttttaaatg

SEQ ID NO: 106742 - DNA, 20 bp, Artificial Sequence
  chemically synthesized
aggttctgtgttaagcagag

SEQ ID NO: 106743 - DNA, 20 bp, Artificial Sequence
  chemically synthesized
aaaggttctgtgttaagcag

SEQ ID NO: 106744 - DNA, 20 bp, Artificial Sequence
  chemically synthesized
taaaggttctgtgttaagca

SEQ ID NO: 106745 - DNA, 20 bp, Artificial Sequence
  chemically synthesized
agtcactcctctgcttaaca

SEQ ID NO: 106746 - DNA, 20 bp, Artificial Sequence
  chemically synthesized
actaaaggttctgtgttaag

SEQ ID NO: 106747 - DNA, 20 bp, Artificial Sequence
  chemically synthesized
accactaaaggttctgtgtt

SEQ ID NO: 106748 - DNA, 20 bp, Artificial Sequence
  chemically synthesized
tctgcttaacacagaacctt

SEQ ID NO: 106749 - DNA, 20 bp, Artificial Sequence
  chemically synthesized
gcttaacacagaacctttag

SEQ ID NO: 106750 - DNA, 20 bp, Artificial Sequence
  chemically synthesized
acaatggtaaaaaccactaa

SEQ ID NO: 106751 - DNA, 20 bp, Artificial Sequence
  chemically synthesized
gacaatggtaaaaaccacta

SEQ ID NO: 106752 - DNA, 20 bp, Artificial Sequence
  chemically synthesized
tttttttacttgcatgacaa

SEQ ID NO: 106753 - DNA, 20 bp, Artificial Sequence
  chemically synthesized
ggtttttaccattgtcatgc

SEQ ID NO: 106754 - DNA, 20 bp, Artificial Sequence
  chemically synthesized
gctagaaagttagtaagggt

SEQ ID NO: 106755 - DNA, 20 bp, Artificial Sequence
  chemically synthesized
tgaagctagaaagttagtaa

SEQ ID NO: 106756 - DNA, 20 bp, Artificial Sequence
  chemically synthesized
atgaagctagaaagttagta

SEQ ID NO: 106757 - DNA, 20 bp, Artificial Sequence
  chemically synthesized
gatgaagctagaaagttagt

SEQ ID NO: 106758 - DNA, 20 bp, Artificial Sequence
  chemically synthesized
tctgacccttactaactttc

SEQ ID NO: 106759 - DNA, 20 bp, Artificial Sequence
  chemically synthesized
gagagatgaagctagaaagt

SEQ ID NO: 106760 - DNA, 20 bp, Artificial Sequence
  chemically synthesized
ttgggagagatgaagctaga

SEQ ID NO: 106761 - DNA, 20 bp, Artificial Sequence
  chemically synthesized
tgaattgggagagatgaagc

SEQ ID NO: 106762 - DNA, 20 bp, Artificial Sequence
  chemically synthesized
agtttgaattgggagagatg

SEQ ID NO: 106763 - DNA, 20 bp, Artificial Sequence
  chemically synthesized
acctagagtttgaattggga

SEQ ID NO: 106764 - DNA, 20 bp, Artificial Sequence
  chemically synthesized
aaacctagagtttgaattgg

SEQ ID NO: 106765 - DNA, 20 bp, Artificial Sequence
  chemically synthesized
gtaaacctagagtttgaatt

SEQ ID NO: 106766 - DNA, 20 bp, Artificial Sequence
  chemically synthesized
ggtaaacctagagtttgaat

SEQ ID NO: 106767 - DNA, 20 bp, Artificial Sequence
  chemically synthesized
atctctcccaattcaaactc

SEQ ID NO: 106768 - DNA, 20 bp, Artificial Sequence
  chemically synthesized
tctctcccaattcaaactct

SEQ ID NO: 106769 - DNA, 20 bp, Artificial Sequence
  chemically synthesized
attgctgcttggtaaaccta

SEQ ID NO: 106770 - DNA, 20 bp, Artificial Sequence
  chemically synthesized
ggattgctgcttggtaaacc

SEQ ID NO: 106771 - DNA, 20 bp, Artificial Sequence
  chemically synthesized
attcaaactctaggtttacc

SEQ ID NO: 106772 - DNA, 20 bp, Artificial Sequence
  chemically synthesized
caaactctaggtttaccaag

SEQ ID NO: 106773 - DNA, 20 bp, Artificial Sequence
  chemically synthesized
attttgagaggattgctgct

SEQ ID NO: 106774 - DNA, 20 bp, Artificial Sequence
  chemically synthesized
catgggaaagtgattttgag

SEQ ID NO: 106775 - DNA, 20 bp, Artificial Sequence
  chemically synthesized
tcatgggaaagtgattttga

SEQ ID NO: 106776 - DNA, 20 bp, Artificial Sequence
  chemically synthesized
agtcatgggaaagtgatttt

SEQ ID NO: 106777 - DNA, 20 bp, Artificial Sequence
  chemically synthesized
acaagtctgaagtcatggga

SEQ ID NO: 106778 - DNA, 20 bp, Artificial Sequence
  chemically synthesized
aaatcactttcccatgactt

SEQ ID NO: 106779 - DNA, 20 bp, Artificial Sequence
  chemically synthesized
gtgcacaagtctgaagtcat

SEQ ID NO: 106780 - DNA, 20 bp, Artificial Sequence
  chemically synthesized
tgtgcacaagtctgaagtca

SEQ ID NO: 106781 - DNA, 20 bp, Artificial Sequence
  chemically synthesized
acatactgtgcacaagtctg

SEQ ID NO: 106782 - DNA, 20 bp, Artificial Sequence
  chemically synthesized
catgacttcagacttgtgca

SEQ ID NO: 106783 - DNA, 20 bp, Artificial Sequence
  chemically synthesized
ccaggcaacatactgtgcac

SEQ ID NO: 106784 - DNA, 20 bp, Artificial Sequence
  chemically synthesized
cttgtgcacagtatgttgcc

SEQ ID NO: 106785 - DNA, 20 bp, Artificial Sequence
  chemically synthesized
gcacagtatgttgcctggct

SEQ ID NO: 106786 - DNA, 20 bp, Artificial Sequence
  chemically synthesized
acagtatgttgcctggctta

SEQ ID NO: 106787 - DNA, 20 bp, Artificial Sequence
  chemically synthesized
tgaggagtattctctaagcc

SEQ ID NO: 106788 - DNA, 20 bp, Artificial Sequence
  chemically synthesized
atgaggagtattctctaagc

SEQ ID NO: 106789 - DNA, 20 bp, Artificial Sequence
  chemically synthesized
aaacatgaggagtattctct

SEQ ID NO: 106790 - DNA, 20 bp, Artificial Sequence
  chemically synthesized
tagggggaaggaaacatgag

SEQ ID NO: 106791 - DNA, 20 bp, Artificial Sequence
  chemically synthesized
ggtagggggaaggaaacatg

SEQ ID NO: 106792 - DNA, 20 bp, Artificial Sequence
  chemically synthesized
aggtagggggaaggaaacat

SEQ ID NO: 106793 - DNA, 20 bp, Artificial Sequence
  chemically synthesized
gggttggtcaggtaggggga

SEQ ID NO: 106794 - DNA, 20 bp, Artificial Sequence
  chemically synthesized
tgggttggtcaggtaggggg

SEQ ID NO: 106795 - DNA, 20 bp, Artificial Sequence
  chemically synthesized
agatgggttggtcaggtagg

SEQ ID NO: 106796 - DNA, 20 bp, Artificial Sequence
  chemically synthesized
gagatgggttggtcaggtag

SEQ ID NO: 106797 - DNA, 20 bp, Artificial Sequence
  chemically synthesized
agagatgggttggtcaggta

SEQ ID NO: 106798 - DNA, 20 bp, Artificial Sequence
  chemically synthesized
aagagatgggttggtcaggt

SEQ ID NO: 106799 - DNA, 20 bp, Artificial Sequence
  chemically synthesized
taagagatgggttggtcagg

SEQ ID NO: 106800 - DNA, 20 bp, Artificial Sequence
  chemically synthesized
acctaagagatgggttggtc

SEQ ID NO: 106801 - DNA, 20 bp, Artificial Sequence
  chemically synthesized
gacctaagagatgggttggt

SEQ ID NO: 106802 - DNA, 20 bp, Artificial Sequence
  chemically synthesized
tggagacctaagagatgggt

SEQ ID NO: 106803 - DNA, 20 bp, Artificial Sequence
  chemically synthesized
tacctgaccaacccatctct

SEQ ID NO: 106804 - DNA, 20 bp, Artificial Sequence
  chemically synthesized
acctgaccaacccatctctt

SEQ ID NO: 106805 - DNA, 20 bp, Artificial Sequence
  chemically synthesized
taaatggagacctaagagat

SEQ ID NO: 106806 - DNA, 20 bp, Artificial Sequence
  chemically synthesized
ctaaatggagacctaagaga

SEQ ID NO: 106807 - DNA, 20 bp, Artificial Sequence
  chemically synthesized
acatctaaatggagacctaa

SEQ ID NO: 106808 - DNA, 20 bp, Artificial Sequence
  chemically synthesized
tgacatctaaatggagacct

SEQ ID NO: 106809 - DNA, 20 bp, Artificial Sequence
  chemically synthesized
ccatctcttaggtctccatt

SEQ ID NO: 106810 - DNA, 20 bp, Artificial Sequence
  chemically synthesized
ctcctcctgacatctaaatg

SEQ ID NO: 106811 - DNA, 20 bp, Artificial Sequence
  chemically synthesized
ggctcctcctgacatctaaa

SEQ ID NO: 106812 - DNA, 20 bp, Artificial Sequence
  chemically synthesized
ttaggtctccatttagatgt

SEQ ID NO: 106813 - DNA, 20 bp, Artificial Sequence
  chemically synthesized
taggtctccatttagatgtc

SEQ ID NO: 106814 - DNA, 20 bp, Artificial Sequence
  chemically synthesized
ggtctccatttagatgtcag

SEQ ID NO: 106815 - DNA, 20 bp, Artificial Sequence
  chemically synthesized
gtctccatttagatgtcagg

SEQ ID NO: 106816 - DNA, 20 bp, Artificial Sequence
  chemically synthesized
ctccatttagatgtcaggag

SEQ ID NO: 106817 - DNA, 20 bp, Artificial Sequence
  chemically synthesized
gagcctgaaggcatgaagaa

SEQ ID NO: 106818 - DNA, 20 bp, Artificial Sequence
  chemically synthesized
tgagcctgaaggcatgaaga

SEQ ID NO: 106819 - DNA, 20 bp, Artificial Sequence
  chemically synthesized
tagctgagcctgaaggcatg

SEQ ID NO: 106820 - DNA, 20 bp, Artificial Sequence
  chemically synthesized
ggagcctttcttcatgcctt

SEQ ID NO: 106821 - DNA, 20 bp, Artificial Sequence
  chemically synthesized
gagcctttcttcatgccttc

SEQ ID NO: 106822 - DNA, 20 bp, Artificial Sequence
  chemically synthesized
tttcttcatgccttcaggct

SEQ ID NO: 106823 - DNA, 20 bp, Artificial Sequence
  chemically synthesized
gatagaatagctgagcctga

SEQ ID NO: 106824 - DNA, 20 bp, Artificial Sequence
  chemically synthesized
tgatagaatagctgagcctg

SEQ ID NO: 106825 - DNA, 20 bp, Artificial Sequence
  chemically synthesized
cccggaatgatagaatagct

SEQ ID NO: 106826 - DNA, 20 bp, Artificial Sequence
  chemically synthesized
tagaacccggaatgatagaa

SEQ ID NO: 106827 - DNA, 20 bp, Artificial Sequence
  chemically synthesized
gctcagctattctatcattc

SEQ ID NO: 106828 - DNA, 20 bp, Artificial Sequence
  chemically synthesized
ctcagctattctatcattcc

SEQ ID NO: 106829 - DNA, 20 bp, Artificial Sequence
  chemically synthesized
taggatagaacccggaatga

SEQ ID NO: 106830 - DNA, 20 bp, Artificial Sequence
  chemically synthesized
aaatgggataggatagaacc

SEQ ID NO: 106831 - DNA, 20 bp, Artificial Sequence
  chemically synthesized
tagcaggaaatgggatagga

SEQ ID NO: 106832 - DNA, 20 bp, Artificial Sequence
  chemically synthesized
gagatagcaggaaatgggat

SEQ ID NO: 106833 - DNA, 20 bp, Artificial Sequence
  chemically synthesized
ggagatagcaggaaatggga

SEQ ID NO: 106834 - DNA, 20 bp, Artificial Sequence
  chemically synthesized
tcagggagatagcaggaaat

SEQ ID NO: 106835 - DNA, 20 bp, Artificial Sequence
  chemically synthesized
gtcagggagatagcaggaaa

SEQ ID NO: 106836 - DNA, 20 bp, Artificial Sequence
  chemically synthesized
caataagtcagggagatagc

SEQ ID NO: 106837 - DNA, 20 bp, Artificial Sequence
  chemically synthesized
ccaataagtcagggagatag

SEQ ID NO: 106838 - DNA, 20 bp, Artificial Sequence
  chemically synthesized
cccccaataagtcagggaga

SEQ ID NO: 106839 - DNA, 20 bp, Artificial Sequence
  chemically synthesized
aggacccccaataagtcagg

SEQ ID NO: 106840 - DNA, 20 bp, Artificial Sequence
  chemically synthesized
ataggacccccaataagtca

SEQ ID NO: 106841 - DNA, 20 bp, Artificial Sequence
  chemically synthesized
ctgctatctccctgacttat

SEQ ID NO: 106842 - DNA, 20 bp, Artificial Sequence
  chemically synthesized
aataggacccccaataagtc

SEQ ID NO: 106843 - DNA, 20 bp, Artificial Sequence
  chemically synthesized
tgctatctccctgacttatt

SEQ ID NO: 106844 - DNA, 20 bp, Artificial Sequence
  chemically synthesized
aaataggacccccaataagt

SEQ ID NO: 106845 - DNA, 20 bp, Artificial Sequence
  chemically synthesized
gctatctccctgacttattg

SEQ ID NO: 106846 - DNA, 20 bp, Artificial Sequence
  chemically synthesized
ctatctccctgacttattgg

SEQ ID NO: 106847 - DNA, 20 bp, Artificial Sequence
  chemically synthesized
acagaaataggacccccaat

SEQ ID NO: 106848 - DNA, 20 bp, Artificial Sequence
  chemically synthesized
ttgctgattttgacagaaat

SEQ ID NO: 106849 - DNA, 20 bp, Artificial Sequence
  chemically synthesized
tttgctgattttgacagaaa

SEQ ID NO: 106850 - DNA, 20 bp, Artificial Sequence
  chemically synthesized
ggtcctatttctgtcaaaat

SEQ ID NO: 106851 - DNA, 20 bp, Artificial Sequence
  chemically synthesized
ctttcctttgctgattttga

SEQ ID NO: 106852 - DNA, 20 bp, Artificial Sequence
  chemically synthesized
tatttctgtcaaaatcagca

SEQ ID NO: 106853 - DNA, 20 bp, Artificial Sequence
  chemically synthesized
atttctgtcaaaatcagcaa

SEQ ID NO: 106854 - DNA, 20 bp, Artificial Sequence
  chemically synthesized
ctgtcaaaatcagcaaagga

SEQ ID NO: 106855 - DNA, 20 bp, Artificial Sequence
  chemically synthesized
tcaaaatcagcaaaggaaag

SEQ ID NO: 106856 - DNA, 20 bp, Artificial Sequence
  chemically synthesized
caaaatcagcaaaggaaagc

SEQ ID NO: 106857 - DNA, 20 bp, Artificial Sequence
  chemically synthesized
aatcagcaaaggaaagcggg

SEQ ID NO: 106858 - DNA, 20 bp, Artificial Sequence
  chemically synthesized
atcagcaaaggaaagcgggt

SEQ ID NO: 106859 - DNA, 20 bp, Artificial Sequence
  chemically synthesized
tcagcaaaggaaagcgggta

SEQ ID NO: 106860 - DNA, 20 bp, Artificial Sequence
  chemically synthesized
cagcaaaggaaagcgggtag

SEQ ID NO: 106861 - DNA, 20 bp, Artificial Sequence
  chemically synthesized
aaaggaaagcgggtaggggt

SEQ ID NO: 106862 - DNA, 20 bp, Artificial Sequence
  chemically synthesized
aaggaaagcgggtaggggtt

SEQ ID NO: 106863 - DNA, 20 bp, Artificial Sequence
  chemically synthesized
aggaaagcgggtaggggtta

SEQ ID NO: 106864 - DNA, 20 bp, Artificial Sequence
  chemically synthesized
ggaaagcgggtaggggttag

SEQ ID NO: 106865 - DNA, 20 bp, Artificial Sequence
  chemically synthesized
aagcgggtaggggttagggg

SEQ ID NO: 106866 - DNA, 20 bp, Artificial Sequence
  chemically synthesized
cgggtaggggttaggggaag

SEQ ID NO: 106867 - DNA, 20 bp, Artificial Sequence
  chemically synthesized
gggtaggggttaggggaaga

SEQ ID NO: 106868 - DNA, 20 bp, Artificial Sequence
  chemically synthesized
gggttaggggaagaaggaac

SEQ ID NO: 106869 - DNA, 20 bp, Artificial Sequence
  chemically synthesized
ggttaggggaagaaggaact

SEQ ID NO: 106870 - DNA, 20 bp, Artificial Sequence
  chemically synthesized
gttaggggaagaaggaactg

SEQ ID NO: 106871 - DNA, 20 bp, Artificial Sequence
  chemically synthesized
ttaggggaagaaggaactgg

SEQ ID NO: 106872 - DNA, 20 bp, Artificial Sequence
  chemically synthesized
gggaagaaggaactgggggt

SEQ ID NO: 106873 - DNA, 20 bp, Artificial Sequence
  chemically synthesized
attgtcttccttctcacccc

SEQ ID NO: 106874 - DNA, 20 bp, Artificial Sequence
  chemically synthesized
aagaaggaactgggggtgag

SEQ ID NO: 106875 - DNA, 20 bp, Artificial Sequence
  chemically synthesized
agaaggaactgggggtgaga

SEQ ID NO: 106876 - DNA, 20 bp, Artificial Sequence
  chemically synthesized
aggaactgggggtgagaagg

SEQ ID NO: 106877 - DNA, 20 bp, Artificial Sequence
  chemically synthesized
agaaggaagacaatatgcat

SEQ ID NO: 106878 - DNA, 20 bp, Artificial Sequence
  chemically synthesized
gaaggaagacaatatgcatc

SEQ ID NO: 106879 - DNA, 20 bp, Artificial Sequence
  chemically synthesized
agacaatatgcatcaggata

SEQ ID NO: 106880 - DNA, 20 bp, Artificial Sequence
  chemically synthesized
gacaatatgcatcaggataa

SEQ ID NO: 106881 - DNA, 20 bp, Artificial Sequence
  chemically synthesized
atgcatcaggataaaggaat

SEQ ID NO: 106882 - DNA, 20 bp, Artificial Sequence
  chemically synthesized
aggataaaggaatgagctgt

SEQ ID NO: 106883 - DNA, 20 bp, Artificial Sequence
  chemically synthesized
gtttcaactaagaatgccaa

SEQ ID NO: 106884 - DNA, 20 bp, Artificial Sequence
  chemically synthesized
gaatgagctgttggcattct

SEQ ID NO: 106885 - DNA, 20 bp, Artificial Sequence
  chemically synthesized
atgccttcagagtttcaact

SEQ ID NO: 106886 - DNA, 20 bp, Artificial Sequence
  chemically synthesized
cattcttagttgaaactctg

SEQ ID NO: 106887 - DNA, 20 bp, Artificial Sequence
  chemically synthesized
attcttagttgaaactctga

SEQ ID NO: 106888 - DNA, 20 bp, Artificial Sequence
  chemically synthesized
actcatggaaaatgccttca

SEQ ID NO: 106889 - DNA, 20 bp, Artificial Sequence
  chemically synthesized
acactcatggaaaatgcctt

SEQ ID NO: 106890 - DNA, 20 bp, Artificial Sequence
  chemically synthesized
actctgaaggcattttccat

SEQ ID NO: 106891 - DNA, 20 bp, Artificial Sequence
  chemically synthesized
gattatagcgtttacactca

SEQ ID NO: 106892 - DNA, 20 bp, Artificial Sequence
  chemically synthesized
gtgatctgtgaaagtgatta

SEQ ID NO: 106893 - DNA, 20 bp, Artificial Sequence
  chemically synthesized
aaacgctataatcactttca

SEQ ID NO: 106894 - DNA, 20 bp, Artificial Sequence
  chemically synthesized
tttttgaaggtgatctgtga

SEQ ID NO: 106895 - DNA, 20 bp, Artificial Sequence
  chemically synthesized
aaacatggcagtatttttga

SEQ ID NO: 106896 - DNA, 20 bp, Artificial Sequence
  chemically synthesized
caaacatggcagtatttttg

SEQ ID NO: 106897 - DNA, 20 bp, Artificial Sequence
  chemically synthesized
aaataagaggtcaaacatgg

SEQ ID NO: 106898 - DNA, 20 bp, Artificial Sequence
  chemically synthesized
actaaataagaggtcaaaca

SEQ ID NO: 106899 - DNA, 20 bp, Artificial Sequence
  chemically synthesized
gccatgtttgacctcttatt

SEQ ID NO: 106900 - DNA, 20 bp, Artificial Sequence
  chemically synthesized
aacaatgtcaactaaataag

SEQ ID NO: 106901 - DNA, 20 bp, Artificial Sequence
  chemically synthesized
taacaatgtcaactaaataa

SEQ ID NO: 106902 - DNA, 20 bp, Artificial Sequence
  chemically synthesized
gataacaatgtcaactaaat

SEQ ID NO: 106903 - DNA, 20 bp, Artificial Sequence
  chemically synthesized
atttagttgacattgttatc

SEQ ID NO: 106904 - DNA, 20 bp, Artificial Sequence
  chemically synthesized
tgggtcaataaatgtcaatc

SEQ ID NO: 106905 - DNA, 20 bp, Artificial Sequence
  chemically synthesized
gagactaagtaaaacaaaat

SEQ ID NO: 106906 - DNA, 20 bp, Artificial Sequence
  chemically synthesized
tgagactaagtaaaacaaaa

SEQ ID NO: 106907 - DNA, 20 bp, Artificial Sequence
  chemically synthesized
ttgacccattttgttttact

SEQ ID NO: 106908 - DNA, 20 bp, Artificial Sequence
  chemically synthesized
tcattgcttacattgagact

SEQ ID NO: 106909 - DNA, 20 bp, Artificial Sequence
  chemically synthesized
gttttacttagtctcaatgt

SEQ ID NO: 106910 - DNA, 20 bp, Artificial Sequence
  chemically synthesized
aagatatcattgcttacatt

SEQ ID NO: 106911 - DNA, 20 bp, Artificial Sequence
  chemically synthesized
tactataaacagttgatttt

SEQ ID NO: 106912 - DNA, 20 bp, Artificial Sequence
  chemically synthesized
atcttaaaatcaactgttta

SEQ ID NO: 106913 - DNA, 20 bp, Artificial Sequence
  chemically synthesized
aatatagccggtactataaa

SEQ ID NO: 106914 - DNA, 20 bp, Artificial Sequence
  chemically synthesized
aaatcaactgtttatagtac

SEQ ID NO: 106915 - DNA, 20 bp, Artificial Sequence
  chemically synthesized
gtgttttaggcaaatatagc

SEQ ID NO: 106916 - DNA, 20 bp, Artificial Sequence
  chemically synthesized
taatgtgttttaggcaaata

SEQ ID NO: 106917 - DNA, 20 bp, Artificial Sequence
  chemically synthesized
taatctatttaatgtgtttt

SEQ ID NO: 106918 - DNA, 20 bp, Artificial Sequence
  chemically synthesized
ttaatctatttaatgtgttt

SEQ ID NO: 106919 - DNA, 20 bp, Artificial Sequence
  chemically synthesized
tttgcctaaaacacattaaa

SEQ ID NO: 106920 - DNA, 20 bp, Artificial Sequence
  chemically synthesized
ttaaattaaattcacataat

SEQ ID NO: 106921 - DNA, 20 bp, Artificial Sequence
  chemically synthesized
tcacataattagaattttat

SEQ ID NO: 106922 - DNA, 20 bp, Artificial Sequence
  chemically synthesized
acataattagaattttatga

SEQ ID NO: 106923 - DNA, 20 bp, Artificial Sequence
  chemically synthesized
aattagaattttatgagagt

SEQ ID NO: 106924 - DNA, 20 bp, Artificial Sequence
  chemically synthesized
gagagtgagaaattacttaa

SEQ ID NO: 106925 - DNA, 20 bp, Artificial Sequence
  chemically synthesized
agagtgagaaattacttaat

SEQ ID NO: 106926 - DNA, 20 bp, Artificial Sequence
  chemically synthesized
taagatgcattgtacccatt

SEQ ID NO: 106927 - DNA, 20 bp, Artificial Sequence
  chemically synthesized
tgggtacaatgcatcttatt

SEQ ID NO: 106928 - DNA, 20 bp, Artificial Sequence
  chemically synthesized
gggtacaatgcatcttatta

SEQ ID NO: 106929 - DNA, 20 bp, Artificial Sequence
  chemically synthesized
agggtatccatcaccttaat

SEQ ID NO: 106930 - DNA, 20 bp, Artificial Sequence
  chemically synthesized
aatgcatcttattaaggtga

SEQ ID NO: 106931 - DNA, 20 bp, Artificial Sequence
  chemically synthesized
taaggtgatggataccctaa

SEQ ID NO: 106932 - DNA, 20 bp, Artificial Sequence
  chemically synthesized
aaggtgatggataccctaaa

SEQ ID NO: 106933 - DNA, 20 bp, Artificial Sequence
  chemically synthesized
tggtcacgtcaggcctttta

SEQ ID NO: 106934 - DNA, 20 bp, Artificial Sequence
  chemically synthesized
atggtcacgtcaggcctttt

SEQ ID NO: 106935 - DNA, 20 bp, Artificial Sequence
  chemically synthesized
aatggtcacgtcaggccttt

SEQ ID NO: 106936 - DNA, 20 bp, Artificial Sequence
  chemically synthesized
gattgtgtaatggtcacgtc

SEQ ID NO: 106937 - DNA, 20 bp, Artificial Sequence
  chemically synthesized
agattgtgtaatggtcacgt

SEQ ID NO: 106938 - DNA, 20 bp, Artificial Sequence
  chemically synthesized
tacatgcatagattgtgtaa

SEQ ID NO: 106939 - DNA, 20 bp, Artificial Sequence
  chemically synthesized
gtataattttgttacatgca

SEQ ID NO: 106940 - DNA, 20 bp, Artificial Sequence
  chemically synthesized
tatataaatttatgaggtac

SEQ ID NO: 106941 - DNA, 20 bp, Artificial Sequence
  chemically synthesized
tttatttatataaatttatg

SEQ ID NO: 106942 - DNA, 20 bp, Artificial Sequence
  chemically synthesized
ttttatttatataaatttat

SEQ ID NO: 106943 - DNA, 20 bp, Artificial Sequence
  chemically synthesized
tatttattttgggaggcatt

SEQ ID NO: 106944 - DNA, 20 bp, Artificial Sequence
  chemically synthesized
aattatgtatttattttggg

SEQ ID NO: 106945 - DNA, 20 bp, Artificial Sequence
  chemically synthesized
caattatgtatttattttgg

SEQ ID NO: 106946 - DNA, 20 bp, Artificial Sequence
  chemically synthesized
gacaattatgtatttatttt

SEQ ID NO: 106947 - DNA, 20 bp, Artificial Sequence
  chemically synthesized
tgacaattatgtatttattt

SEQ ID NO: 106948 - DNA, 20 bp, Artificial Sequence
  chemically synthesized
caaaataaatacataattgt

SEQ ID NO: 106949 - DNA, 20 bp, Artificial Sequence
  chemically synthesized
aaataaatacataattgtca

SEQ ID NO: 106950 - DNA, 20 bp, Artificial Sequence
  chemically synthesized
ataattgtcagagtttgtaa

SEQ ID NO: 106951 - DNA, 20 bp, Artificial Sequence
  chemically synthesized
tcagagtttgtaaaagtatc

SEQ ID NO: 106952 - DNA, 20 bp, Artificial Sequence
  chemically synthesized
gaatattattacatggcaca

SEQ ID NO: 106953 - DNA, 20 bp, Artificial Sequence
  chemically synthesized
gaaaatggaatattattaca

SEQ ID NO: 106954 - DNA, 20 bp, Artificial Sequence
  chemically synthesized
tcccactggaagaatgaaaa

SEQ ID NO: 106955 - DNA, 20 bp, Artificial Sequence
  chemically synthesized
atattccattttcattcttc

SEQ ID NO: 106956 - DNA, 20 bp, Artificial Sequence
  chemically synthesized
ttccattttcattcttccag

SEQ ID NO: 106957 - DNA, 20 bp, Artificial Sequence
  chemically synthesized
tccattttcattcttccagt

SEQ ID NO: 106958 - DNA, 20 bp, Artificial Sequence
  chemically synthesized
tattgtttacttcccactgg

SEQ ID NO: 106959 - DNA, 20 bp, Artificial Sequence
  chemically synthesized
attttcattcttccagtggg

SEQ ID NO: 106960 - DNA, 20 bp, Artificial Sequence
  chemically synthesized
ccttattgtttacttcccac

SEQ ID NO: 106961 - DNA, 20 bp, Artificial Sequence
  chemically synthesized
tccagtgggaagtaaacaat

SEQ ID NO: 106962 - DNA, 20 bp, Artificial Sequence
  chemically synthesized
ccagtgggaagtaaacaata

SEQ ID NO: 106963 - DNA, 20 bp, Artificial Sequence
  chemically synthesized
cagtgggaagtaaacaataa

SEQ ID NO: 106964 - DNA, 20 bp, Artificial Sequence
  chemically synthesized
aaacaataagggaaaaatta

SEQ ID NO: 106965 - DNA, 20 bp, Artificial Sequence
  chemically synthesized
aagggaaaaattatagatga

SEQ ID NO: 106966 - DNA, 20 bp, Artificial Sequence
  chemically synthesized
tagatgacagataatgtata

SEQ ID NO: 106967 - DNA, 20 bp, Artificial Sequence
  chemically synthesized
agatgacagataatgtatat

SEQ ID NO: 106968 - DNA, 20 bp, Artificial Sequence
  chemically synthesized
aggtatgtcataaattgaat

SEQ ID NO: 106969 - DNA, 20 bp, Artificial Sequence
  chemically synthesized
tgtcataaattgaattagcc

SEQ ID NO: 106970 - DNA, 20 bp, Artificial Sequence
  chemically synthesized
gtcataaattgaattagcct

SEQ ID NO: 106971 - DNA, 20 bp, Artificial Sequence
  chemically synthesized
taaattataattaatttcct

SEQ ID NO: 106972 - DNA, 20 bp, Artificial Sequence
  chemically synthesized
ataaattataattaatttcc

SEQ ID NO: 106973 - DNA, 20 bp, Artificial Sequence
  chemically synthesized
ataatttatatttctccctg

SEQ ID NO: 106974 - DNA, 20 bp, Artificial Sequence
  chemically synthesized
tgaaatacatttgccacagg

SEQ ID NO: 106975 - DNA, 20 bp, Artificial Sequence
  chemically synthesized
tttgaaatacatttgccaca

SEQ ID NO: 106976 - DNA, 20 bp, Artificial Sequence
  chemically synthesized
atttgaaatacatttgccac

SEQ ID NO: 106977 - DNA, 20 bp, Artificial Sequence
  chemically synthesized
tatttgaaatacatttgcca

SEQ ID NO: 106978 - DNA, 20 bp, Artificial Sequence
  chemically synthesized
tagtttacaattaagatgtg

SEQ ID NO: 106979 - DNA, 20 bp, Artificial Sequence
  chemically synthesized
tttttacttagtttacaatt

SEQ ID NO: 106980 - DNA, 20 bp, Artificial Sequence
  chemically synthesized
acacatcttaattgtaaact

SEQ ID NO: 106981 - DNA, 20 bp, Artificial Sequence
  chemically synthesized
agtagtcttttttttttact

SEQ ID NO: 106982 - DNA, 20 bp, Artificial Sequence
  chemically synthesized
tgtaaactaagtaaaaaaaa

SEQ ID NO: 106983 - DNA, 20 bp, Artificial Sequence
  chemically synthesized
agggccttctagattataag

SEQ ID NO: 106984 - DNA, 20 bp, Artificial Sequence
  chemically synthesized
aaaaaagactacttataatc

SEQ ID NO: 106985 - DNA, 20 bp, Artificial Sequence
  chemically synthesized
tcaagggccttctagattat

SEQ ID NO: 106986 - DNA, 20 bp, Artificial Sequence
  chemically synthesized
aaagactacttataatctag

SEQ ID NO: 106987 - DNA, 20 bp, Artificial Sequence
  chemically synthesized
aagactacttataatctaga

SEQ ID NO: 106988 - DNA, 20 bp, Artificial Sequence
  chemically synthesized
ttcaattatcaagggccttc

SEQ ID NO: 106989 - DNA, 20 bp, Artificial Sequence
  chemically synthesized
aagtgtatttcaattatcaa

SEQ ID NO: 106990 - DNA, 20 bp, Artificial Sequence
  chemically synthesized
taagtgtatttcaattatca

SEQ ID NO: 106991 - DNA, 20 bp, Artificial Sequence
  chemically synthesized
ctaagtgtatttcaattatc

SEQ ID NO: 106992 - DNA, 20 bp, Artificial Sequence
  chemically synthesized
cttgataattgaaatacact

SEQ ID NO: 106993 - DNA, 20 bp, Artificial Sequence
  chemically synthesized
aaactcgattgttcattgct

SEQ ID NO: 106994 - DNA, 20 bp, Artificial Sequence
  chemically synthesized
acacttagcaatgaacaatc

SEQ ID NO: 106995 - DNA, 20 bp, Artificial Sequence
  chemically synthesized
attacttgtgaattgtgaat

SEQ ID NO: 106996 - DNA, 20 bp, Artificial Sequence
  chemically synthesized
tttgctgattcacaattcac

SEQ ID NO: 106997 - DNA, 20 bp, Artificial Sequence
  chemically synthesized
cacaattcacaagtaatctt

SEQ ID NO: 106998 - DNA, 20 bp, Artificial Sequence
  chemically synthesized
acaattcacaagtaatctta

SEQ ID NO: 106999 - DNA, 20 bp, Artificial Sequence
  chemically synthesized
ttcacaagtaatcttaaggt

SEQ ID NO: 107000 - DNA, 20 bp, Artificial Sequence
  chemically synthesized
tcacaagtaatcttaaggtc

SEQ ID NO: 107001 - DNA, 20 bp, Artificial Sequence
  chemically synthesized
gcaatcagaaacctgacctt

SEQ ID NO: 107002 - DNA, 20 bp, Artificial Sequence
  chemically synthesized
aacaactacgaatgagcaat

SEQ ID NO: 107003 - DNA, 20 bp, Artificial Sequence
  chemically synthesized
ggtttctgattgctcattcg

SEQ ID NO: 107004 - DNA, 20 bp, Artificial Sequence
  chemically synthesized
tttggaaaacaactacgaat

SEQ ID NO: 107005 - DNA, 20 bp, Artificial Sequence
  chemically synthesized
tcattcgtagttgttttcca

SEQ ID NO: 107006 - DNA, 20 bp, Artificial Sequence
  chemically synthesized
aaattagattatcaacactt

SEQ ID NO: 107007 - DNA, 20 bp, Artificial Sequence
  chemically synthesized
atttggagcacaaacaaaat

SEQ ID NO: 107008 - DNA, 20 bp, Artificial Sequence
  chemically synthesized
tgcattggaagaatcatttg

SEQ ID NO: 107009 - DNA, 20 bp, Artificial Sequence
  chemically synthesized
tttgcattggaagaatcatt

SEQ ID NO: 107010 - DNA, 20 bp, Artificial Sequence
  chemically synthesized
ctgggacctttttgcattgg

SEQ ID NO: 107011 - DNA, 20 bp, Artificial Sequence
  chemically synthesized
aatgattcttccaatgcaaa

SEQ ID NO: 107012 - DNA, 20 bp, Artificial Sequence
  chemically synthesized
cagctgggacctttttgcat

SEQ ID NO: 107013 - DNA, 20 bp, Artificial Sequence
  chemically synthesized
atgattcttccaatgcaaaa

SEQ ID NO: 107014 - DNA, 20 bp, Artificial Sequence
  chemically synthesized
cttccaatgcaaaaaggtcc

SEQ ID NO: 107015 - DNA, 20 bp, Artificial Sequence
  chemically synthesized
cctacctttgcaaagcagct

SEQ ID NO: 107016 - DNA, 20 bp, Artificial Sequence
  chemically synthesized
acctacctttgcaaagcagc

SEQ ID NO: 107017 - DNA, 20 bp, Artificial Sequence
  chemically synthesized
aaggtcccagctgctttgca

SEQ ID NO: 107018 - DNA, 20 bp, Artificial Sequence
  chemically synthesized
acctacctacctttgcaaag

SEQ ID NO: 107019 - DNA, 20 bp, Artificial Sequence
  chemically synthesized
aggtcccagctgctttgcaa

SEQ ID NO: 107020 - DNA, 20 bp, Artificial Sequence
  chemically synthesized
caaacctacctacctttgca

SEQ ID NO: 107021 - DNA, 20 bp, Artificial Sequence
  chemically synthesized
tcccagctgctttgcaaagg

SEQ ID NO: 107022 - DNA, 20 bp, Artificial Sequence
  chemically synthesized
cccagctgctttgcaaaggt

SEQ ID NO: 107023 - DNA, 20 bp, Artificial Sequence
  chemically synthesized
agctgctttgcaaaggtagg

SEQ ID NO: 107024 - DNA, 20 bp, Artificial Sequence
  chemically synthesized
gctgctttgcaaaggtaggt

SEQ ID NO: 107025 - DNA, 20 bp, Artificial Sequence
  chemically synthesized
ggtaggtttgcctaaaaatc

SEQ ID NO: 107026 - DNA, 20 bp, Artificial Sequence
  chemically synthesized
tgatgtcgttcttgattttt

SEQ ID NO: 107027 - DNA, 20 bp, Artificial Sequence
  chemically synthesized
gtgatgtcgttcttgatttt

SEQ ID NO: 107028 - DNA, 20 bp, Artificial Sequence
  chemically synthesized
tcaagaacgacatcacccac

SEQ ID NO: 107029 - DNA, 20 bp, Artificial Sequence
  chemically synthesized
ttaacaagaaaatgtcttgt

SEQ ID NO: 107030 - DNA, 20 bp, Artificial Sequence
  chemically synthesized
cttaacaagaaaatgtcttg

SEQ ID NO: 107031 - DNA, 20 bp, Artificial Sequence
  chemically synthesized
ccacaagacattttcttgtt

SEQ ID NO: 107032 - DNA, 20 bp, Artificial Sequence
  chemically synthesized
aagttacttcgcaacttaac

SEQ ID NO: 107033 - DNA, 20 bp, Artificial Sequence
  chemically synthesized
cattttcttgttaagttgcg

SEQ ID NO: 107034 - DNA, 20 bp, Artificial Sequence
  chemically synthesized
ttaagttgcgaagtaacttt

SEQ ID NO: 107035 - DNA, 20 bp, Artificial Sequence
  chemically synthesized
ctagtctgaaaatatactaa

SEQ ID NO: 107036 - DNA, 20 bp, Artificial Sequence
  chemically synthesized
agtaacttttagtatatttt

SEQ ID NO: 107037 - DNA, 20 bp, Artificial Sequence
  chemically synthesized
cttttagtatattttcagac

SEQ ID NO: 107038 - DNA, 20 bp, Artificial Sequence
  chemically synthesized
acactagtctaggaaaacac

SEQ ID NO: 107039 - DNA, 20 bp, Artificial Sequence
  chemically synthesized
ttttcagactagtgttttcc

SEQ ID NO: 107040 - DNA, 20 bp, Artificial Sequence
  chemically synthesized
agactagtgttttcctagac

SEQ ID NO: 107041 - DNA, 20 bp, Artificial Sequence
  chemically synthesized
tgcatggggtacactagtct

SEQ ID NO: 107042 - DNA, 20 bp, Artificial Sequence
  chemically synthesized
atgcatggggtacactagtc

SEQ ID NO: 107043 - DNA, 20 bp, Artificial Sequence
  chemically synthesized
agatcatgcatggggtacac

SEQ ID NO: 107044 - DNA, 20 bp, Artificial Sequence
  chemically synthesized
tctgattcagatcatgcatg

SEQ ID NO: 107045 - DNA, 20 bp, Artificial Sequence
  chemically synthesized
gtctgattcagatcatgcat

SEQ ID NO: 107046 - DNA, 20 bp, Artificial Sequence
  chemically synthesized
agtctgattcagatcatgca

SEQ ID NO: 107047 - DNA, 20 bp, Artificial Sequence
  chemically synthesized
accccatgcatgatctgaat

SEQ ID NO: 107048 - DNA, 20 bp, Artificial Sequence
  chemically synthesized
gattaagagcaagtctgatt

SEQ ID NO: 107049 - DNA, 20 bp, Artificial Sequence
  chemically synthesized
tttaatggaagattaagagc

SEQ ID NO: 107050 - DNA, 20 bp, Artificial Sequence
  chemically synthesized
tgtttttaatggaagattaa

SEQ ID NO: 107051 - DNA, 20 bp, Artificial Sequence
  chemically synthesized
cttgtttttaatggaagatt

SEQ ID NO: 107052 - DNA, 20 bp, Artificial Sequence
  chemically synthesized
gaaagtcttgtttttaatgg

SEQ ID NO: 107053 - DNA, 20 bp, Artificial Sequence
  chemically synthesized
aatgaaagtcttgtttttaa

SEQ ID NO: 107054 - DNA, 20 bp, Artificial Sequence
  chemically synthesized
cttaatcttccattaaaaac

SEQ ID NO: 107055 - DNA, 20 bp, Artificial Sequence
  chemically synthesized
taaaaacaagactttcattc

SEQ ID NO: 107056 - DNA, 20 bp, Artificial Sequence
  chemically synthesized
aaaattcatatctagaatga

SEQ ID NO: 107057 - DNA, 20 bp, Artificial Sequence
  chemically synthesized
atcagactaaaattcatatc

SEQ ID NO: 107058 - DNA, 20 bp, Artificial Sequence
  chemically synthesized
ttcattctagatatgaattt

SEQ ID NO: 107059 - DNA, 20 bp, Artificial Sequence
  chemically synthesized
agtctttaagaataagatat

SEQ ID NO: 107060 - DNA, 20 bp, Artificial Sequence
  chemically synthesized
agtctgatatcttattctta

SEQ ID NO: 107061 - DNA, 20 bp, Artificial Sequence
  chemically synthesized
agaaagtagtctttaagaat

SEQ ID NO: 107062 - DNA, 20 bp, Artificial Sequence
  chemically synthesized
gtgataagaaagtagtcttt

SEQ ID NO: 107063 - DNA, 20 bp, Artificial Sequence
  chemically synthesized
agaactttgtgataagaaag

SEQ ID NO: 107064 - DNA, 20 bp, Artificial Sequence
  chemically synthesized
gtgagaactttgtgataaga

SEQ ID NO: 107065 - DNA, 20 bp, Artificial Sequence
  chemically synthesized
aagactactttcttatcaca

SEQ ID NO: 107066 - DNA, 20 bp, Artificial Sequence
  chemically synthesized
tgatgtgagaactttgtgat

SEQ ID NO: 107067 - DNA, 20 bp, Artificial Sequence
  chemically synthesized
ggtttggatattggtgatgt

SEQ ID NO: 107068 - DNA, 20 bp, Artificial Sequence
  chemically synthesized
aaatgtcttggtttggatat

SEQ ID NO: 107069 - DNA, 20 bp, Artificial Sequence
  chemically synthesized
acatcaccaatatccaaacc

SEQ ID NO: 107070 - DNA, 20 bp, Artificial Sequence
  chemically synthesized
ttgtcttaaatgtcttggtt

SEQ ID NO: 107071 - DNA, 20 bp, Artificial Sequence
  chemically synthesized
gaatgttgtcttaaatgtct

SEQ ID NO: 107072 - DNA, 20 bp, Artificial Sequence
  chemically synthesized
atatccaaaccaagacattt

SEQ ID NO: 107073 - DNA, 20 bp, Artificial Sequence
  chemically synthesized
gacatttaagacaacattct

SEQ ID NO: 107074 - DNA, 20 bp, Artificial Sequence
  chemically synthesized
acatttaagacaacattctc

SEQ ID NO: 107075 - DNA, 20 bp, Artificial Sequence
  chemically synthesized
catttaagacaacattctca

SEQ ID NO: 107076 - DNA, 20 bp, Artificial Sequence
  chemically synthesized
atttaagacaacattctcag

SEQ ID NO: 107077 - DNA, 20 bp, Artificial Sequence
  chemically synthesized
tgtagtcatttatcacccct

SEQ ID NO: 107078 - DNA, 20 bp, Artificial Sequence
  chemically synthesized
tcaggggtgataaatgacta

SEQ ID NO: 107079 - DNA, 20 bp, Artificial Sequence
  chemically synthesized
ttttaaaagcgcaaaaactg

SEQ ID NO: 107080 - DNA, 20 bp, Artificial Sequence
  chemically synthesized
cagtttttgcgcttttaaaa

SEQ ID NO: 107081 - DNA, 20 bp, Artificial Sequence
  chemically synthesized
agtttttgcgcttttaaaat

SEQ ID NO: 107082 - DNA, 20 bp, Artificial Sequence
  chemically synthesized
atttcccaagcctattttaa

SEQ ID NO: 107083 - DNA, 20 bp, Artificial Sequence
  chemically synthesized
ttgcgcttttaaaataggct

SEQ ID NO: 107084 - DNA, 20 bp, Artificial Sequence
  chemically synthesized
tgcgcttttaaaataggctt

SEQ ID NO: 107085 - DNA, 20 bp, Artificial Sequence
  chemically synthesized
caaaatacaggtcatttccc

SEQ ID NO: 107086 - DNA, 20 bp, Artificial Sequence
  chemically synthesized
atgcacgtaatgcaaaatac

SEQ ID NO: 107087 - DNA, 20 bp, Artificial Sequence
  chemically synthesized
gatgcacgtaatgcaaaata

SEQ ID NO: 107088 - DNA, 20 bp, Artificial Sequence
  chemically synthesized
cactctgtaagagcaattag

SEQ ID NO: 107089 - DNA, 20 bp, Artificial Sequence
  chemically synthesized
gaacactctgtaagagcaat

SEQ ID NO: 107090 - DNA, 20 bp, Artificial Sequence
  chemically synthesized
taaacttctaattgctctta

SEQ ID NO: 107091 - DNA, 20 bp, Artificial Sequence
  chemically synthesized
aacttctaattgctcttaca

SEQ ID NO: 107092 - DNA, 20 bp, Artificial Sequence
  chemically synthesized
ttttacagaacactctgtaa

SEQ ID NO: 107093 - DNA, 20 bp, Artificial Sequence
  chemically synthesized
ttttttacagaacactctgt

SEQ ID NO: 107094 - DNA, 20 bp, Artificial Sequence
  chemically synthesized
ttacagagtgttctgtaaaa

SEQ ID NO: 107095 - DNA, 20 bp, Artificial Sequence
  chemically synthesized
atggtggatattctttttta

SEQ ID NO: 107096 - DNA, 20 bp, Artificial Sequence
  chemically synthesized
atagtatttttaaagaatgg

SEQ ID NO: 107097 - DNA, 20 bp, Artificial Sequence
  chemically synthesized
gccatagtatttttaaagaa

SEQ ID NO: 107098 - DNA, 20 bp, Artificial Sequence
  chemically synthesized
ttaatgccatagtattttta

SEQ ID NO: 107099 - DNA, 20 bp, Artificial Sequence
  chemically synthesized
accattctttaaaaatacta

SEQ ID NO: 107100 - DNA, 20 bp, Artificial Sequence
  chemically synthesized
tttaaaaatactatggcatt

SEQ ID NO: 107101 - DNA, 20 bp, Artificial Sequence
  chemically synthesized
gggcttcagtcttaatgcca

SEQ ID NO: 107102 - DNA, 20 bp, Artificial Sequence
  chemically synthesized
atactatggcattaagactg

SEQ ID NO: 107103 - DNA, 20 bp, Artificial Sequence
  chemically synthesized
ggcattaagactgaagccct

SEQ ID NO: 107104 - DNA, 20 bp, Artificial Sequence
  chemically synthesized
cttaacatctctcagggctt

SEQ ID NO: 107105 - DNA, 20 bp, Artificial Sequence
  chemically synthesized
cattaagactgaagccctga

SEQ ID NO: 107106 - DNA, 20 bp, Artificial Sequence
  chemically synthesized
gtctatcttaacatctctca

SEQ ID NO: 107107 - DNA, 20 bp, Artificial Sequence
  chemically synthesized
agtctatcttaacatctctc

SEQ ID NO: 107108 - DNA, 20 bp, Artificial Sequence
  chemically synthesized
tagtctatcttaacatctct

SEQ ID NO: 107109 - DNA, 20 bp, Artificial Sequence
  chemically synthesized
ctgaagccctgagagatgtt

SEQ ID NO: 107110 - DNA, 20 bp, Artificial Sequence
  chemically synthesized
agccctgagagatgttaaga

SEQ ID NO: 107111 - DNA, 20 bp, Artificial Sequence
  chemically synthesized
tgtagtctacagagtttaaa

SEQ ID NO: 107112 - DNA, 20 bp, Artificial Sequence
  chemically synthesized
gatagactatttaaactctg

SEQ ID NO: 107113 - DNA, 20 bp, Artificial Sequence
  chemically synthesized
attcccaaatgtagtctaca

SEQ ID NO: 107114 - DNA, 20 bp, Artificial Sequence
  chemically synthesized
gcattcccaaatgtagtcta

SEQ ID NO: 107115 - DNA, 20 bp, Artificial Sequence
  chemically synthesized
taaactctgtagactacatt

SEQ ID NO: 107116 - DNA, 20 bp, Artificial Sequence
  chemically synthesized
aaactctgtagactacattt

SEQ ID NO: 107117 - DNA, 20 bp, Artificial Sequence
  chemically synthesized
cttggaagcattcccaaatg

SEQ ID NO: 107118 - DNA, 20 bp, Artificial Sequence
  chemically synthesized
ctacatttgggaatgcttcc

SEQ ID NO: 107119 - DNA, 20 bp, Artificial Sequence
  chemically synthesized
tacatttgggaatgcttcca

SEQ ID NO: 107120 - DNA, 20 bp, Artificial Sequence
  chemically synthesized
tttgggaatgcttccaaggt

SEQ ID NO: 107121 - DNA, 20 bp, Artificial Sequence
  chemically synthesized
ctcttcactgctaaccttgg

SEQ ID NO: 107122 - DNA, 20 bp, Artificial Sequence
  chemically synthesized
gggaatgcttccaaggttag

SEQ ID NO: 107123 - DNA, 20 bp, Artificial Sequence
  chemically synthesized
tcactcttcactgctaacct

SEQ ID NO: 107124 - DNA, 20 bp, Artificial Sequence
  chemically synthesized
tgcttccaaggttagcagtg

SEQ ID NO: 107125 - DNA, 20 bp, Artificial Sequence
  chemically synthesized
cttccaaggttagcagtgaa

SEQ ID NO: 107126 - DNA, 20 bp, Artificial Sequence
  chemically synthesized
agcagtgaagagtgactcat

SEQ ID NO: 107127 - DNA, 20 bp, Artificial Sequence
  chemically synthesized
tgaagagtgactcatcagtg

SEQ ID NO: 107128 - DNA, 20 bp, Artificial Sequence
  chemically synthesized
acttccggcccttcactgat

SEQ ID NO: 107129 - DNA, 20 bp, Artificial Sequence
  chemically synthesized
gaagagtgactcatcagtga

SEQ ID NO: 107130 - DNA, 20 bp, Artificial Sequence
  chemically synthesized
aagagtgactcatcagtgaa

SEQ ID NO: 107131 - DNA, 20 bp, Artificial Sequence
  chemically synthesized
gtgactcatcagtgaagggc

SEQ ID NO: 107132 - DNA, 20 bp, Artificial Sequence
  chemically synthesized
actcatcagtgaagggccgg

SEQ ID NO: 107133 - DNA, 20 bp, Artificial Sequence
  chemically synthesized
accaaaaggaaaagaacttc

SEQ ID NO: 107134 - DNA, 20 bp, Artificial Sequence
  chemically synthesized
gccggaagttcttttccttt

SEQ ID NO: 107135 - DNA, 20 bp, Artificial Sequence
  chemically synthesized
ccacattaaaccaaaaggaa

SEQ ID NO: 107136 - DNA, 20 bp, Artificial Sequence
  chemically synthesized
gagatccacattaaaccaaa

SEQ ID NO: 107137 - DNA, 20 bp, Artificial Sequence
  chemically synthesized
agagatccacattaaaccaa

SEQ ID NO: 107138 - DNA, 20 bp, Artificial Sequence
  chemically synthesized
cttttccttttggtttaatg

SEQ ID NO: 107139 - DNA, 20 bp, Artificial Sequence
  chemically synthesized
catattagaaagtagtttga

SEQ ID NO: 107140 - DNA, 20 bp, Artificial Sequence
  chemically synthesized
accatattagaaagtagttt

SEQ ID NO: 107141 - DNA, 20 bp, Artificial Sequence
  chemically synthesized
gtggttaccatattagaaag

SEQ ID NO: 107142 - DNA, 20 bp, Artificial Sequence
  chemically synthesized
tctcaaactactttctaata

SEQ ID NO: 107143 - DNA, 20 bp, Artificial Sequence
  chemically synthesized
ctagtggttaccatattaga

SEQ ID NO: 107144 - DNA, 20 bp, Artificial Sequence
  chemically synthesized
gtgtctagtggttaccatat

SEQ ID NO: 107145 - DNA, 20 bp, Artificial Sequence
  chemically synthesized
ctttctaatatggtaaccac

SEQ ID NO: 107146 - DNA, 20 bp, Artificial Sequence
  chemically synthesized
cagtagccatatgtgtctag

SEQ ID NO: 107147 - DNA, 20 bp, Artificial Sequence
  chemically synthesized
gctcagtagccatatgtgtc

SEQ ID NO: 107148 - DNA, 20 bp, Artificial Sequence
  chemically synthesized
tggtaaccactagacacata

SEQ ID NO: 107149 - DNA, 20 bp, Artificial Sequence
  chemically synthesized
actagacacatatggctact

SEQ ID NO: 107150 - DNA, 20 bp, Artificial Sequence
  chemically synthesized
gccacatttcaagtgctcag

SEQ ID NO: 107151 - DNA, 20 bp, Artificial Sequence
  chemically synthesized
tcagccacatttcaagtgct

SEQ ID NO: 107152 - DNA, 20 bp, Artificial Sequence
  chemically synthesized
gctactgagcacttgaaatg

SEQ ID NO: 107153 - DNA, 20 bp, Artificial Sequence
  chemically synthesized
gttcagatcagccacatttc

SEQ ID NO: 107154 - DNA, 20 bp, Artificial Sequence
  chemically synthesized
cagcgcaactcagttcagat

SEQ ID NO: 107155 - DNA, 20 bp, Artificial Sequence
  chemically synthesized
aaatgtggctgatctgaact

SEQ ID NO: 107156 - DNA, 20 bp, Artificial Sequence
  chemically synthesized
tcttacagcgcaactcagtt

SEQ ID NO: 107157 - DNA, 20 bp, Artificial Sequence
  chemically synthesized
tttactcttacagcgcaact

SEQ ID NO: 107158 - DNA, 20 bp, Artificial Sequence
  chemically synthesized
tctgaactgagttgcgctgt

SEQ ID NO: 107159 - DNA, 20 bp, Artificial Sequence
  chemically synthesized
tgaactgagttgcgctgtaa

SEQ ID NO: 107160 - DNA, 20 bp, Artificial Sequence
  chemically synthesized
tctggtaagttttactctta

SEQ ID NO: 107161 - DNA, 20 bp, Artificial Sequence
  chemically synthesized
gctgtaagagtaaaacttac

SEQ ID NO: 107162 - DNA, 20 bp, Artificial Sequence
  chemically synthesized
ttaagtatttaaaatctggt

SEQ ID NO: 107163 - DNA, 20 bp, Artificial Sequence
  chemically synthesized
tccgttaagtatttaaaatc

SEQ ID NO: 107164 - DNA, 20 bp, Artificial Sequence
  chemically synthesized
accagattttaaatacttaa

SEQ ID NO: 107165 - DNA, 20 bp, Artificial Sequence
  chemically synthesized
ttaattagattttttccgtt

SEQ ID NO: 107166 - DNA, 20 bp, Artificial Sequence
  chemically synthesized
ttgttacaaaagttattaat

SEQ ID NO: 107167 - DNA, 20 bp, Artificial Sequence
  chemically synthesized
ttaacatgtaattgttacaa

SEQ ID NO: 107168 - DNA, 20 bp, Artificial Sequence
  chemically synthesized
atgttaaaatgacaatgttt

SEQ ID NO: 107169 - DNA, 20 bp, Artificial Sequence
  chemically synthesized
tgttaaaatgacaatgtttt

SEQ ID NO: 107170 - DNA, 20 bp, Artificial Sequence
  chemically synthesized
tgacaatgttttgggtatat

SEQ ID NO: 107171 - DNA, 20 bp, Artificial Sequence
  chemically synthesized
gacaatgttttgggtatatt

SEQ ID NO: 107172 - DNA, 20 bp, Artificial Sequence
  chemically synthesized
agaagtgaaattaatttcaa

SEQ ID NO: 107173 - DNA, 20 bp, Artificial Sequence
  chemically synthesized
ctgaaaaaataaaaataaag

SEQ ID NO: 107174 - DNA, 20 bp, Artificial Sequence
  chemically synthesized
acactgaaaaaataaaaata

SEQ ID NO: 107175 - DNA, 20 bp, Artificial Sequence
  chemically synthesized
cttctttatttttatttttt

SEQ ID NO: 107176 - DNA, 20 bp, Artificial Sequence
  chemically synthesized
tattttttcagtgtgcctac

SEQ ID NO: 107177 - DNA, 20 bp, Artificial Sequence
  chemically synthesized
ttttttcagtgtgcctacta

SEQ ID NO: 107178 - DNA, 20 bp, Artificial Sequence
  chemically synthesized
gtaatttaaatttctctagt

SEQ ID NO: 107179 - DNA, 20 bp, Artificial Sequence
  chemically synthesized
tgtaatttaaatttctctag

SEQ ID NO: 107180 - DNA, 20 bp, Artificial Sequence
  chemically synthesized
atatgtaatttaaatttctc

SEQ ID NO: 107181 - DNA, 20 bp, Artificial Sequence
  chemically synthesized
agaaatttaaattacatatg

SEQ ID NO: 107182 - DNA, 20 bp, Artificial Sequence
  chemically synthesized
gcccagtagaaataaaatgt

SEQ ID NO: 107183 - DNA, 20 bp, Artificial Sequence
  chemically synthesized
ggctcacattttatttctac

SEQ ID NO: 107184 - DNA, 20 bp, Artificial Sequence
  chemically synthesized
gctcacattttatttctact

SEQ ID NO: 107185 - DNA, 20 bp, Artificial Sequence
  chemically synthesized
cacattttatttctactggg

SEQ ID NO: 107186 - DNA, 20 bp, Artificial Sequence
  chemically synthesized
cattttatttctactgggca

SEQ ID NO: 107187 - DNA, 20 bp, Artificial Sequence
  chemically synthesized
actacagcagctctgcccag

SEQ ID NO: 107188 - DNA, 20 bp, Artificial Sequence
  chemically synthesized
tttactacagcagctctgcc

SEQ ID NO: 107189 - DNA, 20 bp, Artificial Sequence
  chemically synthesized
tctactgggcagagctgctg

SEQ ID NO: 107190 - DNA, 20 bp, Artificial Sequence
  chemically synthesized
ttctcttcattttactacag

SEQ ID NO: 107191 - DNA, 20 bp, Artificial Sequence
  chemically synthesized
ttgttctcttcattttacta

SEQ ID NO: 107192 - DNA, 20 bp, Artificial Sequence
  chemically synthesized
agagctgctgtagtaaaatg

SEQ ID NO: 107193 - DNA, 20 bp, Artificial Sequence
  chemically synthesized
agctgctgtagtaaaatgaa

SEQ ID NO: 107194 - DNA, 20 bp, Artificial Sequence
  chemically synthesized
tgtagtaaaatgaagagaac

SEQ ID NO: 107195 - DNA, 20 bp, Artificial Sequence
  chemically synthesized
taaaatgaagagaacaagaa

SEQ ID NO: 107196 - DNA, 20 bp, Artificial Sequence
  chemically synthesized
agagaacaagaatagcccca

SEQ ID NO: 107197 - DNA, 20 bp, Artificial Sequence
  chemically synthesized
tgaaaactaagatatctgtg

SEQ ID NO: 107198 - DNA, 20 bp, Artificial Sequence
  chemically synthesized
atgaaaactaagatatctgt

SEQ ID NO: 107199 - DNA, 20 bp, Artificial Sequence
  chemically synthesized
aatgaaaactaagatatctg

SEQ ID NO: 107200 - DNA, 20 bp, Artificial Sequence
  chemically synthesized
gaatagccccacagatatct

SEQ ID NO: 107201 - DNA, 20 bp, Artificial Sequence
  chemically synthesized
ggcttgtaacaatgaaaact

SEQ ID NO: 107202 - DNA, 20 bp, Artificial Sequence
  chemically synthesized
atcttagttttcattgttac

SEQ ID NO: 107203 - DNA, 20 bp, Artificial Sequence
  chemically synthesized
aaaattgtctaataaattgt

SEQ ID NO: 107204 - DNA, 20 bp, Artificial Sequence
  chemically synthesized
gttacaagccaacaatttat

SEQ ID NO: 107205 - DNA, 20 bp, Artificial Sequence
  chemically synthesized
ttttgtgtcatttcaagtca

SEQ ID NO: 107206 - DNA, 20 bp, Artificial Sequence
  chemically synthesized
atttttgtgtcatttcaagt

SEQ ID NO: 107207 - DNA, 20 bp, Artificial Sequence
  chemically synthesized
tgagatttttgtgtcatttc

SEQ ID NO: 107208 - DNA, 20 bp, Artificial Sequence
  chemically synthesized
ttgaaatgacacaaaaatct

SEQ ID NO: 107209 - DNA, 20 bp, Artificial Sequence
  chemically synthesized
gaaatgacacaaaaatctca

SEQ ID NO: 107210 - DNA, 20 bp, Artificial Sequence
  chemically synthesized
aatgacacaaaaatctcaga

SEQ ID NO: 107211 - DNA, 20 bp, Artificial Sequence
  chemically synthesized
tcacaccacaggatctctct

SEQ ID NO: 107212 - DNA, 20 bp, Artificial Sequence
  chemically synthesized
aaaatctcagagagatcctg

SEQ ID NO: 107213 - DNA, 20 bp, Artificial Sequence
  chemically synthesized
tcagagagatcctgtggtgt

SEQ ID NO: 107214 - DNA, 20 bp, Artificial Sequence
  chemically synthesized
actccaaacgctcacaccac

SEQ ID NO: 107215 - DNA, 20 bp, Artificial Sequence
  chemically synthesized
gactccaaacgctcacacca

SEQ ID NO: 107216 - DNA, 20 bp, Artificial Sequence
  chemically synthesized
gatcctgtggtgtgagcgtt

SEQ ID NO: 107217 - DNA, 20 bp, Artificial Sequence
  chemically synthesized
tcctgtggtgtgagcgtttg

SEQ ID NO: 107218 - DNA, 20 bp, Artificial Sequence
  chemically synthesized
gtggtgtgagcgtttggagt

SEQ ID NO: 107219 - DNA, 20 bp, Artificial Sequence
  chemically synthesized
ggtgtgagcgtttggagtca

SEQ ID NO: 107220 - DNA, 20 bp, Artificial Sequence
  chemically synthesized
gtgtgagcgtttggagtcag

SEQ ID NO: 107221 - DNA, 20 bp, Artificial Sequence
  chemically synthesized
aacaatggtccatgaaaaat

SEQ ID NO: 107222 - DNA, 20 bp, Artificial Sequence
  chemically synthesized
agtcagaggcctatttttca

SEQ ID NO: 107223 - DNA, 20 bp, Artificial Sequence
  chemically synthesized
gaacaatggtccatgaaaaa

SEQ ID NO: 107224 - DNA, 20 bp, Artificial Sequence
  chemically synthesized
tttttcatggaccattgttc

SEQ ID NO: 107225 - DNA, 20 bp, Artificial Sequence
  chemically synthesized
gttaaactaaaccagaacaa

SEQ ID NO: 107226 - DNA, 20 bp, Artificial Sequence
  chemically synthesized
catggaccattgttctggtt

SEQ ID NO: 107227 - DNA, 20 bp, Artificial Sequence
  chemically synthesized
gtagatttgttaaactaaac

SEQ ID NO: 107228 - DNA, 20 bp, Artificial Sequence
  chemically synthesized
ttagtttaacaaatctacta

SEQ ID NO: 107229 - DNA, 20 bp, Artificial Sequence
  chemically synthesized
tatactatattacactatag

SEQ ID NO: 107230 - DNA, 20 bp, Artificial Sequence
  chemically synthesized
gtttatactatattacacta

SEQ ID NO: 107231 - DNA, 20 bp, Artificial Sequence
  chemically synthesized
aaatctactatagtgtaata

SEQ ID NO: 107232 - DNA, 20 bp, Artificial Sequence
  chemically synthesized
aatgaacaaaaatgcaaaaa

SEQ ID NO: 107233 - DNA, 20 bp, Artificial Sequence
  chemically synthesized
tttttgcatttttgttcatt

SEQ ID NO: 107234 - DNA, 20 bp, Artificial Sequence
  chemically synthesized
ttgcatttttgttcatttag

SEQ ID NO: 107235 - DNA, 20 bp, Artificial Sequence
  chemically synthesized
gttcatttagaagtttatga

SEQ ID NO: 107236 - DNA, 20 bp, Artificial Sequence
  chemically synthesized
atttagaagtttatgaaagt

SEQ ID NO: 107237 - DNA, 20 bp, Artificial Sequence
  chemically synthesized
agaagtttatgaaagtcagc

SEQ ID NO: 107238 - DNA, 20 bp, Artificial Sequence
  chemically synthesized
tttatgaaagtcagcaagat

SEQ ID NO: 107239 - DNA, 20 bp, Artificial Sequence
  chemically synthesized
aataaattgcattgccaatt

SEQ ID NO: 107240 - DNA, 20 bp, Artificial Sequence
  chemically synthesized
agattattacatttctaaat

SEQ ID NO: 107241 - DNA, 20 bp, Artificial Sequence
  chemically synthesized
aaacttgatgatcaaaaatt

SEQ ID NO: 107242 - DNA, 20 bp, Artificial Sequence
  chemically synthesized
aatctgaatttttgatcatc

SEQ ID NO: 107243 - DNA, 20 bp, Artificial Sequence
  chemically synthesized
tttatgcataatgtattttt

SEQ ID NO: 107244 - DNA, 20 bp, Artificial Sequence
  chemically synthesized
tatgcataatgtatttttga

SEQ ID NO: 107245 - DNA, 20 bp, Artificial Sequence
  chemically synthesized
ttttgagagaaaataaacac

SEQ ID NO: 107246 - DNA, 20 bp, Artificial Sequence
  chemically synthesized
agagaaaataaacacaagca

SEQ ID NO: 107247 - DNA, 20 bp, Artificial Sequence
  chemically synthesized
aaacacaagcaaagaatcaa

SEQ ID NO: 107248 - DNA, 20 bp, Artificial Sequence
  chemically synthesized
aagaatcaatagcatttccc

SEQ ID NO: 107249 - DNA, 20 bp, Artificial Sequence
  chemically synthesized
cccccgaggattgggggctg

SEQ ID NO: 107250 - DNA, 20 bp, Artificial Sequence
  chemically synthesized
tcccccgaggattgggggct

SEQ ID NO: 107251 - DNA, 20 bp, Artificial Sequence
  chemically synthesized
ctcccccgaggattgggggc

SEQ ID NO: 107252 - DNA, 20 bp, Artificial Sequence
  chemically synthesized
gaatctcccccgaggattgg

SEQ ID NO: 107253 - DNA, 20 bp, Artificial Sequence
  chemically synthesized
tttccccagcccccaatcct

SEQ ID NO: 107254 - DNA, 20 bp, Artificial Sequence
  chemically synthesized
agaatctcccccgaggattg

SEQ ID NO: 107255 - DNA, 20 bp, Artificial Sequence
  chemically synthesized
ttccccagcccccaatcctc

SEQ ID NO: 107256 - DNA, 20 bp, Artificial Sequence
  chemically synthesized
gagaatctcccccgaggatt

SEQ ID NO: 107257 - DNA, 20 bp, Artificial Sequence
  chemically synthesized
tccccagcccccaatcctcg

SEQ ID NO: 107258 - DNA, 20 bp, Artificial Sequence
  chemically synthesized
agagaatctcccccgaggat

SEQ ID NO: 107259 - DNA, 20 bp, Artificial Sequence
  chemically synthesized
ccccagcccccaatcctcgg

SEQ ID NO: 107260 - DNA, 20 bp, Artificial Sequence
  chemically synthesized
ccagcccccaatcctcgggg

SEQ ID NO: 107261 - DNA, 20 bp, Artificial Sequence
  chemically synthesized
atgagagagaatctcccccg

SEQ ID NO: 107262 - DNA, 20 bp, Artificial Sequence
  chemically synthesized
aatgagagagaatctccccc

SEQ ID NO: 107263 - DNA, 20 bp, Artificial Sequence
  chemically synthesized
ggaaattaaatataatgaga

SEQ ID NO: 107264 - DNA, 20 bp, Artificial Sequence
  chemically synthesized
gaggaaattaaatataatga

SEQ ID NO: 107265 - DNA, 20 bp, Artificial Sequence
  chemically synthesized
aagaggaaattaaatataat

SEQ ID NO: 107266 - DNA, 20 bp, Artificial Sequence
  chemically synthesized
taaaatgagttaattcaaag

SEQ ID NO: 107267 - DNA, 20 bp, Artificial Sequence
  chemically synthesized
ttaaaatgagttaattcaaa

SEQ ID NO: 107268 - DNA, 20 bp, Artificial Sequence
  chemically synthesized
ttttaaaatgagttaattca

SEQ ID NO: 107269 - DNA, 20 bp, Artificial Sequence
  chemically synthesized
tttgaattaactcattttaa

SEQ ID NO: 107270 - DNA, 20 bp, Artificial Sequence
  chemically synthesized
attttactgtcttttaaaat

SEQ ID NO: 107271 - DNA, 20 bp, Artificial Sequence
  chemically synthesized
aattaactcattttaaaaga

SEQ ID NO: 107272 - DNA, 20 bp, Artificial Sequence
  chemically synthesized
cattttaaaagacagtaaaa

SEQ ID NO: 107273 - DNA, 20 bp, Artificial Sequence
  chemically synthesized
attttaaaagacagtaaaat

SEQ ID NO: 107274 - DNA, 20 bp, Artificial Sequence
  chemically synthesized
gaaatacaattaaaacattt

SEQ ID NO: 107275 - DNA, 20 bp, Artificial Sequence
  chemically synthesized
tcttaacttcagaaaaaaat

SEQ ID NO: 107276 - DNA, 20 bp, Artificial Sequence
  chemically synthesized
gtatttctgatttttttctg

SEQ ID NO: 107277 - DNA, 20 bp, Artificial Sequence
  chemically synthesized
tctgatttttttctgaagtt

SEQ ID NO: 107278 - DNA, 20 bp, Artificial Sequence
  chemically synthesized
tgatttttttctgaagttaa

SEQ ID NO: 107279 - DNA, 20 bp, Artificial Sequence
  chemically synthesized
gtctactttgctcttaactt

SEQ ID NO: 107280 - DNA, 20 bp, Artificial Sequence
  chemically synthesized
tttttctgaagttaagagca

SEQ ID NO: 107281 - DNA, 20 bp, Artificial Sequence
  chemically synthesized
ttctgaagttaagagcaaag

SEQ ID NO: 107282 - DNA, 20 bp, Artificial Sequence
  chemically synthesized
agttaagagcaaagtagact

SEQ ID NO: 107283 - DNA, 20 bp, Artificial Sequence
  chemically synthesized
ttaccatctgtcaattcact

SEQ ID NO: 107284 - DNA, 20 bp, Artificial Sequence
  chemically synthesized
aagtagactgagtgaattga

SEQ ID NO: 107285 - DNA, 20 bp, Artificial Sequence
  chemically synthesized
agactgagtgaattgacaga

SEQ ID NO: 107286 - DNA, 20 bp, Artificial Sequence
  chemically synthesized
attttgcacaccatttattt

SEQ ID NO: 107287 - DNA, 20 bp, Artificial Sequence
  chemically synthesized
gccgttagtcctgaaataaa

SEQ ID NO: 107288 - DNA, 20 bp, Artificial Sequence
  chemically synthesized
ttttgcacaccatttatttc

SEQ ID NO: 107289 - DNA, 20 bp, Artificial Sequence
  chemically synthesized
accatttatttcaggactaa

SEQ ID NO: 107290 - DNA, 20 bp, Artificial Sequence
  chemically synthesized
tttatttcaggactaacggc

SEQ ID NO: 107291 - DNA, 20 bp, Artificial Sequence
  chemically synthesized
actttaatagaacttgccgt

SEQ ID NO: 107292 - DNA, 20 bp, Artificial Sequence
  chemically synthesized
actaacggcaagttctatta

SEQ ID NO: 107293 - DNA, 20 bp, Artificial Sequence
  chemically synthesized
aacggcaagttctattaaag

SEQ ID NO: 107294 - DNA, 20 bp, Artificial Sequence
  chemically synthesized
cttaggaggaactactttaa

SEQ ID NO: 107295 - DNA, 20 bp, Artificial Sequence
  chemically synthesized
ctattaaagtagttcctcct

SEQ ID NO: 107296 - DNA, 20 bp, Artificial Sequence
  chemically synthesized
tattaaagtagttcctccta

SEQ ID NO: 107297 - DNA, 20 bp, Artificial Sequence
  chemically synthesized
ttaaagtagttcctcctaag

SEQ ID NO: 107298 - DNA, 20 bp, Artificial Sequence
  chemically synthesized
gttgagataaactccttagg

SEQ ID NO: 107299 - DNA, 20 bp, Artificial Sequence
  chemically synthesized
ggttgagataaactccttag

SEQ ID NO: 107300 - DNA, 20 bp, Artificial Sequence
  chemically synthesized
ctggttgagataaactcctt

SEQ ID NO: 107301 - DNA, 20 bp, Artificial Sequence
  chemically synthesized
actggttgagataaactcct

SEQ ID NO: 107302 - DNA, 20 bp, Artificial Sequence
  chemically synthesized
cctaaggagtttatctcaac

SEQ ID NO: 107303 - DNA, 20 bp, Artificial Sequence
  chemically synthesized
tgaatggaaattcactggtt

SEQ ID NO: 107304 - DNA, 20 bp, Artificial Sequence
  chemically synthesized
aaggctgaatggaaattcac

SEQ ID NO: 107305 - DNA, 20 bp, Artificial Sequence
  chemically synthesized
tcaaccagtgaatttccatt

SEQ ID NO: 107306 - DNA, 20 bp, Artificial Sequence
  chemically synthesized
gtcaagtgttaaaggctgaa

SEQ ID NO: 107307 - DNA, 20 bp, Artificial Sequence
  chemically synthesized
gcatttgagtcaagtgttaa

SEQ ID NO: 107308 - DNA, 20 bp, Artificial Sequence
  chemically synthesized
ggcatttgagtcaagtgtta

SEQ ID NO: 107309 - DNA, 20 bp, Artificial Sequence
  chemically synthesized
gaggaggtggcatttgagtc

SEQ ID NO: 107310 - DNA, 20 bp, Artificial Sequence
  chemically synthesized
tagaggaggaggtggcattt

SEQ ID NO: 107311 - DNA, 20 bp, Artificial Sequence
  chemically synthesized
aggctttttagaggaggagg

SEQ ID NO: 107312 - DNA, 20 bp, Artificial Sequence
  chemically synthesized
gcaaggctttttagaggagg

SEQ ID NO: 107313 - DNA, 20 bp, Artificial Sequence
  chemically synthesized
ggcaaggctttttagaggag

SEQ ID NO: 107314 - DNA, 20 bp, Artificial Sequence
  chemically synthesized
caggcaaggctttttagagg

SEQ ID NO: 107315 - DNA, 20 bp, Artificial Sequence
  chemically synthesized
atgccacctcctcctctaaa

SEQ ID NO: 107316 - DNA, 20 bp, Artificial Sequence
  chemically synthesized
ccaggcaaggctttttagag

SEQ ID NO: 107317 - DNA, 20 bp, Artificial Sequence
  chemically synthesized
gaccaggcaaggctttttag

SEQ ID NO: 107318 - DNA, 20 bp, Artificial Sequence
  chemically synthesized
ggaccaggcaaggcttttta

SEQ ID NO: 107319 - DNA, 20 bp, Artificial Sequence
  chemically synthesized
taggaccaggcaaggctttt

SEQ ID NO: 107320 - DNA, 20 bp, Artificial Sequence
  chemically synthesized
ctcctctaaaaagccttgcc

SEQ ID NO: 107321 - DNA, 20 bp, Artificial Sequence
  chemically synthesized
ctgcccaataggaccaggca

SEQ ID NO: 107322 - DNA, 20 bp, Artificial Sequence
  chemically synthesized
actgcccaataggaccaggc

SEQ ID NO: 107323 - DNA, 20 bp, Artificial Sequence
  chemically synthesized
gataactgcccaataggacc

SEQ ID NO: 107324 - DNA, 20 bp, Artificial Sequence
  chemically synthesized
aaagccttgcctggtcctat

SEQ ID NO: 107325 - DNA, 20 bp, Artificial Sequence
  chemically synthesized
ggataactgcccaataggac

SEQ ID NO: 107326 - DNA, 20 bp, Artificial Sequence
  chemically synthesized
aagccttgcctggtcctatt

SEQ ID NO: 107327 - DNA, 20 bp, Artificial Sequence
  chemically synthesized
ccttgcctggtcctattggg

SEQ ID NO: 107328 - DNA, 20 bp, Artificial Sequence
  chemically synthesized
gcagtggataactgcccaat

SEQ ID NO: 107329 - DNA, 20 bp, Artificial Sequence
  chemically synthesized
tgcagtggataactgcccaa

SEQ ID NO: 107330 - DNA, 20 bp, Artificial Sequence
  chemically synthesized
tgctctaggagaatatgcag

SEQ ID NO: 107331 - DNA, 20 bp, Artificial Sequence
  chemically synthesized
taatgctctaggagaatatg

SEQ ID NO: 107332 - DNA, 20 bp, Artificial Sequence
  chemically synthesized
ttatccactgcatattctcc

SEQ ID NO: 107333 - DNA, 20 bp, Artificial Sequence
  chemically synthesized
atccactgcatattctccta

SEQ ID NO: 107334 - DNA, 20 bp, Artificial Sequence
  chemically synthesized
tataaggcataatgctctag

SEQ ID NO: 107335 - DNA, 20 bp, Artificial Sequence
  chemically synthesized
tatataaggcataatgctct

SEQ ID NO: 107336 - DNA, 20 bp, Artificial Sequence
  chemically synthesized
atatataaggcataatgctc

SEQ ID NO: 107337 - DNA, 20 bp, Artificial Sequence
  chemically synthesized
caataagagaaatatatata

SEQ ID NO: 107338 - DNA, 20 bp, Artificial Sequence
  chemically synthesized
tcaataagagaaatatatat

SEQ ID NO: 107339 - DNA, 20 bp, Artificial Sequence
  chemically synthesized
agcgaggagaaattcaataa

SEQ ID NO: 107340 - DNA, 20 bp, Artificial Sequence
  chemically synthesized
acagcgaggagaaattcaat

SEQ ID NO: 107341 - DNA, 20 bp, Artificial Sequence
  chemically synthesized
ctctagtttgggacagcgag

SEQ ID NO: 107342 - DNA, 20 bp, Artificial Sequence
  chemically synthesized
cactctagtttgggacagcg

SEQ ID NO: 107343 - DNA, 20 bp, Artificial Sequence
  chemically synthesized
acactctagtttgggacagc

SEQ ID NO: 107344 - DNA, 20 bp, Artificial Sequence
  chemically synthesized
gcacacactctagtttggga

SEQ ID NO: 107345 - DNA, 20 bp, Artificial Sequence
  chemically synthesized
ttctcctcgctgtcccaaac

SEQ ID NO: 107346 - DNA, 20 bp, Artificial Sequence
  chemically synthesized
ctcctcgctgtcccaaacta

SEQ ID NO: 107347 - DNA, 20 bp, Artificial Sequence
  chemically synthesized
ggaagcacacactctagttt

SEQ ID NO: 107348 - DNA, 20 bp, Artificial Sequence
  chemically synthesized
aggaagcacacactctagtt

SEQ ID NO: 107349 - DNA, 20 bp, Artificial Sequence
  chemically synthesized
ttgtcaggaagcacacactc

SEQ ID NO: 107350 - DNA, 20 bp, Artificial Sequence
  chemically synthesized
acttcagccatgttgtcagg

SEQ ID NO: 107351 - DNA, 20 bp, Artificial Sequence
  chemically synthesized
gtgtgtgcttcctgacaaca

SEQ ID NO: 107352 - DNA, 20 bp, Artificial Sequence
  chemically synthesized
ttgacttcagccatgttgtc

SEQ ID NO: 107353 - DNA, 20 bp, Artificial Sequence
  chemically synthesized
gttgacttcagccatgttgt

SEQ ID NO: 107354 - DNA, 20 bp, Artificial Sequence
  chemically synthesized
gcttcctgacaacatggctg

SEQ ID NO: 107355 - DNA, 20 bp, Artificial Sequence
  chemically synthesized
agtaagactcaggttgactt

SEQ ID NO: 107356 - DNA, 20 bp, Artificial Sequence
  chemically synthesized
aacatggctgaagtcaacct

SEQ ID NO: 107357 - DNA, 20 bp, Artificial Sequence
  chemically synthesized
tacagagattagtaagactc

SEQ ID NO: 107358 - DNA, 20 bp, Artificial Sequence
  chemically synthesized
atacagagattagtaagact

SEQ ID NO: 107359 - DNA, 20 bp, Artificial Sequence
  chemically synthesized
ttgataatacagagattagt

SEQ ID NO: 107360 - DNA, 20 bp, Artificial Sequence
  chemically synthesized
gtcattgataatacagagat

SEQ ID NO: 107361 - DNA, 20 bp, Artificial Sequence
  chemically synthesized
gactagtcattgataataca

SEQ ID NO: 107362 - DNA, 20 bp, Artificial Sequence
  chemically synthesized
tggactagtcattgataata

SEQ ID NO: 107363 - DNA, 20 bp, Artificial Sequence
  chemically synthesized
atctctgtattatcaatgac

SEQ ID NO: 107364 - DNA, 20 bp, Artificial Sequence
  chemically synthesized
tgtattatcaatgactagtc

SEQ ID NO: 107365 - DNA, 20 bp, Artificial Sequence
  chemically synthesized
ttatatgttgggcactggac

SEQ ID NO: 107366 - DNA, 20 bp, Artificial Sequence
  chemically synthesized
gtctattatatgttgggcac

SEQ ID NO: 107367 - DNA, 20 bp, Artificial Sequence
  chemically synthesized
ttggatgtctattatatgtt

SEQ ID NO: 107368 - DNA, 20 bp, Artificial Sequence
  chemically synthesized
tttggatgtctattatatgt

SEQ ID NO: 107369 - DNA, 20 bp, Artificial Sequence
  chemically synthesized
gtccagtgcccaacatataa

SEQ ID NO: 107370 - DNA, 20 bp, Artificial Sequence
  chemically synthesized
cctggaatatatgcacattt

SEQ ID NO: 107371 - DNA, 20 bp, Artificial Sequence
  chemically synthesized
tccaaaatgtgcatatattc

SEQ ID NO: 107372 - DNA, 20 bp, Artificial Sequence
  chemically synthesized
ccaaaatgtgcatatattcc

SEQ ID NO: 107373 - DNA, 20 bp, Artificial Sequence
  chemically synthesized
taccatctcattgagaaacc

SEQ ID NO: 107374 - DNA, 20 bp, Artificial Sequence
  chemically synthesized
tatattccaggtttctcaat

SEQ ID NO: 107375 - DNA, 20 bp, Artificial Sequence
  chemically synthesized
ttccaggtttctcaatgaga

SEQ ID NO: 107376 - DNA, 20 bp, Artificial Sequence
  chemically synthesized
aatattaataccatctcatt

SEQ ID NO: 107377 - DNA, 20 bp, Artificial Sequence
  chemically synthesized
gtattaatattgccaaatat

SEQ ID NO: 107378 - DNA, 20 bp, Artificial Sequence
  chemically synthesized
tattaatattgccaaatatt

SEQ ID NO: 107379 - DNA, 20 bp, Artificial Sequence
  chemically synthesized
agtacactatacctaatatt

SEQ ID NO: 107380 - DNA, 20 bp, Artificial Sequence
  chemically synthesized
atattgccaaatattaggta

SEQ ID NO: 107381 - DNA, 20 bp, Artificial Sequence
  chemically synthesized
attaggtatagtgtacttaa

SEQ ID NO: 107382 - DNA, 20 bp, Artificial Sequence
  chemically synthesized
ttttaactagacatactgtt

SEQ ID NO: 107383 - DNA, 20 bp, Artificial Sequence
  chemically synthesized
agtgtacttaacagtatgtc

SEQ ID NO: 107384 - DNA, 20 bp, Artificial Sequence
  chemically synthesized
gaatatatgtatgttttaac

SEQ ID NO: 107385 - DNA, 20 bp, Artificial Sequence
  chemically synthesized
aaatttaaactacatatatg

SEQ ID NO: 107386 - DNA, 20 bp, Artificial Sequence
  chemically synthesized
acatatattctacatatatg

SEQ ID NO: 107387 - DNA, 20 bp, Artificial Sequence
  chemically synthesized
atatgtagtttaaatttctc

SEQ ID NO: 107388 - DNA, 20 bp, Artificial Sequence
  chemically synthesized
tgtagtttaaatttctctag

SEQ ID NO: 107389 - DNA, 20 bp, Artificial Sequence
  chemically synthesized
gtagtttaaatttctctagt

SEQ ID NO: 107390 - DNA, 20 bp, Artificial Sequence
  chemically synthesized
tttttttactgtgcctacta

SEQ ID NO: 107391 - DNA, 20 bp, Artificial Sequence
  chemically synthesized
ttaaatttctctagtaggca

SEQ ID NO: 107392 - DNA, 20 bp, Artificial Sequence
  chemically synthesized
tttttttttactgtgcctac

SEQ ID NO: 107393 - DNA, 20 bp, Artificial Sequence
  chemically synthesized
tagtaggcacagtaaaaaaa

SEQ ID NO: 107394 - DNA, 20 bp, Artificial Sequence
  chemically synthesized
atatatatagaatatatatg

SEQ ID NO: 107395 - DNA, 20 bp, Artificial Sequence
  chemically synthesized
tatatatatatatatatata

SEQ ID NO: 107396 - DNA, 20 bp, Artificial Sequence
  chemically synthesized
tatatatatatatatatata

SEQ ID NO: 107397 - DNA, 20 bp, Artificial Sequence
  chemically synthesized
atatatatatatatggcaca

SEQ ID NO: 107398 - DNA, 20 bp, Artificial Sequence
  chemically synthesized
gcacatagaaatattttaat

SEQ ID NO: 107399 - DNA, 20 bp, Artificial Sequence
  chemically synthesized
cacatagaaatattttaatg

SEQ ID NO: 107400 - DNA, 20 bp, Artificial Sequence
  chemically synthesized
tttaatgaggaatttgatga

SEQ ID NO: 107401 - DNA, 20 bp, Artificial Sequence
  chemically synthesized
gttattaaatcattgaaaat

SEQ ID NO: 107402 - DNA, 20 bp, Artificial Sequence
  chemically synthesized
ttttcaatgatttaataacc

SEQ ID NO: 107403 - DNA, 20 bp, Artificial Sequence
  chemically synthesized
tctctaattaaaaattgact

SEQ ID NO: 107404 - DNA, 20 bp, Artificial Sequence
  chemically synthesized
taaccaagtcaatttttaat

SEQ ID NO: 107405 - DNA, 20 bp, Artificial Sequence
  chemically synthesized
accaagtcaatttttaatta

SEQ ID NO: 107406 - DNA, 20 bp, Artificial Sequence
  chemically synthesized
tttaattagagacaatttat

SEQ ID NO: 107407 - DNA, 20 bp, Artificial Sequence
  chemically synthesized
aagtaaaaattgaccttgaa

SEQ ID NO: 107408 - DNA, 20 bp, Artificial Sequence
  chemically synthesized
tgtgtgtgagacacttttca

SEQ ID NO: 107409 - DNA, 20 bp, Artificial Sequence
  chemically synthesized
gtgtgtgtgagacacttttc

SEQ ID NO: 107410 - DNA, 20 bp, Artificial Sequence
  chemically synthesized
ctttgtgtgtgtgtgtgtgt

SEQ ID NO: 107411 - DNA, 20 bp, Artificial Sequence
  chemically synthesized
ctcacacacacacacacaca

SEQ ID NO: 107412 - DNA, 20 bp, Artificial Sequence
  chemically synthesized
acacacacacaaagacataa

SEQ ID NO: 107413 - DNA, 20 bp, Artificial Sequence
  chemically synthesized
aagacataatggaataataa

SEQ ID NO: 107414 - DNA, 20 bp, Artificial Sequence
  chemically synthesized
tggaataataaaagaccttc

SEQ ID NO: 107415 - DNA, 20 bp, Artificial Sequence
  chemically synthesized
tatttaatttggtgactaga

SEQ ID NO: 107416 - DNA, 20 bp, Artificial Sequence
  chemically synthesized
atatttaatttggtgactag

SEQ ID NO: 107417 - DNA, 20 bp, Artificial Sequence
  chemically synthesized
caaatatttaatttggtgac

SEQ ID NO: 107418 - DNA, 20 bp, Artificial Sequence
  chemically synthesized
tagaagacaaatatttaatt

SEQ ID NO: 107419 - DNA, 20 bp, Artificial Sequence
  chemically synthesized
atcgaagtgattgcatttag

SEQ ID NO: 107420 - DNA, 20 bp, Artificial Sequence
  chemically synthesized
gtaatcgaagtgattgcatt

SEQ ID NO: 107421 - DNA, 20 bp, Artificial Sequence
  chemically synthesized
cctttcagcaaacgtaatcg

SEQ ID NO: 107422 - DNA, 20 bp, Artificial Sequence
  chemically synthesized
acttcgattacgtttgctga

SEQ ID NO: 107423 - DNA, 20 bp, Artificial Sequence
  chemically synthesized
cttcgattacgtttgctgaa

SEQ ID NO: 107424 - DNA, 20 bp, Artificial Sequence
  chemically synthesized
agagccttgggtaatccttt

SEQ ID NO: 107425 - DNA, 20 bp, Artificial Sequence
  chemically synthesized
gtttgctgaaaggattaccc

SEQ ID NO: 107426 - DNA, 20 bp, Artificial Sequence
  chemically synthesized
tttgctgaaaggattaccca

SEQ ID NO: 107427 - DNA, 20 bp, Artificial Sequence
  chemically synthesized
tgtagcaaaaaaagagcctt

SEQ ID NO: 107428 - DNA, 20 bp, Artificial Sequence
  chemically synthesized
ttgtagcaaaaaaagagcct

SEQ ID NO: 107429 - DNA, 20 bp, Artificial Sequence
  chemically synthesized
aaataattgtagcaaaaaaa

SEQ ID NO: 107430 - DNA, 20 bp, Artificial Sequence
  chemically synthesized
ttaaataattgtagcaaaaa

SEQ ID NO: 107431 - DNA, 20 bp, Artificial Sequence
  chemically synthesized
tgagtataattaaataattg

SEQ ID NO: 107432 - DNA, 20 bp, Artificial Sequence
  chemically synthesized
caattatttaattatactca

SEQ ID NO: 107433 - DNA, 20 bp, Artificial Sequence
  chemically synthesized
tacaaatgagtcaaaaccat

SEQ ID NO: 107434 - DNA, 20 bp, Artificial Sequence
  chemically synthesized
tcagatgggcatttacaaat

SEQ ID NO: 107435 - DNA, 20 bp, Artificial Sequence
  chemically synthesized
tcatttgtaaatgcccatct

SEQ ID NO: 107436 - DNA, 20 bp, Artificial Sequence
  chemically synthesized
catttgtaaatgcccatctg

SEQ ID NO: 107437 - DNA, 20 bp, Artificial Sequence
  chemically synthesized
ggattaataaaacctcagat

SEQ ID NO: 107438 - DNA, 20 bp, Artificial Sequence
  chemically synthesized
aggattaataaaacctcaga

SEQ ID NO: 107439 - DNA, 20 bp, Artificial Sequence
  chemically synthesized
gagcaggattaataaaacct

SEQ ID NO: 107440 - DNA, 20 bp, Artificial Sequence
  chemically synthesized
gtcaacatatagtaatgagc

SEQ ID NO: 107441 - DNA, 20 bp, Artificial Sequence
  chemically synthesized
ggtcaacatatagtaatgag

SEQ ID NO: 107442 - DNA, 20 bp, Artificial Sequence
  chemically synthesized
ctgggtcaacatatagtaat

SEQ ID NO: 107443 - DNA, 20 bp, Artificial Sequence
  chemically synthesized
caatagactgggtcaacata

SEQ ID NO: 107444 - DNA, 20 bp, Artificial Sequence
  chemically synthesized
ctcattactatatgttgacc

SEQ ID NO: 107445 - DNA, 20 bp, Artificial Sequence
  chemically synthesized
agatgagatcacaatagact

SEQ ID NO: 107446 - DNA, 20 bp, Artificial Sequence
  chemically synthesized
gagatgagatcacaatagac

SEQ ID NO: 107447 - DNA, 20 bp, Artificial Sequence
  chemically synthesized
ccttagagatgagatcacaa

SEQ ID NO: 107448 - DNA, 20 bp, Artificial Sequence
  chemically synthesized
tctattgtgatctcatctct

SEQ ID NO: 107449 - DNA, 20 bp, Artificial Sequence
  chemically synthesized
ctattgtgatctcatctcta

SEQ ID NO: 107450 - DNA, 20 bp, Artificial Sequence
  chemically synthesized
gctcataaaaccttagagat

SEQ ID NO: 107451 - DNA, 20 bp, Artificial Sequence
  chemically synthesized
gctgtgctcataaaacctta

SEQ ID NO: 107452 - DNA, 20 bp, Artificial Sequence
  chemically synthesized
aggctgtgctcataaaacct

SEQ ID NO: 107453 - DNA, 20 bp, Artificial Sequence
  chemically synthesized
tctcatctctaaggttttat

SEQ ID NO: 107454 - DNA, 20 bp, Artificial Sequence
  chemically synthesized
tctctaaggttttatgagca

SEQ ID NO: 107455 - DNA, 20 bp, Artificial Sequence
  chemically synthesized
tggaaaatttcatgaatatc

SEQ ID NO: 107456 - DNA, 20 bp, Artificial Sequence
  chemically synthesized
ctggaaaatttcatgaatat

SEQ ID NO: 107457 - DNA, 20 bp, Artificial Sequence
  chemically synthesized
ctgatattcatgaaattttc

SEQ ID NO: 107458 - DNA, 20 bp, Artificial Sequence
  chemically synthesized
tgatattcatgaaattttcc

SEQ ID NO: 107459 - DNA, 20 bp, Artificial Sequence
  chemically synthesized
gatattcatgaaattttcca

SEQ ID NO: 107460 - DNA, 20 bp, Artificial Sequence
  chemically synthesized
atattcatgaaattttccag

SEQ ID NO: 107461 - DNA, 20 bp, Artificial Sequence
  chemically synthesized
cagaaatttttacaaacccc

SEQ ID NO: 107462 - DNA, 20 bp, Artificial Sequence
  chemically synthesized
caggggtttgtaaaaatttc

SEQ ID NO: 107463 - DNA, 20 bp, Artificial Sequence
  chemically synthesized
aggggtttgtaaaaatttct

SEQ ID NO: 107464 - DNA, 20 bp, Artificial Sequence
  chemically synthesized
cctttaataatatgatcacc

SEQ ID NO: 107465 - DNA, 20 bp, Artificial Sequence
  chemically synthesized
tctgggtgatcatattatta

SEQ ID NO: 107466 - DNA, 20 bp, Artificial Sequence
  chemically synthesized
ctgggtgatcatattattaa

SEQ ID NO: 107467 - DNA, 20 bp, Artificial Sequence
  chemically synthesized
ggtgatcatattattaaagg

SEQ ID NO: 107468 - DNA, 20 bp, Artificial Sequence
  chemically synthesized
gatatgtttattttcgagaa

SEQ ID NO: 107469 - DNA, 20 bp, Artificial Sequence
  chemically synthesized
gaaaagatatgtttattttc

SEQ ID NO: 107470 - DNA, 20 bp, Artificial Sequence
  chemically synthesized
gtatttggcattgtaatgaa

SEQ ID NO: 107471 - DNA, 20 bp, Artificial Sequence
  chemically synthesized
ccctcccacgatcatgtatt

SEQ ID NO: 107472 - DNA, 20 bp, Artificial Sequence
  chemically synthesized
caatgccaaatacatgatcg

SEQ ID NO: 107473 - DNA, 20 bp, Artificial Sequence
  chemically synthesized
aatgccaaatacatgatcgt

SEQ ID NO: 107474 - DNA, 20 bp, Artificial Sequence
  chemically synthesized
tgccaaatacatgatcgtgg

SEQ ID NO: 107475 - DNA, 20 bp, Artificial Sequence
  chemically synthesized
gccaaatacatgatcgtggg

SEQ ID NO: 107476 - DNA, 20 bp, Artificial Sequence
  chemically synthesized
ccaaatacatgatcgtggga

SEQ ID NO: 107477 - DNA, 20 bp, Artificial Sequence
  chemically synthesized
catgatcgtgggagggatca

SEQ ID NO: 107478 - DNA, 20 bp, Artificial Sequence
  chemically synthesized
gatcgtgggagggatcaaag

SEQ ID NO: 107479 - DNA, 20 bp, Artificial Sequence
  chemically synthesized
aaagaagtgtgtacatgatt

SEQ ID NO: 107480 - DNA, 20 bp, Artificial Sequence
  chemically synthesized
acatgatttagctgctcaac

SEQ ID NO: 107481 - DNA, 20 bp, Artificial Sequence
  chemically synthesized
gagtaattaaaccagttgag

SEQ ID NO: 107482 - DNA, 20 bp, Artificial Sequence
  chemically synthesized
gttgagtaattaaaccagtt

SEQ ID NO: 107483 - DNA, 20 bp, Artificial Sequence
  chemically synthesized
aaagtgttgagtaattaaac

SEQ ID NO: 107484 - DNA, 20 bp, Artificial Sequence
  chemically synthesized
tcttcatagctaaaagtgtt

SEQ ID NO: 107485 - DNA, 20 bp, Artificial Sequence
  chemically synthesized
gtttaattactcaacacttt

SEQ ID NO: 107486 - DNA, 20 bp, Artificial Sequence
  chemically synthesized
taaactctcttcatagctaa

SEQ ID NO: 107487 - DNA, 20 bp, Artificial Sequence
  chemically synthesized
actcaacacttttagctatg

SEQ ID NO: 107488 - DNA, 20 bp, Artificial Sequence
  chemically synthesized
tcaacacttttagctatgaa

SEQ ID NO: 107489 - DNA, 20 bp, Artificial Sequence
  chemically synthesized
aacacttttagctatgaaga

SEQ ID NO: 107490 - DNA, 20 bp, Artificial Sequence
  chemically synthesized
aatggtctaaactctcttca

SEQ ID NO: 107491 - DNA, 20 bp, Artificial Sequence
  chemically synthesized
ttttagctatgaagagagtt

SEQ ID NO: 107492 - DNA, 20 bp, Artificial Sequence
  chemically synthesized
gagagtttagaccattataa

SEQ ID NO: 107493 - DNA, 20 bp, Artificial Sequence
  chemically synthesized
aaaatctaggactattataa

SEQ ID NO: 107494 - DNA, 20 bp, Artificial Sequence
  chemically synthesized
ttagaccattataatagtcc

SEQ ID NO: 107495 - DNA, 20 bp, Artificial Sequence
  chemically synthesized
attataagaataaaaaatct

SEQ ID NO: 107496 - DNA, 20 bp, Artificial Sequence
  chemically synthesized
aattataagaataaaaaatc

SEQ ID NO: 107497 - DNA, 20 bp, Artificial Sequence
  chemically synthesized
taaatatggatataaattat

SEQ ID NO: 107498 - DNA, 20 bp, Artificial Sequence
  chemically synthesized
ttataatttatatccatatt

SEQ ID NO: 107499 - DNA, 20 bp, Artificial Sequence
  chemically synthesized
ataatttatatccatattta

SEQ ID NO: 107500 - DNA, 20 bp, Artificial Sequence
  chemically synthesized
agtaaccaatgctctaaata

SEQ ID NO: 107501 - DNA, 20 bp, Artificial Sequence
  chemically synthesized
tatatccatatttagagcat

SEQ ID NO: 107502 - DNA, 20 bp, Artificial Sequence
  chemically synthesized
ccctttatatatttcaacat

SEQ ID NO: 107503 - DNA, 20 bp, Artificial Sequence
  chemically synthesized
tactcatgttgaaatatata

SEQ ID NO: 107504 - DNA, 20 bp, Artificial Sequence
  chemically synthesized
actcatgttgaaatatataa

SEQ ID NO: 107505 - DNA, 20 bp, Artificial Sequence
  chemically synthesized
ctcatgttgaaatatataaa

SEQ ID NO: 107506 - DNA, 20 bp, Artificial Sequence
  chemically synthesized
ttgaaatatataaagggttg

SEQ ID NO: 107507 - DNA, 20 bp, Artificial Sequence
  chemically synthesized
aaatatataaagggttgaag

SEQ ID NO: 107508 - DNA, 20 bp, Artificial Sequence
  chemically synthesized
taaagggttgaagaagttat

SEQ ID NO: 107509 - DNA, 20 bp, Artificial Sequence
  chemically synthesized
aaagggttgaagaagttata

SEQ ID NO: 107510 - DNA, 20 bp, Artificial Sequence
  chemically synthesized
aagggttgaagaagttataa

SEQ ID NO: 107511 - DNA, 20 bp, Artificial Sequence
  chemically synthesized
tataagggatcatatttctc

SEQ ID NO: 107512 - DNA, 20 bp, Artificial Sequence
  chemically synthesized
atcatctggagtaaaatctg

SEQ ID NO: 107513 - DNA, 20 bp, Artificial Sequence
  chemically synthesized
agatcatctggagtaaaatc

SEQ ID NO: 107514 - DNA, 20 bp, Artificial Sequence
  chemically synthesized
tatttctccagattttactc

SEQ ID NO: 107515 - DNA, 20 bp, Artificial Sequence
  chemically synthesized
cttactctgaagatcatctg

SEQ ID NO: 107516 - DNA, 20 bp, Artificial Sequence
  chemically synthesized
gacttactctgaagatcatc

SEQ ID NO: 107517 - DNA, 20 bp, Artificial Sequence
  chemically synthesized
attttactccagatgatctt

SEQ ID NO: 107518 - DNA, 20 bp, Artificial Sequence
  chemically synthesized
tttactccagatgatcttca

SEQ ID NO: 107519 - DNA, 20 bp, Artificial Sequence
  chemically synthesized
ctccagatgatcttcagagt

SEQ ID NO: 107520 - DNA, 20 bp, Artificial Sequence
  chemically synthesized
ttacaaattgacttactctg

SEQ ID NO: 107521 - DNA, 20 bp, Artificial Sequence
  chemically synthesized
gtcaatttgtaaaccgcata

SEQ ID NO: 107522 - DNA, 20 bp, Artificial Sequence
  chemically synthesized
acttttagattttctatatg

SEQ ID NO: 107523 - DNA, 20 bp, Artificial Sequence
  chemically synthesized
accgcatatagaaaatctaa

SEQ ID NO: 107524 - DNA, 20 bp, Artificial Sequence
  chemically synthesized
gcatatagaaaatctaaaag

SEQ ID NO: 107525 - DNA, 20 bp, Artificial Sequence
  chemically synthesized
gcaataaaaatttccacttt

SEQ ID NO: 107526 - DNA, 20 bp, Artificial Sequence
  chemically synthesized
ttttctcctctgtaatacgg

SEQ ID NO: 107527 - DNA, 20 bp, Artificial Sequence
  chemically synthesized
tttttattgcctccgtatta

SEQ ID NO: 107528 - DNA, 20 bp, Artificial Sequence
  chemically synthesized
attttctcctctgtaatacg

SEQ ID NO: 107529 - DNA, 20 bp, Artificial Sequence
  chemically synthesized
tttattgcctccgtattaca

SEQ ID NO: 107530 - DNA, 20 bp, Artificial Sequence
  chemically synthesized
ccattttctcctctgtaata

SEQ ID NO: 107531 - DNA, 20 bp, Artificial Sequence
  chemically synthesized
ttattgcctccgtattacag

SEQ ID NO: 107532 - DNA, 20 bp, Artificial Sequence
  chemically synthesized
attgcctccgtattacagag

SEQ ID NO: 107533 - DNA, 20 bp, Artificial Sequence
  chemically synthesized
ccgtattacagaggagaaaa

SEQ ID NO: 107534 - DNA, 20 bp, Artificial Sequence
  chemically synthesized
tattacagaggagaaaatgg

SEQ ID NO: 107535 - DNA, 20 bp, Artificial Sequence
  chemically synthesized
gaggagaaaatggtggcaca

SEQ ID NO: 107536 - DNA, 20 bp, Artificial Sequence
  chemically synthesized
aaaatggtggcacacagttt

SEQ ID NO: 107537 - DNA, 20 bp, Artificial Sequence
  chemically synthesized
acacagtttaagtaatttgc

SEQ ID NO: 107538 - DNA, 20 bp, Artificial Sequence
  chemically synthesized
cacagtttaagtaatttgcc

SEQ ID NO: 107539 - DNA, 20 bp, Artificial Sequence
  chemically synthesized
acagtttaagtaatttgcca

SEQ ID NO: 107540 - DNA, 20 bp, Artificial Sequence
  chemically synthesized
accagctacctttatgaccc

SEQ ID NO: 107541 - DNA, 20 bp, Artificial Sequence
  chemically synthesized
agtaatttgccagggtcata

SEQ ID NO: 107542 - DNA, 20 bp, Artificial Sequence
  chemically synthesized
gtaatttgccagggtcataa

SEQ ID NO: 107543 - DNA, 20 bp, Artificial Sequence
  chemically synthesized
atttgccagggtcataaagg

SEQ ID NO: 107544 - DNA, 20 bp, Artificial Sequence
  chemically synthesized
gccagggtcataaaggtagc

SEQ ID NO: 107545 - DNA, 20 bp, Artificial Sequence
  chemically synthesized
ggtcataaaggtagctggta

SEQ ID NO: 107546 - DNA, 20 bp, Artificial Sequence
  chemically synthesized
aaccccctccaagtctttac

SEQ ID NO: 107547 - DNA, 20 bp, Artificial Sequence
  chemically synthesized
aaaggtagctggtaaagact

SEQ ID NO: 107548 - DNA, 20 bp, Artificial Sequence
  chemically synthesized
aggtagctggtaaagacttg

SEQ ID NO: 107549 - DNA, 20 bp, Artificial Sequence
  chemically synthesized
ggtagctggtaaagacttgg

SEQ ID NO: 107550 - DNA, 20 bp, Artificial Sequence
  chemically synthesized
gtagctggtaaagacttgga

SEQ ID NO: 107551 - DNA, 20 bp, Artificial Sequence
  chemically synthesized
tagctggtaaagacttggag

SEQ ID NO: 107552 - DNA, 20 bp, Artificial Sequence
  chemically synthesized
agctggtaaagacttggagg

SEQ ID NO: 107553 - DNA, 20 bp, Artificial Sequence
  chemically synthesized
cttgggtttaaaccccctcc

SEQ ID NO: 107554 - DNA, 20 bp, Artificial Sequence
  chemically synthesized
cttggagggggtttaaaccc

SEQ ID NO: 107555 - DNA, 20 bp, Artificial Sequence
  chemically synthesized
attctatagctacagagctt

SEQ ID NO: 107556 - DNA, 20 bp, Artificial Sequence
  chemically synthesized
gggtttaaacccaagctctg

SEQ ID NO: 107557 - DNA, 20 bp, Artificial Sequence
  chemically synthesized
gattctatagctacagagct

SEQ ID NO: 107558 - DNA, 20 bp, Artificial Sequence
  chemically synthesized
tggaagattctatagctaca

SEQ ID NO: 107559 - DNA, 20 bp, Artificial Sequence
  chemically synthesized
aaacccaagctctgtagcta

SEQ ID NO: 107560 - DNA, 20 bp, Artificial Sequence
  chemically synthesized
gttggaagattctatagcta

SEQ ID NO: 107561 - DNA, 20 bp, Artificial Sequence
  chemically synthesized
tatccagttggaagattcta

SEQ ID NO: 107562 - DNA, 20 bp, Artificial Sequence
  chemically synthesized
tagctatagaatcttccaac

SEQ ID NO: 107563 - DNA, 20 bp, Artificial Sequence
  chemically synthesized
tttgtctagtatccagttgg

SEQ ID NO: 107564 - DNA, 20 bp, Artificial Sequence
  chemically synthesized
tgttttgtctagtatccagt

SEQ ID NO: 107565 - DNA, 20 bp, Artificial Sequence
  chemically synthesized
agaatcttccaactggatac

SEQ ID NO: 107566 - DNA, 20 bp, Artificial Sequence
  chemically synthesized
cttttgttttgtctagtatc

SEQ ID NO: 107567 - DNA, 20 bp, Artificial Sequence
  chemically synthesized
ctgggaacttttgttttgtc

SEQ ID NO: 107568 - DNA, 20 bp, Artificial Sequence
  chemically synthesized
ctggatactagacaaaacaa

SEQ ID NO: 107569 - DNA, 20 bp, Artificial Sequence
  chemically synthesized
ctagacaaaacaaaagttcc

SEQ ID NO: 107570 - DNA, 20 bp, Artificial Sequence
  chemically synthesized
agacaaaacaaaagttccca

SEQ ID NO: 107571 - DNA, 20 bp, Artificial Sequence
  chemically synthesized
ctaatgtgcagcgaagctct

SEQ ID NO: 107572 - DNA, 20 bp, Artificial Sequence
  chemically synthesized
tctaatgtgcagcgaagctc

SEQ ID NO: 107573 - DNA, 20 bp, Artificial Sequence
  chemically synthesized
gctcaatctaatgtgcagcg

SEQ ID NO: 107574 - DNA, 20 bp, Artificial Sequence
  chemically synthesized
cccagagcttcgctgcacat

SEQ ID NO: 107575 - DNA, 20 bp, Artificial Sequence
  chemically synthesized
actcagctcaatctaatgtg

SEQ ID NO: 107576 - DNA, 20 bp, Artificial Sequence
  chemically synthesized
gcttcgctgcacattagatt

SEQ ID NO: 107577 - DNA, 20 bp, Artificial Sequence
  chemically synthesized
gctgcacattagattgagct

SEQ ID NO: 107578 - DNA, 20 bp, Artificial Sequence
  chemically synthesized
gcacattagattgagctgag

SEQ ID NO: 107579 - DNA, 20 bp, Artificial Sequence
  chemically synthesized
cataattcttacaaactact

SEQ ID NO: 107580 - DNA, 20 bp, Artificial Sequence
  chemically synthesized
gattgagctgagtagtttgt

SEQ ID NO: 107581 - DNA, 20 bp, Artificial Sequence
  chemically synthesized
ttgtaagaattatgatgccc

SEQ ID NO: 107582 - DNA, 20 bp, Artificial Sequence
  chemically synthesized
attggtgttctgtgggactt

SEQ ID NO: 107583 - DNA, 20 bp, Artificial Sequence
  chemically synthesized
attatgatgcccaagtccca

SEQ ID NO: 107584 - DNA, 20 bp, Artificial Sequence
  chemically synthesized
tattggtgttctgtgggact

SEQ ID NO: 107585 - DNA, 20 bp, Artificial Sequence
  chemically synthesized
ttattttattggtgttctgt

SEQ ID NO: 107586 - DNA, 20 bp, Artificial Sequence
  chemically synthesized
tttattttattggtgttctg

SEQ ID NO: 107587 - DNA, 20 bp, Artificial Sequence
  chemically synthesized
tcctgagagttttattttat

SEQ ID NO: 107588 - DNA, 20 bp, Artificial Sequence
  chemically synthesized
caccaataaaataaaactct

SEQ ID NO: 107589 - DNA, 20 bp, Artificial Sequence
  chemically synthesized
accaataaaataaaactctc

SEQ ID NO: 107590 - DNA, 20 bp, Artificial Sequence
  chemically synthesized
gttttcacaagatttcctga

SEQ ID NO: 107591 - DNA, 20 bp, Artificial Sequence
  chemically synthesized
tggttttcacaagatttcct

SEQ ID NO: 107592 - DNA, 20 bp, Artificial Sequence
  chemically synthesized
tttgaaactttggttttcac

SEQ ID NO: 107593 - DNA, 20 bp, Artificial Sequence
  chemically synthesized
aggaaatcttgtgaaaacca

SEQ ID NO: 107594 - DNA, 20 bp, Artificial Sequence
  chemically synthesized
gtttcattcttttgaaactt

SEQ ID NO: 107595 - DNA, 20 bp, Artificial Sequence
  chemically synthesized
tgtgaaaaccaaagtttcaa

SEQ ID NO: 107596 - DNA, 20 bp, Artificial Sequence
  chemically synthesized
ctttgagcatcaattgagta

SEQ ID NO: 107597 - DNA, 20 bp, Artificial Sequence
  chemically synthesized
atacactttgagcatcaatt

SEQ ID NO: 107598 - DNA, 20 bp, Artificial Sequence
  chemically synthesized
ctttactcaattgatgctca

SEQ ID NO: 107599 - DNA, 20 bp, Artificial Sequence
  chemically synthesized
atcttaacaaaatacacttt

SEQ ID NO: 107600 - DNA, 20 bp, Artificial Sequence
  chemically synthesized
tgctcaaagtgtattttgtt

SEQ ID NO: 107601 - DNA, 20 bp, Artificial Sequence
  chemically synthesized
gaggctcaaatgacattttc

SEQ ID NO: 107602 - DNA, 20 bp, Artificial Sequence
  chemically synthesized
tgtacttgaaaatgtcattt

SEQ ID NO: 107603 - DNA, 20 bp, Artificial Sequence
  chemically synthesized
tgtaaacaatcagataagag

SEQ ID NO: 107604 - DNA, 20 bp, Artificial Sequence
  chemically synthesized
ctgtaaacaatcagataaga

SEQ ID NO: 107605 - DNA, 20 bp, Artificial Sequence
  chemically synthesized
ctctgtaaacaatcagataa

SEQ ID NO: 107606 - DNA, 20 bp, Artificial Sequence
  chemically synthesized
tgctctgtaaacaatcagat

SEQ ID NO: 107607 - DNA, 20 bp, Artificial Sequence
  chemically synthesized
ctttttgctctgtaaacaat

SEQ ID NO: 107608 - DNA, 20 bp, Artificial Sequence
  chemically synthesized
ctctcttatctgattgttta

SEQ ID NO: 107609 - DNA, 20 bp, Artificial Sequence
  chemically synthesized
ctcttatctgattgtttaca

SEQ ID NO: 107610 - DNA, 20 bp, Artificial Sequence
  chemically synthesized
ctgattgtttacagagcaaa

SEQ ID NO: 107611 - DNA, 20 bp, Artificial Sequence
  chemically synthesized
cagagcaaaaagaaaaaaaa

SEQ ID NO: 107612 - DNA, 20 bp, Artificial Sequence
  chemically synthesized
ttttgggttttatcagaagt

SEQ ID NO: 107613 - DNA, 20 bp, Artificial Sequence
  chemically synthesized
tagtttttgggttttatcag

SEQ ID NO: 107614 - DNA, 20 bp, Artificial Sequence
  chemically synthesized
tcatagtttttgggttttat

SEQ ID NO: 107615 - DNA, 20 bp, Artificial Sequence
  chemically synthesized
gggaattcttcatagttttt

SEQ ID NO: 107616 - DNA, 20 bp, Artificial Sequence
  chemically synthesized
ggggaattcttcatagtttt

SEQ ID NO: 107617 - DNA, 20 bp, Artificial Sequence
  chemically synthesized
gataaaacccaaaaactatg

SEQ ID NO: 107618 - DNA, 20 bp, Artificial Sequence
  chemically synthesized
gaggcatggggaattcttca

SEQ ID NO: 107619 - DNA, 20 bp, Artificial Sequence
  chemically synthesized
tacttttatgacgaggcatg

SEQ ID NO: 107620 - DNA, 20 bp, Artificial Sequence
  chemically synthesized
ctacttttatgacgaggcat

SEQ ID NO: 107621 - DNA, 20 bp, Artificial Sequence
  chemically synthesized
gctacttttatgacgaggca

SEQ ID NO: 107622 - DNA, 20 bp, Artificial Sequence
  chemically synthesized
aaaaagctacttttatgacg

SEQ ID NO: 107623 - DNA, 20 bp, Artificial Sequence
  chemically synthesized
ttccccatgcctcgtcataa

SEQ ID NO: 107624 - DNA, 20 bp, Artificial Sequence
  chemically synthesized
gaaaaagctacttttatgac

SEQ ID NO: 107625 - DNA, 20 bp, Artificial Sequence
  chemically synthesized
cccatgcctcgtcataaaag

SEQ ID NO: 107626 - DNA, 20 bp, Artificial Sequence
  chemically synthesized
aatctataaagtcgaggaaa

SEQ ID NO: 107627 - DNA, 20 bp, Artificial Sequence
  chemically synthesized
aaataaaatctataaagtcg

SEQ ID NO: 107628 - DNA, 20 bp, Artificial Sequence
  chemically synthesized
tagctttttcctcgacttta

SEQ ID NO: 107629 - DNA, 20 bp, Artificial Sequence
  chemically synthesized
caaataaaatctataaagtc

SEQ ID NO: 107630 - DNA, 20 bp, Artificial Sequence
  chemically synthesized
aaaatcaaataaaatctata

SEQ ID NO: 107631 - DNA, 20 bp, Artificial Sequence
  chemically synthesized
ttttatttgattttaaattt

SEQ ID NO: 107632 - DNA, 20 bp, Artificial Sequence
  chemically synthesized
gccaaatacacatgaaaatg

SEQ ID NO: 107633 - DNA, 20 bp, Artificial Sequence
  chemically synthesized
tccacattttcatgtgtatt

SEQ ID NO: 107634 - DNA, 20 bp, Artificial Sequence
  chemically synthesized
gtgtatttggccctcaaacc

SEQ ID NO: 107635 - DNA, 20 bp, Artificial Sequence
  chemically synthesized
aaattacatgcttggtttga

SEQ ID NO: 107636 - DNA, 20 bp, Artificial Sequence
  chemically synthesized
taaattacatgcttggtttg

SEQ ID NO: 107637 - DNA, 20 bp, Artificial Sequence
  chemically synthesized
ttaaattacatgcttggttt

SEQ ID NO: 107638 - DNA, 20 bp, Artificial Sequence
  chemically synthesized
aattttttaaattacatgct

SEQ ID NO: 107639 - DNA, 20 bp, Artificial Sequence
  chemically synthesized
aattacataagaaaaagtat

SEQ ID NO: 107640 - DNA, 20 bp, Artificial Sequence
  chemically synthesized
aactctaattacataagaaa

SEQ ID NO: 107641 - DNA, 20 bp, Artificial Sequence
  chemically synthesized
catactttttcttatgtaat

SEQ ID NO: 107642 - DNA, 20 bp, Artificial Sequence
  chemically synthesized
atttttaactctaattacat

SEQ ID NO: 107643 - DNA, 20 bp, Artificial Sequence
  chemically synthesized
tactttttcttatgtaatta

SEQ ID NO: 107644 - DNA, 20 bp, Artificial Sequence
  chemically synthesized
agagttaaaaatcattgtta

SEQ ID NO: 107645 - DNA, 20 bp, Artificial Sequence
  chemically synthesized
ttacaataatattcattata

SEQ ID NO: 107646 - DNA, 20 bp, Artificial Sequence
  chemically synthesized
atataatgaatattattgta

SEQ ID NO: 107647 - DNA, 20 bp, Artificial Sequence
  chemically synthesized
cttatattagtatattaatt

SEQ ID NO: 107648 - DNA, 20 bp, Artificial Sequence
  chemically synthesized
gcttatattagtatattaat

SEQ ID NO: 107649 - DNA, 20 bp, Artificial Sequence
  chemically synthesized
cctaattaatatactaatat

SEQ ID NO: 107650 - DNA, 20 bp, Artificial Sequence
  chemically synthesized
aactttataagagcttatat

SEQ ID NO: 107651 - DNA, 20 bp, Artificial Sequence
  chemically synthesized
tactaatataagctcttata

SEQ ID NO: 107652 - DNA, 20 bp, Artificial Sequence
  chemically synthesized
taattatttgaactttataa

SEQ ID NO: 107653 - DNA, 20 bp, Artificial Sequence
  chemically synthesized
tttaattatttgaactttat

SEQ ID NO: 107654 - DNA, 20 bp, Artificial Sequence
  chemically synthesized
ttatattatcaacatttcat

SEQ ID NO: 107655 - DNA, 20 bp, Artificial Sequence
  chemically synthesized
tggaagagcttttaattatt

SEQ ID NO: 107656 - DNA, 20 bp, Artificial Sequence
  chemically synthesized
aaaacacactaaataattaa

SEQ ID NO: 107657 - DNA, 20 bp, Artificial Sequence
  chemically synthesized
gtcatttttgcatggtggaa

SEQ ID NO: 107658 - DNA, 20 bp, Artificial Sequence
  chemically synthesized
tagtcatttttgcatggtgg

SEQ ID NO: 107659 - DNA, 20 bp, Artificial Sequence
  chemically synthesized
gtttagtcatttttgcatgg

SEQ ID NO: 107660 - DNA, 20 bp, Artificial Sequence
  chemically synthesized
atcgtttagtcatttttgca

SEQ ID NO: 107661 - DNA, 20 bp, Artificial Sequence
  chemically synthesized
ttagaaattaaaaaatcgtt

SEQ ID NO: 107662 - DNA, 20 bp, Artificial Sequence
  chemically synthesized
aaacgattttttaatttcta

SEQ ID NO: 107663 - DNA, 20 bp, Artificial Sequence
  chemically synthesized
acagtaatctcaaaaagctt

SEQ ID NO: 107664 - DNA, 20 bp, Artificial Sequence
  chemically synthesized
tttaatttctaaagcttttt

SEQ ID NO: 107665 - DNA, 20 bp, Artificial Sequence
  chemically synthesized
cctttcacagtaatctcaaa

SEQ ID NO: 107666 - DNA, 20 bp, Artificial Sequence
  chemically synthesized
gctttttgagattactgtga

SEQ ID NO: 107667 - DNA, 20 bp, Artificial Sequence
  chemically synthesized
ctttttgagattactgtgaa

SEQ ID NO: 107668 - DNA, 20 bp, Artificial Sequence
  chemically synthesized
tttttgagattactgtgaaa

SEQ ID NO: 107669 - DNA, 20 bp, Artificial Sequence
  chemically synthesized
ttttgagattactgtgaaag

SEQ ID NO: 107670 - DNA, 20 bp, Artificial Sequence
  chemically synthesized
tgaaactatgtcccctttca

SEQ ID NO: 107671 - DNA, 20 bp, Artificial Sequence
  chemically synthesized
gattactgtgaaaggggaca

SEQ ID NO: 107672 - DNA, 20 bp, Artificial Sequence
  chemically synthesized
tgtgaaaggggacatagttt

SEQ ID NO: 107673 - DNA, 20 bp, Artificial Sequence
  chemically synthesized
gtgaaaggggacatagtttc

SEQ ID NO: 107674 - DNA, 20 bp, Artificial Sequence
  chemically synthesized
aaggggacatagtttcagga

SEQ ID NO: 107675 - DNA, 20 bp, Artificial Sequence
  chemically synthesized
aggggacatagtttcaggaa

SEQ ID NO: 107676 - DNA, 20 bp, Artificial Sequence
  chemically synthesized
gacatagtttcaggaaaggt

SEQ ID NO: 107677 - DNA, 20 bp, Artificial Sequence
  chemically synthesized
aaggtgagtaaacactatat

SEQ ID NO: 107678 - DNA, 20 bp, Artificial Sequence
  chemically synthesized
tgagaaatgctagtctaata

SEQ ID NO: 107679 - DNA, 20 bp, Artificial Sequence
  chemically synthesized
gagtaaacactatattagac

SEQ ID NO: 107680 - DNA, 20 bp, Artificial Sequence
  chemically synthesized
gtataaaaattgagaaatgc

SEQ ID NO: 107681 - DNA, 20 bp, Artificial Sequence
  chemically synthesized
atgtcagtagtataaaaatt

SEQ ID NO: 107682 - DNA, 20 bp, Artificial Sequence
  chemically synthesized
tatttaggccaaaatgtcag

SEQ ID NO: 107683 - DNA, 20 bp, Artificial Sequence
  chemically synthesized
tttttatactactgacattt

SEQ ID NO: 107684 - DNA, 20 bp, Artificial Sequence
  chemically synthesized
aattatttaggccaaaatgt

SEQ ID NO: 107685 - DNA, 20 bp, Artificial Sequence
  chemically synthesized
ccctccacaaggaattattt

SEQ ID NO: 107686 - DNA, 20 bp, Artificial Sequence
  chemically synthesized
gccctccacaaggaattatt

SEQ ID NO: 107687 - DNA, 20 bp, Artificial Sequence
  chemically synthesized
ttggcctaaataattccttg

SEQ ID NO: 107688 - DNA, 20 bp, Artificial Sequence
  chemically synthesized
ggcctaaataattccttgtg

SEQ ID NO: 107689 - DNA, 20 bp, Artificial Sequence
  chemically synthesized
gcctaaataattccttgtgg

SEQ ID NO: 107690 - DNA, 20 bp, Artificial Sequence
  chemically synthesized
cctaaataattccttgtgga

SEQ ID NO: 107691 - DNA, 20 bp, Artificial Sequence
  chemically synthesized
gcataggatagccctccaca

SEQ ID NO: 107692 - DNA, 20 bp, Artificial Sequence
  chemically synthesized
tgcataggatagccctccac

SEQ ID NO: 107693 - DNA, 20 bp, Artificial Sequence
  chemically synthesized
atatcctacaatgcatagga

SEQ ID NO: 107694 - DNA, 20 bp, Artificial Sequence
  chemically synthesized
taaaatatcctacaatgcat

SEQ ID NO: 107695 - DNA, 20 bp, Artificial Sequence
  chemically synthesized
gagggctatcctatgcattg

SEQ ID NO: 107696 - DNA, 20 bp, Artificial Sequence
  chemically synthesized
ataaaatatcctacaatgca

SEQ ID NO: 107697 - DNA, 20 bp, Artificial Sequence
  chemically synthesized
agggctatcctatgcattgt

SEQ ID NO: 107698 - DNA, 20 bp, Artificial Sequence
  chemically synthesized
aggatattttataccatatc

SEQ ID NO: 107699 - DNA, 20 bp, Artificial Sequence
  chemically synthesized
tagtgggtagaggccagata

SEQ ID NO: 107700 - DNA, 20 bp, Artificial Sequence
  chemically synthesized
gaagtctagtgggtagaggc

SEQ ID NO: 107701 - DNA, 20 bp, Artificial Sequence
  chemically synthesized
aactgaagtctagtgggtag

SEQ ID NO: 107702 - DNA, 20 bp, Artificial Sequence
  chemically synthesized
catatctggcctctacccac

SEQ ID NO: 107703 - DNA, 20 bp, Artificial Sequence
  chemically synthesized
caactgaagtctagtgggta

SEQ ID NO: 107704 - DNA, 20 bp, Artificial Sequence
  chemically synthesized
tacaactgaagtctagtggg

SEQ ID NO: 107705 - DNA, 20 bp, Artificial Sequence
  chemically synthesized
agatacaactgaagtctagt

SEQ ID NO: 107706 - DNA, 20 bp, Artificial Sequence
  chemically synthesized
gagatacaactgaagtctag

SEQ ID NO: 107707 - DNA, 20 bp, Artificial Sequence
  chemically synthesized
ggcctctacccactagactt

SEQ ID NO: 107708 - DNA, 20 bp, Artificial Sequence
  chemically synthesized
ttggagatacaactgaagtc

SEQ ID NO: 107709 - DNA, 20 bp, Artificial Sequence
  chemically synthesized
ctggattggagatacaactg

SEQ ID NO: 107710 - DNA, 20 bp, Artificial Sequence
  chemically synthesized
cttcagttgtatctccaatc

SEQ ID NO: 107711 - DNA, 20 bp, Artificial Sequence
  chemically synthesized
taattattattactggattg

SEQ ID NO: 107712 - DNA, 20 bp, Artificial Sequence
  chemically synthesized
tttaattattattactggat

SEQ ID NO: 107713 - DNA, 20 bp, Artificial Sequence
  chemically synthesized
gcatttttaattattattac

SEQ ID NO: 107714 - DNA, 20 bp, Artificial Sequence
  chemically synthesized
ataataattaaaaatgcctc

SEQ ID NO: 107715 - DNA, 20 bp, Artificial Sequence
  chemically synthesized
ggacatttagcaatatctgg

SEQ ID NO: 107716 - DNA, 20 bp, Artificial Sequence
  chemically synthesized
tggacatttagcaatatctg

SEQ ID NO: 107717 - DNA, 20 bp, Artificial Sequence
  chemically synthesized
agtggacatttagcaatatc

SEQ ID NO: 107718 - DNA, 20 bp, Artificial Sequence
  chemically synthesized
acctccaccaagtggacatt

SEQ ID NO: 107719 - DNA, 20 bp, Artificial Sequence
  chemically synthesized
gatattgctaaatgtccact

SEQ ID NO: 107720 - DNA, 20 bp, Artificial Sequence
  chemically synthesized
attgctaaatgtccacttgg

SEQ ID NO: 107721 - DNA, 20 bp, Artificial Sequence
  chemically synthesized
tgctaaatgtccacttggtg

SEQ ID NO: 107722 - DNA, 20 bp, Artificial Sequence
  chemically synthesized
atatttttacctccaccaag

SEQ ID NO: 107723 - DNA, 20 bp, Artificial Sequence
  chemically synthesized
gctaaatgtccacttggtgg

SEQ ID NO: 107724 - DNA, 20 bp, Artificial Sequence
  chemically synthesized
gggatatttttacctccacc

SEQ ID NO: 107725 - DNA, 20 bp, Artificial Sequence
  chemically synthesized
gttctcaaaatggggggcgg

SEQ ID NO: 107726 - DNA, 20 bp, Artificial Sequence
  chemically synthesized
ggttctcaaaatggggggcg

SEQ ID NO: 107727 - DNA, 20 bp, Artificial Sequence
  chemically synthesized
tggttctcaaaatggggggc

SEQ ID NO: 107728 - DNA, 20 bp, Artificial Sequence
  chemically synthesized
atggttctcaaaatgggggg

SEQ ID NO: 107729 - DNA, 20 bp, Artificial Sequence
  chemically synthesized
gcaatggttctcaaaatggg

SEQ ID NO: 107730 - DNA, 20 bp, Artificial Sequence
  chemically synthesized
tatcccccgccccccatttt

SEQ ID NO: 107731 - DNA, 20 bp, Artificial Sequence
  chemically synthesized
tgcaatggttctcaaaatgg

SEQ ID NO: 107732 - DNA, 20 bp, Artificial Sequence
  chemically synthesized
ttgcaatggttctcaaaatg

SEQ ID NO: 107733 - DNA, 20 bp, Artificial Sequence
  chemically synthesized
attgcaatggttctcaaaat

SEQ ID NO: 107734 - DNA, 20 bp, Artificial Sequence
  chemically synthesized
tattgcaatggttctcaaaa

SEQ ID NO: 107735 - DNA, 20 bp, Artificial Sequence
  chemically synthesized
cattttgagaaccattgcaa

SEQ ID NO: 107736 - DNA, 20 bp, Artificial Sequence
  chemically synthesized
agctaatttgtctattgcaa

SEQ ID NO: 107737 - DNA, 20 bp, Artificial Sequence
  chemically synthesized
aaccattgcaatagacaaat

SEQ ID NO: 107738 - DNA, 20 bp, Artificial Sequence
  chemically synthesized
ttgcaatagacaaattagct

SEQ ID NO: 107739 - DNA, 20 bp, Artificial Sequence
  chemically synthesized
gcaatagacaaattagctca

SEQ ID NO: 107740 - DNA, 20 bp, Artificial Sequence
  chemically synthesized
tttagagatgacataactct

SEQ ID NO: 107741 - DNA, 20 bp, Artificial Sequence
  chemically synthesized
tgtttatgctaagttgttta

SEQ ID NO: 107742 - DNA, 20 bp, Artificial Sequence
  chemically synthesized
tatgtcatctctaaacaact

SEQ ID NO: 107743 - DNA, 20 bp, Artificial Sequence
  chemically synthesized
tttgtttatgctaagttgtt

SEQ ID NO: 107744 - DNA, 20 bp, Artificial Sequence
  chemically synthesized
ttctctagtttgtttatgct

SEQ ID NO: 107745 - DNA, 20 bp, Artificial Sequence
  chemically synthesized
acaacttagcataaacaaac

SEQ ID NO: 107746 - DNA, 20 bp, Artificial Sequence
  chemically synthesized
aacttagcataaacaaacta

SEQ ID NO: 107747 - DNA, 20 bp, Artificial Sequence
  chemically synthesized
ttagcataaacaaactagag

SEQ ID NO: 107748 - DNA, 20 bp, Artificial Sequence
  chemically synthesized
agaagtcgaaagggcttctc

SEQ ID NO: 107749 - DNA, 20 bp, Artificial Sequence
  chemically synthesized
cttcagaccagaagtcgaaa

SEQ ID NO: 107750 - DNA, 20 bp, Artificial Sequence
  chemically synthesized
tcttcagaccagaagtcgaa

SEQ ID NO: 107751 - DNA, 20 bp, Artificial Sequence
  chemically synthesized
ttcttcagaccagaagtcga

SEQ ID NO: 107752 - DNA, 20 bp, Artificial Sequence
  chemically synthesized
agagaagccctttcgacttc

SEQ ID NO: 107753 - DNA, 20 bp, Artificial Sequence
  chemically synthesized
cgcagaattcttcagaccag

SEQ ID NO: 107754 - DNA, 20 bp, Artificial Sequence
  chemically synthesized
ccctttcgacttctggtctg

SEQ ID NO: 107755 - DNA, 20 bp, Artificial Sequence
  chemically synthesized
acacgcagaattcttcagac

SEQ ID NO: 107756 - DNA, 20 bp, Artificial Sequence
  chemically synthesized
tatagacacgcagaattctt

SEQ ID NO: 107757 - DNA, 20 bp, Artificial Sequence
  chemically synthesized
aaacttgtattatagacacg

SEQ ID NO: 107758 - DNA, 20 bp, Artificial Sequence
  chemically synthesized
attctgcgtgtctataatac

SEQ ID NO: 107759 - DNA, 20 bp, Artificial Sequence
  chemically synthesized
tatcaattaaacttgtatta

SEQ ID NO: 107760 - DNA, 20 bp, Artificial Sequence
  chemically synthesized
agtttaattgatatgtacct

SEQ ID NO: 107761 - DNA, 20 bp, Artificial Sequence
  chemically synthesized
atatcagctgataataactt

SEQ ID NO: 107762 - DNA, 20 bp, Artificial Sequence
  chemically synthesized
tatatcagctgataataact

SEQ ID NO: 107763 - DNA, 20 bp, Artificial Sequence
  chemically synthesized
atatgtacctaagttattat

SEQ ID NO: 107764 - DNA, 20 bp, Artificial Sequence
  chemically synthesized
agcatcacaaattgttatat

SEQ ID NO: 107765 - DNA, 20 bp, Artificial Sequence
  chemically synthesized
catttttttgatgattcaga

SEQ ID NO: 107766 - DNA, 20 bp, Artificial Sequence
  chemically synthesized
acaacatttttttgatgatt

SEQ ID NO: 107767 - DNA, 20 bp, Artificial Sequence
  chemically synthesized
aaaatgttgtttgaatgctt

SEQ ID NO: 107768 - DNA, 20 bp, Artificial Sequence
  chemically synthesized
caaaacacattaagcatctt

SEQ ID NO: 107769 - DNA, 20 bp, Artificial Sequence
  chemically synthesized
actgtattacaaaacacatt

SEQ ID NO: 107770 - DNA, 20 bp, Artificial Sequence
  chemically synthesized
gcttaatgtgttttgtaata

SEQ ID NO: 107771 - DNA, 20 bp, Artificial Sequence
  chemically synthesized
atacagtatactaaaaacct

SEQ ID NO: 107772 - DNA, 20 bp, Artificial Sequence
  chemically synthesized
ttaatgatttccaaggtttt

SEQ ID NO: 107773 - DNA, 20 bp, Artificial Sequence
  chemically synthesized
cagttaattaatgatttcca

SEQ ID NO: 107774 - DNA, 20 bp, Artificial Sequence
  chemically synthesized
tcagttaattaatgatttcc

SEQ ID NO: 107775 - DNA, 20 bp, Artificial Sequence
  chemically synthesized
tggaaatcattaattaactg

SEQ ID NO: 107776 - DNA, 20 bp, Artificial Sequence
  chemically synthesized
ctatcaaaattatatggctt

SEQ ID NO: 107777 - DNA, 20 bp, Artificial Sequence
  chemically synthesized
accaaactatcaaaattata

SEQ ID NO: 107778 - DNA, 20 bp, Artificial Sequence
  chemically synthesized
ctgaagccatataattttga

SEQ ID NO: 107779 - DNA, 20 bp, Artificial Sequence
  chemically synthesized
gccatataattttgatagtt

SEQ ID NO: 107780 - DNA, 20 bp, Artificial Sequence
  chemically synthesized
aattttgatagtttggttac

SEQ ID NO: 107781 - DNA, 20 bp, Artificial Sequence
  chemically synthesized
attttgatagtttggttact

SEQ ID NO: 107782 - DNA, 20 bp, Artificial Sequence
  chemically synthesized
acagattagattaaagtgcc

SEQ ID NO: 107783 - DNA, 20 bp, Artificial Sequence
  chemically synthesized
aagatttacagattagatta

SEQ ID NO: 107784 - DNA, 20 bp, Artificial Sequence
  chemically synthesized
ctattggaagatttacagat

SEQ ID NO: 107785 - DNA, 20 bp, Artificial Sequence
  chemically synthesized
gaaatctattggaagattta

SEQ ID NO: 107786 - DNA, 20 bp, Artificial Sequence
  chemically synthesized
ctaatctgtaaatcttccaa

SEQ ID NO: 107787 - DNA, 20 bp, Artificial Sequence
  chemically synthesized
tgagtttggaaatctattgg

SEQ ID NO: 107788 - DNA, 20 bp, Artificial Sequence
  chemically synthesized
ttctgagtttggaaatctat

SEQ ID NO: 107789 - DNA, 20 bp, Artificial Sequence
  chemically synthesized
ttccaatagatttccaaact

SEQ ID NO: 107790 - DNA, 20 bp, Artificial Sequence
  chemically synthesized
caggatgaaaattctgagtt

SEQ ID NO: 107791 - DNA, 20 bp, Artificial Sequence
  chemically synthesized
cagagcaggatgaaaattct

SEQ ID NO: 107792 - DNA, 20 bp, Artificial Sequence
  chemically synthesized
aaagattaaccaatcagagc

SEQ ID NO: 107793 - DNA, 20 bp, Artificial Sequence
  chemically synthesized
aattttcatcctgctctgat

SEQ ID NO: 107794 - DNA, 20 bp, Artificial Sequence
  chemically synthesized
caaagattaaccaatcagag

SEQ ID NO: 107795 - DNA, 20 bp, Artificial Sequence
  chemically synthesized
caccaaagattaaccaatca

SEQ ID NO: 107796 - DNA, 20 bp, Artificial Sequence
  chemically synthesized
cccaccaaagattaaccaat

SEQ ID NO: 107797 - DNA, 20 bp, Artificial Sequence
  chemically synthesized
tgctctgattggttaatctt

SEQ ID NO: 107798 - DNA, 20 bp, Artificial Sequence
  chemically synthesized
tctgattggttaatctttgg

SEQ ID NO: 107799 - DNA, 20 bp, Artificial Sequence
  chemically synthesized
ctgattggttaatctttggt

SEQ ID NO: 107800 - DNA, 20 bp, Artificial Sequence
  chemically synthesized
ataaatggtaaatcccacca

SEQ ID NO: 107801 - DNA, 20 bp, Artificial Sequence
  chemically synthesized
attataatgcaatggataaa

SEQ ID NO: 107802 - DNA, 20 bp, Artificial Sequence
  chemically synthesized
agcaaataattataatgcaa

SEQ ID NO: 107803 - DNA, 20 bp, Artificial Sequence
  chemically synthesized
tgtctttatatgataaggca

SEQ ID NO: 107804 - DNA, 20 bp, Artificial Sequence
  chemically synthesized
aattttgtctttatatgata

SEQ ID NO: 107805 - DNA, 20 bp, Artificial Sequence
  chemically synthesized
caattttgtctttatatgat

SEQ ID NO: 107806 - DNA, 20 bp, Artificial Sequence
  chemically synthesized
ttgctgtgccttatcatata

SEQ ID NO: 107807 - DNA, 20 bp, Artificial Sequence
  chemically synthesized
ttatcatataaagacaaaat

SEQ ID NO: 107808 - DNA, 20 bp, Artificial Sequence
  chemically synthesized
tatcatataaagacaaaatt

SEQ ID NO: 107809 - DNA, 20 bp, Artificial Sequence
  chemically synthesized
tataaagacaaaattgggtg

SEQ ID NO: 107810 - DNA, 20 bp, Artificial Sequence
  chemically synthesized
taaagacaaaattgggtgtg

SEQ ID NO: 107811 - DNA, 20 bp, Artificial Sequence
  chemically synthesized
agacaaaattgggtgtggag

SEQ ID NO: 107812 - DNA, 20 bp, Artificial Sequence
  chemically synthesized
tgatatgccctggaaagtat

SEQ ID NO: 107813 - DNA, 20 bp, Artificial Sequence
  chemically synthesized
gagtagttgcccatactttc

SEQ ID NO: 107814 - DNA, 20 bp, Artificial Sequence
  chemically synthesized
atgatatgccctggaaagta

SEQ ID NO: 107815 - DNA, 20 bp, Artificial Sequence
  chemically synthesized
agtagttgcccatactttcc

SEQ ID NO: 107816 - DNA, 20 bp, Artificial Sequence
  chemically synthesized
gtagttgcccatactttcca

SEQ ID NO: 107817 - DNA, 20 bp, Artificial Sequence
  chemically synthesized
tctcaatgatatgccctgga

SEQ ID NO: 107818 - DNA, 20 bp, Artificial Sequence
  chemically synthesized
tgggtctcaatgatatgccc

SEQ ID NO: 107819 - DNA, 20 bp, Artificial Sequence
  chemically synthesized
actttccagggcatatcatt

SEQ ID NO: 107820 - DNA, 20 bp, Artificial Sequence
  chemically synthesized
atatcattgagacccacact

SEQ ID NO: 107821 - DNA, 20 bp, Artificial Sequence
  chemically synthesized
cataataacctactgagtgt

SEQ ID NO: 107822 - DNA, 20 bp, Artificial Sequence
  chemically synthesized
tcattgagacccacactcag

SEQ ID NO: 107823 - DNA, 20 bp, Artificial Sequence
  chemically synthesized
acataataacctactgagtg

SEQ ID NO: 107824 - DNA, 20 bp, Artificial Sequence
  chemically synthesized
cattgagacccacactcagt

SEQ ID NO: 107825 - DNA, 20 bp, Artificial Sequence
  chemically synthesized
aaagaacataataacctact

SEQ ID NO: 107826 - DNA, 20 bp, Artificial Sequence
  chemically synthesized
taggttattatgttctttaa

SEQ ID NO: 107827 - DNA, 20 bp, Artificial Sequence
  chemically synthesized
cttcaatgtgtaaaccatta

SEQ ID NO: 107828 - DNA, 20 bp, Artificial Sequence
  chemically synthesized
ctttaatggtttacacattg

SEQ ID NO: 107829 - DNA, 20 bp, Artificial Sequence
  chemically synthesized
tttaatggtttacacattga

SEQ ID NO: 107830 - DNA, 20 bp, Artificial Sequence
  chemically synthesized
ttaatggtttacacattgaa

SEQ ID NO: 107831 - DNA, 20 bp, Artificial Sequence
  chemically synthesized
atggtttacacattgaaggg

SEQ ID NO: 107832 - DNA, 20 bp, Artificial Sequence
  chemically synthesized
agggggtatagtttcaggaa

SEQ ID NO: 107833 - DNA, 20 bp, Artificial Sequence
  chemically synthesized
aagggggtatagtttcagga

SEQ ID NO: 107834 - DNA, 20 bp, Artificial Sequence
  chemically synthesized
gtgaaagggggtatagtttc

SEQ ID NO: 107835 - DNA, 20 bp, Artificial Sequence
  chemically synthesized
tgtgaaagggggtatagttt

SEQ ID NO: 107836 - DNA, 20 bp, Artificial Sequence
  chemically synthesized
gattactgtgaaagggggta

SEQ ID NO: 107837 - DNA, 20 bp, Artificial Sequence
  chemically synthesized
tgaaactataccccctttca

SEQ ID NO: 107838 - DNA, 20 bp, Artificial Sequence
  chemically synthesized
tttgagattactgtgaaagg

SEQ ID NO: 107839 - DNA, 20 bp, Artificial Sequence
  chemically synthesized
ttttgagattactgtgaaag

SEQ ID NO: 107840 - DNA, 20 bp, Artificial Sequence
  chemically synthesized
tttttgagattactgtgaaa

SEQ ID NO: 107841 - DNA, 20 bp, Artificial Sequence
  chemically synthesized
ctttttgagattactgtgaa

SEQ ID NO: 107842 - DNA, 20 bp, Artificial Sequence
  chemically synthesized
gctttttgagattactgtga

SEQ ID NO: 107843 - DNA, 20 bp, Artificial Sequence
  chemically synthesized
cctttcacagtaatctcaaa

SEQ ID NO: 107844 - DNA, 20 bp, Artificial Sequence
  chemically synthesized
gttaatttctaaggcttttt

SEQ ID NO: 107845 - DNA, 20 bp, Artificial Sequence
  chemically synthesized
acagtaatctcaaaaagcct

SEQ ID NO: 107846 - DNA, 20 bp, Artificial Sequence
  chemically synthesized
aaataaattgttaatttcta

SEQ ID NO: 107847 - DNA, 20 bp, Artificial Sequence
  chemically synthesized
taaataaattgttaatttct

SEQ ID NO: 107848 - DNA, 20 bp, Artificial Sequence
  chemically synthesized
ttagaaattaacaatttatt

SEQ ID NO: 107849 - DNA, 20 bp, Artificial Sequence
  chemically synthesized
tttatttagtcatttttgca

SEQ ID NO: 107850 - DNA, 20 bp, Artificial Sequence
  chemically synthesized
atttagtcatttttgcacgg

SEQ ID NO: 107851 - DNA, 20 bp, Artificial Sequence
  chemically synthesized
tagtcatttttgcacggtgg

SEQ ID NO: 107852 - DNA, 20 bp, Artificial Sequence
  chemically synthesized
gtcatttttgcacggtggaa

SEQ ID NO: 107853 - DNA, 20 bp, Artificial Sequence
  chemically synthesized
taattatttgtactttataa

SEQ ID NO: 107854 - DNA, 20 bp, Artificial Sequence
  chemically synthesized
tactaatgtaagctattata

SEQ ID NO: 107855 - DNA, 20 bp, Artificial Sequence
  chemically synthesized
tactttataatagcttacat

SEQ ID NO: 107856 - DNA, 20 bp, Artificial Sequence
  chemically synthesized
aaatcctaatatactaatgt

SEQ ID NO: 107857 - DNA, 20 bp, Artificial Sequence
  chemically synthesized
aatagcttacattagtatat

SEQ ID NO: 107858 - DNA, 20 bp, Artificial Sequence
  chemically synthesized
atagcttacattagtatatt

SEQ ID NO: 107859 - DNA, 20 bp, Artificial Sequence
  chemically synthesized
ataacatttaatatgcttta

SEQ ID NO: 107860 - DNA, 20 bp, Artificial Sequence
  chemically synthesized
acatttaatatgctttatag

SEQ ID NO: 107861 - DNA, 20 bp, Artificial Sequence
  chemically synthesized
acataacaaatactactata

SEQ ID NO: 107862 - DNA, 20 bp, Artificial Sequence
  chemically synthesized
ttatagtagtatttgttatg

SEQ ID NO: 107863 - DNA, 20 bp, Artificial Sequence
  chemically synthesized
taagtgagcttttaacaatg

SEQ ID NO: 107864 - DNA, 20 bp, Artificial Sequence
  chemically synthesized
ttaagtgagcttttaacaat

SEQ ID NO: 107865 - DNA, 20 bp, Artificial Sequence
  chemically synthesized
aatatttgcctcattgttaa

SEQ ID NO: 107866 - DNA, 20 bp, Artificial Sequence
  chemically synthesized
ttatgtcaaaacatttaagt

SEQ ID NO: 107867 - DNA, 20 bp, Artificial Sequence
  chemically synthesized
gagcttatgtcaaaacattt

SEQ ID NO: 107868 - DNA, 20 bp, Artificial Sequence
  chemically synthesized
tcacttaaatgttttgacat

SEQ ID NO: 107869 - DNA, 20 bp, Artificial Sequence
  chemically synthesized
ttaatattttcaaattatgt

SEQ ID NO: 107870 - DNA, 20 bp, Artificial Sequence
  chemically synthesized
tcacataatttgaaaatatt

SEQ ID NO: 107871 - DNA, 20 bp, Artificial Sequence
  chemically synthesized
ttgaaaatattaagaatttg

SEQ ID NO: 107872 - DNA, 20 bp, Artificial Sequence
  chemically synthesized
atattaagaatttgaagcta

SEQ ID NO: 107873 - DNA, 20 bp, Artificial Sequence
  chemically synthesized
attaatgttttcaaattcta

SEQ ID NO: 107874 - DNA, 20 bp, Artificial Sequence
  chemically synthesized
ttaatgcattgaattccata

SEQ ID NO: 107875 - DNA, 20 bp, Artificial Sequence
  chemically synthesized
atgcattgaattccatatgg

SEQ ID NO: 107876 - DNA, 20 bp, Artificial Sequence
  chemically synthesized
taaacagactttcttccata

SEQ ID NO: 107877 - DNA, 20 bp, Artificial Sequence
  chemically synthesized
attgaattccatatggaaga

SEQ ID NO: 107878 - DNA, 20 bp, Artificial Sequence
  chemically synthesized
catatggaagaaagtctgtt

SEQ ID NO: 107879 - DNA, 20 bp, Artificial Sequence
  chemically synthesized
ggaagaaagtctgtttagtt

SEQ ID NO: 107880 - DNA, 20 bp, Artificial Sequence
  chemically synthesized
attgaagtccctcaactaaa

SEQ ID NO: 107881 - DNA, 20 bp, Artificial Sequence
  chemically synthesized
gaagaaagtctgtttagttg

SEQ ID NO: 107882 - DNA, 20 bp, Artificial Sequence
  chemically synthesized
aagaaagtctgtttagttga

SEQ ID NO: 107883 - DNA, 20 bp, Artificial Sequence
  chemically synthesized
tggaaaatggaagcatattg

SEQ ID NO: 107884 - DNA, 20 bp, Artificial Sequence
  chemically synthesized
tcttcagaagtggaaaatgg

SEQ ID NO: 107885 - DNA, 20 bp, Artificial Sequence
  chemically synthesized
agatcttcagaagtggaaaa

SEQ ID NO: 107886 - DNA, 20 bp, Artificial Sequence
  chemically synthesized
gcttccattttccacttctg

SEQ ID NO: 107887 - DNA, 20 bp, Artificial Sequence
  chemically synthesized
ccgaaacagatcttcagaag

SEQ ID NO: 107888 - DNA, 20 bp, Artificial Sequence
  chemically synthesized
gagccgaaacagatcttcag

SEQ ID NO: 107889 - DNA, 20 bp, Artificial Sequence
  chemically synthesized
catgagccgaaacagatctt

SEQ ID NO: 107890 - DNA, 20 bp, Artificial Sequence
  chemically synthesized
ccacttctgaagatctgttt

SEQ ID NO: 107891 - DNA, 20 bp, Artificial Sequence
  chemically synthesized
atatttaccatgagccgaaa

SEQ ID NO: 107892 - DNA, 20 bp, Artificial Sequence
  chemically synthesized
tgaagatctgtttcggctca

SEQ ID NO: 107893 - DNA, 20 bp, Artificial Sequence
  chemically synthesized
aaagatgtaatatttaccat

SEQ ID NO: 107894 - DNA, 20 bp, Artificial Sequence
  chemically synthesized
gcatttggggagcgagggta

SEQ ID NO: 107895 - DNA, 20 bp, Artificial Sequence
  chemically synthesized
ctgaagcatttggggagcga

SEQ ID NO: 107896 - DNA, 20 bp, Artificial Sequence
  chemically synthesized
tctgaagcatttggggagcg

SEQ ID NO: 107897 - DNA, 20 bp, Artificial Sequence
  chemically synthesized
atctgaagcatttggggagc

SEQ ID NO: 107898 - DNA, 20 bp, Artificial Sequence
  chemically synthesized
atccatctgaagcatttggg

SEQ ID NO: 107899 - DNA, 20 bp, Artificial Sequence
  chemically synthesized
taatccatctgaagcatttg

SEQ ID NO: 107900 - DNA, 20 bp, Artificial Sequence
  chemically synthesized
ttaatccatctgaagcattt

SEQ ID NO: 107901 - DNA, 20 bp, Artificial Sequence
  chemically synthesized
ccctcgctccccaaatgctt

SEQ ID NO: 107902 - DNA, 20 bp, Artificial Sequence
  chemically synthesized
cttaatccatctgaagcatt

SEQ ID NO: 107903 - DNA, 20 bp, Artificial Sequence
  chemically synthesized
cgctccccaaatgcttcaga

SEQ ID NO: 107904 - DNA, 20 bp, Artificial Sequence
  chemically synthesized
aatggtgcttaatccatctg

SEQ ID NO: 107905 - DNA, 20 bp, Artificial Sequence
  chemically synthesized
ccaaatgcttcagatggatt

SEQ ID NO: 107906 - DNA, 20 bp, Artificial Sequence
  chemically synthesized
gctcccccacacaaaaagaa

SEQ ID NO: 107907 - DNA, 20 bp, Artificial Sequence
  chemically synthesized
taagcaccattctttttgtg

SEQ ID NO: 107908 - DNA, 20 bp, Artificial Sequence
  chemically synthesized
aagcaccattctttttgtgt

SEQ ID NO: 107909 - DNA, 20 bp, Artificial Sequence
  chemically synthesized
ctccagctcccccacacaaa

SEQ ID NO: 107910 - DNA, 20 bp, Artificial Sequence
  chemically synthesized
agcaccattctttttgtgtg

SEQ ID NO: 107911 - DNA, 20 bp, Artificial Sequence
  chemically synthesized
gcaccattctttttgtgtgg

SEQ ID NO: 107912 - DNA, 20 bp, Artificial Sequence
  chemically synthesized
accattctttttgtgtgggg

SEQ ID NO: 107913 - DNA, 20 bp, Artificial Sequence
  chemically synthesized
ttctttttgtgtgggggagc

SEQ ID NO: 107914 - DNA, 20 bp, Artificial Sequence
  chemically synthesized
ctttttgtgtgggggagctg

SEQ ID NO: 107915 - DNA, 20 bp, Artificial Sequence
  chemically synthesized
ttttgtgtgggggagctgga

SEQ ID NO: 107916 - DNA, 20 bp, Artificial Sequence
  chemically synthesized
ttgtgtgggggagctggaga

SEQ ID NO: 107917 - DNA, 20 bp, Artificial Sequence
  chemically synthesized
tattcatctatttctctctc

SEQ ID NO: 107918 - DNA, 20 bp, Artificial Sequence
  chemically synthesized
gggggagctggagagagaaa

SEQ ID NO: 107919 - DNA, 20 bp, Artificial Sequence
  chemically synthesized
ggatggaatcaagggtgtgg

SEQ ID NO: 107920 - DNA, 20 bp, Artificial Sequence
  chemically synthesized
ttaggatggaatcaagggtg

SEQ ID NO: 107921 - DNA, 20 bp, Artificial Sequence
  chemically synthesized
acttgttaggatggaatcaa

SEQ ID NO: 107922 - DNA, 20 bp, Artificial Sequence
  chemically synthesized
tacttgttaggatggaatca

SEQ ID NO: 107923 - DNA, 20 bp, Artificial Sequence
  chemically synthesized
gtacttgttaggatggaatc

SEQ ID NO: 107924 - DNA, 20 bp, Artificial Sequence
  chemically synthesized
acccttgattccatcctaac

SEQ ID NO: 107925 - DNA, 20 bp, Artificial Sequence
  chemically synthesized
tttattggtacttgttagga

SEQ ID NO: 107926 - DNA, 20 bp, Artificial Sequence
  chemically synthesized
gctatttattggtacttgtt

SEQ ID NO: 107927 - DNA, 20 bp, Artificial Sequence
  chemically synthesized
tgctatttattggtacttgt

SEQ ID NO: 107928 - DNA, 20 bp, Artificial Sequence
  chemically synthesized
tcctaacaagtaccaataaa

SEQ ID NO: 107929 - DNA, 20 bp, Artificial Sequence
  chemically synthesized
ggtgagaagttgctatttat

SEQ ID NO: 107930 - DNA, 20 bp, Artificial Sequence
  chemically synthesized
acctctatagaggaggtgag

SEQ ID NO: 107931 - DNA, 20 bp, Artificial Sequence
  chemically synthesized
acaacctctatagaggaggt

SEQ ID NO: 107932 - DNA, 20 bp, Artificial Sequence
  chemically synthesized
gcaacttctcacctcctcta

SEQ ID NO: 107933 - DNA, 20 bp, Artificial Sequence
  chemically synthesized
gaagacaacctctatagagg

SEQ ID NO: 107934 - DNA, 20 bp, Artificial Sequence
  chemically synthesized
aacttctcacctcctctata

SEQ ID NO: 107935 - DNA, 20 bp, Artificial Sequence
  chemically synthesized
tgaagacaacctctatagag

SEQ ID NO: 107936 - DNA, 20 bp, Artificial Sequence
  chemically synthesized
acttctcacctcctctatag

SEQ ID NO: 107937 - DNA, 20 bp, Artificial Sequence
  chemically synthesized
attgaagacaacctctatag

SEQ ID NO: 107938 - DNA, 20 bp, Artificial Sequence
  chemically synthesized
aattgaagacaacctctata

SEQ ID NO: 107939 - DNA, 20 bp, Artificial Sequence
  chemically synthesized
ttaattgaagacaacctcta

SEQ ID NO: 107940 - DNA, 20 bp, Artificial Sequence
  chemically synthesized
ctctagtgtatttttaattg

SEQ ID NO: 107941 - DNA, 20 bp, Artificial Sequence
  chemically synthesized
gtcttcaattaaaaatacac

SEQ ID NO: 107942 - DNA, 20 bp, Artificial Sequence
  chemically synthesized
cttcaattaaaaatacacta

SEQ ID NO: 107943 - DNA, 20 bp, Artificial Sequence
  chemically synthesized
tcaattaaaaatacactaga

SEQ ID NO: 107944 - DNA, 20 bp, Artificial Sequence
  chemically synthesized
ttctatggttataatctctc

SEQ ID NO: 107945 - DNA, 20 bp, Artificial Sequence
  chemically synthesized
cactagagagattataacca

SEQ ID NO: 107946 - DNA, 20 bp, Artificial Sequence
  chemically synthesized
agagagattataaccataga

SEQ ID NO: 107947 - DNA, 20 bp, Artificial Sequence
  chemically synthesized
gagagattataaccatagaa

SEQ ID NO: 107948 - DNA, 20 bp, Artificial Sequence
  chemically synthesized
actactcaatgtcctttcta

SEQ ID NO: 107949 - DNA, 20 bp, Artificial Sequence
  chemically synthesized
ataaccatagaaaggacatt

SEQ ID NO: 107950 - DNA, 20 bp, Artificial Sequence
  chemically synthesized
accatagaaaggacattgag

SEQ ID NO: 107951 - DNA, 20 bp, Artificial Sequence
  chemically synthesized
aggacattgagtagtgcttt

SEQ ID NO: 107952 - DNA, 20 bp, Artificial Sequence
  chemically synthesized
atgtactgccaattagccga

SEQ ID NO: 107953 - DNA, 20 bp, Artificial Sequence
  chemically synthesized
gagtagtgctttcggctaat

SEQ ID NO: 107954 - DNA, 20 bp, Artificial Sequence
  chemically synthesized
tagtgctttcggctaattgg

SEQ ID NO: 107955 - DNA, 20 bp, Artificial Sequence
  chemically synthesized
ggaaggaatgtactgccaat

SEQ ID NO: 107956 - DNA, 20 bp, Artificial Sequence
  chemically synthesized
ggtacctctgaaattttgga

SEQ ID NO: 107957 - DNA, 20 bp, Artificial Sequence
  chemically synthesized
aggtacctctgaaattttgg

SEQ ID NO: 107958 - DNA, 20 bp, Artificial Sequence
  chemically synthesized
gtacattccttccaaaattt

SEQ ID NO: 107959 - DNA, 20 bp, Artificial Sequence
  chemically synthesized
ttgaggtacctctgaaattt

SEQ ID NO: 107960 - DNA, 20 bp, Artificial Sequence
  chemically synthesized
acattccttccaaaatttca

SEQ ID NO: 107961 - DNA, 20 bp, Artificial Sequence
  chemically synthesized
cattccttccaaaatttcag

SEQ ID NO: 107962 - DNA, 20 bp, Artificial Sequence
  chemically synthesized
tcaggggagtcattaaattg

SEQ ID NO: 107963 - DNA, 20 bp, Artificial Sequence
  chemically synthesized
ttcaggggagtcattaaatt

SEQ ID NO: 107964 - DNA, 20 bp, Artificial Sequence
  chemically synthesized
accaattactttattcaggg

SEQ ID NO: 107965 - DNA, 20 bp, Artificial Sequence
  chemically synthesized
tttaatgactcccctgaata

SEQ ID NO: 107966 - DNA, 20 bp, Artificial Sequence
  chemically synthesized
caaccaattactttattcag

SEQ ID NO: 107967 - DNA, 20 bp, Artificial Sequence
  chemically synthesized
tcaaccaattactttattca

SEQ ID NO: 107968 - DNA, 20 bp, Artificial Sequence
  chemically synthesized
ttcaaccaattactttattc

SEQ ID NO: 107969 - DNA, 20 bp, Artificial Sequence
  chemically synthesized
tttcaaccaattactttatt

SEQ ID NO: 107970 - DNA, 20 bp, Artificial Sequence
  chemically synthesized
actcccctgaataaagtaat

SEQ ID NO: 107971 - DNA, 20 bp, Artificial Sequence
  chemically synthesized
attggttgaaatttactttg

SEQ ID NO: 107972 - DNA, 20 bp, Artificial Sequence
  chemically synthesized
aagttatattaagaactgca

SEQ ID NO: 107973 - DNA, 20 bp, Artificial Sequence
  chemically synthesized
gatgggcccaaagttatatt

SEQ ID NO: 107974 - DNA, 20 bp, Artificial Sequence
  chemically synthesized
tgcagttcttaatataactt

SEQ ID NO: 107975 - DNA, 20 bp, Artificial Sequence
  chemically synthesized
gcagttcttaatataacttt

SEQ ID NO: 107976 - DNA, 20 bp, Artificial Sequence
  chemically synthesized
tcttgctaatgatgggccca

SEQ ID NO: 107977 - DNA, 20 bp, Artificial Sequence
  chemically synthesized
tataactttgggcccatcat

SEQ ID NO: 107978 - DNA, 20 bp, Artificial Sequence
  chemically synthesized
ttagagttcttgctaatgat

SEQ ID NO: 107979 - DNA, 20 bp, Artificial Sequence
  chemically synthesized
tttagagttcttgctaatga

SEQ ID NO: 107980 - DNA, 20 bp, Artificial Sequence
  chemically synthesized
actttgggcccatcattagc

SEQ ID NO: 107981 - DNA, 20 bp, Artificial Sequence
  chemically synthesized
tcattagcaagaactctaaa

SEQ ID NO: 107982 - DNA, 20 bp, Artificial Sequence
  chemically synthesized
cattagcaagaactctaaaa

SEQ ID NO: 107983 - DNA, 20 bp, Artificial Sequence
  chemically synthesized
gtttttgtttttccttttta

SEQ ID NO: 107984 - DNA, 20 bp, Artificial Sequence
  chemically synthesized
ttgtttttgtttttcctttt

SEQ ID NO: 107985 - DNA, 20 bp, Artificial Sequence
  chemically synthesized
aggaaaaacaaaaacaaaac

SEQ ID NO: 107986 - DNA, 20 bp, Artificial Sequence
  chemically synthesized
ggaaaaacaaaaacaaaact

SEQ ID NO: 107987 - DNA, 20 bp, Artificial Sequence
  chemically synthesized
gaaaaacaaaaacaaaactg

SEQ ID NO: 107988 - DNA, 20 bp, Artificial Sequence
  chemically synthesized
aacaaaaacaaaactggggt

SEQ ID NO: 107989 - DNA, 20 bp, Artificial Sequence
  chemically synthesized
atttaaatatatactgaccc

SEQ ID NO: 107990 - DNA, 20 bp, Artificial Sequence
  chemically synthesized
ggtcagtatatatttaaatg

SEQ ID NO: 107991 - DNA, 20 bp, Artificial Sequence
  chemically synthesized
tatatatttaaatgaagcac

SEQ ID NO: 107992 - DNA, 20 bp, Artificial Sequence
  chemically synthesized
atatatttaaatgaagcaca

SEQ ID NO: 107993 - DNA, 20 bp, Artificial Sequence
  chemically synthesized
taaatgaagcacaaggaaaa

SEQ ID NO: 107994 - DNA, 20 bp, Artificial Sequence
  chemically synthesized
aaatgaagcacaaggaaaaa

SEQ ID NO: 107995 - DNA, 20 bp, Artificial Sequence
  chemically synthesized
aaaaaggtatttcactttca

SEQ ID NO: 107996 - DNA, 20 bp, Artificial Sequence
  chemically synthesized
aaaaggtatttcactttcaa

SEQ ID NO: 107997 - DNA, 20 bp, Artificial Sequence
  chemically synthesized
aaacagcataggtcctttga

SEQ ID NO: 107998 - DNA, 20 bp, Artificial Sequence
  chemically synthesized
tcaaaaaaaaaaaacagcat

SEQ ID NO: 107999 - DNA, 20 bp, Artificial Sequence
  chemically synthesized
ttcaaaaaaaaaaaacagca

SEQ ID NO: 108000 - DNA, 20 bp, Artificial Sequence
  chemically synthesized
caatcttcaaaaaaaaaaaa

SEQ ID NO: 108001 - DNA, 20 bp, Artificial Sequence
  chemically synthesized
tatgctgttttttttttttg

SEQ ID NO: 108002 - DNA, 20 bp, Artificial Sequence
  chemically synthesized
cattatattataaaatagat

SEQ ID NO: 108003 - DNA, 20 bp, Artificial Sequence
  chemically synthesized
attgtcattatattataaaa

SEQ ID NO: 108004 - DNA, 20 bp, Artificial Sequence
  chemically synthesized
atgacaataatattgcctct

SEQ ID NO: 108005 - DNA, 20 bp, Artificial Sequence
  chemically synthesized
ttattacacagttaactcag

SEQ ID NO: 108006 - DNA, 20 bp, Artificial Sequence
  chemically synthesized
attattacacagttaactca

SEQ ID NO: 108007 - DNA, 20 bp, Artificial Sequence
  chemically synthesized
gaattattacacagttaact

SEQ ID NO: 108008 - DNA, 20 bp, Artificial Sequence
  chemically synthesized
acccaaagtgaattattaca

SEQ ID NO: 108009 - DNA, 20 bp, Artificial Sequence
  chemically synthesized
aactgtgtaataattcactt

SEQ ID NO: 108010 - DNA, 20 bp, Artificial Sequence
  chemically synthesized
actgtgtaataattcacttt

SEQ ID NO: 108011 - DNA, 20 bp, Artificial Sequence
  chemically synthesized
ctcaattattgcagtaccca

SEQ ID NO: 108012 - DNA, 20 bp, Artificial Sequence
  chemically synthesized
ttctgtttgctcaattattg

SEQ ID NO: 108013 - DNA, 20 bp, Artificial Sequence
  chemically synthesized
ctttgggtactgcaataatt

SEQ ID NO: 108014 - DNA, 20 bp, Artificial Sequence
  chemically synthesized
tactgcaataattgagcaaa

SEQ ID NO: 108015 - DNA, 20 bp, Artificial Sequence
  chemically synthesized
tgcaataattgagcaaacag

SEQ ID NO: 108016 - DNA, 20 bp, Artificial Sequence
  chemically synthesized
ataattgagcaaacagaagc

SEQ ID NO: 108017 - DNA, 20 bp, Artificial Sequence
  chemically synthesized
gagcaaacagaagctggtac

SEQ ID NO: 108018 - DNA, 20 bp, Artificial Sequence
  chemically synthesized
gcaaacagaagctggtacca

SEQ ID NO: 108019 - DNA, 20 bp, Artificial Sequence
  chemically synthesized
caaacagaagctggtaccag

SEQ ID NO: 108020 - DNA, 20 bp, Artificial Sequence
  chemically synthesized
gaaaggaatgcctctggtac

SEQ ID NO: 108021 - DNA, 20 bp, Artificial Sequence
  chemically synthesized
ataaaagaaaggaatgcctc

SEQ ID NO: 108022 - DNA, 20 bp, Artificial Sequence
  chemically synthesized
tattacactaaataaaagaa

SEQ ID NO: 108023 - DNA, 20 bp, Artificial Sequence
  chemically synthesized
atattacactaaataaaaga

SEQ ID NO: 108024 - DNA, 20 bp, Artificial Sequence
  chemically synthesized
aggcattcctttcttttatt

SEQ ID NO: 108025 - DNA, 20 bp, Artificial Sequence
  chemically synthesized
aaaaatattacactaaataa

SEQ ID NO: 108026 - DNA, 20 bp, Artificial Sequence
  chemically synthesized
atattttttcataatttaat

SEQ ID NO: 108027 - DNA, 20 bp, Artificial Sequence
  chemically synthesized
tttaatgagaaacatttcaa

SEQ ID NO: 108028 - DNA, 20 bp, Artificial Sequence
  chemically synthesized
gtaaattaatttaacatgaa

SEQ ID NO: 108029 - DNA, 20 bp, Artificial Sequence
  chemically synthesized
tgtaaattaatttaacatga

SEQ ID NO: 108030 - DNA, 20 bp, Artificial Sequence
  chemically synthesized
aaattaatttacaatgctat

SEQ ID NO: 108031 - DNA, 20 bp, Artificial Sequence
  chemically synthesized
tctcattttattatagctta

SEQ ID NO: 108032 - DNA, 20 bp, Artificial Sequence
  chemically synthesized
tggtttctctcattttatta

SEQ ID NO: 108033 - DNA, 20 bp, Artificial Sequence
  chemically synthesized
gctataagctataataaaat

SEQ ID NO: 108034 - DNA, 20 bp, Artificial Sequence
  chemically synthesized
tataagctataataaaatga

SEQ ID NO: 108035 - DNA, 20 bp, Artificial Sequence
  chemically synthesized
aataaaatgagagaaaccat

SEQ ID NO: 108036 - DNA, 20 bp, Artificial Sequence
  chemically synthesized
taacttttgctttttgctga

SEQ ID NO: 108037 - DNA, 20 bp, Artificial Sequence
  chemically synthesized
tgagagaaaccatcagcaaa

SEQ ID NO: 108038 - DNA, 20 bp, Artificial Sequence
  chemically synthesized
aaaccatcagcaaaaagcaa

SEQ ID NO: 108039 - DNA, 20 bp, Artificial Sequence
  chemically synthesized
gcaaaaagcaaaagttaata

SEQ ID NO: 108040 - DNA, 20 bp, Artificial Sequence
  chemically synthesized
aaagcaaaagttaataaaga

SEQ ID NO: 108041 - DNA, 20 bp, Artificial Sequence
  chemically synthesized
aataaagacagatattctta

SEQ ID NO: 108042 - DNA, 20 bp, Artificial Sequence
  chemically synthesized
ttttcagtccttgaaacttt

SEQ ID NO: 108043 - DNA, 20 bp, Artificial Sequence
  chemically synthesized
acagatattcttaaagtttc

SEQ ID NO: 108044 - DNA, 20 bp, Artificial Sequence
  chemically synthesized
cagatattcttaaagtttca

SEQ ID NO: 108045 - DNA, 20 bp, Artificial Sequence
  chemically synthesized
aaagtttcaaggactgaaaa

SEQ ID NO: 108046 - DNA, 20 bp, Artificial Sequence
  chemically synthesized
tttgtgatttgagctttttt

SEQ ID NO: 108047 - DNA, 20 bp, Artificial Sequence
  chemically synthesized
accaaatacttttgtgattt

SEQ ID NO: 108048 - DNA, 20 bp, Artificial Sequence
  chemically synthesized
gaaaaaagctcaaatcacaa

SEQ ID NO: 108049 - DNA, 20 bp, Artificial Sequence
  chemically synthesized
gctcaaatcacaaaagtatt

SEQ ID NO: 108050 - DNA, 20 bp, Artificial Sequence
  chemically synthesized
gaaccaagccacaaaaaaag

SEQ ID NO: 108051 - DNA, 20 bp, Artificial Sequence
  chemically synthesized
tttggtttctcctttttttg

SEQ ID NO: 108052 - DNA, 20 bp, Artificial Sequence
  chemically synthesized
ttgaaccaagccacaaaaaa

SEQ ID NO: 108053 - DNA, 20 bp, Artificial Sequence
  chemically synthesized
attgaaccaagccacaaaaa

SEQ ID NO: 108054 - DNA, 20 bp, Artificial Sequence
  chemically synthesized
tttctcctttttttgtggct

SEQ ID NO: 108055 - DNA, 20 bp, Artificial Sequence
  chemically synthesized
aaattatgacaaattgaacc

SEQ ID NO: 108056 - DNA, 20 bp, Artificial Sequence
  chemically synthesized
gctgtaagtacaaaataatt

SEQ ID NO: 108057 - DNA, 20 bp, Artificial Sequence
  chemically synthesized
tctcaattattttgtactta

SEQ ID NO: 108058 - DNA, 20 bp, Artificial Sequence
  chemically synthesized
aattattttgtacttacagc

SEQ ID NO: 108059 - DNA, 20 bp, Artificial Sequence
  chemically synthesized
tattatgttatgctagctgt

SEQ ID NO: 108060 - DNA, 20 bp, Artificial Sequence
  chemically synthesized
tcatcaatattatgttatgc

SEQ ID NO: 108061 - DNA, 20 bp, Artificial Sequence
  chemically synthesized
agcataacataatattgatg

SEQ ID NO: 108062 - DNA, 20 bp, Artificial Sequence
  chemically synthesized
gcataacataatattgatga

SEQ ID NO: 108063 - DNA, 20 bp, Artificial Sequence
  chemically synthesized
ataacataatattgatgaag

SEQ ID NO: 108064 - DNA, 20 bp, Artificial Sequence
  chemically synthesized
ataatattgatgaaggagaa

SEQ ID NO: 108065 - DNA, 20 bp, Artificial Sequence
  chemically synthesized
gagaaaagatgcattactga

SEQ ID NO: 108066 - DNA, 20 bp, Artificial Sequence
  chemically synthesized
taattatgtatgtttacttt

SEQ ID NO: 108067 - DNA, 20 bp, Artificial Sequence
  chemically synthesized
atacataattaaaatcacct

SEQ ID NO: 108068 - DNA, 20 bp, Artificial Sequence
  chemically synthesized
gcaaagttttgttgtttctt

SEQ ID NO: 108069 - DNA, 20 bp, Artificial Sequence
  chemically synthesized
cgcaaagttttgttgtttct

SEQ ID NO: 108070 - DNA, 20 bp, Artificial Sequence
  chemically synthesized
gtttactgaagtacatcgca

SEQ ID NO: 108071 - DNA, 20 bp, Artificial Sequence
  chemically synthesized
caaaactttgcgatgtactt

SEQ ID NO: 108072 - DNA, 20 bp, Artificial Sequence
  chemically synthesized
aatcttagagtagtttactg

SEQ ID NO: 108073 - DNA, 20 bp, Artificial Sequence
  chemically synthesized
gtacttcagtaaactactct

SEQ ID NO: 108074 - DNA, 20 bp, Artificial Sequence
  chemically synthesized
tctttgtataaatcttagag

SEQ ID NO: 108075 - DNA, 20 bp, Artificial Sequence
  chemically synthesized
ccttctttgtataaatctta

SEQ ID NO: 108076 - DNA, 20 bp, Artificial Sequence
  chemically synthesized
agccttctttgtataaatct

SEQ ID NO: 108077 - DNA, 20 bp, Artificial Sequence
  chemically synthesized
actactctaagatttataca

SEQ ID NO: 108078 - DNA, 20 bp, Artificial Sequence
  chemically synthesized
actctaagatttatacaaag

SEQ ID NO: 108079 - DNA, 20 bp, Artificial Sequence
  chemically synthesized
ctctaagatttatacaaaga

SEQ ID NO: 108080 - DNA, 20 bp, Artificial Sequence
  chemically synthesized
gtacatgttaaattacatca

SEQ ID NO: 108081 - DNA, 20 bp, Artificial Sequence
  chemically synthesized
tgatgtaatttaacatgtac

SEQ ID NO: 108082 - DNA, 20 bp, Artificial Sequence
  chemically synthesized
ttgcccaaagaagtttatac

SEQ ID NO: 108083 - DNA, 20 bp, Artificial Sequence
  chemically synthesized
tgtactggtataaacttctt

SEQ ID NO: 108084 - DNA, 20 bp, Artificial Sequence
  chemically synthesized
gtactggtataaacttcttt

SEQ ID NO: 108085 - DNA, 20 bp, Artificial Sequence
  chemically synthesized
attttgaattttgcccaaag

SEQ ID NO: 108086 - DNA, 20 bp, Artificial Sequence
  chemically synthesized
gaaattttgaattttgccca

SEQ ID NO: 108087 - DNA, 20 bp, Artificial Sequence
  chemically synthesized
tgggcaaaattcaaaatttc

SEQ ID NO: 108088 - DNA, 20 bp, Artificial Sequence
  chemically synthesized
atttcaagcgatgatgaata

SEQ ID NO: 108089 - DNA, 20 bp, Artificial Sequence
  chemically synthesized
agcgatgatgaataaagcat

SEQ ID NO: 108090 - DNA, 20 bp, Artificial Sequence
  chemically synthesized
gcgatgatgaataaagcata

SEQ ID NO: 108091 - DNA, 20 bp, Artificial Sequence
  chemically synthesized
tgatgaataaagcataagga

SEQ ID NO: 108092 - DNA, 20 bp, Artificial Sequence
  chemically synthesized
ataaggaaagttcatgttat

SEQ ID NO: 108093 - DNA, 20 bp, Artificial Sequence
  chemically synthesized
gaaagttcatgttattggaa

SEQ ID NO: 108094 - DNA, 20 bp, Artificial Sequence
  chemically synthesized
aagttcatgttattggaatg

SEQ ID NO: 108095 - DNA, 20 bp, Artificial Sequence
  chemically synthesized
tggaatggagttctctgttt

SEQ ID NO: 108096 - DNA, 20 bp, Artificial Sequence
  chemically synthesized
gtccataatatgcttaaaca

SEQ ID NO: 108097 - DNA, 20 bp, Artificial Sequence
  chemically synthesized
gtgtccataatatgcttaaa

SEQ ID NO: 108098 - DNA, 20 bp, Artificial Sequence
  chemically synthesized
ttctctgtttaagcatatta

SEQ ID NO: 108099 - DNA, 20 bp, Artificial Sequence
  chemically synthesized
gagtagtatctgtcaaattg

SEQ ID NO: 108100 - DNA, 20 bp, Artificial Sequence
  chemically synthesized
ttatggacactccaatttga

SEQ ID NO: 108101 - DNA, 20 bp, Artificial Sequence
  chemically synthesized
cagagtagtatctgtcaaat

SEQ ID NO: 108102 - DNA, 20 bp, Artificial Sequence
  chemically synthesized
tttattaagctgtatcagag

SEQ ID NO: 108103 - DNA, 20 bp, Artificial Sequence
  chemically synthesized
tgacagatactactctgata

SEQ ID NO: 108104 - DNA, 20 bp, Artificial Sequence
  chemically synthesized
aaatttattaagctgtatca

SEQ ID NO: 108105 - DNA, 20 bp, Artificial Sequence
  chemically synthesized
acaaatttattaagctgtat

SEQ ID NO: 108106 - DNA, 20 bp, Artificial Sequence
  chemically synthesized
cagctgaatacaaatttatt

SEQ ID NO: 108107 - DNA, 20 bp, Artificial Sequence
  chemically synthesized
cagcttaataaatttgtatt

SEQ ID NO: 108108 - DNA, 20 bp, Artificial Sequence
  chemically synthesized
aattctcgttagtgtttcag

SEQ ID NO: 108109 - DNA, 20 bp, Artificial Sequence
  chemically synthesized
ctcaattctcgttagtgttt

SEQ ID NO: 108110 - DNA, 20 bp, Artificial Sequence
  chemically synthesized
tcagctgctgaaacactaac

SEQ ID NO: 108111 - DNA, 20 bp, Artificial Sequence
  chemically synthesized
caggtcttctcaattctcgt

SEQ ID NO: 108112 - DNA, 20 bp, Artificial Sequence
  chemically synthesized
ctgaaacactaacgagaatt

SEQ ID NO: 108113 - DNA, 20 bp, Artificial Sequence
  chemically synthesized
aaacactaacgagaattgag

SEQ ID NO: 108114 - DNA, 20 bp, Artificial Sequence
  chemically synthesized
taacgagaattgagaagacc

SEQ ID NO: 108115 - DNA, 20 bp, Artificial Sequence
  chemically synthesized
aacgagaattgagaagacct

SEQ ID NO: 108116 - DNA, 20 bp, Artificial Sequence
  chemically synthesized
attgagaagacctgggctgt

SEQ ID NO: 108117 - DNA, 20 bp, Artificial Sequence
  chemically synthesized
cttcaaaggtccaacagccc

SEQ ID NO: 108118 - DNA, 20 bp, Artificial Sequence
  chemically synthesized
acttcaaaggtccaacagcc

SEQ ID NO: 108119 - DNA, 20 bp, Artificial Sequence
  chemically synthesized
tctggacttcaaaggtccaa

SEQ ID NO: 108120 - DNA, 20 bp, Artificial Sequence
  chemically synthesized
cctgggctgttggacctttg

SEQ ID NO: 108121 - DNA, 20 bp, Artificial Sequence
  chemically synthesized
ttgaaatctctggacttcaa

SEQ ID NO: 108122 - DNA, 20 bp, Artificial Sequence
  chemically synthesized
gctgttggacctttgaagtc

SEQ ID NO: 108123 - DNA, 20 bp, Artificial Sequence
  chemically synthesized
gttgaaatctctggacttca

SEQ ID NO: 108124 - DNA, 20 bp, Artificial Sequence
  chemically synthesized
tgttggacctttgaagtcca

SEQ ID NO: 108125 - DNA, 20 bp, Artificial Sequence
  chemically synthesized
gttctgagagttgaaatctc

SEQ ID NO: 108126 - DNA, 20 bp, Artificial Sequence
  chemically synthesized
agtccagagatttcaactct

SEQ ID NO: 108127 - DNA, 20 bp, Artificial Sequence
  chemically synthesized
agatgaaaaccaggttctga

SEQ ID NO: 108128 - DNA, 20 bp, Artificial Sequence
  chemically synthesized
agatttcaactctcagaacc

SEQ ID NO: 108129 - DNA, 20 bp, Artificial Sequence
  chemically synthesized
aaagatgaaaaccaggttct

SEQ ID NO: 108130 - DNA, 20 bp, Artificial Sequence
  chemically synthesized
atcaattaaagatgaaaacc

SEQ ID NO: 108131 - DNA, 20 bp, Artificial Sequence
  chemically synthesized
tatcaattaaagatgaaaac

SEQ ID NO: 108132 - DNA, 20 bp, Artificial Sequence
  chemically synthesized
tggttttcatctttaattga

SEQ ID NO: 108133 - DNA, 20 bp, Artificial Sequence
  chemically synthesized
ttgtccaattctatcaatta

SEQ ID NO: 108134 - DNA, 20 bp, Artificial Sequence
  chemically synthesized
tcatctttaattgatagaat

SEQ ID NO: 108135 - DNA, 20 bp, Artificial Sequence
  chemically synthesized
tgatagaattggacaacctc

SEQ ID NO: 108136 - DNA, 20 bp, Artificial Sequence
  chemically synthesized
tagaattggacaacctcaag

SEQ ID NO: 108137 - DNA, 20 bp, Artificial Sequence
  chemically synthesized
gaattggacaacctcaagaa

SEQ ID NO: 108138 - DNA, 20 bp, Artificial Sequence
  chemically synthesized
gtgaaactactctcttcttg

SEQ ID NO: 108139 - DNA, 20 bp, Artificial Sequence
  chemically synthesized
attggacaacctcaagaaga

SEQ ID NO: 108140 - DNA, 20 bp, Artificial Sequence
  chemically synthesized
agtgaaactactctcttctt

SEQ ID NO: 108141 - DNA, 20 bp, Artificial Sequence
  chemically synthesized
ggacaacctcaagaagagag

SEQ ID NO: 108142 - DNA, 20 bp, Artificial Sequence
  chemically synthesized
aagaagagagtagtttcact

SEQ ID NO: 108143 - DNA, 20 bp, Artificial Sequence
  chemically synthesized
gaagagagtagtttcacttg

SEQ ID NO: 108144 - DNA, 20 bp, Artificial Sequence
  chemically synthesized
agtagtttcacttggagtga

SEQ ID NO: 108145 - DNA, 20 bp, Artificial Sequence
  chemically synthesized
cagcccagcaccatcactcc

SEQ ID NO: 108146 - DNA, 20 bp, Artificial Sequence
  chemically synthesized
ttcacttggagtgatggtgc

SEQ ID NO: 108147 - DNA, 20 bp, Artificial Sequence
  chemically synthesized
tcacttggagtgatggtgct

SEQ ID NO: 108148 - DNA, 20 bp, Artificial Sequence
  chemically synthesized
cagaatcctcatgagcagcc

SEQ ID NO: 108149 - DNA, 20 bp, Artificial Sequence
  chemically synthesized
gatggtgctgggctgctcat

SEQ ID NO: 108150 - DNA, 20 bp, Artificial Sequence
  chemically synthesized
atggtgctgggctgctcatg

SEQ ID NO: 108151 - DNA, 20 bp, Artificial Sequence
  chemically synthesized
acctgcagaatcctcatgag

SEQ ID NO: 108152 - DNA, 20 bp, Artificial Sequence
  chemically synthesized
ttaacctgcagaatcctcat

SEQ ID NO: 108153 - DNA, 20 bp, Artificial Sequence
  chemically synthesized
ggctgctcatgaggattctg

SEQ ID NO: 108154 - DNA, 20 bp, Artificial Sequence
  chemically synthesized
gctgctcatgaggattctgc

SEQ ID NO: 108155 - DNA, 20 bp, Artificial Sequence
  chemically synthesized
gcttgactgcatttaacctg

SEQ ID NO: 108156 - DNA, 20 bp, Artificial Sequence
  chemically synthesized
aggattctgcaggttaaatg

SEQ ID NO: 108157 - DNA, 20 bp, Artificial Sequence
  chemically synthesized
tctgcaggttaaatgcagtc

SEQ ID NO: 108158 - DNA, 20 bp, Artificial Sequence
  chemically synthesized
ttaaatgcagtcaagcacta

SEQ ID NO: 108159 - DNA, 20 bp, Artificial Sequence
  chemically synthesized
tgcagtcaagcactatagca

SEQ ID NO: 108160 - DNA, 20 bp, Artificial Sequence
  chemically synthesized
aataacctgataccgtgcta

SEQ ID NO: 108161 - DNA, 20 bp, Artificial Sequence
  chemically synthesized
caagcactatagcacggtat

SEQ ID NO: 108162 - DNA, 20 bp, Artificial Sequence
  chemically synthesized
aagcactatagcacggtatc

SEQ ID NO: 108163 - DNA, 20 bp, Artificial Sequence
  chemically synthesized
atcaggttatttgctatcca

SEQ ID NO: 108164 - DNA, 20 bp, Artificial Sequence
  chemically synthesized
gctattatctagtctatgga

SEQ ID NO: 108165 - DNA, 20 bp, Artificial Sequence
  chemically synthesized
gttatttgctatccatagac

SEQ ID NO: 108166 - DNA, 20 bp, Artificial Sequence
  chemically synthesized
ttttgctattatctagtcta

SEQ ID NO: 108167 - DNA, 20 bp, Artificial Sequence
  chemically synthesized
gctatccatagactagataa

SEQ ID NO: 108168 - DNA, 20 bp, Artificial Sequence
  chemically synthesized
caaggacttttgctattatc

SEQ ID NO: 108169 - DNA, 20 bp, Artificial Sequence
  chemically synthesized
catagactagataatagcaa

SEQ ID NO: 108170 - DNA, 20 bp, Artificial Sequence
  chemically synthesized
atagaactttgaaatttgca

SEQ ID NO: 108171 - DNA, 20 bp, Artificial Sequence
  chemically synthesized
catagaactttgaaatttgc

SEQ ID NO: 108172 - DNA, 20 bp, Artificial Sequence
  chemically synthesized
aaaagtccttgcaaatttca

SEQ ID NO: 108173 - DNA, 20 bp, Artificial Sequence
  chemically synthesized
aatttcaaagttctatgact

SEQ ID NO: 108174 - DNA, 20 bp, Artificial Sequence
  chemically synthesized
taaatgttctcactgagtca

SEQ ID NO: 108175 - DNA, 20 bp, Artificial Sequence
  chemically synthesized
tcaaagttctatgactcagt

SEQ ID NO: 108176 - DNA, 20 bp, Artificial Sequence
  chemically synthesized
aaataataaatgttctcact

SEQ ID NO: 108177 - DNA, 20 bp, Artificial Sequence
  chemically synthesized
cagtgagaacatttattatt

SEQ ID NO: 108178 - DNA, 20 bp, Artificial Sequence
  chemically synthesized
gagaacatttattatttagc

SEQ ID NO: 108179 - DNA, 20 bp, Artificial Sequence
  chemically synthesized
acatttattatttagccagc

SEQ ID NO: 108180 - DNA, 20 bp, Artificial Sequence
  chemically synthesized
ttattatttagccagcaagt

SEQ ID NO: 108181 - DNA, 20 bp, Artificial Sequence
  chemically synthesized
tgggctatgtgcttacttgc

SEQ ID NO: 108182 - DNA, 20 bp, Artificial Sequence
  chemically synthesized
ttagccagcaagtaagcaca

SEQ ID NO: 108183 - DNA, 20 bp, Artificial Sequence
  chemically synthesized
taagcacatagcccactatt

SEQ ID NO: 108184 - DNA, 20 bp, Artificial Sequence
  chemically synthesized
acagacacatgctgaatagt

SEQ ID NO: 108185 - DNA, 20 bp, Artificial Sequence
  chemically synthesized
tacagacacatgctgaatag

SEQ ID NO: 108186 - DNA, 20 bp, Artificial Sequence
  chemically synthesized
atgtacagacacatgctgaa

SEQ ID NO: 108187 - DNA, 20 bp, Artificial Sequence
  chemically synthesized
gctctaggatgttatatgta

SEQ ID NO: 108188 - DNA, 20 bp, Artificial Sequence
  chemically synthesized
tgtctgtacatataacatcc

SEQ ID NO: 108189 - DNA, 20 bp, Artificial Sequence
  chemically synthesized
tctgtacatataacatccta

SEQ ID NO: 108190 - DNA, 20 bp, Artificial Sequence
  chemically synthesized
actttgagtagtagggctct

SEQ ID NO: 108191 - DNA, 20 bp, Artificial Sequence
  chemically synthesized
cactttgagtagtagggctc

SEQ ID NO: 108192 - DNA, 20 bp, Artificial Sequence
  chemically synthesized
ggcgcacactttgagtagta

SEQ ID NO: 108193 - DNA, 20 bp, Artificial Sequence
  chemically synthesized
tggcgcacactttgagtagt

SEQ ID NO: 108194 - DNA, 20 bp, Artificial Sequence
  chemically synthesized
tcctagagccctactactca

SEQ ID NO: 108195 - DNA, 20 bp, Artificial Sequence
  chemically synthesized
ctggcgcacactttgagtag

SEQ ID NO: 108196 - DNA, 20 bp, Artificial Sequence
  chemically synthesized
tctctggcgcacactttgag

SEQ ID NO: 108197 - DNA, 20 bp, Artificial Sequence
  chemically synthesized
cagtctctggcgcacacttt

SEQ ID NO: 108198 - DNA, 20 bp, Artificial Sequence
  chemically synthesized
ctactactcaaagtgtgcgc

SEQ ID NO: 108199 - DNA, 20 bp, Artificial Sequence
  chemically synthesized
actactcaaagtgtgcgcca

SEQ ID NO: 108200 - DNA, 20 bp, Artificial Sequence
  chemically synthesized
atgctgctgctgtcagtctc

SEQ ID NO: 108201 - DNA, 20 bp, Artificial Sequence
  chemically synthesized
aagtgtgcgccagagactga

SEQ ID NO: 108202 - DNA, 20 bp, Artificial Sequence
  chemically synthesized
tgtgcgccagagactgacag

SEQ ID NO: 108203 - DNA, 20 bp, Artificial Sequence
  chemically synthesized
gcgccagagactgacagcag

SEQ ID NO: 108204 - DNA, 20 bp, Artificial Sequence
  chemically synthesized
ccaggtgatgctgctgctgt

SEQ ID NO: 108205 - DNA, 20 bp, Artificial Sequence
  chemically synthesized
ctgacagcagcagcatcacc

SEQ ID NO: 108206 - DNA, 20 bp, Artificial Sequence
  chemically synthesized
tgacagcagcagcatcacct

SEQ ID NO: 108207 - DNA, 20 bp, Artificial Sequence
  chemically synthesized
atgctgattcagtaggtccc

SEQ ID NO: 108208 - DNA, 20 bp, Artificial Sequence
  chemically synthesized
gatgctgattcagtaggtcc

SEQ ID NO: 108209 - DNA, 20 bp, Artificial Sequence
  chemically synthesized
tcacctgggacctactgaat

SEQ ID NO: 108210 - DNA, 20 bp, Artificial Sequence
  chemically synthesized
cccagagatgctgattcagt

SEQ ID NO: 108211 - DNA, 20 bp, Artificial Sequence
  chemically synthesized
ccccagagatgctgattcag

SEQ ID NO: 108212 - DNA, 20 bp, Artificial Sequence
  chemically synthesized
caaccccagagatgctgatt

SEQ ID NO: 108213 - DNA, 20 bp, Artificial Sequence
  chemically synthesized
acctactgaatcagcatctc

SEQ ID NO: 108214 - DNA, 20 bp, Artificial Sequence
  chemically synthesized
cctactgaatcagcatctct

SEQ ID NO: 108215 - DNA, 20 bp, Artificial Sequence
  chemically synthesized
ctactgaatcagcatctctg

SEQ ID NO: 108216 - DNA, 20 bp, Artificial Sequence
  chemically synthesized
tgaatcagcatctctggggt

SEQ ID NO: 108217 - DNA, 20 bp, Artificial Sequence
  chemically synthesized
gaatcagcatctctggggtt

SEQ ID NO: 108218 - DNA, 20 bp, Artificial Sequence
  chemically synthesized
attacttagccccaacccca

SEQ ID NO: 108219 - DNA, 20 bp, Artificial Sequence
  chemically synthesized
aatcagcatctctggggttg

SEQ ID NO: 108220 - DNA, 20 bp, Artificial Sequence
  chemically synthesized
agattacttagccccaaccc

SEQ ID NO: 108221 - DNA, 20 bp, Artificial Sequence
  chemically synthesized
gcatctctggggttggggct

SEQ ID NO: 108222 - DNA, 20 bp, Artificial Sequence
  chemically synthesized
ttgttaaaacatagattact

SEQ ID NO: 108223 - DNA, 20 bp, Artificial Sequence
  chemically synthesized
ctggagagcttgttaaaaca

SEQ ID NO: 108224 - DNA, 20 bp, Artificial Sequence
  chemically synthesized
taagtaatctatgttttaac

SEQ ID NO: 108225 - DNA, 20 bp, Artificial Sequence
  chemically synthesized
ctatgttttaacaagctctc

SEQ ID NO: 108226 - DNA, 20 bp, Artificial Sequence
  chemically synthesized
tatgttttaacaagctctcc

SEQ ID NO: 108227 - DNA, 20 bp, Artificial Sequence
  chemically synthesized
atgcatagcaattgcctgga

SEQ ID NO: 108228 - DNA, 20 bp, Artificial Sequence
  chemically synthesized
atatgcatagcaattgcctg

SEQ ID NO: 108229 - DNA, 20 bp, Artificial Sequence
  chemically synthesized
taatatgcatagcaattgcc

SEQ ID NO: 108230 - DNA, 20 bp, Artificial Sequence
  chemically synthesized
agtgcttctcttaatatgca

SEQ ID NO: 108231 - DNA, 20 bp, Artificial Sequence
  chemically synthesized
aggcaattgctatgcatatt

SEQ ID NO: 108232 - DNA, 20 bp, Artificial Sequence
  chemically synthesized
gcaattgctatgcatattaa

SEQ ID NO: 108233 - DNA, 20 bp, Artificial Sequence
  chemically synthesized
attgctatgcatattaagag

SEQ ID NO: 108234 - DNA, 20 bp, Artificial Sequence
  chemically synthesized
tattaagagaagcactgatt

SEQ ID NO: 108235 - DNA, 20 bp, Artificial Sequence
  chemically synthesized
ttaagagaagcactgattca

SEQ ID NO: 108236 - DNA, 20 bp, Artificial Sequence
  chemically synthesized
gttctcacaatgctctgaat

SEQ ID NO: 108237 - DNA, 20 bp, Artificial Sequence
  chemically synthesized
gcactgattcagagcattgt

SEQ ID NO: 108238 - DNA, 20 bp, Artificial Sequence
  chemically synthesized
ttcagagcattgtgagaaca

SEQ ID NO: 108239 - DNA, 20 bp, Artificial Sequence
  chemically synthesized
agagcattgtgagaacatag

SEQ ID NO: 108240 - DNA, 20 bp, Artificial Sequence
  chemically synthesized
tgagaacatagaagatattc

SEQ ID NO: 108241 - DNA, 20 bp, Artificial Sequence
  chemically synthesized
gagaacatagaagatattct

SEQ ID NO: 108242 - DNA, 20 bp, Artificial Sequence
  chemically synthesized
aaagttcttgaggcaaagcc

SEQ ID NO: 108243 - DNA, 20 bp, Artificial Sequence
  chemically synthesized
gatattctaggctttgcctc

SEQ ID NO: 108244 - DNA, 20 bp, Artificial Sequence
  chemically synthesized
aaactaaagttcttgaggca

SEQ ID NO: 108245 - DNA, 20 bp, Artificial Sequence
  chemically synthesized
atccaaaactaaagttcttg

SEQ ID NO: 108246 - DNA, 20 bp, Artificial Sequence
  chemically synthesized
tatccaaaactaaagttctt

SEQ ID NO: 108247 - DNA, 20 bp, Artificial Sequence
  chemically synthesized
aggctttgcctcaagaactt

SEQ ID NO: 108248 - DNA, 20 bp, Artificial Sequence
  chemically synthesized
tgcctcaagaactttagttt

SEQ ID NO: 108249 - DNA, 20 bp, Artificial Sequence
  chemically synthesized
atctattttatccaaaacta

SEQ ID NO: 108250 - DNA, 20 bp, Artificial Sequence
  chemically synthesized
aactttagttttggataaaa

SEQ ID NO: 108251 - DNA, 20 bp, Artificial Sequence
  chemically synthesized
aaaatagatgtaaaacaact

SEQ ID NO: 108252 - DNA, 20 bp, Artificial Sequence
  chemically synthesized
tcattatgaaagattttgct

SEQ ID NO: 108253 - DNA, 20 bp, Artificial Sequence
  chemically synthesized
cagatattacttcattatga

SEQ ID NO: 108254 - DNA, 20 bp, Artificial Sequence
  chemically synthesized
tagcaaaatctttcataatg

SEQ ID NO: 108255 - DNA, 20 bp, Artificial Sequence
  chemically synthesized
tcataatgaagtaatatctg

SEQ ID NO: 108256 - DNA, 20 bp, Artificial Sequence
  chemically synthesized
cataatgaagtaatatctgt

SEQ ID NO: 108257 - DNA, 20 bp, Artificial Sequence
  chemically synthesized
tttgttgaatgaatgaccta

SEQ ID NO: 108258 - DNA, 20 bp, Artificial Sequence
  chemically synthesized
tcattcattcaacaaatatt

SEQ ID NO: 108259 - DNA, 20 bp, Artificial Sequence
  chemically synthesized
cacaatgcctaacaaatagt

SEQ ID NO: 108260 - DNA, 20 bp, Artificial Sequence
  chemically synthesized
acacaatgcctaacaaatag

SEQ ID NO: 108261 - DNA, 20 bp, Artificial Sequence
  chemically synthesized
attgagaacctactatttgt

SEQ ID NO: 108262 - DNA, 20 bp, Artificial Sequence
  chemically synthesized
ttgagaacctactatttgtt

SEQ ID NO: 108263 - DNA, 20 bp, Artificial Sequence
  chemically synthesized
ctaacacaatgcctaacaaa

SEQ ID NO: 108264 - DNA, 20 bp, Artificial Sequence
  chemically synthesized
ctatttgttaggcattgtgt

SEQ ID NO: 108265 - DNA, 20 bp, Artificial Sequence
  chemically synthesized
tttgttaggcattgtgttag

SEQ ID NO: 108266 - DNA, 20 bp, Artificial Sequence
  chemically synthesized
ttaggcattgtgttagtggc

SEQ ID NO: 108267 - DNA, 20 bp, Artificial Sequence
  chemically synthesized
taggcattgtgttagtggct

SEQ ID NO: 108268 - DNA, 20 bp, Artificial Sequence
  chemically synthesized
aggcattgtgttagtggctg

SEQ ID NO: 108269 - DNA, 20 bp, Artificial Sequence
  chemically synthesized
aagcagaactattataaccc

SEQ ID NO: 108270 - DNA, 20 bp, Artificial Sequence
  chemically synthesized
gttagtggctggggttataa

SEQ ID NO: 108271 - DNA, 20 bp, Artificial Sequence
  chemically synthesized
gattgtaagcgtcacaaaag

SEQ ID NO: 108272 - DNA, 20 bp, Artificial Sequence
  chemically synthesized
ctagattgtaagcgtcacaa

SEQ ID NO: 108273 - DNA, 20 bp, Artificial Sequence
  chemically synthesized
cttttgtgacgcttacaatc

SEQ ID NO: 108274 - DNA, 20 bp, Artificial Sequence
  chemically synthesized
ggtatacttcactagattgt

SEQ ID NO: 108275 - DNA, 20 bp, Artificial Sequence
  chemically synthesized
gtgacgcttacaatctagtg

SEQ ID NO: 108276 - DNA, 20 bp, Artificial Sequence
  chemically synthesized
tttatttgggtatacttcac

SEQ ID NO: 108277 - DNA, 20 bp, Artificial Sequence
  chemically synthesized
atttatatatttgtttattt

SEQ ID NO: 108278 - DNA, 20 bp, Artificial Sequence
  chemically synthesized
aatttatatatttgtttatt

SEQ ID NO: 108279 - DNA, 20 bp, Artificial Sequence
  chemically synthesized
atatataaattttaaaaata

SEQ ID NO: 108280 - DNA, 20 bp, Artificial Sequence
  chemically synthesized
ggtttttaaaaaatactatg

SEQ ID NO: 108281 - DNA, 20 bp, Artificial Sequence
  chemically synthesized
gtttttaaaaaatactatgc

SEQ ID NO: 108282 - DNA, 20 bp, Artificial Sequence
  chemically synthesized
caccattattatttcctgca

SEQ ID NO: 108283 - DNA, 20 bp, Artificial Sequence
  chemically synthesized
tactatgcaggaaataataa

SEQ ID NO: 108284 - DNA, 20 bp, Artificial Sequence
  chemically synthesized
atttctgttctttgttttca

SEQ ID NO: 108285 - DNA, 20 bp, Artificial Sequence
  chemically synthesized
ataatggtgctatgaaaaca

SEQ ID NO: 108286 - DNA, 20 bp, Artificial Sequence
  chemically synthesized
ggtgctatgaaaacaaagaa

SEQ ID NO: 108287 - DNA, 20 bp, Artificial Sequence
  chemically synthesized
atgaaaacaaagaacagaaa

SEQ ID NO: 108288 - DNA, 20 bp, Artificial Sequence
  chemically synthesized
caaagaacagaaatggcttt

SEQ ID NO: 108289 - DNA, 20 bp, Artificial Sequence
  chemically synthesized
aaagaacagaaatggctttg

SEQ ID NO: 108290 - DNA, 20 bp, Artificial Sequence
  chemically synthesized
aagaacagaaatggctttga

SEQ ID NO: 108291 - DNA, 20 bp, Artificial Sequence
  chemically synthesized
agaacagaaatggctttgag

SEQ ID NO: 108292 - DNA, 20 bp, Artificial Sequence
  chemically synthesized
acagaaatggctttgagggg

SEQ ID NO: 108293 - DNA, 20 bp, Artificial Sequence
  chemically synthesized
gtatcactctccacccctca

SEQ ID NO: 108294 - DNA, 20 bp, Artificial Sequence
  chemically synthesized
agaaatggctttgaggggtg

SEQ ID NO: 108295 - DNA, 20 bp, Artificial Sequence
  chemically synthesized
aaatggctttgaggggtgga

SEQ ID NO: 108296 - DNA, 20 bp, Artificial Sequence
  chemically synthesized
attattaacaatttaaaata

SEQ ID NO: 108297 - DNA, 20 bp, Artificial Sequence
  chemically synthesized
attgttaataataatatgtt

SEQ ID NO: 108298 - DNA, 20 bp, Artificial Sequence
  chemically synthesized
aataataatatgttaagatt

SEQ ID NO: 108299 - DNA, 20 bp, Artificial Sequence
  chemically synthesized
ataatatgttaagatttagt

SEQ ID NO: 108300 - DNA, 20 bp, Artificial Sequence
  chemically synthesized
gatttagttagttgataaat

SEQ ID NO: 108301 - DNA, 20 bp, Artificial Sequence
  chemically synthesized
gtgcagagcatgcatgcagt

SEQ ID NO: 108302 - DNA, 20 bp, Artificial Sequence
  chemically synthesized
ctgggtgcagagcatgcatg

SEQ ID NO: 108303 - DNA, 20 bp, Artificial Sequence
  chemically synthesized
ctgcatgcatgctctgcacc

SEQ ID NO: 108304 - DNA, 20 bp, Artificial Sequence
  chemically synthesized
aagatgcttatctgggtgca

SEQ ID NO: 108305 - DNA, 20 bp, Artificial Sequence
  chemically synthesized
acaagatgcttatctgggtg

SEQ ID NO: 108306 - DNA, 20 bp, Artificial Sequence
  chemically synthesized
tgcatgctctgcacccagat

SEQ ID NO: 108307 - DNA, 20 bp, Artificial Sequence
  chemically synthesized
attccacaagatgcttatct

SEQ ID NO: 108308 - DNA, 20 bp, Artificial Sequence
  chemically synthesized
tattccacaagatgcttatc

SEQ ID NO: 108309 - DNA, 20 bp, Artificial Sequence
  chemically synthesized
gcacccagataagcatcttg

SEQ ID NO: 108310 - DNA, 20 bp, Artificial Sequence
  chemically synthesized
ggcatactcttatattccac

SEQ ID NO: 108311 - DNA, 20 bp, Artificial Sequence
  chemically synthesized
ataagcatcttgtggaatat

SEQ ID NO: 108312 - DNA, 20 bp, Artificial Sequence
  chemically synthesized
aagcatcttgtggaatataa

SEQ ID NO: 108313 - DNA, 20 bp, Artificial Sequence
  chemically synthesized
tggaatataagagtatgccc

SEQ ID NO: 108314 - DNA, 20 bp, Artificial Sequence
  chemically synthesized
gaatataagagtatgccctg

SEQ ID NO: 108315 - DNA, 20 bp, Artificial Sequence
  chemically synthesized
aatataagagtatgccctgg

SEQ ID NO: 108316 - DNA, 20 bp, Artificial Sequence
  chemically synthesized
tataagagtatgccctggag

SEQ ID NO: 108317 - DNA, 20 bp, Artificial Sequence
  chemically synthesized
actgattataaactcctcca

SEQ ID NO: 108318 - DNA, 20 bp, Artificial Sequence
  chemically synthesized
aactgattataaactcctcc

SEQ ID NO: 108319 - DNA, 20 bp, Artificial Sequence
  chemically synthesized
caactgattataaactcctc

SEQ ID NO: 108320 - DNA, 20 bp, Artificial Sequence
  chemically synthesized
gccctggaggagtttataat

SEQ ID NO: 108321 - DNA, 20 bp, Artificial Sequence
  chemically synthesized
tggaggagtttataatcagt

SEQ ID NO: 108322 - DNA, 20 bp, Artificial Sequence
  chemically synthesized
ggagtttataatcagttgga

SEQ ID NO: 108323 - DNA, 20 bp, Artificial Sequence
  chemically synthesized
ttataatcagttggaaagat

SEQ ID NO: 108324 - DNA, 20 bp, Artificial Sequence
  chemically synthesized
gacaccatactgattatagt

SEQ ID NO: 108325 - DNA, 20 bp, Artificial Sequence
  chemically synthesized
atttaatcaccaactataat

SEQ ID NO: 108326 - DNA, 20 bp, Artificial Sequence
  chemically synthesized
tgcggacaccatactgatta

SEQ ID NO: 108327 - DNA, 20 bp, Artificial Sequence
  chemically synthesized
atcaccaactataatcagta

SEQ ID NO: 108328 - DNA, 20 bp, Artificial Sequence
  chemically synthesized
tataatcagtatggtgtccg

SEQ ID NO: 108329 - DNA, 20 bp, Artificial Sequence
  chemically synthesized
aatcagtatggtgtccgcag

SEQ ID NO: 108330 - DNA, 20 bp, Artificial Sequence
  chemically synthesized
cattctaaagtggtctactg

SEQ ID NO: 108331 - DNA, 20 bp, Artificial Sequence
  chemically synthesized
gtgtccgcagtagaccactt

SEQ ID NO: 108332 - DNA, 20 bp, Artificial Sequence
  chemically synthesized
aacaaagggccattctaaag

SEQ ID NO: 108333 - DNA, 20 bp, Artificial Sequence
  chemically synthesized
cgcagtagaccactttagaa

SEQ ID NO: 108334 - DNA, 20 bp, Artificial Sequence
  chemically synthesized
ttcaacaaagggccattcta

SEQ ID NO: 108335 - DNA, 20 bp, Artificial Sequence
  chemically synthesized
gaggagagagtttcaacaaa

SEQ ID NO: 108336 - DNA, 20 bp, Artificial Sequence
  chemically synthesized
agaggagagagtttcaacaa

SEQ ID NO: 108337 - DNA, 20 bp, Artificial Sequence
  chemically synthesized
gagaggagagagtttcaaca

SEQ ID NO: 108338 - DNA, 20 bp, Artificial Sequence
  chemically synthesized
agtaagaagcagagaggaga

SEQ ID NO: 108339 - DNA, 20 bp, Artificial Sequence
  chemically synthesized
taagtaagaagcagagagga

SEQ ID NO: 108340 - DNA, 20 bp, Artificial Sequence
  chemically synthesized
attaagtaagaagcagagag

SEQ ID NO: 108341 - DNA, 20 bp, Artificial Sequence
  chemically synthesized
ttattaagtaagaagcagag

SEQ ID NO: 108342 - DNA, 20 bp, Artificial Sequence
  chemically synthesized
cttattaagtaagaagcaga

SEQ ID NO: 108343 - DNA, 20 bp, Artificial Sequence
  chemically synthesized
agcttattaagtaagaagca

SEQ ID NO: 108344 - DNA, 20 bp, Artificial Sequence
  chemically synthesized
aaagcttattaagtaagaag

SEQ ID NO: 108345 - DNA, 20 bp, Artificial Sequence
  chemically synthesized
agaaaagcttattaagtaag

SEQ ID NO: 108346 - DNA, 20 bp, Artificial Sequence
  chemically synthesized
ctctctgcttcttacttaat

SEQ ID NO: 108347 - DNA, 20 bp, Artificial Sequence
  chemically synthesized
accagaaaagcttattaagt

SEQ ID NO: 108348 - DNA, 20 bp, Artificial Sequence
  chemically synthesized
gaaaaccagaaaagcttatt

SEQ ID NO: 108349 - DNA, 20 bp, Artificial Sequence
  chemically synthesized
tcttacttaataagcttttc

SEQ ID NO: 108350 - DNA, 20 bp, Artificial Sequence
  chemically synthesized
caggaattggaaaaccagaa

SEQ ID NO: 108351 - DNA, 20 bp, Artificial Sequence
  chemically synthesized
aaaaccaggaattggaaaac

SEQ ID NO: 108352 - DNA, 20 bp, Artificial Sequence
  chemically synthesized
ttttctggttttccaattcc

SEQ ID NO: 108353 - DNA, 20 bp, Artificial Sequence
  chemically synthesized
tgaattagaaaaccaggaat

SEQ ID NO: 108354 - DNA, 20 bp, Artificial Sequence
  chemically synthesized
gcacagtgaattagaaaacc

SEQ ID NO: 108355 - DNA, 20 bp, Artificial Sequence
  chemically synthesized
tgcacagtgaattagaaaac

SEQ ID NO: 108356 - DNA, 20 bp, Artificial Sequence
  chemically synthesized
atttgtcttgcacagtgaat

SEQ ID NO: 108357 - DNA, 20 bp, Artificial Sequence
  chemically synthesized
ggttttctaattcactgtgc

SEQ ID NO: 108358 - DNA, 20 bp, Artificial Sequence
  chemically synthesized
tttttaaaatttgtcttgca

SEQ ID NO: 108359 - DNA, 20 bp, Artificial Sequence
  chemically synthesized
tgtgcaagacaaattttaaa

SEQ ID NO: 108360 - DNA, 20 bp, Artificial Sequence
  chemically synthesized
tgcaagacaaattttaaaaa

SEQ ID NO: 108361 - DNA, 20 bp, Artificial Sequence
  chemically synthesized
ttaaaaagagaaatcaatgt

SEQ ID NO: 108362 - DNA, 20 bp, Artificial Sequence
  chemically synthesized
agaacattctgcattaattt

SEQ ID NO: 108363 - DNA, 20 bp, Artificial Sequence
  chemically synthesized
aatgttggctgaaattaatg

SEQ ID NO: 108364 - DNA, 20 bp, Artificial Sequence
  chemically synthesized
aattaatgcagaatgttctg

SEQ ID NO: 108365 - DNA, 20 bp, Artificial Sequence
  chemically synthesized
taatgcagaatgttctgtgg

SEQ ID NO: 108366 - DNA, 20 bp, Artificial Sequence
  chemically synthesized
tgcagaatgttctgtggaag

SEQ ID NO: 108367 - DNA, 20 bp, Artificial Sequence
  chemically synthesized
catcttgaattcttcttcca

SEQ ID NO: 108368 - DNA, 20 bp, Artificial Sequence
  chemically synthesized
gttctgtggaagaagaattc

SEQ ID NO: 108369 - DNA, 20 bp, Artificial Sequence
  chemically synthesized
tgtggaagaagaattcaaga

SEQ ID NO: 108370 - DNA, 20 bp, Artificial Sequence
  chemically synthesized
gtggaagaagaattcaagat

SEQ ID NO: 108371 - DNA, 20 bp, Artificial Sequence
  chemically synthesized
agaattcaagatgggtcttg

SEQ ID NO: 108372 - DNA, 20 bp, Artificial Sequence
  chemically synthesized
attcaagatgggtcttgaag

SEQ ID NO: 108373 - DNA, 20 bp, Artificial Sequence
  chemically synthesized
caagatgggtcttgaagcag

SEQ ID NO: 108374 - DNA, 20 bp, Artificial Sequence
  chemically synthesized
atacattctactactgcttc

SEQ ID NO: 108375 - DNA, 20 bp, Artificial Sequence
  chemically synthesized
gatgggtcttgaagcagtag

SEQ ID NO: 108376 - DNA, 20 bp, Artificial Sequence
  chemically synthesized
aagcagtagtagaatgtata

SEQ ID NO: 108377 - DNA, 20 bp, Artificial Sequence
  chemically synthesized
agcagtagtagaatgtataa

SEQ ID NO: 108378 - DNA, 20 bp, Artificial Sequence
  chemically synthesized
tagtagaatgtataaaggtg

SEQ ID NO: 108379 - DNA, 20 bp, Artificial Sequence
  chemically synthesized
gtataaaggtgaagataaat

SEQ ID NO: 108380 - DNA, 20 bp, Artificial Sequence
  chemically synthesized
tataaaggtgaagataaata

SEQ ID NO: 108381 - DNA, 20 bp, Artificial Sequence
  chemically synthesized
aaaggtgaagataaataagg

SEQ ID NO: 108382 - DNA, 20 bp, Artificial Sequence
  chemically synthesized
ataaataaggaagtcatttt

SEQ ID NO: 108383 - DNA, 20 bp, Artificial Sequence
  chemically synthesized
tttaagaataccactattgt

SEQ ID NO: 108384 - DNA, 20 bp, Artificial Sequence
  chemically synthesized
attattaatactaacaatag

SEQ ID NO: 108385 - DNA, 20 bp, Artificial Sequence
  chemically synthesized
gttattattaatactaacaa

SEQ ID NO: 108386 - DNA, 20 bp, Artificial Sequence
  chemically synthesized
tattagaaataaaatgattg

SEQ ID NO: 108387 - DNA, 20 bp, Artificial Sequence
  chemically synthesized
gttattagaaataaaatgat

SEQ ID NO: 108388 - DNA, 20 bp, Artificial Sequence
  chemically synthesized
atcattttatttctaataac

SEQ ID NO: 108389 - DNA, 20 bp, Artificial Sequence
  chemically synthesized
ttcatgacagtaccagttat

SEQ ID NO: 108390 - DNA, 20 bp, Artificial Sequence
  chemically synthesized
atcatctttcatgacagtac

SEQ ID NO: 108391 - DNA, 20 bp, Artificial Sequence
  chemically synthesized
aataactggtactgtcatga

SEQ ID NO: 108392 - DNA, 20 bp, Artificial Sequence
  chemically synthesized
taacagatcatctttcatga

SEQ ID NO: 108393 - DNA, 20 bp, Artificial Sequence
  chemically synthesized
cttctgatatgtggtattaa

SEQ ID NO: 108394 - DNA, 20 bp, Artificial Sequence
  chemically synthesized
gatctgttaataccacatat

SEQ ID NO: 108395 - DNA, 20 bp, Artificial Sequence
  chemically synthesized
actaaaacccttctgatatg

SEQ ID NO: 108396 - DNA, 20 bp, Artificial Sequence
  chemically synthesized
ctgttaataccacatatcag

SEQ ID NO: 108397 - DNA, 20 bp, Artificial Sequence
  chemically synthesized
tgttaataccacatatcaga

SEQ ID NO: 108398 - DNA, 20 bp, Artificial Sequence
  chemically synthesized
gttaataccacatatcagaa

SEQ ID NO: 108399 - DNA, 20 bp, Artificial Sequence
  chemically synthesized
accacatatcagaagggttt

SEQ ID NO: 108400 - DNA, 20 bp, Artificial Sequence
  chemically synthesized
atatcagaagggttttagtt

SEQ ID NO: 108401 - DNA, 20 bp, Artificial Sequence
  chemically synthesized
gaagggttttagttcagccc

SEQ ID NO: 108402 - DNA, 20 bp, Artificial Sequence
  chemically synthesized
aacacaatgtatcatgtctg

SEQ ID NO: 108403 - DNA, 20 bp, Artificial Sequence
  chemically synthesized
aaacacaatgtatcatgtct

SEQ ID NO: 108404 - DNA, 20 bp, Artificial Sequence
  chemically synthesized
taaacacaatgtatcatgtc

SEQ ID NO: 108405 - DNA, 20 bp, Artificial Sequence
  chemically synthesized
acatgatacattgtgtttat

SEQ ID NO: 108406 - DNA, 20 bp, Artificial Sequence
  chemically synthesized
gttgtttgccaaagtaatga

SEQ ID NO: 108407 - DNA, 20 bp, Artificial Sequence
  chemically synthesized
taagttttctttcattactt

SEQ ID NO: 108408 - DNA, 20 bp, Artificial Sequence
  chemically synthesized
tcaaaagacgttgtttgcca

SEQ ID NO: 108409 - DNA, 20 bp, Artificial Sequence
  chemically synthesized
gaaaggaaggttaaaatcaa

SEQ ID NO: 108410 - DNA, 20 bp, Artificial Sequence
  chemically synthesized
ccccttagtcattgaaagga

SEQ ID NO: 108411 - DNA, 20 bp, Artificial Sequence
  chemically synthesized
cccccttagtcattgaaagg

SEQ ID NO: 108412 - DNA, 20 bp, Artificial Sequence
  chemically synthesized
agtcccccttagtcattgaa

SEQ ID NO: 108413 - DNA, 20 bp, Artificial Sequence
  chemically synthesized
gagtcccccttagtcattga

SEQ ID NO: 108414 - DNA, 20 bp, Artificial Sequence
  chemically synthesized
taaccttcctttcaatgact

SEQ ID NO: 108415 - DNA, 20 bp, Artificial Sequence
  chemically synthesized
aaccttcctttcaatgacta

SEQ ID NO: 108416 - DNA, 20 bp, Artificial Sequence
  chemically synthesized
accttcctttcaatgactaa

SEQ ID NO: 108417 - DNA, 20 bp, Artificial Sequence
  chemically synthesized
ccttcctttcaatgactaag

SEQ ID NO: 108418 - DNA, 20 bp, Artificial Sequence
  chemically synthesized
cttcctttcaatgactaagg

SEQ ID NO: 108419 - DNA, 20 bp, Artificial Sequence
  chemically synthesized
atacttattagagtccccct

SEQ ID NO: 108420 - DNA, 20 bp, Artificial Sequence
  chemically synthesized
tgactaagggggactctaat

SEQ ID NO: 108421 - DNA, 20 bp, Artificial Sequence
  chemically synthesized
ttctacctagatacttatta

SEQ ID NO: 108422 - DNA, 20 bp, Artificial Sequence
  chemically synthesized
aattctacctagatacttat

SEQ ID NO: 108423 - DNA, 20 bp, Artificial Sequence
  chemically synthesized
gggggactctaataagtatc

SEQ ID NO: 108424 - DNA, 20 bp, Artificial Sequence
  chemically synthesized
ggggactctaataagtatct

SEQ ID NO: 108425 - DNA, 20 bp, Artificial Sequence
  chemically synthesized
gactctaataagtatctagg

SEQ ID NO: 108426 - DNA, 20 bp, Artificial Sequence
  chemically synthesized
tcttctttgacaattctacc

SEQ ID NO: 108427 - DNA, 20 bp, Artificial Sequence
  chemically synthesized
gtatctaggtagaattgtca

SEQ ID NO: 108428 - DNA, 20 bp, Artificial Sequence
  chemically synthesized
tctaggtagaattgtcaaag

SEQ ID NO: 108429 - DNA, 20 bp, Artificial Sequence
  chemically synthesized
gtagaattgtcaaagaagat

SEQ ID NO: 108430 - DNA, 20 bp, Artificial Sequence
  chemically synthesized
aattgtcaaagaagatgagt

SEQ ID NO: 108431 - DNA, 20 bp, Artificial Sequence
  chemically synthesized
atttacatattgactgttac

SEQ ID NO: 108432 - DNA, 20 bp, Artificial Sequence
  chemically synthesized
catttgtgtagtgcttgtaa

SEQ ID NO: 108433 - DNA, 20 bp, Artificial Sequence
  chemically synthesized
tgttacaagcactacacaaa

SEQ ID NO: 108434 - DNA, 20 bp, Artificial Sequence
  chemically synthesized
ttatgtaacaaccatttgtg

SEQ ID NO: 108435 - DNA, 20 bp, Artificial Sequence
  chemically synthesized
ggtaactctaatttcatttc

SEQ ID NO: 108436 - DNA, 20 bp, Artificial Sequence
  chemically synthesized
taacatacttgaaatgaaat

SEQ ID NO: 108437 - DNA, 20 bp, Artificial Sequence
  chemically synthesized
acatacttgaaatgaaatta

SEQ ID NO: 108438 - DNA, 20 bp, Artificial Sequence
  chemically synthesized
acacacacatatatttgcgt

SEQ ID NO: 108439 - DNA, 20 bp, Artificial Sequence
  chemically synthesized
tacacacacatatatttgcg

SEQ ID NO: 108440 - DNA, 20 bp, Artificial Sequence
  chemically synthesized
tcaattaaaaaaaaaaaaac

SEQ ID NO: 108441 - DNA, 20 bp, Artificial Sequence
  chemically synthesized
ttgtttttttttttttaatt

SEQ ID NO: 108442 - DNA, 20 bp, Artificial Sequence
  chemically synthesized
gtttttttttttttaattga

SEQ ID NO: 108443 - DNA, 20 bp, Artificial Sequence
  chemically synthesized
ttttttttttttaattgaga

SEQ ID NO: 108444 - DNA, 20 bp, Artificial Sequence
  chemically synthesized
ttttttttttaattgagaga

SEQ ID NO: 108445 - DNA, 20 bp, Artificial Sequence
  chemically synthesized
ttttttttaattgagagaga

SEQ ID NO: 108446 - DNA, 20 bp, Artificial Sequence
  chemically synthesized
tttttttaattgagagagag

SEQ ID NO: 108447 - DNA, 20 bp, Artificial Sequence
  chemically synthesized
ttttttaattgagagagaga

SEQ ID NO: 108448 - DNA, 20 bp, Artificial Sequence
  chemically synthesized
tccagtctaggtgacagaat

SEQ ID NO: 108449 - DNA, 20 bp, Artificial Sequence
  chemically synthesized
gagggtctcattctgtcacc

SEQ ID NO: 108450 - DNA, 20 bp, Artificial Sequence
  chemically synthesized
ctgtactccagtctaggtga

SEQ ID NO: 108451 - DNA, 20 bp, Artificial Sequence
  chemically synthesized
tctcattctgtcacctagac

SEQ ID NO: 108452 - DNA, 20 bp, Artificial Sequence
  chemically synthesized
tcattctgtcacctagactg

SEQ ID NO: 108453 - DNA, 20 bp, Artificial Sequence
  chemically synthesized
atgctactgtactccagtct

SEQ ID NO: 108454 - DNA, 20 bp, Artificial Sequence
  chemically synthesized
tatgctactgtactccagtc

SEQ ID NO: 108455 - DNA, 20 bp, Artificial Sequence
  chemically synthesized
ctgtcacctagactggagta

SEQ ID NO: 108456 - DNA, 20 bp, Artificial Sequence
  chemically synthesized
gtgactatgctactgtactc

SEQ ID NO: 108457 - DNA, 20 bp, Artificial Sequence
  chemically synthesized
tcacctagactggagtacag

SEQ ID NO: 108458 - DNA, 20 bp, Artificial Sequence
  chemically synthesized
tagactggagtacagtagca

SEQ ID NO: 108459 - DNA, 20 bp, Artificial Sequence
  chemically synthesized
ggagtacagtagcatagtca

SEQ ID NO: 108460 - DNA, 20 bp, Artificial Sequence
  chemically synthesized
agcatagtcacagctccctg

SEQ ID NO: 108461 - DNA, 20 bp, Artificial Sequence
  chemically synthesized
caaggctgcaaggctgcagg

SEQ ID NO: 108462 - DNA, 20 bp, Artificial Sequence
  chemically synthesized
gtcaaggctgcaaggctgca

SEQ ID NO: 108463 - DNA, 20 bp, Artificial Sequence
  chemically synthesized
ggtcaaggctgcaaggctgc

SEQ ID NO: 108464 - DNA, 20 bp, Artificial Sequence
  chemically synthesized
aggtcaaggctgcaaggctg

SEQ ID NO: 108465 - DNA, 20 bp, Artificial Sequence
  chemically synthesized
cacagctccctgcagccttg

SEQ ID NO: 108466 - DNA, 20 bp, Artificial Sequence
  chemically synthesized
cctgggaggtcaaggctgca

SEQ ID NO: 108467 - DNA, 20 bp, Artificial Sequence
  chemically synthesized
gcctgggaggtcaaggctgc

SEQ ID NO: 108468 - DNA, 20 bp, Artificial Sequence
  chemically synthesized
tgcttgagcctgggaggtca

SEQ ID NO: 108469 - DNA, 20 bp, Artificial Sequence
  chemically synthesized
gccttgcagccttgacctcc

SEQ ID NO: 108470 - DNA, 20 bp, Artificial Sequence
  chemically synthesized
ttgcttgagcctgggaggtc

SEQ ID NO: 108471 - DNA, 20 bp, Artificial Sequence
  chemically synthesized
ccttgcagccttgacctccc

SEQ ID NO: 108472 - DNA, 20 bp, Artificial Sequence
  chemically synthesized
gaggattgcttgagcctggg

SEQ ID NO: 108473 - DNA, 20 bp, Artificial Sequence
  chemically synthesized
ggaggattgcttgagcctgg

SEQ ID NO: 108474 - DNA, 20 bp, Artificial Sequence
  chemically synthesized
agccttgacctcccaggctc

SEQ ID NO: 108475 - DNA, 20 bp, Artificial Sequence
  chemically synthesized
caggaggattgcttgagcct

SEQ ID NO: 108476 - DNA, 20 bp, Artificial Sequence
  chemically synthesized
gcaggaggattgcttgagcc

SEQ ID NO: 108477 - DNA, 20 bp, Artificial Sequence
  chemically synthesized
ctgaggcaggaggattgctt

SEQ ID NO: 108478 - DNA, 20 bp, Artificial Sequence
  chemically synthesized
ctcaagcaatcctcctgcct

SEQ ID NO: 108479 - DNA, 20 bp, Artificial Sequence
  chemically synthesized
actcaggacgctgaggcagg

SEQ ID NO: 108480 - DNA, 20 bp, Artificial Sequence
  chemically synthesized
tactcaggacgctgaggcag

SEQ ID NO: 108481 - DNA, 20 bp, Artificial Sequence
  chemically synthesized
gctactcaggacgctgaggc

SEQ ID NO: 108482 - DNA, 20 bp, Artificial Sequence
  chemically synthesized
agctactcaggacgctgagg

SEQ ID NO: 108483 - DNA, 20 bp, Artificial Sequence
  chemically synthesized
cccagctactcaggacgctg

SEQ ID NO: 108484 - DNA, 20 bp, Artificial Sequence
  chemically synthesized
tcccagctactcaggacgct

SEQ ID NO: 108485 - DNA, 20 bp, Artificial Sequence
  chemically synthesized
tcctcctgcctcagcgtcct

SEQ ID NO: 108486 - DNA, 20 bp, Artificial Sequence
  chemically synthesized
tcctgcctcagcgtcctgag

SEQ ID NO: 108487 - DNA, 20 bp, Artificial Sequence
  chemically synthesized
gcctcagcgtcctgagtagc

SEQ ID NO: 108488 - DNA, 20 bp, Artificial Sequence
  chemically synthesized
ctctgtaatcccagctactc

SEQ ID NO: 108489 - DNA, 20 bp, Artificial Sequence
  chemically synthesized
cctcagcgtcctgagtagct

SEQ ID NO: 108490 - DNA, 20 bp, Artificial Sequence
  chemically synthesized
cctctgtaatcccagctact

SEQ ID NO: 108491 - DNA, 20 bp, Artificial Sequence
  chemically synthesized
gtcctgagtagctgggatta

SEQ ID NO: 108492 - DNA, 20 bp, Artificial Sequence
  chemically synthesized
gtggaacacctctgtaatcc

SEQ ID NO: 108493 - DNA, 20 bp, Artificial Sequence
  chemically synthesized
cctgagtagctgggattaca

SEQ ID NO: 108494 - DNA, 20 bp, Artificial Sequence
  chemically synthesized
ctgagtagctgggattacag

SEQ ID NO: 108495 - DNA, 20 bp, Artificial Sequence
  chemically synthesized
taaaaaatagttggatgtgg

SEQ ID NO: 108496 - DNA, 20 bp, Artificial Sequence
  chemically synthesized
ttttaaaaaatagttggatg

SEQ ID NO: 108497 - DNA, 20 bp, Artificial Sequence
  chemically synthesized
aaaattttttaaaaaatagt

SEQ ID NO: 108498 - DNA, 20 bp, Artificial Sequence
  chemically synthesized
caaaaaaattttttaaaaaa

SEQ ID NO: 108499 - DNA, 20 bp, Artificial Sequence
  chemically synthesized
tattttttaaaaaatttttt

SEQ ID NO: 108500 - DNA, 20 bp, Artificial Sequence
  chemically synthesized
tttttaaaaaatttttttgg

SEQ ID NO: 108501 - DNA, 20 bp, Artificial Sequence
  chemically synthesized
tttaaaaaatttttttggta

SEQ ID NO: 108502 - DNA, 20 bp, Artificial Sequence
  chemically synthesized
aaaaatttttttggtagaga

SEQ ID NO: 108503 - DNA, 20 bp, Artificial Sequence
  chemically synthesized
aaatttttttggtagagacg

SEQ ID NO: 108504 - DNA, 20 bp, Artificial Sequence
  chemically synthesized
gtagagacggagtcttgcta

SEQ ID NO: 108505 - DNA, 20 bp, Artificial Sequence
  chemically synthesized
accagtctgggaaccatagc

SEQ ID NO: 108506 - DNA, 20 bp, Artificial Sequence
  chemically synthesized
cggagtcttgctatggttcc

SEQ ID NO: 108507 - DNA, 20 bp, Artificial Sequence
  chemically synthesized
cgagaccagtctgggaacca

SEQ ID NO: 108508 - DNA, 20 bp, Artificial Sequence
  chemically synthesized
tcttgctatggttcccagac

SEQ ID NO: 108509 - DNA, 20 bp, Artificial Sequence
  chemically synthesized
caggagttcgagaccagtct

SEQ ID NO: 108510 - DNA, 20 bp, Artificial Sequence
  chemically synthesized
ccaggagttcgagaccagtc

SEQ ID NO: 108511 - DNA, 20 bp, Artificial Sequence
  chemically synthesized
tgagcccaggagttcgagac

SEQ ID NO: 108512 - DNA, 20 bp, Artificial Sequence
  chemically synthesized
ccagactggtctcgaactcc

SEQ ID NO: 108513 - DNA, 20 bp, Artificial Sequence
  chemically synthesized
tcgcttgagcccaggagttc

SEQ ID NO: 108514 - DNA, 20 bp, Artificial Sequence
  chemically synthesized
cagactggtctcgaactcct

SEQ ID NO: 108515 - DNA, 20 bp, Artificial Sequence
  chemically synthesized
ggagaatcgcttgagcccag

SEQ ID NO: 108516 - DNA, 20 bp, Artificial Sequence
  chemically synthesized
ggtctcgaactcctgggctc

SEQ ID NO: 108517 - DNA, 20 bp, Artificial Sequence
  chemically synthesized
caggagaatcgcttgagccc

SEQ ID NO: 108518 - DNA, 20 bp, Artificial Sequence
  chemically synthesized
gcaggagaatcgcttgagcc

SEQ ID NO: 108519 - DNA, 20 bp, Artificial Sequence
  chemically synthesized
ctaaggcaggagaatcgctt

SEQ ID NO: 108520 - DNA, 20 bp, Artificial Sequence
  chemically synthesized
ctcaagcgattctcctgcct

SEQ ID NO: 108521 - DNA, 20 bp, Artificial Sequence
  chemically synthesized
aatttgggaggctaaggcag

SEQ ID NO: 108522 - DNA, 20 bp, Artificial Sequence
  chemically synthesized
gcaatttgggaggctaaggc

SEQ ID NO: 108523 - DNA, 20 bp, Artificial Sequence
  chemically synthesized
agcaatttgggaggctaagg

SEQ ID NO: 108524 - DNA, 20 bp, Artificial Sequence
  chemically synthesized
cccagcaatttgggaggcta

SEQ ID NO: 108525 - DNA, 20 bp, Artificial Sequence
  chemically synthesized
tcccagcaatttgggaggct

SEQ ID NO: 108526 - DNA, 20 bp, Artificial Sequence
  chemically synthesized
tgtaatcccagcaatttggg

SEQ ID NO: 108527 - DNA, 20 bp, Artificial Sequence
  chemically synthesized
ctgtaatcccagcaatttgg

SEQ ID NO: 108528 - DNA, 20 bp, Artificial Sequence
  chemically synthesized
gccttagcctcccaaattgc

SEQ ID NO: 108529 - DNA, 20 bp, Artificial Sequence
  chemically synthesized
gactgtaatcccagcaattt

SEQ ID NO: 108530 - DNA, 20 bp, Artificial Sequence
  chemically synthesized
ccttagcctcccaaattgct

SEQ ID NO: 108531 - DNA, 20 bp, Artificial Sequence
  chemically synthesized
cgactgtaatcccagcaatt

SEQ ID NO: 108532 - DNA, 20 bp, Artificial Sequence
  chemically synthesized
ctcccaaattgctgggatta

SEQ ID NO: 108533 - DNA, 20 bp, Artificial Sequence
  chemically synthesized
gtggctcacgactgtaatcc

SEQ ID NO: 108534 - DNA, 20 bp, Artificial Sequence
  chemically synthesized
attgctgggattacagtcgt

SEQ ID NO: 108535 - DNA, 20 bp, Artificial Sequence
  chemically synthesized
cagtcgtgagccaccttgcc

SEQ ID NO: 108536 - DNA, 20 bp, Artificial Sequence
  chemically synthesized
atacacacagccaggcaagg

SEQ ID NO: 108537 - DNA, 20 bp, Artificial Sequence
  chemically synthesized
gatatacacacagccaggca

SEQ ID NO: 108538 - DNA, 20 bp, Artificial Sequence
  chemically synthesized
agatatacacacagccaggc

SEQ ID NO: 108539 - DNA, 20 bp, Artificial Sequence
  chemically synthesized
taaaagatatacacacagcc

SEQ ID NO: 108540 - DNA, 20 bp, Artificial Sequence
  chemically synthesized
ttaaaagatatacacacagc

SEQ ID NO: 108541 - DNA, 20 bp, Artificial Sequence
  chemically synthesized
aacattaaaagatatacaca

SEQ ID NO: 108542 - DNA, 20 bp, Artificial Sequence
  chemically synthesized
ctgtaaaagtttaacattaa

SEQ ID NO: 108543 - DNA, 20 bp, Artificial Sequence
  chemically synthesized
cttttaatgttaaactttta

SEQ ID NO: 108544 - DNA, 20 bp, Artificial Sequence
  chemically synthesized
ttaatgttaaacttttacag

SEQ ID NO: 108545 - DNA, 20 bp, Artificial Sequence
  chemically synthesized
agtgagtatttctactgtaa

SEQ ID NO: 108546 - DNA, 20 bp, Artificial Sequence
  chemically synthesized
gcaattgaaaagcaaatagt

SEQ ID NO: 108547 - DNA, 20 bp, Artificial Sequence
  chemically synthesized
gcaagcaattgaaaagcaaa

SEQ ID NO: 108548 - DNA, 20 bp, Artificial Sequence
  chemically synthesized
cttcagagcaagcaattgaa

SEQ ID NO: 108549 - DNA, 20 bp, Artificial Sequence
  chemically synthesized
cttttcaattgcttgctctg

SEQ ID NO: 108550 - DNA, 20 bp, Artificial Sequence
  chemically synthesized
agcattgtgctcttcagagc

SEQ ID NO: 108551 - DNA, 20 bp, Artificial Sequence
  chemically synthesized
tttcaattgcttgctctgaa

SEQ ID NO: 108552 - DNA, 20 bp, Artificial Sequence
  chemically synthesized
gtaaagcattgtgctcttca

SEQ ID NO: 108553 - DNA, 20 bp, Artificial Sequence
  chemically synthesized
cagtaaagcattgtgctctt

SEQ ID NO: 108554 - DNA, 20 bp, Artificial Sequence
  chemically synthesized
gagcacaatgctttactgaa

SEQ ID NO: 108555 - DNA, 20 bp, Artificial Sequence
  chemically synthesized
tttttgatctctgttcagta

SEQ ID NO: 108556 - DNA, 20 bp, Artificial Sequence
  chemically synthesized
gcacaatgctttactgaaca

SEQ ID NO: 108557 - DNA, 20 bp, Artificial Sequence
  chemically synthesized
gtgggtttttgatctctgtt

SEQ ID NO: 108558 - DNA, 20 bp, Artificial Sequence
  chemically synthesized
acagagatcaaaaacccacc

SEQ ID NO: 108559 - DNA, 20 bp, Artificial Sequence
  chemically synthesized
tatttcctgtttaactaggt

SEQ ID NO: 108560 - DNA, 20 bp, Artificial Sequence
  chemically synthesized
ttatttcctgtttaactagg

SEQ ID NO: 108561 - DNA, 20 bp, Artificial Sequence
  chemically synthesized
caaaaacccacctagttaaa

SEQ ID NO: 108562 - DNA, 20 bp, Artificial Sequence
  chemically synthesized
gtcttatttcctgtttaact

SEQ ID NO: 108563 - DNA, 20 bp, Artificial Sequence
  chemically synthesized
aaaaacccacctagttaaac

SEQ ID NO: 108564 - DNA, 20 bp, Artificial Sequence
  chemically synthesized
agtcttatttcctgtttaac

SEQ ID NO: 108565 - DNA, 20 bp, Artificial Sequence
  chemically synthesized
cacctagttaaacaggaaat

SEQ ID NO: 108566 - DNA, 20 bp, Artificial Sequence
  chemically synthesized
agaccattaaatatttttat

SEQ ID NO: 108567 - DNA, 20 bp, Artificial Sequence
  chemically synthesized
agactaataaaaatatttaa

SEQ ID NO: 108568 - DNA, 20 bp, Artificial Sequence
  chemically synthesized
ttattctatagttgttaaat

SEQ ID NO: 108569 - DNA, 20 bp, Artificial Sequence
  chemically synthesized
atggtcttatttaacaacta

SEQ ID NO: 108570 - DNA, 20 bp, Artificial Sequence
  chemically synthesized
ctgttttcagttttattcta

SEQ ID NO: 108571 - DNA, 20 bp, Artificial Sequence
  chemically synthesized
ctatagaataaaactgaaaa

SEQ ID NO: 108572 - DNA, 20 bp, Artificial Sequence
  chemically synthesized
ttatttcactgtactgtttt

SEQ ID NO: 108573 - DNA, 20 bp, Artificial Sequence
  chemically synthesized
gaataaaactgaaaacagta

SEQ ID NO: 108574 - DNA, 20 bp, Artificial Sequence
  chemically synthesized
gaaaacagtacagtgaaata

SEQ ID NO: 108575 - DNA, 20 bp, Artificial Sequence
  chemically synthesized
atgcagtgacattggtacaa

SEQ ID NO: 108576 - DNA, 20 bp, Artificial Sequence
  chemically synthesized
catgcagtgacattggtaca

SEQ ID NO: 108577 - DNA, 20 bp, Artificial Sequence
  chemically synthesized
ccgatatcatgcagtgacat

SEQ ID NO: 108578 - DNA, 20 bp, Artificial Sequence
  chemically synthesized
tgtttagtaccgatatcatg

SEQ ID NO: 108579 - DNA, 20 bp, Artificial Sequence
  chemically synthesized
ccaatgtcactgcatgatat

SEQ ID NO: 108580 - DNA, 20 bp, Artificial Sequence
  chemically synthesized
gctcctgagaacaatttgtt

SEQ ID NO: 108581 - DNA, 20 bp, Artificial Sequence
  chemically synthesized
ggtactaaacaaattgttct

SEQ ID NO: 108582 - DNA, 20 bp, Artificial Sequence
  chemically synthesized
gtactaaacaaattgttctc

SEQ ID NO: 108583 - DNA, 20 bp, Artificial Sequence
  chemically synthesized
actaaacaaattgttctcag

SEQ ID NO: 108584 - DNA, 20 bp, Artificial Sequence
  chemically synthesized
gaatatgacttgtagctcct

SEQ ID NO: 108585 - DNA, 20 bp, Artificial Sequence
  chemically synthesized
aaattgttctcaggagctac

SEQ ID NO: 108586 - DNA, 20 bp, Artificial Sequence
  chemically synthesized
gaccacctgaatatgacttg

SEQ ID NO: 108587 - DNA, 20 bp, Artificial Sequence
  chemically synthesized
caggagctacaagtcatatt

SEQ ID NO: 108588 - DNA, 20 bp, Artificial Sequence
  chemically synthesized
aggagctacaagtcatattc

SEQ ID NO: 108589 - DNA, 20 bp, Artificial Sequence
  chemically synthesized
agctacaagtcatattcagg

SEQ ID NO: 108590 - DNA, 20 bp, Artificial Sequence
  chemically synthesized
acaagtcatattcaggtggt

SEQ ID NO: 108591 - DNA, 20 bp, Artificial Sequence
  chemically synthesized
atttctcattgtgtaaggta

SEQ ID NO: 108592 - DNA, 20 bp, Artificial Sequence
  chemically synthesized
actacatttctcattgtgta

SEQ ID NO: 108593 - DNA, 20 bp, Artificial Sequence
  chemically synthesized
gaaactttaccttacacaat

SEQ ID NO: 108594 - DNA, 20 bp, Artificial Sequence
  chemically synthesized
tactacatttctcattgtgt

SEQ ID NO: 108595 - DNA, 20 bp, Artificial Sequence
  chemically synthesized
accttacacaatgagaaatg

SEQ ID NO: 108596 - DNA, 20 bp, Artificial Sequence
  chemically synthesized
ctaactagttgcagatattt

SEQ ID NO: 108597 - DNA, 20 bp, Artificial Sequence
  chemically synthesized
gtatctgaaatatctgcaac

SEQ ID NO: 108598 - DNA, 20 bp, Artificial Sequence
  chemically synthesized
ttcttaaacctaactagttg

SEQ ID NO: 108599 - DNA, 20 bp, Artificial Sequence
  chemically synthesized
ctgaaatatctgcaactagt

SEQ ID NO: 108600 - DNA, 20 bp, Artificial Sequence
  chemically synthesized
tgaaatatctgcaactagtt

SEQ ID NO: 108601 - DNA, 20 bp, Artificial Sequence
  chemically synthesized
tttcttttcttaaacctaac

SEQ ID NO: 108602 - DNA, 20 bp, Artificial Sequence
  chemically synthesized
atctgcaactagttaggttt

SEQ ID NO: 108603 - DNA, 20 bp, Artificial Sequence
  chemically synthesized
caactagttaggtttaagaa

SEQ ID NO: 108604 - DNA, 20 bp, Artificial Sequence
  chemically synthesized
gaaaagaaaactcttaccat

SEQ ID NO: 108605 - DNA, 20 bp, Artificial Sequence
  chemically synthesized
ttattttcccccaatggtaa

SEQ ID NO: 108606 - DNA, 20 bp, Artificial Sequence
  chemically synthesized
aaaagaaaactcttaccatt

SEQ ID NO: 108607 - DNA, 20 bp, Artificial Sequence
  chemically synthesized
aaagaaaactcttaccattg

SEQ ID NO: 108608 - DNA, 20 bp, Artificial Sequence
  chemically synthesized
atttattttcccccaatggt

SEQ ID NO: 108609 - DNA, 20 bp, Artificial Sequence
  chemically synthesized
aagaaaactcttaccattgg

SEQ ID NO: 108610 - DNA, 20 bp, Artificial Sequence
  chemically synthesized
aaggatttattttcccccaa

SEQ ID NO: 108611 - DNA, 20 bp, Artificial Sequence
  chemically synthesized
tgggggaaaataaatccttt

SEQ ID NO: 108612 - DNA, 20 bp, Artificial Sequence
  chemically synthesized
agttcaatcctatttctaaa

SEQ ID NO: 108613 - DNA, 20 bp, Artificial Sequence
  chemically synthesized
aaaataaatccttttagaaa

SEQ ID NO: 108614 - DNA, 20 bp, Artificial Sequence
  chemically synthesized
cagttcaatcctatttctaa

SEQ ID NO: 108615 - DNA, 20 bp, Artificial Sequence
  chemically synthesized
aaataaatccttttagaaat

SEQ ID NO: 108616 - DNA, 20 bp, Artificial Sequence
  chemically synthesized
ataggattgaactgtcaata

SEQ ID NO: 108617 - DNA, 20 bp, Artificial Sequence
  chemically synthesized
attataaacagctttattga

SEQ ID NO: 108618 - DNA, 20 bp, Artificial Sequence
  chemically synthesized
ttataagaatttattataaa

SEQ ID NO: 108619 - DNA, 20 bp, Artificial Sequence
  chemically synthesized
gtttataataaattcttata

SEQ ID NO: 108620 - DNA, 20 bp, Artificial Sequence
  chemically synthesized
cctttcatgttaaactttat

SEQ ID NO: 108621 - DNA, 20 bp, Artificial Sequence
  chemically synthesized
tcttataaagtttaacatga

SEQ ID NO: 108622 - DNA, 20 bp, Artificial Sequence
  chemically synthesized
cttataaagtttaacatgaa

SEQ ID NO: 108623 - DNA, 20 bp, Artificial Sequence
  chemically synthesized
acatgaaaggactgtaaaaa

SEQ ID NO: 108624 - DNA, 20 bp, Artificial Sequence
  chemically synthesized
ttgaataacatctgttttta

SEQ ID NO: 108625 - DNA, 20 bp, Artificial Sequence
  chemically synthesized
taaaaacagatgttattcaa

SEQ ID NO: 108626 - DNA, 20 bp, Artificial Sequence
  chemically synthesized
gaggctgtagcaataaaaat

SEQ ID NO: 108627 - DNA, 20 bp, Artificial Sequence
  chemically synthesized
acatctgatttttattgcta

SEQ ID NO: 108628 - DNA, 20 bp, Artificial Sequence
  chemically synthesized
caaaagtcagtgagaggctg

SEQ ID NO: 108629 - DNA, 20 bp, Artificial Sequence
  chemically synthesized
atgagacaaaagtcagtgag

SEQ ID NO: 108630 - DNA, 20 bp, Artificial Sequence
  chemically synthesized
aatgagacaaaagtcagtga

SEQ ID NO: 108631 - DNA, 20 bp, Artificial Sequence
  chemically synthesized
aaaatgagacaaaagtcagt

SEQ ID NO: 108632 - DNA, 20 bp, Artificial Sequence
  chemically synthesized
atgaaaaatgagacaaaagt

SEQ ID NO: 108633 - DNA, 20 bp, Artificial Sequence
  chemically synthesized
ctccatgaaaaatgagacaa

SEQ ID NO: 108634 - DNA, 20 bp, Artificial Sequence
  chemically synthesized
taaaagcctccatgaaaaat

SEQ ID NO: 108635 - DNA, 20 bp, Artificial Sequence
  chemically synthesized
gacttttgtctcatttttca

SEQ ID NO: 108636 - DNA, 20 bp, Artificial Sequence
  chemically synthesized
cttttgtctcatttttcatg

SEQ ID NO: 108637 - DNA, 20 bp, Artificial Sequence
  chemically synthesized
ttttgtctcatttttcatgg

SEQ ID NO: 108638 - DNA, 20 bp, Artificial Sequence
  chemically synthesized
catttttcatggaggctttt

SEQ ID NO: 108639 - DNA, 20 bp, Artificial Sequence
  chemically synthesized
tgtattttgttaaaacttaa

SEQ ID NO: 108640 - DNA, 20 bp, Artificial Sequence
  chemically synthesized
tttaacaaaatacaaaattg

SEQ ID NO: 108641 - DNA, 20 bp, Artificial Sequence
  chemically synthesized
taacaaaatacaaaattgaa

SEQ ID NO: 108642 - DNA, 20 bp, Artificial Sequence
  chemically synthesized
aaaattgaagagctttttaa

SEQ ID NO: 108643 - DNA, 20 bp, Artificial Sequence
  chemically synthesized
cataaatctcttcttttaaa

SEQ ID NO: 108644 - DNA, 20 bp, Artificial Sequence
  chemically synthesized
attgaagagctttttaaaag

SEQ ID NO: 108645 - DNA, 20 bp, Artificial Sequence
  chemically synthesized
tgaagagctttttaaaagaa

SEQ ID NO: 108646 - DNA, 20 bp, Artificial Sequence
  chemically synthesized
gaagagatttatgcgatgta

SEQ ID NO: 108647 - DNA, 20 bp, Artificial Sequence
  chemically synthesized
agatttatgcgatgtataga

SEQ ID NO: 108648 - DNA, 20 bp, Artificial Sequence
  chemically synthesized
cgatgtatagaaagattttc

SEQ ID NO: 108649 - DNA, 20 bp, Artificial Sequence
  chemically synthesized
atgtatagaaagattttctg

SEQ ID NO: 108650 - DNA, 20 bp, Artificial Sequence
  chemically synthesized
tgatcaggattttataactc

SEQ ID NO: 108651 - DNA, 20 bp, Artificial Sequence
  chemically synthesized
agttataaaatcctgatcac

SEQ ID NO: 108652 - DNA, 20 bp, Artificial Sequence
  chemically synthesized
cctaagtatatctggtgatc

SEQ ID NO: 108653 - DNA, 20 bp, Artificial Sequence
  chemically synthesized
tcctaagtatatctggtgat

SEQ ID NO: 108654 - DNA, 20 bp, Artificial Sequence
  chemically synthesized
aatcatttcctaagtatatc

SEQ ID NO: 108655 - DNA, 20 bp, Artificial Sequence
  chemically synthesized
tcctgatcaccagatatact

SEQ ID NO: 108656 - DNA, 20 bp, Artificial Sequence
  chemically synthesized
cctgatcaccagatatactt

SEQ ID NO: 108657 - DNA, 20 bp, Artificial Sequence
  chemically synthesized
agccttcttaatcatttcct

SEQ ID NO: 108658 - DNA, 20 bp, Artificial Sequence
  chemically synthesized
gatatacttaggaaatgatt

SEQ ID NO: 108659 - DNA, 20 bp, Artificial Sequence
  chemically synthesized
atacttaggaaatgattaag

SEQ ID NO: 108660 - DNA, 20 bp, Artificial Sequence
  chemically synthesized
tacttaggaaatgattaaga

SEQ ID NO: 108661 - DNA, 20 bp, Artificial Sequence
  chemically synthesized
aaatgattaagaaggctgaa

SEQ ID NO: 108662 - DNA, 20 bp, Artificial Sequence
  chemically synthesized
tagagtctatgtttaccatt

SEQ ID NO: 108663 - DNA, 20 bp, Artificial Sequence
  chemically synthesized
agaaggctgaatggtaaaca

SEQ ID NO: 108664 - DNA, 20 bp, Artificial Sequence
  chemically synthesized
tgaatggtaaacatagactc

SEQ ID NO: 108665 - DNA, 20 bp, Artificial Sequence
  chemically synthesized
aaatgataattacatttcta

SEQ ID NO: 108666 - DNA, 20 bp, Artificial Sequence
  chemically synthesized
gaaaatgataattacatttc

SEQ ID NO: 108667 - DNA, 20 bp, Artificial Sequence
  chemically synthesized
ttttaataattaaaagaaga

SEQ ID NO: 108668 - DNA, 20 bp, Artificial Sequence
  chemically synthesized
atttttaataattaaaagaa

SEQ ID NO: 108669 - DNA, 20 bp, Artificial Sequence
  chemically synthesized
agatttttaataattaaaag

SEQ ID NO: 108670 - DNA, 20 bp, Artificial Sequence
  chemically synthesized
gcaagatttttaataattaa

SEQ ID NO: 108671 - DNA, 20 bp, Artificial Sequence
  chemically synthesized
ttattaaaaatcttgcattt

SEQ ID NO: 108672 - DNA, 20 bp, Artificial Sequence
  chemically synthesized
tattaaaaatcttgcattta

SEQ ID NO: 108673 - DNA, 20 bp, Artificial Sequence
  chemically synthesized
aaacttcagaccttaaatgc

SEQ ID NO: 108674 - DNA, 20 bp, Artificial Sequence
  chemically synthesized
aatcttgcatttaaggtctg

SEQ ID NO: 108675 - DNA, 20 bp, Artificial Sequence
  chemically synthesized
tggattagtctggcaaactt

SEQ ID NO: 108676 - DNA, 20 bp, Artificial Sequence
  chemically synthesized
atttaaggtctgaagtttgc

SEQ ID NO: 108677 - DNA, 20 bp, Artificial Sequence
  chemically synthesized
ctagtaaatttggattagtc

SEQ ID NO: 108678 - DNA, 20 bp, Artificial Sequence
  chemically synthesized
tctcactagtaaatttggat

SEQ ID NO: 108679 - DNA, 20 bp, Artificial Sequence
  chemically synthesized
ccagactaatccaaatttac

SEQ ID NO: 108680 - DNA, 20 bp, Artificial Sequence
  chemically synthesized
atgcctctcactagtaaatt

SEQ ID NO: 108681 - DNA, 20 bp, Artificial Sequence
  chemically synthesized
actaatccaaatttactagt

SEQ ID NO: 108682 - DNA, 20 bp, Artificial Sequence
  chemically synthesized
taatccaaatttactagtga

SEQ ID NO: 108683 - DNA, 20 bp, Artificial Sequence
  chemically synthesized
aatccaaatttactagtgag

SEQ ID NO: 108684 - DNA, 20 bp, Artificial Sequence
  chemically synthesized
aattcaaggatgcctctcac

SEQ ID NO: 108685 - DNA, 20 bp, Artificial Sequence
  chemically synthesized
aacagattaaggagaattca

SEQ ID NO: 108686 - DNA, 20 bp, Artificial Sequence
  chemically synthesized
aaacagattaaggagaattc

SEQ ID NO: 108687 - DNA, 20 bp, Artificial Sequence
  chemically synthesized
aagtaactaaacagattaag

SEQ ID NO: 108688 - DNA, 20 bp, Artificial Sequence
  chemically synthesized
ttaagtaactaaacagatta

SEQ ID NO: 108689 - DNA, 20 bp, Artificial Sequence
  chemically synthesized
tttaagtaactaaacagatt

SEQ ID NO: 108690 - DNA, 20 bp, Artificial Sequence
  chemically synthesized
tgaattctccttaatctgtt

SEQ ID NO: 108691 - DNA, 20 bp, Artificial Sequence
  chemically synthesized
aaacattttaagtaactaaa

SEQ ID NO: 108692 - DNA, 20 bp, Artificial Sequence
  chemically synthesized
tagaaagtcttaaacatttt

SEQ ID NO: 108693 - DNA, 20 bp, Artificial Sequence
  chemically synthesized
tttagttacttaaaatgttt

SEQ ID NO: 108694 - DNA, 20 bp, Artificial Sequence
  chemically synthesized
atgtttaagactttctaatc

SEQ ID NO: 108695 - DNA, 20 bp, Artificial Sequence
  chemically synthesized
gtaggcttctcttgattaga

SEQ ID NO: 108696 - DNA, 20 bp, Artificial Sequence
  chemically synthesized
gtttaagactttctaatcaa

SEQ ID NO: 108697 - DNA, 20 bp, Artificial Sequence
  chemically synthesized
gactgtaggcttctcttgat

SEQ ID NO: 108698 - DNA, 20 bp, Artificial Sequence
  chemically synthesized
taagactttctaatcaagag

SEQ ID NO: 108699 - DNA, 20 bp, Artificial Sequence
  chemically synthesized
ttctaatcaagagaagccta

SEQ ID NO: 108700 - DNA, 20 bp, Artificial Sequence
  chemically synthesized
cattatgccttcgagactgt

SEQ ID NO: 108701 - DNA, 20 bp, Artificial Sequence
  chemically synthesized
acattatgccttcgagactg

SEQ ID NO: 108702 - DNA, 20 bp, Artificial Sequence
  chemically synthesized
aagagaagcctacagtctcg

SEQ ID NO: 108703 - DNA, 20 bp, Artificial Sequence
  chemically synthesized
agagaagcctacagtctcga

SEQ ID NO: 108704 - DNA, 20 bp, Artificial Sequence
  chemically synthesized
ggagagaacattatgccttc

SEQ ID NO: 108705 - DNA, 20 bp, Artificial Sequence
  chemically synthesized
aaagttaaattggtttcgga

SEQ ID NO: 108706 - DNA, 20 bp, Artificial Sequence
  chemically synthesized
ctaaagttaaattggtttcg

SEQ ID NO: 108707 - DNA, 20 bp, Artificial Sequence
  chemically synthesized
acctaaagttaaattggttt

SEQ ID NO: 108708 - DNA, 20 bp, Artificial Sequence
  chemically synthesized
taaataacctaaagttaaat

SEQ ID NO: 108709 - DNA, 20 bp, Artificial Sequence
  chemically synthesized
ctccgaaaccaatttaactt

SEQ ID NO: 108710 - DNA, 20 bp, Artificial Sequence
  chemically synthesized
tccgaaaccaatttaacttt

SEQ ID NO: 108711 - DNA, 20 bp, Artificial Sequence
  chemically synthesized
agttccaattaaataaccta

SEQ ID NO: 108712 - DNA, 20 bp, Artificial Sequence
  chemically synthesized
ttaactttaggttatttaat

SEQ ID NO: 108713 - DNA, 20 bp, Artificial Sequence
  chemically synthesized
gttatttaattggaactcca

SEQ ID NO: 108714 - DNA, 20 bp, Artificial Sequence
  chemically synthesized
aatgaacttctaattctttg

SEQ ID NO: 108715 - DNA, 20 bp, Artificial Sequence
  chemically synthesized
taattggaactccaaagaat

SEQ ID NO: 108716 - DNA, 20 bp, Artificial Sequence
  chemically synthesized
agaatgaacttctaattctt

SEQ ID NO: 108717 - DNA, 20 bp, Artificial Sequence
  chemically synthesized
ttggaactccaaagaattag

SEQ ID NO: 108718 - DNA, 20 bp, Artificial Sequence
  chemically synthesized
agaagttcattctatttcct

SEQ ID NO: 108719 - DNA, 20 bp, Artificial Sequence
  chemically synthesized
tgtgaagaatgccaaggaaa

SEQ ID NO: 108720 - DNA, 20 bp, Artificial Sequence
  chemically synthesized
aggtgctgtgaagaatgcca

SEQ ID NO: 108721 - DNA, 20 bp, Artificial Sequence
  chemically synthesized
caggtgctgtgaagaatgcc

SEQ ID NO: 108722 - DNA, 20 bp, Artificial Sequence
  chemically synthesized
tatttccttggcattcttca

SEQ ID NO: 108723 - DNA, 20 bp, Artificial Sequence
  chemically synthesized
acactgtgccaggtgctgtg

SEQ ID NO: 108724 - DNA, 20 bp, Artificial Sequence
  chemically synthesized
ttggcattcttcacagcacc

SEQ ID NO: 108725 - DNA, 20 bp, Artificial Sequence
  chemically synthesized
attcttcacagcacctggca

SEQ ID NO: 108726 - DNA, 20 bp, Artificial Sequence
  chemically synthesized
tatgtacttaacactgtgcc

SEQ ID NO: 108727 - DNA, 20 bp, Artificial Sequence
  chemically synthesized
atatgtacttaacactgtgc

SEQ ID NO: 108728 - DNA, 20 bp, Artificial Sequence
  chemically synthesized
acagcacctggcacagtgtt

SEQ ID NO: 108729 - DNA, 20 bp, Artificial Sequence
  chemically synthesized
gcacagtgttaagtacatat

SEQ ID NO: 108730 - DNA, 20 bp, Artificial Sequence
  chemically synthesized
ctccttcaaaaatatttatt

SEQ ID NO: 108731 - DNA, 20 bp, Artificial Sequence
  chemically synthesized
atgctcaataaatatttttg

SEQ ID NO: 108732 - DNA, 20 bp, Artificial Sequence
  chemically synthesized
tgctcaataaatatttttga

SEQ ID NO: 108733 - DNA, 20 bp, Artificial Sequence
  chemically synthesized
ctcaataaatatttttgaag

SEQ ID NO: 108734 - DNA, 20 bp, Artificial Sequence
  chemically synthesized
tgaaggagtgaacattgctt

SEQ ID NO: 108735 - DNA, 20 bp, Artificial Sequence
  chemically synthesized
aaggagtgaacattgcttaa

SEQ ID NO: 108736 - DNA, 20 bp, Artificial Sequence
  chemically synthesized
aggagtgaacattgcttaag

SEQ ID NO: 108737 - DNA, 20 bp, Artificial Sequence
  chemically synthesized
ggagtgaacattgcttaaga

SEQ ID NO: 108738 - DNA, 20 bp, Artificial Sequence
  chemically synthesized
gttcctcttatttccctctt

SEQ ID NO: 108739 - DNA, 20 bp, Artificial Sequence
  chemically synthesized
acattgcttaagagggaaat

SEQ ID NO: 108740 - DNA, 20 bp, Artificial Sequence
  chemically synthesized
attgcttaagagggaaataa

SEQ ID NO: 108741 - DNA, 20 bp, Artificial Sequence
  chemically synthesized
ttgcttaagagggaaataag

SEQ ID NO: 108742 - DNA, 20 bp, Artificial Sequence
  chemically synthesized
gggaaataagaggaactatt

SEQ ID NO: 108743 - DNA, 20 bp, Artificial Sequence
  chemically synthesized
aataagaggaactattaaga

SEQ ID NO: 108744 - DNA, 20 bp, Artificial Sequence
  chemically synthesized
ttaaatatcttctatcttaa

SEQ ID NO: 108745 - DNA, 20 bp, Artificial Sequence
  chemically synthesized
aagaggaactattaagatag

SEQ ID NO: 108746 - DNA, 20 bp, Artificial Sequence
  chemically synthesized
aatagggaagaaataatttt

SEQ ID NO: 108747 - DNA, 20 bp, Artificial Sequence
  chemically synthesized
gaatagggaagaaataattt

SEQ ID NO: 108748 - DNA, 20 bp, Artificial Sequence
  chemically synthesized
tatcctctccatgaataggg

SEQ ID NO: 108749 - DNA, 20 bp, Artificial Sequence
  chemically synthesized
aattatttcttccctattca

SEQ ID NO: 108750 - DNA, 20 bp, Artificial Sequence
  chemically synthesized
tcatatcctctccatgaata

SEQ ID NO: 108751 - DNA, 20 bp, Artificial Sequence
  chemically synthesized
ttatttcttccctattcatg

SEQ ID NO: 108752 - DNA, 20 bp, Artificial Sequence
  chemically synthesized
atcatatcctctccatgaat

SEQ ID NO: 108753 - DNA, 20 bp, Artificial Sequence
  chemically synthesized
aatcatatcctctccatgaa

SEQ ID NO: 108754 - DNA, 20 bp, Artificial Sequence
  chemically synthesized
atttcttccctattcatgga

SEQ ID NO: 108755 - DNA, 20 bp, Artificial Sequence
  chemically synthesized
tttcttccctattcatggag

SEQ ID NO: 108756 - DNA, 20 bp, Artificial Sequence
  chemically synthesized
attcatggagaggatatgat

SEQ ID NO: 108757 - DNA, 20 bp, Artificial Sequence
  chemically synthesized
atggagaggatatgattaga

SEQ ID NO: 108758 - DNA, 20 bp, Artificial Sequence
  chemically synthesized
attagaaagacaattgtata

SEQ ID NO: 108759 - DNA, 20 bp, Artificial Sequence
  chemically synthesized
ttaataaaatctatttattt

SEQ ID NO: 108760 - DNA, 20 bp, Artificial Sequence
  chemically synthesized
ttaaacaaaaccaaaataaa

SEQ ID NO: 108761 - DNA, 20 bp, Artificial Sequence
  chemically synthesized
tttgtttaatgcaattccac

SEQ ID NO: 108762 - DNA, 20 bp, Artificial Sequence
  chemically synthesized
gcaaactcagtaaaagcttg

SEQ ID NO: 108763 - DNA, 20 bp, Artificial Sequence
  chemically synthesized
caattccacaagcttttact

SEQ ID NO: 108764 - DNA, 20 bp, Artificial Sequence
  chemically synthesized
agatagtgcaaactcagtaa

SEQ ID NO: 108765 - DNA, 20 bp, Artificial Sequence
  chemically synthesized
gtgtcaagatagtgcaaact

SEQ ID NO: 108766 - DNA, 20 bp, Artificial Sequence
  chemically synthesized
tcagcatttcagtgtcaaga

SEQ ID NO: 108767 - DNA, 20 bp, Artificial Sequence
  chemically synthesized
gtcttcagcatttcagtgtc

SEQ ID NO: 108768 - DNA, 20 bp, Artificial Sequence
  chemically synthesized
ttaaaatgtcttcagcattt

SEQ ID NO: 108769 - DNA, 20 bp, Artificial Sequence
  chemically synthesized
atcttgacactgaaatgctg

SEQ ID NO: 108770 - DNA, 20 bp, Artificial Sequence
  chemically synthesized
tgtaatttttaaaatgtctt

SEQ ID NO: 108771 - DNA, 20 bp, Artificial Sequence
  chemically synthesized
tgaagacattttaaaaatta

SEQ ID NO: 108772 - DNA, 20 bp, Artificial Sequence
  chemically synthesized
taaaaattacagaatcactc

SEQ ID NO: 108773 - DNA, 20 bp, Artificial Sequence
  chemically synthesized
aaattacagaatcactcaag

SEQ ID NO: 108774 - DNA, 20 bp, Artificial Sequence
  chemically synthesized
cactaaactttaagcttctt

SEQ ID NO: 108775 - DNA, 20 bp, Artificial Sequence
  chemically synthesized
agaatcactcaagaagctta

SEQ ID NO: 108776 - DNA, 20 bp, Artificial Sequence
  chemically synthesized
cactcaagaagcttaaagtt

SEQ ID NO: 108777 - DNA, 20 bp, Artificial Sequence
  chemically synthesized
ttaacacaccactaaacttt

SEQ ID NO: 108778 - DNA, 20 bp, Artificial Sequence
  chemically synthesized
tcaagaagcttaaagtttag

SEQ ID NO: 108779 - DNA, 20 bp, Artificial Sequence
  chemically synthesized
tttagtggtgtgttaatttg

SEQ ID NO: 108780 - DNA, 20 bp, Artificial Sequence
  chemically synthesized
gtccttaaacaagttaaaag

SEQ ID NO: 108781 - DNA, 20 bp, Artificial Sequence
  chemically synthesized
actgtccttaaacaagttaa

SEQ ID NO: 108782 - DNA, 20 bp, Artificial Sequence
  chemically synthesized
attctgcttttaacttgttt

SEQ ID NO: 108783 - DNA, 20 bp, Artificial Sequence
  chemically synthesized
ttctgcttttaacttgttta

SEQ ID NO: 108784 - DNA, 20 bp, Artificial Sequence
  chemically synthesized
agagatcactgtccttaaac

SEQ ID NO: 108785 - DNA, 20 bp, Artificial Sequence
  chemically synthesized
gcttttaacttgtttaagga

SEQ ID NO: 108786 - DNA, 20 bp, Artificial Sequence
  chemically synthesized
tttcagtgtggcattaaaca

SEQ ID NO: 108787 - DNA, 20 bp, Artificial Sequence
  chemically synthesized
actttcagtgtggcattaaa

SEQ ID NO: 108788 - DNA, 20 bp, Artificial Sequence
  chemically synthesized
tctgtttaatgccacactga

SEQ ID NO: 108789 - DNA, 20 bp, Artificial Sequence
  chemically synthesized
aacacatagtactttcagtg

SEQ ID NO: 108790 - DNA, 20 bp, Artificial Sequence
  chemically synthesized
ttatgaacacatagtacttt

SEQ ID NO: 108791 - DNA, 20 bp, Artificial Sequence
  chemically synthesized
aattgtttattatgaacaca

SEQ ID NO: 108792 - DNA, 20 bp, Artificial Sequence
  chemically synthesized
aatgagctcataagatcatt

SEQ ID NO: 108793 - DNA, 20 bp, Artificial Sequence
  chemically synthesized
caatttctgaatgatcttat

SEQ ID NO: 108794 - DNA, 20 bp, Artificial Sequence
  chemically synthesized
agacatactaatgagctcat

SEQ ID NO: 108795 - DNA, 20 bp, Artificial Sequence
  chemically synthesized
gaatgatcttatgagctcat

SEQ ID NO: 108796 - DNA, 20 bp, Artificial Sequence
  chemically synthesized
accacatgagacatactaat

SEQ ID NO: 108797 - DNA, 20 bp, Artificial Sequence
  chemically synthesized
gctcattagtatgtctcatg

SEQ ID NO: 108798 - DNA, 20 bp, Artificial Sequence
  chemically synthesized
tttaaagcaataaaccacat

SEQ ID NO: 108799 - DNA, 20 bp, Artificial Sequence
  chemically synthesized
tagttgattatgagatttta

SEQ ID NO: 108800 - DNA, 20 bp, Artificial Sequence
  chemically synthesized
aaatgaccatagttgattat

SEQ ID NO: 108801 - DNA, 20 bp, Artificial Sequence
  chemically synthesized
taaaatctcataatcaacta

SEQ ID NO: 108802 - DNA, 20 bp, Artificial Sequence
  chemically synthesized
agtgcagaaaaaaatgacca

SEQ ID NO: 108803 - DNA, 20 bp, Artificial Sequence
  chemically synthesized
atggtcatttttttctgcac

SEQ ID NO: 108804 - DNA, 20 bp, Artificial Sequence
  chemically synthesized
cagtgacctacattctagtg

SEQ ID NO: 108805 - DNA, 20 bp, Artificial Sequence
  chemically synthesized
tttttttctgcactagaatg

SEQ ID NO: 108806 - DNA, 20 bp, Artificial Sequence
  chemically synthesized
ttttttctgcactagaatgt

SEQ ID NO: 108807 - DNA, 20 bp, Artificial Sequence
  chemically synthesized
gagctcagtgacctacattc

SEQ ID NO: 108808 - DNA, 20 bp, Artificial Sequence
  chemically synthesized
gcactagaatgtaggtcact

SEQ ID NO: 108809 - DNA, 20 bp, Artificial Sequence
  chemically synthesized
ataagaaataaatttgagct

SEQ ID NO: 108810 - DNA, 20 bp, Artificial Sequence
  chemically synthesized
aaaaaataagaaataaattt

SEQ ID NO: 108811 - DNA, 20 bp, Artificial Sequence
  chemically synthesized
agaccctatcaaaaaaaaat

SEQ ID NO: 108812 - DNA, 20 bp, Artificial Sequence
  chemically synthesized
tatttcttatttttttttga

SEQ ID NO: 108813 - DNA, 20 bp, Artificial Sequence
  chemically synthesized
atttcttatttttttttgat

SEQ ID NO: 108814 - DNA, 20 bp, Artificial Sequence
  chemically synthesized
tttcttatttttttttgata

SEQ ID NO: 108815 - DNA, 20 bp, Artificial Sequence
  chemically synthesized
tccagcctggatgacagagt

SEQ ID NO: 108816 - DNA, 20 bp, Artificial Sequence
  chemically synthesized
tagggtctcactctgtcatc

SEQ ID NO: 108817 - DNA, 20 bp, Artificial Sequence
  chemically synthesized
gcactccagcctggatgaca

SEQ ID NO: 108818 - DNA, 20 bp, Artificial Sequence
  chemically synthesized
agggtctcactctgtcatcc

SEQ ID NO: 108819 - DNA, 20 bp, Artificial Sequence
  chemically synthesized
ctgcactccagcctggatga

SEQ ID NO: 108820 - DNA, 20 bp, Artificial Sequence
  chemically synthesized
tctcactctgtcatccaggc

SEQ ID NO: 108821 - DNA, 20 bp, Artificial Sequence
  chemically synthesized
tcactctgtcatccaggctg

SEQ ID NO: 108822 - DNA, 20 bp, Artificial Sequence
  chemically synthesized
ggcacaactgcactccagcc

SEQ ID NO: 108823 - DNA, 20 bp, Artificial Sequence
  chemically synthesized
ctgtcatccaggctggagtg

SEQ ID NO: 108824 - DNA, 20 bp, Artificial Sequence
  chemically synthesized
ataatggcacaactgcactc

SEQ ID NO: 108825 - DNA, 20 bp, Artificial Sequence
  chemically synthesized
ggagtgcagttgtgccatta

SEQ ID NO: 108826 - DNA, 20 bp, Artificial Sequence
  chemically synthesized
gaggctgcagtgagccataa

SEQ ID NO: 108827 - DNA, 20 bp, Artificial Sequence
  chemically synthesized
tgtgccattatggctcactg

SEQ ID NO: 108828 - DNA, 20 bp, Artificial Sequence
  chemically synthesized
caggaagtcgaggctgcagt

SEQ ID NO: 108829 - DNA, 20 bp, Artificial Sequence
  chemically synthesized
aacccaggaagtcgaggctg

SEQ ID NO: 108830 - DNA, 20 bp, Artificial Sequence
  chemically synthesized
cacgtgaacccaggaagtcg

SEQ ID NO: 108831 - DNA, 20 bp, Artificial Sequence
  chemically synthesized
tcactgcagcctcgacttcc

SEQ ID NO: 108832 - DNA, 20 bp, Artificial Sequence
  chemically synthesized
tcacgtgaacccaggaagtc

SEQ ID NO: 108833 - DNA, 20 bp, Artificial Sequence
  chemically synthesized
cactgcagcctcgacttcct

SEQ ID NO: 108834 - DNA, 20 bp, Artificial Sequence
  chemically synthesized
aaggatcacgtgaacccagg

SEQ ID NO: 108835 - DNA, 20 bp, Artificial Sequence
  chemically synthesized
tagaaggatcacgtgaaccc

SEQ ID NO: 108836 - DNA, 20 bp, Artificial Sequence
  chemically synthesized
gtagaaggatcacgtgaacc

SEQ ID NO: 108837 - DNA, 20 bp, Artificial Sequence
  chemically synthesized
ttcacgtgatccttctacct

SEQ ID NO: 108838 - DNA, 20 bp, Artificial Sequence
  chemically synthesized
actcgggagcctgaggtaga

SEQ ID NO: 108839 - DNA, 20 bp, Artificial Sequence
  chemically synthesized
tcacgtgatccttctacctc

SEQ ID NO: 108840 - DNA, 20 bp, Artificial Sequence
  chemically synthesized
tactcgggagcctgaggtag

SEQ ID NO: 108841 - DNA, 20 bp, Artificial Sequence
  chemically synthesized
agctactcgggagcctgagg

SEQ ID NO: 108842 - DNA, 20 bp, Artificial Sequence
  chemically synthesized
cccagctactcgggagcctg

SEQ ID NO: 108843 - DNA, 20 bp, Artificial Sequence
  chemically synthesized
tcccagctactcgggagcct

SEQ ID NO: 108844 - DNA, 20 bp, Artificial Sequence
  chemically synthesized
tccttctacctcaggctccc

SEQ ID NO: 108845 - DNA, 20 bp, Artificial Sequence
  chemically synthesized
ttctacctcaggctcccgag

SEQ ID NO: 108846 - DNA, 20 bp, Artificial Sequence
  chemically synthesized
ctgtagtcccagctactcgg

SEQ ID NO: 108847 - DNA, 20 bp, Artificial Sequence
  chemically synthesized
acctcaggctcccgagtagc

SEQ ID NO: 108848 - DNA, 20 bp, Artificial Sequence
  chemically synthesized
gcctgtagtcccagctactc

SEQ ID NO: 108849 - DNA, 20 bp, Artificial Sequence
  chemically synthesized
cctcaggctcccgagtagct

SEQ ID NO: 108850 - DNA, 20 bp, Artificial Sequence
  chemically synthesized
tgcctgtagtcccagctact

SEQ ID NO: 108851 - DNA, 20 bp, Artificial Sequence
  chemically synthesized
ctcccgagtagctgggacta

SEQ ID NO: 108852 - DNA, 20 bp, Artificial Sequence
  chemically synthesized
tcccgagtagctgggactac

SEQ ID NO: 108853 - DNA, 20 bp, Artificial Sequence
  chemically synthesized
gtggcatgtgcctgtagtcc

SEQ ID NO: 108854 - DNA, 20 bp, Artificial Sequence
  chemically synthesized
cgcatggtggcatgtgcctg

SEQ ID NO: 108855 - DNA, 20 bp, Artificial Sequence
  chemically synthesized
caggcacatgccaccatgcg

SEQ ID NO: 108856 - DNA, 20 bp, Artificial Sequence
  chemically synthesized
aaaagagtacctgcgcatgg

SEQ ID NO: 108857 - DNA, 20 bp, Artificial Sequence
  chemically synthesized
aggcacatgccaccatgcgc

SEQ ID NO: 108858 - DNA, 20 bp, Artificial Sequence
  chemically synthesized
gcaaaaagagtacctgcgca

SEQ ID NO: 108859 - DNA, 20 bp, Artificial Sequence
  chemically synthesized
ctctacaaaaaatgcaaaaa

SEQ ID NO: 108860 - DNA, 20 bp, Artificial Sequence
  chemically synthesized
atctctacaaaaaatgcaaa

SEQ ID NO: 108861 - DNA, 20 bp, Artificial Sequence
  chemically synthesized
tactctttttgcattttttg

SEQ ID NO: 108862 - DNA, 20 bp, Artificial Sequence
  chemically synthesized
ctctttttgcattttttgta

SEQ ID NO: 108863 - DNA, 20 bp, Artificial Sequence
  chemically synthesized
ttttgcattttttgtagaga

SEQ ID NO: 108864 - DNA, 20 bp, Artificial Sequence
  chemically synthesized
tttgcattttttgtagagat

SEQ ID NO: 108865 - DNA, 20 bp, Artificial Sequence
  chemically synthesized
ttgcattttttgtagagatg

SEQ ID NO: 108866 - DNA, 20 bp, Artificial Sequence
  chemically synthesized
tggggtttcaccatgttgcc

SEQ ID NO: 108867 - DNA, 20 bp, Artificial Sequence
  chemically synthesized
tgagatcagcctgggcaaca

SEQ ID NO: 108868 - DNA, 20 bp, Artificial Sequence
  chemically synthesized
ggggtttcaccatgttgccc

SEQ ID NO: 108869 - DNA, 20 bp, Artificial Sequence
  chemically synthesized
caggagtttgagatcagcct

SEQ ID NO: 108870 - DNA, 20 bp, Artificial Sequence
  chemically synthesized
ccaggagtttgagatcagcc

SEQ ID NO: 108871 - DNA, 20 bp, Artificial Sequence
  chemically synthesized
tgagtccaggagtttgagat

SEQ ID NO: 108872 - DNA, 20 bp, Artificial Sequence
  chemically synthesized
ccaggctgatctcaaactcc

SEQ ID NO: 108873 - DNA, 20 bp, Artificial Sequence
  chemically synthesized
tcacttgagtccaggagttt

SEQ ID NO: 108874 - DNA, 20 bp, Artificial Sequence
  chemically synthesized
ggcagatcacttgagtccag

SEQ ID NO: 108875 - DNA, 20 bp, Artificial Sequence
  chemically synthesized
gatctcaaactcctggactc

SEQ ID NO: 108876 - DNA, 20 bp, Artificial Sequence
  chemically synthesized
caggcagatcacttgagtcc

SEQ ID NO: 108877 - DNA, 20 bp, Artificial Sequence
  chemically synthesized
gcaggcagatcacttgagtc

SEQ ID NO: 108878 - DNA, 20 bp, Artificial Sequence
  chemically synthesized
ctgaggcaggcagatcactt

SEQ ID NO: 108879 - DNA, 20 bp, Artificial Sequence
  chemically synthesized
ctcaagtgatctgcctgcct

SEQ ID NO: 108880 - DNA, 20 bp, Artificial Sequence
  chemically synthesized
atttgggaagctgaggcagg

SEQ ID NO: 108881 - DNA, 20 bp, Artificial Sequence
  chemically synthesized
aggatttgggaagctgaggc

SEQ ID NO: 108882 - DNA, 20 bp, Artificial Sequence
  chemically synthesized
aaggatttgggaagctgagg

SEQ ID NO: 108883 - DNA, 20 bp, Artificial Sequence
  chemically synthesized
cccaaggatttgggaagctg

SEQ ID NO: 108884 - DNA, 20 bp, Artificial Sequence
  chemically synthesized
tcccaaggatttgggaagct

SEQ ID NO: 108885 - DNA, 20 bp, Artificial Sequence
  chemically synthesized
tgtaatcccaaggatttggg

SEQ ID NO: 108886 - DNA, 20 bp, Artificial Sequence
  chemically synthesized
gcctcagcttcccaaatcct

SEQ ID NO: 108887 - DNA, 20 bp, Artificial Sequence
  chemically synthesized
gcctgtaatcccaaggattt

SEQ ID NO: 108888 - DNA, 20 bp, Artificial Sequence
  chemically synthesized
cctcagcttcccaaatcctt

SEQ ID NO: 108889 - DNA, 20 bp, Artificial Sequence
  chemically synthesized
tgcctgtaatcccaaggatt

SEQ ID NO: 108890 - DNA, 20 bp, Artificial Sequence
  chemically synthesized
ggctcatgcctgtaatccca

SEQ ID NO: 108891 - DNA, 20 bp, Artificial Sequence
  chemically synthesized
ttcccaaatccttgggatta

SEQ ID NO: 108892 - DNA, 20 bp, Artificial Sequence
  chemically synthesized
tggctcatgcctgtaatccc

SEQ ID NO: 108893 - DNA, 20 bp, Artificial Sequence
  chemically synthesized
tcccaaatccttgggattac

SEQ ID NO: 108894 - DNA, 20 bp, Artificial Sequence
  chemically synthesized
atccttgggattacaggcat

SEQ ID NO: 108895 - DNA, 20 bp, Artificial Sequence
  chemically synthesized
gaaatacacttggggtgcga

SEQ ID NO: 108896 - DNA, 20 bp, Artificial Sequence
  chemically synthesized
ggcatgagccatcgcacccc

SEQ ID NO: 108897 - DNA, 20 bp, Artificial Sequence
  chemically synthesized
aaggtatagaaatacacttg

SEQ ID NO: 108898 - DNA, 20 bp, Artificial Sequence
  chemically synthesized
taaggtatagaaatacactt

SEQ ID NO: 108899 - DNA, 20 bp, Artificial Sequence
  chemically synthesized
gtaaggtatagaaatacact

SEQ ID NO: 108900 - DNA, 20 bp, Artificial Sequence
  chemically synthesized
gtaaggtactttgtaaggta

SEQ ID NO: 108901 - DNA, 20 bp, Artificial Sequence
  chemically synthesized
gtgtatttctataccttaca

SEQ ID NO: 108902 - DNA, 20 bp, Artificial Sequence
  chemically synthesized
actgtgtaaggtactttgta

SEQ ID NO: 108903 - DNA, 20 bp, Artificial Sequence
  chemically synthesized
tactgtgtaaggtactttgt

SEQ ID NO: 108904 - DNA, 20 bp, Artificial Sequence
  chemically synthesized
accttacaaagtaccttaca

SEQ ID NO: 108905 - DNA, 20 bp, Artificial Sequence
  chemically synthesized
tgctggttagttactgtgta

SEQ ID NO: 108906 - DNA, 20 bp, Artificial Sequence
  chemically synthesized
ttgctggttagttactgtgt

SEQ ID NO: 108907 - DNA, 20 bp, Artificial Sequence
  chemically synthesized
taccttacacagtaactaac

SEQ ID NO: 108908 - DNA, 20 bp, Artificial Sequence
  chemically synthesized
agtatctgccatttgctggt

SEQ ID NO: 108909 - DNA, 20 bp, Artificial Sequence
  chemically synthesized
cacagtaactaaccagcaaa

SEQ ID NO: 108910 - DNA, 20 bp, Artificial Sequence
  chemically synthesized
ctggagtatctgccatttgc

SEQ ID NO: 108911 - DNA, 20 bp, Artificial Sequence
  chemically synthesized
agtaactaaccagcaaatgg

SEQ ID NO: 108912 - DNA, 20 bp, Artificial Sequence
  chemically synthesized
ccagcaaatggcagatactc

SEQ ID NO: 108913 - DNA, 20 bp, Artificial Sequence
  chemically synthesized
aatggcagatactccagtca

SEQ ID NO: 108914 - DNA, 20 bp, Artificial Sequence
  chemically synthesized
tatccattcatctatgactg

SEQ ID NO: 108915 - DNA, 20 bp, Artificial Sequence
  chemically synthesized
catatccattcatctatgac

SEQ ID NO: 108916 - DNA, 20 bp, Artificial Sequence
  chemically synthesized
atactccagtcatagatgaa

SEQ ID NO: 108917 - DNA, 20 bp, Artificial Sequence
  chemically synthesized
tttctattagtattcaacag

SEQ ID NO: 108918 - DNA, 20 bp, Artificial Sequence
  chemically synthesized
caatttctattagtattcaa

SEQ ID NO: 108919 - DNA, 20 bp, Artificial Sequence
  chemically synthesized
aatctactgttgaatactaa

SEQ ID NO: 108920 - DNA, 20 bp, Artificial Sequence
  chemically synthesized
tgtgccgttacaatttctat

SEQ ID NO: 108921 - DNA, 20 bp, Artificial Sequence
  chemically synthesized
aatactaatagaaattgtaa

SEQ ID NO: 108922 - DNA, 20 bp, Artificial Sequence
  chemically synthesized
taatagaaattgtaacggca

SEQ ID NO: 108923 - DNA, 20 bp, Artificial Sequence
  chemically synthesized
tataacctctagaattggtt

SEQ ID NO: 108924 - DNA, 20 bp, Artificial Sequence
  chemically synthesized
ttacatttctgaaccaattc

SEQ ID NO: 108925 - DNA, 20 bp, Artificial Sequence
  chemically synthesized
acatttctgaaccaattcta

SEQ ID NO: 108926 - DNA, 20 bp, Artificial Sequence
  chemically synthesized
catttctgaaccaattctag

SEQ ID NO: 108927 - DNA, 20 bp, Artificial Sequence
  chemically synthesized
gaatgtataacctctagaat

SEQ ID NO: 108928 - DNA, 20 bp, Artificial Sequence
  chemically synthesized
ttctttgaatgtataacctc

SEQ ID NO: 108929 - DNA, 20 bp, Artificial Sequence
  chemically synthesized
ttctagaggttatacattca

SEQ ID NO: 108930 - DNA, 20 bp, Artificial Sequence
  chemically synthesized
tagaggttatacattcaaag

SEQ ID NO: 108931 - DNA, 20 bp, Artificial Sequence
  chemically synthesized
agaggttatacattcaaaga

SEQ ID NO: 108932 - DNA, 20 bp, Artificial Sequence
  chemically synthesized
aggttatacattcaaagaag

SEQ ID NO: 108933 - DNA, 20 bp, Artificial Sequence
  chemically synthesized
caaagaaggagtattattat

SEQ ID NO: 108934 - DNA, 20 bp, Artificial Sequence
  chemically synthesized
aaagaaggagtattattatt

SEQ ID NO: 108935 - DNA, 20 bp, Artificial Sequence
  chemically synthesized
tctattttactaacaatttt

SEQ ID NO: 108936 - DNA, 20 bp, Artificial Sequence
  chemically synthesized
tattaggtgcctaaaattgt

SEQ ID NO: 108937 - DNA, 20 bp, Artificial Sequence
  chemically synthesized
gtctattttactaacaattt

SEQ ID NO: 108938 - DNA, 20 bp, Artificial Sequence
  chemically synthesized
gcctaaaattgttagtaaaa

SEQ ID NO: 108939 - DNA, 20 bp, Artificial Sequence
  chemically synthesized
atccagataaatatagtaag

SEQ ID NO: 108940 - DNA, 20 bp, Artificial Sequence
  chemically synthesized
aatccagataaatatagtaa

SEQ ID NO: 108941 - DNA, 20 bp, Artificial Sequence
  chemically synthesized
agaatccagataaatatagt

SEQ ID NO: 108942 - DNA, 20 bp, Artificial Sequence
  chemically synthesized
tataagaatccagataaata

SEQ ID NO: 108943 - DNA, 20 bp, Artificial Sequence
  chemically synthesized
gacctcttactatatttatc

SEQ ID NO: 108944 - DNA, 20 bp, Artificial Sequence
  chemically synthesized
tcttgcatgatataagaatc

SEQ ID NO: 108945 - DNA, 20 bp, Artificial Sequence
  chemically synthesized
gatattttcttgcatgatat

SEQ ID NO: 108946 - DNA, 20 bp, Artificial Sequence
  chemically synthesized
tctggattcttatatcatgc

SEQ ID NO: 108947 - DNA, 20 bp, Artificial Sequence
  chemically synthesized
gcaagaaaatatcaataaac

SEQ ID NO: 108948 - DNA, 20 bp, Artificial Sequence
  chemically synthesized
ataaacaagcatgccaacta

SEQ ID NO: 108949 - DNA, 20 bp, Artificial Sequence
  chemically synthesized
aaaaaaaaaaaaaccatagt

SEQ ID NO: 108950 - DNA, 20 bp, Artificial Sequence
  chemically synthesized
aaaaaaaaaaaaaaaaacca

SEQ ID NO: 108951 - DNA, 20 bp, Artificial Sequence
  chemically synthesized
tttttttttttttttttttt

SEQ ID NO: 108952 - DNA, 20 bp, Artificial Sequence
  chemically synthesized
ttttttttttggtatccctc

SEQ ID NO: 108953 - DNA, 20 bp, Artificial Sequence
  chemically synthesized
aaaatggatctggatctgga

SEQ ID NO: 108954 - DNA, 20 bp, Artificial Sequence
  chemically synthesized
ttttggtatccctccagatc

SEQ ID NO: 108955 - DNA, 20 bp, Artificial Sequence
  chemically synthesized
gaaaatggatctggatctgg

SEQ ID NO: 108956 - DNA, 20 bp, Artificial Sequence
  chemically synthesized
ggaaaatggatctggatctg

SEQ ID NO: 108957 - DNA, 20 bp, Artificial Sequence
  chemically synthesized
agggaaaatggatctggatc

SEQ ID NO: 108958 - DNA, 20 bp, Artificial Sequence
  chemically synthesized
aaaagaagggaaaatggatc

SEQ ID NO: 108959 - DNA, 20 bp, Artificial Sequence
  chemically synthesized
ggtggaaaaagaagggaaaa

SEQ ID NO: 108960 - DNA, 20 bp, Artificial Sequence
  chemically synthesized
cctggaaggtggaaaaagaa

SEQ ID NO: 108961 - DNA, 20 bp, Artificial Sequence
  chemically synthesized
ccctggaaggtggaaaaaga

SEQ ID NO: 108962 - DNA, 20 bp, Artificial Sequence
  chemically synthesized
cccctggaaggtggaaaaag

SEQ ID NO: 108963 - DNA, 20 bp, Artificial Sequence
  chemically synthesized
agccccctggaaggtggaaa

SEQ ID NO: 108964 - DNA, 20 bp, Artificial Sequence
  chemically synthesized
tcccttctttttccaccttc

SEQ ID NO: 108965 - DNA, 20 bp, Artificial Sequence
  chemically synthesized
cccttctttttccaccttcc

SEQ ID NO: 108966 - DNA, 20 bp, Artificial Sequence
  chemically synthesized
ccttctttttccaccttcca

SEQ ID NO: 108967 - DNA, 20 bp, Artificial Sequence
  chemically synthesized
caagtcagccccctggaagg

SEQ ID NO: 108968 - DNA, 20 bp, Artificial Sequence
  chemically synthesized
cttctttttccaccttccag

SEQ ID NO: 108969 - DNA, 20 bp, Artificial Sequence
  chemically synthesized
ttctttttccaccttccagg

SEQ ID NO: 108970 - DNA, 20 bp, Artificial Sequence
  chemically synthesized
atccaagtcagccccctgga

SEQ ID NO: 108971 - DNA, 20 bp, Artificial Sequence
  chemically synthesized
aatccaagtcagccccctgg

SEQ ID NO: 108972 - DNA, 20 bp, Artificial Sequence
  chemically synthesized
tgtaatccaagtcagccccc

SEQ ID NO: 108973 - DNA, 20 bp, Artificial Sequence
  chemically synthesized
caccttccagggggctgact

SEQ ID NO: 108974 - DNA, 20 bp, Artificial Sequence
  chemically synthesized
tctaatgatgtaatccaagt

SEQ ID NO: 108975 - DNA, 20 bp, Artificial Sequence
  chemically synthesized
ggagtctaatgatgtaatcc

SEQ ID NO: 108976 - DNA, 20 bp, Artificial Sequence
  chemically synthesized
gctgacttggattacatcat

SEQ ID NO: 108977 - DNA, 20 bp, Artificial Sequence
  chemically synthesized
cagaaaaccatagggcatag

SEQ ID NO: 108978 - DNA, 20 bp, Artificial Sequence
  chemically synthesized
aacagaaaaccatagggcat

SEQ ID NO: 108979 - DNA, 20 bp, Artificial Sequence
  chemically synthesized
cattagactcctatgcccta

SEQ ID NO: 108980 - DNA, 20 bp, Artificial Sequence
  chemically synthesized
aaacagaaaaccatagggca

SEQ ID NO: 108981 - DNA, 20 bp, Artificial Sequence
  chemically synthesized
aacccaaacagaaaaccata

SEQ ID NO: 108982 - DNA, 20 bp, Artificial Sequence
  chemically synthesized
aaacccaaacagaaaaccat

SEQ ID NO: 108983 - DNA, 20 bp, Artificial Sequence
  chemically synthesized
caaacccaaacagaaaacca

SEQ ID NO: 108984 - DNA, 20 bp, Artificial Sequence
  chemically synthesized
atgccctatggttttctgtt

SEQ ID NO: 108985 - DNA, 20 bp, Artificial Sequence
  chemically synthesized
tgccctatggttttctgttt

SEQ ID NO: 108986 - DNA, 20 bp, Artificial Sequence
  chemically synthesized
tctccttggtcaaacccaaa

SEQ ID NO: 108987 - DNA, 20 bp, Artificial Sequence
  chemically synthesized
ttttctgtttgggtttgacc

SEQ ID NO: 108988 - DNA, 20 bp, Artificial Sequence
  chemically synthesized
tttctgtttgggtttgacca

SEQ ID NO: 108989 - DNA, 20 bp, Artificial Sequence
  chemically synthesized
tctgtttgggtttgaccaag

SEQ ID NO: 108990 - DNA, 20 bp, Artificial Sequence
  chemically synthesized
tgtttgggtttgaccaagga

SEQ ID NO: 108991 - DNA, 20 bp, Artificial Sequence
  chemically synthesized
gtttgggtttgaccaaggag

SEQ ID NO: 108992 - DNA, 20 bp, Artificial Sequence
  chemically synthesized
tggtttgctagtcctctcct

SEQ ID NO: 108993 - DNA, 20 bp, Artificial Sequence
  chemically synthesized
ggtttgaccaaggagaggac

SEQ ID NO: 108994 - DNA, 20 bp, Artificial Sequence
  chemically synthesized
ccttctctgcagtggtttgc

SEQ ID NO: 108995 - DNA, 20 bp, Artificial Sequence
  chemically synthesized
agaggactagcaaaccactg

SEQ ID NO: 108996 - DNA, 20 bp, Artificial Sequence
  chemically synthesized
aggactagcaaaccactgca

SEQ ID NO: 108997 - DNA, 20 bp, Artificial Sequence
  chemically synthesized
agactctcccttctctgcag

SEQ ID NO: 108998 - DNA, 20 bp, Artificial Sequence
  chemically synthesized
actagcaaaccactgcagag

SEQ ID NO: 108999 - DNA, 20 bp, Artificial Sequence
  chemically synthesized
ctagcaaaccactgcagaga

SEQ ID NO: 109000 - DNA, 20 bp, Artificial Sequence
  chemically synthesized
tagcaaaccactgcagagaa

SEQ ID NO: 109001 - DNA, 20 bp, Artificial Sequence
  chemically synthesized
ccaagactctcccttctctg

SEQ ID NO: 109002 - DNA, 20 bp, Artificial Sequence
  chemically synthesized
gcaaaccactgcagagaagg

SEQ ID NO: 109003 - DNA, 20 bp, Artificial Sequence
  chemically synthesized
aaaccactgcagagaaggga

SEQ ID NO: 109004 - DNA, 20 bp, Artificial Sequence
  chemically synthesized
ctgcagagaagggagagtct

SEQ ID NO: 109005 - DNA, 20 bp, Artificial Sequence
  chemically synthesized
tgcagagaagggagagtctt

SEQ ID NO: 109006 - DNA, 20 bp, Artificial Sequence
  chemically synthesized
gagaagggagagtcttgggt

SEQ ID NO: 109007 - DNA, 20 bp, Artificial Sequence
  chemically synthesized
gaagggagagtcttgggtca

SEQ ID NO: 109008 - DNA, 20 bp, Artificial Sequence
  chemically synthesized
gggaatcaatactctgaccc

SEQ ID NO: 109009 - DNA, 20 bp, Artificial Sequence
  chemically synthesized
ctcagggaaaaagagatgaa

SEQ ID NO: 109010 - DNA, 20 bp, Artificial Sequence
  chemically synthesized
actcagggaaaaagagatga

SEQ ID NO: 109011 - DNA, 20 bp, Artificial Sequence
  chemically synthesized
tactcagggaaaaagagatg

SEQ ID NO: 109012 - DNA, 20 bp, Artificial Sequence
  chemically synthesized
aaatgatactcagggaaaaa

SEQ ID NO: 109013 - DNA, 20 bp, Artificial Sequence
  chemically synthesized
cccttcatctctttttccct

SEQ ID NO: 109014 - DNA, 20 bp, Artificial Sequence
  chemically synthesized
cgaaatgatactcagggaaa

SEQ ID NO: 109015 - DNA, 20 bp, Artificial Sequence
  chemically synthesized
ttgcctcgaaatgatactca

SEQ ID NO: 109016 - DNA, 20 bp, Artificial Sequence
  chemically synthesized
tttgcctcgaaatgatactc

SEQ ID NO: 109017 - DNA, 20 bp, Artificial Sequence
  chemically synthesized
atttgcctcgaaatgatact

SEQ ID NO: 109018 - DNA, 20 bp, Artificial Sequence
  chemically synthesized
ttttccctgagtatcatttc

SEQ ID NO: 109019 - DNA, 20 bp, Artificial Sequence
  chemically synthesized
tttccctgagtatcatttcg

SEQ ID NO: 109020 - DNA, 20 bp, Artificial Sequence
  chemically synthesized
tcgaggcaaattctgtcctt

SEQ ID NO: 109021 - DNA, 20 bp, Artificial Sequence
  chemically synthesized
gaggcaaattctgtccttaa

SEQ ID NO: 109022 - DNA, 20 bp, Artificial Sequence
  chemically synthesized
cagtggctttctcttaagga

SEQ ID NO: 109023 - DNA, 20 bp, Artificial Sequence
  chemically synthesized
caaattctgtccttaagaga

SEQ ID NO: 109024 - DNA, 20 bp, Artificial Sequence
  chemically synthesized
ggagcagtggctttctctta

SEQ ID NO: 109025 - DNA, 20 bp, Artificial Sequence
  chemically synthesized
aggagcagtggctttctctt

SEQ ID NO: 109026 - DNA, 20 bp, Artificial Sequence
  chemically synthesized
taatgccttgggaggagcag

SEQ ID NO: 109027 - DNA, 20 bp, Artificial Sequence
  chemically synthesized
ttttaatgccttgggaggag

SEQ ID NO: 109028 - DNA, 20 bp, Artificial Sequence
  chemically synthesized
agaaagccactgctcctccc

SEQ ID NO: 109029 - DNA, 20 bp, Artificial Sequence
  chemically synthesized
gaaagccactgctcctccca

SEQ ID NO: 109030 - DNA, 20 bp, Artificial Sequence
  chemically synthesized
agattttaatgccttgggag

SEQ ID NO: 109031 - DNA, 20 bp, Artificial Sequence
  chemically synthesized
gcagattttaatgccttggg

SEQ ID NO: 109032 - DNA, 20 bp, Artificial Sequence
  chemically synthesized
tgcagattttaatgccttgg

SEQ ID NO: 109033 - DNA, 20 bp, Artificial Sequence
  chemically synthesized
catgcagattttaatgcctt

SEQ ID NO: 109034 - DNA, 20 bp, Artificial Sequence
  chemically synthesized
tcatgcagattttaatgcct

SEQ ID NO: 109035 - DNA, 20 bp, Artificial Sequence
  chemically synthesized
aaaaaaaaaaaaacatcatg

SEQ ID NO: 109036 - DNA, 20 bp, Artificial Sequence
  chemically synthesized
tttttttttttctttttttc

SEQ ID NO: 109037 - DNA, 20 bp, Artificial Sequence
  chemically synthesized
ttttttttttctttttttct

SEQ ID NO: 109038 - DNA, 20 bp, Artificial Sequence
  chemically synthesized
tttctcagagcccagaaaaa

SEQ ID NO: 109039 - DNA, 20 bp, Artificial Sequence
  chemically synthesized
tttctttttttctgggctct

SEQ ID NO: 109040 - DNA, 20 bp, Artificial Sequence
  chemically synthesized
gagagaggtttctcagagcc

SEQ ID NO: 109041 - DNA, 20 bp, Artificial Sequence
  chemically synthesized
ttggggagagaggtttctca

SEQ ID NO: 109042 - DNA, 20 bp, Artificial Sequence
  chemically synthesized
tgttggggagagaggtttct

SEQ ID NO: 109043 - DNA, 20 bp, Artificial Sequence
  chemically synthesized
gaagccgttgttggggagag

SEQ ID NO: 109044 - DNA, 20 bp, Artificial Sequence
  chemically synthesized
tgaagccgttgttggggaga

SEQ ID NO: 109045 - DNA, 20 bp, Artificial Sequence
  chemically synthesized
cctgaagccgttgttgggga

SEQ ID NO: 109046 - DNA, 20 bp, Artificial Sequence
  chemically synthesized
gacctgaagccgttgttggg

SEQ ID NO: 109047 - DNA, 20 bp, Artificial Sequence
  chemically synthesized
gaaacctctctccccaacaa

SEQ ID NO: 109048 - DNA, 20 bp, Artificial Sequence
  chemically synthesized
tagacctgaagccgttgttg

SEQ ID NO: 109049 - DNA, 20 bp, Artificial Sequence
  chemically synthesized
ctagacctgaagccgttgtt

SEQ ID NO: 109050 - DNA, 20 bp, Artificial Sequence
  chemically synthesized
cctagacctgaagccgttgt

SEQ ID NO: 109051 - DNA, 20 bp, Artificial Sequence
  chemically synthesized
tctctccccaacaacggctt

SEQ ID NO: 109052 - DNA, 20 bp, Artificial Sequence
  chemically synthesized
ctctccccaacaacggcttc

SEQ ID NO: 109053 - DNA, 20 bp, Artificial Sequence
  chemically synthesized
cccaacaacggcttcaggtc

SEQ ID NO: 109054 - DNA, 20 bp, Artificial Sequence
  chemically synthesized
ccaacaacggcttcaggtct

SEQ ID NO: 109055 - DNA, 20 bp, Artificial Sequence
  chemically synthesized
tgtcacctctcctagacctg

SEQ ID NO: 109056 - DNA, 20 bp, Artificial Sequence
  chemically synthesized
aacaacggcttcaggtctag

SEQ ID NO: 109057 - DNA, 20 bp, Artificial Sequence
  chemically synthesized
caacggcttcaggtctagga

SEQ ID NO: 109058 - DNA, 20 bp, Artificial Sequence
  chemically synthesized
aacggcttcaggtctaggag

SEQ ID NO: 109059 - DNA, 20 bp, Artificial Sequence
  chemically synthesized
agcagagctgtcacctctcc

SEQ ID NO: 109060 - DNA, 20 bp, Artificial Sequence
  chemically synthesized
ttcaggtctaggagaggtga

SEQ ID NO: 109061 - DNA, 20 bp, Artificial Sequence
  chemically synthesized
ctctaggactagcagcagca

SEQ ID NO: 109062 - DNA, 20 bp, Artificial Sequence
  chemically synthesized
ggtgacagctctgctgctgc

SEQ ID NO: 109063 - DNA, 20 bp, Artificial Sequence
  chemically synthesized
gactctaggactagcagcag

SEQ ID NO: 109064 - DNA, 20 bp, Artificial Sequence
  chemically synthesized
caagactctaggactagcag

SEQ ID NO: 109065 - DNA, 20 bp, Artificial Sequence
  chemically synthesized
agctctgctgctgctagtcc

SEQ ID NO: 109066 - DNA, 20 bp, Artificial Sequence
  chemically synthesized
gcacaagactctaggactag

SEQ ID NO: 109067 - DNA, 20 bp, Artificial Sequence
  chemically synthesized
ctctgctgctgctagtccta

SEQ ID NO: 109068 - DNA, 20 bp, Artificial Sequence
  chemically synthesized
atagcacaagactctaggac

SEQ ID NO: 109069 - DNA, 20 bp, Artificial Sequence
  chemically synthesized
acaagatagcacaagactct

SEQ ID NO: 109070 - DNA, 20 bp, Artificial Sequence
  chemically synthesized
cacaagatagcacaagactc

SEQ ID NO: 109071 - DNA, 20 bp, Artificial Sequence
  chemically synthesized
gaaatctcacaagatagcac

SEQ ID NO: 109072 - DNA, 20 bp, Artificial Sequence
  chemically synthesized
agagtcttgtgctatcttgt

SEQ ID NO: 109073 - DNA, 20 bp, Artificial Sequence
  chemically synthesized
tgtagggaaatctcacaaga

SEQ ID NO: 109074 - DNA, 20 bp, Artificial Sequence
  chemically synthesized
agggtgtagggaaatctcac

SEQ ID NO: 109075 - DNA, 20 bp, Artificial Sequence
  chemically synthesized
tcaggattgggcagggtgta

SEQ ID NO: 109076 - DNA, 20 bp, Artificial Sequence
  chemically synthesized
ctcaggattgggcagggtgt

SEQ ID NO: 109077 - DNA, 20 bp, Artificial Sequence
  chemically synthesized
actcaggattgggcagggtg

SEQ ID NO: 109078 - DNA, 20 bp, Artificial Sequence
  chemically synthesized
tacatactcaggattgggca

SEQ ID NO: 109079 - DNA, 20 bp, Artificial Sequence
  chemically synthesized
ctacatactcaggattgggc

SEQ ID NO: 109080 - DNA, 20 bp, Artificial Sequence
  chemically synthesized
actacatactcaggattggg

SEQ ID NO: 109081 - DNA, 20 bp, Artificial Sequence
  chemically synthesized
cctacaccctgcccaatcct

SEQ ID NO: 109082 - DNA, 20 bp, Artificial Sequence
  chemically synthesized
ggcactacatactcaggatt

SEQ ID NO: 109083 - DNA, 20 bp, Artificial Sequence
  chemically synthesized
aggcactacatactcaggat

SEQ ID NO: 109084 - DNA, 20 bp, Artificial Sequence
  chemically synthesized
cctgcccaatcctgagtatg

SEQ ID NO: 109085 - DNA, 20 bp, Artificial Sequence
  chemically synthesized
ttacaaggcactacatactc

SEQ ID NO: 109086 - DNA, 20 bp, Artificial Sequence
  chemically synthesized
tttacaaggcactacatact

SEQ ID NO: 109087 - DNA, 20 bp, Artificial Sequence
  chemically synthesized
ttgaggagtctttatttaca

SEQ ID NO: 109088 - DNA, 20 bp, Artificial Sequence
  chemically synthesized
tatgtagtgccttgtaaata

SEQ ID NO: 109089 - DNA, 20 bp, Artificial Sequence
  chemically synthesized
gttgaggagtctttatttac

SEQ ID NO: 109090 - DNA, 20 bp, Artificial Sequence
  chemically synthesized
tcagattagggtaagttgag

SEQ ID NO: 109091 - DNA, 20 bp, Artificial Sequence
  chemically synthesized
attcagattagggtaagttg

SEQ ID NO: 109092 - DNA, 20 bp, Artificial Sequence
  chemically synthesized
cattcagattagggtaagtt

SEQ ID NO: 109093 - DNA, 20 bp, Artificial Sequence
  chemically synthesized
tggcacattcagattagggt

SEQ ID NO: 109094 - DNA, 20 bp, Artificial Sequence
  chemically synthesized
cagatggcacattcagatta

SEQ ID NO: 109095 - DNA, 20 bp, Artificial Sequence
  chemically synthesized
acagatggcacattcagatt

SEQ ID NO: 109096 - DNA, 20 bp, Artificial Sequence
  chemically synthesized
aacagatggcacattcagat

SEQ ID NO: 109097 - DNA, 20 bp, Artificial Sequence
  chemically synthesized
caagaaacagatggcacatt

SEQ ID NO: 109098 - DNA, 20 bp, Artificial Sequence
  chemically synthesized
gagtcccaacaagaaacaga

SEQ ID NO: 109099 - DNA, 20 bp, Artificial Sequence
  chemically synthesized
gtcagagtcccaacaagaaa

SEQ ID NO: 109100 - DNA, 20 bp, Artificial Sequence
  chemically synthesized
atgtgccatctgtttcttgt

SEQ ID NO: 109101 - DNA, 20 bp, Artificial Sequence
  chemically synthesized
tgtgccatctgtttcttgtt

SEQ ID NO: 109102 - DNA, 20 bp, Artificial Sequence
  chemically synthesized
cagtcagtcagagtcccaac

SEQ ID NO: 109103 - DNA, 20 bp, Artificial Sequence
  chemically synthesized
gttgatatctcagtcagtca

SEQ ID NO: 109104 - DNA, 20 bp, Artificial Sequence
  chemically synthesized
tgttgggactctgactgact

SEQ ID NO: 109105 - DNA, 20 bp, Artificial Sequence
  chemically synthesized
gtgttgatatctcagtcagt

SEQ ID NO: 109106 - DNA, 20 bp, Artificial Sequence
  chemically synthesized
atttgtgttgatatctcagt

SEQ ID NO: 109107 - DNA, 20 bp, Artificial Sequence
  chemically synthesized
ttgtatttgtgttgatatct

SEQ ID NO: 109108 - DNA, 20 bp, Artificial Sequence
  chemically synthesized
acacaaatacaatcatgaaa

SEQ ID NO: 109109 - DNA, 20 bp, Artificial Sequence
  chemically synthesized
cacaaatacaatcatgaaac

SEQ ID NO: 109110 - DNA, 20 bp, Artificial Sequence
  chemically synthesized
catgaaacaggacacaaatt

SEQ ID NO: 109111 - DNA, 20 bp, Artificial Sequence
  chemically synthesized
gacacaaattcagcacttca

SEQ ID NO: 109112 - DNA, 20 bp, Artificial Sequence
  chemically synthesized
cacaaattcagcacttcaca

SEQ ID NO: 109113 - DNA, 20 bp, Artificial Sequence
  chemically synthesized
agtaccgcaataactctgtg

SEQ ID NO: 109114 - DNA, 20 bp, Artificial Sequence
  chemically synthesized
agcacttcacagagttattg

SEQ ID NO: 109115 - DNA, 20 bp, Artificial Sequence
  chemically synthesized
ttattgcggtactatgttaa

SEQ ID NO: 109116 - DNA, 20 bp, Artificial Sequence
  chemically synthesized
tattgcggtactatgttaat

SEQ ID NO: 109117 - DNA, 20 bp, Artificial Sequence
  chemically synthesized
aactttcatgcccattaaca

SEQ ID NO: 109118 - DNA, 20 bp, Artificial Sequence
  chemically synthesized
tactatgttaatgggcatga

SEQ ID NO: 109119 - DNA, 20 bp, Artificial Sequence
  chemically synthesized
ttaatgggcatgaaagttat

SEQ ID NO: 109120 - DNA, 20 bp, Artificial Sequence
  chemically synthesized
gaaagttatcagtaaactgt

SEQ ID NO: 109121 - DNA, 20 bp, Artificial Sequence
  chemically synthesized
caacatcggtatggcactta

SEQ ID NO: 109122 - DNA, 20 bp, Artificial Sequence
  chemically synthesized
gatagcaatcaacatcggta

SEQ ID NO: 109123 - DNA, 20 bp, Artificial Sequence
  chemically synthesized
taaatgatagcaatcaacat

SEQ ID NO: 109124 - DNA, 20 bp, Artificial Sequence
  chemically synthesized
cgatgttgattgctatcatt

SEQ ID NO: 109125 - DNA, 20 bp, Artificial Sequence
  chemically synthesized
tcatagtttgtgctaaatga

SEQ ID NO: 109126 - DNA, 20 bp, Artificial Sequence
  chemically synthesized
catttagcacaaactatgaa

SEQ ID NO: 109127 - DNA, 20 bp, Artificial Sequence
  chemically synthesized
gacatagtctgaacttttca

SEQ ID NO: 109128 - DNA, 20 bp, Artificial Sequence
  chemically synthesized
agcacaaactatgaaaagtt

SEQ ID NO: 109129 - DNA, 20 bp, Artificial Sequence
  chemically synthesized
gagacacctgtgtatggaca

SEQ ID NO: 109130 - DNA, 20 bp, Artificial Sequence
  chemically synthesized
gttcagactatgtccataca

SEQ ID NO: 109131 - DNA, 20 bp, Artificial Sequence
  chemically synthesized
ttcagactatgtccatacac

SEQ ID NO: 109132 - DNA, 20 bp, Artificial Sequence
  chemically synthesized
tgtgttgagacacctgtgta

SEQ ID NO: 109133 - DNA, 20 bp, Artificial Sequence
  chemically synthesized
atgtcaactggttttgtgtt

SEQ ID NO: 109134 - DNA, 20 bp, Artificial Sequence
  chemically synthesized
caggtgtctcaacacaaaac

SEQ ID NO: 109135 - DNA, 20 bp, Artificial Sequence
  chemically synthesized
caacacaaaaccagttgaca

SEQ ID NO: 109136 - DNA, 20 bp, Artificial Sequence
  chemically synthesized
tcaagttagaccatgtcaac

SEQ ID NO: 109137 - DNA, 20 bp, Artificial Sequence
  chemically synthesized
acatcaatcctatatcaagt

SEQ ID NO: 109138 - DNA, 20 bp, Artificial Sequence
  chemically synthesized
tgacatggtctaacttgata

SEQ ID NO: 109139 - DNA, 20 bp, Artificial Sequence
  chemically synthesized
gacatggtctaacttgatat

SEQ ID NO: 109140 - DNA, 20 bp, Artificial Sequence
  chemically synthesized
agccacatcaatcctatatc

SEQ ID NO: 109141 - DNA, 20 bp, Artificial Sequence
  chemically synthesized
aacttgatataggattgatg

SEQ ID NO: 109142 - DNA, 20 bp, Artificial Sequence
  chemically synthesized
attggacaactgttacagta

SEQ ID NO: 109143 - DNA, 20 bp, Artificial Sequence
  chemically synthesized
ttgatgtggctgtactgtaa

SEQ ID NO: 109144 - DNA, 20 bp, Artificial Sequence
  chemically synthesized
tgattattggacaactgtta

SEQ ID NO: 109145 - DNA, 20 bp, Artificial Sequence
  chemically synthesized
cttatttacaacatgattat

SEQ ID NO: 109146 - DNA, 20 bp, Artificial Sequence
  chemically synthesized
ccaataatcatgttgtaaat

SEQ ID NO: 109147 - DNA, 20 bp, Artificial Sequence
  chemically synthesized
ataagtttttaatatattaa

SEQ ID NO: 109148 - DNA, 20 bp, Artificial Sequence
  chemically synthesized
tgattacatatgtatcaata

SEQ ID NO: 109149 - DNA, 20 bp, Artificial Sequence
  chemically synthesized
tattgatacatatgtaatca

SEQ ID NO: 109150 - DNA, 20 bp, Artificial Sequence
  chemically synthesized
atatgtaatcacagtgttat

SEQ ID NO: 109151 - DNA, 20 bp, Artificial Sequence
  chemically synthesized
acagtgttatcagacttatc

SEQ ID NO: 109152 - DNA, 20 bp, Artificial Sequence
  chemically synthesized
cagccatattaacactggat

SEQ ID NO: 109153 - DNA, 20 bp, Artificial Sequence
  chemically synthesized
atggtcagccatattaacac

SEQ ID NO: 109154 - DNA, 20 bp, Artificial Sequence
  chemically synthesized
agacttatccagtgttaata

SEQ ID NO: 109155 - DNA, 20 bp, Artificial Sequence
  chemically synthesized
agtgttaatatggctgacca

SEQ ID NO: 109156 - DNA, 20 bp, Artificial Sequence
  chemically synthesized
attgagaccttgtctatggt

SEQ ID NO: 109157 - DNA, 20 bp, Artificial Sequence
  chemically synthesized
taatatggctgaccatagac

SEQ ID NO: 109158 - DNA, 20 bp, Artificial Sequence
  chemically synthesized
aatatggctgaccatagaca

SEQ ID NO: 109159 - DNA, 20 bp, Artificial Sequence
  chemically synthesized
gaatattgagaccttgtcta

SEQ ID NO: 109160 - DNA, 20 bp, Artificial Sequence
  chemically synthesized
ctggcggataatggaatatt

SEQ ID NO: 109161 - DNA, 20 bp, Artificial Sequence
  chemically synthesized
tggaacagactggcggataa

SEQ ID NO: 109162 - DNA, 20 bp, Artificial Sequence
  chemically synthesized
ctcaatattccattatccgc

SEQ ID NO: 109163 - DNA, 20 bp, Artificial Sequence
  chemically synthesized
cacgatctggaacagactgg

SEQ ID NO: 109164 - DNA, 20 bp, Artificial Sequence
  chemically synthesized
gcccacgatctggaacagac

SEQ ID NO: 109165 - DNA, 20 bp, Artificial Sequence
  chemically synthesized
cattatccgccagtctgttc

SEQ ID NO: 109166 - DNA, 20 bp, Artificial Sequence
  chemically synthesized
aagtggcccacgatctggaa

SEQ ID NO: 109167 - DNA, 20 bp, Artificial Sequence
  chemically synthesized
cgccagtctgttccagatcg

SEQ ID NO: 109168 - DNA, 20 bp, Artificial Sequence
  chemically synthesized
gccagtctgttccagatcgt

SEQ ID NO: 109169 - DNA, 20 bp, Artificial Sequence
  chemically synthesized
tgtacaagtggcccacgatc

SEQ ID NO: 109170 - DNA, 20 bp, Artificial Sequence
  chemically synthesized
gaactaggaacatgtacaag

SEQ ID NO: 109171 - DNA, 20 bp, Artificial Sequence
  chemically synthesized
tccgaactaggaacatgtac

SEQ ID NO: 109172 - DNA, 20 bp, Artificial Sequence
  chemically synthesized
gggccacttgtacatgttcc

SEQ ID NO: 109173 - DNA, 20 bp, Artificial Sequence
  chemically synthesized
acttgtacatgttcctagtt

SEQ ID NO: 109174 - DNA, 20 bp, Artificial Sequence
  chemically synthesized
ctcttaattgattccgaact

SEQ ID NO: 109175 - DNA, 20 bp, Artificial Sequence
  chemically synthesized
tctcttaattgattccgaac

SEQ ID NO: 109176 - DNA, 20 bp, Artificial Sequence
  chemically synthesized
ttcctagttcggaatcaatt

SEQ ID NO: 109177 - DNA, 20 bp, Artificial Sequence
  chemically synthesized
cctagttcggaatcaattaa

SEQ ID NO: 109178 - DNA, 20 bp, Artificial Sequence
  chemically synthesized
ttcggaatcaattaagagac

SEQ ID NO: 109179 - DNA, 20 bp, Artificial Sequence
  chemically synthesized
ttcccgtctcttcacagagc

SEQ ID NO: 109180 - DNA, 20 bp, Artificial Sequence
  chemically synthesized
attaagagactagctctgtg

SEQ ID NO: 109181 - DNA, 20 bp, Artificial Sequence
  chemically synthesized
taagagactagctctgtgaa

SEQ ID NO: 109182 - DNA, 20 bp, Artificial Sequence
  chemically synthesized
atgcttcccgtctcttcaca

SEQ ID NO: 109183 - DNA, 20 bp, Artificial Sequence
  chemically synthesized
ttatgcttcccgtctcttca

SEQ ID NO: 109184 - DNA, 20 bp, Artificial Sequence
  chemically synthesized
agactagctctgtgaagaga

SEQ ID NO: 109185 - DNA, 20 bp, Artificial Sequence
  chemically synthesized
gactagctctgtgaagagac

SEQ ID NO: 109186 - DNA, 20 bp, Artificial Sequence
  chemically synthesized
tagctctgtgaagagacggg

SEQ ID NO: 109187 - DNA, 20 bp, Artificial Sequence
  chemically synthesized
gggaagcataacctttttct

SEQ ID NO: 109188 - DNA, 20 bp, Artificial Sequence
  chemically synthesized
tatacttataactcagaaaa

SEQ ID NO: 109189 - DNA, 20 bp, Artificial Sequence
  chemically synthesized
ttatacttataactcagaaa

SEQ ID NO: 109190 - DNA, 20 bp, Artificial Sequence
  chemically synthesized
ataacctttttctgagttat

SEQ ID NO: 109191 - DNA, 20 bp, Artificial Sequence
  chemically synthesized
ctgactttatacttataact

SEQ ID NO: 109192 - DNA, 20 bp, Artificial Sequence
  chemically synthesized
ttttctgagttataagtata

SEQ ID NO: 109193 - DNA, 20 bp, Artificial Sequence
  chemically synthesized
ctgagttataagtataaagt

SEQ ID NO: 109194 - DNA, 20 bp, Artificial Sequence
  chemically synthesized
aatcagggtaaaagaatgca

SEQ ID NO: 109195 - DNA, 20 bp, Artificial Sequence
  chemically synthesized
caatcagggtaaaagaatgc

SEQ ID NO: 109196 - DNA, 20 bp, Artificial Sequence
  chemically synthesized
ccaatcagggtaaaagaatg

SEQ ID NO: 109197 - DNA, 20 bp, Artificial Sequence
  chemically synthesized
ctcagccccaatcagggtaa

SEQ ID NO: 109198 - DNA, 20 bp, Artificial Sequence
  chemically synthesized
ctgcattcttttaccctgat

SEQ ID NO: 109199 - DNA, 20 bp, Artificial Sequence
  chemically synthesized
tgcattcttttaccctgatt

SEQ ID NO: 109200 - DNA, 20 bp, Artificial Sequence
  chemically synthesized
gcattcttttaccctgattg

SEQ ID NO: 109201 - DNA, 20 bp, Artificial Sequence
  chemically synthesized
atgtagctcagccccaatca

SEQ ID NO: 109202 - DNA, 20 bp, Artificial Sequence
  chemically synthesized
aatgtagctcagccccaatc

SEQ ID NO: 109203 - DNA, 20 bp, Artificial Sequence
  chemically synthesized
taatgtagctcagccccaat

SEQ ID NO: 109204 - DNA, 20 bp, Artificial Sequence
  chemically synthesized
cttttaccctgattggggct

SEQ ID NO: 109205 - DNA, 20 bp, Artificial Sequence
  chemically synthesized
aggagatttgtaatgtagct

SEQ ID NO: 109206 - DNA, 20 bp, Artificial Sequence
  chemically synthesized
gacaaaggagatttgtaatg

SEQ ID NO: 109207 - DNA, 20 bp, Artificial Sequence
  chemically synthesized
ctaagcttgaagagacaaag

SEQ ID NO: 109208 - DNA, 20 bp, Artificial Sequence
  chemically synthesized
ccctaagcttgaagagacaa

SEQ ID NO: 109209 - DNA, 20 bp, Artificial Sequence
  chemically synthesized
cccctaagcttgaagagaca

SEQ ID NO: 109210 - DNA, 20 bp, Artificial Sequence
  chemically synthesized
caaatctcctttgtctcttc

SEQ ID NO: 109211 - DNA, 20 bp, Artificial Sequence
  chemically synthesized
caagctcccctaagcttgaa

SEQ ID NO: 109212 - DNA, 20 bp, Artificial Sequence
  chemically synthesized
ctcctttgtctcttcaagct

SEQ ID NO: 109213 - DNA, 20 bp, Artificial Sequence
  chemically synthesized
tcctttgtctcttcaagctt

SEQ ID NO: 109214 - DNA, 20 bp, Artificial Sequence
  chemically synthesized
tgcaagctcccctaagcttg

SEQ ID NO: 109215 - DNA, 20 bp, Artificial Sequence
  chemically synthesized
cctttgtctcttcaagctta

SEQ ID NO: 109216 - DNA, 20 bp, Artificial Sequence
  chemically synthesized
ctttgtctcttcaagcttag

SEQ ID NO: 109217 - DNA, 20 bp, Artificial Sequence
  chemically synthesized
ttgtctcttcaagcttaggg

SEQ ID NO: 109218 - DNA, 20 bp, Artificial Sequence
  chemically synthesized
aatttcctgcaagctcccct

SEQ ID NO: 109219 - DNA, 20 bp, Artificial Sequence
  chemically synthesized
ttcaagcttaggggagcttg

SEQ ID NO: 109220 - DNA, 20 bp, Artificial Sequence
  chemically synthesized
tcaagcttaggggagcttgc

SEQ ID NO: 109221 - DNA, 20 bp, Artificial Sequence
  chemically synthesized
cttaacagaaaatttcctgc

SEQ ID NO: 109222 - DNA, 20 bp, Artificial Sequence
  chemically synthesized
cttgcaggaaattttctgtt

SEQ ID NO: 109223 - DNA, 20 bp, Artificial Sequence
  chemically synthesized
ataaaaacataaattcttaa

SEQ ID NO: 109224 - DNA, 20 bp, Artificial Sequence
  chemically synthesized
ttatgaaaaacaatgatact

SEQ ID NO: 109225 - DNA, 20 bp, Artificial Sequence
  chemically synthesized
aaaacaatgatactgagaca

SEQ ID NO: 109226 - DNA, 20 bp, Artificial Sequence
  chemically synthesized
aacaatgatactgagacaca

SEQ ID NO: 109227 - DNA, 20 bp, Artificial Sequence
  chemically synthesized
gtagcatacactctgtgtct

SEQ ID NO: 109228 - DNA, 20 bp, Artificial Sequence
  chemically synthesized
aaaagtatttatttttttcg

SEQ ID NO: 109229 - DNA, 20 bp, Artificial Sequence
  chemically synthesized
acgaaaaaaataaatacttt

SEQ ID NO: 109230 - DNA, 20 bp, Artificial Sequence
  chemically synthesized
cgaaaaaaataaatactttt

SEQ ID NO: 109231 - DNA, 20 bp, Artificial Sequence
  chemically synthesized
gaaaaaaataaatactttta

SEQ ID NO: 109232 - DNA, 20 bp, Artificial Sequence
  chemically synthesized
tttttccttttttaccctaa

SEQ ID NO: 109233 - DNA, 20 bp, Artificial Sequence
  chemically synthesized
taaatacttttagggtaaaa

SEQ ID NO: 109234 - DNA, 20 bp, Artificial Sequence
  chemically synthesized
aaatacttttagggtaaaaa

SEQ ID NO: 109235 - DNA, 20 bp, Artificial Sequence
  chemically synthesized
ttttagggtaaaaaaggaaa

SEQ ID NO: 109236 - DNA, 20 bp, Artificial Sequence
  chemically synthesized
tttagggtaaaaaaggaaaa

SEQ ID NO: 109237 - DNA, 20 bp, Artificial Sequence
  chemically synthesized
agggtaaaaaaggaaaaagg

SEQ ID NO: 109238 - DNA, 20 bp, Artificial Sequence
  chemically synthesized
atatataaagagcagtattt

SEQ ID NO: 109239 - DNA, 20 bp, Artificial Sequence
  chemically synthesized
aatatataaagagcagtatt

SEQ ID NO: 109240 - DNA, 20 bp, Artificial Sequence
  chemically synthesized
ctaacgaaatatataaagag

SEQ ID NO: 109241 - DNA, 20 bp, Artificial Sequence
  chemically synthesized
tcactaacgaaatatataaa

SEQ ID NO: 109242 - DNA, 20 bp, Artificial Sequence
  chemically synthesized
tgtcactaacgaaatatata

SEQ ID NO: 109243 - DNA, 20 bp, Artificial Sequence
  chemically synthesized
ctgctctttatatatttcgt

SEQ ID NO: 109244 - DNA, 20 bp, Artificial Sequence
  chemically synthesized
cccaaaatatggttattgtg

SEQ ID NO: 109245 - DNA, 20 bp, Artificial Sequence
  chemically synthesized
tctacacaataaccatattt

SEQ ID NO: 109246 - DNA, 20 bp, Artificial Sequence
  chemically synthesized
ctacacaataaccatatttt

SEQ ID NO: 109247 - DNA, 20 bp, Artificial Sequence
  chemically synthesized
tttaattgcttcccaaaata

SEQ ID NO: 109248 - DNA, 20 bp, Artificial Sequence
  chemically synthesized
cacaataaccatattttggg

SEQ ID NO: 109249 - DNA, 20 bp, Artificial Sequence
  chemically synthesized
aagcaattaaacacctcaca

SEQ ID NO: 109250 - DNA, 20 bp, Artificial Sequence
  chemically synthesized
atatgatttttgtccatgtg

SEQ ID NO: 109251 - DNA, 20 bp, Artificial Sequence
  chemically synthesized
gatatgatttttgtccatgt

SEQ ID NO: 109252 - DNA, 20 bp, Artificial Sequence
  chemically synthesized
cacatggacaaaaatcatat

SEQ ID NO: 109253 - DNA, 20 bp, Artificial Sequence
  chemically synthesized
catatcggtttcttactatt

SEQ ID NO: 109254 - DNA, 20 bp, Artificial Sequence
  chemically synthesized
atatcggtttcttactattt

SEQ ID NO: 109255 - DNA, 20 bp, Artificial Sequence
  chemically synthesized
gtactgccagcccaaatagt

SEQ ID NO: 109256 - DNA, 20 bp, Artificial Sequence
  chemically synthesized
cggtttcttactatttgggc

SEQ ID NO: 109257 - DNA, 20 bp, Artificial Sequence
  chemically synthesized
taaggtactgccagcccaaa

SEQ ID NO: 109258 - DNA, 20 bp, Artificial Sequence
  chemically synthesized
tttcttactatttgggctgg

SEQ ID NO: 109259 - DNA, 20 bp, Artificial Sequence
  chemically synthesized
ttctttttataaggtactgc

SEQ ID NO: 109260 - DNA, 20 bp, Artificial Sequence
  chemically synthesized
ggctggcagtaccttataaa

SEQ ID NO: 109261 - DNA, 20 bp, Artificial Sequence
  chemically synthesized
gatgcttttttctttttata

SEQ ID NO: 109262 - DNA, 20 bp, Artificial Sequence
  chemically synthesized
tgatgcttttttctttttat

SEQ ID NO: 109263 - DNA, 20 bp, Artificial Sequence
  chemically synthesized
agtaccttataaaaagaaaa

SEQ ID NO: 109264 - DNA, 20 bp, Artificial Sequence
  chemically synthesized
tataaaaagaaaaaagcatc

SEQ ID NO: 109265 - DNA, 20 bp, Artificial Sequence
  chemically synthesized
ataaaaagaaaaaagcatca

SEQ ID NO: 109266 - DNA, 20 bp, Artificial Sequence
  chemically synthesized
aaaaaagcatcaaggcactg

SEQ ID NO: 109267 - DNA, 20 bp, Artificial Sequence
  chemically synthesized
tcctcaaaaatatcatacta

SEQ ID NO: 109268 - DNA, 20 bp, Artificial Sequence
  chemically synthesized
cactgtagtatgatattttt

SEQ ID NO: 109269 - DNA, 20 bp, Artificial Sequence
  chemically synthesized
actgtagtatgatatttttg

SEQ ID NO: 109270 - DNA, 20 bp, Artificial Sequence
  chemically synthesized
gctcatttgaagatttttat

SEQ ID NO: 109271 - DNA, 20 bp, Artificial Sequence
  chemically synthesized
agctcatttgaagattttta

SEQ ID NO: 109272 - DNA, 20 bp, Artificial Sequence
  chemically synthesized
tcctataaaaatcttcaaat

SEQ ID NO: 109273 - DNA, 20 bp, Artificial Sequence
  chemically synthesized
gtccatttgcagctcatttg

SEQ ID NO: 109274 - DNA, 20 bp, Artificial Sequence
  chemically synthesized
atcttcaaatgagctgcaaa

SEQ ID NO: 109275 - DNA, 20 bp, Artificial Sequence
  chemically synthesized
agtctgtttgggtccatttg

SEQ ID NO: 109276 - DNA, 20 bp, Artificial Sequence
  chemically synthesized
gagctgcaaatggacccaaa

SEQ ID NO: 109277 - DNA, 20 bp, Artificial Sequence
  chemically synthesized
atattaaaataagtctgttt

SEQ ID NO: 109278 - DNA, 20 bp, Artificial Sequence
  chemically synthesized
tatattaaaataagtctgtt

SEQ ID NO: 109279 - DNA, 20 bp, Artificial Sequence
  chemically synthesized
gtcctagagtatattaaaat

SEQ ID NO: 109280 - DNA, 20 bp, Artificial Sequence
  chemically synthesized
agacttattttaatatactc

SEQ ID NO: 109281 - DNA, 20 bp, Artificial Sequence
  chemically synthesized
gacttattttaatatactct

SEQ ID NO: 109282 - DNA, 20 bp, Artificial Sequence
  chemically synthesized
ttttattatatatggtccta

SEQ ID NO: 109283 - DNA, 20 bp, Artificial Sequence
  chemically synthesized
ccttttattatatatggtcc

SEQ ID NO: 109284 - DNA, 20 bp, Artificial Sequence
  chemically synthesized
ataggaccttttattatata

SEQ ID NO: 109285 - DNA, 20 bp, Artificial Sequence
  chemically synthesized
tctaggaccatatataataa

SEQ ID NO: 109286 - DNA, 20 bp, Artificial Sequence
  chemically synthesized
ctaggaccatatataataaa

SEQ ID NO: 109287 - DNA, 20 bp, Artificial Sequence
  chemically synthesized
ccatttctataaaatagtat

SEQ ID NO: 109288 - DNA, 20 bp, Artificial Sequence
  chemically synthesized
gccatttctataaaatagta

SEQ ID NO: 109289 - DNA, 20 bp, Artificial Sequence
  chemically synthesized
aaaggtcctatactatttta

SEQ ID NO: 109290 - DNA, 20 bp, Artificial Sequence
  chemically synthesized
cagaagccatttctataaaa

SEQ ID NO: 109291 - DNA, 20 bp, Artificial Sequence
  chemically synthesized
cctatactattttatagaaa

SEQ ID NO: 109292 - DNA, 20 bp, Artificial Sequence
  chemically synthesized
aacctcatctaaggcaacag

SEQ ID NO: 109293 - DNA, 20 bp, Artificial Sequence
  chemically synthesized
agaaatggcttctgttgcct

SEQ ID NO: 109294 - DNA, 20 bp, Artificial Sequence
  chemically synthesized
gtaaacctcatctaaggcaa

SEQ ID NO: 109295 - DNA, 20 bp, Artificial Sequence
  chemically synthesized
tggcttctgttgccttagat

SEQ ID NO: 109296 - DNA, 20 bp, Artificial Sequence
  chemically synthesized
ggcttctgttgccttagatg

SEQ ID NO: 109297 - DNA, 20 bp, Artificial Sequence
  chemically synthesized
ttatgtgtaaacctcatcta

SEQ ID NO: 109298 - DNA, 20 bp, Artificial Sequence
  chemically synthesized
tttatgtgtaaacctcatct

SEQ ID NO: 109299 - DNA, 20 bp, Artificial Sequence
  chemically synthesized
caagcagcactaaaagttaa

SEQ ID NO: 109300 - DNA, 20 bp, Artificial Sequence
  chemically synthesized
cacataaatcttttaacttt

SEQ ID NO: 109301 - DNA, 20 bp, Artificial Sequence
  chemically synthesized
agtgaaacaagcagcactaa

SEQ ID NO: 109302 - DNA, 20 bp, Artificial Sequence
  chemically synthesized
tccaccagaagtgaaacaag

SEQ ID NO: 109303 - DNA, 20 bp, Artificial Sequence
  chemically synthesized
gaatccaccagaagtgaaac

SEQ ID NO: 109304 - DNA, 20 bp, Artificial Sequence
  chemically synthesized
agtgctgcttgtttcacttc

SEQ ID NO: 109305 - DNA, 20 bp, Artificial Sequence
  chemically synthesized
gctgcttgtttcacttctgg

SEQ ID NO: 109306 - DNA, 20 bp, Artificial Sequence
  chemically synthesized
ttgtaaaaagaatccaccag

SEQ ID NO: 109307 - DNA, 20 bp, Artificial Sequence
  chemically synthesized
ttgttgtaaaaagaatccac

SEQ ID NO: 109308 - DNA, 20 bp, Artificial Sequence
  chemically synthesized
tggcagggcattgttgtaaa

SEQ ID NO: 109309 - DNA, 20 bp, Artificial Sequence
  chemically synthesized
ttttacaacaatgccctgcc

SEQ ID NO: 109310 - DNA, 20 bp, Artificial Sequence
  chemically synthesized
tacaacaatgccctgccaag

SEQ ID NO: 109311 - DNA, 20 bp, Artificial Sequence
  chemically synthesized
gtagtattaactgcttggca

SEQ ID NO: 109312 - DNA, 20 bp, Artificial Sequence
  chemically synthesized
agtagtattaactgcttggc

SEQ ID NO: 109313 - DNA, 20 bp, Artificial Sequence
  chemically synthesized
aagtagtattaactgcttgg

SEQ ID NO: 109314 - DNA, 20 bp, Artificial Sequence
  chemically synthesized
atgaagtagtattaactgct

SEQ ID NO: 109315 - DNA, 20 bp, Artificial Sequence
  chemically synthesized
gcagttaatactacttcata

SEQ ID NO: 109316 - DNA, 20 bp, Artificial Sequence
  chemically synthesized
tggcgtcttcctttatgaag

SEQ ID NO: 109317 - DNA, 20 bp, Artificial Sequence
  chemically synthesized
cagttaatactacttcataa

SEQ ID NO: 109318 - DNA, 20 bp, Artificial Sequence
  chemically synthesized
gggtggcgtcttcctttatg

SEQ ID NO: 109319 - DNA, 20 bp, Artificial Sequence
  chemically synthesized
ttaatactacttcataaagg

SEQ ID NO: 109320 - DNA, 20 bp, Artificial Sequence
  chemically synthesized
caaacgtgaaggtcaagggg

SEQ ID NO: 109321 - DNA, 20 bp, Artificial Sequence
  chemically synthesized
tcacaaacgtgaaggtcaag

SEQ ID NO: 109322 - DNA, 20 bp, Artificial Sequence
  chemically synthesized
gtcacaaacgtgaaggtcaa

SEQ ID NO: 109323 - DNA, 20 bp, Artificial Sequence
  chemically synthesized
ggtcacaaacgtgaaggtca

SEQ ID NO: 109324 - DNA, 20 bp, Artificial Sequence
  chemically synthesized
gggtcacaaacgtgaaggtc

SEQ ID NO: 109325 - DNA, 20 bp, Artificial Sequence
  chemically synthesized
attatgggtcacaaacgtga

SEQ ID NO: 109326 - DNA, 20 bp, Artificial Sequence
  chemically synthesized
cattatgggtcacaaacgtg

SEQ ID NO: 109327 - DNA, 20 bp, Artificial Sequence
  chemically synthesized
acgtttgtgacccataatgc

SEQ ID NO: 109328 - DNA, 20 bp, Artificial Sequence
  chemically synthesized
atggaagcaccttgcattat

SEQ ID NO: 109329 - DNA, 20 bp, Artificial Sequence
  chemically synthesized
cgtttgtgacccataatgca

SEQ ID NO: 109330 - DNA, 20 bp, Artificial Sequence
  chemically synthesized
gatggaagcaccttgcatta

SEQ ID NO: 109331 - DNA, 20 bp, Artificial Sequence
  chemically synthesized
agaaaagatagagatgatgg

SEQ ID NO: 109332 - DNA, 20 bp, Artificial Sequence
  chemically synthesized
tctagaaaagatagagatga

SEQ ID NO: 109333 - DNA, 20 bp, Artificial Sequence
  chemically synthesized
ggtgatatctagaaaagata

SEQ ID NO: 109334 - DNA, 20 bp, Artificial Sequence
  chemically synthesized
tccatcatctctatcttttc

SEQ ID NO: 109335 - DNA, 20 bp, Artificial Sequence
  chemically synthesized
agggtgatatctagaaaaga

SEQ ID NO: 109336 - DNA, 20 bp, Artificial Sequence
  chemically synthesized
aggaagggtgatatctagaa

SEQ ID NO: 109337 - DNA, 20 bp, Artificial Sequence
  chemically synthesized
ttccaaggaagggtgatatc

SEQ ID NO: 109338 - DNA, 20 bp, Artificial Sequence
  chemically synthesized
ttctagatatcacccttcct

SEQ ID NO: 109339 - DNA, 20 bp, Artificial Sequence
  chemically synthesized
ttgtctgcacttccaaggaa

SEQ ID NO: 109340 - DNA, 20 bp, Artificial Sequence
  chemically synthesized
tagatatcacccttccttgg

SEQ ID NO: 109341 - DNA, 20 bp, Artificial Sequence
  chemically synthesized
cttgtctgcacttccaagga

SEQ ID NO: 109342 - DNA, 20 bp, Artificial Sequence
  chemically synthesized
acttgtctgcacttccaagg

SEQ ID NO: 109343 - DNA, 20 bp, Artificial Sequence
  chemically synthesized
aacacttgtctgcacttcca

SEQ ID NO: 109344 - DNA, 20 bp, Artificial Sequence
  chemically synthesized
atcacccttccttggaagtg

SEQ ID NO: 109345 - DNA, 20 bp, Artificial Sequence
  chemically synthesized
aaacacttgtctgcacttcc

SEQ ID NO: 109346 - DNA, 20 bp, Artificial Sequence
  chemically synthesized
ccttccttggaagtgcagac

SEQ ID NO: 109347 - DNA, 20 bp, Artificial Sequence
  chemically synthesized
gaattgacctcaaacaaaac

SEQ ID NO: 109348 - DNA, 20 bp, Artificial Sequence
  chemically synthesized
tatttgttcttgttttgttt

SEQ ID NO: 109349 - DNA, 20 bp, Artificial Sequence
  chemically synthesized
atttgttcttgttttgtttg

SEQ ID NO: 109350 - DNA, 20 bp, Artificial Sequence
  chemically synthesized
tttgtttgaggtcaattcac

SEQ ID NO: 109351 - DNA, 20 bp, Artificial Sequence
  chemically synthesized
aaaaaactggagaaaggagc

SEQ ID NO: 109352 - DNA, 20 bp, Artificial Sequence
  chemically synthesized
aattcactggctcctttctc

SEQ ID NO: 109353 - DNA, 20 bp, Artificial Sequence
  chemically synthesized
aaaaaaaaaactggagaaag

SEQ ID NO: 109354 - DNA, 20 bp, Artificial Sequence
  chemically synthesized
aaaaaaaaaaaactggagaa

SEQ ID NO: 109355 - DNA, 20 bp, Artificial Sequence
  chemically synthesized
aaaaaaaaaaaaactggaga

SEQ ID NO: 109356 - DNA, 20 bp, Artificial Sequence
  chemically synthesized
aaaaaaaaaaaaaaaaactg

SEQ ID NO: 109357 - DNA, 20 bp, Artificial Sequence
  chemically synthesized
ttaaaaaaaaaaaaaaaaac

SEQ ID NO: 109358 - DNA, 20 bp, Artificial Sequence
  chemically synthesized
tttttttttaaacaccttga

SEQ ID NO: 109359 - DNA, 20 bp, Artificial Sequence
  chemically synthesized
agatgtattagaagctttca

SEQ ID NO: 109360 - DNA, 20 bp, Artificial Sequence
  chemically synthesized
cagatgtattagaagctttc

SEQ ID NO: 109361 - DNA, 20 bp, Artificial Sequence
  chemically synthesized
ttggctagcagatgtattag

SEQ ID NO: 109362 - DNA, 20 bp, Artificial Sequence
  chemically synthesized
gttttggctagcagatgtat

SEQ ID NO: 109363 - DNA, 20 bp, Artificial Sequence
  chemically synthesized
aaagcttctaatacatctgc

SEQ ID NO: 109364 - DNA, 20 bp, Artificial Sequence
  chemically synthesized
aaaatgactgttttggctag

SEQ ID NO: 109365 - DNA, 20 bp, Artificial Sequence
  chemically synthesized
aatacatctgctagccaaaa

SEQ ID NO: 109366 - DNA, 20 bp, Artificial Sequence
  chemically synthesized
atgaaaatgactgttttggc

SEQ ID NO: 109367 - DNA, 20 bp, Artificial Sequence
  chemically synthesized
tgtaatgaaaatgactgttt

SEQ ID NO: 109368 - DNA, 20 bp, Artificial Sequence
  chemically synthesized
tcattttcattacatgcttg

SEQ ID NO: 109369 - DNA, 20 bp, Artificial Sequence
  chemically synthesized
tttcattacatgcttgtggc

SEQ ID NO: 109370 - DNA, 20 bp, Artificial Sequence
  chemically synthesized
tgttctttttgaccagccac

SEQ ID NO: 109371 - DNA, 20 bp, Artificial Sequence
  chemically synthesized
catgcttgtggctggtcaaa

SEQ ID NO: 109372 - DNA, 20 bp, Artificial Sequence
  chemically synthesized
atacaactgttctttttgac

SEQ ID NO: 109373 - DNA, 20 bp, Artificial Sequence
  chemically synthesized
ttgtggctggtcaaaaagaa

SEQ ID NO: 109374 - DNA, 20 bp, Artificial Sequence
  chemically synthesized
ataatttttattttcttacc

SEQ ID NO: 109375 - DNA, 20 bp, Artificial Sequence
  chemically synthesized
aacctgtttgtggtctgggt

SEQ ID NO: 109376 - DNA, 20 bp, Artificial Sequence
  chemically synthesized
ttataacctgtttgtggtct

SEQ ID NO: 109377 - DNA, 20 bp, Artificial Sequence
  chemically synthesized
tttataacctgtttgtggtc

SEQ ID NO: 109378 - DNA, 20 bp, Artificial Sequence
  chemically synthesized
tttcttacccagaccacaaa

SEQ ID NO: 109379 - DNA, 20 bp, Artificial Sequence
  chemically synthesized
ttcttacccagaccacaaac

SEQ ID NO: 109380 - DNA, 20 bp, Artificial Sequence
  chemically synthesized
tactttttataacctgtttg

SEQ ID NO: 109381 - DNA, 20 bp, Artificial Sequence
  chemically synthesized
gaccacaaacaggttataaa

SEQ ID NO: 109382 - DNA, 20 bp, Artificial Sequence
  chemically synthesized
aacaggttataaaaagtaca

SEQ ID NO: 109383 - DNA, 20 bp, Artificial Sequence
  chemically synthesized
aaggaaccgccaaaatttaa

SEQ ID NO: 109384 - DNA, 20 bp, Artificial Sequence
  chemically synthesized
agtacatggcccttaaattt

SEQ ID NO: 109385 - DNA, 20 bp, Artificial Sequence
  chemically synthesized
aaaggaaccgccaaaattta

SEQ ID NO: 109386 - DNA, 20 bp, Artificial Sequence
  chemically synthesized
taaaggaaccgccaaaattt

SEQ ID NO: 109387 - DNA, 20 bp, Artificial Sequence
  chemically synthesized
acatggcccttaaattttgg

SEQ ID NO: 109388 - DNA, 20 bp, Artificial Sequence
  chemically synthesized
gcttttgaactaaattttaa

SEQ ID NO: 109389 - DNA, 20 bp, Artificial Sequence
  chemically synthesized
ttggcggttcctttaaaatt

SEQ ID NO: 109390 - DNA, 20 bp, Artificial Sequence
  chemically synthesized
ggcttttgaactaaatttta

SEQ ID NO: 109391 - DNA, 20 bp, Artificial Sequence
  chemically synthesized
tcctttaaaatttagttcaa

SEQ ID NO: 109392 - DNA, 20 bp, Artificial Sequence
  chemically synthesized
ttagttcaaaagccaacatg

SEQ ID NO: 109393 - DNA, 20 bp, Artificial Sequence
  chemically synthesized
agttcaaaagccaacatgaa

SEQ ID NO: 109394 - DNA, 20 bp, Artificial Sequence
  chemically synthesized
ttccatctgactcttcatgt

SEQ ID NO: 109395 - DNA, 20 bp, Artificial Sequence
  chemically synthesized
caaaagccaacatgaagagt

SEQ ID NO: 109396 - DNA, 20 bp, Artificial Sequence
  chemically synthesized
agccaacatgaagagtcaga

SEQ ID NO: 109397 - DNA, 20 bp, Artificial Sequence
  chemically synthesized
cagatggaatgactgtcaca

SEQ ID NO: 109398 - DNA, 20 bp, Artificial Sequence
  chemically synthesized
ttggtagctcttccatgtga

SEQ ID NO: 109399 - DNA, 20 bp, Artificial Sequence
  chemically synthesized
atggaatgactgtcacatgg

SEQ ID NO: 109400 - DNA, 20 bp, Artificial Sequence
  chemically synthesized
ggaatgactgtcacatggaa

SEQ ID NO: 109401 - DNA, 20 bp, Artificial Sequence
  chemically synthesized
tgtcacatggaagagctacc

SEQ ID NO: 109402 - DNA, 20 bp, Artificial Sequence
  chemically synthesized
cacatggaagagctaccaag

SEQ ID NO: 109403 - DNA, 20 bp, Artificial Sequence
  chemically synthesized
taaacttattatctgcttgg

SEQ ID NO: 109404 - DNA, 20 bp, Artificial Sequence
  chemically synthesized
ttctaaacttattatctgct

SEQ ID NO: 109405 - DNA, 20 bp, Artificial Sequence
  chemically synthesized
agagctaccaagcagataat

SEQ ID NO: 109406 - DNA, 20 bp, Artificial Sequence
  chemically synthesized
taccaagcagataataagtt

SEQ ID NO: 109407 - DNA, 20 bp, Artificial Sequence
  chemically synthesized
gtgtgttaattttcaattaa

SEQ ID NO: 109408 - DNA, 20 bp, Artificial Sequence
  chemically synthesized
aggtgtgttaattttcaatt

SEQ ID NO: 109409 - DNA, 20 bp, Artificial Sequence
  chemically synthesized
tcaatttgggaatacaatgt

SEQ ID NO: 109410 - DNA, 20 bp, Artificial Sequence
  chemically synthesized
ttcaatttgggaatacaatg

SEQ ID NO: 109411 - DNA, 20 bp, Artificial Sequence
  chemically synthesized
tacattgtattcccaaattg

SEQ ID NO: 109412 - DNA, 20 bp, Artificial Sequence
  chemically synthesized
acagccgttttcttcaattt

SEQ ID NO: 109413 - DNA, 20 bp, Artificial Sequence
  chemically synthesized
aacagccgttttcttcaatt

SEQ ID NO: 109414 - DNA, 20 bp, Artificial Sequence
  chemically synthesized
tattcccaaattgaagaaaa

SEQ ID NO: 109415 - DNA, 20 bp, Artificial Sequence
  chemically synthesized
attgaagaaaacggctgttt

SEQ ID NO: 109416 - DNA, 20 bp, Artificial Sequence
  chemically synthesized
tattatagcagtagccaaaa

SEQ ID NO: 109417 - DNA, 20 bp, Artificial Sequence
  chemically synthesized
gcagcatcttattatagcag

SEQ ID NO: 109418 - DNA, 20 bp, Artificial Sequence
  chemically synthesized
gttttggctactgctataat

SEQ ID NO: 109419 - DNA, 20 bp, Artificial Sequence
  chemically synthesized
tatgcagcatcttattatag

SEQ ID NO: 109420 - DNA, 20 bp, Artificial Sequence
  chemically synthesized
aagtatgcagcatcttatta

SEQ ID NO: 109421 - DNA, 20 bp, Artificial Sequence
  chemically synthesized
gattcagcatgtgaagtatg

SEQ ID NO: 109422 - DNA, 20 bp, Artificial Sequence
  chemically synthesized
ccttccagattcagcatgtg

SEQ ID NO: 109423 - DNA, 20 bp, Artificial Sequence
  chemically synthesized
catacttcacatgctgaatc

SEQ ID NO: 109424 - DNA, 20 bp, Artificial Sequence
  chemically synthesized
acttcacatgctgaatctgg

SEQ ID NO: 109425 - DNA, 20 bp, Artificial Sequence
  chemically synthesized
attgctcccccttccagatt

SEQ ID NO: 109426 - DNA, 20 bp, Artificial Sequence
  chemically synthesized
cttcacatgctgaatctgga

SEQ ID NO: 109427 - DNA, 20 bp, Artificial Sequence
  chemically synthesized
ttcacatgctgaatctggaa

SEQ ID NO: 109428 - DNA, 20 bp, Artificial Sequence
  chemically synthesized
tcacatgctgaatctggaag

SEQ ID NO: 109429 - DNA, 20 bp, Artificial Sequence
  chemically synthesized
cacatgctgaatctggaagg

SEQ ID NO: 109430 - DNA, 20 bp, Artificial Sequence
  chemically synthesized
catgctgaatctggaagggg

SEQ ID NO: 109431 - DNA, 20 bp, Artificial Sequence
  chemically synthesized
gactgaattgctcccccttc

SEQ ID NO: 109432 - DNA, 20 bp, Artificial Sequence
  chemically synthesized
atctggaagggggagcaatt

SEQ ID NO: 109433 - DNA, 20 bp, Artificial Sequence
  chemically synthesized
agcaattcagtcctatctga

SEQ ID NO: 109434 - DNA, 20 bp, Artificial Sequence
  chemically synthesized
cttaggaacaaccgtcagat

SEQ ID NO: 109435 - DNA, 20 bp, Artificial Sequence
  chemically synthesized
gcttaggaacaaccgtcaga

SEQ ID NO: 109436 - DNA, 20 bp, Artificial Sequence
  chemically synthesized
taaagcttaggaacaaccgt

SEQ ID NO: 109437 - DNA, 20 bp, Artificial Sequence
  chemically synthesized
cctatctgacggttgttcct

SEQ ID NO: 109438 - DNA, 20 bp, Artificial Sequence
  chemically synthesized
tgacggttgttcctaagctt

SEQ ID NO: 109439 - DNA, 20 bp, Artificial Sequence
  chemically synthesized
ttgaagttatactaaagctt

SEQ ID NO: 109440 - DNA, 20 bp, Artificial Sequence
  chemically synthesized
tttgaagttatactaaagct

SEQ ID NO: 109441 - DNA, 20 bp, Artificial Sequence
  chemically synthesized
tcatctttgaagttatacta

SEQ ID NO: 109442 - DNA, 20 bp, Artificial Sequence
  chemically synthesized
taagctttagtataacttca

SEQ ID NO: 109443 - DNA, 20 bp, Artificial Sequence
  chemically synthesized
tttagtataacttcaaagat

SEQ ID NO: 109444 - DNA, 20 bp, Artificial Sequence
  chemically synthesized
atttcataccctcatctttg

SEQ ID NO: 109445 - DNA, 20 bp, Artificial Sequence
  chemically synthesized
ttagtataacttcaaagatg

SEQ ID NO: 109446 - DNA, 20 bp, Artificial Sequence
  chemically synthesized
tagtataacttcaaagatga

SEQ ID NO: 109447 - DNA, 20 bp, Artificial Sequence
  chemically synthesized
gtatgaaattccgtcatcgt

SEQ ID NO: 109448 - DNA, 20 bp, Artificial Sequence
  chemically synthesized
caggatctctctgacgatga

SEQ ID NO: 109449 - DNA, 20 bp, Artificial Sequence
  chemically synthesized
atgaaattccgtcatcgtca

SEQ ID NO: 109450 - DNA, 20 bp, Artificial Sequence
  chemically synthesized
gaaattccgtcatcgtcaga

SEQ ID NO: 109451 - DNA, 20 bp, Artificial Sequence
  chemically synthesized
caacccaaggaagagaaagc

SEQ ID NO: 109452 - DNA, 20 bp, Artificial Sequence
  chemically synthesized
gcaacccaaggaagagaaag

SEQ ID NO: 109453 - DNA, 20 bp, Artificial Sequence
  chemically synthesized
tttgcaacccaaggaagaga

SEQ ID NO: 109454 - DNA, 20 bp, Artificial Sequence
  chemically synthesized
agatcctgctttctcttcct

SEQ ID NO: 109455 - DNA, 20 bp, Artificial Sequence
  chemically synthesized
gatcctgctttctcttcctt

SEQ ID NO: 109456 - DNA, 20 bp, Artificial Sequence
  chemically synthesized
taactttgcaacccaaggaa

SEQ ID NO: 109457 - DNA, 20 bp, Artificial Sequence
  chemically synthesized
actaactttgcaacccaagg

SEQ ID NO: 109458 - DNA, 20 bp, Artificial Sequence
  chemically synthesized
tttactaactttgcaaccca

SEQ ID NO: 109459 - DNA, 20 bp, Artificial Sequence
  chemically synthesized
atttactaactttgcaaccc

SEQ ID NO: 109460 - DNA, 20 bp, Artificial Sequence
  chemically synthesized
tttctcttccttgggttgca

SEQ ID NO: 109461 - DNA, 20 bp, Artificial Sequence
  chemically synthesized
tcttccttgggttgcaaagt

SEQ ID NO: 109462 - DNA, 20 bp, Artificial Sequence
  chemically synthesized
gttgcaaagttagtaaatat

SEQ ID NO: 109463 - DNA, 20 bp, Artificial Sequence
  chemically synthesized
aacgagttagttaaaatgga

SEQ ID NO: 109464 - DNA, 20 bp, Artificial Sequence
  chemically synthesized
caacgagttagttaaaatgg

SEQ ID NO: 109465 - DNA, 20 bp, Artificial Sequence
  chemically synthesized
gctcaacgagttagttaaaa

SEQ ID NO: 109466 - DNA, 20 bp, Artificial Sequence
  chemically synthesized
tccattttaactaactcgtt

SEQ ID NO: 109467 - DNA, 20 bp, Artificial Sequence
  chemically synthesized
tggagacaagctcaacgagt

SEQ ID NO: 109468 - DNA, 20 bp, Artificial Sequence
  chemically synthesized
ctattggagacaagctcaac

SEQ ID NO: 109469 - DNA, 20 bp, Artificial Sequence
  chemically synthesized
ttcaatcttctattggagac

SEQ ID NO: 109470 - DNA, 20 bp, Artificial Sequence
  chemically synthesized
ctcgttgagcttgtctccaa

SEQ ID NO: 109471 - DNA, 20 bp, Artificial Sequence
  chemically synthesized
gttgagcttgtctccaatag

SEQ ID NO: 109472 - DNA, 20 bp, Artificial Sequence
  chemically synthesized
aataattcaatcttctattg

SEQ ID NO: 109473 - DNA, 20 bp, Artificial Sequence
  chemically synthesized
ccaataattcaatcttctat

SEQ ID NO: 109474 - DNA, 20 bp, Artificial Sequence
  chemically synthesized
ccaatagaagattgaattat

SEQ ID NO: 109475 - DNA, 20 bp, Artificial Sequence
  chemically synthesized
ctagggatgtgaaaggattg

SEQ ID NO: 109476 - DNA, 20 bp, Artificial Sequence
  chemically synthesized
actagggatgtgaaaggatt

SEQ ID NO: 109477 - DNA, 20 bp, Artificial Sequence
  chemically synthesized
gatactactagggatgtgaa

SEQ ID NO: 109478 - DNA, 20 bp, Artificial Sequence
  chemically synthesized
tgatactactagggatgtga

SEQ ID NO: 109479 - DNA, 20 bp, Artificial Sequence
  chemically synthesized
cctcaatcctttcacatccc

SEQ ID NO: 109480 - DNA, 20 bp, Artificial Sequence
  chemically synthesized
caatcctttcacatccctag

SEQ ID NO: 109481 - DNA, 20 bp, Artificial Sequence
  chemically synthesized
gtgaatgtatgatactacta

SEQ ID NO: 109482 - DNA, 20 bp, Artificial Sequence
  chemically synthesized
cgtgaatgtatgatactact

SEQ ID NO: 109483 - DNA, 20 bp, Artificial Sequence
  chemically synthesized
gcgtgaatgtatgatactac

SEQ ID NO: 109484 - DNA, 20 bp, Artificial Sequence
  chemically synthesized
agtatcatacattcacgctc

SEQ ID NO: 109485 - DNA, 20 bp, Artificial Sequence
  chemically synthesized
atacattcacgctccagcca

SEQ ID NO: 109486 - DNA, 20 bp, Artificial Sequence
  chemically synthesized
cctatgtgaggccatggctg

SEQ ID NO: 109487 - DNA, 20 bp, Artificial Sequence
  chemically synthesized
cacctatgtgaggccatggc

SEQ ID NO: 109488 - DNA, 20 bp, Artificial Sequence
  chemically synthesized
tttccacctatgtgaggcca

SEQ ID NO: 109489 - DNA, 20 bp, Artificial Sequence
  chemically synthesized
gctccagccatggcctcaca

SEQ ID NO: 109490 - DNA, 20 bp, Artificial Sequence
  chemically synthesized
ctccagccatggcctcacat

SEQ ID NO: 109491 - DNA, 20 bp, Artificial Sequence
  chemically synthesized
aaatactttccacctatgtg

SEQ ID NO: 109492 - DNA, 20 bp, Artificial Sequence
  chemically synthesized
cagccatggcctcacatagg

SEQ ID NO: 109493 - DNA, 20 bp, Artificial Sequence
  chemically synthesized
aaaatactttccacctatgt

SEQ ID NO: 109494 - DNA, 20 bp, Artificial Sequence
  chemically synthesized
catggcctcacataggtgga

SEQ ID NO: 109495 - DNA, 20 bp, Artificial Sequence
  chemically synthesized
caagcccaaagtcaaggggt

SEQ ID NO: 109496 - DNA, 20 bp, Artificial Sequence
  chemically synthesized
ccaagcccaaagtcaagggg

SEQ ID NO: 109497 - DNA, 20 bp, Artificial Sequence
  chemically synthesized
tggccaagcccaaagtcaag

SEQ ID NO: 109498 - DNA, 20 bp, Artificial Sequence
  chemically synthesized
attttcctaccccttgactt

SEQ ID NO: 109499 - DNA, 20 bp, Artificial Sequence
  chemically synthesized
gtggccaagcccaaagtcaa

SEQ ID NO: 109500 - DNA, 20 bp, Artificial Sequence
  chemically synthesized
ttttcctaccccttgacttt

SEQ ID NO: 109501 - DNA, 20 bp, Artificial Sequence
  chemically synthesized
tgtggccaagcccaaagtca

SEQ ID NO: 109502 - DNA, 20 bp, Artificial Sequence
  chemically synthesized
ttgtggccaagcccaaagtc

SEQ ID NO: 109503 - DNA, 20 bp, Artificial Sequence
  chemically synthesized
ctaccccttgactttgggct

SEQ ID NO: 109504 - DNA, 20 bp, Artificial Sequence
  chemically synthesized
atgtcttgtggccaagccca

SEQ ID NO: 109505 - DNA, 20 bp, Artificial Sequence
  chemically synthesized
ttgactttgggcttggccac

SEQ ID NO: 109506 - DNA, 20 bp, Artificial Sequence
  chemically synthesized
acaaaacatgtcttgtggcc

SEQ ID NO: 109507 - DNA, 20 bp, Artificial Sequence
  chemically synthesized
attagacaaaacatgtcttg

SEQ ID NO: 109508 - DNA, 20 bp, Artificial Sequence
  chemically synthesized
acaagacatgttttgtctaa

SEQ ID NO: 109509 - DNA, 20 bp, Artificial Sequence
  chemically synthesized
caagacatgttttgtctaat

SEQ ID NO: 109510 - DNA, 20 bp, Artificial Sequence
  chemically synthesized
cacatttgtttatagcccat

SEQ ID NO: 109511 - DNA, 20 bp, Artificial Sequence
  chemically synthesized
cctcttgtcacatttgttta

SEQ ID NO: 109512 - DNA, 20 bp, Artificial Sequence
  chemically synthesized
gggctataaacaaatgtgac

SEQ ID NO: 109513 - DNA, 20 bp, Artificial Sequence
  chemically synthesized
gctataaacaaatgtgacaa

SEQ ID NO: 109514 - DNA, 20 bp, Artificial Sequence
  chemically synthesized
ctataaacaaatgtgacaag

SEQ ID NO: 109515 - DNA, 20 bp, Artificial Sequence
  chemically synthesized
ataaacaaatgtgacaagag

SEQ ID NO: 109516 - DNA, 20 bp, Artificial Sequence
  chemically synthesized
aaacaaatgtgacaagagga

SEQ ID NO: 109517 - DNA, 20 bp, Artificial Sequence
  chemically synthesized
acaagaggagagattttgaa

SEQ ID NO: 109518 - DNA, 20 bp, Artificial Sequence
  chemically synthesized
gtagcacaaggcaatgacag

SEQ ID NO: 109519 - DNA, 20 bp, Artificial Sequence
  chemically synthesized
agagtagcacaaggcaatga

SEQ ID NO: 109520 - DNA, 20 bp, Artificial Sequence
  chemically synthesized
gggtatgacagagtagcaca

SEQ ID NO: 109521 - DNA, 20 bp, Artificial Sequence
  chemically synthesized
ggggtatgacagagtagcac

SEQ ID NO: 109522 - DNA, 20 bp, Artificial Sequence
  chemically synthesized
ctactcggggtatgacagag

SEQ ID NO: 109523 - DNA, 20 bp, Artificial Sequence
  chemically synthesized
cagctactcggggtatgaca

SEQ ID NO: 109524 - DNA, 20 bp, Artificial Sequence
  chemically synthesized
atcagctactcggggtatga

SEQ ID NO: 109525 - DNA, 20 bp, Artificial Sequence
  chemically synthesized
gtgctactctgtcatacccc

SEQ ID NO: 109526 - DNA, 20 bp, Artificial Sequence
  chemically synthesized
ctactctgtcataccccgag

SEQ ID NO: 109527 - DNA, 20 bp, Artificial Sequence
  chemically synthesized
gaagggacatcagctactcg

SEQ ID NO: 109528 - DNA, 20 bp, Artificial Sequence
  chemically synthesized
tgaagggacatcagctactc

SEQ ID NO: 109529 - DNA, 20 bp, Artificial Sequence
  chemically synthesized
ctgaagggacatcagctact

SEQ ID NO: 109530 - DNA, 20 bp, Artificial Sequence
  chemically synthesized
gactcaagctgaagggacat

SEQ ID NO: 109531 - DNA, 20 bp, Artificial Sequence
  chemically synthesized
ccgagtagctgatgtccctt

SEQ ID NO: 109532 - DNA, 20 bp, Artificial Sequence
  chemically synthesized
cttctgagactcaagctgaa

SEQ ID NO: 109533 - DNA, 20 bp, Artificial Sequence
  chemically synthesized
agctgatgtcccttcagctt

SEQ ID NO: 109534 - DNA, 20 bp, Artificial Sequence
  chemically synthesized
tcttctgagactcaagctga

SEQ ID NO: 109535 - DNA, 20 bp, Artificial Sequence
  chemically synthesized
ttcttctgagactcaagctg

SEQ ID NO: 109536 - DNA, 20 bp, Artificial Sequence
  chemically synthesized
tgtcccttcagcttgagtct

SEQ ID NO: 109537 - DNA, 20 bp, Artificial Sequence
  chemically synthesized
catattttcttctgagactc

SEQ ID NO: 109538 - DNA, 20 bp, Artificial Sequence
  chemically synthesized
cccttcagcttgagtctcag

SEQ ID NO: 109539 - DNA, 20 bp, Artificial Sequence
  chemically synthesized
tataccacatattttcttct

SEQ ID NO: 109540 - DNA, 20 bp, Artificial Sequence
  chemically synthesized
gagtctcagaagaaaatatg

SEQ ID NO: 109541 - DNA, 20 bp, Artificial Sequence
  chemically synthesized
tcagaagaaaatatgtggta

SEQ ID NO: 109542 - DNA, 20 bp, Artificial Sequence
  chemically synthesized
atatgtggtatagacccgaa

SEQ ID NO: 109543 - DNA, 20 bp, Artificial Sequence
  chemically synthesized
ctaggccgtcggttctgttc

SEQ ID NO: 109544 - DNA, 20 bp, Artificial Sequence
  chemically synthesized
tctaggccgtcggttctgtt

SEQ ID NO: 109545 - DNA, 20 bp, Artificial Sequence
  chemically synthesized
atagacccgaacagaaccga

SEQ ID NO: 109546 - DNA, 20 bp, Artificial Sequence
  chemically synthesized
cccgaacagaaccgacggcc

SEQ ID NO: 109547 - DNA, 20 bp, Artificial Sequence
  chemically synthesized
tatgcttatctctaggccgt

SEQ ID NO: 109548 - DNA, 20 bp, Artificial Sequence
  chemically synthesized
cgaacagaaccgacggccta

SEQ ID NO: 109549 - DNA, 20 bp, Artificial Sequence
  chemically synthesized
agaaccgacggcctagagat

SEQ ID NO: 109550 - DNA, 20 bp, Artificial Sequence
  chemically synthesized
gtttagctatgcttatctct

SEQ ID NO: 109551 - DNA, 20 bp, Artificial Sequence
  chemically synthesized
ggtttagctatgcttatctc

SEQ ID NO: 109552 - DNA, 20 bp, Artificial Sequence
  chemically synthesized
cgacggcctagagataagca

SEQ ID NO: 109553 - DNA, 20 bp, Artificial Sequence
  chemically synthesized
aatcatggctggaaatggtt

SEQ ID NO: 109554 - DNA, 20 bp, Artificial Sequence
  chemically synthesized
aagcatagctaaaccatttc

SEQ ID NO: 109555 - DNA, 20 bp, Artificial Sequence
  chemically synthesized
tggccaatcatggctggaaa

SEQ ID NO: 109556 - DNA, 20 bp, Artificial Sequence
  chemically synthesized
agggtttggccaatcatggc

SEQ ID NO: 109557 - DNA, 20 bp, Artificial Sequence
  chemically synthesized
aaaccatttccagccatgat

SEQ ID NO: 109558 - DNA, 20 bp, Artificial Sequence
  chemically synthesized
tggtagggtttggccaatca

SEQ ID NO: 109559 - DNA, 20 bp, Artificial Sequence
  chemically synthesized
agctgcagtttggtagggtt

SEQ ID NO: 109560 - DNA, 20 bp, Artificial Sequence
  chemically synthesized
catggagctgcagtttggta

SEQ ID NO: 109561 - DNA, 20 bp, Artificial Sequence
  chemically synthesized
tcatggagctgcagtttggt

SEQ ID NO: 109562 - DNA, 20 bp, Artificial Sequence
  chemically synthesized
ttcatggagctgcagtttgg

SEQ ID NO: 109563 - DNA, 20 bp, Artificial Sequence
  chemically synthesized
ggccaaaccctaccaaactg

SEQ ID NO: 109564 - DNA, 20 bp, Artificial Sequence
  chemically synthesized
ttattcatggagctgcagtt

SEQ ID NO: 109565 - DNA, 20 bp, Artificial Sequence
  chemically synthesized
ttgatttattcatggagctg

SEQ ID NO: 109566 - DNA, 20 bp, Artificial Sequence
  chemically synthesized
acaatattgatttattcatg

SEQ ID NO: 109567 - DNA, 20 bp, Artificial Sequence
  chemically synthesized
caacaatattgatttattca

SEQ ID NO: 109568 - DNA, 20 bp, Artificial Sequence
  chemically synthesized
taaatcaatattgttgttat

SEQ ID NO: 109569 - DNA, 20 bp, Artificial Sequence
  chemically synthesized
accaaaaaaatttaattcag

SEQ ID NO: 109570 - DNA, 20 bp, Artificial Sequence
  chemically synthesized
acaaccaaaaaaatttaatt

SEQ ID NO: 109571 - DNA, 20 bp, Artificial Sequence
  chemically synthesized
gccactgaattaaatttttt

SEQ ID NO: 109572 - DNA, 20 bp, Artificial Sequence
  chemically synthesized
ttttttggttgtttattgtg

SEQ ID NO: 109573 - DNA, 20 bp, Artificial Sequence
  chemically synthesized
ttgtttattgtgcagcaaaa

SEQ ID NO: 109574 - DNA, 20 bp, Artificial Sequence
  chemically synthesized
aaccacatttcagttcatat

SEQ ID NO: 109575 - DNA, 20 bp, Artificial Sequence
  chemically synthesized
gactgatatgaactgaaatg

SEQ ID NO: 109576 - DNA, 20 bp, Artificial Sequence
  chemically synthesized
attgattataaaccacattt

SEQ ID NO: 109577 - DNA, 20 bp, Artificial Sequence
  chemically synthesized
ggtttataatcaatacaatc

SEQ ID NO: 109578 - DNA, 20 bp, Artificial Sequence
  chemically synthesized
ataatcaatacaatccagta

SEQ ID NO: 109579 - DNA, 20 bp, Artificial Sequence
  chemically synthesized
tacatttagtagaactttac

SEQ ID NO: 109580 - DNA, 20 bp, Artificial Sequence
  chemically synthesized
cttgatagacatacatttag

SEQ ID NO: 109581 - DNA, 20 bp, Artificial Sequence
  chemically synthesized
ttgcttgatagacatacatt

SEQ ID NO: 109582 - DNA, 20 bp, Artificial Sequence
  chemically synthesized
ctactaaatgtatgtctatc

SEQ ID NO: 109583 - DNA, 20 bp, Artificial Sequence
  chemically synthesized
gttttttttcttttgcttga

SEQ ID NO: 109584 - DNA, 20 bp, Artificial Sequence
  chemically synthesized
aatgtatgtctatcaagcaa

SEQ ID NO: 109585 - DNA, 20 bp, Artificial Sequence
  chemically synthesized
atcaagcaaaagaaaaaaaa

SEQ ID NO: 109586 - DNA, 20 bp, Artificial Sequence
  chemically synthesized
aaagaaaaaaaacagatgat

SEQ ID NO: 109587 - DNA, 20 bp, Artificial Sequence
  chemically synthesized
aaaaaaaacagatgattaga

SEQ ID NO: 109588 - DNA, 20 bp, Artificial Sequence
  chemically synthesized
gttgtcaaattcttctaaca

SEQ ID NO: 109589 - DNA, 20 bp, Artificial Sequence
  chemically synthesized
atgtatatggactttgttag

SEQ ID NO: 109590 - DNA, 20 bp, Artificial Sequence
  chemically synthesized
ggtatgtatatggactttgt

SEQ ID NO: 109591 - DNA, 20 bp, Artificial Sequence
  chemically synthesized
tctggtacctggtatgtata

SEQ ID NO: 109592 - DNA, 20 bp, Artificial Sequence
  chemically synthesized
aacaaagtccatatacatac

SEQ ID NO: 109593 - DNA, 20 bp, Artificial Sequence
  chemically synthesized
acaaagtccatatacatacc

SEQ ID NO: 109594 - DNA, 20 bp, Artificial Sequence
  chemically synthesized
tccatatacataccaggtac

SEQ ID NO: 109595 - DNA, 20 bp, Artificial Sequence
  chemically synthesized
tgataactcattctggtacc

SEQ ID NO: 109596 - DNA, 20 bp, Artificial Sequence
  chemically synthesized
tacataccaggtaccagaat

SEQ ID NO: 109597 - DNA, 20 bp, Artificial Sequence
  chemically synthesized
caattattgataactcattc

SEQ ID NO: 109598 - DNA, 20 bp, Artificial Sequence
  chemically synthesized
atgagttatcaataattgcc

SEQ ID NO: 109599 - DNA, 20 bp, Artificial Sequence
  chemically synthesized
tgagttatcaataattgcct

SEQ ID NO: 109600 - DNA, 20 bp, Artificial Sequence
  chemically synthesized
gagttatcaataattgccta

SEQ ID NO: 109601 - DNA, 20 bp, Artificial Sequence
  chemically synthesized
agttatcaataattgcctag

SEQ ID NO: 109602 - DNA, 20 bp, Artificial Sequence
  chemically synthesized
atcaataattgcctaggggt

SEQ ID NO: 109603 - DNA, 20 bp, Artificial Sequence
  chemically synthesized
tcaataattgcctaggggta

SEQ ID NO: 109604 - DNA, 20 bp, Artificial Sequence
  chemically synthesized
tatttctaacccttacccct

SEQ ID NO: 109605 - DNA, 20 bp, Artificial Sequence
  chemically synthesized
caataattgcctaggggtaa

SEQ ID NO: 109606 - DNA, 20 bp, Artificial Sequence
  chemically synthesized
ttatttctaacccttacccc

SEQ ID NO: 109607 - DNA, 20 bp, Artificial Sequence
  chemically synthesized
aattgcctaggggtaagggt

SEQ ID NO: 109608 - DNA, 20 bp, Artificial Sequence
  chemically synthesized
gtaagggttagaaataaaaa

SEQ ID NO: 109609 - DNA, 20 bp, Artificial Sequence
  chemically synthesized
ggttagaaataaaaaaagtc

SEQ ID NO: 109610 - DNA, 20 bp, Artificial Sequence
  chemically synthesized
aaaagtcaagttgaacccac

SEQ ID NO: 109611 - DNA, 20 bp, Artificial Sequence
  chemically synthesized
aaagtcaagttgaacccact

SEQ ID NO: 109612 - DNA, 20 bp, Artificial Sequence
  chemically synthesized
acctggaaatacgacctagt

SEQ ID NO: 109613 - DNA, 20 bp, Artificial Sequence
  chemically synthesized
aacctggaaatacgacctag

SEQ ID NO: 109614 - DNA, 20 bp, Artificial Sequence
  chemically synthesized
gaaaacctggaaatacgacc

SEQ ID NO: 109615 - DNA, 20 bp, Artificial Sequence
  chemically synthesized
aacccactaggtcgtatttc

SEQ ID NO: 109616 - DNA, 20 bp, Artificial Sequence
  chemically synthesized
acccactaggtcgtatttcc

SEQ ID NO: 109617 - DNA, 20 bp, Artificial Sequence
  chemically synthesized
ggtcgtatttccaggttttc

SEQ ID NO: 109618 - DNA, 20 bp, Artificial Sequence
  chemically synthesized
gaacagtctgcttgaaaacc

SEQ ID NO: 109619 - DNA, 20 bp, Artificial Sequence
  chemically synthesized
cgtatttccaggttttcaag

SEQ ID NO: 109620 - DNA, 20 bp, Artificial Sequence
  chemically synthesized
ggttttcaagcagactgttc

SEQ ID NO: 109621 - DNA, 20 bp, Artificial Sequence
  chemically synthesized
tcaaatattgcaaaccagaa

SEQ ID NO: 109622 - DNA, 20 bp, Artificial Sequence
  chemically synthesized
tcttttcaaatattgcaaac

SEQ ID NO: 109623 - DNA, 20 bp, Artificial Sequence
  chemically synthesized
tctggtttgcaatatttgaa

SEQ ID NO: 109624 - DNA, 20 bp, Artificial Sequence
  chemically synthesized
tggtttgcaatatttgaaaa

SEQ ID NO: 109625 - DNA, 20 bp, Artificial Sequence
  chemically synthesized
tatttgaaaagagtctgctg

SEQ ID NO: 109626 - DNA, 20 bp, Artificial Sequence
  chemically synthesized
cagtcattagcataccacag

SEQ ID NO: 109627 - DNA, 20 bp, Artificial Sequence
  chemically synthesized
tcacagtcattagcatacca

SEQ ID NO: 109628 - DNA, 20 bp, Artificial Sequence
  chemically synthesized
accacagaattcacagtcat

SEQ ID NO: 109629 - DNA, 20 bp, Artificial Sequence
  chemically synthesized
tccaaagaccacagaattca

SEQ ID NO: 109630 - DNA, 20 bp, Artificial Sequence
  chemically synthesized
gctaatgactgtgaattctg

SEQ ID NO: 109631 - DNA, 20 bp, Artificial Sequence
  chemically synthesized
actgtgaattctgtggtctt

SEQ ID NO: 109632 - DNA, 20 bp, Artificial Sequence
  chemically synthesized
tggaactattccaaagacca

SEQ ID NO: 109633 - DNA, 20 bp, Artificial Sequence
  chemically synthesized
gaattctgtggtctttggaa

SEQ ID NO: 109634 - DNA, 20 bp, Artificial Sequence
  chemically synthesized
agcattttggaactattcca

SEQ ID NO: 109635 - DNA, 20 bp, Artificial Sequence
  chemically synthesized
tggaatagttccaaaatgct

SEQ ID NO: 109636 - DNA, 20 bp, Artificial Sequence
  chemically synthesized
taaacttgagcttagcattt

SEQ ID NO: 109637 - DNA, 20 bp, Artificial Sequence
  chemically synthesized
agttccaaaatgctaagctc

SEQ ID NO: 109638 - DNA, 20 bp, Artificial Sequence
  chemically synthesized
ttttgttttaaacttgagct

SEQ ID NO: 109639 - DNA, 20 bp, Artificial Sequence
  chemically synthesized
tccaattttgttttaaactt

SEQ ID NO: 109640 - DNA, 20 bp, Artificial Sequence
  chemically synthesized
gctcaagtttaaaacaaaat

SEQ ID NO: 109641 - DNA, 20 bp, Artificial Sequence
  chemically synthesized
tctgagcaagaaagatattt

SEQ ID NO: 109642 - DNA, 20 bp, Artificial Sequence
  chemically synthesized
tctcaaatatctttcttgct

SEQ ID NO: 109643 - DNA, 20 bp, Artificial Sequence
  chemically synthesized
taaatcctttctgagcaaga

SEQ ID NO: 109644 - DNA, 20 bp, Artificial Sequence
  chemically synthesized
aaatatctttcttgctcaga

SEQ ID NO: 109645 - DNA, 20 bp, Artificial Sequence
  chemically synthesized
gacttaaatcctttctgagc

SEQ ID NO: 109646 - DNA, 20 bp, Artificial Sequence
  chemically synthesized
aatatctttcttgctcagaa

SEQ ID NO: 109647 - DNA, 20 bp, Artificial Sequence
  chemically synthesized
aaaggacttaaatcctttct

SEQ ID NO: 109648 - DNA, 20 bp, Artificial Sequence
  chemically synthesized
ttcttgctcagaaaggattt

SEQ ID NO: 109649 - DNA, 20 bp, Artificial Sequence
  chemically synthesized
aggatttaagtccttttgta

SEQ ID NO: 109650 - DNA, 20 bp, Artificial Sequence
  chemically synthesized
tttgttcctttctgtacaaa

SEQ ID NO: 109651 - DNA, 20 bp, Artificial Sequence
  chemically synthesized
gtttgttcctttctgtacaa

SEQ ID NO: 109652 - DNA, 20 bp, Artificial Sequence
  chemically synthesized
tttaagtccttttgtacaga

SEQ ID NO: 109653 - DNA, 20 bp, Artificial Sequence
  chemically synthesized
ttaagtccttttgtacagaa

SEQ ID NO: 109654 - DNA, 20 bp, Artificial Sequence
  chemically synthesized
ttgtacagaaaggaacaaac

SEQ ID NO: 109655 - DNA, 20 bp, Artificial Sequence
  chemically synthesized
gaaaggaacaaacaagtgat

SEQ ID NO: 109656 - DNA, 20 bp, Artificial Sequence
  chemically synthesized
aaaggaacaaacaagtgata

SEQ ID NO: 109657 - DNA, 20 bp, Artificial Sequence
  chemically synthesized
acaagtgataaggtaccttt

SEQ ID NO: 109658 - DNA, 20 bp, Artificial Sequence
  chemically synthesized
caagtgataaggtacctttt

SEQ ID NO: 109659 - DNA, 20 bp, Artificial Sequence
  chemically synthesized
taggtaatagaaagcccaaa

SEQ ID NO: 109660 - DNA, 20 bp, Artificial Sequence
  chemically synthesized
ataggtaatagaaagcccaa

SEQ ID NO: 109661 - DNA, 20 bp, Artificial Sequence
  chemically synthesized
ctggaaacataggtaataga

SEQ ID NO: 109662 - DNA, 20 bp, Artificial Sequence
  chemically synthesized
cactctggaaacataggtaa

SEQ ID NO: 109663 - DNA, 20 bp, Artificial Sequence
  chemically synthesized
ctttctattacctatgtttc

SEQ ID NO: 109664 - DNA, 20 bp, Artificial Sequence
  chemically synthesized
ttttaccactctggaaacat

SEQ ID NO: 109665 - DNA, 20 bp, Artificial Sequence
  chemically synthesized
gttttaccactctggaaaca

SEQ ID NO: 109666 - DNA, 20 bp, Artificial Sequence
  chemically synthesized
ttctattacctatgtttcca

SEQ ID NO: 109667 - DNA, 20 bp, Artificial Sequence
  chemically synthesized
tattacctatgtttccagag

SEQ ID NO: 109668 - DNA, 20 bp, Artificial Sequence
  chemically synthesized
gagatccagttttaccactc

SEQ ID NO: 109669 - DNA, 20 bp, Artificial Sequence
  chemically synthesized
tgtttccagagtggtaaaac

SEQ ID NO: 109670 - DNA, 20 bp, Artificial Sequence
  chemically synthesized
gactgaaaacaagagagatc

SEQ ID NO: 109671 - DNA, 20 bp, Artificial Sequence
  chemically synthesized
agatatgactgaaaacaaga

SEQ ID NO: 109672 - DNA, 20 bp, Artificial Sequence
  chemically synthesized
aactggatctctcttgtttt

SEQ ID NO: 109673 - DNA, 20 bp, Artificial Sequence
  chemically synthesized
gtagatatgactgaaaacaa

SEQ ID NO: 109674 - DNA, 20 bp, Artificial Sequence
  chemically synthesized
ctgtagatatgactgaaaac

SEQ ID NO: 109675 - DNA, 20 bp, Artificial Sequence
  chemically synthesized
cttgttttcagtcatatcta

SEQ ID NO: 109676 - DNA, 20 bp, Artificial Sequence
  chemically synthesized
ttgttttcagtcatatctac

SEQ ID NO: 109677 - DNA, 20 bp, Artificial Sequence
  chemically synthesized
catccttaggagggaacctg

SEQ ID NO: 109678 - DNA, 20 bp, Artificial Sequence
  chemically synthesized
atatctacaggttccctcct

SEQ ID NO: 109679 - DNA, 20 bp, Artificial Sequence
  chemically synthesized
tatctacaggttccctccta

SEQ ID NO: 109680 - DNA, 20 bp, Artificial Sequence
  chemically synthesized
aggaaggatcatccttagga

SEQ ID NO: 109681 - DNA, 20 bp, Artificial Sequence
  chemically synthesized
caggaaggatcatccttagg

SEQ ID NO: 109682 - DNA, 20 bp, Artificial Sequence
  chemically synthesized
ccaggaaggatcatccttag

SEQ ID NO: 109683 - DNA, 20 bp, Artificial Sequence
  chemically synthesized
caccaggaaggatcatcctt

SEQ ID NO: 109684 - DNA, 20 bp, Artificial Sequence
  chemically synthesized
ccaccaggaaggatcatcct

SEQ ID NO: 109685 - DNA, 20 bp, Artificial Sequence
  chemically synthesized
ctcctaaggatgatccttcc

SEQ ID NO: 109686 - DNA, 20 bp, Artificial Sequence
  chemically synthesized
ctaaggatgatccttcctgg

SEQ ID NO: 109687 - DNA, 20 bp, Artificial Sequence
  chemically synthesized
gtaaacagaagccaccagga

SEQ ID NO: 109688 - DNA, 20 bp, Artificial Sequence
  chemically synthesized
tgtaaacagaagccaccagg

SEQ ID NO: 109689 - DNA, 20 bp, Artificial Sequence
  chemically synthesized
tgttgtaaacagaagccacc

SEQ ID NO: 109690 - DNA, 20 bp, Artificial Sequence
  chemically synthesized
ttgttgtaaacagaagccac

SEQ ID NO: 109691 - DNA, 20 bp, Artificial Sequence
  chemically synthesized
cgtggcattgttgtaaacag

SEQ ID NO: 109692 - DNA, 20 bp, Artificial Sequence
  chemically synthesized
tggcgtggcattgttgtaaa

SEQ ID NO: 109693 - DNA, 20 bp, Artificial Sequence
  chemically synthesized
gtttacaacaatgccacgcc

SEQ ID NO: 109694 - DNA, 20 bp, Artificial Sequence
  chemically synthesized
tacaacaatgccacgccaag

SEQ ID NO: 109695 - DNA, 20 bp, Artificial Sequence
  chemically synthesized
gtagtgttaactgcttggcg

SEQ ID NO: 109696 - DNA, 20 bp, Artificial Sequence
  chemically synthesized
acgaagtagtgttaactgct

SEQ ID NO: 109697 - DNA, 20 bp, Artificial Sequence
  chemically synthesized
gcagttaacactacttcgta

SEQ ID NO: 109698 - DNA, 20 bp, Artificial Sequence
  chemically synthesized
tggagtcttcctttacgaag

SEQ ID NO: 109699 - DNA, 20 bp, Artificial Sequence
  chemically synthesized
cagttaacactacttcgtaa

SEQ ID NO: 109700 - DNA, 20 bp, Artificial Sequence
  chemically synthesized
gagtggagtcttcctttacg

SEQ ID NO: 109701 - DNA, 20 bp, Artificial Sequence
  chemically synthesized
ttaacactacttcgtaaagg

SEQ ID NO: 109702 - DNA, 20 bp, Artificial Sequence
  chemically synthesized
aatgcgaaggtcaaggagtg

SEQ ID NO: 109703 - DNA, 20 bp, Artificial Sequence
  chemically synthesized
agaatgcgaaggtcaaggag

SEQ ID NO: 109704 - DNA, 20 bp, Artificial Sequence
  chemically synthesized
tcaagaatgcgaaggtcaag

SEQ ID NO: 109705 - DNA, 20 bp, Artificial Sequence
  chemically synthesized
ggtcaagaatgcgaaggtca

SEQ ID NO: 109706 - DNA, 20 bp, Artificial Sequence
  chemically synthesized
gggtcaagaatgcgaaggtc

SEQ ID NO: 109707 - DNA, 20 bp, Artificial Sequence
  chemically synthesized
attatgggtcaagaatgcga

SEQ ID NO: 109708 - DNA, 20 bp, Artificial Sequence
  chemically synthesized
cattatgggtcaagaatgcg

SEQ ID NO: 109709 - DNA, 20 bp, Artificial Sequence
  chemically synthesized
agcacattgcattatgggtc

SEQ ID NO: 109710 - DNA, 20 bp, Artificial Sequence
  chemically synthesized
gtggaagcacattgcattat

SEQ ID NO: 109711 - DNA, 20 bp, Artificial Sequence
  chemically synthesized
tgtggaagcacattgcatta

SEQ ID NO: 109712 - DNA, 20 bp, Artificial Sequence
  chemically synthesized
ggaaatgatagagattgtgg

SEQ ID NO: 109713 - DNA, 20 bp, Artificial Sequence
  chemically synthesized
tctggaaatgatagagattg

SEQ ID NO: 109714 - DNA, 20 bp, Artificial Sequence
  chemically synthesized
ggtgatgtctggaaatgata

SEQ ID NO: 109715 - DNA, 20 bp, Artificial Sequence
  chemically synthesized
tccacaatctctatcatttc

SEQ ID NO: 109716 - DNA, 20 bp, Artificial Sequence
  chemically synthesized
agggtgatgtctggaaatga

SEQ ID NO: 109717 - DNA, 20 bp, Artificial Sequence
  chemically synthesized
ttcccaggaagggtgatgtc

SEQ ID NO: 109718 - DNA, 20 bp, Artificial Sequence
  chemically synthesized
tttccagacatcacccttcc

SEQ ID NO: 109719 - DNA, 20 bp, Artificial Sequence
  chemically synthesized
ttccagacatcacccttcct

SEQ ID NO: 109720 - DNA, 20 bp, Artificial Sequence
  chemically synthesized
ttgtcagcatttcccaggaa

SEQ ID NO: 109721 - DNA, 20 bp, Artificial Sequence
  chemically synthesized
cttgtcagcatttcccagga

SEQ ID NO: 109722 - DNA, 20 bp, Artificial Sequence
  chemically synthesized
acttgtcagcatttcccagg

SEQ ID NO: 109723 - DNA, 20 bp, Artificial Sequence
  chemically synthesized
cgtacttgtcagcatttccc

SEQ ID NO: 109724 - DNA, 20 bp, Artificial Sequence
  chemically synthesized
ccgtacttgtcagcatttcc

SEQ ID NO: 109725 - DNA, 20 bp, Artificial Sequence
  chemically synthesized
ccttcctgggaaatgctgac

SEQ ID NO: 109726 - DNA, 20 bp, Artificial Sequence
  chemically synthesized
ctgggaaatgctgacaagta

SEQ ID NO: 109727 - DNA, 20 bp, Artificial Sequence
  chemically synthesized
ttagcacagtccgtacttgt

SEQ ID NO: 109728 - DNA, 20 bp, Artificial Sequence
  chemically synthesized
gacaagtacggactgtgcta

SEQ ID NO: 109729 - DNA, 20 bp, Artificial Sequence
  chemically synthesized
acaagtacggactgtgctaa

SEQ ID NO: 109730 - DNA, 20 bp, Artificial Sequence
  chemically synthesized
caagtacggactgtgctaaa

SEQ ID NO: 109731 - DNA, 20 bp, Artificial Sequence
  chemically synthesized
acagcctccaccctttagca

SEQ ID NO: 109732 - DNA, 20 bp, Artificial Sequence
  chemically synthesized
gtacggactgtgctaaaggg

SEQ ID NO: 109733 - DNA, 20 bp, Artificial Sequence
  chemically synthesized
acggactgtgctaaagggtg

SEQ ID NO: 109734 - DNA, 20 bp, Artificial Sequence
  chemically synthesized
gaaagacagcctccaccctt

SEQ ID NO: 109735 - DNA, 20 bp, Artificial Sequence
  chemically synthesized
cggactgtgctaaagggtgg

SEQ ID NO: 109736 - DNA, 20 bp, Artificial Sequence
  chemically synthesized
tggtggcaggaggtgaaaga

SEQ ID NO: 109737 - DNA, 20 bp, Artificial Sequence
  chemically synthesized
ctgttggtggcaggaggtga

SEQ ID NO: 109738 - DNA, 20 bp, Artificial Sequence
  chemically synthesized
aataagctgttggtggcagg

SEQ ID NO: 109739 - DNA, 20 bp, Artificial Sequence
  chemically synthesized
aaataagctgttggtggcag

SEQ ID NO: 109740 - DNA, 20 bp, Artificial Sequence
  chemically synthesized
tcaaataagctgttggtggc

SEQ ID NO: 109741 - DNA, 20 bp, Artificial Sequence
  chemically synthesized
ctttcacctcctgccaccaa

SEQ ID NO: 109742 - DNA, 20 bp, Artificial Sequence
  chemically synthesized
ctcaaataagctgttggtgg

SEQ ID NO: 109743 - DNA, 20 bp, Artificial Sequence
  chemically synthesized
ctcctcaaataagctgttgg

SEQ ID NO: 109744 - DNA, 20 bp, Artificial Sequence
  chemically synthesized
actctcctcaaataagctgt

SEQ ID NO: 109745 - DNA, 20 bp, Artificial Sequence
  chemically synthesized
ctgccaccaacagcttattt

SEQ ID NO: 109746 - DNA, 20 bp, Artificial Sequence
  chemically synthesized
tgccaccaacagcttatttg

SEQ ID NO: 109747 - DNA, 20 bp, Artificial Sequence
  chemically synthesized
ccaccaacagcttatttgag

SEQ ID NO: 109748 - DNA, 20 bp, Artificial Sequence
  chemically synthesized
ttcttaaactctcctcaaat

SEQ ID NO: 109749 - DNA, 20 bp, Artificial Sequence
  chemically synthesized
accaacagcttatttgagga

SEQ ID NO: 109750 - DNA, 20 bp, Artificial Sequence
  chemically synthesized
agcttatttgaggagagttt

SEQ ID NO: 109751 - DNA, 20 bp, Artificial Sequence
  chemically synthesized
tatttgaggagagtttaaga

SEQ ID NO: 109752 - DNA, 20 bp, Artificial Sequence
  chemically synthesized
ttgaggagagtttaagaaag

SEQ ID NO: 109753 - DNA, 20 bp, Artificial Sequence
  chemically synthesized
tttaagaaagaagattttac

SEQ ID NO: 109754 - DNA, 20 bp, Artificial Sequence
  chemically synthesized
gaaagaagattttaccagaa

SEQ ID NO: 109755 - DNA, 20 bp, Artificial Sequence
  chemically synthesized
acatgaaattggaacttttc

SEQ ID NO: 109756 - DNA, 20 bp, Artificial Sequence
  chemically synthesized
tataaagaggcacatgaaat

SEQ ID NO: 109757 - DNA, 20 bp, Artificial Sequence
  chemically synthesized
agcagaaaaagcatataaag

SEQ ID NO: 109758 - DNA, 20 bp, Artificial Sequence
  chemically synthesized
aagcagaaaaagcatataaa

SEQ ID NO: 109759 - DNA, 20 bp, Artificial Sequence
  chemically synthesized
agaagcagaaaaagcatata

SEQ ID NO: 109760 - DNA, 20 bp, Artificial Sequence
  chemically synthesized
gactacataagaagcagaaa

SEQ ID NO: 109761 - DNA, 20 bp, Artificial Sequence
  chemically synthesized
tttggagactacataagaag

SEQ ID NO: 109762 - DNA, 20 bp, Artificial Sequence
  chemically synthesized
tgctttttctgcttcttatg

SEQ ID NO: 109763 - DNA, 20 bp, Artificial Sequence
  chemically synthesized
aaatttggagactacataag

SEQ ID NO: 109764 - DNA, 20 bp, Artificial Sequence
  chemically synthesized
ttcaaatttggagactacat

SEQ ID NO: 109765 - DNA, 20 bp, Artificial Sequence
  chemically synthesized
aagactgtcattcaaatttg

SEQ ID NO: 109766 - DNA, 20 bp, Artificial Sequence
  chemically synthesized
ggaagactgtcattcaaatt

SEQ ID NO: 109767 - DNA, 20 bp, Artificial Sequence
  chemically synthesized
tagtctccaaatttgaatga

SEQ ID NO: 109768 - DNA, 20 bp, Artificial Sequence
  chemically synthesized
tgaatgacagtcttcctaac

SEQ ID NO: 109769 - DNA, 20 bp, Artificial Sequence
  chemically synthesized
ctccaaggttactagttagg

SEQ ID NO: 109770 - DNA, 20 bp, Artificial Sequence
  chemically synthesized
ttcctccaaggttactagtt

SEQ ID NO: 109771 - DNA, 20 bp, Artificial Sequence
  chemically synthesized
attcctccaaggttactagt

SEQ ID NO: 109772 - DNA, 20 bp, Artificial Sequence
  chemically synthesized
gtcttcctaactagtaacct

SEQ ID NO: 109773 - DNA, 20 bp, Artificial Sequence
  chemically synthesized
ctatattcctccaaggttac

SEQ ID NO: 109774 - DNA, 20 bp, Artificial Sequence
  chemically synthesized
cttcctaactagtaaccttg

SEQ ID NO: 109775 - DNA, 20 bp, Artificial Sequence
  chemically synthesized
ttcctaactagtaaccttgg

SEQ ID NO: 109776 - DNA, 20 bp, Artificial Sequence
  chemically synthesized
tggtctcctatattcctcca

SEQ ID NO: 109777 - DNA, 20 bp, Artificial Sequence
  chemically synthesized
ttggtctcctatattcctcc

SEQ ID NO: 109778 - DNA, 20 bp, Artificial Sequence
  chemically synthesized
ctagtaaccttggaggaata

SEQ ID NO: 109779 - DNA, 20 bp, Artificial Sequence
  chemically synthesized
tagtaaccttggaggaatat

SEQ ID NO: 109780 - DNA, 20 bp, Artificial Sequence
  chemically synthesized
gtaaccttggaggaatatag

SEQ ID NO: 109781 - DNA, 20 bp, Artificial Sequence
  chemically synthesized
ttggaggaatataggagacc

SEQ ID NO: 109782 - DNA, 20 bp, Artificial Sequence
  chemically synthesized
aggaatataggagaccaagt

SEQ ID NO: 109783 - DNA, 20 bp, Artificial Sequence
  chemically synthesized
ggaatataggagaccaagtg

SEQ ID NO: 109784 - DNA, 20 bp, Artificial Sequence
  chemically synthesized
atataggagaccaagtgagg

SEQ ID NO: 109785 - DNA, 20 bp, Artificial Sequence
  chemically synthesized
tatttgatagcttcctcact

SEQ ID NO: 109786 - DNA, 20 bp, Artificial Sequence
  chemically synthesized
gatgttaagaaattatttga

SEQ ID NO: 109787 - DNA, 20 bp, Artificial Sequence
  chemically synthesized
gtttcaataatgttgatgtt

SEQ ID NO: 109788 - DNA, 20 bp, Artificial Sequence
  chemically synthesized
acatcaacattattgaaaca

SEQ ID NO: 109789 - DNA, 20 bp, Artificial Sequence
  chemically synthesized
agcctccaatgtaaaacaat

SEQ ID NO: 109790 - DNA, 20 bp, Artificial Sequence
  chemically synthesized
agtaactcattgttttacat

SEQ ID NO: 109791 - DNA, 20 bp, Artificial Sequence
  chemically synthesized
taactcattgttttacattg

SEQ ID NO: 109792 - DNA, 20 bp, Artificial Sequence
  chemically synthesized
aactcattgttttacattgg

SEQ ID NO: 109793 - DNA, 20 bp, Artificial Sequence
  chemically synthesized
gttttacattggaggctaaa

SEQ ID NO: 109794 - DNA, 20 bp, Artificial Sequence
  chemically synthesized
ttaaaacatatcattctatt

SEQ ID NO: 109795 - DNA, 20 bp, Artificial Sequence
  chemically synthesized
tagaatgatatgttttaaaa

SEQ ID NO: 109796 - DNA, 20 bp, Artificial Sequence
  chemically synthesized
ttttaaaatggctatctcca

SEQ ID NO: 109797 - DNA, 20 bp, Artificial Sequence
  chemically synthesized
tttaaaatggctatctccat

SEQ ID NO: 109798 - DNA, 20 bp, Artificial Sequence
  chemically synthesized
aaaaaataagcccatggaga

SEQ ID NO: 109799 - DNA, 20 bp, Artificial Sequence
  chemically synthesized
aaaaaaaaaataagcccatg

SEQ ID NO: 109800 - DNA, 20 bp, Artificial Sequence
  chemically synthesized
agaaaaaaaaaataagccca

SEQ ID NO: 109801 - DNA, 20 bp, Artificial Sequence
  chemically synthesized
tcagatgagaaaaaaaaaat

SEQ ID NO: 109802 - DNA, 20 bp, Artificial Sequence
  chemically synthesized
ttttttttttctcatctgat

SEQ ID NO: 109803 - DNA, 20 bp, Artificial Sequence
  chemically synthesized
attgaatccacttatcagat

SEQ ID NO: 109804 - DNA, 20 bp, Artificial Sequence
  chemically synthesized
tttttttctcatctgataag

SEQ ID NO: 109805 - DNA, 20 bp, Artificial Sequence
  chemically synthesized
aaatcattgaatccacttat

SEQ ID NO: 109806 - DNA, 20 bp, Artificial Sequence
  chemically synthesized
aagtggattcaatgatttcc

SEQ ID NO: 109807 - DNA, 20 bp, Artificial Sequence
  chemically synthesized
cagagttgaaaacaaaatct

SEQ ID NO: 109808 - DNA, 20 bp, Artificial Sequence
  chemically synthesized
ccagagaccatagaatcaca

SEQ ID NO: 109809 - DNA, 20 bp, Artificial Sequence
  chemically synthesized
atccagagaccatagaatca

SEQ ID NO: 109810 - DNA, 20 bp, Artificial Sequence
  chemically synthesized
ttttcaactctgtgattcta

SEQ ID NO: 109811 - DNA, 20 bp, Artificial Sequence
  chemically synthesized
ctctgtgattctatggtctc

SEQ ID NO: 109812 - DNA, 20 bp, Artificial Sequence
  chemically synthesized
actacagtatccagagacca

SEQ ID NO: 109813 - DNA, 20 bp, Artificial Sequence
  chemically synthesized
ggttggaactacagtatcca

SEQ ID NO: 109814 - DNA, 20 bp, Artificial Sequence
  chemically synthesized
tctatggtctctggatactg

SEQ ID NO: 109815 - DNA, 20 bp, Artificial Sequence
  chemically synthesized
aaggttggaactacagtatc

SEQ ID NO: 109816 - DNA, 20 bp, Artificial Sequence
  chemically synthesized
tctcttgaaggttggaacta

SEQ ID NO: 109817 - DNA, 20 bp, Artificial Sequence
  chemically synthesized
atactgtagttccaaccttc

SEQ ID NO: 109818 - DNA, 20 bp, Artificial Sequence
  chemically synthesized
tgtgctcttctcttgaaggt

SEQ ID NO: 109819 - DNA, 20 bp, Artificial Sequence
  chemically synthesized
actgtagttccaaccttcaa

SEQ ID NO: 109820 - DNA, 20 bp, Artificial Sequence
  chemically synthesized
gtagttccaaccttcaagag

SEQ ID NO: 109821 - DNA, 20 bp, Artificial Sequence
  chemically synthesized
tagatgtgctcttctcttga

SEQ ID NO: 109822 - DNA, 20 bp, Artificial Sequence
  chemically synthesized
ttagatgtgctcttctcttg

SEQ ID NO: 109823 - DNA, 20 bp, Artificial Sequence
  chemically synthesized
agttccaaccttcaagagaa

SEQ ID NO: 109824 - DNA, 20 bp, Artificial Sequence
  chemically synthesized
gagaagagcacatctaatta

SEQ ID NO: 109825 - DNA, 20 bp, Artificial Sequence
  chemically synthesized
gcgctgtctcgaactttaat

SEQ ID NO: 109826 - DNA, 20 bp, Artificial Sequence
  chemically synthesized
agcacatctaattaaagttc

SEQ ID NO: 109827 - DNA, 20 bp, Artificial Sequence
  chemically synthesized
catctaattaaagttcgaga

SEQ ID NO: 109828 - DNA, 20 bp, Artificial Sequence
  chemically synthesized
aaagttcgagacagcgccaa

SEQ ID NO: 109829 - DNA, 20 bp, Artificial Sequence
  chemically synthesized
tcgagacagcgccaaaagat

SEQ ID NO: 109830 - DNA, 20 bp, Artificial Sequence
  chemically synthesized
gaccgtagctgctaatcttt

SEQ ID NO: 109831 - DNA, 20 bp, Artificial Sequence
  chemically synthesized
agacagcgccaaaagattag

SEQ ID NO: 109832 - DNA, 20 bp, Artificial Sequence
  chemically synthesized
cgccaaaagattagcagcta

SEQ ID NO: 109833 - DNA, 20 bp, Artificial Sequence
  chemically synthesized
ttgctcattaaatgtgaccg

SEQ ID NO: 109834 - DNA, 20 bp, Artificial Sequence
  chemically synthesized
cagctacggtcacatttaat

SEQ ID NO: 109835 - DNA, 20 bp, Artificial Sequence
  chemically synthesized
tacggtcacatttaatgagc

SEQ ID NO: 109836 - DNA, 20 bp, Artificial Sequence
  chemically synthesized
tcacatttaatgagcaagtc

SEQ ID NO: 109837 - DNA, 20 bp, Artificial Sequence
  chemically synthesized
tttaatgagcaagtcgagtg

SEQ ID NO: 109838 - DNA, 20 bp, Artificial Sequence
  chemically synthesized
ttaatgagcaagtcgagtga

SEQ ID NO: 109839 - DNA, 20 bp, Artificial Sequence
  chemically synthesized
aaggcatttttcccattgtc

SEQ ID NO: 109840 - DNA, 20 bp, Artificial Sequence
  chemically synthesized
aggcatttttcccattgtct

SEQ ID NO: 109841 - DNA, 20 bp, Artificial Sequence
  chemically synthesized
tgaggtgactcctagacaat

SEQ ID NO: 109842 - DNA, 20 bp, Artificial Sequence
  chemically synthesized
ttgaggtgactcctagacaa

SEQ ID NO: 109843 - DNA, 20 bp, Artificial Sequence
  chemically synthesized
gcatttttcccattgtctag

SEQ ID NO: 109844 - DNA, 20 bp, Artificial Sequence
  chemically synthesized
catcctattgaggtgactcc

SEQ ID NO: 109845 - DNA, 20 bp, Artificial Sequence
  chemically synthesized
ttgtctaggagtcacctcaa

SEQ ID NO: 109846 - DNA, 20 bp, Artificial Sequence
  chemically synthesized
tgtctaggagtcacctcaat

SEQ ID NO: 109847 - DNA, 20 bp, Artificial Sequence
  chemically synthesized
gtgcatcttccatcctattg

SEQ ID NO: 109848 - DNA, 20 bp, Artificial Sequence
  chemically synthesized
taggagtcacctcaatagga

SEQ ID NO: 109849 - DNA, 20 bp, Artificial Sequence
  chemically synthesized
cgtgcatcttccatcctatt

SEQ ID NO: 109850 - DNA, 20 bp, Artificial Sequence
  chemically synthesized
gagtcacctcaataggatgg

SEQ ID NO: 109851 - DNA, 20 bp, Artificial Sequence
  chemically synthesized
tggaagatgcacgttctata

SEQ ID NO: 109852 - DNA, 20 bp, Artificial Sequence
  chemically synthesized
aggctggtcataagactgta

SEQ ID NO: 109853 - DNA, 20 bp, Artificial Sequence
  chemically synthesized
gttctatacagtcttatgac

SEQ ID NO: 109854 - DNA, 20 bp, Artificial Sequence
  chemically synthesized
ctgaggaacaggctggtcat

SEQ ID NO: 109855 - DNA, 20 bp, Artificial Sequence
  chemically synthesized
aaatatgctgaggaacaggc

SEQ ID NO: 109856 - DNA, 20 bp, Artificial Sequence
  chemically synthesized
cttatgaccagcctgttcct

SEQ ID NO: 109857 - DNA, 20 bp, Artificial Sequence
  chemically synthesized
ggaaaaatatgctgaggaac

SEQ ID NO: 109858 - DNA, 20 bp, Artificial Sequence
  chemically synthesized
aggaaaaatatgctgaggaa

SEQ ID NO: 109859 - DNA, 20 bp, Artificial Sequence
  chemically synthesized
cttaaaggaaaaatatgctg

SEQ ID NO: 109860 - DNA, 20 bp, Artificial Sequence
  chemically synthesized
acttaaaggaaaaatatgct

SEQ ID NO: 109861 - DNA, 20 bp, Artificial Sequence
  chemically synthesized
cctcagcatatttttccttt

SEQ ID NO: 109862 - DNA, 20 bp, Artificial Sequence
  chemically synthesized
tatacctgtttggtacttaa

SEQ ID NO: 109863 - DNA, 20 bp, Artificial Sequence
  chemically synthesized
atatacctgtttggtactta

SEQ ID NO: 109864 - DNA, 20 bp, Artificial Sequence
  chemically synthesized
tttttcctttaagtaccaaa

SEQ ID NO: 109865 - DNA, 20 bp, Artificial Sequence
  chemically synthesized
ttttcctttaagtaccaaac

SEQ ID NO: 109866 - DNA, 20 bp, Artificial Sequence
  chemically synthesized
tctaaattcatatacctgtt

SEQ ID NO: 109867 - DNA, 20 bp, Artificial Sequence
  chemically synthesized
accaaacaggtatatgaatt

SEQ ID NO: 109868 - DNA, 20 bp, Artificial Sequence
  chemically synthesized
atatgaatttagaatataaa

SEQ ID NO: 109869 - DNA, 20 bp, Artificial Sequence
  chemically synthesized
atgaatttagaatataaaaa

SEQ ID NO: 109870 - DNA, 20 bp, Artificial Sequence
  chemically synthesized
tgaatttagaatataaaaag

SEQ ID NO: 109871 - DNA, 20 bp, Artificial Sequence
  chemically synthesized
gaatttagaatataaaaaga

SEQ ID NO: 109872 - DNA, 20 bp, Artificial Sequence
  chemically synthesized
tataaaaagagggttgtgat

SEQ ID NO: 109873 - DNA, 20 bp, Artificial Sequence
  chemically synthesized
agttgatattttcttctcca

SEQ ID NO: 109874 - DNA, 20 bp, Artificial Sequence
  chemically synthesized
caaatatttaaactttggag

SEQ ID NO: 109875 - DNA, 20 bp, Artificial Sequence
  chemically synthesized
attcaaatatttaaactttg

SEQ ID NO: 109876 - DNA, 20 bp, Artificial Sequence
  chemically synthesized
ctattcaaatatttaaactt

SEQ ID NO: 109877 - DNA, 20 bp, Artificial Sequence
  chemically synthesized
ccaaagtttaaatatttgaa

SEQ ID NO: 109878 - DNA, 20 bp, Artificial Sequence
  chemically synthesized
taaatatttgaatagttcac

SEQ ID NO: 109879 - DNA, 20 bp, Artificial Sequence
  chemically synthesized
tttgaatagttcaccagctg

SEQ ID NO: 109880 - DNA, 20 bp, Artificial Sequence
  chemically synthesized
ccactatttaaagctacagc

SEQ ID NO: 109881 - DNA, 20 bp, Artificial Sequence
  chemically synthesized
tttcccactatttaaagcta

SEQ ID NO: 109882 - DNA, 20 bp, Artificial Sequence
  chemically synthesized
tcaccagctgtagctttaaa

SEQ ID NO: 109883 - DNA, 20 bp, Artificial Sequence
  chemically synthesized
ccagctgtagctttaaatag

SEQ ID NO: 109884 - DNA, 20 bp, Artificial Sequence
  chemically synthesized
gcattatttcccactattta

SEQ ID NO: 109885 - DNA, 20 bp, Artificial Sequence
  chemically synthesized
cagctgtagctttaaatagt

SEQ ID NO: 109886 - DNA, 20 bp, Artificial Sequence
  chemically synthesized
ttaaatagtgggaaataatg

SEQ ID NO: 109887 - DNA, 20 bp, Artificial Sequence
  chemically synthesized
atagtgggaaataatgcagc

SEQ ID NO: 109888 - DNA, 20 bp, Artificial Sequence
  chemically synthesized
gtgggaaataatgcagctag

SEQ ID NO: 109889 - DNA, 20 bp, Artificial Sequence
  chemically synthesized
ttttccctgtatggttcttc

SEQ ID NO: 109890 - DNA, 20 bp, Artificial Sequence
  chemically synthesized
atgcagctagaagaaccata

SEQ ID NO: 109891 - DNA, 20 bp, Artificial Sequence
  chemically synthesized
tgcagctagaagaaccatac

SEQ ID NO: 109892 - DNA, 20 bp, Artificial Sequence
  chemically synthesized
gcagctagaagaaccataca

SEQ ID NO: 109893 - DNA, 20 bp, Artificial Sequence
  chemically synthesized
actcactctttttccctgta

SEQ ID NO: 109894 - DNA, 20 bp, Artificial Sequence
  chemically synthesized
agaagaaccatacagggaaa

SEQ ID NO: 109895 - DNA, 20 bp, Artificial Sequence
  chemically synthesized
aagaaccatacagggaaaaa

SEQ ID NO: 109896 - DNA, 20 bp, Artificial Sequence
  chemically synthesized
accatacagggaaaaagagt

SEQ ID NO: 109897 - DNA, 20 bp, Artificial Sequence
  chemically synthesized
aagagtgagttgaaaattct

SEQ ID NO: 109898 - DNA, 20 bp, Artificial Sequence
  chemically synthesized
tgagttgaaaattctcagct

SEQ ID NO: 109899 - DNA, 20 bp, Artificial Sequence
  chemically synthesized
gttgaaaattctcagctcag

SEQ ID NO: 109900 - DNA, 20 bp, Artificial Sequence
  chemically synthesized
ttgatgataaccactgagct

SEQ ID NO: 109901 - DNA, 20 bp, Artificial Sequence
  chemically synthesized
caaacttgatgataaccact

SEQ ID NO: 109902 - DNA, 20 bp, Artificial Sequence
  chemically synthesized
tcagctcagtggttatcatc

SEQ ID NO: 109903 - DNA, 20 bp, Artificial Sequence
  chemically synthesized
tcagtggttatcatcaagtt

SEQ ID NO: 109904 - DNA, 20 bp, Artificial Sequence
  chemically synthesized
tcatcaagtttggttcctgt

SEQ ID NO: 109905 - DNA, 20 bp, Artificial Sequence
  chemically synthesized
tacagtcgctggaggctgac

SEQ ID NO: 109906 - DNA, 20 bp, Artificial Sequence
  chemically synthesized
ctacagtcgctggaggctga

SEQ ID NO: 109907 - DNA, 20 bp, Artificial Sequence
  chemically synthesized
gtttggttcctgtcagcctc

SEQ ID NO: 109908 - DNA, 20 bp, Artificial Sequence
  chemically synthesized
gcaccacctacagtcgctgg

SEQ ID NO: 109909 - DNA, 20 bp, Artificial Sequence
  chemically synthesized
agcaccacctacagtcgctg

SEQ ID NO: 109910 - DNA, 20 bp, Artificial Sequence
  chemically synthesized
ctgtcagcctccagcgactg

SEQ ID NO: 109911 - DNA, 20 bp, Artificial Sequence
  chemically synthesized
taagcaccacctacagtcgc

SEQ ID NO: 109912 - DNA, 20 bp, Artificial Sequence
  chemically synthesized
tgtcagcctccagcgactgt

SEQ ID NO: 109913 - DNA, 20 bp, Artificial Sequence
  chemically synthesized
cagcctccagcgactgtagg

SEQ ID NO: 109914 - DNA, 20 bp, Artificial Sequence
  chemically synthesized
atacctataagcaccaccta

SEQ ID NO: 109915 - DNA, 20 bp, Artificial Sequence
  chemically synthesized
gcgactgtaggtggtgctta

SEQ ID NO: 109916 - DNA, 20 bp, Artificial Sequence
  chemically synthesized
cgactgtaggtggtgcttat

SEQ ID NO: 109917 - DNA, 20 bp, Artificial Sequence
  chemically synthesized
ttttattgatgaatacctat

SEQ ID NO: 109918 - DNA, 20 bp, Artificial Sequence
  chemically synthesized
ttataggtattcatcaataa

SEQ ID NO: 109919 - DNA, 20 bp, Artificial Sequence
  chemically synthesized
tataggtattcatcaataaa

SEQ ID NO: 109920 - DNA, 20 bp, Artificial Sequence
  chemically synthesized
catcaataaaaggtgcattt

SEQ ID NO: 109921 - DNA, 20 bp, Artificial Sequence
  chemically synthesized
atcaataaaaggtgcatttg

SEQ ID NO: 109922 - DNA, 20 bp, Artificial Sequence
  chemically synthesized
tcaataaaaggtgcatttga

SEQ ID NO: 109923 - DNA, 20 bp, Artificial Sequence
  chemically synthesized
caataaaaggtgcatttgag

SEQ ID NO: 109924 - DNA, 20 bp, Artificial Sequence
  chemically synthesized
ggtgcatttgaggggatttc

SEQ ID NO: 109925 - DNA, 20 bp, Artificial Sequence
  chemically synthesized
tttcctccgaagcaaaatgc

SEQ ID NO: 109926 - DNA, 20 bp, Artificial Sequence
  chemically synthesized
ggatttccagcattttgctt

SEQ ID NO: 109927 - DNA, 20 bp, Artificial Sequence
  chemically synthesized
atttccagcattttgcttcg

SEQ ID NO: 109928 - DNA, 20 bp, Artificial Sequence
  chemically synthesized
tttccagcattttgcttcgg

SEQ ID NO: 109929 - DNA, 20 bp, Artificial Sequence
  chemically synthesized
gacataaatgatttcctccg

SEQ ID NO: 109930 - DNA, 20 bp, Artificial Sequence
  chemically synthesized
gaggaaatcatttatgtcaa

SEQ ID NO: 109931 - DNA, 20 bp, Artificial Sequence
  chemically synthesized
aattaagcaattgaaaacag

SEQ ID NO: 109932 - DNA, 20 bp, Artificial Sequence
  chemically synthesized
ctcaattaagcaattgaaaa

SEQ ID NO: 109933 - DNA, 20 bp, Artificial Sequence
  chemically synthesized
ctgttttcaattgcttaatt

SEQ ID NO: 109934 - DNA, 20 bp, Artificial Sequence
  chemically synthesized
acctcaatatatactcaatt

SEQ ID NO: 109935 - DNA, 20 bp, Artificial Sequence
  chemically synthesized
tgcttaattgagtatatatt

SEQ ID NO: 109936 - DNA, 20 bp, Artificial Sequence
  chemically synthesized
gcttaattgagtatatattg

SEQ ID NO: 109937 - DNA, 20 bp, Artificial Sequence
  chemically synthesized
attgagtatatattgaggtt

SEQ ID NO: 109938 - DNA, 20 bp, Artificial Sequence
  chemically synthesized
ttgagtatatattgaggtta

SEQ ID NO: 109939 - DNA, 20 bp, Artificial Sequence
  chemically synthesized
gtatatattgaggttaaggt

SEQ ID NO: 109940 - DNA, 20 bp, Artificial Sequence
  chemically synthesized
attgaggttaaggttagtga

SEQ ID NO: 109941 - DNA, 20 bp, Artificial Sequence
  chemically synthesized
gaggttaaggttagtgaaag

SEQ ID NO: 109942 - DNA, 20 bp, Artificial Sequence
  chemically synthesized
taaggttagtgaaagtggta

SEQ ID NO: 109943 - DNA, 20 bp, Artificial Sequence
  chemically synthesized
ggttagtgaaagtggtaaag

SEQ ID NO: 109944 - DNA, 20 bp, Artificial Sequence
  chemically synthesized
aatgaatacattgcttatta

SEQ ID NO: 109945 - DNA, 20 bp, Artificial Sequence
  chemically synthesized
taacatttcttgactgtaat

SEQ ID NO: 109946 - DNA, 20 bp, Artificial Sequence
  chemically synthesized
atacattgcttattacagtc

SEQ ID NO: 109947 - DNA, 20 bp, Artificial Sequence
  chemically synthesized
tacagtcaagaaatgttata

SEQ ID NO: 109948 - DNA, 20 bp, Artificial Sequence
  chemically synthesized
aagaaatgttatacagaaat

SEQ ID NO: 109949 - DNA, 20 bp, Artificial Sequence
  chemically synthesized
agaaaatgtacaaaccccac

SEQ ID NO: 109950 - DNA, 20 bp, Artificial Sequence
  chemically synthesized
ttccttatttatggctggtg

SEQ ID NO: 109951 - DNA, 20 bp, Artificial Sequence
  chemically synthesized
cttccttatttatggctggt

SEQ ID NO: 109952 - DNA, 20 bp, Artificial Sequence
  chemically synthesized
acttccttatttatggctgg

SEQ ID NO: 109953 - DNA, 20 bp, Artificial Sequence
  chemically synthesized
accacttccttatttatggc

SEQ ID NO: 109954 - DNA, 20 bp, Artificial Sequence
  chemically synthesized
aaaccccaccagccataaat

SEQ ID NO: 109955 - DNA, 20 bp, Artificial Sequence
  chemically synthesized
aaccccaccagccataaata

SEQ ID NO: 109956 - DNA, 20 bp, Artificial Sequence
  chemically synthesized
tctaaccacttccttattta

SEQ ID NO: 109957 - DNA, 20 bp, Artificial Sequence
  chemically synthesized
cccaccagccataaataagg

SEQ ID NO: 109958 - DNA, 20 bp, Artificial Sequence
  chemically synthesized
accagccataaataaggaag

SEQ ID NO: 109959 - DNA, 20 bp, Artificial Sequence
  chemically synthesized
gccataaataaggaagtggt

SEQ ID NO: 109960 - DNA, 20 bp, Artificial Sequence
  chemically synthesized
agtggttagaatgtcgctct

SEQ ID NO: 109961 - DNA, 20 bp, Artificial Sequence
  chemically synthesized
ttagaatgtcgctctcagcc

SEQ ID NO: 109962 - DNA, 20 bp, Artificial Sequence
  chemically synthesized
tagaatgtcgctctcagcca

SEQ ID NO: 109963 - DNA, 20 bp, Artificial Sequence
  chemically synthesized
gacttagggcccttggctga

SEQ ID NO: 109964 - DNA, 20 bp, Artificial Sequence
  chemically synthesized
agaatgtcgctctcagccaa

SEQ ID NO: 109965 - DNA, 20 bp, Artificial Sequence
  chemically synthesized
gggacttagggcccttggct

SEQ ID NO: 109966 - DNA, 20 bp, Artificial Sequence
  chemically synthesized
acaaagggacttagggccct

SEQ ID NO: 109967 - DNA, 20 bp, Artificial Sequence
  chemically synthesized
cgctctcagccaagggccct

SEQ ID NO: 109968 - DNA, 20 bp, Artificial Sequence
  chemically synthesized
aacctacacaaagggactta

SEQ ID NO: 109969 - DNA, 20 bp, Artificial Sequence
  chemically synthesized
aaacctacacaaagggactt

SEQ ID NO: 109970 - DNA, 20 bp, Artificial Sequence
  chemically synthesized
caaacctacacaaagggact

SEQ ID NO: 109971 - DNA, 20 bp, Artificial Sequence
  chemically synthesized
gggccctaagtccctttgtg

SEQ ID NO: 109972 - DNA, 20 bp, Artificial Sequence
  chemically synthesized
ggccctaagtccctttgtgt

SEQ ID NO: 109973 - DNA, 20 bp, Artificial Sequence
  chemically synthesized
tttttccaaacctacacaaa

SEQ ID NO: 109974 - DNA, 20 bp, Artificial Sequence
  chemically synthesized
atttttccaaacctacacaa

SEQ ID NO: 109975 - DNA, 20 bp, Artificial Sequence
  chemically synthesized
aatttttccaaacctacaca

SEQ ID NO: 109976 - DNA, 20 bp, Artificial Sequence
  chemically synthesized
taagtccctttgtgtaggtt

SEQ ID NO: 109977 - DNA, 20 bp, Artificial Sequence
  chemically synthesized
tggaaaaatttatgcctgtc

SEQ ID NO: 109978 - DNA, 20 bp, Artificial Sequence
  chemically synthesized
aaaaatttatgcctgtctag

SEQ ID NO: 109979 - DNA, 20 bp, Artificial Sequence
  chemically synthesized
acagctacaagctgctagac

SEQ ID NO: 109980 - DNA, 20 bp, Artificial Sequence
  chemically synthesized
cacagctacaagctgctaga

SEQ ID NO: 109981 - DNA, 20 bp, Artificial Sequence
  chemically synthesized
gctccacagctacaagctgc

SEQ ID NO: 109982 - DNA, 20 bp, Artificial Sequence
  chemically synthesized
tatgcctgtctagcagcttg

SEQ ID NO: 109983 - DNA, 20 bp, Artificial Sequence
  chemically synthesized
tgtctagcagcttgtagctg

SEQ ID NO: 109984 - DNA, 20 bp, Artificial Sequence
  chemically synthesized
caactctgctccacagctac

SEQ ID NO: 109985 - DNA, 20 bp, Artificial Sequence
  chemically synthesized
tctagcagcttgtagctgtg

SEQ ID NO: 109986 - DNA, 20 bp, Artificial Sequence
  chemically synthesized
agcagcttgtagctgtggag

SEQ ID NO: 109987 - DNA, 20 bp, Artificial Sequence
  chemically synthesized
cagcttgtagctgtggagca

SEQ ID NO: 109988 - DNA, 20 bp, Artificial Sequence
  chemically synthesized
ggtcagccaactctgctcca

SEQ ID NO: 109989 - DNA, 20 bp, Artificial Sequence
  chemically synthesized
ttgtagctgtggagcagagt

SEQ ID NO: 109990 - DNA, 20 bp, Artificial Sequence
  chemically synthesized
agaaggaatcaaagtttggt

SEQ ID NO: 109991 - DNA, 20 bp, Artificial Sequence
  chemically synthesized
tcagagaaggaatcaaagtt

SEQ ID NO: 109992 - DNA, 20 bp, Artificial Sequence
  chemically synthesized
catggtcagagaaggaatca

SEQ ID NO: 109993 - DNA, 20 bp, Artificial Sequence
  chemically synthesized
tagcagaacatggtcagaga

SEQ ID NO: 109994 - DNA, 20 bp, Artificial Sequence
  chemically synthesized
ctagcagaacatggtcagag

SEQ ID NO: 109995 - DNA, 20 bp, Artificial Sequence
  chemically synthesized
aggctagcagaacatggtca

SEQ ID NO: 109996 - DNA, 20 bp, Artificial Sequence
  chemically synthesized
taaggctagcagaacatggt

SEQ ID NO: 109997 - DNA, 20 bp, Artificial Sequence
  chemically synthesized
gacataaggctagcagaaca

SEQ ID NO: 109998 - DNA, 20 bp, Artificial Sequence
  chemically synthesized
cttctctgaccatgttctgc

SEQ ID NO: 109999 - DNA, 20 bp, Artificial Sequence
  chemically synthesized
actgaaggacataaggctag

SEQ ID NO: 110000 - DNA, 20 bp, Artificial Sequence
  chemically synthesized
tttactgaaggacataaggc

SEQ ID NO: 110001 - DNA, 20 bp, Artificial Sequence
  chemically synthesized
gtcatttactgaaggacata

SEQ ID NO: 110002 - DNA, 20 bp, Artificial Sequence
  chemically synthesized
tgtcatttactgaaggacat

SEQ ID NO: 110003 - DNA, 20 bp, Artificial Sequence
  chemically synthesized
tctgctagccttatgtcctt

SEQ ID NO: 110004 - DNA, 20 bp, Artificial Sequence
  chemically synthesized
tggcaactgtcatttactga

SEQ ID NO: 110005 - DNA, 20 bp, Artificial Sequence
  chemically synthesized
atggcaactgtcatttactg

SEQ ID NO: 110006 - DNA, 20 bp, Artificial Sequence
  chemically synthesized
ttatgtccttcagtaaatga

SEQ ID NO: 110007 - DNA, 20 bp, Artificial Sequence
  chemically synthesized
aacaacctcattgtttttta

SEQ ID NO: 110008 - DNA, 20 bp, Artificial Sequence
  chemically synthesized
cagttgccataaaaaacaat

SEQ ID NO: 110009 - DNA, 20 bp, Artificial Sequence
  chemically synthesized
agttgccataaaaaacaatg

SEQ ID NO: 110010 - DNA, 20 bp, Artificial Sequence
  chemically synthesized
tcaaagtagtgggaatgatg

SEQ ID NO: 110011 - DNA, 20 bp, Artificial Sequence
  chemically synthesized
tctcaaagtagtgggaatga

SEQ ID NO: 110012 - DNA, 20 bp, Artificial Sequence
  chemically synthesized
tgttaagatctcaaagtagt

SEQ ID NO: 110013 - DNA, 20 bp, Artificial Sequence
  chemically synthesized
tccatcattcccactacttt

SEQ ID NO: 110014 - DNA, 20 bp, Artificial Sequence
  chemically synthesized
ttgttaagatctcaaagtag

SEQ ID NO: 110015 - DNA, 20 bp, Artificial Sequence
  chemically synthesized
atcttgttaagatctcaaag

SEQ ID NO: 110016 - DNA, 20 bp, Artificial Sequence
  chemically synthesized
gtgatcttgttaagatctca

SEQ ID NO: 110017 - DNA, 20 bp, Artificial Sequence
  chemically synthesized
cactactttgagatcttaac

SEQ ID NO: 110018 - DNA, 20 bp, Artificial Sequence
  chemically synthesized
gatggttatgtgatcttgtt

SEQ ID NO: 110019 - DNA, 20 bp, Artificial Sequence
  chemically synthesized
tctgtgtcttcaagttcaga

SEQ ID NO: 110020 - DNA, 20 bp, Artificial Sequence
  chemically synthesized
cacataaccatctgaacttg

SEQ ID NO: 110021 - DNA, 20 bp, Artificial Sequence
  chemically synthesized
tcagtctgtgtcttcaagtt

SEQ ID NO: 110022 - DNA, 20 bp, Artificial Sequence
  chemically synthesized
accatctgaacttgaagaca

SEQ ID NO: 110023 - DNA, 20 bp, Artificial Sequence
  chemically synthesized
tgaattcagtctgtgtcttc

SEQ ID NO: 110024 - DNA, 20 bp, Artificial Sequence
  chemically synthesized
tagcctgaattatttgaatt

SEQ ID NO: 110025 - DNA, 20 bp, Artificial Sequence
  chemically synthesized
cagactgaattcaaataatt

SEQ ID NO: 110026 - DNA, 20 bp, Artificial Sequence
  chemically synthesized
agactgaattcaaataattc

SEQ ID NO: 110027 - DNA, 20 bp, Artificial Sequence
  chemically synthesized
gaattcaaataattcaggct

SEQ ID NO: 110028 - DNA, 20 bp, Artificial Sequence
  chemically synthesized
taggttatcagcacatgtct

SEQ ID NO: 110029 - DNA, 20 bp, Artificial Sequence
  chemically synthesized
aagacatgtgctgataacct

SEQ ID NO: 110030 - DNA, 20 bp, Artificial Sequence
  chemically synthesized
aataatttttcttaggttat

SEQ ID NO: 110031 - DNA, 20 bp, Artificial Sequence
  chemically synthesized
gtctagcaataatttttctt

SEQ ID NO: 110032 - DNA, 20 bp, Artificial Sequence
  chemically synthesized
agtctagcaataatttttct

SEQ ID NO: 110033 - DNA, 20 bp, Artificial Sequence
  chemically synthesized
aacctaagaaaaattattgc

SEQ ID NO: 110034 - DNA, 20 bp, Artificial Sequence
  chemically synthesized
tagtatttattttaggagtc

SEQ ID NO: 110035 - DNA, 20 bp, Artificial Sequence
  chemically synthesized
tctcatagtatttattttag

SEQ ID NO: 110036 - DNA, 20 bp, Artificial Sequence
  chemically synthesized
tttctcatagtatttatttt

SEQ ID NO: 110037 - DNA, 20 bp, Artificial Sequence
  chemically synthesized
ctttctcatagtatttattt

SEQ ID NO: 110038 - DNA, 20 bp, Artificial Sequence
  chemically synthesized
actcctaaaataaatactat

SEQ ID NO: 110039 - DNA, 20 bp, Artificial Sequence
  chemically synthesized
ctaaaataaatactatgaga

SEQ ID NO: 110040 - DNA, 20 bp, Artificial Sequence
  chemically synthesized
aaaataaatactatgagaaa

SEQ ID NO: 110041 - DNA, 20 bp, Artificial Sequence
  chemically synthesized
tgaaagtggcctctttctca

SEQ ID NO: 110042 - DNA, 20 bp, Artificial Sequence
  chemically synthesized
aaataaatactatgagaaag

SEQ ID NO: 110043 - DNA, 20 bp, Artificial Sequence
  chemically synthesized
gctaaaaatatgtgtgaaag

SEQ ID NO: 110044 - DNA, 20 bp, Artificial Sequence
  chemically synthesized
caagctaaaaatatgtgtga

SEQ ID NO: 110045 - DNA, 20 bp, Artificial Sequence
  chemically synthesized
gccactttcacacatatttt

SEQ ID NO: 110046 - DNA, 20 bp, Artificial Sequence
  chemically synthesized
tgatgcagatacacattttc

SEQ ID NO: 110047 - DNA, 20 bp, Artificial Sequence
  chemically synthesized
gttttttttaacaattgatg

SEQ ID NO: 110048 - DNA, 20 bp, Artificial Sequence
  chemically synthesized
gttaaaaaaaaccttttttt

SEQ ID NO: 110049 - DNA, 20 bp, Artificial Sequence
  chemically synthesized
ttcccatttatccaaaaaaa

SEQ ID NO: 110050 - DNA, 20 bp, Artificial Sequence
  chemically synthesized
tttcccatttatccaaaaaa

SEQ ID NO: 110051 - DNA, 20 bp, Artificial Sequence
  chemically synthesized
aaaccttttttttggataaa

SEQ ID NO: 110052 - DNA, 20 bp, Artificial Sequence
  chemically synthesized
aaccttttttttggataaat

SEQ ID NO: 110053 - DNA, 20 bp, Artificial Sequence
  chemically synthesized
ttttttttggataaatggga

SEQ ID NO: 110054 - DNA, 20 bp, Artificial Sequence
  chemically synthesized
aataaattcaattttatttt

SEQ ID NO: 110055 - DNA, 20 bp, Artificial Sequence
  chemically synthesized
ataaattcaattttattttt

SEQ ID NO: 110056 - DNA, 20 bp, Artificial Sequence
  chemically synthesized
ttttatttttaggacatgaa

SEQ ID NO: 110057 - DNA, 20 bp, Artificial Sequence
  chemically synthesized
catgaatggatgataatttg

SEQ ID NO: 110058 - DNA, 20 bp, Artificial Sequence
  chemically synthesized
atgaatggatgataatttgt

SEQ ID NO: 110059 - DNA, 20 bp, Artificial Sequence
  chemically synthesized
gataatttgtgggcacaaaa

SEQ ID NO: 110060 - DNA, 20 bp, Artificial Sequence
  chemically synthesized
acaaaaaagaataatttgct

SEQ ID NO: 110061 - DNA, 20 bp, Artificial Sequence
  chemically synthesized
aagaataatttgctaagctt

SEQ ID NO: 110062 - DNA, 20 bp, Artificial Sequence
  chemically synthesized
attacactgctactaaagct

SEQ ID NO: 110063 - DNA, 20 bp, Artificial Sequence
  chemically synthesized
aataatttgctaagctttag

SEQ ID NO: 110064 - DNA, 20 bp, Artificial Sequence
  chemically synthesized
aatttgctaagctttagtag

SEQ ID NO: 110065 - DNA, 20 bp, Artificial Sequence
  chemically synthesized
aatgtattacactgctacta

SEQ ID NO: 110066 - DNA, 20 bp, Artificial Sequence
  chemically synthesized
tcatttagagcaagagatac

SEQ ID NO: 110067 - DNA, 20 bp, Artificial Sequence
  chemically synthesized
ttcatttagagcaagagata

SEQ ID NO: 110068 - DNA, 20 bp, Artificial Sequence
  chemically synthesized
aattgattcatttagagcaa

SEQ ID NO: 110069 - DNA, 20 bp, Artificial Sequence
  chemically synthesized
aaaattgattcatttagagc

SEQ ID NO: 110070 - DNA, 20 bp, Artificial Sequence
  chemically synthesized
atttaaaattgattcattta

SEQ ID NO: 110071 - DNA, 20 bp, Artificial Sequence
  chemically synthesized
atatttaaaattgattcatt

SEQ ID NO: 110072 - DNA, 20 bp, Artificial Sequence
  chemically synthesized
atgaattgaatgtatcaatt

SEQ ID NO: 110073 - DNA, 20 bp, Artificial Sequence
  chemically synthesized
atcaattgagatcttaaaat

SEQ ID NO: 110074 - DNA, 20 bp, Artificial Sequence
  chemically synthesized
ccacattcattgctcatttt

SEQ ID NO: 110075 - DNA, 20 bp, Artificial Sequence
  chemically synthesized
cttaaaatgagcaatgaatg

SEQ ID NO: 110076 - DNA, 20 bp, Artificial Sequence
  chemically synthesized
agcaatgaatgtggtaatac

SEQ ID NO: 110077 - DNA, 20 bp, Artificial Sequence
  chemically synthesized
gcaatgaatgtggtaatacc

SEQ ID NO: 110078 - DNA, 20 bp, Artificial Sequence
  chemically synthesized
gaatgtggtaataccaggta

SEQ ID NO: 110079 - DNA, 20 bp, Artificial Sequence
  chemically synthesized
acacataaattatctgtacc

SEQ ID NO: 110080 - DNA, 20 bp, Artificial Sequence
  chemically synthesized
catgcttttctaaataatat

SEQ ID NO: 110081 - DNA, 20 bp, Artificial Sequence
  chemically synthesized
ttatgtgttctaatattatt

SEQ ID NO: 110082 - DNA, 20 bp, Artificial Sequence
  chemically synthesized
tgttctaatattatttagaa

SEQ ID NO: 110083 - DNA, 20 bp, Artificial Sequence
  chemically synthesized
tatttagaaaagcatgccat

SEQ ID NO: 110084 - DNA, 20 bp, Artificial Sequence
  chemically synthesized
ttttagctaagaacagctta

SEQ ID NO: 110085 - DNA, 20 bp, Artificial Sequence
  chemically synthesized
agcatgccataagctgttct

SEQ ID NO: 110086 - DNA, 20 bp, Artificial Sequence
  chemically synthesized
atggtggttttagctaagaa

SEQ ID NO: 110087 - DNA, 20 bp, Artificial Sequence
  chemically synthesized
caattatggtggttttagct

SEQ ID NO: 110088 - DNA, 20 bp, Artificial Sequence
  chemically synthesized
tttctcaattatggtggttt

SEQ ID NO: 110089 - DNA, 20 bp, Artificial Sequence
  chemically synthesized
tatttctttctcaattatgg

SEQ ID NO: 110090 - DNA, 20 bp, Artificial Sequence
  chemically synthesized
tagctaaaaccaccataatt

SEQ ID NO: 110091 - DNA, 20 bp, Artificial Sequence
  chemically synthesized
aagtatttctttctcaatta

SEQ ID NO: 110092 - DNA, 20 bp, Artificial Sequence
  chemically synthesized
taaaaccaccataattgaga

SEQ ID NO: 110093 - DNA, 20 bp, Artificial Sequence
  chemically synthesized
taattgagaaagaaatactt

SEQ ID NO: 110094 - DNA, 20 bp, Artificial Sequence
  chemically synthesized
ttgagaaagaaatacttgag

SEQ ID NO: 110095 - DNA, 20 bp, Artificial Sequence
  chemically synthesized
gagaaagaaatacttgagaa

SEQ ID NO: 110096 - DNA, 20 bp, Artificial Sequence
  chemically synthesized
agaatatctaatctcttctc

SEQ ID NO: 110097 - DNA, 20 bp, Artificial Sequence
  chemically synthesized
agaaatacttgagaagagat

SEQ ID NO: 110098 - DNA, 20 bp, Artificial Sequence
  chemically synthesized
agagattagatattctctac

SEQ ID NO: 110099 - DNA, 20 bp, Artificial Sequence
  chemically synthesized
actgctccattcaactagta

SEQ ID NO: 110100 - DNA, 20 bp, Artificial Sequence
  chemically synthesized
tcactgctccattcaactag

SEQ ID NO: 110101 - DNA, 20 bp, Artificial Sequence
  chemically synthesized
gatattctctactagttgaa

SEQ ID NO: 110102 - DNA, 20 bp, Artificial Sequence
  chemically synthesized
ttttcactgctccattcaac

SEQ ID NO: 110103 - DNA, 20 bp, Artificial Sequence
  chemically synthesized
tattctctactagttgaatg

SEQ ID NO: 110104 - DNA, 20 bp, Artificial Sequence
  chemically synthesized
tctctactagttgaatggag

SEQ ID NO: 110105 - DNA, 20 bp, Artificial Sequence
  chemically synthesized
tagttgaatggagcagtgaa

SEQ ID NO: 110106 - DNA, 20 bp, Artificial Sequence
  chemically synthesized
ttgaatggagcagtgaaaag

SEQ ID NO: 110107 - DNA, 20 bp, Artificial Sequence
  chemically synthesized
gagcagtgaaaagtagattt

SEQ ID NO: 110108 - DNA, 20 bp, Artificial Sequence
  chemically synthesized
aaaagtagattttggtgtcg

SEQ ID NO: 110109 - DNA, 20 bp, Artificial Sequence
  chemically synthesized
ggtgtcgtggttttatgaaa

SEQ ID NO: 110110 - DNA, 20 bp, Artificial Sequence
  chemically synthesized
gttttatgaaaaagaaacat

SEQ ID NO: 110111 - DNA, 20 bp, Artificial Sequence
  chemically synthesized
aaaagaaacatcagaaaata

SEQ ID NO: 110112 - DNA, 20 bp, Artificial Sequence
  chemically synthesized
tttgtttaatggaaatgatt

SEQ ID NO: 110113 - DNA, 20 bp, Artificial Sequence
  chemically synthesized
tgttttttgtttttgtttaa

SEQ ID NO: 110114 - DNA, 20 bp, Artificial Sequence
  chemically synthesized
cattaaacaaaaacaaaaaa

SEQ ID NO: 110115 - DNA, 20 bp, Artificial Sequence
  chemically synthesized
ttaaacaaaaacaaaaaaca

SEQ ID NO: 110116 - DNA, 20 bp, Artificial Sequence
  chemically synthesized
aaaacaaaaaacagagtttt

SEQ ID NO: 110117 - DNA, 20 bp, Artificial Sequence
  chemically synthesized
aaaaaacagagtttttggta

SEQ ID NO: 110118 - DNA, 20 bp, Artificial Sequence
  chemically synthesized
acagagtttttggtatggct

SEQ ID NO: 110119 - DNA, 20 bp, Artificial Sequence
  chemically synthesized
tgtggggtggggacacagcc

SEQ ID NO: 110120 - DNA, 20 bp, Artificial Sequence
  chemically synthesized
gagattgtggggtggggaca

SEQ ID NO: 110121 - DNA, 20 bp, Artificial Sequence
  chemically synthesized
taagatgagattgtggggtg

SEQ ID NO: 110122 - DNA, 20 bp, Artificial Sequence
  chemically synthesized
ttaagatgagattgtggggt

SEQ ID NO: 110123 - DNA, 20 bp, Artificial Sequence
  chemically synthesized
tttaagatgagattgtgggg

SEQ ID NO: 110124 - DNA, 20 bp, Artificial Sequence
  chemically synthesized
caatttaagatgagattgtg

SEQ ID NO: 110125 - DNA, 20 bp, Artificial Sequence
  chemically synthesized
acaatttaagatgagattgt

SEQ ID NO: 110126 - DNA, 20 bp, Artificial Sequence
  chemically synthesized
tacaatttaagatgagattg

SEQ ID NO: 110127 - DNA, 20 bp, Artificial Sequence
  chemically synthesized
tggggattacaatttaagat

SEQ ID NO: 110128 - DNA, 20 bp, Artificial Sequence
  chemically synthesized
ggttatggggattacaattt

SEQ ID NO: 110129 - DNA, 20 bp, Artificial Sequence
  chemically synthesized
tggggattatggaggttatg

SEQ ID NO: 110130 - DNA, 20 bp, Artificial Sequence
  chemically synthesized
gtggggattatggaggttat

SEQ ID NO: 110131 - DNA, 20 bp, Artificial Sequence
  chemically synthesized
cgtggggattatggaggtta

SEQ ID NO: 110132 - DNA, 20 bp, Artificial Sequence
  chemically synthesized
ttgacacgtggggattatgg

SEQ ID NO: 110133 - DNA, 20 bp, Artificial Sequence
  chemically synthesized
cttgacacgtggggattatg

SEQ ID NO: 110134 - DNA, 20 bp, Artificial Sequence
  chemically synthesized
cccttgacacgtggggatta

SEQ ID NO: 110135 - DNA, 20 bp, Artificial Sequence
  chemically synthesized
ggtctctcccttgacacgtg

SEQ ID NO: 110136 - DNA, 20 bp, Artificial Sequence
  chemically synthesized
ctccataatccccacgtgtc

SEQ ID NO: 110137 - DNA, 20 bp, Artificial Sequence
  chemically synthesized
tggtctctcccttgacacgt

SEQ ID NO: 110138 - DNA, 20 bp, Artificial Sequence
  chemically synthesized
tccataatccccacgtgtca

SEQ ID NO: 110139 - DNA, 20 bp, Artificial Sequence
  chemically synthesized
ctggtctctcccttgacacg

SEQ ID NO: 110140 - DNA, 20 bp, Artificial Sequence
  chemically synthesized
ccataatccccacgtgtcaa

SEQ ID NO: 110141 - DNA, 20 bp, Artificial Sequence
  chemically synthesized
ataatccccacgtgtcaagg

SEQ ID NO: 110142 - DNA, 20 bp, Artificial Sequence
  chemically synthesized
aatccccacgtgtcaaggga

SEQ ID NO: 110143 - DNA, 20 bp, Artificial Sequence
  chemically synthesized
ccacgtgtcaagggagagac

SEQ ID NO: 110144 - DNA, 20 bp, Artificial Sequence
  chemically synthesized
cacgtgtcaagggagagacc

SEQ ID NO: 110145 - DNA, 20 bp, Artificial Sequence
  chemically synthesized
gtgtcaagggagagaccagg

SEQ ID NO: 110146 - DNA, 20 bp, Artificial Sequence
  chemically synthesized
gtcaagggagagaccaggtg

SEQ ID NO: 110147 - DNA, 20 bp, Artificial Sequence
  chemically synthesized
tcaagggagagaccaggtgg

SEQ ID NO: 110148 - DNA, 20 bp, Artificial Sequence
  chemically synthesized
atgattccattacctccacc

SEQ ID NO: 110149 - DNA, 20 bp, Artificial Sequence
  chemically synthesized
gagagaccaggtggaggtaa

SEQ ID NO: 110150 - DNA, 20 bp, Artificial Sequence
  chemically synthesized
ggtggaggtaatggaatcat

SEQ ID NO: 110151 - DNA, 20 bp, Artificial Sequence
  chemically synthesized
gtggaggtaatggaatcata

SEQ ID NO: 110152 - DNA, 20 bp, Artificial Sequence
  chemically synthesized
tggaggtaatggaatcataa

SEQ ID NO: 110153 - DNA, 20 bp, Artificial Sequence
  chemically synthesized
aggtaatggaatcataaggg

SEQ ID NO: 110154 - DNA, 20 bp, Artificial Sequence
  chemically synthesized
ctatcatgagaacagcatgg

SEQ ID NO: 110155 - DNA, 20 bp, Artificial Sequence
  chemically synthesized
cgctatcatgagaacagcat

SEQ ID NO: 110156 - DNA, 20 bp, Artificial Sequence
  chemically synthesized
ccgctatcatgagaacagca

SEQ ID NO: 110157 - DNA, 20 bp, Artificial Sequence
  chemically synthesized
agatcccgctatcatgagaa

SEQ ID NO: 110158 - DNA, 20 bp, Artificial Sequence
  chemically synthesized
ctcccatgctgttctcatga

SEQ ID NO: 110159 - DNA, 20 bp, Artificial Sequence
  chemically synthesized
ccatgctgttctcatgatag

SEQ ID NO: 110160 - DNA, 20 bp, Artificial Sequence
  chemically synthesized
ccatcagatcccgctatcat

SEQ ID NO: 110161 - DNA, 20 bp, Artificial Sequence
  chemically synthesized
catgctgttctcatgatagc

SEQ ID NO: 110162 - DNA, 20 bp, Artificial Sequence
  chemically synthesized
ctcatgatagcgggatctga

SEQ ID NO: 110163 - DNA, 20 bp, Artificial Sequence
  chemically synthesized
agagccccttataaaaccat

SEQ ID NO: 110164 - DNA, 20 bp, Artificial Sequence
  chemically synthesized
gcgggatctgatggttttat

SEQ ID NO: 110165 - DNA, 20 bp, Artificial Sequence
  chemically synthesized
cgggatctgatggttttata

SEQ ID NO: 110166 - DNA, 20 bp, Artificial Sequence
  chemically synthesized
gggatctgatggttttataa

SEQ ID NO: 110167 - DNA, 20 bp, Artificial Sequence
  chemically synthesized
ggatctgatggttttataag

SEQ ID NO: 110168 - DNA, 20 bp, Artificial Sequence
  chemically synthesized
agcgcccagcgaagtaggaa

SEQ ID NO: 110169 - DNA, 20 bp, Artificial Sequence
  chemically synthesized
gaagcgcccagcgaagtagg

SEQ ID NO: 110170 - DNA, 20 bp, Artificial Sequence
  chemically synthesized
aggggctcttcctacttcgc

SEQ ID NO: 110171 - DNA, 20 bp, Artificial Sequence
  chemically synthesized
ggagaagcgcccagcgaagt

SEQ ID NO: 110172 - DNA, 20 bp, Artificial Sequence
  chemically synthesized
ggggctcttcctacttcgct

SEQ ID NO: 110173 - DNA, 20 bp, Artificial Sequence
  chemically synthesized
aggagaagcgcccagcgaag

SEQ ID NO: 110174 - DNA, 20 bp, Artificial Sequence
  chemically synthesized
ggaaggagaagcgcccagcg

SEQ ID NO: 110175 - DNA, 20 bp, Artificial Sequence
  chemically synthesized
ccgcaggaaggagaagcgcc

SEQ ID NO: 110176 - DNA, 20 bp, Artificial Sequence
  chemically synthesized
cacaaggccgcaggaaggag

SEQ ID NO: 110177 - DNA, 20 bp, Artificial Sequence
  chemically synthesized
ctgggcgcttctccttcctg

SEQ ID NO: 110178 - DNA, 20 bp, Artificial Sequence
  chemically synthesized
cttcacaaggccgcaggaag

SEQ ID NO: 110179 - DNA, 20 bp, Artificial Sequence
  chemically synthesized
ttcttcacaaggccgcagga

SEQ ID NO: 110180 - DNA, 20 bp, Artificial Sequence
  chemically synthesized
cttcttcacaaggccgcagg

SEQ ID NO: 110181 - DNA, 20 bp, Artificial Sequence
  chemically synthesized
catcttcttcacaaggccgc

SEQ ID NO: 110182 - DNA, 20 bp, Artificial Sequence
  chemically synthesized
gcatcttcttcacaaggccg

SEQ ID NO: 110183 - DNA, 20 bp, Artificial Sequence
  chemically synthesized
ctccttcctgcggccttgtg

SEQ ID NO: 110184 - DNA, 20 bp, Artificial Sequence
  chemically synthesized
cttcctgcggccttgtgaag

SEQ ID NO: 110185 - DNA, 20 bp, Artificial Sequence
  chemically synthesized
aagcaagcatcttcttcaca

SEQ ID NO: 110186 - DNA, 20 bp, Artificial Sequence
  chemically synthesized
gaagcaagcatcttcttcac

SEQ ID NO: 110187 - DNA, 20 bp, Artificial Sequence
  chemically synthesized
gcagaaggtgaaggggaagc

SEQ ID NO: 110188 - DNA, 20 bp, Artificial Sequence
  chemically synthesized
catggcagaaggtgaagggg

SEQ ID NO: 110189 - DNA, 20 bp, Artificial Sequence
  chemically synthesized
aatcatggcagaaggtgaag

SEQ ID NO: 110190 - DNA, 20 bp, Artificial Sequence
  chemically synthesized
caatcatggcagaaggtgaa

SEQ ID NO: 110191 - DNA, 20 bp, Artificial Sequence
  chemically synthesized
acaatcatggcagaaggtga

SEQ ID NO: 110192 - DNA, 20 bp, Artificial Sequence
  chemically synthesized
tacaatcatggcagaaggtg

SEQ ID NO: 110193 - DNA, 20 bp, Artificial Sequence
  chemically synthesized
aaacttacaatcatggcaga

SEQ ID NO: 110194 - DNA, 20 bp, Artificial Sequence
  chemically synthesized
gaaacttacaatcatggcag

SEQ ID NO: 110195 - DNA, 20 bp, Artificial Sequence
  chemically synthesized
caggaaacttacaatcatgg

SEQ ID NO: 110196 - DNA, 20 bp, Artificial Sequence
  chemically synthesized
tcaccttctgccatgattgt

SEQ ID NO: 110197 - DNA, 20 bp, Artificial Sequence
  chemically synthesized
cctcaggaaacttacaatca

SEQ ID NO: 110198 - DNA, 20 bp, Artificial Sequence
  chemically synthesized
gccatgattgtaagtttcct

SEQ ID NO: 110199 - DNA, 20 bp, Artificial Sequence
  chemically synthesized
ccatgattgtaagtttcctg

SEQ ID NO: 110200 - DNA, 20 bp, Artificial Sequence
  chemically synthesized
cacatggctgggtaggcctc

SEQ ID NO: 110201 - DNA, 20 bp, Artificial Sequence
  chemically synthesized
ccacatggctgggtaggcct

SEQ ID NO: 110202 - DNA, 20 bp, Artificial Sequence
  chemically synthesized
taagtttcctgaggcctacc

SEQ ID NO: 110203 - DNA, 20 bp, Artificial Sequence
  chemically synthesized
acagttccacatggctgggt

SEQ ID NO: 110204 - DNA, 20 bp, Artificial Sequence
  chemically synthesized
cacagttccacatggctggg

SEQ ID NO: 110205 - DNA, 20 bp, Artificial Sequence
  chemically synthesized
ctgaggcctacccagccatg

SEQ ID NO: 110206 - DNA, 20 bp, Artificial Sequence
  chemically synthesized
actcacagttccacatggct

SEQ ID NO: 110207 - DNA, 20 bp, Artificial Sequence
  chemically synthesized
gactcacagttccacatggc

SEQ ID NO: 110208 - DNA, 20 bp, Artificial Sequence
  chemically synthesized
aattgactcacagttccaca

SEQ ID NO: 110209 - DNA, 20 bp, Artificial Sequence
  chemically synthesized
acccagccatgtggaactgt

SEQ ID NO: 110210 - DNA, 20 bp, Artificial Sequence
  chemically synthesized
aaagaggtttaattgactca

SEQ ID NO: 110211 - DNA, 20 bp, Artificial Sequence
  chemically synthesized
gggtaatttctaaaggaaag

SEQ ID NO: 110212 - DNA, 20 bp, Artificial Sequence
  chemically synthesized
tcaattaaacctctttcctt

SEQ ID NO: 110213 - DNA, 20 bp, Artificial Sequence
  chemically synthesized
tgggtaatttctaaaggaaa

SEQ ID NO: 110214 - DNA, 20 bp, Artificial Sequence
  chemically synthesized
actgggtaatttctaaagga

SEQ ID NO: 110215 - DNA, 20 bp, Artificial Sequence
  chemically synthesized
cgagactgggtaatttctaa

SEQ ID NO: 110216 - DNA, 20 bp, Artificial Sequence
  chemically synthesized
ccgagactgggtaatttcta

SEQ ID NO: 110217 - DNA, 20 bp, Artificial Sequence
  chemically synthesized
tctttcctttagaaattacc

SEQ ID NO: 110218 - DNA, 20 bp, Artificial Sequence
  chemically synthesized
ctttagaaattacccagtct

SEQ ID NO: 110219 - DNA, 20 bp, Artificial Sequence
  chemically synthesized
tttagaaattacccagtctc

SEQ ID NO: 110220 - DNA, 20 bp, Artificial Sequence
  chemically synthesized
ataaagaactgcccgagact

SEQ ID NO: 110221 - DNA, 20 bp, Artificial Sequence
  chemically synthesized
tataaagaactgcccgagac

SEQ ID NO: 110222 - DNA, 20 bp, Artificial Sequence
  chemically synthesized
agaaattacccagtctcggg

SEQ ID NO: 110223 - DNA, 20 bp, Artificial Sequence
  chemically synthesized
actgctataaagaactgccc

SEQ ID NO: 110224 - DNA, 20 bp, Artificial Sequence
  chemically synthesized
cagtctcgggcagttcttta

SEQ ID NO: 110225 - DNA, 20 bp, Artificial Sequence
  chemically synthesized
tctcgggcagttctttatag

SEQ ID NO: 110226 - DNA, 20 bp, Artificial Sequence
  chemically synthesized
tccattttcatactgctata

SEQ ID NO: 110227 - DNA, 20 bp, Artificial Sequence
  chemically synthesized
tctttatagcagtatgaaaa

SEQ ID NO: 110228 - DNA, 20 bp, Artificial Sequence
  chemically synthesized
agtatgaaaatggactaata

SEQ ID NO: 110229 - DNA, 20 bp, Artificial Sequence
  chemically synthesized
atgaaaatggactaatacag

SEQ ID NO: 110230 - DNA, 20 bp, Artificial Sequence
  chemically synthesized
cttaaacaaagctactgtat

SEQ ID NO: 110231 - DNA, 20 bp, Artificial Sequence
  chemically synthesized
ctaatacagtagctttgttt

SEQ ID NO: 110232 - DNA, 20 bp, Artificial Sequence
  chemically synthesized
gtacttatgttgcttaaaca

SEQ ID NO: 110233 - DNA, 20 bp, Artificial Sequence
  chemically synthesized
tagctttgtttaagcaacat

SEQ ID NO: 110234 - DNA, 20 bp, Artificial Sequence
  chemically synthesized
ttatatttgaatattcattt

SEQ ID NO: 110235 - DNA, 20 bp, Artificial Sequence
  chemically synthesized
atattcaaatataaatcata

SEQ ID NO: 110236 - DNA, 20 bp, Artificial Sequence
  chemically synthesized
tattcaaatataaatcatat

SEQ ID NO: 110237 - DNA, 20 bp, Artificial Sequence
  chemically synthesized
tcaaatataaatcatatagg

SEQ ID NO: 110238 - DNA, 20 bp, Artificial Sequence
  chemically synthesized
agaaccccatttcataagat

SEQ ID NO: 110239 - DNA, 20 bp, Artificial Sequence
  chemically synthesized
gataaactgatcttatgaaa

SEQ ID NO: 110240 - DNA, 20 bp, Artificial Sequence
  chemically synthesized
ataaactgatcttatgaaat

SEQ ID NO: 110241 - DNA, 20 bp, Artificial Sequence
  chemically synthesized
atgacagaaccccatttcat

SEQ ID NO: 110242 - DNA, 20 bp, Artificial Sequence
  chemically synthesized
taaactgatcttatgaaatg

SEQ ID NO: 110243 - DNA, 20 bp, Artificial Sequence
  chemically synthesized
tatgaaatggggttctgtca

SEQ ID NO: 110244 - DNA, 20 bp, Artificial Sequence
  chemically synthesized
attgtaaccaaaaactatga

SEQ ID NO: 110245 - DNA, 20 bp, Artificial Sequence
  chemically synthesized
tggggttctgtcatagtttt

SEQ ID NO: 110246 - DNA, 20 bp, Artificial Sequence
  chemically synthesized
gtacaatgttattgattact

SEQ ID NO: 110247 - DNA, 20 bp, Artificial Sequence
  chemically synthesized
aatgttattgattactgagt

SEQ ID NO: 110248 - DNA, 20 bp, Artificial Sequence
  chemically synthesized
agaagtcctcttagctaact

SEQ ID NO: 110249 - DNA, 20 bp, Artificial Sequence
  chemically synthesized
tattgattactgagttagct

SEQ ID NO: 110250 - DNA, 20 bp, Artificial Sequence
  chemically synthesized
ttgattactgagttagctaa

SEQ ID NO: 110251 - DNA, 20 bp, Artificial Sequence
  chemically synthesized
tgattactgagttagctaag

SEQ ID NO: 110252 - DNA, 20 bp, Artificial Sequence
  chemically synthesized
tataacaggagaagtcctct

SEQ ID NO: 110253 - DNA, 20 bp, Artificial Sequence
  chemically synthesized
gtataatattataacaggag

SEQ ID NO: 110254 - DNA, 20 bp, Artificial Sequence
  chemically synthesized
tatgtataatattataacag

SEQ ID NO: 110255 - DNA, 20 bp, Artificial Sequence
  chemically synthesized
attatgtataatattataac

SEQ ID NO: 110256 - DNA, 20 bp, Artificial Sequence
  chemically synthesized
tattatgtataatattataa

SEQ ID NO: 110257 - DNA, 20 bp, Artificial Sequence
  chemically synthesized
ttatacataatatcacaaca

SEQ ID NO: 110258 - DNA, 20 bp, Artificial Sequence
  chemically synthesized
gttactttattttataacga

SEQ ID NO: 110259 - DNA, 20 bp, Artificial Sequence
  chemically synthesized
gttgctttcgttataaaata

SEQ ID NO: 110260 - DNA, 20 bp, Artificial Sequence
  chemically synthesized
gtaacatgtacattctatct

SEQ ID NO: 110261 - DNA, 20 bp, Artificial Sequence
  chemically synthesized
attggtctcttaatctcaga

SEQ ID NO: 110262 - DNA, 20 bp, Artificial Sequence
  chemically synthesized
tgtacattctatctgagatt

SEQ ID NO: 110263 - DNA, 20 bp, Artificial Sequence
  chemically synthesized
tacattctatctgagattaa

SEQ ID NO: 110264 - DNA, 20 bp, Artificial Sequence
  chemically synthesized
caccattggtctcttaatct

SEQ ID NO: 110265 - DNA, 20 bp, Artificial Sequence
  chemically synthesized
atctgagattaagagaccaa

SEQ ID NO: 110266 - DNA, 20 bp, Artificial Sequence
  chemically synthesized
aagaggaatatattcaccat

SEQ ID NO: 110267 - DNA, 20 bp, Artificial Sequence
  chemically synthesized
ggtgaatatattcctcttca

SEQ ID NO: 110268 - DNA, 20 bp, Artificial Sequence
  chemically synthesized
gtgaatatattcctcttcat

SEQ ID NO: 110269 - DNA, 20 bp, Artificial Sequence
  chemically synthesized
agtgcagtgatcccatgaag

SEQ ID NO: 110270 - DNA, 20 bp, Artificial Sequence
  chemically synthesized
tagtgcagtgatcccatgaa

SEQ ID NO: 110271 - DNA, 20 bp, Artificial Sequence
  chemically synthesized
tttagtgcagtgatcccatg

SEQ ID NO: 110272 - DNA, 20 bp, Artificial Sequence
  chemically synthesized
aaaagccgtgggttttagtg

SEQ ID NO: 110273 - DNA, 20 bp, Artificial Sequence
  chemically synthesized
gatcactgcactaaaaccca

SEQ ID NO: 110274 - DNA, 20 bp, Artificial Sequence
  chemically synthesized
taaataaaagccgtgggttt

SEQ ID NO: 110275 - DNA, 20 bp, Artificial Sequence
  chemically synthesized
gtaaaataaataaaagccgt

SEQ ID NO: 110276 - DNA, 20 bp, Artificial Sequence
  chemically synthesized
tgtaaaataaataaaagccg

SEQ ID NO: 110277 - DNA, 20 bp, Artificial Sequence
  chemically synthesized
aatttttgtaaaataaataa

SEQ ID NO: 110278 - DNA, 20 bp, Artificial Sequence
  chemically synthesized
atttattttacaaaaatttc

SEQ ID NO: 110279 - DNA, 20 bp, Artificial Sequence
  chemically synthesized
taaatccttagatcattaac

SEQ ID NO: 110280 - DNA, 20 bp, Artificial Sequence
  chemically synthesized
aaatttctagttaatgatct

SEQ ID NO: 110281 - DNA, 20 bp, Artificial Sequence
  chemically synthesized
aatttctagttaatgatcta

SEQ ID NO: 110282 - DNA, 20 bp, Artificial Sequence
  chemically synthesized
tagttaatgatctaaggatt

SEQ ID NO: 110283 - DNA, 20 bp, Artificial Sequence
  chemically synthesized
aaaataaaaagctaaatcct

SEQ ID NO: 110284 - DNA, 20 bp, Artificial Sequence
  chemically synthesized
tggtttggtgaaaaaataaa

SEQ ID NO: 110285 - DNA, 20 bp, Artificial Sequence
  chemically synthesized
ttttattttttcaccaaacc

SEQ ID NO: 110286 - DNA, 20 bp, Artificial Sequence
  chemically synthesized
tttattttttcaccaaacca

SEQ ID NO: 110287 - DNA, 20 bp, Artificial Sequence
  chemically synthesized
agtcaatatataccttggtt

SEQ ID NO: 110288 - DNA, 20 bp, Artificial Sequence
  chemically synthesized
cttccagtcaatatatacct

SEQ ID NO: 110289 - DNA, 20 bp, Artificial Sequence
  chemically synthesized
aaaccaaggtatatattgac

SEQ ID NO: 110290 - DNA, 20 bp, Artificial Sequence
  chemically synthesized
ccaaggtatatattgactgg

SEQ ID NO: 110291 - DNA, 20 bp, Artificial Sequence
  chemically synthesized
taatagtttcagaatacttc

SEQ ID NO: 110292 - DNA, 20 bp, Artificial Sequence
  chemically synthesized
tttgttttatataatagttt

SEQ ID NO: 110293 - DNA, 20 bp, Artificial Sequence
  chemically synthesized
agctgttttgttttatataa

SEQ ID NO: 110294 - DNA, 20 bp, Artificial Sequence
  chemically synthesized
aactattatataaaacaaaa

SEQ ID NO: 110295 - DNA, 20 bp, Artificial Sequence
  chemically synthesized
aactgatacaaaaaagtcaa

SEQ ID NO: 110296 - DNA, 20 bp, Artificial Sequence
  chemically synthesized
aacaaacaactgatacaaaa

SEQ ID NO: 110297 - DNA, 20 bp, Artificial Sequence
  chemically synthesized
agcttttgacttttttgtat

SEQ ID NO: 110298 - DNA, 20 bp, Artificial Sequence
  chemically synthesized
tgtatcagttgtttgtttga

SEQ ID NO: 110299 - DNA, 20 bp, Artificial Sequence
  chemically synthesized
ttgtttgaaagttgttcttc

SEQ ID NO: 110300 - DNA, 20 bp, Artificial Sequence
  chemically synthesized
tttgaaagttgttcttcaag

SEQ ID NO: 110301 - DNA, 20 bp, Artificial Sequence
  chemically synthesized
ttgaaagttgttcttcaagt

SEQ ID NO: 110302 - DNA, 20 bp, Artificial Sequence
  chemically synthesized
agaaaacatgttcccacttg

SEQ ID NO: 110303 - DNA, 20 bp, Artificial Sequence
  chemically synthesized
aagactgcaatttaaaatgg

SEQ ID NO: 110304 - DNA, 20 bp, Artificial Sequence
  chemically synthesized
tgtaagactgcaatttaaaa

SEQ ID NO: 110305 - DNA, 20 bp, Artificial Sequence
  chemically synthesized
ttttcttccattttaaattg

SEQ ID NO: 110306 - DNA, 20 bp, Artificial Sequence
  chemically synthesized
cattttaaattgcagtctta

SEQ ID NO: 110307 - DNA, 20 bp, Artificial Sequence
  chemically synthesized
aaagaaaactacagatctgt

SEQ ID NO: 110308 - DNA, 20 bp, Artificial Sequence
  chemically synthesized
attgcagtcttacagatctg

SEQ ID NO: 110309 - DNA, 20 bp, Artificial Sequence
  chemically synthesized
tccccatgaaaagaaaacta

SEQ ID NO: 110310 - DNA, 20 bp, Artificial Sequence
  chemically synthesized
gatctgtagttttcttttca

SEQ ID NO: 110311 - DNA, 20 bp, Artificial Sequence
  chemically synthesized
atctgtagttttcttttcat

SEQ ID NO: 110312 - DNA, 20 bp, Artificial Sequence
  chemically synthesized
tctgtagttttcttttcatg

SEQ ID NO: 110313 - DNA, 20 bp, Artificial Sequence
  chemically synthesized
acgaattttgtccccatgaa

SEQ ID NO: 110314 - DNA, 20 bp, Artificial Sequence
  chemically synthesized
atggggacaaaattcgtttt

SEQ ID NO: 110315 - DNA, 20 bp, Artificial Sequence
  chemically synthesized
aaaattcgttttaagaactc

SEQ ID NO: 110316 - DNA, 20 bp, Artificial Sequence
  chemically synthesized
ttccagagatttatatacca

SEQ ID NO: 110317 - DNA, 20 bp, Artificial Sequence
  chemically synthesized
tcttccagagatttatatac

SEQ ID NO: 110318 - DNA, 20 bp, Artificial Sequence
  chemically synthesized
aactctggtatataaatctc

SEQ ID NO: 110319 - DNA, 20 bp, Artificial Sequence
  chemically synthesized
tctggtatataaatctctgg

SEQ ID NO: 110320 - DNA, 20 bp, Artificial Sequence
  chemically synthesized
tggtatataaatctctggaa

SEQ ID NO: 110321 - DNA, 20 bp, Artificial Sequence
  chemically synthesized
gtatataaatctctggaaga

SEQ ID NO: 110322 - DNA, 20 bp, Artificial Sequence
  chemically synthesized
tttgtgaatgctctcttcca

SEQ ID NO: 110323 - DNA, 20 bp, Artificial Sequence
  chemically synthesized
tatttgtgaatgctctcttc

SEQ ID NO: 110324 - DNA, 20 bp, Artificial Sequence
  chemically synthesized
cacaaataaattccgatcaa

SEQ ID NO: 110325 - DNA, 20 bp, Artificial Sequence
  chemically synthesized
aatgtatgcaatctgttgat

SEQ ID NO: 110326 - DNA, 20 bp, Artificial Sequence
  chemically synthesized
gattgcatacatttctcaat

SEQ ID NO: 110327 - DNA, 20 bp, Artificial Sequence
  chemically synthesized
ctcagtctgcacagctgatt

SEQ ID NO: 110328 - DNA, 20 bp, Artificial Sequence
  chemically synthesized
acatttctcaatcagctgtg

SEQ ID NO: 110329 - DNA, 20 bp, Artificial Sequence
  chemically synthesized
gtgaaaatgctcagtctgca

SEQ ID NO: 110330 - DNA, 20 bp, Artificial Sequence
  chemically synthesized
ctcaatcagctgtgcagact

SEQ ID NO: 110331 - DNA, 20 bp, Artificial Sequence
  chemically synthesized
actggagccgtgaaaatgct

SEQ ID NO: 110332 - DNA, 20 bp, Artificial Sequence
  chemically synthesized
gtgcagactgagcattttca

SEQ ID NO: 110333 - DNA, 20 bp, Artificial Sequence
  chemically synthesized
actgagcattttcacggctc

SEQ ID NO: 110334 - DNA, 20 bp, Artificial Sequence
  chemically synthesized
tcatctttatgaaatgactg

SEQ ID NO: 110335 - DNA, 20 bp, Artificial Sequence
  chemically synthesized
aatcatctttatgaaatgac

SEQ ID NO: 110336 - DNA, 20 bp, Artificial Sequence
  chemically synthesized
acggctccagtcatttcata

SEQ ID NO: 110337 - DNA, 20 bp, Artificial Sequence
  chemically synthesized
gtcatttcataaagatgatt

SEQ ID NO: 110338 - DNA, 20 bp, Artificial Sequence
  chemically synthesized
aaagatgattcagaattaat

SEQ ID NO: 110339 - DNA, 20 bp, Artificial Sequence
  chemically synthesized
taaataataaaagtagcagt

SEQ ID NO: 110340 - DNA, 20 bp, Artificial Sequence
  chemically synthesized
ataaataataaaagtagcag

SEQ ID NO: 110341 - DNA, 20 bp, Artificial Sequence
  chemically synthesized
tatataaataataaaagtag

SEQ ID NO: 110342 - DNA, 20 bp, Artificial Sequence
  chemically synthesized
gaatatataaataataaaag

SEQ ID NO: 110343 - DNA, 20 bp, Artificial Sequence
  chemically synthesized
tgtgaatatataaataataa

SEQ ID NO: 110344 - DNA, 20 bp, Artificial Sequence
  chemically synthesized
ttttattatttatatattca

SEQ ID NO: 110345 - DNA, 20 bp, Artificial Sequence
  chemically synthesized
ttatatattcacagtattga

SEQ ID NO: 110346 - DNA, 20 bp, Artificial Sequence
  chemically synthesized
gaggaggagtaaagagtggg

SEQ ID NO: 110347 - DNA, 20 bp, Artificial Sequence
  chemically synthesized
atagaggaggagtaaagagt

SEQ ID NO: 110348 - DNA, 20 bp, Artificial Sequence
  chemically synthesized
tatagaggaggagtaaagag

SEQ ID NO: 110349 - DNA, 20 bp, Artificial Sequence
  chemically synthesized
tcctatagaggaggagtaaa

SEQ ID NO: 110350 - DNA, 20 bp, Artificial Sequence
  chemically synthesized
attcctatagaggaggagta

SEQ ID NO: 110351 - DNA, 20 bp, Artificial Sequence
  chemically synthesized
gtgttattcctatagaggag

SEQ ID NO: 110352 - DNA, 20 bp, Artificial Sequence
  chemically synthesized
cactctttactcctcctcta

SEQ ID NO: 110353 - DNA, 20 bp, Artificial Sequence
  chemically synthesized
actctttactcctcctctat

SEQ ID NO: 110354 - DNA, 20 bp, Artificial Sequence
  chemically synthesized
gagtgttattcctatagagg

SEQ ID NO: 110355 - DNA, 20 bp, Artificial Sequence
  chemically synthesized
tgagtgttattcctatagag

SEQ ID NO: 110356 - DNA, 20 bp, Artificial Sequence
  chemically synthesized
catgagtgttattcctatag

SEQ ID NO: 110357 - DNA, 20 bp, Artificial Sequence
  chemically synthesized
tcatgagtgttattcctata

SEQ ID NO: 110358 - DNA, 20 bp, Artificial Sequence
  chemically synthesized
catcatgagtgttattccta

SEQ ID NO: 110359 - DNA, 20 bp, Artificial Sequence
  chemically synthesized
taggaataacactcatgatg

SEQ ID NO: 110360 - DNA, 20 bp, Artificial Sequence
  chemically synthesized
tgctgcccgcaccacatcat

SEQ ID NO: 110361 - DNA, 20 bp, Artificial Sequence
  chemically synthesized
ataacactcatgatgtggtg

SEQ ID NO: 110362 - DNA, 20 bp, Artificial Sequence
  chemically synthesized
taacactcatgatgtggtgc

SEQ ID NO: 110363 - DNA, 20 bp, Artificial Sequence
  chemically synthesized
cactcatgatgtggtgcggg

SEQ ID NO: 110364 - DNA, 20 bp, Artificial Sequence
  chemically synthesized
tcatgatgtggtgcgggcag

SEQ ID NO: 110365 - DNA, 20 bp, Artificial Sequence
  chemically synthesized
catgatgtggtgcgggcagc

SEQ ID NO: 110366 - DNA, 20 bp, Artificial Sequence
  chemically synthesized
gatgtggtgcgggcagcagg

SEQ ID NO: 110367 - DNA, 20 bp, Artificial Sequence
  chemically synthesized
aagaaagaaagtcagatgat

SEQ ID NO: 110368 - DNA, 20 bp, Artificial Sequence
  chemically synthesized
aaagaaagaaagtcagatga

SEQ ID NO: 110369 - DNA, 20 bp, Artificial Sequence
  chemically synthesized
atgccttaaagaaagaaagt

SEQ ID NO: 110370 - DNA, 20 bp, Artificial Sequence
  chemically synthesized
agtgatgccttaaagaaaga

SEQ ID NO: 110371 - DNA, 20 bp, Artificial Sequence
  chemically synthesized
tcatctgactttctttcttt

SEQ ID NO: 110372 - DNA, 20 bp, Artificial Sequence
  chemically synthesized
catctgactttctttcttta

SEQ ID NO: 110373 - DNA, 20 bp, Artificial Sequence
  chemically synthesized
gttgagtgatgccttaaaga

SEQ ID NO: 110374 - DNA, 20 bp, Artificial Sequence
  chemically synthesized
attagttgagtgatgcctta

SEQ ID NO: 110375 - DNA, 20 bp, Artificial Sequence
  chemically synthesized
ataggttctcaggattagtt

SEQ ID NO: 110376 - DNA, 20 bp, Artificial Sequence
  chemically synthesized
ggcatcactcaactaatcct

SEQ ID NO: 110377 - DNA, 20 bp, Artificial Sequence
  chemically synthesized
tgttcataggttctcaggat

SEQ ID NO: 110378 - DNA, 20 bp, Artificial Sequence
  chemically synthesized
attattgttcataggttctc

SEQ ID NO: 110379 - DNA, 20 bp, Artificial Sequence
  chemically synthesized
cattattgttcataggttct

SEQ ID NO: 110380 - DNA, 20 bp, Artificial Sequence
  chemically synthesized
tatccaccattattgttcat

SEQ ID NO: 110381 - DNA, 20 bp, Artificial Sequence
  chemically synthesized
atatccaccattattgttca

SEQ ID NO: 110382 - DNA, 20 bp, Artificial Sequence
  chemically synthesized
tgagaacctatgaacaataa

SEQ ID NO: 110383 - DNA, 20 bp, Artificial Sequence
  chemically synthesized
gaacctatgaacaataatgg

SEQ ID NO: 110384 - DNA, 20 bp, Artificial Sequence
  chemically synthesized
gaacaataatggtggatatg

SEQ ID NO: 110385 - DNA, 20 bp, Artificial Sequence
  chemically synthesized
attcacatcaaacttctgtt

SEQ ID NO: 110386 - DNA, 20 bp, Artificial Sequence
  chemically synthesized
acacttgaagaaccaaacag

SEQ ID NO: 110387 - DNA, 20 bp, Artificial Sequence
  chemically synthesized
agaacacttgaagaaccaaa

SEQ ID NO: 110388 - DNA, 20 bp, Artificial Sequence
  chemically synthesized
aaacttctgtttggttcttc

SEQ ID NO: 110389 - DNA, 20 bp, Artificial Sequence
  chemically synthesized
tattctggagagaacacttg

SEQ ID NO: 110390 - DNA, 20 bp, Artificial Sequence
  chemically synthesized
ggttcttcaagtgttctctc

SEQ ID NO: 110391 - DNA, 20 bp, Artificial Sequence
  chemically synthesized
agtggacttcatattctgga

SEQ ID NO: 110392 - DNA, 20 bp, Artificial Sequence
  chemically synthesized
ttagtggacttcatattctg

SEQ ID NO: 110393 - DNA, 20 bp, Artificial Sequence
  chemically synthesized
agtgttctctccagaatatg

SEQ ID NO: 110394 - DNA, 20 bp, Artificial Sequence
  chemically synthesized
aattagtggacttcatattc

SEQ ID NO: 110395 - DNA, 20 bp, Artificial Sequence
  chemically synthesized
actgaggtctaaagaattag

SEQ ID NO: 110396 - DNA, 20 bp, Artificial Sequence
  chemically synthesized
tatgaagtccactaattctt

SEQ ID NO: 110397 - DNA, 20 bp, Artificial Sequence
  chemically synthesized
tctactgaggtctaaagaat

SEQ ID NO: 110398 - DNA, 20 bp, Artificial Sequence
  chemically synthesized
tccactaattctttagacct

SEQ ID NO: 110399 - DNA, 20 bp, Artificial Sequence
  chemically synthesized
catacctctactgaggtcta

SEQ ID NO: 110400 - DNA, 20 bp, Artificial Sequence
  chemically synthesized
actaattctttagacctcag

SEQ ID NO: 110401 - DNA, 20 bp, Artificial Sequence
  chemically synthesized
taattctttagacctcagta

SEQ ID NO: 110402 - DNA, 20 bp, Artificial Sequence
  chemically synthesized
aattctttagacctcagtag

SEQ ID NO: 110403 - DNA, 20 bp, Artificial Sequence
  chemically synthesized
tgcttcacatacctctactg

SEQ ID NO: 110404 - DNA, 20 bp, Artificial Sequence
  chemically synthesized
atgcttcacatacctctact

SEQ ID NO: 110405 - DNA, 20 bp, Artificial Sequence
  chemically synthesized
gacctcagtagaggtatgtg

SEQ ID NO: 110406 - DNA, 20 bp, Artificial Sequence
  chemically synthesized
gtagaggtatgtgaagcatg

SEQ ID NO: 110407 - DNA, 20 bp, Artificial Sequence
  chemically synthesized
gaagcatgtagtaataacaa

SEQ ID NO: 110408 - DNA, 20 bp, Artificial Sequence
  chemically synthesized
taactatttatgtgtcattg

SEQ ID NO: 110409 - DNA, 20 bp, Artificial Sequence
  chemically synthesized
tggctacaatgacacataaa

SEQ ID NO: 110410 - DNA, 20 bp, Artificial Sequence
  chemically synthesized
caatgacacataaatagtta

SEQ ID NO: 110411 - DNA, 20 bp, Artificial Sequence
  chemically synthesized
tccagtacctatagcgattg

SEQ ID NO: 110412 - DNA, 20 bp, Artificial Sequence
  chemically synthesized
agttatggctgcaatcgcta

SEQ ID NO: 110413 - DNA, 20 bp, Artificial Sequence
  chemically synthesized
gttatggctgcaatcgctat

SEQ ID NO: 110414 - DNA, 20 bp, Artificial Sequence
  chemically synthesized
gctgcaatcgctataggtac

SEQ ID NO: 110415 - DNA, 20 bp, Artificial Sequence
  chemically synthesized
gaatgttgttccagtaccta

SEQ ID NO: 110416 - DNA, 20 bp, Artificial Sequence
  chemically synthesized
ttcctagaggaatgttgttc

SEQ ID NO: 110417 - DNA, 20 bp, Artificial Sequence
  chemically synthesized
gtactggaacaacattcctc

SEQ ID NO: 110418 - DNA, 20 bp, Artificial Sequence
  chemically synthesized
tactggaacaacattcctct

SEQ ID NO: 110419 - DNA, 20 bp, Artificial Sequence
  chemically synthesized
cttgatgtcattgttcctag

SEQ ID NO: 110420 - DNA, 20 bp, Artificial Sequence
  chemically synthesized
tcttgatgtcattgttccta

SEQ ID NO: 110421 - DNA, 20 bp, Artificial Sequence
  chemically synthesized
cttcttgatgtcattgttcc

SEQ ID NO: 110422 - DNA, 20 bp, Artificial Sequence
  chemically synthesized
cctctaggaacaatgacatc

SEQ ID NO: 110423 - DNA, 20 bp, Artificial Sequence
  chemically synthesized
ctaggaacaatgacatcaag

SEQ ID NO: 110424 - DNA, 20 bp, Artificial Sequence
  chemically synthesized
aatgacatcaagaagccttg

SEQ ID NO: 110425 - DNA, 20 bp, Artificial Sequence
  chemically synthesized
tgacatcaagaagccttgca

SEQ ID NO: 110426 - DNA, 20 bp, Artificial Sequence
  chemically synthesized
acatcaagaagccttgcaga

SEQ ID NO: 110427 - DNA, 20 bp, Artificial Sequence
  chemically synthesized
tgggagattggctctctgca

SEQ ID NO: 110428 - DNA, 20 bp, Artificial Sequence
  chemically synthesized
ctgggagattggctctctgc

SEQ ID NO: 110429 - DNA, 20 bp, Artificial Sequence
  chemically synthesized
cttgcagagagccaatctcc

SEQ ID NO: 110430 - DNA, 20 bp, Artificial Sequence
  chemically synthesized
tgctcaaaattctgggagat

SEQ ID NO: 110431 - DNA, 20 bp, Artificial Sequence
  chemically synthesized
ttgattgctcaaaattctgg

SEQ ID NO: 110432 - DNA, 20 bp, Artificial Sequence
  chemically synthesized
gtttgattgctcaaaattct

SEQ ID NO: 110433 - DNA, 20 bp, Artificial Sequence
  chemically synthesized
agccaatctcccagaatttt

SEQ ID NO: 110434 - DNA, 20 bp, Artificial Sequence
  chemically synthesized
agtttgattgctcaaaattc

SEQ ID NO: 110435 - DNA, 20 bp, Artificial Sequence
  chemically synthesized
gcattctaaaatgtcacaag

SEQ ID NO: 110436 - DNA, 20 bp, Artificial Sequence
  chemically synthesized
gtgcattctaaaatgtcaca

SEQ ID NO: 110437 - DNA, 20 bp, Artificial Sequence
  chemically synthesized
agtgcattctaaaatgtcac

SEQ ID NO: 110438 - DNA, 20 bp, Artificial Sequence
  chemically synthesized
tcaaactccttgtgacattt

SEQ ID NO: 110439 - DNA, 20 bp, Artificial Sequence
  chemically synthesized
agtaaccctaagagaagatg

SEQ ID NO: 110440 - DNA, 20 bp, Artificial Sequence
  chemically synthesized
gaatgcactgcatcttctct

SEQ ID NO: 110441 - DNA, 20 bp, Artificial Sequence
  chemically synthesized
aatgcactgcatcttctctt

SEQ ID NO: 110442 - DNA, 20 bp, Artificial Sequence
  chemically synthesized
atgcactgcatcttctctta

SEQ ID NO: 110443 - DNA, 20 bp, Artificial Sequence
  chemically synthesized
gtttttagtaaccctaagag

SEQ ID NO: 110444 - DNA, 20 bp, Artificial Sequence
  chemically synthesized
gtagtttttagtaaccctaa

SEQ ID NO: 110445 - DNA, 20 bp, Artificial Sequence
  chemically synthesized
ttgtagtttttagtaaccct

SEQ ID NO: 110446 - DNA, 20 bp, Artificial Sequence
  chemically synthesized
ttaggtatagttgtagtttt

SEQ ID NO: 110447 - DNA, 20 bp, Artificial Sequence
  chemically synthesized
aggtgagttaggtatagttg

SEQ ID NO: 110448 - DNA, 20 bp, Artificial Sequence
  chemically synthesized
gttgctaggtgagttaggta

SEQ ID NO: 110449 - DNA, 20 bp, Artificial Sequence
  chemically synthesized
gaactgttgctaggtgagtt

SEQ ID NO: 110450 - DNA, 20 bp, Artificial Sequence
  chemically synthesized
acaactatacctaactcacc

SEQ ID NO: 110451 - DNA, 20 bp, Artificial Sequence
  chemically synthesized
tgaactgttgctaggtgagt

SEQ ID NO: 110452 - DNA, 20 bp, Artificial Sequence
  chemically synthesized
ggcatgaactgttgctaggt

SEQ ID NO: 110453 - DNA, 20 bp, Artificial Sequence
  chemically synthesized
atacctaactcacctagcaa

SEQ ID NO: 110454 - DNA, 20 bp, Artificial Sequence
  chemically synthesized
tagcggcatgaactgttgct

SEQ ID NO: 110455 - DNA, 20 bp, Artificial Sequence
  chemically synthesized
ttagcggcatgaactgttgc

SEQ ID NO: 110456 - DNA, 20 bp, Artificial Sequence
  chemically synthesized
gtatctttaaaatgaattag

SEQ ID NO: 110457 - DNA, 20 bp, Artificial Sequence
  chemically synthesized
aatgtatctttaaaatgaat

SEQ ID NO: 110458 - DNA, 20 bp, Artificial Sequence
  chemically synthesized
catgccgctaattcatttta

SEQ ID NO: 110459 - DNA, 20 bp, Artificial Sequence
  chemically synthesized
tcattttaaagatacattaa

SEQ ID NO: 110460 - DNA, 20 bp, Artificial Sequence
  chemically synthesized
ttttaaagatacattaacag

SEQ ID NO: 110461 - DNA, 20 bp, Artificial Sequence
  chemically synthesized
aattcaaagagacatatgaa

SEQ ID NO: 110462 - DNA, 20 bp, Artificial Sequence
  chemically synthesized
cacagccaagtcaattcaaa

SEQ ID NO: 110463 - DNA, 20 bp, Artificial Sequence
  chemically synthesized
gacacagccaagtcaattca

SEQ ID NO: 110464 - DNA, 20 bp, Artificial Sequence
  chemically synthesized
tatgtctctttgaattgact

SEQ ID NO: 110465 - DNA, 20 bp, Artificial Sequence
  chemically synthesized
gcctttcaagagacacagcc

SEQ ID NO: 110466 - DNA, 20 bp, Artificial Sequence
  chemically synthesized
tttgagcctttcaagagaca

SEQ ID NO: 110467 - DNA, 20 bp, Artificial Sequence
  chemically synthesized
gacttggctgtgtctcttga

SEQ ID NO: 110468 - DNA, 20 bp, Artificial Sequence
  chemically synthesized
acttggctgtgtctcttgaa

SEQ ID NO: 110469 - DNA, 20 bp, Artificial Sequence
  chemically synthesized
atcaaatttgagcctttcaa

SEQ ID NO: 110470 - DNA, 20 bp, Artificial Sequence
  chemically synthesized
taatcaaatttgagcctttc

SEQ ID NO: 110471 - DNA, 20 bp, Artificial Sequence
  chemically synthesized
attttggcctaatcaaattt

SEQ ID NO: 110472 - DNA, 20 bp, Artificial Sequence
  chemically synthesized
ttgaaaggctcaaatttgat

SEQ ID NO: 110473 - DNA, 20 bp, Artificial Sequence
  chemically synthesized
tgaaaggctcaaatttgatt

SEQ ID NO: 110474 - DNA, 20 bp, Artificial Sequence
  chemically synthesized
aatttgattaggccaaaatg

SEQ ID NO: 110475 - DNA, 20 bp, Artificial Sequence
  chemically synthesized
tttgattaggccaaaatgca

SEQ ID NO: 110476 - DNA, 20 bp, Artificial Sequence
  chemically synthesized
cattaatttcctctgcattt

SEQ ID NO: 110477 - DNA, 20 bp, Artificial Sequence
  chemically synthesized
ttgattaggccaaaatgcag

SEQ ID NO: 110478 - DNA, 20 bp, Artificial Sequence
  chemically synthesized
aatttagggaaatggcacaa

SEQ ID NO: 110479 - DNA, 20 bp, Artificial Sequence
  chemically synthesized
tgaatttagggaaatggcac

SEQ ID NO: 110480 - DNA, 20 bp, Artificial Sequence
  chemically synthesized
catttctgaatttagggaaa

SEQ ID NO: 110481 - DNA, 20 bp, Artificial Sequence
  chemically synthesized
ttgtgccatttccctaaatt

SEQ ID NO: 110482 - DNA, 20 bp, Artificial Sequence
  chemically synthesized
tctttacatttctgaattta

SEQ ID NO: 110483 - DNA, 20 bp, Artificial Sequence
  chemically synthesized
ttctttacatttctgaattt

SEQ ID NO: 110484 - DNA, 20 bp, Artificial Sequence
  chemically synthesized
tttctttacatttctgaatt

SEQ ID NO: 110485 - DNA, 20 bp, Artificial Sequence
  chemically synthesized
tccctaaattcagaaatgta

SEQ ID NO: 110486 - DNA, 20 bp, Artificial Sequence
  chemically synthesized
gacttgtctgtatttgaaat

SEQ ID NO: 110487 - DNA, 20 bp, Artificial Sequence
  chemically synthesized
agaaataccaatttcaaata

SEQ ID NO: 110488 - DNA, 20 bp, Artificial Sequence
  chemically synthesized
taccaatttcaaatacagac

SEQ ID NO: 110489 - DNA, 20 bp, Artificial Sequence
  chemically synthesized
gttcagacttcatttaacat

SEQ ID NO: 110490 - DNA, 20 bp, Artificial Sequence
  chemically synthesized
gacaagtctaatgttaaatg

SEQ ID NO: 110491 - DNA, 20 bp, Artificial Sequence
  chemically synthesized
cgacaatctttttatatgtt

SEQ ID NO: 110492 - DNA, 20 bp, Artificial Sequence
  chemically synthesized
atgaagtctgaacatataaa

SEQ ID NO: 110493 - DNA, 20 bp, Artificial Sequence
  chemically synthesized
catataaaaagattgtcgtc

SEQ ID NO: 110494 - DNA, 20 bp, Artificial Sequence
  chemically synthesized
gtcaagacaaatccattgcc

SEQ ID NO: 110495 - DNA, 20 bp, Artificial Sequence
  chemically synthesized
agctgaagaaaaccaggcaa

SEQ ID NO: 110496 - DNA, 20 bp, Artificial Sequence
  chemically synthesized
gatgtcagctgaagaaaacc

SEQ ID NO: 110497 - DNA, 20 bp, Artificial Sequence
  chemically synthesized
agatgtcagctgaagaaaac

SEQ ID NO: 110498 - DNA, 20 bp, Artificial Sequence
  chemically synthesized
atccattgcctggttttctt

SEQ ID NO: 110499 - DNA, 20 bp, Artificial Sequence
  chemically synthesized
ataaaaatagatgtcagctg

SEQ ID NO: 110500 - DNA, 20 bp, Artificial Sequence
  chemically synthesized
gtctacataaaaatagatgt

SEQ ID NO: 110501 - DNA, 20 bp, Artificial Sequence
  chemically synthesized
tcataccgtctacataaaaa

SEQ ID NO: 110502 - DNA, 20 bp, Artificial Sequence
  chemically synthesized
agctgacatctatttttatg

SEQ ID NO: 110503 - DNA, 20 bp, Artificial Sequence
  chemically synthesized
gacatctatttttatgtaga

SEQ ID NO: 110504 - DNA, 20 bp, Artificial Sequence
  chemically synthesized
tttatgtagacggtatgact

SEQ ID NO: 110505 - DNA, 20 bp, Artificial Sequence
  chemically synthesized
tagacggtatgacttagatt

SEQ ID NO: 110506 - DNA, 20 bp, Artificial Sequence
  chemically synthesized
agacggtatgacttagattc

SEQ ID NO: 110507 - DNA, 20 bp, Artificial Sequence
  chemically synthesized
gacggtatgacttagattca

SEQ ID NO: 110508 - DNA, 20 bp, Artificial Sequence
  chemically synthesized
catgtttagtccctgaatct

SEQ ID NO: 110509 - DNA, 20 bp, Artificial Sequence
  chemically synthesized
agattcagggactaaacatg

SEQ ID NO: 110510 - DNA, 20 bp, Artificial Sequence
  chemically synthesized
attctgaatttcttcatgtt

SEQ ID NO: 110511 - DNA, 20 bp, Artificial Sequence
  chemically synthesized
ggactaaacatgaagaaatt

SEQ ID NO: 110512 - DNA, 20 bp, Artificial Sequence
  chemically synthesized
ttgcatgccttttgaataat

SEQ ID NO: 110513 - DNA, 20 bp, Artificial Sequence
  chemically synthesized
agaataatccaattattcaa

SEQ ID NO: 110514 - DNA, 20 bp, Artificial Sequence
  chemically synthesized
gaataatccaattattcaaa

SEQ ID NO: 110515 - DNA, 20 bp, Artificial Sequence
  chemically synthesized
aaaagagattttttaaataa

SEQ ID NO: 110516 - DNA, 20 bp, Artificial Sequence
  chemically synthesized
atttaaaaaatctcttttca

SEQ ID NO: 110517 - DNA, 20 bp, Artificial Sequence
  chemically synthesized
aaacaaaaacactgtgaaaa

SEQ ID NO: 110518 - DNA, 20 bp, Artificial Sequence
  chemically synthesized
caaaacaaaaacactgtgaa

SEQ ID NO: 110519 - DNA, 20 bp, Artificial Sequence
  chemically synthesized
tttcacagtgtttttgtttt

SEQ ID NO: 110520 - DNA, 20 bp, Artificial Sequence
  chemically synthesized
tgtttttgttttgagtacta

SEQ ID NO: 110521 - DNA, 20 bp, Artificial Sequence
  chemically synthesized
attaaatgtttacaaagcta

SEQ ID NO: 110522 - DNA, 20 bp, Artificial Sequence
  chemically synthesized
tagataattaaatgtttaca

SEQ ID NO: 110523 - DNA, 20 bp, Artificial Sequence
  chemically synthesized
tttgtaaacatttaattatc

SEQ ID NO: 110524 - DNA, 20 bp, Artificial Sequence
  chemically synthesized
catttaattatctagcttta

SEQ ID NO: 110525 - DNA, 20 bp, Artificial Sequence
  chemically synthesized
atttaattatctagctttat

SEQ ID NO: 110526 - DNA, 20 bp, Artificial Sequence
  chemically synthesized
taaaacgaaacccataaagc

SEQ ID NO: 110527 - DNA, 20 bp, Artificial Sequence
  chemically synthesized
tcattaaaacgaaacccata

SEQ ID NO: 110528 - DNA, 20 bp, Artificial Sequence
  chemically synthesized
gatttattgttatcatttgt

SEQ ID NO: 110529 - DNA, 20 bp, Artificial Sequence
  chemically synthesized
aaatacttccaaaattggca

SEQ ID NO: 110530 - DNA, 20 bp, Artificial Sequence
  chemically synthesized
caataaatccatgccaattt

SEQ ID NO: 110531 - DNA, 20 bp, Artificial Sequence
  chemically synthesized
taaatccatgccaattttgg

SEQ ID NO: 110532 - DNA, 20 bp, Artificial Sequence
  chemically synthesized
attagaaatacttccaaaat

SEQ ID NO: 110533 - DNA, 20 bp, Artificial Sequence
  chemically synthesized
tccaatttgttatataatat

SEQ ID NO: 110534 - DNA, 20 bp, Artificial Sequence
  chemically synthesized
tctaatattatataacaaat

SEQ ID NO: 110535 - DNA, 20 bp, Artificial Sequence
  chemically synthesized
atattatataacaaattgga

SEQ ID NO: 110536 - DNA, 20 bp, Artificial Sequence
  chemically synthesized
tattatataacaaattggaa

SEQ ID NO: 110537 - DNA, 20 bp, Artificial Sequence
  chemically synthesized
attttgtacatgattatctc

SEQ ID NO: 110538 - DNA, 20 bp, Artificial Sequence
  chemically synthesized
ttttgtacatgattatctct

SEQ ID NO: 110539 - DNA, 20 bp, Artificial Sequence
  chemically synthesized
tgtacatgattatctctagg

SEQ ID NO: 110540 - DNA, 20 bp, Artificial Sequence
  chemically synthesized
tcttgtggtttgtcttccta

SEQ ID NO: 110541 - DNA, 20 bp, Artificial Sequence
  chemically synthesized
actcttgtggtttgtcttcc

SEQ ID NO: 110542 - DNA, 20 bp, Artificial Sequence
  chemically synthesized
tctctaggaagacaaaccac

SEQ ID NO: 110543 - DNA, 20 bp, Artificial Sequence
  chemically synthesized
tctaggaagacaaaccacaa

SEQ ID NO: 110544 - DNA, 20 bp, Artificial Sequence
  chemically synthesized
agctctgttaattactcttg

SEQ ID NO: 110545 - DNA, 20 bp, Artificial Sequence
  chemically synthesized
caaaccacaagagtaattaa

SEQ ID NO: 110546 - DNA, 20 bp, Artificial Sequence
  chemically synthesized
aaccacaagagtaattaaca

SEQ ID NO: 110547 - DNA, 20 bp, Artificial Sequence
  chemically synthesized
ttgtgatgataatggaatca

SEQ ID NO: 110548 - DNA, 20 bp, Artificial Sequence
  chemically synthesized
tttaacccttgtgatgataa

SEQ ID NO: 110549 - DNA, 20 bp, Artificial Sequence
  chemically synthesized
tatgattccattatcatcac

SEQ ID NO: 110550 - DNA, 20 bp, Artificial Sequence
  chemically synthesized
atgattccattatcatcaca

SEQ ID NO: 110551 - DNA, 20 bp, Artificial Sequence
  chemically synthesized
tgattccattatcatcacaa

SEQ ID NO: 110552 - DNA, 20 bp, Artificial Sequence
  chemically synthesized
tatcatcacaagggttaaac

SEQ ID NO: 110553 - DNA, 20 bp, Artificial Sequence
  chemically synthesized
catcacaagggttaaaccag

SEQ ID NO: 110554 - DNA, 20 bp, Artificial Sequence
  chemically synthesized
aaatagtgaacatgaacttc

SEQ ID NO: 110555 - DNA, 20 bp, Artificial Sequence
  chemically synthesized
gtttgtgagatatatgaaaa

SEQ ID NO: 110556 - DNA, 20 bp, Artificial Sequence
  chemically synthesized
gaactgatacttgggtttgt

SEQ ID NO: 110557 - DNA, 20 bp, Artificial Sequence
  chemically synthesized
ttcatatatctcacaaaccc

SEQ ID NO: 110558 - DNA, 20 bp, Artificial Sequence
  chemically synthesized
tatctcacaaacccaagtat

SEQ ID NO: 110559 - DNA, 20 bp, Artificial Sequence
  chemically synthesized
ggagaactgaactgatactt

SEQ ID NO: 110560 - DNA, 20 bp, Artificial Sequence
  chemically synthesized
aggagaactgaactgatact

SEQ ID NO: 110561 - DNA, 20 bp, Artificial Sequence
  chemically synthesized
cacaaacccaagtatcagtt

SEQ ID NO: 110562 - DNA, 20 bp, Artificial Sequence
  chemically synthesized
aagtatcagttcagttctcc

SEQ ID NO: 110563 - DNA, 20 bp, Artificial Sequence
  chemically synthesized
aatccttcatgaatttccag

SEQ ID NO: 110564 - DNA, 20 bp, Artificial Sequence
  chemically synthesized
ttaatccttcatgaatttcc

SEQ ID NO: 110565 - DNA, 20 bp, Artificial Sequence
  chemically synthesized
tttaatccttcatgaatttc

SEQ ID NO: 110566 - DNA, 20 bp, Artificial Sequence
  chemically synthesized
agttctcctggaaattcatg

SEQ ID NO: 110567 - DNA, 20 bp, Artificial Sequence
  chemically synthesized
gttctcctggaaattcatga

SEQ ID NO: 110568 - DNA, 20 bp, Artificial Sequence
  chemically synthesized
attaaaacaaaacacattat

SEQ ID NO: 110569 - DNA, 20 bp, Artificial Sequence
  chemically synthesized
ttaaaacaaaacacattatt

SEQ ID NO: 110570 - DNA, 20 bp, Artificial Sequence
  chemically synthesized
attaggcaatattttgatat

SEQ ID NO: 110571 - DNA, 20 bp, Artificial Sequence
  chemically synthesized
ttaggcaatattttgatata

SEQ ID NO: 110572 - DNA, 20 bp, Artificial Sequence
  chemically synthesized
aggcaatattttgatataag

SEQ ID NO: 110573 - DNA, 20 bp, Artificial Sequence
  chemically synthesized
caatattttgatataaggag

SEQ ID NO: 110574 - DNA, 20 bp, Artificial Sequence
  chemically synthesized
aatattttgatataaggagt

SEQ ID NO: 110575 - DNA, 20 bp, Artificial Sequence
  chemically synthesized
attttgatataaggagtggg

SEQ ID NO: 110576 - DNA, 20 bp, Artificial Sequence
  chemically synthesized
ctaaattttggaaaacatat

SEQ ID NO: 110577 - DNA, 20 bp, Artificial Sequence
  chemically synthesized
ctaatatgttttccaaaatt

SEQ ID NO: 110578 - DNA, 20 bp, Artificial Sequence
  chemically synthesized
cacacttctgtactaaattt

SEQ ID NO: 110579 - DNA, 20 bp, Artificial Sequence
  chemically synthesized
atgttttccaaaatttagta

SEQ ID NO: 110580 - DNA, 20 bp, Artificial Sequence
  chemically synthesized
ttttccaaaatttagtacag

SEQ ID NO: 110581 - DNA, 20 bp, Artificial Sequence
  chemically synthesized
agaagtgtgtgtatcatctc

SEQ ID NO: 110582 - DNA, 20 bp, Artificial Sequence
  chemically synthesized
tgtgtgtatcatctcaagat

SEQ ID NO: 110583 - DNA, 20 bp, Artificial Sequence
  chemically synthesized
catgtgttaccgccaatctt

SEQ ID NO: 110584 - DNA, 20 bp, Artificial Sequence
  chemically synthesized
gtgtatcatctcaagattgg

SEQ ID NO: 110585 - DNA, 20 bp, Artificial Sequence
  chemically synthesized
atttctgctcatttttttgt

SEQ ID NO: 110586 - DNA, 20 bp, Artificial Sequence
  chemically synthesized
catgttacttacaaaaaaat

SEQ ID NO: 110587 - DNA, 20 bp, Artificial Sequence
  chemically synthesized
gttacttacaaaaaaatgag

SEQ ID NO: 110588 - DNA, 20 bp, Artificial Sequence
  chemically synthesized
aaaaaatgagcagaaataaa

SEQ ID NO: 110589 - DNA, 20 bp, Artificial Sequence
  chemically synthesized
ataaaatataatgacatcac

SEQ ID NO: 110590 - DNA, 20 bp, Artificial Sequence
  chemically synthesized
atataatgacatcactagac

SEQ ID NO: 110591 - DNA, 20 bp, Artificial Sequence
  chemically synthesized
tataatgacatcactagaca

SEQ ID NO: 110592 - DNA, 20 bp, Artificial Sequence
  chemically synthesized
ataatgacatcactagacaa

SEQ ID NO: 110593 - DNA, 20 bp, Artificial Sequence
  chemically synthesized
aaagtagatgttcccttgtc

SEQ ID NO: 110594 - DNA, 20 bp, Artificial Sequence
  chemically synthesized
acaagggaacatctactttt

SEQ ID NO: 110595 - DNA, 20 bp, Artificial Sequence
  chemically synthesized
ctaaataaatttccaaaaag

SEQ ID NO: 110596 - DNA, 20 bp, Artificial Sequence
  chemically synthesized
gccctaaataaatttccaaa

SEQ ID NO: 110597 - DNA, 20 bp, Artificial Sequence
  chemically synthesized
ctactttttggaaatttatt

SEQ ID NO: 110598 - DNA, 20 bp, Artificial Sequence
  chemically synthesized
tactttttggaaatttattt

SEQ ID NO: 110599 - DNA, 20 bp, Artificial Sequence
  chemically synthesized
actttttggaaatttattta

SEQ ID NO: 110600 - DNA, 20 bp, Artificial Sequence
  chemically synthesized
ttttggaaatttatttaggg

SEQ ID NO: 110601 - DNA, 20 bp, Artificial Sequence
  chemically synthesized
gcctatgttttattttttaa

SEQ ID NO: 110602 - DNA, 20 bp, Artificial Sequence
  chemically synthesized
aaccattaaaaaataaaaca

SEQ ID NO: 110603 - DNA, 20 bp, Artificial Sequence
  chemically synthesized
accattaaaaaataaaacat

SEQ ID NO: 110604 - DNA, 20 bp, Artificial Sequence
  chemically synthesized
atctgtatgataaaaatata

SEQ ID NO: 110605 - DNA, 20 bp, Artificial Sequence
  chemically synthesized
ggctttatatttttatcata

SEQ ID NO: 110606 - DNA, 20 bp, Artificial Sequence
  chemically synthesized
ttatatttttatcatacaga

SEQ ID NO: 110607 - DNA, 20 bp, Artificial Sequence
  chemically synthesized
atattgaaaattaataatat

SEQ ID NO: 110608 - DNA, 20 bp, Artificial Sequence
  chemically synthesized
attaattttcaatatgcatt

SEQ ID NO: 110609 - DNA, 20 bp, Artificial Sequence
  chemically synthesized
ttaattttcaatatgcattt

SEQ ID NO: 110610 - DNA, 20 bp, Artificial Sequence
  chemically synthesized
tatgcatttaggaaaaacca

SEQ ID NO: 110611 - DNA, 20 bp, Artificial Sequence
  chemically synthesized
ttgaaatagtaaatatactt

SEQ ID NO: 110612 - DNA, 20 bp, Artificial Sequence
  chemically synthesized
agtatatttactatttcaat

SEQ ID NO: 110613 - DNA, 20 bp, Artificial Sequence
  chemically synthesized
gtgacaatagctaattgaaa

SEQ ID NO: 110614 - DNA, 20 bp, Artificial Sequence
  chemically synthesized
atttcaattagctattgtca

SEQ ID NO: 110615 - DNA, 20 bp, Artificial Sequence
  chemically synthesized
attctacattactgtgacaa

SEQ ID NO: 110616 - DNA, 20 bp, Artificial Sequence
  chemically synthesized
tagctattgtcacagtaatg

SEQ ID NO: 110617 - DNA, 20 bp, Artificial Sequence
  chemically synthesized
tgtcacagtaatgtagaata

SEQ ID NO: 110618 - DNA, 20 bp, Artificial Sequence
  chemically synthesized
taatgtagaataaagctcaa

SEQ ID NO: 110619 - DNA, 20 bp, Artificial Sequence
  chemically synthesized
gattgttgcataaagccatt

SEQ ID NO: 110620 - DNA, 20 bp, Artificial Sequence
  chemically synthesized
aaagaaatgattgttgcata

SEQ ID NO: 110621 - DNA, 20 bp, Artificial Sequence
  chemically synthesized
gcaacaatcatttcttttcc

SEQ ID NO: 110622 - DNA, 20 bp, Artificial Sequence
  chemically synthesized
tagccattcacatccaggaa

SEQ ID NO: 110623 - DNA, 20 bp, Artificial Sequence
  chemically synthesized
tgcactagccattcacatcc

SEQ ID NO: 110624 - DNA, 20 bp, Artificial Sequence
  chemically synthesized
ctgcactagccattcacatc

SEQ ID NO: 110625 - DNA, 20 bp, Artificial Sequence
  chemically synthesized
tttcttttcctggatgtgaa

SEQ ID NO: 110626 - DNA, 20 bp, Artificial Sequence
  chemically synthesized
ttttcctggatgtgaatggc

SEQ ID NO: 110627 - DNA, 20 bp, Artificial Sequence
  chemically synthesized
ctggatgtgaatggctagtg

SEQ ID NO: 110628 - DNA, 20 bp, Artificial Sequence
  chemically synthesized
catgaacagcagggctgcac

SEQ ID NO: 110629 - DNA, 20 bp, Artificial Sequence
  chemically synthesized
gataaaagacatgaacagca

SEQ ID NO: 110630 - DNA, 20 bp, Artificial Sequence
  chemically synthesized
cgataaaagacatgaacagc

SEQ ID NO: 110631 - DNA, 20 bp, Artificial Sequence
  chemically synthesized
acgataaaagacatgaacag

SEQ ID NO: 110632 - DNA, 20 bp, Artificial Sequence
  chemically synthesized
aaaacgataaaagacatgaa

SEQ ID NO: 110633 - DNA, 20 bp, Artificial Sequence
  chemically synthesized
tggtctcaggaaaacgataa

SEQ ID NO: 110634 - DNA, 20 bp, Artificial Sequence
  chemically synthesized
atgtcttttatcgttttcct

SEQ ID NO: 110635 - DNA, 20 bp, Artificial Sequence
  chemically synthesized
ttttatcgttttcctgagac

SEQ ID NO: 110636 - DNA, 20 bp, Artificial Sequence
  chemically synthesized
ccatctaggctgctggtctc

SEQ ID NO: 110637 - DNA, 20 bp, Artificial Sequence
  chemically synthesized
tatcgttttcctgagaccag

SEQ ID NO: 110638 - DNA, 20 bp, Artificial Sequence
  chemically synthesized
tccatctaggctgctggtct

SEQ ID NO: 110639 - DNA, 20 bp, Artificial Sequence
  chemically synthesized
ttttcctgagaccagcagcc

SEQ ID NO: 110640 - DNA, 20 bp, Artificial Sequence
  chemically synthesized
aacacgtccatctaggctgc

SEQ ID NO: 110641 - DNA, 20 bp, Artificial Sequence
  chemically synthesized
cctgagaccagcagcctaga

SEQ ID NO: 110642 - DNA, 20 bp, Artificial Sequence
  chemically synthesized
ttctgagaacacgtccatct

SEQ ID NO: 110643 - DNA, 20 bp, Artificial Sequence
  chemically synthesized
attctgagaacacgtccatc

SEQ ID NO: 110644 - DNA, 20 bp, Artificial Sequence
  chemically synthesized
agcctagatggacgtgttct

SEQ ID NO: 110645 - DNA, 20 bp, Artificial Sequence
  chemically synthesized
tggacgtgttctcagaatga

SEQ ID NO: 110646 - DNA, 20 bp, Artificial Sequence
  chemically synthesized
tgtgcttctgctatcattct

SEQ ID NO: 110647 - DNA, 20 bp, Artificial Sequence
  chemically synthesized
acgtgttctcagaatgatag

SEQ ID NO: 110648 - DNA, 20 bp, Artificial Sequence
  chemically synthesized
tgttctcagaatgatagcag

SEQ ID NO: 110649 - DNA, 20 bp, Artificial Sequence
  chemically synthesized
aatgatagcagaagcacaaa

SEQ ID NO: 110650 - DNA, 20 bp, Artificial Sequence
  chemically synthesized
atgatagcagaagcacaaac

SEQ ID NO: 110651 - DNA, 20 bp, Artificial Sequence
  chemically synthesized
gaagcacaaacaggaatgta

SEQ ID NO: 110652 - DNA, 20 bp, Artificial Sequence
  chemically synthesized
caggaatgtatagatctctt

SEQ ID NO: 110653 - DNA, 20 bp, Artificial Sequence
  chemically synthesized
aggaatgtatagatctctta

SEQ ID NO: 110654 - DNA, 20 bp, Artificial Sequence
  chemically synthesized
gttttcagcctaggccttaa

SEQ ID NO: 110655 - DNA, 20 bp, Artificial Sequence
  chemically synthesized
tgtatagatctcttaaggcc

SEQ ID NO: 110656 - DNA, 20 bp, Artificial Sequence
  chemically synthesized
gtatagatctcttaaggcct

SEQ ID NO: 110657 - DNA, 20 bp, Artificial Sequence
  chemically synthesized
cagttttcagcctaggcctt

SEQ ID NO: 110658 - DNA, 20 bp, Artificial Sequence
  chemically synthesized
gaggtgacagttttcagcct

SEQ ID NO: 110659 - DNA, 20 bp, Artificial Sequence
  chemically synthesized
agaggtgacagttttcagcc

SEQ ID NO: 110660 - DNA, 20 bp, Artificial Sequence
  chemically synthesized
gagtgagaggtgacagtttt

SEQ ID NO: 110661 - DNA, 20 bp, Artificial Sequence
  chemically synthesized
tgagcaggagtgagaggtga

SEQ ID NO: 110662 - DNA, 20 bp, Artificial Sequence
  chemically synthesized
ggtaaatgagcaggagtgag

SEQ ID NO: 110663 - DNA, 20 bp, Artificial Sequence
  chemically synthesized
tggtaaatgagcaggagtga

SEQ ID NO: 110664 - DNA, 20 bp, Artificial Sequence
  chemically synthesized
aatggtaaatgagcaggagt

SEQ ID NO: 110665 - DNA, 20 bp, Artificial Sequence
  chemically synthesized
agcaaatggtaaatgagcag

SEQ ID NO: 110666 - DNA, 20 bp, Artificial Sequence
  chemically synthesized
ttagcaaatggtaaatgagc

SEQ ID NO: 110667 - DNA, 20 bp, Artificial Sequence
  chemically synthesized
tttagcaaatggtaaatgag

SEQ ID NO: 110668 - DNA, 20 bp, Artificial Sequence
  chemically synthesized
tgctttagcaaatggtaaat

SEQ ID NO: 110669 - DNA, 20 bp, Artificial Sequence
  chemically synthesized
tgctcatttaccatttgcta

SEQ ID NO: 110670 - DNA, 20 bp, Artificial Sequence
  chemically synthesized
atgtgatttgctttagcaaa

SEQ ID NO: 110671 - DNA, 20 bp, Artificial Sequence
  chemically synthesized
gttggccatgtgatttgctt

SEQ ID NO: 110672 - DNA, 20 bp, Artificial Sequence
  chemically synthesized
atttgctaaagcaaatcaca

SEQ ID NO: 110673 - DNA, 20 bp, Artificial Sequence
  chemically synthesized
aaatcacatggccaacccct

SEQ ID NO: 110674 - DNA, 20 bp, Artificial Sequence
  chemically synthesized
caacccctagtcttaggggt

SEQ ID NO: 110675 - DNA, 20 bp, Artificial Sequence
  chemically synthesized
acatggccaacccctaagac

SEQ ID NO: 110676 - DNA, 20 bp, Artificial Sequence
  chemically synthesized
ttcccaacccctagtcttag

SEQ ID NO: 110677 - DNA, 20 bp, Artificial Sequence
  chemically synthesized
catggccaacccctaagact

SEQ ID NO: 110678 - DNA, 20 bp, Artificial Sequence
  chemically synthesized
cttcccaacccctagtctta

SEQ ID NO: 110679 - DNA, 20 bp, Artificial Sequence
  chemically synthesized
atggccaacccctaagacta

SEQ ID NO: 110680 - DNA, 20 bp, Artificial Sequence
  chemically synthesized
acttcccaacccctagtctt

SEQ ID NO: 110681 - DNA, 20 bp, Artificial Sequence
  chemically synthesized
tggccaacccctaagactag

SEQ ID NO: 110682 - DNA, 20 bp, Artificial Sequence
  chemically synthesized
tacttcccaacccctagtct

SEQ ID NO: 110683 - DNA, 20 bp, Artificial Sequence
  chemically synthesized
caacccctaagactaggggt

SEQ ID NO: 110684 - DNA, 20 bp, Artificial Sequence
  chemically synthesized
aacccctaagactaggggtt

SEQ ID NO: 110685 - DNA, 20 bp, Artificial Sequence
  chemically synthesized
ggaatgtacttcccaacccc

SEQ ID NO: 110686 - DNA, 20 bp, Artificial Sequence
  chemically synthesized
ccctaagactaggggttggg

SEQ ID NO: 110687 - DNA, 20 bp, Artificial Sequence
  chemically synthesized
gggaagtacattccactcat

SEQ ID NO: 110688 - DNA, 20 bp, Artificial Sequence
  chemically synthesized
ggaagtacattccactcata

SEQ ID NO: 110689 - DNA, 20 bp, Artificial Sequence
  chemically synthesized
taacaatgcctccttatgag

SEQ ID NO: 110690 - DNA, 20 bp, Artificial Sequence
  chemically synthesized
aagtacattccactcataag

SEQ ID NO: 110691 - DNA, 20 bp, Artificial Sequence
  chemically synthesized
agtacattccactcataagg

SEQ ID NO: 110692 - DNA, 20 bp, Artificial Sequence
  chemically synthesized
ccttaacaatgcctccttat

SEQ ID NO: 110693 - DNA, 20 bp, Artificial Sequence
  chemically synthesized
actcataaggaggcattgtt

SEQ ID NO: 110694 - DNA, 20 bp, Artificial Sequence
  chemically synthesized
ctcataaggaggcattgtta

SEQ ID NO: 110695 - DNA, 20 bp, Artificial Sequence
  chemically synthesized
cattgttaaggttgtgattg

SEQ ID NO: 110696 - DNA, 20 bp, Artificial Sequence
  chemically synthesized
tgttaaggttgtgattgcag

SEQ ID NO: 110697 - DNA, 20 bp, Artificial Sequence
  chemically synthesized
gttaaggttgtgattgcaga

SEQ ID NO: 110698 - DNA, 20 bp, Artificial Sequence
  chemically synthesized
aaggttgtgattgcagaagg

SEQ ID NO: 110699 - DNA, 20 bp, Artificial Sequence
  chemically synthesized
ggttgtgattgcagaaggtg

SEQ ID NO: 110700 - DNA, 20 bp, Artificial Sequence
  chemically synthesized
tgtgattgcagaaggtggag

SEQ ID NO: 110701 - DNA, 20 bp, Artificial Sequence
  chemically synthesized
tgcagaaggtggagaagaaa

SEQ ID NO: 110702 - DNA, 20 bp, Artificial Sequence
  chemically synthesized
gcagaaggtggagaagaaat

SEQ ID NO: 110703 - DNA, 20 bp, Artificial Sequence
  chemically synthesized
attaatgattaaatctacta

SEQ ID NO: 110704 - DNA, 20 bp, Artificial Sequence
  chemically synthesized
aaactgttatgtagctgtag

SEQ ID NO: 110705 - DNA, 20 bp, Artificial Sequence
  chemically synthesized
aagaaactgttatgtagctg

SEQ ID NO: 110706 - DNA, 20 bp, Artificial Sequence
  chemically synthesized
aatctactacagctacataa

SEQ ID NO: 110707 - DNA, 20 bp, Artificial Sequence
  chemically synthesized
gctttaaagaaactgttatg

SEQ ID NO: 110708 - DNA, 20 bp, Artificial Sequence
  chemically synthesized
gctacataacagtttcttta

SEQ ID NO: 110709 - DNA, 20 bp, Artificial Sequence
  chemically synthesized
acataacagtttctttaaag

SEQ ID NO: 110710 - DNA, 20 bp, Artificial Sequence
  chemically synthesized
acaatatatcatctgcttta

SEQ ID NO: 110711 - DNA, 20 bp, Artificial Sequence
  chemically synthesized
ttaaagcagatgatatattg

SEQ ID NO: 110712 - DNA, 20 bp, Artificial Sequence
  chemically synthesized
attcagtcaaagatataagt

SEQ ID NO: 110713 - DNA, 20 bp, Artificial Sequence
  chemically synthesized
aagaattcagtcaaagatat

SEQ ID NO: 110714 - DNA, 20 bp, Artificial Sequence
  chemically synthesized
caccctgaagaattcagtca

SEQ ID NO: 110715 - DNA, 20 bp, Artificial Sequence
  chemically synthesized
atatctttgactgaattctt

SEQ ID NO: 110716 - DNA, 20 bp, Artificial Sequence
  chemically synthesized
aaattacaccctgaagaatt

SEQ ID NO: 110717 - DNA, 20 bp, Artificial Sequence
  chemically synthesized
tatctttgactgaattcttc

SEQ ID NO: 110718 - DNA, 20 bp, Artificial Sequence
  chemically synthesized
atctttgactgaattcttca

SEQ ID NO: 110719 - DNA, 20 bp, Artificial Sequence
  chemically synthesized
gtggcaaaaattacaccctg

SEQ ID NO: 110720 - DNA, 20 bp, Artificial Sequence
  chemically synthesized
tctagcacgggtaaatattg

SEQ ID NO: 110721 - DNA, 20 bp, Artificial Sequence
  chemically synthesized
gccacaatatttacccgtgc

SEQ ID NO: 110722 - DNA, 20 bp, Artificial Sequence
  chemically synthesized
acataacaatcatctagcac

SEQ ID NO: 110723 - DNA, 20 bp, Artificial Sequence
  chemically synthesized
tacataacaatcatctagca

SEQ ID NO: 110724 - DNA, 20 bp, Artificial Sequence
  chemically synthesized
aaaaatacataacaatcatc

SEQ ID NO: 110725 - DNA, 20 bp, Artificial Sequence
  chemically synthesized
ttatgtatttttattgttat

SEQ ID NO: 110726 - DNA, 20 bp, Artificial Sequence
  chemically synthesized
tatttcttaaatttagcagc

SEQ ID NO: 110727 - DNA, 20 bp, Artificial Sequence
  chemically synthesized
ctatttcttaaatttagcag

SEQ ID NO: 110728 - DNA, 20 bp, Artificial Sequence
  chemically synthesized
tctctatttcttaaatttag

SEQ ID NO: 110729 - DNA, 20 bp, Artificial Sequence
  chemically synthesized
attaacctgctgctaaattt

SEQ ID NO: 110730 - DNA, 20 bp, Artificial Sequence
  chemically synthesized
gattctctatttcttaaatt

SEQ ID NO: 110731 - DNA, 20 bp, Artificial Sequence
  chemically synthesized
ctgctgctaaatttaagaaa

SEQ ID NO: 110732 - DNA, 20 bp, Artificial Sequence
  chemically synthesized
gctgctaaatttaagaaata

SEQ ID NO: 110733 - DNA, 20 bp, Artificial Sequence
  chemically synthesized
agaatctggaaaaaaaaagt

SEQ ID NO: 110734 - DNA, 20 bp, Artificial Sequence
  chemically synthesized
tacaagaatctggaaaaaaa

SEQ ID NO: 110735 - DNA, 20 bp, Artificial Sequence
  chemically synthesized
agaatcttactttttttttc

SEQ ID NO: 110736 - DNA, 20 bp, Artificial Sequence
  chemically synthesized
taattccttatacaagaatc

SEQ ID NO: 110737 - DNA, 20 bp, Artificial Sequence
  chemically synthesized
ttttttccagattcttgtat

SEQ ID NO: 110738 - DNA, 20 bp, Artificial Sequence
  chemically synthesized
tttttccagattcttgtata

SEQ ID NO: 110739 - DNA, 20 bp, Artificial Sequence
  chemically synthesized
tgtcttttaattccttatac

SEQ ID NO: 110740 - DNA, 20 bp, Artificial Sequence
  chemically synthesized
attcttgtataaggaattaa

SEQ ID NO: 110741 - DNA, 20 bp, Artificial Sequence
  chemically synthesized
aattaaaagacatattttac

SEQ ID NO: 110742 - DNA, 20 bp, Artificial Sequence
  chemically synthesized
ttaaaagacatattttactg

SEQ ID NO: 110743 - DNA, 20 bp, Artificial Sequence
  chemically synthesized
taaaagacatattttactgg

SEQ ID NO: 110744 - DNA, 20 bp, Artificial Sequence
  chemically synthesized
cgctgttaaaggattgcctc

SEQ ID NO: 110745 - DNA, 20 bp, Artificial Sequence
  chemically synthesized
tactggaggcaatcctttaa

SEQ ID NO: 110746 - DNA, 20 bp, Artificial Sequence
  chemically synthesized
tggaggcaatcctttaacag

SEQ ID NO: 110747 - DNA, 20 bp, Artificial Sequence
  chemically synthesized
atactcacatccgctgttaa

SEQ ID NO: 110748 - DNA, 20 bp, Artificial Sequence
  chemically synthesized
tatactcacatccgctgtta

SEQ ID NO: 110749 - DNA, 20 bp, Artificial Sequence
  chemically synthesized
aatcctttaacagcggatgt

SEQ ID NO: 110750 - DNA, 20 bp, Artificial Sequence
  chemically synthesized
tttaacagcggatgtgagta

SEQ ID NO: 110751 - DNA, 20 bp, Artificial Sequence
  chemically synthesized
ttaacagcggatgtgagtat

SEQ ID NO: 110752 - DNA, 20 bp, Artificial Sequence
  chemically synthesized
acagcggatgtgagtatagg

SEQ ID NO: 110753 - DNA, 20 bp, Artificial Sequence
  chemically synthesized
ccctagactagacattgcat

SEQ ID NO: 110754 - DNA, 20 bp, Artificial Sequence
  chemically synthesized
aggcagactgatgcaatgtc

SEQ ID NO: 110755 - DNA, 20 bp, Artificial Sequence
  chemically synthesized
gactgatgcaatgtctagtc

SEQ ID NO: 110756 - DNA, 20 bp, Artificial Sequence
  chemically synthesized
actgatgcaatgtctagtct

SEQ ID NO: 110757 - DNA, 20 bp, Artificial Sequence
  chemically synthesized
ctgatgcaatgtctagtcta

SEQ ID NO: 110758 - DNA, 20 bp, Artificial Sequence
  chemically synthesized
gatgcaatgtctagtctagg

SEQ ID NO: 110759 - DNA, 20 bp, Artificial Sequence
  chemically synthesized
gcatgctctgctccctagac

SEQ ID NO: 110760 - DNA, 20 bp, Artificial Sequence
  chemically synthesized
gcaatgtctagtctagggag

SEQ ID NO: 110761 - DNA, 20 bp, Artificial Sequence
  chemically synthesized
aatgtctagtctagggagca

SEQ ID NO: 110762 - DNA, 20 bp, Artificial Sequence
  chemically synthesized
agatggcatgctctgctccc

SEQ ID NO: 110763 - DNA, 20 bp, Artificial Sequence
  chemically synthesized
gggagcagagcatgccatct

SEQ ID NO: 110764 - DNA, 20 bp, Artificial Sequence
  chemically synthesized
gacaagactcgtgactcaga

SEQ ID NO: 110765 - DNA, 20 bp, Artificial Sequence
  chemically synthesized
gagcatgccatctgagtcac

SEQ ID NO: 110766 - DNA, 20 bp, Artificial Sequence
  chemically synthesized
gtaagacaagactcgtgact

SEQ ID NO: 110767 - DNA, 20 bp, Artificial Sequence
  chemically synthesized
actccagagttgagtaagac

SEQ ID NO: 110768 - DNA, 20 bp, Artificial Sequence
  chemically synthesized
aagtaactccagagttgagt

SEQ ID NO: 110769 - DNA, 20 bp, Artificial Sequence
  chemically synthesized
agtcttgtcttactcaactc

SEQ ID NO: 110770 - DNA, 20 bp, Artificial Sequence
  chemically synthesized
tcttgtcttactcaactctg

SEQ ID NO: 110771 - DNA, 20 bp, Artificial Sequence
  chemically synthesized
aagtaagtaactccagagtt

SEQ ID NO: 110772 - DNA, 20 bp, Artificial Sequence
  chemically synthesized
tcttcaagtaagtaactcca

SEQ ID NO: 110773 - DNA, 20 bp, Artificial Sequence
  chemically synthesized
gctcttcaagtaagtaactc

SEQ ID NO: 110774 - DNA, 20 bp, Artificial Sequence
  chemically synthesized
actctggagttacttacttg

SEQ ID NO: 110775 - DNA, 20 bp, Artificial Sequence
  chemically synthesized
tctggagttacttacttgaa

SEQ ID NO: 110776 - DNA, 20 bp, Artificial Sequence
  chemically synthesized
atagtatatgctcttcaagt

SEQ ID NO: 110777 - DNA, 20 bp, Artificial Sequence
  chemically synthesized
ccatatagtatatgctcttc

SEQ ID NO: 110778 - DNA, 20 bp, Artificial Sequence
  chemically synthesized
cttgaagagcatatactata

SEQ ID NO: 110779 - DNA, 20 bp, Artificial Sequence
  chemically synthesized
ttgaagagcatatactatat

SEQ ID NO: 110780 - DNA, 20 bp, Artificial Sequence
  chemically synthesized
gttgtcttataattcccata

SEQ ID NO: 110781 - DNA, 20 bp, Artificial Sequence
  chemically synthesized
atatactatatgggaattat

SEQ ID NO: 110782 - DNA, 20 bp, Artificial Sequence
  chemically synthesized
tataagacaacactgcccct

SEQ ID NO: 110783 - DNA, 20 bp, Artificial Sequence
  chemically synthesized
ataagacaacactgccccta

SEQ ID NO: 110784 - DNA, 20 bp, Artificial Sequence
  chemically synthesized
tttcccaaactccttagggg

SEQ ID NO: 110785 - DNA, 20 bp, Artificial Sequence
  chemically synthesized
aagacaacactgcccctaag

SEQ ID NO: 110786 - DNA, 20 bp, Artificial Sequence
  chemically synthesized
aattttcccaaactccttag

SEQ ID NO: 110787 - DNA, 20 bp, Artificial Sequence
  chemically synthesized
taattttcccaaactcctta

SEQ ID NO: 110788 - DNA, 20 bp, Artificial Sequence
  chemically synthesized
ataattttcccaaactcctt

SEQ ID NO: 110789 - DNA, 20 bp, Artificial Sequence
  chemically synthesized
aacactgcccctaaggagtt

SEQ ID NO: 110790 - DNA, 20 bp, Artificial Sequence
  chemically synthesized
aataattttcccaaactcct

SEQ ID NO: 110791 - DNA, 20 bp, Artificial Sequence
  chemically synthesized
acactgcccctaaggagttt

SEQ ID NO: 110792 - DNA, 20 bp, Artificial Sequence
  chemically synthesized
tcttgcatattgtattggaa

SEQ ID NO: 110793 - DNA, 20 bp, Artificial Sequence
  chemically synthesized
tattttcttgcatattgtat

SEQ ID NO: 110794 - DNA, 20 bp, Artificial Sequence
  chemically synthesized
tcttttccaatacaatatgc

SEQ ID NO: 110795 - DNA, 20 bp, Artificial Sequence
  chemically synthesized
aagaaaatatttcacatcat

SEQ ID NO: 110796 - DNA, 20 bp, Artificial Sequence
  chemically synthesized
atatttcacatcatgagatt

SEQ ID NO: 110797 - DNA, 20 bp, Artificial Sequence
  chemically synthesized
gagatttagtcacttcctgt

SEQ ID NO: 110798 - DNA, 20 bp, Artificial Sequence
  chemically synthesized
tgctctggttgtcttacagg

SEQ ID NO: 110799 - DNA, 20 bp, Artificial Sequence
  chemically synthesized
ttttgctctggttgtcttac

SEQ ID NO: 110800 - DNA, 20 bp, Artificial Sequence
  chemically synthesized
tttttgctctggttgtctta

SEQ ID NO: 110801 - DNA, 20 bp, Artificial Sequence
  chemically synthesized
gtcacttcctgtaagacaac

SEQ ID NO: 110802 - DNA, 20 bp, Artificial Sequence
  chemically synthesized
cacttcctgtaagacaacca

SEQ ID NO: 110803 - DNA, 20 bp, Artificial Sequence
  chemically synthesized
tgtaagacaaccagagcaaa

SEQ ID NO: 110804 - DNA, 20 bp, Artificial Sequence
  chemically synthesized
actaagaagactttttgctc

SEQ ID NO: 110805 - DNA, 20 bp, Artificial Sequence
  chemically synthesized
accagagcaaaaagtcttct

SEQ ID NO: 110806 - DNA, 20 bp, Artificial Sequence
  chemically synthesized
gagcaaaaagtcttcttagt

SEQ ID NO: 110807 - DNA, 20 bp, Artificial Sequence
  chemically synthesized
acatggtgtatctgactaag

SEQ ID NO: 110808 - DNA, 20 bp, Artificial Sequence
  chemically synthesized
cctacatggtgtatctgact

SEQ ID NO: 110809 - DNA, 20 bp, Artificial Sequence
  chemically synthesized
tcttagtcagatacaccatg

SEQ ID NO: 110810 - DNA, 20 bp, Artificial Sequence
  chemically synthesized
cttagtcagatacaccatgt

SEQ ID NO: 110811 - DNA, 20 bp, Artificial Sequence
  chemically synthesized
gagagagtagtttgcctaca

SEQ ID NO: 110812 - DNA, 20 bp, Artificial Sequence
  chemically synthesized
atgcacaggtgatgagagag

SEQ ID NO: 110813 - DNA, 20 bp, Artificial Sequence
  chemically synthesized
tgcatgcacaggtgatgaga

SEQ ID NO: 110814 - DNA, 20 bp, Artificial Sequence
  chemically synthesized
cgtgcatgcacaggtgatga

SEQ ID NO: 110815 - DNA, 20 bp, Artificial Sequence
  chemically synthesized
cacgtgcatgcacaggtgat

SEQ ID NO: 110816 - DNA, 20 bp, Artificial Sequence
  chemically synthesized
gcacacacacgtgcatgcac

SEQ ID NO: 110817 - DNA, 20 bp, Artificial Sequence
  chemically synthesized
cgcacacacacgtgcatgca

SEQ ID NO: 110818 - DNA, 20 bp, Artificial Sequence
  chemically synthesized
aagttgtaattggaaacaga

SEQ ID NO: 110819 - DNA, 20 bp, Artificial Sequence
  chemically synthesized
aagtaagttgtaattggaaa

SEQ ID NO: 110820 - DNA, 20 bp, Artificial Sequence
  chemically synthesized
tgagaaaagtaagttgtaat

SEQ ID NO: 110821 - DNA, 20 bp, Artificial Sequence
  chemically synthesized
aaagacgagatgagaaaagt

SEQ ID NO: 110822 - DNA, 20 bp, Artificial Sequence
  chemically synthesized
tttgaaagacgagatgagaa

SEQ ID NO: 110823 - DNA, 20 bp, Artificial Sequence
  chemically synthesized
aagaatttgaaagacgagat

SEQ ID NO: 110824 - DNA, 20 bp, Artificial Sequence
  chemically synthesized
aaaacaagaatttgaaagac

SEQ ID NO: 110825 - DNA, 20 bp, Artificial Sequence
  chemically synthesized
ccagaaaaacaagaatttga

SEQ ID NO: 110826 - DNA, 20 bp, Artificial Sequence
  chemically synthesized
ctttcaaattcttgtttttc

SEQ ID NO: 110827 - DNA, 20 bp, Artificial Sequence
  chemically synthesized
tggaacaccaccagaaaaac

SEQ ID NO: 110828 - DNA, 20 bp, Artificial Sequence
  chemically synthesized
tcaaattcttgtttttctgg

SEQ ID NO: 110829 - DNA, 20 bp, Artificial Sequence
  chemically synthesized
ttacaaaaatggaacaccac

SEQ ID NO: 110830 - DNA, 20 bp, Artificial Sequence
  chemically synthesized
tacttttctatttacaaaaa

SEQ ID NO: 110831 - DNA, 20 bp, Artificial Sequence
  chemically synthesized
tggtgttccatttttgtaaa

SEQ ID NO: 110832 - DNA, 20 bp, Artificial Sequence
  chemically synthesized
ttccatttttgtaaatagaa

SEQ ID NO: 110833 - DNA, 20 bp, Artificial Sequence
  chemically synthesized
ttttgtaaatagaaaagtaa

SEQ ID NO: 110834 - DNA, 20 bp, Artificial Sequence
  chemically synthesized
tgtaaatagaaaagtaaaag

SEQ ID NO: 110835 - DNA, 20 bp, Artificial Sequence
  chemically synthesized
taaatagaaaagtaaaagaa

SEQ ID NO: 110836 - DNA, 20 bp, Artificial Sequence
  chemically synthesized
caccctctgagcaggttttt

SEQ ID NO: 110837 - DNA, 20 bp, Artificial Sequence
  chemically synthesized
agtgtgcttaaaaacctgct

SEQ ID NO: 110838 - DNA, 20 bp, Artificial Sequence
  chemically synthesized
tgtgcttaaaaacctgctca

SEQ ID NO: 110839 - DNA, 20 bp, Artificial Sequence
  chemically synthesized
gtgcttaaaaacctgctcag

SEQ ID NO: 110840 - DNA, 20 bp, Artificial Sequence
  chemically synthesized
tgcttaaaaacctgctcaga

SEQ ID NO: 110841 - DNA, 20 bp, Artificial Sequence
  chemically synthesized
ttgaaattcaccctctgagc

SEQ ID NO: 110842 - DNA, 20 bp, Artificial Sequence
  chemically synthesized
tttgaaattcaccctctgag

SEQ ID NO: 110843 - DNA, 20 bp, Artificial Sequence
  chemically synthesized
caatttgaaattcaccctct

SEQ ID NO: 110844 - DNA, 20 bp, Artificial Sequence
  chemically synthesized
tcagagggtgaatttcaaat

SEQ ID NO: 110845 - DNA, 20 bp, Artificial Sequence
  chemically synthesized
tttcaaattggcgtctctat

SEQ ID NO: 110846 - DNA, 20 bp, Artificial Sequence
  chemically synthesized
tcaaattggcgtctctatta

SEQ ID NO: 110847 - DNA, 20 bp, Artificial Sequence
  chemically synthesized
caaattggcgtctctattag

SEQ ID NO: 110848 - DNA, 20 bp, Artificial Sequence
  chemically synthesized
agcaaattagtcctctaata

SEQ ID NO: 110849 - DNA, 20 bp, Artificial Sequence
  chemically synthesized
aaagcaaattagtcctctaa

SEQ ID NO: 110850 - DNA, 20 bp, Artificial Sequence
  chemically synthesized
attgcacatagaaagcaaat

SEQ ID NO: 110851 - DNA, 20 bp, Artificial Sequence
  chemically synthesized
acaccaggattgcacataga

SEQ ID NO: 110852 - DNA, 20 bp, Artificial Sequence
  chemically synthesized
gatcacaccaggattgcaca

SEQ ID NO: 110853 - DNA, 20 bp, Artificial Sequence
  chemically synthesized
ttgctttctatgtgcaatcc

SEQ ID NO: 110854 - DNA, 20 bp, Artificial Sequence
  chemically synthesized
tatgcaacagtgatcacacc

SEQ ID NO: 110855 - DNA, 20 bp, Artificial Sequence
  chemically synthesized
atatgcaacagtgatcacac

SEQ ID NO: 110856 - DNA, 20 bp, Artificial Sequence
  chemically synthesized
aaatccagtaacatatgcaa

SEQ ID NO: 110857 - DNA, 20 bp, Artificial Sequence
  chemically synthesized
atcactgttgcatatgttac

SEQ ID NO: 110858 - DNA, 20 bp, Artificial Sequence
  chemically synthesized
ggggcagaggagttgaaatc

SEQ ID NO: 110859 - DNA, 20 bp, Artificial Sequence
  chemically synthesized
gagtttaggtaggggcagag

SEQ ID NO: 110860 - DNA, 20 bp, Artificial Sequence
  chemically synthesized
atgagtttaggtaggggcag

SEQ ID NO: 110861 - DNA, 20 bp, Artificial Sequence
  chemically synthesized
aatgagtttaggtaggggca

SEQ ID NO: 110862 - DNA, 20 bp, Artificial Sequence
  chemically synthesized
aaaatgagtttaggtagggg

SEQ ID NO: 110863 - DNA, 20 bp, Artificial Sequence
  chemically synthesized
ctcaaaatgagtttaggtag

SEQ ID NO: 110864 - DNA, 20 bp, Artificial Sequence
  chemically synthesized
tctcaaaatgagtttaggta

SEQ ID NO: 110865 - DNA, 20 bp, Artificial Sequence
  chemically synthesized
gtctcaaaatgagtttaggt

SEQ ID NO: 110866 - DNA, 20 bp, Artificial Sequence
  chemically synthesized
agtctcaaaatgagtttagg

SEQ ID NO: 110867 - DNA, 20 bp, Artificial Sequence
  chemically synthesized
gagagtctcaaaatgagttt

SEQ ID NO: 110868 - DNA, 20 bp, Artificial Sequence
  chemically synthesized
tgagagtctcaaaatgagtt

SEQ ID NO: 110869 - DNA, 20 bp, Artificial Sequence
  chemically synthesized
cccctacctaaactcatttt

SEQ ID NO: 110870 - DNA, 20 bp, Artificial Sequence
  chemically synthesized
ccatgtgagagtctcaaaat

SEQ ID NO: 110871 - DNA, 20 bp, Artificial Sequence
  chemically synthesized
ctcattttgagactctcaca

SEQ ID NO: 110872 - DNA, 20 bp, Artificial Sequence
  chemically synthesized
gctatcgacctaccatgtga

SEQ ID NO: 110873 - DNA, 20 bp, Artificial Sequence
  chemically synthesized
attttgagactctcacatgg

SEQ ID NO: 110874 - DNA, 20 bp, Artificial Sequence
  chemically synthesized
ttttgagactctcacatggt

SEQ ID NO: 110875 - DNA, 20 bp, Artificial Sequence
  chemically synthesized
aggctatcgacctaccatgt

SEQ ID NO: 110876 - DNA, 20 bp, Artificial Sequence
  chemically synthesized
actctcacatggtaggtcga

SEQ ID NO: 110877 - DNA, 20 bp, Artificial Sequence
  chemically synthesized
acatggtaggtcgatagcct

SEQ ID NO: 110878 - DNA, 20 bp, Artificial Sequence
  chemically synthesized
atttgagctccataaaactc

SEQ ID NO: 110879 - DNA, 20 bp, Artificial Sequence
  chemically synthesized
ggtcgatagcctgagtttta

SEQ ID NO: 110880 - DNA, 20 bp, Artificial Sequence
  chemically synthesized
catttgagctccataaaact

SEQ ID NO: 110881 - DNA, 20 bp, Artificial Sequence
  chemically synthesized
tcgatagcctgagttttatg

SEQ ID NO: 110882 - DNA, 20 bp, Artificial Sequence
  chemically synthesized
cagaagtcatgtcagcattt

SEQ ID NO: 110883 - DNA, 20 bp, Artificial Sequence
  chemically synthesized
aagtctgacagaagtcatgt

SEQ ID NO: 110884 - DNA, 20 bp, Artificial Sequence
  chemically synthesized
aatgctgacatgacttctgt

SEQ ID NO: 110885 - DNA, 20 bp, Artificial Sequence
  chemically synthesized
tgacaccagaagtctgacag

SEQ ID NO: 110886 - DNA, 20 bp, Artificial Sequence
  chemically synthesized
atgtgacaccagaagtctga

SEQ ID NO: 110887 - DNA, 20 bp, Artificial Sequence
  chemically synthesized
catgacttctgtcagacttc

SEQ ID NO: 110888 - DNA, 20 bp, Artificial Sequence
  chemically synthesized
ttcaccaaatgtgacaccag

SEQ ID NO: 110889 - DNA, 20 bp, Artificial Sequence
  chemically synthesized
tgcttcaccaaatgtgacac

SEQ ID NO: 110890 - DNA, 20 bp, Artificial Sequence
  chemically synthesized
cagacttctggtgtcacatt

SEQ ID NO: 110891 - DNA, 20 bp, Artificial Sequence
  chemically synthesized
ttctggtgtcacatttggtg

SEQ ID NO: 110892 - DNA, 20 bp, Artificial Sequence
  chemically synthesized
tgtcacatttggtgaagcac

SEQ ID NO: 110893 - DNA, 20 bp, Artificial Sequence
  chemically synthesized
gtcacatttggtgaagcacc

SEQ ID NO: 110894 - DNA, 20 bp, Artificial Sequence
  chemically synthesized
cacatttggtgaagcaccag

SEQ ID NO: 110895 - DNA, 20 bp, Artificial Sequence
  chemically synthesized
aatatggtagaatattctcc

SEQ ID NO: 110896 - DNA, 20 bp, Artificial Sequence
  chemically synthesized
caaaggaaagagaaatatgg

SEQ ID NO: 110897 - DNA, 20 bp, Artificial Sequence
  chemically synthesized
aaacaaaggaaagagaaata

SEQ ID NO: 110898 - DNA, 20 bp, Artificial Sequence
  chemically synthesized
gcctagtgaaacaaaggaaa

SEQ ID NO: 110899 - DNA, 20 bp, Artificial Sequence
  chemically synthesized
tggcctagtgaaacaaagga

SEQ ID NO: 110900 - DNA, 20 bp, Artificial Sequence
  chemically synthesized
actctggcctagtgaaacaa

SEQ ID NO: 110901 - DNA, 20 bp, Artificial Sequence
  chemically synthesized
tactctggcctagtgaaaca

SEQ ID NO: 110902 - DNA, 20 bp, Artificial Sequence
  chemically synthesized
ttctctttcctttgtttcac

SEQ ID NO: 110903 - DNA, 20 bp, Artificial Sequence
  chemically synthesized
tctctttcctttgtttcact

SEQ ID NO: 110904 - DNA, 20 bp, Artificial Sequence
  chemically synthesized
tttcctttgtttcactaggc

SEQ ID NO: 110905 - DNA, 20 bp, Artificial Sequence
  chemically synthesized
tcctttgtttcactaggcca

SEQ ID NO: 110906 - DNA, 20 bp, Artificial Sequence
  chemically synthesized
gagagaggactactctggcc

SEQ ID NO: 110907 - DNA, 20 bp, Artificial Sequence
  chemically synthesized
tttgtttcactaggccagag

SEQ ID NO: 110908 - DNA, 20 bp, Artificial Sequence
  chemically synthesized
caagggagagaggactactc

SEQ ID NO: 110909 - DNA, 20 bp, Artificial Sequence
  chemically synthesized
tctgataacccaagggagag

SEQ ID NO: 110910 - DNA, 20 bp, Artificial Sequence
  chemically synthesized
cagagtagtcctctctccct

SEQ ID NO: 110911 - DNA, 20 bp, Artificial Sequence
  chemically synthesized
gtctgataacccaagggaga

SEQ ID NO: 110912 - DNA, 20 bp, Artificial Sequence
  chemically synthesized
agagtagtcctctctccctt

SEQ ID NO: 110913 - DNA, 20 bp, Artificial Sequence
  chemically synthesized
aagtctgataacccaaggga

SEQ ID NO: 110914 - DNA, 20 bp, Artificial Sequence
  chemically synthesized
taaagtctgataacccaagg

SEQ ID NO: 110915 - DNA, 20 bp, Artificial Sequence
  chemically synthesized
tgtaaagtctgataacccaa

SEQ ID NO: 110916 - DNA, 20 bp, Artificial Sequence
  chemically synthesized
gtgtaaagtctgataaccca

SEQ ID NO: 110917 - DNA, 20 bp, Artificial Sequence
  chemically synthesized
tcctctctcccttgggttat

SEQ ID NO: 110918 - DNA, 20 bp, Artificial Sequence
  chemically synthesized
tgtgtaaagtctgataaccc

SEQ ID NO: 110919 - DNA, 20 bp, Artificial Sequence
  chemically synthesized
ggttatcagactttacacac

SEQ ID NO: 110920 - DNA, 20 bp, Artificial Sequence
  chemically synthesized
atatgctttgctagtgtgta

SEQ ID NO: 110921 - DNA, 20 bp, Artificial Sequence
  chemically synthesized
tcagactttacacactagca

SEQ ID NO: 110922 - DNA, 20 bp, Artificial Sequence
  chemically synthesized
atgccaatcatatgctttgc

SEQ ID NO: 110923 - DNA, 20 bp, Artificial Sequence
  chemically synthesized
acactagcaaagcatatgat

SEQ ID NO: 110924 - DNA, 20 bp, Artificial Sequence
  chemically synthesized
atggagtgggtaataagcaa

SEQ ID NO: 110925 - DNA, 20 bp, Artificial Sequence
  chemically synthesized
gaatggagtgggtaataagc

SEQ ID NO: 110926 - DNA, 20 bp, Artificial Sequence
  chemically synthesized
agaggaatggagtgggtaat

SEQ ID NO: 110927 - DNA, 20 bp, Artificial Sequence
  chemically synthesized
cagagagagaggaatggagt

SEQ ID NO: 110928 - DNA, 20 bp, Artificial Sequence
  chemically synthesized
acagagagagaggaatggag

SEQ ID NO: 110929 - DNA, 20 bp, Artificial Sequence
  chemically synthesized
gagacagagagagaggaatg

SEQ ID NO: 110930 - DNA, 20 bp, Artificial Sequence
  chemically synthesized
gagagacagagagagaggaa

SEQ ID NO: 110931 - DNA, 20 bp, Artificial Sequence
  chemically synthesized
agagagagagacagagagag

SEQ ID NO: 110932 - DNA, 20 bp, Artificial Sequence
  chemically synthesized
gagagagagagacagagaga

SEQ ID NO: 110933 - DNA, 20 bp, Artificial Sequence
  chemically synthesized
gggagagagagagacagaga

SEQ ID NO: 110934 - DNA, 20 bp, Artificial Sequence
  chemically synthesized
gagggagagagagagacaga

SEQ ID NO: 110935 - DNA, 20 bp, Artificial Sequence
  chemically synthesized
gagagggagagagagagaca

SEQ ID NO: 110936 - DNA, 20 bp, Artificial Sequence
  chemically synthesized
aggagagggagagagagaga

SEQ ID NO: 110937 - DNA, 20 bp, Artificial Sequence
  chemically synthesized
gggaaggagagggagagaga

SEQ ID NO: 110938 - DNA, 20 bp, Artificial Sequence
  chemically synthesized
atgggaaggagagggagaga

SEQ ID NO: 110939 - DNA, 20 bp, Artificial Sequence
  chemically synthesized
gaatgggaaggagagggaga

SEQ ID NO: 110940 - DNA, 20 bp, Artificial Sequence
  chemically synthesized
gagaatgggaaggagaggga

SEQ ID NO: 110941 - DNA, 20 bp, Artificial Sequence
  chemically synthesized
gggagaatgggaaggagagg

SEQ ID NO: 110942 - DNA, 20 bp, Artificial Sequence
  chemically synthesized
gagggagaatgggaaggaga

SEQ ID NO: 110943 - DNA, 20 bp, Artificial Sequence
  chemically synthesized
agagggagaatgggaaggag

SEQ ID NO: 110944 - DNA, 20 bp, Artificial Sequence
  chemically synthesized
cagagggagaatgggaagga

SEQ ID NO: 110945 - DNA, 20 bp, Artificial Sequence
  chemically synthesized
gacagagggagaatgggaag

SEQ ID NO: 110946 - DNA, 20 bp, Artificial Sequence
  chemically synthesized
aggacagagggagaatggga

SEQ ID NO: 110947 - DNA, 20 bp, Artificial Sequence
  chemically synthesized
aaggacagagggagaatggg

SEQ ID NO: 110948 - DNA, 20 bp, Artificial Sequence
  chemically synthesized
aggaaggacagagggagaat

SEQ ID NO: 110949 - DNA, 20 bp, Artificial Sequence
  chemically synthesized
caggaaggacagagggagaa

SEQ ID NO: 110950 - DNA, 20 bp, Artificial Sequence
  chemically synthesized
gagaacaggaaggacagagg

SEQ ID NO: 110951 - DNA, 20 bp, Artificial Sequence
  chemically synthesized
gggagaacaggaaggacaga

SEQ ID NO: 110952 - DNA, 20 bp, Artificial Sequence
  chemically synthesized
agggagaacaggaaggacag

SEQ ID NO: 110953 - DNA, 20 bp, Artificial Sequence
  chemically synthesized
gagggagaacaggaaggaca

SEQ ID NO: 110954 - DNA, 20 bp, Artificial Sequence
  chemically synthesized
gagagggagaacaggaagga

SEQ ID NO: 110955 - DNA, 20 bp, Artificial Sequence
  chemically synthesized
aggagagagggagaacagga

SEQ ID NO: 110956 - DNA, 20 bp, Artificial Sequence
  chemically synthesized
aaggagagagggagaacagg

SEQ ID NO: 110957 - DNA, 20 bp, Artificial Sequence
  chemically synthesized
agaaaggagagagggagaac

SEQ ID NO: 110958 - DNA, 20 bp, Artificial Sequence
  chemically synthesized
tagaaaggagagagggagaa

SEQ ID NO: 110959 - DNA, 20 bp, Artificial Sequence
  chemically synthesized
gaggatagaaaggagagagg

SEQ ID NO: 110960 - DNA, 20 bp, Artificial Sequence
  chemically synthesized
gggaggatagaaaggagaga

SEQ ID NO: 110961 - DNA, 20 bp, Artificial Sequence
  chemically synthesized
agggaggatagaaaggagag

SEQ ID NO: 110962 - DNA, 20 bp, Artificial Sequence
  chemically synthesized
gagggaggatagaaaggaga

SEQ ID NO: 110963 - DNA, 20 bp, Artificial Sequence
  chemically synthesized
gagagggaggatagaaagga

SEQ ID NO: 110964 - DNA, 20 bp, Artificial Sequence
  chemically synthesized
gagagagggaggatagaaag

SEQ ID NO: 110965 - DNA, 20 bp, Artificial Sequence
  chemically synthesized
aggagagagggaggatagaa

SEQ ID NO: 110966 - DNA, 20 bp, Artificial Sequence
  chemically synthesized
aaggagagagggaggataga

SEQ ID NO: 110967 - DNA, 20 bp, Artificial Sequence
  chemically synthesized
tgtgaaggagagagggagga

SEQ ID NO: 110968 - DNA, 20 bp, Artificial Sequence
  chemically synthesized
gaagtgtgaaggagagaggg

SEQ ID NO: 110969 - DNA, 20 bp, Artificial Sequence
  chemically synthesized
agaagtgtgaaggagagagg

SEQ ID NO: 110970 - DNA, 20 bp, Artificial Sequence
  chemically synthesized
agagaagtgtgaaggagaga

SEQ ID NO: 110971 - DNA, 20 bp, Artificial Sequence
  chemically synthesized
aagagaagtgtgaaggagag

SEQ ID NO: 110972 - DNA, 20 bp, Artificial Sequence
  chemically synthesized
gaagagaagtgtgaaggaga

SEQ ID NO: 110973 - DNA, 20 bp, Artificial Sequence
  chemically synthesized
gagaagagaagtgtgaagga

SEQ ID NO: 110974 - DNA, 20 bp, Artificial Sequence
  chemically synthesized
aggagaagagaagtgtgaag

SEQ ID NO: 110975 - DNA, 20 bp, Artificial Sequence
  chemically synthesized
agaggagaagagaagtgtga

SEQ ID NO: 110976 - DNA, 20 bp, Artificial Sequence
  chemically synthesized
gagaggagaagagaagtgtg

SEQ ID NO: 110977 - DNA, 20 bp, Artificial Sequence
  chemically synthesized
agacagagagaggagaagag

SEQ ID NO: 110978 - DNA, 20 bp, Artificial Sequence
  chemically synthesized
gagagacagagagaggagaa

SEQ ID NO: 110979 - DNA, 20 bp, Artificial Sequence
  chemically synthesized
tagagagacagagagaggag

SEQ ID NO: 110980 - DNA, 20 bp, Artificial Sequence
  chemically synthesized
ttttagagagacagagagag

SEQ ID NO: 110981 - DNA, 20 bp, Artificial Sequence
  chemically synthesized
gattttagagagacagagag

SEQ ID NO: 110982 - DNA, 20 bp, Artificial Sequence
  chemically synthesized
tgattttagagagacagaga

SEQ ID NO: 110983 - DNA, 20 bp, Artificial Sequence
  chemically synthesized
gttgattttagagagacaga

SEQ ID NO: 110984 - DNA, 20 bp, Artificial Sequence
  chemically synthesized
tagttgattttagagagaca

SEQ ID NO: 110985 - DNA, 20 bp, Artificial Sequence
  chemically synthesized
attagttgattttagagaga

SEQ ID NO: 110986 - DNA, 20 bp, Artificial Sequence
  chemically synthesized
aataattagttgattttaga

SEQ ID NO: 110987 - DNA, 20 bp, Artificial Sequence
  chemically synthesized
aaaataattagttgatttta

SEQ ID NO: 110988 - DNA, 20 bp, Artificial Sequence
  chemically synthesized
ggaaaataattagttgattt

SEQ ID NO: 110989 - DNA, 20 bp, Artificial Sequence
  chemically synthesized
tgattaaaatggaaaataat

SEQ ID NO: 110990 - DNA, 20 bp, Artificial Sequence
  chemically synthesized
acttatgaatgtgattaaaa

SEQ ID NO: 110991 - DNA, 20 bp, Artificial Sequence
  chemically synthesized
tccattttaatcacattcat

SEQ ID NO: 110992 - DNA, 20 bp, Artificial Sequence
  chemically synthesized
gtcaatatattttatgtgca

SEQ ID NO: 110993 - DNA, 20 bp, Artificial Sequence
  chemically synthesized
gtgcaaagaaatacatattc

SEQ ID NO: 110994 - DNA, 20 bp, Artificial Sequence
  chemically synthesized
gaaatacatattcaagaaaa

SEQ ID NO: 110995 - DNA, 20 bp, Artificial Sequence
  chemically synthesized
ttcaagaaaaaagttcaaat

SEQ ID NO: 110996 - DNA, 20 bp, Artificial Sequence
  chemically synthesized
acgacaacaaaaacctgttt

SEQ ID NO: 110997 - DNA, 20 bp, Artificial Sequence
  chemically synthesized
agattattttattctgaaac

SEQ ID NO: 110998 - DNA, 20 bp, Artificial Sequence
  chemically synthesized
aagattattttattctgaaa

SEQ ID NO: 110999 - DNA, 20 bp, Artificial Sequence
  chemically synthesized
aataaaataatcttctttgc

SEQ ID NO: 111000 - DNA, 20 bp, Artificial Sequence
  chemically synthesized
cttggttagttctagcaaag

SEQ ID NO: 111001 - DNA, 20 bp, Artificial Sequence
  chemically synthesized
gaacttggttagttctagca

SEQ ID NO: 111002 - DNA, 20 bp, Artificial Sequence
  chemically synthesized
agctagaacttggttagttc

SEQ ID NO: 111003 - DNA, 20 bp, Artificial Sequence
  chemically synthesized
cttctttgctagaactaacc

SEQ ID NO: 111004 - DNA, 20 bp, Artificial Sequence
  chemically synthesized
gacaccagctagaacttggt

SEQ ID NO: 111005 - DNA, 20 bp, Artificial Sequence
  chemically synthesized
tgctagaactaaccaagttc

SEQ ID NO: 111006 - DNA, 20 bp, Artificial Sequence
  chemically synthesized
taaagacaccagctagaact

SEQ ID NO: 111007 - DNA, 20 bp, Artificial Sequence
  chemically synthesized
agaactaaccaagttctagc

SEQ ID NO: 111008 - DNA, 20 bp, Artificial Sequence
  chemically synthesized
tgtgtcttaaagacaccagc

SEQ ID NO: 111009 - DNA, 20 bp, Artificial Sequence
  chemically synthesized
aatttgtgtcttaaagacac

SEQ ID NO: 111010 - DNA, 20 bp, Artificial Sequence
  chemically synthesized
aagttctagctggtgtcttt

SEQ ID NO: 111011 - DNA, 20 bp, Artificial Sequence
  chemically synthesized
ctagccaaatttgtgtctta

SEQ ID NO: 111012 - DNA, 20 bp, Artificial Sequence
  chemically synthesized
gtgtctttaagacacaaatt

SEQ ID NO: 111013 - DNA, 20 bp, Artificial Sequence
  chemically synthesized
ctttaagacacaaatttggc

SEQ ID NO: 111014 - DNA, 20 bp, Artificial Sequence
  chemically synthesized
aagacacaaatttggctaga

SEQ ID NO: 111015 - DNA, 20 bp, Artificial Sequence
  chemically synthesized
caaattaattagtaactttc

SEQ ID NO: 111016 - DNA, 20 bp, Artificial Sequence
  chemically synthesized
ggtatattttacaaattaat

SEQ ID NO: 111017 - DNA, 20 bp, Artificial Sequence
  chemically synthesized
taatttgtaaaatatacctg

SEQ ID NO: 111018 - DNA, 20 bp, Artificial Sequence
  chemically synthesized
aatttgtaaaatatacctga

SEQ ID NO: 111019 - DNA, 20 bp, Artificial Sequence
  chemically synthesized
tttgtaaaatatacctgaag

SEQ ID NO: 111020 - DNA, 20 bp, Artificial Sequence
  chemically synthesized
gtaaaaggcacaactccttc

SEQ ID NO: 111021 - DNA, 20 bp, Artificial Sequence
  chemically synthesized
cgtaaaaggcacaactcctt

SEQ ID NO: 111022 - DNA, 20 bp, Artificial Sequence
  chemically synthesized
tgaaggagttgtgcctttta

SEQ ID NO: 111023 - DNA, 20 bp, Artificial Sequence
  chemically synthesized
gaaggagttgtgccttttac

SEQ ID NO: 111024 - DNA, 20 bp, Artificial Sequence
  chemically synthesized
ttatctaagtatcccgtaaa

SEQ ID NO: 111025 - DNA, 20 bp, Artificial Sequence
  chemically synthesized
attatctaagtatcccgtaa

SEQ ID NO: 111026 - DNA, 20 bp, Artificial Sequence
  chemically synthesized
tgtgccttttacgggatact

SEQ ID NO: 111027 - DNA, 20 bp, Artificial Sequence
  chemically synthesized
tgatggtgaatagattatct

SEQ ID NO: 111028 - DNA, 20 bp, Artificial Sequence
  chemically synthesized
cacccctgactgatggtgaa

SEQ ID NO: 111029 - DNA, 20 bp, Artificial Sequence
  chemically synthesized
ttagataatctattcaccat

SEQ ID NO: 111030 - DNA, 20 bp, Artificial Sequence
  chemically synthesized
ataatctattcaccatcagt

SEQ ID NO: 111031 - DNA, 20 bp, Artificial Sequence
  chemically synthesized
taatctattcaccatcagtc

SEQ ID NO: 111032 - DNA, 20 bp, Artificial Sequence
  chemically synthesized
aatctattcaccatcagtca

SEQ ID NO: 111033 - DNA, 20 bp, Artificial Sequence
  chemically synthesized
tattacccacccctgactga

SEQ ID NO: 111034 - DNA, 20 bp, Artificial Sequence
  chemically synthesized
atctattcaccatcagtcag

SEQ ID NO: 111035 - DNA, 20 bp, Artificial Sequence
  chemically synthesized
tattcaccatcagtcagggg

SEQ ID NO: 111036 - DNA, 20 bp, Artificial Sequence
  chemically synthesized
attcaccatcagtcaggggt

SEQ ID NO: 111037 - DNA, 20 bp, Artificial Sequence
  chemically synthesized
agtacagaagagtagtcaga

SEQ ID NO: 111038 - DNA, 20 bp, Artificial Sequence
  chemically synthesized
aaagtacagaagagtagtca

SEQ ID NO: 111039 - DNA, 20 bp, Artificial Sequence
  chemically synthesized
aaaaagtacagaagagtagt

SEQ ID NO: 111040 - DNA, 20 bp, Artificial Sequence
  chemically synthesized
agataaaaagtacagaagag

SEQ ID NO: 111041 - DNA, 20 bp, Artificial Sequence
  chemically synthesized
ataagataaaaagtacagaa

SEQ ID NO: 111042 - DNA, 20 bp, Artificial Sequence
  chemically synthesized
atataagataaaaagtacag

SEQ ID NO: 111043 - DNA, 20 bp, Artificial Sequence
  chemically synthesized
tgtatataagataaaaagta

SEQ ID NO: 111044 - DNA, 20 bp, Artificial Sequence
  chemically synthesized
aagactgtatataagataaa

SEQ ID NO: 111045 - DNA, 20 bp, Artificial Sequence
  chemically synthesized
tgtactttttatcttatata

SEQ ID NO: 111046 - DNA, 20 bp, Artificial Sequence
  chemically synthesized
ctgtctgaaagactgtatat

SEQ ID NO: 111047 - DNA, 20 bp, Artificial Sequence
  chemically synthesized
ttatcttatatacagtcttt

SEQ ID NO: 111048 - DNA, 20 bp, Artificial Sequence
  chemically synthesized
cttatatacagtctttcaga

SEQ ID NO: 111049 - DNA, 20 bp, Artificial Sequence
  chemically synthesized
ttgaaatagattctgtctga

SEQ ID NO: 111050 - DNA, 20 bp, Artificial Sequence
  chemically synthesized
gtgtgtttactgtattgaaa

SEQ ID NO: 111051 - DNA, 20 bp, Artificial Sequence
  chemically synthesized
agacagaatctatttcaata

SEQ ID NO: 111052 - DNA, 20 bp, Artificial Sequence
  chemically synthesized
ggttttgttttgatttgatt

SEQ ID NO: 111053 - DNA, 20 bp, Artificial Sequence
  chemically synthesized
ttaatcaagagaaggaaaaa

SEQ ID NO: 111054 - DNA, 20 bp, Artificial Sequence
  chemically synthesized
gttaatcaagagaaggaaaa

SEQ ID NO: 111055 - DNA, 20 bp, Artificial Sequence
  chemically synthesized
aagtaaagttaatcaagaga

SEQ ID NO: 111056 - DNA, 20 bp, Artificial Sequence
  chemically synthesized
aaagtaaagttaatcaagag

SEQ ID NO: 111057 - DNA, 20 bp, Artificial Sequence
  chemically synthesized
tcaaaagtaaagttaatcaa

SEQ ID NO: 111058 - DNA, 20 bp, Artificial Sequence
  chemically synthesized
tctcaaaagtaaagttaatc

SEQ ID NO: 111059 - DNA, 20 bp, Artificial Sequence
  chemically synthesized
tcttgattaactttactttt

SEQ ID NO: 111060 - DNA, 20 bp, Artificial Sequence
  chemically synthesized
taatcaatttctcaaaagta

SEQ ID NO: 111061 - DNA, 20 bp, Artificial Sequence
  chemically synthesized
cattataatcaatttctcaa

SEQ ID NO: 111062 - DNA, 20 bp, Artificial Sequence
  chemically synthesized
caaaatgcatttttatgata

SEQ ID NO: 111063 - DNA, 20 bp, Artificial Sequence
  chemically synthesized
aaatgcatttttatgataaa

SEQ ID NO: 111064 - DNA, 20 bp, Artificial Sequence
  chemically synthesized
tgcatttttatgataaagag

SEQ ID NO: 111065 - DNA, 20 bp, Artificial Sequence
  chemically synthesized
aagagaagattccctaaatc

SEQ ID NO: 111066 - DNA, 20 bp, Artificial Sequence
  chemically synthesized
tatgtctcagtcttgattta

SEQ ID NO: 111067 - DNA, 20 bp, Artificial Sequence
  chemically synthesized
ttatgtctcagtcttgattt

SEQ ID NO: 111068 - DNA, 20 bp, Artificial Sequence
  chemically synthesized
attatgtctcagtcttgatt

SEQ ID NO: 111069 - DNA, 20 bp, Artificial Sequence
  chemically synthesized
agattccctaaatcaagact

SEQ ID NO: 111070 - DNA, 20 bp, Artificial Sequence
  chemically synthesized
aatttttcacaattatgtct

SEQ ID NO: 111071 - DNA, 20 bp, Artificial Sequence
  chemically synthesized
agacataattgtgaaaaatt

SEQ ID NO: 111072 - DNA, 20 bp, Artificial Sequence
  chemically synthesized
ataattgtgaaaaattcagc

SEQ ID NO: 111073 - DNA, 20 bp, Artificial Sequence
  chemically synthesized
acttaatccaattataatac

SEQ ID NO: 111074 - DNA, 20 bp, Artificial Sequence
  chemically synthesized
aattcagccagtattataat

SEQ ID NO: 111075 - DNA, 20 bp, Artificial Sequence
  chemically synthesized
gccagtattataattggatt

SEQ ID NO: 111076 - DNA, 20 bp, Artificial Sequence
  chemically synthesized
attataattggattaagtta

SEQ ID NO: 111077 - DNA, 20 bp, Artificial Sequence
  chemically synthesized
ttataattggattaagttat

SEQ ID NO: 111078 - DNA, 20 bp, Artificial Sequence
  chemically synthesized
tatgggattcaacctgaaaa

SEQ ID NO: 111079 - DNA, 20 bp, Artificial Sequence
  chemically synthesized
gaataaaaatttcttttttc

SEQ ID NO: 111080 - DNA, 20 bp, Artificial Sequence
  chemically synthesized
agaataaaaatttctttttt

SEQ ID NO: 111081 - DNA, 20 bp, Artificial Sequence
  chemically synthesized
atatgaccaaattacaatat

SEQ ID NO: 111082 - DNA, 20 bp, Artificial Sequence
  chemically synthesized
tttattctgatattgtaatt

SEQ ID NO: 111083 - DNA, 20 bp, Artificial Sequence
  chemically synthesized
atattgtaatttggtcatat

SEQ ID NO: 111084 - DNA, 20 bp, Artificial Sequence
  chemically synthesized
tattgtaatttggtcatatt

SEQ ID NO: 111085 - DNA, 20 bp, Artificial Sequence
  chemically synthesized
taatttggtcatattaggct

SEQ ID NO: 111086 - DNA, 20 bp, Artificial Sequence
  chemically synthesized
catgacattaaattatatct

SEQ ID NO: 111087 - DNA, 20 bp, Artificial Sequence
  chemically synthesized
aagatataatttaatgtcat

SEQ ID NO: 111088 - DNA, 20 bp, Artificial Sequence
  chemically synthesized
aatttaatgtcatgagtcat

SEQ ID NO: 111089 - DNA, 20 bp, Artificial Sequence
  chemically synthesized
tttaatgtcatgagtcatta

SEQ ID NO: 111090 - DNA, 20 bp, Artificial Sequence
  chemically synthesized
attagagtgtaacattgtac

SEQ ID NO: 111091 - DNA, 20 bp, Artificial Sequence
  chemically synthesized
taacattgtactagtgatca

SEQ ID NO: 111092 - DNA, 20 bp, Artificial Sequence
  chemically synthesized
tccatcagagccatgatcac

SEQ ID NO: 111093 - DNA, 20 bp, Artificial Sequence
  chemically synthesized
actagtgatcatggctctga

SEQ ID NO: 111094 - DNA, 20 bp, Artificial Sequence
  chemically synthesized
tagtgatcatggctctgatg

SEQ ID NO: 111095 - DNA, 20 bp, Artificial Sequence
  chemically synthesized
agtgatcatggctctgatgg

SEQ ID NO: 111096 - DNA, 20 bp, Artificial Sequence
  chemically synthesized
aactgtccatgcctccatca

SEQ ID NO: 111097 - DNA, 20 bp, Artificial Sequence
  chemically synthesized
aaaactgtccatgcctccat

SEQ ID NO: 111098 - DNA, 20 bp, Artificial Sequence
  chemically synthesized
tcatggctctgatggaggca

SEQ ID NO: 111099 - DNA, 20 bp, Artificial Sequence
  chemically synthesized
ggctctgatggaggcatgga

SEQ ID NO: 111100 - DNA, 20 bp, Artificial Sequence
  chemically synthesized
gcatggacagtttttatgca

SEQ ID NO: 111101 - DNA, 20 bp, Artificial Sequence
  chemically synthesized
catggacagtttttatgcaa

SEQ ID NO: 111102 - DNA, 20 bp, Artificial Sequence
  chemically synthesized
atggacagtttttatgcaaa

SEQ ID NO: 111103 - DNA, 20 bp, Artificial Sequence
  chemically synthesized
caaagggaaaaacatgaaaa

SEQ ID NO: 111104 - DNA, 20 bp, Artificial Sequence
  chemically synthesized
gaaaaacatgaaaatggtaa

SEQ ID NO: 111105 - DNA, 20 bp, Artificial Sequence
  chemically synthesized
aaacatgaaaatggtaatgg

SEQ ID NO: 111106 - DNA, 20 bp, Artificial Sequence
  chemically synthesized
aaaatggtaatggaagcctt

SEQ ID NO: 111107 - DNA, 20 bp, Artificial Sequence
  chemically synthesized
aaatggtaatggaagccttt

SEQ ID NO: 111108 - DNA, 20 bp, Artificial Sequence
  chemically synthesized
ctaagccagatgacacctaa

SEQ ID NO: 111109 - DNA, 20 bp, Artificial Sequence
  chemically synthesized
gctaagccagatgacaccta

SEQ ID NO: 111110 - DNA, 20 bp, Artificial Sequence
  chemically synthesized
ggaagcctttaggtgtcatc

SEQ ID NO: 111111 - DNA, 20 bp, Artificial Sequence
  chemically synthesized
cctttaggtgtcatctggct

SEQ ID NO: 111112 - DNA, 20 bp, Artificial Sequence
  chemically synthesized
tacaaaaggaaaagctaagc

SEQ ID NO: 111113 - DNA, 20 bp, Artificial Sequence
  chemically synthesized
aagatacaaaaggaaaagct

SEQ ID NO: 111114 - DNA, 20 bp, Artificial Sequence
  chemically synthesized
ttttgaagatacaaaaggaa

SEQ ID NO: 111115 - DNA, 20 bp, Artificial Sequence
  chemically synthesized
cactgttttgaagatacaaa

SEQ ID NO: 111116 - DNA, 20 bp, Artificial Sequence
  chemically synthesized
ccactgttttgaagatacaa

SEQ ID NO: 111117 - DNA, 20 bp, Artificial Sequence
  chemically synthesized
ttccttttgtatcttcaaaa

SEQ ID NO: 111118 - DNA, 20 bp, Artificial Sequence
  chemically synthesized
ttattcttcccactgttttg

SEQ ID NO: 111119 - DNA, 20 bp, Artificial Sequence
  chemically synthesized
cttttgtatcttcaaaacag

SEQ ID NO: 111120 - DNA, 20 bp, Artificial Sequence
  chemically synthesized
ttttgtatcttcaaaacagt

SEQ ID NO: 111121 - DNA, 20 bp, Artificial Sequence
  chemically synthesized
tgtatcttcaaaacagtggg

SEQ ID NO: 111122 - DNA, 20 bp, Artificial Sequence
  chemically synthesized
agtggctagccaatcaagaa

SEQ ID NO: 111123 - DNA, 20 bp, Artificial Sequence
  chemically synthesized
taaacaatactattcttgat

SEQ ID NO: 111124 - DNA, 20 bp, Artificial Sequence
  chemically synthesized
caatactattcttgattggc

SEQ ID NO: 111125 - DNA, 20 bp, Artificial Sequence
  chemically synthesized
tctccagtggctagccaatc

SEQ ID NO: 111126 - DNA, 20 bp, Artificial Sequence
  chemically synthesized
attcttgattggctagccac

SEQ ID NO: 111127 - DNA, 20 bp, Artificial Sequence
  chemically synthesized
tcttgattggctagccactg

SEQ ID NO: 111128 - DNA, 20 bp, Artificial Sequence
  chemically synthesized
gtatccccatctccagtggc

SEQ ID NO: 111129 - DNA, 20 bp, Artificial Sequence
  chemically synthesized
gattggctagccactggaga

SEQ ID NO: 111130 - DNA, 20 bp, Artificial Sequence
  chemically synthesized
tttggtatccccatctccag

SEQ ID NO: 111131 - DNA, 20 bp, Artificial Sequence
  chemically synthesized
attggctagccactggagat

SEQ ID NO: 111132 - DNA, 20 bp, Artificial Sequence
  chemically synthesized
ttggctagccactggagatg

SEQ ID NO: 111133 - DNA, 20 bp, Artificial Sequence
  chemically synthesized
tcatttggtatccccatctc

SEQ ID NO: 111134 - DNA, 20 bp, Artificial Sequence
  chemically synthesized
gttggagcatttttttcatt

SEQ ID NO: 111135 - DNA, 20 bp, Artificial Sequence
  chemically synthesized
tgaaaaaaatgctccaacac

SEQ ID NO: 111136 - DNA, 20 bp, Artificial Sequence
  chemically synthesized
aatacttcctgcttgtgttg

SEQ ID NO: 111137 - DNA, 20 bp, Artificial Sequence
  chemically synthesized
aaaaaatgctccaacacaag

SEQ ID NO: 111138 - DNA, 20 bp, Artificial Sequence
  chemically synthesized
ataatacttcctgcttgtgt

SEQ ID NO: 111139 - DNA, 20 bp, Artificial Sequence
  chemically synthesized
aaaaatgctccaacacaagc

SEQ ID NO: 111140 - DNA, 20 bp, Artificial Sequence
  chemically synthesized
aatgctccaacacaagcagg

SEQ ID NO: 111141 - DNA, 20 bp, Artificial Sequence
  chemically synthesized
ttttgcaggataaagaaatg

SEQ ID NO: 111142 - DNA, 20 bp, Artificial Sequence
  chemically synthesized
ctctgtgcttttgcaggata

SEQ ID NO: 111143 - DNA, 20 bp, Artificial Sequence
  chemically synthesized
ttcatttctttatcctgcaa

SEQ ID NO: 111144 - DNA, 20 bp, Artificial Sequence
  chemically synthesized
cagagtctctgtgcttttgc

SEQ ID NO: 111145 - DNA, 20 bp, Artificial Sequence
  chemically synthesized
acagagtctctgtgcttttg

SEQ ID NO: 111146 - DNA, 20 bp, Artificial Sequence
  chemically synthesized
ttctttatcctgcaaaagca

SEQ ID NO: 111147 - DNA, 20 bp, Artificial Sequence
  chemically synthesized
ctttatcctgcaaaagcaca

SEQ ID NO: 111148 - DNA, 20 bp, Artificial Sequence
  chemically synthesized
agcacagagactctgtcttg

SEQ ID NO: 111149 - DNA, 20 bp, Artificial Sequence
  chemically synthesized
aaaaatgattctgcaagaca

SEQ ID NO: 111150 - DNA, 20 bp, Artificial Sequence
  chemically synthesized
aaaaaaatgattctgcaaga

SEQ ID NO: 111151 - DNA, 20 bp, Artificial Sequence
  chemically synthesized
aaaaaaaaaaatgattctgc

SEQ ID NO: 111152 - DNA, 20 bp, Artificial Sequence
  chemically synthesized
tttttttttttttcaaattt

SEQ ID NO: 111153 - DNA, 20 bp, Artificial Sequence
  chemically synthesized
tttttttttttcaaatttca

SEQ ID NO: 111154 - DNA, 20 bp, Artificial Sequence
  chemically synthesized
ttttcaaatttcagagctga

SEQ ID NO: 111155 - DNA, 20 bp, Artificial Sequence
  chemically synthesized
tttcaaatttcagagctgaa

SEQ ID NO: 111156 - DNA, 20 bp, Artificial Sequence
  chemically synthesized
ttcaaatttcagagctgaaa

SEQ ID NO: 111157 - DNA, 20 bp, Artificial Sequence
  chemically synthesized
tgttttgcttatggcccttt

SEQ ID NO: 111158 - DNA, 20 bp, Artificial Sequence
  chemically synthesized
ttcagagctgaaagggccat

SEQ ID NO: 111159 - DNA, 20 bp, Artificial Sequence
  chemically synthesized
tagaccagatgttttgctta

SEQ ID NO: 111160 - DNA, 20 bp, Artificial Sequence
  chemically synthesized
agggccataagcaaaacatc

SEQ ID NO: 111161 - DNA, 20 bp, Artificial Sequence
  chemically synthesized
cataagcaaaacatctggtc

SEQ ID NO: 111162 - DNA, 20 bp, Artificial Sequence
  chemically synthesized
aagcaaaacatctggtctag

SEQ ID NO: 111163 - DNA, 20 bp, Artificial Sequence
  chemically synthesized
aaatttgagaaccactagac

SEQ ID NO: 111164 - DNA, 20 bp, Artificial Sequence
  chemically synthesized
cacttaaatttgagaaccac

SEQ ID NO: 111165 - DNA, 20 bp, Artificial Sequence
  chemically synthesized
gtctagtggttctcaaattt

SEQ ID NO: 111166 - DNA, 20 bp, Artificial Sequence
  chemically synthesized
tcttgtgcccacttaaattt

SEQ ID NO: 111167 - DNA, 20 bp, Artificial Sequence
  chemically synthesized
tagtggttctcaaatttaag

SEQ ID NO: 111168 - DNA, 20 bp, Artificial Sequence
  chemically synthesized
agtggttctcaaatttaagt

SEQ ID NO: 111169 - DNA, 20 bp, Artificial Sequence
  chemically synthesized
tctcaaatttaagtgggcac

SEQ ID NO: 111170 - DNA, 20 bp, Artificial Sequence
  chemically synthesized
aagtgggcacaagaactacc

SEQ ID NO: 111171 - DNA, 20 bp, Artificial Sequence
  chemically synthesized
agtgggcacaagaactacct

SEQ ID NO: 111172 - DNA, 20 bp, Artificial Sequence
  chemically synthesized
gtgggcacaagaactaccta

SEQ ID NO: 111173 - DNA, 20 bp, Artificial Sequence
  chemically synthesized
tgggcacaagaactacctag

SEQ ID NO: 111174 - DNA, 20 bp, Artificial Sequence
  chemically synthesized
atatgtaaagagcccctagg

SEQ ID NO: 111175 - DNA, 20 bp, Artificial Sequence
  chemically synthesized
tgcatatgtaaagagcccct

SEQ ID NO: 111176 - DNA, 20 bp, Artificial Sequence
  chemically synthesized
ctgcatatgtaaagagcccc

SEQ ID NO: 111177 - DNA, 20 bp, Artificial Sequence
  chemically synthesized
gtggaatctgcatatgtaaa

SEQ ID NO: 111178 - DNA, 20 bp, Artificial Sequence
  chemically synthesized
tcgtggaatctgcatatgta

SEQ ID NO: 111179 - DNA, 20 bp, Artificial Sequence
  chemically synthesized
ctaggggctctttacatatg

SEQ ID NO: 111180 - DNA, 20 bp, Artificial Sequence
  chemically synthesized
agctctctggggatgggtcg

SEQ ID NO: 111181 - DNA, 20 bp, Artificial Sequence
  chemically synthesized
cagattccacgacccatccc

SEQ ID NO: 111182 - DNA, 20 bp, Artificial Sequence
  chemically synthesized
gattccacgacccatcccca

SEQ ID NO: 111183 - DNA, 20 bp, Artificial Sequence
  chemically synthesized
gtcagaagctctctggggat

SEQ ID NO: 111184 - DNA, 20 bp, Artificial Sequence
  chemically synthesized
tgtcagaagctctctgggga

SEQ ID NO: 111185 - DNA, 20 bp, Artificial Sequence
  chemically synthesized
ttccacgacccatccccaga

SEQ ID NO: 111186 - DNA, 20 bp, Artificial Sequence
  chemically synthesized
attgtgtcagaagctctctg

SEQ ID NO: 111187 - DNA, 20 bp, Artificial Sequence
  chemically synthesized
cattgtgtcagaagctctct

SEQ ID NO: 111188 - DNA, 20 bp, Artificial Sequence
  chemically synthesized
gcattgtgtcagaagctctc

SEQ ID NO: 111189 - DNA, 20 bp, Artificial Sequence
  chemically synthesized
ttaaaaatgcattgtgtcag

SEQ ID NO: 111190 - DNA, 20 bp, Artificial Sequence
  chemically synthesized
ttattaaaaatgcattgtgt

SEQ ID NO: 111191 - DNA, 20 bp, Artificial Sequence
  chemically synthesized
gacacaatgcatttttaata

SEQ ID NO: 111192 - DNA, 20 bp, Artificial Sequence
  chemically synthesized
gcatttttaataaagtttcc

SEQ ID NO: 111193 - DNA, 20 bp, Artificial Sequence
  chemically synthesized
tttaataaagtttccaagta

SEQ ID NO: 111194 - DNA, 20 bp, Artificial Sequence
  chemically synthesized
ccacggacaccatctttact

SEQ ID NO: 111195 - DNA, 20 bp, Artificial Sequence
  chemically synthesized
ataaagtttccaagtaaaga

SEQ ID NO: 111196 - DNA, 20 bp, Artificial Sequence
  chemically synthesized
ccaagtaaagatggtgtccg

SEQ ID NO: 111197 - DNA, 20 bp, Artificial Sequence
  chemically synthesized
ttctccaggtttacatacca

SEQ ID NO: 111198 - DNA, 20 bp, Artificial Sequence
  chemically synthesized
gtgtccgtggtatgtaaacc

SEQ ID NO: 111199 - DNA, 20 bp, Artificial Sequence
  chemically synthesized
gtccgtggtatgtaaacctg

SEQ ID NO: 111200 - DNA, 20 bp, Artificial Sequence
  chemically synthesized
ggtaaaagatatgtttctcc

SEQ ID NO: 111201 - DNA, 20 bp, Artificial Sequence
  chemically synthesized
aggtaaaagatatgtttctc

SEQ ID NO: 111202 - DNA, 20 bp, Artificial Sequence
  chemically synthesized
ggagaaacatatcttttacc

SEQ ID NO: 111203 - DNA, 20 bp, Artificial Sequence
  chemically synthesized
aaaatgatggatctaggtaa

SEQ ID NO: 111204 - DNA, 20 bp, Artificial Sequence
  chemically synthesized
ttctgaaaaatgatggatct

SEQ ID NO: 111205 - DNA, 20 bp, Artificial Sequence
  chemically synthesized
cttctgaaaaatgatggatc

SEQ ID NO: 111206 - DNA, 20 bp, Artificial Sequence
  chemically synthesized
gttgatcttctgaaaaatga

SEQ ID NO: 111207 - DNA, 20 bp, Artificial Sequence
  chemically synthesized
tacctagatccatcattttt

SEQ ID NO: 111208 - DNA, 20 bp, Artificial Sequence
  chemically synthesized
ctagatccatcatttttcag

SEQ ID NO: 111209 - DNA, 20 bp, Artificial Sequence
  chemically synthesized
atttttcagaagatcaacct

SEQ ID NO: 111210 - DNA, 20 bp, Artificial Sequence
  chemically synthesized
tcagtgctgttggagatctc

SEQ ID NO: 111211 - DNA, 20 bp, Artificial Sequence
  chemically synthesized
gtcagtgctgttggagatct

SEQ ID NO: 111212 - DNA, 20 bp, Artificial Sequence
  chemically synthesized
gatcaacctgagatctccaa

SEQ ID NO: 111213 - DNA, 20 bp, Artificial Sequence
  chemically synthesized
tggggaagtcagtgctgttg

SEQ ID NO: 111214 - DNA, 20 bp, Artificial Sequence
  chemically synthesized
cctggggaagtcagtgctgt

SEQ ID NO: 111215 - DNA, 20 bp, Artificial Sequence
  chemically synthesized
tccaacagcactgacttccc

SEQ ID NO: 111216 - DNA, 20 bp, Artificial Sequence
  chemically synthesized
ctctgtaatcctggggaagt

SEQ ID NO: 111217 - DNA, 20 bp, Artificial Sequence
  chemically synthesized
ccaacagcactgacttcccc

SEQ ID NO: 111218 - DNA, 20 bp, Artificial Sequence
  chemically synthesized
tagcctctgtaatcctgggg

SEQ ID NO: 111219 - DNA, 20 bp, Artificial Sequence
  chemically synthesized
cactagcctctgtaatcctg

SEQ ID NO: 111220 - DNA, 20 bp, Artificial Sequence
  chemically synthesized
cactgacttccccaggatta

SEQ ID NO: 111221 - DNA, 20 bp, Artificial Sequence
  chemically synthesized
acactagcctctgtaatcct

SEQ ID NO: 111222 - DNA, 20 bp, Artificial Sequence
  chemically synthesized
aacactagcctctgtaatcc

SEQ ID NO: 111223 - DNA, 20 bp, Artificial Sequence
  chemically synthesized
ctgacttccccaggattaca

SEQ ID NO: 111224 - DNA, 20 bp, Artificial Sequence
  chemically synthesized
tgacttccccaggattacag

SEQ ID NO: 111225 - DNA, 20 bp, Artificial Sequence
  chemically synthesized
ttccccaggattacagaggc

SEQ ID NO: 111226 - DNA, 20 bp, Artificial Sequence
  chemically synthesized
ggattacagaggctagtgtt

SEQ ID NO: 111227 - DNA, 20 bp, Artificial Sequence
  chemically synthesized
gattacagaggctagtgttt

SEQ ID NO: 111228 - DNA, 20 bp, Artificial Sequence
  chemically synthesized
agggtcctgttcctaaacac

SEQ ID NO: 111229 - DNA, 20 bp, Artificial Sequence
  chemically synthesized
cagaggctagtgtttaggaa

SEQ ID NO: 111230 - DNA, 20 bp, Artificial Sequence
  chemically synthesized
agaggctagtgtttaggaac

SEQ ID NO: 111231 - DNA, 20 bp, Artificial Sequence
  chemically synthesized
tattttaagtcaagaagtta

SEQ ID NO: 111232 - DNA, 20 bp, Artificial Sequence
  chemically synthesized
ttattttaagtcaagaagtt

SEQ ID NO: 111233 - DNA, 20 bp, Artificial Sequence
  chemically synthesized
cttattttaagtcaagaagt

SEQ ID NO: 111234 - DNA, 20 bp, Artificial Sequence
  chemically synthesized
atatcttattttaagtcaag

SEQ ID NO: 111235 - DNA, 20 bp, Artificial Sequence
  chemically synthesized
aaaatatcttattttaagtc

SEQ ID NO: 111236 - DNA, 20 bp, Artificial Sequence
  chemically synthesized
ctaacttcttgacttaaaat

SEQ ID NO: 111237 - DNA, 20 bp, Artificial Sequence
  chemically synthesized
agtgcaaaatatcttatttt

SEQ ID NO: 111238 - DNA, 20 bp, Artificial Sequence
  chemically synthesized
gaagtattaaggtatttaga

SEQ ID NO: 111239 - DNA, 20 bp, Artificial Sequence
  chemically synthesized
tagaagtattaaggtattta

SEQ ID NO: 111240 - DNA, 20 bp, Artificial Sequence
  chemically synthesized
aatagaagtattaaggtatt

SEQ ID NO: 111241 - DNA, 20 bp, Artificial Sequence
  chemically synthesized
tttttttaatagaagtatta

SEQ ID NO: 111242 - DNA, 20 bp, Artificial Sequence
  chemically synthesized
ctttttttaatagaagtatt

SEQ ID NO: 111243 - DNA, 20 bp, Artificial Sequence
  chemically synthesized
tctaaaactttttttaatag

SEQ ID NO: 111244 - DNA, 20 bp, Artificial Sequence
  chemically synthesized
cttaatacttctattaaaaa

SEQ ID NO: 111245 - DNA, 20 bp, Artificial Sequence
  chemically synthesized
gactctaaaactttttttaa

SEQ ID NO: 111246 - DNA, 20 bp, Artificial Sequence
  chemically synthesized
acttctattaaaaaaagttt

SEQ ID NO: 111247 - DNA, 20 bp, Artificial Sequence
  chemically synthesized
ttctattaaaaaaagtttta

SEQ ID NO: 111248 - DNA, 20 bp, Artificial Sequence
  chemically synthesized
aaaaaagttttagagtctgt

SEQ ID NO: 111249 - DNA, 20 bp, Artificial Sequence
  chemically synthesized
gttttagagtctgttagctg

SEQ ID NO: 111250 - DNA, 20 bp, Artificial Sequence
  chemically synthesized
ggcacagcttcttcagctaa

SEQ ID NO: 111251 - DNA, 20 bp, Artificial Sequence
  chemically synthesized
ttagagtctgttagctgaag

SEQ ID NO: 111252 - DNA, 20 bp, Artificial Sequence
  chemically synthesized
ttaaaaaggcacagcttctt

SEQ ID NO: 111253 - DNA, 20 bp, Artificial Sequence
  chemically synthesized
taagtatccttaaaaaggca

SEQ ID NO: 111254 - DNA, 20 bp, Artificial Sequence
  chemically synthesized
tgaagaagctgtgccttttt

SEQ ID NO: 111255 - DNA, 20 bp, Artificial Sequence
  chemically synthesized
gaagaagctgtgccttttta

SEQ ID NO: 111256 - DNA, 20 bp, Artificial Sequence
  chemically synthesized
gcttttaagtatccttaaaa

SEQ ID NO: 111257 - DNA, 20 bp, Artificial Sequence
  chemically synthesized
cgcttttaagtatccttaaa

SEQ ID NO: 111258 - DNA, 20 bp, Artificial Sequence
  chemically synthesized
gcctttttaaggatacttaa

SEQ ID NO: 111259 - DNA, 20 bp, Artificial Sequence
  chemically synthesized
ggaaaagcctattcgctttt

SEQ ID NO: 111260 - DNA, 20 bp, Artificial Sequence
  chemically synthesized
taaggatacttaaaagcgaa

SEQ ID NO: 111261 - DNA, 20 bp, Artificial Sequence
  chemically synthesized
aaggatacttaaaagcgaat

SEQ ID NO: 111262 - DNA, 20 bp, Artificial Sequence
  chemically synthesized
cacaatacaaaaatggggaa

SEQ ID NO: 111263 - DNA, 20 bp, Artificial Sequence
  chemically synthesized
tttgccacaatacaaaaatg

SEQ ID NO: 111264 - DNA, 20 bp, Artificial Sequence
  chemically synthesized
ttttgccacaatacaaaaat

SEQ ID NO: 111265 - DNA, 20 bp, Artificial Sequence
  chemically synthesized
attttgccacaatacaaaaa

SEQ ID NO: 111266 - DNA, 20 bp, Artificial Sequence
  chemically synthesized
ttttccccatttttgtattg

SEQ ID NO: 111267 - DNA, 20 bp, Artificial Sequence
  chemically synthesized
ttaatcatttctttttgatt

SEQ ID NO: 111268 - DNA, 20 bp, Artificial Sequence
  chemically synthesized
ggtcaagatcccaaatcaaa

SEQ ID NO: 111269 - DNA, 20 bp, Artificial Sequence
  chemically synthesized
taatcatttctttttgattt

SEQ ID NO: 111270 - DNA, 20 bp, Artificial Sequence
  chemically synthesized
cactgtaccccagcatggtc

SEQ ID NO: 111271 - DNA, 20 bp, Artificial Sequence
  chemically synthesized
atttgggatcttgaccatgc

SEQ ID NO: 111272 - DNA, 20 bp, Artificial Sequence
  chemically synthesized
tttgggatcttgaccatgct

SEQ ID NO: 111273 - DNA, 20 bp, Artificial Sequence
  chemically synthesized
ttgggatcttgaccatgctg

SEQ ID NO: 111274 - DNA, 20 bp, Artificial Sequence
  chemically synthesized
aatgacactgtaccccagca

SEQ ID NO: 111275 - DNA, 20 bp, Artificial Sequence
  chemically synthesized
atcttgaccatgctggggta

SEQ ID NO: 111276 - DNA, 20 bp, Artificial Sequence
  chemically synthesized
cagtgaatgacactgtaccc

SEQ ID NO: 111277 - DNA, 20 bp, Artificial Sequence
  chemically synthesized
gtgtcattcactgcttcctc

SEQ ID NO: 111278 - DNA, 20 bp, Artificial Sequence
  chemically synthesized
aacccaggaactggaggaag

SEQ ID NO: 111279 - DNA, 20 bp, Artificial Sequence
  chemically synthesized
ttgaacccaggaactggagg

SEQ ID NO: 111280 - DNA, 20 bp, Artificial Sequence
  chemically synthesized
tccttgaacccaggaactgg

SEQ ID NO: 111281 - DNA, 20 bp, Artificial Sequence
  chemically synthesized
tcactgcttcctccagttcc

SEQ ID NO: 111282 - DNA, 20 bp, Artificial Sequence
  chemically synthesized
ttccttgaacccaggaactg

SEQ ID NO: 111283 - DNA, 20 bp, Artificial Sequence
  chemically synthesized
cactgcttcctccagttcct

SEQ ID NO: 111284 - DNA, 20 bp, Artificial Sequence
  chemically synthesized
gattccttgaacccaggaac

SEQ ID NO: 111285 - DNA, 20 bp, Artificial Sequence
  chemically synthesized
ttcctccagttcctgggttc

SEQ ID NO: 111286 - DNA, 20 bp, Artificial Sequence
  chemically synthesized
tcctccagttcctgggttca

SEQ ID NO: 111287 - DNA, 20 bp, Artificial Sequence
  chemically synthesized
caggaggattccttgaaccc

SEQ ID NO: 111288 - DNA, 20 bp, Artificial Sequence
  chemically synthesized
gcaggaggattccttgaacc

SEQ ID NO: 111289 - DNA, 20 bp, Artificial Sequence
  chemically synthesized
ttcaaggaatcctcctgcct

SEQ ID NO: 111290 - DNA, 20 bp, Artificial Sequence
  chemically synthesized
acactggaggctgaggcagg

SEQ ID NO: 111291 - DNA, 20 bp, Artificial Sequence
  chemically synthesized
cacactggaggctgaggcag

SEQ ID NO: 111292 - DNA, 20 bp, Artificial Sequence
  chemically synthesized
gacacactggaggctgaggc

SEQ ID NO: 111293 - DNA, 20 bp, Artificial Sequence
  chemically synthesized
agacacactggaggctgagg

SEQ ID NO: 111294 - DNA, 20 bp, Artificial Sequence
  chemically synthesized
aatcctcctgcctcagcctc

SEQ ID NO: 111295 - DNA, 20 bp, Artificial Sequence
  chemically synthesized
cccagacacactggaggctg

SEQ ID NO: 111296 - DNA, 20 bp, Artificial Sequence
  chemically synthesized
tcccagacacactggaggct

SEQ ID NO: 111297 - DNA, 20 bp, Artificial Sequence
  chemically synthesized
tgtagtcccagacacactgg

SEQ ID NO: 111298 - DNA, 20 bp, Artificial Sequence
  chemically synthesized
ttgtagtcccagacacactg

SEQ ID NO: 111299 - DNA, 20 bp, Artificial Sequence
  chemically synthesized
gcctcagcctccagtgtgtc

SEQ ID NO: 111300 - DNA, 20 bp, Artificial Sequence
  chemically synthesized
gcttgtagtcccagacacac

SEQ ID NO: 111301 - DNA, 20 bp, Artificial Sequence
  chemically synthesized
cctcagcctccagtgtgtct

SEQ ID NO: 111302 - DNA, 20 bp, Artificial Sequence
  chemically synthesized
tccagtgtgtctgggactac

SEQ ID NO: 111303 - DNA, 20 bp, Artificial Sequence
  chemically synthesized
ggagctcatgcttgtagtcc

SEQ ID NO: 111304 - DNA, 20 bp, Artificial Sequence
  chemically synthesized
gtgtctgggactacaagcat

SEQ ID NO: 111305 - DNA, 20 bp, Artificial Sequence
  chemically synthesized
ggtgtgggagctcatgcttg

SEQ ID NO: 111306 - DNA, 20 bp, Artificial Sequence
  chemically synthesized
caagcatgagctcccacacc

SEQ ID NO: 111307 - DNA, 20 bp, Artificial Sequence
  chemically synthesized
caaaaattaactgggtgtgg

SEQ ID NO: 111308 - DNA, 20 bp, Artificial Sequence
  chemically synthesized
ttcaaaaattaactgggtgt

SEQ ID NO: 111309 - DNA, 20 bp, Artificial Sequence
  chemically synthesized
attcaaaaattaactgggtg

SEQ ID NO: 111310 - DNA, 20 bp, Artificial Sequence
  chemically synthesized
aaagaattcaaaaattaact

SEQ ID NO: 111311 - DNA, 20 bp, Artificial Sequence
  chemically synthesized
caaagaattcaaaaattaac

SEQ ID NO: 111312 - DNA, 20 bp, Artificial Sequence
  chemically synthesized
gttaatttttgaattctttg

SEQ ID NO: 111313 - DNA, 20 bp, Artificial Sequence
  chemically synthesized
taatttttgaattctttgta

SEQ ID NO: 111314 - DNA, 20 bp, Artificial Sequence
  chemically synthesized
ggcaaggccccatctctaca

SEQ ID NO: 111315 - DNA, 20 bp, Artificial Sequence
  chemically synthesized
ttttgaattctttgtagaga

SEQ ID NO: 111316 - DNA, 20 bp, Artificial Sequence
  chemically synthesized
tttgaattctttgtagagat

SEQ ID NO: 111317 - DNA, 20 bp, Artificial Sequence
  chemically synthesized
ttgaattctttgtagagatg

SEQ ID NO: 111318 - DNA, 20 bp, Artificial Sequence
  chemically synthesized
ccagcctgggcaacatggca

SEQ ID NO: 111319 - DNA, 20 bp, Artificial Sequence
  chemically synthesized
accagcctgggcaacatggc

SEQ ID NO: 111320 - DNA, 20 bp, Artificial Sequence
  chemically synthesized
tggggccttgccatgttgcc

SEQ ID NO: 111321 - DNA, 20 bp, Artificial Sequence
  chemically synthesized
caagaccagcctgggcaaca

SEQ ID NO: 111322 - DNA, 20 bp, Artificial Sequence
  chemically synthesized
ggggccttgccatgttgccc

SEQ ID NO: 111323 - DNA, 20 bp, Artificial Sequence
  chemically synthesized
ccttgccatgttgcccaggc

SEQ ID NO: 111324 - DNA, 20 bp, Artificial Sequence
  chemically synthesized
caggagttcaagaccagcct

SEQ ID NO: 111325 - DNA, 20 bp, Artificial Sequence
  chemically synthesized
tcaggagttcaagaccagcc

SEQ ID NO: 111326 - DNA, 20 bp, Artificial Sequence
  chemically synthesized
tgagctcaggagttcaagac

SEQ ID NO: 111327 - DNA, 20 bp, Artificial Sequence
  chemically synthesized
tcacttgagctcaggagttc

SEQ ID NO: 111328 - DNA, 20 bp, Artificial Sequence
  chemically synthesized
caggctggtcttgaactcct

SEQ ID NO: 111329 - DNA, 20 bp, Artificial Sequence
  chemically synthesized
ggaggatcacttgagctcag

SEQ ID NO: 111330 - DNA, 20 bp, Artificial Sequence
  chemically synthesized
ggtcttgaactcctgagctc

SEQ ID NO: 111331 - DNA, 20 bp, Artificial Sequence
  chemically synthesized
caggaggatcacttgagctc

SEQ ID NO: 111332 - DNA, 20 bp, Artificial Sequence
  chemically synthesized
gcaggaggatcacttgagct

SEQ ID NO: 111333 - DNA, 20 bp, Artificial Sequence
  chemically synthesized
ctaaagcaggaggatcactt

SEQ ID NO: 111334 - DNA, 20 bp, Artificial Sequence
  chemically synthesized
ctcaagtgatcctcctgctt

SEQ ID NO: 111335 - DNA, 20 bp, Artificial Sequence
  chemically synthesized
ctgtgggaggctaaagcagg

SEQ ID NO: 111336 - DNA, 20 bp, Artificial Sequence
  chemically synthesized
actgtgggaggctaaagcag

SEQ ID NO: 111337 - DNA, 20 bp, Artificial Sequence
  chemically synthesized
gaactgtgggaggctaaagc

SEQ ID NO: 111338 - DNA, 20 bp, Artificial Sequence
  chemically synthesized
agaactgtgggaggctaaag

SEQ ID NO: 111339 - DNA, 20 bp, Artificial Sequence
  chemically synthesized
cccagaactgtgggaggcta

SEQ ID NO: 111340 - DNA, 20 bp, Artificial Sequence
  chemically synthesized
cctcctgctttagcctccca

SEQ ID NO: 111341 - DNA, 20 bp, Artificial Sequence
  chemically synthesized
tgtaatcccagaactgtggg

SEQ ID NO: 111342 - DNA, 20 bp, Artificial Sequence
  chemically synthesized
ctgtaatcccagaactgtgg

SEQ ID NO: 111343 - DNA, 20 bp, Artificial Sequence
  chemically synthesized
gctttagcctcccacagttc

SEQ ID NO: 111344 - DNA, 20 bp, Artificial Sequence
  chemically synthesized
ttctgtaatcccagaactgt

SEQ ID NO: 111345 - DNA, 20 bp, Artificial Sequence
  chemically synthesized
ctttagcctcccacagttct

SEQ ID NO: 111346 - DNA, 20 bp, Artificial Sequence
  chemically synthesized
cttctgtaatcccagaactg

SEQ ID NO: 111347 - DNA, 20 bp, Artificial Sequence
  chemically synthesized
ctcccacagttctgggatta

SEQ ID NO: 111348 - DNA, 20 bp, Artificial Sequence
  chemically synthesized
gtgggtcacttctgtaatcc

SEQ ID NO: 111349 - DNA, 20 bp, Artificial Sequence
  chemically synthesized
ccacagttctgggattacag

SEQ ID NO: 111350 - DNA, 20 bp, Artificial Sequence
  chemically synthesized
gctaaatggccaggcattgt

SEQ ID NO: 111351 - DNA, 20 bp, Artificial Sequence
  chemically synthesized
cagaagtgacccacaatgcc

SEQ ID NO: 111352 - DNA, 20 bp, Artificial Sequence
  chemically synthesized
ggctaaatggccaggcattg

SEQ ID NO: 111353 - DNA, 20 bp, Artificial Sequence
  chemically synthesized
acccacaatgcctggccatt

SEQ ID NO: 111354 - DNA, 20 bp, Artificial Sequence
  chemically synthesized
aatttaaaggctaaatggcc

SEQ ID NO: 111355 - DNA, 20 bp, Artificial Sequence
  chemically synthesized
aaatttaaaggctaaatggc

SEQ ID NO: 111356 - DNA, 20 bp, Artificial Sequence
  chemically synthesized
aaaaaaatttaaaggctaaa

SEQ ID NO: 111357 - DNA, 20 bp, Artificial Sequence
  chemically synthesized
tacccataaaaaaaatttaa

SEQ ID NO: 111358 - DNA, 20 bp, Artificial Sequence
  chemically synthesized
gtacccataaaaaaaattta

SEQ ID NO: 111359 - DNA, 20 bp, Artificial Sequence
  chemically synthesized
tagcctttaaatttttttta

SEQ ID NO: 111360 - DNA, 20 bp, Artificial Sequence
  chemically synthesized
agcctttaaattttttttat

SEQ ID NO: 111361 - DNA, 20 bp, Artificial Sequence
  chemically synthesized
aaattttttttatgggtaca

SEQ ID NO: 111362 - DNA, 20 bp, Artificial Sequence
  chemically synthesized
ttttttttatgggtacatag

SEQ ID NO: 111363 - DNA, 20 bp, Artificial Sequence
  chemically synthesized
tttttttatgggtacatagt

SEQ ID NO: 111364 - DNA, 20 bp, Artificial Sequence
  chemically synthesized
atagtaggtgcatatattta

SEQ ID NO: 111365 - DNA, 20 bp, Artificial Sequence
  chemically synthesized
tagtaggtgcatatatttac

SEQ ID NO: 111366 - DNA, 20 bp, Artificial Sequence
  chemically synthesized
agtaggtgcatatatttacg

SEQ ID NO: 111367 - DNA, 20 bp, Artificial Sequence
  chemically synthesized
catatatttacggggtacat

SEQ ID NO: 111368 - DNA, 20 bp, Artificial Sequence
  chemically synthesized
gtacatgagatattttgata

SEQ ID NO: 111369 - DNA, 20 bp, Artificial Sequence
  chemically synthesized
tacatgagatattttgatat

SEQ ID NO: 111370 - DNA, 20 bp, Artificial Sequence
  chemically synthesized
atgtgattattacacattgt

SEQ ID NO: 111371 - DNA, 20 bp, Artificial Sequence
  chemically synthesized
gatgtgattattacacattg

SEQ ID NO: 111372 - DNA, 20 bp, Artificial Sequence
  chemically synthesized
acaatgtgtaataatcacat

SEQ ID NO: 111373 - DNA, 20 bp, Artificial Sequence
  chemically synthesized
caatgtgtaataatcacatc

SEQ ID NO: 111374 - DNA, 20 bp, Artificial Sequence
  chemically synthesized
taataatcacatcaggataa

SEQ ID NO: 111375 - DNA, 20 bp, Artificial Sequence
  chemically synthesized
aataatcacatcaggataac

SEQ ID NO: 111376 - DNA, 20 bp, Artificial Sequence
  chemically synthesized
ataatcacatcaggataacg

SEQ ID NO: 111377 - DNA, 20 bp, Artificial Sequence
  chemically synthesized
cttaaaaatggtcaagaaaa

SEQ ID NO: 111378 - DNA, 20 bp, Artificial Sequence
  chemically synthesized
ctgtatacttaaaaatggtc

SEQ ID NO: 111379 - DNA, 20 bp, Artificial Sequence
  chemically synthesized
ccattttcttgaccattttt

SEQ ID NO: 111380 - DNA, 20 bp, Artificial Sequence
  chemically synthesized
ctcaactgtatacttaaaaa

SEQ ID NO: 111381 - DNA, 20 bp, Artificial Sequence
  chemically synthesized
cttgaccatttttaagtata

SEQ ID NO: 111382 - DNA, 20 bp, Artificial Sequence
  chemically synthesized
ccatttttaagtatacagtt

SEQ ID NO: 111383 - DNA, 20 bp, Artificial Sequence
  chemically synthesized
gtatacagttgagtactatt

SEQ ID NO: 111384 - DNA, 20 bp, Artificial Sequence
  chemically synthesized
tataatattaatgtacttaa

SEQ ID NO: 111385 - DNA, 20 bp, Artificial Sequence
  chemically synthesized
ctagagatggatagtggtga

SEQ ID NO: 111386 - DNA, 20 bp, Artificial Sequence
  chemically synthesized
aacattctagagatggatag

SEQ ID NO: 111387 - DNA, 20 bp, Artificial Sequence
  chemically synthesized
gaaaacattctagagatgga

SEQ ID NO: 111388 - DNA, 20 bp, Artificial Sequence
  chemically synthesized
ccatcaccactatccatctc

SEQ ID NO: 111389 - DNA, 20 bp, Artificial Sequence
  chemically synthesized
tgatgaaaacattctagaga

SEQ ID NO: 111390 - DNA, 20 bp, Artificial Sequence
  chemically synthesized
gggatgatgaaaacattcta

SEQ ID NO: 111391 - DNA, 20 bp, Artificial Sequence
  chemically synthesized
ttgggatgatgaaaacattc

SEQ ID NO: 111392 - DNA, 20 bp, Artificial Sequence
  chemically synthesized
gagtacctgagtttcagttt

SEQ ID NO: 111393 - DNA, 20 bp, Artificial Sequence
  chemically synthesized
tgagtacctgagtttcagtt

SEQ ID NO: 111394 - DNA, 20 bp, Artificial Sequence
  chemically synthesized
catcatcccaaactgaaact

SEQ ID NO: 111395 - DNA, 20 bp, Artificial Sequence
  chemically synthesized
atcatcccaaactgaaactc

SEQ ID NO: 111396 - DNA, 20 bp, Artificial Sequence
  chemically synthesized
tttaatgagtacctgagttt

SEQ ID NO: 111397 - DNA, 20 bp, Artificial Sequence
  chemically synthesized
ttattgtttaatgagtacct

SEQ ID NO: 111398 - DNA, 20 bp, Artificial Sequence
  chemically synthesized
atgagggcttattgtttaat

SEQ ID NO: 111399 - DNA, 20 bp, Artificial Sequence
  chemically synthesized
tcaggtactcattaaacaat

SEQ ID NO: 111400 - DNA, 20 bp, Artificial Sequence
  chemically synthesized
ctggaggaagaagagaatga

SEQ ID NO: 111401 - DNA, 20 bp, Artificial Sequence
  chemically synthesized
gctggaggaagaagagaatg

SEQ ID NO: 111402 - DNA, 20 bp, Artificial Sequence
  chemically synthesized
agctggaggaagaagagaat

SEQ ID NO: 111403 - DNA, 20 bp, Artificial Sequence
  chemically synthesized
accaggagctggaggaagaa

SEQ ID NO: 111404 - DNA, 20 bp, Artificial Sequence
  chemically synthesized
ccctcattctcttcttcctc

SEQ ID NO: 111405 - DNA, 20 bp, Artificial Sequence
  chemically synthesized
ttaccaggagctggaggaag

SEQ ID NO: 111406 - DNA, 20 bp, Artificial Sequence
  chemically synthesized
atgttaccaggagctggagg

SEQ ID NO: 111407 - DNA, 20 bp, Artificial Sequence
  chemically synthesized
aggatgttaccaggagctgg

SEQ ID NO: 111408 - DNA, 20 bp, Artificial Sequence
  chemically synthesized
tctcttcttcctccagctcc

SEQ ID NO: 111409 - DNA, 20 bp, Artificial Sequence
  chemically synthesized
aaggatgttaccaggagctg

SEQ ID NO: 111410 - DNA, 20 bp, Artificial Sequence
  chemically synthesized
tgaaggatgttaccaggagc

SEQ ID NO: 111411 - DNA, 20 bp, Artificial Sequence
  chemically synthesized
aagttgaaggatgttaccag

SEQ ID NO: 111412 - DNA, 20 bp, Artificial Sequence
  chemically synthesized
taaagttgaaggatgttacc

SEQ ID NO: 111413 - DNA, 20 bp, Artificial Sequence
  chemically synthesized
gtaaagttgaaggatgttac

SEQ ID NO: 111414 - DNA, 20 bp, Artificial Sequence
  chemically synthesized
ttatacagacgtaaagttga

SEQ ID NO: 111415 - DNA, 20 bp, Artificial Sequence
  chemically synthesized
tttatacagacgtaaagttg

SEQ ID NO: 111416 - DNA, 20 bp, Artificial Sequence
  chemically synthesized
gtcaaatttatacagacgta

SEQ ID NO: 111417 - DNA, 20 bp, Artificial Sequence
  chemically synthesized
ctacaacagtcaaatttata

SEQ ID NO: 111418 - DNA, 20 bp, Artificial Sequence
  chemically synthesized
ctgtataaatttgactgttg

SEQ ID NO: 111419 - DNA, 20 bp, Artificial Sequence
  chemically synthesized
tgtataaatttgactgttgt

SEQ ID NO: 111420 - DNA, 20 bp, Artificial Sequence
  chemically synthesized
ataaatttgactgttgtagg

SEQ ID NO: 111421 - DNA, 20 bp, Artificial Sequence
  chemically synthesized
ctggtatgagctacctacaa

SEQ ID NO: 111422 - DNA, 20 bp, Artificial Sequence
  chemically synthesized
ctgttgtaggtagctcatac

SEQ ID NO: 111423 - DNA, 20 bp, Artificial Sequence
  chemically synthesized
ttgtaggtagctcataccag

SEQ ID NO: 111424 - DNA, 20 bp, Artificial Sequence
  chemically synthesized
ttgtatgattccactggtat

SEQ ID NO: 111425 - DNA, 20 bp, Artificial Sequence
  chemically synthesized
aaaatattgtatgattccac

SEQ ID NO: 111426 - DNA, 20 bp, Artificial Sequence
  chemically synthesized
aatatttttcattttgtgtc

SEQ ID NO: 111427 - DNA, 20 bp, Artificial Sequence
  chemically synthesized
ttatgctaagtgaaataaac

SEQ ID NO: 111428 - DNA, 20 bp, Artificial Sequence
  chemically synthesized
tgtgtctggtttatttcact

SEQ ID NO: 111429 - DNA, 20 bp, Artificial Sequence
  chemically synthesized
aatcttagaggcattatgct

SEQ ID NO: 111430 - DNA, 20 bp, Artificial Sequence
  chemically synthesized
tcacttagcataatgcctct

SEQ ID NO: 111431 - DNA, 20 bp, Artificial Sequence
  chemically synthesized
ctaatatgggtgaatcttag

SEQ ID NO: 111432 - DNA, 20 bp, Artificial Sequence
  chemically synthesized
gctaatatgggtgaatctta

SEQ ID NO: 111433 - DNA, 20 bp, Artificial Sequence
  chemically synthesized
gagctaatatgggtgaatct

SEQ ID NO: 111434 - DNA, 20 bp, Artificial Sequence
  chemically synthesized
cctctaagattcacccatat

SEQ ID NO: 111435 - DNA, 20 bp, Artificial Sequence
  chemically synthesized
atcaaaagatgagctaatat

SEQ ID NO: 111436 - DNA, 20 bp, Artificial Sequence
  chemically synthesized
aatcaaaagatgagctaata

SEQ ID NO: 111437 - DNA, 20 bp, Artificial Sequence
  chemically synthesized
aattcagcaaatcaaaagat

SEQ ID NO: 111438 - DNA, 20 bp, Artificial Sequence
  chemically synthesized
aaaagaattcagcaaatcaa

SEQ ID NO: 111439 - DNA, 20 bp, Artificial Sequence
  chemically synthesized
aacaagaagttaaaagaatt

SEQ ID NO: 111440 - DNA, 20 bp, Artificial Sequence
  chemically synthesized
catcttgaacaagaagttaa

SEQ ID NO: 111441 - DNA, 20 bp, Artificial Sequence
  chemically synthesized
attcttttaacttcttgttc

SEQ ID NO: 111442 - DNA, 20 bp, Artificial Sequence
  chemically synthesized
agaacatcatcttgaacaag

SEQ ID NO: 111443 - DNA, 20 bp, Artificial Sequence
  chemically synthesized
gccagaacatcatcttgaac

SEQ ID NO: 111444 - DNA, 20 bp, Artificial Sequence
  chemically synthesized
tcttgttcaagatgatgttc

SEQ ID NO: 111445 - DNA, 20 bp, Artificial Sequence
  chemically synthesized
agatgatgttctggctcttt

SEQ ID NO: 111446 - DNA, 20 bp, Artificial Sequence
  chemically synthesized
aaattcatttcttaaagagc

SEQ ID NO: 111447 - DNA, 20 bp, Artificial Sequence
  chemically synthesized
atagaaattcatttcttaaa

SEQ ID NO: 111448 - DNA, 20 bp, Artificial Sequence
  chemically synthesized
tgatagaaattcatttctta

SEQ ID NO: 111449 - DNA, 20 bp, Artificial Sequence
  chemically synthesized
tattgaagttggacaaatga

SEQ ID NO: 111450 - DNA, 20 bp, Artificial Sequence
  chemically synthesized
tatcatttgtccaacttcaa

SEQ ID NO: 111451 - DNA, 20 bp, Artificial Sequence
  chemically synthesized
tagcagctatctattgaagt

SEQ ID NO: 111452 - DNA, 20 bp, Artificial Sequence
  chemically synthesized
atttgtccaacttcaataga

SEQ ID NO: 111453 - DNA, 20 bp, Artificial Sequence
  chemically synthesized
catttagcagctatctattg

SEQ ID NO: 111454 - DNA, 20 bp, Artificial Sequence
  chemically synthesized
tcaatagatagctgctaaat

SEQ ID NO: 111455 - DNA, 20 bp, Artificial Sequence
  chemically synthesized
gaatgctttctctcatttag

SEQ ID NO: 111456 - DNA, 20 bp, Artificial Sequence
  chemically synthesized
aatagatagctgctaaatga

SEQ ID NO: 111457 - DNA, 20 bp, Artificial Sequence
  chemically synthesized
tctgaatgctttctctcatt

SEQ ID NO: 111458 - DNA, 20 bp, Artificial Sequence
  chemically synthesized
gatagctgctaaatgagaga

SEQ ID NO: 111459 - DNA, 20 bp, Artificial Sequence
  chemically synthesized
gctaaatgagagaaagcatt

SEQ ID NO: 111460 - DNA, 20 bp, Artificial Sequence
  chemically synthesized
aatgagagaaagcattcaga

SEQ ID NO: 111461 - DNA, 20 bp, Artificial Sequence
  chemically synthesized
atgagagaaagcattcagaa

SEQ ID NO: 111462 - DNA, 20 bp, Artificial Sequence
  chemically synthesized
tgagagaaagcattcagaaa

SEQ ID NO: 111463 - DNA, 20 bp, Artificial Sequence
  chemically synthesized
gcattcagaaagggcattcc

SEQ ID NO: 111464 - DNA, 20 bp, Artificial Sequence
  chemically synthesized
cattcagaaagggcattcct

SEQ ID NO: 111465 - DNA, 20 bp, Artificial Sequence
  chemically synthesized
tctgtctatttcattcaccc

SEQ ID NO: 111466 - DNA, 20 bp, Artificial Sequence
  chemically synthesized
ctctgtctatttcattcacc

SEQ ID NO: 111467 - DNA, 20 bp, Artificial Sequence
  chemically synthesized
gcattcctgggtgaatgaaa

SEQ ID NO: 111468 - DNA, 20 bp, Artificial Sequence
  chemically synthesized
tcctgggtgaatgaaataga

SEQ ID NO: 111469 - DNA, 20 bp, Artificial Sequence
  chemically synthesized
ctgggtgaatgaaatagaca

SEQ ID NO: 111470 - DNA, 20 bp, Artificial Sequence
  chemically synthesized
tgaatgaaatagacagagcc

SEQ ID NO: 111471 - DNA, 20 bp, Artificial Sequence
  chemically synthesized
aatgaaatagacagagcctg

SEQ ID NO: 111472 - DNA, 20 bp, Artificial Sequence
  chemically synthesized
atgaaatagacagagcctgg

SEQ ID NO: 111473 - DNA, 20 bp, Artificial Sequence
  chemically synthesized
aatagacagagcctggaggc

SEQ ID NO: 111474 - DNA, 20 bp, Artificial Sequence
  chemically synthesized
acatcactatgccggcctcc

SEQ ID NO: 111475 - DNA, 20 bp, Artificial Sequence
  chemically synthesized
cacatcactatgccggcctc

SEQ ID NO: 111476 - DNA, 20 bp, Artificial Sequence
  chemically synthesized
acagagcctggaggccggca

SEQ ID NO: 111477 - DNA, 20 bp, Artificial Sequence
  chemically synthesized
tgcatttcacatcactatgc

SEQ ID NO: 111478 - DNA, 20 bp, Artificial Sequence
  chemically synthesized
tgtgaaatgcattttctact

SEQ ID NO: 111479 - DNA, 20 bp, Artificial Sequence
  chemically synthesized
tcaagtgactttcaactaag

SEQ ID NO: 111480 - DNA, 20 bp, Artificial Sequence
  chemically synthesized
tgcattttctacttagttga

SEQ ID NO: 111481 - DNA, 20 bp, Artificial Sequence
  chemically synthesized
ttttcaagtgactttcaact

SEQ ID NO: 111482 - DNA, 20 bp, Artificial Sequence
  chemically synthesized
ttagttgaaagtcacttgaa

SEQ ID NO: 111483 - DNA, 20 bp, Artificial Sequence
  chemically synthesized
tcctatttctttttcttttc

SEQ ID NO: 111484 - DNA, 20 bp, Artificial Sequence
  chemically synthesized
gaaagtcacttgaaaagaaa

SEQ ID NO: 111485 - DNA, 20 bp, Artificial Sequence
  chemically synthesized
cacttgaaaagaaaaagaaa

SEQ ID NO: 111486 - DNA, 20 bp, Artificial Sequence
  chemically synthesized
acttgaaaagaaaaagaaat

SEQ ID NO: 111487 - DNA, 20 bp, Artificial Sequence
  chemically synthesized
aagaaaaagaaataggaaat

SEQ ID NO: 111488 - DNA, 20 bp, Artificial Sequence
  chemically synthesized
gaaaaagaaataggaaataa

SEQ ID NO: 111489 - DNA, 20 bp, Artificial Sequence
  chemically synthesized
aaaagaaataggaaataaga

SEQ ID NO: 111490 - DNA, 20 bp, Artificial Sequence
  chemically synthesized
gaaataggaaataagagaga

SEQ ID NO: 111491 - DNA, 20 bp, Artificial Sequence
  chemically synthesized
aaataggaaataagagagac

SEQ ID NO: 111492 - DNA, 20 bp, Artificial Sequence
  chemically synthesized
ataggaaataagagagacag

SEQ ID NO: 111493 - DNA, 20 bp, Artificial Sequence
  chemically synthesized
taggaaataagagagacagg

SEQ ID NO: 111494 - DNA, 20 bp, Artificial Sequence
  chemically synthesized
ggaaataagagagacaggag

SEQ ID NO: 111495 - DNA, 20 bp, Artificial Sequence
  chemically synthesized
aataagagagacaggaggag

SEQ ID NO: 111496 - DNA, 20 bp, Artificial Sequence
  chemically synthesized
taagagagacaggaggagaa

SEQ ID NO: 111497 - DNA, 20 bp, Artificial Sequence
  chemically synthesized
gagagacaggaggagaagag

SEQ ID NO: 111498 - DNA, 20 bp, Artificial Sequence
  chemically synthesized
gagacaggaggagaagagaa

SEQ ID NO: 111499 - DNA, 20 bp, Artificial Sequence
  chemically synthesized
gacaggaggagaagagaaga

SEQ ID NO: 111500 - DNA, 20 bp, Artificial Sequence
  chemically synthesized
gaagagagatgaactaaact

SEQ ID NO: 111501 - DNA, 20 bp, Artificial Sequence
  chemically synthesized
agtcttagtttttctcagtt

SEQ ID NO: 111502 - DNA, 20 bp, Artificial Sequence
  chemically synthesized
aagaaagtcttagtttttct

SEQ ID NO: 111503 - DNA, 20 bp, Artificial Sequence
  chemically synthesized
gaactaaactgagaaaaact

SEQ ID NO: 111504 - DNA, 20 bp, Artificial Sequence
  chemically synthesized
gcgcagccttaagaaagtct

SEQ ID NO: 111505 - DNA, 20 bp, Artificial Sequence
  chemically synthesized
agaaaaactaagactttctt

SEQ ID NO: 111506 - DNA, 20 bp, Artificial Sequence
  chemically synthesized
gaaaaactaagactttctta

SEQ ID NO: 111507 - DNA, 20 bp, Artificial Sequence
  chemically synthesized
agcacagcgcagccttaaga

SEQ ID NO: 111508 - DNA, 20 bp, Artificial Sequence
  chemically synthesized
tctgagcacagcgcagcctt

SEQ ID NO: 111509 - DNA, 20 bp, Artificial Sequence
  chemically synthesized
ctactaatctgagcacagcg

SEQ ID NO: 111510 - DNA, 20 bp, Artificial Sequence
  chemically synthesized
tcttaaggctgcgctgtgct

SEQ ID NO: 111511 - DNA, 20 bp, Artificial Sequence
  chemically synthesized
tagccctactaatctgagca

SEQ ID NO: 111512 - DNA, 20 bp, Artificial Sequence
  chemically synthesized
aggctgcgctgtgctcagat

SEQ ID NO: 111513 - DNA, 20 bp, Artificial Sequence
  chemically synthesized
ctgcgctgtgctcagattag

SEQ ID NO: 111514 - DNA, 20 bp, Artificial Sequence
  chemically synthesized
ttgcatagccctactaatct

SEQ ID NO: 111515 - DNA, 20 bp, Artificial Sequence
  chemically synthesized
tgcgctgtgctcagattagt

SEQ ID NO: 111516 - DNA, 20 bp, Artificial Sequence
  chemically synthesized
gcgctgtgctcagattagta

SEQ ID NO: 111517 - DNA, 20 bp, Artificial Sequence
  chemically synthesized
attagtagggctatgcaaat

SEQ ID NO: 111518 - DNA, 20 bp, Artificial Sequence
  chemically synthesized
tgttaataacctcatttgca

SEQ ID NO: 111519 - DNA, 20 bp, Artificial Sequence
  chemically synthesized
ttagtagggctatgcaaatg

SEQ ID NO: 111520 - DNA, 20 bp, Artificial Sequence
  chemically synthesized
tatgcaaatgaggttattaa

SEQ ID NO: 111521 - DNA, 20 bp, Artificial Sequence
  chemically synthesized
atgcaaatgaggttattaac

SEQ ID NO: 111522 - DNA, 20 bp, Artificial Sequence
  chemically synthesized
agtgtgtaccaattaatatt

SEQ ID NO: 111523 - DNA, 20 bp, Artificial Sequence
  chemically synthesized
ggtatattctaaatattaat

SEQ ID NO: 111524 - DNA, 20 bp, Artificial Sequence
  chemically synthesized
aaatattaattggtacacac

SEQ ID NO: 111525 - DNA, 20 bp, Artificial Sequence
  chemically synthesized
ttggtacacactggtataca

SEQ ID NO: 111526 - DNA, 20 bp, Artificial Sequence
  chemically synthesized
atatcgggttccatgtatac

SEQ ID NO: 111527 - DNA, 20 bp, Artificial Sequence
  chemically synthesized
aaaggtattttaataatatc

SEQ ID NO: 111528 - DNA, 20 bp, Artificial Sequence
  chemically synthesized
caaaggtattttaataatat

SEQ ID NO: 111529 - DNA, 20 bp, Artificial Sequence
  chemically synthesized
cgatattattaaaatacctt

SEQ ID NO: 111530 - DNA, 20 bp, Artificial Sequence
  chemically synthesized
gatattattaaaataccttt

SEQ ID NO: 111531 - DNA, 20 bp, Artificial Sequence
  chemically synthesized
atattattaaaatacctttg

SEQ ID NO: 111532 - DNA, 20 bp, Artificial Sequence
  chemically synthesized
ttgtctatagtttgccccaa

SEQ ID NO: 111533 - DNA, 20 bp, Artificial Sequence
  chemically synthesized
tttgtctatagtttgcccca

SEQ ID NO: 111534 - DNA, 20 bp, Artificial Sequence
  chemically synthesized
aatacctttggggcaaacta

SEQ ID NO: 111535 - DNA, 20 bp, Artificial Sequence
  chemically synthesized
tttggggcaaactatagaca

SEQ ID NO: 111536 - DNA, 20 bp, Artificial Sequence
  chemically synthesized
tatttgcttttctttgtcta

SEQ ID NO: 111537 - DNA, 20 bp, Artificial Sequence
  chemically synthesized
ggcaaactatagacaaagaa

SEQ ID NO: 111538 - DNA, 20 bp, Artificial Sequence
  chemically synthesized
tagacaaagaaaagcaaata

SEQ ID NO: 111539 - DNA, 20 bp, Artificial Sequence
  chemically synthesized
acaaagaaaagcaaataaag

SEQ ID NO: 111540 - DNA, 20 bp, Artificial Sequence
  chemically synthesized
gcaaataaagaagtgaaata

SEQ ID NO: 111541 - DNA, 20 bp, Artificial Sequence
  chemically synthesized
aataaagaagtgaaataaag

SEQ ID NO: 111542 - DNA, 20 bp, Artificial Sequence
  chemically synthesized
aagaagtgaaataaagaagt

SEQ ID NO: 111543 - DNA, 20 bp, Artificial Sequence
  chemically synthesized
atacctctcgaatagcaaca

SEQ ID NO: 111544 - DNA, 20 bp, Artificial Sequence
  chemically synthesized
aagcatctatgttgctattc

SEQ ID NO: 111545 - DNA, 20 bp, Artificial Sequence
  chemically synthesized
gcatctatgttgctattcga

SEQ ID NO: 111546 - DNA, 20 bp, Artificial Sequence
  chemically synthesized
catctatgttgctattcgag

SEQ ID NO: 111547 - DNA, 20 bp, Artificial Sequence
  chemically synthesized
cacgataaatacctctcgaa

SEQ ID NO: 111548 - DNA, 20 bp, Artificial Sequence
  chemically synthesized
gagaggtatttatcgtgctt

SEQ ID NO: 111549 - DNA, 20 bp, Artificial Sequence
  chemically synthesized
ataaattaaaattaaatctt

SEQ ID NO: 111550 - DNA, 20 bp, Artificial Sequence
  chemically synthesized
agatttaattttaatttata

SEQ ID NO: 111551 - DNA, 20 bp, Artificial Sequence
  chemically synthesized
atttatatagttactgtcat

SEQ ID NO: 111552 - DNA, 20 bp, Artificial Sequence
  chemically synthesized
aagctgcaaaatgctcatga

SEQ ID NO: 111553 - DNA, 20 bp, Artificial Sequence
  chemically synthesized
ttactgtcatgagcattttg

SEQ ID NO: 111554 - DNA, 20 bp, Artificial Sequence
  chemically synthesized
atgagcattttgcagctttt

SEQ ID NO: 111555 - DNA, 20 bp, Artificial Sequence
  chemically synthesized
gcattttgcagcttttaagt

SEQ ID NO: 111556 - DNA, 20 bp, Artificial Sequence
  chemically synthesized
taacttcccttctgacttaa

SEQ ID NO: 111557 - DNA, 20 bp, Artificial Sequence
  chemically synthesized
ttttgcagcttttaagtcag

SEQ ID NO: 111558 - DNA, 20 bp, Artificial Sequence
  chemically synthesized
tttgcagcttttaagtcaga

SEQ ID NO: 111559 - DNA, 20 bp, Artificial Sequence
  chemically synthesized
ttgcagcttttaagtcagaa

SEQ ID NO: 111560 - DNA, 20 bp, Artificial Sequence
  chemically synthesized
cagcttttaagtcagaaggg

SEQ ID NO: 111561 - DNA, 20 bp, Artificial Sequence
  chemically synthesized
atttaatttatgttttattg

SEQ ID NO: 111562 - DNA, 20 bp, Artificial Sequence
  chemically synthesized
ttatgttttattgtagaaaa

SEQ ID NO: 111563 - DNA, 20 bp, Artificial Sequence
  chemically synthesized
ttattgtagaaaaaagttta

SEQ ID NO: 111564 - DNA, 20 bp, Artificial Sequence
  chemically synthesized
gtttaaagttttaaaaacat

SEQ ID NO: 111565 - DNA, 20 bp, Artificial Sequence
  chemically synthesized
ttttaaaaacatcagtatac

SEQ ID NO: 111566 - DNA, 20 bp, Artificial Sequence
  chemically synthesized
gtgtacaattggagatacac

SEQ ID NO: 111567 - DNA, 20 bp, Artificial Sequence
  chemically synthesized
tgcctctaagtgtacaattg

SEQ ID NO: 111568 - DNA, 20 bp, Artificial Sequence
  chemically synthesized
cttgcctctaagtgtacaat

SEQ ID NO: 111569 - DNA, 20 bp, Artificial Sequence
  chemically synthesized
tgtatctccaattgtacact

SEQ ID NO: 111570 - DNA, 20 bp, Artificial Sequence
  chemically synthesized
tatctccaattgtacactta

SEQ ID NO: 111571 - DNA, 20 bp, Artificial Sequence
  chemically synthesized
atctccaattgtacacttag

SEQ ID NO: 111572 - DNA, 20 bp, Artificial Sequence
  chemically synthesized
ccaattgtacacttagaggc

SEQ ID NO: 111573 - DNA, 20 bp, Artificial Sequence
  chemically synthesized
caattgtacacttagaggca

SEQ ID NO: 111574 - DNA, 20 bp, Artificial Sequence
  chemically synthesized
cattaccaggccttgcctct

SEQ ID NO: 111575 - DNA, 20 bp, Artificial Sequence
  chemically synthesized
gtacacttagaggcaaggcc

SEQ ID NO: 111576 - DNA, 20 bp, Artificial Sequence
  chemically synthesized
ctcttctcgaaagcattacc

SEQ ID NO: 111577 - DNA, 20 bp, Artificial Sequence
  chemically synthesized
cctcttctcgaaagcattac

SEQ ID NO: 111578 - DNA, 20 bp, Artificial Sequence
  chemically synthesized
caaggcctggtaatgctttc

SEQ ID NO: 111579 - DNA, 20 bp, Artificial Sequence
  chemically synthesized
ggcctggtaatgctttcgag

SEQ ID NO: 111580 - DNA, 20 bp, Artificial Sequence
  chemically synthesized
cctggtaatgctttcgagaa

SEQ ID NO: 111581 - DNA, 20 bp, Artificial Sequence
  chemically synthesized
aaagccctacctcttctcga

SEQ ID NO: 111582 - DNA, 20 bp, Artificial Sequence
  chemically synthesized
ctggtaatgctttcgagaag

SEQ ID NO: 111583 - DNA, 20 bp, Artificial Sequence
  chemically synthesized
gtaatgctttcgagaagagg

SEQ ID NO: 111584 - DNA, 20 bp, Artificial Sequence
  chemically synthesized
taatgctttcgagaagaggt

SEQ ID NO: 111585 - DNA, 20 bp, Artificial Sequence
  chemically synthesized
aatgctttcgagaagaggta

SEQ ID NO: 111586 - DNA, 20 bp, Artificial Sequence
  chemically synthesized
ttcgagaagaggtagggctt

SEQ ID NO: 111587 - DNA, 20 bp, Artificial Sequence
  chemically synthesized
gaagaggtagggctttggcc

SEQ ID NO: 111588 - DNA, 20 bp, Artificial Sequence
  chemically synthesized
agaggtagggctttggccaa

SEQ ID NO: 111589 - DNA, 20 bp, Artificial Sequence
  chemically synthesized
gaaaattcaactcttggcca

SEQ ID NO: 111590 - DNA, 20 bp, Artificial Sequence
  chemically synthesized
tacctggaaaattcaactct

SEQ ID NO: 111591 - DNA, 20 bp, Artificial Sequence
  chemically synthesized
tggccaagagttgaattttc

SEQ ID NO: 111592 - DNA, 20 bp, Artificial Sequence
  chemically synthesized
ggccaagagttgaattttcc

SEQ ID NO: 111593 - DNA, 20 bp, Artificial Sequence
  chemically synthesized
caagagttgaattttccagg

SEQ ID NO: 111594 - DNA, 20 bp, Artificial Sequence
  chemically synthesized
gttgaattttccaggtagac

SEQ ID NO: 111595 - DNA, 20 bp, Artificial Sequence
  chemically synthesized
cctttctctccttgtctacc

SEQ ID NO: 111596 - DNA, 20 bp, Artificial Sequence
  chemically synthesized
ttgaattttccaggtagaca

SEQ ID NO: 111597 - DNA, 20 bp, Artificial Sequence
  chemically synthesized
gaattttccaggtagacaag

SEQ ID NO: 111598 - DNA, 20 bp, Artificial Sequence
  chemically synthesized
attttccaggtagacaagga

SEQ ID NO: 111599 - DNA, 20 bp, Artificial Sequence
  chemically synthesized
tccaggtagacaaggagaga

SEQ ID NO: 111600 - DNA, 20 bp, Artificial Sequence
  chemically synthesized
ccaggtagacaaggagagaa

SEQ ID NO: 111601 - DNA, 20 bp, Artificial Sequence
  chemically synthesized
caggtagacaaggagagaaa

SEQ ID NO: 111602 - DNA, 20 bp, Artificial Sequence
  chemically synthesized
aaggagagaaagggtattct

SEQ ID NO: 111603 - DNA, 20 bp, Artificial Sequence
  chemically synthesized
gagaaagggtattctgagca

SEQ ID NO: 111604 - DNA, 20 bp, Artificial Sequence
  chemically synthesized
caagagaagttatctttgct

SEQ ID NO: 111605 - DNA, 20 bp, Artificial Sequence
  chemically synthesized
gtcattatcccagtcaagag

SEQ ID NO: 111606 - DNA, 20 bp, Artificial Sequence
  chemically synthesized
caaagataacttctcttgac

SEQ ID NO: 111607 - DNA, 20 bp, Artificial Sequence
  chemically synthesized
aaagataacttctcttgact

SEQ ID NO: 111608 - DNA, 20 bp, Artificial Sequence
  chemically synthesized
gtagtcattatcccagtcaa

SEQ ID NO: 111609 - DNA, 20 bp, Artificial Sequence
  chemically synthesized
aagtagtcattatcccagtc

SEQ ID NO: 111610 - DNA, 20 bp, Artificial Sequence
  chemically synthesized
acagcaagtagtcattatcc

SEQ ID NO: 111611 - DNA, 20 bp, Artificial Sequence
  chemically synthesized
aatgaatactaaacagcaag

SEQ ID NO: 111612 - DNA, 20 bp, Artificial Sequence
  chemically synthesized
gataatgactacttgctgtt

SEQ ID NO: 111613 - DNA, 20 bp, Artificial Sequence
  chemically synthesized
ctgaatgaatactaaacagc

SEQ ID NO: 111614 - DNA, 20 bp, Artificial Sequence
  chemically synthesized
tgagctgaatgaatactaaa

SEQ ID NO: 111615 - DNA, 20 bp, Artificial Sequence
  chemically synthesized
cttgctgtttagtattcatt

SEQ ID NO: 111616 - DNA, 20 bp, Artificial Sequence
  chemically synthesized
tgtttagtattcattcagct

SEQ ID NO: 111617 - DNA, 20 bp, Artificial Sequence
  chemically synthesized
agtttcttataaatgacact

SEQ ID NO: 111618 - DNA, 20 bp, Artificial Sequence
  chemically synthesized
ttcagctcagtgtcatttat

SEQ ID NO: 111619 - DNA, 20 bp, Artificial Sequence
  chemically synthesized
catttataagaaactttgta

SEQ ID NO: 111620 - DNA, 20 bp, Artificial Sequence
  chemically synthesized
ttataagaaactttgtatgg

SEQ ID NO: 111621 - DNA, 20 bp, Artificial Sequence
  chemically synthesized
ttaattaaagctgccataca

SEQ ID NO: 111622 - DNA, 20 bp, Artificial Sequence
  chemically synthesized
gttttgatgccatttaatta

SEQ ID NO: 111623 - DNA, 20 bp, Artificial Sequence
  chemically synthesized
gtatggcagctttaattaaa

SEQ ID NO: 111624 - DNA, 20 bp, Artificial Sequence
  chemically synthesized
ttccatggagaagtatcaaa

SEQ ID NO: 111625 - DNA, 20 bp, Artificial Sequence
  chemically synthesized
aactttttgatacttctcca

SEQ ID NO: 111626 - DNA, 20 bp, Artificial Sequence
  chemically synthesized
aactccacctttccatggag

SEQ ID NO: 111627 - DNA, 20 bp, Artificial Sequence
  chemically synthesized
ttttgatacttctccatgga

SEQ ID NO: 111628 - DNA, 20 bp, Artificial Sequence
  chemically synthesized
tttgatacttctccatggaa

SEQ ID NO: 111629 - DNA, 20 bp, Artificial Sequence
  chemically synthesized
ataaactccacctttccatg

SEQ ID NO: 111630 - DNA, 20 bp, Artificial Sequence
  chemically synthesized
acataaactccacctttcca

SEQ ID NO: 111631 - DNA, 20 bp, Artificial Sequence
  chemically synthesized
gatacttctccatggaaagg

SEQ ID NO: 111632 - DNA, 20 bp, Artificial Sequence
  chemically synthesized
tacttctccatggaaaggtg

SEQ ID NO: 111633 - DNA, 20 bp, Artificial Sequence
  chemically synthesized
gagctctgattcaaggggat

SEQ ID NO: 111634 - DNA, 20 bp, Artificial Sequence
  chemically synthesized
atgttctcatccccttgaat

SEQ ID NO: 111635 - DNA, 20 bp, Artificial Sequence
  chemically synthesized
tgacagagctctgattcaag

SEQ ID NO: 111636 - DNA, 20 bp, Artificial Sequence
  chemically synthesized
gtgacagagctctgattcaa

SEQ ID NO: 111637 - DNA, 20 bp, Artificial Sequence
  chemically synthesized
gttctcatccccttgaatca

SEQ ID NO: 111638 - DNA, 20 bp, Artificial Sequence
  chemically synthesized
agtgacagagctctgattca

SEQ ID NO: 111639 - DNA, 20 bp, Artificial Sequence
  chemically synthesized
cagtgacagagctctgattc

SEQ ID NO: 111640 - DNA, 20 bp, Artificial Sequence
  chemically synthesized
ctatttgtcaatcagtgaca

SEQ ID NO: 111641 - DNA, 20 bp, Artificial Sequence
  chemically synthesized
ttctatttgtcaatcagtga

SEQ ID NO: 111642 - DNA, 20 bp, Artificial Sequence
  chemically synthesized
cccatattctatttgtcaat

SEQ ID NO: 111643 - DNA, 20 bp, Artificial Sequence
  chemically synthesized
ctctgtcactgattgacaaa

SEQ ID NO: 111644 - DNA, 20 bp, Artificial Sequence
  chemically synthesized
actgattgacaaatagaata

SEQ ID NO: 111645 - DNA, 20 bp, Artificial Sequence
  chemically synthesized
ctgattgacaaatagaatat

SEQ ID NO: 111646 - DNA, 20 bp, Artificial Sequence
  chemically synthesized
gattgacaaatagaatatgg

SEQ ID NO: 111647 - DNA, 20 bp, Artificial Sequence
  chemically synthesized
tgacaaatagaatatgggag

SEQ ID NO: 111648 - DNA, 20 bp, Artificial Sequence
  chemically synthesized
gcctgccctaaaagcaagaa

SEQ ID NO: 111649 - DNA, 20 bp, Artificial Sequence
  chemically synthesized
agcaaaaccattcttgcttt

SEQ ID NO: 111650 - DNA, 20 bp, Artificial Sequence
  chemically synthesized
gcaaaaccattcttgctttt

SEQ ID NO: 111651 - DNA, 20 bp, Artificial Sequence
  chemically synthesized
caaaaccattcttgctttta

SEQ ID NO: 111652 - DNA, 20 bp, Artificial Sequence
  chemically synthesized
tcaaggcctgccctaaaagc

SEQ ID NO: 111653 - DNA, 20 bp, Artificial Sequence
  chemically synthesized
aaccattcttgcttttaggg

SEQ ID NO: 111654 - DNA, 20 bp, Artificial Sequence
  chemically synthesized
accattcttgcttttagggc

SEQ ID NO: 111655 - DNA, 20 bp, Artificial Sequence
  chemically synthesized
cttctcaaggcctgccctaa

SEQ ID NO: 111656 - DNA, 20 bp, Artificial Sequence
  chemically synthesized
ttgcttttagggcaggcctt

SEQ ID NO: 111657 - DNA, 20 bp, Artificial Sequence
  chemically synthesized
cttttagggcaggccttgag

SEQ ID NO: 111658 - DNA, 20 bp, Artificial Sequence
  chemically synthesized
ttaaagctgcaagcttctca

SEQ ID NO: 111659 - DNA, 20 bp, Artificial Sequence
  chemically synthesized
attaaagctgcaagcttctc

SEQ ID NO: 111660 - DNA, 20 bp, Artificial Sequence
  chemically synthesized
ggcaggccttgagaagcttg

SEQ ID NO: 111661 - DNA, 20 bp, Artificial Sequence
  chemically synthesized
ggacaagaaattaaagctgc

SEQ ID NO: 111662 - DNA, 20 bp, Artificial Sequence
  chemically synthesized
tcctaagggacaagaaatta

SEQ ID NO: 111663 - DNA, 20 bp, Artificial Sequence
  chemically synthesized
agctttaatttcttgtccct

SEQ ID NO: 111664 - DNA, 20 bp, Artificial Sequence
  chemically synthesized
gctttaatttcttgtccctt

SEQ ID NO: 111665 - DNA, 20 bp, Artificial Sequence
  chemically synthesized
gagcaattatcctaagggac

SEQ ID NO: 111666 - DNA, 20 bp, Artificial Sequence
  chemically synthesized
cccaagagcaattatcctaa

SEQ ID NO: 111667 - DNA, 20 bp, Artificial Sequence
  chemically synthesized
tcccaagagcaattatccta

SEQ ID NO: 111668 - DNA, 20 bp, Artificial Sequence
  chemically synthesized
gtcccaagagcaattatcct

SEQ ID NO: 111669 - DNA, 20 bp, Artificial Sequence
  chemically synthesized
tcccttaggataattgctct

SEQ ID NO: 111670 - DNA, 20 bp, Artificial Sequence
  chemically synthesized
cccttaggataattgctctt

SEQ ID NO: 111671 - DNA, 20 bp, Artificial Sequence
  chemically synthesized
gtgtaagagttgggtcccaa

SEQ ID NO: 111672 - DNA, 20 bp, Artificial Sequence
  chemically synthesized
cagtgtaagagttgggtccc

SEQ ID NO: 111673 - DNA, 20 bp, Artificial Sequence
  chemically synthesized
tttttcacagtgtaagagtt

SEQ ID NO: 111674 - DNA, 20 bp, Artificial Sequence
  chemically synthesized
ctttttcacagtgtaagagt

SEQ ID NO: 111675 - DNA, 20 bp, Artificial Sequence
  chemically synthesized
tgggctttttcacagtgtaa

SEQ ID NO: 111676 - DNA, 20 bp, Artificial Sequence
  chemically synthesized
tttgggctttttcacagtgt

SEQ ID NO: 111677 - DNA, 20 bp, Artificial Sequence
  chemically synthesized
ccaactcttacactgtgaaa

SEQ ID NO: 111678 - DNA, 20 bp, Artificial Sequence
  chemically synthesized
gagcagtttgggctttttca

SEQ ID NO: 111679 - DNA, 20 bp, Artificial Sequence
  chemically synthesized
acctctccatggagcagttt

SEQ ID NO: 111680 - DNA, 20 bp, Artificial Sequence
  chemically synthesized
gacctctccatggagcagtt

SEQ ID NO: 111681 - DNA, 20 bp, Artificial Sequence
  chemically synthesized
aaaaagcccaaactgctcca

SEQ ID NO: 111682 - DNA, 20 bp, Artificial Sequence
  chemically synthesized
aaagcccaaactgctccatg

SEQ ID NO: 111683 - DNA, 20 bp, Artificial Sequence
  chemically synthesized
atgtggacctctccatggag

SEQ ID NO: 111684 - DNA, 20 bp, Artificial Sequence
  chemically synthesized
agcccaaactgctccatgga

SEQ ID NO: 111685 - DNA, 20 bp, Artificial Sequence
  chemically synthesized
gcccaaactgctccatggag

SEQ ID NO: 111686 - DNA, 20 bp, Artificial Sequence
  chemically synthesized
ttcatgtggacctctccatg

SEQ ID NO: 111687 - DNA, 20 bp, Artificial Sequence
  chemically synthesized
tcttcatgtggacctctcca

SEQ ID NO: 111688 - DNA, 20 bp, Artificial Sequence
  chemically synthesized
tccatggagaggtccacatg

SEQ ID NO: 111689 - DNA, 20 bp, Artificial Sequence
  chemically synthesized
actgtcagtttttcttcatg

SEQ ID NO: 111690 - DNA, 20 bp, Artificial Sequence
  chemically synthesized
tccacatgaagaaaaactga

SEQ ID NO: 111691 - DNA, 20 bp, Artificial Sequence
  chemically synthesized
catgaagaaaaactgacagt

SEQ ID NO: 111692 - DNA, 20 bp, Artificial Sequence
  chemically synthesized
ggaaaataggtgctgactgt

SEQ ID NO: 111693 - DNA, 20 bp, Artificial Sequence
  chemically synthesized
gacagtcagcacctattttc

SEQ ID NO: 111694 - DNA, 20 bp, Artificial Sequence
  chemically synthesized
acagtcagcacctattttcc

SEQ ID NO: 111695 - DNA, 20 bp, Artificial Sequence
  chemically synthesized
cactcacatgcctggaaaat

SEQ ID NO: 111696 - DNA, 20 bp, Artificial Sequence
  chemically synthesized
tcactcacatgcctggaaaa

SEQ ID NO: 111697 - DNA, 20 bp, Artificial Sequence
  chemically synthesized
cacctattttccaggcatgt

SEQ ID NO: 111698 - DNA, 20 bp, Artificial Sequence
  chemically synthesized
agagggctcactcacatgcc

SEQ ID NO: 111699 - DNA, 20 bp, Artificial Sequence
  chemically synthesized
tattttccaggcatgtgagt

SEQ ID NO: 111700 - DNA, 20 bp, Artificial Sequence
  chemically synthesized
ggcatgtgagtgagccctct

SEQ ID NO: 111701 - DNA, 20 bp, Artificial Sequence
  chemically synthesized
atgtgagtgagccctcttgg

SEQ ID NO: 111702 - DNA, 20 bp, Artificial Sequence
  chemically synthesized
tggaggattcacttccaaga

SEQ ID NO: 111703 - DNA, 20 bp, Artificial Sequence
  chemically synthesized
ctggaggattcacttccaag

SEQ ID NO: 111704 - DNA, 20 bp, Artificial Sequence
  chemically synthesized
gctggaggattcacttccaa

SEQ ID NO: 111705 - DNA, 20 bp, Artificial Sequence
  chemically synthesized
atgctggaggattcacttcc

SEQ ID NO: 111706 - DNA, 20 bp, Artificial Sequence
  chemically synthesized
cctcttggaagtgaatcctc

SEQ ID NO: 111707 - DNA, 20 bp, Artificial Sequence
  chemically synthesized
ggaagtgaatcctccagcat

SEQ ID NO: 111708 - DNA, 20 bp, Artificial Sequence
  chemically synthesized
ggtagattgcctgatgctgg

SEQ ID NO: 111709 - DNA, 20 bp, Artificial Sequence
  chemically synthesized
gaagtgaatcctccagcatc

SEQ ID NO: 111710 - DNA, 20 bp, Artificial Sequence
  chemically synthesized
gggtagattgcctgatgctg

SEQ ID NO: 111711 - DNA, 20 bp, Artificial Sequence
  chemically synthesized
tggggtagattgcctgatgc

SEQ ID NO: 111712 - DNA, 20 bp, Artificial Sequence
  chemically synthesized
tcagttgatatcagttgggg

SEQ ID NO: 111713 - DNA, 20 bp, Artificial Sequence
  chemically synthesized
gtttcagttgatatcagttg

SEQ ID NO: 111714 - DNA, 20 bp, Artificial Sequence
  chemically synthesized
tgtttcagttgatatcagtt

SEQ ID NO: 111715 - DNA, 20 bp, Artificial Sequence
  chemically synthesized
ctgtttcagttgatatcagt

SEQ ID NO: 111716 - DNA, 20 bp, Artificial Sequence
  chemically synthesized
atccctgtttcagttgatat

SEQ ID NO: 111717 - DNA, 20 bp, Artificial Sequence
  chemically synthesized
ccaactgatatcaactgaaa

SEQ ID NO: 111718 - DNA, 20 bp, Artificial Sequence
  chemically synthesized
caactgatatcaactgaaac

SEQ ID NO: 111719 - DNA, 20 bp, Artificial Sequence
  chemically synthesized
aactgatatcaactgaaaca

SEQ ID NO: 111720 - DNA, 20 bp, Artificial Sequence
  chemically synthesized
gggcttgcttatccctgttt

SEQ ID NO: 111721 - DNA, 20 bp, Artificial Sequence
  chemically synthesized
atatcaactgaaacagggat

SEQ ID NO: 111722 - DNA, 20 bp, Artificial Sequence
  chemically synthesized
caactgaaacagggataagc

SEQ ID NO: 111723 - DNA, 20 bp, Artificial Sequence
  chemically synthesized
agtttgctcaaggttcaatg

SEQ ID NO: 111724 - DNA, 20 bp, Artificial Sequence
  chemically synthesized
cagtttgctcaaggttcaat

SEQ ID NO: 111725 - DNA, 20 bp, Artificial Sequence
  chemically synthesized
acagtttgctcaaggttcaa

SEQ ID NO: 111726 - DNA, 20 bp, Artificial Sequence
  chemically synthesized
agcaagccccattgaacctt

SEQ ID NO: 111727 - DNA, 20 bp, Artificial Sequence
  chemically synthesized
atgaatctacagtttgctca

SEQ ID NO: 111728 - DNA, 20 bp, Artificial Sequence
  chemically synthesized
catgaatctacagtttgctc

SEQ ID NO: 111729 - DNA, 20 bp, Artificial Sequence
  chemically synthesized
attgaaccttgagcaaactg

SEQ ID NO: 111730 - DNA, 20 bp, Artificial Sequence
  chemically synthesized
ttgttttgttcatgaatcta

SEQ ID NO: 111731 - DNA, 20 bp, Artificial Sequence
  chemically synthesized
tgtagattcatgaacaaaac

SEQ ID NO: 111732 - DNA, 20 bp, Artificial Sequence
  chemically synthesized
aaaacaagtaatttttactg

SEQ ID NO: 111733 - DNA, 20 bp, Artificial Sequence
  chemically synthesized
agcccaaaacttcatggctt

SEQ ID NO: 111734 - DNA, 20 bp, Artificial Sequence
  chemically synthesized
taatttttactgaagccatg

SEQ ID NO: 111735 - DNA, 20 bp, Artificial Sequence
  chemically synthesized
caagccagcccaaaacttca

SEQ ID NO: 111736 - DNA, 20 bp, Artificial Sequence
  chemically synthesized
ttactgaagccatgaagttt

SEQ ID NO: 111737 - DNA, 20 bp, Artificial Sequence
  chemically synthesized
tactgaagccatgaagtttt

SEQ ID NO: 111738 - DNA, 20 bp, Artificial Sequence
  chemically synthesized
gaagccatgaagttttgggc

SEQ ID NO: 111739 - DNA, 20 bp, Artificial Sequence
  chemically synthesized
acttttgctacataacaagc

SEQ ID NO: 111740 - DNA, 20 bp, Artificial Sequence
  chemically synthesized
ttttgggctggcttgttatg

SEQ ID NO: 111741 - DNA, 20 bp, Artificial Sequence
  chemically synthesized
gttaacttttgctacataac

SEQ ID NO: 111742 - DNA, 20 bp, Artificial Sequence
  chemically synthesized
gctggcttgttatgtagcaa

SEQ ID NO: 111743 - DNA, 20 bp, Artificial Sequence
  chemically synthesized
gttatgtagcaaaagttaac

SEQ ID NO: 111744 - DNA, 20 bp, Artificial Sequence
  chemically synthesized
taagatcagagaaggtattc

SEQ ID NO: 111745 - DNA, 20 bp, Artificial Sequence
  chemically synthesized
cttatgagtaagatcagaga

SEQ ID NO: 111746 - DNA, 20 bp, Artificial Sequence
  chemically synthesized
ccttatgagtaagatcagag

SEQ ID NO: 111747 - DNA, 20 bp, Artificial Sequence
  chemically synthesized
atcccttatgagtaagatca

SEQ ID NO: 111748 - DNA, 20 bp, Artificial Sequence
  chemically synthesized
gcatcccttatgagtaagat

SEQ ID NO: 111749 - DNA, 20 bp, Artificial Sequence
  chemically synthesized
ccttctctgatcttactcat

SEQ ID NO: 111750 - DNA, 20 bp, Artificial Sequence
  chemically synthesized
cttctctgatcttactcata

SEQ ID NO: 111751 - DNA, 20 bp, Artificial Sequence
  chemically synthesized
cttctgcatcccttatgagt

SEQ ID NO: 111752 - DNA, 20 bp, Artificial Sequence
  chemically synthesized
ttctctgatcttactcataa

SEQ ID NO: 111753 - DNA, 20 bp, Artificial Sequence
  chemically synthesized
gcaccttctgcatcccttat

SEQ ID NO: 111754 - DNA, 20 bp, Artificial Sequence
  chemically synthesized
gatcttactcataagggatg

SEQ ID NO: 111755 - DNA, 20 bp, Artificial Sequence
  chemically synthesized
cttactcataagggatgcag

SEQ ID NO: 111756 - DNA, 20 bp, Artificial Sequence
  chemically synthesized
ttactcataagggatgcaga

SEQ ID NO: 111757 - DNA, 20 bp, Artificial Sequence
  chemically synthesized
gcagaaggtgccccttctct

SEQ ID NO: 111758 - DNA, 20 bp, Artificial Sequence
  chemically synthesized
ctttagtcatccaagagaag

SEQ ID NO: 111759 - DNA, 20 bp, Artificial Sequence
  chemically synthesized
cctttagtcatccaagagaa

SEQ ID NO: 111760 - DNA, 20 bp, Artificial Sequence
  chemically synthesized
tcctttagtcatccaagaga

SEQ ID NO: 111761 - DNA, 20 bp, Artificial Sequence
  chemically synthesized
gtcctttagtcatccaagag

SEQ ID NO: 111762 - DNA, 20 bp, Artificial Sequence
  chemically synthesized
aaagtcctttagtcatccaa

SEQ ID NO: 111763 - DNA, 20 bp, Artificial Sequence
  chemically synthesized
acaaagtcctttagtcatcc

SEQ ID NO: 111764 - DNA, 20 bp, Artificial Sequence
  chemically synthesized
ccccttctcttggatgacta

SEQ ID NO: 111765 - DNA, 20 bp, Artificial Sequence
  chemically synthesized
cccttctcttggatgactaa

SEQ ID NO: 111766 - DNA, 20 bp, Artificial Sequence
  chemically synthesized
taatagagtacaaagtcctt

SEQ ID NO: 111767 - DNA, 20 bp, Artificial Sequence
  chemically synthesized
ctatattataatagagtaca

SEQ ID NO: 111768 - DNA, 20 bp, Artificial Sequence
  chemically synthesized
ggaagggctatattataata

SEQ ID NO: 111769 - DNA, 20 bp, Artificial Sequence
  chemically synthesized
aaggaagggctatattataa

SEQ ID NO: 111770 - DNA, 20 bp, Artificial Sequence
  chemically synthesized
ctttgtactctattataata

SEQ ID NO: 111771 - DNA, 20 bp, Artificial Sequence
  chemically synthesized
agacctagccaaggaaggaa

SEQ ID NO: 111772 - DNA, 20 bp, Artificial Sequence
  chemically synthesized
gagacctagccaaggaagga

SEQ ID NO: 111773 - DNA, 20 bp, Artificial Sequence
  chemically synthesized
taatatagcccttccttcct

SEQ ID NO: 111774 - DNA, 20 bp, Artificial Sequence
  chemically synthesized
agagacctagccaaggaagg

SEQ ID NO: 111775 - DNA, 20 bp, Artificial Sequence
  chemically synthesized
cagagagacctagccaagga

SEQ ID NO: 111776 - DNA, 20 bp, Artificial Sequence
  chemically synthesized
atagcccttccttccttggc

SEQ ID NO: 111777 - DNA, 20 bp, Artificial Sequence
  chemically synthesized
acagagagacctagccaagg

SEQ ID NO: 111778 - DNA, 20 bp, Artificial Sequence
  chemically synthesized
tagcccttccttccttggct

SEQ ID NO: 111779 - DNA, 20 bp, Artificial Sequence
  chemically synthesized
aggacagagagacctagcca

SEQ ID NO: 111780 - DNA, 20 bp, Artificial Sequence
  chemically synthesized
gaggacagagagacctagcc

SEQ ID NO: 111781 - DNA, 20 bp, Artificial Sequence
  chemically synthesized
ggcaggaggacagagagacc

SEQ ID NO: 111782 - DNA, 20 bp, Artificial Sequence
  chemically synthesized
gcttggggcaggaggacaga

SEQ ID NO: 111783 - DNA, 20 bp, Artificial Sequence
  chemically synthesized
gggcttggggcaggaggaca

SEQ ID NO: 111784 - DNA, 20 bp, Artificial Sequence
  chemically synthesized
tggggcttggggcaggagga

SEQ ID NO: 111785 - DNA, 20 bp, Artificial Sequence
  chemically synthesized
gtggtggggcttggggcagg

SEQ ID NO: 111786 - DNA, 20 bp, Artificial Sequence
  chemically synthesized
tctctctgtcctcctgcccc

SEQ ID NO: 111787 - DNA, 20 bp, Artificial Sequence
  chemically synthesized
agtggtggggcttggggcag

SEQ ID NO: 111788 - DNA, 20 bp, Artificial Sequence
  chemically synthesized
atagtggtggggcttggggc

SEQ ID NO: 111789 - DNA, 20 bp, Artificial Sequence
  chemically synthesized
aatagtggtggggcttgggg

SEQ ID NO: 111790 - DNA, 20 bp, Artificial Sequence
  chemically synthesized
attaatagtggtggggcttg

SEQ ID NO: 111791 - DNA, 20 bp, Artificial Sequence
  chemically synthesized
aattaatagtggtggggctt

SEQ ID NO: 111792 - DNA, 20 bp, Artificial Sequence
  chemically synthesized
gaattaatagtggtggggct

SEQ ID NO: 111793 - DNA, 20 bp, Artificial Sequence
  chemically synthesized
aagaggaattaatagtggtg

SEQ ID NO: 111794 - DNA, 20 bp, Artificial Sequence
  chemically synthesized
aaagaggaattaatagtggt

SEQ ID NO: 111795 - DNA, 20 bp, Artificial Sequence
  chemically synthesized
aaaagaggaattaatagtgg

SEQ ID NO: 111796 - DNA, 20 bp, Artificial Sequence
  chemically synthesized
cccaaaagaggaattaatag

SEQ ID NO: 111797 - DNA, 20 bp, Artificial Sequence
  chemically synthesized
taccccaaaagaggaattaa

SEQ ID NO: 111798 - DNA, 20 bp, Artificial Sequence
  chemically synthesized
accactattaattcctcttt

SEQ ID NO: 111799 - DNA, 20 bp, Artificial Sequence
  chemically synthesized
ccactattaattcctctttt

SEQ ID NO: 111800 - DNA, 20 bp, Artificial Sequence
  chemically synthesized
cactattaattcctcttttg

SEQ ID NO: 111801 - DNA, 20 bp, Artificial Sequence
  chemically synthesized
atatggaactaccccaaaag

SEQ ID NO: 111802 - DNA, 20 bp, Artificial Sequence
  chemically synthesized
gatatggaactaccccaaaa

SEQ ID NO: 111803 - DNA, 20 bp, Artificial Sequence
  chemically synthesized
tattaattcctcttttgggg

SEQ ID NO: 111804 - DNA, 20 bp, Artificial Sequence
  chemically synthesized
aagatatggaactaccccaa

SEQ ID NO: 111805 - DNA, 20 bp, Artificial Sequence
  chemically synthesized
atatacaagttgataagata

SEQ ID NO: 111806 - DNA, 20 bp, Artificial Sequence
  chemically synthesized
atgaaaatatacaagttgat

SEQ ID NO: 111807 - DNA, 20 bp, Artificial Sequence
  chemically synthesized
aaacaggcatgaaaatatac

SEQ ID NO: 111808 - DNA, 20 bp, Artificial Sequence
  chemically synthesized
tcttctacagaacagtaaac

SEQ ID NO: 111809 - DNA, 20 bp, Artificial Sequence
  chemically synthesized
atcttctacagaacagtaaa

SEQ ID NO: 111810 - DNA, 20 bp, Artificial Sequence
  chemically synthesized
catgcctgtttactgttctg

SEQ ID NO: 111811 - DNA, 20 bp, Artificial Sequence
  chemically synthesized
aagtgggatcttctacagaa

SEQ ID NO: 111812 - DNA, 20 bp, Artificial Sequence
  chemically synthesized
gcctgtttactgttctgtag

SEQ ID NO: 111813 - DNA, 20 bp, Artificial Sequence
  chemically synthesized
ttaagaagtgggatcttcta

SEQ ID NO: 111814 - DNA, 20 bp, Artificial Sequence
  chemically synthesized
aagaagagctattaagaagt

SEQ ID NO: 111815 - DNA, 20 bp, Artificial Sequence
  chemically synthesized
taagaagagctattaagaag

SEQ ID NO: 111816 - DNA, 20 bp, Artificial Sequence
  chemically synthesized
tagaagatcccacttcttaa

SEQ ID NO: 111817 - DNA, 20 bp, Artificial Sequence
  chemically synthesized
ttttaagaagagctattaag

SEQ ID NO: 111818 - DNA, 20 bp, Artificial Sequence
  chemically synthesized
gacttttaagaagagctatt

SEQ ID NO: 111819 - DNA, 20 bp, Artificial Sequence
  chemically synthesized
ttcttaatagctcttcttaa

SEQ ID NO: 111820 - DNA, 20 bp, Artificial Sequence
  chemically synthesized
ctgaatgtgacttttaagaa

SEQ ID NO: 111821 - DNA, 20 bp, Artificial Sequence
  chemically synthesized
tcctgaatgtgacttttaag

SEQ ID NO: 111822 - DNA, 20 bp, Artificial Sequence
  chemically synthesized
gattcctgaatgtgactttt

SEQ ID NO: 111823 - DNA, 20 bp, Artificial Sequence
  chemically synthesized
ctcttcttaaaagtcacatt

SEQ ID NO: 111824 - DNA, 20 bp, Artificial Sequence
  chemically synthesized
tcttcttaaaagtcacattc

SEQ ID NO: 111825 - DNA, 20 bp, Artificial Sequence
  chemically synthesized
cattcaggaatccattcaaa

SEQ ID NO: 111826 - DNA, 20 bp, Artificial Sequence
  chemically synthesized
tggaaaatgtactttttgaa

SEQ ID NO: 111827 - DNA, 20 bp, Artificial Sequence
  chemically synthesized
aaaaagtacattttccacta

SEQ ID NO: 111828 - DNA, 20 bp, Artificial Sequence
  chemically synthesized
aaaagtacattttccactac

SEQ ID NO: 111829 - DNA, 20 bp, Artificial Sequence
  chemically synthesized
catgcaatatatacccgtag

SEQ ID NO: 111830 - DNA, 20 bp, Artificial Sequence
  chemically synthesized
attcatgcaatatatacccg

SEQ ID NO: 111831 - DNA, 20 bp, Artificial Sequence
  chemically synthesized
atgaatttcaaaatttcttt

SEQ ID NO: 111832 - DNA, 20 bp, Artificial Sequence
  chemically synthesized
tgaatttcaaaatttctttc

SEQ ID NO: 111833 - DNA, 20 bp, Artificial Sequence
  chemically synthesized
atctttcatccatgacctga

SEQ ID NO: 111834 - DNA, 20 bp, Artificial Sequence
  chemically synthesized
tcaaaatttctttcaggtca

SEQ ID NO: 111835 - DNA, 20 bp, Artificial Sequence
  chemically synthesized
ttctttcaggtcatggatga

SEQ ID NO: 111836 - DNA, 20 bp, Artificial Sequence
  chemically synthesized
tcatggatgaaagatgaatt

SEQ ID NO: 111837 - DNA, 20 bp, Artificial Sequence
  chemically synthesized
catggatgaaagatgaattt

SEQ ID NO: 111838 - DNA, 20 bp, Artificial Sequence
  chemically synthesized
atggatgaaagatgaattta

SEQ ID NO: 111839 - DNA, 20 bp, Artificial Sequence
  chemically synthesized
gatgcaaccattgcattgat

SEQ ID NO: 111840 - DNA, 20 bp, Artificial Sequence
  chemically synthesized
gggttgtctaatcaatgcaa

SEQ ID NO: 111841 - DNA, 20 bp, Artificial Sequence
  chemically synthesized
tgcaatggttgcatccaaat

SEQ ID NO: 111842 - DNA, 20 bp, Artificial Sequence
  chemically synthesized
ggaaaacaagtgttcttatt

SEQ ID NO: 111843 - DNA, 20 bp, Artificial Sequence
  chemically synthesized
tctcttttggagtggaaaac

SEQ ID NO: 111844 - DNA, 20 bp, Artificial Sequence
  chemically synthesized
acacttgttttccactccaa

SEQ ID NO: 111845 - DNA, 20 bp, Artificial Sequence
  chemically synthesized
ttgttgattctcttttggag

SEQ ID NO: 111846 - DNA, 20 bp, Artificial Sequence
  chemically synthesized
acttgttttccactccaaaa

SEQ ID NO: 111847 - DNA, 20 bp, Artificial Sequence
  chemically synthesized
aaattgttgattctcttttg

SEQ ID NO: 111848 - DNA, 20 bp, Artificial Sequence
  chemically synthesized
gtaaattgttgattctcttt

SEQ ID NO: 111849 - DNA, 20 bp, Artificial Sequence
  chemically synthesized
gaatcaacaatttaccatac

SEQ ID NO: 111850 - DNA, 20 bp, Artificial Sequence
  chemically synthesized
aatcaacaatttaccatacc

SEQ ID NO: 111851 - DNA, 20 bp, Artificial Sequence
  chemically synthesized
ggtagcttcttcacctggta

SEQ ID NO: 111852 - DNA, 20 bp, Artificial Sequence
  chemically synthesized
acaatttaccataccaggtg

SEQ ID NO: 111853 - DNA, 20 bp, Artificial Sequence
  chemically synthesized
atttaccataccaggtgaag

SEQ ID NO: 111854 - DNA, 20 bp, Artificial Sequence
  chemically synthesized
gtagaggtagcttcttcacc

SEQ ID NO: 111855 - DNA, 20 bp, Artificial Sequence
  chemically synthesized
aaaagtgcaatgagtagagg

SEQ ID NO: 111856 - DNA, 20 bp, Artificial Sequence
  chemically synthesized
ttaaaaagtgcaatgagtag

SEQ ID NO: 111857 - DNA, 20 bp, Artificial Sequence
  chemically synthesized
tttaaaaagtgcaatgagta

SEQ ID NO: 111858 - DNA, 20 bp, Artificial Sequence
  chemically synthesized
gttttaaaaagtgcaatgag

SEQ ID NO: 111859 - DNA, 20 bp, Artificial Sequence
  chemically synthesized
gcagttttaaaaagtgcaat

SEQ ID NO: 111860 - DNA, 20 bp, Artificial Sequence
  chemically synthesized
ctgtgcaatgcagttttaaa

SEQ ID NO: 111861 - DNA, 20 bp, Artificial Sequence
  chemically synthesized
ctttttaaaactgcattgca

SEQ ID NO: 111862 - DNA, 20 bp, Artificial Sequence
  chemically synthesized
tggaaaatggctgtgcaatg

SEQ ID NO: 111863 - DNA, 20 bp, Artificial Sequence
  chemically synthesized
ctttacaaatatttggaaaa

SEQ ID NO: 111864 - DNA, 20 bp, Artificial Sequence
  chemically synthesized
gcagtagctttacaaatatt

SEQ ID NO: 111865 - DNA, 20 bp, Artificial Sequence
  chemically synthesized
ccattttccaaatatttgta

SEQ ID NO: 111866 - DNA, 20 bp, Artificial Sequence
  chemically synthesized
atcctttttagtttttgcag

SEQ ID NO: 111867 - DNA, 20 bp, Artificial Sequence
  chemically synthesized
taaatcctttttagtttttg

SEQ ID NO: 111868 - DNA, 20 bp, Artificial Sequence
  chemically synthesized
aagctactgcaaaaactaaa

SEQ ID NO: 111869 - DNA, 20 bp, Artificial Sequence
  chemically synthesized
agctactgcaaaaactaaaa

SEQ ID NO: 111870 - DNA, 20 bp, Artificial Sequence
  chemically synthesized
tttactccataaatcctttt

SEQ ID NO: 111871 - DNA, 20 bp, Artificial Sequence
  chemically synthesized
caaaaactaaaaaggattta

SEQ ID NO: 111872 - DNA, 20 bp, Artificial Sequence
  chemically synthesized
aaaactaaaaaggatttatg

SEQ ID NO: 111873 - DNA, 20 bp, Artificial Sequence
  chemically synthesized
aggatttatggagtaaatca

SEQ ID NO: 111874 - DNA, 20 bp, Artificial Sequence
  chemically synthesized
ggatttatggagtaaatcat

SEQ ID NO: 111875 - DNA, 20 bp, Artificial Sequence
  chemically synthesized
tttatggagtaaatcatggg

SEQ ID NO: 111876 - DNA, 20 bp, Artificial Sequence
  chemically synthesized
taaatcatgggaagaatgcc

SEQ ID NO: 111877 - DNA, 20 bp, Artificial Sequence
  chemically synthesized
catgggaagaatgcctggtc

SEQ ID NO: 111878 - DNA, 20 bp, Artificial Sequence
  chemically synthesized
gggaagaatgcctggtcaag

SEQ ID NO: 111879 - DNA, 20 bp, Artificial Sequence
  chemically synthesized
tatttatgaaccacttgacc

SEQ ID NO: 111880 - DNA, 20 bp, Artificial Sequence
  chemically synthesized
atatttatgaaccacttgac

SEQ ID NO: 111881 - DNA, 20 bp, Artificial Sequence
  chemically synthesized
tcaagtggttcataaatatc

SEQ ID NO: 111882 - DNA, 20 bp, Artificial Sequence
  chemically synthesized
caagtggttcataaatatcc

SEQ ID NO: 111883 - DNA, 20 bp, Artificial Sequence
  chemically synthesized
accccaaatagaatgagacc

SEQ ID NO: 111884 - DNA, 20 bp, Artificial Sequence
  chemically synthesized
gctgtgaccccaaatagaat

SEQ ID NO: 111885 - DNA, 20 bp, Artificial Sequence
  chemically synthesized
tatccaggtctcattctatt

SEQ ID NO: 111886 - DNA, 20 bp, Artificial Sequence
  chemically synthesized
atccaggtctcattctattt

SEQ ID NO: 111887 - DNA, 20 bp, Artificial Sequence
  chemically synthesized
tccaggtctcattctatttg

SEQ ID NO: 111888 - DNA, 20 bp, Artificial Sequence
  chemically synthesized
ttcaaggctgtgaccccaaa

SEQ ID NO: 111889 - DNA, 20 bp, Artificial Sequence
  chemically synthesized
tctcattctatttggggtca

SEQ ID NO: 111890 - DNA, 20 bp, Artificial Sequence
  chemically synthesized
tcaatattggattaaattca

SEQ ID NO: 111891 - DNA, 20 bp, Artificial Sequence
  chemically synthesized
ttcaatattggattaaattc

SEQ ID NO: 111892 - DNA, 20 bp, Artificial Sequence
  chemically synthesized
ccaattcaacaattcaatat

SEQ ID NO: 111893 - DNA, 20 bp, Artificial Sequence
  chemically synthesized
ccaatattgaattgttgaat

SEQ ID NO: 111894 - DNA, 20 bp, Artificial Sequence
  chemically synthesized
caatattgaattgttgaatt

SEQ ID NO: 111895 - DNA, 20 bp, Artificial Sequence
  chemically synthesized
atattgaattgttgaattgg

SEQ ID NO: 111896 - DNA, 20 bp, Artificial Sequence
  chemically synthesized
gaattgttgaattgggagca

SEQ ID NO: 111897 - DNA, 20 bp, Artificial Sequence
  chemically synthesized
tgaattgggagcaaagaatt

SEQ ID NO: 111898 - DNA, 20 bp, Artificial Sequence
  chemically synthesized
gaattgggagcaaagaattg

SEQ ID NO: 111899 - DNA, 20 bp, Artificial Sequence
  chemically synthesized
caaagaattgaggtgaaatg

SEQ ID NO: 111900 - DNA, 20 bp, Artificial Sequence
  chemically synthesized
gaattgaggtgaaatgtggt

SEQ ID NO: 111901 - DNA, 20 bp, Artificial Sequence
  chemically synthesized
gtgaaatgtggttggctcct

SEQ ID NO: 111902 - DNA, 20 bp, Artificial Sequence
  chemically synthesized
gaaatgtggttggctcctga

SEQ ID NO: 111903 - DNA, 20 bp, Artificial Sequence
  chemically synthesized
agcatttcagttgctctcag

SEQ ID NO: 111904 - DNA, 20 bp, Artificial Sequence
  chemically synthesized
gcagcatttcagttgctctc

SEQ ID NO: 111905 - DNA, 20 bp, Artificial Sequence
  chemically synthesized
agcagcatttcagttgctct

SEQ ID NO: 111906 - DNA, 20 bp, Artificial Sequence
  chemically synthesized
ctctgcaggaagcagcattt

SEQ ID NO: 111907 - DNA, 20 bp, Artificial Sequence
  chemically synthesized
aactgaaatgctgcttcctg

SEQ ID NO: 111908 - DNA, 20 bp, Artificial Sequence
  chemically synthesized
aagttattctctgcaggaag

SEQ ID NO: 111909 - DNA, 20 bp, Artificial Sequence
  chemically synthesized
ctgaaatgctgcttcctgca

SEQ ID NO: 111910 - DNA, 20 bp, Artificial Sequence
  chemically synthesized
agaaagttattctctgcagg

SEQ ID NO: 111911 - DNA, 20 bp, Artificial Sequence
  chemically synthesized
caaagaaagttattctctgc

SEQ ID NO: 111912 - DNA, 20 bp, Artificial Sequence
  chemically synthesized
acaaagaaagttattctctg

SEQ ID NO: 111913 - DNA, 20 bp, Artificial Sequence
  chemically synthesized
ttctctgggagttacaaaga

SEQ ID NO: 111914 - DNA, 20 bp, Artificial Sequence
  chemically synthesized
attattctctgggagttaca

SEQ ID NO: 111915 - DNA, 20 bp, Artificial Sequence
  chemically synthesized
ataactttctttgtaactcc

SEQ ID NO: 111916 - DNA, 20 bp, Artificial Sequence
  chemically synthesized
aactttctttgtaactccca

SEQ ID NO: 111917 - DNA, 20 bp, Artificial Sequence
  chemically synthesized
gcaaatatattattctctgg

SEQ ID NO: 111918 - DNA, 20 bp, Artificial Sequence
  chemically synthesized
ttgcaaatatattattctct

SEQ ID NO: 111919 - DNA, 20 bp, Artificial Sequence
  chemically synthesized
tttgcaaatatattattctc

SEQ ID NO: 111920 - DNA, 20 bp, Artificial Sequence
  chemically synthesized
cagagaataatatatttgca

SEQ ID NO: 111921 - DNA, 20 bp, Artificial Sequence
  chemically synthesized
agagaataatatatttgcaa

SEQ ID NO: 111922 - DNA, 20 bp, Artificial Sequence
  chemically synthesized
taatatatttgcaaaggtgt

SEQ ID NO: 111923 - DNA, 20 bp, Artificial Sequence
  chemically synthesized
atatatttgcaaaggtgttg

SEQ ID NO: 111924 - DNA, 20 bp, Artificial Sequence
  chemically synthesized
tatatttgcaaaggtgttgg

SEQ ID NO: 111925 - DNA, 20 bp, Artificial Sequence
  chemically synthesized
gcaaaggtgttggaggtgaa

SEQ ID NO: 111926 - DNA, 20 bp, Artificial Sequence
  chemically synthesized
tgttggaggtgaatagatat

SEQ ID NO: 111927 - DNA, 20 bp, Artificial Sequence
  chemically synthesized
ttggaggtgaatagatatta

SEQ ID NO: 111928 - DNA, 20 bp, Artificial Sequence
  chemically synthesized
ggaggtgaatagatattaga

SEQ ID NO: 111929 - DNA, 20 bp, Artificial Sequence
  chemically synthesized
gaggtgaatagatattagag

SEQ ID NO: 111930 - DNA, 20 bp, Artificial Sequence
  chemically synthesized
aatagatattagagaggaaa

SEQ ID NO: 111931 - DNA, 20 bp, Artificial Sequence
  chemically synthesized
agaggaaaaagtaaaatctt

SEQ ID NO: 111932 - DNA, 20 bp, Artificial Sequence
  chemically synthesized
aggaaaaagtaaaatcttta

SEQ ID NO: 111933 - DNA, 20 bp, Artificial Sequence
  chemically synthesized
tataatctttcagttctcta

SEQ ID NO: 111934 - DNA, 20 bp, Artificial Sequence
  chemically synthesized
taaaatctttagagaactga

SEQ ID NO: 111935 - DNA, 20 bp, Artificial Sequence
  chemically synthesized
gtcacataaatataatcttt

SEQ ID NO: 111936 - DNA, 20 bp, Artificial Sequence
  chemically synthesized
aagattatatttatgtgact

SEQ ID NO: 111937 - DNA, 20 bp, Artificial Sequence
  chemically synthesized
ataataacttacaatgatct

SEQ ID NO: 111938 - DNA, 20 bp, Artificial Sequence
  chemically synthesized
tatgtgactcagatcattgt

SEQ ID NO: 111939 - DNA, 20 bp, Artificial Sequence
  chemically synthesized
gactattgactattcaatat

SEQ ID NO: 111940 - DNA, 20 bp, Artificial Sequence
  chemically synthesized
attataatgctaatattgaa

SEQ ID NO: 111941 - DNA, 20 bp, Artificial Sequence
  chemically synthesized
tgctaatattgaatagtcaa

SEQ ID NO: 111942 - DNA, 20 bp, Artificial Sequence
  chemically synthesized
gtcaatagtcaacatgctaa

SEQ ID NO: 111943 - DNA, 20 bp, Artificial Sequence
  chemically synthesized
gttgtccttgagaggtctgt

SEQ ID NO: 111944 - DNA, 20 bp, Artificial Sequence
  chemically synthesized
aacatgctaacagacctctc

SEQ ID NO: 111945 - DNA, 20 bp, Artificial Sequence
  chemically synthesized
acatgctaacagacctctca

SEQ ID NO: 111946 - DNA, 20 bp, Artificial Sequence
  chemically synthesized
agtctgtggttgtccttgag

SEQ ID NO: 111947 - DNA, 20 bp, Artificial Sequence
  chemically synthesized
gagtctgtggttgtccttga

SEQ ID NO: 111948 - DNA, 20 bp, Artificial Sequence
  chemically synthesized
ctgagtctgtggttgtcctt

SEQ ID NO: 111949 - DNA, 20 bp, Artificial Sequence
  chemically synthesized
agacctctcaaggacaacca

SEQ ID NO: 111950 - DNA, 20 bp, Artificial Sequence
  chemically synthesized
ctcaaggacaaccacagact

SEQ ID NO: 111951 - DNA, 20 bp, Artificial Sequence
  chemically synthesized
tcaaggacaaccacagactc

SEQ ID NO: 111952 - DNA, 20 bp, Artificial Sequence
  chemically synthesized
tttgtttgctcctgagtctg

SEQ ID NO: 111953 - DNA, 20 bp, Artificial Sequence
  chemically synthesized
aaggacaaccacagactcag

SEQ ID NO: 111954 - DNA, 20 bp, Artificial Sequence
  chemically synthesized
aattacttttgtttgctcct

SEQ ID NO: 111955 - DNA, 20 bp, Artificial Sequence
  chemically synthesized
acagactcaggagcaaacaa

SEQ ID NO: 111956 - DNA, 20 bp, Artificial Sequence
  chemically synthesized
tctgtttcttgatagtgaga

SEQ ID NO: 111957 - DNA, 20 bp, Artificial Sequence
  chemically synthesized
tttgttgctttctcactatc

SEQ ID NO: 111958 - DNA, 20 bp, Artificial Sequence
  chemically synthesized
aatgtctgtttcttgatagt

SEQ ID NO: 111959 - DNA, 20 bp, Artificial Sequence
  chemically synthesized
gaagaatgtctgtttcttga

SEQ ID NO: 111960 - DNA, 20 bp, Artificial Sequence
  chemically synthesized
gctttctcactatcaagaaa

SEQ ID NO: 111961 - DNA, 20 bp, Artificial Sequence
  chemically synthesized
gaaacagacattcttccatc

SEQ ID NO: 111962 - DNA, 20 bp, Artificial Sequence
  chemically synthesized
gatcatattagtctagatgg

SEQ ID NO: 111963 - DNA, 20 bp, Artificial Sequence
  chemically synthesized
ggagatcatattagtctaga

SEQ ID NO: 111964 - DNA, 20 bp, Artificial Sequence
  chemically synthesized
cactggagatcatattagtc

SEQ ID NO: 111965 - DNA, 20 bp, Artificial Sequence
  chemically synthesized
tttcccactggagatcatat

SEQ ID NO: 111966 - DNA, 20 bp, Artificial Sequence
  chemically synthesized
atctagactaatatgatctc

SEQ ID NO: 111967 - DNA, 20 bp, Artificial Sequence
  chemically synthesized
tagactaatatgatctccag

SEQ ID NO: 111968 - DNA, 20 bp, Artificial Sequence
  chemically synthesized
agactaatatgatctccagt

SEQ ID NO: 111969 - DNA, 20 bp, Artificial Sequence
  chemically synthesized
acataaatcatttcccactg

SEQ ID NO: 111970 - DNA, 20 bp, Artificial Sequence
  chemically synthesized
agacataaatcatttcccac

SEQ ID NO: 111971 - DNA, 20 bp, Artificial Sequence
  chemically synthesized
agagagtttcatgaatgtaa

SEQ ID NO: 111972 - DNA, 20 bp, Artificial Sequence
  chemically synthesized
agagagagtttcatgaatgt

SEQ ID NO: 111973 - DNA, 20 bp, Artificial Sequence
  chemically synthesized
ttacgcctggttatgagaga

SEQ ID NO: 111974 - DNA, 20 bp, Artificial Sequence
  chemically synthesized
cattacgcctggttatgaga

SEQ ID NO: 111975 - DNA, 20 bp, Artificial Sequence
  chemically synthesized
atgaaactctctctcataac

SEQ ID NO: 111976 - DNA, 20 bp, Artificial Sequence
  chemically synthesized
gtcattacgcctggttatga

SEQ ID NO: 111977 - DNA, 20 bp, Artificial Sequence
  chemically synthesized
tgaaactctctctcataacc

SEQ ID NO: 111978 - DNA, 20 bp, Artificial Sequence
  chemically synthesized
aagtcattacgcctggttat

SEQ ID NO: 111979 - DNA, 20 bp, Artificial Sequence
  chemically synthesized
gtaaaagaagtcattacgcc

SEQ ID NO: 111980 - DNA, 20 bp, Artificial Sequence
  chemically synthesized
attctccgaagaggtaaaag

SEQ ID NO: 111981 - DNA, 20 bp, Artificial Sequence
  chemically synthesized
gccattctccgaagaggtaa

SEQ ID NO: 111982 - DNA, 20 bp, Artificial Sequence
  chemically synthesized
aatgacttcttttacctctt

SEQ ID NO: 111983 - DNA, 20 bp, Artificial Sequence
  chemically synthesized
tgacttcttttacctcttcg

SEQ ID NO: 111984 - DNA, 20 bp, Artificial Sequence
  chemically synthesized
aaatcagccattctccgaag

SEQ ID NO: 111985 - DNA, 20 bp, Artificial Sequence
  chemically synthesized
taaatcagccattctccgaa

SEQ ID NO: 111986 - DNA, 20 bp, Artificial Sequence
  chemically synthesized
tcttttacctcttcggagaa

SEQ ID NO: 111987 - DNA, 20 bp, Artificial Sequence
  chemically synthesized
cataaatcagccattctccg

SEQ ID NO: 111988 - DNA, 20 bp, Artificial Sequence
  chemically synthesized
acaaaggtctgtgcataaat

SEQ ID NO: 111989 - DNA, 20 bp, Artificial Sequence
  chemically synthesized
gagaatggctgatttatgca

SEQ ID NO: 111990 - DNA, 20 bp, Artificial Sequence
  chemically synthesized
aaagaaaagttattgcacaa

SEQ ID NO: 111991 - DNA, 20 bp, Artificial Sequence
  chemically synthesized
taaagaaaagttattgcaca

SEQ ID NO: 111992 - DNA, 20 bp, Artificial Sequence
  chemically synthesized
tgtgcaataacttttcttta

SEQ ID NO: 111993 - DNA, 20 bp, Artificial Sequence
  chemically synthesized
cagcatcaatctttaaagaa

SEQ ID NO: 111994 - DNA, 20 bp, Artificial Sequence
  chemically synthesized
tttaacagcatcaatcttta

SEQ ID NO: 111995 - DNA, 20 bp, Artificial Sequence
  chemically synthesized
cacatttttttcatgtttaa

SEQ ID NO: 111996 - DNA, 20 bp, Artificial Sequence
  chemically synthesized
tattaaaataaaatgtcaga

SEQ ID NO: 111997 - DNA, 20 bp, Artificial Sequence
  chemically synthesized
attatattaaaataaaatgt

SEQ ID NO: 111998 - DNA, 20 bp, Artificial Sequence
  chemically synthesized
cattttattttaatataatt

SEQ ID NO: 111999 - DNA, 20 bp, Artificial Sequence
  chemically synthesized
aggtccttttgcagtttaca

SEQ ID NO: 112000 - DNA, 20 bp, Artificial Sequence
  chemically synthesized
gaaaaccatgtaaactgcaa

SEQ ID NO: 112001 - DNA, 20 bp, Artificial Sequence
  chemically synthesized
aaaaccatgtaaactgcaaa

SEQ ID NO: 112002 - DNA, 20 bp, Artificial Sequence
  chemically synthesized
ttccacatgaggtccttttg

SEQ ID NO: 112003 - DNA, 20 bp, Artificial Sequence
  chemically synthesized
aactgcaaaaggacctcatg

SEQ ID NO: 112004 - DNA, 20 bp, Artificial Sequence
  chemically synthesized
tgtgattttcattccacatg

SEQ ID NO: 112005 - DNA, 20 bp, Artificial Sequence
  chemically synthesized
atgtgattttcattccacat

SEQ ID NO: 112006 - DNA, 20 bp, Artificial Sequence
  chemically synthesized
ttgaaaataatttaggttat

SEQ ID NO: 112007 - DNA, 20 bp, Artificial Sequence
  chemically synthesized
aatggtattgaaaataattt

SEQ ID NO: 112008 - DNA, 20 bp, Artificial Sequence
  chemically synthesized
taatggtattgaaaataatt

SEQ ID NO: 112009 - DNA, 20 bp, Artificial Sequence
  chemically synthesized
aggtattagtcaaagattaa

SEQ ID NO: 112010 - DNA, 20 bp, Artificial Sequence
  chemically synthesized
aacattccaggtattagtca

SEQ ID NO: 112011 - DNA, 20 bp, Artificial Sequence
  chemically synthesized
attaatctttgactaatacc

SEQ ID NO: 112012 - DNA, 20 bp, Artificial Sequence
  chemically synthesized
taataaaacattccaggtat

SEQ ID NO: 112013 - DNA, 20 bp, Artificial Sequence
  chemically synthesized
ttctgataataaaacattcc

SEQ ID NO: 112014 - DNA, 20 bp, Artificial Sequence
  chemically synthesized
attctgataataaaacattc

SEQ ID NO: 112015 - DNA, 20 bp, Artificial Sequence
  chemically synthesized
tacctggaatgttttattat

SEQ ID NO: 112016 - DNA, 20 bp, Artificial Sequence
  chemically synthesized
ttttattatcagaattatga

SEQ ID NO: 112017 - DNA, 20 bp, Artificial Sequence
  chemically synthesized
tttattatcagaattatgaa

SEQ ID NO: 112018 - DNA, 20 bp, Artificial Sequence
  chemically synthesized
atcagaattatgaaaggcac

SEQ ID NO: 112019 - DNA, 20 bp, Artificial Sequence
  chemically synthesized
cagaattatgaaaggcacaa

SEQ ID NO: 112020 - DNA, 20 bp, Artificial Sequence
  chemically synthesized
gaattatgaaaggcacaaga

SEQ ID NO: 112021 - DNA, 20 bp, Artificial Sequence
  chemically synthesized
aattatgaaaggcacaagag

SEQ ID NO: 112022 - DNA, 20 bp, Artificial Sequence
  chemically synthesized
gcacaagagaggcactaatg

SEQ ID NO: 112023 - DNA, 20 bp, Artificial Sequence
  chemically synthesized
atttttaagatgaactacat

SEQ ID NO: 112024 - DNA, 20 bp, Artificial Sequence
  chemically synthesized
aagtcctttaaattattttt

SEQ ID NO: 112025 - DNA, 20 bp, Artificial Sequence
  chemically synthesized
ttcatcttaaaaataattta

SEQ ID NO: 112026 - DNA, 20 bp, Artificial Sequence
  chemically synthesized
tcatcttaaaaataatttaa

SEQ ID NO: 112027 - DNA, 20 bp, Artificial Sequence
  chemically synthesized
aaaaataatttaaaggactt

SEQ ID NO: 112028 - DNA, 20 bp, Artificial Sequence
  chemically synthesized
ggggataaaaaaagaatctt

SEQ ID NO: 112029 - DNA, 20 bp, Artificial Sequence
  chemically synthesized
gtaaattgaggggataaaaa

SEQ ID NO: 112030 - DNA, 20 bp, Artificial Sequence
  chemically synthesized
ttctcaaagtgtaaattgag

SEQ ID NO: 112031 - DNA, 20 bp, Artificial Sequence
  chemically synthesized
attctcaaagtgtaaattga

SEQ ID NO: 112032 - DNA, 20 bp, Artificial Sequence
  chemically synthesized
aattctcaaagtgtaaattg

SEQ ID NO: 112033 - DNA, 20 bp, Artificial Sequence
  chemically synthesized
aaattctcaaagtgtaaatt

SEQ ID NO: 112034 - DNA, 20 bp, Artificial Sequence
  chemically synthesized
atcccctcaatttacacttt

SEQ ID NO: 112035 - DNA, 20 bp, Artificial Sequence
  chemically synthesized
atcctactggaaaattctca

SEQ ID NO: 112036 - DNA, 20 bp, Artificial Sequence
  chemically synthesized
tttacactttgagaattttc

SEQ ID NO: 112037 - DNA, 20 bp, Artificial Sequence
  chemically synthesized
acactttgagaattttccag

SEQ ID NO: 112038 - DNA, 20 bp, Artificial Sequence
  chemically synthesized
cactttgagaattttccagt

SEQ ID NO: 112039 - DNA, 20 bp, Artificial Sequence
  chemically synthesized
ttgagaattttccagtagga

SEQ ID NO: 112040 - DNA, 20 bp, Artificial Sequence
  chemically synthesized
tgagaattttccagtaggat

SEQ ID NO: 112041 - DNA, 20 bp, Artificial Sequence
  chemically synthesized
acaatcactacccatcctac

SEQ ID NO: 112042 - DNA, 20 bp, Artificial Sequence
  chemically synthesized
gaattttccagtaggatggg

SEQ ID NO: 112043 - DNA, 20 bp, Artificial Sequence
  chemically synthesized
agtgattgttacctatcaca

SEQ ID NO: 112044 - DNA, 20 bp, Artificial Sequence
  chemically synthesized
atgatattcctctatgtgat

SEQ ID NO: 112045 - DNA, 20 bp, Artificial Sequence
  chemically synthesized
tgattgttacctatcacata

SEQ ID NO: 112046 - DNA, 20 bp, Artificial Sequence
  chemically synthesized
aatgatattcctctatgtga

SEQ ID NO: 112047 - DNA, 20 bp, Artificial Sequence
  chemically synthesized
gattgttacctatcacatag

SEQ ID NO: 112048 - DNA, 20 bp, Artificial Sequence
  chemically synthesized
gaatatcattttttttgttt

SEQ ID NO: 112049 - DNA, 20 bp, Artificial Sequence
  chemically synthesized
tcattttttttgttttggtc

SEQ ID NO: 112050 - DNA, 20 bp, Artificial Sequence
  chemically synthesized
tttttttgttttggtctaga

SEQ ID NO: 112051 - DNA, 20 bp, Artificial Sequence
  chemically synthesized
gtctttgggagcagactttc

SEQ ID NO: 112052 - DNA, 20 bp, Artificial Sequence
  chemically synthesized
gtctagaaagtctgctccca

SEQ ID NO: 112053 - DNA, 20 bp, Artificial Sequence
  chemically synthesized
gggttattggtctttgggag

SEQ ID NO: 112054 - DNA, 20 bp, Artificial Sequence
  chemically synthesized
ttagggttattggtctttgg

SEQ ID NO: 112055 - DNA, 20 bp, Artificial Sequence
  chemically synthesized
ttttagggttattggtcttt

SEQ ID NO: 112056 - DNA, 20 bp, Artificial Sequence
  chemically synthesized
tttttagggttattggtctt

SEQ ID NO: 112057 - DNA, 20 bp, Artificial Sequence
  chemically synthesized
gaataattttttagggttat

SEQ ID NO: 112058 - DNA, 20 bp, Artificial Sequence
  chemically synthesized
taaccttgaataatttttta

SEQ ID NO: 112059 - DNA, 20 bp, Artificial Sequence
  chemically synthesized
ctaaccttgaataatttttt

SEQ ID NO: 112060 - DNA, 20 bp, Artificial Sequence
  chemically synthesized
tctaaccttgaataattttt

SEQ ID NO: 112061 - DNA, 20 bp, Artificial Sequence
  chemically synthesized
ataaccctaaaaaattattc

SEQ ID NO: 112062 - DNA, 20 bp, Artificial Sequence
  chemically synthesized
taaccctaaaaaattattca

SEQ ID NO: 112063 - DNA, 20 bp, Artificial Sequence
  chemically synthesized
cctaaaaaattattcaaggt

SEQ ID NO: 112064 - DNA, 20 bp, Artificial Sequence
  chemically synthesized
taaaaaattattcaaggtta

SEQ ID NO: 112065 - DNA, 20 bp, Artificial Sequence
  chemically synthesized
aaaaaattattcaaggttag

SEQ ID NO: 112066 - DNA, 20 bp, Artificial Sequence
  chemically synthesized
aaattattcaaggttagagg

SEQ ID NO: 112067 - DNA, 20 bp, Artificial Sequence
  chemically synthesized
aattattcaaggttagagga

SEQ ID NO: 112068 - DNA, 20 bp, Artificial Sequence
  chemically synthesized
attattcaaggttagaggaa

SEQ ID NO: 112069 - DNA, 20 bp, Artificial Sequence
  chemically synthesized
tattcaaggttagaggaagg

SEQ ID NO: 112070 - DNA, 20 bp, Artificial Sequence
  chemically synthesized
attcaaggttagaggaaggg

SEQ ID NO: 112071 - DNA, 20 bp, Artificial Sequence
  chemically synthesized
tcaaggttagaggaagggag

SEQ ID NO: 112072 - DNA, 20 bp, Artificial Sequence
  chemically synthesized
caaggttagaggaagggagg

SEQ ID NO: 112073 - DNA, 20 bp, Artificial Sequence
  chemically synthesized
aggttagaggaagggaggag

SEQ ID NO: 112074 - DNA, 20 bp, Artificial Sequence
  chemically synthesized
tagaggaagggaggaggaga

SEQ ID NO: 112075 - DNA, 20 bp, Artificial Sequence
  chemically synthesized
ttgaccacagaaaaatgtca

SEQ ID NO: 112076 - DNA, 20 bp, Artificial Sequence
  chemically synthesized
aattctttgacatttttctg

SEQ ID NO: 112077 - DNA, 20 bp, Artificial Sequence
  chemically synthesized
ggtcaggaaaagtttgacca

SEQ ID NO: 112078 - DNA, 20 bp, Artificial Sequence
  chemically synthesized
agaattgaaaaggtcaggaa

SEQ ID NO: 112079 - DNA, 20 bp, Artificial Sequence
  chemically synthesized
aaacaagaattgaaaaggtc

SEQ ID NO: 112080 - DNA, 20 bp, Artificial Sequence
  chemically synthesized
caaacaagaattgaaaaggt

SEQ ID NO: 112081 - DNA, 20 bp, Artificial Sequence
  chemically synthesized
tctccaaacaagaattgaaa

SEQ ID NO: 112082 - DNA, 20 bp, Artificial Sequence
  chemically synthesized
ttctccaaacaagaattgaa

SEQ ID NO: 112083 - DNA, 20 bp, Artificial Sequence
  chemically synthesized
tgaccttttcaattcttgtt

SEQ ID NO: 112084 - DNA, 20 bp, Artificial Sequence
  chemically synthesized
accttttcaattcttgtttg

SEQ ID NO: 112085 - DNA, 20 bp, Artificial Sequence
  chemically synthesized
tcagaacttcttctccaaac

SEQ ID NO: 112086 - DNA, 20 bp, Artificial Sequence
  chemically synthesized
ttttcaattcttgtttggag

SEQ ID NO: 112087 - DNA, 20 bp, Artificial Sequence
  chemically synthesized
tcaattcttgtttggagaag

SEQ ID NO: 112088 - DNA, 20 bp, Artificial Sequence
  chemically synthesized
ggacaagatccacataattt

SEQ ID NO: 112089 - DNA, 20 bp, Artificial Sequence
  chemically synthesized
gaagaagttctgaaattatg

SEQ ID NO: 112090 - DNA, 20 bp, Artificial Sequence
  chemically synthesized
gaaattatgtggatcttgtc

SEQ ID NO: 112091 - DNA, 20 bp, Artificial Sequence
  chemically synthesized
aaattatgtggatcttgtcc

SEQ ID NO: 112092 - DNA, 20 bp, Artificial Sequence
  chemically synthesized
atctccattagaacctggac

SEQ ID NO: 112093 - DNA, 20 bp, Artificial Sequence
  chemically synthesized
ctttgatctccattagaacc

SEQ ID NO: 112094 - DNA, 20 bp, Artificial Sequence
  chemically synthesized
ggatcttgtccaggttctaa

SEQ ID NO: 112095 - DNA, 20 bp, Artificial Sequence
  chemically synthesized
atcttgtccaggttctaatg

SEQ ID NO: 112096 - DNA, 20 bp, Artificial Sequence
  chemically synthesized
caactttctttgatctccat

SEQ ID NO: 112097 - DNA, 20 bp, Artificial Sequence
  chemically synthesized
ccaggttctaatggagatca

SEQ ID NO: 112098 - DNA, 20 bp, Artificial Sequence
  chemically synthesized
gttctaatggagatcaaaga

SEQ ID NO: 112099 - DNA, 20 bp, Artificial Sequence
  chemically synthesized
taatggagatcaaagaaagt

SEQ ID NO: 112100 - DNA, 20 bp, Artificial Sequence
  chemically synthesized
gatcaaagaaagttggcaaa

SEQ ID NO: 112101 - DNA, 20 bp, Artificial Sequence
  chemically synthesized
agaaagttggcaaatagtcc

SEQ ID NO: 112102 - DNA, 20 bp, Artificial Sequence
  chemically synthesized
atgaaaacattgagaaggct

SEQ ID NO: 112103 - DNA, 20 bp, Artificial Sequence
  chemically synthesized
aatgaaaacattgagaaggc

SEQ ID NO: 112104 - DNA, 20 bp, Artificial Sequence
  chemically synthesized
tggcaatgaaaacattgaga

SEQ ID NO: 112105 - DNA, 20 bp, Artificial Sequence
  chemically synthesized
gtggcaatgaaaacattgag

SEQ ID NO: 112106 - DNA, 20 bp, Artificial Sequence
  chemically synthesized
gcagtggcaatgaaaacatt

SEQ ID NO: 112107 - DNA, 20 bp, Artificial Sequence
  chemically synthesized
aaatgcataccatggggcag

SEQ ID NO: 112108 - DNA, 20 bp, Artificial Sequence
  chemically synthesized
ttttcattgccactgcccca

SEQ ID NO: 112109 - DNA, 20 bp, Artificial Sequence
  chemically synthesized
tttaaatgcataccatgggg

SEQ ID NO: 112110 - DNA, 20 bp, Artificial Sequence
  chemically synthesized
tgttttaaatgcataccatg

SEQ ID NO: 112111 - DNA, 20 bp, Artificial Sequence
  chemically synthesized
ttgttttaaatgcataccat

SEQ ID NO: 112112 - DNA, 20 bp, Artificial Sequence
  chemically synthesized
gttgttttaaatgcatacca

SEQ ID NO: 112113 - DNA, 20 bp, Artificial Sequence
  chemically synthesized
taacgttaataaaattaata

SEQ ID NO: 112114 - DNA, 20 bp, Artificial Sequence
  chemically synthesized
attttattaacgttatctat

SEQ ID NO: 112115 - DNA, 20 bp, Artificial Sequence
  chemically synthesized
gaaatcacaccaatgactga

SEQ ID NO: 112116 - DNA, 20 bp, Artificial Sequence
  chemically synthesized
taacgttatctatcagtcat

SEQ ID NO: 112117 - DNA, 20 bp, Artificial Sequence
  chemically synthesized
ccaaacatcctgagtaacac

SEQ ID NO: 112118 - DNA, 20 bp, Artificial Sequence
  chemically synthesized
gtgtgatttcctgtgttact

SEQ ID NO: 112119 - DNA, 20 bp, Artificial Sequence
  chemically synthesized
cccaaacatcctgagtaaca

SEQ ID NO: 112120 - DNA, 20 bp, Artificial Sequence
  chemically synthesized
tgtgatttcctgtgttactc

SEQ ID NO: 112121 - DNA, 20 bp, Artificial Sequence
  chemically synthesized
ttctttttcccaaacatcct

SEQ ID NO: 112122 - DNA, 20 bp, Artificial Sequence
  chemically synthesized
cctgtgttactcaggatgtt

SEQ ID NO: 112123 - DNA, 20 bp, Artificial Sequence
  chemically synthesized
ctgtgttactcaggatgttt

SEQ ID NO: 112124 - DNA, 20 bp, Artificial Sequence
  chemically synthesized
tactcaggatgtttgggaaa

SEQ ID NO: 112125 - DNA, 20 bp, Artificial Sequence
  chemically synthesized
gaaacacagtttggtaaaag

SEQ ID NO: 112126 - DNA, 20 bp, Artificial Sequence
  chemically synthesized
ctgaaacacagtttggtaaa

SEQ ID NO: 112127 - DNA, 20 bp, Artificial Sequence
  chemically synthesized
cctgaaacacagtttggtaa

SEQ ID NO: 112128 - DNA, 20 bp, Artificial Sequence
  chemically synthesized
agattgcctgaaacacagtt

SEQ ID NO: 112129 - DNA, 20 bp, Artificial Sequence
  chemically synthesized
ccttttaccaaactgtgttt

SEQ ID NO: 112130 - DNA, 20 bp, Artificial Sequence
  chemically synthesized
cttttaccaaactgtgtttc

SEQ ID NO: 112131 - DNA, 20 bp, Artificial Sequence
  chemically synthesized
agttgagattgcctgaaaca

SEQ ID NO: 112132 - DNA, 20 bp, Artificial Sequence
  chemically synthesized
gtttcaggcaatctcaactt

SEQ ID NO: 112133 - DNA, 20 bp, Artificial Sequence
  chemically synthesized
ttcaatcagacaccaaagtt

SEQ ID NO: 112134 - DNA, 20 bp, Artificial Sequence
  chemically synthesized
tctctttcaatcagacacca

SEQ ID NO: 112135 - DNA, 20 bp, Artificial Sequence
  chemically synthesized
caactttggtgtctgattga

SEQ ID NO: 112136 - DNA, 20 bp, Artificial Sequence
  chemically synthesized
actttggtgtctgattgaaa

SEQ ID NO: 112137 - DNA, 20 bp, Artificial Sequence
  chemically synthesized
cttggcccttctctttcaat

SEQ ID NO: 112138 - DNA, 20 bp, Artificial Sequence
  chemically synthesized
ttggtgtctgattgaaagag

SEQ ID NO: 112139 - DNA, 20 bp, Artificial Sequence
  chemically synthesized
tggtgtctgattgaaagaga

SEQ ID NO: 112140 - DNA, 20 bp, Artificial Sequence
  chemically synthesized
ggtgtctgattgaaagagaa

SEQ ID NO: 112141 - DNA, 20 bp, Artificial Sequence
  chemically synthesized
ctgattgaaagagaagggcc

SEQ ID NO: 112142 - DNA, 20 bp, Artificial Sequence
  chemically synthesized
cttgggaaaatacattgact

SEQ ID NO: 112143 - DNA, 20 bp, Artificial Sequence
  chemically synthesized
ccaagtcaatgtattttccc

SEQ ID NO: 112144 - DNA, 20 bp, Artificial Sequence
  chemically synthesized
caagtcaatgtattttccca

SEQ ID NO: 112145 - DNA, 20 bp, Artificial Sequence
  chemically synthesized
agtcaatgtattttcccaag

SEQ ID NO: 112146 - DNA, 20 bp, Artificial Sequence
  chemically synthesized
gtcaatgtattttcccaagg

SEQ ID NO: 112147 - DNA, 20 bp, Artificial Sequence
  chemically synthesized
tcaatgtattttcccaagga

SEQ ID NO: 112148 - DNA, 20 bp, Artificial Sequence
  chemically synthesized
tctttcataatgccctcctt

SEQ ID NO: 112149 - DNA, 20 bp, Artificial Sequence
  chemically synthesized
atctttcataatgccctcct

SEQ ID NO: 112150 - DNA, 20 bp, Artificial Sequence
  chemically synthesized
tcccaaggagggcattatga

SEQ ID NO: 112151 - DNA, 20 bp, Artificial Sequence
  chemically synthesized
ttatactgaaaattgtaaga

SEQ ID NO: 112152 - DNA, 20 bp, Artificial Sequence
  chemically synthesized
tattatactgaaaattgtaa

SEQ ID NO: 112153 - DNA, 20 bp, Artificial Sequence
  chemically synthesized
catattatactgaaaattgt

SEQ ID NO: 112154 - DNA, 20 bp, Artificial Sequence
  chemically synthesized
aatatctctcttacaatttt

SEQ ID NO: 112155 - DNA, 20 bp, Artificial Sequence
  chemically synthesized
atatgtttgttatcatgaat

SEQ ID NO: 112156 - DNA, 20 bp, Artificial Sequence
  chemically synthesized
tatgtttgttatcatgaatg

SEQ ID NO: 112157 - DNA, 20 bp, Artificial Sequence
  chemically synthesized
atgtttgttatcatgaatga

SEQ ID NO: 112158 - DNA, 20 bp, Artificial Sequence
  chemically synthesized
ttatcatgaatgagggtatt

SEQ ID NO: 112159 - DNA, 20 bp, Artificial Sequence
  chemically synthesized
aaagtcttgggatataaaca

SEQ ID NO: 112160 - DNA, 20 bp, Artificial Sequence
  chemically synthesized
taaagtcttgggatataaac

SEQ ID NO: 112161 - DNA, 20 bp, Artificial Sequence
  chemically synthesized
ttcagccttgtttatatccc

SEQ ID NO: 112162 - DNA, 20 bp, Artificial Sequence
  chemically synthesized
gaaaagctctttaaagtctt

SEQ ID NO: 112163 - DNA, 20 bp, Artificial Sequence
  chemically synthesized
ggaaaagctctttaaagtct

SEQ ID NO: 112164 - DNA, 20 bp, Artificial Sequence
  chemically synthesized
gtttatatcccaagacttta

SEQ ID NO: 112165 - DNA, 20 bp, Artificial Sequence
  chemically synthesized
ttatatcccaagactttaaa

SEQ ID NO: 112166 - DNA, 20 bp, Artificial Sequence
  chemically synthesized
cgttttggaaaagctcttta

SEQ ID NO: 112167 - DNA, 20 bp, Artificial Sequence
  chemically synthesized
catattgactcgttttggaa

SEQ ID NO: 112168 - DNA, 20 bp, Artificial Sequence
  chemically synthesized
ttaaagagcttttccaaaac

SEQ ID NO: 112169 - DNA, 20 bp, Artificial Sequence
  chemically synthesized
gcgttcatattgactcgttt

SEQ ID NO: 112170 - DNA, 20 bp, Artificial Sequence
  chemically synthesized
acgagtcaatatgaacgctt

SEQ ID NO: 112171 - DNA, 20 bp, Artificial Sequence
  chemically synthesized
ttccataaattttagttctt

SEQ ID NO: 112172 - DNA, 20 bp, Artificial Sequence
  chemically synthesized
cgcttaagaactaaaattta

SEQ ID NO: 112173 - DNA, 20 bp, Artificial Sequence
  chemically synthesized
tgttaatcttccataaattt

SEQ ID NO: 112174 - DNA, 20 bp, Artificial Sequence
  chemically synthesized
ttaagaactaaaatttatgg

SEQ ID NO: 112175 - DNA, 20 bp, Artificial Sequence
  chemically synthesized
ttatggaagattaacaattg

SEQ ID NO: 112176 - DNA, 20 bp, Artificial Sequence
  chemically synthesized
aaatccattttgtttaaaga

SEQ ID NO: 112177 - DNA, 20 bp, Artificial Sequence
  chemically synthesized
ttgaaaatccattttgttta

SEQ ID NO: 112178 - DNA, 20 bp, Artificial Sequence
  chemically synthesized
gaagctttctttaaacaaaa

SEQ ID NO: 112179 - DNA, 20 bp, Artificial Sequence
  chemically synthesized
aaatggattttcaacactca

SEQ ID NO: 112180 - DNA, 20 bp, Artificial Sequence
  chemically synthesized
cttgaaatattggttactgt

SEQ ID NO: 112181 - DNA, 20 bp, Artificial Sequence
  chemically synthesized
ctcacagtaaccaatatttc

SEQ ID NO: 112182 - DNA, 20 bp, Artificial Sequence
  chemically synthesized
tgaaactatgcttgaaatat

SEQ ID NO: 112183 - DNA, 20 bp, Artificial Sequence
  chemically synthesized
agtaaccaatatttcaagca

SEQ ID NO: 112184 - DNA, 20 bp, Artificial Sequence
  chemically synthesized
agaaactacttagaaagaaa

SEQ ID NO: 112185 - DNA, 20 bp, Artificial Sequence
  chemically synthesized
tcacacgtctatttctttct

SEQ ID NO: 112186 - DNA, 20 bp, Artificial Sequence
  chemically synthesized
cacgtctatttctttctaag

SEQ ID NO: 112187 - DNA, 20 bp, Artificial Sequence
  chemically synthesized
tgtgtgagaaactacttaga

SEQ ID NO: 112188 - DNA, 20 bp, Artificial Sequence
  chemically synthesized
gatttgtgtgagaaactact

SEQ ID NO: 112189 - DNA, 20 bp, Artificial Sequence
  chemically synthesized
aattctcatttgatttgtgt

SEQ ID NO: 112190 - DNA, 20 bp, Artificial Sequence
  chemically synthesized
gtttctcacacaaatcaaat

SEQ ID NO: 112191 - DNA, 20 bp, Artificial Sequence
  chemically synthesized
caaatgagaattgtgctctc

SEQ ID NO: 112192 - DNA, 20 bp, Artificial Sequence
  chemically synthesized
aaatgagaattgtgctctca

SEQ ID NO: 112193 - DNA, 20 bp, Artificial Sequence
  chemically synthesized
ttatttcactatcaccttga

SEQ ID NO: 112194 - DNA, 20 bp, Artificial Sequence
  chemically synthesized
gaattgtgctctcaaggtga

SEQ ID NO: 112195 - DNA, 20 bp, Artificial Sequence
  chemically synthesized
gtttatttcactatcacctt

SEQ ID NO: 112196 - DNA, 20 bp, Artificial Sequence
  chemically synthesized
tagtgaaataaacaatacca

SEQ ID NO: 112197 - DNA, 20 bp, Artificial Sequence
  chemically synthesized
caatatgtataaatagactt

SEQ ID NO: 112198 - DNA, 20 bp, Artificial Sequence
  chemically synthesized
tttatgtcaatatgtataaa

SEQ ID NO: 112199 - DNA, 20 bp, Artificial Sequence
  chemically synthesized
cttatttttatgtatacata

SEQ ID NO: 112200 - DNA, 20 bp, Artificial Sequence
  chemically synthesized
ctatatgtatacataaaaat

SEQ ID NO: 112201 - DNA, 20 bp, Artificial Sequence
  chemically synthesized
cataaaaataagcctgaaaa

SEQ ID NO: 112202 - DNA, 20 bp, Artificial Sequence
  chemically synthesized
attatgttattactattttc

SEQ ID NO: 112203 - DNA, 20 bp, Artificial Sequence
  chemically synthesized
tattatgttattactatttt

SEQ ID NO: 112204 - DNA, 20 bp, Artificial Sequence
  chemically synthesized
aaatagtaataacataatat

SEQ ID NO: 112205 - DNA, 20 bp, Artificial Sequence
  chemically synthesized
ataatattagctatgtttat

SEQ ID NO: 112206 - DNA, 20 bp, Artificial Sequence
  chemically synthesized
cggtaagcacccaataaaca

SEQ ID NO: 112207 - DNA, 20 bp, Artificial Sequence
  chemically synthesized
taatattagctatgtttatt

SEQ ID NO: 112208 - DNA, 20 bp, Artificial Sequence
  chemically synthesized
aacagtttctggcacacggt

SEQ ID NO: 112209 - DNA, 20 bp, Artificial Sequence
  chemically synthesized
attgggtgcttaccgtgtgc

SEQ ID NO: 112210 - DNA, 20 bp, Artificial Sequence
  chemically synthesized
atggaacagtttctggcaca

SEQ ID NO: 112211 - DNA, 20 bp, Artificial Sequence
  chemically synthesized
gaagtgcatggaacagtttc

SEQ ID NO: 112212 - DNA, 20 bp, Artificial Sequence
  chemically synthesized
atgtactgaagtgcatggaa

SEQ ID NO: 112213 - DNA, 20 bp, Artificial Sequence
  chemically synthesized
agaaactgttccatgcactt

SEQ ID NO: 112214 - DNA, 20 bp, Artificial Sequence
  chemically synthesized
aattaatgtactgaagtgca

SEQ ID NO: 112215 - DNA, 20 bp, Artificial Sequence
  chemically synthesized
tgatgcgaattaatgtactg

SEQ ID NO: 112216 - DNA, 20 bp, Artificial Sequence
  chemically synthesized
acctcttcaggttgttgtga

SEQ ID NO: 112217 - DNA, 20 bp, Artificial Sequence
  chemically synthesized
tacctcttcaggttgttgtg

SEQ ID NO: 112218 - DNA, 20 bp, Artificial Sequence
  chemically synthesized
ctacctcttcaggttgttgt

SEQ ID NO: 112219 - DNA, 20 bp, Artificial Sequence
  chemically synthesized
atcaccctcacaacaacctg

SEQ ID NO: 112220 - DNA, 20 bp, Artificial Sequence
  chemically synthesized
caccctcacaacaacctgaa

SEQ ID NO: 112221 - DNA, 20 bp, Artificial Sequence
  chemically synthesized
accctcacaacaacctgaag

SEQ ID NO: 112222 - DNA, 20 bp, Artificial Sequence
  chemically synthesized
ctcacaacaacctgaagagg

SEQ ID NO: 112223 - DNA, 20 bp, Artificial Sequence
  chemically synthesized
gtaatgacagctacctcttc

SEQ ID NO: 112224 - DNA, 20 bp, Artificial Sequence
  chemically synthesized
agtaatgacagctacctctt

SEQ ID NO: 112225 - DNA, 20 bp, Artificial Sequence
  chemically synthesized
gcataaatcaaaagtaatga

SEQ ID NO: 112226 - DNA, 20 bp, Artificial Sequence
  chemically synthesized
gattatggagcataaatcaa

SEQ ID NO: 112227 - DNA, 20 bp, Artificial Sequence
  chemically synthesized
tgaattgctctcagattatg

SEQ ID NO: 112228 - DNA, 20 bp, Artificial Sequence
  chemically synthesized
tgatttatgctccataatct

SEQ ID NO: 112229 - DNA, 20 bp, Artificial Sequence
  chemically synthesized
tctgaattgctctcagatta

SEQ ID NO: 112230 - DNA, 20 bp, Artificial Sequence
  chemically synthesized
atttatgctccataatctga

SEQ ID NO: 112231 - DNA, 20 bp, Artificial Sequence
  chemically synthesized
acgcatttctgaattgctct

SEQ ID NO: 112232 - DNA, 20 bp, Artificial Sequence
  chemically synthesized
tccataatctgagagcaatt

SEQ ID NO: 112233 - DNA, 20 bp, Artificial Sequence
  chemically synthesized
gcaattcagaaatgcgtcta

SEQ ID NO: 112234 - DNA, 20 bp, Artificial Sequence
  chemically synthesized
ttcagaaatgcgtctatggt

SEQ ID NO: 112235 - DNA, 20 bp, Artificial Sequence
  chemically synthesized
attctggggcttactgacca

SEQ ID NO: 112236 - DNA, 20 bp, Artificial Sequence
  chemically synthesized
gaaatgcgtctatggtcagt

SEQ ID NO: 112237 - DNA, 20 bp, Artificial Sequence
  chemically synthesized
cgtctatggtcagtaagccc

SEQ ID NO: 112238 - DNA, 20 bp, Artificial Sequence
  chemically synthesized
gagtttaaatcgtgattctg

SEQ ID NO: 112239 - DNA, 20 bp, Artificial Sequence
  chemically synthesized
tgagtttaaatcgtgattct

SEQ ID NO: 112240 - DNA, 20 bp, Artificial Sequence
  chemically synthesized
ctgagtttaaatcgtgattc

SEQ ID NO: 112241 - DNA, 20 bp, Artificial Sequence
  chemically synthesized
ccagaatcacgatttaaact

SEQ ID NO: 112242 - DNA, 20 bp, Artificial Sequence
  chemically synthesized
cagaatcacgatttaaactc

SEQ ID NO: 112243 - DNA, 20 bp, Artificial Sequence
  chemically synthesized
aatcacgatttaaactcagg

SEQ ID NO: 112244 - DNA, 20 bp, Artificial Sequence
  chemically synthesized
acgatttaaactcaggcagt

SEQ ID NO: 112245 - DNA, 20 bp, Artificial Sequence
  chemically synthesized
actttgaagcccgactgcct

SEQ ID NO: 112246 - DNA, 20 bp, Artificial Sequence
  chemically synthesized
cgatttaaactcaggcagtc

SEQ ID NO: 112247 - DNA, 20 bp, Artificial Sequence
  chemically synthesized
actcaggcagtcgggcttca

SEQ ID NO: 112248 - DNA, 20 bp, Artificial Sequence
  chemically synthesized
gtttcatagtgtgaactttg

SEQ ID NO: 112249 - DNA, 20 bp, Artificial Sequence
  chemically synthesized
ctggggtggatagtgtttca

SEQ ID NO: 112250 - DNA, 20 bp, Artificial Sequence
  chemically synthesized
ctatgaaacactatccaccc

SEQ ID NO: 112251 - DNA, 20 bp, Artificial Sequence
  chemically synthesized
tagagagaggctggggtgga

SEQ ID NO: 112252 - DNA, 20 bp, Artificial Sequence
  chemically synthesized
gcattagagagaggctgggg

SEQ ID NO: 112253 - DNA, 20 bp, Artificial Sequence
  chemically synthesized
attgcattagagagaggctg

SEQ ID NO: 112254 - DNA, 20 bp, Artificial Sequence
  chemically synthesized
cattgcattagagagaggct

SEQ ID NO: 112255 - DNA, 20 bp, Artificial Sequence
  chemically synthesized
acattgcattagagagaggc

SEQ ID NO: 112256 - DNA, 20 bp, Artificial Sequence
  chemically synthesized
tctgacattgcattagagag

SEQ ID NO: 112257 - DNA, 20 bp, Artificial Sequence
  chemically synthesized
ttctgacattgcattagaga

SEQ ID NO: 112258 - DNA, 20 bp, Artificial Sequence
  chemically synthesized
acttctgacattgcattaga

SEQ ID NO: 112259 - DNA, 20 bp, Artificial Sequence
  chemically synthesized
gtacttctgacattgcatta

SEQ ID NO: 112260 - DNA, 20 bp, Artificial Sequence
  chemically synthesized
tagtacttctgacattgcat

SEQ ID NO: 112261 - DNA, 20 bp, Artificial Sequence
  chemically synthesized
gcctctctctaatgcaatgt

SEQ ID NO: 112262 - DNA, 20 bp, Artificial Sequence
  chemically synthesized
tctctctaatgcaatgtcag

SEQ ID NO: 112263 - DNA, 20 bp, Artificial Sequence
  chemically synthesized
tctgcactttaaatgacgtt

SEQ ID NO: 112264 - DNA, 20 bp, Artificial Sequence
  chemically synthesized
gaagtactaaacgtcattta

SEQ ID NO: 112265 - DNA, 20 bp, Artificial Sequence
  chemically synthesized
actaaacgtcatttaaagtg

SEQ ID NO: 112266 - DNA, 20 bp, Artificial Sequence
  chemically synthesized
taaacgtcatttaaagtgca

SEQ ID NO: 112267 - DNA, 20 bp, Artificial Sequence
  chemically synthesized
aaagtgcagagaaatgccta

SEQ ID NO: 112268 - DNA, 20 bp, Artificial Sequence
  chemically synthesized
aagtgcagagaaatgcctat

SEQ ID NO: 112269 - DNA, 20 bp, Artificial Sequence
  chemically synthesized
gtctccatctcaattcctat

SEQ ID NO: 112270 - DNA, 20 bp, Artificial Sequence
  chemically synthesized
tgtctccatctcaattccta

SEQ ID NO: 112271 - DNA, 20 bp, Artificial Sequence
  chemically synthesized
gagaaatgcctataggaatt

SEQ ID NO: 112272 - DNA, 20 bp, Artificial Sequence
  chemically synthesized
aatgcctataggaattgaga

SEQ ID NO: 112273 - DNA, 20 bp, Artificial Sequence
  chemically synthesized
tgcctataggaattgagatg

SEQ ID NO: 112274 - DNA, 20 bp, Artificial Sequence
  chemically synthesized
ataggaattgagatggagac

SEQ ID NO: 112275 - DNA, 20 bp, Artificial Sequence
  chemically synthesized
gatggagacaagatgtcttc

SEQ ID NO: 112276 - DNA, 20 bp, Artificial Sequence
  chemically synthesized
agacaagatgtcttccagct

SEQ ID NO: 112277 - DNA, 20 bp, Artificial Sequence
  chemically synthesized
gacaagatgtcttccagctt

SEQ ID NO: 112278 - DNA, 20 bp, Artificial Sequence
  chemically synthesized
tccctgagcccccaagctgg

SEQ ID NO: 112279 - DNA, 20 bp, Artificial Sequence
  chemically synthesized
acaagatgtcttccagcttg

SEQ ID NO: 112280 - DNA, 20 bp, Artificial Sequence
  chemically synthesized
caagatgtcttccagcttgg

SEQ ID NO: 112281 - DNA, 20 bp, Artificial Sequence
  chemically synthesized
ttttccctgagcccccaagc

SEQ ID NO: 112282 - DNA, 20 bp, Artificial Sequence
  chemically synthesized
tgtcttccagcttgggggct

SEQ ID NO: 112283 - DNA, 20 bp, Artificial Sequence
  chemically synthesized
ccctttttccctgagccccc

SEQ ID NO: 112284 - DNA, 20 bp, Artificial Sequence
  chemically synthesized
gtcttccagcttgggggctc

SEQ ID NO: 112285 - DNA, 20 bp, Artificial Sequence
  chemically synthesized
tcttccagcttgggggctca

SEQ ID NO: 112286 - DNA, 20 bp, Artificial Sequence
  chemically synthesized
agcttgggggctcagggaaa

SEQ ID NO: 112287 - DNA, 20 bp, Artificial Sequence
  chemically synthesized
cgaatcttccctttttccct

SEQ ID NO: 112288 - DNA, 20 bp, Artificial Sequence
  chemically synthesized
gcttgggggctcagggaaaa

SEQ ID NO: 112289 - DNA, 20 bp, Artificial Sequence
  chemically synthesized
cttgggggctcagggaaaaa

SEQ ID NO: 112290 - DNA, 20 bp, Artificial Sequence
  chemically synthesized
gggggctcagggaaaaaggg

SEQ ID NO: 112291 - DNA, 20 bp, Artificial Sequence
  chemically synthesized
aaaaagggaagattcgaaaa

SEQ ID NO: 112292 - DNA, 20 bp, Artificial Sequence
  chemically synthesized
cattacctacttttcaagga

SEQ ID NO: 112293 - DNA, 20 bp, Artificial Sequence
  chemically synthesized
cgaaaatggctttccttgaa

SEQ ID NO: 112294 - DNA, 20 bp, Artificial Sequence
  chemically synthesized
aaatggctttccttgaaaag

SEQ ID NO: 112295 - DNA, 20 bp, Artificial Sequence
  chemically synthesized
caaacattacctacttttca

SEQ ID NO: 112296 - DNA, 20 bp, Artificial Sequence
  chemically synthesized
aatggctttccttgaaaagt

SEQ ID NO: 112297 - DNA, 20 bp, Artificial Sequence
  chemically synthesized
ccaaacattacctacttttc

SEQ ID NO: 112298 - DNA, 20 bp, Artificial Sequence
  chemically synthesized
cttgaaaagtaggtaatgtt

SEQ ID NO: 112299 - DNA, 20 bp, Artificial Sequence
  chemically synthesized
ttgaaaagtaggtaatgttt

SEQ ID NO: 112300 - DNA, 20 bp, Artificial Sequence
  chemically synthesized
aaagtaggtaatgtttgggt

SEQ ID NO: 112301 - DNA, 20 bp, Artificial Sequence
  chemically synthesized
aggtaatgtttgggtaagct

SEQ ID NO: 112302 - DNA, 20 bp, Artificial Sequence
  chemically synthesized
gagattcctttttttcatct

SEQ ID NO: 112303 - DNA, 20 bp, Artificial Sequence
  chemically synthesized
gggtaagcttagatgaaaaa

SEQ ID NO: 112304 - DNA, 20 bp, Artificial Sequence
  chemically synthesized
ggtaagcttagatgaaaaaa

SEQ ID NO: 112305 - DNA, 20 bp, Artificial Sequence
  chemically synthesized
agatgaaaaaaaggaatctc

SEQ ID NO: 112306 - DNA, 20 bp, Artificial Sequence
  chemically synthesized
atgatcttgttttttgtctt

SEQ ID NO: 112307 - DNA, 20 bp, Artificial Sequence
  chemically synthesized
ggaatctcaagacaaaaaac

SEQ ID NO: 112308 - DNA, 20 bp, Artificial Sequence
  chemically synthesized
acaaaaaacaagatcatcga

SEQ ID NO: 112309 - DNA, 20 bp, Artificial Sequence
  chemically synthesized
aacaagatcatcgaaagaca

SEQ ID NO: 112310 - DNA, 20 bp, Artificial Sequence
  chemically synthesized
aagatcatcgaaagacacag

SEQ ID NO: 112311 - DNA, 20 bp, Artificial Sequence
  chemically synthesized
tcatcgaaagacacagaagt

SEQ ID NO: 112312 - DNA, 20 bp, Artificial Sequence
  chemically synthesized
cgaaagacacagaagtaagc

SEQ ID NO: 112313 - DNA, 20 bp, Artificial Sequence
  chemically synthesized
agacacagaagtaagctggc

SEQ ID NO: 112314 - DNA, 20 bp, Artificial Sequence
  chemically synthesized
tactaaaatgaacagctagc

SEQ ID NO: 112315 - DNA, 20 bp, Artificial Sequence
  chemically synthesized
ctcctactaaaatgaacagc

SEQ ID NO: 112316 - DNA, 20 bp, Artificial Sequence
  chemically synthesized
agctggctagctgttcattt

SEQ ID NO: 112317 - DNA, 20 bp, Artificial Sequence
  chemically synthesized
tcaactcctactaaaatgaa

SEQ ID NO: 112318 - DNA, 20 bp, Artificial Sequence
  chemically synthesized
tggctagctgttcattttag

SEQ ID NO: 112319 - DNA, 20 bp, Artificial Sequence
  chemically synthesized
ggctagctgttcattttagt

SEQ ID NO: 112320 - DNA, 20 bp, Artificial Sequence
  chemically synthesized
ctagctgttcattttagtag

SEQ ID NO: 112321 - DNA, 20 bp, Artificial Sequence
  chemically synthesized
gttcattttagtaggagttg

SEQ ID NO: 112322 - DNA, 20 bp, Artificial Sequence
  chemically synthesized
ttcattttagtaggagttga

SEQ ID NO: 112323 - DNA, 20 bp, Artificial Sequence
  chemically synthesized
gtaggagttgaaggtgcatt

SEQ ID NO: 112324 - DNA, 20 bp, Artificial Sequence
  chemically synthesized
aggagttgaaggtgcattga

SEQ ID NO: 112325 - DNA, 20 bp, Artificial Sequence
  chemically synthesized
ggagttgaaggtgcattgag

SEQ ID NO: 112326 - DNA, 20 bp, Artificial Sequence
  chemically synthesized
ggtgcattgagaggtaaaat

SEQ ID NO: 112327 - DNA, 20 bp, Artificial Sequence
  chemically synthesized
tgagaggtaaaataagaaat

SEQ ID NO: 112328 - DNA, 20 bp, Artificial Sequence
  chemically synthesized
ggtaaaataagaaataagat

SEQ ID NO: 112329 - DNA, 20 bp, Artificial Sequence
  chemically synthesized
taagaaataagattggaaac

SEQ ID NO: 112330 - DNA, 20 bp, Artificial Sequence
  chemically synthesized
ataagattggaaacgagact

SEQ ID NO: 112331 - DNA, 20 bp, Artificial Sequence
  chemically synthesized
taagattggaaacgagactc

SEQ ID NO: 112332 - DNA, 20 bp, Artificial Sequence
  chemically synthesized
aagattggaaacgagactca

SEQ ID NO: 112333 - DNA, 20 bp, Artificial Sequence
  chemically synthesized
agattggaaacgagactcag

SEQ ID NO: 112334 - DNA, 20 bp, Artificial Sequence
  chemically synthesized
ggctctccacaattgcccct

SEQ ID NO: 112335 - DNA, 20 bp, Artificial Sequence
  chemically synthesized
acgagactcaggggcaattg

SEQ ID NO: 112336 - DNA, 20 bp, Artificial Sequence
  chemically synthesized
gagactcaggggcaattgtg

SEQ ID NO: 112337 - DNA, 20 bp, Artificial Sequence
  chemically synthesized
gactcaggggcaattgtgga

SEQ ID NO: 112338 - DNA, 20 bp, Artificial Sequence
  chemically synthesized
caggggcaattgtggagagc

SEQ ID NO: 112339 - DNA, 20 bp, Artificial Sequence
  chemically synthesized
aggggcaattgtggagagcc

SEQ ID NO: 112340 - DNA, 20 bp, Artificial Sequence
  chemically synthesized
caattgtggagagccaggtg

SEQ ID NO: 112341 - DNA, 20 bp, Artificial Sequence
  chemically synthesized
aattgtggagagccaggtga

SEQ ID NO: 112342 - DNA, 20 bp, Artificial Sequence
  chemically synthesized
ttgtggagagccaggtgaag

SEQ ID NO: 112343 - DNA, 20 bp, Artificial Sequence
  chemically synthesized
attctacagactccttcacc

SEQ ID NO: 112344 - DNA, 20 bp, Artificial Sequence
  chemically synthesized
gagccaggtgaaggagtctg

SEQ ID NO: 112345 - DNA, 20 bp, Artificial Sequence
  chemically synthesized
aagcccttcagaatattcta

SEQ ID NO: 112346 - DNA, 20 bp, Artificial Sequence
  chemically synthesized
ggagtctgtagaatattctg

SEQ ID NO: 112347 - DNA, 20 bp, Artificial Sequence
  chemically synthesized
gagtctgtagaatattctga

SEQ ID NO: 112348 - DNA, 20 bp, Artificial Sequence
  chemically synthesized
agtctgtagaatattctgaa

SEQ ID NO: 112349 - DNA, 20 bp, Artificial Sequence
  chemically synthesized
tttttgacttcaaagccctt

SEQ ID NO: 112350 - DNA, 20 bp, Artificial Sequence
  chemically synthesized
gaatattctgaagggctttg

SEQ ID NO: 112351 - DNA, 20 bp, Artificial Sequence
  chemically synthesized
aaacaccttttttgacttca

SEQ ID NO: 112352 - DNA, 20 bp, Artificial Sequence
  chemically synthesized
gaagggctttgaagtcaaaa

SEQ ID NO: 112353 - DNA, 20 bp, Artificial Sequence
  chemically synthesized
aagggctttgaagtcaaaaa

SEQ ID NO: 112354 - DNA, 20 bp, Artificial Sequence
  chemically synthesized
gaagtcaaaaaaggtgtttg

SEQ ID NO: 112355 - DNA, 20 bp, Artificial Sequence
  chemically synthesized
agtcaaaaaaggtgtttgaa

SEQ ID NO: 112356 - DNA, 20 bp, Artificial Sequence
  chemically synthesized
gtcaaaaaaggtgtttgaag

SEQ ID NO: 112357 - DNA, 20 bp, Artificial Sequence
  chemically synthesized
tcaaaaaaggtgtttgaaga

SEQ ID NO: 112358 - DNA, 20 bp, Artificial Sequence
  chemically synthesized
caaaaaaggtgtttgaagag

SEQ ID NO: 112359 - DNA, 20 bp, Artificial Sequence
  chemically synthesized
aaaaaggtgtttgaagaggg

SEQ ID NO: 112360 - DNA, 20 bp, Artificial Sequence
  chemically synthesized
agtgttcaataagtatttgt

SEQ ID NO: 112361 - DNA, 20 bp, Artificial Sequence
  chemically synthesized
tcacatgaaaagtgttcaat

SEQ ID NO: 112362 - DNA, 20 bp, Artificial Sequence
  chemically synthesized
gactgtgtgtgtcacatgaa

SEQ ID NO: 112363 - DNA, 20 bp, Artificial Sequence
  chemically synthesized
cacttttcatgtgacacaca

SEQ ID NO: 112364 - DNA, 20 bp, Artificial Sequence
  chemically synthesized
tcatgtgacacacacagtct

SEQ ID NO: 112365 - DNA, 20 bp, Artificial Sequence
  chemically synthesized
acacacacagtcttggacaa

SEQ ID NO: 112366 - DNA, 20 bp, Artificial Sequence
  chemically synthesized
cttgtatatatccattgtcc

SEQ ID NO: 112367 - DNA, 20 bp, Artificial Sequence
  chemically synthesized
cttggacaatggatatatac

SEQ ID NO: 112368 - DNA, 20 bp, Artificial Sequence
  chemically synthesized
tggatatatacaagtgaata

SEQ ID NO: 112369 - DNA, 20 bp, Artificial Sequence
  chemically synthesized
atatatacaagtgaataaag

SEQ ID NO: 112370 - DNA, 20 bp, Artificial Sequence
  chemically synthesized
atgcaaattccatgagagca

SEQ ID NO: 112371 - DNA, 20 bp, Artificial Sequence
  chemically synthesized
agatgaaatctttgctctca

SEQ ID NO: 112372 - DNA, 20 bp, Artificial Sequence
  chemically synthesized
ctacaatgcaaattccatga

SEQ ID NO: 112373 - DNA, 20 bp, Artificial Sequence
  chemically synthesized
aactacaatgcaaattccat

SEQ ID NO: 112374 - DNA, 20 bp, Artificial Sequence
  chemically synthesized
ctctcatggaatttgcattg

SEQ ID NO: 112375 - DNA, 20 bp, Artificial Sequence
  chemically synthesized
ttgcattgtagttacaacct

SEQ ID NO: 112376 - DNA, 20 bp, Artificial Sequence
  chemically synthesized
agcttcctaaaacatagctt

SEQ ID NO: 112377 - DNA, 20 bp, Artificial Sequence
  chemically synthesized
aagcttcctaaaacatagct

SEQ ID NO: 112378 - DNA, 20 bp, Artificial Sequence
  chemically synthesized
ttacaacctaagctatgttt

SEQ ID NO: 112379 - DNA, 20 bp, Artificial Sequence
  chemically synthesized
tacaacctaagctatgtttt

SEQ ID NO: 112380 - DNA, 20 bp, Artificial Sequence
  chemically synthesized
aaattaagcttcctaaaaca

SEQ ID NO: 112381 - DNA, 20 bp, Artificial Sequence
  chemically synthesized
aacctaagctatgttttagg

SEQ ID NO: 112382 - DNA, 20 bp, Artificial Sequence
  chemically synthesized
tgcagatttccatttaaatt

SEQ ID NO: 112383 - DNA, 20 bp, Artificial Sequence
  chemically synthesized
tttaggaagcttaatttaaa

SEQ ID NO: 112384 - DNA, 20 bp, Artificial Sequence
  chemically synthesized
taatttaaatggaaatctgc

SEQ ID NO: 112385 - DNA, 20 bp, Artificial Sequence
  chemically synthesized
ttaaatggaaatctgcaagt

SEQ ID NO: 112386 - DNA, 20 bp, Artificial Sequence
  chemically synthesized
agtggctccaatccaacttg

SEQ ID NO: 112387 - DNA, 20 bp, Artificial Sequence
  chemically synthesized
tggaaatctgcaagttggat

SEQ ID NO: 112388 - DNA, 20 bp, Artificial Sequence
  chemically synthesized
gaaatctgcaagttggattg

SEQ ID NO: 112389 - DNA, 20 bp, Artificial Sequence
  chemically synthesized
gcaagttggattggagccac

SEQ ID NO: 112390 - DNA, 20 bp, Artificial Sequence
  chemically synthesized
agttggattggagccactgg

SEQ ID NO: 112391 - DNA, 20 bp, Artificial Sequence
  chemically synthesized
gttggattggagccactggt

SEQ ID NO: 112392 - DNA, 20 bp, Artificial Sequence
  chemically synthesized
cactcattcctgcccaccag

SEQ ID NO: 112393 - DNA, 20 bp, Artificial Sequence
  chemically synthesized
ggattggagccactggtggg

SEQ ID NO: 112394 - DNA, 20 bp, Artificial Sequence
  chemically synthesized
gattggagccactggtgggc

SEQ ID NO: 112395 - DNA, 20 bp, Artificial Sequence
  chemically synthesized
ctccactcattcctgcccac

SEQ ID NO: 112396 - DNA, 20 bp, Artificial Sequence
  chemically synthesized
agccactggtgggcaggaat

SEQ ID NO: 112397 - DNA, 20 bp, Artificial Sequence
  chemically synthesized
cactggtgggcaggaatgag

SEQ ID NO: 112398 - DNA, 20 bp, Artificial Sequence
  chemically synthesized
ctggtgggcaggaatgagtg

SEQ ID NO: 112399 - DNA, 20 bp, Artificial Sequence
  chemically synthesized
tggtgggcaggaatgagtgg

SEQ ID NO: 112400 - DNA, 20 bp, Artificial Sequence
  chemically synthesized
gtgggcaggaatgagtggag

SEQ ID NO: 112401 - DNA, 20 bp, Artificial Sequence
  chemically synthesized
tgggcaggaatgagtggagg

SEQ ID NO: 112402 - DNA, 20 bp, Artificial Sequence
  chemically synthesized
gggcaggaatgagtggagga

SEQ ID NO: 112403 - DNA, 20 bp, Artificial Sequence
  chemically synthesized
gagtggaggagggtaaaaaa

SEQ ID NO: 112404 - DNA, 20 bp, Artificial Sequence
  chemically synthesized
ggaggagggtaaaaaatagt

SEQ ID NO: 112405 - DNA, 20 bp, Artificial Sequence
  chemically synthesized
aggagggtaaaaaatagtaa

SEQ ID NO: 112406 - DNA, 20 bp, Artificial Sequence
  chemically synthesized
aaaatagtaagagtgtgaat

SEQ ID NO: 112407 - DNA, 20 bp, Artificial Sequence
  chemically synthesized
aatagtaagagtgtgaatga

SEQ ID NO: 112408 - DNA, 20 bp, Artificial Sequence
  chemically synthesized
agtaagagtgtgaatgagag

SEQ ID NO: 112409 - DNA, 20 bp, Artificial Sequence
  chemically synthesized
taagagtgtgaatgagagtg

SEQ ID NO: 112410 - DNA, 20 bp, Artificial Sequence
  chemically synthesized
aagagtgtgaatgagagtgg

SEQ ID NO: 112411 - DNA, 20 bp, Artificial Sequence
  chemically synthesized
gtgtgaatgagagtggaggt

SEQ ID NO: 112412 - DNA, 20 bp, Artificial Sequence
  chemically synthesized
tgtgaatgagagtggaggta

SEQ ID NO: 112413 - DNA, 20 bp, Artificial Sequence
  chemically synthesized
gtgaatgagagtggaggtaa

SEQ ID NO: 112414 - DNA, 20 bp, Artificial Sequence
  chemically synthesized
tgaatgagagtggaggtaag

SEQ ID NO: 112415 - DNA, 20 bp, Artificial Sequence
  chemically synthesized
tgagagtggaggtaaggggc

SEQ ID NO: 112416 - DNA, 20 bp, Artificial Sequence
  chemically synthesized
agtggaggtaaggggctagt

SEQ ID NO: 112417 - DNA, 20 bp, Artificial Sequence
  chemically synthesized
gaggtaaggggctagtgaga

SEQ ID NO: 112418 - DNA, 20 bp, Artificial Sequence
  chemically synthesized
aggtaaggggctagtgagaa

SEQ ID NO: 112419 - DNA, 20 bp, Artificial Sequence
  chemically synthesized
tatgaccattcctttctcac

SEQ ID NO: 112420 - DNA, 20 bp, Artificial Sequence
  chemically synthesized
aggggctagtgagaaaggaa

SEQ ID NO: 112421 - DNA, 20 bp, Artificial Sequence
  chemically synthesized
gtgagaaaggaatggtcata

SEQ ID NO: 112422 - DNA, 20 bp, Artificial Sequence
  chemically synthesized
aaggaatggtcataaagaat

SEQ ID NO: 112423 - DNA, 20 bp, Artificial Sequence
  chemically synthesized
aggaatggtcataaagaatt

SEQ ID NO: 112424 - DNA, 20 bp, Artificial Sequence
  chemically synthesized
ggaatggtcataaagaatta

SEQ ID NO: 112425 - DNA, 20 bp, Artificial Sequence
  chemically synthesized
aatggtcataaagaattagg

SEQ ID NO: 112426 - DNA, 20 bp, Artificial Sequence
  chemically synthesized
atggtcataaagaattaggg

SEQ ID NO: 112427 - DNA, 20 bp, Artificial Sequence
  chemically synthesized
gtcataaagaattagggagg

SEQ ID NO: 112428 - DNA, 20 bp, Artificial Sequence
  chemically synthesized
aattagggaggcagaatcta

SEQ ID NO: 112429 - DNA, 20 bp, Artificial Sequence
  chemically synthesized
aagttcatttttaaggtctg

SEQ ID NO: 112430 - DNA, 20 bp, Artificial Sequence
  chemically synthesized
cactttcaagttcattttta

SEQ ID NO: 112431 - DNA, 20 bp, Artificial Sequence
  chemically synthesized
tcactttcaagttcattttt

SEQ ID NO: 112432 - DNA, 20 bp, Artificial Sequence
  chemically synthesized
gaccttaaaaatgaacttga

SEQ ID NO: 112433 - DNA, 20 bp, Artificial Sequence
  chemically synthesized
ttaaaaatgaacttgaaagt

SEQ ID NO: 112434 - DNA, 20 bp, Artificial Sequence
  chemically synthesized
taaaaatgaacttgaaagtg

SEQ ID NO: 112435 - DNA, 20 bp, Artificial Sequence
  chemically synthesized
cacttacttgcctcactttc

SEQ ID NO: 112436 - DNA, 20 bp, Artificial Sequence
  chemically synthesized
aatgaacttgaaagtgaggc

SEQ ID NO: 112437 - DNA, 20 bp, Artificial Sequence
  chemically synthesized
aacttgaaagtgaggcaagt

SEQ ID NO: 112438 - DNA, 20 bp, Artificial Sequence
  chemically synthesized
ttgaaagtgaggcaagtaag

SEQ ID NO: 112439 - DNA, 20 bp, Artificial Sequence
  chemically synthesized
tgaaagtgaggcaagtaagt

SEQ ID NO: 112440 - DNA, 20 bp, Artificial Sequence
  chemically synthesized
aaagtgaggcaagtaagtgg

SEQ ID NO: 112441 - DNA, 20 bp, Artificial Sequence
  chemically synthesized
aggcaagtaagtgggagatt

SEQ ID NO: 112442 - DNA, 20 bp, Artificial Sequence
  chemically synthesized
gtcagagagttcagatcata

SEQ ID NO: 112443 - DNA, 20 bp, Artificial Sequence
  chemically synthesized
atcttttcagtcagagagtt

SEQ ID NO: 112444 - DNA, 20 bp, Artificial Sequence
  chemically synthesized
gtaccatcttttcagtcaga

SEQ ID NO: 112445 - DNA, 20 bp, Artificial Sequence
  chemically synthesized
cggtaccatcttttcagtca

SEQ ID NO: 112446 - DNA, 20 bp, Artificial Sequence
  chemically synthesized
atctgaactctctgactgaa

SEQ ID NO: 112447 - DNA, 20 bp, Artificial Sequence
  chemically synthesized
cccggtaccatcttttcagt

SEQ ID NO: 112448 - DNA, 20 bp, Artificial Sequence
  chemically synthesized
gaactctctgactgaaaaga

SEQ ID NO: 112449 - DNA, 20 bp, Artificial Sequence
  chemically synthesized
tcatcccggtaccatctttt

SEQ ID NO: 112450 - DNA, 20 bp, Artificial Sequence
  chemically synthesized
tctgactgaaaagatggtac

SEQ ID NO: 112451 - DNA, 20 bp, Artificial Sequence
  chemically synthesized
ctgactgaaaagatggtacc

SEQ ID NO: 112452 - DNA, 20 bp, Artificial Sequence
  chemically synthesized
aaagatggtaccgggatgaa

SEQ ID NO: 112453 - DNA, 20 bp, Artificial Sequence
  chemically synthesized
tcctatcctgctgttcatcc

SEQ ID NO: 112454 - DNA, 20 bp, Artificial Sequence
  chemically synthesized
gatggtaccgggatgaacag

SEQ ID NO: 112455 - DNA, 20 bp, Artificial Sequence
  chemically synthesized
atggtaccgggatgaacagc

SEQ ID NO: 112456 - DNA, 20 bp, Artificial Sequence
  chemically synthesized
taccgggatgaacagcagga

SEQ ID NO: 112457 - DNA, 20 bp, Artificial Sequence
  chemically synthesized
accgggatgaacagcaggat

SEQ ID NO: 112458 - DNA, 20 bp, Artificial Sequence
  chemically synthesized
tgaacagcaggataggaaat

SEQ ID NO: 112459 - DNA, 20 bp, Artificial Sequence
  chemically synthesized
gcaggataggaaataagact

SEQ ID NO: 112460 - DNA, 20 bp, Artificial Sequence
  chemically synthesized
aataggccattttttatacc

SEQ ID NO: 112461 - DNA, 20 bp, Artificial Sequence
  chemically synthesized
ataagacttggtataaaaaa

SEQ ID NO: 112462 - DNA, 20 bp, Artificial Sequence
  chemically synthesized
ggtataaaaaatggcctatt

SEQ ID NO: 112463 - DNA, 20 bp, Artificial Sequence
  chemically synthesized
gtataaaaaatggcctattt

SEQ ID NO: 112464 - DNA, 20 bp, Artificial Sequence
  chemically synthesized
aaattcagtatgacccaaat

SEQ ID NO: 112465 - DNA, 20 bp, Artificial Sequence
  chemically synthesized
taaattcagtatgacccaaa

SEQ ID NO: 112466 - DNA, 20 bp, Artificial Sequence
  chemically synthesized
tctcacaaatgacataaatt

SEQ ID NO: 112467 - DNA, 20 bp, Artificial Sequence
  chemically synthesized
actgaatttatgtcatttgt

SEQ ID NO: 112468 - DNA, 20 bp, Artificial Sequence
  chemically synthesized
atgtcatttgtgagacattt

SEQ ID NO: 112469 - DNA, 20 bp, Artificial Sequence
  chemically synthesized
catttgtgagacatttgagt

SEQ ID NO: 112470 - DNA, 20 bp, Artificial Sequence
  chemically synthesized
agtaagaaatgtcctacata

SEQ ID NO: 112471 - DNA, 20 bp, Artificial Sequence
  chemically synthesized
ccacatttcttactgtatgt

SEQ ID NO: 112472 - DNA, 20 bp, Artificial Sequence
  chemically synthesized
cccacatttcttactgtatg

SEQ ID NO: 112473 - DNA, 20 bp, Artificial Sequence
  chemically synthesized
agaaatgtcctacatacagt

SEQ ID NO: 112474 - DNA, 20 bp, Artificial Sequence
  chemically synthesized
cctacatacagtaagaaatg

SEQ ID NO: 112475 - DNA, 20 bp, Artificial Sequence
  chemically synthesized
ctacatacagtaagaaatgt

SEQ ID NO: 112476 - DNA, 20 bp, Artificial Sequence
  chemically synthesized
atacagtaagaaatgtggga

SEQ ID NO: 112477 - DNA, 20 bp, Artificial Sequence
  chemically synthesized
aagaaatgtgggacagacat

SEQ ID NO: 112478 - DNA, 20 bp, Artificial Sequence
  chemically synthesized
aatgtgggacagacattgga

SEQ ID NO: 112479 - DNA, 20 bp, Artificial Sequence
  chemically synthesized
atgtgggacagacattggaa

SEQ ID NO: 112480 - DNA, 20 bp, Artificial Sequence
  chemically synthesized
aataaaaatgttcaaatcat

SEQ ID NO: 112481 - DNA, 20 bp, Artificial Sequence
  chemically synthesized
atgttcaaatcattggatta

SEQ ID NO: 112482 - DNA, 20 bp, Artificial Sequence
  chemically synthesized
tgttcaaatcattggattaa

SEQ ID NO: 112483 - DNA, 20 bp, Artificial Sequence
  chemically synthesized
ttcaaatcattggattaaag

SEQ ID NO: 112484 - DNA, 20 bp, Artificial Sequence
  chemically synthesized
aatcattggattaaaggaga

SEQ ID NO: 112485 - DNA, 20 bp, Artificial Sequence
  chemically synthesized
tcattggattaaaggagatg

SEQ ID NO: 112486 - DNA, 20 bp, Artificial Sequence
  chemically synthesized
ggattaaaggagatggagaa

SEQ ID NO: 112487 - DNA, 20 bp, Artificial Sequence
  chemically synthesized
gatggagaaaagactgtttc

SEQ ID NO: 112488 - DNA, 20 bp, Artificial Sequence
  chemically synthesized
gttagttattatactagaaa

SEQ ID NO: 112489 - DNA, 20 bp, Artificial Sequence
  chemically synthesized
ttatgtgttagttattatac

SEQ ID NO: 112490 - DNA, 20 bp, Artificial Sequence
  chemically synthesized
agttactgtcagttatgtgt

SEQ ID NO: 112491 - DNA, 20 bp, Artificial Sequence
  chemically synthesized
aataactaacacataactga

SEQ ID NO: 112492 - DNA, 20 bp, Artificial Sequence
  chemically synthesized
atttagtcaatagttactgt

SEQ ID NO: 112493 - DNA, 20 bp, Artificial Sequence
  chemically synthesized
ttcatttgatatttagtcaa

SEQ ID NO: 112494 - DNA, 20 bp, Artificial Sequence
  chemically synthesized
cattatcttcatttgatatt

SEQ ID NO: 112495 - DNA, 20 bp, Artificial Sequence
  chemically synthesized
tattgactaaatatcaaatg

SEQ ID NO: 112496 - DNA, 20 bp, Artificial Sequence
  chemically synthesized
aaatatcaaatgaagataat

SEQ ID NO: 112497 - DNA, 20 bp, Artificial Sequence
  chemically synthesized
gataatgagattaatgaaat

SEQ ID NO: 112498 - DNA, 20 bp, Artificial Sequence
  chemically synthesized
tgagattaatgaaatcagaa

SEQ ID NO: 112499 - DNA, 20 bp, Artificial Sequence
  chemically synthesized
tgaaatcagaaaagaatgca

SEQ ID NO: 112500 - DNA, 20 bp, Artificial Sequence
  chemically synthesized
aatgcatagaattgatactg

SEQ ID NO: 112501 - DNA, 20 bp, Artificial Sequence
  chemically synthesized
atgcatagaattgatactgt

SEQ ID NO: 112502 - DNA, 20 bp, Artificial Sequence
  chemically synthesized
tagaattgatactgtgggct

SEQ ID NO: 112503 - DNA, 20 bp, Artificial Sequence
  chemically synthesized
gagccaccacaccaagccca

SEQ ID NO: 112504 - DNA, 20 bp, Artificial Sequence
  chemically synthesized
ttgatactgtgggcttggtg

SEQ ID NO: 112505 - DNA, 20 bp, Artificial Sequence
  chemically synthesized
atactgtgggcttggtgtgg

SEQ ID NO: 112506 - DNA, 20 bp, Artificial Sequence
  chemically synthesized
caggtgtgagccaccacacc

SEQ ID NO: 112507 - DNA, 20 bp, Artificial Sequence
  chemically synthesized
aacgctgagattacaggtgt

SEQ ID NO: 112508 - DNA, 20 bp, Artificial Sequence
  chemically synthesized
gtggctcacacctgtaatct

SEQ ID NO: 112509 - DNA, 20 bp, Artificial Sequence
  chemically synthesized
tcccaaaacgctgagattac

SEQ ID NO: 112510 - DNA, 20 bp, Artificial Sequence
  chemically synthesized
ctcccaaaacgctgagatta

SEQ ID NO: 112511 - DNA, 20 bp, Artificial Sequence
  chemically synthesized
cacctgtaatctcagcgttt

SEQ ID NO: 112512 - DNA, 20 bp, Artificial Sequence
  chemically synthesized
ccccggcctcccaaaacgct

SEQ ID NO: 112513 - DNA, 20 bp, Artificial Sequence
  chemically synthesized
acctgtaatctcagcgtttt

SEQ ID NO: 112514 - DNA, 20 bp, Artificial Sequence
  chemically synthesized
ctgtaatctcagcgttttgg

SEQ ID NO: 112515 - DNA, 20 bp, Artificial Sequence
  chemically synthesized
tgtaatctcagcgttttggg

SEQ ID NO: 112516 - DNA, 20 bp, Artificial Sequence
  chemically synthesized
atctcagcgttttgggaggc

SEQ ID NO: 112517 - DNA, 20 bp, Artificial Sequence
  chemically synthesized
tctcagcgttttgggaggcc

SEQ ID NO: 112518 - DNA, 20 bp, Artificial Sequence
  chemically synthesized
ctcagcgttttgggaggccg

SEQ ID NO: 112519 - DNA, 20 bp, Artificial Sequence
  chemically synthesized
agcgttttgggaggccgggg

SEQ ID NO: 112520 - DNA, 20 bp, Artificial Sequence
  chemically synthesized
gcgttttgggaggccggggc

SEQ ID NO: 112521 - DNA, 20 bp, Artificial Sequence
  chemically synthesized
ctcaggtgatgcgcccgccc

SEQ ID NO: 112522 - DNA, 20 bp, Artificial Sequence
  chemically synthesized
ccggggcgggcgcatcacct

SEQ ID NO: 112523 - DNA, 20 bp, Artificial Sequence
  chemically synthesized
cggggcgggcgcatcacctg

SEQ ID NO: 112524 - DNA, 20 bp, Artificial Sequence
  chemically synthesized
gcgggcgcatcacctgaggt

SEQ ID NO: 112525 - DNA, 20 bp, Artificial Sequence
  chemically synthesized
cgggcgcatcacctgaggtc

SEQ ID NO: 112526 - DNA, 20 bp, Artificial Sequence
  chemically synthesized
ggtcgcaaactcctgacctc

SEQ ID NO: 112527 - DNA, 20 bp, Artificial Sequence
  chemically synthesized
ggcgcatcacctgaggtcag

SEQ ID NO: 112528 - DNA, 20 bp, Artificial Sequence
  chemically synthesized
tggtcgcaaactcctgacct

SEQ ID NO: 112529 - DNA, 20 bp, Artificial Sequence
  chemically synthesized
tgaggtcaggagtttgcgac

SEQ ID NO: 112530 - DNA, 20 bp, Artificial Sequence
  chemically synthesized
tcaggagtttgcgaccagcc

SEQ ID NO: 112531 - DNA, 20 bp, Artificial Sequence
  chemically synthesized
tttcaccaggttggccaggc

SEQ ID NO: 112532 - DNA, 20 bp, Artificial Sequence
  chemically synthesized
agggtttcaccaggttggcc

SEQ ID NO: 112533 - DNA, 20 bp, Artificial Sequence
  chemically synthesized
tgcgaccagcctggccaacc

SEQ ID NO: 112534 - DNA, 20 bp, Artificial Sequence
  chemically synthesized
cagggtttcaccaggttggc

SEQ ID NO: 112535 - DNA, 20 bp, Artificial Sequence
  chemically synthesized
cagacagggtttcaccaggt

SEQ ID NO: 112536 - DNA, 20 bp, Artificial Sequence
  chemically synthesized
agtacagacagggtttcacc

SEQ ID NO: 112537 - DNA, 20 bp, Artificial Sequence
  chemically synthesized
tagtacagacagggtttcac

SEQ ID NO: 112538 - DNA, 20 bp, Artificial Sequence
  chemically synthesized
ttttatttttagtacagaca

SEQ ID NO: 112539 - DNA, 20 bp, Artificial Sequence
  chemically synthesized
tttttatttttagtacagac

SEQ ID NO: 112540 - DNA, 20 bp, Artificial Sequence
  chemically synthesized
ttttttatttttagtacaga

SEQ ID NO: 112541 - DNA, 20 bp, Artificial Sequence
  chemically synthesized
ctaattttttatttttagta

SEQ ID NO: 112542 - DNA, 20 bp, Artificial Sequence
  chemically synthesized
cctggctaattttttatttt

SEQ ID NO: 112543 - DNA, 20 bp, Artificial Sequence
  chemically synthesized
ctgtactaaaaataaaaaat

SEQ ID NO: 112544 - DNA, 20 bp, Artificial Sequence
  chemically synthesized
actaaaaataaaaaattagc

SEQ ID NO: 112545 - DNA, 20 bp, Artificial Sequence
  chemically synthesized
ctaaaaataaaaaattagcc

SEQ ID NO: 112546 - DNA, 20 bp, Artificial Sequence
  chemically synthesized
aataaaaaattagccaggca

SEQ ID NO: 112547 - DNA, 20 bp, Artificial Sequence
  chemically synthesized
aaaaaattagccaggcatgg

SEQ ID NO: 112548 - DNA, 20 bp, Artificial Sequence
  chemically synthesized
gaggcgccttccaccatgcc

SEQ ID NO: 112549 - DNA, 20 bp, Artificial Sequence
  chemically synthesized
aaattagccaggcatggtgg

SEQ ID NO: 112550 - DNA, 20 bp, Artificial Sequence
  chemically synthesized
aattagccaggcatggtgga

SEQ ID NO: 112551 - DNA, 20 bp, Artificial Sequence
  chemically synthesized
gtggaaggcgcctctaatcc

SEQ ID NO: 112552 - DNA, 20 bp, Artificial Sequence
  chemically synthesized
tcccaagtagctgggattag

SEQ ID NO: 112553 - DNA, 20 bp, Artificial Sequence
  chemically synthesized
ctcccaagtagctgggatta

SEQ ID NO: 112554 - DNA, 20 bp, Artificial Sequence
  chemically synthesized
gcctcccaagtagctgggat

SEQ ID NO: 112555 - DNA, 20 bp, Artificial Sequence
  chemically synthesized
cgcctctaatcccagctact

SEQ ID NO: 112556 - DNA, 20 bp, Artificial Sequence
  chemically synthesized
cctcagcctcccaagtagct

SEQ ID NO: 112557 - DNA, 20 bp, Artificial Sequence
  chemically synthesized
gcctctaatcccagctactt

SEQ ID NO: 112558 - DNA, 20 bp, Artificial Sequence
  chemically synthesized
gcctcagcctcccaagtagc

SEQ ID NO: 112559 - DNA, 20 bp, Artificial Sequence
  chemically synthesized
ctctaatcccagctacttgg

SEQ ID NO: 112560 - DNA, 20 bp, Artificial Sequence
  chemically synthesized
tctaatcccagctacttggg

SEQ ID NO: 112561 - DNA, 20 bp, Artificial Sequence
  chemically synthesized
tcctgcctcagcctcccaag

SEQ ID NO: 112562 - DNA, 20 bp, Artificial Sequence
  chemically synthesized
ttctcctgcctcagcctccc

SEQ ID NO: 112563 - DNA, 20 bp, Artificial Sequence
  chemically synthesized
tcccagctacttgggaggct

SEQ ID NO: 112564 - DNA, 20 bp, Artificial Sequence
  chemically synthesized
cccagctacttgggaggctg

SEQ ID NO: 112565 - DNA, 20 bp, Artificial Sequence
  chemically synthesized
agctacttgggaggctgagg

SEQ ID NO: 112566 - DNA, 20 bp, Artificial Sequence
  chemically synthesized
gctacttgggaggctgaggc

SEQ ID NO: 112567 - DNA, 20 bp, Artificial Sequence
  chemically synthesized
tacttgggaggctgaggcag

SEQ ID NO: 112568 - DNA, 20 bp, Artificial Sequence
  chemically synthesized
ttcaagtgattctcctgcct

SEQ ID NO: 112569 - DNA, 20 bp, Artificial Sequence
  chemically synthesized
gcaggagaatcacttgaacc

SEQ ID NO: 112570 - DNA, 20 bp, Artificial Sequence
  chemically synthesized
caggagaatcacttgaaccc

SEQ ID NO: 112571 - DNA, 20 bp, Artificial Sequence
  chemically synthesized
aacctccacctcccgggttc

SEQ ID NO: 112572 - DNA, 20 bp, Artificial Sequence
  chemically synthesized
ggagaatcacttgaacccgg

SEQ ID NO: 112573 - DNA, 20 bp, Artificial Sequence
  chemically synthesized
gagaatcacttgaacccggg

SEQ ID NO: 112574 - DNA, 20 bp, Artificial Sequence
  chemically synthesized
aatcacttgaacccgggagg

SEQ ID NO: 112575 - DNA, 20 bp, Artificial Sequence
  chemically synthesized
cactgcaacctccacctccc

SEQ ID NO: 112576 - DNA, 20 bp, Artificial Sequence
  chemically synthesized
tcacttgaacccgggaggtg

SEQ ID NO: 112577 - DNA, 20 bp, Artificial Sequence
  chemically synthesized
tcactgcaacctccacctcc

SEQ ID NO: 112578 - DNA, 20 bp, Artificial Sequence
  chemically synthesized
cacttgaacccgggaggtgg

SEQ ID NO: 112579 - DNA, 20 bp, Artificial Sequence
  chemically synthesized
aacccgggaggtggaggttg

SEQ ID NO: 112580 - DNA, 20 bp, Artificial Sequence
  chemically synthesized
cgggaggtggaggttgcagt

SEQ ID NO: 112581 - DNA, 20 bp, Artificial Sequence
  chemically synthesized
ggtggaggttgcagtgagcc

SEQ ID NO: 112582 - DNA, 20 bp, Artificial Sequence
  chemically synthesized
ggagtgcaatggcgcaatct

SEQ ID NO: 112583 - DNA, 20 bp, Artificial Sequence
  chemically synthesized
tcccccaggctggagtgcaa

SEQ ID NO: 112584 - DNA, 20 bp, Artificial Sequence
  chemically synthesized
aagattgcgccattgcactc

SEQ ID NO: 112585 - DNA, 20 bp, Artificial Sequence
  chemically synthesized
tgcgccattgcactccagcc

SEQ ID NO: 112586 - DNA, 20 bp, Artificial Sequence
  chemically synthesized
gcgccattgcactccagcct

SEQ ID NO: 112587 - DNA, 20 bp, Artificial Sequence
  chemically synthesized
cgccattgcactccagcctg

SEQ ID NO: 112588 - DNA, 20 bp, Artificial Sequence
  chemically synthesized
cgctcttgtcccccaggctg

SEQ ID NO: 112589 - DNA, 20 bp, Artificial Sequence
  chemically synthesized
gccattgcactccagcctgg

SEQ ID NO: 112590 - DNA, 20 bp, Artificial Sequence
  chemically synthesized
ctcgctcttgtcccccaggc

SEQ ID NO: 112591 - DNA, 20 bp, Artificial Sequence
  chemically synthesized
tgcactccagcctgggggac

SEQ ID NO: 112592 - DNA, 20 bp, Artificial Sequence
  chemically synthesized
aagtctcgctcttgtccccc

SEQ ID NO: 112593 - DNA, 20 bp, Artificial Sequence
  chemically synthesized
gaagtctcgctcttgtcccc

SEQ ID NO: 112594 - DNA, 20 bp, Artificial Sequence
  chemically synthesized
cactccagcctgggggacaa

SEQ ID NO: 112595 - DNA, 20 bp, Artificial Sequence
  chemically synthesized
ccagcctgggggacaagagc

SEQ ID NO: 112596 - DNA, 20 bp, Artificial Sequence
  chemically synthesized
ttttttttttttttgagacg

SEQ ID NO: 112597 - DNA, 20 bp, Artificial Sequence
  chemically synthesized
tttttttttttttttttttt

SEQ ID NO: 112598 - DNA, 20 bp, Artificial Sequence
  chemically synthesized
aaaaaaaaaaaaaaaaaaaa

SEQ ID NO: 112599 - DNA, 20 bp, Artificial Sequence
  chemically synthesized
aaaaaaaagtcaaaaaatac

SEQ ID NO: 112600 - DNA, 20 bp, Artificial Sequence
  chemically synthesized
agtcaaaaaataccagatgc

SEQ ID NO: 112601 - DNA, 20 bp, Artificial Sequence
  chemically synthesized
ttcacaacctcaccagcatc

SEQ ID NO: 112602 - DNA, 20 bp, Artificial Sequence
  chemically synthesized
aaaaaataccagatgctggt

SEQ ID NO: 112603 - DNA, 20 bp, Artificial Sequence
  chemically synthesized
aaaaataccagatgctggtg

SEQ ID NO: 112604 - DNA, 20 bp, Artificial Sequence
  chemically synthesized
ccctttcttcacaacctcac

SEQ ID NO: 112605 - DNA, 20 bp, Artificial Sequence
  chemically synthesized
cagatgctggtgaggttgtg

SEQ ID NO: 112606 - DNA, 20 bp, Artificial Sequence
  chemically synthesized
tgctggtgaggttgtgaaga

SEQ ID NO: 112607 - DNA, 20 bp, Artificial Sequence
  chemically synthesized
gctggtgaggttgtgaagaa

SEQ ID NO: 112608 - DNA, 20 bp, Artificial Sequence
  chemically synthesized
ctggtgaggttgtgaagaaa

SEQ ID NO: 112609 - DNA, 20 bp, Artificial Sequence
  chemically synthesized
tggtgaggttgtgaagaaag

SEQ ID NO: 112610 - DNA, 20 bp, Artificial Sequence
  chemically synthesized
cattcccaccaacagggtat

SEQ ID NO: 112611 - DNA, 20 bp, Artificial Sequence
  chemically synthesized
ggggaatgcttataccctgt

SEQ ID NO: 112612 - DNA, 20 bp, Artificial Sequence
  chemically synthesized
gaatgcttataccctgttgg

SEQ ID NO: 112613 - DNA, 20 bp, Artificial Sequence
  chemically synthesized
aatgcttataccctgttggt

SEQ ID NO: 112614 - DNA, 20 bp, Artificial Sequence
  chemically synthesized
aatttacattcccaccaaca

SEQ ID NO: 112615 - DNA, 20 bp, Artificial Sequence
  chemically synthesized
taatttacattcccaccaac

SEQ ID NO: 112616 - DNA, 20 bp, Artificial Sequence
  chemically synthesized
ctaatttacattcccaccaa

SEQ ID NO: 112617 - DNA, 20 bp, Artificial Sequence
  chemically synthesized
ctgttggtgggaatgtaaat

SEQ ID NO: 112618 - DNA, 20 bp, Artificial Sequence
  chemically synthesized
ggtgggaatgtaaattagtt

SEQ ID NO: 112619 - DNA, 20 bp, Artificial Sequence
  chemically synthesized
gtaaattagttcagccactg

SEQ ID NO: 112620 - DNA, 20 bp, Artificial Sequence
  chemically synthesized
attagttcagccactgtgga

SEQ ID NO: 112621 - DNA, 20 bp, Artificial Sequence
  chemically synthesized
ttccaaactgctttccacag

SEQ ID NO: 112622 - DNA, 20 bp, Artificial Sequence
  chemically synthesized
agttcagccactgtggaaag

SEQ ID NO: 112623 - DNA, 20 bp, Artificial Sequence
  chemically synthesized
tatttccaaactgctttcca

SEQ ID NO: 112624 - DNA, 20 bp, Artificial Sequence
  chemically synthesized
agccactgtggaaagcagtt

SEQ ID NO: 112625 - DNA, 20 bp, Artificial Sequence
  chemically synthesized
agcagtttggaaatacctct

SEQ ID NO: 112626 - DNA, 20 bp, Artificial Sequence
  chemically synthesized
gttcagttttgagttcttag

SEQ ID NO: 112627 - DNA, 20 bp, Artificial Sequence
  chemically synthesized
agttcagttttgagttctta

SEQ ID NO: 112628 - DNA, 20 bp, Artificial Sequence
  chemically synthesized
gtagttcagttttgagttct

SEQ ID NO: 112629 - DNA, 20 bp, Artificial Sequence
  chemically synthesized
ttgaacggtagttcagtttt

SEQ ID NO: 112630 - DNA, 20 bp, Artificial Sequence
  chemically synthesized
tgctgggttgaacggtagtt

SEQ ID NO: 112631 - DNA, 20 bp, Artificial Sequence
  chemically synthesized
ggcattgctgggttgaacgg

SEQ ID NO: 112632 - DNA, 20 bp, Artificial Sequence
  chemically synthesized
aactgaactaccgttcaacc

SEQ ID NO: 112633 - DNA, 20 bp, Artificial Sequence
  chemically synthesized
aatggcattgctgggttgaa

SEQ ID NO: 112634 - DNA, 20 bp, Artificial Sequence
  chemically synthesized
tacccagtaatggcattgct

SEQ ID NO: 112635 - DNA, 20 bp, Artificial Sequence
  chemically synthesized
atacccagtaatggcattgc

SEQ ID NO: 112636 - DNA, 20 bp, Artificial Sequence
  chemically synthesized
caacccagcaatgccattac

SEQ ID NO: 112637 - DNA, 20 bp, Artificial Sequence
  chemically synthesized
aacccagcaatgccattact

SEQ ID NO: 112638 - DNA, 20 bp, Artificial Sequence
  chemically synthesized
tttgggtatatacccagtaa

SEQ ID NO: 112639 - DNA, 20 bp, Artificial Sequence
  chemically synthesized
tattcctttgggtatatacc

SEQ ID NO: 112640 - DNA, 20 bp, Artificial Sequence
  chemically synthesized
cattactgggtatataccca

SEQ ID NO: 112641 - DNA, 20 bp, Artificial Sequence
  chemically synthesized
attactgggtatatacccaa

SEQ ID NO: 112642 - DNA, 20 bp, Artificial Sequence
  chemically synthesized
agaatgatttatattccttt

SEQ ID NO: 112643 - DNA, 20 bp, Artificial Sequence
  chemically synthesized
tagaatgatttatattcctt

SEQ ID NO: 112644 - DNA, 20 bp, Artificial Sequence
  chemically synthesized
atataaatcattctaccata

SEQ ID NO: 112645 - DNA, 20 bp, Artificial Sequence
  chemically synthesized
agctgcatgtgtctttatgg

SEQ ID NO: 112646 - DNA, 20 bp, Artificial Sequence
  chemically synthesized
tacagctgcatgtgtcttta

SEQ ID NO: 112647 - DNA, 20 bp, Artificial Sequence
  chemically synthesized
ttctaccataaagacacatg

SEQ ID NO: 112648 - DNA, 20 bp, Artificial Sequence
  chemically synthesized
atagtgcagcaatgaacata

SEQ ID NO: 112649 - DNA, 20 bp, Artificial Sequence
  chemically synthesized
ctttggtattgggaatagtg

SEQ ID NO: 112650 - DNA, 20 bp, Artificial Sequence
  chemically synthesized
catgtctttggtattgggaa

SEQ ID NO: 112651 - DNA, 20 bp, Artificial Sequence
  chemically synthesized
ctgcactattcccaatacca

SEQ ID NO: 112652 - DNA, 20 bp, Artificial Sequence
  chemically synthesized
gattccatgtctttggtatt

SEQ ID NO: 112653 - DNA, 20 bp, Artificial Sequence
  chemically synthesized
tgattccatgtctttggtat

SEQ ID NO: 112654 - DNA, 20 bp, Artificial Sequence
  chemically synthesized
tattcccaataccaaagaca

SEQ ID NO: 112655 - DNA, 20 bp, Artificial Sequence
  chemically synthesized
ttaggttgattccatgtctt

SEQ ID NO: 112656 - DNA, 20 bp, Artificial Sequence
  chemically synthesized
tctaccattgatgggcattt

SEQ ID NO: 112657 - DNA, 20 bp, Artificial Sequence
  chemically synthesized
atctaccattgatgggcatt

SEQ ID NO: 112658 - DNA, 20 bp, Artificial Sequence
  chemically synthesized
tcaacctaaatgcccatcaa

SEQ ID NO: 112659 - DNA, 20 bp, Artificial Sequence
  chemically synthesized
atatctgatctaccattgat

SEQ ID NO: 112660 - DNA, 20 bp, Artificial Sequence
  chemically synthesized
acctaaatgcccatcaatgg

SEQ ID NO: 112661 - DNA, 20 bp, Artificial Sequence
  chemically synthesized
tatatctgatctaccattga

SEQ ID NO: 112662 - DNA, 20 bp, Artificial Sequence
  chemically synthesized
aatgcccatcaatggtagat

SEQ ID NO: 112663 - DNA, 20 bp, Artificial Sequence
  chemically synthesized
catcaatggtagatcagata

SEQ ID NO: 112664 - DNA, 20 bp, Artificial Sequence
  chemically synthesized
tagatcagatatagaaaatg

SEQ ID NO: 112665 - DNA, 20 bp, Artificial Sequence
  chemically synthesized
aaaatgtggtacatatacac

SEQ ID NO: 112666 - DNA, 20 bp, Artificial Sequence
  chemically synthesized
aaatgtggtacatatacacc

SEQ ID NO: 112667 - DNA, 20 bp, Artificial Sequence
  chemically synthesized
aatgtggtacatatacacca

SEQ ID NO: 112668 - DNA, 20 bp, Artificial Sequence
  chemically synthesized
tctggctgcacagtattccc

SEQ ID NO: 112669 - DNA, 20 bp, Artificial Sequence
  chemically synthesized
atacaccagggaatactgtg

SEQ ID NO: 112670 - DNA, 20 bp, Artificial Sequence
  chemically synthesized
accagggaatactgtgcagc

SEQ ID NO: 112671 - DNA, 20 bp, Artificial Sequence
  chemically synthesized
cattcttttttctggctgca

SEQ ID NO: 112672 - DNA, 20 bp, Artificial Sequence
  chemically synthesized
aatactgtgcagccagaaaa

SEQ ID NO: 112673 - DNA, 20 bp, Artificial Sequence
  chemically synthesized
cataatctcattcttttttc

SEQ ID NO: 112674 - DNA, 20 bp, Artificial Sequence
  chemically synthesized
gtgcagccagaaaaaagaat

SEQ ID NO: 112675 - DNA, 20 bp, Artificial Sequence
  chemically synthesized
gaatgagattatgttctttg

SEQ ID NO: 112676 - DNA, 20 bp, Artificial Sequence
  chemically synthesized
gctccatccatgttgctgca

SEQ ID NO: 112677 - DNA, 20 bp, Artificial Sequence
  chemically synthesized
ttatgttctttgcagcaaca

SEQ ID NO: 112678 - DNA, 20 bp, Artificial Sequence
  chemically synthesized
gttctttgcagcaacatgga

SEQ ID NO: 112679 - DNA, 20 bp, Artificial Sequence
  chemically synthesized
tctttgcagcaacatggatg

SEQ ID NO: 112680 - DNA, 20 bp, Artificial Sequence
  chemically synthesized
tgcagcaacatggatggagc

SEQ ID NO: 112681 - DNA, 20 bp, Artificial Sequence
  chemically synthesized
cagcaacatggatggagctg

SEQ ID NO: 112682 - DNA, 20 bp, Artificial Sequence
  chemically synthesized
agcaacatggatggagctgg

SEQ ID NO: 112683 - DNA, 20 bp, Artificial Sequence
  chemically synthesized
tcacctaggataatggcctc

SEQ ID NO: 112684 - DNA, 20 bp, Artificial Sequence
  chemically synthesized
ggagctggaggccattatcc

SEQ ID NO: 112685 - DNA, 20 bp, Artificial Sequence
  chemically synthesized
gagctggaggccattatcct

SEQ ID NO: 112686 - DNA, 20 bp, Artificial Sequence
  chemically synthesized
tgttatttcacctaggataa

SEQ ID NO: 112687 - DNA, 20 bp, Artificial Sequence
  chemically synthesized
gttcctatgttatttcacct

SEQ ID NO: 112688 - DNA, 20 bp, Artificial Sequence
  chemically synthesized
tgttcctatgttatttcacc

SEQ ID NO: 112689 - DNA, 20 bp, Artificial Sequence
  chemically synthesized
ttatcctaggtgaaataaca

SEQ ID NO: 112690 - DNA, 20 bp, Artificial Sequence
  chemically synthesized
tatcctaggtgaaataacat

SEQ ID NO: 112691 - DNA, 20 bp, Artificial Sequence
  chemically synthesized
taggtgaaataacataggaa

SEQ ID NO: 112692 - DNA, 20 bp, Artificial Sequence
  chemically synthesized
aagtgagaatatatggtatt

SEQ ID NO: 112693 - DNA, 20 bp, Artificial Sequence
  chemically synthesized
cacttataagtgagaatata

SEQ ID NO: 112694 - DNA, 20 bp, Artificial Sequence
  chemically synthesized
taccatatattctcacttat

SEQ ID NO: 112695 - DNA, 20 bp, Artificial Sequence
  chemically synthesized
gtttagctccacttataagt

SEQ ID NO: 112696 - DNA, 20 bp, Artificial Sequence
  chemically synthesized
catatattctcacttataag

SEQ ID NO: 112697 - DNA, 20 bp, Artificial Sequence
  chemically synthesized
tatattctcacttataagtg

SEQ ID NO: 112698 - DNA, 20 bp, Artificial Sequence
  chemically synthesized
cagtgtttagctccacttat

SEQ ID NO: 112699 - DNA, 20 bp, Artificial Sequence
  chemically synthesized
tataagtggagctaaacact

SEQ ID NO: 112700 - DNA, 20 bp, Artificial Sequence
  chemically synthesized
gttcatatgtactcagtgtt

SEQ ID NO: 112701 - DNA, 20 bp, Artificial Sequence
  chemically synthesized
tctttgtgttcatatgtact

SEQ ID NO: 112702 - DNA, 20 bp, Artificial Sequence
  chemically synthesized
actgagtacatatgaacaca

SEQ ID NO: 112703 - DNA, 20 bp, Artificial Sequence
  chemically synthesized
gagtacatatgaacacaaag

SEQ ID NO: 112704 - DNA, 20 bp, Artificial Sequence
  chemically synthesized
agtacatatgaacacaaaga

SEQ ID NO: 112705 - DNA, 20 bp, Artificial Sequence
  chemically synthesized
gtacatatgaacacaaagaa

SEQ ID NO: 112706 - DNA, 20 bp, Artificial Sequence
  chemically synthesized
gaacacaaagaagggaacaa

SEQ ID NO: 112707 - DNA, 20 bp, Artificial Sequence
  chemically synthesized
aagaagggaacaacagaaac

SEQ ID NO: 112708 - DNA, 20 bp, Artificial Sequence
  chemically synthesized
agaagggaacaacagaaacc

SEQ ID NO: 112709 - DNA, 20 bp, Artificial Sequence
  chemically synthesized
ctccaccctagagtagatcc

SEQ ID NO: 112710 - DNA, 20 bp, Artificial Sequence
  chemically synthesized
acagaaaccaggatctactc

SEQ ID NO: 112711 - DNA, 20 bp, Artificial Sequence
  chemically synthesized
cagaaaccaggatctactct

SEQ ID NO: 112712 - DNA, 20 bp, Artificial Sequence
  chemically synthesized
agaaaccaggatctactcta

SEQ ID NO: 112713 - DNA, 20 bp, Artificial Sequence
  chemically synthesized
tcccaccctccaccctagag

SEQ ID NO: 112714 - DNA, 20 bp, Artificial Sequence
  chemically synthesized
aaccaggatctactctaggg

SEQ ID NO: 112715 - DNA, 20 bp, Artificial Sequence
  chemically synthesized
ccaggatctactctagggtg

SEQ ID NO: 112716 - DNA, 20 bp, Artificial Sequence
  chemically synthesized
tcctcccaccctccacccta

SEQ ID NO: 112717 - DNA, 20 bp, Artificial Sequence
  chemically synthesized
caggatctactctagggtgg

SEQ ID NO: 112718 - DNA, 20 bp, Artificial Sequence
  chemically synthesized
aggatctactctagggtgga

SEQ ID NO: 112719 - DNA, 20 bp, Artificial Sequence
  chemically synthesized
catcctcccaccctccaccc

SEQ ID NO: 112720 - DNA, 20 bp, Artificial Sequence
  chemically synthesized
atctactctagggtggaggg

SEQ ID NO: 112721 - DNA, 20 bp, Artificial Sequence
  chemically synthesized
tctactctagggtggagggt

SEQ ID NO: 112722 - DNA, 20 bp, Artificial Sequence
  chemically synthesized
tactctagggtggagggtgg

SEQ ID NO: 112723 - DNA, 20 bp, Artificial Sequence
  chemically synthesized
actctagggtggagggtggg

SEQ ID NO: 112724 - DNA, 20 bp, Artificial Sequence
  chemically synthesized
tagggtggagggtgggagga

SEQ ID NO: 112725 - DNA, 20 bp, Artificial Sequence
  chemically synthesized
tggagggtgggaggatggtg

SEQ ID NO: 112726 - DNA, 20 bp, Artificial Sequence
  chemically synthesized
gtgggaggatggtgaagact

SEQ ID NO: 112727 - DNA, 20 bp, Artificial Sequence
  chemically synthesized
gtacctgataggtagtttct

SEQ ID NO: 112728 - DNA, 20 bp, Artificial Sequence
  chemically synthesized
aagactgagaaactacctat

SEQ ID NO: 112729 - DNA, 20 bp, Artificial Sequence
  chemically synthesized
agactgagaaactacctatc

SEQ ID NO: 112730 - DNA, 20 bp, Artificial Sequence
  chemically synthesized
taagcatggtacctgatagg

SEQ ID NO: 112731 - DNA, 20 bp, Artificial Sequence
  chemically synthesized
taataagcatggtacctgat

SEQ ID NO: 112732 - DNA, 20 bp, Artificial Sequence
  chemically synthesized
ataataagcatggtacctga

SEQ ID NO: 112733 - DNA, 20 bp, Artificial Sequence
  chemically synthesized
tgtcacccagataataagca

SEQ ID NO: 112734 - DNA, 20 bp, Artificial Sequence
  chemically synthesized
caggtaccatgcttattatc

SEQ ID NO: 112735 - DNA, 20 bp, Artificial Sequence
  chemically synthesized
aggtaccatgcttattatct

SEQ ID NO: 112736 - DNA, 20 bp, Artificial Sequence
  chemically synthesized
tattttgtcacccagataat

SEQ ID NO: 112737 - DNA, 20 bp, Artificial Sequence
  chemically synthesized
gaacagattattttgtcacc

SEQ ID NO: 112738 - DNA, 20 bp, Artificial Sequence
  chemically synthesized
tgtcatgggagtttggtgaa

SEQ ID NO: 112739 - DNA, 20 bp, Artificial Sequence
  chemically synthesized
aattgcatgtcatgggagtt

SEQ ID NO: 112740 - DNA, 20 bp, Artificial Sequence
  chemically synthesized
gggtaaattgcatgtcatgg

SEQ ID NO: 112741 - DNA, 20 bp, Artificial Sequence
  chemically synthesized
atgggtaaattgcatgtcat

SEQ ID NO: 112742 - DNA, 20 bp, Artificial Sequence
  chemically synthesized
catgggtaaattgcatgtca

SEQ ID NO: 112743 - DNA, 20 bp, Artificial Sequence
  chemically synthesized
catgtgcaggtttgttacat

SEQ ID NO: 112744 - DNA, 20 bp, Artificial Sequence
  chemically synthesized
acatgtgcaggtttgttaca

SEQ ID NO: 112745 - DNA, 20 bp, Artificial Sequence
  chemically synthesized
agctctaggggcacatgtgc

SEQ ID NO: 112746 - DNA, 20 bp, Artificial Sequence
  chemically synthesized
aagctctaggggcacatgtg

SEQ ID NO: 112747 - DNA, 20 bp, Artificial Sequence
  chemically synthesized
caaacctgcacatgtgcccc

SEQ ID NO: 112748 - DNA, 20 bp, Artificial Sequence
  chemically synthesized
aacctgcacatgtgccccta

SEQ ID NO: 112749 - DNA, 20 bp, Artificial Sequence
  chemically synthesized
acttttattttaagctctag

SEQ ID NO: 112750 - DNA, 20 bp, Artificial Sequence
  chemically synthesized
cacttttattttaagctcta

SEQ ID NO: 112751 - DNA, 20 bp, Artificial Sequence
  chemically synthesized
tcacttttattttaagctct

SEQ ID NO: 112752 - DNA, 20 bp, Artificial Sequence
  chemically synthesized
ttcacttttattttaagctc

SEQ ID NO: 112753 - DNA, 20 bp, Artificial Sequence
  chemically synthesized
gcccctagagcttaaaataa

SEQ ID NO: 112754 - DNA, 20 bp, Artificial Sequence
  chemically synthesized
ttttttttcacttttatttt

SEQ ID NO: 112755 - DNA, 20 bp, Artificial Sequence
  chemically synthesized
ataaaagtgaaaaaaaaaaa

SEQ ID NO: 112756 - DNA, 20 bp, Artificial Sequence
  chemically synthesized
aaagtgaaaaaaaaaaaaag

SEQ ID NO: 112757 - DNA, 20 bp, Artificial Sequence
  chemically synthesized
tgaaaaaaaaaaaaagaaga

SEQ ID NO: 112758 - DNA, 20 bp, Artificial Sequence
  chemically synthesized
aaaaaaaaaaagaagaaaga

SEQ ID NO: 112759 - DNA, 20 bp, Artificial Sequence
  chemically synthesized
aaaaaaaaagaagaaagaaa

SEQ ID NO: 112760 - DNA, 20 bp, Artificial Sequence
  chemically synthesized
aaaaaaaagaagaaagaaag

SEQ ID NO: 112761 - DNA, 20 bp, Artificial Sequence
  chemically synthesized
aaaaagaagaaagaaagagg

SEQ ID NO: 112762 - DNA, 20 bp, Artificial Sequence
  chemically synthesized
aaaagaagaaagaaagagga

SEQ ID NO: 112763 - DNA, 20 bp, Artificial Sequence
  chemically synthesized
agaaagaaagaggaaggaat

SEQ ID NO: 112764 - DNA, 20 bp, Artificial Sequence
  chemically synthesized
aagaggaaggaatgagtgct

SEQ ID NO: 112765 - DNA, 20 bp, Artificial Sequence
  chemically synthesized
gaggaaggaatgagtgctta

SEQ ID NO: 112766 - DNA, 20 bp, Artificial Sequence
  chemically synthesized
ggaaggaatgagtgcttaga

SEQ ID NO: 112767 - DNA, 20 bp, Artificial Sequence
  chemically synthesized
aattgtctccttgtctctct

SEQ ID NO: 112768 - DNA, 20 bp, Artificial Sequence
  chemically synthesized
gaatgagtgcttagagagac

SEQ ID NO: 112769 - DNA, 20 bp, Artificial Sequence
  chemically synthesized
aatgagtgcttagagagaca

SEQ ID NO: 112770 - DNA, 20 bp, Artificial Sequence
  chemically synthesized
tgagtgcttagagagacaag

SEQ ID NO: 112771 - DNA, 20 bp, Artificial Sequence
  chemically synthesized
tagagagacaaggagacaat

SEQ ID NO: 112772 - DNA, 20 bp, Artificial Sequence
  chemically synthesized
attagtataatatatcaccc

SEQ ID NO: 112773 - DNA, 20 bp, Artificial Sequence
  chemically synthesized
gtataatatatcaccctggc

SEQ ID NO: 112774 - DNA, 20 bp, Artificial Sequence
  chemically synthesized
tctcaccttttgacttgcca

SEQ ID NO: 112775 - DNA, 20 bp, Artificial Sequence
  chemically synthesized
gtctcaccttttgacttgcc

SEQ ID NO: 112776 - DNA, 20 bp, Artificial Sequence
  chemically synthesized
tgtctcaccttttgacttgc

SEQ ID NO: 112777 - DNA, 20 bp, Artificial Sequence
  chemically synthesized
atatcaccctggcaagtcaa

SEQ ID NO: 112778 - DNA, 20 bp, Artificial Sequence
  chemically synthesized
tatcaccctggcaagtcaaa

SEQ ID NO: 112779 - DNA, 20 bp, Artificial Sequence
  chemically synthesized
accctggcaagtcaaaaggt

SEQ ID NO: 112780 - DNA, 20 bp, Artificial Sequence
  chemically synthesized
tcaaaaggtgagacattttt

SEQ ID NO: 112781 - DNA, 20 bp, Artificial Sequence
  chemically synthesized
aaaggtgagacatttttcag

SEQ ID NO: 112782 - DNA, 20 bp, Artificial Sequence
  chemically synthesized
aaggtgagacatttttcagt

SEQ ID NO: 112783 - DNA, 20 bp, Artificial Sequence
  chemically synthesized
agacatttttcagtaggctg

SEQ ID NO: 112784 - DNA, 20 bp, Artificial Sequence
  chemically synthesized
atttttcagtaggctgtagt

SEQ ID NO: 112785 - DNA, 20 bp, Artificial Sequence
  chemically synthesized
tttcagtaggctgtagtgag

SEQ ID NO: 112786 - DNA, 20 bp, Artificial Sequence
  chemically synthesized
tttgttattactgctcacta

SEQ ID NO: 112787 - DNA, 20 bp, Artificial Sequence
  chemically synthesized
gagcagtaataacaaaatat

SEQ ID NO: 112788 - DNA, 20 bp, Artificial Sequence
  chemically synthesized
cagtaataacaaaatatgag

SEQ ID NO: 112789 - DNA, 20 bp, Artificial Sequence
  chemically synthesized
acaaaatatgagtagatttc

SEQ ID NO: 112790 - DNA, 20 bp, Artificial Sequence
  chemically synthesized
caaaatatgagtagatttct

SEQ ID NO: 112791 - DNA, 20 bp, Artificial Sequence
  chemically synthesized
aaaatatgagtagatttcta

SEQ ID NO: 112792 - DNA, 20 bp, Artificial Sequence
  chemically synthesized
gagtagatttctagggcaat

SEQ ID NO: 112793 - DNA, 20 bp, Artificial Sequence
  chemically synthesized
ttatcaagtcctcattgccc

SEQ ID NO: 112794 - DNA, 20 bp, Artificial Sequence
  chemically synthesized
agtagatttctagggcaatg

SEQ ID NO: 112795 - DNA, 20 bp, Artificial Sequence
  chemically synthesized
caaatgcaaatatttttatc

SEQ ID NO: 112796 - DNA, 20 bp, Artificial Sequence
  chemically synthesized
ttgataaaaatatttgcatt

SEQ ID NO: 112797 - DNA, 20 bp, Artificial Sequence
  chemically synthesized
ataaaaatatttgcatttgg

SEQ ID NO: 112798 - DNA, 20 bp, Artificial Sequence
  chemically synthesized
atatttgcatttggtagtta

SEQ ID NO: 112799 - DNA, 20 bp, Artificial Sequence
  chemically synthesized
tggtagttatggtgatttca

SEQ ID NO: 112800 - DNA, 20 bp, Artificial Sequence
  chemically synthesized
gtagttatggtgatttcata

SEQ ID NO: 112801 - DNA, 20 bp, Artificial Sequence
  chemically synthesized
gttatggtgatttcatagag

SEQ ID NO: 112802 - DNA, 20 bp, Artificial Sequence
  chemically synthesized
gatttcatagagaagtgttt

SEQ ID NO: 112803 - DNA, 20 bp, Artificial Sequence
  chemically synthesized
tcatagagaagtgtttcagt

SEQ ID NO: 112804 - DNA, 20 bp, Artificial Sequence
  chemically synthesized
catagagaagtgtttcagtt

SEQ ID NO: 112805 - DNA, 20 bp, Artificial Sequence
  chemically synthesized
tagagaagtgtttcagttgg

SEQ ID NO: 112806 - DNA, 20 bp, Artificial Sequence
  chemically synthesized
agagaagtgtttcagttggg

SEQ ID NO: 112807 - DNA, 20 bp, Artificial Sequence
  chemically synthesized
gaagtgtttcagttgggagg

SEQ ID NO: 112808 - DNA, 20 bp, Artificial Sequence
  chemically synthesized
tttcagttgggaggcagatg

SEQ ID NO: 112809 - DNA, 20 bp, Artificial Sequence
  chemically synthesized
ttcctttacattttaaagtc

SEQ ID NO: 112810 - DNA, 20 bp, Artificial Sequence
  chemically synthesized
catctttcctttacatttta

SEQ ID NO: 112811 - DNA, 20 bp, Artificial Sequence
  chemically synthesized
aaacttgactttaaaatgta

SEQ ID NO: 112812 - DNA, 20 bp, Artificial Sequence
  chemically synthesized
aacttgactttaaaatgtaa

SEQ ID NO: 112813 - DNA, 20 bp, Artificial Sequence
  chemically synthesized
tgactttaaaatgtaaagga

SEQ ID NO: 112814 - DNA, 20 bp, Artificial Sequence
  chemically synthesized
tttaaaatgtaaaggaaaga

SEQ ID NO: 112815 - DNA, 20 bp, Artificial Sequence
  chemically synthesized
gtaaaggaaagatggatgtt

SEQ ID NO: 112816 - DNA, 20 bp, Artificial Sequence
  chemically synthesized
taaaggaaagatggatgttt

SEQ ID NO: 112817 - DNA, 20 bp, Artificial Sequence
  chemically synthesized
aggaaagatggatgtttagg

SEQ ID NO: 112818 - DNA, 20 bp, Artificial Sequence
  chemically synthesized
aaagatggatgtttaggaag

SEQ ID NO: 112819 - DNA, 20 bp, Artificial Sequence
  chemically synthesized
actcatctaatagaaattag

SEQ ID NO: 112820 - DNA, 20 bp, Artificial Sequence
  chemically synthesized
atcactcatctaatagaaat

SEQ ID NO: 112821 - DNA, 20 bp, Artificial Sequence
  chemically synthesized
atatttccactaatttctat

SEQ ID NO: 112822 - DNA, 20 bp, Artificial Sequence
  chemically synthesized
tccactaatttctattagat

SEQ ID NO: 112823 - DNA, 20 bp, Artificial Sequence
  chemically synthesized
gcttcaaatcactcatctaa

SEQ ID NO: 112824 - DNA, 20 bp, Artificial Sequence
  chemically synthesized
tctattagatgagtgatttg

SEQ ID NO: 112825 - DNA, 20 bp, Artificial Sequence
  chemically synthesized
agtgatttgaagcttgcttt

SEQ ID NO: 112826 - DNA, 20 bp, Artificial Sequence
  chemically synthesized
gacccaagatcaccaaaagc

SEQ ID NO: 112827 - DNA, 20 bp, Artificial Sequence
  chemically synthesized
gaaagacccaagatcaccaa

SEQ ID NO: 112828 - DNA, 20 bp, Artificial Sequence
  chemically synthesized
aagcttgcttttggtgatct

SEQ ID NO: 112829 - DNA, 20 bp, Artificial Sequence
  chemically synthesized
agcttgcttttggtgatctt

SEQ ID NO: 112830 - DNA, 20 bp, Artificial Sequence
  chemically synthesized
agcattacagggaaagaccc

SEQ ID NO: 112831 - DNA, 20 bp, Artificial Sequence
  chemically synthesized
ttgactcagcattacaggga

SEQ ID NO: 112832 - DNA, 20 bp, Artificial Sequence
  chemically synthesized
tacattgactcagcattaca

SEQ ID NO: 112833 - DNA, 20 bp, Artificial Sequence
  chemically synthesized
ctacattgactcagcattac

SEQ ID NO: 112834 - DNA, 20 bp, Artificial Sequence
  chemically synthesized
gggtctttccctgtaatgct

SEQ ID NO: 112835 - DNA, 20 bp, Artificial Sequence
  chemically synthesized
tctacattgactcagcatta

SEQ ID NO: 112836 - DNA, 20 bp, Artificial Sequence
  chemically synthesized
cccattactctacattgact

SEQ ID NO: 112837 - DNA, 20 bp, Artificial Sequence
  chemically synthesized
cctgtaatgctgagtcaatg

SEQ ID NO: 112838 - DNA, 20 bp, Artificial Sequence
  chemically synthesized
tgtaatgctgagtcaatgta

SEQ ID NO: 112839 - DNA, 20 bp, Artificial Sequence
  chemically synthesized
gctgagtcaatgtagagtaa

SEQ ID NO: 112840 - DNA, 20 bp, Artificial Sequence
  chemically synthesized
ctgagtcaatgtagagtaat

SEQ ID NO: 112841 - DNA, 20 bp, Artificial Sequence
  chemically synthesized
agtcaatgtagagtaatggg

SEQ ID NO: 112842 - DNA, 20 bp, Artificial Sequence
  chemically synthesized
gtcaatgtagagtaatgggt

SEQ ID NO: 112843 - DNA, 20 bp, Artificial Sequence
  chemically synthesized
atgtagagtaatgggtagga

SEQ ID NO: 112844 - DNA, 20 bp, Artificial Sequence
  chemically synthesized
tagagtaatgggtaggacag

SEQ ID NO: 112845 - DNA, 20 bp, Artificial Sequence
  chemically synthesized
gagtaatgggtaggacagta

SEQ ID NO: 112846 - DNA, 20 bp, Artificial Sequence
  chemically synthesized
aatgggtaggacagtagagt

SEQ ID NO: 112847 - DNA, 20 bp, Artificial Sequence
  chemically synthesized
gggtaggacagtagagttgg

SEQ ID NO: 112848 - DNA, 20 bp, Artificial Sequence
  chemically synthesized
taggacagtagagttggtag

SEQ ID NO: 112849 - DNA, 20 bp, Artificial Sequence
  chemically synthesized
cagtagagttggtagaagat

SEQ ID NO: 112850 - DNA, 20 bp, Artificial Sequence
  chemically synthesized
agagttggtagaagatcaga

SEQ ID NO: 112851 - DNA, 20 bp, Artificial Sequence
  chemically synthesized
gaagatcagaaagtcaaact

SEQ ID NO: 112852 - DNA, 20 bp, Artificial Sequence
  chemically synthesized
aagatcagaaagtcaaactt

SEQ ID NO: 112853 - DNA, 20 bp, Artificial Sequence
  chemically synthesized
aaaagtcagcatttgaacct

SEQ ID NO: 112854 - DNA, 20 bp, Artificial Sequence
  chemically synthesized
acccgaatatatagaaaagt

SEQ ID NO: 112855 - DNA, 20 bp, Artificial Sequence
  chemically synthesized
ctcaacccgaatatatagaa

SEQ ID NO: 112856 - DNA, 20 bp, Artificial Sequence
  chemically synthesized
tgctgacttttctatatatt

SEQ ID NO: 112857 - DNA, 20 bp, Artificial Sequence
  chemically synthesized
gctgacttttctatatattc

SEQ ID NO: 112858 - DNA, 20 bp, Artificial Sequence
  chemically synthesized
ggatgctcaacccgaatata

SEQ ID NO: 112859 - DNA, 20 bp, Artificial Sequence
  chemically synthesized
cttttctatatattcgggtt

SEQ ID NO: 112860 - DNA, 20 bp, Artificial Sequence
  chemically synthesized
gattttggattttcagattt

SEQ ID NO: 112861 - DNA, 20 bp, Artificial Sequence
  chemically synthesized
ggattttggattttcagatt

SEQ ID NO: 112862 - DNA, 20 bp, Artificial Sequence
  chemically synthesized
ttttttggattttggatttt

SEQ ID NO: 112863 - DNA, 20 bp, Artificial Sequence
  chemically synthesized
ttttagagttttttggattt

SEQ ID NO: 112864 - DNA, 20 bp, Artificial Sequence
  chemically synthesized
tttcagcttttagagttttt

SEQ ID NO: 112865 - DNA, 20 bp, Artificial Sequence
  chemically synthesized
caaaatccaaaaaactctaa

SEQ ID NO: 112866 - DNA, 20 bp, Artificial Sequence
  chemically synthesized
tcaaaaattttcagctttta

SEQ ID NO: 112867 - DNA, 20 bp, Artificial Sequence
  chemically synthesized
gctcaaaaattttcagcttt

SEQ ID NO: 112868 - DNA, 20 bp, Artificial Sequence
  chemically synthesized
tgtcggcgctcaaaaatttt

SEQ ID NO: 112869 - DNA, 20 bp, Artificial Sequence
  chemically synthesized
tctaaaagctgaaaattttt

SEQ ID NO: 112870 - DNA, 20 bp, Artificial Sequence
  chemically synthesized
atttactttgagaatcatgt

SEQ ID NO: 112871 - DNA, 20 bp, Artificial Sequence
  chemically synthesized
gagcgccgacatgattctca

SEQ ID NO: 112872 - DNA, 20 bp, Artificial Sequence
  chemically synthesized
ctccaatgagcatttacttt

SEQ ID NO: 112873 - DNA, 20 bp, Artificial Sequence
  chemically synthesized
ttctcaaagtaaatgctcat

SEQ ID NO: 112874 - DNA, 20 bp, Artificial Sequence
  chemically synthesized
ctcaaagtaaatgctcattg

SEQ ID NO: 112875 - DNA, 20 bp, Artificial Sequence
  chemically synthesized
aaaattggaaatactccaat

SEQ ID NO: 112876 - DNA, 20 bp, Artificial Sequence
  chemically synthesized
caaaccccaaaattcaaaat

SEQ ID NO: 112877 - DNA, 20 bp, Artificial Sequence
  chemically synthesized
gtatttccaattttgaattt

SEQ ID NO: 112878 - DNA, 20 bp, Artificial Sequence
  chemically synthesized
tatttccaattttgaatttt

SEQ ID NO: 112879 - DNA, 20 bp, Artificial Sequence
  chemically synthesized
atttccaattttgaattttg

SEQ ID NO: 112880 - DNA, 20 bp, Artificial Sequence
  chemically synthesized
caattttgaattttggggtt

SEQ ID NO: 112881 - DNA, 20 bp, Artificial Sequence
  chemically synthesized
aattttgaattttggggttt

SEQ ID NO: 112882 - DNA, 20 bp, Artificial Sequence
  chemically synthesized
ttgctttataattatgggtt

SEQ ID NO: 112883 - DNA, 20 bp, Artificial Sequence
  chemically synthesized
attacttgctttataattat

SEQ ID NO: 112884 - DNA, 20 bp, Artificial Sequence
  chemically synthesized
gattacttgctttataatta

SEQ ID NO: 112885 - DNA, 20 bp, Artificial Sequence
  chemically synthesized
atgcttaacccataattata

SEQ ID NO: 112886 - DNA, 20 bp, Artificial Sequence
  chemically synthesized
ttaacccataattataaagc

SEQ ID NO: 112887 - DNA, 20 bp, Artificial Sequence
  chemically synthesized
tttcagattttttcagattt

SEQ ID NO: 112888 - DNA, 20 bp, Artificial Sequence
  chemically synthesized
ttttggatttcagatttttt

SEQ ID NO: 112889 - DNA, 20 bp, Artificial Sequence
  chemically synthesized
ctgattctttttttggattt

SEQ ID NO: 112890 - DNA, 20 bp, Artificial Sequence
  chemically synthesized
aaaaatctgaaatccaaaaa

SEQ ID NO: 112891 - DNA, 20 bp, Artificial Sequence
  chemically synthesized
tttttttctgattctttttt

SEQ ID NO: 112892 - DNA, 20 bp, Artificial Sequence
  chemically synthesized
ctgaaatccaaaaaaagaat

SEQ ID NO: 112893 - DNA, 20 bp, Artificial Sequence
  chemically synthesized
acttgggaccacaagtgtta

SEQ ID NO: 112894 - DNA, 20 bp, Artificial Sequence
  chemically synthesized
attgatatccataacacttg

SEQ ID NO: 112895 - DNA, 20 bp, Artificial Sequence
  chemically synthesized
tccaaaacacttgggaccac

SEQ ID NO: 112896 - DNA, 20 bp, Artificial Sequence
  chemically synthesized
tccataacacttgtggtccc

SEQ ID NO: 112897 - DNA, 20 bp, Artificial Sequence
  chemically synthesized
atcccttatccaaaacactt

SEQ ID NO: 112898 - DNA, 20 bp, Artificial Sequence
  chemically synthesized
acttgtggtcccaagtgttt

SEQ ID NO: 112899 - DNA, 20 bp, Artificial Sequence
  chemically synthesized
tatcccttatccaaaacact

SEQ ID NO: 112900 - DNA, 20 bp, Artificial Sequence
  chemically synthesized
tggtcccaagtgttttggat

SEQ ID NO: 112901 - DNA, 20 bp, Artificial Sequence
  chemically synthesized
ggtcccaagtgttttggata

SEQ ID NO: 112902 - DNA, 20 bp, Artificial Sequence
  chemically synthesized
gtcccaagtgttttggataa

SEQ ID NO: 112903 - DNA, 20 bp, Artificial Sequence
  chemically synthesized
ttggataagggatactcaac

SEQ ID NO: 112904 - DNA, 20 bp, Artificial Sequence
  chemically synthesized
gtaacacacaagtactggtt

SEQ ID NO: 112905 - DNA, 20 bp, Artificial Sequence
  chemically synthesized
ctaaggtaacacacaagtac

SEQ ID NO: 112906 - DNA, 20 bp, Artificial Sequence
  chemically synthesized
cttctactaaggtaacacac

SEQ ID NO: 112907 - DNA, 20 bp, Artificial Sequence
  chemically synthesized
ccagtacttgtgtgttacct

SEQ ID NO: 112908 - DNA, 20 bp, Artificial Sequence
  chemically synthesized
gtacttgtgtgttaccttag

SEQ ID NO: 112909 - DNA, 20 bp, Artificial Sequence
  chemically synthesized
cttgtgtgttaccttagtag

SEQ ID NO: 112910 - DNA, 20 bp, Artificial Sequence
  chemically synthesized
aggctgggtaacttctacta

SEQ ID NO: 112911 - DNA, 20 bp, Artificial Sequence
  chemically synthesized
gaggctgggtaacttctact

SEQ ID NO: 112912 - DNA, 20 bp, Artificial Sequence
  chemically synthesized
ttaccttagtagaagttacc

SEQ ID NO: 112913 - DNA, 20 bp, Artificial Sequence
  chemically synthesized
gtagaagttacccagcctct

SEQ ID NO: 112914 - DNA, 20 bp, Artificial Sequence
  chemically synthesized
agaggaaaaactgagaggct

SEQ ID NO: 112915 - DNA, 20 bp, Artificial Sequence
  chemically synthesized
cagaggaaaaactgagaggc

SEQ ID NO: 112916 - DNA, 20 bp, Artificial Sequence
  chemically synthesized
agtacagaggaaaaactgag

SEQ ID NO: 112917 - DNA, 20 bp, Artificial Sequence
  chemically synthesized
tagtacagaggaaaaactga

SEQ ID NO: 112918 - DNA, 20 bp, Artificial Sequence
  chemically synthesized
tttagtacagaggaaaaact

SEQ ID NO: 112919 - DNA, 20 bp, Artificial Sequence
  chemically synthesized
ccatcgtatatttagtacag

SEQ ID NO: 112920 - DNA, 20 bp, Artificial Sequence
  chemically synthesized
accatcgtatatttagtaca

SEQ ID NO: 112921 - DNA, 20 bp, Artificial Sequence
  chemically synthesized
ataccatcgtatatttagta

SEQ ID NO: 112922 - DNA, 20 bp, Artificial Sequence
  chemically synthesized
atgtaataccatcgtatatt

SEQ ID NO: 112923 - DNA, 20 bp, Artificial Sequence
  chemically synthesized
cctctgtactaaatatacga

SEQ ID NO: 112924 - DNA, 20 bp, Artificial Sequence
  chemically synthesized
acgatggtattacatcatgc

SEQ ID NO: 112925 - DNA, 20 bp, Artificial Sequence
  chemically synthesized
ggtattacatcatgcaagca

SEQ ID NO: 112926 - DNA, 20 bp, Artificial Sequence
  chemically synthesized
catcatgcaagcaaagcact

SEQ ID NO: 112927 - DNA, 20 bp, Artificial Sequence
  chemically synthesized
tatgtgccaaggtgtgtact

SEQ ID NO: 112928 - DNA, 20 bp, Artificial Sequence
  chemically synthesized
aaagcacttagtacacacct

SEQ ID NO: 112929 - DNA, 20 bp, Artificial Sequence
  chemically synthesized
ttagtacacaccttggcaca

SEQ ID NO: 112930 - DNA, 20 bp, Artificial Sequence
  chemically synthesized
aaaatagttactatgtgcca

SEQ ID NO: 112931 - DNA, 20 bp, Artificial Sequence
  chemically synthesized
taaaatagttactatgtgcc

SEQ ID NO: 112932 - DNA, 20 bp, Artificial Sequence
  chemically synthesized
cacatagtaactattttaaa

SEQ ID NO: 112933 - DNA, 20 bp, Artificial Sequence
  chemically synthesized
taatagctacctttttaaaa

SEQ ID NO: 112934 - DNA, 20 bp, Artificial Sequence
  chemically synthesized
acatagtaactattttaaaa

SEQ ID NO: 112935 - DNA, 20 bp, Artificial Sequence
  chemically synthesized
tagtaactattttaaaaagg

SEQ ID NO: 112936 - DNA, 20 bp, Artificial Sequence
  chemically synthesized
aaggggggtaataataataa

SEQ ID NO: 112937 - DNA, 20 bp, Artificial Sequence
  chemically synthesized
tatttttcaattattaaggg

SEQ ID NO: 112938 - DNA, 20 bp, Artificial Sequence
  chemically synthesized
gtatttttcaattattaagg

SEQ ID NO: 112939 - DNA, 20 bp, Artificial Sequence
  chemically synthesized
tgtatttttcaattattaag

SEQ ID NO: 112940 - DNA, 20 bp, Artificial Sequence
  chemically synthesized
atgtatttttcaattattaa

SEQ ID NO: 112941 - DNA, 20 bp, Artificial Sequence
  chemically synthesized
catgtatttttcaattatta

SEQ ID NO: 112942 - DNA, 20 bp, Artificial Sequence
  chemically synthesized
tcatgtatttttcaattatt

SEQ ID NO: 112943 - DNA, 20 bp, Artificial Sequence
  chemically synthesized
atacatgatgactttaatcc

SEQ ID NO: 112944 - DNA, 20 bp, Artificial Sequence
  chemically synthesized
tgtttacttttctgggatta

SEQ ID NO: 112945 - DNA, 20 bp, Artificial Sequence
  chemically synthesized
tgatgactttaatcccagaa

SEQ ID NO: 112946 - DNA, 20 bp, Artificial Sequence
  chemically synthesized
caataaatgtttacttttct

SEQ ID NO: 112947 - DNA, 20 bp, Artificial Sequence
  chemically synthesized
acaataaatgtttacttttc

SEQ ID NO: 112948 - DNA, 20 bp, Artificial Sequence
  chemically synthesized
aagtaaacatttattgtgac

SEQ ID NO: 112949 - DNA, 20 bp, Artificial Sequence
  chemically synthesized
catttattgtgacaagcttt

SEQ ID NO: 112950 - DNA, 20 bp, Artificial Sequence
  chemically synthesized
agggcaattatataaactaa

SEQ ID NO: 112951 - DNA, 20 bp, Artificial Sequence
  chemically synthesized
tatataattgccctcctaac

SEQ ID NO: 112952 - DNA, 20 bp, Artificial Sequence
  chemically synthesized
tttattactcccagttagga

SEQ ID NO: 112953 - DNA, 20 bp, Artificial Sequence
  chemically synthesized
atataattgccctcctaact

SEQ ID NO: 112954 - DNA, 20 bp, Artificial Sequence
  chemically synthesized
ttttattactcccagttagg

SEQ ID NO: 112955 - DNA, 20 bp, Artificial Sequence
  chemically synthesized
attttattactcccagttag

SEQ ID NO: 112956 - DNA, 20 bp, Artificial Sequence
  chemically synthesized
ataattgccctcctaactgg

SEQ ID NO: 112957 - DNA, 20 bp, Artificial Sequence
  chemically synthesized
aaattttattactcccagtt

SEQ ID NO: 112958 - DNA, 20 bp, Artificial Sequence
  chemically synthesized
taaattttattactcccagt

SEQ ID NO: 112959 - DNA, 20 bp, Artificial Sequence
  chemically synthesized
ctactaaattttattactcc

SEQ ID NO: 112960 - DNA, 20 bp, Artificial Sequence
  chemically synthesized
taactgggagtaataaaatt

SEQ ID NO: 112961 - DNA, 20 bp, Artificial Sequence
  chemically synthesized
ctgggagtaataaaatttag

SEQ ID NO: 112962 - DNA, 20 bp, Artificial Sequence
  chemically synthesized
aatttagtagttattttaac

SEQ ID NO: 112963 - DNA, 20 bp, Artificial Sequence
  chemically synthesized
ttagtagttattttaacaag

SEQ ID NO: 112964 - DNA, 20 bp, Artificial Sequence
  chemically synthesized
gttattttaacaagtagcaa

SEQ ID NO: 112965 - DNA, 20 bp, Artificial Sequence
  chemically synthesized
agaataaaattggagaggtt

SEQ ID NO: 112966 - DNA, 20 bp, Artificial Sequence
  chemically synthesized
tgagaagaataaaattggag

SEQ ID NO: 112967 - DNA, 20 bp, Artificial Sequence
  chemically synthesized
ttgagaagaataaaattgga

SEQ ID NO: 112968 - DNA, 20 bp, Artificial Sequence
  chemically synthesized
atttgagaagaataaaattg

SEQ ID NO: 112969 - DNA, 20 bp, Artificial Sequence
  chemically synthesized
tcatttgagaagaataaaat

SEQ ID NO: 112970 - DNA, 20 bp, Artificial Sequence
  chemically synthesized
tatttccattttcatttgag

SEQ ID NO: 112971 - DNA, 20 bp, Artificial Sequence
  chemically synthesized
tattatttccattttcattt

SEQ ID NO: 112972 - DNA, 20 bp, Artificial Sequence
  chemically synthesized
ttattcttctcaaatgaaaa

SEQ ID NO: 112973 - DNA, 20 bp, Artificial Sequence
  chemically synthesized
tcaaatgaaaatggaaataa

SEQ ID NO: 112974 - DNA, 20 bp, Artificial Sequence
  chemically synthesized
caaatgaaaatggaaataat

SEQ ID NO: 112975 - DNA, 20 bp, Artificial Sequence
  chemically synthesized
aatgaaaatggaaataatag

SEQ ID NO: 112976 - DNA, 20 bp, Artificial Sequence
  chemically synthesized
taataggagtaccaacatca

SEQ ID NO: 112977 - DNA, 20 bp, Artificial Sequence
  chemically synthesized
aataggagtaccaacatcac

SEQ ID NO: 112978 - DNA, 20 bp, Artificial Sequence
  chemically synthesized
ttagtgaaaacctgtgatgt

SEQ ID NO: 112979 - DNA, 20 bp, Artificial Sequence
  chemically synthesized
caacatcacaggttttcact

SEQ ID NO: 112980 - DNA, 20 bp, Artificial Sequence
  chemically synthesized
aacatcacaggttttcacta

SEQ ID NO: 112981 - DNA, 20 bp, Artificial Sequence
  chemically synthesized
tcattttctaatttgatcct

SEQ ID NO: 112982 - DNA, 20 bp, Artificial Sequence
  chemically synthesized
gttttcactaaggatcaaat

SEQ ID NO: 112983 - DNA, 20 bp, Artificial Sequence
  chemically synthesized
aggatcaaattagaaaatga

SEQ ID NO: 112984 - DNA, 20 bp, Artificial Sequence
  chemically synthesized
caaattagaaaatgacagta

SEQ ID NO: 112985 - DNA, 20 bp, Artificial Sequence
  chemically synthesized
tttatgtttcataattggca

SEQ ID NO: 112986 - DNA, 20 bp, Artificial Sequence
  chemically synthesized
aatattttatgtttcataat

SEQ ID NO: 112987 - DNA, 20 bp, Artificial Sequence
  chemically synthesized
attatgaaacataaaatatt

SEQ ID NO: 112988 - DNA, 20 bp, Artificial Sequence
  chemically synthesized
caaagttatattaattaata

SEQ ID NO: 112989 - DNA, 20 bp, Artificial Sequence
  chemically synthesized
tcttaaaagtcaatggatca

SEQ ID NO: 112990 - DNA, 20 bp, Artificial Sequence
  chemically synthesized
aggatgctcttaaaagtcaa

SEQ ID NO: 112991 - DNA, 20 bp, Artificial Sequence
  chemically synthesized
actttgatccattgactttt

SEQ ID NO: 112992 - DNA, 20 bp, Artificial Sequence
  chemically synthesized
tttgatccattgacttttaa

SEQ ID NO: 112993 - DNA, 20 bp, Artificial Sequence
  chemically synthesized
atctaataggatgctcttaa

SEQ ID NO: 112994 - DNA, 20 bp, Artificial Sequence
  chemically synthesized
gacttttaagagcatcctat

SEQ ID NO: 112995 - DNA, 20 bp, Artificial Sequence
  chemically synthesized
actgaagatgtaaatctaat

SEQ ID NO: 112996 - DNA, 20 bp, Artificial Sequence
  chemically synthesized
aactgaagatgtaaatctaa

SEQ ID NO: 112997 - DNA, 20 bp, Artificial Sequence
  chemically synthesized
tcctattagatttacatctt

SEQ ID NO: 112998 - DNA, 20 bp, Artificial Sequence
  chemically synthesized
attaaacaaaagtcaaactg

SEQ ID NO: 112999 - DNA, 20 bp, Artificial Sequence
  chemically synthesized
tatgaattaccattaaacaa

SEQ ID NO: 113000 - DNA, 20 bp, Artificial Sequence
  chemically synthesized
tcagtttgacttttgtttaa

SEQ ID NO: 113001 - DNA, 20 bp, Artificial Sequence
  chemically synthesized
tggtaattcataaaattaat

SEQ ID NO: 113002 - DNA, 20 bp, Artificial Sequence
  chemically synthesized
ggtaattcataaaattaata

SEQ ID NO: 113003 - DNA, 20 bp, Artificial Sequence
  chemically synthesized
tgaaaaagctttcaagtgaa

SEQ ID NO: 113004 - DNA, 20 bp, Artificial Sequence
  chemically synthesized
ttgaaaaagctttcaagtga

SEQ ID NO: 113005 - DNA, 20 bp, Artificial Sequence
  chemically synthesized
aataaggacctttcacttga

SEQ ID NO: 113006 - DNA, 20 bp, Artificial Sequence
  chemically synthesized
agcactttgaaaaagctttc

SEQ ID NO: 113007 - DNA, 20 bp, Artificial Sequence
  chemically synthesized
ttcacttgaaagctttttca

SEQ ID NO: 113008 - DNA, 20 bp, Artificial Sequence
  chemically synthesized
aatatgaaagcactttgaaa

SEQ ID NO: 113009 - DNA, 20 bp, Artificial Sequence
  chemically synthesized
ttataagggaataaatatga

SEQ ID NO: 113010 - DNA, 20 bp, Artificial Sequence
  chemically synthesized
tttcatatttattcccttat

SEQ ID NO: 113011 - DNA, 20 bp, Artificial Sequence
  chemically synthesized
cttttgtgaggatcttataa

SEQ ID NO: 113012 - DNA, 20 bp, Artificial Sequence
  chemically synthesized
gcttttgtgaggatcttata

SEQ ID NO: 113013 - DNA, 20 bp, Artificial Sequence
  chemically synthesized
agcttttgtgaggatcttat

SEQ ID NO: 113014 - DNA, 20 bp, Artificial Sequence
  chemically synthesized
cccttataagatcctcacaa

SEQ ID NO: 113015 - DNA, 20 bp, Artificial Sequence
  chemically synthesized
ttcctcgcagagcttttgtg

SEQ ID NO: 113016 - DNA, 20 bp, Artificial Sequence
  chemically synthesized
attcctcgcagagcttttgt

SEQ ID NO: 113017 - DNA, 20 bp, Artificial Sequence
  chemically synthesized
gatcctcacaaaagctctgc

SEQ ID NO: 113018 - DNA, 20 bp, Artificial Sequence
  chemically synthesized
atcctcacaaaagctctgcg

SEQ ID NO: 113019 - DNA, 20 bp, Artificial Sequence
  chemically synthesized
attgtgttttattcctcgca

SEQ ID NO: 113020 - DNA, 20 bp, Artificial Sequence
  chemically synthesized
ccattgtgttttattcctcg

SEQ ID NO: 113021 - DNA, 20 bp, Artificial Sequence
  chemically synthesized
ctgcgaggaataaaacacaa

SEQ ID NO: 113022 - DNA, 20 bp, Artificial Sequence
  chemically synthesized
gaataaaacacaatggttat

SEQ ID NO: 113023 - DNA, 20 bp, Artificial Sequence
  chemically synthesized
ataaaacacaatggttattg

SEQ ID NO: 113024 - DNA, 20 bp, Artificial Sequence
  chemically synthesized
taaaacacaatggttattgg

SEQ ID NO: 113025 - DNA, 20 bp, Artificial Sequence
  chemically synthesized
tactgaaaagtcaattttgt

SEQ ID NO: 113026 - DNA, 20 bp, Artificial Sequence
  chemically synthesized
ggctaacaaaattgactttt

SEQ ID NO: 113027 - DNA, 20 bp, Artificial Sequence
  chemically synthesized
aagacactgtgcatactgaa

SEQ ID NO: 113028 - DNA, 20 bp, Artificial Sequence
  chemically synthesized
aattgacttttcagtatgca

SEQ ID NO: 113029 - DNA, 20 bp, Artificial Sequence
  chemically synthesized
gaaaagcccacattggtaag

SEQ ID NO: 113030 - DNA, 20 bp, Artificial Sequence
  chemically synthesized
acagtgtcttcttaccaatg

SEQ ID NO: 113031 - DNA, 20 bp, Artificial Sequence
  chemically synthesized
aaagaaaagcccacattggt

SEQ ID NO: 113032 - DNA, 20 bp, Artificial Sequence
  chemically synthesized
cagtgtcttcttaccaatgt

SEQ ID NO: 113033 - DNA, 20 bp, Artificial Sequence
  chemically synthesized
accaaaagaaaagcccacat

SEQ ID NO: 113034 - DNA, 20 bp, Artificial Sequence
  chemically synthesized
accaatgtgggcttttcttt

SEQ ID NO: 113035 - DNA, 20 bp, Artificial Sequence
  chemically synthesized
atatctataaaccaaaagaa

SEQ ID NO: 113036 - DNA, 20 bp, Artificial Sequence
  chemically synthesized
attttatatctataaaccaa

SEQ ID NO: 113037 - DNA, 20 bp, Artificial Sequence
  chemically synthesized
tgggcttttcttttggttta

SEQ ID NO: 113038 - DNA, 20 bp, Artificial Sequence
  chemically synthesized
tataaaattacaaaatccaa

SEQ ID NO: 113039 - DNA, 20 bp, Artificial Sequence
  chemically synthesized
taactttgtaaattaactat

SEQ ID NO: 113040 - DNA, 20 bp, Artificial Sequence
  chemically synthesized
aatccaatagttaatttaca

SEQ ID NO: 113041 - DNA, 20 bp, Artificial Sequence
  chemically synthesized
atttacaaagttattcaatt

SEQ ID NO: 113042 - DNA, 20 bp, Artificial Sequence
  chemically synthesized
caattatctagaatgataca

SEQ ID NO: 113043 - DNA, 20 bp, Artificial Sequence
  chemically synthesized
gtcattactttgtatcattc

SEQ ID NO: 113044 - DNA, 20 bp, Artificial Sequence
  chemically synthesized
cattacattaaacaattatc

SEQ ID NO: 113045 - DNA, 20 bp, Artificial Sequence
  chemically synthesized
tagataattgtttaatgtaa

SEQ ID NO: 113046 - DNA, 20 bp, Artificial Sequence
  chemically synthesized
tttaatgtaatggcaacatc

SEQ ID NO: 113047 - DNA, 20 bp, Artificial Sequence
  chemically synthesized
aatgtaatggcaacatccag

SEQ ID NO: 113048 - DNA, 20 bp, Artificial Sequence
  chemically synthesized
gtaatggcaacatccagaag

SEQ ID NO: 113049 - DNA, 20 bp, Artificial Sequence
  chemically synthesized
taatggcaacatccagaagt

SEQ ID NO: 113050 - DNA, 20 bp, Artificial Sequence
  chemically synthesized
aaacctttaaaacctacttc

SEQ ID NO: 113051 - DNA, 20 bp, Artificial Sequence
  chemically synthesized
acatccagaagtaggtttta

SEQ ID NO: 113052 - DNA, 20 bp, Artificial Sequence
  chemically synthesized
catccagaagtaggttttaa

SEQ ID NO: 113053 - DNA, 20 bp, Artificial Sequence
  chemically synthesized
taacatgtttacgtatgaat

SEQ ID NO: 113054 - DNA, 20 bp, Artificial Sequence
  chemically synthesized
gtttacgtatgaatgagaca

SEQ ID NO: 113055 - DNA, 20 bp, Artificial Sequence
  chemically synthesized
agacatggttcatgttacca

SEQ ID NO: 113056 - DNA, 20 bp, Artificial Sequence
  chemically synthesized
cgttttggaccatgttacca

SEQ ID NO: 113057 - DNA, 20 bp, Artificial Sequence
  chemically synthesized
ttcatgttaccatggtaaca

SEQ ID NO: 113058 - DNA, 20 bp, Artificial Sequence
  chemically synthesized
catggtaacatggtccaaaa

SEQ ID NO: 113059 - DNA, 20 bp, Artificial Sequence
  chemically synthesized
ttttaagtgttgtaccgttt

SEQ ID NO: 113060 - DNA, 20 bp, Artificial Sequence
  chemically synthesized
gagtttagctatttgatttt

SEQ ID NO: 113061 - DNA, 20 bp, Artificial Sequence
  chemically synthesized
gtacaacacttaaaatcaaa

SEQ ID NO: 113062 - DNA, 20 bp, Artificial Sequence
  chemically synthesized
aatttaatgcaatatgagtt

SEQ ID NO: 113063 - DNA, 20 bp, Artificial Sequence
  chemically synthesized
accccaatttaatgcaatat

SEQ ID NO: 113064 - DNA, 20 bp, Artificial Sequence
  chemically synthesized
aaactcatattgcattaaat

SEQ ID NO: 113065 - DNA, 20 bp, Artificial Sequence
  chemically synthesized
aactcatattgcattaaatt

SEQ ID NO: 113066 - DNA, 20 bp, Artificial Sequence
  chemically synthesized
actcatattgcattaaattg

SEQ ID NO: 113067 - DNA, 20 bp, Artificial Sequence
  chemically synthesized
ttgcattaaattggggtgac

SEQ ID NO: 113068 - DNA, 20 bp, Artificial Sequence
  chemically synthesized
attagaatccatttttcatc

SEQ ID NO: 113069 - DNA, 20 bp, Artificial Sequence
  chemically synthesized
tggggtgactggatgaaaaa

SEQ ID NO: 113070 - DNA, 20 bp, Artificial Sequence
  chemically synthesized
aaagactgaatgcagaaaat

SEQ ID NO: 113071 - DNA, 20 bp, Artificial Sequence
  chemically synthesized
ggattctaattttctgcatt

SEQ ID NO: 113072 - DNA, 20 bp, Artificial Sequence
  chemically synthesized
gcaggaagaaagactgaatg

SEQ ID NO: 113073 - DNA, 20 bp, Artificial Sequence
  chemically synthesized
ttttatctcctgcaggaaga

SEQ ID NO: 113074 - DNA, 20 bp, Artificial Sequence
  chemically synthesized
gcattcagtctttcttcctg

SEQ ID NO: 113075 - DNA, 20 bp, Artificial Sequence
  chemically synthesized
cattcagtctttcttcctgc

SEQ ID NO: 113076 - DNA, 20 bp, Artificial Sequence
  chemically synthesized
ttcagtctttcttcctgcag

SEQ ID NO: 113077 - DNA, 20 bp, Artificial Sequence
  chemically synthesized
ggtcttttatctcctgcagg

SEQ ID NO: 113078 - DNA, 20 bp, Artificial Sequence
  chemically synthesized
actggtcttttatctcctgc

SEQ ID NO: 113079 - DNA, 20 bp, Artificial Sequence
  chemically synthesized
gactggtcttttatctcctg

SEQ ID NO: 113080 - DNA, 20 bp, Artificial Sequence
  chemically synthesized
tttcttcctgcaggagataa

SEQ ID NO: 113081 - DNA, 20 bp, Artificial Sequence
  chemically synthesized
tcctgcaggagataaaagac

SEQ ID NO: 113082 - DNA, 20 bp, Artificial Sequence
  chemically synthesized
tggggacaaatgttcaggac

SEQ ID NO: 113083 - DNA, 20 bp, Artificial Sequence
  chemically synthesized
gtcaatggggacaaatgttc

SEQ ID NO: 113084 - DNA, 20 bp, Artificial Sequence
  chemically synthesized
agtcaatggggacaaatgtt

SEQ ID NO: 113085 - DNA, 20 bp, Artificial Sequence
  chemically synthesized
tttagaaaagggagtcaatg

SEQ ID NO: 113086 - DNA, 20 bp, Artificial Sequence
  chemically synthesized
gtttagaaaagggagtcaat

SEQ ID NO: 113087 - DNA, 20 bp, Artificial Sequence
  chemically synthesized
agtttagaaaagggagtcaa

SEQ ID NO: 113088 - DNA, 20 bp, Artificial Sequence
  chemically synthesized
aattaaaagtttagaaaagg

SEQ ID NO: 113089 - DNA, 20 bp, Artificial Sequence
  chemically synthesized
ataattaaaagtttagaaaa

SEQ ID NO: 113090 - DNA, 20 bp, Artificial Sequence
  chemically synthesized
aataattaaaagtttagaaa

SEQ ID NO: 113091 - DNA, 20 bp, Artificial Sequence
  chemically synthesized
aaataattaaaagtttagaa

SEQ ID NO: 113092 - DNA, 20 bp, Artificial Sequence
  chemically synthesized
aatgaaaataattaaaagtt

SEQ ID NO: 113093 - DNA, 20 bp, Artificial Sequence
  chemically synthesized
gaaataatgaaaataattaa

SEQ ID NO: 113094 - DNA, 20 bp, Artificial Sequence
  chemically synthesized
ttattttcattatttcattt

SEQ ID NO: 113095 - DNA, 20 bp, Artificial Sequence
  chemically synthesized
tttcatttcggattttctct

SEQ ID NO: 113096 - DNA, 20 bp, Artificial Sequence
  chemically synthesized
ctgaattcctgtagatctca

SEQ ID NO: 113097 - DNA, 20 bp, Artificial Sequence
  chemically synthesized
cggattttctctgagatcta

SEQ ID NO: 113098 - DNA, 20 bp, Artificial Sequence
  chemically synthesized
ccctgaattcctgtagatct

SEQ ID NO: 113099 - DNA, 20 bp, Artificial Sequence
  chemically synthesized
ggattttctctgagatctac

SEQ ID NO: 113100 - DNA, 20 bp, Artificial Sequence
  chemically synthesized
tttgggaccctgaattcctg

SEQ ID NO: 113101 - DNA, 20 bp, Artificial Sequence
  chemically synthesized
ctctgagatctacaggaatt

SEQ ID NO: 113102 - DNA, 20 bp, Artificial Sequence
  chemically synthesized
tctgagatctacaggaattc

SEQ ID NO: 113103 - DNA, 20 bp, Artificial Sequence
  chemically synthesized
ctgagatctacaggaattca

SEQ ID NO: 113104 - DNA, 20 bp, Artificial Sequence
  chemically synthesized
aggaattcagggtcccaaaa

SEQ ID NO: 113105 - DNA, 20 bp, Artificial Sequence
  chemically synthesized
actttattattttccatttt

SEQ ID NO: 113106 - DNA, 20 bp, Artificial Sequence
  chemically synthesized
tactttattattttccattt

SEQ ID NO: 113107 - DNA, 20 bp, Artificial Sequence
  chemically synthesized
tcccaaaatggaaaataata

SEQ ID NO: 113108 - DNA, 20 bp, Artificial Sequence
  chemically synthesized
aataataaagtaactaaata

SEQ ID NO: 113109 - DNA, 20 bp, Artificial Sequence
  chemically synthesized
gattgtcttcttgctatatt

SEQ ID NO: 113110 - DNA, 20 bp, Artificial Sequence
  chemically synthesized
ataaagtaactaaatatagc

SEQ ID NO: 113111 - DNA, 20 bp, Artificial Sequence
  chemically synthesized
aagtaactaaatatagcaag

SEQ ID NO: 113112 - DNA, 20 bp, Artificial Sequence
  chemically synthesized
tagcaagaagacaatcatgt

SEQ ID NO: 113113 - DNA, 20 bp, Artificial Sequence
  chemically synthesized
aagacaatcatgtgagtctt

SEQ ID NO: 113114 - DNA, 20 bp, Artificial Sequence
  chemically synthesized
tataatgctcaggaatactc

SEQ ID NO: 113115 - DNA, 20 bp, Artificial Sequence
  chemically synthesized
tgtgagtcttgagtattcct

SEQ ID NO: 113116 - DNA, 20 bp, Artificial Sequence
  chemically synthesized
aacctctgactataatgctc

SEQ ID NO: 113117 - DNA, 20 bp, Artificial Sequence
  chemically synthesized
ttgagtattcctgagcatta

SEQ ID NO: 113118 - DNA, 20 bp, Artificial Sequence
  chemically synthesized
gaacctctgactataatgct

SEQ ID NO: 113119 - DNA, 20 bp, Artificial Sequence
  chemically synthesized
gtattcctgagcattatagt

SEQ ID NO: 113120 - DNA, 20 bp, Artificial Sequence
  chemically synthesized
attcctgagcattatagtca

SEQ ID NO: 113121 - DNA, 20 bp, Artificial Sequence
  chemically synthesized
ttcctgagcattatagtcag

SEQ ID NO: 113122 - DNA, 20 bp, Artificial Sequence
  chemically synthesized
ccatgaatctattgttcagt

SEQ ID NO: 113123 - DNA, 20 bp, Artificial Sequence
  chemically synthesized
cagaggttctcactgaacaa

SEQ ID NO: 113124 - DNA, 20 bp, Artificial Sequence
  chemically synthesized
ctacccatgaatctattgtt

SEQ ID NO: 113125 - DNA, 20 bp, Artificial Sequence
  chemically synthesized
ctcactgaacaatagattca

SEQ ID NO: 113126 - DNA, 20 bp, Artificial Sequence
  chemically synthesized
tcactgaacaatagattcat

SEQ ID NO: 113127 - DNA, 20 bp, Artificial Sequence
  chemically synthesized
ctgaacaatagattcatggg

SEQ ID NO: 113128 - DNA, 20 bp, Artificial Sequence
  chemically synthesized
gataccagttcaattgaacg

SEQ ID NO: 113129 - DNA, 20 bp, Artificial Sequence
  chemically synthesized
catgctacgttcaattgaac

SEQ ID NO: 113130 - DNA, 20 bp, Artificial Sequence
  chemically synthesized
tctctaccctcgatagatac

SEQ ID NO: 113131 - DNA, 20 bp, Artificial Sequence
  chemically synthesized
caattgaactggtatctatc

SEQ ID NO: 113132 - DNA, 20 bp, Artificial Sequence
  chemically synthesized
aattgaactggtatctatcg

SEQ ID NO: 113133 - DNA, 20 bp, Artificial Sequence
  chemically synthesized
attgaactggtatctatcga

SEQ ID NO: 113134 - DNA, 20 bp, Artificial Sequence
  chemically synthesized
gaactggtatctatcgaggg

SEQ ID NO: 113135 - DNA, 20 bp, Artificial Sequence
  chemically synthesized
actactgtctctaccctcga

SEQ ID NO: 113136 - DNA, 20 bp, Artificial Sequence
  chemically synthesized
actggtatctatcgagggta

SEQ ID NO: 113137 - DNA, 20 bp, Artificial Sequence
  chemically synthesized
gtatctatcgagggtagaga

SEQ ID NO: 113138 - DNA, 20 bp, Artificial Sequence
  chemically synthesized
tctatcgagggtagagacag

SEQ ID NO: 113139 - DNA, 20 bp, Artificial Sequence
  chemically synthesized
gagacagtagtattgtgaat

SEQ ID NO: 113140 - DNA, 20 bp, Artificial Sequence
  chemically synthesized
agacagtagtattgtgaatg

SEQ ID NO: 113141 - DNA, 20 bp, Artificial Sequence
  chemically synthesized
agtagtattgtgaatgagga

SEQ ID NO: 113142 - DNA, 20 bp, Artificial Sequence
  chemically synthesized
gtagtattgtgaatgaggat

SEQ ID NO: 113143 - DNA, 20 bp, Artificial Sequence
  chemically synthesized
tagtattgtgaatgaggatg

SEQ ID NO: 113144 - DNA, 20 bp, Artificial Sequence
  chemically synthesized
gaatgaggatggggttttta

SEQ ID NO: 113145 - DNA, 20 bp, Artificial Sequence
  chemically synthesized
ggtttttatagtatcaatat

SEQ ID NO: 113146 - DNA, 20 bp, Artificial Sequence
  chemically synthesized
tagtatcaatatgagaataa

SEQ ID NO: 113147 - DNA, 20 bp, Artificial Sequence
  chemically synthesized
agtatcaatatgagaataaa

SEQ ID NO: 113148 - DNA, 20 bp, Artificial Sequence
  chemically synthesized
ttccttttcttatataaaca

SEQ ID NO: 113149 - DNA, 20 bp, Artificial Sequence
  chemically synthesized
gaaaatttccatgtttatat

SEQ ID NO: 113150 - DNA, 20 bp, Artificial Sequence
  chemically synthesized
tttccatgtttatataagaa

SEQ ID NO: 113151 - DNA, 20 bp, Artificial Sequence
  chemically synthesized
ttccatgtttatataagaaa

SEQ ID NO: 113152 - DNA, 20 bp, Artificial Sequence
  chemically synthesized
actcttttcaataagataat

SEQ ID NO: 113153 - DNA, 20 bp, Artificial Sequence
  chemically synthesized
gaactaattatcttattgaa

SEQ ID NO: 113154 - DNA, 20 bp, Artificial Sequence
  chemically synthesized
catgaaaaactcttttcaat

SEQ ID NO: 113155 - DNA, 20 bp, Artificial Sequence
  chemically synthesized
actaattatcttattgaaaa

SEQ ID NO: 113156 - DNA, 20 bp, Artificial Sequence
  chemically synthesized
aaaagagtttttcatgatct

SEQ ID NO: 113157 - DNA, 20 bp, Artificial Sequence
  chemically synthesized
agtctttgcataatgtatcc

SEQ ID NO: 113158 - DNA, 20 bp, Artificial Sequence
  chemically synthesized
gatcttggatacattatgca

SEQ ID NO: 113159 - DNA, 20 bp, Artificial Sequence
  chemically synthesized
ttatgtcatggaaaaagtaa

SEQ ID NO: 113160 - DNA, 20 bp, Artificial Sequence
  chemically synthesized
aaaaaattatgtcatggaaa

SEQ ID NO: 113161 - DNA, 20 bp, Artificial Sequence
  chemically synthesized
aaaaaaaaaaaattatgtca

SEQ ID NO: 113162 - DNA, 20 bp, Artificial Sequence
  chemically synthesized
aatttttttttttttttttt

SEQ ID NO: 113163 - DNA, 20 bp, Artificial Sequence
  chemically synthesized
ttttttttttttttttgaga

SEQ ID NO: 113164 - DNA, 20 bp, Artificial Sequence
  chemically synthesized
ttttttttttttttgagatg

SEQ ID NO: 113165 - DNA, 20 bp, Artificial Sequence
  chemically synthesized
tccagcctgggtgacacagt

SEQ ID NO: 113166 - DNA, 20 bp, Artificial Sequence
  chemically synthesized
tggagtctcactgtgtcacc

SEQ ID NO: 113167 - DNA, 20 bp, Artificial Sequence
  chemically synthesized
gcactccagcctgggtgaca

SEQ ID NO: 113168 - DNA, 20 bp, Artificial Sequence
  chemically synthesized
ggagtctcactgtgtcaccc

SEQ ID NO: 113169 - DNA, 20 bp, Artificial Sequence
  chemically synthesized
tctcactgtgtcacccaggc

SEQ ID NO: 113170 - DNA, 20 bp, Artificial Sequence
  chemically synthesized
tcactgtgtcacccaggctg

SEQ ID NO: 113171 - DNA, 20 bp, Artificial Sequence
  chemically synthesized
gtgccattgcactccagcct

SEQ ID NO: 113172 - DNA, 20 bp, Artificial Sequence
  chemically synthesized
cgtgccattgcactccagcc

SEQ ID NO: 113173 - DNA, 20 bp, Artificial Sequence
  chemically synthesized
gagatcgtgccattgcactc

SEQ ID NO: 113174 - DNA, 20 bp, Artificial Sequence
  chemically synthesized
tcacccaggctggagtgcaa

SEQ ID NO: 113175 - DNA, 20 bp, Artificial Sequence
  chemically synthesized
ggagtgcaatggcacgatct

SEQ ID NO: 113176 - DNA, 20 bp, Artificial Sequence
  chemically synthesized
ggcagaggatgcagtgagct

SEQ ID NO: 113177 - DNA, 20 bp, Artificial Sequence
  chemically synthesized
taggaggcagaggatgcagt

SEQ ID NO: 113178 - DNA, 20 bp, Artificial Sequence
  chemically synthesized
aacgtaggaggcagaggatg

SEQ ID NO: 113179 - DNA, 20 bp, Artificial Sequence
  chemically synthesized
cgcttgaacgtaggaggcag

SEQ ID NO: 113180 - DNA, 20 bp, Artificial Sequence
  chemically synthesized
tcgcttgaacgtaggaggca

SEQ ID NO: 113181 - DNA, 20 bp, Artificial Sequence
  chemically synthesized
aatcgcttgaacgtaggagg

SEQ ID NO: 113182 - DNA, 20 bp, Artificial Sequence
  chemically synthesized
gagaatcgcttgaacgtagg

SEQ ID NO: 113183 - DNA, 20 bp, Artificial Sequence
  chemically synthesized
ggagaatcgcttgaacgtag

SEQ ID NO: 113184 - DNA, 20 bp, Artificial Sequence
  chemically synthesized
atcctctgcctcctacgttc

SEQ ID NO: 113185 - DNA, 20 bp, Artificial Sequence
  chemically synthesized
caggagaatcgcttgaacgt

SEQ ID NO: 113186 - DNA, 20 bp, Artificial Sequence
  chemically synthesized
gcaggagaatcgcttgaacg

SEQ ID NO: 113187 - DNA, 20 bp, Artificial Sequence
  chemically synthesized
tactcgggaggcagaggcag

SEQ ID NO: 113188 - DNA, 20 bp, Artificial Sequence
  chemically synthesized
actactcgggaggcagaggc

SEQ ID NO: 113189 - DNA, 20 bp, Artificial Sequence
  chemically synthesized
aactactcgggaggcagagg

SEQ ID NO: 113190 - DNA, 20 bp, Artificial Sequence
  chemically synthesized
cccaactactcgggaggcag

SEQ ID NO: 113191 - DNA, 20 bp, Artificial Sequence
  chemically synthesized
tcccaactactcgggaggca

SEQ ID NO: 113192 - DNA, 20 bp, Artificial Sequence
  chemically synthesized
ttctcctgcctctgcctccc

SEQ ID NO: 113193 - DNA, 20 bp, Artificial Sequence
  chemically synthesized
aatcccaactactcgggagg

SEQ ID NO: 113194 - DNA, 20 bp, Artificial Sequence
  chemically synthesized
tcctgcctctgcctcccgag

SEQ ID NO: 113195 - DNA, 20 bp, Artificial Sequence
  chemically synthesized
tgtaatcccaactactcggg

SEQ ID NO: 113196 - DNA, 20 bp, Artificial Sequence
  chemically synthesized
ctgtaatcccaactactcgg

SEQ ID NO: 113197 - DNA, 20 bp, Artificial Sequence
  chemically synthesized
gcctctgcctcccgagtagt

SEQ ID NO: 113198 - DNA, 20 bp, Artificial Sequence
  chemically synthesized
gcctgtaatcccaactactc

SEQ ID NO: 113199 - DNA, 20 bp, Artificial Sequence
  chemically synthesized
cctctgcctcccgagtagtt

SEQ ID NO: 113200 - DNA, 20 bp, Artificial Sequence
  chemically synthesized
cgcctgtaatcccaactact

SEQ ID NO: 113201 - DNA, 20 bp, Artificial Sequence
  chemically synthesized
ctcccgagtagttgggatta

SEQ ID NO: 113202 - DNA, 20 bp, Artificial Sequence
  chemically synthesized
tcccgagtagttgggattac

SEQ ID NO: 113203 - DNA, 20 bp, Artificial Sequence
  chemically synthesized
caggcgtgtgccaccacacc

SEQ ID NO: 113204 - DNA, 20 bp, Artificial Sequence
  chemically synthesized
caaaaattagccaggtgtgg

SEQ ID NO: 113205 - DNA, 20 bp, Artificial Sequence
  chemically synthesized
atacaaaaattagccaggtg

SEQ ID NO: 113206 - DNA, 20 bp, Artificial Sequence
  chemically synthesized
taaaaatacaaaaattagcc

SEQ ID NO: 113207 - DNA, 20 bp, Artificial Sequence
  chemically synthesized
ctaaaaatacaaaaattagc

SEQ ID NO: 113208 - DNA, 20 bp, Artificial Sequence
  chemically synthesized
tctactaaaaatacaaaaat

SEQ ID NO: 113209 - DNA, 20 bp, Artificial Sequence
  chemically synthesized
ctggctaatttttgtatttt

SEQ ID NO: 113210 - DNA, 20 bp, Artificial Sequence
  chemically synthesized
gctaatttttgtatttttag

SEQ ID NO: 113211 - DNA, 20 bp, Artificial Sequence
  chemically synthesized
taatttttgtatttttagta

SEQ ID NO: 113212 - DNA, 20 bp, Artificial Sequence
  chemically synthesized
ttttgtatttttagtagaga

SEQ ID NO: 113213 - DNA, 20 bp, Artificial Sequence
  chemically synthesized
tttgtatttttagtagagac

SEQ ID NO: 113214 - DNA, 20 bp, Artificial Sequence
  chemically synthesized
ttgtatttttagtagagacg

SEQ ID NO: 113215 - DNA, 20 bp, Artificial Sequence
  chemically synthesized
gagacggggtttcgccatgt

SEQ ID NO: 113216 - DNA, 20 bp, Artificial Sequence
  chemically synthesized
cggggtttcgccatgttggt

SEQ ID NO: 113217 - DNA, 20 bp, Artificial Sequence
  chemically synthesized
cgagaccagcctgaccaaca

SEQ ID NO: 113218 - DNA, 20 bp, Artificial Sequence
  chemically synthesized
ggggtttcgccatgttggtc

SEQ ID NO: 113219 - DNA, 20 bp, Artificial Sequence
  chemically synthesized
tttcgccatgttggtcaggc

SEQ ID NO: 113220 - DNA, 20 bp, Artificial Sequence
  chemically synthesized
tgaggtcgggagttcgagac

SEQ ID NO: 113221 - DNA, 20 bp, Artificial Sequence
  chemically synthesized
tcacctgaggtcgggagttc

SEQ ID NO: 113222 - DNA, 20 bp, Artificial Sequence
  chemically synthesized
tggtctcgaactcccgacct

SEQ ID NO: 113223 - DNA, 20 bp, Artificial Sequence
  chemically synthesized
ggcagatcacctgaggtcgg

SEQ ID NO: 113224 - DNA, 20 bp, Artificial Sequence
  chemically synthesized
ggtctcgaactcccgacctc

SEQ ID NO: 113225 - DNA, 20 bp, Artificial Sequence
  chemically synthesized
tgggcagatcacctgaggtc

SEQ ID NO: 113226 - DNA, 20 bp, Artificial Sequence
  chemically synthesized
gtgggcagatcacctgaggt

SEQ ID NO: 113227 - DNA, 20 bp, Artificial Sequence
  chemically synthesized
tgaggtgggcagatcacctg

SEQ ID NO: 113228 - DNA, 20 bp, Artificial Sequence
  chemically synthesized
ctgaggtgggcagatcacct

SEQ ID NO: 113229 - DNA, 20 bp, Artificial Sequence
  chemically synthesized
ctcaggtgatctgcccacct

SEQ ID NO: 113230 - DNA, 20 bp, Artificial Sequence
  chemically synthesized
ctttgggaggctgaggtggg

SEQ ID NO: 113231 - DNA, 20 bp, Artificial Sequence
  chemically synthesized
gcactttgggaggctgaggt

SEQ ID NO: 113232 - DNA, 20 bp, Artificial Sequence
  chemically synthesized
agcactttgggaggctgagg

SEQ ID NO: 113233 - DNA, 20 bp, Artificial Sequence
  chemically synthesized
cccagcactttgggaggctg

SEQ ID NO: 113234 - DNA, 20 bp, Artificial Sequence
  chemically synthesized
tcccagcactttgggaggct

SEQ ID NO: 113235 - DNA, 20 bp, Artificial Sequence
  chemically synthesized
ctgcccacctcagcctccca

SEQ ID NO: 113236 - DNA, 20 bp, Artificial Sequence
  chemically synthesized
tataatcccagcactttggg

SEQ ID NO: 113237 - DNA, 20 bp, Artificial Sequence
  chemically synthesized
atataatcccagcactttgg

SEQ ID NO: 113238 - DNA, 20 bp, Artificial Sequence
  chemically synthesized
acctcagcctcccaaagtgc

SEQ ID NO: 113239 - DNA, 20 bp, Artificial Sequence
  chemically synthesized
gcatataatcccagcacttt

SEQ ID NO: 113240 - DNA, 20 bp, Artificial Sequence
  chemically synthesized
cctcagcctcccaaagtgct

SEQ ID NO: 113241 - DNA, 20 bp, Artificial Sequence
  chemically synthesized
tgcatataatcccagcactt

SEQ ID NO: 113242 - DNA, 20 bp, Artificial Sequence
  chemically synthesized
gtggctcatgcatataatcc

SEQ ID NO: 113243 - DNA, 20 bp, Artificial Sequence
  chemically synthesized
agtgctgggattatatgcat

SEQ ID NO: 113244 - DNA, 20 bp, Artificial Sequence
  chemically synthesized
tatgcatgagccaccacgcc

SEQ ID NO: 113245 - DNA, 20 bp, Artificial Sequence
  chemically synthesized
atatcatgggccaggcgtgg

SEQ ID NO: 113246 - DNA, 20 bp, Artificial Sequence
  chemically synthesized
ttcatatcatgggccaggcg

SEQ ID NO: 113247 - DNA, 20 bp, Artificial Sequence
  chemically synthesized
taaaattcatatcatgggcc

SEQ ID NO: 113248 - DNA, 20 bp, Artificial Sequence
  chemically synthesized
ataaaattcatatcatgggc

SEQ ID NO: 113249 - DNA, 20 bp, Artificial Sequence
  chemically synthesized
tggcataaaattcatatcat

SEQ ID NO: 113250 - DNA, 20 bp, Artificial Sequence
  chemically synthesized
ttggcataaaattcatatca

SEQ ID NO: 113251 - DNA, 20 bp, Artificial Sequence
  chemically synthesized
atgatatgaattttatgcca

SEQ ID NO: 113252 - DNA, 20 bp, Artificial Sequence
  chemically synthesized
gcaaagaattagcaaagctt

SEQ ID NO: 113253 - DNA, 20 bp, Artificial Sequence
  chemically synthesized
aaaaaggcaaagaattagca

SEQ ID NO: 113254 - DNA, 20 bp, Artificial Sequence
  chemically synthesized
ttgtgaaaaaggcaaagaat

SEQ ID NO: 113255 - DNA, 20 bp, Artificial Sequence
  chemically synthesized
aactaattgtgaaaaaggca

SEQ ID NO: 113256 - DNA, 20 bp, Artificial Sequence
  chemically synthesized
taataaactaattgtgaaaa

SEQ ID NO: 113257 - DNA, 20 bp, Artificial Sequence
  chemically synthesized
ttaataaactaattgtgaaa

SEQ ID NO: 113258 - DNA, 20 bp, Artificial Sequence
  chemically synthesized
ttctttgcctttttcacaat

SEQ ID NO: 113259 - DNA, 20 bp, Artificial Sequence
  chemically synthesized
tttttcacaattagtttatt

SEQ ID NO: 113260 - DNA, 20 bp, Artificial Sequence
  chemically synthesized
tttcacaattagtttattaa

SEQ ID NO: 113261 - DNA, 20 bp, Artificial Sequence
  chemically synthesized
ttcacaattagtttattaag

SEQ ID NO: 113262 - DNA, 20 bp, Artificial Sequence
  chemically synthesized
tcacaattagtttattaaga

SEQ ID NO: 113263 - DNA, 20 bp, Artificial Sequence
  chemically synthesized
tattcaaaaagacagttata

SEQ ID NO: 113264 - DNA, 20 bp, Artificial Sequence
  chemically synthesized
ttattcaaaaagacagttat

SEQ ID NO: 113265 - DNA, 20 bp, Artificial Sequence
  chemically synthesized
gttattcaaaaagacagtta

SEQ ID NO: 113266 - DNA, 20 bp, Artificial Sequence
  chemically synthesized
gtccatgttattcaaaaaga

SEQ ID NO: 113267 - DNA, 20 bp, Artificial Sequence
  chemically synthesized
tattgtccatgttattcaaa

SEQ ID NO: 113268 - DNA, 20 bp, Artificial Sequence
  chemically synthesized
aactgtctttttgaataaca

SEQ ID NO: 113269 - DNA, 20 bp, Artificial Sequence
  chemically synthesized
tttttgaataacatggacaa

SEQ ID NO: 113270 - DNA, 20 bp, Artificial Sequence
  chemically synthesized
tgtagtacagaattggtatt

SEQ ID NO: 113271 - DNA, 20 bp, Artificial Sequence
  chemically synthesized
tacttactgtagtacagaat

SEQ ID NO: 113272 - DNA, 20 bp, Artificial Sequence
  chemically synthesized
ttaataccaattctgtacta

SEQ ID NO: 113273 - DNA, 20 bp, Artificial Sequence
  chemically synthesized
aaatgttacttactgtagta

SEQ ID NO: 113274 - DNA, 20 bp, Artificial Sequence
  chemically synthesized
taccaattctgtactacagt

SEQ ID NO: 113275 - DNA, 20 bp, Artificial Sequence
  chemically synthesized
caccaaaatgttacttactg

SEQ ID NO: 113276 - DNA, 20 bp, Artificial Sequence
  chemically synthesized
tactacagtaagtaacattt

SEQ ID NO: 113277 - DNA, 20 bp, Artificial Sequence
  chemically synthesized
agtaacattttggtgacatt

SEQ ID NO: 113278 - DNA, 20 bp, Artificial Sequence
  chemically synthesized
tgacatttagatatatttct

SEQ ID NO: 113279 - DNA, 20 bp, Artificial Sequence
  chemically synthesized
catttagatatatttctgag

SEQ ID NO: 113280 - DNA, 20 bp, Artificial Sequence
  chemically synthesized
gaatttctccatggtccact

SEQ ID NO: 113281 - DNA, 20 bp, Artificial Sequence
  chemically synthesized
atatatttctgagtggacca

SEQ ID NO: 113282 - DNA, 20 bp, Artificial Sequence
  chemically synthesized
atatttctgagtggaccatg

SEQ ID NO: 113283 - DNA, 20 bp, Artificial Sequence
  chemically synthesized
tcgttatttgaatttctcca

SEQ ID NO: 113284 - DNA, 20 bp, Artificial Sequence
  chemically synthesized
tgtaatataatttatttcta

SEQ ID NO: 113285 - DNA, 20 bp, Artificial Sequence
  chemically synthesized
ggacatcaacatggaagcca

SEQ ID NO: 113286 - DNA, 20 bp, Artificial Sequence
  chemically synthesized
attgaaggacatcaacatgg

SEQ ID NO: 113287 - DNA, 20 bp, Artificial Sequence
  chemically synthesized
aaaattgaaggacatcaaca

SEQ ID NO: 113288 - DNA, 20 bp, Artificial Sequence
  chemically synthesized
ggttaaagatttaaaattga

SEQ ID NO: 113289 - DNA, 20 bp, Artificial Sequence
  chemically synthesized
gggttaaagatttaaaattg

SEQ ID NO: 113290 - DNA, 20 bp, Artificial Sequence
  chemically synthesized
tcaattttaaatctttaacc

SEQ ID NO: 113291 - DNA, 20 bp, Artificial Sequence
  chemically synthesized
ttggaaaaagatctgggtta

SEQ ID NO: 113292 - DNA, 20 bp, Artificial Sequence
  chemically synthesized
taaggtttggaaaaagatct

SEQ ID NO: 113293 - DNA, 20 bp, Artificial Sequence
  chemically synthesized
ctaaggtttggaaaaagatc

SEQ ID NO: 113294 - DNA, 20 bp, Artificial Sequence
  chemically synthesized
gtaaatctaaggtttggaaa

SEQ ID NO: 113295 - DNA, 20 bp, Artificial Sequence
  chemically synthesized
ccagatctttttccaaacct

SEQ ID NO: 113296 - DNA, 20 bp, Artificial Sequence
  chemically synthesized
gtgaatgtaaatctaaggtt

SEQ ID NO: 113297 - DNA, 20 bp, Artificial Sequence
  chemically synthesized
cagttgtgaatgtaaatcta

SEQ ID NO: 113298 - DNA, 20 bp, Artificial Sequence
  chemically synthesized
gcagttgtgaatgtaaatct

SEQ ID NO: 113299 - DNA, 20 bp, Artificial Sequence
  chemically synthesized
tttacattcacaactgcttc

SEQ ID NO: 113300 - DNA, 20 bp, Artificial Sequence
  chemically synthesized
tacattcacaactgcttcaa

SEQ ID NO: 113301 - DNA, 20 bp, Artificial Sequence
  chemically synthesized
aaaccttacctctcttgaag

SEQ ID NO: 113302 - DNA, 20 bp, Artificial Sequence
  chemically synthesized
cattcacaactgcttcaaga

SEQ ID NO: 113303 - DNA, 20 bp, Artificial Sequence
  chemically synthesized
attcacaactgcttcaagag

SEQ ID NO: 113304 - DNA, 20 bp, Artificial Sequence
  chemically synthesized
tgaaaaccttacctctcttg

SEQ ID NO: 113305 - DNA, 20 bp, Artificial Sequence
  chemically synthesized
acaactgcttcaagagaggt

SEQ ID NO: 113306 - DNA, 20 bp, Artificial Sequence
  chemically synthesized
caactgcttcaagagaggta

SEQ ID NO: 113307 - DNA, 20 bp, Artificial Sequence
  chemically synthesized
atctgtaagtgaaaaatcag

SEQ ID NO: 113308 - DNA, 20 bp, Artificial Sequence
  chemically synthesized
tatctgtaagtgaaaaatca

SEQ ID NO: 113309 - DNA, 20 bp, Artificial Sequence
  chemically synthesized
ggtatctgtaagtgaaaaat

SEQ ID NO: 113310 - DNA, 20 bp, Artificial Sequence
  chemically synthesized
cacctctgatttttcactta

SEQ ID NO: 113311 - DNA, 20 bp, Artificial Sequence
  chemically synthesized
tttgattttgaggtatctgt

SEQ ID NO: 113312 - DNA, 20 bp, Artificial Sequence
  chemically synthesized
caagaacgtgtttgattttg

SEQ ID NO: 113313 - DNA, 20 bp, Artificial Sequence
  chemically synthesized
tcaagaacgtgtttgatttt

SEQ ID NO: 113314 - DNA, 20 bp, Artificial Sequence
  chemically synthesized
cagttgtgaggagcaaagtc

SEQ ID NO: 113315 - DNA, 20 bp, Artificial Sequence
  chemically synthesized
gcaaacagttgtgaggagca

SEQ ID NO: 113316 - DNA, 20 bp, Artificial Sequence
  chemically synthesized
agatggcaaacagttgtgag

SEQ ID NO: 113317 - DNA, 20 bp, Artificial Sequence
  chemically synthesized
caagatggcaaacagttgtg

SEQ ID NO: 113318 - DNA, 20 bp, Artificial Sequence
  chemically synthesized
tcaagatggcaaacagttgt

SEQ ID NO: 113319 - DNA, 20 bp, Artificial Sequence
  chemically synthesized
gcagaattcaagatggcaaa

SEQ ID NO: 113320 - DNA, 20 bp, Artificial Sequence
  chemically synthesized
atgagttgcagaattcaaga

SEQ ID NO: 113321 - DNA, 20 bp, Artificial Sequence
  chemically synthesized
aatcatgagttgcagaattc

SEQ ID NO: 113322 - DNA, 20 bp, Artificial Sequence
  chemically synthesized
cttcactcaatcatgagttg

SEQ ID NO: 113323 - DNA, 20 bp, Artificial Sequence
  chemically synthesized
gaattctgcaactcatgatt

SEQ ID NO: 113324 - DNA, 20 bp, Artificial Sequence
  chemically synthesized
tagtgtcttcactcaatcat

SEQ ID NO: 113325 - DNA, 20 bp, Artificial Sequence
  chemically synthesized
ctgcaactcatgattgagtg

SEQ ID NO: 113326 - DNA, 20 bp, Artificial Sequence
  chemically synthesized
ttgagtgaagacactacctt

SEQ ID NO: 113327 - DNA, 20 bp, Artificial Sequence
  chemically synthesized
ttggcatgattgactgaagg

SEQ ID NO: 113328 - DNA, 20 bp, Artificial Sequence
  chemically synthesized
cacttggcatgattgactga

SEQ ID NO: 113329 - DNA, 20 bp, Artificial Sequence
  chemically synthesized
ccacttggcatgattgactg

SEQ ID NO: 113330 - DNA, 20 bp, Artificial Sequence
  chemically synthesized
taccttcagtcaatcatgcc

SEQ ID NO: 113331 - DNA, 20 bp, Artificial Sequence
  chemically synthesized
cttcagtcaatcatgccaag

SEQ ID NO: 113332 - DNA, 20 bp, Artificial Sequence
  chemically synthesized
agtcaatcatgccaagtggt

SEQ ID NO: 113333 - DNA, 20 bp, Artificial Sequence
  chemically synthesized
atcagtgcctgcttaccact

SEQ ID NO: 113334 - DNA, 20 bp, Artificial Sequence
  chemically synthesized
caatcatgccaagtggtaag

SEQ ID NO: 113335 - DNA, 20 bp, Artificial Sequence
  chemically synthesized
aatcatgccaagtggtaagc

SEQ ID NO: 113336 - DNA, 20 bp, Artificial Sequence
  chemically synthesized
tgtgaggtaaaatgagaaat

SEQ ID NO: 113337 - DNA, 20 bp, Artificial Sequence
  chemically synthesized
cagaaaatgtgaggtaaaat

SEQ ID NO: 113338 - DNA, 20 bp, Artificial Sequence
  chemically synthesized
ggaggtgagcagaaaatgtg

SEQ ID NO: 113339 - DNA, 20 bp, Artificial Sequence
  chemically synthesized
tggaggtgagcagaaaatgt

SEQ ID NO: 113340 - DNA, 20 bp, Artificial Sequence
  chemically synthesized
ttgtgggaggtggaggtgag

SEQ ID NO: 113341 - DNA, 20 bp, Artificial Sequence
  chemically synthesized
gttttgtgggaggtggaggt

SEQ ID NO: 113342 - DNA, 20 bp, Artificial Sequence
  chemically synthesized
atatgttttgtgggaggtgg

SEQ ID NO: 113343 - DNA, 20 bp, Artificial Sequence
  chemically synthesized
catatgttttgtgggaggtg

SEQ ID NO: 113344 - DNA, 20 bp, Artificial Sequence
  chemically synthesized
gtcatatgttttgtgggagg

SEQ ID NO: 113345 - DNA, 20 bp, Artificial Sequence
  chemically synthesized
actgtcatatgttttgtggg

SEQ ID NO: 113346 - DNA, 20 bp, Artificial Sequence
  chemically synthesized
cactgtcatatgttttgtgg

SEQ ID NO: 113347 - DNA, 20 bp, Artificial Sequence
  chemically synthesized
aacactgtcatatgttttgt

SEQ ID NO: 113348 - DNA, 20 bp, Artificial Sequence
  chemically synthesized
caacactgtcatatgttttg

SEQ ID NO: 113349 - DNA, 20 bp, Artificial Sequence
  chemically synthesized
acctcccacaaaacatatga

SEQ ID NO: 113350 - DNA, 20 bp, Artificial Sequence
  chemically synthesized
gtgttgattttatctccaaa

SEQ ID NO: 113351 - DNA, 20 bp, Artificial Sequence
  chemically synthesized
acagatacgtgagctatttg

SEQ ID NO: 113352 - DNA, 20 bp, Artificial Sequence
  chemically synthesized
aaacagatacgtgagctatt

SEQ ID NO: 113353 - DNA, 20 bp, Artificial Sequence
  chemically synthesized
aacaaacaaaacagatacgt

SEQ ID NO: 113354 - DNA, 20 bp, Artificial Sequence
  chemically synthesized
gtgaggttgaacaaacaaaa

SEQ ID NO: 113355 - DNA, 20 bp, Artificial Sequence
  chemically synthesized
aattgatgatcaaagtggtg

SEQ ID NO: 113356 - DNA, 20 bp, Artificial Sequence
  chemically synthesized
gaattgatgatcaaagtggt

SEQ ID NO: 113357 - DNA, 20 bp, Artificial Sequence
  chemically synthesized
gcaagaattgatgatcaaag

SEQ ID NO: 113358 - DNA, 20 bp, Artificial Sequence
  chemically synthesized
caagcaagaattgatgatca

SEQ ID NO: 113359 - DNA, 20 bp, Artificial Sequence
  chemically synthesized
tttgatcatcaattcttgct

SEQ ID NO: 113360 - DNA, 20 bp, Artificial Sequence
  chemically synthesized
atttctgtaataagccaagc

SEQ ID NO: 113361 - DNA, 20 bp, Artificial Sequence
  chemically synthesized
cattatttctgtaataagcc

SEQ ID NO: 113362 - DNA, 20 bp, Artificial Sequence
  chemically synthesized
aattcttgcttggcttatta

SEQ ID NO: 113363 - DNA, 20 bp, Artificial Sequence
  chemically synthesized
taggacattatttctgtaat

SEQ ID NO: 113364 - DNA, 20 bp, Artificial Sequence
  chemically synthesized
cccatgcagggacaacagtt

SEQ ID NO: 113365 - DNA, 20 bp, Artificial Sequence
  chemically synthesized
acccatgcagggacaacagt

SEQ ID NO: 113366 - DNA, 20 bp, Artificial Sequence
  chemically synthesized
tgagacccatgcagggacaa

SEQ ID NO: 113367 - DNA, 20 bp, Artificial Sequence
  chemically synthesized
tcctaactgttgtccctgca

SEQ ID NO: 113368 - DNA, 20 bp, Artificial Sequence
  chemically synthesized
cctaactgttgtccctgcat

SEQ ID NO: 113369 - DNA, 20 bp, Artificial Sequence
  chemically synthesized
aaagatatgagacccatgca

SEQ ID NO: 113370 - DNA, 20 bp, Artificial Sequence
  chemically synthesized
gaaagatatgagacccatgc

SEQ ID NO: 113371 - DNA, 20 bp, Artificial Sequence
  chemically synthesized
ggaaagatatgagacccatg

SEQ ID NO: 113372 - DNA, 20 bp, Artificial Sequence
  chemically synthesized
agaatgaattggaaagatat

SEQ ID NO: 113373 - DNA, 20 bp, Artificial Sequence
  chemically synthesized
ggttaggagaatgaattgga

SEQ ID NO: 113374 - DNA, 20 bp, Artificial Sequence
  chemically synthesized
tagtggttaggagaatgaat

SEQ ID NO: 113375 - DNA, 20 bp, Artificial Sequence
  chemically synthesized
atcattctggtagtggttag

SEQ ID NO: 113376 - DNA, 20 bp, Artificial Sequence
  chemically synthesized
agatcattctggtagtggtt

SEQ ID NO: 113377 - DNA, 20 bp, Artificial Sequence
  chemically synthesized
aagatcattctggtagtggt

SEQ ID NO: 113378 - DNA, 20 bp, Artificial Sequence
  chemically synthesized
ttcattctcctaaccactac

SEQ ID NO: 113379 - DNA, 20 bp, Artificial Sequence
  chemically synthesized
ttaaaagatcattctggtag

SEQ ID NO: 113380 - DNA, 20 bp, Artificial Sequence
  chemically synthesized
tttttaaaagatcattctgg

SEQ ID NO: 113381 - DNA, 20 bp, Artificial Sequence
  chemically synthesized
atgtttttaaaagatcattc

SEQ ID NO: 113382 - DNA, 20 bp, Artificial Sequence
  chemically synthesized
ctaatcagacatgtttttaa

SEQ ID NO: 113383 - DNA, 20 bp, Artificial Sequence
  chemically synthesized
cttttaaaaacatgtctgat

SEQ ID NO: 113384 - DNA, 20 bp, Artificial Sequence
  chemically synthesized
aagcaaggaaatggactaat

SEQ ID NO: 113385 - DNA, 20 bp, Artificial Sequence
  chemically synthesized
cctagttctaagcaaggaaa

SEQ ID NO: 113386 - DNA, 20 bp, Artificial Sequence
  chemically synthesized
gattagtccatttccttgct

SEQ ID NO: 113387 - DNA, 20 bp, Artificial Sequence
  chemically synthesized
tcatagcctagttctaagca

SEQ ID NO: 113388 - DNA, 20 bp, Artificial Sequence
  chemically synthesized
gtcatagcctagttctaagc

SEQ ID NO: 113389 - DNA, 20 bp, Artificial Sequence
  chemically synthesized
tccatttccttgcttagaac

SEQ ID NO: 113390 - DNA, 20 bp, Artificial Sequence
  chemically synthesized
ccatttccttgcttagaact

SEQ ID NO: 113391 - DNA, 20 bp, Artificial Sequence
  chemically synthesized
ttaagtcatagcctagttct

SEQ ID NO: 113392 - DNA, 20 bp, Artificial Sequence
  chemically synthesized
tatcactttaagtcatagcc

SEQ ID NO: 113393 - DNA, 20 bp, Artificial Sequence
  chemically synthesized
tagaactaggctatgactta

SEQ ID NO: 113394 - DNA, 20 bp, Artificial Sequence
  chemically synthesized
acttttatcactttaagtca

SEQ ID NO: 113395 - DNA, 20 bp, Artificial Sequence
  chemically synthesized
ctctggacttttatcacttt

SEQ ID NO: 113396 - DNA, 20 bp, Artificial Sequence
  chemically synthesized
gctatgacttaaagtgataa

SEQ ID NO: 113397 - DNA, 20 bp, Artificial Sequence
  chemically synthesized
gacttaaagtgataaaagtc

SEQ ID NO: 113398 - DNA, 20 bp, Artificial Sequence
  chemically synthesized
cttaaagtgataaaagtcca

SEQ ID NO: 113399 - DNA, 20 bp, Artificial Sequence
  chemically synthesized
gccacctatttttcagactc

SEQ ID NO: 113400 - DNA, 20 bp, Artificial Sequence
  chemically synthesized
aaagtccagagtctgaaaaa

SEQ ID NO: 113401 - DNA, 20 bp, Artificial Sequence
  chemically synthesized
aagtccagagtctgaaaaat

SEQ ID NO: 113402 - DNA, 20 bp, Artificial Sequence
  chemically synthesized
gccccttgccacctattttt

SEQ ID NO: 113403 - DNA, 20 bp, Artificial Sequence
  chemically synthesized
tccagagtctgaaaaatagg

SEQ ID NO: 113404 - DNA, 20 bp, Artificial Sequence
  chemically synthesized
gagtctgaaaaataggtggc

SEQ ID NO: 113405 - DNA, 20 bp, Artificial Sequence
  chemically synthesized
agtctgaaaaataggtggca

SEQ ID NO: 113406 - DNA, 20 bp, Artificial Sequence
  chemically synthesized
gtctgaaaaataggtggcaa

SEQ ID NO: 113407 - DNA, 20 bp, Artificial Sequence
  chemically synthesized
tctgaaaaataggtggcaag

SEQ ID NO: 113408 - DNA, 20 bp, Artificial Sequence
  chemically synthesized
gaaaaataggtggcaagggg

SEQ ID NO: 113409 - DNA, 20 bp, Artificial Sequence
  chemically synthesized
aaaataggtggcaaggggca

SEQ ID NO: 113410 - DNA, 20 bp, Artificial Sequence
  chemically synthesized
aataggtggcaaggggcaga

SEQ ID NO: 113411 - DNA, 20 bp, Artificial Sequence
  chemically synthesized
taggtggcaaggggcagaga

SEQ ID NO: 113412 - DNA, 20 bp, Artificial Sequence
  chemically synthesized
tggcaaggggcagagagagc

SEQ ID NO: 113413 - DNA, 20 bp, Artificial Sequence
  chemically synthesized
agggctcagtaagtgtaagc

SEQ ID NO: 113414 - DNA, 20 bp, Artificial Sequence
  chemically synthesized
tcgaagggctcagtaagtgt

SEQ ID NO: 113415 - DNA, 20 bp, Artificial Sequence
  chemically synthesized
agagccagcttacacttact

SEQ ID NO: 113416 - DNA, 20 bp, Artificial Sequence
  chemically synthesized
ttggactcgaagggctcagt

SEQ ID NO: 113417 - DNA, 20 bp, Artificial Sequence
  chemically synthesized
actattggactcgaagggct

SEQ ID NO: 113418 - DNA, 20 bp, Artificial Sequence
  chemically synthesized
ttacacttactgagcccttc

SEQ ID NO: 113419 - DNA, 20 bp, Artificial Sequence
  chemically synthesized
ggcagactattggactcgaa

SEQ ID NO: 113420 - DNA, 20 bp, Artificial Sequence
  chemically synthesized
aggcagactattggactcga

SEQ ID NO: 113421 - DNA, 20 bp, Artificial Sequence
  chemically synthesized
gaggcagactattggactcg

SEQ ID NO: 113422 - DNA, 20 bp, Artificial Sequence
  chemically synthesized
actgagcccttcgagtccaa

SEQ ID NO: 113423 - DNA, 20 bp, Artificial Sequence
  chemically synthesized
ataccagagaggcagactat

SEQ ID NO: 113424 - DNA, 20 bp, Artificial Sequence
  chemically synthesized
agtccaatagtctgcctctc

SEQ ID NO: 113425 - DNA, 20 bp, Artificial Sequence
  chemically synthesized
taaaatgcataccagagagg

SEQ ID NO: 113426 - DNA, 20 bp, Artificial Sequence
  chemically synthesized
atgtaaaatgcataccagag

SEQ ID NO: 113427 - DNA, 20 bp, Artificial Sequence
  chemically synthesized
tatgtaaaatgcataccaga

SEQ ID NO: 113428 - DNA, 20 bp, Artificial Sequence
  chemically synthesized
tatatgtaaaatgcatacca

SEQ ID NO: 113429 - DNA, 20 bp, Artificial Sequence
  chemically synthesized
gatatatgtaaaatgcatac

SEQ ID NO: 113430 - DNA, 20 bp, Artificial Sequence
  chemically synthesized
ttttatcaggtttaaatgat

SEQ ID NO: 113431 - DNA, 20 bp, Artificial Sequence
  chemically synthesized
gtacatcacaggattttatc

SEQ ID NO: 113432 - DNA, 20 bp, Artificial Sequence
  chemically synthesized
agtacatcacaggattttat

SEQ ID NO: 113433 - DNA, 20 bp, Artificial Sequence
  chemically synthesized
ctatacaatgagtacatcac

SEQ ID NO: 113434 - DNA, 20 bp, Artificial Sequence
  chemically synthesized
tctatacaatgagtacatca

SEQ ID NO: 113435 - DNA, 20 bp, Artificial Sequence
  chemically synthesized
cctgtgatgtactcattgta

SEQ ID NO: 113436 - DNA, 20 bp, Artificial Sequence
  chemically synthesized
attttactcttctatacaat

SEQ ID NO: 113437 - DNA, 20 bp, Artificial Sequence
  chemically synthesized
gtgatgtactcattgtatag

SEQ ID NO: 113438 - DNA, 20 bp, Artificial Sequence
  chemically synthesized
gatgtactcattgtatagaa

SEQ ID NO: 113439 - DNA, 20 bp, Artificial Sequence
  chemically synthesized
attgtatagaagagtaaaat

SEQ ID NO: 113440 - DNA, 20 bp, Artificial Sequence
  chemically synthesized
ttgtatagaagagtaaaatt

SEQ ID NO: 113441 - DNA, 20 bp, Artificial Sequence
  chemically synthesized
agaagagtaaaattgggact

SEQ ID NO: 113442 - DNA, 20 bp, Artificial Sequence
  chemically synthesized
aagagtaaaattgggactca

SEQ ID NO: 113443 - DNA, 20 bp, Artificial Sequence
  chemically synthesized
agagtaaaattgggactcag

SEQ ID NO: 113444 - DNA, 20 bp, Artificial Sequence
  chemically synthesized
taaaattgggactcagaggt

SEQ ID NO: 113445 - DNA, 20 bp, Artificial Sequence
  chemically synthesized
tagcttattgtctgacctct

SEQ ID NO: 113446 - DNA, 20 bp, Artificial Sequence
  chemically synthesized
ggactcagaggtcagacaat

SEQ ID NO: 113447 - DNA, 20 bp, Artificial Sequence
  chemically synthesized
tcagaggtcagacaataagc

SEQ ID NO: 113448 - DNA, 20 bp, Artificial Sequence
  chemically synthesized
aggtcagacaataagctagt

SEQ ID NO: 113449 - DNA, 20 bp, Artificial Sequence
  chemically synthesized
accccttatttagcacttac

SEQ ID NO: 113450 - DNA, 20 bp, Artificial Sequence
  chemically synthesized
taagctagtaagtgctaaat

SEQ ID NO: 113451 - DNA, 20 bp, Artificial Sequence
  chemically synthesized
aagctagtaagtgctaaata

SEQ ID NO: 113452 - DNA, 20 bp, Artificial Sequence
  chemically synthesized
agctagtaagtgctaaataa

SEQ ID NO: 113453 - DNA, 20 bp, Artificial Sequence
  chemically synthesized
gctagtaagtgctaaataag

SEQ ID NO: 113454 - DNA, 20 bp, Artificial Sequence
  chemically synthesized
aagcaggaagaccccttatt

SEQ ID NO: 113455 - DNA, 20 bp, Artificial Sequence
  chemically synthesized
gtatggaccttgtaagcagg

SEQ ID NO: 113456 - DNA, 20 bp, Artificial Sequence
  chemically synthesized
taaggggtcttcctgcttac

SEQ ID NO: 113457 - DNA, 20 bp, Artificial Sequence
  chemically synthesized
aaggggtcttcctgcttaca

SEQ ID NO: 113458 - DNA, 20 bp, Artificial Sequence
  chemically synthesized
agagtatggaccttgtaagc

SEQ ID NO: 113459 - DNA, 20 bp, Artificial Sequence
  chemically synthesized
tagagtatggaccttgtaag

SEQ ID NO: 113460 - DNA, 20 bp, Artificial Sequence
  chemically synthesized
agctagagtatggaccttgt

SEQ ID NO: 113461 - DNA, 20 bp, Artificial Sequence
  chemically synthesized
tgcttacaaggtccatactc

SEQ ID NO: 113462 - DNA, 20 bp, Artificial Sequence
  chemically synthesized
atgatgtagcagctagagta

SEQ ID NO: 113463 - DNA, 20 bp, Artificial Sequence
  chemically synthesized
acagcatgatgtagcagcta

SEQ ID NO: 113464 - DNA, 20 bp, Artificial Sequence
  chemically synthesized
agacagcatgatgtagcagc

SEQ ID NO: 113465 - DNA, 20 bp, Artificial Sequence
  chemically synthesized
ggaaagacagcatgatgtag

SEQ ID NO: 113466 - DNA, 20 bp, Artificial Sequence
  chemically synthesized
tgtggaaagacagcatgatg

SEQ ID NO: 113467 - DNA, 20 bp, Artificial Sequence
  chemically synthesized
ggctaaattatgtggaaaga

SEQ ID NO: 113468 - DNA, 20 bp, Artificial Sequence
  chemically synthesized
ctggggctaaattatgtgga

SEQ ID NO: 113469 - DNA, 20 bp, Artificial Sequence
  chemically synthesized
tgctgtctttccacataatt

SEQ ID NO: 113470 - DNA, 20 bp, Artificial Sequence
  chemically synthesized
tcaactggggctaaattatg

SEQ ID NO: 113471 - DNA, 20 bp, Artificial Sequence
  chemically synthesized
ctttccacataatttagccc

SEQ ID NO: 113472 - DNA, 20 bp, Artificial Sequence
  chemically synthesized
aaatgaaattagatcaactg

SEQ ID NO: 113473 - DNA, 20 bp, Artificial Sequence
  chemically synthesized
gaaatgaaattagatcaact

SEQ ID NO: 113474 - DNA, 20 bp, Artificial Sequence
  chemically synthesized
agaaatgaaattagatcaac

SEQ ID NO: 113475 - DNA, 20 bp, Artificial Sequence
  chemically synthesized
gttgctacaagaaatgaaat

SEQ ID NO: 113476 - DNA, 20 bp, Artificial Sequence
  chemically synthesized
tgatctaatttcatttcttg

SEQ ID NO: 113477 - DNA, 20 bp, Artificial Sequence
  chemically synthesized
ggctggggtatggttgctac

SEQ ID NO: 113478 - DNA, 20 bp, Artificial Sequence
  chemically synthesized
ttcttgtagcaaccataccc

SEQ ID NO: 113479 - DNA, 20 bp, Artificial Sequence
  chemically synthesized
gaaggaacttggctggggta

SEQ ID NO: 113480 - DNA, 20 bp, Artificial Sequence
  chemically synthesized
gtagcaaccataccccagcc

SEQ ID NO: 113481 - DNA, 20 bp, Artificial Sequence
  chemically synthesized
aatctgaaggaacttggctg

SEQ ID NO: 113482 - DNA, 20 bp, Artificial Sequence
  chemically synthesized
gaatctgaaggaacttggct

SEQ ID NO: 113483 - DNA, 20 bp, Artificial Sequence
  chemically synthesized
agaatctgaaggaacttggc

SEQ ID NO: 113484 - DNA, 20 bp, Artificial Sequence
  chemically synthesized
tgtgagaatctgaaggaact

SEQ ID NO: 113485 - DNA, 20 bp, Artificial Sequence
  chemically synthesized
ataccccagccaagttcctt

SEQ ID NO: 113486 - DNA, 20 bp, Artificial Sequence
  chemically synthesized
gtggtagtgtgagaatctga

SEQ ID NO: 113487 - DNA, 20 bp, Artificial Sequence
  chemically synthesized
tgtggtagtgtgagaatctg

SEQ ID NO: 113488 - DNA, 20 bp, Artificial Sequence
  chemically synthesized
cttagtcagtgtggtagtgt

SEQ ID NO: 113489 - DNA, 20 bp, Artificial Sequence
  chemically synthesized
caaaggcttagtcagtgtgg

SEQ ID NO: 113490 - DNA, 20 bp, Artificial Sequence
  chemically synthesized
atccaaaggcttagtcagtg

SEQ ID NO: 113491 - DNA, 20 bp, Artificial Sequence
  chemically synthesized
ctcacactaccacactgact

SEQ ID NO: 113492 - DNA, 20 bp, Artificial Sequence
  chemically synthesized
accatatccaaaggcttagt

SEQ ID NO: 113493 - DNA, 20 bp, Artificial Sequence
  chemically synthesized
taccacactgactaagcctt

SEQ ID NO: 113494 - DNA, 20 bp, Artificial Sequence
  chemically synthesized
aaacaccatatccaaaggct

SEQ ID NO: 113495 - DNA, 20 bp, Artificial Sequence
  chemically synthesized
actgactaagcctttggata

SEQ ID NO: 113496 - DNA, 20 bp, Artificial Sequence
  chemically synthesized
agaggaaacaccatatccaa

SEQ ID NO: 113497 - DNA, 20 bp, Artificial Sequence
  chemically synthesized
tagaggaaacaccatatcca

SEQ ID NO: 113498 - DNA, 20 bp, Artificial Sequence
  chemically synthesized
gaaaagagcattcgtgatag

SEQ ID NO: 113499 - DNA, 20 bp, Artificial Sequence
  chemically synthesized
tgaaaagagcattcgtgata

SEQ ID NO: 113500 - DNA, 20 bp, Artificial Sequence
  chemically synthesized
gttgaaaagagcattcgtga

SEQ ID NO: 113501 - DNA, 20 bp, Artificial Sequence
  chemically synthesized
taggttcatggggttgaaaa

SEQ ID NO: 113502 - DNA, 20 bp, Artificial Sequence
  chemically synthesized
tttaggttcatggggttgaa

SEQ ID NO: 113503 - DNA, 20 bp, Artificial Sequence
  chemically synthesized
aggagttatttaggttcatg

SEQ ID NO: 113504 - DNA, 20 bp, Artificial Sequence
  chemically synthesized
taggagttatttaggttcat

SEQ ID NO: 113505 - DNA, 20 bp, Artificial Sequence
  chemically synthesized
ttaggagttatttaggttca

SEQ ID NO: 113506 - DNA, 20 bp, Artificial Sequence
  chemically synthesized
agaattgttaggagttattt

SEQ ID NO: 113507 - DNA, 20 bp, Artificial Sequence
  chemically synthesized
aagaattgttaggagttatt

SEQ ID NO: 113508 - DNA, 20 bp, Artificial Sequence
  chemically synthesized
caccttagaagaattgttag

SEQ ID NO: 113509 - DNA, 20 bp, Artificial Sequence
  chemically synthesized
gtcaccttagaagaattgtt

SEQ ID NO: 113510 - DNA, 20 bp, Artificial Sequence
  chemically synthesized
agtcaccttagaagaattgt

SEQ ID NO: 113511 - DNA, 20 bp, Artificial Sequence
  chemically synthesized
taactcctaacaattcttct

SEQ ID NO: 113512 - DNA, 20 bp, Artificial Sequence
  chemically synthesized
aactcctaacaattcttcta

SEQ ID NO: 113513 - DNA, 20 bp, Artificial Sequence
  chemically synthesized
tttagagaaagtcaccttag

SEQ ID NO: 113514 - DNA, 20 bp, Artificial Sequence
  chemically synthesized
ctgtttagagaaagtcacct

SEQ ID NO: 113515 - DNA, 20 bp, Artificial Sequence
  chemically synthesized
tgagaacctctgtttagaga

SEQ ID NO: 113516 - DNA, 20 bp, Artificial Sequence
  chemically synthesized
ctaaggtgactttctctaaa

SEQ ID NO: 113517 - DNA, 20 bp, Artificial Sequence
  chemically synthesized
aaggtgactttctctaaaca

SEQ ID NO: 113518 - DNA, 20 bp, Artificial Sequence
  chemically synthesized
aggtgactttctctaaacag

SEQ ID NO: 113519 - DNA, 20 bp, Artificial Sequence
  chemically synthesized
ccagtgagaacctctgttta

SEQ ID NO: 113520 - DNA, 20 bp, Artificial Sequence
  chemically synthesized
gtccagtgagaacctctgtt

SEQ ID NO: 113521 - DNA, 20 bp, Artificial Sequence
  chemically synthesized
ctctaaacagaggttctcac

SEQ ID NO: 113522 - DNA, 20 bp, Artificial Sequence
  chemically synthesized
ccatgaatctattgtccagt

SEQ ID NO: 113523 - DNA, 20 bp, Artificial Sequence
  chemically synthesized
cagaggttctcactggacaa

SEQ ID NO: 113524 - DNA, 20 bp, Artificial Sequence
  chemically synthesized
ctacccatgaatctattgtc

SEQ ID NO: 113525 - DNA, 20 bp, Artificial Sequence
  chemically synthesized
ctcactggacaatagattca

SEQ ID NO: 113526 - DNA, 20 bp, Artificial Sequence
  chemically synthesized
tcactggacaatagattcat

SEQ ID NO: 113527 - DNA, 20 bp, Artificial Sequence
  chemically synthesized
ctggacaatagattcatggg

SEQ ID NO: 113528 - DNA, 20 bp, Artificial Sequence
  chemically synthesized
tggacaatagattcatgggt

SEQ ID NO: 113529 - DNA, 20 bp, Artificial Sequence
  chemically synthesized
gataccaactgaattgagca

SEQ ID NO: 113530 - DNA, 20 bp, Artificial Sequence
  chemically synthesized
aggacatgctatgctcaatt

SEQ ID NO: 113531 - DNA, 20 bp, Artificial Sequence
  chemically synthesized
caatagataccaactgaatt

SEQ ID NO: 113532 - DNA, 20 bp, Artificial Sequence
  chemically synthesized
catgctatgctcaattcagt

SEQ ID NO: 113533 - DNA, 20 bp, Artificial Sequence
  chemically synthesized
aattcagttggtatctattg

SEQ ID NO: 113534 - DNA, 20 bp, Artificial Sequence
  chemically synthesized
attcagttggtatctattgt

SEQ ID NO: 113535 - DNA, 20 bp, Artificial Sequence
  chemically synthesized
cagttggtatctattgtggg

SEQ ID NO: 113536 - DNA, 20 bp, Artificial Sequence
  chemically synthesized
aaaaatatctctgcccacaa

SEQ ID NO: 113537 - DNA, 20 bp, Artificial Sequence
  chemically synthesized
gttggtatctattgtgggca

SEQ ID NO: 113538 - DNA, 20 bp, Artificial Sequence
  chemically synthesized
gatatttttaaaatctcccc

SEQ ID NO: 113539 - DNA, 20 bp, Artificial Sequence
  chemically synthesized
accttgcttatgcactgggg

SEQ ID NO: 113540 - DNA, 20 bp, Artificial Sequence
  chemically synthesized
taaccttgcttatgcactgg

SEQ ID NO: 113541 - DNA, 20 bp, Artificial Sequence
  chemically synthesized
ttaaccttgcttatgcactg

SEQ ID NO: 113542 - DNA, 20 bp, Artificial Sequence
  chemically synthesized
taaaatctcccccagtgcat

SEQ ID NO: 113543 - DNA, 20 bp, Artificial Sequence
  chemically synthesized
tttaaccttgcttatgcact

SEQ ID NO: 113544 - DNA, 20 bp, Artificial Sequence
  chemically synthesized
ttttaaccttgcttatgcac

SEQ ID NO: 113545 - DNA, 20 bp, Artificial Sequence
  chemically synthesized
atctcccccagtgcataagc

SEQ ID NO: 113546 - DNA, 20 bp, Artificial Sequence
  chemically synthesized
tctcccccagtgcataagca

SEQ ID NO: 113547 - DNA, 20 bp, Artificial Sequence
  chemically synthesized
aaggttaaaatccaccgttc

SEQ ID NO: 113548 - DNA, 20 bp, Artificial Sequence
  chemically synthesized
aggttaaaatccaccgttct

SEQ ID NO: 113549 - DNA, 20 bp, Artificial Sequence
  chemically synthesized
aggaaactcacctagaacgg

SEQ ID NO: 113550 - DNA, 20 bp, Artificial Sequence
  chemically synthesized
gccaggaaactcacctagaa

SEQ ID NO: 113551 - DNA, 20 bp, Artificial Sequence
  chemically synthesized
taaaatccaccgttctaggt

SEQ ID NO: 113552 - DNA, 20 bp, Artificial Sequence
  chemically synthesized
aagaggccaggaaactcacc

SEQ ID NO: 113553 - DNA, 20 bp, Artificial Sequence
  chemically synthesized
accgttctaggtgagtttcc

SEQ ID NO: 113554 - DNA, 20 bp, Artificial Sequence
  chemically synthesized
ctaaaccttccaaagaggcc

SEQ ID NO: 113555 - DNA, 20 bp, Artificial Sequence
  chemically synthesized
ggtgagtttcctggcctctt

SEQ ID NO: 113556 - DNA, 20 bp, Artificial Sequence
  chemically synthesized
gctaaaccttccaaagaggc

SEQ ID NO: 113557 - DNA, 20 bp, Artificial Sequence
  chemically synthesized
gagtttcctggcctctttgg

SEQ ID NO: 113558 - DNA, 20 bp, Artificial Sequence
  chemically synthesized
agtttcctggcctctttgga

SEQ ID NO: 113559 - DNA, 20 bp, Artificial Sequence
  chemically synthesized
ctaggctaaaccttccaaag

SEQ ID NO: 113560 - DNA, 20 bp, Artificial Sequence
  chemically synthesized
actaggctaaaccttccaaa

SEQ ID NO: 113561 - DNA, 20 bp, Artificial Sequence
  chemically synthesized
agactaggctaaaccttcca

SEQ ID NO: 113562 - DNA, 20 bp, Artificial Sequence
  chemically synthesized
cctggcctctttggaaggtt

SEQ ID NO: 113563 - DNA, 20 bp, Artificial Sequence
  chemically synthesized
cctctttggaaggtttagcc

SEQ ID NO: 113564 - DNA, 20 bp, Artificial Sequence
  chemically synthesized
tctagcaaaaacagaagact

SEQ ID NO: 113565 - DNA, 20 bp, Artificial Sequence
  chemically synthesized
gtctagcaaaaacagaagac

SEQ ID NO: 113566 - DNA, 20 bp, Artificial Sequence
  chemically synthesized
acagggtctagcaaaaacag

SEQ ID NO: 113567 - DNA, 20 bp, Artificial Sequence
  chemically synthesized
gcctagtcttctgtttttgc

SEQ ID NO: 113568 - DNA, 20 bp, Artificial Sequence
  chemically synthesized
tggacagggtctagcaaaaa

SEQ ID NO: 113569 - DNA, 20 bp, Artificial Sequence
  chemically synthesized
gtagagagctggacagggtc

SEQ ID NO: 113570 - DNA, 20 bp, Artificial Sequence
  chemically synthesized
tgtttttgctagaccctgtc

SEQ ID NO: 113571 - DNA, 20 bp, Artificial Sequence
  chemically synthesized
ttacagtagagagctggaca

SEQ ID NO: 113572 - DNA, 20 bp, Artificial Sequence
  chemically synthesized
attacagtagagagctggac

SEQ ID NO: 113573 - DNA, 20 bp, Artificial Sequence
  chemically synthesized
aattacagtagagagctgga

SEQ ID NO: 113574 - DNA, 20 bp, Artificial Sequence
  chemically synthesized
tgagaattacagtagagagc

SEQ ID NO: 113575 - DNA, 20 bp, Artificial Sequence
  chemically synthesized
attatgagaattacagtaga

SEQ ID NO: 113576 - DNA, 20 bp, Artificial Sequence
  chemically synthesized
gcattatgagaattacagta

SEQ ID NO: 113577 - DNA, 20 bp, Artificial Sequence
  chemically synthesized
tagcattatgagaattacag

SEQ ID NO: 113578 - DNA, 20 bp, Artificial Sequence
  chemically synthesized
taatagcattatgagaatta

SEQ ID NO: 113579 - DNA, 20 bp, Artificial Sequence
  chemically synthesized
caaaattataatagcattat

SEQ ID NO: 113580 - DNA, 20 bp, Artificial Sequence
  chemically synthesized
atcctaagacaaaattataa

SEQ ID NO: 113581 - DNA, 20 bp, Artificial Sequence
  chemically synthesized
atgctattataattttgtct

SEQ ID NO: 113582 - DNA, 20 bp, Artificial Sequence
  chemically synthesized
tgctattataattttgtctt

SEQ ID NO: 113583 - DNA, 20 bp, Artificial Sequence
  chemically synthesized
gaggtgaagacatacatcct

SEQ ID NO: 113584 - DNA, 20 bp, Artificial Sequence
  chemically synthesized
aggatgtatgtcttcacctc

SEQ ID NO: 113585 - DNA, 20 bp, Artificial Sequence
  chemically synthesized
aggttcacattccagaggtg

SEQ ID NO: 113586 - DNA, 20 bp, Artificial Sequence
  chemically synthesized
ttgagaggttcacattccag

SEQ ID NO: 113587 - DNA, 20 bp, Artificial Sequence
  chemically synthesized
tttgagaggttcacattcca

SEQ ID NO: 113588 - DNA, 20 bp, Artificial Sequence
  chemically synthesized
cctttgagaggttcacattc

SEQ ID NO: 113589 - DNA, 20 bp, Artificial Sequence
  chemically synthesized
tctggaatgtgaacctctca

SEQ ID NO: 113590 - DNA, 20 bp, Artificial Sequence
  chemically synthesized
ctggaatgtgaacctctcaa

SEQ ID NO: 113591 - DNA, 20 bp, Artificial Sequence
  chemically synthesized
acattatttctgcctttgag

SEQ ID NO: 113592 - DNA, 20 bp, Artificial Sequence
  chemically synthesized
gaatgtgaacctctcaaagg

SEQ ID NO: 113593 - DNA, 20 bp, Artificial Sequence
  chemically synthesized
aacattatttctgcctttga

SEQ ID NO: 113594 - DNA, 20 bp, Artificial Sequence
  chemically synthesized
ttaacattatttctgccttt

SEQ ID NO: 113595 - DNA, 20 bp, Artificial Sequence
  chemically synthesized
gcagaaataatgttaaaata

SEQ ID NO: 113596 - DNA, 20 bp, Artificial Sequence
  chemically synthesized
agaaataatgttaaaataca

SEQ ID NO: 113597 - DNA, 20 bp, Artificial Sequence
  chemically synthesized
gaaataatgttaaaatacag

SEQ ID NO: 113598 - DNA, 20 bp, Artificial Sequence
  chemically synthesized
actttgtaacatatattcaa

SEQ ID NO: 113599 - DNA, 20 bp, Artificial Sequence
  chemically synthesized
gcttttgaatatatgttaca

SEQ ID NO: 113600 - DNA, 20 bp, Artificial Sequence
  chemically synthesized
atatatgttacaaagtgatc

SEQ ID NO: 113601 - DNA, 20 bp, Artificial Sequence
  chemically synthesized
gtctgtcggtgtggaaatac

SEQ ID NO: 113602 - DNA, 20 bp, Artificial Sequence
  chemically synthesized
atccagtatttccacaccga

SEQ ID NO: 113603 - DNA, 20 bp, Artificial Sequence
  chemically synthesized
tgtgtgtgtgtctgtcggtg

SEQ ID NO: 113604 - DNA, 20 bp, Artificial Sequence
  chemically synthesized
gtgtgtgtgtgtgtgtctgt

SEQ ID NO: 113605 - DNA, 20 bp, Artificial Sequence
  chemically synthesized
ttcgtaaaactttggttcgg

SEQ ID NO: 113606 - DNA, 20 bp, Artificial Sequence
  chemically synthesized
acacacaaaccaccgaacca

SEQ ID NO: 113607 - DNA, 20 bp, Artificial Sequence
  chemically synthesized
ttgttcgtaaaactttggtt

SEQ ID NO: 113608 - DNA, 20 bp, Artificial Sequence
  chemically synthesized
caatattgttcgtaaaactt

SEQ ID NO: 113609 - DNA, 20 bp, Artificial Sequence
  chemically synthesized
caatattgaaacttacttaa

SEQ ID NO: 113610 - DNA, 20 bp, Artificial Sequence
  chemically synthesized
ggagtccatcacttttaagt

SEQ ID NO: 113611 - DNA, 20 bp, Artificial Sequence
  chemically synthesized
ataaggagtccatcactttt

SEQ ID NO: 113612 - DNA, 20 bp, Artificial Sequence
  chemically synthesized
tgaaacttacttaaaagtga

SEQ ID NO: 113613 - DNA, 20 bp, Artificial Sequence
  chemically synthesized
taaaatagaatagaaataag

SEQ ID NO: 113614 - DNA, 20 bp, Artificial Sequence
  chemically synthesized
agtaaaatagaatagaaata

SEQ ID NO: 113615 - DNA, 20 bp, Artificial Sequence
  chemically synthesized
tagtaaaatagaatagaaat

SEQ ID NO: 113616 - DNA, 20 bp, Artificial Sequence
  chemically synthesized
atgaaattagtaaaatagaa

SEQ ID NO: 113617 - DNA, 20 bp, Artificial Sequence
  chemically synthesized
aatgaatgaaattagtaaaa

SEQ ID NO: 113618 - DNA, 20 bp, Artificial Sequence
  chemically synthesized
aagatagaaatgaatgaaat

SEQ ID NO: 113619 - DNA, 20 bp, Artificial Sequence
  chemically synthesized
atcaatccatatttttaaga

SEQ ID NO: 113620 - DNA, 20 bp, Artificial Sequence
  chemically synthesized
tcatttctatcttaaaaata

SEQ ID NO: 113621 - DNA, 20 bp, Artificial Sequence
  chemically synthesized
gagtatcaatccatattttt

SEQ ID NO: 113622 - DNA, 20 bp, Artificial Sequence
  chemically synthesized
atatggattgatactcatta

SEQ ID NO: 113623 - DNA, 20 bp, Artificial Sequence
  chemically synthesized
ggttgtataatcactttaat

SEQ ID NO: 113624 - DNA, 20 bp, Artificial Sequence
  chemically synthesized
attaaagtgattatacaacc

SEQ ID NO: 113625 - DNA, 20 bp, Artificial Sequence
  chemically synthesized
aacagttcagtaaaagtact

SEQ ID NO: 113626 - DNA, 20 bp, Artificial Sequence
  chemically synthesized
aaacagttcagtaaaagtac

SEQ ID NO: 113627 - DNA, 20 bp, Artificial Sequence
  chemically synthesized
tttcaaaaacagttcagtaa

SEQ ID NO: 113628 - DNA, 20 bp, Artificial Sequence
  chemically synthesized
ggtgcttttcaaaaacagtt

SEQ ID NO: 113629 - DNA, 20 bp, Artificial Sequence
  chemically synthesized
agaaaggtgcttttcaaaaa

SEQ ID NO: 113630 - DNA, 20 bp, Artificial Sequence
  chemically synthesized
tttactgaactgtttttgaa

SEQ ID NO: 113631 - DNA, 20 bp, Artificial Sequence
  chemically synthesized
tttttgaaaagcacctttct

SEQ ID NO: 113632 - DNA, 20 bp, Artificial Sequence
  chemically synthesized
ttttgaaaagcacctttctt

SEQ ID NO: 113633 - DNA, 20 bp, Artificial Sequence
  chemically synthesized
tttgaaaagcacctttcttg

SEQ ID NO: 113634 - DNA, 20 bp, Artificial Sequence
  chemically synthesized
catcataagggccccaagaa

SEQ ID NO: 113635 - DNA, 20 bp, Artificial Sequence
  chemically synthesized
ccatcataagggccccaaga

SEQ ID NO: 113636 - DNA, 20 bp, Artificial Sequence
  chemically synthesized
aattccatcataagggcccc

SEQ ID NO: 113637 - DNA, 20 bp, Artificial Sequence
  chemically synthesized
ctttcttggggcccttatga

SEQ ID NO: 113638 - DNA, 20 bp, Artificial Sequence
  chemically synthesized
gggaactaattccatcataa

SEQ ID NO: 113639 - DNA, 20 bp, Artificial Sequence
  chemically synthesized
agggaactaattccatcata

SEQ ID NO: 113640 - DNA, 20 bp, Artificial Sequence
  chemically synthesized
aagggaactaattccatcat

SEQ ID NO: 113641 - DNA, 20 bp, Artificial Sequence
  chemically synthesized
tggggcccttatgatggaat

SEQ ID NO: 113642 - DNA, 20 bp, Artificial Sequence
  chemically synthesized
ggaattagttcccttataac

SEQ ID NO: 113643 - DNA, 20 bp, Artificial Sequence
  chemically synthesized
gacacttcctcttgttataa

SEQ ID NO: 113644 - DNA, 20 bp, Artificial Sequence
  chemically synthesized
tgacacttcctcttgttata

SEQ ID NO: 113645 - DNA, 20 bp, Artificial Sequence
  chemically synthesized
aattagttcccttataacaa

SEQ ID NO: 113646 - DNA, 20 bp, Artificial Sequence
  chemically synthesized
atgacacttcctcttgttat

SEQ ID NO: 113647 - DNA, 20 bp, Artificial Sequence
  chemically synthesized
attagttcccttataacaag

SEQ ID NO: 113648 - DNA, 20 bp, Artificial Sequence
  chemically synthesized
agttcccttataacaagagg

SEQ ID NO: 113649 - DNA, 20 bp, Artificial Sequence
  chemically synthesized
ataacaagaggaagtgtcat

SEQ ID NO: 113650 - DNA, 20 bp, Artificial Sequence
  chemically synthesized
aacaagaggaagtgtcatca

SEQ ID NO: 113651 - DNA, 20 bp, Artificial Sequence
  chemically synthesized
taacatagcaaagagagaca

SEQ ID NO: 113652 - DNA, 20 bp, Artificial Sequence
  chemically synthesized
cctaacatagcaaagagaga

SEQ ID NO: 113653 - DNA, 20 bp, Artificial Sequence
  chemically synthesized
gtgtcctaacatagcaaaga

SEQ ID NO: 113654 - DNA, 20 bp, Artificial Sequence
  chemically synthesized
ctgtgtcctaacatagcaaa

SEQ ID NO: 113655 - DNA, 20 bp, Artificial Sequence
  chemically synthesized
ctctgtgtcctaacatagca

SEQ ID NO: 113656 - DNA, 20 bp, Artificial Sequence
  chemically synthesized
tctgtctctctttgctatgt

SEQ ID NO: 113657 - DNA, 20 bp, Artificial Sequence
  chemically synthesized
ctgtctctctttgctatgtt

SEQ ID NO: 113658 - DNA, 20 bp, Artificial Sequence
  chemically synthesized
cttctctctgtgtcctaaca

SEQ ID NO: 113659 - DNA, 20 bp, Artificial Sequence
  chemically synthesized
ctctttgctatgttaggaca

SEQ ID NO: 113660 - DNA, 20 bp, Artificial Sequence
  chemically synthesized
ctttgctatgttaggacaca

SEQ ID NO: 113661 - DNA, 20 bp, Artificial Sequence
  chemically synthesized
ttgctatgttaggacacaga

SEQ ID NO: 113662 - DNA, 20 bp, Artificial Sequence
  chemically synthesized
ctatgttaggacacagagag

SEQ ID NO: 113663 - DNA, 20 bp, Artificial Sequence
  chemically synthesized
tatgttaggacacagagaga

SEQ ID NO: 113664 - DNA, 20 bp, Artificial Sequence
  chemically synthesized
gttaggacacagagagaagg

SEQ ID NO: 113665 - DNA, 20 bp, Artificial Sequence
  chemically synthesized
ccctcttcctggtttgcaga

SEQ ID NO: 113666 - DNA, 20 bp, Artificial Sequence
  chemically synthesized
gaaggaagccatctgcaaac

SEQ ID NO: 113667 - DNA, 20 bp, Artificial Sequence
  chemically synthesized
aaggaagccatctgcaaacc

SEQ ID NO: 113668 - DNA, 20 bp, Artificial Sequence
  chemically synthesized
gggcccctcttcctggtttg

SEQ ID NO: 113669 - DNA, 20 bp, Artificial Sequence
  chemically synthesized
gaagccatctgcaaaccagg

SEQ ID NO: 113670 - DNA, 20 bp, Artificial Sequence
  chemically synthesized
agccatctgcaaaccaggaa

SEQ ID NO: 113671 - DNA, 20 bp, Artificial Sequence
  chemically synthesized
gccatctgcaaaccaggaag

SEQ ID NO: 113672 - DNA, 20 bp, Artificial Sequence
  chemically synthesized
ccatctgcaaaccaggaaga

SEQ ID NO: 113673 - DNA, 20 bp, Artificial Sequence
  chemically synthesized
catctgcaaaccaggaagag

SEQ ID NO: 113674 - DNA, 20 bp, Artificial Sequence
  chemically synthesized
ctggtgagggcccctcttcc

SEQ ID NO: 113675 - DNA, 20 bp, Artificial Sequence
  chemically synthesized
ccaggaagaggggccctcac

SEQ ID NO: 113676 - DNA, 20 bp, Artificial Sequence
  chemically synthesized
caggaagaggggccctcacc

SEQ ID NO: 113677 - DNA, 20 bp, Artificial Sequence
  chemically synthesized
ccaagatcagggcctggtga

SEQ ID NO: 113678 - DNA, 20 bp, Artificial Sequence
  chemically synthesized
tccaagatcagggcctggtg

SEQ ID NO: 113679 - DNA, 20 bp, Artificial Sequence
  chemically synthesized
ttccaagatcagggcctggt

SEQ ID NO: 113680 - DNA, 20 bp, Artificial Sequence
  chemically synthesized
gggattccaagatcagggcc

SEQ ID NO: 113681 - DNA, 20 bp, Artificial Sequence
  chemically synthesized
ccctcaccaggccctgatct

SEQ ID NO: 113682 - DNA, 20 bp, Artificial Sequence
  chemically synthesized
aggctgggattccaagatca

SEQ ID NO: 113683 - DNA, 20 bp, Artificial Sequence
  chemically synthesized
gaggctgggattccaagatc

SEQ ID NO: 113684 - DNA, 20 bp, Artificial Sequence
  chemically synthesized
ggaggctgggattccaagat

SEQ ID NO: 113685 - DNA, 20 bp, Artificial Sequence
  chemically synthesized
aggccctgatcttggaatcc

SEQ ID NO: 113686 - DNA, 20 bp, Artificial Sequence
  chemically synthesized
gttctggaggctgggattcc

SEQ ID NO: 113687 - DNA, 20 bp, Artificial Sequence
  chemically synthesized
gatcttggaatcccagcctc

SEQ ID NO: 113688 - DNA, 20 bp, Artificial Sequence
  chemically synthesized
ttctcacagttctggaggct

SEQ ID NO: 113689 - DNA, 20 bp, Artificial Sequence
  chemically synthesized
tttctcacagttctggaggc

SEQ ID NO: 113690 - DNA, 20 bp, Artificial Sequence
  chemically synthesized
cttatttctcacagttctgg

SEQ ID NO: 113691 - DNA, 20 bp, Artificial Sequence
  chemically synthesized
tcttatttctcacagttctg

SEQ ID NO: 113692 - DNA, 20 bp, Artificial Sequence
  chemically synthesized
atcccagcctccagaactgt

SEQ ID NO: 113693 - DNA, 20 bp, Artificial Sequence
  chemically synthesized
aatcttatttctcacagttc

SEQ ID NO: 113694 - DNA, 20 bp, Artificial Sequence
  chemically synthesized
caacagaatcttatttctca

SEQ ID NO: 113695 - DNA, 20 bp, Artificial Sequence
  chemically synthesized
cctccagaactgtgagaaat

SEQ ID NO: 113696 - DNA, 20 bp, Artificial Sequence
  chemically synthesized
gaaataagattctgttgtat

SEQ ID NO: 113697 - DNA, 20 bp, Artificial Sequence
  chemically synthesized
gggaaagaaggcttatacaa

SEQ ID NO: 113698 - DNA, 20 bp, Artificial Sequence
  chemically synthesized
gggggtgggtaagggaaaga

SEQ ID NO: 113699 - DNA, 20 bp, Artificial Sequence
  chemically synthesized
ggggggtgggtaagggaaag

SEQ ID NO: 113700 - DNA, 20 bp, Artificial Sequence
  chemically synthesized
tttggggggtgggtaaggga

SEQ ID NO: 113701 - DNA, 20 bp, Artificial Sequence
  chemically synthesized
cttttttggggggtgggtaa

SEQ ID NO: 113702 - DNA, 20 bp, Artificial Sequence
  chemically synthesized
tcttttttggggggtgggta

SEQ ID NO: 113703 - DNA, 20 bp, Artificial Sequence
  chemically synthesized
ttcttttttggggggtgggt

SEQ ID NO: 113704 - DNA, 20 bp, Artificial Sequence
  chemically synthesized
ttctttcttttttggggggt

SEQ ID NO: 113705 - DNA, 20 bp, Artificial Sequence
  chemically synthesized
tttctttcttttttgggggg

SEQ ID NO: 113706 - DNA, 20 bp, Artificial Sequence
  chemically synthesized
cccttacccaccccccaaaa

SEQ ID NO: 113707 - DNA, 20 bp, Artificial Sequence
  chemically synthesized
gattttctttcttttttggg

SEQ ID NO: 113708 - DNA, 20 bp, Artificial Sequence
  chemically synthesized
tgattttctttcttttttgg

SEQ ID NO: 113709 - DNA, 20 bp, Artificial Sequence
  chemically synthesized
atgattttctttcttttttg

SEQ ID NO: 113710 - DNA, 20 bp, Artificial Sequence
  chemically synthesized
gatgattttctttctttttt

SEQ ID NO: 113711 - DNA, 20 bp, Artificial Sequence
  chemically synthesized
tacccaccccccaaaaaaga

SEQ ID NO: 113712 - DNA, 20 bp, Artificial Sequence
  chemically synthesized
agatgattttctttcttttt

SEQ ID NO: 113713 - DNA, 20 bp, Artificial Sequence
  chemically synthesized
gtgatacaaacatgttcaga

SEQ ID NO: 113714 - DNA, 20 bp, Artificial Sequence
  chemically synthesized
tggtgatacaaacatgttca

SEQ ID NO: 113715 - DNA, 20 bp, Artificial Sequence
  chemically synthesized
tctggtgatacaaacatgtt

SEQ ID NO: 113716 - DNA, 20 bp, Artificial Sequence
  chemically synthesized
tctgaacatgtttgtatcac

SEQ ID NO: 113717 - DNA, 20 bp, Artificial Sequence
  chemically synthesized
atgtgtcgtggtgttaggtc

SEQ ID NO: 113718 - DNA, 20 bp, Artificial Sequence
  chemically synthesized
ctgccatgtgtcgtggtgtt

SEQ ID NO: 113719 - DNA, 20 bp, Artificial Sequence
  chemically synthesized
cctgccatgtgtcgtggtgt

SEQ ID NO: 113720 - DNA, 20 bp, Artificial Sequence
  chemically synthesized
agacctaacaccacgacaca

SEQ ID NO: 113721 - DNA, 20 bp, Artificial Sequence
  chemically synthesized
taaacacctgccatgtgtcg

SEQ ID NO: 113722 - DNA, 20 bp, Artificial Sequence
  chemically synthesized
cctaacaccacgacacatgg

SEQ ID NO: 113723 - DNA, 20 bp, Artificial Sequence
  chemically synthesized
ctaacaccacgacacatggc

SEQ ID NO: 113724 - DNA, 20 bp, Artificial Sequence
  chemically synthesized
cacgacacatggcaggtgtt

SEQ ID NO: 113725 - DNA, 20 bp, Artificial Sequence
  chemically synthesized
cacatggcaggtgtttagca

SEQ ID NO: 113726 - DNA, 20 bp, Artificial Sequence
  chemically synthesized
tctgagaacttttattaatt

SEQ ID NO: 113727 - DNA, 20 bp, Artificial Sequence
  chemically synthesized
aagatacgctgaattaataa

SEQ ID NO: 113728 - DNA, 20 bp, Artificial Sequence
  chemically synthesized
gctgaattaataaaagttct

SEQ ID NO: 113729 - DNA, 20 bp, Artificial Sequence
  chemically synthesized
tatatatataaaatttttct

SEQ ID NO: 113730 - DNA, 20 bp, Artificial Sequence
  chemically synthesized
gtatataatttttaaatatc

SEQ ID NO: 113731 - DNA, 20 bp, Artificial Sequence
  chemically synthesized
atataatttttaaatatcca

SEQ ID NO: 113732 - DNA, 20 bp, Artificial Sequence
  chemically synthesized
taatttttaaatatccagag

SEQ ID NO: 113733 - DNA, 20 bp, Artificial Sequence
  chemically synthesized
tttttaaatatccagagcag

SEQ ID NO: 113734 - DNA, 20 bp, Artificial Sequence
  chemically synthesized
ttttaaatatccagagcaga

SEQ ID NO: 113735 - DNA, 20 bp, Artificial Sequence
  chemically synthesized
gcgatgaatgccttctgctc

SEQ ID NO: 113736 - DNA, 20 bp, Artificial Sequence
  chemically synthesized
gagcagaaggcattcatcgc

SEQ ID NO: 113737 - DNA, 20 bp, Artificial Sequence
  chemically synthesized
agcagaaggcattcatcgcc

SEQ ID NO: 113738 - DNA, 20 bp, Artificial Sequence
  chemically synthesized
tttgatatttttattttgcc

SEQ ID NO: 113739 - DNA, 20 bp, Artificial Sequence
  chemically synthesized
ttgttgtctaaagagtgtga

SEQ ID NO: 113740 - DNA, 20 bp, Artificial Sequence
  chemically synthesized
aaattcactttcacactctt

SEQ ID NO: 113741 - DNA, 20 bp, Artificial Sequence
  chemically synthesized
tattttgattgttgtctaaa

SEQ ID NO: 113742 - DNA, 20 bp, Artificial Sequence
  chemically synthesized
tctattttgattgttgtcta

SEQ ID NO: 113743 - DNA, 20 bp, Artificial Sequence
  chemically synthesized
tctttagacaacaatcaaaa

SEQ ID NO: 113744 - DNA, 20 bp, Artificial Sequence
  chemically synthesized
tagacaacaatcaaaataga

SEQ ID NO: 113745 - DNA, 20 bp, Artificial Sequence
  chemically synthesized
ctgttgctttagtttgaatt

SEQ ID NO: 113746 - DNA, 20 bp, Artificial Sequence
  chemically synthesized
ataaaactcaattcaaacta

SEQ ID NO: 113747 - DNA, 20 bp, Artificial Sequence
  chemically synthesized
ctcaattcaaactaaagcaa

SEQ ID NO: 113748 - DNA, 20 bp, Artificial Sequence
  chemically synthesized
tcaattcaaactaaagcaac

SEQ ID NO: 113749 - DNA, 20 bp, Artificial Sequence
  chemically synthesized
tgtattccttcctgttgctt

SEQ ID NO: 113750 - DNA, 20 bp, Artificial Sequence
  chemically synthesized
attcaaactaaagcaacagg

SEQ ID NO: 113751 - DNA, 20 bp, Artificial Sequence
  chemically synthesized
ttcaaactaaagcaacagga

SEQ ID NO: 113752 - DNA, 20 bp, Artificial Sequence
  chemically synthesized
caacaggaaggaatacacta

SEQ ID NO: 113753 - DNA, 20 bp, Artificial Sequence
  chemically synthesized
aacaggaaggaatacactaa

SEQ ID NO: 113754 - DNA, 20 bp, Artificial Sequence
  chemically synthesized
ttctaaggagaagaaacctt

SEQ ID NO: 113755 - DNA, 20 bp, Artificial Sequence
  chemically synthesized
cactaaaggtttcttctcct

SEQ ID NO: 113756 - DNA, 20 bp, Artificial Sequence
  chemically synthesized
ggatccctaattctaaggag

SEQ ID NO: 113757 - DNA, 20 bp, Artificial Sequence
  chemically synthesized
taaggatccctaattctaag

SEQ ID NO: 113758 - DNA, 20 bp, Artificial Sequence
  chemically synthesized
aggtttcttctccttagaat

SEQ ID NO: 113759 - DNA, 20 bp, Artificial Sequence
  chemically synthesized
ggtttcttctccttagaatt

SEQ ID NO: 113760 - DNA, 20 bp, Artificial Sequence
  chemically synthesized
tttaaggatccctaattcta

SEQ ID NO: 113761 - DNA, 20 bp, Artificial Sequence
  chemically synthesized
gtttcttctccttagaatta

SEQ ID NO: 113762 - DNA, 20 bp, Artificial Sequence
  chemically synthesized
atttaaggatccctaattct

SEQ ID NO: 113763 - DNA, 20 bp, Artificial Sequence
  chemically synthesized
gagaatgcagaggcaattta

SEQ ID NO: 113764 - DNA, 20 bp, Artificial Sequence
  chemically synthesized
tgagaatgcagaggcaattt

SEQ ID NO: 113765 - DNA, 20 bp, Artificial Sequence
  chemically synthesized
tggactatctgagaatgcag

SEQ ID NO: 113766 - DNA, 20 bp, Artificial Sequence
  chemically synthesized
ttggactatctgagaatgca

SEQ ID NO: 113767 - DNA, 20 bp, Artificial Sequence
  chemically synthesized
ttaaattgcctctgcattct

SEQ ID NO: 113768 - DNA, 20 bp, Artificial Sequence
  chemically synthesized
tcttggactatctgagaatg

SEQ ID NO: 113769 - DNA, 20 bp, Artificial Sequence
  chemically synthesized
attgcctctgcattctcaga

SEQ ID NO: 113770 - DNA, 20 bp, Artificial Sequence
  chemically synthesized
tcgtatttcttggactatct

SEQ ID NO: 113771 - DNA, 20 bp, Artificial Sequence
  chemically synthesized
tctgcattctcagatagtcc

SEQ ID NO: 113772 - DNA, 20 bp, Artificial Sequence
  chemically synthesized
aattggagtatcgtatttct

SEQ ID NO: 113773 - DNA, 20 bp, Artificial Sequence
  chemically synthesized
ttagtaccttgaataaattg

SEQ ID NO: 113774 - DNA, 20 bp, Artificial Sequence
  chemically synthesized
aattagtaccttgaataaat

SEQ ID NO: 113775 - DNA, 20 bp, Artificial Sequence
  chemically synthesized
tacgatactccaatttattc

SEQ ID NO: 113776 - DNA, 20 bp, Artificial Sequence
  chemically synthesized
acgatactccaatttattca

SEQ ID NO: 113777 - DNA, 20 bp, Artificial Sequence
  chemically synthesized
tgcaatcttagtagcacaat

SEQ ID NO: 113778 - DNA, 20 bp, Artificial Sequence
  chemically synthesized
aaggtactaattgtgctact

SEQ ID NO: 113779 - DNA, 20 bp, Artificial Sequence
  chemically synthesized
aagaaagaatgcaatcttag

SEQ ID NO: 113780 - DNA, 20 bp, Artificial Sequence
  chemically synthesized
aagaagaaagaatgcaatct

SEQ ID NO: 113781 - DNA, 20 bp, Artificial Sequence
  chemically synthesized
ttaattctgaagaaagaaga

SEQ ID NO: 113782 - DNA, 20 bp, Artificial Sequence
  chemically synthesized
tgcattctttcttctttctt

SEQ ID NO: 113783 - DNA, 20 bp, Artificial Sequence
  chemically synthesized
cggattaattctgaagaaag

SEQ ID NO: 113784 - DNA, 20 bp, Artificial Sequence
  chemically synthesized
gcacggattaattctgaaga

SEQ ID NO: 113785 - DNA, 20 bp, Artificial Sequence
  chemically synthesized
tggcgcacggattaattctg

SEQ ID NO: 113786 - DNA, 20 bp, Artificial Sequence
  chemically synthesized
ctcaccaaaattttggcgca

SEQ ID NO: 113787 - DNA, 20 bp, Artificial Sequence
  chemically synthesized
taatccgtgcgccaaaattt

SEQ ID NO: 113788 - DNA, 20 bp, Artificial Sequence
  chemically synthesized
gaagtttctcaccaaaattt

SEQ ID NO: 113789 - DNA, 20 bp, Artificial Sequence
  chemically synthesized
ccgtgcgccaaaattttggt

SEQ ID NO: 113790 - DNA, 20 bp, Artificial Sequence
  chemically synthesized
aaaataaaataaaattggag

SEQ ID NO: 113791 - DNA, 20 bp, Artificial Sequence
  chemically synthesized
aataaaataaaataaaattg

SEQ ID NO: 113792 - DNA, 20 bp, Artificial Sequence
  chemically synthesized
aaaataaaataaaataaaat

SEQ ID NO: 113793 - DNA, 20 bp, Artificial Sequence
  chemically synthesized
ttattttaatttattttttt

SEQ ID NO: 113794 - DNA, 20 bp, Artificial Sequence
  chemically synthesized
tttaatttatttttttgaga

SEQ ID NO: 113795 - DNA, 20 bp, Artificial Sequence
  chemically synthesized
taatttatttttttgagaca

SEQ ID NO: 113796 - DNA, 20 bp, Artificial Sequence
  chemically synthesized
actccagcctggtgaaagag

SEQ ID NO: 113797 - DNA, 20 bp, Artificial Sequence
  chemically synthesized
gacagagtctgctctttcac

SEQ ID NO: 113798 - DNA, 20 bp, Artificial Sequence
  chemically synthesized
acagagtctgctctttcacc

SEQ ID NO: 113799 - DNA, 20 bp, Artificial Sequence
  chemically synthesized
tgcactccagcctggtgaaa

SEQ ID NO: 113800 - DNA, 20 bp, Artificial Sequence
  chemically synthesized
actgcactccagcctggtga

SEQ ID NO: 113801 - DNA, 20 bp, Artificial Sequence
  chemically synthesized
agtctgctctttcaccaggc

SEQ ID NO: 113802 - DNA, 20 bp, Artificial Sequence
  chemically synthesized
tctgctctttcaccaggctg

SEQ ID NO: 113803 - DNA, 20 bp, Artificial Sequence
  chemically synthesized
ggcgccactgcactccagcc

SEQ ID NO: 113804 - DNA, 20 bp, Artificial Sequence
  chemically synthesized
tctttcaccaggctggagtg

SEQ ID NO: 113805 - DNA, 20 bp, Artificial Sequence
  chemically synthesized
gagatggcgccactgcactc

SEQ ID NO: 113806 - DNA, 20 bp, Artificial Sequence
  chemically synthesized
ttcaccaggctggagtgcag

SEQ ID NO: 113807 - DNA, 20 bp, Artificial Sequence
  chemically synthesized
ggagtgcagtggcgccatct

SEQ ID NO: 113808 - DNA, 20 bp, Artificial Sequence
  chemically synthesized
gaggttgcagtgagccgaga

SEQ ID NO: 113809 - DNA, 20 bp, Artificial Sequence
  chemically synthesized
ggtggaggttgcagtgagcc

SEQ ID NO: 113810 - DNA, 20 bp, Artificial Sequence
  chemically synthesized
caggaggtggaggttgcagt

SEQ ID NO: 113811 - DNA, 20 bp, Artificial Sequence
  chemically synthesized
aacccaggaggtggaggttg

SEQ ID NO: 113812 - DNA, 20 bp, Artificial Sequence
  chemically synthesized
tgcttgaacccaggaggtgg

SEQ ID NO: 113813 - DNA, 20 bp, Artificial Sequence
  chemically synthesized
tcactgcaacctccacctcc

SEQ ID NO: 113814 - DNA, 20 bp, Artificial Sequence
  chemically synthesized
ttgcttgaacccaggaggtg

SEQ ID NO: 113815 - DNA, 20 bp, Artificial Sequence
  chemically synthesized
cactgcaacctccacctcct

SEQ ID NO: 113816 - DNA, 20 bp, Artificial Sequence
  chemically synthesized
aattgcttgaacccaggagg

SEQ ID NO: 113817 - DNA, 20 bp, Artificial Sequence
  chemically synthesized
gagaattgcttgaacccagg

SEQ ID NO: 113818 - DNA, 20 bp, Artificial Sequence
  chemically synthesized
ggagaattgcttgaacccag

SEQ ID NO: 113819 - DNA, 20 bp, Artificial Sequence
  chemically synthesized
aacctccacctcctgggttc

SEQ ID NO: 113820 - DNA, 20 bp, Artificial Sequence
  chemically synthesized
caggagaattgcttgaaccc

SEQ ID NO: 113821 - DNA, 20 bp, Artificial Sequence
  chemically synthesized
gcaggagaattgcttgaacc

SEQ ID NO: 113822 - DNA, 20 bp, Artificial Sequence
  chemically synthesized
ttcaagcaattctcctgcct

SEQ ID NO: 113823 - DNA, 20 bp, Artificial Sequence
  chemically synthesized
tactcaggaggctgaggcag

SEQ ID NO: 113824 - DNA, 20 bp, Artificial Sequence
  chemically synthesized
gctactcaggaggctgaggc

SEQ ID NO: 113825 - DNA, 20 bp, Artificial Sequence
  chemically synthesized
agctactcaggaggctgagg

SEQ ID NO: 113826 - DNA, 20 bp, Artificial Sequence
  chemically synthesized
cccagctactcaggaggctg

SEQ ID NO: 113827 - DNA, 20 bp, Artificial Sequence
  chemically synthesized
tcccagctactcaggaggct

SEQ ID NO: 113828 - DNA, 20 bp, Artificial Sequence
  chemically synthesized
ttctcctgcctcagcctcct

SEQ ID NO: 113829 - DNA, 20 bp, Artificial Sequence
  chemically synthesized
tcctgcctcagcctcctgag

SEQ ID NO: 113830 - DNA, 20 bp, Artificial Sequence
  chemically synthesized
tgtagtcccagctactcagg

SEQ ID NO: 113831 - DNA, 20 bp, Artificial Sequence
  chemically synthesized
ctgtagtcccagctactcag

SEQ ID NO: 113832 - DNA, 20 bp, Artificial Sequence
  chemically synthesized
gcctcagcctcctgagtagc

SEQ ID NO: 113833 - DNA, 20 bp, Artificial Sequence
  chemically synthesized
gcctgtagtcccagctactc

SEQ ID NO: 113834 - DNA, 20 bp, Artificial Sequence
  chemically synthesized
cctcagcctcctgagtagct

SEQ ID NO: 113835 - DNA, 20 bp, Artificial Sequence
  chemically synthesized
cgcctgtagtcccagctact

SEQ ID NO: 113836 - DNA, 20 bp, Artificial Sequence
  chemically synthesized
ctcctgagtagctgggacta

SEQ ID NO: 113837 - DNA, 20 bp, Artificial Sequence
  chemically synthesized
tcctgagtagctgggactac

SEQ ID NO: 113838 - DNA, 20 bp, Artificial Sequence
  chemically synthesized
gtggagtacgcctgtagtcc

SEQ ID NO: 113839 - DNA, 20 bp, Artificial Sequence
  chemically synthesized
ggtgtggtggagtacgcctg

SEQ ID NO: 113840 - DNA, 20 bp, Artificial Sequence
  chemically synthesized
aaaattagccgggtgtggtg

SEQ ID NO: 113841 - DNA, 20 bp, Artificial Sequence
  chemically synthesized
caggcgtactccaccacacc

SEQ ID NO: 113842 - DNA, 20 bp, Artificial Sequence
  chemically synthesized
caaaaattagccgggtgtgg

SEQ ID NO: 113843 - DNA, 20 bp, Artificial Sequence
  chemically synthesized
atacaaaaattagccgggtg

SEQ ID NO: 113844 - DNA, 20 bp, Artificial Sequence
  chemically synthesized
taaaaatacaaaaattagcc

SEQ ID NO: 113845 - DNA, 20 bp, Artificial Sequence
  chemically synthesized
ctaaaaatacaaaaattagc

SEQ ID NO: 113846 - DNA, 20 bp, Artificial Sequence
  chemically synthesized
tctactaaaaatacaaaaat

SEQ ID NO: 113847 - DNA, 20 bp, Artificial Sequence
  chemically synthesized
ccggctaatttttgtatttt

SEQ ID NO: 113848 - DNA, 20 bp, Artificial Sequence
  chemically synthesized
gctaatttttgtatttttag

SEQ ID NO: 113849 - DNA, 20 bp, Artificial Sequence
  chemically synthesized
taatttttgtatttttagta

SEQ ID NO: 113850 - DNA, 20 bp, Artificial Sequence
  chemically synthesized
ttttgtatttttagtagaga

SEQ ID NO: 113851 - DNA, 20 bp, Artificial Sequence
  chemically synthesized
tttgtatttttagtagagac

SEQ ID NO: 113852 - DNA, 20 bp, Artificial Sequence
  chemically synthesized
ttgtatttttagtagagacg

SEQ ID NO: 113853 - DNA, 20 bp, Artificial Sequence
  chemically synthesized
tgtatttttagtagagacgg

SEQ ID NO: 113854 - DNA, 20 bp, Artificial Sequence
  chemically synthesized
gagacgggggtttcaccttg

SEQ ID NO: 113855 - DNA, 20 bp, Artificial Sequence
  chemically synthesized
cgggggtttcaccttgtggc

SEQ ID NO: 113856 - DNA, 20 bp, Artificial Sequence
  chemically synthesized
gggggtttcaccttgtggcc

SEQ ID NO: 113857 - DNA, 20 bp, Artificial Sequence
  chemically synthesized
tcgagaccatcctggccaca

SEQ ID NO: 113858 - DNA, 20 bp, Artificial Sequence
  chemically synthesized
atcgagaccatcctggccac

SEQ ID NO: 113859 - DNA, 20 bp, Artificial Sequence
  chemically synthesized
gtttcaccttgtggccagga

SEQ ID NO: 113860 - DNA, 20 bp, Artificial Sequence
  chemically synthesized
tcaagagatcgagaccatcc

SEQ ID NO: 113861 - DNA, 20 bp, Artificial Sequence
  chemically synthesized
gatcacgaggtcaagagatc

SEQ ID NO: 113862 - DNA, 20 bp, Artificial Sequence
  chemically synthesized
cgggcggatcacgaggtcaa

SEQ ID NO: 113863 - DNA, 20 bp, Artificial Sequence
  chemically synthesized
ggcgggcggatcacgaggtc

SEQ ID NO: 113864 - DNA, 20 bp, Artificial Sequence
  chemically synthesized
gcagaggcgggcggatcacg

SEQ ID NO: 113865 - DNA, 20 bp, Artificial Sequence
  chemically synthesized
ggcagaggcgggcggatcac

SEQ ID NO: 113866 - DNA, 20 bp, Artificial Sequence
  chemically synthesized
ctttgggaggcagaggcggg

SEQ ID NO: 113867 - DNA, 20 bp, Artificial Sequence
  chemically synthesized
gcactttgggaggcagaggc

SEQ ID NO: 113868 - DNA, 20 bp, Artificial Sequence
  chemically synthesized
agcactttgggaggcagagg

SEQ ID NO: 113869 - DNA, 20 bp, Artificial Sequence
  chemically synthesized
cccagcactttgggaggcag

SEQ ID NO: 113870 - DNA, 20 bp, Artificial Sequence
  chemically synthesized
tcccagcactttgggaggca

SEQ ID NO: 113871 - DNA, 20 bp, Artificial Sequence
  chemically synthesized
ccgcccgcctctgcctccca

SEQ ID NO: 113872 - DNA, 20 bp, Artificial Sequence
  chemically synthesized
aatcccagcactttgggagg

SEQ ID NO: 113873 - DNA, 20 bp, Artificial Sequence
  chemically synthesized
tgtaatcccagcactttggg

SEQ ID NO: 113874 - DNA, 20 bp, Artificial Sequence
  chemically synthesized
ctgtaatcccagcactttgg

SEQ ID NO: 113875 - DNA, 20 bp, Artificial Sequence
  chemically synthesized
gcctctgcctcccaaagtgc

SEQ ID NO: 113876 - DNA, 20 bp, Artificial Sequence
  chemically synthesized
gcctgtaatcccagcacttt

SEQ ID NO: 113877 - DNA, 20 bp, Artificial Sequence
  chemically synthesized
cctctgcctcccaaagtgct

SEQ ID NO: 113878 - DNA, 20 bp, Artificial Sequence
  chemically synthesized
cgcctgtaatcccagcactt

SEQ ID NO: 113879 - DNA, 20 bp, Artificial Sequence
  chemically synthesized
ctcccaaagtgctgggatta

SEQ ID NO: 113880 - DNA, 20 bp, Artificial Sequence
  chemically synthesized
tcccaaagtgctgggattac

SEQ ID NO: 113881 - DNA, 20 bp, Artificial Sequence
  chemically synthesized
gtggctcacgcctgtaatcc

SEQ ID NO: 113882 - DNA, 20 bp, Artificial Sequence
  chemically synthesized
agtgctgggattacaggcgt

SEQ ID NO: 113883 - DNA, 20 bp, Artificial Sequence
  chemically synthesized
gttattaaaattgggtgtgg

SEQ ID NO: 113884 - DNA, 20 bp, Artificial Sequence
  chemically synthesized
tatgttattaaaattgggtg

SEQ ID NO: 113885 - DNA, 20 bp, Artificial Sequence
  chemically synthesized
tctaatatgttattaaaatt

SEQ ID NO: 113886 - DNA, 20 bp, Artificial Sequence
  chemically synthesized
ttctaatatgttattaaaat

SEQ ID NO: 113887 - DNA, 20 bp, Artificial Sequence
  chemically synthesized
acccaattttaataacatat

SEQ ID NO: 113888 - DNA, 20 bp, Artificial Sequence
  chemically synthesized
taataacatattagaaatca

SEQ ID NO: 113889 - DNA, 20 bp, Artificial Sequence
  chemically synthesized
atcaaagatatcttaattca

SEQ ID NO: 113890 - DNA, 20 bp, Artificial Sequence
  chemically synthesized
tcaaagatatcttaattcat

SEQ ID NO: 113891 - DNA, 20 bp, Artificial Sequence
  chemically synthesized
tctgagtacacctatgaatt

SEQ ID NO: 113892 - DNA, 20 bp, Artificial Sequence
  chemically synthesized
tcttaattcataggtgtact

SEQ ID NO: 113893 - DNA, 20 bp, Artificial Sequence
  chemically synthesized
aaagtttgaattgtacatct

SEQ ID NO: 113894 - DNA, 20 bp, Artificial Sequence
  chemically synthesized
ccagagagacaagtttcata

SEQ ID NO: 113895 - DNA, 20 bp, Artificial Sequence
  chemically synthesized
ctttatgaaacttgtctctc

SEQ ID NO: 113896 - DNA, 20 bp, Artificial Sequence
  chemically synthesized
taaaacatttccagagagac

SEQ ID NO: 113897 - DNA, 20 bp, Artificial Sequence
  chemically synthesized
atgaataaaacatttccaga

SEQ ID NO: 113898 - DNA, 20 bp, Artificial Sequence
  chemically synthesized
tgatgaataaaacatttcca

SEQ ID NO: 113899 - DNA, 20 bp, Artificial Sequence
  chemically synthesized
tctgatgaataaaacatttc

SEQ ID NO: 113900 - DNA, 20 bp, Artificial Sequence
  chemically synthesized
tctggaaatgttttattcat

SEQ ID NO: 113901 - DNA, 20 bp, Artificial Sequence
  chemically synthesized
ggaaatgttttattcatcag

SEQ ID NO: 113902 - DNA, 20 bp, Artificial Sequence
  chemically synthesized
tcagaagacaatttttataa

SEQ ID NO: 113903 - DNA, 20 bp, Artificial Sequence
  chemically synthesized
cagaagacaatttttataat

SEQ ID NO: 113904 - DNA, 20 bp, Artificial Sequence
  chemically synthesized
agaagacaatttttataatg

SEQ ID NO: 113905 - DNA, 20 bp, Artificial Sequence
  chemically synthesized
gaagacaatttttataatgg

SEQ ID NO: 113906 - DNA, 20 bp, Artificial Sequence
  chemically synthesized
aagacaatttttataatggg

SEQ ID NO: 113907 - DNA, 20 bp, Artificial Sequence
  chemically synthesized
atttttataatggggggatt

SEQ ID NO: 113908 - DNA, 20 bp, Artificial Sequence
  chemically synthesized
ttttataatggggggattga

SEQ ID NO: 113909 - DNA, 20 bp, Artificial Sequence
  chemically synthesized
tttataatggggggattgag

SEQ ID NO: 113910 - DNA, 20 bp, Artificial Sequence
  chemically synthesized
tataatggggggattgagag

SEQ ID NO: 113911 - DNA, 20 bp, Artificial Sequence
  chemically synthesized
ggggggattgagaggagacg

SEQ ID NO: 113912 - DNA, 20 bp, Artificial Sequence
  chemically synthesized
gggggattgagaggagacgt

SEQ ID NO: 113913 - DNA, 20 bp, Artificial Sequence
  chemically synthesized
aggagacgtaggtaaaacac

SEQ ID NO: 113914 - DNA, 20 bp, Artificial Sequence
  chemically synthesized
acgtaggtaaaacacgagat

SEQ ID NO: 113915 - DNA, 20 bp, Artificial Sequence
  chemically synthesized
cgtaggtaaaacacgagatt

SEQ ID NO: 113916 - DNA, 20 bp, Artificial Sequence
  chemically synthesized
gtaggtaaaacacgagatta

SEQ ID NO: 113917 - DNA, 20 bp, Artificial Sequence
  chemically synthesized
ggtaaaacacgagattaggg

SEQ ID NO: 113918 - DNA, 20 bp, Artificial Sequence
  chemically synthesized
gtaaaacacgagattaggga

SEQ ID NO: 113919 - DNA, 20 bp, Artificial Sequence
  chemically synthesized
taaaacacgagattagggaa

SEQ ID NO: 113920 - DNA, 20 bp, Artificial Sequence
  chemically synthesized
aaacacgagattagggaagg

SEQ ID NO: 113921 - DNA, 20 bp, Artificial Sequence
  chemically synthesized
tagggaagggagtgatttga

SEQ ID NO: 113922 - DNA, 20 bp, Artificial Sequence
  chemically synthesized
agggagtgatttgaaagata

SEQ ID NO: 113923 - DNA, 20 bp, Artificial Sequence
  chemically synthesized
tgatttgaaagatatggcct

SEQ ID NO: 113924 - DNA, 20 bp, Artificial Sequence
  chemically synthesized
tgtgatctgggtcatgtctc

SEQ ID NO: 113925 - DNA, 20 bp, Artificial Sequence
  chemically synthesized
ctgtgatctgggtcatgtct

SEQ ID NO: 113926 - DNA, 20 bp, Artificial Sequence
  chemically synthesized
atatggcctgagacatgacc

SEQ ID NO: 113927 - DNA, 20 bp, Artificial Sequence
  chemically synthesized
ctgagacatgacccagatca

SEQ ID NO: 113928 - DNA, 20 bp, Artificial Sequence
  chemically synthesized
gataccttcatctgtgatct

SEQ ID NO: 113929 - DNA, 20 bp, Artificial Sequence
  chemically synthesized
agataccttcatctgtgatc

SEQ ID NO: 113930 - DNA, 20 bp, Artificial Sequence
  chemically synthesized
catgacccagatcacagatg

SEQ ID NO: 113931 - DNA, 20 bp, Artificial Sequence
  chemically synthesized
atgacccagatcacagatga

SEQ ID NO: 113932 - DNA, 20 bp, Artificial Sequence
  chemically synthesized
ctaaggagcaataaatatat

SEQ ID NO: 113933 - DNA, 20 bp, Artificial Sequence
  chemically synthesized
ctcatatatttattgctcct

SEQ ID NO: 113934 - DNA, 20 bp, Artificial Sequence
  chemically synthesized
tctcagcaagacaaactaag

SEQ ID NO: 113935 - DNA, 20 bp, Artificial Sequence
  chemically synthesized
tttctcagcaagacaaacta

SEQ ID NO: 113936 - DNA, 20 bp, Artificial Sequence
  chemically synthesized
ttttctcagcaagacaaact

SEQ ID NO: 113937 - DNA, 20 bp, Artificial Sequence
  chemically synthesized
gctccttagtttgtcttgct

SEQ ID NO: 113938 - DNA, 20 bp, Artificial Sequence
  chemically synthesized
attaacatatttttctcagc

SEQ ID NO: 113939 - DNA, 20 bp, Artificial Sequence
  chemically synthesized
tgtaattaacatatttttct

SEQ ID NO: 113940 - DNA, 20 bp, Artificial Sequence
  chemically synthesized
ctttatgatgttcataaagg

SEQ ID NO: 113941 - DNA, 20 bp, Artificial Sequence
  chemically synthesized
gacctttatgatgttcataa

SEQ ID NO: 113942 - DNA, 20 bp, Artificial Sequence
  chemically synthesized
tgacctttatgatgttcata

SEQ ID NO: 113943 - DNA, 20 bp, Artificial Sequence
  chemically synthesized
ccacctttatgaacatcata

SEQ ID NO: 113944 - DNA, 20 bp, Artificial Sequence
  chemically synthesized
cacctttatgaacatcataa

SEQ ID NO: 113945 - DNA, 20 bp, Artificial Sequence
  chemically synthesized
aatgtgggggtgtgggtatg

SEQ ID NO: 113946 - DNA, 20 bp, Artificial Sequence
  chemically synthesized
taaagacaatgtgggggtgt

SEQ ID NO: 113947 - DNA, 20 bp, Artificial Sequence
  chemically synthesized
gtaaagacaatgtgggggtg

SEQ ID NO: 113948 - DNA, 20 bp, Artificial Sequence
  chemically synthesized
agcttgtaaagacaatgtgg

SEQ ID NO: 113949 - DNA, 20 bp, Artificial Sequence
  chemically synthesized
tagcttgtaaagacaatgtg

SEQ ID NO: 113950 - DNA, 20 bp, Artificial Sequence
  chemically synthesized
ttagcttgtaaagacaatgt

SEQ ID NO: 113951 - DNA, 20 bp, Artificial Sequence
  chemically synthesized
attagcttgtaaagacaatg

SEQ ID NO: 113952 - DNA, 20 bp, Artificial Sequence
  chemically synthesized
cacccccacattgtctttac

SEQ ID NO: 113953 - DNA, 20 bp, Artificial Sequence
  chemically synthesized
cattgtaatattagcttgta

SEQ ID NO: 113954 - DNA, 20 bp, Artificial Sequence
  chemically synthesized
ctgagagatcattgtaatat

SEQ ID NO: 113955 - DNA, 20 bp, Artificial Sequence
  chemically synthesized
ctaatattacaatgatctct

SEQ ID NO: 113956 - DNA, 20 bp, Artificial Sequence
  chemically synthesized
taatattacaatgatctctc

SEQ ID NO: 113957 - DNA, 20 bp, Artificial Sequence
  chemically synthesized
aatattacaatgatctctca

SEQ ID NO: 113958 - DNA, 20 bp, Artificial Sequence
  chemically synthesized
atattacaatgatctctcag

SEQ ID NO: 113959 - DNA, 20 bp, Artificial Sequence
  chemically synthesized
ggttctctaagtacccctga

SEQ ID NO: 113960 - DNA, 20 bp, Artificial Sequence
  chemically synthesized
gtggttctctaagtacccct

SEQ ID NO: 113961 - DNA, 20 bp, Artificial Sequence
  chemically synthesized
aatgatctctcaggggtact

SEQ ID NO: 113962 - DNA, 20 bp, Artificial Sequence
  chemically synthesized
tgatctctcaggggtactta

SEQ ID NO: 113963 - DNA, 20 bp, Artificial Sequence
  chemically synthesized
caaatattaagtggttctct

SEQ ID NO: 113964 - DNA, 20 bp, Artificial Sequence
  chemically synthesized
agagtttcacaaatattaag

SEQ ID NO: 113965 - DNA, 20 bp, Artificial Sequence
  chemically synthesized
acaagagtttcacaaatatt

SEQ ID NO: 113966 - DNA, 20 bp, Artificial Sequence
  chemically synthesized
tctttctgaatatttcacaa

SEQ ID NO: 113967 - DNA, 20 bp, Artificial Sequence
  chemically synthesized
tgtctttctgaatatttcac

SEQ ID NO: 113968 - DNA, 20 bp, Artificial Sequence
  chemically synthesized
tgaaactcttgtgaaatatt

SEQ ID NO: 113969 - DNA, 20 bp, Artificial Sequence
  chemically synthesized
actcttgtgaaatattcaga

SEQ ID NO: 113970 - DNA, 20 bp, Artificial Sequence
  chemically synthesized
ttgtgaaatattcagaaaga

SEQ ID NO: 113971 - DNA, 20 bp, Artificial Sequence
  chemically synthesized
gtgaaatattcagaaagaca

SEQ ID NO: 113972 - DNA, 20 bp, Artificial Sequence
  chemically synthesized
ggtaactaactgaaaatgga

SEQ ID NO: 113973 - DNA, 20 bp, Artificial Sequence
  chemically synthesized
agacagagtctttccatttt

SEQ ID NO: 113974 - DNA, 20 bp, Artificial Sequence
  chemically synthesized
cctgggtaactaactgaaaa

SEQ ID NO: 113975 - DNA, 20 bp, Artificial Sequence
  chemically synthesized
agagtctttccattttcagt

SEQ ID NO: 113976 - DNA, 20 bp, Artificial Sequence
  chemically synthesized
tccattttcagttagttacc

SEQ ID NO: 113977 - DNA, 20 bp, Artificial Sequence
  chemically synthesized
ccattttcagttagttaccc

SEQ ID NO: 113978 - DNA, 20 bp, Artificial Sequence
  chemically synthesized
cattttcagttagttaccca

SEQ ID NO: 113979 - DNA, 20 bp, Artificial Sequence
  chemically synthesized
aagtactaccataaaaccct

SEQ ID NO: 113980 - DNA, 20 bp, Artificial Sequence
  chemically synthesized
aaagtactaccataaaaccc

SEQ ID NO: 113981 - DNA, 20 bp, Artificial Sequence
  chemically synthesized
gttagttacccagggtttta

SEQ ID NO: 113982 - DNA, 20 bp, Artificial Sequence
  chemically synthesized
agttacccagggttttatgg

SEQ ID NO: 113983 - DNA, 20 bp, Artificial Sequence
  chemically synthesized
acaaagctgttcatggttca

SEQ ID NO: 113984 - DNA, 20 bp, Artificial Sequence
  chemically synthesized
gtagtactttgaaccatgaa

SEQ ID NO: 113985 - DNA, 20 bp, Artificial Sequence
  chemically synthesized
agagttgacaaagctgttca

SEQ ID NO: 113986 - DNA, 20 bp, Artificial Sequence
  chemically synthesized
gggcctaagaagagttgaca

SEQ ID NO: 113987 - DNA, 20 bp, Artificial Sequence
  chemically synthesized
acagctttgtcaactcttct

SEQ ID NO: 113988 - DNA, 20 bp, Artificial Sequence
  chemically synthesized
cagctttgtcaactcttctt

SEQ ID NO: 113989 - DNA, 20 bp, Artificial Sequence
  chemically synthesized
ttctgctttgggcctaagaa

SEQ ID NO: 113990 - DNA, 20 bp, Artificial Sequence
  chemically synthesized
ttttctgctttgggcctaag

SEQ ID NO: 113991 - DNA, 20 bp, Artificial Sequence
  chemically synthesized
gtcaactcttcttaggccca

SEQ ID NO: 113992 - DNA, 20 bp, Artificial Sequence
  chemically synthesized
acattttctgctttgggcct

SEQ ID NO: 113993 - DNA, 20 bp, Artificial Sequence
  chemically synthesized
aactcttcttaggcccaaag

SEQ ID NO: 113994 - DNA, 20 bp, Artificial Sequence
  chemically synthesized
tccaaaacattttctgcttt

SEQ ID NO: 113995 - DNA, 20 bp, Artificial Sequence
  chemically synthesized
atccaaaacattttctgctt

SEQ ID NO: 113996 - DNA, 20 bp, Artificial Sequence
  chemically synthesized
gcccaaagcagaaaatgttt

SEQ ID NO: 113997 - DNA, 20 bp, Artificial Sequence
  chemically synthesized
aaagcagaaaatgttttgga

SEQ ID NO: 113998 - DNA, 20 bp, Artificial Sequence
  chemically synthesized
agcagaaaatgttttggata

SEQ ID NO: 113999 - DNA, 20 bp, Artificial Sequence
  chemically synthesized
aactatattcgtaattgaat

SEQ ID NO: 114000 - DNA, 20 bp, Artificial Sequence
  chemically synthesized
atccgattcaattacgaata

SEQ ID NO: 114001 - DNA, 20 bp, Artificial Sequence
  chemically synthesized
gaatatagtttttttattta

SEQ ID NO: 114002 - DNA, 20 bp, Artificial Sequence
  chemically synthesized
aatatagtttttttatttaa

SEQ ID NO: 114003 - DNA, 20 bp, Artificial Sequence
  chemically synthesized
gtttcaggatttttaaattg

SEQ ID NO: 114004 - DNA, 20 bp, Artificial Sequence
  chemically synthesized
cctttaggggtgaaagtttc

SEQ ID NO: 114005 - DNA, 20 bp, Artificial Sequence
  chemically synthesized
gcctttaggggtgaaagttt

SEQ ID NO: 114006 - DNA, 20 bp, Artificial Sequence
  chemically synthesized
tacaaagcctttaggggtga

SEQ ID NO: 114007 - DNA, 20 bp, Artificial Sequence
  chemically synthesized
tcctgaaactttcaccccta

SEQ ID NO: 114008 - DNA, 20 bp, Artificial Sequence
  chemically synthesized
cctgaaactttcacccctaa

SEQ ID NO: 114009 - DNA, 20 bp, Artificial Sequence
  chemically synthesized
acgccatacaaagcctttag

SEQ ID NO: 114010 - DNA, 20 bp, Artificial Sequence
  chemically synthesized
aacgccatacaaagccttta

SEQ ID NO: 114011 - DNA, 20 bp, Artificial Sequence
  chemically synthesized
gaacgccatacaaagccttt

SEQ ID NO: 114012 - DNA, 20 bp, Artificial Sequence
  chemically synthesized
agaacgccatacaaagcctt

SEQ ID NO: 114013 - DNA, 20 bp, Artificial Sequence
  chemically synthesized
tcacccctaaaggctttgta

SEQ ID NO: 114014 - DNA, 20 bp, Artificial Sequence
  chemically synthesized
tttttatagaacgccataca

SEQ ID NO: 114015 - DNA, 20 bp, Artificial Sequence
  chemically synthesized
tttaagcaaatgtattttta

SEQ ID NO: 114016 - DNA, 20 bp, Artificial Sequence
  chemically synthesized
atatgctaactggaattttt

SEQ ID NO: 114017 - DNA, 20 bp, Artificial Sequence
  chemically synthesized
atacatttgcttaaaaattc

SEQ ID NO: 114018 - DNA, 20 bp, Artificial Sequence
  chemically synthesized
atttgcttaaaaattccagt

SEQ ID NO: 114019 - DNA, 20 bp, Artificial Sequence
  chemically synthesized
gttatttctgatatgctaac

SEQ ID NO: 114020 - DNA, 20 bp, Artificial Sequence
  chemically synthesized
aaaaattccagttagcatat

SEQ ID NO: 114021 - DNA, 20 bp, Artificial Sequence
  chemically synthesized
tcagaaataacaatatttat

SEQ ID NO: 114022 - DNA, 20 bp, Artificial Sequence
  chemically synthesized
ccttgtacttcaggataagg

SEQ ID NO: 114023 - DNA, 20 bp, Artificial Sequence
  chemically synthesized
tccttgtacttcaggataag

SEQ ID NO: 114024 - DNA, 20 bp, Artificial Sequence
  chemically synthesized
gtccttgtacttcaggataa

SEQ ID NO: 114025 - DNA, 20 bp, Artificial Sequence
  chemically synthesized
agaaacacccccttatcctg

SEQ ID NO: 114026 - DNA, 20 bp, Artificial Sequence
  chemically synthesized
cgtccttgtacttcaggata

SEQ ID NO: 114027 - DNA, 20 bp, Artificial Sequence
  chemically synthesized
tcgtccttgtacttcaggat

SEQ ID NO: 114028 - DNA, 20 bp, Artificial Sequence
  chemically synthesized
acccccttatcctgaagtac

SEQ ID NO: 114029 - DNA, 20 bp, Artificial Sequence
  chemically synthesized
taccgtcgtccttgtacttc

SEQ ID NO: 114030 - DNA, 20 bp, Artificial Sequence
  chemically synthesized
cccccttatcctgaagtaca

SEQ ID NO: 114031 - DNA, 20 bp, Artificial Sequence
  chemically synthesized
ttaccgtcgtccttgtactt

SEQ ID NO: 114032 - DNA, 20 bp, Artificial Sequence
  chemically synthesized
atcctgaagtacaaggacga

SEQ ID NO: 114033 - DNA, 20 bp, Artificial Sequence
  chemically synthesized
gaagtacaaggacgacggta

SEQ ID NO: 114034 - DNA, 20 bp, Artificial Sequence
  chemically synthesized
gacggtaaagttcttgattt

SEQ ID NO: 114035 - DNA, 20 bp, Artificial Sequence
  chemically synthesized
tcactttccttactaaaatc

SEQ ID NO: 114036 - DNA, 20 bp, Artificial Sequence
  chemically synthesized
gtaaagttcttgattttagt

SEQ ID NO: 114037 - DNA, 20 bp, Artificial Sequence
  chemically synthesized
taaagttcttgattttagta

SEQ ID NO: 114038 - DNA, 20 bp, Artificial Sequence
  chemically synthesized
gttcttgattttagtaagga

SEQ ID NO: 114039 - DNA, 20 bp, Artificial Sequence
  chemically synthesized
ttgattttagtaaggaaagt

SEQ ID NO: 114040 - DNA, 20 bp, Artificial Sequence
  chemically synthesized
tttcctcccgtattataaaa

SEQ ID NO: 114041 - DNA, 20 bp, Artificial Sequence
  chemically synthesized
atttcctcccgtattataaa

SEQ ID NO: 114042 - DNA, 20 bp, Artificial Sequence
  chemically synthesized
agttacacctttttataata

SEQ ID NO: 114043 - DNA, 20 bp, Artificial Sequence
  chemically synthesized
gttacacctttttataatac

SEQ ID NO: 114044 - DNA, 20 bp, Artificial Sequence
  chemically synthesized
tacacctttttataatacgg

SEQ ID NO: 114045 - DNA, 20 bp, Artificial Sequence
  chemically synthesized
acacctttttataatacggg

SEQ ID NO: 114046 - DNA, 20 bp, Artificial Sequence
  chemically synthesized
aattcttctctgaaagacat

SEQ ID NO: 114047 - DNA, 20 bp, Artificial Sequence
  chemically synthesized
gaggaaattctaatgtcttt

SEQ ID NO: 114048 - DNA, 20 bp, Artificial Sequence
  chemically synthesized
ggaaattctaatgtctttca

SEQ ID NO: 114049 - DNA, 20 bp, Artificial Sequence
  chemically synthesized
aattctaatgtctttcagag

SEQ ID NO: 114050 - DNA, 20 bp, Artificial Sequence
  chemically synthesized
catgattaattcttctctga

SEQ ID NO: 114051 - DNA, 20 bp, Artificial Sequence
  chemically synthesized
ttaatcatgttaattccatt

SEQ ID NO: 114052 - DNA, 20 bp, Artificial Sequence
  chemically synthesized
taaagcatatacattctgaa

SEQ ID NO: 114053 - DNA, 20 bp, Artificial Sequence
  chemically synthesized
ttaaacatacatgtaatata

SEQ ID NO: 114054 - DNA, 20 bp, Artificial Sequence
  chemically synthesized
ttatattacatgtatgttta

SEQ ID NO: 114055 - DNA, 20 bp, Artificial Sequence
  chemically synthesized
tcagcaataatcataattca

SEQ ID NO: 114056 - DNA, 20 bp, Artificial Sequence
  chemically synthesized
tatgaattatgattattgct

SEQ ID NO: 114057 - DNA, 20 bp, Artificial Sequence
  chemically synthesized
tgaattatgattattgctga

SEQ ID NO: 114058 - DNA, 20 bp, Artificial Sequence
  chemically synthesized
tcgtaagatatttattctct

SEQ ID NO: 114059 - DNA, 20 bp, Artificial Sequence
  chemically synthesized
gagagaataaatatcttacg

SEQ ID NO: 114060 - DNA, 20 bp, Artificial Sequence
  chemically synthesized
agaataaatatcttacgaag

SEQ ID NO: 114061 - DNA, 20 bp, Artificial Sequence
  chemically synthesized
tcgtctatcagccacttcgt

SEQ ID NO: 114062 - DNA, 20 bp, Artificial Sequence
  chemically synthesized
atatcttacgaagtggctga

SEQ ID NO: 114063 - DNA, 20 bp, Artificial Sequence
  chemically synthesized
tacctatcactttcgtctat

SEQ ID NO: 114064 - DNA, 20 bp, Artificial Sequence
  chemically synthesized
acgaagtggctgatagacga

SEQ ID NO: 114065 - DNA, 20 bp, Artificial Sequence
  chemically synthesized
tggctgatagacgaaagtga

SEQ ID NO: 114066 - DNA, 20 bp, Artificial Sequence
  chemically synthesized
ggctgatagacgaaagtgat

SEQ ID NO: 114067 - DNA, 20 bp, Artificial Sequence
  chemically synthesized
tgatagacgaaagtgatagg

SEQ ID NO: 114068 - DNA, 20 bp, Artificial Sequence
  chemically synthesized
gacgaaagtgataggtagtc

SEQ ID NO: 114069 - DNA, 20 bp, Artificial Sequence
  chemically synthesized
aaagtgataggtagtctagc

SEQ ID NO: 114070 - DNA, 20 bp, Artificial Sequence
  chemically synthesized
agtgataggtagtctagcaa

SEQ ID NO: 114071 - DNA, 20 bp, Artificial Sequence
  chemically synthesized
atggagactccagctcttgc

SEQ ID NO: 114072 - DNA, 20 bp, Artificial Sequence
  chemically synthesized
ataggtagtctagcaagagc

SEQ ID NO: 114073 - DNA, 20 bp, Artificial Sequence
  chemically synthesized
aggtagtctagcaagagctg

SEQ ID NO: 114074 - DNA, 20 bp, Artificial Sequence
  chemically synthesized
ttttctatatatggagactc

SEQ ID NO: 114075 - DNA, 20 bp, Artificial Sequence
  chemically synthesized
agagctggagtctccatata

SEQ ID NO: 114076 - DNA, 20 bp, Artificial Sequence
  chemically synthesized
aatccgtttttctatatatg

SEQ ID NO: 114077 - DNA, 20 bp, Artificial Sequence
  chemically synthesized
tcaatccgtttttctatata

SEQ ID NO: 114078 - DNA, 20 bp, Artificial Sequence
  chemically synthesized
agtctccatatatagaaaaa

SEQ ID NO: 114079 - DNA, 20 bp, Artificial Sequence
  chemically synthesized
tatatagaaaaacggattga

SEQ ID NO: 114080 - DNA, 20 bp, Artificial Sequence
  chemically synthesized
gaaaaacggattgacagtct

SEQ ID NO: 114081 - DNA, 20 bp, Artificial Sequence
  chemically synthesized
aaaacggattgacagtctta

SEQ ID NO: 114082 - DNA, 20 bp, Artificial Sequence
  chemically synthesized
cacaaaatgtgtttttctct

SEQ ID NO: 114083 - DNA, 20 bp, Artificial Sequence
  chemically synthesized
agagaaaaacacattttgtg

SEQ ID NO: 114084 - DNA, 20 bp, Artificial Sequence
  chemically synthesized
gagaaaaacacattttgtga

SEQ ID NO: 114085 - DNA, 20 bp, Artificial Sequence
  chemically synthesized
tgctagtgaatgaagagaga

SEQ ID NO: 114086 - DNA, 20 bp, Artificial Sequence
  chemically synthesized
atgctagtgaatgaagagag

SEQ ID NO: 114087 - DNA, 20 bp, Artificial Sequence
  chemically synthesized
aatgctagtgaatgaagaga

SEQ ID NO: 114088 - DNA, 20 bp, Artificial Sequence
  chemically synthesized
caaatgctagtgaatgaaga

SEQ ID NO: 114089 - DNA, 20 bp, Artificial Sequence
  chemically synthesized
tacaaatgctagtgaatgaa

SEQ ID NO: 114090 - DNA, 20 bp, Artificial Sequence
  chemically synthesized
caccctctctcttcattcac

SEQ ID NO: 114091 - DNA, 20 bp, Artificial Sequence
  chemically synthesized
catacaaatgctagtgaatg

SEQ ID NO: 114092 - DNA, 20 bp, Artificial Sequence
  chemically synthesized
gatttacttcatacaaatgc

SEQ ID NO: 114093 - DNA, 20 bp, Artificial Sequence
  chemically synthesized
cattcactagcatttgtatg

SEQ ID NO: 114094 - DNA, 20 bp, Artificial Sequence
  chemically synthesized
aagtaaatcatcactacttt

SEQ ID NO: 114095 - DNA, 20 bp, Artificial Sequence
  chemically synthesized
agtaaatcatcactactttt

SEQ ID NO: 114096 - DNA, 20 bp, Artificial Sequence
  chemically synthesized
gtaaatcatcactacttttg

SEQ ID NO: 114097 - DNA, 20 bp, Artificial Sequence
  chemically synthesized
atatctgtctaccccaaaag

SEQ ID NO: 114098 - DNA, 20 bp, Artificial Sequence
  chemically synthesized
aatcatcactacttttgggg

SEQ ID NO: 114099 - DNA, 20 bp, Artificial Sequence
  chemically synthesized
gatatatctgtctaccccaa

SEQ ID NO: 114100 - DNA, 20 bp, Artificial Sequence
  chemically synthesized
atcactacttttggggtaga

SEQ ID NO: 114101 - DNA, 20 bp, Artificial Sequence
  chemically synthesized
acagatatatcaaaatctgt

SEQ ID NO: 114102 - DNA, 20 bp, Artificial Sequence
  chemically synthesized
gatatatcaaaatctgttgg

SEQ ID NO: 114103 - DNA, 20 bp, Artificial Sequence
  chemically synthesized
tatatcaaaatctgttggca

SEQ ID NO: 114104 - DNA, 20 bp, Artificial Sequence
  chemically synthesized
caaagcaacagctctgccaa

SEQ ID NO: 114105 - DNA, 20 bp, Artificial Sequence
  chemically synthesized
tgttggcagagctgttgctt

SEQ ID NO: 114106 - DNA, 20 bp, Artificial Sequence
  chemically synthesized
gaaatgcctagccaaagcaa

SEQ ID NO: 114107 - DNA, 20 bp, Artificial Sequence
  chemically synthesized
ggcagagctgttgctttggc

SEQ ID NO: 114108 - DNA, 20 bp, Artificial Sequence
  chemically synthesized
gcagagctgttgctttggct

SEQ ID NO: 114109 - DNA, 20 bp, Artificial Sequence
  chemically synthesized
aaatttgaaatgcctagcca

SEQ ID NO: 114110 - DNA, 20 bp, Artificial Sequence
  chemically synthesized
aaaaggaaatttgaaatgcc

SEQ ID NO: 114111 - DNA, 20 bp, Artificial Sequence
  chemically synthesized
ttctcatatattaaaaaaaa

SEQ ID NO: 114112 - DNA, 20 bp, Artificial Sequence
  chemically synthesized
gttctcatatattaaaaaaa

SEQ ID NO: 114113 - DNA, 20 bp, Artificial Sequence
  chemically synthesized
ttcctttttttttaatatat

SEQ ID NO: 114114 - DNA, 20 bp, Artificial Sequence
  chemically synthesized
ttcatgctgtatagcaatca

SEQ ID NO: 114115 - DNA, 20 bp, Artificial Sequence
  chemically synthesized
tgagaactatgattgctata

SEQ ID NO: 114116 - DNA, 20 bp, Artificial Sequence
  chemically synthesized
attcatagattcatgctgta

SEQ ID NO: 114117 - DNA, 20 bp, Artificial Sequence
  chemically synthesized
agctggtagcattgtattca

SEQ ID NO: 114118 - DNA, 20 bp, Artificial Sequence
  chemically synthesized
atctatgaatacaatgctac

SEQ ID NO: 114119 - DNA, 20 bp, Artificial Sequence
  chemically synthesized
acttcatttgaagaagctgg

SEQ ID NO: 114120 - DNA, 20 bp, Artificial Sequence
  chemically synthesized
ttcacttcatttgaagaagc

SEQ ID NO: 114121 - DNA, 20 bp, Artificial Sequence
  chemically synthesized
ctttttcacttcatttgaag

SEQ ID NO: 114122 - DNA, 20 bp, Artificial Sequence
  chemically synthesized
gctaccagcttcttcaaatg

SEQ ID NO: 114123 - DNA, 20 bp, Artificial Sequence
  chemically synthesized
atgctttttcacttcatttg

SEQ ID NO: 114124 - DNA, 20 bp, Artificial Sequence
  chemically synthesized
cttcttcaaatgaagtgaaa

SEQ ID NO: 114125 - DNA, 20 bp, Artificial Sequence
  chemically synthesized
taggtaggagaaaagtgaaa

SEQ ID NO: 114126 - DNA, 20 bp, Artificial Sequence
  chemically synthesized
ataatatgtaggtaggagaa

SEQ ID NO: 114127 - DNA, 20 bp, Artificial Sequence
  chemically synthesized
tttctataatatgtaggtag

SEQ ID NO: 114128 - DNA, 20 bp, Artificial Sequence
  chemically synthesized
attttctataatatgtaggt

SEQ ID NO: 114129 - DNA, 20 bp, Artificial Sequence
  chemically synthesized
aattttctataatatgtagg

SEQ ID NO: 114130 - DNA, 20 bp, Artificial Sequence
  chemically synthesized
aggaattttctataatatgt

SEQ ID NO: 114131 - DNA, 20 bp, Artificial Sequence
  chemically synthesized
tttctcctacctacatatta

SEQ ID NO: 114132 - DNA, 20 bp, Artificial Sequence
  chemically synthesized
aaggaattttctataatatg

SEQ ID NO: 114133 - DNA, 20 bp, Artificial Sequence
  chemically synthesized
gaatttttattttgaacaaa

SEQ ID NO: 114134 - DNA, 20 bp, Artificial Sequence
  chemically synthesized
tgaatttttattttgaacaa

SEQ ID NO: 114135 - DNA, 20 bp, Artificial Sequence
  chemically synthesized
ttgttcaaaataaaaattca

SEQ ID NO: 114136 - DNA, 20 bp, Artificial Sequence
  chemically synthesized
gttcaaaataaaaattcata

SEQ ID NO: 114137 - DNA, 20 bp, Artificial Sequence
  chemically synthesized
ttcaaaataaaaattcatag

SEQ ID NO: 114138 - DNA, 20 bp, Artificial Sequence
  chemically synthesized
aaaaattcatagaggaaaaa

SEQ ID NO: 114139 - DNA, 20 bp, Artificial Sequence
  chemically synthesized
aaaaagcaaacacttccatt

SEQ ID NO: 114140 - DNA, 20 bp, Artificial Sequence
  chemically synthesized
tcagtatttcagctaaatgg

SEQ ID NO: 114141 - DNA, 20 bp, Artificial Sequence
  chemically synthesized
atttcagtatttcagctaaa

SEQ ID NO: 114142 - DNA, 20 bp, Artificial Sequence
  chemically synthesized
tacatgcaatttcagtattt

SEQ ID NO: 114143 - DNA, 20 bp, Artificial Sequence
  chemically synthesized
taagagattacatgcaattt

SEQ ID NO: 114144 - DNA, 20 bp, Artificial Sequence
  chemically synthesized
gaaattgcatgtaatctctt

SEQ ID NO: 114145 - DNA, 20 bp, Artificial Sequence
  chemically synthesized
aaattgcatgtaatctctta

SEQ ID NO: 114146 - DNA, 20 bp, Artificial Sequence
  chemically synthesized
aataaagcagcataccttaa

SEQ ID NO: 114147 - DNA, 20 bp, Artificial Sequence
  chemically synthesized
taaataaagcagcatacctt

SEQ ID NO: 114148 - DNA, 20 bp, Artificial Sequence
  chemically synthesized
gagcttgaaaataaataaag

SEQ ID NO: 114149 - DNA, 20 bp, Artificial Sequence
  chemically synthesized
gccgagcttgaaaataaata

SEQ ID NO: 114150 - DNA, 20 bp, Artificial Sequence
  chemically synthesized
atgctgctttatttattttc

SEQ ID NO: 114151 - DNA, 20 bp, Artificial Sequence
  chemically synthesized
gctttatttattttcaagct

SEQ ID NO: 114152 - DNA, 20 bp, Artificial Sequence
  chemically synthesized
gagcaacaaatggaaatgcc

SEQ ID NO: 114153 - DNA, 20 bp, Artificial Sequence
  chemically synthesized
tggtgttgaagagcaacaaa

SEQ ID NO: 114154 - DNA, 20 bp, Artificial Sequence
  chemically synthesized
gtcaagaaactggtgttgaa

SEQ ID NO: 114155 - DNA, 20 bp, Artificial Sequence
  chemically synthesized
catttgttgctcttcaacac

SEQ ID NO: 114156 - DNA, 20 bp, Artificial Sequence
  chemically synthesized
gagtcaagaaactggtgttg

SEQ ID NO: 114157 - DNA, 20 bp, Artificial Sequence
  chemically synthesized
attgaattgagtcaagaaac

SEQ ID NO: 114158 - DNA, 20 bp, Artificial Sequence
  chemically synthesized
tcagctgattgaattgagtc

SEQ ID NO: 114159 - DNA, 20 bp, Artificial Sequence
  chemically synthesized
acatttcagctgattgaatt

SEQ ID NO: 114160 - DNA, 20 bp, Artificial Sequence
  chemically synthesized
gtttcttgactcaattcaat

SEQ ID NO: 114161 - DNA, 20 bp, Artificial Sequence
  chemically synthesized
ttattgttaatggcacattt

SEQ ID NO: 114162 - DNA, 20 bp, Artificial Sequence
  chemically synthesized
aaactattgattattgttaa

SEQ ID NO: 114163 - DNA, 20 bp, Artificial Sequence
  chemically synthesized
gtgccattaacaataatcaa

SEQ ID NO: 114164 - DNA, 20 bp, Artificial Sequence
  chemically synthesized
ttaacaataatcaatagttt

SEQ ID NO: 114165 - DNA, 20 bp, Artificial Sequence
  chemically synthesized
acaataatcaatagtttcag

SEQ ID NO: 114166 - DNA, 20 bp, Artificial Sequence
  chemically synthesized
tcggagatgtcatggtaaaa

SEQ ID NO: 114167 - DNA, 20 bp, Artificial Sequence
  chemically synthesized
tgaaagactcggagatgtca

SEQ ID NO: 114168 - DNA, 20 bp, Artificial Sequence
  chemically synthesized
cgttttaccatgacatctcc

SEQ ID NO: 114169 - DNA, 20 bp, Artificial Sequence
  chemically synthesized
atcttttgatgaaagactcg

SEQ ID NO: 114170 - DNA, 20 bp, Artificial Sequence
  chemically synthesized
tgatcttttgatgaaagact

SEQ ID NO: 114171 - DNA, 20 bp, Artificial Sequence
  chemically synthesized
atctccgagtctttcatcaa

SEQ ID NO: 114172 - DNA, 20 bp, Artificial Sequence
  chemically synthesized
ggataatgatcttttgatga

SEQ ID NO: 114173 - DNA, 20 bp, Artificial Sequence
  chemically synthesized
ctgatttttagttagatggt

SEQ ID NO: 114174 - DNA, 20 bp, Artificial Sequence
  chemically synthesized
actcctgatttttagttaga

SEQ ID NO: 114175 - DNA, 20 bp, Artificial Sequence
  chemically synthesized
gccaactcctgatttttagt

SEQ ID NO: 114176 - DNA, 20 bp, Artificial Sequence
  chemically synthesized
ccaaccatctaactaaaaat

SEQ ID NO: 114177 - DNA, 20 bp, Artificial Sequence
  chemically synthesized
caaccatctaactaaaaatc

SEQ ID NO: 114178 - DNA, 20 bp, Artificial Sequence
  chemically synthesized
tatagccaactcctgatttt

SEQ ID NO: 114179 - DNA, 20 bp, Artificial Sequence
  chemically synthesized
accatctaactaaaaatcag

SEQ ID NO: 114180 - DNA, 20 bp, Artificial Sequence
  chemically synthesized
tctaactaaaaatcaggagt

SEQ ID NO: 114181 - DNA, 20 bp, Artificial Sequence
  chemically synthesized
atggattgaaatgacattta

SEQ ID NO: 114182 - DNA, 20 bp, Artificial Sequence
  chemically synthesized
tcatttcaatccataaaatg

SEQ ID NO: 114183 - DNA, 20 bp, Artificial Sequence
  chemically synthesized
aaggtttaaactacatttta

SEQ ID NO: 114184 - DNA, 20 bp, Artificial Sequence
  chemically synthesized
ataaaatgtagtttaaacct

SEQ ID NO: 114185 - DNA, 20 bp, Artificial Sequence
  chemically synthesized
taaaatgtagtttaaacctt

SEQ ID NO: 114186 - DNA, 20 bp, Artificial Sequence
  chemically synthesized
atgtagtttaaaccttgggc

SEQ ID NO: 114187 - DNA, 20 bp, Artificial Sequence
  chemically synthesized
tctataaatccacttgccca

SEQ ID NO: 114188 - DNA, 20 bp, Artificial Sequence
  chemically synthesized
tagtttaaaccttgggcaag

SEQ ID NO: 114189 - DNA, 20 bp, Artificial Sequence
  chemically synthesized
ttctataaatccacttgccc

SEQ ID NO: 114190 - DNA, 20 bp, Artificial Sequence
  chemically synthesized
accttgggcaagtggattta

SEQ ID NO: 114191 - DNA, 20 bp, Artificial Sequence
  chemically synthesized
atttatagaaaatacaatat

SEQ ID NO: 114192 - DNA, 20 bp, Artificial Sequence
  chemically synthesized
gaaaatacaatattagctgc

SEQ ID NO: 114193 - DNA, 20 bp, Artificial Sequence
  chemically synthesized
aaaatacaatattagctgcc

SEQ ID NO: 114194 - DNA, 20 bp, Artificial Sequence
  chemically synthesized
aaatacaatattagctgcca

SEQ ID NO: 114195 - DNA, 20 bp, Artificial Sequence
  chemically synthesized
tacaatattagctgccaggg

SEQ ID NO: 114196 - DNA, 20 bp, Artificial Sequence
  chemically synthesized
acagtttccctcttccctgg

SEQ ID NO: 114197 - DNA, 20 bp, Artificial Sequence
  chemically synthesized
caatattagctgccagggaa

SEQ ID NO: 114198 - DNA, 20 bp, Artificial Sequence
  chemically synthesized
aatattagctgccagggaag

SEQ ID NO: 114199 - DNA, 20 bp, Artificial Sequence
  chemically synthesized
atattagctgccagggaaga

SEQ ID NO: 114200 - DNA, 20 bp, Artificial Sequence
  chemically synthesized
gagacagtttccctcttccc

SEQ ID NO: 114201 - DNA, 20 bp, Artificial Sequence
  chemically synthesized
aaattattttaaaacagaga

SEQ ID NO: 114202 - DNA, 20 bp, Artificial Sequence
  chemically synthesized
tccaaaattattttaaaaca

SEQ ID NO: 114203 - DNA, 20 bp, Artificial Sequence
  chemically synthesized
attccaaaattattttaaaa

SEQ ID NO: 114204 - DNA, 20 bp, Artificial Sequence
  chemically synthesized
tctctgttttaaaataattt

SEQ ID NO: 114205 - DNA, 20 bp, Artificial Sequence
  chemically synthesized
ttaaaataattttggaatct

SEQ ID NO: 114206 - DNA, 20 bp, Artificial Sequence
  chemically synthesized
taactataataaggttaact

SEQ ID NO: 114207 - DNA, 20 bp, Artificial Sequence
  chemically synthesized
aatcttagttaaccttatta

SEQ ID NO: 114208 - DNA, 20 bp, Artificial Sequence
  chemically synthesized
tttgcgtcttaactataata

SEQ ID NO: 114209 - DNA, 20 bp, Artificial Sequence
  chemically synthesized
atttgcgtcttaactataat

SEQ ID NO: 114210 - DNA, 20 bp, Artificial Sequence
  chemically synthesized
tagttaaccttattatagtt

SEQ ID NO: 114211 - DNA, 20 bp, Artificial Sequence
  chemically synthesized
atagttaagacgcaaatgtt

SEQ ID NO: 114212 - DNA, 20 bp, Artificial Sequence
  chemically synthesized
tagttaagacgcaaatgttg

SEQ ID NO: 114213 - DNA, 20 bp, Artificial Sequence
  chemically synthesized
gacgcaaatgttgaggtttt

SEQ ID NO: 114214 - DNA, 20 bp, Artificial Sequence
  chemically synthesized
cgcaaatgttgaggttttca

SEQ ID NO: 114215 - DNA, 20 bp, Artificial Sequence
  chemically synthesized
gcaaatgttgaggttttcag

SEQ ID NO: 114216 - DNA, 20 bp, Artificial Sequence
  chemically synthesized
tgaggttttcagaggctcta

SEQ ID NO: 114217 - DNA, 20 bp, Artificial Sequence
  chemically synthesized
gaggttttcagaggctctat

SEQ ID NO: 114218 - DNA, 20 bp, Artificial Sequence
  chemically synthesized
ggttttcagaggctctatgg

SEQ ID NO: 114219 - DNA, 20 bp, Artificial Sequence
  chemically synthesized
atccagataaaactcccata

SEQ ID NO: 114220 - DNA, 20 bp, Artificial Sequence
  chemically synthesized
aaatccagataaaactccca

SEQ ID NO: 114221 - DNA, 20 bp, Artificial Sequence
  chemically synthesized
ggctctatgggagttttatc

SEQ ID NO: 114222 - DNA, 20 bp, Artificial Sequence
  chemically synthesized
gggagttttatctggatttt

SEQ ID NO: 114223 - DNA, 20 bp, Artificial Sequence
  chemically synthesized
ctacatttattctcaaaatc

SEQ ID NO: 114224 - DNA, 20 bp, Artificial Sequence
  chemically synthesized
ctggattttgagaataaatg

SEQ ID NO: 114225 - DNA, 20 bp, Artificial Sequence
  chemically synthesized
ataaatgtagtttatcactt

SEQ ID NO: 114226 - DNA, 20 bp, Artificial Sequence
  chemically synthesized
taaatgtagtttatcacttt

SEQ ID NO: 114227 - DNA, 20 bp, Artificial Sequence
  chemically synthesized
aaatgtagtttatcactttg

SEQ ID NO: 114228 - DNA, 20 bp, Artificial Sequence
  chemically synthesized
tagtttatcactttggggtt

SEQ ID NO: 114229 - DNA, 20 bp, Artificial Sequence
  chemically synthesized
tttttactgtctcaacccca

SEQ ID NO: 114230 - DNA, 20 bp, Artificial Sequence
  chemically synthesized
ttatcactttggggttgaga

SEQ ID NO: 114231 - DNA, 20 bp, Artificial Sequence
  chemically synthesized
tttggggttgagacagtaaa

SEQ ID NO: 114232 - DNA, 20 bp, Artificial Sequence
  chemically synthesized
agagcttgggaataaggcag

SEQ ID NO: 114233 - DNA, 20 bp, Artificial Sequence
  chemically synthesized
gagagcttgggaataaggca

SEQ ID NO: 114234 - DNA, 20 bp, Artificial Sequence
  chemically synthesized
agagagcttgggaataaggc

SEQ ID NO: 114235 - DNA, 20 bp, Artificial Sequence
  chemically synthesized
gagagagcttgggaataagg

SEQ ID NO: 114236 - DNA, 20 bp, Artificial Sequence
  chemically synthesized
aaagcccctgccttattccc

SEQ ID NO: 114237 - DNA, 20 bp, Artificial Sequence
  chemically synthesized
aaagagagagcttgggaata

SEQ ID NO: 114238 - DNA, 20 bp, Artificial Sequence
  chemically synthesized
aaaagagagagcttgggaat

SEQ ID NO: 114239 - DNA, 20 bp, Artificial Sequence
  chemically synthesized
ggtagaaaaagagagagctt

SEQ ID NO: 114240 - DNA, 20 bp, Artificial Sequence
  chemically synthesized
aggtagaaaaagagagagct

SEQ ID NO: 114241 - DNA, 20 bp, Artificial Sequence
  chemically synthesized
acccgaggtagaaaaagaga

SEQ ID NO: 114242 - DNA, 20 bp, Artificial Sequence
  chemically synthesized
gtacccgaggtagaaaaaga

SEQ ID NO: 114243 - DNA, 20 bp, Artificial Sequence
  chemically synthesized
gtgtacccgaggtagaaaaa

SEQ ID NO: 114244 - DNA, 20 bp, Artificial Sequence
  chemically synthesized
cagtgtacccgaggtagaaa

SEQ ID NO: 114245 - DNA, 20 bp, Artificial Sequence
  chemically synthesized
agctctctctttttctacct

SEQ ID NO: 114246 - DNA, 20 bp, Artificial Sequence
  chemically synthesized
gctctctctttttctacctc

SEQ ID NO: 114247 - DNA, 20 bp, Artificial Sequence
  chemically synthesized
aactttcagtgtacccgagg

SEQ ID NO: 114248 - DNA, 20 bp, Artificial Sequence
  chemically synthesized
cataactttcagtgtacccg

SEQ ID NO: 114249 - DNA, 20 bp, Artificial Sequence
  chemically synthesized
acataactttcagtgtaccc

SEQ ID NO: 114250 - DNA, 20 bp, Artificial Sequence
  chemically synthesized
ttctacctcgggtacactga

SEQ ID NO: 114251 - DNA, 20 bp, Artificial Sequence
  chemically synthesized
cacatattacacataacttt

SEQ ID NO: 114252 - DNA, 20 bp, Artificial Sequence
  chemically synthesized
gttatgtgtaatatgtgcct

SEQ ID NO: 114253 - DNA, 20 bp, Artificial Sequence
  chemically synthesized
gtaatatgtgccttagctca

SEQ ID NO: 114254 - DNA, 20 bp, Artificial Sequence
  chemically synthesized
tcttttccatctttgagcta

SEQ ID NO: 114255 - DNA, 20 bp, Artificial Sequence
  chemically synthesized
ctcttttccatctttgagct

SEQ ID NO: 114256 - DNA, 20 bp, Artificial Sequence
  chemically synthesized
tatgtgccttagctcaaaga

SEQ ID NO: 114257 - DNA, 20 bp, Artificial Sequence
  chemically synthesized
ggctactcttttccatcttt

SEQ ID NO: 114258 - DNA, 20 bp, Artificial Sequence
  chemically synthesized
gccttagctcaaagatggaa

SEQ ID NO: 114259 - DNA, 20 bp, Artificial Sequence
  chemically synthesized
cttagctcaaagatggaaaa

SEQ ID NO: 114260 - DNA, 20 bp, Artificial Sequence
  chemically synthesized
agctcaaagatggaaaagag

SEQ ID NO: 114261 - DNA, 20 bp, Artificial Sequence
  chemically synthesized
cataaagtccagtgtcgatc

SEQ ID NO: 114262 - DNA, 20 bp, Artificial Sequence
  chemically synthesized
acataaagtccagtgtcgat

SEQ ID NO: 114263 - DNA, 20 bp, Artificial Sequence
  chemically synthesized
aagagtagcctgatcgacac

SEQ ID NO: 114264 - DNA, 20 bp, Artificial Sequence
  chemically synthesized
tttgttgctcacataaagtc

SEQ ID NO: 114265 - DNA, 20 bp, Artificial Sequence
  chemically synthesized
atcgacactggactttatgt

SEQ ID NO: 114266 - DNA, 20 bp, Artificial Sequence
  chemically synthesized
gtttatttgttgctcacata

SEQ ID NO: 114267 - DNA, 20 bp, Artificial Sequence
  chemically synthesized
tgtgagcaacaaataaactg

SEQ ID NO: 114268 - DNA, 20 bp, Artificial Sequence
  chemically synthesized
gcaacaaataaactgtggtt

SEQ ID NO: 114269 - DNA, 20 bp, Artificial Sequence
  chemically synthesized
ccagtggcttaaccaaacca

SEQ ID NO: 114270 - DNA, 20 bp, Artificial Sequence
  chemically synthesized
aaataaactgtggtttggtt

SEQ ID NO: 114271 - DNA, 20 bp, Artificial Sequence
  chemically synthesized
ctgtggtttggttaagccac

SEQ ID NO: 114272 - DNA, 20 bp, Artificial Sequence
  chemically synthesized
atttattcgtttttgtccag

SEQ ID NO: 114273 - DNA, 20 bp, Artificial Sequence
  chemically synthesized
tgtatttattcgtttttgtc

SEQ ID NO: 114274 - DNA, 20 bp, Artificial Sequence
  chemically synthesized
acgaataaatacattttctt

SEQ ID NO: 114275 - DNA, 20 bp, Artificial Sequence
  chemically synthesized
tagcttatcccatgttactc

SEQ ID NO: 114276 - DNA, 20 bp, Artificial Sequence
  chemically synthesized
atacattttcttgagtaaca

SEQ ID NO: 114277 - DNA, 20 bp, Artificial Sequence
  chemically synthesized
tacattttcttgagtaacat

SEQ ID NO: 114278 - DNA, 20 bp, Artificial Sequence
  chemically synthesized
tttcttgagtaacatgggat

SEQ ID NO: 114279 - DNA, 20 bp, Artificial Sequence
  chemically synthesized
tgagtaacatgggataagct

SEQ ID NO: 114280 - DNA, 20 bp, Artificial Sequence
  chemically synthesized
attatgctgagaaaatgtct

SEQ ID NO: 114281 - DNA, 20 bp, Artificial Sequence
  chemically synthesized
gataagctaagacattttct

SEQ ID NO: 114282 - DNA, 20 bp, Artificial Sequence
  chemically synthesized
aagcagttggaaattatgct

SEQ ID NO: 114283 - DNA, 20 bp, Artificial Sequence
  chemically synthesized
atctctctttcaaaagcagt

SEQ ID NO: 114284 - DNA, 20 bp, Artificial Sequence
  chemically synthesized
taatttccaactgcttttga

SEQ ID NO: 114285 - DNA, 20 bp, Artificial Sequence
  chemically synthesized
tctgatctctctttcaaaag

SEQ ID NO: 114286 - DNA, 20 bp, Artificial Sequence
  chemically synthesized
atttccaactgcttttgaaa

SEQ ID NO: 114287 - DNA, 20 bp, Artificial Sequence
  chemically synthesized
atttctgatctctctttcaa

SEQ ID NO: 114288 - DNA, 20 bp, Artificial Sequence
  chemically synthesized
ttccaactgcttttgaaaga

SEQ ID NO: 114289 - DNA, 20 bp, Artificial Sequence
  chemically synthesized
actgcttttgaaagagagat

SEQ ID NO: 114290 - DNA, 20 bp, Artificial Sequence
  chemically synthesized
gaaaataaatattttatgtt

SEQ ID NO: 114291 - DNA, 20 bp, Artificial Sequence
  chemically synthesized
ctatatttactatggaagca

SEQ ID NO: 114292 - DNA, 20 bp, Artificial Sequence
  chemically synthesized
atttattttccatgcttcca

SEQ ID NO: 114293 - DNA, 20 bp, Artificial Sequence
  chemically synthesized
cctaactatatttactatgg

SEQ ID NO: 114294 - DNA, 20 bp, Artificial Sequence
  chemically synthesized
tgtcctaactatatttacta

SEQ ID NO: 114295 - DNA, 20 bp, Artificial Sequence
  chemically synthesized
ccatgcttccatagtaaata

SEQ ID NO: 114296 - DNA, 20 bp, Artificial Sequence
  chemically synthesized
gcttccatagtaaatatagt

SEQ ID NO: 114297 - DNA, 20 bp, Artificial Sequence
  chemically synthesized
cttccatagtaaatatagtt

SEQ ID NO: 114298 - DNA, 20 bp, Artificial Sequence
  chemically synthesized
gtaaatatagttaggacaca

SEQ ID NO: 114299 - DNA, 20 bp, Artificial Sequence
  chemically synthesized
gcttctgaatcattaaaggg

SEQ ID NO: 114300 - DNA, 20 bp, Artificial Sequence
  chemically synthesized
caagcttctgaatcattaaa

SEQ ID NO: 114301 - DNA, 20 bp, Artificial Sequence
  chemically synthesized
gcaagcttctgaatcattaa

SEQ ID NO: 114302 - DNA, 20 bp, Artificial Sequence
  chemically synthesized
tgcaagcttctgaatcatta

SEQ ID NO: 114303 - DNA, 20 bp, Artificial Sequence
  chemically synthesized
gaatcttccctttaatgatt

SEQ ID NO: 114304 - DNA, 20 bp, Artificial Sequence
  chemically synthesized
tcttccctttaatgattcag

SEQ ID NO: 114305 - DNA, 20 bp, Artificial Sequence
  chemically synthesized
tttaatgattcagaagcttg

SEQ ID NO: 114306 - DNA, 20 bp, Artificial Sequence
  chemically synthesized
ttctaatctcaagaaactgc

SEQ ID NO: 114307 - DNA, 20 bp, Artificial Sequence
  chemically synthesized
tcagaagcttgcagtttctt

SEQ ID NO: 114308 - DNA, 20 bp, Artificial Sequence
  chemically synthesized
agcttgcagtttcttgagat

SEQ ID NO: 114309 - DNA, 20 bp, Artificial Sequence
  chemically synthesized
ttatctctatttctaatctc

SEQ ID NO: 114310 - DNA, 20 bp, Artificial Sequence
  chemically synthesized
cagtttcttgagattagaaa

SEQ ID NO: 114311 - DNA, 20 bp, Artificial Sequence
  chemically synthesized
gtttcttgagattagaaata

SEQ ID NO: 114312 - DNA, 20 bp, Artificial Sequence
  chemically synthesized
taaattttcattatataata

SEQ ID NO: 114313 - DNA, 20 bp, Artificial Sequence
  chemically synthesized
attttcattatataatacag

SEQ ID NO: 114314 - DNA, 20 bp, Artificial Sequence
  chemically synthesized
agatataaatacaaattgta

SEQ ID NO: 114315 - DNA, 20 bp, Artificial Sequence
  chemically synthesized
tataaatacaaattgtatag

SEQ ID NO: 114316 - DNA, 20 bp, Artificial Sequence
  chemically synthesized
acaaattgtatagtagaaaa

SEQ ID NO: 114317 - DNA, 20 bp, Artificial Sequence
  chemically synthesized
gacgtatttttgccctcaac

SEQ ID NO: 114318 - DNA, 20 bp, Artificial Sequence
  chemically synthesized
atatctttaaatctagttga

SEQ ID NO: 114319 - DNA, 20 bp, Artificial Sequence
  chemically synthesized
catatctttaaatctagttg

SEQ ID NO: 114320 - DNA, 20 bp, Artificial Sequence
  chemically synthesized
acatatctttaaatctagtt

SEQ ID NO: 114321 - DNA, 20 bp, Artificial Sequence
  chemically synthesized
tttgccctcaactagattta

SEQ ID NO: 114322 - DNA, 20 bp, Artificial Sequence
  chemically synthesized
ataaaacatatctttaaatc

SEQ ID NO: 114323 - DNA, 20 bp, Artificial Sequence
  chemically synthesized
taaaaaattattttatgtca

SEQ ID NO: 114324 - DNA, 20 bp, Artificial Sequence
  chemically synthesized
ctaaaaaattattttatgtc

SEQ ID NO: 114325 - DNA, 20 bp, Artificial Sequence
  chemically synthesized
actaaaaaattattttatgt

SEQ ID NO: 114326 - DNA, 20 bp, Artificial Sequence
  chemically synthesized
cctgacataaaataattttt

SEQ ID NO: 114327 - DNA, 20 bp, Artificial Sequence
  chemically synthesized
taaaataattttttagtcat

SEQ ID NO: 114328 - DNA, 20 bp, Artificial Sequence
  chemically synthesized
aaaataattttttagtcatt

SEQ ID NO: 114329 - DNA, 20 bp, Artificial Sequence
  chemically synthesized
gcagattactttgaaaaata

SEQ ID NO: 114330 - DNA, 20 bp, Artificial Sequence
  chemically synthesized
gggttattctttatttttca

SEQ ID NO: 114331 - DNA, 20 bp, Artificial Sequence
  chemically synthesized
tcaaagtaatctgctaaaaa

SEQ ID NO: 114332 - DNA, 20 bp, Artificial Sequence
  chemically synthesized
ctattttagtctatttttag

SEQ ID NO: 114333 - DNA, 20 bp, Artificial Sequence
  chemically synthesized
agtctattttagtctatttt

SEQ ID NO: 114334 - DNA, 20 bp, Artificial Sequence
  chemically synthesized
ctgctaaaaatagactaaaa

SEQ ID NO: 114335 - DNA, 20 bp, Artificial Sequence
  chemically synthesized
agctttgattaagtctattt

SEQ ID NO: 114336 - DNA, 20 bp, Artificial Sequence
  chemically synthesized
gactaaaatagacttaatca

SEQ ID NO: 114337 - DNA, 20 bp, Artificial Sequence
  chemically synthesized
gtaaataataagctttgatt

SEQ ID NO: 114338 - DNA, 20 bp, Artificial Sequence
  chemically synthesized
agctatggtaggtaaataat

SEQ ID NO: 114339 - DNA, 20 bp, Artificial Sequence
  chemically synthesized
agcttattatttacctacca

SEQ ID NO: 114340 - DNA, 20 bp, Artificial Sequence
  chemically synthesized
ttttacccatcagctatggt

SEQ ID NO: 114341 - DNA, 20 bp, Artificial Sequence
  chemically synthesized
attttacccatcagctatgg

SEQ ID NO: 114342 - DNA, 20 bp, Artificial Sequence
  chemically synthesized
tatttacctaccatagctga

SEQ ID NO: 114343 - DNA, 20 bp, Artificial Sequence
  chemically synthesized
tacattttacccatcagcta

SEQ ID NO: 114344 - DNA, 20 bp, Artificial Sequence
  chemically synthesized
atttacctaccatagctgat

SEQ ID NO: 114345 - DNA, 20 bp, Artificial Sequence
  chemically synthesized
tgggtttacattttacccat

SEQ ID NO: 114346 - DNA, 20 bp, Artificial Sequence
  chemically synthesized
ataaataaataaaaatacat

SEQ ID NO: 114347 - DNA, 20 bp, Artificial Sequence
  chemically synthesized
aataaataaataaaaataca

SEQ ID NO: 114348 - DNA, 20 bp, Artificial Sequence
  chemically synthesized
tttatttatttatttgtttt

SEQ ID NO: 114349 - DNA, 20 bp, Artificial Sequence
  chemically synthesized
tatttatttgttttgagatg

SEQ ID NO: 114350 - DNA, 20 bp, Artificial Sequence
  chemically synthesized
tccagcctgggtgacaaagt

SEQ ID NO: 114351 - DNA, 20 bp, Artificial Sequence
  chemically synthesized
tgaagtctcactttgtcacc

SEQ ID NO: 114352 - DNA, 20 bp, Artificial Sequence
  chemically synthesized
gcactccagcctgggtgaca

SEQ ID NO: 114353 - DNA, 20 bp, Artificial Sequence
  chemically synthesized
gaagtctcactttgtcaccc

SEQ ID NO: 114354 - DNA, 20 bp, Artificial Sequence
  chemically synthesized
tctcactttgtcacccaggc

SEQ ID NO: 114355 - DNA, 20 bp, Artificial Sequence
  chemically synthesized
tcactttgtcacccaggctg

SEQ ID NO: 114356 - DNA, 20 bp, Artificial Sequence
  chemically synthesized
gcgccactgcactccagcct

SEQ ID NO: 114357 - DNA, 20 bp, Artificial Sequence
  chemically synthesized
ggcgccactgcactccagcc

SEQ ID NO: 114358 - DNA, 20 bp, Artificial Sequence
  chemically synthesized
ttgtcacccaggctggagtg

SEQ ID NO: 114359 - DNA, 20 bp, Artificial Sequence
  chemically synthesized
gaggtggcgccactgcactc

SEQ ID NO: 114360 - DNA, 20 bp, Artificial Sequence
  chemically synthesized
tcacccaggctggagtgcag

SEQ ID NO: 114361 - DNA, 20 bp, Artificial Sequence
  chemically synthesized
ggagtgcagtggcgccacct

SEQ ID NO: 114362 - DNA, 20 bp, Artificial Sequence
  chemically synthesized
gaggttgcagtgagccgagg

SEQ ID NO: 114363 - DNA, 20 bp, Artificial Sequence
  chemically synthesized
gcagaggttgcagtgagccg

SEQ ID NO: 114364 - DNA, 20 bp, Artificial Sequence
  chemically synthesized
ggcagaggttgcagtgagcc

SEQ ID NO: 114365 - DNA, 20 bp, Artificial Sequence
  chemically synthesized
caggaggcagaggttgcagt

SEQ ID NO: 114366 - DNA, 20 bp, Artificial Sequence
  chemically synthesized
aacccaggaggcagaggttg

SEQ ID NO: 114367 - DNA, 20 bp, Artificial Sequence
  chemically synthesized
cgcttgaacccaggaggcag

SEQ ID NO: 114368 - DNA, 20 bp, Artificial Sequence
  chemically synthesized
tcactgcaacctctgcctcc

SEQ ID NO: 114369 - DNA, 20 bp, Artificial Sequence
  chemically synthesized
tcgcttgaacccaggaggca

SEQ ID NO: 114370 - DNA, 20 bp, Artificial Sequence
  chemically synthesized
cactgcaacctctgcctcct

SEQ ID NO: 114371 - DNA, 20 bp, Artificial Sequence
  chemically synthesized
aatcgcttgaacccaggagg

SEQ ID NO: 114372 - DNA, 20 bp, Artificial Sequence
  chemically synthesized
gagaatcgcttgaacccagg

SEQ ID NO: 114373 - DNA, 20 bp, Artificial Sequence
  chemically synthesized
ggagaatcgcttgaacccag

SEQ ID NO: 114374 - DNA, 20 bp, Artificial Sequence
  chemically synthesized
aacctctgcctcctgggttc

SEQ ID NO: 114375 - DNA, 20 bp, Artificial Sequence
  chemically synthesized
tgggagaatcgcttgaaccc

SEQ ID NO: 114376 - DNA, 20 bp, Artificial Sequence
  chemically synthesized
gtgggagaatcgcttgaacc

SEQ ID NO: 114377 - DNA, 20 bp, Artificial Sequence
  chemically synthesized
ttcaagcgattctcccacct

SEQ ID NO: 114378 - DNA, 20 bp, Artificial Sequence
  chemically synthesized
tacttgggaggctgaggtgg

SEQ ID NO: 114379 - DNA, 20 bp, Artificial Sequence
  chemically synthesized
gctacttgggaggctgaggt

SEQ ID NO: 114380 - DNA, 20 bp, Artificial Sequence
  chemically synthesized
agctacttgggaggctgagg

SEQ ID NO: 114381 - DNA, 20 bp, Artificial Sequence
  chemically synthesized
cctagctacttgggaggctg

SEQ ID NO: 114382 - DNA, 20 bp, Artificial Sequence
  chemically synthesized
tcctagctacttgggaggct

SEQ ID NO: 114383 - DNA, 20 bp, Artificial Sequence
  chemically synthesized
ttctcccacctcagcctccc

SEQ ID NO: 114384 - DNA, 20 bp, Artificial Sequence
  chemically synthesized
tcccacctcagcctcccaag

SEQ ID NO: 114385 - DNA, 20 bp, Artificial Sequence
  chemically synthesized
tgtaatcctagctacttggg

SEQ ID NO: 114386 - DNA, 20 bp, Artificial Sequence
  chemically synthesized
ctgtaatcctagctacttgg

SEQ ID NO: 114387 - DNA, 20 bp, Artificial Sequence
  chemically synthesized
acctcagcctcccaagtagc

SEQ ID NO: 114388 - DNA, 20 bp, Artificial Sequence
  chemically synthesized
gcctgtaatcctagctactt

SEQ ID NO: 114389 - DNA, 20 bp, Artificial Sequence
  chemically synthesized
cctcagcctcccaagtagct

SEQ ID NO: 114390 - DNA, 20 bp, Artificial Sequence
  chemically synthesized
cgcctgtaatcctagctact

SEQ ID NO: 114391 - DNA, 20 bp, Artificial Sequence
  chemically synthesized
ctcccaagtagctaggatta

SEQ ID NO: 114392 - DNA, 20 bp, Artificial Sequence
  chemically synthesized
tcccaagtagctaggattac

SEQ ID NO: 114393 - DNA, 20 bp, Artificial Sequence
  chemically synthesized
gtgacctgcgcctgtaatcc

SEQ ID NO: 114394 - DNA, 20 bp, Artificial Sequence
  chemically synthesized
agtagctaggattacaggcg

SEQ ID NO: 114395 - DNA, 20 bp, Artificial Sequence
  chemically synthesized
gtagctaggattacaggcgc

SEQ ID NO: 114396 - DNA, 20 bp, Artificial Sequence
  chemically synthesized
caggcgcaggtcaccatacc

SEQ ID NO: 114397 - DNA, 20 bp, Artificial Sequence
  chemically synthesized
atacaaaaattagctgggta

SEQ ID NO: 114398 - DNA, 20 bp, Artificial Sequence
  chemically synthesized
taaaaatacaaaaattagct

SEQ ID NO: 114399 - DNA, 20 bp, Artificial Sequence
  chemically synthesized
ctaaaaatacaaaaattagc

SEQ ID NO: 114400 - DNA, 20 bp, Artificial Sequence
  chemically synthesized
tctactaaaaatacaaaaat

SEQ ID NO: 114401 - DNA, 20 bp, Artificial Sequence
  chemically synthesized
ccagctaatttttgtatttt

SEQ ID NO: 114402 - DNA, 20 bp, Artificial Sequence
  chemically synthesized
gctaatttttgtatttttag

SEQ ID NO: 114403 - DNA, 20 bp, Artificial Sequence
  chemically synthesized
taatttttgtatttttagta

SEQ ID NO: 114404 - DNA, 20 bp, Artificial Sequence
  chemically synthesized
ttttgtatttttagtagaga

SEQ ID NO: 114405 - DNA, 20 bp, Artificial Sequence
  chemically synthesized
tttgtatttttagtagagat

SEQ ID NO: 114406 - DNA, 20 bp, Artificial Sequence
  chemically synthesized
ttgtatttttagtagagatg

SEQ ID NO: 114407 - DNA, 20 bp, Artificial Sequence
  chemically synthesized
gagatggggtttcgccatgt

SEQ ID NO: 114408 - DNA, 20 bp, Artificial Sequence
  chemically synthesized
tggggtttcgccatgttggc

SEQ ID NO: 114409 - DNA, 20 bp, Artificial Sequence
  chemically synthesized
cgagaccagcctggccaaca

SEQ ID NO: 114410 - DNA, 20 bp, Artificial Sequence
  chemically synthesized
ggggtttcgccatgttggcc

SEQ ID NO: 114411 - DNA, 20 bp, Artificial Sequence
  chemically synthesized
tttcgccatgttggccaggc

SEQ ID NO: 114412 - DNA, 20 bp, Artificial Sequence
  chemically synthesized
tcaggagttcgagaccagcc

SEQ ID NO: 114413 - DNA, 20 bp, Artificial Sequence
  chemically synthesized
tgaagtcaggagttcgagac

SEQ ID NO: 114414 - DNA, 20 bp, Artificial Sequence
  chemically synthesized
tcacctgaagtcaggagttc

SEQ ID NO: 114415 - DNA, 20 bp, Artificial Sequence
  chemically synthesized
tggtctcgaactcctgactt

SEQ ID NO: 114416 - DNA, 20 bp, Artificial Sequence
  chemically synthesized
ggtggatcacctgaagtcag

SEQ ID NO: 114417 - DNA, 20 bp, Artificial Sequence
  chemically synthesized
ggtctcgaactcctgacttc

SEQ ID NO: 114418 - DNA, 20 bp, Artificial Sequence
  chemically synthesized
tgggtggatcacctgaagtc

SEQ ID NO: 114419 - DNA, 20 bp, Artificial Sequence
  chemically synthesized
gtgggtggatcacctgaagt

SEQ ID NO: 114420 - DNA, 20 bp, Artificial Sequence
  chemically synthesized
cgaggtgggtggatcacctg

SEQ ID NO: 114421 - DNA, 20 bp, Artificial Sequence
  chemically synthesized
ttcaggtgatccacccacct

SEQ ID NO: 114422 - DNA, 20 bp, Artificial Sequence
  chemically synthesized
ctttgggaggccgaggtggg

SEQ ID NO: 114423 - DNA, 20 bp, Artificial Sequence
  chemically synthesized
gcactttgggaggccgaggt

SEQ ID NO: 114424 - DNA, 20 bp, Artificial Sequence
  chemically synthesized
agcactttgggaggccgagg

SEQ ID NO: 114425 - DNA, 20 bp, Artificial Sequence
  chemically synthesized
cccagcactttgggaggccg

SEQ ID NO: 114426 - DNA, 20 bp, Artificial Sequence
  chemically synthesized
ccccagcactttgggaggcc

SEQ ID NO: 114427 - DNA, 20 bp, Artificial Sequence
  chemically synthesized
ccacccacctcggcctccca

SEQ ID NO: 114428 - DNA, 20 bp, Artificial Sequence
  chemically synthesized
tgtaaccccagcactttggg

SEQ ID NO: 114429 - DNA, 20 bp, Artificial Sequence
  chemically synthesized
ctgtaaccccagcactttgg

SEQ ID NO: 114430 - DNA, 20 bp, Artificial Sequence
  chemically synthesized
acctcggcctcccaaagtgc

SEQ ID NO: 114431 - DNA, 20 bp, Artificial Sequence
  chemically synthesized
gcctgtaaccccagcacttt

SEQ ID NO: 114432 - DNA, 20 bp, Artificial Sequence
  chemically synthesized
cctcggcctcccaaagtgct

SEQ ID NO: 114433 - DNA, 20 bp, Artificial Sequence
  chemically synthesized
tgcctgtaaccccagcactt

SEQ ID NO: 114434 - DNA, 20 bp, Artificial Sequence
  chemically synthesized
ctcggcctcccaaagtgctg

SEQ ID NO: 114435 - DNA, 20 bp, Artificial Sequence
  chemically synthesized
ctcccaaagtgctggggtta

SEQ ID NO: 114436 - DNA, 20 bp, Artificial Sequence
  chemically synthesized
tcccaaagtgctggggttac

SEQ ID NO: 114437 - DNA, 20 bp, Artificial Sequence
  chemically synthesized
gtggctcatgcctgtaaccc

SEQ ID NO: 114438 - DNA, 20 bp, Artificial Sequence
  chemically synthesized
agtgctggggttacaggcat

SEQ ID NO: 114439 - DNA, 20 bp, Artificial Sequence
  chemically synthesized
caggcatgagccaccgcatc

SEQ ID NO: 114440 - DNA, 20 bp, Artificial Sequence
  chemically synthesized
ggtttcccggccagatgcgg

SEQ ID NO: 114441 - DNA, 20 bp, Artificial Sequence
  chemically synthesized
gtgggtttcccggccagatg

SEQ ID NO: 114442 - DNA, 20 bp, Artificial Sequence
  chemically synthesized
catgagccaccgcatctggc

SEQ ID NO: 114443 - DNA, 20 bp, Artificial Sequence
  chemically synthesized
atgagccaccgcatctggcc

SEQ ID NO: 114444 - DNA, 20 bp, Artificial Sequence
  chemically synthesized
agatatgtgggtttcccggc

SEQ ID NO: 114445 - DNA, 20 bp, Artificial Sequence
  chemically synthesized
taatagatatgtgggtttcc

SEQ ID NO: 114446 - DNA, 20 bp, Artificial Sequence
  chemically synthesized
cagaattttaatagatatgt

SEQ ID NO: 114447 - DNA, 20 bp, Artificial Sequence
  chemically synthesized
ccagaattttaatagatatg

SEQ ID NO: 114448 - DNA, 20 bp, Artificial Sequence
  chemically synthesized
aagctactccagaattttaa

SEQ ID NO: 114449 - DNA, 20 bp, Artificial Sequence
  chemically synthesized
ccacatatctattaaaattc

SEQ ID NO: 114450 - DNA, 20 bp, Artificial Sequence
  chemically synthesized
acatatctattaaaattctg

SEQ ID NO: 114451 - DNA, 20 bp, Artificial Sequence
  chemically synthesized
tatctattaaaattctggag

SEQ ID NO: 114452 - DNA, 20 bp, Artificial Sequence
  chemically synthesized
aaatgctgataaagctactc

SEQ ID NO: 114453 - DNA, 20 bp, Artificial Sequence
  chemically synthesized
aaattctggagtagctttat

SEQ ID NO: 114454 - DNA, 20 bp, Artificial Sequence
  chemically synthesized
aaatattataaatgctgata

SEQ ID NO: 114455 - DNA, 20 bp, Artificial Sequence
  chemically synthesized
ataaaattttatttatgaaa

SEQ ID NO: 114456 - DNA, 20 bp, Artificial Sequence
  chemically synthesized
ttttatttatgaaatagcct

SEQ ID NO: 114457 - DNA, 20 bp, Artificial Sequence
  chemically synthesized
cactgtaatatatttggctt

SEQ ID NO: 114458 - DNA, 20 bp, Artificial Sequence
  chemically synthesized
ccactgtaatatatttggct

SEQ ID NO: 114459 - DNA, 20 bp, Artificial Sequence
  chemically synthesized
atgtaccactgtaatatatt

SEQ ID NO: 114460 - DNA, 20 bp, Artificial Sequence
  chemically synthesized
agcctaagccaaatatatta

SEQ ID NO: 114461 - DNA, 20 bp, Artificial Sequence
  chemically synthesized
ctaagccaaatatattacag

SEQ ID NO: 114462 - DNA, 20 bp, Artificial Sequence
  chemically synthesized
ctcactcttcgatgtatggt

SEQ ID NO: 114463 - DNA, 20 bp, Artificial Sequence
  chemically synthesized
cattgtctaaccatacatcg

SEQ ID NO: 114464 - DNA, 20 bp, Artificial Sequence
  chemically synthesized
tttgctcactcttcgatgta

SEQ ID NO: 114465 - DNA, 20 bp, Artificial Sequence
  chemically synthesized
ttgtctaaccatacatcgaa

SEQ ID NO: 114466 - DNA, 20 bp, Artificial Sequence
  chemically synthesized
ctaaccatacatcgaagagt

SEQ ID NO: 114467 - DNA, 20 bp, Artificial Sequence
  chemically synthesized
ataagggcaatgcaaatgta

SEQ ID NO: 114468 - DNA, 20 bp, Artificial Sequence
  chemically synthesized
atataagggcaatgcaaatg

SEQ ID NO: 114469 - DNA, 20 bp, Artificial Sequence
  chemically synthesized
tggcttgtgatagaatataa

SEQ ID NO: 114470 - DNA, 20 bp, Artificial Sequence
  chemically synthesized
atggcttgtgatagaatata

SEQ ID NO: 114471 - DNA, 20 bp, Artificial Sequence
  chemically synthesized
catggcttgtgatagaatat

SEQ ID NO: 114472 - DNA, 20 bp, Artificial Sequence
  chemically synthesized
ttgcccttatattctatcac

SEQ ID NO: 114473 - DNA, 20 bp, Artificial Sequence
  chemically synthesized
atatctcccatggcttgtga

SEQ ID NO: 114474 - DNA, 20 bp, Artificial Sequence
  chemically synthesized
ttatattctatcacaagcca

SEQ ID NO: 114475 - DNA, 20 bp, Artificial Sequence
  chemically synthesized
tatattctatcacaagccat

SEQ ID NO: 114476 - DNA, 20 bp, Artificial Sequence
  chemically synthesized
tattctatcacaagccatgg

SEQ ID NO: 114477 - DNA, 20 bp, Artificial Sequence
  chemically synthesized
gactttatagatatctccca

SEQ ID NO: 114478 - DNA, 20 bp, Artificial Sequence
  chemically synthesized
agccatgggagatatctata

SEQ ID NO: 114479 - DNA, 20 bp, Artificial Sequence
  chemically synthesized
tggaacagtatcagacttta

SEQ ID NO: 114480 - DNA, 20 bp, Artificial Sequence
  chemically synthesized
taatttgtttggaacagtat

SEQ ID NO: 114481 - DNA, 20 bp, Artificial Sequence
  chemically synthesized
tggaggtaatttgtttggaa

SEQ ID NO: 114482 - DNA, 20 bp, Artificial Sequence
  chemically synthesized
tcatttggaggtaatttgtt

SEQ ID NO: 114483 - DNA, 20 bp, Artificial Sequence
  chemically synthesized
gagttagtttgatcatttgg

SEQ ID NO: 114484 - DNA, 20 bp, Artificial Sequence
  chemically synthesized
tgagttagtttgatcatttg

SEQ ID NO: 114485 - DNA, 20 bp, Artificial Sequence
  chemically synthesized
gttgagttagtttgatcatt

SEQ ID NO: 114486 - DNA, 20 bp, Artificial Sequence
  chemically synthesized
ctccaaaatgcgtgttgagt

SEQ ID NO: 114487 - DNA, 20 bp, Artificial Sequence
  chemically synthesized
tctcctccaaaatgcgtgtt

SEQ ID NO: 114488 - DNA, 20 bp, Artificial Sequence
  chemically synthesized
aactaactcaacacgcattt

SEQ ID NO: 114489 - DNA, 20 bp, Artificial Sequence
  chemically synthesized
ctaactcaacacgcattttg

SEQ ID NO: 114490 - DNA, 20 bp, Artificial Sequence
  chemically synthesized
taactcaacacgcattttgg

SEQ ID NO: 114491 - DNA, 20 bp, Artificial Sequence
  chemically synthesized
actcaacacgcattttggag

SEQ ID NO: 114492 - DNA, 20 bp, Artificial Sequence
  chemically synthesized
aacacgcattttggaggaga

SEQ ID NO: 114493 - DNA, 20 bp, Artificial Sequence
  chemically synthesized
acgcattttggaggagaaag

SEQ ID NO: 114494 - DNA, 20 bp, Artificial Sequence
  chemically synthesized
cgcattttggaggagaaagt

SEQ ID NO: 114495 - DNA, 20 bp, Artificial Sequence
  chemically synthesized
gcattttggaggagaaagtg

SEQ ID NO: 114496 - DNA, 20 bp, Artificial Sequence
  chemically synthesized
tggaggagaaagtggggtca

SEQ ID NO: 114497 - DNA, 20 bp, Artificial Sequence
  chemically synthesized
aggagaaagtggggtcaaag

SEQ ID NO: 114498 - DNA, 20 bp, Artificial Sequence
  chemically synthesized
ggagaaagtggggtcaaagc

SEQ ID NO: 114499 - DNA, 20 bp, Artificial Sequence
  chemically synthesized
ggggtcaaagcaggatgatg

SEQ ID NO: 114500 - DNA, 20 bp, Artificial Sequence
  chemically synthesized
tcaaagcaggatgatgaagc

SEQ ID NO: 114501 - DNA, 20 bp, Artificial Sequence
  chemically synthesized
tgaagcaagaacgataaatt

SEQ ID NO: 114502 - DNA, 20 bp, Artificial Sequence
  chemically synthesized
gaagcaagaacgataaattc

SEQ ID NO: 114503 - DNA, 20 bp, Artificial Sequence
  chemically synthesized
agcaagaacgataaattcag

SEQ ID NO: 114504 - DNA, 20 bp, Artificial Sequence
  chemically synthesized
tacgtaacagtggcaatgta

SEQ ID NO: 114505 - DNA, 20 bp, Artificial Sequence
  chemically synthesized
ttgcatagagtacgtaacag

SEQ ID NO: 114506 - DNA, 20 bp, Artificial Sequence
  chemically synthesized
ctgttgcatagagtacgtaa

SEQ ID NO: 114507 - DNA, 20 bp, Artificial Sequence
  chemically synthesized
ctgttacgtactctatgcaa

SEQ ID NO: 114508 - DNA, 20 bp, Artificial Sequence
  chemically synthesized
ctttgctgctctgttgcata

SEQ ID NO: 114509 - DNA, 20 bp, Artificial Sequence
  chemically synthesized
gttacgtactctatgcaaca

SEQ ID NO: 114510 - DNA, 20 bp, Artificial Sequence
  chemically synthesized
tactttgctgctctgttgca

SEQ ID NO: 114511 - DNA, 20 bp, Artificial Sequence
  chemically synthesized
acgtactctatgcaacagag

SEQ ID NO: 114512 - DNA, 20 bp, Artificial Sequence
  chemically synthesized
ctctatgcaacagagcagca

SEQ ID NO: 114513 - DNA, 20 bp, Artificial Sequence
  chemically synthesized
tatgcaacagagcagcaaag

SEQ ID NO: 114514 - DNA, 20 bp, Artificial Sequence
  chemically synthesized
gtttttcttttttgatatga

SEQ ID NO: 114515 - DNA, 20 bp, Artificial Sequence
  chemically synthesized
gatcaactatcatatcaaaa

SEQ ID NO: 114516 - DNA, 20 bp, Artificial Sequence
  chemically synthesized
atcatatcaaaaaagaaaaa

SEQ ID NO: 114517 - DNA, 20 bp, Artificial Sequence
  chemically synthesized
tcatatcaaaaaagaaaaac

SEQ ID NO: 114518 - DNA, 20 bp, Artificial Sequence
  chemically synthesized
atatcaaaaaagaaaaacag

SEQ ID NO: 114519 - DNA, 20 bp, Artificial Sequence
  chemically synthesized
tcaaaaaagaaaaacaggag

SEQ ID NO: 114520 - DNA, 20 bp, Artificial Sequence
  chemically synthesized
caaaaaagaaaaacaggaga

SEQ ID NO: 114521 - DNA, 20 bp, Artificial Sequence
  chemically synthesized
aaaaagaaaaacaggagaag

SEQ ID NO: 114522 - DNA, 20 bp, Artificial Sequence
  chemically synthesized
aaacaggagaaggagaacga

SEQ ID NO: 114523 - DNA, 20 bp, Artificial Sequence
  chemically synthesized
aacaggagaaggagaacgat

SEQ ID NO: 114524 - DNA, 20 bp, Artificial Sequence
  chemically synthesized
caggagaaggagaacgatag

SEQ ID NO: 114525 - DNA, 20 bp, Artificial Sequence
  chemically synthesized
aggagaaggagaacgatagg

SEQ ID NO: 114526 - DNA, 20 bp, Artificial Sequence
  chemically synthesized
ggagaaggagaacgatagga

SEQ ID NO: 114527 - DNA, 20 bp, Artificial Sequence
  chemically synthesized
agaaggagaacgataggagg

SEQ ID NO: 114528 - DNA, 20 bp, Artificial Sequence
  chemically synthesized
aaggagaacgataggaggga

SEQ ID NO: 114529 - DNA, 20 bp, Artificial Sequence
  chemically synthesized
aggagaacgataggagggag

SEQ ID NO: 114530 - DNA, 20 bp, Artificial Sequence
  chemically synthesized
gagaacgataggagggagag

SEQ ID NO: 114531 - DNA, 20 bp, Artificial Sequence
  chemically synthesized
aacgataggagggagaggag

SEQ ID NO: 114532 - DNA, 20 bp, Artificial Sequence
  chemically synthesized
aatcaaatcataataagcag

SEQ ID NO: 114533 - DNA, 20 bp, Artificial Sequence
  chemically synthesized
cagaatcaaatcataataag

SEQ ID NO: 114534 - DNA, 20 bp, Artificial Sequence
  chemically synthesized
ttccagaatcaaatcataat

SEQ ID NO: 114535 - DNA, 20 bp, Artificial Sequence
  chemically synthesized
tgcttattatgatttgattc

SEQ ID NO: 114536 - DNA, 20 bp, Artificial Sequence
  chemically synthesized
tattctagtttgaataattc

SEQ ID NO: 114537 - DNA, 20 bp, Artificial Sequence
  chemically synthesized
gattctggaattattcaaac

SEQ ID NO: 114538 - DNA, 20 bp, Artificial Sequence
  chemically synthesized
ctattatgaaaagtatattc

SEQ ID NO: 114539 - DNA, 20 bp, Artificial Sequence
  chemically synthesized
ctagaatatacttttcataa

SEQ ID NO: 114540 - DNA, 20 bp, Artificial Sequence
  chemically synthesized
tatttttaaactattatgaa

SEQ ID NO: 114541 - DNA, 20 bp, Artificial Sequence
  chemically synthesized
atagtttaaaaatatcataa

SEQ ID NO: 114542 - DNA, 20 bp, Artificial Sequence
  chemically synthesized
atatcataatagtttcataa

SEQ ID NO: 114543 - DNA, 20 bp, Artificial Sequence
  chemically synthesized
ttcataatagtttttcataa

SEQ ID NO: 114544 - DNA, 20 bp, Artificial Sequence
  chemically synthesized
tttaaaaatatcaaaaaata

SEQ ID NO: 114545 - DNA, 20 bp, Artificial Sequence
  chemically synthesized
aaaatatcaaaaaataaagt

SEQ ID NO: 114546 - DNA, 20 bp, Artificial Sequence
  chemically synthesized
taataagatgattgattttt

SEQ ID NO: 114547 - DNA, 20 bp, Artificial Sequence
  chemically synthesized
tggatataaatcattataat

SEQ ID NO: 114548 - DNA, 20 bp, Artificial Sequence
  chemically synthesized
ctagtctctcaaatacaatt

SEQ ID NO: 114549 - DNA, 20 bp, Artificial Sequence
  chemically synthesized
tttatatccaaattgtattt

SEQ ID NO: 114550 - DNA, 20 bp, Artificial Sequence
  chemically synthesized
tatatccaaattgtatttga

SEQ ID NO: 114551 - DNA, 20 bp, Artificial Sequence
  chemically synthesized
ccaaattgtatttgagagac

SEQ ID NO: 114552 - DNA, 20 bp, Artificial Sequence
  chemically synthesized
ttgtatttgagagactagta

SEQ ID NO: 114553 - DNA, 20 bp, Artificial Sequence
  chemically synthesized
acttgatataataactttac

SEQ ID NO: 114554 - DNA, 20 bp, Artificial Sequence
  chemically synthesized
actagtaaagttattatatc

SEQ ID NO: 114555 - DNA, 20 bp, Artificial Sequence
  chemically synthesized
gtaaagttattatatcaagt

SEQ ID NO: 114556 - DNA, 20 bp, Artificial Sequence
  chemically synthesized
ggagttttgttatgtatagt

SEQ ID NO: 114557 - DNA, 20 bp, Artificial Sequence
  chemically synthesized
ttatggagttttgttatgta

SEQ ID NO: 114558 - DNA, 20 bp, Artificial Sequence
  chemically synthesized
tacataacaaaactccataa

SEQ ID NO: 114559 - DNA, 20 bp, Artificial Sequence
  chemically synthesized
aattttcctgaactattatg

SEQ ID NO: 114560 - DNA, 20 bp, Artificial Sequence
  chemically synthesized
ataattttcctgaactatta

SEQ ID NO: 114561 - DNA, 20 bp, Artificial Sequence
  chemically synthesized
aacaaaactccataatagtt

SEQ ID NO: 114562 - DNA, 20 bp, Artificial Sequence
  chemically synthesized
acaaaactccataatagttc

SEQ ID NO: 114563 - DNA, 20 bp, Artificial Sequence
  chemically synthesized
atagttcaggaaaattatat

SEQ ID NO: 114564 - DNA, 20 bp, Artificial Sequence
  chemically synthesized
tagttcaggaaaattatatc

SEQ ID NO: 114565 - DNA, 20 bp, Artificial Sequence
  chemically synthesized
ggaaaattatatcaggtatt

SEQ ID NO: 114566 - DNA, 20 bp, Artificial Sequence
  chemically synthesized
aggtattgagaataaacttt

SEQ ID NO: 114567 - DNA, 20 bp, Artificial Sequence
  chemically synthesized
gtattgagaataaactttaa

SEQ ID NO: 114568 - DNA, 20 bp, Artificial Sequence
  chemically synthesized
gtagtacaaggaggctctta

SEQ ID NO: 114569 - DNA, 20 bp, Artificial Sequence
  chemically synthesized
tcatattctgtagtacaagg

SEQ ID NO: 114570 - DNA, 20 bp, Artificial Sequence
  chemically synthesized
atcatattctgtagtacaag

SEQ ID NO: 114571 - DNA, 20 bp, Artificial Sequence
  chemically synthesized
ttaagagcctccttgtacta

SEQ ID NO: 114572 - DNA, 20 bp, Artificial Sequence
  chemically synthesized
gaatcatattctgtagtaca

SEQ ID NO: 114573 - DNA, 20 bp, Artificial Sequence
  chemically synthesized
agaatcatattctgtagtac

SEQ ID NO: 114574 - DNA, 20 bp, Artificial Sequence
  chemically synthesized
ttggtgagaatcatattctg

SEQ ID NO: 114575 - DNA, 20 bp, Artificial Sequence
  chemically synthesized
tacagaatatgattctcacc

SEQ ID NO: 114576 - DNA, 20 bp, Artificial Sequence
  chemically synthesized
tgtttaaatgaagtcttggt

SEQ ID NO: 114577 - DNA, 20 bp, Artificial Sequence
  chemically synthesized
gttttgtttaaatgaagtct

SEQ ID NO: 114578 - DNA, 20 bp, Artificial Sequence
  chemically synthesized
ggggtagttttgtttaaatg

SEQ ID NO: 114579 - DNA, 20 bp, Artificial Sequence
  chemically synthesized
agtgaaaacagaacgtgggg

SEQ ID NO: 114580 - DNA, 20 bp, Artificial Sequence
  chemically synthesized
aacagtgaaaacagaacgtg

SEQ ID NO: 114581 - DNA, 20 bp, Artificial Sequence
  chemically synthesized
aaacagtgaaaacagaacgt

SEQ ID NO: 114582 - DNA, 20 bp, Artificial Sequence
  chemically synthesized
taaacagtgaaaacagaacg

SEQ ID NO: 114583 - DNA, 20 bp, Artificial Sequence
  chemically synthesized
atatgcataaacagtgaaaa

SEQ ID NO: 114584 - DNA, 20 bp, Artificial Sequence
  chemically synthesized
taaagttccatatgcataaa

SEQ ID NO: 114585 - DNA, 20 bp, Artificial Sequence
  chemically synthesized
gttttcactgtttatgcata

SEQ ID NO: 114586 - DNA, 20 bp, Artificial Sequence
  chemically synthesized
tttatgcatatggaacttta

SEQ ID NO: 114587 - DNA, 20 bp, Artificial Sequence
  chemically synthesized
aaacaaaaattatttccata

SEQ ID NO: 114588 - DNA, 20 bp, Artificial Sequence
  chemically synthesized
atggaaataatttttgtttc

SEQ ID NO: 114589 - DNA, 20 bp, Artificial Sequence
  chemically synthesized
tggaaataatttttgtttct

SEQ ID NO: 114590 - DNA, 20 bp, Artificial Sequence
  chemically synthesized
tttcagacaattgtttttcc

SEQ ID NO: 114591 - DNA, 20 bp, Artificial Sequence
  chemically synthesized
gttaatgatcaaacaatttt

SEQ ID NO: 114592 - DNA, 20 bp, Artificial Sequence
  chemically synthesized
tgagatggctgaatttgtcg

SEQ ID NO: 114593 - DNA, 20 bp, Artificial Sequence
  chemically synthesized
atcattaactacgacaaatt

SEQ ID NO: 114594 - DNA, 20 bp, Artificial Sequence
  chemically synthesized
ctgtgaaaataagaatgaga

SEQ ID NO: 114595 - DNA, 20 bp, Artificial Sequence
  chemically synthesized
tgatctgtgaaaataagaat

SEQ ID NO: 114596 - DNA, 20 bp, Artificial Sequence
  chemically synthesized
ccatctcattcttattttca

SEQ ID NO: 114597 - DNA, 20 bp, Artificial Sequence
  chemically synthesized
ctaacatgatctgtgaaaat

SEQ ID NO: 114598 - DNA, 20 bp, Artificial Sequence
  chemically synthesized
cttattttcacagatcatgt

SEQ ID NO: 114599 - DNA, 20 bp, Artificial Sequence
  chemically synthesized
ttattttcacagatcatgtt

SEQ ID NO: 114600 - DNA, 20 bp, Artificial Sequence
  chemically synthesized
ttttcacagatcatgttagg

SEQ ID NO: 114601 - DNA, 20 bp, Artificial Sequence
  chemically synthesized
cacagatcatgttaggaaga

SEQ ID NO: 114602 - DNA, 20 bp, Artificial Sequence
  chemically synthesized
aatgttaatctggcattttg

SEQ ID NO: 114603 - DNA, 20 bp, Artificial Sequence
  chemically synthesized
ggaagaaagctacaaaatgc

SEQ ID NO: 114604 - DNA, 20 bp, Artificial Sequence
  chemically synthesized
tatgttttgaaatgttaatc

SEQ ID NO: 114605 - DNA, 20 bp, Artificial Sequence
  chemically synthesized
acatttcaaaacatatttga

SEQ ID NO: 114606 - DNA, 20 bp, Artificial Sequence
  chemically synthesized
aaacatatttgaaagtaatg

SEQ ID NO: 114607 - DNA, 20 bp, Artificial Sequence
  chemically synthesized
aacatatttgaaagtaatga

SEQ ID NO: 114608 - DNA, 20 bp, Artificial Sequence
  chemically synthesized
acatatttgaaagtaatgaa

SEQ ID NO: 114609 - DNA, 20 bp, Artificial Sequence
  chemically synthesized
gtaatgaagggaaactgatt

SEQ ID NO: 114610 - DNA, 20 bp, Artificial Sequence
  chemically synthesized
tgaagggaaactgattcagt

SEQ ID NO: 114611 - DNA, 20 bp, Artificial Sequence
  chemically synthesized
tttagcgttgctaactgaat

SEQ ID NO: 114612 - DNA, 20 bp, Artificial Sequence
  chemically synthesized
gttagcaacgctaaataaaa

SEQ ID NO: 114613 - DNA, 20 bp, Artificial Sequence
  chemically synthesized
tatgaattgtctgttttatt

SEQ ID NO: 114614 - DNA, 20 bp, Artificial Sequence
  chemically synthesized
aataaaacagacaattcata

SEQ ID NO: 114615 - DNA, 20 bp, Artificial Sequence
  chemically synthesized
tatttaatattttacaggga

SEQ ID NO: 114616 - DNA, 20 bp, Artificial Sequence
  chemically synthesized
tgtttatttaatattttaca

SEQ ID NO: 114617 - DNA, 20 bp, Artificial Sequence
  chemically synthesized
gtgtttatttaatattttac

SEQ ID NO: 114618 - DNA, 20 bp, Artificial Sequence
  chemically synthesized
agtgtttatttaatatttta

SEQ ID NO: 114619 - DNA, 20 bp, Artificial Sequence
  chemically synthesized
ttttaaaagttgacattttt

SEQ ID NO: 114620 - DNA, 20 bp, Artificial Sequence
  chemically synthesized
attggtttattaaattttaa

SEQ ID NO: 114621 - DNA, 20 bp, Artificial Sequence
  chemically synthesized
aatttaataaaccaatccct

SEQ ID NO: 114622 - DNA, 20 bp, Artificial Sequence
  chemically synthesized
cagagaaataacttagggat

SEQ ID NO: 114623 - DNA, 20 bp, Artificial Sequence
  chemically synthesized
ttgctcagagaaataactta

SEQ ID NO: 114624 - DNA, 20 bp, Artificial Sequence
  chemically synthesized
tttgctcagagaaataactt

SEQ ID NO: 114625 - DNA, 20 bp, Artificial Sequence
  chemically synthesized
ctttgctcagagaaataact

SEQ ID NO: 114626 - DNA, 20 bp, Artificial Sequence
  chemically synthesized
aatccctaagttatttctct

SEQ ID NO: 114627 - DNA, 20 bp, Artificial Sequence
  chemically synthesized
ctaagttatttctctgagca

SEQ ID NO: 114628 - DNA, 20 bp, Artificial Sequence
  chemically synthesized
tcaaggagaaactttgctca

SEQ ID NO: 114629 - DNA, 20 bp, Artificial Sequence
  chemically synthesized
ggtcaaggagaaactttgct

SEQ ID NO: 114630 - DNA, 20 bp, Artificial Sequence
  chemically synthesized
aaaccagagcttcggtcaag

SEQ ID NO: 114631 - DNA, 20 bp, Artificial Sequence
  chemically synthesized
gcaaagtttctccttgaccg

SEQ ID NO: 114632 - DNA, 20 bp, Artificial Sequence
  chemically synthesized
taaaaccagagcttcggtca

SEQ ID NO: 114633 - DNA, 20 bp, Artificial Sequence
  chemically synthesized
ataaaaccagagcttcggtc

SEQ ID NO: 114634 - DNA, 20 bp, Artificial Sequence
  chemically synthesized
tttctccttgaccgaagctc

SEQ ID NO: 114635 - DNA, 20 bp, Artificial Sequence
  chemically synthesized
tgcatataaaaccagagctt

SEQ ID NO: 114636 - DNA, 20 bp, Artificial Sequence
  chemically synthesized
aacatttgcatataaaacca

SEQ ID NO: 114637 - DNA, 20 bp, Artificial Sequence
  chemically synthesized
aaaacatttgcatataaaac

SEQ ID NO: 114638 - DNA, 20 bp, Artificial Sequence
  chemically synthesized
tttatatgcaaatgttttcc

SEQ ID NO: 114639 - DNA, 20 bp, Artificial Sequence
  chemically synthesized
tatgcaaatgttttcctggt

SEQ ID NO: 114640 - DNA, 20 bp, Artificial Sequence
  chemically synthesized
tgcaaatgttttcctggtca

SEQ ID NO: 114641 - DNA, 20 bp, Artificial Sequence
  chemically synthesized
aaaaagtacatgctctgacc

SEQ ID NO: 114642 - DNA, 20 bp, Artificial Sequence
  chemically synthesized
gaaaaagtacatgctctgac

SEQ ID NO: 114643 - DNA, 20 bp, Artificial Sequence
  chemically synthesized
tcagagcatgtactttttct

SEQ ID NO: 114644 - DNA, 20 bp, Artificial Sequence
  chemically synthesized
taacaccctcgtcttagaaa

SEQ ID NO: 114645 - DNA, 20 bp, Artificial Sequence
  chemically synthesized
gcatgtactttttctaagac

SEQ ID NO: 114646 - DNA, 20 bp, Artificial Sequence
  chemically synthesized
catgtactttttctaagacg

SEQ ID NO: 114647 - DNA, 20 bp, Artificial Sequence
  chemically synthesized
atgtactttttctaagacga

SEQ ID NO: 114648 - DNA, 20 bp, Artificial Sequence
  chemically synthesized
tccacttaacaccctcgtct

SEQ ID NO: 114649 - DNA, 20 bp, Artificial Sequence
  chemically synthesized
ttttctaagacgagggtgtt

SEQ ID NO: 114650 - DNA, 20 bp, Artificial Sequence
  chemically synthesized
tctaagacgagggtgttaag

SEQ ID NO: 114651 - DNA, 20 bp, Artificial Sequence
  chemically synthesized
aggagagaggcagagggaga

SEQ ID NO: 114652 - DNA, 20 bp, Artificial Sequence
  chemically synthesized
gaggagagaggcagagggag

SEQ ID NO: 114653 - DNA, 20 bp, Artificial Sequence
  chemically synthesized
aaggaggagagaggcagagg

SEQ ID NO: 114654 - DNA, 20 bp, Artificial Sequence
  chemically synthesized
acaaggaggagagaggcaga

SEQ ID NO: 114655 - DNA, 20 bp, Artificial Sequence
  chemically synthesized
gacaaggaggagagaggcag

SEQ ID NO: 114656 - DNA, 20 bp, Artificial Sequence
  chemically synthesized
ggacaaggaggagagaggca

SEQ ID NO: 114657 - DNA, 20 bp, Artificial Sequence
  chemically synthesized
ttggacaaggaggagagagg

SEQ ID NO: 114658 - DNA, 20 bp, Artificial Sequence
  chemically synthesized
tatttggacaaggaggagag

SEQ ID NO: 114659 - DNA, 20 bp, Artificial Sequence
  chemically synthesized
gtatttggacaaggaggaga

SEQ ID NO: 114660 - DNA, 20 bp, Artificial Sequence
  chemically synthesized
cggtatttggacaaggagga

SEQ ID NO: 114661 - DNA, 20 bp, Artificial Sequence
  chemically synthesized
ttcggtatttggacaaggag

SEQ ID NO: 114662 - DNA, 20 bp, Artificial Sequence
  chemically synthesized
atttcggtatttggacaagg

SEQ ID NO: 114663 - DNA, 20 bp, Artificial Sequence
  chemically synthesized
tatttcggtatttggacaag

SEQ ID NO: 114664 - DNA, 20 bp, Artificial Sequence
  chemically synthesized
tgtatttcggtatttggaca

SEQ ID NO: 114665 - DNA, 20 bp, Artificial Sequence
  chemically synthesized
atgtatttcggtatttggac

SEQ ID NO: 114666 - DNA, 20 bp, Artificial Sequence
  chemically synthesized
gcctgatgtatttcggtatt

SEQ ID NO: 114667 - DNA, 20 bp, Artificial Sequence
  chemically synthesized
ttatacagcctgatgtattt

SEQ ID NO: 114668 - DNA, 20 bp, Artificial Sequence
  chemically synthesized
gtccaaataccgaaatacat

SEQ ID NO: 114669 - DNA, 20 bp, Artificial Sequence
  chemically synthesized
tccaaataccgaaatacatc

SEQ ID NO: 114670 - DNA, 20 bp, Artificial Sequence
  chemically synthesized
aaatacatcaggctgtataa

SEQ ID NO: 114671 - DNA, 20 bp, Artificial Sequence
  chemically synthesized
acaaaatagttgcttttata

SEQ ID NO: 114672 - DNA, 20 bp, Artificial Sequence
  chemically synthesized
aagccagggacaaaacaaaa

SEQ ID NO: 114673 - DNA, 20 bp, Artificial Sequence
  chemically synthesized
caactattttgttttgtccc

SEQ ID NO: 114674 - DNA, 20 bp, Artificial Sequence
  chemically synthesized
tacttgtaactgacaagcca

SEQ ID NO: 114675 - DNA, 20 bp, Artificial Sequence
  chemically synthesized
ttgttttgtccctggcttgt

SEQ ID NO: 114676 - DNA, 20 bp, Artificial Sequence
  chemically synthesized
gtacttgtaactgacaagcc

SEQ ID NO: 114677 - DNA, 20 bp, Artificial Sequence
  chemically synthesized
tgtacttgtaactgacaagc

SEQ ID NO: 114678 - DNA, 20 bp, Artificial Sequence
  chemically synthesized
catttgtacttgtaactgac

SEQ ID NO: 114679 - DNA, 20 bp, Artificial Sequence
  chemically synthesized
gtccctggcttgtcagttac

SEQ ID NO: 114680 - DNA, 20 bp, Artificial Sequence
  chemically synthesized
cagttacaagtacaaatgct

SEQ ID NO: 114681 - DNA, 20 bp, Artificial Sequence
  chemically synthesized
ggatccaattgaacaattct

SEQ ID NO: 114682 - DNA, 20 bp, Artificial Sequence
  chemically synthesized
aatgctgagaattgttcaat

SEQ ID NO: 114683 - DNA, 20 bp, Artificial Sequence
  chemically synthesized
aattgttcaattggatccac

SEQ ID NO: 114684 - DNA, 20 bp, Artificial Sequence
  chemically synthesized
ttgttcaattggatccacaa

SEQ ID NO: 114685 - DNA, 20 bp, Artificial Sequence
  chemically synthesized
tttccgctttagcactcttg

SEQ ID NO: 114686 - DNA, 20 bp, Artificial Sequence
  chemically synthesized
ttggatccacaagagtgcta

SEQ ID NO: 114687 - DNA, 20 bp, Artificial Sequence
  chemically synthesized
gatccacaagagtgctaaag

SEQ ID NO: 114688 - DNA, 20 bp, Artificial Sequence
  chemically synthesized
taagtcaggcatttccgctt

SEQ ID NO: 114689 - DNA, 20 bp, Artificial Sequence
  chemically synthesized
gaaacaatggcaagtaagtc

SEQ ID NO: 114690 - DNA, 20 bp, Artificial Sequence
  chemically synthesized
tgaaacaatggcaagtaagt

SEQ ID NO: 114691 - DNA, 20 bp, Artificial Sequence
  chemically synthesized
ctgatgaaacaatggcaagt

SEQ ID NO: 114692 - DNA, 20 bp, Artificial Sequence
  chemically synthesized
agagctgatgaaacaatggc

SEQ ID NO: 114693 - DNA, 20 bp, Artificial Sequence
  chemically synthesized
taaaagagctgatgaaacaa

SEQ ID NO: 114694 - DNA, 20 bp, Artificial Sequence
  chemically synthesized
cttacttgccattgtttcat

SEQ ID NO: 114695 - DNA, 20 bp, Artificial Sequence
  chemically synthesized
aagactccaagggagtaaaa

SEQ ID NO: 114696 - DNA, 20 bp, Artificial Sequence
  chemically synthesized
agaagactccaagggagtaa

SEQ ID NO: 114697 - DNA, 20 bp, Artificial Sequence
  chemically synthesized
catcagctcttttactccct

SEQ ID NO: 114698 - DNA, 20 bp, Artificial Sequence
  chemically synthesized
tcagctcttttactcccttg

SEQ ID NO: 114699 - DNA, 20 bp, Artificial Sequence
  chemically synthesized
gctcctagaagactccaagg

SEQ ID NO: 114700 - DNA, 20 bp, Artificial Sequence
  chemically synthesized
aggctcctagaagactccaa

SEQ ID NO: 114701 - DNA, 20 bp, Artificial Sequence
  chemically synthesized
aaggctcctagaagactcca

SEQ ID NO: 114702 - DNA, 20 bp, Artificial Sequence
  chemically synthesized
aaaggctcctagaagactcc

SEQ ID NO: 114703 - DNA, 20 bp, Artificial Sequence
  chemically synthesized
tttactcccttggagtcttc

SEQ ID NO: 114704 - DNA, 20 bp, Artificial Sequence
  chemically synthesized
ttactcccttggagtcttct

SEQ ID NO: 114705 - DNA, 20 bp, Artificial Sequence
  chemically synthesized
actcccttggagtcttctag

SEQ ID NO: 114706 - DNA, 20 bp, Artificial Sequence
  chemically synthesized
ccgtaaggaaaggctcctag

SEQ ID NO: 114707 - DNA, 20 bp, Artificial Sequence
  chemically synthesized
tacccgtaaggaaaggctcc

SEQ ID NO: 114708 - DNA, 20 bp, Artificial Sequence
  chemically synthesized
cttctaggagcctttcctta

SEQ ID NO: 114709 - DNA, 20 bp, Artificial Sequence
  chemically synthesized
aggatgctacccgtaaggaa

SEQ ID NO: 114710 - DNA, 20 bp, Artificial Sequence
  chemically synthesized
ttctaggagcctttccttac

SEQ ID NO: 114711 - DNA, 20 bp, Artificial Sequence
  chemically synthesized
caggatgctacccgtaagga

SEQ ID NO: 114712 - DNA, 20 bp, Artificial Sequence
  chemically synthesized
taggagcctttccttacggg

SEQ ID NO: 114713 - DNA, 20 bp, Artificial Sequence
  chemically synthesized
cctacaggatgctacccgta

SEQ ID NO: 114714 - DNA, 20 bp, Artificial Sequence
  chemically synthesized
tcctacaggatgctacccgt

SEQ ID NO: 114715 - DNA, 20 bp, Artificial Sequence
  chemically synthesized
tccttacgggtagcatcctg

SEQ ID NO: 114716 - DNA, 20 bp, Artificial Sequence
  chemically synthesized
ccttacgggtagcatcctgt

SEQ ID NO: 114717 - DNA, 20 bp, Artificial Sequence
  chemically synthesized
aacaactgccaatgtcctac

SEQ ID NO: 114718 - DNA, 20 bp, Artificial Sequence
  chemically synthesized
aaacaactgccaatgtccta

SEQ ID NO: 114719 - DNA, 20 bp, Artificial Sequence
  chemically synthesized
ggtagcatcctgtaggacat

SEQ ID NO: 114720 - DNA, 20 bp, Artificial Sequence
  chemically synthesized
agcatcctgtaggacattgg

SEQ ID NO: 114721 - DNA, 20 bp, Artificial Sequence
  chemically synthesized
taggacattggcagttgttt

SEQ ID NO: 114722 - DNA, 20 bp, Artificial Sequence
  chemically synthesized
gcagttgtttcagcttctgt

SEQ ID NO: 114723 - DNA, 20 bp, Artificial Sequence
  chemically synthesized
gtttcttgcctggcttacag

SEQ ID NO: 114724 - DNA, 20 bp, Artificial Sequence
  chemically synthesized
ttgtttcagcttctgtaagc

SEQ ID NO: 114725 - DNA, 20 bp, Artificial Sequence
  chemically synthesized
tgtttcagcttctgtaagcc

SEQ ID NO: 114726 - DNA, 20 bp, Artificial Sequence
  chemically synthesized
aaagtttcttgcctggctta

SEQ ID NO: 114727 - DNA, 20 bp, Artificial Sequence
  chemically synthesized
tcagcttctgtaagccaggc

SEQ ID NO: 114728 - DNA, 20 bp, Artificial Sequence
  chemically synthesized
acctggaaaagtttcttgcc

SEQ ID NO: 114729 - DNA, 20 bp, Artificial Sequence
  chemically synthesized
agccaggcaagaaacttttc

SEQ ID NO: 114730 - DNA, 20 bp, Artificial Sequence
  chemically synthesized
gccaggcaagaaacttttcc

SEQ ID NO: 114731 - DNA, 20 bp, Artificial Sequence
  chemically synthesized
agttccccctggacctggaa

SEQ ID NO: 114732 - DNA, 20 bp, Artificial Sequence
  chemically synthesized
gcaagaaacttttccaggtc

SEQ ID NO: 114733 - DNA, 20 bp, Artificial Sequence
  chemically synthesized
caagaaacttttccaggtcc

SEQ ID NO: 114734 - DNA, 20 bp, Artificial Sequence
  chemically synthesized
aagaaacttttccaggtcca

SEQ ID NO: 114735 - DNA, 20 bp, Artificial Sequence
  chemically synthesized
agaaacttttccaggtccag

SEQ ID NO: 114736 - DNA, 20 bp, Artificial Sequence
  chemically synthesized
gcaacagttccccctggacc

SEQ ID NO: 114737 - DNA, 20 bp, Artificial Sequence
  chemically synthesized
gaaacttttccaggtccagg

SEQ ID NO: 114738 - DNA, 20 bp, Artificial Sequence
  chemically synthesized
attactgcaacagttccccc

SEQ ID NO: 114739 - DNA, 20 bp, Artificial Sequence
  chemically synthesized
aggtccagggggaactgttg

SEQ ID NO: 114740 - DNA, 20 bp, Artificial Sequence
  chemically synthesized
aaactcatagattactgcaa

SEQ ID NO: 114741 - DNA, 20 bp, Artificial Sequence
  chemically synthesized
gaactgttgcagtaatctat

SEQ ID NO: 114742 - DNA, 20 bp, Artificial Sequence
  chemically synthesized
gctgctttggaagaaactca

SEQ ID NO: 114743 - DNA, 20 bp, Artificial Sequence
  chemically synthesized
taatctatgagtttcttcca

SEQ ID NO: 114744 - DNA, 20 bp, Artificial Sequence
  chemically synthesized
tctatgagtttcttccaaag

SEQ ID NO: 114745 - DNA, 20 bp, Artificial Sequence
  chemically synthesized
tgagcgagaggctgctttgg

SEQ ID NO: 114746 - DNA, 20 bp, Artificial Sequence
  chemically synthesized
gagtgagcgagaggctgctt

SEQ ID NO: 114747 - DNA, 20 bp, Artificial Sequence
  chemically synthesized
ttgcagggtgagtgagcgag

SEQ ID NO: 114748 - DNA, 20 bp, Artificial Sequence
  chemically synthesized
tttgcagggtgagtgagcga

SEQ ID NO: 114749 - DNA, 20 bp, Artificial Sequence
  chemically synthesized
cctttgcagggtgagtgagc

SEQ ID NO: 114750 - DNA, 20 bp, Artificial Sequence
  chemically synthesized
tggtcctttgcagggtgagt

SEQ ID NO: 114751 - DNA, 20 bp, Artificial Sequence
  chemically synthesized
catttggtcctttgcagggt

SEQ ID NO: 114752 - DNA, 20 bp, Artificial Sequence
  chemically synthesized
tctcgctcactcaccctgca

SEQ ID NO: 114753 - DNA, 20 bp, Artificial Sequence
  chemically synthesized
ctcgctcactcaccctgcaa

SEQ ID NO: 114754 - DNA, 20 bp, Artificial Sequence
  chemically synthesized
tgaacatttggtcctttgca

SEQ ID NO: 114755 - DNA, 20 bp, Artificial Sequence
  chemically synthesized
ctgaacatttggtcctttgc

SEQ ID NO: 114756 - DNA, 20 bp, Artificial Sequence
  chemically synthesized
tctgaacatttggtcctttg

SEQ ID NO: 114757 - DNA, 20 bp, Artificial Sequence
  chemically synthesized
cctgcaaaggaccaaatgtt

SEQ ID NO: 114758 - DNA, 20 bp, Artificial Sequence
  chemically synthesized
aataattgcatctgaacatt

SEQ ID NO: 114759 - DNA, 20 bp, Artificial Sequence
  chemically synthesized
cagatgcaattattaaatat

SEQ ID NO: 114760 - DNA, 20 bp, Artificial Sequence
  chemically synthesized
gcaattattaaatatcagaa

SEQ ID NO: 114761 - DNA, 20 bp, Artificial Sequence
  chemically synthesized
aaatatcagaatggtgcacc

SEQ ID NO: 114762 - DNA, 20 bp, Artificial Sequence
  chemically synthesized
ctctttttatggagttcact

SEQ ID NO: 114763 - DNA, 20 bp, Artificial Sequence
  chemically synthesized
tctctttttatggagttcac

SEQ ID NO: 114764 - DNA, 20 bp, Artificial Sequence
  chemically synthesized
cacctagtgaactccataaa

SEQ ID NO: 114765 - DNA, 20 bp, Artificial Sequence
  chemically synthesized
tccatctttctctttttatg

SEQ ID NO: 114766 - DNA, 20 bp, Artificial Sequence
  chemically synthesized
cctagtgaactccataaaaa

SEQ ID NO: 114767 - DNA, 20 bp, Artificial Sequence
  chemically synthesized
cctccatctttctcttttta

SEQ ID NO: 114768 - DNA, 20 bp, Artificial Sequence
  chemically synthesized
gtgaactccataaaaagaga

SEQ ID NO: 114769 - DNA, 20 bp, Artificial Sequence
  chemically synthesized
actccataaaaagagaaaga

SEQ ID NO: 114770 - DNA, 20 bp, Artificial Sequence
  chemically synthesized
tccataaaaagagaaagatg

SEQ ID NO: 114771 - DNA, 20 bp, Artificial Sequence
  chemically synthesized
ccataaaaagagaaagatgg

SEQ ID NO: 114772 - DNA, 20 bp, Artificial Sequence
  chemically synthesized
attgttggtatattacaatt

SEQ ID NO: 114773 - DNA, 20 bp, Artificial Sequence
  chemically synthesized
aaattgtaatataccaacaa

SEQ ID NO: 114774 - DNA, 20 bp, Artificial Sequence
  chemically synthesized
aattgtaatataccaacaat

SEQ ID NO: 114775 - DNA, 20 bp, Artificial Sequence
  chemically synthesized
attgtaatataccaacaatg

SEQ ID NO: 114776 - DNA, 20 bp, Artificial Sequence
  chemically synthesized
gcaacaactcaccccattgt

SEQ ID NO: 114777 - DNA, 20 bp, Artificial Sequence
  chemically synthesized
taatataccaacaatggggt

SEQ ID NO: 114778 - DNA, 20 bp, Artificial Sequence
  chemically synthesized
aatggggtgagttgttgcta

SEQ ID NO: 114779 - DNA, 20 bp, Artificial Sequence
  chemically synthesized
gttgcttaaaggaagagctg

SEQ ID NO: 114780 - DNA, 20 bp, Artificial Sequence
  chemically synthesized
gttgctacagctcttccttt

SEQ ID NO: 114781 - DNA, 20 bp, Artificial Sequence
  chemically synthesized
atagttgttgcttaaaggaa

SEQ ID NO: 114782 - DNA, 20 bp, Artificial Sequence
  chemically synthesized
ttatagttgttgcttaaagg

SEQ ID NO: 114783 - DNA, 20 bp, Artificial Sequence
  chemically synthesized
atattatagttgttgcttaa

SEQ ID NO: 114784 - DNA, 20 bp, Artificial Sequence
  chemically synthesized
aatattatagttgttgctta

SEQ ID NO: 114785 - DNA, 20 bp, Artificial Sequence
  chemically synthesized
aaatagactgcacaatatta

SEQ ID NO: 114786 - DNA, 20 bp, Artificial Sequence
  chemically synthesized
gcaacaactataatattgtg

SEQ ID NO: 114787 - DNA, 20 bp, Artificial Sequence
  chemically synthesized
taaataaaaatgaaagtaaa

SEQ ID NO: 114788 - DNA, 20 bp, Artificial Sequence
  chemically synthesized
tttaagttaaataaaaatga

SEQ ID NO: 114789 - DNA, 20 bp, Artificial Sequence
  chemically synthesized
tttcatttttatttaactta

SEQ ID NO: 114790 - DNA, 20 bp, Artificial Sequence
  chemically synthesized
ttcatttttatttaacttaa

SEQ ID NO: 114791 - DNA, 20 bp, Artificial Sequence
  chemically synthesized
tcccccatacaaacgccttt

SEQ ID NO: 114792 - DNA, 20 bp, Artificial Sequence
  chemically synthesized
ttaacttaaaggcgtttgta

SEQ ID NO: 114793 - DNA, 20 bp, Artificial Sequence
  chemically synthesized
taacttaaaggcgtttgtat

SEQ ID NO: 114794 - DNA, 20 bp, Artificial Sequence
  chemically synthesized
aacttaaaggcgtttgtatg

SEQ ID NO: 114795 - DNA, 20 bp, Artificial Sequence
  chemically synthesized
acttaaaggcgtttgtatgg

SEQ ID NO: 114796 - DNA, 20 bp, Artificial Sequence
  chemically synthesized
taaaggcgtttgtatggggg

SEQ ID NO: 114797 - DNA, 20 bp, Artificial Sequence
  chemically synthesized
aaaggcgtttgtatggggga

SEQ ID NO: 114798 - DNA, 20 bp, Artificial Sequence
  chemically synthesized
ttgtatgggggaaggcatgc

SEQ ID NO: 114799 - DNA, 20 bp, Artificial Sequence
  chemically synthesized
gcatgcaagaatgacaatta

SEQ ID NO: 114800 - DNA, 20 bp, Artificial Sequence
  chemically synthesized
cctctgtggagaggggttta

SEQ ID NO: 114801 - DNA, 20 bp, Artificial Sequence
  chemically synthesized
tttctataaacccctctcca

SEQ ID NO: 114802 - DNA, 20 bp, Artificial Sequence
  chemically synthesized
gaaacctcctctgtggagag

SEQ ID NO: 114803 - DNA, 20 bp, Artificial Sequence
  chemically synthesized
tgaaacctcctctgtggaga

SEQ ID NO: 114804 - DNA, 20 bp, Artificial Sequence
  chemically synthesized
tctataaacccctctccaca

SEQ ID NO: 114805 - DNA, 20 bp, Artificial Sequence
  chemically synthesized
atgaaacctcctctgtggag

SEQ ID NO: 114806 - DNA, 20 bp, Artificial Sequence
  chemically synthesized
ctataaacccctctccacag

SEQ ID NO: 114807 - DNA, 20 bp, Artificial Sequence
  chemically synthesized
tatgaaacctcctctgtgga

SEQ ID NO: 114808 - DNA, 20 bp, Artificial Sequence
  chemically synthesized
ataaacccctctccacagag

SEQ ID NO: 114809 - DNA, 20 bp, Artificial Sequence
  chemically synthesized
tatatgaaacctcctctgtg

SEQ ID NO: 114810 - DNA, 20 bp, Artificial Sequence
  chemically synthesized
taaacccctctccacagagg

SEQ ID NO: 114811 - DNA, 20 bp, Artificial Sequence
  chemically synthesized
tatatatgaaacctcctctg

SEQ ID NO: 114812 - DNA, 20 bp, Artificial Sequence
  chemically synthesized
acatatatttgaacatgtga

SEQ ID NO: 114813 - DNA, 20 bp, Artificial Sequence
  chemically synthesized
tttgaacatgtgaaagttca

SEQ ID NO: 114814 - DNA, 20 bp, Artificial Sequence
  chemically synthesized
aaactacaaaattgaaaaaa

SEQ ID NO: 114815 - DNA, 20 bp, Artificial Sequence
  chemically synthesized
aaaactacaaaattgaaaaa

SEQ ID NO: 114816 - DNA, 20 bp, Artificial Sequence
  chemically synthesized
gtacctttttttcaattttg

SEQ ID NO: 114817 - DNA, 20 bp, Artificial Sequence
  chemically synthesized
ttcaattttgtagtttttgt

SEQ ID NO: 114818 - DNA, 20 bp, Artificial Sequence
  chemically synthesized
tttttgttggtcaattttga

SEQ ID NO: 114819 - DNA, 20 bp, Artificial Sequence
  chemically synthesized
tttggcagtatattaaaaat

SEQ ID NO: 114820 - DNA, 20 bp, Artificial Sequence
  chemically synthesized
aaggtttgtctcaaatttgg

SEQ ID NO: 114821 - DNA, 20 bp, Artificial Sequence
  chemically synthesized
tttaatatactgccaaattt

SEQ ID NO: 114822 - DNA, 20 bp, Artificial Sequence
  chemically synthesized
ataaaggtttgtctcaaatt

SEQ ID NO: 114823 - DNA, 20 bp, Artificial Sequence
  chemically synthesized
aaatttgagacaaaccttta

SEQ ID NO: 114824 - DNA, 20 bp, Artificial Sequence
  chemically synthesized
ttttagggttttaactataa

SEQ ID NO: 114825 - DNA, 20 bp, Artificial Sequence
  chemically synthesized
attttagggttttaactata

SEQ ID NO: 114826 - DNA, 20 bp, Artificial Sequence
  chemically synthesized
agcatggtacagggatttta

SEQ ID NO: 114827 - DNA, 20 bp, Artificial Sequence
  chemically synthesized
aagcatggtacagggatttt

SEQ ID NO: 114828 - DNA, 20 bp, Artificial Sequence
  chemically synthesized
caagcatggtacagggattt

SEQ ID NO: 114829 - DNA, 20 bp, Artificial Sequence
  chemically synthesized
tcaaagacaagcatggtaca

SEQ ID NO: 114830 - DNA, 20 bp, Artificial Sequence
  chemically synthesized
atcaaagacaagcatggtac

SEQ ID NO: 114831 - DNA, 20 bp, Artificial Sequence
  chemically synthesized
catcaaagacaagcatggta

SEQ ID NO: 114832 - DNA, 20 bp, Artificial Sequence
  chemically synthesized
agcagcatcaaagacaagca

SEQ ID NO: 114833 - DNA, 20 bp, Artificial Sequence
  chemically synthesized
ctcagagcagcatcaaagac

SEQ ID NO: 114834 - DNA, 20 bp, Artificial Sequence
  chemically synthesized
tctgcctcagagcagcatca

SEQ ID NO: 114835 - DNA, 20 bp, Artificial Sequence
  chemically synthesized
cttgtctttgatgctgctct

SEQ ID NO: 114836 - DNA, 20 bp, Artificial Sequence
  chemically synthesized
ttgtctttgatgctgctctg

SEQ ID NO: 114837 - DNA, 20 bp, Artificial Sequence
  chemically synthesized
ccttgttttctgcctcagag

SEQ ID NO: 114838 - DNA, 20 bp, Artificial Sequence
  chemically synthesized
tctttgatgctgctctgagg

SEQ ID NO: 114839 - DNA, 20 bp, Artificial Sequence
  chemically synthesized
aatccttgttttctgcctca

SEQ ID NO: 114840 - DNA, 20 bp, Artificial Sequence
  chemically synthesized
caaatccttgttttctgcct

SEQ ID NO: 114841 - DNA, 20 bp, Artificial Sequence
  chemically synthesized
gctgctctgaggcagaaaac

SEQ ID NO: 114842 - DNA, 20 bp, Artificial Sequence
  chemically synthesized
ctgctctgaggcagaaaaca

SEQ ID NO: 114843 - DNA, 20 bp, Artificial Sequence
  chemically synthesized
aaaacaaggatttgatatgc

SEQ ID NO: 114844 - DNA, 20 bp, Artificial Sequence
  chemically synthesized
aaacaaggatttgatatgca

SEQ ID NO: 114845 - DNA, 20 bp, Artificial Sequence
  chemically synthesized
acaaggatttgatatgcaag

SEQ ID NO: 114846 - DNA, 20 bp, Artificial Sequence
  chemically synthesized
gatttgatatgcaaggagaa

SEQ ID NO: 114847 - DNA, 20 bp, Artificial Sequence
  chemically synthesized
gatatgcaaggagaaaagtc

SEQ ID NO: 114848 - DNA, 20 bp, Artificial Sequence
  chemically synthesized
aagtcaagaaaatacaaacc

SEQ ID NO: 114849 - DNA, 20 bp, Artificial Sequence
  chemically synthesized
agtcttttccttttgattct

SEQ ID NO: 114850 - DNA, 20 bp, Artificial Sequence
  chemically synthesized
aaatacaaacctagaatcaa

SEQ ID NO: 114851 - DNA, 20 bp, Artificial Sequence
  chemically synthesized
tagtcttttccttttgattc

SEQ ID NO: 114852 - DNA, 20 bp, Artificial Sequence
  chemically synthesized
aatacaaacctagaatcaaa

SEQ ID NO: 114853 - DNA, 20 bp, Artificial Sequence
  chemically synthesized
aaacctagaatcaaaaggaa

SEQ ID NO: 114854 - DNA, 20 bp, Artificial Sequence
  chemically synthesized
tagaatcaaaaggaaaagac

SEQ ID NO: 114855 - DNA, 20 bp, Artificial Sequence
  chemically synthesized
gaatcaaaaggaaaagacta

SEQ ID NO: 114856 - DNA, 20 bp, Artificial Sequence
  chemically synthesized
aatcaaaaggaaaagactag

SEQ ID NO: 114857 - DNA, 20 bp, Artificial Sequence
  chemically synthesized
aaaggaaaagactagaggaa

SEQ ID NO: 114858 - DNA, 20 bp, Artificial Sequence
  chemically synthesized
cttctttttgtcttttcctc

SEQ ID NO: 114859 - DNA, 20 bp, Artificial Sequence
  chemically synthesized
agactagaggaaaagacaaa

SEQ ID NO: 114860 - DNA, 20 bp, Artificial Sequence
  chemically synthesized
ctagaggaaaagacaaaaag

SEQ ID NO: 114861 - DNA, 20 bp, Artificial Sequence
  chemically synthesized
tagaggaaaagacaaaaaga

SEQ ID NO: 114862 - DNA, 20 bp, Artificial Sequence
  chemically synthesized
agaggaaaagacaaaaagaa

SEQ ID NO: 114863 - DNA, 20 bp, Artificial Sequence
  chemically synthesized
gaggaaaagacaaaaagaag

SEQ ID NO: 114864 - DNA, 20 bp, Artificial Sequence
  chemically synthesized
aaagacaaaaagaaggggat

SEQ ID NO: 114865 - DNA, 20 bp, Artificial Sequence
  chemically synthesized
agacaaaaagaaggggattg

SEQ ID NO: 114866 - DNA, 20 bp, Artificial Sequence
  chemically synthesized
gacaaaaagaaggggattgg

SEQ ID NO: 114867 - DNA, 20 bp, Artificial Sequence
  chemically synthesized
acaaaaagaaggggattgga

SEQ ID NO: 114868 - DNA, 20 bp, Artificial Sequence
  chemically synthesized
aagaaggggattggagggca

SEQ ID NO: 114869 - DNA, 20 bp, Artificial Sequence
  chemically synthesized
agaaggggattggagggcaa

SEQ ID NO: 114870 - DNA, 20 bp, Artificial Sequence
  chemically synthesized
aggggattggagggcaaagg

SEQ ID NO: 114871 - DNA, 20 bp, Artificial Sequence
  chemically synthesized
gattggagggcaaaggaaga

SEQ ID NO: 114872 - DNA, 20 bp, Artificial Sequence
  chemically synthesized
caaaggaagaaagacttaac

SEQ ID NO: 114873 - DNA, 20 bp, Artificial Sequence
  chemically synthesized
atgttatttctttacttgtt

SEQ ID NO: 114874 - DNA, 20 bp, Artificial Sequence
  chemically synthesized
gaagaaagacttaacaagta

SEQ ID NO: 114875 - DNA, 20 bp, Artificial Sequence
  chemically synthesized
agtaaagaaataacatttca

SEQ ID NO: 114876 - DNA, 20 bp, Artificial Sequence
  chemically synthesized
tgatagtttgcacaaaatga

SEQ ID NO: 114877 - DNA, 20 bp, Artificial Sequence
  chemically synthesized
actgatgtcatgcaaaatga

SEQ ID NO: 114878 - DNA, 20 bp, Artificial Sequence
  chemically synthesized
actatcattttgcatgacat

SEQ ID NO: 114879 - DNA, 20 bp, Artificial Sequence
  chemically synthesized
atcagttataattattgtgt

SEQ ID NO: 114880 - DNA, 20 bp, Artificial Sequence
  chemically synthesized
ttctcagttgtatgatcaag

SEQ ID NO: 114881 - DNA, 20 bp, Artificial Sequence
  chemically synthesized
atgttctcagttgtatgatc

SEQ ID NO: 114882 - DNA, 20 bp, Artificial Sequence
  chemically synthesized
aactacttgatcatacaact

SEQ ID NO: 114883 - DNA, 20 bp, Artificial Sequence
  chemically synthesized
tttattttggaaaatgttct

SEQ ID NO: 114884 - DNA, 20 bp, Artificial Sequence
  chemically synthesized
tacacataacatttttattt

SEQ ID NO: 114885 - DNA, 20 bp, Artificial Sequence
  chemically synthesized
aaatgttatgtgtaatgaaa

SEQ ID NO: 114886 - DNA, 20 bp, Artificial Sequence
  chemically synthesized
atgttatgtgtaatgaaaaa

SEQ ID NO: 114887 - DNA, 20 bp, Artificial Sequence
  chemically synthesized
ttatgtgtaatgaaaaagag

SEQ ID NO: 114888 - DNA, 20 bp, Artificial Sequence
  chemically synthesized
atgtgtaatgaaaaagagta

SEQ ID NO: 114889 - DNA, 20 bp, Artificial Sequence
  chemically synthesized
aagagtagagttttaaaaac

SEQ ID NO: 114890 - DNA, 20 bp, Artificial Sequence
  chemically synthesized
agagtagagttttaaaaact

SEQ ID NO: 114891 - DNA, 20 bp, Artificial Sequence
  chemically synthesized
gtagagttttaaaaactagg

SEQ ID NO: 114892 - DNA, 20 bp, Artificial Sequence
  chemically synthesized
gaattgaactcagatctgcc

SEQ ID NO: 114893 - DNA, 20 bp, Artificial Sequence
  chemically synthesized
tttaaaaactaggcagatct

SEQ ID NO: 114894 - DNA, 20 bp, Artificial Sequence
  chemically synthesized
agaacactgggaattgaact

SEQ ID NO: 114895 - DNA, 20 bp, Artificial Sequence
  chemically synthesized
gcagatctgagttcaattcc

SEQ ID NO: 114896 - DNA, 20 bp, Artificial Sequence
  chemically synthesized
cgtaagtggtaaagaacact

SEQ ID NO: 114897 - DNA, 20 bp, Artificial Sequence
  chemically synthesized
acgtaagtggtaaagaacac

SEQ ID NO: 114898 - DNA, 20 bp, Artificial Sequence
  chemically synthesized
gccatatcacgtaagtggta

SEQ ID NO: 114899 - DNA, 20 bp, Artificial Sequence
  chemically synthesized
aacttgccatatcacgtaag

SEQ ID NO: 114900 - DNA, 20 bp, Artificial Sequence
  chemically synthesized
gggaacttgccatatcacgt

SEQ ID NO: 114901 - DNA, 20 bp, Artificial Sequence
  chemically synthesized
tctttaccacttacgtgata

SEQ ID NO: 114902 - DNA, 20 bp, Artificial Sequence
  chemically synthesized
taccacttacgtgatatggc

SEQ ID NO: 114903 - DNA, 20 bp, Artificial Sequence
  chemically synthesized
gagaaactgagaatcagaga

SEQ ID NO: 114904 - DNA, 20 bp, Artificial Sequence
  chemically synthesized
tgagaaactgagaatcagag

SEQ ID NO: 114905 - DNA, 20 bp, Artificial Sequence
  chemically synthesized
atgagaaactgagaatcaga

SEQ ID NO: 114906 - DNA, 20 bp, Artificial Sequence
  chemically synthesized
caagttccctctctgattct

SEQ ID NO: 114907 - DNA, 20 bp, Artificial Sequence
  chemically synthesized
agatgagaaactgagaatca

SEQ ID NO: 114908 - DNA, 20 bp, Artificial Sequence
  chemically synthesized
gcagatgagaaactgagaat

SEQ ID NO: 114909 - DNA, 20 bp, Artificial Sequence
  chemically synthesized
gatattgcagatgagaaact

SEQ ID NO: 114910 - DNA, 20 bp, Artificial Sequence
  chemically synthesized
cagcaatagatattgcagat

SEQ ID NO: 114911 - DNA, 20 bp, Artificial Sequence
  chemically synthesized
catcacagcaatagatattg

SEQ ID NO: 114912 - DNA, 20 bp, Artificial Sequence
  chemically synthesized
tttaattctcatcacagcaa

SEQ ID NO: 114913 - DNA, 20 bp, Artificial Sequence
  chemically synthesized
gcaatatctattgctgtgat

SEQ ID NO: 114914 - DNA, 20 bp, Artificial Sequence
  chemically synthesized
ttttattttaattctcatca

SEQ ID NO: 114915 - DNA, 20 bp, Artificial Sequence
  chemically synthesized
taaaataaaaaattcctgtg

SEQ ID NO: 114916 - DNA, 20 bp, Artificial Sequence
  chemically synthesized
cgtggggcactcaacttcac

SEQ ID NO: 114917 - DNA, 20 bp, Artificial Sequence
  chemically synthesized
taaaaaattcctgtgaagtt

SEQ ID NO: 114918 - DNA, 20 bp, Artificial Sequence
  chemically synthesized
acgtggggcactcaacttca

SEQ ID NO: 114919 - DNA, 20 bp, Artificial Sequence
  chemically synthesized
atgtataactgtataacgtg

SEQ ID NO: 114920 - DNA, 20 bp, Artificial Sequence
  chemically synthesized
aatgtataactgtataacgt

SEQ ID NO: 114921 - DNA, 20 bp, Artificial Sequence
  chemically synthesized
gttgagtgccccacgttata

SEQ ID NO: 114922 - DNA, 20 bp, Artificial Sequence
  chemically synthesized
taatgtataactgtataacg

SEQ ID NO: 114923 - DNA, 20 bp, Artificial Sequence
  chemically synthesized
cgttatacagttatacatta

SEQ ID NO: 114924 - DNA, 20 bp, Artificial Sequence
  chemically synthesized
tagaaggaactaatgttttt

SEQ ID NO: 114925 - DNA, 20 bp, Artificial Sequence
  chemically synthesized
ttacagttactcaaaaacat

SEQ ID NO: 114926 - DNA, 20 bp, Artificial Sequence
  chemically synthesized
ggaaatgggatatgggtaga

SEQ ID NO: 114927 - DNA, 20 bp, Artificial Sequence
  chemically synthesized
gggaaatgggatatgggtag

SEQ ID NO: 114928 - DNA, 20 bp, Artificial Sequence
  chemically synthesized
atggggaaatgggatatggg

SEQ ID NO: 114929 - DNA, 20 bp, Artificial Sequence
  chemically synthesized
ggaatggggaaatgggatat

SEQ ID NO: 114930 - DNA, 20 bp, Artificial Sequence
  chemically synthesized
aggaatggggaaatgggata

SEQ ID NO: 114931 - DNA, 20 bp, Artificial Sequence
  chemically synthesized
tattacaggaatggggaaat

SEQ ID NO: 114932 - DNA, 20 bp, Artificial Sequence
  chemically synthesized
atattacaggaatggggaaa

SEQ ID NO: 114933 - DNA, 20 bp, Artificial Sequence
  chemically synthesized
tttaaaatattacaggaatg

SEQ ID NO: 114934 - DNA, 20 bp, Artificial Sequence
  chemically synthesized
ttttaaaatattacaggaat

SEQ ID NO: 114935 - DNA, 20 bp, Artificial Sequence
  chemically synthesized
tttttaaaatattacaggaa

SEQ ID NO: 114936 - DNA, 20 bp, Artificial Sequence
  chemically synthesized
tcatctttttaaaatattac

SEQ ID NO: 114937 - DNA, 20 bp, Artificial Sequence
  chemically synthesized
ttcatctttttaaaatatta

SEQ ID NO: 114938 - DNA, 20 bp, Artificial Sequence
  chemically synthesized
cattcctgtaatattttaaa

SEQ ID NO: 114939 - DNA, 20 bp, Artificial Sequence
  chemically synthesized
ttagagtttttgtcatgaaa

SEQ ID NO: 114940 - DNA, 20 bp, Artificial Sequence
  chemically synthesized
ttttagagtttttgtcatga

SEQ ID NO: 114941 - DNA, 20 bp, Artificial Sequence
  chemically synthesized
aaaatatgaatacattttta

SEQ ID NO: 114942 - DNA, 20 bp, Artificial Sequence
  chemically synthesized
caaaaatatgaatacatttt

SEQ ID NO: 114943 - DNA, 20 bp, Artificial Sequence
  chemically synthesized
tatataaaatgcatgtattg

SEQ ID NO: 114944 - DNA, 20 bp, Artificial Sequence
  chemically synthesized
gatacacacacatatgccct

SEQ ID NO: 114945 - DNA, 20 bp, Artificial Sequence
  chemically synthesized
attatatagatatttgctga

SEQ ID NO: 114946 - DNA, 20 bp, Artificial Sequence
  chemically synthesized
tattatatagatatttgctg

SEQ ID NO: 114947 - DNA, 20 bp, Artificial Sequence
  chemically synthesized
ttattatatagatatttgct

SEQ ID NO: 114948 - DNA, 20 bp, Artificial Sequence
  chemically synthesized
ctttctaagctattattata

SEQ ID NO: 114949 - DNA, 20 bp, Artificial Sequence
  chemically synthesized
agcaaatatctatataataa

SEQ ID NO: 114950 - DNA, 20 bp, Artificial Sequence
  chemically synthesized
atatctatataataatagct

SEQ ID NO: 114951 - DNA, 20 bp, Artificial Sequence
  chemically synthesized
ctatataataatagcttaga

SEQ ID NO: 114952 - DNA, 20 bp, Artificial Sequence
  chemically synthesized
tatataataatagcttagaa

SEQ ID NO: 114953 - DNA, 20 bp, Artificial Sequence
  chemically synthesized
ctaaggcaattttcctttct

SEQ ID NO: 114954 - DNA, 20 bp, Artificial Sequence
  chemically synthesized
cttagaaaggaaaattgcct

SEQ ID NO: 114955 - DNA, 20 bp, Artificial Sequence
  chemically synthesized
ttagaaaggaaaattgcctt

SEQ ID NO: 114956 - DNA, 20 bp, Artificial Sequence
  chemically synthesized
gaaaggaaaattgccttagg

SEQ ID NO: 114957 - DNA, 20 bp, Artificial Sequence
  chemically synthesized
cataggactgttactgccta

SEQ ID NO: 114958 - DNA, 20 bp, Artificial Sequence
  chemically synthesized
ccataggactgttactgcct

SEQ ID NO: 114959 - DNA, 20 bp, Artificial Sequence
  chemically synthesized
aaaattgccttaggcagtaa

SEQ ID NO: 114960 - DNA, 20 bp, Artificial Sequence
  chemically synthesized
cttaggcagtaacagtccta

SEQ ID NO: 114961 - DNA, 20 bp, Artificial Sequence
  chemically synthesized
cagtaacagtcctatggaaa

SEQ ID NO: 114962 - DNA, 20 bp, Artificial Sequence
  chemically synthesized
ttacctgaatctttttccat

SEQ ID NO: 114963 - DNA, 20 bp, Artificial Sequence
  chemically synthesized
tttacctgaatctttttcca

SEQ ID NO: 114964 - DNA, 20 bp, Artificial Sequence
  chemically synthesized
cagtcctatggaaaaagatt

SEQ ID NO: 114965 - DNA, 20 bp, Artificial Sequence
  chemically synthesized
agtcctatggaaaaagattc

SEQ ID NO: 114966 - DNA, 20 bp, Artificial Sequence
  chemically synthesized
taatttcctcattgcagaca

SEQ ID NO: 114967 - DNA, 20 bp, Artificial Sequence
  chemically synthesized
aggtaaactttgtctgcaat

SEQ ID NO: 114968 - DNA, 20 bp, Artificial Sequence
  chemically synthesized
ggtaaactttgtctgcaatg

SEQ ID NO: 114969 - DNA, 20 bp, Artificial Sequence
  chemically synthesized
gagtactaatttcctcattg

SEQ ID NO: 114970 - DNA, 20 bp, Artificial Sequence
  chemically synthesized
tttgtctgcaatgaggaaat

SEQ ID NO: 114971 - DNA, 20 bp, Artificial Sequence
  chemically synthesized
gcaaataagacatttaaata

SEQ ID NO: 114972 - DNA, 20 bp, Artificial Sequence
  chemically synthesized
aggcaaataagacatttaaa

SEQ ID NO: 114973 - DNA, 20 bp, Artificial Sequence
  chemically synthesized
tgtagtaatagaaggcaaat

SEQ ID NO: 114974 - DNA, 20 bp, Artificial Sequence
  chemically synthesized
agtgtttgtgtagtaataga

SEQ ID NO: 114975 - DNA, 20 bp, Artificial Sequence
  chemically synthesized
aagtgtttgtgtagtaatag

SEQ ID NO: 114976 - DNA, 20 bp, Artificial Sequence
  chemically synthesized
agaaagtgtttgtgtagtaa

SEQ ID NO: 114977 - DNA, 20 bp, Artificial Sequence
  chemically synthesized
aatcccagaaagtgtttgtg

SEQ ID NO: 114978 - DNA, 20 bp, Artificial Sequence
  chemically synthesized
attactacacaaacactttc

SEQ ID NO: 114979 - DNA, 20 bp, Artificial Sequence
  chemically synthesized
ttactacacaaacactttct

SEQ ID NO: 114980 - DNA, 20 bp, Artificial Sequence
  chemically synthesized
agcttatgtttaatcccaga

SEQ ID NO: 114981 - DNA, 20 bp, Artificial Sequence
  chemically synthesized
ttttagcttatgtttaatcc

SEQ ID NO: 114982 - DNA, 20 bp, Artificial Sequence
  chemically synthesized
cactttctgggattaaacat

SEQ ID NO: 114983 - DNA, 20 bp, Artificial Sequence
  chemically synthesized
gattaaacataagctaaaaa

SEQ ID NO: 114984 - DNA, 20 bp, Artificial Sequence
  chemically synthesized
aattttttaaaatccatttt

SEQ ID NO: 114985 - DNA, 20 bp, Artificial Sequence
  chemically synthesized
aagcaatgtgtatcatattc

SEQ ID NO: 114986 - DNA, 20 bp, Artificial Sequence
  chemically synthesized
tatgatacacattgcttgtt

SEQ ID NO: 114987 - DNA, 20 bp, Artificial Sequence
  chemically synthesized
attgacaatcacatcttaac

SEQ ID NO: 114988 - DNA, 20 bp, Artificial Sequence
  chemically synthesized
gttgctgctgaaataaattg

SEQ ID NO: 114989 - DNA, 20 bp, Artificial Sequence
  chemically synthesized
tgcaaaactgcaatttattt

SEQ ID NO: 114990 - DNA, 20 bp, Artificial Sequence
  chemically synthesized
aaaactgcaatttatttcag

SEQ ID NO: 114991 - DNA, 20 bp, Artificial Sequence
  chemically synthesized
tttcagcagcaactttatca

SEQ ID NO: 114992 - DNA, 20 bp, Artificial Sequence
  chemically synthesized
ttcagcagcaactttatcat

SEQ ID NO: 114993 - DNA, 20 bp, Artificial Sequence
  chemically synthesized
ggtttgcacatcccatgata

SEQ ID NO: 114994 - DNA, 20 bp, Artificial Sequence
  chemically synthesized
ttatcatgggatgtgcaaac

SEQ ID NO: 114995 - DNA, 20 bp, Artificial Sequence
  chemically synthesized
tatcatgggatgtgcaaacc

SEQ ID NO: 114996 - DNA, 20 bp, Artificial Sequence
  chemically synthesized
ggcaggagttgtttattgcc

SEQ ID NO: 114997 - DNA, 20 bp, Artificial Sequence
  chemically synthesized
ggcaataaacaactcctgcc

SEQ ID NO: 114998 - DNA, 20 bp, Artificial Sequence
  chemically synthesized
tgctgccgctggctcggcag

SEQ ID NO: 114999 - DNA, 20 bp, Artificial Sequence
  chemically synthesized
ataaacaactcctgccgagc

SEQ ID NO: 115000 - DNA, 20 bp, Artificial Sequence
  chemically synthesized
tttgctgccgctggctcggc

SEQ ID NO: 115001 - DNA, 20 bp, Artificial Sequence
  chemically synthesized
ctttgctgccgctggctcgg

SEQ ID NO: 115002 - DNA, 20 bp, Artificial Sequence
  chemically synthesized
aacaactcctgccgagccag

SEQ ID NO: 115003 - DNA, 20 bp, Artificial Sequence
  chemically synthesized
gggctttgctgccgctggct

SEQ ID NO: 115004 - DNA, 20 bp, Artificial Sequence
  chemically synthesized
aactcctgccgagccagcgg

SEQ ID NO: 115005 - DNA, 20 bp, Artificial Sequence
  chemically synthesized
tccgggggctttgctgccgc

SEQ ID NO: 115006 - DNA, 20 bp, Artificial Sequence
  chemically synthesized
ctgccgagccagcggcagca

SEQ ID NO: 115007 - DNA, 20 bp, Artificial Sequence
  chemically synthesized
gccagcggcagcaaagcccc

SEQ ID NO: 115008 - DNA, 20 bp, Artificial Sequence
  chemically synthesized
agcggcagcaaagcccccgg

SEQ ID NO: 115009 - DNA, 20 bp, Artificial Sequence
  chemically synthesized
cggcagcaaagcccccggaa

SEQ ID NO: 115010 - DNA, 20 bp, Artificial Sequence
  chemically synthesized
tgaataaacagctcttccgg

SEQ ID NO: 115011 - DNA, 20 bp, Artificial Sequence
  chemically synthesized
atgaataaacagctcttccg

SEQ ID NO: 115012 - DNA, 20 bp, Artificial Sequence
  chemically synthesized
gatgaataaacagctcttcc

SEQ ID NO: 115013 - DNA, 20 bp, Artificial Sequence
  chemically synthesized
tgatgaataaacagctcttc

SEQ ID NO: 115014 - DNA, 20 bp, Artificial Sequence
  chemically synthesized
cctcacccatgatgaataaa

SEQ ID NO: 115015 - DNA, 20 bp, Artificial Sequence
  chemically synthesized
gaagagctgtttattcatca

SEQ ID NO: 115016 - DNA, 20 bp, Artificial Sequence
  chemically synthesized
aagagctgtttattcatcat

SEQ ID NO: 115017 - DNA, 20 bp, Artificial Sequence
  chemically synthesized
gctgtttattcatcatgggt

SEQ ID NO: 115018 - DNA, 20 bp, Artificial Sequence
  chemically synthesized
ctgtttattcatcatgggtg

SEQ ID NO: 115019 - DNA, 20 bp, Artificial Sequence
  chemically synthesized
tcatgggtgaggtttttgct

SEQ ID NO: 115020 - DNA, 20 bp, Artificial Sequence
  chemically synthesized
tgaggtttttgctgagcaca

SEQ ID NO: 115021 - DNA, 20 bp, Artificial Sequence
  chemically synthesized
actgtggaagactgtgtgct

SEQ ID NO: 115022 - DNA, 20 bp, Artificial Sequence
  chemically synthesized
gctgagcacacagtcttcca

SEQ ID NO: 115023 - DNA, 20 bp, Artificial Sequence
  chemically synthesized
gagcacacagtcttccacag

SEQ ID NO: 115024 - DNA, 20 bp, Artificial Sequence
  chemically synthesized
gcactgaaactccactgtgg

SEQ ID NO: 115025 - DNA, 20 bp, Artificial Sequence
  chemically synthesized
gcacacagtcttccacagtg

SEQ ID NO: 115026 - DNA, 20 bp, Artificial Sequence
  chemically synthesized
tgagcactgaaactccactg

SEQ ID NO: 115027 - DNA, 20 bp, Artificial Sequence
  chemically synthesized
agtcttccacagtggagttt

SEQ ID NO: 115028 - DNA, 20 bp, Artificial Sequence
  chemically synthesized
tggagtttcagtgctcatac

SEQ ID NO: 115029 - DNA, 20 bp, Artificial Sequence
  chemically synthesized
agaagatttttatccagtat

SEQ ID NO: 115030 - DNA, 20 bp, Artificial Sequence
  chemically synthesized
gcagacagaagatttttatc

SEQ ID NO: 115031 - DNA, 20 bp, Artificial Sequence
  chemically synthesized
ccaccagttaatgcagacag

SEQ ID NO: 115032 - DNA, 20 bp, Artificial Sequence
  chemically synthesized
cctccaccagttaatgcaga

SEQ ID NO: 115033 - DNA, 20 bp, Artificial Sequence
  chemically synthesized
aatcttctgtctgcattaac

SEQ ID NO: 115034 - DNA, 20 bp, Artificial Sequence
  chemically synthesized
ctaccctccaccagttaatg

SEQ ID NO: 115035 - DNA, 20 bp, Artificial Sequence
  chemically synthesized
cttctgtctgcattaactgg

SEQ ID NO: 115036 - DNA, 20 bp, Artificial Sequence
  chemically synthesized
tctgtctgcattaactggtg

SEQ ID NO: 115037 - DNA, 20 bp, Artificial Sequence
  chemically synthesized
ctgtctgcattaactggtgg

SEQ ID NO: 115038 - DNA, 20 bp, Artificial Sequence
  chemically synthesized
tgtctgcattaactggtgga

SEQ ID NO: 115039 - DNA, 20 bp, Artificial Sequence
  chemically synthesized
aaacctattctaccctccac

SEQ ID NO: 115040 - DNA, 20 bp, Artificial Sequence
  chemically synthesized
ctgcattaactggtggaggg

SEQ ID NO: 115041 - DNA, 20 bp, Artificial Sequence
  chemically synthesized
ttaactggtggagggtagaa

SEQ ID NO: 115042 - DNA, 20 bp, Artificial Sequence
  chemically synthesized
taactggtggagggtagaat

SEQ ID NO: 115043 - DNA, 20 bp, Artificial Sequence
  chemically synthesized
ggagggtagaataggtttat

SEQ ID NO: 115044 - DNA, 20 bp, Artificial Sequence
  chemically synthesized
gagggtagaataggtttatg

SEQ ID NO: 115045 - DNA, 20 bp, Artificial Sequence
  chemically synthesized
agaataggtttatgaggatg

SEQ ID NO: 115046 - DNA, 20 bp, Artificial Sequence
  chemically synthesized
gtttatgaggatgtagctac

SEQ ID NO: 115047 - DNA, 20 bp, Artificial Sequence
  chemically synthesized
caatgcttccttttttccag

SEQ ID NO: 115048 - DNA, 20 bp, Artificial Sequence
  chemically synthesized
aggatgtagctactggaaaa

SEQ ID NO: 115049 - DNA, 20 bp, Artificial Sequence
  chemically synthesized
ggatgtagctactggaaaaa

SEQ ID NO: 115050 - DNA, 20 bp, Artificial Sequence
  chemically synthesized
gtgcaatgcttccttttttc

SEQ ID NO: 115051 - DNA, 20 bp, Artificial Sequence
  chemically synthesized
tgtagctactggaaaaaagg

SEQ ID NO: 115052 - DNA, 20 bp, Artificial Sequence
  chemically synthesized
aaaaaaggaagcattgcact

SEQ ID NO: 115053 - DNA, 20 bp, Artificial Sequence
  chemically synthesized
ttaggagttgataaatagct

SEQ ID NO: 115054 - DNA, 20 bp, Artificial Sequence
  chemically synthesized
tttatttaggagttgataaa

SEQ ID NO: 115055 - DNA, 20 bp, Artificial Sequence
  chemically synthesized
cagtattaaagtttatttag

SEQ ID NO: 115056 - DNA, 20 bp, Artificial Sequence
  chemically synthesized
tgcagtattaaagtttattt

SEQ ID NO: 115057 - DNA, 20 bp, Artificial Sequence
  chemically synthesized
gtgcagtattaaagtttatt

SEQ ID NO: 115058 - DNA, 20 bp, Artificial Sequence
  chemically synthesized
ctttcagctgtgcagtatta

SEQ ID NO: 115059 - DNA, 20 bp, Artificial Sequence
  chemically synthesized
aaataaactttaatactgca

SEQ ID NO: 115060 - DNA, 20 bp, Artificial Sequence
  chemically synthesized
tacactacctttcagctgtg

SEQ ID NO: 115061 - DNA, 20 bp, Artificial Sequence
  chemically synthesized
ctttaatactgcacagctga

SEQ ID NO: 115062 - DNA, 20 bp, Artificial Sequence
  chemically synthesized
tttaatactgcacagctgaa

SEQ ID NO: 115063 - DNA, 20 bp, Artificial Sequence
  chemically synthesized
aatactgcacagctgaaagg

SEQ ID NO: 115064 - DNA, 20 bp, Artificial Sequence
  chemically synthesized
cagaaccctacactaccttt

SEQ ID NO: 115065 - DNA, 20 bp, Artificial Sequence
  chemically synthesized
tgcacagctgaaaggtagtg

SEQ ID NO: 115066 - DNA, 20 bp, Artificial Sequence
  chemically synthesized
gcacagctgaaaggtagtgt

SEQ ID NO: 115067 - DNA, 20 bp, Artificial Sequence
  chemically synthesized
cacagctgaaaggtagtgta

SEQ ID NO: 115068 - DNA, 20 bp, Artificial Sequence
  chemically synthesized
tgaaaggtagtgtagggttc

SEQ ID NO: 115069 - DNA, 20 bp, Artificial Sequence
  chemically synthesized
aggtagtgtagggttctggt

SEQ ID NO: 115070 - DNA, 20 bp, Artificial Sequence
  chemically synthesized
ggtagtgtagggttctggtt

SEQ ID NO: 115071 - DNA, 20 bp, Artificial Sequence
  chemically synthesized
gtttaatttatttgcccaac

SEQ ID NO: 115072 - DNA, 20 bp, Artificial Sequence
  chemically synthesized
caaataaattaaacctcatg

SEQ ID NO: 115073 - DNA, 20 bp, Artificial Sequence
  chemically synthesized
gttagcccttgaactacatg

SEQ ID NO: 115074 - DNA, 20 bp, Artificial Sequence
  chemically synthesized
cgttagcccttgaactacat

SEQ ID NO: 115075 - DNA, 20 bp, Artificial Sequence
  chemically synthesized
aattaaacctcatgtagttc

SEQ ID NO: 115076 - DNA, 20 bp, Artificial Sequence
  chemically synthesized
attaaacctcatgtagttca

SEQ ID NO: 115077 - DNA, 20 bp, Artificial Sequence
  chemically synthesized
ttaaacctcatgtagttcaa

SEQ ID NO: 115078 - DNA, 20 bp, Artificial Sequence
  chemically synthesized
atgtagttcaagggctaacg

SEQ ID NO: 115079 - DNA, 20 bp, Artificial Sequence
  chemically synthesized
agggagccggcagtccacgt

SEQ ID NO: 115080 - DNA, 20 bp, Artificial Sequence
  chemically synthesized
caagggctaacgtggactgc

SEQ ID NO: 115081 - DNA, 20 bp, Artificial Sequence
  chemically synthesized
ctagataagcagggagccgg

SEQ ID NO: 115082 - DNA, 20 bp, Artificial Sequence
  chemically synthesized
aaactagataagcagggagc

SEQ ID NO: 115083 - DNA, 20 bp, Artificial Sequence
  chemically synthesized
ctgaaaactagataagcagg

SEQ ID NO: 115084 - DNA, 20 bp, Artificial Sequence
  chemically synthesized
gcctgaaaactagataagca

SEQ ID NO: 115085 - DNA, 20 bp, Artificial Sequence
  chemically synthesized
ctgccggctccctgcttatc

SEQ ID NO: 115086 - DNA, 20 bp, Artificial Sequence
  chemically synthesized
tgcctgaaaactagataagc

SEQ ID NO: 115087 - DNA, 20 bp, Artificial Sequence
  chemically synthesized
ttgcctgaaaactagataag

SEQ ID NO: 115088 - DNA, 20 bp, Artificial Sequence
  chemically synthesized
agtttgcctgaaaactagat

SEQ ID NO: 115089 - DNA, 20 bp, Artificial Sequence
  chemically synthesized
ctccctgcttatctagtttt

SEQ ID NO: 115090 - DNA, 20 bp, Artificial Sequence
  chemically synthesized
tccctgcttatctagttttc

SEQ ID NO: 115091 - DNA, 20 bp, Artificial Sequence
  chemically synthesized
ttgatagtttgcctgaaaac

SEQ ID NO: 115092 - DNA, 20 bp, Artificial Sequence
  chemically synthesized
ttcaggcaaactatcaatgc

SEQ ID NO: 115093 - DNA, 20 bp, Artificial Sequence
  chemically synthesized
gatatttctccttgcattga

SEQ ID NO: 115094 - DNA, 20 bp, Artificial Sequence
  chemically synthesized
tcaggcaaactatcaatgca

SEQ ID NO: 115095 - DNA, 20 bp, Artificial Sequence
  chemically synthesized
aggcaaactatcaatgcaag

SEQ ID NO: 115096 - DNA, 20 bp, Artificial Sequence
  chemically synthesized
aatgcaaggagaaatatcaa

SEQ ID NO: 115097 - DNA, 20 bp, Artificial Sequence
  chemically synthesized
tgcaaggagaaatatcaaaa

SEQ ID NO: 115098 - DNA, 20 bp, Artificial Sequence
  chemically synthesized
tttcaagcatgatacataaa

SEQ ID NO: 115099 - DNA, 20 bp, Artificial Sequence
  chemically synthesized
gcagtggttctgaatttttc

SEQ ID NO: 115100 - DNA, 20 bp, Artificial Sequence
  chemically synthesized
tgtatcatgcttgaaaaatt

SEQ ID NO: 115101 - DNA, 20 bp, Artificial Sequence
  chemically synthesized
gattcgtggagttgttgcag

SEQ ID NO: 115102 - DNA, 20 bp, Artificial Sequence
  chemically synthesized
tgagattcgtggagttgttg

SEQ ID NO: 115103 - DNA, 20 bp, Artificial Sequence
  chemically synthesized
ttgtagcattgagattcgtg

SEQ ID NO: 115104 - DNA, 20 bp, Artificial Sequence
  chemically synthesized
aattgtagcattgagattcg

SEQ ID NO: 115105 - DNA, 20 bp, Artificial Sequence
  chemically synthesized
gtatgcccaattgtagcatt

SEQ ID NO: 115106 - DNA, 20 bp, Artificial Sequence
  chemically synthesized
acgaatctcaatgctacaat

SEQ ID NO: 115107 - DNA, 20 bp, Artificial Sequence
  chemically synthesized
cgaatctcaatgctacaatt

SEQ ID NO: 115108 - DNA, 20 bp, Artificial Sequence
  chemically synthesized
gtaaggtgtatgcccaattg

SEQ ID NO: 115109 - DNA, 20 bp, Artificial Sequence
  chemically synthesized
acaattgggcatacacctta

SEQ ID NO: 115110 - DNA, 20 bp, Artificial Sequence
  chemically synthesized
tacacatggttcaaactgta

SEQ ID NO: 115111 - DNA, 20 bp, Artificial Sequence
  chemically synthesized
ttacacatggttcaaactgt

SEQ ID NO: 115112 - DNA, 20 bp, Artificial Sequence
  chemically synthesized
caattgtcagcagttacaca

SEQ ID NO: 115113 - DNA, 20 bp, Artificial Sequence
  chemically synthesized
cacacccagtcaattgtcag

SEQ ID NO: 115114 - DNA, 20 bp, Artificial Sequence
  chemically synthesized
ggtcacacccagtcaattgt

SEQ ID NO: 115115 - DNA, 20 bp, Artificial Sequence
  chemically synthesized
tgtaactgctgacaattgac

SEQ ID NO: 115116 - DNA, 20 bp, Artificial Sequence
  chemically synthesized
gtaactgctgacaattgact

SEQ ID NO: 115117 - DNA, 20 bp, Artificial Sequence
  chemically synthesized
ccacttttataggtcacacc

SEQ ID NO: 115118 - DNA, 20 bp, Artificial Sequence
  chemically synthesized
tgactgggtgtgacctataa

SEQ ID NO: 115119 - DNA, 20 bp, Artificial Sequence
  chemically synthesized
ctgggtgtgacctataaaag

SEQ ID NO: 115120 - DNA, 20 bp, Artificial Sequence
  chemically synthesized
catgaaactgccacttttat

SEQ ID NO: 115121 - DNA, 20 bp, Artificial Sequence
  chemically synthesized
gcatgaaactgccactttta

SEQ ID NO: 115122 - DNA, 20 bp, Artificial Sequence
  chemically synthesized
ggtgtgacctataaaagtgg

SEQ ID NO: 115123 - DNA, 20 bp, Artificial Sequence
  chemically synthesized
ataaaagtggcagtttcatg

SEQ ID NO: 115124 - DNA, 20 bp, Artificial Sequence
  chemically synthesized
agtttcatgcagtttgcatt

SEQ ID NO: 115125 - DNA, 20 bp, Artificial Sequence
  chemically synthesized
ttttgcactggagatggagt

SEQ ID NO: 115126 - DNA, 20 bp, Artificial Sequence
  chemically synthesized
attaagacttactccatctc

SEQ ID NO: 115127 - DNA, 20 bp, Artificial Sequence
  chemically synthesized
caaattttgcactggagatg

SEQ ID NO: 115128 - DNA, 20 bp, Artificial Sequence
  chemically synthesized
tccaaattttgcactggaga

SEQ ID NO: 115129 - DNA, 20 bp, Artificial Sequence
  chemically synthesized
ctgttccaaattttgcactg

SEQ ID NO: 115130 - DNA, 20 bp, Artificial Sequence
  chemically synthesized
ttctgttccaaattttgcac

SEQ ID NO: 115131 - DNA, 20 bp, Artificial Sequence
  chemically synthesized
tccatctccagtgcaaaatt

SEQ ID NO: 115132 - DNA, 20 bp, Artificial Sequence
  chemically synthesized
ctccagtgcaaaatttggaa

SEQ ID NO: 115133 - DNA, 20 bp, Artificial Sequence
  chemically synthesized
gcaaaatttggaacagaaat

SEQ ID NO: 115134 - DNA, 20 bp, Artificial Sequence
  chemically synthesized
atttatattctggaatgtga

SEQ ID NO: 115135 - DNA, 20 bp, Artificial Sequence
  chemically synthesized
agaaataagctgtcacattc

SEQ ID NO: 115136 - DNA, 20 bp, Artificial Sequence
  chemically synthesized
ctaaccctgcatttatattc

SEQ ID NO: 115137 - DNA, 20 bp, Artificial Sequence
  chemically synthesized
cacattccagaatataaatg

SEQ ID NO: 115138 - DNA, 20 bp, Artificial Sequence
  chemically synthesized
acattccagaatataaatgc

SEQ ID NO: 115139 - DNA, 20 bp, Artificial Sequence
  chemically synthesized
cattccagaatataaatgca

SEQ ID NO: 115140 - DNA, 20 bp, Artificial Sequence
  chemically synthesized
ccagaatataaatgcagggt

SEQ ID NO: 115141 - DNA, 20 bp, Artificial Sequence
  chemically synthesized
atttgacatattttctaatg

SEQ ID NO: 115142 - DNA, 20 bp, Artificial Sequence
  chemically synthesized
tgtttgaaattggactacat

SEQ ID NO: 115143 - DNA, 20 bp, Artificial Sequence
  chemically synthesized
ttttaaattttgtttgaaat

SEQ ID NO: 115144 - DNA, 20 bp, Artificial Sequence
  chemically synthesized
aaaaatatgaaattctccca

SEQ ID NO: 115145 - DNA, 20 bp, Artificial Sequence
  chemically synthesized
aatatgaaattctcccatgg

SEQ ID NO: 115146 - DNA, 20 bp, Artificial Sequence
  chemically synthesized
taagtttcactctgccatgg

SEQ ID NO: 115147 - DNA, 20 bp, Artificial Sequence
  chemically synthesized
tatgaaattctcccatggca

SEQ ID NO: 115148 - DNA, 20 bp, Artificial Sequence
  chemically synthesized
tctaagtttcactctgccat

SEQ ID NO: 115149 - DNA, 20 bp, Artificial Sequence
  chemically synthesized
ctctaagtttcactctgcca

SEQ ID NO: 115150 - DNA, 20 bp, Artificial Sequence
  chemically synthesized
tcccatggcagagtgaaact

SEQ ID NO: 115151 - DNA, 20 bp, Artificial Sequence
  chemically synthesized
ccatggcagagtgaaactta

SEQ ID NO: 115152 - DNA, 20 bp, Artificial Sequence
  chemically synthesized
tgcacaatattacattctct

SEQ ID NO: 115153 - DNA, 20 bp, Artificial Sequence
  chemically synthesized
tgtaatattgtgcattttat

SEQ ID NO: 115154 - DNA, 20 bp, Artificial Sequence
  chemically synthesized
attgtgcattttatcagcat

SEQ ID NO: 115155 - DNA, 20 bp, Artificial Sequence
  chemically synthesized
atcagcatcagcttcatgat

SEQ ID NO: 115156 - DNA, 20 bp, Artificial Sequence
  chemically synthesized
atcaagcgcagctcatcatg

SEQ ID NO: 115157 - DNA, 20 bp, Artificial Sequence
  chemically synthesized
gagctaagatgcatcaagcg

SEQ ID NO: 115158 - DNA, 20 bp, Artificial Sequence
  chemically synthesized
tagaggagctaagatgcatc

SEQ ID NO: 115159 - DNA, 20 bp, Artificial Sequence
  chemically synthesized
gagctgcgcttgatgcatct

SEQ ID NO: 115160 - DNA, 20 bp, Artificial Sequence
  chemically synthesized
agtttaaggatagaggagct

SEQ ID NO: 115161 - DNA, 20 bp, Artificial Sequence
  chemically synthesized
tttctagtttaaggatagag

SEQ ID NO: 115162 - DNA, 20 bp, Artificial Sequence
  chemically synthesized
catttctagtttaaggatag

SEQ ID NO: 115163 - DNA, 20 bp, Artificial Sequence
  chemically synthesized
gcatttctagtttaaggata

SEQ ID NO: 115164 - DNA, 20 bp, Artificial Sequence
  chemically synthesized
cggcatttctagtttaagga

SEQ ID NO: 115165 - DNA, 20 bp, Artificial Sequence
  chemically synthesized
tagctcctctatccttaaac

SEQ ID NO: 115166 - DNA, 20 bp, Artificial Sequence
  chemically synthesized
taagcggcatttctagttta

SEQ ID NO: 115167 - DNA, 20 bp, Artificial Sequence
  chemically synthesized
gtaagcggcatttctagttt

SEQ ID NO: 115168 - DNA, 20 bp, Artificial Sequence
  chemically synthesized
cagagggtaagcggcatttc

SEQ ID NO: 115169 - DNA, 20 bp, Artificial Sequence
  chemically synthesized
ctctggaagcagagggtaag

SEQ ID NO: 115170 - DNA, 20 bp, Artificial Sequence
  chemically synthesized
tttctctggaagcagagggt

SEQ ID NO: 115171 - DNA, 20 bp, Artificial Sequence
  chemically synthesized
ttactttctctggaagcaga

SEQ ID NO: 115172 - DNA, 20 bp, Artificial Sequence
  chemically synthesized
tgccgcttaccctctgcttc

SEQ ID NO: 115173 - DNA, 20 bp, Artificial Sequence
  chemically synthesized
gttactttctctggaagcag

SEQ ID NO: 115174 - DNA, 20 bp, Artificial Sequence
  chemically synthesized
agttactttctctggaagca

SEQ ID NO: 115175 - DNA, 20 bp, Artificial Sequence
  chemically synthesized
ccgcttaccctctgcttcca

SEQ ID NO: 115176 - DNA, 20 bp, Artificial Sequence
  chemically synthesized
ctagttactttctctggaag

SEQ ID NO: 115177 - DNA, 20 bp, Artificial Sequence
  chemically synthesized
ttaccctctgcttccagaga

SEQ ID NO: 115178 - DNA, 20 bp, Artificial Sequence
  chemically synthesized
ttactagttactttctctgg

SEQ ID NO: 115179 - DNA, 20 bp, Artificial Sequence
  chemically synthesized
tatttactagttactttctc

SEQ ID NO: 115180 - DNA, 20 bp, Artificial Sequence
  chemically synthesized
ctgcttccagagaaagtaac

SEQ ID NO: 115181 - DNA, 20 bp, Artificial Sequence
  chemically synthesized
actcttggaaagttatttac

SEQ ID NO: 115182 - DNA, 20 bp, Artificial Sequence
  chemically synthesized
taactagtaaataactttcc

SEQ ID NO: 115183 - DNA, 20 bp, Artificial Sequence
  chemically synthesized
actagtaaataactttccaa

SEQ ID NO: 115184 - DNA, 20 bp, Artificial Sequence
  chemically synthesized
ttttgcaaataactcttgga

SEQ ID NO: 115185 - DNA, 20 bp, Artificial Sequence
  chemically synthesized
tgcattttgcaaataactct

SEQ ID NO: 115186 - DNA, 20 bp, Artificial Sequence
  chemically synthesized
aaaatgcaatgcacataaat

SEQ ID NO: 115187 - DNA, 20 bp, Artificial Sequence
  chemically synthesized
aatgcacataaatcagatga

SEQ ID NO: 115188 - DNA, 20 bp, Artificial Sequence
  chemically synthesized
tgcacataaatcagatgaaa

SEQ ID NO: 115189 - DNA, 20 bp, Artificial Sequence
  chemically synthesized
tcagatgaaagagttctacc

SEQ ID NO: 115190 - DNA, 20 bp, Artificial Sequence
  chemically synthesized
tgaaaatcacattgtctcgg

SEQ ID NO: 115191 - DNA, 20 bp, Artificial Sequence
  chemically synthesized
ggctgaaaatcacattgtct

SEQ ID NO: 115192 - DNA, 20 bp, Artificial Sequence
  chemically synthesized
taccgagacaatgtgatttt

SEQ ID NO: 115193 - DNA, 20 bp, Artificial Sequence
  chemically synthesized
gcaaacttgctggtaggatt

SEQ ID NO: 115194 - DNA, 20 bp, Artificial Sequence
  chemically synthesized
gattttcagccaaatcctac

SEQ ID NO: 115195 - DNA, 20 bp, Artificial Sequence
  chemically synthesized
ttcagccaaatcctaccagc

SEQ ID NO: 115196 - DNA, 20 bp, Artificial Sequence
  chemically synthesized
aaagcagcaaacttgctggt

SEQ ID NO: 115197 - DNA, 20 bp, Artificial Sequence
  chemically synthesized
caaagcagcaaacttgctgg

SEQ ID NO: 115198 - DNA, 20 bp, Artificial Sequence
  chemically synthesized
ttacaaagcagcaaacttgc

SEQ ID NO: 115199 - DNA, 20 bp, Artificial Sequence
  chemically synthesized
taagggcctaatttacaaag

SEQ ID NO: 115200 - DNA, 20 bp, Artificial Sequence
  chemically synthesized
aagtttgctgctttgtaaat

SEQ ID NO: 115201 - DNA, 20 bp, Artificial Sequence
  chemically synthesized
ccctaagggcctaatttaca

SEQ ID NO: 115202 - DNA, 20 bp, Artificial Sequence
  chemically synthesized
agtttgctgctttgtaaatt

SEQ ID NO: 115203 - DNA, 20 bp, Artificial Sequence
  chemically synthesized
tgctttgtaaattaggccct

SEQ ID NO: 115204 - DNA, 20 bp, Artificial Sequence
  chemically synthesized
gctttgtaaattaggccctt

SEQ ID NO: 115205 - DNA, 20 bp, Artificial Sequence
  chemically synthesized
ctttgtaaattaggccctta

SEQ ID NO: 115206 - DNA, 20 bp, Artificial Sequence
  chemically synthesized
tgtaaattaggcccttaggg

SEQ ID NO: 115207 - DNA, 20 bp, Artificial Sequence
  chemically synthesized
gagttactgttcttccctaa

SEQ ID NO: 115208 - DNA, 20 bp, Artificial Sequence
  chemically synthesized
agagttactgttcttcccta

SEQ ID NO: 115209 - DNA, 20 bp, Artificial Sequence
  chemically synthesized
aagagttactgttcttccct

SEQ ID NO: 115210 - DNA, 20 bp, Artificial Sequence
  chemically synthesized
attaggcccttagggaagaa

SEQ ID NO: 115211 - DNA, 20 bp, Artificial Sequence
  chemically synthesized
gggaagaacagtaactcttt

SEQ ID NO: 115212 - DNA, 20 bp, Artificial Sequence
  chemically synthesized
ggaagaacagtaactctttc

SEQ ID NO: 115213 - DNA, 20 bp, Artificial Sequence
  chemically synthesized
ggtttcttactgtcctgaaa

SEQ ID NO: 115214 - DNA, 20 bp, Artificial Sequence
  chemically synthesized
gaacagtaactctttcagga

SEQ ID NO: 115215 - DNA, 20 bp, Artificial Sequence
  chemically synthesized
atggtttcttactgtcctga

SEQ ID NO: 115216 - DNA, 20 bp, Artificial Sequence
  chemically synthesized
agtaactctttcaggacagt

SEQ ID NO: 115217 - DNA, 20 bp, Artificial Sequence
  chemically synthesized
aagggtatcatttaggaaaa

SEQ ID NO: 115218 - DNA, 20 bp, Artificial Sequence
  chemically synthesized
agaccacaagggtatcattt

SEQ ID NO: 115219 - DNA, 20 bp, Artificial Sequence
  chemically synthesized
cagaccacaagggtatcatt

SEQ ID NO: 115220 - DNA, 20 bp, Artificial Sequence
  chemically synthesized
tttcctaaatgatacccttg

SEQ ID NO: 115221 - DNA, 20 bp, Artificial Sequence
  chemically synthesized
gtcaatatttcagaccacaa

SEQ ID NO: 115222 - DNA, 20 bp, Artificial Sequence
  chemically synthesized
tgtcaatatttcagaccaca

SEQ ID NO: 115223 - DNA, 20 bp, Artificial Sequence
  chemically synthesized
ttgtcaatatttcagaccac

SEQ ID NO: 115224 - DNA, 20 bp, Artificial Sequence
  chemically synthesized
gcctgatgttgtcaatattt

SEQ ID NO: 115225 - DNA, 20 bp, Artificial Sequence
  chemically synthesized
gtctgaaatattgacaacat

SEQ ID NO: 115226 - DNA, 20 bp, Artificial Sequence
  chemically synthesized
tctgaaatattgacaacatc

SEQ ID NO: 115227 - DNA, 20 bp, Artificial Sequence
  chemically synthesized
tttccaaattagaaaatatt

SEQ ID NO: 115228 - DNA, 20 bp, Artificial Sequence
  chemically synthesized
aggctgaatattttctaatt

SEQ ID NO: 115229 - DNA, 20 bp, Artificial Sequence
  chemically synthesized
ttttaacgtattttccaaat

SEQ ID NO: 115230 - DNA, 20 bp, Artificial Sequence
  chemically synthesized
aaaatacgttaaaaattcga

SEQ ID NO: 115231 - DNA, 20 bp, Artificial Sequence
  chemically synthesized
taaaaattcgatggcaataa

SEQ ID NO: 115232 - DNA, 20 bp, Artificial Sequence
  chemically synthesized
aaattcgatggcaataacag

SEQ ID NO: 115233 - DNA, 20 bp, Artificial Sequence
  chemically synthesized
agcagaaaatctcctcaaat

SEQ ID NO: 115234 - DNA, 20 bp, Artificial Sequence
  chemically synthesized
cgtaaaggagctcatttgag

SEQ ID NO: 115235 - DNA, 20 bp, Artificial Sequence
  chemically synthesized
cacgtaaaggagctcatttg

SEQ ID NO: 115236 - DNA, 20 bp, Artificial Sequence
  chemically synthesized
gcacgtaaaggagctcattt

SEQ ID NO: 115237 - DNA, 20 bp, Artificial Sequence
  chemically synthesized
tattcaagaggcacgtaaag

SEQ ID NO: 115238 - DNA, 20 bp, Artificial Sequence
  chemically synthesized
attattcaagaggcacgtaa

SEQ ID NO: 115239 - DNA, 20 bp, Artificial Sequence
  chemically synthesized
tattattcaagaggcacgta

SEQ ID NO: 115240 - DNA, 20 bp, Artificial Sequence
  chemically synthesized
agtcttacctattattcaag

SEQ ID NO: 115241 - DNA, 20 bp, Artificial Sequence
  chemically synthesized
cagtcttacctattattcaa

SEQ ID NO: 115242 - DNA, 20 bp, Artificial Sequence
  chemically synthesized
tttacgtgcctcttgaataa

SEQ ID NO: 115243 - DNA, 20 bp, Artificial Sequence
  chemically synthesized
ttacgtgcctcttgaataat

SEQ ID NO: 115244 - DNA, 20 bp, Artificial Sequence
  chemically synthesized
aacagtcttacctattattc

SEQ ID NO: 115245 - DNA, 20 bp, Artificial Sequence
  chemically synthesized
gtgcctcttgaataataggt

SEQ ID NO: 115246 - DNA, 20 bp, Artificial Sequence
  chemically synthesized
cccacacaagcaggaaacaa

SEQ ID NO: 115247 - DNA, 20 bp, Artificial Sequence
  chemically synthesized
actgttgtttcctgcttgtg

SEQ ID NO: 115248 - DNA, 20 bp, Artificial Sequence
  chemically synthesized
cgtaaaacccccacacaagc

SEQ ID NO: 115249 - DNA, 20 bp, Artificial Sequence
  chemically synthesized
ctgttgtttcctgcttgtgt

SEQ ID NO: 115250 - DNA, 20 bp, Artificial Sequence
  chemically synthesized
ccgtaaaacccccacacaag

SEQ ID NO: 115251 - DNA, 20 bp, Artificial Sequence
  chemically synthesized
tgttgtttcctgcttgtgtg

SEQ ID NO: 115252 - DNA, 20 bp, Artificial Sequence
  chemically synthesized
gttgtttcctgcttgtgtgg

SEQ ID NO: 115253 - DNA, 20 bp, Artificial Sequence
  chemically synthesized
aagccgtaaaacccccacac

SEQ ID NO: 115254 - DNA, 20 bp, Artificial Sequence
  chemically synthesized
ctgcttgtgtgggggtttta

SEQ ID NO: 115255 - DNA, 20 bp, Artificial Sequence
  chemically synthesized
agattccgagagaaatgttg

SEQ ID NO: 115256 - DNA, 20 bp, Artificial Sequence
  chemically synthesized
tacggcttcaacatttctct

SEQ ID NO: 115257 - DNA, 20 bp, Artificial Sequence
  chemically synthesized
tacacacacatagattccga

SEQ ID NO: 115258 - DNA, 20 bp, Artificial Sequence
  chemically synthesized
cgtacacacacatagattcc

SEQ ID NO: 115259 - DNA, 20 bp, Artificial Sequence
  chemically synthesized
ggattcaacgtacacacaca

SEQ ID NO: 115260 - DNA, 20 bp, Artificial Sequence
  chemically synthesized
cctggcacaattaaaattta

SEQ ID NO: 115261 - DNA, 20 bp, Artificial Sequence
  chemically synthesized
acctggcacaattaaaattt

SEQ ID NO: 115262 - DNA, 20 bp, Artificial Sequence
  chemically synthesized
gacctggcacaattaaaatt

SEQ ID NO: 115263 - DNA, 20 bp, Artificial Sequence
  chemically synthesized
tccctaaattttaattgtgc

SEQ ID NO: 115264 - DNA, 20 bp, Artificial Sequence
  chemically synthesized
ccctaaattttaattgtgcc

SEQ ID NO: 115265 - DNA, 20 bp, Artificial Sequence
  chemically synthesized
aattttaattgtgccaggtc

SEQ ID NO: 115266 - DNA, 20 bp, Artificial Sequence
  chemically synthesized
gactcattctagactagacc

SEQ ID NO: 115267 - DNA, 20 bp, Artificial Sequence
  chemically synthesized
taattgtgccaggtctagtc

SEQ ID NO: 115268 - DNA, 20 bp, Artificial Sequence
  chemically synthesized
attcttgactcattctagac

SEQ ID NO: 115269 - DNA, 20 bp, Artificial Sequence
  chemically synthesized
tgccaggtctagtctagaat

SEQ ID NO: 115270 - DNA, 20 bp, Artificial Sequence
  chemically synthesized
taagtattcttgactcattc

SEQ ID NO: 115271 - DNA, 20 bp, Artificial Sequence
  chemically synthesized
ggtctagtctagaatgagtc

SEQ ID NO: 115272 - DNA, 20 bp, Artificial Sequence
  chemically synthesized
aatgcacagatatggaaatt

SEQ ID NO: 115273 - DNA, 20 bp, Artificial Sequence
  chemically synthesized
gcatgttgaatgcacagata

SEQ ID NO: 115274 - DNA, 20 bp, Artificial Sequence
  chemically synthesized
tttagagcatgttgaatgca

SEQ ID NO: 115275 - DNA, 20 bp, Artificial Sequence
  chemically synthesized
aaaactatatgatacattta

SEQ ID NO: 115276 - DNA, 20 bp, Artificial Sequence
  chemically synthesized
ttaaaactatatgatacatt

SEQ ID NO: 115277 - DNA, 20 bp, Artificial Sequence
  chemically synthesized
catgctctaaatgtatcata

SEQ ID NO: 115278 - DNA, 20 bp, Artificial Sequence
  chemically synthesized
tcatatagttttaaattttc

SEQ ID NO: 115279 - DNA, 20 bp, Artificial Sequence
  chemically synthesized
cacttaaacccatatggttc

SEQ ID NO: 115280 - DNA, 20 bp, Artificial Sequence
  chemically synthesized
ttaaattttccggaaccata

SEQ ID NO: 115281 - DNA, 20 bp, Artificial Sequence
  chemically synthesized
taaattttccggaaccatat

SEQ ID NO: 115282 - DNA, 20 bp, Artificial Sequence
  chemically synthesized
ataagccacttaaacccata

SEQ ID NO: 115283 - DNA, 20 bp, Artificial Sequence
  chemically synthesized
ttccggaaccatatgggttt

SEQ ID NO: 115284 - DNA, 20 bp, Artificial Sequence
  chemically synthesized
cggaaccatatgggtttaag

SEQ ID NO: 115285 - DNA, 20 bp, Artificial Sequence
  chemically synthesized
gtttaagtggcttatatgat

SEQ ID NO: 115286 - DNA, 20 bp, Artificial Sequence
  chemically synthesized
ttacattttacttatcatat

SEQ ID NO: 115287 - DNA, 20 bp, Artificial Sequence
  chemically synthesized
gataagtaaaatgtaaaaat

SEQ ID NO: 115288 - DNA, 20 bp, Artificial Sequence
  chemically synthesized
atgtaaaaataagaatcata

SEQ ID NO: 115289 - DNA, 20 bp, Artificial Sequence
  chemically synthesized
taagaatcataaagaaaaaa

SEQ ID NO: 115290 - DNA, 20 bp, Artificial Sequence
  chemically synthesized
aaagaaaaaaaagatatgtt

SEQ ID NO: 115291 - DNA, 20 bp, Artificial Sequence
  chemically synthesized
tatgttcagaaaaaaaacca

SEQ ID NO: 115292 - DNA, 20 bp, Artificial Sequence
  chemically synthesized
atgttcagaaaaaaaaccaa

SEQ ID NO: 115293 - DNA, 20 bp, Artificial Sequence
  chemically synthesized
aaaatctaattcaagacctt

SEQ ID NO: 115294 - DNA, 20 bp, Artificial Sequence
  chemically synthesized
aaaaaccaaaggtcttgaat

SEQ ID NO: 115295 - DNA, 20 bp, Artificial Sequence
  chemically synthesized
tttaaaaaaaaatctaattc

SEQ ID NO: 115296 - DNA, 20 bp, Artificial Sequence
  chemically synthesized
ttttttaaattcctttgtcc

SEQ ID NO: 115297 - DNA, 20 bp, Artificial Sequence
  chemically synthesized
tagtttgataacttggacaa

SEQ ID NO: 115298 - DNA, 20 bp, Artificial Sequence
  chemically synthesized
gtagtttgataacttggaca

SEQ ID NO: 115299 - DNA, 20 bp, Artificial Sequence
  chemically synthesized
gggcctgtagtttgataact

SEQ ID NO: 115300 - DNA, 20 bp, Artificial Sequence
  chemically synthesized
ttgtccaagttatcaaacta

SEQ ID NO: 115301 - DNA, 20 bp, Artificial Sequence
  chemically synthesized
tgtccaagttatcaaactac

SEQ ID NO: 115302 - DNA, 20 bp, Artificial Sequence
  chemically synthesized
agttatcaaactacaggccc

SEQ ID NO: 115303 - DNA, 20 bp, Artificial Sequence
  chemically synthesized
caaattttctccagggcctg

SEQ ID NO: 115304 - DNA, 20 bp, Artificial Sequence
  chemically synthesized
ttatcaaactacaggccctg

SEQ ID NO: 115305 - DNA, 20 bp, Artificial Sequence
  chemically synthesized
attcagccaaattttctcca

SEQ ID NO: 115306 - DNA, 20 bp, Artificial Sequence
  chemically synthesized
aattcagccaaattttctcc

SEQ ID NO: 115307 - DNA, 20 bp, Artificial Sequence
  chemically synthesized
aaattcagccaaattttctc

SEQ ID NO: 115308 - DNA, 20 bp, Artificial Sequence
  chemically synthesized
tacaggccctggagaaaatt

SEQ ID NO: 115309 - DNA, 20 bp, Artificial Sequence
  chemically synthesized
tcattgttacttgtaaaatt

SEQ ID NO: 115310 - DNA, 20 bp, Artificial Sequence
  chemically synthesized
aaaatttggctgaattttac

SEQ ID NO: 115311 - DNA, 20 bp, Artificial Sequence
  chemically synthesized
attttacaagtaacaatgac

SEQ ID NO: 115312 - DNA, 20 bp, Artificial Sequence
  chemically synthesized
aagtaacaatgaccagatat

SEQ ID NO: 115313 - DNA, 20 bp, Artificial Sequence
  chemically synthesized
ttattacagtttctaatatc

SEQ ID NO: 115314 - DNA, 20 bp, Artificial Sequence
  chemically synthesized
ctgtttgcaaagcattatta

SEQ ID NO: 115315 - DNA, 20 bp, Artificial Sequence
  chemically synthesized
ctgtaataatgctttgcaaa

SEQ ID NO: 115316 - DNA, 20 bp, Artificial Sequence
  chemically synthesized
tacagtagattctgtttgca

SEQ ID NO: 115317 - DNA, 20 bp, Artificial Sequence
  chemically synthesized
gcaaacagaatctactgtat

SEQ ID NO: 115318 - DNA, 20 bp, Artificial Sequence
  chemically synthesized
aaagtacttaaccaatacag

SEQ ID NO: 115319 - DNA, 20 bp, Artificial Sequence
  chemically synthesized
aaaaaagtacttaaccaata

SEQ ID NO: 115320 - DNA, 20 bp, Artificial Sequence
  chemically synthesized
cagaatctactgtattggtt

SEQ ID NO: 115321 - DNA, 20 bp, Artificial Sequence
  chemically synthesized
taaaactttgttatgtaaaa

SEQ ID NO: 115322 - DNA, 20 bp, Artificial Sequence
  chemically synthesized
aagtacttttttacataaca

SEQ ID NO: 115323 - DNA, 20 bp, Artificial Sequence
  chemically synthesized
acataacaaagttttataat

SEQ ID NO: 115324 - DNA, 20 bp, Artificial Sequence
  chemically synthesized
agttttataatcagctattc

SEQ ID NO: 115325 - DNA, 20 bp, Artificial Sequence
  chemically synthesized
tgtgcaccataaagctggaa

SEQ ID NO: 115326 - DNA, 20 bp, Artificial Sequence
  chemically synthesized
aatcagctattccagcttta

SEQ ID NO: 115327 - DNA, 20 bp, Artificial Sequence
  chemically synthesized
atttttgtgcaccataaagc

SEQ ID NO: 115328 - DNA, 20 bp, Artificial Sequence
  chemically synthesized
agctatttttgtgcaccata

SEQ ID NO: 115329 - DNA, 20 bp, Artificial Sequence
  chemically synthesized
agctttatggtgcacaaaaa

SEQ ID NO: 115330 - DNA, 20 bp, Artificial Sequence
  chemically synthesized
tatggtgcacaaaaatagct

SEQ ID NO: 115331 - DNA, 20 bp, Artificial Sequence
  chemically synthesized
tccttactccatcaaattct

SEQ ID NO: 115332 - DNA, 20 bp, Artificial Sequence
  chemically synthesized
aaaaatagctgagaatttga

SEQ ID NO: 115333 - DNA, 20 bp, Artificial Sequence
  chemically synthesized
aaatagctgagaatttgatg

SEQ ID NO: 115334 - DNA, 20 bp, Artificial Sequence
  chemically synthesized
agctgagaatttgatggagt

SEQ ID NO: 115335 - DNA, 20 bp, Artificial Sequence
  chemically synthesized
gctgagaatttgatggagta

SEQ ID NO: 115336 - DNA, 20 bp, Artificial Sequence
  chemically synthesized
aaggaataatgtgatttcaa

SEQ ID NO: 115337 - DNA, 20 bp, Artificial Sequence
  chemically synthesized
aggaataatgtgatttcaaa

SEQ ID NO: 115338 - DNA, 20 bp, Artificial Sequence
  chemically synthesized
aaggttttcattctattcat

SEQ ID NO: 115339 - DNA, 20 bp, Artificial Sequence
  chemically synthesized
ggttttcattctattcataa

SEQ ID NO: 115340 - DNA, 20 bp, Artificial Sequence
  chemically synthesized
gtacacagtgctcttatgaa

SEQ ID NO: 115341 - DNA, 20 bp, Artificial Sequence
  chemically synthesized
tacatactgagaatggtaca

SEQ ID NO: 115342 - DNA, 20 bp, Artificial Sequence
  chemically synthesized
agagcactgtgtaccattct

SEQ ID NO: 115343 - DNA, 20 bp, Artificial Sequence
  chemically synthesized
ccttatttacatactgagaa

SEQ ID NO: 115344 - DNA, 20 bp, Artificial Sequence
  chemically synthesized
gctgcccttatttacatact

SEQ ID NO: 115345 - DNA, 20 bp, Artificial Sequence
  chemically synthesized
accattctcagtatgtaaat

SEQ ID NO: 115346 - DNA, 20 bp, Artificial Sequence
  chemically synthesized
ccattctcagtatgtaaata

SEQ ID NO: 115347 - DNA, 20 bp, Artificial Sequence
  chemically synthesized
cattctcagtatgtaaataa

SEQ ID NO: 115348 - DNA, 20 bp, Artificial Sequence
  chemically synthesized
tctcagtatgtaaataaggg

SEQ ID NO: 115349 - DNA, 20 bp, Artificial Sequence
  chemically synthesized
taaataagggcagcatgaaa

SEQ ID NO: 115350 - DNA, 20 bp, Artificial Sequence
  chemically synthesized
agcatgaaacagtgttctca

SEQ ID NO: 115351 - DNA, 20 bp, Artificial Sequence
  chemically synthesized
gctgctggtccatggactat

SEQ ID NO: 115352 - DNA, 20 bp, Artificial Sequence
  chemically synthesized
aacagtgttctcatagtcca

SEQ ID NO: 115353 - DNA, 20 bp, Artificial Sequence
  chemically synthesized
tgttctcatagtccatggac

SEQ ID NO: 115354 - DNA, 20 bp, Artificial Sequence
  chemically synthesized
ttgctggtgctgctggtcca

SEQ ID NO: 115355 - DNA, 20 bp, Artificial Sequence
  chemically synthesized
tctcatagtccatggaccag

SEQ ID NO: 115356 - DNA, 20 bp, Artificial Sequence
  chemically synthesized
agtccatggaccagcagcac

SEQ ID NO: 115357 - DNA, 20 bp, Artificial Sequence
  chemically synthesized
tcagacgttgctggtgctgc

SEQ ID NO: 115358 - DNA, 20 bp, Artificial Sequence
  chemically synthesized
aataacttctcagacgttgc

SEQ ID NO: 115359 - DNA, 20 bp, Artificial Sequence
  chemically synthesized
cagcagcaccagcaacgtct

SEQ ID NO: 115360 - DNA, 20 bp, Artificial Sequence
  chemically synthesized
cagcaccagcaacgtctgag

SEQ ID NO: 115361 - DNA, 20 bp, Artificial Sequence
  chemically synthesized
ttgcatttctaataacttct

SEQ ID NO: 115362 - DNA, 20 bp, Artificial Sequence
  chemically synthesized
agcaacgtctgagaagttat

SEQ ID NO: 115363 - DNA, 20 bp, Artificial Sequence
  chemically synthesized
ttattagaaatgcaaattcc

SEQ ID NO: 115364 - DNA, 20 bp, Artificial Sequence
  chemically synthesized
tattagaaatgcaaattccc

SEQ ID NO: 115365 - DNA, 20 bp, Artificial Sequence
  chemically synthesized
aaatgcaaattcccaggcct

SEQ ID NO: 115366 - DNA, 20 bp, Artificial Sequence
  chemically synthesized
gtagagctaggctgaggcct

SEQ ID NO: 115367 - DNA, 20 bp, Artificial Sequence
  chemically synthesized
agtagagctaggctgaggcc

SEQ ID NO: 115368 - DNA, 20 bp, Artificial Sequence
  chemically synthesized
caaattcccaggcctcagcc

SEQ ID NO: 115369 - DNA, 20 bp, Artificial Sequence
  chemically synthesized
gattcagtagagctaggctg

SEQ ID NO: 115370 - DNA, 20 bp, Artificial Sequence
  chemically synthesized
tgattcagtagagctaggct

SEQ ID NO: 115371 - DNA, 20 bp, Artificial Sequence
  chemically synthesized
gtctctgattcagtagagct

SEQ ID NO: 115372 - DNA, 20 bp, Artificial Sequence
  chemically synthesized
agtctctgattcagtagagc

SEQ ID NO: 115373 - DNA, 20 bp, Artificial Sequence
  chemically synthesized
acagagtctctgattcagta

SEQ ID NO: 115374 - DNA, 20 bp, Artificial Sequence
  chemically synthesized
tcagcctagctctactgaat

SEQ ID NO: 115375 - DNA, 20 bp, Artificial Sequence
  chemically synthesized
ccacagagtctctgattcag

SEQ ID NO: 115376 - DNA, 20 bp, Artificial Sequence
  chemically synthesized
agcctagctctactgaatca

SEQ ID NO: 115377 - DNA, 20 bp, Artificial Sequence
  chemically synthesized
tacccacagagtctctgatt

SEQ ID NO: 115378 - DNA, 20 bp, Artificial Sequence
  chemically synthesized
ctactgaatcagagactctg

SEQ ID NO: 115379 - DNA, 20 bp, Artificial Sequence
  chemically synthesized
tactgaatcagagactctgt

SEQ ID NO: 115380 - DNA, 20 bp, Artificial Sequence
  chemically synthesized
cttgccggattttacccaca

SEQ ID NO: 115381 - DNA, 20 bp, Artificial Sequence
  chemically synthesized
agcttgccggattttaccca

SEQ ID NO: 115382 - DNA, 20 bp, Artificial Sequence
  chemically synthesized
gagactctgtgggtaaaatc

SEQ ID NO: 115383 - DNA, 20 bp, Artificial Sequence
  chemically synthesized
ctctgtgggtaaaatccggc

SEQ ID NO: 115384 - DNA, 20 bp, Artificial Sequence
  chemically synthesized
cttgttaaaacacagcttgc

SEQ ID NO: 115385 - DNA, 20 bp, Artificial Sequence
  chemically synthesized
ttggaaggcttgttaaaaca

SEQ ID NO: 115386 - DNA, 20 bp, Artificial Sequence
  chemically synthesized
ccggcaagctgtgttttaac

SEQ ID NO: 115387 - DNA, 20 bp, Artificial Sequence
  chemically synthesized
aagctttagcatatattgga

SEQ ID NO: 115388 - DNA, 20 bp, Artificial Sequence
  chemically synthesized
caagctttagcatatattgg

SEQ ID NO: 115389 - DNA, 20 bp, Artificial Sequence
  chemically synthesized
tctcaagctttagcatatat

SEQ ID NO: 115390 - DNA, 20 bp, Artificial Sequence
  chemically synthesized
aagccttccaatatatgcta

SEQ ID NO: 115391 - DNA, 20 bp, Artificial Sequence
  chemically synthesized
tccaatatatgctaaagctt

SEQ ID NO: 115392 - DNA, 20 bp, Artificial Sequence
  chemically synthesized
caactgtgattctcaagctt

SEQ ID NO: 115393 - DNA, 20 bp, Artificial Sequence
  chemically synthesized
tcctggcaactgtgattctc

SEQ ID NO: 115394 - DNA, 20 bp, Artificial Sequence
  chemically synthesized
atgctaaagcttgagaatca

SEQ ID NO: 115395 - DNA, 20 bp, Artificial Sequence
  chemically synthesized
agcttgagaatcacagttgc

SEQ ID NO: 115396 - DNA, 20 bp, Artificial Sequence
  chemically synthesized
gcttgagaatcacagttgcc

SEQ ID NO: 115397 - DNA, 20 bp, Artificial Sequence
  chemically synthesized
gaatcacagttgccaggaac

SEQ ID NO: 115398 - DNA, 20 bp, Artificial Sequence
  chemically synthesized
tcgttctcaaatctggttcc

SEQ ID NO: 115399 - DNA, 20 bp, Artificial Sequence
  chemically synthesized
agttgccaggaaccagattt

SEQ ID NO: 115400 - DNA, 20 bp, Artificial Sequence
  chemically synthesized
atgccagtcgttctcaaatc

SEQ ID NO: 115401 - DNA, 20 bp, Artificial Sequence
  chemically synthesized
gaaccagatttgagaacgac

SEQ ID NO: 115402 - DNA, 20 bp, Artificial Sequence
  chemically synthesized
agatttgagaacgactggca

SEQ ID NO: 115403 - DNA, 20 bp, Artificial Sequence
  chemically synthesized
tttgagaacgactggcatag

SEQ ID NO: 115404 - DNA, 20 bp, Artificial Sequence
  chemically synthesized
cagcttagcatctactatgc

SEQ ID NO: 115405 - DNA, 20 bp, Artificial Sequence
  chemically synthesized
cgactggcatagtagatgct

SEQ ID NO: 115406 - DNA, 20 bp, Artificial Sequence
  chemically synthesized
tggcatagtagatgctaagc

SEQ ID NO: 115407 - DNA, 20 bp, Artificial Sequence
  chemically synthesized
ggcatagtagatgctaagct

SEQ ID NO: 115408 - DNA, 20 bp, Artificial Sequence
  chemically synthesized
ggggtccgggcagcccagct

SEQ ID NO: 115409 - DNA, 20 bp, Artificial Sequence
  chemically synthesized
agatgctaagctgggctgcc

SEQ ID NO: 115410 - DNA, 20 bp, Artificial Sequence
  chemically synthesized
gaaaaggggtccgggcagcc

SEQ ID NO: 115411 - DNA, 20 bp, Artificial Sequence
  chemically synthesized
gtcctgaaaaggggtccggg

SEQ ID NO: 115412 - DNA, 20 bp, Artificial Sequence
  chemically synthesized
tcagtcctgaaaaggggtcc

SEQ ID NO: 115413 - DNA, 20 bp, Artificial Sequence
  chemically synthesized
ttcagtcctgaaaaggggtc

SEQ ID NO: 115414 - DNA, 20 bp, Artificial Sequence
  chemically synthesized
gggctgcccggacccctttt

SEQ ID NO: 115415 - DNA, 20 bp, Artificial Sequence
  chemically synthesized
ggctgcccggaccccttttc

SEQ ID NO: 115416 - DNA, 20 bp, Artificial Sequence
  chemically synthesized
agtatttcagtcctgaaaag

SEQ ID NO: 115417 - DNA, 20 bp, Artificial Sequence
  chemically synthesized
aagtatttcagtcctgaaaa

SEQ ID NO: 115418 - DNA, 20 bp, Artificial Sequence
  chemically synthesized
gaagtatttcagtcctgaaa

SEQ ID NO: 115419 - DNA, 20 bp, Artificial Sequence
  chemically synthesized
agaagtatttcagtcctgaa

SEQ ID NO: 115420 - DNA, 20 bp, Artificial Sequence
  chemically synthesized
agctggggtcagaagtattt

SEQ ID NO: 115421 - DNA, 20 bp, Artificial Sequence
  chemically synthesized
gactgaaatacttctgaccc

SEQ ID NO: 115422 - DNA, 20 bp, Artificial Sequence
  chemically synthesized
ctaccagcagctggggtcag

SEQ ID NO: 115423 - DNA, 20 bp, Artificial Sequence
  chemically synthesized
gcactaccagcagctggggt

SEQ ID NO: 115424 - DNA, 20 bp, Artificial Sequence
  chemically synthesized
atacttctgaccccagctgc

SEQ ID NO: 115425 - DNA, 20 bp, Artificial Sequence
  chemically synthesized
agtagcactaccagcagctg

SEQ ID NO: 115426 - DNA, 20 bp, Artificial Sequence
  chemically synthesized
cagtagcactaccagcagct

SEQ ID NO: 115427 - DNA, 20 bp, Artificial Sequence
  chemically synthesized
ccagtagcactaccagcagc

SEQ ID NO: 115428 - DNA, 20 bp, Artificial Sequence
  chemically synthesized
cttctgaccccagctgctgg

SEQ ID NO: 115429 - DNA, 20 bp, Artificial Sequence
  chemically synthesized
tcagccagtagcactaccag

SEQ ID NO: 115430 - DNA, 20 bp, Artificial Sequence
  chemically synthesized
ctgtcagccagtagcactac

SEQ ID NO: 115431 - DNA, 20 bp, Artificial Sequence
  chemically synthesized
ccagctgctggtagtgctac

SEQ ID NO: 115432 - DNA, 20 bp, Artificial Sequence
  chemically synthesized
agctgaggactgtcagccag

SEQ ID NO: 115433 - DNA, 20 bp, Artificial Sequence
  chemically synthesized
ctggtagtgctactggctga

SEQ ID NO: 115434 - DNA, 20 bp, Artificial Sequence
  chemically synthesized
aacagctgaggactgtcagc

SEQ ID NO: 115435 - DNA, 20 bp, Artificial Sequence
  chemically synthesized
gaataacagctgaggactgt

SEQ ID NO: 115436 - DNA, 20 bp, Artificial Sequence
  chemically synthesized
tgctactggctgacagtcct

SEQ ID NO: 115437 - DNA, 20 bp, Artificial Sequence
  chemically synthesized
tcagacaggaataacagctg

SEQ ID NO: 115438 - DNA, 20 bp, Artificial Sequence
  chemically synthesized
ctcagacaggaataacagct

SEQ ID NO: 115439 - DNA, 20 bp, Artificial Sequence
  chemically synthesized
cagctctcagacaggaataa

SEQ ID NO: 115440 - DNA, 20 bp, Artificial Sequence
  chemically synthesized
ctcagctgttattcctgtct

SEQ ID NO: 115441 - DNA, 20 bp, Artificial Sequence
  chemically synthesized
cagctgttattcctgtctga

SEQ ID NO: 115442 - DNA, 20 bp, Artificial Sequence
  chemically synthesized
gctgagtccagctctcagac

SEQ ID NO: 115443 - DNA, 20 bp, Artificial Sequence
  chemically synthesized
agctgagtccagctctcaga

SEQ ID NO: 115444 - DNA, 20 bp, Artificial Sequence
  chemically synthesized
tgttattcctgtctgagagc

SEQ ID NO: 115445 - DNA, 20 bp, Artificial Sequence
  chemically synthesized
ctttagctgagtccagctct

SEQ ID NO: 115446 - DNA, 20 bp, Artificial Sequence
  chemically synthesized
tcctgtctgagagctggact

SEQ ID NO: 115447 - DNA, 20 bp, Artificial Sequence
  chemically synthesized
cacctctctttagctgagtc

SEQ ID NO: 115448 - DNA, 20 bp, Artificial Sequence
  chemically synthesized
ctgagagctggactcagcta

SEQ ID NO: 115449 - DNA, 20 bp, Artificial Sequence
  chemically synthesized
gagagctggactcagctaaa

SEQ ID NO: 115450 - DNA, 20 bp, Artificial Sequence
  chemically synthesized
ctaggcacctctctttagct

SEQ ID NO: 115451 - DNA, 20 bp, Artificial Sequence
  chemically synthesized
gagctggactcagctaaaga

SEQ ID NO: 115452 - DNA, 20 bp, Artificial Sequence
  chemically synthesized
agctggactcagctaaagag

SEQ ID NO: 115453 - DNA, 20 bp, Artificial Sequence
  chemically synthesized
ttgggctaggcacctctctt

SEQ ID NO: 115454 - DNA, 20 bp, Artificial Sequence
  chemically synthesized
ctcagctaaagagaggtgcc

SEQ ID NO: 115455 - DNA, 20 bp, Artificial Sequence
  chemically synthesized
aaagagaggtgcctagccca

SEQ ID NO: 115456 - DNA, 20 bp, Artificial Sequence
  chemically synthesized
atagtgggtaactttgggct

SEQ ID NO: 115457 - DNA, 20 bp, Artificial Sequence
  chemically synthesized
catagtgggtaactttgggc

SEQ ID NO: 115458 - DNA, 20 bp, Artificial Sequence
  chemically synthesized
gggacatagtgggtaacttt

SEQ ID NO: 115459 - DNA, 20 bp, Artificial Sequence
  chemically synthesized
ggggacatagtgggtaactt

SEQ ID NO: 115460 - DNA, 20 bp, Artificial Sequence
  chemically synthesized
gcccgtctcggggacatagt

SEQ ID NO: 115461 - DNA, 20 bp, Artificial Sequence
  chemically synthesized
agcccgtctcggggacatag

SEQ ID NO: 115462 - DNA, 20 bp, Artificial Sequence
  chemically synthesized
aagttacccactatgtcccc

SEQ ID NO: 115463 - DNA, 20 bp, Artificial Sequence
  chemically synthesized
tgcagcccgtctcggggaca

SEQ ID NO: 115464 - DNA, 20 bp, Artificial Sequence
  chemically synthesized
tacccactatgtccccgaga

SEQ ID NO: 115465 - DNA, 20 bp, Artificial Sequence
  chemically synthesized
acccactatgtccccgagac

SEQ ID NO: 115466 - DNA, 20 bp, Artificial Sequence
  chemically synthesized
aatacgtgcagcccgtctcg

SEQ ID NO: 115467 - DNA, 20 bp, Artificial Sequence
  chemically synthesized
caatacgtgcagcccgtctc

SEQ ID NO: 115468 - DNA, 20 bp, Artificial Sequence
  chemically synthesized
ccaatacgtgcagcccgtct

SEQ ID NO: 115469 - DNA, 20 bp, Artificial Sequence
  chemically synthesized
ccgagacgggctgcacgtat

SEQ ID NO: 115470 - DNA, 20 bp, Artificial Sequence
  chemically synthesized
ctcccatcaaccaatacgtg

SEQ ID NO: 115471 - DNA, 20 bp, Artificial Sequence
  chemically synthesized
gggctgcacgtattggttga

SEQ ID NO: 115472 - DNA, 20 bp, Artificial Sequence
  chemically synthesized
ggctgcacgtattggttgat

SEQ ID NO: 115473 - DNA, 20 bp, Artificial Sequence
  chemically synthesized
ctgcacgtattggttgatgg

SEQ ID NO: 115474 - DNA, 20 bp, Artificial Sequence
  chemically synthesized
gcacgtattggttgatggga

SEQ ID NO: 115475 - DNA, 20 bp, Artificial Sequence
  chemically synthesized
attggttgatgggagagttg

SEQ ID NO: 115476 - DNA, 20 bp, Artificial Sequence
  chemically synthesized
ttggttgatgggagagttgt

SEQ ID NO: 115477 - DNA, 20 bp, Artificial Sequence
  chemically synthesized
tggttgatgggagagttgtg

SEQ ID NO: 115478 - DNA, 20 bp, Artificial Sequence
  chemically synthesized
agttgtggggtataaaatcc

SEQ ID NO: 115479 - DNA, 20 bp, Artificial Sequence
  chemically synthesized
gttgtggggtataaaatcct

SEQ ID NO: 115480 - DNA, 20 bp, Artificial Sequence
  chemically synthesized
tgagttgcagcaagggaccc

SEQ ID NO: 115481 - DNA, 20 bp, Artificial Sequence
  chemically synthesized
ctgagttgcagcaagggacc

SEQ ID NO: 115482 - DNA, 20 bp, Artificial Sequence
  chemically synthesized
attgtcctgagttgcagcaa

SEQ ID NO: 115483 - DNA, 20 bp, Artificial Sequence
  chemically synthesized
aattgtcctgagttgcagca

SEQ ID NO: 115484 - DNA, 20 bp, Artificial Sequence
  chemically synthesized
gaattgtcctgagttgcagc

SEQ ID NO: 115485 - DNA, 20 bp, Artificial Sequence
  chemically synthesized
ctgggtcccttgctgcaact

SEQ ID NO: 115486 - DNA, 20 bp, Artificial Sequence
  chemically synthesized
tgggtcccttgctgcaactc

SEQ ID NO: 115487 - DNA, 20 bp, Artificial Sequence
  chemically synthesized
ttcagaattgtcctgagttg

SEQ ID NO: 115488 - DNA, 20 bp, Artificial Sequence
  chemically synthesized
tagcccttcagaattgtcct

SEQ ID NO: 115489 - DNA, 20 bp, Artificial Sequence
  chemically synthesized
tgcaactcaggacaattctg

SEQ ID NO: 115490 - DNA, 20 bp, Artificial Sequence
  chemically synthesized
gcaactcaggacaattctga

SEQ ID NO: 115491 - DNA, 20 bp, Artificial Sequence
  chemically synthesized
caactcaggacaattctgaa

SEQ ID NO: 115492 - DNA, 20 bp, Artificial Sequence
  chemically synthesized
ctgaaggtagaatagccctt

SEQ ID NO: 115493 - DNA, 20 bp, Artificial Sequence
  chemically synthesized
tctgaagtctgaaggtagaa

SEQ ID NO: 115494 - DNA, 20 bp, Artificial Sequence
  chemically synthesized
ctgaagggctattctacctt

SEQ ID NO: 115495 - DNA, 20 bp, Artificial Sequence
  chemically synthesized
ggatctctgaagtctgaagg

SEQ ID NO: 115496 - DNA, 20 bp, Artificial Sequence
  chemically synthesized
ggaggatctctgaagtctga

SEQ ID NO: 115497 - DNA, 20 bp, Artificial Sequence
  chemically synthesized
gctattctaccttcagactt

SEQ ID NO: 115498 - DNA, 20 bp, Artificial Sequence
  chemically synthesized
aggaggatctctgaagtctg

SEQ ID NO: 115499 - DNA, 20 bp, Artificial Sequence
  chemically synthesized
tattctaccttcagacttca

SEQ ID NO: 115500 - DNA, 20 bp, Artificial Sequence
  chemically synthesized
cttccccaggaggatctctg

SEQ ID NO: 115501 - DNA, 20 bp, Artificial Sequence
  chemically synthesized
tcagacttcagagatcctcc

SEQ ID NO: 115502 - DNA, 20 bp, Artificial Sequence
  chemically synthesized
cagacttcagagatcctcct

SEQ ID NO: 115503 - DNA, 20 bp, Artificial Sequence
  chemically synthesized
agacttcagagatcctcctg

SEQ ID NO: 115504 - DNA, 20 bp, Artificial Sequence
  chemically synthesized
cttcagagatcctcctgggg

SEQ ID NO: 115505 - DNA, 20 bp, Artificial Sequence
  chemically synthesized
ccttcctagccttccccagg

SEQ ID NO: 115506 - DNA, 20 bp, Artificial Sequence
  chemically synthesized
ttcagagatcctcctgggga

SEQ ID NO: 115507 - DNA, 20 bp, Artificial Sequence
  chemically synthesized
tccttcctagccttccccag

SEQ ID NO: 115508 - DNA, 20 bp, Artificial Sequence
  chemically synthesized
tctccttcctagccttcccc

SEQ ID NO: 115509 - DNA, 20 bp, Artificial Sequence
  chemically synthesized
ctctccttcctagccttccc

SEQ ID NO: 115510 - DNA, 20 bp, Artificial Sequence
  chemically synthesized
gagatcctcctggggaaggc

SEQ ID NO: 115511 - DNA, 20 bp, Artificial Sequence
  chemically synthesized
agatcctcctggggaaggct

SEQ ID NO: 115512 - DNA, 20 bp, Artificial Sequence
  chemically synthesized
tcctcctggggaaggctagg

SEQ ID NO: 115513 - DNA, 20 bp, Artificial Sequence
  chemically synthesized
cctcctggggaaggctagga

SEQ ID NO: 115514 - DNA, 20 bp, Artificial Sequence
  chemically synthesized
tcctggggaaggctaggaag

SEQ ID NO: 115515 - DNA, 20 bp, Artificial Sequence
  chemically synthesized
ctggggaaggctaggaagga

SEQ ID NO: 115516 - DNA, 20 bp, Artificial Sequence
  chemically synthesized
aaccctccgcctctccttcc

SEQ ID NO: 115517 - DNA, 20 bp, Artificial Sequence
  chemically synthesized
tggggaaggctaggaaggag

SEQ ID NO: 115518 - DNA, 20 bp, Artificial Sequence
  chemically synthesized
ggaaggctaggaaggagagg

SEQ ID NO: 115519 - DNA, 20 bp, Artificial Sequence
  chemically synthesized
aaggctaggaaggagaggcg

SEQ ID NO: 115520 - DNA, 20 bp, Artificial Sequence
  chemically synthesized
aggctaggaaggagaggcgg

SEQ ID NO: 115521 - DNA, 20 bp, Artificial Sequence
  chemically synthesized
ggctaggaaggagaggcgga

SEQ ID NO: 115522 - DNA, 20 bp, Artificial Sequence
  chemically synthesized
gcggagggttgattgtgttg

SEQ ID NO: 115523 - DNA, 20 bp, Artificial Sequence
  chemically synthesized
gtgttgtagttgtgactgta

SEQ ID NO: 115524 - DNA, 20 bp, Artificial Sequence
  chemically synthesized
ttgtagttgtgactgtatgg

SEQ ID NO: 115525 - DNA, 20 bp, Artificial Sequence
  chemically synthesized
ggagaagctgggctaccata

SEQ ID NO: 115526 - DNA, 20 bp, Artificial Sequence
  chemically synthesized
gttgtgactgtatggtagcc

SEQ ID NO: 115527 - DNA, 20 bp, Artificial Sequence
  chemically synthesized
attgggcagaaggagaagct

SEQ ID NO: 115528 - DNA, 20 bp, Artificial Sequence
  chemically synthesized
gattgggcagaaggagaagc

SEQ ID NO: 115529 - DNA, 20 bp, Artificial Sequence
  chemically synthesized
gcaggattgggcagaaggag

SEQ ID NO: 115530 - DNA, 20 bp, Artificial Sequence
  chemically synthesized
ggagcaggattgggcagaag

SEQ ID NO: 115531 - DNA, 20 bp, Artificial Sequence
  chemically synthesized
agggagcaggattgggcaga

SEQ ID NO: 115532 - DNA, 20 bp, Artificial Sequence
  chemically synthesized
aagggagcaggattgggcag

SEQ ID NO: 115533 - DNA, 20 bp, Artificial Sequence
  chemically synthesized
ggaaagggagcaggattggg

SEQ ID NO: 115534 - DNA, 20 bp, Artificial Sequence
  chemically synthesized
aaaggaaagggagcaggatt

SEQ ID NO: 115535 - DNA, 20 bp, Artificial Sequence
  chemically synthesized
gaaaggaaagggagcaggat

SEQ ID NO: 115536 - DNA, 20 bp, Artificial Sequence
  chemically synthesized
cggaggaaaggaaagggagc

SEQ ID NO: 115537 - DNA, 20 bp, Artificial Sequence
  chemically synthesized
gcggaggaaaggaaagggag

SEQ ID NO: 115538 - DNA, 20 bp, Artificial Sequence
  chemically synthesized
tgagcggaggaaaggaaagg

SEQ ID NO: 115539 - DNA, 20 bp, Artificial Sequence
  chemically synthesized
tgtgagcggaggaaaggaaa

SEQ ID NO: 115540 - DNA, 20 bp, Artificial Sequence
  chemically synthesized
ctgtgagcggaggaaaggaa

SEQ ID NO: 115541 - DNA, 20 bp, Artificial Sequence
  chemically synthesized
cctgtgagcggaggaaagga

SEQ ID NO: 115542 - DNA, 20 bp, Artificial Sequence
  chemically synthesized
aacacctgtgagcggaggaa

SEQ ID NO: 115543 - DNA, 20 bp, Artificial Sequence
  chemically synthesized
taacacctgtgagcggagga

SEQ ID NO: 115544 - DNA, 20 bp, Artificial Sequence
  chemically synthesized
cctttcctttcctccgctca

SEQ ID NO: 115545 - DNA, 20 bp, Artificial Sequence
  chemically synthesized
ggattaacacctgtgagcgg

SEQ ID NO: 115546 - DNA, 20 bp, Artificial Sequence
  chemically synthesized
ctttcctttcctccgctcac

SEQ ID NO: 115547 - DNA, 20 bp, Artificial Sequence
  chemically synthesized
aggattaacacctgtgagcg

SEQ ID NO: 115548 - DNA, 20 bp, Artificial Sequence
  chemically synthesized
tcaggattaacacctgtgag

SEQ ID NO: 115549 - DNA, 20 bp, Artificial Sequence
  chemically synthesized
ctctcaggattaacacctgt

SEQ ID NO: 115550 - DNA, 20 bp, Artificial Sequence
  chemically synthesized
cgctcacaggtgttaatcct

SEQ ID NO: 115551 - DNA, 20 bp, Artificial Sequence
  chemically synthesized
ctcacaggtgttaatcctga

SEQ ID NO: 115552 - DNA, 20 bp, Artificial Sequence
  chemically synthesized
ttttattggagagtgctctc

SEQ ID NO: 115553 - DNA, 20 bp, Artificial Sequence
  chemically synthesized
attttattggagagtgctct

SEQ ID NO: 115554 - DNA, 20 bp, Artificial Sequence
  chemically synthesized
catgaaggaattttattgga

SEQ ID NO: 115555 - DNA, 20 bp, Artificial Sequence
  chemically synthesized
agcatgaaggaattttattg

SEQ ID NO: 115556 - DNA, 20 bp, Artificial Sequence
  chemically synthesized
ttagcatgaaggaattttat

SEQ ID NO: 115557 - DNA, 20 bp, Artificial Sequence
  chemically synthesized
tgagaaagtgattagcatga

SEQ ID NO: 115558 - DNA, 20 bp, Artificial Sequence
  chemically synthesized
ctgagaaagtgattagcatg

SEQ ID NO: 115559 - DNA, 20 bp, Artificial Sequence
  chemically synthesized
gcagattctgagaaagtgat

SEQ ID NO: 115560 - DNA, 20 bp, Artificial Sequence
  chemically synthesized
cttcatgctaatcactttct

SEQ ID NO: 115561 - DNA, 20 bp, Artificial Sequence
  chemically synthesized
ccagaaagcagattctgaga

SEQ ID NO: 115562 - DNA, 20 bp, Artificial Sequence
  chemically synthesized
tctcccagaaagcagattct

SEQ ID NO: 115563 - DNA, 20 bp, Artificial Sequence
  chemically synthesized
ctttctcagaatctgctttc

SEQ ID NO: 115564 - DNA, 20 bp, Artificial Sequence
  chemically synthesized
tttctcagaatctgctttct

SEQ ID NO: 115565 - DNA, 20 bp, Artificial Sequence
  chemically synthesized
ggtcaagttctcccagaaag

SEQ ID NO: 115566 - DNA, 20 bp, Artificial Sequence
  chemically synthesized
tctcagaatctgctttctgg

SEQ ID NO: 115567 - DNA, 20 bp, Artificial Sequence
  chemically synthesized
ggaggtcaagttctcccaga

SEQ ID NO: 115568 - DNA, 20 bp, Artificial Sequence
  chemically synthesized
ttcaggaggtcaagttctcc

SEQ ID NO: 115569 - DNA, 20 bp, Artificial Sequence
  chemically synthesized
gcatgacaattcaggaggtc

SEQ ID NO: 115570 - DNA, 20 bp, Artificial Sequence
  chemically synthesized
gttcagcatgacaattcagg

SEQ ID NO: 115571 - DNA, 20 bp, Artificial Sequence
  chemically synthesized
tgttcagcatgacaattcag

SEQ ID NO: 115572 - DNA, 20 bp, Artificial Sequence
  chemically synthesized
cttgttcagcatgacaattc

SEQ ID NO: 115573 - DNA, 20 bp, Artificial Sequence
  chemically synthesized
ccttgttcagcatgacaatt

SEQ ID NO: 115574 - DNA, 20 bp, Artificial Sequence
  chemically synthesized
cctgaattgtcatgctgaac

SEQ ID NO: 115575 - DNA, 20 bp, Artificial Sequence
  chemically synthesized
ctgaattgtcatgctgaaca

SEQ ID NO: 115576 - DNA, 20 bp, Artificial Sequence
  chemically synthesized
atatttttaaaatccttgtt

SEQ ID NO: 115577 - DNA, 20 bp, Artificial Sequence
  chemically synthesized
ttttaaaaatatacttgcct

SEQ ID NO: 115578 - DNA, 20 bp, Artificial Sequence
  chemically synthesized
accacatatatttcttaggc

SEQ ID NO: 115579 - DNA, 20 bp, Artificial Sequence
  chemically synthesized
ggagaccacatatatttctt

SEQ ID NO: 115580 - DNA, 20 bp, Artificial Sequence
  chemically synthesized
tggagaccacatatatttct

SEQ ID NO: 115581 - DNA, 20 bp, Artificial Sequence
  chemically synthesized
acttgcctaagaaatatatg

SEQ ID NO: 115582 - DNA, 20 bp, Artificial Sequence
  chemically synthesized
agaaatatatgtggtctcca

SEQ ID NO: 115583 - DNA, 20 bp, Artificial Sequence
  chemically synthesized
gaaatatatgtggtctccaa

SEQ ID NO: 115584 - DNA, 20 bp, Artificial Sequence
  chemically synthesized
aaatatatgtggtctccaaa

SEQ ID NO: 115585 - DNA, 20 bp, Artificial Sequence
  chemically synthesized
cctccatcttgttccctttg

SEQ ID NO: 115586 - DNA, 20 bp, Artificial Sequence
  chemically synthesized
atcctccatcttgttccctt

SEQ ID NO: 115587 - DNA, 20 bp, Artificial Sequence
  chemically synthesized
atgtggtctccaaagggaac

SEQ ID NO: 115588 - DNA, 20 bp, Artificial Sequence
  chemically synthesized
ggtctccaaagggaacaaga

SEQ ID NO: 115589 - DNA, 20 bp, Artificial Sequence
  chemically synthesized
tctccaaagggaacaagatg

SEQ ID NO: 115590 - DNA, 20 bp, Artificial Sequence
  chemically synthesized
ctccaaagggaacaagatgg

SEQ ID NO: 115591 - DNA, 20 bp, Artificial Sequence
  chemically synthesized
agatggaggattctcacatg

SEQ ID NO: 115592 - DNA, 20 bp, Artificial Sequence
  chemically synthesized
caggcacaattactgcatgt

SEQ ID NO: 115593 - DNA, 20 bp, Artificial Sequence
  chemically synthesized
caaaagttcagtagcaattc

SEQ ID NO: 115594 - DNA, 20 bp, Artificial Sequence
  chemically synthesized
ccaaaagttcagtagcaatt

SEQ ID NO: 115595 - DNA, 20 bp, Artificial Sequence
  chemically synthesized
aagggcaaccaaaagttcag

SEQ ID NO: 115596 - DNA, 20 bp, Artificial Sequence
  chemically synthesized
ctgaattgctactgaacttt

SEQ ID NO: 115597 - DNA, 20 bp, Artificial Sequence
  chemically synthesized
ttaaagggcaaccaaaagtt

SEQ ID NO: 115598 - DNA, 20 bp, Artificial Sequence
  chemically synthesized
tctccttaaagggcaaccaa

SEQ ID NO: 115599 - DNA, 20 bp, Artificial Sequence
  chemically synthesized
tgaacttttggttgcccttt

SEQ ID NO: 115600 - DNA, 20 bp, Artificial Sequence
  chemically synthesized
gaacttttggttgcccttta

SEQ ID NO: 115601 - DNA, 20 bp, Artificial Sequence
  chemically synthesized
acttttggttgccctttaag

SEQ ID NO: 115602 - DNA, 20 bp, Artificial Sequence
  chemically synthesized
tatctataggtctccttaaa

SEQ ID NO: 115603 - DNA, 20 bp, Artificial Sequence
  chemically synthesized
ttatctataggtctccttaa

SEQ ID NO: 115604 - DNA, 20 bp, Artificial Sequence
  chemically synthesized
attatctataggtctcctta

SEQ ID NO: 115605 - DNA, 20 bp, Artificial Sequence
  chemically synthesized
ttgccctttaaggagaccta

SEQ ID NO: 115606 - DNA, 20 bp, Artificial Sequence
  chemically synthesized
tgcaaacctgtattatctat

SEQ ID NO: 115607 - DNA, 20 bp, Artificial Sequence
  chemically synthesized
atgcaaacctgtattatcta

SEQ ID NO: 115608 - DNA, 20 bp, Artificial Sequence
  chemically synthesized
aaggagacctatagataata

SEQ ID NO: 115609 - DNA, 20 bp, Artificial Sequence
  chemically synthesized
aggagacctatagataatac

SEQ ID NO: 115610 - DNA, 20 bp, Artificial Sequence
  chemically synthesized
atacaggtttgcattatcat

SEQ ID NO: 115611 - DNA, 20 bp, Artificial Sequence
  chemically synthesized
tttgcattatcatcagttac

SEQ ID NO: 115612 - DNA, 20 bp, Artificial Sequence
  chemically synthesized
cattatcatcagttacaagc

SEQ ID NO: 115613 - DNA, 20 bp, Artificial Sequence
  chemically synthesized
ttacaagcaagaatctactg

SEQ ID NO: 115614 - DNA, 20 bp, Artificial Sequence
  chemically synthesized
tacaagcaagaatctactga

SEQ ID NO: 115615 - DNA, 20 bp, Artificial Sequence
  chemically synthesized
acaagcaagaatctactgaa

SEQ ID NO: 115616 - DNA, 20 bp, Artificial Sequence
  chemically synthesized
caagcaagaatctactgaag

SEQ ID NO: 115617 - DNA, 20 bp, Artificial Sequence
  chemically synthesized
ccaacactccgccccttcag

SEQ ID NO: 115618 - DNA, 20 bp, Artificial Sequence
  chemically synthesized
gcaagaatctactgaagggg

SEQ ID NO: 115619 - DNA, 20 bp, Artificial Sequence
  chemically synthesized
gctccaacactccgcccctt

SEQ ID NO: 115620 - DNA, 20 bp, Artificial Sequence
  chemically synthesized
aagaatctactgaaggggcg

SEQ ID NO: 115621 - DNA, 20 bp, Artificial Sequence
  chemically synthesized
ctactgaaggggcggagtgt

SEQ ID NO: 115622 - DNA, 20 bp, Artificial Sequence
  chemically synthesized
actgaaggggcggagtgttg

SEQ ID NO: 115623 - DNA, 20 bp, Artificial Sequence
  chemically synthesized
ggcggagtgttggagctata

SEQ ID NO: 115624 - DNA, 20 bp, Artificial Sequence
  chemically synthesized
agtgttggagctataaagct

SEQ ID NO: 115625 - DNA, 20 bp, Artificial Sequence
  chemically synthesized
tagggttgcactaagcttta

SEQ ID NO: 115626 - DNA, 20 bp, Artificial Sequence
  chemically synthesized
ggcacgtatagggttgcact

SEQ ID NO: 115627 - DNA, 20 bp, Artificial Sequence
  chemically synthesized
cactttctttggcacgtata

SEQ ID NO: 115628 - DNA, 20 bp, Artificial Sequence
  chemically synthesized
acactttctttggcacgtat

SEQ ID NO: 115629 - DNA, 20 bp, Artificial Sequence
  chemically synthesized
aacactttctttggcacgta

SEQ ID NO: 115630 - DNA, 20 bp, Artificial Sequence
  chemically synthesized
gtgcaaccctatacgtgcca

SEQ ID NO: 115631 - DNA, 20 bp, Artificial Sequence
  chemically synthesized
aaccctatacgtgccaaaga

SEQ ID NO: 115632 - DNA, 20 bp, Artificial Sequence
  chemically synthesized
ctctggataaacactttctt

SEQ ID NO: 115633 - DNA, 20 bp, Artificial Sequence
  chemically synthesized
tgccaaagaaagtgtttatc

SEQ ID NO: 115634 - DNA, 20 bp, Artificial Sequence
  chemically synthesized
ccaaagaaagtgtttatcca

SEQ ID NO: 115635 - DNA, 20 bp, Artificial Sequence
  chemically synthesized
ccttcatgtgcagttgtctc

SEQ ID NO: 115636 - DNA, 20 bp, Artificial Sequence
  chemically synthesized
tccagagacaactgcacatg

SEQ ID NO: 115637 - DNA, 20 bp, Artificial Sequence
  chemically synthesized
ccagagacaactgcacatga

SEQ ID NO: 115638 - DNA, 20 bp, Artificial Sequence
  chemically synthesized
tgattctttaccttcatgtg

SEQ ID NO: 115639 - DNA, 20 bp, Artificial Sequence
  chemically synthesized
gacaactgcacatgaaggta

SEQ ID NO: 115640 - DNA, 20 bp, Artificial Sequence
  chemically synthesized
cacatgaaggtaaagaatca

SEQ ID NO: 115641 - DNA, 20 bp, Artificial Sequence
  chemically synthesized
atgaaggtaaagaatcacag

SEQ ID NO: 115642 - DNA, 20 bp, Artificial Sequence
  chemically synthesized
tgaaggtaaagaatcacaga

SEQ ID NO: 115643 - DNA, 20 bp, Artificial Sequence
  chemically synthesized
aatcacagaaggcatgtttt

SEQ ID NO: 115644 - DNA, 20 bp, Artificial Sequence
  chemically synthesized
tcaggtcttaaaaagaaaat

SEQ ID NO: 115645 - DNA, 20 bp, Artificial Sequence
  chemically synthesized
atcaggtcttaaaaagaaaa

SEQ ID NO: 115646 - DNA, 20 bp, Artificial Sequence
  chemically synthesized
agcatacccattttcttttt

SEQ ID NO: 115647 - DNA, 20 bp, Artificial Sequence
  chemically synthesized
attgataatcaggtcttaaa

SEQ ID NO: 115648 - DNA, 20 bp, Artificial Sequence
  chemically synthesized
tgatttcttcattgataatc

SEQ ID NO: 115649 - DNA, 20 bp, Artificial Sequence
  chemically synthesized
ttgatttcttcattgataat

SEQ ID NO: 115650 - DNA, 20 bp, Artificial Sequence
  chemically synthesized
ttaagacctgattatcaatg

SEQ ID NO: 115651 - DNA, 20 bp, Artificial Sequence
  chemically synthesized
tatcaatgaagaaatcaaat

SEQ ID NO: 115652 - DNA, 20 bp, Artificial Sequence
  chemically synthesized
aatgaagaaatcaaataagt

SEQ ID NO: 115653 - DNA, 20 bp, Artificial Sequence
  chemically synthesized
gtagggttctaatgacaggt

SEQ ID NO: 115654 - DNA, 20 bp, Artificial Sequence
  chemically synthesized
agtaagttctgacctgtcat

SEQ ID NO: 115655 - DNA, 20 bp, Artificial Sequence
  chemically synthesized
gggagtagggttctaatgac

SEQ ID NO: 115656 - DNA, 20 bp, Artificial Sequence
  chemically synthesized
cgggagtagggttctaatga

SEQ ID NO: 115657 - DNA, 20 bp, Artificial Sequence
  chemically synthesized
gtgtgtgtgtggcgggagta

SEQ ID NO: 115658 - DNA, 20 bp, Artificial Sequence
  chemically synthesized
tgtgtgtgtgtggcgggagt

SEQ ID NO: 115659 - DNA, 20 bp, Artificial Sequence
  chemically synthesized
gtgtgtgtgtgtggcgggag

SEQ ID NO: 115660 - DNA, 20 bp, Artificial Sequence
  chemically synthesized
atggtgtgtgtgtgtggcgg

SEQ ID NO: 115661 - DNA, 20 bp, Artificial Sequence
  chemically synthesized
ccatggtgtgtgtgtgtggc

SEQ ID NO: 115662 - DNA, 20 bp, Artificial Sequence
  chemically synthesized
accatggtgtgtgtgtgtgg

SEQ ID NO: 115663 - DNA, 20 bp, Artificial Sequence
  chemically synthesized
aataccatggtgtgtgtgtg

SEQ ID NO: 115664 - DNA, 20 bp, Artificial Sequence
  chemically synthesized
cccgccacacacacacacca

SEQ ID NO: 115665 - DNA, 20 bp, Artificial Sequence
  chemically synthesized
agatttattcagaaatacca

SEQ ID NO: 115666 - DNA, 20 bp, Artificial Sequence
  chemically synthesized
tgcagtcttagagatttatt

SEQ ID NO: 115667 - DNA, 20 bp, Artificial Sequence
  chemically synthesized
gtatttctgaataaatctct

SEQ ID NO: 115668 - DNA, 20 bp, Artificial Sequence
  chemically synthesized
ttcaactcaatgcagtctta

SEQ ID NO: 115669 - DNA, 20 bp, Artificial Sequence
  chemically synthesized
tattcaactcaatgcagtct

SEQ ID NO: 115670 - DNA, 20 bp, Artificial Sequence
  chemically synthesized
taaatctctaagactgcatt

SEQ ID NO: 115671 - DNA, 20 bp, Artificial Sequence
  chemically synthesized
tgatgatattcaactcaatg

SEQ ID NO: 115672 - DNA, 20 bp, Artificial Sequence
  chemically synthesized
tgaatatcatcaatttctta

SEQ ID NO: 115673 - DNA, 20 bp, Artificial Sequence
  chemically synthesized
ttatgtattatgttggccat

SEQ ID NO: 115674 - DNA, 20 bp, Artificial Sequence
  chemically synthesized
ttcctttttatgtattatgt

SEQ ID NO: 115675 - DNA, 20 bp, Artificial Sequence
  chemically synthesized
tggccaacataatacataaa

SEQ ID NO: 115676 - DNA, 20 bp, Artificial Sequence
  chemically synthesized
ggccaacataatacataaaa

SEQ ID NO: 115677 - DNA, 20 bp, Artificial Sequence
  chemically synthesized
cataatacataaaaaggaaa

SEQ ID NO: 115678 - DNA, 20 bp, Artificial Sequence
  chemically synthesized
ataatacataaaaaggaaaa

SEQ ID NO: 115679 - DNA, 20 bp, Artificial Sequence
  chemically synthesized
atacataaaaaggaaaaagg

SEQ ID NO: 115680 - DNA, 20 bp, Artificial Sequence
  chemically synthesized
tacataaaaaggaaaaagga

SEQ ID NO: 115681 - DNA, 20 bp, Artificial Sequence
  chemically synthesized
acataaaaaggaaaaaggaa

SEQ ID NO: 115682 - DNA, 20 bp, Artificial Sequence
  chemically synthesized
ggcttaccccggaaagcaac

SEQ ID NO: 115683 - DNA, 20 bp, Artificial Sequence
  chemically synthesized
aagggaaacttgttgctttc

SEQ ID NO: 115684 - DNA, 20 bp, Artificial Sequence
  chemically synthesized
agggaaacttgttgctttcc

SEQ ID NO: 115685 - DNA, 20 bp, Artificial Sequence
  chemically synthesized
gggaaacttgttgctttccg

SEQ ID NO: 115686 - DNA, 20 bp, Artificial Sequence
  chemically synthesized
ctctttaggcttaccccgga

SEQ ID NO: 115687 - DNA, 20 bp, Artificial Sequence
  chemically synthesized
aacttgttgctttccggggt

SEQ ID NO: 115688 - DNA, 20 bp, Artificial Sequence
  chemically synthesized
taagctctttaggcttaccc

SEQ ID NO: 115689 - DNA, 20 bp, Artificial Sequence
  chemically synthesized
tgctttccggggtaagccta

SEQ ID NO: 115690 - DNA, 20 bp, Artificial Sequence
  chemically synthesized
ctttccggggtaagcctaaa

SEQ ID NO: 115691 - DNA, 20 bp, Artificial Sequence
  chemically synthesized
atacaataattaagctcttt

SEQ ID NO: 115692 - DNA, 20 bp, Artificial Sequence
  chemically synthesized
tatacaataattaagctctt

SEQ ID NO: 115693 - DNA, 20 bp, Artificial Sequence
  chemically synthesized
atggtgtgtatacaataatt

SEQ ID NO: 115694 - DNA, 20 bp, Artificial Sequence
  chemically synthesized
ccatatatctaatagtagaa

SEQ ID NO: 115695 - DNA, 20 bp, Artificial Sequence
  chemically synthesized
tatacacaccattctactat

SEQ ID NO: 115696 - DNA, 20 bp, Artificial Sequence
  chemically synthesized
ttcatccatatatctaatag

SEQ ID NO: 115697 - DNA, 20 bp, Artificial Sequence
  chemically synthesized
tttttcatccatatatctaa

SEQ ID NO: 115698 - DNA, 20 bp, Artificial Sequence
  chemically synthesized
ccattctactattagatata

SEQ ID NO: 115699 - DNA, 20 bp, Artificial Sequence
  chemically synthesized
atggatgaaaaatactttat

SEQ ID NO: 115700 - DNA, 20 bp, Artificial Sequence
  chemically synthesized
cacagtataatgcaccgata

SEQ ID NO: 115701 - DNA, 20 bp, Artificial Sequence
  chemically synthesized
tttatcggtgcattatactg

SEQ ID NO: 115702 - DNA, 20 bp, Artificial Sequence
  chemically synthesized
cctacacacttacaattcca

SEQ ID NO: 115703 - DNA, 20 bp, Artificial Sequence
  chemically synthesized
gcattatactgtggaattgt

SEQ ID NO: 115704 - DNA, 20 bp, Artificial Sequence
  chemically synthesized
actgtggaattgtaagtgtg

SEQ ID NO: 115705 - DNA, 20 bp, Artificial Sequence
  chemically synthesized
ctgtggaattgtaagtgtgt

SEQ ID NO: 115706 - DNA, 20 bp, Artificial Sequence
  chemically synthesized
taagtgtgtaggtataatta

SEQ ID NO: 115707 - DNA, 20 bp, Artificial Sequence
  chemically synthesized
tataattacagaaacatatt

SEQ ID NO: 115708 - DNA, 20 bp, Artificial Sequence
  chemically synthesized
agaaacatattgagtatttt

SEQ ID NO: 115709 - DNA, 20 bp, Artificial Sequence
  chemically synthesized
atattgagtatttttagaaa

SEQ ID NO: 115710 - DNA, 20 bp, Artificial Sequence
  chemically synthesized
tattgagtatttttagaaaa

SEQ ID NO: 115711 - DNA, 20 bp, Artificial Sequence
  chemically synthesized
ataacctttcatatcagatt

SEQ ID NO: 115712 - DNA, 20 bp, Artificial Sequence
  chemically synthesized
aaaggctcaatctgatatga

SEQ ID NO: 115713 - DNA, 20 bp, Artificial Sequence
  chemically synthesized
aaggctcaatctgatatgaa

SEQ ID NO: 115714 - DNA, 20 bp, Artificial Sequence
  chemically synthesized
ggcaaaataacctttcatat

SEQ ID NO: 115715 - DNA, 20 bp, Artificial Sequence
  chemically synthesized
atatgaaaggttattttgcc

SEQ ID NO: 115716 - DNA, 20 bp, Artificial Sequence
  chemically synthesized
tatgaaaggttattttgccc

SEQ ID NO: 115717 - DNA, 20 bp, Artificial Sequence
  chemically synthesized
tcacattttaaaaataacct

SEQ ID NO: 115718 - DNA, 20 bp, Artificial Sequence
  chemically synthesized
atcacattttaaaaataacc

SEQ ID NO: 115719 - DNA, 20 bp, Artificial Sequence
  chemically synthesized
atttttaaaatgtgataaat

SEQ ID NO: 115720 - DNA, 20 bp, Artificial Sequence
  chemically synthesized
tttttaaaatgtgataaatt

SEQ ID NO: 115721 - DNA, 20 bp, Artificial Sequence
  chemically synthesized
tgataaattaggaacattca

SEQ ID NO: 115722 - DNA, 20 bp, Artificial Sequence
  chemically synthesized
ttaggaacattcaaagaact

SEQ ID NO: 115723 - DNA, 20 bp, Artificial Sequence
  chemically synthesized
gtgttatttagcagaagact

SEQ ID NO: 115724 - DNA, 20 bp, Artificial Sequence
  chemically synthesized
gtgaaagtgttatttagcag

SEQ ID NO: 115725 - DNA, 20 bp, Artificial Sequence
  chemically synthesized
atagtgaaagtgttatttag

SEQ ID NO: 115726 - DNA, 20 bp, Artificial Sequence
  chemically synthesized
gccatagtgaaagtgttatt

SEQ ID NO: 115727 - DNA, 20 bp, Artificial Sequence
  chemically synthesized
gctaaataacactttcacta

SEQ ID NO: 115728 - DNA, 20 bp, Artificial Sequence
  chemically synthesized
acaatgccaggccatagtga

SEQ ID NO: 115729 - DNA, 20 bp, Artificial Sequence
  chemically synthesized
ataacactttcactatggcc

SEQ ID NO: 115730 - DNA, 20 bp, Artificial Sequence
  chemically synthesized
tctataacaatgccaggcca

SEQ ID NO: 115731 - DNA, 20 bp, Artificial Sequence
  chemically synthesized
gattactctataacaatgcc

SEQ ID NO: 115732 - DNA, 20 bp, Artificial Sequence
  chemically synthesized
tgattactctataacaatgc

SEQ ID NO: 115733 - DNA, 20 bp, Artificial Sequence
  chemically synthesized
actatggcctggcattgtta

SEQ ID NO: 115734 - DNA, 20 bp, Artificial Sequence
  chemically synthesized
tatggcctggcattgttata

SEQ ID NO: 115735 - DNA, 20 bp, Artificial Sequence
  chemically synthesized
aactaggaaggaaagattca

SEQ ID NO: 115736 - DNA, 20 bp, Artificial Sequence
  chemically synthesized
taaactaggaaggaaagatt

SEQ ID NO: 115737 - DNA, 20 bp, Artificial Sequence
  chemically synthesized
tactctgaatctttccttcc

SEQ ID NO: 115738 - DNA, 20 bp, Artificial Sequence
  chemically synthesized
tgcaaataaactaggaagga

SEQ ID NO: 115739 - DNA, 20 bp, Artificial Sequence
  chemically synthesized
aaattgcaaataaactagga

SEQ ID NO: 115740 - DNA, 20 bp, Artificial Sequence
  chemically synthesized
taaattgcaaataaactagg

SEQ ID NO: 115741 - DNA, 20 bp, Artificial Sequence
  chemically synthesized
ggctaaattgcaaataaact

SEQ ID NO: 115742 - DNA, 20 bp, Artificial Sequence
  chemically synthesized
tggctaaattgcaaataaac

SEQ ID NO: 115743 - DNA, 20 bp, Artificial Sequence
  chemically synthesized
ttcctagtttatttgcaatt

SEQ ID NO: 115744 - DNA, 20 bp, Artificial Sequence
  chemically synthesized
aatatcataggaaatgatag

SEQ ID NO: 115745 - DNA, 20 bp, Artificial Sequence
  chemically synthesized
taaaatatcataggaaatga

SEQ ID NO: 115746 - DNA, 20 bp, Artificial Sequence
  chemically synthesized
tctttctcctaaaatatcat

SEQ ID NO: 115747 - DNA, 20 bp, Artificial Sequence
  chemically synthesized
atctttctcctaaaatatca

SEQ ID NO: 115748 - DNA, 20 bp, Artificial Sequence
  chemically synthesized
tatcatttcctatgatattt

SEQ ID NO: 115749 - DNA, 20 bp, Artificial Sequence
  chemically synthesized
atcatttcctatgatatttt

SEQ ID NO: 115750 - DNA, 20 bp, Artificial Sequence
  chemically synthesized
catttcctatgatattttag

SEQ ID NO: 115751 - DNA, 20 bp, Artificial Sequence
  chemically synthesized
tcctatgatattttaggaga

SEQ ID NO: 115752 - DNA, 20 bp, Artificial Sequence
  chemically synthesized
atattttaggagaaagatta

SEQ ID NO: 115753 - DNA, 20 bp, Artificial Sequence
  chemically synthesized
tattttaggagaaagattaa

SEQ ID NO: 115754 - DNA, 20 bp, Artificial Sequence
  chemically synthesized
cattattttgttcctttttt

SEQ ID NO: 115755 - DNA, 20 bp, Artificial Sequence
  chemically synthesized
acctatatctcaccaaaaaa

SEQ ID NO: 115756 - DNA, 20 bp, Artificial Sequence
  chemically synthesized
gacctatatctcaccaaaaa

SEQ ID NO: 115757 - DNA, 20 bp, Artificial Sequence
  chemically synthesized
attttgttcctttttttggt

SEQ ID NO: 115758 - DNA, 20 bp, Artificial Sequence
  chemically synthesized
ttcctttttttggtgagata

SEQ ID NO: 115759 - DNA, 20 bp, Artificial Sequence
  chemically synthesized
tcctttttttggtgagatat

SEQ ID NO: 115760 - DNA, 20 bp, Artificial Sequence
  chemically synthesized
ttttttggtgagatataggt

SEQ ID NO: 115761 - DNA, 20 bp, Artificial Sequence
  chemically synthesized
ttttggtgagatataggtca

SEQ ID NO: 115762 - DNA, 20 bp, Artificial Sequence
  chemically synthesized
ttggtgagatataggtcaga

SEQ ID NO: 115763 - DNA, 20 bp, Artificial Sequence
  chemically synthesized
gatataggtcagagagacct

SEQ ID NO: 115764 - DNA, 20 bp, Artificial Sequence
  chemically synthesized
ataggtcagagagaccttag

SEQ ID NO: 115765 - DNA, 20 bp, Artificial Sequence
  chemically synthesized
cttacatccaggtgctacta

SEQ ID NO: 115766 - DNA, 20 bp, Artificial Sequence
  chemically synthesized
tcttacatccaggtgctact

SEQ ID NO: 115767 - DNA, 20 bp, Artificial Sequence
  chemically synthesized
agagagaccttagtagcacc

SEQ ID NO: 115768 - DNA, 20 bp, Artificial Sequence
  chemically synthesized
ccttagtagcacctggatgt

SEQ ID NO: 115769 - DNA, 20 bp, Artificial Sequence
  chemically synthesized
atcattttgatcttacatcc

SEQ ID NO: 115770 - DNA, 20 bp, Artificial Sequence
  chemically synthesized
aatcattttgatcttacatc

SEQ ID NO: 115771 - DNA, 20 bp, Artificial Sequence
  chemically synthesized
tgagtagcggttgatatggc

SEQ ID NO: 115772 - DNA, 20 bp, Artificial Sequence
  chemically synthesized
tctatgagtagcggttgata

SEQ ID NO: 115773 - DNA, 20 bp, Artificial Sequence
  chemically synthesized
gccatatcaaccgctactca

SEQ ID NO: 115774 - DNA, 20 bp, Artificial Sequence
  chemically synthesized
aactctggttctatgagtag

SEQ ID NO: 115775 - DNA, 20 bp, Artificial Sequence
  chemically synthesized
attaactctggttctatgag

SEQ ID NO: 115776 - DNA, 20 bp, Artificial Sequence
  chemically synthesized
tcaaccgctactcatagaac

SEQ ID NO: 115777 - DNA, 20 bp, Artificial Sequence
  chemically synthesized
cagattaactctggttctat

SEQ ID NO: 115778 - DNA, 20 bp, Artificial Sequence
  chemically synthesized
aaccgctactcatagaacca

SEQ ID NO: 115779 - DNA, 20 bp, Artificial Sequence
  chemically synthesized
tttgaatttcagattaactc

SEQ ID NO: 115780 - DNA, 20 bp, Artificial Sequence
  chemically synthesized
gttacaggaaatttgaattt

SEQ ID NO: 115781 - DNA, 20 bp, Artificial Sequence
  chemically synthesized
gtaggaactgttatggttac

SEQ ID NO: 115782 - DNA, 20 bp, Artificial Sequence
  chemically synthesized
agtaggaactgttatggtta

SEQ ID NO: 115783 - DNA, 20 bp, Artificial Sequence
  chemically synthesized
caaatttcctgtaaccataa

SEQ ID NO: 115784 - DNA, 20 bp, Artificial Sequence
  chemically synthesized
caaactagtaggaactgtta

SEQ ID NO: 115785 - DNA, 20 bp, Artificial Sequence
  chemically synthesized
gtaaccataacagttcctac

SEQ ID NO: 115786 - DNA, 20 bp, Artificial Sequence
  chemically synthesized
caatttactagcaaactagt

SEQ ID NO: 115787 - DNA, 20 bp, Artificial Sequence
  chemically synthesized
gcaatttactagcaaactag

SEQ ID NO: 115788 - DNA, 20 bp, Artificial Sequence
  chemically synthesized
aacagttcctactagtttgc

SEQ ID NO: 115789 - DNA, 20 bp, Artificial Sequence
  chemically synthesized
aatgcaatttactagcaaac

SEQ ID NO: 115790 - DNA, 20 bp, Artificial Sequence
  chemically synthesized
aaaatcaaaatgcaatttac

SEQ ID NO: 115791 - DNA, 20 bp, Artificial Sequence
  chemically synthesized
cccctcacaagtacaatata

SEQ ID NO: 115792 - DNA, 20 bp, Artificial Sequence
  chemically synthesized
taactttatattgtacttgt

SEQ ID NO: 115793 - DNA, 20 bp, Artificial Sequence
  chemically synthesized
aactttatattgtacttgtg

SEQ ID NO: 115794 - DNA, 20 bp, Artificial Sequence
  chemically synthesized
actttatattgtacttgtga

SEQ ID NO: 115795 - DNA, 20 bp, Artificial Sequence
  chemically synthesized
ctttatattgtacttgtgag

SEQ ID NO: 115796 - DNA, 20 bp, Artificial Sequence
  chemically synthesized
aaattctagcttcccctcac

SEQ ID NO: 115797 - DNA, 20 bp, Artificial Sequence
  chemically synthesized
tatattgtacttgtgagggg

SEQ ID NO: 115798 - DNA, 20 bp, Artificial Sequence
  chemically synthesized
ttgtacttgtgaggggaagc

SEQ ID NO: 115799 - DNA, 20 bp, Artificial Sequence
  chemically synthesized
atccataggtgacaaaattc

SEQ ID NO: 115800 - DNA, 20 bp, Artificial Sequence
  chemically synthesized
agctagaattttgtcaccta

SEQ ID NO: 115801 - DNA, 20 bp, Artificial Sequence
  chemically synthesized
acaaagtgctgtatatccat

SEQ ID NO: 115802 - DNA, 20 bp, Artificial Sequence
  chemically synthesized
tacaaagtgctgtatatcca

SEQ ID NO: 115803 - DNA, 20 bp, Artificial Sequence
  chemically synthesized
ttttgtcacctatggatata

SEQ ID NO: 115804 - DNA, 20 bp, Artificial Sequence
  chemically synthesized
tatggatatacagcactttg

SEQ ID NO: 115805 - DNA, 20 bp, Artificial Sequence
  chemically synthesized
gatatacagcactttgtaga

SEQ ID NO: 115806 - DNA, 20 bp, Artificial Sequence
  chemically synthesized
atatacagcactttgtagaa

SEQ ID NO: 115807 - DNA, 20 bp, Artificial Sequence
  chemically synthesized
taaaaggaatcctttctaca

SEQ ID NO: 115808 - DNA, 20 bp, Artificial Sequence
  chemically synthesized
tagaattgctagagattaaa

SEQ ID NO: 115809 - DNA, 20 bp, Artificial Sequence
  chemically synthesized
atagaattgctagagattaa

SEQ ID NO: 115810 - DNA, 20 bp, Artificial Sequence
  chemically synthesized
aaaggattccttttaatctc

SEQ ID NO: 115811 - DNA, 20 bp, Artificial Sequence
  chemically synthesized
cgttactaatagaattgcta

SEQ ID NO: 115812 - DNA, 20 bp, Artificial Sequence
  chemically synthesized
cacgttactaatagaattgc

SEQ ID NO: 115813 - DNA, 20 bp, Artificial Sequence
  chemically synthesized
ttaatctctagcaattctat

SEQ ID NO: 115814 - DNA, 20 bp, Artificial Sequence
  chemically synthesized
tcattagtgcacgttactaa

SEQ ID NO: 115815 - DNA, 20 bp, Artificial Sequence
  chemically synthesized
tattagtaacgtgcactaat

SEQ ID NO: 115816 - DNA, 20 bp, Artificial Sequence
  chemically synthesized
tagtaacgtgcactaatgag

SEQ ID NO: 115817 - DNA, 20 bp, Artificial Sequence
  chemically synthesized
tgacagcttttgcttctcat

SEQ ID NO: 115818 - DNA, 20 bp, Artificial Sequence
  chemically synthesized
cgtgcactaatgagaagcaa

SEQ ID NO: 115819 - DNA, 20 bp, Artificial Sequence
  chemically synthesized
actaatccaggcaatgttga

SEQ ID NO: 115820 - DNA, 20 bp, Artificial Sequence
  chemically synthesized
caaaagctgtcaacattgcc

SEQ ID NO: 115821 - DNA, 20 bp, Artificial Sequence
  chemically synthesized
gctgtcaacattgcctggat

SEQ ID NO: 115822 - DNA, 20 bp, Artificial Sequence
  chemically synthesized
gtcaacattgcctggattag

SEQ ID NO: 115823 - DNA, 20 bp, Artificial Sequence
  chemically synthesized
taggaatggactactaatcc

SEQ ID NO: 115824 - DNA, 20 bp, Artificial Sequence
  chemically synthesized
ctaggaatggactactaatc

SEQ ID NO: 115825 - DNA, 20 bp, Artificial Sequence
  chemically synthesized
ctggattagtagtccattcc

SEQ ID NO: 115826 - DNA, 20 bp, Artificial Sequence
  chemically synthesized
agagttggttttgctaggaa

SEQ ID NO: 115827 - DNA, 20 bp, Artificial Sequence
  chemically synthesized
accacagagttggttttgct

SEQ ID NO: 115828 - DNA, 20 bp, Artificial Sequence
  chemically synthesized
aaccacagagttggttttgc

SEQ ID NO: 115829 - DNA, 20 bp, Artificial Sequence
  chemically synthesized
tcctagcaaaaccaactctg

SEQ ID NO: 115830 - DNA, 20 bp, Artificial Sequence
  chemically synthesized
aacagataaaaccacagagt

SEQ ID NO: 115831 - DNA, 20 bp, Artificial Sequence
  chemically synthesized
caaaaacagataaaaccaca

SEQ ID NO: 115832 - DNA, 20 bp, Artificial Sequence
  chemically synthesized
cccaaaaacagataaaacca

SEQ ID NO: 115833 - DNA, 20 bp, Artificial Sequence
  chemically synthesized
tctgtggttttatctgtttt

SEQ ID NO: 115834 - DNA, 20 bp, Artificial Sequence
  chemically synthesized
ctgtggttttatctgttttt

SEQ ID NO: 115835 - DNA, 20 bp, Artificial Sequence
  chemically synthesized
aggtagatgttgcccaaaaa

SEQ ID NO: 115836 - DNA, 20 bp, Artificial Sequence
  chemically synthesized
gtttttgggcaacatctacc

SEQ ID NO: 115837 - DNA, 20 bp, Artificial Sequence
  chemically synthesized
tctccagtcatatttctagg

SEQ ID NO: 115838 - DNA, 20 bp, Artificial Sequence
  chemically synthesized
ccttctccagtcatatttct

SEQ ID NO: 115839 - DNA, 20 bp, Artificial Sequence
  chemically synthesized
cccttctccagtcatatttc

SEQ ID NO: 115840 - DNA, 20 bp, Artificial Sequence
  chemically synthesized
catctacctagaaatatgac

SEQ ID NO: 115841 - DNA, 20 bp, Artificial Sequence
  chemically synthesized
tctacctagaaatatgactg

SEQ ID NO: 115842 - DNA, 20 bp, Artificial Sequence
  chemically synthesized
acctagaaatatgactggag

SEQ ID NO: 115843 - DNA, 20 bp, Artificial Sequence
  chemically synthesized
cctagaaatatgactggaga

SEQ ID NO: 115844 - DNA, 20 bp, Artificial Sequence
  chemically synthesized
ctagaaatatgactggagaa

SEQ ID NO: 115845 - DNA, 20 bp, Artificial Sequence
  chemically synthesized
tcattgccaccacccttctc

SEQ ID NO: 115846 - DNA, 20 bp, Artificial Sequence
  chemically synthesized
gaaatatgactggagaaggg

SEQ ID NO: 115847 - DNA, 20 bp, Artificial Sequence
  chemically synthesized
atatgactggagaagggtgg

SEQ ID NO: 115848 - DNA, 20 bp, Artificial Sequence
  chemically synthesized
tggagaagggtggtggcaat

SEQ ID NO: 115849 - DNA, 20 bp, Artificial Sequence
  chemically synthesized
gagaagggtggtggcaatga

SEQ ID NO: 115850 - DNA, 20 bp, Artificial Sequence
  chemically synthesized
tttcataacagaggagaaaa

SEQ ID NO: 115851 - DNA, 20 bp, Artificial Sequence
  chemically synthesized
agtttcataacagaggagaa

SEQ ID NO: 115852 - DNA, 20 bp, Artificial Sequence
  chemically synthesized
cttacagtttcataacagag

SEQ ID NO: 115853 - DNA, 20 bp, Artificial Sequence
  chemically synthesized
gccttacagtttcataacag

SEQ ID NO: 115854 - DNA, 20 bp, Artificial Sequence
  chemically synthesized
cgccttacagtttcataaca

SEQ ID NO: 115855 - DNA, 20 bp, Artificial Sequence
  chemically synthesized
ctcgccttacagtttcataa

SEQ ID NO: 115856 - DNA, 20 bp, Artificial Sequence
  chemically synthesized
ctcctctgttatgaaactgt

SEQ ID NO: 115857 - DNA, 20 bp, Artificial Sequence
  chemically synthesized
tcctctgttatgaaactgta

SEQ ID NO: 115858 - DNA, 20 bp, Artificial Sequence
  chemically synthesized
ctgttatgaaactgtaaggc

SEQ ID NO: 115859 - DNA, 20 bp, Artificial Sequence
  chemically synthesized
tgttatgaaactgtaaggcg

SEQ ID NO: 115860 - DNA, 20 bp, Artificial Sequence
  chemically synthesized
gtcatatattcctcgcctta

SEQ ID NO: 115861 - DNA, 20 bp, Artificial Sequence
  chemically synthesized
ggatgaaaagcaagcatcag

SEQ ID NO: 115862 - DNA, 20 bp, Artificial Sequence
  chemically synthesized
tgtggatgaaaagcaagcat

SEQ ID NO: 115863 - DNA, 20 bp, Artificial Sequence
  chemically synthesized
tcatgctgtggatgaaaagc

SEQ ID NO: 115864 - DNA, 20 bp, Artificial Sequence
  chemically synthesized
ttcttcatgctgtggatgaa

SEQ ID NO: 115865 - DNA, 20 bp, Artificial Sequence
  chemically synthesized
tgatgcttgcttttcatcca

SEQ ID NO: 115866 - DNA, 20 bp, Artificial Sequence
  chemically synthesized
tgcttttcatccacagcatg

SEQ ID NO: 115867 - DNA, 20 bp, Artificial Sequence
  chemically synthesized
atctgccattcttcatgctg

SEQ ID NO: 115868 - DNA, 20 bp, Artificial Sequence
  chemically synthesized
ttcatccacagcatgaagaa

SEQ ID NO: 115869 - DNA, 20 bp, Artificial Sequence
  chemically synthesized
atccacagcatgaagaatgg

SEQ ID NO: 115870 - DNA, 20 bp, Artificial Sequence
  chemically synthesized
agaatggcagatctaatgta

SEQ ID NO: 115871 - DNA, 20 bp, Artificial Sequence
  chemically synthesized
ttatcttccatgctgtacat

SEQ ID NO: 115872 - DNA, 20 bp, Artificial Sequence
  chemically synthesized
ggcagatctaatgtacagca

SEQ ID NO: 115873 - DNA, 20 bp, Artificial Sequence
  chemically synthesized
agatctaatgtacagcatgg

SEQ ID NO: 115874 - DNA, 20 bp, Artificial Sequence
  chemically synthesized
agcatggaagataattttta

SEQ ID NO: 115875 - DNA, 20 bp, Artificial Sequence
  chemically synthesized
ataaagagttatgtggatgt

SEQ ID NO: 115876 - DNA, 20 bp, Artificial Sequence
  chemically synthesized
aaaacatataaagagttatg

SEQ ID NO: 115877 - DNA, 20 bp, Artificial Sequence
  chemically synthesized
tatgtttgaaaacatataaa

SEQ ID NO: 115878 - DNA, 20 bp, Artificial Sequence
  chemically synthesized
aatatgtttgaaaacatata

SEQ ID NO: 115879 - DNA, 20 bp, Artificial Sequence
  chemically synthesized
tatatgttttcaaacatatt

SEQ ID NO: 115880 - DNA, 20 bp, Artificial Sequence
  chemically synthesized
tatgttttcaaacatattca

SEQ ID NO: 115881 - DNA, 20 bp, Artificial Sequence
  chemically synthesized
aatatcttatgaagtgatga

SEQ ID NO: 115882 - DNA, 20 bp, Artificial Sequence
  chemically synthesized
ttattctatcatcacttcat

SEQ ID NO: 115883 - DNA, 20 bp, Artificial Sequence
  chemically synthesized
aaaatggaaaatatcttatg

SEQ ID NO: 115884 - DNA, 20 bp, Artificial Sequence
  chemically synthesized
aaagaaggtaggtagaaaaa

SEQ ID NO: 115885 - DNA, 20 bp, Artificial Sequence
  chemically synthesized
acatagaaaaagaaggtagg

SEQ ID NO: 115886 - DNA, 20 bp, Artificial Sequence
  chemically synthesized
tatacatagaaaaagaaggt

SEQ ID NO: 115887 - DNA, 20 bp, Artificial Sequence
  chemically synthesized
gtatacatagaaaaagaagg

SEQ ID NO: 115888 - DNA, 20 bp, Artificial Sequence
  chemically synthesized
tgagtatacatagaaaaaga

SEQ ID NO: 115889 - DNA, 20 bp, Artificial Sequence
  chemically synthesized
ctgagtatacatagaaaaag

SEQ ID NO: 115890 - DNA, 20 bp, Artificial Sequence
  chemically synthesized
cagctgagtatacatagaaa

SEQ ID NO: 115891 - DNA, 20 bp, Artificial Sequence
  chemically synthesized
aatatccagctgagtataca

SEQ ID NO: 115892 - DNA, 20 bp, Artificial Sequence
  chemically synthesized
cttctttttctatgtatact

SEQ ID NO: 115893 - DNA, 20 bp, Artificial Sequence
  chemically synthesized
tttttctatgtatactcagc

SEQ ID NO: 115894 - DNA, 20 bp, Artificial Sequence
  chemically synthesized
agagaatgaaatatccagct

SEQ ID NO: 115895 - DNA, 20 bp, Artificial Sequence
  chemically synthesized
ttggcagagaatgaaatatc

SEQ ID NO: 115896 - DNA, 20 bp, Artificial Sequence
  chemically synthesized
gatatttcattctctgccaa

SEQ ID NO: 115897 - DNA, 20 bp, Artificial Sequence
  chemically synthesized
cgagtgtaaagccattggca

SEQ ID NO: 115898 - DNA, 20 bp, Artificial Sequence
  chemically synthesized
atcgagtgtaaagccattgg

SEQ ID NO: 115899 - DNA, 20 bp, Artificial Sequence
  chemically synthesized
tgtatcgagtgtaaagccat

SEQ ID NO: 115900 - DNA, 20 bp, Artificial Sequence
  chemically synthesized
gataatctgtatcgagtgta

SEQ ID NO: 115901 - DNA, 20 bp, Artificial Sequence
  chemically synthesized
caatggctttacactcgata

SEQ ID NO: 115902 - DNA, 20 bp, Artificial Sequence
  chemically synthesized
aattaaagataatctgtatc

SEQ ID NO: 115903 - DNA, 20 bp, Artificial Sequence
  chemically synthesized
aagaatgaggttcagaatta

SEQ ID NO: 115904 - DNA, 20 bp, Artificial Sequence
  chemically synthesized
gtggaaataagaatgaggtt

SEQ ID NO: 115905 - DNA, 20 bp, Artificial Sequence
  chemically synthesized
ggcatgtggaaataagaatg

SEQ ID NO: 115906 - DNA, 20 bp, Artificial Sequence
  chemically synthesized
aggcatgtggaaataagaat

SEQ ID NO: 115907 - DNA, 20 bp, Artificial Sequence
  chemically synthesized
gttggtaggcatgtggaaat

SEQ ID NO: 115908 - DNA, 20 bp, Artificial Sequence
  chemically synthesized
attagatgttggtaggcatg

SEQ ID NO: 115909 - DNA, 20 bp, Artificial Sequence
  chemically synthesized
ttattgaattagatgttggt

SEQ ID NO: 115910 - DNA, 20 bp, Artificial Sequence
  chemically synthesized
attattgaattagatgttgg

SEQ ID NO: 115911 - DNA, 20 bp, Artificial Sequence
  chemically synthesized
tgaattattgaattagatgt

SEQ ID NO: 115912 - DNA, 20 bp, Artificial Sequence
  chemically synthesized
gcatggatgaattattgaat

SEQ ID NO: 115913 - DNA, 20 bp, Artificial Sequence
  chemically synthesized
ataggtacggaatggatgca

SEQ ID NO: 115914 - DNA, 20 bp, Artificial Sequence
  chemically synthesized
ggtacacaataggtacggaa

SEQ ID NO: 115915 - DNA, 20 bp, Artificial Sequence
  chemically synthesized
atcctggtacacaataggta

SEQ ID NO: 115916 - DNA, 20 bp, Artificial Sequence
  chemically synthesized
cacagatcctggtacacaat

SEQ ID NO: 115917 - DNA, 20 bp, Artificial Sequence
  chemically synthesized
gcacagatcctggtacacaa

SEQ ID NO: 115918 - DNA, 20 bp, Artificial Sequence
  chemically synthesized
attccgtacctattgtgtac

SEQ ID NO: 115919 - DNA, 20 bp, Artificial Sequence
  chemically synthesized
ttccgtacctattgtgtacc

SEQ ID NO: 115920 - DNA, 20 bp, Artificial Sequence
  chemically synthesized
ccatcatcaggcacagatcc

SEQ ID NO: 115921 - DNA, 20 bp, Artificial Sequence
  chemically synthesized
tctgtcaccatcatcaggca

SEQ ID NO: 115922 - DNA, 20 bp, Artificial Sequence
  chemically synthesized
ccaggatctgtgcctgatga

SEQ ID NO: 115923 - DNA, 20 bp, Artificial Sequence
  chemically synthesized
gattttctgtcaccatcatc

SEQ ID NO: 115924 - DNA, 20 bp, Artificial Sequence
  chemically synthesized
ggattttctgtcaccatcat

SEQ ID NO: 115925 - DNA, 20 bp, Artificial Sequence
  chemically synthesized
tctgtgcctgatgatggtga

SEQ ID NO: 115926 - DNA, 20 bp, Artificial Sequence
  chemically synthesized
taccaaagtccatgtattat

SEQ ID NO: 115927 - DNA, 20 bp, Artificial Sequence
  chemically synthesized
acagaaaatccaataataca

SEQ ID NO: 115928 - DNA, 20 bp, Artificial Sequence
  chemically synthesized
atccaataatacatggactt

SEQ ID NO: 115929 - DNA, 20 bp, Artificial Sequence
  chemically synthesized
cttgaatatgttaaatacca

SEQ ID NO: 115930 - DNA, 20 bp, Artificial Sequence
  chemically synthesized
ctttggtatttaacatattc

SEQ ID NO: 115931 - DNA, 20 bp, Artificial Sequence
  chemically synthesized
tttaacatattcaagtttaa

SEQ ID NO: 115932 - DNA, 20 bp, Artificial Sequence
  chemically synthesized
taacatattcaagtttaaca

SEQ ID NO: 115933 - DNA, 20 bp, Artificial Sequence
  chemically synthesized
aacatattcaagtttaacag

SEQ ID NO: 115934 - DNA, 20 bp, Artificial Sequence
  chemically synthesized
acatattcaagtttaacaga

SEQ ID NO: 115935 - DNA, 20 bp, Artificial Sequence
  chemically synthesized
ttcaagtttaacagagggta

SEQ ID NO: 115936 - DNA, 20 bp, Artificial Sequence
  chemically synthesized
agtttaacagagggtacaga

SEQ ID NO: 115937 - DNA, 20 bp, Artificial Sequence
  chemically synthesized
gtttaacagagggtacagat

SEQ ID NO: 115938 - DNA, 20 bp, Artificial Sequence
  chemically synthesized
cagataggtaaacatttaac

SEQ ID NO: 115939 - DNA, 20 bp, Artificial Sequence
  chemically synthesized
gataggtaaacatttaacta

SEQ ID NO: 115940 - DNA, 20 bp, Artificial Sequence
  chemically synthesized
ccttaattacattgtaactc

SEQ ID NO: 115941 - DNA, 20 bp, Artificial Sequence
  chemically synthesized
actagagttacaatgtaatt

SEQ ID NO: 115942 - DNA, 20 bp, Artificial Sequence
  chemically synthesized
ctagagttacaatgtaatta

SEQ ID NO: 115943 - DNA, 20 bp, Artificial Sequence
  chemically synthesized
gaaggactccagatggttta

SEQ ID NO: 115944 - DNA, 20 bp, Artificial Sequence
  chemically synthesized
aattaaggctataaaccatc

SEQ ID NO: 115945 - DNA, 20 bp, Artificial Sequence
  chemically synthesized
ttaaggctataaaccatctg

SEQ ID NO: 115946 - DNA, 20 bp, Artificial Sequence
  chemically synthesized
ctactgggaaggactccaga

SEQ ID NO: 115947 - DNA, 20 bp, Artificial Sequence
  chemically synthesized
tgagctactgggaaggactc

SEQ ID NO: 115948 - DNA, 20 bp, Artificial Sequence
  chemically synthesized
aaaccatctggagtccttcc

SEQ ID NO: 115949 - DNA, 20 bp, Artificial Sequence
  chemically synthesized
ccatctggagtccttcccag

SEQ ID NO: 115950 - DNA, 20 bp, Artificial Sequence
  chemically synthesized
ttacatttgagctactggga

SEQ ID NO: 115951 - DNA, 20 bp, Artificial Sequence
  chemically synthesized
gttacatttgagctactggg

SEQ ID NO: 115952 - DNA, 20 bp, Artificial Sequence
  chemically synthesized
tatgttacatttgagctact

SEQ ID NO: 115953 - DNA, 20 bp, Artificial Sequence
  chemically synthesized
atatgttacatttgagctac

SEQ ID NO: 115954 - DNA, 20 bp, Artificial Sequence
  chemically synthesized
gattgatatatgttacattt

SEQ ID NO: 115955 - DNA, 20 bp, Artificial Sequence
  chemically synthesized
gagatagaagtttatgaaag

SEQ ID NO: 115956 - DNA, 20 bp, Artificial Sequence
  chemically synthesized
attgagatagaagtttatga

SEQ ID NO: 115957 - DNA, 20 bp, Artificial Sequence
  chemically synthesized
tgtttggcaaattgagatag

SEQ ID NO: 115958 - DNA, 20 bp, Artificial Sequence
  chemically synthesized
acttgtttggcaaattgaga

SEQ ID NO: 115959 - DNA, 20 bp, Artificial Sequence
  chemically synthesized
tatcacttgtttggcaaatt

SEQ ID NO: 115960 - DNA, 20 bp, Artificial Sequence
  chemically synthesized
tctatctcaatttgccaaac

SEQ ID NO: 115961 - DNA, 20 bp, Artificial Sequence
  chemically synthesized
agatacatttatcacttgtt

SEQ ID NO: 115962 - DNA, 20 bp, Artificial Sequence
  chemically synthesized
ggaaagagtaaaacatgttt

SEQ ID NO: 115963 - DNA, 20 bp, Artificial Sequence
  chemically synthesized
tccacctcttttgatggaaa

SEQ ID NO: 115964 - DNA, 20 bp, Artificial Sequence
  chemically synthesized
tctccacctcttttgatgga

SEQ ID NO: 115965 - DNA, 20 bp, Artificial Sequence
  chemically synthesized
tgttttactctttccatcaa

SEQ ID NO: 115966 - DNA, 20 bp, Artificial Sequence
  chemically synthesized
ttttactctttccatcaaaa

SEQ ID NO: 115967 - DNA, 20 bp, Artificial Sequence
  chemically synthesized
tttactctttccatcaaaag

SEQ ID NO: 115968 - DNA, 20 bp, Artificial Sequence
  chemically synthesized
atgatctccacctcttttga

SEQ ID NO: 115969 - DNA, 20 bp, Artificial Sequence
  chemically synthesized
actctttccatcaaaagagg

SEQ ID NO: 115970 - DNA, 20 bp, Artificial Sequence
  chemically synthesized
tctttccatcaaaagaggtg

SEQ ID NO: 115971 - DNA, 20 bp, Artificial Sequence
  chemically synthesized
caaaagaggtggagatcatc

SEQ ID NO: 115972 - DNA, 20 bp, Artificial Sequence
  chemically synthesized
agaggtggagatcatccagc

SEQ ID NO: 115973 - DNA, 20 bp, Artificial Sequence
  chemically synthesized
gaggtggagatcatccagca

SEQ ID NO: 115974 - DNA, 20 bp, Artificial Sequence
  chemically synthesized
attttgagataaagccttgc

SEQ ID NO: 115975 - DNA, 20 bp, Artificial Sequence
  chemically synthesized
catcactctattttgagata

SEQ ID NO: 115976 - DNA, 20 bp, Artificial Sequence
  chemically synthesized
agcaaggctttatctcaaaa

SEQ ID NO: 115977 - DNA, 20 bp, Artificial Sequence
  chemically synthesized
caaggctttatctcaaaata

SEQ ID NO: 115978 - DNA, 20 bp, Artificial Sequence
  chemically synthesized
agcatccatcactctatttt

SEQ ID NO: 115979 - DNA, 20 bp, Artificial Sequence
  chemically synthesized
tttatctcaaaatagagtga

SEQ ID NO: 115980 - DNA, 20 bp, Artificial Sequence
  chemically synthesized
gagtgatggatgcttaacaa

SEQ ID NO: 115981 - DNA, 20 bp, Artificial Sequence
  chemically synthesized
tagttaggcaaacttttgtt

SEQ ID NO: 115982 - DNA, 20 bp, Artificial Sequence
  chemically synthesized
tatttttatgaaaattagtt

SEQ ID NO: 115983 - DNA, 20 bp, Artificial Sequence
  chemically synthesized
ttatttttatgaaaattagt

SEQ ID NO: 115984 - DNA, 20 bp, Artificial Sequence
  chemically synthesized
ttttttatttttatgaaaat

SEQ ID NO: 115985 - DNA, 20 bp, Artificial Sequence
  chemically synthesized
cataaaaataaaaaaccttt

SEQ ID NO: 115986 - DNA, 20 bp, Artificial Sequence
  chemically synthesized
gcctgtactgtatatctaaa

SEQ ID NO: 115987 - DNA, 20 bp, Artificial Sequence
  chemically synthesized
agcctgtactgtatatctaa

SEQ ID NO: 115988 - DNA, 20 bp, Artificial Sequence
  chemically synthesized
taaaaaaccttttagatata

SEQ ID NO: 115989 - DNA, 20 bp, Artificial Sequence
  chemically synthesized
aaccttttagatatacagta

SEQ ID NO: 115990 - DNA, 20 bp, Artificial Sequence
  chemically synthesized
accttttagatatacagtac

SEQ ID NO: 115991 - DNA, 20 bp, Artificial Sequence
  chemically synthesized
tatacagtacaggcttttgc

SEQ ID NO: 115992 - DNA, 20 bp, Artificial Sequence
  chemically synthesized
ccctaaaatgaaaccagcaa

SEQ ID NO: 115993 - DNA, 20 bp, Artificial Sequence
  chemically synthesized
ctccagccctaaaatgaaac

SEQ ID NO: 115994 - DNA, 20 bp, Artificial Sequence
  chemically synthesized
ggcttttgctggtttcattt

SEQ ID NO: 115995 - DNA, 20 bp, Artificial Sequence
  chemically synthesized
gcttttgctggtttcatttt

SEQ ID NO: 115996 - DNA, 20 bp, Artificial Sequence
  chemically synthesized
cttttgctggtttcatttta

SEQ ID NO: 115997 - DNA, 20 bp, Artificial Sequence
  chemically synthesized
tgctggtttcattttagggc

SEQ ID NO: 115998 - DNA, 20 bp, Artificial Sequence
  chemically synthesized
ctggtttcattttagggctg

SEQ ID NO: 115999 - DNA, 20 bp, Artificial Sequence
  chemically synthesized
ggtttcattttagggctgga

SEQ ID NO: 116000 - DNA, 20 bp, Artificial Sequence
  chemically synthesized
tctctcagaatcaatctctc

SEQ ID NO: 116001 - DNA, 20 bp, Artificial Sequence
  chemically synthesized
gggctggagagattgattct

SEQ ID NO: 116002 - DNA, 20 bp, Artificial Sequence
  chemically synthesized
gctggagagattgattctga

SEQ ID NO: 116003 - DNA, 20 bp, Artificial Sequence
  chemically synthesized
gaacatcattacaattctct

SEQ ID NO: 116004 - DNA, 20 bp, Artificial Sequence
  chemically synthesized
agaattgtaatgatgttccc

SEQ ID NO: 116005 - DNA, 20 bp, Artificial Sequence
  chemically synthesized
gaattgtaatgatgttccca

SEQ ID NO: 116006 - DNA, 20 bp, Artificial Sequence
  chemically synthesized
cttaacttgtatacaacctt

SEQ ID NO: 116007 - DNA, 20 bp, Artificial Sequence
  chemically synthesized
acttaacttgtatacaacct

SEQ ID NO: 116008 - DNA, 20 bp, Artificial Sequence
  chemically synthesized
atgttcccaaggttgtatac

SEQ ID NO: 116009 - DNA, 20 bp, Artificial Sequence
  chemically synthesized
cccaaggttgtatacaagtt

SEQ ID NO: 116010 - DNA, 20 bp, Artificial Sequence
  chemically synthesized
aaggttgtatacaagttaag

SEQ ID NO: 116011 - DNA, 20 bp, Artificial Sequence
  chemically synthesized
gttgtatacaagttaagtgg

SEQ ID NO: 116012 - DNA, 20 bp, Artificial Sequence
  chemically synthesized
tgtatacaagttaagtggca

SEQ ID NO: 116013 - DNA, 20 bp, Artificial Sequence
  chemically synthesized
tacaagttaagtggcagagc

SEQ ID NO: 116014 - DNA, 20 bp, Artificial Sequence
  chemically synthesized
acaagttaagtggcagagct

SEQ ID NO: 116015 - DNA, 20 bp, Artificial Sequence
  chemically synthesized
caagttaagtggcagagctg

SEQ ID NO: 116016 - DNA, 20 bp, Artificial Sequence
  chemically synthesized
aagttaagtggcagagctgg

SEQ ID NO: 116017 - DNA, 20 bp, Artificial Sequence
  chemically synthesized
aagtggcagagctgggggta

SEQ ID NO: 116018 - DNA, 20 bp, Artificial Sequence
  chemically synthesized
caagacttgggctatacccc

SEQ ID NO: 116019 - DNA, 20 bp, Artificial Sequence
  chemically synthesized
cagagctgggggtatagccc

SEQ ID NO: 116020 - DNA, 20 bp, Artificial Sequence
  chemically synthesized
ttttctagaatgcaagactt

SEQ ID NO: 116021 - DNA, 20 bp, Artificial Sequence
  chemically synthesized
cttttctagaatgcaagact

SEQ ID NO: 116022 - DNA, 20 bp, Artificial Sequence
  chemically synthesized
atagcccaagtcttgcattc

SEQ ID NO: 116023 - DNA, 20 bp, Artificial Sequence
  chemically synthesized
aaacttcttttctagaatgc

SEQ ID NO: 116024 - DNA, 20 bp, Artificial Sequence
  chemically synthesized
ccaagtcttgcattctagaa

SEQ ID NO: 116025 - DNA, 20 bp, Artificial Sequence
  chemically synthesized
agtcttgcattctagaaaag

SEQ ID NO: 116026 - DNA, 20 bp, Artificial Sequence
  chemically synthesized
agttacaaaaacttcttttc

SEQ ID NO: 116027 - DNA, 20 bp, Artificial Sequence
  chemically synthesized
aagaagtttttgtaactctg

SEQ ID NO: 116028 - DNA, 20 bp, Artificial Sequence
  chemically synthesized
agtttttgtaactctgaaga

SEQ ID NO: 116029 - DNA, 20 bp, Artificial Sequence
  chemically synthesized
tattccaatatctgtcttca

SEQ ID NO: 116030 - DNA, 20 bp, Artificial Sequence
  chemically synthesized
tgtattccaatatctgtctt

SEQ ID NO: 116031 - DNA, 20 bp, Artificial Sequence
  chemically synthesized
gtaactctgaagacagatat

SEQ ID NO: 116032 - DNA, 20 bp, Artificial Sequence
  chemically synthesized
acaatgaatatatcagagag

SEQ ID NO: 116033 - DNA, 20 bp, Artificial Sequence
  chemically synthesized
gtacaatgaatatatcagag

SEQ ID NO: 116034 - DNA, 20 bp, Artificial Sequence
  chemically synthesized
agtacaatgaatatatcaga

SEQ ID NO: 116035 - DNA, 20 bp, Artificial Sequence
  chemically synthesized
ttagtacaatgaatatatca

SEQ ID NO: 116036 - DNA, 20 bp, Artificial Sequence
  chemically synthesized
ttttagtacaatgaatatat

SEQ ID NO: 116037 - DNA, 20 bp, Artificial Sequence
  chemically synthesized
tgatatattcattgtactaa

SEQ ID NO: 116038 - DNA, 20 bp, Artificial Sequence
  chemically synthesized
atattcattgtactaaaaga

SEQ ID NO: 116039 - DNA, 20 bp, Artificial Sequence
  chemically synthesized
ccttgtgcctttctttcttt

SEQ ID NO: 116040 - DNA, 20 bp, Artificial Sequence
  chemically synthesized
tcattgtactaaaagaaaga

SEQ ID NO: 116041 - DNA, 20 bp, Artificial Sequence
  chemically synthesized
cattgtactaaaagaaagaa

SEQ ID NO: 116042 - DNA, 20 bp, Artificial Sequence
  chemically synthesized
actaaaagaaagaaaggcac

SEQ ID NO: 116043 - DNA, 20 bp, Artificial Sequence
  chemically synthesized
ctaaaagaaagaaaggcaca

SEQ ID NO: 116044 - DNA, 20 bp, Artificial Sequence
  chemically synthesized
aaagaaagaaaggcacaagg

SEQ ID NO: 116045 - DNA, 20 bp, Artificial Sequence
  chemically synthesized
aagattatgtcactgaatcc

SEQ ID NO: 116046 - DNA, 20 bp, Artificial Sequence
  chemically synthesized
ctaaaatgaagaccaggatt

SEQ ID NO: 116047 - DNA, 20 bp, Artificial Sequence
  chemically synthesized
tgtgctctaaaatgaagacc

SEQ ID NO: 116048 - DNA, 20 bp, Artificial Sequence
  chemically synthesized
ttgtgctctaaaatgaagac

SEQ ID NO: 116049 - DNA, 20 bp, Artificial Sequence
  chemically synthesized
ctgaatcctggtcttcattt

SEQ ID NO: 116050 - DNA, 20 bp, Artificial Sequence
  chemically synthesized
gaatcctggtcttcatttta

SEQ ID NO: 116051 - DNA, 20 bp, Artificial Sequence
  chemically synthesized
taaatttgtgctctaaaatg

SEQ ID NO: 116052 - DNA, 20 bp, Artificial Sequence
  chemically synthesized
gaccctgcatatggcaataa

SEQ ID NO: 116053 - DNA, 20 bp, Artificial Sequence
  chemically synthesized
ttttctgttattgccatatg

SEQ ID NO: 116054 - DNA, 20 bp, Artificial Sequence
  chemically synthesized
tttctgttattgccatatgc

SEQ ID NO: 116055 - DNA, 20 bp, Artificial Sequence
  chemically synthesized
ttctgttattgccatatgca

SEQ ID NO: 116056 - DNA, 20 bp, Artificial Sequence
  chemically synthesized
tgtttcaacgaccctgcata

SEQ ID NO: 116057 - DNA, 20 bp, Artificial Sequence
  chemically synthesized
acatacaaatacctacacat

SEQ ID NO: 116058 - DNA, 20 bp, Artificial Sequence
  chemically synthesized
catacaaatacctacacata

SEQ ID NO: 116059 - DNA, 20 bp, Artificial Sequence
  chemically synthesized
gtatgtgttcccttatgtgt

SEQ ID NO: 116060 - DNA, 20 bp, Artificial Sequence
  chemically synthesized
atacaaatacctacacataa

SEQ ID NO: 116061 - DNA, 20 bp, Artificial Sequence
  chemically synthesized
tgtatgtgttcccttatgtg

SEQ ID NO: 116062 - DNA, 20 bp, Artificial Sequence
  chemically synthesized
taagggaacacatacataca

SEQ ID NO: 116063 - DNA, 20 bp, Artificial Sequence
  chemically synthesized
ttctgcaatagtttgggtag

SEQ ID NO: 116064 - DNA, 20 bp, Artificial Sequence
  chemically synthesized
ttttctgcaatagtttgggt

SEQ ID NO: 116065 - DNA, 20 bp, Artificial Sequence
  chemically synthesized
cttttctgcaatagtttggg

SEQ ID NO: 116066 - DNA, 20 bp, Artificial Sequence
  chemically synthesized
gatcttttctgcaatagttt

SEQ ID NO: 116067 - DNA, 20 bp, Artificial Sequence
  chemically synthesized
agatcttttctgcaatagtt

SEQ ID NO: 116068 - DNA, 20 bp, Artificial Sequence
  chemically synthesized
ttctcctacccaaactattg

SEQ ID NO: 116069 - DNA, 20 bp, Artificial Sequence
  chemically synthesized
cagccagatcttttctgcaa

SEQ ID NO: 116070 - DNA, 20 bp, Artificial Sequence
  chemically synthesized
ctacccaaactattgcagaa

SEQ ID NO: 116071 - DNA, 20 bp, Artificial Sequence
  chemically synthesized
aaactattgcagaaaagatc

SEQ ID NO: 116072 - DNA, 20 bp, Artificial Sequence
  chemically synthesized
attttaaagcaaagagcagc

SEQ ID NO: 116073 - DNA, 20 bp, Artificial Sequence
  chemically synthesized
ttttattttaaagcaaagag

SEQ ID NO: 116074 - DNA, 20 bp, Artificial Sequence
  chemically synthesized
gatttttattttaaagcaaa

SEQ ID NO: 116075 - DNA, 20 bp, Artificial Sequence
  chemically synthesized
tggatttttattttaaagca

SEQ ID NO: 116076 - DNA, 20 bp, Artificial Sequence
  chemically synthesized
aaaaatggatttttatttta

SEQ ID NO: 116077 - DNA, 20 bp, Artificial Sequence
  chemically synthesized
cagcaaatttgcattaaaaa

SEQ ID NO: 116078 - DNA, 20 bp, Artificial Sequence
  chemically synthesized
catttttaatgcaaatttgc

SEQ ID NO: 116079 - DNA, 20 bp, Artificial Sequence
  chemically synthesized
tatgttggtgaacggcaaac

SEQ ID NO: 116080 - DNA, 20 bp, Artificial Sequence
  chemically synthesized
ttaattcatatgttggtgaa

SEQ ID NO: 116081 - DNA, 20 bp, Artificial Sequence
  chemically synthesized
aacctcgttaattcatatgt

SEQ ID NO: 116082 - DNA, 20 bp, Artificial Sequence
  chemically synthesized
tcaccaacatatgaattaac

SEQ ID NO: 116083 - DNA, 20 bp, Artificial Sequence
  chemically synthesized
caccaacatatgaattaacg

SEQ ID NO: 116084 - DNA, 20 bp, Artificial Sequence
  chemically synthesized
taccagacctcaagagagag

SEQ ID NO: 116085 - DNA, 20 bp, Artificial Sequence
  chemically synthesized
gtaccagacctcaagagaga

SEQ ID NO: 116086 - DNA, 20 bp, Artificial Sequence
  chemically synthesized
gttttcatcccctctctctt

SEQ ID NO: 116087 - DNA, 20 bp, Artificial Sequence
  chemically synthesized
agtaccagacctcaagagag

SEQ ID NO: 116088 - DNA, 20 bp, Artificial Sequence
  chemically synthesized
ttttcatcccctctctcttg

SEQ ID NO: 116089 - DNA, 20 bp, Artificial Sequence
  chemically synthesized
tagtaccagacctcaagaga

SEQ ID NO: 116090 - DNA, 20 bp, Artificial Sequence
  chemically synthesized
tttagtaccagacctcaaga

SEQ ID NO: 116091 - DNA, 20 bp, Artificial Sequence
  chemically synthesized
aatttagtaccagacctcaa

SEQ ID NO: 116092 - DNA, 20 bp, Artificial Sequence
  chemically synthesized
atcccctctctcttgaggtc

SEQ ID NO: 116093 - DNA, 20 bp, Artificial Sequence
  chemically synthesized
gtaatttagtaccagacctc

SEQ ID NO: 116094 - DNA, 20 bp, Artificial Sequence
  chemically synthesized
gagtttgagtaatttagtac

SEQ ID NO: 116095 - DNA, 20 bp, Artificial Sequence
  chemically synthesized
tctggagagtttgagtaatt

SEQ ID NO: 116096 - DNA, 20 bp, Artificial Sequence
  chemically synthesized
caattaactctggagagttt

SEQ ID NO: 116097 - DNA, 20 bp, Artificial Sequence
  chemically synthesized
actaaattactcaaactctc

SEQ ID NO: 116098 - DNA, 20 bp, Artificial Sequence
  chemically synthesized
taaattactcaaactctcca

SEQ ID NO: 116099 - DNA, 20 bp, Artificial Sequence
  chemically synthesized
ggtttccaattaactctgga

SEQ ID NO: 116100 - DNA, 20 bp, Artificial Sequence
  chemically synthesized
atggtttccaattaactctg

SEQ ID NO: 116101 - DNA, 20 bp, Artificial Sequence
  chemically synthesized
tcatggtttccaattaactc

SEQ ID NO: 116102 - DNA, 20 bp, Artificial Sequence
  chemically synthesized
tcaaactctccagagttaat

SEQ ID NO: 116103 - DNA, 20 bp, Artificial Sequence
  chemically synthesized
ctttgggaacatttaggtca

SEQ ID NO: 116104 - DNA, 20 bp, Artificial Sequence
  chemically synthesized
gcaatactttgggaacattt

SEQ ID NO: 116105 - DNA, 20 bp, Artificial Sequence
  chemically synthesized
agcaatactttgggaacatt

SEQ ID NO: 116106 - DNA, 20 bp, Artificial Sequence
  chemically synthesized
ccatgacctaaatgttccca

SEQ ID NO: 116107 - DNA, 20 bp, Artificial Sequence
  chemically synthesized
gaactaatcagcaatacttt

SEQ ID NO: 116108 - DNA, 20 bp, Artificial Sequence
  chemically synthesized
agaactaatcagcaatactt

SEQ ID NO: 116109 - DNA, 20 bp, Artificial Sequence
  chemically synthesized
gttcccaaagtattgctgat

SEQ ID NO: 116110 - DNA, 20 bp, Artificial Sequence
  chemically synthesized
tgagttttctgagaactaat

SEQ ID NO: 116111 - DNA, 20 bp, Artificial Sequence
  chemically synthesized
aagtattgctgattagttct

SEQ ID NO: 116112 - DNA, 20 bp, Artificial Sequence
  chemically synthesized
aagatgggaatgagttttct

SEQ ID NO: 116113 - DNA, 20 bp, Artificial Sequence
  chemically synthesized
gggtgacaaaagatgggaat

SEQ ID NO: 116114 - DNA, 20 bp, Artificial Sequence
  chemically synthesized
tgtctggggtgacaaaagat

SEQ ID NO: 116115 - DNA, 20 bp, Artificial Sequence
  chemically synthesized
gtgtctggggtgacaaaaga

SEQ ID NO: 116116 - DNA, 20 bp, Artificial Sequence
  chemically synthesized
tgtggtgtctggggtgacaa

SEQ ID NO: 116117 - DNA, 20 bp, Artificial Sequence
  chemically synthesized
attcccatcttttgtcaccc

SEQ ID NO: 116118 - DNA, 20 bp, Artificial Sequence
  chemically synthesized
aagtcatcctgtggtgtctg

SEQ ID NO: 116119 - DNA, 20 bp, Artificial Sequence
  chemically synthesized
aaagtcatcctgtggtgtct

SEQ ID NO: 116120 - DNA, 20 bp, Artificial Sequence
  chemically synthesized
ttttgtcaccccagacacca

SEQ ID NO: 116121 - DNA, 20 bp, Artificial Sequence
  chemically synthesized
aaaagtcatcctgtggtgtc

SEQ ID NO: 116122 - DNA, 20 bp, Artificial Sequence
  chemically synthesized
tttgtcaccccagacaccac

SEQ ID NO: 116123 - DNA, 20 bp, Artificial Sequence
  chemically synthesized
catgttaaaaagtcatcctg

SEQ ID NO: 116124 - DNA, 20 bp, Artificial Sequence
  chemically synthesized
ttgctactgcacatgttaaa

SEQ ID NO: 116125 - DNA, 20 bp, Artificial Sequence
  chemically synthesized
ggatgactttttaacatgtg

SEQ ID NO: 116126 - DNA, 20 bp, Artificial Sequence
  chemically synthesized
tgactttttaacatgtgcag

SEQ ID NO: 116127 - DNA, 20 bp, Artificial Sequence
  chemically synthesized
catgtgcagtagcaacacac

SEQ ID NO: 116128 - DNA, 20 bp, Artificial Sequence
  chemically synthesized
cagtagcaacacactggcat

SEQ ID NO: 116129 - DNA, 20 bp, Artificial Sequence
  chemically synthesized
gattaatctatttctcatgc

SEQ ID NO: 116130 - DNA, 20 bp, Artificial Sequence
  chemically synthesized
caacacactggcatgagaaa

SEQ ID NO: 116131 - DNA, 20 bp, Artificial Sequence
  chemically synthesized
agaaatagattaatcctcca

SEQ ID NO: 116132 - DNA, 20 bp, Artificial Sequence
  chemically synthesized
aagctgtggtttatctttgg

SEQ ID NO: 116133 - DNA, 20 bp, Artificial Sequence
  chemically synthesized
aaagctgtggtttatctttg

SEQ ID NO: 116134 - DNA, 20 bp, Artificial Sequence
  chemically synthesized
tcaaagctgtggtttatctt

SEQ ID NO: 116135 - DNA, 20 bp, Artificial Sequence
  chemically synthesized
aatcctccaaagataaacca

SEQ ID NO: 116136 - DNA, 20 bp, Artificial Sequence
  chemically synthesized
cacagatagcttcaaagctg

SEQ ID NO: 116137 - DNA, 20 bp, Artificial Sequence
  chemically synthesized
aaagataaaccacagctttg

SEQ ID NO: 116138 - DNA, 20 bp, Artificial Sequence
  chemically synthesized
agtttacacagatagcttca

SEQ ID NO: 116139 - DNA, 20 bp, Artificial Sequence
  chemically synthesized
gtgaaggaagtttacacaga

SEQ ID NO: 116140 - DNA, 20 bp, Artificial Sequence
  chemically synthesized
atcagtgaaggaagtttaca

SEQ ID NO: 116141 - DNA, 20 bp, Artificial Sequence
  chemically synthesized
aatgtctgtatcagtgaagg

SEQ ID NO: 116142 - DNA, 20 bp, Artificial Sequence
  chemically synthesized
taaaatgtctgtatcagtga

SEQ ID NO: 116143 - DNA, 20 bp, Artificial Sequence
  chemically synthesized
ataaaatgtctgtatcagtg

SEQ ID NO: 116144 - DNA, 20 bp, Artificial Sequence
  chemically synthesized
gtaaacttccttcactgata

SEQ ID NO: 116145 - DNA, 20 bp, Artificial Sequence
  chemically synthesized
aaaaaataaaatgtctgtat

SEQ ID NO: 116146 - DNA, 20 bp, Artificial Sequence
  chemically synthesized
aaaaaaatatacatatcacc

SEQ ID NO: 116147 - DNA, 20 bp, Artificial Sequence
  chemically synthesized
tatacatatcacctagactt

SEQ ID NO: 116148 - DNA, 20 bp, Artificial Sequence
  chemically synthesized
tctcttactatctaaagtct

SEQ ID NO: 116149 - DNA, 20 bp, Artificial Sequence
  chemically synthesized
ctctcttactatctaaagtc

SEQ ID NO: 116150 - DNA, 20 bp, Artificial Sequence
  chemically synthesized
catatcacctagactttaga

SEQ ID NO: 116151 - DNA, 20 bp, Artificial Sequence
  chemically synthesized
ctatactctcttactatcta

SEQ ID NO: 116152 - DNA, 20 bp, Artificial Sequence
  chemically synthesized
tcacctagactttagatagt

SEQ ID NO: 116153 - DNA, 20 bp, Artificial Sequence
  chemically synthesized
acctagactttagatagtaa

SEQ ID NO: 116154 - DNA, 20 bp, Artificial Sequence
  chemically synthesized
ctagactttagatagtaaga

SEQ ID NO: 116155 - DNA, 20 bp, Artificial Sequence
  chemically synthesized
ctttagatagtaagagagta

SEQ ID NO: 116156 - DNA, 20 bp, Artificial Sequence
  chemically synthesized
tttagatagtaagagagtat

SEQ ID NO: 116157 - DNA, 20 bp, Artificial Sequence
  chemically synthesized
ataggcattatcaatcacgt

SEQ ID NO: 116158 - DNA, 20 bp, Artificial Sequence
  chemically synthesized
taggcattatcaatcacgta

SEQ ID NO: 116159 - DNA, 20 bp, Artificial Sequence
  chemically synthesized
aatcacgtaaggaattttga

SEQ ID NO: 116160 - DNA, 20 bp, Artificial Sequence
  chemically synthesized
tcataaggttaaaaaaatga

SEQ ID NO: 116161 - DNA, 20 bp, Artificial Sequence
  chemically synthesized
attcataaggttaaaaaaat

SEQ ID NO: 116162 - DNA, 20 bp, Artificial Sequence
  chemically synthesized
ctattttaaaaacattcata

SEQ ID NO: 116163 - DNA, 20 bp, Artificial Sequence
  chemically synthesized
tctattttaaaaacattcat

SEQ ID NO: 116164 - DNA, 20 bp, Artificial Sequence
  chemically synthesized
ccttatgaatgtttttaaaa

SEQ ID NO: 116165 - DNA, 20 bp, Artificial Sequence
  chemically synthesized
ttatgaatgtttttaaaata

SEQ ID NO: 116166 - DNA, 20 bp, Artificial Sequence
  chemically synthesized
gagatttgcgaatttatcat

SEQ ID NO: 116167 - DNA, 20 bp, Artificial Sequence
  chemically synthesized
agatttgcgaatttatcatt

SEQ ID NO: 116168 - DNA, 20 bp, Artificial Sequence
  chemically synthesized
gatttgcgaatttatcatta

SEQ ID NO: 116169 - DNA, 20 bp, Artificial Sequence
  chemically synthesized
ttagggaaagtgtataatta

SEQ ID NO: 116170 - DNA, 20 bp, Artificial Sequence
  chemically synthesized
agtactaatggttttaggga

SEQ ID NO: 116171 - DNA, 20 bp, Artificial Sequence
  chemically synthesized
ggaaagtactaatggtttta

SEQ ID NO: 116172 - DNA, 20 bp, Artificial Sequence
  chemically synthesized
aggaaagtactaatggtttt

SEQ ID NO: 116173 - DNA, 20 bp, Artificial Sequence
  chemically synthesized
tacactttccctaaaaccat

SEQ ID NO: 116174 - DNA, 20 bp, Artificial Sequence
  chemically synthesized
caggaaagtactaatggttt

SEQ ID NO: 116175 - DNA, 20 bp, Artificial Sequence
  chemically synthesized
tcttttcaggaaagtactaa

SEQ ID NO: 116176 - DNA, 20 bp, Artificial Sequence
  chemically synthesized
accattagtactttcctgaa

SEQ ID NO: 116177 - DNA, 20 bp, Artificial Sequence
  chemically synthesized
taatgcaggtcttttcagga

SEQ ID NO: 116178 - DNA, 20 bp, Artificial Sequence
  chemically synthesized
ctcctaatgcaggtcttttc

SEQ ID NO: 116179 - DNA, 20 bp, Artificial Sequence
  chemically synthesized
tctcctaatgcaggtctttt

SEQ ID NO: 116180 - DNA, 20 bp, Artificial Sequence
  chemically synthesized
tttcctgaaaagacctgcat

SEQ ID NO: 116181 - DNA, 20 bp, Artificial Sequence
  chemically synthesized
ttcctgaaaagacctgcatt

SEQ ID NO: 116182 - DNA, 20 bp, Artificial Sequence
  chemically synthesized
cctgaaaagacctgcattag

SEQ ID NO: 116183 - DNA, 20 bp, Artificial Sequence
  chemically synthesized
ctactgctgtctcctaatgc

SEQ ID NO: 116184 - DNA, 20 bp, Artificial Sequence
  chemically synthesized
tctactgctgtctcctaatg

SEQ ID NO: 116185 - DNA, 20 bp, Artificial Sequence
  chemically synthesized
aaaagacctgcattaggaga

SEQ ID NO: 116186 - DNA, 20 bp, Artificial Sequence
  chemically synthesized
agacctgcattaggagacag

SEQ ID NO: 116187 - DNA, 20 bp, Artificial Sequence
  chemically synthesized
cctgcattaggagacagcag

SEQ ID NO: 116188 - DNA, 20 bp, Artificial Sequence
  chemically synthesized
acgggtaatgcaaagtaaag

SEQ ID NO: 116189 - DNA, 20 bp, Artificial Sequence
  chemically synthesized
gaaacgggtaatgcaaagta

SEQ ID NO: 116190 - DNA, 20 bp, Artificial Sequence
  chemically synthesized
caaatgaaacgggtaatgca

SEQ ID NO: 116191 - DNA, 20 bp, Artificial Sequence
  chemically synthesized
aaatacaaatcaaatgaaac

SEQ ID NO: 116192 - DNA, 20 bp, Artificial Sequence
  chemically synthesized
gaaatacaaatcaaatgaaa

SEQ ID NO: 116193 - DNA, 20 bp, Artificial Sequence
  chemically synthesized
aatttttttcagtgatttat

SEQ ID NO: 116194 - DNA, 20 bp, Artificial Sequence
  chemically synthesized
ctttatcaactaattttttt

SEQ ID NO: 116195 - DNA, 20 bp, Artificial Sequence
  chemically synthesized
cataaatcactgaaaaaaat

SEQ ID NO: 116196 - DNA, 20 bp, Artificial Sequence
  chemically synthesized
ctgaaaaaaattagttgata

SEQ ID NO: 116197 - DNA, 20 bp, Artificial Sequence
  chemically synthesized
agttgataaagaaatgtaca

SEQ ID NO: 116198 - DNA, 20 bp, Artificial Sequence
  chemically synthesized
agaaatgtacacagtgttat

SEQ ID NO: 116199 - DNA, 20 bp, Artificial Sequence
  chemically synthesized
aatgtacacagtgttatgag

SEQ ID NO: 116200 - DNA, 20 bp, Artificial Sequence
  chemically synthesized
gaaaaaaatatgtgtgtata

SEQ ID NO: 116201 - DNA, 20 bp, Artificial Sequence
  chemically synthesized
aagaaaaaaatatgtgtgta

SEQ ID NO: 116202 - DNA, 20 bp, Artificial Sequence
  chemically synthesized
atctctttaaaaattcaaga

SEQ ID NO: 116203 - DNA, 20 bp, Artificial Sequence
  chemically synthesized
atcaatctctttaaaaattc

SEQ ID NO: 116204 - DNA, 20 bp, Artificial Sequence
  chemically synthesized
ttttctttcttgaattttta

SEQ ID NO: 116205 - DNA, 20 bp, Artificial Sequence
  chemically synthesized
ttctttcttgaatttttaaa

SEQ ID NO: 116206 - DNA, 20 bp, Artificial Sequence
  chemically synthesized
taaagagattgatactcttt

SEQ ID NO: 116207 - DNA, 20 bp, Artificial Sequence
  chemically synthesized
tataaaatgcagatcttaaa

SEQ ID NO: 116208 - DNA, 20 bp, Artificial Sequence
  chemically synthesized
aatataaaatgcagatctta

SEQ ID NO: 116209 - DNA, 20 bp, Artificial Sequence
  chemically synthesized
cagcagaaaaatataaaatg

SEQ ID NO: 116210 - DNA, 20 bp, Artificial Sequence
  chemically synthesized
accttttcgtattgtatcag

SEQ ID NO: 116211 - DNA, 20 bp, Artificial Sequence
  chemically synthesized
agtaccttttcgtattgtat

SEQ ID NO: 116212 - DNA, 20 bp, Artificial Sequence
  chemically synthesized
ttctgctgatacaatacgaa

SEQ ID NO: 116213 - DNA, 20 bp, Artificial Sequence
  chemically synthesized
tctgctgatacaatacgaaa

SEQ ID NO: 116214 - DNA, 20 bp, Artificial Sequence
  chemically synthesized
caatacgaaaaggtactatt

SEQ ID NO: 116215 - DNA, 20 bp, Artificial Sequence
  chemically synthesized
atacgaaaaggtactatttg

SEQ ID NO: 116216 - DNA, 20 bp, Artificial Sequence
  chemically synthesized
acgaaaaggtactatttgga

SEQ ID NO: 116217 - DNA, 20 bp, Artificial Sequence
  chemically synthesized
cgaaaaggtactatttggag

SEQ ID NO: 116218 - DNA, 20 bp, Artificial Sequence
  chemically synthesized
tatatttcaacctctccaaa

SEQ ID NO: 116219 - DNA, 20 bp, Artificial Sequence
  chemically synthesized
gagaggttgaaatataatgt

SEQ ID NO: 116220 - DNA, 20 bp, Artificial Sequence
  chemically synthesized
agaggttgaaatataatgtt

SEQ ID NO: 116221 - DNA, 20 bp, Artificial Sequence
  chemically synthesized
aggttgaaatataatgttgg

SEQ ID NO: 116222 - DNA, 20 bp, Artificial Sequence
  chemically synthesized
tgggagtaatgaattacatt

SEQ ID NO: 116223 - DNA, 20 bp, Artificial Sequence
  chemically synthesized
gtaatgaattacatttggtt

SEQ ID NO: 116224 - DNA, 20 bp, Artificial Sequence
  chemically synthesized
catttggtttggttaatata

SEQ ID NO: 116225 - DNA, 20 bp, Artificial Sequence
  chemically synthesized
tttggtttggttaatataca

SEQ ID NO: 116226 - DNA, 20 bp, Artificial Sequence
  chemically synthesized
aatgcccaaaaggatatttt

SEQ ID NO: 116227 - DNA, 20 bp, Artificial Sequence
  chemically synthesized
agagactcaaaatatccttt

SEQ ID NO: 116228 - DNA, 20 bp, Artificial Sequence
  chemically synthesized
gagactcaaaatatcctttt

SEQ ID NO: 116229 - DNA, 20 bp, Artificial Sequence
  chemically synthesized
cagttgtataaatgcccaaa

SEQ ID NO: 116230 - DNA, 20 bp, Artificial Sequence
  chemically synthesized
acagttgtataaatgcccaa

SEQ ID NO: 116231 - DNA, 20 bp, Artificial Sequence
  chemically synthesized
ttgggcatttatacaactgt

SEQ ID NO: 116232 - DNA, 20 bp, Artificial Sequence
  chemically synthesized
tgggcatttatacaactgta

SEQ ID NO: 116233 - DNA, 20 bp, Artificial Sequence
  chemically synthesized
gggcatttatacaactgtaa

SEQ ID NO: 116234 - DNA, 20 bp, Artificial Sequence
  chemically synthesized
ttttttctaaagatccctta

SEQ ID NO: 116235 - DNA, 20 bp, Artificial Sequence
  chemically synthesized
atacaactgtaagggatctt

SEQ ID NO: 116236 - DNA, 20 bp, Artificial Sequence
  chemically synthesized
gttaactgcatttttttcta

SEQ ID NO: 116237 - DNA, 20 bp, Artificial Sequence
  chemically synthesized
gggatctttagaaaaaaatg

SEQ ID NO: 116238 - DNA, 20 bp, Artificial Sequence
  chemically synthesized
atgcagttaacactacttcc

SEQ ID NO: 116239 - DNA, 20 bp, Artificial Sequence
  chemically synthesized
gtgtgtaattatctgggaag

SEQ ID NO: 116240 - DNA, 20 bp, Artificial Sequence
  chemically synthesized
taagtgtgtaattatctggg

SEQ ID NO: 116241 - DNA, 20 bp, Artificial Sequence
  chemically synthesized
ttttaagtgtgtaattatct

SEQ ID NO: 116242 - DNA, 20 bp, Artificial Sequence
  chemically synthesized
attttaagtgtgtaattatc

SEQ ID NO: 116243 - DNA, 20 bp, Artificial Sequence
  chemically synthesized
gataattacacacttaaaat

SEQ ID NO: 116244 - DNA, 20 bp, Artificial Sequence
  chemically synthesized
tataggtcaacaccaatttt

SEQ ID NO: 116245 - DNA, 20 bp, Artificial Sequence
  chemically synthesized
ttaaaattggtgttgaccta

SEQ ID NO: 116246 - DNA, 20 bp, Artificial Sequence
  chemically synthesized
aattggtgttgacctatagt

SEQ ID NO: 116247 - DNA, 20 bp, Artificial Sequence
  chemically synthesized
acagaaatgtgtccaactat

SEQ ID NO: 116248 - DNA, 20 bp, Artificial Sequence
  chemically synthesized
aacagaaatgtgtccaacta

SEQ ID NO: 116249 - DNA, 20 bp, Artificial Sequence
  chemically synthesized
cattgagaatttatttagaa

SEQ ID NO: 116250 - DNA, 20 bp, Artificial Sequence
  chemically synthesized
caaatcattgagaatttatt

SEQ ID NO: 116251 - DNA, 20 bp, Artificial Sequence
  chemically synthesized
ttcgcattatacaaatcatt

SEQ ID NO: 116252 - DNA, 20 bp, Artificial Sequence
  chemically synthesized
tttgtataatgcgaattttt

SEQ ID NO: 116253 - DNA, 20 bp, Artificial Sequence
  chemically synthesized
tataatgcgaatttttaagt

SEQ ID NO: 116254 - DNA, 20 bp, Artificial Sequence
  chemically synthesized
gcgaatttttaagttggctt

SEQ ID NO: 116255 - DNA, 20 bp, Artificial Sequence
  chemically synthesized
tttatcactgcaagtaacca

SEQ ID NO: 116256 - DNA, 20 bp, Artificial Sequence
  chemically synthesized
aagttggctttggttacttg

SEQ ID NO: 116257 - DNA, 20 bp, Artificial Sequence
  chemically synthesized
tttaaagagtttatcactgc

SEQ ID NO: 116258 - DNA, 20 bp, Artificial Sequence
  chemically synthesized
ttgcagtgataaactcttta

SEQ ID NO: 116259 - DNA, 20 bp, Artificial Sequence
  chemically synthesized
ttaggaaatatatctttaaa

SEQ ID NO: 116260 - DNA, 20 bp, Artificial Sequence
  chemically synthesized
cattaggaaatatatcttta

SEQ ID NO: 116261 - DNA, 20 bp, Artificial Sequence
  chemically synthesized
ctgcttagtctatcaacatt

SEQ ID NO: 116262 - DNA, 20 bp, Artificial Sequence
  chemically synthesized
gatatatttcctaatgttga

SEQ ID NO: 116263 - DNA, 20 bp, Artificial Sequence
  chemically synthesized
gctgcttagtctatcaacat

SEQ ID NO: 116264 - DNA, 20 bp, Artificial Sequence
  chemically synthesized
tttcctaatgttgatagact

SEQ ID NO: 116265 - DNA, 20 bp, Artificial Sequence
  chemically synthesized
cctaatgttgatagactaag

SEQ ID NO: 116266 - DNA, 20 bp, Artificial Sequence
  chemically synthesized
aggagagaagaaaagctgct

SEQ ID NO: 116267 - DNA, 20 bp, Artificial Sequence
  chemically synthesized
atccttttaggagagaagaa

SEQ ID NO: 116268 - DNA, 20 bp, Artificial Sequence
  chemically synthesized
aacaaatccttttaggagag

SEQ ID NO: 116269 - DNA, 20 bp, Artificial Sequence
  chemically synthesized
cagcttttcttctctcctaa

SEQ ID NO: 116270 - DNA, 20 bp, Artificial Sequence
  chemically synthesized
agcttttcttctctcctaaa

SEQ ID NO: 116271 - DNA, 20 bp, Artificial Sequence
  chemically synthesized
ttaaacaaatccttttagga

SEQ ID NO: 116272 - DNA, 20 bp, Artificial Sequence
  chemically synthesized
ttttaaacaaatccttttag

SEQ ID NO: 116273 - DNA, 20 bp, Artificial Sequence
  chemically synthesized
tattttaaacaaatcctttt

SEQ ID NO: 116274 - DNA, 20 bp, Artificial Sequence
  chemically synthesized
ctattttaaacaaatccttt

SEQ ID NO: 116275 - DNA, 20 bp, Artificial Sequence
  chemically synthesized
ctaaaaggatttgtttaaaa

SEQ ID NO: 116276 - DNA, 20 bp, Artificial Sequence
  chemically synthesized
tagtataaaaaccaatttaa

SEQ ID NO: 116277 - DNA, 20 bp, Artificial Sequence
  chemically synthesized
cttaggctcatcttttaaat

SEQ ID NO: 116278 - DNA, 20 bp, Artificial Sequence
  chemically synthesized
taaaaaccaatttaaaagat

SEQ ID NO: 116279 - DNA, 20 bp, Artificial Sequence
  chemically synthesized
ccaatttaaaagatgagcct

SEQ ID NO: 116280 - DNA, 20 bp, Artificial Sequence
  chemically synthesized
ggtttgtaagagatgatctt

SEQ ID NO: 116281 - DNA, 20 bp, Artificial Sequence
  chemically synthesized
aggtttgtaagagatgatct

SEQ ID NO: 116282 - DNA, 20 bp, Artificial Sequence
  chemically synthesized
cagtcttatcaggtttgtaa

SEQ ID NO: 116283 - DNA, 20 bp, Artificial Sequence
  chemically synthesized
cacagtcttatcaggtttgt

SEQ ID NO: 116284 - DNA, 20 bp, Artificial Sequence
  chemically synthesized
tcatctcttacaaacctgat

SEQ ID NO: 116285 - DNA, 20 bp, Artificial Sequence
  chemically synthesized
tataactgcacagtcttatc

SEQ ID NO: 116286 - DNA, 20 bp, Artificial Sequence
  chemically synthesized
atataactgcacagtcttat

SEQ ID NO: 116287 - DNA, 20 bp, Artificial Sequence
  chemically synthesized
acaaacctgataagactgtg

SEQ ID NO: 116288 - DNA, 20 bp, Artificial Sequence
  chemically synthesized
tgaggatatatataactgca

SEQ ID NO: 116289 - DNA, 20 bp, Artificial Sequence
  chemically synthesized
tctctaagttattgtggatg

SEQ ID NO: 116290 - DNA, 20 bp, Artificial Sequence
  chemically synthesized
ttctctaagttattgtggat

SEQ ID NO: 116291 - DNA, 20 bp, Artificial Sequence
  chemically synthesized
tgtttttctctaagttattg

SEQ ID NO: 116292 - DNA, 20 bp, Artificial Sequence
  chemically synthesized
tatcctcatccacaataact

SEQ ID NO: 116293 - DNA, 20 bp, Artificial Sequence
  chemically synthesized
tcctcatccacaataactta

SEQ ID NO: 116294 - DNA, 20 bp, Artificial Sequence
  chemically synthesized
gttttgttctgtttttctct

SEQ ID NO: 116295 - DNA, 20 bp, Artificial Sequence
  chemically synthesized
cacaataacttagagaaaaa

SEQ ID NO: 116296 - DNA, 20 bp, Artificial Sequence
  chemically synthesized
cagaacaaaacaactaactg

SEQ ID NO: 116297 - DNA, 20 bp, Artificial Sequence
  chemically synthesized
aacaactaacaagctacagt

SEQ ID NO: 116298 - DNA, 20 bp, Artificial Sequence
  chemically synthesized
tatcaacaactaacaagcta

SEQ ID NO: 116299 - DNA, 20 bp, Artificial Sequence
  chemically synthesized
aacaactaactgtagcttgt

SEQ ID NO: 116300 - DNA, 20 bp, Artificial Sequence
  chemically synthesized
attatgtatcaacaactaac

SEQ ID NO: 116301 - DNA, 20 bp, Artificial Sequence
  chemically synthesized
agttgttgatacataatatt

SEQ ID NO: 116302 - DNA, 20 bp, Artificial Sequence
  chemically synthesized
tgttgatacataatattcag

SEQ ID NO: 116303 - DNA, 20 bp, Artificial Sequence
  chemically synthesized
gatacataatattcagaaga

SEQ ID NO: 116304 - DNA, 20 bp, Artificial Sequence
  chemically synthesized
ataatattcagaagacagca

SEQ ID NO: 116305 - DNA, 20 bp, Artificial Sequence
  chemically synthesized
atattcagaagacagcaaag

SEQ ID NO: 116306 - DNA, 20 bp, Artificial Sequence
  chemically synthesized
tattcagaagacagcaaagc

SEQ ID NO: 116307 - DNA, 20 bp, Artificial Sequence
  chemically synthesized
tcagaagacagcaaagcagg

SEQ ID NO: 116308 - DNA, 20 bp, Artificial Sequence
  chemically synthesized
cagaagacagcaaagcaggc

SEQ ID NO: 116309 - DNA, 20 bp, Artificial Sequence
  chemically synthesized
gacagcaaagcaggcaggtt

SEQ ID NO: 116310 - DNA, 20 bp, Artificial Sequence
  chemically synthesized
gtgtgtttgccatttgatat

SEQ ID NO: 116311 - DNA, 20 bp, Artificial Sequence
  chemically synthesized
ttcagttttctaatatcaaa

SEQ ID NO: 116312 - DNA, 20 bp, Artificial Sequence
  chemically synthesized
atcaaatggcaaacacacaa

SEQ ID NO: 116313 - DNA, 20 bp, Artificial Sequence
  chemically synthesized
acacaacagattcactttaa

SEQ ID NO: 116314 - DNA, 20 bp, Artificial Sequence
  chemically synthesized
aacagattcactttaaaaga

SEQ ID NO: 116315 - DNA, 20 bp, Artificial Sequence
  chemically synthesized
ttagccacttctttctttta

SEQ ID NO: 116316 - DNA, 20 bp, Artificial Sequence
  chemically synthesized
agattcactttaaaagaaag

SEQ ID NO: 116317 - DNA, 20 bp, Artificial Sequence
  chemically synthesized
ttcactttaaaagaaagaag

SEQ ID NO: 116318 - DNA, 20 bp, Artificial Sequence
  chemically synthesized
ttcatctgttgatatgtttt

SEQ ID NO: 116319 - DNA, 20 bp, Artificial Sequence
  chemically synthesized
agtggctaaaaacatatcaa

SEQ ID NO: 116320 - DNA, 20 bp, Artificial Sequence
  chemically synthesized
caacagatgaaataaactta

SEQ ID NO: 116321 - DNA, 20 bp, Artificial Sequence
  chemically synthesized
cagatgaaataaacttatag

SEQ ID NO: 116322 - DNA, 20 bp, Artificial Sequence
  chemically synthesized
gatgaaataaacttatagta

SEQ ID NO: 116323 - DNA, 20 bp, Artificial Sequence
  chemically synthesized
cactgacaggactctactat

SEQ ID NO: 116324 - DNA, 20 bp, Artificial Sequence
  chemically synthesized
aacttatagtagagtcctgt

SEQ ID NO: 116325 - DNA, 20 bp, Artificial Sequence
  chemically synthesized
ttatagtagagtcctgtcag

SEQ ID NO: 116326 - DNA, 20 bp, Artificial Sequence
  chemically synthesized
tatttccaaattccactgac

SEQ ID NO: 116327 - DNA, 20 bp, Artificial Sequence
  chemically synthesized
gtatttccaaattccactga

SEQ ID NO: 116328 - DNA, 20 bp, Artificial Sequence
  chemically synthesized
agagtcctgtcagtggaatt

SEQ ID NO: 116329 - DNA, 20 bp, Artificial Sequence
  chemically synthesized
taattcagaatttagatcag

SEQ ID NO: 116330 - DNA, 20 bp, Artificial Sequence
  chemically synthesized
tcataattcagaatttagat

SEQ ID NO: 116331 - DNA, 20 bp, Artificial Sequence
  chemically synthesized
cgatatcataattcagaatt

SEQ ID NO: 116332 - DNA, 20 bp, Artificial Sequence
  chemically synthesized
aatatttcgatatcataatt

SEQ ID NO: 116333 - DNA, 20 bp, Artificial Sequence
  chemically synthesized
agtaagagactaggtaataa

SEQ ID NO: 116334 - DNA, 20 bp, Artificial Sequence
  chemically synthesized
tatttgtgacttttattacc

SEQ ID NO: 116335 - DNA, 20 bp, Artificial Sequence
  chemically synthesized
agagtactgagtaagagact

SEQ ID NO: 116336 - DNA, 20 bp, Artificial Sequence
  chemically synthesized
gagagtactgagtaagagac

SEQ ID NO: 116337 - DNA, 20 bp, Artificial Sequence
  chemically synthesized
ttattacctagtctcttact

SEQ ID NO: 116338 - DNA, 20 bp, Artificial Sequence
  chemically synthesized
cacaagagagtactgagtaa

SEQ ID NO: 116339 - DNA, 20 bp, Artificial Sequence
  chemically synthesized
accacaagagagtactgagt

SEQ ID NO: 116340 - DNA, 20 bp, Artificial Sequence
  chemically synthesized
attaaccacaagagagtact

SEQ ID NO: 116341 - DNA, 20 bp, Artificial Sequence
  chemically synthesized
tcttactcagtactctcttg

SEQ ID NO: 116342 - DNA, 20 bp, Artificial Sequence
  chemically synthesized
gtgtattattaaccacaaga

SEQ ID NO: 116343 - DNA, 20 bp, Artificial Sequence
  chemically synthesized
atgtgtattattaaccacaa

SEQ ID NO: 116344 - DNA, 20 bp, Artificial Sequence
  chemically synthesized
aaatgtgtattattaaccac

SEQ ID NO: 116345 - DNA, 20 bp, Artificial Sequence
  chemically synthesized
ggttaataatacacatttga

SEQ ID NO: 116346 - DNA, 20 bp, Artificial Sequence
  chemically synthesized
gttaataatacacatttgaa

SEQ ID NO: 116347 - DNA, 20 bp, Artificial Sequence
  chemically synthesized
ttaataatacacatttgaaa

SEQ ID NO: 116348 - DNA, 20 bp, Artificial Sequence
  chemically synthesized
cacatttgaaagggcccttt

SEQ ID NO: 116349 - DNA, 20 bp, Artificial Sequence
  chemically synthesized
gttcatgtgctttgctaaaa

SEQ ID NO: 116350 - DNA, 20 bp, Artificial Sequence
  chemically synthesized
ttgaaagggcccttttagca

SEQ ID NO: 116351 - DNA, 20 bp, Artificial Sequence
  chemically synthesized
tgttcatgtgctttgctaaa

SEQ ID NO: 116352 - DNA, 20 bp, Artificial Sequence
  chemically synthesized
ctgttcatgtgctttgctaa

SEQ ID NO: 116353 - DNA, 20 bp, Artificial Sequence
  chemically synthesized
cttttagcaaagcacatgaa

SEQ ID NO: 116354 - DNA, 20 bp, Artificial Sequence
  chemically synthesized
catgaacagacactttttaa

SEQ ID NO: 116355 - DNA, 20 bp, Artificial Sequence
  chemically synthesized
catgtatgttttcttttaaa

SEQ ID NO: 116356 - DNA, 20 bp, Artificial Sequence
  chemically synthesized
aaaacatacatgcgaccaac

SEQ ID NO: 116357 - DNA, 20 bp, Artificial Sequence
  chemically synthesized
gctttttttcatatgcttgt

SEQ ID NO: 116358 - DNA, 20 bp, Artificial Sequence
  chemically synthesized
accaacaagcatatgaaaaa

SEQ ID NO: 116359 - DNA, 20 bp, Artificial Sequence
  chemically synthesized
ctccaatgatcagtgatgtt

SEQ ID NO: 116360 - DNA, 20 bp, Artificial Sequence
  chemically synthesized
agctcaacatcactgatcat

SEQ ID NO: 116361 - DNA, 20 bp, Artificial Sequence
  chemically synthesized
ctcaacatcactgatcattg

SEQ ID NO: 116362 - DNA, 20 bp, Artificial Sequence
  chemically synthesized
atttgcatttctccaatgat

SEQ ID NO: 116363 - DNA, 20 bp, Artificial Sequence
  chemically synthesized
gaaatgcaaatcaaaaccac

SEQ ID NO: 116364 - DNA, 20 bp, Artificial Sequence
  chemically synthesized
aaatgcaaatcaaaaccaca

SEQ ID NO: 116365 - DNA, 20 bp, Artificial Sequence
  chemically synthesized
atgcaaatcaaaaccacaag

SEQ ID NO: 116366 - DNA, 20 bp, Artificial Sequence
  chemically synthesized
tatgtgatggtatctccttg

SEQ ID NO: 116367 - DNA, 20 bp, Artificial Sequence
  chemically synthesized
ccattctgactggtatgtga

SEQ ID NO: 116368 - DNA, 20 bp, Artificial Sequence
  chemically synthesized
aaggagataccatcacatac

SEQ ID NO: 116369 - DNA, 20 bp, Artificial Sequence
  chemically synthesized
agataccatcacataccagt

SEQ ID NO: 116370 - DNA, 20 bp, Artificial Sequence
  chemically synthesized
ccatcacataccagtcagaa

SEQ ID NO: 116371 - DNA, 20 bp, Artificial Sequence
  chemically synthesized
ttagtgatagccattctgac

SEQ ID NO: 116372 - DNA, 20 bp, Artificial Sequence
  chemically synthesized
tatttttgactatttagtga

SEQ ID NO: 116373 - DNA, 20 bp, Artificial Sequence
  chemically synthesized
tcagaatggctatcactaaa

SEQ ID NO: 116374 - DNA, 20 bp, Artificial Sequence
  chemically synthesized
acctgttatttttgactatt

SEQ ID NO: 116375 - DNA, 20 bp, Artificial Sequence
  chemically synthesized
cactaaatagtcaaaaataa

SEQ ID NO: 116376 - DNA, 20 bp, Artificial Sequence
  chemically synthesized
actaaatagtcaaaaataac

SEQ ID NO: 116377 - DNA, 20 bp, Artificial Sequence
  chemically synthesized
tagtcaaaaataacaggttc

SEQ ID NO: 116378 - DNA, 20 bp, Artificial Sequence
  chemically synthesized
gtcaaaaataacaggttctg

SEQ ID NO: 116379 - DNA, 20 bp, Artificial Sequence
  chemically synthesized
aataacaggttctggagaaa

SEQ ID NO: 116380 - DNA, 20 bp, Artificial Sequence
  chemically synthesized
tataagcaatgctttttctc

SEQ ID NO: 116381 - DNA, 20 bp, Artificial Sequence
  chemically synthesized
cactataaccaacagtttat

SEQ ID NO: 116382 - DNA, 20 bp, Artificial Sequence
  chemically synthesized
aagcattgcttataaactgt

SEQ ID NO: 116383 - DNA, 20 bp, Artificial Sequence
  chemically synthesized
tgcttataaactgttggtta

SEQ ID NO: 116384 - DNA, 20 bp, Artificial Sequence
  chemically synthesized
ataacatacactataaccaa

SEQ ID NO: 116385 - DNA, 20 bp, Artificial Sequence
  chemically synthesized
ggttatagtgtatgttattt

SEQ ID NO: 116386 - DNA, 20 bp, Artificial Sequence
  chemically synthesized
atttcagtcattgtgaaaac

SEQ ID NO: 116387 - DNA, 20 bp, Artificial Sequence
  chemically synthesized
agtcattgtgaaaaccagtg

SEQ ID NO: 116388 - DNA, 20 bp, Artificial Sequence
  chemically synthesized
tcattgtgaaaaccagtgtg

SEQ ID NO: 116389 - DNA, 20 bp, Artificial Sequence
  chemically synthesized
tctctgaagaatctccacac

SEQ ID NO: 116390 - DNA, 20 bp, Artificial Sequence
  chemically synthesized
aaaccagtgtggagattctt

SEQ ID NO: 116391 - DNA, 20 bp, Artificial Sequence
  chemically synthesized
accagtgtggagattcttca

SEQ ID NO: 116392 - DNA, 20 bp, Artificial Sequence
  chemically synthesized
agctccatccatgatctctg

SEQ ID NO: 116393 - DNA, 20 bp, Artificial Sequence
  chemically synthesized
tggagattcttcagagatca

SEQ ID NO: 116394 - DNA, 20 bp, Artificial Sequence
  chemically synthesized
gattcttcagagatcatgga

SEQ ID NO: 116395 - DNA, 20 bp, Artificial Sequence
  chemically synthesized
ttcttcagagatcatggatg

SEQ ID NO: 116396 - DNA, 20 bp, Artificial Sequence
  chemically synthesized
agagatcatggatggagctg

SEQ ID NO: 116397 - DNA, 20 bp, Artificial Sequence
  chemically synthesized
gagatcatggatggagctgc

SEQ ID NO: 116398 - DNA, 20 bp, Artificial Sequence
  chemically synthesized
ttgctaaggacaatggcctg

SEQ ID NO: 116399 - DNA, 20 bp, Artificial Sequence
  chemically synthesized
gagctgcaggccattgtcct

SEQ ID NO: 116400 - DNA, 20 bp, Artificial Sequence
  chemically synthesized
cattagtttgctaaggacaa

SEQ ID NO: 116401 - DNA, 20 bp, Artificial Sequence
  chemically synthesized
gttcctgcattagtttgcta

SEQ ID NO: 116402 - DNA, 20 bp, Artificial Sequence
  chemically synthesized
tgttcctgcattagtttgct

SEQ ID NO: 116403 - DNA, 20 bp, Artificial Sequence
  chemically synthesized
ttgtccttagcaaactaatg

SEQ ID NO: 116404 - DNA, 20 bp, Artificial Sequence
  chemically synthesized
tgtccttagcaaactaatgc

SEQ ID NO: 116405 - DNA, 20 bp, Artificial Sequence
  chemically synthesized
ttggttttctgttcctgcat

SEQ ID NO: 116406 - DNA, 20 bp, Artificial Sequence
  chemically synthesized
ttagcaaactaatgcaggaa

SEQ ID NO: 116407 - DNA, 20 bp, Artificial Sequence
  chemically synthesized
aagtgagaacatgcagtatt

SEQ ID NO: 116408 - DNA, 20 bp, Artificial Sequence
  chemically synthesized
cactaataagtgagaacatg

SEQ ID NO: 116409 - DNA, 20 bp, Artificial Sequence
  chemically synthesized
tactgcatgttctcacttat

SEQ ID NO: 116410 - DNA, 20 bp, Artificial Sequence
  chemically synthesized
tttagctcccactaataagt

SEQ ID NO: 116411 - DNA, 20 bp, Artificial Sequence
  chemically synthesized
tgcatgttctcacttattag

SEQ ID NO: 116412 - DNA, 20 bp, Artificial Sequence
  chemically synthesized
gcatgttctcacttattagt

SEQ ID NO: 116413 - DNA, 20 bp, Artificial Sequence
  chemically synthesized
atcatttagctcccactaat

SEQ ID NO: 116414 - DNA, 20 bp, Artificial Sequence
  chemically synthesized
atgttctcacttattagtgg

SEQ ID NO: 116415 - DNA, 20 bp, Artificial Sequence
  chemically synthesized
attagtgggagctaaatgat

SEQ ID NO: 116416 - DNA, 20 bp, Artificial Sequence
  chemically synthesized
gtccatgtgttctcatcatt

SEQ ID NO: 116417 - DNA, 20 bp, Artificial Sequence
  chemically synthesized
agctaaatgatgagaacaca

SEQ ID NO: 116418 - DNA, 20 bp, Artificial Sequence
  chemically synthesized
atgatgagaacacatggaca

SEQ ID NO: 116419 - DNA, 20 bp, Artificial Sequence
  chemically synthesized
gatgagaacacatggacaca

SEQ ID NO: 116420 - DNA, 20 bp, Artificial Sequence
  chemically synthesized
tgagaacacatggacacaga

SEQ ID NO: 116421 - DNA, 20 bp, Artificial Sequence
  chemically synthesized
gagaacacatggacacagag

SEQ ID NO: 116422 - DNA, 20 bp, Artificial Sequence
  chemically synthesized
atggacacagagaggaacaa

SEQ ID NO: 116423 - DNA, 20 bp, Artificial Sequence
  chemically synthesized
acagagaggaacaacagacg

SEQ ID NO: 116424 - DNA, 20 bp, Artificial Sequence
  chemically synthesized
gagaggaacaacagacgtgg

SEQ ID NO: 116425 - DNA, 20 bp, Artificial Sequence
  chemically synthesized
caacagacgtggaagcctac

SEQ ID NO: 116426 - DNA, 20 bp, Artificial Sequence
  chemically synthesized
acagacgtggaagcctactg

SEQ ID NO: 116427 - DNA, 20 bp, Artificial Sequence
  chemically synthesized
gacgtggaagcctactggag

SEQ ID NO: 116428 - DNA, 20 bp, Artificial Sequence
  chemically synthesized
cccaccctccccactccagt

SEQ ID NO: 116429 - DNA, 20 bp, Artificial Sequence
  chemically synthesized
acgtggaagcctactggagt

SEQ ID NO: 116430 - DNA, 20 bp, Artificial Sequence
  chemically synthesized
tcccaccctccccactccag

SEQ ID NO: 116431 - DNA, 20 bp, Artificial Sequence
  chemically synthesized
cgtggaagcctactggagtg

SEQ ID NO: 116432 - DNA, 20 bp, Artificial Sequence
  chemically synthesized
tggaagcctactggagtggg

SEQ ID NO: 116433 - DNA, 20 bp, Artificial Sequence
  chemically synthesized
tcctcccaccctccccactc

SEQ ID NO: 116434 - DNA, 20 bp, Artificial Sequence
  chemically synthesized
ggaagcctactggagtgggg

SEQ ID NO: 116435 - DNA, 20 bp, Artificial Sequence
  chemically synthesized
gaagcctactggagtgggga

SEQ ID NO: 116436 - DNA, 20 bp, Artificial Sequence
  chemically synthesized
gcctactggagtggggaggg

SEQ ID NO: 116437 - DNA, 20 bp, Artificial Sequence
  chemically synthesized
cctactggagtggggagggt

SEQ ID NO: 116438 - DNA, 20 bp, Artificial Sequence
  chemically synthesized
tactggagtggggagggtgg

SEQ ID NO: 116439 - DNA, 20 bp, Artificial Sequence
  chemically synthesized
actggagtggggagggtggg

SEQ ID NO: 116440 - DNA, 20 bp, Artificial Sequence
  chemically synthesized
tggagtggggagggtgggag

SEQ ID NO: 116441 - DNA, 20 bp, Artificial Sequence
  chemically synthesized
ggagtggggagggtgggagg

SEQ ID NO: 116442 - DNA, 20 bp, Artificial Sequence
  chemically synthesized
gagtggggagggtgggagga

SEQ ID NO: 116443 - DNA, 20 bp, Artificial Sequence
  chemically synthesized
gtggggagggtgggaggagg

SEQ ID NO: 116444 - DNA, 20 bp, Artificial Sequence
  chemically synthesized
ggggagggtgggaggaggga

SEQ ID NO: 116445 - DNA, 20 bp, Artificial Sequence
  chemically synthesized
gggagggtgggaggagggag

SEQ ID NO: 116446 - DNA, 20 bp, Artificial Sequence
  chemically synthesized
gtgggaggagggagaggatc

SEQ ID NO: 116447 - DNA, 20 bp, Artificial Sequence
  chemically synthesized
gtattaagcgtagtacacat

SEQ ID NO: 116448 - DNA, 20 bp, Artificial Sequence
  chemically synthesized
tgttacccaggtattaagcg

SEQ ID NO: 116449 - DNA, 20 bp, Artificial Sequence
  chemically synthesized
tgtgtactacgcttaatacc

SEQ ID NO: 116450 - DNA, 20 bp, Artificial Sequence
  chemically synthesized
gtgtactacgcttaatacct

SEQ ID NO: 116451 - DNA, 20 bp, Artificial Sequence
  chemically synthesized
tattttgttacccaggtatt

SEQ ID NO: 116452 - DNA, 20 bp, Artificial Sequence
  chemically synthesized
taccgattattttgttaccc

SEQ ID NO: 116453 - DNA, 20 bp, Artificial Sequence
  chemically synthesized
gtaccgattattttgttacc

SEQ ID NO: 116454 - DNA, 20 bp, Artificial Sequence
  chemically synthesized
tacctgggtaacaaaataat

SEQ ID NO: 116455 - DNA, 20 bp, Artificial Sequence
  chemically synthesized
taggtaaactcatgtcatgg

SEQ ID NO: 116456 - DNA, 20 bp, Artificial Sequence
  chemically synthesized
ataggtaaactcatgtcatg

SEQ ID NO: 116457 - DNA, 20 bp, Artificial Sequence
  chemically synthesized
acaacaaacccccatgacat

SEQ ID NO: 116458 - DNA, 20 bp, Artificial Sequence
  chemically synthesized
tataggtaaactcatgtcat

SEQ ID NO: 116459 - DNA, 20 bp, Artificial Sequence
  chemically synthesized
atataggtaaactcatgtca

SEQ ID NO: 116460 - DNA, 20 bp, Artificial Sequence
  chemically synthesized
cgtgtgcaggtttgttatat

SEQ ID NO: 116461 - DNA, 20 bp, Artificial Sequence
  chemically synthesized
acgtgtgcaggtttgttata

SEQ ID NO: 116462 - DNA, 20 bp, Artificial Sequence
  chemically synthesized
aagttcaggagcacgtgtgc

SEQ ID NO: 116463 - DNA, 20 bp, Artificial Sequence
  chemically synthesized
taagttcaggagcacgtgtg

SEQ ID NO: 116464 - DNA, 20 bp, Artificial Sequence
  chemically synthesized
aacttttattttaagttcag

SEQ ID NO: 116465 - DNA, 20 bp, Artificial Sequence
  chemically synthesized
ttaacttttattttaagttc

SEQ ID NO: 116466 - DNA, 20 bp, Artificial Sequence
  chemically synthesized
cttaacttttattttaagtt

SEQ ID NO: 116467 - DNA, 20 bp, Artificial Sequence
  chemically synthesized
tgctcctgaacttaaaataa

SEQ ID NO: 116468 - DNA, 20 bp, Artificial Sequence
  chemically synthesized
tttttcttaacttttatttt

SEQ ID NO: 116469 - DNA, 20 bp, Artificial Sequence
  chemically synthesized
ctgaacttaaaataaaagtt

SEQ ID NO: 116470 - DNA, 20 bp, Artificial Sequence
  chemically synthesized
ttaaaataaaagttaagaaa

SEQ ID NO: 116471 - DNA, 20 bp, Artificial Sequence
  chemically synthesized
aatacatgttgaatataaaa

SEQ ID NO: 116472 - DNA, 20 bp, Artificial Sequence
  chemically synthesized
atattcaacatgtattgtta

SEQ ID NO: 116473 - DNA, 20 bp, Artificial Sequence
  chemically synthesized
aaaactgcagaacattattt

SEQ ID NO: 116474 - DNA, 20 bp, Artificial Sequence
  chemically synthesized
tacactaaaataatgttctg

SEQ ID NO: 116475 - DNA, 20 bp, Artificial Sequence
  chemically synthesized
tcaaaggagcttgaaaactg

SEQ ID NO: 116476 - DNA, 20 bp, Artificial Sequence
  chemically synthesized
aataatgttctgcagttttc

SEQ ID NO: 116477 - DNA, 20 bp, Artificial Sequence
  chemically synthesized
cagttttcaagctcctttga

SEQ ID NO: 116478 - DNA, 20 bp, Artificial Sequence
  chemically synthesized
agttttcaagctcctttgac

SEQ ID NO: 116479 - DNA, 20 bp, Artificial Sequence
  chemically synthesized
atctgtggatcctgtcaaag

SEQ ID NO: 116480 - DNA, 20 bp, Artificial Sequence
  chemically synthesized
ctatctgtggatcctgtcaa

SEQ ID NO: 116481 - DNA, 20 bp, Artificial Sequence
  chemically synthesized
gctatctgtggatcctgtca

SEQ ID NO: 116482 - DNA, 20 bp, Artificial Sequence
  chemically synthesized
agctcctttgacaggatcca

SEQ ID NO: 116483 - DNA, 20 bp, Artificial Sequence
  chemically synthesized
cctttgacaggatccacaga

SEQ ID NO: 116484 - DNA, 20 bp, Artificial Sequence
  chemically synthesized
atgaaaggaggtgctatctg

SEQ ID NO: 116485 - DNA, 20 bp, Artificial Sequence
  chemically synthesized
gctatttaaaatatgaaagg

SEQ ID NO: 116486 - DNA, 20 bp, Artificial Sequence
  chemically synthesized
agctatttaaaatatgaaag

SEQ ID NO: 116487 - DNA, 20 bp, Artificial Sequence
  chemically synthesized
caagctatttaaaatatgaa

SEQ ID NO: 116488 - DNA, 20 bp, Artificial Sequence
  chemically synthesized
tcaagctatttaaaatatga

SEQ ID NO: 116489 - DNA, 20 bp, Artificial Sequence
  chemically synthesized
acctcctttcatattttaaa

SEQ ID NO: 116490 - DNA, 20 bp, Artificial Sequence
  chemically synthesized
catattttaaatagcttgat

SEQ ID NO: 116491 - DNA, 20 bp, Artificial Sequence
  chemically synthesized
atattttaaatagcttgatg

SEQ ID NO: 116492 - DNA, 20 bp, Artificial Sequence
  chemically synthesized
cctgcctcattagcctcatc

SEQ ID NO: 116493 - DNA, 20 bp, Artificial Sequence
  chemically synthesized
aatagcttgatgaggctaat

SEQ ID NO: 116494 - DNA, 20 bp, Artificial Sequence
  chemically synthesized
atagcttgatgaggctaatg

SEQ ID NO: 116495 - DNA, 20 bp, Artificial Sequence
  chemically synthesized
gcttgatgaggctaatgagg

SEQ ID NO: 116496 - DNA, 20 bp, Artificial Sequence
  chemically synthesized
cttgatgaggctaatgaggc

SEQ ID NO: 116497 - DNA, 20 bp, Artificial Sequence
  chemically synthesized
ataattacaacctgcctcat

SEQ ID NO: 116498 - DNA, 20 bp, Artificial Sequence
  chemically synthesized
caggttgtaattatcatgaa

SEQ ID NO: 116499 - DNA, 20 bp, Artificial Sequence
  chemically synthesized
taattatcatgaacagttta

SEQ ID NO: 116500 - DNA, 20 bp, Artificial Sequence
  chemically synthesized
atcatgaacagtttatagat

SEQ ID NO: 116501 - DNA, 20 bp, Artificial Sequence
  chemically synthesized
tcatgaacagtttatagatg

SEQ ID NO: 116502 - DNA, 20 bp, Artificial Sequence
  chemically synthesized
tagatgaggaacttaacttt

SEQ ID NO: 116503 - DNA, 20 bp, Artificial Sequence
  chemically synthesized
agatgaggaacttaactttc

SEQ ID NO: 116504 - DNA, 20 bp, Artificial Sequence
  chemically synthesized
acccagcttccctgaaagtt

SEQ ID NO: 116505 - DNA, 20 bp, Artificial Sequence
  chemically synthesized
gatgaggaacttaactttca

SEQ ID NO: 116506 - DNA, 20 bp, Artificial Sequence
  chemically synthesized
gaggaacttaactttcaggg

SEQ ID NO: 116507 - DNA, 20 bp, Artificial Sequence
  chemically synthesized
aactcacccagcttccctga

SEQ ID NO: 116508 - DNA, 20 bp, Artificial Sequence
  chemically synthesized
aacttaactttcagggaagc

SEQ ID NO: 116509 - DNA, 20 bp, Artificial Sequence
  chemically synthesized
acttaactttcagggaagct

SEQ ID NO: 116510 - DNA, 20 bp, Artificial Sequence
  chemically synthesized
aactttcagggaagctgggt

SEQ ID NO: 116511 - DNA, 20 bp, Artificial Sequence
  chemically synthesized
atttattttggcaactcacc

SEQ ID NO: 116512 - DNA, 20 bp, Artificial Sequence
  chemically synthesized
tcaagatttgtcatttattt

SEQ ID NO: 116513 - DNA, 20 bp, Artificial Sequence
  chemically synthesized
acagtggactagattgtttc

SEQ ID NO: 116514 - DNA, 20 bp, Artificial Sequence
  chemically synthesized
tgacaaatcttgaaacaatc

SEQ ID NO: 116515 - DNA, 20 bp, Artificial Sequence
  chemically synthesized
tgtcttatagtacagtggac

SEQ ID NO: 116516 - DNA, 20 bp, Artificial Sequence
  chemically synthesized
ggtaatgtcttatagtacag

SEQ ID NO: 116517 - DNA, 20 bp, Artificial Sequence
  chemically synthesized
aatctagtccactgtactat

SEQ ID NO: 116518 - DNA, 20 bp, Artificial Sequence
  chemically synthesized
agaggtaatgtcttatagta

SEQ ID NO: 116519 - DNA, 20 bp, Artificial Sequence
  chemically synthesized
ccttgagaggtaatgtctta

SEQ ID NO: 116520 - DNA, 20 bp, Artificial Sequence
  chemically synthesized
actataagacattacctctc

SEQ ID NO: 116521 - DNA, 20 bp, Artificial Sequence
  chemically synthesized
ctataagacattacctctca

SEQ ID NO: 116522 - DNA, 20 bp, Artificial Sequence
  chemically synthesized
taagacattacctctcaagg

SEQ ID NO: 116523 - DNA, 20 bp, Artificial Sequence
  chemically synthesized
actggcaagtctaccttgag

SEQ ID NO: 116524 - DNA, 20 bp, Artificial Sequence
  chemically synthesized
gactggcaagtctaccttga

SEQ ID NO: 116525 - DNA, 20 bp, Artificial Sequence
  chemically synthesized
gagactggcaagtctacctt

SEQ ID NO: 116526 - DNA, 20 bp, Artificial Sequence
  chemically synthesized
acctctcaaggtagacttgc

SEQ ID NO: 116527 - DNA, 20 bp, Artificial Sequence
  chemically synthesized
tacttcacagggagactggc

SEQ ID NO: 116528 - DNA, 20 bp, Artificial Sequence
  chemically synthesized
tatttacttcacagggagac

SEQ ID NO: 116529 - DNA, 20 bp, Artificial Sequence
  chemically synthesized
gacttgccagtctccctgtg

SEQ ID NO: 116530 - DNA, 20 bp, Artificial Sequence
  chemically synthesized
cattatatttacttcacagg

SEQ ID NO: 116531 - DNA, 20 bp, Artificial Sequence
  chemically synthesized
tccattatatttacttcaca

SEQ ID NO: 116532 - DNA, 20 bp, Artificial Sequence
  chemically synthesized
atccattatatttacttcac

SEQ ID NO: 116533 - DNA, 20 bp, Artificial Sequence
  chemically synthesized
tatccattatatttacttca

SEQ ID NO: 116534 - DNA, 20 bp, Artificial Sequence
  chemically synthesized
tccctgtgaagtaaatataa

SEQ ID NO: 116535 - DNA, 20 bp, Artificial Sequence
  chemically synthesized
taatatgtcactattctcaa

SEQ ID NO: 116536 - DNA, 20 bp, Artificial Sequence
  chemically synthesized
aaacaaagggcttttgagaa

SEQ ID NO: 116537 - DNA, 20 bp, Artificial Sequence
  chemically synthesized
acagaaaacaaagggctttt

SEQ ID NO: 116538 - DNA, 20 bp, Artificial Sequence
  chemically synthesized
taataataacagaaaacaaa

SEQ ID NO: 116539 - DNA, 20 bp, Artificial Sequence
  chemically synthesized
ataataataacagaaaacaa

SEQ ID NO: 116540 - DNA, 20 bp, Artificial Sequence
  chemically synthesized
tataataataacagaaaaca

SEQ ID NO: 116541 - DNA, 20 bp, Artificial Sequence
  chemically synthesized
cctaattcatataataataa

SEQ ID NO: 116542 - DNA, 20 bp, Artificial Sequence
  chemically synthesized
tctgttattattatatgaat

SEQ ID NO: 116543 - DNA, 20 bp, Artificial Sequence
  chemically synthesized
ctgttattattatatgaatt

SEQ ID NO: 116544 - DNA, 20 bp, Artificial Sequence
  chemically synthesized
tattatatgaattaggatta

SEQ ID NO: 116545 - DNA, 20 bp, Artificial Sequence
  chemically synthesized
attatatgaattaggattat

SEQ ID NO: 116546 - DNA, 20 bp, Artificial Sequence
  chemically synthesized
ttatatgaattaggattatg

SEQ ID NO: 116547 - DNA, 20 bp, Artificial Sequence
  chemically synthesized
tgtgtgtatatatgtgtgaa

SEQ ID NO: 116548 - DNA, 20 bp, Artificial Sequence
  chemically synthesized
tgtgtatatatgtgtgaaaa

SEQ ID NO: 116549 - DNA, 20 bp, Artificial Sequence
  chemically synthesized
atatatgtgtgaaaagagaa

SEQ ID NO: 116550 - DNA, 20 bp, Artificial Sequence
  chemically synthesized
cggatgaagatggtaagcaa

SEQ ID NO: 116551 - DNA, 20 bp, Artificial Sequence
  chemically synthesized
acggatgaagatggtaagca

SEQ ID NO: 116552 - DNA, 20 bp, Artificial Sequence
  chemically synthesized
agatgacggatgaagatggt

SEQ ID NO: 116553 - DNA, 20 bp, Artificial Sequence
  chemically synthesized
tcatagatgacggatgaaga

SEQ ID NO: 116554 - DNA, 20 bp, Artificial Sequence
  chemically synthesized
catctcatagatgacggatg

SEQ ID NO: 116555 - DNA, 20 bp, Artificial Sequence
  chemically synthesized
gtaacacatctcatagatga

SEQ ID NO: 116556 - DNA, 20 bp, Artificial Sequence
  chemically synthesized
catcttcatccgtcatctat

SEQ ID NO: 116557 - DNA, 20 bp, Artificial Sequence
  chemically synthesized
atttattgtaacacatctca

SEQ ID NO: 116558 - DNA, 20 bp, Artificial Sequence
  chemically synthesized
cttacctcgagttcaaagtt

SEQ ID NO: 116559 - DNA, 20 bp, Artificial Sequence
  chemically synthesized
aaatactgaactttgaactc

SEQ ID NO: 116560 - DNA, 20 bp, Artificial Sequence
  chemically synthesized
tcaagcttacctcgagttca

SEQ ID NO: 116561 - DNA, 20 bp, Artificial Sequence
  chemically synthesized
aatactgaactttgaactcg

SEQ ID NO: 116562 - DNA, 20 bp, Artificial Sequence
  chemically synthesized
ctgaactttgaactcgaggt

SEQ ID NO: 116563 - DNA, 20 bp, Artificial Sequence
  chemically synthesized
caaatcctcaagcttacctc

SEQ ID NO: 116564 - DNA, 20 bp, Artificial Sequence
  chemically synthesized
tttgaactcgaggtaagctt

SEQ ID NO: 116565 - DNA, 20 bp, Artificial Sequence
  chemically synthesized
ttgaactcgaggtaagcttg

SEQ ID NO: 116566 - DNA, 20 bp, Artificial Sequence
  chemically synthesized
tctttctaaatcaaatcctc

SEQ ID NO: 116567 - DNA, 20 bp, Artificial Sequence
  chemically synthesized
gtaagcttgaggatttgatt

SEQ ID NO: 116568 - DNA, 20 bp, Artificial Sequence
  chemically synthesized
gcttgaggatttgatttaga

SEQ ID NO: 116569 - DNA, 20 bp, Artificial Sequence
  chemically synthesized
tgaggatttgatttagaaag

SEQ ID NO: 116570 - DNA, 20 bp, Artificial Sequence
  chemically synthesized
gaggatttgatttagaaaga

SEQ ID NO: 116571 - DNA, 20 bp, Artificial Sequence
  chemically synthesized
gatttagaaagaaggcatta

SEQ ID NO: 116572 - DNA, 20 bp, Artificial Sequence
  chemically synthesized
atttagaaagaaggcattac

SEQ ID NO: 116573 - DNA, 20 bp, Artificial Sequence
  chemically synthesized
ataactttgtataatttcat

SEQ ID NO: 116574 - DNA, 20 bp, Artificial Sequence
  chemically synthesized
aattcttatgaaattataca

SEQ ID NO: 116575 - DNA, 20 bp, Artificial Sequence
  chemically synthesized
tatgaaattatacaaagtta

SEQ ID NO: 116576 - DNA, 20 bp, Artificial Sequence
  chemically synthesized
agttatagtacatacaattt

SEQ ID NO: 116577 - DNA, 20 bp, Artificial Sequence
  chemically synthesized
actaacttatcatttagaga

SEQ ID NO: 116578 - DNA, 20 bp, Artificial Sequence
  chemically synthesized
tactaacttatcatttagag

SEQ ID NO: 116579 - DNA, 20 bp, Artificial Sequence
  chemically synthesized
atttactaacttatcattta

SEQ ID NO: 116580 - DNA, 20 bp, Artificial Sequence
  chemically synthesized
tttggccttctctaaatgat

SEQ ID NO: 116581 - DNA, 20 bp, Artificial Sequence
  chemically synthesized
acatttactaacttatcatt

SEQ ID NO: 116582 - DNA, 20 bp, Artificial Sequence
  chemically synthesized
gccttctctaaatgataagt

SEQ ID NO: 116583 - DNA, 20 bp, Artificial Sequence
  chemically synthesized
aatgataagttagtaaatgt

SEQ ID NO: 116584 - DNA, 20 bp, Artificial Sequence
  chemically synthesized
gtaaatgttggttaatgata

SEQ ID NO: 116585 - DNA, 20 bp, Artificial Sequence
  chemically synthesized
aaatgttggttaatgataca

SEQ ID NO: 116586 - DNA, 20 bp, Artificial Sequence
  chemically synthesized
atgttggttaatgatacaga

SEQ ID NO: 116587 - DNA, 20 bp, Artificial Sequence
  chemically synthesized
tcccaaaatacatagacatt

SEQ ID NO: 116588 - DNA, 20 bp, Artificial Sequence
  chemically synthesized
atctgaatgtctatgtattt

SEQ ID NO: 116589 - DNA, 20 bp, Artificial Sequence
  chemically synthesized
aaaagatatcccaaaataca

SEQ ID NO: 116590 - DNA, 20 bp, Artificial Sequence
  chemically synthesized
tctgaatgtctatgtatttt

SEQ ID NO: 116591 - DNA, 20 bp, Artificial Sequence
  chemically synthesized
atgttagaaattttatgtaa

SEQ ID NO: 116592 - DNA, 20 bp, Artificial Sequence
  chemically synthesized
gaagtattttattttcatgt

SEQ ID NO: 116593 - DNA, 20 bp, Artificial Sequence
  chemically synthesized
gtctagtaaagcaatgtatg

SEQ ID NO: 116594 - DNA, 20 bp, Artificial Sequence
  chemically synthesized
tacttcatacattgctttac

SEQ ID NO: 116595 - DNA, 20 bp, Artificial Sequence
  chemically synthesized
tcactgtaaaatgtctagta

SEQ ID NO: 116596 - DNA, 20 bp, Artificial Sequence
  chemically synthesized
ttatttcactgtaaaatgtc

SEQ ID NO: 116597 - DNA, 20 bp, Artificial Sequence
  chemically synthesized
ttgctttactagacatttta

SEQ ID NO: 116598 - DNA, 20 bp, Artificial Sequence
  chemically synthesized
aaattaattcatcgttcagt

SEQ ID NO: 116599 - DNA, 20 bp, Artificial Sequence
  chemically synthesized
cgacaaattaattcatcgtt

SEQ ID NO: 116600 - DNA, 20 bp, Artificial Sequence
  chemically synthesized
aacgatgaattaatttgtcg

SEQ ID NO: 116601 - DNA, 20 bp, Artificial Sequence
  chemically synthesized
attaatttgtcgaagtgact

SEQ ID NO: 116602 - DNA, 20 bp, Artificial Sequence
  chemically synthesized
ttgtcgaagtgacttagttt

SEQ ID NO: 116603 - DNA, 20 bp, Artificial Sequence
  chemically synthesized
ttttagaatctacttaaact

SEQ ID NO: 116604 - DNA, 20 bp, Artificial Sequence
  chemically synthesized
tcgaagtgacttagtttaag

SEQ ID NO: 116605 - DNA, 20 bp, Artificial Sequence
  chemically synthesized
ttagtttaagtagattctaa

SEQ ID NO: 116606 - DNA, 20 bp, Artificial Sequence
  chemically synthesized
aattagaagggcaattcttt

SEQ ID NO: 116607 - DNA, 20 bp, Artificial Sequence
  chemically synthesized
aaataggtttacaattagaa

SEQ ID NO: 116608 - DNA, 20 bp, Artificial Sequence
  chemically synthesized
aaaataggtttacaattaga

SEQ ID NO: 116609 - DNA, 20 bp, Artificial Sequence
  chemically synthesized
taaaataggtttacaattag

SEQ ID NO: 116610 - DNA, 20 bp, Artificial Sequence
  chemically synthesized
cattaaaataggtttacaat

SEQ ID NO: 116611 - DNA, 20 bp, Artificial Sequence
  chemically synthesized
taattgtaaacctattttaa

SEQ ID NO: 116612 - DNA, 20 bp, Artificial Sequence
  chemically synthesized
catatctgagccattaaaat

SEQ ID NO: 116613 - DNA, 20 bp, Artificial Sequence
  chemically synthesized
tcatatctgagccattaaaa

SEQ ID NO: 116614 - DNA, 20 bp, Artificial Sequence
  chemically synthesized
gtaaacctattttaatggct

SEQ ID NO: 116615 - DNA, 20 bp, Artificial Sequence
  chemically synthesized
ttgtcttgtaaatcatatct

SEQ ID NO: 116616 - DNA, 20 bp, Artificial Sequence
  chemically synthesized
atggctcagatatgatttac

SEQ ID NO: 116617 - DNA, 20 bp, Artificial Sequence
  chemically synthesized
tcagatatgatttacaagac

SEQ ID NO: 116618 - DNA, 20 bp, Artificial Sequence
  chemically synthesized
atgatttacaagacaagatg

SEQ ID NO: 116619 - DNA, 20 bp, Artificial Sequence
  chemically synthesized
tgatttacaagacaagatgt

SEQ ID NO: 116620 - DNA, 20 bp, Artificial Sequence
  chemically synthesized
aagacaagatgtgggattac

SEQ ID NO: 116621 - DNA, 20 bp, Artificial Sequence
  chemically synthesized
acaagatgtgggattacaag

SEQ ID NO: 116622 - DNA, 20 bp, Artificial Sequence
  chemically synthesized
tgtgggattacaagtagctt

SEQ ID NO: 116623 - DNA, 20 bp, Artificial Sequence
  chemically synthesized
tgataagttttaattagctc

SEQ ID NO: 116624 - DNA, 20 bp, Artificial Sequence
  chemically synthesized
ttattttgataagttttaat

SEQ ID NO: 116625 - DNA, 20 bp, Artificial Sequence
  chemically synthesized
ctttaaatctttattttgat

SEQ ID NO: 116626 - DNA, 20 bp, Artificial Sequence
  chemically synthesized
aattaaaacttatcaaaata

SEQ ID NO: 116627 - DNA, 20 bp, Artificial Sequence
  chemically synthesized
cttatcaaaataaagattta

SEQ ID NO: 116628 - DNA, 20 bp, Artificial Sequence
  chemically synthesized
gtaattaaaagtacgaaagc

SEQ ID NO: 116629 - DNA, 20 bp, Artificial Sequence
  chemically synthesized
cctggtaattaaaagtacga

SEQ ID NO: 116630 - DNA, 20 bp, Artificial Sequence
  chemically synthesized
tttttcaccctggtaattaa

SEQ ID NO: 116631 - DNA, 20 bp, Artificial Sequence
  chemically synthesized
gctttcgtacttttaattac

SEQ ID NO: 116632 - DNA, 20 bp, Artificial Sequence
  chemically synthesized
ctttcgtacttttaattacc

SEQ ID NO: 116633 - DNA, 20 bp, Artificial Sequence
  chemically synthesized
tttcgtacttttaattacca

SEQ ID NO: 116634 - DNA, 20 bp, Artificial Sequence
  chemically synthesized
ttaaatgcaatttttcaccc

SEQ ID NO: 116635 - DNA, 20 bp, Artificial Sequence
  chemically synthesized
gggtgaaaaattgcatttaa

SEQ ID NO: 116636 - DNA, 20 bp, Artificial Sequence
  chemically synthesized
aaaattgcatttaaaagacc

SEQ ID NO: 116637 - DNA, 20 bp, Artificial Sequence
  chemically synthesized
caatacatttcaaagtatct

SEQ ID NO: 116638 - DNA, 20 bp, Artificial Sequence
  chemically synthesized
tcaatacatttcaaagtatc

SEQ ID NO: 116639 - DNA, 20 bp, Artificial Sequence
  chemically synthesized
aaggccatcaatacatttca

SEQ ID NO: 116640 - DNA, 20 bp, Artificial Sequence
  chemically synthesized
gatactttgaaatgtattga

SEQ ID NO: 116641 - DNA, 20 bp, Artificial Sequence
  chemically synthesized
atgtattgatggccttttat

SEQ ID NO: 116642 - DNA, 20 bp, Artificial Sequence
  chemically synthesized
attttaattgatcttataaa

SEQ ID NO: 116643 - DNA, 20 bp, Artificial Sequence
  chemically synthesized
aattttaattgatcttataa

SEQ ID NO: 116644 - DNA, 20 bp, Artificial Sequence
  chemically synthesized
aagatcaattaaaatttata

SEQ ID NO: 116645 - DNA, 20 bp, Artificial Sequence
  chemically synthesized
caattaaaatttataaagaa

SEQ ID NO: 116646 - DNA, 20 bp, Artificial Sequence
  chemically synthesized
tataaagaacagtcataatt

SEQ ID NO: 116647 - DNA, 20 bp, Artificial Sequence
  chemically synthesized
ataaagaacagtcataattt

SEQ ID NO: 116648 - DNA, 20 bp, Artificial Sequence
  chemically synthesized
taggatttatttttttcaat

SEQ ID NO: 116649 - DNA, 20 bp, Artificial Sequence
  chemically synthesized
gatttatttttttcaattag

SEQ ID NO: 116650 - DNA, 20 bp, Artificial Sequence
  chemically synthesized
caattagaagtacaacatga

SEQ ID NO: 116651 - DNA, 20 bp, Artificial Sequence
  chemically synthesized
aattagaagtacaacatgaa

SEQ ID NO: 116652 - DNA, 20 bp, Artificial Sequence
  chemically synthesized
aacatgaaaggaatgaatct

SEQ ID NO: 116653 - DNA, 20 bp, Artificial Sequence
  chemically synthesized
acatgaaaggaatgaatctg

SEQ ID NO: 116654 - DNA, 20 bp, Artificial Sequence
  chemically synthesized
catgaaaggaatgaatctga

SEQ ID NO: 116655 - DNA, 20 bp, Artificial Sequence
  chemically synthesized
cttaaaaccagatgcaccct

SEQ ID NO: 116656 - DNA, 20 bp, Artificial Sequence
  chemically synthesized
aatgaatctgagggtgcatc

SEQ ID NO: 116657 - DNA, 20 bp, Artificial Sequence
  chemically synthesized
ctgagggtgcatctggtttt

SEQ ID NO: 116658 - DNA, 20 bp, Artificial Sequence
  chemically synthesized
agtcagaggattcttaaaac

SEQ ID NO: 116659 - DNA, 20 bp, Artificial Sequence
  chemically synthesized
gtggtatattcataagtcag

SEQ ID NO: 116660 - DNA, 20 bp, Artificial Sequence
  chemically synthesized
agtggtatattcataagtca

SEQ ID NO: 116661 - DNA, 20 bp, Artificial Sequence
  chemically synthesized
taagtggtatattcataagt

SEQ ID NO: 116662 - DNA, 20 bp, Artificial Sequence
  chemically synthesized
atagtaagtggtatattcat

SEQ ID NO: 116663 - DNA, 20 bp, Artificial Sequence
  chemically synthesized
tatgaatataccacttacta

SEQ ID NO: 116664 - DNA, 20 bp, Artificial Sequence
  chemically synthesized
aatatccagactatagtaag

SEQ ID NO: 116665 - DNA, 20 bp, Artificial Sequence
  chemically synthesized
atgaatatccagactatagt

SEQ ID NO: 116666 - DNA, 20 bp, Artificial Sequence
  chemically synthesized
atataccacttactatagtc

SEQ ID NO: 116667 - DNA, 20 bp, Artificial Sequence
  chemically synthesized
gatgatgaatatccagacta

SEQ ID NO: 116668 - DNA, 20 bp, Artificial Sequence
  chemically synthesized
tgatgacgatgatgaatatc

SEQ ID NO: 116669 - DNA, 20 bp, Artificial Sequence
  chemically synthesized
agtaagttgtggttgatgaa

SEQ ID NO: 116670 - DNA, 20 bp, Artificial Sequence
  chemically synthesized
aaataatttacagtaagttg

SEQ ID NO: 116671 - DNA, 20 bp, Artificial Sequence
  chemically synthesized
gccctcaaataatttacagt

SEQ ID NO: 116672 - DNA, 20 bp, Artificial Sequence
  chemically synthesized
ctttgccctcaaataattta

SEQ ID NO: 116673 - DNA, 20 bp, Artificial Sequence
  chemically synthesized
caacttactgtaaattattt

SEQ ID NO: 116674 - DNA, 20 bp, Artificial Sequence
  chemically synthesized
aacttactgtaaattatttg

SEQ ID NO: 116675 - DNA, 20 bp, Artificial Sequence
  chemically synthesized
acttactgtaaattatttga

SEQ ID NO: 116676 - DNA, 20 bp, Artificial Sequence
  chemically synthesized
ctgtaaattatttgagggca

SEQ ID NO: 116677 - DNA, 20 bp, Artificial Sequence
  chemically synthesized
gagggcaaagattcacacca

SEQ ID NO: 116678 - DNA, 20 bp, Artificial Sequence
  chemically synthesized
aagattcacaccacagttcc

SEQ ID NO: 116679 - DNA, 20 bp, Artificial Sequence
  chemically synthesized
tattaaattgccaggaactg

SEQ ID NO: 116680 - DNA, 20 bp, Artificial Sequence
  chemically synthesized
tgagtatctattaaattgcc

SEQ ID NO: 116681 - DNA, 20 bp, Artificial Sequence
  chemically synthesized
ttgagtatctattaaattgc

SEQ ID NO: 116682 - DNA, 20 bp, Artificial Sequence
  chemically synthesized
cacagttcctggcaatttaa

SEQ ID NO: 116683 - DNA, 20 bp, Artificial Sequence
  chemically synthesized
tgactttaattaaatttatt

SEQ ID NO: 116684 - DNA, 20 bp, Artificial Sequence
  chemically synthesized
atactcaataaatttaatta

SEQ ID NO: 116685 - DNA, 20 bp, Artificial Sequence
  chemically synthesized
ctgtataccttatcggtagt

SEQ ID NO: 116686 - DNA, 20 bp, Artificial Sequence
  chemically synthesized
gctgtataccttatcggtag

SEQ ID NO: 116687 - DNA, 20 bp, Artificial Sequence
  chemically synthesized
tcaataaacctactaccgat

SEQ ID NO: 116688 - DNA, 20 bp, Artificial Sequence
  chemically synthesized
caataaacctactaccgata

SEQ ID NO: 116689 - DNA, 20 bp, Artificial Sequence
  chemically synthesized
gaagctgtataccttatcgg

SEQ ID NO: 116690 - DNA, 20 bp, Artificial Sequence
  chemically synthesized
ttagaagctgtataccttat

SEQ ID NO: 116691 - DNA, 20 bp, Artificial Sequence
  chemically synthesized
cctactaccgataaggtata

SEQ ID NO: 116692 - DNA, 20 bp, Artificial Sequence
  chemically synthesized
gcctatggccttgtttttag

SEQ ID NO: 116693 - DNA, 20 bp, Artificial Sequence
  chemically synthesized
ggtatacagcttctaaaaac

SEQ ID NO: 116694 - DNA, 20 bp, Artificial Sequence
  chemically synthesized
gtatacagcttctaaaaaca

SEQ ID NO: 116695 - DNA, 20 bp, Artificial Sequence
  chemically synthesized
agagcctatggccttgtttt

SEQ ID NO: 116696 - DNA, 20 bp, Artificial Sequence
  chemically synthesized
agcttctaaaaacaaggcca

SEQ ID NO: 116697 - DNA, 20 bp, Artificial Sequence
  chemically synthesized
gcttctaaaaacaaggccat

SEQ ID NO: 116698 - DNA, 20 bp, Artificial Sequence
  chemically synthesized
tttttaagaacaagagccta

SEQ ID NO: 116699 - DNA, 20 bp, Artificial Sequence
  chemically synthesized
tttaagttttttaagaacaa

SEQ ID NO: 116700 - DNA, 20 bp, Artificial Sequence
  chemically synthesized
attttaagttttttaagaac

SEQ ID NO: 116701 - DNA, 20 bp, Artificial Sequence
  chemically synthesized
aagaaaattttaagtttttt

SEQ ID NO: 116702 - DNA, 20 bp, Artificial Sequence
  chemically synthesized
attcacatcaagaaaatttt

SEQ ID NO: 116703 - DNA, 20 bp, Artificial Sequence
  chemically synthesized
ttattcaataaattcacatc

SEQ ID NO: 116704 - DNA, 20 bp, Artificial Sequence
  chemically synthesized
aataataatttatatttata

SEQ ID NO: 116705 - DNA, 20 bp, Artificial Sequence
  chemically synthesized
tttatatttatatagaattt

SEQ ID NO: 116706 - DNA, 20 bp, Artificial Sequence
  chemically synthesized
tatatttatatagaatttta

SEQ ID NO: 116707 - DNA, 20 bp, Artificial Sequence
  chemically synthesized
ttatatagaattttagagtt

SEQ ID NO: 116708 - DNA, 20 bp, Artificial Sequence
  chemically synthesized
aactgaaataatttatgtga

SEQ ID NO: 116709 - DNA, 20 bp, Artificial Sequence
  chemically synthesized
tgctttcacataaattattt

SEQ ID NO: 116710 - DNA, 20 bp, Artificial Sequence
  chemically synthesized
aatattttcaaattattatg

SEQ ID NO: 116711 - DNA, 20 bp, Artificial Sequence
  chemically synthesized
taatattttcaaattattat

SEQ ID NO: 116712 - DNA, 20 bp, Artificial Sequence
  chemically synthesized
aacaatagttttttataaca

SEQ ID NO: 116713 - DNA, 20 bp, Artificial Sequence
  chemically synthesized
tgttataaaaaactattgtt

SEQ ID NO: 116714 - DNA, 20 bp, Artificial Sequence
  chemically synthesized
tcttggttataactgaacaa

SEQ ID NO: 116715 - DNA, 20 bp, Artificial Sequence
  chemically synthesized
actattgttcagttataacc

SEQ ID NO: 116716 - DNA, 20 bp, Artificial Sequence
  chemically synthesized
attctcatttttaaacatct

SEQ ID NO: 116717 - DNA, 20 bp, Artificial Sequence
  chemically synthesized
taaccaagatgtttaaaaat

SEQ ID NO: 116718 - DNA, 20 bp, Artificial Sequence
  chemically synthesized
agatgtttaaaaatgagaat

SEQ ID NO: 116719 - DNA, 20 bp, Artificial Sequence
  chemically synthesized
gcaaaacacaattttgggca

SEQ ID NO: 116720 - DNA, 20 bp, Artificial Sequence
  chemically synthesized
gcaaagcaaaacacaatttt

SEQ ID NO: 116721 - DNA, 20 bp, Artificial Sequence
  chemically synthesized
tgcaaagcaaaacacaattt

SEQ ID NO: 116722 - DNA, 20 bp, Artificial Sequence
  chemically synthesized
tgaatatctgtacatttgca

SEQ ID NO: 116723 - DNA, 20 bp, Artificial Sequence
  chemically synthesized
tgttttgctttgcaaatgta

SEQ ID NO: 116724 - DNA, 20 bp, Artificial Sequence
  chemically synthesized
atgtacagatattcaatctt

SEQ ID NO: 116725 - DNA, 20 bp, Artificial Sequence
  chemically synthesized
gatgaaagatacaaattcca

SEQ ID NO: 116726 - DNA, 20 bp, Artificial Sequence
  chemically synthesized
gctaatataaaatttgatga

SEQ ID NO: 116727 - DNA, 20 bp, Artificial Sequence
  chemically synthesized
tctttcatcaaattttatat

SEQ ID NO: 116728 - DNA, 20 bp, Artificial Sequence
  chemically synthesized
aaattttatattagccatga

SEQ ID NO: 116729 - DNA, 20 bp, Artificial Sequence
  chemically synthesized
agtccaccccttcactttca

SEQ ID NO: 116730 - DNA, 20 bp, Artificial Sequence
  chemically synthesized
ttatattagccatgaaagtg

SEQ ID NO: 116731 - DNA, 20 bp, Artificial Sequence
  chemically synthesized
tatattagccatgaaagtga

SEQ ID NO: 116732 - DNA, 20 bp, Artificial Sequence
  chemically synthesized
atattagccatgaaagtgaa

SEQ ID NO: 116733 - DNA, 20 bp, Artificial Sequence
  chemically synthesized
tattagccatgaaagtgaag

SEQ ID NO: 116734 - DNA, 20 bp, Artificial Sequence
  chemically synthesized
tagccatgaaagtgaagggg

SEQ ID NO: 116735 - DNA, 20 bp, Artificial Sequence
  chemically synthesized
gaaggggtggactattttac

SEQ ID NO: 116736 - DNA, 20 bp, Artificial Sequence
  chemically synthesized
aaggggtggactattttact

SEQ ID NO: 116737 - DNA, 20 bp, Artificial Sequence
  chemically synthesized
caatgtgttgcccagtaaaa

SEQ ID NO: 116738 - DNA, 20 bp, Artificial Sequence
  chemically synthesized
gctaaatacaatgtgttgcc

SEQ ID NO: 116739 - DNA, 20 bp, Artificial Sequence
  chemically synthesized
actgggcaacacattgtatt

SEQ ID NO: 116740 - DNA, 20 bp, Artificial Sequence
  chemically synthesized
aacagaaactcagtcattga

SEQ ID NO: 116741 - DNA, 20 bp, Artificial Sequence
  chemically synthesized
gtatttagctgtcaatgact

SEQ ID NO: 116742 - DNA, 20 bp, Artificial Sequence
  chemically synthesized
gtggaagagtaacagaaact

SEQ ID NO: 116743 - DNA, 20 bp, Artificial Sequence
  chemically synthesized
taactttcgtggaagagtaa

SEQ ID NO: 116744 - DNA, 20 bp, Artificial Sequence
  chemically synthesized
aattgttaactttcgtggaa

SEQ ID NO: 116745 - DNA, 20 bp, Artificial Sequence
  chemically synthesized
tttctgttactcttccacga

SEQ ID NO: 116746 - DNA, 20 bp, Artificial Sequence
  chemically synthesized
aaaattgttaactttcgtgg

SEQ ID NO: 116747 - DNA, 20 bp, Artificial Sequence
  chemically synthesized
aaaaaaattgttaactttcg

SEQ ID NO: 116748 - DNA, 20 bp, Artificial Sequence
  chemically synthesized
agacactcattttgaaaatt

SEQ ID NO: 116749 - DNA, 20 bp, Artificial Sequence
  chemically synthesized
tttttctgaattttcaaaat

SEQ ID NO: 116750 - DNA, 20 bp, Artificial Sequence
  chemically synthesized
tattgaaataacattttttg

SEQ ID NO: 116751 - DNA, 20 bp, Artificial Sequence
  chemically synthesized
aatgttatttcaatactttc

SEQ ID NO: 116752 - DNA, 20 bp, Artificial Sequence
  chemically synthesized
atgttatttcaatactttct

SEQ ID NO: 116753 - DNA, 20 bp, Artificial Sequence
  chemically synthesized
atttctttaatacacctaga

SEQ ID NO: 116754 - DNA, 20 bp, Artificial Sequence
  chemically synthesized
gtctatttctttaatacacc

SEQ ID NO: 116755 - DNA, 20 bp, Artificial Sequence
  chemically synthesized
aatactttctaggtgtatta

SEQ ID NO: 116756 - DNA, 20 bp, Artificial Sequence
  chemically synthesized
ttctaggtgtattaaagaaa

SEQ ID NO: 116757 - DNA, 20 bp, Artificial Sequence
  chemically synthesized
aggtgtattaaagaaataga

SEQ ID NO: 116758 - DNA, 20 bp, Artificial Sequence
  chemically synthesized
taacaggttaattttgacag

SEQ ID NO: 116759 - DNA, 20 bp, Artificial Sequence
  chemically synthesized
aaataacaggttaattttga

SEQ ID NO: 116760 - DNA, 20 bp, Artificial Sequence
  chemically synthesized
tcaaaattaacctgttattt

SEQ ID NO: 116761 - DNA, 20 bp, Artificial Sequence
  chemically synthesized
tgaacatttgccaaaataac

SEQ ID NO: 116762 - DNA, 20 bp, Artificial Sequence
  chemically synthesized
ctgaacatttgccaaaataa

SEQ ID NO: 116763 - DNA, 20 bp, Artificial Sequence
  chemically synthesized
ctgttattttggcaaatgtt

SEQ ID NO: 116764 - DNA, 20 bp, Artificial Sequence
  chemically synthesized
caaatgttcagattgcctat

SEQ ID NO: 116765 - DNA, 20 bp, Artificial Sequence
  chemically synthesized
aagaccaggatcaaacttat

SEQ ID NO: 116766 - DNA, 20 bp, Artificial Sequence
  chemically synthesized
gaagaccaggatcaaactta

SEQ ID NO: 116767 - DNA, 20 bp, Artificial Sequence
  chemically synthesized
attgcctataagtttgatcc

SEQ ID NO: 116768 - DNA, 20 bp, Artificial Sequence
  chemically synthesized
ataagtttgatcctggtctt

SEQ ID NO: 116769 - DNA, 20 bp, Artificial Sequence
  chemically synthesized
gtacttgatgtctgaagacc

SEQ ID NO: 116770 - DNA, 20 bp, Artificial Sequence
  chemically synthesized
ggtacttgatgtctgaagac

SEQ ID NO: 116771 - DNA, 20 bp, Artificial Sequence
  chemically synthesized
cttttggtacttgatgtctg

SEQ ID NO: 116772 - DNA, 20 bp, Artificial Sequence
  chemically synthesized
gatcctggtcttcagacatc

SEQ ID NO: 116773 - DNA, 20 bp, Artificial Sequence
  chemically synthesized
cttcagacatcaagtaccaa

SEQ ID NO: 116774 - DNA, 20 bp, Artificial Sequence
  chemically synthesized
gatgcgttttaaggcacttt

SEQ ID NO: 116775 - DNA, 20 bp, Artificial Sequence
  chemically synthesized
tctggacaggatgcgtttta

SEQ ID NO: 116776 - DNA, 20 bp, Artificial Sequence
  chemically synthesized
gtctggacaggatgcgtttt

SEQ ID NO: 116777 - DNA, 20 bp, Artificial Sequence
  chemically synthesized
gccttaaaacgcatcctgtc

SEQ ID NO: 116778 - DNA, 20 bp, Artificial Sequence
  chemically synthesized
agccaaatgggtgtctggac

SEQ ID NO: 116779 - DNA, 20 bp, Artificial Sequence
  chemically synthesized
aagccaaatgggtgtctgga

SEQ ID NO: 116780 - DNA, 20 bp, Artificial Sequence
  chemically synthesized
acagaagccaaatgggtgtc

SEQ ID NO: 116781 - DNA, 20 bp, Artificial Sequence
  chemically synthesized
atcctgtccagacacccatt

SEQ ID NO: 116782 - DNA, 20 bp, Artificial Sequence
  chemically synthesized
ttgggtgacagaagccaaat

SEQ ID NO: 116783 - DNA, 20 bp, Artificial Sequence
  chemically synthesized
tttgggtgacagaagccaaa

SEQ ID NO: 116784 - DNA, 20 bp, Artificial Sequence
  chemically synthesized
aggagtattttgggtgacag

SEQ ID NO: 116785 - DNA, 20 bp, Artificial Sequence
  chemically synthesized
ggcaggagtattttgggtga

SEQ ID NO: 116786 - DNA, 20 bp, Artificial Sequence
  chemically synthesized
agggagggcaggagtatttt

SEQ ID NO: 116787 - DNA, 20 bp, Artificial Sequence
  chemically synthesized
cagggagggcaggagtattt

SEQ ID NO: 116788 - DNA, 20 bp, Artificial Sequence
  chemically synthesized
ataaaaagcagggagggcag

SEQ ID NO: 116789 - DNA, 20 bp, Artificial Sequence
  chemically synthesized
tgataaaaagcagggagggc

SEQ ID NO: 116790 - DNA, 20 bp, Artificial Sequence
  chemically synthesized
gtgataaaaagcagggaggg

SEQ ID NO: 116791 - DNA, 20 bp, Artificial Sequence
  chemically synthesized
tgggtgataaaaagcaggga

SEQ ID NO: 116792 - DNA, 20 bp, Artificial Sequence
  chemically synthesized
atgggtgataaaaagcaggg

SEQ ID NO: 116793 - DNA, 20 bp, Artificial Sequence
  chemically synthesized
tatgggtgataaaaagcagg

SEQ ID NO: 116794 - DNA, 20 bp, Artificial Sequence
  chemically synthesized
cttatgggtgataaaaagca

SEQ ID NO: 116795 - DNA, 20 bp, Artificial Sequence
  chemically synthesized
acttatgggtgataaaaagc

SEQ ID NO: 116796 - DNA, 20 bp, Artificial Sequence
  chemically synthesized
aacttatgggtgataaaaag

SEQ ID NO: 116797 - DNA, 20 bp, Artificial Sequence
  chemically synthesized
tcaaacttatgggtgataaa

SEQ ID NO: 116798 - DNA, 20 bp, Artificial Sequence
  chemically synthesized
ccctgctttttatcacccat

SEQ ID NO: 116799 - DNA, 20 bp, Artificial Sequence
  chemically synthesized
aggaggcccatcaaacttat

SEQ ID NO: 116800 - DNA, 20 bp, Artificial Sequence
  chemically synthesized
gaggaggcccatcaaactta

SEQ ID NO: 116801 - DNA, 20 bp, Artificial Sequence
  chemically synthesized
tttatcacccataagtttga

SEQ ID NO: 116802 - DNA, 20 bp, Artificial Sequence
  chemically synthesized
ttatcacccataagtttgat

SEQ ID NO: 116803 - DNA, 20 bp, Artificial Sequence
  chemically synthesized
tgagtagaactacagagagg

SEQ ID NO: 116804 - DNA, 20 bp, Artificial Sequence
  chemically synthesized
tttgatgggcctcctctctg

SEQ ID NO: 116805 - DNA, 20 bp, Artificial Sequence
  chemically synthesized
atgagtagaactacagagag

SEQ ID NO: 116806 - DNA, 20 bp, Artificial Sequence
  chemically synthesized
acatgagtagaactacagag

SEQ ID NO: 116807 - DNA, 20 bp, Artificial Sequence
  chemically synthesized
aacatgagtagaactacaga

SEQ ID NO: 116808 - DNA, 20 bp, Artificial Sequence
  chemically synthesized
agaacatgagtagaactaca

SEQ ID NO: 116809 - DNA, 20 bp, Artificial Sequence
  chemically synthesized
acagaacatgagtagaacta

SEQ ID NO: 116810 - DNA, 20 bp, Artificial Sequence
  chemically synthesized
tgtttttgacagaacatgag

SEQ ID NO: 116811 - DNA, 20 bp, Artificial Sequence
  chemically synthesized
ggatgtttttgacagaacat

SEQ ID NO: 116812 - DNA, 20 bp, Artificial Sequence
  chemically synthesized
gacacactggatgtttttga

SEQ ID NO: 116813 - DNA, 20 bp, Artificial Sequence
  chemically synthesized
catgttctgtcaaaaacatc

SEQ ID NO: 116814 - DNA, 20 bp, Artificial Sequence
  chemically synthesized
gtcaaaaacatccagtgtgt

SEQ ID NO: 116815 - DNA, 20 bp, Artificial Sequence
  chemically synthesized
tcaaaaacatccagtgtgtc

SEQ ID NO: 116816 - DNA, 20 bp, Artificial Sequence
  chemically synthesized
tgttctcaaccctgacacac

SEQ ID NO: 116817 - DNA, 20 bp, Artificial Sequence
  chemically synthesized
caaaaacatccagtgtgtca

SEQ ID NO: 116818 - DNA, 20 bp, Artificial Sequence
  chemically synthesized
acatccagtgtgtcagggtt

SEQ ID NO: 116819 - DNA, 20 bp, Artificial Sequence
  chemically synthesized
cagtgtgtcagggttgagaa

SEQ ID NO: 116820 - DNA, 20 bp, Artificial Sequence
  chemically synthesized
tgtgtcagggttgagaacag

SEQ ID NO: 116821 - DNA, 20 bp, Artificial Sequence
  chemically synthesized
gagaacagaagcttgtgaca

SEQ ID NO: 116822 - DNA, 20 bp, Artificial Sequence
  chemically synthesized
gatctctggtgctatgtcac

SEQ ID NO: 116823 - DNA, 20 bp, Artificial Sequence
  chemically synthesized
agaagcttgtgacatagcac

SEQ ID NO: 116824 - DNA, 20 bp, Artificial Sequence
  chemically synthesized
aagcttgtgacatagcacca

SEQ ID NO: 116825 - DNA, 20 bp, Artificial Sequence
  chemically synthesized
aggtggtgatggaagatctc

SEQ ID NO: 116826 - DNA, 20 bp, Artificial Sequence
  chemically synthesized
ccagtgtcaggtggtgatgg

SEQ ID NO: 116827 - DNA, 20 bp, Artificial Sequence
  chemically synthesized
agaccagtgtcaggtggtga

SEQ ID NO: 116828 - DNA, 20 bp, Artificial Sequence
  chemically synthesized
attaatagaccagtgtcagg

SEQ ID NO: 116829 - DNA, 20 bp, Artificial Sequence
  chemically synthesized
cttccatcaccacctgacac

SEQ ID NO: 116830 - DNA, 20 bp, Artificial Sequence
  chemically synthesized
tcgattaatagaccagtgtc

SEQ ID NO: 116831 - DNA, 20 bp, Artificial Sequence
  chemically synthesized
gtcgattaatagaccagtgt

SEQ ID NO: 116832 - DNA, 20 bp, Artificial Sequence
  chemically synthesized
aaggatgtcgattaatagac

SEQ ID NO: 116833 - DNA, 20 bp, Artificial Sequence
  chemically synthesized
acgcaaaggatgtcgattaa

SEQ ID NO: 116834 - DNA, 20 bp, Artificial Sequence
  chemically synthesized
cacttcatgattttacgcaa

SEQ ID NO: 116835 - DNA, 20 bp, Artificial Sequence
  chemically synthesized
ccacttcatgattttacgca

SEQ ID NO: 116836 - DNA, 20 bp, Artificial Sequence
  chemically synthesized
atcctttgcgtaaaatcatg

SEQ ID NO: 116837 - DNA, 20 bp, Artificial Sequence
  chemically synthesized
ctttgcgtaaaatcatgaag

SEQ ID NO: 116838 - DNA, 20 bp, Artificial Sequence
  chemically synthesized
aaaatcatgaagtggcttct

SEQ ID NO: 116839 - DNA, 20 bp, Artificial Sequence
  chemically synthesized
agataaattggatggcttag

SEQ ID NO: 116840 - DNA, 20 bp, Artificial Sequence
  chemically synthesized
gcaagataaattggatggct

SEQ ID NO: 116841 - DNA, 20 bp, Artificial Sequence
  chemically synthesized
tagatgcaagataaattgga

SEQ ID NO: 116842 - DNA, 20 bp, Artificial Sequence
  chemically synthesized
tggctagatgcaagataaat

SEQ ID NO: 116843 - DNA, 20 bp, Artificial Sequence
  chemically synthesized
catccaatttatcttgcatc

SEQ ID NO: 116844 - DNA, 20 bp, Artificial Sequence
  chemically synthesized
gagaaatactggctagatgc

SEQ ID NO: 116845 - DNA, 20 bp, Artificial Sequence
  chemically synthesized
caatttatcttgcatctagc

SEQ ID NO: 116846 - DNA, 20 bp, Artificial Sequence
  chemically synthesized
taagttggagaaatactggc

SEQ ID NO: 116847 - DNA, 20 bp, Artificial Sequence
  chemically synthesized
tgaataagttggagaaatac

SEQ ID NO: 116848 - DNA, 20 bp, Artificial Sequence
  chemically synthesized
atactcttgtgaataagttg

SEQ ID NO: 116849 - DNA, 20 bp, Artificial Sequence
  chemically synthesized
ttatactcttgtgaataagt

SEQ ID NO: 116850 - DNA, 20 bp, Artificial Sequence
  chemically synthesized
tatttctccaacttattcac

SEQ ID NO: 116851 - DNA, 20 bp, Artificial Sequence
  chemically synthesized
ttcgttatactcttgtgaat

SEQ ID NO: 116852 - DNA, 20 bp, Artificial Sequence
  chemically synthesized
tttctccaacttattcacaa

SEQ ID NO: 116853 - DNA, 20 bp, Artificial Sequence
  chemically synthesized
tattcacaagagtataacga

SEQ ID NO: 116854 - DNA, 20 bp, Artificial Sequence
  chemically synthesized
tttcatctgggcatttgaca

SEQ ID NO: 116855 - DNA, 20 bp, Artificial Sequence
  chemically synthesized
gaaagactttgtcaaatgcc

SEQ ID NO: 116856 - DNA, 20 bp, Artificial Sequence
  chemically synthesized
agtctatttgcatttcatct

SEQ ID NO: 116857 - DNA, 20 bp, Artificial Sequence
  chemically synthesized
cagtctatttgcatttcatc

SEQ ID NO: 116858 - DNA, 20 bp, Artificial Sequence
  chemically synthesized
atgcccagatgaaatgcaaa

SEQ ID NO: 116859 - DNA, 20 bp, Artificial Sequence
  chemically synthesized
agtaggtaagtaaaatgcag

SEQ ID NO: 116860 - DNA, 20 bp, Artificial Sequence
  chemically synthesized
acaagtaggtaagtaaaatg

SEQ ID NO: 116861 - DNA, 20 bp, Artificial Sequence
  chemically synthesized
aaacttttagacaagtaggt

SEQ ID NO: 116862 - DNA, 20 bp, Artificial Sequence
  chemically synthesized
tgaaaaacttttagacaagt

SEQ ID NO: 116863 - DNA, 20 bp, Artificial Sequence
  chemically synthesized
atgaaaaacttttagacaag

SEQ ID NO: 116864 - DNA, 20 bp, Artificial Sequence
  chemically synthesized
ttacttacctacttgtctaa

SEQ ID NO: 116865 - DNA, 20 bp, Artificial Sequence
  chemically synthesized
acaatgaaaaacttttagac

SEQ ID NO: 116866 - DNA, 20 bp, Artificial Sequence
  chemically synthesized
gttttacaatgaaaaacttt

SEQ ID NO: 116867 - DNA, 20 bp, Artificial Sequence
  chemically synthesized
attattttatctcaataatt

SEQ ID NO: 116868 - DNA, 20 bp, Artificial Sequence
  chemically synthesized
tccctattgtctaaattatt

SEQ ID NO: 116869 - DNA, 20 bp, Artificial Sequence
  chemically synthesized
tatctcaataatttagacaa

SEQ ID NO: 116870 - DNA, 20 bp, Artificial Sequence
  chemically synthesized
atctcaataatttagacaat

SEQ ID NO: 116871 - DNA, 20 bp, Artificial Sequence
  chemically synthesized
tctcaataatttagacaata

SEQ ID NO: 116872 - DNA, 20 bp, Artificial Sequence
  chemically synthesized
tagggatttatccctgtatg

SEQ ID NO: 116873 - DNA, 20 bp, Artificial Sequence
  chemically synthesized
agggatttatccctgtatgc

SEQ ID NO: 116874 - DNA, 20 bp, Artificial Sequence
  chemically synthesized
cacagatatacctgcataca

SEQ ID NO: 116875 - DNA, 20 bp, Artificial Sequence
  chemically synthesized
acacagatatacctgcatac

SEQ ID NO: 116876 - DNA, 20 bp, Artificial Sequence
  chemically synthesized
aacacagatatacctgcata

SEQ ID NO: 116877 - DNA, 20 bp, Artificial Sequence
  chemically synthesized
gctaatttagtaaaacaaca

SEQ ID NO: 116878 - DNA, 20 bp, Artificial Sequence
  chemically synthesized
tctgtgttgttttactaaat

SEQ ID NO: 116879 - DNA, 20 bp, Artificial Sequence
  chemically synthesized
attgaagagattagctaatt

SEQ ID NO: 116880 - DNA, 20 bp, Artificial Sequence
  chemically synthesized
aacccatttattgaagagat

SEQ ID NO: 116881 - DNA, 20 bp, Artificial Sequence
  chemically synthesized
atatgaacccatttattgaa

SEQ ID NO: 116882 - DNA, 20 bp, Artificial Sequence
  chemically synthesized
tagctaatctcttcaataaa

SEQ ID NO: 116883 - DNA, 20 bp, Artificial Sequence
  chemically synthesized
aaatatgaacccatttattg

SEQ ID NO: 116884 - DNA, 20 bp, Artificial Sequence
  chemically synthesized
agctaatctcttcaataaat

SEQ ID NO: 116885 - DNA, 20 bp, Artificial Sequence
  chemically synthesized
atgggttcatatttctctta

SEQ ID NO: 116886 - DNA, 20 bp, Artificial Sequence
  chemically synthesized
aacttacgtggaggctataa

SEQ ID NO: 116887 - DNA, 20 bp, Artificial Sequence
  chemically synthesized
gcaacttacgtggaggctat

SEQ ID NO: 116888 - DNA, 20 bp, Artificial Sequence
  chemically synthesized
ttctcttatagcctccacgt

SEQ ID NO: 116889 - DNA, 20 bp, Artificial Sequence
  chemically synthesized
gctaaatgcaacttacgtgg

SEQ ID NO: 116890 - DNA, 20 bp, Artificial Sequence
  chemically synthesized
tgctaaatgcaacttacgtg

SEQ ID NO: 116891 - DNA, 20 bp, Artificial Sequence
  chemically synthesized
aatgctaaatgcaacttacg

SEQ ID NO: 116892 - DNA, 20 bp, Artificial Sequence
  chemically synthesized
gcctccacgtaagttgcatt

SEQ ID NO: 116893 - DNA, 20 bp, Artificial Sequence
  chemically synthesized
atttagcattttaaatgtct

SEQ ID NO: 116894 - DNA, 20 bp, Artificial Sequence
  chemically synthesized
agcattttaaatgtcttgga

SEQ ID NO: 116895 - DNA, 20 bp, Artificial Sequence
  chemically synthesized
agatattattgtagctgtcc

SEQ ID NO: 116896 - DNA, 20 bp, Artificial Sequence
  chemically synthesized
aattataagagatattattg

SEQ ID NO: 116897 - DNA, 20 bp, Artificial Sequence
  chemically synthesized
attttatgtaaaaattataa

SEQ ID NO: 116898 - DNA, 20 bp, Artificial Sequence
  chemically synthesized
gaattttatgtaaaaattat

SEQ ID NO: 116899 - DNA, 20 bp, Artificial Sequence
  chemically synthesized
taaccagttgttgataaatg

SEQ ID NO: 116900 - DNA, 20 bp, Artificial Sequence
  chemically synthesized
caactgcatttatcaacaac

SEQ ID NO: 116901 - DNA, 20 bp, Artificial Sequence
  chemically synthesized
tgcatttatcaacaactggt

SEQ ID NO: 116902 - DNA, 20 bp, Artificial Sequence
  chemically synthesized
gcatttatcaacaactggtt

SEQ ID NO: 116903 - DNA, 20 bp, Artificial Sequence
  chemically synthesized
catttatcaacaactggtta

SEQ ID NO: 116904 - DNA, 20 bp, Artificial Sequence
  chemically synthesized
atttatcaacaactggttag

SEQ ID NO: 116905 - DNA, 20 bp, Artificial Sequence
  chemically synthesized
tttatcaacaactggttagg

SEQ ID NO: 116906 - DNA, 20 bp, Artificial Sequence
  chemically synthesized
tatatcaatcgccccctaac

SEQ ID NO: 116907 - DNA, 20 bp, Artificial Sequence
  chemically synthesized
tggttagggggcgattgata

SEQ ID NO: 116908 - DNA, 20 bp, Artificial Sequence
  chemically synthesized
ggcgattgatatagctatgt

SEQ ID NO: 116909 - DNA, 20 bp, Artificial Sequence
  chemically synthesized
gcgattgatatagctatgtg

SEQ ID NO: 116910 - DNA, 20 bp, Artificial Sequence
  chemically synthesized
cgattgatatagctatgtga

SEQ ID NO: 116911 - DNA, 20 bp, Artificial Sequence
  chemically synthesized
gattgatatagctatgtgag

SEQ ID NO: 116912 - DNA, 20 bp, Artificial Sequence
  chemically synthesized
ctattctccttcccctcaca

SEQ ID NO: 116913 - DNA, 20 bp, Artificial Sequence
  chemically synthesized
tgatatagctatgtgagggg

SEQ ID NO: 116914 - DNA, 20 bp, Artificial Sequence
  chemically synthesized
gatatagctatgtgagggga

SEQ ID NO: 116915 - DNA, 20 bp, Artificial Sequence
  chemically synthesized
tatagctatgtgaggggaag

SEQ ID NO: 116916 - DNA, 20 bp, Artificial Sequence
  chemically synthesized
ctatgtgaggggaaggagaa

SEQ ID NO: 116917 - DNA, 20 bp, Artificial Sequence
  chemically synthesized
tgaggggaaggagaatagat

SEQ ID NO: 116918 - DNA, 20 bp, Artificial Sequence
  chemically synthesized
gcatgatctctataaaaggg

SEQ ID NO: 116919 - DNA, 20 bp, Artificial Sequence
  chemically synthesized
gtgttatcaccaccctttta

SEQ ID NO: 116920 - DNA, 20 bp, Artificial Sequence
  chemically synthesized
gttatcaccacccttttata

SEQ ID NO: 116921 - DNA, 20 bp, Artificial Sequence
  chemically synthesized
atggcatgatctctataaaa

SEQ ID NO: 116922 - DNA, 20 bp, Artificial Sequence
  chemically synthesized
aatggcatgatctctataaa

SEQ ID NO: 116923 - DNA, 20 bp, Artificial Sequence
  chemically synthesized
gaatggcatgatctctataa

SEQ ID NO: 116924 - DNA, 20 bp, Artificial Sequence
  chemically synthesized
ttatagagatcatgccattc

SEQ ID NO: 116925 - DNA, 20 bp, Artificial Sequence
  chemically synthesized
tagagatcatgccattcaag

SEQ ID NO: 116926 - DNA, 20 bp, Artificial Sequence
  chemically synthesized
atctattttcaccacttgaa

SEQ ID NO: 116927 - DNA, 20 bp, Artificial Sequence
  chemically synthesized
tgccattcaagtggtgaaaa

SEQ ID NO: 116928 - DNA, 20 bp, Artificial Sequence
  chemically synthesized
gtgaaaatagattataattg

SEQ ID NO: 116929 - DNA, 20 bp, Artificial Sequence
  chemically synthesized
tataattgcagtgataatca

SEQ ID NO: 116930 - DNA, 20 bp, Artificial Sequence
  chemically synthesized
tgataatcacagaattgtaa

SEQ ID NO: 116931 - DNA, 20 bp, Artificial Sequence
  chemically synthesized
atcacagaattgtaaaagac

SEQ ID NO: 116932 - DNA, 20 bp, Artificial Sequence
  chemically synthesized
tcacagaattgtaaaagact

SEQ ID NO: 116933 - DNA, 20 bp, Artificial Sequence
  chemically synthesized
agaattgtaaaagactgggc

SEQ ID NO: 116934 - DNA, 20 bp, Artificial Sequence
  chemically synthesized
acctgccagattgtctagcc

SEQ ID NO: 116935 - DNA, 20 bp, Artificial Sequence
  chemically synthesized
aaagactgggctagacaatc

SEQ ID NO: 116936 - DNA, 20 bp, Artificial Sequence
  chemically synthesized
ttcagacctgccagattgtc

SEQ ID NO: 116937 - DNA, 20 bp, Artificial Sequence
  chemically synthesized
gactgggctagacaatctgg

SEQ ID NO: 116938 - DNA, 20 bp, Artificial Sequence
  chemically synthesized
actgggctagacaatctggc

SEQ ID NO: 116939 - DNA, 20 bp, Artificial Sequence
  chemically synthesized
aattaccatttcagacctgc

SEQ ID NO: 116940 - DNA, 20 bp, Artificial Sequence
  chemically synthesized
acaatctggcaggtctgaaa

SEQ ID NO: 116941 - DNA, 20 bp, Artificial Sequence
  chemically synthesized
actaaatgaaattaccattt

SEQ ID NO: 116942 - DNA, 20 bp, Artificial Sequence
  chemically synthesized
tctgaaatggtaatttcatt

SEQ ID NO: 116943 - DNA, 20 bp, Artificial Sequence
  chemically synthesized
ttcatttagtcttgtaaaaa

SEQ ID NO: 116944 - DNA, 20 bp, Artificial Sequence
  chemically synthesized
gatacagttgccatttttac

SEQ ID NO: 116945 - DNA, 20 bp, Artificial Sequence
  chemically synthesized
aaaatggcaactgtatcact

SEQ ID NO: 116946 - DNA, 20 bp, Artificial Sequence
  chemically synthesized
taacctatttctgagtgata

SEQ ID NO: 116947 - DNA, 20 bp, Artificial Sequence
  chemically synthesized
gcaactgtatcactcagaaa

SEQ ID NO: 116948 - DNA, 20 bp, Artificial Sequence
  chemically synthesized
caactgtatcactcagaaat

SEQ ID NO: 116949 - DNA, 20 bp, Artificial Sequence
  chemically synthesized
ggagcacctaacctatttct

SEQ ID NO: 116950 - DNA, 20 bp, Artificial Sequence
  chemically synthesized
tgtatcactcagaaataggt

SEQ ID NO: 116951 - DNA, 20 bp, Artificial Sequence
  chemically synthesized
gtatcactcagaaataggtt

SEQ ID NO: 116952 - DNA, 20 bp, Artificial Sequence
  chemically synthesized
atgaaatagcagtattttcg

SEQ ID NO: 116953 - DNA, 20 bp, Artificial Sequence
  chemically synthesized
taatgaaatagcagtatttt

SEQ ID NO: 116954 - DNA, 20 bp, Artificial Sequence
  chemically synthesized
tttgtgaattaatgaaatag

SEQ ID NO: 116955 - DNA, 20 bp, Artificial Sequence
  chemically synthesized
tgatttgtgaattaatgaaa

SEQ ID NO: 116956 - DNA, 20 bp, Artificial Sequence
  chemically synthesized
tatttcattaattcacaaat

SEQ ID NO: 116957 - DNA, 20 bp, Artificial Sequence
  chemically synthesized
ttcacaaatcagtatttgtc

SEQ ID NO: 116958 - DNA, 20 bp, Artificial Sequence
  chemically synthesized
caaatcagtatttgtctgga

SEQ ID NO: 116959 - DNA, 20 bp, Artificial Sequence
  chemically synthesized
aatttggttaaatatctttc

SEQ ID NO: 116960 - DNA, 20 bp, Artificial Sequence
  chemically synthesized
agatatttaaccaaattata

SEQ ID NO: 116961 - DNA, 20 bp, Artificial Sequence
  chemically synthesized
tttttgtggtctgtataatt

SEQ ID NO: 116962 - DNA, 20 bp, Artificial Sequence
  chemically synthesized
attatacagaccacaaaaaa

SEQ ID NO: 116963 - DNA, 20 bp, Artificial Sequence
  chemically synthesized
taggatgcctcttttttttg

SEQ ID NO: 116964 - DNA, 20 bp, Artificial Sequence
  chemically synthesized
tatacagaccacaaaaaaaa

SEQ ID NO: 116965 - DNA, 20 bp, Artificial Sequence
  chemically synthesized
atacagaccacaaaaaaaag

SEQ ID NO: 116966 - DNA, 20 bp, Artificial Sequence
  chemically synthesized
cacaaaaaaaagaggcatcc

SEQ ID NO: 116967 - DNA, 20 bp, Artificial Sequence
  chemically synthesized
aaagaggcatcctagaaatt

SEQ ID NO: 116968 - DNA, 20 bp, Artificial Sequence
  chemically synthesized
aatgtcctccctcaatttct

SEQ ID NO: 116969 - DNA, 20 bp, Artificial Sequence
  chemically synthesized
aagaggcatcctagaaattg

SEQ ID NO: 116970 - DNA, 20 bp, Artificial Sequence
  chemically synthesized
aaatgtcctccctcaatttc

SEQ ID NO: 116971 - DNA, 20 bp, Artificial Sequence
  chemically synthesized
agaggcatcctagaaattga

SEQ ID NO: 116972 - DNA, 20 bp, Artificial Sequence
  chemically synthesized
aggcatcctagaaattgagg

SEQ ID NO: 116973 - DNA, 20 bp, Artificial Sequence
  chemically synthesized
ggcatcctagaaattgaggg

SEQ ID NO: 116974 - DNA, 20 bp, Artificial Sequence
  chemically synthesized
gggaggacatttgactatca

SEQ ID NO: 116975 - DNA, 20 bp, Artificial Sequence
  chemically synthesized
acactcttcaatcactgtga

SEQ ID NO: 116976 - DNA, 20 bp, Artificial Sequence
  chemically synthesized
tttgactatcacagtgattg

SEQ ID NO: 116977 - DNA, 20 bp, Artificial Sequence
  chemically synthesized
tgactatcacagtgattgaa

SEQ ID NO: 116978 - DNA, 20 bp, Artificial Sequence
  chemically synthesized
attgaagagtgttactataa

SEQ ID NO: 116979 - DNA, 20 bp, Artificial Sequence
  chemically synthesized
ctctccacagaatgctatta

SEQ ID NO: 116980 - DNA, 20 bp, Artificial Sequence
  chemically synthesized
gttactataatagcattctg

SEQ ID NO: 116981 - DNA, 20 bp, Artificial Sequence
  chemically synthesized
tactataatagcattctgtg

SEQ ID NO: 116982 - DNA, 20 bp, Artificial Sequence
  chemically synthesized
ctataatagcattctgtgga

SEQ ID NO: 116983 - DNA, 20 bp, Artificial Sequence
  chemically synthesized
tataatagcattctgtggag

SEQ ID NO: 116984 - DNA, 20 bp, Artificial Sequence
  chemically synthesized
ataatagcattctgtggaga

SEQ ID NO: 116985 - DNA, 20 bp, Artificial Sequence
  chemically synthesized
ccatcttcattccctctcca

SEQ ID NO: 116986 - DNA, 20 bp, Artificial Sequence
  chemically synthesized
cattctgtggagagggaatg

SEQ ID NO: 116987 - DNA, 20 bp, Artificial Sequence
  chemically synthesized
ctgtggagagggaatgaaga

SEQ ID NO: 116988 - DNA, 20 bp, Artificial Sequence
  chemically synthesized
tggagagggaatgaagatgg

SEQ ID NO: 116989 - DNA, 20 bp, Artificial Sequence
  chemically synthesized
agagttctttgttgtataag

SEQ ID NO: 116990 - DNA, 20 bp, Artificial Sequence
  chemically synthesized
gggagagttctttgttgtat

SEQ ID NO: 116991 - DNA, 20 bp, Artificial Sequence
  chemically synthesized
ggtagacttcttatacaaca

SEQ ID NO: 116992 - DNA, 20 bp, Artificial Sequence
  chemically synthesized
atacaacaaagaactctccc

SEQ ID NO: 116993 - DNA, 20 bp, Artificial Sequence
  chemically synthesized
aagtgctgtcagacttggga

SEQ ID NO: 116994 - DNA, 20 bp, Artificial Sequence
  chemically synthesized
caaagtgctgtcagacttgg

SEQ ID NO: 116995 - DNA, 20 bp, Artificial Sequence
  chemically synthesized
tccaaagtgctgtcagactt

SEQ ID NO: 116996 - DNA, 20 bp, Artificial Sequence
  chemically synthesized
aagaactctcccaagtctga

SEQ ID NO: 116997 - DNA, 20 bp, Artificial Sequence
  chemically synthesized
ttccaaagtgctgtcagact

SEQ ID NO: 116998 - DNA, 20 bp, Artificial Sequence
  chemically synthesized
gggatattccaaagtgctgt

SEQ ID NO: 116999 - DNA, 20 bp, Artificial Sequence
  chemically synthesized
tcccaagtctgacagcactt

SEQ ID NO: 117000 - DNA, 20 bp, Artificial Sequence
  chemically synthesized
atgtccagtgggatattcca

SEQ ID NO: 117001 - DNA, 20 bp, Artificial Sequence
  chemically synthesized
agcactttggaatatcccac

SEQ ID NO: 117002 - DNA, 20 bp, Artificial Sequence
  chemically synthesized
cacatacatgcatgtccagt

SEQ ID NO: 117003 - DNA, 20 bp, Artificial Sequence
  chemically synthesized
ccacatacatgcatgtccag

SEQ ID NO: 117004 - DNA, 20 bp, Artificial Sequence
  chemically synthesized
tttccacatacatgcatgtc

SEQ ID NO: 117005 - DNA, 20 bp, Artificial Sequence
  chemically synthesized
ccactggacatgcatgtatg

SEQ ID NO: 117006 - DNA, 20 bp, Artificial Sequence
  chemically synthesized
ggtttaggtgtttataaaca

SEQ ID NO: 117007 - DNA, 20 bp, Artificial Sequence
  chemically synthesized
aggtttaggtgtttataaac

SEQ ID NO: 117008 - DNA, 20 bp, Artificial Sequence
  chemically synthesized
caggtttaggtgtttataaa

SEQ ID NO: 117009 - DNA, 20 bp, Artificial Sequence
  chemically synthesized
tgtttataaacacctaaacc

SEQ ID NO: 117010 - DNA, 20 bp, Artificial Sequence
  chemically synthesized
ttgagttacgttccaggttt

SEQ ID NO: 117011 - DNA, 20 bp, Artificial Sequence
  chemically synthesized
attgagttacgttccaggtt

SEQ ID NO: 117012 - DNA, 20 bp, Artificial Sequence
  chemically synthesized
gtaaaattgagttacgttcc

SEQ ID NO: 117013 - DNA, 20 bp, Artificial Sequence
  chemically synthesized
tgtaaaattgagttacgttc

SEQ ID NO: 117014 - DNA, 20 bp, Artificial Sequence
  chemically synthesized
ttatgtttacgtgtaaaatt

SEQ ID NO: 117015 - DNA, 20 bp, Artificial Sequence
  chemically synthesized
tcaattttacacgtaaacat

SEQ ID NO: 117016 - DNA, 20 bp, Artificial Sequence
  chemically synthesized
ttcaatgtcttaaaatcatg

SEQ ID NO: 117017 - DNA, 20 bp, Artificial Sequence
  chemically synthesized
attcaatgtcttaaaatcat

SEQ ID NO: 117018 - DNA, 20 bp, Artificial Sequence
  chemically synthesized
gatattttcctcatgatttt

SEQ ID NO: 117019 - DNA, 20 bp, Artificial Sequence
  chemically synthesized
ttttaagacattgaattttt

SEQ ID NO: 117020 - DNA, 20 bp, Artificial Sequence
  chemically synthesized
cgttatggcagttagttgca

SEQ ID NO: 117021 - DNA, 20 bp, Artificial Sequence
  chemically synthesized
tcttggatcgttatggcagt

SEQ ID NO: 117022 - DNA, 20 bp, Artificial Sequence
  chemically synthesized
tttttcttggatcgttatgg

SEQ ID NO: 117023 - DNA, 20 bp, Artificial Sequence
  chemically synthesized
aattttttcttggatcgtta

SEQ ID NO: 117024 - DNA, 20 bp, Artificial Sequence
  chemically synthesized
actaactgccataacgatcc

SEQ ID NO: 117025 - DNA, 20 bp, Artificial Sequence
  chemically synthesized
ccatgaaataaattttttct

SEQ ID NO: 117026 - DNA, 20 bp, Artificial Sequence
  chemically synthesized
ccaagaaaaaatttatttca

SEQ ID NO: 117027 - DNA, 20 bp, Artificial Sequence
  chemically synthesized
aaaaatttatttcatggtgt

SEQ ID NO: 117028 - DNA, 20 bp, Artificial Sequence
  chemically synthesized
aaaatttatttcatggtgtt

SEQ ID NO: 117029 - DNA, 20 bp, Artificial Sequence
  chemically synthesized
atggtgttaggaattttgcc

SEQ ID NO: 117030 - DNA, 20 bp, Artificial Sequence
  chemically synthesized
ggtgttaggaattttgccaa

SEQ ID NO: 117031 - DNA, 20 bp, Artificial Sequence
  chemically synthesized
ccaaaatgctgaacaactct

SEQ ID NO: 117032 - DNA, 20 bp, Artificial Sequence
  chemically synthesized
gaattttgccaagagttgtt

SEQ ID NO: 117033 - DNA, 20 bp, Artificial Sequence
  chemically synthesized
ccaagagttgttcagcattt

SEQ ID NO: 117034 - DNA, 20 bp, Artificial Sequence
  chemically synthesized
cattttggaaaattacgcta

SEQ ID NO: 117035 - DNA, 20 bp, Artificial Sequence
  chemically synthesized
tgaggggcattggtcatcca

SEQ ID NO: 117036 - DNA, 20 bp, Artificial Sequence
  chemically synthesized
tcaaataccatgaggggcat

SEQ ID NO: 117037 - DNA, 20 bp, Artificial Sequence
  chemically synthesized
tggatgaccaatgcccctca

SEQ ID NO: 117038 - DNA, 20 bp, Artificial Sequence
  chemically synthesized
ggagactcaaataccatgag

SEQ ID NO: 117039 - DNA, 20 bp, Artificial Sequence
  chemically synthesized
tggagactcaaataccatga

SEQ ID NO: 117040 - DNA, 20 bp, Artificial Sequence
  chemically synthesized
atggagactcaaataccatg

SEQ ID NO: 117041 - DNA, 20 bp, Artificial Sequence
  chemically synthesized
tatggagactcaaataccat

SEQ ID NO: 117042 - DNA, 20 bp, Artificial Sequence
  chemically synthesized
caatgcccctcatggtattt

SEQ ID NO: 117043 - DNA, 20 bp, Artificial Sequence
  chemically synthesized
tgacaccattgtgttgtatg

SEQ ID NO: 117044 - DNA, 20 bp, Artificial Sequence
  chemically synthesized
aatgacaccattgtgttgta

SEQ ID NO: 117045 - DNA, 20 bp, Artificial Sequence
  chemically synthesized
tgagtctccatacaacacaa

SEQ ID NO: 117046 - DNA, 20 bp, Artificial Sequence
  chemically synthesized
caatgcagtataaacaaatg

SEQ ID NO: 117047 - DNA, 20 bp, Artificial Sequence
  chemically synthesized
atttgtttatactgcattga

SEQ ID NO: 117048 - DNA, 20 bp, Artificial Sequence
  chemically synthesized
agatcacgagactatcaatg

SEQ ID NO: 117049 - DNA, 20 bp, Artificial Sequence
  chemically synthesized
aagtgaagtttttagatcac

SEQ ID NO: 117050 - DNA, 20 bp, Artificial Sequence
  chemically synthesized
tggaacacaagtgaagtttt

SEQ ID NO: 117051 - DNA, 20 bp, Artificial Sequence
  chemically synthesized
atcacactggaacacaagtg

SEQ ID NO: 117052 - DNA, 20 bp, Artificial Sequence
  chemically synthesized
taaaaacttcacttgtgttc

SEQ ID NO: 117053 - DNA, 20 bp, Artificial Sequence
  chemically synthesized
gcaggatcacactggaacac

SEQ ID NO: 117054 - DNA, 20 bp, Artificial Sequence
  chemically synthesized
ttattcaggcaggatcacac

SEQ ID NO: 117055 - DNA, 20 bp, Artificial Sequence
  chemically synthesized
tagtatgcagttattcaggc

SEQ ID NO: 117056 - DNA, 20 bp, Artificial Sequence
  chemically synthesized
gtagtatgcagttattcagg

SEQ ID NO: 117057 - DNA, 20 bp, Artificial Sequence
  chemically synthesized
gttgtagtatgcagttattc

SEQ ID NO: 117058 - DNA, 20 bp, Artificial Sequence
  chemically synthesized
tgttgtagtatgcagttatt

SEQ ID NO: 117059 - DNA, 20 bp, Artificial Sequence
  chemically synthesized
ataatatgtgttgtagtatg

SEQ ID NO: 117060 - DNA, 20 bp, Artificial Sequence
  chemically synthesized
taataaaataatatgtgttg

SEQ ID NO: 117061 - DNA, 20 bp, Artificial Sequence
  chemically synthesized
tctattttaaagagaaataa

SEQ ID NO: 117062 - DNA, 20 bp, Artificial Sequence
  chemically synthesized
actctattttaaagagaaat

SEQ ID NO: 117063 - DNA, 20 bp, Artificial Sequence
  chemically synthesized
actcttatttctctttaaaa

SEQ ID NO: 117064 - DNA, 20 bp, Artificial Sequence
  chemically synthesized
tgccgtaactctattttaaa

SEQ ID NO: 117065 - DNA, 20 bp, Artificial Sequence
  chemically synthesized
tcttatttctctttaaaata

SEQ ID NO: 117066 - DNA, 20 bp, Artificial Sequence
  chemically synthesized
gatgccgtaactctatttta

SEQ ID NO: 117067 - DNA, 20 bp, Artificial Sequence
  chemically synthesized
ttctctttaaaatagagtta

SEQ ID NO: 117068 - DNA, 20 bp, Artificial Sequence
  chemically synthesized
taccctacttatacaggcaa

SEQ ID NO: 117069 - DNA, 20 bp, Artificial Sequence
  chemically synthesized
atttaaactattgcctgtat

SEQ ID NO: 117070 - DNA, 20 bp, Artificial Sequence
  chemically synthesized
taaactattgcctgtataag

SEQ ID NO: 117071 - DNA, 20 bp, Artificial Sequence
  chemically synthesized
acaacataccctacttatac

SEQ ID NO: 117072 - DNA, 20 bp, Artificial Sequence
  chemically synthesized
aaactattgcctgtataagt

SEQ ID NO: 117073 - DNA, 20 bp, Artificial Sequence
  chemically synthesized
gacaacataccctacttata

SEQ ID NO: 117074 - DNA, 20 bp, Artificial Sequence
  chemically synthesized
aactattgcctgtataagta

SEQ ID NO: 117075 - DNA, 20 bp, Artificial Sequence
  chemically synthesized
ggtatgttgtctacatattt

SEQ ID NO: 117076 - DNA, 20 bp, Artificial Sequence
  chemically synthesized
cgattataagccaaaatatg

SEQ ID NO: 117077 - DNA, 20 bp, Artificial Sequence
  chemically synthesized
aataccttctttacgattat

SEQ ID NO: 117078 - DNA, 20 bp, Artificial Sequence
  chemically synthesized
tattttggcttataatcgta

SEQ ID NO: 117079 - DNA, 20 bp, Artificial Sequence
  chemically synthesized
tttggcttataatcgtaaag

SEQ ID NO: 117080 - DNA, 20 bp, Artificial Sequence
  chemically synthesized
ttggcttataatcgtaaaga

SEQ ID NO: 117081 - DNA, 20 bp, Artificial Sequence
  chemically synthesized
atcgtaaagaaggtattaca

SEQ ID NO: 117082 - DNA, 20 bp, Artificial Sequence
  chemically synthesized
aaagtatttgttatttaaaa

SEQ ID NO: 117083 - DNA, 20 bp, Artificial Sequence
  chemically synthesized
atttgttatttaaaaaagaa

SEQ ID NO: 117084 - DNA, 20 bp, Artificial Sequence
  chemically synthesized
ttgttatttaaaaaagaaaa

SEQ ID NO: 117085 - DNA, 20 bp, Artificial Sequence
  chemically synthesized
tgttatttaaaaaagaaaag

SEQ ID NO: 117086 - DNA, 20 bp, Artificial Sequence
  chemically synthesized
gttatttaaaaaagaaaaga

SEQ ID NO: 117087 - DNA, 20 bp, Artificial Sequence
  chemically synthesized
ttatttaaaaaagaaaagag

SEQ ID NO: 117088 - DNA, 20 bp, Artificial Sequence
  chemically synthesized
tttaaaaaagaaaagagggg

SEQ ID NO: 117089 - DNA, 20 bp, Artificial Sequence
  chemically synthesized
aaagaaaagaggggtggcat

SEQ ID NO: 117090 - DNA, 20 bp, Artificial Sequence
  chemically synthesized
aagaaaagaggggtggcatt

SEQ ID NO: 117091 - DNA, 20 bp, Artificial Sequence
  chemically synthesized
agaggggtggcattgggtct

SEQ ID NO: 117092 - DNA, 20 bp, Artificial Sequence
  chemically synthesized
ggggtggcattgggtctgag

SEQ ID NO: 117093 - DNA, 20 bp, Artificial Sequence
  chemically synthesized
tcggtggttttcaaacttct

SEQ ID NO: 117094 - DNA, 20 bp, Artificial Sequence
  chemically synthesized
aagtttgaaaaccaccgata

SEQ ID NO: 117095 - DNA, 20 bp, Artificial Sequence
  chemically synthesized
ccccagtggctctgtatcgg

SEQ ID NO: 117096 - DNA, 20 bp, Artificial Sequence
  chemically synthesized
gtttgaaaaccaccgataca

SEQ ID NO: 117097 - DNA, 20 bp, Artificial Sequence
  chemically synthesized
attccccagtggctctgtat

SEQ ID NO: 117098 - DNA, 20 bp, Artificial Sequence
  chemically synthesized
aaccaccgatacagagccac

SEQ ID NO: 117099 - DNA, 20 bp, Artificial Sequence
  chemically synthesized
accaccgatacagagccact

SEQ ID NO: 117100 - DNA, 20 bp, Artificial Sequence
  chemically synthesized
ccaccgatacagagccactg

SEQ ID NO: 117101 - DNA, 20 bp, Artificial Sequence
  chemically synthesized
tttctcttgagattccccag

SEQ ID NO: 117102 - DNA, 20 bp, Artificial Sequence
  chemically synthesized
aactttctcttgagattccc

SEQ ID NO: 117103 - DNA, 20 bp, Artificial Sequence
  chemically synthesized
cagagccactggggaatctc

SEQ ID NO: 117104 - DNA, 20 bp, Artificial Sequence
  chemically synthesized
gagccactggggaatctcaa

SEQ ID NO: 117105 - DNA, 20 bp, Artificial Sequence
  chemically synthesized
cactggggaatctcaagaga

SEQ ID NO: 117106 - DNA, 20 bp, Artificial Sequence
  chemically synthesized
agtataataaactttctctt

SEQ ID NO: 117107 - DNA, 20 bp, Artificial Sequence
  chemically synthesized
tgaaaaattctattaatttt

SEQ ID NO: 117108 - DNA, 20 bp, Artificial Sequence
  chemically synthesized
tttattatactgaaaattaa

SEQ ID NO: 117109 - DNA, 20 bp, Artificial Sequence
  chemically synthesized
tgaaaattaatagaattttt

SEQ ID NO: 117110 - DNA, 20 bp, Artificial Sequence
  chemically synthesized
gaaaattaatagaatttttc

SEQ ID NO: 117111 - DNA, 20 bp, Artificial Sequence
  chemically synthesized
aaattaatagaatttttcag

SEQ ID NO: 117112 - DNA, 20 bp, Artificial Sequence
  chemically synthesized
attaatagaatttttcagga

SEQ ID NO: 117113 - DNA, 20 bp, Artificial Sequence
  chemically synthesized
agaatttttcaggagagaat

SEQ ID NO: 117114 - DNA, 20 bp, Artificial Sequence
  chemically synthesized
gaatttttcaggagagaatg

SEQ ID NO: 117115 - DNA, 20 bp, Artificial Sequence
  chemically synthesized
gagattggatgcacagggag

SEQ ID NO: 117116 - DNA, 20 bp, Artificial Sequence
  chemically synthesized
agagattggatgcacaggga

SEQ ID NO: 117117 - DNA, 20 bp, Artificial Sequence
  chemically synthesized
cagagattggatgcacaggg

SEQ ID NO: 117118 - DNA, 20 bp, Artificial Sequence
  chemically synthesized
tcagagattggatgcacagg

SEQ ID NO: 117119 - DNA, 20 bp, Artificial Sequence
  chemically synthesized
gatcagagattggatgcaca

SEQ ID NO: 117120 - DNA, 20 bp, Artificial Sequence
  chemically synthesized
ggatcagagattggatgcac

SEQ ID NO: 117121 - DNA, 20 bp, Artificial Sequence
  chemically synthesized
gggatcagagattggatgca

SEQ ID NO: 117122 - DNA, 20 bp, Artificial Sequence
  chemically synthesized
gagctctagggatcagagat

SEQ ID NO: 117123 - DNA, 20 bp, Artificial Sequence
  chemically synthesized
tgcatccaatctctgatccc

SEQ ID NO: 117124 - DNA, 20 bp, Artificial Sequence
  chemically synthesized
ctatggagctctagggatca

SEQ ID NO: 117125 - DNA, 20 bp, Artificial Sequence
  chemically synthesized
catccaatctctgatcccta

SEQ ID NO: 117126 - DNA, 20 bp, Artificial Sequence
  chemically synthesized
ctctatggagctctagggat

SEQ ID NO: 117127 - DNA, 20 bp, Artificial Sequence
  chemically synthesized
tcattctctatggagctcta

SEQ ID NO: 117128 - DNA, 20 bp, Artificial Sequence
  chemically synthesized
ttcattctctatggagctct

SEQ ID NO: 117129 - DNA, 20 bp, Artificial Sequence
  chemically synthesized
tttcattctctatggagctc

SEQ ID NO: 117130 - DNA, 20 bp, Artificial Sequence
  chemically synthesized
ctctgatccctagagctcca

SEQ ID NO: 117131 - DNA, 20 bp, Artificial Sequence
  chemically synthesized
ctgatccctagagctccata

SEQ ID NO: 117132 - DNA, 20 bp, Artificial Sequence
  chemically synthesized
atgctatttcattctctatg

SEQ ID NO: 117133 - DNA, 20 bp, Artificial Sequence
  chemically synthesized
aaatgctatttcattctcta

SEQ ID NO: 117134 - DNA, 20 bp, Artificial Sequence
  chemically synthesized
gagctccatagagaatgaaa

SEQ ID NO: 117135 - DNA, 20 bp, Artificial Sequence
  chemically synthesized
tcacagctggttgtagaaga

SEQ ID NO: 117136 - DNA, 20 bp, Artificial Sequence
  chemically synthesized
agtcacagctggttgtagaa

SEQ ID NO: 117137 - DNA, 20 bp, Artificial Sequence
  chemically synthesized
aaattgctctcttctacaac

SEQ ID NO: 117138 - DNA, 20 bp, Artificial Sequence
  chemically synthesized
atagtcacagctggttgtag

SEQ ID NO: 117139 - DNA, 20 bp, Artificial Sequence
  chemically synthesized
ccgatagtcacagctggttg

SEQ ID NO: 117140 - DNA, 20 bp, Artificial Sequence
  chemically synthesized
ggttcaccgatagtcacagc

SEQ ID NO: 117141 - DNA, 20 bp, Artificial Sequence
  chemically synthesized
ctacaaccagctgtgactat

SEQ ID NO: 117142 - DNA, 20 bp, Artificial Sequence
  chemically synthesized
ctccggttcaccgatagtca

SEQ ID NO: 117143 - DNA, 20 bp, Artificial Sequence
  chemically synthesized
gtagacctccggttcaccga

SEQ ID NO: 117144 - DNA, 20 bp, Artificial Sequence
  chemically synthesized
agctgtgactatcggtgaac

SEQ ID NO: 117145 - DNA, 20 bp, Artificial Sequence
  chemically synthesized
ctgtgactatcggtgaaccg

SEQ ID NO: 117146 - DNA, 20 bp, Artificial Sequence
  chemically synthesized
tgtgactatcggtgaaccgg

SEQ ID NO: 117147 - DNA, 20 bp, Artificial Sequence
  chemically synthesized
tcgtatatgaagtagacctc

SEQ ID NO: 117148 - DNA, 20 bp, Artificial Sequence
  chemically synthesized
attcaggttcgtatatgaag

SEQ ID NO: 117149 - DNA, 20 bp, Artificial Sequence
  chemically synthesized
ttaattcaggttcgtatatg

SEQ ID NO: 117150 - DNA, 20 bp, Artificial Sequence
  chemically synthesized
gggctggctgtttttaattc

SEQ ID NO: 117151 - DNA, 20 bp, Artificial Sequence
  chemically synthesized
agggctggctgtttttaatt

SEQ ID NO: 117152 - DNA, 20 bp, Artificial Sequence
  chemically synthesized
atacgaacctgaattaaaaa

SEQ ID NO: 117153 - DNA, 20 bp, Artificial Sequence
  chemically synthesized
gaacctgaattaaaaacagc

SEQ ID NO: 117154 - DNA, 20 bp, Artificial Sequence
  chemically synthesized
attaaaaacagccagccctt

SEQ ID NO: 117155 - DNA, 20 bp, Artificial Sequence
  chemically synthesized
ctctgaactgactcaagggc

SEQ ID NO: 117156 - DNA, 20 bp, Artificial Sequence
  chemically synthesized
aaaacagccagcccttgagt

SEQ ID NO: 117157 - DNA, 20 bp, Artificial Sequence
  chemically synthesized
tgggctctgaactgactcaa

SEQ ID NO: 117158 - DNA, 20 bp, Artificial Sequence
  chemically synthesized
gtgggctctgaactgactca

SEQ ID NO: 117159 - DNA, 20 bp, Artificial Sequence
  chemically synthesized
cgtgggctctgaactgactc

SEQ ID NO: 117160 - DNA, 20 bp, Artificial Sequence
  chemically synthesized
agccagcccttgagtcagtt

SEQ ID NO: 117161 - DNA, 20 bp, Artificial Sequence
  chemically synthesized
ccagcccttgagtcagttca

SEQ ID NO: 117162 - DNA, 20 bp, Artificial Sequence
  chemically synthesized
tcaaatgtaatcaagaacgt

SEQ ID NO: 117163 - DNA, 20 bp, Artificial Sequence
  chemically synthesized
gtcaaatgtaatcaagaacg

SEQ ID NO: 117164 - DNA, 20 bp, Artificial Sequence
  chemically synthesized
ttattgtgtcaaatgtaatc

SEQ ID NO: 117165 - DNA, 20 bp, Artificial Sequence
  chemically synthesized
aataatcatcatcatatctt

SEQ ID NO: 117166 - DNA, 20 bp, Artificial Sequence
  chemically synthesized
gtcaggctgatttgagtctt

SEQ ID NO: 117167 - DNA, 20 bp, Artificial Sequence
  chemically synthesized
tcatatcttaagactcaaat

SEQ ID NO: 117168 - DNA, 20 bp, Artificial Sequence
  chemically synthesized
gagcactgtcaggctgattt

SEQ ID NO: 117169 - DNA, 20 bp, Artificial Sequence
  chemically synthesized
taagactcaaatcagcctga

SEQ ID NO: 117170 - DNA, 20 bp, Artificial Sequence
  chemically synthesized
gccctgagttgagcactgtc

SEQ ID NO: 117171 - DNA, 20 bp, Artificial Sequence
  chemically synthesized
agccctgagttgagcactgt

SEQ ID NO: 117172 - DNA, 20 bp, Artificial Sequence
  chemically synthesized
cagcctgacagtgctcaact

SEQ ID NO: 117173 - DNA, 20 bp, Artificial Sequence
  chemically synthesized
agcctgacagtgctcaactc

SEQ ID NO: 117174 - DNA, 20 bp, Artificial Sequence
  chemically synthesized
gcctgacagtgctcaactca

SEQ ID NO: 117175 - DNA, 20 bp, Artificial Sequence
  chemically synthesized
gggagaagcagccctgagtt

SEQ ID NO: 117176 - DNA, 20 bp, Artificial Sequence
  chemically synthesized
taattgggagaagcagccct

SEQ ID NO: 117177 - DNA, 20 bp, Artificial Sequence
  chemically synthesized
tttcagctaattgggagaag

SEQ ID NO: 117178 - DNA, 20 bp, Artificial Sequence
  chemically synthesized
aattttcagctaattgggag

SEQ ID NO: 117179 - DNA, 20 bp, Artificial Sequence
  chemically synthesized
tcagggctgcttctcccaat

SEQ ID NO: 117180 - DNA, 20 bp, Artificial Sequence
  chemically synthesized
tgcaattttcagctaattgg

SEQ ID NO: 117181 - DNA, 20 bp, Artificial Sequence
  chemically synthesized
gctgcaattttcagctaatt

SEQ ID NO: 117182 - DNA, 20 bp, Artificial Sequence
  chemically synthesized
ggctgcaattttcagctaat

SEQ ID NO: 117183 - DNA, 20 bp, Artificial Sequence
  chemically synthesized
tcccaattagctgaaaattg

SEQ ID NO: 117184 - DNA, 20 bp, Artificial Sequence
  chemically synthesized
atgagctgggctgcaatttt

SEQ ID NO: 117185 - DNA, 20 bp, Artificial Sequence
  chemically synthesized
attagctgaaaattgcagcc

SEQ ID NO: 117186 - DNA, 20 bp, Artificial Sequence
  chemically synthesized
tattccctaggagatgagct

SEQ ID NO: 117187 - DNA, 20 bp, Artificial Sequence
  chemically synthesized
gtattccctaggagatgagc

SEQ ID NO: 117188 - DNA, 20 bp, Artificial Sequence
  chemically synthesized
ttgcagcccagctcatctcc

SEQ ID NO: 117189 - DNA, 20 bp, Artificial Sequence
  chemically synthesized
tgcagcccagctcatctcct

SEQ ID NO: 117190 - DNA, 20 bp, Artificial Sequence
  chemically synthesized
aaacgtattccctaggagat

SEQ ID NO: 117191 - DNA, 20 bp, Artificial Sequence
  chemically synthesized
gcagcccagctcatctccta

SEQ ID NO: 117192 - DNA, 20 bp, Artificial Sequence
  chemically synthesized
aatgtaaacgtattccctag

SEQ ID NO: 117193 - DNA, 20 bp, Artificial Sequence
  chemically synthesized
taaatgtaaacgtattccct

SEQ ID NO: 117194 - DNA, 20 bp, Artificial Sequence
  chemically synthesized
gtaaatgtaaacgtattccc

SEQ ID NO: 117195 - DNA, 20 bp, Artificial Sequence
  chemically synthesized
ttacatttacaattttgctg

SEQ ID NO: 117196 - DNA, 20 bp, Artificial Sequence
  chemically synthesized
tacaattttgctgtggcaaa

SEQ ID NO: 117197 - DNA, 20 bp, Artificial Sequence
  chemically synthesized
tgtttgttgcctttttgcca

SEQ ID NO: 117198 - DNA, 20 bp, Artificial Sequence
  chemically synthesized
acaattttgctgtggcaaaa

SEQ ID NO: 117199 - DNA, 20 bp, Artificial Sequence
  chemically synthesized
caaaaaggcaacaaacacgc

SEQ ID NO: 117200 - DNA, 20 bp, Artificial Sequence
  chemically synthesized
aaaggcaacaaacacgctgg

SEQ ID NO: 117201 - DNA, 20 bp, Artificial Sequence
  chemically synthesized
aaggcaacaaacacgctgga

SEQ ID NO: 117202 - DNA, 20 bp, Artificial Sequence
  chemically synthesized
ggcaacaaacacgctggaag

SEQ ID NO: 117203 - DNA, 20 bp, Artificial Sequence
  chemically synthesized
aaaagctgatttgctccttc

SEQ ID NO: 117204 - DNA, 20 bp, Artificial Sequence
  chemically synthesized
acacgctggaaggagcaaat

SEQ ID NO: 117205 - DNA, 20 bp, Artificial Sequence
  chemically synthesized
tagttagtgtaaaagttaaa

SEQ ID NO: 117206 - DNA, 20 bp, Artificial Sequence
  chemically synthesized
acttaaaatagttagtgtaa

SEQ ID NO: 117207 - DNA, 20 bp, Artificial Sequence
  chemically synthesized
ttaggtaaacttaaaatagt

SEQ ID NO: 117208 - DNA, 20 bp, Artificial Sequence
  chemically synthesized
acttttacactaactatttt

SEQ ID NO: 117209 - DNA, 20 bp, Artificial Sequence
  chemically synthesized
agacttaggtaaacttaaaa

SEQ ID NO: 117210 - DNA, 20 bp, Artificial Sequence
  chemically synthesized
taactattttaagtttacct

SEQ ID NO: 117211 - DNA, 20 bp, Artificial Sequence
  chemically synthesized
attttaagtttacctaagtc

SEQ ID NO: 117212 - DNA, 20 bp, Artificial Sequence
  chemically synthesized
aaaacaggtttaccagactt

SEQ ID NO: 117213 - DNA, 20 bp, Artificial Sequence
  chemically synthesized
caaaacaggtttaccagact

SEQ ID NO: 117214 - DNA, 20 bp, Artificial Sequence
  chemically synthesized
tcttgtcaaaacaggtttac

SEQ ID NO: 117215 - DNA, 20 bp, Artificial Sequence
  chemically synthesized
gttgtcattcttgtcaaaac

SEQ ID NO: 117216 - DNA, 20 bp, Artificial Sequence
  chemically synthesized
tctggtaaacctgttttgac

SEQ ID NO: 117217 - DNA, 20 bp, Artificial Sequence
  chemically synthesized
cgttgtcattcttgtcaaaa

SEQ ID NO: 117218 - DNA, 20 bp, Artificial Sequence
  chemically synthesized
gttttgacaagaatgacaac

SEQ ID NO: 117219 - DNA, 20 bp, Artificial Sequence
  chemically synthesized
ttttgacaagaatgacaacg

SEQ ID NO: 117220 - DNA, 20 bp, Artificial Sequence
  chemically synthesized
tgacaagaatgacaacgagg

SEQ ID NO: 117221 - DNA, 20 bp, Artificial Sequence
  chemically synthesized
ataaaaaatcataacaaaaa

SEQ ID NO: 117222 - DNA, 20 bp, Artificial Sequence
  chemically synthesized
tgattttttataactgcgca

SEQ ID NO: 117223 - DNA, 20 bp, Artificial Sequence
  chemically synthesized
tagttatcttaaactttgcg

SEQ ID NO: 117224 - DNA, 20 bp, Artificial Sequence
  chemically synthesized
tttataactgcgcaaagttt

SEQ ID NO: 117225 - DNA, 20 bp, Artificial Sequence
  chemically synthesized
tgcgcaaagtttaagataac

SEQ ID NO: 117226 - DNA, 20 bp, Artificial Sequence
  chemically synthesized
cgcaaagtttaagataacta

SEQ ID NO: 117227 - DNA, 20 bp, Artificial Sequence
  chemically synthesized
agtttaagataactagagtt

SEQ ID NO: 117228 - DNA, 20 bp, Artificial Sequence
  chemically synthesized
tccccttctagtccaaactc

SEQ ID NO: 117229 - DNA, 20 bp, Artificial Sequence
  chemically synthesized
aagataactagagtttggac

SEQ ID NO: 117230 - DNA, 20 bp, Artificial Sequence
  chemically synthesized
ataactagagtttggactag

SEQ ID NO: 117231 - DNA, 20 bp, Artificial Sequence
  chemically synthesized
taactagagtttggactaga

SEQ ID NO: 117232 - DNA, 20 bp, Artificial Sequence
  chemically synthesized
aactagagtttggactagaa

SEQ ID NO: 117233 - DNA, 20 bp, Artificial Sequence
  chemically synthesized
actagagtttggactagaag

SEQ ID NO: 117234 - DNA, 20 bp, Artificial Sequence
  chemically synthesized
gtgtatctgttttccccttc

SEQ ID NO: 117235 - DNA, 20 bp, Artificial Sequence
  chemically synthesized
tttggactagaaggggaaaa

SEQ ID NO: 117236 - DNA, 20 bp, Artificial Sequence
  chemically synthesized
cacaatgtgaatatttttac

SEQ ID NO: 117237 - DNA, 20 bp, Artificial Sequence
  chemically synthesized
tctgaaagctttcatttgac

SEQ ID NO: 117238 - DNA, 20 bp, Artificial Sequence
  chemically synthesized
acaagttacttgtcaaatga

SEQ ID NO: 117239 - DNA, 20 bp, Artificial Sequence
  chemically synthesized
acttgtcaaatgaaagcttt

SEQ ID NO: 117240 - DNA, 20 bp, Artificial Sequence
  chemically synthesized
tgtcaaatgaaagctttcag

SEQ ID NO: 117241 - DNA, 20 bp, Artificial Sequence
  chemically synthesized
agaaaggctgtttcttctga

SEQ ID NO: 117242 - DNA, 20 bp, Artificial Sequence
  chemically synthesized
atgaaagctttcagaagaaa

SEQ ID NO: 117243 - DNA, 20 bp, Artificial Sequence
  chemically synthesized
cagaagaaacagcctttctt

SEQ ID NO: 117244 - DNA, 20 bp, Artificial Sequence
  chemically synthesized
atgcaccgtttaccaaagaa

SEQ ID NO: 117245 - DNA, 20 bp, Artificial Sequence
  chemically synthesized
aatgcaccgtttaccaaaga

SEQ ID NO: 117246 - DNA, 20 bp, Artificial Sequence
  chemically synthesized
aacagcctttctttggtaaa

SEQ ID NO: 117247 - DNA, 20 bp, Artificial Sequence
  chemically synthesized
ttttaatgcaccgtttacca

SEQ ID NO: 117248 - DNA, 20 bp, Artificial Sequence
  chemically synthesized
ttaaaataatttgcaactaa

SEQ ID NO: 117249 - DNA, 20 bp, Artificial Sequence
  chemically synthesized
aataatttgcaactaataga

SEQ ID NO: 117250 - DNA, 20 bp, Artificial Sequence
  chemically synthesized
ataatttgcaactaatagat

SEQ ID NO: 117251 - DNA, 20 bp, Artificial Sequence
  chemically synthesized
taatttgcaactaatagata

SEQ ID NO: 117252 - DNA, 20 bp, Artificial Sequence
  chemically synthesized
aattacatgtccctatctat

SEQ ID NO: 117253 - DNA, 20 bp, Artificial Sequence
  chemically synthesized
acatgtaatttgaaaacaaa

SEQ ID NO: 117254 - DNA, 20 bp, Artificial Sequence
  chemically synthesized
gtaatttgaaaacaaaaagt

SEQ ID NO: 117255 - DNA, 20 bp, Artificial Sequence
  chemically synthesized
acaaaaagtgagtaaatgtc

SEQ ID NO: 117256 - DNA, 20 bp, Artificial Sequence
  chemically synthesized
caaaaagtgagtaaatgtca

SEQ ID NO: 117257 - DNA, 20 bp, Artificial Sequence
  chemically synthesized
gtgagtaaatgtcaaggtcc

SEQ ID NO: 117258 - DNA, 20 bp, Artificial Sequence
  chemically synthesized
tgagtaaatgtcaaggtcct

SEQ ID NO: 117259 - DNA, 20 bp, Artificial Sequence
  chemically synthesized
ataattggaaaatatttcct

SEQ ID NO: 117260 - DNA, 20 bp, Artificial Sequence
  chemically synthesized
tataattggaaaatatttcc

SEQ ID NO: 117261 - DNA, 20 bp, Artificial Sequence
  chemically synthesized
ttatcgggttagcatataat

SEQ ID NO: 117262 - DNA, 20 bp, Artificial Sequence
  chemically synthesized
tggacatggagttatcgggt

SEQ ID NO: 117263 - DNA, 20 bp, Artificial Sequence
  chemically synthesized
cacatggacatggagttatc

SEQ ID NO: 117264 - DNA, 20 bp, Artificial Sequence
  chemically synthesized
tcacatggacatggagttat

SEQ ID NO: 117265 - DNA, 20 bp, Artificial Sequence
  chemically synthesized
cgctatgtcacatggacatg

SEQ ID NO: 117266 - DNA, 20 bp, Artificial Sequence
  chemically synthesized
aacgctatgtcacatggaca

SEQ ID NO: 117267 - DNA, 20 bp, Artificial Sequence
  chemically synthesized
aactccatgtccatgtgaca

SEQ ID NO: 117268 - DNA, 20 bp, Artificial Sequence
  chemically synthesized
cagaataacgctatgtcaca

SEQ ID NO: 117269 - DNA, 20 bp, Artificial Sequence
  chemically synthesized
aagtaatttacagaattaca

SEQ ID NO: 117270 - DNA, 20 bp, Artificial Sequence
  chemically synthesized
tataggagagaagtaattta

SEQ ID NO: 117271 - DNA, 20 bp, Artificial Sequence
  chemically synthesized
ccctcagaaatataggagag

SEQ ID NO: 117272 - DNA, 20 bp, Artificial Sequence
  chemically synthesized
cacccctcagaaatatagga

SEQ ID NO: 117273 - DNA, 20 bp, Artificial Sequence
  chemically synthesized
tccacccctcagaaatatag

SEQ ID NO: 117274 - DNA, 20 bp, Artificial Sequence
  chemically synthesized
attccacccctcagaaatat

SEQ ID NO: 117275 - DNA, 20 bp, Artificial Sequence
  chemically synthesized
tacttctctcctatatttct

SEQ ID NO: 117276 - DNA, 20 bp, Artificial Sequence
  chemically synthesized
tattccacccctcagaaata

SEQ ID NO: 117277 - DNA, 20 bp, Artificial Sequence
  chemically synthesized
acttctctcctatatttctg

SEQ ID NO: 117278 - DNA, 20 bp, Artificial Sequence
  chemically synthesized
cttctctcctatatttctga

SEQ ID NO: 117279 - DNA, 20 bp, Artificial Sequence
  chemically synthesized
ttctctcctatatttctgag

SEQ ID NO: 117280 - DNA, 20 bp, Artificial Sequence
  chemically synthesized
tctcctatatttctgagggg

SEQ ID NO: 117281 - DNA, 20 bp, Artificial Sequence
  chemically synthesized
tccttggttattccacccct

SEQ ID NO: 117282 - DNA, 20 bp, Artificial Sequence
  chemically synthesized
ttctgaggggtggaataacc

SEQ ID NO: 117283 - DNA, 20 bp, Artificial Sequence
  chemically synthesized
tctgaggggtggaataacca

SEQ ID NO: 117284 - DNA, 20 bp, Artificial Sequence
  chemically synthesized
aaaatgcacaaaaatgtcct

SEQ ID NO: 117285 - DNA, 20 bp, Artificial Sequence
  chemically synthesized
atagaaaggtatcataattg

SEQ ID NO: 117286 - DNA, 20 bp, Artificial Sequence
  chemically synthesized
catagaaaggtatcataatt

SEQ ID NO: 117287 - DNA, 20 bp, Artificial Sequence
  chemically synthesized
aattatgatacctttctatg

SEQ ID NO: 117288 - DNA, 20 bp, Artificial Sequence
  chemically synthesized
ctgccctgatctgcatagaa

SEQ ID NO: 117289 - DNA, 20 bp, Artificial Sequence
  chemically synthesized
actgccctgatctgcataga

SEQ ID NO: 117290 - DNA, 20 bp, Artificial Sequence
  chemically synthesized
tgatacctttctatgcagat

SEQ ID NO: 117291 - DNA, 20 bp, Artificial Sequence
  chemically synthesized
gcaaactgccctgatctgca

SEQ ID NO: 117292 - DNA, 20 bp, Artificial Sequence
  chemically synthesized
gatacctttctatgcagatc

SEQ ID NO: 117293 - DNA, 20 bp, Artificial Sequence
  chemically synthesized
atacctttctatgcagatca

SEQ ID NO: 117294 - DNA, 20 bp, Artificial Sequence
  chemically synthesized
cctttctatgcagatcaggg

SEQ ID NO: 117295 - DNA, 20 bp, Artificial Sequence
  chemically synthesized
agggcagtttgcacacacta

SEQ ID NO: 117296 - DNA, 20 bp, Artificial Sequence
  chemically synthesized
gggcagtttgcacacactat

SEQ ID NO: 117297 - DNA, 20 bp, Artificial Sequence
  chemically synthesized
gtcactttccatttttccca

SEQ ID NO: 117298 - DNA, 20 bp, Artificial Sequence
  chemically synthesized
tgcacacactatgggaaaaa

SEQ ID NO: 117299 - DNA, 20 bp, Artificial Sequence
  chemically synthesized
cacactatgggaaaaatgga

SEQ ID NO: 117300 - DNA, 20 bp, Artificial Sequence
  chemically synthesized
tgggaaaaatggaaagtgac

SEQ ID NO: 117301 - DNA, 20 bp, Artificial Sequence
  chemically synthesized
gggaaaaatggaaagtgaca

SEQ ID NO: 117302 - DNA, 20 bp, Artificial Sequence
  chemically synthesized
gacaaggtaaccatgcttca

SEQ ID NO: 117303 - DNA, 20 bp, Artificial Sequence
  chemically synthesized
agcacagccaccatgaagca

SEQ ID NO: 117304 - DNA, 20 bp, Artificial Sequence
  chemically synthesized
aaggtaaccatgcttcatgg

SEQ ID NO: 117305 - DNA, 20 bp, Artificial Sequence
  chemically synthesized
tcttcagcacagccaccatg

SEQ ID NO: 117306 - DNA, 20 bp, Artificial Sequence
  chemically synthesized
gcttcatggtggctgtgctg

SEQ ID NO: 117307 - DNA, 20 bp, Artificial Sequence
  chemically synthesized
atctgagcaaatcttcagca

SEQ ID NO: 117308 - DNA, 20 bp, Artificial Sequence
  chemically synthesized
ctgttatctgagcaaatctt

SEQ ID NO: 117309 - DNA, 20 bp, Artificial Sequence
  chemically synthesized
ggctgtgctgaagatttgct

SEQ ID NO: 117310 - DNA, 20 bp, Artificial Sequence
  chemically synthesized
ctgaagatttgctcagataa

SEQ ID NO: 117311 - DNA, 20 bp, Artificial Sequence
  chemically synthesized
gcataaggacactgttatct

SEQ ID NO: 117312 - DNA, 20 bp, Artificial Sequence
  chemically synthesized
cgcttagaagacagcgcata

SEQ ID NO: 117313 - DNA, 20 bp, Artificial Sequence
  chemically synthesized
ccgcttagaagacagcgcat

SEQ ID NO: 117314 - DNA, 20 bp, Artificial Sequence
  chemically synthesized
gtccttatgcgctgtcttct

SEQ ID NO: 117315 - DNA, 20 bp, Artificial Sequence
  chemically synthesized
actgtcatccgcttagaaga

SEQ ID NO: 117316 - DNA, 20 bp, Artificial Sequence
  chemically synthesized
cttatgcgctgtcttctaag

SEQ ID NO: 117317 - DNA, 20 bp, Artificial Sequence
  chemically synthesized
ctgcactgtcatccgcttag

SEQ ID NO: 117318 - DNA, 20 bp, Artificial Sequence
  chemically synthesized
tgtctgcactgtcatccgct

SEQ ID NO: 117319 - DNA, 20 bp, Artificial Sequence
  chemically synthesized
gctgtcttctaagcggatga

SEQ ID NO: 117320 - DNA, 20 bp, Artificial Sequence
  chemically synthesized
cttctaagcggatgacagtg

SEQ ID NO: 117321 - DNA, 20 bp, Artificial Sequence
  chemically synthesized
agcggatgacagtgcagaca

SEQ ID NO: 117322 - DNA, 20 bp, Artificial Sequence
  chemically synthesized
ggatgacagtgcagacatgg

SEQ ID NO: 117323 - DNA, 20 bp, Artificial Sequence
  chemically synthesized
atgacagtgcagacatggaa

SEQ ID NO: 117324 - DNA, 20 bp, Artificial Sequence
  chemically synthesized
agacatggaagagaaatatg

SEQ ID NO: 117325 - DNA, 20 bp, Artificial Sequence
  chemically synthesized
atggaagagaaatatgcaga

SEQ ID NO: 117326 - DNA, 20 bp, Artificial Sequence
  chemically synthesized
tggaagagaaatatgcagat

SEQ ID NO: 117327 - DNA, 20 bp, Artificial Sequence
  chemically synthesized
cagatgggaaaacatgaatc

SEQ ID NO: 117328 - DNA, 20 bp, Artificial Sequence
  chemically synthesized
gggaaaacatgaatctagaa

SEQ ID NO: 117329 - DNA, 20 bp, Artificial Sequence
  chemically synthesized
aaaacatgaatctagaaaag

SEQ ID NO: 117330 - DNA, 20 bp, Artificial Sequence
  chemically synthesized
aaacatgaatctagaaaagt

SEQ ID NO: 117331 - DNA, 20 bp, Artificial Sequence
  chemically synthesized
cagtatttttcccacttttc

SEQ ID NO: 117332 - DNA, 20 bp, Artificial Sequence
  chemically synthesized
agaaaagtgggaaaaatact

SEQ ID NO: 117333 - DNA, 20 bp, Artificial Sequence
  chemically synthesized
gaaaagtgggaaaaatactg

SEQ ID NO: 117334 - DNA, 20 bp, Artificial Sequence
  chemically synthesized
aaagtgggaaaaatactgag

SEQ ID NO: 117335 - DNA, 20 bp, Artificial Sequence
  chemically synthesized
gtgggaaaaatactgaggag

SEQ ID NO: 117336 - DNA, 20 bp, Artificial Sequence
  chemically synthesized
tgggaaaaatactgaggagc

SEQ ID NO: 117337 - DNA, 20 bp, Artificial Sequence
  chemically synthesized
tttccaggtctcctgctcct

SEQ ID NO: 117338 - DNA, 20 bp, Artificial Sequence
  chemically synthesized
ggaaaaatactgaggagcag

SEQ ID NO: 117339 - DNA, 20 bp, Artificial Sequence
  chemically synthesized
atactgaggagcaggagacc

SEQ ID NO: 117340 - DNA, 20 bp, Artificial Sequence
  chemically synthesized
gaggagcaggagacctggaa

SEQ ID NO: 117341 - DNA, 20 bp, Artificial Sequence
  chemically synthesized
tagaattgtcttacttttcc

SEQ ID NO: 117342 - DNA, 20 bp, Artificial Sequence
  chemically synthesized
agcaggagacctggaaaagt

SEQ ID NO: 117343 - DNA, 20 bp, Artificial Sequence
  chemically synthesized
ctagaattgtcttacttttc

SEQ ID NO: 117344 - DNA, 20 bp, Artificial Sequence
  chemically synthesized
ctggaaaagtaagacaattc

SEQ ID NO: 117345 - DNA, 20 bp, Artificial Sequence
  chemically synthesized
ggaaaagtaagacaattcta

SEQ ID NO: 117346 - DNA, 20 bp, Artificial Sequence
  chemically synthesized
aaagtaagacaattctagag

SEQ ID NO: 117347 - DNA, 20 bp, Artificial Sequence
  chemically synthesized
aagtaagacaattctagagt

SEQ ID NO: 117348 - DNA, 20 bp, Artificial Sequence
  chemically synthesized
tcttctatctcagcccactc

SEQ ID NO: 117349 - DNA, 20 bp, Artificial Sequence
  chemically synthesized
agacaattctagagtgggct

SEQ ID NO: 117350 - DNA, 20 bp, Artificial Sequence
  chemically synthesized
aattctagagtgggctgaga

SEQ ID NO: 117351 - DNA, 20 bp, Artificial Sequence
  chemically synthesized
tctagagtgggctgagatag

SEQ ID NO: 117352 - DNA, 20 bp, Artificial Sequence
  chemically synthesized
ttacaacatgtcttctatct

SEQ ID NO: 117353 - DNA, 20 bp, Artificial Sequence
  chemically synthesized
agaagacatgttgtaaccac

SEQ ID NO: 117354 - DNA, 20 bp, Artificial Sequence
  chemically synthesized
gaagacatgttgtaaccact

SEQ ID NO: 117355 - DNA, 20 bp, Artificial Sequence
  chemically synthesized
aagacatgttgtaaccactg

SEQ ID NO: 117356 - DNA, 20 bp, Artificial Sequence
  chemically synthesized
catgttgtaaccactgggga

SEQ ID NO: 117357 - DNA, 20 bp, Artificial Sequence
  chemically synthesized
acatgttttcctgtccccag

SEQ ID NO: 117358 - DNA, 20 bp, Artificial Sequence
  chemically synthesized
atgttgtaaccactggggac

SEQ ID NO: 117359 - DNA, 20 bp, Artificial Sequence
  chemically synthesized
ttcacatgttttcctgtccc

SEQ ID NO: 117360 - DNA, 20 bp, Artificial Sequence
  chemically synthesized
gggacaggaaaacatgtgaa

SEQ ID NO: 117361 - DNA, 20 bp, Artificial Sequence
  chemically synthesized
ggacaggaaaacatgtgaac

SEQ ID NO: 117362 - DNA, 20 bp, Artificial Sequence
  chemically synthesized
gtgaacaggaacatgtatat

SEQ ID NO: 117363 - DNA, 20 bp, Artificial Sequence
  chemically synthesized
ggaacatgtatataagctga

SEQ ID NO: 117364 - DNA, 20 bp, Artificial Sequence
  chemically synthesized
tgtgagctcttgcacactgt

SEQ ID NO: 117365 - DNA, 20 bp, Artificial Sequence
  chemically synthesized
tatataagctgacagtgtgc

SEQ ID NO: 117366 - DNA, 20 bp, Artificial Sequence
  chemically synthesized
tataagctgacagtgtgcaa

SEQ ID NO: 117367 - DNA, 20 bp, Artificial Sequence
  chemically synthesized
tgacagtgtgcaagagctca

SEQ ID NO: 117368 - DNA, 20 bp, Artificial Sequence
  chemically synthesized
agtgtgcaagagctcacaga

SEQ ID NO: 117369 - DNA, 20 bp, Artificial Sequence
  chemically synthesized
tgttagcatttgctttctgt

SEQ ID NO: 117370 - DNA, 20 bp, Artificial Sequence
  chemically synthesized
tcacagaaagcaaatgctaa

SEQ ID NO: 117371 - DNA, 20 bp, Artificial Sequence
  chemically synthesized
aaagcaaatgctaacagtaa

SEQ ID NO: 117372 - DNA, 20 bp, Artificial Sequence
  chemically synthesized
tggtatttctctattactgt

SEQ ID NO: 117373 - DNA, 20 bp, Artificial Sequence
  chemically synthesized
agcaaatgctaacagtaata

SEQ ID NO: 117374 - DNA, 20 bp, Artificial Sequence
  chemically synthesized
agtaatagagaaataccatt

SEQ ID NO: 117375 - DNA, 20 bp, Artificial Sequence
  chemically synthesized
gtaatagagaaataccattg

SEQ ID NO: 117376 - DNA, 20 bp, Artificial Sequence
  chemically synthesized
atagagaaataccattgagg

SEQ ID NO: 117377 - DNA, 20 bp, Artificial Sequence
  chemically synthesized
tatctctacctctgcctcaa

SEQ ID NO: 117378 - DNA, 20 bp, Artificial Sequence
  chemically synthesized
agagaaataccattgaggca

SEQ ID NO: 117379 - DNA, 20 bp, Artificial Sequence
  chemically synthesized
gagaaataccattgaggcag

SEQ ID NO: 117380 - DNA, 20 bp, Artificial Sequence
  chemically synthesized
aaataccattgaggcagagg

SEQ ID NO: 117381 - DNA, 20 bp, Artificial Sequence
  chemically synthesized
ataccattgaggcagaggta

SEQ ID NO: 117382 - DNA, 20 bp, Artificial Sequence
  chemically synthesized
gaggcagaggtagagataaa

SEQ ID NO: 117383 - DNA, 20 bp, Artificial Sequence
  chemically synthesized
aggtagagataaaaagaaat

SEQ ID NO: 117384 - DNA, 20 bp, Artificial Sequence
  chemically synthesized
ggtagagataaaaagaaata

SEQ ID NO: 117385 - DNA, 20 bp, Artificial Sequence
  chemically synthesized
tagagataaaaagaaataag

SEQ ID NO: 117386 - DNA, 20 bp, Artificial Sequence
  chemically synthesized
agagataaaaagaaataagg

SEQ ID NO: 117387 - DNA, 20 bp, Artificial Sequence
  chemically synthesized
gagataaaaagaaataagga

SEQ ID NO: 117388 - DNA, 20 bp, Artificial Sequence
  chemically synthesized
aaaaagaaataaggagggat

SEQ ID NO: 117389 - DNA, 20 bp, Artificial Sequence
  chemically synthesized
aaataaggagggatcggcca

SEQ ID NO: 117390 - DNA, 20 bp, Artificial Sequence
  chemically synthesized
taaggagggatcggccatgg

SEQ ID NO: 117391 - DNA, 20 bp, Artificial Sequence
  chemically synthesized
attacaggcgtgagccacca

SEQ ID NO: 117392 - DNA, 20 bp, Artificial Sequence
  chemically synthesized
agtgctgggattacaggcgt

SEQ ID NO: 117393 - DNA, 20 bp, Artificial Sequence
  chemically synthesized
gtggctcacgcctgtaatcc

SEQ ID NO: 117394 - DNA, 20 bp, Artificial Sequence
  chemically synthesized
tcccaaagtgctgggattac

SEQ ID NO: 117395 - DNA, 20 bp, Artificial Sequence
  chemically synthesized
ctcccaaagtgctgggatta

SEQ ID NO: 117396 - DNA, 20 bp, Artificial Sequence
  chemically synthesized
cgcctgtaatcccagcactt

SEQ ID NO: 117397 - DNA, 20 bp, Artificial Sequence
  chemically synthesized
ccttggcctcccaaagtgct

SEQ ID NO: 117398 - DNA, 20 bp, Artificial Sequence
  chemically synthesized
gcctgtaatcccagcacttt

SEQ ID NO: 117399 - DNA, 20 bp, Artificial Sequence
  chemically synthesized
accttggcctcccaaagtgc

SEQ ID NO: 117400 - DNA, 20 bp, Artificial Sequence
  chemically synthesized
ctgtaatcccagcactttgg

SEQ ID NO: 117401 - DNA, 20 bp, Artificial Sequence
  chemically synthesized
tgtaatcccagcactttggg

SEQ ID NO: 117402 - DNA, 20 bp, Artificial Sequence
  chemically synthesized
ccacccaccttggcctccca

SEQ ID NO: 117403 - DNA, 20 bp, Artificial Sequence
  chemically synthesized
tcccagcactttgggaggcc

SEQ ID NO: 117404 - DNA, 20 bp, Artificial Sequence
  chemically synthesized
cccagcactttgggaggcca

SEQ ID NO: 117405 - DNA, 20 bp, Artificial Sequence
  chemically synthesized
agcactttgggaggccaagg

SEQ ID NO: 117406 - DNA, 20 bp, Artificial Sequence
  chemically synthesized
gcactttgggaggccaaggt

SEQ ID NO: 117407 - DNA, 20 bp, Artificial Sequence
  chemically synthesized
ctttgggaggccaaggtggg

SEQ ID NO: 117408 - DNA, 20 bp, Artificial Sequence
  chemically synthesized
acctcgtgatccacccacct

SEQ ID NO: 117409 - DNA, 20 bp, Artificial Sequence
  chemically synthesized
ggccaaggtgggtggatcac

SEQ ID NO: 117410 - DNA, 20 bp, Artificial Sequence
  chemically synthesized
gccaaggtgggtggatcacg

SEQ ID NO: 117411 - DNA, 20 bp, Artificial Sequence
  chemically synthesized
aggtgggtggatcacgaggt

SEQ ID NO: 117412 - DNA, 20 bp, Artificial Sequence
  chemically synthesized
ggtgggtggatcacgaggtc

SEQ ID NO: 117413 - DNA, 20 bp, Artificial Sequence
  chemically synthesized
tgggtggatcacgaggtcag

SEQ ID NO: 117414 - DNA, 20 bp, Artificial Sequence
  chemically synthesized
gatcacgaggtcaggagttc

SEQ ID NO: 117415 - DNA, 20 bp, Artificial Sequence
  chemically synthesized
cgaggtcaggagttcaagac

SEQ ID NO: 117416 - DNA, 20 bp, Artificial Sequence
  chemically synthesized
tcaggagttcaagaccagcc

SEQ ID NO: 117417 - DNA, 20 bp, Artificial Sequence
  chemically synthesized
tttcaccatcttggccaggc

SEQ ID NO: 117418 - DNA, 20 bp, Artificial Sequence
  chemically synthesized
agttcaagaccagcctggcc

SEQ ID NO: 117419 - DNA, 20 bp, Artificial Sequence
  chemically synthesized
agggtttcaccatcttggcc

SEQ ID NO: 117420 - DNA, 20 bp, Artificial Sequence
  chemically synthesized
caagaccagcctggccaaga

SEQ ID NO: 117421 - DNA, 20 bp, Artificial Sequence
  chemically synthesized
cagggtttcaccatcttggc

SEQ ID NO: 117422 - DNA, 20 bp, Artificial Sequence
  chemically synthesized
gagacagggtttcaccatct

SEQ ID NO: 117423 - DNA, 20 bp, Artificial Sequence
  chemically synthesized
ttgtatttttagtagagaca

SEQ ID NO: 117424 - DNA, 20 bp, Artificial Sequence
  chemically synthesized
tttgtatttttagtagagac

SEQ ID NO: 117425 - DNA, 20 bp, Artificial Sequence
  chemically synthesized
ttttgtatttttagtagaga

SEQ ID NO: 117426 - DNA, 20 bp, Artificial Sequence
  chemically synthesized
ttttttttgtatttttagta

SEQ ID NO: 117427 - DNA, 20 bp, Artificial Sequence
  chemically synthesized
aattttttttgtatttttag

SEQ ID NO: 117428 - DNA, 20 bp, Artificial Sequence
  chemically synthesized
gctaattttttttgtatttt

SEQ ID NO: 117429 - DNA, 20 bp, Artificial Sequence
  chemically synthesized
actaaaaatacaaaaaaaat

SEQ ID NO: 117430 - DNA, 20 bp, Artificial Sequence
  chemically synthesized
aaaaatacaaaaaaaattag

SEQ ID NO: 117431 - DNA, 20 bp, Artificial Sequence
  chemically synthesized
aaaatacaaaaaaaattagc

SEQ ID NO: 117432 - DNA, 20 bp, Artificial Sequence
  chemically synthesized
aaatacaaaaaaaattagca

SEQ ID NO: 117433 - DNA, 20 bp, Artificial Sequence
  chemically synthesized
caaaaaaaattagcagggcg

SEQ ID NO: 117434 - DNA, 20 bp, Artificial Sequence
  chemically synthesized
aaaaaattagcagggcgtgg

SEQ ID NO: 117435 - DNA, 20 bp, Artificial Sequence
  chemically synthesized
aaattagcagggcgtggtgg

SEQ ID NO: 117436 - DNA, 20 bp, Artificial Sequence
  chemically synthesized
aattagcagggcgtggtggt

SEQ ID NO: 117437 - DNA, 20 bp, Artificial Sequence
  chemically synthesized
gtggtgggtgcctgtaatcc

SEQ ID NO: 117438 - DNA, 20 bp, Artificial Sequence
  chemically synthesized
tcccgagtggctgggattac

SEQ ID NO: 117439 - DNA, 20 bp, Artificial Sequence
  chemically synthesized
ctcccgagtggctgggatta

SEQ ID NO: 117440 - DNA, 20 bp, Artificial Sequence
  chemically synthesized
tgcctgtaatcccagccact

SEQ ID NO: 117441 - DNA, 20 bp, Artificial Sequence
  chemically synthesized
tctcagcctcccgagtggct

SEQ ID NO: 117442 - DNA, 20 bp, Artificial Sequence
  chemically synthesized
gcctgtaatcccagccactc

SEQ ID NO: 117443 - DNA, 20 bp, Artificial Sequence
  chemically synthesized
gtctcagcctcccgagtggc

SEQ ID NO: 117444 - DNA, 20 bp, Artificial Sequence
  chemically synthesized
ctgtaatcccagccactcgg

SEQ ID NO: 117445 - DNA, 20 bp, Artificial Sequence
  chemically synthesized
tgtaatcccagccactcggg

SEQ ID NO: 117446 - DNA, 20 bp, Artificial Sequence
  chemically synthesized
ctctgtctcagcctcccgag

SEQ ID NO: 117447 - DNA, 20 bp, Artificial Sequence
  chemically synthesized
attctctgtctcagcctccc

SEQ ID NO: 117448 - DNA, 20 bp, Artificial Sequence
  chemically synthesized
tcccagccactcgggaggct

SEQ ID NO: 117449 - DNA, 20 bp, Artificial Sequence
  chemically synthesized
agccactcgggaggctgaga

SEQ ID NO: 117450 - DNA, 20 bp, Artificial Sequence
  chemically synthesized
ccactcgggaggctgagaca

SEQ ID NO: 117451 - DNA, 20 bp, Artificial Sequence
  chemically synthesized
gttcaagcaattctctgtct

SEQ ID NO: 117452 - DNA, 20 bp, Artificial Sequence
  chemically synthesized
gacagagaattgcttgaacc

SEQ ID NO: 117453 - DNA, 20 bp, Artificial Sequence
  chemically synthesized
acagagaattgcttgaaccc

SEQ ID NO: 117454 - DNA, 20 bp, Artificial Sequence
  chemically synthesized
aacctctccctcctgggttc

SEQ ID NO: 117455 - DNA, 20 bp, Artificial Sequence
  chemically synthesized
agagaattgcttgaacccag

SEQ ID NO: 117456 - DNA, 20 bp, Artificial Sequence
  chemically synthesized
gagaattgcttgaacccagg

SEQ ID NO: 117457 - DNA, 20 bp, Artificial Sequence
  chemically synthesized
agaattgcttgaacccagga

SEQ ID NO: 117458 - DNA, 20 bp, Artificial Sequence
  chemically synthesized
aattgcttgaacccaggagg

SEQ ID NO: 117459 - DNA, 20 bp, Artificial Sequence
  chemically synthesized
cactgcaacctctccctcct

SEQ ID NO: 117460 - DNA, 20 bp, Artificial Sequence
  chemically synthesized
ttgcttgaacccaggaggga

SEQ ID NO: 117461 - DNA, 20 bp, Artificial Sequence
  chemically synthesized
tcactgcaacctctccctcc

SEQ ID NO: 117462 - DNA, 20 bp, Artificial Sequence
  chemically synthesized
tgcttgaacccaggagggag

SEQ ID NO: 117463 - DNA, 20 bp, Artificial Sequence
  chemically synthesized
aacccaggagggagaggttg

SEQ ID NO: 117464 - DNA, 20 bp, Artificial Sequence
  chemically synthesized
caggagggagaggttgcagt

SEQ ID NO: 117465 - DNA, 20 bp, Artificial Sequence
  chemically synthesized
gggagaggttgcagtgagcc

SEQ ID NO: 117466 - DNA, 20 bp, Artificial Sequence
  chemically synthesized
gtagtgcagtggtgcgatct

SEQ ID NO: 117467 - DNA, 20 bp, Artificial Sequence
  chemically synthesized
ttgcccaggctgtagtgcag

SEQ ID NO: 117468 - DNA, 20 bp, Artificial Sequence
  chemically synthesized
aagatcgcaccactgcacta

SEQ ID NO: 117469 - DNA, 20 bp, Artificial Sequence
  chemically synthesized
ctcttgcccaggctgtagtg

SEQ ID NO: 117470 - DNA, 20 bp, Artificial Sequence
  chemically synthesized
cgcaccactgcactacagcc

SEQ ID NO: 117471 - DNA, 20 bp, Artificial Sequence
  chemically synthesized
gcaccactgcactacagcct

SEQ ID NO: 117472 - DNA, 20 bp, Artificial Sequence
  chemically synthesized
tcgctctcttgcccaggctg

SEQ ID NO: 117473 - DNA, 20 bp, Artificial Sequence
  chemically synthesized
cactgcactacagcctgggc

SEQ ID NO: 117474 - DNA, 20 bp, Artificial Sequence
  chemically synthesized
ctgcactacagcctgggcaa

SEQ ID NO: 117475 - DNA, 20 bp, Artificial Sequence
  chemically synthesized
ggagtctcgctctcttgccc

SEQ ID NO: 117476 - DNA, 20 bp, Artificial Sequence
  chemically synthesized
gcactacagcctgggcaaga

SEQ ID NO: 117477 - DNA, 20 bp, Artificial Sequence
  chemically synthesized
cggagtctcgctctcttgcc

SEQ ID NO: 117478 - DNA, 20 bp, Artificial Sequence
  chemically synthesized
tacagcctgggcaagagagc

SEQ ID NO: 117479 - DNA, 20 bp, Artificial Sequence
  chemically synthesized
ttttttttttttttgagacg

SEQ ID NO: 117480 - DNA, 20 bp, Artificial Sequence
  chemically synthesized
ttttttttttttttttgaga

SEQ ID NO: 117481 - DNA, 20 bp, Artificial Sequence
  chemically synthesized
tttttttttttttttttttt

SEQ ID NO: 117482 - DNA, 20 bp, Artificial Sequence
  chemically synthesized
caaaaaaaaaaaaaaaaaaa

SEQ ID NO: 117483 - DNA, 20 bp, Artificial Sequence
  chemically synthesized
aaaaaaaaaaaaaaaaaaaa

SEQ ID NO: 117484 - DNA, 20 bp, Artificial Sequence
  chemically synthesized
aaaaaaaaaaaaaaaggaat

SEQ ID NO: 117485 - DNA, 20 bp, Artificial Sequence
  chemically synthesized
aaaaaaaaaaaaaaggaata

SEQ ID NO: 117486 - DNA, 20 bp, Artificial Sequence
  chemically synthesized
aaaaaaaaaaaaggaataag

SEQ ID NO: 117487 - DNA, 20 bp, Artificial Sequence
  chemically synthesized
aaaaaaaaaaggaataagga

SEQ ID NO: 117488 - DNA, 20 bp, Artificial Sequence
  chemically synthesized
aaaaaaaaggaataaggaga

SEQ ID NO: 117489 - DNA, 20 bp, Artificial Sequence
  chemically synthesized
aaaaaaaggaataaggagag

SEQ ID NO: 117490 - DNA, 20 bp, Artificial Sequence
  chemically synthesized
aaggaataaggagagaggca

SEQ ID NO: 117491 - DNA, 20 bp, Artificial Sequence
  chemically synthesized
ataaggagagaggcaaagtt

SEQ ID NO: 117492 - DNA, 20 bp, Artificial Sequence
  chemically synthesized
taaggagagaggcaaagttg

SEQ ID NO: 117493 - DNA, 20 bp, Artificial Sequence
  chemically synthesized
gagagaggcaaagttgagga

SEQ ID NO: 117494 - DNA, 20 bp, Artificial Sequence
  chemically synthesized
agagaggcaaagttgaggac

SEQ ID NO: 117495 - DNA, 20 bp, Artificial Sequence
  chemically synthesized
aaagttgaggacaggcgcac

SEQ ID NO: 117496 - DNA, 20 bp, Artificial Sequence
  chemically synthesized
aagttgaggacaggcgcact

SEQ ID NO: 117497 - DNA, 20 bp, Artificial Sequence
  chemically synthesized
agttgaggacaggcgcactg

SEQ ID NO: 117498 - DNA, 20 bp, Artificial Sequence
  chemically synthesized
tgttatttctgtcatttccc

SEQ ID NO: 117499 - DNA, 20 bp, Artificial Sequence
  chemically synthesized
caggcgcactggggaaatga

SEQ ID NO: 117500 - DNA, 20 bp, Artificial Sequence
  chemically synthesized
aaatgacagaaataacaact

SEQ ID NO: 117501 - DNA, 20 bp, Artificial Sequence
  chemically synthesized
atgacagaaataacaactca

SEQ ID NO: 117502 - DNA, 20 bp, Artificial Sequence
  chemically synthesized
agaaataacaactcagagaa

SEQ ID NO: 117503 - DNA, 20 bp, Artificial Sequence
  chemically synthesized
gcacttactcacttttctct

SEQ ID NO: 117504 - DNA, 20 bp, Artificial Sequence
  chemically synthesized
ataacaactcagagaaaagt

SEQ ID NO: 117505 - DNA, 20 bp, Artificial Sequence
  chemically synthesized
caactcagagaaaagtgagt

SEQ ID NO: 117506 - DNA, 20 bp, Artificial Sequence
  chemically synthesized
agtaagtgcaacatctcttt

SEQ ID NO: 117507 - DNA, 20 bp, Artificial Sequence
  chemically synthesized
tgggaataacaagactcaaa

SEQ ID NO: 117508 - DNA, 20 bp, Artificial Sequence
  chemically synthesized
tttgggaataacaagactca

SEQ ID NO: 117509 - DNA, 20 bp, Artificial Sequence
  chemically synthesized
tagggatgtttgggaataac

SEQ ID NO: 117510 - DNA, 20 bp, Artificial Sequence
  chemically synthesized
ttgggtgaatagggatgttt

SEQ ID NO: 117511 - DNA, 20 bp, Artificial Sequence
  chemically synthesized
tttgggtgaatagggatgtt

SEQ ID NO: 117512 - DNA, 20 bp, Artificial Sequence
  chemically synthesized
tgttaatctttgggtgaata

SEQ ID NO: 117513 - DNA, 20 bp, Artificial Sequence
  chemically synthesized
atgttaatctttgggtgaat

SEQ ID NO: 117514 - DNA, 20 bp, Artificial Sequence
  chemically synthesized
aatgttaatctttgggtgaa

SEQ ID NO: 117515 - DNA, 20 bp, Artificial Sequence
  chemically synthesized
caaacatccctattcaccca

SEQ ID NO: 117516 - DNA, 20 bp, Artificial Sequence
  chemically synthesized
tgtaggaaatgttaatcttt

SEQ ID NO: 117517 - DNA, 20 bp, Artificial Sequence
  chemically synthesized
ttgtaggaaatgttaatctt

SEQ ID NO: 117518 - DNA, 20 bp, Artificial Sequence
  chemically synthesized
caaagattaacatttcctac

SEQ ID NO: 117519 - DNA, 20 bp, Artificial Sequence
  chemically synthesized
ttcataacatggtgtcttgt

SEQ ID NO: 117520 - DNA, 20 bp, Artificial Sequence
  chemically synthesized
attcataacatggtgtcttg

SEQ ID NO: 117521 - DNA, 20 bp, Artificial Sequence
  chemically synthesized
agttaaggatattcataaca

SEQ ID NO: 117522 - DNA, 20 bp, Artificial Sequence
  chemically synthesized
ttatgaatatccttaactaa

SEQ ID NO: 117523 - DNA, 20 bp, Artificial Sequence
  chemically synthesized
tgagggatatccattagtta

SEQ ID NO: 117524 - DNA, 20 bp, Artificial Sequence
  chemically synthesized
ttgagggatatccattagtt

SEQ ID NO: 117525 - DNA, 20 bp, Artificial Sequence
  chemically synthesized
tcttcttgagggatatccat

SEQ ID NO: 117526 - DNA, 20 bp, Artificial Sequence
  chemically synthesized
ttaactaatggatatccctc

SEQ ID NO: 117527 - DNA, 20 bp, Artificial Sequence
  chemically synthesized
actaatggatatccctcaag

SEQ ID NO: 117528 - DNA, 20 bp, Artificial Sequence
  chemically synthesized
aaataaatatttcttcttga

SEQ ID NO: 117529 - DNA, 20 bp, Artificial Sequence
  chemically synthesized
aaaataaatatttcttcttg

SEQ ID NO: 117530 - DNA, 20 bp, Artificial Sequence
  chemically synthesized
aaaaataaatatttcttctt

SEQ ID NO: 117531 - DNA, 20 bp, Artificial Sequence
  chemically synthesized
agaaatatttatttttctta

SEQ ID NO: 117532 - DNA, 20 bp, Artificial Sequence
  chemically synthesized
tatttatttttcttatagta

SEQ ID NO: 117533 - DNA, 20 bp, Artificial Sequence
  chemically synthesized
aatgtatgtaactgtactat

SEQ ID NO: 117534 - DNA, 20 bp, Artificial Sequence
  chemically synthesized
atagtacagttacatacatt

SEQ ID NO: 117535 - DNA, 20 bp, Artificial Sequence
  chemically synthesized
tagtacagttacatacattt

SEQ ID NO: 117536 - DNA, 20 bp, Artificial Sequence
  chemically synthesized
agttacatacatttgggaat

SEQ ID NO: 117537 - DNA, 20 bp, Artificial Sequence
  chemically synthesized
catacatttgggaattagaa

SEQ ID NO: 117538 - DNA, 20 bp, Artificial Sequence
  chemically synthesized
aattagaatggatttttaat

SEQ ID NO: 117539 - DNA, 20 bp, Artificial Sequence
  chemically synthesized
ttttaattggtttctgatcc

SEQ ID NO: 117540 - DNA, 20 bp, Artificial Sequence
  chemically synthesized
aaaatgattaaaacttggat

SEQ ID NO: 117541 - DNA, 20 bp, Artificial Sequence
  chemically synthesized
cctgcaaaatgattaaaact

SEQ ID NO: 117542 - DNA, 20 bp, Artificial Sequence
  chemically synthesized
tccaagttttaatcattttg

SEQ ID NO: 117543 - DNA, 20 bp, Artificial Sequence
  chemically synthesized
ccaagttttaatcattttgc

SEQ ID NO: 117544 - DNA, 20 bp, Artificial Sequence
  chemically synthesized
gttttaatcattttgcagga

SEQ ID NO: 117545 - DNA, 20 bp, Artificial Sequence
  chemically synthesized
ttaatcattttgcaggaaag

SEQ ID NO: 117546 - DNA, 20 bp, Artificial Sequence
  chemically synthesized
tcattttgcaggaaagaagc

SEQ ID NO: 117547 - DNA, 20 bp, Artificial Sequence
  chemically synthesized
cattttgcaggaaagaagcc

SEQ ID NO: 117548 - DNA, 20 bp, Artificial Sequence
  chemically synthesized
ttcatatgttgtaagagtcc

SEQ ID NO: 117549 - DNA, 20 bp, Artificial Sequence
  chemically synthesized
tgagtattcatatgttgtaa

SEQ ID NO: 117550 - DNA, 20 bp, Artificial Sequence
  chemically synthesized
gatgagtattcatatgttgt

SEQ ID NO: 117551 - DNA, 20 bp, Artificial Sequence
  chemically synthesized
tgatattatacataatagat

SEQ ID NO: 117552 - DNA, 20 bp, Artificial Sequence
  chemically synthesized
ttaaatgatattatacataa

SEQ ID NO: 117553 - DNA, 20 bp, Artificial Sequence
  chemically synthesized
tattatgtataatatcattt

SEQ ID NO: 117554 - DNA, 20 bp, Artificial Sequence
  chemically synthesized
tatgtataatatcatttaag

SEQ ID NO: 117555 - DNA, 20 bp, Artificial Sequence
  chemically synthesized
tgcacatccacaaagatttg

SEQ ID NO: 117556 - DNA, 20 bp, Artificial Sequence
  chemically synthesized
atgcacatccacaaagattt

SEQ ID NO: 117557 - DNA, 20 bp, Artificial Sequence
  chemically synthesized
tatgcacatccacaaagatt

SEQ ID NO: 117558 - DNA, 20 bp, Artificial Sequence
  chemically synthesized
gattttgccccaaatctttg

SEQ ID NO: 117559 - DNA, 20 bp, Artificial Sequence
  chemically synthesized
ttcaattatgcacatccaca

SEQ ID NO: 117560 - DNA, 20 bp, Artificial Sequence
  chemically synthesized
tttgtggatgtgcataattg

SEQ ID NO: 117561 - DNA, 20 bp, Artificial Sequence
  chemically synthesized
gatgtgcataattgaagaaa

SEQ ID NO: 117562 - DNA, 20 bp, Artificial Sequence
  chemically synthesized
aagataatgttattacttct

SEQ ID NO: 117563 - DNA, 20 bp, Artificial Sequence
  chemically synthesized
ccgtcaattaatttaccgag

SEQ ID NO: 117564 - DNA, 20 bp, Artificial Sequence
  chemically synthesized
aaaccgtcaattaatttacc

SEQ ID NO: 117565 - DNA, 20 bp, Artificial Sequence
  chemically synthesized
cttctcggtaaattaattga

SEQ ID NO: 117566 - DNA, 20 bp, Artificial Sequence
  chemically synthesized
taattgacggtttctccttt

SEQ ID NO: 117567 - DNA, 20 bp, Artificial Sequence
  chemically synthesized
attgttgaccaatcttaaag

SEQ ID NO: 117568 - DNA, 20 bp, Artificial Sequence
  chemically synthesized
gacggtttctcctttaagat

SEQ ID NO: 117569 - DNA, 20 bp, Artificial Sequence
  chemically synthesized
agattgttgaccaatcttaa

SEQ ID NO: 117570 - DNA, 20 bp, Artificial Sequence
  chemically synthesized
cagattgttgaccaatctta

SEQ ID NO: 117571 - DNA, 20 bp, Artificial Sequence
  chemically synthesized
ttaagattggtcaacaatct

SEQ ID NO: 117572 - DNA, 20 bp, Artificial Sequence
  chemically synthesized
gaagtgttgctcatagtact

SEQ ID NO: 117573 - DNA, 20 bp, Artificial Sequence
  chemically synthesized
gtcaacaatctgagtactat

SEQ ID NO: 117574 - DNA, 20 bp, Artificial Sequence
  chemically synthesized
tatagaagaagtgttgctca

SEQ ID NO: 117575 - DNA, 20 bp, Artificial Sequence
  chemically synthesized
tatgagcaacacttcttcta

SEQ ID NO: 117576 - DNA, 20 bp, Artificial Sequence
  chemically synthesized
gagaacagaatctatagaag

SEQ ID NO: 117577 - DNA, 20 bp, Artificial Sequence
  chemically synthesized
aaggagaacagaatctatag

SEQ ID NO: 117578 - DNA, 20 bp, Artificial Sequence
  chemically synthesized
ctaaaggagaacagaatcta

SEQ ID NO: 117579 - DNA, 20 bp, Artificial Sequence
  chemically synthesized
ttttgttttctaaaggagaa

SEQ ID NO: 117580 - DNA, 20 bp, Artificial Sequence
  chemically synthesized
ctatagattctgttctcctt

SEQ ID NO: 117581 - DNA, 20 bp, Artificial Sequence
  chemically synthesized
gtgaattttgttttctaaag

SEQ ID NO: 117582 - DNA, 20 bp, Artificial Sequence
  chemically synthesized
acgtgaattttgttttctaa

SEQ ID NO: 117583 - DNA, 20 bp, Artificial Sequence
  chemically synthesized
gacgtgaattttgttttcta

SEQ ID NO: 117584 - DNA, 20 bp, Artificial Sequence
  chemically synthesized
aaaattcacgtcttctgttg

SEQ ID NO: 117585 - DNA, 20 bp, Artificial Sequence
  chemically synthesized
aagatttaattctacaacag

SEQ ID NO: 117586 - DNA, 20 bp, Artificial Sequence
  chemically synthesized
tcaaagatttaattctacaa

SEQ ID NO: 117587 - DNA, 20 bp, Artificial Sequence
  chemically synthesized
ttgtagaattaaatctttga

SEQ ID NO: 117588 - DNA, 20 bp, Artificial Sequence
  chemically synthesized
ctcaacattaagaactgtca

SEQ ID NO: 117589 - DNA, 20 bp, Artificial Sequence
  chemically synthesized
ctttgacagttcttaatgtt

SEQ ID NO: 117590 - DNA, 20 bp, Artificial Sequence
  chemically synthesized
tttttatttttctcaacatt

SEQ ID NO: 117591 - DNA, 20 bp, Artificial Sequence
  chemically synthesized
aaataaaaatatcctcacga

SEQ ID NO: 117592 - DNA, 20 bp, Artificial Sequence
  chemically synthesized
aaagaatgttgactttcgtg

SEQ ID NO: 117593 - DNA, 20 bp, Artificial Sequence
  chemically synthesized
taaagaatgttgactttcgt

SEQ ID NO: 117594 - DNA, 20 bp, Artificial Sequence
  chemically synthesized
ctcttttctcaataatatta

SEQ ID NO: 117595 - DNA, 20 bp, Artificial Sequence
  chemically synthesized
caacattctttaatattatt

SEQ ID NO: 117596 - DNA, 20 bp, Artificial Sequence
  chemically synthesized
ttctttaatattattgagaa

SEQ ID NO: 117597 - DNA, 20 bp, Artificial Sequence
  chemically synthesized
ctttaatattattgagaaaa

SEQ ID NO: 117598 - DNA, 20 bp, Artificial Sequence
  chemically synthesized
ttcacattttattaaaacta

SEQ ID NO: 117599 - DNA, 20 bp, Artificial Sequence
  chemically synthesized
acacttatagcagtggaccg

SEQ ID NO: 117600 - DNA, 20 bp, Artificial Sequence
  chemically synthesized
aaactacggtccactgctat

SEQ ID NO: 117601 - DNA, 20 bp, Artificial Sequence
  chemically synthesized
cttcatgacacttatagcag

SEQ ID NO: 117602 - DNA, 20 bp, Artificial Sequence
  chemically synthesized
taacttcatgacacttatag

SEQ ID NO: 117603 - DNA, 20 bp, Artificial Sequence
  chemically synthesized
tgttaacttcatgacactta

SEQ ID NO: 117604 - DNA, 20 bp, Artificial Sequence
  chemically synthesized
ccactgctataagtgtcatg

SEQ ID NO: 117605 - DNA, 20 bp, Artificial Sequence
  chemically synthesized
tcatgaagttaacatatacc

SEQ ID NO: 117606 - DNA, 20 bp, Artificial Sequence
  chemically synthesized
aagttaacatatacctagta

SEQ ID NO: 117607 - DNA, 20 bp, Artificial Sequence
  chemically synthesized
tattttttacaaactttact

SEQ ID NO: 117608 - DNA, 20 bp, Artificial Sequence
  chemically synthesized
ttattttttacaaactttac

SEQ ID NO: 117609 - DNA, 20 bp, Artificial Sequence
  chemically synthesized
taaagtttgtaaaaaataat

SEQ ID NO: 117610 - DNA, 20 bp, Artificial Sequence
  chemically synthesized
tgtaaaaaataatcagaaat

SEQ ID NO: 117611 - DNA, 20 bp, Artificial Sequence
  chemically synthesized
aaataatcagaaataagctt

SEQ ID NO: 117612 - DNA, 20 bp, Artificial Sequence
  chemically synthesized
acatgtggattttttcacta

SEQ ID NO: 117613 - DNA, 20 bp, Artificial Sequence
  chemically synthesized
aaacagcaaaattcaacatg

SEQ ID NO: 117614 - DNA, 20 bp, Artificial Sequence
  chemically synthesized
ctttaaggtaatgtgagaaa

SEQ ID NO: 117615 - DNA, 20 bp, Artificial Sequence
  chemically synthesized
aaaacactttaaggtaatgt

SEQ ID NO: 117616 - DNA, 20 bp, Artificial Sequence
  chemically synthesized
ctgtttctcacattacctta

SEQ ID NO: 117617 - DNA, 20 bp, Artificial Sequence
  chemically synthesized
gaatttggaaaaacacttta

SEQ ID NO: 117618 - DNA, 20 bp, Artificial Sequence
  chemically synthesized
agaatttggaaaaacacttt

SEQ ID NO: 117619 - DNA, 20 bp, Artificial Sequence
  chemically synthesized
taaagtgtttttccaaattc

SEQ ID NO: 117620 - DNA, 20 bp, Artificial Sequence
  chemically synthesized
gatttggctaagctagaatt

SEQ ID NO: 117621 - DNA, 20 bp, Artificial Sequence
  chemically synthesized
tgtttttccaaattctagct

SEQ ID NO: 117622 - DNA, 20 bp, Artificial Sequence
  chemically synthesized
tccttatgatttggctaagc

SEQ ID NO: 117623 - DNA, 20 bp, Artificial Sequence
  chemically synthesized
agtttccttatgatttggct

SEQ ID NO: 117624 - DNA, 20 bp, Artificial Sequence
  chemically synthesized
ttctagcttagccaaatcat

SEQ ID NO: 117625 - DNA, 20 bp, Artificial Sequence
  chemically synthesized
tctagcttagccaaatcata

SEQ ID NO: 117626 - DNA, 20 bp, Artificial Sequence
  chemically synthesized
atttcagtttccttatgatt

SEQ ID NO: 117627 - DNA, 20 bp, Artificial Sequence
  chemically synthesized
aaatcataaggaaactgaaa

SEQ ID NO: 117628 - DNA, 20 bp, Artificial Sequence
  chemically synthesized
cactcaaaggatttctattt

SEQ ID NO: 117629 - DNA, 20 bp, Artificial Sequence
  chemically synthesized
aactgaaatagaaatccttt

SEQ ID NO: 117630 - DNA, 20 bp, Artificial Sequence
  chemically synthesized
agtatgtagtagtcactcaa

SEQ ID NO: 117631 - DNA, 20 bp, Artificial Sequence
  chemically synthesized
aagtatgtagtagtcactca

SEQ ID NO: 117632 - DNA, 20 bp, Artificial Sequence
  chemically synthesized
ccataatttaaagtatgtag

SEQ ID NO: 117633 - DNA, 20 bp, Artificial Sequence
  chemically synthesized
tatccataatttaaagtatg

SEQ ID NO: 117634 - DNA, 20 bp, Artificial Sequence
  chemically synthesized
ctactacatactttaaatta

SEQ ID NO: 117635 - DNA, 20 bp, Artificial Sequence
  chemically synthesized
aacatgatatccataattta

SEQ ID NO: 117636 - DNA, 20 bp, Artificial Sequence
  chemically synthesized
atatcatgttgtaaaacatc

SEQ ID NO: 117637 - DNA, 20 bp, Artificial Sequence
  chemically synthesized
atgacagcacaagaatgagc

SEQ ID NO: 117638 - DNA, 20 bp, Artificial Sequence
  chemically synthesized
aatcatgacagcacaagaat

SEQ ID NO: 117639 - DNA, 20 bp, Artificial Sequence
  chemically synthesized
ttggaaaatcatgacagcac

SEQ ID NO: 117640 - DNA, 20 bp, Artificial Sequence
  chemically synthesized
tttattttggaaaatcatga

SEQ ID NO: 117641 - DNA, 20 bp, Artificial Sequence
  chemically synthesized
aaacagcaaatgttttattt

SEQ ID NO: 117642 - DNA, 20 bp, Artificial Sequence
  chemically synthesized
aaaataaaacatttgctgtt

SEQ ID NO: 117643 - DNA, 20 bp, Artificial Sequence
  chemically synthesized
tttaaatgacaacatctaaa

SEQ ID NO: 117644 - DNA, 20 bp, Artificial Sequence
  chemically synthesized
tttagatgttgtcatttaaa

SEQ ID NO: 117645 - DNA, 20 bp, Artificial Sequence
  chemically synthesized
atcagttgactaatcattaa

SEQ ID NO: 117646 - DNA, 20 bp, Artificial Sequence
  chemically synthesized
ttaaaaagacccttaatgat

SEQ ID NO: 117647 - DNA, 20 bp, Artificial Sequence
  chemically synthesized
aatcagttgactaatcatta

SEQ ID NO: 117648 - DNA, 20 bp, Artificial Sequence
  chemically synthesized
aaatcagttgactaatcatt

SEQ ID NO: 117649 - DNA, 20 bp, Artificial Sequence
  chemically synthesized
tgaaatcaactaaagcaaat

SEQ ID NO: 117650 - DNA, 20 bp, Artificial Sequence
  chemically synthesized
attagtcaactgatttgctt

SEQ ID NO: 117651 - DNA, 20 bp, Artificial Sequence
  chemically synthesized
atatactttgaaatcaacta

SEQ ID NO: 117652 - DNA, 20 bp, Artificial Sequence
  chemically synthesized
atttgctttagttgatttca

SEQ ID NO: 117653 - DNA, 20 bp, Artificial Sequence
  chemically synthesized
tcatcatcaatgttgtcaat

SEQ ID NO: 117654 - DNA, 20 bp, Artificial Sequence
  chemically synthesized
acaacttgtatgggattttt

SEQ ID NO: 117655 - DNA, 20 bp, Artificial Sequence
  chemically synthesized
aatacttaaaaatcccatac

SEQ ID NO: 117656 - DNA, 20 bp, Artificial Sequence
  chemically synthesized
gttcagtggacaacttgtat

SEQ ID NO: 117657 - DNA, 20 bp, Artificial Sequence
  chemically synthesized
tgttcagtggacaacttgta

SEQ ID NO: 117658 - DNA, 20 bp, Artificial Sequence
  chemically synthesized
gaaatgaccaaattgttcag

SEQ ID NO: 117659 - DNA, 20 bp, Artificial Sequence
  chemically synthesized
aagttgtccactgaacaatt

SEQ ID NO: 117660 - DNA, 20 bp, Artificial Sequence
  chemically synthesized
aaggaaatgaccaaattgtt

SEQ ID NO: 117661 - DNA, 20 bp, Artificial Sequence
  chemically synthesized
cattaataaggaaatgaata

SEQ ID NO: 117662 - DNA, 20 bp, Artificial Sequence
  chemically synthesized
gcattaataaggaaatgaat

SEQ ID NO: 117663 - DNA, 20 bp, Artificial Sequence
  chemically synthesized
tgcttctgtgagcattaata

SEQ ID NO: 117664 - DNA, 20 bp, Artificial Sequence
  chemically synthesized
atgcttctgtgagcattaat

SEQ ID NO: 117665 - DNA, 20 bp, Artificial Sequence
  chemically synthesized
catttccttattaatgctca

SEQ ID NO: 117666 - DNA, 20 bp, Artificial Sequence
  chemically synthesized
ttccttattaatgctcacag

SEQ ID NO: 117667 - DNA, 20 bp, Artificial Sequence
  chemically synthesized
aatgataactatgcttctgt

SEQ ID NO: 117668 - DNA, 20 bp, Artificial Sequence
  chemically synthesized
tattaatgctcacagaagca

SEQ ID NO: 117669 - DNA, 20 bp, Artificial Sequence
  chemically synthesized
catagttatcattttttttt

SEQ ID NO: 117670 - DNA, 20 bp, Artificial Sequence
  chemically synthesized
gttatcattttttttttagt

SEQ ID NO: 117671 - DNA, 20 bp, Artificial Sequence
  chemically synthesized
attttttttttagtgagtca

SEQ ID NO: 117672 - DNA, 20 bp, Artificial Sequence
  chemically synthesized
ttttttagtgagtcacagaa

SEQ ID NO: 117673 - DNA, 20 bp, Artificial Sequence
  chemically synthesized
tttttagtgagtcacagaat

SEQ ID NO: 117674 - DNA, 20 bp, Artificial Sequence
  chemically synthesized
aaataaggaaaacggaacat

SEQ ID NO: 117675 - DNA, 20 bp, Artificial Sequence
  chemically synthesized
atagagcaaaataaggaaaa

SEQ ID NO: 117676 - DNA, 20 bp, Artificial Sequence
  chemically synthesized
aaaactgatagagcaaaata

SEQ ID NO: 117677 - DNA, 20 bp, Artificial Sequence
  chemically synthesized
caaaactgatagagcaaaat

SEQ ID NO: 117678 - DNA, 20 bp, Artificial Sequence
  chemically synthesized
ttttccttattttgctctat

SEQ ID NO: 117679 - DNA, 20 bp, Artificial Sequence
  chemically synthesized
ttgggctcacaaaactgata

SEQ ID NO: 117680 - DNA, 20 bp, Artificial Sequence
  chemically synthesized
ctttgggctcacaaaactga

SEQ ID NO: 117681 - DNA, 20 bp, Artificial Sequence
  chemically synthesized
ttttgctctatcagttttgt

SEQ ID NO: 117682 - DNA, 20 bp, Artificial Sequence
  chemically synthesized
ctatcagttttgtgagccca

SEQ ID NO: 117683 - DNA, 20 bp, Artificial Sequence
  chemically synthesized
gtggtcaactttatttcttt

SEQ ID NO: 117684 - DNA, 20 bp, Artificial Sequence
  chemically synthesized
tgtggtcaactttatttctt

SEQ ID NO: 117685 - DNA, 20 bp, Artificial Sequence
  chemically synthesized
tttgtgagcccaaagaaata

SEQ ID NO: 117686 - DNA, 20 bp, Artificial Sequence
  chemically synthesized
caaagaaataaagttgacca

SEQ ID NO: 117687 - DNA, 20 bp, Artificial Sequence
  chemically synthesized
aataaagttgaccacagcaa

SEQ ID NO: 117688 - DNA, 20 bp, Artificial Sequence
  chemically synthesized
ccccagcactgcttttgctg

SEQ ID NO: 117689 - DNA, 20 bp, Artificial Sequence
  chemically synthesized
aaagttgaccacagcaaaag

SEQ ID NO: 117690 - DNA, 20 bp, Artificial Sequence
  chemically synthesized
gaccacagcaaaagcagtgc

SEQ ID NO: 117691 - DNA, 20 bp, Artificial Sequence
  chemically synthesized
accacagcaaaagcagtgct

SEQ ID NO: 117692 - DNA, 20 bp, Artificial Sequence
  chemically synthesized
ccacagcaaaagcagtgctg

SEQ ID NO: 117693 - DNA, 20 bp, Artificial Sequence
  chemically synthesized
cagcaaaagcagtgctgggg

SEQ ID NO: 117694 - DNA, 20 bp, Artificial Sequence
  chemically synthesized
gcaaaagcagtgctggggaa

SEQ ID NO: 117695 - DNA, 20 bp, Artificial Sequence
  chemically synthesized
caaaagcagtgctggggaag

SEQ ID NO: 117696 - DNA, 20 bp, Artificial Sequence
  chemically synthesized
ctataaactggcctcttccc

SEQ ID NO: 117697 - DNA, 20 bp, Artificial Sequence
  chemically synthesized
agcagtgctggggaagaggc

SEQ ID NO: 117698 - DNA, 20 bp, Artificial Sequence
  chemically synthesized
ctggggaagaggccagttta

SEQ ID NO: 117699 - DNA, 20 bp, Artificial Sequence
  chemically synthesized
tggggaagaggccagtttat

SEQ ID NO: 117700 - DNA, 20 bp, Artificial Sequence
  chemically synthesized
attgcagttatcctataaac

SEQ ID NO: 117701 - DNA, 20 bp, Artificial Sequence
  chemically synthesized
tttccaagtaaaaggtattg

SEQ ID NO: 117702 - DNA, 20 bp, Artificial Sequence
  chemically synthesized
taactgcaataccttttact

SEQ ID NO: 117703 - DNA, 20 bp, Artificial Sequence
  chemically synthesized
caaacatatttccaagtaaa

SEQ ID NO: 117704 - DNA, 20 bp, Artificial Sequence
  chemically synthesized
tcaaacatatttccaagtaa

SEQ ID NO: 117705 - DNA, 20 bp, Artificial Sequence
  chemically synthesized
tgatcttcaaacatatttcc

SEQ ID NO: 117706 - DNA, 20 bp, Artificial Sequence
  chemically synthesized
tttacttggaaatatgtttg

SEQ ID NO: 117707 - DNA, 20 bp, Artificial Sequence
  chemically synthesized
tatgtttgaagatcacctga

SEQ ID NO: 117708 - DNA, 20 bp, Artificial Sequence
  chemically synthesized
cctgtgtcaattaaactttc

SEQ ID NO: 117709 - DNA, 20 bp, Artificial Sequence
  chemically synthesized
tcctgtgtcaattaaacttt

SEQ ID NO: 117710 - DNA, 20 bp, Artificial Sequence
  chemically synthesized
acctgaaagtttaattgaca

SEQ ID NO: 117711 - DNA, 20 bp, Artificial Sequence
  chemically synthesized
cctgaaagtttaattgacac

SEQ ID NO: 117712 - DNA, 20 bp, Artificial Sequence
  chemically synthesized
aaagtttaattgacacagga

SEQ ID NO: 117713 - DNA, 20 bp, Artificial Sequence
  chemically synthesized
aagtttaattgacacaggat

SEQ ID NO: 117714 - DNA, 20 bp, Artificial Sequence
  chemically synthesized
ttaattgacacaggatggga

SEQ ID NO: 117715 - DNA, 20 bp, Artificial Sequence
  chemically synthesized
acaggatgggacagcacatc

SEQ ID NO: 117716 - DNA, 20 bp, Artificial Sequence
  chemically synthesized
caggatgggacagcacatct

SEQ ID NO: 117717 - DNA, 20 bp, Artificial Sequence
  chemically synthesized
gacagcacatctaggaaaaa

SEQ ID NO: 117718 - DNA, 20 bp, Artificial Sequence
  chemically synthesized
tgaatggcatccatttttcc

SEQ ID NO: 117719 - DNA, 20 bp, Artificial Sequence
  chemically synthesized
taggaaaaatggatgccatt

SEQ ID NO: 117720 - DNA, 20 bp, Artificial Sequence
  chemically synthesized
cggaagaacgattgtctgaa

SEQ ID NO: 117721 - DNA, 20 bp, Artificial Sequence
  chemically synthesized
gatagtcagatcaaaatcgg

SEQ ID NO: 117722 - DNA, 20 bp, Artificial Sequence
  chemically synthesized
acagatagtcagatcaaaat

SEQ ID NO: 117723 - DNA, 20 bp, Artificial Sequence
  chemically synthesized
ccgcaaagcgaacagatagt

SEQ ID NO: 117724 - DNA, 20 bp, Artificial Sequence
  chemically synthesized
tacaccgcaaagcgaacaga

SEQ ID NO: 117725 - DNA, 20 bp, Artificial Sequence
  chemically synthesized
gatatacaccgcaaagcgaa

SEQ ID NO: 117726 - DNA, 20 bp, Artificial Sequence
  chemically synthesized
ctgactatctgttcgctttg

SEQ ID NO: 117727 - DNA, 20 bp, Artificial Sequence
  chemically synthesized
acaatttgatatacaccgca

SEQ ID NO: 117728 - DNA, 20 bp, Artificial Sequence
  chemically synthesized
attaaatttcaaaaacatca

SEQ ID NO: 117729 - DNA, 20 bp, Artificial Sequence
  chemically synthesized
ttaaatttcaaaaacatcac

SEQ ID NO: 117730 - DNA, 20 bp, Artificial Sequence
  chemically synthesized
tcaaaaacatcacaggtcta

SEQ ID NO: 117731 - DNA, 20 bp, Artificial Sequence
  chemically synthesized
caaaaacatcacaggtctac

SEQ ID NO: 117732 - DNA, 20 bp, Artificial Sequence
  chemically synthesized
aaaaacatcacaggtctaca

SEQ ID NO: 117733 - DNA, 20 bp, Artificial Sequence
  chemically synthesized
ggggaactaatgattccctg

SEQ ID NO: 117734 - DNA, 20 bp, Artificial Sequence
  chemically synthesized
acaggtctacagggaatcat

SEQ ID NO: 117735 - DNA, 20 bp, Artificial Sequence
  chemically synthesized
agggaatcattagttccccc

SEQ ID NO: 117736 - DNA, 20 bp, Artificial Sequence
  chemically synthesized
caactctcgaaagtacttgg

SEQ ID NO: 117737 - DNA, 20 bp, Artificial Sequence
  chemically synthesized
tcaactctcgaaagtacttg

SEQ ID NO: 117738 - DNA, 20 bp, Artificial Sequence
  chemically synthesized
gtcaactctcgaaagtactt

SEQ ID NO: 117739 - DNA, 20 bp, Artificial Sequence
  chemically synthesized
agtcaactctcgaaagtact

SEQ ID NO: 117740 - DNA, 20 bp, Artificial Sequence
  chemically synthesized
tagttcccccaagtactttc

SEQ ID NO: 117741 - DNA, 20 bp, Artificial Sequence
  chemically synthesized
gttcccccaagtactttcga

SEQ ID NO: 117742 - DNA, 20 bp, Artificial Sequence
  chemically synthesized
gagctacagtcaactctcga

SEQ ID NO: 117743 - DNA, 20 bp, Artificial Sequence
  chemically synthesized
gtactttcgagagttgactg

SEQ ID NO: 117744 - DNA, 20 bp, Artificial Sequence
  chemically synthesized
gcagggaagtaaaagagcta

SEQ ID NO: 117745 - DNA, 20 bp, Artificial Sequence
  chemically synthesized
attacagcagggaagtaaaa

SEQ ID NO: 117746 - DNA, 20 bp, Artificial Sequence
  chemically synthesized
tcattacagcagggaagtaa

SEQ ID NO: 117747 - DNA, 20 bp, Artificial Sequence
  chemically synthesized
ttcctgtcattacagcaggg

SEQ ID NO: 117748 - DNA, 20 bp, Artificial Sequence
  chemically synthesized
cgtttcctgtcattacagca

SEQ ID NO: 117749 - DNA, 20 bp, Artificial Sequence
  chemically synthesized
acgtttcctgtcattacagc

SEQ ID NO: 117750 - DNA, 20 bp, Artificial Sequence
  chemically synthesized
cacgtttcctgtcattacag

SEQ ID NO: 117751 - DNA, 20 bp, Artificial Sequence
  chemically synthesized
ttacttccctgctgtaatga

SEQ ID NO: 117752 - DNA, 20 bp, Artificial Sequence
  chemically synthesized
tacttccctgctgtaatgac

SEQ ID NO: 117753 - DNA, 20 bp, Artificial Sequence
  chemically synthesized
gaccacgtttcctgtcatta

SEQ ID NO: 117754 - DNA, 20 bp, Artificial Sequence
  chemically synthesized
tgctgtaatgacaggaaacg

SEQ ID NO: 117755 - DNA, 20 bp, Artificial Sequence
  chemically synthesized
gtgggagatagcaataaatt

SEQ ID NO: 117756 - DNA, 20 bp, Artificial Sequence
  chemically synthesized
tctctaagagaggtgggaga

SEQ ID NO: 117757 - DNA, 20 bp, Artificial Sequence
  chemically synthesized
atggtctctaagagaggtgg

SEQ ID NO: 117758 - DNA, 20 bp, Artificial Sequence
  chemically synthesized
caatggtctctaagagaggt

SEQ ID NO: 117759 - DNA, 20 bp, Artificial Sequence
  chemically synthesized
ttgctatctcccacctctct

SEQ ID NO: 117760 - DNA, 20 bp, Artificial Sequence
  chemically synthesized
acaatggtctctaagagagg

SEQ ID NO: 117761 - DNA, 20 bp, Artificial Sequence
  chemically synthesized
gctatctcccacctctctta

SEQ ID NO: 117762 - DNA, 20 bp, Artificial Sequence
  chemically synthesized
tgaacaatggtctctaagag

SEQ ID NO: 117763 - DNA, 20 bp, Artificial Sequence
  chemically synthesized
atgaacaatggtctctaaga

SEQ ID NO: 117764 - DNA, 20 bp, Artificial Sequence
  chemically synthesized
aaatgaacaatggtctctaa

SEQ ID NO: 117765 - DNA, 20 bp, Artificial Sequence
  chemically synthesized
tgaaatgaacaatggtctct

SEQ ID NO: 117766 - DNA, 20 bp, Artificial Sequence
  chemically synthesized
tggatgagtgaaatgaacaa

SEQ ID NO: 117767 - DNA, 20 bp, Artificial Sequence
  chemically synthesized
attcaggaaggaaaatggat

SEQ ID NO: 117768 - DNA, 20 bp, Artificial Sequence
  chemically synthesized
catttattcaggaaggaaaa

SEQ ID NO: 117769 - DNA, 20 bp, Artificial Sequence
  chemically synthesized
ctattgacatttattcagga

SEQ ID NO: 117770 - DNA, 20 bp, Artificial Sequence
  chemically synthesized
cctattgacatttattcagg

SEQ ID NO: 117771 - DNA, 20 bp, Artificial Sequence
  chemically synthesized
tttcctattgacatttattc

SEQ ID NO: 117772 - DNA, 20 bp, Artificial Sequence
  chemically synthesized
ttttcctattgacatttatt

SEQ ID NO: 117773 - DNA, 20 bp, Artificial Sequence
  chemically synthesized
ccttcctgaataaatgtcaa

SEQ ID NO: 117774 - DNA, 20 bp, Artificial Sequence
  chemically synthesized
cttcctgaataaatgtcaat

SEQ ID NO: 117775 - DNA, 20 bp, Artificial Sequence
  chemically synthesized
taaatgtcaataggaaaaat

SEQ ID NO: 117776 - DNA, 20 bp, Artificial Sequence
  chemically synthesized
ttttgataaactatatttta

SEQ ID NO: 117777 - DNA, 20 bp, Artificial Sequence
  chemically synthesized
gtttatcaaactataaaata

SEQ ID NO: 117778 - DNA, 20 bp, Artificial Sequence
  chemically synthesized
ggtgaaaaagaaagcatata

SEQ ID NO: 117779 - DNA, 20 bp, Artificial Sequence
  chemically synthesized
caataagaaggtgaaaaaga

SEQ ID NO: 117780 - DNA, 20 bp, Artificial Sequence
  chemically synthesized
ttgtcaataagaaggtgaaa

SEQ ID NO: 117781 - DNA, 20 bp, Artificial Sequence
  chemically synthesized
gacaaatgttgtcaataaga

SEQ ID NO: 117782 - DNA, 20 bp, Artificial Sequence
  chemically synthesized
ggacaaatgttgtcaataag

SEQ ID NO: 117783 - DNA, 20 bp, Artificial Sequence
  chemically synthesized
atcggacaaatgttgtcaat

SEQ ID NO: 117784 - DNA, 20 bp, Artificial Sequence
  chemically synthesized
caacatttgtccgattatat

SEQ ID NO: 117785 - DNA, 20 bp, Artificial Sequence
  chemically synthesized
ctggaacctgctaatataat

SEQ ID NO: 117786 - DNA, 20 bp, Artificial Sequence
  chemically synthesized
catttgtccgattatattag

SEQ ID NO: 117787 - DNA, 20 bp, Artificial Sequence
  chemically synthesized
atttgtccgattatattagc

SEQ ID NO: 117788 - DNA, 20 bp, Artificial Sequence
  chemically synthesized
ccgattatattagcaggttc

SEQ ID NO: 117789 - DNA, 20 bp, Artificial Sequence
  chemically synthesized
cgattatattagcaggttcc

SEQ ID NO: 117790 - DNA, 20 bp, Artificial Sequence
  chemically synthesized
tattagcaggttccaggact

SEQ ID NO: 117791 - DNA, 20 bp, Artificial Sequence
  chemically synthesized
ataattgttaaacttagtcc

SEQ ID NO: 117792 - DNA, 20 bp, Artificial Sequence
  chemically synthesized
ttaacaataattgttaaact

SEQ ID NO: 117793 - DNA, 20 bp, Artificial Sequence
  chemically synthesized
taagtttaacaattattgtt

SEQ ID NO: 117794 - DNA, 20 bp, Artificial Sequence
  chemically synthesized
agtttaacaattattgttaa

SEQ ID NO: 117795 - DNA, 20 bp, Artificial Sequence
  chemically synthesized
attattgttaagagtttttg

SEQ ID NO: 117796 - DNA, 20 bp, Artificial Sequence
  chemically synthesized
ttattgttaagagtttttgt

SEQ ID NO: 117797 - DNA, 20 bp, Artificial Sequence
  chemically synthesized
tattgttaagagtttttgta

SEQ ID NO: 117798 - DNA, 20 bp, Artificial Sequence
  chemically synthesized
agagtttttgtagggaaaaa

SEQ ID NO: 117799 - DNA, 20 bp, Artificial Sequence
  chemically synthesized
gggaaaaatggtatttcttg

SEQ ID NO: 117800 - DNA, 20 bp, Artificial Sequence
  chemically synthesized
tcaactactaatatatctac

SEQ ID NO: 117801 - DNA, 20 bp, Artificial Sequence
  chemically synthesized
ggtatttcttgtagatatat

SEQ ID NO: 117802 - DNA, 20 bp, Artificial Sequence
  chemically synthesized
atttcttgtagatatattag

SEQ ID NO: 117803 - DNA, 20 bp, Artificial Sequence
  chemically synthesized
tgataatttatgtaaaaatt

SEQ ID NO: 117804 - DNA, 20 bp, Artificial Sequence
  chemically synthesized
taaaaatttagtgtttgtga

SEQ ID NO: 117805 - DNA, 20 bp, Artificial Sequence
  chemically synthesized
aaaaatttagtgtttgtgat

SEQ ID NO: 117806 - DNA, 20 bp, Artificial Sequence
  chemically synthesized
tcaaatgaaaagttttaaaa

SEQ ID NO: 117807 - DNA, 20 bp, Artificial Sequence
  chemically synthesized
tgttcatattttcaaatgaa

SEQ ID NO: 117808 - DNA, 20 bp, Artificial Sequence
  chemically synthesized
gacatgattagatggggaaa

SEQ ID NO: 117809 - DNA, 20 bp, Artificial Sequence
  chemically synthesized
aggaaagacatgattagatg

SEQ ID NO: 117810 - DNA, 20 bp, Artificial Sequence
  chemically synthesized
caggaaagacatgattagat

SEQ ID NO: 117811 - DNA, 20 bp, Artificial Sequence
  chemically synthesized
tcaggaaagacatgattaga

SEQ ID NO: 117812 - DNA, 20 bp, Artificial Sequence
  chemically synthesized
tgcttcaggaaagacatgat

SEQ ID NO: 117813 - DNA, 20 bp, Artificial Sequence
  chemically synthesized
atctaatcatgtctttcctg

SEQ ID NO: 117814 - DNA, 20 bp, Artificial Sequence
  chemically synthesized
taaaaatatatgcttcagga

SEQ ID NO: 117815 - DNA, 20 bp, Artificial Sequence
  chemically synthesized
actttaaaaatatatgcttc

SEQ ID NO: 117816 - DNA, 20 bp, Artificial Sequence
  chemically synthesized
tactttaaaaatatatgctt

SEQ ID NO: 117817 - DNA, 20 bp, Artificial Sequence
  chemically synthesized
tcctgaagcatatattttta

SEQ ID NO: 117818 - DNA, 20 bp, Artificial Sequence
  chemically synthesized
tgaagcatatatttttaaag

SEQ ID NO: 117819 - DNA, 20 bp, Artificial Sequence
  chemically synthesized
tcacatgttgcaagttttaa

SEQ ID NO: 117820 - DNA, 20 bp, Artificial Sequence
  chemically synthesized
catcacatgttgcaagtttt

SEQ ID NO: 117821 - DNA, 20 bp, Artificial Sequence
  chemically synthesized
atagctacatcacatgttgc

SEQ ID NO: 117822 - DNA, 20 bp, Artificial Sequence
  chemically synthesized
aaaacttgcaacatgtgatg

SEQ ID NO: 117823 - DNA, 20 bp, Artificial Sequence
  chemically synthesized
catgcagattaaaataatta

SEQ ID NO: 117824 - DNA, 20 bp, Artificial Sequence
  chemically synthesized
ttatcctattatttttcatg

SEQ ID NO: 117825 - DNA, 20 bp, Artificial Sequence
  chemically synthesized
ttaatctgcatgaaaaataa

SEQ ID NO: 117826 - DNA, 20 bp, Artificial Sequence
  chemically synthesized
taatctgcatgaaaaataat

SEQ ID NO: 117827 - DNA, 20 bp, Artificial Sequence
  chemically synthesized
aaataataggataaaaatta

SEQ ID NO: 117828 - DNA, 20 bp, Artificial Sequence
  chemically synthesized
taggataaaaattaaagtat

SEQ ID NO: 117829 - DNA, 20 bp, Artificial Sequence
  chemically synthesized
tatcagtgtaattttgatgt

SEQ ID NO: 117830 - DNA, 20 bp, Artificial Sequence
  chemically synthesized
aaacaaatgtgcaatgttat

SEQ ID NO: 117831 - DNA, 20 bp, Artificial Sequence
  chemically synthesized
acattgcacatttgttttgt

SEQ ID NO: 117832 - DNA, 20 bp, Artificial Sequence
  chemically synthesized
atattattcttatatcattt

SEQ ID NO: 117833 - DNA, 20 bp, Artificial Sequence
  chemically synthesized
aatatgtgctcaaatgatat

SEQ ID NO: 117834 - DNA, 20 bp, Artificial Sequence
  chemically synthesized
aaatgatataagaataatat

SEQ ID NO: 117835 - DNA, 20 bp, Artificial Sequence
  chemically synthesized
aatgatataagaataatatt

SEQ ID NO: 117836 - DNA, 20 bp, Artificial Sequence
  chemically synthesized
agaataatattaggtaaata

SEQ ID NO: 117837 - DNA, 20 bp, Artificial Sequence
  chemically synthesized
aatattaggtaaatatggaa

SEQ ID NO: 117838 - DNA, 20 bp, Artificial Sequence
  chemically synthesized
attaggtaaatatggaaaag

SEQ ID NO: 117839 - DNA, 20 bp, Artificial Sequence
  chemically synthesized
tatggaaaagtagttctatg

SEQ ID NO: 117840 - DNA, 20 bp, Artificial Sequence
  chemically synthesized
tttaaaaaatgtattcttca

SEQ ID NO: 117841 - DNA, 20 bp, Artificial Sequence
  chemically synthesized
aatacattttttaaaaatct

SEQ ID NO: 117842 - DNA, 20 bp, Artificial Sequence
  chemically synthesized
tttcactgcattgatgaact

SEQ ID NO: 117843 - DNA, 20 bp, Artificial Sequence
  chemically synthesized
aaaatcttagttcatcaatg

SEQ ID NO: 117844 - DNA, 20 bp, Artificial Sequence
  chemically synthesized
ttagttcatcaatgcagtga

SEQ ID NO: 117845 - DNA, 20 bp, Artificial Sequence
  chemically synthesized
caatgcagtgaaagcaaata

SEQ ID NO: 117846 - DNA, 20 bp, Artificial Sequence
  chemically synthesized
aaagcaaatacagaattctc

SEQ ID NO: 117847 - DNA, 20 bp, Artificial Sequence
  chemically synthesized
taatttaatgggagaatcta

SEQ ID NO: 117848 - DNA, 20 bp, Artificial Sequence
  chemically synthesized
tataatttaatgggagaatc

SEQ ID NO: 117849 - DNA, 20 bp, Artificial Sequence
  chemically synthesized
atactgttataatttaatgg

SEQ ID NO: 117850 - DNA, 20 bp, Artificial Sequence
  chemically synthesized
gaatactgttataatttaat

SEQ ID NO: 117851 - DNA, 20 bp, Artificial Sequence
  chemically synthesized
tgaatactgttataatttaa

SEQ ID NO: 117852 - DNA, 20 bp, Artificial Sequence
  chemically synthesized
attctcccattaaattataa

SEQ ID NO: 117853 - DNA, 20 bp, Artificial Sequence
  chemically synthesized
cattaaattataacagtatt

SEQ ID NO: 117854 - DNA, 20 bp, Artificial Sequence
  chemically synthesized
cttcttccaccatatattga

SEQ ID NO: 117855 - DNA, 20 bp, Artificial Sequence
  chemically synthesized
ttcagaattctttcaatata

SEQ ID NO: 117856 - DNA, 20 bp, Artificial Sequence
  chemically synthesized
agaattctttcaatatatgg

SEQ ID NO: 117857 - DNA, 20 bp, Artificial Sequence
  chemically synthesized
attctttcaatatatggtgg

SEQ ID NO: 117858 - DNA, 20 bp, Artificial Sequence
  chemically synthesized
ctttcaatatatggtggaag

SEQ ID NO: 117859 - DNA, 20 bp, Artificial Sequence
  chemically synthesized
atatatggtggaagaagcaa

SEQ ID NO: 117860 - DNA, 20 bp, Artificial Sequence
  chemically synthesized
gaagcaaaagctgatattaa

SEQ ID NO: 117861 - DNA, 20 bp, Artificial Sequence
  chemically synthesized
gcataatattctattaatat

SEQ ID NO: 117862 - DNA, 20 bp, Artificial Sequence
  chemically synthesized
tagaatattatgccttttct

SEQ ID NO: 117863 - DNA, 20 bp, Artificial Sequence
  chemically synthesized
tataatgtttttctgagaaa

SEQ ID NO: 117864 - DNA, 20 bp, Artificial Sequence
  chemically synthesized
gtataatgtttttctgagaa

SEQ ID NO: 117865 - DNA, 20 bp, Artificial Sequence
  chemically synthesized
tgaaagtataatgtttttct

SEQ ID NO: 117866 - DNA, 20 bp, Artificial Sequence
  chemically synthesized
agaaaaacattatactttca

SEQ ID NO: 117867 - DNA, 20 bp, Artificial Sequence
  chemically synthesized
tatgagtccacattctatga

SEQ ID NO: 117868 - DNA, 20 bp, Artificial Sequence
  chemically synthesized
cattatactttcatagaatg

SEQ ID NO: 117869 - DNA, 20 bp, Artificial Sequence
  chemically synthesized
ttctccatatacatatatat

SEQ ID NO: 117870 - DNA, 20 bp, Artificial Sequence
  chemically synthesized
tggactcatatatatgtata

SEQ ID NO: 117871 - DNA, 20 bp, Artificial Sequence
  chemically synthesized
gactcatatatatgtatatg

SEQ ID NO: 117872 - DNA, 20 bp, Artificial Sequence
  chemically synthesized
cagatactgcaatagatatt

SEQ ID NO: 117873 - DNA, 20 bp, Artificial Sequence
  chemically synthesized
aatgtgctcaatatctattg

SEQ ID NO: 117874 - DNA, 20 bp, Artificial Sequence
  chemically synthesized
ctctttgccagatactgcaa

SEQ ID NO: 117875 - DNA, 20 bp, Artificial Sequence
  chemically synthesized
tcaatatctattgcagtatc

SEQ ID NO: 117876 - DNA, 20 bp, Artificial Sequence
  chemically synthesized
atctattgcagtatctggca

SEQ ID NO: 117877 - DNA, 20 bp, Artificial Sequence
  chemically synthesized
ctattgcagtatctggcaaa

SEQ ID NO: 117878 - DNA, 20 bp, Artificial Sequence
  chemically synthesized
attaagcactcactctttgc

SEQ ID NO: 117879 - DNA, 20 bp, Artificial Sequence
  chemically synthesized
tgcagtatctggcaaagagt

SEQ ID NO: 117880 - DNA, 20 bp, Artificial Sequence
  chemically synthesized
taagtgcttcagtaaaaatt

SEQ ID NO: 117881 - DNA, 20 bp, Artificial Sequence
  chemically synthesized
tgagtgcttaatttttactg

SEQ ID NO: 117882 - DNA, 20 bp, Artificial Sequence
  chemically synthesized
cattttctaattaagtgctt

SEQ ID NO: 117883 - DNA, 20 bp, Artificial Sequence
  chemically synthesized
tttttactgaagcacttaat

SEQ ID NO: 117884 - DNA, 20 bp, Artificial Sequence
  chemically synthesized
atatttgccattttctaatt

SEQ ID NO: 117885 - DNA, 20 bp, Artificial Sequence
  chemically synthesized
tgaagcacttaattagaaaa

SEQ ID NO: 117886 - DNA, 20 bp, Artificial Sequence
  chemically synthesized
agaaaatggcaaatatatgt

SEQ ID NO: 117887 - DNA, 20 bp, Artificial Sequence
  chemically synthesized
tggcaaatatatgtcagtat

SEQ ID NO: 117888 - DNA, 20 bp, Artificial Sequence
  chemically synthesized
cagtatcagtattttcacca

SEQ ID NO: 117889 - DNA, 20 bp, Artificial Sequence
  chemically synthesized
ctatataatgaaagtatcta

SEQ ID NO: 117890 - DNA, 20 bp, Artificial Sequence
  chemically synthesized
ctgtgattactatataatga

SEQ ID NO: 117891 - DNA, 20 bp, Artificial Sequence
  chemically synthesized
ccatagatactttcattata

SEQ ID NO: 117892 - DNA, 20 bp, Artificial Sequence
  chemically synthesized
ctttcattatatagtaatca

SEQ ID NO: 117893 - DNA, 20 bp, Artificial Sequence
  chemically synthesized
tcattatatagtaatcacag

SEQ ID NO: 117894 - DNA, 20 bp, Artificial Sequence
  chemically synthesized
aagtcagaatcagacagtgg

SEQ ID NO: 117895 - DNA, 20 bp, Artificial Sequence
  chemically synthesized
tacaagtcagaatcagacag

SEQ ID NO: 117896 - DNA, 20 bp, Artificial Sequence
  chemically synthesized
aagtacaagtcagaatcaga

SEQ ID NO: 117897 - DNA, 20 bp, Artificial Sequence
  chemically synthesized
ttgaaagtacaagtcagaat

SEQ ID NO: 117898 - DNA, 20 bp, Artificial Sequence
  chemically synthesized
ctaactttgaaagtacaagt

SEQ ID NO: 117899 - DNA, 20 bp, Artificial Sequence
  chemically synthesized
tattctaactttgaaagtac

SEQ ID NO: 117900 - DNA, 20 bp, Artificial Sequence
  chemically synthesized
gattctgacttgtactttca

SEQ ID NO: 117901 - DNA, 20 bp, Artificial Sequence
  chemically synthesized
ctgacttgtactttcaaagt

SEQ ID NO: 117902 - DNA, 20 bp, Artificial Sequence
  chemically synthesized
ctttattattctaactttga

SEQ ID NO: 117903 - DNA, 20 bp, Artificial Sequence
  chemically synthesized
ctttcaaagttagaataata

SEQ ID NO: 117904 - DNA, 20 bp, Artificial Sequence
  chemically synthesized
ttagaataataaagctctgc

SEQ ID NO: 117905 - DNA, 20 bp, Artificial Sequence
  chemically synthesized
tagaataataaagctctgcc

SEQ ID NO: 117906 - DNA, 20 bp, Artificial Sequence
  chemically synthesized
tgaaaatgggttacctggca

SEQ ID NO: 117907 - DNA, 20 bp, Artificial Sequence
  chemically synthesized
tttgaaaatgggttacctgg

SEQ ID NO: 117908 - DNA, 20 bp, Artificial Sequence
  chemically synthesized
gcttttgaaaatgggttacc

SEQ ID NO: 117909 - DNA, 20 bp, Artificial Sequence
  chemically synthesized
caaagtttgcttttgaaaat

SEQ ID NO: 117910 - DNA, 20 bp, Artificial Sequence
  chemically synthesized
gccaggtaacccattttcaa

SEQ ID NO: 117911 - DNA, 20 bp, Artificial Sequence
  chemically synthesized
ccaaagtttgcttttgaaaa

SEQ ID NO: 117912 - DNA, 20 bp, Artificial Sequence
  chemically synthesized
ccattttcaaaagcaaactt

SEQ ID NO: 117913 - DNA, 20 bp, Artificial Sequence
  chemically synthesized
tgtattccaaagttttgcca

SEQ ID NO: 117914 - DNA, 20 bp, Artificial Sequence
  chemically synthesized
agcaaactttggcaaaactt

SEQ ID NO: 117915 - DNA, 20 bp, Artificial Sequence
  chemically synthesized
atcttcttttttgtattcca

SEQ ID NO: 117916 - DNA, 20 bp, Artificial Sequence
  chemically synthesized
caaaactttggaatacaaaa

SEQ ID NO: 117917 - DNA, 20 bp, Artificial Sequence
  chemically synthesized
aactttggaatacaaaaaag

SEQ ID NO: 117918 - DNA, 20 bp, Artificial Sequence
  chemically synthesized
ttggaatacaaaaaagaaga

SEQ ID NO: 117919 - DNA, 20 bp, Artificial Sequence
  chemically synthesized
ggaatacaaaaaagaagatg

SEQ ID NO: 117920 - DNA, 20 bp, Artificial Sequence
  chemically synthesized
aatacaaaaaagaagatgga

SEQ ID NO: 117921 - DNA, 20 bp, Artificial Sequence
  chemically synthesized
tggagagaaacttgcctttc

SEQ ID NO: 117922 - DNA, 20 bp, Artificial Sequence
  chemically synthesized
gccattcttcctggaaaggc

SEQ ID NO: 117923 - DNA, 20 bp, Artificial Sequence
  chemically synthesized
ggagagaaacttgcctttcc

SEQ ID NO: 117924 - DNA, 20 bp, Artificial Sequence
  chemically synthesized
gagaaacttgcctttccagg

SEQ ID NO: 117925 - DNA, 20 bp, Artificial Sequence
  chemically synthesized
ctttgccattcttcctggaa

SEQ ID NO: 117926 - DNA, 20 bp, Artificial Sequence
  chemically synthesized
tctttgccattcttcctgga

SEQ ID NO: 117927 - DNA, 20 bp, Artificial Sequence
  chemically synthesized
acttgcctttccaggaagaa

SEQ ID NO: 117928 - DNA, 20 bp, Artificial Sequence
  chemically synthesized
cacatctttgccattcttcc

SEQ ID NO: 117929 - DNA, 20 bp, Artificial Sequence
  chemically synthesized
cctttccaggaagaatggca

SEQ ID NO: 117930 - DNA, 20 bp, Artificial Sequence
  chemically synthesized
caggaagaatggcaaagatg

SEQ ID NO: 117931 - DNA, 20 bp, Artificial Sequence
  chemically synthesized
aagaatggcaaagatgtggt

SEQ ID NO: 117932 - DNA, 20 bp, Artificial Sequence
  chemically synthesized
gatgtggtgagatgccctct

SEQ ID NO: 117933 - DNA, 20 bp, Artificial Sequence
  chemically synthesized
tgtggtgagatgccctctta

SEQ ID NO: 117934 - DNA, 20 bp, Artificial Sequence
  chemically synthesized
ttaacatactggctctaaga

SEQ ID NO: 117935 - DNA, 20 bp, Artificial Sequence
  chemically synthesized
attaacatactggctctaag

SEQ ID NO: 117936 - DNA, 20 bp, Artificial Sequence
  chemically synthesized
gtgagatgccctcttagagc

SEQ ID NO: 117937 - DNA, 20 bp, Artificial Sequence
  chemically synthesized
tattaacatactggctctaa

SEQ ID NO: 117938 - DNA, 20 bp, Artificial Sequence
  chemically synthesized
cgtattaacatactggctct

SEQ ID NO: 117939 - DNA, 20 bp, Artificial Sequence
  chemically synthesized
ttattagcgtattaacatac

SEQ ID NO: 117940 - DNA, 20 bp, Artificial Sequence
  chemically synthesized
gtatgttaatacgctaataa

SEQ ID NO: 117941 - DNA, 20 bp, Artificial Sequence
  chemically synthesized
tgttaatacgctaataaaag

SEQ ID NO: 117942 - DNA, 20 bp, Artificial Sequence
  chemically synthesized
taagtcttttctacttttat

SEQ ID NO: 117943 - DNA, 20 bp, Artificial Sequence
  chemically synthesized
atacgctaataaaagtagaa

SEQ ID NO: 117944 - DNA, 20 bp, Artificial Sequence
  chemically synthesized
taaaagtagaaaagacttac

SEQ ID NO: 117945 - DNA, 20 bp, Artificial Sequence
  chemically synthesized
atatttcaaatagttctagt

SEQ ID NO: 117946 - DNA, 20 bp, Artificial Sequence
  chemically synthesized
tttgatatttcaaatagttc

SEQ ID NO: 117947 - DNA, 20 bp, Artificial Sequence
  chemically synthesized
ttactttttgatatttcaaa

SEQ ID NO: 117948 - DNA, 20 bp, Artificial Sequence
  chemically synthesized
gaactatttgaaatatcaaa

SEQ ID NO: 117949 - DNA, 20 bp, Artificial Sequence
  chemically synthesized
agtaacacatcactgtatgt

SEQ ID NO: 117950 - DNA, 20 bp, Artificial Sequence
  chemically synthesized
tttgagaattttctcacata

SEQ ID NO: 117951 - DNA, 20 bp, Artificial Sequence
  chemically synthesized
tatgtgagaaaattctcaaa

SEQ ID NO: 117952 - DNA, 20 bp, Artificial Sequence
  chemically synthesized
gttaggttctgtaacttttt

SEQ ID NO: 117953 - DNA, 20 bp, Artificial Sequence
  chemically synthesized
agaaaattctcaaaaagtta

SEQ ID NO: 117954 - DNA, 20 bp, Artificial Sequence
  chemically synthesized
agcatcacctatatgatgtt

SEQ ID NO: 117955 - DNA, 20 bp, Artificial Sequence
  chemically synthesized
cagcatcacctatatgatgt

SEQ ID NO: 117956 - DNA, 20 bp, Artificial Sequence
  chemically synthesized
ttacagaacctaacatcata

SEQ ID NO: 117957 - DNA, 20 bp, Artificial Sequence
  chemically synthesized
tacagaacctaacatcatat

SEQ ID NO: 117958 - DNA, 20 bp, Artificial Sequence
  chemically synthesized
gtgtgtgtgtttttacattg

SEQ ID NO: 117959 - DNA, 20 bp, Artificial Sequence
  chemically synthesized
tgtaaaaacacacacacaca

SEQ ID NO: 117960 - DNA, 20 bp, Artificial Sequence
  chemically synthesized
aacacacacacacacagaaa

SEQ ID NO: 117961 - DNA, 20 bp, Artificial Sequence
  chemically synthesized
acacacacacacacagaaaa

SEQ ID NO: 117962 - DNA, 20 bp, Artificial Sequence
  chemically synthesized
acacacacacacagaaaaag

SEQ ID NO: 117963 - DNA, 20 bp, Artificial Sequence
  chemically synthesized
acacagaaaaaggagactga

SEQ ID NO: 117964 - DNA, 20 bp, Artificial Sequence
  chemically synthesized
gaaattcttgtatttgctat

SEQ ID NO: 117965 - DNA, 20 bp, Artificial Sequence
  chemically synthesized
aggagactgatagcaaatac

SEQ ID NO: 117966 - DNA, 20 bp, Artificial Sequence
  chemically synthesized
aaatacaagaatttctgtgt

SEQ ID NO: 117967 - DNA, 20 bp, Artificial Sequence
  chemically synthesized
agtttgtgttaattctgaca

SEQ ID NO: 117968 - DNA, 20 bp, Artificial Sequence
  chemically synthesized
gtgtcagaattaacacaaac

SEQ ID NO: 117969 - DNA, 20 bp, Artificial Sequence
  chemically synthesized
ttaacacaaactggtgtttt

SEQ ID NO: 117970 - DNA, 20 bp, Artificial Sequence
  chemically synthesized
ctttcctaagctcaaaacac

SEQ ID NO: 117971 - DNA, 20 bp, Artificial Sequence
  chemically synthesized
acaaactggtgttttgagct

SEQ ID NO: 117972 - DNA, 20 bp, Artificial Sequence
  chemically synthesized
caaactggtgttttgagctt

SEQ ID NO: 117973 - DNA, 20 bp, Artificial Sequence
  chemically synthesized
ctggtgttttgagcttagga

SEQ ID NO: 117974 - DNA, 20 bp, Artificial Sequence
  chemically synthesized
agagagtctgtgactttcct

SEQ ID NO: 117975 - DNA, 20 bp, Artificial Sequence
  chemically synthesized
ttttgagcttaggaaagtca

SEQ ID NO: 117976 - DNA, 20 bp, Artificial Sequence
  chemically synthesized
aaaggatactgaggcacaga

SEQ ID NO: 117977 - DNA, 20 bp, Artificial Sequence
  chemically synthesized
gtcacagactctctgtgcct

SEQ ID NO: 117978 - DNA, 20 bp, Artificial Sequence
  chemically synthesized
gaaaaggatactgaggcaca

SEQ ID NO: 117979 - DNA, 20 bp, Artificial Sequence
  chemically synthesized
gagaaaaggatactgaggca

SEQ ID NO: 117980 - DNA, 20 bp, Artificial Sequence
  chemically synthesized
tgacagagaaaaggatactg

SEQ ID NO: 117981 - DNA, 20 bp, Artificial Sequence
  chemically synthesized
atgacagagaaaaggatact

SEQ ID NO: 117982 - DNA, 20 bp, Artificial Sequence
  chemically synthesized
aaatatttatgacagagaaa

SEQ ID NO: 117983 - DNA, 20 bp, Artificial Sequence
  chemically synthesized
aaaatatttatgacagagaa

SEQ ID NO: 117984 - DNA, 20 bp, Artificial Sequence
  chemically synthesized
atatcaaaatatttatgaca

SEQ ID NO: 117985 - DNA, 20 bp, Artificial Sequence
  chemically synthesized
caatatcaaaatatttatga

SEQ ID NO: 117986 - DNA, 20 bp, Artificial Sequence
  chemically synthesized
aaatattttgatattgaaat

SEQ ID NO: 117987 - DNA, 20 bp, Artificial Sequence
  chemically synthesized
tattgaaattggtgacttca

SEQ ID NO: 117988 - DNA, 20 bp, Artificial Sequence
  chemically synthesized
attgaaattggtgacttcat

SEQ ID NO: 117989 - DNA, 20 bp, Artificial Sequence
  chemically synthesized
taggtctgagttaacctatg

SEQ ID NO: 117990 - DNA, 20 bp, Artificial Sequence
  chemically synthesized
ggtgacttcataggttaact

SEQ ID NO: 117991 - DNA, 20 bp, Artificial Sequence
  chemically synthesized
cataggttaactcagaccta

SEQ ID NO: 117992 - DNA, 20 bp, Artificial Sequence
  chemically synthesized
acgtgacattctataggtct

SEQ ID NO: 117993 - DNA, 20 bp, Artificial Sequence
  chemically synthesized
aaatgaacgtgacattctat

SEQ ID NO: 117994 - DNA, 20 bp, Artificial Sequence
  chemically synthesized
taaatgaacgtgacattcta

SEQ ID NO: 117995 - DNA, 20 bp, Artificial Sequence
  chemically synthesized
tatagaatgtcacgttcatt

SEQ ID NO: 117996 - DNA, 20 bp, Artificial Sequence
  chemically synthesized
tgtcacgttcatttagaata

SEQ ID NO: 117997 - DNA, 20 bp, Artificial Sequence
  chemically synthesized
gtcacgttcatttagaatat

SEQ ID NO: 117998 - DNA, 20 bp, Artificial Sequence
  chemically synthesized
cgttcatttagaatatggga

SEQ ID NO: 117999 - DNA, 20 bp, Artificial Sequence
  chemically synthesized
atatgggacagcaaattgta

SEQ ID NO: 118000 - DNA, 20 bp, Artificial Sequence
  chemically synthesized
ccaaatgagtagcaggtgga

SEQ ID NO: 118001 - DNA, 20 bp, Artificial Sequence
  chemically synthesized
tttgccaaatgagtagcagg

SEQ ID NO: 118002 - DNA, 20 bp, Artificial Sequence
  chemically synthesized
ctgtttgccaaatgagtagc

SEQ ID NO: 118003 - DNA, 20 bp, Artificial Sequence
  chemically synthesized
actgtttgccaaatgagtag

SEQ ID NO: 118004 - DNA, 20 bp, Artificial Sequence
  chemically synthesized
ctgtccacctgctactcatt

SEQ ID NO: 118005 - DNA, 20 bp, Artificial Sequence
  chemically synthesized
tgcactgtttgccaaatgag

SEQ ID NO: 118006 - DNA, 20 bp, Artificial Sequence
  chemically synthesized
atatgcactgtttgccaaat

SEQ ID NO: 118007 - DNA, 20 bp, Artificial Sequence
  chemically synthesized
cctgctactcatttggcaaa

SEQ ID NO: 118008 - DNA, 20 bp, Artificial Sequence
  chemically synthesized
ttggcaaacagtgcatatcc

SEQ ID NO: 118009 - DNA, 20 bp, Artificial Sequence
  chemically synthesized
tggcaaacagtgcatatccc

SEQ ID NO: 118010 - DNA, 20 bp, Artificial Sequence
  chemically synthesized
ggcaaacagtgcatatccca

SEQ ID NO: 118011 - DNA, 20 bp, Artificial Sequence
  chemically synthesized
caaacagtgcatatcccagg

SEQ ID NO: 118012 - DNA, 20 bp, Artificial Sequence
  chemically synthesized
acagtgcatatcccagggag

SEQ ID NO: 118013 - DNA, 20 bp, Artificial Sequence
  chemically synthesized
tgcgctgggttctgctccct

SEQ ID NO: 118014 - DNA, 20 bp, Artificial Sequence
  chemically synthesized
ttgcgctgggttctgctccc

SEQ ID NO: 118015 - DNA, 20 bp, Artificial Sequence
  chemically synthesized
atatcccagggagcagaacc

SEQ ID NO: 118016 - DNA, 20 bp, Artificial Sequence
  chemically synthesized
cagggagcagaacccagcgc

SEQ ID NO: 118017 - DNA, 20 bp, Artificial Sequence
  chemically synthesized
taggacagcttgcttgcgct

SEQ ID NO: 118018 - DNA, 20 bp, Artificial Sequence
  chemically synthesized
gtaggacagcttgcttgcgc

SEQ ID NO: 118019 - DNA, 20 bp, Artificial Sequence
  chemically synthesized
gagcagaacccagcgcaagc

SEQ ID NO: 118020 - DNA, 20 bp, Artificial Sequence
  chemically synthesized
cttaattgataatggtagga

SEQ ID NO: 118021 - DNA, 20 bp, Artificial Sequence
  chemically synthesized
agcccttaattgataatggt

SEQ ID NO: 118022 - DNA, 20 bp, Artificial Sequence
  chemically synthesized
aagcccttaattgataatgg

SEQ ID NO: 118023 - DNA, 20 bp, Artificial Sequence
  chemically synthesized
ttcaagcccttaattgataa

SEQ ID NO: 118024 - DNA, 20 bp, Artificial Sequence
  chemically synthesized
ctgtcctaccattatcaatt

SEQ ID NO: 118025 - DNA, 20 bp, Artificial Sequence
  chemically synthesized
tgtcctaccattatcaatta

SEQ ID NO: 118026 - DNA, 20 bp, Artificial Sequence
  chemically synthesized
gtcctaccattatcaattaa

SEQ ID NO: 118027 - DNA, 20 bp, Artificial Sequence
  chemically synthesized
cattatcaattaagggcttg

SEQ ID NO: 118028 - DNA, 20 bp, Artificial Sequence
  chemically synthesized
tcaattaagggcttgaagtc

SEQ ID NO: 118029 - DNA, 20 bp, Artificial Sequence
  chemically synthesized
tgggactcattcttgacttc

SEQ ID NO: 118030 - DNA, 20 bp, Artificial Sequence
  chemically synthesized
aagggcttgaagtcaagaat

SEQ ID NO: 118031 - DNA, 20 bp, Artificial Sequence
  chemically synthesized
tgaagtcaagaatgagtccc

SEQ ID NO: 118032 - DNA, 20 bp, Artificial Sequence
  chemically synthesized
aagaatgagtcccaagccac

SEQ ID NO: 118033 - DNA, 20 bp, Artificial Sequence
  chemically synthesized
ccttggcaaaccagtggctt

SEQ ID NO: 118034 - DNA, 20 bp, Artificial Sequence
  chemically synthesized
tccttggcaaaccagtggct

SEQ ID NO: 118035 - DNA, 20 bp, Artificial Sequence
  chemically synthesized
cagactccttggcaaaccag

SEQ ID NO: 118036 - DNA, 20 bp, Artificial Sequence
  chemically synthesized
tcccaagccactggtttgcc

SEQ ID NO: 118037 - DNA, 20 bp, Artificial Sequence
  chemically synthesized
ttgcagactccttggcaaac

SEQ ID NO: 118038 - DNA, 20 bp, Artificial Sequence
  chemically synthesized
cccaagccactggtttgcca

SEQ ID NO: 118039 - DNA, 20 bp, Artificial Sequence
  chemically synthesized
caagccactggtttgccaag

SEQ ID NO: 118040 - DNA, 20 bp, Artificial Sequence
  chemically synthesized
gcaagattttgcagactcct

SEQ ID NO: 118041 - DNA, 20 bp, Artificial Sequence
  chemically synthesized
aaagttctagcaagattttg

SEQ ID NO: 118042 - DNA, 20 bp, Artificial Sequence
  chemically synthesized
aggagtctgcaaaatcttgc

SEQ ID NO: 118043 - DNA, 20 bp, Artificial Sequence
  chemically synthesized
ttgaaagtcaaagttctagc

SEQ ID NO: 118044 - DNA, 20 bp, Artificial Sequence
  chemically synthesized
agaattgaaagtcaaagttc

SEQ ID NO: 118045 - DNA, 20 bp, Artificial Sequence
  chemically synthesized
agaaccagaattgaaagtca

SEQ ID NO: 118046 - DNA, 20 bp, Artificial Sequence
  chemically synthesized
agaactttgactttcaattc

SEQ ID NO: 118047 - DNA, 20 bp, Artificial Sequence
  chemically synthesized
gttgcaagaaccagaattga

SEQ ID NO: 118048 - DNA, 20 bp, Artificial Sequence
  chemically synthesized
aatagtgcagttgcaagaac

SEQ ID NO: 118049 - DNA, 20 bp, Artificial Sequence
  chemically synthesized
ttctttaatagtgcagttgc

SEQ ID NO: 118050 - DNA, 20 bp, Artificial Sequence
  chemically synthesized
gccaaggttctttaatagtg

SEQ ID NO: 118051 - DNA, 20 bp, Artificial Sequence
  chemically synthesized
ttcttgcaactgcactatta

SEQ ID NO: 118052 - DNA, 20 bp, Artificial Sequence
  chemically synthesized
aagaggccaaggttctttaa

SEQ ID NO: 118053 - DNA, 20 bp, Artificial Sequence
  chemically synthesized
actgcactattaaagaacct

SEQ ID NO: 118054 - DNA, 20 bp, Artificial Sequence
  chemically synthesized
tctactctaagaagaggcca

SEQ ID NO: 118055 - DNA, 20 bp, Artificial Sequence
  chemically synthesized
gtctactctaagaagaggcc

SEQ ID NO: 118056 - DNA, 20 bp, Artificial Sequence
  chemically synthesized
aaagaaccttggcctcttct

SEQ ID NO: 118057 - DNA, 20 bp, Artificial Sequence
  chemically synthesized
agaaccttggcctcttctta

SEQ ID NO: 118058 - DNA, 20 bp, Artificial Sequence
  chemically synthesized
acctggtctactctaagaag

SEQ ID NO: 118059 - DNA, 20 bp, Artificial Sequence
  chemically synthesized
gacctggtctactctaagaa

SEQ ID NO: 118060 - DNA, 20 bp, Artificial Sequence
  chemically synthesized
accttggcctcttcttagag

SEQ ID NO: 118061 - DNA, 20 bp, Artificial Sequence
  chemically synthesized
cggacctggtctactctaag

SEQ ID NO: 118062 - DNA, 20 bp, Artificial Sequence
  chemically synthesized
ggacggacctggtctactct

SEQ ID NO: 118063 - DNA, 20 bp, Artificial Sequence
  chemically synthesized
ggcctcttcttagagtagac

SEQ ID NO: 118064 - DNA, 20 bp, Artificial Sequence
  chemically synthesized
gcctcttcttagagtagacc

SEQ ID NO: 118065 - DNA, 20 bp, Artificial Sequence
  chemically synthesized
ctattcctggtggacggacc

SEQ ID NO: 118066 - DNA, 20 bp, Artificial Sequence
  chemically synthesized
agtagaccaggtccgtccac

SEQ ID NO: 118067 - DNA, 20 bp, Artificial Sequence
  chemically synthesized
gtagaccaggtccgtccacc

SEQ ID NO: 118068 - DNA, 20 bp, Artificial Sequence
  chemically synthesized
tagcaactattcctggtgga

SEQ ID NO: 118069 - DNA, 20 bp, Artificial Sequence
  chemically synthesized
ccaggtccgtccaccaggaa

SEQ ID NO: 118070 - DNA, 20 bp, Artificial Sequence
  chemically synthesized
ctcttagcaactattcctgg

SEQ ID NO: 118071 - DNA, 20 bp, Artificial Sequence
  chemically synthesized
taactcttagcaactattcc

SEQ ID NO: 118072 - DNA, 20 bp, Artificial Sequence
  chemically synthesized
gtccaccaggaatagttgct

SEQ ID NO: 118073 - DNA, 20 bp, Artificial Sequence
  chemically synthesized
ccaccaggaatagttgctaa

SEQ ID NO: 118074 - DNA, 20 bp, Artificial Sequence
  chemically synthesized
ggaatagttgctaagagtta

SEQ ID NO: 118075 - DNA, 20 bp, Artificial Sequence
  chemically synthesized
cctggccaacccataactct

SEQ ID NO: 118076 - DNA, 20 bp, Artificial Sequence
  chemically synthesized
gaatagttgctaagagttat

SEQ ID NO: 118077 - DNA, 20 bp, Artificial Sequence
  chemically synthesized
agttgctaagagttatgggt

SEQ ID NO: 118078 - DNA, 20 bp, Artificial Sequence
  chemically synthesized
gctaagagttatgggttggc

SEQ ID NO: 118079 - DNA, 20 bp, Artificial Sequence
  chemically synthesized
ctaagagttatgggttggcc

SEQ ID NO: 118080 - DNA, 20 bp, Artificial Sequence
  chemically synthesized
taagagttatgggttggcca

SEQ ID NO: 118081 - DNA, 20 bp, Artificial Sequence
  chemically synthesized
cttctcatgtagagtaaccc

SEQ ID NO: 118082 - DNA, 20 bp, Artificial Sequence
  chemically synthesized
tggccagggttactctacat

SEQ ID NO: 118083 - DNA, 20 bp, Artificial Sequence
  chemically synthesized
ccccatacacttctcatgta

SEQ ID NO: 118084 - DNA, 20 bp, Artificial Sequence
  chemically synthesized
ccagggttactctacatgag

SEQ ID NO: 118085 - DNA, 20 bp, Artificial Sequence
  chemically synthesized
acccccatacacttctcatg

SEQ ID NO: 118086 - DNA, 20 bp, Artificial Sequence
  chemically synthesized
tactctacatgagaagtgta

SEQ ID NO: 118087 - DNA, 20 bp, Artificial Sequence
  chemically synthesized
actctacatgagaagtgtat

SEQ ID NO: 118088 - DNA, 20 bp, Artificial Sequence
  chemically synthesized
ctctacatgagaagtgtatg

SEQ ID NO: 118089 - DNA, 20 bp, Artificial Sequence
  chemically synthesized
tctacatgagaagtgtatgg

SEQ ID NO: 118090 - DNA, 20 bp, Artificial Sequence
  chemically synthesized
gccaagcacttggtgtgtgt

SEQ ID NO: 118091 - DNA, 20 bp, Artificial Sequence
  chemically synthesized
ggggtttactcacacacacc

SEQ ID NO: 118092 - DNA, 20 bp, Artificial Sequence
  chemically synthesized
actcacacacaccaagtgct

SEQ ID NO: 118093 - DNA, 20 bp, Artificial Sequence
  chemically synthesized
cagaagcccagccaagcact

SEQ ID NO: 118094 - DNA, 20 bp, Artificial Sequence
  chemically synthesized
acacacaccaagtgcttggc

SEQ ID NO: 118095 - DNA, 20 bp, Artificial Sequence
  chemically synthesized
cacacaccaagtgcttggct

SEQ ID NO: 118096 - DNA, 20 bp, Artificial Sequence
  chemically synthesized
gcaattccagaagcccagcc

SEQ ID NO: 118097 - DNA, 20 bp, Artificial Sequence
  chemically synthesized
caagtgcttggctgggcttc

SEQ ID NO: 118098 - DNA, 20 bp, Artificial Sequence
  chemically synthesized
ggtaggcaattccagaagcc

SEQ ID NO: 118099 - DNA, 20 bp, Artificial Sequence
  chemically synthesized
tgacaggtaggcaattccag

SEQ ID NO: 118100 - DNA, 20 bp, Artificial Sequence
  chemically synthesized
tcctgacaggtaggcaattc

SEQ ID NO: 118101 - DNA, 20 bp, Artificial Sequence
  chemically synthesized
ttctggaattgcctacctgt

SEQ ID NO: 118102 - DNA, 20 bp, Artificial Sequence
  chemically synthesized
tctggaattgcctacctgtc

SEQ ID NO: 118103 - DNA, 20 bp, Artificial Sequence
  chemically synthesized
taaaacttatcctgacaggt

SEQ ID NO: 118104 - DNA, 20 bp, Artificial Sequence
  chemically synthesized
gtaaaacttatcctgacagg

SEQ ID NO: 118105 - DNA, 20 bp, Artificial Sequence
  chemically synthesized
acagtaaaacttatcctgac

SEQ ID NO: 118106 - DNA, 20 bp, Artificial Sequence
  chemically synthesized
aattgcctacctgtcaggat

SEQ ID NO: 118107 - DNA, 20 bp, Artificial Sequence
  chemically synthesized
aacagtaaaacttatcctga

SEQ ID NO: 118108 - DNA, 20 bp, Artificial Sequence
  chemically synthesized
aggataagttttactgttac

SEQ ID NO: 118109 - DNA, 20 bp, Artificial Sequence
  chemically synthesized
ataagttttactgttaccag

SEQ ID NO: 118110 - DNA, 20 bp, Artificial Sequence
  chemically synthesized
tgctaggttgctgctggtaa

SEQ ID NO: 118111 - DNA, 20 bp, Artificial Sequence
  chemically synthesized
cctagttgctaggttgctgc

SEQ ID NO: 118112 - DNA, 20 bp, Artificial Sequence
  chemically synthesized
tactgttaccagcagcaacc

SEQ ID NO: 118113 - DNA, 20 bp, Artificial Sequence
  chemically synthesized
accagcagcaacctagcaac

SEQ ID NO: 118114 - DNA, 20 bp, Artificial Sequence
  chemically synthesized
ccagcagcaacctagcaact

SEQ ID NO: 118115 - DNA, 20 bp, Artificial Sequence
  chemically synthesized
ttacttttagcctagttgct

SEQ ID NO: 118116 - DNA, 20 bp, Artificial Sequence
  chemically synthesized
attacttttagcctagttgc

SEQ ID NO: 118117 - DNA, 20 bp, Artificial Sequence
  chemically synthesized
caacctagcaactaggctaa

SEQ ID NO: 118118 - DNA, 20 bp, Artificial Sequence
  chemically synthesized
gctagtgattacttttagcc

SEQ ID NO: 118119 - DNA, 20 bp, Artificial Sequence
  chemically synthesized
accacgctagtgattacttt

SEQ ID NO: 118120 - DNA, 20 bp, Artificial Sequence
  chemically synthesized
actaggctaaaagtaatcac

SEQ ID NO: 118121 - DNA, 20 bp, Artificial Sequence
  chemically synthesized
gctaaaagtaatcactagcg

SEQ ID NO: 118122 - DNA, 20 bp, Artificial Sequence
  chemically synthesized
acctataaaccacaccacgc

SEQ ID NO: 118123 - DNA, 20 bp, Artificial Sequence
  chemically synthesized
aagtaatcactagcgtggtg

SEQ ID NO: 118124 - DNA, 20 bp, Artificial Sequence
  chemically synthesized
cactagcgtggtgtggttta

SEQ ID NO: 118125 - DNA, 20 bp, Artificial Sequence
  chemically synthesized
actagcgtggtgtggtttat

SEQ ID NO: 118126 - DNA, 20 bp, Artificial Sequence
  chemically synthesized
tgtggtttataggttttgtg

SEQ ID NO: 118127 - DNA, 20 bp, Artificial Sequence
  chemically synthesized
gtggtttataggttttgtgt

SEQ ID NO: 118128 - DNA, 20 bp, Artificial Sequence
  chemically synthesized
ggaagtaactcataattttg

SEQ ID NO: 118129 - DNA, 20 bp, Artificial Sequence
  chemically synthesized
tggaagtaactcataatttt

SEQ ID NO: 118130 - DNA, 20 bp, Artificial Sequence
  chemically synthesized
aaaaaaatcctcaaaattat

SEQ ID NO: 118131 - DNA, 20 bp, Artificial Sequence
  chemically synthesized
tcaacattctaatagaatgg

SEQ ID NO: 118132 - DNA, 20 bp, Artificial Sequence
  chemically synthesized
atgagttacttccattctat

SEQ ID NO: 118133 - DNA, 20 bp, Artificial Sequence
  chemically synthesized
tcatcaacattctaatagaa

SEQ ID NO: 118134 - DNA, 20 bp, Artificial Sequence
  chemically synthesized
tgtcttcatcaacattctaa

SEQ ID NO: 118135 - DNA, 20 bp, Artificial Sequence
  chemically synthesized
attctattagaatgttgatg

SEQ ID NO: 118136 - DNA, 20 bp, Artificial Sequence
  chemically synthesized
tattagaatgttgatgaaga

SEQ ID NO: 118137 - DNA, 20 bp, Artificial Sequence
  chemically synthesized
ttagaatgttgatgaagaca

SEQ ID NO: 118138 - DNA, 20 bp, Artificial Sequence
  chemically synthesized
gttgatgaagacagagtgtc

SEQ ID NO: 118139 - DNA, 20 bp, Artificial Sequence
  chemically synthesized
ttgatgaagacagagtgtca

SEQ ID NO: 118140 - DNA, 20 bp, Artificial Sequence
  chemically synthesized
gatgaagacagagtgtcaag

SEQ ID NO: 118141 - DNA, 20 bp, Artificial Sequence
  chemically synthesized
atgaagacagagtgtcaagg

SEQ ID NO: 118142 - DNA, 20 bp, Artificial Sequence
  chemically synthesized
tgaagacagagtgtcaagga

SEQ ID NO: 118143 - DNA, 20 bp, Artificial Sequence
  chemically synthesized
agagtgtcaaggagggttaa

SEQ ID NO: 118144 - DNA, 20 bp, Artificial Sequence
  chemically synthesized
agggttaatggcatttgttt

SEQ ID NO: 118145 - DNA, 20 bp, Artificial Sequence
  chemically synthesized
gggttaatggcatttgtttc

SEQ ID NO: 118146 - DNA, 20 bp, Artificial Sequence
  chemically synthesized
ggttaatggcatttgtttca

SEQ ID NO: 118147 - DNA, 20 bp, Artificial Sequence
  chemically synthesized
atggcatttgtttcagggaa

SEQ ID NO: 118148 - DNA, 20 bp, Artificial Sequence
  chemically synthesized
agggaaaagaaaaacgttat

SEQ ID NO: 118149 - DNA, 20 bp, Artificial Sequence
  chemically synthesized
gaaaagaaaaacgttattag

SEQ ID NO: 118150 - DNA, 20 bp, Artificial Sequence
  chemically synthesized
aaaacgttattagcagatcc

SEQ ID NO: 118151 - DNA, 20 bp, Artificial Sequence
  chemically synthesized
tagagtctattaaaattgct

SEQ ID NO: 118152 - DNA, 20 bp, Artificial Sequence
  chemically synthesized
atagagtctattaaaattgc

SEQ ID NO: 118153 - DNA, 20 bp, Artificial Sequence
  chemically synthesized
gcagatcccagcaattttaa

SEQ ID NO: 118154 - DNA, 20 bp, Artificial Sequence
  chemically synthesized
aatagaggcaatagacaata

SEQ ID NO: 118155 - DNA, 20 bp, Artificial Sequence
  chemically synthesized
acaatagaggcaatagacaa

SEQ ID NO: 118156 - DNA, 20 bp, Artificial Sequence
  chemically synthesized
gcaatcaacaatagaggcaa

SEQ ID NO: 118157 - DNA, 20 bp, Artificial Sequence
  chemically synthesized
cagatggcaatcaacaatag

SEQ ID NO: 118158 - DNA, 20 bp, Artificial Sequence
  chemically synthesized
gcagatggcaatcaacaata

SEQ ID NO: 118159 - DNA, 20 bp, Artificial Sequence
  chemically synthesized
tagcagatggcaatcaacaa

SEQ ID NO: 118160 - DNA, 20 bp, Artificial Sequence
  chemically synthesized
aaagtctctattttagcaga

SEQ ID NO: 118161 - DNA, 20 bp, Artificial Sequence
  chemically synthesized
ttgattgccatctgctaaaa

SEQ ID NO: 118162 - DNA, 20 bp, Artificial Sequence
  chemically synthesized
taataaagtctctattttag

SEQ ID NO: 118163 - DNA, 20 bp, Artificial Sequence
  chemically synthesized
gattgccatctgctaaaata

SEQ ID NO: 118164 - DNA, 20 bp, Artificial Sequence
  chemically synthesized
acttaataaagtctctattt

SEQ ID NO: 118165 - DNA, 20 bp, Artificial Sequence
  chemically synthesized
gctaaaatagagactttatt

SEQ ID NO: 118166 - DNA, 20 bp, Artificial Sequence
  chemically synthesized
aaaagaagctatacttaata

SEQ ID NO: 118167 - DNA, 20 bp, Artificial Sequence
  chemically synthesized
aatagagactttattaagta

SEQ ID NO: 118168 - DNA, 20 bp, Artificial Sequence
  chemically synthesized
agggatatcttcagtaaaag

SEQ ID NO: 118169 - DNA, 20 bp, Artificial Sequence
  chemically synthesized
aagtatagcttcttttactg

SEQ ID NO: 118170 - DNA, 20 bp, Artificial Sequence
  chemically synthesized
atcagggatatcttcagtaa

SEQ ID NO: 118171 - DNA, 20 bp, Artificial Sequence
  chemically synthesized
gaagtaatcagggatatctt

SEQ ID NO: 118172 - DNA, 20 bp, Artificial Sequence
  chemically synthesized
gaaatccaccgaagtaatca

SEQ ID NO: 118173 - DNA, 20 bp, Artificial Sequence
  chemically synthesized
agaaatccaccgaagtaatc

SEQ ID NO: 118174 - DNA, 20 bp, Artificial Sequence
  chemically synthesized
gaagatatccctgattactt

SEQ ID NO: 118175 - DNA, 20 bp, Artificial Sequence
  chemically synthesized
tagaaatccaccgaagtaat

SEQ ID NO: 118176 - DNA, 20 bp, Artificial Sequence
  chemically synthesized
gatatccctgattacttcgg

SEQ ID NO: 118177 - DNA, 20 bp, Artificial Sequence
  chemically synthesized
aattttttagaaatccaccg

SEQ ID NO: 118178 - DNA, 20 bp, Artificial Sequence
  chemically synthesized
aggatggaggagaaattttt

SEQ ID NO: 118179 - DNA, 20 bp, Artificial Sequence
  chemically synthesized
ttcccacaaggaggatggag

SEQ ID NO: 118180 - DNA, 20 bp, Artificial Sequence
  chemically synthesized
acttcccacaaggaggatgg

SEQ ID NO: 118181 - DNA, 20 bp, Artificial Sequence
  chemically synthesized
gacttcccacaaggaggatg

SEQ ID NO: 118182 - DNA, 20 bp, Artificial Sequence
  chemically synthesized
gagacttcccacaaggagga

SEQ ID NO: 118183 - DNA, 20 bp, Artificial Sequence
  chemically synthesized
tttctcctccatcctccttg

SEQ ID NO: 118184 - DNA, 20 bp, Artificial Sequence
  chemically synthesized
ttctcctccatcctccttgt

SEQ ID NO: 118185 - DNA, 20 bp, Artificial Sequence
  chemically synthesized
tcctgagacttcccacaagg

SEQ ID NO: 118186 - DNA, 20 bp, Artificial Sequence
  chemically synthesized
ttcctgagacttcccacaag

SEQ ID NO: 118187 - DNA, 20 bp, Artificial Sequence
  chemically synthesized
tcctccatcctccttgtggg

SEQ ID NO: 118188 - DNA, 20 bp, Artificial Sequence
  chemically synthesized
ttttcctgagacttcccaca

SEQ ID NO: 118189 - DNA, 20 bp, Artificial Sequence
  chemically synthesized
tttttcctgagacttcccac

SEQ ID NO: 118190 - DNA, 20 bp, Artificial Sequence
  chemically synthesized
atcctccttgtgggaagtct

SEQ ID NO: 118191 - DNA, 20 bp, Artificial Sequence
  chemically synthesized
tcctccttgtgggaagtctc

SEQ ID NO: 118192 - DNA, 20 bp, Artificial Sequence
  chemically synthesized
attgaatctttttttttcct

SEQ ID NO: 118193 - DNA, 20 bp, Artificial Sequence
  chemically synthesized
gggaagtctcaggaaaaaaa

SEQ ID NO: 118194 - DNA, 20 bp, Artificial Sequence
  chemically synthesized
aagattcaatatgattcaaa

SEQ ID NO: 118195 - DNA, 20 bp, Artificial Sequence
  chemically synthesized
agattcaatatgattcaaat

SEQ ID NO: 118196 - DNA, 20 bp, Artificial Sequence
  chemically synthesized
atgattcaaataggctctgc

SEQ ID NO: 118197 - DNA, 20 bp, Artificial Sequence
  chemically synthesized
gattcaaataggctctgcca

SEQ ID NO: 118198 - DNA, 20 bp, Artificial Sequence
  chemically synthesized
tagagattgattctctggca

SEQ ID NO: 118199 - DNA, 20 bp, Artificial Sequence
  chemically synthesized
gatagagattgattctctgg

SEQ ID NO: 118200 - DNA, 20 bp, Artificial Sequence
  chemically synthesized
gaggatagagattgattctc

SEQ ID NO: 118201 - DNA, 20 bp, Artificial Sequence
  chemically synthesized
ctagagacagagagaggata

SEQ ID NO: 118202 - DNA, 20 bp, Artificial Sequence
  chemically synthesized
agctagagacagagagagga

SEQ ID NO: 118203 - DNA, 20 bp, Artificial Sequence
  chemically synthesized
agctagctagagacagagag

SEQ ID NO: 118204 - DNA, 20 bp, Artificial Sequence
  chemically synthesized
tagctagctagagacagaga

SEQ ID NO: 118205 - DNA, 20 bp, Artificial Sequence
  chemically synthesized
gctagctagctagagacaga

SEQ ID NO: 118206 - DNA, 20 bp, Artificial Sequence
  chemically synthesized
ctctatcctctctctgtctc

SEQ ID NO: 118207 - DNA, 20 bp, Artificial Sequence
  chemically synthesized
tagctagctagctagagaca

SEQ ID NO: 118208 - DNA, 20 bp, Artificial Sequence
  chemically synthesized
attagctagctagctagaga

SEQ ID NO: 118209 - DNA, 20 bp, Artificial Sequence
  chemically synthesized
atcctctctctgtctctagc

SEQ ID NO: 118210 - DNA, 20 bp, Artificial Sequence
  chemically synthesized
attaattagctagctagcta

SEQ ID NO: 118211 - DNA, 20 bp, Artificial Sequence
  chemically synthesized
tctctctgtctctagctagc

SEQ ID NO: 118212 - DNA, 20 bp, Artificial Sequence
  chemically synthesized
tgattaattagctagctagc

SEQ ID NO: 118213 - DNA, 20 bp, Artificial Sequence
  chemically synthesized
atattgattaattagctagc

SEQ ID NO: 118214 - DNA, 20 bp, Artificial Sequence
  chemically synthesized
gggaatattgattaattagc

SEQ ID NO: 118215 - DNA, 20 bp, Artificial Sequence
  chemically synthesized
ttctgggaatattgattaat

SEQ ID NO: 118216 - DNA, 20 bp, Artificial Sequence
  chemically synthesized
agctaattaatcaatattcc

SEQ ID NO: 118217 - DNA, 20 bp, Artificial Sequence
  chemically synthesized
taatcaatattcccagaaaa

SEQ ID NO: 118218 - DNA, 20 bp, Artificial Sequence
  chemically synthesized
aagtttaaggacttttttct

SEQ ID NO: 118219 - DNA, 20 bp, Artificial Sequence
  chemically synthesized
gaagtttaaggacttttttc

SEQ ID NO: 118220 - DNA, 20 bp, Artificial Sequence
  chemically synthesized
catattctggtagaagttta

SEQ ID NO: 118221 - DNA, 20 bp, Artificial Sequence
  chemically synthesized
tcatattctggtagaagttt

SEQ ID NO: 118222 - DNA, 20 bp, Artificial Sequence
  chemically synthesized
aaaagtccttaaacttctac

SEQ ID NO: 118223 - DNA, 20 bp, Artificial Sequence
  chemically synthesized
cttacctcatattctggtag

SEQ ID NO: 118224 - DNA, 20 bp, Artificial Sequence
  chemically synthesized
attcttacctcatattctgg

SEQ ID NO: 118225 - DNA, 20 bp, Artificial Sequence
  chemically synthesized
ttaaacttctaccagaatat

SEQ ID NO: 118226 - DNA, 20 bp, Artificial Sequence
  chemically synthesized
taaacttctaccagaatatg

SEQ ID NO: 118227 - DNA, 20 bp, Artificial Sequence
  chemically synthesized
gttattcttacctcatattc

SEQ ID NO: 118228 - DNA, 20 bp, Artificial Sequence
  chemically synthesized
cttctaccagaatatgaggt

SEQ ID NO: 118229 - DNA, 20 bp, Artificial Sequence
  chemically synthesized
agaatatgaggtaagaataa

SEQ ID NO: 118230 - DNA, 20 bp, Artificial Sequence
  chemically synthesized
tgaggtaagaataacagcct

SEQ ID NO: 118231 - DNA, 20 bp, Artificial Sequence
  chemically synthesized
aggtaagaataacagccttg

SEQ ID NO: 118232 - DNA, 20 bp, Artificial Sequence
  chemically synthesized
ggtaagaataacagccttgg

SEQ ID NO: 118233 - DNA, 20 bp, Artificial Sequence
  chemically synthesized
taagaataacagccttggag

SEQ ID NO: 118234 - DNA, 20 bp, Artificial Sequence
  chemically synthesized
ttttttctatgactcctcca

SEQ ID NO: 118235 - DNA, 20 bp, Artificial Sequence
  chemically synthesized
tttttttctatgactcctcc

SEQ ID NO: 118236 - DNA, 20 bp, Artificial Sequence
  chemically synthesized
taacagccttggaggagtca

SEQ ID NO: 118237 - DNA, 20 bp, Artificial Sequence
  chemically synthesized
catagaaaaaaatgtctgaa

SEQ ID NO: 118238 - DNA, 20 bp, Artificial Sequence
  chemically synthesized
tagaaaaaaatgtctgaata

SEQ ID NO: 118239 - DNA, 20 bp, Artificial Sequence
  chemically synthesized
acgtgaattttgactctatt

SEQ ID NO: 118240 - DNA, 20 bp, Artificial Sequence
  chemically synthesized
tcacgtaacacaaattccct

SEQ ID NO: 118241 - DNA, 20 bp, Artificial Sequence
  chemically synthesized
gtaacacaaattcccttggt

SEQ ID NO: 118242 - DNA, 20 bp, Artificial Sequence
  chemically synthesized
acatttgccatgctaaccaa

SEQ ID NO: 118243 - DNA, 20 bp, Artificial Sequence
  chemically synthesized
tacatttgccatgctaacca

SEQ ID NO: 118244 - DNA, 20 bp, Artificial Sequence
  chemically synthesized
atacatttgccatgctaacc

SEQ ID NO: 118245 - DNA, 20 bp, Artificial Sequence
  chemically synthesized
acaaattcccttggttagca

SEQ ID NO: 118246 - DNA, 20 bp, Artificial Sequence
  chemically synthesized
tggttagcatggcaaatgta

SEQ ID NO: 118247 - DNA, 20 bp, Artificial Sequence
  chemically synthesized
ggttagcatggcaaatgtat

SEQ ID NO: 118248 - DNA, 20 bp, Artificial Sequence
  chemically synthesized
tcaattcttcacgtaggcat

SEQ ID NO: 118249 - DNA, 20 bp, Artificial Sequence
  chemically synthesized
tataggcttatgcctacgtg

SEQ ID NO: 118250 - DNA, 20 bp, Artificial Sequence
  chemically synthesized
attagctcaattcttcacgt

SEQ ID NO: 118251 - DNA, 20 bp, Artificial Sequence
  chemically synthesized
cattagctcaattcttcacg

SEQ ID NO: 118252 - DNA, 20 bp, Artificial Sequence
  chemically synthesized
ttatgcctacgtgaagaatt

SEQ ID NO: 118253 - DNA, 20 bp, Artificial Sequence
  chemically synthesized
tacgtgaagaattgagctaa

SEQ ID NO: 118254 - DNA, 20 bp, Artificial Sequence
  chemically synthesized
aagaattgagctaatggcac

SEQ ID NO: 118255 - DNA, 20 bp, Artificial Sequence
  chemically synthesized
atagtattctctagtgccat

SEQ ID NO: 118256 - DNA, 20 bp, Artificial Sequence
  chemically synthesized
gaattgagctaatggcacta

SEQ ID NO: 118257 - DNA, 20 bp, Artificial Sequence
  chemically synthesized
gttacctgaatagtattctc

SEQ ID NO: 118258 - DNA, 20 bp, Artificial Sequence
  chemically synthesized
tggcactagagaatactatt

SEQ ID NO: 118259 - DNA, 20 bp, Artificial Sequence
  chemically synthesized
ggcactagagaatactattc

SEQ ID NO: 118260 - DNA, 20 bp, Artificial Sequence
  chemically synthesized
ctcaccgtgagttacctgaa

SEQ ID NO: 118261 - DNA, 20 bp, Artificial Sequence
  chemically synthesized
aatactattcaggtaactca

SEQ ID NO: 118262 - DNA, 20 bp, Artificial Sequence
  chemically synthesized
ctattcaggtaactcacggt

SEQ ID NO: 118263 - DNA, 20 bp, Artificial Sequence
  chemically synthesized
aagggaaatcatctcaccgt

SEQ ID NO: 118264 - DNA, 20 bp, Artificial Sequence
  chemically synthesized
acggtgagatgatttccctt

SEQ ID NO: 118265 - DNA, 20 bp, Artificial Sequence
  chemically synthesized
gtgagatgatttcccttcag

SEQ ID NO: 118266 - DNA, 20 bp, Artificial Sequence
  chemically synthesized
atataggccaggccactgaa

SEQ ID NO: 118267 - DNA, 20 bp, Artificial Sequence
  chemically synthesized
catataggccaggccactga

SEQ ID NO: 118268 - DNA, 20 bp, Artificial Sequence
  chemically synthesized
gcatataggccaggccactg

SEQ ID NO: 118269 - DNA, 20 bp, Artificial Sequence
  chemically synthesized
atgatttcccttcagtggcc

SEQ ID NO: 118270 - DNA, 20 bp, Artificial Sequence
  chemically synthesized
gatagcatagcatataggcc

SEQ ID NO: 118271 - DNA, 20 bp, Artificial Sequence
  chemically synthesized
agatagcatagcatataggc

SEQ ID NO: 118272 - DNA, 20 bp, Artificial Sequence
  chemically synthesized
agatagatagcatagcatat

SEQ ID NO: 118273 - DNA, 20 bp, Artificial Sequence
  chemically synthesized
aagatagatagcatagcata

SEQ ID NO: 118274 - DNA, 20 bp, Artificial Sequence
  chemically synthesized
tgtttgtaagatagatagca

SEQ ID NO: 118275 - DNA, 20 bp, Artificial Sequence
  chemically synthesized
gtaagtgtttgtaagataga

SEQ ID NO: 118276 - DNA, 20 bp, Artificial Sequence
  chemically synthesized
ctcagtaagtgtttgtaaga

SEQ ID NO: 118277 - DNA, 20 bp, Artificial Sequence
  chemically synthesized
tgcactcagtaagtgtttgt

SEQ ID NO: 118278 - DNA, 20 bp, Artificial Sequence
  chemically synthesized
ctatcttacaaacacttact

SEQ ID NO: 118279 - DNA, 20 bp, Artificial Sequence
  chemically synthesized
gcatagaacatgcactcagt

SEQ ID NO: 118280 - DNA, 20 bp, Artificial Sequence
  chemically synthesized
ctatgcatagaacatgcact

SEQ ID NO: 118281 - DNA, 20 bp, Artificial Sequence
  chemically synthesized
ctgagtgcatgttctatgca

SEQ ID NO: 118282 - DNA, 20 bp, Artificial Sequence
  chemically synthesized
atctggtccaatactatgca

SEQ ID NO: 118283 - DNA, 20 bp, Artificial Sequence
  chemically synthesized
gcatgttctatgcatagtat

SEQ ID NO: 118284 - DNA, 20 bp, Artificial Sequence
  chemically synthesized
ttctatgcatagtattggac

SEQ ID NO: 118285 - DNA, 20 bp, Artificial Sequence
  chemically synthesized
tagtattggaccagatactg

SEQ ID NO: 118286 - DNA, 20 bp, Artificial Sequence
  chemically synthesized
ttatacaacactacagtatc

SEQ ID NO: 118287 - DNA, 20 bp, Artificial Sequence
  chemically synthesized
aagaatcttatacaacacta

SEQ ID NO: 118288 - DNA, 20 bp, Artificial Sequence
  chemically synthesized
cagatactgtagtgttgtat

SEQ ID NO: 118289 - DNA, 20 bp, Artificial Sequence
  chemically synthesized
tagtgttgtataagattctt

SEQ ID NO: 118290 - DNA, 20 bp, Artificial Sequence
  chemically synthesized
gaccatgaaaacaatttctc

SEQ ID NO: 118291 - DNA, 20 bp, Artificial Sequence
  chemically synthesized
ttcttgagaaattgttttca

SEQ ID NO: 118292 - DNA, 20 bp, Artificial Sequence
  chemically synthesized
tgttttcatggtcaaacttt

SEQ ID NO: 118293 - DNA, 20 bp, Artificial Sequence
  chemically synthesized
tttcatggtcaaacttttag

SEQ ID NO: 118294 - DNA, 20 bp, Artificial Sequence
  chemically synthesized
ttcatggtcaaacttttaga

SEQ ID NO: 118295 - DNA, 20 bp, Artificial Sequence
  chemically synthesized
tcatggtcaaacttttagaa

SEQ ID NO: 118296 - DNA, 20 bp, Artificial Sequence
  chemically synthesized
acagtatgcatcccttctaa

SEQ ID NO: 118297 - DNA, 20 bp, Artificial Sequence
  chemically synthesized
tagaagggatgcatactgta

SEQ ID NO: 118298 - DNA, 20 bp, Artificial Sequence
  chemically synthesized
gggggaagggataatctata

SEQ ID NO: 118299 - DNA, 20 bp, Artificial Sequence
  chemically synthesized
ttatgaaagtatggggggaa

SEQ ID NO: 118300 - DNA, 20 bp, Artificial Sequence
  chemically synthesized
tttatgaaagtatgggggga

SEQ ID NO: 118301 - DNA, 20 bp, Artificial Sequence
  chemically synthesized
atttatgaaagtatgggggg

SEQ ID NO: 118302 - DNA, 20 bp, Artificial Sequence
  chemically synthesized
tgtatttatgaaagtatggg

SEQ ID NO: 118303 - DNA, 20 bp, Artificial Sequence
  chemically synthesized
gtgtatttatgaaagtatgg

SEQ ID NO: 118304 - DNA, 20 bp, Artificial Sequence
  chemically synthesized
tgtgtatttatgaaagtatg

SEQ ID NO: 118305 - DNA, 20 bp, Artificial Sequence
  chemically synthesized
atgtgtatttatgaaagtat

SEQ ID NO: 118306 - DNA, 20 bp, Artificial Sequence
  chemically synthesized
tatgtgtatttatgaaagta

SEQ ID NO: 118307 - DNA, 20 bp, Artificial Sequence
  chemically synthesized
caaagtatgtgtatttatga

SEQ ID NO: 118308 - DNA, 20 bp, Artificial Sequence
  chemically synthesized
gcatgcttggtgaatcaaca

SEQ ID NO: 118309 - DNA, 20 bp, Artificial Sequence
  chemically synthesized
acatactttgttgattcacc

SEQ ID NO: 118310 - DNA, 20 bp, Artificial Sequence
  chemically synthesized
cccttattacagtgcatgct

SEQ ID NO: 118311 - DNA, 20 bp, Artificial Sequence
  chemically synthesized
caccaagcatgcactgtaat

SEQ ID NO: 118312 - DNA, 20 bp, Artificial Sequence
  chemically synthesized
accaagcatgcactgtaata

SEQ ID NO: 118313 - DNA, 20 bp, Artificial Sequence
  chemically synthesized
ccaagcatgcactgtaataa

SEQ ID NO: 118314 - DNA, 20 bp, Artificial Sequence
  chemically synthesized
gagtaatcagacccttatta

SEQ ID NO: 118315 - DNA, 20 bp, Artificial Sequence
  chemically synthesized
ttctttcccataggagtaat

SEQ ID NO: 118316 - DNA, 20 bp, Artificial Sequence
  chemically synthesized
taagggtctgattactccta

SEQ ID NO: 118317 - DNA, 20 bp, Artificial Sequence
  chemically synthesized
aagggtctgattactcctat

SEQ ID NO: 118318 - DNA, 20 bp, Artificial Sequence
  chemically synthesized
aacagacttctttcccatag

SEQ ID NO: 118319 - DNA, 20 bp, Artificial Sequence
  chemically synthesized
gtctgattactcctatggga

SEQ ID NO: 118320 - DNA, 20 bp, Artificial Sequence
  chemically synthesized
cgaacagacttctttcccat

SEQ ID NO: 118321 - DNA, 20 bp, Artificial Sequence
  chemically synthesized
gcgaacagacttctttccca

SEQ ID NO: 118322 - DNA, 20 bp, Artificial Sequence
  chemically synthesized
tgattactcctatgggaaag

SEQ ID NO: 118323 - DNA, 20 bp, Artificial Sequence
  chemically synthesized
tcaagttaaatcaaagcgaa

SEQ ID NO: 118324 - DNA, 20 bp, Artificial Sequence
  chemically synthesized
ggtaatatcaagttaaatca

SEQ ID NO: 118325 - DNA, 20 bp, Artificial Sequence
  chemically synthesized
aaaaatgattaggtaatatc

SEQ ID NO: 118326 - DNA, 20 bp, Artificial Sequence
  chemically synthesized
ctatggatgaaaaaatgatt

SEQ ID NO: 118327 - DNA, 20 bp, Artificial Sequence
  chemically synthesized
tctatggatgaaaaaatgat

SEQ ID NO: 118328 - DNA, 20 bp, Artificial Sequence
  chemically synthesized
cctaatcattttttcatcca

SEQ ID NO: 118329 - DNA, 20 bp, Artificial Sequence
  chemically synthesized
taactcaagaaagggttcta

SEQ ID NO: 118330 - DNA, 20 bp, Artificial Sequence
  chemically synthesized
catccatagaaccctttctt

SEQ ID NO: 118331 - DNA, 20 bp, Artificial Sequence
  chemically synthesized
ataagtaataactcaagaaa

SEQ ID NO: 118332 - DNA, 20 bp, Artificial Sequence
  chemically synthesized
aataagtaataactcaagaa

SEQ ID NO: 118333 - DNA, 20 bp, Artificial Sequence
  chemically synthesized
taataagtaataactcaaga

SEQ ID NO: 118334 - DNA, 20 bp, Artificial Sequence
  chemically synthesized
atcttaataagtaataactc

SEQ ID NO: 118335 - DNA, 20 bp, Artificial Sequence
  chemically synthesized
ttcttgagttattacttatt

SEQ ID NO: 118336 - DNA, 20 bp, Artificial Sequence
  chemically synthesized
tagttccactgtatcttaat

SEQ ID NO: 118337 - DNA, 20 bp, Artificial Sequence
  chemically synthesized
agttattacttattaagata

SEQ ID NO: 118338 - DNA, 20 bp, Artificial Sequence
  chemically synthesized
tattacttattaagatacag

SEQ ID NO: 118339 - DNA, 20 bp, Artificial Sequence
  chemically synthesized
ttattaagatacagtggaac

SEQ ID NO: 118340 - DNA, 20 bp, Artificial Sequence
  chemically synthesized
aaatggggttttggcagaac

SEQ ID NO: 118341 - DNA, 20 bp, Artificial Sequence
  chemically synthesized
ttttccaaatggggttttgg

SEQ ID NO: 118342 - DNA, 20 bp, Artificial Sequence
  chemically synthesized
tctttttccaaatggggttt

SEQ ID NO: 118343 - DNA, 20 bp, Artificial Sequence
  chemically synthesized
agttctgccaaaaccccatt

SEQ ID NO: 118344 - DNA, 20 bp, Artificial Sequence
  chemically synthesized
gagttttctttttccaaatg

SEQ ID NO: 118345 - DNA, 20 bp, Artificial Sequence
  chemically synthesized
ggagttttctttttccaaat

SEQ ID NO: 118346 - DNA, 20 bp, Artificial Sequence
  chemically synthesized
gggagttttctttttccaaa

SEQ ID NO: 118347 - DNA, 20 bp, Artificial Sequence
  chemically synthesized
gccaaaaccccatttggaaa

SEQ ID NO: 118348 - DNA, 20 bp, Artificial Sequence
  chemically synthesized
gaaaaagaaaactcccactc

SEQ ID NO: 118349 - DNA, 20 bp, Artificial Sequence
  chemically synthesized
atactcatcatctagagtgg

SEQ ID NO: 118350 - DNA, 20 bp, Artificial Sequence
  chemically synthesized
acatactcatcatctagagt

SEQ ID NO: 118351 - DNA, 20 bp, Artificial Sequence
  chemically synthesized
cacatactcatcatctagag

SEQ ID NO: 118352 - DNA, 20 bp, Artificial Sequence
  chemically synthesized
cttcacatactcatcatcta

SEQ ID NO: 118353 - DNA, 20 bp, Artificial Sequence
  chemically synthesized
aaactcccactctagatgat

SEQ ID NO: 118354 - DNA, 20 bp, Artificial Sequence
  chemically synthesized
atcttcacatactcatcatc

SEQ ID NO: 118355 - DNA, 20 bp, Artificial Sequence
  chemically synthesized
ctctagatgatgagtatgtg

SEQ ID NO: 118356 - DNA, 20 bp, Artificial Sequence
  chemically synthesized
gatgatgagtatgtgaagat

SEQ ID NO: 118357 - DNA, 20 bp, Artificial Sequence
  chemically synthesized
atgatgagtatgtgaagatc

SEQ ID NO: 118358 - DNA, 20 bp, Artificial Sequence
  chemically synthesized
gtgataccttggtggttgta

SEQ ID NO: 118359 - DNA, 20 bp, Artificial Sequence
  chemically synthesized
tgttataccatacaaccacc

SEQ ID NO: 118360 - DNA, 20 bp, Artificial Sequence
  chemically synthesized
gttataccatacaaccacca

SEQ ID NO: 118361 - DNA, 20 bp, Artificial Sequence
  chemically synthesized
acaggttggtgataccttgg

SEQ ID NO: 118362 - DNA, 20 bp, Artificial Sequence
  chemically synthesized
ggaacaggttggtgatacct

SEQ ID NO: 118363 - DNA, 20 bp, Artificial Sequence
  chemically synthesized
agaagtattcaggaacaggt

SEQ ID NO: 118364 - DNA, 20 bp, Artificial Sequence
  chemically synthesized
ttgtagaagtattcaggaac

SEQ ID NO: 118365 - DNA, 20 bp, Artificial Sequence
  chemically synthesized
gttgtagaagtattcaggaa

SEQ ID NO: 118366 - DNA, 20 bp, Artificial Sequence
  chemically synthesized
gtaaagttgtagaagtattc

SEQ ID NO: 118367 - DNA, 20 bp, Artificial Sequence
  chemically synthesized
tgtaaagttgtagaagtatt

SEQ ID NO: 118368 - DNA, 20 bp, Artificial Sequence
  chemically synthesized
gctgccttgtaaagttgtag

SEQ ID NO: 118369 - DNA, 20 bp, Artificial Sequence
  chemically synthesized
caggctgccttgtaaagttg

SEQ ID NO: 118370 - DNA, 20 bp, Artificial Sequence
  chemically synthesized
gaatacttctacaactttac

SEQ ID NO: 118371 - DNA, 20 bp, Artificial Sequence
  chemically synthesized
aatacttctacaactttaca

SEQ ID NO: 118372 - DNA, 20 bp, Artificial Sequence
  chemically synthesized
acttctacaactttacaagg

SEQ ID NO: 118373 - DNA, 20 bp, Artificial Sequence
  chemically synthesized
atggaacaggctgccttgta

SEQ ID NO: 118374 - DNA, 20 bp, Artificial Sequence
  chemically synthesized
aagctgtccaaagatggaac

SEQ ID NO: 118375 - DNA, 20 bp, Artificial Sequence
  chemically synthesized
aaagctgtccaaagatggaa

SEQ ID NO: 118376 - DNA, 20 bp, Artificial Sequence
  chemically synthesized
aaggcagcctgttccatctt

SEQ ID NO: 118377 - DNA, 20 bp, Artificial Sequence
  chemically synthesized
gttataaagctgtccaaaga

SEQ ID NO: 118378 - DNA, 20 bp, Artificial Sequence
  chemically synthesized
cagcctgttccatctttgga

SEQ ID NO: 118379 - DNA, 20 bp, Artificial Sequence
  chemically synthesized
tattgttataaagctgtcca

SEQ ID NO: 118380 - DNA, 20 bp, Artificial Sequence
  chemically synthesized
gagagaggaatattgttata

SEQ ID NO: 118381 - DNA, 20 bp, Artificial Sequence
  chemically synthesized
tatttcagcttaatagagag

SEQ ID NO: 118382 - DNA, 20 bp, Artificial Sequence
  chemically synthesized
atatttcagcttaatagaga

SEQ ID NO: 118383 - DNA, 20 bp, Artificial Sequence
  chemically synthesized
acaatattcctctctctatt

SEQ ID NO: 118384 - DNA, 20 bp, Artificial Sequence
  chemically synthesized
gtatatttcagcttaataga

SEQ ID NO: 118385 - DNA, 20 bp, Artificial Sequence
  chemically synthesized
acgtatatttcagcttaata

SEQ ID NO: 118386 - DNA, 20 bp, Artificial Sequence
  chemically synthesized
gaacgtatatttcagcttaa

SEQ ID NO: 118387 - DNA, 20 bp, Artificial Sequence
  chemically synthesized
agtcctaagaacgtatattt

SEQ ID NO: 118388 - DNA, 20 bp, Artificial Sequence
  chemically synthesized
taagctgaaatatacgttct

SEQ ID NO: 118389 - DNA, 20 bp, Artificial Sequence
  chemically synthesized
aagctgaaatatacgttctt

SEQ ID NO: 118390 - DNA, 20 bp, Artificial Sequence
  chemically synthesized
gaaatatacgttcttaggac

SEQ ID NO: 118391 - DNA, 20 bp, Artificial Sequence
  chemically synthesized
aaatatacgttcttaggact

SEQ ID NO: 118392 - DNA, 20 bp, Artificial Sequence
  chemically synthesized
taagcatataacctagtcct

SEQ ID NO: 118393 - DNA, 20 bp, Artificial Sequence
  chemically synthesized
ataaatttaagcatataacc

SEQ ID NO: 118394 - DNA, 20 bp, Artificial Sequence
  chemically synthesized
atcttaggccgaataaattt

SEQ ID NO: 118395 - DNA, 20 bp, Artificial Sequence
  chemically synthesized
gttatatgcttaaatttatt

SEQ ID NO: 118396 - DNA, 20 bp, Artificial Sequence
  chemically synthesized
tgcttaaatttattcggcct

SEQ ID NO: 118397 - DNA, 20 bp, Artificial Sequence
  chemically synthesized
ggaaagccaaaggggatctt

SEQ ID NO: 118398 - DNA, 20 bp, Artificial Sequence
  chemically synthesized
aggaaagccaaaggggatct

SEQ ID NO: 118399 - DNA, 20 bp, Artificial Sequence
  chemically synthesized
attcggcctaagatcccctt

SEQ ID NO: 118400 - DNA, 20 bp, Artificial Sequence
  chemically synthesized
gtgggaaaggaaagccaaag

SEQ ID NO: 118401 - DNA, 20 bp, Artificial Sequence
  chemically synthesized
agtgggaaaggaaagccaaa

SEQ ID NO: 118402 - DNA, 20 bp, Artificial Sequence
  chemically synthesized
cagtgggaaaggaaagccaa

SEQ ID NO: 118403 - DNA, 20 bp, Artificial Sequence
  chemically synthesized
acagtgggaaaggaaagcca

SEQ ID NO: 118404 - DNA, 20 bp, Artificial Sequence
  chemically synthesized
gatagaacagtgggaaagga

SEQ ID NO: 118405 - DNA, 20 bp, Artificial Sequence
  chemically synthesized
atgtgatagaacagtgggaa

SEQ ID NO: 118406 - DNA, 20 bp, Artificial Sequence
  chemically synthesized
aatgtgatagaacagtggga

SEQ ID NO: 118407 - DNA, 20 bp, Artificial Sequence
  chemically synthesized
acacaatgtgatagaacagt

SEQ ID NO: 118408 - DNA, 20 bp, Artificial Sequence
  chemically synthesized
cacacaatgtgatagaacag

SEQ ID NO: 118409 - DNA, 20 bp, Artificial Sequence
  chemically synthesized
caacacacaatgtgatagaa

SEQ ID NO: 118410 - DNA, 20 bp, Artificial Sequence
  chemically synthesized
acacacaacacacaatgtga

SEQ ID NO: 118411 - DNA, 20 bp, Artificial Sequence
  chemically synthesized
tgtgtgtgtgtgtgtgtgta

SEQ ID NO: 118412 - DNA, 20 bp, Artificial Sequence
  chemically synthesized
tgtgtgtgtgtgtgtgtaaa

SEQ ID NO: 118413 - DNA, 20 bp, Artificial Sequence
  chemically synthesized
tgtgtgtgtgtgtgtaaaga

SEQ ID NO: 118414 - DNA, 20 bp, Artificial Sequence
  chemically synthesized
gtgtgtgtgtgtaaagagag

SEQ ID NO: 118415 - DNA, 20 bp, Artificial Sequence
  chemically synthesized
gtgtaaagagagaagtgaaa

SEQ ID NO: 118416 - DNA, 20 bp, Artificial Sequence
  chemically synthesized
taaagagagaagtgaaacag

SEQ ID NO: 118417 - DNA, 20 bp, Artificial Sequence
  chemically synthesized
aaagagagaagtgaaacaga

SEQ ID NO: 118418 - DNA, 20 bp, Artificial Sequence
  chemically synthesized
agagagaagtgaaacagaag

SEQ ID NO: 118419 - DNA, 20 bp, Artificial Sequence
  chemically synthesized
tggagataacatagagtttt

SEQ ID NO: 118420 - DNA, 20 bp, Artificial Sequence
  chemically synthesized
ccaaatatggagataacata

SEQ ID NO: 118421 - DNA, 20 bp, Artificial Sequence
  chemically synthesized
ttccaaatatggagataaca

SEQ ID NO: 118422 - DNA, 20 bp, Artificial Sequence
  chemically synthesized
ctctatgttatctccatatt

SEQ ID NO: 118423 - DNA, 20 bp, Artificial Sequence
  chemically synthesized
ccaaaaacattccaaatatg

SEQ ID NO: 118424 - DNA, 20 bp, Artificial Sequence
  chemically synthesized
aaccaaaaacattccaaata

SEQ ID NO: 118425 - DNA, 20 bp, Artificial Sequence
  chemically synthesized
ctccatatttggaatgtttt

SEQ ID NO: 118426 - DNA, 20 bp, Artificial Sequence
  chemically synthesized
atatttggaatgtttttggt

SEQ ID NO: 118427 - DNA, 20 bp, Artificial Sequence
  chemically synthesized
tggaatgtttttggttggtg

SEQ ID NO: 118428 - DNA, 20 bp, Artificial Sequence
  chemically synthesized
ggaatgtttttggttggtgt

SEQ ID NO: 118429 - DNA, 20 bp, Artificial Sequence
  chemically synthesized
atgtttttggttggtgtagg

SEQ ID NO: 118430 - DNA, 20 bp, Artificial Sequence
  chemically synthesized
tttttggttggtgtaggcag

SEQ ID NO: 118431 - DNA, 20 bp, Artificial Sequence
  chemically synthesized
ttctatgcatattaaaattt

SEQ ID NO: 118432 - DNA, 20 bp, Artificial Sequence
  chemically synthesized
ttctcaaattttaatatgca

SEQ ID NO: 118433 - DNA, 20 bp, Artificial Sequence
  chemically synthesized
taatatgcatagaaataact

SEQ ID NO: 118434 - DNA, 20 bp, Artificial Sequence
  chemically synthesized
atatgcatagaaataacttg

SEQ ID NO: 118435 - DNA, 20 bp, Artificial Sequence
  chemically synthesized
tatgcatagaaataacttgg

SEQ ID NO: 118436 - DNA, 20 bp, Artificial Sequence
  chemically synthesized
taacaagctttcaggcctcc

SEQ ID NO: 118437 - DNA, 20 bp, Artificial Sequence
  chemically synthesized
gaaataacttggaggcctga

SEQ ID NO: 118438 - DNA, 20 bp, Artificial Sequence
  chemically synthesized
ggaacttttaacaagctttc

SEQ ID NO: 118439 - DNA, 20 bp, Artificial Sequence
  chemically synthesized
gggaacttttaacaagcttt

SEQ ID NO: 118440 - DNA, 20 bp, Artificial Sequence
  chemically synthesized
gaggcctgaaagcttgttaa

SEQ ID NO: 118441 - DNA, 20 bp, Artificial Sequence
  chemically synthesized
ggacttggggaacttttaac

SEQ ID NO: 118442 - DNA, 20 bp, Artificial Sequence
  chemically synthesized
aagcttgttaaaagttcccc

SEQ ID NO: 118443 - DNA, 20 bp, Artificial Sequence
  chemically synthesized
atctctggggatgggacttg

SEQ ID NO: 118444 - DNA, 20 bp, Artificial Sequence
  chemically synthesized
aatctctggggatgggactt

SEQ ID NO: 118445 - DNA, 20 bp, Artificial Sequence
  chemically synthesized
gaatctctggggatgggact

SEQ ID NO: 118446 - DNA, 20 bp, Artificial Sequence
  chemically synthesized
agttccccaagtcccatccc

SEQ ID NO: 118447 - DNA, 20 bp, Artificial Sequence
  chemically synthesized
ttccccaagtcccatcccca

SEQ ID NO: 118448 - DNA, 20 bp, Artificial Sequence
  chemically synthesized
aaatcagaatctctggggat

SEQ ID NO: 118449 - DNA, 20 bp, Artificial Sequence
  chemically synthesized
taaatcagaatctctgggga

SEQ ID NO: 118450 - DNA, 20 bp, Artificial Sequence
  chemically synthesized
caactaaatcagaatctctg

SEQ ID NO: 118451 - DNA, 20 bp, Artificial Sequence
  chemically synthesized
ccaactaaatcagaatctct

SEQ ID NO: 118452 - DNA, 20 bp, Artificial Sequence
  chemically synthesized
tccaactaaatcagaatctc

SEQ ID NO: 118453 - DNA, 20 bp, Artificial Sequence
  chemically synthesized
catccccagagattctgatt

SEQ ID NO: 118454 - DNA, 20 bp, Artificial Sequence
  chemically synthesized
cccagagattctgatttagt

SEQ ID NO: 118455 - DNA, 20 bp, Artificial Sequence
  chemically synthesized
cctaccccatccaactaaat

SEQ ID NO: 118456 - DNA, 20 bp, Artificial Sequence
  chemically synthesized
gagattctgatttagttgga

SEQ ID NO: 118457 - DNA, 20 bp, Artificial Sequence
  chemically synthesized
agattctgatttagttggat

SEQ ID NO: 118458 - DNA, 20 bp, Artificial Sequence
  chemically synthesized
gattctgatttagttggatg

SEQ ID NO: 118459 - DNA, 20 bp, Artificial Sequence
  chemically synthesized
tctgatttagttggatgggg

SEQ ID NO: 118460 - DNA, 20 bp, Artificial Sequence
  chemically synthesized
ctgatttagttggatggggt

SEQ ID NO: 118461 - DNA, 20 bp, Artificial Sequence
  chemically synthesized
cactagaaatttaaatttgt

SEQ ID NO: 118462 - DNA, 20 bp, Artificial Sequence
  chemically synthesized
tcactagaaatttaaatttg

SEQ ID NO: 118463 - DNA, 20 bp, Artificial Sequence
  chemically synthesized
gacctacaaatttaaatttc

SEQ ID NO: 118464 - DNA, 20 bp, Artificial Sequence
  chemically synthesized
tacaaatttaaatttctagt

SEQ ID NO: 118465 - DNA, 20 bp, Artificial Sequence
  chemically synthesized
ggtatcacctatgagctcac

SEQ ID NO: 118466 - DNA, 20 bp, Artificial Sequence
  chemically synthesized
ttaaatttctagtgagctca

SEQ ID NO: 118467 - DNA, 20 bp, Artificial Sequence
  chemically synthesized
taaatttctagtgagctcat

SEQ ID NO: 118468 - DNA, 20 bp, Artificial Sequence
  chemically synthesized
gcagcattggtatcacctat

SEQ ID NO: 118469 - DNA, 20 bp, Artificial Sequence
  chemically synthesized
ataggtgataccaatgctgc

SEQ ID NO: 118470 - DNA, 20 bp, Artificial Sequence
  chemically synthesized
ggtcctctgactggcagcat

SEQ ID NO: 118471 - DNA, 20 bp, Artificial Sequence
  chemically synthesized
gtgataccaatgctgccagt

SEQ ID NO: 118472 - DNA, 20 bp, Artificial Sequence
  chemically synthesized
gataccaatgctgccagtca

SEQ ID NO: 118473 - DNA, 20 bp, Artificial Sequence
  chemically synthesized
aagtatggtcctctgactgg

SEQ ID NO: 118474 - DNA, 20 bp, Artificial Sequence
  chemically synthesized
ataccaatgctgccagtcag

SEQ ID NO: 118475 - DNA, 20 bp, Artificial Sequence
  chemically synthesized
ccaaagtatggtcctctgac

SEQ ID NO: 118476 - DNA, 20 bp, Artificial Sequence
  chemically synthesized
ccagtcagaggaccatactt

SEQ ID NO: 118477 - DNA, 20 bp, Artificial Sequence
  chemically synthesized
cagtcagaggaccatacttt

SEQ ID NO: 118478 - DNA, 20 bp, Artificial Sequence
  chemically synthesized
ccgcagtgttacccaaagta

SEQ ID NO: 118479 - DNA, 20 bp, Artificial Sequence
  chemically synthesized
caagaccgcagtgttaccca

SEQ ID NO: 118480 - DNA, 20 bp, Artificial Sequence
  chemically synthesized
ccatactttgggtaacactg

SEQ ID NO: 118481 - DNA, 20 bp, Artificial Sequence
  chemically synthesized
tttgggtaacactgcggtct

SEQ ID NO: 118482 - DNA, 20 bp, Artificial Sequence
  chemically synthesized
ttgggtaacactgcggtctt

SEQ ID NO: 118483 - DNA, 20 bp, Artificial Sequence
  chemically synthesized
caacagtgtacccaagaccg

SEQ ID NO: 118484 - DNA, 20 bp, Artificial Sequence
  chemically synthesized
ggcagagcaacagtgtaccc

SEQ ID NO: 118485 - DNA, 20 bp, Artificial Sequence
  chemically synthesized
atgaggtcttggcagagcaa

SEQ ID NO: 118486 - DNA, 20 bp, Artificial Sequence
  chemically synthesized
gggtacactgttgctctgcc

SEQ ID NO: 118487 - DNA, 20 bp, Artificial Sequence
  chemically synthesized
tagggcatgaggtcttggca

SEQ ID NO: 118488 - DNA, 20 bp, Artificial Sequence
  chemically synthesized
gctagggcatgaggtcttgg

SEQ ID NO: 118489 - DNA, 20 bp, Artificial Sequence
  chemically synthesized
ccagctagggcatgaggtct

SEQ ID NO: 118490 - DNA, 20 bp, Artificial Sequence
  chemically synthesized
tctgccaagacctcatgccc

SEQ ID NO: 118491 - DNA, 20 bp, Artificial Sequence
  chemically synthesized
ttccaaccagctagggcatg

SEQ ID NO: 118492 - DNA, 20 bp, Artificial Sequence
  chemically synthesized
attccaaccagctagggcat

SEQ ID NO: 118493 - DNA, 20 bp, Artificial Sequence
  chemically synthesized
ccaagacctcatgccctagc

SEQ ID NO: 118494 - DNA, 20 bp, Artificial Sequence
  chemically synthesized
gtcaatattccaaccagcta

SEQ ID NO: 118495 - DNA, 20 bp, Artificial Sequence
  chemically synthesized
gacctcatgccctagctggt

SEQ ID NO: 118496 - DNA, 20 bp, Artificial Sequence
  chemically synthesized
agtcaatattccaaccagct

SEQ ID NO: 118497 - DNA, 20 bp, Artificial Sequence
  chemically synthesized
tagtcaatattccaaccagc

SEQ ID NO: 118498 - DNA, 20 bp, Artificial Sequence
  chemically synthesized
ttagtagtcaatattccaac

SEQ ID NO: 118499 - DNA, 20 bp, Artificial Sequence
  chemically synthesized
gttggaatattgactactaa

SEQ ID NO: 118500 - DNA, 20 bp, Artificial Sequence
  chemically synthesized
aggcagctgtgagctgttag

SEQ ID NO: 118501 - DNA, 20 bp, Artificial Sequence
  chemically synthesized
gggaggcagctgtgagctgt

SEQ ID NO: 118502 - DNA, 20 bp, Artificial Sequence
  chemically synthesized
tattgactactaacagctca

SEQ ID NO: 118503 - DNA, 20 bp, Artificial Sequence
  chemically synthesized
ccagggagggaggcagctgt

SEQ ID NO: 118504 - DNA, 20 bp, Artificial Sequence
  chemically synthesized
gcaatttccagggagggagg

SEQ ID NO: 118505 - DNA, 20 bp, Artificial Sequence
  chemically synthesized
ctcacagctgcctccctccc

SEQ ID NO: 118506 - DNA, 20 bp, Artificial Sequence
  chemically synthesized
aaggcaatttccagggaggg

SEQ ID NO: 118507 - DNA, 20 bp, Artificial Sequence
  chemically synthesized
gaaggcaatttccagggagg

SEQ ID NO: 118508 - DNA, 20 bp, Artificial Sequence
  chemically synthesized
ctgaaggcaatttccaggga

SEQ ID NO: 118509 - DNA, 20 bp, Artificial Sequence
  chemically synthesized
gctgaaggcaatttccaggg

SEQ ID NO: 118510 - DNA, 20 bp, Artificial Sequence
  chemically synthesized
agctgaaggcaatttccagg

SEQ ID NO: 118511 - DNA, 20 bp, Artificial Sequence
  chemically synthesized
acagctgaaggcaatttcca

SEQ ID NO: 118512 - DNA, 20 bp, Artificial Sequence
  chemically synthesized
tacagctgaaggcaatttcc

SEQ ID NO: 118513 - DNA, 20 bp, Artificial Sequence
  chemically synthesized
ctacagctgaaggcaatttc

SEQ ID NO: 118514 - DNA, 20 bp, Artificial Sequence
  chemically synthesized
ccctccctggaaattgcctt

SEQ ID NO: 118515 - DNA, 20 bp, Artificial Sequence
  chemically synthesized
ctggaaattgccttcagctg

SEQ ID NO: 118516 - DNA, 20 bp, Artificial Sequence
  chemically synthesized
agattgttacctacagctga

SEQ ID NO: 118517 - DNA, 20 bp, Artificial Sequence
  chemically synthesized
tggaaattgccttcagctgt

SEQ ID NO: 118518 - DNA, 20 bp, Artificial Sequence
  chemically synthesized
aagattgttacctacagctg

SEQ ID NO: 118519 - DNA, 20 bp, Artificial Sequence
  chemically synthesized
tggagtaagattgttaccta

SEQ ID NO: 118520 - DNA, 20 bp, Artificial Sequence
  chemically synthesized
tgtaggtaacaatcttactc

SEQ ID NO: 118521 - DNA, 20 bp, Artificial Sequence
  chemically synthesized
gggaaagagcagactggagt

SEQ ID NO: 118522 - DNA, 20 bp, Artificial Sequence
  chemically synthesized
ccatgggaaagagcagactg

SEQ ID NO: 118523 - DNA, 20 bp, Artificial Sequence
  chemically synthesized
ccccatgggaaagagcagac

SEQ ID NO: 118524 - DNA, 20 bp, Artificial Sequence
  chemically synthesized
ggtcaccccatgggaaagag

SEQ ID NO: 118525 - DNA, 20 bp, Artificial Sequence
  chemically synthesized
ctccagtctgctctttccca

SEQ ID NO: 118526 - DNA, 20 bp, Artificial Sequence
  chemically synthesized
ctgggtcaccccatgggaaa

SEQ ID NO: 118527 - DNA, 20 bp, Artificial Sequence
  chemically synthesized
tccagtctgctctttcccat

SEQ ID NO: 118528 - DNA, 20 bp, Artificial Sequence
  chemically synthesized
ccagtctgctctttcccatg

SEQ ID NO: 118529 - DNA, 20 bp, Artificial Sequence
  chemically synthesized
tcctgggtcaccccatggga

SEQ ID NO: 118530 - DNA, 20 bp, Artificial Sequence
  chemically synthesized
atggtcctgggtcaccccat

SEQ ID NO: 118531 - DNA, 20 bp, Artificial Sequence
  chemically synthesized
aatggtcctgggtcacccca

SEQ ID NO: 118532 - DNA, 20 bp, Artificial Sequence
  chemically synthesized
ctctttcccatggggtgacc

SEQ ID NO: 118533 - DNA, 20 bp, Artificial Sequence
  chemically synthesized
tctttcccatggggtgaccc

SEQ ID NO: 118534 - DNA, 20 bp, Artificial Sequence
  chemically synthesized
actagagagttaatggtcct

SEQ ID NO: 118535 - DNA, 20 bp, Artificial Sequence
  chemically synthesized
tactagagagttaatggtcc

SEQ ID NO: 118536 - DNA, 20 bp, Artificial Sequence
  chemically synthesized
acccaatactagagagttaa

SEQ ID NO: 118537 - DNA, 20 bp, Artificial Sequence
  chemically synthesized
acccaggaccattaactctc

SEQ ID NO: 118538 - DNA, 20 bp, Artificial Sequence
  chemically synthesized
cctttgaacccaatactaga

SEQ ID NO: 118539 - DNA, 20 bp, Artificial Sequence
  chemically synthesized
gaccattaactctctagtat

SEQ ID NO: 118540 - DNA, 20 bp, Artificial Sequence
  chemically synthesized
accattaactctctagtatt

SEQ ID NO: 118541 - DNA, 20 bp, Artificial Sequence
  chemically synthesized
gacctttgaacccaatacta

SEQ ID NO: 118542 - DNA, 20 bp, Artificial Sequence
  chemically synthesized
tggacctttgaacccaatac

SEQ ID NO: 118543 - DNA, 20 bp, Artificial Sequence
  chemically synthesized
actctctagtattgggttca

SEQ ID NO: 118544 - DNA, 20 bp, Artificial Sequence
  chemically synthesized
ctctctagtattgggttcaa

SEQ ID NO: 118545 - DNA, 20 bp, Artificial Sequence
  chemically synthesized
tagtattgggttcaaaggtc

SEQ ID NO: 118546 - DNA, 20 bp, Artificial Sequence
  chemically synthesized
ctgaattgaagcaagggatc

SEQ ID NO: 118547 - DNA, 20 bp, Artificial Sequence
  chemically synthesized
gacacgctgaattgaagcaa

SEQ ID NO: 118548 - DNA, 20 bp, Artificial Sequence
  chemically synthesized
agacacgctgaattgaagca

SEQ ID NO: 118549 - DNA, 20 bp, Artificial Sequence
  chemically synthesized
gagacacgctgaattgaagc

SEQ ID NO: 118550 - DNA, 20 bp, Artificial Sequence
  chemically synthesized
ccagatcccttgcttcaatt

SEQ ID NO: 118551 - DNA, 20 bp, Artificial Sequence
  chemically synthesized
tttagagacacgctgaattg

SEQ ID NO: 118552 - DNA, 20 bp, Artificial Sequence
  chemically synthesized
ttcaattcagcgtgtctcta

SEQ ID NO: 118553 - DNA, 20 bp, Artificial Sequence
  chemically synthesized
tcaattcagcgtgtctctaa

SEQ ID NO: 118554 - DNA, 20 bp, Artificial Sequence
  chemically synthesized
caattcagcgtgtctctaaa

SEQ ID NO: 118555 - DNA, 20 bp, Artificial Sequence
  chemically synthesized
ggaaattgcatggcccttta

SEQ ID NO: 118556 - DNA, 20 bp, Artificial Sequence
  chemically synthesized
ctggaaattgcatggccctt

SEQ ID NO: 118557 - DNA, 20 bp, Artificial Sequence
  chemically synthesized
ggggagttctggaaattgca

SEQ ID NO: 118558 - DNA, 20 bp, Artificial Sequence
  chemically synthesized
ctaaagggccatgcaatttc

SEQ ID NO: 118559 - DNA, 20 bp, Artificial Sequence
  chemically synthesized
tcagattttcaggggagttc

SEQ ID NO: 118560 - DNA, 20 bp, Artificial Sequence
  chemically synthesized
gcctcatcagattttcaggg

SEQ ID NO: 118561 - DNA, 20 bp, Artificial Sequence
  chemically synthesized
cggcctcatcagattttcag

SEQ ID NO: 118562 - DNA, 20 bp, Artificial Sequence
  chemically synthesized
gcggcctcatcagattttca

SEQ ID NO: 118563 - DNA, 20 bp, Artificial Sequence
  chemically synthesized
tgcggcctcatcagattttc

SEQ ID NO: 118564 - DNA, 20 bp, Artificial Sequence
  chemically synthesized
ttgcggcctcatcagatttt

SEQ ID NO: 118565 - DNA, 20 bp, Artificial Sequence
  chemically synthesized
aactcccctgaaaatctgat

SEQ ID NO: 118566 - DNA, 20 bp, Artificial Sequence
  chemically synthesized
actcccctgaaaatctgatg

SEQ ID NO: 118567 - DNA, 20 bp, Artificial Sequence
  chemically synthesized
gcagtgcgttgcggcctcat

SEQ ID NO: 118568 - DNA, 20 bp, Artificial Sequence
  chemically synthesized
gtgaagcctgcagtgcgttg

SEQ ID NO: 118569 - DNA, 20 bp, Artificial Sequence
  chemically synthesized
gatgaggccgcaacgcactg

SEQ ID NO: 118570 - DNA, 20 bp, Artificial Sequence
  chemically synthesized
atgaggccgcaacgcactgc

SEQ ID NO: 118571 - DNA, 20 bp, Artificial Sequence
  chemically synthesized
aagaagtgcagtgaagcctg

SEQ ID NO: 118572 - DNA, 20 bp, Artificial Sequence
  chemically synthesized
acagacgaagaagtgcagtg

SEQ ID NO: 118573 - DNA, 20 bp, Artificial Sequence
  chemically synthesized
attgcacagacgaagaagtg

SEQ ID NO: 118574 - DNA, 20 bp, Artificial Sequence
  chemically synthesized
gcaagattgcacagacgaag

SEQ ID NO: 118575 - DNA, 20 bp, Artificial Sequence
  chemically synthesized
taggcaagattgcacagacg

SEQ ID NO: 118576 - DNA, 20 bp, Artificial Sequence
  chemically synthesized
gtaagataggcaagattgca

SEQ ID NO: 118577 - DNA, 20 bp, Artificial Sequence
  chemically synthesized
tgtaaggttgtaagataggc

SEQ ID NO: 118578 - DNA, 20 bp, Artificial Sequence
  chemically synthesized
catgtgtaaggttgtaagat

SEQ ID NO: 118579 - DNA, 20 bp, Artificial Sequence
  chemically synthesized
acatgtgtaaggttgtaaga

SEQ ID NO: 118580 - DNA, 20 bp, Artificial Sequence
  chemically synthesized
agatacatgtgtaaggttgt

SEQ ID NO: 118581 - DNA, 20 bp, Artificial Sequence
  chemically synthesized
tcccatgagatacatgtgta

SEQ ID NO: 118582 - DNA, 20 bp, Artificial Sequence
  chemically synthesized
ttcccatgagatacatgtgt

SEQ ID NO: 118583 - DNA, 20 bp, Artificial Sequence
  chemically synthesized
aaccttacacatgtatctca

SEQ ID NO: 118584 - DNA, 20 bp, Artificial Sequence
  chemically synthesized
accttacacatgtatctcat

SEQ ID NO: 118585 - DNA, 20 bp, Artificial Sequence
  chemically synthesized
ttgttgaggagtgttcccat

SEQ ID NO: 118586 - DNA, 20 bp, Artificial Sequence
  chemically synthesized
tgtgcataaggtttgttgag

SEQ ID NO: 118587 - DNA, 20 bp, Artificial Sequence
  chemically synthesized
tgtgtgcataaggtttgttg

SEQ ID NO: 118588 - DNA, 20 bp, Artificial Sequence
  chemically synthesized
ttgtgtgcataaggtttgtt

SEQ ID NO: 118589 - DNA, 20 bp, Artificial Sequence
  chemically synthesized
gatagagagttgtgtgcata

SEQ ID NO: 118590 - DNA, 20 bp, Artificial Sequence
  chemically synthesized
agatagagagttgtgtgcat

SEQ ID NO: 118591 - DNA, 20 bp, Artificial Sequence
  chemically synthesized
atgcacacaactctctatct

SEQ ID NO: 118592 - DNA, 20 bp, Artificial Sequence
  chemically synthesized
tggaaatagactaagataga

SEQ ID NO: 118593 - DNA, 20 bp, Artificial Sequence
  chemically synthesized
cctggaaatagactaagata

SEQ ID NO: 118594 - DNA, 20 bp, Artificial Sequence
  chemically synthesized
tccctggaaatagactaaga

SEQ ID NO: 118595 - DNA, 20 bp, Artificial Sequence
  chemically synthesized
gggctccctggaaatagact

SEQ ID NO: 118596 - DNA, 20 bp, Artificial Sequence
  chemically synthesized
tctctatcttagtctatttc

SEQ ID NO: 118597 - DNA, 20 bp, Artificial Sequence
  chemically synthesized
ctctatcttagtctatttcc

SEQ ID NO: 118598 - DNA, 20 bp, Artificial Sequence
  chemically synthesized
tctatcttagtctatttcca

SEQ ID NO: 118599 - DNA, 20 bp, Artificial Sequence
  chemically synthesized
tagactgggctccctggaaa

SEQ ID NO: 118600 - DNA, 20 bp, Artificial Sequence
  chemically synthesized
tatcttagtctatttccagg

SEQ ID NO: 118601 - DNA, 20 bp, Artificial Sequence
  chemically synthesized
tagtctatttccagggagcc

SEQ ID NO: 118602 - DNA, 20 bp, Artificial Sequence
  chemically synthesized
ctaacttagactgggctccc

SEQ ID NO: 118603 - DNA, 20 bp, Artificial Sequence
  chemically synthesized
atttccagggagcccagtct

SEQ ID NO: 118604 - DNA, 20 bp, Artificial Sequence
  chemically synthesized
aaacccatctaacttagact

SEQ ID NO: 118605 - DNA, 20 bp, Artificial Sequence
  chemically synthesized
aaaacccatctaacttagac

SEQ ID NO: 118606 - DNA, 20 bp, Artificial Sequence
  chemically synthesized
ccagggagcccagtctaagt

SEQ ID NO: 118607 - DNA, 20 bp, Artificial Sequence
  chemically synthesized
ggagcccagtctaagttaga

SEQ ID NO: 118608 - DNA, 20 bp, Artificial Sequence
  chemically synthesized
aacaaaaaacccatctaact

SEQ ID NO: 118609 - DNA, 20 bp, Artificial Sequence
  chemically synthesized
gagcccagtctaagttagat

SEQ ID NO: 118610 - DNA, 20 bp, Artificial Sequence
  chemically synthesized
ggtgctacatgtgggttcaa

SEQ ID NO: 118611 - DNA, 20 bp, Artificial Sequence
  chemically synthesized
gtttcttttgaacccacatg

SEQ ID NO: 118612 - DNA, 20 bp, Artificial Sequence
  chemically synthesized
aaatgcaaggtgctacatgt

SEQ ID NO: 118613 - DNA, 20 bp, Artificial Sequence
  chemically synthesized
taaatgcaaggtgctacatg

SEQ ID NO: 118614 - DNA, 20 bp, Artificial Sequence
  chemically synthesized
aaagatgtaatgtaaatgca

SEQ ID NO: 118615 - DNA, 20 bp, Artificial Sequence
  chemically synthesized
gaaagatgtaatgtaaatgc

SEQ ID NO: 118616 - DNA, 20 bp, Artificial Sequence
  chemically synthesized
tgcatttacattacatcttt

SEQ ID NO: 118617 - DNA, 20 bp, Artificial Sequence
  chemically synthesized
actggtaggctgaatactga

SEQ ID NO: 118618 - DNA, 20 bp, Artificial Sequence
  chemically synthesized
acattacatctttcagtatt

SEQ ID NO: 118619 - DNA, 20 bp, Artificial Sequence
  chemically synthesized
tctttcagtattcagcctac

SEQ ID NO: 118620 - DNA, 20 bp, Artificial Sequence
  chemically synthesized
tttcaacaagttggactggt

SEQ ID NO: 118621 - DNA, 20 bp, Artificial Sequence
  chemically synthesized
ttttcaacaagttggactgg

SEQ ID NO: 118622 - DNA, 20 bp, Artificial Sequence
  chemically synthesized
aagttttcaacaagttggac

SEQ ID NO: 118623 - DNA, 20 bp, Artificial Sequence
  chemically synthesized
ccaaaaagttttcaacaagt

SEQ ID NO: 118624 - DNA, 20 bp, Artificial Sequence
  chemically synthesized
ggagccaaaaagttttcaac

SEQ ID NO: 118625 - DNA, 20 bp, Artificial Sequence
  chemically synthesized
ccaacttgttgaaaactttt

SEQ ID NO: 118626 - DNA, 20 bp, Artificial Sequence
  chemically synthesized
caagagtatcaggagccaaa

SEQ ID NO: 118627 - DNA, 20 bp, Artificial Sequence
  chemically synthesized
atagcagacaagagtatcag

SEQ ID NO: 118628 - DNA, 20 bp, Artificial Sequence
  chemically synthesized
atatagcagacaagagtatc

SEQ ID NO: 118629 - DNA, 20 bp, Artificial Sequence
  chemically synthesized
aatatagcagacaagagtat

SEQ ID NO: 118630 - DNA, 20 bp, Artificial Sequence
  chemically synthesized
atagcaaatatagcagacaa

SEQ ID NO: 118631 - DNA, 20 bp, Artificial Sequence
  chemically synthesized
aaatagcaaatatagcagac

SEQ ID NO: 118632 - DNA, 20 bp, Artificial Sequence
  chemically synthesized
gggagaaatagcaaatatag

SEQ ID NO: 118633 - DNA, 20 bp, Artificial Sequence
  chemically synthesized
gcagggagaaatagcaaata

SEQ ID NO: 118634 - DNA, 20 bp, Artificial Sequence
  chemically synthesized
tgccacaaagcagggagaaa

SEQ ID NO: 118635 - DNA, 20 bp, Artificial Sequence
  chemically synthesized
aatcaatgccacaaagcagg

SEQ ID NO: 118636 - DNA, 20 bp, Artificial Sequence
  chemically synthesized
tgctatttctccctgctttg

SEQ ID NO: 118637 - DNA, 20 bp, Artificial Sequence
  chemically synthesized
caaatcaatgccacaaagca

SEQ ID NO: 118638 - DNA, 20 bp, Artificial Sequence
  chemically synthesized
tcaaatcaatgccacaaagc

SEQ ID NO: 118639 - DNA, 20 bp, Artificial Sequence
  chemically synthesized
atcaaatcaatgccacaaag

SEQ ID NO: 118640 - DNA, 20 bp, Artificial Sequence
  chemically synthesized
cttatcaaatcaatgccaca

SEQ ID NO: 118641 - DNA, 20 bp, Artificial Sequence
  chemically synthesized
ctttgtggcattgatttgat

SEQ ID NO: 118642 - DNA, 20 bp, Artificial Sequence
  chemically synthesized
cagtggcttggatgaagaca

SEQ ID NO: 118643 - DNA, 20 bp, Artificial Sequence
  chemically synthesized
tgttatctatgtcttcatcc

SEQ ID NO: 118644 - DNA, 20 bp, Artificial Sequence
  chemically synthesized
tttcatcagtggcttggatg

SEQ ID NO: 118645 - DNA, 20 bp, Artificial Sequence
  chemically synthesized
caatattttcatcagtggct

SEQ ID NO: 118646 - DNA, 20 bp, Artificial Sequence
  chemically synthesized
cttttcaatattttcatcag

SEQ ID NO: 118647 - DNA, 20 bp, Artificial Sequence
  chemically synthesized
gtccttttcaatattttcat

SEQ ID NO: 118648 - DNA, 20 bp, Artificial Sequence
  chemically synthesized
ccactgatgaaaatattgaa

SEQ ID NO: 118649 - DNA, 20 bp, Artificial Sequence
  chemically synthesized
cactgatgaaaatattgaaa

SEQ ID NO: 118650 - DNA, 20 bp, Artificial Sequence
  chemically synthesized
gatgaaaatattgaaaagga

SEQ ID NO: 118651 - DNA, 20 bp, Artificial Sequence
  chemically synthesized
tgaaaatattgaaaaggaca

SEQ ID NO: 118652 - DNA, 20 bp, Artificial Sequence
  chemically synthesized
atattgaaaaggacagagct

SEQ ID NO: 118653 - DNA, 20 bp, Artificial Sequence
  chemically synthesized
gaaaaggacagagctgagat

SEQ ID NO: 118654 - DNA, 20 bp, Artificial Sequence
  chemically synthesized
tattcccggtaatctaatct

SEQ ID NO: 118655 - DNA, 20 bp, Artificial Sequence
  chemically synthesized
cagagctgagattagattac

SEQ ID NO: 118656 - DNA, 20 bp, Artificial Sequence
  chemically synthesized
agagctgagattagattacc

SEQ ID NO: 118657 - DNA, 20 bp, Artificial Sequence
  chemically synthesized
tgagattagattaccgggaa

SEQ ID NO: 118658 - DNA, 20 bp, Artificial Sequence
  chemically synthesized
aggtttcaggcagctattcc

SEQ ID NO: 118659 - DNA, 20 bp, Artificial Sequence
  chemically synthesized
atttggaaggaggtttcagg

SEQ ID NO: 118660 - DNA, 20 bp, Artificial Sequence
  chemically synthesized
tcaatttggaaggaggtttc

SEQ ID NO: 118661 - DNA, 20 bp, Artificial Sequence
  chemically synthesized
atcaatttggaaggaggttt

SEQ ID NO: 118662 - DNA, 20 bp, Artificial Sequence
  chemically synthesized
atacctatcaatttggaagg

SEQ ID NO: 118663 - DNA, 20 bp, Artificial Sequence
  chemically synthesized
gatacctatcaatttggaag

SEQ ID NO: 118664 - DNA, 20 bp, Artificial Sequence
  chemically synthesized
tggatacctatcaatttgga

SEQ ID NO: 118665 - DNA, 20 bp, Artificial Sequence
  chemically synthesized
atggatacctatcaatttgg

SEQ ID NO: 118666 - DNA, 20 bp, Artificial Sequence
  chemically synthesized
gaaacctccttccaaattga

SEQ ID NO: 118667 - DNA, 20 bp, Artificial Sequence
  chemically synthesized
aaacctccttccaaattgat

SEQ ID NO: 118668 - DNA, 20 bp, Artificial Sequence
  chemically synthesized
ctaatggatacctatcaatt

SEQ ID NO: 118669 - DNA, 20 bp, Artificial Sequence
  chemically synthesized
ccaaattgataggtatccat

SEQ ID NO: 118670 - DNA, 20 bp, Artificial Sequence
  chemically synthesized
attgataggtatccattaga

SEQ ID NO: 118671 - DNA, 20 bp, Artificial Sequence
  chemically synthesized
ctcccttcactgctgtctaa

SEQ ID NO: 118672 - DNA, 20 bp, Artificial Sequence
  chemically synthesized
gataggtatccattagacag

SEQ ID NO: 118673 - DNA, 20 bp, Artificial Sequence
  chemically synthesized
gtatccattagacagcagtg

SEQ ID NO: 118674 - DNA, 20 bp, Artificial Sequence
  chemically synthesized
tatccattagacagcagtga

SEQ ID NO: 118675 - DNA, 20 bp, Artificial Sequence
  chemically synthesized
atccattagacagcagtgaa

SEQ ID NO: 118676 - DNA, 20 bp, Artificial Sequence
  chemically synthesized
ccattagacagcagtgaagg

SEQ ID NO: 118677 - DNA, 20 bp, Artificial Sequence
  chemically synthesized
agacagcagtgaagggagca

SEQ ID NO: 118678 - DNA, 20 bp, Artificial Sequence
  chemically synthesized
gacagcagtgaagggagcat

SEQ ID NO: 118679 - DNA, 20 bp, Artificial Sequence
  chemically synthesized
agtgaagggagcataggcct

SEQ ID NO: 118680 - DNA, 20 bp, Artificial Sequence
  chemically synthesized
tgaagggagcataggcctca

SEQ ID NO: 118681 - DNA, 20 bp, Artificial Sequence
  chemically synthesized
atcccaaatctgcaactctg

SEQ ID NO: 118682 - DNA, 20 bp, Artificial Sequence
  chemically synthesized
gagcataggcctcagagttg

SEQ ID NO: 118683 - DNA, 20 bp, Artificial Sequence
  chemically synthesized
catcccaaatctgcaactct

SEQ ID NO: 118684 - DNA, 20 bp, Artificial Sequence
  chemically synthesized
aggcctcagagttgcagatt

SEQ ID NO: 118685 - DNA, 20 bp, Artificial Sequence
  chemically synthesized
ggcctcagagttgcagattt

SEQ ID NO: 118686 - DNA, 20 bp, Artificial Sequence
  chemically synthesized
tcagagttgcagatttggga

SEQ ID NO: 118687 - DNA, 20 bp, Artificial Sequence
  chemically synthesized
gcagatttgggatggaacaa

SEQ ID NO: 118688 - DNA, 20 bp, Artificial Sequence
  chemically synthesized
atggaacaacagttccgttt

SEQ ID NO: 118689 - DNA, 20 bp, Artificial Sequence
  chemically synthesized
gaacaacagttccgtttaag

SEQ ID NO: 118690 - DNA, 20 bp, Artificial Sequence
  chemically synthesized
gcttttgacctctgcttaaa

SEQ ID NO: 118691 - DNA, 20 bp, Artificial Sequence
  chemically synthesized
acaacagttccgtttaagca

SEQ ID NO: 118692 - DNA, 20 bp, Artificial Sequence
  chemically synthesized
caacagttccgtttaagcag

SEQ ID NO: 118693 - DNA, 20 bp, Artificial Sequence
  chemically synthesized
tccgtttaagcagaggtcaa

SEQ ID NO: 118694 - DNA, 20 bp, Artificial Sequence
  chemically synthesized
tttaagcagaggtcaaaagc

SEQ ID NO: 118695 - DNA, 20 bp, Artificial Sequence
  chemically synthesized
gaggtcaaaagctagactca

SEQ ID NO: 118696 - DNA, 20 bp, Artificial Sequence
  chemically synthesized
gttctctttagctgtgagtc

SEQ ID NO: 118697 - DNA, 20 bp, Artificial Sequence
  chemically synthesized
aaaagctagactcacagcta

SEQ ID NO: 118698 - DNA, 20 bp, Artificial Sequence
  chemically synthesized
gcattgttctctttagctgt

SEQ ID NO: 118699 - DNA, 20 bp, Artificial Sequence
  chemically synthesized
aagctagactcacagctaaa

SEQ ID NO: 118700 - DNA, 20 bp, Artificial Sequence
  chemically synthesized
taaaatggcattgttctctt

SEQ ID NO: 118701 - DNA, 20 bp, Artificial Sequence
  chemically synthesized
taaagagaacaatgccattt

SEQ ID NO: 118702 - DNA, 20 bp, Artificial Sequence
  chemically synthesized
ttaaaatagaaatgctaaaa

SEQ ID NO: 118703 - DNA, 20 bp, Artificial Sequence
  chemically synthesized
ttttagcatttctattttaa

SEQ ID NO: 118704 - DNA, 20 bp, Artificial Sequence
  chemically synthesized
tttagcatttctattttaat

SEQ ID NO: 118705 - DNA, 20 bp, Artificial Sequence
  chemically synthesized
acttaagtttcctattaaaa

SEQ ID NO: 118706 - DNA, 20 bp, Artificial Sequence
  chemically synthesized
tctattttaataggaaactt

SEQ ID NO: 118707 - DNA, 20 bp, Artificial Sequence
  chemically synthesized
gtgttatataagtgatactt

SEQ ID NO: 118708 - DNA, 20 bp, Artificial Sequence
  chemically synthesized
tttgttgaaatgtgttatat

SEQ ID NO: 118709 - DNA, 20 bp, Artificial Sequence
  chemically synthesized
tgattttatgtttttatagt

SEQ ID NO: 118710 - DNA, 20 bp, Artificial Sequence
  chemically synthesized
tttatgattttatgttttta

SEQ ID NO: 118711 - DNA, 20 bp, Artificial Sequence
  chemically synthesized
gttttcatgctgggacaaat

SEQ ID NO: 118712 - DNA, 20 bp, Artificial Sequence
  chemically synthesized
attattcatctaatttgtcc

SEQ ID NO: 118713 - DNA, 20 bp, Artificial Sequence
  chemically synthesized
ccaaatacagttttcatgct

SEQ ID NO: 118714 - DNA, 20 bp, Artificial Sequence
  chemically synthesized
accaaatacagttttcatgc

SEQ ID NO: 118715 - DNA, 20 bp, Artificial Sequence
  chemically synthesized
cccagcatgaaaactgtatt

SEQ ID NO: 118716 - DNA, 20 bp, Artificial Sequence
  chemically synthesized
ctccatgaaatgaccaaata

SEQ ID NO: 118717 - DNA, 20 bp, Artificial Sequence
  chemically synthesized
aactgtatttggtcatttca

SEQ ID NO: 118718 - DNA, 20 bp, Artificial Sequence
  chemically synthesized
ctgtatttggtcatttcatg

SEQ ID NO: 118719 - DNA, 20 bp, Artificial Sequence
  chemically synthesized
tgtatttggtcatttcatgg

SEQ ID NO: 118720 - DNA, 20 bp, Artificial Sequence
  chemically synthesized
gtatttggtcatttcatgga

SEQ ID NO: 118721 - DNA, 20 bp, Artificial Sequence
  chemically synthesized
ttcgtttacacattttaaaa

SEQ ID NO: 118722 - DNA, 20 bp, Artificial Sequence
  chemically synthesized
cgtttacacattttaaaaaa

SEQ ID NO: 118723 - DNA, 20 bp, Artificial Sequence
  chemically synthesized
gtttacacattttaaaaaag

SEQ ID NO: 118724 - DNA, 20 bp, Artificial Sequence
  chemically synthesized
ttaaaaaagaggttgtgata

SEQ ID NO: 118725 - DNA, 20 bp, Artificial Sequence
  chemically synthesized
aagaggttgtgataaagttg

SEQ ID NO: 118726 - DNA, 20 bp, Artificial Sequence
  chemically synthesized
gtgataaagttgaagttcaa

SEQ ID NO: 118727 - DNA, 20 bp, Artificial Sequence
  chemically synthesized
atgtcctagtgaagttgggg

SEQ ID NO: 118728 - DNA, 20 bp, Artificial Sequence
  chemically synthesized
taaatgtcctagtgaagttg

SEQ ID NO: 118729 - DNA, 20 bp, Artificial Sequence
  chemically synthesized
ttaaatgtcctagtgaagtt

SEQ ID NO: 118730 - DNA, 20 bp, Artificial Sequence
  chemically synthesized
aacagctaccccaacttcac

SEQ ID NO: 118731 - DNA, 20 bp, Artificial Sequence
  chemically synthesized
tttaaatgtcctagtgaagt

SEQ ID NO: 118732 - DNA, 20 bp, Artificial Sequence
  chemically synthesized
acagctaccccaacttcact

SEQ ID NO: 118733 - DNA, 20 bp, Artificial Sequence
  chemically synthesized
gtattttaaatgtcctagtg

SEQ ID NO: 118734 - DNA, 20 bp, Artificial Sequence
  chemically synthesized
tgccagtattttaaatgtcc

SEQ ID NO: 118735 - DNA, 20 bp, Artificial Sequence
  chemically synthesized
cactaggacatttaaaatac

SEQ ID NO: 118736 - DNA, 20 bp, Artificial Sequence
  chemically synthesized
gcctttttcttttatattgc

SEQ ID NO: 118737 - DNA, 20 bp, Artificial Sequence
  chemically synthesized
ttaaaatactggcaatataa

SEQ ID NO: 118738 - DNA, 20 bp, Artificial Sequence
  chemically synthesized
tactggcaatataaaagaaa

SEQ ID NO: 118739 - DNA, 20 bp, Artificial Sequence
  chemically synthesized
actggcaatataaaagaaaa

SEQ ID NO: 118740 - DNA, 20 bp, Artificial Sequence
  chemically synthesized
aaaagaaaaaggcaatccat

SEQ ID NO: 118741 - DNA, 20 bp, Artificial Sequence
  chemically synthesized
gccgctcatacaattactga

SEQ ID NO: 118742 - DNA, 20 bp, Artificial Sequence
  chemically synthesized
caatccatcagtaattgtat

SEQ ID NO: 118743 - DNA, 20 bp, Artificial Sequence
  chemically synthesized
tccatcagtaattgtatgag

SEQ ID NO: 118744 - DNA, 20 bp, Artificial Sequence
  chemically synthesized
gtaattgtatgagcggccat

SEQ ID NO: 118745 - DNA, 20 bp, Artificial Sequence
  chemically synthesized
gtatgagcggccataagttt

SEQ ID NO: 118746 - DNA, 20 bp, Artificial Sequence
  chemically synthesized
acctacgttgcttaaactta

SEQ ID NO: 118747 - DNA, 20 bp, Artificial Sequence
  chemically synthesized
ggccataagtttaagcaacg

SEQ ID NO: 118748 - DNA, 20 bp, Artificial Sequence
  chemically synthesized
gccataagtttaagcaacgt

SEQ ID NO: 118749 - DNA, 20 bp, Artificial Sequence
  chemically synthesized
aacgtaggttattatctaca

SEQ ID NO: 118750 - DNA, 20 bp, Artificial Sequence
  chemically synthesized
acgtaggttattatctacaa

SEQ ID NO: 118751 - DNA, 20 bp, Artificial Sequence
  chemically synthesized
accaaattcaatcacctttg

SEQ ID NO: 118752 - DNA, 20 bp, Artificial Sequence
  chemically synthesized
tctacaaaggtgattgaatt

SEQ ID NO: 118753 - DNA, 20 bp, Artificial Sequence
  chemically synthesized
cagagcaattaaagcaaatc

SEQ ID NO: 118754 - DNA, 20 bp, Artificial Sequence
  chemically synthesized
acagagcaattaaagcaaat

SEQ ID NO: 118755 - DNA, 20 bp, Artificial Sequence
  chemically synthesized
tttatgccacagagcaatta

SEQ ID NO: 118756 - DNA, 20 bp, Artificial Sequence
  chemically synthesized
gatttgctttaattgctctg

SEQ ID NO: 118757 - DNA, 20 bp, Artificial Sequence
  chemically synthesized
gtcagtgtgtttatgccaca

SEQ ID NO: 118758 - DNA, 20 bp, Artificial Sequence
  chemically synthesized
cagtcagtgtgtttatgcca

SEQ ID NO: 118759 - DNA, 20 bp, Artificial Sequence
  chemically synthesized
tgtggcataaacacactgac

SEQ ID NO: 118760 - DNA, 20 bp, Artificial Sequence
  chemically synthesized
tacatcactctgtgtccagt

SEQ ID NO: 118761 - DNA, 20 bp, Artificial Sequence
  chemically synthesized
ataaacacactgactggaca

SEQ ID NO: 118762 - DNA, 20 bp, Artificial Sequence
  chemically synthesized
aaacacactgactggacaca

SEQ ID NO: 118763 - DNA, 20 bp, Artificial Sequence
  chemically synthesized
tcattacatcactctgtgtc

SEQ ID NO: 118764 - DNA, 20 bp, Artificial Sequence
  chemically synthesized
tggacacagagtgatgtaat

SEQ ID NO: 118765 - DNA, 20 bp, Artificial Sequence
  chemically synthesized
gatgtaatgagtatcataat

SEQ ID NO: 118766 - DNA, 20 bp, Artificial Sequence
  chemically synthesized
atgtaatgagtatcataatt

SEQ ID NO: 118767 - DNA, 20 bp, Artificial Sequence
  chemically synthesized
tcataattaggaatttgata

SEQ ID NO: 118768 - DNA, 20 bp, Artificial Sequence
  chemically synthesized
attaggaatttgataaagct

SEQ ID NO: 118769 - DNA, 20 bp, Artificial Sequence
  chemically synthesized
ctaatagtcagtttcacact

SEQ ID NO: 118770 - DNA, 20 bp, Artificial Sequence
  chemically synthesized
ctaagtgtgaaactgactat

SEQ ID NO: 118771 - DNA, 20 bp, Artificial Sequence
  chemically synthesized
ttcaaatatcttctaatagt

SEQ ID NO: 118772 - DNA, 20 bp, Artificial Sequence
  chemically synthesized
agtgtgaaactgactattag

SEQ ID NO: 118773 - DNA, 20 bp, Artificial Sequence
  chemically synthesized
gtgtttcaaatatcttctaa

SEQ ID NO: 118774 - DNA, 20 bp, Artificial Sequence
  chemically synthesized
caattccccattcaaagcag

SEQ ID NO: 118775 - DNA, 20 bp, Artificial Sequence
  chemically synthesized
cacacaactactgctttgaa

SEQ ID NO: 118776 - DNA, 20 bp, Artificial Sequence
  chemically synthesized
aatcaattccccattcaaag

SEQ ID NO: 118777 - DNA, 20 bp, Artificial Sequence
  chemically synthesized
acacaactactgctttgaat

SEQ ID NO: 118778 - DNA, 20 bp, Artificial Sequence
  chemically synthesized
cacaactactgctttgaatg

SEQ ID NO: 118779 - DNA, 20 bp, Artificial Sequence
  chemically synthesized
ggaaatcaattccccattca

SEQ ID NO: 118780 - DNA, 20 bp, Artificial Sequence
  chemically synthesized
tgaatggggaattgatttcc

SEQ ID NO: 118781 - DNA, 20 bp, Artificial Sequence
  chemically synthesized
gaaaattatttaaattaact

SEQ ID NO: 118782 - DNA, 20 bp, Artificial Sequence
  chemically synthesized
tgaaaattatttaaattaac

SEQ ID NO: 118783 - DNA, 20 bp, Artificial Sequence
  chemically synthesized
gtcatcagtattcatagaaa

SEQ ID NO: 118784 - DNA, 20 bp, Artificial Sequence
  chemically synthesized
ctgtcatcagtattcataga

SEQ ID NO: 118785 - DNA, 20 bp, Artificial Sequence
  chemically synthesized
ccgtctgtcatcagtattca

SEQ ID NO: 118786 - DNA, 20 bp, Artificial Sequence
  chemically synthesized
ctttctatgaatactgatga

SEQ ID NO: 118787 - DNA, 20 bp, Artificial Sequence
  chemically synthesized
gtggtcattccgtctgtcat

SEQ ID NO: 118788 - DNA, 20 bp, Artificial Sequence
  chemically synthesized
ctatgaatactgatgacaga

SEQ ID NO: 118789 - DNA, 20 bp, Artificial Sequence
  chemically synthesized
gatgacagacggaatgacca

SEQ ID NO: 118790 - DNA, 20 bp, Artificial Sequence
  chemically synthesized
ccagccaatgttttatgctg

SEQ ID NO: 118791 - DNA, 20 bp, Artificial Sequence
  chemically synthesized
atgaccacagcataaaacat

SEQ ID NO: 118792 - DNA, 20 bp, Artificial Sequence
  chemically synthesized
ccacagcataaaacattggc

SEQ ID NO: 118793 - DNA, 20 bp, Artificial Sequence
  chemically synthesized
cagcataaaacattggctgg

SEQ ID NO: 118794 - DNA, 20 bp, Artificial Sequence
  chemically synthesized
agtacatagtgacattcttc

SEQ ID NO: 118795 - DNA, 20 bp, Artificial Sequence
  chemically synthesized
aaataatttcttgaagtaca

SEQ ID NO: 118796 - DNA, 20 bp, Artificial Sequence
  chemically synthesized
agaatgtcactatgtacttc

SEQ ID NO: 118797 - DNA, 20 bp, Artificial Sequence
  chemically synthesized
atgggggaaataatttcttg

SEQ ID NO: 118798 - DNA, 20 bp, Artificial Sequence
  chemically synthesized
cttttcaataaaaaacatgg

SEQ ID NO: 118799 - DNA, 20 bp, Artificial Sequence
  chemically synthesized
tcttttcaataaaaaacatg

SEQ ID NO: 118800 - DNA, 20 bp, Artificial Sequence
  chemically synthesized
atcttttcaataaaaaacat

SEQ ID NO: 118801 - DNA, 20 bp, Artificial Sequence
  chemically synthesized
tatcttttcaataaaaaaca

SEQ ID NO: 118802 - DNA, 20 bp, Artificial Sequence
  chemically synthesized
cccccatgttttttattgaa

SEQ ID NO: 118803 - DNA, 20 bp, Artificial Sequence
  chemically synthesized
ttattaggaaggaaatggac

SEQ ID NO: 118804 - DNA, 20 bp, Artificial Sequence
  chemically synthesized
tttattaggaaggaaatgga

SEQ ID NO: 118805 - DNA, 20 bp, Artificial Sequence
  chemically synthesized
catttttattaggaaggaaa

SEQ ID NO: 118806 - DNA, 20 bp, Artificial Sequence
  chemically synthesized
ttaccacatttttattagga

SEQ ID NO: 118807 - DNA, 20 bp, Artificial Sequence
  chemically synthesized
cttaccacatttttattagg

SEQ ID NO: 118808 - DNA, 20 bp, Artificial Sequence
  chemically synthesized
aatcttaccacatttttatt

SEQ ID NO: 118809 - DNA, 20 bp, Artificial Sequence
  chemically synthesized
aaatcttaccacatttttat

SEQ ID NO: 118810 - DNA, 20 bp, Artificial Sequence
  chemically synthesized
tttccttcctaataaaaatg

SEQ ID NO: 118811 - DNA, 20 bp, Artificial Sequence
  chemically synthesized
cttcctaataaaaatgtggt

SEQ ID NO: 118812 - DNA, 20 bp, Artificial Sequence
  chemically synthesized
cagttaaaagcattttcaga

SEQ ID NO: 118813 - DNA, 20 bp, Artificial Sequence
  chemically synthesized
ttaacagttaaaagcatttt

SEQ ID NO: 118814 - DNA, 20 bp, Artificial Sequence
  chemically synthesized
ccctgtttattaacagttaa

SEQ ID NO: 118815 - DNA, 20 bp, Artificial Sequence
  chemically synthesized
acttactccctgtttattaa

SEQ ID NO: 118816 - DNA, 20 bp, Artificial Sequence
  chemically synthesized
tgcttttaactgttaataaa

SEQ ID NO: 118817 - DNA, 20 bp, Artificial Sequence
  chemically synthesized
gcttttaactgttaataaac

SEQ ID NO: 118818 - DNA, 20 bp, Artificial Sequence
  chemically synthesized
cttttaactgttaataaaca

SEQ ID NO: 118819 - DNA, 20 bp, Artificial Sequence
  chemically synthesized
tttaactgttaataaacagg

SEQ ID NO: 118820 - DNA, 20 bp, Artificial Sequence
  chemically synthesized
actgttaataaacagggagt

SEQ ID NO: 118821 - DNA, 20 bp, Artificial Sequence
  chemically synthesized
gggagtaagtaaaataaaaa

SEQ ID NO: 118822 - DNA, 20 bp, Artificial Sequence
  chemically synthesized
ggagtaagtaaaataaaaat

SEQ ID NO: 118823 - DNA, 20 bp, Artificial Sequence
  chemically synthesized
atatatttgcaaaaatatga

SEQ ID NO: 118824 - DNA, 20 bp, Artificial Sequence
  chemically synthesized
tatttgcaaaaatatgatag

SEQ ID NO: 118825 - DNA, 20 bp, Artificial Sequence
  chemically synthesized
atttgcaaaaatatgataga

SEQ ID NO: 118826 - DNA, 20 bp, Artificial Sequence
  chemically synthesized
atatgatagaaggaattgct

SEQ ID NO: 118827 - DNA, 20 bp, Artificial Sequence
  chemically synthesized
agaatcattctcaacattct

SEQ ID NO: 118828 - DNA, 20 bp, Artificial Sequence
  chemically synthesized
aaggaattgctaagaatgtt

SEQ ID NO: 118829 - DNA, 20 bp, Artificial Sequence
  chemically synthesized
ctatcaaaaatttacaaata

SEQ ID NO: 118830 - DNA, 20 bp, Artificial Sequence
  chemically synthesized
ctttatttgtaaatttttga

SEQ ID NO: 118831 - DNA, 20 bp, Artificial Sequence
  chemically synthesized
tttttgatagtttctacaat

SEQ ID NO: 118832 - DNA, 20 bp, Artificial Sequence
  chemically synthesized
agtacaagtgattcttattg

SEQ ID NO: 118833 - DNA, 20 bp, Artificial Sequence
  chemically synthesized
aataagaatcacttgtacta

SEQ ID NO: 118834 - DNA, 20 bp, Artificial Sequence
  chemically synthesized
ataagaatcacttgtactaa

SEQ ID NO: 118835 - DNA, 20 bp, Artificial Sequence
  chemically synthesized
taacttctttcctttagtac

SEQ ID NO: 118836 - DNA, 20 bp, Artificial Sequence
  chemically synthesized
gaatcacttgtactaaagga

SEQ ID NO: 118837 - DNA, 20 bp, Artificial Sequence
  chemically synthesized
ttgaaataacttctttcctt

SEQ ID NO: 118838 - DNA, 20 bp, Artificial Sequence
  chemically synthesized
tcacttgtactaaaggaaag

SEQ ID NO: 118839 - DNA, 20 bp, Artificial Sequence
  chemically synthesized
aaagaagttatttcaaaata

SEQ ID NO: 118840 - DNA, 20 bp, Artificial Sequence
  chemically synthesized
gaagttatttcaaaatatag

SEQ ID NO: 118841 - DNA, 20 bp, Artificial Sequence
  chemically synthesized
atagaagaaacatccaaaca

SEQ ID NO: 118842 - DNA, 20 bp, Artificial Sequence
  chemically synthesized
atctaccatttttctgtgtt

SEQ ID NO: 118843 - DNA, 20 bp, Artificial Sequence
  chemically synthesized
aacatccaaacacagaaaaa

SEQ ID NO: 118844 - DNA, 20 bp, Artificial Sequence
  chemically synthesized
atccaaacacagaaaaatgg

SEQ ID NO: 118845 - DNA, 20 bp, Artificial Sequence
  chemically synthesized
tggtagataaaataccaaaa

SEQ ID NO: 118846 - DNA, 20 bp, Artificial Sequence
  chemically synthesized
gcctttttgattttctattt

SEQ ID NO: 118847 - DNA, 20 bp, Artificial Sequence
  chemically synthesized
taccaaaatagaaaatcaaa

SEQ ID NO: 118848 - DNA, 20 bp, Artificial Sequence
  chemically synthesized
accaaaatagaaaatcaaaa

SEQ ID NO: 118849 - DNA, 20 bp, Artificial Sequence
  chemically synthesized
aaaatcaaaaaggcacaatc

SEQ ID NO: 118850 - DNA, 20 bp, Artificial Sequence
  chemically synthesized
aaatcaaaaaggcacaatct

SEQ ID NO: 118851 - DNA, 20 bp, Artificial Sequence
  chemically synthesized
aaaaaggcacaatctgggct

SEQ ID NO: 118852 - DNA, 20 bp, Artificial Sequence
  chemically synthesized
acttaacttgtttctaagcc

SEQ ID NO: 118853 - DNA, 20 bp, Artificial Sequence
  chemically synthesized
cacaatctgggcttagaaac

SEQ ID NO: 118854 - DNA, 20 bp, Artificial Sequence
  chemically synthesized
gagctacttaacttgtttct

SEQ ID NO: 118855 - DNA, 20 bp, Artificial Sequence
  chemically synthesized
tctgggcttagaaacaagtt

SEQ ID NO: 118856 - DNA, 20 bp, Artificial Sequence
  chemically synthesized
gggcttagaaacaagttaag

SEQ ID NO: 118857 - DNA, 20 bp, Artificial Sequence
  chemically synthesized
agttaagtagctctgtgttt

SEQ ID NO: 118858 - DNA, 20 bp, Artificial Sequence
  chemically synthesized
tgtggcatttctgaaacaca

SEQ ID NO: 118859 - DNA, 20 bp, Artificial Sequence
  chemically synthesized
tttgtggcatttctgaaaca

SEQ ID NO: 118860 - DNA, 20 bp, Artificial Sequence
  chemically synthesized
tgcaccactgtgtgtttttg

SEQ ID NO: 118861 - DNA, 20 bp, Artificial Sequence
  chemically synthesized
agaaatgccacaaaaacaca

SEQ ID NO: 118862 - DNA, 20 bp, Artificial Sequence
  chemically synthesized
aatgccacaaaaacacacag

SEQ ID NO: 118863 - DNA, 20 bp, Artificial Sequence
  chemically synthesized
caaaaacacacagtggtgca

SEQ ID NO: 118864 - DNA, 20 bp, Artificial Sequence
  chemically synthesized
aaaaacacacagtggtgcac

SEQ ID NO: 118865 - DNA, 20 bp, Artificial Sequence
  chemically synthesized
aaaacacacagtggtgcacg

SEQ ID NO: 118866 - DNA, 20 bp, Artificial Sequence
  chemically synthesized
cacagtggtgcacggggctg

SEQ ID NO: 118867 - DNA, 20 bp, Artificial Sequence
  chemically synthesized
ggtgcacggggctgcagaca

SEQ ID NO: 118868 - DNA, 20 bp, Artificial Sequence
  chemically synthesized
gtgcacggggctgcagacat

SEQ ID NO: 118869 - DNA, 20 bp, Artificial Sequence
  chemically synthesized
ccccaaaagccctatgtctg

SEQ ID NO: 118870 - DNA, 20 bp, Artificial Sequence
  chemically synthesized
tgcacggggctgcagacata

SEQ ID NO: 118871 - DNA, 20 bp, Artificial Sequence
  chemically synthesized
ggctgcagacatagggcttt

SEQ ID NO: 118872 - DNA, 20 bp, Artificial Sequence
  chemically synthesized
gctgcagacatagggctttt

SEQ ID NO: 118873 - DNA, 20 bp, Artificial Sequence
  chemically synthesized
ctgcagacatagggcttttg

SEQ ID NO: 118874 - DNA, 20 bp, Artificial Sequence
  chemically synthesized
cttcccagcccaggccccaa

SEQ ID NO: 118875 - DNA, 20 bp, Artificial Sequence
  chemically synthesized
gacatagggcttttggggcc

SEQ ID NO: 118876 - DNA, 20 bp, Artificial Sequence
  chemically synthesized
acatagggcttttggggcct

SEQ ID NO: 118877 - DNA, 20 bp, Artificial Sequence
  chemically synthesized
agggcttttggggcctgggc

SEQ ID NO: 118878 - DNA, 20 bp, Artificial Sequence
  chemically synthesized
gggcttttggggcctgggct

SEQ ID NO: 118879 - DNA, 20 bp, Artificial Sequence
  chemically synthesized
tgctacctacttcccagccc

SEQ ID NO: 118880 - DNA, 20 bp, Artificial Sequence
  chemically synthesized
cttttggggcctgggctggg

SEQ ID NO: 118881 - DNA, 20 bp, Artificial Sequence
  chemically synthesized
ctgctacctacttcccagcc

SEQ ID NO: 118882 - DNA, 20 bp, Artificial Sequence
  chemically synthesized
ttggggcctgggctgggaag

SEQ ID NO: 118883 - DNA, 20 bp, Artificial Sequence
  chemically synthesized
tggggcctgggctgggaagt

SEQ ID NO: 118884 - DNA, 20 bp, Artificial Sequence
  chemically synthesized
ggctactgctacctacttcc

SEQ ID NO: 118885 - DNA, 20 bp, Artificial Sequence
  chemically synthesized
ggcctgggctgggaagtagg

SEQ ID NO: 118886 - DNA, 20 bp, Artificial Sequence
  chemically synthesized
ctgggctgggaagtaggtag

SEQ ID NO: 118887 - DNA, 20 bp, Artificial Sequence
  chemically synthesized
ggctgggaagtaggtagcag

SEQ ID NO: 118888 - DNA, 20 bp, Artificial Sequence
  chemically synthesized
gggaagtaggtagcagtagc

SEQ ID NO: 118889 - DNA, 20 bp, Artificial Sequence
  chemically synthesized
ggaagtaggtagcagtagcc

SEQ ID NO: 118890 - DNA, 20 bp, Artificial Sequence
  chemically synthesized
aagtaggtagcagtagccag

SEQ ID NO: 118891 - DNA, 20 bp, Artificial Sequence
  chemically synthesized
ggtagcagtagccaggagtt

SEQ ID NO: 118892 - DNA, 20 bp, Artificial Sequence
  chemically synthesized
cccagcagaatctgaactcc

SEQ ID NO: 118893 - DNA, 20 bp, Artificial Sequence
  chemically synthesized
gccaggagttcagattctgc

SEQ ID NO: 118894 - DNA, 20 bp, Artificial Sequence
  chemically synthesized
ccaggagttcagattctgct

SEQ ID NO: 118895 - DNA, 20 bp, Artificial Sequence
  chemically synthesized
ttatagattcttgagcccag

SEQ ID NO: 118896 - DNA, 20 bp, Artificial Sequence
  chemically synthesized
gttcagattctgctgggctc

SEQ ID NO: 118897 - DNA, 20 bp, Artificial Sequence
  chemically synthesized
tgtttatagattcttgagcc

SEQ ID NO: 118898 - DNA, 20 bp, Artificial Sequence
  chemically synthesized
ccgagtgtttatagattctt

SEQ ID NO: 118899 - DNA, 20 bp, Artificial Sequence
  chemically synthesized
tgtcttataccgagtgttta

SEQ ID NO: 118900 - DNA, 20 bp, Artificial Sequence
  chemically synthesized
ctcaagaatctataaacact

SEQ ID NO: 118901 - DNA, 20 bp, Artificial Sequence
  chemically synthesized
aatctataaacactcggtat

SEQ ID NO: 118902 - DNA, 20 bp, Artificial Sequence
  chemically synthesized
caggtcctttgtcttatacc

SEQ ID NO: 118903 - DNA, 20 bp, Artificial Sequence
  chemically synthesized
taaacactcggtataagaca

SEQ ID NO: 118904 - DNA, 20 bp, Artificial Sequence
  chemically synthesized
aaacactcggtataagacaa

SEQ ID NO: 118905 - DNA, 20 bp, Artificial Sequence
  chemically synthesized
cggtataagacaaaggacct

SEQ ID NO: 118906 - DNA, 20 bp, Artificial Sequence
  chemically synthesized
ataagacaaaggacctgagc

SEQ ID NO: 118907 - DNA, 20 bp, Artificial Sequence
  chemically synthesized
taagacaaaggacctgagcc

SEQ ID NO: 118908 - DNA, 20 bp, Artificial Sequence
  chemically synthesized
tgcagcaaagagcctggctc

SEQ ID NO: 118909 - DNA, 20 bp, Artificial Sequence
  chemically synthesized
ttgcagcaaagagcctggct

SEQ ID NO: 118910 - DNA, 20 bp, Artificial Sequence
  chemically synthesized
actaattgcagcaaagagcc

SEQ ID NO: 118911 - DNA, 20 bp, Artificial Sequence
  chemically synthesized
ccttgactaattgcagcaaa

SEQ ID NO: 118912 - DNA, 20 bp, Artificial Sequence
  chemically synthesized
atccttgactaattgcagca

SEQ ID NO: 118913 - DNA, 20 bp, Artificial Sequence
  chemically synthesized
gccaggctctttgctgcaat

SEQ ID NO: 118914 - DNA, 20 bp, Artificial Sequence
  chemically synthesized
atatcatccttgactaattg

SEQ ID NO: 118915 - DNA, 20 bp, Artificial Sequence
  chemically synthesized
gctctttgctgcaattagtc

SEQ ID NO: 118916 - DNA, 20 bp, Artificial Sequence
  chemically synthesized
ctctttgctgcaattagtca

SEQ ID NO: 118917 - DNA, 20 bp, Artificial Sequence
  chemically synthesized
caattagtcaaggatgatat

SEQ ID NO: 118918 - DNA, 20 bp, Artificial Sequence
  chemically synthesized
aattagtcaaggatgatatc

SEQ ID NO: 118919 - DNA, 20 bp, Artificial Sequence
  chemically synthesized
gatgatatcaggtttcccta

SEQ ID NO: 118920 - DNA, 20 bp, Artificial Sequence
  chemically synthesized
atgatatcaggtttccctac

SEQ ID NO: 118921 - DNA, 20 bp, Artificial Sequence
  chemically synthesized
tgatatcaggtttccctacg

SEQ ID NO: 118922 - DNA, 20 bp, Artificial Sequence
  chemically synthesized
cagctccctttcaccccgta

SEQ ID NO: 118923 - DNA, 20 bp, Artificial Sequence
  chemically synthesized
gcagctccctttcaccccgt

SEQ ID NO: 118924 - DNA, 20 bp, Artificial Sequence
  chemically synthesized
tgcagctccctttcaccccg

SEQ ID NO: 118925 - DNA, 20 bp, Artificial Sequence
  chemically synthesized
caggtttccctacggggtga

SEQ ID NO: 118926 - DNA, 20 bp, Artificial Sequence
  chemically synthesized
aggtttccctacggggtgaa

SEQ ID NO: 118927 - DNA, 20 bp, Artificial Sequence
  chemically synthesized
ggtttccctacggggtgaaa

SEQ ID NO: 118928 - DNA, 20 bp, Artificial Sequence
  chemically synthesized
tttccctacggggtgaaagg

SEQ ID NO: 118929 - DNA, 20 bp, Artificial Sequence
  chemically synthesized
tttttttttttttttttttg

SEQ ID NO: 118930 - DNA, 20 bp, Artificial Sequence
  chemically synthesized
ttctaggttgtgatcaatag

SEQ ID NO: 118931 - DNA, 20 bp, Artificial Sequence
  chemically synthesized
cagttctaggttgtgatcaa

SEQ ID NO: 118932 - DNA, 20 bp, Artificial Sequence
  chemically synthesized
atctgctattgatcacaacc

SEQ ID NO: 118933 - DNA, 20 bp, Artificial Sequence
  chemically synthesized
gatgtcatttaatcagttct

SEQ ID NO: 118934 - DNA, 20 bp, Artificial Sequence
  chemically synthesized
ggatgtcatttaatcagttc

SEQ ID NO: 118935 - DNA, 20 bp, Artificial Sequence
  chemically synthesized
aaaaagggatgtcatttaat

SEQ ID NO: 118936 - DNA, 20 bp, Artificial Sequence
  chemically synthesized
gattaaatgacatccctttt

SEQ ID NO: 118937 - DNA, 20 bp, Artificial Sequence
  chemically synthesized
attaaatgacatcccttttt

SEQ ID NO: 118938 - DNA, 20 bp, Artificial Sequence
  chemically synthesized
ttaaatgacatcccttttta

SEQ ID NO: 118939 - DNA, 20 bp, Artificial Sequence
  chemically synthesized
taaatgacatccctttttag

SEQ ID NO: 118940 - DNA, 20 bp, Artificial Sequence
  chemically synthesized
ttccaatttccccctaaaaa

SEQ ID NO: 118941 - DNA, 20 bp, Artificial Sequence
  chemically synthesized
aaatgacatccctttttagg

SEQ ID NO: 118942 - DNA, 20 bp, Artificial Sequence
  chemically synthesized
tttccaatttccccctaaaa

SEQ ID NO: 118943 - DNA, 20 bp, Artificial Sequence
  chemically synthesized
ctttccaatttccccctaaa

SEQ ID NO: 118944 - DNA, 20 bp, Artificial Sequence
  chemically synthesized
atccctttttagggggaaat

SEQ ID NO: 118945 - DNA, 20 bp, Artificial Sequence
  chemically synthesized
ctttttagggggaaattgga

SEQ ID NO: 118946 - DNA, 20 bp, Artificial Sequence
  chemically synthesized
tagggggaaattggaaagat

SEQ ID NO: 118947 - DNA, 20 bp, Artificial Sequence
  chemically synthesized
ttggacatataggtattaat

SEQ ID NO: 118948 - DNA, 20 bp, Artificial Sequence
  chemically synthesized
ttaaaaatgtttggacatat

SEQ ID NO: 118949 - DNA, 20 bp, Artificial Sequence
  chemically synthesized
attaaaaatgtttggacata

SEQ ID NO: 118950 - DNA, 20 bp, Artificial Sequence
  chemically synthesized
tttcttatattaaaaatgtt

SEQ ID NO: 118951 - DNA, 20 bp, Artificial Sequence
  chemically synthesized
tgtccaaacatttttaatat

SEQ ID NO: 118952 - DNA, 20 bp, Artificial Sequence
  chemically synthesized
aatcatttgaattaatgatt

SEQ ID NO: 118953 - DNA, 20 bp, Artificial Sequence
  chemically synthesized
tcatttgaattaatgattta

SEQ ID NO: 118954 - DNA, 20 bp, Artificial Sequence
  chemically synthesized
ttgaattaatgatttagaga

SEQ ID NO: 118955 - DNA, 20 bp, Artificial Sequence
  chemically synthesized
tgaattaatgatttagagaa

SEQ ID NO: 118956 - DNA, 20 bp, Artificial Sequence
  chemically synthesized
aatgatttagagaaaggaaa

SEQ ID NO: 118957 - DNA, 20 bp, Artificial Sequence
  chemically synthesized
gctttattcagtatgtaaca

SEQ ID NO: 118958 - DNA, 20 bp, Artificial Sequence
  chemically synthesized
ggctttattcagtatgtaac

SEQ ID NO: 118959 - DNA, 20 bp, Artificial Sequence
  chemically synthesized
tggctttattcagtatgtaa

SEQ ID NO: 118960 - DNA, 20 bp, Artificial Sequence
  chemically synthesized
tccctgttacatactgaata

SEQ ID NO: 118961 - DNA, 20 bp, Artificial Sequence
  chemically synthesized
tgggatcctttggctttatt

SEQ ID NO: 118962 - DNA, 20 bp, Artificial Sequence
  chemically synthesized
ttacatactgaataaagcca

SEQ ID NO: 118963 - DNA, 20 bp, Artificial Sequence
  chemically synthesized
tacatactgaataaagccaa

SEQ ID NO: 118964 - DNA, 20 bp, Artificial Sequence
  chemically synthesized
cttatagttttgggatcctt

SEQ ID NO: 118965 - DNA, 20 bp, Artificial Sequence
  chemically synthesized
tctagaaatcttatagtttt

SEQ ID NO: 118966 - DNA, 20 bp, Artificial Sequence
  chemically synthesized
ccaaaggatcccaaaactat

SEQ ID NO: 118967 - DNA, 20 bp, Artificial Sequence
  chemically synthesized
ttctagaaatcttatagttt

SEQ ID NO: 118968 - DNA, 20 bp, Artificial Sequence
  chemically synthesized
gcacaattctagaaatctta

SEQ ID NO: 118969 - DNA, 20 bp, Artificial Sequence
  chemically synthesized
tcccaaaactataagatttc

SEQ ID NO: 118970 - DNA, 20 bp, Artificial Sequence
  chemically synthesized
aatttttttctgcacaattc

SEQ ID NO: 118971 - DNA, 20 bp, Artificial Sequence
  chemically synthesized
ataagatttctagaattgtg

SEQ ID NO: 118972 - DNA, 20 bp, Artificial Sequence
  chemically synthesized
gaattgtgcagaaaaaaatt

SEQ ID NO: 118973 - DNA, 20 bp, Artificial Sequence
  chemically synthesized
gtgcagaaaaaaattaagtc

SEQ ID NO: 118974 - DNA, 20 bp, Artificial Sequence
  chemically synthesized
agatttatttttagaaagtt

SEQ ID NO: 118975 - DNA, 20 bp, Artificial Sequence
  chemically synthesized
taggtagatttatttttaga

SEQ ID NO: 118976 - DNA, 20 bp, Artificial Sequence
  chemically synthesized
aatttaggtagatttatttt

SEQ ID NO: 118977 - DNA, 20 bp, Artificial Sequence
  chemically synthesized
caataaaaatagaatttagg

SEQ ID NO: 118978 - DNA, 20 bp, Artificial Sequence
  chemically synthesized
attcaataaaaatagaattt

SEQ ID NO: 118979 - DNA, 20 bp, Artificial Sequence
  chemically synthesized
cattcaataaaaatagaatt

SEQ ID NO: 118980 - DNA, 20 bp, Artificial Sequence
  chemically synthesized
tttaaaacattcaataaaaa

SEQ ID NO: 118981 - DNA, 20 bp, Artificial Sequence
  chemically synthesized
tatttttattgaatgtttta

SEQ ID NO: 118982 - DNA, 20 bp, Artificial Sequence
  chemically synthesized
ttttattgaatgttttaaag

SEQ ID NO: 118983 - DNA, 20 bp, Artificial Sequence
  chemically synthesized
tgttttaaagaagtctttct

SEQ ID NO: 118984 - DNA, 20 bp, Artificial Sequence
  chemically synthesized
ctatctgtatcattctcaga

SEQ ID NO: 118985 - DNA, 20 bp, Artificial Sequence
  chemically synthesized
atttctatctgtatcattct

SEQ ID NO: 118986 - DNA, 20 bp, Artificial Sequence
  chemically synthesized
aagtctttctgagaatgata

SEQ ID NO: 118987 - DNA, 20 bp, Artificial Sequence
  chemically synthesized
ctttctgagaatgatacaga

SEQ ID NO: 118988 - DNA, 20 bp, Artificial Sequence
  chemically synthesized
aaaatataaatataattgaa

SEQ ID NO: 118989 - DNA, 20 bp, Artificial Sequence
  chemically synthesized
ataattgaaaagtaacatga

SEQ ID NO: 118990 - DNA, 20 bp, Artificial Sequence
  chemically synthesized
taattgaaaagtaacatgat

SEQ ID NO: 118991 - DNA, 20 bp, Artificial Sequence
  chemically synthesized
aagtaacatgatgggtattg

SEQ ID NO: 118992 - DNA, 20 bp, Artificial Sequence
  chemically synthesized
ggtattgtagctaacattaa

SEQ ID NO: 118993 - DNA, 20 bp, Artificial Sequence
  chemically synthesized
tttaattgaaccattaatgt

SEQ ID NO: 118994 - DNA, 20 bp, Artificial Sequence
  chemically synthesized
atggttcaattaaaccaaat

SEQ ID NO: 118995 - DNA, 20 bp, Artificial Sequence
  chemically synthesized
gggagaaagtttttcttatt

SEQ ID NO: 118996 - DNA, 20 bp, Artificial Sequence
  chemically synthesized
atattaaagcaaatgggaga

SEQ ID NO: 118997 - DNA, 20 bp, Artificial Sequence
  chemically synthesized
tcaaatattaaagcaaatgg

SEQ ID NO: 118998 - DNA, 20 bp, Artificial Sequence
  chemically synthesized
tatcaaatattaaagcaaat

SEQ ID NO: 118999 - DNA, 20 bp, Artificial Sequence
  chemically synthesized
gtatcaaatattaaagcaaa

SEQ ID NO: 119000 - DNA, 20 bp, Artificial Sequence
  chemically synthesized
tattacagtatcaaatatta

SEQ ID NO: 119001 - DNA, 20 bp, Artificial Sequence
  chemically synthesized
tgttcataaatttaatatta

SEQ ID NO: 119002 - DNA, 20 bp, Artificial Sequence
  chemically synthesized
ttaaatttatgaacaaaaaa

SEQ ID NO: 119003 - DNA, 20 bp, Artificial Sequence
  chemically synthesized
atgaacaaaaaacagtctgt

SEQ ID NO: 119004 - DNA, 20 bp, Artificial Sequence
  chemically synthesized
aaaaaattataggataccaa

SEQ ID NO: 119005 - DNA, 20 bp, Artificial Sequence
  chemically synthesized
gtttcctaataaaaaattat

SEQ ID NO: 119006 - DNA, 20 bp, Artificial Sequence
  chemically synthesized
tgtttcctaataaaaaatta

SEQ ID NO: 119007 - DNA, 20 bp, Artificial Sequence
  chemically synthesized
ggtatcctataattttttat

SEQ ID NO: 119008 - DNA, 20 bp, Artificial Sequence
  chemically synthesized
gtatcctataattttttatt

SEQ ID NO: 119009 - DNA, 20 bp, Artificial Sequence
  chemically synthesized
aattttttattaggaaacaa

SEQ ID NO: 119010 - DNA, 20 bp, Artificial Sequence
  chemically synthesized
ttttattaggaaacaatggt

SEQ ID NO: 119011 - DNA, 20 bp, Artificial Sequence
  chemically synthesized
agttttcccaggaaaaacaa

SEQ ID NO: 119012 - DNA, 20 bp, Artificial Sequence
  chemically synthesized
gataatactattgtttttcc

SEQ ID NO: 119013 - DNA, 20 bp, Artificial Sequence
  chemically synthesized
ataatactattgtttttcct

SEQ ID NO: 119014 - DNA, 20 bp, Artificial Sequence
  chemically synthesized
tcctatgtatcagttttccc

SEQ ID NO: 119015 - DNA, 20 bp, Artificial Sequence
  chemically synthesized
ctcctatgtatcagttttcc

SEQ ID NO: 119016 - DNA, 20 bp, Artificial Sequence
  chemically synthesized
ttcctgggaaaactgataca

SEQ ID NO: 119017 - DNA, 20 bp, Artificial Sequence
  chemically synthesized
tcctgggaaaactgatacat

SEQ ID NO: 119018 - DNA, 20 bp, Artificial Sequence
  chemically synthesized
ttagaaatgctcctatgtat

SEQ ID NO: 119019 - DNA, 20 bp, Artificial Sequence
  chemically synthesized
ctgggaaaactgatacatag

SEQ ID NO: 119020 - DNA, 20 bp, Artificial Sequence
  chemically synthesized
tgatacataggagcatttct

SEQ ID NO: 119021 - DNA, 20 bp, Artificial Sequence
  chemically synthesized
aacgcaccaaaatatatgct

SEQ ID NO: 119022 - DNA, 20 bp, Artificial Sequence
  chemically synthesized
gcatttctaagcatatattt

SEQ ID NO: 119023 - DNA, 20 bp, Artificial Sequence
  chemically synthesized
aagcatatattttggtgcgt

SEQ ID NO: 119024 - DNA, 20 bp, Artificial Sequence
  chemically synthesized
tatattttggtgcgttggtt

SEQ ID NO: 119025 - DNA, 20 bp, Artificial Sequence
  chemically synthesized
tttggtgcgttggttcagcc

SEQ ID NO: 119026 - DNA, 20 bp, Artificial Sequence
  chemically synthesized
tgcgttggttcagcccagtt

SEQ ID NO: 119027 - DNA, 20 bp, Artificial Sequence
  chemically synthesized
gcgttggttcagcccagttc

SEQ ID NO: 119028 - DNA, 20 bp, Artificial Sequence
  chemically synthesized
cagtcctacagtcctgaact

SEQ ID NO: 119029 - DNA, 20 bp, Artificial Sequence
  chemically synthesized
ccagtcctacagtcctgaac

SEQ ID NO: 119030 - DNA, 20 bp, Artificial Sequence
  chemically synthesized
ttcagcccagttcaggactg

SEQ ID NO: 119031 - DNA, 20 bp, Artificial Sequence
  chemically synthesized
tcagcccagttcaggactgt

SEQ ID NO: 119032 - DNA, 20 bp, Artificial Sequence
  chemically synthesized
ccagttcaggactgtaggac

SEQ ID NO: 119033 - DNA, 20 bp, Artificial Sequence
  chemically synthesized
cagttcaggactgtaggact

SEQ ID NO: 119034 - DNA, 20 bp, Artificial Sequence
  chemically synthesized
ttcattctaacccagtccta

SEQ ID NO: 119035 - DNA, 20 bp, Artificial Sequence
  chemically synthesized
tcaggactgtaggactgggt

SEQ ID NO: 119036 - DNA, 20 bp, Artificial Sequence
  chemically synthesized
tagccattttcattctaacc

SEQ ID NO: 119037 - DNA, 20 bp, Artificial Sequence
  chemically synthesized
ggactgggttagaatgaaaa

SEQ ID NO: 119038 - DNA, 20 bp, Artificial Sequence
  chemically synthesized
ttagaatgaaaatggctact

SEQ ID NO: 119039 - DNA, 20 bp, Artificial Sequence
  chemically synthesized
tacctggtgatgtagccaag

SEQ ID NO: 119040 - DNA, 20 bp, Artificial Sequence
  chemically synthesized
aattacctggtgatgtagcc

SEQ ID NO: 119041 - DNA, 20 bp, Artificial Sequence
  chemically synthesized
tggctacttggctacatcac

SEQ ID NO: 119042 - DNA, 20 bp, Artificial Sequence
  chemically synthesized
ggctacttggctacatcacc

SEQ ID NO: 119043 - DNA, 20 bp, Artificial Sequence
  chemically synthesized
tggaaaattacctggtgatg

SEQ ID NO: 119044 - DNA, 20 bp, Artificial Sequence
  chemically synthesized
tactggtgtggaaaattacc

SEQ ID NO: 119045 - DNA, 20 bp, Artificial Sequence
  chemically synthesized
caccaggtaattttccacac

SEQ ID NO: 119046 - DNA, 20 bp, Artificial Sequence
  chemically synthesized
tcattggtgatttactggtg

SEQ ID NO: 119047 - DNA, 20 bp, Artificial Sequence
  chemically synthesized
ccatgtcattggtgatttac

SEQ ID NO: 119048 - DNA, 20 bp, Artificial Sequence
  chemically synthesized
ccagtaaatcaccaatgaca

SEQ ID NO: 119049 - DNA, 20 bp, Artificial Sequence
  chemically synthesized
gacatttggaaccatgtcat

SEQ ID NO: 119050 - DNA, 20 bp, Artificial Sequence
  chemically synthesized
tgcacacaaagggagacatt

SEQ ID NO: 119051 - DNA, 20 bp, Artificial Sequence
  chemically synthesized
gcagggattgcacacaaagg

SEQ ID NO: 119052 - DNA, 20 bp, Artificial Sequence
  chemically synthesized
ttgcagggattgcacacaaa

SEQ ID NO: 119053 - DNA, 20 bp, Artificial Sequence
  chemically synthesized
cttgcagggattgcacacaa

SEQ ID NO: 119054 - DNA, 20 bp, Artificial Sequence
  chemically synthesized
gcttgcagggattgcacaca

SEQ ID NO: 119055 - DNA, 20 bp, Artificial Sequence
  chemically synthesized
cctttgtgtgcaatccctgc

SEQ ID NO: 119056 - DNA, 20 bp, Artificial Sequence
  chemically synthesized
tgtgtgcaatccctgcaagc

SEQ ID NO: 119057 - DNA, 20 bp, Artificial Sequence
  chemically synthesized
tagaatgtttctagcttgca

SEQ ID NO: 119058 - DNA, 20 bp, Artificial Sequence
  chemically synthesized
ttagaatgtttctagcttgc

SEQ ID NO: 119059 - DNA, 20 bp, Artificial Sequence
  chemically synthesized
attagaatgtttctagcttg

SEQ ID NO: 119060 - DNA, 20 bp, Artificial Sequence
  chemically synthesized
tcaagtaattagaatgtttc

SEQ ID NO: 119061 - DNA, 20 bp, Artificial Sequence
  chemically synthesized
gtcatctcctttcaagtaat

SEQ ID NO: 119062 - DNA, 20 bp, Artificial Sequence
  chemically synthesized
gaaacattctaattacttga

SEQ ID NO: 119063 - DNA, 20 bp, Artificial Sequence
  chemically synthesized
aaacattctaattacttgaa

SEQ ID NO: 119064 - DNA, 20 bp, Artificial Sequence
  chemically synthesized
acattctaattacttgaaag

SEQ ID NO: 119065 - DNA, 20 bp, Artificial Sequence
  chemically synthesized
attttatgtcatctcctttc

SEQ ID NO: 119066 - DNA, 20 bp, Artificial Sequence
  chemically synthesized
aaaggagatgacataaaatg

SEQ ID NO: 119067 - DNA, 20 bp, Artificial Sequence
  chemically synthesized
ggagatgacataaaatgaag

SEQ ID NO: 119068 - DNA, 20 bp, Artificial Sequence
  chemically synthesized
gagatgacataaaatgaagc

SEQ ID NO: 119069 - DNA, 20 bp, Artificial Sequence
  chemically synthesized
taaaaggttcatagtggtaa

SEQ ID NO: 119070 - DNA, 20 bp, Artificial Sequence
  chemically synthesized
tggatctaaaaggttcatag

SEQ ID NO: 119071 - DNA, 20 bp, Artificial Sequence
  chemically synthesized
atatggatctaaaaggttca

SEQ ID NO: 119072 - DNA, 20 bp, Artificial Sequence
  chemically synthesized
tgttaccactatgaaccttt

SEQ ID NO: 119073 - DNA, 20 bp, Artificial Sequence
  chemically synthesized
atgatccatatggatctaaa

SEQ ID NO: 119074 - DNA, 20 bp, Artificial Sequence
  chemically synthesized
catgatccatatggatctaa

SEQ ID NO: 119075 - DNA, 20 bp, Artificial Sequence
  chemically synthesized
atgaaccttttagatccata

SEQ ID NO: 119076 - DNA, 20 bp, Artificial Sequence
  chemically synthesized
agagagtgtcatgatccata

SEQ ID NO: 119077 - DNA, 20 bp, Artificial Sequence
  chemically synthesized
atatggatcatgacactctc

SEQ ID NO: 119078 - DNA, 20 bp, Artificial Sequence
  chemically synthesized
gatcatgacactctctggcc

SEQ ID NO: 119079 - DNA, 20 bp, Artificial Sequence
  chemically synthesized
tcttggggctccgggccaga

SEQ ID NO: 119080 - DNA, 20 bp, Artificial Sequence
  chemically synthesized
tcatgacactctctggcccg

SEQ ID NO: 119081 - DNA, 20 bp, Artificial Sequence
  chemically synthesized
aatcttggggctccgggcca

SEQ ID NO: 119082 - DNA, 20 bp, Artificial Sequence
  chemically synthesized
gaaatcttggggctccgggc

SEQ ID NO: 119083 - DNA, 20 bp, Artificial Sequence
  chemically synthesized
atgtgaaatcttggggctcc

SEQ ID NO: 119084 - DNA, 20 bp, Artificial Sequence
  chemically synthesized
actctctggcccggagcccc

SEQ ID NO: 119085 - DNA, 20 bp, Artificial Sequence
  chemically synthesized
gatgtgaaatcttggggctc

SEQ ID NO: 119086 - DNA, 20 bp, Artificial Sequence
  chemically synthesized
atctatgatgtgaaatcttg

SEQ ID NO: 119087 - DNA, 20 bp, Artificial Sequence
  chemically synthesized
catctatgatgtgaaatctt

SEQ ID NO: 119088 - DNA, 20 bp, Artificial Sequence
  chemically synthesized
acatctatgatgtgaaatct

SEQ ID NO: 119089 - DNA, 20 bp, Artificial Sequence
  chemically synthesized
agccccaagatttcacatca

SEQ ID NO: 119090 - DNA, 20 bp, Artificial Sequence
  chemically synthesized
gatgttatattaccctactg

SEQ ID NO: 119091 - DNA, 20 bp, Artificial Sequence
  chemically synthesized
attctctgcattctacagta

SEQ ID NO: 119092 - DNA, 20 bp, Artificial Sequence
  chemically synthesized
aattctctgcattctacagt

SEQ ID NO: 119093 - DNA, 20 bp, Artificial Sequence
  chemically synthesized
aaattctctgcattctacag

SEQ ID NO: 119094 - DNA, 20 bp, Artificial Sequence
  chemically synthesized
tattaccctactgtagaatg

SEQ ID NO: 119095 - DNA, 20 bp, Artificial Sequence
  chemically synthesized
aaaaaattctctgcattcta

SEQ ID NO: 119096 - DNA, 20 bp, Artificial Sequence
  chemically synthesized
ttaccctactgtagaatgca

SEQ ID NO: 119097 - DNA, 20 bp, Artificial Sequence
  chemically synthesized
gagaattttttttttttttt

SEQ ID NO: 119098 - DNA, 20 bp, Artificial Sequence
  chemically synthesized
ttttttttttttttgagaca

SEQ ID NO: 119099 - DNA, 20 bp, Artificial Sequence
  chemically synthesized
tacagcctgggcgacagagc

SEQ ID NO: 119100 - DNA, 20 bp, Artificial Sequence
  chemically synthesized
caaagtcttgctctgtcgcc

SEQ ID NO: 119101 - DNA, 20 bp, Artificial Sequence
  chemically synthesized
gcactacagcctgggcgaca

SEQ ID NO: 119102 - DNA, 20 bp, Artificial Sequence
  chemically synthesized
aaagtcttgctctgtcgccc

SEQ ID NO: 119103 - DNA, 20 bp, Artificial Sequence
  chemically synthesized
ctgcactacagcctgggcga

SEQ ID NO: 119104 - DNA, 20 bp, Artificial Sequence
  chemically synthesized
ttgctctgtcgcccaggctg

SEQ ID NO: 119105 - DNA, 20 bp, Artificial Sequence
  chemically synthesized
gtgccactgcactacagcct

SEQ ID NO: 119106 - DNA, 20 bp, Artificial Sequence
  chemically synthesized
tgtgccactgcactacagcc

SEQ ID NO: 119107 - DNA, 20 bp, Artificial Sequence
  chemically synthesized
ctgtcgcccaggctgtagtg

SEQ ID NO: 119108 - DNA, 20 bp, Artificial Sequence
  chemically synthesized
gagattgtgccactgcacta

SEQ ID NO: 119109 - DNA, 20 bp, Artificial Sequence
  chemically synthesized
tcgcccaggctgtagtgcag

SEQ ID NO: 119110 - DNA, 20 bp, Artificial Sequence
  chemically synthesized
gtagtgcagtggcacaatct

SEQ ID NO: 119111 - DNA, 20 bp, Artificial Sequence
  chemically synthesized
ttcggaggtttaagtgagct

SEQ ID NO: 119112 - DNA, 20 bp, Artificial Sequence
  chemically synthesized
aactcttcggaggtttaagt

SEQ ID NO: 119113 - DNA, 20 bp, Artificial Sequence
  chemically synthesized
taagaactcttcggaggttt

SEQ ID NO: 119114 - DNA, 20 bp, Artificial Sequence
  chemically synthesized
tcagctcacttaaacctccg

SEQ ID NO: 119115 - DNA, 20 bp, Artificial Sequence
  chemically synthesized
agctcacttaaacctccgaa

SEQ ID NO: 119116 - DNA, 20 bp, Artificial Sequence
  chemically synthesized
gaagcataagaactcttcgg

SEQ ID NO: 119117 - DNA, 20 bp, Artificial Sequence
  chemically synthesized
tgaagcataagaactcttcg

SEQ ID NO: 119118 - DNA, 20 bp, Artificial Sequence
  chemically synthesized
tatgaagcataagaactctt

SEQ ID NO: 119119 - DNA, 20 bp, Artificial Sequence
  chemically synthesized
cccaactgattatgaagcat

SEQ ID NO: 119120 - DNA, 20 bp, Artificial Sequence
  chemically synthesized
gagttcttatgcttcataat

SEQ ID NO: 119121 - DNA, 20 bp, Artificial Sequence
  chemically synthesized
aatcttcccaactgattatg

SEQ ID NO: 119122 - DNA, 20 bp, Artificial Sequence
  chemically synthesized
tcttatgcttcataatcagt

SEQ ID NO: 119123 - DNA, 20 bp, Artificial Sequence
  chemically synthesized
cttatgcttcataatcagtt

SEQ ID NO: 119124 - DNA, 20 bp, Artificial Sequence
  chemically synthesized
atgcttcataatcagttggg

SEQ ID NO: 119125 - DNA, 20 bp, Artificial Sequence
  chemically synthesized
cataatcagttgggaagatt

SEQ ID NO: 119126 - DNA, 20 bp, Artificial Sequence
  chemically synthesized
ataatcagttgggaagattt

SEQ ID NO: 119127 - DNA, 20 bp, Artificial Sequence
  chemically synthesized
agttgggaagatttgggtct

SEQ ID NO: 119128 - DNA, 20 bp, Artificial Sequence
  chemically synthesized
aatcccatttttatattgct

SEQ ID NO: 119129 - DNA, 20 bp, Artificial Sequence
  chemically synthesized
gggtctcagcaatataaaaa

SEQ ID NO: 119130 - DNA, 20 bp, Artificial Sequence
  chemically synthesized
ggtctcagcaatataaaaat

SEQ ID NO: 119131 - DNA, 20 bp, Artificial Sequence
  chemically synthesized
agagtcatatgtatagttac

SEQ ID NO: 119132 - DNA, 20 bp, Artificial Sequence
  chemically synthesized
tcaggagagagtcatatgta

SEQ ID NO: 119133 - DNA, 20 bp, Artificial Sequence
  chemically synthesized
atacatatgactctctcctg

SEQ ID NO: 119134 - DNA, 20 bp, Artificial Sequence
  chemically synthesized
tctttcggctcttcaggaga

SEQ ID NO: 119135 - DNA, 20 bp, Artificial Sequence
  chemically synthesized
acatatgactctctcctgaa

SEQ ID NO: 119136 - DNA, 20 bp, Artificial Sequence
  chemically synthesized
tgtctttcggctcttcagga

SEQ ID NO: 119137 - DNA, 20 bp, Artificial Sequence
  chemically synthesized
tgtgtctttcggctcttcag

SEQ ID NO: 119138 - DNA, 20 bp, Artificial Sequence
  chemically synthesized
aatgtgtctttcggctcttc

SEQ ID NO: 119139 - DNA, 20 bp, Artificial Sequence
  chemically synthesized
aaatgtgtctttcggctctt

SEQ ID NO: 119140 - DNA, 20 bp, Artificial Sequence
  chemically synthesized
actctctcctgaagagccga

SEQ ID NO: 119141 - DNA, 20 bp, Artificial Sequence
  chemically synthesized
cagtatgaaaatgtgtcttt

SEQ ID NO: 119142 - DNA, 20 bp, Artificial Sequence
  chemically synthesized
agacacattttcatactgct

SEQ ID NO: 119143 - DNA, 20 bp, Artificial Sequence
  chemically synthesized
actcctttaggtacacttag

SEQ ID NO: 119144 - DNA, 20 bp, Artificial Sequence
  chemically synthesized
tcaactcctttaggtacact

SEQ ID NO: 119145 - DNA, 20 bp, Artificial Sequence
  chemically synthesized
catactgctaagtgtaccta

SEQ ID NO: 119146 - DNA, 20 bp, Artificial Sequence
  chemically synthesized
atactgctaagtgtacctaa

SEQ ID NO: 119147 - DNA, 20 bp, Artificial Sequence
  chemically synthesized
actgctaagtgtacctaaag

SEQ ID NO: 119148 - DNA, 20 bp, Artificial Sequence
  chemically synthesized
aatccattatcaactccttt

SEQ ID NO: 119149 - DNA, 20 bp, Artificial Sequence
  chemically synthesized
caatccattatcaactcctt

SEQ ID NO: 119150 - DNA, 20 bp, Artificial Sequence
  chemically synthesized
gtacctaaaggagttgataa

SEQ ID NO: 119151 - DNA, 20 bp, Artificial Sequence
  chemically synthesized
ttttaaggactgagaggatt

SEQ ID NO: 119152 - DNA, 20 bp, Artificial Sequence
  chemically synthesized
tttaacataccaaatcctct

SEQ ID NO: 119153 - DNA, 20 bp, Artificial Sequence
  chemically synthesized
agtccattttaaggactgag

SEQ ID NO: 119154 - DNA, 20 bp, Artificial Sequence
  chemically synthesized
tagtccattttaaggactga

SEQ ID NO: 119155 - DNA, 20 bp, Artificial Sequence
  chemically synthesized
tgtagtccattttaaggact

SEQ ID NO: 119156 - DNA, 20 bp, Artificial Sequence
  chemically synthesized
aatcctctcagtccttaaaa

SEQ ID NO: 119157 - DNA, 20 bp, Artificial Sequence
  chemically synthesized
gtaccttgtagtccatttta

SEQ ID NO: 119158 - DNA, 20 bp, Artificial Sequence
  chemically synthesized
tgtaccttgtagtccatttt

SEQ ID NO: 119159 - DNA, 20 bp, Artificial Sequence
  chemically synthesized
cagtccttaaaatggactac

SEQ ID NO: 119160 - DNA, 20 bp, Artificial Sequence
  chemically synthesized
agtccttaaaatggactaca

SEQ ID NO: 119161 - DNA, 20 bp, Artificial Sequence
  chemically synthesized
cttatgcgaaatgtaccttg

SEQ ID NO: 119162 - DNA, 20 bp, Artificial Sequence
  chemically synthesized
ctacaaggtacatttcgcat

SEQ ID NO: 119163 - DNA, 20 bp, Artificial Sequence
  chemically synthesized
acaaggtacatttcgcataa

SEQ ID NO: 119164 - DNA, 20 bp, Artificial Sequence
  chemically synthesized
caaggtacatttcgcataag

SEQ ID NO: 119165 - DNA, 20 bp, Artificial Sequence
  chemically synthesized
cgcataagaggaatttaaaa

SEQ ID NO: 119166 - DNA, 20 bp, Artificial Sequence
  chemically synthesized
gcataagaggaatttaaaat

SEQ ID NO: 119167 - DNA, 20 bp, Artificial Sequence
  chemically synthesized
cataagaggaatttaaaata

SEQ ID NO: 119168 - DNA, 20 bp, Artificial Sequence
  chemically synthesized
aaaatagggtattcaaaatt

SEQ ID NO: 119169 - DNA, 20 bp, Artificial Sequence
  chemically synthesized
aatagggtattcaaaattga

SEQ ID NO: 119170 - DNA, 20 bp, Artificial Sequence
  chemically synthesized
atagggtattcaaaattgag

SEQ ID NO: 119171 - DNA, 20 bp, Artificial Sequence
  chemically synthesized
tagggtattcaaaattgaga

SEQ ID NO: 119172 - DNA, 20 bp, Artificial Sequence
  chemically synthesized
caaaattgagagggttgaac

SEQ ID NO: 119173 - DNA, 20 bp, Artificial Sequence
  chemically synthesized
aattgagagggttgaactgg

SEQ ID NO: 119174 - DNA, 20 bp, Artificial Sequence
  chemically synthesized
gagggttgaactggtggctt

SEQ ID NO: 119175 - DNA, 20 bp, Artificial Sequence
  chemically synthesized
acaaatgaccccaaagccac

SEQ ID NO: 119176 - DNA, 20 bp, Artificial Sequence
  chemically synthesized
agggttgaactggtggcttt

SEQ ID NO: 119177 - DNA, 20 bp, Artificial Sequence
  chemically synthesized
gggttgaactggtggctttg

SEQ ID NO: 119178 - DNA, 20 bp, Artificial Sequence
  chemically synthesized
taaagctacaaatgacccca

SEQ ID NO: 119179 - DNA, 20 bp, Artificial Sequence
  chemically synthesized
ggtggctttggggtcatttg

SEQ ID NO: 119180 - DNA, 20 bp, Artificial Sequence
  chemically synthesized
ttaaaattaaattaaattta

SEQ ID NO: 119181 - DNA, 20 bp, Artificial Sequence
  chemically synthesized
tttaaatttaatttaatttt

SEQ ID NO: 119182 - DNA, 20 bp, Artificial Sequence
  chemically synthesized
taaatttaatttaattttaa

SEQ ID NO: 119183 - DNA, 20 bp, Artificial Sequence
  chemically synthesized
tttaatttaattttaagaga

SEQ ID NO: 119184 - DNA, 20 bp, Artificial Sequence
  chemically synthesized
taatttaattttaagagatg

SEQ ID NO: 119185 - DNA, 20 bp, Artificial Sequence
  chemically synthesized
tccagcctgggtgacgtagt

SEQ ID NO: 119186 - DNA, 20 bp, Artificial Sequence
  chemically synthesized
tggagtctcactacgtcacc

SEQ ID NO: 119187 - DNA, 20 bp, Artificial Sequence
  chemically synthesized
gtactccagcctgggtgacg

SEQ ID NO: 119188 - DNA, 20 bp, Artificial Sequence
  chemically synthesized
ggagtctcactacgtcaccc

SEQ ID NO: 119189 - DNA, 20 bp, Artificial Sequence
  chemically synthesized
tctcactacgtcacccaggc

SEQ ID NO: 119190 - DNA, 20 bp, Artificial Sequence
  chemically synthesized
tcactacgtcacccaggctg

SEQ ID NO: 119191 - DNA, 20 bp, Artificial Sequence
  chemically synthesized
atgccagtgtactccagcct

SEQ ID NO: 119192 - DNA, 20 bp, Artificial Sequence
  chemically synthesized
catgccagtgtactccagcc

SEQ ID NO: 119193 - DNA, 20 bp, Artificial Sequence
  chemically synthesized
atgatcatgccagtgtactc

SEQ ID NO: 119194 - DNA, 20 bp, Artificial Sequence
  chemically synthesized
tcacccaggctggagtacac

SEQ ID NO: 119195 - DNA, 20 bp, Artificial Sequence
  chemically synthesized
gcagtgagctatgatcatgc

SEQ ID NO: 119196 - DNA, 20 bp, Artificial Sequence
  chemically synthesized
ggagtacactggcatgatca

SEQ ID NO: 119197 - DNA, 20 bp, Artificial Sequence
  chemically synthesized
ggcatgatcatagctcactg

SEQ ID NO: 119198 - DNA, 20 bp, Artificial Sequence
  chemically synthesized
gttcagttcaaggctgcagt

SEQ ID NO: 119199 - DNA, 20 bp, Artificial Sequence
  chemically synthesized
aggagttcagttcaaggctg

SEQ ID NO: 119200 - DNA, 20 bp, Artificial Sequence
  chemically synthesized
gaacctaggagttcagttca

SEQ ID NO: 119201 - DNA, 20 bp, Artificial Sequence
  chemically synthesized
tgaacctaggagttcagttc

SEQ ID NO: 119202 - DNA, 20 bp, Artificial Sequence
  chemically synthesized
gcagccttgaactgaactcc

SEQ ID NO: 119203 - DNA, 20 bp, Artificial Sequence
  chemically synthesized
cagccttgaactgaactcct

SEQ ID NO: 119204 - DNA, 20 bp, Artificial Sequence
  chemically synthesized
atttcttgaacctaggagtt

SEQ ID NO: 119205 - DNA, 20 bp, Artificial Sequence
  chemically synthesized
agaggatttcttgaacctag

SEQ ID NO: 119206 - DNA, 20 bp, Artificial Sequence
  chemically synthesized
tgaactgaactcctaggttc

SEQ ID NO: 119207 - DNA, 20 bp, Artificial Sequence
  chemically synthesized
caagaggatttcttgaacct

SEQ ID NO: 119208 - DNA, 20 bp, Artificial Sequence
  chemically synthesized
gcaagaggatttcttgaacc

SEQ ID NO: 119209 - DNA, 20 bp, Artificial Sequence
  chemically synthesized
ttcaagaaatcctcttgcct

SEQ ID NO: 119210 - DNA, 20 bp, Artificial Sequence
  chemically synthesized
acttgggaagctgaggcaag

SEQ ID NO: 119211 - DNA, 20 bp, Artificial Sequence
  chemically synthesized
tacttgggaagctgaggcaa

SEQ ID NO: 119212 - DNA, 20 bp, Artificial Sequence
  chemically synthesized
gctacttgggaagctgaggc

SEQ ID NO: 119213 - DNA, 20 bp, Artificial Sequence
  chemically synthesized
cccagctacttgggaagctg

SEQ ID NO: 119214 - DNA, 20 bp, Artificial Sequence
  chemically synthesized
tcccagctacttgggaagct

SEQ ID NO: 119215 - DNA, 20 bp, Artificial Sequence
  chemically synthesized
tcctcttgcctcagcttccc

SEQ ID NO: 119216 - DNA, 20 bp, Artificial Sequence
  chemically synthesized
tcttgcctcagcttcccaag

SEQ ID NO: 119217 - DNA, 20 bp, Artificial Sequence
  chemically synthesized
tgtagtcccagctacttggg

SEQ ID NO: 119218 - DNA, 20 bp, Artificial Sequence
  chemically synthesized
gcctcagcttcccaagtagc

SEQ ID NO: 119219 - DNA, 20 bp, Artificial Sequence
  chemically synthesized
gtttgtagtcccagctactt

SEQ ID NO: 119220 - DNA, 20 bp, Artificial Sequence
  chemically synthesized
cctcagcttcccaagtagct

SEQ ID NO: 119221 - DNA, 20 bp, Artificial Sequence
  chemically synthesized
agtttgtagtcccagctact

SEQ ID NO: 119222 - DNA, 20 bp, Artificial Sequence
  chemically synthesized
aaaagccaagtttgtagtcc

SEQ ID NO: 119223 - DNA, 20 bp, Artificial Sequence
  chemically synthesized
agtagctgggactacaaact

SEQ ID NO: 119224 - DNA, 20 bp, Artificial Sequence
  chemically synthesized
aaaaaaaaaagccaagtttg

SEQ ID NO: 119225 - DNA, 20 bp, Artificial Sequence
  chemically synthesized
aaaaaaaaaaaaaaaaagcc

SEQ ID NO: 119226 - DNA, 20 bp, Artificial Sequence
  chemically synthesized
acataaaaaaaaaaaaaaaa

SEQ ID NO: 119227 - DNA, 20 bp, Artificial Sequence
  chemically synthesized
ttttttttttttatgttttg

SEQ ID NO: 119228 - DNA, 20 bp, Artificial Sequence
  chemically synthesized
ttttttatgttttgtagaaa

SEQ ID NO: 119229 - DNA, 20 bp, Artificial Sequence
  chemically synthesized
accagcctgggcaacatagt

SEQ ID NO: 119230 - DNA, 20 bp, Artificial Sequence
  chemically synthesized
tggtatctcactatgttgcc

SEQ ID NO: 119231 - DNA, 20 bp, Artificial Sequence
  chemically synthesized
tgagaccagcctgggcaaca

SEQ ID NO: 119232 - DNA, 20 bp, Artificial Sequence
  chemically synthesized
ggtatctcactatgttgccc

SEQ ID NO: 119233 - DNA, 20 bp, Artificial Sequence
  chemically synthesized
tctcactatgttgcccaggc

SEQ ID NO: 119234 - DNA, 20 bp, Artificial Sequence
  chemically synthesized
caagagtttgagaccagcct

SEQ ID NO: 119235 - DNA, 20 bp, Artificial Sequence
  chemically synthesized
ccaagagtttgagaccagcc

SEQ ID NO: 119236 - DNA, 20 bp, Artificial Sequence
  chemically synthesized
agaggccaagagtttgagac

SEQ ID NO: 119237 - DNA, 20 bp, Artificial Sequence
  chemically synthesized
ccaggctggtctcaaactct

SEQ ID NO: 119238 - DNA, 20 bp, Artificial Sequence
  chemically synthesized
tcactagaggccaagagttt

SEQ ID NO: 119239 - DNA, 20 bp, Artificial Sequence
  chemically synthesized
ggaggatcactagaggccaa

SEQ ID NO: 119240 - DNA, 20 bp, Artificial Sequence
  chemically synthesized
ggtctcaaactcttggcctc

SEQ ID NO: 119241 - DNA, 20 bp, Artificial Sequence
  chemically synthesized
tgggaggatcactagaggcc

SEQ ID NO: 119242 - DNA, 20 bp, Artificial Sequence
  chemically synthesized
gggggtgggaggatcactag

SEQ ID NO: 119243 - DNA, 20 bp, Artificial Sequence
  chemically synthesized
tgggggtgggaggatcacta

SEQ ID NO: 119244 - DNA, 20 bp, Artificial Sequence
  chemically synthesized
ggtgggggtgggaggatcac

SEQ ID NO: 119245 - DNA, 20 bp, Artificial Sequence
  chemically synthesized
gaggccgaggtgggggtggg

SEQ ID NO: 119246 - DNA, 20 bp, Artificial Sequence
  chemically synthesized
ggaggccgaggtgggggtgg

SEQ ID NO: 119247 - DNA, 20 bp, Artificial Sequence
  chemically synthesized
tgggaggccgaggtgggggt

SEQ ID NO: 119248 - DNA, 20 bp, Artificial Sequence
  chemically synthesized
ttgggaggccgaggtggggg

SEQ ID NO: 119249 - DNA, 20 bp, Artificial Sequence
  chemically synthesized
tgatcctcccacccccacct

SEQ ID NO: 119250 - DNA, 20 bp, Artificial Sequence
  chemically synthesized
actttgggaggccgaggtgg

SEQ ID NO: 119251 - DNA, 20 bp, Artificial Sequence
  chemically synthesized
cactttgggaggccgaggtg

SEQ ID NO: 119252 - DNA, 20 bp, Artificial Sequence
  chemically synthesized
gcactttgggaggccgaggt

SEQ ID NO: 119253 - DNA, 20 bp, Artificial Sequence
  chemically synthesized
agcactttgggaggccgagg

SEQ ID NO: 119254 - DNA, 20 bp, Artificial Sequence
  chemically synthesized
cccagcactttgggaggccg

SEQ ID NO: 119255 - DNA, 20 bp, Artificial Sequence
  chemically synthesized
tcccagcactttgggaggcc

SEQ ID NO: 119256 - DNA, 20 bp, Artificial Sequence
  chemically synthesized
acccccacctcggcctccca

SEQ ID NO: 119257 - DNA, 20 bp, Artificial Sequence
  chemically synthesized
cataatcccagcactttggg

SEQ ID NO: 119258 - DNA, 20 bp, Artificial Sequence
  chemically synthesized
ccataatcccagcactttgg

SEQ ID NO: 119259 - DNA, 20 bp, Artificial Sequence
  chemically synthesized
acctcggcctcccaaagtgc

SEQ ID NO: 119260 - DNA, 20 bp, Artificial Sequence
  chemically synthesized
ccccataatcccagcacttt

SEQ ID NO: 119261 - DNA, 20 bp, Artificial Sequence
  chemically synthesized
cctcggcctcccaaagtgct

SEQ ID NO: 119262 - DNA, 20 bp, Artificial Sequence
  chemically synthesized
tccccataatcccagcactt

SEQ ID NO: 119263 - DNA, 20 bp, Artificial Sequence
  chemically synthesized
ctcccaaagtgctgggatta

SEQ ID NO: 119264 - DNA, 20 bp, Artificial Sequence
  chemically synthesized
tcccaaagtgctgggattat

SEQ ID NO: 119265 - DNA, 20 bp, Artificial Sequence
  chemically synthesized
gggacatgtccccataatcc

SEQ ID NO: 119266 - DNA, 20 bp, Artificial Sequence
  chemically synthesized
cccaaagtgctgggattatg

SEQ ID NO: 119267 - DNA, 20 bp, Artificial Sequence
  chemically synthesized
attatggggacatgtcccac

SEQ ID NO: 119268 - DNA, 20 bp, Artificial Sequence
  chemically synthesized
ttatggggacatgtcccacc

SEQ ID NO: 119269 - DNA, 20 bp, Artificial Sequence
  chemically synthesized
aaaatattaaagttcctggt

SEQ ID NO: 119270 - DNA, 20 bp, Artificial Sequence
  chemically synthesized
taaaatattaaagttcctgg

SEQ ID NO: 119271 - DNA, 20 bp, Artificial Sequence
  chemically synthesized
atttaaaatattaaagttcc

SEQ ID NO: 119272 - DNA, 20 bp, Artificial Sequence
  chemically synthesized
acattttatttaaaatatta

SEQ ID NO: 119273 - DNA, 20 bp, Artificial Sequence
  chemically synthesized
gcctgctcataatatatatg

SEQ ID NO: 119274 - DNA, 20 bp, Artificial Sequence
  chemically synthesized
atgtgccacatatatattat

SEQ ID NO: 119275 - DNA, 20 bp, Artificial Sequence
  chemically synthesized
tgccacatatatattatgag

SEQ ID NO: 119276 - DNA, 20 bp, Artificial Sequence
  chemically synthesized
gccacatatatattatgagc

SEQ ID NO: 119277 - DNA, 20 bp, Artificial Sequence
  chemically synthesized
atacaacctttattacattg

SEQ ID NO: 119278 - DNA, 20 bp, Artificial Sequence
  chemically synthesized
aatacaacctttattacatt

SEQ ID NO: 119279 - DNA, 20 bp, Artificial Sequence
  chemically synthesized
aaatacaacctttattacat

SEQ ID NO: 119280 - DNA, 20 bp, Artificial Sequence
  chemically synthesized
gagcaggccccaatgtaata

SEQ ID NO: 119281 - DNA, 20 bp, Artificial Sequence
  chemically synthesized
agcaggccccaatgtaataa

SEQ ID NO: 119282 - DNA, 20 bp, Artificial Sequence
  chemically synthesized
attttaaacaaatatcccgc

SEQ ID NO: 119283 - DNA, 20 bp, Artificial Sequence
  chemically synthesized
aaatatgatagaatgctagc

SEQ ID NO: 119284 - DNA, 20 bp, Artificial Sequence
  chemically synthesized
aaaatatgatagaatgctag

SEQ ID NO: 119285 - DNA, 20 bp, Artificial Sequence
  chemically synthesized
acaaaaatatgatagaatgc

SEQ ID NO: 119286 - DNA, 20 bp, Artificial Sequence
  chemically synthesized
agctatgtacaaaaatatga

SEQ ID NO: 119287 - DNA, 20 bp, Artificial Sequence
  chemically synthesized
ttctatcatatttttgtaca

SEQ ID NO: 119288 - DNA, 20 bp, Artificial Sequence
  chemically synthesized
tatttttgtacatagctttg

SEQ ID NO: 119289 - DNA, 20 bp, Artificial Sequence
  chemically synthesized
atttttgtacatagctttga

SEQ ID NO: 119290 - DNA, 20 bp, Artificial Sequence
  chemically synthesized
tttgtacatagctttgaagg

SEQ ID NO: 119291 - DNA, 20 bp, Artificial Sequence
  chemically synthesized
ataaagatttgctgccttca

SEQ ID NO: 119292 - DNA, 20 bp, Artificial Sequence
  chemically synthesized
ttccaaaaatttaaaggata

SEQ ID NO: 119293 - DNA, 20 bp, Artificial Sequence
  chemically synthesized
gattatttccaaaaatttaa

SEQ ID NO: 119294 - DNA, 20 bp, Artificial Sequence
  chemically synthesized
ggattatttccaaaaattta

SEQ ID NO: 119295 - DNA, 20 bp, Artificial Sequence
  chemically synthesized
atctttatcctttaaatttt

SEQ ID NO: 119296 - DNA, 20 bp, Artificial Sequence
  chemically synthesized
aaatttttggaaataatcca

SEQ ID NO: 119297 - DNA, 20 bp, Artificial Sequence
  chemically synthesized
tgttgggcactgaatggctt

SEQ ID NO: 119298 - DNA, 20 bp, Artificial Sequence
  chemically synthesized
ggaaataatccaaagccatt

SEQ ID NO: 119299 - DNA, 20 bp, Artificial Sequence
  chemically synthesized
atcagatgttgggcactgaa

SEQ ID NO: 119300 - DNA, 20 bp, Artificial Sequence
  chemically synthesized
gaaacaattcatcagatgtt

SEQ ID NO: 119301 - DNA, 20 bp, Artificial Sequence
  chemically synthesized
tgaaacaattcatcagatgt

SEQ ID NO: 119302 - DNA, 20 bp, Artificial Sequence
  chemically synthesized
aattgaatgaaacaattcat

SEQ ID NO: 119303 - DNA, 20 bp, Artificial Sequence
  chemically synthesized
ttcaattacaaacaattatt

SEQ ID NO: 119304 - DNA, 20 bp, Artificial Sequence
  chemically synthesized
aattattgagtacaattact

SEQ ID NO: 119305 - DNA, 20 bp, Artificial Sequence
  chemically synthesized
agccataccttttatttgct

SEQ ID NO: 119306 - DNA, 20 bp, Artificial Sequence
  chemically synthesized
tacaattactcagcaaataa

SEQ ID NO: 119307 - DNA, 20 bp, Artificial Sequence
  chemically synthesized
acaattactcagcaaataaa

SEQ ID NO: 119308 - DNA, 20 bp, Artificial Sequence
  chemically synthesized
tactcagcaaataaaaggta

SEQ ID NO: 119309 - DNA, 20 bp, Artificial Sequence
  chemically synthesized
cagactgttatattatttta

SEQ ID NO: 119310 - DNA, 20 bp, Artificial Sequence
  chemically synthesized
atggctataaaataatataa

SEQ ID NO: 119311 - DNA, 20 bp, Artificial Sequence
  chemically synthesized
aaataatataacagtctgct

SEQ ID NO: 119312 - DNA, 20 bp, Artificial Sequence
  chemically synthesized
aataatataacagtctgctg

SEQ ID NO: 119313 - DNA, 20 bp, Artificial Sequence
  chemically synthesized
gactgttttatgatcctcag

SEQ ID NO: 119314 - DNA, 20 bp, Artificial Sequence
  chemically synthesized
aaggactgttttatgatcct

SEQ ID NO: 119315 - DNA, 20 bp, Artificial Sequence
  chemically synthesized
gtctgctgaggatcataaaa

SEQ ID NO: 119316 - DNA, 20 bp, Artificial Sequence
  chemically synthesized
aggatcataaaacagtcctt

SEQ ID NO: 119317 - DNA, 20 bp, Artificial Sequence
  chemically synthesized
atcataaaacagtccttaag

SEQ ID NO: 119318 - DNA, 20 bp, Artificial Sequence
  chemically synthesized
tccttttctggaactactta

SEQ ID NO: 119319 - DNA, 20 bp, Artificial Sequence
  chemically synthesized
ttccttttctggaactactt

SEQ ID NO: 119320 - DNA, 20 bp, Artificial Sequence
  chemically synthesized
aaacagtccttaagtagttc

SEQ ID NO: 119321 - DNA, 20 bp, Artificial Sequence
  chemically synthesized
gtccttaagtagttccagaa

SEQ ID NO: 119322 - DNA, 20 bp, Artificial Sequence
  chemically synthesized
tccttaagtagttccagaaa

SEQ ID NO: 119323 - DNA, 20 bp, Artificial Sequence
  chemically synthesized
taattttagagttccttttc

SEQ ID NO: 119324 - DNA, 20 bp, Artificial Sequence
  chemically synthesized
cccttggcaatataatttta

SEQ ID NO: 119325 - DNA, 20 bp, Artificial Sequence
  chemically synthesized
gtcccttggcaatataattt

SEQ ID NO: 119326 - DNA, 20 bp, Artificial Sequence
  chemically synthesized
aactctaaaattatattgcc

SEQ ID NO: 119327 - DNA, 20 bp, Artificial Sequence
  chemically synthesized
actctaaaattatattgcca

SEQ ID NO: 119328 - DNA, 20 bp, Artificial Sequence
  chemically synthesized
ctctaaaattatattgccaa

SEQ ID NO: 119329 - DNA, 20 bp, Artificial Sequence
  chemically synthesized
aaaattatattgccaaggga

SEQ ID NO: 119330 - DNA, 20 bp, Artificial Sequence
  chemically synthesized
tatctacaaataccgtccct

SEQ ID NO: 119331 - DNA, 20 bp, Artificial Sequence
  chemically synthesized
ttgccaagggacggtatttg

SEQ ID NO: 119332 - DNA, 20 bp, Artificial Sequence
  chemically synthesized
agggacggtatttgtagata

SEQ ID NO: 119333 - DNA, 20 bp, Artificial Sequence
  chemically synthesized
tatttgtagatacagcatat

SEQ ID NO: 119334 - DNA, 20 bp, Artificial Sequence
  chemically synthesized
cagcatataagactcttatg

SEQ ID NO: 119335 - DNA, 20 bp, Artificial Sequence
  chemically synthesized
caagcattagaacttcataa

SEQ ID NO: 119336 - DNA, 20 bp, Artificial Sequence
  chemically synthesized
gacaagcattagaacttcat

SEQ ID NO: 119337 - DNA, 20 bp, Artificial Sequence
  chemically synthesized
tttaggagagggacaagcat

SEQ ID NO: 119338 - DNA, 20 bp, Artificial Sequence
  chemically synthesized
tgtttatttaggagagggac

SEQ ID NO: 119339 - DNA, 20 bp, Artificial Sequence
  chemically synthesized
ttgtttgtttatttaggaga

SEQ ID NO: 119340 - DNA, 20 bp, Artificial Sequence
  chemically synthesized
tttgtttgtttatttaggag

SEQ ID NO: 119341 - DNA, 20 bp, Artificial Sequence
  chemically synthesized
atttgtttgtttatttagga

SEQ ID NO: 119342 - DNA, 20 bp, Artificial Sequence
  chemically synthesized
tcatttgtttgtttatttag

SEQ ID NO: 119343 - DNA, 20 bp, Artificial Sequence
  chemically synthesized
gttcatttgtttgtttattt

SEQ ID NO: 119344 - DNA, 20 bp, Artificial Sequence
  chemically synthesized
tgttcatttgtttgtttatt

SEQ ID NO: 119345 - DNA, 20 bp, Artificial Sequence
  chemically synthesized
aaataaacaaacaaatgaac

SEQ ID NO: 119346 - DNA, 20 bp, Artificial Sequence
  chemically synthesized
ttcctgggaagaaaagcaaa

SEQ ID NO: 119347 - DNA, 20 bp, Artificial Sequence
  chemically synthesized
acactatttgcttttcttcc

SEQ ID NO: 119348 - DNA, 20 bp, Artificial Sequence
  chemically synthesized
aaacattttcctgggaagaa

SEQ ID NO: 119349 - DNA, 20 bp, Artificial Sequence
  chemically synthesized
cactatttgcttttcttccc

SEQ ID NO: 119350 - DNA, 20 bp, Artificial Sequence
  chemically synthesized
aagtaaaacattttcctggg

SEQ ID NO: 119351 - DNA, 20 bp, Artificial Sequence
  chemically synthesized
aaaaagtaaaacattttcct

SEQ ID NO: 119352 - DNA, 20 bp, Artificial Sequence
  chemically synthesized
gaaaaagtaaaacattttcc

SEQ ID NO: 119353 - DNA, 20 bp, Artificial Sequence
  chemically synthesized
gaaagtaaaaacaaatgaaa

SEQ ID NO: 119354 - DNA, 20 bp, Artificial Sequence
  chemically synthesized
ttttcatttgtttttacttt

SEQ ID NO: 119355 - DNA, 20 bp, Artificial Sequence
  chemically synthesized
gcattctcaaatttttctga

SEQ ID NO: 119356 - DNA, 20 bp, Artificial Sequence
  chemically synthesized
ttttactttcagaaaaattt

SEQ ID NO: 119357 - DNA, 20 bp, Artificial Sequence
  chemically synthesized
gaaaaatttgagaatgcttt

SEQ ID NO: 119358 - DNA, 20 bp, Artificial Sequence
  chemically synthesized
catgtatgacatgtttccaa

SEQ ID NO: 119359 - DNA, 20 bp, Artificial Sequence
  chemically synthesized
acatgtaaatatcatgcatc

SEQ ID NO: 119360 - DNA, 20 bp, Artificial Sequence
  chemically synthesized
aaatatcatgcatcaagtct

SEQ ID NO: 119361 - DNA, 20 bp, Artificial Sequence
  chemically synthesized
aatatcatgcatcaagtctc

SEQ ID NO: 119362 - DNA, 20 bp, Artificial Sequence
  chemically synthesized
tatcatgcatcaagtctcag

SEQ ID NO: 119363 - DNA, 20 bp, Artificial Sequence
  chemically synthesized
atcatgcatcaagtctcagg

SEQ ID NO: 119364 - DNA, 20 bp, Artificial Sequence
  chemically synthesized
tcatgcatcaagtctcagga

SEQ ID NO: 119365 - DNA, 20 bp, Artificial Sequence
  chemically synthesized
tgctttttttttaccctcct

SEQ ID NO: 119366 - DNA, 20 bp, Artificial Sequence
  chemically synthesized
gtctcaggagggtaaaaaaa

SEQ ID NO: 119367 - DNA, 20 bp, Artificial Sequence
  chemically synthesized
ggagggtaaaaaaaaagcac

SEQ ID NO: 119368 - DNA, 20 bp, Artificial Sequence
  chemically synthesized
aaaaaaaagcactggaatca

SEQ ID NO: 119369 - DNA, 20 bp, Artificial Sequence
  chemically synthesized
aaaaaaagcactggaatcaa

SEQ ID NO: 119370 - DNA, 20 bp, Artificial Sequence
  chemically synthesized
ttcttgcttccctttgattc

SEQ ID NO: 119371 - DNA, 20 bp, Artificial Sequence
  chemically synthesized
aaaaaagcactggaatcaaa

SEQ ID NO: 119372 - DNA, 20 bp, Artificial Sequence
  chemically synthesized
aaagcactggaatcaaaggg

SEQ ID NO: 119373 - DNA, 20 bp, Artificial Sequence
  chemically synthesized
cactggaatcaaagggaagc

SEQ ID NO: 119374 - DNA, 20 bp, Artificial Sequence
  chemically synthesized
tggaatcaaagggaagcaag

SEQ ID NO: 119375 - DNA, 20 bp, Artificial Sequence
  chemically synthesized
gaagcaagaagattcatttc

SEQ ID NO: 119376 - DNA, 20 bp, Artificial Sequence
  chemically synthesized
aagcaagaagattcatttca

SEQ ID NO: 119377 - DNA, 20 bp, Artificial Sequence
  chemically synthesized
caagaagattcatttcaagg

SEQ ID NO: 119378 - DNA, 20 bp, Artificial Sequence
  chemically synthesized
aagattcatttcaaggaaga

SEQ ID NO: 119379 - DNA, 20 bp, Artificial Sequence
  chemically synthesized
atttcaaggaagacagatcc

SEQ ID NO: 119380 - DNA, 20 bp, Artificial Sequence
  chemically synthesized
tttcaaggaagacagatcca

SEQ ID NO: 119381 - DNA, 20 bp, Artificial Sequence
  chemically synthesized
tttgacattcacaacagcct

SEQ ID NO: 119382 - DNA, 20 bp, Artificial Sequence
  chemically synthesized
cgctcatttgacattcacaa

SEQ ID NO: 119383 - DNA, 20 bp, Artificial Sequence
  chemically synthesized
ggctgttgtgaatgtcaaat

SEQ ID NO: 119384 - DNA, 20 bp, Artificial Sequence
  chemically synthesized
gtgaatgtcaaatgagcgta

SEQ ID NO: 119385 - DNA, 20 bp, Artificial Sequence
  chemically synthesized
gagcgtaaagacttgataac

SEQ ID NO: 119386 - DNA, 20 bp, Artificial Sequence
  chemically synthesized
tctctattctgccagttatc

SEQ ID NO: 119387 - DNA, 20 bp, Artificial Sequence
  chemically synthesized
cgtaaagacttgataactgg

SEQ ID NO: 119388 - DNA, 20 bp, Artificial Sequence
  chemically synthesized
agacttgataactggcagaa

SEQ ID NO: 119389 - DNA, 20 bp, Artificial Sequence
  chemically synthesized
ccaacttttctctattctgc

SEQ ID NO: 119390 - DNA, 20 bp, Artificial Sequence
  chemically synthesized
acttgataactggcagaata

SEQ ID NO: 119391 - DNA, 20 bp, Artificial Sequence
  chemically synthesized
ataactggcagaatagagaa

SEQ ID NO: 119392 - DNA, 20 bp, Artificial Sequence
  chemically synthesized
ctggcagaatagagaaaagt

SEQ ID NO: 119393 - DNA, 20 bp, Artificial Sequence
  chemically synthesized
aaaagttggttacaatctcc

SEQ ID NO: 119394 - DNA, 20 bp, Artificial Sequence
  chemically synthesized
catcctttgtagatttctgg

SEQ ID NO: 119395 - DNA, 20 bp, Artificial Sequence
  chemically synthesized
ttcatcctttgtagatttct

SEQ ID NO: 119396 - DNA, 20 bp, Artificial Sequence
  chemically synthesized
cttcatcctttgtagatttc

SEQ ID NO: 119397 - DNA, 20 bp, Artificial Sequence
  chemically synthesized
caatctcccagaaatctaca

SEQ ID NO: 119398 - DNA, 20 bp, Artificial Sequence
  chemically synthesized
aatctcccagaaatctacaa

SEQ ID NO: 119399 - DNA, 20 bp, Artificial Sequence
  chemically synthesized
taaagcctcttcatcctttg

SEQ ID NO: 119400 - DNA, 20 bp, Artificial Sequence
  chemically synthesized
ccagaaatctacaaaggatg

SEQ ID NO: 119401 - DNA, 20 bp, Artificial Sequence
  chemically synthesized
agaaatctacaaaggatgaa

SEQ ID NO: 119402 - DNA, 20 bp, Artificial Sequence
  chemically synthesized
gaaatctacaaaggatgaag

SEQ ID NO: 119403 - DNA, 20 bp, Artificial Sequence
  chemically synthesized
tacaaaggatgaagaggctt

SEQ ID NO: 119404 - DNA, 20 bp, Artificial Sequence
  chemically synthesized
acaaaggatgaagaggcttt

SEQ ID NO: 119405 - DNA, 20 bp, Artificial Sequence
  chemically synthesized
ggatgaagaggctttaggat

SEQ ID NO: 119406 - DNA, 20 bp, Artificial Sequence
  chemically synthesized
gatgaagaggctttaggatg

SEQ ID NO: 119407 - DNA, 20 bp, Artificial Sequence
  chemically synthesized
cctattgtcacctcatccta

SEQ ID NO: 119408 - DNA, 20 bp, Artificial Sequence
  chemically synthesized
gctttaggatgaggtgacaa

SEQ ID NO: 119409 - DNA, 20 bp, Artificial Sequence
  chemically synthesized
ctttaggatgaggtgacaat

SEQ ID NO: 119410 - DNA, 20 bp, Artificial Sequence
  chemically synthesized
tttaggatgaggtgacaata

SEQ ID NO: 119411 - DNA, 20 bp, Artificial Sequence
  chemically synthesized
atgaggtgacaatagggata

SEQ ID NO: 119412 - DNA, 20 bp, Artificial Sequence
  chemically synthesized
gaggtgacaatagggataaa

SEQ ID NO: 119413 - DNA, 20 bp, Artificial Sequence
  chemically synthesized
ggtgacaatagggataaaga

SEQ ID NO: 119414 - DNA, 20 bp, Artificial Sequence
  chemically synthesized
gtgacaatagggataaagag

SEQ ID NO: 119415 - DNA, 20 bp, Artificial Sequence
  chemically synthesized
tgacaatagggataaagaga

SEQ ID NO: 119416 - DNA, 20 bp, Artificial Sequence
  chemically synthesized
taaagagagggaattgtttc

SEQ ID NO: 119417 - DNA, 20 bp, Artificial Sequence
  chemically synthesized
aagagagggaattgtttcta

SEQ ID NO: 119418 - DNA, 20 bp, Artificial Sequence
  chemically synthesized
ttctacttcaaaaattgctc

SEQ ID NO: 119419 - DNA, 20 bp, Artificial Sequence
  chemically synthesized
tgtttctagagcaatttttg

SEQ ID NO: 119420 - DNA, 20 bp, Artificial Sequence
  chemically synthesized
ttctagagcaatttttgaag

SEQ ID NO: 119421 - DNA, 20 bp, Artificial Sequence
  chemically synthesized
aatttttgaagtagaattca

SEQ ID NO: 119422 - DNA, 20 bp, Artificial Sequence
  chemically synthesized
gaagtagaattcacagaatt

SEQ ID NO: 119423 - DNA, 20 bp, Artificial Sequence
  chemically synthesized
gtagaattcacagaatttgg

SEQ ID NO: 119424 - DNA, 20 bp, Artificial Sequence
  chemically synthesized
aattcacagaatttggaagc

SEQ ID NO: 119425 - DNA, 20 bp, Artificial Sequence
  chemically synthesized
tactgacacatgtattaaac

SEQ ID NO: 119426 - DNA, 20 bp, Artificial Sequence
  chemically synthesized
agccagtttaatacatgtgt

SEQ ID NO: 119427 - DNA, 20 bp, Artificial Sequence
  chemically synthesized
cagtttaatacatgtgtcag

SEQ ID NO: 119428 - DNA, 20 bp, Artificial Sequence
  chemically synthesized
taatacatgtgtcagtagat

SEQ ID NO: 119429 - DNA, 20 bp, Artificial Sequence
  chemically synthesized
aatacatgtgtcagtagatt

SEQ ID NO: 119430 - DNA, 20 bp, Artificial Sequence
  chemically synthesized
catgtgtcagtagattggga

SEQ ID NO: 119431 - DNA, 20 bp, Artificial Sequence
  chemically synthesized
tgtgtcagtagattgggaaa

SEQ ID NO: 119432 - DNA, 20 bp, Artificial Sequence
  chemically synthesized
tgtcagtagattgggaaaga

SEQ ID NO: 119433 - DNA, 20 bp, Artificial Sequence
  chemically synthesized
tagattgggaaagagagatc

SEQ ID NO: 119434 - DNA, 20 bp, Artificial Sequence
  chemically synthesized
gattgggaaagagagatcaa

SEQ ID NO: 119435 - DNA, 20 bp, Artificial Sequence
  chemically synthesized
gggaaagagagatcaagaga

SEQ ID NO: 119436 - DNA, 20 bp, Artificial Sequence
  chemically synthesized
ggaaagagagatcaagagaa

SEQ ID NO: 119437 - DNA, 20 bp, Artificial Sequence
  chemically synthesized
aagagagatcaagagaaagg

SEQ ID NO: 119438 - DNA, 20 bp, Artificial Sequence
  chemically synthesized
agagatcaagagaaaggtag

SEQ ID NO: 119439 - DNA, 20 bp, Artificial Sequence
  chemically synthesized
gagatcaagagaaaggtaga

SEQ ID NO: 119440 - DNA, 20 bp, Artificial Sequence
  chemically synthesized
gaaaggtagaaggtaattct

SEQ ID NO: 119441 - DNA, 20 bp, Artificial Sequence
  chemically synthesized
aaaggtagaaggtaattctt

SEQ ID NO: 119442 - DNA, 20 bp, Artificial Sequence
  chemically synthesized
gaaggtaattcttaggtttc

SEQ ID NO: 119443 - DNA, 20 bp, Artificial Sequence
  chemically synthesized
gtctctaaaactggaaacct

SEQ ID NO: 119444 - DNA, 20 bp, Artificial Sequence
  chemically synthesized
aattcttaggtttccagttt

SEQ ID NO: 119445 - DNA, 20 bp, Artificial Sequence
  chemically synthesized
ttcttaggtttccagtttta

SEQ ID NO: 119446 - DNA, 20 bp, Artificial Sequence
  chemically synthesized
aacttaattgtctctaaaac

SEQ ID NO: 119447 - DNA, 20 bp, Artificial Sequence
  chemically synthesized
ttccagttttagagacaatt

SEQ ID NO: 119448 - DNA, 20 bp, Artificial Sequence
  chemically synthesized
agttttagagacaattaagt

SEQ ID NO: 119449 - DNA, 20 bp, Artificial Sequence
  chemically synthesized
aattttctgtgttttcagtg

SEQ ID NO: 119450 - DNA, 20 bp, Artificial Sequence
  chemically synthesized
attacactacactgaaaaca

SEQ ID NO: 119451 - DNA, 20 bp, Artificial Sequence
  chemically synthesized
agttaaattttctgtgtttt

SEQ ID NO: 119452 - DNA, 20 bp, Artificial Sequence
  chemically synthesized
cagaaaatttaactttcttt

SEQ ID NO: 119453 - DNA, 20 bp, Artificial Sequence
  chemically synthesized
agaaaatttaactttctttt

SEQ ID NO: 119454 - DNA, 20 bp, Artificial Sequence
  chemically synthesized
gaaaatttaactttctttta

SEQ ID NO: 119455 - DNA, 20 bp, Artificial Sequence
  chemically synthesized
attatcttgcccctaaaaga

SEQ ID NO: 119456 - DNA, 20 bp, Artificial Sequence
  chemically synthesized
aaaatttaactttcttttag

SEQ ID NO: 119457 - DNA, 20 bp, Artificial Sequence
  chemically synthesized
atgcattatcttgcccctaa

SEQ ID NO: 119458 - DNA, 20 bp, Artificial Sequence
  chemically synthesized
tttaactttcttttaggggc

SEQ ID NO: 119459 - DNA, 20 bp, Artificial Sequence
  chemically synthesized
aggctgcaaaatgtgtcaag

SEQ ID NO: 119460 - DNA, 20 bp, Artificial Sequence
  chemically synthesized
tacaggctgcaaaatgtgtc

SEQ ID NO: 119461 - DNA, 20 bp, Artificial Sequence
  chemically synthesized
attctacttgacacattttg

SEQ ID NO: 119462 - DNA, 20 bp, Artificial Sequence
  chemically synthesized
ttgacacattttgcagcctg

SEQ ID NO: 119463 - DNA, 20 bp, Artificial Sequence
  chemically synthesized
ttaccacctggatatgctac

SEQ ID NO: 119464 - DNA, 20 bp, Artificial Sequence
  chemically synthesized
attaccacctggatatgcta

SEQ ID NO: 119465 - DNA, 20 bp, Artificial Sequence
  chemically synthesized
tttgcagcctgtagcatatc

SEQ ID NO: 119466 - DNA, 20 bp, Artificial Sequence
  chemically synthesized
ttgcagcctgtagcatatcc

SEQ ID NO: 119467 - DNA, 20 bp, Artificial Sequence
  chemically synthesized
cagcctgtagcatatccagg

SEQ ID NO: 119468 - DNA, 20 bp, Artificial Sequence
  chemically synthesized
acctaacctacattaccacc

SEQ ID NO: 119469 - DNA, 20 bp, Artificial Sequence
  chemically synthesized
agcatatccaggtggtaatg

SEQ ID NO: 119470 - DNA, 20 bp, Artificial Sequence
  chemically synthesized
gcatatccaggtggtaatgt

SEQ ID NO: 119471 - DNA, 20 bp, Artificial Sequence
  chemically synthesized
atccaggtggtaatgtaggt

SEQ ID NO: 119472 - DNA, 20 bp, Artificial Sequence
  chemically synthesized
tccaggtggtaatgtaggtt

SEQ ID NO: 119473 - DNA, 20 bp, Artificial Sequence
  chemically synthesized
aggtggtaatgtaggttagg

SEQ ID NO: 119474 - DNA, 20 bp, Artificial Sequence
  chemically synthesized
tggtaatgtaggttaggtgg

SEQ ID NO: 119475 - DNA, 20 bp, Artificial Sequence
  chemically synthesized
aatgtaggttaggtggcaga

SEQ ID NO: 119476 - DNA, 20 bp, Artificial Sequence
  chemically synthesized
aggttaggtggcagaaagta

SEQ ID NO: 119477 - DNA, 20 bp, Artificial Sequence
  chemically synthesized
ggtggcagaaagtacagttc

SEQ ID NO: 119478 - DNA, 20 bp, Artificial Sequence
  chemically synthesized
tggcagaaagtacagttctg

SEQ ID NO: 119479 - DNA, 20 bp, Artificial Sequence
  chemically synthesized
gaaagtacagttctggagat

SEQ ID NO: 119480 - DNA, 20 bp, Artificial Sequence
  chemically synthesized
aaagtacagttctggagatc

SEQ ID NO: 119481 - DNA, 20 bp, Artificial Sequence
  chemically synthesized
tacactcttctcctgatctc

SEQ ID NO: 119482 - DNA, 20 bp, Artificial Sequence
  chemically synthesized
agtacagttctggagatcag

SEQ ID NO: 119483 - DNA, 20 bp, Artificial Sequence
  chemically synthesized
acagttctggagatcaggag

SEQ ID NO: 119484 - DNA, 20 bp, Artificial Sequence
  chemically synthesized
agttctggagatcaggagaa

SEQ ID NO: 119485 - DNA, 20 bp, Artificial Sequence
  chemically synthesized
ggagatcaggagaagagtgt

SEQ ID NO: 119486 - DNA, 20 bp, Artificial Sequence
  chemically synthesized
atcaggagaagagtgtaaga

SEQ ID NO: 119487 - DNA, 20 bp, Artificial Sequence
  chemically synthesized
aggagaagagtgtaagatgg

SEQ ID NO: 119488 - DNA, 20 bp, Artificial Sequence
  chemically synthesized
gtaagatggaagttgacact

SEQ ID NO: 119489 - DNA, 20 bp, Artificial Sequence
  chemically synthesized
taagatggaagttgacactg

SEQ ID NO: 119490 - DNA, 20 bp, Artificial Sequence
  chemically synthesized
agatggaagttgacactgag

SEQ ID NO: 119491 - DNA, 20 bp, Artificial Sequence
  chemically synthesized
cagttaacattaagactcct

SEQ ID NO: 119492 - DNA, 20 bp, Artificial Sequence
  chemically synthesized
tgttggcttcagttaacatt

SEQ ID NO: 119493 - DNA, 20 bp, Artificial Sequence
  chemically synthesized
aggagtcttaatgttaactg

SEQ ID NO: 119494 - DNA, 20 bp, Artificial Sequence
  chemically synthesized
ttaatgttaactgaagccaa

SEQ ID NO: 119495 - DNA, 20 bp, Artificial Sequence
  chemically synthesized
gtagctttgtctgttggctt

SEQ ID NO: 119496 - DNA, 20 bp, Artificial Sequence
  chemically synthesized
ttaactgaagccaacagaca

SEQ ID NO: 119497 - DNA, 20 bp, Artificial Sequence
  chemically synthesized
ttttgagtagctttgtctgt

SEQ ID NO: 119498 - DNA, 20 bp, Artificial Sequence
  chemically synthesized
ttctctctgcacattttgag

SEQ ID NO: 119499 - DNA, 20 bp, Artificial Sequence
  chemically synthesized
tctttctctctgcacatttt

SEQ ID NO: 119500 - DNA, 20 bp, Artificial Sequence
  chemically synthesized
acaaagctactcaaaatgtg

SEQ ID NO: 119501 - DNA, 20 bp, Artificial Sequence
  chemically synthesized
aaagctactcaaaatgtgca

SEQ ID NO: 119502 - DNA, 20 bp, Artificial Sequence
  chemically synthesized
agctactcaaaatgtgcaga

SEQ ID NO: 119503 - DNA, 20 bp, Artificial Sequence
  chemically synthesized
actcaaaatgtgcagagaga

SEQ ID NO: 119504 - DNA, 20 bp, Artificial Sequence
  chemically synthesized
caaaatgtgcagagagaaag

SEQ ID NO: 119505 - DNA, 20 bp, Artificial Sequence
  chemically synthesized
aaatgtgcagagagaaagaa

SEQ ID NO: 119506 - DNA, 20 bp, Artificial Sequence
  chemically synthesized
atgtgcagagagaaagaaga

SEQ ID NO: 119507 - DNA, 20 bp, Artificial Sequence
  chemically synthesized
gagaaagaagagagacaatt

SEQ ID NO: 119508 - DNA, 20 bp, Artificial Sequence
  chemically synthesized
agaagagagacaattaagaa

SEQ ID NO: 119509 - DNA, 20 bp, Artificial Sequence
  chemically synthesized
caacatttaaaattgcattg

SEQ ID NO: 119510 - DNA, 20 bp, Artificial Sequence
  chemically synthesized
atttaaaattgcattgaaga

SEQ ID NO: 119511 - DNA, 20 bp, Artificial Sequence
  chemically synthesized
ttaaaattgcattgaagaca

SEQ ID NO: 119512 - DNA, 20 bp, Artificial Sequence
  chemically synthesized
gttgtaacaatgatcagtgc

SEQ ID NO: 119513 - DNA, 20 bp, Artificial Sequence
  chemically synthesized
ttgggagttgtaacaatgat

SEQ ID NO: 119514 - DNA, 20 bp, Artificial Sequence
  chemically synthesized
agctcaagatacaaagttgg

SEQ ID NO: 119515 - DNA, 20 bp, Artificial Sequence
  chemically synthesized
gtagctcaagatacaaagtt

SEQ ID NO: 119516 - DNA, 20 bp, Artificial Sequence
  chemically synthesized
agtagctcaagatacaaagt

SEQ ID NO: 119517 - DNA, 20 bp, Artificial Sequence
  chemically synthesized
ggggagtagctcaagataca

SEQ ID NO: 119518 - DNA, 20 bp, Artificial Sequence
  chemically synthesized
aactcccaactttgtatctt

SEQ ID NO: 119519 - DNA, 20 bp, Artificial Sequence
  chemically synthesized
taagttatggggagtagctc

SEQ ID NO: 119520 - DNA, 20 bp, Artificial Sequence
  chemically synthesized
gaatcttaagttatggggag

SEQ ID NO: 119521 - DNA, 20 bp, Artificial Sequence
  chemically synthesized
tatgaatcttaagttatggg

SEQ ID NO: 119522 - DNA, 20 bp, Artificial Sequence
  chemically synthesized
tatatgaatcttaagttatg

SEQ ID NO: 119523 - DNA, 20 bp, Artificial Sequence
  chemically synthesized
tgagctactccccataactt

SEQ ID NO: 119524 - DNA, 20 bp, Artificial Sequence
  chemically synthesized
atatatgaatcttaagttat

SEQ ID NO: 119525 - DNA, 20 bp, Artificial Sequence
  chemically synthesized
gatatatgaatcttaagtta

SEQ ID NO: 119526 - DNA, 20 bp, Artificial Sequence
  chemically synthesized
tagctggatatatgaatctt

SEQ ID NO: 119527 - DNA, 20 bp, Artificial Sequence
  chemically synthesized
taacttaagattcatatatc

SEQ ID NO: 119528 - DNA, 20 bp, Artificial Sequence
  chemically synthesized
agatgtgtggagtagatagc

SEQ ID NO: 119529 - DNA, 20 bp, Artificial Sequence
  chemically synthesized
taggagatgtgtggagtaga

SEQ ID NO: 119530 - DNA, 20 bp, Artificial Sequence
  chemically synthesized
catctaggagatgtgtggag

SEQ ID NO: 119531 - DNA, 20 bp, Artificial Sequence
  chemically synthesized
atacatctaggagatgtgtg

SEQ ID NO: 119532 - DNA, 20 bp, Artificial Sequence
  chemically synthesized
ttatacatctaggagatgtg

SEQ ID NO: 119533 - DNA, 20 bp, Artificial Sequence
  chemically synthesized
tatctactccacacatctcc

SEQ ID NO: 119534 - DNA, 20 bp, Artificial Sequence
  chemically synthesized
aatgcctattatacatctag

SEQ ID NO: 119535 - DNA, 20 bp, Artificial Sequence
  chemically synthesized
gaaatgcctattatacatct

SEQ ID NO: 119536 - DNA, 20 bp, Artificial Sequence
  chemically synthesized
tgaaatgcctattatacatc

SEQ ID NO: 119537 - DNA, 20 bp, Artificial Sequence
  chemically synthesized
cacatctcctagatgtataa

SEQ ID NO: 119538 - DNA, 20 bp, Artificial Sequence
  chemically synthesized
acatctcctagatgtataat

SEQ ID NO: 119539 - DNA, 20 bp, Artificial Sequence
  chemically synthesized
catattttgggaggaagatg

SEQ ID NO: 119540 - DNA, 20 bp, Artificial Sequence
  chemically synthesized
gagtaacatattttgggagg

SEQ ID NO: 119541 - DNA, 20 bp, Artificial Sequence
  chemically synthesized
caggagtaacatattttggg

SEQ ID NO: 119542 - DNA, 20 bp, Artificial Sequence
  chemically synthesized
ccaggagtaacatattttgg

SEQ ID NO: 119543 - DNA, 20 bp, Artificial Sequence
  chemically synthesized
ctccaggagtaacatatttt

SEQ ID NO: 119544 - DNA, 20 bp, Artificial Sequence
  chemically synthesized
gctccaggagtaacatattt

SEQ ID NO: 119545 - DNA, 20 bp, Artificial Sequence
  chemically synthesized
ctcccaaaatatgttactcc

SEQ ID NO: 119546 - DNA, 20 bp, Artificial Sequence
  chemically synthesized
cccaaaatatgttactcctg

SEQ ID NO: 119547 - DNA, 20 bp, Artificial Sequence
  chemically synthesized
tgagatggggaaggctccag

SEQ ID NO: 119548 - DNA, 20 bp, Artificial Sequence
  chemically synthesized
actgagatggggaaggctcc

SEQ ID NO: 119549 - DNA, 20 bp, Artificial Sequence
  chemically synthesized
tactgagatggggaaggctc

SEQ ID NO: 119550 - DNA, 20 bp, Artificial Sequence
  chemically synthesized
atcatttactgagatgggga

SEQ ID NO: 119551 - DNA, 20 bp, Artificial Sequence
  chemically synthesized
catcatttactgagatgggg

SEQ ID NO: 119552 - DNA, 20 bp, Artificial Sequence
  chemically synthesized
tcctggagccttccccatct

SEQ ID NO: 119553 - DNA, 20 bp, Artificial Sequence
  chemically synthesized
ggtcatcatttactgagatg

SEQ ID NO: 119554 - DNA, 20 bp, Artificial Sequence
  chemically synthesized
gggtcatcatttactgagat

SEQ ID NO: 119555 - DNA, 20 bp, Artificial Sequence
  chemically synthesized
ggggtcatcatttactgaga

SEQ ID NO: 119556 - DNA, 20 bp, Artificial Sequence
  chemically synthesized
agatggggtcatcatttact

SEQ ID NO: 119557 - DNA, 20 bp, Artificial Sequence
  chemically synthesized
gcctgagcaacggaaagatg

SEQ ID NO: 119558 - DNA, 20 bp, Artificial Sequence
  chemically synthesized
agcctgagcaacggaaagat

SEQ ID NO: 119559 - DNA, 20 bp, Artificial Sequence
  chemically synthesized
tagcctgagcaacggaaaga

SEQ ID NO: 119560 - DNA, 20 bp, Artificial Sequence
  chemically synthesized
tttttagcctgagcaacgga

SEQ ID NO: 119561 - DNA, 20 bp, Artificial Sequence
  chemically synthesized
gaccccatctttccgttgct

SEQ ID NO: 119562 - DNA, 20 bp, Artificial Sequence
  chemically synthesized
accccatctttccgttgctc

SEQ ID NO: 119563 - DNA, 20 bp, Artificial Sequence
  chemically synthesized
agaatttttagcctgagcaa

SEQ ID NO: 119564 - DNA, 20 bp, Artificial Sequence
  chemically synthesized
gactcaagaatttttagcct

SEQ ID NO: 119565 - DNA, 20 bp, Artificial Sequence
  chemically synthesized
caagaagactcaagaatttt

SEQ ID NO: 119566 - DNA, 20 bp, Artificial Sequence
  chemically synthesized
tgctcaggctaaaaattctt

SEQ ID NO: 119567 - DNA, 20 bp, Artificial Sequence
  chemically synthesized
agaaagagtcaagaagactc

SEQ ID NO: 119568 - DNA, 20 bp, Artificial Sequence
  chemically synthesized
gtgtgagagaaagagtcaag

SEQ ID NO: 119569 - DNA, 20 bp, Artificial Sequence
  chemically synthesized
taggtgtgagagaaagagtc

SEQ ID NO: 119570 - DNA, 20 bp, Artificial Sequence
  chemically synthesized
aaatttaggtgtgagagaaa

SEQ ID NO: 119571 - DNA, 20 bp, Artificial Sequence
  chemically synthesized
ataaatttaggtgtgagaga

SEQ ID NO: 119572 - DNA, 20 bp, Artificial Sequence
  chemically synthesized
tggaataaatttaggtgtga

SEQ ID NO: 119573 - DNA, 20 bp, Artificial Sequence
  chemically synthesized
aatggaataaatttaggtgt

SEQ ID NO: 119574 - DNA, 20 bp, Artificial Sequence
  chemically synthesized
ttttataatggaataaattt

SEQ ID NO: 119575 - DNA, 20 bp, Artificial Sequence
  chemically synthesized
attttataatggaataaatt

SEQ ID NO: 119576 - DNA, 20 bp, Artificial Sequence
  chemically synthesized
gagcacaacagattttataa

SEQ ID NO: 119577 - DNA, 20 bp, Artificial Sequence
  chemically synthesized
attttgggtacagagcacaa

SEQ ID NO: 119578 - DNA, 20 bp, Artificial Sequence
  chemically synthesized
tctactatattttgggtaca

SEQ ID NO: 119579 - DNA, 20 bp, Artificial Sequence
  chemically synthesized
attctactatattttgggta

SEQ ID NO: 119580 - DNA, 20 bp, Artificial Sequence
  chemically synthesized
tgtgctctgtacccaaaata

SEQ ID NO: 119581 - DNA, 20 bp, Artificial Sequence
  chemically synthesized
gttggattctactatatttt

SEQ ID NO: 119582 - DNA, 20 bp, Artificial Sequence
  chemically synthesized
ggttggattctactatattt

SEQ ID NO: 119583 - DNA, 20 bp, Artificial Sequence
  chemically synthesized
gctctgtacccaaaatatag

SEQ ID NO: 119584 - DNA, 20 bp, Artificial Sequence
  chemically synthesized
tgaatgtggtgaggagtggt

SEQ ID NO: 119585 - DNA, 20 bp, Artificial Sequence
  chemically synthesized
gaggtgaatgtggtgaggag

SEQ ID NO: 119586 - DNA, 20 bp, Artificial Sequence
  chemically synthesized
ggagaggtgaatgtggtgag

SEQ ID NO: 119587 - DNA, 20 bp, Artificial Sequence
  chemically synthesized
tgggagaggtgaatgtggtg

SEQ ID NO: 119588 - DNA, 20 bp, Artificial Sequence
  chemically synthesized
atgggagaggtgaatgtggt

SEQ ID NO: 119589 - DNA, 20 bp, Artificial Sequence
  chemically synthesized
cagaatgggagaggtgaatg

SEQ ID NO: 119590 - DNA, 20 bp, Artificial Sequence
  chemically synthesized
ggctgggatcagaatgggag

SEQ ID NO: 119591 - DNA, 20 bp, Artificial Sequence
  chemically synthesized
tggctgggatcagaatggga

SEQ ID NO: 119592 - DNA, 20 bp, Artificial Sequence
  chemically synthesized
tgtggctgggatcagaatgg

SEQ ID NO: 119593 - DNA, 20 bp, Artificial Sequence
  chemically synthesized
actgtggctgggatcagaat

SEQ ID NO: 119594 - DNA, 20 bp, Artificial Sequence
  chemically synthesized
gactgtggctgggatcagaa

SEQ ID NO: 119595 - DNA, 20 bp, Artificial Sequence
  chemically synthesized
cacctctcccattctgatcc

SEQ ID NO: 119596 - DNA, 20 bp, Artificial Sequence
  chemically synthesized
gagatgactgtggctgggat

SEQ ID NO: 119597 - DNA, 20 bp, Artificial Sequence
  chemically synthesized
tcccattctgatcccagcca

SEQ ID NO: 119598 - DNA, 20 bp, Artificial Sequence
  chemically synthesized
gtcaagagatgactgtggct

SEQ ID NO: 119599 - DNA, 20 bp, Artificial Sequence
  chemically synthesized
agtcaagagatgactgtggc

SEQ ID NO: 119600 - DNA, 20 bp, Artificial Sequence
  chemically synthesized
attcagtcaagagatgactg

SEQ ID NO: 119601 - DNA, 20 bp, Artificial Sequence
  chemically synthesized
tgttgtcataattcagtcaa

SEQ ID NO: 119602 - DNA, 20 bp, Artificial Sequence
  chemically synthesized
actgttgtcataattcagtc

SEQ ID NO: 119603 - DNA, 20 bp, Artificial Sequence
  chemically synthesized
aggaaactgttgtcataatt

SEQ ID NO: 119604 - DNA, 20 bp, Artificial Sequence
  chemically synthesized
tcttgactgaattatgacaa

SEQ ID NO: 119605 - DNA, 20 bp, Artificial Sequence
  chemically synthesized
ttatgacaacagtttcctaa

SEQ ID NO: 119606 - DNA, 20 bp, Artificial Sequence
  chemically synthesized
acagaagtagtgagaccatt

SEQ ID NO: 119607 - DNA, 20 bp, Artificial Sequence
  chemically synthesized
aacagaagtagtgagaccat

SEQ ID NO: 119608 - DNA, 20 bp, Artificial Sequence
  chemically synthesized
atagactaaacagaagtagt

SEQ ID NO: 119609 - DNA, 20 bp, Artificial Sequence
  chemically synthesized
tacaatagactaaacagaag

SEQ ID NO: 119610 - DNA, 20 bp, Artificial Sequence
  chemically synthesized
atggtctcactacttctgtt

SEQ ID NO: 119611 - DNA, 20 bp, Artificial Sequence
  chemically synthesized
tgttacaatagactaaacag

SEQ ID NO: 119612 - DNA, 20 bp, Artificial Sequence
  chemically synthesized
ctctgttacaatagactaaa

SEQ ID NO: 119613 - DNA, 20 bp, Artificial Sequence
  chemically synthesized
ttctgtttagtctattgtaa

SEQ ID NO: 119614 - DNA, 20 bp, Artificial Sequence
  chemically synthesized
atctggctcctctgttacaa

SEQ ID NO: 119615 - DNA, 20 bp, Artificial Sequence
  chemically synthesized
ctgtttagtctattgtaaca

SEQ ID NO: 119616 - DNA, 20 bp, Artificial Sequence
  chemically synthesized
tgtttagtctattgtaacag

SEQ ID NO: 119617 - DNA, 20 bp, Artificial Sequence
  chemically synthesized
tttagtctattgtaacagag

SEQ ID NO: 119618 - DNA, 20 bp, Artificial Sequence
  chemically synthesized
gtctattgtaacagaggagc

SEQ ID NO: 119619 - DNA, 20 bp, Artificial Sequence
  chemically synthesized
ttgtaacagaggagccagat

SEQ ID NO: 119620 - DNA, 20 bp, Artificial Sequence
  chemically synthesized
gtgacatgttttgtcttatc

SEQ ID NO: 119621 - DNA, 20 bp, Artificial Sequence
  chemically synthesized
ttggagggttttgaatggag

SEQ ID NO: 119622 - DNA, 20 bp, Artificial Sequence
  chemically synthesized
tattggagggttttgaatgg

SEQ ID NO: 119623 - DNA, 20 bp, Artificial Sequence
  chemically synthesized
ttattggagggttttgaatg

SEQ ID NO: 119624 - DNA, 20 bp, Artificial Sequence
  chemically synthesized
agttattggagggttttgaa

SEQ ID NO: 119625 - DNA, 20 bp, Artificial Sequence
  chemically synthesized
atgagatgggagttattgga

SEQ ID NO: 119626 - DNA, 20 bp, Artificial Sequence
  chemically synthesized
aatgagatgggagttattgg

SEQ ID NO: 119627 - DNA, 20 bp, Artificial Sequence
  chemically synthesized
gaatgagatgggagttattg

SEQ ID NO: 119628 - DNA, 20 bp, Artificial Sequence
  chemically synthesized
ctgaatgagatgggagttat

SEQ ID NO: 119629 - DNA, 20 bp, Artificial Sequence
  chemically synthesized
ttttaatctgaatgagatgg

SEQ ID NO: 119630 - DNA, 20 bp, Artificial Sequence
  chemically synthesized
gcttttaatctgaatgagat

SEQ ID NO: 119631 - DNA, 20 bp, Artificial Sequence
  chemically synthesized
ccaataactcccatctcatt

SEQ ID NO: 119632 - DNA, 20 bp, Artificial Sequence
  chemically synthesized
agcttttaatctgaatgaga

SEQ ID NO: 119633 - DNA, 20 bp, Artificial Sequence
  chemically synthesized
ctttagcttttaatctgaat

SEQ ID NO: 119634 - DNA, 20 bp, Artificial Sequence
  chemically synthesized
tcccatctcattcagattaa

SEQ ID NO: 119635 - DNA, 20 bp, Artificial Sequence
  chemically synthesized
ctcattcagattaaaagcta

SEQ ID NO: 119636 - DNA, 20 bp, Artificial Sequence
  chemically synthesized
agattaaaagctaaagtcca

SEQ ID NO: 119637 - DNA, 20 bp, Artificial Sequence
  chemically synthesized
ccttttaggcctgtggactt

SEQ ID NO: 119638 - DNA, 20 bp, Artificial Sequence
  chemically synthesized
gattaaaagctaaagtccac

SEQ ID NO: 119639 - DNA, 20 bp, Artificial Sequence
  chemically synthesized
atattggccttttaggcctg

SEQ ID NO: 119640 - DNA, 20 bp, Artificial Sequence
  chemically synthesized
gctaaagtccacaggcctaa

SEQ ID NO: 119641 - DNA, 20 bp, Artificial Sequence
  chemically synthesized
ctaaagtccacaggcctaaa

SEQ ID NO: 119642 - DNA, 20 bp, Artificial Sequence
  chemically synthesized
tctgattatattggcctttt

SEQ ID NO: 119643 - DNA, 20 bp, Artificial Sequence
  chemically synthesized
atctgattatattggccttt

SEQ ID NO: 119644 - DNA, 20 bp, Artificial Sequence
  chemically synthesized
gcctaaaaggccaatataat

SEQ ID NO: 119645 - DNA, 20 bp, Artificial Sequence
  chemically synthesized
taactggcatctgattatat

SEQ ID NO: 119646 - DNA, 20 bp, Artificial Sequence
  chemically synthesized
aggccaatataatcagatgc

SEQ ID NO: 119647 - DNA, 20 bp, Artificial Sequence
  chemically synthesized
aataaatttagaggggtaac

SEQ ID NO: 119648 - DNA, 20 bp, Artificial Sequence
  chemically synthesized
agttgacaataaatttagag

SEQ ID NO: 119649 - DNA, 20 bp, Artificial Sequence
  chemically synthesized
tagttgacaataaatttaga

SEQ ID NO: 119650 - DNA, 20 bp, Artificial Sequence
  chemically synthesized
gtagttgacaataaatttag

SEQ ID NO: 119651 - DNA, 20 bp, Artificial Sequence
  chemically synthesized
ggtagttgacaataaattta

SEQ ID NO: 119652 - DNA, 20 bp, Artificial Sequence
  chemically synthesized
aaggtagttgacaataaatt

SEQ ID NO: 119653 - DNA, 20 bp, Artificial Sequence
  chemically synthesized
ggatcaagcgagcaggaagg

SEQ ID NO: 119654 - DNA, 20 bp, Artificial Sequence
  chemically synthesized
aaaggatcaagcgagcagga

SEQ ID NO: 119655 - DNA, 20 bp, Artificial Sequence
  chemically synthesized
aaaaggatcaagcgagcagg

SEQ ID NO: 119656 - DNA, 20 bp, Artificial Sequence
  chemically synthesized
cagaaaaggatcaagcgagc

SEQ ID NO: 119657 - DNA, 20 bp, Artificial Sequence
  chemically synthesized
gcagaaaaggatcaagcgag

SEQ ID NO: 119658 - DNA, 20 bp, Artificial Sequence
  chemically synthesized
taggcagaaaaggatcaagc

SEQ ID NO: 119659 - DNA, 20 bp, Artificial Sequence
  chemically synthesized
cagttaggcagaaaaggatc

SEQ ID NO: 119660 - DNA, 20 bp, Artificial Sequence
  chemically synthesized
ggagatcagttaggcagaaa

SEQ ID NO: 119661 - DNA, 20 bp, Artificial Sequence
  chemically synthesized
gggagatcagttaggcagaa

SEQ ID NO: 119662 - DNA, 20 bp, Artificial Sequence
  chemically synthesized
taaaagggagatcagttagg

SEQ ID NO: 119663 - DNA, 20 bp, Artificial Sequence
  chemically synthesized
ccttaaaagggagatcagtt

SEQ ID NO: 119664 - DNA, 20 bp, Artificial Sequence
  chemically synthesized
accttaaaagggagatcagt

SEQ ID NO: 119665 - DNA, 20 bp, Artificial Sequence
  chemically synthesized
aggaaccttaaaagggagat

SEQ ID NO: 119666 - DNA, 20 bp, Artificial Sequence
  chemically synthesized
gcctaactgatctccctttt

SEQ ID NO: 119667 - DNA, 20 bp, Artificial Sequence
  chemically synthesized
cctaactgatctccctttta

SEQ ID NO: 119668 - DNA, 20 bp, Artificial Sequence
  chemically synthesized
gttgaaggaaccttaaaagg

SEQ ID NO: 119669 - DNA, 20 bp, Artificial Sequence
  chemically synthesized
atgttgaaggaaccttaaaa

SEQ ID NO: 119670 - DNA, 20 bp, Artificial Sequence
  chemically synthesized
catgttgaaggaaccttaaa

SEQ ID NO: 119671 - DNA, 20 bp, Artificial Sequence
  chemically synthesized
gcatgttgaaggaaccttaa

SEQ ID NO: 119672 - DNA, 20 bp, Artificial Sequence
  chemically synthesized
gaatattcttggcatgttga

SEQ ID NO: 119673 - DNA, 20 bp, Artificial Sequence
  chemically synthesized
ggaatattcttggcatgttg

SEQ ID NO: 119674 - DNA, 20 bp, Artificial Sequence
  chemically synthesized
taaggttccttcaacatgcc

SEQ ID NO: 119675 - DNA, 20 bp, Artificial Sequence
  chemically synthesized
ccccaaagcaggaatattct

SEQ ID NO: 119676 - DNA, 20 bp, Artificial Sequence
  chemically synthesized
tgccaagaatattcctgctt

SEQ ID NO: 119677 - DNA, 20 bp, Artificial Sequence
  chemically synthesized
gccaagaatattcctgcttt

SEQ ID NO: 119678 - DNA, 20 bp, Artificial Sequence
  chemically synthesized
ccaagaatattcctgctttg

SEQ ID NO: 119679 - DNA, 20 bp, Artificial Sequence
  chemically synthesized
aagttaaaatgccccaaagc

SEQ ID NO: 119680 - DNA, 20 bp, Artificial Sequence
  chemically synthesized
taagttaaaatgccccaaag

SEQ ID NO: 119681 - DNA, 20 bp, Artificial Sequence
  chemically synthesized
taataagttaaaatgcccca

SEQ ID NO: 119682 - DNA, 20 bp, Artificial Sequence
  chemically synthesized
tttggggcattttaacttat

SEQ ID NO: 119683 - DNA, 20 bp, Artificial Sequence
  chemically synthesized
ttggggcattttaacttatt

SEQ ID NO: 119684 - DNA, 20 bp, Artificial Sequence
  chemically synthesized
tagtccaggagagtcctaat

SEQ ID NO: 119685 - DNA, 20 bp, Artificial Sequence
  chemically synthesized
ttaacttattaggactctcc

SEQ ID NO: 119686 - DNA, 20 bp, Artificial Sequence
  chemically synthesized
ggggaaaaagtagtccagga

SEQ ID NO: 119687 - DNA, 20 bp, Artificial Sequence
  chemically synthesized
ggggggaaaaagtagtccag

SEQ ID NO: 119688 - DNA, 20 bp, Artificial Sequence
  chemically synthesized
tgggggggaaaaagtagtcc

SEQ ID NO: 119689 - DNA, 20 bp, Artificial Sequence
  chemically synthesized
ttgggggggaaaaagtagtc

SEQ ID NO: 119690 - DNA, 20 bp, Artificial Sequence
  chemically synthesized
tataattgggggggaaaaag

SEQ ID NO: 119691 - DNA, 20 bp, Artificial Sequence
  chemically synthesized
atgtataattgggggggaaa

SEQ ID NO: 119692 - DNA, 20 bp, Artificial Sequence
  chemically synthesized
ggccatatgtataattgggg

SEQ ID NO: 119693 - DNA, 20 bp, Artificial Sequence
  chemically synthesized
gggccatatgtataattggg

SEQ ID NO: 119694 - DNA, 20 bp, Artificial Sequence
  chemically synthesized
tgggccatatgtataattgg

SEQ ID NO: 119695 - DNA, 20 bp, Artificial Sequence
  chemically synthesized
gtgggccatatgtataattg

SEQ ID NO: 119696 - DNA, 20 bp, Artificial Sequence
  chemically synthesized
tgtgggccatatgtataatt

SEQ ID NO: 119697 - DNA, 20 bp, Artificial Sequence
  chemically synthesized
atgtgggccatatgtataat

SEQ ID NO: 119698 - DNA, 20 bp, Artificial Sequence
  chemically synthesized
ttcccccccaattatacata

SEQ ID NO: 119699 - DNA, 20 bp, Artificial Sequence
  chemically synthesized
atacatatggcccacatcct

SEQ ID NO: 119700 - DNA, 20 bp, Artificial Sequence
  chemically synthesized
tctaaaagacctgaggatgt

SEQ ID NO: 119701 - DNA, 20 bp, Artificial Sequence
  chemically synthesized
tacatatggcccacatcctc

SEQ ID NO: 119702 - DNA, 20 bp, Artificial Sequence
  chemically synthesized
ttctaaaagacctgaggatg

SEQ ID NO: 119703 - DNA, 20 bp, Artificial Sequence
  chemically synthesized
agcaaattctaaaagacctg

SEQ ID NO: 119704 - DNA, 20 bp, Artificial Sequence
  chemically synthesized
aagcaaattctaaaagacct

SEQ ID NO: 119705 - DNA, 20 bp, Artificial Sequence
  chemically synthesized
gcccacatcctcaggtcttt

SEQ ID NO: 119706 - DNA, 20 bp, Artificial Sequence
  chemically synthesized
ggcatttaagcaaattctaa

SEQ ID NO: 119707 - DNA, 20 bp, Artificial Sequence
  chemically synthesized
ttactgaaaaggtggcattt

SEQ ID NO: 119708 - DNA, 20 bp, Artificial Sequence
  chemically synthesized
ttgcttaaatgccacctttt

SEQ ID NO: 119709 - DNA, 20 bp, Artificial Sequence
  chemically synthesized
aaaaggtcttactgaaaagg

SEQ ID NO: 119710 - DNA, 20 bp, Artificial Sequence
  chemically synthesized
ttaaatgccaccttttcagt

SEQ ID NO: 119711 - DNA, 20 bp, Artificial Sequence
  chemically synthesized
caaaaaaggtcttactgaaa

SEQ ID NO: 119712 - DNA, 20 bp, Artificial Sequence
  chemically synthesized
tcaaaaaaggtcttactgaa

SEQ ID NO: 119713 - DNA, 20 bp, Artificial Sequence
  chemically synthesized
gaaaatgtggtaatcaaaaa

SEQ ID NO: 119714 - DNA, 20 bp, Artificial Sequence
  chemically synthesized
tgaaaatgtggtaatcaaaa

SEQ ID NO: 119715 - DNA, 20 bp, Artificial Sequence
  chemically synthesized
ggagtgctgccatgaaaatg

SEQ ID NO: 119716 - DNA, 20 bp, Artificial Sequence
  chemically synthesized
ttttgattaccacattttca

SEQ ID NO: 119717 - DNA, 20 bp, Artificial Sequence
  chemically synthesized
tgattaccacattttcatgg

SEQ ID NO: 119718 - DNA, 20 bp, Artificial Sequence
  chemically synthesized
gagagagggaggtggaagag

SEQ ID NO: 119719 - DNA, 20 bp, Artificial Sequence
  chemically synthesized
gagagagagggaggtggaag

SEQ ID NO: 119720 - DNA, 20 bp, Artificial Sequence
  chemically synthesized
agagagagagggaggtggaa

SEQ ID NO: 119721 - DNA, 20 bp, Artificial Sequence
  chemically synthesized
ggagagagagagggaggtgg

SEQ ID NO: 119722 - DNA, 20 bp, Artificial Sequence
  chemically synthesized
agtggagagagagagggagg

SEQ ID NO: 119723 - DNA, 20 bp, Artificial Sequence
  chemically synthesized
acaagtggagagagagaggg

SEQ ID NO: 119724 - DNA, 20 bp, Artificial Sequence
  chemically synthesized
aacaagtggagagagagagg

SEQ ID NO: 119725 - DNA, 20 bp, Artificial Sequence
  chemically synthesized
aaaacaagtggagagagaga

SEQ ID NO: 119726 - DNA, 20 bp, Artificial Sequence
  chemically synthesized
gaaaacaagtggagagagag

SEQ ID NO: 119727 - DNA, 20 bp, Artificial Sequence
  chemically synthesized
ggaaaacaagtggagagaga

SEQ ID NO: 119728 - DNA, 20 bp, Artificial Sequence
  chemically synthesized
gaggaaaacaagtggagaga

SEQ ID NO: 119729 - DNA, 20 bp, Artificial Sequence
  chemically synthesized
aagaggaaaacaagtggaga

SEQ ID NO: 119730 - DNA, 20 bp, Artificial Sequence
  chemically synthesized
caaagaggaaaacaagtgga

SEQ ID NO: 119731 - DNA, 20 bp, Artificial Sequence
  chemically synthesized
aacaaagaggaaaacaagtg

SEQ ID NO: 119732 - DNA, 20 bp, Artificial Sequence
  chemically synthesized
agaacaaagaggaaaacaag

SEQ ID NO: 119733 - DNA, 20 bp, Artificial Sequence
  chemically synthesized
ggaagaacaaagaggaaaac

SEQ ID NO: 119734 - DNA, 20 bp, Artificial Sequence
  chemically synthesized
cacagtgtggaagaacaaag

SEQ ID NO: 119735 - DNA, 20 bp, Artificial Sequence
  chemically synthesized
acacagtgtggaagaacaaa

SEQ ID NO: 119736 - DNA, 20 bp, Artificial Sequence
  chemically synthesized
acacacagtgtggaagaaca

SEQ ID NO: 119737 - DNA, 20 bp, Artificial Sequence
  chemically synthesized
tggtcatacacacagtgtgg

SEQ ID NO: 119738 - DNA, 20 bp, Artificial Sequence
  chemically synthesized
agatggtcatacacacagtg

SEQ ID NO: 119739 - DNA, 20 bp, Artificial Sequence
  chemically synthesized
gtgtcagatggtcatacaca

SEQ ID NO: 119740 - DNA, 20 bp, Artificial Sequence
  chemically synthesized
taaatacatgatgtgtcaga

SEQ ID NO: 119741 - DNA, 20 bp, Artificial Sequence
  chemically synthesized
aaattaaatacatgatgtgt

SEQ ID NO: 119742 - DNA, 20 bp, Artificial Sequence
  chemically synthesized
tggaagcagaagttggaaga

SEQ ID NO: 119743 - DNA, 20 bp, Artificial Sequence
  chemically synthesized
ttcttggaagcagaagttgg

SEQ ID NO: 119744 - DNA, 20 bp, Artificial Sequence
  chemically synthesized
atattcttggaagcagaagt

SEQ ID NO: 119745 - DNA, 20 bp, Artificial Sequence
  chemically synthesized
gcttatattcttggaagcag

SEQ ID NO: 119746 - DNA, 20 bp, Artificial Sequence
  chemically synthesized
gtcttccaacttctgcttcc

SEQ ID NO: 119747 - DNA, 20 bp, Artificial Sequence
  chemically synthesized
aaagcttatattcttggaag

SEQ ID NO: 119748 - DNA, 20 bp, Artificial Sequence
  chemically synthesized
cataaagcttatattcttgg

SEQ ID NO: 119749 - DNA, 20 bp, Artificial Sequence
  chemically synthesized
acttctgcttccaagaatat

SEQ ID NO: 119750 - DNA, 20 bp, Artificial Sequence
  chemically synthesized
cctcataaagcttatattct

SEQ ID NO: 119751 - DNA, 20 bp, Artificial Sequence
  chemically synthesized
tccaagaatataagctttat

SEQ ID NO: 119752 - DNA, 20 bp, Artificial Sequence
  chemically synthesized
ccaagaatataagctttatg

SEQ ID NO: 119753 - DNA, 20 bp, Artificial Sequence
  chemically synthesized
caagaatataagctttatga

SEQ ID NO: 119754 - DNA, 20 bp, Artificial Sequence
  chemically synthesized
tgaaaagccctaccctcata

SEQ ID NO: 119755 - DNA, 20 bp, Artificial Sequence
  chemically synthesized
gaatataagctttatgaggg

SEQ ID NO: 119756 - DNA, 20 bp, Artificial Sequence
  chemically synthesized
aatataagctttatgagggt

SEQ ID NO: 119757 - DNA, 20 bp, Artificial Sequence
  chemically synthesized
atataagctttatgagggta

SEQ ID NO: 119758 - DNA, 20 bp, Artificial Sequence
  chemically synthesized
acttggtatagagcaatgaa

SEQ ID NO: 119759 - DNA, 20 bp, Artificial Sequence
  chemically synthesized
gcttttcattgctctatacc

SEQ ID NO: 119760 - DNA, 20 bp, Artificial Sequence
  chemically synthesized
agtaattggtacttggtata

SEQ ID NO: 119761 - DNA, 20 bp, Artificial Sequence
  chemically synthesized
ccagtaattggtacttggta

SEQ ID NO: 119762 - DNA, 20 bp, Artificial Sequence
  chemically synthesized
taggcccagtaattggtact

SEQ ID NO: 119763 - DNA, 20 bp, Artificial Sequence
  chemically synthesized
ctataccaagtaccaattac

SEQ ID NO: 119764 - DNA, 20 bp, Artificial Sequence
  chemically synthesized
tataccaagtaccaattact

SEQ ID NO: 119765 - DNA, 20 bp, Artificial Sequence
  chemically synthesized
tgctaggtaggcccagtaat

SEQ ID NO: 119766 - DNA, 20 bp, Artificial Sequence
  chemically synthesized
aagtttgtgctaggtaggcc

SEQ ID NO: 119767 - DNA, 20 bp, Artificial Sequence
  chemically synthesized
taccaattactgggcctacc

SEQ ID NO: 119768 - DNA, 20 bp, Artificial Sequence
  chemically synthesized
gtatgaagtttgtgctaggt

SEQ ID NO: 119769 - DNA, 20 bp, Artificial Sequence
  chemically synthesized
tgtatgaagtttgtgctagg

SEQ ID NO: 119770 - DNA, 20 bp, Artificial Sequence
  chemically synthesized
ttttgtatgaagtttgtgct

SEQ ID NO: 119771 - DNA, 20 bp, Artificial Sequence
  chemically synthesized
cttttgtatgaagtttgtgc

SEQ ID NO: 119772 - DNA, 20 bp, Artificial Sequence
  chemically synthesized
ctagcacaaacttcatacaa

SEQ ID NO: 119773 - DNA, 20 bp, Artificial Sequence
  chemically synthesized
tcaacaaatacttttgtatg

SEQ ID NO: 119774 - DNA, 20 bp, Artificial Sequence
  chemically synthesized
ttcatacaaaagtatttgtt

SEQ ID NO: 119775 - DNA, 20 bp, Artificial Sequence
  chemically synthesized
tacaaaagtatttgttgagt

SEQ ID NO: 119776 - DNA, 20 bp, Artificial Sequence
  chemically synthesized
agtaagtaaattaattttta

SEQ ID NO: 119777 - DNA, 20 bp, Artificial Sequence
  chemically synthesized
attaatttttatggtgtcga

SEQ ID NO: 119778 - DNA, 20 bp, Artificial Sequence
  chemically synthesized
aatttttatggtgtcgatgg

SEQ ID NO: 119779 - DNA, 20 bp, Artificial Sequence
  chemically synthesized
atggcagatgatattttact

SEQ ID NO: 119780 - DNA, 20 bp, Artificial Sequence
  chemically synthesized
cctagtgcgtagtaagaact

SEQ ID NO: 119781 - DNA, 20 bp, Artificial Sequence
  chemically synthesized
cacaatgcctagtgcgtagt

SEQ ID NO: 119782 - DNA, 20 bp, Artificial Sequence
  chemically synthesized
actgagttcttactacgcac

SEQ ID NO: 119783 - DNA, 20 bp, Artificial Sequence
  chemically synthesized
ctgagttcttactacgcact

SEQ ID NO: 119784 - DNA, 20 bp, Artificial Sequence
  chemically synthesized
ttggcacaatgcctagtgcg

SEQ ID NO: 119785 - DNA, 20 bp, Artificial Sequence
  chemically synthesized
gaggtgcttggcacaatgcc

SEQ ID NO: 119786 - DNA, 20 bp, Artificial Sequence
  chemically synthesized
tacgcactaggcattgtgcc

SEQ ID NO: 119787 - DNA, 20 bp, Artificial Sequence
  chemically synthesized
tataataattgtgaggtgct

SEQ ID NO: 119788 - DNA, 20 bp, Artificial Sequence
  chemically synthesized
ctaatcatataataattgtg

SEQ ID NO: 119789 - DNA, 20 bp, Artificial Sequence
  chemically synthesized
tctaatcatataataattgt

SEQ ID NO: 119790 - DNA, 20 bp, Artificial Sequence
  chemically synthesized
cctcacaattattatatgat

SEQ ID NO: 119791 - DNA, 20 bp, Artificial Sequence
  chemically synthesized
tcacaattattatatgatta

SEQ ID NO: 119792 - DNA, 20 bp, Artificial Sequence
  chemically synthesized
tattatatgattagagaaat

SEQ ID NO: 119793 - DNA, 20 bp, Artificial Sequence
  chemically synthesized
attagagaaatgagatattc

SEQ ID NO: 119794 - DNA, 20 bp, Artificial Sequence
  chemically synthesized
tattcaagataatattgttc

SEQ ID NO: 119795 - DNA, 20 bp, Artificial Sequence
  chemically synthesized
attcaagataatattgttct

SEQ ID NO: 119796 - DNA, 20 bp, Artificial Sequence
  chemically synthesized
ataatattgttctgggaacc

SEQ ID NO: 119797 - DNA, 20 bp, Artificial Sequence
  chemically synthesized
taatattgttctgggaacca

SEQ ID NO: 119798 - DNA, 20 bp, Artificial Sequence
  chemically synthesized
actttatcctccttggttcc

SEQ ID NO: 119799 - DNA, 20 bp, Artificial Sequence
  chemically synthesized
atattgttctgggaaccaag

SEQ ID NO: 119800 - DNA, 20 bp, Artificial Sequence
  chemically synthesized
tattgttctgggaaccaagg

SEQ ID NO: 119801 - DNA, 20 bp, Artificial Sequence
  chemically synthesized
aatcaaaactttatcctcct

SEQ ID NO: 119802 - DNA, 20 bp, Artificial Sequence
  chemically synthesized
tctgggaaccaaggaggata

SEQ ID NO: 119803 - DNA, 20 bp, Artificial Sequence
  chemically synthesized
aaggaggataaagttttgat

SEQ ID NO: 119804 - DNA, 20 bp, Artificial Sequence
  chemically synthesized
gaggataaagttttgattag

SEQ ID NO: 119805 - DNA, 20 bp, Artificial Sequence
  chemically synthesized
ggataaagttttgattagca

SEQ ID NO: 119806 - DNA, 20 bp, Artificial Sequence
  chemically synthesized
tgattagcagagttgaccaa

SEQ ID NO: 119807 - DNA, 20 bp, Artificial Sequence
  chemically synthesized
gattagcagagttgaccaac

SEQ ID NO: 119808 - DNA, 20 bp, Artificial Sequence
  chemically synthesized
tattttaacattgatcctgt

SEQ ID NO: 119809 - DNA, 20 bp, Artificial Sequence
  chemically synthesized
acaggatcaatgttaaaata

SEQ ID NO: 119810 - DNA, 20 bp, Artificial Sequence
  chemically synthesized
atcaatgttaaaatatagtc

SEQ ID NO: 119811 - DNA, 20 bp, Artificial Sequence
  chemically synthesized
aatgttaaaatatagtcaag

SEQ ID NO: 119812 - DNA, 20 bp, Artificial Sequence
  chemically synthesized
ttaaaatatagtcaagaaga

SEQ ID NO: 119813 - DNA, 20 bp, Artificial Sequence
  chemically synthesized
acgaattaaaatacactaat

SEQ ID NO: 119814 - DNA, 20 bp, Artificial Sequence
  chemically synthesized
gtgactttgtaatagctaat

SEQ ID NO: 119815 - DNA, 20 bp, Artificial Sequence
  chemically synthesized
tacactaattagctattaca

SEQ ID NO: 119816 - DNA, 20 bp, Artificial Sequence
  chemically synthesized
gatcatcagtgactttgtaa

SEQ ID NO: 119817 - DNA, 20 bp, Artificial Sequence
  chemically synthesized
tacaaagtcactgatgatct

SEQ ID NO: 119818 - DNA, 20 bp, Artificial Sequence
  chemically synthesized
caaggacttactaagatcat

SEQ ID NO: 119819 - DNA, 20 bp, Artificial Sequence
  chemically synthesized
aagtcactgatgatcttagt

SEQ ID NO: 119820 - DNA, 20 bp, Artificial Sequence
  chemically synthesized
tatgaaaacaaggacttact

SEQ ID NO: 119821 - DNA, 20 bp, Artificial Sequence
  chemically synthesized
accaccactttatgaaaaca

SEQ ID NO: 119822 - DNA, 20 bp, Artificial Sequence
  chemically synthesized
caccaccactttatgaaaac

SEQ ID NO: 119823 - DNA, 20 bp, Artificial Sequence
  chemically synthesized
agtaagtccttgttttcata

SEQ ID NO: 119824 - DNA, 20 bp, Artificial Sequence
  chemically synthesized
aagtccttgttttcataaag

SEQ ID NO: 119825 - DNA, 20 bp, Artificial Sequence
  chemically synthesized
tccttgttttcataaagtgg

SEQ ID NO: 119826 - DNA, 20 bp, Artificial Sequence
  chemically synthesized
ttttcataaagtggtggtgc

SEQ ID NO: 119827 - DNA, 20 bp, Artificial Sequence
  chemically synthesized
tttcataaagtggtggtgct

SEQ ID NO: 119828 - DNA, 20 bp, Artificial Sequence
  chemically synthesized
ttcataaagtggtggtgctg

SEQ ID NO: 119829 - DNA, 20 bp, Artificial Sequence
  chemically synthesized
ataaagtggtggtgctgggg

SEQ ID NO: 119830 - DNA, 20 bp, Artificial Sequence
  chemically synthesized
agtggtggtgctggggaagt

SEQ ID NO: 119831 - DNA, 20 bp, Artificial Sequence
  chemically synthesized
ccactccagtctcacttccc

SEQ ID NO: 119832 - DNA, 20 bp, Artificial Sequence
  chemically synthesized
tggtgctggggaagtgagac

SEQ ID NO: 119833 - DNA, 20 bp, Artificial Sequence
  chemically synthesized
gtgctggggaagtgagactg

SEQ ID NO: 119834 - DNA, 20 bp, Artificial Sequence
  chemically synthesized
ctggggaagtgagactggag

SEQ ID NO: 119835 - DNA, 20 bp, Artificial Sequence
  chemically synthesized
tggggaagtgagactggagt

SEQ ID NO: 119836 - DNA, 20 bp, Artificial Sequence
  chemically synthesized
agttgtactttgacccactc

SEQ ID NO: 119837 - DNA, 20 bp, Artificial Sequence
  chemically synthesized
agtgagactggagtgggtca

SEQ ID NO: 119838 - DNA, 20 bp, Artificial Sequence
  chemically synthesized
ggagtgggtcaaagtacaac

SEQ ID NO: 119839 - DNA, 20 bp, Artificial Sequence
  chemically synthesized
gtgggtcaaagtacaactag

SEQ ID NO: 119840 - DNA, 20 bp, Artificial Sequence
  chemically synthesized
caaagtacaactagtagcta

SEQ ID NO: 119841 - DNA, 20 bp, Artificial Sequence
  chemically synthesized
gtttcctgttctttagctac

SEQ ID NO: 119842 - DNA, 20 bp, Artificial Sequence
  chemically synthesized
tacaactagtagctaaagaa

SEQ ID NO: 119843 - DNA, 20 bp, Artificial Sequence
  chemically synthesized
acaactagtagctaaagaac

SEQ ID NO: 119844 - DNA, 20 bp, Artificial Sequence
  chemically synthesized
cattactgtttcctgttctt

SEQ ID NO: 119845 - DNA, 20 bp, Artificial Sequence
  chemically synthesized
agtagctaaagaacaggaaa

SEQ ID NO: 119846 - DNA, 20 bp, Artificial Sequence
  chemically synthesized
tatcatttttaagcagtagt

SEQ ID NO: 119847 - DNA, 20 bp, Artificial Sequence
  chemically synthesized
actatatcatttttaagcag

SEQ ID NO: 119848 - DNA, 20 bp, Artificial Sequence
  chemically synthesized
cttactatatcatttttaag

SEQ ID NO: 119849 - DNA, 20 bp, Artificial Sequence
  chemically synthesized
ctgcttactatatcattttt

SEQ ID NO: 119850 - DNA, 20 bp, Artificial Sequence
  chemically synthesized
actactgcttaaaaatgata

SEQ ID NO: 119851 - DNA, 20 bp, Artificial Sequence
  chemically synthesized
ctgcttaaaaatgatatagt

SEQ ID NO: 119852 - DNA, 20 bp, Artificial Sequence
  chemically synthesized
cttaaaaatgatatagtaag

SEQ ID NO: 119853 - DNA, 20 bp, Artificial Sequence
  chemically synthesized
aaaaatgatatagtaagcag

SEQ ID NO: 119854 - DNA, 20 bp, Artificial Sequence
  chemically synthesized
atgatatagtaagcagaagc

SEQ ID NO: 119855 - DNA, 20 bp, Artificial Sequence
  chemically synthesized
atagtaagcagaagcaagta

SEQ ID NO: 119856 - DNA, 20 bp, Artificial Sequence
  chemically synthesized
taagcagaagcaagtacagc

SEQ ID NO: 119857 - DNA, 20 bp, Artificial Sequence
  chemically synthesized
cagaagcaagtacagctgga

SEQ ID NO: 119858 - DNA, 20 bp, Artificial Sequence
  chemically synthesized
tatatcattttttttctatc

SEQ ID NO: 119859 - DNA, 20 bp, Artificial Sequence
  chemically synthesized
aaaaaaatgatatactaaaa

SEQ ID NO: 119860 - DNA, 20 bp, Artificial Sequence
  chemically synthesized
tcatcctaagagaacttttt

SEQ ID NO: 119861 - DNA, 20 bp, Artificial Sequence
  chemically synthesized
atatactaaaaaagttctct

SEQ ID NO: 119862 - DNA, 20 bp, Artificial Sequence
  chemically synthesized
tatactaaaaaagttctctt

SEQ ID NO: 119863 - DNA, 20 bp, Artificial Sequence
  chemically synthesized
taaaaaagttctcttaggat

SEQ ID NO: 119864 - DNA, 20 bp, Artificial Sequence
  chemically synthesized
tcaagtctccctcatcctaa

SEQ ID NO: 119865 - DNA, 20 bp, Artificial Sequence
  chemically synthesized
aaaaaagttctcttaggatg

SEQ ID NO: 119866 - DNA, 20 bp, Artificial Sequence
  chemically synthesized
aaaaagttctcttaggatga

SEQ ID NO: 119867 - DNA, 20 bp, Artificial Sequence
  chemically synthesized
actcaagtctccctcatcct

SEQ ID NO: 119868 - DNA, 20 bp, Artificial Sequence
  chemically synthesized
aaagttctcttaggatgagg

SEQ ID NO: 119869 - DNA, 20 bp, Artificial Sequence
  chemically synthesized
tcttaggatgagggagactt

SEQ ID NO: 119870 - DNA, 20 bp, Artificial Sequence
  chemically synthesized
tttagcaggccaacatactc

SEQ ID NO: 119871 - DNA, 20 bp, Artificial Sequence
  chemically synthesized
tgagggagacttgagtatgt

SEQ ID NO: 119872 - DNA, 20 bp, Artificial Sequence
  chemically synthesized
ttgagtatgttggcctgcta

SEQ ID NO: 119873 - DNA, 20 bp, Artificial Sequence
  chemically synthesized
tgagtatgttggcctgctaa

SEQ ID NO: 119874 - DNA, 20 bp, Artificial Sequence
  chemically synthesized
gagtatgttggcctgctaaa

SEQ ID NO: 119875 - DNA, 20 bp, Artificial Sequence
  chemically synthesized
agtatgttggcctgctaaag

SEQ ID NO: 119876 - DNA, 20 bp, Artificial Sequence
  chemically synthesized
ttttgctcctcccctttagc

SEQ ID NO: 119877 - DNA, 20 bp, Artificial Sequence
  chemically synthesized
tttttgctcctcccctttag

SEQ ID NO: 119878 - DNA, 20 bp, Artificial Sequence
  chemically synthesized
tatgttggcctgctaaaggg

SEQ ID NO: 119879 - DNA, 20 bp, Artificial Sequence
  chemically synthesized
atgttggcctgctaaagggg

SEQ ID NO: 119880 - DNA, 20 bp, Artificial Sequence
  chemically synthesized
ttctttttgctcctcccctt

SEQ ID NO: 119881 - DNA, 20 bp, Artificial Sequence
  chemically synthesized
gttggcctgctaaaggggag

SEQ ID NO: 119882 - DNA, 20 bp, Artificial Sequence
  chemically synthesized
tgctaaaggggaggagcaaa

SEQ ID NO: 119883 - DNA, 20 bp, Artificial Sequence
  chemically synthesized
aaaggggaggagcaaaaaga

SEQ ID NO: 119884 - DNA, 20 bp, Artificial Sequence
  chemically synthesized
ggggaggagcaaaaagaaag

SEQ ID NO: 119885 - DNA, 20 bp, Artificial Sequence
  chemically synthesized
gaaattgaatatcccaaaaa

SEQ ID NO: 119886 - DNA, 20 bp, Artificial Sequence
  chemically synthesized
aaattgaatatcccaaaaaa

SEQ ID NO: 119887 - DNA, 20 bp, Artificial Sequence
  chemically synthesized
tattctactttccttttttt

SEQ ID NO: 119888 - DNA, 20 bp, Artificial Sequence
  chemically synthesized
ttattctactttcctttttt

SEQ ID NO: 119889 - DNA, 20 bp, Artificial Sequence
  chemically synthesized
tgaatatcccaaaaaaagga

SEQ ID NO: 119890 - DNA, 20 bp, Artificial Sequence
  chemically synthesized
atatcccaaaaaaaggaaag

SEQ ID NO: 119891 - DNA, 20 bp, Artificial Sequence
  chemically synthesized
cattctccaacatgttgttt

SEQ ID NO: 119892 - DNA, 20 bp, Artificial Sequence
  chemically synthesized
taattactaaaacaacatgt

SEQ ID NO: 119893 - DNA, 20 bp, Artificial Sequence
  chemically synthesized
attactaaaacaacatgttg

SEQ ID NO: 119894 - DNA, 20 bp, Artificial Sequence
  chemically synthesized
caacatgttggagaatgtaa

SEQ ID NO: 119895 - DNA, 20 bp, Artificial Sequence
  chemically synthesized
acatgttggagaatgtaaaa

SEQ ID NO: 119896 - DNA, 20 bp, Artificial Sequence
  chemically synthesized
tggagaatgtaaaagagatc

SEQ ID NO: 119897 - DNA, 20 bp, Artificial Sequence
  chemically synthesized
gagctactctagttaaacac

SEQ ID NO: 119898 - DNA, 20 bp, Artificial Sequence
  chemically synthesized
aaagagatctagtgtttaac

SEQ ID NO: 119899 - DNA, 20 bp, Artificial Sequence
  chemically synthesized
agagatctagtgtttaacta

SEQ ID NO: 119900 - DNA, 20 bp, Artificial Sequence
  chemically synthesized
gatctagtgtttaactagag

SEQ ID NO: 119901 - DNA, 20 bp, Artificial Sequence
  chemically synthesized
tgtgtagcaaggagctactc

SEQ ID NO: 119902 - DNA, 20 bp, Artificial Sequence
  chemically synthesized
cctattttgtgtgtagcaag

SEQ ID NO: 119903 - DNA, 20 bp, Artificial Sequence
  chemically synthesized
gccctattttgtgtgtagca

SEQ ID NO: 119904 - DNA, 20 bp, Artificial Sequence
  chemically synthesized
agccctattttgtgtgtagc

SEQ ID NO: 119905 - DNA, 20 bp, Artificial Sequence
  chemically synthesized
attgagccctattttgtgtg

SEQ ID NO: 119906 - DNA, 20 bp, Artificial Sequence
  chemically synthesized
gctccttgctacacacaaaa

SEQ ID NO: 119907 - DNA, 20 bp, Artificial Sequence
  chemically synthesized
ctccttgctacacacaaaat

SEQ ID NO: 119908 - DNA, 20 bp, Artificial Sequence
  chemically synthesized
tccttgctacacacaaaata

SEQ ID NO: 119909 - DNA, 20 bp, Artificial Sequence
  chemically synthesized
caagaaaagagaaaacaatt

SEQ ID NO: 119910 - DNA, 20 bp, Artificial Sequence
  chemically synthesized
tcttcattgcaacaagaaaa

SEQ ID NO: 119911 - DNA, 20 bp, Artificial Sequence
  chemically synthesized
catcttcattgcaacaagaa

SEQ ID NO: 119912 - DNA, 20 bp, Artificial Sequence
  chemically synthesized
tttctcatcttcattgcaac

SEQ ID NO: 119913 - DNA, 20 bp, Artificial Sequence
  chemically synthesized
tctcttttcttgttgcaatg

SEQ ID NO: 119914 - DNA, 20 bp, Artificial Sequence
  chemically synthesized
tttcttgttgcaatgaagat

SEQ ID NO: 119915 - DNA, 20 bp, Artificial Sequence
  chemically synthesized
ttgttgcaatgaagatgaga

SEQ ID NO: 119916 - DNA, 20 bp, Artificial Sequence
  chemically synthesized
tgttgcaatgaagatgagaa

SEQ ID NO: 119917 - DNA, 20 bp, Artificial Sequence
  chemically synthesized
aatgaagatgagaaaggacc

SEQ ID NO: 119918 - DNA, 20 bp, Artificial Sequence
  chemically synthesized
atgaagatgagaaaggacct

SEQ ID NO: 119919 - DNA, 20 bp, Artificial Sequence
  chemically synthesized
gatgagaaaggacctaggaa

SEQ ID NO: 119920 - DNA, 20 bp, Artificial Sequence
  chemically synthesized
tgagaaaggacctaggaata

SEQ ID NO: 119921 - DNA, 20 bp, Artificial Sequence
  chemically synthesized
ctctttgcttctctattcct

SEQ ID NO: 119922 - DNA, 20 bp, Artificial Sequence
  chemically synthesized
actctttgcttctctattcc

SEQ ID NO: 119923 - DNA, 20 bp, Artificial Sequence
  chemically synthesized
gaaaggacctaggaatagag

SEQ ID NO: 119924 - DNA, 20 bp, Artificial Sequence
  chemically synthesized
gacctaggaatagagaagca

SEQ ID NO: 119925 - DNA, 20 bp, Artificial Sequence
  chemically synthesized
cctaggaatagagaagcaaa

SEQ ID NO: 119926 - DNA, 20 bp, Artificial Sequence
  chemically synthesized
agaagcaaagagtgacttac

SEQ ID NO: 119927 - DNA, 20 bp, Artificial Sequence
  chemically synthesized
acaaccttgaaggcacttgt

SEQ ID NO: 119928 - DNA, 20 bp, Artificial Sequence
  chemically synthesized
agtgacttacaagtgccttc

SEQ ID NO: 119929 - DNA, 20 bp, Artificial Sequence
  chemically synthesized
gtgacttacaagtgccttca

SEQ ID NO: 119930 - DNA, 20 bp, Artificial Sequence
  chemically synthesized
tccgtctttgacaaccttga

SEQ ID NO: 119931 - DNA, 20 bp, Artificial Sequence
  chemically synthesized
ctccgtctttgacaaccttg

SEQ ID NO: 119932 - DNA, 20 bp, Artificial Sequence
  chemically synthesized
aagtgccttcaaggttgtca

SEQ ID NO: 119933 - DNA, 20 bp, Artificial Sequence
  chemically synthesized
gccttcaaggttgtcaaaga

SEQ ID NO: 119934 - DNA, 20 bp, Artificial Sequence
  chemically synthesized
cttcaaggttgtcaaagacg

SEQ ID NO: 119935 - DNA, 20 bp, Artificial Sequence
  chemically synthesized
gttgtcaaagacggagaaaa

SEQ ID NO: 119936 - DNA, 20 bp, Artificial Sequence
  chemically synthesized
ttgtcaaagacggagaaaac

SEQ ID NO: 119937 - DNA, 20 bp, Artificial Sequence
  chemically synthesized
aaaacaggtcaaaatgtttt

SEQ ID NO: 119938 - DNA, 20 bp, Artificial Sequence
  chemically synthesized
attttaatgatcaaaattaa

SEQ ID NO: 119939 - DNA, 20 bp, Artificial Sequence
  chemically synthesized
ttgatcattaaaatacaaaa

SEQ ID NO: 119940 - DNA, 20 bp, Artificial Sequence
  chemically synthesized
aaatacaaaacagtattata

SEQ ID NO: 119941 - DNA, 20 bp, Artificial Sequence
  chemically synthesized
caaaacagtattataaagaa

SEQ ID NO: 119942 - DNA, 20 bp, Artificial Sequence
  chemically synthesized
aaacagtattataaagaaca

SEQ ID NO: 119943 - DNA, 20 bp, Artificial Sequence
  chemically synthesized
tataaagaacagagaatact

SEQ ID NO: 119944 - DNA, 20 bp, Artificial Sequence
  chemically synthesized
cattttcttccataacatct

SEQ ID NO: 119945 - DNA, 20 bp, Artificial Sequence
  chemically synthesized
cagagaatactgagatgtta

SEQ ID NO: 119946 - DNA, 20 bp, Artificial Sequence
  chemically synthesized
agaatactgagatgttatgg

SEQ ID NO: 119947 - DNA, 20 bp, Artificial Sequence
  chemically synthesized
tctaggttctaagaaagatt

SEQ ID NO: 119948 - DNA, 20 bp, Artificial Sequence
  chemically synthesized
tgtacatgctgaatctttct

SEQ ID NO: 119949 - DNA, 20 bp, Artificial Sequence
  chemically synthesized
aatccctctaggttctaaga

SEQ ID NO: 119950 - DNA, 20 bp, Artificial Sequence
  chemically synthesized
gctgaatctttcttagaacc

SEQ ID NO: 119951 - DNA, 20 bp, Artificial Sequence
  chemically synthesized
aaaaaatccctctaggttct

SEQ ID NO: 119952 - DNA, 20 bp, Artificial Sequence
  chemically synthesized
tgaatctttcttagaaccta

SEQ ID NO: 119953 - DNA, 20 bp, Artificial Sequence
  chemically synthesized
gaatctttcttagaacctag

SEQ ID NO: 119954 - DNA, 20 bp, Artificial Sequence
  chemically synthesized
aatctttcttagaacctaga

SEQ ID NO: 119955 - DNA, 20 bp, Artificial Sequence
  chemically synthesized
agatactaaaaaatccctct

SEQ ID NO: 119956 - DNA, 20 bp, Artificial Sequence
  chemically synthesized
cagatactaaaaaatccctc

SEQ ID NO: 119957 - DNA, 20 bp, Artificial Sequence
  chemically synthesized
tagaacctagagggattttt

SEQ ID NO: 119958 - DNA, 20 bp, Artificial Sequence
  chemically synthesized
tagagggattttttagtatc

SEQ ID NO: 119959 - DNA, 20 bp, Artificial Sequence
  chemically synthesized
agagggattttttagtatct

SEQ ID NO: 119960 - DNA, 20 bp, Artificial Sequence
  chemically synthesized
agggattttttagtatctgg

SEQ ID NO: 119961 - DNA, 20 bp, Artificial Sequence
  chemically synthesized
ttttttagtatctgggagct

SEQ ID NO: 119962 - DNA, 20 bp, Artificial Sequence
  chemically synthesized
aagttccttagctaagctcc

SEQ ID NO: 119963 - DNA, 20 bp, Artificial Sequence
  chemically synthesized
tagtatctgggagcttagct

SEQ ID NO: 119964 - DNA, 20 bp, Artificial Sequence
  chemically synthesized
agtatctgggagcttagcta

SEQ ID NO: 119965 - DNA, 20 bp, Artificial Sequence
  chemically synthesized
tgcctagaagttccttagct

SEQ ID NO: 119966 - DNA, 20 bp, Artificial Sequence
  chemically synthesized
aaacatgcctagaagttcct

SEQ ID NO: 119967 - DNA, 20 bp, Artificial Sequence
  chemically synthesized
gagcttagctaaggaacttc

SEQ ID NO: 119968 - DNA, 20 bp, Artificial Sequence
  chemically synthesized
agcttagctaaggaacttct

SEQ ID NO: 119969 - DNA, 20 bp, Artificial Sequence
  chemically synthesized
agagggttaaacatgcctag

SEQ ID NO: 119970 - DNA, 20 bp, Artificial Sequence
  chemically synthesized
atcagagggttaaacatgcc

SEQ ID NO: 119971 - DNA, 20 bp, Artificial Sequence
  chemically synthesized
gagatggtccttgcatcaga

SEQ ID NO: 119972 - DNA, 20 bp, Artificial Sequence
  chemically synthesized
catgtttaaccctctgatgc

SEQ ID NO: 119973 - DNA, 20 bp, Artificial Sequence
  chemically synthesized
ggagatggtccttgcatcag

SEQ ID NO: 119974 - DNA, 20 bp, Artificial Sequence
  chemically synthesized
atgtttaaccctctgatgca

SEQ ID NO: 119975 - DNA, 20 bp, Artificial Sequence
  chemically synthesized
aggagatggtccttgcatca

SEQ ID NO: 119976 - DNA, 20 bp, Artificial Sequence
  chemically synthesized
agaggagatggtccttgcat

SEQ ID NO: 119977 - DNA, 20 bp, Artificial Sequence
  chemically synthesized
aactcatcaagcagaggaga

SEQ ID NO: 119978 - DNA, 20 bp, Artificial Sequence
  chemically synthesized
tacaaactcatcaagcagag

SEQ ID NO: 119979 - DNA, 20 bp, Artificial Sequence
  chemically synthesized
ggtacaaactcatcaagcag

SEQ ID NO: 119980 - DNA, 20 bp, Artificial Sequence
  chemically synthesized
aggtacaaactcatcaagca

SEQ ID NO: 119981 - DNA, 20 bp, Artificial Sequence
  chemically synthesized
gaccatctcctctgcttgat

SEQ ID NO: 119982 - DNA, 20 bp, Artificial Sequence
  chemically synthesized
ccaggtacaaactcatcaag

SEQ ID NO: 119983 - DNA, 20 bp, Artificial Sequence
  chemically synthesized
tagccaggtacaaactcatc

SEQ ID NO: 119984 - DNA, 20 bp, Artificial Sequence
  chemically synthesized
ctgcttgatgagtttgtacc

SEQ ID NO: 119985 - DNA, 20 bp, Artificial Sequence
  chemically synthesized
ttgatgagtttgtacctggc

SEQ ID NO: 119986 - DNA, 20 bp, Artificial Sequence
  chemically synthesized
tgagtttgtacctggctagt

SEQ ID NO: 119987 - DNA, 20 bp, Artificial Sequence
  chemically synthesized
tccacaactgccaactagcc

SEQ ID NO: 119988 - DNA, 20 bp, Artificial Sequence
  chemically synthesized
ttccacaactgccaactagc

SEQ ID NO: 119989 - DNA, 20 bp, Artificial Sequence
  chemically synthesized
gtttgtacctggctagttgg

SEQ ID NO: 119990 - DNA, 20 bp, Artificial Sequence
  chemically synthesized
gggcttccacaactgccaac

SEQ ID NO: 119991 - DNA, 20 bp, Artificial Sequence
  chemically synthesized
acctggctagttggcagttg

SEQ ID NO: 119992 - DNA, 20 bp, Artificial Sequence
  chemically synthesized
tggctagttggcagttgtgg

SEQ ID NO: 119993 - DNA, 20 bp, Artificial Sequence
  chemically synthesized
cagttgtggaagccctcata

SEQ ID NO: 119994 - DNA, 20 bp, Artificial Sequence
  chemically synthesized
gtctgcttgtagctgtatga

SEQ ID NO: 119995 - DNA, 20 bp, Artificial Sequence
  chemically synthesized
tgtctgcttgtagctgtatg

SEQ ID NO: 119996 - DNA, 20 bp, Artificial Sequence
  chemically synthesized
ttgtctgcttgtagctgtat

SEQ ID NO: 119997 - DNA, 20 bp, Artificial Sequence
  chemically synthesized
ggaagccctcatacagctac

SEQ ID NO: 119998 - DNA, 20 bp, Artificial Sequence
  chemically synthesized
agccctcatacagctacaag

SEQ ID NO: 119999 - DNA, 20 bp, Artificial Sequence
  chemically synthesized
aactctgaattgtctgcttg

SEQ ID NO: 120000 - DNA, 20 bp, Artificial Sequence
  chemically synthesized
acagctacaagcagacaatt

SEQ ID NO: 120001 - DNA, 20 bp, Artificial Sequence
  chemically synthesized
agctacaagcagacaattca

SEQ ID NO: 120002 - DNA, 20 bp, Artificial Sequence
  chemically synthesized
tcactctttaaacaagaaat

SEQ ID NO: 120003 - DNA, 20 bp, Artificial Sequence
  chemically synthesized
taatgcttatttcttgttta

SEQ ID NO: 120004 - DNA, 20 bp, Artificial Sequence
  chemically synthesized
atgcttatttcttgtttaaa

SEQ ID NO: 120005 - DNA, 20 bp, Artificial Sequence
  chemically synthesized
tccaggatcactctttaaac

SEQ ID NO: 120006 - DNA, 20 bp, Artificial Sequence
  chemically synthesized
tcttgtttaaagagtgatcc

SEQ ID NO: 120007 - DNA, 20 bp, Artificial Sequence
  chemically synthesized
tttaaagagtgatcctggaa

SEQ ID NO: 120008 - DNA, 20 bp, Artificial Sequence
  chemically synthesized
catttccttatttctgttcc

SEQ ID NO: 120009 - DNA, 20 bp, Artificial Sequence
  chemically synthesized
tcatttccttatttctgttc

SEQ ID NO: 120010 - DNA, 20 bp, Artificial Sequence
  chemically synthesized
agtgatcctggaacagaaat

SEQ ID NO: 120011 - DNA, 20 bp, Artificial Sequence
  chemically synthesized
gtgatcctggaacagaaata

SEQ ID NO: 120012 - DNA, 20 bp, Artificial Sequence
  chemically synthesized
aaggaaatgaaatctcatga

SEQ ID NO: 120013 - DNA, 20 bp, Artificial Sequence
  chemically synthesized
ctttatgatgacactgtcat

SEQ ID NO: 120014 - DNA, 20 bp, Artificial Sequence
  chemically synthesized
ctcatgacagtgtcatcata

SEQ ID NO: 120015 - DNA, 20 bp, Artificial Sequence
  chemically synthesized
cagtgtcatcataaagtcat

SEQ ID NO: 120016 - DNA, 20 bp, Artificial Sequence
  chemically synthesized
gtcatcataaagtcatcagc

SEQ ID NO: 120017 - DNA, 20 bp, Artificial Sequence
  chemically synthesized
tcataaagtcatcagccaga

SEQ ID NO: 120018 - DNA, 20 bp, Artificial Sequence
  chemically synthesized
taaagtcatcagccagatgg

SEQ ID NO: 120019 - DNA, 20 bp, Artificial Sequence
  chemically synthesized
agatttcaaggactgccatc

SEQ ID NO: 120020 - DNA, 20 bp, Artificial Sequence
  chemically synthesized
cctctaaggattagatttca

SEQ ID NO: 120021 - DNA, 20 bp, Artificial Sequence
  chemically synthesized
gcctctaaggattagatttc

SEQ ID NO: 120022 - DNA, 20 bp, Artificial Sequence
  chemically synthesized
agtccttgaaatctaatcct

SEQ ID NO: 120023 - DNA, 20 bp, Artificial Sequence
  chemically synthesized
tccttgaaatctaatcctta

SEQ ID NO: 120024 - DNA, 20 bp, Artificial Sequence
  chemically synthesized
tgtgagaagcctctaaggat

SEQ ID NO: 120025 - DNA, 20 bp, Artificial Sequence
  chemically synthesized
ccttgaaatctaatccttag

SEQ ID NO: 120026 - DNA, 20 bp, Artificial Sequence
  chemically synthesized
attattgtgagaagcctcta

SEQ ID NO: 120027 - DNA, 20 bp, Artificial Sequence
  chemically synthesized
aattattgtgagaagcctct

SEQ ID NO: 120028 - DNA, 20 bp, Artificial Sequence
  chemically synthesized
atattacaaattattgtgag

SEQ ID NO: 120029 - DNA, 20 bp, Artificial Sequence
  chemically synthesized
gtgatattacaaattattgt

SEQ ID NO: 120030 - DNA, 20 bp, Artificial Sequence
  chemically synthesized
gtttgtgaataagataatat

SEQ ID NO: 120031 - DNA, 20 bp, Artificial Sequence
  chemically synthesized
atagatatgagtttgtgaat

SEQ ID NO: 120032 - DNA, 20 bp, Artificial Sequence
  chemically synthesized
caatctctgtgaatagatat

SEQ ID NO: 120033 - DNA, 20 bp, Artificial Sequence
  chemically synthesized
cacaaactcatatctattca

SEQ ID NO: 120034 - DNA, 20 bp, Artificial Sequence
  chemically synthesized
caaactcatatctattcaca

SEQ ID NO: 120035 - DNA, 20 bp, Artificial Sequence
  chemically synthesized
ttgtcttcaatctctgtgaa

SEQ ID NO: 120036 - DNA, 20 bp, Artificial Sequence
  chemically synthesized
atatctattcacagagattg

SEQ ID NO: 120037 - DNA, 20 bp, Artificial Sequence
  chemically synthesized
attcacagagattgaagaca

SEQ ID NO: 120038 - DNA, 20 bp, Artificial Sequence
  chemically synthesized
aagacaaagaaatgaacttg

SEQ ID NO: 120039 - DNA, 20 bp, Artificial Sequence
  chemically synthesized
gacaaagaaatgaacttgca

SEQ ID NO: 120040 - DNA, 20 bp, Artificial Sequence
  chemically synthesized
acaaagaaatgaacttgcag

SEQ ID NO: 120041 - DNA, 20 bp, Artificial Sequence
  chemically synthesized
ccagaaatgtgagcctctgc

SEQ ID NO: 120042 - DNA, 20 bp, Artificial Sequence
  chemically synthesized
cttgcagaggctcacatttc

SEQ ID NO: 120043 - DNA, 20 bp, Artificial Sequence
  chemically synthesized
acatataaagccagaaatgt

SEQ ID NO: 120044 - DNA, 20 bp, Artificial Sequence
  chemically synthesized
tccatgataacatataaagc

SEQ ID NO: 120045 - DNA, 20 bp, Artificial Sequence
  chemically synthesized
agagtccatgataacatata

SEQ ID NO: 120046 - DNA, 20 bp, Artificial Sequence
  chemically synthesized
tctggctttatatgttatca

SEQ ID NO: 120047 - DNA, 20 bp, Artificial Sequence
  chemically synthesized
tatgttatcatggactctgt

SEQ ID NO: 120048 - DNA, 20 bp, Artificial Sequence
  chemically synthesized
atgttatcatggactctgta

SEQ ID NO: 120049 - DNA, 20 bp, Artificial Sequence
  chemically synthesized
tccttatcgtagtccttaca

SEQ ID NO: 120050 - DNA, 20 bp, Artificial Sequence
  chemically synthesized
tttccttatcgtagtcctta

SEQ ID NO: 120051 - DNA, 20 bp, Artificial Sequence
  chemically synthesized
gactctgtaaggactacgat

SEQ ID NO: 120052 - DNA, 20 bp, Artificial Sequence
  chemically synthesized
actctgtaaggactacgata

SEQ ID NO: 120053 - DNA, 20 bp, Artificial Sequence
  chemically synthesized
atatgttgttttccttatcg

SEQ ID NO: 120054 - DNA, 20 bp, Artificial Sequence
  chemically synthesized
aaacaacatattttcctaca

SEQ ID NO: 120055 - DNA, 20 bp, Artificial Sequence
  chemically synthesized
aacaacatattttcctacat

SEQ ID NO: 120056 - DNA, 20 bp, Artificial Sequence
  chemically synthesized
attattgttgtgacctatgt

SEQ ID NO: 120057 - DNA, 20 bp, Artificial Sequence
  chemically synthesized
gattattgttgtgacctatg

SEQ ID NO: 120058 - DNA, 20 bp, Artificial Sequence
  chemically synthesized
tcacaacaataatctatgtt

SEQ ID NO: 120059 - DNA, 20 bp, Artificial Sequence
  chemically synthesized
tagaaacccagatctgaaca

SEQ ID NO: 120060 - DNA, 20 bp, Artificial Sequence
  chemically synthesized
caataatctatgttcagatc

SEQ ID NO: 120061 - DNA, 20 bp, Artificial Sequence
  chemically synthesized
aataatctatgttcagatct

SEQ ID NO: 120062 - DNA, 20 bp, Artificial Sequence
  chemically synthesized
aattgtacagtttagaaacc

SEQ ID NO: 120063 - DNA, 20 bp, Artificial Sequence
  chemically synthesized
ctcaactaaattgtacagtt

SEQ ID NO: 120064 - DNA, 20 bp, Artificial Sequence
  chemically synthesized
ggtttctaaactgtacaatt

SEQ ID NO: 120065 - DNA, 20 bp, Artificial Sequence
  chemically synthesized
tgcttctcaactaaattgta

SEQ ID NO: 120066 - DNA, 20 bp, Artificial Sequence
  chemically synthesized
ctaaactgtacaatttagtt

SEQ ID NO: 120067 - DNA, 20 bp, Artificial Sequence
  chemically synthesized
aactgtacaatttagttgag

SEQ ID NO: 120068 - DNA, 20 bp, Artificial Sequence
  chemically synthesized
tgtacaatttagttgagaag

SEQ ID NO: 120069 - DNA, 20 bp, Artificial Sequence
  chemically synthesized
ctatctatggaaaaaagaga

SEQ ID NO: 120070 - DNA, 20 bp, Artificial Sequence
  chemically synthesized
tctatctatggaaaaaagag

SEQ ID NO: 120071 - DNA, 20 bp, Artificial Sequence
  chemically synthesized
taatctatctatggaaaaaa

SEQ ID NO: 120072 - DNA, 20 bp, Artificial Sequence
  chemically synthesized
gcagccttctcttttttcca

SEQ ID NO: 120073 - DNA, 20 bp, Artificial Sequence
  chemically synthesized
actaatctatctatggaaaa

SEQ ID NO: 120074 - DNA, 20 bp, Artificial Sequence
  chemically synthesized
ccttctcttttttccataga

SEQ ID NO: 120075 - DNA, 20 bp, Artificial Sequence
  chemically synthesized
aaaaggaactaatctatcta

SEQ ID NO: 120076 - DNA, 20 bp, Artificial Sequence
  chemically synthesized
tcttttttccatagatagat

SEQ ID NO: 120077 - DNA, 20 bp, Artificial Sequence
  chemically synthesized
tagatagattagttcctttt

SEQ ID NO: 120078 - DNA, 20 bp, Artificial Sequence
  chemically synthesized
aataggcatttatgcttaaa

SEQ ID NO: 120079 - DNA, 20 bp, Artificial Sequence
  chemically synthesized
aaataggcatttatgcttaa

SEQ ID NO: 120080 - DNA, 20 bp, Artificial Sequence
  chemically synthesized
tatatagaataaatataaat

SEQ ID NO: 120081 - DNA, 20 bp, Artificial Sequence
  chemically synthesized
ttatatagaataaatataaa

SEQ ID NO: 120082 - DNA, 20 bp, Artificial Sequence
  chemically synthesized
tatatttattctatataaaa

SEQ ID NO: 120083 - DNA, 20 bp, Artificial Sequence
  chemically synthesized
tttttacttgccattttata

SEQ ID NO: 120084 - DNA, 20 bp, Artificial Sequence
  chemically synthesized
tttattctatataaaatggc

SEQ ID NO: 120085 - DNA, 20 bp, Artificial Sequence
  chemically synthesized
agtaaaaatgatcatatcaa

SEQ ID NO: 120086 - DNA, 20 bp, Artificial Sequence
  chemically synthesized
gatcatatcaaaagccactg

SEQ ID NO: 120087 - DNA, 20 bp, Artificial Sequence
  chemically synthesized
tgagtcttcaaattctacag

SEQ ID NO: 120088 - DNA, 20 bp, Artificial Sequence
  chemically synthesized
agatgagtcttcaaattcta

SEQ ID NO: 120089 - DNA, 20 bp, Artificial Sequence
  chemically synthesized
aaaagccactgtagaatttg

SEQ ID NO: 120090 - DNA, 20 bp, Artificial Sequence
  chemically synthesized
agtttattaatacatcagat

SEQ ID NO: 120091 - DNA, 20 bp, Artificial Sequence
  chemically synthesized
gtttaagtttattaatacat

SEQ ID NO: 120092 - DNA, 20 bp, Artificial Sequence
  chemically synthesized
gatgtattaataaacttaaa

SEQ ID NO: 120093 - DNA, 20 bp, Artificial Sequence
  chemically synthesized
atgtttatattttgctgttt

SEQ ID NO: 120094 - DNA, 20 bp, Artificial Sequence
  chemically synthesized
aaacagcaaaatataaacat

SEQ ID NO: 120095 - DNA, 20 bp, Artificial Sequence
  chemically synthesized
agtttcaagacataataaaa

SEQ ID NO: 120096 - DNA, 20 bp, Artificial Sequence
  chemically synthesized
cactgccatgttgcagtttc

SEQ ID NO: 120097 - DNA, 20 bp, Artificial Sequence
  chemically synthesized
tatgtcttgaaactgcaaca

SEQ ID NO: 120098 - DNA, 20 bp, Artificial Sequence
  chemically synthesized
tatcagacactgccatgttg

SEQ ID NO: 120099 - DNA, 20 bp, Artificial Sequence
  chemically synthesized
gtcttgaaactgcaacatgg

SEQ ID NO: 120100 - DNA, 20 bp, Artificial Sequence
  chemically synthesized
catggcagtgtctgatatca

SEQ ID NO: 120101 - DNA, 20 bp, Artificial Sequence
  chemically synthesized
aaagaaatttgctttgatat

SEQ ID NO: 120102 - DNA, 20 bp, Artificial Sequence
  chemically synthesized
tatcaaagcaaatttctttc

SEQ ID NO: 120103 - DNA, 20 bp, Artificial Sequence
  chemically synthesized
aagatataaaatgtacttga

SEQ ID NO: 120104 - DNA, 20 bp, Artificial Sequence
  chemically synthesized
taaactgttgaatgttaaat

SEQ ID NO: 120105 - DNA, 20 bp, Artificial Sequence
  chemically synthesized
atatcttatttaacattcaa

SEQ ID NO: 120106 - DNA, 20 bp, Artificial Sequence
  chemically synthesized
cattcaacagtttaaaacta

SEQ ID NO: 120107 - DNA, 20 bp, Artificial Sequence
  chemically synthesized
taaattagtaataaaatctt

SEQ ID NO: 120108 - DNA, 20 bp, Artificial Sequence
  chemically synthesized
acttggaagaatatttaaat

SEQ ID NO: 120109 - DNA, 20 bp, Artificial Sequence
  chemically synthesized
actaatttaaatattcttcc

SEQ ID NO: 120110 - DNA, 20 bp, Artificial Sequence
  chemically synthesized
caaaatttttgtacacttgg

SEQ ID NO: 120111 - DNA, 20 bp, Artificial Sequence
  chemically synthesized
aggcaaaatttttgtacact

SEQ ID NO: 120112 - DNA, 20 bp, Artificial Sequence
  chemically synthesized
aagtgtacaaaaattttgcc

SEQ ID NO: 120113 - DNA, 20 bp, Artificial Sequence
  chemically synthesized
agtgtacaaaaattttgcct

SEQ ID NO: 120114 - DNA, 20 bp, Artificial Sequence
  chemically synthesized
tcagtcacatggagaaacct

SEQ ID NO: 120115 - DNA, 20 bp, Artificial Sequence
  chemically synthesized
ttcagtcacatggagaaacc

SEQ ID NO: 120116 - DNA, 20 bp, Artificial Sequence
  chemically synthesized
ctgagactttcagtcacatg

SEQ ID NO: 120117 - DNA, 20 bp, Artificial Sequence
  chemically synthesized
cactgagactttcagtcaca

SEQ ID NO: 120118 - DNA, 20 bp, Artificial Sequence
  chemically synthesized
aggtttctccatgtgactga

SEQ ID NO: 120119 - DNA, 20 bp, Artificial Sequence
  chemically synthesized
ctccatgtgactgaaagtct

SEQ ID NO: 120120 - DNA, 20 bp, Artificial Sequence
  chemically synthesized
attgcctgcactgagacttt

SEQ ID NO: 120121 - DNA, 20 bp, Artificial Sequence
  chemically synthesized
tgtgactgaaagtctcagtg

SEQ ID NO: 120122 - DNA, 20 bp, Artificial Sequence
  chemically synthesized
gtgactgaaagtctcagtgc

SEQ ID NO: 120123 - DNA, 20 bp, Artificial Sequence
  chemically synthesized
actaatgcattgcctgcact

SEQ ID NO: 120124 - DNA, 20 bp, Artificial Sequence
  chemically synthesized
tctcagtgcaggcaatgcat

SEQ ID NO: 120125 - DNA, 20 bp, Artificial Sequence
  chemically synthesized
ggcaatgcattagtgtttca

SEQ ID NO: 120126 - DNA, 20 bp, Artificial Sequence
  chemically synthesized
attagtgtttcatagtaaaa

SEQ ID NO: 120127 - DNA, 20 bp, Artificial Sequence
  chemically synthesized
tcatttctcacagttcaggt

SEQ ID NO: 120128 - DNA, 20 bp, Artificial Sequence
  chemically synthesized
tggtgtctaacctgaactgt

SEQ ID NO: 120129 - DNA, 20 bp, Artificial Sequence
  chemically synthesized
tacatcatttctcacagttc

SEQ ID NO: 120130 - DNA, 20 bp, Artificial Sequence
  chemically synthesized
ttacatcatttctcacagtt

SEQ ID NO: 120131 - DNA, 20 bp, Artificial Sequence
  chemically synthesized
tctgattacatcatttctca

SEQ ID NO: 120132 - DNA, 20 bp, Artificial Sequence
  chemically synthesized
actgtgagaaatgatgtaat

SEQ ID NO: 120133 - DNA, 20 bp, Artificial Sequence
  chemically synthesized
tgtaatcagaaaactttcca

SEQ ID NO: 120134 - DNA, 20 bp, Artificial Sequence
  chemically synthesized
ggtaggagggattctgtgga

SEQ ID NO: 120135 - DNA, 20 bp, Artificial Sequence
  chemically synthesized
tttaggtaggagggattctg

SEQ ID NO: 120136 - DNA, 20 bp, Artificial Sequence
  chemically synthesized
ctatagctttttaggtagga

SEQ ID NO: 120137 - DNA, 20 bp, Artificial Sequence
  chemically synthesized
actatagctttttaggtagg

SEQ ID NO: 120138 - DNA, 20 bp, Artificial Sequence
  chemically synthesized
aactatagctttttaggtag

SEQ ID NO: 120139 - DNA, 20 bp, Artificial Sequence
  chemically synthesized
cagaatccctcctacctaaa

SEQ ID NO: 120140 - DNA, 20 bp, Artificial Sequence
  chemically synthesized
gtaactatagctttttaggt

SEQ ID NO: 120141 - DNA, 20 bp, Artificial Sequence
  chemically synthesized
tgtaactatagctttttagg

SEQ ID NO: 120142 - DNA, 20 bp, Artificial Sequence
  chemically synthesized
ttctgtaactatagcttttt

SEQ ID NO: 120143 - DNA, 20 bp, Artificial Sequence
  chemically synthesized
gttctgtaactatagctttt

SEQ ID NO: 120144 - DNA, 20 bp, Artificial Sequence
  chemically synthesized
ccctcctacctaaaaagcta

SEQ ID NO: 120145 - DNA, 20 bp, Artificial Sequence
  chemically synthesized
tacctaaaaagctatagtta

SEQ ID NO: 120146 - DNA, 20 bp, Artificial Sequence
  chemically synthesized
ttgaaaaagttctgtaacta

SEQ ID NO: 120147 - DNA, 20 bp, Artificial Sequence
  chemically synthesized
atagttacagaactttttca

SEQ ID NO: 120148 - DNA, 20 bp, Artificial Sequence
  chemically synthesized
agtatctcatatctttgaaa

SEQ ID NO: 120149 - DNA, 20 bp, Artificial Sequence
  chemically synthesized
cagaactttttcaaagatat

SEQ ID NO: 120150 - DNA, 20 bp, Artificial Sequence
  chemically synthesized
atatttgggttatggagaaa

SEQ ID NO: 120151 - DNA, 20 bp, Artificial Sequence
  chemically synthesized
atgtcaatatttgggttatg

SEQ ID NO: 120152 - DNA, 20 bp, Artificial Sequence
  chemically synthesized
taatgtcaatatttgggtta

SEQ ID NO: 120153 - DNA, 20 bp, Artificial Sequence
  chemically synthesized
gattaataatgtcaatattt

SEQ ID NO: 120154 - DNA, 20 bp, Artificial Sequence
  chemically synthesized
agattaataatgtcaatatt

SEQ ID NO: 120155 - DNA, 20 bp, Artificial Sequence
  chemically synthesized
taaactcatcttaaaaagga

SEQ ID NO: 120156 - DNA, 20 bp, Artificial Sequence
  chemically synthesized
attattaatctttccttttt

SEQ ID NO: 120157 - DNA, 20 bp, Artificial Sequence
  chemically synthesized
atattaaactcatcttaaaa

SEQ ID NO: 120158 - DNA, 20 bp, Artificial Sequence
  chemically synthesized
tatattaaactcatcttaaa

SEQ ID NO: 120159 - DNA, 20 bp, Artificial Sequence
  chemically synthesized
taatctttcctttttaagat

SEQ ID NO: 120160 - DNA, 20 bp, Artificial Sequence
  chemically synthesized
tgagtttaatataacaacaa

SEQ ID NO: 120161 - DNA, 20 bp, Artificial Sequence
  chemically synthesized
aaactacaactatgacagga

SEQ ID NO: 120162 - DNA, 20 bp, Artificial Sequence
  chemically synthesized
gtgaaaatgccatcctgtca

SEQ ID NO: 120163 - DNA, 20 bp, Artificial Sequence
  chemically synthesized
tcaaaaactacaactatgac

SEQ ID NO: 120164 - DNA, 20 bp, Artificial Sequence
  chemically synthesized
ctcaaaaactacaactatga

SEQ ID NO: 120165 - DNA, 20 bp, Artificial Sequence
  chemically synthesized
atgccatcctgtcatagttg

SEQ ID NO: 120166 - DNA, 20 bp, Artificial Sequence
  chemically synthesized
ctgtcatagttgtagttttt

SEQ ID NO: 120167 - DNA, 20 bp, Artificial Sequence
  chemically synthesized
gtattccatggtatttgtgt

SEQ ID NO: 120168 - DNA, 20 bp, Artificial Sequence
  chemically synthesized
tgagaccaacacaaatacca

SEQ ID NO: 120169 - DNA, 20 bp, Artificial Sequence
  chemically synthesized
tatggctacgtagtattcca

SEQ ID NO: 120170 - DNA, 20 bp, Artificial Sequence
  chemically synthesized
aaataccatggaatactacg

SEQ ID NO: 120171 - DNA, 20 bp, Artificial Sequence
  chemically synthesized
attctttttttatggctacg

SEQ ID NO: 120172 - DNA, 20 bp, Artificial Sequence
  chemically synthesized
atactacgtagccataaaaa

SEQ ID NO: 120173 - DNA, 20 bp, Artificial Sequence
  chemically synthesized
atgatctcattcttttttta

SEQ ID NO: 120174 - DNA, 20 bp, Artificial Sequence
  chemically synthesized
cgtagccataaaaaaagaat

SEQ ID NO: 120175 - DNA, 20 bp, Artificial Sequence
  chemically synthesized
gaatgagatcatgtcctttg

SEQ ID NO: 120176 - DNA, 20 bp, Artificial Sequence
  chemically synthesized
aatgagatcatgtcctttgc

SEQ ID NO: 120177 - DNA, 20 bp, Artificial Sequence
  chemically synthesized
atgagatcatgtcctttgca

SEQ ID NO: 120178 - DNA, 20 bp, Artificial Sequence
  chemically synthesized
atccatctatgtccctgcaa

SEQ ID NO: 120179 - DNA, 20 bp, Artificial Sequence
  chemically synthesized
gatccatctatgtccctgca

SEQ ID NO: 120180 - DNA, 20 bp, Artificial Sequence
  chemically synthesized
tcatgtcctttgcagggaca

SEQ ID NO: 120181 - DNA, 20 bp, Artificial Sequence
  chemically synthesized
gtcctttgcagggacataga

SEQ ID NO: 120182 - DNA, 20 bp, Artificial Sequence
  chemically synthesized
tgcagggacatagatggatc

SEQ ID NO: 120183 - DNA, 20 bp, Artificial Sequence
  chemically synthesized
cagggacatagatggatctg

SEQ ID NO: 120184 - DNA, 20 bp, Artificial Sequence
  chemically synthesized
agggacatagatggatctgg

SEQ ID NO: 120185 - DNA, 20 bp, Artificial Sequence
  chemically synthesized
ttgataaggacaatggcctc

SEQ ID NO: 120186 - DNA, 20 bp, Artificial Sequence
  chemically synthesized
tattagtttgataaggacaa

SEQ ID NO: 120187 - DNA, 20 bp, Artificial Sequence
  chemically synthesized
gttcctgtattagtttgata

SEQ ID NO: 120188 - DNA, 20 bp, Artificial Sequence
  chemically synthesized
tgttcctgtattagtttgat

SEQ ID NO: 120189 - DNA, 20 bp, Artificial Sequence
  chemically synthesized
ttgtccttatcaaactaata

SEQ ID NO: 120190 - DNA, 20 bp, Artificial Sequence
  chemically synthesized
tgtccttatcaaactaatac

SEQ ID NO: 120191 - DNA, 20 bp, Artificial Sequence
  chemically synthesized
ttggttttttgttcctgtat

SEQ ID NO: 120192 - DNA, 20 bp, Artificial Sequence
  chemically synthesized
aaatgagaacatggggtatt

SEQ ID NO: 120193 - DNA, 20 bp, Artificial Sequence
  chemically synthesized
cacttataaatgagaacatg

SEQ ID NO: 120194 - DNA, 20 bp, Artificial Sequence
  chemically synthesized
ccacttataaatgagaacat

SEQ ID NO: 120195 - DNA, 20 bp, Artificial Sequence
  chemically synthesized
cccacttataaatgagaaca

SEQ ID NO: 120196 - DNA, 20 bp, Artificial Sequence
  chemically synthesized
taccccatgttctcatttat

SEQ ID NO: 120197 - DNA, 20 bp, Artificial Sequence
  chemically synthesized
tttagctcccacttataaat

SEQ ID NO: 120198 - DNA, 20 bp, Artificial Sequence
  chemically synthesized
cccatgttctcatttataag

SEQ ID NO: 120199 - DNA, 20 bp, Artificial Sequence
  chemically synthesized
ccatgttctcatttataagt

SEQ ID NO: 120200 - DNA, 20 bp, Artificial Sequence
  chemically synthesized
atgttctcatttataagtgg

SEQ ID NO: 120201 - DNA, 20 bp, Artificial Sequence
  chemically synthesized
ataagtgggagctaaatgat

SEQ ID NO: 120202 - DNA, 20 bp, Artificial Sequence
  chemically synthesized
gtccatgtgttctcatcatt

SEQ ID NO: 120203 - DNA, 20 bp, Artificial Sequence
  chemically synthesized
agctaaatgatgagaacaca

SEQ ID NO: 120204 - DNA, 20 bp, Artificial Sequence
  chemically synthesized
gatgagaacacatggacacg

SEQ ID NO: 120205 - DNA, 20 bp, Artificial Sequence
  chemically synthesized
tgagaacacatggacacgta

SEQ ID NO: 120206 - DNA, 20 bp, Artificial Sequence
  chemically synthesized
gagaacacatggacacgtag

SEQ ID NO: 120207 - DNA, 20 bp, Artificial Sequence
  chemically synthesized
agaacacatggacacgtaga

SEQ ID NO: 120208 - DNA, 20 bp, Artificial Sequence
  chemically synthesized
gaacacatggacacgtagag

SEQ ID NO: 120209 - DNA, 20 bp, Artificial Sequence
  chemically synthesized
tagaggggaacaacacatgc

SEQ ID NO: 120210 - DNA, 20 bp, Artificial Sequence
  chemically synthesized
agaggggaacaacacatgct

SEQ ID NO: 120211 - DNA, 20 bp, Artificial Sequence
  chemically synthesized
gaggggaacaacacatgcta

SEQ ID NO: 120212 - DNA, 20 bp, Artificial Sequence
  chemically synthesized
ctccacactctaatagtccc

SEQ ID NO: 120213 - DNA, 20 bp, Artificial Sequence
  chemically synthesized
caacacatgctagggactat

SEQ ID NO: 120214 - DNA, 20 bp, Artificial Sequence
  chemically synthesized
acacatgctagggactatta

SEQ ID NO: 120215 - DNA, 20 bp, Artificial Sequence
  chemically synthesized
tcccaccctccacactctaa

SEQ ID NO: 120216 - DNA, 20 bp, Artificial Sequence
  chemically synthesized
tgctagggactattagagtg

SEQ ID NO: 120217 - DNA, 20 bp, Artificial Sequence
  chemically synthesized
ctagggactattagagtgtg

SEQ ID NO: 120218 - DNA, 20 bp, Artificial Sequence
  chemically synthesized
tagggactattagagtgtgg

SEQ ID NO: 120219 - DNA, 20 bp, Artificial Sequence
  chemically synthesized
agggactattagagtgtgga

SEQ ID NO: 120220 - DNA, 20 bp, Artificial Sequence
  chemically synthesized
gactattagagtgtggaggg

SEQ ID NO: 120221 - DNA, 20 bp, Artificial Sequence
  chemically synthesized
actattagagtgtggagggt

SEQ ID NO: 120222 - DNA, 20 bp, Artificial Sequence
  chemically synthesized
tattagagtgtggagggtgg

SEQ ID NO: 120223 - DNA, 20 bp, Artificial Sequence
  chemically synthesized
attagagtgtggagggtggg

SEQ ID NO: 120224 - DNA, 20 bp, Artificial Sequence
  chemically synthesized
tagagtgtggagggtgggag

SEQ ID NO: 120225 - DNA, 20 bp, Artificial Sequence
  chemically synthesized
gtgtggagggtgggaggagc

SEQ ID NO: 120226 - DNA, 20 bp, Artificial Sequence
  chemically synthesized
gtggagggtgggaggagcga

SEQ ID NO: 120227 - DNA, 20 bp, Artificial Sequence
  chemically synthesized
tggagggtgggaggagcgag

SEQ ID NO: 120228 - DNA, 20 bp, Artificial Sequence
  chemically synthesized
ggtgggaggagcgagaggat

SEQ ID NO: 120229 - DNA, 20 bp, Artificial Sequence
  chemically synthesized
gtgggaggagcgagaggatc

SEQ ID NO: 120230 - DNA, 20 bp, Artificial Sequence
  chemically synthesized
gaggagcgagaggatcagga

SEQ ID NO: 120231 - DNA, 20 bp, Artificial Sequence
  chemically synthesized
ggatcaggaaagtcaactaa

SEQ ID NO: 120232 - DNA, 20 bp, Artificial Sequence
  chemically synthesized
gatcaggaaagtcaactaac

SEQ ID NO: 120233 - DNA, 20 bp, Artificial Sequence
  chemically synthesized
gtattaatcctggtacccgt

SEQ ID NO: 120234 - DNA, 20 bp, Artificial Sequence
  chemically synthesized
gaaagtcaactaacgggtac

SEQ ID NO: 120235 - DNA, 20 bp, Artificial Sequence
  chemically synthesized
aaagtcaactaacgggtacc

SEQ ID NO: 120236 - DNA, 20 bp, Artificial Sequence
  chemically synthesized
catcacctaggtattaatcc

SEQ ID NO: 120237 - DNA, 20 bp, Artificial Sequence
  chemically synthesized
cgggtaccaggattaatacc

SEQ ID NO: 120238 - DNA, 20 bp, Artificial Sequence
  chemically synthesized
gggtaccaggattaatacct

SEQ ID NO: 120239 - DNA, 20 bp, Artificial Sequence
  chemically synthesized
tacagattatttcatcacct

SEQ ID NO: 120240 - DNA, 20 bp, Artificial Sequence
  chemically synthesized
gtacagattatttcatcacc

SEQ ID NO: 120241 - DNA, 20 bp, Artificial Sequence
  chemically synthesized
tgatgaaataatctgtacaa

SEQ ID NO: 120242 - DNA, 20 bp, Artificial Sequence
  chemically synthesized
tgtcatgggggtctgttgta

SEQ ID NO: 120243 - DNA, 20 bp, Artificial Sequence
  chemically synthesized
taggtaaacttgtgtcatgg

SEQ ID NO: 120244 - DNA, 20 bp, Artificial Sequence
  chemically synthesized
ataggtaaacttgtgtcatg

SEQ ID NO: 120245 - DNA, 20 bp, Artificial Sequence
  chemically synthesized
acaacagacccccatgacac

SEQ ID NO: 120246 - DNA, 20 bp, Artificial Sequence
  chemically synthesized
cataggtaaacttgtgtcat

SEQ ID NO: 120247 - DNA, 20 bp, Artificial Sequence
  chemically synthesized
acataggtaaacttgtgtca

SEQ ID NO: 120248 - DNA, 20 bp, Artificial Sequence
  chemically synthesized
catgtgcaggtttgttacat

SEQ ID NO: 120249 - DNA, 20 bp, Artificial Sequence
  chemically synthesized
acatgtgcaggtttgttaca

SEQ ID NO: 120250 - DNA, 20 bp, Artificial Sequence
  chemically synthesized
aagttcaggggtacatgtgc

SEQ ID NO: 120251 - DNA, 20 bp, Artificial Sequence
  chemically synthesized
taagttcaggggtacatgtg

SEQ ID NO: 120252 - DNA, 20 bp, Artificial Sequence
  chemically synthesized
tttttcacttttaagttcag

SEQ ID NO: 120253 - DNA, 20 bp, Artificial Sequence
  chemically synthesized
ttttttcacttttaagttca

SEQ ID NO: 120254 - DNA, 20 bp, Artificial Sequence
  chemically synthesized
attttttcacttttaagttc

SEQ ID NO: 120255 - DNA, 20 bp, Artificial Sequence
  chemically synthesized
acatgtacccctgaacttaa

SEQ ID NO: 120256 - DNA, 20 bp, Artificial Sequence
  chemically synthesized
tattttttcacttttaagtt

SEQ ID NO: 120257 - DNA, 20 bp, Artificial Sequence
  chemically synthesized
atttttattttttcactttt

SEQ ID NO: 120258 - DNA, 20 bp, Artificial Sequence
  chemically synthesized
aaataaaaataaaaataaaa

SEQ ID NO: 120259 - DNA, 20 bp, Artificial Sequence
  chemically synthesized
taaaaaagaaaatgtataaa

SEQ ID NO: 120260 - DNA, 20 bp, Artificial Sequence
  chemically synthesized
aatgtataaatagaaaaaat

SEQ ID NO: 120261 - DNA, 20 bp, Artificial Sequence
  chemically synthesized
atgtataaatagaaaaaatc

SEQ ID NO: 120262 - DNA, 20 bp, Artificial Sequence
  chemically synthesized
tataaatagaaaaaatcagg

SEQ ID NO: 120263 - DNA, 20 bp, Artificial Sequence
  chemically synthesized
agaaaaaatcaggcagaaac

SEQ ID NO: 120264 - DNA, 20 bp, Artificial Sequence
  chemically synthesized
acaagtaaatgcattacaac

SEQ ID NO: 120265 - DNA, 20 bp, Artificial Sequence
  chemically synthesized
cattacaacaagccactgtg

SEQ ID NO: 120266 - DNA, 20 bp, Artificial Sequence
  chemically synthesized
ttacaacaagccactgtgta

SEQ ID NO: 120267 - DNA, 20 bp, Artificial Sequence
  chemically synthesized
aaagtgttgtctctacacag

SEQ ID NO: 120268 - DNA, 20 bp, Artificial Sequence
  chemically synthesized
taaaaagtgttgtctctaca

SEQ ID NO: 120269 - DNA, 20 bp, Artificial Sequence
  chemically synthesized
tgcctctatttataaataaa

SEQ ID NO: 120270 - DNA, 20 bp, Artificial Sequence
  chemically synthesized
caacactttttatttataaa

SEQ ID NO: 120271 - DNA, 20 bp, Artificial Sequence
  chemically synthesized
acactttttatttataaata

SEQ ID NO: 120272 - DNA, 20 bp, Artificial Sequence
  chemically synthesized
cactttttatttataaatag

SEQ ID NO: 120273 - DNA, 20 bp, Artificial Sequence
  chemically synthesized
tatttataaatagaggcaat

SEQ ID NO: 120274 - DNA, 20 bp, Artificial Sequence
  chemically synthesized
tagaggcaataagatttttg

SEQ ID NO: 120275 - DNA, 20 bp, Artificial Sequence
  chemically synthesized
aggcaataagatttttgaag

SEQ ID NO: 120276 - DNA, 20 bp, Artificial Sequence
  chemically synthesized
ataagatttttgaagtagca

SEQ ID NO: 120277 - DNA, 20 bp, Artificial Sequence
  chemically synthesized
taaatgggttaagcagttta

SEQ ID NO: 120278 - DNA, 20 bp, Artificial Sequence
  chemically synthesized
ataaatgggttaagcagttt

SEQ ID NO: 120279 - DNA, 20 bp, Artificial Sequence
  chemically synthesized
cataaatgggttaagcagtt

SEQ ID NO: 120280 - DNA, 20 bp, Artificial Sequence
  chemically synthesized
ttaggcataaatgggttaag

SEQ ID NO: 120281 - DNA, 20 bp, Artificial Sequence
  chemically synthesized
accttaggcataaatgggtt

SEQ ID NO: 120282 - DNA, 20 bp, Artificial Sequence
  chemically synthesized
ttgcaaccttaggcataaat

SEQ ID NO: 120283 - DNA, 20 bp, Artificial Sequence
  chemically synthesized
attgcaaccttaggcataaa

SEQ ID NO: 120284 - DNA, 20 bp, Artificial Sequence
  chemically synthesized
tgcttaacccatttatgcct

SEQ ID NO: 120285 - DNA, 20 bp, Artificial Sequence
  chemically synthesized
gcttaacccatttatgccta

SEQ ID NO: 120286 - DNA, 20 bp, Artificial Sequence
  chemically synthesized
attcaaaaaattgcaacctt

SEQ ID NO: 120287 - DNA, 20 bp, Artificial Sequence
  chemically synthesized
aattcaaaaaattgcaacct

SEQ ID NO: 120288 - DNA, 20 bp, Artificial Sequence
  chemically synthesized
attttttgaatttttgcaat

SEQ ID NO: 120289 - DNA, 20 bp, Artificial Sequence
  chemically synthesized
gaatttttgcaatcagacct

SEQ ID NO: 120290 - DNA, 20 bp, Artificial Sequence
  chemically synthesized
ttttgcaatcagaccttggt

SEQ ID NO: 120291 - DNA, 20 bp, Artificial Sequence
  chemically synthesized
tttgcaatcagaccttggtg

SEQ ID NO: 120292 - DNA, 20 bp, Artificial Sequence
  chemically synthesized
actgttcaaggtcctcacca

SEQ ID NO: 120293 - DNA, 20 bp, Artificial Sequence
  chemically synthesized
tactgttcaaggtcctcacc

SEQ ID NO: 120294 - DNA, 20 bp, Artificial Sequence
  chemically synthesized
accttggtgaggaccttgaa

SEQ ID NO: 120295 - DNA, 20 bp, Artificial Sequence
  chemically synthesized
ttggtgaggaccttgaacag

SEQ ID NO: 120296 - DNA, 20 bp, Artificial Sequence
  chemically synthesized
tatttatattctactgttca

SEQ ID NO: 120297 - DNA, 20 bp, Artificial Sequence
  chemically synthesized
ttatttatattctactgttc

SEQ ID NO: 120298 - DNA, 20 bp, Artificial Sequence
  chemically synthesized
ataaataattcccacatgct

SEQ ID NO: 120299 - DNA, 20 bp, Artificial Sequence
  chemically synthesized
tattggaatactaagcatgt

SEQ ID NO: 120300 - DNA, 20 bp, Artificial Sequence
  chemically synthesized
ttattggaatactaagcatg

SEQ ID NO: 120301 - DNA, 20 bp, Artificial Sequence
  chemically synthesized
tgttccattattggaatact

SEQ ID NO: 120302 - DNA, 20 bp, Artificial Sequence
  chemically synthesized
catgcttagtattccaataa

SEQ ID NO: 120303 - DNA, 20 bp, Artificial Sequence
  chemically synthesized
ttatcctagtgttccattat

SEQ ID NO: 120304 - DNA, 20 bp, Artificial Sequence
  chemically synthesized
gtattccaataatggaacac

SEQ ID NO: 120305 - DNA, 20 bp, Artificial Sequence
  chemically synthesized
tattccaataatggaacact

SEQ ID NO: 120306 - DNA, 20 bp, Artificial Sequence
  chemically synthesized
taatggaacactaggataaa

SEQ ID NO: 120307 - DNA, 20 bp, Artificial Sequence
  chemically synthesized
ttcactttagctatttatcc

SEQ ID NO: 120308 - DNA, 20 bp, Artificial Sequence
  chemically synthesized
aacactaggataaatagcta

SEQ ID NO: 120309 - DNA, 20 bp, Artificial Sequence
  chemically synthesized
atctttgtctatgttcactt

SEQ ID NO: 120310 - DNA, 20 bp, Artificial Sequence
  chemically synthesized
ataaatagctaaagtgaaca

SEQ ID NO: 120311 - DNA, 20 bp, Artificial Sequence
  chemically synthesized
agctaaagtgaacatagaca

SEQ ID NO: 120312 - DNA, 20 bp, Artificial Sequence
  chemically synthesized
gaacatagacaaagatgatc

SEQ ID NO: 120313 - DNA, 20 bp, Artificial Sequence
  chemically synthesized
acatagacaaagatgatcta

SEQ ID NO: 120314 - DNA, 20 bp, Artificial Sequence
  chemically synthesized
tagacaaagatgatctagag

SEQ ID NO: 120315 - DNA, 20 bp, Artificial Sequence
  chemically synthesized
agacaaagatgatctagagc

SEQ ID NO: 120316 - DNA, 20 bp, Artificial Sequence
  chemically synthesized
ttttactgatagtcctgctc

SEQ ID NO: 120317 - DNA, 20 bp, Artificial Sequence
  chemically synthesized
atgatctagagcaggactat

SEQ ID NO: 120318 - DNA, 20 bp, Artificial Sequence
  chemically synthesized
atcacagaaagttttactga

SEQ ID NO: 120319 - DNA, 20 bp, Artificial Sequence
  chemically synthesized
aggtaaccaccaatcacaga

SEQ ID NO: 120320 - DNA, 20 bp, Artificial Sequence
  chemically synthesized
tcagtaaaactttctgtgat

SEQ ID NO: 120321 - DNA, 20 bp, Artificial Sequence
  chemically synthesized
gtaaaactttctgtgattgg

SEQ ID NO: 120322 - DNA, 20 bp, Artificial Sequence
  chemically synthesized
catcaggtaaccaccaatca

SEQ ID NO: 120323 - DNA, 20 bp, Artificial Sequence
  chemically synthesized
gattggtggttacctgatgc

SEQ ID NO: 120324 - DNA, 20 bp, Artificial Sequence
  chemically synthesized
attggtggttacctgatgct

SEQ ID NO: 120325 - DNA, 20 bp, Artificial Sequence
  chemically synthesized
cccctacccttcccagcatc

SEQ ID NO: 120326 - DNA, 20 bp, Artificial Sequence
  chemically synthesized
ccccctacccttcccagcat

SEQ ID NO: 120327 - DNA, 20 bp, Artificial Sequence
  chemically synthesized
ggtggttacctgatgctggg

SEQ ID NO: 120328 - DNA, 20 bp, Artificial Sequence
  chemically synthesized
gtggttacctgatgctggga

SEQ ID NO: 120329 - DNA, 20 bp, Artificial Sequence
  chemically synthesized
tggttacctgatgctgggaa

SEQ ID NO: 120330 - DNA, 20 bp, Artificial Sequence
  chemically synthesized
ttacctgatgctgggaaggg

SEQ ID NO: 120331 - DNA, 20 bp, Artificial Sequence
  chemically synthesized
ccctcaccccctacccttcc

SEQ ID NO: 120332 - DNA, 20 bp, Artificial Sequence
  chemically synthesized
tacctgatgctgggaagggt

SEQ ID NO: 120333 - DNA, 20 bp, Artificial Sequence
  chemically synthesized
acctgatgctgggaagggta

SEQ ID NO: 120334 - DNA, 20 bp, Artificial Sequence
  chemically synthesized
cctgatgctgggaagggtag

SEQ ID NO: 120335 - DNA, 20 bp, Artificial Sequence
  chemically synthesized
ctgatgctgggaagggtagg

SEQ ID NO: 120336 - DNA, 20 bp, Artificial Sequence
  chemically synthesized
tgctgggaagggtagggggt

SEQ ID NO: 120337 - DNA, 20 bp, Artificial Sequence
  chemically synthesized
gctgggaagggtagggggtg

SEQ ID NO: 120338 - DNA, 20 bp, Artificial Sequence
  chemically synthesized
ctgggaagggtagggggtga

SEQ ID NO: 120339 - DNA, 20 bp, Artificial Sequence
  chemically synthesized
tgggaagggtagggggtgag

SEQ ID NO: 120340 - DNA, 20 bp, Artificial Sequence
  chemically synthesized
tgagcctgcaaaatcgaatc

SEQ ID NO: 120341 - DNA, 20 bp, Artificial Sequence
  chemically synthesized
atgaacttgattcgattttg

SEQ ID NO: 120342 - DNA, 20 bp, Artificial Sequence
  chemically synthesized
tgaacttgattcgattttgc

SEQ ID NO: 120343 - DNA, 20 bp, Artificial Sequence
  chemically synthesized
ttgattcgattttgcaggct

SEQ ID NO: 120344 - DNA, 20 bp, Artificial Sequence
  chemically synthesized
gattcgattttgcaggctca

SEQ ID NO: 120345 - DNA, 20 bp, Artificial Sequence
  chemically synthesized
cgattttgcaggctcagaga

SEQ ID NO: 120346 - DNA, 20 bp, Artificial Sequence
  chemically synthesized
gcaaattcccttccatctct

SEQ ID NO: 120347 - DNA, 20 bp, Artificial Sequence
  chemically synthesized
ttttgcaggctcagagatgg

SEQ ID NO: 120348 - DNA, 20 bp, Artificial Sequence
  chemically synthesized
tttgcaggctcagagatgga

SEQ ID NO: 120349 - DNA, 20 bp, Artificial Sequence
  chemically synthesized
ttgcaggctcagagatggaa

SEQ ID NO: 120350 - DNA, 20 bp, Artificial Sequence
  chemically synthesized
tcaaggcacaattcatcgtg

SEQ ID NO: 120351 - DNA, 20 bp, Artificial Sequence
  chemically synthesized
ctcaaggcacaattcatcgt

SEQ ID NO: 120352 - DNA, 20 bp, Artificial Sequence
  chemically synthesized
ctcacgatgaattgtgcctt

SEQ ID NO: 120353 - DNA, 20 bp, Artificial Sequence
  chemically synthesized
ttagatatgggtgagactca

SEQ ID NO: 120354 - DNA, 20 bp, Artificial Sequence
  chemically synthesized
attagatatgggtgagactc

SEQ ID NO: 120355 - DNA, 20 bp, Artificial Sequence
  chemically synthesized
aatataaattagatatgggt

SEQ ID NO: 120356 - DNA, 20 bp, Artificial Sequence
  chemically synthesized
atctaatataaattagatat

SEQ ID NO: 120357 - DNA, 20 bp, Artificial Sequence
  chemically synthesized
aatctaatataaattagata

SEQ ID NO: 120358 - DNA, 20 bp, Artificial Sequence
  chemically synthesized
aagtgcaatctaatataaat

SEQ ID NO: 120359 - DNA, 20 bp, Artificial Sequence
  chemically synthesized
cacccatatctaatttatat

SEQ ID NO: 120360 - DNA, 20 bp, Artificial Sequence
  chemically synthesized
ttatattagattgcactttt

SEQ ID NO: 120361 - DNA, 20 bp, Artificial Sequence
  chemically synthesized
ttatttcagcataaactcaa

SEQ ID NO: 120362 - DNA, 20 bp, Artificial Sequence
  chemically synthesized
ttttgagtttatgctgaaat

SEQ ID NO: 120363 - DNA, 20 bp, Artificial Sequence
  chemically synthesized
aagccccaaaaatcttattt

SEQ ID NO: 120364 - DNA, 20 bp, Artificial Sequence
  chemically synthesized
ttatgctgaaataagatttt

SEQ ID NO: 120365 - DNA, 20 bp, Artificial Sequence
  chemically synthesized
tatgctgaaataagattttt

SEQ ID NO: 120366 - DNA, 20 bp, Artificial Sequence
  chemically synthesized
atgctgaaataagatttttg

SEQ ID NO: 120367 - DNA, 20 bp, Artificial Sequence
  chemically synthesized
aaataagatttttggggctt

SEQ ID NO: 120368 - DNA, 20 bp, Artificial Sequence
  chemically synthesized
aataagatttttggggcttt

SEQ ID NO: 120369 - DNA, 20 bp, Artificial Sequence
  chemically synthesized
ataagatttttggggctttg

SEQ ID NO: 120370 - DNA, 20 bp, Artificial Sequence
  chemically synthesized
atacattcatttcatcccca

SEQ ID NO: 120371 - DNA, 20 bp, Artificial Sequence
  chemically synthesized
aatgaatgtattttgtcttt

SEQ ID NO: 120372 - DNA, 20 bp, Artificial Sequence
  chemically synthesized
gaatgtattttgtctttgag

SEQ ID NO: 120373 - DNA, 20 bp, Artificial Sequence
  chemically synthesized
caaaattcttgttcttctca

SEQ ID NO: 120374 - DNA, 20 bp, Artificial Sequence
  chemically synthesized
attttgtctttgagaagaac

SEQ ID NO: 120375 - DNA, 20 bp, Artificial Sequence
  chemically synthesized
tttgagaagaacaagaattt

SEQ ID NO: 120376 - DNA, 20 bp, Artificial Sequence
  chemically synthesized
ttgagaagaacaagaatttt

SEQ ID NO: 120377 - DNA, 20 bp, Artificial Sequence
  chemically synthesized
tgagaagaacaagaattttg

SEQ ID NO: 120378 - DNA, 20 bp, Artificial Sequence
  chemically synthesized
agaacaagaattttggggaa

SEQ ID NO: 120379 - DNA, 20 bp, Artificial Sequence
  chemically synthesized
gaacaagaattttggggaaa

SEQ ID NO: 120380 - DNA, 20 bp, Artificial Sequence
  chemically synthesized
aacaagaattttggggaaaa

SEQ ID NO: 120381 - DNA, 20 bp, Artificial Sequence
  chemically synthesized
acaagaattttggggaaaag

SEQ ID NO: 120382 - DNA, 20 bp, Artificial Sequence
  chemically synthesized
caagaattttggggaaaagg

SEQ ID NO: 120383 - DNA, 20 bp, Artificial Sequence
  chemically synthesized
gaattttggggaaaaggggg

SEQ ID NO: 120384 - DNA, 20 bp, Artificial Sequence
  chemically synthesized
gaaaagggggcagaatgcta

SEQ ID NO: 120385 - DNA, 20 bp, Artificial Sequence
  chemically synthesized
aagggaaaaacattaaacca

SEQ ID NO: 120386 - DNA, 20 bp, Artificial Sequence
  chemically synthesized
ttttaccataagtttgggaa

SEQ ID NO: 120387 - DNA, 20 bp, Artificial Sequence
  chemically synthesized
attttaccataagtttggga

SEQ ID NO: 120388 - DNA, 20 bp, Artificial Sequence
  chemically synthesized
aattttaccataagtttggg

SEQ ID NO: 120389 - DNA, 20 bp, Artificial Sequence
  chemically synthesized
tttttcccttcccaaactta

SEQ ID NO: 120390 - DNA, 20 bp, Artificial Sequence
  chemically synthesized
ttaaattttaccataagttt

SEQ ID NO: 120391 - DNA, 20 bp, Artificial Sequence
  chemically synthesized
attaaattttaccataagtt

SEQ ID NO: 120392 - DNA, 20 bp, Artificial Sequence
  chemically synthesized
tggcaattaaattttaccat

SEQ ID NO: 120393 - DNA, 20 bp, Artificial Sequence
  chemically synthesized
aaatttaattgccattgcaa

SEQ ID NO: 120394 - DNA, 20 bp, Artificial Sequence
  chemically synthesized
cacatttactactgttgcaa

SEQ ID NO: 120395 - DNA, 20 bp, Artificial Sequence
  chemically synthesized
tttaattgccattgcaacag

SEQ ID NO: 120396 - DNA, 20 bp, Artificial Sequence
  chemically synthesized
cagtagtaaatgtgaccttg

SEQ ID NO: 120397 - DNA, 20 bp, Artificial Sequence
  chemically synthesized
gtagtaaatgtgaccttgaa

SEQ ID NO: 120398 - DNA, 20 bp, Artificial Sequence
  chemically synthesized
tagtaaatgtgaccttgaag

SEQ ID NO: 120399 - DNA, 20 bp, Artificial Sequence
  chemically synthesized
atgtcctaatcacctcttca

SEQ ID NO: 120400 - DNA, 20 bp, Artificial Sequence
  chemically synthesized
catgtcctaatcacctcttc

SEQ ID NO: 120401 - DNA, 20 bp, Artificial Sequence
  chemically synthesized
tgtgaccttgaagaggtgat

SEQ ID NO: 120402 - DNA, 20 bp, Artificial Sequence
  chemically synthesized
gtgaccttgaagaggtgatt

SEQ ID NO: 120403 - DNA, 20 bp, Artificial Sequence
  chemically synthesized
gaagaggtgattaggacatg

SEQ ID NO: 120404 - DNA, 20 bp, Artificial Sequence
  chemically synthesized
aagaggtgattaggacatga

SEQ ID NO: 120405 - DNA, 20 bp, Artificial Sequence
  chemically synthesized
ctaatccgttcatgaaggca

SEQ ID NO: 120406 - DNA, 20 bp, Artificial Sequence
  chemically synthesized
tgctaatccgttcatgaagg

SEQ ID NO: 120407 - DNA, 20 bp, Artificial Sequence
  chemically synthesized
gaaggctctgccttcatgaa

SEQ ID NO: 120408 - DNA, 20 bp, Artificial Sequence
  chemically synthesized
tgatgctaatccgttcatga

SEQ ID NO: 120409 - DNA, 20 bp, Artificial Sequence
  chemically synthesized
atgatgctaatccgttcatg

SEQ ID NO: 120410 - DNA, 20 bp, Artificial Sequence
  chemically synthesized
ctctgccttcatgaacggat

SEQ ID NO: 120411 - DNA, 20 bp, Artificial Sequence
  chemically synthesized
acggattagcatcattattg

SEQ ID NO: 120412 - DNA, 20 bp, Artificial Sequence
  chemically synthesized
cggattagcatcattattgt

SEQ ID NO: 120413 - DNA, 20 bp, Artificial Sequence
  chemically synthesized
gattagcatcattattgtgg

SEQ ID NO: 120414 - DNA, 20 bp, Artificial Sequence
  chemically synthesized
agcatcattattgtgggagt

SEQ ID NO: 120415 - DNA, 20 bp, Artificial Sequence
  chemically synthesized
tgtgggagtgagtttcatat

SEQ ID NO: 120416 - DNA, 20 bp, Artificial Sequence
  chemically synthesized
gtgggagtgagtttcatata

SEQ ID NO: 120417 - DNA, 20 bp, Artificial Sequence
  chemically synthesized
agtgagtttcatataaggac

SEQ ID NO: 120418 - DNA, 20 bp, Artificial Sequence
  chemically synthesized
gtttcatataaggacaagtt

SEQ ID NO: 120419 - DNA, 20 bp, Artificial Sequence
  chemically synthesized
accaaaagagagaaaaaatg

SEQ ID NO: 120420 - DNA, 20 bp, Artificial Sequence
  chemically synthesized
gaccaaaagagagaaaaaat

SEQ ID NO: 120421 - DNA, 20 bp, Artificial Sequence
  chemically synthesized
agaccaaaagagagaaaaaa

SEQ ID NO: 120422 - DNA, 20 bp, Artificial Sequence
  chemically synthesized
gccccattttttctctcttt

SEQ ID NO: 120423 - DNA, 20 bp, Artificial Sequence
  chemically synthesized
gaaggtggaagaccaaaaga

SEQ ID NO: 120424 - DNA, 20 bp, Artificial Sequence
  chemically synthesized
tggaaggtggaagaccaaaa

SEQ ID NO: 120425 - DNA, 20 bp, Artificial Sequence
  chemically synthesized
gatggaaggtggaagaccaa

SEQ ID NO: 120426 - DNA, 20 bp, Artificial Sequence
  chemically synthesized
gattccatgatggaaggtgg

SEQ ID NO: 120427 - DNA, 20 bp, Artificial Sequence
  chemically synthesized
catgattccatgatggaagg

SEQ ID NO: 120428 - DNA, 20 bp, Artificial Sequence
  chemically synthesized
tggtcttccaccttccatca

SEQ ID NO: 120429 - DNA, 20 bp, Artificial Sequence
  chemically synthesized
tgtcatgattccatgatgga

SEQ ID NO: 120430 - DNA, 20 bp, Artificial Sequence
  chemically synthesized
gtgtcatgattccatgatgg

SEQ ID NO: 120431 - DNA, 20 bp, Artificial Sequence
  chemically synthesized
gttgtgtcatgattccatga

SEQ ID NO: 120432 - DNA, 20 bp, Artificial Sequence
  chemically synthesized
tcatggaatcatgacacaac

SEQ ID NO: 120433 - DNA, 20 bp, Artificial Sequence
  chemically synthesized
tggaatcatgacacaacaag

SEQ ID NO: 120434 - DNA, 20 bp, Artificial Sequence
  chemically synthesized
ggaatcatgacacaacaaga

SEQ ID NO: 120435 - DNA, 20 bp, Artificial Sequence
  chemically synthesized
cacaacaagaaggcccttac

SEQ ID NO: 120436 - DNA, 20 bp, Artificial Sequence
  chemically synthesized
aaggggctggaatctggtaa

SEQ ID NO: 120437 - DNA, 20 bp, Artificial Sequence
  chemically synthesized
caaggggctggaatctggta

SEQ ID NO: 120438 - DNA, 20 bp, Artificial Sequence
  chemically synthesized
tcaaggggctggaatctggt

SEQ ID NO: 120439 - DNA, 20 bp, Artificial Sequence
  chemically synthesized
agaaggcccttaccagattc

SEQ ID NO: 120440 - DNA, 20 bp, Artificial Sequence
  chemically synthesized
aagatcaaggggctggaatc

SEQ ID NO: 120441 - DNA, 20 bp, Artificial Sequence
  chemically synthesized
gaagtccaagatcaaggggc

SEQ ID NO: 120442 - DNA, 20 bp, Artificial Sequence
  chemically synthesized
ctgcgaagtccaagatcaag

SEQ ID NO: 120443 - DNA, 20 bp, Artificial Sequence
  chemically synthesized
agattccagccccttgatct

SEQ ID NO: 120444 - DNA, 20 bp, Artificial Sequence
  chemically synthesized
gctgcgaagtccaagatcaa

SEQ ID NO: 120445 - DNA, 20 bp, Artificial Sequence
  chemically synthesized
ggctgcgaagtccaagatca

SEQ ID NO: 120446 - DNA, 20 bp, Artificial Sequence
  chemically synthesized
aggctgcgaagtccaagatc

SEQ ID NO: 120447 - DNA, 20 bp, Artificial Sequence
  chemically synthesized
ttctggaggctgcgaagtcc

SEQ ID NO: 120448 - DNA, 20 bp, Artificial Sequence
  chemically synthesized
ccccttgatcttggacttcg

SEQ ID NO: 120449 - DNA, 20 bp, Artificial Sequence
  chemically synthesized
tcatagttctggaggctgcg

SEQ ID NO: 120450 - DNA, 20 bp, Artificial Sequence
  chemically synthesized
atcttggacttcgcagcctc

SEQ ID NO: 120451 - DNA, 20 bp, Artificial Sequence
  chemically synthesized
ttgttggctcatagttctgg

SEQ ID NO: 120452 - DNA, 20 bp, Artificial Sequence
  chemically synthesized
tttgttggctcatagttctg

SEQ ID NO: 120453 - DNA, 20 bp, Artificial Sequence
  chemically synthesized
ttcgcagcctccagaactat

SEQ ID NO: 120454 - DNA, 20 bp, Artificial Sequence
  chemically synthesized
gatttgttggctcatagttc

SEQ ID NO: 120455 - DNA, 20 bp, Artificial Sequence
  chemically synthesized
aacagggatttgttggctca

SEQ ID NO: 120456 - DNA, 20 bp, Artificial Sequence
  chemically synthesized
tataatgaacagggatttgt

SEQ ID NO: 120457 - DNA, 20 bp, Artificial Sequence
  chemically synthesized
tgggtaatttataatgaaca

SEQ ID NO: 120458 - DNA, 20 bp, Artificial Sequence
  chemically synthesized
ctgggtaatttataatgaac

SEQ ID NO: 120459 - DNA, 20 bp, Artificial Sequence
  chemically synthesized
actgggtaatttataatgaa

SEQ ID NO: 120460 - DNA, 20 bp, Artificial Sequence
  chemically synthesized
cctgttcattataaattacc

SEQ ID NO: 120461 - DNA, 20 bp, Artificial Sequence
  chemically synthesized
attataaattacccagtctg

SEQ ID NO: 120462 - DNA, 20 bp, Artificial Sequence
  chemically synthesized
gtaacaaaataccacagact

SEQ ID NO: 120463 - DNA, 20 bp, Artificial Sequence
  chemically synthesized
cgtaacaaaataccacagac

SEQ ID NO: 120464 - DNA, 20 bp, Artificial Sequence
  chemically synthesized
gcttccgtaacaaaatacca

SEQ ID NO: 120465 - DNA, 20 bp, Artificial Sequence
  chemically synthesized
cagtctgtggtattttgtta

SEQ ID NO: 120466 - DNA, 20 bp, Artificial Sequence
  chemically synthesized
tctgtggtattttgttacgg

SEQ ID NO: 120467 - DNA, 20 bp, Artificial Sequence
  chemically synthesized
ttttgttacggaagcacgaa

SEQ ID NO: 120468 - DNA, 20 bp, Artificial Sequence
  chemically synthesized
tttgttacggaagcacgaaa

SEQ ID NO: 120469 - DNA, 20 bp, Artificial Sequence
  chemically synthesized
acggaagcacgaaaaggact

SEQ ID NO: 120470 - DNA, 20 bp, Artificial Sequence
  chemically synthesized
agcacgaaaaggactaagac

SEQ ID NO: 120471 - DNA, 20 bp, Artificial Sequence
  chemically synthesized
gcacgaaaaggactaagaca

SEQ ID NO: 120472 - DNA, 20 bp, Artificial Sequence
  chemically synthesized
tacttctgttgtccttgtct

SEQ ID NO: 120473 - DNA, 20 bp, Artificial Sequence
  chemically synthesized
aaggactaagacaaggacaa

SEQ ID NO: 120474 - DNA, 20 bp, Artificial Sequence
  chemically synthesized
gactaagacaaggacaacag

SEQ ID NO: 120475 - DNA, 20 bp, Artificial Sequence
  chemically synthesized
taagacaaggacaacagaag

SEQ ID NO: 120476 - DNA, 20 bp, Artificial Sequence
  chemically synthesized
aagacaaggacaacagaagt

SEQ ID NO: 120477 - DNA, 20 bp, Artificial Sequence
  chemically synthesized
caacagaagtaggttgcatt

SEQ ID NO: 120478 - DNA, 20 bp, Artificial Sequence
  chemically synthesized
acagaagtaggttgcatttg

SEQ ID NO: 120479 - DNA, 20 bp, Artificial Sequence
  chemically synthesized
aagtaggttgcatttggaga

SEQ ID NO: 120480 - DNA, 20 bp, Artificial Sequence
  chemically synthesized
gtaggttgcatttggagaaa

SEQ ID NO: 120481 - DNA, 20 bp, Artificial Sequence
  chemically synthesized
ttgcatttggagaaagagat

SEQ ID NO: 120482 - DNA, 20 bp, Artificial Sequence
  chemically synthesized
catttggagaaagagattgg

SEQ ID NO: 120483 - DNA, 20 bp, Artificial Sequence
  chemically synthesized
ttggagaaagagattggaag

SEQ ID NO: 120484 - DNA, 20 bp, Artificial Sequence
  chemically synthesized
tggagaaagagattggaaga

SEQ ID NO: 120485 - DNA, 20 bp, Artificial Sequence
  chemically synthesized
aaagagattggaagaaggca

SEQ ID NO: 120486 - DNA, 20 bp, Artificial Sequence
  chemically synthesized
gattggaagaaggcaaagat

SEQ ID NO: 120487 - DNA, 20 bp, Artificial Sequence
  chemically synthesized
gaagaaggcaaagatgagtt

SEQ ID NO: 120488 - DNA, 20 bp, Artificial Sequence
  chemically synthesized
ggcaaagatgagtttagctt

SEQ ID NO: 120489 - DNA, 20 bp, Artificial Sequence
  chemically synthesized
cttcacattgaagaggtcca

SEQ ID NO: 120490 - DNA, 20 bp, Artificial Sequence
  chemically synthesized
acaggaacttcacattgaag

SEQ ID NO: 120491 - DNA, 20 bp, Artificial Sequence
  chemically synthesized
cacaggaacttcacattgaa

SEQ ID NO: 120492 - DNA, 20 bp, Artificial Sequence
  chemically synthesized
ctttggacctcttcaatgtg

SEQ ID NO: 120493 - DNA, 20 bp, Artificial Sequence
  chemically synthesized
cccacaggaacttcacattg

SEQ ID NO: 120494 - DNA, 20 bp, Artificial Sequence
  chemically synthesized
tcttcaatgtgaagttcctg

SEQ ID NO: 120495 - DNA, 20 bp, Artificial Sequence
  chemically synthesized
cttcaatgtgaagttcctgt

SEQ ID NO: 120496 - DNA, 20 bp, Artificial Sequence
  chemically synthesized
tttcgatgttaatgtcccac

SEQ ID NO: 120497 - DNA, 20 bp, Artificial Sequence
  chemically synthesized
ctttcgatgttaatgtccca

SEQ ID NO: 120498 - DNA, 20 bp, Artificial Sequence
  chemically synthesized
ctgtgggacattaacatcga

SEQ ID NO: 120499 - DNA, 20 bp, Artificial Sequence
  chemically synthesized
gggacattaacatcgaaaga

SEQ ID NO: 120500 - DNA, 20 bp, Artificial Sequence
  chemically synthesized
acattaacatcgaaagaaag

SEQ ID NO: 120501 - DNA, 20 bp, Artificial Sequence
  chemically synthesized
ttaacatcgaaagaaagcag

SEQ ID NO: 120502 - DNA, 20 bp, Artificial Sequence
  chemically synthesized
taacatcgaaagaaagcagc

SEQ ID NO: 120503 - DNA, 20 bp, Artificial Sequence
  chemically synthesized
tcttttgagttttagacatg

SEQ ID NO: 120504 - DNA, 20 bp, Artificial Sequence
  chemically synthesized
gagaatgatcttttgagttt

SEQ ID NO: 120505 - DNA, 20 bp, Artificial Sequence
  chemically synthesized
tctacatgtctaaaactcaa

SEQ ID NO: 120506 - DNA, 20 bp, Artificial Sequence
  chemically synthesized
ccagctgagaatgatctttt

SEQ ID NO: 120507 - DNA, 20 bp, Artificial Sequence
  chemically synthesized
aaaactcaaaagatcattct

SEQ ID NO: 120508 - DNA, 20 bp, Artificial Sequence
  chemically synthesized
ctcaaaagatcattctcagc

SEQ ID NO: 120509 - DNA, 20 bp, Artificial Sequence
  chemically synthesized
acccatctataattccagct

SEQ ID NO: 120510 - DNA, 20 bp, Artificial Sequence
  chemically synthesized
atcattctcagctggaatta

SEQ ID NO: 120511 - DNA, 20 bp, Artificial Sequence
  chemically synthesized
tgactacccatctataattc

SEQ ID NO: 120512 - DNA, 20 bp, Artificial Sequence
  chemically synthesized
ttctcagctggaattataga

SEQ ID NO: 120513 - DNA, 20 bp, Artificial Sequence
  chemically synthesized
tctcagctggaattatagat

SEQ ID NO: 120514 - DNA, 20 bp, Artificial Sequence
  chemically synthesized
cagctggaattatagatggg

SEQ ID NO: 120515 - DNA, 20 bp, Artificial Sequence
  chemically synthesized
tatagatgggtagtcatcaa

SEQ ID NO: 120516 - DNA, 20 bp, Artificial Sequence
  chemically synthesized
ttcatccacttgtgtagttt

SEQ ID NO: 120517 - DNA, 20 bp, Artificial Sequence
  chemically synthesized
tcaacagactgaaactacac

SEQ ID NO: 120518 - DNA, 20 bp, Artificial Sequence
  chemically synthesized
acagactgaaactacacaag

SEQ ID NO: 120519 - DNA, 20 bp, Artificial Sequence
  chemically synthesized
caagaattcatccacttgtg

SEQ ID NO: 120520 - DNA, 20 bp, Artificial Sequence
  chemically synthesized
caagtggatgaattcttgca

SEQ ID NO: 120521 - DNA, 20 bp, Artificial Sequence
  chemically synthesized
agtggatgaattcttgcaaa

SEQ ID NO: 120522 - DNA, 20 bp, Artificial Sequence
  chemically synthesized
acttcacatgtactctttgc

SEQ ID NO: 120523 - DNA, 20 bp, Artificial Sequence
  chemically synthesized
tcttgcaaagagtacatgtg

SEQ ID NO: 120524 - DNA, 20 bp, Artificial Sequence
  chemically synthesized
gcaaagagtacatgtgaagt

SEQ ID NO: 120525 - DNA, 20 bp, Artificial Sequence
  chemically synthesized
gagtacatgtgaagtgagaa

SEQ ID NO: 120526 - DNA, 20 bp, Artificial Sequence
  chemically synthesized
catgtgaagtgagaaaagaa

SEQ ID NO: 120527 - DNA, 20 bp, Artificial Sequence
  chemically synthesized
atgtgaagtgagaaaagaac

SEQ ID NO: 120528 - DNA, 20 bp, Artificial Sequence
  chemically synthesized
tgtgaagtgagaaaagaaca

SEQ ID NO: 120529 - DNA, 20 bp, Artificial Sequence
  chemically synthesized
gaagtgagaaaagaacaggg

SEQ ID NO: 120530 - DNA, 20 bp, Artificial Sequence
  chemically synthesized
aagaacagggaagaacttta

SEQ ID NO: 120531 - DNA, 20 bp, Artificial Sequence
  chemically synthesized
acttctgactcatgtctata

SEQ ID NO: 120532 - DNA, 20 bp, Artificial Sequence
  chemically synthesized
gggaagaactttatagacat

SEQ ID NO: 120533 - DNA, 20 bp, Artificial Sequence
  chemically synthesized
agaactttatagacatgagt

SEQ ID NO: 120534 - DNA, 20 bp, Artificial Sequence
  chemically synthesized
actttatagacatgagtcag

SEQ ID NO: 120535 - DNA, 20 bp, Artificial Sequence
  chemically synthesized
ttatagacatgagtcagaag

SEQ ID NO: 120536 - DNA, 20 bp, Artificial Sequence
  chemically synthesized
gacatgagtcagaagtagct

SEQ ID NO: 120537 - DNA, 20 bp, Artificial Sequence
  chemically synthesized
tacagaatctgcaattcacc

SEQ ID NO: 120538 - DNA, 20 bp, Artificial Sequence
  chemically synthesized
agaagtagcttggtgaattg

SEQ ID NO: 120539 - DNA, 20 bp, Artificial Sequence
  chemically synthesized
ggtgaattgcagattctgta

SEQ ID NO: 120540 - DNA, 20 bp, Artificial Sequence
  chemically synthesized
gtgaattgcagattctgtac

SEQ ID NO: 120541 - DNA, 20 bp, Artificial Sequence
  chemically synthesized
actcacatttttagcctgta

SEQ ID NO: 120542 - DNA, 20 bp, Artificial Sequence
  chemically synthesized
tctgtacaggctaaaaatgt

SEQ ID NO: 120543 - DNA, 20 bp, Artificial Sequence
  chemically synthesized
tagaagccaactcacatttt

SEQ ID NO: 120544 - DNA, 20 bp, Artificial Sequence
  chemically synthesized
tacaggctaaaaatgtgagt

SEQ ID NO: 120545 - DNA, 20 bp, Artificial Sequence
  chemically synthesized
aaagtaaatgagaattttag

SEQ ID NO: 120546 - DNA, 20 bp, Artificial Sequence
  chemically synthesized
ggtaaagtaaatgagaattt

SEQ ID NO: 120547 - DNA, 20 bp, Artificial Sequence
  chemically synthesized
cccctatgggtaaagtaaat

SEQ ID NO: 120548 - DNA, 20 bp, Artificial Sequence
  chemically synthesized
attctcatttactttaccca

SEQ ID NO: 120549 - DNA, 20 bp, Artificial Sequence
  chemically synthesized
ttctcatttactttacccat

SEQ ID NO: 120550 - DNA, 20 bp, Artificial Sequence
  chemically synthesized
acttacttcccctatgggta

SEQ ID NO: 120551 - DNA, 20 bp, Artificial Sequence
  chemically synthesized
tctcatttactttacccata

SEQ ID NO: 120552 - DNA, 20 bp, Artificial Sequence
  chemically synthesized
ctcatttactttacccatag

SEQ ID NO: 120553 - DNA, 20 bp, Artificial Sequence
  chemically synthesized
atttactttacccatagggg

SEQ ID NO: 120554 - DNA, 20 bp, Artificial Sequence
  chemically synthesized
catatacttacttcccctat

SEQ ID NO: 120555 - DNA, 20 bp, Artificial Sequence
  chemically synthesized
gcatatacttacttccccta

SEQ ID NO: 120556 - DNA, 20 bp, Artificial Sequence
  chemically synthesized
actttacccataggggaagt

SEQ ID NO: 120557 - DNA, 20 bp, Artificial Sequence
  chemically synthesized
aagtaagtatatgcattcct

SEQ ID NO: 120558 - DNA, 20 bp, Artificial Sequence
  chemically synthesized
tatatgcattccttagctga

SEQ ID NO: 120559 - DNA, 20 bp, Artificial Sequence
  chemically synthesized
ttccaaaaagctatcagcta

SEQ ID NO: 120560 - DNA, 20 bp, Artificial Sequence
  chemically synthesized
gttccaaaaagctatcagct

SEQ ID NO: 120561 - DNA, 20 bp, Artificial Sequence
  chemically synthesized
gcttggttccaaaaagctat

SEQ ID NO: 120562 - DNA, 20 bp, Artificial Sequence
  chemically synthesized
ttccttagctgatagctttt

SEQ ID NO: 120563 - DNA, 20 bp, Artificial Sequence
  chemically synthesized
ttttttggcttggttccaaa

SEQ ID NO: 120564 - DNA, 20 bp, Artificial Sequence
  chemically synthesized
gctgatagctttttggaacc

SEQ ID NO: 120565 - DNA, 20 bp, Artificial Sequence
  chemically synthesized
ccagtttatattttttggct

SEQ ID NO: 120566 - DNA, 20 bp, Artificial Sequence
  chemically synthesized
gacttccagtttatattttt

SEQ ID NO: 120567 - DNA, 20 bp, Artificial Sequence
  chemically synthesized
ccaagccaaaaaatataaac

SEQ ID NO: 120568 - DNA, 20 bp, Artificial Sequence
  chemically synthesized
agccaaaaaatataaactgg

SEQ ID NO: 120569 - DNA, 20 bp, Artificial Sequence
  chemically synthesized
ttcttcatgggaatgacttc

SEQ ID NO: 120570 - DNA, 20 bp, Artificial Sequence
  chemically synthesized
aactggaagtcattcccatg

SEQ ID NO: 120571 - DNA, 20 bp, Artificial Sequence
  chemically synthesized
aaggtctctggattcttcat

SEQ ID NO: 120572 - DNA, 20 bp, Artificial Sequence
  chemically synthesized
caaggtctctggattcttca

SEQ ID NO: 120573 - DNA, 20 bp, Artificial Sequence
  chemically synthesized
agtcattcccatgaagaatc

SEQ ID NO: 120574 - DNA, 20 bp, Artificial Sequence
  chemically synthesized
tcattcccatgaagaatcca

SEQ ID NO: 120575 - DNA, 20 bp, Artificial Sequence
  chemically synthesized
aattgttttatcaaggtctc

SEQ ID NO: 120576 - DNA, 20 bp, Artificial Sequence
  chemically synthesized
tttaaaaaattgttttatca

SEQ ID NO: 120577 - DNA, 20 bp, Artificial Sequence
  chemically synthesized
ttttaaaaaattgttttatc

SEQ ID NO: 120578 - DNA, 20 bp, Artificial Sequence
  chemically synthesized
aaacaattttttaaaaaact

SEQ ID NO: 120579 - DNA, 20 bp, Artificial Sequence
  chemically synthesized
acaattttttaaaaaactga

SEQ ID NO: 120580 - DNA, 20 bp, Artificial Sequence
  chemically synthesized
aattttttaaaaaactgaga

SEQ ID NO: 120581 - DNA, 20 bp, Artificial Sequence
  chemically synthesized
tttttaaaaaactgagagag

SEQ ID NO: 120582 - DNA, 20 bp, Artificial Sequence
  chemically synthesized
gatggcccaagccactctct

SEQ ID NO: 120583 - DNA, 20 bp, Artificial Sequence
  chemically synthesized
aaaaaactgagagagtggct

SEQ ID NO: 120584 - DNA, 20 bp, Artificial Sequence
  chemically synthesized
aaaaactgagagagtggctt

SEQ ID NO: 120585 - DNA, 20 bp, Artificial Sequence
  chemically synthesized
ctcatgctccttgatggccc

SEQ ID NO: 120586 - DNA, 20 bp, Artificial Sequence
  chemically synthesized
agagagtggcttgggccatc

SEQ ID NO: 120587 - DNA, 20 bp, Artificial Sequence
  chemically synthesized
gagagtggcttgggccatca

SEQ ID NO: 120588 - DNA, 20 bp, Artificial Sequence
  chemically synthesized
gagtggcttgggccatcaag

SEQ ID NO: 120589 - DNA, 20 bp, Artificial Sequence
  chemically synthesized
ttcattctcatgctccttga

SEQ ID NO: 120590 - DNA, 20 bp, Artificial Sequence
  chemically synthesized
cttgggccatcaaggagcat

SEQ ID NO: 120591 - DNA, 20 bp, Artificial Sequence
  chemically synthesized
catcaaggagcatgagaatg

SEQ ID NO: 120592 - DNA, 20 bp, Artificial Sequence
  chemically synthesized
tcaaggagcatgagaatgaa

SEQ ID NO: 120593 - DNA, 20 bp, Artificial Sequence
  chemically synthesized
aaggagcatgagaatgaaga

SEQ ID NO: 120594 - DNA, 20 bp, Artificial Sequence
  chemically synthesized
aggagcatgagaatgaagag

SEQ ID NO: 120595 - DNA, 20 bp, Artificial Sequence
  chemically synthesized
ggagcatgagaatgaagaga

SEQ ID NO: 120596 - DNA, 20 bp, Artificial Sequence
  chemically synthesized
gagcatgagaatgaagagag

SEQ ID NO: 120597 - DNA, 20 bp, Artificial Sequence
  chemically synthesized
gaatgaagagaggggtctgt

SEQ ID NO: 120598 - DNA, 20 bp, Artificial Sequence
  chemically synthesized
gaagagaggggtctgtcaga

SEQ ID NO: 120599 - DNA, 20 bp, Artificial Sequence
  chemically synthesized
agagaggggtctgtcagaaa

SEQ ID NO: 120600 - DNA, 20 bp, Artificial Sequence
  chemically synthesized
atctatactactctttctga

SEQ ID NO: 120601 - DNA, 20 bp, Artificial Sequence
  chemically synthesized
gaggggtctgtcagaaagag

SEQ ID NO: 120602 - DNA, 20 bp, Artificial Sequence
  chemically synthesized
gtctgtcagaaagagtagta

SEQ ID NO: 120603 - DNA, 20 bp, Artificial Sequence
  chemically synthesized
gtcagaaagagtagtataga

SEQ ID NO: 120604 - DNA, 20 bp, Artificial Sequence
  chemically synthesized
aaagagtagtatagatagac

SEQ ID NO: 120605 - DNA, 20 bp, Artificial Sequence
  chemically synthesized
gtagtatagatagactagat

SEQ ID NO: 120606 - DNA, 20 bp, Artificial Sequence
  chemically synthesized
agagcttgaggacactgatc

SEQ ID NO: 120607 - DNA, 20 bp, Artificial Sequence
  chemically synthesized
tagactagatcagtgtcctc

SEQ ID NO: 120608 - DNA, 20 bp, Artificial Sequence
  chemically synthesized
agatcagtgtcctcaagctc

SEQ ID NO: 120609 - DNA, 20 bp, Artificial Sequence
  chemically synthesized
tggtatgaaactagagcttg

SEQ ID NO: 120610 - DNA, 20 bp, Artificial Sequence
  chemically synthesized
atggtatgaaactagagctt

SEQ ID NO: 120611 - DNA, 20 bp, Artificial Sequence
  chemically synthesized
ttgctcatggtatgaaacta

SEQ ID NO: 120612 - DNA, 20 bp, Artificial Sequence
  chemically synthesized
gcttgctcatggtatgaaac

SEQ ID NO: 120613 - DNA, 20 bp, Artificial Sequence
  chemically synthesized
aagctctagtttcataccat

SEQ ID NO: 120614 - DNA, 20 bp, Artificial Sequence
  chemically synthesized
tctagtttcataccatgagc

SEQ ID NO: 120615 - DNA, 20 bp, Artificial Sequence
  chemically synthesized
ccaagaaaaaagcttgctca

SEQ ID NO: 120616 - DNA, 20 bp, Artificial Sequence
  chemically synthesized
ccatgagcaagcttttttct

SEQ ID NO: 120617 - DNA, 20 bp, Artificial Sequence
  chemically synthesized
aaactaaggggccaagaaaa

SEQ ID NO: 120618 - DNA, 20 bp, Artificial Sequence
  chemically synthesized
aagcttttttcttggcccct

SEQ ID NO: 120619 - DNA, 20 bp, Artificial Sequence
  chemically synthesized
gtaatataaactaaggggcc

SEQ ID NO: 120620 - DNA, 20 bp, Artificial Sequence
  chemically synthesized
tttaggtaatataaactaag

SEQ ID NO: 120621 - DNA, 20 bp, Artificial Sequence
  chemically synthesized
gtttaggtaatataaactaa

SEQ ID NO: 120622 - DNA, 20 bp, Artificial Sequence
  chemically synthesized
agtttaggtaatataaacta

SEQ ID NO: 120623 - DNA, 20 bp, Artificial Sequence
  chemically synthesized
gagtttaggtaatataaact

SEQ ID NO: 120624 - DNA, 20 bp, Artificial Sequence
  chemically synthesized
gagattaatttgatgagttt

SEQ ID NO: 120625 - DNA, 20 bp, Artificial Sequence
  chemically synthesized
agagattaatttgatgagtt

SEQ ID NO: 120626 - DNA, 20 bp, Artificial Sequence
  chemically synthesized
aagtcagagattaatttgat

SEQ ID NO: 120627 - DNA, 20 bp, Artificial Sequence
  chemically synthesized
gggaaagcaaattaaagtca

SEQ ID NO: 120628 - DNA, 20 bp, Artificial Sequence
  chemically synthesized
tggggaaagcaaattaaagt

SEQ ID NO: 120629 - DNA, 20 bp, Artificial Sequence
  chemically synthesized
cttttggggaaagcaaatta

SEQ ID NO: 120630 - DNA, 20 bp, Artificial Sequence
  chemically synthesized
ctttaatttgctttccccaa

SEQ ID NO: 120631 - DNA, 20 bp, Artificial Sequence
  chemically synthesized
aaagagaagtcttttgggga

SEQ ID NO: 120632 - DNA, 20 bp, Artificial Sequence
  chemically synthesized
tctcaaagagaagtcttttg

SEQ ID NO: 120633 - DNA, 20 bp, Artificial Sequence
  chemically synthesized
ttctcaaagagaagtctttt

SEQ ID NO: 120634 - DNA, 20 bp, Artificial Sequence
  chemically synthesized
cttctcaaagagaagtcttt

SEQ ID NO: 120635 - DNA, 20 bp, Artificial Sequence
  chemically synthesized
tccccaaaagacttctcttt

SEQ ID NO: 120636 - DNA, 20 bp, Artificial Sequence
  chemically synthesized
aatatctgcttctcaaagag

SEQ ID NO: 120637 - DNA, 20 bp, Artificial Sequence
  chemically synthesized
ccaaaagacttctctttgag

SEQ ID NO: 120638 - DNA, 20 bp, Artificial Sequence
  chemically synthesized
ggaaatatctgcttctcaaa

SEQ ID NO: 120639 - DNA, 20 bp, Artificial Sequence
  chemically synthesized
aaagacttctctttgagaag

SEQ ID NO: 120640 - DNA, 20 bp, Artificial Sequence
  chemically synthesized
tgggaaatatctgcttctca

SEQ ID NO: 120641 - DNA, 20 bp, Artificial Sequence
  chemically synthesized
agaagcagatatttcccact

SEQ ID NO: 120642 - DNA, 20 bp, Artificial Sequence
  chemically synthesized
gtcaaccattagatcttagt

SEQ ID NO: 120643 - DNA, 20 bp, Artificial Sequence
  chemically synthesized
agtcaaccattagatcttag

SEQ ID NO: 120644 - DNA, 20 bp, Artificial Sequence
  chemically synthesized
gagagtcaaccattagatct

SEQ ID NO: 120645 - DNA, 20 bp, Artificial Sequence
  chemically synthesized
tatttcccactaagatctaa

SEQ ID NO: 120646 - DNA, 20 bp, Artificial Sequence
  chemically synthesized
ggtatcagagagtcaaccat

SEQ ID NO: 120647 - DNA, 20 bp, Artificial Sequence
  chemically synthesized
tggaatcaattggtatcaga

SEQ ID NO: 120648 - DNA, 20 bp, Artificial Sequence
  chemically synthesized
catggaatcaattggtatca

SEQ ID NO: 120649 - DNA, 20 bp, Artificial Sequence
  chemically synthesized
cacatggaatcaattggtat

SEQ ID NO: 120650 - DNA, 20 bp, Artificial Sequence
  chemically synthesized
attattcacatggaatcaat

SEQ ID NO: 120651 - DNA, 20 bp, Artificial Sequence
  chemically synthesized
ttcaggaagaattattcaca

SEQ ID NO: 120652 - DNA, 20 bp, Artificial Sequence
  chemically synthesized
agggacagattaggttcagg

SEQ ID NO: 120653 - DNA, 20 bp, Artificial Sequence
  chemically synthesized
aacagggacagattaggttc

SEQ ID NO: 120654 - DNA, 20 bp, Artificial Sequence
  chemically synthesized
aaacagggacagattaggtt

SEQ ID NO: 120655 - DNA, 20 bp, Artificial Sequence
  chemically synthesized
caattaaacagggacagatt

SEQ ID NO: 120656 - DNA, 20 bp, Artificial Sequence
  chemically synthesized
tcaattaaacagggacagat

SEQ ID NO: 120657 - DNA, 20 bp, Artificial Sequence
  chemically synthesized
tgtgttcaattaaacaggga

SEQ ID NO: 120658 - DNA, 20 bp, Artificial Sequence
  chemically synthesized
tatatgtgttcaattaaaca

SEQ ID NO: 120659 - DNA, 20 bp, Artificial Sequence
  chemically synthesized
ttatatgtgttcaattaaac

SEQ ID NO: 120660 - DNA, 20 bp, Artificial Sequence
  chemically synthesized
cttatatgtgttcaattaaa

SEQ ID NO: 120661 - DNA, 20 bp, Artificial Sequence
  chemically synthesized
ctgtttaattgaacacatat

SEQ ID NO: 120662 - DNA, 20 bp, Artificial Sequence
  chemically synthesized
acatataagatctgtatttt

SEQ ID NO: 120663 - DNA, 20 bp, Artificial Sequence
  chemically synthesized
tggactttcttctcaaaata

SEQ ID NO: 120664 - DNA, 20 bp, Artificial Sequence
  chemically synthesized
tataagatctgtattttgag

SEQ ID NO: 120665 - DNA, 20 bp, Artificial Sequence
  chemically synthesized
agatctgtattttgagaaga

SEQ ID NO: 120666 - DNA, 20 bp, Artificial Sequence
  chemically synthesized
gtattttgagaagaaagtcc

SEQ ID NO: 120667 - DNA, 20 bp, Artificial Sequence
  chemically synthesized
tttttctcaatggcaaggct

SEQ ID NO: 120668 - DNA, 20 bp, Artificial Sequence
  chemically synthesized
aaagtccaagccttgccatt

SEQ ID NO: 120669 - DNA, 20 bp, Artificial Sequence
  chemically synthesized
actactttttctcaatggca

SEQ ID NO: 120670 - DNA, 20 bp, Artificial Sequence
  chemically synthesized
aactactttttctcaatggc

SEQ ID NO: 120671 - DNA, 20 bp, Artificial Sequence
  chemically synthesized
tagtaactactttttctcaa

SEQ ID NO: 120672 - DNA, 20 bp, Artificial Sequence
  chemically synthesized
caagccttgccattgagaaa

SEQ ID NO: 120673 - DNA, 20 bp, Artificial Sequence
  chemically synthesized
gccttgccattgagaaaaag

SEQ ID NO: 120674 - DNA, 20 bp, Artificial Sequence
  chemically synthesized
tgagaaaaagtagttactat

SEQ ID NO: 120675 - DNA, 20 bp, Artificial Sequence
  chemically synthesized
gatatttggaaaaattctca

SEQ ID NO: 120676 - DNA, 20 bp, Artificial Sequence
  chemically synthesized
atgagaatttttccaaatat

SEQ ID NO: 120677 - DNA, 20 bp, Artificial Sequence
  chemically synthesized
ttgaatatggagctgatatt

SEQ ID NO: 120678 - DNA, 20 bp, Artificial Sequence
  chemically synthesized
caaatatcagctccatattc

SEQ ID NO: 120679 - DNA, 20 bp, Artificial Sequence
  chemically synthesized
aaagggcaaacttgaatatg

SEQ ID NO: 120680 - DNA, 20 bp, Artificial Sequence
  chemically synthesized
agaaagggcaaacttgaata

SEQ ID NO: 120681 - DNA, 20 bp, Artificial Sequence
  chemically synthesized
aaaagaccctggtggagaaa

SEQ ID NO: 120682 - DNA, 20 bp, Artificial Sequence
  chemically synthesized
aaaaagaccctggtggagaa

SEQ ID NO: 120683 - DNA, 20 bp, Artificial Sequence
  chemically synthesized
caagtttgccctttctccac

SEQ ID NO: 120684 - DNA, 20 bp, Artificial Sequence
  chemically synthesized
gaaaaagaccctggtggaga

SEQ ID NO: 120685 - DNA, 20 bp, Artificial Sequence
  chemically synthesized
aagtttgccctttctccacc

SEQ ID NO: 120686 - DNA, 20 bp, Artificial Sequence
  chemically synthesized
agtttgccctttctccacca

SEQ ID NO: 120687 - DNA, 20 bp, Artificial Sequence
  chemically synthesized
ctatgaaaaagaccctggtg

SEQ ID NO: 120688 - DNA, 20 bp, Artificial Sequence
  chemically synthesized
ccctatgaaaaagaccctgg

SEQ ID NO: 120689 - DNA, 20 bp, Artificial Sequence
  chemically synthesized
gagccctatgaaaaagaccc

SEQ ID NO: 120690 - DNA, 20 bp, Artificial Sequence
  chemically synthesized
ctccaccagggtctttttca

SEQ ID NO: 120691 - DNA, 20 bp, Artificial Sequence
  chemically synthesized
tccaccagggtctttttcat

SEQ ID NO: 120692 - DNA, 20 bp, Artificial Sequence
  chemically synthesized
ccaccagggtctttttcata

SEQ ID NO: 120693 - DNA, 20 bp, Artificial Sequence
  chemically synthesized
ttaattggagccctatgaaa

SEQ ID NO: 120694 - DNA, 20 bp, Artificial Sequence
  chemically synthesized
aagttgggaagttttaattg

SEQ ID NO: 120695 - DNA, 20 bp, Artificial Sequence
  chemically synthesized
taaagttgggaagttttaat

SEQ ID NO: 120696 - DNA, 20 bp, Artificial Sequence
  chemically synthesized
agattcaacctaaagttggg

SEQ ID NO: 120697 - DNA, 20 bp, Artificial Sequence
  chemically synthesized
caattaaaacttcccaactt

SEQ ID NO: 120698 - DNA, 20 bp, Artificial Sequence
  chemically synthesized
aattaaaacttcccaacttt

SEQ ID NO: 120699 - DNA, 20 bp, Artificial Sequence
  chemically synthesized
agaagattcaacctaaagtt

SEQ ID NO: 120700 - DNA, 20 bp, Artificial Sequence
  chemically synthesized
aagaagattcaacctaaagt

SEQ ID NO: 120701 - DNA, 20 bp, Artificial Sequence
  chemically synthesized
ggaaaagaagattcaaccta

SEQ ID NO: 120702 - DNA, 20 bp, Artificial Sequence
  chemically synthesized
tggaaaagaccatggaaaag

SEQ ID NO: 120703 - DNA, 20 bp, Artificial Sequence
  chemically synthesized
aggttgaatcttcttttcca

SEQ ID NO: 120704 - DNA, 20 bp, Artificial Sequence
  chemically synthesized
agatggaaaagaccatggaa

SEQ ID NO: 120705 - DNA, 20 bp, Artificial Sequence
  chemically synthesized
tgtatagatggaaaagacca

SEQ ID NO: 120706 - DNA, 20 bp, Artificial Sequence
  chemically synthesized
cagtaggtgtatagatggaa

SEQ ID NO: 120707 - DNA, 20 bp, Artificial Sequence
  chemically synthesized
ccagacagtaggtgtataga

SEQ ID NO: 120708 - DNA, 20 bp, Artificial Sequence
  chemically synthesized
aattccagacagtaggtgta

SEQ ID NO: 120709 - DNA, 20 bp, Artificial Sequence
  chemically synthesized
ccatctatacacctactgtc

SEQ ID NO: 120710 - DNA, 20 bp, Artificial Sequence
  chemically synthesized
aatcctgaattccagacagt

SEQ ID NO: 120711 - DNA, 20 bp, Artificial Sequence
  chemically synthesized
taatcctgaattccagacag

SEQ ID NO: 120712 - DNA, 20 bp, Artificial Sequence
  chemically synthesized
ctctaatcctgaattccaga

SEQ ID NO: 120713 - DNA, 20 bp, Artificial Sequence
  chemically synthesized
tacacctactgtctggaatt

SEQ ID NO: 120714 - DNA, 20 bp, Artificial Sequence
  chemically synthesized
acacctactgtctggaattc

SEQ ID NO: 120715 - DNA, 20 bp, Artificial Sequence
  chemically synthesized
gcaactctaatcctgaattc

SEQ ID NO: 120716 - DNA, 20 bp, Artificial Sequence
  chemically synthesized
tactgtctggaattcaggat

SEQ ID NO: 120717 - DNA, 20 bp, Artificial Sequence
  chemically synthesized
ctgtctggaattcaggatta

SEQ ID NO: 120718 - DNA, 20 bp, Artificial Sequence
  chemically synthesized
attagagttgctctattccc

SEQ ID NO: 120719 - DNA, 20 bp, Artificial Sequence
  chemically synthesized
gctggtcaccctggggaata

SEQ ID NO: 120720 - DNA, 20 bp, Artificial Sequence
  chemically synthesized
ttagagttgctctattcccc

SEQ ID NO: 120721 - DNA, 20 bp, Artificial Sequence
  chemically synthesized
tagagttgctctattcccca

SEQ ID NO: 120722 - DNA, 20 bp, Artificial Sequence
  chemically synthesized
aagctggtcaccctggggaa

SEQ ID NO: 120723 - DNA, 20 bp, Artificial Sequence
  chemically synthesized
aatttaagctggtcaccctg

SEQ ID NO: 120724 - DNA, 20 bp, Artificial Sequence
  chemically synthesized
gaatttaagctggtcaccct

SEQ ID NO: 120725 - DNA, 20 bp, Artificial Sequence
  chemically synthesized
gctctattccccagggtgac

SEQ ID NO: 120726 - DNA, 20 bp, Artificial Sequence
  chemically synthesized
tgaatttaagctggtcaccc

SEQ ID NO: 120727 - DNA, 20 bp, Artificial Sequence
  chemically synthesized
ctgtgaagctgaatttaagc

SEQ ID NO: 120728 - DNA, 20 bp, Artificial Sequence
  chemically synthesized
cagggtgaccagcttaaatt

SEQ ID NO: 120729 - DNA, 20 bp, Artificial Sequence
  chemically synthesized
actcctgtgaagctgaattt

SEQ ID NO: 120730 - DNA, 20 bp, Artificial Sequence
  chemically synthesized
ccagcttaaattcagcttca

SEQ ID NO: 120731 - DNA, 20 bp, Artificial Sequence
  chemically synthesized
cagcttaaattcagcttcac

SEQ ID NO: 120732 - DNA, 20 bp, Artificial Sequence
  chemically synthesized
gcttaaattcagcttcacag

SEQ ID NO: 120733 - DNA, 20 bp, Artificial Sequence
  chemically synthesized
agagagtaaaaactcctgtg

SEQ ID NO: 120734 - DNA, 20 bp, Artificial Sequence
  chemically synthesized
aaactgagctagacattaga

SEQ ID NO: 120735 - DNA, 20 bp, Artificial Sequence
  chemically synthesized
agtttttactctctaatgtc

SEQ ID NO: 120736 - DNA, 20 bp, Artificial Sequence
  chemically synthesized
tgaaactgagctagacatta

SEQ ID NO: 120737 - DNA, 20 bp, Artificial Sequence
  chemically synthesized
tttgaaactgagctagacat

SEQ ID NO: 120738 - DNA, 20 bp, Artificial Sequence
  chemically synthesized
ttactctctaatgtctagct

SEQ ID NO: 120739 - DNA, 20 bp, Artificial Sequence
  chemically synthesized
actaaattttgaaactgagc

SEQ ID NO: 120740 - DNA, 20 bp, Artificial Sequence
  chemically synthesized
gccaactaaattttgaaact

SEQ ID NO: 120741 - DNA, 20 bp, Artificial Sequence
  chemically synthesized
tctagctcagtttcaaaatt

SEQ ID NO: 120742 - DNA, 20 bp, Artificial Sequence
  chemically synthesized
gctcagtttcaaaatttagt

SEQ ID NO: 120743 - DNA, 20 bp, Artificial Sequence
  chemically synthesized
aatgatatatggaaattaag

SEQ ID NO: 120744 - DNA, 20 bp, Artificial Sequence
  chemically synthesized
gataatgatatatggaaatt

SEQ ID NO: 120745 - DNA, 20 bp, Artificial Sequence
  chemically synthesized
agaaatgagataatgatata

SEQ ID NO: 120746 - DNA, 20 bp, Artificial Sequence
  chemically synthesized
taggaagtcttaggagaaat

SEQ ID NO: 120747 - DNA, 20 bp, Artificial Sequence
  chemically synthesized
atcattatctcatttctcct

SEQ ID NO: 120748 - DNA, 20 bp, Artificial Sequence
  chemically synthesized
ctaagagtaggaagtcttag

SEQ ID NO: 120749 - DNA, 20 bp, Artificial Sequence
  chemically synthesized
aactaagagtaggaagtctt

SEQ ID NO: 120750 - DNA, 20 bp, Artificial Sequence
  chemically synthesized
gaactaagagtaggaagtct

SEQ ID NO: 120751 - DNA, 20 bp, Artificial Sequence
  chemically synthesized
gattttgaactaagagtagg

SEQ ID NO: 120752 - DNA, 20 bp, Artificial Sequence
  chemically synthesized
ctcctaagacttcctactct

SEQ ID NO: 120753 - DNA, 20 bp, Artificial Sequence
  chemically synthesized
acagattttgaactaagagt

SEQ ID NO: 120754 - DNA, 20 bp, Artificial Sequence
  chemically synthesized
aacagattttgaactaagag

SEQ ID NO: 120755 - DNA, 20 bp, Artificial Sequence
  chemically synthesized
caaaacagattttgaactaa

SEQ ID NO: 120756 - DNA, 20 bp, Artificial Sequence
  chemically synthesized
gccaaaacagattttgaact

SEQ ID NO: 120757 - DNA, 20 bp, Artificial Sequence
  chemically synthesized
tcttagttcaaaatctgttt

SEQ ID NO: 120758 - DNA, 20 bp, Artificial Sequence
  chemically synthesized
agtcaccactggggccaaaa

SEQ ID NO: 120759 - DNA, 20 bp, Artificial Sequence
  chemically synthesized
ttcaaaatctgttttggccc

SEQ ID NO: 120760 - DNA, 20 bp, Artificial Sequence
  chemically synthesized
aaaatctgttttggccccag

SEQ ID NO: 120761 - DNA, 20 bp, Artificial Sequence
  chemically synthesized
agaagtaaaagtcaccactg

SEQ ID NO: 120762 - DNA, 20 bp, Artificial Sequence
  chemically synthesized
aagaagtaaaagtcaccact

SEQ ID NO: 120763 - DNA, 20 bp, Artificial Sequence
  chemically synthesized
caagaagtaaaagtcaccac

SEQ ID NO: 120764 - DNA, 20 bp, Artificial Sequence
  chemically synthesized
tgatttttaacaagaagtaa

SEQ ID NO: 120765 - DNA, 20 bp, Artificial Sequence
  chemically synthesized
gctcggtgatttttaacaag

SEQ ID NO: 120766 - DNA, 20 bp, Artificial Sequence
  chemically synthesized
taagctcggtgatttttaac

SEQ ID NO: 120767 - DNA, 20 bp, Artificial Sequence
  chemically synthesized
acttcttgttaaaaatcacc

SEQ ID NO: 120768 - DNA, 20 bp, Artificial Sequence
  chemically synthesized
aattactgaaaaaataagct

SEQ ID NO: 120769 - DNA, 20 bp, Artificial Sequence
  chemically synthesized
aatcaccgagcttatttttt

SEQ ID NO: 120770 - DNA, 20 bp, Artificial Sequence
  chemically synthesized
acatcaattactgaaaaaat

SEQ ID NO: 120771 - DNA, 20 bp, Artificial Sequence
  chemically synthesized
cagtaattgatgtcatattt

SEQ ID NO: 120772 - DNA, 20 bp, Artificial Sequence
  chemically synthesized
gaccacggtgaaaaataatt

SEQ ID NO: 120773 - DNA, 20 bp, Artificial Sequence
  chemically synthesized
aactcaattatttttcaccg

SEQ ID NO: 120774 - DNA, 20 bp, Artificial Sequence
  chemically synthesized
gtacaatatgaggaagacca

SEQ ID NO: 120775 - DNA, 20 bp, Artificial Sequence
  chemically synthesized
agcacctgtacaatatgagg

SEQ ID NO: 120776 - DNA, 20 bp, Artificial Sequence
  chemically synthesized
aatagcacctgtacaatatg

SEQ ID NO: 120777 - DNA, 20 bp, Artificial Sequence
  chemically synthesized
aaatagcacctgtacaatat

SEQ ID NO: 120778 - DNA, 20 bp, Artificial Sequence
  chemically synthesized
gtggtcttcctcatattgta

SEQ ID NO: 120779 - DNA, 20 bp, Artificial Sequence
  chemically synthesized
tggtcttcctcatattgtac

SEQ ID NO: 120780 - DNA, 20 bp, Artificial Sequence
  chemically synthesized
ttgtacaggtgctatttttt

SEQ ID NO: 120781 - DNA, 20 bp, Artificial Sequence
  chemically synthesized
ccttgtgcaagctgaaaaaa

SEQ ID NO: 120782 - DNA, 20 bp, Artificial Sequence
  chemically synthesized
gctattttttcagcttgcac

SEQ ID NO: 120783 - DNA, 20 bp, Artificial Sequence
  chemically synthesized
ctattttttcagcttgcaca

SEQ ID NO: 120784 - DNA, 20 bp, Artificial Sequence
  chemically synthesized
aatgtacaattaccttgtgc

SEQ ID NO: 120785 - DNA, 20 bp, Artificial Sequence
  chemically synthesized
aggtaattgtacattctgca

SEQ ID NO: 120786 - DNA, 20 bp, Artificial Sequence
  chemically synthesized
ggtaattgtacattctgcaa

SEQ ID NO: 120787 - DNA, 20 bp, Artificial Sequence
  chemically synthesized
gtaattgtacattctgcaaa

SEQ ID NO: 120788 - DNA, 20 bp, Artificial Sequence
  chemically synthesized
aattgtacattctgcaaagg

SEQ ID NO: 120789 - DNA, 20 bp, Artificial Sequence
  chemically synthesized
ttgaatgatgactccctttg

SEQ ID NO: 120790 - DNA, 20 bp, Artificial Sequence
  chemically synthesized
atcattcaaaaaacatttac

SEQ ID NO: 120791 - DNA, 20 bp, Artificial Sequence
  chemically synthesized
cacgtgatataatagggagc

SEQ ID NO: 120792 - DNA, 20 bp, Artificial Sequence
  chemically synthesized
gaaccacgtgatataatagg

SEQ ID NO: 120793 - DNA, 20 bp, Artificial Sequence
  chemically synthesized
ctgaaccacgtgatataata

SEQ ID NO: 120794 - DNA, 20 bp, Artificial Sequence
  chemically synthesized
cctgaaccacgtgatataat

SEQ ID NO: 120795 - DNA, 20 bp, Artificial Sequence
  chemically synthesized
tcctgaaccacgtgatataa

SEQ ID NO: 120796 - DNA, 20 bp, Artificial Sequence
  chemically synthesized
tagctccctattatatcacg

SEQ ID NO: 120797 - DNA, 20 bp, Artificial Sequence
  chemically synthesized
ccctattatatcacgtggtt

SEQ ID NO: 120798 - DNA, 20 bp, Artificial Sequence
  chemically synthesized
cctattatatcacgtggttc

SEQ ID NO: 120799 - DNA, 20 bp, Artificial Sequence
  chemically synthesized
atatcacgtggttcaggacc

SEQ ID NO: 120800 - DNA, 20 bp, Artificial Sequence
  chemically synthesized
tatcacgtggttcaggacct

SEQ ID NO: 120801 - DNA, 20 bp, Artificial Sequence
  chemically synthesized
atcacgtggttcaggacctg

SEQ ID NO: 120802 - DNA, 20 bp, Artificial Sequence
  chemically synthesized
ttctcatttgatacatcccc

SEQ ID NO: 120803 - DNA, 20 bp, Artificial Sequence
  chemically synthesized
tttctcatttgatacatccc

SEQ ID NO: 120804 - DNA, 20 bp, Artificial Sequence
  chemically synthesized
gacctggggatgtatcaaat

SEQ ID NO: 120805 - DNA, 20 bp, Artificial Sequence
  chemically synthesized
tggggatgtatcaaatgaga

SEQ ID NO: 120806 - DNA, 20 bp, Artificial Sequence
  chemically synthesized
atctaaatgccatgagggca

SEQ ID NO: 120807 - DNA, 20 bp, Artificial Sequence
  chemically synthesized
agacaaaatctctgccctca

SEQ ID NO: 120808 - DNA, 20 bp, Artificial Sequence
  chemically synthesized
taatctaaatgccatgaggg

SEQ ID NO: 120809 - DNA, 20 bp, Artificial Sequence
  chemically synthesized
aattaatctaaatgccatga

SEQ ID NO: 120810 - DNA, 20 bp, Artificial Sequence
  chemically synthesized
aaattaatctaaatgccatg

SEQ ID NO: 120811 - DNA, 20 bp, Artificial Sequence
  chemically synthesized
taaattaatctaaatgccat

SEQ ID NO: 120812 - DNA, 20 bp, Artificial Sequence
  chemically synthesized
atctctgccctcatggcatt

SEQ ID NO: 120813 - DNA, 20 bp, Artificial Sequence
  chemically synthesized
atggcatttagattaattta

SEQ ID NO: 120814 - DNA, 20 bp, Artificial Sequence
  chemically synthesized
tggcatttagattaatttaa

SEQ ID NO: 120815 - DNA, 20 bp, Artificial Sequence
  chemically synthesized
aaggacaaatatttaacaat

SEQ ID NO: 120816 - DNA, 20 bp, Artificial Sequence
  chemically synthesized
tttatatttttatttatgat

SEQ ID NO: 120817 - DNA, 20 bp, Artificial Sequence
  chemically synthesized
tttatgattggaataaatgc

SEQ ID NO: 120818 - DNA, 20 bp, Artificial Sequence
  chemically synthesized
ggaataaatgctagtgaaaa

SEQ ID NO: 120819 - DNA, 20 bp, Artificial Sequence
  chemically synthesized
atctctagtgcttttttcac

SEQ ID NO: 120820 - DNA, 20 bp, Artificial Sequence
  chemically synthesized
aatgctagtgaaaaaagcac

SEQ ID NO: 120821 - DNA, 20 bp, Artificial Sequence
  chemically synthesized
tgctagtgaaaaaagcacta

SEQ ID NO: 120822 - DNA, 20 bp, Artificial Sequence
  chemically synthesized
tgaaaaaagcactagagatc

SEQ ID NO: 120823 - DNA, 20 bp, Artificial Sequence
  chemically synthesized
attatacctctcttgatctc

SEQ ID NO: 120824 - DNA, 20 bp, Artificial Sequence
  chemically synthesized
aaaaaagcactagagatcaa

SEQ ID NO: 120825 - DNA, 20 bp, Artificial Sequence
  chemically synthesized
aaaagcactagagatcaaga

SEQ ID NO: 120826 - DNA, 20 bp, Artificial Sequence
  chemically synthesized
aaagcactagagatcaagag

SEQ ID NO: 120827 - DNA, 20 bp, Artificial Sequence
  chemically synthesized
gagatcaagagaggtataat

SEQ ID NO: 120828 - DNA, 20 bp, Artificial Sequence
  chemically synthesized
agatcaagagaggtataata

SEQ ID NO: 120829 - DNA, 20 bp, Artificial Sequence
  chemically synthesized
gagaggtataataaggatac

SEQ ID NO: 120830 - DNA, 20 bp, Artificial Sequence
  chemically synthesized
agaggtataataaggataca

SEQ ID NO: 120831 - DNA, 20 bp, Artificial Sequence
  chemically synthesized
tataataaggatacaaggct

SEQ ID NO: 120832 - DNA, 20 bp, Artificial Sequence
  chemically synthesized
aaggatacaaggcttagttt

SEQ ID NO: 120833 - DNA, 20 bp, Artificial Sequence
  chemically synthesized
aggatacaaggcttagtttg

SEQ ID NO: 120834 - DNA, 20 bp, Artificial Sequence
  chemically synthesized
agacagtatctcctcaaact

SEQ ID NO: 120835 - DNA, 20 bp, Artificial Sequence
  chemically synthesized
gatacaaggcttagtttgag

SEQ ID NO: 120836 - DNA, 20 bp, Artificial Sequence
  chemically synthesized
tttgaggagatactgtctat

SEQ ID NO: 120837 - DNA, 20 bp, Artificial Sequence
  chemically synthesized
aaattaacagcgcttataga

SEQ ID NO: 120838 - DNA, 20 bp, Artificial Sequence
  chemically synthesized
atggaaattaacagcgctta

SEQ ID NO: 120839 - DNA, 20 bp, Artificial Sequence
  chemically synthesized
tatatatgaatggaaattaa

SEQ ID NO: 120840 - DNA, 20 bp, Artificial Sequence
  chemically synthesized
catttcccattatatatgaa

SEQ ID NO: 120841 - DNA, 20 bp, Artificial Sequence
  chemically synthesized
taatttccattcatatataa

SEQ ID NO: 120842 - DNA, 20 bp, Artificial Sequence
  chemically synthesized
aatttccattcatatataat

SEQ ID NO: 120843 - DNA, 20 bp, Artificial Sequence
  chemically synthesized
ttcatatataatgggaaatg

SEQ ID NO: 120844 - DNA, 20 bp, Artificial Sequence
  chemically synthesized
ataatgggaaatgaagtgac

SEQ ID NO: 120845 - DNA, 20 bp, Artificial Sequence
  chemically synthesized
ccaatgggaaaatttgtgga

SEQ ID NO: 120846 - DNA, 20 bp, Artificial Sequence
  chemically synthesized
cccaatgggaaaatttgtgg

SEQ ID NO: 120847 - DNA, 20 bp, Artificial Sequence
  chemically synthesized
acccaatgggaaaatttgtg

SEQ ID NO: 120848 - DNA, 20 bp, Artificial Sequence
  chemically synthesized
acacccaatgggaaaatttg

SEQ ID NO: 120849 - DNA, 20 bp, Artificial Sequence
  chemically synthesized
ccctccacaaattttcccat

SEQ ID NO: 120850 - DNA, 20 bp, Artificial Sequence
  chemically synthesized
cctccacaaattttcccatt

SEQ ID NO: 120851 - DNA, 20 bp, Artificial Sequence
  chemically synthesized
tctcactccacacacccaat

SEQ ID NO: 120852 - DNA, 20 bp, Artificial Sequence
  chemically synthesized
atctcactccacacacccaa

SEQ ID NO: 120853 - DNA, 20 bp, Artificial Sequence
  chemically synthesized
aaattttcccattgggtgtg

SEQ ID NO: 120854 - DNA, 20 bp, Artificial Sequence
  chemically synthesized
attttcccattgggtgtgtg

SEQ ID NO: 120855 - DNA, 20 bp, Artificial Sequence
  chemically synthesized
tcccattgggtgtgtggagt

SEQ ID NO: 120856 - DNA, 20 bp, Artificial Sequence
  chemically synthesized
gggtgtgtggagtgagatac

SEQ ID NO: 120857 - DNA, 20 bp, Artificial Sequence
  chemically synthesized
ggtgtgtggagtgagatact

SEQ ID NO: 120858 - DNA, 20 bp, Artificial Sequence
  chemically synthesized
gtggagtgagatactaggat

SEQ ID NO: 120859 - DNA, 20 bp, Artificial Sequence
  chemically synthesized
agctgtacatggtctcatcc

SEQ ID NO: 120860 - DNA, 20 bp, Artificial Sequence
  chemically synthesized
tactaggatgagaccatgta

SEQ ID NO: 120861 - DNA, 20 bp, Artificial Sequence
  chemically synthesized
gatagagttatagctgtaca

SEQ ID NO: 120862 - DNA, 20 bp, Artificial Sequence
  chemically synthesized
tgggattcatgatagagtta

SEQ ID NO: 120863 - DNA, 20 bp, Artificial Sequence
  chemically synthesized
tcactttgggattcatgata

SEQ ID NO: 120864 - DNA, 20 bp, Artificial Sequence
  chemically synthesized
agtcactttgggattcatga

SEQ ID NO: 120865 - DNA, 20 bp, Artificial Sequence
  chemically synthesized
taactctatcatgaatccca

SEQ ID NO: 120866 - DNA, 20 bp, Artificial Sequence
  chemically synthesized
tctgataaataagtcacttt

SEQ ID NO: 120867 - DNA, 20 bp, Artificial Sequence
  chemically synthesized
atctgataaataagtcactt

SEQ ID NO: 120868 - DNA, 20 bp, Artificial Sequence
  chemically synthesized
tcccaaagtgacttatttat

SEQ ID NO: 120869 - DNA, 20 bp, Artificial Sequence
  chemically synthesized
ttacctgttatctgataaat

SEQ ID NO: 120870 - DNA, 20 bp, Artificial Sequence
  chemically synthesized
gtgacttatttatcagataa

SEQ ID NO: 120871 - DNA, 20 bp, Artificial Sequence
  chemically synthesized
tgacttatttatcagataac

SEQ ID NO: 120872 - DNA, 20 bp, Artificial Sequence
  chemically synthesized
ttatttatcagataacaggt

SEQ ID NO: 120873 - DNA, 20 bp, Artificial Sequence
  chemically synthesized
tatttatcagataacaggta

SEQ ID NO: 120874 - DNA, 20 bp, Artificial Sequence
  chemically synthesized
ttatcagataacaggtaagg

SEQ ID NO: 120875 - DNA, 20 bp, Artificial Sequence
  chemically synthesized
aaggcagtgtgcgccatgat

SEQ ID NO: 120876 - DNA, 20 bp, Artificial Sequence
  chemically synthesized
aatatctttctatctcatca

SEQ ID NO: 120877 - DNA, 20 bp, Artificial Sequence
  chemically synthesized
cagtgtgcgccatgatgaga

SEQ ID NO: 120878 - DNA, 20 bp, Artificial Sequence
  chemically synthesized
gtgcgccatgatgagataga

SEQ ID NO: 120879 - DNA, 20 bp, Artificial Sequence
  chemically synthesized
gagatagaaagatattcctt

SEQ ID NO: 120880 - DNA, 20 bp, Artificial Sequence
  chemically synthesized
tagaaagatattcctttgga

SEQ ID NO: 120881 - DNA, 20 bp, Artificial Sequence
  chemically synthesized
gaaagatattcctttggata

SEQ ID NO: 120882 - DNA, 20 bp, Artificial Sequence
  chemically synthesized
actttgataactctatccaa

SEQ ID NO: 120883 - DNA, 20 bp, Artificial Sequence
  chemically synthesized
tactttgataactctatcca

SEQ ID NO: 120884 - DNA, 20 bp, Artificial Sequence
  chemically synthesized
tcctttggatagagttatca

SEQ ID NO: 120885 - DNA, 20 bp, Artificial Sequence
  chemically synthesized
tttggatagagttatcaaag

SEQ ID NO: 120886 - DNA, 20 bp, Artificial Sequence
  chemically synthesized
tatcaaagtagactgataaa

SEQ ID NO: 120887 - DNA, 20 bp, Artificial Sequence
  chemically synthesized
tagctagaagagccatttat

SEQ ID NO: 120888 - DNA, 20 bp, Artificial Sequence
  chemically synthesized
agactgataaatggctcttc

SEQ ID NO: 120889 - DNA, 20 bp, Artificial Sequence
  chemically synthesized
atactgatttatagctagaa

SEQ ID NO: 120890 - DNA, 20 bp, Artificial Sequence
  chemically synthesized
aaatactgatttatagctag

SEQ ID NO: 120891 - DNA, 20 bp, Artificial Sequence
  chemically synthesized
gcaaaatactgatttatagc

SEQ ID NO: 120892 - DNA, 20 bp, Artificial Sequence
  chemically synthesized
tggctcttctagctataaat

SEQ ID NO: 120893 - DNA, 20 bp, Artificial Sequence
  chemically synthesized
aaaagcaaaatactgattta

SEQ ID NO: 120894 - DNA, 20 bp, Artificial Sequence
  chemically synthesized
taaccaagagattaaacaaa

SEQ ID NO: 120895 - DNA, 20 bp, Artificial Sequence
  chemically synthesized
ttgctttttgtttaatctct

SEQ ID NO: 120896 - DNA, 20 bp, Artificial Sequence
  chemically synthesized
aaaagtagtgacataaccaa

SEQ ID NO: 120897 - DNA, 20 bp, Artificial Sequence
  chemically synthesized
acaaaagtagtgacataacc

SEQ ID NO: 120898 - DNA, 20 bp, Artificial Sequence
  chemically synthesized
tttgcccgctgtcacaaaag

SEQ ID NO: 120899 - DNA, 20 bp, Artificial Sequence
  chemically synthesized
ttatgtcactacttttgtga

SEQ ID NO: 120900 - DNA, 20 bp, Artificial Sequence
  chemically synthesized
tcatttgcccgctgtcacaa

SEQ ID NO: 120901 - DNA, 20 bp, Artificial Sequence
  chemically synthesized
tgtcactacttttgtgacag

SEQ ID NO: 120902 - DNA, 20 bp, Artificial Sequence
  chemically synthesized
gtcactacttttgtgacagc

SEQ ID NO: 120903 - DNA, 20 bp, Artificial Sequence
  chemically synthesized
ttttgtgacagcgggcaaat

SEQ ID NO: 120904 - DNA, 20 bp, Artificial Sequence
  chemically synthesized
attttaaaaacgaggaacat

SEQ ID NO: 120905 - DNA, 20 bp, Artificial Sequence
  chemically synthesized
agacttctattttaaaaacg

SEQ ID NO: 120906 - DNA, 20 bp, Artificial Sequence
  chemically synthesized
cagacttctattttaaaaac

SEQ ID NO: 120907 - DNA, 20 bp, Artificial Sequence
  chemically synthesized
tatgttcctcgtttttaaaa

SEQ ID NO: 120908 - DNA, 20 bp, Artificial Sequence
  chemically synthesized
gttcctcgtttttaaaatag

SEQ ID NO: 120909 - DNA, 20 bp, Artificial Sequence
  chemically synthesized
cgtttttaaaatagaagtct

SEQ ID NO: 120910 - DNA, 20 bp, Artificial Sequence
  chemically synthesized
ttaaaatagaagtctgagcc

SEQ ID NO: 120911 - DNA, 20 bp, Artificial Sequence
  chemically synthesized
ctaaactcacggacttggct

SEQ ID NO: 120912 - DNA, 20 bp, Artificial Sequence
  chemically synthesized
gaagtctgagccaagtccgt

SEQ ID NO: 120913 - DNA, 20 bp, Artificial Sequence
  chemically synthesized
accaactaaactcacggact

SEQ ID NO: 120914 - DNA, 20 bp, Artificial Sequence
  chemically synthesized
ctgagccaagtccgtgagtt

SEQ ID NO: 120915 - DNA, 20 bp, Artificial Sequence
  chemically synthesized
ataaataccaactaaactca

SEQ ID NO: 120916 - DNA, 20 bp, Artificial Sequence
  chemically synthesized
gccaagtccgtgagtttagt

SEQ ID NO: 120917 - DNA, 20 bp, Artificial Sequence
  chemically synthesized
actggagcttgggagggttc

SEQ ID NO: 120918 - DNA, 20 bp, Artificial Sequence
  chemically synthesized
ttatcgtcttgaaccctccc

SEQ ID NO: 120919 - DNA, 20 bp, Artificial Sequence
  chemically synthesized
agctaaactggagcttggga

SEQ ID NO: 120920 - DNA, 20 bp, Artificial Sequence
  chemically synthesized
cagctaaactggagcttggg

SEQ ID NO: 120921 - DNA, 20 bp, Artificial Sequence
  chemically synthesized
ccagctaaactggagcttgg

SEQ ID NO: 120922 - DNA, 20 bp, Artificial Sequence
  chemically synthesized
tcttgaaccctcccaagctc

SEQ ID NO: 120923 - DNA, 20 bp, Artificial Sequence
  chemically synthesized
atccagctaaactggagctt

SEQ ID NO: 120924 - DNA, 20 bp, Artificial Sequence
  chemically synthesized
aatccagctaaactggagct

SEQ ID NO: 120925 - DNA, 20 bp, Artificial Sequence
  chemically synthesized
aaccctcccaagctccagtt

SEQ ID NO: 120926 - DNA, 20 bp, Artificial Sequence
  chemically synthesized
tttccaatccagctaaactg

SEQ ID NO: 120927 - DNA, 20 bp, Artificial Sequence
  chemically synthesized
ctcccaagctccagtttagc

SEQ ID NO: 120928 - DNA, 20 bp, Artificial Sequence
  chemically synthesized
tttttccaatccagctaaac

SEQ ID NO: 120929 - DNA, 20 bp, Artificial Sequence
  chemically synthesized
aagctccagtttagctggat

SEQ ID NO: 120930 - DNA, 20 bp, Artificial Sequence
  chemically synthesized
gaggatttgtttttccaatc

SEQ ID NO: 120931 - DNA, 20 bp, Artificial Sequence
  chemically synthesized
attggaaaaacaaatcctca

SEQ ID NO: 120932 - DNA, 20 bp, Artificial Sequence
  chemically synthesized
gtgaaactggatggaccatg

SEQ ID NO: 120933 - DNA, 20 bp, Artificial Sequence
  chemically synthesized
ggtgaaactggatggaccat

SEQ ID NO: 120934 - DNA, 20 bp, Artificial Sequence
  chemically synthesized
acaaatcctcatggtccatc

SEQ ID NO: 120935 - DNA, 20 bp, Artificial Sequence
  chemically synthesized
aatggggtggtgaaactgga

SEQ ID NO: 120936 - DNA, 20 bp, Artificial Sequence
  chemically synthesized
taataatggggtggtgaaac

SEQ ID NO: 120937 - DNA, 20 bp, Artificial Sequence
  chemically synthesized
tgttggctgtaataatgggg

SEQ ID NO: 120938 - DNA, 20 bp, Artificial Sequence
  chemically synthesized
tactgttggctgtaataatg

SEQ ID NO: 120939 - DNA, 20 bp, Artificial Sequence
  chemically synthesized
gtttcaccaccccattatta

SEQ ID NO: 120940 - DNA, 20 bp, Artificial Sequence
  chemically synthesized
ctactgttggctgtaataat

SEQ ID NO: 120941 - DNA, 20 bp, Artificial Sequence
  chemically synthesized
actactgttggctgtaataa

SEQ ID NO: 120942 - DNA, 20 bp, Artificial Sequence
  chemically synthesized
caccccattattacagccaa

SEQ ID NO: 120943 - DNA, 20 bp, Artificial Sequence
  chemically synthesized
cccattattacagccaacag

SEQ ID NO: 120944 - DNA, 20 bp, Artificial Sequence
  chemically synthesized
attatttctaaaactactgt

SEQ ID NO: 120945 - DNA, 20 bp, Artificial Sequence
  chemically synthesized
attacagccaacagtagttt

SEQ ID NO: 120946 - DNA, 20 bp, Artificial Sequence
  chemically synthesized
cttggagaagcattcataaa

SEQ ID NO: 120947 - DNA, 20 bp, Artificial Sequence
  chemically synthesized
tcttggagaagcattcataa

SEQ ID NO: 120948 - DNA, 20 bp, Artificial Sequence
  chemically synthesized
ccttttatgaatgcttctcc

SEQ ID NO: 120949 - DNA, 20 bp, Artificial Sequence
  chemically synthesized
ttttatgaatgcttctccaa

SEQ ID NO: 120950 - DNA, 20 bp, Artificial Sequence
  chemically synthesized
tttatgaatgcttctccaag

SEQ ID NO: 120951 - DNA, 20 bp, Artificial Sequence
  chemically synthesized
aatatcaatgcctcttggag

SEQ ID NO: 120952 - DNA, 20 bp, Artificial Sequence
  chemically synthesized
gagaatatcaatgcctcttg

SEQ ID NO: 120953 - DNA, 20 bp, Artificial Sequence
  chemically synthesized
cagagaatatcaatgcctct

SEQ ID NO: 120954 - DNA, 20 bp, Artificial Sequence
  chemically synthesized
gaaaagtccacatgataaca

SEQ ID NO: 120955 - DNA, 20 bp, Artificial Sequence
  chemically synthesized
cagaaaagtccacatgataa

SEQ ID NO: 120956 - DNA, 20 bp, Artificial Sequence
  chemically synthesized
tgatattctctgttatcatg

SEQ ID NO: 120957 - DNA, 20 bp, Artificial Sequence
  chemically synthesized
tgttatcatgtggacttttc

SEQ ID NO: 120958 - DNA, 20 bp, Artificial Sequence
  chemically synthesized
ttctgcagatgataccagaa

SEQ ID NO: 120959 - DNA, 20 bp, Artificial Sequence
  chemically synthesized
gattattctgcagatgatac

SEQ ID NO: 120960 - DNA, 20 bp, Artificial Sequence
  chemically synthesized
gacttttctggtatcatctg

SEQ ID NO: 120961 - DNA, 20 bp, Artificial Sequence
  chemically synthesized
acttctccgggattattctg

SEQ ID NO: 120962 - DNA, 20 bp, Artificial Sequence
  chemically synthesized
tatcatctgcagaataatcc

SEQ ID NO: 120963 - DNA, 20 bp, Artificial Sequence
  chemically synthesized
tcatctgcagaataatcccg

SEQ ID NO: 120964 - DNA, 20 bp, Artificial Sequence
  chemically synthesized
tctgcagaataatcccggag

SEQ ID NO: 120965 - DNA, 20 bp, Artificial Sequence
  chemically synthesized
cttggccctgaaacttctcc

SEQ ID NO: 120966 - DNA, 20 bp, Artificial Sequence
  chemically synthesized
acttggccctgaaacttctc

SEQ ID NO: 120967 - DNA, 20 bp, Artificial Sequence
  chemically synthesized
gaataatcccggagaagttt

SEQ ID NO: 120968 - DNA, 20 bp, Artificial Sequence
  chemically synthesized
aataatcccggagaagtttc

SEQ ID NO: 120969 - DNA, 20 bp, Artificial Sequence
  chemically synthesized
ataatcccggagaagtttca

SEQ ID NO: 120970 - DNA, 20 bp, Artificial Sequence
  chemically synthesized
cccggagaagtttcagggcc

SEQ ID NO: 120971 - DNA, 20 bp, Artificial Sequence
  chemically synthesized
tgtagatgtggcaaatgact

SEQ ID NO: 120972 - DNA, 20 bp, Artificial Sequence
  chemically synthesized
gtggcagacaaatgtagatg

SEQ ID NO: 120973 - DNA, 20 bp, Artificial Sequence
  chemically synthesized
ccgccagtggcagacaaatg

SEQ ID NO: 120974 - DNA, 20 bp, Artificial Sequence
  chemically synthesized
catctacatttgtctgccac

SEQ ID NO: 120975 - DNA, 20 bp, Artificial Sequence
  chemically synthesized
ctacatttgtctgccactgg

SEQ ID NO: 120976 - DNA, 20 bp, Artificial Sequence
  chemically synthesized
ccaaagacctccgccagtgg

SEQ ID NO: 120977 - DNA, 20 bp, Artificial Sequence
  chemically synthesized
acatttgtctgccactggcg

SEQ ID NO: 120978 - DNA, 20 bp, Artificial Sequence
  chemically synthesized
catttgtctgccactggcgg

SEQ ID NO: 120979 - DNA, 20 bp, Artificial Sequence
  chemically synthesized
tggccaaagacctccgccag

SEQ ID NO: 120980 - DNA, 20 bp, Artificial Sequence
  chemically synthesized
agttggccaaagacctccgc

SEQ ID NO: 120981 - DNA, 20 bp, Artificial Sequence
  chemically synthesized
ctgccactggcggaggtctt

SEQ ID NO: 120982 - DNA, 20 bp, Artificial Sequence
  chemically synthesized
aaatctatagcagttggcca

SEQ ID NO: 120983 - DNA, 20 bp, Artificial Sequence
  chemically synthesized
aggtctttggccaactgcta

SEQ ID NO: 120984 - DNA, 20 bp, Artificial Sequence
  chemically synthesized
tcataaaaatctatagcagt

SEQ ID NO: 120985 - DNA, 20 bp, Artificial Sequence
  chemically synthesized
tttctcataaaaatctatag

SEQ ID NO: 120986 - DNA, 20 bp, Artificial Sequence
  chemically synthesized
ctctttctcataaaaatcta

SEQ ID NO: 120987 - DNA, 20 bp, Artificial Sequence
  chemically synthesized
caactgctatagatttttat

SEQ ID NO: 120988 - DNA, 20 bp, Artificial Sequence
  chemically synthesized
tgctatagatttttatgaga

SEQ ID NO: 120989 - DNA, 20 bp, Artificial Sequence
  chemically synthesized
ctatagatttttatgagaaa

SEQ ID NO: 120990 - DNA, 20 bp, Artificial Sequence
  chemically synthesized
atgagaaagagaatgaatgt

SEQ ID NO: 120991 - DNA, 20 bp, Artificial Sequence
  chemically synthesized
agttttttttatgaaatctc

SEQ ID NO: 120992 - DNA, 20 bp, Artificial Sequence
  chemically synthesized
ttttttatgaaatctctagt

SEQ ID NO: 120993 - DNA, 20 bp, Artificial Sequence
  chemically synthesized
ttttatgaaatctctagttg

SEQ ID NO: 120994 - DNA, 20 bp, Artificial Sequence
  chemically synthesized
attttaagacactccaacta

SEQ ID NO: 120995 - DNA, 20 bp, Artificial Sequence
  chemically synthesized
gtattttaagacactccaac

SEQ ID NO: 120996 - DNA, 20 bp, Artificial Sequence
  chemically synthesized
agctgtttacgaagtatttt

SEQ ID NO: 120997 - DNA, 20 bp, Artificial Sequence
  chemically synthesized
gtcttaaaatacttcgtaaa

SEQ ID NO: 120998 - DNA, 20 bp, Artificial Sequence
  chemically synthesized
ggattcagaagctgtttacg

SEQ ID NO: 120999 - DNA, 20 bp, Artificial Sequence
  chemically synthesized
attctgacctgaggattcag

SEQ ID NO: 121000 - DNA, 20 bp, Artificial Sequence
  chemically synthesized
gtaaacagcttctgaatcct

SEQ ID NO: 121001 - DNA, 20 bp, Artificial Sequence
  chemically synthesized
taaacagcttctgaatcctc

SEQ ID NO: 121002 - DNA, 20 bp, Artificial Sequence
  chemically synthesized
tgtattctgacctgaggatt

SEQ ID NO: 121003 - DNA, 20 bp, Artificial Sequence
  chemically synthesized
cagcttctgaatcctcaggt

SEQ ID NO: 121004 - DNA, 20 bp, Artificial Sequence
  chemically synthesized
aatatatgtattctgacctg

SEQ ID NO: 121005 - DNA, 20 bp, Artificial Sequence
  chemically synthesized
taatatatgtattctgacct

SEQ ID NO: 121006 - DNA, 20 bp, Artificial Sequence
  chemically synthesized
tcaggtcagaatacatatat

SEQ ID NO: 121007 - DNA, 20 bp, Artificial Sequence
  chemically synthesized
taaatcatatggtaggttaa

SEQ ID NO: 121008 - DNA, 20 bp, Artificial Sequence
  chemically synthesized
gattgactaaatcatatggt

SEQ ID NO: 121009 - DNA, 20 bp, Artificial Sequence
  chemically synthesized
tgattgactaaatcatatgg

SEQ ID NO: 121010 - DNA, 20 bp, Artificial Sequence
  chemically synthesized
ttttaacctaccatatgatt

SEQ ID NO: 121011 - DNA, 20 bp, Artificial Sequence
  chemically synthesized
tcatgattgactaaatcata

SEQ ID NO: 121012 - DNA, 20 bp, Artificial Sequence
  chemically synthesized
tatgatttagtcaatcatga

SEQ ID NO: 121013 - DNA, 20 bp, Artificial Sequence
  chemically synthesized
ttagtcaatcatgacagtat

SEQ ID NO: 121014 - DNA, 20 bp, Artificial Sequence
  chemically synthesized
tagtcaatcatgacagtata

SEQ ID NO: 121015 - DNA, 20 bp, Artificial Sequence
  chemically synthesized
gtataaggtaacccaccttt

SEQ ID NO: 121016 - DNA, 20 bp, Artificial Sequence
  chemically synthesized
tataaggtaacccacctttc

SEQ ID NO: 121017 - DNA, 20 bp, Artificial Sequence
  chemically synthesized
aaaagtttgtcctgaaaggt

SEQ ID NO: 121018 - DNA, 20 bp, Artificial Sequence
  chemically synthesized
gaaaagtttgtcctgaaagg

SEQ ID NO: 121019 - DNA, 20 bp, Artificial Sequence
  chemically synthesized
tttgaaaagtttgtcctgaa

SEQ ID NO: 121020 - DNA, 20 bp, Artificial Sequence
  chemically synthesized
atttgaaaagtttgtcctga

SEQ ID NO: 121021 - DNA, 20 bp, Artificial Sequence
  chemically synthesized
ctcaagatgctgcatttgaa

SEQ ID NO: 121022 - DNA, 20 bp, Artificial Sequence
  chemically synthesized
caggacaaacttttcaaatg

SEQ ID NO: 121023 - DNA, 20 bp, Artificial Sequence
  chemically synthesized
cttttcaaatgcagcatctt

SEQ ID NO: 121024 - DNA, 20 bp, Artificial Sequence
  chemically synthesized
cttgatactggttattgctc

SEQ ID NO: 121025 - DNA, 20 bp, Artificial Sequence
  chemically synthesized
gcagcatcttgagcaataac

SEQ ID NO: 121026 - DNA, 20 bp, Artificial Sequence
  chemically synthesized
cttgagcaataaccagtatc

SEQ ID NO: 121027 - DNA, 20 bp, Artificial Sequence
  chemically synthesized
taagttgaaatacttgatac

SEQ ID NO: 121028 - DNA, 20 bp, Artificial Sequence
  chemically synthesized
cagtatcaagtatttcaact

SEQ ID NO: 121029 - DNA, 20 bp, Artificial Sequence
  chemically synthesized
tatcaagtatttcaacttag

SEQ ID NO: 121030 - DNA, 20 bp, Artificial Sequence
  chemically synthesized
attgccaattaattgctact

SEQ ID NO: 121031 - DNA, 20 bp, Artificial Sequence
  chemically synthesized
tcaacttagtagcaattaat

SEQ ID NO: 121032 - DNA, 20 bp, Artificial Sequence
  chemically synthesized
gtagcaattaattggcaata

SEQ ID NO: 121033 - DNA, 20 bp, Artificial Sequence
  chemically synthesized
gcaattaattggcaataaag

SEQ ID NO: 121034 - DNA, 20 bp, Artificial Sequence
  chemically synthesized
caattaattggcaataaagt

SEQ ID NO: 121035 - DNA, 20 bp, Artificial Sequence
  chemically synthesized
ctcttgtgataaaaacaatt

SEQ ID NO: 121036 - DNA, 20 bp, Artificial Sequence
  chemically synthesized
ggcttaattgtttttatcac

SEQ ID NO: 121037 - DNA, 20 bp, Artificial Sequence
  chemically synthesized
cttaattgtttttatcacaa

SEQ ID NO: 121038 - DNA, 20 bp, Artificial Sequence
  chemically synthesized
gagaaaaaaactacaaaaat

SEQ ID NO: 121039 - DNA, 20 bp, Artificial Sequence
  chemically synthesized
tatatatgagcttatttttg

SEQ ID NO: 121040 - DNA, 20 bp, Artificial Sequence
  chemically synthesized
catattcaacaattatatat

SEQ ID NO: 121041 - DNA, 20 bp, Artificial Sequence
  chemically synthesized
aagagggaaagaaatgtatg

SEQ ID NO: 121042 - DNA, 20 bp, Artificial Sequence
  chemically synthesized
gaagagggaaagaaatgtat

SEQ ID NO: 121043 - DNA, 20 bp, Artificial Sequence
  chemically synthesized
aacaagttaatgaagaggga

SEQ ID NO: 121044 - DNA, 20 bp, Artificial Sequence
  chemically synthesized
attcaacaagttaatgaaga

SEQ ID NO: 121045 - DNA, 20 bp, Artificial Sequence
  chemically synthesized
aattcaacaagttaatgaag

SEQ ID NO: 121046 - DNA, 20 bp, Artificial Sequence
  chemically synthesized
caattcaacaagttaatgaa

SEQ ID NO: 121047 - DNA, 20 bp, Artificial Sequence
  chemically synthesized
aacaattcaacaagttaatg

SEQ ID NO: 121048 - DNA, 20 bp, Artificial Sequence
  chemically synthesized
aattacataaacaattcaac

SEQ ID NO: 121049 - DNA, 20 bp, Artificial Sequence
  chemically synthesized
tgttgaattgtttatgtaat

SEQ ID NO: 121050 - DNA, 20 bp, Artificial Sequence
  chemically synthesized
atgtaattagtgccatctac

SEQ ID NO: 121051 - DNA, 20 bp, Artificial Sequence
  chemically synthesized
tttagttgaacgccagtaga

SEQ ID NO: 121052 - DNA, 20 bp, Artificial Sequence
  chemically synthesized
caggtttagttgaacgccag

SEQ ID NO: 121053 - DNA, 20 bp, Artificial Sequence
  chemically synthesized
atgcaggtttagttgaacgc

SEQ ID NO: 121054 - DNA, 20 bp, Artificial Sequence
  chemically synthesized
atattttctgtatgcaggtt

SEQ ID NO: 121055 - DNA, 20 bp, Artificial Sequence
  chemically synthesized
cgttcaactaaacctgcata

SEQ ID NO: 121056 - DNA, 20 bp, Artificial Sequence
  chemically synthesized
gttcaatattttctgtatgc

SEQ ID NO: 121057 - DNA, 20 bp, Artificial Sequence
  chemically synthesized
tgttcaatattttctgtatg

SEQ ID NO: 121058 - DNA, 20 bp, Artificial Sequence
  chemically synthesized
cagaaaatattgaacaacaa

SEQ ID NO: 121059 - DNA, 20 bp, Artificial Sequence
  chemically synthesized
aatattgaacaacaaaagaa

SEQ ID NO: 121060 - DNA, 20 bp, Artificial Sequence
  chemically synthesized
aaagaatagtactgttattc

SEQ ID NO: 121061 - DNA, 20 bp, Artificial Sequence
  chemically synthesized
aaaattcgtgactagaataa

SEQ ID NO: 121062 - DNA, 20 bp, Artificial Sequence
  chemically synthesized
tccttcaaaaaattcgtgac

SEQ ID NO: 121063 - DNA, 20 bp, Artificial Sequence
  chemically synthesized
ttctagtcacgaattttttg

SEQ ID NO: 121064 - DNA, 20 bp, Artificial Sequence
  chemically synthesized
tctagtcacgaattttttga

SEQ ID NO: 121065 - DNA, 20 bp, Artificial Sequence
  chemically synthesized
ttgaaggatcaaaatacttt

SEQ ID NO: 121066 - DNA, 20 bp, Artificial Sequence
  chemically synthesized
tttaaagtaaggtattctaa

SEQ ID NO: 121067 - DNA, 20 bp, Artificial Sequence
  chemically synthesized
ttttttctaattttaaagta

SEQ ID NO: 121068 - DNA, 20 bp, Artificial Sequence
  chemically synthesized
tttttttctaattttaaagt

SEQ ID NO: 121069 - DNA, 20 bp, Artificial Sequence
  chemically synthesized
agaataccttactttaaaat

SEQ ID NO: 121070 - DNA, 20 bp, Artificial Sequence
  chemically synthesized
tgactttttttctaatttta

SEQ ID NO: 121071 - DNA, 20 bp, Artificial Sequence
  chemically synthesized
ttactttaaaattagaaaaa

SEQ ID NO: 121072 - DNA, 20 bp, Artificial Sequence
  chemically synthesized
tagaaaaaaagtcaaaatat

SEQ ID NO: 121073 - DNA, 20 bp, Artificial Sequence
  chemically synthesized
tgtaggtgatttggtttagt

SEQ ID NO: 121074 - DNA, 20 bp, Artificial Sequence
  chemically synthesized
aaaatgtaggtgatttggtt

SEQ ID NO: 121075 - DNA, 20 bp, Artificial Sequence
  chemically synthesized
cgaagaaaatgtaggtgatt

SEQ ID NO: 121076 - DNA, 20 bp, Artificial Sequence
  chemically synthesized
acaaacaacgaagaaaatgt

SEQ ID NO: 121077 - DNA, 20 bp, Artificial Sequence
  chemically synthesized
gacaaacaacgaagaaaatg

SEQ ID NO: 121078 - DNA, 20 bp, Artificial Sequence
  chemically synthesized
attgccaaagacaaacaacg

SEQ ID NO: 121079 - DNA, 20 bp, Artificial Sequence
  chemically synthesized
ttttcttcgttgtttgtctt

SEQ ID NO: 121080 - DNA, 20 bp, Artificial Sequence
  chemically synthesized
ttgaaaacactgaattgcca

SEQ ID NO: 121081 - DNA, 20 bp, Artificial Sequence
  chemically synthesized
gttgtttgtctttggcaatt

SEQ ID NO: 121082 - DNA, 20 bp, Artificial Sequence
  chemically synthesized
gtttcaagtgatgagatagc

SEQ ID NO: 121083 - DNA, 20 bp, Artificial Sequence
  chemically synthesized
atatgtttcaagtgatgaga

SEQ ID NO: 121084 - DNA, 20 bp, Artificial Sequence
  chemically synthesized
tgaaatatgtttcaagtgat

SEQ ID NO: 121085 - DNA, 20 bp, Artificial Sequence
  chemically synthesized
ctttctttgaaatatgtttc

SEQ ID NO: 121086 - DNA, 20 bp, Artificial Sequence
  chemically synthesized
atcacttgaaacatatttca

SEQ ID NO: 121087 - DNA, 20 bp, Artificial Sequence
  chemically synthesized
cttgaaacatatttcaaaga

SEQ ID NO: 121088 - DNA, 20 bp, Artificial Sequence
  chemically synthesized
gaaacatatttcaaagaaag

SEQ ID NO: 121089 - DNA, 20 bp, Artificial Sequence
  chemically synthesized
caaagaaagaagtcaattaa

SEQ ID NO: 121090 - DNA, 20 bp, Artificial Sequence
  chemically synthesized
agaaagaagtcaattaatgg

SEQ ID NO: 121091 - DNA, 20 bp, Artificial Sequence
  chemically synthesized
gaaagaagtcaattaatggt

SEQ ID NO: 121092 - DNA, 20 bp, Artificial Sequence
  chemically synthesized
taatggtaggttttatctcg

SEQ ID NO: 121093 - DNA, 20 bp, Artificial Sequence
  chemically synthesized
atttcaggttgatatgcttc

SEQ ID NO: 121094 - DNA, 20 bp, Artificial Sequence
  chemically synthesized
aaatgtttaatagaaatttc

SEQ ID NO: 121095 - DNA, 20 bp, Artificial Sequence
  chemically synthesized
gaaatgtttaatagaaattt

SEQ ID NO: 121096 - DNA, 20 bp, Artificial Sequence
  chemically synthesized
gcacttgcagaaatgtttaa

SEQ ID NO: 121097 - DNA, 20 bp, Artificial Sequence
  chemically synthesized
tttctattaaacatttctgc

SEQ ID NO: 121098 - DNA, 20 bp, Artificial Sequence
  chemically synthesized
attaaacatttctgcaagtg

SEQ ID NO: 121099 - DNA, 20 bp, Artificial Sequence
  chemically synthesized
aagcctcctctctgcacttg

SEQ ID NO: 121100 - DNA, 20 bp, Artificial Sequence
  chemically synthesized
taaacatttctgcaagtgca

SEQ ID NO: 121101 - DNA, 20 bp, Artificial Sequence
  chemically synthesized
aacatttctgcaagtgcaga

SEQ ID NO: 121102 - DNA, 20 bp, Artificial Sequence
  chemically synthesized
acatttctgcaagtgcagag

SEQ ID NO: 121103 - DNA, 20 bp, Artificial Sequence
  chemically synthesized
atttctgcaagtgcagagag

SEQ ID NO: 121104 - DNA, 20 bp, Artificial Sequence
  chemically synthesized
tttctgcaagtgcagagagg

SEQ ID NO: 121105 - DNA, 20 bp, Artificial Sequence
  chemically synthesized
agtgcagagaggaggcttct

SEQ ID NO: 121106 - DNA, 20 bp, Artificial Sequence
  chemically synthesized
agtattatcttaatgcttag

SEQ ID NO: 121107 - DNA, 20 bp, Artificial Sequence
  chemically synthesized
agaggaggcttctaagcatt

SEQ ID NO: 121108 - DNA, 20 bp, Artificial Sequence
  chemically synthesized
attagtattatcttaatgct

SEQ ID NO: 121109 - DNA, 20 bp, Artificial Sequence
  chemically synthesized
ttaagataatactaattgtt

SEQ ID NO: 121110 - DNA, 20 bp, Artificial Sequence
  chemically synthesized
gatataactatcttaacaat

SEQ ID NO: 121111 - DNA, 20 bp, Artificial Sequence
  chemically synthesized
gataatactaattgttaaga

SEQ ID NO: 121112 - DNA, 20 bp, Artificial Sequence
  chemically synthesized
gatagttatatcaaattcaa

SEQ ID NO: 121113 - DNA, 20 bp, Artificial Sequence
  chemically synthesized
atagttatatcaaattcaat

SEQ ID NO: 121114 - DNA, 20 bp, Artificial Sequence
  chemically synthesized
ttatatcaaattcaatagga

SEQ ID NO: 121115 - DNA, 20 bp, Artificial Sequence
  chemically synthesized
tatatcaaattcaataggat

SEQ ID NO: 121116 - DNA, 20 bp, Artificial Sequence
  chemically synthesized
caaattcaataggatgggtt

SEQ ID NO: 121117 - DNA, 20 bp, Artificial Sequence
  chemically synthesized
tgggttaagtcattgataaa

SEQ ID NO: 121118 - DNA, 20 bp, Artificial Sequence
  chemically synthesized
aagtcattgataaatggaca

SEQ ID NO: 121119 - DNA, 20 bp, Artificial Sequence
  chemically synthesized
agtcattgataaatggacac

SEQ ID NO: 121120 - DNA, 20 bp, Artificial Sequence
  chemically synthesized
ttgataaatggacacaggaa

SEQ ID NO: 121121 - DNA, 20 bp, Artificial Sequence
  chemically synthesized
tgataaatggacacaggaat

SEQ ID NO: 121122 - DNA, 20 bp, Artificial Sequence
  chemically synthesized
aatggacacaggaataggaa

SEQ ID NO: 121123 - DNA, 20 bp, Artificial Sequence
  chemically synthesized
atggacacaggaataggaac

SEQ ID NO: 121124 - DNA, 20 bp, Artificial Sequence
  chemically synthesized
gacacaggaataggaacagg

SEQ ID NO: 121125 - DNA, 20 bp, Artificial Sequence
  chemically synthesized
taggaacaggtagttcaaac

SEQ ID NO: 121126 - DNA, 20 bp, Artificial Sequence
  chemically synthesized
ggaacaggtagttcaaacaa

SEQ ID NO: 121127 - DNA, 20 bp, Artificial Sequence
  chemically synthesized
caggtagttcaaacaagaga

SEQ ID NO: 121128 - DNA, 20 bp, Artificial Sequence
  chemically synthesized
ggtagttcaaacaagagaaa

SEQ ID NO: 121129 - DNA, 20 bp, Artificial Sequence
  chemically synthesized
agttcaaacaagagaaagag

SEQ ID NO: 121130 - DNA, 20 bp, Artificial Sequence
  chemically synthesized
gttcaaacaagagaaagagt

SEQ ID NO: 121131 - DNA, 20 bp, Artificial Sequence
  chemically synthesized
gtgggatgattttatttaaa

SEQ ID NO: 121132 - DNA, 20 bp, Artificial Sequence
  chemically synthesized
gattttatttaaaaagaaaa

SEQ ID NO: 121133 - DNA, 20 bp, Artificial Sequence
  chemically synthesized
aaagaaaaaagttaactttc

SEQ ID NO: 121134 - DNA, 20 bp, Artificial Sequence
  chemically synthesized
ctctattttttattacttga

SEQ ID NO: 121135 - DNA, 20 bp, Artificial Sequence
  chemically synthesized
aactttcaagtaataaaaaa

SEQ ID NO: 121136 - DNA, 20 bp, Artificial Sequence
  chemically synthesized
ctttcaagtaataaaaaata

SEQ ID NO: 121137 - DNA, 20 bp, Artificial Sequence
  chemically synthesized
aaatagagtattaaattgaa

SEQ ID NO: 121138 - DNA, 20 bp, Artificial Sequence
  chemically synthesized
aatagagtattaaattgaaa

SEQ ID NO: 121139 - DNA, 20 bp, Artificial Sequence
  chemically synthesized
ttaaattgaaaaggtacaat

SEQ ID NO: 121140 - DNA, 20 bp, Artificial Sequence
  chemically synthesized
ttattttttgttaatttaat

SEQ ID NO: 121141 - DNA, 20 bp, Artificial Sequence
  chemically synthesized
ttaacaaaaaataaaatcca

SEQ ID NO: 121142 - DNA, 20 bp, Artificial Sequence
  chemically synthesized
tttactggtcttttcagctt

SEQ ID NO: 121143 - DNA, 20 bp, Artificial Sequence
  chemically synthesized
aaataaaatccaaagctgaa

SEQ ID NO: 121144 - DNA, 20 bp, Artificial Sequence
  chemically synthesized
aaatccaaagctgaaaagac

SEQ ID NO: 121145 - DNA, 20 bp, Artificial Sequence
  chemically synthesized
gctagttttactggtctttt

SEQ ID NO: 121146 - DNA, 20 bp, Artificial Sequence
  chemically synthesized
gctgaaaagaccagtaaaac

SEQ ID NO: 121147 - DNA, 20 bp, Artificial Sequence
  chemically synthesized
cgtgaatgtgctagttttac

SEQ ID NO: 121148 - DNA, 20 bp, Artificial Sequence
  chemically synthesized
gcagtaatacgtgaatgtgc

SEQ ID NO: 121149 - DNA, 20 bp, Artificial Sequence
  chemically synthesized
gcacattcacgtattactgc

SEQ ID NO: 121150 - DNA, 20 bp, Artificial Sequence
  chemically synthesized
cacattcacgtattactgct

SEQ ID NO: 121151 - DNA, 20 bp, Artificial Sequence
  chemically synthesized
acattcacgtattactgctg

SEQ ID NO: 121152 - DNA, 20 bp, Artificial Sequence
  chemically synthesized
taatagataacggtccccag

SEQ ID NO: 121153 - DNA, 20 bp, Artificial Sequence
  chemically synthesized
tcctaatagataacggtccc

SEQ ID NO: 121154 - DNA, 20 bp, Artificial Sequence
  chemically synthesized
caaattgtcctaatagataa

SEQ ID NO: 121155 - DNA, 20 bp, Artificial Sequence
  chemically synthesized
tgctggggaccgttatctat

SEQ ID NO: 121156 - DNA, 20 bp, Artificial Sequence
  chemically synthesized
gctggggaccgttatctatt

SEQ ID NO: 121157 - DNA, 20 bp, Artificial Sequence
  chemically synthesized
ctattgccaaattgtcctaa

SEQ ID NO: 121158 - DNA, 20 bp, Artificial Sequence
  chemically synthesized
cgttatctattaggacaatt

SEQ ID NO: 121159 - DNA, 20 bp, Artificial Sequence
  chemically synthesized
ctattaggacaatttggcaa

SEQ ID NO: 121160 - DNA, 20 bp, Artificial Sequence
  chemically synthesized
acaatttggcaatagatacc

SEQ ID NO: 121161 - DNA, 20 bp, Artificial Sequence
  chemically synthesized
ataagcatttgtatgtcact

SEQ ID NO: 121162 - DNA, 20 bp, Artificial Sequence
  chemically synthesized
attattgagtcaatgggaat

SEQ ID NO: 121163 - DNA, 20 bp, Artificial Sequence
  chemically synthesized
agtgagattattgagtcaat

SEQ ID NO: 121164 - DNA, 20 bp, Artificial Sequence
  chemically synthesized
aagtgagattattgagtcaa

SEQ ID NO: 121165 - DNA, 20 bp, Artificial Sequence
  chemically synthesized
gtaccaaaagtgagattatt

SEQ ID NO: 121166 - DNA, 20 bp, Artificial Sequence
  chemically synthesized
tgactcaataatctcacttt

SEQ ID NO: 121167 - DNA, 20 bp, Artificial Sequence
  chemically synthesized
caggataaagtaccaaaagt

SEQ ID NO: 121168 - DNA, 20 bp, Artificial Sequence
  chemically synthesized
ttatcaggataaagtaccaa

SEQ ID NO: 121169 - DNA, 20 bp, Artificial Sequence
  chemically synthesized
ttgaagattttatcaggata

SEQ ID NO: 121170 - DNA, 20 bp, Artificial Sequence
  chemically synthesized
cttcttttgaagattttatc

SEQ ID NO: 121171 - DNA, 20 bp, Artificial Sequence
  chemically synthesized
tcttcttttgaagattttat

SEQ ID NO: 121172 - DNA, 20 bp, Artificial Sequence
  chemically synthesized
tatcctgataaaatcttcaa

SEQ ID NO: 121173 - DNA, 20 bp, Artificial Sequence
  chemically synthesized
cctgataaaatcttcaaaag

SEQ ID NO: 121174 - DNA, 20 bp, Artificial Sequence
  chemically synthesized
agtatattgatcttcttttg

SEQ ID NO: 121175 - DNA, 20 bp, Artificial Sequence
  chemically synthesized
aatgaagattttaagtcata

SEQ ID NO: 121176 - DNA, 20 bp, Artificial Sequence
  chemically synthesized
ctttggttaatgaagatttt

SEQ ID NO: 121177 - DNA, 20 bp, Artificial Sequence
  chemically synthesized
ttttactgctttggttaatg

SEQ ID NO: 121178 - DNA, 20 bp, Artificial Sequence
  chemically synthesized
cttaaaatcttcattaacca

SEQ ID NO: 121179 - DNA, 20 bp, Artificial Sequence
  chemically synthesized
aaaatcttcattaaccaaag

SEQ ID NO: 121180 - DNA, 20 bp, Artificial Sequence
  chemically synthesized
ttctcatttttttactgctt

SEQ ID NO: 121181 - DNA, 20 bp, Artificial Sequence
  chemically synthesized
aaccaaagcagtaaaaaaat

SEQ ID NO: 121182 - DNA, 20 bp, Artificial Sequence
  chemically synthesized
agcagtaaaaaaatgagaaa

SEQ ID NO: 121183 - DNA, 20 bp, Artificial Sequence
  chemically synthesized
gcagtaaaaaaatgagaaac

SEQ ID NO: 121184 - DNA, 20 bp, Artificial Sequence
  chemically synthesized
taaaaaaatgagaaacaggc

SEQ ID NO: 121185 - DNA, 20 bp, Artificial Sequence
  chemically synthesized
aaaaaaatgagaaacaggcc

SEQ ID NO: 121186 - DNA, 20 bp, Artificial Sequence
  chemically synthesized
aatgagaaacaggccgggtg

SEQ ID NO: 121187 - DNA, 20 bp, Artificial Sequence
  chemically synthesized
gagaaacaggccgggtgcgg

SEQ ID NO: 121188 - DNA, 20 bp, Artificial Sequence
  chemically synthesized
caggcatgagccaccgcacc

SEQ ID NO: 121189 - DNA, 20 bp, Artificial Sequence
  chemically synthesized
agtgctgggattacaggcat

SEQ ID NO: 121190 - DNA, 20 bp, Artificial Sequence
  chemically synthesized
gtggctcatgcctgtaatcc

SEQ ID NO: 121191 - DNA, 20 bp, Artificial Sequence
  chemically synthesized
tccctaagtgctgggattac

SEQ ID NO: 121192 - DNA, 20 bp, Artificial Sequence
  chemically synthesized
ctccctaagtgctgggatta

SEQ ID NO: 121193 - DNA, 20 bp, Artificial Sequence
  chemically synthesized
atgcctgtaatcccagcact

SEQ ID NO: 121194 - DNA, 20 bp, Artificial Sequence
  chemically synthesized
tgcctgtaatcccagcactt

SEQ ID NO: 121195 - DNA, 20 bp, Artificial Sequence
  chemically synthesized
ccttggcctccctaagtgct

SEQ ID NO: 121196 - DNA, 20 bp, Artificial Sequence
  chemically synthesized
gcctgtaatcccagcactta

SEQ ID NO: 121197 - DNA, 20 bp, Artificial Sequence
  chemically synthesized
gccttggcctccctaagtgc

SEQ ID NO: 121198 - DNA, 20 bp, Artificial Sequence
  chemically synthesized
ctgtaatcccagcacttagg

SEQ ID NO: 121199 - DNA, 20 bp, Artificial Sequence
  chemically synthesized
tgtaatcccagcacttaggg

SEQ ID NO: 121200 - DNA, 20 bp, Artificial Sequence
  chemically synthesized
ccacccgccttggcctccct

SEQ ID NO: 121201 - DNA, 20 bp, Artificial Sequence
  chemically synthesized
tcccagcacttagggaggcc

SEQ ID NO: 121202 - DNA, 20 bp, Artificial Sequence
  chemically synthesized
cccagcacttagggaggcca

SEQ ID NO: 121203 - DNA, 20 bp, Artificial Sequence
  chemically synthesized
agcacttagggaggccaagg

SEQ ID NO: 121204 - DNA, 20 bp, Artificial Sequence
  chemically synthesized
gcacttagggaggccaaggc

SEQ ID NO: 121205 - DNA, 20 bp, Artificial Sequence
  chemically synthesized
cttagggaggccaaggcggg

SEQ ID NO: 121206 - DNA, 20 bp, Artificial Sequence
  chemically synthesized
acctcgtgatccacccgcct

SEQ ID NO: 121207 - DNA, 20 bp, Artificial Sequence
  chemically synthesized
ggccaaggcgggtggatcac

SEQ ID NO: 121208 - DNA, 20 bp, Artificial Sequence
  chemically synthesized
gccaaggcgggtggatcacg

SEQ ID NO: 121209 - DNA, 20 bp, Artificial Sequence
  chemically synthesized
aggcgggtggatcacgaggt

SEQ ID NO: 121210 - DNA, 20 bp, Artificial Sequence
  chemically synthesized
ggcgggtggatcacgaggtc

SEQ ID NO: 121211 - DNA, 20 bp, Artificial Sequence
  chemically synthesized
cgggtggatcacgaggtcag

SEQ ID NO: 121212 - DNA, 20 bp, Artificial Sequence
  chemically synthesized
gatcacgaggtcaggagttc

SEQ ID NO: 121213 - DNA, 20 bp, Artificial Sequence
  chemically synthesized
cgaggtcaggagttcaagac

SEQ ID NO: 121214 - DNA, 20 bp, Artificial Sequence
  chemically synthesized
tcaggagttcaagaccagtc

SEQ ID NO: 121215 - DNA, 20 bp, Artificial Sequence
  chemically synthesized
tttcaccatcttggccagac

SEQ ID NO: 121216 - DNA, 20 bp, Artificial Sequence
  chemically synthesized
agttcaagaccagtctggcc

SEQ ID NO: 121217 - DNA, 20 bp, Artificial Sequence
  chemically synthesized
caagaccagtctggccaaga

SEQ ID NO: 121218 - DNA, 20 bp, Artificial Sequence
  chemically synthesized
cggtgtttcaccatcttggc

SEQ ID NO: 121219 - DNA, 20 bp, Artificial Sequence
  chemically synthesized
gagacggtgtttcaccatct

SEQ ID NO: 121220 - DNA, 20 bp, Artificial Sequence
  chemically synthesized
ttttatatttttagtagaga

SEQ ID NO: 121221 - DNA, 20 bp, Artificial Sequence
  chemically synthesized
taatttttatatttttagta

SEQ ID NO: 121222 - DNA, 20 bp, Artificial Sequence
  chemically synthesized
gctaatttttatatttttag

SEQ ID NO: 121223 - DNA, 20 bp, Artificial Sequence
  chemically synthesized
ccggctaatttttatatttt

SEQ ID NO: 121224 - DNA, 20 bp, Artificial Sequence
  chemically synthesized
tctactaaaaatataaaaat

SEQ ID NO: 121225 - DNA, 20 bp, Artificial Sequence
  chemically synthesized
ctaaaaatataaaaattagc

SEQ ID NO: 121226 - DNA, 20 bp, Artificial Sequence
  chemically synthesized
taaaaatataaaaattagcc

SEQ ID NO: 121227 - DNA, 20 bp, Artificial Sequence
  chemically synthesized
taaaaattagccgggtgtgc

SEQ ID NO: 121228 - DNA, 20 bp, Artificial Sequence
  chemically synthesized
caggagcctaccagcacacc

SEQ ID NO: 121229 - DNA, 20 bp, Artificial Sequence
  chemically synthesized
aaattagccgggtgtgctgg

SEQ ID NO: 121230 - DNA, 20 bp, Artificial Sequence
  chemically synthesized
aattagccgggtgtgctggt

SEQ ID NO: 121231 - DNA, 20 bp, Artificial Sequence
  chemically synthesized
ctgggattacaggagcctac

SEQ ID NO: 121232 - DNA, 20 bp, Artificial Sequence
  chemically synthesized
ccgagtagctgggattacag

SEQ ID NO: 121233 - DNA, 20 bp, Artificial Sequence
  chemically synthesized
ctggtaggctcctgtaatcc

SEQ ID NO: 121234 - DNA, 20 bp, Artificial Sequence
  chemically synthesized
tcccgagtagctgggattac

SEQ ID NO: 121235 - DNA, 20 bp, Artificial Sequence
  chemically synthesized
ctcccgagtagctgggatta

SEQ ID NO: 121236 - DNA, 20 bp, Artificial Sequence
  chemically synthesized
ctcctgtaatcccagctact

SEQ ID NO: 121237 - DNA, 20 bp, Artificial Sequence
  chemically synthesized
cctcagcctcccgagtagct

SEQ ID NO: 121238 - DNA, 20 bp, Artificial Sequence
  chemically synthesized
tcctgtaatcccagctactc

SEQ ID NO: 121239 - DNA, 20 bp, Artificial Sequence
  chemically synthesized
gcctcagcctcccgagtagc

SEQ ID NO: 121240 - DNA, 20 bp, Artificial Sequence
  chemically synthesized
ctgtaatcccagctactcgg

SEQ ID NO: 121241 - DNA, 20 bp, Artificial Sequence
  chemically synthesized
tgtaatcccagctactcggg

SEQ ID NO: 121242 - DNA, 20 bp, Artificial Sequence
  chemically synthesized
ctctgcctcagcctcccgag

SEQ ID NO: 121243 - DNA, 20 bp, Artificial Sequence
  chemically synthesized
attctctgcctcagcctccc

SEQ ID NO: 121244 - DNA, 20 bp, Artificial Sequence
  chemically synthesized
tcccagctactcgggaggct

SEQ ID NO: 121245 - DNA, 20 bp, Artificial Sequence
  chemically synthesized
cccagctactcgggaggctg

SEQ ID NO: 121246 - DNA, 20 bp, Artificial Sequence
  chemically synthesized
agctactcgggaggctgagg

SEQ ID NO: 121247 - DNA, 20 bp, Artificial Sequence
  chemically synthesized
ctactcgggaggctgaggca

SEQ ID NO: 121248 - DNA, 20 bp, Artificial Sequence
  chemically synthesized
gttcaagcaattctctgcct

SEQ ID NO: 121249 - DNA, 20 bp, Artificial Sequence
  chemically synthesized
ggcagagaattgcttgaacc

SEQ ID NO: 121250 - DNA, 20 bp, Artificial Sequence
  chemically synthesized
gcagagaattgcttgaaccc

SEQ ID NO: 121251 - DNA, 20 bp, Artificial Sequence
  chemically synthesized
aacttccatctcctgggttc

SEQ ID NO: 121252 - DNA, 20 bp, Artificial Sequence
  chemically synthesized
agagaattgcttgaacccag

SEQ ID NO: 121253 - DNA, 20 bp, Artificial Sequence
  chemically synthesized
aattgcttgaacccaggaga

SEQ ID NO: 121254 - DNA, 20 bp, Artificial Sequence
  chemically synthesized
cactgcaacttccatctcct

SEQ ID NO: 121255 - DNA, 20 bp, Artificial Sequence
  chemically synthesized
tcactgcaacttccatctcc

SEQ ID NO: 121256 - DNA, 20 bp, Artificial Sequence
  chemically synthesized
tgcttgaacccaggagatgg

SEQ ID NO: 121257 - DNA, 20 bp, Artificial Sequence
  chemically synthesized
aacccaggagatggaagttg

SEQ ID NO: 121258 - DNA, 20 bp, Artificial Sequence
  chemically synthesized
caggagatggaagttgcagt

SEQ ID NO: 121259 - DNA, 20 bp, Artificial Sequence
  chemically synthesized
gatggaagttgcagtgagcc

SEQ ID NO: 121260 - DNA, 20 bp, Artificial Sequence
  chemically synthesized
ggagtgcagtggcgtgatct

SEQ ID NO: 121261 - DNA, 20 bp, Artificial Sequence
  chemically synthesized
tcgcccaggctggagtgcag

SEQ ID NO: 121262 - DNA, 20 bp, Artificial Sequence
  chemically synthesized
aagatcacgccactgcactc

SEQ ID NO: 121263 - DNA, 20 bp, Artificial Sequence
  chemically synthesized
ctgtcgcccaggctggagtg

SEQ ID NO: 121264 - DNA, 20 bp, Artificial Sequence
  chemically synthesized
cacgccactgcactccagcc

SEQ ID NO: 121265 - DNA, 20 bp, Artificial Sequence
  chemically synthesized
acgccactgcactccagcct

SEQ ID NO: 121266 - DNA, 20 bp, Artificial Sequence
  chemically synthesized
tcactctgtcgcccaggctg

SEQ ID NO: 121267 - DNA, 20 bp, Artificial Sequence
  chemically synthesized
tctcactctgtcgcccaggc

SEQ ID NO: 121268 - DNA, 20 bp, Artificial Sequence
  chemically synthesized
ctgcactccagcctgggcga

SEQ ID NO: 121269 - DNA, 20 bp, Artificial Sequence
  chemically synthesized
ggagtctcactctgtcgccc

SEQ ID NO: 121270 - DNA, 20 bp, Artificial Sequence
  chemically synthesized
gcactccagcctgggcgaca

SEQ ID NO: 121271 - DNA, 20 bp, Artificial Sequence
  chemically synthesized
tggagtctcactctgtcgcc

SEQ ID NO: 121272 - DNA, 20 bp, Artificial Sequence
  chemically synthesized
tccagcctgggcgacagagt

SEQ ID NO: 121273 - DNA, 20 bp, Artificial Sequence
  chemically synthesized
gacagagtgagactccatct

SEQ ID NO: 121274 - DNA, 20 bp, Artificial Sequence
  chemically synthesized
ttttttttttttccgagatg

SEQ ID NO: 121275 - DNA, 20 bp, Artificial Sequence
  chemically synthesized
ttttttttttttttccgaga

SEQ ID NO: 121276 - DNA, 20 bp, Artificial Sequence
  chemically synthesized
ttttttttttttttttttcc

SEQ ID NO: 121277 - DNA, 20 bp, Artificial Sequence
  chemically synthesized
aaaaaaaaaaaaaaaaaaaa

SEQ ID NO: 121278 - DNA, 20 bp, Artificial Sequence
  chemically synthesized
aaaaaaaaaaaaaaaaaaaa

SEQ ID NO: 121279 - DNA, 20 bp, Artificial Sequence
  chemically synthesized
aacaatgtcgatgtttaatg

SEQ ID NO: 121280 - DNA, 20 bp, Artificial Sequence
  chemically synthesized
acaatgtcgatgtttaatgc

SEQ ID NO: 121281 - DNA, 20 bp, Artificial Sequence
  chemically synthesized
caatgtcgatgtttaatgca

SEQ ID NO: 121282 - DNA, 20 bp, Artificial Sequence
  chemically synthesized
gtttaatgcagggacattaa

SEQ ID NO: 121283 - DNA, 20 bp, Artificial Sequence
  chemically synthesized
aacataatacatcattccaa

SEQ ID NO: 121284 - DNA, 20 bp, Artificial Sequence
  chemically synthesized
tttgctacatattggaccat

SEQ ID NO: 121285 - DNA, 20 bp, Artificial Sequence
  chemically synthesized
cattccaatggtccaatatg

SEQ ID NO: 121286 - DNA, 20 bp, Artificial Sequence
  chemically synthesized
tgtgcacatttgctacatat

SEQ ID NO: 121287 - DNA, 20 bp, Artificial Sequence
  chemically synthesized
caatatgtagcaaatgtgca

SEQ ID NO: 121288 - DNA, 20 bp, Artificial Sequence
  chemically synthesized
tgcacagtaatcactgtaaa

SEQ ID NO: 121289 - DNA, 20 bp, Artificial Sequence
  chemically synthesized
cacagtaatcactgtaaaaa

SEQ ID NO: 121290 - DNA, 20 bp, Artificial Sequence
  chemically synthesized
agaaaattgtgctcttttta

SEQ ID NO: 121291 - DNA, 20 bp, Artificial Sequence
  chemically synthesized
ttgtgttctgttttttacac

SEQ ID NO: 121292 - DNA, 20 bp, Artificial Sequence
  chemically synthesized
caattttcttgtgtaaaaaa

SEQ ID NO: 121293 - DNA, 20 bp, Artificial Sequence
  chemically synthesized
tcttagagataaacacagtg

SEQ ID NO: 121294 - DNA, 20 bp, Artificial Sequence
  chemically synthesized
tgtattcttagagataaaca

SEQ ID NO: 121295 - DNA, 20 bp, Artificial Sequence
  chemically synthesized
actacactgtgtttatctct

SEQ ID NO: 121296 - DNA, 20 bp, Artificial Sequence
  chemically synthesized
ctcatgattatgtattctta

SEQ ID NO: 121297 - DNA, 20 bp, Artificial Sequence
  chemically synthesized
agctcatgattatgtattct

SEQ ID NO: 121298 - DNA, 20 bp, Artificial Sequence
  chemically synthesized
ctctaagaatacataatcat

SEQ ID NO: 121299 - DNA, 20 bp, Artificial Sequence
  chemically synthesized
aatttcttccatttcgtgtt

SEQ ID NO: 121300 - DNA, 20 bp, Artificial Sequence
  chemically synthesized
atcatgagctgaacacgaaa

SEQ ID NO: 121301 - DNA, 20 bp, Artificial Sequence
  chemically synthesized
atgagctgaacacgaaatgg

SEQ ID NO: 121302 - DNA, 20 bp, Artificial Sequence
  chemically synthesized
aaattgaaaataatgcttct

SEQ ID NO: 121303 - DNA, 20 bp, Artificial Sequence
  chemically synthesized
aattgaaaataatgcttctg

SEQ ID NO: 121304 - DNA, 20 bp, Artificial Sequence
  chemically synthesized
ttgaaaataatgcttctgag

SEQ ID NO: 121305 - DNA, 20 bp, Artificial Sequence
  chemically synthesized
aaaatgatttttctcctcag

SEQ ID NO: 121306 - DNA, 20 bp, Artificial Sequence
  chemically synthesized
acaaaaatgatttttctcct

SEQ ID NO: 121307 - DNA, 20 bp, Artificial Sequence
  chemically synthesized
taatatttgttcttttgcgt

SEQ ID NO: 121308 - DNA, 20 bp, Artificial Sequence
  chemically synthesized
taaatatcatactaacgcaa

SEQ ID NO: 121309 - DNA, 20 bp, Artificial Sequence
  chemically synthesized
ttgcgttagtatgatattta

SEQ ID NO: 121310 - DNA, 20 bp, Artificial Sequence
  chemically synthesized
tttacagaataaaaatcaaa

SEQ ID NO: 121311 - DNA, 20 bp, Artificial Sequence
  chemically synthesized
taaaaatcaaacagtgttct

SEQ ID NO: 121312 - DNA, 20 bp, Artificial Sequence
  chemically synthesized
aaacacgctgaaattatgct

SEQ ID NO: 121313 - DNA, 20 bp, Artificial Sequence
  chemically synthesized
cagtgttcttagcataattt

SEQ ID NO: 121314 - DNA, 20 bp, Artificial Sequence
  chemically synthesized
tagcataatttcagcgtgtt

SEQ ID NO: 121315 - DNA, 20 bp, Artificial Sequence
  chemically synthesized
agattgtatatgttcaatag

SEQ ID NO: 121316 - DNA, 20 bp, Artificial Sequence
  chemically synthesized
atagattgtatatgttcaat

SEQ ID NO: 121317 - DNA, 20 bp, Artificial Sequence
  chemically synthesized
tatagattgtatatgttcaa

SEQ ID NO: 121318 - DNA, 20 bp, Artificial Sequence
  chemically synthesized
ctgagaaattacattatata

SEQ ID NO: 121319 - DNA, 20 bp, Artificial Sequence
  chemically synthesized
ctatatataatgtaatttct

SEQ ID NO: 121320 - DNA, 20 bp, Artificial Sequence
  chemically synthesized
ctaggatgttttagttaact

SEQ ID NO: 121321 - DNA, 20 bp, Artificial Sequence
  chemically synthesized
ggtttgattctaggatgttt

SEQ ID NO: 121322 - DNA, 20 bp, Artificial Sequence
  chemically synthesized
ctcagttaactaaaacatcc

SEQ ID NO: 121323 - DNA, 20 bp, Artificial Sequence
  chemically synthesized
ctattacttggtttgattct

SEQ ID NO: 121324 - DNA, 20 bp, Artificial Sequence
  chemically synthesized
actattacttggtttgattc

SEQ ID NO: 121325 - DNA, 20 bp, Artificial Sequence
  chemically synthesized
aaacatcctagaatcaaacc

SEQ ID NO: 121326 - DNA, 20 bp, Artificial Sequence
  chemically synthesized
cctagaatcaaaccaagtaa

SEQ ID NO: 121327 - DNA, 20 bp, Artificial Sequence
  chemically synthesized
atgcagtaaatactattact

SEQ ID NO: 121328 - DNA, 20 bp, Artificial Sequence
  chemically synthesized
gtaatagtatttactgcata

SEQ ID NO: 121329 - DNA, 20 bp, Artificial Sequence
  chemically synthesized
ctgggtctatttgctatatg

SEQ ID NO: 121330 - DNA, 20 bp, Artificial Sequence
  chemically synthesized
tatttactgcatatagcaaa

SEQ ID NO: 121331 - DNA, 20 bp, Artificial Sequence
  chemically synthesized
ctgcatatagcaaatagacc

SEQ ID NO: 121332 - DNA, 20 bp, Artificial Sequence
  chemically synthesized
tgataatagtttggtaatct

SEQ ID NO: 121333 - DNA, 20 bp, Artificial Sequence
  chemically synthesized
ttgataatagtttggtaatc

SEQ ID NO: 121334 - DNA, 20 bp, Artificial Sequence
  chemically synthesized
ttagcttcttgataatagtt

SEQ ID NO: 121335 - DNA, 20 bp, Artificial Sequence
  chemically synthesized
cagattaccaaactattatc

SEQ ID NO: 121336 - DNA, 20 bp, Artificial Sequence
  chemically synthesized
tggcattagcttcttgataa

SEQ ID NO: 121337 - DNA, 20 bp, Artificial Sequence
  chemically synthesized
attaccaaactattatcaag

SEQ ID NO: 121338 - DNA, 20 bp, Artificial Sequence
  chemically synthesized
aaagtcagtgatattggcat

SEQ ID NO: 121339 - DNA, 20 bp, Artificial Sequence
  chemically synthesized
atagcaaaagtcagtgatat

SEQ ID NO: 121340 - DNA, 20 bp, Artificial Sequence
  chemically synthesized
tctgctttcatagcaaaagt

SEQ ID NO: 121341 - DNA, 20 bp, Artificial Sequence
  chemically synthesized
gtcctctgctttcatagcaa

SEQ ID NO: 121342 - DNA, 20 bp, Artificial Sequence
  chemically synthesized
atcactgacttttgctatga

SEQ ID NO: 121343 - DNA, 20 bp, Artificial Sequence
  chemically synthesized
actgacttttgctatgaaag

SEQ ID NO: 121344 - DNA, 20 bp, Artificial Sequence
  chemically synthesized
gacactgtcctctgctttca

SEQ ID NO: 121345 - DNA, 20 bp, Artificial Sequence
  chemically synthesized
tgacttttgctatgaaagca

SEQ ID NO: 121346 - DNA, 20 bp, Artificial Sequence
  chemically synthesized
gacttttgctatgaaagcag

SEQ ID NO: 121347 - DNA, 20 bp, Artificial Sequence
  chemically synthesized
tttgctatgaaagcagagga

SEQ ID NO: 121348 - DNA, 20 bp, Artificial Sequence
  chemically synthesized
aaagcagaggacagtgtcta

SEQ ID NO: 121349 - DNA, 20 bp, Artificial Sequence
  chemically synthesized
aagcagaggacagtgtctaa

SEQ ID NO: 121350 - DNA, 20 bp, Artificial Sequence
  chemically synthesized
gaggacagtgtctaaaggca

SEQ ID NO: 121351 - DNA, 20 bp, Artificial Sequence
  chemically synthesized
gcaactatgctctgtgcctt

SEQ ID NO: 121352 - DNA, 20 bp, Artificial Sequence
  chemically synthesized
ggacagtgtctaaaggcaca

SEQ ID NO: 121353 - DNA, 20 bp, Artificial Sequence
  chemically synthesized
gtgtctaaaggcacagagca

SEQ ID NO: 121354 - DNA, 20 bp, Artificial Sequence
  chemically synthesized
tgttaattgttttgtaatag

SEQ ID NO: 121355 - DNA, 20 bp, Artificial Sequence
  chemically synthesized
aaatgttaattgttttgtaa

SEQ ID NO: 121356 - DNA, 20 bp, Artificial Sequence
  chemically synthesized
acaattaacatttatccgcg

SEQ ID NO: 121357 - DNA, 20 bp, Artificial Sequence
  chemically synthesized
gaaaaggcaggcattccacg

SEQ ID NO: 121358 - DNA, 20 bp, Artificial Sequence
  chemically synthesized
aggagtatggaagaaaaggc

SEQ ID NO: 121359 - DNA, 20 bp, Artificial Sequence
  chemically synthesized
aaggagtatggaagaaaagg

SEQ ID NO: 121360 - DNA, 20 bp, Artificial Sequence
  chemically synthesized
taaaaggagtatggaagaaa

SEQ ID NO: 121361 - DNA, 20 bp, Artificial Sequence
  chemically synthesized
ataaaaggagtatggaagaa

SEQ ID NO: 121362 - DNA, 20 bp, Artificial Sequence
  chemically synthesized
gcttgataaaaggagtatgg

SEQ ID NO: 121363 - DNA, 20 bp, Artificial Sequence
  chemically synthesized
aatgcttgataaaaggagta

SEQ ID NO: 121364 - DNA, 20 bp, Artificial Sequence
  chemically synthesized
actgtaatgcttgataaaag

SEQ ID NO: 121365 - DNA, 20 bp, Artificial Sequence
  chemically synthesized
tcttccatactccttttatc

SEQ ID NO: 121366 - DNA, 20 bp, Artificial Sequence
  chemically synthesized
aaactgtaatgcttgataaa

SEQ ID NO: 121367 - DNA, 20 bp, Artificial Sequence
  chemically synthesized
gaaactgtaatgcttgataa

SEQ ID NO: 121368 - DNA, 20 bp, Artificial Sequence
  chemically synthesized
actccttttatcaagcatta

SEQ ID NO: 121369 - DNA, 20 bp, Artificial Sequence
  chemically synthesized
aggatctgaaaagtggagaa

SEQ ID NO: 121370 - DNA, 20 bp, Artificial Sequence
  chemically synthesized
agtttctattctccactttt

SEQ ID NO: 121371 - DNA, 20 bp, Artificial Sequence
  chemically synthesized
gtgcgaggatctgaaaagtg

SEQ ID NO: 121372 - DNA, 20 bp, Artificial Sequence
  chemically synthesized
tagtgcgaggatctgaaaag

SEQ ID NO: 121373 - DNA, 20 bp, Artificial Sequence
  chemically synthesized
aaatagtgcgaggatctgaa

SEQ ID NO: 121374 - DNA, 20 bp, Artificial Sequence
  chemically synthesized
aagggctttcaaatagtgcg

SEQ ID NO: 121375 - DNA, 20 bp, Artificial Sequence
  chemically synthesized
gaagggctttcaaatagtgc

SEQ ID NO: 121376 - DNA, 20 bp, Artificial Sequence
  chemically synthesized
cagatcctcgcactatttga

SEQ ID NO: 121377 - DNA, 20 bp, Artificial Sequence
  chemically synthesized
ccctcagaagggctttcaaa

SEQ ID NO: 121378 - DNA, 20 bp, Artificial Sequence
  chemically synthesized
cactatttgaaagcccttct

SEQ ID NO: 121379 - DNA, 20 bp, Artificial Sequence
  chemically synthesized
actatttgaaagcccttctg

SEQ ID NO: 121380 - DNA, 20 bp, Artificial Sequence
  chemically synthesized
ctatttgaaagcccttctga

SEQ ID NO: 121381 - DNA, 20 bp, Artificial Sequence
  chemically synthesized
tggcagaagttccctcagaa

SEQ ID NO: 121382 - DNA, 20 bp, Artificial Sequence
  chemically synthesized
ttggcagaagttccctcaga

SEQ ID NO: 121383 - DNA, 20 bp, Artificial Sequence
  chemically synthesized
tttggcagaagttccctcag

SEQ ID NO: 121384 - DNA, 20 bp, Artificial Sequence
  chemically synthesized
gcctttggcagaagttccct

SEQ ID NO: 121385 - DNA, 20 bp, Artificial Sequence
  chemically synthesized
ttctgagggaacttctgcca

SEQ ID NO: 121386 - DNA, 20 bp, Artificial Sequence
  chemically synthesized
tctgagggaacttctgccaa

SEQ ID NO: 121387 - DNA, 20 bp, Artificial Sequence
  chemically synthesized
aaaaggcaagcctttggcag

SEQ ID NO: 121388 - DNA, 20 bp, Artificial Sequence
  chemically synthesized
tagaaaaggcaagcctttgg

SEQ ID NO: 121389 - DNA, 20 bp, Artificial Sequence
  chemically synthesized
ttctagaaaaggcaagcctt

SEQ ID NO: 121390 - DNA, 20 bp, Artificial Sequence
  chemically synthesized
aggatatttctagaaaaggc

SEQ ID NO: 121391 - DNA, 20 bp, Artificial Sequence
  chemically synthesized
tgccaaaggcttgccttttc

SEQ ID NO: 121392 - DNA, 20 bp, Artificial Sequence
  chemically synthesized
ccctaggatatttctagaaa

SEQ ID NO: 121393 - DNA, 20 bp, Artificial Sequence
  chemically synthesized
accctaggatatttctagaa

SEQ ID NO: 121394 - DNA, 20 bp, Artificial Sequence
  chemically synthesized
tttgtaccctaggatatttc

SEQ ID NO: 121395 - DNA, 20 bp, Artificial Sequence
  chemically synthesized
tgccttttctagaaatatcc

SEQ ID NO: 121396 - DNA, 20 bp, Artificial Sequence
  chemically synthesized
gccttttctagaaatatcct

SEQ ID NO: 121397 - DNA, 20 bp, Artificial Sequence
  chemically synthesized
ccttttctagaaatatccta

SEQ ID NO: 121398 - DNA, 20 bp, Artificial Sequence
  chemically synthesized
aagtggtaattttgtaccct

SEQ ID NO: 121399 - DNA, 20 bp, Artificial Sequence
  chemically synthesized
gaagtggtaattttgtaccc

SEQ ID NO: 121400 - DNA, 20 bp, Artificial Sequence
  chemically synthesized
gaggaggagaaagaaagaag

SEQ ID NO: 121401 - DNA, 20 bp, Artificial Sequence
  chemically synthesized
agtgaggaggagaaagaaag

SEQ ID NO: 121402 - DNA, 20 bp, Artificial Sequence
  chemically synthesized
ttaagtgaggaggagaaaga

SEQ ID NO: 121403 - DNA, 20 bp, Artificial Sequence
  chemically synthesized
tggcttaagtgaggaggaga

SEQ ID NO: 121404 - DNA, 20 bp, Artificial Sequence
  chemically synthesized
ggtttggcttaagtgaggag

SEQ ID NO: 121405 - DNA, 20 bp, Artificial Sequence
  chemically synthesized
taggtttggcttaagtgagg

SEQ ID NO: 121406 - DNA, 20 bp, Artificial Sequence
  chemically synthesized
tttctttctcctcctcactt

SEQ ID NO: 121407 - DNA, 20 bp, Artificial Sequence
  chemically synthesized
ttaggtttggcttaagtgag

SEQ ID NO: 121408 - DNA, 20 bp, Artificial Sequence
  chemically synthesized
ctttaggtttggcttaagtg

SEQ ID NO: 121409 - DNA, 20 bp, Artificial Sequence
  chemically synthesized
actttaggtttggcttaagt

SEQ ID NO: 121410 - DNA, 20 bp, Artificial Sequence
  chemically synthesized
tatcactttaggtttggctt

SEQ ID NO: 121411 - DNA, 20 bp, Artificial Sequence
  chemically synthesized
cctcacttaagccaaaccta

SEQ ID NO: 121412 - DNA, 20 bp, Artificial Sequence
  chemically synthesized
ttcttttatcactttaggtt

SEQ ID NO: 121413 - DNA, 20 bp, Artificial Sequence
  chemically synthesized
tacatttcttttatcacttt

SEQ ID NO: 121414 - DNA, 20 bp, Artificial Sequence
  chemically synthesized
atacatttcttttatcactt

SEQ ID NO: 121415 - DNA, 20 bp, Artificial Sequence
  chemically synthesized
agccaaacctaaagtgataa

SEQ ID NO: 121416 - DNA, 20 bp, Artificial Sequence
  chemically synthesized
tgataaaagaaatgtattcc

SEQ ID NO: 121417 - DNA, 20 bp, Artificial Sequence
  chemically synthesized
ttacatgttctttcgtatct

SEQ ID NO: 121418 - DNA, 20 bp, Artificial Sequence
  chemically synthesized
aaatgtattccaagatacga

SEQ ID NO: 121419 - DNA, 20 bp, Artificial Sequence
  chemically synthesized
gatacgaaagaacatgtaat

SEQ ID NO: 121420 - DNA, 20 bp, Artificial Sequence
  chemically synthesized
aagaacatgtaattggccct

SEQ ID NO: 121421 - DNA, 20 bp, Artificial Sequence
  chemically synthesized
tagcaccctctggatactaa

SEQ ID NO: 121422 - DNA, 20 bp, Artificial Sequence
  chemically synthesized
tgtaattggcccttagtatc

SEQ ID NO: 121423 - DNA, 20 bp, Artificial Sequence
  chemically synthesized
atagcaccctctggatacta

SEQ ID NO: 121424 - DNA, 20 bp, Artificial Sequence
  chemically synthesized
aatagcaccctctggatact

SEQ ID NO: 121425 - DNA, 20 bp, Artificial Sequence
  chemically synthesized
taattggcccttagtatcca

SEQ ID NO: 121426 - DNA, 20 bp, Artificial Sequence
  chemically synthesized
aattggcccttagtatccag

SEQ ID NO: 121427 - DNA, 20 bp, Artificial Sequence
  chemically synthesized
attggcccttagtatccaga

SEQ ID NO: 121428 - DNA, 20 bp, Artificial Sequence
  chemically synthesized
aaaatgcaaatagcaccctc

SEQ ID NO: 121429 - DNA, 20 bp, Artificial Sequence
  chemically synthesized
ctcttcttttaaaatgcaaa

SEQ ID NO: 121430 - DNA, 20 bp, Artificial Sequence
  chemically synthesized
gggtgctatttgcattttaa

SEQ ID NO: 121431 - DNA, 20 bp, Artificial Sequence
  chemically synthesized
tgctatttgcattttaaaag

SEQ ID NO: 121432 - DNA, 20 bp, Artificial Sequence
  chemically synthesized
ctatttgcattttaaaagaa

SEQ ID NO: 121433 - DNA, 20 bp, Artificial Sequence
  chemically synthesized
tttaatagatgagagataat

SEQ ID NO: 121434 - DNA, 20 bp, Artificial Sequence
  chemically synthesized
attagcaatttaatagatga

SEQ ID NO: 121435 - DNA, 20 bp, Artificial Sequence
  chemically synthesized
taattagcaatttaatagat

SEQ ID NO: 121436 - DNA, 20 bp, Artificial Sequence
  chemically synthesized
gctattaattagcaatttaa

SEQ ID NO: 121437 - DNA, 20 bp, Artificial Sequence
  chemically synthesized
tctattaaattgctaattaa

SEQ ID NO: 121438 - DNA, 20 bp, Artificial Sequence
  chemically synthesized
tggatgttcatgctattaat

SEQ ID NO: 121439 - DNA, 20 bp, Artificial Sequence
  chemically synthesized
gcatgaacatccacaaaact

SEQ ID NO: 121440 - DNA, 20 bp, Artificial Sequence
  chemically synthesized
agttattggtctcagttttg

SEQ ID NO: 121441 - DNA, 20 bp, Artificial Sequence
  chemically synthesized
ggtaaccaagttattggtct

SEQ ID NO: 121442 - DNA, 20 bp, Artificial Sequence
  chemically synthesized
caaaactgagaccaataact

SEQ ID NO: 121443 - DNA, 20 bp, Artificial Sequence
  chemically synthesized
aaaaaaggtaaccaagttat

SEQ ID NO: 121444 - DNA, 20 bp, Artificial Sequence
  chemically synthesized
catttgaaaaaaaggtaacc

SEQ ID NO: 121445 - DNA, 20 bp, Artificial Sequence
  chemically synthesized
aaggaattcatttgaaaaaa

SEQ ID NO: 121446 - DNA, 20 bp, Artificial Sequence
  chemically synthesized
aaaggaattcatttgaaaaa

SEQ ID NO: 121447 - DNA, 20 bp, Artificial Sequence
  chemically synthesized
acaattcagtgttttataaa

SEQ ID NO: 121448 - DNA, 20 bp, Artificial Sequence
  chemically synthesized
aacaattcagtgttttataa

SEQ ID NO: 121449 - DNA, 20 bp, Artificial Sequence
  chemically synthesized
taagtattttattaacaatt

SEQ ID NO: 121450 - DNA, 20 bp, Artificial Sequence
  chemically synthesized
tgttaataaaatacttatga

SEQ ID NO: 121451 - DNA, 20 bp, Artificial Sequence
  chemically synthesized
ctctgatactggtccatcat

SEQ ID NO: 121452 - DNA, 20 bp, Artificial Sequence
  chemically synthesized
ataaaatacttatgatggac

SEQ ID NO: 121453 - DNA, 20 bp, Artificial Sequence
  chemically synthesized
tacttatgatggaccagtat

SEQ ID NO: 121454 - DNA, 20 bp, Artificial Sequence
  chemically synthesized
cttatgatggaccagtatca

SEQ ID NO: 121455 - DNA, 20 bp, Artificial Sequence
  chemically synthesized
ttacatatatgctctgatac

SEQ ID NO: 121456 - DNA, 20 bp, Artificial Sequence
  chemically synthesized
gtatcagagcatatatgtaa

SEQ ID NO: 121457 - DNA, 20 bp, Artificial Sequence
  chemically synthesized
agagcatatatgtaaaagct

SEQ ID NO: 121458 - DNA, 20 bp, Artificial Sequence
  chemically synthesized
gagcatatatgtaaaagctc

SEQ ID NO: 121459 - DNA, 20 bp, Artificial Sequence
  chemically synthesized
tgtttttattttgtattcct

SEQ ID NO: 121460 - DNA, 20 bp, Artificial Sequence
  chemically synthesized
caaaataaaaacaaaatttt

SEQ ID NO: 121461 - DNA, 20 bp, Artificial Sequence
  chemically synthesized
taaaatcatttattttactc

SEQ ID NO: 121462 - DNA, 20 bp, Artificial Sequence
  chemically synthesized
atcatttattttactcaagc

SEQ ID NO: 121463 - DNA, 20 bp, Artificial Sequence
  chemically synthesized
caaggttatttaacttgctt

SEQ ID NO: 121464 - DNA, 20 bp, Artificial Sequence
  chemically synthesized
tcaagcaagttaaataacct

SEQ ID NO: 121465 - DNA, 20 bp, Artificial Sequence
  chemically synthesized
agcaagttaaataaccttgg

SEQ ID NO: 121466 - DNA, 20 bp, Artificial Sequence
  chemically synthesized
tgagtgatgggtggcttcca

SEQ ID NO: 121467 - DNA, 20 bp, Artificial Sequence
  chemically synthesized
atgagtgatgggtggcttcc

SEQ ID NO: 121468 - DNA, 20 bp, Artificial Sequence
  chemically synthesized
aggaacctatgagtgatggg

SEQ ID NO: 121469 - DNA, 20 bp, Artificial Sequence
  chemically synthesized
aacaggaacctatgagtgat

SEQ ID NO: 121470 - DNA, 20 bp, Artificial Sequence
  chemically synthesized
tggaagccacccatcactca

SEQ ID NO: 121471 - DNA, 20 bp, Artificial Sequence
  chemically synthesized
aaacaggaacctatgagtga

SEQ ID NO: 121472 - DNA, 20 bp, Artificial Sequence
  chemically synthesized
ggaagccacccatcactcat

SEQ ID NO: 121473 - DNA, 20 bp, Artificial Sequence
  chemically synthesized
cttttcaaacaggaacctat

SEQ ID NO: 121474 - DNA, 20 bp, Artificial Sequence
  chemically synthesized
ctcataggttcctgtttgaa

SEQ ID NO: 121475 - DNA, 20 bp, Artificial Sequence
  chemically synthesized
tatatctagacttttcaaac

SEQ ID NO: 121476 - DNA, 20 bp, Artificial Sequence
  chemically synthesized
ttatatctagacttttcaaa

SEQ ID NO: 121477 - DNA, 20 bp, Artificial Sequence
  chemically synthesized
aggttcctgtttgaaaagtc

SEQ ID NO: 121478 - DNA, 20 bp, Artificial Sequence
  chemically synthesized
tgtttgaaaagtctagatat

SEQ ID NO: 121479 - DNA, 20 bp, Artificial Sequence
  chemically synthesized
tttgaaaagtctagatataa

SEQ ID NO: 121480 - DNA, 20 bp, Artificial Sequence
  chemically synthesized
atggtataacctcttatatc

SEQ ID NO: 121481 - DNA, 20 bp, Artificial Sequence
  chemically synthesized
ttgaaaagtctagatataag

SEQ ID NO: 121482 - DNA, 20 bp, Artificial Sequence
  chemically synthesized
atataagaggttataccatt

SEQ ID NO: 121483 - DNA, 20 bp, Artificial Sequence
  chemically synthesized
aagaggttataccatttgga

SEQ ID NO: 121484 - DNA, 20 bp, Artificial Sequence
  chemically synthesized
tacccatgaaaccatccaaa

SEQ ID NO: 121485 - DNA, 20 bp, Artificial Sequence
  chemically synthesized
ataccatttggatggtttca

SEQ ID NO: 121486 - DNA, 20 bp, Artificial Sequence
  chemically synthesized
taccatttggatggtttcat

SEQ ID NO: 121487 - DNA, 20 bp, Artificial Sequence
  chemically synthesized
atgggtatatgcacatgttc

SEQ ID NO: 121488 - DNA, 20 bp, Artificial Sequence
  chemically synthesized
ctgcataaaattatatgggc

SEQ ID NO: 121489 - DNA, 20 bp, Artificial Sequence
  chemically synthesized
aaaactgcataaaattatat

SEQ ID NO: 121490 - DNA, 20 bp, Artificial Sequence
  chemically synthesized
aaaaactgcataaaattata

SEQ ID NO: 121491 - DNA, 20 bp, Artificial Sequence
  chemically synthesized
ctagcccatataattttatg

SEQ ID NO: 121492 - DNA, 20 bp, Artificial Sequence
  chemically synthesized
atatcaattacacttcaata

SEQ ID NO: 121493 - DNA, 20 bp, Artificial Sequence
  chemically synthesized
taattttaacagctttattg

SEQ ID NO: 121494 - DNA, 20 bp, Artificial Sequence
  chemically synthesized
tttatgttttttaattttaa

SEQ ID NO: 121495 - DNA, 20 bp, Artificial Sequence
  chemically synthesized
aaattaaaaaacataaaatg

SEQ ID NO: 121496 - DNA, 20 bp, Artificial Sequence
  chemically synthesized
ttaaaaaacataaaatgcag

SEQ ID NO: 121497 - DNA, 20 bp, Artificial Sequence
  chemically synthesized
taaaaaacataaaatgcaga

SEQ ID NO: 121498 - DNA, 20 bp, Artificial Sequence
  chemically synthesized
gattatgtttttagattcat

SEQ ID NO: 121499 - DNA, 20 bp, Artificial Sequence
  chemically synthesized
tgatctattgattatgtttt

SEQ ID NO: 121500 - DNA, 20 bp, Artificial Sequence
  chemically synthesized
gaatctaaaaacataatcaa

SEQ ID NO: 121501 - DNA, 20 bp, Artificial Sequence
  chemically synthesized
atgttataatttataatttt

SEQ ID NO: 121502 - DNA, 20 bp, Artificial Sequence
  chemically synthesized
tatgttataatttataattt

SEQ ID NO: 121503 - DNA, 20 bp, Artificial Sequence
  chemically synthesized
ttataaattataacatatcc

SEQ ID NO: 121504 - DNA, 20 bp, Artificial Sequence
  chemically synthesized
cagagattttggaaaattct

SEQ ID NO: 121505 - DNA, 20 bp, Artificial Sequence
  chemically synthesized
tcagagattttggaaaattc

SEQ ID NO: 121506 - DNA, 20 bp, Artificial Sequence
  chemically synthesized
actatttctttcagagattt

SEQ ID NO: 121507 - DNA, 20 bp, Artificial Sequence
  chemically synthesized
gaattttccaaaatctctga

SEQ ID NO: 121508 - DNA, 20 bp, Artificial Sequence
  chemically synthesized
ctagcttactatttctttca

SEQ ID NO: 121509 - DNA, 20 bp, Artificial Sequence
  chemically synthesized
tccaaaatctctgaaagaaa

SEQ ID NO: 121510 - DNA, 20 bp, Artificial Sequence
  chemically synthesized
ctctagcttactatttcttt

SEQ ID NO: 121511 - DNA, 20 bp, Artificial Sequence
  chemically synthesized
aaatctctgaaagaaatagt

SEQ ID NO: 121512 - DNA, 20 bp, Artificial Sequence
  chemically synthesized
ctctgaaagaaatagtaagc

SEQ ID NO: 121513 - DNA, 20 bp, Artificial Sequence
  chemically synthesized
ctgaaagaaatagtaagcta

SEQ ID NO: 121514 - DNA, 20 bp, Artificial Sequence
  chemically synthesized
ggaaatctgtcatttaactc

SEQ ID NO: 121515 - DNA, 20 bp, Artificial Sequence
  chemically synthesized
agtaagctagagttaaatga

SEQ ID NO: 121516 - DNA, 20 bp, Artificial Sequence
  chemically synthesized
tgacagatttcctactaaac

SEQ ID NO: 121517 - DNA, 20 bp, Artificial Sequence
  chemically synthesized
tctttactaccttgtttagt

SEQ ID NO: 121518 - DNA, 20 bp, Artificial Sequence
  chemically synthesized
gacagatttcctactaaaca

SEQ ID NO: 121519 - DNA, 20 bp, Artificial Sequence
  chemically synthesized
ctctttactaccttgtttag

SEQ ID NO: 121520 - DNA, 20 bp, Artificial Sequence
  chemically synthesized
agatttcctactaaacaagg

SEQ ID NO: 121521 - DNA, 20 bp, Artificial Sequence
  chemically synthesized
tcactctttactaccttgtt

SEQ ID NO: 121522 - DNA, 20 bp, Artificial Sequence
  chemically synthesized
tcctactaaacaaggtagta

SEQ ID NO: 121523 - DNA, 20 bp, Artificial Sequence
  chemically synthesized
ctactaaacaaggtagtaaa

SEQ ID NO: 121524 - DNA, 20 bp, Artificial Sequence
  chemically synthesized
taaacaaggtagtaaagagt

SEQ ID NO: 121525 - DNA, 20 bp, Artificial Sequence
  chemically synthesized
aaacaaggtagtaaagagtg

SEQ ID NO: 121526 - DNA, 20 bp, Artificial Sequence
  chemically synthesized
aaaagttctggtttgacgtc

SEQ ID NO: 121527 - DNA, 20 bp, Artificial Sequence
  chemically synthesized
agtgaggcttgacgtcaaac

SEQ ID NO: 121528 - DNA, 20 bp, Artificial Sequence
  chemically synthesized
taaagtacatcaaaaagttc

SEQ ID NO: 121529 - DNA, 20 bp, Artificial Sequence
  chemically synthesized
aagcattaaagtacatcaaa

SEQ ID NO: 121530 - DNA, 20 bp, Artificial Sequence
  chemically synthesized
tttctacctttcaagcatta

SEQ ID NO: 121531 - DNA, 20 bp, Artificial Sequence
  chemically synthesized
tgatgtactttaatgcttga

SEQ ID NO: 121532 - DNA, 20 bp, Artificial Sequence
  chemically synthesized
gatgtactttaatgcttgaa

SEQ ID NO: 121533 - DNA, 20 bp, Artificial Sequence
  chemically synthesized
gtactttaatgcttgaaagg

SEQ ID NO: 121534 - DNA, 20 bp, Artificial Sequence
  chemically synthesized
cacgcgtatttctacctttc

SEQ ID NO: 121535 - DNA, 20 bp, Artificial Sequence
  chemically synthesized
caattttgcagaaaaatata

SEQ ID NO: 121536 - DNA, 20 bp, Artificial Sequence
  chemically synthesized
tcgctgtgaatacaattttg

SEQ ID NO: 121537 - DNA, 20 bp, Artificial Sequence
  chemically synthesized
tttctgcaaaattgtattca

SEQ ID NO: 121538 - DNA, 20 bp, Artificial Sequence
  chemically synthesized
caaaattgtattcacagcga

SEQ ID NO: 121539 - DNA, 20 bp, Artificial Sequence
  chemically synthesized
attgtattcacagcgaaagt

SEQ ID NO: 121540 - DNA, 20 bp, Artificial Sequence
  chemically synthesized
ttgtattcacagcgaaagtt

SEQ ID NO: 121541 - DNA, 20 bp, Artificial Sequence
  chemically synthesized
caagatttccttaggtataa

SEQ ID NO: 121542 - DNA, 20 bp, Artificial Sequence
  chemically synthesized
aagttaggactgttatacct

SEQ ID NO: 121543 - DNA, 20 bp, Artificial Sequence
  chemically synthesized
agttaggactgttataccta

SEQ ID NO: 121544 - DNA, 20 bp, Artificial Sequence
  chemically synthesized
cactcagtcaagatttcctt

SEQ ID NO: 121545 - DNA, 20 bp, Artificial Sequence
  chemically synthesized
gcactcagtcaagatttcct

SEQ ID NO: 121546 - DNA, 20 bp, Artificial Sequence
  chemically synthesized
tacctaaggaaatcttgact

SEQ ID NO: 121547 - DNA, 20 bp, Artificial Sequence
  chemically synthesized
gtgagggttagcactcagtc

SEQ ID NO: 121548 - DNA, 20 bp, Artificial Sequence
  chemically synthesized
attcagtgagggttagcact

SEQ ID NO: 121549 - DNA, 20 bp, Artificial Sequence
  chemically synthesized
gggcagtattcagtgagggt

SEQ ID NO: 121550 - DNA, 20 bp, Artificial Sequence
  chemically synthesized
acctgggcagtattcagtga

SEQ ID NO: 121551 - DNA, 20 bp, Artificial Sequence
  chemically synthesized
aacctgggcagtattcagtg

SEQ ID NO: 121552 - DNA, 20 bp, Artificial Sequence
  chemically synthesized
aaacctgggcagtattcagt

SEQ ID NO: 121553 - DNA, 20 bp, Artificial Sequence
  chemically synthesized
cacaaaacctgggcagtatt

SEQ ID NO: 121554 - DNA, 20 bp, Artificial Sequence
  chemically synthesized
aaccctcactgaatactgcc

SEQ ID NO: 121555 - DNA, 20 bp, Artificial Sequence
  chemically synthesized
accctcactgaatactgccc

SEQ ID NO: 121556 - DNA, 20 bp, Artificial Sequence
  chemically synthesized
acatcctcacaaaacctggg

SEQ ID NO: 121557 - DNA, 20 bp, Artificial Sequence
  chemically synthesized
cctacatcctcacaaaacct

SEQ ID NO: 121558 - DNA, 20 bp, Artificial Sequence
  chemically synthesized
tcctacatcctcacaaaacc

SEQ ID NO: 121559 - DNA, 20 bp, Artificial Sequence
  chemically synthesized
gaatactgcccaggttttgt

SEQ ID NO: 121560 - DNA, 20 bp, Artificial Sequence
  chemically synthesized
aatactgcccaggttttgtg

SEQ ID NO: 121561 - DNA, 20 bp, Artificial Sequence
  chemically synthesized
gcccaggttttgtgaggatg

SEQ ID NO: 121562 - DNA, 20 bp, Artificial Sequence
  chemically synthesized
cccaggttttgtgaggatgt

SEQ ID NO: 121563 - DNA, 20 bp, Artificial Sequence
  chemically synthesized
tgtgaggatgtaggattaaa

SEQ ID NO: 121564 - DNA, 20 bp, Artificial Sequence
  chemically synthesized
atgtcagtcaaggtcagtgg

SEQ ID NO: 121565 - DNA, 20 bp, Artificial Sequence
  chemically synthesized
caatgtcagtcaaggtcagt

SEQ ID NO: 121566 - DNA, 20 bp, Artificial Sequence
  chemically synthesized
tcaatgtcagtcaaggtcag

SEQ ID NO: 121567 - DNA, 20 bp, Artificial Sequence
  chemically synthesized
ccctcaatgtcagtcaaggt

SEQ ID NO: 121568 - DNA, 20 bp, Artificial Sequence
  chemically synthesized
agccccctcaatgtcagtca

SEQ ID NO: 121569 - DNA, 20 bp, Artificial Sequence
  chemically synthesized
gagccccctcaatgtcagtc

SEQ ID NO: 121570 - DNA, 20 bp, Artificial Sequence
  chemically synthesized
cactgaccttgactgacatt

SEQ ID NO: 121571 - DNA, 20 bp, Artificial Sequence
  chemically synthesized
actgaccttgactgacattg

SEQ ID NO: 121572 - DNA, 20 bp, Artificial Sequence
  chemically synthesized
ctgaccttgactgacattga

SEQ ID NO: 121573 - DNA, 20 bp, Artificial Sequence
  chemically synthesized
ggcctgagccccctcaatgt

SEQ ID NO: 121574 - DNA, 20 bp, Artificial Sequence
  chemically synthesized
tgaccttgactgacattgag

SEQ ID NO: 121575 - DNA, 20 bp, Artificial Sequence
  chemically synthesized
gaccttgactgacattgagg

SEQ ID NO: 121576 - DNA, 20 bp, Artificial Sequence
  chemically synthesized
tgactgacattgagggggct

SEQ ID NO: 121577 - DNA, 20 bp, Artificial Sequence
  chemically synthesized
gactgacattgagggggctc

SEQ ID NO: 121578 - DNA, 20 bp, Artificial Sequence
  chemically synthesized
ttgtgtttatataagggcct

SEQ ID NO: 121579 - DNA, 20 bp, Artificial Sequence
  chemically synthesized
gaacctttgtgtttatataa

SEQ ID NO: 121580 - DNA, 20 bp, Artificial Sequence
  chemically synthesized
agaacctttgtgtttatata

SEQ ID NO: 121581 - DNA, 20 bp, Artificial Sequence
  chemically synthesized
gagaacctttgtgtttatat

SEQ ID NO: 121582 - DNA, 20 bp, Artificial Sequence
  chemically synthesized
caggcccttatataaacaca

SEQ ID NO: 121583 - DNA, 20 bp, Artificial Sequence
  chemically synthesized
aggcccttatataaacacaa

SEQ ID NO: 121584 - DNA, 20 bp, Artificial Sequence
  chemically synthesized
tataaacacaaaggttctca

SEQ ID NO: 121585 - DNA, 20 bp, Artificial Sequence
  chemically synthesized
ataaacacaaaggttctcaa

SEQ ID NO: 121586 - DNA, 20 bp, Artificial Sequence
  chemically synthesized
aacacaaaggttctcaaagg

SEQ ID NO: 121587 - DNA, 20 bp, Artificial Sequence
  chemically synthesized
aaaaaaaaaaggctaccttt

SEQ ID NO: 121588 - DNA, 20 bp, Artificial Sequence
  chemically synthesized
agaagggagaaaaaaaaaaa

SEQ ID NO: 121589 - DNA, 20 bp, Artificial Sequence
  chemically synthesized
aagaagggagaaaaaaaaaa

SEQ ID NO: 121590 - DNA, 20 bp, Artificial Sequence
  chemically synthesized
ggggaatgtctttaagaagg

SEQ ID NO: 121591 - DNA, 20 bp, Artificial Sequence
  chemically synthesized
tttttttttctcccttctta

SEQ ID NO: 121592 - DNA, 20 bp, Artificial Sequence
  chemically synthesized
gtggggaatgtctttaagaa

SEQ ID NO: 121593 - DNA, 20 bp, Artificial Sequence
  chemically synthesized
tgtggggaatgtctttaaga

SEQ ID NO: 121594 - DNA, 20 bp, Artificial Sequence
  chemically synthesized
gtgtggggaatgtctttaag

SEQ ID NO: 121595 - DNA, 20 bp, Artificial Sequence
  chemically synthesized
tctgtgtggggaatgtcttt

SEQ ID NO: 121596 - DNA, 20 bp, Artificial Sequence
  chemically synthesized
tcttaaagacattccccaca

SEQ ID NO: 121597 - DNA, 20 bp, Artificial Sequence
  chemically synthesized
aagggaaaacattctgtgtg

SEQ ID NO: 121598 - DNA, 20 bp, Artificial Sequence
  chemically synthesized
aaagggaaaacattctgtgt

SEQ ID NO: 121599 - DNA, 20 bp, Artificial Sequence
  chemically synthesized
gaaagggaaaacattctgtg

SEQ ID NO: 121600 - DNA, 20 bp, Artificial Sequence
  chemically synthesized
gaatattaccgtaggagaaa

SEQ ID NO: 121601 - DNA, 20 bp, Artificial Sequence
  chemically synthesized
agaatattaccgtaggagaa

SEQ ID NO: 121602 - DNA, 20 bp, Artificial Sequence
  chemically synthesized
aatgttttccctttctccta

SEQ ID NO: 121603 - DNA, 20 bp, Artificial Sequence
  chemically synthesized
cagaatattaccgtaggaga

SEQ ID NO: 121604 - DNA, 20 bp, Artificial Sequence
  chemically synthesized
cgggcagaatattaccgtag

SEQ ID NO: 121605 - DNA, 20 bp, Artificial Sequence
  chemically synthesized
ggcgggcagaatattaccgt

SEQ ID NO: 121606 - DNA, 20 bp, Artificial Sequence
  chemically synthesized
gggcgggcagaatattaccg

SEQ ID NO: 121607 - DNA, 20 bp, Artificial Sequence
  chemically synthesized
taaaacccaaggtgggcggg

SEQ ID NO: 121608 - DNA, 20 bp, Artificial Sequence
  chemically synthesized
gggtaaaacccaaggtgggc

SEQ ID NO: 121609 - DNA, 20 bp, Artificial Sequence
  chemically synthesized
aatattctgcccgcccacct

SEQ ID NO: 121610 - DNA, 20 bp, Artificial Sequence
  chemically synthesized
tgggtaaaacccaaggtggg

SEQ ID NO: 121611 - DNA, 20 bp, Artificial Sequence
  chemically synthesized
atattctgcccgcccacctt

SEQ ID NO: 121612 - DNA, 20 bp, Artificial Sequence
  chemically synthesized
acttgggtaaaacccaaggt

SEQ ID NO: 121613 - DNA, 20 bp, Artificial Sequence
  chemically synthesized
cacttgggtaaaacccaagg

SEQ ID NO: 121614 - DNA, 20 bp, Artificial Sequence
  chemically synthesized
tgacacttgggtaaaaccca

SEQ ID NO: 121615 - DNA, 20 bp, Artificial Sequence
  chemically synthesized
atgacacttgggtaaaaccc

SEQ ID NO: 121616 - DNA, 20 bp, Artificial Sequence
  chemically synthesized
gcccaccttgggttttaccc

SEQ ID NO: 121617 - DNA, 20 bp, Artificial Sequence
  chemically synthesized
tcctagtgtgaatgacactt

SEQ ID NO: 121618 - DNA, 20 bp, Artificial Sequence
  chemically synthesized
ttcctagtgtgaatgacact

SEQ ID NO: 121619 - DNA, 20 bp, Artificial Sequence
  chemically synthesized
tacccaagtgtcattcacac

SEQ ID NO: 121620 - DNA, 20 bp, Artificial Sequence
  chemically synthesized
acccaagtgtcattcacact

SEQ ID NO: 121621 - DNA, 20 bp, Artificial Sequence
  chemically synthesized
ctggtcaaggtcatggttcc

SEQ ID NO: 121622 - DNA, 20 bp, Artificial Sequence
  chemically synthesized
ggcaaagctggtcaaggtca

SEQ ID NO: 121623 - DNA, 20 bp, Artificial Sequence
  chemically synthesized
ctaggaaccatgaccttgac

SEQ ID NO: 121624 - DNA, 20 bp, Artificial Sequence
  chemically synthesized
gcagtaggcaaagctggtca

SEQ ID NO: 121625 - DNA, 20 bp, Artificial Sequence
  chemically synthesized
agcagtaggcaaagctggtc

SEQ ID NO: 121626 - DNA, 20 bp, Artificial Sequence
  chemically synthesized
ttcacagcagtaggcaaagc

SEQ ID NO: 121627 - DNA, 20 bp, Artificial Sequence
  chemically synthesized
aaatttcacagcagtaggca

SEQ ID NO: 121628 - DNA, 20 bp, Artificial Sequence
  chemically synthesized
gtagtaaatttcacagcagt

SEQ ID NO: 121629 - DNA, 20 bp, Artificial Sequence
  chemically synthesized
agtagtaaatttcacagcag

SEQ ID NO: 121630 - DNA, 20 bp, Artificial Sequence
  chemically synthesized
cccagtagtaaatttcacag

SEQ ID NO: 121631 - DNA, 20 bp, Artificial Sequence
  chemically synthesized
tatcccagtagtaaatttca

SEQ ID NO: 121632 - DNA, 20 bp, Artificial Sequence
  chemically synthesized
actgctgtgaaatttactac

SEQ ID NO: 121633 - DNA, 20 bp, Artificial Sequence
  chemically synthesized
ctgctgtgaaatttactact

SEQ ID NO: 121634 - DNA, 20 bp, Artificial Sequence
  chemically synthesized
gaggtctggagttatcccag

SEQ ID NO: 121635 - DNA, 20 bp, Artificial Sequence
  chemically synthesized
tctgaggtctggagttatcc

SEQ ID NO: 121636 - DNA, 20 bp, Artificial Sequence
  chemically synthesized
atttactactgggataactc

SEQ ID NO: 121637 - DNA, 20 bp, Artificial Sequence
  chemically synthesized
actgggataactccagacct

SEQ ID NO: 121638 - DNA, 20 bp, Artificial Sequence
  chemically synthesized
tacactccttctgaggtctg

SEQ ID NO: 121639 - DNA, 20 bp, Artificial Sequence
  chemically synthesized
tttacactccttctgaggtc

SEQ ID NO: 121640 - DNA, 20 bp, Artificial Sequence
  chemically synthesized
gggataactccagacctcag

SEQ ID NO: 121641 - DNA, 20 bp, Artificial Sequence
  chemically synthesized
ggataactccagacctcaga

SEQ ID NO: 121642 - DNA, 20 bp, Artificial Sequence
  chemically synthesized
ataactccagacctcagaag

SEQ ID NO: 121643 - DNA, 20 bp, Artificial Sequence
  chemically synthesized
ttgaatttacactccttctg

SEQ ID NO: 121644 - DNA, 20 bp, Artificial Sequence
  chemically synthesized
tttgaatttacactccttct

SEQ ID NO: 121645 - DNA, 20 bp, Artificial Sequence
  chemically synthesized
gtgtaaattcaaaaatacaa

SEQ ID NO: 121646 - DNA, 20 bp, Artificial Sequence
  chemically synthesized
aagagaaaagggtgtgtgtg

SEQ ID NO: 121647 - DNA, 20 bp, Artificial Sequence
  chemically synthesized
tggaattcagaaagagaaaa

SEQ ID NO: 121648 - DNA, 20 bp, Artificial Sequence
  chemically synthesized
atggaattcagaaagagaaa

SEQ ID NO: 121649 - DNA, 20 bp, Artificial Sequence
  chemically synthesized
aatggaattcagaaagagaa

SEQ ID NO: 121650 - DNA, 20 bp, Artificial Sequence
  chemically synthesized
ttgtcaatggaattcagaaa

SEQ ID NO: 121651 - DNA, 20 bp, Artificial Sequence
  chemically synthesized
cattgtcaatggaattcaga

SEQ ID NO: 121652 - DNA, 20 bp, Artificial Sequence
  chemically synthesized
acaccattgtcaatggaatt

SEQ ID NO: 121653 - DNA, 20 bp, Artificial Sequence
  chemically synthesized
tttctgaattccattgacaa

SEQ ID NO: 121654 - DNA, 20 bp, Artificial Sequence
  chemically synthesized
gtggtgtacaccattgtcaa

SEQ ID NO: 121655 - DNA, 20 bp, Artificial Sequence
  chemically synthesized
attgacaatggtgtacacca

SEQ ID NO: 121656 - DNA, 20 bp, Artificial Sequence
  chemically synthesized
ttgacaatggtgtacaccac

SEQ ID NO: 121657 - DNA, 20 bp, Artificial Sequence
  chemically synthesized
tgacaatggtgtacaccaca

SEQ ID NO: 121658 - DNA, 20 bp, Artificial Sequence
  chemically synthesized
accacacaagcaattccctg

SEQ ID NO: 121659 - DNA, 20 bp, Artificial Sequence
  chemically synthesized
accacagggaattgcttgtg

SEQ ID NO: 121660 - DNA, 20 bp, Artificial Sequence
  chemically synthesized
acacaccatgatcaccacac

SEQ ID NO: 121661 - DNA, 20 bp, Artificial Sequence
  chemically synthesized
aattgcttgtgtggtgatca

SEQ ID NO: 121662 - DNA, 20 bp, Artificial Sequence
  chemically synthesized
tgtggtgatcatggtgtgtg

SEQ ID NO: 121663 - DNA, 20 bp, Artificial Sequence
  chemically synthesized
gaagaaatttaaaatactgt

SEQ ID NO: 121664 - DNA, 20 bp, Artificial Sequence
  chemically synthesized
atttaaaatactgtgagcac

SEQ ID NO: 121665 - DNA, 20 bp, Artificial Sequence
  chemically synthesized
tttttataagctagtgctca

SEQ ID NO: 121666 - DNA, 20 bp, Artificial Sequence
  chemically synthesized
ggcaatctttttttataagc

SEQ ID NO: 121667 - DNA, 20 bp, Artificial Sequence
  chemically synthesized
tgagcactagcttataaaaa

SEQ ID NO: 121668 - DNA, 20 bp, Artificial Sequence
  chemically synthesized
caaaggcaatctttttttat

SEQ ID NO: 121669 - DNA, 20 bp, Artificial Sequence
  chemically synthesized
acacacacacacatatacaa

SEQ ID NO: 121670 - DNA, 20 bp, Artificial Sequence
  chemically synthesized
tacacacacacacatataca

SEQ ID NO: 121671 - DNA, 20 bp, Artificial Sequence
  chemically synthesized
atgtgtgtgtgttttctatg

SEQ ID NO: 121672 - DNA, 20 bp, Artificial Sequence
  chemically synthesized
ttagcattttatattcttca

SEQ ID NO: 121673 - DNA, 20 bp, Artificial Sequence
  chemically synthesized
gaaacaatcttttggggatt

SEQ ID NO: 121674 - DNA, 20 bp, Artificial Sequence
  chemically synthesized
ataaaatgctaaatccccaa

SEQ ID NO: 121675 - DNA, 20 bp, Artificial Sequence
  chemically synthesized
gttggggaaacaatcttttg

SEQ ID NO: 121676 - DNA, 20 bp, Artificial Sequence
  chemically synthesized
ggttggggaaacaatctttt

SEQ ID NO: 121677 - DNA, 20 bp, Artificial Sequence
  chemically synthesized
tggttggggaaacaatcttt

SEQ ID NO: 121678 - DNA, 20 bp, Artificial Sequence
  chemically synthesized
caaaagattgtttccccaac

SEQ ID NO: 121679 - DNA, 20 bp, Artificial Sequence
  chemically synthesized
aaaagattgtttccccaacc

SEQ ID NO: 121680 - DNA, 20 bp, Artificial Sequence
  chemically synthesized
aaacatttctttcctggttg

SEQ ID NO: 121681 - DNA, 20 bp, Artificial Sequence
  chemically synthesized
gaaacatttctttcctggtt

SEQ ID NO: 121682 - DNA, 20 bp, Artificial Sequence
  chemically synthesized
gattgtttccccaaccagga

SEQ ID NO: 121683 - DNA, 20 bp, Artificial Sequence
  chemically synthesized
tgaaacatttctttcctggt

SEQ ID NO: 121684 - DNA, 20 bp, Artificial Sequence
  chemically synthesized
aatgtgaaacatttctttcc

SEQ ID NO: 121685 - DNA, 20 bp, Artificial Sequence
  chemically synthesized
tagtgcagtagcagcataat

SEQ ID NO: 121686 - DNA, 20 bp, Artificial Sequence
  chemically synthesized
atagtgcagtagcagcataa

SEQ ID NO: 121687 - DNA, 20 bp, Artificial Sequence
  chemically synthesized
tcaagcacatagtgcagtag

SEQ ID NO: 121688 - DNA, 20 bp, Artificial Sequence
  chemically synthesized
atatcaagcacatagtgcag

SEQ ID NO: 121689 - DNA, 20 bp, Artificial Sequence
  chemically synthesized
tatatatcaagcacatagtg

SEQ ID NO: 121690 - DNA, 20 bp, Artificial Sequence
  chemically synthesized
gtgaatatatatcaagcaca

SEQ ID NO: 121691 - DNA, 20 bp, Artificial Sequence
  chemically synthesized
agatactgtgaatatatatc

SEQ ID NO: 121692 - DNA, 20 bp, Artificial Sequence
  chemically synthesized
atgtgcttgatatatattca

SEQ ID NO: 121693 - DNA, 20 bp, Artificial Sequence
  chemically synthesized
gatatatattcacagtatct

SEQ ID NO: 121694 - DNA, 20 bp, Artificial Sequence
  chemically synthesized
atatatattcacagtatctt

SEQ ID NO: 121695 - DNA, 20 bp, Artificial Sequence
  chemically synthesized
tatattcacagtatcttagg

SEQ ID NO: 121696 - DNA, 20 bp, Artificial Sequence
  chemically synthesized
cacaatcactttttctacct

SEQ ID NO: 121697 - DNA, 20 bp, Artificial Sequence
  chemically synthesized
cacagtatcttaggtagaaa

SEQ ID NO: 121698 - DNA, 20 bp, Artificial Sequence
  chemically synthesized
ttaggtagaaaaagtgattg

SEQ ID NO: 121699 - DNA, 20 bp, Artificial Sequence
  chemically synthesized
aaaaagtgattgtggactat

SEQ ID NO: 121700 - DNA, 20 bp, Artificial Sequence
  chemically synthesized
aattaattcaggttgtctca

SEQ ID NO: 121701 - DNA, 20 bp, Artificial Sequence
  chemically synthesized
aaaattcttgaaattaattc

SEQ ID NO: 121702 - DNA, 20 bp, Artificial Sequence
  chemically synthesized
caaaattcttgaaattaatt

SEQ ID NO: 121703 - DNA, 20 bp, Artificial Sequence
  chemically synthesized
agacaacctgaattaatttc

SEQ ID NO: 121704 - DNA, 20 bp, Artificial Sequence
  chemically synthesized
gaattaatttcaagaatttt

SEQ ID NO: 121705 - DNA, 20 bp, Artificial Sequence
  chemically synthesized
gagaagacaaacaattaaag

SEQ ID NO: 121706 - DNA, 20 bp, Artificial Sequence
  chemically synthesized
tgagagaagacaaacaatta

SEQ ID NO: 121707 - DNA, 20 bp, Artificial Sequence
  chemically synthesized
acacataaaagaaatgagag

SEQ ID NO: 121708 - DNA, 20 bp, Artificial Sequence
  chemically synthesized
cttacacataaaagaaatga

SEQ ID NO: 121709 - DNA, 20 bp, Artificial Sequence
  chemically synthesized
ttcttacacataaaagaaat

SEQ ID NO: 121710 - DNA, 20 bp, Artificial Sequence
  chemically synthesized
aaataagttcttacacataa

SEQ ID NO: 121711 - DNA, 20 bp, Artificial Sequence
  chemically synthesized
ctctcatttcttttatgtgt

SEQ ID NO: 121712 - DNA, 20 bp, Artificial Sequence
  chemically synthesized
ttatgtgtaagaacttattt

SEQ ID NO: 121713 - DNA, 20 bp, Artificial Sequence
  chemically synthesized
agggtcaatatcactaaaat

SEQ ID NO: 121714 - DNA, 20 bp, Artificial Sequence
  chemically synthesized
ttagtgatattgaccctaca

SEQ ID NO: 121715 - DNA, 20 bp, Artificial Sequence
  chemically synthesized
gtgatattgaccctacatgg

SEQ ID NO: 121716 - DNA, 20 bp, Artificial Sequence
  chemically synthesized
cctctcttttctaccatgta

SEQ ID NO: 121717 - DNA, 20 bp, Artificial Sequence
  chemically synthesized
tcctctcttttctaccatgt

SEQ ID NO: 121718 - DNA, 20 bp, Artificial Sequence
  chemically synthesized
ctcctctcttttctaccatg

SEQ ID NO: 121719 - DNA, 20 bp, Artificial Sequence
  chemically synthesized
attgaccctacatggtagaa

SEQ ID NO: 121720 - DNA, 20 bp, Artificial Sequence
  chemically synthesized
tgaccctacatggtagaaaa

SEQ ID NO: 121721 - DNA, 20 bp, Artificial Sequence
  chemically synthesized
accctacatggtagaaaaga

SEQ ID NO: 121722 - DNA, 20 bp, Artificial Sequence
  chemically synthesized
ccctacatggtagaaaagag

SEQ ID NO: 121723 - DNA, 20 bp, Artificial Sequence
  chemically synthesized
ctacatggtagaaaagagag

SEQ ID NO: 121724 - DNA, 20 bp, Artificial Sequence
  chemically synthesized
tacatggtagaaaagagagg

SEQ ID NO: 121725 - DNA, 20 bp, Artificial Sequence
  chemically synthesized
atggtagaaaagagaggagg

SEQ ID NO: 121726 - DNA, 20 bp, Artificial Sequence
  chemically synthesized
ggtagaaaagagaggaggaa

SEQ ID NO: 121727 - DNA, 20 bp, Artificial Sequence
  chemically synthesized
gaaaagagaggaggaagaga

SEQ ID NO: 121728 - DNA, 20 bp, Artificial Sequence
  chemically synthesized
aaagagaggaggaagagaaa

SEQ ID NO: 121729 - DNA, 20 bp, Artificial Sequence
  chemically synthesized
gagaggaggaagagaaagag

SEQ ID NO: 121730 - DNA, 20 bp, Artificial Sequence
  chemically synthesized
ggaagagaaagagtagctaa

SEQ ID NO: 121731 - DNA, 20 bp, Artificial Sequence
  chemically synthesized
gaaagagtagctaaaagcct

SEQ ID NO: 121732 - DNA, 20 bp, Artificial Sequence
  chemically synthesized
cattgtattgctcaggcttt

SEQ ID NO: 121733 - DNA, 20 bp, Artificial Sequence
  chemically synthesized
gcaggctcattgtattgctc

SEQ ID NO: 121734 - DNA, 20 bp, Artificial Sequence
  chemically synthesized
agcaggctcattgtattgct

SEQ ID NO: 121735 - DNA, 20 bp, Artificial Sequence
  chemically synthesized
aaaagcctgagcaatacaat

SEQ ID NO: 121736 - DNA, 20 bp, Artificial Sequence
  chemically synthesized
gagcaatacaatgagcctgc

SEQ ID NO: 121737 - DNA, 20 bp, Artificial Sequence
  chemically synthesized
agcaatacaatgagcctgct

SEQ ID NO: 121738 - DNA, 20 bp, Artificial Sequence
  chemically synthesized
cgccaggattcaaacccagc

SEQ ID NO: 121739 - DNA, 20 bp, Artificial Sequence
  chemically synthesized
acgccaggattcaaacccag

SEQ ID NO: 121740 - DNA, 20 bp, Artificial Sequence
  chemically synthesized
atcacgccaggattcaaacc

SEQ ID NO: 121741 - DNA, 20 bp, Artificial Sequence
  chemically synthesized
agcctgctgggtttgaatcc

SEQ ID NO: 121742 - DNA, 20 bp, Artificial Sequence
  chemically synthesized
tgccactaagcgatcacgcc

SEQ ID NO: 121743 - DNA, 20 bp, Artificial Sequence
  chemically synthesized
ttgccactaagcgatcacgc

SEQ ID NO: 121744 - DNA, 20 bp, Artificial Sequence
  chemically synthesized
tgaatcctggcgtgatcgct

SEQ ID NO: 121745 - DNA, 20 bp, Artificial Sequence
  chemically synthesized
atcctggcgtgatcgcttag

SEQ ID NO: 121746 - DNA, 20 bp, Artificial Sequence
  chemically synthesized
taactctcccatttgccact

SEQ ID NO: 121747 - DNA, 20 bp, Artificial Sequence
  chemically synthesized
cgtgatcgcttagtggcaaa

SEQ ID NO: 121748 - DNA, 20 bp, Artificial Sequence
  chemically synthesized
gtgatcgcttagtggcaaat

SEQ ID NO: 121749 - DNA, 20 bp, Artificial Sequence
  chemically synthesized
gatcgcttagtggcaaatgg

SEQ ID NO: 121750 - DNA, 20 bp, Artificial Sequence
  chemically synthesized
tcgcttagtggcaaatggga

SEQ ID NO: 121751 - DNA, 20 bp, Artificial Sequence
  chemically synthesized
gaggaaactgaggcacagaa

SEQ ID NO: 121752 - DNA, 20 bp, Artificial Sequence
  chemically synthesized
taattatcttttctgtgcct

SEQ ID NO: 121753 - DNA, 20 bp, Artificial Sequence
  chemically synthesized
caaaggaggaaactgaggca

SEQ ID NO: 121754 - DNA, 20 bp, Artificial Sequence
  chemically synthesized
tttagcaaaggaggaaactg

SEQ ID NO: 121755 - DNA, 20 bp, Artificial Sequence
  chemically synthesized
atttagcaaaggaggaaact

SEQ ID NO: 121756 - DNA, 20 bp, Artificial Sequence
  chemically synthesized
atattcccatttagcaaagg

SEQ ID NO: 121757 - DNA, 20 bp, Artificial Sequence
  chemically synthesized
aatattcccatttagcaaag

SEQ ID NO: 121758 - DNA, 20 bp, Artificial Sequence
  chemically synthesized
ttaatattcccatttagcaa

SEQ ID NO: 121759 - DNA, 20 bp, Artificial Sequence
  chemically synthesized
cagtttcctcctttgctaaa

SEQ ID NO: 121760 - DNA, 20 bp, Artificial Sequence
  chemically synthesized
gttaatattcccatttagca

SEQ ID NO: 121761 - DNA, 20 bp, Artificial Sequence
  chemically synthesized
agtttcctcctttgctaaat

SEQ ID NO: 121762 - DNA, 20 bp, Artificial Sequence
  chemically synthesized
atactgttaatattcccatt

SEQ ID NO: 121763 - DNA, 20 bp, Artificial Sequence
  chemically synthesized
ttgctaaatgggaatattaa

SEQ ID NO: 121764 - DNA, 20 bp, Artificial Sequence
  chemically synthesized
gaatattaacagtatttatg

SEQ ID NO: 121765 - DNA, 20 bp, Artificial Sequence
  chemically synthesized
tatttatgtggaaatatgat

SEQ ID NO: 121766 - DNA, 20 bp, Artificial Sequence
  chemically synthesized
atttatgtggaaatatgatt

SEQ ID NO: 121767 - DNA, 20 bp, Artificial Sequence
  chemically synthesized
tatgtggaaatatgattagg

SEQ ID NO: 121768 - DNA, 20 bp, Artificial Sequence
  chemically synthesized
atgtggaaatatgattaggt

SEQ ID NO: 121769 - DNA, 20 bp, Artificial Sequence
  chemically synthesized
tatgattaggtgggttaact

SEQ ID NO: 121770 - DNA, 20 bp, Artificial Sequence
  chemically synthesized
tgattaggtgggttaactta

SEQ ID NO: 121771 - DNA, 20 bp, Artificial Sequence
  chemically synthesized
atgttctccctgaattctct

SEQ ID NO: 121772 - DNA, 20 bp, Artificial Sequence
  chemically synthesized
gtgggttaacttagagaatt

SEQ ID NO: 121773 - DNA, 20 bp, Artificial Sequence
  chemically synthesized
tgggttaacttagagaattc

SEQ ID NO: 121774 - DNA, 20 bp, Artificial Sequence
  chemically synthesized
gggttaacttagagaattca

SEQ ID NO: 121775 - DNA, 20 bp, Artificial Sequence
  chemically synthesized
gttaacttagagaattcagg

SEQ ID NO: 121776 - DNA, 20 bp, Artificial Sequence
  chemically synthesized
attcagggagaacatttaca

SEQ ID NO: 121777 - DNA, 20 bp, Artificial Sequence
  chemically synthesized
ttcagggagaacatttacaa

SEQ ID NO: 121778 - DNA, 20 bp, Artificial Sequence
  chemically synthesized
agaacatttacaaaggtgcc

SEQ ID NO: 121779 - DNA, 20 bp, Artificial Sequence
  chemically synthesized
tttaatccttcgggcacgcc

SEQ ID NO: 121780 - DNA, 20 bp, Artificial Sequence
  chemically synthesized
atttaatccttcgggcacgc

SEQ ID NO: 121781 - DNA, 20 bp, Artificial Sequence
  chemically synthesized
aaaggtgcctggcgtgcccg

SEQ ID NO: 121782 - DNA, 20 bp, Artificial Sequence
  chemically synthesized
aaggtgcctggcgtgcccga

SEQ ID NO: 121783 - DNA, 20 bp, Artificial Sequence
  chemically synthesized
taatatttatttaatccttc

SEQ ID NO: 121784 - DNA, 20 bp, Artificial Sequence
  chemically synthesized
ttaatatttatttaatcctt

SEQ ID NO: 121785 - DNA, 20 bp, Artificial Sequence
  chemically synthesized
aaataaatattaatcatcat

SEQ ID NO: 121786 - DNA, 20 bp, Artificial Sequence
  chemically synthesized
atattaatcatcatcagcat

SEQ ID NO: 121787 - DNA, 20 bp, Artificial Sequence
  chemically synthesized
atcatcatcattactactgc

SEQ ID NO: 121788 - DNA, 20 bp, Artificial Sequence
  chemically synthesized
agtagtagatgtgctagcag

SEQ ID NO: 121789 - DNA, 20 bp, Artificial Sequence
  chemically synthesized
attagtagtagatgtgctag

SEQ ID NO: 121790 - DNA, 20 bp, Artificial Sequence
  chemically synthesized
aaaattagtagtagatgtgc

SEQ ID NO: 121791 - DNA, 20 bp, Artificial Sequence
  chemically synthesized
tgactcattaaaattagtag

SEQ ID NO: 121792 - DNA, 20 bp, Artificial Sequence
  chemically synthesized
gtttgactcattaaaattag

SEQ ID NO: 121793 - DNA, 20 bp, Artificial Sequence
  chemically synthesized
atagtttgactcattaaaat

SEQ ID NO: 121794 - DNA, 20 bp, Artificial Sequence
  chemically synthesized
catctactactaattttaat

SEQ ID NO: 121795 - DNA, 20 bp, Artificial Sequence
  chemically synthesized
ggctcacactgtggggaata

SEQ ID NO: 121796 - DNA, 20 bp, Artificial Sequence
  chemically synthesized
gagtcaaactatattcccca

SEQ ID NO: 121797 - DNA, 20 bp, Artificial Sequence
  chemically synthesized
cagaaggggctcacactgtg

SEQ ID NO: 121798 - DNA, 20 bp, Artificial Sequence
  chemically synthesized
aactatattccccacagtgt

SEQ ID NO: 121799 - DNA, 20 bp, Artificial Sequence
  chemically synthesized
tcagaaggggctcacactgt

SEQ ID NO: 121800 - DNA, 20 bp, Artificial Sequence
  chemically synthesized
ttcagaaggggctcacactg

SEQ ID NO: 121801 - DNA, 20 bp, Artificial Sequence
  chemically synthesized
acttgctttgcattcagaag

SEQ ID NO: 121802 - DNA, 20 bp, Artificial Sequence
  chemically synthesized
tacttgctttgcattcagaa

SEQ ID NO: 121803 - DNA, 20 bp, Artificial Sequence
  chemically synthesized
ctacttgctttgcattcaga

SEQ ID NO: 121804 - DNA, 20 bp, Artificial Sequence
  chemically synthesized
gctacttgctttgcattcag

SEQ ID NO: 121805 - DNA, 20 bp, Artificial Sequence
  chemically synthesized
gtgagccccttctgaatgca

SEQ ID NO: 121806 - DNA, 20 bp, Artificial Sequence
  chemically synthesized
cgagctacttgctttgcatt

SEQ ID NO: 121807 - DNA, 20 bp, Artificial Sequence
  chemically synthesized
gccccttctgaatgcaaagc

SEQ ID NO: 121808 - DNA, 20 bp, Artificial Sequence
  chemically synthesized
ccttctgaatgcaaagcaag

SEQ ID NO: 121809 - DNA, 20 bp, Artificial Sequence
  chemically synthesized
gacaatgtccataaaacagc

SEQ ID NO: 121810 - DNA, 20 bp, Artificial Sequence
  chemically synthesized
gcaagtagctcgctgtttta

SEQ ID NO: 121811 - DNA, 20 bp, Artificial Sequence
  chemically synthesized
tctagacaatgtccataaaa

SEQ ID NO: 121812 - DNA, 20 bp, Artificial Sequence
  chemically synthesized
gctgttttatggacattgtc

SEQ ID NO: 121813 - DNA, 20 bp, Artificial Sequence
  chemically synthesized
ttttagagttgcagcatttc

SEQ ID NO: 121814 - DNA, 20 bp, Artificial Sequence
  chemically synthesized
aagggagaattttagagttg

SEQ ID NO: 121815 - DNA, 20 bp, Artificial Sequence
  chemically synthesized
aagttaaagggagaatttta

SEQ ID NO: 121816 - DNA, 20 bp, Artificial Sequence
  chemically synthesized
ccaagttaaagggagaattt

SEQ ID NO: 121817 - DNA, 20 bp, Artificial Sequence
  chemically synthesized
tttatcttccaagttaaagg

SEQ ID NO: 121818 - DNA, 20 bp, Artificial Sequence
  chemically synthesized
ctaaaattctccctttaact

SEQ ID NO: 121819 - DNA, 20 bp, Artificial Sequence
  chemically synthesized
cttttatcttccaagttaaa

SEQ ID NO: 121820 - DNA, 20 bp, Artificial Sequence
  chemically synthesized
gcttttatcttccaagttaa

SEQ ID NO: 121821 - DNA, 20 bp, Artificial Sequence
  chemically synthesized
tgcttttatcttccaagtta

SEQ ID NO: 121822 - DNA, 20 bp, Artificial Sequence
  chemically synthesized
aaattctccctttaacttgg

SEQ ID NO: 121823 - DNA, 20 bp, Artificial Sequence
  chemically synthesized
tgcacttgcttttatcttcc

SEQ ID NO: 121824 - DNA, 20 bp, Artificial Sequence
  chemically synthesized
ccctttaacttggaagataa

SEQ ID NO: 121825 - DNA, 20 bp, Artificial Sequence
  chemically synthesized
ttaacttggaagataaaagc

SEQ ID NO: 121826 - DNA, 20 bp, Artificial Sequence
  chemically synthesized
ggaagataaaagcaagtgca

SEQ ID NO: 121827 - DNA, 20 bp, Artificial Sequence
  chemically synthesized
accttaaaattttaatgata

SEQ ID NO: 121828 - DNA, 20 bp, Artificial Sequence
  chemically synthesized
caaccttaaaattttaatga

SEQ ID NO: 121829 - DNA, 20 bp, Artificial Sequence
  chemically synthesized
agctctatcattaaaatttt

SEQ ID NO: 121830 - DNA, 20 bp, Artificial Sequence
  chemically synthesized
gctctatcattaaaatttta

SEQ ID NO: 121831 - DNA, 20 bp, Artificial Sequence
  chemically synthesized
aaaattttaaggttgaatat

SEQ ID NO: 121832 - DNA, 20 bp, Artificial Sequence
  chemically synthesized
atcacaaaacacattttaaa

SEQ ID NO: 121833 - DNA, 20 bp, Artificial Sequence
  chemically synthesized
tatcacaaaacacattttaa

SEQ ID NO: 121834 - DNA, 20 bp, Artificial Sequence
  chemically synthesized
gttttgtgatattcacctac

SEQ ID NO: 121835 - DNA, 20 bp, Artificial Sequence
  chemically synthesized
caaacatttattttacttgt

SEQ ID NO: 121836 - DNA, 20 bp, Artificial Sequence
  chemically synthesized
acaaacatttattttacttg

SEQ ID NO: 121837 - DNA, 20 bp, Artificial Sequence
  chemically synthesized
agtaaaataaatgtttgttc

SEQ ID NO: 121838 - DNA, 20 bp, Artificial Sequence
  chemically synthesized
gtaaaataaatgtttgttcc

SEQ ID NO: 121839 - DNA, 20 bp, Artificial Sequence
  chemically synthesized
aatttaagtaatagttcacc

SEQ ID NO: 121840 - DNA, 20 bp, Artificial Sequence
  chemically synthesized
gtcattaaaaatttaagtaa

SEQ ID NO: 121841 - DNA, 20 bp, Artificial Sequence
  chemically synthesized
gacacagtcattaaaaattt

SEQ ID NO: 121842 - DNA, 20 bp, Artificial Sequence
  chemically synthesized
tttttaatgactgtgtctca

SEQ ID NO: 121843 - DNA, 20 bp, Artificial Sequence
  chemically synthesized
cttgaagttcctttgagaca

SEQ ID NO: 121844 - DNA, 20 bp, Artificial Sequence
  chemically synthesized
ttttaatgactgtgtctcaa

SEQ ID NO: 121845 - DNA, 20 bp, Artificial Sequence
  chemically synthesized
gcctttcttgaagttccttt

SEQ ID NO: 121846 - DNA, 20 bp, Artificial Sequence
  chemically synthesized
ctgtgtctcaaaggaacttc

SEQ ID NO: 121847 - DNA, 20 bp, Artificial Sequence
  chemically synthesized
gtctcaaaggaacttcaaga

SEQ ID NO: 121848 - DNA, 20 bp, Artificial Sequence
  chemically synthesized
tctcaaaggaacttcaagaa

SEQ ID NO: 121849 - DNA, 20 bp, Artificial Sequence
  chemically synthesized
actctgcactgcctttcttg

SEQ ID NO: 121850 - DNA, 20 bp, Artificial Sequence
  chemically synthesized
caaaggaacttcaagaaagg

SEQ ID NO: 121851 - DNA, 20 bp, Artificial Sequence
  chemically synthesized
gaacttcaagaaaggcagtg

SEQ ID NO: 121852 - DNA, 20 bp, Artificial Sequence
  chemically synthesized
acttcaagaaaggcagtgca

SEQ ID NO: 121853 - DNA, 20 bp, Artificial Sequence
  chemically synthesized
aaggcagtgcagagtaacga

SEQ ID NO: 121854 - DNA, 20 bp, Artificial Sequence
  chemically synthesized
aggcagtgcagagtaacgaa

SEQ ID NO: 121855 - DNA, 20 bp, Artificial Sequence
  chemically synthesized
gtaacgaaaggacatcttcc

SEQ ID NO: 121856 - DNA, 20 bp, Artificial Sequence
  chemically synthesized
taacgaaaggacatcttccc

SEQ ID NO: 121857 - DNA, 20 bp, Artificial Sequence
  chemically synthesized
cgaaaggacatcttcccagg

SEQ ID NO: 121858 - DNA, 20 bp, Artificial Sequence
  chemically synthesized
gacaagcaaaacttcctggg

SEQ ID NO: 121859 - DNA, 20 bp, Artificial Sequence
  chemically synthesized
atggacaagcaaaacttcct

SEQ ID NO: 121860 - DNA, 20 bp, Artificial Sequence
  chemically synthesized
aatggacaagcaaaacttcc

SEQ ID NO: 121861 - DNA, 20 bp, Artificial Sequence
  chemically synthesized
caaactgcagaacaatggac

SEQ ID NO: 121862 - DNA, 20 bp, Artificial Sequence
  chemically synthesized
aagatcaaactgcagaacaa

SEQ ID NO: 121863 - DNA, 20 bp, Artificial Sequence
  chemically synthesized
tttgcttgtccattgttctg

SEQ ID NO: 121864 - DNA, 20 bp, Artificial Sequence
  chemically synthesized
acttccttaagatcaaactg

SEQ ID NO: 121865 - DNA, 20 bp, Artificial Sequence
  chemically synthesized
ttgttctgcagtttgatctt

SEQ ID NO: 121866 - DNA, 20 bp, Artificial Sequence
  chemically synthesized
tgttctgcagtttgatctta

SEQ ID NO: 121867 - DNA, 20 bp, Artificial Sequence
  chemically synthesized
tctgcagtttgatcttaagg

SEQ ID NO: 121868 - DNA, 20 bp, Artificial Sequence
  chemically synthesized
acaaggttaatgacttcctt

SEQ ID NO: 121869 - DNA, 20 bp, Artificial Sequence
  chemically synthesized
aaggaagtcattaaccttgt

SEQ ID NO: 121870 - DNA, 20 bp, Artificial Sequence
  chemically synthesized
tgacaaaactgggacttaca

SEQ ID NO: 121871 - DNA, 20 bp, Artificial Sequence
  chemically synthesized
atgacaaaactgggacttac

SEQ ID NO: 121872 - DNA, 20 bp, Artificial Sequence
  chemically synthesized
gtcattaaccttgtaagtcc

SEQ ID NO: 121873 - DNA, 20 bp, Artificial Sequence
  chemically synthesized
agtttacagatgacaaaact

SEQ ID NO: 121874 - DNA, 20 bp, Artificial Sequence
  chemically synthesized
tagtttacagatgacaaaac

SEQ ID NO: 121875 - DNA, 20 bp, Artificial Sequence
  chemically synthesized
cagttttgtcatctgtaaac

SEQ ID NO: 121876 - DNA, 20 bp, Artificial Sequence
  chemically synthesized
agttttgtcatctgtaaact

SEQ ID NO: 121877 - DNA, 20 bp, Artificial Sequence
  chemically synthesized
agtaaccccatcctagttta

SEQ ID NO: 121878 - DNA, 20 bp, Artificial Sequence
  chemically synthesized
ttgtcatctgtaaactagga

SEQ ID NO: 121879 - DNA, 20 bp, Artificial Sequence
  chemically synthesized
tgtcatctgtaaactaggat

SEQ ID NO: 121880 - DNA, 20 bp, Artificial Sequence
  chemically synthesized
gtcatctgtaaactaggatg

SEQ ID NO: 121881 - DNA, 20 bp, Artificial Sequence
  chemically synthesized
cagagcaagtaaccccatcc

SEQ ID NO: 121882 - DNA, 20 bp, Artificial Sequence
  chemically synthesized
gccggaggcatggtcagagc

SEQ ID NO: 121883 - DNA, 20 bp, Artificial Sequence
  chemically synthesized
acaagccggaggcatggtca

SEQ ID NO: 121884 - DNA, 20 bp, Artificial Sequence
  chemically synthesized
ggacaagccggaggcatggt

SEQ ID NO: 121885 - DNA, 20 bp, Artificial Sequence
  chemically synthesized
acttgctctgaccatgcctc

SEQ ID NO: 121886 - DNA, 20 bp, Artificial Sequence
  chemically synthesized
ttcaggacaagccggaggca

SEQ ID NO: 121887 - DNA, 20 bp, Artificial Sequence
  chemically synthesized
gacacttcaggacaagccgg

SEQ ID NO: 121888 - DNA, 20 bp, Artificial Sequence
  chemically synthesized
tgacacttcaggacaagccg

SEQ ID NO: 121889 - DNA, 20 bp, Artificial Sequence
  chemically synthesized
tttgacacttcaggacaagc

SEQ ID NO: 121890 - DNA, 20 bp, Artificial Sequence
  chemically synthesized
catgcctccggcttgtcctg

SEQ ID NO: 121891 - DNA, 20 bp, Artificial Sequence
  chemically synthesized
tgattttgacacttcaggac

SEQ ID NO: 121892 - DNA, 20 bp, Artificial Sequence
  chemically synthesized
ttgcttgattttgacacttc

SEQ ID NO: 121893 - DNA, 20 bp, Artificial Sequence
  chemically synthesized
attgcttgattttgacactt

SEQ ID NO: 121894 - DNA, 20 bp, Artificial Sequence
  chemically synthesized
tgtcctgaagtgtcaaaatc

SEQ ID NO: 121895 - DNA, 20 bp, Artificial Sequence
  chemically synthesized
gtcaaaatcaagcaattgct

SEQ ID NO: 121896 - DNA, 20 bp, Artificial Sequence
  chemically synthesized
atcctgttttacaattttcc

SEQ ID NO: 121897 - DNA, 20 bp, Artificial Sequence
  chemically synthesized
ttgctcggaaaattgtaaaa

SEQ ID NO: 121898 - DNA, 20 bp, Artificial Sequence
  chemically synthesized
tgctcggaaaattgtaaaac

SEQ ID NO: 121899 - DNA, 20 bp, Artificial Sequence
  chemically synthesized
tttttgttcataagcatatt

SEQ ID NO: 121900 - DNA, 20 bp, Artificial Sequence
  chemically synthesized
ctttttgttcataagcatat

SEQ ID NO: 121901 - DNA, 20 bp, Artificial Sequence
  chemically synthesized
atgtagaactttttgttcat

SEQ ID NO: 121902 - DNA, 20 bp, Artificial Sequence
  chemically synthesized
ctaatatgcttatgaacaaa

SEQ ID NO: 121903 - DNA, 20 bp, Artificial Sequence
  chemically synthesized
gaacaaaaagttctacatgt

SEQ ID NO: 121904 - DNA, 20 bp, Artificial Sequence
  chemically synthesized
aaaataacaaatccaacatg

SEQ ID NO: 121905 - DNA, 20 bp, Artificial Sequence
  chemically synthesized
ttggatttgttatttttcct

SEQ ID NO: 121906 - DNA, 20 bp, Artificial Sequence
  chemically synthesized
gaatgtaaatacaggatcca

SEQ ID NO: 121907 - DNA, 20 bp, Artificial Sequence
  chemically synthesized
tgaatgtaaatacaggatcc

SEQ ID NO: 121908 - DNA, 20 bp, Artificial Sequence
  chemically synthesized
tggttcatgaatgtaaatac

SEQ ID NO: 121909 - DNA, 20 bp, Artificial Sequence
  chemically synthesized
ttggttcatgaatgtaaata

SEQ ID NO: 121910 - DNA, 20 bp, Artificial Sequence
  chemically synthesized
tgtatttacattcatgaacc

SEQ ID NO: 121911 - DNA, 20 bp, Artificial Sequence
  chemically synthesized
gtatttacattcatgaacca

SEQ ID NO: 121912 - DNA, 20 bp, Artificial Sequence
  chemically synthesized
tatttacattcatgaaccaa

SEQ ID NO: 121913 - DNA, 20 bp, Artificial Sequence
  chemically synthesized
aaatttttccatgaatccct

SEQ ID NO: 121914 - DNA, 20 bp, Artificial Sequence
  chemically synthesized
ttcatgaaccaagggattca

SEQ ID NO: 121915 - DNA, 20 bp, Artificial Sequence
  chemically synthesized
atggaaaaatttaactctgt

SEQ ID NO: 121916 - DNA, 20 bp, Artificial Sequence
  chemically synthesized
ctcttggtggttagctaaca

SEQ ID NO: 121917 - DNA, 20 bp, Artificial Sequence
  chemically synthesized
acctcttggtggttagctaa

SEQ ID NO: 121918 - DNA, 20 bp, Artificial Sequence
  chemically synthesized
aactctgttagctaaccacc

SEQ ID NO: 121919 - DNA, 20 bp, Artificial Sequence
  chemically synthesized
gcaaacgacctcttggtggt

SEQ ID NO: 121920 - DNA, 20 bp, Artificial Sequence
  chemically synthesized
ctctgttagctaaccaccaa

SEQ ID NO: 121921 - DNA, 20 bp, Artificial Sequence
  chemically synthesized
tctgttagctaaccaccaag

SEQ ID NO: 121922 - DNA, 20 bp, Artificial Sequence
  chemically synthesized
aagagcaaacgacctcttgg

SEQ ID NO: 121923 - DNA, 20 bp, Artificial Sequence
  chemically synthesized
tctaagagcaaacgacctct

SEQ ID NO: 121924 - DNA, 20 bp, Artificial Sequence
  chemically synthesized
accaagaggtcgtttgctct

SEQ ID NO: 121925 - DNA, 20 bp, Artificial Sequence
  chemically synthesized
tgggtagagaatggatctaa

SEQ ID NO: 121926 - DNA, 20 bp, Artificial Sequence
  chemically synthesized
aatgggtagagaatggatct

SEQ ID NO: 121927 - DNA, 20 bp, Artificial Sequence
  chemically synthesized
agtaggaaatgggtagagaa

SEQ ID NO: 121928 - DNA, 20 bp, Artificial Sequence
  chemically synthesized
agtggagtaggaaatgggta

SEQ ID NO: 121929 - DNA, 20 bp, Artificial Sequence
  chemically synthesized
tgagtggagtaggaaatggg

SEQ ID NO: 121930 - DNA, 20 bp, Artificial Sequence
  chemically synthesized
tactgagtggagtaggaaat

SEQ ID NO: 121931 - DNA, 20 bp, Artificial Sequence
  chemically synthesized
atactgagtggagtaggaaa

SEQ ID NO: 121932 - DNA, 20 bp, Artificial Sequence
  chemically synthesized
atctcaatactgagtggagt

SEQ ID NO: 121933 - DNA, 20 bp, Artificial Sequence
  chemically synthesized
tacccatttcctactccact

SEQ ID NO: 121934 - DNA, 20 bp, Artificial Sequence
  chemically synthesized
catctcaatactgagtggag

SEQ ID NO: 121935 - DNA, 20 bp, Artificial Sequence
  chemically synthesized
gtacatctcaatactgagtg

SEQ ID NO: 121936 - DNA, 20 bp, Artificial Sequence
  chemically synthesized
tagtacatctcaatactgag

SEQ ID NO: 121937 - DNA, 20 bp, Artificial Sequence
  chemically synthesized
ttcctactccactcagtatt

SEQ ID NO: 121938 - DNA, 20 bp, Artificial Sequence
  chemically synthesized
agttagtacatctcaatact

SEQ ID NO: 121939 - DNA, 20 bp, Artificial Sequence
  chemically synthesized
ttgagatgtactaactccca

SEQ ID NO: 121940 - DNA, 20 bp, Artificial Sequence
  chemically synthesized
ttctgacctcctatgggagt

SEQ ID NO: 121941 - DNA, 20 bp, Artificial Sequence
  chemically synthesized
tgagatgtactaactcccat

SEQ ID NO: 121942 - DNA, 20 bp, Artificial Sequence
  chemically synthesized
agatgtactaactcccatag

SEQ ID NO: 121943 - DNA, 20 bp, Artificial Sequence
  chemically synthesized
gatgtactaactcccatagg

SEQ ID NO: 121944 - DNA, 20 bp, Artificial Sequence
  chemically synthesized
gaaattctgacctcctatgg

SEQ ID NO: 121945 - DNA, 20 bp, Artificial Sequence
  chemically synthesized
aggaaattctgacctcctat

SEQ ID NO: 121946 - DNA, 20 bp, Artificial Sequence
  chemically synthesized
caggaaattctgacctccta

SEQ ID NO: 121947 - DNA, 20 bp, Artificial Sequence
  chemically synthesized
tactaactcccataggaggt

SEQ ID NO: 121948 - DNA, 20 bp, Artificial Sequence
  chemically synthesized
cataggaggtcagaatttcc

SEQ ID NO: 121949 - DNA, 20 bp, Artificial Sequence
  chemically synthesized
ataggaggtcagaatttcct

SEQ ID NO: 121950 - DNA, 20 bp, Artificial Sequence
  chemically synthesized
gccagctagcaagaaatccc

SEQ ID NO: 121951 - DNA, 20 bp, Artificial Sequence
  chemically synthesized
agccagctagcaagaaatcc

SEQ ID NO: 121952 - DNA, 20 bp, Artificial Sequence
  chemically synthesized
aatttcctgggatttcttgc

SEQ ID NO: 121953 - DNA, 20 bp, Artificial Sequence
  chemically synthesized
tcctgggatttcttgctagc

SEQ ID NO: 121954 - DNA, 20 bp, Artificial Sequence
  chemically synthesized
ctagttagaagccagctagc

SEQ ID NO: 121955 - DNA, 20 bp, Artificial Sequence
  chemically synthesized
taacctagttagaagccagc

SEQ ID NO: 121956 - DNA, 20 bp, Artificial Sequence
  chemically synthesized
gacttaacctagttagaagc

SEQ ID NO: 121957 - DNA, 20 bp, Artificial Sequence
  chemically synthesized
cttgctagctggcttctaac

SEQ ID NO: 121958 - DNA, 20 bp, Artificial Sequence
  chemically synthesized
ttgctagctggcttctaact

SEQ ID NO: 121959 - DNA, 20 bp, Artificial Sequence
  chemically synthesized
tcatgacttaacctagttag

SEQ ID NO: 121960 - DNA, 20 bp, Artificial Sequence
  chemically synthesized
gtctcatgacttaacctagt

SEQ ID NO: 121961 - DNA, 20 bp, Artificial Sequence
  chemically synthesized
agctggcttctaactaggtt

SEQ ID NO: 121962 - DNA, 20 bp, Artificial Sequence
  chemically synthesized
gtgtgtctcatgacttaacc

SEQ ID NO: 121963 - DNA, 20 bp, Artificial Sequence
  chemically synthesized
ttctaactaggttaagtcat

SEQ ID NO: 121964 - DNA, 20 bp, Artificial Sequence
  chemically synthesized
ggttaagtcatgagacacac

SEQ ID NO: 121965 - DNA, 20 bp, Artificial Sequence
  chemically synthesized
taagtcatgagacacactag

SEQ ID NO: 121966 - DNA, 20 bp, Artificial Sequence
  chemically synthesized
aagtcatgagacacactagt

SEQ ID NO: 121967 - DNA, 20 bp, Artificial Sequence
  chemically synthesized
gtcatgagacacactagtgg

SEQ ID NO: 121968 - DNA, 20 bp, Artificial Sequence
  chemically synthesized
catgctcttctgtctcccac

SEQ ID NO: 121969 - DNA, 20 bp, Artificial Sequence
  chemically synthesized
tgagacacactagtgggaga

SEQ ID NO: 121970 - DNA, 20 bp, Artificial Sequence
  chemically synthesized
gacacactagtgggagacag

SEQ ID NO: 121971 - DNA, 20 bp, Artificial Sequence
  chemically synthesized
cacactagtgggagacagaa

SEQ ID NO: 121972 - DNA, 20 bp, Artificial Sequence
  chemically synthesized
agtgggagacagaagagcat

SEQ ID NO: 121973 - DNA, 20 bp, Artificial Sequence
  chemically synthesized
ggagacagaagagcatgaga

SEQ ID NO: 121974 - DNA, 20 bp, Artificial Sequence
  chemically synthesized
gagacagaagagcatgagaa

SEQ ID NO: 121975 - DNA, 20 bp, Artificial Sequence
  chemically synthesized
agacagaagagcatgagaaa

SEQ ID NO: 121976 - DNA, 20 bp, Artificial Sequence
  chemically synthesized
agcatgagaaagggtgaaac

SEQ ID NO: 121977 - DNA, 20 bp, Artificial Sequence
  chemically synthesized
gccaagacagagagagaagg

SEQ ID NO: 121978 - DNA, 20 bp, Artificial Sequence
  chemically synthesized
tgccaagacagagagagaag

SEQ ID NO: 121979 - DNA, 20 bp, Artificial Sequence
  chemically synthesized
ctgccaagacagagagagaa

SEQ ID NO: 121980 - DNA, 20 bp, Artificial Sequence
  chemically synthesized
actgccaagacagagagaga

SEQ ID NO: 121981 - DNA, 20 bp, Artificial Sequence
  chemically synthesized
tactgccaagacagagagag

SEQ ID NO: 121982 - DNA, 20 bp, Artificial Sequence
  chemically synthesized
agatactgccaagacagaga

SEQ ID NO: 121983 - DNA, 20 bp, Artificial Sequence
  chemically synthesized
tcccccttctctctctgtct

SEQ ID NO: 121984 - DNA, 20 bp, Artificial Sequence
  chemically synthesized
ggagatactgccaagacaga

SEQ ID NO: 121985 - DNA, 20 bp, Artificial Sequence
  chemically synthesized
aaggagatactgccaagaca

SEQ ID NO: 121986 - DNA, 20 bp, Artificial Sequence
  chemically synthesized
cccttctctctctgtcttgg

SEQ ID NO: 121987 - DNA, 20 bp, Artificial Sequence
  chemically synthesized
caaaggagatactgccaaga

SEQ ID NO: 121988 - DNA, 20 bp, Artificial Sequence
  chemically synthesized
gagacaaaggagatactgcc

SEQ ID NO: 121989 - DNA, 20 bp, Artificial Sequence
  chemically synthesized
agtgggaaacggagacaaag

SEQ ID NO: 121990 - DNA, 20 bp, Artificial Sequence
  chemically synthesized
ccagtgggaaacggagacaa

SEQ ID NO: 121991 - DNA, 20 bp, Artificial Sequence
  chemically synthesized
tccagtgggaaacggagaca

SEQ ID NO: 121992 - DNA, 20 bp, Artificial Sequence
  chemically synthesized
cagccgtccagtgggaaacg

SEQ ID NO: 121993 - DNA, 20 bp, Artificial Sequence
  chemically synthesized
agcagccgtccagtgggaaa

SEQ ID NO: 121994 - DNA, 20 bp, Artificial Sequence
  chemically synthesized
cctttgtctccgtttcccac

SEQ ID NO: 121995 - DNA, 20 bp, Artificial Sequence
  chemically synthesized
tgtctccgtttcccactgga

SEQ ID NO: 121996 - DNA, 20 bp, Artificial Sequence
  chemically synthesized
agagggagcagccgtccagt

SEQ ID NO: 121997 - DNA, 20 bp, Artificial Sequence
  chemically synthesized
cagagggagcagccgtccag

SEQ ID NO: 121998 - DNA, 20 bp, Artificial Sequence
  chemically synthesized
ttacagagggagcagccgtc

SEQ ID NO: 121999 - DNA, 20 bp, Artificial Sequence
  chemically synthesized
taatggaattacagagggag

SEQ ID NO: 122000 - DNA, 20 bp, Artificial Sequence
  chemically synthesized
aggtaatggaattacagagg

SEQ ID NO: 122001 - DNA, 20 bp, Artificial Sequence
  chemically synthesized
gcaggtaatggaattacaga

SEQ ID NO: 122002 - DNA, 20 bp, Artificial Sequence
  chemically synthesized
agcaggtaatggaattacag

SEQ ID NO: 122003 - DNA, 20 bp, Artificial Sequence
  chemically synthesized
cagcaggtaatggaattaca

SEQ ID NO: 122004 - DNA, 20 bp, Artificial Sequence
  chemically synthesized
cacagcaggtaatggaatta

SEQ ID NO: 122005 - DNA, 20 bp, Artificial Sequence
  chemically synthesized
aaggtctgcacagcaggtaa

SEQ ID NO: 122006 - DNA, 20 bp, Artificial Sequence
  chemically synthesized
taattccattacctgctgtg

SEQ ID NO: 122007 - DNA, 20 bp, Artificial Sequence
  chemically synthesized
caatgtaaggtctgcacagc

SEQ ID NO: 122008 - DNA, 20 bp, Artificial Sequence
  chemically synthesized
ccaatgtaaggtctgcacag

SEQ ID NO: 122009 - DNA, 20 bp, Artificial Sequence
  chemically synthesized
cacccaatgtaaggtctgca

SEQ ID NO: 122010 - DNA, 20 bp, Artificial Sequence
  chemically synthesized
ctgctgtgcagaccttacat

SEQ ID NO: 122011 - DNA, 20 bp, Artificial Sequence
  chemically synthesized
tgctgtgcagaccttacatt

SEQ ID NO: 122012 - DNA, 20 bp, Artificial Sequence
  chemically synthesized
gtgctaattcacccaatgta

SEQ ID NO: 122013 - DNA, 20 bp, Artificial Sequence
  chemically synthesized
ggtgctaattcacccaatgt

SEQ ID NO: 122014 - DNA, 20 bp, Artificial Sequence
  chemically synthesized
agaccttacattgggtgaat

SEQ ID NO: 122015 - DNA, 20 bp, Artificial Sequence
  chemically synthesized
ttgggtgaattagcacccga

SEQ ID NO: 122016 - DNA, 20 bp, Artificial Sequence
  chemically synthesized
gcccagaaaccagaaccatc

SEQ ID NO: 122017 - DNA, 20 bp, Artificial Sequence
  chemically synthesized
gaattagcacccgatggttc

SEQ ID NO: 122018 - DNA, 20 bp, Artificial Sequence
  chemically synthesized
agcccagaaaccagaaccat

SEQ ID NO: 122019 - DNA, 20 bp, Artificial Sequence
  chemically synthesized
cacccgatggttctggtttc

SEQ ID NO: 122020 - DNA, 20 bp, Artificial Sequence
  chemically synthesized
acccgatggttctggtttct

SEQ ID NO: 122021 - DNA, 20 bp, Artificial Sequence
  chemically synthesized
ttttaccaaagcccagaaac

SEQ ID NO: 122022 - DNA, 20 bp, Artificial Sequence
  chemically synthesized
tggttctggtttctgggctt

SEQ ID NO: 122023 - DNA, 20 bp, Artificial Sequence
  chemically synthesized
cgacaagttttaccaaagcc

SEQ ID NO: 122024 - DNA, 20 bp, Artificial Sequence
  chemically synthesized
ggaaccgacaagttttacca

SEQ ID NO: 122025 - DNA, 20 bp, Artificial Sequence
  chemically synthesized
tgggctttggtaaaacttgt

SEQ ID NO: 122026 - DNA, 20 bp, Artificial Sequence
  chemically synthesized
tcaagggctggggaaccgac

SEQ ID NO: 122027 - DNA, 20 bp, Artificial Sequence
  chemically synthesized
ggtaaaacttgtcggttccc

SEQ ID NO: 122028 - DNA, 20 bp, Artificial Sequence
  chemically synthesized
tattaccacctcaagggctg

SEQ ID NO: 122029 - DNA, 20 bp, Artificial Sequence
  chemically synthesized
ttgtcggttccccagccctt

SEQ ID NO: 122030 - DNA, 20 bp, Artificial Sequence
  chemically synthesized
ctattaccacctcaagggct

SEQ ID NO: 122031 - DNA, 20 bp, Artificial Sequence
  chemically synthesized
tgtcggttccccagcccttg

SEQ ID NO: 122032 - DNA, 20 bp, Artificial Sequence
  chemically synthesized
actattaccacctcaagggc

SEQ ID NO: 122033 - DNA, 20 bp, Artificial Sequence
  chemically synthesized
cggttccccagcccttgagg

SEQ ID NO: 122034 - DNA, 20 bp, Artificial Sequence
  chemically synthesized
ggaaactattaccacctcaa

SEQ ID NO: 122035 - DNA, 20 bp, Artificial Sequence
  chemically synthesized
aggaaactattaccacctca

SEQ ID NO: 122036 - DNA, 20 bp, Artificial Sequence
  chemically synthesized
caggaaactattaccacctc

SEQ ID NO: 122037 - DNA, 20 bp, Artificial Sequence
  chemically synthesized
cccagcccttgaggtggtaa

SEQ ID NO: 122038 - DNA, 20 bp, Artificial Sequence
  chemically synthesized
gaggtggtaatagtttcctg

SEQ ID NO: 122039 - DNA, 20 bp, Artificial Sequence
  chemically synthesized
acccagagtttagcaacttc

SEQ ID NO: 122040 - DNA, 20 bp, Artificial Sequence
  chemically synthesized
aacccagagtttagcaactt

SEQ ID NO: 122041 - DNA, 20 bp, Artificial Sequence
  chemically synthesized
ttcctgaagttgctaaactc

SEQ ID NO: 122042 - DNA, 20 bp, Artificial Sequence
  chemically synthesized
tcctgaagttgctaaactct

SEQ ID NO: 122043 - DNA, 20 bp, Artificial Sequence
  chemically synthesized
cagtgaggcaacccagagtt

SEQ ID NO: 122044 - DNA, 20 bp, Artificial Sequence
  chemically synthesized
gaggacagtgaggcaaccca

SEQ ID NO: 122045 - DNA, 20 bp, Artificial Sequence
  chemically synthesized
cagaggacagtgaggcaacc

SEQ ID NO: 122046 - DNA, 20 bp, Artificial Sequence
  chemically synthesized
aaacccaacagaggacagtg

SEQ ID NO: 122047 - DNA, 20 bp, Artificial Sequence
  chemically synthesized
caaacccaacagaggacagt

SEQ ID NO: 122048 - DNA, 20 bp, Artificial Sequence
  chemically synthesized
ctgacaaacccaacagagga

SEQ ID NO: 122049 - DNA, 20 bp, Artificial Sequence
  chemically synthesized
gttgcctcactgtcctctgt

SEQ ID NO: 122050 - DNA, 20 bp, Artificial Sequence
  chemically synthesized
ttgcctcactgtcctctgtt

SEQ ID NO: 122051 - DNA, 20 bp, Artificial Sequence
  chemically synthesized
ggagctgacaaacccaacag

SEQ ID NO: 122052 - DNA, 20 bp, Artificial Sequence
  chemically synthesized
aggagctgacaaacccaaca

SEQ ID NO: 122053 - DNA, 20 bp, Artificial Sequence
  chemically synthesized
gaaggagctgacaaacccaa

SEQ ID NO: 122054 - DNA, 20 bp, Artificial Sequence
  chemically synthesized
ctgtcctctgttgggtttgt

SEQ ID NO: 122055 - DNA, 20 bp, Artificial Sequence
  chemically synthesized
gctcctccataggaatgaag

SEQ ID NO: 122056 - DNA, 20 bp, Artificial Sequence
  chemically synthesized
tggctcctccataggaatga

SEQ ID NO: 122057 - DNA, 20 bp, Artificial Sequence
  chemically synthesized
ctggctcctccataggaatg

SEQ ID NO: 122058 - DNA, 20 bp, Artificial Sequence
  chemically synthesized
tgtcagctccttcattccta

SEQ ID NO: 122059 - DNA, 20 bp, Artificial Sequence
  chemically synthesized
tcagctccttcattcctatg

SEQ ID NO: 122060 - DNA, 20 bp, Artificial Sequence
  chemically synthesized
cagctccttcattcctatgg

SEQ ID NO: 122061 - DNA, 20 bp, Artificial Sequence
  chemically synthesized
gctccttcattcctatggag

SEQ ID NO: 122062 - DNA, 20 bp, Artificial Sequence
  chemically synthesized
cagaggactggctcctccat

SEQ ID NO: 122063 - DNA, 20 bp, Artificial Sequence
  chemically synthesized
acagaggactggctcctcca

SEQ ID NO: 122064 - DNA, 20 bp, Artificial Sequence
  chemically synthesized
cttcattcctatggaggagc

SEQ ID NO: 122065 - DNA, 20 bp, Artificial Sequence
  chemically synthesized
ggaaattcaatacagaggac

SEQ ID NO: 122066 - DNA, 20 bp, Artificial Sequence
  chemically synthesized
acagaggaaattcaatacag

SEQ ID NO: 122067 - DNA, 20 bp, Artificial Sequence
  chemically synthesized
aacagaggaaattcaataca

SEQ ID NO: 122068 - DNA, 20 bp, Artificial Sequence
  chemically synthesized
caaacagaggaaattcaata

SEQ ID NO: 122069 - DNA, 20 bp, Artificial Sequence
  chemically synthesized
acattcgatatttcaaacag

SEQ ID NO: 122070 - DNA, 20 bp, Artificial Sequence
  chemically synthesized
cacattcgatatttcaaaca

SEQ ID NO: 122071 - DNA, 20 bp, Artificial Sequence
  chemically synthesized
accacattcgatatttcaaa

SEQ ID NO: 122072 - DNA, 20 bp, Artificial Sequence
  chemically synthesized
tctgtttgaaatatcgaatg

SEQ ID NO: 122073 - DNA, 20 bp, Artificial Sequence
  chemically synthesized
gaaatatcgaatgtggttta

SEQ ID NO: 122074 - DNA, 20 bp, Artificial Sequence
  chemically synthesized
cagttcgtgttgtcaggaat

SEQ ID NO: 122075 - DNA, 20 bp, Artificial Sequence
  chemically synthesized
ttctttcagttcgtgttgtc

SEQ ID NO: 122076 - DNA, 20 bp, Artificial Sequence
  chemically synthesized
tttctttcagttcgtgttgt

SEQ ID NO: 122077 - DNA, 20 bp, Artificial Sequence
  chemically synthesized
ttcctgacaacacgaactga

SEQ ID NO: 122078 - DNA, 20 bp, Artificial Sequence
  chemically synthesized
atttactgtgagatttcttt

SEQ ID NO: 122079 - DNA, 20 bp, Artificial Sequence
  chemically synthesized
acgaactgaaagaaatctca

SEQ ID NO: 122080 - DNA, 20 bp, Artificial Sequence
  chemically synthesized
taggtaggatcatttactgt

SEQ ID NO: 122081 - DNA, 20 bp, Artificial Sequence
  chemically synthesized
ccccctgtggaattgtaggt

SEQ ID NO: 122082 - DNA, 20 bp, Artificial Sequence
  chemically synthesized
tccccctgtggaattgtagg

SEQ ID NO: 122083 - DNA, 20 bp, Artificial Sequence
  chemically synthesized
atttccccctgtggaattgt

SEQ ID NO: 122084 - DNA, 20 bp, Artificial Sequence
  chemically synthesized
aatttccccctgtggaattg

SEQ ID NO: 122085 - DNA, 20 bp, Artificial Sequence
  chemically synthesized
tgatcctacctacaattcca

SEQ ID NO: 122086 - DNA, 20 bp, Artificial Sequence
  chemically synthesized
gatcctacctacaattccac

SEQ ID NO: 122087 - DNA, 20 bp, Artificial Sequence
  chemically synthesized
atcctacctacaattccaca

SEQ ID NO: 122088 - DNA, 20 bp, Artificial Sequence
  chemically synthesized
tcctacctacaattccacag

SEQ ID NO: 122089 - DNA, 20 bp, Artificial Sequence
  chemically synthesized
cctacctacaattccacagg

SEQ ID NO: 122090 - DNA, 20 bp, Artificial Sequence
  chemically synthesized
atatattaaatttccccctg

SEQ ID NO: 122091 - DNA, 20 bp, Artificial Sequence
  chemically synthesized
acatacatttcatgaaatat

SEQ ID NO: 122092 - DNA, 20 bp, Artificial Sequence
  chemically synthesized
agagaaggatgcaagatgta

SEQ ID NO: 122093 - DNA, 20 bp, Artificial Sequence
  chemically synthesized
gagactagagagaaggatgc

SEQ ID NO: 122094 - DNA, 20 bp, Artificial Sequence
  chemically synthesized
acatcttgcatccttctctc

SEQ ID NO: 122095 - DNA, 20 bp, Artificial Sequence
  chemically synthesized
ttcctctgagactagagaga

SEQ ID NO: 122096 - DNA, 20 bp, Artificial Sequence
  chemically synthesized
cttcctctgagactagagag

SEQ ID NO: 122097 - DNA, 20 bp, Artificial Sequence
  chemically synthesized
cctcttcctctgagactaga

SEQ ID NO: 122098 - DNA, 20 bp, Artificial Sequence
  chemically synthesized
tgcatccttctctctagtct

SEQ ID NO: 122099 - DNA, 20 bp, Artificial Sequence
  chemically synthesized
cgcctcttcctctgagacta

SEQ ID NO: 122100 - DNA, 20 bp, Artificial Sequence
  chemically synthesized
catccttctctctagtctca

SEQ ID NO: 122101 - DNA, 20 bp, Artificial Sequence
  chemically synthesized
atccttctctctagtctcag

SEQ ID NO: 122102 - DNA, 20 bp, Artificial Sequence
  chemically synthesized
gtcgcctcttcctctgagac

SEQ ID NO: 122103 - DNA, 20 bp, Artificial Sequence
  chemically synthesized
cttctctctagtctcagagg

SEQ ID NO: 122104 - DNA, 20 bp, Artificial Sequence
  chemically synthesized
tctctctagtctcagaggaa

SEQ ID NO: 122105 - DNA, 20 bp, Artificial Sequence
  chemically synthesized
gaaaagtcgcctcttcctct

SEQ ID NO: 122106 - DNA, 20 bp, Artificial Sequence
  chemically synthesized
ctctctagtctcagaggaag

SEQ ID NO: 122107 - DNA, 20 bp, Artificial Sequence
  chemically synthesized
atcaacttccaatagcagaa

SEQ ID NO: 122108 - DNA, 20 bp, Artificial Sequence
  chemically synthesized
agaggcgacttttctgctat

SEQ ID NO: 122109 - DNA, 20 bp, Artificial Sequence
  chemically synthesized
ggcgacttttctgctattgg

SEQ ID NO: 122110 - DNA, 20 bp, Artificial Sequence
  chemically synthesized
gtgaaatcaacttccaatag

SEQ ID NO: 122111 - DNA, 20 bp, Artificial Sequence
  chemically synthesized
atggtgaaatcaacttccaa

SEQ ID NO: 122112 - DNA, 20 bp, Artificial Sequence
  chemically synthesized
tggaagttgatttcaccatc

SEQ ID NO: 122113 - DNA, 20 bp, Artificial Sequence
  chemically synthesized
ggaagttgatttcaccatct

SEQ ID NO: 122114 - DNA, 20 bp, Artificial Sequence
  chemically synthesized
agaatagatgggtgcccaga

SEQ ID NO: 122115 - DNA, 20 bp, Artificial Sequence
  chemically synthesized
tcccagaatagatgggtgcc

SEQ ID NO: 122116 - DNA, 20 bp, Artificial Sequence
  chemically synthesized
aggaggatcccagaatagat

SEQ ID NO: 122117 - DNA, 20 bp, Artificial Sequence
  chemically synthesized
atctgggcacccatctattc

SEQ ID NO: 122118 - DNA, 20 bp, Artificial Sequence
  chemically synthesized
gaggaggatcccagaataga

SEQ ID NO: 122119 - DNA, 20 bp, Artificial Sequence
  chemically synthesized
tctgggcacccatctattct

SEQ ID NO: 122120 - DNA, 20 bp, Artificial Sequence
  chemically synthesized
tgtggaggaggatcccagaa

SEQ ID NO: 122121 - DNA, 20 bp, Artificial Sequence
  chemically synthesized
gagtatgtggaggaggatcc

SEQ ID NO: 122122 - DNA, 20 bp, Artificial Sequence
  chemically synthesized
agagagggagtatgtggagg

SEQ ID NO: 122123 - DNA, 20 bp, Artificial Sequence
  chemically synthesized
gagagagggagtatgtggag

SEQ ID NO: 122124 - DNA, 20 bp, Artificial Sequence
  chemically synthesized
aagagagagggagtatgtgg

SEQ ID NO: 122125 - DNA, 20 bp, Artificial Sequence
  chemically synthesized
aaagagagagggagtatgtg

SEQ ID NO: 122126 - DNA, 20 bp, Artificial Sequence
  chemically synthesized
acaaagagagagggagtatg

SEQ ID NO: 122127 - DNA, 20 bp, Artificial Sequence
  chemically synthesized
ggaacacacaaagagagagg

SEQ ID NO: 122128 - DNA, 20 bp, Artificial Sequence
  chemically synthesized
ttggaacacacaaagagaga

SEQ ID NO: 122129 - DNA, 20 bp, Artificial Sequence
  chemically synthesized
gttggaacacacaaagagag

SEQ ID NO: 122130 - DNA, 20 bp, Artificial Sequence
  chemically synthesized
agttggaacacacaaagaga

SEQ ID NO: 122131 - DNA, 20 bp, Artificial Sequence
  chemically synthesized
gaagttggaacacacaaaga

SEQ ID NO: 122132 - DNA, 20 bp, Artificial Sequence
  chemically synthesized
aagaagttggaacacacaaa

SEQ ID NO: 122133 - DNA, 20 bp, Artificial Sequence
  chemically synthesized
gcaagaagttggaacacaca

SEQ ID NO: 122134 - DNA, 20 bp, Artificial Sequence
  chemically synthesized
cccgcagagaggcaagaagt

SEQ ID NO: 122135 - DNA, 20 bp, Artificial Sequence
  chemically synthesized
ggtccccgcagagaggcaag

SEQ ID NO: 122136 - DNA, 20 bp, Artificial Sequence
  chemically synthesized
gaaggtccccgcagagaggc

SEQ ID NO: 122137 - DNA, 20 bp, Artificial Sequence
  chemically synthesized
tccaacttcttgcctctctg

SEQ ID NO: 122138 - DNA, 20 bp, Artificial Sequence
  chemically synthesized
ccaacttcttgcctctctgc

SEQ ID NO: 122139 - DNA, 20 bp, Artificial Sequence
  chemically synthesized
caacttcttgcctctctgcg

SEQ ID NO: 122140 - DNA, 20 bp, Artificial Sequence
  chemically synthesized
tagagaaggtccccgcagag

SEQ ID NO: 122141 - DNA, 20 bp, Artificial Sequence
  chemically synthesized
ctagagaaggtccccgcaga

SEQ ID NO: 122142 - DNA, 20 bp, Artificial Sequence
  chemically synthesized
ctctagagaaggtccccgca

SEQ ID NO: 122143 - DNA, 20 bp, Artificial Sequence
  chemically synthesized
gtctctagagaaggtccccg

SEQ ID NO: 122144 - DNA, 20 bp, Artificial Sequence
  chemically synthesized
ctctctgcggggaccttctc

SEQ ID NO: 122145 - DNA, 20 bp, Artificial Sequence
  chemically synthesized
ctctgcggggaccttctcta

SEQ ID NO: 122146 - DNA, 20 bp, Artificial Sequence
  chemically synthesized
atgtttgaagtctctagaga

SEQ ID NO: 122147 - DNA, 20 bp, Artificial Sequence
  chemically synthesized
catgtttgaagtctctagag

SEQ ID NO: 122148 - DNA, 20 bp, Artificial Sequence
  chemically synthesized
actcatgtttgaagtctcta

SEQ ID NO: 122149 - DNA, 20 bp, Artificial Sequence
  chemically synthesized
acactcatgtttgaagtctc

SEQ ID NO: 122150 - DNA, 20 bp, Artificial Sequence
  chemically synthesized
tctctagagacttcaaacat

SEQ ID NO: 122151 - DNA, 20 bp, Artificial Sequence
  chemically synthesized
gagagagacactcatgtttg

SEQ ID NO: 122152 - DNA, 20 bp, Artificial Sequence
  chemically synthesized
gttgttgtttaaagatgaga

SEQ ID NO: 122153 - DNA, 20 bp, Artificial Sequence
  chemically synthesized
ttgttgttgtttaaagatga

SEQ ID NO: 122154 - DNA, 20 bp, Artificial Sequence
  chemically synthesized
tgttgttgttgtttaaagat

SEQ ID NO: 122155 - DNA, 20 bp, Artificial Sequence
  chemically synthesized
attgttgttgttgttgttta

SEQ ID NO: 122156 - DNA, 20 bp, Artificial Sequence
  chemically synthesized
ggaaagaaaatgatagagtg

SEQ ID NO: 122157 - DNA, 20 bp, Artificial Sequence
  chemically synthesized
tgaaaggaaagaaaatgata

SEQ ID NO: 122158 - DNA, 20 bp, Artificial Sequence
  chemically synthesized
tgtgaaaggaaagaaaatga

SEQ ID NO: 122159 - DNA, 20 bp, Artificial Sequence
  chemically synthesized
agagtgtgactgtgaaagga

SEQ ID NO: 122160 - DNA, 20 bp, Artificial Sequence
  chemically synthesized
tatcattttctttcctttca

SEQ ID NO: 122161 - DNA, 20 bp, Artificial Sequence
  chemically synthesized
ctaaagagtgtgactgtgaa

SEQ ID NO: 122162 - DNA, 20 bp, Artificial Sequence
  chemically synthesized
tctaaagagtgtgactgtga

SEQ ID NO: 122163 - DNA, 20 bp, Artificial Sequence
  chemically synthesized
cctttcacagtcacactctt

SEQ ID NO: 122164 - DNA, 20 bp, Artificial Sequence
  chemically synthesized
ttcacagtcacactctttag

SEQ ID NO: 122165 - DNA, 20 bp, Artificial Sequence
  chemically synthesized
tcacagtcacactctttaga

SEQ ID NO: 122166 - DNA, 20 bp, Artificial Sequence
  chemically synthesized
gtgaatatctgccttctaaa

SEQ ID NO: 122167 - DNA, 20 bp, Artificial Sequence
  chemically synthesized
cagtcacactctttagaagg

SEQ ID NO: 122168 - DNA, 20 bp, Artificial Sequence
  chemically synthesized
gagtgaatatctgccttcta

SEQ ID NO: 122169 - DNA, 20 bp, Artificial Sequence
  chemically synthesized
tgtagtcaagttgagataat

SEQ ID NO: 122170 - DNA, 20 bp, Artificial Sequence
  chemically synthesized
ggcacgaatgtagtcaagtt

SEQ ID NO: 122171 - DNA, 20 bp, Artificial Sequence
  chemically synthesized
agagtggcacgaatgtagtc

SEQ ID NO: 122172 - DNA, 20 bp, Artificial Sequence
  chemically synthesized
attggagagtggcacgaatg

SEQ ID NO: 122173 - DNA, 20 bp, Artificial Sequence
  chemically synthesized
gattttcatgaattggagag

SEQ ID NO: 122174 - DNA, 20 bp, Artificial Sequence
  chemically synthesized
cctgattttcatgaattgga

SEQ ID NO: 122175 - DNA, 20 bp, Artificial Sequence
  chemically synthesized
agcctgattttcatgaattg

SEQ ID NO: 122176 - DNA, 20 bp, Artificial Sequence
  chemically synthesized
gaagcctgattttcatgaat

SEQ ID NO: 122177 - DNA, 20 bp, Artificial Sequence
  chemically synthesized
actctccaattcatgaaaat

SEQ ID NO: 122178 - DNA, 20 bp, Artificial Sequence
  chemically synthesized
ctctccaattcatgaaaatc

SEQ ID NO: 122179 - DNA, 20 bp, Artificial Sequence
  chemically synthesized
tagtggaacgatgatggcag

SEQ ID NO: 122180 - DNA, 20 bp, Artificial Sequence
  chemically synthesized
ttttagtggaacgatgatgg

SEQ ID NO: 122181 - DNA, 20 bp, Artificial Sequence
  chemically synthesized
tagttttagtggaacgatga

SEQ ID NO: 122182 - DNA, 20 bp, Artificial Sequence
  chemically synthesized
ttctgtcagaatagttttag

SEQ ID NO: 122183 - DNA, 20 bp, Artificial Sequence
  chemically synthesized
gacttctgtcagaatagttt

SEQ ID NO: 122184 - DNA, 20 bp, Artificial Sequence
  chemically synthesized
ttccactaaaactattctga

SEQ ID NO: 122185 - DNA, 20 bp, Artificial Sequence
  chemically synthesized
catagtgacttctgtcagaa

SEQ ID NO: 122186 - DNA, 20 bp, Artificial Sequence
  chemically synthesized
cactaaaactattctgacag

SEQ ID NO: 122187 - DNA, 20 bp, Artificial Sequence
  chemically synthesized
tttgccatagtgacttctgt

SEQ ID NO: 122188 - DNA, 20 bp, Artificial Sequence
  chemically synthesized
tattctgacagaagtcacta

SEQ ID NO: 122189 - DNA, 20 bp, Artificial Sequence
  chemically synthesized
gccagtaattcaatttgcca

SEQ ID NO: 122190 - DNA, 20 bp, Artificial Sequence
  chemically synthesized
actatggcaaattgaattac

SEQ ID NO: 122191 - DNA, 20 bp, Artificial Sequence
  chemically synthesized
gagaggtaaagaattggggc

SEQ ID NO: 122192 - DNA, 20 bp, Artificial Sequence
  chemically synthesized
cagggagaggtaaagaattg

SEQ ID NO: 122193 - DNA, 20 bp, Artificial Sequence
  chemically synthesized
acagggagaggtaaagaatt

SEQ ID NO: 122194 - DNA, 20 bp, Artificial Sequence
  chemically synthesized
tacagggagaggtaaagaat

SEQ ID NO: 122195 - DNA, 20 bp, Artificial Sequence
  chemically synthesized
catggatacagggagaggta

SEQ ID NO: 122196 - DNA, 20 bp, Artificial Sequence
  chemically synthesized
aagggcatggatacagggag

SEQ ID NO: 122197 - DNA, 20 bp, Artificial Sequence
  chemically synthesized
aaagggcatggatacaggga

SEQ ID NO: 122198 - DNA, 20 bp, Artificial Sequence
  chemically synthesized
gcaaagggcatggatacagg

SEQ ID NO: 122199 - DNA, 20 bp, Artificial Sequence
  chemically synthesized
tagcaaagggcatggataca

SEQ ID NO: 122200 - DNA, 20 bp, Artificial Sequence
  chemically synthesized
ttagcaaagggcatggatac

SEQ ID NO: 122201 - DNA, 20 bp, Artificial Sequence
  chemically synthesized
cttagcaaagggcatggata

SEQ ID NO: 122202 - DNA, 20 bp, Artificial Sequence
  chemically synthesized
gagttacttagcaaagggca

SEQ ID NO: 122203 - DNA, 20 bp, Artificial Sequence
  chemically synthesized
ctgtatccatgccctttgct

SEQ ID NO: 122204 - DNA, 20 bp, Artificial Sequence
  chemically synthesized
tttcagagttacttagcaaa

SEQ ID NO: 122205 - DNA, 20 bp, Artificial Sequence
  chemically synthesized
atttcagagttacttagcaa

SEQ ID NO: 122206 - DNA, 20 bp, Artificial Sequence
  chemically synthesized
aatttcagagttacttagca

SEQ ID NO: 122207 - DNA, 20 bp, Artificial Sequence
  chemically synthesized
ggaagaatttcagagttact

SEQ ID NO: 122208 - DNA, 20 bp, Artificial Sequence
  chemically synthesized
ctttcgtaggaagaatttca

SEQ ID NO: 122209 - DNA, 20 bp, Artificial Sequence
  chemically synthesized
gtctttcgtaggaagaattt

SEQ ID NO: 122210 - DNA, 20 bp, Artificial Sequence
  chemically synthesized
ctctgaaattcttcctacga

SEQ ID NO: 122211 - DNA, 20 bp, Artificial Sequence
  chemically synthesized
ggcatgctgtctttcgtagg

SEQ ID NO: 122212 - DNA, 20 bp, Artificial Sequence
  chemically synthesized
aagggcatgctgtctttcgt

SEQ ID NO: 122213 - DNA, 20 bp, Artificial Sequence
  chemically synthesized
gaaattcttcctacgaaaga

SEQ ID NO: 122214 - DNA, 20 bp, Artificial Sequence
  chemically synthesized
caagggcatgctgtctttcg

SEQ ID NO: 122215 - DNA, 20 bp, Artificial Sequence
  chemically synthesized
atgaccaagctcaatgtcaa

SEQ ID NO: 122216 - DNA, 20 bp, Artificial Sequence
  chemically synthesized
gacagcatgcccttgacatt

SEQ ID NO: 122217 - DNA, 20 bp, Artificial Sequence
  chemically synthesized
catgaccaagctcaatgtca

SEQ ID NO: 122218 - DNA, 20 bp, Artificial Sequence
  chemically synthesized
gcatgaccaagctcaatgtc

SEQ ID NO: 122219 - DNA, 20 bp, Artificial Sequence
  chemically synthesized
catgcccttgacattgagct

SEQ ID NO: 122220 - DNA, 20 bp, Artificial Sequence
  chemically synthesized
gcaaagcaaggcgcatgacc

SEQ ID NO: 122221 - DNA, 20 bp, Artificial Sequence
  chemically synthesized
cactgggattaggcaaagca

SEQ ID NO: 122222 - DNA, 20 bp, Artificial Sequence
  chemically synthesized
ccactgggattaggcaaagc

SEQ ID NO: 122223 - DNA, 20 bp, Artificial Sequence
  chemically synthesized
tatcccactgggattaggca

SEQ ID NO: 122224 - DNA, 20 bp, Artificial Sequence
  chemically synthesized
cgccttgctttgcctaatcc

SEQ ID NO: 122225 - DNA, 20 bp, Artificial Sequence
  chemically synthesized
agtaatatcccactgggatt

SEQ ID NO: 122226 - DNA, 20 bp, Artificial Sequence
  chemically synthesized
cttgctttgcctaatcccag

SEQ ID NO: 122227 - DNA, 20 bp, Artificial Sequence
  chemically synthesized
tagtaatatcccactgggat

SEQ ID NO: 122228 - DNA, 20 bp, Artificial Sequence
  chemically synthesized
ttgctttgcctaatcccagt

SEQ ID NO: 122229 - DNA, 20 bp, Artificial Sequence
  chemically synthesized
acttctagtaatatcccact

SEQ ID NO: 122230 - DNA, 20 bp, Artificial Sequence
  chemically synthesized
tacttctagtaatatcccac

SEQ ID NO: 122231 - DNA, 20 bp, Artificial Sequence
  chemically synthesized
taatcccagtgggatattac

SEQ ID NO: 122232 - DNA, 20 bp, Artificial Sequence
  chemically synthesized
tcccagtgggatattactag

SEQ ID NO: 122233 - DNA, 20 bp, Artificial Sequence
  chemically synthesized
gcctctgcttgtgttacttc

SEQ ID NO: 122234 - DNA, 20 bp, Artificial Sequence
  chemically synthesized
gatattactagaagtaacac

SEQ ID NO: 122235 - DNA, 20 bp, Artificial Sequence
  chemically synthesized
attactagaagtaacacaag

SEQ ID NO: 122236 - DNA, 20 bp, Artificial Sequence
  chemically synthesized
tactagaagtaacacaagca

SEQ ID NO: 122237 - DNA, 20 bp, Artificial Sequence
  chemically synthesized
actagaagtaacacaagcag

SEQ ID NO: 122238 - DNA, 20 bp, Artificial Sequence
  chemically synthesized
acactgcataaatacatttc

SEQ ID NO: 122239 - DNA, 20 bp, Artificial Sequence
  chemically synthesized
aggcttgaaatgtatttatg

SEQ ID NO: 122240 - DNA, 20 bp, Artificial Sequence
  chemically synthesized
tgaaatgtatttatgcagtg

SEQ ID NO: 122241 - DNA, 20 bp, Artificial Sequence
  chemically synthesized
atggtgaagtgcaaaaggga

SEQ ID NO: 122242 - DNA, 20 bp, Artificial Sequence
  chemically synthesized
ggtaatggtgaagtgcaaaa

SEQ ID NO: 122243 - DNA, 20 bp, Artificial Sequence
  chemically synthesized
aggtaatggtgaagtgcaaa

SEQ ID NO: 122244 - DNA, 20 bp, Artificial Sequence
  chemically synthesized
aaggtaatggtgaagtgcaa

SEQ ID NO: 122245 - DNA, 20 bp, Artificial Sequence
  chemically synthesized
tttgtcttaaggtaatggtg

SEQ ID NO: 122246 - DNA, 20 bp, Artificial Sequence
  chemically synthesized
ttgcacttcaccattacctt

SEQ ID NO: 122247 - DNA, 20 bp, Artificial Sequence
  chemically synthesized
gcatgtttgtcttaaggtaa

SEQ ID NO: 122248 - DNA, 20 bp, Artificial Sequence
  chemically synthesized
tccagagcatgtttgtctta

SEQ ID NO: 122249 - DNA, 20 bp, Artificial Sequence
  chemically synthesized
gtccagagcatgtttgtctt

SEQ ID NO: 122250 - DNA, 20 bp, Artificial Sequence
  chemically synthesized
accttaagacaaacatgctc

SEQ ID NO: 122251 - DNA, 20 bp, Artificial Sequence
  chemically synthesized
aagacaaacatgctctggac

SEQ ID NO: 122252 - DNA, 20 bp, Artificial Sequence
  chemically synthesized
gagatgagtaggctagtcca

SEQ ID NO: 122253 - DNA, 20 bp, Artificial Sequence
  chemically synthesized
ctgagatgagtaggctagtc

SEQ ID NO: 122254 - DNA, 20 bp, Artificial Sequence
  chemically synthesized
tcctcctgagatgagtaggc

SEQ ID NO: 122255 - DNA, 20 bp, Artificial Sequence
  chemically synthesized
attctcctcctgagatgagt

SEQ ID NO: 122256 - DNA, 20 bp, Artificial Sequence
  chemically synthesized
ctggactagcctactcatct

SEQ ID NO: 122257 - DNA, 20 bp, Artificial Sequence
  chemically synthesized
cattctcctcctgagatgag

SEQ ID NO: 122258 - DNA, 20 bp, Artificial Sequence
  chemically synthesized
tggactagcctactcatctc

SEQ ID NO: 122259 - DNA, 20 bp, Artificial Sequence
  chemically synthesized
gactagcctactcatctcag

SEQ ID NO: 122260 - DNA, 20 bp, Artificial Sequence
  chemically synthesized
actcattctcctcctgagat

SEQ ID NO: 122261 - DNA, 20 bp, Artificial Sequence
  chemically synthesized
actagcctactcatctcagg

SEQ ID NO: 122262 - DNA, 20 bp, Artificial Sequence
  chemically synthesized
tagcctactcatctcaggag

SEQ ID NO: 122263 - DNA, 20 bp, Artificial Sequence
  chemically synthesized
atgtcactcattctcctcct

SEQ ID NO: 122264 - DNA, 20 bp, Artificial Sequence
  chemically synthesized
actcatctcaggaggagaat

SEQ ID NO: 122265 - DNA, 20 bp, Artificial Sequence
  chemically synthesized
ggaggagaatgagtgacata

SEQ ID NO: 122266 - DNA, 20 bp, Artificial Sequence
  chemically synthesized
aggagaatgagtgacatatg

SEQ ID NO: 122267 - DNA, 20 bp, Artificial Sequence
  chemically synthesized
agaatgagtgacatatggag

SEQ ID NO: 122268 - DNA, 20 bp, Artificial Sequence
  chemically synthesized
aatgagtgacatatggagca

SEQ ID NO: 122269 - DNA, 20 bp, Artificial Sequence
  chemically synthesized
ttcatgttgcaggttgattg

SEQ ID NO: 122270 - DNA, 20 bp, Artificial Sequence
  chemically synthesized
cttcatgttgcaggttgatt

SEQ ID NO: 122271 - DNA, 20 bp, Artificial Sequence
  chemically synthesized
tcttcatgttgcaggttgat

SEQ ID NO: 122272 - DNA, 20 bp, Artificial Sequence
  chemically synthesized
gtggcacttcttcatgttgc

SEQ ID NO: 122273 - DNA, 20 bp, Artificial Sequence
  chemically synthesized
cccaatcaacctgcaacatg

SEQ ID NO: 122274 - DNA, 20 bp, Artificial Sequence
  chemically synthesized
ggtggcacttcttcatgttg

SEQ ID NO: 122275 - DNA, 20 bp, Artificial Sequence
  chemically synthesized
aatcaacctgcaacatgaag

SEQ ID NO: 122276 - DNA, 20 bp, Artificial Sequence
  chemically synthesized
aattttcagcttgggtgggg

SEQ ID NO: 122277 - DNA, 20 bp, Artificial Sequence
  chemically synthesized
gaagaagtgccaccccaccc

SEQ ID NO: 122278 - DNA, 20 bp, Artificial Sequence
  chemically synthesized
atgaattttcagcttgggtg

SEQ ID NO: 122279 - DNA, 20 bp, Artificial Sequence
  chemically synthesized
catgaattttcagcttgggt

SEQ ID NO: 122280 - DNA, 20 bp, Artificial Sequence
  chemically synthesized
tcatgaattttcagcttggg

SEQ ID NO: 122281 - DNA, 20 bp, Artificial Sequence
  chemically synthesized
ctttcatgaattttcagctt

SEQ ID NO: 122282 - DNA, 20 bp, Artificial Sequence
  chemically synthesized
cctttcatgaattttcagct

SEQ ID NO: 122283 - DNA, 20 bp, Artificial Sequence
  chemically synthesized
tattgcctttcatgaatttt

SEQ ID NO: 122284 - DNA, 20 bp, Artificial Sequence
  chemically synthesized
cccaagctgaaaattcatga

SEQ ID NO: 122285 - DNA, 20 bp, Artificial Sequence
  chemically synthesized
ccaagctgaaaattcatgaa

SEQ ID NO: 122286 - DNA, 20 bp, Artificial Sequence
  chemically synthesized
aaaattcatgaaaggcaata

SEQ ID NO: 122287 - DNA, 20 bp, Artificial Sequence
  chemically synthesized
aaattcatgaaaggcaatat

SEQ ID NO: 122288 - DNA, 20 bp, Artificial Sequence
  chemically synthesized
tgtgagtggcatatagcaat

SEQ ID NO: 122289 - DNA, 20 bp, Artificial Sequence
  chemically synthesized
tcacaaatgtgagtggcata

SEQ ID NO: 122290 - DNA, 20 bp, Artificial Sequence
  chemically synthesized
actattttcacaaatgtgag

SEQ ID NO: 122291 - DNA, 20 bp, Artificial Sequence
  chemically synthesized
ttaactattttcacaaatgt

SEQ ID NO: 122292 - DNA, 20 bp, Artificial Sequence
  chemically synthesized
gccactcacatttgtgaaaa

SEQ ID NO: 122293 - DNA, 20 bp, Artificial Sequence
  chemically synthesized
gtgaaaatagttaactgatt

SEQ ID NO: 122294 - DNA, 20 bp, Artificial Sequence
  chemically synthesized
ttggcttttggtaactgaat

SEQ ID NO: 122295 - DNA, 20 bp, Artificial Sequence
  chemically synthesized
ttaactgattcagttaccaa

SEQ ID NO: 122296 - DNA, 20 bp, Artificial Sequence
  chemically synthesized
tttccataggcattggcttt

SEQ ID NO: 122297 - DNA, 20 bp, Artificial Sequence
  chemically synthesized
ttaccaaaagccaatgccta

SEQ ID NO: 122298 - DNA, 20 bp, Artificial Sequence
  chemically synthesized
ttaaatctttccataggcat

SEQ ID NO: 122299 - DNA, 20 bp, Artificial Sequence
  chemically synthesized
caaaagccaatgcctatgga

SEQ ID NO: 122300 - DNA, 20 bp, Artificial Sequence
  chemically synthesized
aagaacttaaatctttccat

SEQ ID NO: 122301 - DNA, 20 bp, Artificial Sequence
  chemically synthesized
taagaacttaaatctttcca

SEQ ID NO: 122302 - DNA, 20 bp, Artificial Sequence
  chemically synthesized
caatgcctatggaaagattt

SEQ ID NO: 122303 - DNA, 20 bp, Artificial Sequence
  chemically synthesized
tgcaaataaatcaagtaaat

SEQ ID NO: 122304 - DNA, 20 bp, Artificial Sequence
  chemically synthesized
ccagttgctgcaaataaatc

SEQ ID NO: 122305 - DNA, 20 bp, Artificial Sequence
  chemically synthesized
ttatttacttgatttatttg

SEQ ID NO: 122306 - DNA, 20 bp, Artificial Sequence
  chemically synthesized
cttgatttatttgcagcaac

SEQ ID NO: 122307 - DNA, 20 bp, Artificial Sequence
  chemically synthesized
aagagaatagtcagcagcac

SEQ ID NO: 122308 - DNA, 20 bp, Artificial Sequence
  chemically synthesized
ttcgagaagagaatagtcag

SEQ ID NO: 122309 - DNA, 20 bp, Artificial Sequence
  chemically synthesized
aacttcgagaagagaatagt

SEQ ID NO: 122310 - DNA, 20 bp, Artificial Sequence
  chemically synthesized
agagaacttcgagaagagaa

SEQ ID NO: 122311 - DNA, 20 bp, Artificial Sequence
  chemically synthesized
tgctgactattctcttctcg

SEQ ID NO: 122312 - DNA, 20 bp, Artificial Sequence
  chemically synthesized
aaagcagagaacttcgagaa

SEQ ID NO: 122313 - DNA, 20 bp, Artificial Sequence
  chemically synthesized
agaaagcagagaacttcgag

SEQ ID NO: 122314 - DNA, 20 bp, Artificial Sequence
  chemically synthesized
ccaagaaagcagagaacttc

SEQ ID NO: 122315 - DNA, 20 bp, Artificial Sequence
  chemically synthesized
gagtggaagccaagaaagca

SEQ ID NO: 122316 - DNA, 20 bp, Artificial Sequence
  chemically synthesized
ctcgaagttctctgctttct

SEQ ID NO: 122317 - DNA, 20 bp, Artificial Sequence
  chemically synthesized
aagagtggaagccaagaaag

SEQ ID NO: 122318 - DNA, 20 bp, Artificial Sequence
  chemically synthesized
caaaagagtggaagccaaga

SEQ ID NO: 122319 - DNA, 20 bp, Artificial Sequence
  chemically synthesized
cgaccaaaagagtggaagcc

SEQ ID NO: 122320 - DNA, 20 bp, Artificial Sequence
  chemically synthesized
agaggcgaccaaaagagtgg

SEQ ID NO: 122321 - DNA, 20 bp, Artificial Sequence
  chemically synthesized
tttcttggcttccactcttt

SEQ ID NO: 122322 - DNA, 20 bp, Artificial Sequence
  chemically synthesized
tacagaggcgaccaaaagag

SEQ ID NO: 122323 - DNA, 20 bp, Artificial Sequence
  chemically synthesized
gaatacagaggcgaccaaaa

SEQ ID NO: 122324 - DNA, 20 bp, Artificial Sequence
  chemically synthesized
gagaatacagaggcgaccaa

SEQ ID NO: 122325 - DNA, 20 bp, Artificial Sequence
  chemically synthesized
tgaacactcagagaatacag

SEQ ID NO: 122326 - DNA, 20 bp, Artificial Sequence
  chemically synthesized
ttgaacactcagagaataca

SEQ ID NO: 122327 - DNA, 20 bp, Artificial Sequence
  chemically synthesized
gcttgaacactcagagaata

SEQ ID NO: 122328 - DNA, 20 bp, Artificial Sequence
  chemically synthesized
tggtcgcctctgtattctct

SEQ ID NO: 122329 - DNA, 20 bp, Artificial Sequence
  chemically synthesized
aaaaaaagcttgaacactca

SEQ ID NO: 122330 - DNA, 20 bp, Artificial Sequence
  chemically synthesized
tctgtattctctgagtgttc

SEQ ID NO: 122331 - DNA, 20 bp, Artificial Sequence
  chemically synthesized
aaaaaaaaagcttgaacact

SEQ ID NO: 122332 - DNA, 20 bp, Artificial Sequence
  chemically synthesized
aggcaaaaaaaaaaaaaaaa

SEQ ID NO: 122333 - DNA, 20 bp, Artificial Sequence
  chemically synthesized
aacattaatatttaaaggac

SEQ ID NO: 122334 - DNA, 20 bp, Artificial Sequence
  chemically synthesized
gaacattaatatttaaagga

SEQ ID NO: 122335 - DNA, 20 bp, Artificial Sequence
  chemically synthesized
tggagaacattaatatttaa

SEQ ID NO: 122336 - DNA, 20 bp, Artificial Sequence
  chemically synthesized
ttggagaacattaatattta

SEQ ID NO: 122337 - DNA, 20 bp, Artificial Sequence
  chemically synthesized
gatccagagacagaattttg

SEQ ID NO: 122338 - DNA, 20 bp, Artificial Sequence
  chemically synthesized
ttgatccagagacagaattt

SEQ ID NO: 122339 - DNA, 20 bp, Artificial Sequence
  chemically synthesized
gttctccaaaattctgtctc

SEQ ID NO: 122340 - DNA, 20 bp, Artificial Sequence
  chemically synthesized
atatcagattgatccagaga

SEQ ID NO: 122341 - DNA, 20 bp, Artificial Sequence
  chemically synthesized
caacatatcagattgatcca

SEQ ID NO: 122342 - DNA, 20 bp, Artificial Sequence
  chemically synthesized
accaacatatcagattgatc

SEQ ID NO: 122343 - DNA, 20 bp, Artificial Sequence
  chemically synthesized
tctggatcaatctgatatgt

SEQ ID NO: 122344 - DNA, 20 bp, Artificial Sequence
  chemically synthesized
ccagttgaggaccaacatat

SEQ ID NO: 122345 - DNA, 20 bp, Artificial Sequence
  chemically synthesized
ctgatatgttggtcctcaac

SEQ ID NO: 122346 - DNA, 20 bp, Artificial Sequence
  chemically synthesized
gatatgttggtcctcaactg

SEQ ID NO: 122347 - DNA, 20 bp, Artificial Sequence
  chemically synthesized
cctgcctcctgctccagttg

SEQ ID NO: 122348 - DNA, 20 bp, Artificial Sequence
  chemically synthesized
ccctgcctcctgctccagtt

SEQ ID NO: 122349 - DNA, 20 bp, Artificial Sequence
  chemically synthesized
atgttggtcctcaactggag

SEQ ID NO: 122350 - DNA, 20 bp, Artificial Sequence
  chemically synthesized
tgttggtcctcaactggagc

SEQ ID NO: 122351 - DNA, 20 bp, Artificial Sequence
  chemically synthesized
ttggtcctcaactggagcag

SEQ ID NO: 122352 - DNA, 20 bp, Artificial Sequence
  chemically synthesized
tggtcctcaactggagcagg

SEQ ID NO: 122353 - DNA, 20 bp, Artificial Sequence
  chemically synthesized
atgttccctgcctcctgctc

SEQ ID NO: 122354 - DNA, 20 bp, Artificial Sequence
  chemically synthesized
tcctcaactggagcaggagg

SEQ ID NO: 122355 - DNA, 20 bp, Artificial Sequence
  chemically synthesized
cctcaactggagcaggaggc

SEQ ID NO: 122356 - DNA, 20 bp, Artificial Sequence
  chemically synthesized
ctcaactggagcaggaggca

SEQ ID NO: 122357 - DNA, 20 bp, Artificial Sequence
  chemically synthesized
gaggcagggaacatactccc

SEQ ID NO: 122358 - DNA, 20 bp, Artificial Sequence
  chemically synthesized
aggcagggaacatactccct

SEQ ID NO: 122359 - DNA, 20 bp, Artificial Sequence
  chemically synthesized
cagggaacatactccctggg

SEQ ID NO: 122360 - DNA, 20 bp, Artificial Sequence
  chemically synthesized
ttatgatacaactacccagg

SEQ ID NO: 122361 - DNA, 20 bp, Artificial Sequence
  chemically synthesized
acttatgatacaactaccca

SEQ ID NO: 122362 - DNA, 20 bp, Artificial Sequence
  chemically synthesized
aacttatgatacaactaccc

SEQ ID NO: 122363 - DNA, 20 bp, Artificial Sequence
  chemically synthesized
aaacttatgatacaactacc

SEQ ID NO: 122364 - DNA, 20 bp, Artificial Sequence
  chemically synthesized
tccctgggtagttgtatcat

SEQ ID NO: 122365 - DNA, 20 bp, Artificial Sequence
  chemically synthesized
gaagtagaagatttggataa

SEQ ID NO: 122366 - DNA, 20 bp, Artificial Sequence
  chemically synthesized
gtcaatggaagtagaagatt

SEQ ID NO: 122367 - DNA, 20 bp, Artificial Sequence
  chemically synthesized
ggtagtgtcaatggaagtag

SEQ ID NO: 122368 - DNA, 20 bp, Artificial Sequence
  chemically synthesized
taaggtagtgtcaatggaag

SEQ ID NO: 122369 - DNA, 20 bp, Artificial Sequence
  chemically synthesized
aattaaggtagtgtcaatgg

SEQ ID NO: 122370 - DNA, 20 bp, Artificial Sequence
  chemically synthesized
gtaaattaaggtagtgtcaa

SEQ ID NO: 122371 - DNA, 20 bp, Artificial Sequence
  chemically synthesized
gatagggacgtaaattaagg

SEQ ID NO: 122372 - DNA, 20 bp, Artificial Sequence
  chemically synthesized
gatgatagggacgtaaatta

SEQ ID NO: 122373 - DNA, 20 bp, Artificial Sequence
  chemically synthesized
agatgatagggacgtaaatt

SEQ ID NO: 122374 - DNA, 20 bp, Artificial Sequence
  chemically synthesized
tacctgagcaagagatgata

SEQ ID NO: 122375 - DNA, 20 bp, Artificial Sequence
  chemically synthesized
gtacctgagcaagagatgat

SEQ ID NO: 122376 - DNA, 20 bp, Artificial Sequence
  chemically synthesized
agtacctgagcaagagatga

SEQ ID NO: 122377 - DNA, 20 bp, Artificial Sequence
  chemically synthesized
cgtccctatcatctcttgct

SEQ ID NO: 122378 - DNA, 20 bp, Artificial Sequence
  chemically synthesized
gtccctatcatctcttgctc

SEQ ID NO: 122379 - DNA, 20 bp, Artificial Sequence
  chemically synthesized
ttattttagtacctgagcaa

SEQ ID NO: 122380 - DNA, 20 bp, Artificial Sequence
  chemically synthesized
gattattttagtacctgagc

SEQ ID NO: 122381 - DNA, 20 bp, Artificial Sequence
  chemically synthesized
aaaagattattttagtacct

SEQ ID NO: 122382 - DNA, 20 bp, Artificial Sequence
  chemically synthesized
gccaataaaaaagattattt

SEQ ID NO: 122383 - DNA, 20 bp, Artificial Sequence
  chemically synthesized
actaaaataatcttttttat

SEQ ID NO: 122384 - DNA, 20 bp, Artificial Sequence
  chemically synthesized
gagggagggagccaataaaa

SEQ ID NO: 122385 - DNA, 20 bp, Artificial Sequence
  chemically synthesized
ggtttgagagtggagggagg

SEQ ID NO: 122386 - DNA, 20 bp, Artificial Sequence
  chemically synthesized
gtggtttgagagtggaggga

SEQ ID NO: 122387 - DNA, 20 bp, Artificial Sequence
  chemically synthesized
ggtggtttgagagtggaggg

SEQ ID NO: 122388 - DNA, 20 bp, Artificial Sequence
  chemically synthesized
gggtggtttgagagtggagg

SEQ ID NO: 122389 - DNA, 20 bp, Artificial Sequence
  chemically synthesized
aagggtggtttgagagtgga

SEQ ID NO: 122390 - DNA, 20 bp, Artificial Sequence
  chemically synthesized
gaagggtggtttgagagtgg

SEQ ID NO: 122391 - DNA, 20 bp, Artificial Sequence
  chemically synthesized
ggaagggtggtttgagagtg

SEQ ID NO: 122392 - DNA, 20 bp, Artificial Sequence
  chemically synthesized
gtggaagggtggtttgagag

SEQ ID NO: 122393 - DNA, 20 bp, Artificial Sequence
  chemically synthesized
taggtggaagggtggtttga

SEQ ID NO: 122394 - DNA, 20 bp, Artificial Sequence
  chemically synthesized
tgtaggtggaagggtggttt

SEQ ID NO: 122395 - DNA, 20 bp, Artificial Sequence
  chemically synthesized
gttgtatgtaggtggaaggg

SEQ ID NO: 122396 - DNA, 20 bp, Artificial Sequence
  chemically synthesized
gcagttgtatgtaggtggaa

SEQ ID NO: 122397 - DNA, 20 bp, Artificial Sequence
  chemically synthesized
cgcagttgtatgtaggtgga

SEQ ID NO: 122398 - DNA, 20 bp, Artificial Sequence
  chemically synthesized
acgcagttgtatgtaggtgg

SEQ ID NO: 122399 - DNA, 20 bp, Artificial Sequence
  chemically synthesized
tttacgcagttgtatgtagg

SEQ ID NO: 122400 - DNA, 20 bp, Artificial Sequence
  chemically synthesized
tcatttacgcagttgtatgt

SEQ ID NO: 122401 - DNA, 20 bp, Artificial Sequence
  chemically synthesized
atcatttacgcagttgtatg

SEQ ID NO: 122402 - DNA, 20 bp, Artificial Sequence
  chemically synthesized
ttacaaaaagatcatttacg

SEQ ID NO: 122403 - DNA, 20 bp, Artificial Sequence
  chemically synthesized
ggttctatttgcattacaaa

SEQ ID NO: 122404 - DNA, 20 bp, Artificial Sequence
  chemically synthesized
tgatctttttgtaatgcaaa

SEQ ID NO: 122405 - DNA, 20 bp, Artificial Sequence
  chemically synthesized
ttttacacagaggagaaatg

SEQ ID NO: 122406 - DNA, 20 bp, Artificial Sequence
  chemically synthesized
gttttacacagaggagaaat

SEQ ID NO: 122407 - DNA, 20 bp, Artificial Sequence
  chemically synthesized
ttgaaaggttttacacagag

SEQ ID NO: 122408 - DNA, 20 bp, Artificial Sequence
  chemically synthesized
cattgaaaggttttacacag

SEQ ID NO: 122409 - DNA, 20 bp, Artificial Sequence
  chemically synthesized
ccattgaaaggttttacaca

SEQ ID NO: 122410 - DNA, 20 bp, Artificial Sequence
  chemically synthesized
aaccattgaaaggttttaca

SEQ ID NO: 122411 - DNA, 20 bp, Artificial Sequence
  chemically synthesized
ctctgtgtaaaacctttcaa

SEQ ID NO: 122412 - DNA, 20 bp, Artificial Sequence
  chemically synthesized
ggtaatagcaaaccattgaa

SEQ ID NO: 122413 - DNA, 20 bp, Artificial Sequence
  chemically synthesized
aggtaatagcaaaccattga

SEQ ID NO: 122414 - DNA, 20 bp, Artificial Sequence
  chemically synthesized
ggactttgtcttgcaggtaa

SEQ ID NO: 122415 - DNA, 20 bp, Artificial Sequence
  chemically synthesized
aatggtttgctattacctgc

SEQ ID NO: 122416 - DNA, 20 bp, Artificial Sequence
  chemically synthesized
aggttaggactttgtcttgc

SEQ ID NO: 122417 - DNA, 20 bp, Artificial Sequence
  chemically synthesized
ttgctattacctgcaagaca

SEQ ID NO: 122418 - DNA, 20 bp, Artificial Sequence
  chemically synthesized
gaggttaggactttgtcttg

SEQ ID NO: 122419 - DNA, 20 bp, Artificial Sequence
  chemically synthesized
gtaatccaaagagagaggtt

SEQ ID NO: 122420 - DNA, 20 bp, Artificial Sequence
  chemically synthesized
tgtaatccaaagagagaggt

SEQ ID NO: 122421 - DNA, 20 bp, Artificial Sequence
  chemically synthesized
aaagtcctaacctctctctt

SEQ ID NO: 122422 - DNA, 20 bp, Artificial Sequence
  chemically synthesized
gccttgtaatccaaagagag

SEQ ID NO: 122423 - DNA, 20 bp, Artificial Sequence
  chemically synthesized
ggccttgtaatccaaagaga

SEQ ID NO: 122424 - DNA, 20 bp, Artificial Sequence
  chemically synthesized
agggccttgtaatccaaaga

SEQ ID NO: 122425 - DNA, 20 bp, Artificial Sequence
  chemically synthesized
cgagggccttgtaatccaaa

SEQ ID NO: 122426 - DNA, 20 bp, Artificial Sequence
  chemically synthesized
ttcgagggccttgtaatcca

SEQ ID NO: 122427 - DNA, 20 bp, Artificial Sequence
  chemically synthesized
aacctctctctttggattac

SEQ ID NO: 122428 - DNA, 20 bp, Artificial Sequence
  chemically synthesized
acctctctctttggattaca

SEQ ID NO: 122429 - DNA, 20 bp, Artificial Sequence
  chemically synthesized
ggtaggggtcatatattcga

SEQ ID NO: 122430 - DNA, 20 bp, Artificial Sequence
  chemically synthesized
aggtaggggtcatatattcg

SEQ ID NO: 122431 - DNA, 20 bp, Artificial Sequence
  chemically synthesized
taggtaggggtcatatattc

SEQ ID NO: 122432 - DNA, 20 bp, Artificial Sequence
  chemically synthesized
gaaagtgaatatgtaggtag

SEQ ID NO: 122433 - DNA, 20 bp, Artificial Sequence
  chemically synthesized
tgaaagtgaatatgtaggta

SEQ ID NO: 122434 - DNA, 20 bp, Artificial Sequence
  chemically synthesized
atgaaagtgaatatgtaggt

SEQ ID NO: 122435 - DNA, 20 bp, Artificial Sequence
  chemically synthesized
gatgaaagtgaatatgtagg

SEQ ID NO: 122436 - DNA, 20 bp, Artificial Sequence
  chemically synthesized
aaagatgaaagtgaatatgt

SEQ ID NO: 122437 - DNA, 20 bp, Artificial Sequence
  chemically synthesized
aaaagatgaaagtgaatatg

SEQ ID NO: 122438 - DNA, 20 bp, Artificial Sequence
  chemically synthesized
aagaagatatcaaaagatga

SEQ ID NO: 122439 - DNA, 20 bp, Artificial Sequence
  chemically synthesized
aaaaaggaagaagatatcaa

SEQ ID NO: 122440 - DNA, 20 bp, Artificial Sequence
  chemically synthesized
ggaattgctcaaaaaggaag

SEQ ID NO: 122441 - DNA, 20 bp, Artificial Sequence
  chemically synthesized
ttgatatcttcttccttttt

SEQ ID NO: 122442 - DNA, 20 bp, Artificial Sequence
  chemically synthesized
tatggaattgctcaaaaagg

SEQ ID NO: 122443 - DNA, 20 bp, Artificial Sequence
  chemically synthesized
aattatggaattgctcaaaa

SEQ ID NO: 122444 - DNA, 20 bp, Artificial Sequence
  chemically synthesized
caattatggaattgctcaaa

SEQ ID NO: 122445 - DNA, 20 bp, Artificial Sequence
  chemically synthesized
tattctcatgtggacaatta

SEQ ID NO: 122446 - DNA, 20 bp, Artificial Sequence
  chemically synthesized
aattccataattgtccacat

SEQ ID NO: 122447 - DNA, 20 bp, Artificial Sequence
  chemically synthesized
agagcatttatattctcatg

SEQ ID NO: 122448 - DNA, 20 bp, Artificial Sequence
  chemically synthesized
tgagaatataaatgctctga

SEQ ID NO: 122449 - DNA, 20 bp, Artificial Sequence
  chemically synthesized
gagaatataaatgctctgaa

SEQ ID NO: 122450 - DNA, 20 bp, Artificial Sequence
  chemically synthesized
acaagtcacttaacctttca

SEQ ID NO: 122451 - DNA, 20 bp, Artificial Sequence
  chemically synthesized
tataaatgctctgaaaggtt

SEQ ID NO: 122452 - DNA, 20 bp, Artificial Sequence
  chemically synthesized
gaacaagtcacttaaccttt

SEQ ID NO: 122453 - DNA, 20 bp, Artificial Sequence
  chemically synthesized
aaaggttaagtgacttgttc

SEQ ID NO: 122454 - DNA, 20 bp, Artificial Sequence
  chemically synthesized
aaggttaagtgacttgttca

SEQ ID NO: 122455 - DNA, 20 bp, Artificial Sequence
  chemically synthesized
ctagctatgtcaccttgaac

SEQ ID NO: 122456 - DNA, 20 bp, Artificial Sequence
  chemically synthesized
gtgacttgttcaaggtgaca

SEQ ID NO: 122457 - DNA, 20 bp, Artificial Sequence
  chemically synthesized
cttgttcaaggtgacatagc

SEQ ID NO: 122458 - DNA, 20 bp, Artificial Sequence
  chemically synthesized
ttcaaggtgacatagctagt

SEQ ID NO: 122459 - DNA, 20 bp, Artificial Sequence
  chemically synthesized
atgatgactctttcactgac

SEQ ID NO: 122460 - DNA, 20 bp, Artificial Sequence
  chemically synthesized
gtgacatagctagtcagtga

SEQ ID NO: 122461 - DNA, 20 bp, Artificial Sequence
  chemically synthesized
gacatagctagtcagtgaaa

SEQ ID NO: 122462 - DNA, 20 bp, Artificial Sequence
  chemically synthesized
aaagagtcatcataaaaatg

SEQ ID NO: 122463 - DNA, 20 bp, Artificial Sequence
  chemically synthesized
aagagtcatcataaaaatgc

SEQ ID NO: 122464 - DNA, 20 bp, Artificial Sequence
  chemically synthesized
atcataaaaatgcaggtttc

SEQ ID NO: 122465 - DNA, 20 bp, Artificial Sequence
  chemically synthesized
tgaaacctgaattgagagtc

SEQ ID NO: 122466 - DNA, 20 bp, Artificial Sequence
  chemically synthesized
aggtttctggactctcaatt

SEQ ID NO: 122467 - DNA, 20 bp, Artificial Sequence
  chemically synthesized
ggtttctggactctcaattc

SEQ ID NO: 122468 - DNA, 20 bp, Artificial Sequence
  chemically synthesized
tgaaatgaaacctgaattga

SEQ ID NO: 122469 - DNA, 20 bp, Artificial Sequence
  chemically synthesized
attgaaatgaaacctgaatt

SEQ ID NO: 122470 - DNA, 20 bp, Artificial Sequence
  chemically synthesized
attcaggtttcatttcaatt

SEQ ID NO: 122471 - DNA, 20 bp, Artificial Sequence
  chemically synthesized
gtttcatttcaattcagtta

SEQ ID NO: 122472 - DNA, 20 bp, Artificial Sequence
  chemically synthesized
tcatttcaattcagttaaag

SEQ ID NO: 122473 - DNA, 20 bp, Artificial Sequence
  chemically synthesized
agaagttatgcatccatata

SEQ ID NO: 122474 - DNA, 20 bp, Artificial Sequence
  chemically synthesized
tttccttaaatttctttata

SEQ ID NO: 122475 - DNA, 20 bp, Artificial Sequence
  chemically synthesized
gcatccatataaagaaattt

SEQ ID NO: 122476 - DNA, 20 bp, Artificial Sequence
  chemically synthesized
catccatataaagaaattta

SEQ ID NO: 122477 - DNA, 20 bp, Artificial Sequence
  chemically synthesized
atataaagaaatttaaggaa

SEQ ID NO: 122478 - DNA, 20 bp, Artificial Sequence
  chemically synthesized
tataaagaaatttaaggaaa

SEQ ID NO: 122479 - DNA, 20 bp, Artificial Sequence
  chemically synthesized
agaaatttaaggaaaaggac

SEQ ID NO: 122480 - DNA, 20 bp, Artificial Sequence
  chemically synthesized
gaaatttaaggaaaaggact

SEQ ID NO: 122481 - DNA, 20 bp, Artificial Sequence
  chemically synthesized
aagctcagttaaaataaacc

SEQ ID NO: 122482 - DNA, 20 bp, Artificial Sequence
  chemically synthesized
ggactgggtttattttaact

SEQ ID NO: 122483 - DNA, 20 bp, Artificial Sequence
  chemically synthesized
tttattttaactgagctttg

SEQ ID NO: 122484 - DNA, 20 bp, Artificial Sequence
  chemically synthesized
gttttatattcttcaaagct

SEQ ID NO: 122485 - DNA, 20 bp, Artificial Sequence
  chemically synthesized
agattgttttatattcttca

SEQ ID NO: 122486 - DNA, 20 bp, Artificial Sequence
  chemically synthesized
ccagtcatgctataatcatc

SEQ ID NO: 122487 - DNA, 20 bp, Artificial Sequence
  chemically synthesized
taaaacaatcttgatgatta

SEQ ID NO: 122488 - DNA, 20 bp, Artificial Sequence
  chemically synthesized
cttgatgattatagcatgac

SEQ ID NO: 122489 - DNA, 20 bp, Artificial Sequence
  chemically synthesized
tattatacataataattttc

SEQ ID NO: 122490 - DNA, 20 bp, Artificial Sequence
  chemically synthesized
gaaaattattatgtataata

SEQ ID NO: 122491 - DNA, 20 bp, Artificial Sequence
  chemically synthesized
attattatgtataataaagt

SEQ ID NO: 122492 - DNA, 20 bp, Artificial Sequence
  chemically synthesized
ttattatgtataataaagta

SEQ ID NO: 122493 - DNA, 20 bp, Artificial Sequence
  chemically synthesized
agtaaggcatttctgaaaaa

SEQ ID NO: 122494 - DNA, 20 bp, Artificial Sequence
  chemically synthesized
tttttctgctgtcttttttt

SEQ ID NO: 122495 - DNA, 20 bp, Artificial Sequence
  chemically synthesized
aggcatttctgaaaaaaaga

SEQ ID NO: 122496 - DNA, 20 bp, Artificial Sequence
  chemically synthesized
catttctgaaaaaaagacag

SEQ ID NO: 122497 - DNA, 20 bp, Artificial Sequence
  chemically synthesized
aaagacagcagaaaaataca

SEQ ID NO: 122498 - DNA, 20 bp, Artificial Sequence
  chemically synthesized
ttgaaaatcactaaacaatt

SEQ ID NO: 122499 - DNA, 20 bp, Artificial Sequence
  chemically synthesized
attcttgggaccaaattgtt

SEQ ID NO: 122500 - DNA, 20 bp, Artificial Sequence
  chemically synthesized
tcactaaacaatttggtccc

SEQ ID NO: 122501 - DNA, 20 bp, Artificial Sequence
  chemically synthesized
tagaacattaattcattctt

SEQ ID NO: 122502 - DNA, 20 bp, Artificial Sequence
  chemically synthesized
atagaacattaattcattct

SEQ ID NO: 122503 - DNA, 20 bp, Artificial Sequence
  chemically synthesized
cttttcccaataaggattta

SEQ ID NO: 122504 - DNA, 20 bp, Artificial Sequence
  chemically synthesized
aatgttctataaatccttat

SEQ ID NO: 122505 - DNA, 20 bp, Artificial Sequence
  chemically synthesized
atgttctataaatccttatt

SEQ ID NO: 122506 - DNA, 20 bp, Artificial Sequence
  chemically synthesized
gtgcttctcttttcccaata

SEQ ID NO: 122507 - DNA, 20 bp, Artificial Sequence
  chemically synthesized
tgtgcttctcttttcccaat

SEQ ID NO: 122508 - DNA, 20 bp, Artificial Sequence
  chemically synthesized
ctataaatccttattgggaa

SEQ ID NO: 122509 - DNA, 20 bp, Artificial Sequence
  chemically synthesized
ataaatccttattgggaaaa

SEQ ID NO: 122510 - DNA, 20 bp, Artificial Sequence
  chemically synthesized
aatccttattgggaaaagag

SEQ ID NO: 122511 - DNA, 20 bp, Artificial Sequence
  chemically synthesized
tttaattcacacaaggaggg

SEQ ID NO: 122512 - DNA, 20 bp, Artificial Sequence
  chemically synthesized
cgttttaattcacacaagga

SEQ ID NO: 122513 - DNA, 20 bp, Artificial Sequence
  chemically synthesized
tcgttttaattcacacaagg

SEQ ID NO: 122514 - DNA, 20 bp, Artificial Sequence
  chemically synthesized
gtcgttttaattcacacaag

SEQ ID NO: 122515 - DNA, 20 bp, Artificial Sequence
  chemically synthesized
aggtcgttttaattcacaca

SEQ ID NO: 122516 - DNA, 20 bp, Artificial Sequence
  chemically synthesized
taggtcgttttaattcacac

SEQ ID NO: 122517 - DNA, 20 bp, Artificial Sequence
  chemically synthesized
aatccataaagaggttttat

SEQ ID NO: 122518 - DNA, 20 bp, Artificial Sequence
  chemically synthesized
aaatccataaagaggtttta

SEQ ID NO: 122519 - DNA, 20 bp, Artificial Sequence
  chemically synthesized
cgacctataaaacctcttta

SEQ ID NO: 122520 - DNA, 20 bp, Artificial Sequence
  chemically synthesized
tctattataaatccataaag

SEQ ID NO: 122521 - DNA, 20 bp, Artificial Sequence
  chemically synthesized
ttctattataaatccataaa

SEQ ID NO: 122522 - DNA, 20 bp, Artificial Sequence
  chemically synthesized
atttctattataaatccata

SEQ ID NO: 122523 - DNA, 20 bp, Artificial Sequence
  chemically synthesized
acctctttatggatttataa

SEQ ID NO: 122524 - DNA, 20 bp, Artificial Sequence
  chemically synthesized
ttataatagaaatgttaaaa

SEQ ID NO: 122525 - DNA, 20 bp, Artificial Sequence
  chemically synthesized
agaaatgttaaaatagctgt

SEQ ID NO: 122526 - DNA, 20 bp, Artificial Sequence
  chemically synthesized
atgttaaaatagctgtaaga

SEQ ID NO: 122527 - DNA, 20 bp, Artificial Sequence
  chemically synthesized
cttttgaaatggctttctta

SEQ ID NO: 122528 - DNA, 20 bp, Artificial Sequence
  chemically synthesized
ctgtaagaaagccatttcaa

SEQ ID NO: 122529 - DNA, 20 bp, Artificial Sequence
  chemically synthesized
gagaggctttacttttgaaa

SEQ ID NO: 122530 - DNA, 20 bp, Artificial Sequence
  chemically synthesized
agaaagccatttcaaaagta

SEQ ID NO: 122531 - DNA, 20 bp, Artificial Sequence
  chemically synthesized
gtcttgaagttaatggtgag

SEQ ID NO: 122532 - DNA, 20 bp, Artificial Sequence
  chemically synthesized
agtcttgaagttaatggtga

SEQ ID NO: 122533 - DNA, 20 bp, Artificial Sequence
  chemically synthesized
tgagtcttgaagttaatggt

SEQ ID NO: 122534 - DNA, 20 bp, Artificial Sequence
  chemically synthesized
tagatgagtcttgaagttaa

SEQ ID NO: 122535 - DNA, 20 bp, Artificial Sequence
  chemically synthesized
agcctctcaccattaacttc

SEQ ID NO: 122536 - DNA, 20 bp, Artificial Sequence
  chemically synthesized
ggtttaatagatgagtcttg

SEQ ID NO: 122537 - DNA, 20 bp, Artificial Sequence
  chemically synthesized
atgtcagaggtttaatagat

SEQ ID NO: 122538 - DNA, 20 bp, Artificial Sequence
  chemically synthesized
tggtaatgtcagaggtttaa

SEQ ID NO: 122539 - DNA, 20 bp, Artificial Sequence
  chemically synthesized
gagttgtttggtaatgtcag

SEQ ID NO: 122540 - DNA, 20 bp, Artificial Sequence
  chemically synthesized
agagttgtttggtaatgtca

SEQ ID NO: 122541 - DNA, 20 bp, Artificial Sequence
  chemically synthesized
acagagttgtttggtaatgt

SEQ ID NO: 122542 - DNA, 20 bp, Artificial Sequence
  chemically synthesized
ccttctgaaacagagttgtt

SEQ ID NO: 122543 - DNA, 20 bp, Artificial Sequence
  chemically synthesized
attaccaaacaactctgttt

SEQ ID NO: 122544 - DNA, 20 bp, Artificial Sequence
  chemically synthesized
gagtgttaccttctgaaaca

SEQ ID NO: 122545 - DNA, 20 bp, Artificial Sequence
  chemically synthesized
accaaacaactctgtttcag

SEQ ID NO: 122546 - DNA, 20 bp, Artificial Sequence
  chemically synthesized
ccaaacaactctgtttcaga

SEQ ID NO: 122547 - DNA, 20 bp, Artificial Sequence
  chemically synthesized
tagagtgttaccttctgaaa

SEQ ID NO: 122548 - DNA, 20 bp, Artificial Sequence
  chemically synthesized
tcagaaggtaacactctata

SEQ ID NO: 122549 - DNA, 20 bp, Artificial Sequence
  chemically synthesized
cagaaggtaacactctatac

SEQ ID NO: 122550 - DNA, 20 bp, Artificial Sequence
  chemically synthesized
agaaggtaacactctataca

SEQ ID NO: 122551 - DNA, 20 bp, Artificial Sequence
  chemically synthesized
taaatagtatgccctgtata

SEQ ID NO: 122552 - DNA, 20 bp, Artificial Sequence
  chemically synthesized
cttaaatagtatgccctgta

SEQ ID NO: 122553 - DNA, 20 bp, Artificial Sequence
  chemically synthesized
ctatacagggcatactattt

SEQ ID NO: 122554 - DNA, 20 bp, Artificial Sequence
  chemically synthesized
atgagggccattttcttaaa

SEQ ID NO: 122555 - DNA, 20 bp, Artificial Sequence
  chemically synthesized
gggcatactatttaagaaaa

SEQ ID NO: 122556 - DNA, 20 bp, Artificial Sequence
  chemically synthesized
ttcagtaagccggaaaatga

SEQ ID NO: 122557 - DNA, 20 bp, Artificial Sequence
  chemically synthesized
agaaaatggccctcattttc

SEQ ID NO: 122558 - DNA, 20 bp, Artificial Sequence
  chemically synthesized
tttcagtaagccggaaaatg

SEQ ID NO: 122559 - DNA, 20 bp, Artificial Sequence
  chemically synthesized
ttttcagtaagccggaaaat

SEQ ID NO: 122560 - DNA, 20 bp, Artificial Sequence
  chemically synthesized
attaatcattttcagtaagc

SEQ ID NO: 122561 - DNA, 20 bp, Artificial Sequence
  chemically synthesized
aaagattaatcattttcagt

SEQ ID NO: 122562 - DNA, 20 bp, Artificial Sequence
  chemically synthesized
ttgtaaagattaatcatttt

SEQ ID NO: 122563 - DNA, 20 bp, Artificial Sequence
  chemically synthesized
aaaatgattaatctttacaa

SEQ ID NO: 122564 - DNA, 20 bp, Artificial Sequence
  chemically synthesized
tagtcttcaaagctattgta

SEQ ID NO: 122565 - DNA, 20 bp, Artificial Sequence
  chemically synthesized
taatctttacaatagctttg

SEQ ID NO: 122566 - DNA, 20 bp, Artificial Sequence
  chemically synthesized
acgttggtatgtagtcttca

SEQ ID NO: 122567 - DNA, 20 bp, Artificial Sequence
  chemically synthesized
aaagtaacgacgttggtatg

SEQ ID NO: 122568 - DNA, 20 bp, Artificial Sequence
  chemically synthesized
ggacagaaaagtaacgacgt

SEQ ID NO: 122569 - DNA, 20 bp, Artificial Sequence
  chemically synthesized
tcattgttgaaaggacagaa

SEQ ID NO: 122570 - DNA, 20 bp, Artificial Sequence
  chemically synthesized
tgtagtcattgttgaaagga

SEQ ID NO: 122571 - DNA, 20 bp, Artificial Sequence
  chemically synthesized
agcttgtagtcattgttgaa

SEQ ID NO: 122572 - DNA, 20 bp, Artificial Sequence
  chemically synthesized
cagcttgtagtcattgttga

SEQ ID NO: 122573 - DNA, 20 bp, Artificial Sequence
  chemically synthesized
gtcctttcaacaatgactac

SEQ ID NO: 122574 - DNA, 20 bp, Artificial Sequence
  chemically synthesized
ttcaacaatgactacaagct

SEQ ID NO: 122575 - DNA, 20 bp, Artificial Sequence
  chemically synthesized
actagtctgctctcagcttg

SEQ ID NO: 122576 - DNA, 20 bp, Artificial Sequence
  chemically synthesized
caacaatgactacaagctga

SEQ ID NO: 122577 - DNA, 20 bp, Artificial Sequence
  chemically synthesized
caatgactacaagctgagag

SEQ ID NO: 122578 - DNA, 20 bp, Artificial Sequence
  chemically synthesized
cacatttactagtctgctct

SEQ ID NO: 122579 - DNA, 20 bp, Artificial Sequence
  chemically synthesized
actacaagctgagagcagac

SEQ ID NO: 122580 - DNA, 20 bp, Artificial Sequence
  chemically synthesized
ttggccgataacacatttac

SEQ ID NO: 122581 - DNA, 20 bp, Artificial Sequence
  chemically synthesized
cagactagtaaatgtgttat

SEQ ID NO: 122582 - DNA, 20 bp, Artificial Sequence
  chemically synthesized
tgtgttatcggccaacccat

SEQ ID NO: 122583 - DNA, 20 bp, Artificial Sequence
  chemically synthesized
ataatggaactctaatgggt

SEQ ID NO: 122584 - DNA, 20 bp, Artificial Sequence
  chemically synthesized
tgttatcggccaacccatta

SEQ ID NO: 122585 - DNA, 20 bp, Artificial Sequence
  chemically synthesized
gaaaataatggaactctaat

SEQ ID NO: 122586 - DNA, 20 bp, Artificial Sequence
  chemically synthesized
agaaaataatggaactctaa

SEQ ID NO: 122587 - DNA, 20 bp, Artificial Sequence
  chemically synthesized
ccatgtaagacagaaaataa

SEQ ID NO: 122588 - DNA, 20 bp, Artificial Sequence
  chemically synthesized
ccattattttctgtcttaca

SEQ ID NO: 122589 - DNA, 20 bp, Artificial Sequence
  chemically synthesized
ttacatgaagccatgtaaga

SEQ ID NO: 122590 - DNA, 20 bp, Artificial Sequence
  chemically synthesized
ttcattacatgaagccatgt

SEQ ID NO: 122591 - DNA, 20 bp, Artificial Sequence
  chemically synthesized
ttataaaaattcattacatg

SEQ ID NO: 122592 - DNA, 20 bp, Artificial Sequence
  chemically synthesized
aatttttataattaaactaa

SEQ ID NO: 122593 - DNA, 20 bp, Artificial Sequence
  chemically synthesized
aaaaatatattgtatgccat

SEQ ID NO: 122594 - DNA, 20 bp, Artificial Sequence
  chemically synthesized
tggggcctgaaagtaaagag

SEQ ID NO: 122595 - DNA, 20 bp, Artificial Sequence
  chemically synthesized
atggggcctgaaagtaaaga

SEQ ID NO: 122596 - DNA, 20 bp, Artificial Sequence
  chemically synthesized
aatggggcctgaaagtaaag

SEQ ID NO: 122597 - DNA, 20 bp, Artificial Sequence
  chemically synthesized
aaatggggcctgaaagtaaa

SEQ ID NO: 122598 - DNA, 20 bp, Artificial Sequence
  chemically synthesized
atttttcccctctttacttt

SEQ ID NO: 122599 - DNA, 20 bp, Artificial Sequence
  chemically synthesized
tttttcccctctttactttc

SEQ ID NO: 122600 - DNA, 20 bp, Artificial Sequence
  chemically synthesized
agaaatggggcctgaaagta

SEQ ID NO: 122601 - DNA, 20 bp, Artificial Sequence
  chemically synthesized
ggaagagaaatggggcctga

SEQ ID NO: 122602 - DNA, 20 bp, Artificial Sequence
  chemically synthesized
aagcagctggaagagaaatg

SEQ ID NO: 122603 - DNA, 20 bp, Artificial Sequence
  chemically synthesized
aaagcagctggaagagaaat

SEQ ID NO: 122604 - DNA, 20 bp, Artificial Sequence
  chemically synthesized
caaagcagctggaagagaaa

SEQ ID NO: 122605 - DNA, 20 bp, Artificial Sequence
  chemically synthesized
ttcaggccccatttctcttc

SEQ ID NO: 122606 - DNA, 20 bp, Artificial Sequence
  chemically synthesized
ttattccaaagcagctggaa

SEQ ID NO: 122607 - DNA, 20 bp, Artificial Sequence
  chemically synthesized
acttattccaaagcagctgg

SEQ ID NO: 122608 - DNA, 20 bp, Artificial Sequence
  chemically synthesized
catttctcttccagctgctt

SEQ ID NO: 122609 - DNA, 20 bp, Artificial Sequence
  chemically synthesized
gaaacttattccaaagcagc

SEQ ID NO: 122610 - DNA, 20 bp, Artificial Sequence
  chemically synthesized
gtatgaaacttattccaaag

SEQ ID NO: 122611 - DNA, 20 bp, Artificial Sequence
  chemically synthesized
tcttccagctgctttggaat

SEQ ID NO: 122612 - DNA, 20 bp, Artificial Sequence
  chemically synthesized
tttgtatgaaacttattcca

SEQ ID NO: 122613 - DNA, 20 bp, Artificial Sequence
  chemically synthesized
tggaataagtttcatacaaa

SEQ ID NO: 122614 - DNA, 20 bp, Artificial Sequence
  chemically synthesized
aataagtttcatacaaaaag

SEQ ID NO: 122615 - DNA, 20 bp, Artificial Sequence
  chemically synthesized
ataagtttcatacaaaaaga

SEQ ID NO: 122616 - DNA, 20 bp, Artificial Sequence
  chemically synthesized
taagtttcatacaaaaagaa

SEQ ID NO: 122617 - DNA, 20 bp, Artificial Sequence
  chemically synthesized
agtttcatacaaaaagaagg

SEQ ID NO: 122618 - DNA, 20 bp, Artificial Sequence
  chemically synthesized
gtttcatacaaaaagaaggg

SEQ ID NO: 122619 - DNA, 20 bp, Artificial Sequence
  chemically synthesized
ttcatacaaaaagaagggag

SEQ ID NO: 122620 - DNA, 20 bp, Artificial Sequence
  chemically synthesized
catacaaaaagaagggagga

SEQ ID NO: 122621 - DNA, 20 bp, Artificial Sequence
  chemically synthesized
atacaaaaagaagggaggag

SEQ ID NO: 122622 - DNA, 20 bp, Artificial Sequence
  chemically synthesized
agaagggaggagaggtctcc

SEQ ID NO: 122623 - DNA, 20 bp, Artificial Sequence
  chemically synthesized
ttaaggtaacgaagcacttg

SEQ ID NO: 122624 - DNA, 20 bp, Artificial Sequence
  chemically synthesized
aattaaggtaacgaagcact

SEQ ID NO: 122625 - DNA, 20 bp, Artificial Sequence
  chemically synthesized
ataatgaaattaaggtaacg

SEQ ID NO: 122626 - DNA, 20 bp, Artificial Sequence
  chemically synthesized
aaaatgtcataatgaaatta

SEQ ID NO: 122627 - DNA, 20 bp, Artificial Sequence
  chemically synthesized
aaaaatgtcataatgaaatt

SEQ ID NO: 122628 - DNA, 20 bp, Artificial Sequence
  chemically synthesized
tttcattatgacatttttga

SEQ ID NO: 122629 - DNA, 20 bp, Artificial Sequence
  chemically synthesized
ttgaaagcattctctttatc

SEQ ID NO: 122630 - DNA, 20 bp, Artificial Sequence
  chemically synthesized
tgaaagcattctctttatct

SEQ ID NO: 122631 - DNA, 20 bp, Artificial Sequence
  chemically synthesized
aaagagagagcccagataaa

SEQ ID NO: 122632 - DNA, 20 bp, Artificial Sequence
  chemically synthesized
ttaaagagagagcccagata

SEQ ID NO: 122633 - DNA, 20 bp, Artificial Sequence
  chemically synthesized
agcaaattaaagagagagcc

SEQ ID NO: 122634 - DNA, 20 bp, Artificial Sequence
  chemically synthesized
aagtcagcaaattaaagaga

SEQ ID NO: 122635 - DNA, 20 bp, Artificial Sequence
  chemically synthesized
taaagtcagcaaattaaaga

SEQ ID NO: 122636 - DNA, 20 bp, Artificial Sequence
  chemically synthesized
aataaagtcagcaaattaaa

SEQ ID NO: 122637 - DNA, 20 bp, Artificial Sequence
  chemically synthesized
ttaataaagtcagcaaatta

SEQ ID NO: 122638 - DNA, 20 bp, Artificial Sequence
  chemically synthesized
cttaagccttttaataaagt

SEQ ID NO: 122639 - DNA, 20 bp, Artificial Sequence
  chemically synthesized
taatttgctgactttattaa

SEQ ID NO: 122640 - DNA, 20 bp, Artificial Sequence
  chemically synthesized
aatttgctgactttattaaa

SEQ ID NO: 122641 - DNA, 20 bp, Artificial Sequence
  chemically synthesized
attgcttaagccttttaata

SEQ ID NO: 122642 - DNA, 20 bp, Artificial Sequence
  chemically synthesized
ctgactttattaaaaggctt

SEQ ID NO: 122643 - DNA, 20 bp, Artificial Sequence
  chemically synthesized
tgttaattacagtattgctt

SEQ ID NO: 122644 - DNA, 20 bp, Artificial Sequence
  chemically synthesized
gctgggtgatttgttaatta

SEQ ID NO: 122645 - DNA, 20 bp, Artificial Sequence
  chemically synthesized
actgtaattaacaaatcacc

SEQ ID NO: 122646 - DNA, 20 bp, Artificial Sequence
  chemically synthesized
ctcagatgcctggggtagct

SEQ ID NO: 122647 - DNA, 20 bp, Artificial Sequence
  chemically synthesized
aacaaatcacccagctaccc

SEQ ID NO: 122648 - DNA, 20 bp, Artificial Sequence
  chemically synthesized
tctcagatgcctggggtagc

SEQ ID NO: 122649 - DNA, 20 bp, Artificial Sequence
  chemically synthesized
acaaatcacccagctacccc

SEQ ID NO: 122650 - DNA, 20 bp, Artificial Sequence
  chemically synthesized
cttttctcagatgcctgggg

SEQ ID NO: 122651 - DNA, 20 bp, Artificial Sequence
  chemically synthesized
tgacttttctcagatgcctg

SEQ ID NO: 122652 - DNA, 20 bp, Artificial Sequence
  chemically synthesized
ctgacttttctcagatgcct

SEQ ID NO: 122653 - DNA, 20 bp, Artificial Sequence
  chemically synthesized
cccagctaccccaggcatct

SEQ ID NO: 122654 - DNA, 20 bp, Artificial Sequence
  chemically synthesized
actgacttttctcagatgcc

SEQ ID NO: 122655 - DNA, 20 bp, Artificial Sequence
  chemically synthesized
ctaccccaggcatctgagaa

SEQ ID NO: 122656 - DNA, 20 bp, Artificial Sequence
  chemically synthesized
ccctctcaactgacttttct

SEQ ID NO: 122657 - DNA, 20 bp, Artificial Sequence
  chemically synthesized
cccaggcatctgagaaaagt

SEQ ID NO: 122658 - DNA, 20 bp, Artificial Sequence
  chemically synthesized
gcatctgagaaaagtcagtt

SEQ ID NO: 122659 - DNA, 20 bp, Artificial Sequence
  chemically synthesized
atctgagaaaagtcagttga

SEQ ID NO: 122660 - DNA, 20 bp, Artificial Sequence
  chemically synthesized
tctgagaaaagtcagttgag

SEQ ID NO: 122661 - DNA, 20 bp, Artificial Sequence
  chemically synthesized
ctgagaaaagtcagttgaga

SEQ ID NO: 122662 - DNA, 20 bp, Artificial Sequence
  chemically synthesized
aaaagtcagttgagagggtg

SEQ ID NO: 122663 - DNA, 20 bp, Artificial Sequence
  chemically synthesized
cagttgagagggtgtagaaa

SEQ ID NO: 122664 - DNA, 20 bp, Artificial Sequence
  chemically synthesized
tgagagggtgtagaaatgga

SEQ ID NO: 122665 - DNA, 20 bp, Artificial Sequence
  chemically synthesized
gagagggtgtagaaatggat

SEQ ID NO: 122666 - DNA, 20 bp, Artificial Sequence
  chemically synthesized
agggtgtagaaatggatggg

SEQ ID NO: 122667 - DNA, 20 bp, Artificial Sequence
  chemically synthesized
tggatgggtggaaacgattc

SEQ ID NO: 122668 - DNA, 20 bp, Artificial Sequence
  chemically synthesized
ctgtcctctggcattgtttc

SEQ ID NO: 122669 - DNA, 20 bp, Artificial Sequence
  chemically synthesized
aacgattccagaaacaatgc

SEQ ID NO: 122670 - DNA, 20 bp, Artificial Sequence
  chemically synthesized
cgattccagaaacaatgcca

SEQ ID NO: 122671 - DNA, 20 bp, Artificial Sequence
  chemically synthesized
gattccagaaacaatgccag

SEQ ID NO: 122672 - DNA, 20 bp, Artificial Sequence
  chemically synthesized
ccagaaacaatgccagagga

SEQ ID NO: 122673 - DNA, 20 bp, Artificial Sequence
  chemically synthesized
ttttctggggttctgtcctc

SEQ ID NO: 122674 - DNA, 20 bp, Artificial Sequence
  chemically synthesized
aatgccagaggacagaaccc

SEQ ID NO: 122675 - DNA, 20 bp, Artificial Sequence
  chemically synthesized
gaggacagaaccccagaaaa

SEQ ID NO: 122676 - DNA, 20 bp, Artificial Sequence
  chemically synthesized
tgaaaaaacgccattttctg

SEQ ID NO: 122677 - DNA, 20 bp, Artificial Sequence
  chemically synthesized
ctgaaaaaacgccattttct

SEQ ID NO: 122678 - DNA, 20 bp, Artificial Sequence
  chemically synthesized
gctgaaaaaacgccattttc

SEQ ID NO: 122679 - DNA, 20 bp, Artificial Sequence
  chemically synthesized
cccagaaaatggcgtttttt

SEQ ID NO: 122680 - DNA, 20 bp, Artificial Sequence
  chemically synthesized
gcgttttttcagctcctttt

SEQ ID NO: 122681 - DNA, 20 bp, Artificial Sequence
  chemically synthesized
tgctcatggggtctgaaaag

SEQ ID NO: 122682 - DNA, 20 bp, Artificial Sequence
  chemically synthesized
tatgctcatggggtctgaaa

SEQ ID NO: 122683 - DNA, 20 bp, Artificial Sequence
  chemically synthesized
atatgctcatggggtctgaa

SEQ ID NO: 122684 - DNA, 20 bp, Artificial Sequence
  chemically synthesized
agctccttttcagaccccat

SEQ ID NO: 122685 - DNA, 20 bp, Artificial Sequence
  chemically synthesized
tctaccacaatatgctcatg

SEQ ID NO: 122686 - DNA, 20 bp, Artificial Sequence
  chemically synthesized
gtctaccacaatatgctcat

SEQ ID NO: 122687 - DNA, 20 bp, Artificial Sequence
  chemically synthesized
agtctaccacaatatgctca

SEQ ID NO: 122688 - DNA, 20 bp, Artificial Sequence
  chemically synthesized
cagaccccatgagcatattg

SEQ ID NO: 122689 - DNA, 20 bp, Artificial Sequence
  chemically synthesized
accccatgagcatattgtgg

SEQ ID NO: 122690 - DNA, 20 bp, Artificial Sequence
  chemically synthesized
gatatttgagaacaataatg

SEQ ID NO: 122691 - DNA, 20 bp, Artificial Sequence
  chemically synthesized
cattattgttctcaaatatc

SEQ ID NO: 122692 - DNA, 20 bp, Artificial Sequence
  chemically synthesized
tgaaaaggcactggatattt

SEQ ID NO: 122693 - DNA, 20 bp, Artificial Sequence
  chemically synthesized
cttctggcgtgaaaaggcac

SEQ ID NO: 122694 - DNA, 20 bp, Artificial Sequence
  chemically synthesized
tataatcttctggcgtgaaa

SEQ ID NO: 122695 - DNA, 20 bp, Artificial Sequence
  chemically synthesized
tatccagtgccttttcacgc

SEQ ID NO: 122696 - DNA, 20 bp, Artificial Sequence
  chemically synthesized
gtataatcttctggcgtgaa

SEQ ID NO: 122697 - DNA, 20 bp, Artificial Sequence
  chemically synthesized
ccagtgccttttcacgccag

SEQ ID NO: 122698 - DNA, 20 bp, Artificial Sequence
  chemically synthesized
aatgccgatgtataatcttc

SEQ ID NO: 122699 - DNA, 20 bp, Artificial Sequence
  chemically synthesized
cacgccagaagattatacat

SEQ ID NO: 122700 - DNA, 20 bp, Artificial Sequence
  chemically synthesized
tggccattcctgagttcaat

SEQ ID NO: 122701 - DNA, 20 bp, Artificial Sequence
  chemically synthesized
atcggcattcccattgaact

SEQ ID NO: 122702 - DNA, 20 bp, Artificial Sequence
  chemically synthesized
atggccattcctgagttcaa

SEQ ID NO: 122703 - DNA, 20 bp, Artificial Sequence
  chemically synthesized
tcggcattcccattgaactc

SEQ ID NO: 122704 - DNA, 20 bp, Artificial Sequence
  chemically synthesized
attcccattgaactcaggaa

SEQ ID NO: 122705 - DNA, 20 bp, Artificial Sequence
  chemically synthesized
ccagtcacatggccattcct

SEQ ID NO: 122706 - DNA, 20 bp, Artificial Sequence
  chemically synthesized
ctcaggaatggccatgtgac

SEQ ID NO: 122707 - DNA, 20 bp, Artificial Sequence
  chemically synthesized
agtagacaaaaccagtcaca

SEQ ID NO: 122708 - DNA, 20 bp, Artificial Sequence
  chemically synthesized
aagtgaccagtagacaaaac

SEQ ID NO: 122709 - DNA, 20 bp, Artificial Sequence
  chemically synthesized
atgtgactggttttgtctac

SEQ ID NO: 122710 - DNA, 20 bp, Artificial Sequence
  chemically synthesized
ttctgcctggaagtgaccag

SEQ ID NO: 122711 - DNA, 20 bp, Artificial Sequence
  chemically synthesized
gccttctgcctggaagtgac

SEQ ID NO: 122712 - DNA, 20 bp, Artificial Sequence
  chemically synthesized
ttttgtctactggtcacttc

SEQ ID NO: 122713 - DNA, 20 bp, Artificial Sequence
  chemically synthesized
tttgtctactggtcacttcc

SEQ ID NO: 122714 - DNA, 20 bp, Artificial Sequence
  chemically synthesized
gtctactggtcacttccagg

SEQ ID NO: 122715 - DNA, 20 bp, Artificial Sequence
  chemically synthesized
ttcttgagccttctgcctgg

SEQ ID NO: 122716 - DNA, 20 bp, Artificial Sequence
  chemically synthesized
tactggtcacttccaggcag

SEQ ID NO: 122717 - DNA, 20 bp, Artificial Sequence
  chemically synthesized
actggtcacttccaggcaga

SEQ ID NO: 122718 - DNA, 20 bp, Artificial Sequence
  chemically synthesized
tggttcttgagccttctgcc

SEQ ID NO: 122719 - DNA, 20 bp, Artificial Sequence
  chemically synthesized
cacttccaggcagaaggctc

SEQ ID NO: 122720 - DNA, 20 bp, Artificial Sequence
  chemically synthesized
aggcaaggaacatggttctt

SEQ ID NO: 122721 - DNA, 20 bp, Artificial Sequence
  chemically synthesized
gatcatagaggcaaggaaca

SEQ ID NO: 122722 - DNA, 20 bp, Artificial Sequence
  chemically synthesized
ctttcatgatcatagaggca

SEQ ID NO: 122723 - DNA, 20 bp, Artificial Sequence
  chemically synthesized
tctttcatgatcatagaggc

SEQ ID NO: 122724 - DNA, 20 bp, Artificial Sequence
  chemically synthesized
acattctttcatgatcatag

SEQ ID NO: 122725 - DNA, 20 bp, Artificial Sequence
  chemically synthesized
tacattctttcatgatcata

SEQ ID NO: 122726 - DNA, 20 bp, Artificial Sequence
  chemically synthesized
ggtacattctttcatgatca

SEQ ID NO: 122727 - DNA, 20 bp, Artificial Sequence
  chemically synthesized
ccttgcctctatgatcatga

SEQ ID NO: 122728 - DNA, 20 bp, Artificial Sequence
  chemically synthesized
tgatcatgaaagaatgtacc

SEQ ID NO: 122729 - DNA, 20 bp, Artificial Sequence
  chemically synthesized
catgaaagaatgtaccaaga

SEQ ID NO: 122730 - DNA, 20 bp, Artificial Sequence
  chemically synthesized
tgaaagaatgtaccaagatg

SEQ ID NO: 122731 - DNA, 20 bp, Artificial Sequence
  chemically synthesized
ggctgatggtatctccatct

SEQ ID NO: 122732 - DNA, 20 bp, Artificial Sequence
  chemically synthesized
taccaagatggagataccat

SEQ ID NO: 122733 - DNA, 20 bp, Artificial Sequence
  chemically synthesized
gatggagataccatcagcca

SEQ ID NO: 122734 - DNA, 20 bp, Artificial Sequence
  chemically synthesized
cactcggggaccatggctga

SEQ ID NO: 122735 - DNA, 20 bp, Artificial Sequence
  chemically synthesized
gcttagtcactcggggacca

SEQ ID NO: 122736 - DNA, 20 bp, Artificial Sequence
  chemically synthesized
taccatcagccatggtcccc

SEQ ID NO: 122737 - DNA, 20 bp, Artificial Sequence
  chemically synthesized
ctacttagcttagtcactcg

SEQ ID NO: 122738 - DNA, 20 bp, Artificial Sequence
  chemically synthesized
tctacttagcttagtcactc

SEQ ID NO: 122739 - DNA, 20 bp, Artificial Sequence
  chemically synthesized
gccatggtccccgagtgact

SEQ ID NO: 122740 - DNA, 20 bp, Artificial Sequence
  chemically synthesized
ttctacttagcttagtcact

SEQ ID NO: 122741 - DNA, 20 bp, Artificial Sequence
  chemically synthesized
ggtccccgagtgactaagct

SEQ ID NO: 122742 - DNA, 20 bp, Artificial Sequence
  chemically synthesized
ccccgagtgactaagctaag

SEQ ID NO: 122743 - DNA, 20 bp, Artificial Sequence
  chemically synthesized
tgagagcattctacttagct

SEQ ID NO: 122744 - DNA, 20 bp, Artificial Sequence
  chemically synthesized
actgatgagagcattctact

SEQ ID NO: 122745 - DNA, 20 bp, Artificial Sequence
  chemically synthesized
gctaagtagaatgctctcat

SEQ ID NO: 122746 - DNA, 20 bp, Artificial Sequence
  chemically synthesized
tgttcgttgtagactgatga

SEQ ID NO: 122747 - DNA, 20 bp, Artificial Sequence
  chemically synthesized
catgttcgttgtagactgat

SEQ ID NO: 122748 - DNA, 20 bp, Artificial Sequence
  chemically synthesized
ctcatgttacatgttcgttg

SEQ ID NO: 122749 - DNA, 20 bp, Artificial Sequence
  chemically synthesized
ctacaacgaacatgtaacat

SEQ ID NO: 122750 - DNA, 20 bp, Artificial Sequence
  chemically synthesized
catgtaacatgagtaaaata

SEQ ID NO: 122751 - DNA, 20 bp, Artificial Sequence
  chemically synthesized
tgagtaaaatatagactatt

SEQ ID NO: 122752 - DNA, 20 bp, Artificial Sequence
  chemically synthesized
cctcaaatctagaggcttaa

SEQ ID NO: 122753 - DNA, 20 bp, Artificial Sequence
  chemically synthesized
aatatagactattaagcctc

SEQ ID NO: 122754 - DNA, 20 bp, Artificial Sequence
  chemically synthesized
ataagcaacctcaaatctag

SEQ ID NO: 122755 - DNA, 20 bp, Artificial Sequence
  chemically synthesized
actattaagcctctagattt

SEQ ID NO: 122756 - DNA, 20 bp, Artificial Sequence
  chemically synthesized
aataagcaacctcaaatcta

SEQ ID NO: 122757 - DNA, 20 bp, Artificial Sequence
  chemically synthesized
ctattaagcctctagatttg

SEQ ID NO: 122758 - DNA, 20 bp, Artificial Sequence
  chemically synthesized
gtaataagcaacctcaaatc

SEQ ID NO: 122759 - DNA, 20 bp, Artificial Sequence
  chemically synthesized
tttgaggttgcttattactg

SEQ ID NO: 122760 - DNA, 20 bp, Artificial Sequence
  chemically synthesized
ataggctaagctacagtaat

SEQ ID NO: 122761 - DNA, 20 bp, Artificial Sequence
  chemically synthesized
ggttgcttattactgtagct

SEQ ID NO: 122762 - DNA, 20 bp, Artificial Sequence
  chemically synthesized
agtcagcataggctaagcta

SEQ ID NO: 122763 - DNA, 20 bp, Artificial Sequence
  chemically synthesized
tatgtcagtcagcataggct

SEQ ID NO: 122764 - DNA, 20 bp, Artificial Sequence
  chemically synthesized
ataggtatgtcagtcagcat

SEQ ID NO: 122765 - DNA, 20 bp, Artificial Sequence
  chemically synthesized
aataggtatgtcagtcagca

SEQ ID NO: 122766 - DNA, 20 bp, Artificial Sequence
  chemically synthesized
atctgaataggtatgtcagt

SEQ ID NO: 122767 - DNA, 20 bp, Artificial Sequence
  chemically synthesized
tcatatctgaataggtatgt

SEQ ID NO: 122768 - DNA, 20 bp, Artificial Sequence
  chemically synthesized
tgctgactgacatacctatt

SEQ ID NO: 122769 - DNA, 20 bp, Artificial Sequence
  chemically synthesized
aaataaggtcatatctgaat

SEQ ID NO: 122770 - DNA, 20 bp, Artificial Sequence
  chemically synthesized
gaaataaggtcatatctgaa

SEQ ID NO: 122771 - DNA, 20 bp, Artificial Sequence
  chemically synthesized
gccctactctatgtgaaata

SEQ ID NO: 122772 - DNA, 20 bp, Artificial Sequence
  chemically synthesized
tgccctactctatgtgaaat

SEQ ID NO: 122773 - DNA, 20 bp, Artificial Sequence
  chemically synthesized
agatatgaccttatttcaca

SEQ ID NO: 122774 - DNA, 20 bp, Artificial Sequence
  chemically synthesized
atatgaccttatttcacata

SEQ ID NO: 122775 - DNA, 20 bp, Artificial Sequence
  chemically synthesized
tgaccttatttcacatagag

SEQ ID NO: 122776 - DNA, 20 bp, Artificial Sequence
  chemically synthesized
gaccttatttcacatagagt

SEQ ID NO: 122777 - DNA, 20 bp, Artificial Sequence
  chemically synthesized
accttatttcacatagagta

SEQ ID NO: 122778 - DNA, 20 bp, Artificial Sequence
  chemically synthesized
tagggcaattctaatacctc

SEQ ID NO: 122779 - DNA, 20 bp, Artificial Sequence
  chemically synthesized
ccaggactgtctggaggtat

SEQ ID NO: 122780 - DNA, 20 bp, Artificial Sequence
  chemically synthesized
gcaattctaatacctccaga

SEQ ID NO: 122781 - DNA, 20 bp, Artificial Sequence
  chemically synthesized
cctggtccaggactgtctgg

SEQ ID NO: 122782 - DNA, 20 bp, Artificial Sequence
  chemically synthesized
tcctggtccaggactgtctg

SEQ ID NO: 122783 - DNA, 20 bp, Artificial Sequence
  chemically synthesized
ggtcctggtccaggactgtc

SEQ ID NO: 122784 - DNA, 20 bp, Artificial Sequence
  chemically synthesized
ctaatacctccagacagtcc

SEQ ID NO: 122785 - DNA, 20 bp, Artificial Sequence
  chemically synthesized
acctccagacagtcctggac

SEQ ID NO: 122786 - DNA, 20 bp, Artificial Sequence
  chemically synthesized
cctccagacagtcctggacc

SEQ ID NO: 122787 - DNA, 20 bp, Artificial Sequence
  chemically synthesized
tctagccctggtcctggtcc

SEQ ID NO: 122788 - DNA, 20 bp, Artificial Sequence
  chemically synthesized
ttctagccctggtcctggtc

SEQ ID NO: 122789 - DNA, 20 bp, Artificial Sequence
  chemically synthesized
agacagtcctggaccaggac

SEQ ID NO: 122790 - DNA, 20 bp, Artificial Sequence
  chemically synthesized
gacagtcctggaccaggacc

SEQ ID NO: 122791 - DNA, 20 bp, Artificial Sequence
  chemically synthesized
acagtcctggaccaggacca

SEQ ID NO: 122792 - DNA, 20 bp, Artificial Sequence
  chemically synthesized
gtttattctagccctggtcc

SEQ ID NO: 122793 - DNA, 20 bp, Artificial Sequence
  chemically synthesized
tcctggaccaggaccagggc

SEQ ID NO: 122794 - DNA, 20 bp, Artificial Sequence
  chemically synthesized
atactagtttattctagccc

SEQ ID NO: 122795 - DNA, 20 bp, Artificial Sequence
  chemically synthesized
gtcattatactagtttattc

SEQ ID NO: 122796 - DNA, 20 bp, Artificial Sequence
  chemically synthesized
ggaccagggctagaataaac

SEQ ID NO: 122797 - DNA, 20 bp, Artificial Sequence
  chemically synthesized
ttctttatgtgtcattatac

SEQ ID NO: 122798 - DNA, 20 bp, Artificial Sequence
  chemically synthesized
aactagtataatgacacata

SEQ ID NO: 122799 - DNA, 20 bp, Artificial Sequence
  chemically synthesized
gtataatgacacataaagaa

SEQ ID NO: 122800 - DNA, 20 bp, Artificial Sequence
  chemically synthesized
tataatgacacataaagaac

SEQ ID NO: 122801 - DNA, 20 bp, Artificial Sequence
  chemically synthesized
ggcttcctatttattaataa

SEQ ID NO: 122802 - DNA, 20 bp, Artificial Sequence
  chemically synthesized
gtggcttcctatttattaat

SEQ ID NO: 122803 - DNA, 20 bp, Artificial Sequence
  chemically synthesized
caggttctcttattaataaa

SEQ ID NO: 122804 - DNA, 20 bp, Artificial Sequence
  chemically synthesized
aggttctcttattaataaat

SEQ ID NO: 122805 - DNA, 20 bp, Artificial Sequence
  chemically synthesized
ttctcttattaataaatagg

SEQ ID NO: 122806 - DNA, 20 bp, Artificial Sequence
  chemically synthesized
acatttcctcaacatttatg

SEQ ID NO: 122807 - DNA, 20 bp, Artificial Sequence
  chemically synthesized
taggaagccacataaatgtt

SEQ ID NO: 122808 - DNA, 20 bp, Artificial Sequence
  chemically synthesized
aggaagccacataaatgttg

SEQ ID NO: 122809 - DNA, 20 bp, Artificial Sequence
  chemically synthesized
ataaatgttgaggaaatgtt

SEQ ID NO: 122810 - DNA, 20 bp, Artificial Sequence
  chemically synthesized
acctgtagttcagaaaaaca

SEQ ID NO: 122811 - DNA, 20 bp, Artificial Sequence
  chemically synthesized
tacctgtagttcagaaaaac

SEQ ID NO: 122812 - DNA, 20 bp, Artificial Sequence
  chemically synthesized
ttacctgtagttcagaaaaa

SEQ ID NO: 122813 - DNA, 20 bp, Artificial Sequence
  chemically synthesized
atccctgtttttctgaacta

SEQ ID NO: 122814 - DNA, 20 bp, Artificial Sequence
  chemically synthesized
tccctgtttttctgaactac

SEQ ID NO: 122815 - DNA, 20 bp, Artificial Sequence
  chemically synthesized
ctgagatgttacctgtagtt

SEQ ID NO: 122816 - DNA, 20 bp, Artificial Sequence
  chemically synthesized
atattctgagatgttacctg

SEQ ID NO: 122817 - DNA, 20 bp, Artificial Sequence
  chemically synthesized
ctgaactacaggtaacatct

SEQ ID NO: 122818 - DNA, 20 bp, Artificial Sequence
  chemically synthesized
tgtcctatagaatatattct

SEQ ID NO: 122819 - DNA, 20 bp, Artificial Sequence
  chemically synthesized
acatctcagaatatattcta

SEQ ID NO: 122820 - DNA, 20 bp, Artificial Sequence
  chemically synthesized
catctcagaatatattctat

SEQ ID NO: 122821 - DNA, 20 bp, Artificial Sequence
  chemically synthesized
tcagaatatattctatagga

SEQ ID NO: 122822 - DNA, 20 bp, Artificial Sequence
  chemically synthesized
gataggcaggttctgtccta

SEQ ID NO: 122823 - DNA, 20 bp, Artificial Sequence
  chemically synthesized
cttttatggtcaagataggc

SEQ ID NO: 122824 - DNA, 20 bp, Artificial Sequence
  chemically synthesized
tcttttatggtcaagatagg

SEQ ID NO: 122825 - DNA, 20 bp, Artificial Sequence
  chemically synthesized
ttttcttttatggtcaagat

SEQ ID NO: 122826 - DNA, 20 bp, Artificial Sequence
  chemically synthesized
attttcttttatggtcaaga

SEQ ID NO: 122827 - DNA, 20 bp, Artificial Sequence
  chemically synthesized
agctattttcttttatggtc

SEQ ID NO: 122828 - DNA, 20 bp, Artificial Sequence
  chemically synthesized
cctgcctatcttgaccataa

SEQ ID NO: 122829 - DNA, 20 bp, Artificial Sequence
  chemically synthesized
tagggagctattttctttta

SEQ ID NO: 122830 - DNA, 20 bp, Artificial Sequence
  chemically synthesized
atcttgaccataaaagaaaa

SEQ ID NO: 122831 - DNA, 20 bp, Artificial Sequence
  chemically synthesized
tccatcacacaatggatagg

SEQ ID NO: 122832 - DNA, 20 bp, Artificial Sequence
  chemically synthesized
cctccatcacacaatggata

SEQ ID NO: 122833 - DNA, 20 bp, Artificial Sequence
  chemically synthesized
gcctccatcacacaatggat

SEQ ID NO: 122834 - DNA, 20 bp, Artificial Sequence
  chemically synthesized
agcctccatcacacaatgga

SEQ ID NO: 122835 - DNA, 20 bp, Artificial Sequence
  chemically synthesized
tgggagcctccatcacacaa

SEQ ID NO: 122836 - DNA, 20 bp, Artificial Sequence
  chemically synthesized
gctccctatccattgtgtga

SEQ ID NO: 122837 - DNA, 20 bp, Artificial Sequence
  chemically synthesized
tccctatccattgtgtgatg

SEQ ID NO: 122838 - DNA, 20 bp, Artificial Sequence
  chemically synthesized
ccctatccattgtgtgatgg

SEQ ID NO: 122839 - DNA, 20 bp, Artificial Sequence
  chemically synthesized
gtgtgatggaggctcccatc

SEQ ID NO: 122840 - DNA, 20 bp, Artificial Sequence
  chemically synthesized
tgtgatggaggctcccatct

SEQ ID NO: 122841 - DNA, 20 bp, Artificial Sequence
  chemically synthesized
cataactgctacctagatgg

SEQ ID NO: 122842 - DNA, 20 bp, Artificial Sequence
  chemically synthesized
gatggaggctcccatctagg

SEQ ID NO: 122843 - DNA, 20 bp, Artificial Sequence
  chemically synthesized
aacataactgctacctagat

SEQ ID NO: 122844 - DNA, 20 bp, Artificial Sequence
  chemically synthesized
gaacataactgctacctaga

SEQ ID NO: 122845 - DNA, 20 bp, Artificial Sequence
  chemically synthesized
ggaggctcccatctaggtag

SEQ ID NO: 122846 - DNA, 20 bp, Artificial Sequence
  chemically synthesized
tgtggaacataactgctacc

SEQ ID NO: 122847 - DNA, 20 bp, Artificial Sequence
  chemically synthesized
taggtagcagttatgttcca

SEQ ID NO: 122848 - DNA, 20 bp, Artificial Sequence
  chemically synthesized
gcagttatgttccacagaca

SEQ ID NO: 122849 - DNA, 20 bp, Artificial Sequence
  chemically synthesized
tgaaaaaatagccatgtctg

SEQ ID NO: 122850 - DNA, 20 bp, Artificial Sequence
  chemically synthesized
cagctatagaaatgaaaaaa

SEQ ID NO: 122851 - DNA, 20 bp, Artificial Sequence
  chemically synthesized
tggctattttttcatttcta

SEQ ID NO: 122852 - DNA, 20 bp, Artificial Sequence
  chemically synthesized
tattttttcatttctatagc

SEQ ID NO: 122853 - DNA, 20 bp, Artificial Sequence
  chemically synthesized
atgaagctgcttgccagcta

SEQ ID NO: 122854 - DNA, 20 bp, Artificial Sequence
  chemically synthesized
ttttcatttctatagctggc

SEQ ID NO: 122855 - DNA, 20 bp, Artificial Sequence
  chemically synthesized
tcatttctatagctggcaag

SEQ ID NO: 122856 - DNA, 20 bp, Artificial Sequence
  chemically synthesized
tctttcatgaagctgcttgc

SEQ ID NO: 122857 - DNA, 20 bp, Artificial Sequence
  chemically synthesized
gctggcaagcagcttcatga

SEQ ID NO: 122858 - DNA, 20 bp, Artificial Sequence
  chemically synthesized
tggcaagcagcttcatgaaa

SEQ ID NO: 122859 - DNA, 20 bp, Artificial Sequence
  chemically synthesized
ctccatttttctctttcatg

SEQ ID NO: 122860 - DNA, 20 bp, Artificial Sequence
  chemically synthesized
agcttcatgaaagagaaaaa

SEQ ID NO: 122861 - DNA, 20 bp, Artificial Sequence
  chemically synthesized
cttcatgaaagagaaaaatg

SEQ ID NO: 122862 - DNA, 20 bp, Artificial Sequence
  chemically synthesized
tgaacacagttttagaaaca

SEQ ID NO: 122863 - DNA, 20 bp, Artificial Sequence
  chemically synthesized
aagttttatgaacacagttt

SEQ ID NO: 122864 - DNA, 20 bp, Artificial Sequence
  chemically synthesized
tttttcaagttttatgaaca

SEQ ID NO: 122865 - DNA, 20 bp, Artificial Sequence
  chemically synthesized
agatcttttcttattttttc

SEQ ID NO: 122866 - DNA, 20 bp, Artificial Sequence
  chemically synthesized
ttcataaaacttgaaaaaat

SEQ ID NO: 122867 - DNA, 20 bp, Artificial Sequence
  chemically synthesized
aaaacttgaaaaaataagaa

SEQ ID NO: 122868 - DNA, 20 bp, Artificial Sequence
  chemically synthesized
aaaaaataagaaaagatctg

SEQ ID NO: 122869 - DNA, 20 bp, Artificial Sequence
  chemically synthesized
tatctgcatgtcattgacta

SEQ ID NO: 122870 - DNA, 20 bp, Artificial Sequence
  chemically synthesized
gatctgtagtcaatgacatg

SEQ ID NO: 122871 - DNA, 20 bp, Artificial Sequence
  chemically synthesized
gaattttatggtatgttaaa

SEQ ID NO: 122872 - DNA, 20 bp, Artificial Sequence
  chemically synthesized
ctttaagtgggagaatttta

SEQ ID NO: 122873 - DNA, 20 bp, Artificial Sequence
  chemically synthesized
ccataaaattctcccactta

SEQ ID NO: 122874 - DNA, 20 bp, Artificial Sequence
  chemically synthesized
aaattatgcactttaagtgg

SEQ ID NO: 122875 - DNA, 20 bp, Artificial Sequence
  chemically synthesized
gaaaattatgcactttaagt

SEQ ID NO: 122876 - DNA, 20 bp, Artificial Sequence
  chemically synthesized
agaaaattatgcactttaag

SEQ ID NO: 122877 - DNA, 20 bp, Artificial Sequence
  chemically synthesized
accagaaaattatgcacttt

SEQ ID NO: 122878 - DNA, 20 bp, Artificial Sequence
  chemically synthesized
acttaaagtgcataattttc

SEQ ID NO: 122879 - DNA, 20 bp, Artificial Sequence
  chemically synthesized
accctgaatacattaagaac

SEQ ID NO: 122880 - DNA, 20 bp, Artificial Sequence
  chemically synthesized
tgcacaaccctgaatacatt

SEQ ID NO: 122881 - DNA, 20 bp, Artificial Sequence
  chemically synthesized
tttctggttcttaatgtatt

SEQ ID NO: 122882 - DNA, 20 bp, Artificial Sequence
  chemically synthesized
ttctggttcttaatgtattc

SEQ ID NO: 122883 - DNA, 20 bp, Artificial Sequence
  chemically synthesized
tctggttcttaatgtattca

SEQ ID NO: 122884 - DNA, 20 bp, Artificial Sequence
  chemically synthesized
ctcaaattagatcataataa

SEQ ID NO: 122885 - DNA, 20 bp, Artificial Sequence
  chemically synthesized
ccattattatgatctaattt

SEQ ID NO: 122886 - DNA, 20 bp, Artificial Sequence
  chemically synthesized
caaataaaatgttctcaaat

SEQ ID NO: 122887 - DNA, 20 bp, Artificial Sequence
  chemically synthesized
attggtatgggtttcattgg

SEQ ID NO: 122888 - DNA, 20 bp, Artificial Sequence
  chemically synthesized
aattggtatgggtttcattg

SEQ ID NO: 122889 - DNA, 20 bp, Artificial Sequence
  chemically synthesized
taattggtatgggtttcatt

SEQ ID NO: 122890 - DNA, 20 bp, Artificial Sequence
  chemically synthesized
ttaattggtatgggtttcat

SEQ ID NO: 122891 - DNA, 20 bp, Artificial Sequence
  chemically synthesized
aagggactgttaattggtat

SEQ ID NO: 122892 - DNA, 20 bp, Artificial Sequence
  chemically synthesized
aaagggactgttaattggta

SEQ ID NO: 122893 - DNA, 20 bp, Artificial Sequence
  chemically synthesized
atgaaacccataccaattaa

SEQ ID NO: 122894 - DNA, 20 bp, Artificial Sequence
  chemically synthesized
aatagaaagggactgttaat

SEQ ID NO: 122895 - DNA, 20 bp, Artificial Sequence
  chemically synthesized
aggagaatagacaatagaaa

SEQ ID NO: 122896 - DNA, 20 bp, Artificial Sequence
  chemically synthesized
gaggagaatagacaatagaa

SEQ ID NO: 122897 - DNA, 20 bp, Artificial Sequence
  chemically synthesized
ggaggagaatagacaataga

SEQ ID NO: 122898 - DNA, 20 bp, Artificial Sequence
  chemically synthesized
aggaggaggagaatagacaa

SEQ ID NO: 122899 - DNA, 20 bp, Artificial Sequence
  chemically synthesized
agactgaaggaggaggagaa

SEQ ID NO: 122900 - DNA, 20 bp, Artificial Sequence
  chemically synthesized
agtaaagactgaaggaggag

SEQ ID NO: 122901 - DNA, 20 bp, Artificial Sequence
  chemically synthesized
tgtctattctcctcctcctt

SEQ ID NO: 122902 - DNA, 20 bp, Artificial Sequence
  chemically synthesized
ccagtaaagactgaaggagg

SEQ ID NO: 122903 - DNA, 20 bp, Artificial Sequence
  chemically synthesized
tccagtaaagactgaaggag

SEQ ID NO: 122904 - DNA, 20 bp, Artificial Sequence
  chemically synthesized
catccagtaaagactgaagg

SEQ ID NO: 122905 - DNA, 20 bp, Artificial Sequence
  chemically synthesized
acatccagtaaagactgaag

SEQ ID NO: 122906 - DNA, 20 bp, Artificial Sequence
  chemically synthesized
aaacatccagtaaagactga

SEQ ID NO: 122907 - DNA, 20 bp, Artificial Sequence
  chemically synthesized
aaaacatccagtaaagactg

SEQ ID NO: 122908 - DNA, 20 bp, Artificial Sequence
  chemically synthesized
cctcctccttcagtctttac

SEQ ID NO: 122909 - DNA, 20 bp, Artificial Sequence
  chemically synthesized
ttcatataaaacatccagta

SEQ ID NO: 122910 - DNA, 20 bp, Artificial Sequence
  chemically synthesized
atacattcatataaaacatc

SEQ ID NO: 122911 - DNA, 20 bp, Artificial Sequence
  chemically synthesized
atgaatgtattgatacaatt

SEQ ID NO: 122912 - DNA, 20 bp, Artificial Sequence
  chemically synthesized
tgaatgtattgatacaattt

SEQ ID NO: 122913 - DNA, 20 bp, Artificial Sequence
  chemically synthesized
gaatgtattgatacaatttg

SEQ ID NO: 122914 - DNA, 20 bp, Artificial Sequence
  chemically synthesized
aatttggggtcttttgtgac

SEQ ID NO: 122915 - DNA, 20 bp, Artificial Sequence
  chemically synthesized
gtgatggaatccagtcacaa

SEQ ID NO: 122916 - DNA, 20 bp, Artificial Sequence
  chemically synthesized
atatgctaagtgatggaatc

SEQ ID NO: 122917 - DNA, 20 bp, Artificial Sequence
  chemically synthesized
tgtgactggattccatcact

SEQ ID NO: 122918 - DNA, 20 bp, Artificial Sequence
  chemically synthesized
ctcaaaaatatgctaagtga

SEQ ID NO: 122919 - DNA, 20 bp, Artificial Sequence
  chemically synthesized
gtgaacctcaaaaatatgct

SEQ ID NO: 122920 - DNA, 20 bp, Artificial Sequence
  chemically synthesized
ccatcacttagcatattttt

SEQ ID NO: 122921 - DNA, 20 bp, Artificial Sequence
  chemically synthesized
catcacttagcatatttttg

SEQ ID NO: 122922 - DNA, 20 bp, Artificial Sequence
  chemically synthesized
tttgaggttcactcatgtta

SEQ ID NO: 122923 - DNA, 20 bp, Artificial Sequence
  chemically synthesized
actgatatgcactgtaacat

SEQ ID NO: 122924 - DNA, 20 bp, Artificial Sequence
  chemically synthesized
actcatgttacagtgcatat

SEQ ID NO: 122925 - DNA, 20 bp, Artificial Sequence
  chemically synthesized
gaatattatttagcaataaa

SEQ ID NO: 122926 - DNA, 20 bp, Artificial Sequence
  chemically synthesized
tccaaaaatggaatattatt

SEQ ID NO: 122927 - DNA, 20 bp, Artificial Sequence
  chemically synthesized
gctaaataatattccatttt

SEQ ID NO: 122928 - DNA, 20 bp, Artificial Sequence
  chemically synthesized
atgtcctctacatccaaaaa

SEQ ID NO: 122929 - DNA, 20 bp, Artificial Sequence
  chemically synthesized
taatattccatttttggatg

SEQ ID NO: 122930 - DNA, 20 bp, Artificial Sequence
  chemically synthesized
atattccatttttggatgta

SEQ ID NO: 122931 - DNA, 20 bp, Artificial Sequence
  chemically synthesized
tattccatttttggatgtag

SEQ ID NO: 122932 - DNA, 20 bp, Artificial Sequence
  chemically synthesized
acattttaaaatttattcat

SEQ ID NO: 122933 - DNA, 20 bp, Artificial Sequence
  chemically synthesized
aaaatttattcattagctga

SEQ ID NO: 122934 - DNA, 20 bp, Artificial Sequence
  chemically synthesized
gaaccaacccaaatgtccat

SEQ ID NO: 122935 - DNA, 20 bp, Artificial Sequence
  chemically synthesized
ttcattagctgatggacatt

SEQ ID NO: 122936 - DNA, 20 bp, Artificial Sequence
  chemically synthesized
tcattagctgatggacattt

SEQ ID NO: 122937 - DNA, 20 bp, Artificial Sequence
  chemically synthesized
tagctgatggacatttgggt

SEQ ID NO: 122938 - DNA, 20 bp, Artificial Sequence
  chemically synthesized
tttgggttggttctactttt

SEQ ID NO: 122939 - DNA, 20 bp, Artificial Sequence
  chemically synthesized
tatttataatagccaaaaag

SEQ ID NO: 122940 - DNA, 20 bp, Artificial Sequence
  chemically synthesized
cattatttataatagccaaa

SEQ ID NO: 122941 - DNA, 20 bp, Artificial Sequence
  chemically synthesized
catagcagcattatttataa

SEQ ID NO: 122942 - DNA, 20 bp, Artificial Sequence
  chemically synthesized
ctttatacagatgttcatag

SEQ ID NO: 122943 - DNA, 20 bp, Artificial Sequence
  chemically synthesized
aacctttatacagatgttca

SEQ ID NO: 122944 - DNA, 20 bp, Artificial Sequence
  chemically synthesized
ctgctatgaacatctgtata

SEQ ID NO: 122945 - DNA, 20 bp, Artificial Sequence
  chemically synthesized
tgctatgaacatctgtataa

SEQ ID NO: 122946 - DNA, 20 bp, Artificial Sequence
  chemically synthesized
gtacacagaaaacctttata

SEQ ID NO: 122947 - DNA, 20 bp, Artificial Sequence
  chemically synthesized
aataaaaatacatatgtaca

SEQ ID NO: 122948 - DNA, 20 bp, Artificial Sequence
  chemically synthesized
tatgtatttttatttctgtt

SEQ ID NO: 122949 - DNA, 20 bp, Artificial Sequence
  chemically synthesized
actcccaggtgtatgctgaa

SEQ ID NO: 122950 - DNA, 20 bp, Artificial Sequence
  chemically synthesized
atttctgttcagcatacacc

SEQ ID NO: 122951 - DNA, 20 bp, Artificial Sequence
  chemically synthesized
tttctgttcagcatacacct

SEQ ID NO: 122952 - DNA, 20 bp, Artificial Sequence
  chemically synthesized
tctgttcagcatacacctgg

SEQ ID NO: 122953 - DNA, 20 bp, Artificial Sequence
  chemically synthesized
gttcagcatacacctgggag

SEQ ID NO: 122954 - DNA, 20 bp, Artificial Sequence
  chemically synthesized
gacaaaaccattctactccc

SEQ ID NO: 122955 - DNA, 20 bp, Artificial Sequence
  chemically synthesized
tgacaaaaccattctactcc

SEQ ID NO: 122956 - DNA, 20 bp, Artificial Sequence
  chemically synthesized
gcatacacctgggagtagaa

SEQ ID NO: 122957 - DNA, 20 bp, Artificial Sequence
  chemically synthesized
agtagaatggttttgtcata

SEQ ID NO: 122958 - DNA, 20 bp, Artificial Sequence
  chemically synthesized
agaatggttttgtcatatgg

SEQ ID NO: 122959 - DNA, 20 bp, Artificial Sequence
  chemically synthesized
tcctggaaatattaaacatg

SEQ ID NO: 122960 - DNA, 20 bp, Artificial Sequence
  chemically synthesized
agcttcatgtttaatatttc

SEQ ID NO: 122961 - DNA, 20 bp, Artificial Sequence
  chemically synthesized
gcttcatgtttaatatttcc

SEQ ID NO: 122962 - DNA, 20 bp, Artificial Sequence
  chemically synthesized
ttcatgtttaatatttccag

SEQ ID NO: 122963 - DNA, 20 bp, Artificial Sequence
  chemically synthesized
gtttaatatttccaggagac

SEQ ID NO: 122964 - DNA, 20 bp, Artificial Sequence
  chemically synthesized
tttaatatttccaggagact

SEQ ID NO: 122965 - DNA, 20 bp, Artificial Sequence
  chemically synthesized
cactacccttcccagtctcc

SEQ ID NO: 122966 - DNA, 20 bp, Artificial Sequence
  chemically synthesized
aatatttccaggagactggg

SEQ ID NO: 122967 - DNA, 20 bp, Artificial Sequence
  chemically synthesized
atatttccaggagactggga

SEQ ID NO: 122968 - DNA, 20 bp, Artificial Sequence
  chemically synthesized
tatttccaggagactgggaa

SEQ ID NO: 122969 - DNA, 20 bp, Artificial Sequence
  chemically synthesized
ttccaggagactgggaaggg

SEQ ID NO: 122970 - DNA, 20 bp, Artificial Sequence
  chemically synthesized
ccccctaccactacccttcc

SEQ ID NO: 122971 - DNA, 20 bp, Artificial Sequence
  chemically synthesized
caggagactgggaagggtag

SEQ ID NO: 122972 - DNA, 20 bp, Artificial Sequence
  chemically synthesized
gagactgggaagggtagtgg

SEQ ID NO: 122973 - DNA, 20 bp, Artificial Sequence
  chemically synthesized
agactgggaagggtagtggt

SEQ ID NO: 122974 - DNA, 20 bp, Artificial Sequence
  chemically synthesized
gactgggaagggtagtggta

SEQ ID NO: 122975 - DNA, 20 bp, Artificial Sequence
  chemically synthesized
actgggaagggtagtggtag

SEQ ID NO: 122976 - DNA, 20 bp, Artificial Sequence
  chemically synthesized
ctgggaagggtagtggtagg

SEQ ID NO: 122977 - DNA, 20 bp, Artificial Sequence
  chemically synthesized
gaagggtagtggtaggggga

SEQ ID NO: 122978 - DNA, 20 bp, Artificial Sequence
  chemically synthesized
aagggtagtggtagggggaa

SEQ ID NO: 122979 - DNA, 20 bp, Artificial Sequence
  chemically synthesized
agggtagtggtagggggaaa

SEQ ID NO: 122980 - DNA, 20 bp, Artificial Sequence
  chemically synthesized
gggtagtggtagggggaaag

SEQ ID NO: 122981 - DNA, 20 bp, Artificial Sequence
  chemically synthesized
ggtagtggtagggggaaagg

SEQ ID NO: 122982 - DNA, 20 bp, Artificial Sequence
  chemically synthesized
gtagtggtagggggaaaggg

SEQ ID NO: 122983 - DNA, 20 bp, Artificial Sequence
  chemically synthesized
tagtggtagggggaaagggg

SEQ ID NO: 122984 - DNA, 20 bp, Artificial Sequence
  chemically synthesized
ggtagggggaaaggggggga

SEQ ID NO: 122985 - DNA, 20 bp, Artificial Sequence
  chemically synthesized
ggaaagggggggatggctaa

SEQ ID NO: 122986 - DNA, 20 bp, Artificial Sequence
  chemically synthesized
gaaagggggggatggctaat

SEQ ID NO: 122987 - DNA, 20 bp, Artificial Sequence
  chemically synthesized
agggggggatggctaatggg

SEQ ID NO: 122988 - DNA, 20 bp, Artificial Sequence
  chemically synthesized
ttataaatttcactacccat

SEQ ID NO: 122989 - DNA, 20 bp, Artificial Sequence
  chemically synthesized
aaatttataatacaaaaata

SEQ ID NO: 122990 - DNA, 20 bp, Artificial Sequence
  chemically synthesized
aatacaaaaatatagtttga

SEQ ID NO: 122991 - DNA, 20 bp, Artificial Sequence
  chemically synthesized
tatagtttgatagaatgaat

SEQ ID NO: 122992 - DNA, 20 bp, Artificial Sequence
  chemically synthesized
ttgatagaatgaataagatc

SEQ ID NO: 122993 - DNA, 20 bp, Artificial Sequence
  chemically synthesized
cctcttgtgctatcaaatac

SEQ ID NO: 122994 - DNA, 20 bp, Artificial Sequence
  chemically synthesized
gaataagatctagtatttga

SEQ ID NO: 122995 - DNA, 20 bp, Artificial Sequence
  chemically synthesized
gatctagtatttgatagcac

SEQ ID NO: 122996 - DNA, 20 bp, Artificial Sequence
  chemically synthesized
tctagtatttgatagcacaa

SEQ ID NO: 122997 - DNA, 20 bp, Artificial Sequence
  chemically synthesized
ctagtatttgatagcacaag

SEQ ID NO: 122998 - DNA, 20 bp, Artificial Sequence
  chemically synthesized
atagcacaagaggatgacta

SEQ ID NO: 122999 - DNA, 20 bp, Artificial Sequence
  chemically synthesized
cacaataaattttttgactg

SEQ ID NO: 123000 - DNA, 20 bp, Artificial Sequence
  chemically synthesized
aacgacaatctaataataat

SEQ ID NO: 123001 - DNA, 20 bp, Artificial Sequence
  chemically synthesized
taaaaataactgattattat

SEQ ID NO: 123002 - DNA, 20 bp, Artificial Sequence
  chemically synthesized
tattagattgtcgtttgtaa

SEQ ID NO: 123003 - DNA, 20 bp, Artificial Sequence
  chemically synthesized
gattgtcgtttgtaacagaa

SEQ ID NO: 123004 - DNA, 20 bp, Artificial Sequence
  chemically synthesized
aacagaaaagataattgctt

SEQ ID NO: 123005 - DNA, 20 bp, Artificial Sequence
  chemically synthesized
acagaaaagataattgcttg

SEQ ID NO: 123006 - DNA, 20 bp, Artificial Sequence
  chemically synthesized
aaaagataattgcttgaggt

SEQ ID NO: 123007 - DNA, 20 bp, Artificial Sequence
  chemically synthesized
aaagataattgcttgaggtg

SEQ ID NO: 123008 - DNA, 20 bp, Artificial Sequence
  chemically synthesized
aagataattgcttgaggtga

SEQ ID NO: 123009 - DNA, 20 bp, Artificial Sequence
  chemically synthesized
cctggcctatccctcacctc

SEQ ID NO: 123010 - DNA, 20 bp, Artificial Sequence
  chemically synthesized
taattgcttgaggtgaggga

SEQ ID NO: 123011 - DNA, 20 bp, Artificial Sequence
  chemically synthesized
aattgcttgaggtgagggat

SEQ ID NO: 123012 - DNA, 20 bp, Artificial Sequence
  chemically synthesized
gcttgaggtgagggataggc

SEQ ID NO: 123013 - DNA, 20 bp, Artificial Sequence
  chemically synthesized
cttgaggtgagggataggcc

SEQ ID NO: 123014 - DNA, 20 bp, Artificial Sequence
  chemically synthesized
aacagtcacattggggtacc

SEQ ID NO: 123015 - DNA, 20 bp, Artificial Sequence
  chemically synthesized
aatgtgtaacagtcacattg

SEQ ID NO: 123016 - DNA, 20 bp, Artificial Sequence
  chemically synthesized
caatgtgtaacagtcacatt

SEQ ID NO: 123017 - DNA, 20 bp, Artificial Sequence
  chemically synthesized
acaatgtgtaacagtcacat

SEQ ID NO: 123018 - DNA, 20 bp, Artificial Sequence
  chemically synthesized
tataggcatacaatgtgtaa

SEQ ID NO: 123019 - DNA, 20 bp, Artificial Sequence
  chemically synthesized
tacaggaaatattttgatat

SEQ ID NO: 123020 - DNA, 20 bp, Artificial Sequence
  chemically synthesized
atacaggaaatattttgata

SEQ ID NO: 123021 - DNA, 20 bp, Artificial Sequence
  chemically synthesized
tatatatatttatgggatac

SEQ ID NO: 123022 - DNA, 20 bp, Artificial Sequence
  chemically synthesized
gtatatatatttatgggata

SEQ ID NO: 123023 - DNA, 20 bp, Artificial Sequence
  chemically synthesized
cagtaggtatatatatttat

SEQ ID NO: 123024 - DNA, 20 bp, Artificial Sequence
  chemically synthesized
acagtaggtatatatattta

SEQ ID NO: 123025 - DNA, 20 bp, Artificial Sequence
  chemically synthesized
aatttttgtgggtacacagt

SEQ ID NO: 123026 - DNA, 20 bp, Artificial Sequence
  chemically synthesized
taatttttgtgggtacacag

SEQ ID NO: 123027 - DNA, 20 bp, Artificial Sequence
  chemically synthesized
ttttaatttttgtgggtaca

SEQ ID NO: 123028 - DNA, 20 bp, Artificial Sequence
  chemically synthesized
ttttaatttttaatttttgt

SEQ ID NO: 123029 - DNA, 20 bp, Artificial Sequence
  chemically synthesized
tttttaatttttaatttttg

SEQ ID NO: 123030 - DNA, 20 bp, Artificial Sequence
  chemically synthesized
aaaaattaaaaaaatatttc

SEQ ID NO: 123031 - DNA, 20 bp, Artificial Sequence
  chemically synthesized
aaaattaaaaaaatatttcc

SEQ ID NO: 123032 - DNA, 20 bp, Artificial Sequence
  chemically synthesized
gaaaacagtttggaagttcc

SEQ ID NO: 123033 - DNA, 20 bp, Artificial Sequence
  chemically synthesized
caactttgaaaacagtttgg

SEQ ID NO: 123034 - DNA, 20 bp, Artificial Sequence
  chemically synthesized
aaacaactttgaaaacagtt

SEQ ID NO: 123035 - DNA, 20 bp, Artificial Sequence
  chemically synthesized
gaacttccaaactgttttca

SEQ ID NO: 123036 - DNA, 20 bp, Artificial Sequence
  chemically synthesized
tggtgaaacaactttgaaaa

SEQ ID NO: 123037 - DNA, 20 bp, Artificial Sequence
  chemically synthesized
ttactggtggaaatgtaaaa

SEQ ID NO: 123038 - DNA, 20 bp, Artificial Sequence
  chemically synthesized
tcaccattttacatttccac

SEQ ID NO: 123039 - DNA, 20 bp, Artificial Sequence
  chemically synthesized
tggaattttcacattactgg

SEQ ID NO: 123040 - DNA, 20 bp, Artificial Sequence
  chemically synthesized
gcttggaattttcacattac

SEQ ID NO: 123041 - DNA, 20 bp, Artificial Sequence
  chemically synthesized
accagtaatgtgaaaattcc

SEQ ID NO: 123042 - DNA, 20 bp, Artificial Sequence
  chemically synthesized
ttgagaagatgaagaatgct

SEQ ID NO: 123043 - DNA, 20 bp, Artificial Sequence
  chemically synthesized
taacaagtgttgagaagatg

SEQ ID NO: 123044 - DNA, 20 bp, Artificial Sequence
  chemically synthesized
agacaataacaagtgttgag

SEQ ID NO: 123045 - DNA, 20 bp, Artificial Sequence
  chemically synthesized
tacagacaataacaagtgtt

SEQ ID NO: 123046 - DNA, 20 bp, Artificial Sequence
  chemically synthesized
caaaaaatacagacaataac

SEQ ID NO: 123047 - DNA, 20 bp, Artificial Sequence
  chemically synthesized
gatggctaatacaaaaaata

SEQ ID NO: 123048 - DNA, 20 bp, Artificial Sequence
  chemically synthesized
attgtctgtattttttgtat

SEQ ID NO: 123049 - DNA, 20 bp, Artificial Sequence
  chemically synthesized
attttttgtattagccatcc

SEQ ID NO: 123050 - DNA, 20 bp, Artificial Sequence
  chemically synthesized
ttttgtattagccatcctag

SEQ ID NO: 123051 - DNA, 20 bp, Artificial Sequence
  chemically synthesized
tttgtattagccatcctagt

SEQ ID NO: 123052 - DNA, 20 bp, Artificial Sequence
  chemically synthesized
gtactttttacccactagga

SEQ ID NO: 123053 - DNA, 20 bp, Artificial Sequence
  chemically synthesized
gatagtactttttacccact

SEQ ID NO: 123054 - DNA, 20 bp, Artificial Sequence
  chemically synthesized
agatagtactttttacccac

SEQ ID NO: 123055 - DNA, 20 bp, Artificial Sequence
  chemically synthesized
tagccatcctagtgggtaaa

SEQ ID NO: 123056 - DNA, 20 bp, Artificial Sequence
  chemically synthesized
aaatgaaaaccacaaggaga

SEQ ID NO: 123057 - DNA, 20 bp, Artificial Sequence
  chemically synthesized
taaaaagtactatctccttg

SEQ ID NO: 123058 - DNA, 20 bp, Artificial Sequence
  chemically synthesized
atgcaaatgaaaaccacaag

SEQ ID NO: 123059 - DNA, 20 bp, Artificial Sequence
  chemically synthesized
aaatgcaaatgaaaaccaca

SEQ ID NO: 123060 - DNA, 20 bp, Artificial Sequence
  chemically synthesized
aaaatgcaaatgaaaaccac

SEQ ID NO: 123061 - DNA, 20 bp, Artificial Sequence
  chemically synthesized
tccataagcacatgaaaaga

SEQ ID NO: 123062 - DNA, 20 bp, Artificial Sequence
  chemically synthesized
gatctccataagcacatgaa

SEQ ID NO: 123063 - DNA, 20 bp, Artificial Sequence
  chemically synthesized
accatcttttcatgtgctta

SEQ ID NO: 123064 - DNA, 20 bp, Artificial Sequence
  chemically synthesized
catcttttcatgtgcttatg

SEQ ID NO: 123065 - DNA, 20 bp, Artificial Sequence
  chemically synthesized
gtagatgtatagatctccat

SEQ ID NO: 123066 - DNA, 20 bp, Artificial Sequence
  chemically synthesized
atttctccaaagtagatgta

SEQ ID NO: 123067 - DNA, 20 bp, Artificial Sequence
  chemically synthesized
ggagatctatacatctactt

SEQ ID NO: 123068 - DNA, 20 bp, Artificial Sequence
  chemically synthesized
agatctatacatctactttg

SEQ ID NO: 123069 - DNA, 20 bp, Artificial Sequence
  chemically synthesized
gaataggcatttctccaaag

SEQ ID NO: 123070 - DNA, 20 bp, Artificial Sequence
  chemically synthesized
tttgaataggcatttctcca

SEQ ID NO: 123071 - DNA, 20 bp, Artificial Sequence
  chemically synthesized
agtgaagaaacagtttgaat

SEQ ID NO: 123072 - DNA, 20 bp, Artificial Sequence
  chemically synthesized
aagtgaagaaacagtttgaa

SEQ ID NO: 123073 - DNA, 20 bp, Artificial Sequence
  chemically synthesized
cttaattacaagtgaagaaa

SEQ ID NO: 123074 - DNA, 20 bp, Artificial Sequence
  chemically synthesized
aaatgacttaattacaagtg

SEQ ID NO: 123075 - DNA, 20 bp, Artificial Sequence
  chemically synthesized
ctgtttcttcacttgtaatt

SEQ ID NO: 123076 - DNA, 20 bp, Artificial Sequence
  chemically synthesized
aggataaatgacttaattac

SEQ ID NO: 123077 - DNA, 20 bp, Artificial Sequence
  chemically synthesized
ctcataattcaacaacaaaa

SEQ ID NO: 123078 - DNA, 20 bp, Artificial Sequence
  chemically synthesized
actcataattcaacaacaaa

SEQ ID NO: 123079 - DNA, 20 bp, Artificial Sequence
  chemically synthesized
cctttttgttgttgaattat

SEQ ID NO: 123080 - DNA, 20 bp, Artificial Sequence
  chemically synthesized
tttttatatattcttgatac

SEQ ID NO: 123081 - DNA, 20 bp, Artificial Sequence
  chemically synthesized
tttgataagatacttgtatc

SEQ ID NO: 123082 - DNA, 20 bp, Artificial Sequence
  chemically synthesized
ttgtaaatcatatatttgat

SEQ ID NO: 123083 - DNA, 20 bp, Artificial Sequence
  chemically synthesized
caaatatttttacccattct

SEQ ID NO: 123084 - DNA, 20 bp, Artificial Sequence
  chemically synthesized
aaatatttttacccattctg

SEQ ID NO: 123085 - DNA, 20 bp, Artificial Sequence
  chemically synthesized
gaaaagacaatcctcagaat

SEQ ID NO: 123086 - DNA, 20 bp, Artificial Sequence
  chemically synthesized
ggaaaagacaatcctcagaa

SEQ ID NO: 123087 - DNA, 20 bp, Artificial Sequence
  chemically synthesized
gaaagggaaaagacaatcct

SEQ ID NO: 123088 - DNA, 20 bp, Artificial Sequence
  chemically synthesized
aatattgtaaagaaagggaa

SEQ ID NO: 123089 - DNA, 20 bp, Artificial Sequence
  chemically synthesized
caagcaatattgtaaagaaa

SEQ ID NO: 123090 - DNA, 20 bp, Artificial Sequence
  chemically synthesized
gcaagcaatattgtaaagaa

SEQ ID NO: 123091 - DNA, 20 bp, Artificial Sequence
  chemically synthesized
tgcaagcaatattgtaaaga

SEQ ID NO: 123092 - DNA, 20 bp, Artificial Sequence
  chemically synthesized
gtactgcaagcaatattgta

SEQ ID NO: 123093 - DNA, 20 bp, Artificial Sequence
  chemically synthesized
tttctttacaatattgcttg

SEQ ID NO: 123094 - DNA, 20 bp, Artificial Sequence
  chemically synthesized
aattaaaacttttgtactgc

SEQ ID NO: 123095 - DNA, 20 bp, Artificial Sequence
  chemically synthesized
caatattgcttgcagtacaa

SEQ ID NO: 123096 - DNA, 20 bp, Artificial Sequence
  chemically synthesized
caaaagttttaattttgtta

SEQ ID NO: 123097 - DNA, 20 bp, Artificial Sequence
  chemically synthesized
taaccgaaaaatacacaatt

SEQ ID NO: 123098 - DNA, 20 bp, Artificial Sequence
  chemically synthesized
agtccaaattgtgtattttt

SEQ ID NO: 123099 - DNA, 20 bp, Artificial Sequence
  chemically synthesized
ttttcggttacttttgcttt

SEQ ID NO: 123100 - DNA, 20 bp, Artificial Sequence
  chemically synthesized
agatatgacaccaaaagcaa

SEQ ID NO: 123101 - DNA, 20 bp, Artificial Sequence
  chemically synthesized
tttcttagatatgacaccaa

SEQ ID NO: 123102 - DNA, 20 bp, Artificial Sequence
  chemically synthesized
ttgcttttggtgtcatatct

SEQ ID NO: 123103 - DNA, 20 bp, Artificial Sequence
  chemically synthesized
tggattatgcagtgttttct

SEQ ID NO: 123104 - DNA, 20 bp, Artificial Sequence
  chemically synthesized
taggaatacaatggattatg

SEQ ID NO: 123105 - DNA, 20 bp, Artificial Sequence
  chemically synthesized
aagaaaatgtaggaatacaa

SEQ ID NO: 123106 - DNA, 20 bp, Artificial Sequence
  chemically synthesized
aaactcttctaagaaaatgt

SEQ ID NO: 123107 - DNA, 20 bp, Artificial Sequence
  chemically synthesized
aaaactcttctaagaaaatg

SEQ ID NO: 123108 - DNA, 20 bp, Artificial Sequence
  chemically synthesized
attgtattcctacattttct

SEQ ID NO: 123109 - DNA, 20 bp, Artificial Sequence
  chemically synthesized
gtattcctacattttcttag

SEQ ID NO: 123110 - DNA, 20 bp, Artificial Sequence
  chemically synthesized
attcctacattttcttagaa

SEQ ID NO: 123111 - DNA, 20 bp, Artificial Sequence
  chemically synthesized
taaaactttaaaactcttct

SEQ ID NO: 123112 - DNA, 20 bp, Artificial Sequence
  chemically synthesized
attttcttagaagagtttta

SEQ ID NO: 123113 - DNA, 20 bp, Artificial Sequence
  chemically synthesized
ttagaagagttttaaagttt

SEQ ID NO: 123114 - DNA, 20 bp, Artificial Sequence
  chemically synthesized
atagagctaaatatattaat

SEQ ID NO: 123115 - DNA, 20 bp, Artificial Sequence
  chemically synthesized
ttagttcttattaatatatt

SEQ ID NO: 123116 - DNA, 20 bp, Artificial Sequence
  chemically synthesized
tatatttttaatgaatcata

SEQ ID NO: 123117 - DNA, 20 bp, Artificial Sequence
  chemically synthesized
aatatatttttaatgaatca

SEQ ID NO: 123118 - DNA, 20 bp, Artificial Sequence
  chemically synthesized
aaaaatatattattattata

SEQ ID NO: 123119 - DNA, 20 bp, Artificial Sequence
  chemically synthesized
ttataaagtttattttacaa

SEQ ID NO: 123120 - DNA, 20 bp, Artificial Sequence
  chemically synthesized
atgtatataattatttgtca

SEQ ID NO: 123121 - DNA, 20 bp, Artificial Sequence
  chemically synthesized
caaataattatatacattta

SEQ ID NO: 123122 - DNA, 20 bp, Artificial Sequence
  chemically synthesized
aaataattatatacatttat

SEQ ID NO: 123123 - DNA, 20 bp, Artificial Sequence
  chemically synthesized
aataattatatacatttatg

SEQ ID NO: 123124 - DNA, 20 bp, Artificial Sequence
  chemically synthesized
tccacagtgtatacatatat

SEQ ID NO: 123125 - DNA, 20 bp, Artificial Sequence
  chemically synthesized
tctgatatatgtatacactg

SEQ ID NO: 123126 - DNA, 20 bp, Artificial Sequence
  chemically synthesized
tgctcgatataatcattcca

SEQ ID NO: 123127 - DNA, 20 bp, Artificial Sequence
  chemically synthesized
cactgtggaatgattatatc

SEQ ID NO: 123128 - DNA, 20 bp, Artificial Sequence
  chemically synthesized
atgataaatatatgcagtga

SEQ ID NO: 123129 - DNA, 20 bp, Artificial Sequence
  chemically synthesized
taaaatatgataaatatatg

SEQ ID NO: 123130 - DNA, 20 bp, Artificial Sequence
  chemically synthesized
catatatttatcatatttta

SEQ ID NO: 123131 - DNA, 20 bp, Artificial Sequence
  chemically synthesized
tatttatcatattttatagc

SEQ ID NO: 123132 - DNA, 20 bp, Artificial Sequence
  chemically synthesized
acatttaaaatctgttattt

SEQ ID NO: 123133 - DNA, 20 bp, Artificial Sequence
  chemically synthesized
tttcaaaattgctaaaataa

SEQ ID NO: 123134 - DNA, 20 bp, Artificial Sequence
  chemically synthesized
caatataatattattaacta

SEQ ID NO: 123135 - DNA, 20 bp, Artificial Sequence
  chemically synthesized
atattattaactatggtcac

SEQ ID NO: 123136 - DNA, 20 bp, Artificial Sequence
  chemically synthesized
atgacacaacctggtgacca

SEQ ID NO: 123137 - DNA, 20 bp, Artificial Sequence
  chemically synthesized
tattattaactatggtcacc

SEQ ID NO: 123138 - DNA, 20 bp, Artificial Sequence
  chemically synthesized
tgagactttatgacacaacc

SEQ ID NO: 123139 - DNA, 20 bp, Artificial Sequence
  chemically synthesized
ggtcaccaggttgtgtcata

SEQ ID NO: 123140 - DNA, 20 bp, Artificial Sequence
  chemically synthesized
gtcaggaggaataagttttt

SEQ ID NO: 123141 - DNA, 20 bp, Artificial Sequence
  chemically synthesized
aaactttagtcaggaggaat

SEQ ID NO: 123142 - DNA, 20 bp, Artificial Sequence
  chemically synthesized
ggttaaaaactttagtcagg

SEQ ID NO: 123143 - DNA, 20 bp, Artificial Sequence
  chemically synthesized
aaacttattcctcctgacta

SEQ ID NO: 123144 - DNA, 20 bp, Artificial Sequence
  chemically synthesized
gggttaaaaactttagtcag

SEQ ID NO: 123145 - DNA, 20 bp, Artificial Sequence
  chemically synthesized
aggggttaaaaactttagtc

SEQ ID NO: 123146 - DNA, 20 bp, Artificial Sequence
  chemically synthesized
aaggggttaaaaactttagt

SEQ ID NO: 123147 - DNA, 20 bp, Artificial Sequence
  chemically synthesized
tcaaaaggggttaaaaactt

SEQ ID NO: 123148 - DNA, 20 bp, Artificial Sequence
  chemically synthesized
ggggagatgttgatcaaaag

SEQ ID NO: 123149 - DNA, 20 bp, Artificial Sequence
  chemically synthesized
tggggagatgttgatcaaaa

SEQ ID NO: 123150 - DNA, 20 bp, Artificial Sequence
  chemically synthesized
atggggagatgttgatcaaa

SEQ ID NO: 123151 - DNA, 20 bp, Artificial Sequence
  chemically synthesized
aatggggagatgttgatcaa

SEQ ID NO: 123152 - DNA, 20 bp, Artificial Sequence
  chemically synthesized
atttaggggtggaaaatggg

SEQ ID NO: 123153 - DNA, 20 bp, Artificial Sequence
  chemically synthesized
ggatttaggggtggaaaatg

SEQ ID NO: 123154 - DNA, 20 bp, Artificial Sequence
  chemically synthesized
tggatttaggggtggaaaat

SEQ ID NO: 123155 - DNA, 20 bp, Artificial Sequence
  chemically synthesized
gtggatttaggggtggaaaa

SEQ ID NO: 123156 - DNA, 20 bp, Artificial Sequence
  chemically synthesized
agaggctgtggatttagggg

SEQ ID NO: 123157 - DNA, 20 bp, Artificial Sequence
  chemically synthesized
accagaggctgtggatttag

SEQ ID NO: 123158 - DNA, 20 bp, Artificial Sequence
  chemically synthesized
taccagaggctgtggattta

SEQ ID NO: 123159 - DNA, 20 bp, Artificial Sequence
  chemically synthesized
attttccacccctaaatcca

SEQ ID NO: 123160 - DNA, 20 bp, Artificial Sequence
  chemically synthesized
ttaccagaggctgtggattt

SEQ ID NO: 123161 - DNA, 20 bp, Artificial Sequence
  chemically synthesized
gttaccagaggctgtggatt

SEQ ID NO: 123162 - DNA, 20 bp, Artificial Sequence
  chemically synthesized
acccctaaatccacagcctc

SEQ ID NO: 123163 - DNA, 20 bp, Artificial Sequence
  chemically synthesized
atggtggttaccagaggctg

SEQ ID NO: 123164 - DNA, 20 bp, Artificial Sequence
  chemically synthesized
agtagaatggtggttaccag

SEQ ID NO: 123165 - DNA, 20 bp, Artificial Sequence
  chemically synthesized
gagtagaatggtggttacca

SEQ ID NO: 123166 - DNA, 20 bp, Artificial Sequence
  chemically synthesized
gagagtagaatggtggttac

SEQ ID NO: 123167 - DNA, 20 bp, Artificial Sequence
  chemically synthesized
tgaagtagagagtagaatgg

SEQ ID NO: 123168 - DNA, 20 bp, Artificial Sequence
  chemically synthesized
cattgaagtagagagtagaa

SEQ ID NO: 123169 - DNA, 20 bp, Artificial Sequence
  chemically synthesized
aaactcattgaagtagagag

SEQ ID NO: 123170 - DNA, 20 bp, Artificial Sequence
  chemically synthesized
gtcaaactcattgaagtaga

SEQ ID NO: 123171 - DNA, 20 bp, Artificial Sequence
  chemically synthesized
aagtcaaactcattgaagta

SEQ ID NO: 123172 - DNA, 20 bp, Artificial Sequence
  chemically synthesized
attctactctctacttcaat

SEQ ID NO: 123173 - DNA, 20 bp, Artificial Sequence
  chemically synthesized
aaaagtcaaactcattgaag

SEQ ID NO: 123174 - DNA, 20 bp, Artificial Sequence
  chemically synthesized
taaaaaagtcaaactcattg

SEQ ID NO: 123175 - DNA, 20 bp, Artificial Sequence
  chemically synthesized
ttcaatgagtttgacttttt

SEQ ID NO: 123176 - DNA, 20 bp, Artificial Sequence
  chemically synthesized
cttatgtgtggaatctaaaa

SEQ ID NO: 123177 - DNA, 20 bp, Artificial Sequence
  chemically synthesized
cttttttagattccacacat

SEQ ID NO: 123178 - DNA, 20 bp, Artificial Sequence
  chemically synthesized
tgcgtgatctcacttatgtg

SEQ ID NO: 123179 - DNA, 20 bp, Artificial Sequence
  chemically synthesized
tttagattccacacataagt

SEQ ID NO: 123180 - DNA, 20 bp, Artificial Sequence
  chemically synthesized
cacacataagtgagatcacg

SEQ ID NO: 123181 - DNA, 20 bp, Artificial Sequence
  chemically synthesized
tgaaataagccaggcacaga

SEQ ID NO: 123182 - DNA, 20 bp, Artificial Sequence
  chemically synthesized
agtatttgactttctgtgcc

SEQ ID NO: 123183 - DNA, 20 bp, Artificial Sequence
  chemically synthesized
taaatgaaataagccaggca

SEQ ID NO: 123184 - DNA, 20 bp, Artificial Sequence
  chemically synthesized
tatactaaatgaaataagcc

SEQ ID NO: 123185 - DNA, 20 bp, Artificial Sequence
  chemically synthesized
ttatactaaatgaaataagc

SEQ ID NO: 123186 - DNA, 20 bp, Artificial Sequence
  chemically synthesized
gacattatactaaatgaaat

SEQ ID NO: 123187 - DNA, 20 bp, Artificial Sequence
  chemically synthesized
tgtgcctggcttatttcatt

SEQ ID NO: 123188 - DNA, 20 bp, Artificial Sequence
  chemically synthesized
tcatttagtataatgtcctc

SEQ ID NO: 123189 - DNA, 20 bp, Artificial Sequence
  chemically synthesized
catttagtataatgtcctcc

SEQ ID NO: 123190 - DNA, 20 bp, Artificial Sequence
  chemically synthesized
gacagcgtggatgaacctgg

SEQ ID NO: 123191 - DNA, 20 bp, Artificial Sequence
  chemically synthesized
tgacagcgtggatgaacctg

SEQ ID NO: 123192 - DNA, 20 bp, Artificial Sequence
  chemically synthesized
tatgacagcgtggatgaacc

SEQ ID NO: 123193 - DNA, 20 bp, Artificial Sequence
  chemically synthesized
tccttttgtttatgacagcg

SEQ ID NO: 123194 - DNA, 20 bp, Artificial Sequence
  chemically synthesized
gaatatccttttgtttatga

SEQ ID NO: 123195 - DNA, 20 bp, Artificial Sequence
  chemically synthesized
atccacgctgtcataaacaa

SEQ ID NO: 123196 - DNA, 20 bp, Artificial Sequence
  chemically synthesized
tccacgctgtcataaacaaa

SEQ ID NO: 123197 - DNA, 20 bp, Artificial Sequence
  chemically synthesized
caaaaggatattctttattt

SEQ ID NO: 123198 - DNA, 20 bp, Artificial Sequence
  chemically synthesized
aaaaggatattctttattta

SEQ ID NO: 123199 - DNA, 20 bp, Artificial Sequence
  chemically synthesized
gtattattcagccttaaata

SEQ ID NO: 123200 - DNA, 20 bp, Artificial Sequence
  chemically synthesized
atacacaatggagtattatt

SEQ ID NO: 123201 - DNA, 20 bp, Artificial Sequence
  chemically synthesized
tgtggtacatatacacaatg

SEQ ID NO: 123202 - DNA, 20 bp, Artificial Sequence
  chemically synthesized
aatgtggtacatatacacaa

SEQ ID NO: 123203 - DNA, 20 bp, Artificial Sequence
  chemically synthesized
atgaatggataaagaaaatg

SEQ ID NO: 123204 - DNA, 20 bp, Artificial Sequence
  chemically synthesized
catcagtggatgaatggata

SEQ ID NO: 123205 - DNA, 20 bp, Artificial Sequence
  chemically synthesized
agtttccatcagtggatgaa

SEQ ID NO: 123206 - DNA, 20 bp, Artificial Sequence
  chemically synthesized
tttatccattcatccactga

SEQ ID NO: 123207 - DNA, 20 bp, Artificial Sequence
  chemically synthesized
tcaacctaagtttccatcag

SEQ ID NO: 123208 - DNA, 20 bp, Artificial Sequence
  chemically synthesized
gaatcaacctaagtttccat

SEQ ID NO: 123209 - DNA, 20 bp, Artificial Sequence
  chemically synthesized
ttcatccactgatggaaact

SEQ ID NO: 123210 - DNA, 20 bp, Artificial Sequence
  chemically synthesized
tcatccactgatggaaactt

SEQ ID NO: 123211 - DNA, 20 bp, Artificial Sequence
  chemically synthesized
ccatgatatggaatcaacct

SEQ ID NO: 123212 - DNA, 20 bp, Artificial Sequence
  chemically synthesized
cttaggttgattccatatca

SEQ ID NO: 123213 - DNA, 20 bp, Artificial Sequence
  chemically synthesized
tagtcacaaaagccatgata

SEQ ID NO: 123214 - DNA, 20 bp, Artificial Sequence
  chemically synthesized
tattgcagcattagtcacaa

SEQ ID NO: 123215 - DNA, 20 bp, Artificial Sequence
  chemically synthesized
tcctgtgtttattgcagcat

SEQ ID NO: 123216 - DNA, 20 bp, Artificial Sequence
  chemically synthesized
cttcactcctgtgtttattg

SEQ ID NO: 123217 - DNA, 20 bp, Artificial Sequence
  chemically synthesized
gactaatgctgcaataaaca

SEQ ID NO: 123218 - DNA, 20 bp, Artificial Sequence
  chemically synthesized
actaatgctgcaataaacac

SEQ ID NO: 123219 - DNA, 20 bp, Artificial Sequence
  chemically synthesized
taatgctgcaataaacacag

SEQ ID NO: 123220 - DNA, 20 bp, Artificial Sequence
  chemically synthesized
ctgcaataaacacaggagtg

SEQ ID NO: 123221 - DNA, 20 bp, Artificial Sequence
  chemically synthesized
atttaaaccagtatgtcaaa

SEQ ID NO: 123222 - DNA, 20 bp, Artificial Sequence
  chemically synthesized
gaatttaaaccagtatgtca

SEQ ID NO: 123223 - DNA, 20 bp, Artificial Sequence
  chemically synthesized
aagatatctctttgacatac

SEQ ID NO: 123224 - DNA, 20 bp, Artificial Sequence
  chemically synthesized
atatccaaaagaatttaaac

SEQ ID NO: 123225 - DNA, 20 bp, Artificial Sequence
  chemically synthesized
catactggtttaaattcttt

SEQ ID NO: 123226 - DNA, 20 bp, Artificial Sequence
  chemically synthesized
acttccgggtatatatccaa

SEQ ID NO: 123227 - DNA, 20 bp, Artificial Sequence
  chemically synthesized
aattcttttggatatatacc

SEQ ID NO: 123228 - DNA, 20 bp, Artificial Sequence
  chemically synthesized
tcttttggatatatacccgg

SEQ ID NO: 123229 - DNA, 20 bp, Artificial Sequence
  chemically synthesized
tttggatatatacccggaag

SEQ ID NO: 123230 - DNA, 20 bp, Artificial Sequence
  chemically synthesized
ttggatatatacccggaagt

SEQ ID NO: 123231 - DNA, 20 bp, Artificial Sequence
  chemically synthesized
gatccagcaatcccacttcc

SEQ ID NO: 123232 - DNA, 20 bp, Artificial Sequence
  chemically synthesized
ggatccagcaatcccacttc

SEQ ID NO: 123233 - DNA, 20 bp, Artificial Sequence
  chemically synthesized
atacccggaagtgggattgc

SEQ ID NO: 123234 - DNA, 20 bp, Artificial Sequence
  chemically synthesized
agtgggattgctggatccta

SEQ ID NO: 123235 - DNA, 20 bp, Artificial Sequence
  chemically synthesized
aacagaattaccataggatc

SEQ ID NO: 123236 - DNA, 20 bp, Artificial Sequence
  chemically synthesized
actgaaaacagaattaccat

SEQ ID NO: 123237 - DNA, 20 bp, Artificial Sequence
  chemically synthesized
aactgaaaacagaattacca

SEQ ID NO: 123238 - DNA, 20 bp, Artificial Sequence
  chemically synthesized
tcctatggtaattctgtttt

SEQ ID NO: 123239 - DNA, 20 bp, Artificial Sequence
  chemically synthesized
gctcctcaaaaaactgaaaa

SEQ ID NO: 123240 - DNA, 20 bp, Artificial Sequence
  chemically synthesized
aattctgttttcagtttttt

SEQ ID NO: 123241 - DNA, 20 bp, Artificial Sequence
  chemically synthesized
attctgttttcagttttttg

SEQ ID NO: 123242 - DNA, 20 bp, Artificial Sequence
  chemically synthesized
tctgttttcagttttttgag

SEQ ID NO: 123243 - DNA, 20 bp, Artificial Sequence
  chemically synthesized
cattatggagaacagtatgg

SEQ ID NO: 123244 - DNA, 20 bp, Artificial Sequence
  chemically synthesized
aaccattatggagaacagta

SEQ ID NO: 123245 - DNA, 20 bp, Artificial Sequence
  chemically synthesized
agtacaaccattatggagaa

SEQ ID NO: 123246 - DNA, 20 bp, Artificial Sequence
  chemically synthesized
taccatactgttctccataa

SEQ ID NO: 123247 - DNA, 20 bp, Artificial Sequence
  chemically synthesized
atattagtacaaccattatg

SEQ ID NO: 123248 - DNA, 20 bp, Artificial Sequence
  chemically synthesized
gtatattagtacaaccatta

SEQ ID NO: 123249 - DNA, 20 bp, Artificial Sequence
  chemically synthesized
tcattggtgggaatgtatat

SEQ ID NO: 123250 - DNA, 20 bp, Artificial Sequence
  chemically synthesized
aacacttgtatatcattggt

SEQ ID NO: 123251 - DNA, 20 bp, Artificial Sequence
  chemically synthesized
taacacttgtatatcattgg

SEQ ID NO: 123252 - DNA, 20 bp, Artificial Sequence
  chemically synthesized
aggtaacacttgtatatcat

SEQ ID NO: 123253 - DNA, 20 bp, Artificial Sequence
  chemically synthesized
cattcccaccaatgatatac

SEQ ID NO: 123254 - DNA, 20 bp, Artificial Sequence
  chemically synthesized
tgatcaaggatatggaaaaa

SEQ ID NO: 123255 - DNA, 20 bp, Artificial Sequence
  chemically synthesized
ttgatcaaggatatggaaaa

SEQ ID NO: 123256 - DNA, 20 bp, Artificial Sequence
  chemically synthesized
acaagtgttgatcaaggata

SEQ ID NO: 123257 - DNA, 20 bp, Artificial Sequence
  chemically synthesized
atgataacaagtgttgatca

SEQ ID NO: 123258 - DNA, 20 bp, Artificial Sequence
  chemically synthesized
aatgataacaagtgttgatc

SEQ ID NO: 123259 - DNA, 20 bp, Artificial Sequence
  chemically synthesized
aaaaagagaagaatgataac

SEQ ID NO: 123260 - DNA, 20 bp, Artificial Sequence
  chemically synthesized
aatggctgttataaaaagag

SEQ ID NO: 123261 - DNA, 20 bp, Artificial Sequence
  chemically synthesized
tagaatggctgttataaaaa

SEQ ID NO: 123262 - DNA, 20 bp, Artificial Sequence
  chemically synthesized
tcattcttctctttttataa

SEQ ID NO: 123263 - DNA, 20 bp, Artificial Sequence
  chemically synthesized
gttagaatggctgttataaa

SEQ ID NO: 123264 - DNA, 20 bp, Artificial Sequence
  chemically synthesized
ttttataacagccattctaa

SEQ ID NO: 123265 - DNA, 20 bp, Artificial Sequence
  chemically synthesized
tttataacagccattctaac

SEQ ID NO: 123266 - DNA, 20 bp, Artificial Sequence
  chemically synthesized
tcaccttacacctgttagaa

SEQ ID NO: 123267 - DNA, 20 bp, Artificial Sequence
  chemically synthesized
agatgtcaccttacacctgt

SEQ ID NO: 123268 - DNA, 20 bp, Artificial Sequence
  chemically synthesized
acagccattctaacaggtgt

SEQ ID NO: 123269 - DNA, 20 bp, Artificial Sequence
  chemically synthesized
cagccattctaacaggtgta

SEQ ID NO: 123270 - DNA, 20 bp, Artificial Sequence
  chemically synthesized
atgcatattacaatcgcagt

SEQ ID NO: 123271 - DNA, 20 bp, Artificial Sequence
  chemically synthesized
ggaaatgcatattacaatcg

SEQ ID NO: 123272 - DNA, 20 bp, Artificial Sequence
  chemically synthesized
atatgcatttccccaatgat

SEQ ID NO: 123273 - DNA, 20 bp, Artificial Sequence
  chemically synthesized
ctcaacatcactaatcattg

SEQ ID NO: 123274 - DNA, 20 bp, Artificial Sequence
  chemically synthesized
gctcaacatcactaatcatt

SEQ ID NO: 123275 - DNA, 20 bp, Artificial Sequence
  chemically synthesized
tgctcaacatcactaatcat

SEQ ID NO: 123276 - DNA, 20 bp, Artificial Sequence
  chemically synthesized
ccccaatgattagtgatgtt

SEQ ID NO: 123277 - DNA, 20 bp, Artificial Sequence
  chemically synthesized
agcatttttcacaaacccgt

SEQ ID NO: 123278 - DNA, 20 bp, Artificial Sequence
  chemically synthesized
aagatgtacaaatagctaac

SEQ ID NO: 123279 - DNA, 20 bp, Artificial Sequence
  chemically synthesized
gaagatgtacaaatagctaa

SEQ ID NO: 123280 - DNA, 20 bp, Artificial Sequence
  chemically synthesized
ctcaaaagaagatgtacaaa

SEQ ID NO: 123281 - DNA, 20 bp, Artificial Sequence
  chemically synthesized
ctatttgtacatcttctttt

SEQ ID NO: 123282 - DNA, 20 bp, Artificial Sequence
  chemically synthesized
acttaaacatttctcaaaag

SEQ ID NO: 123283 - DNA, 20 bp, Artificial Sequence
  chemically synthesized
aacacttaaacatttctcaa

SEQ ID NO: 123284 - DNA, 20 bp, Artificial Sequence
  chemically synthesized
tcttcttttgagaaatgttt

SEQ ID NO: 123285 - DNA, 20 bp, Artificial Sequence
  chemically synthesized
acaaataatctgattaaaat

SEQ ID NO: 123286 - DNA, 20 bp, Artificial Sequence
  chemically synthesized
agtgttttgcccattttaat

SEQ ID NO: 123287 - DNA, 20 bp, Artificial Sequence
  chemically synthesized
aacaaataatctgattaaaa

SEQ ID NO: 123288 - DNA, 20 bp, Artificial Sequence
  chemically synthesized
ttagcttaaatgtatcataa

SEQ ID NO: 123289 - DNA, 20 bp, Artificial Sequence
  chemically synthesized
ttttcttttatgatacattt

SEQ ID NO: 123290 - DNA, 20 bp, Artificial Sequence
  chemically synthesized
ctcacaccatacacaaaaat

SEQ ID NO: 123291 - DNA, 20 bp, Artificial Sequence
  chemically synthesized
tttaagctaatttttgtgta

SEQ ID NO: 123292 - DNA, 20 bp, Artificial Sequence
  chemically synthesized
ctaatttttgtgtatggtgt

SEQ ID NO: 123293 - DNA, 20 bp, Artificial Sequence
  chemically synthesized
taatttttgtgtatggtgtg

SEQ ID NO: 123294 - DNA, 20 bp, Artificial Sequence
  chemically synthesized
tttttgtgtatggtgtgagg

SEQ ID NO: 123295 - DNA, 20 bp, Artificial Sequence
  chemically synthesized
ttttgtgtatggtgtgaggt

SEQ ID NO: 123296 - DNA, 20 bp, Artificial Sequence
  chemically synthesized
tttgtgtatggtgtgaggtg

SEQ ID NO: 123297 - DNA, 20 bp, Artificial Sequence
  chemically synthesized
acatgaaaaataatgaaatt

SEQ ID NO: 123298 - DNA, 20 bp, Artificial Sequence
  chemically synthesized
ttatttttcatgtgtatatc

SEQ ID NO: 123299 - DNA, 20 bp, Artificial Sequence
  chemically synthesized
atgtgtatatccagttattc

SEQ ID NO: 123300 - DNA, 20 bp, Artificial Sequence
  chemically synthesized
caacctggtgctagaataac

SEQ ID NO: 123301 - DNA, 20 bp, Artificial Sequence
  chemically synthesized
atatccagttattctagcac

SEQ ID NO: 123302 - DNA, 20 bp, Artificial Sequence
  chemically synthesized
tatccagttattctagcacc

SEQ ID NO: 123303 - DNA, 20 bp, Artificial Sequence
  chemically synthesized
agtctttcacaacctggtgc

SEQ ID NO: 123304 - DNA, 20 bp, Artificial Sequence
  chemically synthesized
aagaatagtctttcacaacc

SEQ ID NO: 123305 - DNA, 20 bp, Artificial Sequence
  chemically synthesized
attctagcaccaggttgtga

SEQ ID NO: 123306 - DNA, 20 bp, Artificial Sequence
  chemically synthesized
agaattcaatggaaaaagaa

SEQ ID NO: 123307 - DNA, 20 bp, Artificial Sequence
  chemically synthesized
ccaagagaattcaatggaaa

SEQ ID NO: 123308 - DNA, 20 bp, Artificial Sequence
  chemically synthesized
agggtaccaagagaattcaa

SEQ ID NO: 123309 - DNA, 20 bp, Artificial Sequence
  chemically synthesized
ctttttccattgaattctct

SEQ ID NO: 123310 - DNA, 20 bp, Artificial Sequence
  chemically synthesized
atttttgacaagggtaccaa

SEQ ID NO: 123311 - DNA, 20 bp, Artificial Sequence
  chemically synthesized
tgatttttgacaagggtacc

SEQ ID NO: 123312 - DNA, 20 bp, Artificial Sequence
  chemically synthesized
ggtcaactgatttttgacaa

SEQ ID NO: 123313 - DNA, 20 bp, Artificial Sequence
  chemically synthesized
tggtcaactgatttttgaca

SEQ ID NO: 123314 - DNA, 20 bp, Artificial Sequence
  chemically synthesized
atggtcaactgatttttgac

SEQ ID NO: 123315 - DNA, 20 bp, Artificial Sequence
  chemically synthesized
ttggtacccttgtcaaaaat

SEQ ID NO: 123316 - DNA, 20 bp, Artificial Sequence
  chemically synthesized
aaagtaaacctttgcattta

SEQ ID NO: 123317 - DNA, 20 bp, Artificial Sequence
  chemically synthesized
atcagttgaccataaatgca

SEQ ID NO: 123318 - DNA, 20 bp, Artificial Sequence
  chemically synthesized
tcagttgaccataaatgcaa

SEQ ID NO: 123319 - DNA, 20 bp, Artificial Sequence
  chemically synthesized
aaatagaattgaaagttcaa

SEQ ID NO: 123320 - DNA, 20 bp, Artificial Sequence
  chemically synthesized
gatcaatgaaatagaattga

SEQ ID NO: 123321 - DNA, 20 bp, Artificial Sequence
  chemically synthesized
agacatatagatcaatgaaa

SEQ ID NO: 123322 - DNA, 20 bp, Artificial Sequence
  chemically synthesized
ctagaatgtgaatagacata

SEQ ID NO: 123323 - DNA, 20 bp, Artificial Sequence
  chemically synthesized
atgtggtactagaatgtgaa

SEQ ID NO: 123324 - DNA, 20 bp, Artificial Sequence
  chemically synthesized
ctatatgtctattcacattc

SEQ ID NO: 123325 - DNA, 20 bp, Artificial Sequence
  chemically synthesized
ttattaagtcaatgtggtac

SEQ ID NO: 123326 - DNA, 20 bp, Artificial Sequence
  chemically synthesized
ctacaattattaagtcaatg

SEQ ID NO: 123327 - DNA, 20 bp, Artificial Sequence
  chemically synthesized
actacaaagctacaattatt

SEQ ID NO: 123328 - DNA, 20 bp, Artificial Sequence
  chemically synthesized
ccacattgacttaataattg

SEQ ID NO: 123329 - DNA, 20 bp, Artificial Sequence
  chemically synthesized
acttaataattgtagctttg

SEQ ID NO: 123330 - DNA, 20 bp, Artificial Sequence
  chemically synthesized
taataattgtagctttgtag

SEQ ID NO: 123331 - DNA, 20 bp, Artificial Sequence
  chemically synthesized
caatttcaaaaactactaca

SEQ ID NO: 123332 - DNA, 20 bp, Artificial Sequence
  chemically synthesized
tttgtagtagtttttgaaat

SEQ ID NO: 123333 - DNA, 20 bp, Artificial Sequence
  chemically synthesized
tagtagtttttgaaattgga

SEQ ID NO: 123334 - DNA, 20 bp, Artificial Sequence
  chemically synthesized
aaaaaagaacaacattggag

SEQ ID NO: 123335 - DNA, 20 bp, Artificial Sequence
  chemically synthesized
tgaaaaaagaacaacattgg

SEQ ID NO: 123336 - DNA, 20 bp, Artificial Sequence
  chemically synthesized
ttgaaaaaagaacaacattg

SEQ ID NO: 123337 - DNA, 20 bp, Artificial Sequence
  chemically synthesized
ccttgaaaaaagaacaacat

SEQ ID NO: 123338 - DNA, 20 bp, Artificial Sequence
  chemically synthesized
tccaatgttgttcttttttc

SEQ ID NO: 123339 - DNA, 20 bp, Artificial Sequence
  chemically synthesized
ccaatgttgttcttttttca

SEQ ID NO: 123340 - DNA, 20 bp, Artificial Sequence
  chemically synthesized
agtcaaaacaaccttgaaaa

SEQ ID NO: 123341 - DNA, 20 bp, Artificial Sequence
  chemically synthesized
gaaatgcaagggatgtagaa

SEQ ID NO: 123342 - DNA, 20 bp, Artificial Sequence
  chemically synthesized
ctattgaaatgcaagggatg

SEQ ID NO: 123343 - DNA, 20 bp, Artificial Sequence
  chemically synthesized
ccatttctattgaaatgcaa

SEQ ID NO: 123344 - DNA, 20 bp, Artificial Sequence
  chemically synthesized
accatttctattgaaatgca

SEQ ID NO: 123345 - DNA, 20 bp, Artificial Sequence
  chemically synthesized
taccatttctattgaaatgc

SEQ ID NO: 123346 - DNA, 20 bp, Artificial Sequence
  chemically synthesized
ctacatcccttgcatttcaa

SEQ ID NO: 123347 - DNA, 20 bp, Artificial Sequence
  chemically synthesized
cccttgcatttcaatagaaa

SEQ ID NO: 123348 - DNA, 20 bp, Artificial Sequence
  chemically synthesized
ttgcatttcaatagaaatgg

SEQ ID NO: 123349 - DNA, 20 bp, Artificial Sequence
  chemically synthesized
tgcatttcaatagaaatggt

SEQ ID NO: 123350 - DNA, 20 bp, Artificial Sequence
  chemically synthesized
ttttttcagaaattgacaag

SEQ ID NO: 123351 - DNA, 20 bp, Artificial Sequence
  chemically synthesized
tttttttttcagaaattgac

SEQ ID NO: 123352 - DNA, 20 bp, Artificial Sequence
  chemically synthesized
actggctttttttttttttt

SEQ ID NO: 123353 - DNA, 20 bp, Artificial Sequence
  chemically synthesized
aatttctgaaaaaaaaaaaa

SEQ ID NO: 123354 - DNA, 20 bp, Artificial Sequence
  chemically synthesized
tctgaaaaaaaaaaaaaagc

SEQ ID NO: 123355 - DNA, 20 bp, Artificial Sequence
  chemically synthesized
atcattatcaaaatcacaac

SEQ ID NO: 123356 - DNA, 20 bp, Artificial Sequence
  chemically synthesized
tgattttgataatgattcca

SEQ ID NO: 123357 - DNA, 20 bp, Artificial Sequence
  chemically synthesized
attttgataatgattccata

SEQ ID NO: 123358 - DNA, 20 bp, Artificial Sequence
  chemically synthesized
caattgatctacagactcta

SEQ ID NO: 123359 - DNA, 20 bp, Artificial Sequence
  chemically synthesized
taatgattccatagagtctg

SEQ ID NO: 123360 - DNA, 20 bp, Artificial Sequence
  chemically synthesized
atatccccccaattgatcta

SEQ ID NO: 123361 - DNA, 20 bp, Artificial Sequence
  chemically synthesized
catagagtctgtagatcaat

SEQ ID NO: 123362 - DNA, 20 bp, Artificial Sequence
  chemically synthesized
atagagtctgtagatcaatt

SEQ ID NO: 123363 - DNA, 20 bp, Artificial Sequence
  chemically synthesized
tagagtctgtagatcaattg

SEQ ID NO: 123364 - DNA, 20 bp, Artificial Sequence
  chemically synthesized
agagtctgtagatcaattgg

SEQ ID NO: 123365 - DNA, 20 bp, Artificial Sequence
  chemically synthesized
gagtctgtagatcaattggg

SEQ ID NO: 123366 - DNA, 20 bp, Artificial Sequence
  chemically synthesized
tcaaaagacttaatattatt

SEQ ID NO: 123367 - DNA, 20 bp, Artificial Sequence
  chemically synthesized
attgatatcttaataatatt

SEQ ID NO: 123368 - DNA, 20 bp, Artificial Sequence
  chemically synthesized
aatattaagtcttttgatct

SEQ ID NO: 123369 - DNA, 20 bp, Artificial Sequence
  chemically synthesized
atcacatgttctcagatcaa

SEQ ID NO: 123370 - DNA, 20 bp, Artificial Sequence
  chemically synthesized
agaaaaatatcacatgttct

SEQ ID NO: 123371 - DNA, 20 bp, Artificial Sequence
  chemically synthesized
agaaattaaagataaaaaaa

SEQ ID NO: 123372 - DNA, 20 bp, Artificial Sequence
  chemically synthesized
agcagtgttgaaagaaatta

SEQ ID NO: 123373 - DNA, 20 bp, Artificial Sequence
  chemically synthesized
agaatacaaagcagtgttga

SEQ ID NO: 123374 - DNA, 20 bp, Artificial Sequence
  chemically synthesized
gtatactgaagaatacaaag

SEQ ID NO: 123375 - DNA, 20 bp, Artificial Sequence
  chemically synthesized
cttgtatactgaagaataca

SEQ ID NO: 123376 - DNA, 20 bp, Artificial Sequence
  chemically synthesized
caacactgctttgtattctt

SEQ ID NO: 123377 - DNA, 20 bp, Artificial Sequence
  chemically synthesized
gatgcaaggcttgtatactg

SEQ ID NO: 123378 - DNA, 20 bp, Artificial Sequence
  chemically synthesized
ctttgtattcttcagtatac

SEQ ID NO: 123379 - DNA, 20 bp, Artificial Sequence
  chemically synthesized
ttaggaataaaagagatgca

SEQ ID NO: 123380 - DNA, 20 bp, Artificial Sequence
  chemically synthesized
cttaggaataaaagagatgc

SEQ ID NO: 123381 - DNA, 20 bp, Artificial Sequence
  chemically synthesized
ttaaaaacttaggaataaaa

SEQ ID NO: 123382 - DNA, 20 bp, Artificial Sequence
  chemically synthesized
tgttaaaaacttaggaataa

SEQ ID NO: 123383 - DNA, 20 bp, Artificial Sequence
  chemically synthesized
cttgcatctcttttattcct

SEQ ID NO: 123384 - DNA, 20 bp, Artificial Sequence
  chemically synthesized
tcaaaaaatgttaaaaactt

SEQ ID NO: 123385 - DNA, 20 bp, Artificial Sequence
  chemically synthesized
atcaaaaaatgttaaaaact

SEQ ID NO: 123386 - DNA, 20 bp, Artificial Sequence
  chemically synthesized
aattaagaaaatatttacaa

SEQ ID NO: 123387 - DNA, 20 bp, Artificial Sequence
  chemically synthesized
aataatctaaaagtgaaatt

SEQ ID NO: 123388 - DNA, 20 bp, Artificial Sequence
  chemically synthesized
tattttcttaatttcacttt

SEQ ID NO: 123389 - DNA, 20 bp, Artificial Sequence
  chemically synthesized
attaaaaatgaataatctaa

SEQ ID NO: 123390 - DNA, 20 bp, Artificial Sequence
  chemically synthesized
tcagcaaatttgtaggatac

SEQ ID NO: 123391 - DNA, 20 bp, Artificial Sequence
  chemically synthesized
aaataattcagcaaatttgt

SEQ ID NO: 123392 - DNA, 20 bp, Artificial Sequence
  chemically synthesized
aaaataattcagcaaatttg

SEQ ID NO: 123393 - DNA, 20 bp, Artificial Sequence
  chemically synthesized
ttagaaataataaaataatt

SEQ ID NO: 123394 - DNA, 20 bp, Artificial Sequence
  chemically synthesized
aagaatctatgaaaaaatat

SEQ ID NO: 123395 - DNA, 20 bp, Artificial Sequence
  chemically synthesized
ttatttctaatattttttca

SEQ ID NO: 123396 - DNA, 20 bp, Artificial Sequence
  chemically synthesized
cttgtaattagaaaattttg

SEQ ID NO: 123397 - DNA, 20 bp, Artificial Sequence
  chemically synthesized
cttcaaaattttctaattac

SEQ ID NO: 123398 - DNA, 20 bp, Artificial Sequence
  chemically synthesized
ttcaaaattttctaattaca

SEQ ID NO: 123399 - DNA, 20 bp, Artificial Sequence
  chemically synthesized
agacaacatgaccttgtaat

SEQ ID NO: 123400 - DNA, 20 bp, Artificial Sequence
  chemically synthesized
tacaaggtcatgttgtctgc

SEQ ID NO: 123401 - DNA, 20 bp, Artificial Sequence
  chemically synthesized
aaggtcatgttgtctgcaag

SEQ ID NO: 123402 - DNA, 20 bp, Artificial Sequence
  chemically synthesized
ggtcatgttgtctgcaagta

SEQ ID NO: 123403 - DNA, 20 bp, Artificial Sequence
  chemically synthesized
agtaaaattatctctacttg

SEQ ID NO: 123404 - DNA, 20 bp, Artificial Sequence
  chemically synthesized
catccagattagaaaggaat

SEQ ID NO: 123405 - DNA, 20 bp, Artificial Sequence
  chemically synthesized
aaaagacatccagattagaa

SEQ ID NO: 123406 - DNA, 20 bp, Artificial Sequence
  chemically synthesized
ttacttattcctttctaatc

SEQ ID NO: 123407 - DNA, 20 bp, Artificial Sequence
  chemically synthesized
taaaagacatccagattaga

SEQ ID NO: 123408 - DNA, 20 bp, Artificial Sequence
  chemically synthesized
taaataaaagacatccagat

SEQ ID NO: 123409 - DNA, 20 bp, Artificial Sequence
  chemically synthesized
aaaaataaataaaagacatc

SEQ ID NO: 123410 - DNA, 20 bp, Artificial Sequence
  chemically synthesized
taggcaagaaaaataaataa

SEQ ID NO: 123411 - DNA, 20 bp, Artificial Sequence
  chemically synthesized
tcaggccagggaaattaggc

SEQ ID NO: 123412 - DNA, 20 bp, Artificial Sequence
  chemically synthesized
aagttcaggccagggaaatt

SEQ ID NO: 123413 - DNA, 20 bp, Artificial Sequence
  chemically synthesized
tttttcttgcctaatttccc

SEQ ID NO: 123414 - DNA, 20 bp, Artificial Sequence
  chemically synthesized
gaagttcaggccagggaaat

SEQ ID NO: 123415 - DNA, 20 bp, Artificial Sequence
  chemically synthesized
tgtactggaagttcaggcca

SEQ ID NO: 123416 - DNA, 20 bp, Artificial Sequence
  chemically synthesized
ttgtactggaagttcaggcc

SEQ ID NO: 123417 - DNA, 20 bp, Artificial Sequence
  chemically synthesized
attgtactggaagttcaggc

SEQ ID NO: 123418 - DNA, 20 bp, Artificial Sequence
  chemically synthesized
atttccctggcctgaacttc

SEQ ID NO: 123419 - DNA, 20 bp, Artificial Sequence
  chemically synthesized
cagtattgtactggaagttc

SEQ ID NO: 123420 - DNA, 20 bp, Artificial Sequence
  chemically synthesized
tcagtattgtactggaagtt

SEQ ID NO: 123421 - DNA, 20 bp, Artificial Sequence
  chemically synthesized
tctattcagtattgtactgg

SEQ ID NO: 123422 - DNA, 20 bp, Artificial Sequence
  chemically synthesized
acttctattcagtattgtac

SEQ ID NO: 123423 - DNA, 20 bp, Artificial Sequence
  chemically synthesized
acttccagtacaatactgaa

SEQ ID NO: 123424 - DNA, 20 bp, Artificial Sequence
  chemically synthesized
tccagtacaatactgaatag

SEQ ID NO: 123425 - DNA, 20 bp, Artificial Sequence
  chemically synthesized
ctggtctcaccacttctatt

SEQ ID NO: 123426 - DNA, 20 bp, Artificial Sequence
  chemically synthesized
agtacaatactgaatagaag

SEQ ID NO: 123427 - DNA, 20 bp, Artificial Sequence
  chemically synthesized
caatactgaatagaagtggt

SEQ ID NO: 123428 - DNA, 20 bp, Artificial Sequence
  chemically synthesized
ctgaatagaagtggtgagac

SEQ ID NO: 123429 - DNA, 20 bp, Artificial Sequence
  chemically synthesized
tgaatagaagtggtgagacc

SEQ ID NO: 123430 - DNA, 20 bp, Artificial Sequence
  chemically synthesized
aggaaatagtgaaggatgcc

SEQ ID NO: 123431 - DNA, 20 bp, Artificial Sequence
  chemically synthesized
ctaagatcaggaaatagtga

SEQ ID NO: 123432 - DNA, 20 bp, Artificial Sequence
  chemically synthesized
cctaagatcaggaaatagtg

SEQ ID NO: 123433 - DNA, 20 bp, Artificial Sequence
  chemically synthesized
tttcccctaagatcaggaaa

SEQ ID NO: 123434 - DNA, 20 bp, Artificial Sequence
  chemically synthesized
ccttcactatttcctgatct

SEQ ID NO: 123435 - DNA, 20 bp, Artificial Sequence
  chemically synthesized
cttcactatttcctgatctt

SEQ ID NO: 123436 - DNA, 20 bp, Artificial Sequence
  chemically synthesized
ttcactatttcctgatctta

SEQ ID NO: 123437 - DNA, 20 bp, Artificial Sequence
  chemically synthesized
gaatgctttcccctaagatc

SEQ ID NO: 123438 - DNA, 20 bp, Artificial Sequence
  chemically synthesized
tcactatttcctgatcttag

SEQ ID NO: 123439 - DNA, 20 bp, Artificial Sequence
  chemically synthesized
tgaatgctttcccctaagat

SEQ ID NO: 123440 - DNA, 20 bp, Artificial Sequence
  chemically synthesized
tatttcctgatcttagggga

SEQ ID NO: 123441 - DNA, 20 bp, Artificial Sequence
  chemically synthesized
aacactgaatgctttcccct

SEQ ID NO: 123442 - DNA, 20 bp, Artificial Sequence
  chemically synthesized
tgatcttaggggaaagcatt

SEQ ID NO: 123443 - DNA, 20 bp, Artificial Sequence
  chemically synthesized
tcagtgtttcacaataacat

SEQ ID NO: 123444 - DNA, 20 bp, Artificial Sequence
  chemically synthesized
tttcacaataacattagctg

SEQ ID NO: 123445 - DNA, 20 bp, Artificial Sequence
  chemically synthesized
aggcagctacaaaaattcca

SEQ ID NO: 123446 - DNA, 20 bp, Artificial Sequence
  chemically synthesized
cattagctgtggaatttttg

SEQ ID NO: 123447 - DNA, 20 bp, Artificial Sequence
  chemically synthesized
ttcctcaacctgataaaagg

SEQ ID NO: 123448 - DNA, 20 bp, Artificial Sequence
  chemically synthesized
tttttgtagctgccttttat

SEQ ID NO: 123449 - DNA, 20 bp, Artificial Sequence
  chemically synthesized
ttttgtagctgccttttatc

SEQ ID NO: 123450 - DNA, 20 bp, Artificial Sequence
  chemically synthesized
gatttcctcaacctgataaa

SEQ ID NO: 123451 - DNA, 20 bp, Artificial Sequence
  chemically synthesized
ggatttcctcaacctgataa

SEQ ID NO: 123452 - DNA, 20 bp, Artificial Sequence
  chemically synthesized
tagctgccttttatcaggtt

SEQ ID NO: 123453 - DNA, 20 bp, Artificial Sequence
  chemically synthesized
agctgccttttatcaggttg

SEQ ID NO: 123454 - DNA, 20 bp, Artificial Sequence
  chemically synthesized
cgaggaaacgaatacagaag

SEQ ID NO: 123455 - DNA, 20 bp, Artificial Sequence
  chemically synthesized
ccgaggaaacgaatacagaa

SEQ ID NO: 123456 - DNA, 20 bp, Artificial Sequence
  chemically synthesized
gcccgaggaaacgaatacag

SEQ ID NO: 123457 - DNA, 20 bp, Artificial Sequence
  chemically synthesized
gaagcccgaggaaacgaata

SEQ ID NO: 123458 - DNA, 20 bp, Artificial Sequence
  chemically synthesized
ctcttctgtattcgtttcct

SEQ ID NO: 123459 - DNA, 20 bp, Artificial Sequence
  chemically synthesized
tcttctgtattcgtttcctc

SEQ ID NO: 123460 - DNA, 20 bp, Artificial Sequence
  chemically synthesized
cacttaattacagaagcccg

SEQ ID NO: 123461 - DNA, 20 bp, Artificial Sequence
  chemically synthesized
acacttaattacagaagccc

SEQ ID NO: 123462 - DNA, 20 bp, Artificial Sequence
  chemically synthesized
attgtgacacttaattacag

SEQ ID NO: 123463 - DNA, 20 bp, Artificial Sequence
  chemically synthesized
ttcctcgggcttctgtaatt

SEQ ID NO: 123464 - DNA, 20 bp, Artificial Sequence
  chemically synthesized
caaattgtgacacttaatta

SEQ ID NO: 123465 - DNA, 20 bp, Artificial Sequence
  chemically synthesized
attaagtgtcacaatttgcg

SEQ ID NO: 123466 - DNA, 20 bp, Artificial Sequence
  chemically synthesized
agtgtcacaatttgcgtagc

SEQ ID NO: 123467 - DNA, 20 bp, Artificial Sequence
  chemically synthesized
gtgtcacaatttgcgtagct

SEQ ID NO: 123468 - DNA, 20 bp, Artificial Sequence
  chemically synthesized
tcacaatttgcgtagctggg

SEQ ID NO: 123469 - DNA, 20 bp, Artificial Sequence
  chemically synthesized
gacaatgagttttgtctacc

SEQ ID NO: 123470 - DNA, 20 bp, Artificial Sequence
  chemically synthesized
gtagacaaaactcattgtct

SEQ ID NO: 123471 - DNA, 20 bp, Artificial Sequence
  chemically synthesized
ctccagaagtctgagacaat

SEQ ID NO: 123472 - DNA, 20 bp, Artificial Sequence
  chemically synthesized
aactcattgtctcagacttc

SEQ ID NO: 123473 - DNA, 20 bp, Artificial Sequence
  chemically synthesized
gatctagcctccagaagtct

SEQ ID NO: 123474 - DNA, 20 bp, Artificial Sequence
  chemically synthesized
ctcattgtctcagacttctg

SEQ ID NO: 123475 - DNA, 20 bp, Artificial Sequence
  chemically synthesized
tcattgtctcagacttctgg

SEQ ID NO: 123476 - DNA, 20 bp, Artificial Sequence
  chemically synthesized
attttggatctagcctccag

SEQ ID NO: 123477 - DNA, 20 bp, Artificial Sequence
  chemically synthesized
tgtctcagacttctggaggc

SEQ ID NO: 123478 - DNA, 20 bp, Artificial Sequence
  chemically synthesized
ttgattttggatctagcctc

SEQ ID NO: 123479 - DNA, 20 bp, Artificial Sequence
  chemically synthesized
tggaatcttgattttggatc

SEQ ID NO: 123480 - DNA, 20 bp, Artificial Sequence
  chemically synthesized
tggaggctagatccaaaatc

SEQ ID NO: 123481 - DNA, 20 bp, Artificial Sequence
  chemically synthesized
gcctgctggaatcttgattt

SEQ ID NO: 123482 - DNA, 20 bp, Artificial Sequence
  chemically synthesized
tagatccaaaatcaagattc

SEQ ID NO: 123483 - DNA, 20 bp, Artificial Sequence
  chemically synthesized
atccaaaatcaagattccag

SEQ ID NO: 123484 - DNA, 20 bp, Artificial Sequence
  chemically synthesized
tccaaaatcaagattccagc

SEQ ID NO: 123485 - DNA, 20 bp, Artificial Sequence
  chemically synthesized
cagcaggagtatgggcctgc

SEQ ID NO: 123486 - DNA, 20 bp, Artificial Sequence
  chemically synthesized
acaggtttcagcaggagtat

SEQ ID NO: 123487 - DNA, 20 bp, Artificial Sequence
  chemically synthesized
tacaggtttcagcaggagta

SEQ ID NO: 123488 - DNA, 20 bp, Artificial Sequence
  chemically synthesized
tcccctacaggtttcagcag

SEQ ID NO: 123489 - DNA, 20 bp, Artificial Sequence
  chemically synthesized
tctcccctacaggtttcagc

SEQ ID NO: 123490 - DNA, 20 bp, Artificial Sequence
  chemically synthesized
ttctcccctacaggtttcag

SEQ ID NO: 123491 - DNA, 20 bp, Artificial Sequence
  chemically synthesized
catactcctgctgaaacctg

SEQ ID NO: 123492 - DNA, 20 bp, Artificial Sequence
  chemically synthesized
aaattctcccctacaggttt

SEQ ID NO: 123493 - DNA, 20 bp, Artificial Sequence
  chemically synthesized
atactcctgctgaaacctgt

SEQ ID NO: 123494 - DNA, 20 bp, Artificial Sequence
  chemically synthesized
tactcctgctgaaacctgta

SEQ ID NO: 123495 - DNA, 20 bp, Artificial Sequence
  chemically synthesized
actcctgctgaaacctgtag

SEQ ID NO: 123496 - DNA, 20 bp, Artificial Sequence
  chemically synthesized
tcctgctgaaacctgtaggg

SEQ ID NO: 123497 - DNA, 20 bp, Artificial Sequence
  chemically synthesized
aaggaaaaattctcccctac

SEQ ID NO: 123498 - DNA, 20 bp, Artificial Sequence
  chemically synthesized
caaggaaaaattctccccta

SEQ ID NO: 123499 - DNA, 20 bp, Artificial Sequence
  chemically synthesized
ttagaagcaaggaagaggca

SEQ ID NO: 123500 - DNA, 20 bp, Artificial Sequence
  chemically synthesized
attagaagcaaggaagaggc

SEQ ID NO: 123501 - DNA, 20 bp, Artificial Sequence
  chemically synthesized
catcattagaagcaaggaag

SEQ ID NO: 123502 - DNA, 20 bp, Artificial Sequence
  chemically synthesized
ccatcattagaagcaaggaa

SEQ ID NO: 123503 - DNA, 20 bp, Artificial Sequence
  chemically synthesized
ggccatcattagaagcaagg

SEQ ID NO: 123504 - DNA, 20 bp, Artificial Sequence
  chemically synthesized
aacggccatcattagaagca

SEQ ID NO: 123505 - DNA, 20 bp, Artificial Sequence
  chemically synthesized
taacggccatcattagaagc

SEQ ID NO: 123506 - DNA, 20 bp, Artificial Sequence
  chemically synthesized
ctcttccttgcttctaatga

SEQ ID NO: 123507 - DNA, 20 bp, Artificial Sequence
  chemically synthesized
tgattaacggccatcattag

SEQ ID NO: 123508 - DNA, 20 bp, Artificial Sequence
  chemically synthesized
taatgattaacggccatcat

SEQ ID NO: 123509 - DNA, 20 bp, Artificial Sequence
  chemically synthesized
caagtaaaactaatgattaa

SEQ ID NO: 123510 - DNA, 20 bp, Artificial Sequence
  chemically synthesized
taatgatggccgttaatcat

SEQ ID NO: 123511 - DNA, 20 bp, Artificial Sequence
  chemically synthesized
aagtgctacagttgcaagac

SEQ ID NO: 123512 - DNA, 20 bp, Artificial Sequence
  chemically synthesized
ttttacttgtcttgcaactg

SEQ ID NO: 123513 - DNA, 20 bp, Artificial Sequence
  chemically synthesized
gattaaagtgctacagttgc

SEQ ID NO: 123514 - DNA, 20 bp, Artificial Sequence
  chemically synthesized
agttagagattaaagtgcta

SEQ ID NO: 123515 - DNA, 20 bp, Artificial Sequence
  chemically synthesized
gatgttacagttagagatta

SEQ ID NO: 123516 - DNA, 20 bp, Artificial Sequence
  chemically synthesized
accatgtgatgttacagtta

SEQ ID NO: 123517 - DNA, 20 bp, Artificial Sequence
  chemically synthesized
acaccatgtgatgttacagt

SEQ ID NO: 123518 - DNA, 20 bp, Artificial Sequence
  chemically synthesized
aaaaacaccatgtgatgtta

SEQ ID NO: 123519 - DNA, 20 bp, Artificial Sequence
  chemically synthesized
tctctaactgtaacatcaca

SEQ ID NO: 123520 - DNA, 20 bp, Artificial Sequence
  chemically synthesized
atcacatggtgtttttcccg

SEQ ID NO: 123521 - DNA, 20 bp, Artificial Sequence
  chemically synthesized
catggtgtttttcccgtggt

SEQ ID NO: 123522 - DNA, 20 bp, Artificial Sequence
  chemically synthesized
cacataaaggcactgaccac

SEQ ID NO: 123523 - DNA, 20 bp, Artificial Sequence
  chemically synthesized
ccacataaaggcactgacca

SEQ ID NO: 123524 - DNA, 20 bp, Artificial Sequence
  chemically synthesized
ccgtggtcagtgcctttatg

SEQ ID NO: 123525 - DNA, 20 bp, Artificial Sequence
  chemically synthesized
gagagaagaatgccacataa

SEQ ID NO: 123526 - DNA, 20 bp, Artificial Sequence
  chemically synthesized
agagagaagaatgccacata

SEQ ID NO: 123527 - DNA, 20 bp, Artificial Sequence
  chemically synthesized
aaagaggcatacacagagag

SEQ ID NO: 123528 - DNA, 20 bp, Artificial Sequence
  chemically synthesized
ggaaaagaggcatacacaga

SEQ ID NO: 123529 - DNA, 20 bp, Artificial Sequence
  chemically synthesized
gaggaaaagaggcatacaca

SEQ ID NO: 123530 - DNA, 20 bp, Artificial Sequence
  chemically synthesized
aagaggaaaagaggcataca

SEQ ID NO: 123531 - DNA, 20 bp, Artificial Sequence
  chemically synthesized
ttttataagaagaggaaaag

SEQ ID NO: 123532 - DNA, 20 bp, Artificial Sequence
  chemically synthesized
tttttataagaagaggaaaa

SEQ ID NO: 123533 - DNA, 20 bp, Artificial Sequence
  chemically synthesized
tatttttataagaagaggaa

SEQ ID NO: 123534 - DNA, 20 bp, Artificial Sequence
  chemically synthesized
gatggtatttttataagaag

SEQ ID NO: 123535 - DNA, 20 bp, Artificial Sequence
  chemically synthesized
agatggtatttttataagaa

SEQ ID NO: 123536 - DNA, 20 bp, Artificial Sequence
  chemically synthesized
taagatggtatttttataag

SEQ ID NO: 123537 - DNA, 20 bp, Artificial Sequence
  chemically synthesized
agttaagatggtatttttat

SEQ ID NO: 123538 - DNA, 20 bp, Artificial Sequence
  chemically synthesized
cagatgcagtcaagttaaga

SEQ ID NO: 123539 - DNA, 20 bp, Artificial Sequence
  chemically synthesized
tttgcagatgcagtcaagtt

SEQ ID NO: 123540 - DNA, 20 bp, Artificial Sequence
  chemically synthesized
gagtctttgcagatgcagtc

SEQ ID NO: 123541 - DNA, 20 bp, Artificial Sequence
  chemically synthesized
aaatagagtctttgcagatg

SEQ ID NO: 123542 - DNA, 20 bp, Artificial Sequence
  chemically synthesized
ttaacttgactgcatctgca

SEQ ID NO: 123543 - DNA, 20 bp, Artificial Sequence
  chemically synthesized
atgtagaaatagagtctttg

SEQ ID NO: 123544 - DNA, 20 bp, Artificial Sequence
  chemically synthesized
tgtgaccttatgtagaaata

SEQ ID NO: 123545 - DNA, 20 bp, Artificial Sequence
  chemically synthesized
aatgtgaccttatgtagaaa

SEQ ID NO: 123546 - DNA, 20 bp, Artificial Sequence
  chemically synthesized
caaagactctatttctacat

SEQ ID NO: 123547 - DNA, 20 bp, Artificial Sequence
  chemically synthesized
aaagactctatttctacata

SEQ ID NO: 123548 - DNA, 20 bp, Artificial Sequence
  chemically synthesized
tctgcaaatgtgaccttatg

SEQ ID NO: 123549 - DNA, 20 bp, Artificial Sequence
  chemically synthesized
tctacataaggtcacatttg

SEQ ID NO: 123550 - DNA, 20 bp, Artificial Sequence
  chemically synthesized
aggtcacatttgcagatacc

SEQ ID NO: 123551 - DNA, 20 bp, Artificial Sequence
  chemically synthesized
ggtcacatttgcagatacct

SEQ ID NO: 123552 - DNA, 20 bp, Artificial Sequence
  chemically synthesized
catttgcagatacctgggct

SEQ ID NO: 123553 - DNA, 20 bp, Artificial Sequence
  chemically synthesized
atttgcagatacctgggctc

SEQ ID NO: 123554 - DNA, 20 bp, Artificial Sequence
  chemically synthesized
catactaaaagcctgagccc

SEQ ID NO: 123555 - DNA, 20 bp, Artificial Sequence
  chemically synthesized
acatactaaaagcctgagcc

SEQ ID NO: 123556 - DNA, 20 bp, Artificial Sequence
  chemically synthesized
gatacctgggctcaggcttt

SEQ ID NO: 123557 - DNA, 20 bp, Artificial Sequence
  chemically synthesized
aaaagacatactaaaagcct

SEQ ID NO: 123558 - DNA, 20 bp, Artificial Sequence
  chemically synthesized
gctcccaaaagacatactaa

SEQ ID NO: 123559 - DNA, 20 bp, Artificial Sequence
  chemically synthesized
caggcttttagtatgtcttt

SEQ ID NO: 123560 - DNA, 20 bp, Artificial Sequence
  chemically synthesized
aggcttttagtatgtctttt

SEQ ID NO: 123561 - DNA, 20 bp, Artificial Sequence
  chemically synthesized
gcttttagtatgtcttttgg

SEQ ID NO: 123562 - DNA, 20 bp, Artificial Sequence
  chemically synthesized
tttagtatgtcttttgggag

SEQ ID NO: 123563 - DNA, 20 bp, Artificial Sequence
  chemically synthesized
atagtgtcccccgctcccaa

SEQ ID NO: 123564 - DNA, 20 bp, Artificial Sequence
  chemically synthesized
ttagtatgtcttttgggagc

SEQ ID NO: 123565 - DNA, 20 bp, Artificial Sequence
  chemically synthesized
tagtatgtcttttgggagcg

SEQ ID NO: 123566 - DNA, 20 bp, Artificial Sequence
  chemically synthesized
agtatgtcttttgggagcgg

SEQ ID NO: 123567 - DNA, 20 bp, Artificial Sequence
  chemically synthesized
agaaggttttgtggattgaa

SEQ ID NO: 123568 - DNA, 20 bp, Artificial Sequence
  chemically synthesized
aaaaaaaaaagaaggttttg

SEQ ID NO: 123569 - DNA, 20 bp, Artificial Sequence
  chemically synthesized
taaaaaaaaaaaaaaaaaga

SEQ ID NO: 123570 - DNA, 20 bp, Artificial Sequence
  chemically synthesized
ctaaaaaaaaaaaaaaaaag

SEQ ID NO: 123571 - DNA, 20 bp, Artificial Sequence
  chemically synthesized
cgtctaaaaaaaaaaaaaaa

SEQ ID NO: 123572 - DNA, 20 bp, Artificial Sequence
  chemically synthesized
cttctttttttttttttttt

SEQ ID NO: 123573 - DNA, 20 bp, Artificial Sequence
  chemically synthesized
tttttttttttttttttaga

SEQ ID NO: 123574 - DNA, 20 bp, Artificial Sequence
  chemically synthesized
tttttttttttttttagacg

SEQ ID NO: 123575 - DNA, 20 bp, Artificial Sequence
  chemically synthesized
tccggcctgggcgaaagagc

SEQ ID NO: 123576 - DNA, 20 bp, Artificial Sequence
  chemically synthesized
cggagtctcgctctttcgcc

SEQ ID NO: 123577 - DNA, 20 bp, Artificial Sequence
  chemically synthesized
gcagtccggcctgggcgaaa

SEQ ID NO: 123578 - DNA, 20 bp, Artificial Sequence
  chemically synthesized
ggagtctcgctctttcgccc

SEQ ID NO: 123579 - DNA, 20 bp, Artificial Sequence
  chemically synthesized
ctgcagtccggcctgggcga

SEQ ID NO: 123580 - DNA, 20 bp, Artificial Sequence
  chemically synthesized
tctcgctctttcgcccaggc

SEQ ID NO: 123581 - DNA, 20 bp, Artificial Sequence
  chemically synthesized
gcagcactgcagtccggcct

SEQ ID NO: 123582 - DNA, 20 bp, Artificial Sequence
  chemically synthesized
agcagcactgcagtccggcc

SEQ ID NO: 123583 - DNA, 20 bp, Artificial Sequence
  chemically synthesized
ctttcgcccaggccggactg

SEQ ID NO: 123584 - DNA, 20 bp, Artificial Sequence
  chemically synthesized
gagacagcagcactgcagtc

SEQ ID NO: 123585 - DNA, 20 bp, Artificial Sequence
  chemically synthesized
gagccgagacagcagcactg

SEQ ID NO: 123586 - DNA, 20 bp, Artificial Sequence
  chemically synthesized
ggactgcagtgctgctgtct

SEQ ID NO: 123587 - DNA, 20 bp, Artificial Sequence
  chemically synthesized
tttgcagtgagccgagacag

SEQ ID NO: 123588 - DNA, 20 bp, Artificial Sequence
  chemically synthesized
gagtttgcagtgagccgaga

SEQ ID NO: 123589 - DNA, 20 bp, Artificial Sequence
  chemically synthesized
ggcagagtttgcagtgagcc

SEQ ID NO: 123590 - DNA, 20 bp, Artificial Sequence
  chemically synthesized
ctggaggcagagtttgcagt

SEQ ID NO: 123591 - DNA, 20 bp, Artificial Sequence
  chemically synthesized
aaccctggaggcagagtttg

SEQ ID NO: 123592 - DNA, 20 bp, Artificial Sequence
  chemically synthesized
ctcactgcaaactctgcctc

SEQ ID NO: 123593 - DNA, 20 bp, Artificial Sequence
  chemically synthesized
tcactgcaaactctgcctcc

SEQ ID NO: 123594 - DNA, 20 bp, Artificial Sequence
  chemically synthesized
tggcgcgaaccctggaggca

SEQ ID NO: 123595 - DNA, 20 bp, Artificial Sequence
  chemically synthesized
cactgcaaactctgcctcca

SEQ ID NO: 123596 - DNA, 20 bp, Artificial Sequence
  chemically synthesized
aatggcgcgaaccctggagg

SEQ ID NO: 123597 - DNA, 20 bp, Artificial Sequence
  chemically synthesized
gagaatggcgcgaaccctgg

SEQ ID NO: 123598 - DNA, 20 bp, Artificial Sequence
  chemically synthesized
ggagaatggcgcgaaccctg

SEQ ID NO: 123599 - DNA, 20 bp, Artificial Sequence
  chemically synthesized
caggagaatggcgcgaaccc

SEQ ID NO: 123600 - DNA, 20 bp, Artificial Sequence
  chemically synthesized
aggaggctgaggcaggagaa

SEQ ID NO: 123601 - DNA, 20 bp, Artificial Sequence
  chemically synthesized
ttcgcgccattctcctgcct

SEQ ID NO: 123602 - DNA, 20 bp, Artificial Sequence
  chemically synthesized
tactcaggaggctgaggcag

SEQ ID NO: 123603 - DNA, 20 bp, Artificial Sequence
  chemically synthesized
gctactcaggaggctgaggc

SEQ ID NO: 123604 - DNA, 20 bp, Artificial Sequence
  chemically synthesized
agctactcaggaggctgagg

SEQ ID NO: 123605 - DNA, 20 bp, Artificial Sequence
  chemically synthesized
cccagctactcaggaggctg

SEQ ID NO: 123606 - DNA, 20 bp, Artificial Sequence
  chemically synthesized
tcccagctactcaggaggct

SEQ ID NO: 123607 - DNA, 20 bp, Artificial Sequence
  chemically synthesized
ttctcctgcctcagcctcct

SEQ ID NO: 123608 - DNA, 20 bp, Artificial Sequence
  chemically synthesized
tcctgcctcagcctcctgag

SEQ ID NO: 123609 - DNA, 20 bp, Artificial Sequence
  chemically synthesized
tgtagtcccagctactcagg

SEQ ID NO: 123610 - DNA, 20 bp, Artificial Sequence
  chemically synthesized
ctgtagtcccagctactcag

SEQ ID NO: 123611 - DNA, 20 bp, Artificial Sequence
  chemically synthesized
gcctcagcctcctgagtagc

SEQ ID NO: 123612 - DNA, 20 bp, Artificial Sequence
  chemically synthesized
gcctgtagtcccagctactc

SEQ ID NO: 123613 - DNA, 20 bp, Artificial Sequence
  chemically synthesized
cctcagcctcctgagtagct

SEQ ID NO: 123614 - DNA, 20 bp, Artificial Sequence
  chemically synthesized
cgcctgtagtcccagctact

SEQ ID NO: 123615 - DNA, 20 bp, Artificial Sequence
  chemically synthesized
ctcctgagtagctgggacta

SEQ ID NO: 123616 - DNA, 20 bp, Artificial Sequence
  chemically synthesized
tcctgagtagctgggactac

SEQ ID NO: 123617 - DNA, 20 bp, Artificial Sequence
  chemically synthesized
gtggcgggcgcctgtagtcc

SEQ ID NO: 123618 - DNA, 20 bp, Artificial Sequence
  chemically synthesized
ggcacggtggcgggcgcctg

SEQ ID NO: 123619 - DNA, 20 bp, Artificial Sequence
  chemically synthesized
aattagctgggcacggtggc

SEQ ID NO: 123620 - DNA, 20 bp, Artificial Sequence
  chemically synthesized
aaattagctgggcacggtgg

SEQ ID NO: 123621 - DNA, 20 bp, Artificial Sequence
  chemically synthesized
caggcgcccgccaccgtgcc

SEQ ID NO: 123622 - DNA, 20 bp, Artificial Sequence
  chemically synthesized
aaaaaattagctgggcacgg

SEQ ID NO: 123623 - DNA, 20 bp, Artificial Sequence
  chemically synthesized
tacaaaaaattagctgggca

SEQ ID NO: 123624 - DNA, 20 bp, Artificial Sequence
  chemically synthesized
aaaaatacaaaaaattagct

SEQ ID NO: 123625 - DNA, 20 bp, Artificial Sequence
  chemically synthesized
taaaaatacaaaaaattagc

SEQ ID NO: 123626 - DNA, 20 bp, Artificial Sequence
  chemically synthesized
ctgctaaaaatacaaaaaat

SEQ ID NO: 123627 - DNA, 20 bp, Artificial Sequence
  chemically synthesized
cagctaattttttgtatttt

SEQ ID NO: 123628 - DNA, 20 bp, Artificial Sequence
  chemically synthesized
ctaattttttgtatttttag

SEQ ID NO: 123629 - DNA, 20 bp, Artificial Sequence
  chemically synthesized
aattttttgtatttttagca

SEQ ID NO: 123630 - DNA, 20 bp, Artificial Sequence
  chemically synthesized
ttttgtatttttagcagaga

SEQ ID NO: 123631 - DNA, 20 bp, Artificial Sequence
  chemically synthesized
tttgtatttttagcagagac

SEQ ID NO: 123632 - DNA, 20 bp, Artificial Sequence
  chemically synthesized
ttgtatttttagcagagacg

SEQ ID NO: 123633 - DNA, 20 bp, Artificial Sequence
  chemically synthesized
gagacggggttttaccgtgt

SEQ ID NO: 123634 - DNA, 20 bp, Artificial Sequence
  chemically synthesized
cggggttttaccgtgttagc

SEQ ID NO: 123635 - DNA, 20 bp, Artificial Sequence
  chemically synthesized
tgagaccatcctggctaaca

SEQ ID NO: 123636 - DNA, 20 bp, Artificial Sequence
  chemically synthesized
ggggttttaccgtgttagcc

SEQ ID NO: 123637 - DNA, 20 bp, Artificial Sequence
  chemically synthesized
ttttaccgtgttagccagga

SEQ ID NO: 123638 - DNA, 20 bp, Artificial Sequence
  chemically synthesized
tcaggagattgagaccatcc

SEQ ID NO: 123639 - DNA, 20 bp, Artificial Sequence
  chemically synthesized
gatcacgaggtcaggagatt

SEQ ID NO: 123640 - DNA, 20 bp, Artificial Sequence
  chemically synthesized
cagttggatcacgaggtcag

SEQ ID NO: 123641 - DNA, 20 bp, Artificial Sequence
  chemically synthesized
ggcagttggatcacgaggtc

SEQ ID NO: 123642 - DNA, 20 bp, Artificial Sequence
  chemically synthesized
aggcagttggatcacgaggt

SEQ ID NO: 123643 - DNA, 20 bp, Artificial Sequence
  chemically synthesized
gccgaggcagttggatcacg

SEQ ID NO: 123644 - DNA, 20 bp, Artificial Sequence
  chemically synthesized
ggccgaggcagttggatcac

SEQ ID NO: 123645 - DNA, 20 bp, Artificial Sequence
  chemically synthesized
acctcgtgatccaactgcct

SEQ ID NO: 123646 - DNA, 20 bp, Artificial Sequence
  chemically synthesized
ctttgggaggccgaggcagt

SEQ ID NO: 123647 - DNA, 20 bp, Artificial Sequence
  chemically synthesized
agcactttgggaggccgagg

SEQ ID NO: 123648 - DNA, 20 bp, Artificial Sequence
  chemically synthesized
cccagcactttgggaggccg

SEQ ID NO: 123649 - DNA, 20 bp, Artificial Sequence
  chemically synthesized
tcccagcactttgggaggcc

SEQ ID NO: 123650 - DNA, 20 bp, Artificial Sequence
  chemically synthesized
ccaactgcctcggcctccca

SEQ ID NO: 123651 - DNA, 20 bp, Artificial Sequence
  chemically synthesized
tgtaatcccagcactttggg

SEQ ID NO: 123652 - DNA, 20 bp, Artificial Sequence
  chemically synthesized
ctgtaatcccagcactttgg

SEQ ID NO: 123653 - DNA, 20 bp, Artificial Sequence
  chemically synthesized
gcctcggcctcccaaagtgc

SEQ ID NO: 123654 - DNA, 20 bp, Artificial Sequence
  chemically synthesized
gcctgtaatcccagcacttt

SEQ ID NO: 123655 - DNA, 20 bp, Artificial Sequence
  chemically synthesized
cctcggcctcccaaagtgct

SEQ ID NO: 123656 - DNA, 20 bp, Artificial Sequence
  chemically synthesized
cgcctgtaatcccagcactt

SEQ ID NO: 123657 - DNA, 20 bp, Artificial Sequence
  chemically synthesized
ctcccaaagtgctgggatta

SEQ ID NO: 123658 - DNA, 20 bp, Artificial Sequence
  chemically synthesized
tcccaaagtgctgggattac

SEQ ID NO: 123659 - DNA, 20 bp, Artificial Sequence
  chemically synthesized
gtggctcacgcctgtaatcc

SEQ ID NO: 123660 - DNA, 20 bp, Artificial Sequence
  chemically synthesized
agtgctgggattacaggcgt

SEQ ID NO: 123661 - DNA, 20 bp, Artificial Sequence
  chemically synthesized
caggcgtgagccaccacacc

SEQ ID NO: 123662 - DNA, 20 bp, Artificial Sequence
  chemically synthesized
aaggtattggccaggtgtgg

SEQ ID NO: 123663 - DNA, 20 bp, Artificial Sequence
  chemically synthesized
tagaaggtattggccaggtg

SEQ ID NO: 123664 - DNA, 20 bp, Artificial Sequence
  chemically synthesized
aagaatagaaggtattggcc

SEQ ID NO: 123665 - DNA, 20 bp, Artificial Sequence
  chemically synthesized
gaagaatagaaggtattggc

SEQ ID NO: 123666 - DNA, 20 bp, Artificial Sequence
  chemically synthesized
aaatgaagaatagaaggtat

SEQ ID NO: 123667 - DNA, 20 bp, Artificial Sequence
  chemically synthesized
cttaacaaatgaagaataga

SEQ ID NO: 123668 - DNA, 20 bp, Artificial Sequence
  chemically synthesized
acttaacaaatgaagaatag

SEQ ID NO: 123669 - DNA, 20 bp, Artificial Sequence
  chemically synthesized
aacacttaacaaatgaagaa

SEQ ID NO: 123670 - DNA, 20 bp, Artificial Sequence
  chemically synthesized
taaagaacacttaacaaatg

SEQ ID NO: 123671 - DNA, 20 bp, Artificial Sequence
  chemically synthesized
ccttctattcttcatttgtt

SEQ ID NO: 123672 - DNA, 20 bp, Artificial Sequence
  chemically synthesized
cctttcaagcttgaaaaata

SEQ ID NO: 123673 - DNA, 20 bp, Artificial Sequence
  chemically synthesized
ttaagtgttctttatttttc

SEQ ID NO: 123674 - DNA, 20 bp, Artificial Sequence
  chemically synthesized
tctttatttttcaagcttga

SEQ ID NO: 123675 - DNA, 20 bp, Artificial Sequence
  chemically synthesized
ctttatttttcaagcttgaa

SEQ ID NO: 123676 - DNA, 20 bp, Artificial Sequence
  chemically synthesized
tttatttttcaagcttgaaa

SEQ ID NO: 123677 - DNA, 20 bp, Artificial Sequence
  chemically synthesized
acaaagtacaaaaccctttc

SEQ ID NO: 123678 - DNA, 20 bp, Artificial Sequence
  chemically synthesized
tatagaaaattcatgtgaca

SEQ ID NO: 123679 - DNA, 20 bp, Artificial Sequence
  chemically synthesized
tatggtcatcacaataaata

SEQ ID NO: 123680 - DNA, 20 bp, Artificial Sequence
  chemically synthesized
aataaaggacaaaaatcgta

SEQ ID NO: 123681 - DNA, 20 bp, Artificial Sequence
  chemically synthesized
ataccatatcaatagaataa

SEQ ID NO: 123682 - DNA, 20 bp, Artificial Sequence
  chemically synthesized
tataccatatcaatagaata

SEQ ID NO: 123683 - DNA, 20 bp, Artificial Sequence
  chemically synthesized
tgtcctttattctattgata

SEQ ID NO: 123684 - DNA, 20 bp, Artificial Sequence
  chemically synthesized
aatgtattataccatatcaa

SEQ ID NO: 123685 - DNA, 20 bp, Artificial Sequence
  chemically synthesized
ataatacattgattaaattt

SEQ ID NO: 123686 - DNA, 20 bp, Artificial Sequence
  chemically synthesized
ttatcacaggaatgtaaggt

SEQ ID NO: 123687 - DNA, 20 bp, Artificial Sequence
  chemically synthesized
agatttatcacaggaatgta

SEQ ID NO: 123688 - DNA, 20 bp, Artificial Sequence
  chemically synthesized
aagatttatcacaggaatgt

SEQ ID NO: 123689 - DNA, 20 bp, Artificial Sequence
  chemically synthesized
aaccaggtaagatttatcac

SEQ ID NO: 123690 - DNA, 20 bp, Artificial Sequence
  chemically synthesized
taaccaggtaagatttatca

SEQ ID NO: 123691 - DNA, 20 bp, Artificial Sequence
  chemically synthesized
ttcctgtgataaatcttacc

SEQ ID NO: 123692 - DNA, 20 bp, Artificial Sequence
  chemically synthesized
gattgctaccataaccaggt

SEQ ID NO: 123693 - DNA, 20 bp, Artificial Sequence
  chemically synthesized
tgataaatcttacctggtta

SEQ ID NO: 123694 - DNA, 20 bp, Artificial Sequence
  chemically synthesized
acatgattgctaccataacc

SEQ ID NO: 123695 - DNA, 20 bp, Artificial Sequence
  chemically synthesized
taaatcttacctggttatgg

SEQ ID NO: 123696 - DNA, 20 bp, Artificial Sequence
  chemically synthesized
aacatgattgctaccataac

SEQ ID NO: 123697 - DNA, 20 bp, Artificial Sequence
  chemically synthesized
atgttaatatgttgttgtat

SEQ ID NO: 123698 - DNA, 20 bp, Artificial Sequence
  chemically synthesized
tgttaatatgttgttgtatt

SEQ ID NO: 123699 - DNA, 20 bp, Artificial Sequence
  chemically synthesized
attaggtttgataatttttt

SEQ ID NO: 123700 - DNA, 20 bp, Artificial Sequence
  chemically synthesized
ttaggtttgataattttttg

SEQ ID NO: 123701 - DNA, 20 bp, Artificial Sequence
  chemically synthesized
ataattttttgaggcgtttc

SEQ ID NO: 123702 - DNA, 20 bp, Artificial Sequence
  chemically synthesized
cgtttcaagtctatattcat

SEQ ID NO: 123703 - DNA, 20 bp, Artificial Sequence
  chemically synthesized
agcaatatgccttatgaata

SEQ ID NO: 123704 - DNA, 20 bp, Artificial Sequence
  chemically synthesized
gtttcaagtctatattcata

SEQ ID NO: 123705 - DNA, 20 bp, Artificial Sequence
  chemically synthesized
tcataaggcatattgctctg

SEQ ID NO: 123706 - DNA, 20 bp, Artificial Sequence
  chemically synthesized
tcacaagaaaacaagctaca

SEQ ID NO: 123707 - DNA, 20 bp, Artificial Sequence
  chemically synthesized
tatcacaagaaaacaagcta

SEQ ID NO: 123708 - DNA, 20 bp, Artificial Sequence
  chemically synthesized
caaagatatcacaagaaaac

SEQ ID NO: 123709 - DNA, 20 bp, Artificial Sequence
  chemically synthesized
taaccagacaaagatatcac

SEQ ID NO: 123710 - DNA, 20 bp, Artificial Sequence
  chemically synthesized
tttcttgtgatatctttgtc

SEQ ID NO: 123711 - DNA, 20 bp, Artificial Sequence
  chemically synthesized
gaacacttcctaaccagaca

SEQ ID NO: 123712 - DNA, 20 bp, Artificial Sequence
  chemically synthesized
ttgtgatatctttgtctggt

SEQ ID NO: 123713 - DNA, 20 bp, Artificial Sequence
  chemically synthesized
tgtgatatctttgtctggtt

SEQ ID NO: 123714 - DNA, 20 bp, Artificial Sequence
  chemically synthesized
gatatctttgtctggttagg

SEQ ID NO: 123715 - DNA, 20 bp, Artificial Sequence
  chemically synthesized
agaaaggaacacttcctaac

SEQ ID NO: 123716 - DNA, 20 bp, Artificial Sequence
  chemically synthesized
ttccaaaaaatagaagagaa

SEQ ID NO: 123717 - DNA, 20 bp, Artificial Sequence
  chemically synthesized
cttccaaaaaatagaagaga

SEQ ID NO: 123718 - DNA, 20 bp, Artificial Sequence
  chemically synthesized
aactcttccaaaaaatagaa

SEQ ID NO: 123719 - DNA, 20 bp, Artificial Sequence
  chemically synthesized
acaactcttccaaaaaatag

SEQ ID NO: 123720 - DNA, 20 bp, Artificial Sequence
  chemically synthesized
ttcctttctcttctattttt

SEQ ID NO: 123721 - DNA, 20 bp, Artificial Sequence
  chemically synthesized
taaacaactcttccaaaaaa

SEQ ID NO: 123722 - DNA, 20 bp, Artificial Sequence
  chemically synthesized
ctttctcttctattttttgg

SEQ ID NO: 123723 - DNA, 20 bp, Artificial Sequence
  chemically synthesized
ttctcttctattttttggaa

SEQ ID NO: 123724 - DNA, 20 bp, Artificial Sequence
  chemically synthesized
ggaagagttgtttatatgtt

SEQ ID NO: 123725 - DNA, 20 bp, Artificial Sequence
  chemically synthesized
agagttgtttatatgtttgg

SEQ ID NO: 123726 - DNA, 20 bp, Artificial Sequence
  chemically synthesized
atatgtttggtagaattcat

SEQ ID NO: 123727 - DNA, 20 bp, Artificial Sequence
  chemically synthesized
tatgtttggtagaattcatc

SEQ ID NO: 123728 - DNA, 20 bp, Artificial Sequence
  chemically synthesized
atgtttggtagaattcatcg

SEQ ID NO: 123729 - DNA, 20 bp, Artificial Sequence
  chemically synthesized
tgtttggtagaattcatcgg

SEQ ID NO: 123730 - DNA, 20 bp, Artificial Sequence
  chemically synthesized
ttggtagaattcatcggggg

SEQ ID NO: 123731 - DNA, 20 bp, Artificial Sequence
  chemically synthesized
attcatcgggggaagacttc

SEQ ID NO: 123732 - DNA, 20 bp, Artificial Sequence
  chemically synthesized
ttcatcgggggaagacttct

SEQ ID NO: 123733 - DNA, 20 bp, Artificial Sequence
  chemically synthesized
aatgaaaggctcaggcccag

SEQ ID NO: 123734 - DNA, 20 bp, Artificial Sequence
  chemically synthesized
gggggaagacttctgggcct

SEQ ID NO: 123735 - DNA, 20 bp, Artificial Sequence
  chemically synthesized
cccaatgaaaggctcaggcc

SEQ ID NO: 123736 - DNA, 20 bp, Artificial Sequence
  chemically synthesized
cttctcccaatgaaaggctc

SEQ ID NO: 123737 - DNA, 20 bp, Artificial Sequence
  chemically synthesized
acttctcccaatgaaaggct

SEQ ID NO: 123738 - DNA, 20 bp, Artificial Sequence
  chemically synthesized
tctgggcctgagcctttcat

SEQ ID NO: 123739 - DNA, 20 bp, Artificial Sequence
  chemically synthesized
ctgggcctgagcctttcatt

SEQ ID NO: 123740 - DNA, 20 bp, Artificial Sequence
  chemically synthesized
taaaaacttctcccaatgaa

SEQ ID NO: 123741 - DNA, 20 bp, Artificial Sequence
  chemically synthesized
gggcctgagcctttcattgg

SEQ ID NO: 123742 - DNA, 20 bp, Artificial Sequence
  chemically synthesized
ttaaaaacttctcccaatga

SEQ ID NO: 123743 - DNA, 20 bp, Artificial Sequence
  chemically synthesized
cctgagcctttcattgggag

SEQ ID NO: 123744 - DNA, 20 bp, Artificial Sequence
  chemically synthesized
cctataacaagaaattgaat

SEQ ID NO: 123745 - DNA, 20 bp, Artificial Sequence
  chemically synthesized
accaattcaatttcttgtta

SEQ ID NO: 123746 - DNA, 20 bp, Artificial Sequence
  chemically synthesized
ccaattcaatttcttgttat

SEQ ID NO: 123747 - DNA, 20 bp, Artificial Sequence
  chemically synthesized
aacctggatagacctataac

SEQ ID NO: 123748 - DNA, 20 bp, Artificial Sequence
  chemically synthesized
tttcttgttataggtctatc

SEQ ID NO: 123749 - DNA, 20 bp, Artificial Sequence
  chemically synthesized
ttcttgttataggtctatcc

SEQ ID NO: 123750 - DNA, 20 bp, Artificial Sequence
  chemically synthesized
aaacaaatagataacctgga

SEQ ID NO: 123751 - DNA, 20 bp, Artificial Sequence
  chemically synthesized
aactaaacaaatagataacc

SEQ ID NO: 123752 - DNA, 20 bp, Artificial Sequence
  chemically synthesized
atccaggttatctatttgtt

SEQ ID NO: 123753 - DNA, 20 bp, Artificial Sequence
  chemically synthesized
attatgaacaactaaacaaa

SEQ ID NO: 123754 - DNA, 20 bp, Artificial Sequence
  chemically synthesized
gaaataaaaagaagtaaaag

SEQ ID NO: 123755 - DNA, 20 bp, Artificial Sequence
  chemically synthesized
agaaataaaaagaagtaaaa

SEQ ID NO: 123756 - DNA, 20 bp, Artificial Sequence
  chemically synthesized
acagaaataaaaagaagtaa

SEQ ID NO: 123757 - DNA, 20 bp, Artificial Sequence
  chemically synthesized
aacattacagaaataaaaag

SEQ ID NO: 123758 - DNA, 20 bp, Artificial Sequence
  chemically synthesized
accaacattacagaaataaa

SEQ ID NO: 123759 - DNA, 20 bp, Artificial Sequence
  chemically synthesized
tctttttatttctgtaatgt

SEQ ID NO: 123760 - DNA, 20 bp, Artificial Sequence
  chemically synthesized
gtgcattactaccaacatta

SEQ ID NO: 123761 - DNA, 20 bp, Artificial Sequence
  chemically synthesized
ttttatttctgtaatgttgg

SEQ ID NO: 123762 - DNA, 20 bp, Artificial Sequence
  chemically synthesized
actaatattagagaaaaaga

SEQ ID NO: 123763 - DNA, 20 bp, Artificial Sequence
  chemically synthesized
tactaatattagagaaaaag

SEQ ID NO: 123764 - DNA, 20 bp, Artificial Sequence
  chemically synthesized
ttactaatattagagaaaaa

SEQ ID NO: 123765 - DNA, 20 bp, Artificial Sequence
  chemically synthesized
aattactaatattagagaaa

SEQ ID NO: 123766 - DNA, 20 bp, Artificial Sequence
  chemically synthesized
accctctttttctctaatat

SEQ ID NO: 123767 - DNA, 20 bp, Artificial Sequence
  chemically synthesized
tggtcaaattactaatatta

SEQ ID NO: 123768 - DNA, 20 bp, Artificial Sequence
  chemically synthesized
aatggtcaaattactaatat

SEQ ID NO: 123769 - DNA, 20 bp, Artificial Sequence
  chemically synthesized
ctgattggttaggaaagaaa

SEQ ID NO: 123770 - DNA, 20 bp, Artificial Sequence
  chemically synthesized
ttttagctgattggttagga

SEQ ID NO: 123771 - DNA, 20 bp, Artificial Sequence
  chemically synthesized
ccatttctttcctaaccaat

SEQ ID NO: 123772 - DNA, 20 bp, Artificial Sequence
  chemically synthesized
aaagttttagctgattggtt

SEQ ID NO: 123773 - DNA, 20 bp, Artificial Sequence
  chemically synthesized
caaagttttagctgattggt

SEQ ID NO: 123774 - DNA, 20 bp, Artificial Sequence
  chemically synthesized
ttgacaaagttttagctgat

SEQ ID NO: 123775 - DNA, 20 bp, Artificial Sequence
  chemically synthesized
caacaaaattgacaaagttt

SEQ ID NO: 123776 - DNA, 20 bp, Artificial Sequence
  chemically synthesized
aaaggtcaacaaaattgaca

SEQ ID NO: 123777 - DNA, 20 bp, Artificial Sequence
  chemically synthesized
agaaatttagttatttgaaa

SEQ ID NO: 123778 - DNA, 20 bp, Artificial Sequence
  chemically synthesized
tagaaatttagttatttgaa

SEQ ID NO: 123779 - DNA, 20 bp, Artificial Sequence
  chemically synthesized
ttttcaaataactaaatttc

SEQ ID NO: 123780 - DNA, 20 bp, Artificial Sequence
  chemically synthesized
aaaaccaaaatctagaaatt

SEQ ID NO: 123781 - DNA, 20 bp, Artificial Sequence
  chemically synthesized
ataactaaatttctagattt

SEQ ID NO: 123782 - DNA, 20 bp, Artificial Sequence
  chemically synthesized
aaatcaacaaaaccaaaatc

SEQ ID NO: 123783 - DNA, 20 bp, Artificial Sequence
  chemically synthesized
gatagaggaagaaaatataa

SEQ ID NO: 123784 - DNA, 20 bp, Artificial Sequence
  chemically synthesized
tgaaaaaaatcagatagagg

SEQ ID NO: 123785 - DNA, 20 bp, Artificial Sequence
  chemically synthesized
gtgtgaaaaaaatcagatag

SEQ ID NO: 123786 - DNA, 20 bp, Artificial Sequence
  chemically synthesized
agtgtgaaaaaaatcagata

SEQ ID NO: 123787 - DNA, 20 bp, Artificial Sequence
  chemically synthesized
ttagtgtgaaaaaaatcaga

SEQ ID NO: 123788 - DNA, 20 bp, Artificial Sequence
  chemically synthesized
acaattagtgtgaaaaaaat

SEQ ID NO: 123789 - DNA, 20 bp, Artificial Sequence
  chemically synthesized
cagcaggaagtaataacaat

SEQ ID NO: 123790 - DNA, 20 bp, Artificial Sequence
  chemically synthesized
aatctacagtaagcagcagg

SEQ ID NO: 123791 - DNA, 20 bp, Artificial Sequence
  chemically synthesized
gtaaatctacagtaagcagc

SEQ ID NO: 123792 - DNA, 20 bp, Artificial Sequence
  chemically synthesized
agtaaatctacagtaagcag

SEQ ID NO: 123793 - DNA, 20 bp, Artificial Sequence
  chemically synthesized
ttacttcctgctgcttactg

SEQ ID NO: 123794 - DNA, 20 bp, Artificial Sequence
  chemically synthesized
aaaagtaaatctacagtaag

SEQ ID NO: 123795 - DNA, 20 bp, Artificial Sequence
  chemically synthesized
gagaaaagtaaatctacagt

SEQ ID NO: 123796 - DNA, 20 bp, Artificial Sequence
  chemically synthesized
agaagagaaaagtaaatcta

SEQ ID NO: 123797 - DNA, 20 bp, Artificial Sequence
  chemically synthesized
aaactagaaaaagaagagaa

SEQ ID NO: 123798 - DNA, 20 bp, Artificial Sequence
  chemically synthesized
ttaagaaactagaaaaagaa

SEQ ID NO: 123799 - DNA, 20 bp, Artificial Sequence
  chemically synthesized
ttacttttctcttctttttc

SEQ ID NO: 123800 - DNA, 20 bp, Artificial Sequence
  chemically synthesized
ccttaagaaactagaaaaag

SEQ ID NO: 123801 - DNA, 20 bp, Artificial Sequence
  chemically synthesized
ctaccttaagaaactagaaa

SEQ ID NO: 123802 - DNA, 20 bp, Artificial Sequence
  chemically synthesized
tcttctttttctagtttctt

SEQ ID NO: 123803 - DNA, 20 bp, Artificial Sequence
  chemically synthesized
aagcttctaccttaagaaac

SEQ ID NO: 123804 - DNA, 20 bp, Artificial Sequence
  chemically synthesized
cttctttttctagtttctta

SEQ ID NO: 123805 - DNA, 20 bp, Artificial Sequence
  chemically synthesized
ctttttctagtttcttaagg

SEQ ID NO: 123806 - DNA, 20 bp, Artificial Sequence
  chemically synthesized
tttctagtttcttaaggtag

SEQ ID NO: 123807 - DNA, 20 bp, Artificial Sequence
  chemically synthesized
gtagcctaagcttctacctt

SEQ ID NO: 123808 - DNA, 20 bp, Artificial Sequence
  chemically synthesized
agtttcttaaggtagaagct

SEQ ID NO: 123809 - DNA, 20 bp, Artificial Sequence
  chemically synthesized
gtttcttaaggtagaagctt

SEQ ID NO: 123810 - DNA, 20 bp, Artificial Sequence
  chemically synthesized
agatctgaaatcagtagcct

SEQ ID NO: 123811 - DNA, 20 bp, Artificial Sequence
  chemically synthesized
gaagcttaggctactgattt

SEQ ID NO: 123812 - DNA, 20 bp, Artificial Sequence
  chemically synthesized
ggaaaaagatctgaaatcag

SEQ ID NO: 123813 - DNA, 20 bp, Artificial Sequence
  chemically synthesized
aaaggaaaaagatctgaaat

SEQ ID NO: 123814 - DNA, 20 bp, Artificial Sequence
  chemically synthesized
acctatatttaaaaaggaaa

SEQ ID NO: 123815 - DNA, 20 bp, Artificial Sequence
  chemically synthesized
ataaatacctatatttaaaa

SEQ ID NO: 123816 - DNA, 20 bp, Artificial Sequence
  chemically synthesized
tataaatacctatatttaaa

SEQ ID NO: 123817 - DNA, 20 bp, Artificial Sequence
  chemically synthesized
atctttttcctttttaaata

SEQ ID NO: 123818 - DNA, 20 bp, Artificial Sequence
  chemically synthesized
tctttttcctttttaaatat

SEQ ID NO: 123819 - DNA, 20 bp, Artificial Sequence
  chemically synthesized
tttttaaatataggtattta

SEQ ID NO: 123820 - DNA, 20 bp, Artificial Sequence
  chemically synthesized
atagttatacattttactct

SEQ ID NO: 123821 - DNA, 20 bp, Artificial Sequence
  chemically synthesized
ggaggctgaagcagtgctta

SEQ ID NO: 123822 - DNA, 20 bp, Artificial Sequence
  chemically synthesized
gaggaggctgaagcagtgct

SEQ ID NO: 123823 - DNA, 20 bp, Artificial Sequence
  chemically synthesized
ttttactctaagcactgctt

SEQ ID NO: 123824 - DNA, 20 bp, Artificial Sequence
  chemically synthesized
cttatgggaggaggctgaag

SEQ ID NO: 123825 - DNA, 20 bp, Artificial Sequence
  chemically synthesized
aaacttatgggaggaggctg

SEQ ID NO: 123826 - DNA, 20 bp, Artificial Sequence
  chemically synthesized
ataccaaaacttatgggagg

SEQ ID NO: 123827 - DNA, 20 bp, Artificial Sequence
  chemically synthesized
ctgcttcagcctcctcccat

SEQ ID NO: 123828 - DNA, 20 bp, Artificial Sequence
  chemically synthesized
tataccaaaacttatgggag

SEQ ID NO: 123829 - DNA, 20 bp, Artificial Sequence
  chemically synthesized
aatataccaaaacttatggg

SEQ ID NO: 123830 - DNA, 20 bp, Artificial Sequence
  chemically synthesized
caatataccaaaacttatgg

SEQ ID NO: 123831 - DNA, 20 bp, Artificial Sequence
  chemically synthesized
tacaatataccaaaacttat

SEQ ID NO: 123832 - DNA, 20 bp, Artificial Sequence
  chemically synthesized
cagcctcctcccataagttt

SEQ ID NO: 123833 - DNA, 20 bp, Artificial Sequence
  chemically synthesized
atacaatataccaaaactta

SEQ ID NO: 123834 - DNA, 20 bp, Artificial Sequence
  chemically synthesized
caaaaatatcttgagataaa

SEQ ID NO: 123835 - DNA, 20 bp, Artificial Sequence
  chemically synthesized
tttttatttccatttatctc

SEQ ID NO: 123836 - DNA, 20 bp, Artificial Sequence
  chemically synthesized
agaaaatacaaaaatatctt

SEQ ID NO: 123837 - DNA, 20 bp, Artificial Sequence
  chemically synthesized
caatgggacaaagaagaaat

SEQ ID NO: 123838 - DNA, 20 bp, Artificial Sequence
  chemically synthesized
aaatagccaatgggacaaag

SEQ ID NO: 123839 - DNA, 20 bp, Artificial Sequence
  chemically synthesized
cttaaatagccaatgggaca

SEQ ID NO: 123840 - DNA, 20 bp, Artificial Sequence
  chemically synthesized
ttatttcttctttgtcccat

SEQ ID NO: 123841 - DNA, 20 bp, Artificial Sequence
  chemically synthesized
cacactcttaaatagccaat

SEQ ID NO: 123842 - DNA, 20 bp, Artificial Sequence
  chemically synthesized
acacactcttaaatagccaa

SEQ ID NO: 123843 - DNA, 20 bp, Artificial Sequence
  chemically synthesized
ctttgtcccattggctattt

SEQ ID NO: 123844 - DNA, 20 bp, Artificial Sequence
  chemically synthesized
ttgtcccattggctatttaa

SEQ ID NO: 123845 - DNA, 20 bp, Artificial Sequence
  chemically synthesized
ttatacaacacactcttaaa

SEQ ID NO: 123846 - DNA, 20 bp, Artificial Sequence
  chemically synthesized
atttgggagttcataaatat

SEQ ID NO: 123847 - DNA, 20 bp, Artificial Sequence
  chemically synthesized
agtaacagatgtaaatttgg

SEQ ID NO: 123848 - DNA, 20 bp, Artificial Sequence
  chemically synthesized
tcagtaacagatgtaaattt

SEQ ID NO: 123849 - DNA, 20 bp, Artificial Sequence
  chemically synthesized
atcagtaacagatgtaaatt

SEQ ID NO: 123850 - DNA, 20 bp, Artificial Sequence
  chemically synthesized
gtacaattaaaaatcagtaa

SEQ ID NO: 123851 - DNA, 20 bp, Artificial Sequence
  chemically synthesized
aatggagtacaattaaaaat

SEQ ID NO: 123852 - DNA, 20 bp, Artificial Sequence
  chemically synthesized
tttttaattgtactccatta

SEQ ID NO: 123853 - DNA, 20 bp, Artificial Sequence
  chemically synthesized
cagattttatgaccataatg

SEQ ID NO: 123854 - DNA, 20 bp, Artificial Sequence
  chemically synthesized
tgcagattttatgaccataa

SEQ ID NO: 123855 - DNA, 20 bp, Artificial Sequence
  chemically synthesized
gggattaaaatcatacaatg

SEQ ID NO: 123856 - DNA, 20 bp, Artificial Sequence
  chemically synthesized
taagtctcactacattcaaa

SEQ ID NO: 123857 - DNA, 20 bp, Artificial Sequence
  chemically synthesized
gattttaatccctttgaatg

SEQ ID NO: 123858 - DNA, 20 bp, Artificial Sequence
  chemically synthesized
ataagtctcactacattcaa

SEQ ID NO: 123859 - DNA, 20 bp, Artificial Sequence
  chemically synthesized
aataagtctcactacattca

SEQ ID NO: 123860 - DNA, 20 bp, Artificial Sequence
  chemically synthesized
ttaatccctttgaatgtagt

SEQ ID NO: 123861 - DNA, 20 bp, Artificial Sequence
  chemically synthesized
catatgctaggtcataaaat

SEQ ID NO: 123862 - DNA, 20 bp, Artificial Sequence
  chemically synthesized
gtgagacttattttatgacc

SEQ ID NO: 123863 - DNA, 20 bp, Artificial Sequence
  chemically synthesized
ttattttatgacctagcata

SEQ ID NO: 123864 - DNA, 20 bp, Artificial Sequence
  chemically synthesized
tctagggtaggccatatgct

SEQ ID NO: 123865 - DNA, 20 bp, Artificial Sequence
  chemically synthesized
ctctagggtaggccatatgc

SEQ ID NO: 123866 - DNA, 20 bp, Artificial Sequence
  chemically synthesized
acctagcatatggcctaccc

SEQ ID NO: 123867 - DNA, 20 bp, Artificial Sequence
  chemically synthesized
ctagcatatggcctacccta

SEQ ID NO: 123868 - DNA, 20 bp, Artificial Sequence
  chemically synthesized
cacgaaatattctctagggt

SEQ ID NO: 123869 - DNA, 20 bp, Artificial Sequence
  chemically synthesized
acacgaaatattctctaggg

SEQ ID NO: 123870 - DNA, 20 bp, Artificial Sequence
  chemically synthesized
tgtacacgaaatattctcta

SEQ ID NO: 123871 - DNA, 20 bp, Artificial Sequence
  chemically synthesized
ctgtacacgaaatattctct

SEQ ID NO: 123872 - DNA, 20 bp, Artificial Sequence
  chemically synthesized
actgtacacgaaatattctc

SEQ ID NO: 123873 - DNA, 20 bp, Artificial Sequence
  chemically synthesized
cctagagaatatttcgtgta

SEQ ID NO: 123874 - DNA, 20 bp, Artificial Sequence
  chemically synthesized
atatttcgtgtacagttgaa

SEQ ID NO: 123875 - DNA, 20 bp, Artificial Sequence
  chemically synthesized
cgtgtacagttgaaaagaat

SEQ ID NO: 123876 - DNA, 20 bp, Artificial Sequence
  chemically synthesized
aatgagtattctgctattat

SEQ ID NO: 123877 - DNA, 20 bp, Artificial Sequence
  chemically synthesized
agcgtttcatccaataatag

SEQ ID NO: 123878 - DNA, 20 bp, Artificial Sequence
  chemically synthesized
tacagcgtttcatccaataa

SEQ ID NO: 123879 - DNA, 20 bp, Artificial Sequence
  chemically synthesized
ttattggatgaaacgctgta

SEQ ID NO: 123880 - DNA, 20 bp, Artificial Sequence
  chemically synthesized
agacctaacagatatctata

SEQ ID NO: 123881 - DNA, 20 bp, Artificial Sequence
  chemically synthesized
aacgctgtatagatatctgt

SEQ ID NO: 123882 - DNA, 20 bp, Artificial Sequence
  chemically synthesized
acgctgtatagatatctgtt

SEQ ID NO: 123883 - DNA, 20 bp, Artificial Sequence
  chemically synthesized
tataaacttacaagacctaa

SEQ ID NO: 123884 - DNA, 20 bp, Artificial Sequence
  chemically synthesized
agatatctgttaggtcttgt

SEQ ID NO: 123885 - DNA, 20 bp, Artificial Sequence
  chemically synthesized
tataaagactataaacttac

SEQ ID NO: 123886 - DNA, 20 bp, Artificial Sequence
  chemically synthesized
tgttaggtcttgtaagttta

SEQ ID NO: 123887 - DNA, 20 bp, Artificial Sequence
  chemically synthesized
ttgtaagtttatagtcttta

SEQ ID NO: 123888 - DNA, 20 bp, Artificial Sequence
  chemically synthesized
gacacttgaaaaagactata

SEQ ID NO: 123889 - DNA, 20 bp, Artificial Sequence
  chemically synthesized
tagtctttatagtctttttc

SEQ ID NO: 123890 - DNA, 20 bp, Artificial Sequence
  chemically synthesized
aaggaaatagacacttgaaa

SEQ ID NO: 123891 - DNA, 20 bp, Artificial Sequence
  chemically synthesized
taggcaaattaacaaggaaa

SEQ ID NO: 123892 - DNA, 20 bp, Artificial Sequence
  chemically synthesized
aagaactaggcaaattaaca

SEQ ID NO: 123893 - DNA, 20 bp, Artificial Sequence
  chemically synthesized
aaagaactaggcaaattaac

SEQ ID NO: 123894 - DNA, 20 bp, Artificial Sequence
  chemically synthesized
tatttccttgttaatttgcc

SEQ ID NO: 123895 - DNA, 20 bp, Artificial Sequence
  chemically synthesized
taataacaggtaaaagaact

SEQ ID NO: 123896 - DNA, 20 bp, Artificial Sequence
  chemically synthesized
ttaataacaggtaaaagaac

SEQ ID NO: 123897 - DNA, 20 bp, Artificial Sequence
  chemically synthesized
tcacttttaataacaggtaa

SEQ ID NO: 123898 - DNA, 20 bp, Artificial Sequence
  chemically synthesized
aacatctcacttttaataac

SEQ ID NO: 123899 - DNA, 20 bp, Artificial Sequence
  chemically synthesized
gttcttttacctgttattaa

SEQ ID NO: 123900 - DNA, 20 bp, Artificial Sequence
  chemically synthesized
caacatctcacttttaataa

SEQ ID NO: 123901 - DNA, 20 bp, Artificial Sequence
  chemically synthesized
ttttacctgttattaaaagt

SEQ ID NO: 123902 - DNA, 20 bp, Artificial Sequence
  chemically synthesized
ttattaaaagtgagatgttg

SEQ ID NO: 123903 - DNA, 20 bp, Artificial Sequence
  chemically synthesized
taattcaacaaaaatagttg

SEQ ID NO: 123904 - DNA, 20 bp, Artificial Sequence
  chemically synthesized
ggtaattcaacaaaaatagt

SEQ ID NO: 123905 - DNA, 20 bp, Artificial Sequence
  chemically synthesized
attaggtaattcaacaaaaa

SEQ ID NO: 123906 - DNA, 20 bp, Artificial Sequence
  chemically synthesized
actgaactgaaagaagaatt

SEQ ID NO: 123907 - DNA, 20 bp, Artificial Sequence
  chemically synthesized
gactgaactgaaagaagaat

SEQ ID NO: 123908 - DNA, 20 bp, Artificial Sequence
  chemically synthesized
gaattacctaattcttcttt

SEQ ID NO: 123909 - DNA, 20 bp, Artificial Sequence
  chemically synthesized
aaaactgactgaactgaaag

SEQ ID NO: 123910 - DNA, 20 bp, Artificial Sequence
  chemically synthesized
acctaattcttctttcagtt

SEQ ID NO: 123911 - DNA, 20 bp, Artificial Sequence
  chemically synthesized
gcaaaaactgactgaactga

SEQ ID NO: 123912 - DNA, 20 bp, Artificial Sequence
  chemically synthesized
aattcttctttcagttcagt

SEQ ID NO: 123913 - DNA, 20 bp, Artificial Sequence
  chemically synthesized
aaatattaaggaaatacaga

SEQ ID NO: 123914 - DNA, 20 bp, Artificial Sequence
  chemically synthesized
gaaaaaatattaaggaaata

SEQ ID NO: 123915 - DNA, 20 bp, Artificial Sequence
  chemically synthesized
aaaagaaagaaaaaatatta

SEQ ID NO: 123916 - DNA, 20 bp, Artificial Sequence
  chemically synthesized
gaaaagaaagaaaaaatatt

SEQ ID NO: 123917 - DNA, 20 bp, Artificial Sequence
  chemically synthesized
aatccaatccaaagaaaaga

SEQ ID NO: 123918 - DNA, 20 bp, Artificial Sequence
  chemically synthesized
tattttttctttcttttctt

SEQ ID NO: 123919 - DNA, 20 bp, Artificial Sequence
  chemically synthesized
ggataatccaatccaaagaa

SEQ ID NO: 123920 - DNA, 20 bp, Artificial Sequence
  chemically synthesized
tttctttcttttctttggat

SEQ ID NO: 123921 - DNA, 20 bp, Artificial Sequence
  chemically synthesized
aaatgggataatccaatcca

SEQ ID NO: 123922 - DNA, 20 bp, Artificial Sequence
  chemically synthesized
aaacttgaaaataggtaaat

SEQ ID NO: 123923 - DNA, 20 bp, Artificial Sequence
  chemically synthesized
caaacttgaaaataggtaaa

SEQ ID NO: 123924 - DNA, 20 bp, Artificial Sequence
  chemically synthesized
tatcccatttacctattttc

SEQ ID NO: 123925 - DNA, 20 bp, Artificial Sequence
  chemically synthesized
gaatcagcaaacttgaaaat

SEQ ID NO: 123926 - DNA, 20 bp, Artificial Sequence
  chemically synthesized
agaatcagcaaacttgaaaa

SEQ ID NO: 123927 - DNA, 20 bp, Artificial Sequence
  chemically synthesized
caagctgcaaaagaaagaat

SEQ ID NO: 123928 - DNA, 20 bp, Artificial Sequence
  chemically synthesized
tttgctgattctttcttttg

SEQ ID NO: 123929 - DNA, 20 bp, Artificial Sequence
  chemically synthesized
cagattcaagctgcaaaaga

SEQ ID NO: 123930 - DNA, 20 bp, Artificial Sequence
  chemically synthesized
acgtcagattcaagctgcaa

SEQ ID NO: 123931 - DNA, 20 bp, Artificial Sequence
  chemically synthesized
tttcacttgacgtcagattc

SEQ ID NO: 123932 - DNA, 20 bp, Artificial Sequence
  chemically synthesized
tgcagcttgaatctgacgtc

SEQ ID NO: 123933 - DNA, 20 bp, Artificial Sequence
  chemically synthesized
attaaattttcacttgacgt

SEQ ID NO: 123934 - DNA, 20 bp, Artificial Sequence
  chemically synthesized
gtcaagtgaaaatttaattt

SEQ ID NO: 123935 - DNA, 20 bp, Artificial Sequence
  chemically synthesized
gtggaatatctggagttgga

SEQ ID NO: 123936 - DNA, 20 bp, Artificial Sequence
  chemically synthesized
gttattgtgctttccaactc

SEQ ID NO: 123937 - DNA, 20 bp, Artificial Sequence
  chemically synthesized
ctcagtggaatatctggagt

SEQ ID NO: 123938 - DNA, 20 bp, Artificial Sequence
  chemically synthesized
agaactcagtggaatatctg

SEQ ID NO: 123939 - DNA, 20 bp, Artificial Sequence
  chemically synthesized
taagaactcagtggaatatc

SEQ ID NO: 123940 - DNA, 20 bp, Artificial Sequence
  chemically synthesized
ccaactccagatattccact

SEQ ID NO: 123941 - DNA, 20 bp, Artificial Sequence
  chemically synthesized
aattgtaaataagaactcag

SEQ ID NO: 123942 - DNA, 20 bp, Artificial Sequence
  chemically synthesized
agaaattgtaaataagaact

SEQ ID NO: 123943 - DNA, 20 bp, Artificial Sequence
  chemically synthesized
aagagatagaaattgtaaat

SEQ ID NO: 123944 - DNA, 20 bp, Artificial Sequence
  chemically synthesized
agagagtatcaataaagaga

SEQ ID NO: 123945 - DNA, 20 bp, Artificial Sequence
  chemically synthesized
aaatagagagtatcaataaa

SEQ ID NO: 123946 - DNA, 20 bp, Artificial Sequence
  chemically synthesized
acaaatagagagtatcaata

SEQ ID NO: 123947 - DNA, 20 bp, Artificial Sequence
  chemically synthesized
tgcttgtcttaacaaataga

SEQ ID NO: 123948 - DNA, 20 bp, Artificial Sequence
  chemically synthesized
tgtgcttgtcttaacaaata

SEQ ID NO: 123949 - DNA, 20 bp, Artificial Sequence
  chemically synthesized
attgatactctctatttgtt

SEQ ID NO: 123950 - DNA, 20 bp, Artificial Sequence
  chemically synthesized
catgtgcttgtcttaacaaa

SEQ ID NO: 123951 - DNA, 20 bp, Artificial Sequence
  chemically synthesized
tactctctatttgttaagac

SEQ ID NO: 123952 - DNA, 20 bp, Artificial Sequence
  chemically synthesized
tatttgttaagacaagcaca

SEQ ID NO: 123953 - DNA, 20 bp, Artificial Sequence
  chemically synthesized
atttgttaagacaagcacat

SEQ ID NO: 123954 - DNA, 20 bp, Artificial Sequence
  chemically synthesized
aagacaagcacatgggcttc

SEQ ID NO: 123955 - DNA, 20 bp, Artificial Sequence
  chemically synthesized
catgttcttgcgggatctag

SEQ ID NO: 123956 - DNA, 20 bp, Artificial Sequence
  chemically synthesized
tgacatgttcttgcgggatc

SEQ ID NO: 123957 - DNA, 20 bp, Artificial Sequence
  chemically synthesized
catgggcttctagatcccgc

SEQ ID NO: 123958 - DNA, 20 bp, Artificial Sequence
  chemically synthesized
aacctctgacatgttcttgc

SEQ ID NO: 123959 - DNA, 20 bp, Artificial Sequence
  chemically synthesized
caacctctgacatgttcttg

SEQ ID NO: 123960 - DNA, 20 bp, Artificial Sequence
  chemically synthesized
tagatcccgcaagaacatgt

SEQ ID NO: 123961 - DNA, 20 bp, Artificial Sequence
  chemically synthesized
gatcccgcaagaacatgtca

SEQ ID NO: 123962 - DNA, 20 bp, Artificial Sequence
  chemically synthesized
atcccgcaagaacatgtcag

SEQ ID NO: 123963 - DNA, 20 bp, Artificial Sequence
  chemically synthesized
gaggtgtccataggggattt

SEQ ID NO: 123964 - DNA, 20 bp, Artificial Sequence
  chemically synthesized
gaggttgccaaaatccccta

SEQ ID NO: 123965 - DNA, 20 bp, Artificial Sequence
  chemically synthesized
ggagaatgaggtgtccatag

SEQ ID NO: 123966 - DNA, 20 bp, Artificial Sequence
  chemically synthesized
tggagaatgaggtgtccata

SEQ ID NO: 123967 - DNA, 20 bp, Artificial Sequence
  chemically synthesized
ctggagaatgaggtgtccat

SEQ ID NO: 123968 - DNA, 20 bp, Artificial Sequence
  chemically synthesized
tctggagaatgaggtgtcca

SEQ ID NO: 123969 - DNA, 20 bp, Artificial Sequence
  chemically synthesized
cctatggacacctcattctc

SEQ ID NO: 123970 - DNA, 20 bp, Artificial Sequence
  chemically synthesized
cagtgaagctctggagaatg

SEQ ID NO: 123971 - DNA, 20 bp, Artificial Sequence
  chemically synthesized
ccagtgaagctctggagaat

SEQ ID NO: 123972 - DNA, 20 bp, Artificial Sequence
  chemically synthesized
tatggacacctcattctcca

SEQ ID NO: 123973 - DNA, 20 bp, Artificial Sequence
  chemically synthesized
aaacttccagtgaagctctg

SEQ ID NO: 123974 - DNA, 20 bp, Artificial Sequence
  chemically synthesized
aaaaacttccagtgaagctc

SEQ ID NO: 123975 - DNA, 20 bp, Artificial Sequence
  chemically synthesized
ctcattctccagagcttcac

SEQ ID NO: 123976 - DNA, 20 bp, Artificial Sequence
  chemically synthesized
attctccagagcttcactgg

SEQ ID NO: 123977 - DNA, 20 bp, Artificial Sequence
  chemically synthesized
ctggagaaaaacttccagtg

SEQ ID NO: 123978 - DNA, 20 bp, Artificial Sequence
  chemically synthesized
taggtctggagaaaaacttc

SEQ ID NO: 123979 - DNA, 20 bp, Artificial Sequence
  chemically synthesized
cttcactggaagtttttctc

SEQ ID NO: 123980 - DNA, 20 bp, Artificial Sequence
  chemically synthesized
ttgagataaacataggtctg

SEQ ID NO: 123981 - DNA, 20 bp, Artificial Sequence
  chemically synthesized
agttgagataaacataggtc

SEQ ID NO: 123982 - DNA, 20 bp, Artificial Sequence
  chemically synthesized
atgctagttgagataaacat

SEQ ID NO: 123983 - DNA, 20 bp, Artificial Sequence
  chemically synthesized
gatgctagttgagataaaca

SEQ ID NO: 123984 - DNA, 20 bp, Artificial Sequence
  chemically synthesized
agacctatgtttatctcaac

SEQ ID NO: 123985 - DNA, 20 bp, Artificial Sequence
  chemically synthesized
ctaaggctgtgatgctagtt

SEQ ID NO: 123986 - DNA, 20 bp, Artificial Sequence
  chemically synthesized
gtttatctcaactagcatca

SEQ ID NO: 123987 - DNA, 20 bp, Artificial Sequence
  chemically synthesized
ggttcctaaggctgtgatgc

SEQ ID NO: 123988 - DNA, 20 bp, Artificial Sequence
  chemically synthesized
ctcaactagcatcacagcct

SEQ ID NO: 123989 - DNA, 20 bp, Artificial Sequence
  chemically synthesized
tcaactagcatcacagcctt

SEQ ID NO: 123990 - DNA, 20 bp, Artificial Sequence
  chemically synthesized
tttaacataacaggttccta

SEQ ID NO: 123991 - DNA, 20 bp, Artificial Sequence
  chemically synthesized
ctttaacataacaggttcct

SEQ ID NO: 123992 - DNA, 20 bp, Artificial Sequence
  chemically synthesized
cagcaattctttaacataac

SEQ ID NO: 123993 - DNA, 20 bp, Artificial Sequence
  chemically synthesized
gcagcaattctttaacataa

SEQ ID NO: 123994 - DNA, 20 bp, Artificial Sequence
  chemically synthesized
cttaggaacctgttatgtta

SEQ ID NO: 123995 - DNA, 20 bp, Artificial Sequence
  chemically synthesized
gttaaagaattgctgctaat

SEQ ID NO: 123996 - DNA, 20 bp, Artificial Sequence
  chemically synthesized
tgttggtccaaaccaattag

SEQ ID NO: 123997 - DNA, 20 bp, Artificial Sequence
  chemically synthesized
agaattgctgctaattggtt

SEQ ID NO: 123998 - DNA, 20 bp, Artificial Sequence
  chemically synthesized
gggtgttggtccaaaccaat

SEQ ID NO: 123999 - DNA, 20 bp, Artificial Sequence
  chemically synthesized
attggtttggaccaacaccc

SEQ ID NO: 124000 - DNA, 20 bp, Artificial Sequence
  chemically synthesized
aagccctagctccagggtgt

SEQ ID NO: 124001 - DNA, 20 bp, Artificial Sequence
  chemically synthesized
tggtttggaccaacaccctg

SEQ ID NO: 124002 - DNA, 20 bp, Artificial Sequence
  chemically synthesized
ttggaccaacaccctggagc

SEQ ID NO: 124003 - DNA, 20 bp, Artificial Sequence
  chemically synthesized
tggaccaacaccctggagct

SEQ ID NO: 124004 - DNA, 20 bp, Artificial Sequence
  chemically synthesized
taggaaaagccctagctcca

SEQ ID NO: 124005 - DNA, 20 bp, Artificial Sequence
  chemically synthesized
ggaccaacaccctggagcta

SEQ ID NO: 124006 - DNA, 20 bp, Artificial Sequence
  chemically synthesized
ctaggaaaagccctagctcc

SEQ ID NO: 124007 - DNA, 20 bp, Artificial Sequence
  chemically synthesized
tctaggaaaagccctagctc

SEQ ID NO: 124008 - DNA, 20 bp, Artificial Sequence
  chemically synthesized
taactttctaggaaaagccc

SEQ ID NO: 124009 - DNA, 20 bp, Artificial Sequence
  chemically synthesized
cctggagctagggcttttcc

SEQ ID NO: 124010 - DNA, 20 bp, Artificial Sequence
  chemically synthesized
tagagataactttctaggaa

SEQ ID NO: 124011 - DNA, 20 bp, Artificial Sequence
  chemically synthesized
gagctagggcttttcctaga

SEQ ID NO: 124012 - DNA, 20 bp, Artificial Sequence
  chemically synthesized
cgacttagagataactttct

SEQ ID NO: 124013 - DNA, 20 bp, Artificial Sequence
  chemically synthesized
ccgacttagagataactttc

SEQ ID NO: 124014 - DNA, 20 bp, Artificial Sequence
  chemically synthesized
tttcctagaaagttatctct

SEQ ID NO: 124015 - DNA, 20 bp, Artificial Sequence
  chemically synthesized
ctagaaagttatctctaagt

SEQ ID NO: 124016 - DNA, 20 bp, Artificial Sequence
  chemically synthesized
tagaaagttatctctaagtc

SEQ ID NO: 124017 - DNA, 20 bp, Artificial Sequence
  chemically synthesized
cctttatttggcccgactta

SEQ ID NO: 124018 - DNA, 20 bp, Artificial Sequence
  chemically synthesized
tgcctttatttggcccgact

SEQ ID NO: 124019 - DNA, 20 bp, Artificial Sequence
  chemically synthesized
tctctaagtcgggccaaata

SEQ ID NO: 124020 - DNA, 20 bp, Artificial Sequence
  chemically synthesized
ctctaagtcgggccaaataa

SEQ ID NO: 124021 - DNA, 20 bp, Artificial Sequence
  chemically synthesized
tacatggccttgcctttatt

SEQ ID NO: 124022 - DNA, 20 bp, Artificial Sequence
  chemically synthesized
aagtcgggccaaataaaggc

SEQ ID NO: 124023 - DNA, 20 bp, Artificial Sequence
  chemically synthesized
agtcgggccaaataaaggca

SEQ ID NO: 124024 - DNA, 20 bp, Artificial Sequence
  chemically synthesized
taaaggcaaggccatgtata

SEQ ID NO: 124025 - DNA, 20 bp, Artificial Sequence
  chemically synthesized
aaaggcaaggccatgtatat

SEQ ID NO: 124026 - DNA, 20 bp, Artificial Sequence
  chemically synthesized
ctggaataaacctatataca

SEQ ID NO: 124027 - DNA, 20 bp, Artificial Sequence
  chemically synthesized
ccatgtatataggtttattc

SEQ ID NO: 124028 - DNA, 20 bp, Artificial Sequence
  chemically synthesized
catgtatataggtttattcc

SEQ ID NO: 124029 - DNA, 20 bp, Artificial Sequence
  chemically synthesized
atgtatataggtttattcca

SEQ ID NO: 124030 - DNA, 20 bp, Artificial Sequence
  chemically synthesized
gtatataggtttattccagg

SEQ ID NO: 124031 - DNA, 20 bp, Artificial Sequence
  chemically synthesized
tgacctatcttgcagctccc

SEQ ID NO: 124032 - DNA, 20 bp, Artificial Sequence
  chemically synthesized
ggtttattccagggagctgc

SEQ ID NO: 124033 - DNA, 20 bp, Artificial Sequence
  chemically synthesized
tattccagggagctgcaaga

SEQ ID NO: 124034 - DNA, 20 bp, Artificial Sequence
  chemically synthesized
attccagggagctgcaagat

SEQ ID NO: 124035 - DNA, 20 bp, Artificial Sequence
  chemically synthesized
ccactgtttgacctatcttg

SEQ ID NO: 124036 - DNA, 20 bp, Artificial Sequence
  chemically synthesized
gagctgcaagataggtcaaa

SEQ ID NO: 124037 - DNA, 20 bp, Artificial Sequence
  chemically synthesized
ctgcaagataggtcaaacag

SEQ ID NO: 124038 - DNA, 20 bp, Artificial Sequence
  chemically synthesized
aagataggtcaaacagtggc

SEQ ID NO: 124039 - DNA, 20 bp, Artificial Sequence
  chemically synthesized
agataggtcaaacagtggca

SEQ ID NO: 124040 - DNA, 20 bp, Artificial Sequence
  chemically synthesized
tcaaacagtggcaaggttct

SEQ ID NO: 124041 - DNA, 20 bp, Artificial Sequence
  chemically synthesized
aaaaaggccaattttattcc

SEQ ID NO: 124042 - DNA, 20 bp, Artificial Sequence
  chemically synthesized
caaggttcttggaataaaat

SEQ ID NO: 124043 - DNA, 20 bp, Artificial Sequence
  chemically synthesized
gaataaaattggcctttttg

SEQ ID NO: 124044 - DNA, 20 bp, Artificial Sequence
  chemically synthesized
aggattggaattcttcaaaa

SEQ ID NO: 124045 - DNA, 20 bp, Artificial Sequence
  chemically synthesized
caggattggaattcttcaaa

SEQ ID NO: 124046 - DNA, 20 bp, Artificial Sequence
  chemically synthesized
tttttgaagaattccaatcc

SEQ ID NO: 124047 - DNA, 20 bp, Artificial Sequence
  chemically synthesized
cagagagtgtagaccaggat

SEQ ID NO: 124048 - DNA, 20 bp, Artificial Sequence
  chemically synthesized
gccaccagagagtgtagacc

SEQ ID NO: 124049 - DNA, 20 bp, Artificial Sequence
  chemically synthesized
agccaccagagagtgtagac

SEQ ID NO: 124050 - DNA, 20 bp, Artificial Sequence
  chemically synthesized
caatcctggtctacactctc

SEQ ID NO: 124051 - DNA, 20 bp, Artificial Sequence
  chemically synthesized
cttttagccaccagagagtg

SEQ ID NO: 124052 - DNA, 20 bp, Artificial Sequence
  chemically synthesized
tcctggtctacactctctgg

SEQ ID NO: 124053 - DNA, 20 bp, Artificial Sequence
  chemically synthesized
gcagccttttagccaccaga

SEQ ID NO: 124054 - DNA, 20 bp, Artificial Sequence
  chemically synthesized
tagcagccttttagccacca

SEQ ID NO: 124055 - DNA, 20 bp, Artificial Sequence
  chemically synthesized
actagcagccttttagccac

SEQ ID NO: 124056 - DNA, 20 bp, Artificial Sequence
  chemically synthesized
ctacactctctggtggctaa

SEQ ID NO: 124057 - DNA, 20 bp, Artificial Sequence
  chemically synthesized
tacactctctggtggctaaa

SEQ ID NO: 124058 - DNA, 20 bp, Artificial Sequence
  chemically synthesized
tgtgaaaactagcagccttt

SEQ ID NO: 124059 - DNA, 20 bp, Artificial Sequence
  chemically synthesized
tctggtggctaaaaggctgc

SEQ ID NO: 124060 - DNA, 20 bp, Artificial Sequence
  chemically synthesized
ataatagctgtgaaaactag

SEQ ID NO: 124061 - DNA, 20 bp, Artificial Sequence
  chemically synthesized
taaaaggctgctagttttca

SEQ ID NO: 124062 - DNA, 20 bp, Artificial Sequence
  chemically synthesized
accataatagctgtgaaaac

SEQ ID NO: 124063 - DNA, 20 bp, Artificial Sequence
  chemically synthesized
gctagttttcacagctatta

SEQ ID NO: 124064 - DNA, 20 bp, Artificial Sequence
  chemically synthesized
cagtagccttgcaaccataa

SEQ ID NO: 124065 - DNA, 20 bp, Artificial Sequence
  chemically synthesized
ttcacagctattatggttgc

SEQ ID NO: 124066 - DNA, 20 bp, Artificial Sequence
  chemically synthesized
tcacagctattatggttgca

SEQ ID NO: 124067 - DNA, 20 bp, Artificial Sequence
  chemically synthesized
acagtagccttgaaaatcag

SEQ ID NO: 124068 - DNA, 20 bp, Artificial Sequence
  chemically synthesized
ttgcaaggctactgattttc

SEQ ID NO: 124069 - DNA, 20 bp, Artificial Sequence
  chemically synthesized
tgcaaggctactgattttca

SEQ ID NO: 124070 - DNA, 20 bp, Artificial Sequence
  chemically synthesized
tccacagtagccttgaaaat

SEQ ID NO: 124071 - DNA, 20 bp, Artificial Sequence
  chemically synthesized
actgattttcaaggctactg

SEQ ID NO: 124072 - DNA, 20 bp, Artificial Sequence
  chemically synthesized
tgattttcaaggctactgtg

SEQ ID NO: 124073 - DNA, 20 bp, Artificial Sequence
  chemically synthesized
actttctcccagctccacag

SEQ ID NO: 124074 - DNA, 20 bp, Artificial Sequence
  chemically synthesized
tttcaaggctactgtggagc

SEQ ID NO: 124075 - DNA, 20 bp, Artificial Sequence
  chemically synthesized
ttcaaggctactgtggagct

SEQ ID NO: 124076 - DNA, 20 bp, Artificial Sequence
  chemically synthesized
gtcactttctcccagctcca

SEQ ID NO: 124077 - DNA, 20 bp, Artificial Sequence
  chemically synthesized
caaggctactgtggagctgg

SEQ ID NO: 124078 - DNA, 20 bp, Artificial Sequence
  chemically synthesized
gctactgtggagctgggaga

SEQ ID NO: 124079 - DNA, 20 bp, Artificial Sequence
  chemically synthesized
cctttcccgtcactttctcc

SEQ ID NO: 124080 - DNA, 20 bp, Artificial Sequence
  chemically synthesized
gtggagctgggagaaagtga

SEQ ID NO: 124081 - DNA, 20 bp, Artificial Sequence
  chemically synthesized
tggagctgggagaaagtgac

SEQ ID NO: 124082 - DNA, 20 bp, Artificial Sequence
  chemically synthesized
gctgggagaaagtgacggga

SEQ ID NO: 124083 - DNA, 20 bp, Artificial Sequence
  chemically synthesized
ctgggagaaagtgacgggaa

SEQ ID NO: 124084 - DNA, 20 bp, Artificial Sequence
  chemically synthesized
aagtttgaggttttttaagt

SEQ ID NO: 124085 - DNA, 20 bp, Artificial Sequence
  chemically synthesized
ggcaaagtttgaggtttttt

SEQ ID NO: 124086 - DNA, 20 bp, Artificial Sequence
  chemically synthesized
aataaaaatggcaaagtttg

SEQ ID NO: 124087 - DNA, 20 bp, Artificial Sequence
  chemically synthesized
caataaaaatggcaaagttt

SEQ ID NO: 124088 - DNA, 20 bp, Artificial Sequence
  chemically synthesized
gactctcaataaaaatggca

SEQ ID NO: 124089 - DNA, 20 bp, Artificial Sequence
  chemically synthesized
atgctgactctcaataaaaa

SEQ ID NO: 124090 - DNA, 20 bp, Artificial Sequence
  chemically synthesized
caaactttgccatttttatt

SEQ ID NO: 124091 - DNA, 20 bp, Artificial Sequence
  chemically synthesized
aactttgccatttttattga

SEQ ID NO: 124092 - DNA, 20 bp, Artificial Sequence
  chemically synthesized
ttgccatttttattgagagt

SEQ ID NO: 124093 - DNA, 20 bp, Artificial Sequence
  chemically synthesized
agcatttcaaaaattgttgc

SEQ ID NO: 124094 - DNA, 20 bp, Artificial Sequence
  chemically synthesized
caaaaattgttgccagcctt

SEQ ID NO: 124095 - DNA, 20 bp, Artificial Sequence
  chemically synthesized
cctgggaattaaccaaaggc

SEQ ID NO: 124096 - DNA, 20 bp, Artificial Sequence
  chemically synthesized
gaaccctgggaattaaccaa

SEQ ID NO: 124097 - DNA, 20 bp, Artificial Sequence
  chemically synthesized
tgaaccctgggaattaacca

SEQ ID NO: 124098 - DNA, 20 bp, Artificial Sequence
  chemically synthesized
gccagcctttggttaattcc

SEQ ID NO: 124099 - DNA, 20 bp, Artificial Sequence
  chemically synthesized
ccagcctttggttaattccc

SEQ ID NO: 124100 - DNA, 20 bp, Artificial Sequence
  chemically synthesized
cagcctttggttaattccca

SEQ ID NO: 124101 - DNA, 20 bp, Artificial Sequence
  chemically synthesized
tttggttaattcccagggtt

SEQ ID NO: 124102 - DNA, 20 bp, Artificial Sequence
  chemically synthesized
catcgccttttctgaaccct

SEQ ID NO: 124103 - DNA, 20 bp, Artificial Sequence
  chemically synthesized
acatcgccttttctgaaccc

SEQ ID NO: 124104 - DNA, 20 bp, Artificial Sequence
  chemically synthesized
ttaattcccagggttcagaa

SEQ ID NO: 124105 - DNA, 20 bp, Artificial Sequence
  chemically synthesized
taattcccagggttcagaaa

SEQ ID NO: 124106 - DNA, 20 bp, Artificial Sequence
  chemically synthesized
agggttcagaaaaggcgatg

SEQ ID NO: 124107 - DNA, 20 bp, Artificial Sequence
  chemically synthesized
gggttcagaaaaggcgatgt

SEQ ID NO: 124108 - DNA, 20 bp, Artificial Sequence
  chemically synthesized
ggttcagaaaaggcgatgtg

SEQ ID NO: 124109 - DNA, 20 bp, Artificial Sequence
  chemically synthesized
cagaaaaggcgatgtggggc

SEQ ID NO: 124110 - DNA, 20 bp, Artificial Sequence
  chemically synthesized
agaaaaggcgatgtggggcc

SEQ ID NO: 124111 - DNA, 20 bp, Artificial Sequence
  chemically synthesized
cgatgtggggccaggcatgt

SEQ ID NO: 124112 - DNA, 20 bp, Artificial Sequence
  chemically synthesized
caggcgtgagccaacatgcc

SEQ ID NO: 124113 - DNA, 20 bp, Artificial Sequence
  chemically synthesized
aagtgctgggatacaggcgt

SEQ ID NO: 124114 - DNA, 20 bp, Artificial Sequence
  chemically synthesized
gttggctcacgcctgtatcc

SEQ ID NO: 124115 - DNA, 20 bp, Artificial Sequence
  chemically synthesized
ctcccaaagtgctgggatac

SEQ ID NO: 124116 - DNA, 20 bp, Artificial Sequence
  chemically synthesized
cctcccaaagtgctgggata

SEQ ID NO: 124117 - DNA, 20 bp, Artificial Sequence
  chemically synthesized
acgcctgtatcccagcactt

SEQ ID NO: 124118 - DNA, 20 bp, Artificial Sequence
  chemically synthesized
cttcagcctcccaaagtgct

SEQ ID NO: 124119 - DNA, 20 bp, Artificial Sequence
  chemically synthesized
cgcctgtatcccagcacttt

SEQ ID NO: 124120 - DNA, 20 bp, Artificial Sequence
  chemically synthesized
acttcagcctcccaaagtgc

SEQ ID NO: 124121 - DNA, 20 bp, Artificial Sequence
  chemically synthesized
cctgtatcccagcactttgg

SEQ ID NO: 124122 - DNA, 20 bp, Artificial Sequence
  chemically synthesized
ctgtatcccagcactttggg

SEQ ID NO: 124123 - DNA, 20 bp, Artificial Sequence
  chemically synthesized
ccgcccacttcagcctccca

SEQ ID NO: 124124 - DNA, 20 bp, Artificial Sequence
  chemically synthesized
cccagcactttgggaggctg

SEQ ID NO: 124125 - DNA, 20 bp, Artificial Sequence
  chemically synthesized
agcactttgggaggctgaag

SEQ ID NO: 124126 - DNA, 20 bp, Artificial Sequence
  chemically synthesized
gcactttgggaggctgaagt

SEQ ID NO: 124127 - DNA, 20 bp, Artificial Sequence
  chemically synthesized
ctttgggaggctgaagtggg

SEQ ID NO: 124128 - DNA, 20 bp, Artificial Sequence
  chemically synthesized
ctcgagtgttccgcccactt

SEQ ID NO: 124129 - DNA, 20 bp, Artificial Sequence
  chemically synthesized
ctgaagtgggcggaacactc

SEQ ID NO: 124130 - DNA, 20 bp, Artificial Sequence
  chemically synthesized
tgaagtgggcggaacactcg

SEQ ID NO: 124131 - DNA, 20 bp, Artificial Sequence
  chemically synthesized
gtgggcggaacactcgaggt

SEQ ID NO: 124132 - DNA, 20 bp, Artificial Sequence
  chemically synthesized
tgggcggaacactcgaggtc

SEQ ID NO: 124133 - DNA, 20 bp, Artificial Sequence
  chemically synthesized
ggtctcaaactcctgacctc

SEQ ID NO: 124134 - DNA, 20 bp, Artificial Sequence
  chemically synthesized
ggcggaacactcgaggtcag

SEQ ID NO: 124135 - DNA, 20 bp, Artificial Sequence
  chemically synthesized
acactcgaggtcaggagttt

SEQ ID NO: 124136 - DNA, 20 bp, Artificial Sequence
  chemically synthesized
cgaggtcaggagtttgagac

SEQ ID NO: 124137 - DNA, 20 bp, Artificial Sequence
  chemically synthesized
tcaggagtttgagaccagcc

SEQ ID NO: 124138 - DNA, 20 bp, Artificial Sequence
  chemically synthesized
tttcactatgttggccaggc

SEQ ID NO: 124139 - DNA, 20 bp, Artificial Sequence
  chemically synthesized
agggtttcactatgttggcc

SEQ ID NO: 124140 - DNA, 20 bp, Artificial Sequence
  chemically synthesized
tgagaccagcctggccaaca

SEQ ID NO: 124141 - DNA, 20 bp, Artificial Sequence
  chemically synthesized
cagggtttcactatgttggc

SEQ ID NO: 124142 - DNA, 20 bp, Artificial Sequence
  chemically synthesized
gagacagggtttcactatgt

SEQ ID NO: 124143 - DNA, 20 bp, Artificial Sequence
  chemically synthesized
tcgtgtttttagtagagaca

SEQ ID NO: 124144 - DNA, 20 bp, Artificial Sequence
  chemically synthesized
ctcgtgtttttagtagagac

SEQ ID NO: 124145 - DNA, 20 bp, Artificial Sequence
  chemically synthesized
tctcgtgtttttagtagaga

SEQ ID NO: 124146 - DNA, 20 bp, Artificial Sequence
  chemically synthesized
tatttctcgtgtttttagta

SEQ ID NO: 124147 - DNA, 20 bp, Artificial Sequence
  chemically synthesized
actatttctcgtgtttttag

SEQ ID NO: 124148 - DNA, 20 bp, Artificial Sequence
  chemically synthesized
cctgtctctactaaaaacac

SEQ ID NO: 124149 - DNA, 20 bp, Artificial Sequence
  chemically synthesized
ccaactatttctcgtgtttt

SEQ ID NO: 124150 - DNA, 20 bp, Artificial Sequence
  chemically synthesized
tctactaaaaacacgagaaa

SEQ ID NO: 124151 - DNA, 20 bp, Artificial Sequence
  chemically synthesized
ctaaaaacacgagaaatagt

SEQ ID NO: 124152 - DNA, 20 bp, Artificial Sequence
  chemically synthesized
taaaaacacgagaaatagtt

SEQ ID NO: 124153 - DNA, 20 bp, Artificial Sequence
  chemically synthesized
acacgagaaatagttgggcg

SEQ ID NO: 124154 - DNA, 20 bp, Artificial Sequence
  chemically synthesized
cgagaaatagttgggcgtgg

SEQ ID NO: 124155 - DNA, 20 bp, Artificial Sequence
  chemically synthesized
ggcgtggtggaatgtgcctg

SEQ ID NO: 124156 - DNA, 20 bp, Artificial Sequence
  chemically synthesized
tcccaagtagatggaactac

SEQ ID NO: 124157 - DNA, 20 bp, Artificial Sequence
  chemically synthesized
atcccaagtagatggaacta

SEQ ID NO: 124158 - DNA, 20 bp, Artificial Sequence
  chemically synthesized
tgcctgtagttccatctact

SEQ ID NO: 124159 - DNA, 20 bp, Artificial Sequence
  chemically synthesized
gcctgtagttccatctactt

SEQ ID NO: 124160 - DNA, 20 bp, Artificial Sequence
  chemically synthesized
ctctcagcatcccaagtaga

SEQ ID NO: 124161 - DNA, 20 bp, Artificial Sequence
  chemically synthesized
gagtctctcagcatcccaag

SEQ ID NO: 124162 - DNA, 20 bp, Artificial Sequence
  chemically synthesized
agtgagtctctcagcatccc

SEQ ID NO: 124163 - DNA, 20 bp, Artificial Sequence
  chemically synthesized
ttccatctacttgggatgct

SEQ ID NO: 124164 - DNA, 20 bp, Artificial Sequence
  chemically synthesized
ccatctacttgggatgctga

SEQ ID NO: 124165 - DNA, 20 bp, Artificial Sequence
  chemically synthesized
ctgtgatcaagtgagtctct

SEQ ID NO: 124166 - DNA, 20 bp, Artificial Sequence
  chemically synthesized
tccacctcctgtgatcaagt

SEQ ID NO: 124167 - DNA, 20 bp, Artificial Sequence
  chemically synthesized
ctgagagactcacttgatca

SEQ ID NO: 124168 - DNA, 20 bp, Artificial Sequence
  chemically synthesized
tgagagactcacttgatcac

SEQ ID NO: 124169 - DNA, 20 bp, Artificial Sequence
  chemically synthesized
aacctccacctcctgtgatc

SEQ ID NO: 124170 - DNA, 20 bp, Artificial Sequence
  chemically synthesized
agagactcacttgatcacag

SEQ ID NO: 124171 - DNA, 20 bp, Artificial Sequence
  chemically synthesized
gagactcacttgatcacagg

SEQ ID NO: 124172 - DNA, 20 bp, Artificial Sequence
  chemically synthesized
actcacttgatcacaggagg

SEQ ID NO: 124173 - DNA, 20 bp, Artificial Sequence
  chemically synthesized
tcacttgatcacaggaggtg

SEQ ID NO: 124174 - DNA, 20 bp, Artificial Sequence
  chemically synthesized
cacttgatcacaggaggtgg

SEQ ID NO: 124175 - DNA, 20 bp, Artificial Sequence
  chemically synthesized
caggaggtggaggttgcact

SEQ ID NO: 124176 - DNA, 20 bp, Artificial Sequence
  chemically synthesized
ggtggaggttgcactaagcc

SEQ ID NO: 124177 - DNA, 20 bp, Artificial Sequence
  chemically synthesized
gcagtggcatgatcttggct

SEQ ID NO: 124178 - DNA, 20 bp, Artificial Sequence
  chemically synthesized
ggagtgcagtggcatgatct

SEQ ID NO: 124179 - DNA, 20 bp, Artificial Sequence
  chemically synthesized
tcacccaggctggagtgcag

SEQ ID NO: 124180 - DNA, 20 bp, Artificial Sequence
  chemically synthesized
aagatcatgccactgcactc

SEQ ID NO: 124181 - DNA, 20 bp, Artificial Sequence
  chemically synthesized
ctgtcacccaggctggagtg

SEQ ID NO: 124182 - DNA, 20 bp, Artificial Sequence
  chemically synthesized
catgccactgcactccagcc

SEQ ID NO: 124183 - DNA, 20 bp, Artificial Sequence
  chemically synthesized
atgccactgcactccagcct

SEQ ID NO: 124184 - DNA, 20 bp, Artificial Sequence
  chemically synthesized
tcactctgtcacccaggctg

SEQ ID NO: 124185 - DNA, 20 bp, Artificial Sequence
  chemically synthesized
tctcactctgtcacccaggc

SEQ ID NO: 124186 - DNA, 20 bp, Artificial Sequence
  chemically synthesized
ctgcactccagcctgggtga

SEQ ID NO: 124187 - DNA, 20 bp, Artificial Sequence
  chemically synthesized
ggagtctcactctgtcaccc

SEQ ID NO: 124188 - DNA, 20 bp, Artificial Sequence
  chemically synthesized
gcactccagcctgggtgaca

SEQ ID NO: 124189 - DNA, 20 bp, Artificial Sequence
  chemically synthesized
tggagtctcactctgtcacc

SEQ ID NO: 124190 - DNA, 20 bp, Artificial Sequence
  chemically synthesized
tccagcctgggtgacagagt

SEQ ID NO: 124191 - DNA, 20 bp, Artificial Sequence
  chemically synthesized
tttttcctttttttgagatg

SEQ ID NO: 124192 - DNA, 20 bp, Artificial Sequence
  chemically synthesized
tttttttcctttttttgaga

SEQ ID NO: 124193 - DNA, 20 bp, Artificial Sequence
  chemically synthesized
gtgagactccatctcaaaaa

SEQ ID NO: 124194 - DNA, 20 bp, Artificial Sequence
  chemically synthesized
tgagactccatctcaaaaaa

SEQ ID NO: 124195 - DNA, 20 bp, Artificial Sequence
  chemically synthesized
tttctttttttccttttttt

SEQ ID NO: 124196 - DNA, 20 bp, Artificial Sequence
  chemically synthesized
catctcaaaaaaaggaaaaa

SEQ ID NO: 124197 - DNA, 20 bp, Artificial Sequence
  chemically synthesized
tcaaaaaaaggaaaaaaaga

SEQ ID NO: 124198 - DNA, 20 bp, Artificial Sequence
  chemically synthesized
aaaaggaaaaaaagaaagaa

SEQ ID NO: 124199 - DNA, 20 bp, Artificial Sequence
  chemically synthesized
aaaaaagaaagaaaagaaaa

SEQ ID NO: 124200 - DNA, 20 bp, Artificial Sequence
  chemically synthesized
agaaagaaaagaaaaaagaa

SEQ ID NO: 124201 - DNA, 20 bp, Artificial Sequence
  chemically synthesized
gatgatttcgaaaatttttt

SEQ ID NO: 124202 - DNA, 20 bp, Artificial Sequence
  chemically synthesized
atgatttcgaaaattttttg

SEQ ID NO: 124203 - DNA, 20 bp, Artificial Sequence
  chemically synthesized
gatttcgaaaattttttgag

SEQ ID NO: 124204 - DNA, 20 bp, Artificial Sequence
  chemically synthesized
ttcgaaaattttttgaggag

SEQ ID NO: 124205 - DNA, 20 bp, Artificial Sequence
  chemically synthesized
ttttgaggagcagatttaca

SEQ ID NO: 124206 - DNA, 20 bp, Artificial Sequence
  chemically synthesized
ccgtgcttgaaaatataatg

SEQ ID NO: 124207 - DNA, 20 bp, Artificial Sequence
  chemically synthesized
agttaccacattatattttc

SEQ ID NO: 124208 - DNA, 20 bp, Artificial Sequence
  chemically synthesized
ccacattatattttcaagca

SEQ ID NO: 124209 - DNA, 20 bp, Artificial Sequence
  chemically synthesized
cacattatattttcaagcac

SEQ ID NO: 124210 - DNA, 20 bp, Artificial Sequence
  chemically synthesized
tatattttcaagcacgggat

SEQ ID NO: 124211 - DNA, 20 bp, Artificial Sequence
  chemically synthesized
gggataagttaaattgtgaa

SEQ ID NO: 124212 - DNA, 20 bp, Artificial Sequence
  chemically synthesized
ttaaattgtgaaaagcaaac

SEQ ID NO: 124213 - DNA, 20 bp, Artificial Sequence
  chemically synthesized
aaattgtgaaaagcaaacta

SEQ ID NO: 124214 - DNA, 20 bp, Artificial Sequence
  chemically synthesized
tgattgtaccatattttctc

SEQ ID NO: 124215 - DNA, 20 bp, Artificial Sequence
  chemically synthesized
aaagcaaactagagaaaata

SEQ ID NO: 124216 - DNA, 20 bp, Artificial Sequence
  chemically synthesized
gagaaaatatggtacaatca

SEQ ID NO: 124217 - DNA, 20 bp, Artificial Sequence
  chemically synthesized
tatggtacaatcaaagcata

SEQ ID NO: 124218 - DNA, 20 bp, Artificial Sequence
  chemically synthesized
atcaaagcataaagttattc

SEQ ID NO: 124219 - DNA, 20 bp, Artificial Sequence
  chemically synthesized
tcaaagcataaagttattca

SEQ ID NO: 124220 - DNA, 20 bp, Artificial Sequence
  chemically synthesized
gcataaagttattcaaggct

SEQ ID NO: 124221 - DNA, 20 bp, Artificial Sequence
  chemically synthesized
atatttaatgcagagtcacc

SEQ ID NO: 124222 - DNA, 20 bp, Artificial Sequence
  chemically synthesized
ttatataaatatttaatgca

SEQ ID NO: 124223 - DNA, 20 bp, Artificial Sequence
  chemically synthesized
tattatataaatatttaatg

SEQ ID NO: 124224 - DNA, 20 bp, Artificial Sequence
  chemically synthesized
taaatatttatataatataa

SEQ ID NO: 124225 - DNA, 20 bp, Artificial Sequence
  chemically synthesized
tatataatataatagttacc

SEQ ID NO: 124226 - DNA, 20 bp, Artificial Sequence
  chemically synthesized
atataatataatagttacct

SEQ ID NO: 124227 - DNA, 20 bp, Artificial Sequence
  chemically synthesized
tataatataatagttacctg

SEQ ID NO: 124228 - DNA, 20 bp, Artificial Sequence
  chemically synthesized
agtaatgggctagtttcccc

SEQ ID NO: 124229 - DNA, 20 bp, Artificial Sequence
  chemically synthesized
taatagttacctggggaaac

SEQ ID NO: 124230 - DNA, 20 bp, Artificial Sequence
  chemically synthesized
tagtaatgggctagtttccc

SEQ ID NO: 124231 - DNA, 20 bp, Artificial Sequence
  chemically synthesized
gaacacaggtagtaatgggc

SEQ ID NO: 124232 - DNA, 20 bp, Artificial Sequence
  chemically synthesized
gatagaacacaggtagtaat

SEQ ID NO: 124233 - DNA, 20 bp, Artificial Sequence
  chemically synthesized
tgatagaacacaggtagtaa

SEQ ID NO: 124234 - DNA, 20 bp, Artificial Sequence
  chemically synthesized
cattgctgatagaacacagg

SEQ ID NO: 124235 - DNA, 20 bp, Artificial Sequence
  chemically synthesized
ctacattgctgatagaacac

SEQ ID NO: 124236 - DNA, 20 bp, Artificial Sequence
  chemically synthesized
tctacattgctgatagaaca

SEQ ID NO: 124237 - DNA, 20 bp, Artificial Sequence
  chemically synthesized
cattactacctgtgttctat

SEQ ID NO: 124238 - DNA, 20 bp, Artificial Sequence
  chemically synthesized
agtgctctctacattgctga

SEQ ID NO: 124239 - DNA, 20 bp, Artificial Sequence
  chemically synthesized
cctgtgttctatcagcaatg

SEQ ID NO: 124240 - DNA, 20 bp, Artificial Sequence
  chemically synthesized
tgtgttctatcagcaatgta

SEQ ID NO: 124241 - DNA, 20 bp, Artificial Sequence
  chemically synthesized
tgttctatcagcaatgtaga

SEQ ID NO: 124242 - DNA, 20 bp, Artificial Sequence
  chemically synthesized
gttctcaaagcatacaaaca

SEQ ID NO: 124243 - DNA, 20 bp, Artificial Sequence
  chemically synthesized
aagttctcaaagcatacaaa

SEQ ID NO: 124244 - DNA, 20 bp, Artificial Sequence
  chemically synthesized
gcactctgtttgtatgcttt

SEQ ID NO: 124245 - DNA, 20 bp, Artificial Sequence
  chemically synthesized
tgaaactcttaaagttctca

SEQ ID NO: 124246 - DNA, 20 bp, Artificial Sequence
  chemically synthesized
ttgtatgctttgagaacttt

SEQ ID NO: 124247 - DNA, 20 bp, Artificial Sequence
  chemically synthesized
gtatgctttgagaactttaa

SEQ ID NO: 124248 - DNA, 20 bp, Artificial Sequence
  chemically synthesized
aagtatgcatgaaactctta

SEQ ID NO: 124249 - DNA, 20 bp, Artificial Sequence
  chemically synthesized
taagagtttcatgcatactt

SEQ ID NO: 124250 - DNA, 20 bp, Artificial Sequence
  chemically synthesized
gagtttcatgcatactttag

SEQ ID NO: 124251 - DNA, 20 bp, Artificial Sequence
  chemically synthesized
agtttcatgcatactttaga

SEQ ID NO: 124252 - DNA, 20 bp, Artificial Sequence
  chemically synthesized
caatagtacttttccttcta

SEQ ID NO: 124253 - DNA, 20 bp, Artificial Sequence
  chemically synthesized
catgcatactttagaaggaa

SEQ ID NO: 124254 - DNA, 20 bp, Artificial Sequence
  chemically synthesized
tttagaaggaaaagtactat

SEQ ID NO: 124255 - DNA, 20 bp, Artificial Sequence
  chemically synthesized
ttagaaggaaaagtactatt

SEQ ID NO: 124256 - DNA, 20 bp, Artificial Sequence
  chemically synthesized
agaaaagatcaataacccaa

SEQ ID NO: 124257 - DNA, 20 bp, Artificial Sequence
  chemically synthesized
ttctatgtgattaaagagaa

SEQ ID NO: 124258 - DNA, 20 bp, Artificial Sequence
  chemically synthesized
aaagcttctatgtgattaaa

SEQ ID NO: 124259 - DNA, 20 bp, Artificial Sequence
  chemically synthesized
ctaaagcttctatgtgatta

SEQ ID NO: 124260 - DNA, 20 bp, Artificial Sequence
  chemically synthesized
atcttttctctttaatcaca

SEQ ID NO: 124261 - DNA, 20 bp, Artificial Sequence
  chemically synthesized
ttttctctttaatcacatag

SEQ ID NO: 124262 - DNA, 20 bp, Artificial Sequence
  chemically synthesized
ctttaatcacatagaagctt

SEQ ID NO: 124263 - DNA, 20 bp, Artificial Sequence
  chemically synthesized
tttaatcacatagaagcttt

SEQ ID NO: 124264 - DNA, 20 bp, Artificial Sequence
  chemically synthesized
ttaatcacatagaagcttta

SEQ ID NO: 124265 - DNA, 20 bp, Artificial Sequence
  chemically synthesized
taatcacatagaagctttag

SEQ ID NO: 124266 - DNA, 20 bp, Artificial Sequence
  chemically synthesized
atcacatagaagctttaggg

SEQ ID NO: 124267 - DNA, 20 bp, Artificial Sequence
  chemically synthesized
ttcccttttgttctccccta

SEQ ID NO: 124268 - DNA, 20 bp, Artificial Sequence
  chemically synthesized
gaagctttaggggagaacaa

SEQ ID NO: 124269 - DNA, 20 bp, Artificial Sequence
  chemically synthesized
aagctttaggggagaacaaa

SEQ ID NO: 124270 - DNA, 20 bp, Artificial Sequence
  chemically synthesized
agctttaggggagaacaaaa

SEQ ID NO: 124271 - DNA, 20 bp, Artificial Sequence
  chemically synthesized
ggggagaacaaaagggaata

SEQ ID NO: 124272 - DNA, 20 bp, Artificial Sequence
  chemically synthesized
gggaataaagaaaatacatg

SEQ ID NO: 124273 - DNA, 20 bp, Artificial Sequence
  chemically synthesized
aaagaaaatacatgaagaaa

SEQ ID NO: 124274 - DNA, 20 bp, Artificial Sequence
  chemically synthesized
gaaaatacatgaagaaatgg

SEQ ID NO: 124275 - DNA, 20 bp, Artificial Sequence
  chemically synthesized
aaaatacatgaagaaatggt

SEQ ID NO: 124276 - DNA, 20 bp, Artificial Sequence
  chemically synthesized
catgaagaaatggtaggtcc

SEQ ID NO: 124277 - DNA, 20 bp, Artificial Sequence
  chemically synthesized
aagaaatggtaggtcctggc

SEQ ID NO: 124278 - DNA, 20 bp, Artificial Sequence
  chemically synthesized
aaatggtaggtcctggcaag

SEQ ID NO: 124279 - DNA, 20 bp, Artificial Sequence
  chemically synthesized
ttattagaaatcttcttgcc

SEQ ID NO: 124280 - DNA, 20 bp, Artificial Sequence
  chemically synthesized
attattagaaatcttcttgc

SEQ ID NO: 124281 - DNA, 20 bp, Artificial Sequence
  chemically synthesized
acaataatgaaaagcattat

SEQ ID NO: 124282 - DNA, 20 bp, Artificial Sequence
  chemically synthesized
gtttctggtacaataatgaa

SEQ ID NO: 124283 - DNA, 20 bp, Artificial Sequence
  chemically synthesized
aatgcttttcattattgtac

SEQ ID NO: 124284 - DNA, 20 bp, Artificial Sequence
  chemically synthesized
tagtttgaggtttgggtttc

SEQ ID NO: 124285 - DNA, 20 bp, Artificial Sequence
  chemically synthesized
acactagtagtttgaggttt

SEQ ID NO: 124286 - DNA, 20 bp, Artificial Sequence
  chemically synthesized
cacactagtagtttgaggtt

SEQ ID NO: 124287 - DNA, 20 bp, Artificial Sequence
  chemically synthesized
tgacccacactagtagtttg

SEQ ID NO: 124288 - DNA, 20 bp, Artificial Sequence
  chemically synthesized
aaacccaaacctcaaactac

SEQ ID NO: 124289 - DNA, 20 bp, Artificial Sequence
  chemically synthesized
ttgacccacactagtagttt

SEQ ID NO: 124290 - DNA, 20 bp, Artificial Sequence
  chemically synthesized
caaacctcaaactactagtg

SEQ ID NO: 124291 - DNA, 20 bp, Artificial Sequence
  chemically synthesized
aaacctcaaactactagtgt

SEQ ID NO: 124292 - DNA, 20 bp, Artificial Sequence
  chemically synthesized
agcaaattgacccacactag

SEQ ID NO: 124293 - DNA, 20 bp, Artificial Sequence
  chemically synthesized
atcagcaaattgacccacac

SEQ ID NO: 124294 - DNA, 20 bp, Artificial Sequence
  chemically synthesized
ggagttgtacaaaattaaat

SEQ ID NO: 124295 - DNA, 20 bp, Artificial Sequence
  chemically synthesized
tatattttgtgtattttttg

SEQ ID NO: 124296 - DNA, 20 bp, Artificial Sequence
  chemically synthesized
tatatattttgtgtattttt

SEQ ID NO: 124297 - DNA, 20 bp, Artificial Sequence
  chemically synthesized
aaaatacacaaaatatataa

SEQ ID NO: 124298 - DNA, 20 bp, Artificial Sequence
  chemically synthesized
aaatatataaaagaaaaatt

SEQ ID NO: 124299 - DNA, 20 bp, Artificial Sequence
  chemically synthesized
cataaaaatatgtacggtag

SEQ ID NO: 124300 - DNA, 20 bp, Artificial Sequence
  chemically synthesized
caccataaaaatatgtacgg

SEQ ID NO: 124301 - DNA, 20 bp, Artificial Sequence
  chemically synthesized
atccaccataaaaatatgta

SEQ ID NO: 124302 - DNA, 20 bp, Artificial Sequence
  chemically synthesized
cactaccgtacatattttta

SEQ ID NO: 124303 - DNA, 20 bp, Artificial Sequence
  chemically synthesized
taccgtacatatttttatgg

SEQ ID NO: 124304 - DNA, 20 bp, Artificial Sequence
  chemically synthesized
tacatatttttatggtggat

SEQ ID NO: 124305 - DNA, 20 bp, Artificial Sequence
  chemically synthesized
gttatctgtggaaggatcga

SEQ ID NO: 124306 - DNA, 20 bp, Artificial Sequence
  chemically synthesized
tgatgccatcgatccttcca

SEQ ID NO: 124307 - DNA, 20 bp, Artificial Sequence
  chemically synthesized
catttttagttatctgtgga

SEQ ID NO: 124308 - DNA, 20 bp, Artificial Sequence
  chemically synthesized
acatttttagttatctgtgg

SEQ ID NO: 124309 - DNA, 20 bp, Artificial Sequence
  chemically synthesized
cttacatttttagttatctg

SEQ ID NO: 124310 - DNA, 20 bp, Artificial Sequence
  chemically synthesized
ccacagataactaaaaatgt

SEQ ID NO: 124311 - DNA, 20 bp, Artificial Sequence
  chemically synthesized
gaagtagtgccttacatttt

SEQ ID NO: 124312 - DNA, 20 bp, Artificial Sequence
  chemically synthesized
cacagataactaaaaatgta

SEQ ID NO: 124313 - DNA, 20 bp, Artificial Sequence
  chemically synthesized
acatttttcaaatatggaag

SEQ ID NO: 124314 - DNA, 20 bp, Artificial Sequence
  chemically synthesized
gagacatttttcaaatatgg

SEQ ID NO: 124315 - DNA, 20 bp, Artificial Sequence
  chemically synthesized
agggagacatttttcaaata

SEQ ID NO: 124316 - DNA, 20 bp, Artificial Sequence
  chemically synthesized
ttgaaaaatgtctccctttt

SEQ ID NO: 124317 - DNA, 20 bp, Artificial Sequence
  chemically synthesized
aaattattttactaaaaagg

SEQ ID NO: 124318 - DNA, 20 bp, Artificial Sequence
  chemically synthesized
tcaaattattttactaaaaa

SEQ ID NO: 124319 - DNA, 20 bp, Artificial Sequence
  chemically synthesized
ctcaaattattttactaaaa

SEQ ID NO: 124320 - DNA, 20 bp, Artificial Sequence
  chemically synthesized
tctcaaattattttactaaa

SEQ ID NO: 124321 - DNA, 20 bp, Artificial Sequence
  chemically synthesized
cctttttagtaaaataattt

SEQ ID NO: 124322 - DNA, 20 bp, Artificial Sequence
  chemically synthesized
aataatttgagacactcaaa

SEQ ID NO: 124323 - DNA, 20 bp, Artificial Sequence
  chemically synthesized
agtaactaaggcagctattt

SEQ ID NO: 124324 - DNA, 20 bp, Artificial Sequence
  chemically synthesized
agacactcaaatagctgcct

SEQ ID NO: 124325 - DNA, 20 bp, Artificial Sequence
  chemically synthesized
attgtatgtagtaactaagg

SEQ ID NO: 124326 - DNA, 20 bp, Artificial Sequence
  chemically synthesized
cttattgtatgtagtaacta

SEQ ID NO: 124327 - DNA, 20 bp, Artificial Sequence
  chemically synthesized
acttattgtatgtagtaact

SEQ ID NO: 124328 - DNA, 20 bp, Artificial Sequence
  chemically synthesized
aaagttgaacttattgtatg

SEQ ID NO: 124329 - DNA, 20 bp, Artificial Sequence
  chemically synthesized
ccttagttactacatacaat

SEQ ID NO: 124330 - DNA, 20 bp, Artificial Sequence
  chemically synthesized
aatcacataattaattttaa

SEQ ID NO: 124331 - DNA, 20 bp, Artificial Sequence
  chemically synthesized
taaaattaattatgtgatta

SEQ ID NO: 124332 - DNA, 20 bp, Artificial Sequence
  chemically synthesized
ttatagaatgtctgtgtttc

SEQ ID NO: 124333 - DNA, 20 bp, Artificial Sequence
  chemically synthesized
tctttaggaaacttgaaaca

SEQ ID NO: 124334 - DNA, 20 bp, Artificial Sequence
  chemically synthesized
tctgtgtttcaagtttccta

SEQ ID NO: 124335 - DNA, 20 bp, Artificial Sequence
  chemically synthesized
tgtttttgaaggcattcttt

SEQ ID NO: 124336 - DNA, 20 bp, Artificial Sequence
  chemically synthesized
gtgtttttgaaggcattctt

SEQ ID NO: 124337 - DNA, 20 bp, Artificial Sequence
  chemically synthesized
caaaatctctgtgtttttga

SEQ ID NO: 124338 - DNA, 20 bp, Artificial Sequence
  chemically synthesized
gcaaaatctctgtgtttttg

SEQ ID NO: 124339 - DNA, 20 bp, Artificial Sequence
  chemically synthesized
aaagaatgccttcaaaaaca

SEQ ID NO: 124340 - DNA, 20 bp, Artificial Sequence
  chemically synthesized
agaatgccttcaaaaacaca

SEQ ID NO: 124341 - DNA, 20 bp, Artificial Sequence
  chemically synthesized
tcaaaaacacagagattttg

SEQ ID NO: 124342 - DNA, 20 bp, Artificial Sequence
  chemically synthesized
acacagagattttgcagcct

SEQ ID NO: 124343 - DNA, 20 bp, Artificial Sequence
  chemically synthesized
ttattgaataaacatttcta

SEQ ID NO: 124344 - DNA, 20 bp, Artificial Sequence
  chemically synthesized
attattgaataaacatttct

SEQ ID NO: 124345 - DNA, 20 bp, Artificial Sequence
  chemically synthesized
tgtttattcaataatttgaa

SEQ ID NO: 124346 - DNA, 20 bp, Artificial Sequence
  chemically synthesized
aagtattgaatttcttgctt

SEQ ID NO: 124347 - DNA, 20 bp, Artificial Sequence
  chemically synthesized
tattgaaaactatctgaagc

SEQ ID NO: 124348 - DNA, 20 bp, Artificial Sequence
  chemically synthesized
attgaatttcttgcttcaga

SEQ ID NO: 124349 - DNA, 20 bp, Artificial Sequence
  chemically synthesized
ataatattgaaaactatctg

SEQ ID NO: 124350 - DNA, 20 bp, Artificial Sequence
  chemically synthesized
agatagttttcaatattata

SEQ ID NO: 124351 - DNA, 20 bp, Artificial Sequence
  chemically synthesized
tcaatattatatagccaaat

SEQ ID NO: 124352 - DNA, 20 bp, Artificial Sequence
  chemically synthesized
tattatatagccaaatcagc

SEQ ID NO: 124353 - DNA, 20 bp, Artificial Sequence
  chemically synthesized
ttgtttgagcctggctgatt

SEQ ID NO: 124354 - DNA, 20 bp, Artificial Sequence
  chemically synthesized
attatatagccaaatcagcc

SEQ ID NO: 124355 - DNA, 20 bp, Artificial Sequence
  chemically synthesized
agtgaaatcttgtttgagcc

SEQ ID NO: 124356 - DNA, 20 bp, Artificial Sequence
  chemically synthesized
caaatcagccaggctcaaac

SEQ ID NO: 124357 - DNA, 20 bp, Artificial Sequence
  chemically synthesized
agagaagtgaaatcttgttt

SEQ ID NO: 124358 - DNA, 20 bp, Artificial Sequence
  chemically synthesized
agtacatgaattcaatagag

SEQ ID NO: 124359 - DNA, 20 bp, Artificial Sequence
  chemically synthesized
aagagtacatgaattcaata

SEQ ID NO: 124360 - DNA, 20 bp, Artificial Sequence
  chemically synthesized
ctaagagtacatgaattcaa

SEQ ID NO: 124361 - DNA, 20 bp, Artificial Sequence
  chemically synthesized
ctattgaattcatgtactct

SEQ ID NO: 124362 - DNA, 20 bp, Artificial Sequence
  chemically synthesized
gaattcatgtactcttagct

SEQ ID NO: 124363 - DNA, 20 bp, Artificial Sequence
  chemically synthesized
tttgtgcttggctgagctaa

SEQ ID NO: 124364 - DNA, 20 bp, Artificial Sequence
  chemically synthesized
gttttgtgcttggctgagct

SEQ ID NO: 124365 - DNA, 20 bp, Artificial Sequence
  chemically synthesized
catgtactcttagctcagcc

SEQ ID NO: 124366 - DNA, 20 bp, Artificial Sequence
  chemically synthesized
tagctgttttgtgcttggct

SEQ ID NO: 124367 - DNA, 20 bp, Artificial Sequence
  chemically synthesized
agcattagctgttttgtgct

SEQ ID NO: 124368 - DNA, 20 bp, Artificial Sequence
  chemically synthesized
tagctcagccaagcacaaaa

SEQ ID NO: 124369 - DNA, 20 bp, Artificial Sequence
  chemically synthesized
cttttcaaacgtgacagcat

SEQ ID NO: 124370 - DNA, 20 bp, Artificial Sequence
  chemically synthesized
taaaagcttttcaaacgtga

SEQ ID NO: 124371 - DNA, 20 bp, Artificial Sequence
  chemically synthesized
ctaatgctgtcacgtttgaa

SEQ ID NO: 124372 - DNA, 20 bp, Artificial Sequence
  chemically synthesized
ttgtgtcaaattcagcgtaa

SEQ ID NO: 124373 - DNA, 20 bp, Artificial Sequence
  chemically synthesized
gattgcttttgtgtcaaatt

SEQ ID NO: 124374 - DNA, 20 bp, Artificial Sequence
  chemically synthesized
ttacgctgaatttgacacaa

SEQ ID NO: 124375 - DNA, 20 bp, Artificial Sequence
  chemically synthesized
ttgacacaaaagcaatcaca

SEQ ID NO: 124376 - DNA, 20 bp, Artificial Sequence
  chemically synthesized
gcaatcacaaagccgacaaa

SEQ ID NO: 124377 - DNA, 20 bp, Artificial Sequence
  chemically synthesized
caatcacaaagccgacaaaa

SEQ ID NO: 124378 - DNA, 20 bp, Artificial Sequence
  chemically synthesized
aatcacaaagccgacaaaaa

SEQ ID NO: 124379 - DNA, 20 bp, Artificial Sequence
  chemically synthesized
aagagaaatcccctttttgt

SEQ ID NO: 124380 - DNA, 20 bp, Artificial Sequence
  chemically synthesized
atcacaaagccgacaaaaag

SEQ ID NO: 124381 - DNA, 20 bp, Artificial Sequence
  chemically synthesized
tcccctgtcagtttttgaaa

SEQ ID NO: 124382 - DNA, 20 bp, Artificial Sequence
  chemically synthesized
tttcccctgtcagtttttga

SEQ ID NO: 124383 - DNA, 20 bp, Artificial Sequence
  chemically synthesized
atttctctttcaaaaactga

SEQ ID NO: 124384 - DNA, 20 bp, Artificial Sequence
  chemically synthesized
tttctctttcaaaaactgac

SEQ ID NO: 124385 - DNA, 20 bp, Artificial Sequence
  chemically synthesized
ttctctttcaaaaactgaca

SEQ ID NO: 124386 - DNA, 20 bp, Artificial Sequence
  chemically synthesized
tctctttcaaaaactgacag

SEQ ID NO: 124387 - DNA, 20 bp, Artificial Sequence
  chemically synthesized
tcatttattttttcccctgt

SEQ ID NO: 124388 - DNA, 20 bp, Artificial Sequence
  chemically synthesized
ggaaaaaataaatgaaaact

SEQ ID NO: 124389 - DNA, 20 bp, Artificial Sequence
  chemically synthesized
aaaaaataaatgaaaactcg

SEQ ID NO: 124390 - DNA, 20 bp, Artificial Sequence
  chemically synthesized
ataaatgaaaactcggagcc

SEQ ID NO: 124391 - DNA, 20 bp, Artificial Sequence
  chemically synthesized
taaatgaaaactcggagcct

SEQ ID NO: 124392 - DNA, 20 bp, Artificial Sequence
  chemically synthesized
gagagattttcccaggctcc

SEQ ID NO: 124393 - DNA, 20 bp, Artificial Sequence
  chemically synthesized
gtgtcaagagagattttccc

SEQ ID NO: 124394 - DNA, 20 bp, Artificial Sequence
  chemically synthesized
agtgtcaagagagattttcc

SEQ ID NO: 124395 - DNA, 20 bp, Artificial Sequence
  chemically synthesized
tttcttttccagtgtcaaga

SEQ ID NO: 124396 - DNA, 20 bp, Artificial Sequence
  chemically synthesized
gggaaaatctctcttgacac

SEQ ID NO: 124397 - DNA, 20 bp, Artificial Sequence
  chemically synthesized
actttcttttccagtgtcaa

SEQ ID NO: 124398 - DNA, 20 bp, Artificial Sequence
  chemically synthesized
aaactttcttttccagtgtc

SEQ ID NO: 124399 - DNA, 20 bp, Artificial Sequence
  chemically synthesized
aatctctcttgacactggaa

SEQ ID NO: 124400 - DNA, 20 bp, Artificial Sequence
  chemically synthesized
tctcttgacactggaaaaga

SEQ ID NO: 124401 - DNA, 20 bp, Artificial Sequence
  chemically synthesized
tcgttttaaactttcttttc

SEQ ID NO: 124402 - DNA, 20 bp, Artificial Sequence
  chemically synthesized
aaagaaagtttaaaacgatc

SEQ ID NO: 124403 - DNA, 20 bp, Artificial Sequence
  chemically synthesized
atcaagaaataatttttcca

SEQ ID NO: 124404 - DNA, 20 bp, Artificial Sequence
  chemically synthesized
aaacttggcaatggattctt

SEQ ID NO: 124405 - DNA, 20 bp, Artificial Sequence
  chemically synthesized
tttccaaagaatccattgcc

SEQ ID NO: 124406 - DNA, 20 bp, Artificial Sequence
  chemically synthesized
gattggtccaaacttggcaa

SEQ ID NO: 124407 - DNA, 20 bp, Artificial Sequence
  chemically synthesized
aaagaatccattgccaagtt

SEQ ID NO: 124408 - DNA, 20 bp, Artificial Sequence
  chemically synthesized
ttttaagattggtccaaact

SEQ ID NO: 124409 - DNA, 20 bp, Artificial Sequence
  chemically synthesized
caagtttggaccaatcttaa

SEQ ID NO: 124410 - DNA, 20 bp, Artificial Sequence
  chemically synthesized
gttccctaggcttttaagat

SEQ ID NO: 124411 - DNA, 20 bp, Artificial Sequence
  chemically synthesized
ttggaccaatcttaaaagcc

SEQ ID NO: 124412 - DNA, 20 bp, Artificial Sequence
  chemically synthesized
aacctgttccctaggctttt

SEQ ID NO: 124413 - DNA, 20 bp, Artificial Sequence
  chemically synthesized
tggaccaatcttaaaagcct

SEQ ID NO: 124414 - DNA, 20 bp, Artificial Sequence
  chemically synthesized
ggaccaatcttaaaagccta

SEQ ID NO: 124415 - DNA, 20 bp, Artificial Sequence
  chemically synthesized
aatcttaaaagcctagggaa

SEQ ID NO: 124416 - DNA, 20 bp, Artificial Sequence
  chemically synthesized
atcttaaaagcctagggaac

SEQ ID NO: 124417 - DNA, 20 bp, Artificial Sequence
  chemically synthesized
gagttcataacctgttccct

SEQ ID NO: 124418 - DNA, 20 bp, Artificial Sequence
  chemically synthesized
tgagttcataacctgttccc

SEQ ID NO: 124419 - DNA, 20 bp, Artificial Sequence
  chemically synthesized
aacaggttatgaactcaacc

SEQ ID NO: 124420 - DNA, 20 bp, Artificial Sequence
  chemically synthesized
catttggcggattcttggtt

SEQ ID NO: 124421 - DNA, 20 bp, Artificial Sequence
  chemically synthesized
tatttcatttggcggattct

SEQ ID NO: 124422 - DNA, 20 bp, Artificial Sequence
  chemically synthesized
ataggatttatttcatttgg

SEQ ID NO: 124423 - DNA, 20 bp, Artificial Sequence
  chemically synthesized
atcataggatttatttcatt

SEQ ID NO: 124424 - DNA, 20 bp, Artificial Sequence
  chemically synthesized
ctgccaacagtgatcatcat

SEQ ID NO: 124425 - DNA, 20 bp, Artificial Sequence
  chemically synthesized
actgccaacagtgatcatca

SEQ ID NO: 124426 - DNA, 20 bp, Artificial Sequence
  chemically synthesized
aatcctatgatgatcactgt

SEQ ID NO: 124427 - DNA, 20 bp, Artificial Sequence
  chemically synthesized
cctatgatgatcactgttgg

SEQ ID NO: 124428 - DNA, 20 bp, Artificial Sequence
  chemically synthesized
ttggcacctaaaactgccaa

SEQ ID NO: 124429 - DNA, 20 bp, Artificial Sequence
  chemically synthesized
atgatcactgttggcagttt

SEQ ID NO: 124430 - DNA, 20 bp, Artificial Sequence
  chemically synthesized
tgatcactgttggcagtttt

SEQ ID NO: 124431 - DNA, 20 bp, Artificial Sequence
  chemically synthesized
ttggcagttttaggtgccaa

SEQ ID NO: 124432 - DNA, 20 bp, Artificial Sequence
  chemically synthesized
aggcaaaaatagtatgccat

SEQ ID NO: 124433 - DNA, 20 bp, Artificial Sequence
  chemically synthesized
actttcacaagaggcaaaaa

SEQ ID NO: 124434 - DNA, 20 bp, Artificial Sequence
  chemically synthesized
actatttttgcctcttgtga

SEQ ID NO: 124435 - DNA, 20 bp, Artificial Sequence
  chemically synthesized
ccatttagaactttcacaag

SEQ ID NO: 124436 - DNA, 20 bp, Artificial Sequence
  chemically synthesized
gccatttagaactttcacaa

SEQ ID NO: 124437 - DNA, 20 bp, Artificial Sequence
  chemically synthesized
atgccatttagaactttcac

SEQ ID NO: 124438 - DNA, 20 bp, Artificial Sequence
  chemically synthesized
cctcttgtgaaagttctaaa

SEQ ID NO: 124439 - DNA, 20 bp, Artificial Sequence
  chemically synthesized
ctatgagagatgatgccatt

SEQ ID NO: 124440 - DNA, 20 bp, Artificial Sequence
  chemically synthesized
ctaaatggcatcatctctca

SEQ ID NO: 124441 - DNA, 20 bp, Artificial Sequence
  chemically synthesized
taaatggcatcatctctcat

SEQ ID NO: 124442 - DNA, 20 bp, Artificial Sequence
  chemically synthesized
gctatgacagaatcctatga

SEQ ID NO: 124443 - DNA, 20 bp, Artificial Sequence
  chemically synthesized
aggctatgacagaatcctat

SEQ ID NO: 124444 - DNA, 20 bp, Artificial Sequence
  chemically synthesized
tctctcataggattctgtca

SEQ ID NO: 124445 - DNA, 20 bp, Artificial Sequence
  chemically synthesized
tctttgccaataggctatga

SEQ ID NO: 124446 - DNA, 20 bp, Artificial Sequence
  chemically synthesized
aggattctgtcatagcctat

SEQ ID NO: 124447 - DNA, 20 bp, Artificial Sequence
  chemically synthesized
tctgtcatagcctattggca

SEQ ID NO: 124448 - DNA, 20 bp, Artificial Sequence
  chemically synthesized
taatcaaaatctttgccaat

SEQ ID NO: 124449 - DNA, 20 bp, Artificial Sequence
  chemically synthesized
ctaatcaaaatctttgccaa

SEQ ID NO: 124450 - DNA, 20 bp, Artificial Sequence
  chemically synthesized
ctattggcaaagattttgat

SEQ ID NO: 124451 - DNA, 20 bp, Artificial Sequence
  chemically synthesized
gatgttaggcaaaaacatac

SEQ ID NO: 124452 - DNA, 20 bp, Artificial Sequence
  chemically synthesized
gagatagaaagacagatgtt

SEQ ID NO: 124453 - DNA, 20 bp, Artificial Sequence
  chemically synthesized
tgagatagaaagacagatgt

SEQ ID NO: 124454 - DNA, 20 bp, Artificial Sequence
  chemically synthesized
gttcttttgagatagaaaga

SEQ ID NO: 124455 - DNA, 20 bp, Artificial Sequence
  chemically synthesized
taaagttcttttgagataga

SEQ ID NO: 124456 - DNA, 20 bp, Artificial Sequence
  chemically synthesized
catctgtctttctatctcaa

SEQ ID NO: 124457 - DNA, 20 bp, Artificial Sequence
  chemically synthesized
acaataaagttcttttgaga

SEQ ID NO: 124458 - DNA, 20 bp, Artificial Sequence
  chemically synthesized
tacaacaataaagttctttt

SEQ ID NO: 124459 - DNA, 20 bp, Artificial Sequence
  chemically synthesized
atgggcctggtacaacaata

SEQ ID NO: 124460 - DNA, 20 bp, Artificial Sequence
  chemically synthesized
aaagaactttattgttgtac

SEQ ID NO: 124461 - DNA, 20 bp, Artificial Sequence
  chemically synthesized
aagaactttattgttgtacc

SEQ ID NO: 124462 - DNA, 20 bp, Artificial Sequence
  chemically synthesized
ttattgttgtaccaggccca

SEQ ID NO: 124463 - DNA, 20 bp, Artificial Sequence
  chemically synthesized
ttttatcttctctatgggcc

SEQ ID NO: 124464 - DNA, 20 bp, Artificial Sequence
  chemically synthesized
attgttgtaccaggcccata

SEQ ID NO: 124465 - DNA, 20 bp, Artificial Sequence
  chemically synthesized
gttgtaccaggcccatagag

SEQ ID NO: 124466 - DNA, 20 bp, Artificial Sequence
  chemically synthesized
tttaattttatcttctctat

SEQ ID NO: 124467 - DNA, 20 bp, Artificial Sequence
  chemically synthesized
gtttaattttatcttctcta

SEQ ID NO: 124468 - DNA, 20 bp, Artificial Sequence
  chemically synthesized
gaagataaaattaaaccatg

SEQ ID NO: 124469 - DNA, 20 bp, Artificial Sequence
  chemically synthesized
ttgttagccacatggcttca

SEQ ID NO: 124470 - DNA, 20 bp, Artificial Sequence
  chemically synthesized
aattaaaccatgaagccatg

SEQ ID NO: 124471 - DNA, 20 bp, Artificial Sequence
  chemically synthesized
agttaattttgttagccaca

SEQ ID NO: 124472 - DNA, 20 bp, Artificial Sequence
  chemically synthesized
tagaaagtagttaattttgt

SEQ ID NO: 124473 - DNA, 20 bp, Artificial Sequence
  chemically synthesized
aaaaacatgaagttagaaag

SEQ ID NO: 124474 - DNA, 20 bp, Artificial Sequence
  chemically synthesized
aacaaaaacatgaagttaga

SEQ ID NO: 124475 - DNA, 20 bp, Artificial Sequence
  chemically synthesized
ctaaaacaaaaacatgaagt

SEQ ID NO: 124476 - DNA, 20 bp, Artificial Sequence
  chemically synthesized
ttttctaaaacaaaaacatg

SEQ ID NO: 124477 - DNA, 20 bp, Artificial Sequence
  chemically synthesized
ctaacttcatgtttttgttt

SEQ ID NO: 124478 - DNA, 20 bp, Artificial Sequence
  chemically synthesized
tttttgttttagaaaaaatt

SEQ ID NO: 124479 - DNA, 20 bp, Artificial Sequence
  chemically synthesized
ttttgttttagaaaaaatta

SEQ ID NO: 124480 - DNA, 20 bp, Artificial Sequence
  chemically synthesized
tttgttttagaaaaaattaa

SEQ ID NO: 124481 - DNA, 20 bp, Artificial Sequence
  chemically synthesized
ttagaaaaaattaagggtga

SEQ ID NO: 124482 - DNA, 20 bp, Artificial Sequence
  chemically synthesized
aagagacggccataacatat

SEQ ID NO: 124483 - DNA, 20 bp, Artificial Sequence
  chemically synthesized
aaacaattaccaatatgtta

SEQ ID NO: 124484 - DNA, 20 bp, Artificial Sequence
  chemically synthesized
attagcaggccatcaagaga

SEQ ID NO: 124485 - DNA, 20 bp, Artificial Sequence
  chemically synthesized
atgttatggccgtctcttga

SEQ ID NO: 124486 - DNA, 20 bp, Artificial Sequence
  chemically synthesized
attaattagcaggccatcaa

SEQ ID NO: 124487 - DNA, 20 bp, Artificial Sequence
  chemically synthesized
caattaattagcaggccatc

SEQ ID NO: 124488 - DNA, 20 bp, Artificial Sequence
  chemically synthesized
agtatcaacaattaattagc

SEQ ID NO: 124489 - DNA, 20 bp, Artificial Sequence
  chemically synthesized
gagtatcaacaattaattag

SEQ ID NO: 124490 - DNA, 20 bp, Artificial Sequence
  chemically synthesized
atagagtatcaacaattaat

SEQ ID NO: 124491 - DNA, 20 bp, Artificial Sequence
  chemically synthesized
aacagaatgcagatggcata

SEQ ID NO: 124492 - DNA, 20 bp, Artificial Sequence
  chemically synthesized
aaaacagaatgcagatggca

SEQ ID NO: 124493 - DNA, 20 bp, Artificial Sequence
  chemically synthesized
gtgaaaaaacagaatgcaga

SEQ ID NO: 124494 - DNA, 20 bp, Artificial Sequence
  chemically synthesized
tttggtgaaaaaacagaatg

SEQ ID NO: 124495 - DNA, 20 bp, Artificial Sequence
  chemically synthesized
gtcttgatttggtgaaaaaa

SEQ ID NO: 124496 - DNA, 20 bp, Artificial Sequence
  chemically synthesized
ttctgttttttcaccaaatc

SEQ ID NO: 124497 - DNA, 20 bp, Artificial Sequence
  chemically synthesized
gcaacaggagagtcttgatt

SEQ ID NO: 124498 - DNA, 20 bp, Artificial Sequence
  chemically synthesized
ggaaagaaacagcaacagga

SEQ ID NO: 124499 - DNA, 20 bp, Artificial Sequence
  chemically synthesized
gtggaaagaaacagcaacag

SEQ ID NO: 124500 - DNA, 20 bp, Artificial Sequence
  chemically synthesized
gagtggaaagaaacagcaac

SEQ ID NO: 124501 - DNA, 20 bp, Artificial Sequence
  chemically synthesized
agagtggaaagaaacagcaa

SEQ ID NO: 124502 - DNA, 20 bp, Artificial Sequence
  chemically synthesized
gtggtcagagtggaaagaaa

SEQ ID NO: 124503 - DNA, 20 bp, Artificial Sequence
  chemically synthesized
gaaagcgtggtcagagtgga

SEQ ID NO: 124504 - DNA, 20 bp, Artificial Sequence
  chemically synthesized
tcttgaaagcgtggtcagag

SEQ ID NO: 124505 - DNA, 20 bp, Artificial Sequence
  chemically synthesized
ttatcttgaaagcgtggtca

SEQ ID NO: 124506 - DNA, 20 bp, Artificial Sequence
  chemically synthesized
gcttatcttgaaagcgtggt

SEQ ID NO: 124507 - DNA, 20 bp, Artificial Sequence
  chemically synthesized
tccactctgaccacgctttc

SEQ ID NO: 124508 - DNA, 20 bp, Artificial Sequence
  chemically synthesized
aaaagcttatcttgaaagcg

SEQ ID NO: 124509 - DNA, 20 bp, Artificial Sequence
  chemically synthesized
tctgaccacgctttcaagat

SEQ ID NO: 124510 - DNA, 20 bp, Artificial Sequence
  chemically synthesized
gtggaaaaagcttatcttga

SEQ ID NO: 124511 - DNA, 20 bp, Artificial Sequence
  chemically synthesized
ccggagatgtcatgtggaaa

SEQ ID NO: 124512 - DNA, 20 bp, Artificial Sequence
  chemically synthesized
ataaaaccggagatgtcatg

SEQ ID NO: 124513 - DNA, 20 bp, Artificial Sequence
  chemically synthesized
ctttttccacatgacatctc

SEQ ID NO: 124514 - DNA, 20 bp, Artificial Sequence
  chemically synthesized
acagaacagaaataaaaccg

SEQ ID NO: 124515 - DNA, 20 bp, Artificial Sequence
  chemically synthesized
tcacagaacagaaataaaac

SEQ ID NO: 124516 - DNA, 20 bp, Artificial Sequence
  chemically synthesized
ataacaacctattcacagaa

SEQ ID NO: 124517 - DNA, 20 bp, Artificial Sequence
  chemically synthesized
ttttatttctgttctgtgaa

SEQ ID NO: 124518 - DNA, 20 bp, Artificial Sequence
  chemically synthesized
tttatttctgttctgtgaat

SEQ ID NO: 124519 - DNA, 20 bp, Artificial Sequence
  chemically synthesized
ggacaataacaacctattca

SEQ ID NO: 124520 - DNA, 20 bp, Artificial Sequence
  chemically synthesized
ataaataaggagaataaatg

SEQ ID NO: 124521 - DNA, 20 bp, Artificial Sequence
  chemically synthesized
cataaataaggagaataaat

SEQ ID NO: 124522 - DNA, 20 bp, Artificial Sequence
  chemically synthesized
acataaataaggagaataaa

SEQ ID NO: 124523 - DNA, 20 bp, Artificial Sequence
  chemically synthesized
ctcaaaaatacataaataag

SEQ ID NO: 124524 - DNA, 20 bp, Artificial Sequence
  chemically synthesized
gtctcaaaaatacataaata

SEQ ID NO: 124525 - DNA, 20 bp, Artificial Sequence
  chemically synthesized
tgtctcaaaaatacataaat

SEQ ID NO: 124526 - DNA, 20 bp, Artificial Sequence
  chemically synthesized
ctccttatttatgtattttt

SEQ ID NO: 124527 - DNA, 20 bp, Artificial Sequence
  chemically synthesized
ttatttatgtatttttgaga

SEQ ID NO: 124528 - DNA, 20 bp, Artificial Sequence
  chemically synthesized
atttatgtatttttgagaca

SEQ ID NO: 124529 - DNA, 20 bp, Artificial Sequence
  chemically synthesized
tccagcctgggtgacagagc

SEQ ID NO: 124530 - DNA, 20 bp, Artificial Sequence
  chemically synthesized
cagagtcttgctctgtcacc

SEQ ID NO: 124531 - DNA, 20 bp, Artificial Sequence
  chemically synthesized
gcactccagcctgggtgaca

SEQ ID NO: 124532 - DNA, 20 bp, Artificial Sequence
  chemically synthesized
agagtcttgctctgtcaccc

SEQ ID NO: 124533 - DNA, 20 bp, Artificial Sequence
  chemically synthesized
ctgcactccagcctgggtga

SEQ ID NO: 124534 - DNA, 20 bp, Artificial Sequence
  chemically synthesized
tcttgctctgtcacccaggc

SEQ ID NO: 124535 - DNA, 20 bp, Artificial Sequence
  chemically synthesized
ttgctctgtcacccaggctg

SEQ ID NO: 124536 - DNA, 20 bp, Artificial Sequence
  chemically synthesized
acgccactgcactccagcct

SEQ ID NO: 124537 - DNA, 20 bp, Artificial Sequence
  chemically synthesized
cacgccactgcactccagcc

SEQ ID NO: 124538 - DNA, 20 bp, Artificial Sequence
  chemically synthesized
ctgtcacccaggctggagtg

SEQ ID NO: 124539 - DNA, 20 bp, Artificial Sequence
  chemically synthesized
aagatcacgccactgcactc

SEQ ID NO: 124540 - DNA, 20 bp, Artificial Sequence
  chemically synthesized
tcacccaggctggagtgcag

SEQ ID NO: 124541 - DNA, 20 bp, Artificial Sequence
  chemically synthesized
ggagtgcagtggcgtgatct

SEQ ID NO: 124542 - DNA, 20 bp, Artificial Sequence
  chemically synthesized
ggcggaggttgcagtgagcc

SEQ ID NO: 124543 - DNA, 20 bp, Artificial Sequence
  chemically synthesized
cgggaggcggaggttgcagt

SEQ ID NO: 124544 - DNA, 20 bp, Artificial Sequence
  chemically synthesized
aacccgggaggcggaggttg

SEQ ID NO: 124545 - DNA, 20 bp, Artificial Sequence
  chemically synthesized
cgcttgaacccgggaggcgg

SEQ ID NO: 124546 - DNA, 20 bp, Artificial Sequence
  chemically synthesized
tcactgcaacctccgcctcc

SEQ ID NO: 124547 - DNA, 20 bp, Artificial Sequence
  chemically synthesized
tcgcttgaacccgggaggcg

SEQ ID NO: 124548 - DNA, 20 bp, Artificial Sequence
  chemically synthesized
cactgcaacctccgcctccc

SEQ ID NO: 124549 - DNA, 20 bp, Artificial Sequence
  chemically synthesized
aatcgcttgaacccgggagg

SEQ ID NO: 124550 - DNA, 20 bp, Artificial Sequence
  chemically synthesized
gggaatcgcttgaacccggg

SEQ ID NO: 124551 - DNA, 20 bp, Artificial Sequence
  chemically synthesized
ggggaatcgcttgaacccgg

SEQ ID NO: 124552 - DNA, 20 bp, Artificial Sequence
  chemically synthesized
aacctccgcctcccgggttc

SEQ ID NO: 124553 - DNA, 20 bp, Artificial Sequence
  chemically synthesized
caggggaatcgcttgaaccc

SEQ ID NO: 124554 - DNA, 20 bp, Artificial Sequence
  chemically synthesized
gcaggggaatcgcttgaacc

SEQ ID NO: 124555 - DNA, 20 bp, Artificial Sequence
  chemically synthesized
ttcaagcgattcccctgcct

SEQ ID NO: 124556 - DNA, 20 bp, Artificial Sequence
  chemically synthesized
tacttgggaggctgaggcag

SEQ ID NO: 124557 - DNA, 20 bp, Artificial Sequence
  chemically synthesized
ctacttgggaggctgaggca

SEQ ID NO: 124558 - DNA, 20 bp, Artificial Sequence
  chemically synthesized
gctacttgggaggctgaggc

SEQ ID NO: 124559 - DNA, 20 bp, Artificial Sequence
  chemically synthesized
agctacttgggaggctgagg

SEQ ID NO: 124560 - DNA, 20 bp, Artificial Sequence
  chemically synthesized
cccagctacttgggaggctg

SEQ ID NO: 124561 - DNA, 20 bp, Artificial Sequence
  chemically synthesized
tcccagctacttgggaggct

SEQ ID NO: 124562 - DNA, 20 bp, Artificial Sequence
  chemically synthesized
ttcccctgcctcagcctccc

SEQ ID NO: 124563 - DNA, 20 bp, Artificial Sequence
  chemically synthesized
ccctgcctcagcctcccaag

SEQ ID NO: 124564 - DNA, 20 bp, Artificial Sequence
  chemically synthesized
tgtagtcccagctacttggg

SEQ ID NO: 124565 - DNA, 20 bp, Artificial Sequence
  chemically synthesized
ctgtagtcccagctacttgg

SEQ ID NO: 124566 - DNA, 20 bp, Artificial Sequence
  chemically synthesized
gcctcagcctcccaagtagc

SEQ ID NO: 124567 - DNA, 20 bp, Artificial Sequence
  chemically synthesized
gcctgtagtcccagctactt

SEQ ID NO: 124568 - DNA, 20 bp, Artificial Sequence
  chemically synthesized
cctcagcctcccaagtagct

SEQ ID NO: 124569 - DNA, 20 bp, Artificial Sequence
  chemically synthesized
tgcctgtagtcccagctact

SEQ ID NO: 124570 - DNA, 20 bp, Artificial Sequence
  chemically synthesized
ctcccaagtagctgggacta

SEQ ID NO: 124571 - DNA, 20 bp, Artificial Sequence
  chemically synthesized
tcccaagtagctgggactac

SEQ ID NO: 124572 - DNA, 20 bp, Artificial Sequence
  chemically synthesized
gtgctgcatgcctgtagtcc

SEQ ID NO: 124573 - DNA, 20 bp, Artificial Sequence
  chemically synthesized
ggcgtggtgctgcatgcctg

SEQ ID NO: 124574 - DNA, 20 bp, Artificial Sequence
  chemically synthesized
tagctgggactacaggcatg

SEQ ID NO: 124575 - DNA, 20 bp, Artificial Sequence
  chemically synthesized
acaggcatgcagcaccacgc

SEQ ID NO: 124576 - DNA, 20 bp, Artificial Sequence
  chemically synthesized
caggcatgcagcaccacgcc

SEQ ID NO: 124577 - DNA, 20 bp, Artificial Sequence
  chemically synthesized
atacaaaaactagcctggcg

SEQ ID NO: 124578 - DNA, 20 bp, Artificial Sequence
  chemically synthesized
catgcagcaccacgccaggc

SEQ ID NO: 124579 - DNA, 20 bp, Artificial Sequence
  chemically synthesized
taaaaatacaaaaactagcc

SEQ ID NO: 124580 - DNA, 20 bp, Artificial Sequence
  chemically synthesized
tctactaaaaatacaaaaac

SEQ ID NO: 124581 - DNA, 20 bp, Artificial Sequence
  chemically synthesized
caggctagtttttgtatttt

SEQ ID NO: 124582 - DNA, 20 bp, Artificial Sequence
  chemically synthesized
gctagtttttgtatttttag

SEQ ID NO: 124583 - DNA, 20 bp, Artificial Sequence
  chemically synthesized
tagtttttgtatttttagta

SEQ ID NO: 124584 - DNA, 20 bp, Artificial Sequence
  chemically synthesized
ttttgtatttttagtagaga

SEQ ID NO: 124585 - DNA, 20 bp, Artificial Sequence
  chemically synthesized
tttgtatttttagtagagac

SEQ ID NO: 124586 - DNA, 20 bp, Artificial Sequence
  chemically synthesized
ttgtatttttagtagagaca

SEQ ID NO: 124587 - DNA, 20 bp, Artificial Sequence
  chemically synthesized
gagacagggtttcaccatgt

SEQ ID NO: 124588 - DNA, 20 bp, Artificial Sequence
  chemically synthesized
cagggtttcaccatgttggt

SEQ ID NO: 124589 - DNA, 20 bp, Artificial Sequence
  chemically synthesized
tgagaccggcctgaccaaca

SEQ ID NO: 124590 - DNA, 20 bp, Artificial Sequence
  chemically synthesized
agggtttcaccatgttggtc

SEQ ID NO: 124591 - DNA, 20 bp, Artificial Sequence
  chemically synthesized
tttcaccatgttggtcaggc

SEQ ID NO: 124592 - DNA, 20 bp, Artificial Sequence
  chemically synthesized
cgagatcaggagtttgagac

SEQ ID NO: 124593 - DNA, 20 bp, Artificial Sequence
  chemically synthesized
gatcacgagatcaggagttt

SEQ ID NO: 124594 - DNA, 20 bp, Artificial Sequence
  chemically synthesized
caggcagatcacgagatcag

SEQ ID NO: 124595 - DNA, 20 bp, Artificial Sequence
  chemically synthesized
ggcaggcagatcacgagatc

SEQ ID NO: 124596 - DNA, 20 bp, Artificial Sequence
  chemically synthesized
aggcaggcagatcacgagat

SEQ ID NO: 124597 - DNA, 20 bp, Artificial Sequence
  chemically synthesized
ggccgaggcaggcagatcac

SEQ ID NO: 124598 - DNA, 20 bp, Artificial Sequence
  chemically synthesized
atctcgtgatctgcctgcct

SEQ ID NO: 124599 - DNA, 20 bp, Artificial Sequence
  chemically synthesized
ctttgggaggccgaggcagg

SEQ ID NO: 124600 - DNA, 20 bp, Artificial Sequence
  chemically synthesized
gcactttgggaggccgaggc

SEQ ID NO: 124601 - DNA, 20 bp, Artificial Sequence
  chemically synthesized
agcactttgggaggccgagg

SEQ ID NO: 124602 - DNA, 20 bp, Artificial Sequence
  chemically synthesized
cccagcactttgggaggccg

SEQ ID NO: 124603 - DNA, 20 bp, Artificial Sequence
  chemically synthesized
tcccagcactttgggaggcc

SEQ ID NO: 124604 - DNA, 20 bp, Artificial Sequence
  chemically synthesized
ctgcctgcctcggcctccca

SEQ ID NO: 124605 - DNA, 20 bp, Artificial Sequence
  chemically synthesized
tgtaatcccagcactttggg

SEQ ID NO: 124606 - DNA, 20 bp, Artificial Sequence
  chemically synthesized
ctgtaatcccagcactttgg

SEQ ID NO: 124607 - DNA, 20 bp, Artificial Sequence
  chemically synthesized
gcctcggcctcccaaagtgc

SEQ ID NO: 124608 - DNA, 20 bp, Artificial Sequence
  chemically synthesized
acctgtaatcccagcacttt

SEQ ID NO: 124609 - DNA, 20 bp, Artificial Sequence
  chemically synthesized
cctcggcctcccaaagtgct

SEQ ID NO: 124610 - DNA, 20 bp, Artificial Sequence
  chemically synthesized
tacctgtaatcccagcactt

SEQ ID NO: 124611 - DNA, 20 bp, Artificial Sequence
  chemically synthesized
ctcccaaagtgctgggatta

SEQ ID NO: 124612 - DNA, 20 bp, Artificial Sequence
  chemically synthesized
tcccaaagtgctgggattac

SEQ ID NO: 124613 - DNA, 20 bp, Artificial Sequence
  chemically synthesized
gtggctcatacctgtaatcc

SEQ ID NO: 124614 - DNA, 20 bp, Artificial Sequence
  chemically synthesized
agtgctgggattacaggtat

SEQ ID NO: 124615 - DNA, 20 bp, Artificial Sequence
  chemically synthesized
caggtatgagccaccgcgcc

SEQ ID NO: 124616 - DNA, 20 bp, Artificial Sequence
  chemically synthesized
aatggtgaggccgggcgcgg

SEQ ID NO: 124617 - DNA, 20 bp, Artificial Sequence
  chemically synthesized
aagaatggtgaggccgggcg

SEQ ID NO: 124618 - DNA, 20 bp, Artificial Sequence
  chemically synthesized
aaaaaaagaatggtgaggcc

SEQ ID NO: 124619 - DNA, 20 bp, Artificial Sequence
  chemically synthesized
gaaaaaaagaatggtgaggc

SEQ ID NO: 124620 - DNA, 20 bp, Artificial Sequence
  chemically synthesized
tttagaaaaaaagaatggtg

SEQ ID NO: 124621 - DNA, 20 bp, Artificial Sequence
  chemically synthesized
atttagaaaaaaagaatggt

SEQ ID NO: 124622 - DNA, 20 bp, Artificial Sequence
  chemically synthesized
ttttatttagaaaaaaagaa

SEQ ID NO: 124623 - DNA, 20 bp, Artificial Sequence
  chemically synthesized
cctccttttatttagaaaaa

SEQ ID NO: 124624 - DNA, 20 bp, Artificial Sequence
  chemically synthesized
cattctttttttctaaataa

SEQ ID NO: 124625 - DNA, 20 bp, Artificial Sequence
  chemically synthesized
attctttttttctaaataaa

SEQ ID NO: 124626 - DNA, 20 bp, Artificial Sequence
  chemically synthesized
aaaaaactcctccttttatt

SEQ ID NO: 124627 - DNA, 20 bp, Artificial Sequence
  chemically synthesized
tctttttttctaaataaaag

SEQ ID NO: 124628 - DNA, 20 bp, Artificial Sequence
  chemically synthesized
ctttttttctaaataaaagg

SEQ ID NO: 124629 - DNA, 20 bp, Artificial Sequence
  chemically synthesized
ttttttctaaataaaaggag

SEQ ID NO: 124630 - DNA, 20 bp, Artificial Sequence
  chemically synthesized
gaggagttttttctaaatgt

SEQ ID NO: 124631 - DNA, 20 bp, Artificial Sequence
  chemically synthesized
gtccttgctggtctgacatt

SEQ ID NO: 124632 - DNA, 20 bp, Artificial Sequence
  chemically synthesized
gttttttctaaatgtcagac

SEQ ID NO: 124633 - DNA, 20 bp, Artificial Sequence
  chemically synthesized
tttctaaatgtcagaccagc

SEQ ID NO: 124634 - DNA, 20 bp, Artificial Sequence
  chemically synthesized
ttctaaatgtcagaccagca

SEQ ID NO: 124635 - DNA, 20 bp, Artificial Sequence
  chemically synthesized
ttccatctttatgtccttgc

SEQ ID NO: 124636 - DNA, 20 bp, Artificial Sequence
  chemically synthesized
gtcagaccagcaaggacata

SEQ ID NO: 124637 - DNA, 20 bp, Artificial Sequence
  chemically synthesized
gaccagcaaggacataaaga

SEQ ID NO: 124638 - DNA, 20 bp, Artificial Sequence
  chemically synthesized
gaaattaatgaaataatata

SEQ ID NO: 124639 - DNA, 20 bp, Artificial Sequence
  chemically synthesized
attaatgaaataatataaag

SEQ ID NO: 124640 - DNA, 20 bp, Artificial Sequence
  chemically synthesized
gaagttaaaataattattaa

SEQ ID NO: 124641 - DNA, 20 bp, Artificial Sequence
  chemically synthesized
ataaatatttatgcaatatt

SEQ ID NO: 124642 - DNA, 20 bp, Artificial Sequence
  chemically synthesized
gcaatattaagtttacaaat

SEQ ID NO: 124643 - DNA, 20 bp, Artificial Sequence
  chemically synthesized
aaaatttaatttacattatg

SEQ ID NO: 124644 - DNA, 20 bp, Artificial Sequence
  chemically synthesized
gtagacaattaaaatatatg

SEQ ID NO: 124645 - DNA, 20 bp, Artificial Sequence
  chemically synthesized
caattaaaatatatgtagat

SEQ ID NO: 124646 - DNA, 20 bp, Artificial Sequence
  chemically synthesized
aaatatatgtagataagaac

SEQ ID NO: 124647 - DNA, 20 bp, Artificial Sequence
  chemically synthesized
tatatgtagataagaactag

SEQ ID NO: 124648 - DNA, 20 bp, Artificial Sequence
  chemically synthesized
tatgtagataagaactagaa

SEQ ID NO: 124649 - DNA, 20 bp, Artificial Sequence
  chemically synthesized
tctttattgacagtctcttc

SEQ ID NO: 124650 - DNA, 20 bp, Artificial Sequence
  chemically synthesized
actagaagagactgtcaata

SEQ ID NO: 124651 - DNA, 20 bp, Artificial Sequence
  chemically synthesized
taattgctaatctttattga

SEQ ID NO: 124652 - DNA, 20 bp, Artificial Sequence
  chemically synthesized
aagagactgtcaataaagat

SEQ ID NO: 124653 - DNA, 20 bp, Artificial Sequence
  chemically synthesized
atgaatcattaattgctttt

SEQ ID NO: 124654 - DNA, 20 bp, Artificial Sequence
  chemically synthesized
caaaaatgcttgataccaaa

SEQ ID NO: 124655 - DNA, 20 bp, Artificial Sequence
  chemically synthesized
attaattgctttttggtatc

SEQ ID NO: 124656 - DNA, 20 bp, Artificial Sequence
  chemically synthesized
tttttggtatcaagcatttt

SEQ ID NO: 124657 - DNA, 20 bp, Artificial Sequence
  chemically synthesized
tcaccatacctgaacgtaaa

SEQ ID NO: 124658 - DNA, 20 bp, Artificial Sequence
  chemically synthesized
ggtaattttctttttacgtt

SEQ ID NO: 124659 - DNA, 20 bp, Artificial Sequence
  chemically synthesized
gtaattttctttttacgttc

SEQ ID NO: 124660 - DNA, 20 bp, Artificial Sequence
  chemically synthesized
tttctttttacgttcaggta

SEQ ID NO: 124661 - DNA, 20 bp, Artificial Sequence
  chemically synthesized
ttacgttcaggtatggtgac

SEQ ID NO: 124662 - DNA, 20 bp, Artificial Sequence
  chemically synthesized
ataactcttaaaatttgagc

SEQ ID NO: 124663 - DNA, 20 bp, Artificial Sequence
  chemically synthesized
tggtgactggctcaaatttt

SEQ ID NO: 124664 - DNA, 20 bp, Artificial Sequence
  chemically synthesized
tgttataactcttaaaattt

SEQ ID NO: 124665 - DNA, 20 bp, Artificial Sequence
  chemically synthesized
gtgactggctcaaattttaa

SEQ ID NO: 124666 - DNA, 20 bp, Artificial Sequence
  chemically synthesized
tcaaattttaagagttataa

SEQ ID NO: 124667 - DNA, 20 bp, Artificial Sequence
  chemically synthesized
tttaagagttataacagtgt

SEQ ID NO: 124668 - DNA, 20 bp, Artificial Sequence
  chemically synthesized
aagagttataacagtgttgg

SEQ ID NO: 124669 - DNA, 20 bp, Artificial Sequence
  chemically synthesized
gttataacagtgttggtggt

SEQ ID NO: 124670 - DNA, 20 bp, Artificial Sequence
  chemically synthesized
ttataacagtgttggtggtt

SEQ ID NO: 124671 - DNA, 20 bp, Artificial Sequence
  chemically synthesized
tgaaacatttcattgttgct

SEQ ID NO: 124672 - DNA, 20 bp, Artificial Sequence
  chemically synthesized
aacatttcattgttgctcag

SEQ ID NO: 124673 - DNA, 20 bp, Artificial Sequence
  chemically synthesized
tttcattgttgctcagtagt

SEQ ID NO: 124674 - DNA, 20 bp, Artificial Sequence
  chemically synthesized
ctacactaactctcactact

SEQ ID NO: 124675 - DNA, 20 bp, Artificial Sequence
  chemically synthesized
tcattgttgctcagtagtga

SEQ ID NO: 124676 - DNA, 20 bp, Artificial Sequence
  chemically synthesized
tgttgctcagtagtgagagt

SEQ ID NO: 124677 - DNA, 20 bp, Artificial Sequence
  chemically synthesized
ctcagtagtgagagttagtg

SEQ ID NO: 124678 - DNA, 20 bp, Artificial Sequence
  chemically synthesized
gagttagtgtagtcatcact

SEQ ID NO: 124679 - DNA, 20 bp, Artificial Sequence
  chemically synthesized
agttagtgtagtcatcactg

SEQ ID NO: 124680 - DNA, 20 bp, Artificial Sequence
  chemically synthesized
cagcctcctttgcagcacct

SEQ ID NO: 124681 - DNA, 20 bp, Artificial Sequence
  chemically synthesized
gtcatcactgaggtgctgca

SEQ ID NO: 124682 - DNA, 20 bp, Artificial Sequence
  chemically synthesized
tcatcactgaggtgctgcaa

SEQ ID NO: 124683 - DNA, 20 bp, Artificial Sequence
  chemically synthesized
atcactgaggtgctgcaaag

SEQ ID NO: 124684 - DNA, 20 bp, Artificial Sequence
  chemically synthesized
tcactgaggtgctgcaaagg

SEQ ID NO: 124685 - DNA, 20 bp, Artificial Sequence
  chemically synthesized
acagcagccagcctcctttg

SEQ ID NO: 124686 - DNA, 20 bp, Artificial Sequence
  chemically synthesized
tgaggtgctgcaaaggaggc

SEQ ID NO: 124687 - DNA, 20 bp, Artificial Sequence
  chemically synthesized
agagctgtgattacagcagc

SEQ ID NO: 124688 - DNA, 20 bp, Artificial Sequence
  chemically synthesized
ttggagagctgtgattacag

SEQ ID NO: 124689 - DNA, 20 bp, Artificial Sequence
  chemically synthesized
gaggctggctgctgtaatca

SEQ ID NO: 124690 - DNA, 20 bp, Artificial Sequence
  chemically synthesized
gccttggagagctgtgatta

SEQ ID NO: 124691 - DNA, 20 bp, Artificial Sequence
  chemically synthesized
tgctgtaatcacagctctcc

SEQ ID NO: 124692 - DNA, 20 bp, Artificial Sequence
  chemically synthesized
gctgtaatcacagctctcca

SEQ ID NO: 124693 - DNA, 20 bp, Artificial Sequence
  chemically synthesized
gctatgtctacagccttgga

SEQ ID NO: 124694 - DNA, 20 bp, Artificial Sequence
  chemically synthesized
aagctatgtctacagccttg

SEQ ID NO: 124695 - DNA, 20 bp, Artificial Sequence
  chemically synthesized
atcacagctctccaaggctg

SEQ ID NO: 124696 - DNA, 20 bp, Artificial Sequence
  chemically synthesized
caaagctatgtctacagcct

SEQ ID NO: 124697 - DNA, 20 bp, Artificial Sequence
  chemically synthesized
gctctccaaggctgtagaca

SEQ ID NO: 124698 - DNA, 20 bp, Artificial Sequence
  chemically synthesized
caatcacaaagctatgtcta

SEQ ID NO: 124699 - DNA, 20 bp, Artificial Sequence
  chemically synthesized
agcctcacaaggcaatcaca

SEQ ID NO: 124700 - DNA, 20 bp, Artificial Sequence
  chemically synthesized
tagctttgtgattgccttgt

SEQ ID NO: 124701 - DNA, 20 bp, Artificial Sequence
  chemically synthesized
agctttgtgattgccttgtg

SEQ ID NO: 124702 - DNA, 20 bp, Artificial Sequence
  chemically synthesized
gagagcctgtgagcctcaca

SEQ ID NO: 124703 - DNA, 20 bp, Artificial Sequence
  chemically synthesized
agagagcctgtgagcctcac

SEQ ID NO: 124704 - DNA, 20 bp, Artificial Sequence
  chemically synthesized
tgattgccttgtgaggctca

SEQ ID NO: 124705 - DNA, 20 bp, Artificial Sequence
  chemically synthesized
gattgccttgtgaggctcac

SEQ ID NO: 124706 - DNA, 20 bp, Artificial Sequence
  chemically synthesized
agattaacaagagagcctgt

SEQ ID NO: 124707 - DNA, 20 bp, Artificial Sequence
  chemically synthesized
tgtgcctaagattaacaaga

SEQ ID NO: 124708 - DNA, 20 bp, Artificial Sequence
  chemically synthesized
tgtgtgcctaagattaacaa

SEQ ID NO: 124709 - DNA, 20 bp, Artificial Sequence
  chemically synthesized
tctgtgtgcctaagattaac

SEQ ID NO: 124710 - DNA, 20 bp, Artificial Sequence
  chemically synthesized
acaggctctcttgttaatct

SEQ ID NO: 124711 - DNA, 20 bp, Artificial Sequence
  chemically synthesized
caggctctcttgttaatctt

SEQ ID NO: 124712 - DNA, 20 bp, Artificial Sequence
  chemically synthesized
tcttgttaatcttaggcaca

SEQ ID NO: 124713 - DNA, 20 bp, Artificial Sequence
  chemically synthesized
ctttctgagtctgtgtgcct

SEQ ID NO: 124714 - DNA, 20 bp, Artificial Sequence
  chemically synthesized
taatcttaggcacacagact

SEQ ID NO: 124715 - DNA, 20 bp, Artificial Sequence
  chemically synthesized
cttaggcacacagactcaga

SEQ ID NO: 124716 - DNA, 20 bp, Artificial Sequence
  chemically synthesized
ttgctccgtaagttctttct

SEQ ID NO: 124717 - DNA, 20 bp, Artificial Sequence
  chemically synthesized
acagactcagaaagaactta

SEQ ID NO: 124718 - DNA, 20 bp, Artificial Sequence
  chemically synthesized
agactcagaaagaacttacg

SEQ ID NO: 124719 - DNA, 20 bp, Artificial Sequence
  chemically synthesized
tcagaaagaacttacggagc

SEQ ID NO: 124720 - DNA, 20 bp, Artificial Sequence
  chemically synthesized
gcaacacccccttgctccgt

SEQ ID NO: 124721 - DNA, 20 bp, Artificial Sequence
  chemically synthesized
cagaaagaacttacggagca

SEQ ID NO: 124722 - DNA, 20 bp, Artificial Sequence
  chemically synthesized
agaaagaacttacggagcaa

SEQ ID NO: 124723 - DNA, 20 bp, Artificial Sequence
  chemically synthesized
gaaagaacttacggagcaag

SEQ ID NO: 124724 - DNA, 20 bp, Artificial Sequence
  chemically synthesized
aaagaacttacggagcaagg

SEQ ID NO: 124725 - DNA, 20 bp, Artificial Sequence
  chemically synthesized
ggagcaagggggtgttgctt

SEQ ID NO: 124726 - DNA, 20 bp, Artificial Sequence
  chemically synthesized
gaggagacattaaatggcta

SEQ ID NO: 124727 - DNA, 20 bp, Artificial Sequence
  chemically synthesized
agacaggaggagacattaaa

SEQ ID NO: 124728 - DNA, 20 bp, Artificial Sequence
  chemically synthesized
agtgtgaaaatagacaggag

SEQ ID NO: 124729 - DNA, 20 bp, Artificial Sequence
  chemically synthesized
aaagtgtgaaaatagacagg

SEQ ID NO: 124730 - DNA, 20 bp, Artificial Sequence
  chemically synthesized
aaaagtgtgaaaatagacag

SEQ ID NO: 124731 - DNA, 20 bp, Artificial Sequence
  chemically synthesized
aaaaaagtgtgaaaatagac

SEQ ID NO: 124732 - DNA, 20 bp, Artificial Sequence
  chemically synthesized
gaaaaaagtgtgaaaataga

SEQ ID NO: 124733 - DNA, 20 bp, Artificial Sequence
  chemically synthesized
ttaggaaaaaagtgtgaaaa

SEQ ID NO: 124734 - DNA, 20 bp, Artificial Sequence
  chemically synthesized
aaaattttcttttaggaaaa

SEQ ID NO: 124735 - DNA, 20 bp, Artificial Sequence
  chemically synthesized
ttttcacacttttttcctaa

SEQ ID NO: 124736 - DNA, 20 bp, Artificial Sequence
  chemically synthesized
attacttaaaattttctttt

SEQ ID NO: 124737 - DNA, 20 bp, Artificial Sequence
  chemically synthesized
tattacttaaaattttcttt

SEQ ID NO: 124738 - DNA, 20 bp, Artificial Sequence
  chemically synthesized
ttttcctaaaagaaaatttt

SEQ ID NO: 124739 - DNA, 20 bp, Artificial Sequence
  chemically synthesized
aaaagaaaattttaagtaat

SEQ ID NO: 124740 - DNA, 20 bp, Artificial Sequence
  chemically synthesized
gaaaattttaagtaataagc

SEQ ID NO: 124741 - DNA, 20 bp, Artificial Sequence
  chemically synthesized
cactactaagtgatattagc

SEQ ID NO: 124742 - DNA, 20 bp, Artificial Sequence
  chemically synthesized
tcatcactactaagtgatat

SEQ ID NO: 124743 - DNA, 20 bp, Artificial Sequence
  chemically synthesized
ataagccagctaatatcact

SEQ ID NO: 124744 - DNA, 20 bp, Artificial Sequence
  chemically synthesized
agccagctaatatcacttag

SEQ ID NO: 124745 - DNA, 20 bp, Artificial Sequence
  chemically synthesized
tcgaatgtgtcatcactact

SEQ ID NO: 124746 - DNA, 20 bp, Artificial Sequence
  chemically synthesized
gtgatgacacattcgatgta

SEQ ID NO: 124747 - DNA, 20 bp, Artificial Sequence
  chemically synthesized
gacacattcgatgtaaagac

SEQ ID NO: 124748 - DNA, 20 bp, Artificial Sequence
  chemically synthesized
gagcaaataaaatggttatc

SEQ ID NO: 124749 - DNA, 20 bp, Artificial Sequence
  chemically synthesized
aaggtagggagcaaataaaa

SEQ ID NO: 124750 - DNA, 20 bp, Artificial Sequence
  chemically synthesized
taattcttctaaaaggtagg

SEQ ID NO: 124751 - DNA, 20 bp, Artificial Sequence
  chemically synthesized
tttatttgctccctaccttt

SEQ ID NO: 124752 - DNA, 20 bp, Artificial Sequence
  chemically synthesized
tttaattcttctaaaaggta

SEQ ID NO: 124753 - DNA, 20 bp, Artificial Sequence
  chemically synthesized
gtttaattcttctaaaaggt

SEQ ID NO: 124754 - DNA, 20 bp, Artificial Sequence
  chemically synthesized
tgtttaattcttctaaaagg

SEQ ID NO: 124755 - DNA, 20 bp, Artificial Sequence
  chemically synthesized
atttgctccctaccttttag

SEQ ID NO: 124756 - DNA, 20 bp, Artificial Sequence
  chemically synthesized
caatgtttaattcttctaaa

SEQ ID NO: 124757 - DNA, 20 bp, Artificial Sequence
  chemically synthesized
acaatgtttaattcttctaa

SEQ ID NO: 124758 - DNA, 20 bp, Artificial Sequence
  chemically synthesized
gtttcattaaaaatgaaatg

SEQ ID NO: 124759 - DNA, 20 bp, Artificial Sequence
  chemically synthesized
attgttttattttttcatca

SEQ ID NO: 124760 - DNA, 20 bp, Artificial Sequence
  chemically synthesized
taatatgaaattttttttcg

SEQ ID NO: 124761 - DNA, 20 bp, Artificial Sequence
  chemically synthesized
agaaaatgaaagcaatgaaa

SEQ ID NO: 124762 - DNA, 20 bp, Artificial Sequence
  chemically synthesized
aaccaacaggtagaaaatga

SEQ ID NO: 124763 - DNA, 20 bp, Artificial Sequence
  chemically synthesized
tgctttcattttctacctgt

SEQ ID NO: 124764 - DNA, 20 bp, Artificial Sequence
  chemically synthesized
attactgataaaccaacagg

SEQ ID NO: 124765 - DNA, 20 bp, Artificial Sequence
  chemically synthesized
tacattactgataaaccaac

SEQ ID NO: 124766 - DNA, 20 bp, Artificial Sequence
  chemically synthesized
ttacattactgataaaccaa

SEQ ID NO: 124767 - DNA, 20 bp, Artificial Sequence
  chemically synthesized
ttttctacctgttggtttat

SEQ ID NO: 124768 - DNA, 20 bp, Artificial Sequence
  chemically synthesized
gtaattattaattgacaaat

SEQ ID NO: 124769 - DNA, 20 bp, Artificial Sequence
  chemically synthesized
ttgtcaattaataattacat

SEQ ID NO: 124770 - DNA, 20 bp, Artificial Sequence
  chemically synthesized
ataattacatgagtcttttt

SEQ ID NO: 124771 - DNA, 20 bp, Artificial Sequence
  chemically synthesized
aaccccataagaatctgaaa

SEQ ID NO: 124772 - DNA, 20 bp, Artificial Sequence
  chemically synthesized
gagtctttttcagattctta

SEQ ID NO: 124773 - DNA, 20 bp, Artificial Sequence
  chemically synthesized
agtctttttcagattcttat

SEQ ID NO: 124774 - DNA, 20 bp, Artificial Sequence
  chemically synthesized
gtctttttcagattcttatg

SEQ ID NO: 124775 - DNA, 20 bp, Artificial Sequence
  chemically synthesized
acaaagcaagaaaaccccat

SEQ ID NO: 124776 - DNA, 20 bp, Artificial Sequence
  chemically synthesized
ctacgtggctaaaacaaagc

SEQ ID NO: 124777 - DNA, 20 bp, Artificial Sequence
  chemically synthesized
ggggttttcttgctttgttt

SEQ ID NO: 124778 - DNA, 20 bp, Artificial Sequence
  chemically synthesized
ttgtctacgtggctaaaaca

SEQ ID NO: 124779 - DNA, 20 bp, Artificial Sequence
  chemically synthesized
cttgctttgttttagccacg

SEQ ID NO: 124780 - DNA, 20 bp, Artificial Sequence
  chemically synthesized
tcctcttccaattgtctacg

SEQ ID NO: 124781 - DNA, 20 bp, Artificial Sequence
  chemically synthesized
gttttagccacgtagacaat

SEQ ID NO: 124782 - DNA, 20 bp, Artificial Sequence
  chemically synthesized
ttagccacgtagacaattgg

SEQ ID NO: 124783 - DNA, 20 bp, Artificial Sequence
  chemically synthesized
agccacgtagacaattggaa

SEQ ID NO: 124784 - DNA, 20 bp, Artificial Sequence
  chemically synthesized
gccacgtagacaattggaag

SEQ ID NO: 124785 - DNA, 20 bp, Artificial Sequence
  chemically synthesized
acgtagacaattggaagagg

SEQ ID NO: 124786 - DNA, 20 bp, Artificial Sequence
  chemically synthesized
aattggaagaggaagcctgt

SEQ ID NO: 124787 - DNA, 20 bp, Artificial Sequence
  chemically synthesized
attggaagaggaagcctgtg

SEQ ID NO: 124788 - DNA, 20 bp, Artificial Sequence
  chemically synthesized
actcttgtagatgacctcac

SEQ ID NO: 124789 - DNA, 20 bp, Artificial Sequence
  chemically synthesized
tactcttgtagatgacctca

SEQ ID NO: 124790 - DNA, 20 bp, Artificial Sequence
  chemically synthesized
aagcctgtgaggtcatctac

SEQ ID NO: 124791 - DNA, 20 bp, Artificial Sequence
  chemically synthesized
gcctgtgaggtcatctacaa

SEQ ID NO: 124792 - DNA, 20 bp, Artificial Sequence
  chemically synthesized
atgcatagcaattactcttg

SEQ ID NO: 124793 - DNA, 20 bp, Artificial Sequence
  chemically synthesized
agagttgtgatgcgaatgca

SEQ ID NO: 124794 - DNA, 20 bp, Artificial Sequence
  chemically synthesized
atcttcttttgaaagtagta

SEQ ID NO: 124795 - DNA, 20 bp, Artificial Sequence
  chemically synthesized
gaatcttcttttgaaagtag

SEQ ID NO: 124796 - DNA, 20 bp, Artificial Sequence
  chemically synthesized
cacaactctactactttcaa

SEQ ID NO: 124797 - DNA, 20 bp, Artificial Sequence
  chemically synthesized
tcagaatcttcttttgaaag

SEQ ID NO: 124798 - DNA, 20 bp, Artificial Sequence
  chemically synthesized
aactctactactttcaaaag

SEQ ID NO: 124799 - DNA, 20 bp, Artificial Sequence
  chemically synthesized
agttcagaatcttcttttga

SEQ ID NO: 124800 - DNA, 20 bp, Artificial Sequence
  chemically synthesized
aactgaaggctagagaagtt

SEQ ID NO: 124801 - DNA, 20 bp, Artificial Sequence
  chemically synthesized
aagaagattctgaacttctc

SEQ ID NO: 124802 - DNA, 20 bp, Artificial Sequence
  chemically synthesized
aagaaaactgaaggctagag

SEQ ID NO: 124803 - DNA, 20 bp, Artificial Sequence
  chemically synthesized
ttctgaacttctctagcctt

SEQ ID NO: 124804 - DNA, 20 bp, Artificial Sequence
  chemically synthesized
gagaagaaaactgaaggcta

SEQ ID NO: 124805 - DNA, 20 bp, Artificial Sequence
  chemically synthesized
cagagaagaaaactgaaggc

SEQ ID NO: 124806 - DNA, 20 bp, Artificial Sequence
  chemically synthesized
tttgcagagaagaaaactga

SEQ ID NO: 124807 - DNA, 20 bp, Artificial Sequence
  chemically synthesized
gtttgcagagaagaaaactg

SEQ ID NO: 124808 - DNA, 20 bp, Artificial Sequence
  chemically synthesized
attattcttagtttgcagag

SEQ ID NO: 124809 - DNA, 20 bp, Artificial Sequence
  chemically synthesized
cttattattcttagtttgca

SEQ ID NO: 124810 - DNA, 20 bp, Artificial Sequence
  chemically synthesized
agttttcttctctgcaaact

SEQ ID NO: 124811 - DNA, 20 bp, Artificial Sequence
  chemically synthesized
ctcttattattcttagtttg

SEQ ID NO: 124812 - DNA, 20 bp, Artificial Sequence
  chemically synthesized
aaaagtactcttattattct

SEQ ID NO: 124813 - DNA, 20 bp, Artificial Sequence
  chemically synthesized
ctctgcaaactaagaataat

SEQ ID NO: 124814 - DNA, 20 bp, Artificial Sequence
  chemically synthesized
ctgcaaactaagaataataa

SEQ ID NO: 124815 - DNA, 20 bp, Artificial Sequence
  chemically synthesized
aataataagagtacttttca

SEQ ID NO: 124816 - DNA, 20 bp, Artificial Sequence
  chemically synthesized
taataagagtacttttcaaa

SEQ ID NO: 124817 - DNA, 20 bp, Artificial Sequence
  chemically synthesized
tttcaaaaacactctttgaa

SEQ ID NO: 124818 - DNA, 20 bp, Artificial Sequence
  chemically synthesized
ttttcaaagagtgtttttga

SEQ ID NO: 124819 - DNA, 20 bp, Artificial Sequence
  chemically synthesized
tttcaaagagtgtttttgaa

SEQ ID NO: 124820 - DNA, 20 bp, Artificial Sequence
  chemically synthesized
gctagtcactttatatatat

SEQ ID NO: 124821 - DNA, 20 bp, Artificial Sequence
  chemically synthesized
gaaataaaccaatatatata

SEQ ID NO: 124822 - DNA, 20 bp, Artificial Sequence
  chemically synthesized
accaatatatataaagtgac

SEQ ID NO: 124823 - DNA, 20 bp, Artificial Sequence
  chemically synthesized
ctgtgtgtcaaaaagtatgc

SEQ ID NO: 124824 - DNA, 20 bp, Artificial Sequence
  chemically synthesized
aatgcttgctgtgtgtcaaa

SEQ ID NO: 124825 - DNA, 20 bp, Artificial Sequence
  chemically synthesized
ctagcatactttttgacaca

SEQ ID NO: 124826 - DNA, 20 bp, Artificial Sequence
  chemically synthesized
catactttttgacacacagc

SEQ ID NO: 124827 - DNA, 20 bp, Artificial Sequence
  chemically synthesized
acacagcaagcattcactaa

SEQ ID NO: 124828 - DNA, 20 bp, Artificial Sequence
  chemically synthesized
ctaatgttaataataacttt

SEQ ID NO: 124829 - DNA, 20 bp, Artificial Sequence
  chemically synthesized
ctaaaagttattattaacat

SEQ ID NO: 124830 - DNA, 20 bp, Artificial Sequence
  chemically synthesized
taaaagttattattaacatt

SEQ ID NO: 124831 - DNA, 20 bp, Artificial Sequence
  chemically synthesized
cattaggattactttaattt

SEQ ID NO: 124832 - DNA, 20 bp, Artificial Sequence
  chemically synthesized
aatgatgtatgctaaaatta

SEQ ID NO: 124833 - DNA, 20 bp, Artificial Sequence
  chemically synthesized
aattttagcatacatcattc

SEQ ID NO: 124834 - DNA, 20 bp, Artificial Sequence
  chemically synthesized
agcatacatcattcaagaaa

SEQ ID NO: 124835 - DNA, 20 bp, Artificial Sequence
  chemically synthesized
agaaatggatgaaaaaatta

SEQ ID NO: 124836 - DNA, 20 bp, Artificial Sequence
  chemically synthesized
ggatgaaaaaattacagctt

SEQ ID NO: 124837 - DNA, 20 bp, Artificial Sequence
  chemically synthesized
gatacagataaagatggcca

SEQ ID NO: 124838 - DNA, 20 bp, Artificial Sequence
  chemically synthesized
gttcccgatacagataaaga

SEQ ID NO: 124839 - DNA, 20 bp, Artificial Sequence
  chemically synthesized
gtaagttcccgatacagata

SEQ ID NO: 124840 - DNA, 20 bp, Artificial Sequence
  chemically synthesized
ttggccatctttatctgtat

SEQ ID NO: 124841 - DNA, 20 bp, Artificial Sequence
  chemically synthesized
tggccatctttatctgtatc

SEQ ID NO: 124842 - DNA, 20 bp, Artificial Sequence
  chemically synthesized
ttcaatgtaagttcccgata

SEQ ID NO: 124843 - DNA, 20 bp, Artificial Sequence
  chemically synthesized
tattgctgcagattcaatgt

SEQ ID NO: 124844 - DNA, 20 bp, Artificial Sequence
  chemically synthesized
gggaacttacattgaatctg

SEQ ID NO: 124845 - DNA, 20 bp, Artificial Sequence
  chemically synthesized
tttaatgatgtgtattgctg

SEQ ID NO: 124846 - DNA, 20 bp, Artificial Sequence
  chemically synthesized
catcattaaattcctaaaca

SEQ ID NO: 124847 - DNA, 20 bp, Artificial Sequence
  chemically synthesized
tcattaaattcctaaacaca

SEQ ID NO: 124848 - DNA, 20 bp, Artificial Sequence
  chemically synthesized
tttgtttgtgctctgtgttt

SEQ ID NO: 124849 - DNA, 20 bp, Artificial Sequence
  chemically synthesized
ttttgtttgtgctctgtgtt

SEQ ID NO: 124850 - DNA, 20 bp, Artificial Sequence
  chemically synthesized
acaaaaaatgtcaatctcta

SEQ ID NO: 124851 - DNA, 20 bp, Artificial Sequence
  chemically synthesized
aaaatgtcaatctctataga

SEQ ID NO: 124852 - DNA, 20 bp, Artificial Sequence
  chemically synthesized
tggctcagccactatctata

SEQ ID NO: 124853 - DNA, 20 bp, Artificial Sequence
  chemically synthesized
atgtcaatctctatagatag

SEQ ID NO: 124854 - DNA, 20 bp, Artificial Sequence
  chemically synthesized
aatggctcagccactatcta

SEQ ID NO: 124855 - DNA, 20 bp, Artificial Sequence
  chemically synthesized
aatctctatagatagtggct

SEQ ID NO: 124856 - DNA, 20 bp, Artificial Sequence
  chemically synthesized
actacatcataaaaatggct

SEQ ID NO: 124857 - DNA, 20 bp, Artificial Sequence
  chemically synthesized
ctaaaactacatcataaaaa

SEQ ID NO: 124858 - DNA, 20 bp, Artificial Sequence
  chemically synthesized
gctgagccatttttatgatg

SEQ ID NO: 124859 - DNA, 20 bp, Artificial Sequence
  chemically synthesized
ccatttttatgatgtagttt

SEQ ID NO: 124860 - DNA, 20 bp, Artificial Sequence
  chemically synthesized
tgtagttttagaccattcca

SEQ ID NO: 124861 - DNA, 20 bp, Artificial Sequence
  chemically synthesized
aaaaaaaaaacgctttggaa

SEQ ID NO: 124862 - DNA, 20 bp, Artificial Sequence
  chemically synthesized
attaaaaaaaaaaaacgctt

SEQ ID NO: 124863 - DNA, 20 bp, Artificial Sequence
  chemically synthesized
ttttttttttttaatttcaa

SEQ ID NO: 124864 - DNA, 20 bp, Artificial Sequence
  chemically synthesized
ttaatttcaaaagtttgaca

SEQ ID NO: 124865 - DNA, 20 bp, Artificial Sequence
  chemically synthesized
taatttcaaaagtttgacaa

SEQ ID NO: 124866 - DNA, 20 bp, Artificial Sequence
  chemically synthesized
ttcaaaagtttgacaaagga

SEQ ID NO: 124867 - DNA, 20 bp, Artificial Sequence
  chemically synthesized
tagcaattataatacaattc

SEQ ID NO: 124868 - DNA, 20 bp, Artificial Sequence
  chemically synthesized
ttaatcacctaaaataaaac

SEQ ID NO: 124869 - DNA, 20 bp, Artificial Sequence
  chemically synthesized
atacaattctggttttattt

SEQ ID NO: 124870 - DNA, 20 bp, Artificial Sequence
  chemically synthesized
tacaattctggttttatttt

SEQ ID NO: 124871 - DNA, 20 bp, Artificial Sequence
  chemically synthesized
attgcattgtcaaaacatgt

SEQ ID NO: 124872 - DNA, 20 bp, Artificial Sequence
  chemically synthesized
tgcagaaggaaatatgaaag

SEQ ID NO: 124873 - DNA, 20 bp, Artificial Sequence
  chemically synthesized
atctgcagaaggaaatatga

SEQ ID NO: 124874 - DNA, 20 bp, Artificial Sequence
  chemically synthesized
tactttcatatttccttctg

SEQ ID NO: 124875 - DNA, 20 bp, Artificial Sequence
  chemically synthesized
gagacaaaaatatctgcaga

SEQ ID NO: 124876 - DNA, 20 bp, Artificial Sequence
  chemically synthesized
agagacaaaaatatctgcag

SEQ ID NO: 124877 - DNA, 20 bp, Artificial Sequence
  chemically synthesized
ataagagacaaaaatatctg

SEQ ID NO: 124878 - DNA, 20 bp, Artificial Sequence
  chemically synthesized
atatttttgtctcttattta

SEQ ID NO: 124879 - DNA, 20 bp, Artificial Sequence
  chemically synthesized
gagcaagtagctttaaataa

SEQ ID NO: 124880 - DNA, 20 bp, Artificial Sequence
  chemically synthesized
aagagcaagtagctttaaat

SEQ ID NO: 124881 - DNA, 20 bp, Artificial Sequence
  chemically synthesized
attgctcttagaagagcaag

SEQ ID NO: 124882 - DNA, 20 bp, Artificial Sequence
  chemically synthesized
ttaattgctcttagaagagc

SEQ ID NO: 124883 - DNA, 20 bp, Artificial Sequence
  chemically synthesized
ttaaagctacttgctcttct

SEQ ID NO: 124884 - DNA, 20 bp, Artificial Sequence
  chemically synthesized
aaagctacttgctcttctaa

SEQ ID NO: 124885 - DNA, 20 bp, Artificial Sequence
  chemically synthesized
gggtttaattgctcttagaa

SEQ ID NO: 124886 - DNA, 20 bp, Artificial Sequence
  chemically synthesized
tagggtttaattgctcttag

SEQ ID NO: 124887 - DNA, 20 bp, Artificial Sequence
  chemically synthesized
ggttagggtttaattgctct

SEQ ID NO: 124888 - DNA, 20 bp, Artificial Sequence
  chemically synthesized
agtgatggtaagaatggtta

SEQ ID NO: 124889 - DNA, 20 bp, Artificial Sequence
  chemically synthesized
aagtgatggtaagaatggtt

SEQ ID NO: 124890 - DNA, 20 bp, Artificial Sequence
  chemically synthesized
aaagtgatggtaagaatggt

SEQ ID NO: 124891 - DNA, 20 bp, Artificial Sequence
  chemically synthesized
tcctaaagtgatggtaagaa

SEQ ID NO: 124892 - DNA, 20 bp, Artificial Sequence
  chemically synthesized
gaaaatcctaaagtgatggt

SEQ ID NO: 124893 - DNA, 20 bp, Artificial Sequence
  chemically synthesized
aaccattcttaccatcactt

SEQ ID NO: 124894 - DNA, 20 bp, Artificial Sequence
  chemically synthesized
accattcttaccatcacttt

SEQ ID NO: 124895 - DNA, 20 bp, Artificial Sequence
  chemically synthesized
ctaagaaaatcctaaagtga

SEQ ID NO: 124896 - DNA, 20 bp, Artificial Sequence
  chemically synthesized
tttaacctaagaaaatccta

SEQ ID NO: 124897 - DNA, 20 bp, Artificial Sequence
  chemically synthesized
ccatcactttaggattttct

SEQ ID NO: 124898 - DNA, 20 bp, Artificial Sequence
  chemically synthesized
catcactttaggattttctt

SEQ ID NO: 124899 - DNA, 20 bp, Artificial Sequence
  chemically synthesized
atgagaaataaatttaacct

SEQ ID NO: 124900 - DNA, 20 bp, Artificial Sequence
  chemically synthesized
gactctggtagttagcaaat

SEQ ID NO: 124901 - DNA, 20 bp, Artificial Sequence
  chemically synthesized
atttctcatttgctaactac

SEQ ID NO: 124902 - DNA, 20 bp, Artificial Sequence
  chemically synthesized
ttctcatttgctaactacca

SEQ ID NO: 124903 - DNA, 20 bp, Artificial Sequence
  chemically synthesized
ggcaagaggactctggtagt

SEQ ID NO: 124904 - DNA, 20 bp, Artificial Sequence
  chemically synthesized
ctagggcaagaggactctgg

SEQ ID NO: 124905 - DNA, 20 bp, Artificial Sequence
  chemically synthesized
tgactagggcaagaggactc

SEQ ID NO: 124906 - DNA, 20 bp, Artificial Sequence
  chemically synthesized
ctaccagagtcctcttgccc

SEQ ID NO: 124907 - DNA, 20 bp, Artificial Sequence
  chemically synthesized
atagatttgactagggcaag

SEQ ID NO: 124908 - DNA, 20 bp, Artificial Sequence
  chemically synthesized
gatagatttgactagggcaa

SEQ ID NO: 124909 - DNA, 20 bp, Artificial Sequence
  chemically synthesized
gtgatagatttgactagggc

SEQ ID NO: 124910 - DNA, 20 bp, Artificial Sequence
  chemically synthesized
tacagtgatagatttgacta

SEQ ID NO: 124911 - DNA, 20 bp, Artificial Sequence
  chemically synthesized
atacagtgatagatttgact

SEQ ID NO: 124912 - DNA, 20 bp, Artificial Sequence
  chemically synthesized
catacagtgatagatttgac

SEQ ID NO: 124913 - DNA, 20 bp, Artificial Sequence
  chemically synthesized
agatgagaggcatacagtga

SEQ ID NO: 124914 - DNA, 20 bp, Artificial Sequence
  chemically synthesized
aaggagagatgagaggcata

SEQ ID NO: 124915 - DNA, 20 bp, Artificial Sequence
  chemically synthesized
tgagaagaaggagagatgag

SEQ ID NO: 124916 - DNA, 20 bp, Artificial Sequence
  chemically synthesized
atgagaagaaggagagatga

SEQ ID NO: 124917 - DNA, 20 bp, Artificial Sequence
  chemically synthesized
agatgagaagaaggagagat

SEQ ID NO: 124918 - DNA, 20 bp, Artificial Sequence
  chemically synthesized
gagttagatgagaagaagga

SEQ ID NO: 124919 - DNA, 20 bp, Artificial Sequence
  chemically synthesized
ttgagttagatgagaagaag

SEQ ID NO: 124920 - DNA, 20 bp, Artificial Sequence
  chemically synthesized
ccttgagttagatgagaaga

SEQ ID NO: 124921 - DNA, 20 bp, Artificial Sequence
  chemically synthesized
tccttgagttagatgagaag

SEQ ID NO: 124922 - DNA, 20 bp, Artificial Sequence
  chemically synthesized
ggatccttgagttagatgag

SEQ ID NO: 124923 - DNA, 20 bp, Artificial Sequence
  chemically synthesized
actggatccttgagttagat

SEQ ID NO: 124924 - DNA, 20 bp, Artificial Sequence
  chemically synthesized
tccttcttctcatctaactc

SEQ ID NO: 124925 - DNA, 20 bp, Artificial Sequence
  chemically synthesized
ccttcttctcatctaactca

SEQ ID NO: 124926 - DNA, 20 bp, Artificial Sequence
  chemically synthesized
tttggactggatccttgagt

SEQ ID NO: 124927 - DNA, 20 bp, Artificial Sequence
  chemically synthesized
tctcatctaactcaaggatc

SEQ ID NO: 124928 - DNA, 20 bp, Artificial Sequence
  chemically synthesized
gaagtttggactggatcctt

SEQ ID NO: 124929 - DNA, 20 bp, Artificial Sequence
  chemically synthesized
agaaaatacgaagtttggac

SEQ ID NO: 124930 - DNA, 20 bp, Artificial Sequence
  chemically synthesized
taagcagaaaatacgaagtt

SEQ ID NO: 124931 - DNA, 20 bp, Artificial Sequence
  chemically synthesized
aggtataagcagaaaatacg

SEQ ID NO: 124932 - DNA, 20 bp, Artificial Sequence
  chemically synthesized
aactggtaagaaggtataag

SEQ ID NO: 124933 - DNA, 20 bp, Artificial Sequence
  chemically synthesized
gttaactggtaagaaggtat

SEQ ID NO: 124934 - DNA, 20 bp, Artificial Sequence
  chemically synthesized
ttctgcttataccttcttac

SEQ ID NO: 124935 - DNA, 20 bp, Artificial Sequence
  chemically synthesized
aaagtagttaactggtaaga

SEQ ID NO: 124936 - DNA, 20 bp, Artificial Sequence
  chemically synthesized
caaagtagttaactggtaag

SEQ ID NO: 124937 - DNA, 20 bp, Artificial Sequence
  chemically synthesized
aaccaaagtagttaactggt

SEQ ID NO: 124938 - DNA, 20 bp, Artificial Sequence
  chemically synthesized
cacaaaccaaagtagttaac

SEQ ID NO: 124939 - DNA, 20 bp, Artificial Sequence
  chemically synthesized
ttcttaccagttaactactt

SEQ ID NO: 124940 - DNA, 20 bp, Artificial Sequence
  chemically synthesized
tattggatcacaaaccaaag

SEQ ID NO: 124941 - DNA, 20 bp, Artificial Sequence
  chemically synthesized
atctattggatcacaaacca

SEQ ID NO: 124942 - DNA, 20 bp, Artificial Sequence
  chemically synthesized
tactttggtttgtgatccaa

SEQ ID NO: 124943 - DNA, 20 bp, Artificial Sequence
  chemically synthesized
ttcggatactatgaatctat

SEQ ID NO: 124944 - DNA, 20 bp, Artificial Sequence
  chemically synthesized
tttgtgatccaatagattca

SEQ ID NO: 124945 - DNA, 20 bp, Artificial Sequence
  chemically synthesized
ttcatagtatccgaaactta

SEQ ID NO: 124946 - DNA, 20 bp, Artificial Sequence
  chemically synthesized
tttttcttctctataagttt

SEQ ID NO: 124947 - DNA, 20 bp, Artificial Sequence
  chemically synthesized
catagtatccgaaacttata

SEQ ID NO: 124948 - DNA, 20 bp, Artificial Sequence
  chemically synthesized
agtatccgaaacttatagag

SEQ ID NO: 124949 - DNA, 20 bp, Artificial Sequence
  chemically synthesized
tacttctttttcttctctat

SEQ ID NO: 124950 - DNA, 20 bp, Artificial Sequence
  chemically synthesized
cgaaacttatagagaagaaa

SEQ ID NO: 124951 - DNA, 20 bp, Artificial Sequence
  chemically synthesized
aacttatagagaagaaaaag

SEQ ID NO: 124952 - DNA, 20 bp, Artificial Sequence
  chemically synthesized
ttatagagaagaaaaagaag

SEQ ID NO: 124953 - DNA, 20 bp, Artificial Sequence
  chemically synthesized
agtcatattcgtgaggtagt

SEQ ID NO: 124954 - DNA, 20 bp, Artificial Sequence
  chemically synthesized
ctctagtcatattcgtgagg

SEQ ID NO: 124955 - DNA, 20 bp, Artificial Sequence
  chemically synthesized
aagctctagtcatattcgtg

SEQ ID NO: 124956 - DNA, 20 bp, Artificial Sequence
  chemically synthesized
aaagctctagtcatattcgt

SEQ ID NO: 124957 - DNA, 20 bp, Artificial Sequence
  chemically synthesized
gactacctcacgaatatgac

SEQ ID NO: 124958 - DNA, 20 bp, Artificial Sequence
  chemically synthesized
ctacctcacgaatatgacta

SEQ ID NO: 124959 - DNA, 20 bp, Artificial Sequence
  chemically synthesized
gtggttattcttgaaagctc

SEQ ID NO: 124960 - DNA, 20 bp, Artificial Sequence
  chemically synthesized
cgaatatgactagagctttc

SEQ ID NO: 124961 - DNA, 20 bp, Artificial Sequence
  chemically synthesized
aatcatgtggttattcttga

SEQ ID NO: 124962 - DNA, 20 bp, Artificial Sequence
  chemically synthesized
atgtaatatatagaatcatg

SEQ ID NO: 124963 - DNA, 20 bp, Artificial Sequence
  chemically synthesized
tggtctgactatgtaatata

SEQ ID NO: 124964 - DNA, 20 bp, Artificial Sequence
  chemically synthesized
acatgattctatatattaca

SEQ ID NO: 124965 - DNA, 20 bp, Artificial Sequence
  chemically synthesized
gattctatatattacatagt

SEQ ID NO: 124966 - DNA, 20 bp, Artificial Sequence
  chemically synthesized
tatatattacatagtcagac

SEQ ID NO: 124967 - DNA, 20 bp, Artificial Sequence
  chemically synthesized
atatattacatagtcagacc

SEQ ID NO: 124968 - DNA, 20 bp, Artificial Sequence
  chemically synthesized
tacatagtcagaccaggaat

SEQ ID NO: 124969 - DNA, 20 bp, Artificial Sequence
  chemically synthesized
acatagtcagaccaggaatt

SEQ ID NO: 124970 - DNA, 20 bp, Artificial Sequence
  chemically synthesized
atggtcattttcctaattcc

SEQ ID NO: 124971 - DNA, 20 bp, Artificial Sequence
  chemically synthesized
ggaattaggaaaatgaccat

SEQ ID NO: 124972 - DNA, 20 bp, Artificial Sequence
  chemically synthesized
aattaggaaaatgaccattg

SEQ ID NO: 124973 - DNA, 20 bp, Artificial Sequence
  chemically synthesized
gatgaattaggaatctccaa

SEQ ID NO: 124974 - DNA, 20 bp, Artificial Sequence
  chemically synthesized
tggatgagcatagatgaatt

SEQ ID NO: 124975 - DNA, 20 bp, Artificial Sequence
  chemically synthesized
atggatgagcatagatgaat

SEQ ID NO: 124976 - DNA, 20 bp, Artificial Sequence
  chemically synthesized
gttttttcaatggatgagca

SEQ ID NO: 124977 - DNA, 20 bp, Artificial Sequence
  chemically synthesized
taatggttttttcaatggat

SEQ ID NO: 124978 - DNA, 20 bp, Artificial Sequence
  chemically synthesized
accactaatggttttttcaa

SEQ ID NO: 124979 - DNA, 20 bp, Artificial Sequence
  chemically synthesized
tcatccattgaaaaaaccat

SEQ ID NO: 124980 - DNA, 20 bp, Artificial Sequence
  chemically synthesized
tccattgaaaaaaccattag

SEQ ID NO: 124981 - DNA, 20 bp, Artificial Sequence
  chemically synthesized
gagacacatgttaccactaa

SEQ ID NO: 124982 - DNA, 20 bp, Artificial Sequence
  chemically synthesized
tggtaacatgtgtctcttga

SEQ ID NO: 124983 - DNA, 20 bp, Artificial Sequence
  chemically synthesized
gtgaataaaaattctttcaa

SEQ ID NO: 124984 - DNA, 20 bp, Artificial Sequence
  chemically synthesized
aggtgaataaaaattctttc

SEQ ID NO: 124985 - DNA, 20 bp, Artificial Sequence
  chemically synthesized
tgaaagaatttttattcacc

SEQ ID NO: 124986 - DNA, 20 bp, Artificial Sequence
  chemically synthesized
ctctgttggagtcaaaatct

SEQ ID NO: 124987 - DNA, 20 bp, Artificial Sequence
  chemically synthesized
gctctgttggagtcaaaatc

SEQ ID NO: 124988 - DNA, 20 bp, Artificial Sequence
  chemically synthesized
cacctagattttgactccaa

SEQ ID NO: 124989 - DNA, 20 bp, Artificial Sequence
  chemically synthesized
cctagattttgactccaaca

SEQ ID NO: 124990 - DNA, 20 bp, Artificial Sequence
  chemically synthesized
tcttatcattagctctgttg

SEQ ID NO: 124991 - DNA, 20 bp, Artificial Sequence
  chemically synthesized
agtcttatcattagctctgt

SEQ ID NO: 124992 - DNA, 20 bp, Artificial Sequence
  chemically synthesized
actccaacagagctaatgat

SEQ ID NO: 124993 - DNA, 20 bp, Artificial Sequence
  chemically synthesized
gaattttacagtcttatcat

SEQ ID NO: 124994 - DNA, 20 bp, Artificial Sequence
  chemically synthesized
gaaagccacatagaatttta

SEQ ID NO: 124995 - DNA, 20 bp, Artificial Sequence
  chemically synthesized
taagactgtaaaattctatg

SEQ ID NO: 124996 - DNA, 20 bp, Artificial Sequence
  chemically synthesized
gaggatgttagaaagccaca

SEQ ID NO: 124997 - DNA, 20 bp, Artificial Sequence
  chemically synthesized
tatatgatgaggatgttaga

SEQ ID NO: 124998 - DNA, 20 bp, Artificial Sequence
  chemically synthesized
agtttatatgatgaggatgt

SEQ ID NO: 124999 - DNA, 20 bp, Artificial Sequence
  chemically synthesized
aggttttagtttatatgatg

SEQ ID NO: 125000 - DNA, 20 bp, Artificial Sequence
  chemically synthesized
aaggttttagtttatatgat

SEQ ID NO: 125001 - DNA, 20 bp, Artificial Sequence
  chemically synthesized
ctgctatgaggacaaggttt

SEQ ID NO: 125002 - DNA, 20 bp, Artificial Sequence
  chemically synthesized
cctgagctgctatgaggaca

SEQ ID NO: 125003 - DNA, 20 bp, Artificial Sequence
  chemically synthesized
aaactaaaaccttgtcctca

SEQ ID NO: 125004 - DNA, 20 bp, Artificial Sequence
  chemically synthesized
acctgagctgctatgaggac

SEQ ID NO: 125005 - DNA, 20 bp, Artificial Sequence
  chemically synthesized
ctaaaaccttgtcctcatag

SEQ ID NO: 125006 - DNA, 20 bp, Artificial Sequence
  chemically synthesized
aagggacctgagctgctatg

SEQ ID NO: 125007 - DNA, 20 bp, Artificial Sequence
  chemically synthesized
gaagggacctgagctgctat

SEQ ID NO: 125008 - DNA, 20 bp, Artificial Sequence
  chemically synthesized
accttgtcctcatagcagct

SEQ ID NO: 125009 - DNA, 20 bp, Artificial Sequence
  chemically synthesized
ccttgtcctcatagcagctc

SEQ ID NO: 125010 - DNA, 20 bp, Artificial Sequence
  chemically synthesized
ccattttatcgaagggacct

SEQ ID NO: 125011 - DNA, 20 bp, Artificial Sequence
  chemically synthesized
gtcatagccattttatcgaa

SEQ ID NO: 125012 - DNA, 20 bp, Artificial Sequence
  chemically synthesized
tgtcatagccattttatcga

SEQ ID NO: 125013 - DNA, 20 bp, Artificial Sequence
  chemically synthesized
ctgtcatagccattttatcg

SEQ ID NO: 125014 - DNA, 20 bp, Artificial Sequence
  chemically synthesized
ctcaggtcccttcgataaaa

SEQ ID NO: 125015 - DNA, 20 bp, Artificial Sequence
  chemically synthesized
cttcgataaaatggctatga

SEQ ID NO: 125016 - DNA, 20 bp, Artificial Sequence
  chemically synthesized
tcgataaaatggctatgaca

SEQ ID NO: 125017 - DNA, 20 bp, Artificial Sequence
  chemically synthesized
cttttagccaatctctgtca

SEQ ID NO: 125018 - DNA, 20 bp, Artificial Sequence
  chemically synthesized
aaaatggctatgacagagat

SEQ ID NO: 125019 - DNA, 20 bp, Artificial Sequence
  chemically synthesized
ctatgacagagattggctaa

SEQ ID NO: 125020 - DNA, 20 bp, Artificial Sequence
  chemically synthesized
taatggaattagtgagcttt

SEQ ID NO: 125021 - DNA, 20 bp, Artificial Sequence
  chemically synthesized
gaagagttaatggaattagt

SEQ ID NO: 125022 - DNA, 20 bp, Artificial Sequence
  chemically synthesized
tcaggaagagttaatggaat

SEQ ID NO: 125023 - DNA, 20 bp, Artificial Sequence
  chemically synthesized
tgaatttcaggaagagttaa

SEQ ID NO: 125024 - DNA, 20 bp, Artificial Sequence
  chemically synthesized
tctcgattgaatttcaggaa

SEQ ID NO: 125025 - DNA, 20 bp, Artificial Sequence
  chemically synthesized
gttctcgattgaatttcagg

SEQ ID NO: 125026 - DNA, 20 bp, Artificial Sequence
  chemically synthesized
cttgttctcgattgaatttc

SEQ ID NO: 125027 - DNA, 20 bp, Artificial Sequence
  chemically synthesized
acttgttctcgattgaattt

SEQ ID NO: 125028 - DNA, 20 bp, Artificial Sequence
  chemically synthesized
actcttcctgaaattcaatc

SEQ ID NO: 125029 - DNA, 20 bp, Artificial Sequence
  chemically synthesized
cctgaaattcaatcgagaac

SEQ ID NO: 125030 - DNA, 20 bp, Artificial Sequence
  chemically synthesized
cgagaacaagttctgtgtga

SEQ ID NO: 125031 - DNA, 20 bp, Artificial Sequence
  chemically synthesized
gagaacaagttctgtgtgat

SEQ ID NO: 125032 - DNA, 20 bp, Artificial Sequence
  chemically synthesized
ttccaccacatcccatcaca

SEQ ID NO: 125033 - DNA, 20 bp, Artificial Sequence
  chemically synthesized
aagttctgtgtgatgggatg

SEQ ID NO: 125034 - DNA, 20 bp, Artificial Sequence
  chemically synthesized
ttctgtgtgatgggatgtgg

SEQ ID NO: 125035 - DNA, 20 bp, Artificial Sequence
  chemically synthesized
tgtgtgatgggatgtggtgg

SEQ ID NO: 125036 - DNA, 20 bp, Artificial Sequence
  chemically synthesized
gaagtgatatacataatttc

SEQ ID NO: 125037 - DNA, 20 bp, Artificial Sequence
  chemically synthesized
aagtgatatacataatttcc

SEQ ID NO: 125038 - DNA, 20 bp, Artificial Sequence
  chemically synthesized
atatacataatttccaggcc

SEQ ID NO: 125039 - DNA, 20 bp, Artificial Sequence
  chemically synthesized
tggtgttttatggccaggcc

SEQ ID NO: 125040 - DNA, 20 bp, Artificial Sequence
  chemically synthesized
atccatggtgttttatggcc

SEQ ID NO: 125041 - DNA, 20 bp, Artificial Sequence
  chemically synthesized
aatccatggtgttttatggc

SEQ ID NO: 125042 - DNA, 20 bp, Artificial Sequence
  chemically synthesized
agtcaatccatggtgtttta

SEQ ID NO: 125043 - DNA, 20 bp, Artificial Sequence
  chemically synthesized
ggcctggccataaaacacca

SEQ ID NO: 125044 - DNA, 20 bp, Artificial Sequence
  chemically synthesized
gaatgtggtcagtcaatcca

SEQ ID NO: 125045 - DNA, 20 bp, Artificial Sequence
  chemically synthesized
aaaggaagacagaatgtggt

SEQ ID NO: 125046 - DNA, 20 bp, Artificial Sequence
  chemically synthesized
cagaaaaggaagacagaatg

SEQ ID NO: 125047 - DNA, 20 bp, Artificial Sequence
  chemically synthesized
gccactgcagaaaaggaaga

SEQ ID NO: 125048 - DNA, 20 bp, Artificial Sequence
  chemically synthesized
aaaagccactgcagaaaagg

SEQ ID NO: 125049 - DNA, 20 bp, Artificial Sequence
  chemically synthesized
cattctgtcttccttttctg

SEQ ID NO: 125050 - DNA, 20 bp, Artificial Sequence
  chemically synthesized
gccaaaagccactgcagaaa

SEQ ID NO: 125051 - DNA, 20 bp, Artificial Sequence
  chemically synthesized
tgccaaaagccactgcagaa

SEQ ID NO: 125052 - DNA, 20 bp, Artificial Sequence
  chemically synthesized
tctgtcttccttttctgcag

SEQ ID NO: 125053 - DNA, 20 bp, Artificial Sequence
  chemically synthesized
cacactgccaaaagccactg

SEQ ID NO: 125054 - DNA, 20 bp, Artificial Sequence
  chemically synthesized
tccttttctgcagtggcttt

SEQ ID NO: 125055 - DNA, 20 bp, Artificial Sequence
  chemically synthesized
ttttctgcagtggcttttgg

SEQ ID NO: 125056 - DNA, 20 bp, Artificial Sequence
  chemically synthesized
cattttcaacacactgccaa

SEQ ID NO: 125057 - DNA, 20 bp, Artificial Sequence
  chemically synthesized
ggcagtgtgttgaaaatgac

SEQ ID NO: 125058 - DNA, 20 bp, Artificial Sequence
  chemically synthesized
aatgacaagtgtcacaaaat

SEQ ID NO: 125059 - DNA, 20 bp, Artificial Sequence
  chemically synthesized
caagtgtcacaaaattggaa

SEQ ID NO: 125060 - DNA, 20 bp, Artificial Sequence
  chemically synthesized
gtcacaaaattggaaaagtc

SEQ ID NO: 125061 - DNA, 20 bp, Artificial Sequence
  chemically synthesized
tcacaaaattggaaaagtct

SEQ ID NO: 125062 - DNA, 20 bp, Artificial Sequence
  chemically synthesized
ttggaaaagtctgggtttcc

SEQ ID NO: 125063 - DNA, 20 bp, Artificial Sequence
  chemically synthesized
aacatggtcacttggaaacc

SEQ ID NO: 125064 - DNA, 20 bp, Artificial Sequence
  chemically synthesized
tgtcccccaacatggtcact

SEQ ID NO: 125065 - DNA, 20 bp, Artificial Sequence
  chemically synthesized
gggtttccaagtgaccatgt

SEQ ID NO: 125066 - DNA, 20 bp, Artificial Sequence
  chemically synthesized
ggtttccaagtgaccatgtt

SEQ ID NO: 125067 - DNA, 20 bp, Artificial Sequence
  chemically synthesized
gtttccaagtgaccatgttg

SEQ ID NO: 125068 - DNA, 20 bp, Artificial Sequence
  chemically synthesized
tttccaagtgaccatgttgg

SEQ ID NO: 125069 - DNA, 20 bp, Artificial Sequence
  chemically synthesized
ttaggagctgtcccccaaca

SEQ ID NO: 125070 - DNA, 20 bp, Artificial Sequence
  chemically synthesized
caagtgaccatgttggggga

SEQ ID NO: 125071 - DNA, 20 bp, Artificial Sequence
  chemically synthesized
catgttgggggacagctcct

SEQ ID NO: 125072 - DNA, 20 bp, Artificial Sequence
  chemically synthesized
tgggggacagctcctaagaa

SEQ ID NO: 125073 - DNA, 20 bp, Artificial Sequence
  chemically synthesized
ggttgacaagccattcttag

SEQ ID NO: 125074 - DNA, 20 bp, Artificial Sequence
  chemically synthesized
gaggttgacaagccattctt

SEQ ID NO: 125075 - DNA, 20 bp, Artificial Sequence
  chemically synthesized
agaggttgacaagccattct

SEQ ID NO: 125076 - DNA, 20 bp, Artificial Sequence
  chemically synthesized
atagtccagtagaggttgac

SEQ ID NO: 125077 - DNA, 20 bp, Artificial Sequence
  chemically synthesized
aatggcttgtcaacctctac

SEQ ID NO: 125078 - DNA, 20 bp, Artificial Sequence
  chemically synthesized
gttatatcatagtccagtag

SEQ ID NO: 125079 - DNA, 20 bp, Artificial Sequence
  chemically synthesized
ggttatatcatagtccagta

SEQ ID NO: 125080 - DNA, 20 bp, Artificial Sequence
  chemically synthesized
ttggttatatcatagtccag

SEQ ID NO: 125081 - DNA, 20 bp, Artificial Sequence
  chemically synthesized
ttcttggttatatcatagtc

SEQ ID NO: 125082 - DNA, 20 bp, Artificial Sequence
  chemically synthesized
ctgctttcttggttatatca

SEQ ID NO: 125083 - DNA, 20 bp, Artificial Sequence
  chemically synthesized
tactggactatgatataacc

SEQ ID NO: 125084 - DNA, 20 bp, Artificial Sequence
  chemically synthesized
ggactatgatataaccaaga

SEQ ID NO: 125085 - DNA, 20 bp, Artificial Sequence
  chemically synthesized
ctatgatataaccaagaaag

SEQ ID NO: 125086 - DNA, 20 bp, Artificial Sequence
  chemically synthesized
cacaataaagactgctttct

SEQ ID NO: 125087 - DNA, 20 bp, Artificial Sequence
  chemically synthesized
ctcaatagcttaacacaata

SEQ ID NO: 125088 - DNA, 20 bp, Artificial Sequence
  chemically synthesized
aaagcagtctttattgtgtt

SEQ ID NO: 125089 - DNA, 20 bp, Artificial Sequence
  chemically synthesized
ctttattgtgttaagctatt

SEQ ID NO: 125090 - DNA, 20 bp, Artificial Sequence
  chemically synthesized
aatgaactctgaaatctcaa

SEQ ID NO: 125091 - DNA, 20 bp, Artificial Sequence
  chemically synthesized
gtgttaagctattgagattt

SEQ ID NO: 125092 - DNA, 20 bp, Artificial Sequence
  chemically synthesized
gttaagctattgagatttca

SEQ ID NO: 125093 - DNA, 20 bp, Artificial Sequence
  chemically synthesized
tcagagttcatttcttacta

SEQ ID NO: 125094 - DNA, 20 bp, Artificial Sequence
  chemically synthesized
aggctatgctaagctatagt

SEQ ID NO: 125095 - DNA, 20 bp, Artificial Sequence
  chemically synthesized
gttcatttcttactatagct

SEQ ID NO: 125096 - DNA, 20 bp, Artificial Sequence
  chemically synthesized
ggttaggctatgctaagcta

SEQ ID NO: 125097 - DNA, 20 bp, Artificial Sequence
  chemically synthesized
tttcttactatagcttagca

SEQ ID NO: 125098 - DNA, 20 bp, Artificial Sequence
  chemically synthesized
tagtcaggttaggctatgct

SEQ ID NO: 125099 - DNA, 20 bp, Artificial Sequence
  chemically synthesized
atttccaaattagtcaggtt

SEQ ID NO: 125100 - DNA, 20 bp, Artificial Sequence
  chemically synthesized
catttccaaattagtcaggt

SEQ ID NO: 125101 - DNA, 20 bp, Artificial Sequence
  chemically synthesized
cttccatttccaaattagtc

SEQ ID NO: 125102 - DNA, 20 bp, Artificial Sequence
  chemically synthesized
atagcctaacctgactaatt

SEQ ID NO: 125103 - DNA, 20 bp, Artificial Sequence
  chemically synthesized
gcttccatttccaaattagt

SEQ ID NO: 125104 - DNA, 20 bp, Artificial Sequence
  chemically synthesized
aatggcttccatttccaaat

SEQ ID NO: 125105 - DNA, 20 bp, Artificial Sequence
  chemically synthesized
taacctgactaatttggaaa

SEQ ID NO: 125106 - DNA, 20 bp, Artificial Sequence
  chemically synthesized
cctgactaatttggaaatgg

SEQ ID NO: 125107 - DNA, 20 bp, Artificial Sequence
  chemically synthesized
tatcattttcttggatgaaa

SEQ ID NO: 125108 - DNA, 20 bp, Artificial Sequence
  chemically synthesized
aaatggaagccatttcatcc

SEQ ID NO: 125109 - DNA, 20 bp, Artificial Sequence
  chemically synthesized
aggaaaccgtatcattttct

SEQ ID NO: 125110 - DNA, 20 bp, Artificial Sequence
  chemically synthesized
tttcatccaagaaaatgata

SEQ ID NO: 125111 - DNA, 20 bp, Artificial Sequence
  chemically synthesized
aaatgatacggtttccttct

SEQ ID NO: 125112 - DNA, 20 bp, Artificial Sequence
  chemically synthesized
attggttatgtcatctaaga

SEQ ID NO: 125113 - DNA, 20 bp, Artificial Sequence
  chemically synthesized
aattggttatgtcatctaag

SEQ ID NO: 125114 - DNA, 20 bp, Artificial Sequence
  chemically synthesized
tcaaattggttatgtcatct

SEQ ID NO: 125115 - DNA, 20 bp, Artificial Sequence
  chemically synthesized
ttagatgacataaccaattt

SEQ ID NO: 125116 - DNA, 20 bp, Artificial Sequence
  chemically synthesized
ccagtatctgattctcaaat

SEQ ID NO: 125117 - DNA, 20 bp, Artificial Sequence
  chemically synthesized
gacataaccaatttgagaat

SEQ ID NO: 125118 - DNA, 20 bp, Artificial Sequence
  chemically synthesized
ccaatttgagaatcagatac

SEQ ID NO: 125119 - DNA, 20 bp, Artificial Sequence
  chemically synthesized
ttgagaatcagatactggtt

SEQ ID NO: 125120 - DNA, 20 bp, Artificial Sequence
  chemically synthesized
gaaaaggccttttgctaaac

SEQ ID NO: 125121 - DNA, 20 bp, Artificial Sequence
  chemically synthesized
atcagatactggtttagcaa

SEQ ID NO: 125122 - DNA, 20 bp, Artificial Sequence
  chemically synthesized
tcagatactggtttagcaaa

SEQ ID NO: 125123 - DNA, 20 bp, Artificial Sequence
  chemically synthesized
tagcaaaaggccttttctgt

SEQ ID NO: 125124 - DNA, 20 bp, Artificial Sequence
  chemically synthesized
gatattttatctgacagaaa

SEQ ID NO: 125125 - DNA, 20 bp, Artificial Sequence
  chemically synthesized
agatattttatctgacagaa

SEQ ID NO: 125126 - DNA, 20 bp, Artificial Sequence
  chemically synthesized
tctatagatattttatctga

SEQ ID NO: 125127 - DNA, 20 bp, Artificial Sequence
  chemically synthesized
tctgtcagataaaatatcta

SEQ ID NO: 125128 - DNA, 20 bp, Artificial Sequence
  chemically synthesized
tgtcagataaaatatctata

SEQ ID NO: 125129 - DNA, 20 bp, Artificial Sequence
  chemically synthesized
gtcagataaaatatctatag

SEQ ID NO: 125130 - DNA, 20 bp, Artificial Sequence
  chemically synthesized
tcagataaaatatctataga

SEQ ID NO: 125131 - DNA, 20 bp, Artificial Sequence
  chemically synthesized
cacttgatcaaaaccctcta

SEQ ID NO: 125132 - DNA, 20 bp, Artificial Sequence
  chemically synthesized
atctatagagggttttgatc

SEQ ID NO: 125133 - DNA, 20 bp, Artificial Sequence
  chemically synthesized
ggtaggaggttgatcagatt

SEQ ID NO: 125134 - DNA, 20 bp, Artificial Sequence
  chemically synthesized
tggtaggaggttgatcagat

SEQ ID NO: 125135 - DNA, 20 bp, Artificial Sequence
  chemically synthesized
taacatggtaggaggttgat

SEQ ID NO: 125136 - DNA, 20 bp, Artificial Sequence
  chemically synthesized
cagggaagtaacatggtagg

SEQ ID NO: 125137 - DNA, 20 bp, Artificial Sequence
  chemically synthesized
gcagggaagtaacatggtag

SEQ ID NO: 125138 - DNA, 20 bp, Artificial Sequence
  chemically synthesized
gagcagggaagtaacatggt

SEQ ID NO: 125139 - DNA, 20 bp, Artificial Sequence
  chemically synthesized
tgagcagggaagtaacatgg

SEQ ID NO: 125140 - DNA, 20 bp, Artificial Sequence
  chemically synthesized
ttttgagcagggaagtaaca

SEQ ID NO: 125141 - DNA, 20 bp, Artificial Sequence
  chemically synthesized
ttagggtattttgagcaggg

SEQ ID NO: 125142 - DNA, 20 bp, Artificial Sequence
  chemically synthesized
gctttagggtattttgagca

SEQ ID NO: 125143 - DNA, 20 bp, Artificial Sequence
  chemically synthesized
agctttagggtattttgagc

SEQ ID NO: 125144 - DNA, 20 bp, Artificial Sequence
  chemically synthesized
aagctttagggtattttgag

SEQ ID NO: 125145 - DNA, 20 bp, Artificial Sequence
  chemically synthesized
gttaagctttagggtatttt

SEQ ID NO: 125146 - DNA, 20 bp, Artificial Sequence
  chemically synthesized
tccctgctcaaaatacccta

SEQ ID NO: 125147 - DNA, 20 bp, Artificial Sequence
  chemically synthesized
taaacaatggttaagcttta

SEQ ID NO: 125148 - DNA, 20 bp, Artificial Sequence
  chemically synthesized
ttaaacaatggttaagcttt

SEQ ID NO: 125149 - DNA, 20 bp, Artificial Sequence
  chemically synthesized
gttaaacaatggttaagctt

SEQ ID NO: 125150 - DNA, 20 bp, Artificial Sequence
  chemically synthesized
ttaaatgttaaacaatggtt

SEQ ID NO: 125151 - DNA, 20 bp, Artificial Sequence
  chemically synthesized
agcccttaaatgttaaacaa

SEQ ID NO: 125152 - DNA, 20 bp, Artificial Sequence
  chemically synthesized
ttaaccattgtttaacattt

SEQ ID NO: 125153 - DNA, 20 bp, Artificial Sequence
  chemically synthesized
taaccattgtttaacattta

SEQ ID NO: 125154 - DNA, 20 bp, Artificial Sequence
  chemically synthesized
aaccattgtttaacatttaa

SEQ ID NO: 125155 - DNA, 20 bp, Artificial Sequence
  chemically synthesized
tatttactagtcagtttgaa

SEQ ID NO: 125156 - DNA, 20 bp, Artificial Sequence
  chemically synthesized
taagggcttttcaaactgac

SEQ ID NO: 125157 - DNA, 20 bp, Artificial Sequence
  chemically synthesized
caaacttagtatttactagt

SEQ ID NO: 125158 - DNA, 20 bp, Artificial Sequence
  chemically synthesized
ccttcaaacttagtatttac

SEQ ID NO: 125159 - DNA, 20 bp, Artificial Sequence
  chemically synthesized
caaactgactagtaaatact

SEQ ID NO: 125160 - DNA, 20 bp, Artificial Sequence
  chemically synthesized
actagtaaatactaagtttg

SEQ ID NO: 125161 - DNA, 20 bp, Artificial Sequence
  chemically synthesized
ctagtaaatactaagtttga

SEQ ID NO: 125162 - DNA, 20 bp, Artificial Sequence
  chemically synthesized
gcgtttaatcccttcaaact

SEQ ID NO: 125163 - DNA, 20 bp, Artificial Sequence
  chemically synthesized
tagtaaatactaagtttgaa

SEQ ID NO: 125164 - DNA, 20 bp, Artificial Sequence
  chemically synthesized
gaagggattaaacgcatgca

SEQ ID NO: 125165 - DNA, 20 bp, Artificial Sequence
  chemically synthesized
gttttatcaagcagcatgca

SEQ ID NO: 125166 - DNA, 20 bp, Artificial Sequence
  chemically synthesized
aataactatgttttatcaag

SEQ ID NO: 125167 - DNA, 20 bp, Artificial Sequence
  chemically synthesized
cttaataactatgttttatc

SEQ ID NO: 125168 - DNA, 20 bp, Artificial Sequence
  chemically synthesized
gcatgctgcttgataaaaca

SEQ ID NO: 125169 - DNA, 20 bp, Artificial Sequence
  chemically synthesized
cttgataaaacatagttatt

SEQ ID NO: 125170 - DNA, 20 bp, Artificial Sequence
  chemically synthesized
ataaaagaaaaaggaaaagg

SEQ ID NO: 125171 - DNA, 20 bp, Artificial Sequence
  chemically synthesized
aggataaaagaaaaaggaaa

SEQ ID NO: 125172 - DNA, 20 bp, Artificial Sequence
  chemically synthesized
caggataaaagaaaaaggaa

SEQ ID NO: 125173 - DNA, 20 bp, Artificial Sequence
  chemically synthesized
ttcctcaggataaaagaaaa

SEQ ID NO: 125174 - DNA, 20 bp, Artificial Sequence
  chemically synthesized
attcctcaggataaaagaaa

SEQ ID NO: 125175 - DNA, 20 bp, Artificial Sequence
  chemically synthesized
tttcctttttcttttatcct

SEQ ID NO: 125176 - DNA, 20 bp, Artificial Sequence
  chemically synthesized
tctataattcctcaggataa

SEQ ID NO: 125177 - DNA, 20 bp, Artificial Sequence
  chemically synthesized
ttcctttttcttttatcctg

SEQ ID NO: 125178 - DNA, 20 bp, Artificial Sequence
  chemically synthesized
ttagtagtctataattcctc

SEQ ID NO: 125179 - DNA, 20 bp, Artificial Sequence
  chemically synthesized
cttagtagtctataattcct

SEQ ID NO: 125180 - DNA, 20 bp, Artificial Sequence
  chemically synthesized
tcttttatcctgaggaatta

SEQ ID NO: 125181 - DNA, 20 bp, Artificial Sequence
  chemically synthesized
ctgaggaattatagactact

SEQ ID NO: 125182 - DNA, 20 bp, Artificial Sequence
  chemically synthesized
aggaattatagactactaag

SEQ ID NO: 125183 - DNA, 20 bp, Artificial Sequence
  chemically synthesized
tcaaatatctgtctgcttag

SEQ ID NO: 125184 - DNA, 20 bp, Artificial Sequence
  chemically synthesized
attatagactactaagcaga

SEQ ID NO: 125185 - DNA, 20 bp, Artificial Sequence
  chemically synthesized
tcctcaaatatctgtctgct

SEQ ID NO: 125186 - DNA, 20 bp, Artificial Sequence
  chemically synthesized
tactaagcagacagatattt

SEQ ID NO: 125187 - DNA, 20 bp, Artificial Sequence
  chemically synthesized
actaagcagacagatatttg

SEQ ID NO: 125188 - DNA, 20 bp, Artificial Sequence
  chemically synthesized
acagatatttgaggaaattt

SEQ ID NO: 125189 - DNA, 20 bp, Artificial Sequence
  chemically synthesized
agatatttgaggaaatttca

SEQ ID NO: 125190 - DNA, 20 bp, Artificial Sequence
  chemically synthesized
gatatttgaggaaatttcag

SEQ ID NO: 125191 - DNA, 20 bp, Artificial Sequence
  chemically synthesized
tttgaggaaatttcagagga

SEQ ID NO: 125192 - DNA, 20 bp, Artificial Sequence
  chemically synthesized
tgaggaaatttcagaggaaa

SEQ ID NO: 125193 - DNA, 20 bp, Artificial Sequence
  chemically synthesized
gaaatttcagaggaaagaga

SEQ ID NO: 125194 - DNA, 20 bp, Artificial Sequence
  chemically synthesized
atttcagaggaaagagaaag

SEQ ID NO: 125195 - DNA, 20 bp, Artificial Sequence
  chemically synthesized
ttcagaggaaagagaaagaa

SEQ ID NO: 125196 - DNA, 20 bp, Artificial Sequence
  chemically synthesized
agaggaaagagaaagaagag

SEQ ID NO: 125197 - DNA, 20 bp, Artificial Sequence
  chemically synthesized
aagagaaagaagagaagaat

SEQ ID NO: 125198 - DNA, 20 bp, Artificial Sequence
  chemically synthesized
gaaagaagagaagaatgagc

SEQ ID NO: 125199 - DNA, 20 bp, Artificial Sequence
  chemically synthesized
aaagaagagaagaatgagct

SEQ ID NO: 125200 - DNA, 20 bp, Artificial Sequence
  chemically synthesized
aagagaagaatgagctgggc

SEQ ID NO: 125201 - DNA, 20 bp, Artificial Sequence
  chemically synthesized
gagaagaatgagctgggctg

SEQ ID NO: 125202 - DNA, 20 bp, Artificial Sequence
  chemically synthesized
agaagaatgagctgggctgg

SEQ ID NO: 125203 - DNA, 20 bp, Artificial Sequence
  chemically synthesized
ccattctcttacctccagcc

SEQ ID NO: 125204 - DNA, 20 bp, Artificial Sequence
  chemically synthesized
gaatgagctgggctggaggt

SEQ ID NO: 125205 - DNA, 20 bp, Artificial Sequence
  chemically synthesized
atgagctgggctggaggtaa

SEQ ID NO: 125206 - DNA, 20 bp, Artificial Sequence
  chemically synthesized
tccccccattctcttacctc

SEQ ID NO: 125207 - DNA, 20 bp, Artificial Sequence
  chemically synthesized
ctgggctggaggtaagagaa

SEQ ID NO: 125208 - DNA, 20 bp, Artificial Sequence
  chemically synthesized
tgggctggaggtaagagaat

SEQ ID NO: 125209 - DNA, 20 bp, Artificial Sequence
  chemically synthesized
gggctggaggtaagagaatg

SEQ ID NO: 125210 - DNA, 20 bp, Artificial Sequence
  chemically synthesized
ggctggaggtaagagaatgg

SEQ ID NO: 125211 - DNA, 20 bp, Artificial Sequence
  chemically synthesized
gctggaggtaagagaatggg

SEQ ID NO: 125212 - DNA, 20 bp, Artificial Sequence
  chemically synthesized
tggaggtaagagaatggggg

SEQ ID NO: 125213 - DNA, 20 bp, Artificial Sequence
  chemically synthesized
ggtaagagaatggggggaga

SEQ ID NO: 125214 - DNA, 20 bp, Artificial Sequence
  chemically synthesized
agagaatggggggagaaagt

SEQ ID NO: 125215 - DNA, 20 bp, Artificial Sequence
  chemically synthesized
agaatggggggagaaagtga

SEQ ID NO: 125216 - DNA, 20 bp, Artificial Sequence
  chemically synthesized
caggattggggaggaataag

SEQ ID NO: 125217 - DNA, 20 bp, Artificial Sequence
  chemically synthesized
atcaggattggggaggaata

SEQ ID NO: 125218 - DNA, 20 bp, Artificial Sequence
  chemically synthesized
tatcaggattggggaggaat

SEQ ID NO: 125219 - DNA, 20 bp, Artificial Sequence
  chemically synthesized
agtgggtatcaggattgggg

SEQ ID NO: 125220 - DNA, 20 bp, Artificial Sequence
  chemically synthesized
gagtgggtatcaggattggg

SEQ ID NO: 125221 - DNA, 20 bp, Artificial Sequence
  chemically synthesized
gtgagtgggtatcaggattg

SEQ ID NO: 125222 - DNA, 20 bp, Artificial Sequence
  chemically synthesized
ggtgagtgggtatcaggatt

SEQ ID NO: 125223 - DNA, 20 bp, Artificial Sequence
  chemically synthesized
gggtgagtgggtatcaggat

SEQ ID NO: 125224 - DNA, 20 bp, Artificial Sequence
  chemically synthesized
aatgggggtgagtgggtatc

SEQ ID NO: 125225 - DNA, 20 bp, Artificial Sequence
  chemically synthesized
aaatgggggtgagtgggtat

SEQ ID NO: 125226 - DNA, 20 bp, Artificial Sequence
  chemically synthesized
atcaagaaatgggggtgagt

SEQ ID NO: 125227 - DNA, 20 bp, Artificial Sequence
  chemically synthesized
gatcaagaaatgggggtgag

SEQ ID NO: 125228 - DNA, 20 bp, Artificial Sequence
  chemically synthesized
ctggatcaagaaatgggggt

SEQ ID NO: 125229 - DNA, 20 bp, Artificial Sequence
  chemically synthesized
ggccctggatcaagaaatgg

SEQ ID NO: 125230 - DNA, 20 bp, Artificial Sequence
  chemically synthesized
aggccctggatcaagaaatg

SEQ ID NO: 125231 - DNA, 20 bp, Artificial Sequence
  chemically synthesized
gaggccctggatcaagaaat

SEQ ID NO: 125232 - DNA, 20 bp, Artificial Sequence
  chemically synthesized
ggaggccctggatcaagaaa

SEQ ID NO: 125233 - DNA, 20 bp, Artificial Sequence
  chemically synthesized
ctcacccccatttcttgatc

SEQ ID NO: 125234 - DNA, 20 bp, Artificial Sequence
  chemically synthesized
tcacccccatttcttgatcc

SEQ ID NO: 125235 - DNA, 20 bp, Artificial Sequence
  chemically synthesized
cacccccatttcttgatcca

SEQ ID NO: 125236 - DNA, 20 bp, Artificial Sequence
  chemically synthesized
ttatttggaggccctggatc

SEQ ID NO: 125237 - DNA, 20 bp, Artificial Sequence
  chemically synthesized
catatcttatttggaggccc

SEQ ID NO: 125238 - DNA, 20 bp, Artificial Sequence
  chemically synthesized
ttgatccagggcctccaaat

SEQ ID NO: 125239 - DNA, 20 bp, Artificial Sequence
  chemically synthesized
ctctttcatatcttatttgg

SEQ ID NO: 125240 - DNA, 20 bp, Artificial Sequence
  chemically synthesized
actctttcatatcttatttg

SEQ ID NO: 125241 - DNA, 20 bp, Artificial Sequence
  chemically synthesized
ctactctttcatatcttatt

SEQ ID NO: 125242 - DNA, 20 bp, Artificial Sequence
  chemically synthesized
ggcctccaaataagatatga

SEQ ID NO: 125243 - DNA, 20 bp, Artificial Sequence
  chemically synthesized
cctccaaataagatatgaaa

SEQ ID NO: 125244 - DNA, 20 bp, Artificial Sequence
  chemically synthesized
ccaaataagatatgaaagag

SEQ ID NO: 125245 - DNA, 20 bp, Artificial Sequence
  chemically synthesized
tccttcctagaaaaagtaac

SEQ ID NO: 125246 - DNA, 20 bp, Artificial Sequence
  chemically synthesized
ttccttcctagaaaaagtaa

SEQ ID NO: 125247 - DNA, 20 bp, Artificial Sequence
  chemically synthesized
agtagacctgttactttttc

SEQ ID NO: 125248 - DNA, 20 bp, Artificial Sequence
  chemically synthesized
gtagacctgttactttttct

SEQ ID NO: 125249 - DNA, 20 bp, Artificial Sequence
  chemically synthesized
gcttaattccttcctagaaa

SEQ ID NO: 125250 - DNA, 20 bp, Artificial Sequence
  chemically synthesized
gacctgttactttttctagg

SEQ ID NO: 125251 - DNA, 20 bp, Artificial Sequence
  chemically synthesized
acctgttactttttctagga

SEQ ID NO: 125252 - DNA, 20 bp, Artificial Sequence
  chemically synthesized
attcgggcttaattccttcc

SEQ ID NO: 125253 - DNA, 20 bp, Artificial Sequence
  chemically synthesized
actttttctaggaaggaatt

SEQ ID NO: 125254 - DNA, 20 bp, Artificial Sequence
  chemically synthesized
aggaaggaattaagcccgaa

SEQ ID NO: 125255 - DNA, 20 bp, Artificial Sequence
  chemically synthesized
ttgcatgaagtcaaccattc

SEQ ID NO: 125256 - DNA, 20 bp, Artificial Sequence
  chemically synthesized
gttgcatgaagtcaaccatt

SEQ ID NO: 125257 - DNA, 20 bp, Artificial Sequence
  chemically synthesized
cgtatttatgtagttgcatg

SEQ ID NO: 125258 - DNA, 20 bp, Artificial Sequence
  chemically synthesized
aattggtatacgtatttatg

SEQ ID NO: 125259 - DNA, 20 bp, Artificial Sequence
  chemically synthesized
aaatacgtataccaattttg

SEQ ID NO: 125260 - DNA, 20 bp, Artificial Sequence
  chemically synthesized
ctttaagatcacttcaaaat

SEQ ID NO: 125261 - DNA, 20 bp, Artificial Sequence
  chemically synthesized
ccaattttgaagtgatctta

SEQ ID NO: 125262 - DNA, 20 bp, Artificial Sequence
  chemically synthesized
ttttgaagtgatcttaaaga

SEQ ID NO: 125263 - DNA, 20 bp, Artificial Sequence
  chemically synthesized
ttttctgttgcaccatcttt

SEQ ID NO: 125264 - DNA, 20 bp, Artificial Sequence
  chemically synthesized
tgatcttaaagatggtgcaa

SEQ ID NO: 125265 - DNA, 20 bp, Artificial Sequence
  chemically synthesized
aagatggtgcaacagaaaac

SEQ ID NO: 125266 - DNA, 20 bp, Artificial Sequence
  chemically synthesized
gtaatctggatatagttggc

SEQ ID NO: 125267 - DNA, 20 bp, Artificial Sequence
  chemically synthesized
tttagtaatctggatatagt

SEQ ID NO: 125268 - DNA, 20 bp, Artificial Sequence
  chemically synthesized
gaaaaccagccaactatatc

SEQ ID NO: 125269 - DNA, 20 bp, Artificial Sequence
  chemically synthesized
tttgtttagtaatctggata

SEQ ID NO: 125270 - DNA, 20 bp, Artificial Sequence
  chemically synthesized
gttaattttgtttagtaatc

SEQ ID NO: 125271 - DNA, 20 bp, Artificial Sequence
  chemically synthesized
atgttaaagttaattttgtt

SEQ ID NO: 125272 - DNA, 20 bp, Artificial Sequence
  chemically synthesized
gacagctaatgtcaatgtta

SEQ ID NO: 125273 - DNA, 20 bp, Artificial Sequence
  chemically synthesized
attaactttaacattgacat

SEQ ID NO: 125274 - DNA, 20 bp, Artificial Sequence
  chemically synthesized
agagaatagaggaaaattga

SEQ ID NO: 125275 - DNA, 20 bp, Artificial Sequence
  chemically synthesized
tgagtcaaggtagagaatag

SEQ ID NO: 125276 - DNA, 20 bp, Artificial Sequence
  chemically synthesized
ttgagtcaaggtagagaata

SEQ ID NO: 125277 - DNA, 20 bp, Artificial Sequence
  chemically synthesized
ttttgagtcaaggtagagaa

SEQ ID NO: 125278 - DNA, 20 bp, Artificial Sequence
  chemically synthesized
tagacttttgagtcaaggta

SEQ ID NO: 125279 - DNA, 20 bp, Artificial Sequence
  chemically synthesized
agtagacttttgagtcaagg

SEQ ID NO: 125280 - DNA, 20 bp, Artificial Sequence
  chemically synthesized
gccagtagacttttgagtca

SEQ ID NO: 125281 - DNA, 20 bp, Artificial Sequence
  chemically synthesized
tattctctaccttgactcaa

SEQ ID NO: 125282 - DNA, 20 bp, Artificial Sequence
  chemically synthesized
agccagtagacttttgagtc

SEQ ID NO: 125283 - DNA, 20 bp, Artificial Sequence
  chemically synthesized
tgcctagccagtagactttt

SEQ ID NO: 125284 - DNA, 20 bp, Artificial Sequence
  chemically synthesized
accttgactcaaaagtctac

SEQ ID NO: 125285 - DNA, 20 bp, Artificial Sequence
  chemically synthesized
tgactcaaaagtctactggc

SEQ ID NO: 125286 - DNA, 20 bp, Artificial Sequence
  chemically synthesized
gactcaaaagtctactggct

SEQ ID NO: 125287 - DNA, 20 bp, Artificial Sequence
  chemically synthesized
gagttagcatgcctagccag

SEQ ID NO: 125288 - DNA, 20 bp, Artificial Sequence
  chemically synthesized
catgagttagcatgcctagc

SEQ ID NO: 125289 - DNA, 20 bp, Artificial Sequence
  chemically synthesized
caggcatgagttagcatgcc

SEQ ID NO: 125290 - DNA, 20 bp, Artificial Sequence
  chemically synthesized
ctaggattacaggcatgagt

SEQ ID NO: 125291 - DNA, 20 bp, Artificial Sequence
  chemically synthesized
agcactaggattacaggcat

SEQ ID NO: 125292 - DNA, 20 bp, Artificial Sequence
  chemically synthesized
ctaactcatgcctgtaatcc

SEQ ID NO: 125293 - DNA, 20 bp, Artificial Sequence
  chemically synthesized
tcccaaagcactaggattac

SEQ ID NO: 125294 - DNA, 20 bp, Artificial Sequence
  chemically synthesized
ctcccaaagcactaggatta

SEQ ID NO: 125295 - DNA, 20 bp, Artificial Sequence
  chemically synthesized
tgcctgtaatcctagtgctt

SEQ ID NO: 125296 - DNA, 20 bp, Artificial Sequence
  chemically synthesized
ccttggcctcccaaagcact

SEQ ID NO: 125297 - DNA, 20 bp, Artificial Sequence
  chemically synthesized
gcctgtaatcctagtgcttt

SEQ ID NO: 125298 - DNA, 20 bp, Artificial Sequence
  chemically synthesized
tccttggcctcccaaagcac

SEQ ID NO: 125299 - DNA, 20 bp, Artificial Sequence
  chemically synthesized
ctgtaatcctagtgctttgg

SEQ ID NO: 125300 - DNA, 20 bp, Artificial Sequence
  chemically synthesized
tgtaatcctagtgctttggg

SEQ ID NO: 125301 - DNA, 20 bp, Artificial Sequence
  chemically synthesized
tctccttccttggcctccca

SEQ ID NO: 125302 - DNA, 20 bp, Artificial Sequence
  chemically synthesized
tcctagtgctttgggaggcc

SEQ ID NO: 125303 - DNA, 20 bp, Artificial Sequence
  chemically synthesized
cctagtgctttgggaggcca

SEQ ID NO: 125304 - DNA, 20 bp, Artificial Sequence
  chemically synthesized
agtgctttgggaggccaagg

SEQ ID NO: 125305 - DNA, 20 bp, Artificial Sequence
  chemically synthesized
gtgctttgggaggccaagga

SEQ ID NO: 125306 - DNA, 20 bp, Artificial Sequence
  chemically synthesized
gctttgggaggccaaggaag

SEQ ID NO: 125307 - DNA, 20 bp, Artificial Sequence
  chemically synthesized
ctcaagcaattctccttcct

SEQ ID NO: 125308 - DNA, 20 bp, Artificial Sequence
  chemically synthesized
ccaaggaaggagaattgctt

SEQ ID NO: 125309 - DNA, 20 bp, Artificial Sequence
  chemically synthesized
caaggaaggagaattgcttg

SEQ ID NO: 125310 - DNA, 20 bp, Artificial Sequence
  chemically synthesized
aaggagaattgcttgaggcc

SEQ ID NO: 125311 - DNA, 20 bp, Artificial Sequence
  chemically synthesized
gttcttgaactcttggcctc

SEQ ID NO: 125312 - DNA, 20 bp, Artificial Sequence
  chemically synthesized
ggagaattgcttgaggccaa

SEQ ID NO: 125313 - DNA, 20 bp, Artificial Sequence
  chemically synthesized
ttgcttgaggccaagagttc

SEQ ID NO: 125314 - DNA, 20 bp, Artificial Sequence
  chemically synthesized
gagatgggttcttgaactct

SEQ ID NO: 125315 - DNA, 20 bp, Artificial Sequence
  chemically synthesized
agttcaagaacccatctcta

SEQ ID NO: 125316 - DNA, 20 bp, Artificial Sequence
  chemically synthesized
tttttgttttctgtagagat

SEQ ID NO: 125317 - DNA, 20 bp, Artificial Sequence
  chemically synthesized
atttttgttttctgtagaga

SEQ ID NO: 125318 - DNA, 20 bp, Artificial Sequence
  chemically synthesized
aaaaatttttgttttctgta

SEQ ID NO: 125319 - DNA, 20 bp, Artificial Sequence
  chemically synthesized
ttaaaaatttttgttttctg

SEQ ID NO: 125320 - DNA, 20 bp, Artificial Sequence
  chemically synthesized
aacaaaaatttttaaaaaat

SEQ ID NO: 125321 - DNA, 20 bp, Artificial Sequence
  chemically synthesized
aaaatttttaaaaaattagc

SEQ ID NO: 125322 - DNA, 20 bp, Artificial Sequence
  chemically synthesized
aaatttttaaaaaattagcc

SEQ ID NO: 125323 - DNA, 20 bp, Artificial Sequence
  chemically synthesized
tttaaaaaattagccaggcg

SEQ ID NO: 125324 - DNA, 20 bp, Artificial Sequence
  chemically synthesized
aaaaaattagccaggcgtgg

SEQ ID NO: 125325 - DNA, 20 bp, Artificial Sequence
  chemically synthesized
caggcgtgtaccaccacgcc

SEQ ID NO: 125326 - DNA, 20 bp, Artificial Sequence
  chemically synthesized
caggcgtggtggtacacgcc

SEQ ID NO: 125327 - DNA, 20 bp, Artificial Sequence
  chemically synthesized
cgtggtggtacacgcctggc

SEQ ID NO: 125328 - DNA, 20 bp, Artificial Sequence
  chemically synthesized
ggtggtacacgcctggctag

SEQ ID NO: 125329 - DNA, 20 bp, Artificial Sequence
  chemically synthesized
agtagctgggactactagcc

SEQ ID NO: 125330 - DNA, 20 bp, Artificial Sequence
  chemically synthesized
tagtagctgggactactagc

SEQ ID NO: 125331 - DNA, 20 bp, Artificial Sequence
  chemically synthesized
acacgcctggctagtagtcc

SEQ ID NO: 125332 - DNA, 20 bp, Artificial Sequence
  chemically synthesized
tccctagtagctgggactac

SEQ ID NO: 125333 - DNA, 20 bp, Artificial Sequence
  chemically synthesized
tggctagtagtcccagctac

SEQ ID NO: 125334 - DNA, 20 bp, Artificial Sequence
  chemically synthesized
ggctagtagtcccagctact

SEQ ID NO: 125335 - DNA, 20 bp, Artificial Sequence
  chemically synthesized
cctcagcctccctagtagct

SEQ ID NO: 125336 - DNA, 20 bp, Artificial Sequence
  chemically synthesized
gctagtagtcccagctacta

SEQ ID NO: 125337 - DNA, 20 bp, Artificial Sequence
  chemically synthesized
gcctcagcctccctagtagc

SEQ ID NO: 125338 - DNA, 20 bp, Artificial Sequence
  chemically synthesized
tagtagtcccagctactagg

SEQ ID NO: 125339 - DNA, 20 bp, Artificial Sequence
  chemically synthesized
agtagtcccagctactaggg

SEQ ID NO: 125340 - DNA, 20 bp, Artificial Sequence
  chemically synthesized
tcctgcctcagcctccctag

SEQ ID NO: 125341 - DNA, 20 bp, Artificial Sequence
  chemically synthesized
tcctcctgcctcagcctccc

SEQ ID NO: 125342 - DNA, 20 bp, Artificial Sequence
  chemically synthesized
tcccagctactagggaggct

SEQ ID NO: 125343 - DNA, 20 bp, Artificial Sequence
  chemically synthesized
cccagctactagggaggctg

SEQ ID NO: 125344 - DNA, 20 bp, Artificial Sequence
  chemically synthesized
agctactagggaggctgagg

SEQ ID NO: 125345 - DNA, 20 bp, Artificial Sequence
  chemically synthesized
gctactagggaggctgaggc

SEQ ID NO: 125346 - DNA, 20 bp, Artificial Sequence
  chemically synthesized
tactagggaggctgaggcag

SEQ ID NO: 125347 - DNA, 20 bp, Artificial Sequence
  chemically synthesized
actagggaggctgaggcagg

SEQ ID NO: 125348 - DNA, 20 bp, Artificial Sequence
  chemically synthesized
ctcaagcagtcctcctgcct

SEQ ID NO: 125349 - DNA, 20 bp, Artificial Sequence
  chemically synthesized
ctgaggcaggaggactgctt

SEQ ID NO: 125350 - DNA, 20 bp, Artificial Sequence
  chemically synthesized
cttgaactctggggctcaag

SEQ ID NO: 125351 - DNA, 20 bp, Artificial Sequence
  chemically synthesized
caggaggactgcttgagccc

SEQ ID NO: 125352 - DNA, 20 bp, Artificial Sequence
  chemically synthesized
agccttgaactctggggctc

SEQ ID NO: 125353 - DNA, 20 bp, Artificial Sequence
  chemically synthesized
ggaggactgcttgagcccca

SEQ ID NO: 125354 - DNA, 20 bp, Artificial Sequence
  chemically synthesized
tcactgagccttgaactctg

SEQ ID NO: 125355 - DNA, 20 bp, Artificial Sequence
  chemically synthesized
ctgcttgagccccagagttc

SEQ ID NO: 125356 - DNA, 20 bp, Artificial Sequence
  chemically synthesized
ctcactgagccttgaactct

SEQ ID NO: 125357 - DNA, 20 bp, Artificial Sequence
  chemically synthesized
tgcttgagccccagagttca

SEQ ID NO: 125358 - DNA, 20 bp, Artificial Sequence
  chemically synthesized
gctcactgagccttgaactc

SEQ ID NO: 125359 - DNA, 20 bp, Artificial Sequence
  chemically synthesized
gagccccagagttcaaggct

SEQ ID NO: 125360 - DNA, 20 bp, Artificial Sequence
  chemically synthesized
cccagagttcaaggctcagt

SEQ ID NO: 125361 - DNA, 20 bp, Artificial Sequence
  chemically synthesized
tggcacaatcatagctcact

SEQ ID NO: 125362 - DNA, 20 bp, Artificial Sequence
  chemically synthesized
aaagtgcagtggcacaatca

SEQ ID NO: 125363 - DNA, 20 bp, Artificial Sequence
  chemically synthesized
tcacccaggctaaagtgcag

SEQ ID NO: 125364 - DNA, 20 bp, Artificial Sequence
  chemically synthesized
atgattgtgccactgcactt

SEQ ID NO: 125365 - DNA, 20 bp, Artificial Sequence
  chemically synthesized
ctgtcacccaggctaaagtg

SEQ ID NO: 125366 - DNA, 20 bp, Artificial Sequence
  chemically synthesized
tgtgccactgcactttagcc

SEQ ID NO: 125367 - DNA, 20 bp, Artificial Sequence
  chemically synthesized
gtgccactgcactttagcct

SEQ ID NO: 125368 - DNA, 20 bp, Artificial Sequence
  chemically synthesized
tctcactgtcacccaggcta

SEQ ID NO: 125369 - DNA, 20 bp, Artificial Sequence
  chemically synthesized
ctgcactttagcctgggtga

SEQ ID NO: 125370 - DNA, 20 bp, Artificial Sequence
  chemically synthesized
acagagtctcactgtcaccc

SEQ ID NO: 125371 - DNA, 20 bp, Artificial Sequence
  chemically synthesized
gacagagtctcactgtcacc

SEQ ID NO: 125372 - DNA, 20 bp, Artificial Sequence
  chemically synthesized
actttagcctgggtgacagt

SEQ ID NO: 125373 - DNA, 20 bp, Artificial Sequence
  chemically synthesized
gacagtgagactctgtctct

SEQ ID NO: 125374 - DNA, 20 bp, Artificial Sequence
  chemically synthesized
tatttattttcttagagaca

SEQ ID NO: 125375 - DNA, 20 bp, Artificial Sequence
  chemically synthesized
tatatttattttcttagaga

SEQ ID NO: 125376 - DNA, 20 bp, Artificial Sequence
  chemically synthesized
tttgtatatttattttctta

SEQ ID NO: 125377 - DNA, 20 bp, Artificial Sequence
  chemically synthesized
actttgtatatttattttct

SEQ ID NO: 125378 - DNA, 20 bp, Artificial Sequence
  chemically synthesized
tctaagaaaataaatataca

SEQ ID NO: 125379 - DNA, 20 bp, Artificial Sequence
  chemically synthesized
gttaaagctgaaatgaacag

SEQ ID NO: 125380 - DNA, 20 bp, Artificial Sequence
  chemically synthesized
acaaagtctactgttcattt

SEQ ID NO: 125381 - DNA, 20 bp, Artificial Sequence
  chemically synthesized
cacgttaaagctgaaatgaa

SEQ ID NO: 125382 - DNA, 20 bp, Artificial Sequence
  chemically synthesized
attaacagaaaatcacgtta

SEQ ID NO: 125383 - DNA, 20 bp, Artificial Sequence
  chemically synthesized
gtttaatgtaaagttattaa

SEQ ID NO: 125384 - DNA, 20 bp, Artificial Sequence
  chemically synthesized
atttaatgatgtttaatgta

SEQ ID NO: 125385 - DNA, 20 bp, Artificial Sequence
  chemically synthesized
catcattaaattacaatcta

SEQ ID NO: 125386 - DNA, 20 bp, Artificial Sequence
  chemically synthesized
catttgataaaattatacca

SEQ ID NO: 125387 - DNA, 20 bp, Artificial Sequence
  chemically synthesized
ataattttatcaaatgtaac

SEQ ID NO: 125388 - DNA, 20 bp, Artificial Sequence
  chemically synthesized
acctttttaaaataaaatac

SEQ ID NO: 125389 - DNA, 20 bp, Artificial Sequence
  chemically synthesized
aaccagtattttattttaaa

SEQ ID NO: 125390 - DNA, 20 bp, Artificial Sequence
  chemically synthesized
accagtattttattttaaaa

SEQ ID NO: 125391 - DNA, 20 bp, Artificial Sequence
  chemically synthesized
agaaaccaaggttagtatca

SEQ ID NO: 125392 - DNA, 20 bp, Artificial Sequence
  chemically synthesized
ggtatctttgatactaacct

SEQ ID NO: 125393 - DNA, 20 bp, Artificial Sequence
  chemically synthesized
aaaatcacagaaaccaaggt

SEQ ID NO: 125394 - DNA, 20 bp, Artificial Sequence
  chemically synthesized
aaagaaaatcacagaaacca

SEQ ID NO: 125395 - DNA, 20 bp, Artificial Sequence
  chemically synthesized
aaaagaaaatcacagaaacc

SEQ ID NO: 125396 - DNA, 20 bp, Artificial Sequence
  chemically synthesized
tgcaatccaaaagaaaatca

SEQ ID NO: 125397 - DNA, 20 bp, Artificial Sequence
  chemically synthesized
tggtttctgtgattttcttt

SEQ ID NO: 125398 - DNA, 20 bp, Artificial Sequence
  chemically synthesized
atacagtagatgcaatccaa

SEQ ID NO: 125399 - DNA, 20 bp, Artificial Sequence
  chemically synthesized
tttggattgcatctactgta

SEQ ID NO: 125400 - DNA, 20 bp, Artificial Sequence
  chemically synthesized
ttggattgcatctactgtat

SEQ ID NO: 125401 - DNA, 20 bp, Artificial Sequence
  chemically synthesized
tggattgcatctactgtata

SEQ ID NO: 125402 - DNA, 20 bp, Artificial Sequence
  chemically synthesized
gaaggagggtccctatacag

SEQ ID NO: 125403 - DNA, 20 bp, Artificial Sequence
  chemically synthesized
atggaaggagggtccctata

SEQ ID NO: 125404 - DNA, 20 bp, Artificial Sequence
  chemically synthesized
aagcttgagtcatggaagga

SEQ ID NO: 125405 - DNA, 20 bp, Artificial Sequence
  chemically synthesized
caagcttgagtcatggaagg

SEQ ID NO: 125406 - DNA, 20 bp, Artificial Sequence
  chemically synthesized
ccaagcttgagtcatggaag

SEQ ID NO: 125407 - DNA, 20 bp, Artificial Sequence
  chemically synthesized
agccaagcttgagtcatgga

SEQ ID NO: 125408 - DNA, 20 bp, Artificial Sequence
  chemically synthesized
gagccaagcttgagtcatgg

SEQ ID NO: 125409 - DNA, 20 bp, Artificial Sequence
  chemically synthesized
ggaccctccttccatgactc

SEQ ID NO: 125410 - DNA, 20 bp, Artificial Sequence
  chemically synthesized
ccagagccaagcttgagtca

SEQ ID NO: 125411 - DNA, 20 bp, Artificial Sequence
  chemically synthesized
ctccttccatgactcaagct

SEQ ID NO: 125412 - DNA, 20 bp, Artificial Sequence
  chemically synthesized
gacaggccagagccaagctt

SEQ ID NO: 125413 - DNA, 20 bp, Artificial Sequence
  chemically synthesized
ccatgactcaagcttggctc

SEQ ID NO: 125414 - DNA, 20 bp, Artificial Sequence
  chemically synthesized
tcttaggacaggccagagcc

SEQ ID NO: 125415 - DNA, 20 bp, Artificial Sequence
  chemically synthesized
gcaggtcttaggacaggcca

SEQ ID NO: 125416 - DNA, 20 bp, Artificial Sequence
  chemically synthesized
gagcaggtcttaggacaggc

SEQ ID NO: 125417 - DNA, 20 bp, Artificial Sequence
  chemically synthesized
gcttggctctggcctgtcct

SEQ ID NO: 125418 - DNA, 20 bp, Artificial Sequence
  chemically synthesized
agctgagcaggtcttaggac

SEQ ID NO: 125419 - DNA, 20 bp, Artificial Sequence
  chemically synthesized
aagctgagcaggtcttagga

SEQ ID NO: 125420 - DNA, 20 bp, Artificial Sequence
  chemically synthesized
gaagaagctgagcaggtctt

SEQ ID NO: 125421 - DNA, 20 bp, Artificial Sequence
  chemically synthesized
ggaagaagctgagcaggtct

SEQ ID NO: 125422 - DNA, 20 bp, Artificial Sequence
  chemically synthesized
ggcctgtcctaagacctgct

SEQ ID NO: 125423 - DNA, 20 bp, Artificial Sequence
  chemically synthesized
agctaaggaagaagctgagc

SEQ ID NO: 125424 - DNA, 20 bp, Artificial Sequence
  chemically synthesized
aagctaaggaagaagctgag

SEQ ID NO: 125425 - DNA, 20 bp, Artificial Sequence
  chemically synthesized
tggaagctaaggaagaagct

SEQ ID NO: 125426 - DNA, 20 bp, Artificial Sequence
  chemically synthesized
gacctgctcagcttcttcct

SEQ ID NO: 125427 - DNA, 20 bp, Artificial Sequence
  chemically synthesized
atggctggaagctaaggaag

SEQ ID NO: 125428 - DNA, 20 bp, Artificial Sequence
  chemically synthesized
acaatggctggaagctaagg

SEQ ID NO: 125429 - DNA, 20 bp, Artificial Sequence
  chemically synthesized
tcagcttcttccttagcttc

SEQ ID NO: 125430 - DNA, 20 bp, Artificial Sequence
  chemically synthesized
aacacaatggctggaagcta

SEQ ID NO: 125431 - DNA, 20 bp, Artificial Sequence
  chemically synthesized
caacacaatggctggaagct

SEQ ID NO: 125432 - DNA, 20 bp, Artificial Sequence
  chemically synthesized
ggattcaacacaatggctgg

SEQ ID NO: 125433 - DNA, 20 bp, Artificial Sequence
  chemically synthesized
aaaggattcaacacaatggc

SEQ ID NO: 125434 - DNA, 20 bp, Artificial Sequence
  chemically synthesized
tgttaaaggattcaacacaa

SEQ ID NO: 125435 - DNA, 20 bp, Artificial Sequence
  chemically synthesized
acagttgaatgaaatgttaa

SEQ ID NO: 125436 - DNA, 20 bp, Artificial Sequence
  chemically synthesized
aacagttgaatgaaatgtta

SEQ ID NO: 125437 - DNA, 20 bp, Artificial Sequence
  chemically synthesized
tttcattcaactgttgcctc

SEQ ID NO: 125438 - DNA, 20 bp, Artificial Sequence
  chemically synthesized
accttcagaaccggaggcaa

SEQ ID NO: 125439 - DNA, 20 bp, Artificial Sequence
  chemically synthesized
aagaacaccttcagaaccgg

SEQ ID NO: 125440 - DNA, 20 bp, Artificial Sequence
  chemically synthesized
caagaacaccttcagaaccg

SEQ ID NO: 125441 - DNA, 20 bp, Artificial Sequence
  chemically synthesized
aactgttgcctccggttctg

SEQ ID NO: 125442 - DNA, 20 bp, Artificial Sequence
  chemically synthesized
actgttgcctccggttctga

SEQ ID NO: 125443 - DNA, 20 bp, Artificial Sequence
  chemically synthesized
tacaagaacaccttcagaac

SEQ ID NO: 125444 - DNA, 20 bp, Artificial Sequence
  chemically synthesized
atgaagtacaagaacacctt

SEQ ID NO: 125445 - DNA, 20 bp, Artificial Sequence
  chemically synthesized
gaatcagtgggatgaagtac

SEQ ID NO: 125446 - DNA, 20 bp, Artificial Sequence
  chemically synthesized
aattcagaatcagtgggatg

SEQ ID NO: 125447 - DNA, 20 bp, Artificial Sequence
  chemically synthesized
tgaaagaattcagaatcagt

SEQ ID NO: 125448 - DNA, 20 bp, Artificial Sequence
  chemically synthesized
ttgaaagaattcagaatcag

SEQ ID NO: 125449 - DNA, 20 bp, Artificial Sequence
  chemically synthesized
tagttgaaagaattcagaat

SEQ ID NO: 125450 - DNA, 20 bp, Artificial Sequence
  chemically synthesized
ttattctagttgaaagaatt

SEQ ID NO: 125451 - DNA, 20 bp, Artificial Sequence
  chemically synthesized
tgattctgaattctttcaac

SEQ ID NO: 125452 - DNA, 20 bp, Artificial Sequence
  chemically synthesized
tttccttttattctagttga

SEQ ID NO: 125453 - DNA, 20 bp, Artificial Sequence
  chemically synthesized
aattctttcaactagaataa

SEQ ID NO: 125454 - DNA, 20 bp, Artificial Sequence
  chemically synthesized
attctttcaactagaataaa

SEQ ID NO: 125455 - DNA, 20 bp, Artificial Sequence
  chemically synthesized
atttatttttccttttattc

SEQ ID NO: 125456 - DNA, 20 bp, Artificial Sequence
  chemically synthesized
taaaaggaaaaataaatata

SEQ ID NO: 125457 - DNA, 20 bp, Artificial Sequence
  chemically synthesized
aaggaaaaataaatatatag

SEQ ID NO: 125458 - DNA, 20 bp, Artificial Sequence
  chemically synthesized
aaatatatagtagtaaatgc

SEQ ID NO: 125459 - DNA, 20 bp, Artificial Sequence
  chemically synthesized
tatagtagtaaatgctagtc

SEQ ID NO: 125460 - DNA, 20 bp, Artificial Sequence
  chemically synthesized
tagtagtaaatgctagtctg

SEQ ID NO: 125461 - DNA, 20 bp, Artificial Sequence
  chemically synthesized
agtagtaaatgctagtctgg

SEQ ID NO: 125462 - DNA, 20 bp, Artificial Sequence
  chemically synthesized
ttaaaatgtctcctccagac

SEQ ID NO: 125463 - DNA, 20 bp, Artificial Sequence
  chemically synthesized
tagtaaatgctagtctggag

SEQ ID NO: 125464 - DNA, 20 bp, Artificial Sequence
  chemically synthesized
tacatttaaaatgtctcctc

SEQ ID NO: 125465 - DNA, 20 bp, Artificial Sequence
  chemically synthesized
aaatgtgagataacgtttgg

SEQ ID NO: 125466 - DNA, 20 bp, Artificial Sequence
  chemically synthesized
cataaatgtgagataacgtt

SEQ ID NO: 125467 - DNA, 20 bp, Artificial Sequence
  chemically synthesized
taaataagcaacataaatgt

SEQ ID NO: 125468 - DNA, 20 bp, Artificial Sequence
  chemically synthesized
caatgaataattttttaaat

SEQ ID NO: 125469 - DNA, 20 bp, Artificial Sequence
  chemically synthesized
aaaaattattcattgtgtta

SEQ ID NO: 125470 - DNA, 20 bp, Artificial Sequence
  chemically synthesized
attattcattgtgttatggc

SEQ ID NO: 125471 - DNA, 20 bp, Artificial Sequence
  chemically synthesized
ttattcattgtgttatggct

SEQ ID NO: 125472 - DNA, 20 bp, Artificial Sequence
  chemically synthesized
aatcctgttgttcatcatcc

SEQ ID NO: 125473 - DNA, 20 bp, Artificial Sequence
  chemically synthesized
atggctaggatgatgaacaa

SEQ ID NO: 125474 - DNA, 20 bp, Artificial Sequence
  chemically synthesized
tggctaggatgatgaacaac

SEQ ID NO: 125475 - DNA, 20 bp, Artificial Sequence
  chemically synthesized
tatttgccatcaaaaaagca

SEQ ID NO: 125476 - DNA, 20 bp, Artificial Sequence
  chemically synthesized
aggattctttgcttttttga

SEQ ID NO: 125477 - DNA, 20 bp, Artificial Sequence
  chemically synthesized
actaatatttgccatcaaaa

SEQ ID NO: 125478 - DNA, 20 bp, Artificial Sequence
  chemically synthesized
gcttttttgatggcaaatat

SEQ ID NO: 125479 - DNA, 20 bp, Artificial Sequence
  chemically synthesized
ccttcaggaaaataatttaa

SEQ ID NO: 125480 - DNA, 20 bp, Artificial Sequence
  chemically synthesized
tctgttaaattattttcctg

SEQ ID NO: 125481 - DNA, 20 bp, Artificial Sequence
  chemically synthesized
ctgttaaattattttcctga

SEQ ID NO: 125482 - DNA, 20 bp, Artificial Sequence
  chemically synthesized
tgatgttctatgtcaccttc

SEQ ID NO: 125483 - DNA, 20 bp, Artificial Sequence
  chemically synthesized
ttgatgttctatgtcacctt

SEQ ID NO: 125484 - DNA, 20 bp, Artificial Sequence
  chemically synthesized
ttattttcctgaaggtgaca

SEQ ID NO: 125485 - DNA, 20 bp, Artificial Sequence
  chemically synthesized
ggttctagggatcaagaatt

SEQ ID NO: 125486 - DNA, 20 bp, Artificial Sequence
  chemically synthesized
ttaactcaattcttgatccc

SEQ ID NO: 125487 - DNA, 20 bp, Artificial Sequence
  chemically synthesized
catatttggttctagggatc

SEQ ID NO: 125488 - DNA, 20 bp, Artificial Sequence
  chemically synthesized
atgattcatatttggttcta

SEQ ID NO: 125489 - DNA, 20 bp, Artificial Sequence
  chemically synthesized
gatgattcatatttggttct

SEQ ID NO: 125490 - DNA, 20 bp, Artificial Sequence
  chemically synthesized
agatgattcatatttggttc

SEQ ID NO: 125491 - DNA, 20 bp, Artificial Sequence
  chemically synthesized
tctaacagatgattcatatt

SEQ ID NO: 125492 - DNA, 20 bp, Artificial Sequence
  chemically synthesized
accaaatatgaatcatctgt

SEQ ID NO: 125493 - DNA, 20 bp, Artificial Sequence
  chemically synthesized
atatgaatcatctgttagaa

SEQ ID NO: 125494 - DNA, 20 bp, Artificial Sequence
  chemically synthesized
ctgctgtagtgcttttctaa

SEQ ID NO: 125495 - DNA, 20 bp, Artificial Sequence
  chemically synthesized
catctgttagaaaagcacta

SEQ ID NO: 125496 - DNA, 20 bp, Artificial Sequence
  chemically synthesized
ctgttagaaaagcactacag

SEQ ID NO: 125497 - DNA, 20 bp, Artificial Sequence
  chemically synthesized
gggatatggatattctgctg

SEQ ID NO: 125498 - DNA, 20 bp, Artificial Sequence
  chemically synthesized
gtggcaaggatgaggggata

SEQ ID NO: 125499 - DNA, 20 bp, Artificial Sequence
  chemically synthesized
gctgaagtggcaaggatgag

SEQ ID NO: 125500 - DNA, 20 bp, Artificial Sequence
  chemically synthesized
tgctgaagtggcaaggatga

SEQ ID NO: 125501 - DNA, 20 bp, Artificial Sequence
  chemically synthesized
gtgctgaagtggcaaggatg

SEQ ID NO: 125502 - DNA, 20 bp, Artificial Sequence
  chemically synthesized
ggtgctgaagtggcaaggat

SEQ ID NO: 125503 - DNA, 20 bp, Artificial Sequence
  chemically synthesized
tgatgggtgctgaagtggca

SEQ ID NO: 125504 - DNA, 20 bp, Artificial Sequence
  chemically synthesized
tcccctcatccttgccactt

SEQ ID NO: 125505 - DNA, 20 bp, Artificial Sequence
  chemically synthesized
ctgatgggtgctgaagtggc

SEQ ID NO: 125506 - DNA, 20 bp, Artificial Sequence
  chemically synthesized
caggctgatgggtgctgaag

SEQ ID NO: 125507 - DNA, 20 bp, Artificial Sequence
  chemically synthesized
aatcaggctgatgggtgctg

SEQ ID NO: 125508 - DNA, 20 bp, Artificial Sequence
  chemically synthesized
cttgccacttcagcacccat

SEQ ID NO: 125509 - DNA, 20 bp, Artificial Sequence
  chemically synthesized
cactgggaaatcaggctgat

SEQ ID NO: 125510 - DNA, 20 bp, Artificial Sequence
  chemically synthesized
gcactgggaaatcaggctga

SEQ ID NO: 125511 - DNA, 20 bp, Artificial Sequence
  chemically synthesized
cacccatcagcctgatttcc

SEQ ID NO: 125512 - DNA, 20 bp, Artificial Sequence
  chemically synthesized
aatgctggcactgggaaatc

SEQ ID NO: 125513 - DNA, 20 bp, Artificial Sequence
  chemically synthesized
aaatgctggcactgggaaat

SEQ ID NO: 125514 - DNA, 20 bp, Artificial Sequence
  chemically synthesized
tcagcctgatttcccagtgc

SEQ ID NO: 125515 - DNA, 20 bp, Artificial Sequence
  chemically synthesized
ggcaatgaaatgctggcact

SEQ ID NO: 125516 - DNA, 20 bp, Artificial Sequence
  chemically synthesized
aggcaatgaaatgctggcac

SEQ ID NO: 125517 - DNA, 20 bp, Artificial Sequence
  chemically synthesized
gccttcaggcaatgaaatgc

SEQ ID NO: 125518 - DNA, 20 bp, Artificial Sequence
  chemically synthesized
tgccagcatttcattgcctg

SEQ ID NO: 125519 - DNA, 20 bp, Artificial Sequence
  chemically synthesized
gccagcatttcattgcctga

SEQ ID NO: 125520 - DNA, 20 bp, Artificial Sequence
  chemically synthesized
tgtggcaacagaaagccttc

SEQ ID NO: 125521 - DNA, 20 bp, Artificial Sequence
  chemically synthesized
ctgtggcaacagaaagcctt

SEQ ID NO: 125522 - DNA, 20 bp, Artificial Sequence
  chemically synthesized
caaactcctgtggcaacaga

SEQ ID NO: 125523 - DNA, 20 bp, Artificial Sequence
  chemically synthesized
ctgaaggctttctgttgcca

SEQ ID NO: 125524 - DNA, 20 bp, Artificial Sequence
  chemically synthesized
tgaaggctttctgttgccac

SEQ ID NO: 125525 - DNA, 20 bp, Artificial Sequence
  chemically synthesized
aaagcaaactcctgtggcaa

SEQ ID NO: 125526 - DNA, 20 bp, Artificial Sequence
  chemically synthesized
aaggctttctgttgccacag

SEQ ID NO: 125527 - DNA, 20 bp, Artificial Sequence
  chemically synthesized
gatggcaaagcaaactcctg

SEQ ID NO: 125528 - DNA, 20 bp, Artificial Sequence
  chemically synthesized
agcctgtcacatggatggca

SEQ ID NO: 125529 - DNA, 20 bp, Artificial Sequence
  chemically synthesized
tgtctagcctgtcacatgga

SEQ ID NO: 125530 - DNA, 20 bp, Artificial Sequence
  chemically synthesized
ttgctttgccatccatgtga

SEQ ID NO: 125531 - DNA, 20 bp, Artificial Sequence
  chemically synthesized
tgctttgccatccatgtgac

SEQ ID NO: 125532 - DNA, 20 bp, Artificial Sequence
  chemically synthesized
ggtatgtctagcctgtcaca

SEQ ID NO: 125533 - DNA, 20 bp, Artificial Sequence
  chemically synthesized
ttgccatccatgtgacaggc

SEQ ID NO: 125534 - DNA, 20 bp, Artificial Sequence
  chemically synthesized
atgtgacaggctagacatac

SEQ ID NO: 125535 - DNA, 20 bp, Artificial Sequence
  chemically synthesized
catcagttgcctggtatgtc

SEQ ID NO: 125536 - DNA, 20 bp, Artificial Sequence
  chemically synthesized
tgtgacaggctagacatacc

SEQ ID NO: 125537 - DNA, 20 bp, Artificial Sequence
  chemically synthesized
gaggggaggcatcagttgcc

SEQ ID NO: 125538 - DNA, 20 bp, Artificial Sequence
  chemically synthesized
gggagctggaggggaggcat

SEQ ID NO: 125539 - DNA, 20 bp, Artificial Sequence
  chemically synthesized
ggcaactgatgcctcccctc

SEQ ID NO: 125540 - DNA, 20 bp, Artificial Sequence
  chemically synthesized
gcctctgggagctggagggg

SEQ ID NO: 125541 - DNA, 20 bp, Artificial Sequence
  chemically synthesized
tgcctctgggagctggaggg

SEQ ID NO: 125542 - DNA, 20 bp, Artificial Sequence
  chemically synthesized
gctgcctctgggagctggag

SEQ ID NO: 125543 - DNA, 20 bp, Artificial Sequence
  chemically synthesized
ggctgcctctgggagctgga

SEQ ID NO: 125544 - DNA, 20 bp, Artificial Sequence
  chemically synthesized
aggctgcctctgggagctgg

SEQ ID NO: 125545 - DNA, 20 bp, Artificial Sequence
  chemically synthesized
gatgcctcccctccagctcc

SEQ ID NO: 125546 - DNA, 20 bp, Artificial Sequence
  chemically synthesized
caggctgcctctgggagctg

SEQ ID NO: 125547 - DNA, 20 bp, Artificial Sequence
  chemically synthesized
tgcctcccctccagctccca

SEQ ID NO: 125548 - DNA, 20 bp, Artificial Sequence
  chemically synthesized
tacaggctgcctctgggagc

SEQ ID NO: 125549 - DNA, 20 bp, Artificial Sequence
  chemically synthesized
gcctcccctccagctcccag

SEQ ID NO: 125550 - DNA, 20 bp, Artificial Sequence
  chemically synthesized
tcccctccagctcccagagg

SEQ ID NO: 125551 - DNA, 20 bp, Artificial Sequence
  chemically synthesized
tatatacaggctgcctctgg

SEQ ID NO: 125552 - DNA, 20 bp, Artificial Sequence
  chemically synthesized
attatatacaggctgcctct

SEQ ID NO: 125553 - DNA, 20 bp, Artificial Sequence
  chemically synthesized
cattatatacaggctgcctc

SEQ ID NO: 125554 - DNA, 20 bp, Artificial Sequence
  chemically synthesized
tacaattagtcattatatac

SEQ ID NO: 125555 - DNA, 20 bp, Artificial Sequence
  chemically synthesized
ctacaattagtcattatata

SEQ ID NO: 125556 - DNA, 20 bp, Artificial Sequence
  chemically synthesized
ctgtatataatgactaattg

SEQ ID NO: 125557 - DNA, 20 bp, Artificial Sequence
  chemically synthesized
tgtatataatgactaattgt

SEQ ID NO: 125558 - DNA, 20 bp, Artificial Sequence
  chemically synthesized
aatatcccaattcctacaat

SEQ ID NO: 125559 - DNA, 20 bp, Artificial Sequence
  chemically synthesized
taatgactaattgtaggaat

SEQ ID NO: 125560 - DNA, 20 bp, Artificial Sequence
  chemically synthesized
aatgactaattgtaggaatt

SEQ ID NO: 125561 - DNA, 20 bp, Artificial Sequence
  chemically synthesized
gaattgggatattgttacac

SEQ ID NO: 125562 - DNA, 20 bp, Artificial Sequence
  chemically synthesized
tcccctagcatcaagggagc

SEQ ID NO: 125563 - DNA, 20 bp, Artificial Sequence
  chemically synthesized
tatttcccctagcatcaagg

SEQ ID NO: 125564 - DNA, 20 bp, Artificial Sequence
  chemically synthesized
tacactagctcccttgatgc

SEQ ID NO: 125565 - DNA, 20 bp, Artificial Sequence
  chemically synthesized
gttatttcccctagcatcaa

SEQ ID NO: 125566 - DNA, 20 bp, Artificial Sequence
  chemically synthesized
acactagctcccttgatgct

SEQ ID NO: 125567 - DNA, 20 bp, Artificial Sequence
  chemically synthesized
agttatttcccctagcatca

SEQ ID NO: 125568 - DNA, 20 bp, Artificial Sequence
  chemically synthesized
cactagctcccttgatgcta

SEQ ID NO: 125569 - DNA, 20 bp, Artificial Sequence
  chemically synthesized
gagttatttcccctagcatc

SEQ ID NO: 125570 - DNA, 20 bp, Artificial Sequence
  chemically synthesized
actagctcccttgatgctag

SEQ ID NO: 125571 - DNA, 20 bp, Artificial Sequence
  chemically synthesized
tgcctcagagttatttcccc

SEQ ID NO: 125572 - DNA, 20 bp, Artificial Sequence
  chemically synthesized
atgctaggggaaataactct

SEQ ID NO: 125573 - DNA, 20 bp, Artificial Sequence
  chemically synthesized
tgctaggggaaataactctg

SEQ ID NO: 125574 - DNA, 20 bp, Artificial Sequence
  chemically synthesized
cttgtaaaatacatgcctca

SEQ ID NO: 125575 - DNA, 20 bp, Artificial Sequence
  chemically synthesized
cccttgtaaaatacatgcct

SEQ ID NO: 125576 - DNA, 20 bp, Artificial Sequence
  chemically synthesized
ctctgaggcatgtattttac

SEQ ID NO: 125577 - DNA, 20 bp, Artificial Sequence
  chemically synthesized
tctgaggcatgtattttaca

SEQ ID NO: 125578 - DNA, 20 bp, Artificial Sequence
  chemically synthesized
ctgaggcatgtattttacaa

SEQ ID NO: 125579 - DNA, 20 bp, Artificial Sequence
  chemically synthesized
catgtattttacaagggttc

SEQ ID NO: 125580 - DNA, 20 bp, Artificial Sequence
  chemically synthesized
tgtattttacaagggttcca

SEQ ID NO: 125581 - DNA, 20 bp, Artificial Sequence
  chemically synthesized
ctttatcccttgggaaactc

SEQ ID NO: 125582 - DNA, 20 bp, Artificial Sequence
  chemically synthesized
caagggttccagagtttccc

SEQ ID NO: 125583 - DNA, 20 bp, Artificial Sequence
  chemically synthesized
aagggttccagagtttccca

SEQ ID NO: 125584 - DNA, 20 bp, Artificial Sequence
  chemically synthesized
agggttccagagtttcccaa

SEQ ID NO: 125585 - DNA, 20 bp, Artificial Sequence
  chemically synthesized
tcactggagctttatccctt

SEQ ID NO: 125586 - DNA, 20 bp, Artificial Sequence
  chemically synthesized
ccagagtttcccaagggata

SEQ ID NO: 125587 - DNA, 20 bp, Artificial Sequence
  chemically synthesized
gtcactggagctttatccct

SEQ ID NO: 125588 - DNA, 20 bp, Artificial Sequence
  chemically synthesized
tttcccaagggataaagctc

SEQ ID NO: 125589 - DNA, 20 bp, Artificial Sequence
  chemically synthesized
gctgctgttgtgggtcactg

SEQ ID NO: 125590 - DNA, 20 bp, Artificial Sequence
  chemically synthesized
cagctgctgttgtgggtcac

SEQ ID NO: 125591 - DNA, 20 bp, Artificial Sequence
  chemically synthesized
aaagctccagtgacccacaa

SEQ ID NO: 125592 - DNA, 20 bp, Artificial Sequence
  chemically synthesized
gctccagtgacccacaacag

SEQ ID NO: 125593 - DNA, 20 bp, Artificial Sequence
  chemically synthesized
atcaagccagctgctgttgt

SEQ ID NO: 125594 - DNA, 20 bp, Artificial Sequence
  chemically synthesized
tatcaagccagctgctgttg

SEQ ID NO: 125595 - DNA, 20 bp, Artificial Sequence
  chemically synthesized
cagtgacccacaacagcagc

SEQ ID NO: 125596 - DNA, 20 bp, Artificial Sequence
  chemically synthesized
agagtggtgcattatcaagc

SEQ ID NO: 125597 - DNA, 20 bp, Artificial Sequence
  chemically synthesized
gtaaagagtggtgcattatc

SEQ ID NO: 125598 - DNA, 20 bp, Artificial Sequence
  chemically synthesized
gcaaggcagccagtaaagag

SEQ ID NO: 125599 - DNA, 20 bp, Artificial Sequence
  chemically synthesized
gataatgcaccactctttac

SEQ ID NO: 125600 - DNA, 20 bp, Artificial Sequence
  chemically synthesized
gaggcaaggcagccagtaaa

SEQ ID NO: 125601 - DNA, 20 bp, Artificial Sequence
  chemically synthesized
gtgaggcaaggcagccagta

SEQ ID NO: 125602 - DNA, 20 bp, Artificial Sequence
  chemically synthesized
gacaggtgaggcaaggcagc

SEQ ID NO: 125603 - DNA, 20 bp, Artificial Sequence
  chemically synthesized
atgagacaggtgaggcaagg

SEQ ID NO: 125604 - DNA, 20 bp, Artificial Sequence
  chemically synthesized
aaaatgagacaggtgaggca

SEQ ID NO: 125605 - DNA, 20 bp, Artificial Sequence
  chemically synthesized
aaaaatgagacaggtgaggc

SEQ ID NO: 125606 - DNA, 20 bp, Artificial Sequence
  chemically synthesized
gtggaaaaatgagacaggtg

SEQ ID NO: 125607 - DNA, 20 bp, Artificial Sequence
  chemically synthesized
agtggaaaaatgagacaggt

SEQ ID NO: 125608 - DNA, 20 bp, Artificial Sequence
  chemically synthesized
gaagagtggaaaaatgagac

SEQ ID NO: 125609 - DNA, 20 bp, Artificial Sequence
  chemically synthesized
agaagagtggaaaaatgaga

SEQ ID NO: 125610 - DNA, 20 bp, Artificial Sequence
  chemically synthesized
cagtagaagagtggaaaaat

SEQ ID NO: 125611 - DNA, 20 bp, Artificial Sequence
  chemically synthesized
taaattaatcagtagaagag

SEQ ID NO: 125612 - DNA, 20 bp, Artificial Sequence
  chemically synthesized
gggtaaattaatcagtagaa

SEQ ID NO: 125613 - DNA, 20 bp, Artificial Sequence
  chemically synthesized
gggggtaaattaatcagtag

SEQ ID NO: 125614 - DNA, 20 bp, Artificial Sequence
  chemically synthesized
ttggggggtaaattaatcag

SEQ ID NO: 125615 - DNA, 20 bp, Artificial Sequence
  chemically synthesized
tatttggggggtaaattaat

SEQ ID NO: 125616 - DNA, 20 bp, Artificial Sequence
  chemically synthesized
gagcaagtgatttatttggg

SEQ ID NO: 125617 - DNA, 20 bp, Artificial Sequence
  chemically synthesized
agagcaagtgatttatttgg

SEQ ID NO: 125618 - DNA, 20 bp, Artificial Sequence
  chemically synthesized
aagagcaagtgatttatttg

SEQ ID NO: 125619 - DNA, 20 bp, Artificial Sequence
  chemically synthesized
taagagcaagtgatttattt

SEQ ID NO: 125620 - DNA, 20 bp, Artificial Sequence
  chemically synthesized
ttaagagcaagtgatttatt

SEQ ID NO: 125621 - DNA, 20 bp, Artificial Sequence
  chemically synthesized
ttggaaaaggttttaagagc

SEQ ID NO: 125622 - DNA, 20 bp, Artificial Sequence
  chemically synthesized
acccttggaaaaggttttaa

SEQ ID NO: 125623 - DNA, 20 bp, Artificial Sequence
  chemically synthesized
agacccttggaaaaggtttt

SEQ ID NO: 125624 - DNA, 20 bp, Artificial Sequence
  chemically synthesized
ttgctcttaaaaccttttcc

SEQ ID NO: 125625 - DNA, 20 bp, Artificial Sequence
  chemically synthesized
tgctcttaaaaccttttcca

SEQ ID NO: 125626 - DNA, 20 bp, Artificial Sequence
  chemically synthesized
gctcttaaaaccttttccaa

SEQ ID NO: 125627 - DNA, 20 bp, Artificial Sequence
  chemically synthesized
actcagaagacccttggaaa

SEQ ID NO: 125628 - DNA, 20 bp, Artificial Sequence
  chemically synthesized
cactcagaagacccttggaa

SEQ ID NO: 125629 - DNA, 20 bp, Artificial Sequence
  chemically synthesized
gggttcactcagaagaccct

SEQ ID NO: 125630 - DNA, 20 bp, Artificial Sequence
  chemically synthesized
accttttccaagggtcttct

SEQ ID NO: 125631 - DNA, 20 bp, Artificial Sequence
  chemically synthesized
cttcccttgggttcactcag

SEQ ID NO: 125632 - DNA, 20 bp, Artificial Sequence
  chemically synthesized
tatcttcccttgggttcact

SEQ ID NO: 125633 - DNA, 20 bp, Artificial Sequence
  chemically synthesized
agggtcttctgagtgaaccc

SEQ ID NO: 125634 - DNA, 20 bp, Artificial Sequence
  chemically synthesized
gggtcttctgagtgaaccca

SEQ ID NO: 125635 - DNA, 20 bp, Artificial Sequence
  chemically synthesized
ggtcttctgagtgaacccaa

SEQ ID NO: 125636 - DNA, 20 bp, Artificial Sequence
  chemically synthesized
cttctgagtgaacccaaggg

SEQ ID NO: 125637 - DNA, 20 bp, Artificial Sequence
  chemically synthesized
taatacacttatcttccctt

SEQ ID NO: 125638 - DNA, 20 bp, Artificial Sequence
  chemically synthesized
ctaatacacttatcttccct

SEQ ID NO: 125639 - DNA, 20 bp, Artificial Sequence
  chemically synthesized
gagtgaacccaagggaagat

SEQ ID NO: 125640 - DNA, 20 bp, Artificial Sequence
  chemically synthesized
ccaagggaagataagtgtat

SEQ ID NO: 125641 - DNA, 20 bp, Artificial Sequence
  chemically synthesized
aaaaaagaaagaaaaagaag

SEQ ID NO: 125642 - DNA, 20 bp, Artificial Sequence
  chemically synthesized
aaaaaaaaagaaagaaaaag

SEQ ID NO: 125643 - DNA, 20 bp, Artificial Sequence
  chemically synthesized
aaaaaaaaaaaagaaagaaa

SEQ ID NO: 125644 - DNA, 20 bp, Artificial Sequence
  chemically synthesized
tccatcaaaaaaaaaaaaga

SEQ ID NO: 125645 - DNA, 20 bp, Artificial Sequence
  chemically synthesized
aaactccatcaaaaaaaaaa

SEQ ID NO: 125646 - DNA, 20 bp, Artificial Sequence
  chemically synthesized
tctttcttttttttttttga

SEQ ID NO: 125647 - DNA, 20 bp, Artificial Sequence
  chemically synthesized
tttcttttttttttttgatg

SEQ ID NO: 125648 - DNA, 20 bp, Artificial Sequence
  chemically synthesized
cactccagcctgggttacaa

SEQ ID NO: 125649 - DNA, 20 bp, Artificial Sequence
  chemically synthesized
ggagttttgctcttgtaacc

SEQ ID NO: 125650 - DNA, 20 bp, Artificial Sequence
  chemically synthesized
gagttttgctcttgtaaccc

SEQ ID NO: 125651 - DNA, 20 bp, Artificial Sequence
  chemically synthesized
tgcactccagcctgggttac

SEQ ID NO: 125652 - DNA, 20 bp, Artificial Sequence
  chemically synthesized
tttgctcttgtaacccaggc

SEQ ID NO: 125653 - DNA, 20 bp, Artificial Sequence
  chemically synthesized
tgctcttgtaacccaggctg

SEQ ID NO: 125654 - DNA, 20 bp, Artificial Sequence
  chemically synthesized
gcaccattgcactccagcct

SEQ ID NO: 125655 - DNA, 20 bp, Artificial Sequence
  chemically synthesized
tgcaccattgcactccagcc

SEQ ID NO: 125656 - DNA, 20 bp, Artificial Sequence
  chemically synthesized
gagattgcaccattgcactc

SEQ ID NO: 125657 - DNA, 20 bp, Artificial Sequence
  chemically synthesized
taacccaggctggagtgcaa

SEQ ID NO: 125658 - DNA, 20 bp, Artificial Sequence
  chemically synthesized
ggcggaggttgcagtgagcg

SEQ ID NO: 125659 - DNA, 20 bp, Artificial Sequence
  chemically synthesized
gaggcggaggttgcagtgag

SEQ ID NO: 125660 - DNA, 20 bp, Artificial Sequence
  chemically synthesized
cgggaggcggaggttgcagt

SEQ ID NO: 125661 - DNA, 20 bp, Artificial Sequence
  chemically synthesized
aacccgggaggcggaggttg

SEQ ID NO: 125662 - DNA, 20 bp, Artificial Sequence
  chemically synthesized
agcttgaacccgggaggcgg

SEQ ID NO: 125663 - DNA, 20 bp, Artificial Sequence
  chemically synthesized
tcactgcaacctccgcctcc

SEQ ID NO: 125664 - DNA, 20 bp, Artificial Sequence
  chemically synthesized
tagcttgaacccgggaggcg

SEQ ID NO: 125665 - DNA, 20 bp, Artificial Sequence
  chemically synthesized
cactgcaacctccgcctccc

SEQ ID NO: 125666 - DNA, 20 bp, Artificial Sequence
  chemically synthesized
gatagcttgaacccgggagg

SEQ ID NO: 125667 - DNA, 20 bp, Artificial Sequence
  chemically synthesized
gaggatagcttgaacccggg

SEQ ID NO: 125668 - DNA, 20 bp, Artificial Sequence
  chemically synthesized
ggaggatagcttgaacccgg

SEQ ID NO: 125669 - DNA, 20 bp, Artificial Sequence
  chemically synthesized
aacctccgcctcccgggttc

SEQ ID NO: 125670 - DNA, 20 bp, Artificial Sequence
  chemically synthesized
caggaggatagcttgaaccc

SEQ ID NO: 125671 - DNA, 20 bp, Artificial Sequence
  chemically synthesized
acaggaggatagcttgaacc

SEQ ID NO: 125672 - DNA, 20 bp, Artificial Sequence
  chemically synthesized
gggaggctgagacaggagga

SEQ ID NO: 125673 - DNA, 20 bp, Artificial Sequence
  chemically synthesized
ttcaagctatcctcctgtct

SEQ ID NO: 125674 - DNA, 20 bp, Artificial Sequence
  chemically synthesized
actcgggaggctgagacagg

SEQ ID NO: 125675 - DNA, 20 bp, Artificial Sequence
  chemically synthesized
tactcgggaggctgagacag

SEQ ID NO: 125676 - DNA, 20 bp, Artificial Sequence
  chemically synthesized
gctactcgggaggctgagac

SEQ ID NO: 125677 - DNA, 20 bp, Artificial Sequence
  chemically synthesized
tgctactcgggaggctgaga

SEQ ID NO: 125678 - DNA, 20 bp, Artificial Sequence
  chemically synthesized
ttcctgctactcgggaggct

SEQ ID NO: 125679 - DNA, 20 bp, Artificial Sequence
  chemically synthesized
tcctcctgtctcagcctccc

SEQ ID NO: 125680 - DNA, 20 bp, Artificial Sequence
  chemically synthesized
tcctgtctcagcctcccgag

SEQ ID NO: 125681 - DNA, 20 bp, Artificial Sequence
  chemically synthesized
tgtagttcctgctactcggg

SEQ ID NO: 125682 - DNA, 20 bp, Artificial Sequence
  chemically synthesized
ctgtagttcctgctactcgg

SEQ ID NO: 125683 - DNA, 20 bp, Artificial Sequence
  chemically synthesized
tgtctcagcctcccgagtag

SEQ ID NO: 125684 - DNA, 20 bp, Artificial Sequence
  chemically synthesized
gtctcagcctcccgagtagc

SEQ ID NO: 125685 - DNA, 20 bp, Artificial Sequence
  chemically synthesized
gcctgtagttcctgctactc

SEQ ID NO: 125686 - DNA, 20 bp, Artificial Sequence
  chemically synthesized
tgcctgtagttcctgctact

SEQ ID NO: 125687 - DNA, 20 bp, Artificial Sequence
  chemically synthesized
ctcccgagtagcaggaacta

SEQ ID NO: 125688 - DNA, 20 bp, Artificial Sequence
  chemically synthesized
tcccgagtagcaggaactac

SEQ ID NO: 125689 - DNA, 20 bp, Artificial Sequence
  chemically synthesized
ggcatgatggcacgtgcctg

SEQ ID NO: 125690 - DNA, 20 bp, Artificial Sequence
  chemically synthesized
caggcacgtgccatcatgcc

SEQ ID NO: 125691 - DNA, 20 bp, Artificial Sequence
  chemically synthesized
aaaaaattagctgggcatga

SEQ ID NO: 125692 - DNA, 20 bp, Artificial Sequence
  chemically synthesized
acaaaaaaaaaaaattagct

SEQ ID NO: 125693 - DNA, 20 bp, Artificial Sequence
  chemically synthesized
tacaaaaaaaaaaaattagc

SEQ ID NO: 125694 - DNA, 20 bp, Artificial Sequence
  chemically synthesized
aaaatacaaaaaaaaaaaat

SEQ ID NO: 125695 - DNA, 20 bp, Artificial Sequence
  chemically synthesized
ttttttttttgtatttttaa

SEQ ID NO: 125696 - DNA, 20 bp, Artificial Sequence
  chemically synthesized
ttttttttgtatttttaata

SEQ ID NO: 125697 - DNA, 20 bp, Artificial Sequence
  chemically synthesized
ttttgtatttttaatagaga

SEQ ID NO: 125698 - DNA, 20 bp, Artificial Sequence
  chemically synthesized
tttgtatttttaatagagac

SEQ ID NO: 125699 - DNA, 20 bp, Artificial Sequence
  chemically synthesized
ttgtatttttaatagagaca

SEQ ID NO: 125700 - DNA, 20 bp, Artificial Sequence
  chemically synthesized
gagacagggtttcaccatgt

SEQ ID NO: 125701 - DNA, 20 bp, Artificial Sequence
  chemically synthesized
cagggtttcaccatgttggc

SEQ ID NO: 125702 - DNA, 20 bp, Artificial Sequence
  chemically synthesized
tgagaccagcccggccaaca

SEQ ID NO: 125703 - DNA, 20 bp, Artificial Sequence
  chemically synthesized
agggtttcaccatgttggcc

SEQ ID NO: 125704 - DNA, 20 bp, Artificial Sequence
  chemically synthesized
tttcaccatgttggccgggc

SEQ ID NO: 125705 - DNA, 20 bp, Artificial Sequence
  chemically synthesized
tcaggagtttgagaccagcc

SEQ ID NO: 125706 - DNA, 20 bp, Artificial Sequence
  chemically synthesized
tgaggtcaggagtttgagac

SEQ ID NO: 125707 - DNA, 20 bp, Artificial Sequence
  chemically synthesized
tcacctgaggtcaggagttt

SEQ ID NO: 125708 - DNA, 20 bp, Artificial Sequence
  chemically synthesized
tggtctcaaactcctgacct

SEQ ID NO: 125709 - DNA, 20 bp, Artificial Sequence
  chemically synthesized
ggtggatcacctgaggtcag

SEQ ID NO: 125710 - DNA, 20 bp, Artificial Sequence
  chemically synthesized
ggtctcaaactcctgacctc

SEQ ID NO: 125711 - DNA, 20 bp, Artificial Sequence
  chemically synthesized
caggtggatcacctgaggtc

SEQ ID NO: 125712 - DNA, 20 bp, Artificial Sequence
  chemically synthesized
gcaggtggatcacctgaggt

SEQ ID NO: 125713 - DNA, 20 bp, Artificial Sequence
  chemically synthesized
cgaggcaggtggatcacctg

SEQ ID NO: 125714 - DNA, 20 bp, Artificial Sequence
  chemically synthesized
ccgaggcaggtggatcacct

SEQ ID NO: 125715 - DNA, 20 bp, Artificial Sequence
  chemically synthesized
ctcaggtgatccacctgcct

SEQ ID NO: 125716 - DNA, 20 bp, Artificial Sequence
  chemically synthesized
ctttgggaggccgaggcagg

SEQ ID NO: 125717 - DNA, 20 bp, Artificial Sequence
  chemically synthesized
gcactttgggaggccgaggc

SEQ ID NO: 125718 - DNA, 20 bp, Artificial Sequence
  chemically synthesized
agcactttgggaggccgagg

SEQ ID NO: 125719 - DNA, 20 bp, Artificial Sequence
  chemically synthesized
cccagcactttgggaggccg

SEQ ID NO: 125720 - DNA, 20 bp, Artificial Sequence
  chemically synthesized
tcccagcactttgggaggcc

SEQ ID NO: 125721 - DNA, 20 bp, Artificial Sequence
  chemically synthesized
ccacctgcctcggcctccca

SEQ ID NO: 125722 - DNA, 20 bp, Artificial Sequence
  chemically synthesized
tgtaatcccagcactttggg

SEQ ID NO: 125723 - DNA, 20 bp, Artificial Sequence
  chemically synthesized
ctgtaatcccagcactttgg

SEQ ID NO: 125724 - DNA, 20 bp, Artificial Sequence
  chemically synthesized
gcctcggcctcccaaagtgc

SEQ ID NO: 125725 - DNA, 20 bp, Artificial Sequence
  chemically synthesized
gcctgtaatcccagcacttt

SEQ ID NO: 125726 - DNA, 20 bp, Artificial Sequence
  chemically synthesized
cctcggcctcccaaagtgct

SEQ ID NO: 125727 - DNA, 20 bp, Artificial Sequence
  chemically synthesized
cgcctgtaatcccagcactt

SEQ ID NO: 125728 - DNA, 20 bp, Artificial Sequence
  chemically synthesized
ctcccaaagtgctgggatta

SEQ ID NO: 125729 - DNA, 20 bp, Artificial Sequence
  chemically synthesized
tcccaaagtgctgggattac

SEQ ID NO: 125730 - DNA, 20 bp, Artificial Sequence
  chemically synthesized
gtggctcacgcctgtaatcc

SEQ ID NO: 125731 - DNA, 20 bp, Artificial Sequence
  chemically synthesized
agtgctgggattacaggcgt

SEQ ID NO: 125732 - DNA, 20 bp, Artificial Sequence
  chemically synthesized
caggcgtgagccaccgcgcc

SEQ ID NO: 125733 - DNA, 20 bp, Artificial Sequence
  chemically synthesized
aagaagttggccaggcgcgg

SEQ ID NO: 125734 - DNA, 20 bp, Artificial Sequence
  chemically synthesized
taaaagaagttggccaggcg

SEQ ID NO: 125735 - DNA, 20 bp, Artificial Sequence
  chemically synthesized
attgttaaaagaagttggcc

SEQ ID NO: 125736 - DNA, 20 bp, Artificial Sequence
  chemically synthesized
tattgttaaaagaagttggc

SEQ ID NO: 125737 - DNA, 20 bp, Artificial Sequence
  chemically synthesized
taggtattgttaaaagaagt

SEQ ID NO: 125738 - DNA, 20 bp, Artificial Sequence
  chemically synthesized
ttcttaggtattgttaaaag

SEQ ID NO: 125739 - DNA, 20 bp, Artificial Sequence
  chemically synthesized
gaattcttaggtattgttaa

SEQ ID NO: 125740 - DNA, 20 bp, Artificial Sequence
  chemically synthesized
aacttcttttaacaatacct

SEQ ID NO: 125741 - DNA, 20 bp, Artificial Sequence
  chemically synthesized
tgcacccagcgtgaattctt

SEQ ID NO: 125742 - DNA, 20 bp, Artificial Sequence
  chemically synthesized
atgcacccagcgtgaattct

SEQ ID NO: 125743 - DNA, 20 bp, Artificial Sequence
  chemically synthesized
caatacctaagaattcacgc

SEQ ID NO: 125744 - DNA, 20 bp, Artificial Sequence
  chemically synthesized
aatacctaagaattcacgct

SEQ ID NO: 125745 - DNA, 20 bp, Artificial Sequence
  chemically synthesized
ccagtcttacaaaatgcacc

SEQ ID NO: 125746 - DNA, 20 bp, Artificial Sequence
  chemically synthesized
tcacgctgggtgcattttgt

SEQ ID NO: 125747 - DNA, 20 bp, Artificial Sequence
  chemically synthesized
ctgggtgcattttgtaagac

SEQ ID NO: 125748 - DNA, 20 bp, Artificial Sequence
  chemically synthesized
gtgatagcctcaatataagc

SEQ ID NO: 125749 - DNA, 20 bp, Artificial Sequence
  chemically synthesized
ttgtaagactggcttatatt

SEQ ID NO: 125750 - DNA, 20 bp, Artificial Sequence
  chemically synthesized
tgtaagactggcttatattg

SEQ ID NO: 125751 - DNA, 20 bp, Artificial Sequence
  chemically synthesized
accagtgatagcctcaatat

SEQ ID NO: 125752 - DNA, 20 bp, Artificial Sequence
  chemically synthesized
gcttatattgaggctatcac

SEQ ID NO: 125753 - DNA, 20 bp, Artificial Sequence
  chemically synthesized
acttccaatgataccagtga

SEQ ID NO: 125754 - DNA, 20 bp, Artificial Sequence
  chemically synthesized
gaggctatcactggtatcat

SEQ ID NO: 125755 - DNA, 20 bp, Artificial Sequence
  chemically synthesized
tcttggacttccaatgatac

SEQ ID NO: 125756 - DNA, 20 bp, Artificial Sequence
  chemically synthesized
gctatcactggtatcattgg

SEQ ID NO: 125757 - DNA, 20 bp, Artificial Sequence
  chemically synthesized
actggtatcattggaagtcc

SEQ ID NO: 125758 - DNA, 20 bp, Artificial Sequence
  chemically synthesized
tggtatcattggaagtccaa

SEQ ID NO: 125759 - DNA, 20 bp, Artificial Sequence
  chemically synthesized
ggtatcattggaagtccaag

SEQ ID NO: 125760 - DNA, 20 bp, Artificial Sequence
  chemically synthesized
gtatcattggaagtccaaga

SEQ ID NO: 125761 - DNA, 20 bp, Artificial Sequence
  chemically synthesized
atcattggaagtccaagagg

SEQ ID NO: 125762 - DNA, 20 bp, Artificial Sequence
  chemically synthesized
tcattggaagtccaagaggg

SEQ ID NO: 125763 - DNA, 20 bp, Artificial Sequence
  chemically synthesized
tctatatagtacctccctct

SEQ ID NO: 125764 - DNA, 20 bp, Artificial Sequence
  chemically synthesized
tccaagagggaggtactata

SEQ ID NO: 125765 - DNA, 20 bp, Artificial Sequence
  chemically synthesized
atttcagagtagaatctata

SEQ ID NO: 125766 - DNA, 20 bp, Artificial Sequence
  chemically synthesized
gaaaagaacatatttcagag

SEQ ID NO: 125767 - DNA, 20 bp, Artificial Sequence
  chemically synthesized
tttgaaaagaacatatttca

SEQ ID NO: 125768 - DNA, 20 bp, Artificial Sequence
  chemically synthesized
tatttgaaaagaacatattt

SEQ ID NO: 125769 - DNA, 20 bp, Artificial Sequence
  chemically synthesized
tgtttattttaatatttgaa

SEQ ID NO: 125770 - DNA, 20 bp, Artificial Sequence
  chemically synthesized
ttttcaaatattaaaataaa

SEQ ID NO: 125771 - DNA, 20 bp, Artificial Sequence
  chemically synthesized
tttcaaatattaaaataaac

SEQ ID NO: 125772 - DNA, 20 bp, Artificial Sequence
  chemically synthesized
gttgcatagaaaaaataatg

SEQ ID NO: 125773 - DNA, 20 bp, Artificial Sequence
  chemically synthesized
accagcttagagaagttgca

SEQ ID NO: 125774 - DNA, 20 bp, Artificial Sequence
  chemically synthesized
tttttctatgcaacttctct

SEQ ID NO: 125775 - DNA, 20 bp, Artificial Sequence
  chemically synthesized
ttcataaaaccagcttagag

SEQ ID NO: 125776 - DNA, 20 bp, Artificial Sequence
  chemically synthesized
tctatgcaacttctctaagc

SEQ ID NO: 125777 - DNA, 20 bp, Artificial Sequence
  chemically synthesized
tatttcataaaaccagctta

SEQ ID NO: 125778 - DNA, 20 bp, Artificial Sequence
  chemically synthesized
tttatttcataaaaccagct

SEQ ID NO: 125779 - DNA, 20 bp, Artificial Sequence
  chemically synthesized
ttatttttatttcataaaac

SEQ ID NO: 125780 - DNA, 20 bp, Artificial Sequence
  chemically synthesized
tttatgaaataaaaataata

SEQ ID NO: 125781 - DNA, 20 bp, Artificial Sequence
  chemically synthesized
ataaaaataatacagaaaac

SEQ ID NO: 125782 - DNA, 20 bp, Artificial Sequence
  chemically synthesized
ttaagggataaagtagatgg

SEQ ID NO: 125783 - DNA, 20 bp, Artificial Sequence
  chemically synthesized
tgcttaagggataaagtaga

SEQ ID NO: 125784 - DNA, 20 bp, Artificial Sequence
  chemically synthesized
ttcatgcttaagggataaag

SEQ ID NO: 125785 - DNA, 20 bp, Artificial Sequence
  chemically synthesized
ggtttcatgcttaagggata

SEQ ID NO: 125786 - DNA, 20 bp, Artificial Sequence
  chemically synthesized
tgccatctactttatccctt

SEQ ID NO: 125787 - DNA, 20 bp, Artificial Sequence
  chemically synthesized
ctatcaggtttcatgcttaa

SEQ ID NO: 125788 - DNA, 20 bp, Artificial Sequence
  chemically synthesized
tctatcaggtttcatgctta

SEQ ID NO: 125789 - DNA, 20 bp, Artificial Sequence
  chemically synthesized
gtctatcaggtttcatgctt

SEQ ID NO: 125790 - DNA, 20 bp, Artificial Sequence
  chemically synthesized
cccttaagcatgaaacctga

SEQ ID NO: 125791 - DNA, 20 bp, Artificial Sequence
  chemically synthesized
aagaatctagaatgtctatc

SEQ ID NO: 125792 - DNA, 20 bp, Artificial Sequence
  chemically synthesized
aaagaatctagaatgtctat

SEQ ID NO: 125793 - DNA, 20 bp, Artificial Sequence
  chemically synthesized
atgaaacctgatagacattc

SEQ ID NO: 125794 - DNA, 20 bp, Artificial Sequence
  chemically synthesized
gtgacgcttaggaaagaatc

SEQ ID NO: 125795 - DNA, 20 bp, Artificial Sequence
  chemically synthesized
gacattctagattctttcct

SEQ ID NO: 125796 - DNA, 20 bp, Artificial Sequence
  chemically synthesized
gtgttgggtgacgcttagga

SEQ ID NO: 125797 - DNA, 20 bp, Artificial Sequence
  chemically synthesized
tgaggtgttgggtgacgctt

SEQ ID NO: 125798 - DNA, 20 bp, Artificial Sequence
  chemically synthesized
atgaggtgttgggtgacgct

SEQ ID NO: 125799 - DNA, 20 bp, Artificial Sequence
  chemically synthesized
aactaattatatgaggtgtt

SEQ ID NO: 125800 - DNA, 20 bp, Artificial Sequence
  chemically synthesized
taactaattatatgaggtgt

SEQ ID NO: 125801 - DNA, 20 bp, Artificial Sequence
  chemically synthesized
aatttgtaactaattatatg

SEQ ID NO: 125802 - DNA, 20 bp, Artificial Sequence
  chemically synthesized
cacccaacacctcatataat

SEQ ID NO: 125803 - DNA, 20 bp, Artificial Sequence
  chemically synthesized
aaatttgtaactaattatat

SEQ ID NO: 125804 - DNA, 20 bp, Artificial Sequence
  chemically synthesized
aggaaagaagttatatatga

SEQ ID NO: 125805 - DNA, 20 bp, Artificial Sequence
  chemically synthesized
agaggaaagaagttatatat

SEQ ID NO: 125806 - DNA, 20 bp, Artificial Sequence
  chemically synthesized
tgccaatagaaagaggaaag

SEQ ID NO: 125807 - DNA, 20 bp, Artificial Sequence
  chemically synthesized
cagtgccaatagaaagagga

SEQ ID NO: 125808 - DNA, 20 bp, Artificial Sequence
  chemically synthesized
tttgcagtgccaatagaaag

SEQ ID NO: 125809 - DNA, 20 bp, Artificial Sequence
  chemically synthesized
aacttctttcctctttctat

SEQ ID NO: 125810 - DNA, 20 bp, Artificial Sequence
  chemically synthesized
gtttgcagtgccaatagaaa

SEQ ID NO: 125811 - DNA, 20 bp, Artificial Sequence
  chemically synthesized
aggtttgcagtgccaataga

SEQ ID NO: 125812 - DNA, 20 bp, Artificial Sequence
  chemically synthesized
atagaggtttgcagtgccaa

SEQ ID NO: 125813 - DNA, 20 bp, Artificial Sequence
  chemically synthesized
caaaaaatgatagaggtttg

SEQ ID NO: 125814 - DNA, 20 bp, Artificial Sequence
  chemically synthesized
gtgagggcaaaaaatgatag

SEQ ID NO: 125815 - DNA, 20 bp, Artificial Sequence
  chemically synthesized
tgtgagggcaaaaaatgata

SEQ ID NO: 125816 - DNA, 20 bp, Artificial Sequence
  chemically synthesized
gatgtgagggcaaaaaatga

SEQ ID NO: 125817 - DNA, 20 bp, Artificial Sequence
  chemically synthesized
agagcctcttatggatgtga

SEQ ID NO: 125818 - DNA, 20 bp, Artificial Sequence
  chemically synthesized
tagagcctcttatggatgtg

SEQ ID NO: 125819 - DNA, 20 bp, Artificial Sequence
  chemically synthesized
atagagcctcttatggatgt

SEQ ID NO: 125820 - DNA, 20 bp, Artificial Sequence
  chemically synthesized
ttttttgccctcacatccat

SEQ ID NO: 125821 - DNA, 20 bp, Artificial Sequence
  chemically synthesized
ttttgccctcacatccataa

SEQ ID NO: 125822 - DNA, 20 bp, Artificial Sequence
  chemically synthesized
tttgccctcacatccataag

SEQ ID NO: 125823 - DNA, 20 bp, Artificial Sequence
  chemically synthesized
ggatgatatagagcctctta

SEQ ID NO: 125824 - DNA, 20 bp, Artificial Sequence
  chemically synthesized
gggtctgggaggatgatata

SEQ ID NO: 125825 - DNA, 20 bp, Artificial Sequence
  chemically synthesized
ttgggtctgggaggatgata

SEQ ID NO: 125826 - DNA, 20 bp, Artificial Sequence
  chemically synthesized
gaggctctatatcatcctcc

SEQ ID NO: 125827 - DNA, 20 bp, Artificial Sequence
  chemically synthesized
aacagagatttgggtctggg

SEQ ID NO: 125828 - DNA, 20 bp, Artificial Sequence
  chemically synthesized
aaacagagatttgggtctgg

SEQ ID NO: 125829 - DNA, 20 bp, Artificial Sequence
  chemically synthesized
taaaacagagatttgggtct

SEQ ID NO: 125830 - DNA, 20 bp, Artificial Sequence
  chemically synthesized
ctaaaacagagatttgggtc

SEQ ID NO: 125831 - DNA, 20 bp, Artificial Sequence
  chemically synthesized
acattctaaaacagagattt

SEQ ID NO: 125832 - DNA, 20 bp, Artificial Sequence
  chemically synthesized
tacattctaaaacagagatt

SEQ ID NO: 125833 - DNA, 20 bp, Artificial Sequence
  chemically synthesized
ccagacccaaatctctgttt

SEQ ID NO: 125834 - DNA, 20 bp, Artificial Sequence
  chemically synthesized
agaatttacattctaaaaca

SEQ ID NO: 125835 - DNA, 20 bp, Artificial Sequence
  chemically synthesized
gtagaatttacattctaaaa

SEQ ID NO: 125836 - DNA, 20 bp, Artificial Sequence
  chemically synthesized
gttttaatctttaattgggg

SEQ ID NO: 125837 - DNA, 20 bp, Artificial Sequence
  chemically synthesized
tgtaaattctaccccaatta

SEQ ID NO: 125838 - DNA, 20 bp, Artificial Sequence
  chemically synthesized
ttagttttaatctttaattg

SEQ ID NO: 125839 - DNA, 20 bp, Artificial Sequence
  chemically synthesized
gttagttttaatctttaatt

SEQ ID NO: 125840 - DNA, 20 bp, Artificial Sequence
  chemically synthesized
tgttagttttaatctttaat

SEQ ID NO: 125841 - DNA, 20 bp, Artificial Sequence
  chemically synthesized
tgcagtgatcagatttatgt

SEQ ID NO: 125842 - DNA, 20 bp, Artificial Sequence
  chemically synthesized
ataagagggagtgcagtgat

SEQ ID NO: 125843 - DNA, 20 bp, Artificial Sequence
  chemically synthesized
gggttttataagagggagtg

SEQ ID NO: 125844 - DNA, 20 bp, Artificial Sequence
  chemically synthesized
ttgaagggttttataagagg

SEQ ID NO: 125845 - DNA, 20 bp, Artificial Sequence
  chemically synthesized
cattgaagggttttataaga

SEQ ID NO: 125846 - DNA, 20 bp, Artificial Sequence
  chemically synthesized
acattgaagggttttataag

SEQ ID NO: 125847 - DNA, 20 bp, Artificial Sequence
  chemically synthesized
aacattgaagggttttataa

SEQ ID NO: 125848 - DNA, 20 bp, Artificial Sequence
  chemically synthesized
gaaacattgaagggttttat

SEQ ID NO: 125849 - DNA, 20 bp, Artificial Sequence
  chemically synthesized
gacagtagggaaacattgaa

SEQ ID NO: 125850 - DNA, 20 bp, Artificial Sequence
  chemically synthesized
agacagtagggaaacattga

SEQ ID NO: 125851 - DNA, 20 bp, Artificial Sequence
  chemically synthesized
aagacagtagggaaacattg

SEQ ID NO: 125852 - DNA, 20 bp, Artificial Sequence
  chemically synthesized
agatattccagaagacagta

SEQ ID NO: 125853 - DNA, 20 bp, Artificial Sequence
  chemically synthesized
aagatattccagaagacagt

SEQ ID NO: 125854 - DNA, 20 bp, Artificial Sequence
  chemically synthesized
taagatattccagaagacag

SEQ ID NO: 125855 - DNA, 20 bp, Artificial Sequence
  chemically synthesized
aatgtttccctactgtcttc

SEQ ID NO: 125856 - DNA, 20 bp, Artificial Sequence
  chemically synthesized
agctaagatattccagaaga

SEQ ID NO: 125857 - DNA, 20 bp, Artificial Sequence
  chemically synthesized
gtccagctaagatattccag

SEQ ID NO: 125858 - DNA, 20 bp, Artificial Sequence
  chemically synthesized
tatgtccagctaagatattc

SEQ ID NO: 125859 - DNA, 20 bp, Artificial Sequence
  chemically synthesized
tactgtcttctggaatatct

SEQ ID NO: 125860 - DNA, 20 bp, Artificial Sequence
  chemically synthesized
gtcttctggaatatcttagc

SEQ ID NO: 125861 - DNA, 20 bp, Artificial Sequence
  chemically synthesized
aagaacacgtatgtccagct

SEQ ID NO: 125862 - DNA, 20 bp, Artificial Sequence
  chemically synthesized
catagaagaacacgtatgtc

SEQ ID NO: 125863 - DNA, 20 bp, Artificial Sequence
  chemically synthesized
ttatctaggcaagatcatag

SEQ ID NO: 125864 - DNA, 20 bp, Artificial Sequence
  chemically synthesized
agattatctaggcaagatca

SEQ ID NO: 125865 - DNA, 20 bp, Artificial Sequence
  chemically synthesized
tgttcttctatgatcttgcc

SEQ ID NO: 125866 - DNA, 20 bp, Artificial Sequence
  chemically synthesized
acctctcagattatctaggc

SEQ ID NO: 125867 - DNA, 20 bp, Artificial Sequence
  chemically synthesized
ataaacctctcagattatct

SEQ ID NO: 125868 - DNA, 20 bp, Artificial Sequence
  chemically synthesized
gataaacctctcagattatc

SEQ ID NO: 125869 - DNA, 20 bp, Artificial Sequence
  chemically synthesized
tgatcttgcctagataatct

SEQ ID NO: 125870 - DNA, 20 bp, Artificial Sequence
  chemically synthesized
atcttgcctagataatctga

SEQ ID NO: 125871 - DNA, 20 bp, Artificial Sequence
  chemically synthesized
tcttgcctagataatctgag

SEQ ID NO: 125872 - DNA, 20 bp, Artificial Sequence
  chemically synthesized
tgctttgtagataaacctct

SEQ ID NO: 125873 - DNA, 20 bp, Artificial Sequence
  chemically synthesized
atctgagaggtttatctaca

SEQ ID NO: 125874 - DNA, 20 bp, Artificial Sequence
  chemically synthesized
tcttgtgatttgttgctttg

SEQ ID NO: 125875 - DNA, 20 bp, Artificial Sequence
  chemically synthesized
tctacaaagcaacaaatcac

SEQ ID NO: 125876 - DNA, 20 bp, Artificial Sequence
  chemically synthesized
aaagcaacaaatcacaagat

SEQ ID NO: 125877 - DNA, 20 bp, Artificial Sequence
  chemically synthesized
gcaacaaatcacaagataag

SEQ ID NO: 125878 - DNA, 20 bp, Artificial Sequence
  chemically synthesized
caacaaatcacaagataagc

SEQ ID NO: 125879 - DNA, 20 bp, Artificial Sequence
  chemically synthesized
aacaaatcacaagataagca

SEQ ID NO: 125880 - DNA, 20 bp, Artificial Sequence
  chemically synthesized
tcacaagataagcagggtat

SEQ ID NO: 125881 - DNA, 20 bp, Artificial Sequence
  chemically synthesized
cagggtataagaaaccatca

SEQ ID NO: 125882 - DNA, 20 bp, Artificial Sequence
  chemically synthesized
ggttcttgtattatctgtga

SEQ ID NO: 125883 - DNA, 20 bp, Artificial Sequence
  chemically synthesized
gaaaccatcacagataatac

SEQ ID NO: 125884 - DNA, 20 bp, Artificial Sequence
  chemically synthesized
ataatacaagaaccttgcaa

SEQ ID NO: 125885 - DNA, 20 bp, Artificial Sequence
  chemically synthesized
gtaacagctctactgttgca

SEQ ID NO: 125886 - DNA, 20 bp, Artificial Sequence
  chemically synthesized
atacaagaaccttgcaacag

SEQ ID NO: 125887 - DNA, 20 bp, Artificial Sequence
  chemically synthesized
agtaacagctctactgttgc

SEQ ID NO: 125888 - DNA, 20 bp, Artificial Sequence
  chemically synthesized
acaagaaccttgcaacagta

SEQ ID NO: 125889 - DNA, 20 bp, Artificial Sequence
  chemically synthesized
cttgggcctagatgtagtaa

SEQ ID NO: 125890 - DNA, 20 bp, Artificial Sequence
  chemically synthesized
agtagagctgttactacatc

SEQ ID NO: 125891 - DNA, 20 bp, Artificial Sequence
  chemically synthesized
gtagagctgttactacatct

SEQ ID NO: 125892 - DNA, 20 bp, Artificial Sequence
  chemically synthesized
tcatcccttgggcctagatg

SEQ ID NO: 125893 - DNA, 20 bp, Artificial Sequence
  chemically synthesized
ctgttactacatctaggccc

SEQ ID NO: 125894 - DNA, 20 bp, Artificial Sequence
  chemically synthesized
tgttactacatctaggccca

SEQ ID NO: 125895 - DNA, 20 bp, Artificial Sequence
  chemically synthesized
gttactacatctaggcccaa

SEQ ID NO: 125896 - DNA, 20 bp, Artificial Sequence
  chemically synthesized
ctcccctcatcccttgggcc

SEQ ID NO: 125897 - DNA, 20 bp, Artificial Sequence
  chemically synthesized
tacatctaggcccaagggat

SEQ ID NO: 125898 - DNA, 20 bp, Artificial Sequence
  chemically synthesized
tttccctcccctcatccctt

SEQ ID NO: 125899 - DNA, 20 bp, Artificial Sequence
  chemically synthesized
acatctaggcccaagggatg

SEQ ID NO: 125900 - DNA, 20 bp, Artificial Sequence
  chemically synthesized
ttttccctcccctcatccct

SEQ ID NO: 125901 - DNA, 20 bp, Artificial Sequence
  chemically synthesized
catctaggcccaagggatga

SEQ ID NO: 125902 - DNA, 20 bp, Artificial Sequence
  chemically synthesized
atctaggcccaagggatgag

SEQ ID NO: 125903 - DNA, 20 bp, Artificial Sequence
  chemically synthesized
ctaggcccaagggatgaggg

SEQ ID NO: 125904 - DNA, 20 bp, Artificial Sequence
  chemically synthesized
taggcccaagggatgagggg

SEQ ID NO: 125905 - DNA, 20 bp, Artificial Sequence
  chemically synthesized
aggcccaagggatgagggga

SEQ ID NO: 125906 - DNA, 20 bp, Artificial Sequence
  chemically synthesized
caagggatgaggggagggaa

SEQ ID NO: 125907 - DNA, 20 bp, Artificial Sequence
  chemically synthesized
gggatgaggggagggaaaag

SEQ ID NO: 125908 - DNA, 20 bp, Artificial Sequence
  chemically synthesized
ggggagggaaaagtggccaa

SEQ ID NO: 125909 - DNA, 20 bp, Artificial Sequence
  chemically synthesized
gagggaaaagtggccaaaag

SEQ ID NO: 125910 - DNA, 20 bp, Artificial Sequence
  chemically synthesized
gggaaaagtggccaaaagca

SEQ ID NO: 125911 - DNA, 20 bp, Artificial Sequence
  chemically synthesized
tcattccaattctctgcttt

SEQ ID NO: 125912 - DNA, 20 bp, Artificial Sequence
  chemically synthesized
agtggccaaaagcagagaat

SEQ ID NO: 125913 - DNA, 20 bp, Artificial Sequence
  chemically synthesized
caaaagcagagaattggaat

SEQ ID NO: 125914 - DNA, 20 bp, Artificial Sequence
  chemically synthesized
ttggaatgagaaaccaccct

SEQ ID NO: 125915 - DNA, 20 bp, Artificial Sequence
  chemically synthesized
gaatgagaaaccaccctgag

SEQ ID NO: 125916 - DNA, 20 bp, Artificial Sequence
  chemically synthesized
ggttattgctcttctcaggg

SEQ ID NO: 125917 - DNA, 20 bp, Artificial Sequence
  chemically synthesized
atgagaaaccaccctgagaa

SEQ ID NO: 125918 - DNA, 20 bp, Artificial Sequence
  chemically synthesized
aaaggttattgctcttctca

SEQ ID NO: 125919 - DNA, 20 bp, Artificial Sequence
  chemically synthesized
aaaaggttattgctcttctc

SEQ ID NO: 125920 - DNA, 20 bp, Artificial Sequence
  chemically synthesized
caaaaggttattgctcttct

SEQ ID NO: 125921 - DNA, 20 bp, Artificial Sequence
  chemically synthesized
agagcaataaccttttgtca

SEQ ID NO: 125922 - DNA, 20 bp, Artificial Sequence
  chemically synthesized
tgactatgtcctttgacaaa

SEQ ID NO: 125923 - DNA, 20 bp, Artificial Sequence
  chemically synthesized
gagcaataaccttttgtcaa

SEQ ID NO: 125924 - DNA, 20 bp, Artificial Sequence
  chemically synthesized
ctgactatgtcctttgacaa

SEQ ID NO: 125925 - DNA, 20 bp, Artificial Sequence
  chemically synthesized
taaccttttgtcaaaggaca

SEQ ID NO: 125926 - DNA, 20 bp, Artificial Sequence
  chemically synthesized
cttttgtcaaaggacatagt

SEQ ID NO: 125927 - DNA, 20 bp, Artificial Sequence
  chemically synthesized
caaaggacatagtcagcctg

SEQ ID NO: 125928 - DNA, 20 bp, Artificial Sequence
  chemically synthesized
cctccctttgaggttgccac

SEQ ID NO: 125929 - DNA, 20 bp, Artificial Sequence
  chemically synthesized
ccctccctttgaggttgcca

SEQ ID NO: 125930 - DNA, 20 bp, Artificial Sequence
  chemically synthesized
gtcagcctgtggcaacctca

SEQ ID NO: 125931 - DNA, 20 bp, Artificial Sequence
  chemically synthesized
tcagcctgtggcaacctcaa

SEQ ID NO: 125932 - DNA, 20 bp, Artificial Sequence
  chemically synthesized
cagcctgtggcaacctcaaa

SEQ ID NO: 125933 - DNA, 20 bp, Artificial Sequence
  chemically synthesized
gcctgtggcaacctcaaagg

SEQ ID NO: 125934 - DNA, 20 bp, Artificial Sequence
  chemically synthesized
cctgtggcaacctcaaaggg

SEQ ID NO: 125935 - DNA, 20 bp, Artificial Sequence
  chemically synthesized
ctcctaattccctccctttg

SEQ ID NO: 125936 - DNA, 20 bp, Artificial Sequence
  chemically synthesized
ctgtggcaacctcaaaggga

SEQ ID NO: 125937 - DNA, 20 bp, Artificial Sequence
  chemically synthesized
tctcctaattccctcccttt

SEQ ID NO: 125938 - DNA, 20 bp, Artificial Sequence
  chemically synthesized
caacctcaaagggagggaat

SEQ ID NO: 125939 - DNA, 20 bp, Artificial Sequence
  chemically synthesized
aacctcaaagggagggaatt

SEQ ID NO: 125940 - DNA, 20 bp, Artificial Sequence
  chemically synthesized
cctcaaagggagggaattag

SEQ ID NO: 125941 - DNA, 20 bp, Artificial Sequence
  chemically synthesized
acaggaggtaaagtgaggtc

SEQ ID NO: 125942 - DNA, 20 bp, Artificial Sequence
  chemically synthesized
tgaagacaggaggtaaagtg

SEQ ID NO: 125943 - DNA, 20 bp, Artificial Sequence
  chemically synthesized
ttgaagacaggaggtaaagt

SEQ ID NO: 125944 - DNA, 20 bp, Artificial Sequence
  chemically synthesized
gaaattgaagacaggaggta

SEQ ID NO: 125945 - DNA, 20 bp, Artificial Sequence
  chemically synthesized
agaaggaaattgaagacagg

SEQ ID NO: 125946 - DNA, 20 bp, Artificial Sequence
  chemically synthesized
tagaaggaaattgaagacag

SEQ ID NO: 125947 - DNA, 20 bp, Artificial Sequence
  chemically synthesized
cctagaaggaaattgaagac

SEQ ID NO: 125948 - DNA, 20 bp, Artificial Sequence
  chemically synthesized
ccctagaaggaaattgaaga

SEQ ID NO: 125949 - DNA, 20 bp, Artificial Sequence
  chemically synthesized
agagccctagaaggaaattg

SEQ ID NO: 125950 - DNA, 20 bp, Artificial Sequence
  chemically synthesized
tcctgtcttcaatttccttc

SEQ ID NO: 125951 - DNA, 20 bp, Artificial Sequence
  chemically synthesized
cctgtcttcaatttccttct

SEQ ID NO: 125952 - DNA, 20 bp, Artificial Sequence
  chemically synthesized
ctgtcttcaatttccttcta

SEQ ID NO: 125953 - DNA, 20 bp, Artificial Sequence
  chemically synthesized
aggcacccaagagccctaga

SEQ ID NO: 125954 - DNA, 20 bp, Artificial Sequence
  chemically synthesized
taggcacccaagagccctag

SEQ ID NO: 125955 - DNA, 20 bp, Artificial Sequence
  chemically synthesized
caatttccttctagggctct

SEQ ID NO: 125956 - DNA, 20 bp, Artificial Sequence
  chemically synthesized
gtttaggcacccaagagccc

SEQ ID NO: 125957 - DNA, 20 bp, Artificial Sequence
  chemically synthesized
aatttccttctagggctctt

SEQ ID NO: 125958 - DNA, 20 bp, Artificial Sequence
  chemically synthesized
cagttggtttaggcacccaa

SEQ ID NO: 125959 - DNA, 20 bp, Artificial Sequence
  chemically synthesized
tccagttggtttaggcaccc

SEQ ID NO: 125960 - DNA, 20 bp, Artificial Sequence
  chemically synthesized
ctttggcttccagttggttt

SEQ ID NO: 125961 - DNA, 20 bp, Artificial Sequence
  chemically synthesized
tcttgggtgcctaaaccaac

SEQ ID NO: 125962 - DNA, 20 bp, Artificial Sequence
  chemically synthesized
cctttggcttccagttggtt

SEQ ID NO: 125963 - DNA, 20 bp, Artificial Sequence
  chemically synthesized
tgggtgcctaaaccaactgg

SEQ ID NO: 125964 - DNA, 20 bp, Artificial Sequence
  chemically synthesized
catgccctttggcttccagt

SEQ ID NO: 125965 - DNA, 20 bp, Artificial Sequence
  chemically synthesized
cctaaaccaactggaagcca

SEQ ID NO: 125966 - DNA, 20 bp, Artificial Sequence
  chemically synthesized
ctcccatgccctttggcttc

SEQ ID NO: 125967 - DNA, 20 bp, Artificial Sequence
  chemically synthesized
ctaaaccaactggaagccaa

SEQ ID NO: 125968 - DNA, 20 bp, Artificial Sequence
  chemically synthesized
taaaccaactggaagccaaa

SEQ ID NO: 125969 - DNA, 20 bp, Artificial Sequence
  chemically synthesized
caactggaagccaaagggca

SEQ ID NO: 125970 - DNA, 20 bp, Artificial Sequence
  chemically synthesized
cattgggctcccatgccctt

SEQ ID NO: 125971 - DNA, 20 bp, Artificial Sequence
  chemically synthesized
aactggaagccaaagggcat

SEQ ID NO: 125972 - DNA, 20 bp, Artificial Sequence
  chemically synthesized
ctggaagccaaagggcatgg

SEQ ID NO: 125973 - DNA, 20 bp, Artificial Sequence
  chemically synthesized
ggctgacctctgtcatcatt

SEQ ID NO: 125974 - DNA, 20 bp, Artificial Sequence
  chemically synthesized
gcatgggagcccaatgatga

SEQ ID NO: 125975 - DNA, 20 bp, Artificial Sequence
  chemically synthesized
aggctgacctctgtcatcat

SEQ ID NO: 125976 - DNA, 20 bp, Artificial Sequence
  chemically synthesized
atgggagcccaatgatgaca

SEQ ID NO: 125977 - DNA, 20 bp, Artificial Sequence
  chemically synthesized
tgggagcccaatgatgacag

SEQ ID NO: 125978 - DNA, 20 bp, Artificial Sequence
  chemically synthesized
agcccaatgatgacagaggt

SEQ ID NO: 125979 - DNA, 20 bp, Artificial Sequence
  chemically synthesized
gatgacagaggtcagcctcc

SEQ ID NO: 125980 - DNA, 20 bp, Artificial Sequence
  chemically synthesized
cccttgctctttattctggg

SEQ ID NO: 125981 - DNA, 20 bp, Artificial Sequence
  chemically synthesized
tcccttgctctttattctgg

SEQ ID NO: 125982 - DNA, 20 bp, Artificial Sequence
  chemically synthesized
gaggtcagcctcccagaata

SEQ ID NO: 125983 - DNA, 20 bp, Artificial Sequence
  chemically synthesized
tctcccttgctctttattct

SEQ ID NO: 125984 - DNA, 20 bp, Artificial Sequence
  chemically synthesized
ggtcagcctcccagaataaa

SEQ ID NO: 125985 - DNA, 20 bp, Artificial Sequence
  chemically synthesized
ctctcccttgctctttattc

SEQ ID NO: 125986 - DNA, 20 bp, Artificial Sequence
  chemically synthesized
agcctcccagaataaagagc

SEQ ID NO: 125987 - DNA, 20 bp, Artificial Sequence
  chemically synthesized
gcctcccagaataaagagca

SEQ ID NO: 125988 - DNA, 20 bp, Artificial Sequence
  chemically synthesized
cctcccagaataaagagcaa

SEQ ID NO: 125989 - DNA, 20 bp, Artificial Sequence
  chemically synthesized
tcccagaataaagagcaagg

SEQ ID NO: 125990 - DNA, 20 bp, Artificial Sequence
  chemically synthesized
ccagaataaagagcaaggga

SEQ ID NO: 125991 - DNA, 20 bp, Artificial Sequence
  chemically synthesized
gaataaagagcaagggagag

SEQ ID NO: 125992 - DNA, 20 bp, Artificial Sequence
  chemically synthesized
aataaagagcaagggagaga

SEQ ID NO: 125993 - DNA, 20 bp, Artificial Sequence
  chemically synthesized
gagcaagggagagaaggtca

SEQ ID NO: 125994 - DNA, 20 bp, Artificial Sequence
  chemically synthesized
agggagagaaggtcaaagaa

SEQ ID NO: 125995 - DNA, 20 bp, Artificial Sequence
  chemically synthesized
agaaggtcaaagaatggcta

SEQ ID NO: 125996 - DNA, 20 bp, Artificial Sequence
  chemically synthesized
ggtcaaagaatggctacaga

SEQ ID NO: 125997 - DNA, 20 bp, Artificial Sequence
  chemically synthesized
acattttgtttgtccatctg

SEQ ID NO: 125998 - DNA, 20 bp, Artificial Sequence
  chemically synthesized
atggacaaacaaaatgtata

SEQ ID NO: 125999 - DNA, 20 bp, Artificial Sequence
  chemically synthesized
caaacaaaatgtatatggca

SEQ ID NO: 126000 - DNA, 20 bp, Artificial Sequence
  chemically synthesized
aaacaaaatgtatatggcac

SEQ ID NO: 126001 - DNA, 20 bp, Artificial Sequence
  chemically synthesized
acataacaaaataagaagca

SEQ ID NO: 126002 - DNA, 20 bp, Artificial Sequence
  chemically synthesized
tacttacataacaaaataag

SEQ ID NO: 126003 - DNA, 20 bp, Artificial Sequence
  chemically synthesized
ctttacttacataacaaaat

SEQ ID NO: 126004 - DNA, 20 bp, Artificial Sequence
  chemically synthesized
tgcttcttattttgttatgt

SEQ ID NO: 126005 - DNA, 20 bp, Artificial Sequence
  chemically synthesized
cttattttgttatgtaagta

SEQ ID NO: 126006 - DNA, 20 bp, Artificial Sequence
  chemically synthesized
ggcaacagggttaattaaaa

SEQ ID NO: 126007 - DNA, 20 bp, Artificial Sequence
  chemically synthesized
aggcaacagggttaattaaa

SEQ ID NO: 126008 - DNA, 20 bp, Artificial Sequence
  chemically synthesized
ataactttgtggaggcaaca

SEQ ID NO: 126009 - DNA, 20 bp, Artificial Sequence
  chemically synthesized
cataactttgtggaggcaac

SEQ ID NO: 126010 - DNA, 20 bp, Artificial Sequence
  chemically synthesized
acataactttgtggaggcaa

SEQ ID NO: 126011 - DNA, 20 bp, Artificial Sequence
  chemically synthesized
ttaaccctgttgcctccaca

SEQ ID NO: 126012 - DNA, 20 bp, Artificial Sequence
  chemically synthesized
aacttcacataactttgtgg

SEQ ID NO: 126013 - DNA, 20 bp, Artificial Sequence
  chemically synthesized
taacttcacataactttgtg

SEQ ID NO: 126014 - DNA, 20 bp, Artificial Sequence
  chemically synthesized
tataacttcacataactttg

SEQ ID NO: 126015 - DNA, 20 bp, Artificial Sequence
  chemically synthesized
tgcctccacaaagttatgtg

SEQ ID NO: 126016 - DNA, 20 bp, Artificial Sequence
  chemically synthesized
acaaagttatgtgaagttat

SEQ ID NO: 126017 - DNA, 20 bp, Artificial Sequence
  chemically synthesized
ttatgtgaagttataagtta

SEQ ID NO: 126018 - DNA, 20 bp, Artificial Sequence
  chemically synthesized
tataagttaaagaaatactt

SEQ ID NO: 126019 - DNA, 20 bp, Artificial Sequence
  chemically synthesized
agttaaagaaatacttgaga

SEQ ID NO: 126020 - DNA, 20 bp, Artificial Sequence
  chemically synthesized
ccaccgcacctggccatctc

SEQ ID NO: 126021 - DNA, 20 bp, Artificial Sequence
  chemically synthesized
aaagaaatacttgagatggc

SEQ ID NO: 126022 - DNA, 20 bp, Artificial Sequence
  chemically synthesized
aagaaatacttgagatggcc

SEQ ID NO: 126023 - DNA, 20 bp, Artificial Sequence
  chemically synthesized
atacttgagatggccaggtg

SEQ ID NO: 126024 - DNA, 20 bp, Artificial Sequence
  chemically synthesized
cttgagatggccaggtgcgg

SEQ ID NO: 126025 - DNA, 20 bp, Artificial Sequence
  chemically synthesized
caggcgtgagccaccgcacc

SEQ ID NO: 126026 - DNA, 20 bp, Artificial Sequence
  chemically synthesized
agacctgggattacaggcgt

SEQ ID NO: 126027 - DNA, 20 bp, Artificial Sequence
  chemically synthesized
gtggctcacgcctgtaatcc

SEQ ID NO: 126028 - DNA, 20 bp, Artificial Sequence
  chemically synthesized
tcccagagacctgggattac

SEQ ID NO: 126029 - DNA, 20 bp, Artificial Sequence
  chemically synthesized
tggctcacgcctgtaatccc

SEQ ID NO: 126030 - DNA, 20 bp, Artificial Sequence
  chemically synthesized
ctcccagagacctgggatta

SEQ ID NO: 126031 - DNA, 20 bp, Artificial Sequence
  chemically synthesized
cgcctgtaatcccaggtctc

SEQ ID NO: 126032 - DNA, 20 bp, Artificial Sequence
  chemically synthesized
ctttggcctcccagagacct

SEQ ID NO: 126033 - DNA, 20 bp, Artificial Sequence
  chemically synthesized
gcctgtaatcccaggtctct

SEQ ID NO: 126034 - DNA, 20 bp, Artificial Sequence
  chemically synthesized
gctttggcctcccagagacc

SEQ ID NO: 126035 - DNA, 20 bp, Artificial Sequence
  chemically synthesized
ctgtaatcccaggtctctgg

SEQ ID NO: 126036 - DNA, 20 bp, Artificial Sequence
  chemically synthesized
tgtaatcccaggtctctggg

SEQ ID NO: 126037 - DNA, 20 bp, Artificial Sequence
  chemically synthesized
ccacccgctttggcctccca

SEQ ID NO: 126038 - DNA, 20 bp, Artificial Sequence
  chemically synthesized
atccacccgctttggcctcc

SEQ ID NO: 126039 - DNA, 20 bp, Artificial Sequence
  chemically synthesized
cccaggtctctgggaggcca

SEQ ID NO: 126040 - DNA, 20 bp, Artificial Sequence
  chemically synthesized
aggtctctgggaggccaaag

SEQ ID NO: 126041 - DNA, 20 bp, Artificial Sequence
  chemically synthesized
ggtctctgggaggccaaagc

SEQ ID NO: 126042 - DNA, 20 bp, Artificial Sequence
  chemically synthesized
ctctgggaggccaaagcggg

SEQ ID NO: 126043 - DNA, 20 bp, Artificial Sequence
  chemically synthesized
acctcatgatccacccgctt

SEQ ID NO: 126044 - DNA, 20 bp, Artificial Sequence
  chemically synthesized
ggccaaagcgggtggatcat

SEQ ID NO: 126045 - DNA, 20 bp, Artificial Sequence
  chemically synthesized
gccaaagcgggtggatcatg

SEQ ID NO: 126046 - DNA, 20 bp, Artificial Sequence
  chemically synthesized
aagcgggtggatcatgaggt

SEQ ID NO: 126047 - DNA, 20 bp, Artificial Sequence
  chemically synthesized
agcgggtggatcatgaggtc

SEQ ID NO: 126048 - DNA, 20 bp, Artificial Sequence
  chemically synthesized
cgggtggatcatgaggtcag

SEQ ID NO: 126049 - DNA, 20 bp, Artificial Sequence
  chemically synthesized
gatcatgaggtcaggagttc

SEQ ID NO: 126050 - DNA, 20 bp, Artificial Sequence
  chemically synthesized
tgaggtcaggagttcgagac

SEQ ID NO: 126051 - DNA, 20 bp, Artificial Sequence
  chemically synthesized
tttcagcatgtcggtcaggc

SEQ ID NO: 126052 - DNA, 20 bp, Artificial Sequence
  chemically synthesized
tgggtttcagcatgtcggtc

SEQ ID NO: 126053 - DNA, 20 bp, Artificial Sequence
  chemically synthesized
ctgggtttcagcatgtcggt

SEQ ID NO: 126054 - DNA, 20 bp, Artificial Sequence
  chemically synthesized
gagactgggtttcagcatgt

SEQ ID NO: 126055 - DNA, 20 bp, Artificial Sequence
  chemically synthesized
ctgaccgacatgctgaaacc

SEQ ID NO: 126056 - DNA, 20 bp, Artificial Sequence
  chemically synthesized
ttttagtagagactgggttt

SEQ ID NO: 126057 - DNA, 20 bp, Artificial Sequence
  chemically synthesized
ttgtatttttagtagagact

SEQ ID NO: 126058 - DNA, 20 bp, Artificial Sequence
  chemically synthesized
tttgtatttttagtagagac

SEQ ID NO: 126059 - DNA, 20 bp, Artificial Sequence
  chemically synthesized
taatttttgtatttttagta

SEQ ID NO: 126060 - DNA, 20 bp, Artificial Sequence
  chemically synthesized
gctaatttttgtatttttag

SEQ ID NO: 126061 - DNA, 20 bp, Artificial Sequence
  chemically synthesized
tgtgctaatttttgtatttt

SEQ ID NO: 126062 - DNA, 20 bp, Artificial Sequence
  chemically synthesized
tctactaaaaatacaaaaat

SEQ ID NO: 126063 - DNA, 20 bp, Artificial Sequence
  chemically synthesized
ttagcacacgcctgtaatcc

SEQ ID NO: 126064 - DNA, 20 bp, Artificial Sequence
  chemically synthesized
tcctgagtagctgggattac

SEQ ID NO: 126065 - DNA, 20 bp, Artificial Sequence
  chemically synthesized
ctcctgagtagctgggatta

SEQ ID NO: 126066 - DNA, 20 bp, Artificial Sequence
  chemically synthesized
cgcctgtaatcccagctact

SEQ ID NO: 126067 - DNA, 20 bp, Artificial Sequence
  chemically synthesized
cctcagcctcctgagtagct

SEQ ID NO: 126068 - DNA, 20 bp, Artificial Sequence
  chemically synthesized
gcctgtaatcccagctactc

SEQ ID NO: 126069 - DNA, 20 bp, Artificial Sequence
  chemically synthesized
gcctcagcctcctgagtagc

SEQ ID NO: 126070 - DNA, 20 bp, Artificial Sequence
  chemically synthesized
ctgtaatcccagctactcag

SEQ ID NO: 126071 - DNA, 20 bp, Artificial Sequence
  chemically synthesized
tgtaatcccagctactcagg

SEQ ID NO: 126072 - DNA, 20 bp, Artificial Sequence
  chemically synthesized
tcctgcctcagcctcctgag

SEQ ID NO: 126073 - DNA, 20 bp, Artificial Sequence
  chemically synthesized
ttctcctgcctcagcctcct

SEQ ID NO: 126074 - DNA, 20 bp, Artificial Sequence
  chemically synthesized
tcccagctactcaggaggct

SEQ ID NO: 126075 - DNA, 20 bp, Artificial Sequence
  chemically synthesized
cccagctactcaggaggctg

SEQ ID NO: 126076 - DNA, 20 bp, Artificial Sequence
  chemically synthesized
agctactcaggaggctgagg

SEQ ID NO: 126077 - DNA, 20 bp, Artificial Sequence
  chemically synthesized
gctactcaggaggctgaggc

SEQ ID NO: 126078 - DNA, 20 bp, Artificial Sequence
  chemically synthesized
tactcaggaggctgaggcag

SEQ ID NO: 126079 - DNA, 20 bp, Artificial Sequence
  chemically synthesized
ttcaagtgattctcctgcct

SEQ ID NO: 126080 - DNA, 20 bp, Artificial Sequence
  chemically synthesized
gcaggagaatcacttgaacc

SEQ ID NO: 126081 - DNA, 20 bp, Artificial Sequence
  chemically synthesized
caggagaatcacttgaaccc

SEQ ID NO: 126082 - DNA, 20 bp, Artificial Sequence
  chemically synthesized
aacctctgcctcccgggttc

SEQ ID NO: 126083 - DNA, 20 bp, Artificial Sequence
  chemically synthesized
ggagaatcacttgaacccgg

SEQ ID NO: 126084 - DNA, 20 bp, Artificial Sequence
  chemically synthesized
gagaatcacttgaacccggg

SEQ ID NO: 126085 - DNA, 20 bp, Artificial Sequence
  chemically synthesized
aatcacttgaacccgggagg

SEQ ID NO: 126086 - DNA, 20 bp, Artificial Sequence
  chemically synthesized
cactgcaacctctgcctccc

SEQ ID NO: 126087 - DNA, 20 bp, Artificial Sequence
  chemically synthesized
tcacttgaacccgggaggca

SEQ ID NO: 126088 - DNA, 20 bp, Artificial Sequence
  chemically synthesized
tcactgcaacctctgcctcc

SEQ ID NO: 126089 - DNA, 20 bp, Artificial Sequence
  chemically synthesized
cacttgaacccgggaggcag

SEQ ID NO: 126090 - DNA, 20 bp, Artificial Sequence
  chemically synthesized
aacccgggaggcagaggttg

SEQ ID NO: 126091 - DNA, 20 bp, Artificial Sequence
  chemically synthesized
cgggaggcagaggttgcagt

SEQ ID NO: 126092 - DNA, 20 bp, Artificial Sequence
  chemically synthesized
ggcagaggttgcagtgagcc

SEQ ID NO: 126093 - DNA, 20 bp, Artificial Sequence
  chemically synthesized
ggagtgcagcggcatgatct

SEQ ID NO: 126094 - DNA, 20 bp, Artificial Sequence
  chemically synthesized
tcacccaggctggagtgcag

SEQ ID NO: 126095 - DNA, 20 bp, Artificial Sequence
  chemically synthesized
gagatcatgccgctgcactc

SEQ ID NO: 126096 - DNA, 20 bp, Artificial Sequence
  chemically synthesized
ctgtcacccaggctggagtg

SEQ ID NO: 126097 - DNA, 20 bp, Artificial Sequence
  chemically synthesized
catgccgctgcactccagcc

SEQ ID NO: 126098 - DNA, 20 bp, Artificial Sequence
  chemically synthesized
atgccgctgcactccagcct

SEQ ID NO: 126099 - DNA, 20 bp, Artificial Sequence
  chemically synthesized
ttgctctgtcacccaggctg

SEQ ID NO: 126100 - DNA, 20 bp, Artificial Sequence
  chemically synthesized
ttttgctctgtcacccaggc

SEQ ID NO: 126101 - DNA, 20 bp, Artificial Sequence
  chemically synthesized
ctgcactccagcctgggtga

SEQ ID NO: 126102 - DNA, 20 bp, Artificial Sequence
  chemically synthesized
ggagttttgctctgtcaccc

SEQ ID NO: 126103 - DNA, 20 bp, Artificial Sequence
  chemically synthesized
gcactccagcctgggtgaca

SEQ ID NO: 126104 - DNA, 20 bp, Artificial Sequence
  chemically synthesized
tggagttttgctctgtcacc

SEQ ID NO: 126105 - DNA, 20 bp, Artificial Sequence
  chemically synthesized
atgtatttatttttgagatg

SEQ ID NO: 126106 - DNA, 20 bp, Artificial Sequence
  chemically synthesized
ctatgtatttatttttgaga

SEQ ID NO: 126107 - DNA, 20 bp, Artificial Sequence
  chemically synthesized
ctttctatgtatttattttt

SEQ ID NO: 126108 - DNA, 20 bp, Artificial Sequence
  chemically synthesized
ccatctcaaaaataaataca

SEQ ID NO: 126109 - DNA, 20 bp, Artificial Sequence
  chemically synthesized
ctcaaaaataaatacataga

SEQ ID NO: 126110 - DNA, 20 bp, Artificial Sequence
  chemically synthesized
atacatagaaagaaatactt

SEQ ID NO: 126111 - DNA, 20 bp, Artificial Sequence
  chemically synthesized
gcttatttacaaaatatctg

SEQ ID NO: 126112 - DNA, 20 bp, Artificial Sequence
  chemically synthesized
acttcagatattttgtaaat

SEQ ID NO: 126113 - DNA, 20 bp, Artificial Sequence
  chemically synthesized
gatattttgtaaataagcat

SEQ ID NO: 126114 - DNA, 20 bp, Artificial Sequence
  chemically synthesized
atattttgtaaataagcatc

SEQ ID NO: 126115 - DNA, 20 bp, Artificial Sequence
  chemically synthesized
ttgtaaataagcatcaggac

SEQ ID NO: 126116 - DNA, 20 bp, Artificial Sequence
  chemically synthesized
aaataagcatcaggactaga

SEQ ID NO: 126117 - DNA, 20 bp, Artificial Sequence
  chemically synthesized
ctagttttgtggggtctttc

SEQ ID NO: 126118 - DNA, 20 bp, Artificial Sequence
  chemically synthesized
ttacaatcactagttttgtg

SEQ ID NO: 126119 - DNA, 20 bp, Artificial Sequence
  chemically synthesized
ctagaaagaccccacaaaac

SEQ ID NO: 126120 - DNA, 20 bp, Artificial Sequence
  chemically synthesized
gttacaatcactagttttgt

SEQ ID NO: 126121 - DNA, 20 bp, Artificial Sequence
  chemically synthesized
tgttacaatcactagttttg

SEQ ID NO: 126122 - DNA, 20 bp, Artificial Sequence
  chemically synthesized
tgatttcatgttacaatcac

SEQ ID NO: 126123 - DNA, 20 bp, Artificial Sequence
  chemically synthesized
gtaacatgaaatcaaaaata

SEQ ID NO: 126124 - DNA, 20 bp, Artificial Sequence
  chemically synthesized
gaaatcaaaaatatagtccc

SEQ ID NO: 126125 - DNA, 20 bp, Artificial Sequence
  chemically synthesized
actgagttttaattattctg

SEQ ID NO: 126126 - DNA, 20 bp, Artificial Sequence
  chemically synthesized
tactgagttttaattattct

SEQ ID NO: 126127 - DNA, 20 bp, Artificial Sequence
  chemically synthesized
ttactgagttttaattattc

SEQ ID NO: 126128 - DNA, 20 bp, Artificial Sequence
  chemically synthesized
tccccagaataattaaaact

SEQ ID NO: 126129 - DNA, 20 bp, Artificial Sequence
  chemically synthesized
cagaataattaaaactcagt

SEQ ID NO: 126130 - DNA, 20 bp, Artificial Sequence
  chemically synthesized
aataattaaaactcagtaag

SEQ ID NO: 126131 - DNA, 20 bp, Artificial Sequence
  chemically synthesized
tataatgtgtgccacttact

SEQ ID NO: 126132 - DNA, 20 bp, Artificial Sequence
  chemically synthesized
tcagtaagtggcacacatta

SEQ ID NO: 126133 - DNA, 20 bp, Artificial Sequence
  chemically synthesized
taaacctgataaaaaaacag

SEQ ID NO: 126134 - DNA, 20 bp, Artificial Sequence
  chemically synthesized
aaataaacctgataaaaaaa

SEQ ID NO: 126135 - DNA, 20 bp, Artificial Sequence
  chemically synthesized
atagactactgtttttttat

SEQ ID NO: 126136 - DNA, 20 bp, Artificial Sequence
  chemically synthesized
tagactactgtttttttatc

SEQ ID NO: 126137 - DNA, 20 bp, Artificial Sequence
  chemically synthesized
ttatcaggtttatttctgtt

SEQ ID NO: 126138 - DNA, 20 bp, Artificial Sequence
  chemically synthesized
tatcaggtttatttctgttt

SEQ ID NO: 126139 - DNA, 20 bp, Artificial Sequence
  chemically synthesized
atacatagcaaacacccaaa

SEQ ID NO: 126140 - DNA, 20 bp, Artificial Sequence
  chemically synthesized
tcgactagttttgcaataca

SEQ ID NO: 126141 - DNA, 20 bp, Artificial Sequence
  chemically synthesized
tttgctatgtattgcaaaac

SEQ ID NO: 126142 - DNA, 20 bp, Artificial Sequence
  chemically synthesized
ttgcaatataatatgtcgac

SEQ ID NO: 126143 - DNA, 20 bp, Artificial Sequence
  chemically synthesized
gacatattatattgcaactt

SEQ ID NO: 126144 - DNA, 20 bp, Artificial Sequence
  chemically synthesized
agaggttgacatgttaactg

SEQ ID NO: 126145 - DNA, 20 bp, Artificial Sequence
  chemically synthesized
agagacttacggttaaacag

SEQ ID NO: 126146 - DNA, 20 bp, Artificial Sequence
  chemically synthesized
gagagacttacggttaaaca

SEQ ID NO: 126147 - DNA, 20 bp, Artificial Sequence
  chemically synthesized
gagagagacttacggttaaa

SEQ ID NO: 126148 - DNA, 20 bp, Artificial Sequence
  chemically synthesized
gtcaacctctgtttaaccgt

SEQ ID NO: 126149 - DNA, 20 bp, Artificial Sequence
  chemically synthesized
aaagattagagagagactta

SEQ ID NO: 126150 - DNA, 20 bp, Artificial Sequence
  chemically synthesized
tggcgttcaaagattagaga

SEQ ID NO: 126151 - DNA, 20 bp, Artificial Sequence
  chemically synthesized
aatggcgttcaaagattaga

SEQ ID NO: 126152 - DNA, 20 bp, Artificial Sequence
  chemically synthesized
acaatggcgttcaaagatta

SEQ ID NO: 126153 - DNA, 20 bp, Artificial Sequence
  chemically synthesized
aaacaatggcgttcaaagat

SEQ ID NO: 126154 - DNA, 20 bp, Artificial Sequence
  chemically synthesized
acacaaaacaatggcgttca

SEQ ID NO: 126155 - DNA, 20 bp, Artificial Sequence
  chemically synthesized
caatgagacacacaaaacaa

SEQ ID NO: 126156 - DNA, 20 bp, Artificial Sequence
  chemically synthesized
cctagtggaacaacaacaat

SEQ ID NO: 126157 - DNA, 20 bp, Artificial Sequence
  chemically synthesized
tctcattgttgttgttccac

SEQ ID NO: 126158 - DNA, 20 bp, Artificial Sequence
  chemically synthesized
ctcattgttgttgttccact

SEQ ID NO: 126159 - DNA, 20 bp, Artificial Sequence
  chemically synthesized
attgttgttgttccactagg

SEQ ID NO: 126160 - DNA, 20 bp, Artificial Sequence
  chemically synthesized
aaagctgttccactacctag

SEQ ID NO: 126161 - DNA, 20 bp, Artificial Sequence
  chemically synthesized
gttgttgttccactaggtag

SEQ ID NO: 126162 - DNA, 20 bp, Artificial Sequence
  chemically synthesized
acgaaagctgttccactacc

SEQ ID NO: 126163 - DNA, 20 bp, Artificial Sequence
  chemically synthesized
tgttccactaggtagtggaa

SEQ ID NO: 126164 - DNA, 20 bp, Artificial Sequence
  chemically synthesized
aggtagtggaacagctttcg

SEQ ID NO: 126165 - DNA, 20 bp, Artificial Sequence
  chemically synthesized
ttacaaggcctcaactacga

SEQ ID NO: 126166 - DNA, 20 bp, Artificial Sequence
  chemically synthesized
gtggaacagctttcgtagtt

SEQ ID NO: 126167 - DNA, 20 bp, Artificial Sequence
  chemically synthesized
tggaacagctttcgtagttg

SEQ ID NO: 126168 - DNA, 20 bp, Artificial Sequence
  chemically synthesized
tagaagactaaacaattaca

SEQ ID NO: 126169 - DNA, 20 bp, Artificial Sequence
  chemically synthesized
ttagaagactaaacaattac

SEQ ID NO: 126170 - DNA, 20 bp, Artificial Sequence
  chemically synthesized
gttgaggccttgtaattgtt

SEQ ID NO: 126171 - DNA, 20 bp, Artificial Sequence
  chemically synthesized
ataaaccaaagattaattag

SEQ ID NO: 126172 - DNA, 20 bp, Artificial Sequence
  chemically synthesized
tttataaaccaaagattaat

SEQ ID NO: 126173 - DNA, 20 bp, Artificial Sequence
  chemically synthesized
ttagtcttctaattaatctt

SEQ ID NO: 126174 - DNA, 20 bp, Artificial Sequence
  chemically synthesized
accatttattttataaacca

SEQ ID NO: 126175 - DNA, 20 bp, Artificial Sequence
  chemically synthesized
tctttggtttataaaataaa

SEQ ID NO: 126176 - DNA, 20 bp, Artificial Sequence
  chemically synthesized
aatggtgtaaatgctcttat

SEQ ID NO: 126177 - DNA, 20 bp, Artificial Sequence
  chemically synthesized
tttatacagctttcttataa

SEQ ID NO: 126178 - DNA, 20 bp, Artificial Sequence
  chemically synthesized
gtgtaaatgctcttataaga

SEQ ID NO: 126179 - DNA, 20 bp, Artificial Sequence
  chemically synthesized
actttatacagctttcttat

SEQ ID NO: 126180 - DNA, 20 bp, Artificial Sequence
  chemically synthesized
tcttataagaaagctgtata

SEQ ID NO: 126181 - DNA, 20 bp, Artificial Sequence
  chemically synthesized
attttcatttacactttata

SEQ ID NO: 126182 - DNA, 20 bp, Artificial Sequence
  chemically synthesized
gtgtaaatgaaaatgtcttt

SEQ ID NO: 126183 - DNA, 20 bp, Artificial Sequence
  chemically synthesized
agaatatttcagaacactta

SEQ ID NO: 126184 - DNA, 20 bp, Artificial Sequence
  chemically synthesized
ggaatatccacagaatattt

SEQ ID NO: 126185 - DNA, 20 bp, Artificial Sequence
  chemically synthesized
aagtgttctgaaatattctg

SEQ ID NO: 126186 - DNA, 20 bp, Artificial Sequence
  chemically synthesized
gtttgtaattggaatatcca

SEQ ID NO: 126187 - DNA, 20 bp, Artificial Sequence
  chemically synthesized
gttgaaaaagggtttgtaat

SEQ ID NO: 126188 - DNA, 20 bp, Artificial Sequence
  chemically synthesized
tgctatgataagttgaaaaa

SEQ ID NO: 126189 - DNA, 20 bp, Artificial Sequence
  chemically synthesized
ctgctatgataagttgaaaa

SEQ ID NO: 126190 - DNA, 20 bp, Artificial Sequence
  chemically synthesized
cctgctatgataagttgaaa

SEQ ID NO: 126191 - DNA, 20 bp, Artificial Sequence
  chemically synthesized
aaccctttttcaacttatca

SEQ ID NO: 126192 - DNA, 20 bp, Artificial Sequence
  chemically synthesized
cctttttcaacttatcatag

SEQ ID NO: 126193 - DNA, 20 bp, Artificial Sequence
  chemically synthesized
ctaaagtagcctgctatgat

SEQ ID NO: 126194 - DNA, 20 bp, Artificial Sequence
  chemically synthesized
ctttttcaacttatcatagc

SEQ ID NO: 126195 - DNA, 20 bp, Artificial Sequence
  chemically synthesized
cttatcatagcaggctactt

SEQ ID NO: 126196 - DNA, 20 bp, Artificial Sequence
  chemically synthesized
cccaagtatgtgtactaaag

SEQ ID NO: 126197 - DNA, 20 bp, Artificial Sequence
  chemically synthesized
agtcccaagtatgtgtacta

SEQ ID NO: 126198 - DNA, 20 bp, Artificial Sequence
  chemically synthesized
gctactttagtacacatact

SEQ ID NO: 126199 - DNA, 20 bp, Artificial Sequence
  chemically synthesized
ctactttagtacacatactt

SEQ ID NO: 126200 - DNA, 20 bp, Artificial Sequence
  chemically synthesized
aggatatgagaaaaagtccc

SEQ ID NO: 126201 - DNA, 20 bp, Artificial Sequence
  chemically synthesized
taacagtaggatatgagaaa

SEQ ID NO: 126202 - DNA, 20 bp, Artificial Sequence
  chemically synthesized
ggtacataacagtaggatat

SEQ ID NO: 126203 - DNA, 20 bp, Artificial Sequence
  chemically synthesized
tacacatggtacataacagt

SEQ ID NO: 126204 - DNA, 20 bp, Artificial Sequence
  chemically synthesized
atacacatggtacataacag

SEQ ID NO: 126205 - DNA, 20 bp, Artificial Sequence
  chemically synthesized
caaatacacatggtacataa

SEQ ID NO: 126206 - DNA, 20 bp, Artificial Sequence
  chemically synthesized
gtattattttcaaatacaca

SEQ ID NO: 126207 - DNA, 20 bp, Artificial Sequence
  chemically synthesized
atgtgtatttgaaaataata

SEQ ID NO: 126208 - DNA, 20 bp, Artificial Sequence
  chemically synthesized
cagttgacattccttaaaaa

SEQ ID NO: 126209 - DNA, 20 bp, Artificial Sequence
  chemically synthesized
ggaatcagagactattttta

SEQ ID NO: 126210 - DNA, 20 bp, Artificial Sequence
  chemically synthesized
tggaatcagagactattttt

SEQ ID NO: 126211 - DNA, 20 bp, Artificial Sequence
  chemically synthesized
gcgaaggcaaattggaatca

SEQ ID NO: 126212 - DNA, 20 bp, Artificial Sequence
  chemically synthesized
aagcgaaggcaaattggaat

SEQ ID NO: 126213 - DNA, 20 bp, Artificial Sequence
  chemically synthesized
taacgaaagcgaaggcaaat

SEQ ID NO: 126214 - DNA, 20 bp, Artificial Sequence
  chemically synthesized
attaagactaacgaaagcga

SEQ ID NO: 126215 - DNA, 20 bp, Artificial Sequence
  chemically synthesized
aattaagactaacgaaagcg

SEQ ID NO: 126216 - DNA, 20 bp, Artificial Sequence
  chemically synthesized
caatttgccttcgctttcgt

SEQ ID NO: 126217 - DNA, 20 bp, Artificial Sequence
  chemically synthesized
ttagtaattaagactaacga

SEQ ID NO: 126218 - DNA, 20 bp, Artificial Sequence
  chemically synthesized
atagtaaaatgttagtaatt

SEQ ID NO: 126219 - DNA, 20 bp, Artificial Sequence
  chemically synthesized
ttgctagcatagtaaaatgt

SEQ ID NO: 126220 - DNA, 20 bp, Artificial Sequence
  chemically synthesized
ttactaacattttactatgc

SEQ ID NO: 126221 - DNA, 20 bp, Artificial Sequence
  chemically synthesized
tctaaaaaatattgctagca

SEQ ID NO: 126222 - DNA, 20 bp, Artificial Sequence
  chemically synthesized
ggcattctaaaaaatattgc

SEQ ID NO: 126223 - DNA, 20 bp, Artificial Sequence
  chemically synthesized
actatgctagcaatattttt

SEQ ID NO: 126224 - DNA, 20 bp, Artificial Sequence
  chemically synthesized
gcaatattttttagaatgcc

SEQ ID NO: 126225 - DNA, 20 bp, Artificial Sequence
  chemically synthesized
atattttttagaatgcctag

SEQ ID NO: 126226 - DNA, 20 bp, Artificial Sequence
  chemically synthesized
atgtttatgtgaaaaccact

SEQ ID NO: 126227 - DNA, 20 bp, Artificial Sequence
  chemically synthesized
tatgtttatgtgaaaaccac

SEQ ID NO: 126228 - DNA, 20 bp, Artificial Sequence
  chemically synthesized
tagtggttttcacataaaca

SEQ ID NO: 126229 - DNA, 20 bp, Artificial Sequence
  chemically synthesized
ggttttcacataaacatagc

SEQ ID NO: 126230 - DNA, 20 bp, Artificial Sequence
  chemically synthesized
tttactggcatgaatcaaaa

SEQ ID NO: 126231 - DNA, 20 bp, Artificial Sequence
  chemically synthesized
tatttactggcatgaatcaa

SEQ ID NO: 126232 - DNA, 20 bp, Artificial Sequence
  chemically synthesized
caagctcttttgattcatgc

SEQ ID NO: 126233 - DNA, 20 bp, Artificial Sequence
  chemically synthesized
aggatgtacaaaatatttac

SEQ ID NO: 126234 - DNA, 20 bp, Artificial Sequence
  chemically synthesized
taaatattttgtacatccta

SEQ ID NO: 126235 - DNA, 20 bp, Artificial Sequence
  chemically synthesized
tccctattgaaatgaactgt

SEQ ID NO: 126236 - DNA, 20 bp, Artificial Sequence
  chemically synthesized
ttccctattgaaatgaactg

SEQ ID NO: 126237 - DNA, 20 bp, Artificial Sequence
  chemically synthesized
catcctacagttcatttcaa

SEQ ID NO: 126238 - DNA, 20 bp, Artificial Sequence
  chemically synthesized
atcctacagttcatttcaat

SEQ ID NO: 126239 - DNA, 20 bp, Artificial Sequence
  chemically synthesized
tcctacagttcatttcaata

SEQ ID NO: 126240 - DNA, 20 bp, Artificial Sequence
  chemically synthesized
gttcatttcaatagggaaaa

SEQ ID NO: 126241 - DNA, 20 bp, Artificial Sequence
  chemically synthesized
gagatggccttttaaaaata

SEQ ID NO: 126242 - DNA, 20 bp, Artificial Sequence
  chemically synthesized
aaaacagtctatatttttaa

SEQ ID NO: 126243 - DNA, 20 bp, Artificial Sequence
  chemically synthesized
aaacagtctatatttttaaa

SEQ ID NO: 126244 - DNA, 20 bp, Artificial Sequence
  chemically synthesized
tatttttaaaaggccatctc

SEQ ID NO: 126245 - DNA, 20 bp, Artificial Sequence
  chemically synthesized
cttttcctaatatctagaga

SEQ ID NO: 126246 - DNA, 20 bp, Artificial Sequence
  chemically synthesized
aaaaggccatctctagatat

SEQ ID NO: 126247 - DNA, 20 bp, Artificial Sequence
  chemically synthesized
ttatcttttcctaatatcta

SEQ ID NO: 126248 - DNA, 20 bp, Artificial Sequence
  chemically synthesized
aaaggccatctctagatatt

SEQ ID NO: 126249 - DNA, 20 bp, Artificial Sequence
  chemically synthesized
ctttatcttttcctaatatc

SEQ ID NO: 126250 - DNA, 20 bp, Artificial Sequence
  chemically synthesized
ccatctctagatattaggaa

SEQ ID NO: 126251 - DNA, 20 bp, Artificial Sequence
  chemically synthesized
ctagatattaggaaaagata

SEQ ID NO: 126252 - DNA, 20 bp, Artificial Sequence
  chemically synthesized
gatattaggaaaagataaag

SEQ ID NO: 126253 - DNA, 20 bp, Artificial Sequence
  chemically synthesized
ttatcttcctacataatagg

SEQ ID NO: 126254 - DNA, 20 bp, Artificial Sequence
  chemically synthesized
aagcagttcttcctattatg

SEQ ID NO: 126255 - DNA, 20 bp, Artificial Sequence
  chemically synthesized
agcagttcttcctattatgt

SEQ ID NO: 126256 - DNA, 20 bp, Artificial Sequence
  chemically synthesized
aaattatcttcctacataat

SEQ ID NO: 126257 - DNA, 20 bp, Artificial Sequence
  chemically synthesized
aaaattatcttcctacataa

SEQ ID NO: 126258 - DNA, 20 bp, Artificial Sequence
  chemically synthesized
agttcttcctattatgtagg

SEQ ID NO: 126259 - DNA, 20 bp, Artificial Sequence
  chemically synthesized
taggaagataattttaatcc

SEQ ID NO: 126260 - DNA, 20 bp, Artificial Sequence
  chemically synthesized
gataattttaatcctggaaa

SEQ ID NO: 126261 - DNA, 20 bp, Artificial Sequence
  chemically synthesized
aaaagtttccttctttttcc

SEQ ID NO: 126262 - DNA, 20 bp, Artificial Sequence
  chemically synthesized
aattttaatcctggaaaaag

SEQ ID NO: 126263 - DNA, 20 bp, Artificial Sequence
  chemically synthesized
taaaagtttccttctttttc

SEQ ID NO: 126264 - DNA, 20 bp, Artificial Sequence
  chemically synthesized
attttaatcctggaaaaaga

SEQ ID NO: 126265 - DNA, 20 bp, Artificial Sequence
  chemically synthesized
aataatggttcaggttataa

SEQ ID NO: 126266 - DNA, 20 bp, Artificial Sequence
  chemically synthesized
tttgcctgaaataatggttc

SEQ ID NO: 126267 - DNA, 20 bp, Artificial Sequence
  chemically synthesized
gtttgcctgaaataatggtt

SEQ ID NO: 126268 - DNA, 20 bp, Artificial Sequence
  chemically synthesized
tataacctgaaccattattt

SEQ ID NO: 126269 - DNA, 20 bp, Artificial Sequence
  chemically synthesized
ataacctgaaccattatttc

SEQ ID NO: 126270 - DNA, 20 bp, Artificial Sequence
  chemically synthesized
cccatgtttgcctgaaataa

SEQ ID NO: 126271 - DNA, 20 bp, Artificial Sequence
  chemically synthesized
accattatttcaggcaaaca

SEQ ID NO: 126272 - DNA, 20 bp, Artificial Sequence
  chemically synthesized
ccattatttcaggcaaacat

SEQ ID NO: 126273 - DNA, 20 bp, Artificial Sequence
  chemically synthesized
aaagccttctattattgagc

SEQ ID NO: 126274 - DNA, 20 bp, Artificial Sequence
  chemically synthesized
tttgaatgcttgctcaataa

SEQ ID NO: 126275 - DNA, 20 bp, Artificial Sequence
  chemically synthesized
gctgaaagccttctattatt

SEQ ID NO: 126276 - DNA, 20 bp, Artificial Sequence
  chemically synthesized
gaatgcttgctcaataatag

SEQ ID NO: 126277 - DNA, 20 bp, Artificial Sequence
  chemically synthesized
aatgcttgctcaataataga

SEQ ID NO: 126278 - DNA, 20 bp, Artificial Sequence
  chemically synthesized
gctcaataatagaaggcttt

SEQ ID NO: 126279 - DNA, 20 bp, Artificial Sequence
  chemically synthesized
tatgaccacttttttgctga

SEQ ID NO: 126280 - DNA, 20 bp, Artificial Sequence
  chemically synthesized
atagaaggctttcagcaaaa

SEQ ID NO: 126281 - DNA, 20 bp, Artificial Sequence
  chemically synthesized
gaaggctttcagcaaaaaag

SEQ ID NO: 126282 - DNA, 20 bp, Artificial Sequence
  chemically synthesized
gtggtcatatgtgtgttatg

SEQ ID NO: 126283 - DNA, 20 bp, Artificial Sequence
  chemically synthesized
tcatatgtgtgttatgtagc

SEQ ID NO: 126284 - DNA, 20 bp, Artificial Sequence
  chemically synthesized
tgttatgtagcaagttaaaa

SEQ ID NO: 126285 - DNA, 20 bp, Artificial Sequence
  chemically synthesized
agcaagttaaaatggctcct

SEQ ID NO: 126286 - DNA, 20 bp, Artificial Sequence
  chemically synthesized
gcaagttaaaatggctcctt

SEQ ID NO: 126287 - DNA, 20 bp, Artificial Sequence
  chemically synthesized
caagttaaaatggctccttg

SEQ ID NO: 126288 - DNA, 20 bp, Artificial Sequence
  chemically synthesized
agtgggatgcacaccccaag

SEQ ID NO: 126289 - DNA, 20 bp, Artificial Sequence
  chemically synthesized
tcagtgggatgcacacccca

SEQ ID NO: 126290 - DNA, 20 bp, Artificial Sequence
  chemically synthesized
ctcagtgggatgcacacccc

SEQ ID NO: 126291 - DNA, 20 bp, Artificial Sequence
  chemically synthesized
cttggggtgtgcatcccact

SEQ ID NO: 126292 - DNA, 20 bp, Artificial Sequence
  chemically synthesized
ttggggtgtgcatcccactg

SEQ ID NO: 126293 - DNA, 20 bp, Artificial Sequence
  chemically synthesized
tggggtgtgcatcccactga

SEQ ID NO: 126294 - DNA, 20 bp, Artificial Sequence
  chemically synthesized
tgaaaaagcataccctcagt

SEQ ID NO: 126295 - DNA, 20 bp, Artificial Sequence
  chemically synthesized
gtgaaaaagcataccctcag

SEQ ID NO: 126296 - DNA, 20 bp, Artificial Sequence
  chemically synthesized
agggtgaaaaagcataccct

SEQ ID NO: 126297 - DNA, 20 bp, Artificial Sequence
  chemically synthesized
gttgaaggtcaagggtgaaa

SEQ ID NO: 126298 - DNA, 20 bp, Artificial Sequence
  chemically synthesized
aatgtacagttgaaggtcaa

SEQ ID NO: 126299 - DNA, 20 bp, Artificial Sequence
  chemically synthesized
taatgtacagttgaaggtca

SEQ ID NO: 126300 - DNA, 20 bp, Artificial Sequence
  chemically synthesized
ataatgtacagttgaaggtc

SEQ ID NO: 126301 - DNA, 20 bp, Artificial Sequence
  chemically synthesized
ttatgataatgtacagttga

SEQ ID NO: 126302 - DNA, 20 bp, Artificial Sequence
  chemically synthesized
attatgataatgtacagttg

SEQ ID NO: 126303 - DNA, 20 bp, Artificial Sequence
  chemically synthesized
taataaattatgataatgta

SEQ ID NO: 126304 - DNA, 20 bp, Artificial Sequence
  chemically synthesized
tgtacattatcataatttat

SEQ ID NO: 126305 - DNA, 20 bp, Artificial Sequence
  chemically synthesized
tagttaattaaaaatattta

SEQ ID NO: 126306 - DNA, 20 bp, Artificial Sequence
  chemically synthesized
agttaattaaaaatatttat

SEQ ID NO: 126307 - DNA, 20 bp, Artificial Sequence
  chemically synthesized
aattaaaaatatttataggc

SEQ ID NO: 126308 - DNA, 20 bp, Artificial Sequence
  chemically synthesized
ttaaaaatatttataggcta

SEQ ID NO: 126309 - DNA, 20 bp, Artificial Sequence
  chemically synthesized
tggattattgagtgagtctc

SEQ ID NO: 126310 - DNA, 20 bp, Artificial Sequence
  chemically synthesized
ggatagatggattattgagt

SEQ ID NO: 126311 - DNA, 20 bp, Artificial Sequence
  chemically synthesized
agagggatagatggattatt

SEQ ID NO: 126312 - DNA, 20 bp, Artificial Sequence
  chemically synthesized
gggatgcacagagggataga

SEQ ID NO: 126313 - DNA, 20 bp, Artificial Sequence
  chemically synthesized
tgtggggatgcacagaggga

SEQ ID NO: 126314 - DNA, 20 bp, Artificial Sequence
  chemically synthesized
gatgtgtggggatgcacaga

SEQ ID NO: 126315 - DNA, 20 bp, Artificial Sequence
  chemically synthesized
ggatgtgtggggatgcacag

SEQ ID NO: 126316 - DNA, 20 bp, Artificial Sequence
  chemically synthesized
tggatgtgtggggatgcaca

SEQ ID NO: 126317 - DNA, 20 bp, Artificial Sequence
  chemically synthesized
gatggatgtgtggggatgca

SEQ ID NO: 126318 - DNA, 20 bp, Artificial Sequence
  chemically synthesized
gctacatggatggatgtgtg

SEQ ID NO: 126319 - DNA, 20 bp, Artificial Sequence
  chemically synthesized
ggctacatggatggatgtgt

SEQ ID NO: 126320 - DNA, 20 bp, Artificial Sequence
  chemically synthesized
tggctacatggatggatgtg

SEQ ID NO: 126321 - DNA, 20 bp, Artificial Sequence
  chemically synthesized
tccccacacatccatccatg

SEQ ID NO: 126322 - DNA, 20 bp, Artificial Sequence
  chemically synthesized
agactagctggctacatgga

SEQ ID NO: 126323 - DNA, 20 bp, Artificial Sequence
  chemically synthesized
cacacatccatccatgtagc

SEQ ID NO: 126324 - DNA, 20 bp, Artificial Sequence
  chemically synthesized
atagagactagctggctaca

SEQ ID NO: 126325 - DNA, 20 bp, Artificial Sequence
  chemically synthesized
catccatccatgtagccagc

SEQ ID NO: 126326 - DNA, 20 bp, Artificial Sequence
  chemically synthesized
taaataaaatagagactagc

SEQ ID NO: 126327 - DNA, 20 bp, Artificial Sequence
  chemically synthesized
atggtaaataaaatagagac

SEQ ID NO: 126328 - DNA, 20 bp, Artificial Sequence
  chemically synthesized
aacagatggtaaataaaata

SEQ ID NO: 126329 - DNA, 20 bp, Artificial Sequence
  chemically synthesized
ctaacagatggtaaataaaa

SEQ ID NO: 126330 - DNA, 20 bp, Artificial Sequence
  chemically synthesized
ctattttatttaccatctgt

SEQ ID NO: 126331 - DNA, 20 bp, Artificial Sequence
  chemically synthesized
aatggctggtgtctaacaga

SEQ ID NO: 126332 - DNA, 20 bp, Artificial Sequence
  chemically synthesized
tcataatggctggtgtctaa

SEQ ID NO: 126333 - DNA, 20 bp, Artificial Sequence
  chemically synthesized
atttaccatctgttagacac

SEQ ID NO: 126334 - DNA, 20 bp, Artificial Sequence
  chemically synthesized
caagttcttatcataatggc

SEQ ID NO: 126335 - DNA, 20 bp, Artificial Sequence
  chemically synthesized
tagacaccagccattatgat

SEQ ID NO: 126336 - DNA, 20 bp, Artificial Sequence
  chemically synthesized
tttccaagttcttatcataa

SEQ ID NO: 126337 - DNA, 20 bp, Artificial Sequence
  chemically synthesized
cagccattatgataagaact

SEQ ID NO: 126338 - DNA, 20 bp, Artificial Sequence
  chemically synthesized
cttaaacccttttgttttcc

SEQ ID NO: 126339 - DNA, 20 bp, Artificial Sequence
  chemically synthesized
gataagaacttggaaaacaa

SEQ ID NO: 126340 - DNA, 20 bp, Artificial Sequence
  chemically synthesized
ataagaacttggaaaacaaa

SEQ ID NO: 126341 - DNA, 20 bp, Artificial Sequence
  chemically synthesized
taagaacttggaaaacaaaa

SEQ ID NO: 126342 - DNA, 20 bp, Artificial Sequence
  chemically synthesized
cttggaaaacaaaagggttt

SEQ ID NO: 126343 - DNA, 20 bp, Artificial Sequence
  chemically synthesized
gaaaacaaaagggtttaaga

SEQ ID NO: 126344 - DNA, 20 bp, Artificial Sequence
  chemically synthesized
agggtttaagacagattacc

SEQ ID NO: 126345 - DNA, 20 bp, Artificial Sequence
  chemically synthesized
aagacagattacctggcttc

SEQ ID NO: 126346 - DNA, 20 bp, Artificial Sequence
  chemically synthesized
aggcacctaaaccagaagcc

SEQ ID NO: 126347 - DNA, 20 bp, Artificial Sequence
  chemically synthesized
caggcacctaaaccagaagc

SEQ ID NO: 126348 - DNA, 20 bp, Artificial Sequence
  chemically synthesized
agattacctggcttctggtt

SEQ ID NO: 126349 - DNA, 20 bp, Artificial Sequence
  chemically synthesized
gattacctggcttctggttt

SEQ ID NO: 126350 - DNA, 20 bp, Artificial Sequence
  chemically synthesized
ctaacaggcacctaaaccag

SEQ ID NO: 126351 - DNA, 20 bp, Artificial Sequence
  chemically synthesized
tatctaacaggcacctaaac

SEQ ID NO: 126352 - DNA, 20 bp, Artificial Sequence
  chemically synthesized
cttctggtttaggtgcctgt

SEQ ID NO: 126353 - DNA, 20 bp, Artificial Sequence
  chemically synthesized
tggtttaggtgcctgttaga

SEQ ID NO: 126354 - DNA, 20 bp, Artificial Sequence
  chemically synthesized
gaatagcaccactatctaac

SEQ ID NO: 126355 - DNA, 20 bp, Artificial Sequence
  chemically synthesized
tgaatagcaccactatctaa

SEQ ID NO: 126356 - DNA, 20 bp, Artificial Sequence
  chemically synthesized
tttaggtgcctgttagatag

SEQ ID NO: 126357 - DNA, 20 bp, Artificial Sequence
  chemically synthesized
ttctttggataggcagtgaa

SEQ ID NO: 126358 - DNA, 20 bp, Artificial Sequence
  chemically synthesized
ctctgcattctttggatagg

SEQ ID NO: 126359 - DNA, 20 bp, Artificial Sequence
  chemically synthesized
tgctattcactgcctatcca

SEQ ID NO: 126360 - DNA, 20 bp, Artificial Sequence
  chemically synthesized
tcactctgcattctttggat

SEQ ID NO: 126361 - DNA, 20 bp, Artificial Sequence
  chemically synthesized
ctcactctgcattctttgga

SEQ ID NO: 126362 - DNA, 20 bp, Artificial Sequence
  chemically synthesized
cactgcctatccaaagaatg

SEQ ID NO: 126363 - DNA, 20 bp, Artificial Sequence
  chemically synthesized
catgctcactctgcattctt

SEQ ID NO: 126364 - DNA, 20 bp, Artificial Sequence
  chemically synthesized
ctgcctatccaaagaatgca

SEQ ID NO: 126365 - DNA, 20 bp, Artificial Sequence
  chemically synthesized
ctatccaaagaatgcagagt

SEQ ID NO: 126366 - DNA, 20 bp, Artificial Sequence
  chemically synthesized
caaagaatgcagagtgagca

SEQ ID NO: 126367 - DNA, 20 bp, Artificial Sequence
  chemically synthesized
aagaatgcagagtgagcatg

SEQ ID NO: 126368 - DNA, 20 bp, Artificial Sequence
  chemically synthesized
aatgcagagtgagcatggag

SEQ ID NO: 126369 - DNA, 20 bp, Artificial Sequence
  chemically synthesized
gtgagcatggagaagataat

SEQ ID NO: 126370 - DNA, 20 bp, Artificial Sequence
  chemically synthesized
catggagaagataatgagtt

SEQ ID NO: 126371 - DNA, 20 bp, Artificial Sequence
  chemically synthesized
gaagataatgagttcagttt

SEQ ID NO: 126372 - DNA, 20 bp, Artificial Sequence
  chemically synthesized
tcagttttggacctattcac

SEQ ID NO: 126373 - DNA, 20 bp, Artificial Sequence
  chemically synthesized
cagttttggacctattcact

SEQ ID NO: 126374 - DNA, 20 bp, Artificial Sequence
  chemically synthesized
ctcacaacctcccagtgaat

SEQ ID NO: 126375 - DNA, 20 bp, Artificial Sequence
  chemically synthesized
cctcacaacctcccagtgaa

SEQ ID NO: 126376 - DNA, 20 bp, Artificial Sequence
  chemically synthesized
gttttggacctattcactgg

SEQ ID NO: 126377 - DNA, 20 bp, Artificial Sequence
  chemically synthesized
ttttggacctattcactggg

SEQ ID NO: 126378 - DNA, 20 bp, Artificial Sequence
  chemically synthesized
gtgtgttcctcacaacctcc

SEQ ID NO: 126379 - DNA, 20 bp, Artificial Sequence
  chemically synthesized
cctattcactgggaggttgt

SEQ ID NO: 126380 - DNA, 20 bp, Artificial Sequence
  chemically synthesized
ctattcactgggaggttgtg

SEQ ID NO: 126381 - DNA, 20 bp, Artificial Sequence
  chemically synthesized
cacacataaaactaacattt

SEQ ID NO: 126382 - DNA, 20 bp, Artificial Sequence
  chemically synthesized
agtcctcctgactaaaatgt

SEQ ID NO: 126383 - DNA, 20 bp, Artificial Sequence
  chemically synthesized
cataaaactaacattttagt

SEQ ID NO: 126384 - DNA, 20 bp, Artificial Sequence
  chemically synthesized
ataaaactaacattttagtc

SEQ ID NO: 126385 - DNA, 20 bp, Artificial Sequence
  chemically synthesized
aaaactaacattttagtcag

SEQ ID NO: 126386 - DNA, 20 bp, Artificial Sequence
  chemically synthesized
aaactaacattttagtcagg

SEQ ID NO: 126387 - DNA, 20 bp, Artificial Sequence
  chemically synthesized
cattttagtcaggaggactg

SEQ ID NO: 126388 - DNA, 20 bp, Artificial Sequence
  chemically synthesized
attttagtcaggaggactga

SEQ ID NO: 126389 - DNA, 20 bp, Artificial Sequence
  chemically synthesized
cagctatgctatagatcctt

SEQ ID NO: 126390 - DNA, 20 bp, Artificial Sequence
  chemically synthesized
caggaggactgaaggatcta

SEQ ID NO: 126391 - DNA, 20 bp, Artificial Sequence
  chemically synthesized
ggactgaaggatctatagca

SEQ ID NO: 126392 - DNA, 20 bp, Artificial Sequence
  chemically synthesized
caaaatacacagctatgcta

SEQ ID NO: 126393 - DNA, 20 bp, Artificial Sequence
  chemically synthesized
tatagcatagctgtgtattt

SEQ ID NO: 126394 - DNA, 20 bp, Artificial Sequence
  chemically synthesized
tctgtctctcccaaaataca

SEQ ID NO: 126395 - DNA, 20 bp, Artificial Sequence
  chemically synthesized
atagcatagctgtgtatttt

SEQ ID NO: 126396 - DNA, 20 bp, Artificial Sequence
  chemically synthesized
agcatagctgtgtattttgg

SEQ ID NO: 126397 - DNA, 20 bp, Artificial Sequence
  chemically synthesized
catagctgtgtattttggga

SEQ ID NO: 126398 - DNA, 20 bp, Artificial Sequence
  chemically synthesized
gctgtgtattttgggagaga

SEQ ID NO: 126399 - DNA, 20 bp, Artificial Sequence
  chemically synthesized
ttttgggagagacagaaatc

SEQ ID NO: 126400 - DNA, 20 bp, Artificial Sequence
  chemically synthesized
tttgggagagacagaaatct

SEQ ID NO: 126401 - DNA, 20 bp, Artificial Sequence
  chemically synthesized
gagagacagaaatctgggat

SEQ ID NO: 126402 - DNA, 20 bp, Artificial Sequence
  chemically synthesized
tctgtagtgacggccaatcc

SEQ ID NO: 126403 - DNA, 20 bp, Artificial Sequence
  chemically synthesized
tctgggattggccgtcacta

SEQ ID NO: 126404 - DNA, 20 bp, Artificial Sequence
  chemically synthesized
tttttatttctctgtagtga

SEQ ID NO: 126405 - DNA, 20 bp, Artificial Sequence
  chemically synthesized
tgggattggccgtcactaca

SEQ ID NO: 126406 - DNA, 20 bp, Artificial Sequence
  chemically synthesized
ctttgctttttatttctctg

SEQ ID NO: 126407 - DNA, 20 bp, Artificial Sequence
  chemically synthesized
cgtcactacagagaaataaa

SEQ ID NO: 126408 - DNA, 20 bp, Artificial Sequence
  chemically synthesized
ctacagagaaataaaaagca

SEQ ID NO: 126409 - DNA, 20 bp, Artificial Sequence
  chemically synthesized
aaaagcaaagcctcaaatgc

SEQ ID NO: 126410 - DNA, 20 bp, Artificial Sequence
  chemically synthesized
tgagaatgcacttgcatttg

SEQ ID NO: 126411 - DNA, 20 bp, Artificial Sequence
  chemically synthesized
atgagaatgcacttgcattt

SEQ ID NO: 126412 - DNA, 20 bp, Artificial Sequence
  chemically synthesized
caagtgcattctcatttata

SEQ ID NO: 126413 - DNA, 20 bp, Artificial Sequence
  chemically synthesized
agtctatgtgccatataaat

SEQ ID NO: 126414 - DNA, 20 bp, Artificial Sequence
  chemically synthesized
attctcatttatatggcaca

SEQ ID NO: 126415 - DNA, 20 bp, Artificial Sequence
  chemically synthesized
atttatatggcacatagact

SEQ ID NO: 126416 - DNA, 20 bp, Artificial Sequence
  chemically synthesized
tcccagcccggtgttgggct

SEQ ID NO: 126417 - DNA, 20 bp, Artificial Sequence
  chemically synthesized
acatagactgagcccaacac

SEQ ID NO: 126418 - DNA, 20 bp, Artificial Sequence
  chemically synthesized
catagactgagcccaacacc

SEQ ID NO: 126419 - DNA, 20 bp, Artificial Sequence
  chemically synthesized
tccattcccagcccggtgtt

SEQ ID NO: 126420 - DNA, 20 bp, Artificial Sequence
  chemically synthesized
gtccattcccagcccggtgt

SEQ ID NO: 126421 - DNA, 20 bp, Artificial Sequence
  chemically synthesized
gactgagcccaacaccgggc

SEQ ID NO: 126422 - DNA, 20 bp, Artificial Sequence
  chemically synthesized
actgagcccaacaccgggct

SEQ ID NO: 126423 - DNA, 20 bp, Artificial Sequence
  chemically synthesized
ccaggagtccattcccagcc

SEQ ID NO: 126424 - DNA, 20 bp, Artificial Sequence
  chemically synthesized
gcccaacaccgggctgggaa

SEQ ID NO: 126425 - DNA, 20 bp, Artificial Sequence
  chemically synthesized
attttccaggagtccattcc

SEQ ID NO: 126426 - DNA, 20 bp, Artificial Sequence
  chemically synthesized
ccgggctgggaatggactcc

SEQ ID NO: 126427 - DNA, 20 bp, Artificial Sequence
  chemically synthesized
ttttacgttgtattttccag

SEQ ID NO: 126428 - DNA, 20 bp, Artificial Sequence
  chemically synthesized
ctttttacgttgtattttcc

SEQ ID NO: 126429 - DNA, 20 bp, Artificial Sequence
  chemically synthesized
tctttttacgttgtattttc

SEQ ID NO: 126430 - DNA, 20 bp, Artificial Sequence
  chemically synthesized
cctggaaaatacaacgtaaa

SEQ ID NO: 126431 - DNA, 20 bp, Artificial Sequence
  chemically synthesized
aaaagaataaataaaacaca

SEQ ID NO: 126432 - DNA, 20 bp, Artificial Sequence
  chemically synthesized
aagaataaataaaacacaaa

SEQ ID NO: 126433 - DNA, 20 bp, Artificial Sequence
  chemically synthesized
ataaaacacaaagagcaaat

SEQ ID NO: 126434 - DNA, 20 bp, Artificial Sequence
  chemically synthesized
agagcaaataagatgaatga

SEQ ID NO: 126435 - DNA, 20 bp, Artificial Sequence
  chemically synthesized
aaataagatgaatgaaagac

SEQ ID NO: 126436 - DNA, 20 bp, Artificial Sequence
  chemically synthesized
ataagatgaatgaaagacta

SEQ ID NO: 126437 - DNA, 20 bp, Artificial Sequence
  chemically synthesized
agatgaatgaaagactagag

SEQ ID NO: 126438 - DNA, 20 bp, Artificial Sequence
  chemically synthesized
gatgaatgaaagactagaga

SEQ ID NO: 126439 - DNA, 20 bp, Artificial Sequence
  chemically synthesized
tgaatgaaagactagagaag

SEQ ID NO: 126440 - DNA, 20 bp, Artificial Sequence
  chemically synthesized
gaatgaaagactagagaagg

SEQ ID NO: 126441 - DNA, 20 bp, Artificial Sequence
  chemically synthesized
tgatattcctcctccttctc

SEQ ID NO: 126442 - DNA, 20 bp, Artificial Sequence
  chemically synthesized
atgaaagactagagaaggag

SEQ ID NO: 126443 - DNA, 20 bp, Artificial Sequence
  chemically synthesized
tgaaagactagagaaggagg

SEQ ID NO: 126444 - DNA, 20 bp, Artificial Sequence
  chemically synthesized
agagaaggaggaggaatatc

SEQ ID NO: 126445 - DNA, 20 bp, Artificial Sequence
  chemically synthesized
aaggaggaggaatatcaaga

SEQ ID NO: 126446 - DNA, 20 bp, Artificial Sequence
  chemically synthesized
atcaagaaagtgtactttta

SEQ ID NO: 126447 - DNA, 20 bp, Artificial Sequence
  chemically synthesized
ttcttttccatgttctataa

SEQ ID NO: 126448 - DNA, 20 bp, Artificial Sequence
  chemically synthesized
aagtgtacttttatagaaca

SEQ ID NO: 126449 - DNA, 20 bp, Artificial Sequence
  chemically synthesized
tacttttatagaacatggaa

SEQ ID NO: 126450 - DNA, 20 bp, Artificial Sequence
  chemically synthesized
tttatagaacatggaaaaga

SEQ ID NO: 126451 - DNA, 20 bp, Artificial Sequence
  chemically synthesized
agaaagattttcaaaaacac

SEQ ID NO: 126452 - DNA, 20 bp, Artificial Sequence
  chemically synthesized
aaagattttcaaaaacacaa

SEQ ID NO: 126453 - DNA, 20 bp, Artificial Sequence
  chemically synthesized
gtgacatctatgagatttga

SEQ ID NO: 126454 - DNA, 20 bp, Artificial Sequence
  chemically synthesized
attaacactttcaaatctca

SEQ ID NO: 126455 - DNA, 20 bp, Artificial Sequence
  chemically synthesized
ttatgtcttgtgacatctat

SEQ ID NO: 126456 - DNA, 20 bp, Artificial Sequence
  chemically synthesized
tcaaatctcatagatgtcac

SEQ ID NO: 126457 - DNA, 20 bp, Artificial Sequence
  chemically synthesized
gtagatattcaaataaatgt

SEQ ID NO: 126458 - DNA, 20 bp, Artificial Sequence
  chemically synthesized
acacagagcttcagacagtg

SEQ ID NO: 126459 - DNA, 20 bp, Artificial Sequence
  chemically synthesized
ttgaatatctacactgtctg

SEQ ID NO: 126460 - DNA, 20 bp, Artificial Sequence
  chemically synthesized
gaacaacacagagcttcaga

SEQ ID NO: 126461 - DNA, 20 bp, Artificial Sequence
  chemically synthesized
gaaagaacaacacagagctt

SEQ ID NO: 126462 - DNA, 20 bp, Artificial Sequence
  chemically synthesized
tgcaaggaaagaacaacaca

SEQ ID NO: 126463 - DNA, 20 bp, Artificial Sequence
  chemically synthesized
aatgcaaggaaagaacaaca

SEQ ID NO: 126464 - DNA, 20 bp, Artificial Sequence
  chemically synthesized
ttaagtgattaatgcaagga

SEQ ID NO: 126465 - DNA, 20 bp, Artificial Sequence
  chemically synthesized
atgattaagtgattaatgca

SEQ ID NO: 126466 - DNA, 20 bp, Artificial Sequence
  chemically synthesized
gatgattaagtgattaatgc

SEQ ID NO: 126467 - DNA, 20 bp, Artificial Sequence
  chemically synthesized
tataggattgtatgatgatt

SEQ ID NO: 126468 - DNA, 20 bp, Artificial Sequence
  chemically synthesized
taatcatcatacaatcctat

SEQ ID NO: 126469 - DNA, 20 bp, Artificial Sequence
  chemically synthesized
acgtaaacaattatacttat

SEQ ID NO: 126470 - DNA, 20 bp, Artificial Sequence
  chemically synthesized
aacgtaaacaattatactta

SEQ ID NO: 126471 - DNA, 20 bp, Artificial Sequence
  chemically synthesized
gataattgcagcaatagaaa

SEQ ID NO: 126472 - DNA, 20 bp, Artificial Sequence
  chemically synthesized
aatgaggataattgcagcaa

SEQ ID NO: 126473 - DNA, 20 bp, Artificial Sequence
  chemically synthesized
ttgttaaatgaggataattg

SEQ ID NO: 126474 - DNA, 20 bp, Artificial Sequence
  chemically synthesized
atttcctcatttgttaaatg

SEQ ID NO: 126475 - DNA, 20 bp, Artificial Sequence
  chemically synthesized
tatttcctcatttgttaaat

SEQ ID NO: 126476 - DNA, 20 bp, Artificial Sequence
  chemically synthesized
attatcctcatttaacaaat

SEQ ID NO: 126477 - DNA, 20 bp, Artificial Sequence
  chemically synthesized
ttatcctcatttaacaaatg

SEQ ID NO: 126478 - DNA, 20 bp, Artificial Sequence
  chemically synthesized
atttaacaaatgaggaaata

SEQ ID NO: 126479 - DNA, 20 bp, Artificial Sequence
  chemically synthesized
aacaaatgaggaaataaaga

SEQ ID NO: 126480 - DNA, 20 bp, Artificial Sequence
  chemically synthesized
taaagacagcgttaaataac

SEQ ID NO: 126481 - DNA, 20 bp, Artificial Sequence
  chemically synthesized
cagcgttaaataactggtct

SEQ ID NO: 126482 - DNA, 20 bp, Artificial Sequence
  chemically synthesized
agcgttaaataactggtcta

SEQ ID NO: 126483 - DNA, 20 bp, Artificial Sequence
  chemically synthesized
ctatctatgtgaccttagac

SEQ ID NO: 126484 - DNA, 20 bp, Artificial Sequence
  chemically synthesized
aatcactatctatgtgacct

SEQ ID NO: 126485 - DNA, 20 bp, Artificial Sequence
  chemically synthesized
ataactggtctaaggtcaca

SEQ ID NO: 126486 - DNA, 20 bp, Artificial Sequence
  chemically synthesized
ctggtctaaggtcacataga

SEQ ID NO: 126487 - DNA, 20 bp, Artificial Sequence
  chemically synthesized
gtcacatagatagtgattgt

SEQ ID NO: 126488 - DNA, 20 bp, Artificial Sequence
  chemically synthesized
cacatagatagtgattgtta

SEQ ID NO: 126489 - DNA, 20 bp, Artificial Sequence
  chemically synthesized
tgattgttagagccgacact

SEQ ID NO: 126490 - DNA, 20 bp, Artificial Sequence
  chemically synthesized
aacttcttgaatccaagtgt

SEQ ID NO: 126491 - DNA, 20 bp, Artificial Sequence
  chemically synthesized
tagagccgacacttggattc

SEQ ID NO: 126492 - DNA, 20 bp, Artificial Sequence
  chemically synthesized
aggtctaacttcttgaatcc

SEQ ID NO: 126493 - DNA, 20 bp, Artificial Sequence
  chemically synthesized
agccgacacttggattcaag

SEQ ID NO: 126494 - DNA, 20 bp, Artificial Sequence
  chemically synthesized
gacacttggattcaagaagt

SEQ ID NO: 126495 - DNA, 20 bp, Artificial Sequence
  chemically synthesized
ttcaagaagttagacctcca

SEQ ID NO: 126496 - DNA, 20 bp, Artificial Sequence
  chemically synthesized
acttttggcatgggctttgg

SEQ ID NO: 126497 - DNA, 20 bp, Artificial Sequence
  chemically synthesized
tacttttggcatgggctttg

SEQ ID NO: 126498 - DNA, 20 bp, Artificial Sequence
  chemically synthesized
gatacttttggcatgggctt

SEQ ID NO: 126499 - DNA, 20 bp, Artificial Sequence
  chemically synthesized
acctccaaagcccatgccaa

SEQ ID NO: 126500 - DNA, 20 bp, Artificial Sequence
  chemically synthesized
ccaatggatacttttggcat

SEQ ID NO: 126501 - DNA, 20 bp, Artificial Sequence
  chemically synthesized
gccaatggatacttttggca

SEQ ID NO: 126502 - DNA, 20 bp, Artificial Sequence
  chemically synthesized
ccaaagccaatggatacttt

SEQ ID NO: 126503 - DNA, 20 bp, Artificial Sequence
  chemically synthesized
cccatgccaaaagtatccat

SEQ ID NO: 126504 - DNA, 20 bp, Artificial Sequence
  chemically synthesized
ccaaaagtatccattggctt

SEQ ID NO: 126505 - DNA, 20 bp, Artificial Sequence
  chemically synthesized
ttccatgtggccaaagccaa

SEQ ID NO: 126506 - DNA, 20 bp, Artificial Sequence
  chemically synthesized
cagggaattccatgtggcca

SEQ ID NO: 126507 - DNA, 20 bp, Artificial Sequence
  chemically synthesized
atccattggctttggccaca

SEQ ID NO: 126508 - DNA, 20 bp, Artificial Sequence
  chemically synthesized
ggtcttcagggaattccatg

SEQ ID NO: 126509 - DNA, 20 bp, Artificial Sequence
  chemically synthesized
tggccacatggaattccctg

SEQ ID NO: 126510 - DNA, 20 bp, Artificial Sequence
  chemically synthesized
cattttgtgtatggtcttca

SEQ ID NO: 126511 - DNA, 20 bp, Artificial Sequence
  chemically synthesized
tcattttgtgtatggtcttc

SEQ ID NO: 126512 - DNA, 20 bp, Artificial Sequence
  chemically synthesized
atcattttgtgtatggtctt

SEQ ID NO: 126513 - DNA, 20 bp, Artificial Sequence
  chemically synthesized
cactgaaatcattttgtgta

SEQ ID NO: 126514 - DNA, 20 bp, Artificial Sequence
  chemically synthesized
gaccatacacaaaatgattt

SEQ ID NO: 126515 - DNA, 20 bp, Artificial Sequence
  chemically synthesized
tacacaaaatgatttcagtg

SEQ ID NO: 126516 - DNA, 20 bp, Artificial Sequence
  chemically synthesized
acaaaatgatttcagtgcag

SEQ ID NO: 126517 - DNA, 20 bp, Artificial Sequence
  chemically synthesized
aaatgatttcagtgcagtgg

SEQ ID NO: 126518 - DNA, 20 bp, Artificial Sequence
  chemically synthesized
cagtggtagaaatcttactg

SEQ ID NO: 126519 - DNA, 20 bp, Artificial Sequence
  chemically synthesized
agtggtagaaatcttactgt

SEQ ID NO: 126520 - DNA, 20 bp, Artificial Sequence
  chemically synthesized
tggtagaaatcttactgtag

SEQ ID NO: 126521 - DNA, 20 bp, Artificial Sequence
  chemically synthesized
attttttaatctcctacagt

SEQ ID NO: 126522 - DNA, 20 bp, Artificial Sequence
  chemically synthesized
aggtattttttaatctccta

SEQ ID NO: 126523 - DNA, 20 bp, Artificial Sequence
  chemically synthesized
attaaaaaatacctatgaaa

SEQ ID NO: 126524 - DNA, 20 bp, Artificial Sequence
  chemically synthesized
tactgtccttactttttcat

SEQ ID NO: 126525 - DNA, 20 bp, Artificial Sequence
  chemically synthesized
ttactgtccttactttttca

SEQ ID NO: 126526 - DNA, 20 bp, Artificial Sequence
  chemically synthesized
aaaaatacctatgaaaaagt

SEQ ID NO: 126527 - DNA, 20 bp, Artificial Sequence
  chemically synthesized
aaaatacctatgaaaaagta

SEQ ID NO: 126528 - DNA, 20 bp, Artificial Sequence
  chemically synthesized
tacctatgaaaaagtaagga

SEQ ID NO: 126529 - DNA, 20 bp, Artificial Sequence
  chemically synthesized
aaagtaaggacagtaaattg

SEQ ID NO: 126530 - DNA, 20 bp, Artificial Sequence
  chemically synthesized
tataatgatctatggttgga

SEQ ID NO: 126531 - DNA, 20 bp, Artificial Sequence
  chemically synthesized
aattgtagactatccaacca

SEQ ID NO: 126532 - DNA, 20 bp, Artificial Sequence
  chemically synthesized
ttcttataatgatctatggt

SEQ ID NO: 126533 - DNA, 20 bp, Artificial Sequence
  chemically synthesized
ttccttcttataatgatcta

SEQ ID NO: 126534 - DNA, 20 bp, Artificial Sequence
  chemically synthesized
atccaaccatagatcattat

SEQ ID NO: 126535 - DNA, 20 bp, Artificial Sequence
  chemically synthesized
caaccatagatcattataag

SEQ ID NO: 126536 - DNA, 20 bp, Artificial Sequence
  chemically synthesized
aaccatagatcattataaga

SEQ ID NO: 126537 - DNA, 20 bp, Artificial Sequence
  chemically synthesized
catagatcattataagaagg

SEQ ID NO: 126538 - DNA, 20 bp, Artificial Sequence
  chemically synthesized
gatcattataagaaggaagt

SEQ ID NO: 126539 - DNA, 20 bp, Artificial Sequence
  chemically synthesized
tcattataagaaggaagtca

SEQ ID NO: 126540 - DNA, 20 bp, Artificial Sequence
  chemically synthesized
cattataagaaggaagtcag

SEQ ID NO: 126541 - DNA, 20 bp, Artificial Sequence
  chemically synthesized
attataagaaggaagtcaga

SEQ ID NO: 126542 - DNA, 20 bp, Artificial Sequence
  chemically synthesized
ttataagaaggaagtcagag

SEQ ID NO: 126543 - DNA, 20 bp, Artificial Sequence
  chemically synthesized
ataagaaggaagtcagaggg

SEQ ID NO: 126544 - DNA, 20 bp, Artificial Sequence
  chemically synthesized
aaggaagtcagaggggagtt

SEQ ID NO: 126545 - DNA, 20 bp, Artificial Sequence
  chemically synthesized
tcagaggggagtttggtgtc

SEQ ID NO: 126546 - DNA, 20 bp, Artificial Sequence
  chemically synthesized
agaggggagtttggtgtcaa

SEQ ID NO: 126547 - DNA, 20 bp, Artificial Sequence
  chemically synthesized
ggggagtttggtgtcaagag

SEQ ID NO: 126548 - DNA, 20 bp, Artificial Sequence
  chemically synthesized
gagaagttttttcccaaata

SEQ ID NO: 126549 - DNA, 20 bp, Artificial Sequence
  chemically synthesized
tactcaagttttccatattt

SEQ ID NO: 126550 - DNA, 20 bp, Artificial Sequence
  chemically synthesized
atactcaagttttccatatt

SEQ ID NO: 126551 - DNA, 20 bp, Artificial Sequence
  chemically synthesized
ttcccaaatatggaaaactt

SEQ ID NO: 126552 - DNA, 20 bp, Artificial Sequence
  chemically synthesized
caatacctatattcatactc

SEQ ID NO: 126553 - DNA, 20 bp, Artificial Sequence
  chemically synthesized
ggaaaacttgagtatgaata

SEQ ID NO: 126554 - DNA, 20 bp, Artificial Sequence
  chemically synthesized
gaaaacttgagtatgaatat

SEQ ID NO: 126555 - DNA, 20 bp, Artificial Sequence
  chemically synthesized
gtatgaatataggtattgat

SEQ ID NO: 126556 - DNA, 20 bp, Artificial Sequence
  chemically synthesized
tatgaatataggtattgatt

SEQ ID NO: 126557 - DNA, 20 bp, Artificial Sequence
  chemically synthesized
atgaatataggtattgattg

SEQ ID NO: 126558 - DNA, 20 bp, Artificial Sequence
  chemically synthesized
taggtattgattggggaaaa

SEQ ID NO: 126559 - DNA, 20 bp, Artificial Sequence
  chemically synthesized
tgattggggaaaatggtcaa

SEQ ID NO: 126560 - DNA, 20 bp, Artificial Sequence
  chemically synthesized
gggaaaatggtcaaaagaca

SEQ ID NO: 126561 - DNA, 20 bp, Artificial Sequence
  chemically synthesized
tcaaaagacaaagatgatgc

SEQ ID NO: 126562 - DNA, 20 bp, Artificial Sequence
  chemically synthesized
aagacaaagatgatgccaga

SEQ ID NO: 126563 - DNA, 20 bp, Artificial Sequence
  chemically synthesized
acaaagatgatgccagatgg

SEQ ID NO: 126564 - DNA, 20 bp, Artificial Sequence
  chemically synthesized
tcagggacttttcttccatc

SEQ ID NO: 126565 - DNA, 20 bp, Artificial Sequence
  chemically synthesized
gatgatgccagatggaagaa

SEQ ID NO: 126566 - DNA, 20 bp, Artificial Sequence
  chemically synthesized
cagatggaagaaaagtccct

SEQ ID NO: 126567 - DNA, 20 bp, Artificial Sequence
  chemically synthesized
atggaagaaaagtccctgag

SEQ ID NO: 126568 - DNA, 20 bp, Artificial Sequence
  chemically synthesized
tggaagaaaagtccctgaga

SEQ ID NO: 126569 - DNA, 20 bp, Artificial Sequence
  chemically synthesized
tcaatacacgcaccttctca

SEQ ID NO: 126570 - DNA, 20 bp, Artificial Sequence
  chemically synthesized
ttcaatacacgcaccttctc

SEQ ID NO: 126571 - DNA, 20 bp, Artificial Sequence
  chemically synthesized
gttcaatacacgcaccttct

SEQ ID NO: 126572 - DNA, 20 bp, Artificial Sequence
  chemically synthesized
acacaggagaaggaggtagt

SEQ ID NO: 126573 - DNA, 20 bp, Artificial Sequence
  chemically synthesized
ggaaacacaggagaaggagg

SEQ ID NO: 126574 - DNA, 20 bp, Artificial Sequence
  chemically synthesized
aggggaaacacaggagaagg

SEQ ID NO: 126575 - DNA, 20 bp, Artificial Sequence
  chemically synthesized
caggggaaacacaggagaag

SEQ ID NO: 126576 - DNA, 20 bp, Artificial Sequence
  chemically synthesized
aacaggggaaacacaggaga

SEQ ID NO: 126577 - DNA, 20 bp, Artificial Sequence
  chemically synthesized
taacaggggaaacacaggag

SEQ ID NO: 126578 - DNA, 20 bp, Artificial Sequence
  chemically synthesized
aaataacaggggaaacacag

SEQ ID NO: 126579 - DNA, 20 bp, Artificial Sequence
  chemically synthesized
aaaaataacaggggaaacac

SEQ ID NO: 126580 - DNA, 20 bp, Artificial Sequence
  chemically synthesized
gaaaaataacaggggaaaca

SEQ ID NO: 126581 - DNA, 20 bp, Artificial Sequence
  chemically synthesized
cacaaatggaaaaataacag

SEQ ID NO: 126582 - DNA, 20 bp, Artificial Sequence
  chemically synthesized
gcacaaatggaaaaataaca

SEQ ID NO: 126583 - DNA, 20 bp, Artificial Sequence
  chemically synthesized
tgcacaaatggaaaaataac

SEQ ID NO: 126584 - DNA, 20 bp, Artificial Sequence
  chemically synthesized
ctgcacaaatggaaaaataa

SEQ ID NO: 126585 - DNA, 20 bp, Artificial Sequence
  chemically synthesized
ctgttatttttccatttgtg

SEQ ID NO: 126586 - DNA, 20 bp, Artificial Sequence
  chemically synthesized
ttgtgggaaaactgcacaaa

SEQ ID NO: 126587 - DNA, 20 bp, Artificial Sequence
  chemically synthesized
tttgtgcagttttcccacaa

SEQ ID NO: 126588 - DNA, 20 bp, Artificial Sequence
  chemically synthesized
agcaaagagaggtctattgt

SEQ ID NO: 126589 - DNA, 20 bp, Artificial Sequence
  chemically synthesized
gagcaaagagaggtctattg

SEQ ID NO: 126590 - DNA, 20 bp, Artificial Sequence
  chemically synthesized
accatccacagagcaaagag

SEQ ID NO: 126591 - DNA, 20 bp, Artificial Sequence
  chemically synthesized
caccatccacagagcaaaga

SEQ ID NO: 126592 - DNA, 20 bp, Artificial Sequence
  chemically synthesized
cacaccatccacagagcaaa

SEQ ID NO: 126593 - DNA, 20 bp, Artificial Sequence
  chemically synthesized
atagacctctctttgctctg

SEQ ID NO: 126594 - DNA, 20 bp, Artificial Sequence
  chemically synthesized
tacacaccatccacagagca

SEQ ID NO: 126595 - DNA, 20 bp, Artificial Sequence
  chemically synthesized
acctctctttgctctgtgga

SEQ ID NO: 126596 - DNA, 20 bp, Artificial Sequence
  chemically synthesized
ctaagtacacaccatccaca

SEQ ID NO: 126597 - DNA, 20 bp, Artificial Sequence
  chemically synthesized
aactaagtacacaccatcca

SEQ ID NO: 126598 - DNA, 20 bp, Artificial Sequence
  chemically synthesized
ctctgtggatggtgtgtact

SEQ ID NO: 126599 - DNA, 20 bp, Artificial Sequence
  chemically synthesized
cagggagatgagttaaaact

SEQ ID NO: 126600 - DNA, 20 bp, Artificial Sequence
  chemically synthesized
ttagttttaactcatctccc

SEQ ID NO: 126601 - DNA, 20 bp, Artificial Sequence
  chemically synthesized
accactaaagccagggagat

SEQ ID NO: 126602 - DNA, 20 bp, Artificial Sequence
  chemically synthesized
aattaaccactaaagccagg

SEQ ID NO: 126603 - DNA, 20 bp, Artificial Sequence
  chemically synthesized
ttaactcatctccctggctt

SEQ ID NO: 126604 - DNA, 20 bp, Artificial Sequence
  chemically synthesized
tgaattaaccactaaagcca

SEQ ID NO: 126605 - DNA, 20 bp, Artificial Sequence
  chemically synthesized
ttgaattaaccactaaagcc

SEQ ID NO: 126606 - DNA, 20 bp, Artificial Sequence
  chemically synthesized
actcatctccctggctttag

SEQ ID NO: 126607 - DNA, 20 bp, Artificial Sequence
  chemically synthesized
tttgaattaaccactaaagc

SEQ ID NO: 126608 - DNA, 20 bp, Artificial Sequence
  chemically synthesized
catctttgaattaaccacta

SEQ ID NO: 126609 - DNA, 20 bp, Artificial Sequence
  chemically synthesized
tggctttagtggttaattca

SEQ ID NO: 126610 - DNA, 20 bp, Artificial Sequence
  chemically synthesized
tttagtggttaattcaaaga

SEQ ID NO: 126611 - DNA, 20 bp, Artificial Sequence
  chemically synthesized
ttaattcaaagatggactta

SEQ ID NO: 126612 - DNA, 20 bp, Artificial Sequence
  chemically synthesized
ttgaccttacttggaaccat

SEQ ID NO: 126613 - DNA, 20 bp, Artificial Sequence
  chemically synthesized
aaagatggacttatggttcc

SEQ ID NO: 126614 - DNA, 20 bp, Artificial Sequence
  chemically synthesized
atggacttatggttccaagt

SEQ ID NO: 126615 - DNA, 20 bp, Artificial Sequence
  chemically synthesized
tggacttatggttccaagta

SEQ ID NO: 126616 - DNA, 20 bp, Artificial Sequence
  chemically synthesized
tggttctgattgaccttact

SEQ ID NO: 126617 - DNA, 20 bp, Artificial Sequence
  chemically synthesized
tggttccaagtaaggtcaat

SEQ ID NO: 126618 - DNA, 20 bp, Artificial Sequence
  chemically synthesized
aaatcctagagttgtttcat

SEQ ID NO: 126619 - DNA, 20 bp, Artificial Sequence
  chemically synthesized
cagaaccaatgaaacaactc

SEQ ID NO: 126620 - DNA, 20 bp, Artificial Sequence
  chemically synthesized
agaaccaatgaaacaactct

SEQ ID NO: 126621 - DNA, 20 bp, Artificial Sequence
  chemically synthesized
caacaacaacaaaaatccta

SEQ ID NO: 126622 - DNA, 20 bp, Artificial Sequence
  chemically synthesized
aacaacaacaacaaaaatcc

SEQ ID NO: 126623 - DNA, 20 bp, Artificial Sequence
  chemically synthesized
gttgttgttcgtgattctaa

SEQ ID NO: 126624 - DNA, 20 bp, Artificial Sequence
  chemically synthesized
tgttgttcgtgattctaaaa

SEQ ID NO: 126625 - DNA, 20 bp, Artificial Sequence
  chemically synthesized
aagcaatgggttttctcttt

SEQ ID NO: 126626 - DNA, 20 bp, Artificial Sequence
  chemically synthesized
catcttaaacaagaagcaat

SEQ ID NO: 126627 - DNA, 20 bp, Artificial Sequence
  chemically synthesized
ccatcttaaacaagaagcaa

SEQ ID NO: 126628 - DNA, 20 bp, Artificial Sequence
  chemically synthesized
aaacccattgcttcttgttt

SEQ ID NO: 126629 - DNA, 20 bp, Artificial Sequence
  chemically synthesized
tctcatccatcttaaacaag

SEQ ID NO: 126630 - DNA, 20 bp, Artificial Sequence
  chemically synthesized
ctttctcatccatcttaaac

SEQ ID NO: 126631 - DNA, 20 bp, Artificial Sequence
  chemically synthesized
ccattgcttcttgtttaaga

SEQ ID NO: 126632 - DNA, 20 bp, Artificial Sequence
  chemically synthesized
gcttcttgtttaagatggat

SEQ ID NO: 126633 - DNA, 20 bp, Artificial Sequence
  chemically synthesized
cttgtttaagatggatgaga

SEQ ID NO: 126634 - DNA, 20 bp, Artificial Sequence
  chemically synthesized
aagatggatgagaaagcacg

SEQ ID NO: 126635 - DNA, 20 bp, Artificial Sequence
  chemically synthesized
tgagaaagcacgtagttctg

SEQ ID NO: 126636 - DNA, 20 bp, Artificial Sequence
  chemically synthesized
agatggatatcaggatactg

SEQ ID NO: 126637 - DNA, 20 bp, Artificial Sequence
  chemically synthesized
attgttctaagatggatatc

SEQ ID NO: 126638 - DNA, 20 bp, Artificial Sequence
  chemically synthesized
aattgttctaagatggatat

SEQ ID NO: 126639 - DNA, 20 bp, Artificial Sequence
  chemically synthesized
cagtatcctgatatccatct

SEQ ID NO: 126640 - DNA, 20 bp, Artificial Sequence
  chemically synthesized
tcctcttaattgttctaaga

SEQ ID NO: 126641 - DNA, 20 bp, Artificial Sequence
  chemically synthesized
taattcctcttaattgttct

SEQ ID NO: 126642 - DNA, 20 bp, Artificial Sequence
  chemically synthesized
atatccatcttagaacaatt

SEQ ID NO: 126643 - DNA, 20 bp, Artificial Sequence
  chemically synthesized
atccatcttagaacaattaa

SEQ ID NO: 126644 - DNA, 20 bp, Artificial Sequence
  chemically synthesized
tccatcttagaacaattaag

SEQ ID NO: 126645 - DNA, 20 bp, Artificial Sequence
  chemically synthesized
aacaattaagaggaattaaa

SEQ ID NO: 126646 - DNA, 20 bp, Artificial Sequence
  chemically synthesized
gaattaaacggaacaaatac

SEQ ID NO: 126647 - DNA, 20 bp, Artificial Sequence
  chemically synthesized
aattaaacggaacaaatact

SEQ ID NO: 126648 - DNA, 20 bp, Artificial Sequence
  chemically synthesized
attaaacggaacaaatactg

SEQ ID NO: 126649 - DNA, 20 bp, Artificial Sequence
  chemically synthesized
taaacggaacaaatactggg

SEQ ID NO: 126650 - DNA, 20 bp, Artificial Sequence
  chemically synthesized
acggaacaaatactggggag

SEQ ID NO: 126651 - DNA, 20 bp, Artificial Sequence
  chemically synthesized
ggaacaaatactggggagca

SEQ ID NO: 126652 - DNA, 20 bp, Artificial Sequence
  chemically synthesized
cattgcatggctctgctccc

SEQ ID NO: 126653 - DNA, 20 bp, Artificial Sequence
  chemically synthesized
tggggagcagagccatgcaa

SEQ ID NO: 126654 - DNA, 20 bp, Artificial Sequence
  chemically synthesized
gggagcagagccatgcaatg

SEQ ID NO: 126655 - DNA, 20 bp, Artificial Sequence
  chemically synthesized
agttttccttctccattgca

SEQ ID NO: 126656 - DNA, 20 bp, Artificial Sequence
  chemically synthesized
agcagagccatgcaatggag

SEQ ID NO: 126657 - DNA, 20 bp, Artificial Sequence
  chemically synthesized
gcagagccatgcaatggaga

SEQ ID NO: 126658 - DNA, 20 bp, Artificial Sequence
  chemically synthesized
atgcaatggagaaggaaaac

SEQ ID NO: 126659 - DNA, 20 bp, Artificial Sequence
  chemically synthesized
ggagaaggaaaactagaatc

SEQ ID NO: 126660 - DNA, 20 bp, Artificial Sequence
  chemically synthesized
taaatagcatgaccagattc

SEQ ID NO: 126661 - DNA, 20 bp, Artificial Sequence
  chemically synthesized
caggaattaaatagcatgac

SEQ ID NO: 126662 - DNA, 20 bp, Artificial Sequence
  chemically synthesized
ggcttgattcaggaattaaa

SEQ ID NO: 126663 - DNA, 20 bp, Artificial Sequence
  chemically synthesized
tgctatttaattcctgaatc

SEQ ID NO: 126664 - DNA, 20 bp, Artificial Sequence
  chemically synthesized
agatagacgaggcttgattc

SEQ ID NO: 126665 - DNA, 20 bp, Artificial Sequence
  chemically synthesized
aagatagacgaggcttgatt

SEQ ID NO: 126666 - DNA, 20 bp, Artificial Sequence
  chemically synthesized
aaacagttgaaagatagacg

SEQ ID NO: 126667 - DNA, 20 bp, Artificial Sequence
  chemically synthesized
taaacagttgaaagatagac

SEQ ID NO: 126668 - DNA, 20 bp, Artificial Sequence
  chemically synthesized
gtcattaaacagttgaaaga

SEQ ID NO: 126669 - DNA, 20 bp, Artificial Sequence
  chemically synthesized
cagtgtcattaaacagttga

SEQ ID NO: 126670 - DNA, 20 bp, Artificial Sequence
  chemically synthesized
tattgatcagtgtcattaaa

SEQ ID NO: 126671 - DNA, 20 bp, Artificial Sequence
  chemically synthesized
ctcagacaaaatgtattgat

SEQ ID NO: 126672 - DNA, 20 bp, Artificial Sequence
  chemically synthesized
ctgatcaatacattttgtct

SEQ ID NO: 126673 - DNA, 20 bp, Artificial Sequence
  chemically synthesized
tcaatacattttgtctgagt

SEQ ID NO: 126674 - DNA, 20 bp, Artificial Sequence
  chemically synthesized
caaagtagcttagacttact

SEQ ID NO: 126675 - DNA, 20 bp, Artificial Sequence
  chemically synthesized
cattttgtctgagtaagtct

SEQ ID NO: 126676 - DNA, 20 bp, Artificial Sequence
  chemically synthesized
aaatccatttcaaagtagct

SEQ ID NO: 126677 - DNA, 20 bp, Artificial Sequence
  chemically synthesized
atggaaaatccatttcaaag

SEQ ID NO: 126678 - DNA, 20 bp, Artificial Sequence
  chemically synthesized
aagtctaagctactttgaaa

SEQ ID NO: 126679 - DNA, 20 bp, Artificial Sequence
  chemically synthesized
gtaatggaaaatccatttca

SEQ ID NO: 126680 - DNA, 20 bp, Artificial Sequence
  chemically synthesized
gaacttgtacattgtagtaa

SEQ ID NO: 126681 - DNA, 20 bp, Artificial Sequence
  chemically synthesized
aagttagaacttgtacattg

SEQ ID NO: 126682 - DNA, 20 bp, Artificial Sequence
  chemically synthesized
tttccattactacaatgtac

SEQ ID NO: 126683 - DNA, 20 bp, Artificial Sequence
  chemically synthesized
aatgtacaagttctaactta

SEQ ID NO: 126684 - DNA, 20 bp, Artificial Sequence
  chemically synthesized
tgtacaagttctaacttata

SEQ ID NO: 126685 - DNA, 20 bp, Artificial Sequence
  chemically synthesized
gtttgtctctctctataagt

SEQ ID NO: 126686 - DNA, 20 bp, Artificial Sequence
  chemically synthesized
tacaagttctaacttataga

SEQ ID NO: 126687 - DNA, 20 bp, Artificial Sequence
  chemically synthesized
caagttctaacttatagaga

SEQ ID NO: 126688 - DNA, 20 bp, Artificial Sequence
  chemically synthesized
aagagtttgtctctctctat

SEQ ID NO: 126689 - DNA, 20 bp, Artificial Sequence
  chemically synthesized
gacctttgtttacatcaaaa

SEQ ID NO: 126690 - DNA, 20 bp, Artificial Sequence
  chemically synthesized
gagacctttgtttacatcaa

SEQ ID NO: 126691 - DNA, 20 bp, Artificial Sequence
  chemically synthesized
aaactcttttgatgtaaaca

SEQ ID NO: 126692 - DNA, 20 bp, Artificial Sequence
  chemically synthesized
aactcttttgatgtaaacaa

SEQ ID NO: 126693 - DNA, 20 bp, Artificial Sequence
  chemically synthesized
tgatgtaaacaaaggtctcc

SEQ ID NO: 126694 - DNA, 20 bp, Artificial Sequence
  chemically synthesized
gatgtaaacaaaggtctcct

SEQ ID NO: 126695 - DNA, 20 bp, Artificial Sequence
  chemically synthesized
gattcttgtacaattcctag

SEQ ID NO: 126696 - DNA, 20 bp, Artificial Sequence
  chemically synthesized
atgattcttgtacaattcct

SEQ ID NO: 126697 - DNA, 20 bp, Artificial Sequence
  chemically synthesized
catgattcttgtacaattcc

SEQ ID NO: 126698 - DNA, 20 bp, Artificial Sequence
  chemically synthesized
aggtctcctaggaattgtac

SEQ ID NO: 126699 - DNA, 20 bp, Artificial Sequence
  chemically synthesized
taggaattgtacaagaatca

SEQ ID NO: 126700 - DNA, 20 bp, Artificial Sequence
  chemically synthesized
aggaattgtacaagaatcat

SEQ ID NO: 126701 - DNA, 20 bp, Artificial Sequence
  chemically synthesized
agaatcatgggaattgtaca

SEQ ID NO: 126702 - DNA, 20 bp, Artificial Sequence
  chemically synthesized
gaatcatgggaattgtacat

SEQ ID NO: 126703 - DNA, 20 bp, Artificial Sequence
  chemically synthesized
atgggaattgtacatgggaa

SEQ ID NO: 126704 - DNA, 20 bp, Artificial Sequence
  chemically synthesized
ttttaaacttttgtatttga

SEQ ID NO: 126705 - DNA, 20 bp, Artificial Sequence
  chemically synthesized
ggaatagctttcaaatacaa

SEQ ID NO: 126706 - DNA, 20 bp, Artificial Sequence
  chemically synthesized
tttcaaatacaaaagtttaa

SEQ ID NO: 126707 - DNA, 20 bp, Artificial Sequence
  chemically synthesized
tcaaatacaaaagtttaaaa

SEQ ID NO: 126708 - DNA, 20 bp, Artificial Sequence
  chemically synthesized
caaatacaaaagtttaaaag

SEQ ID NO: 126709 - DNA, 20 bp, Artificial Sequence
  chemically synthesized
agctactttaagcaggatca

SEQ ID NO: 126710 - DNA, 20 bp, Artificial Sequence
  chemically synthesized
gaggactttgatcctgctta

SEQ ID NO: 126711 - DNA, 20 bp, Artificial Sequence
  chemically synthesized
tagttaaagctactttaagc

SEQ ID NO: 126712 - DNA, 20 bp, Artificial Sequence
  chemically synthesized
gactttgatcctgcttaaag

SEQ ID NO: 126713 - DNA, 20 bp, Artificial Sequence
  chemically synthesized
ctagttaaagctactttaag

SEQ ID NO: 126714 - DNA, 20 bp, Artificial Sequence
  chemically synthesized
accctagttaaagctacttt

SEQ ID NO: 126715 - DNA, 20 bp, Artificial Sequence
  chemically synthesized
ctgcttaaagtagctttaac

SEQ ID NO: 126716 - DNA, 20 bp, Artificial Sequence
  chemically synthesized
tgcttaaagtagctttaact

SEQ ID NO: 126717 - DNA, 20 bp, Artificial Sequence
  chemically synthesized
gcttaaagtagctttaacta

SEQ ID NO: 126718 - DNA, 20 bp, Artificial Sequence
  chemically synthesized
ttatctagataccctagtta

SEQ ID NO: 126719 - DNA, 20 bp, Artificial Sequence
  chemically synthesized
gtagctttaactagggtatc

SEQ ID NO: 126720 - DNA, 20 bp, Artificial Sequence
  chemically synthesized
gtgtatttatctagataccc

SEQ ID NO: 126721 - DNA, 20 bp, Artificial Sequence
  chemically synthesized
aagcattcagtgtatttatc

SEQ ID NO: 126722 - DNA, 20 bp, Artificial Sequence
  chemically synthesized
tccaaggtgatataagcatt

SEQ ID NO: 126723 - DNA, 20 bp, Artificial Sequence
  chemically synthesized
gaactcctccaaggtgatat

SEQ ID NO: 126724 - DNA, 20 bp, Artificial Sequence
  chemically synthesized
actgaatgcttatatcacct

SEQ ID NO: 126725 - DNA, 20 bp, Artificial Sequence
  chemically synthesized
tgaatgcttatatcaccttg

SEQ ID NO: 126726 - DNA, 20 bp, Artificial Sequence
  chemically synthesized
gaatgcttatatcaccttgg

SEQ ID NO: 126727 - DNA, 20 bp, Artificial Sequence
  chemically synthesized
atgcttatatcaccttggag

SEQ ID NO: 126728 - DNA, 20 bp, Artificial Sequence
  chemically synthesized
tttatgtaggaactcctcca

SEQ ID NO: 126729 - DNA, 20 bp, Artificial Sequence
  chemically synthesized
ttttatgtaggaactcctcc

SEQ ID NO: 126730 - DNA, 20 bp, Artificial Sequence
  chemically synthesized
gctttggaaattttttatgt

SEQ ID NO: 126731 - DNA, 20 bp, Artificial Sequence
  chemically synthesized
ggctttggaaattttttatg

SEQ ID NO: 126732 - DNA, 20 bp, Artificial Sequence
  chemically synthesized
tcctacataaaaaatttcca

SEQ ID NO: 126733 - DNA, 20 bp, Artificial Sequence
  chemically synthesized
taaaaaatttccaaagccca

SEQ ID NO: 126734 - DNA, 20 bp, Artificial Sequence
  chemically synthesized
agttttggttctatgggctt

SEQ ID NO: 126735 - DNA, 20 bp, Artificial Sequence
  chemically synthesized
ttggtaagttttggttctat

SEQ ID NO: 126736 - DNA, 20 bp, Artificial Sequence
  chemically synthesized
tttggtaagttttggttcta

SEQ ID NO: 126737 - DNA, 20 bp, Artificial Sequence
  chemically synthesized
ataacatttttggtaagttt

SEQ ID NO: 126738 - DNA, 20 bp, Artificial Sequence
  chemically synthesized
aatgccataacatttttggt

SEQ ID NO: 126739 - DNA, 20 bp, Artificial Sequence
  chemically synthesized
tctaaatgccataacatttt

SEQ ID NO: 126740 - DNA, 20 bp, Artificial Sequence
  chemically synthesized
aaaacttaccaaaaatgtta

SEQ ID NO: 126741 - DNA, 20 bp, Artificial Sequence
  chemically synthesized
accaaaaatgttatggcatt

SEQ ID NO: 126742 - DNA, 20 bp, Artificial Sequence
  chemically synthesized
tttagacaacattattctgt

SEQ ID NO: 126743 - DNA, 20 bp, Artificial Sequence
  chemically synthesized
cttcctacccataaggctca

SEQ ID NO: 126744 - DNA, 20 bp, Artificial Sequence
  chemically synthesized
acattattctgtgagcctta

SEQ ID NO: 126745 - DNA, 20 bp, Artificial Sequence
  chemically synthesized
cattattctgtgagccttat

SEQ ID NO: 126746 - DNA, 20 bp, Artificial Sequence
  chemically synthesized
tattctgtgagccttatggg

SEQ ID NO: 126747 - DNA, 20 bp, Artificial Sequence
  chemically synthesized
attctgtgagccttatgggt

SEQ ID NO: 126748 - DNA, 20 bp, Artificial Sequence
  chemically synthesized
aaaatcccttcctacccata

SEQ ID NO: 126749 - DNA, 20 bp, Artificial Sequence
  chemically synthesized
aaaaatcccttcctacccat

SEQ ID NO: 126750 - DNA, 20 bp, Artificial Sequence
  chemically synthesized
ctgtgagccttatgggtagg

SEQ ID NO: 126751 - DNA, 20 bp, Artificial Sequence
  chemically synthesized
tgtgagccttatgggtagga

SEQ ID NO: 126752 - DNA, 20 bp, Artificial Sequence
  chemically synthesized
gtgagccttatgggtaggaa

SEQ ID NO: 126753 - DNA, 20 bp, Artificial Sequence
  chemically synthesized
tagaaagaggtaaacattgg

SEQ ID NO: 126754 - DNA, 20 bp, Artificial Sequence
  chemically synthesized
gaatagaaagaggtaaacat

SEQ ID NO: 126755 - DNA, 20 bp, Artificial Sequence
  chemically synthesized
taaagaaattgaatagaaag

SEQ ID NO: 126756 - DNA, 20 bp, Artificial Sequence
  chemically synthesized
ataaagaaattgaatagaaa

SEQ ID NO: 126757 - DNA, 20 bp, Artificial Sequence
  chemically synthesized
atataaagaaattgaataga

SEQ ID NO: 126758 - DNA, 20 bp, Artificial Sequence
  chemically synthesized
cataatataaagaaattgaa

SEQ ID NO: 126759 - DNA, 20 bp, Artificial Sequence
  chemically synthesized
atttatgtattcataatata

SEQ ID NO: 126760 - DNA, 20 bp, Artificial Sequence
  chemically synthesized
aaatgaaaatgacactcaaa

SEQ ID NO: 126761 - DNA, 20 bp, Artificial Sequence
  chemically synthesized
atgaaaatgacactcaaaaa

SEQ ID NO: 126762 - DNA, 20 bp, Artificial Sequence
  chemically synthesized
gaaaatgacactcaaaaaga

SEQ ID NO: 126763 - DNA, 20 bp, Artificial Sequence
  chemically synthesized
ccccagatgtctctcttttt

SEQ ID NO: 126764 - DNA, 20 bp, Artificial Sequence
  chemically synthesized
cactcaaaaagagagacatc

SEQ ID NO: 126765 - DNA, 20 bp, Artificial Sequence
  chemically synthesized
actcaaaaagagagacatct

SEQ ID NO: 126766 - DNA, 20 bp, Artificial Sequence
  chemically synthesized
ctcaaaaagagagacatctg

SEQ ID NO: 126767 - DNA, 20 bp, Artificial Sequence
  chemically synthesized
tcctgggataattttgtccc

SEQ ID NO: 126768 - DNA, 20 bp, Artificial Sequence
  chemically synthesized
atctggggacaaaattatcc

SEQ ID NO: 126769 - DNA, 20 bp, Artificial Sequence
  chemically synthesized
tctggggacaaaattatccc

SEQ ID NO: 126770 - DNA, 20 bp, Artificial Sequence
  chemically synthesized
accctatatgtgaatgtcct

SEQ ID NO: 126771 - DNA, 20 bp, Artificial Sequence
  chemically synthesized
caccctatatgtgaatgtcc

SEQ ID NO: 126772 - DNA, 20 bp, Artificial Sequence
  chemically synthesized
tatcccaggacattcacata

SEQ ID NO: 126773 - DNA, 20 bp, Artificial Sequence
  chemically synthesized
atcccaggacattcacatat

SEQ ID NO: 126774 - DNA, 20 bp, Artificial Sequence
  chemically synthesized
tcccaggacattcacatata

SEQ ID NO: 126775 - DNA, 20 bp, Artificial Sequence
  chemically synthesized
caggacattcacatataggg

SEQ ID NO: 126776 - DNA, 20 bp, Artificial Sequence
  chemically synthesized
acatatagggtggccacgcc

SEQ ID NO: 126777 - DNA, 20 bp, Artificial Sequence
  chemically synthesized
accatggatgtaaccaggcg

SEQ ID NO: 126778 - DNA, 20 bp, Artificial Sequence
  chemically synthesized
tttaaaccatggatgtaacc

SEQ ID NO: 126779 - DNA, 20 bp, Artificial Sequence
  chemically synthesized
ttttaaaccatggatgtaac

SEQ ID NO: 126780 - DNA, 20 bp, Artificial Sequence
  chemically synthesized
gccacgcctggttacatcca

SEQ ID NO: 126781 - DNA, 20 bp, Artificial Sequence
  chemically synthesized
agtagaattattttaaacca

SEQ ID NO: 126782 - DNA, 20 bp, Artificial Sequence
  chemically synthesized
tacttaaaagggaaaaagag

SEQ ID NO: 126783 - DNA, 20 bp, Artificial Sequence
  chemically synthesized
atctacttaaaagggaaaaa

SEQ ID NO: 126784 - DNA, 20 bp, Artificial Sequence
  chemically synthesized
agatctacttaaaagggaaa

SEQ ID NO: 126785 - DNA, 20 bp, Artificial Sequence
  chemically synthesized
ttctactctttttccctttt

SEQ ID NO: 126786 - DNA, 20 bp, Artificial Sequence
  chemically synthesized
tactctttttcccttttaag

SEQ ID NO: 126787 - DNA, 20 bp, Artificial Sequence
  chemically synthesized
tatcaaagatctacttaaaa

SEQ ID NO: 126788 - DNA, 20 bp, Artificial Sequence
  chemically synthesized
ttatcaaagatctacttaaa

SEQ ID NO: 126789 - DNA, 20 bp, Artificial Sequence
  chemically synthesized
gttatcaaagatctacttaa

SEQ ID NO: 126790 - DNA, 20 bp, Artificial Sequence
  chemically synthesized
tttaagtagatctttgataa

SEQ ID NO: 126791 - DNA, 20 bp, Artificial Sequence
  chemically synthesized
gagtgggtgttccgttatca

SEQ ID NO: 126792 - DNA, 20 bp, Artificial Sequence
  chemically synthesized
tgtgatgatgacatttgagt

SEQ ID NO: 126793 - DNA, 20 bp, Artificial Sequence
  chemically synthesized
atgtgatgatgacatttgag

SEQ ID NO: 126794 - DNA, 20 bp, Artificial Sequence
  chemically synthesized
tatatgtgatgatgacattt

SEQ ID NO: 126795 - DNA, 20 bp, Artificial Sequence
  chemically synthesized
aaatgtcatcatcacatata

SEQ ID NO: 126796 - DNA, 20 bp, Artificial Sequence
  chemically synthesized
tgcacatatgagagcagggg

SEQ ID NO: 126797 - DNA, 20 bp, Artificial Sequence
  chemically synthesized
gactgcacatatgagagcag

SEQ ID NO: 126798 - DNA, 20 bp, Artificial Sequence
  chemically synthesized
tgactgcacatatgagagca

SEQ ID NO: 126799 - DNA, 20 bp, Artificial Sequence
  chemically synthesized
atgactgcacatatgagagc

SEQ ID NO: 126800 - DNA, 20 bp, Artificial Sequence
  chemically synthesized
aatgactgcacatatgagag

SEQ ID NO: 126801 - DNA, 20 bp, Artificial Sequence
  chemically synthesized
gaaaatgactgcacatatga

SEQ ID NO: 126802 - DNA, 20 bp, Artificial Sequence
  chemically synthesized
ttcccctgctctcatatgtg

SEQ ID NO: 126803 - DNA, 20 bp, Artificial Sequence
  chemically synthesized
gagaaaatgactgcacatat

SEQ ID NO: 126804 - DNA, 20 bp, Artificial Sequence
  chemically synthesized
gcagtcattttctctcaccg

SEQ ID NO: 126805 - DNA, 20 bp, Artificial Sequence
  chemically synthesized
ttatgggagaaccacggtga

SEQ ID NO: 126806 - DNA, 20 bp, Artificial Sequence
  chemically synthesized
tgttatgggagaaccacggt

SEQ ID NO: 126807 - DNA, 20 bp, Artificial Sequence
  chemically synthesized
aaagtgttatgggagaacca

SEQ ID NO: 126808 - DNA, 20 bp, Artificial Sequence
  chemically synthesized
atcttaacaaagtgttatgg

SEQ ID NO: 126809 - DNA, 20 bp, Artificial Sequence
  chemically synthesized
aaatcttaacaaagtgttat

SEQ ID NO: 126810 - DNA, 20 bp, Artificial Sequence
  chemically synthesized
aaaatcttaacaaagtgtta

SEQ ID NO: 126811 - DNA, 20 bp, Artificial Sequence
  chemically synthesized
ttctcccataacactttgtt

SEQ ID NO: 126812 - DNA, 20 bp, Artificial Sequence
  chemically synthesized
caagttttaaaatcttaaca

SEQ ID NO: 126813 - DNA, 20 bp, Artificial Sequence
  chemically synthesized
atcatagtagcacacagtac

SEQ ID NO: 126814 - DNA, 20 bp, Artificial Sequence
  chemically synthesized
atgtaaatcatagtagcaca

SEQ ID NO: 126815 - DNA, 20 bp, Artificial Sequence
  chemically synthesized
tgtaaaaatgtaaatcatag

SEQ ID NO: 126816 - DNA, 20 bp, Artificial Sequence
  chemically synthesized
aaatgtaaaaatgtaaatca

SEQ ID NO: 126817 - DNA, 20 bp, Artificial Sequence
  chemically synthesized
acactgtctagagtcagaga

SEQ ID NO: 126818 - DNA, 20 bp, Artificial Sequence
  chemically synthesized
tacatttctgtctctgactc

SEQ ID NO: 126819 - DNA, 20 bp, Artificial Sequence
  chemically synthesized
aaggacactgtctagagtca

SEQ ID NO: 126820 - DNA, 20 bp, Artificial Sequence
  chemically synthesized
gcaaggacactgtctagagt

SEQ ID NO: 126821 - DNA, 20 bp, Artificial Sequence
  chemically synthesized
tttctgtctctgactctaga

SEQ ID NO: 126822 - DNA, 20 bp, Artificial Sequence
  chemically synthesized
tgaggcaaggacactgtcta

SEQ ID NO: 126823 - DNA, 20 bp, Artificial Sequence
  chemically synthesized
tttgaggcaaggacactgtc

SEQ ID NO: 126824 - DNA, 20 bp, Artificial Sequence
  chemically synthesized
tagacagtgtccttgcctca

SEQ ID NO: 126825 - DNA, 20 bp, Artificial Sequence
  chemically synthesized
ctgtccttgcctttgaggca

SEQ ID NO: 126826 - DNA, 20 bp, Artificial Sequence
  chemically synthesized
agacagtgtccttgcctcaa

SEQ ID NO: 126827 - DNA, 20 bp, Artificial Sequence
  chemically synthesized
tctgtccttgcctttgaggc

SEQ ID NO: 126828 - DNA, 20 bp, Artificial Sequence
  chemically synthesized
agtgtccttgcctcaaaggc

SEQ ID NO: 126829 - DNA, 20 bp, Artificial Sequence
  chemically synthesized
agattctgtccttgcctttg

SEQ ID NO: 126830 - DNA, 20 bp, Artificial Sequence
  chemically synthesized
gtgtccttgcctcaaaggca

SEQ ID NO: 126831 - DNA, 20 bp, Artificial Sequence
  chemically synthesized
cagattctgtccttgccttt

SEQ ID NO: 126832 - DNA, 20 bp, Artificial Sequence
  chemically synthesized
ccttgcctcaaaggcaagga

SEQ ID NO: 126833 - DNA, 20 bp, Artificial Sequence
  chemically synthesized
aaaggcaaggacagaatctg

SEQ ID NO: 126834 - DNA, 20 bp, Artificial Sequence
  chemically synthesized
ggcaaggacagaatctgtag

SEQ ID NO: 126835 - DNA, 20 bp, Artificial Sequence
  chemically synthesized
ggccctgacagcatcttcta

SEQ ID NO: 126836 - DNA, 20 bp, Artificial Sequence
  chemically synthesized
gaatctgtagaagatgctgt

SEQ ID NO: 126837 - DNA, 20 bp, Artificial Sequence
  chemically synthesized
aatctgtagaagatgctgtc

SEQ ID NO: 126838 - DNA, 20 bp, Artificial Sequence
  chemically synthesized
atctgtagaagatgctgtca

SEQ ID NO: 126839 - DNA, 20 bp, Artificial Sequence
  chemically synthesized
ggcagatagatgggccctga

SEQ ID NO: 126840 - DNA, 20 bp, Artificial Sequence
  chemically synthesized
agtgccaacggcagatagat

SEQ ID NO: 126841 - DNA, 20 bp, Artificial Sequence
  chemically synthesized
gagtgccaacggcagataga

SEQ ID NO: 126842 - DNA, 20 bp, Artificial Sequence
  chemically synthesized
ggatgagtgccaacggcaga

SEQ ID NO: 126843 - DNA, 20 bp, Artificial Sequence
  chemically synthesized
agggcccatctatctgccgt

SEQ ID NO: 126844 - DNA, 20 bp, Artificial Sequence
  chemically synthesized
tgaaggatgagtgccaacgg

SEQ ID NO: 126845 - DNA, 20 bp, Artificial Sequence
  chemically synthesized
acttgaaggatgagtgccaa

SEQ ID NO: 126846 - DNA, 20 bp, Artificial Sequence
  chemically synthesized
gccgttggcactcatccttc

SEQ ID NO: 126847 - DNA, 20 bp, Artificial Sequence
  chemically synthesized
ctggcatatacttgaaggat

SEQ ID NO: 126848 - DNA, 20 bp, Artificial Sequence
  chemically synthesized
cactgctggcatatacttga

SEQ ID NO: 126849 - DNA, 20 bp, Artificial Sequence
  chemically synthesized
acactgctggcatatacttg

SEQ ID NO: 126850 - DNA, 20 bp, Artificial Sequence
  chemically synthesized
ctcatccttcaagtatatgc

SEQ ID NO: 126851 - DNA, 20 bp, Artificial Sequence
  chemically synthesized
atccttcaagtatatgccag

SEQ ID NO: 126852 - DNA, 20 bp, Artificial Sequence
  chemically synthesized
tgcttgtactaggacactgc

SEQ ID NO: 126853 - DNA, 20 bp, Artificial Sequence
  chemically synthesized
agtatatgccagcagtgtcc

SEQ ID NO: 126854 - DNA, 20 bp, Artificial Sequence
  chemically synthesized
tgccagcagtgtcctagtac

SEQ ID NO: 126855 - DNA, 20 bp, Artificial Sequence
  chemically synthesized
gtagggcaaatgcttgtact

SEQ ID NO: 126856 - DNA, 20 bp, Artificial Sequence
  chemically synthesized
agtagggcaaatgcttgtac

SEQ ID NO: 126857 - DNA, 20 bp, Artificial Sequence
  chemically synthesized
aatctctcaggtttgcagta

SEQ ID NO: 126858 - DNA, 20 bp, Artificial Sequence
  chemically synthesized
aaatctctcaggtttgcagt

SEQ ID NO: 126859 - DNA, 20 bp, Artificial Sequence
  chemically synthesized
aaaatctctcaggtttgcag

SEQ ID NO: 126860 - DNA, 20 bp, Artificial Sequence
  chemically synthesized
atttgccctactgcaaacct

SEQ ID NO: 126861 - DNA, 20 bp, Artificial Sequence
  chemically synthesized
aggaaaatctctcaggtttg

SEQ ID NO: 126862 - DNA, 20 bp, Artificial Sequence
  chemically synthesized
ttgccctactgcaaacctga

SEQ ID NO: 126863 - DNA, 20 bp, Artificial Sequence
  chemically synthesized
caagctgaggaaaatctctc

SEQ ID NO: 126864 - DNA, 20 bp, Artificial Sequence
  chemically synthesized
gcaagctgaggaaaatctct

SEQ ID NO: 126865 - DNA, 20 bp, Artificial Sequence
  chemically synthesized
caaacctgagagattttcct

SEQ ID NO: 126866 - DNA, 20 bp, Artificial Sequence
  chemically synthesized
ccagcgcacctagcaagctg

SEQ ID NO: 126867 - DNA, 20 bp, Artificial Sequence
  chemically synthesized
agagattttcctcagcttgc

SEQ ID NO: 126868 - DNA, 20 bp, Artificial Sequence
  chemically synthesized
gccagcgcacctagcaagct

SEQ ID NO: 126869 - DNA, 20 bp, Artificial Sequence
  chemically synthesized
gagattttcctcagcttgct

SEQ ID NO: 126870 - DNA, 20 bp, Artificial Sequence
  chemically synthesized
ttctggccagcgcacctagc

SEQ ID NO: 126871 - DNA, 20 bp, Artificial Sequence
  chemically synthesized
cctcagcttgctaggtgcgc

SEQ ID NO: 126872 - DNA, 20 bp, Artificial Sequence
  chemically synthesized
gcacttctggccagcgcacc

SEQ ID NO: 126873 - DNA, 20 bp, Artificial Sequence
  chemically synthesized
agcttgctaggtgcgctggc

SEQ ID NO: 126874 - DNA, 20 bp, Artificial Sequence
  chemically synthesized
ttgctaggtgcgctggccag

SEQ ID NO: 126875 - DNA, 20 bp, Artificial Sequence
  chemically synthesized
aactttccagcacttctggc

SEQ ID NO: 126876 - DNA, 20 bp, Artificial Sequence
  chemically synthesized
ggtgcgctggccagaagtgc

SEQ ID NO: 126877 - DNA, 20 bp, Artificial Sequence
  chemically synthesized
cataaactttccagcacttc

SEQ ID NO: 126878 - DNA, 20 bp, Artificial Sequence
  chemically synthesized
cgctggccagaagtgctgga

SEQ ID NO: 126879 - DNA, 20 bp, Artificial Sequence
  chemically synthesized
ttcctggtacataaactttc

SEQ ID NO: 126880 - DNA, 20 bp, Artificial Sequence
  chemically synthesized
gtgctggaaagtttatgtac

SEQ ID NO: 126881 - DNA, 20 bp, Artificial Sequence
  chemically synthesized
tgctggaaagtttatgtacc

SEQ ID NO: 126882 - DNA, 20 bp, Artificial Sequence
  chemically synthesized
tggaaagtttatgtaccagg

SEQ ID NO: 126883 - DNA, 20 bp, Artificial Sequence
  chemically synthesized
atcattggctaaatgcttcc

SEQ ID NO: 126884 - DNA, 20 bp, Artificial Sequence
  chemically synthesized
tttatgtaccaggaagcatt

SEQ ID NO: 126885 - DNA, 20 bp, Artificial Sequence
  chemically synthesized
aggaagcatttagccaatga

SEQ ID NO: 126886 - DNA, 20 bp, Artificial Sequence
  chemically synthesized
ttccaactcttatccatcat

SEQ ID NO: 126887 - DNA, 20 bp, Artificial Sequence
  chemically synthesized
gcatttagccaatgatggat

SEQ ID NO: 126888 - DNA, 20 bp, Artificial Sequence
  chemically synthesized
atttagccaatgatggataa

SEQ ID NO: 126889 - DNA, 20 bp, Artificial Sequence
  chemically synthesized
agccaatgatggataagagt

SEQ ID NO: 126890 - DNA, 20 bp, Artificial Sequence
  chemically synthesized
atgatggataagagttggaa

SEQ ID NO: 126891 - DNA, 20 bp, Artificial Sequence
  chemically synthesized
tggataagagttggaatagt

SEQ ID NO: 126892 - DNA, 20 bp, Artificial Sequence
  chemically synthesized
agagttggaatagttagccc

SEQ ID NO: 126893 - DNA, 20 bp, Artificial Sequence
  chemically synthesized
ggggtaaaggcaaggaacca

SEQ ID NO: 126894 - DNA, 20 bp, Artificial Sequence
  chemically synthesized
gggggtaaaggcaaggaacc

SEQ ID NO: 126895 - DNA, 20 bp, Artificial Sequence
  chemically synthesized
agggggtaaaggcaaggaac

SEQ ID NO: 126896 - DNA, 20 bp, Artificial Sequence
  chemically synthesized
accacaagggggtaaaggca

SEQ ID NO: 126897 - DNA, 20 bp, Artificial Sequence
  chemically synthesized
aaccacaagggggtaaaggc

SEQ ID NO: 126898 - DNA, 20 bp, Artificial Sequence
  chemically synthesized
tgtcaaccacaagggggtaa

SEQ ID NO: 126899 - DNA, 20 bp, Artificial Sequence
  chemically synthesized
ttgtcaaccacaagggggta

SEQ ID NO: 126900 - DNA, 20 bp, Artificial Sequence
  chemically synthesized
tccttgcctttacccccttg

SEQ ID NO: 126901 - DNA, 20 bp, Artificial Sequence
  chemically synthesized
caaagttgtcaaccacaagg

SEQ ID NO: 126902 - DNA, 20 bp, Artificial Sequence
  chemically synthesized
tcaaagttgtcaaccacaag

SEQ ID NO: 126903 - DNA, 20 bp, Artificial Sequence
  chemically synthesized
ctcaaagttgtcaaccacaa

SEQ ID NO: 126904 - DNA, 20 bp, Artificial Sequence
  chemically synthesized
cctcaaagttgtcaaccaca

SEQ ID NO: 126905 - DNA, 20 bp, Artificial Sequence
  chemically synthesized
gcctcaaagttgtcaaccac

SEQ ID NO: 126906 - DNA, 20 bp, Artificial Sequence
  chemically synthesized
cccttgtggttgacaacttt

SEQ ID NO: 126907 - DNA, 20 bp, Artificial Sequence
  chemically synthesized
ccttgtggttgacaactttg

SEQ ID NO: 126908 - DNA, 20 bp, Artificial Sequence
  chemically synthesized
caaacaaaaaacatgcctca

SEQ ID NO: 126909 - DNA, 20 bp, Artificial Sequence
  chemically synthesized
tttgtttgtttactatctcc

SEQ ID NO: 126910 - DNA, 20 bp, Artificial Sequence
  chemically synthesized
tgtttgtttactatctccca

SEQ ID NO: 126911 - DNA, 20 bp, Artificial Sequence
  chemically synthesized
gatgaaggagctctgggaga

SEQ ID NO: 126912 - DNA, 20 bp, Artificial Sequence
  chemically synthesized
tcctgatgaaggagctctgg

SEQ ID NO: 126913 - DNA, 20 bp, Artificial Sequence
  chemically synthesized
gatcctgatgaaggagctct

SEQ ID NO: 126914 - DNA, 20 bp, Artificial Sequence
  chemically synthesized
tgatcctgatgaaggagctc

SEQ ID NO: 126915 - DNA, 20 bp, Artificial Sequence
  chemically synthesized
atctcccagagctccttcat

SEQ ID NO: 126916 - DNA, 20 bp, Artificial Sequence
  chemically synthesized
tctcccagagctccttcatc

SEQ ID NO: 126917 - DNA, 20 bp, Artificial Sequence
  chemically synthesized
ggggtttgatcctgatgaag

SEQ ID NO: 126918 - DNA, 20 bp, Artificial Sequence
  chemically synthesized
ctggggtttgatcctgatga

SEQ ID NO: 126919 - DNA, 20 bp, Artificial Sequence
  chemically synthesized
actggggtttgatcctgatg

SEQ ID NO: 126920 - DNA, 20 bp, Artificial Sequence
  chemically synthesized
ccttcatcaggatcaaaccc

SEQ ID NO: 126921 - DNA, 20 bp, Artificial Sequence
  chemically synthesized
tcatcaggatcaaaccccag

SEQ ID NO: 126922 - DNA, 20 bp, Artificial Sequence
  chemically synthesized
gttattgctttgggccactg

SEQ ID NO: 126923 - DNA, 20 bp, Artificial Sequence
  chemically synthesized
agttattgctttgggccact

SEQ ID NO: 126924 - DNA, 20 bp, Artificial Sequence
  chemically synthesized
tagttattgctttgggccac

SEQ ID NO: 126925 - DNA, 20 bp, Artificial Sequence
  chemically synthesized
gatcaaaccccagtggccca

SEQ ID NO: 126926 - DNA, 20 bp, Artificial Sequence
  chemically synthesized
atggaactagttattgcttt

SEQ ID NO: 126927 - DNA, 20 bp, Artificial Sequence
  chemically synthesized
tatggaactagttattgctt

SEQ ID NO: 126928 - DNA, 20 bp, Artificial Sequence
  chemically synthesized
cagtggcccaaagcaataac

SEQ ID NO: 126929 - DNA, 20 bp, Artificial Sequence
  chemically synthesized
aattaagccagttatggaac

SEQ ID NO: 126930 - DNA, 20 bp, Artificial Sequence
  chemically synthesized
gcaataactagttccataac

SEQ ID NO: 126931 - DNA, 20 bp, Artificial Sequence
  chemically synthesized
gccaataattaagccagtta

SEQ ID NO: 126932 - DNA, 20 bp, Artificial Sequence
  chemically synthesized
aaagaagccaataattaagc

SEQ ID NO: 126933 - DNA, 20 bp, Artificial Sequence
  chemically synthesized
tccataactggcttaattat

SEQ ID NO: 126934 - DNA, 20 bp, Artificial Sequence
  chemically synthesized
aatgaaagaagccaataatt

SEQ ID NO: 126935 - DNA, 20 bp, Artificial Sequence
  chemically synthesized
aatgagataataaatgaaag

SEQ ID NO: 126936 - DNA, 20 bp, Artificial Sequence
  chemically synthesized
gacaatgagataataaatga

SEQ ID NO: 126937 - DNA, 20 bp, Artificial Sequence
  chemically synthesized
cagtaggagagtgggacaat

SEQ ID NO: 126938 - DNA, 20 bp, Artificial Sequence
  chemically synthesized
ggaagtaccagtaggagagt

SEQ ID NO: 126939 - DNA, 20 bp, Artificial Sequence
  chemically synthesized
aggaagtaccagtaggagag

SEQ ID NO: 126940 - DNA, 20 bp, Artificial Sequence
  chemically synthesized
tcattgtcccactctcctac

SEQ ID NO: 126941 - DNA, 20 bp, Artificial Sequence
  chemically synthesized
cccaggaagtaccagtagga

SEQ ID NO: 126942 - DNA, 20 bp, Artificial Sequence
  chemically synthesized
atcccaggaagtaccagtag

SEQ ID NO: 126943 - DNA, 20 bp, Artificial Sequence
  chemically synthesized
tgatcccaggaagtaccagt

SEQ ID NO: 126944 - DNA, 20 bp, Artificial Sequence
  chemically synthesized
gtgatcccaggaagtaccag

SEQ ID NO: 126945 - DNA, 20 bp, Artificial Sequence
  chemically synthesized
aatgtgatcccaggaagtac

SEQ ID NO: 126946 - DNA, 20 bp, Artificial Sequence
  chemically synthesized
actctcctactggtacttcc

SEQ ID NO: 126947 - DNA, 20 bp, Artificial Sequence
  chemically synthesized
ctctcctactggtacttcct

SEQ ID NO: 126948 - DNA, 20 bp, Artificial Sequence
  chemically synthesized
ggttgtaatgtgatcccagg

SEQ ID NO: 126949 - DNA, 20 bp, Artificial Sequence
  chemically synthesized
tttggttgtaatgtgatccc

SEQ ID NO: 126950 - DNA, 20 bp, Artificial Sequence
  chemically synthesized
gtttggttgtaatgtgatcc

SEQ ID NO: 126951 - DNA, 20 bp, Artificial Sequence
  chemically synthesized
gattaatggtgaaagtggtt

SEQ ID NO: 126952 - DNA, 20 bp, Artificial Sequence
  chemically synthesized
acaatgattaatggtgaaag

SEQ ID NO: 126953 - DNA, 20 bp, Artificial Sequence
  chemically synthesized
taaacaatgattaatggtga

SEQ ID NO: 126954 - DNA, 20 bp, Artificial Sequence
  chemically synthesized
gacctttaaacaatgattaa

SEQ ID NO: 126955 - DNA, 20 bp, Artificial Sequence
  chemically synthesized
tcaccattaatcattgttta

SEQ ID NO: 126956 - DNA, 20 bp, Artificial Sequence
  chemically synthesized
caccattaatcattgtttaa

SEQ ID NO: 126957 - DNA, 20 bp, Artificial Sequence
  chemically synthesized
gtttaaaggtctgtttctga

SEQ ID NO: 126958 - DNA, 20 bp, Artificial Sequence
  chemically synthesized
aggctagcttctttcagaaa

SEQ ID NO: 126959 - DNA, 20 bp, Artificial Sequence
  chemically synthesized
taaaggtctgtttctgaaag

SEQ ID NO: 126960 - DNA, 20 bp, Artificial Sequence
  chemically synthesized
taacttaggctagcttcttt

SEQ ID NO: 126961 - DNA, 20 bp, Artificial Sequence
  chemically synthesized
ggtctgtttctgaaagaagc

SEQ ID NO: 126962 - DNA, 20 bp, Artificial Sequence
  chemically synthesized
tttctgaaagaagctagcct

SEQ ID NO: 126963 - DNA, 20 bp, Artificial Sequence
  chemically synthesized
gataaaatactaacttaggc

SEQ ID NO: 126964 - DNA, 20 bp, Artificial Sequence
  chemically synthesized
tgaaagaagctagcctaagt

SEQ ID NO: 126965 - DNA, 20 bp, Artificial Sequence
  chemically synthesized
aatggataaaatactaactt

SEQ ID NO: 126966 - DNA, 20 bp, Artificial Sequence
  chemically synthesized
aaatggataaaatactaact

SEQ ID NO: 126967 - DNA, 20 bp, Artificial Sequence
  chemically synthesized
cagagaaggatttttttaaa

SEQ ID NO: 126968 - DNA, 20 bp, Artificial Sequence
  chemically synthesized
catttaaaaaaatccttctc

SEQ ID NO: 126969 - DNA, 20 bp, Artificial Sequence
  chemically synthesized
ttcttccgctttgccagaga

SEQ ID NO: 126970 - DNA, 20 bp, Artificial Sequence
  chemically synthesized
cttcttccgctttgccagag

SEQ ID NO: 126971 - DNA, 20 bp, Artificial Sequence
  chemically synthesized
aaaaaaatccttctctggca

SEQ ID NO: 126972 - DNA, 20 bp, Artificial Sequence
  chemically synthesized
tagcttcttccgctttgcca

SEQ ID NO: 126973 - DNA, 20 bp, Artificial Sequence
  chemically synthesized
aaaatccttctctggcaaag

SEQ ID NO: 126974 - DNA, 20 bp, Artificial Sequence
  chemically synthesized
tctagcttcttccgctttgc

SEQ ID NO: 126975 - DNA, 20 bp, Artificial Sequence
  chemically synthesized
atccttctctggcaaagcgg

SEQ ID NO: 126976 - DNA, 20 bp, Artificial Sequence
  chemically synthesized
cttctctggcaaagcggaag

SEQ ID NO: 126977 - DNA, 20 bp, Artificial Sequence
  chemically synthesized
tctggcaaagcggaagaagc

SEQ ID NO: 126978 - DNA, 20 bp, Artificial Sequence
  chemically synthesized
tttactttatttttattttc

SEQ ID NO: 126979 - DNA, 20 bp, Artificial Sequence
  chemically synthesized
gaagctagaaaataaaaata

SEQ ID NO: 126980 - DNA, 20 bp, Artificial Sequence
  chemically synthesized
gaaaataaaaataaagtaaa

SEQ ID NO: 126981 - DNA, 20 bp, Artificial Sequence
  chemically synthesized
gtaaaaattaaaaacatcct

SEQ ID NO: 126982 - DNA, 20 bp, Artificial Sequence
  chemically synthesized
aaacactagtttgtgcacta

SEQ ID NO: 126983 - DNA, 20 bp, Artificial Sequence
  chemically synthesized
caaacactagtttgtgcact

SEQ ID NO: 126984 - DNA, 20 bp, Artificial Sequence
  chemically synthesized
aacatccttagtgcacaaac

SEQ ID NO: 126985 - DNA, 20 bp, Artificial Sequence
  chemically synthesized
ttagtgcacaaactagtgtt

SEQ ID NO: 126986 - DNA, 20 bp, Artificial Sequence
  chemically synthesized
gtattccaaatgccaaacac

SEQ ID NO: 126987 - DNA, 20 bp, Artificial Sequence
  chemically synthesized
acaaactagtgtttggcatt

SEQ ID NO: 126988 - DNA, 20 bp, Artificial Sequence
  chemically synthesized
atttgacagacatttattga

SEQ ID NO: 126989 - DNA, 20 bp, Artificial Sequence
  chemically synthesized
catttgacagacatttattg

SEQ ID NO: 126990 - DNA, 20 bp, Artificial Sequence
  chemically synthesized
tcaataaatgtctgtcaaat

SEQ ID NO: 126991 - DNA, 20 bp, Artificial Sequence
  chemically synthesized
tacatgtacaactcatttga

SEQ ID NO: 126992 - DNA, 20 bp, Artificial Sequence
  chemically synthesized
tgtcaaatgagttgtacatg

SEQ ID NO: 126993 - DNA, 20 bp, Artificial Sequence
  chemically synthesized
taaagagaaagtggggataa

SEQ ID NO: 126994 - DNA, 20 bp, Artificial Sequence
  chemically synthesized
atcattataaagagaaagtg

SEQ ID NO: 126995 - DNA, 20 bp, Artificial Sequence
  chemically synthesized
tatcattataaagagaaagt

SEQ ID NO: 126996 - DNA, 20 bp, Artificial Sequence
  chemically synthesized
atatcattataaagagaaag

SEQ ID NO: 126997 - DNA, 20 bp, Artificial Sequence
  chemically synthesized
tttatatcattataaagaga

SEQ ID NO: 126998 - DNA, 20 bp, Artificial Sequence
  chemically synthesized
catttttatatcattataaa

SEQ ID NO: 126999 - DNA, 20 bp, Artificial Sequence
  chemically synthesized
ggcatttttatatcattata

SEQ ID NO: 127000 - DNA, 20 bp, Artificial Sequence
  chemically synthesized
atataaaaatgccatttcta

SEQ ID NO: 127001 - DNA, 20 bp, Artificial Sequence
  chemically synthesized
gcaaaggttaactttagaaa

SEQ ID NO: 127002 - DNA, 20 bp, Artificial Sequence
  chemically synthesized
tgctgggcaaaggttaactt

SEQ ID NO: 127003 - DNA, 20 bp, Artificial Sequence
  chemically synthesized
ttctaaagttaacctttgcc

SEQ ID NO: 127004 - DNA, 20 bp, Artificial Sequence
  chemically synthesized
agactgaagatgctgggcaa

SEQ ID NO: 127005 - DNA, 20 bp, Artificial Sequence
  chemically synthesized
aagactgaagatgctgggca

SEQ ID NO: 127006 - DNA, 20 bp, Artificial Sequence
  chemically synthesized
gaagaaagactgaagatgct

SEQ ID NO: 127007 - DNA, 20 bp, Artificial Sequence
  chemically synthesized
taacctttgcccagcatctt

SEQ ID NO: 127008 - DNA, 20 bp, Artificial Sequence
  chemically synthesized
agaagaaagactgaagatgc

SEQ ID NO: 127009 - DNA, 20 bp, Artificial Sequence
  chemically synthesized
ttacttaagaagaaagactg

SEQ ID NO: 127010 - DNA, 20 bp, Artificial Sequence
  chemically synthesized
catcttcagtctttcttctt

SEQ ID NO: 127011 - DNA, 20 bp, Artificial Sequence
  chemically synthesized
atagtggttacttaagaaga

SEQ ID NO: 127012 - DNA, 20 bp, Artificial Sequence
  chemically synthesized
acaaatagtggttacttaag

SEQ ID NO: 127013 - DNA, 20 bp, Artificial Sequence
  chemically synthesized
caaacaaatagtggttactt

SEQ ID NO: 127014 - DNA, 20 bp, Artificial Sequence
  chemically synthesized
gaaatgcaacaaacaaatag

SEQ ID NO: 127015 - DNA, 20 bp, Artificial Sequence
  chemically synthesized
cttgaaatgcaacaaacaaa

SEQ ID NO: 127016 - DNA, 20 bp, Artificial Sequence
  chemically synthesized
ctatttgtttgttgcatttc

SEQ ID NO: 127017 - DNA, 20 bp, Artificial Sequence
  chemically synthesized
aagttttcataatttgaaaa

SEQ ID NO: 127018 - DNA, 20 bp, Artificial Sequence
  chemically synthesized
cataatttgaaaatggactc

SEQ ID NO: 127019 - DNA, 20 bp, Artificial Sequence
  chemically synthesized
gaaggaaatgggaaagtctt

SEQ ID NO: 127020 - DNA, 20 bp, Artificial Sequence
  chemically synthesized
aaataaggaaggaaatggga

SEQ ID NO: 127021 - DNA, 20 bp, Artificial Sequence
  chemically synthesized
aggaaaataaggaaggaaat

SEQ ID NO: 127022 - DNA, 20 bp, Artificial Sequence
  chemically synthesized
gaggaaaataaggaaggaaa

SEQ ID NO: 127023 - DNA, 20 bp, Artificial Sequence
  chemically synthesized
gcataagaggaaaataagga

SEQ ID NO: 127024 - DNA, 20 bp, Artificial Sequence
  chemically synthesized
agcataagaggaaaataagg

SEQ ID NO: 127025 - DNA, 20 bp, Artificial Sequence
  chemically synthesized
ataagcataagaggaaaata

SEQ ID NO: 127026 - DNA, 20 bp, Artificial Sequence
  chemically synthesized
cataagcataagaggaaaat

SEQ ID NO: 127027 - DNA, 20 bp, Artificial Sequence
  chemically synthesized
atcattagcataagcataag

SEQ ID NO: 127028 - DNA, 20 bp, Artificial Sequence
  chemically synthesized
gatcattagcataagcataa

SEQ ID NO: 127029 - DNA, 20 bp, Artificial Sequence
  chemically synthesized
gagatcattagcataagcat

SEQ ID NO: 127030 - DNA, 20 bp, Artificial Sequence
  chemically synthesized
ggaatagagatcattagcat

SEQ ID NO: 127031 - DNA, 20 bp, Artificial Sequence
  chemically synthesized
tcgcctggaatagagatcat

SEQ ID NO: 127032 - DNA, 20 bp, Artificial Sequence
  chemically synthesized
tatgctaatgatctctattc

SEQ ID NO: 127033 - DNA, 20 bp, Artificial Sequence
  chemically synthesized
atgctaatgatctctattcc

SEQ ID NO: 127034 - DNA, 20 bp, Artificial Sequence
  chemically synthesized
acatttgttcgcctggaata

SEQ ID NO: 127035 - DNA, 20 bp, Artificial Sequence
  chemically synthesized
ggacatttgttcgcctggaa

SEQ ID NO: 127036 - DNA, 20 bp, Artificial Sequence
  chemically synthesized
tcagaggacatttgttcgcc

SEQ ID NO: 127037 - DNA, 20 bp, Artificial Sequence
  chemically synthesized
aagaaacaaaggaaattcag

SEQ ID NO: 127038 - DNA, 20 bp, Artificial Sequence
  chemically synthesized
taagaaacaaaggaaattca

SEQ ID NO: 127039 - DNA, 20 bp, Artificial Sequence
  chemically synthesized
aataagaaacaaaggaaatt

SEQ ID NO: 127040 - DNA, 20 bp, Artificial Sequence
  chemically synthesized
aggcattaaataagaaacaa

SEQ ID NO: 127041 - DNA, 20 bp, Artificial Sequence
  chemically synthesized
aaggcattaaataagaaaca

SEQ ID NO: 127042 - DNA, 20 bp, Artificial Sequence
  chemically synthesized
ttgatacaaaggcattaaat

SEQ ID NO: 127043 - DNA, 20 bp, Artificial Sequence
  chemically synthesized
aatgaatgtggttgatacaa

SEQ ID NO: 127044 - DNA, 20 bp, Artificial Sequence
  chemically synthesized
aaatgaatgtggttgataca

SEQ ID NO: 127045 - DNA, 20 bp, Artificial Sequence
  chemically synthesized
atgttttatacaaatgaatg

SEQ ID NO: 127046 - DNA, 20 bp, Artificial Sequence
  chemically synthesized
tactagtaaacatgacatta

SEQ ID NO: 127047 - DNA, 20 bp, Artificial Sequence
  chemically synthesized
atctttaatgtcatgtttac

SEQ ID NO: 127048 - DNA, 20 bp, Artificial Sequence
  chemically synthesized
tttaatgtcatgtttactag

SEQ ID NO: 127049 - DNA, 20 bp, Artificial Sequence
  chemically synthesized
ataaggcacagatattctac

SEQ ID NO: 127050 - DNA, 20 bp, Artificial Sequence
  chemically synthesized
tatggattttatataaggca

SEQ ID NO: 127051 - DNA, 20 bp, Artificial Sequence
  chemically synthesized
taatttatggattttatata

SEQ ID NO: 127052 - DNA, 20 bp, Artificial Sequence
  chemically synthesized
ttaatttatggattttatat

SEQ ID NO: 127053 - DNA, 20 bp, Artificial Sequence
  chemically synthesized
ctcccatatcttttaattta

SEQ ID NO: 127054 - DNA, 20 bp, Artificial Sequence
  chemically synthesized
atataaaatccataaattaa

SEQ ID NO: 127055 - DNA, 20 bp, Artificial Sequence
  chemically synthesized
aatccataaattaaaagata

SEQ ID NO: 127056 - DNA, 20 bp, Artificial Sequence
  chemically synthesized
atccataaattaaaagatat

SEQ ID NO: 127057 - DNA, 20 bp, Artificial Sequence
  chemically synthesized
ccataaattaaaagatatgg

SEQ ID NO: 127058 - DNA, 20 bp, Artificial Sequence
  chemically synthesized
cataaattaaaagatatggg

SEQ ID NO: 127059 - DNA, 20 bp, Artificial Sequence
  chemically synthesized
ataaattaaaagatatggga

SEQ ID NO: 127060 - DNA, 20 bp, Artificial Sequence
  chemically synthesized
tatgggagggtcaaataatt

SEQ ID NO: 127061 - DNA, 20 bp, Artificial Sequence
  chemically synthesized
ggagggtcaaataattcagt

SEQ ID NO: 127062 - DNA, 20 bp, Artificial Sequence
  chemically synthesized
gagaggtcattgattagttt

SEQ ID NO: 127063 - DNA, 20 bp, Artificial Sequence
  chemically synthesized
gggaaagagaggtcattgat

SEQ ID NO: 127064 - DNA, 20 bp, Artificial Sequence
  chemically synthesized
taagaaagttagggaaagag

SEQ ID NO: 127065 - DNA, 20 bp, Artificial Sequence
  chemically synthesized
ttaagaaagttagggaaaga

SEQ ID NO: 127066 - DNA, 20 bp, Artificial Sequence
  chemically synthesized
ttttaagaaagttagggaaa

SEQ ID NO: 127067 - DNA, 20 bp, Artificial Sequence
  chemically synthesized
tattttaagaaagttaggga

SEQ ID NO: 127068 - DNA, 20 bp, Artificial Sequence
  chemically synthesized
tagttattttaagaaagtta

SEQ ID NO: 127069 - DNA, 20 bp, Artificial Sequence
  chemically synthesized
atagttattttaagaaagtt

SEQ ID NO: 127070 - DNA, 20 bp, Artificial Sequence
  chemically synthesized
tatagttattttaagaaagt

SEQ ID NO: 127071 - DNA, 20 bp, Artificial Sequence
  chemically synthesized
aacctatagttattttaaga

SEQ ID NO: 127072 - DNA, 20 bp, Artificial Sequence
  chemically synthesized
ctctaacctatagttatttt

SEQ ID NO: 127073 - DNA, 20 bp, Artificial Sequence
  chemically synthesized
taactttcttaaaataacta

SEQ ID NO: 127074 - DNA, 20 bp, Artificial Sequence
  chemically synthesized
aactttcttaaaataactat

SEQ ID NO: 127075 - DNA, 20 bp, Artificial Sequence
  chemically synthesized
ttcttaaaataactataggt

SEQ ID NO: 127076 - DNA, 20 bp, Artificial Sequence
  chemically synthesized
cttaaaataactataggtta

SEQ ID NO: 127077 - DNA, 20 bp, Artificial Sequence
  chemically synthesized
aacagattctctctaaccta

SEQ ID NO: 127078 - DNA, 20 bp, Artificial Sequence
  chemically synthesized
taaaataactataggttaga

SEQ ID NO: 127079 - DNA, 20 bp, Artificial Sequence
  chemically synthesized
ataggttagagagaatctgt

SEQ ID NO: 127080 - DNA, 20 bp, Artificial Sequence
  chemically synthesized
caggcaataggatatgccaa

SEQ ID NO: 127081 - DNA, 20 bp, Artificial Sequence
  chemically synthesized
agaagatagacacaggcaat

SEQ ID NO: 127082 - DNA, 20 bp, Artificial Sequence
  chemically synthesized
aagaagatagacacaggcaa

SEQ ID NO: 127083 - DNA, 20 bp, Artificial Sequence
  chemically synthesized
ttgattaagaagatagacac

SEQ ID NO: 127084 - DNA, 20 bp, Artificial Sequence
  chemically synthesized
tttgattaagaagatagaca

SEQ ID NO: 127085 - DNA, 20 bp, Artificial Sequence
  chemically synthesized
ctgtaatttgattaagaaga

SEQ ID NO: 127086 - DNA, 20 bp, Artificial Sequence
  chemically synthesized
ttatctgtaatttgattaag

SEQ ID NO: 127087 - DNA, 20 bp, Artificial Sequence
  chemically synthesized
tatttatctgtaatttgatt

SEQ ID NO: 127088 - DNA, 20 bp, Artificial Sequence
  chemically synthesized
ctatcttcttaatcaaatta

SEQ ID NO: 127089 - DNA, 20 bp, Artificial Sequence
  chemically synthesized
caaattacagataaataatt

SEQ ID NO: 127090 - DNA, 20 bp, Artificial Sequence
  chemically synthesized
cactggcttcaatatataga

SEQ ID NO: 127091 - DNA, 20 bp, Artificial Sequence
  chemically synthesized
ccactggcttcaatatatag

SEQ ID NO: 127092 - DNA, 20 bp, Artificial Sequence
  chemically synthesized
tccactggcttcaatatata

SEQ ID NO: 127093 - DNA, 20 bp, Artificial Sequence
  chemically synthesized
aaacgtccctctatatattg

SEQ ID NO: 127094 - DNA, 20 bp, Artificial Sequence
  chemically synthesized
aatccactggcttcaatata

SEQ ID NO: 127095 - DNA, 20 bp, Artificial Sequence
  chemically synthesized
gtccctctatatattgaagc

SEQ ID NO: 127096 - DNA, 20 bp, Artificial Sequence
  chemically synthesized
cctctatatattgaagccag

SEQ ID NO: 127097 - DNA, 20 bp, Artificial Sequence
  chemically synthesized
atatattgaagccagtggat

SEQ ID NO: 127098 - DNA, 20 bp, Artificial Sequence
  chemically synthesized
tatattgaagccagtggatt

SEQ ID NO: 127099 - DNA, 20 bp, Artificial Sequence
  chemically synthesized
tgtgggagaccctaatccac

SEQ ID NO: 127100 - DNA, 20 bp, Artificial Sequence
  chemically synthesized
atattgaagccagtggatta

SEQ ID NO: 127101 - DNA, 20 bp, Artificial Sequence
  chemically synthesized
tgtctccctaggtcatgtgg

SEQ ID NO: 127102 - DNA, 20 bp, Artificial Sequence
  chemically synthesized
ggtgtctccctaggtcatgt

SEQ ID NO: 127103 - DNA, 20 bp, Artificial Sequence
  chemically synthesized
ttagggtctcccacatgacc

SEQ ID NO: 127104 - DNA, 20 bp, Artificial Sequence
  chemically synthesized
tggtgtctccctaggtcatg

SEQ ID NO: 127105 - DNA, 20 bp, Artificial Sequence
  chemically synthesized
tagggtctcccacatgacct

SEQ ID NO: 127106 - DNA, 20 bp, Artificial Sequence
  chemically synthesized
agggtctcccacatgaccta

SEQ ID NO: 127107 - DNA, 20 bp, Artificial Sequence
  chemically synthesized
ggtctcccacatgacctagg

SEQ ID NO: 127108 - DNA, 20 bp, Artificial Sequence
  chemically synthesized
atgccagctggtgtctccct

SEQ ID NO: 127109 - DNA, 20 bp, Artificial Sequence
  chemically synthesized
catgccagctggtgtctccc

SEQ ID NO: 127110 - DNA, 20 bp, Artificial Sequence
  chemically synthesized
cacatgacctagggagacac

SEQ ID NO: 127111 - DNA, 20 bp, Artificial Sequence
  chemically synthesized
tgacctagggagacaccagc

SEQ ID NO: 127112 - DNA, 20 bp, Artificial Sequence
  chemically synthesized
tagggagacaccagctggca

SEQ ID NO: 127113 - DNA, 20 bp, Artificial Sequence
  chemically synthesized
actcccttagccatgccagc

SEQ ID NO: 127114 - DNA, 20 bp, Artificial Sequence
  chemically synthesized
aaccactcccttagccatgc

SEQ ID NO: 127115 - DNA, 20 bp, Artificial Sequence
  chemically synthesized
agacaccagctggcatggct

SEQ ID NO: 127116 - DNA, 20 bp, Artificial Sequence
  chemically synthesized
gacaccagctggcatggcta

SEQ ID NO: 127117 - DNA, 20 bp, Artificial Sequence
  chemically synthesized
acaccagctggcatggctaa

SEQ ID NO: 127118 - DNA, 20 bp, Artificial Sequence
  chemically synthesized
accagctggcatggctaagg

SEQ ID NO: 127119 - DNA, 20 bp, Artificial Sequence
  chemically synthesized
agctggcatggctaagggag

SEQ ID NO: 127120 - DNA, 20 bp, Artificial Sequence
  chemically synthesized
gtatggtgcaaccactccct

SEQ ID NO: 127121 - DNA, 20 bp, Artificial Sequence
  chemically synthesized
tgctgggagtaggggaggta

SEQ ID NO: 127122 - DNA, 20 bp, Artificial Sequence
  chemically synthesized
ttcactgctgggagtagggg

SEQ ID NO: 127123 - DNA, 20 bp, Artificial Sequence
  chemically synthesized
cttcactgctgggagtaggg

SEQ ID NO: 127124 - DNA, 20 bp, Artificial Sequence
  chemically synthesized
caccatacctcccctactcc

SEQ ID NO: 127125 - DNA, 20 bp, Artificial Sequence
  chemically synthesized
agcttcactgctgggagtag

SEQ ID NO: 127126 - DNA, 20 bp, Artificial Sequence
  chemically synthesized
aagcttcactgctgggagta

SEQ ID NO: 127127 - DNA, 20 bp, Artificial Sequence
  chemically synthesized
caagcttcactgctgggagt

SEQ ID NO: 127128 - DNA, 20 bp, Artificial Sequence
  chemically synthesized
catacctcccctactcccag

SEQ ID NO: 127129 - DNA, 20 bp, Artificial Sequence
  chemically synthesized
gcaagcttcactgctgggag

SEQ ID NO: 127130 - DNA, 20 bp, Artificial Sequence
  chemically synthesized
gctgcaagcttcactgctgg

SEQ ID NO: 127131 - DNA, 20 bp, Artificial Sequence
  chemically synthesized
ctcccctactcccagcagtg

SEQ ID NO: 127132 - DNA, 20 bp, Artificial Sequence
  chemically synthesized
ttgctgcaagcttcactgct

SEQ ID NO: 127133 - DNA, 20 bp, Artificial Sequence
  chemically synthesized
gttgctgcaagcttcactgc

SEQ ID NO: 127134 - DNA, 20 bp, Artificial Sequence
  chemically synthesized
actcccagcagtgaagcttg

SEQ ID NO: 127135 - DNA, 20 bp, Artificial Sequence
  chemically synthesized
agcagtgaagcttgcagcaa

SEQ ID NO: 127136 - DNA, 20 bp, Artificial Sequence
  chemically synthesized
ggagtcacttctgttgctgc

SEQ ID NO: 127137 - DNA, 20 bp, Artificial Sequence
  chemically synthesized
agtgaagcttgcagcaacag

SEQ ID NO: 127138 - DNA, 20 bp, Artificial Sequence
  chemically synthesized
tctccttaacgagaagtaag

SEQ ID NO: 127139 - DNA, 20 bp, Artificial Sequence
  chemically synthesized
cttctccttaacgagaagta

SEQ ID NO: 127140 - DNA, 20 bp, Artificial Sequence
  chemically synthesized
tcttctccttaacgagaagt

SEQ ID NO: 127141 - DNA, 20 bp, Artificial Sequence
  chemically synthesized
gtgactccttacttctcgtt

SEQ ID NO: 127142 - DNA, 20 bp, Artificial Sequence
  chemically synthesized
tgactccttacttctcgtta

SEQ ID NO: 127143 - DNA, 20 bp, Artificial Sequence
  chemically synthesized
gctctcttctccttaacgag

SEQ ID NO: 127144 - DNA, 20 bp, Artificial Sequence
  chemically synthesized
actccttacttctcgttaag

SEQ ID NO: 127145 - DNA, 20 bp, Artificial Sequence
  chemically synthesized
ttcgctctcttctccttaac

SEQ ID NO: 127146 - DNA, 20 bp, Artificial Sequence
  chemically synthesized
ccttacttctcgttaaggag

SEQ ID NO: 127147 - DNA, 20 bp, Artificial Sequence
  chemically synthesized
ttacttctcgttaaggagaa

SEQ ID NO: 127148 - DNA, 20 bp, Artificial Sequence
  chemically synthesized
acttctcgttaaggagaaga

SEQ ID NO: 127149 - DNA, 20 bp, Artificial Sequence
  chemically synthesized
gttaaggagaagagagcgaa

SEQ ID NO: 127150 - DNA, 20 bp, Artificial Sequence
  chemically synthesized
ggagaagagagcgaaaagta

SEQ ID NO: 127151 - DNA, 20 bp, Artificial Sequence
  chemically synthesized
gaagagagcgaaaagtaaag

SEQ ID NO: 127152 - DNA, 20 bp, Artificial Sequence
  chemically synthesized
ggtatccaagatgcaagaca

SEQ ID NO: 127153 - DNA, 20 bp, Artificial Sequence
  chemically synthesized
gaagactttgtcttgcatct

SEQ ID NO: 127154 - DNA, 20 bp, Artificial Sequence
  chemically synthesized
tgagctggtatccaagatgc

SEQ ID NO: 127155 - DNA, 20 bp, Artificial Sequence
  chemically synthesized
ttgtcttgcatcttggatac

SEQ ID NO: 127156 - DNA, 20 bp, Artificial Sequence
  chemically synthesized
ctgtggctgagctggtatcc

SEQ ID NO: 127157 - DNA, 20 bp, Artificial Sequence
  chemically synthesized
ttgcatcttggataccagct

SEQ ID NO: 127158 - DNA, 20 bp, Artificial Sequence
  chemically synthesized
ccatcctactgtggctgagc

SEQ ID NO: 127159 - DNA, 20 bp, Artificial Sequence
  chemically synthesized
cttggataccagctcagcca

SEQ ID NO: 127160 - DNA, 20 bp, Artificial Sequence
  chemically synthesized
tgccccatcctactgtggct

SEQ ID NO: 127161 - DNA, 20 bp, Artificial Sequence
  chemically synthesized
ggataccagctcagccacag

SEQ ID NO: 127162 - DNA, 20 bp, Artificial Sequence
  chemically synthesized
gataccagctcagccacagt

SEQ ID NO: 127163 - DNA, 20 bp, Artificial Sequence
  chemically synthesized
gcccatgccccatcctactg

SEQ ID NO: 127164 - DNA, 20 bp, Artificial Sequence
  chemically synthesized
ccagctcagccacagtagga

SEQ ID NO: 127165 - DNA, 20 bp, Artificial Sequence
  chemically synthesized
cagctcagccacagtaggat

SEQ ID NO: 127166 - DNA, 20 bp, Artificial Sequence
  chemically synthesized
agctcagccacagtaggatg

SEQ ID NO: 127167 - DNA, 20 bp, Artificial Sequence
  chemically synthesized
agccacagtaggatggggca

SEQ ID NO: 127168 - DNA, 20 bp, Artificial Sequence
  chemically synthesized
gccacagtaggatggggcat

SEQ ID NO: 127169 - DNA, 20 bp, Artificial Sequence
  chemically synthesized
acagtaggatggggcatggg

SEQ ID NO: 127170 - DNA, 20 bp, Artificial Sequence
  chemically synthesized
agtaggatggggcatgggca

SEQ ID NO: 127171 - DNA, 20 bp, Artificial Sequence
  chemically synthesized
tggggcatgggcagagtcat

SEQ ID NO: 127172 - DNA, 20 bp, Artificial Sequence
  chemically synthesized
ggggcatgggcagagtcatg

SEQ ID NO: 127173 - DNA, 20 bp, Artificial Sequence
  chemically synthesized
gagtcatgaggcccccattc

SEQ ID NO: 127174 - DNA, 20 bp, Artificial Sequence
  chemically synthesized
agtcatgaggcccccattcc

SEQ ID NO: 127175 - DNA, 20 bp, Artificial Sequence
  chemically synthesized
ggaactagggcctggaatgg

SEQ ID NO: 127176 - DNA, 20 bp, Artificial Sequence
  chemically synthesized
aggaactagggcctggaatg

SEQ ID NO: 127177 - DNA, 20 bp, Artificial Sequence
  chemically synthesized
caggaactagggcctggaat

SEQ ID NO: 127178 - DNA, 20 bp, Artificial Sequence
  chemically synthesized
ccaggaactagggcctggaa

SEQ ID NO: 127179 - DNA, 20 bp, Artificial Sequence
  chemically synthesized
gaggcccccattccaggccc

SEQ ID NO: 127180 - DNA, 20 bp, Artificial Sequence
  chemically synthesized
gctatccaggaactagggcc

SEQ ID NO: 127181 - DNA, 20 bp, Artificial Sequence
  chemically synthesized
ccattccaggccctagttcc

SEQ ID NO: 127182 - DNA, 20 bp, Artificial Sequence
  chemically synthesized
gaaatgctatccaggaacta

SEQ ID NO: 127183 - DNA, 20 bp, Artificial Sequence
  chemically synthesized
agaaatgctatccaggaact

SEQ ID NO: 127184 - DNA, 20 bp, Artificial Sequence
  chemically synthesized
tagaaatgctatccaggaac

SEQ ID NO: 127185 - DNA, 20 bp, Artificial Sequence
  chemically synthesized
tccaggccctagttcctgga

SEQ ID NO: 127186 - DNA, 20 bp, Artificial Sequence
  chemically synthesized
tgtgtctagaaatgctatcc

SEQ ID NO: 127187 - DNA, 20 bp, Artificial Sequence
  chemically synthesized
gtgtgtctagaaatgctatc

SEQ ID NO: 127188 - DNA, 20 bp, Artificial Sequence
  chemically synthesized
tagttcctggatagcatttc

SEQ ID NO: 127189 - DNA, 20 bp, Artificial Sequence
  chemically synthesized
cttttggcccagggtgtgtc

SEQ ID NO: 127190 - DNA, 20 bp, Artificial Sequence
  chemically synthesized
tagcatttctagacacaccc

SEQ ID NO: 127191 - DNA, 20 bp, Artificial Sequence
  chemically synthesized
agcatttctagacacaccct

SEQ ID NO: 127192 - DNA, 20 bp, Artificial Sequence
  chemically synthesized
gcagattcccttttggccca

SEQ ID NO: 127193 - DNA, 20 bp, Artificial Sequence
  chemically synthesized
ctagacacaccctgggccaa

SEQ ID NO: 127194 - DNA, 20 bp, Artificial Sequence
  chemically synthesized
agcagattcccttttggccc

SEQ ID NO: 127195 - DNA, 20 bp, Artificial Sequence
  chemically synthesized
tagacacaccctgggccaaa

SEQ ID NO: 127196 - DNA, 20 bp, Artificial Sequence
  chemically synthesized
tagcagattcccttttggcc

SEQ ID NO: 127197 - DNA, 20 bp, Artificial Sequence
  chemically synthesized
agacacaccctgggccaaaa

SEQ ID NO: 127198 - DNA, 20 bp, Artificial Sequence
  chemically synthesized
taaggtagcagattcccttt

SEQ ID NO: 127199 - DNA, 20 bp, Artificial Sequence
  chemically synthesized
agtccttccctttaaggtag

SEQ ID NO: 127200 - DNA, 20 bp, Artificial Sequence
  chemically synthesized
aaagggaatctgctacctta

SEQ ID NO: 127201 - DNA, 20 bp, Artificial Sequence
  chemically synthesized
aagggaatctgctaccttaa

SEQ ID NO: 127202 - DNA, 20 bp, Artificial Sequence
  chemically synthesized
agggaatctgctaccttaaa

SEQ ID NO: 127203 - DNA, 20 bp, Artificial Sequence
  chemically synthesized
ctgagtccttccctttaagg

SEQ ID NO: 127204 - DNA, 20 bp, Artificial Sequence
  chemically synthesized
gaatctgctaccttaaaggg

SEQ ID NO: 127205 - DNA, 20 bp, Artificial Sequence
  chemically synthesized
ggactgagtccttcccttta

SEQ ID NO: 127206 - DNA, 20 bp, Artificial Sequence
  chemically synthesized
aatctgctaccttaaaggga

SEQ ID NO: 127207 - DNA, 20 bp, Artificial Sequence
  chemically synthesized
aggactgagtccttcccttt

SEQ ID NO: 127208 - DNA, 20 bp, Artificial Sequence
  chemically synthesized
ctaccttaaagggaaggact

SEQ ID NO: 127209 - DNA, 20 bp, Artificial Sequence
  chemically synthesized
tgatgaatcctgataggact

SEQ ID NO: 127210 - DNA, 20 bp, Artificial Sequence
  chemically synthesized
agggaaggactcagtcctat

SEQ ID NO: 127211 - DNA, 20 bp, Artificial Sequence
  chemically synthesized
gggaaggactcagtcctatc

SEQ ID NO: 127212 - DNA, 20 bp, Artificial Sequence
  chemically synthesized
agtagctgatgaatcctgat

SEQ ID NO: 127213 - DNA, 20 bp, Artificial Sequence
  chemically synthesized
tagtagctgatgaatcctga

SEQ ID NO: 127214 - DNA, 20 bp, Artificial Sequence
  chemically synthesized
tcagtcctatcaggattcat

SEQ ID NO: 127215 - DNA, 20 bp, Artificial Sequence
  chemically synthesized
gattcatcagctactaacta

SEQ ID NO: 127216 - DNA, 20 bp, Artificial Sequence
  chemically synthesized
ttcaaggcctctttagttag

SEQ ID NO: 127217 - DNA, 20 bp, Artificial Sequence
  chemically synthesized
ttcatcagctactaactaaa

SEQ ID NO: 127218 - DNA, 20 bp, Artificial Sequence
  chemically synthesized
tcatcagctactaactaaag

SEQ ID NO: 127219 - DNA, 20 bp, Artificial Sequence
  chemically synthesized
acgttcaaggcctctttagt

SEQ ID NO: 127220 - DNA, 20 bp, Artificial Sequence
  chemically synthesized
ttcaacgttcaaggcctctt

SEQ ID NO: 127221 - DNA, 20 bp, Artificial Sequence
  chemically synthesized
aactggttattcaacgttca

SEQ ID NO: 127222 - DNA, 20 bp, Artificial Sequence
  chemically synthesized
caactggttattcaacgttc

SEQ ID NO: 127223 - DNA, 20 bp, Artificial Sequence
  chemically synthesized
ggccttgaacgttgaataac

SEQ ID NO: 127224 - DNA, 20 bp, Artificial Sequence
  chemically synthesized
tactccctgggtattgcaac

SEQ ID NO: 127225 - DNA, 20 bp, Artificial Sequence
  chemically synthesized
gaataaccagttgcaatacc

SEQ ID NO: 127226 - DNA, 20 bp, Artificial Sequence
  chemically synthesized
aataaccagttgcaataccc

SEQ ID NO: 127227 - DNA, 20 bp, Artificial Sequence
  chemically synthesized
ataaccagttgcaataccca

SEQ ID NO: 127228 - DNA, 20 bp, Artificial Sequence
  chemically synthesized
aaccagttgcaatacccagg

SEQ ID NO: 127229 - DNA, 20 bp, Artificial Sequence
  chemically synthesized
agtcccacagtgtactccct

SEQ ID NO: 127230 - DNA, 20 bp, Artificial Sequence
  chemically synthesized
aagtcccacagtgtactccc

SEQ ID NO: 127231 - DNA, 20 bp, Artificial Sequence
  chemically synthesized
aatacccagggagtacactg

SEQ ID NO: 127232 - DNA, 20 bp, Artificial Sequence
  chemically synthesized
atacccagggagtacactgt

SEQ ID NO: 127233 - DNA, 20 bp, Artificial Sequence
  chemically synthesized
agggagtacactgtgggact

SEQ ID NO: 127234 - DNA, 20 bp, Artificial Sequence
  chemically synthesized
atctcagaggccaagtccca

SEQ ID NO: 127235 - DNA, 20 bp, Artificial Sequence
  chemically synthesized
cactgtgggacttggcctct

SEQ ID NO: 127236 - DNA, 20 bp, Artificial Sequence
  chemically synthesized
gccagcacatctcagaggcc

SEQ ID NO: 127237 - DNA, 20 bp, Artificial Sequence
  chemically synthesized
atgaagccagcacatctcag

SEQ ID NO: 127238 - DNA, 20 bp, Artificial Sequence
  chemically synthesized
tatgaagccagcacatctca

SEQ ID NO: 127239 - DNA, 20 bp, Artificial Sequence
  chemically synthesized
cctatgaagccagcacatct

SEQ ID NO: 127240 - DNA, 20 bp, Artificial Sequence
  chemically synthesized
acttggcctctgagatgtgc

SEQ ID NO: 127241 - DNA, 20 bp, Artificial Sequence
  chemically synthesized
tctgagatgtgctggcttca

SEQ ID NO: 127242 - DNA, 20 bp, Artificial Sequence
  chemically synthesized
ctgagatgtgctggcttcat

SEQ ID NO: 127243 - DNA, 20 bp, Artificial Sequence
  chemically synthesized
tgctgggtgacctatgaagc

SEQ ID NO: 127244 - DNA, 20 bp, Artificial Sequence
  chemically synthesized
aatttgctgggtgacctatg

SEQ ID NO: 127245 - DNA, 20 bp, Artificial Sequence
  chemically synthesized
tgctggcttcataggtcacc

SEQ ID NO: 127246 - DNA, 20 bp, Artificial Sequence
  chemically synthesized
accacagctgggaatttgct

SEQ ID NO: 127247 - DNA, 20 bp, Artificial Sequence
  chemically synthesized
caccacagctgggaatttgc

SEQ ID NO: 127248 - DNA, 20 bp, Artificial Sequence
  chemically synthesized
taggtcacccagcaaattcc

SEQ ID NO: 127249 - DNA, 20 bp, Artificial Sequence
  chemically synthesized
acccagcaaattcccagctg

SEQ ID NO: 127250 - DNA, 20 bp, Artificial Sequence
  chemically synthesized
tcaccataaccaccacagct

SEQ ID NO: 127251 - DNA, 20 bp, Artificial Sequence
  chemically synthesized
cagcaaattcccagctgtgg

SEQ ID NO: 127252 - DNA, 20 bp, Artificial Sequence
  chemically synthesized
ttcaccataaccaccacagc

SEQ ID NO: 127253 - DNA, 20 bp, Artificial Sequence
  chemically synthesized
gtctttcaccataaccacca

SEQ ID NO: 127254 - DNA, 20 bp, Artificial Sequence
  chemically synthesized
attcccagctgtggtggtta

SEQ ID NO: 127255 - DNA, 20 bp, Artificial Sequence
  chemically synthesized
agctgtggtggttatggtga

SEQ ID NO: 127256 - DNA, 20 bp, Artificial Sequence
  chemically synthesized
ctacttttctcaaacagaag

SEQ ID NO: 127257 - DNA, 20 bp, Artificial Sequence
  chemically synthesized
tctacttttctcaaacagaa

SEQ ID NO: 127258 - DNA, 20 bp, Artificial Sequence
  chemically synthesized
gtgaaagaccccttctgttt

SEQ ID NO: 127259 - DNA, 20 bp, Artificial Sequence
  chemically synthesized
gtctacttttctcaaacaga

SEQ ID NO: 127260 - DNA, 20 bp, Artificial Sequence
  chemically synthesized
tgtctacttttctcaaacag

SEQ ID NO: 127261 - DNA, 20 bp, Artificial Sequence
  chemically synthesized
ttctgtctacttttctcaaa

SEQ ID NO: 127262 - DNA, 20 bp, Artificial Sequence
  chemically synthesized
agaccccttctgtttgagaa

SEQ ID NO: 127263 - DNA, 20 bp, Artificial Sequence
  chemically synthesized
ccccttctgtttgagaaaag

SEQ ID NO: 127264 - DNA, 20 bp, Artificial Sequence
  chemically synthesized
ttctgtttgagaaaagtaga

SEQ ID NO: 127265 - DNA, 20 bp, Artificial Sequence
  chemically synthesized
tttgagaaaagtagacagaa

SEQ ID NO: 127266 - DNA, 20 bp, Artificial Sequence
  chemically synthesized
gaaaagtagacagaaaagta

SEQ ID NO: 127267 - DNA, 20 bp, Artificial Sequence
  chemically synthesized
aaaagtagacagaaaagtaa

SEQ ID NO: 127268 - DNA, 20 bp, Artificial Sequence
  chemically synthesized
aaagtagacagaaaagtaaa

SEQ ID NO: 127269 - DNA, 20 bp, Artificial Sequence
  chemically synthesized
aagtagacagaaaagtaaag

SEQ ID NO: 127270 - DNA, 20 bp, Artificial Sequence
  chemically synthesized
ggtacctaaggggcaagaca

SEQ ID NO: 127271 - DNA, 20 bp, Artificial Sequence
  chemically synthesized
ggggactttgtcttgcccct

SEQ ID NO: 127272 - DNA, 20 bp, Artificial Sequence
  chemically synthesized
gggactttgtcttgcccctt

SEQ ID NO: 127273 - DNA, 20 bp, Artificial Sequence
  chemically synthesized
tgagctggtacctaaggggc

SEQ ID NO: 127274 - DNA, 20 bp, Artificial Sequence
  chemically synthesized
tggctgagctggtacctaag

SEQ ID NO: 127275 - DNA, 20 bp, Artificial Sequence
  chemically synthesized
gtggctgagctggtacctaa

SEQ ID NO: 127276 - DNA, 20 bp, Artificial Sequence
  chemically synthesized
ttgtcttgccccttaggtac

SEQ ID NO: 127277 - DNA, 20 bp, Artificial Sequence
  chemically synthesized
tgtggctgagctggtaccta

SEQ ID NO: 127278 - DNA, 20 bp, Artificial Sequence
  chemically synthesized
ctgtggctgagctggtacct

SEQ ID NO: 127279 - DNA, 20 bp, Artificial Sequence
  chemically synthesized
ttgccccttaggtaccagct

SEQ ID NO: 127280 - DNA, 20 bp, Artificial Sequence
  chemically synthesized
ctgcctttctgtggctgagc

SEQ ID NO: 127281 - DNA, 20 bp, Artificial Sequence
  chemically synthesized
cttaggtaccagctcagcca

SEQ ID NO: 127282 - DNA, 20 bp, Artificial Sequence
  chemically synthesized
ttctctgcctttctgtggct

SEQ ID NO: 127283 - DNA, 20 bp, Artificial Sequence
  chemically synthesized
ggtaccagctcagccacaga

SEQ ID NO: 127284 - DNA, 20 bp, Artificial Sequence
  chemically synthesized
gtaccagctcagccacagaa

SEQ ID NO: 127285 - DNA, 20 bp, Artificial Sequence
  chemically synthesized
cctgcttctctgcctttctg

SEQ ID NO: 127286 - DNA, 20 bp, Artificial Sequence
  chemically synthesized
ccagctcagccacagaaagg

SEQ ID NO: 127287 - DNA, 20 bp, Artificial Sequence
  chemically synthesized
agctcagccacagaaaggca

SEQ ID NO: 127288 - DNA, 20 bp, Artificial Sequence
  chemically synthesized
tcagccacagaaaggcagag

SEQ ID NO: 127289 - DNA, 20 bp, Artificial Sequence
  chemically synthesized
gccacagaaaggcagagaag

SEQ ID NO: 127290 - DNA, 20 bp, Artificial Sequence
  chemically synthesized
ccacagaaaggcagagaagc

SEQ ID NO: 127291 - DNA, 20 bp, Artificial Sequence
  chemically synthesized
cagaaaggcagagaagcagg

SEQ ID NO: 127292 - DNA, 20 bp, Artificial Sequence
  chemically synthesized
agaaaggcagagaagcaggc

SEQ ID NO: 127293 - DNA, 20 bp, Artificial Sequence
  chemically synthesized
cagagaagcaggcaggcttc

SEQ ID NO: 127294 - DNA, 20 bp, Artificial Sequence
  chemically synthesized
agagaagcaggcaggcttct

SEQ ID NO: 127295 - DNA, 20 bp, Artificial Sequence
  chemically synthesized
ccaggactcagaaatcccag

SEQ ID NO: 127296 - DNA, 20 bp, Artificial Sequence
  chemically synthesized
aggccaggactcagaaatcc

SEQ ID NO: 127297 - DNA, 20 bp, Artificial Sequence
  chemically synthesized
ggcaggcttctgggatttct

SEQ ID NO: 127298 - DNA, 20 bp, Artificial Sequence
  chemically synthesized
cttctgggatttctgagtcc

SEQ ID NO: 127299 - DNA, 20 bp, Artificial Sequence
  chemically synthesized
caagaacctaggccaggact

SEQ ID NO: 127300 - DNA, 20 bp, Artificial Sequence
  chemically synthesized
gggatttctgagtcctggcc

SEQ ID NO: 127301 - DNA, 20 bp, Artificial Sequence
  chemically synthesized
ggatttctgagtcctggcct

SEQ ID NO: 127302 - DNA, 20 bp, Artificial Sequence
  chemically synthesized
gctgtccaagaacctaggcc

SEQ ID NO: 127303 - DNA, 20 bp, Artificial Sequence
  chemically synthesized
tgctgtccaagaacctaggc

SEQ ID NO: 127304 - DNA, 20 bp, Artificial Sequence
  chemically synthesized
tgagtcctggcctaggttct

SEQ ID NO: 127305 - DNA, 20 bp, Artificial Sequence
  chemically synthesized
aaaatgctgtccaagaacct

SEQ ID NO: 127306 - DNA, 20 bp, Artificial Sequence
  chemically synthesized
aaaaatgctgtccaagaacc

SEQ ID NO: 127307 - DNA, 20 bp, Artificial Sequence
  chemically synthesized
tcctggcctaggttcttgga

SEQ ID NO: 127308 - DNA, 20 bp, Artificial Sequence
  chemically synthesized
caggaccaaaaatgctgtcc

SEQ ID NO: 127309 - DNA, 20 bp, Artificial Sequence
  chemically synthesized
aggttcttggacagcatttt

SEQ ID NO: 127310 - DNA, 20 bp, Artificial Sequence
  chemically synthesized
cagcatttttggtcctgcct

SEQ ID NO: 127311 - DNA, 20 bp, Artificial Sequence
  chemically synthesized
agcatttttggtcctgcctt

SEQ ID NO: 127312 - DNA, 20 bp, Artificial Sequence
  chemically synthesized
gctcccctctggcccaaggc

SEQ ID NO: 127313 - DNA, 20 bp, Artificial Sequence
  chemically synthesized
ggctcccctctggcccaagg

SEQ ID NO: 127314 - DNA, 20 bp, Artificial Sequence
  chemically synthesized
tttttggtcctgccttgggc

SEQ ID NO: 127315 - DNA, 20 bp, Artificial Sequence
  chemically synthesized
tttggtcctgccttgggcca

SEQ ID NO: 127316 - DNA, 20 bp, Artificial Sequence
  chemically synthesized
ttgggctcccctctggccca

SEQ ID NO: 127317 - DNA, 20 bp, Artificial Sequence
  chemically synthesized
ttggtcctgccttgggccag

SEQ ID NO: 127318 - DNA, 20 bp, Artificial Sequence
  chemically synthesized
cttgggctcccctctggccc

SEQ ID NO: 127319 - DNA, 20 bp, Artificial Sequence
  chemically synthesized
tggtcctgccttgggccaga

SEQ ID NO: 127320 - DNA, 20 bp, Artificial Sequence
  chemically synthesized
ggtcctgccttgggccagag

SEQ ID NO: 127321 - DNA, 20 bp, Artificial Sequence
  chemically synthesized
tcctgccttgggccagaggg

SEQ ID NO: 127322 - DNA, 20 bp, Artificial Sequence
  chemically synthesized
tagggccttgggctcccctc

SEQ ID NO: 127323 - DNA, 20 bp, Artificial Sequence
  chemically synthesized
cttgggccagaggggagccc

SEQ ID NO: 127324 - DNA, 20 bp, Artificial Sequence
  chemically synthesized
ttgggccagaggggagccca

SEQ ID NO: 127325 - DNA, 20 bp, Artificial Sequence
  chemically synthesized
gacccatattttagggcctt

SEQ ID NO: 127326 - DNA, 20 bp, Artificial Sequence
  chemically synthesized
ggacccatattttagggcct

SEQ ID NO: 127327 - DNA, 20 bp, Artificial Sequence
  chemically synthesized
gagcccaaggccctaaaata

SEQ ID NO: 127328 - DNA, 20 bp, Artificial Sequence
  chemically synthesized
gaactgggacccatatttta

SEQ ID NO: 127329 - DNA, 20 bp, Artificial Sequence
  chemically synthesized
agcccaaggccctaaaatat

SEQ ID NO: 127330 - DNA, 20 bp, Artificial Sequence
  chemically synthesized
agaactgggacccatatttt

SEQ ID NO: 127331 - DNA, 20 bp, Artificial Sequence
  chemically synthesized
gagaactgggacccatattt

SEQ ID NO: 127332 - DNA, 20 bp, Artificial Sequence
  chemically synthesized
aggccctaaaatatgggtcc

SEQ ID NO: 127333 - DNA, 20 bp, Artificial Sequence
  chemically synthesized
tggtgaatgctgagagaact

SEQ ID NO: 127334 - DNA, 20 bp, Artificial Sequence
  chemically synthesized
aatatgggtcccagttctct

SEQ ID NO: 127335 - DNA, 20 bp, Artificial Sequence
  chemically synthesized
gtggtgaatgctgagagaac

SEQ ID NO: 127336 - DNA, 20 bp, Artificial Sequence
  chemically synthesized
cagcttgtggtgaatgctga

SEQ ID NO: 127337 - DNA, 20 bp, Artificial Sequence
  chemically synthesized
atcagcttgtggtgaatgct

SEQ ID NO: 127338 - DNA, 20 bp, Artificial Sequence
  chemically synthesized
gttctctcagcattcaccac

SEQ ID NO: 127339 - DNA, 20 bp, Artificial Sequence
  chemically synthesized
agggctcttccatcagcttg

SEQ ID NO: 127340 - DNA, 20 bp, Artificial Sequence
  chemically synthesized
cagcattcaccacaagctga

SEQ ID NO: 127341 - DNA, 20 bp, Artificial Sequence
  chemically synthesized
cattcaccacaagctgatgg

SEQ ID NO: 127342 - DNA, 20 bp, Artificial Sequence
  chemically synthesized
ttcaccacaagctgatggaa

SEQ ID NO: 127343 - DNA, 20 bp, Artificial Sequence
  chemically synthesized
aagcccaagggctcttccat

SEQ ID NO: 127344 - DNA, 20 bp, Artificial Sequence
  chemically synthesized
caagctgatggaagagccct

SEQ ID NO: 127345 - DNA, 20 bp, Artificial Sequence
  chemically synthesized
aagctgatggaagagccctt

SEQ ID NO: 127346 - DNA, 20 bp, Artificial Sequence
  chemically synthesized
ggtgttcacttaaagcccaa

SEQ ID NO: 127347 - DNA, 20 bp, Artificial Sequence
  chemically synthesized
tggtgttcacttaaagccca

SEQ ID NO: 127348 - DNA, 20 bp, Artificial Sequence
  chemically synthesized
tggaagagcccttgggcttt

SEQ ID NO: 127349 - DNA, 20 bp, Artificial Sequence
  chemically synthesized
ctggtgttcacttaaagccc

SEQ ID NO: 127350 - DNA, 20 bp, Artificial Sequence
  chemically synthesized
cctccactggtgttcactta

SEQ ID NO: 127351 - DNA, 20 bp, Artificial Sequence
  chemically synthesized
cttgggctttaagtgaacac

SEQ ID NO: 127352 - DNA, 20 bp, Artificial Sequence
  chemically synthesized
gggctttaagtgaacaccag

SEQ ID NO: 127353 - DNA, 20 bp, Artificial Sequence
  chemically synthesized
gctttaagtgaacaccagtg

SEQ ID NO: 127354 - DNA, 20 bp, Artificial Sequence
  chemically synthesized
ctttaagtgaacaccagtgg

SEQ ID NO: 127355 - DNA, 20 bp, Artificial Sequence
  chemically synthesized
gggttctgcttggcctccac

SEQ ID NO: 127356 - DNA, 20 bp, Artificial Sequence
  chemically synthesized
agtgaacaccagtggaggcc

SEQ ID NO: 127357 - DNA, 20 bp, Artificial Sequence
  chemically synthesized
gaacaccagtggaggccaag

SEQ ID NO: 127358 - DNA, 20 bp, Artificial Sequence
  chemically synthesized
accaccatgagggttctgct

SEQ ID NO: 127359 - DNA, 20 bp, Artificial Sequence
  chemically synthesized
gaggccaagcagaaccctca

SEQ ID NO: 127360 - DNA, 20 bp, Artificial Sequence
  chemically synthesized
gccaagcagaaccctcatgg

SEQ ID NO: 127361 - DNA, 20 bp, Artificial Sequence
  chemically synthesized
tgtggccctcaccaccatga

SEQ ID NO: 127362 - DNA, 20 bp, Artificial Sequence
  chemically synthesized
ctgtggccctcaccaccatg

SEQ ID NO: 127363 - DNA, 20 bp, Artificial Sequence
  chemically synthesized
cctgtggccctcaccaccat

SEQ ID NO: 127364 - DNA, 20 bp, Artificial Sequence
  chemically synthesized
agcagaaccctcatggtggt

SEQ ID NO: 127365 - DNA, 20 bp, Artificial Sequence
  chemically synthesized
gcagaaccctcatggtggtg

SEQ ID NO: 127366 - DNA, 20 bp, Artificial Sequence
  chemically synthesized
cagaaccctcatggtggtga

SEQ ID NO: 127367 - DNA, 20 bp, Artificial Sequence
  chemically synthesized
cctcatggtggtgagggcca

SEQ ID NO: 127368 - DNA, 20 bp, Artificial Sequence
  chemically synthesized
ctcatggtggtgagggccac

SEQ ID NO: 127369 - DNA, 20 bp, Artificial Sequence
  chemically synthesized
tcatggtggtgagggccaca

SEQ ID NO: 127370 - DNA, 20 bp, Artificial Sequence
  chemically synthesized
atggtggtgagggccacagg

SEQ ID NO: 127371 - DNA, 20 bp, Artificial Sequence
  chemically synthesized
ggtggtgagggccacaggga

SEQ ID NO: 127372 - DNA, 20 bp, Artificial Sequence
  chemically synthesized
gtggtgagggccacagggag

SEQ ID NO: 127373 - DNA, 20 bp, Artificial Sequence
  chemically synthesized
ggcagaggatcctctccctg

SEQ ID NO: 127374 - DNA, 20 bp, Artificial Sequence
  chemically synthesized
cttgcccttttaaaaggcag

SEQ ID NO: 127375 - DNA, 20 bp, Artificial Sequence
  chemically synthesized
ccttgcccttttaaaaggca

SEQ ID NO: 127376 - DNA, 20 bp, Artificial Sequence
  chemically synthesized
ttccttgcccttttaaaagg

SEQ ID NO: 127377 - DNA, 20 bp, Artificial Sequence
  chemically synthesized
gaggatcctctgccttttaa

SEQ ID NO: 127378 - DNA, 20 bp, Artificial Sequence
  chemically synthesized
aggatcctctgccttttaaa

SEQ ID NO: 127379 - DNA, 20 bp, Artificial Sequence
  chemically synthesized
ggatcctctgccttttaaaa

SEQ ID NO: 127380 - DNA, 20 bp, Artificial Sequence
  chemically synthesized
ctcttccttgcccttttaaa

SEQ ID NO: 127381 - DNA, 20 bp, Artificial Sequence
  chemically synthesized
gctcttccttgcccttttaa

SEQ ID NO: 127382 - DNA, 20 bp, Artificial Sequence
  chemically synthesized
cctctgccttttaaaagggc

SEQ ID NO: 127383 - DNA, 20 bp, Artificial Sequence
  chemically synthesized
ctctgccttttaaaagggca

SEQ ID NO: 127384 - DNA, 20 bp, Artificial Sequence
  chemically synthesized
tgccttttaaaagggcaagg

SEQ ID NO: 127385 - DNA, 20 bp, Artificial Sequence
  chemically synthesized
ccttttaaaagggcaaggaa

SEQ ID NO: 127386 - DNA, 20 bp, Artificial Sequence
  chemically synthesized
tttaaaagggcaaggaagag

SEQ ID NO: 127387 - DNA, 20 bp, Artificial Sequence
  chemically synthesized
ttaaaagggcaaggaagagc

SEQ ID NO: 127388 - DNA, 20 bp, Artificial Sequence
  chemically synthesized
taaaagggcaaggaagagca

SEQ ID NO: 127389 - DNA, 20 bp, Artificial Sequence
  chemically synthesized
aaagggcaaggaagagcagg

SEQ ID NO: 127390 - DNA, 20 bp, Artificial Sequence
  chemically synthesized
gcagggagcactttatattg

SEQ ID NO: 127391 - DNA, 20 bp, Artificial Sequence
  chemically synthesized
agcactcacaccacaatata

SEQ ID NO: 127392 - DNA, 20 bp, Artificial Sequence
  chemically synthesized
agcactttatattgtggtgt

SEQ ID NO: 127393 - DNA, 20 bp, Artificial Sequence
  chemically synthesized
ttatattgtggtgtgagtgc

SEQ ID NO: 127394 - DNA, 20 bp, Artificial Sequence
  chemically synthesized
ttgtggtgtgagtgctagct

SEQ ID NO: 127395 - DNA, 20 bp, Artificial Sequence
  chemically synthesized
ctattctattgtggctaagc

SEQ ID NO: 127396 - DNA, 20 bp, Artificial Sequence
  chemically synthesized
tgttctattctattgtggct

SEQ ID NO: 127397 - DNA, 20 bp, Artificial Sequence
  chemically synthesized
gagtgctagcttagccacaa

SEQ ID NO: 127398 - DNA, 20 bp, Artificial Sequence
  chemically synthesized
cctcatgttctattctattg

SEQ ID NO: 127399 - DNA, 20 bp, Artificial Sequence
  chemically synthesized
ctagcttagccacaatagaa

SEQ ID NO: 127400 - DNA, 20 bp, Artificial Sequence
  chemically synthesized
gccacaatagaatagaacat

SEQ ID NO: 127401 - DNA, 20 bp, Artificial Sequence
  chemically synthesized
ccacaatagaatagaacatg

SEQ ID NO: 127402 - DNA, 20 bp, Artificial Sequence
  chemically synthesized
agaacatgaggtaaactgct

SEQ ID NO: 127403 - DNA, 20 bp, Artificial Sequence
  chemically synthesized
gaacatgaggtaaactgcta

SEQ ID NO: 127404 - DNA, 20 bp, Artificial Sequence
  chemically synthesized
attggagtcaaaaaccttag

SEQ ID NO: 127405 - DNA, 20 bp, Artificial Sequence
  chemically synthesized
gtcattggagtcaaaaacct

SEQ ID NO: 127406 - DNA, 20 bp, Artificial Sequence
  chemically synthesized
aggtttttgactccaatgac

SEQ ID NO: 127407 - DNA, 20 bp, Artificial Sequence
  chemically synthesized
tgtctgagggccagtcattg

SEQ ID NO: 127408 - DNA, 20 bp, Artificial Sequence
  chemically synthesized
gctgtctgagggccagtcat

SEQ ID NO: 127409 - DNA, 20 bp, Artificial Sequence
  chemically synthesized
tgactccaatgactggccct

SEQ ID NO: 127410 - DNA, 20 bp, Artificial Sequence
  chemically synthesized
cagagatgctgtctgagggc

SEQ ID NO: 127411 - DNA, 20 bp, Artificial Sequence
  chemically synthesized
tccaatgactggccctcaga

SEQ ID NO: 127412 - DNA, 20 bp, Artificial Sequence
  chemically synthesized
tatccagagatgctgtctga

SEQ ID NO: 127413 - DNA, 20 bp, Artificial Sequence
  chemically synthesized
atatccagagatgctgtctg

SEQ ID NO: 127414 - DNA, 20 bp, Artificial Sequence
  chemically synthesized
catatccagagatgctgtct

SEQ ID NO: 127415 - DNA, 20 bp, Artificial Sequence
  chemically synthesized
tggccctcagacagcatctc

SEQ ID NO: 127416 - DNA, 20 bp, Artificial Sequence
  chemically synthesized
ttaggccccgggcatatcca

SEQ ID NO: 127417 - DNA, 20 bp, Artificial Sequence
  chemically synthesized
tcttaggccccgggcatatc

SEQ ID NO: 127418 - DNA, 20 bp, Artificial Sequence
  chemically synthesized
acagcatctctggatatgcc

SEQ ID NO: 127419 - DNA, 20 bp, Artificial Sequence
  chemically synthesized
cagcatctctggatatgccc

SEQ ID NO: 127420 - DNA, 20 bp, Artificial Sequence
  chemically synthesized
agcatctctggatatgcccg

SEQ ID NO: 127421 - DNA, 20 bp, Artificial Sequence
  chemically synthesized
tctggatatgcccggggcct

SEQ ID NO: 127422 - DNA, 20 bp, Artificial Sequence
  chemically synthesized
cggtggaaatcttaggcccc

SEQ ID NO: 127423 - DNA, 20 bp, Artificial Sequence
  chemically synthesized
tcggtggaaatcttaggccc

SEQ ID NO: 127424 - DNA, 20 bp, Artificial Sequence
  chemically synthesized
gatttttcggtggaaatctt

SEQ ID NO: 127425 - DNA, 20 bp, Artificial Sequence
  chemically synthesized
agatttttcggtggaaatct

SEQ ID NO: 127426 - DNA, 20 bp, Artificial Sequence
  chemically synthesized
tctggcagcagatttttcgg

SEQ ID NO: 127427 - DNA, 20 bp, Artificial Sequence
  chemically synthesized
acatctggcagcagattttt

SEQ ID NO: 127428 - DNA, 20 bp, Artificial Sequence
  chemically synthesized
tccaccgaaaaatctgctgc

SEQ ID NO: 127429 - DNA, 20 bp, Artificial Sequence
  chemically synthesized
agcttcaatacatctggcag

SEQ ID NO: 127430 - DNA, 20 bp, Artificial Sequence
  chemically synthesized
tggagcttcaatacatctgg

SEQ ID NO: 127431 - DNA, 20 bp, Artificial Sequence
  chemically synthesized
cagtggagcttcaatacatc

SEQ ID NO: 127432 - DNA, 20 bp, Artificial Sequence
  chemically synthesized
atctgctgccagatgtattg

SEQ ID NO: 127433 - DNA, 20 bp, Artificial Sequence
  chemically synthesized
gaaacaaataacatgcagtg

SEQ ID NO: 127434 - DNA, 20 bp, Artificial Sequence
  chemically synthesized
aggaaacaaataacatgcag

SEQ ID NO: 127435 - DNA, 20 bp, Artificial Sequence
  chemically synthesized
gaaaggaaacaaataacatg

SEQ ID NO: 127436 - DNA, 20 bp, Artificial Sequence
  chemically synthesized
tcctaaaagcagcaagagaa

SEQ ID NO: 127437 - DNA, 20 bp, Artificial Sequence
  chemically synthesized
atcctaaaagcagcaagaga

SEQ ID NO: 127438 - DNA, 20 bp, Artificial Sequence
  chemically synthesized
aagaatcctaaaagcagcaa

SEQ ID NO: 127439 - DNA, 20 bp, Artificial Sequence
  chemically synthesized
gaaagaatcctaaaagcagc

SEQ ID NO: 127440 - DNA, 20 bp, Artificial Sequence
  chemically synthesized
ttcctttctcttgctgcttt

SEQ ID NO: 127441 - DNA, 20 bp, Artificial Sequence
  chemically synthesized
tcctttctcttgctgctttt

SEQ ID NO: 127442 - DNA, 20 bp, Artificial Sequence
  chemically synthesized
taaagaaagaatcctaaaag

SEQ ID NO: 127443 - DNA, 20 bp, Artificial Sequence
  chemically synthesized
ggataaagaaagaatcctaa

SEQ ID NO: 127444 - DNA, 20 bp, Artificial Sequence
  chemically synthesized
ccacaggtcaaggataaaga

SEQ ID NO: 127445 - DNA, 20 bp, Artificial Sequence
  chemically synthesized
actcccacaggtcaaggata

SEQ ID NO: 127446 - DNA, 20 bp, Artificial Sequence
  chemically synthesized
ctttctttatccttgacctg

SEQ ID NO: 127447 - DNA, 20 bp, Artificial Sequence
  chemically synthesized
aatcaaactcccacaggtca

SEQ ID NO: 127448 - DNA, 20 bp, Artificial Sequence
  chemically synthesized
tttctttatccttgacctgt

SEQ ID NO: 127449 - DNA, 20 bp, Artificial Sequence
  chemically synthesized
taatcaaactcccacaggtc

SEQ ID NO: 127450 - DNA, 20 bp, Artificial Sequence
  chemically synthesized
tctttatccttgacctgtgg

SEQ ID NO: 127451 - DNA, 20 bp, Artificial Sequence
  chemically synthesized
tgcaataatcaaactcccac

SEQ ID NO: 127452 - DNA, 20 bp, Artificial Sequence
  chemically synthesized
atgcaataatcaaactccca

SEQ ID NO: 127453 - DNA, 20 bp, Artificial Sequence
  chemically synthesized
gtttgattattgcatgcctt

SEQ ID NO: 127454 - DNA, 20 bp, Artificial Sequence
  chemically synthesized
tttgattattgcatgccttg

SEQ ID NO: 127455 - DNA, 20 bp, Artificial Sequence
  chemically synthesized
gattattgcatgccttgagg

SEQ ID NO: 127456 - DNA, 20 bp, Artificial Sequence
  chemically synthesized
ttatctcagagactacctca

SEQ ID NO: 127457 - DNA, 20 bp, Artificial Sequence
  chemically synthesized
attatctcagagactacctc

SEQ ID NO: 127458 - DNA, 20 bp, Artificial Sequence
  chemically synthesized
catgccttgaggtagtctct

SEQ ID NO: 127459 - DNA, 20 bp, Artificial Sequence
  chemically synthesized
caccaagcagaattatctca

SEQ ID NO: 127460 - DNA, 20 bp, Artificial Sequence
  chemically synthesized
aacaccaagcagaattatct

SEQ ID NO: 127461 - DNA, 20 bp, Artificial Sequence
  chemically synthesized
gtctctgagataattctgct

SEQ ID NO: 127462 - DNA, 20 bp, Artificial Sequence
  chemically synthesized
caaagttatagaacaccaag

SEQ ID NO: 127463 - DNA, 20 bp, Artificial Sequence
  chemically synthesized
cgacaaagttatagaacacc

SEQ ID NO: 127464 - DNA, 20 bp, Artificial Sequence
  chemically synthesized
attcaagtacgacaaagtta

SEQ ID NO: 127465 - DNA, 20 bp, Artificial Sequence
  chemically synthesized
accaacattcaagtacgaca

SEQ ID NO: 127466 - DNA, 20 bp, Artificial Sequence
  chemically synthesized
actttgtcgtacttgaatgt

SEQ ID NO: 127467 - DNA, 20 bp, Artificial Sequence
  chemically synthesized
agagaaagataccaacattc

SEQ ID NO: 127468 - DNA, 20 bp, Artificial Sequence
  chemically synthesized
gagaacttcagaaacagaga

SEQ ID NO: 127469 - DNA, 20 bp, Artificial Sequence
  chemically synthesized
atcagagaacttcagaaaca

SEQ ID NO: 127470 - DNA, 20 bp, Artificial Sequence
  chemically synthesized
ggtatctttctctgtttctg

SEQ ID NO: 127471 - DNA, 20 bp, Artificial Sequence
  chemically synthesized
atatcagagaacttcagaaa

SEQ ID NO: 127472 - DNA, 20 bp, Artificial Sequence
  chemically synthesized
gggacaatatcagagaactt

SEQ ID NO: 127473 - DNA, 20 bp, Artificial Sequence
  chemically synthesized
gatacaaagggacaatatca

SEQ ID NO: 127474 - DNA, 20 bp, Artificial Sequence
  chemically synthesized
ttgatacaaagggacaatat

SEQ ID NO: 127475 - DNA, 20 bp, Artificial Sequence
  chemically synthesized
ggatagaaagttgatacaaa

SEQ ID NO: 127476 - DNA, 20 bp, Artificial Sequence
  chemically synthesized
gggatagaaagttgatacaa

SEQ ID NO: 127477 - DNA, 20 bp, Artificial Sequence
  chemically synthesized
agggatagaaagttgataca

SEQ ID NO: 127478 - DNA, 20 bp, Artificial Sequence
  chemically synthesized
gagaaagagatagggataga

SEQ ID NO: 127479 - DNA, 20 bp, Artificial Sequence
  chemically synthesized
ggtagagaaagagataggga

SEQ ID NO: 127480 - DNA, 20 bp, Artificial Sequence
  chemically synthesized
aggaggtagagaaagagata

SEQ ID NO: 127481 - DNA, 20 bp, Artificial Sequence
  chemically synthesized
caggaggtagagaaagagat

SEQ ID NO: 127482 - DNA, 20 bp, Artificial Sequence
  chemically synthesized
acaggaggtagagaaagaga

SEQ ID NO: 127483 - DNA, 20 bp, Artificial Sequence
  chemically synthesized
ttaaacaggaggtagagaaa

SEQ ID NO: 127484 - DNA, 20 bp, Artificial Sequence
  chemically synthesized
ccttaaacaggaggtagaga

SEQ ID NO: 127485 - DNA, 20 bp, Artificial Sequence
  chemically synthesized
ttggccttaaacaggaggta

SEQ ID NO: 127486 - DNA, 20 bp, Artificial Sequence
  chemically synthesized
tattggccttaaacaggagg

SEQ ID NO: 127487 - DNA, 20 bp, Artificial Sequence
  chemically synthesized
tctttctctacctcctgttt

SEQ ID NO: 127488 - DNA, 20 bp, Artificial Sequence
  chemically synthesized
agttattggccttaaacagg

SEQ ID NO: 127489 - DNA, 20 bp, Artificial Sequence
  chemically synthesized
ctttctctacctcctgttta

SEQ ID NO: 127490 - DNA, 20 bp, Artificial Sequence
  chemically synthesized
gagttattggccttaaacag

SEQ ID NO: 127491 - DNA, 20 bp, Artificial Sequence
  chemically synthesized
aagagttattggccttaaac

SEQ ID NO: 127492 - DNA, 20 bp, Artificial Sequence
  chemically synthesized
taagagttattggccttaaa

SEQ ID NO: 127493 - DNA, 20 bp, Artificial Sequence
  chemically synthesized
agggtcaatctaagagttat

SEQ ID NO: 127494 - DNA, 20 bp, Artificial Sequence
  chemically synthesized
tgtttaaggccaataactct

SEQ ID NO: 127495 - DNA, 20 bp, Artificial Sequence
  chemically synthesized
cctcaaaagggtcaatctaa

SEQ ID NO: 127496 - DNA, 20 bp, Artificial Sequence
  chemically synthesized
agcctcaaaagggtcaatct

SEQ ID NO: 127497 - DNA, 20 bp, Artificial Sequence
  chemically synthesized
actcttagattgaccctttt

SEQ ID NO: 127498 - DNA, 20 bp, Artificial Sequence
  chemically synthesized
ctcttagattgacccttttg

SEQ ID NO: 127499 - DNA, 20 bp, Artificial Sequence
  chemically synthesized
tccagaaaatagcctcaaaa

SEQ ID NO: 127500 - DNA, 20 bp, Artificial Sequence
  chemically synthesized
atccagaaaatagcctcaaa

SEQ ID NO: 127501 - DNA, 20 bp, Artificial Sequence
  chemically synthesized
gatccagaaaatagcctcaa

SEQ ID NO: 127502 - DNA, 20 bp, Artificial Sequence
  chemically synthesized
acccttttgaggctattttc

SEQ ID NO: 127503 - DNA, 20 bp, Artificial Sequence
  chemically synthesized
tgcctacaagatccagaaaa

SEQ ID NO: 127504 - DNA, 20 bp, Artificial Sequence
  chemically synthesized
aggctattttctggatcttg

SEQ ID NO: 127505 - DNA, 20 bp, Artificial Sequence
  chemically synthesized
ggctgtctgcctacaagatc

SEQ ID NO: 127506 - DNA, 20 bp, Artificial Sequence
  chemically synthesized
ggctattttctggatcttgt

SEQ ID NO: 127507 - DNA, 20 bp, Artificial Sequence
  chemically synthesized
tattttctggatcttgtagg

SEQ ID NO: 127508 - DNA, 20 bp, Artificial Sequence
  chemically synthesized
caaataggctgtctgcctac

SEQ ID NO: 127509 - DNA, 20 bp, Artificial Sequence
  chemically synthesized
ttctggatcttgtaggcaga

SEQ ID NO: 127510 - DNA, 20 bp, Artificial Sequence
  chemically synthesized
ctggctgtgtattttcaaat

SEQ ID NO: 127511 - DNA, 20 bp, Artificial Sequence
  chemically synthesized
tctggctgtgtattttcaaa

SEQ ID NO: 127512 - DNA, 20 bp, Artificial Sequence
  chemically synthesized
acagcctatttgaaaataca

SEQ ID NO: 127513 - DNA, 20 bp, Artificial Sequence
  chemically synthesized
cctatttgaaaatacacagc

SEQ ID NO: 127514 - DNA, 20 bp, Artificial Sequence
  chemically synthesized
tatttgaaaatacacagcca

SEQ ID NO: 127515 - DNA, 20 bp, Artificial Sequence
  chemically synthesized
ttgaaaatacacagccagag

SEQ ID NO: 127516 - DNA, 20 bp, Artificial Sequence
  chemically synthesized
tttttttcttttgtcttctc

SEQ ID NO: 127517 - DNA, 20 bp, Artificial Sequence
  chemically synthesized
tacacagccagagaagacaa

SEQ ID NO: 127518 - DNA, 20 bp, Artificial Sequence
  chemically synthesized
agacaaaagaaaaaaataat

SEQ ID NO: 127519 - DNA, 20 bp, Artificial Sequence
  chemically synthesized
aaaaataataagaaacaatg

SEQ ID NO: 127520 - DNA, 20 bp, Artificial Sequence
  chemically synthesized
aaacaatgaagcatacctac

SEQ ID NO: 127521 - DNA, 20 bp, Artificial Sequence
  chemically synthesized
tttttgtgtctggatcttgt

SEQ ID NO: 127522 - DNA, 20 bp, Artificial Sequence
  chemically synthesized
tgaagcatacctacaagatc

SEQ ID NO: 127523 - DNA, 20 bp, Artificial Sequence
  chemically synthesized
ttttttgtgtctggatcttg

SEQ ID NO: 127524 - DNA, 20 bp, Artificial Sequence
  chemically synthesized
tttgaagggttttttgtgtc

SEQ ID NO: 127525 - DNA, 20 bp, Artificial Sequence
  chemically synthesized
gattcattgatttttttgaa

SEQ ID NO: 127526 - DNA, 20 bp, Artificial Sequence
  chemically synthesized
ggattcattgatttttttga

SEQ ID NO: 127527 - DNA, 20 bp, Artificial Sequence
  chemically synthesized
tggattcattgatttttttg

SEQ ID NO: 127528 - DNA, 20 bp, Artificial Sequence
  chemically synthesized
ttcaaaaaaatcaatgaatc

SEQ ID NO: 127529 - DNA, 20 bp, Artificial Sequence
  chemically synthesized
tcaaaaaaatcaatgaatcc

SEQ ID NO: 127530 - DNA, 20 bp, Artificial Sequence
  chemically synthesized
aaaaaaatcaatgaatccag

SEQ ID NO: 127531 - DNA, 20 bp, Artificial Sequence
  chemically synthesized
aaatcaatgaatccaggagc

SEQ ID NO: 127532 - DNA, 20 bp, Artificial Sequence
  chemically synthesized
cttttcaaaaaactggctcc

SEQ ID NO: 127533 - DNA, 20 bp, Artificial Sequence
  chemically synthesized
tgttgatcttttcaaaaaac

SEQ ID NO: 127534 - DNA, 20 bp, Artificial Sequence
  chemically synthesized
ccaggagccagttttttgaa

SEQ ID NO: 127535 - DNA, 20 bp, Artificial Sequence
  chemically synthesized
cagttttttgaaaagatcaa

SEQ ID NO: 127536 - DNA, 20 bp, Artificial Sequence
  chemically synthesized
gaaaagatcaacagaattga

SEQ ID NO: 127537 - DNA, 20 bp, Artificial Sequence
  chemically synthesized
caacagaattgatagaccgc

SEQ ID NO: 127538 - DNA, 20 bp, Artificial Sequence
  chemically synthesized
agaattgatagaccgctagt

SEQ ID NO: 127539 - DNA, 20 bp, Artificial Sequence
  chemically synthesized
ttctttattagtcttactag

SEQ ID NO: 127540 - DNA, 20 bp, Artificial Sequence
  chemically synthesized
ttcttctttattagtcttac

SEQ ID NO: 127541 - DNA, 20 bp, Artificial Sequence
  chemically synthesized
gaccgctagtaagactaata

SEQ ID NO: 127542 - DNA, 20 bp, Artificial Sequence
  chemically synthesized
cgctagtaagactaataaag

SEQ ID NO: 127543 - DNA, 20 bp, Artificial Sequence
  chemically synthesized
ttctctcttttcttctttat

SEQ ID NO: 127544 - DNA, 20 bp, Artificial Sequence
  chemically synthesized
gtaagactaataaagaagaa

SEQ ID NO: 127545 - DNA, 20 bp, Artificial Sequence
  chemically synthesized
aagactaataaagaagaaaa

SEQ ID NO: 127546 - DNA, 20 bp, Artificial Sequence
  chemically synthesized
gactaataaagaagaaaaga

SEQ ID NO: 127547 - DNA, 20 bp, Artificial Sequence
  chemically synthesized
taataaagaagaaaagagag

SEQ ID NO: 127548 - DNA, 20 bp, Artificial Sequence
  chemically synthesized
gaaaagagagaagaatcaaa

SEQ ID NO: 127549 - DNA, 20 bp, Artificial Sequence
  chemically synthesized
agatgcaataaaaaatgata

SEQ ID NO: 127550 - DNA, 20 bp, Artificial Sequence
  chemically synthesized
gatgcaataaaaaatgataa

SEQ ID NO: 127551 - DNA, 20 bp, Artificial Sequence
  chemically synthesized
atgcaataaaaaatgataaa

SEQ ID NO: 127552 - DNA, 20 bp, Artificial Sequence
  chemically synthesized
tgcaataaaaaatgataaag

SEQ ID NO: 127553 - DNA, 20 bp, Artificial Sequence
  chemically synthesized
ttgtatttctgtggtgtcgg

SEQ ID NO: 127554 - DNA, 20 bp, Artificial Sequence
  chemically synthesized
ggatatcaccaccgacacca

SEQ ID NO: 127555 - DNA, 20 bp, Artificial Sequence
  chemically synthesized
agtttgtatttctgtggtgt

SEQ ID NO: 127556 - DNA, 20 bp, Artificial Sequence
  chemically synthesized
gatggtagtttgtatttctg

SEQ ID NO: 127557 - DNA, 20 bp, Artificial Sequence
  chemically synthesized
acagaaatacaaactaccat

SEQ ID NO: 127558 - DNA, 20 bp, Artificial Sequence
  chemically synthesized
agaaatacaaactaccatca

SEQ ID NO: 127559 - DNA, 20 bp, Artificial Sequence
  chemically synthesized
tttatagtattctctgatgg

SEQ ID NO: 127560 - DNA, 20 bp, Artificial Sequence
  chemically synthesized
gtgtttatagtattctctga

SEQ ID NO: 127561 - DNA, 20 bp, Artificial Sequence
  chemically synthesized
tatttgcgtagaggtgttta

SEQ ID NO: 127562 - DNA, 20 bp, Artificial Sequence
  chemically synthesized
tttctagtttatttgcgtag

SEQ ID NO: 127563 - DNA, 20 bp, Artificial Sequence
  chemically synthesized
ttttctagtttatttgcgta

SEQ ID NO: 127564 - DNA, 20 bp, Artificial Sequence
  chemically synthesized
gattttctagtttatttgcg

SEQ ID NO: 127565 - DNA, 20 bp, Artificial Sequence
  chemically synthesized
acacctctacgcaaataaac

SEQ ID NO: 127566 - DNA, 20 bp, Artificial Sequence
  chemically synthesized
cgcaaataaactagaaaatc

SEQ ID NO: 127567 - DNA, 20 bp, Artificial Sequence
  chemically synthesized
tccatttcttctagattttc

SEQ ID NO: 127568 - DNA, 20 bp, Artificial Sequence
  chemically synthesized
aaataaactagaaaatctag

SEQ ID NO: 127569 - DNA, 20 bp, Artificial Sequence
  chemically synthesized
actagaaaatctagaagaaa

SEQ ID NO: 127570 - DNA, 20 bp, Artificial Sequence
  chemically synthesized
aggaatttatccatttcttc

SEQ ID NO: 127571 - DNA, 20 bp, Artificial Sequence
  chemically synthesized
ttgggaaggtgtatgtgtgc

SEQ ID NO: 127572 - DNA, 20 bp, Artificial Sequence
  chemically synthesized
cttgggaaggtgtatgtgtg

SEQ ID NO: 127573 - DNA, 20 bp, Artificial Sequence
  chemically synthesized
ctgcacacatacaccttccc

SEQ ID NO: 127574 - DNA, 20 bp, Artificial Sequence
  chemically synthesized
ttcctggtttagtcttggga

SEQ ID NO: 127575 - DNA, 20 bp, Artificial Sequence
  chemically synthesized
cttcctggtttagtcttggg

SEQ ID NO: 127576 - DNA, 20 bp, Artificial Sequence
  chemically synthesized
cttcttcctggtttagtctt

SEQ ID NO: 127577 - DNA, 20 bp, Artificial Sequence
  chemically synthesized
acttcttcctggtttagtct

SEQ ID NO: 127578 - DNA, 20 bp, Artificial Sequence
  chemically synthesized
acaccttcccaagactaaac

SEQ ID NO: 127579 - DNA, 20 bp, Artificial Sequence
  chemically synthesized
caccttcccaagactaaacc

SEQ ID NO: 127580 - DNA, 20 bp, Artificial Sequence
  chemically synthesized
cttcccaagactaaaccagg

SEQ ID NO: 127581 - DNA, 20 bp, Artificial Sequence
  chemically synthesized
gattcaacttcttcctggtt

SEQ ID NO: 127582 - DNA, 20 bp, Artificial Sequence
  chemically synthesized
cccaagactaaaccaggaag

SEQ ID NO: 127583 - DNA, 20 bp, Artificial Sequence
  chemically synthesized
tcagggattcaacttcttcc

SEQ ID NO: 127584 - DNA, 20 bp, Artificial Sequence
  chemically synthesized
gaagaagttgaatccctgaa

SEQ ID NO: 127585 - DNA, 20 bp, Artificial Sequence
  chemically synthesized
gcctgttattggtctattca

SEQ ID NO: 127586 - DNA, 20 bp, Artificial Sequence
  chemically synthesized
agcctgttattggtctattc

SEQ ID NO: 127587 - DNA, 20 bp, Artificial Sequence
  chemically synthesized
gagcctgttattggtctatt

SEQ ID NO: 127588 - DNA, 20 bp, Artificial Sequence
  chemically synthesized
atccctgaatagaccaataa

SEQ ID NO: 127589 - DNA, 20 bp, Artificial Sequence
  chemically synthesized
tccctgaatagaccaataac

SEQ ID NO: 127590 - DNA, 20 bp, Artificial Sequence
  chemically synthesized
tcaatttcagagcctgttat

SEQ ID NO: 127591 - DNA, 20 bp, Artificial Sequence
  chemically synthesized
caataacaggctctgaaatt

SEQ ID NO: 127592 - DNA, 20 bp, Artificial Sequence
  chemically synthesized
taattattgcctcaatttca

SEQ ID NO: 127593 - DNA, 20 bp, Artificial Sequence
  chemically synthesized
aataacaggctctgaaattg

SEQ ID NO: 127594 - DNA, 20 bp, Artificial Sequence
  chemically synthesized
attaattattgcctcaattt

SEQ ID NO: 127595 - DNA, 20 bp, Artificial Sequence
  chemically synthesized
gaaattgaggcaataattaa

SEQ ID NO: 127596 - DNA, 20 bp, Artificial Sequence
  chemically synthesized
ctggactttttttggtttgt

SEQ ID NO: 127597 - DNA, 20 bp, Artificial Sequence
  chemically synthesized
cctggactttttttggtttg

SEQ ID NO: 127598 - DNA, 20 bp, Artificial Sequence
  chemically synthesized
aatagcctacaaaccaaaaa

SEQ ID NO: 127599 - DNA, 20 bp, Artificial Sequence
  chemically synthesized
gtctggtcctggactttttt

SEQ ID NO: 127600 - DNA, 20 bp, Artificial Sequence
  chemically synthesized
cctacaaaccaaaaaaagtc

SEQ ID NO: 127601 - DNA, 20 bp, Artificial Sequence
  chemically synthesized
ctacaaaccaaaaaaagtcc

SEQ ID NO: 127602 - DNA, 20 bp, Artificial Sequence
  chemically synthesized
aaccaaaaaaagtccaggac

SEQ ID NO: 127603 - DNA, 20 bp, Artificial Sequence
  chemically synthesized
gctgtgaatccgtctggtcc

SEQ ID NO: 127604 - DNA, 20 bp, Artificial Sequence
  chemically synthesized
aaaaaaagtccaggaccaga

SEQ ID NO: 127605 - DNA, 20 bp, Artificial Sequence
  chemically synthesized
aattcggctgtgaatccgtc

SEQ ID NO: 127606 - DNA, 20 bp, Artificial Sequence
  chemically synthesized
tccaggaccagacggattca

SEQ ID NO: 127607 - DNA, 20 bp, Artificial Sequence
  chemically synthesized
tttgcacctctggtagaatt

SEQ ID NO: 127608 - DNA, 20 bp, Artificial Sequence
  chemically synthesized
gattcacagccgaattctac

SEQ ID NO: 127609 - DNA, 20 bp, Artificial Sequence
  chemically synthesized
ttcacagccgaattctacca

SEQ ID NO: 127610 - DNA, 20 bp, Artificial Sequence
  chemically synthesized
tcacagccgaattctaccag

SEQ ID NO: 127611 - DNA, 20 bp, Artificial Sequence
  chemically synthesized
gttcctctttgcacctctgg

SEQ ID NO: 127612 - DNA, 20 bp, Artificial Sequence
  chemically synthesized
ccagttcctctttgcacctc

SEQ ID NO: 127613 - DNA, 20 bp, Artificial Sequence
  chemically synthesized
cgaattctaccagaggtgca

SEQ ID NO: 127614 - DNA, 20 bp, Artificial Sequence
  chemically synthesized
aattctaccagaggtgcaaa

SEQ ID NO: 127615 - DNA, 20 bp, Artificial Sequence
  chemically synthesized
attctaccagaggtgcaaag

SEQ ID NO: 127616 - DNA, 20 bp, Artificial Sequence
  chemically synthesized
ccagaggtgcaaagaggaac

SEQ ID NO: 127617 - DNA, 20 bp, Artificial Sequence
  chemically synthesized
agttttagaaggaatgatac

SEQ ID NO: 127618 - DNA, 20 bp, Artificial Sequence
  chemically synthesized
ttgattggaatagttttaga

SEQ ID NO: 127619 - DNA, 20 bp, Artificial Sequence
  chemically synthesized
attgattggaatagttttag

SEQ ID NO: 127620 - DNA, 20 bp, Artificial Sequence
  chemically synthesized
tctattgattggaatagttt

SEQ ID NO: 127621 - DNA, 20 bp, Artificial Sequence
  chemically synthesized
tctttttctattgattggaa

SEQ ID NO: 127622 - DNA, 20 bp, Artificial Sequence
  chemically synthesized
tctaaaactattccaatcaa

SEQ ID NO: 127623 - DNA, 20 bp, Artificial Sequence
  chemically synthesized
ttccctctttttctattgat

SEQ ID NO: 127624 - DNA, 20 bp, Artificial Sequence
  chemically synthesized
actattccaatcaatagaaa

SEQ ID NO: 127625 - DNA, 20 bp, Artificial Sequence
  chemically synthesized
tattccaatcaatagaaaaa

SEQ ID NO: 127626 - DNA, 20 bp, Artificial Sequence
  chemically synthesized
attccaatcaatagaaaaag

SEQ ID NO: 127627 - DNA, 20 bp, Artificial Sequence
  chemically synthesized
ttccaatcaatagaaaaaga

SEQ ID NO: 127628 - DNA, 20 bp, Artificial Sequence
  chemically synthesized
cctcataaaatgagttaggg

SEQ ID NO: 127629 - DNA, 20 bp, Artificial Sequence
  chemically synthesized
gcctcataaaatgagttagg

SEQ ID NO: 127630 - DNA, 20 bp, Artificial Sequence
  chemically synthesized
tggcctcataaaatgagtta

SEQ ID NO: 127631 - DNA, 20 bp, Artificial Sequence
  chemically synthesized
ctggcctcataaaatgagtt

SEQ ID NO: 127632 - DNA, 20 bp, Artificial Sequence
  chemically synthesized
gctggcctcataaaatgagt

SEQ ID NO: 127633 - DNA, 20 bp, Artificial Sequence
  chemically synthesized
tcctccctaactcattttat

SEQ ID NO: 127634 - DNA, 20 bp, Artificial Sequence
  chemically synthesized
tgatgctggcctcataaaat

SEQ ID NO: 127635 - DNA, 20 bp, Artificial Sequence
  chemically synthesized
cctccctaactcattttatg

SEQ ID NO: 127636 - DNA, 20 bp, Artificial Sequence
  chemically synthesized
cctaactcattttatgaggc

SEQ ID NO: 127637 - DNA, 20 bp, Artificial Sequence
  chemically synthesized
ctttggtatcaggatgatgc

SEQ ID NO: 127638 - DNA, 20 bp, Artificial Sequence
  chemically synthesized
ccagcatcatcctgatacca

SEQ ID NO: 127639 - DNA, 20 bp, Artificial Sequence
  chemically synthesized
ctctgccaggctttggtatc

SEQ ID NO: 127640 - DNA, 20 bp, Artificial Sequence
  chemically synthesized
tctctgccaggctttggtat

SEQ ID NO: 127641 - DNA, 20 bp, Artificial Sequence
  chemically synthesized
atcatcctgataccaaagcc

SEQ ID NO: 127642 - DNA, 20 bp, Artificial Sequence
  chemically synthesized
gttgtgtctctgccaggctt

SEQ ID NO: 127643 - DNA, 20 bp, Artificial Sequence
  chemically synthesized
atcctgataccaaagcctgg

SEQ ID NO: 127644 - DNA, 20 bp, Artificial Sequence
  chemically synthesized
cctgataccaaagcctggca

SEQ ID NO: 127645 - DNA, 20 bp, Artificial Sequence
  chemically synthesized
ttttttgttgtgtctctgcc

SEQ ID NO: 127646 - DNA, 20 bp, Artificial Sequence
  chemically synthesized
tttttttgttgtgtctctgc

SEQ ID NO: 127647 - DNA, 20 bp, Artificial Sequence
  chemically synthesized
tggcagagacacaacaaaaa

SEQ ID NO: 127648 - DNA, 20 bp, Artificial Sequence
  chemically synthesized
gcagagacacaacaaaaaaa

SEQ ID NO: 127649 - DNA, 20 bp, Artificial Sequence
  chemically synthesized
acaacaaaaaaagagaattt

SEQ ID NO: 127650 - DNA, 20 bp, Artificial Sequence
  chemically synthesized
ttttgcatcgatgttcatca

SEQ ID NO: 127651 - DNA, 20 bp, Artificial Sequence
  chemically synthesized
tttttgcatcgatgttcatc

SEQ ID NO: 127652 - DNA, 20 bp, Artificial Sequence
  chemically synthesized
atttttgcatcgatgttcat

SEQ ID NO: 127653 - DNA, 20 bp, Artificial Sequence
  chemically synthesized
ggtttgccagtattttattg

SEQ ID NO: 127654 - DNA, 20 bp, Artificial Sequence
  chemically synthesized
cggtttgccagtattttatt

SEQ ID NO: 127655 - DNA, 20 bp, Artificial Sequence
  chemically synthesized
aaaaatcctcaataaaatac

SEQ ID NO: 127656 - DNA, 20 bp, Artificial Sequence
  chemically synthesized
tgctgctggattcggtttgc

SEQ ID NO: 127657 - DNA, 20 bp, Artificial Sequence
  chemically synthesized
aaatactggcaaaccgaatc

SEQ ID NO: 127658 - DNA, 20 bp, Artificial Sequence
  chemically synthesized
tactggcaaaccgaatccag

SEQ ID NO: 127659 - DNA, 20 bp, Artificial Sequence
  chemically synthesized
ttttgatgtgctgctggatt

SEQ ID NO: 127660 - DNA, 20 bp, Artificial Sequence
  chemically synthesized
taagctttttgatgtgctgc

SEQ ID NO: 127661 - DNA, 20 bp, Artificial Sequence
  chemically synthesized
gaatccagcagcacatcaaa

SEQ ID NO: 127662 - DNA, 20 bp, Artificial Sequence
  chemically synthesized
cccacttgatcatggtggat

SEQ ID NO: 127663 - DNA, 20 bp, Artificial Sequence
  chemically synthesized
tgaagcccacttgatcatgg

SEQ ID NO: 127664 - DNA, 20 bp, Artificial Sequence
  chemically synthesized
aaagcttatccaccatgatc

SEQ ID NO: 127665 - DNA, 20 bp, Artificial Sequence
  chemically synthesized
ggatgaagcccacttgatca

SEQ ID NO: 127666 - DNA, 20 bp, Artificial Sequence
  chemically synthesized
gcttatccaccatgatcaag

SEQ ID NO: 127667 - DNA, 20 bp, Artificial Sequence
  chemically synthesized
cttatccaccatgatcaagt

SEQ ID NO: 127668 - DNA, 20 bp, Artificial Sequence
  chemically synthesized
gatcaagtgggcttcatccc

SEQ ID NO: 127669 - DNA, 20 bp, Artificial Sequence
  chemically synthesized
atcaagtgggcttcatccct

SEQ ID NO: 127670 - DNA, 20 bp, Artificial Sequence
  chemically synthesized
agccttgcatcccagggatg

SEQ ID NO: 127671 - DNA, 20 bp, Artificial Sequence
  chemically synthesized
tgaaccagccttgcatccca

SEQ ID NO: 127672 - DNA, 20 bp, Artificial Sequence
  chemically synthesized
gggcttcatccctgggatgc

SEQ ID NO: 127673 - DNA, 20 bp, Artificial Sequence
  chemically synthesized
ttgaaccagccttgcatccc

SEQ ID NO: 127674 - DNA, 20 bp, Artificial Sequence
  chemically synthesized
ggcttcatccctgggatgca

SEQ ID NO: 127675 - DNA, 20 bp, Artificial Sequence
  chemically synthesized
gttgaaccagccttgcatcc

SEQ ID NO: 127676 - DNA, 20 bp, Artificial Sequence
  chemically synthesized
tcatccctgggatgcaaggc

SEQ ID NO: 127677 - DNA, 20 bp, Artificial Sequence
  chemically synthesized
ttgatttgcgtatgttgaac

SEQ ID NO: 127678 - DNA, 20 bp, Artificial Sequence
  chemically synthesized
gcaaatcaataaatgtaatc

SEQ ID NO: 127679 - DNA, 20 bp, Artificial Sequence
  chemically synthesized
cgttggttctgtttatatgc

SEQ ID NO: 127680 - DNA, 20 bp, Artificial Sequence
  chemically synthesized
aatgtaatccagcatataaa

SEQ ID NO: 127681 - DNA, 20 bp, Artificial Sequence
  chemically synthesized
aaccatgtggtttttgtcgt

SEQ ID NO: 127682 - DNA, 20 bp, Artificial Sequence
  chemically synthesized
aaccaacgacaaaaaccaca

SEQ ID NO: 127683 - DNA, 20 bp, Artificial Sequence
  chemically synthesized
catctattgagataaccatg

SEQ ID NO: 127684 - DNA, 20 bp, Artificial Sequence
  chemically synthesized
aaaccacatggttatctcaa

SEQ ID NO: 127685 - DNA, 20 bp, Artificial Sequence
  chemically synthesized
gggccttttctgcatctatt

SEQ ID NO: 127686 - DNA, 20 bp, Artificial Sequence
  chemically synthesized
catggttatctcaatagatg

SEQ ID NO: 127687 - DNA, 20 bp, Artificial Sequence
  chemically synthesized
ttatctcaatagatgcagaa

SEQ ID NO: 127688 - DNA, 20 bp, Artificial Sequence
  chemically synthesized
tatctcaatagatgcagaaa

SEQ ID NO: 127689 - DNA, 20 bp, Artificial Sequence
  chemically synthesized
gggctgttgaatttggtcaa

SEQ ID NO: 127690 - DNA, 20 bp, Artificial Sequence
  chemically synthesized
agggctgttgaatttggtca

SEQ ID NO: 127691 - DNA, 20 bp, Artificial Sequence
  chemically synthesized
aagggctgttgaatttggtc

SEQ ID NO: 127692 - DNA, 20 bp, Artificial Sequence
  chemically synthesized
aggcccttgaccaaattcaa

SEQ ID NO: 127693 - DNA, 20 bp, Artificial Sequence
  chemically synthesized
gcatgaagggctgttgaatt

SEQ ID NO: 127694 - DNA, 20 bp, Artificial Sequence
  chemically synthesized
tcgagagtttttagcatgaa

SEQ ID NO: 127695 - DNA, 20 bp, Artificial Sequence
  chemically synthesized
atcgagagtttttagcatga

SEQ ID NO: 127696 - DNA, 20 bp, Artificial Sequence
  chemically synthesized
tatcgagagtttttagcatg

SEQ ID NO: 127697 - DNA, 20 bp, Artificial Sequence
  chemically synthesized
cctaatttatcgagagtttt

SEQ ID NO: 127698 - DNA, 20 bp, Artificial Sequence
  chemically synthesized
atcaatacctaatttatcga

SEQ ID NO: 127699 - DNA, 20 bp, Artificial Sequence
  chemically synthesized
gctaaaaactctcgataaat

SEQ ID NO: 127700 - DNA, 20 bp, Artificial Sequence
  chemically synthesized
ccatcaatacctaatttatc

SEQ ID NO: 127701 - DNA, 20 bp, Artificial Sequence
  chemically synthesized
ctaaaaactctcgataaatt

SEQ ID NO: 127702 - DNA, 20 bp, Artificial Sequence
  chemically synthesized
ctcgataaattaggtattga

SEQ ID NO: 127703 - DNA, 20 bp, Artificial Sequence
  chemically synthesized
tcgataaattaggtattgat

SEQ ID NO: 127704 - DNA, 20 bp, Artificial Sequence
  chemically synthesized
tgatgggacgtatctcaaaa

SEQ ID NO: 127705 - DNA, 20 bp, Artificial Sequence
  chemically synthesized
taaatagctcttactatttt

SEQ ID NO: 127706 - DNA, 20 bp, Artificial Sequence
  chemically synthesized
gggacgtatctcaaaatagt

SEQ ID NO: 127707 - DNA, 20 bp, Artificial Sequence
  chemically synthesized
gacgtatctcaaaatagtaa

SEQ ID NO: 127708 - DNA, 20 bp, Artificial Sequence
  chemically synthesized
ggctgtgggtttgtcataaa

SEQ ID NO: 127709 - DNA, 20 bp, Artificial Sequence
  chemically synthesized
agctatttatgacaaaccca

SEQ ID NO: 127710 - DNA, 20 bp, Artificial Sequence
  chemically synthesized
ttcagtatgatattggctgt

SEQ ID NO: 127711 - DNA, 20 bp, Artificial Sequence
  chemically synthesized
attcagtatgatattggctg

SEQ ID NO: 127712 - DNA, 20 bp, Artificial Sequence
  chemically synthesized
ttgcccattcagtatgatat

SEQ ID NO: 127713 - DNA, 20 bp, Artificial Sequence
  chemically synthesized
acagccaatatcatactgaa

SEQ ID NO: 127714 - DNA, 20 bp, Artificial Sequence
  chemically synthesized
cagccaatatcatactgaat

SEQ ID NO: 127715 - DNA, 20 bp, Artificial Sequence
  chemically synthesized
tgcttccagttttgcccatt

SEQ ID NO: 127716 - DNA, 20 bp, Artificial Sequence
  chemically synthesized
tcatactgaatgggcaaaac

SEQ ID NO: 127717 - DNA, 20 bp, Artificial Sequence
  chemically synthesized
tactgaatgggcaaaactgg

SEQ ID NO: 127718 - DNA, 20 bp, Artificial Sequence
  chemically synthesized
gttttcaaagggaatgcttc

SEQ ID NO: 127719 - DNA, 20 bp, Artificial Sequence
  chemically synthesized
gtcttgtgccagttttcaaa

SEQ ID NO: 127720 - DNA, 20 bp, Artificial Sequence
  chemically synthesized
tgtcttgtgccagttttcaa

SEQ ID NO: 127721 - DNA, 20 bp, Artificial Sequence
  chemically synthesized
gaagcattccctttgaaaac

SEQ ID NO: 127722 - DNA, 20 bp, Artificial Sequence
  chemically synthesized
ctgtcttgtgccagttttca

SEQ ID NO: 127723 - DNA, 20 bp, Artificial Sequence
  chemically synthesized
ttccctttgaaaactggcac

SEQ ID NO: 127724 - DNA, 20 bp, Artificial Sequence
  chemically synthesized
agggcatccctgtcttgtgc

SEQ ID NO: 127725 - DNA, 20 bp, Artificial Sequence
  chemically synthesized
ctttgaaaactggcacaaga

SEQ ID NO: 127726 - DNA, 20 bp, Artificial Sequence
  chemically synthesized
tttgaaaactggcacaagac

SEQ ID NO: 127727 - DNA, 20 bp, Artificial Sequence
  chemically synthesized
ttgaaaactggcacaagaca

SEQ ID NO: 127728 - DNA, 20 bp, Artificial Sequence
  chemically synthesized
tgaataggagtggtgagaga

SEQ ID NO: 127729 - DNA, 20 bp, Artificial Sequence
  chemically synthesized
ttgaataggagtggtgagag

SEQ ID NO: 127730 - DNA, 20 bp, Artificial Sequence
  chemically synthesized
gttgaataggagtggtgaga

SEQ ID NO: 127731 - DNA, 20 bp, Artificial Sequence
  chemically synthesized
atgttgaataggagtggtga

SEQ ID NO: 127732 - DNA, 20 bp, Artificial Sequence
  chemically synthesized
ctatgttgaataggagtggt

SEQ ID NO: 127733 - DNA, 20 bp, Artificial Sequence
  chemically synthesized
aacactatgttgaataggag

SEQ ID NO: 127734 - DNA, 20 bp, Artificial Sequence
  chemically synthesized
tccaacactatgttgaatag

SEQ ID NO: 127735 - DNA, 20 bp, Artificial Sequence
  chemically synthesized
cttccaacactatgttgaat

SEQ ID NO: 127736 - DNA, 20 bp, Artificial Sequence
  chemically synthesized
ctcaccactcctattcaaca

SEQ ID NO: 127737 - DNA, 20 bp, Artificial Sequence
  chemically synthesized
acttccaacactatgttgaa

SEQ ID NO: 127738 - DNA, 20 bp, Artificial Sequence
  chemically synthesized
actcctattcaacatagtgt

SEQ ID NO: 127739 - DNA, 20 bp, Artificial Sequence
  chemically synthesized
cctattcaacatagtgttgg

SEQ ID NO: 127740 - DNA, 20 bp, Artificial Sequence
  chemically synthesized
caacatagtgttggaagttc

SEQ ID NO: 127741 - DNA, 20 bp, Artificial Sequence
  chemically synthesized
atagtgttggaagttctggc

SEQ ID NO: 127742 - DNA, 20 bp, Artificial Sequence
  chemically synthesized
tagtgttggaagttctggcc

SEQ ID NO: 127743 - DNA, 20 bp, Artificial Sequence
  chemically synthesized
agtgttggaagttctggcca

SEQ ID NO: 127744 - DNA, 20 bp, Artificial Sequence
  chemically synthesized
tcctgcctgatcgccctggc

SEQ ID NO: 127745 - DNA, 20 bp, Artificial Sequence
  chemically synthesized
gaagttctggccagggcgat

SEQ ID NO: 127746 - DNA, 20 bp, Artificial Sequence
  chemically synthesized
tttttcctgcctgatcgccc

SEQ ID NO: 127747 - DNA, 20 bp, Artificial Sequence
  chemically synthesized
aagttctggccagggcgatc

SEQ ID NO: 127748 - DNA, 20 bp, Artificial Sequence
  chemically synthesized
ttctggccagggcgatcagg

SEQ ID NO: 127749 - DNA, 20 bp, Artificial Sequence
  chemically synthesized
tctggccagggcgatcaggc

SEQ ID NO: 127750 - DNA, 20 bp, Artificial Sequence
  chemically synthesized
cagggcgatcaggcaggaaa

SEQ ID NO: 127751 - DNA, 20 bp, Artificial Sequence
  chemically synthesized
tcaggcaggaaaaagaaata

SEQ ID NO: 127752 - DNA, 20 bp, Artificial Sequence
  chemically synthesized
caggcaggaaaaagaaataa

SEQ ID NO: 127753 - DNA, 20 bp, Artificial Sequence
  chemically synthesized
aggcaggaaaaagaaataaa

SEQ ID NO: 127754 - DNA, 20 bp, Artificial Sequence
  chemically synthesized
agaaataaagggtattcaat

SEQ ID NO: 127755 - DNA, 20 bp, Artificial Sequence
  chemically synthesized
gaaataaagggtattcaatt

SEQ ID NO: 127756 - DNA, 20 bp, Artificial Sequence
  chemically synthesized
aaagggtattcaattaggaa

SEQ ID NO: 127757 - DNA, 20 bp, Artificial Sequence
  chemically synthesized
agggtattcaattaggaaaa

SEQ ID NO: 127758 - DNA, 20 bp, Artificial Sequence
  chemically synthesized
gggtattcaattaggaaaag

SEQ ID NO: 127759 - DNA, 20 bp, Artificial Sequence
  chemically synthesized
tattcaattaggaaaagagg

SEQ ID NO: 127760 - DNA, 20 bp, Artificial Sequence
  chemically synthesized
agtcaaattgtccctgtttg

SEQ ID NO: 127761 - DNA, 20 bp, Artificial Sequence
  chemically synthesized
aatcatgtcgtctgcaaaca

SEQ ID NO: 127762 - DNA, 20 bp, Artificial Sequence
  chemically synthesized
caatcatgtcgtctgcaaac

SEQ ID NO: 127763 - DNA, 20 bp, Artificial Sequence
  chemically synthesized
acaatcatgtcgtctgcaaa

SEQ ID NO: 127764 - DNA, 20 bp, Artificial Sequence
  chemically synthesized
agacgacatgattgtatatt

SEQ ID NO: 127765 - DNA, 20 bp, Artificial Sequence
  chemically synthesized
gattttgggctgagacgatg

SEQ ID NO: 127766 - DNA, 20 bp, Artificial Sequence
  chemically synthesized
tttagaaaaccccatcgtct

SEQ ID NO: 127767 - DNA, 20 bp, Artificial Sequence
  chemically synthesized
agattttgggctgagacgat

SEQ ID NO: 127768 - DNA, 20 bp, Artificial Sequence
  chemically synthesized
gagattttgggctgagacga

SEQ ID NO: 127769 - DNA, 20 bp, Artificial Sequence
  chemically synthesized
gcttaaggagattttgggct

SEQ ID NO: 127770 - DNA, 20 bp, Artificial Sequence
  chemically synthesized
tatcagcttaaggagatttt

SEQ ID NO: 127771 - DNA, 20 bp, Artificial Sequence
  chemically synthesized
ttatcagcttaaggagattt

SEQ ID NO: 127772 - DNA, 20 bp, Artificial Sequence
  chemically synthesized
tctcagcccaaaatctcctt

SEQ ID NO: 127773 - DNA, 20 bp, Artificial Sequence
  chemically synthesized
aagttgcttatcagcttaag

SEQ ID NO: 127774 - DNA, 20 bp, Artificial Sequence
  chemically synthesized
tgaagttgcttatcagctta

SEQ ID NO: 127775 - DNA, 20 bp, Artificial Sequence
  chemically synthesized
ctgaagttgcttatcagctt

SEQ ID NO: 127776 - DNA, 20 bp, Artificial Sequence
  chemically synthesized
caaaatctccttaagctgat

SEQ ID NO: 127777 - DNA, 20 bp, Artificial Sequence
  chemically synthesized
actttgctgaagttgcttat

SEQ ID NO: 127778 - DNA, 20 bp, Artificial Sequence
  chemically synthesized
cttaagctgataagcaactt

SEQ ID NO: 127779 - DNA, 20 bp, Artificial Sequence
  chemically synthesized
gctgataagcaacttcagca

SEQ ID NO: 127780 - DNA, 20 bp, Artificial Sequence
  chemically synthesized
tatatcctgagactttgctg

SEQ ID NO: 127781 - DNA, 20 bp, Artificial Sequence
  chemically synthesized
aagcaacttcagcaaagtct

SEQ ID NO: 127782 - DNA, 20 bp, Artificial Sequence
  chemically synthesized
agcaacttcagcaaagtctc

SEQ ID NO: 127783 - DNA, 20 bp, Artificial Sequence
  chemically synthesized
gcacattgattttatatcct

SEQ ID NO: 127784 - DNA, 20 bp, Artificial Sequence
  chemically synthesized
aatcaatgtgcaaaaatcac

SEQ ID NO: 127785 - DNA, 20 bp, Artificial Sequence
  chemically synthesized
tttgtctgttattggtgtat

SEQ ID NO: 127786 - DNA, 20 bp, Artificial Sequence
  chemically synthesized
gcattcttatacaccaataa

SEQ ID NO: 127787 - DNA, 20 bp, Artificial Sequence
  chemically synthesized
gctctctgtttgtctgttat

SEQ ID NO: 127788 - DNA, 20 bp, Artificial Sequence
  chemically synthesized
atacaccaataacagacaaa

SEQ ID NO: 127789 - DNA, 20 bp, Artificial Sequence
  chemically synthesized
acaccaataacagacaaaca

SEQ ID NO: 127790 - DNA, 20 bp, Artificial Sequence
  chemically synthesized
accaataacagacaaacaga

SEQ ID NO: 127791 - DNA, 20 bp, Artificial Sequence
  chemically synthesized
caaacagagagccaaatcat

SEQ ID NO: 127792 - DNA, 20 bp, Artificial Sequence
  chemically synthesized
atgagagttcactcatgatt

SEQ ID NO: 127793 - DNA, 20 bp, Artificial Sequence
  chemically synthesized
tttgaagcaattgtgaatga

SEQ ID NO: 127794 - DNA, 20 bp, Artificial Sequence
  chemically synthesized
tctttgaagcaattgtgaat

SEQ ID NO: 127795 - DNA, 20 bp, Artificial Sequence
  chemically synthesized
tctcattcacaattgcttca

SEQ ID NO: 127796 - DNA, 20 bp, Artificial Sequence
  chemically synthesized
tcattcacaattgcttcaaa

SEQ ID NO: 127797 - DNA, 20 bp, Artificial Sequence
  chemically synthesized
taggtattttattctctttg

SEQ ID NO: 127798 - DNA, 20 bp, Artificial Sequence
  chemically synthesized
cccttgtaagttgtatttgt

SEQ ID NO: 127799 - DNA, 20 bp, Artificial Sequence
  chemically synthesized
tcccttgtaagttgtatttg

SEQ ID NO: 127800 - DNA, 20 bp, Artificial Sequence
  chemically synthesized
tacctacaaatacaacttac

SEQ ID NO: 127801 - DNA, 20 bp, Artificial Sequence
  chemically synthesized
acctacaaatacaacttaca

SEQ ID NO: 127802 - DNA, 20 bp, Artificial Sequence
  chemically synthesized
cctacaaatacaacttacaa

SEQ ID NO: 127803 - DNA, 20 bp, Artificial Sequence
  chemically synthesized
aggtccttcacatcccttgt

SEQ ID NO: 127804 - DNA, 20 bp, Artificial Sequence
  chemically synthesized
tacaacttacaagggatgtg

SEQ ID NO: 127805 - DNA, 20 bp, Artificial Sequence
  chemically synthesized
acaacttacaagggatgtga

SEQ ID NO: 127806 - DNA, 20 bp, Artificial Sequence
  chemically synthesized
gggatgtgaaggacctcttc

SEQ ID NO: 127807 - DNA, 20 bp, Artificial Sequence
  chemically synthesized
ggatgtgaaggacctcttca

SEQ ID NO: 127808 - DNA, 20 bp, Artificial Sequence
  chemically synthesized
atgtgaaggacctcttcaag

SEQ ID NO: 127809 - DNA, 20 bp, Artificial Sequence
  chemically synthesized
gtttgtagttctccttgaag

SEQ ID NO: 127810 - DNA, 20 bp, Artificial Sequence
  chemically synthesized
ggtttgtagttctccttgaa

SEQ ID NO: 127811 - DNA, 20 bp, Artificial Sequence
  chemically synthesized
gtggtttgtagttctccttg

SEQ ID NO: 127812 - DNA, 20 bp, Artificial Sequence
  chemically synthesized
tttccttgagcagtggtttg

SEQ ID NO: 127813 - DNA, 20 bp, Artificial Sequence
  chemically synthesized
agaactacaaaccactgctc

SEQ ID NO: 127814 - DNA, 20 bp, Artificial Sequence
  chemically synthesized
gaactacaaaccactgctca

SEQ ID NO: 127815 - DNA, 20 bp, Artificial Sequence
  chemically synthesized
tcttttatttccttgagcag

SEQ ID NO: 127816 - DNA, 20 bp, Artificial Sequence
  chemically synthesized
tcctcttttatttccttgag

SEQ ID NO: 127817 - DNA, 20 bp, Artificial Sequence
  chemically synthesized
gtgtcctcttttatttcctt

SEQ ID NO: 127818 - DNA, 20 bp, Artificial Sequence
  chemically synthesized
accactgctcaaggaaataa

SEQ ID NO: 127819 - DNA, 20 bp, Artificial Sequence
  chemically synthesized
cactgctcaaggaaataaaa

SEQ ID NO: 127820 - DNA, 20 bp, Artificial Sequence
  chemically synthesized
actgctcaaggaaataaaag

SEQ ID NO: 127821 - DNA, 20 bp, Artificial Sequence
  chemically synthesized
taaaagaggacacaaacaaa

SEQ ID NO: 127822 - DNA, 20 bp, Artificial Sequence
  chemically synthesized
aagaggacacaaacaaatgg

SEQ ID NO: 127823 - DNA, 20 bp, Artificial Sequence
  chemically synthesized
ggaagaacattccatgctca

SEQ ID NO: 127824 - DNA, 20 bp, Artificial Sequence
  chemically synthesized
attcttcctatccatgagca

SEQ ID NO: 127825 - DNA, 20 bp, Artificial Sequence
  chemically synthesized
gaacattccatgctcatgga

SEQ ID NO: 127826 - DNA, 20 bp, Artificial Sequence
  chemically synthesized
aacattccatgctcatggat

SEQ ID NO: 127827 - DNA, 20 bp, Artificial Sequence
  chemically synthesized
tattgattcttcctatccat

SEQ ID NO: 127828 - DNA, 20 bp, Artificial Sequence
  chemically synthesized
attccatgctcatggatagg

SEQ ID NO: 127829 - DNA, 20 bp, Artificial Sequence
  chemically synthesized
aagaatcaatatcgtgaaaa

SEQ ID NO: 127830 - DNA, 20 bp, Artificial Sequence
  chemically synthesized
ataaatttccttgggcagta

SEQ ID NO: 127831 - DNA, 20 bp, Artificial Sequence
  chemically synthesized
tgaaaatggccatactgccc

SEQ ID NO: 127832 - DNA, 20 bp, Artificial Sequence
  chemically synthesized
gaaaatggccatactgccca

SEQ ID NO: 127833 - DNA, 20 bp, Artificial Sequence
  chemically synthesized
aatctataaatttccttggg

SEQ ID NO: 127834 - DNA, 20 bp, Artificial Sequence
  chemically synthesized
ttgaatctataaatttcctt

SEQ ID NO: 127835 - DNA, 20 bp, Artificial Sequence
  chemically synthesized
attgaatctataaatttcct

SEQ ID NO: 127836 - DNA, 20 bp, Artificial Sequence
  chemically synthesized
atactgcccaaggaaattta

SEQ ID NO: 127837 - DNA, 20 bp, Artificial Sequence
  chemically synthesized
cattggtagcttgatgggga

SEQ ID NO: 127838 - DNA, 20 bp, Artificial Sequence
  chemically synthesized
gattcaatgccatccccatc

SEQ ID NO: 127839 - DNA, 20 bp, Artificial Sequence
  chemically synthesized
aagtcattggtagcttgatg

SEQ ID NO: 127840 - DNA, 20 bp, Artificial Sequence
  chemically synthesized
aaagtcattggtagcttgat

SEQ ID NO: 127841 - DNA, 20 bp, Artificial Sequence
  chemically synthesized
gaaagtcattggtagcttga

SEQ ID NO: 127842 - DNA, 20 bp, Artificial Sequence
  chemically synthesized
tctgtgaagaaagtcattgg

SEQ ID NO: 127843 - DNA, 20 bp, Artificial Sequence
  chemically synthesized
aattctgtgaagaaagtcat

SEQ ID NO: 127844 - DNA, 20 bp, Artificial Sequence
  chemically synthesized
gctaccaatgactttcttca

SEQ ID NO: 127845 - DNA, 20 bp, Artificial Sequence
  chemically synthesized
tttttccaattctgtgaaga

SEQ ID NO: 127846 - DNA, 20 bp, Artificial Sequence
  chemically synthesized
tagttttttccaattctgtg

SEQ ID NO: 127847 - DNA, 20 bp, Artificial Sequence
  chemically synthesized
aatgactttcttcacagaat

SEQ ID NO: 127848 - DNA, 20 bp, Artificial Sequence
  chemically synthesized
aattggaaaaaactacttta

SEQ ID NO: 127849 - DNA, 20 bp, Artificial Sequence
  chemically synthesized
gttccatatgaactttaaag

SEQ ID NO: 127850 - DNA, 20 bp, Artificial Sequence
  chemically synthesized
ttggttccatatgaacttta

SEQ ID NO: 127851 - DNA, 20 bp, Artificial Sequence
  chemically synthesized
aaactactttaaagttcata

SEQ ID NO: 127852 - DNA, 20 bp, Artificial Sequence
  chemically synthesized
aagttcatatggaaccaaaa

SEQ ID NO: 127853 - DNA, 20 bp, Artificial Sequence
  chemically synthesized
gttcatatggaaccaaaaaa

SEQ ID NO: 127854 - DNA, 20 bp, Artificial Sequence
  chemically synthesized
tggcaatgtgggctcttttt

SEQ ID NO: 127855 - DNA, 20 bp, Artificial Sequence
  chemically synthesized
caggattgtcttggcaatgt

SEQ ID NO: 127856 - DNA, 20 bp, Artificial Sequence
  chemically synthesized
aaaaaagagcccacattgcc

SEQ ID NO: 127857 - DNA, 20 bp, Artificial Sequence
  chemically synthesized
tcaggattgtcttggcaatg

SEQ ID NO: 127858 - DNA, 20 bp, Artificial Sequence
  chemically synthesized
cttttggctcaggattgtct

SEQ ID NO: 127859 - DNA, 20 bp, Artificial Sequence
  chemically synthesized
cacattgccaagacaatcct

SEQ ID NO: 127860 - DNA, 20 bp, Artificial Sequence
  chemically synthesized
ccaagacaatcctgagccaa

SEQ ID NO: 127861 - DNA, 20 bp, Artificial Sequence
  chemically synthesized
cagctttgttcttttggctc

SEQ ID NO: 127862 - DNA, 20 bp, Artificial Sequence
  chemically synthesized
ccagctttgttcttttggct

SEQ ID NO: 127863 - DNA, 20 bp, Artificial Sequence
  chemically synthesized
tgcctccagctttgttcttt

SEQ ID NO: 127864 - DNA, 20 bp, Artificial Sequence
  chemically synthesized
aatcctgagccaaaagaaca

SEQ ID NO: 127865 - DNA, 20 bp, Artificial Sequence
  chemically synthesized
ctgagccaaaagaacaaagc

SEQ ID NO: 127866 - DNA, 20 bp, Artificial Sequence
  chemically synthesized
gagccaaaagaacaaagctg

SEQ ID NO: 127867 - DNA, 20 bp, Artificial Sequence
  chemically synthesized
agccaaaagaacaaagctgg

SEQ ID NO: 127868 - DNA, 20 bp, Artificial Sequence
  chemically synthesized
gtcaggtagcgtgatgcctc

SEQ ID NO: 127869 - DNA, 20 bp, Artificial Sequence
  chemically synthesized
tagtatagtttgaagtcagg

SEQ ID NO: 127870 - DNA, 20 bp, Artificial Sequence
  chemically synthesized
ttgtagtatagtttgaagtc

SEQ ID NO: 127871 - DNA, 20 bp, Artificial Sequence
  chemically synthesized
cttgtagtatagtttgaagt

SEQ ID NO: 127872 - DNA, 20 bp, Artificial Sequence
  chemically synthesized
tagccttgtagtatagtttg

SEQ ID NO: 127873 - DNA, 20 bp, Artificial Sequence
  chemically synthesized
ctgacttcaaactatactac

SEQ ID NO: 127874 - DNA, 20 bp, Artificial Sequence
  chemically synthesized
tgacttcaaactatactaca

SEQ ID NO: 127875 - DNA, 20 bp, Artificial Sequence
  chemically synthesized
gttaccgtagccttgtagta

SEQ ID NO: 127876 - DNA, 20 bp, Artificial Sequence
  chemically synthesized
ttttggttaccgtagccttg

SEQ ID NO: 127877 - DNA, 20 bp, Artificial Sequence
  chemically synthesized
caaactatactacaaggcta

SEQ ID NO: 127878 - DNA, 20 bp, Artificial Sequence
  chemically synthesized
ccatgctgttttggttaccg

SEQ ID NO: 127879 - DNA, 20 bp, Artificial Sequence
  chemically synthesized
caaggctacggtaaccaaaa

SEQ ID NO: 127880 - DNA, 20 bp, Artificial Sequence
  chemically synthesized
gtaccagtaccatgctgttt

SEQ ID NO: 127881 - DNA, 20 bp, Artificial Sequence
  chemically synthesized
ctacggtaaccaaaacagca

SEQ ID NO: 127882 - DNA, 20 bp, Artificial Sequence
  chemically synthesized
taaccaaaacagcatggtac

SEQ ID NO: 127883 - DNA, 20 bp, Artificial Sequence
  chemically synthesized
gtatatctctgttttggtac

SEQ ID NO: 127884 - DNA, 20 bp, Artificial Sequence
  chemically synthesized
gcatggtactggtaccaaaa

SEQ ID NO: 127885 - DNA, 20 bp, Artificial Sequence
  chemically synthesized
atggtactggtaccaaaaca

SEQ ID NO: 127886 - DNA, 20 bp, Artificial Sequence
  chemically synthesized
attggtgtatatctctgttt

SEQ ID NO: 127887 - DNA, 20 bp, Artificial Sequence
  chemically synthesized
aaaacagagatatacaccaa

SEQ ID NO: 127888 - DNA, 20 bp, Artificial Sequence
  chemically synthesized
agagatatacaccaatggaa

SEQ ID NO: 127889 - DNA, 20 bp, Artificial Sequence
  chemically synthesized
agagctctgttctgttccat

SEQ ID NO: 127890 - DNA, 20 bp, Artificial Sequence
  chemically synthesized
tatacaccaatggaacagaa

SEQ ID NO: 127891 - DNA, 20 bp, Artificial Sequence
  chemically synthesized
tacaccaatggaacagaaca

SEQ ID NO: 127892 - DNA, 20 bp, Artificial Sequence
  chemically synthesized
atggaacagaacagagctct

SEQ ID NO: 127893 - DNA, 20 bp, Artificial Sequence
  chemically synthesized
atgtgtggtattatttctga

SEQ ID NO: 127894 - DNA, 20 bp, Artificial Sequence
  chemically synthesized
agatgtgtggtattatttct

SEQ ID NO: 127895 - DNA, 20 bp, Artificial Sequence
  chemically synthesized
atcagatggttgtagatgtg

SEQ ID NO: 127896 - DNA, 20 bp, Artificial Sequence
  chemically synthesized
tgtcaaagatcagatggttg

SEQ ID NO: 127897 - DNA, 20 bp, Artificial Sequence
  chemically synthesized
caggtttgtcaaagatcaga

SEQ ID NO: 127898 - DNA, 20 bp, Artificial Sequence
  chemically synthesized
ttgtcaggtttgtcaaagat

SEQ ID NO: 127899 - DNA, 20 bp, Artificial Sequence
  chemically synthesized
tgtttttgtcaggtttgtca

SEQ ID NO: 127900 - DNA, 20 bp, Artificial Sequence
  chemically synthesized
ccccatttcttgtttttgtc

SEQ ID NO: 127901 - DNA, 20 bp, Artificial Sequence
  chemically synthesized
tccccatttcttgtttttgt

SEQ ID NO: 127902 - DNA, 20 bp, Artificial Sequence
  chemically synthesized
ttgacaaacctgacaaaaac

SEQ ID NO: 127903 - DNA, 20 bp, Artificial Sequence
  chemically synthesized
aacctgacaaaaacaagaaa

SEQ ID NO: 127904 - DNA, 20 bp, Artificial Sequence
  chemically synthesized
acctgacaaaaacaagaaat

SEQ ID NO: 127905 - DNA, 20 bp, Artificial Sequence
  chemically synthesized
cctgacaaaaacaagaaatg

SEQ ID NO: 127906 - DNA, 20 bp, Artificial Sequence
  chemically synthesized
acaaaaacaagaaatgggga

SEQ ID NO: 127907 - DNA, 20 bp, Artificial Sequence
  chemically synthesized
caaaaacaagaaatggggaa

SEQ ID NO: 127908 - DNA, 20 bp, Artificial Sequence
  chemically synthesized
ccagcaccatttattaaata

SEQ ID NO: 127909 - DNA, 20 bp, Artificial Sequence
  chemically synthesized
cccagcaccatttattaaat

SEQ ID NO: 127910 - DNA, 20 bp, Artificial Sequence
  chemically synthesized
tcccagcaccatttattaaa

SEQ ID NO: 127911 - DNA, 20 bp, Artificial Sequence
  chemically synthesized
aggattccctatttaataaa

SEQ ID NO: 127912 - DNA, 20 bp, Artificial Sequence
  chemically synthesized
ccctatttaataaatggtgc

SEQ ID NO: 127913 - DNA, 20 bp, Artificial Sequence
  chemically synthesized
cctatttaataaatggtgct

SEQ ID NO: 127914 - DNA, 20 bp, Artificial Sequence
  chemically synthesized
ataaatggtgctgggaaaac

SEQ ID NO: 127915 - DNA, 20 bp, Artificial Sequence
  chemically synthesized
atatggctagccagttttcc

SEQ ID NO: 127916 - DNA, 20 bp, Artificial Sequence
  chemically synthesized
atggtgctgggaaaactggc

SEQ ID NO: 127917 - DNA, 20 bp, Artificial Sequence
  chemically synthesized
gctctctacatatggctagc

SEQ ID NO: 127918 - DNA, 20 bp, Artificial Sequence
  chemically synthesized
ttcagctctctacatatggc

SEQ ID NO: 127919 - DNA, 20 bp, Artificial Sequence
  chemically synthesized
gaaaactggctagccatatg

SEQ ID NO: 127920 - DNA, 20 bp, Artificial Sequence
  chemically synthesized
aaactggctagccatatgta

SEQ ID NO: 127921 - DNA, 20 bp, Artificial Sequence
  chemically synthesized
cagtttcagctctctacata

SEQ ID NO: 127922 - DNA, 20 bp, Artificial Sequence
  chemically synthesized
actggctagccatatgtaga

SEQ ID NO: 127923 - DNA, 20 bp, Artificial Sequence
  chemically synthesized
catatgtagagagctgaaac

SEQ ID NO: 127924 - DNA, 20 bp, Artificial Sequence
  chemically synthesized
ataaggaagggatccagttt

SEQ ID NO: 127925 - DNA, 20 bp, Artificial Sequence
  chemically synthesized
tatggtataaggaagggatc

SEQ ID NO: 127926 - DNA, 20 bp, Artificial Sequence
  chemically synthesized
tttgtatatggtataaggaa

SEQ ID NO: 127927 - DNA, 20 bp, Artificial Sequence
  chemically synthesized
ttttgtatatggtataagga

SEQ ID NO: 127928 - DNA, 20 bp, Artificial Sequence
  chemically synthesized
tttttgtatatggtataagg

SEQ ID NO: 127929 - DNA, 20 bp, Artificial Sequence
  chemically synthesized
taatttttgtatatggtata

SEQ ID NO: 127930 - DNA, 20 bp, Artificial Sequence
  chemically synthesized
ttaatttttgtatatggtat

SEQ ID NO: 127931 - DNA, 20 bp, Artificial Sequence
  chemically synthesized
cttgaattaatttttgtata

SEQ ID NO: 127932 - DNA, 20 bp, Artificial Sequence
  chemically synthesized
ccatatacaaaaattaattc

SEQ ID NO: 127933 - DNA, 20 bp, Artificial Sequence
  chemically synthesized
atacaaaaattaattcaaga

SEQ ID NO: 127934 - DNA, 20 bp, Artificial Sequence
  chemically synthesized
aattaattcaagatggattg

SEQ ID NO: 127935 - DNA, 20 bp, Artificial Sequence
  chemically synthesized
atggattgaagacttaatgt

SEQ ID NO: 127936 - DNA, 20 bp, Artificial Sequence
  chemically synthesized
atggttttaggtctaacatt

SEQ ID NO: 127937 - DNA, 20 bp, Artificial Sequence
  chemically synthesized
tctagggtttttatggtttt

SEQ ID NO: 127938 - DNA, 20 bp, Artificial Sequence
  chemically synthesized
ttctagggtttttatggttt

SEQ ID NO: 127939 - DNA, 20 bp, Artificial Sequence
  chemically synthesized
gttttcttctagggttttta

SEQ ID NO: 127940 - DNA, 20 bp, Artificial Sequence
  chemically synthesized
acctaaaaccataaaaaccc

SEQ ID NO: 127941 - DNA, 20 bp, Artificial Sequence
  chemically synthesized
taaaaccataaaaaccctag

SEQ ID NO: 127942 - DNA, 20 bp, Artificial Sequence
  chemically synthesized
attgcctaggttttcttcta

SEQ ID NO: 127943 - DNA, 20 bp, Artificial Sequence
  chemically synthesized
tattgcctaggttttcttct

SEQ ID NO: 127944 - DNA, 20 bp, Artificial Sequence
  chemically synthesized
gtattgcctaggttttcttc

SEQ ID NO: 127945 - DNA, 20 bp, Artificial Sequence
  chemically synthesized
aaaaaccctagaagaaaacc

SEQ ID NO: 127946 - DNA, 20 bp, Artificial Sequence
  chemically synthesized
aaaaccctagaagaaaacct

SEQ ID NO: 127947 - DNA, 20 bp, Artificial Sequence
  chemically synthesized
cgtcctgaatggtattgcct

SEQ ID NO: 127948 - DNA, 20 bp, Artificial Sequence
  chemically synthesized
acgtcctgaatggtattgcc

SEQ ID NO: 127949 - DNA, 20 bp, Artificial Sequence
  chemically synthesized
aaaacctaggcaataccatt

SEQ ID NO: 127950 - DNA, 20 bp, Artificial Sequence
  chemically synthesized
aaacctaggcaataccattc

SEQ ID NO: 127951 - DNA, 20 bp, Artificial Sequence
  chemically synthesized
gcccatgcctacgtcctgaa

SEQ ID NO: 127952 - DNA, 20 bp, Artificial Sequence
  chemically synthesized
aggcaataccattcaggacg

SEQ ID NO: 127953 - DNA, 20 bp, Artificial Sequence
  chemically synthesized
ggcaataccattcaggacgt

SEQ ID NO: 127954 - DNA, 20 bp, Artificial Sequence
  chemically synthesized
taccattcaggacgtaggca

SEQ ID NO: 127955 - DNA, 20 bp, Artificial Sequence
  chemically synthesized
accattcaggacgtaggcat

SEQ ID NO: 127956 - DNA, 20 bp, Artificial Sequence
  chemically synthesized
ttcaggacgtaggcatgggc

SEQ ID NO: 127957 - DNA, 20 bp, Artificial Sequence
  chemically synthesized
tcaggacgtaggcatgggca

SEQ ID NO: 127958 - DNA, 20 bp, Artificial Sequence
  chemically synthesized
cttttggtgttttagacatg

SEQ ID NO: 127959 - DNA, 20 bp, Artificial Sequence
  chemically synthesized
tgccattgcttttggtgttt

SEQ ID NO: 127960 - DNA, 20 bp, Artificial Sequence
  chemically synthesized
cttcatgtctaaaacaccaa

SEQ ID NO: 127961 - DNA, 20 bp, Artificial Sequence
  chemically synthesized
gtctaaaacaccaaaagcaa

SEQ ID NO: 127962 - DNA, 20 bp, Artificial Sequence
  chemically synthesized
gcttttgttgccattgcttt

SEQ ID NO: 127963 - DNA, 20 bp, Artificial Sequence
  chemically synthesized
accaaaagcaatggcaacaa

SEQ ID NO: 127964 - DNA, 20 bp, Artificial Sequence
  chemically synthesized
aatggcaacaaaagccaaaa

SEQ ID NO: 127965 - DNA, 20 bp, Artificial Sequence
  chemically synthesized
tagatcccatttgtccgttt

SEQ ID NO: 127966 - DNA, 20 bp, Artificial Sequence
  chemically synthesized
caaaagccaaaacggacaaa

SEQ ID NO: 127967 - DNA, 20 bp, Artificial Sequence
  chemically synthesized
aaaagccaaaacggacaaat

SEQ ID NO: 127968 - DNA, 20 bp, Artificial Sequence
  chemically synthesized
cagaagctctttagtttcat

SEQ ID NO: 127969 - DNA, 20 bp, Artificial Sequence
  chemically synthesized
aatgggatctaatgaaacta

SEQ ID NO: 127970 - DNA, 20 bp, Artificial Sequence
  chemically synthesized
tgggatctaatgaaactaaa

SEQ ID NO: 127971 - DNA, 20 bp, Artificial Sequence
  chemically synthesized
tttgctgtgcagaagctctt

SEQ ID NO: 127972 - DNA, 20 bp, Artificial Sequence
  chemically synthesized
gaaactaaagagcttctgca

SEQ ID NO: 127973 - DNA, 20 bp, Artificial Sequence
  chemically synthesized
tagtttcttttgctgtgcag

SEQ ID NO: 127974 - DNA, 20 bp, Artificial Sequence
  chemically synthesized
tggtagtttcttttgctgtg

SEQ ID NO: 127975 - DNA, 20 bp, Artificial Sequence
  chemically synthesized
aaagagcttctgcacagcaa

SEQ ID NO: 127976 - DNA, 20 bp, Artificial Sequence
  chemically synthesized
acagcaaaagaaactaccat

SEQ ID NO: 127977 - DNA, 20 bp, Artificial Sequence
  chemically synthesized
agcaaaagaaactaccatca

SEQ ID NO: 127978 - DNA, 20 bp, Artificial Sequence
  chemically synthesized
ctgcctgttcactctgatgg

SEQ ID NO: 127979 - DNA, 20 bp, Artificial Sequence
  chemically synthesized
aggctgcctgttcactctga

SEQ ID NO: 127980 - DNA, 20 bp, Artificial Sequence
  chemically synthesized
gaaactaccatcagagtgaa

SEQ ID NO: 127981 - DNA, 20 bp, Artificial Sequence
  chemically synthesized
aaactaccatcagagtgaac

SEQ ID NO: 127982 - DNA, 20 bp, Artificial Sequence
  chemically synthesized
ctaccatcagagtgaacagg

SEQ ID NO: 127983 - DNA, 20 bp, Artificial Sequence
  chemically synthesized
cagagtgaacaggcagccta

SEQ ID NO: 127984 - DNA, 20 bp, Artificial Sequence
  chemically synthesized
tgaacaggcagcctacagaa

SEQ ID NO: 127985 - DNA, 20 bp, Artificial Sequence
  chemically synthesized
gaacaggcagcctacagaat

SEQ ID NO: 127986 - DNA, 20 bp, Artificial Sequence
  chemically synthesized
aaaattttctcccattctgt

SEQ ID NO: 127987 - DNA, 20 bp, Artificial Sequence
  chemically synthesized
aaaaattttctcccattctg

SEQ ID NO: 127988 - DNA, 20 bp, Artificial Sequence
  chemically synthesized
acaggcagcctacagaatgg

SEQ ID NO: 127989 - DNA, 20 bp, Artificial Sequence
  chemically synthesized
ttagccctttgtcagatgag

SEQ ID NO: 127990 - DNA, 20 bp, Artificial Sequence
  chemically synthesized
atattagccctttgtcagat

SEQ ID NO: 127991 - DNA, 20 bp, Artificial Sequence
  chemically synthesized
tgcaatctactcatctgaca

SEQ ID NO: 127992 - DNA, 20 bp, Artificial Sequence
  chemically synthesized
gcaatctactcatctgacaa

SEQ ID NO: 127993 - DNA, 20 bp, Artificial Sequence
  chemically synthesized
caatctactcatctgacaaa

SEQ ID NO: 127994 - DNA, 20 bp, Artificial Sequence
  chemically synthesized
tctggatattagccctttgt

SEQ ID NO: 127995 - DNA, 20 bp, Artificial Sequence
  chemically synthesized
tctgacaaagggctaatatc

SEQ ID NO: 127996 - DNA, 20 bp, Artificial Sequence
  chemically synthesized
tctttgtagattctggatat

SEQ ID NO: 127997 - DNA, 20 bp, Artificial Sequence
  chemically synthesized
tttgagttctttgtagattc

SEQ ID NO: 127998 - DNA, 20 bp, Artificial Sequence
  chemically synthesized
gctaatatccagaatctaca

SEQ ID NO: 127999 - DNA, 20 bp, Artificial Sequence
  chemically synthesized
aagtttgtttgagttctttg

SEQ ID NO: 128000 - DNA, 20 bp, Artificial Sequence
  chemically synthesized
tttttcttgtaagtttgttt

SEQ ID NO: 128001 - DNA, 20 bp, Artificial Sequence
  chemically synthesized
aagaactcaaacaaacttac

SEQ ID NO: 128002 - DNA, 20 bp, Artificial Sequence
  chemically synthesized
ggttgtttgttttttcttgt

SEQ ID NO: 128003 - DNA, 20 bp, Artificial Sequence
  chemically synthesized
aaacaaacaaccccatcaaa

SEQ ID NO: 128004 - DNA, 20 bp, Artificial Sequence
  chemically synthesized
ccttcgcccactttttgatg

SEQ ID NO: 128005 - DNA, 20 bp, Artificial Sequence
  chemically synthesized
tccttcgcccactttttgat

SEQ ID NO: 128006 - DNA, 20 bp, Artificial Sequence
  chemically synthesized
atccttcgcccactttttga

SEQ ID NO: 128007 - DNA, 20 bp, Artificial Sequence
  chemically synthesized
caaacaaccccatcaaaaag

SEQ ID NO: 128008 - DNA, 20 bp, Artificial Sequence
  chemically synthesized
aaacaaccccatcaaaaagt

SEQ ID NO: 128009 - DNA, 20 bp, Artificial Sequence
  chemically synthesized
accccatcaaaaagtgggcg

SEQ ID NO: 128010 - DNA, 20 bp, Artificial Sequence
  chemically synthesized
ccccatcaaaaagtgggcga

SEQ ID NO: 128011 - DNA, 20 bp, Artificial Sequence
  chemically synthesized
aagtgggcgaaggatatgaa

SEQ ID NO: 128012 - DNA, 20 bp, Artificial Sequence
  chemically synthesized
tatgaacagacacttctcaa

SEQ ID NO: 128013 - DNA, 20 bp, Artificial Sequence
  chemically synthesized
cataaatgtcttcttttgag

SEQ ID NO: 128014 - DNA, 20 bp, Artificial Sequence
  chemically synthesized
gaacagacacttctcaaaag

SEQ ID NO: 128015 - DNA, 20 bp, Artificial Sequence
  chemically synthesized
ctgcataaatgtcttctttt

SEQ ID NO: 128016 - DNA, 20 bp, Artificial Sequence
  chemically synthesized
ctcaaaagaagacatttatg

SEQ ID NO: 128017 - DNA, 20 bp, Artificial Sequence
  chemically synthesized
gaagacatttatgcagccaa

SEQ ID NO: 128018 - DNA, 20 bp, Artificial Sequence
  chemically synthesized
gcattttttcatgtgtcttt

SEQ ID NO: 128019 - DNA, 20 bp, Artificial Sequence
  chemically synthesized
ctctgatggccagtgatgat

SEQ ID NO: 128020 - DNA, 20 bp, Artificial Sequence
  chemically synthesized
gaaaaaatgctcatcatcac

SEQ ID NO: 128021 - DNA, 20 bp, Artificial Sequence
  chemically synthesized
tgctcatcatcactggccat

SEQ ID NO: 128022 - DNA, 20 bp, Artificial Sequence
  chemically synthesized
ctcatcatcactggccatca

SEQ ID NO: 128023 - DNA, 20 bp, Artificial Sequence
  chemically synthesized
atttgcgtttctctgatggc

SEQ ID NO: 128024 - DNA, 20 bp, Artificial Sequence
  chemically synthesized
tttgatttgcgtttctctga

SEQ ID NO: 128025 - DNA, 20 bp, Artificial Sequence
  chemically synthesized
acgcaaatcaaaaccacaat

SEQ ID NO: 128026 - DNA, 20 bp, Artificial Sequence
  chemically synthesized
tgtgagatggtatctcattg

SEQ ID NO: 128027 - DNA, 20 bp, Artificial Sequence
  chemically synthesized
ccattctaactggtgtgaga

SEQ ID NO: 128028 - DNA, 20 bp, Artificial Sequence
  chemically synthesized
aatgagataccatctcacac

SEQ ID NO: 128029 - DNA, 20 bp, Artificial Sequence
  chemically synthesized
attgccattctaactggtgt

SEQ ID NO: 128030 - DNA, 20 bp, Artificial Sequence
  chemically synthesized
agataccatctcacaccagt

SEQ ID NO: 128031 - DNA, 20 bp, Artificial Sequence
  chemically synthesized
ccatctcacaccagttagaa

SEQ ID NO: 128032 - DNA, 20 bp, Artificial Sequence
  chemically synthesized
ttaatgattgccattctaac

SEQ ID NO: 128033 - DNA, 20 bp, Artificial Sequence
  chemically synthesized
ttagaatggcaatcattaaa

SEQ ID NO: 128034 - DNA, 20 bp, Artificial Sequence
  chemically synthesized
aatggcaatcattaaaaagt

SEQ ID NO: 128035 - DNA, 20 bp, Artificial Sequence
  chemically synthesized
atggcaatcattaaaaagtc

SEQ ID NO: 128036 - DNA, 20 bp, Artificial Sequence
  chemically synthesized
attaaaaagtcaggaaacaa

SEQ ID NO: 128037 - DNA, 20 bp, Artificial Sequence
  chemically synthesized
ttaaaaagtcaggaaacaac

SEQ ID NO: 128038 - DNA, 20 bp, Artificial Sequence
  chemically synthesized
agtcaggaaacaacaggtgc

SEQ ID NO: 128039 - DNA, 20 bp, Artificial Sequence
  chemically synthesized
tcaggaaacaacaggtgctg

SEQ ID NO: 128040 - DNA, 20 bp, Artificial Sequence
  chemically synthesized
aggaaacaacaggtgctgga

SEQ ID NO: 128041 - DNA, 20 bp, Artificial Sequence
  chemically synthesized
ggaaacaacaggtgctggag

SEQ ID NO: 128042 - DNA, 20 bp, Artificial Sequence
  chemically synthesized
ctatttctccacatcctctc

SEQ ID NO: 128043 - DNA, 20 bp, Artificial Sequence
  chemically synthesized
aacaggtgctggagaggatg

SEQ ID NO: 128044 - DNA, 20 bp, Artificial Sequence
  chemically synthesized
caggtgctggagaggatgtg

SEQ ID NO: 128045 - DNA, 20 bp, Artificial Sequence
  chemically synthesized
ctggagaggatgtggagaaa

SEQ ID NO: 128046 - DNA, 20 bp, Artificial Sequence
  chemically synthesized
tggagaggatgtggagaaat

SEQ ID NO: 128047 - DNA, 20 bp, Artificial Sequence
  chemically synthesized
acagtctcactaacagtgta

SEQ ID NO: 128048 - DNA, 20 bp, Artificial Sequence
  chemically synthesized
ataggaacactttacactgt

SEQ ID NO: 128049 - DNA, 20 bp, Artificial Sequence
  chemically synthesized
gaacactttacactgttagt

SEQ ID NO: 128050 - DNA, 20 bp, Artificial Sequence
  chemically synthesized
ctagtttacagtctcactaa

SEQ ID NO: 128051 - DNA, 20 bp, Artificial Sequence
  chemically synthesized
ctgttagtgagactgtaaac

SEQ ID NO: 128052 - DNA, 20 bp, Artificial Sequence
  chemically synthesized
acaatggttgaactagttta

SEQ ID NO: 128053 - DNA, 20 bp, Artificial Sequence
  chemically synthesized
gacttccacaatggttgaac

SEQ ID NO: 128054 - DNA, 20 bp, Artificial Sequence
  chemically synthesized
gtaaactagttcaaccattg

SEQ ID NO: 128055 - DNA, 20 bp, Artificial Sequence
  chemically synthesized
aactagttcaaccattgtgg

SEQ ID NO: 128056 - DNA, 20 bp, Artificial Sequence
  chemically synthesized
cgccacactgacttccacaa

SEQ ID NO: 128057 - DNA, 20 bp, Artificial Sequence
  chemically synthesized
agttcaaccattgtggaagt

SEQ ID NO: 128058 - DNA, 20 bp, Artificial Sequence
  chemically synthesized
aaccattgtggaagtcagtg

SEQ ID NO: 128059 - DNA, 20 bp, Artificial Sequence
  chemically synthesized
aagtcagtgtggcgattcct

SEQ ID NO: 128060 - DNA, 20 bp, Artificial Sequence
  chemically synthesized
agtcagtgtggcgattcctc

SEQ ID NO: 128061 - DNA, 20 bp, Artificial Sequence
  chemically synthesized
gtcagtgtggcgattcctca

SEQ ID NO: 128062 - DNA, 20 bp, Artificial Sequence
  chemically synthesized
tttctagttctagatccctg

SEQ ID NO: 128063 - DNA, 20 bp, Artificial Sequence
  chemically synthesized
gtggcgattcctcagggatc

SEQ ID NO: 128064 - DNA, 20 bp, Artificial Sequence
  chemically synthesized
atttctagttctagatccct

SEQ ID NO: 128065 - DNA, 20 bp, Artificial Sequence
  chemically synthesized
attcctcagggatctagaac

SEQ ID NO: 128066 - DNA, 20 bp, Artificial Sequence
  chemically synthesized
tcaaatggtatttctagttc

SEQ ID NO: 128067 - DNA, 20 bp, Artificial Sequence
  chemically synthesized
gctgggtcaaatggtatttc

SEQ ID NO: 128068 - DNA, 20 bp, Artificial Sequence
  chemically synthesized
actagaaataccatttgacc

SEQ ID NO: 128069 - DNA, 20 bp, Artificial Sequence
  chemically synthesized
aatgggatagctgggtcaaa

SEQ ID NO: 128070 - DNA, 20 bp, Artificial Sequence
  chemically synthesized
tacccagtaatgggatagct

SEQ ID NO: 128071 - DNA, 20 bp, Artificial Sequence
  chemically synthesized
atacccagtaatgggatagc

SEQ ID NO: 128072 - DNA, 20 bp, Artificial Sequence
  chemically synthesized
gtatatacccagtaatggga

SEQ ID NO: 128073 - DNA, 20 bp, Artificial Sequence
  chemically synthesized
tgacccagctatcccattac

SEQ ID NO: 128074 - DNA, 20 bp, Artificial Sequence
  chemically synthesized
gacccagctatcccattact

SEQ ID NO: 128075 - DNA, 20 bp, Artificial Sequence
  chemically synthesized
ttgggtatatacccagtaat

SEQ ID NO: 128076 - DNA, 20 bp, Artificial Sequence
  chemically synthesized
tttgggtatatacccagtaa

SEQ ID NO: 128077 - DNA, 20 bp, Artificial Sequence
  chemically synthesized
taatcctttgggtatatacc

SEQ ID NO: 128078 - DNA, 20 bp, Artificial Sequence
  chemically synthesized
cattactgggtatataccca

SEQ ID NO: 128079 - DNA, 20 bp, Artificial Sequence
  chemically synthesized
attactgggtatatacccaa

SEQ ID NO: 128080 - DNA, 20 bp, Artificial Sequence
  chemically synthesized
agcaggatttataatccttt

SEQ ID NO: 128081 - DNA, 20 bp, Artificial Sequence
  chemically synthesized
cagcaggatttataatcctt

SEQ ID NO: 128082 - DNA, 20 bp, Artificial Sequence
  chemically synthesized
gcatgtatctttacagcagc

SEQ ID NO: 128083 - DNA, 20 bp, Artificial Sequence
  chemically synthesized
tgcatgtatctttacagcag

SEQ ID NO: 128084 - DNA, 20 bp, Artificial Sequence
  chemically synthesized
ttataaatcctgctgctgta

SEQ ID NO: 128085 - DNA, 20 bp, Artificial Sequence
  chemically synthesized
ctgtgcatgtatctttacag

SEQ ID NO: 128086 - DNA, 20 bp, Artificial Sequence
  chemically synthesized
tacctgtgcatgtatcttta

SEQ ID NO: 128087 - DNA, 20 bp, Artificial Sequence
  chemically synthesized
ctgctgtaaagatacatgca

SEQ ID NO: 128088 - DNA, 20 bp, Artificial Sequence
  chemically synthesized
tgctgtaaagatacatgcac

SEQ ID NO: 128089 - DNA, 20 bp, Artificial Sequence
  chemically synthesized
ctttgctattgtgaatagtg

SEQ ID NO: 128090 - DNA, 20 bp, Artificial Sequence
  chemically synthesized
tattgctgcactattcacaa

SEQ ID NO: 128091 - DNA, 20 bp, Artificial Sequence
  chemically synthesized
caggtctttgctattgtgaa

SEQ ID NO: 128092 - DNA, 20 bp, Artificial Sequence
  chemically synthesized
ctgcactattcacaatagca

SEQ ID NO: 128093 - DNA, 20 bp, Artificial Sequence
  chemically synthesized
tattcacaatagcaaagacc

SEQ ID NO: 128094 - DNA, 20 bp, Artificial Sequence
  chemically synthesized
tggacatttggattggttcc

SEQ ID NO: 128095 - DNA, 20 bp, Artificial Sequence
  chemically synthesized
atggacatttggattggttc

SEQ ID NO: 128096 - DNA, 20 bp, Artificial Sequence
  chemically synthesized
tcattgatggacatttggat

SEQ ID NO: 128097 - DNA, 20 bp, Artificial Sequence
  chemically synthesized
gtctatcattgatggacatt

SEQ ID NO: 128098 - DNA, 20 bp, Artificial Sequence
  chemically synthesized
atccaaatgtccatcaatga

SEQ ID NO: 128099 - DNA, 20 bp, Artificial Sequence
  chemically synthesized
ttaatccagtctatcattga

SEQ ID NO: 128100 - DNA, 20 bp, Artificial Sequence
  chemically synthesized
aatgtccatcaatgatagac

SEQ ID NO: 128101 - DNA, 20 bp, Artificial Sequence
  chemically synthesized
catcaatgatagactggatt

SEQ ID NO: 128102 - DNA, 20 bp, Artificial Sequence
  chemically synthesized
tgtgccacattttcttaatc

SEQ ID NO: 128103 - DNA, 20 bp, Artificial Sequence
  chemically synthesized
tagactggattaagaaaatg

SEQ ID NO: 128104 - DNA, 20 bp, Artificial Sequence
  chemically synthesized
aatgtggcacatatacacca

SEQ ID NO: 128105 - DNA, 20 bp, Artificial Sequence
  chemically synthesized
tatggttgcatagtattcca

SEQ ID NO: 128106 - DNA, 20 bp, Artificial Sequence
  chemically synthesized
catccttttttatggttgca

SEQ ID NO: 128107 - DNA, 20 bp, Artificial Sequence
  chemically synthesized
aatactatgcaaccataaaa

SEQ ID NO: 128108 - DNA, 20 bp, Artificial Sequence
  chemically synthesized
atactatgcaaccataaaaa

SEQ ID NO: 128109 - DNA, 20 bp, Artificial Sequence
  chemically synthesized
tgtgaactcatcctttttta

SEQ ID NO: 128110 - DNA, 20 bp, Artificial Sequence
  chemically synthesized
atgcaaccataaaaaaggat

SEQ ID NO: 128111 - DNA, 20 bp, Artificial Sequence
  chemically synthesized
ggatgagttcacatcctttg

SEQ ID NO: 128112 - DNA, 20 bp, Artificial Sequence
  chemically synthesized
gatgagttcacatcctttgt

SEQ ID NO: 128113 - DNA, 20 bp, Artificial Sequence
  chemically synthesized
atgagttcacatcctttgta

SEQ ID NO: 128114 - DNA, 20 bp, Artificial Sequence
  chemically synthesized
cttcatccatgtccctacaa

SEQ ID NO: 128115 - DNA, 20 bp, Artificial Sequence
  chemically synthesized
gcttcatccatgtccctaca

SEQ ID NO: 128116 - DNA, 20 bp, Artificial Sequence
  chemically synthesized
tcacatcctttgtagggaca

SEQ ID NO: 128117 - DNA, 20 bp, Artificial Sequence
  chemically synthesized
cctttgtagggacatggatg

SEQ ID NO: 128118 - DNA, 20 bp, Artificial Sequence
  chemically synthesized
tgtagggacatggatgaagc

SEQ ID NO: 128119 - DNA, 20 bp, Artificial Sequence
  chemically synthesized
ttgctgagaaagatgatttc

SEQ ID NO: 128120 - DNA, 20 bp, Artificial Sequence
  chemically synthesized
aagctggaaatcatctttct

SEQ ID NO: 128121 - DNA, 20 bp, Artificial Sequence
  chemically synthesized
cttgtgatagtttgctgaga

SEQ ID NO: 128122 - DNA, 20 bp, Artificial Sequence
  chemically synthesized
tgtccttgtgatagtttgct

SEQ ID NO: 128123 - DNA, 20 bp, Artificial Sequence
  chemically synthesized
ctttctcagcaaactatcac

SEQ ID NO: 128124 - DNA, 20 bp, Artificial Sequence
  chemically synthesized
tttctcagcaaactatcaca

SEQ ID NO: 128125 - DNA, 20 bp, Artificial Sequence
  chemically synthesized
ttggttttctgtccttgtga

SEQ ID NO: 128126 - DNA, 20 bp, Artificial Sequence
  chemically synthesized
tcagcaaactatcacaagga

SEQ ID NO: 128127 - DNA, 20 bp, Artificial Sequence
  chemically synthesized
gagtgagaacatgcggtgtt

SEQ ID NO: 128128 - DNA, 20 bp, Artificial Sequence
  chemically synthesized
cacctatgagtgagaacatg

SEQ ID NO: 128129 - DNA, 20 bp, Artificial Sequence
  chemically synthesized
acaccgcatgttctcactca

SEQ ID NO: 128130 - DNA, 20 bp, Artificial Sequence
  chemically synthesized
caccgcatgttctcactcat

SEQ ID NO: 128131 - DNA, 20 bp, Artificial Sequence
  chemically synthesized
ttcaattcccacctatgagt

SEQ ID NO: 128132 - DNA, 20 bp, Artificial Sequence
  chemically synthesized
cgcatgttctcactcatagg

SEQ ID NO: 128133 - DNA, 20 bp, Artificial Sequence
  chemically synthesized
gcatgttctcactcataggt

SEQ ID NO: 128134 - DNA, 20 bp, Artificial Sequence
  chemically synthesized
attgttcaattcccacctat

SEQ ID NO: 128135 - DNA, 20 bp, Artificial Sequence
  chemically synthesized
ataggtgggaattgaacaat

SEQ ID NO: 128136 - DNA, 20 bp, Artificial Sequence
  chemically synthesized
aattgaacaatgagaacacc

SEQ ID NO: 128137 - DNA, 20 bp, Artificial Sequence
  chemically synthesized
acaatgagaacacctggacg

SEQ ID NO: 128138 - DNA, 20 bp, Artificial Sequence
  chemically synthesized
caatgagaacacctggacgc

SEQ ID NO: 128139 - DNA, 20 bp, Artificial Sequence
  chemically synthesized
atgttccccttcctgcgtcc

SEQ ID NO: 128140 - DNA, 20 bp, Artificial Sequence
  chemically synthesized
gatgttccccttcctgcgtc

SEQ ID NO: 128141 - DNA, 20 bp, Artificial Sequence
  chemically synthesized
tgagaacacctggacgcagg

SEQ ID NO: 128142 - DNA, 20 bp, Artificial Sequence
  chemically synthesized
gagaacacctggacgcagga

SEQ ID NO: 128143 - DNA, 20 bp, Artificial Sequence
  chemically synthesized
agaacacctggacgcaggaa

SEQ ID NO: 128144 - DNA, 20 bp, Artificial Sequence
  chemically synthesized
gaacacctggacgcaggaag

SEQ ID NO: 128145 - DNA, 20 bp, Artificial Sequence
  chemically synthesized
ggaaggggaacatcacacac

SEQ ID NO: 128146 - DNA, 20 bp, Artificial Sequence
  chemically synthesized
gaaggggaacatcacacacc

SEQ ID NO: 128147 - DNA, 20 bp, Artificial Sequence
  chemically synthesized
aaggggaacatcacacaccg

SEQ ID NO: 128148 - DNA, 20 bp, Artificial Sequence
  chemically synthesized
cctcaccccacgacaggccc

SEQ ID NO: 128149 - DNA, 20 bp, Artificial Sequence
  chemically synthesized
tcacacaccggggcctgtcg

SEQ ID NO: 128150 - DNA, 20 bp, Artificial Sequence
  chemically synthesized
cacacaccggggcctgtcgt

SEQ ID NO: 128151 - DNA, 20 bp, Artificial Sequence
  chemically synthesized
acacaccggggcctgtcgtg

SEQ ID NO: 128152 - DNA, 20 bp, Artificial Sequence
  chemically synthesized
ccgtcccctcaccccacgac

SEQ ID NO: 128153 - DNA, 20 bp, Artificial Sequence
  chemically synthesized
cccgtcccctcaccccacga

SEQ ID NO: 128154 - DNA, 20 bp, Artificial Sequence
  chemically synthesized
accggggcctgtcgtggggt

SEQ ID NO: 128155 - DNA, 20 bp, Artificial Sequence
  chemically synthesized
ccggggcctgtcgtggggtg

SEQ ID NO: 128156 - DNA, 20 bp, Artificial Sequence
  chemically synthesized
cggggcctgtcgtggggtga

SEQ ID NO: 128157 - DNA, 20 bp, Artificial Sequence
  chemically synthesized
ggggcctgtcgtggggtgag

SEQ ID NO: 128158 - DNA, 20 bp, Artificial Sequence
  chemically synthesized
cctgtcgtggggtgagggga

SEQ ID NO: 128159 - DNA, 20 bp, Artificial Sequence
  chemically synthesized
ctgtcgtggggtgaggggac

SEQ ID NO: 128160 - DNA, 20 bp, Artificial Sequence
  chemically synthesized
tgtcgtggggtgaggggacg

SEQ ID NO: 128161 - DNA, 20 bp, Artificial Sequence
  chemically synthesized
gtcgtggggtgaggggacgg

SEQ ID NO: 128162 - DNA, 20 bp, Artificial Sequence
  chemically synthesized
cgtggggtgaggggacgggg

SEQ ID NO: 128163 - DNA, 20 bp, Artificial Sequence
  chemically synthesized
gtggggtgaggggacggggg

SEQ ID NO: 128164 - DNA, 20 bp, Artificial Sequence
  chemically synthesized
tggggtgaggggacggggga

SEQ ID NO: 128165 - DNA, 20 bp, Artificial Sequence
  chemically synthesized
gtgaggggacgggggaggga

SEQ ID NO: 128166 - DNA, 20 bp, Artificial Sequence
  chemically synthesized
ggacgggggagggatagcat

SEQ ID NO: 128167 - DNA, 20 bp, Artificial Sequence
  chemically synthesized
gacgggggagggatagcatt

SEQ ID NO: 128168 - DNA, 20 bp, Artificial Sequence
  chemically synthesized
cgggggagggatagcattgg

SEQ ID NO: 128169 - DNA, 20 bp, Artificial Sequence
  chemically synthesized
attaacttgtcatttacatt

SEQ ID NO: 128170 - DNA, 20 bp, Artificial Sequence
  chemically synthesized
cattaacttgtcatttacat

SEQ ID NO: 128171 - DNA, 20 bp, Artificial Sequence
  chemically synthesized
atatacctaatgtaaatgac

SEQ ID NO: 128172 - DNA, 20 bp, Artificial Sequence
  chemically synthesized
taatgtaaatgacaagttaa

SEQ ID NO: 128173 - DNA, 20 bp, Artificial Sequence
  chemically synthesized
aatgtaaatgacaagttaat

SEQ ID NO: 128174 - DNA, 20 bp, Artificial Sequence
  chemically synthesized
gtaaatgacaagttaatggg

SEQ ID NO: 128175 - DNA, 20 bp, Artificial Sequence
  chemically synthesized
aaatgacaagttaatgggtg

SEQ ID NO: 128176 - DNA, 20 bp, Artificial Sequence
  chemically synthesized
atgggtggagcataccaaca

SEQ ID NO: 128177 - DNA, 20 bp, Artificial Sequence
  chemically synthesized
tatctatacatgtgccgtgt

SEQ ID NO: 128178 - DNA, 20 bp, Artificial Sequence
  chemically synthesized
ataccaacacggcacatgta

SEQ ID NO: 128179 - DNA, 20 bp, Artificial Sequence
  chemically synthesized
tagatatgtaacaaacctgc

SEQ ID NO: 128180 - DNA, 20 bp, Artificial Sequence
  chemically synthesized
ggtacatgtgcacaacttgc

SEQ ID NO: 128181 - DNA, 20 bp, Artificial Sequence
  chemically synthesized
gggtacatgtgcacaacttg

SEQ ID NO: 128182 - DNA, 20 bp, Artificial Sequence
  chemically synthesized
caagttgtgcacatgtaccc

SEQ ID NO: 128183 - DNA, 20 bp, Artificial Sequence
  chemically synthesized
taattatactttaagttcta

SEQ ID NO: 128184 - DNA, 20 bp, Artificial Sequence
  chemically synthesized
ttaattatactttaagttct

SEQ ID NO: 128185 - DNA, 20 bp, Artificial Sequence
  chemically synthesized
cacatgtaccctagaactta

SEQ ID NO: 128186 - DNA, 20 bp, Artificial Sequence
  chemically synthesized
tttaattatactttaagttc

SEQ ID NO: 128187 - DNA, 20 bp, Artificial Sequence
  chemically synthesized
tttttttttaattatacttt

SEQ ID NO: 128188 - DNA, 20 bp, Artificial Sequence
  chemically synthesized
taaagtataattaaaaaaaa

SEQ ID NO: 128189 - DNA, 20 bp, Artificial Sequence
  chemically synthesized
gtataattaaaaaaaaaagt

SEQ ID NO: 128190 - DNA, 20 bp, Artificial Sequence
  chemically synthesized
aaaaaagtaagttgtgatgt

SEQ ID NO: 128191 - DNA, 20 bp, Artificial Sequence
  chemically synthesized
gatgttagaaacataaaatg

SEQ ID NO: 128192 - DNA, 20 bp, Artificial Sequence
  chemically synthesized
atgttagaaacataaaatgt

SEQ ID NO: 128193 - DNA, 20 bp, Artificial Sequence
  chemically synthesized
gttagaaacataaaatgtgg

SEQ ID NO: 128194 - DNA, 20 bp, Artificial Sequence
  chemically synthesized
ttagaaacataaaatgtggg

SEQ ID NO: 128195 - DNA, 20 bp, Artificial Sequence
  chemically synthesized
agaaacataaaatgtgggag

SEQ ID NO: 128196 - DNA, 20 bp, Artificial Sequence
  chemically synthesized
gaaacataaaatgtgggagg

SEQ ID NO: 128197 - DNA, 20 bp, Artificial Sequence
  chemically synthesized
aaacataaaatgtgggagga

SEQ ID NO: 128198 - DNA, 20 bp, Artificial Sequence
  chemically synthesized
acataaaatgtgggaggagg

SEQ ID NO: 128199 - DNA, 20 bp, Artificial Sequence
  chemically synthesized
ataaaatgtgggaggaggga

SEQ ID NO: 128200 - DNA, 20 bp, Artificial Sequence
  chemically synthesized
tgtgggaggagggagagtca

SEQ ID NO: 128201 - DNA, 20 bp, Artificial Sequence
  chemically synthesized
ggagggagagtcaaagtgtt

SEQ ID NO: 128202 - DNA, 20 bp, Artificial Sequence
  chemically synthesized
atatgcacacaatcaaattt

SEQ ID NO: 128203 - DNA, 20 bp, Artificial Sequence
  chemically synthesized
aatcaaatttaagttattat

SEQ ID NO: 128204 - DNA, 20 bp, Artificial Sequence
  chemically synthesized
gcttacataaaacattttat

SEQ ID NO: 128205 - DNA, 20 bp, Artificial Sequence
  chemically synthesized
gcttataaaatgttttatgt

SEQ ID NO: 128206 - DNA, 20 bp, Artificial Sequence
  chemically synthesized
aaaatgttttatgtaagcct

SEQ ID NO: 128207 - DNA, 20 bp, Artificial Sequence
  chemically synthesized
aatgttttatgtaagcctcg

SEQ ID NO: 128208 - DNA, 20 bp, Artificial Sequence
  chemically synthesized
tgtgctttgtggatactccg

SEQ ID NO: 128209 - DNA, 20 bp, Artificial Sequence
  chemically synthesized
ttgtgctttgtggatactcc

SEQ ID NO: 128210 - DNA, 20 bp, Artificial Sequence
  chemically synthesized
taagcctcggagtatccaca

SEQ ID NO: 128211 - DNA, 20 bp, Artificial Sequence
  chemically synthesized
tattataagtttgtgctttg

SEQ ID NO: 128212 - DNA, 20 bp, Artificial Sequence
  chemically synthesized
atcattcatgtatgtattat

SEQ ID NO: 128213 - DNA, 20 bp, Artificial Sequence
  chemically synthesized
tacatgaatgataaaaacaa

SEQ ID NO: 128214 - DNA, 20 bp, Artificial Sequence
  chemically synthesized
tgataaaaacaaaagaccca

SEQ ID NO: 128215 - DNA, 20 bp, Artificial Sequence
  chemically synthesized
tttgtgtagtagtatacttt

SEQ ID NO: 128216 - DNA, 20 bp, Artificial Sequence
  chemically synthesized
ttttgtgtagtagtatactt

SEQ ID NO: 128217 - DNA, 20 bp, Artificial Sequence
  chemically synthesized
gttttgatggttttgtgtag

SEQ ID NO: 128218 - DNA, 20 bp, Artificial Sequence
  chemically synthesized
tgtgttttgatggttttgtg

SEQ ID NO: 128219 - DNA, 20 bp, Artificial Sequence
  chemically synthesized
tgtcttcctttgtgttttga

SEQ ID NO: 128220 - DNA, 20 bp, Artificial Sequence
  chemically synthesized
cacaaaaccatcaaaacaca

SEQ ID NO: 128221 - DNA, 20 bp, Artificial Sequence
  chemically synthesized
acaaaaccatcaaaacacaa

SEQ ID NO: 128222 - DNA, 20 bp, Artificial Sequence
  chemically synthesized
aaaccatcaaaacacaaagg

SEQ ID NO: 128223 - DNA, 20 bp, Artificial Sequence
  chemically synthesized
catcaaaacacaaaggaaga

SEQ ID NO: 128224 - DNA, 20 bp, Artificial Sequence
  chemically synthesized
aacacaaaggaagacagcaa

SEQ ID NO: 128225 - DNA, 20 bp, Artificial Sequence
  chemically synthesized
cacaaaggaagacagcaata

SEQ ID NO: 128226 - DNA, 20 bp, Artificial Sequence
  chemically synthesized
acaaaggaagacagcaatag

SEQ ID NO: 128227 - DNA, 20 bp, Artificial Sequence
  chemically synthesized
aaggaagacagcaatagagg

SEQ ID NO: 128228 - DNA, 20 bp, Artificial Sequence
  chemically synthesized
aagacagcaatagaggaaga

SEQ ID NO: 128229 - DNA, 20 bp, Artificial Sequence
  chemically synthesized
agacagcaatagaggaagaa

SEQ ID NO: 128230 - DNA, 20 bp, Artificial Sequence
  chemically synthesized
aatagaggaagaaaggaaca

SEQ ID NO: 128231 - DNA, 20 bp, Artificial Sequence
  chemically synthesized
gaaaggaacaaagaatctgt

SEQ ID NO: 128232 - DNA, 20 bp, Artificial Sequence
  chemically synthesized
attgtttcctggttgtctta

SEQ ID NO: 128233 - DNA, 20 bp, Artificial Sequence
  chemically synthesized
caaagaatctgtaagacaac

SEQ ID NO: 128234 - DNA, 20 bp, Artificial Sequence
  chemically synthesized
aaagaatctgtaagacaacc

SEQ ID NO: 128235 - DNA, 20 bp, Artificial Sequence
  chemically synthesized
tcattttgttcattgtttcc

SEQ ID NO: 128236 - DNA, 20 bp, Artificial Sequence
  chemically synthesized
aacaatgaacaaaatgacac

SEQ ID NO: 128237 - DNA, 20 bp, Artificial Sequence
  chemically synthesized
atgaacaaaatgacactagt

SEQ ID NO: 128238 - DNA, 20 bp, Artificial Sequence
  chemically synthesized
atggatgggtaaggacttac

SEQ ID NO: 128239 - DNA, 20 bp, Artificial Sequence
  chemically synthesized
aaaataatgatggatgggta

SEQ ID NO: 128240 - DNA, 20 bp, Artificial Sequence
  chemically synthesized
caaaataatgatggatgggt

SEQ ID NO: 128241 - DNA, 20 bp, Artificial Sequence
  chemically synthesized
cattcaaaataatgatggat

SEQ ID NO: 128242 - DNA, 20 bp, Artificial Sequence
  chemically synthesized
acattcaaaataatgatgga

SEQ ID NO: 128243 - DNA, 20 bp, Artificial Sequence
  chemically synthesized
atttacattcaaaataatga

SEQ ID NO: 128244 - DNA, 20 bp, Artificial Sequence
  chemically synthesized
atcattattttgaatgtaaa

SEQ ID NO: 128245 - DNA, 20 bp, Artificial Sequence
  chemically synthesized
ctctatgccttttgattgga

SEQ ID NO: 128246 - DNA, 20 bp, Artificial Sequence
  chemically synthesized
agattaaactctccaatcaa

SEQ ID NO: 128247 - DNA, 20 bp, Artificial Sequence
  chemically synthesized
cactctatgccttttgattg

SEQ ID NO: 128248 - DNA, 20 bp, Artificial Sequence
  chemically synthesized
gattaaactctccaatcaaa

SEQ ID NO: 128249 - DNA, 20 bp, Artificial Sequence
  chemically synthesized
accactctatgccttttgat

SEQ ID NO: 128250 - DNA, 20 bp, Artificial Sequence
  chemically synthesized
aactctccaatcaaaaggca

SEQ ID NO: 128251 - DNA, 20 bp, Artificial Sequence
  chemically synthesized
ctctccaatcaaaaggcata

SEQ ID NO: 128252 - DNA, 20 bp, Artificial Sequence
  chemically synthesized
tccaatcaaaaggcatagag

SEQ ID NO: 128253 - DNA, 20 bp, Artificial Sequence
  chemically synthesized
tcaaaaggcatagagtggtt

SEQ ID NO: 128254 - DNA, 20 bp, Artificial Sequence
  chemically synthesized
aaaggcatagagtggttgag

SEQ ID NO: 128255 - DNA, 20 bp, Artificial Sequence
  chemically synthesized
taacgacaacaacaaaaaac

SEQ ID NO: 128256 - DNA, 20 bp, Artificial Sequence
  chemically synthesized
cttgtaggcagcacatattt

SEQ ID NO: 128257 - DNA, 20 bp, Artificial Sequence
  chemically synthesized
acttgtaggcagcacatatt

SEQ ID NO: 128258 - DNA, 20 bp, Artificial Sequence
  chemically synthesized
cccaaatatgtgctgcctac

SEQ ID NO: 128259 - DNA, 20 bp, Artificial Sequence
  chemically synthesized
tgaaatgagccacttgtagg

SEQ ID NO: 128260 - DNA, 20 bp, Artificial Sequence
  chemically synthesized
aaatatgtgctgcctacaag

SEQ ID NO: 128261 - DNA, 20 bp, Artificial Sequence
  chemically synthesized
aggtgaaatgagccacttgt

SEQ ID NO: 128262 - DNA, 20 bp, Artificial Sequence
  chemically synthesized
aaggtgaaatgagccacttg

SEQ ID NO: 128263 - DNA, 20 bp, Artificial Sequence
  chemically synthesized
catgtcctttaaggtgaaat

SEQ ID NO: 128264 - DNA, 20 bp, Artificial Sequence
  chemically synthesized
aagtggctcatttcacctta

SEQ ID NO: 128265 - DNA, 20 bp, Artificial Sequence
  chemically synthesized
agtggctcatttcaccttaa

SEQ ID NO: 128266 - DNA, 20 bp, Artificial Sequence
  chemically synthesized
cagtctatgcatgtccttta

SEQ ID NO: 128267 - DNA, 20 bp, Artificial Sequence
  chemically synthesized
tcagtctatgcatgtccttt

SEQ ID NO: 128268 - DNA, 20 bp, Artificial Sequence
  chemically synthesized
ttcaccttaaaggacatgca

SEQ ID NO: 128269 - DNA, 20 bp, Artificial Sequence
  chemically synthesized
aaaggacatgcatagactga

SEQ ID NO: 128270 - DNA, 20 bp, Artificial Sequence
  chemically synthesized
acatgcatagactgaaagta

SEQ ID NO: 128271 - DNA, 20 bp, Artificial Sequence
  chemically synthesized
catgcatagactgaaagtaa

SEQ ID NO: 128272 - DNA, 20 bp, Artificial Sequence
  chemically synthesized
ttttttcatccctttacttt

SEQ ID NO: 128273 - DNA, 20 bp, Artificial Sequence
  chemically synthesized
atgcatagactgaaagtaaa

SEQ ID NO: 128274 - DNA, 20 bp, Artificial Sequence
  chemically synthesized
tgaaagtaaagggatgaaaa

SEQ ID NO: 128275 - DNA, 20 bp, Artificial Sequence
  chemically synthesized
tttttgttctcatgtacatg

SEQ ID NO: 128276 - DNA, 20 bp, Artificial Sequence
  chemically synthesized
aaaagatactccatgtacat

SEQ ID NO: 128277 - DNA, 20 bp, Artificial Sequence
  chemically synthesized
tctttttgttctcatgtaca

SEQ ID NO: 128278 - DNA, 20 bp, Artificial Sequence
  chemically synthesized
tccatgtacatgagaacaaa

SEQ ID NO: 128279 - DNA, 20 bp, Artificial Sequence
  chemically synthesized
catgtacatgagaacaaaaa

SEQ ID NO: 128280 - DNA, 20 bp, Artificial Sequence
  chemically synthesized
tgtacatgagaacaaaaaga

SEQ ID NO: 128281 - DNA, 20 bp, Artificial Sequence
  chemically synthesized
acatgagaacaaaaagagag

SEQ ID NO: 128282 - DNA, 20 bp, Artificial Sequence
  chemically synthesized
catgagaacaaaaagagagc

SEQ ID NO: 128283 - DNA, 20 bp, Artificial Sequence
  chemically synthesized
atgagaacaaaaagagagca

SEQ ID NO: 128284 - DNA, 20 bp, Artificial Sequence
  chemically synthesized
agaacaaaaagagagcaggg

SEQ ID NO: 128285 - DNA, 20 bp, Artificial Sequence
  chemically synthesized
cagggtagttacacttactt

SEQ ID NO: 128286 - DNA, 20 bp, Artificial Sequence
  chemically synthesized
aagattattttgtctgaagt

SEQ ID NO: 128287 - DNA, 20 bp, Artificial Sequence
  chemically synthesized
cctaaagattattttgtctg

SEQ ID NO: 128288 - DNA, 20 bp, Artificial Sequence
  chemically synthesized
acttcagacaaaataatctt

SEQ ID NO: 128289 - DNA, 20 bp, Artificial Sequence
  chemically synthesized
cttcagacaaaataatcttt

SEQ ID NO: 128290 - DNA, 20 bp, Artificial Sequence
  chemically synthesized
ctttgaacagatttgaccta

SEQ ID NO: 128291 - DNA, 20 bp, Artificial Sequence
  chemically synthesized
ctttaggtcaaatctgttca

SEQ ID NO: 128292 - DNA, 20 bp, Artificial Sequence
  chemically synthesized
atgttctttgtcactttgaa

SEQ ID NO: 128293 - DNA, 20 bp, Artificial Sequence
  chemically synthesized
caaatctgttcaaagtgaca

SEQ ID NO: 128294 - DNA, 20 bp, Artificial Sequence
  chemically synthesized
aacatcattatatattgata

SEQ ID NO: 128295 - DNA, 20 bp, Artificial Sequence
  chemically synthesized
acatcattatatattgataa

SEQ ID NO: 128296 - DNA, 20 bp, Artificial Sequence
  chemically synthesized
ttgataaaggttatttcatc

SEQ ID NO: 128297 - DNA, 20 bp, Artificial Sequence
  chemically synthesized
gataaaggttatttcatcaa

SEQ ID NO: 128298 - DNA, 20 bp, Artificial Sequence
  chemically synthesized
ataaaggttatttcatcaag

SEQ ID NO: 128299 - DNA, 20 bp, Artificial Sequence
  chemically synthesized
tttcatcaagaggacataac

SEQ ID NO: 128300 - DNA, 20 bp, Artificial Sequence
  chemically synthesized
agaggacataacaagtatat

SEQ ID NO: 128301 - DNA, 20 bp, Artificial Sequence
  chemically synthesized
agtatataagcatcccaaat

SEQ ID NO: 128302 - DNA, 20 bp, Artificial Sequence
  chemically synthesized
tatataagcatcccaaatca

SEQ ID NO: 128303 - DNA, 20 bp, Artificial Sequence
  chemically synthesized
atatttaggtgctctgattt

SEQ ID NO: 128304 - DNA, 20 bp, Artificial Sequence
  chemically synthesized
tatatttaggtgctctgatt

SEQ ID NO: 128305 - DNA, 20 bp, Artificial Sequence
  chemically synthesized
aatgtttgctttatatattt

SEQ ID NO: 128306 - DNA, 20 bp, Artificial Sequence
  chemically synthesized
taatgtttgctttatatatt

SEQ ID NO: 128307 - DNA, 20 bp, Artificial Sequence
  chemically synthesized
tcagagcacctaaatatata

SEQ ID NO: 128308 - DNA, 20 bp, Artificial Sequence
  chemically synthesized
aaatatataaagcaaacatt

SEQ ID NO: 128309 - DNA, 20 bp, Artificial Sequence
  chemically synthesized
aatatataaagcaaacatta

SEQ ID NO: 128310 - DNA, 20 bp, Artificial Sequence
  chemically synthesized
atatataaagcaaacattaa

SEQ ID NO: 128311 - DNA, 20 bp, Artificial Sequence
  chemically synthesized
agcaaacattaagggatctg

SEQ ID NO: 128312 - DNA, 20 bp, Artificial Sequence
  chemically synthesized
gcaaacattaagggatctga

SEQ ID NO: 128313 - DNA, 20 bp, Artificial Sequence
  chemically synthesized
caaacattaagggatctgaa

SEQ ID NO: 128314 - DNA, 20 bp, Artificial Sequence
  chemically synthesized
ttataggctatgtttccctt

SEQ ID NO: 128315 - DNA, 20 bp, Artificial Sequence
  chemically synthesized
aagggatctgaagggaaaca

SEQ ID NO: 128316 - DNA, 20 bp, Artificial Sequence
  chemically synthesized
gcctgctattattatgttat

SEQ ID NO: 128317 - DNA, 20 bp, Artificial Sequence
  chemically synthesized
tgcctgctattattatgtta

SEQ ID NO: 128318 - DNA, 20 bp, Artificial Sequence
  chemically synthesized
catagcctataacataataa

SEQ ID NO: 128319 - DNA, 20 bp, Artificial Sequence
  chemically synthesized
agcctataacataataatag

SEQ ID NO: 128320 - DNA, 20 bp, Artificial Sequence
  chemically synthesized
gcctataacataataatagc

SEQ ID NO: 128321 - DNA, 20 bp, Artificial Sequence
  chemically synthesized
caatttcaatattccacttt

SEQ ID NO: 128322 - DNA, 20 bp, Artificial Sequence
  chemically synthesized
tttctgtctattgcttaaag

SEQ ID NO: 128323 - DNA, 20 bp, Artificial Sequence
  chemically synthesized
caatattccactttaagcaa

SEQ ID NO: 128324 - DNA, 20 bp, Artificial Sequence
  chemically synthesized
atttttctgtctattgctta

SEQ ID NO: 128325 - DNA, 20 bp, Artificial Sequence
  chemically synthesized
attccactttaagcaataga

SEQ ID NO: 128326 - DNA, 20 bp, Artificial Sequence
  chemically synthesized
caatagacagaaaaattcat

SEQ ID NO: 128327 - DNA, 20 bp, Artificial Sequence
  chemically synthesized
aaaaattcataagaaaacat

SEQ ID NO: 128328 - DNA, 20 bp, Artificial Sequence
  chemically synthesized
tttggtctaaaatgtcattc

SEQ ID NO: 128329 - DNA, 20 bp, Artificial Sequence
  chemically synthesized
attggacttgaatgacattt

SEQ ID NO: 128330 - DNA, 20 bp, Artificial Sequence
  chemically synthesized
gaatgacattttagaccaaa

SEQ ID NO: 128331 - DNA, 20 bp, Artificial Sequence
  chemically synthesized
atatgtctgttaggtccatt

SEQ ID NO: 128332 - DNA, 20 bp, Artificial Sequence
  chemically synthesized
tttagaccaaatggacctaa

SEQ ID NO: 128333 - DNA, 20 bp, Artificial Sequence
  chemically synthesized
atgttctgtatatgtctgtt

SEQ ID NO: 128334 - DNA, 20 bp, Artificial Sequence
  chemically synthesized
aatgttctgtatatgtctgt

SEQ ID NO: 128335 - DNA, 20 bp, Artificial Sequence
  chemically synthesized
atggacctaacagacatata

SEQ ID NO: 128336 - DNA, 20 bp, Artificial Sequence
  chemically synthesized
acagaacattgtgccctgaa

SEQ ID NO: 128337 - DNA, 20 bp, Artificial Sequence
  chemically synthesized
gaacattgtgccctgaacag

SEQ ID NO: 128338 - DNA, 20 bp, Artificial Sequence
  chemically synthesized
ctgtattttcctactgttca

SEQ ID NO: 128339 - DNA, 20 bp, Artificial Sequence
  chemically synthesized
aacattgtgccctgaacagt

SEQ ID NO: 128340 - DNA, 20 bp, Artificial Sequence
  chemically synthesized
tctgtattttcctactgttc

SEQ ID NO: 128341 - DNA, 20 bp, Artificial Sequence
  chemically synthesized
atctgtattttcctactgtt

SEQ ID NO: 128342 - DNA, 20 bp, Artificial Sequence
  chemically synthesized
ccctgaacagtaggaaaata

SEQ ID NO: 128343 - DNA, 20 bp, Artificial Sequence
  chemically synthesized
ggaaaatacagattcttctc

SEQ ID NO: 128344 - DNA, 20 bp, Artificial Sequence
  chemically synthesized
atgttacatgtgtacttgag

SEQ ID NO: 128345 - DNA, 20 bp, Artificial Sequence
  chemically synthesized
agaatgttacatgtgtactt

SEQ ID NO: 128346 - DNA, 20 bp, Artificial Sequence
  chemically synthesized
agtacacatgtaacattctc

SEQ ID NO: 128347 - DNA, 20 bp, Artificial Sequence
  chemically synthesized
gtacacatgtaacattctcc

SEQ ID NO: 128348 - DNA, 20 bp, Artificial Sequence
  chemically synthesized
acatgtaacattctccagga

SEQ ID NO: 128349 - DNA, 20 bp, Artificial Sequence
  chemically synthesized
ctaacatatgatctatcctg

SEQ ID NO: 128350 - DNA, 20 bp, Artificial Sequence
  chemically synthesized
gcctaacatatgatctatcc

SEQ ID NO: 128351 - DNA, 20 bp, Artificial Sequence
  chemically synthesized
ctccaggatagatcatatgt

SEQ ID NO: 128352 - DNA, 20 bp, Artificial Sequence
  chemically synthesized
tccaggatagatcatatgtt

SEQ ID NO: 128353 - DNA, 20 bp, Artificial Sequence
  chemically synthesized
atagatcatatgttaggcca

SEQ ID NO: 128354 - DNA, 20 bp, Artificial Sequence
  chemically synthesized
tcatatgttaggccacagac

SEQ ID NO: 128355 - DNA, 20 bp, Artificial Sequence
  chemically synthesized
aatttgttgagacttgtctg

SEQ ID NO: 128356 - DNA, 20 bp, Artificial Sequence
  chemically synthesized
tgggttttcttaaatttgtt

SEQ ID NO: 128357 - DNA, 20 bp, Artificial Sequence
  chemically synthesized
agacaagtctcaacaaattt

SEQ ID NO: 128358 - DNA, 20 bp, Artificial Sequence
  chemically synthesized
ggtcagaaaagatacacgat

SEQ ID NO: 128359 - DNA, 20 bp, Artificial Sequence
  chemically synthesized
tggtcagaaaagatacacga

SEQ ID NO: 128360 - DNA, 20 bp, Artificial Sequence
  chemically synthesized
attttatattgtggtcagaa

SEQ ID NO: 128361 - DNA, 20 bp, Artificial Sequence
  chemically synthesized
ttctaattttatattgtggt

SEQ ID NO: 128362 - DNA, 20 bp, Artificial Sequence
  chemically synthesized
tgatttctaattttatattg

SEQ ID NO: 128363 - DNA, 20 bp, Artificial Sequence
  chemically synthesized
ttctgaccacaatataaaat

SEQ ID NO: 128364 - DNA, 20 bp, Artificial Sequence
  chemically synthesized
aaattagaaatcaattacat

SEQ ID NO: 128365 - DNA, 20 bp, Artificial Sequence
  chemically synthesized
atgagaaatcatataaaatt

SEQ ID NO: 128366 - DNA, 20 bp, Artificial Sequence
  chemically synthesized
atataaaattaagaaatatg

SEQ ID NO: 128367 - DNA, 20 bp, Artificial Sequence
  chemically synthesized
ttgtttaggagcatattgtt

SEQ ID NO: 128368 - DNA, 20 bp, Artificial Sequence
  chemically synthesized
ttgacccaataattgtttag

SEQ ID NO: 128369 - DNA, 20 bp, Artificial Sequence
  chemically synthesized
ttttgacccaataattgttt

SEQ ID NO: 128370 - DNA, 20 bp, Artificial Sequence
  chemically synthesized
cttttgacccaataattgtt

SEQ ID NO: 128371 - DNA, 20 bp, Artificial Sequence
  chemically synthesized
atatgctcctaaacaattat

SEQ ID NO: 128372 - DNA, 20 bp, Artificial Sequence
  chemically synthesized
tatgctcctaaacaattatt

SEQ ID NO: 128373 - DNA, 20 bp, Artificial Sequence
  chemically synthesized
ctaaacaattattgggtcaa

SEQ ID NO: 128374 - DNA, 20 bp, Artificial Sequence
  chemically synthesized
aacaattattgggtcaaaag

SEQ ID NO: 128375 - DNA, 20 bp, Artificial Sequence
  chemically synthesized
tgggtcaaaagaagaaattc

SEQ ID NO: 128376 - DNA, 20 bp, Artificial Sequence
  chemically synthesized
ggtcaaaagaagaaattcaa

SEQ ID NO: 128377 - DNA, 20 bp, Artificial Sequence
  chemically synthesized
gtcaaaagaagaaattcaag

SEQ ID NO: 128378 - DNA, 20 bp, Artificial Sequence
  chemically synthesized
ttcaagaggaaattttttaa

SEQ ID NO: 128379 - DNA, 20 bp, Artificial Sequence
  chemically synthesized
ggaaattttttaaaagtctt

SEQ ID NO: 128380 - DNA, 20 bp, Artificial Sequence
  chemically synthesized
ttttcatttctgtttgtctc

SEQ ID NO: 128381 - DNA, 20 bp, Artificial Sequence
  chemically synthesized
tttaaaagtcttgagacaaa

SEQ ID NO: 128382 - DNA, 20 bp, Artificial Sequence
  chemically synthesized
acagaaatgaaaacacaaca

SEQ ID NO: 128383 - DNA, 20 bp, Artificial Sequence
  chemically synthesized
acacaacatagaaaaacttc

SEQ ID NO: 128384 - DNA, 20 bp, Artificial Sequence
  chemically synthesized
cacaacatagaaaaacttct

SEQ ID NO: 128385 - DNA, 20 bp, Artificial Sequence
  chemically synthesized
acaacatagaaaaacttctg

SEQ ID NO: 128386 - DNA, 20 bp, Artificial Sequence
  chemically synthesized
caacatagaaaaacttctgg

SEQ ID NO: 128387 - DNA, 20 bp, Artificial Sequence
  chemically synthesized
catagaaaaacttctggggg

SEQ ID NO: 128388 - DNA, 20 bp, Artificial Sequence
  chemically synthesized
actgcttttgctacccccag

SEQ ID NO: 128389 - DNA, 20 bp, Artificial Sequence
  chemically synthesized
agcactgcttttgctacccc

SEQ ID NO: 128390 - DNA, 20 bp, Artificial Sequence
  chemically synthesized
aaaacttctgggggtagcaa

SEQ ID NO: 128391 - DNA, 20 bp, Artificial Sequence
  chemically synthesized
acttctgggggtagcaaaag

SEQ ID NO: 128392 - DNA, 20 bp, Artificial Sequence
  chemically synthesized
ggggtagcaaaagcagtgct

SEQ ID NO: 128393 - DNA, 20 bp, Artificial Sequence
  chemically synthesized
ggtagcaaaagcagtgctaa

SEQ ID NO: 128394 - DNA, 20 bp, Artificial Sequence
  chemically synthesized
gtagcaaaagcagtgctaag

SEQ ID NO: 128395 - DNA, 20 bp, Artificial Sequence
  chemically synthesized
tagcaaaagcagtgctaaga

SEQ ID NO: 128396 - DNA, 20 bp, Artificial Sequence
  chemically synthesized
caaaagcagtgctaagaggg

SEQ ID NO: 128397 - DNA, 20 bp, Artificial Sequence
  chemically synthesized
attgatataaacttccctct

SEQ ID NO: 128398 - DNA, 20 bp, Artificial Sequence
  chemically synthesized
tatttcttcttttttgatgt

SEQ ID NO: 128399 - DNA, 20 bp, Artificial Sequence
  chemically synthesized
atatttcttcttttttgatg

SEQ ID NO: 128400 - DNA, 20 bp, Artificial Sequence
  chemically synthesized
aataaattcctacatcaaaa

SEQ ID NO: 128401 - DNA, 20 bp, Artificial Sequence
  chemically synthesized
aaattcctacatcaaaaaag

SEQ ID NO: 128402 - DNA, 20 bp, Artificial Sequence
  chemically synthesized
taatgttaggtatttcattt

SEQ ID NO: 128403 - DNA, 20 bp, Artificial Sequence
  chemically synthesized
gtttcctgaggtataatgtt

SEQ ID NO: 128404 - DNA, 20 bp, Artificial Sequence
  chemically synthesized
agtttcctgaggtataatgt

SEQ ID NO: 128405 - DNA, 20 bp, Artificial Sequence
  chemically synthesized
aaatacctaacattatacct

SEQ ID NO: 128406 - DNA, 20 bp, Artificial Sequence
  chemically synthesized
aatacctaacattatacctc

SEQ ID NO: 128407 - DNA, 20 bp, Artificial Sequence
  chemically synthesized
cttctttttgtagtttcctg

SEQ ID NO: 128408 - DNA, 20 bp, Artificial Sequence
  chemically synthesized
tcttctttttgtagtttcct

SEQ ID NO: 128409 - DNA, 20 bp, Artificial Sequence
  chemically synthesized
atacctcaggaaactacaaa

SEQ ID NO: 128410 - DNA, 20 bp, Artificial Sequence
  chemically synthesized
cctcaggaaactacaaaaag

SEQ ID NO: 128411 - DNA, 20 bp, Artificial Sequence
  chemically synthesized
ttaattcattcttctttttg

SEQ ID NO: 128412 - DNA, 20 bp, Artificial Sequence
  chemically synthesized
tacaaaaagaagaatgaatt

SEQ ID NO: 128413 - DNA, 20 bp, Artificial Sequence
  chemically synthesized
agaagaatgaattaagccca

SEQ ID NO: 128414 - DNA, 20 bp, Artificial Sequence
  chemically synthesized
gaatgaattaagcccaaagt

SEQ ID NO: 128415 - DNA, 20 bp, Artificial Sequence
  chemically synthesized
ttcttctttctgctaacttt

SEQ ID NO: 128416 - DNA, 20 bp, Artificial Sequence
  chemically synthesized
tgaattaagcccaaagttag

SEQ ID NO: 128417 - DNA, 20 bp, Artificial Sequence
  chemically synthesized
tttcttctttctgctaactt

SEQ ID NO: 128418 - DNA, 20 bp, Artificial Sequence
  chemically synthesized
ttaagcccaaagttagcaga

SEQ ID NO: 128419 - DNA, 20 bp, Artificial Sequence
  chemically synthesized
agcccaaagttagcagaaag

SEQ ID NO: 128420 - DNA, 20 bp, Artificial Sequence
  chemically synthesized
gcagaaagaagaaaataaca

SEQ ID NO: 128421 - DNA, 20 bp, Artificial Sequence
  chemically synthesized
aagaagaaaataacaaagat

SEQ ID NO: 128422 - DNA, 20 bp, Artificial Sequence
  chemically synthesized
gaagaaaataacaaagatca

SEQ ID NO: 128423 - DNA, 20 bp, Artificial Sequence
  chemically synthesized
gaaaataacaaagatcagag

SEQ ID NO: 128424 - DNA, 20 bp, Artificial Sequence
  chemically synthesized
cagagcagaaataaatgaaa

SEQ ID NO: 128425 - DNA, 20 bp, Artificial Sequence
  chemically synthesized
gagcagaaataaatgaaata

SEQ ID NO: 128426 - DNA, 20 bp, Artificial Sequence
  chemically synthesized
gaaataaatgaaatagagac

SEQ ID NO: 128427 - DNA, 20 bp, Artificial Sequence
  chemically synthesized
aataaatgaaatagagacta

SEQ ID NO: 128428 - DNA, 20 bp, Artificial Sequence
  chemically synthesized
ctttttttctattgtttctc

SEQ ID NO: 128429 - DNA, 20 bp, Artificial Sequence
  chemically synthesized
aatagagactagagaaacaa

SEQ ID NO: 128430 - DNA, 20 bp, Artificial Sequence
  chemically synthesized
ctagagaaacaatagaaaaa

SEQ ID NO: 128431 - DNA, 20 bp, Artificial Sequence
  chemically synthesized
aaaaaagtcaataaaactaa

SEQ ID NO: 128432 - DNA, 20 bp, Artificial Sequence
  chemically synthesized
aagtcaataaaactaaaagt

SEQ ID NO: 128433 - DNA, 20 bp, Artificial Sequence
  chemically synthesized
cttttcaaaaaaccaacttt

SEQ ID NO: 128434 - DNA, 20 bp, Artificial Sequence
  chemically synthesized
ctaaaagttggttttttgaa

SEQ ID NO: 128435 - DNA, 20 bp, Artificial Sequence
  chemically synthesized
aaggatttgtcaattgtgtt

SEQ ID NO: 128436 - DNA, 20 bp, Artificial Sequence
  chemically synthesized
aaacacaattgacaaatcct

SEQ ID NO: 128437 - DNA, 20 bp, Artificial Sequence
  chemically synthesized
acaattgacaaatccttagc

SEQ ID NO: 128438 - DNA, 20 bp, Artificial Sequence
  chemically synthesized
cttcattcttagtctagcta

SEQ ID NO: 128439 - DNA, 20 bp, Artificial Sequence
  chemically synthesized
tcttcattcttagtctagct

SEQ ID NO: 128440 - DNA, 20 bp, Artificial Sequence
  chemically synthesized
gacaaatccttagctagact

SEQ ID NO: 128441 - DNA, 20 bp, Artificial Sequence
  chemically synthesized
tgctctcttcattcttagtc

SEQ ID NO: 128442 - DNA, 20 bp, Artificial Sequence
  chemically synthesized
ccttagctagactaagaatg

SEQ ID NO: 128443 - DNA, 20 bp, Artificial Sequence
  chemically synthesized
gagcctgctctcttcattct

SEQ ID NO: 128444 - DNA, 20 bp, Artificial Sequence
  chemically synthesized
ttagctagactaagaatgaa

SEQ ID NO: 128445 - DNA, 20 bp, Artificial Sequence
  chemically synthesized
agctagactaagaatgaaga

SEQ ID NO: 128446 - DNA, 20 bp, Artificial Sequence
  chemically synthesized
tagactaagaatgaagagag

SEQ ID NO: 128447 - DNA, 20 bp, Artificial Sequence
  chemically synthesized
agactaagaatgaagagagc

SEQ ID NO: 128448 - DNA, 20 bp, Artificial Sequence
  chemically synthesized
atttctgatttgatttattt

SEQ ID NO: 128449 - DNA, 20 bp, Artificial Sequence
  chemically synthesized
caggctcaaataaatcaaat

SEQ ID NO: 128450 - DNA, 20 bp, Artificial Sequence
  chemically synthesized
ataaatcaaatcagaaatca

SEQ ID NO: 128451 - DNA, 20 bp, Artificial Sequence
  chemically synthesized
aaatcaaatcagaaatcaaa

SEQ ID NO: 128452 - DNA, 20 bp, Artificial Sequence
  chemically synthesized
tcaaatcagaaatcaaagag

SEQ ID NO: 128453 - DNA, 20 bp, Artificial Sequence
  chemically synthesized
agacattatgactgataaca

SEQ ID NO: 128454 - DNA, 20 bp, Artificial Sequence
  chemically synthesized
cctttgtatttctgtgttat

SEQ ID NO: 128455 - DNA, 20 bp, Artificial Sequence
  chemically synthesized
actgataacacagaaataca

SEQ ID NO: 128456 - DNA, 20 bp, Artificial Sequence
  chemically synthesized
ctgataacacagaaatacaa

SEQ ID NO: 128457 - DNA, 20 bp, Artificial Sequence
  chemically synthesized
acagaaatacaaaggatcct

SEQ ID NO: 128458 - DNA, 20 bp, Artificial Sequence
  chemically synthesized
agaaatacaaaggatcctaa

SEQ ID NO: 128459 - DNA, 20 bp, Artificial Sequence
  chemically synthesized
attgttcatcgtagtctctt

SEQ ID NO: 128460 - DNA, 20 bp, Artificial Sequence
  chemically synthesized
aattgttcatcgtagtctct

SEQ ID NO: 128461 - DNA, 20 bp, Artificial Sequence
  chemically synthesized
tggtatataattgttcatcg

SEQ ID NO: 128462 - DNA, 20 bp, Artificial Sequence
  chemically synthesized
acgatgaacaattatatacc

SEQ ID NO: 128463 - DNA, 20 bp, Artificial Sequence
  chemically synthesized
acaattatataccaagaaat

SEQ ID NO: 128464 - DNA, 20 bp, Artificial Sequence
  chemically synthesized
tgttaggatgtccaatttct

SEQ ID NO: 128465 - DNA, 20 bp, Artificial Sequence
  chemically synthesized
caagaaattggacatcctaa

SEQ ID NO: 128466 - DNA, 20 bp, Artificial Sequence
  chemically synthesized
agaattcatccatttctgtt

SEQ ID NO: 128467 - DNA, 20 bp, Artificial Sequence
  chemically synthesized
attggacatcctaacagaaa

SEQ ID NO: 128468 - DNA, 20 bp, Artificial Sequence
  chemically synthesized
aagaattcatccatttctgt

SEQ ID NO: 128469 - DNA, 20 bp, Artificial Sequence
  chemically synthesized
aacagaaatggatgaattct

SEQ ID NO: 128470 - DNA, 20 bp, Artificial Sequence
  chemically synthesized
ttggtagattatgtatttct

SEQ ID NO: 128471 - DNA, 20 bp, Artificial Sequence
  chemically synthesized
ttttcattattcagttttgg

SEQ ID NO: 128472 - DNA, 20 bp, Artificial Sequence
  chemically synthesized
caattttcattattcagttt

SEQ ID NO: 128473 - DNA, 20 bp, Artificial Sequence
  chemically synthesized
gatttccaattttcattatt

SEQ ID NO: 128474 - DNA, 20 bp, Artificial Sequence
  chemically synthesized
caaaactgaataatgaaaat

SEQ ID NO: 128475 - DNA, 20 bp, Artificial Sequence
  chemically synthesized
atgaaaattggaaatctgaa

SEQ ID NO: 128476 - DNA, 20 bp, Artificial Sequence
  chemically synthesized
aattggaaatctgaaaagac

SEQ ID NO: 128477 - DNA, 20 bp, Artificial Sequence
  chemically synthesized
ttagctgttactggtctttt

SEQ ID NO: 128478 - DNA, 20 bp, Artificial Sequence
  chemically synthesized
aaatctgaaaagaccagtaa

SEQ ID NO: 128479 - DNA, 20 bp, Artificial Sequence
  chemically synthesized
actctttccttagctgttac

SEQ ID NO: 128480 - DNA, 20 bp, Artificial Sequence
  chemically synthesized
tgaaaagaccagtaacagct

SEQ ID NO: 128481 - DNA, 20 bp, Artificial Sequence
  chemically synthesized
gaaaagaccagtaacagcta

SEQ ID NO: 128482 - DNA, 20 bp, Artificial Sequence
  chemically synthesized
agaccagtaacagctaagga

SEQ ID NO: 128483 - DNA, 20 bp, Artificial Sequence
  chemically synthesized
accagtaacagctaaggaaa

SEQ ID NO: 128484 - DNA, 20 bp, Artificial Sequence
  chemically synthesized
aatctccttaactctttcct

SEQ ID NO: 128485 - DNA, 20 bp, Artificial Sequence
  chemically synthesized
taacagctaaggaaagagtt

SEQ ID NO: 128486 - DNA, 20 bp, Artificial Sequence
  chemically synthesized
aacagctaaggaaagagtta

SEQ ID NO: 128487 - DNA, 20 bp, Artificial Sequence
  chemically synthesized
cagctaaggaaagagttaag

SEQ ID NO: 128488 - DNA, 20 bp, Artificial Sequence
  chemically synthesized
aagagttaaggagattgcat

SEQ ID NO: 128489 - DNA, 20 bp, Artificial Sequence
  chemically synthesized
gagattgcatcagtatttaa

SEQ ID NO: 128490 - DNA, 20 bp, Artificial Sequence
  chemically synthesized
atttaaaagttctcacatca

SEQ ID NO: 128491 - DNA, 20 bp, Artificial Sequence
  chemically synthesized
tttaaaagttctcacatcaa

SEQ ID NO: 128492 - DNA, 20 bp, Artificial Sequence
  chemically synthesized
cttgagctttcctttgatgt

SEQ ID NO: 128493 - DNA, 20 bp, Artificial Sequence
  chemically synthesized
aaagttctcacatcaaagga

SEQ ID NO: 128494 - DNA, 20 bp, Artificial Sequence
  chemically synthesized
ctcacatcaaaggaaagctc

SEQ ID NO: 128495 - DNA, 20 bp, Artificial Sequence
  chemically synthesized
atcaaaggaaagctcaagac

SEQ ID NO: 128496 - DNA, 20 bp, Artificial Sequence
  chemically synthesized
ccatgaagccatctggtctt

SEQ ID NO: 128497 - DNA, 20 bp, Artificial Sequence
  chemically synthesized
aaggaaagctcaagaccaga

SEQ ID NO: 128498 - DNA, 20 bp, Artificial Sequence
  chemically synthesized
aattctcccatgaagccatc

SEQ ID NO: 128499 - DNA, 20 bp, Artificial Sequence
  chemically synthesized
ctcaagaccagatggcttca

SEQ ID NO: 128500 - DNA, 20 bp, Artificial Sequence
  chemically synthesized
tcaagaccagatggcttcat

SEQ ID NO: 128501 - DNA, 20 bp, Artificial Sequence
  chemically synthesized
aagaccagatggcttcatgg

SEQ ID NO: 128502 - DNA, 20 bp, Artificial Sequence
  chemically synthesized
gtttgtagaattctcccatg

SEQ ID NO: 128503 - DNA, 20 bp, Artificial Sequence
  chemically synthesized
aggtcttctttaaatgtttg

SEQ ID NO: 128504 - DNA, 20 bp, Artificial Sequence
  chemically synthesized
gagaattctacaaacattta

SEQ ID NO: 128505 - DNA, 20 bp, Artificial Sequence
  chemically synthesized
aattctacaaacatttaaag

SEQ ID NO: 128506 - DNA, 20 bp, Artificial Sequence
  chemically synthesized
gtttgagaaagatttgtgtt

SEQ ID NO: 128507 - DNA, 20 bp, Artificial Sequence
  chemically synthesized
agtttgagaaagatttgtgt

SEQ ID NO: 128508 - DNA, 20 bp, Artificial Sequence
  chemically synthesized
ttttccaaaagagtttgaga

SEQ ID NO: 128509 - DNA, 20 bp, Artificial Sequence
  chemically synthesized
ttagttttccaaaagagttt

SEQ ID NO: 128510 - DNA, 20 bp, Artificial Sequence
  chemically synthesized
aaatctttctcaaactcttt

SEQ ID NO: 128511 - DNA, 20 bp, Artificial Sequence
  chemically synthesized
tcctctttagttttccaaaa

SEQ ID NO: 128512 - DNA, 20 bp, Artificial Sequence
  chemically synthesized
cttcctctttagttttccaa

SEQ ID NO: 128513 - DNA, 20 bp, Artificial Sequence
  chemically synthesized
caaactcttttggaaaacta

SEQ ID NO: 128514 - DNA, 20 bp, Artificial Sequence
  chemically synthesized
aactcttttggaaaactaaa

SEQ ID NO: 128515 - DNA, 20 bp, Artificial Sequence
  chemically synthesized
actcttttggaaaactaaag

SEQ ID NO: 128516 - DNA, 20 bp, Artificial Sequence
  chemically synthesized
cttttggaaaactaaagagg

SEQ ID NO: 128517 - DNA, 20 bp, Artificial Sequence
  chemically synthesized
ttttggaaaactaaagagga

SEQ ID NO: 128518 - DNA, 20 bp, Artificial Sequence
  chemically synthesized
tggacgaatcccttcctctt

SEQ ID NO: 128519 - DNA, 20 bp, Artificial Sequence
  chemically synthesized
tttggaaaactaaagaggaa

SEQ ID NO: 128520 - DNA, 20 bp, Artificial Sequence
  chemically synthesized
ctggccttgtaaaataaatt

SEQ ID NO: 128521 - DNA, 20 bp, Artificial Sequence
  chemically synthesized
ttcgtccaaatttattttac

SEQ ID NO: 128522 - DNA, 20 bp, Artificial Sequence
  chemically synthesized
tcgtccaaatttattttaca

SEQ ID NO: 128523 - DNA, 20 bp, Artificial Sequence
  chemically synthesized
ccaaatttattttacaaggc

SEQ ID NO: 128524 - DNA, 20 bp, Artificial Sequence
  chemically synthesized
ctttgggatcagggtattgc

SEQ ID NO: 128525 - DNA, 20 bp, Artificial Sequence
  chemically synthesized
tttgcctggctttgggatca

SEQ ID NO: 128526 - DNA, 20 bp, Artificial Sequence
  chemically synthesized
ccagcaataccctgatccca

SEQ ID NO: 128527 - DNA, 20 bp, Artificial Sequence
  chemically synthesized
ctttgcctggctttgggatc

SEQ ID NO: 128528 - DNA, 20 bp, Artificial Sequence
  chemically synthesized
tctttgcctggctttgggat

SEQ ID NO: 128529 - DNA, 20 bp, Artificial Sequence
  chemically synthesized
caataccctgatcccaaagc

SEQ ID NO: 128530 - DNA, 20 bp, Artificial Sequence
  chemically synthesized
aataccctgatcccaaagcc

SEQ ID NO: 128531 - DNA, 20 bp, Artificial Sequence
  chemically synthesized
tagtgtctttgcctggcttt

SEQ ID NO: 128532 - DNA, 20 bp, Artificial Sequence
  chemically synthesized
gtagtgtctttgcctggctt

SEQ ID NO: 128533 - DNA, 20 bp, Artificial Sequence
  chemically synthesized
cctgatcccaaagccaggca

SEQ ID NO: 128534 - DNA, 20 bp, Artificial Sequence
  chemically synthesized
ttccttgtagtgtctttgcc

SEQ ID NO: 128535 - DNA, 20 bp, Artificial Sequence
  chemically synthesized
aagccaggcaaagacactac

SEQ ID NO: 128536 - DNA, 20 bp, Artificial Sequence
  chemically synthesized
agccaggcaaagacactaca

SEQ ID NO: 128537 - DNA, 20 bp, Artificial Sequence
  chemically synthesized
aggcaaagacactacaagga

SEQ ID NO: 128538 - DNA, 20 bp, Artificial Sequence
  chemically synthesized
cctatagttttctttccttg

SEQ ID NO: 128539 - DNA, 20 bp, Artificial Sequence
  chemically synthesized
actacaaggaaagaaaacta

SEQ ID NO: 128540 - DNA, 20 bp, Artificial Sequence
  chemically synthesized
ctacaaggaaagaaaactat

SEQ ID NO: 128541 - DNA, 20 bp, Artificial Sequence
  chemically synthesized
tcattcgtgatattggccta

SEQ ID NO: 128542 - DNA, 20 bp, Artificial Sequence
  chemically synthesized
tctaatttcattcgtgatat

SEQ ID NO: 128543 - DNA, 20 bp, Artificial Sequence
  chemically synthesized
gccaatatcacgaatgaaat

SEQ ID NO: 128544 - DNA, 20 bp, Artificial Sequence
  chemically synthesized
tggttcactagtatttcatt

SEQ ID NO: 128545 - DNA, 20 bp, Artificial Sequence
  chemically synthesized
aaaaattctcaatgaaatac

SEQ ID NO: 128546 - DNA, 20 bp, Artificial Sequence
  chemically synthesized
aactattaaatatggttcac

SEQ ID NO: 128547 - DNA, 20 bp, Artificial Sequence
  chemically synthesized
tactagtgaaccatatttaa

SEQ ID NO: 128548 - DNA, 20 bp, Artificial Sequence
  chemically synthesized
ttctaataaactattaaata

SEQ ID NO: 128549 - DNA, 20 bp, Artificial Sequence
  chemically synthesized
aaccatatttaatagtttat

SEQ ID NO: 128550 - DNA, 20 bp, Artificial Sequence
  chemically synthesized
catatttaatagtttattag

SEQ ID NO: 128551 - DNA, 20 bp, Artificial Sequence
  chemically synthesized
atatttaatagtttattaga

SEQ ID NO: 128552 - DNA, 20 bp, Artificial Sequence
  chemically synthesized
aaggattattcaccatgacc

SEQ ID NO: 128553 - DNA, 20 bp, Artificial Sequence
  chemically synthesized
ggattattcaccatgaccaa

SEQ ID NO: 128554 - DNA, 20 bp, Artificial Sequence
  chemically synthesized
ggataaatccctcttggtca

SEQ ID NO: 128555 - DNA, 20 bp, Artificial Sequence
  chemically synthesized
gattattcaccatgaccaag

SEQ ID NO: 128556 - DNA, 20 bp, Artificial Sequence
  chemically synthesized
attattcaccatgaccaaga

SEQ ID NO: 128557 - DNA, 20 bp, Artificial Sequence
  chemically synthesized
tcccagggataaatccctct

SEQ ID NO: 128558 - DNA, 20 bp, Artificial Sequence
  chemically synthesized
gaccaagagggatttatccc

SEQ ID NO: 128559 - DNA, 20 bp, Artificial Sequence
  chemically synthesized
accaagagggatttatccct

SEQ ID NO: 128560 - DNA, 20 bp, Artificial Sequence
  chemically synthesized
agagggatttatccctggga

SEQ ID NO: 128561 - DNA, 20 bp, Artificial Sequence
  chemically synthesized
tgaaacaaccttctatccca

SEQ ID NO: 128562 - DNA, 20 bp, Artificial Sequence
  chemically synthesized
gggatttatccctgggatag

SEQ ID NO: 128563 - DNA, 20 bp, Artificial Sequence
  chemically synthesized
ttgaaacaaccttctatccc

SEQ ID NO: 128564 - DNA, 20 bp, Artificial Sequence
  chemically synthesized
ggatttatccctgggataga

SEQ ID NO: 128565 - DNA, 20 bp, Artificial Sequence
  chemically synthesized
attgaaacaaccttctatcc

SEQ ID NO: 128566 - DNA, 20 bp, Artificial Sequence
  chemically synthesized
aaatgtgattcaacatataa

SEQ ID NO: 128567 - DNA, 20 bp, Artificial Sequence
  chemically synthesized
attcaacatataacagaatg

SEQ ID NO: 128568 - DNA, 20 bp, Artificial Sequence
  chemically synthesized
agtttattaaaatgatcata

SEQ ID NO: 128569 - DNA, 20 bp, Artificial Sequence
  chemically synthesized
tatgatcattttaataaact

SEQ ID NO: 128570 - DNA, 20 bp, Artificial Sequence
  chemically synthesized
atcattttaataaactcaga

SEQ ID NO: 128571 - DNA, 20 bp, Artificial Sequence
  chemically synthesized
cattttaataaactcagaaa

SEQ ID NO: 128572 - DNA, 20 bp, Artificial Sequence
  chemically synthesized
ttttgtcaaatgctctttct

SEQ ID NO: 128573 - DNA, 20 bp, Artificial Sequence
  chemically synthesized
aaaattcaacatccttttat

SEQ ID NO: 128574 - DNA, 20 bp, Artificial Sequence
  chemically synthesized
ctaagagtttttctcataaa

SEQ ID NO: 128575 - DNA, 20 bp, Artificial Sequence
  chemically synthesized
gctaagagtttttctcataa

SEQ ID NO: 128576 - DNA, 20 bp, Artificial Sequence
  chemically synthesized
ccttttatgagaaaaactct

SEQ ID NO: 128577 - DNA, 20 bp, Artificial Sequence
  chemically synthesized
ttctatacctaatttgctaa

SEQ ID NO: 128578 - DNA, 20 bp, Artificial Sequence
  chemically synthesized
gagaaaaactcttagcaaat

SEQ ID NO: 128579 - DNA, 20 bp, Artificial Sequence
  chemically synthesized
tcttctatacctaatttgct

SEQ ID NO: 128580 - DNA, 20 bp, Artificial Sequence
  chemically synthesized
agaaaaactcttagcaaatt

SEQ ID NO: 128581 - DNA, 20 bp, Artificial Sequence
  chemically synthesized
aactcttagcaaattaggta

SEQ ID NO: 128582 - DNA, 20 bp, Artificial Sequence
  chemically synthesized
tcttagcaaattaggtatag

SEQ ID NO: 128583 - DNA, 20 bp, Artificial Sequence
  chemically synthesized
atagaagaaatgttctccaa

SEQ ID NO: 128584 - DNA, 20 bp, Artificial Sequence
  chemically synthesized
ttatggcttttattcttttg

SEQ ID NO: 128585 - DNA, 20 bp, Artificial Sequence
  chemically synthesized
atttatggcttttattcttt

SEQ ID NO: 128586 - DNA, 20 bp, Artificial Sequence
  chemically synthesized
aatgttctccaaaagaataa

SEQ ID NO: 128587 - DNA, 20 bp, Artificial Sequence
  chemically synthesized
agctgtgggcttgtaattta

SEQ ID NO: 128588 - DNA, 20 bp, Artificial Sequence
  chemically synthesized
gaataaaagccataaattac

SEQ ID NO: 128589 - DNA, 20 bp, Artificial Sequence
  chemically synthesized
agccataaattacaagccca

SEQ ID NO: 128590 - DNA, 20 bp, Artificial Sequence
  chemically synthesized
ttgtgcatgatgttagctgt

SEQ ID NO: 128591 - DNA, 20 bp, Artificial Sequence
  chemically synthesized
gttgtgcatgatgttagctg

SEQ ID NO: 128592 - DNA, 20 bp, Artificial Sequence
  chemically synthesized
tttactgttgtgcatgatgt

SEQ ID NO: 128593 - DNA, 20 bp, Artificial Sequence
  chemically synthesized
acagctaacatcatgcacaa

SEQ ID NO: 128594 - DNA, 20 bp, Artificial Sequence
  chemically synthesized
tcatgcacaacagtaaaacg

SEQ ID NO: 128595 - DNA, 20 bp, Artificial Sequence
  chemically synthesized
tgcacaacagtaaaacgtag

SEQ ID NO: 128596 - DNA, 20 bp, Artificial Sequence
  chemically synthesized
gcacaacagtaaaacgtaga

SEQ ID NO: 128597 - DNA, 20 bp, Artificial Sequence
  chemically synthesized
aacgtagaaggcttttctct

SEQ ID NO: 128598 - DNA, 20 bp, Artificial Sequence
  chemically synthesized
ttgctcctgatcttagagaa

SEQ ID NO: 128599 - DNA, 20 bp, Artificial Sequence
  chemically synthesized
agaaggcttttctctaagat

SEQ ID NO: 128600 - DNA, 20 bp, Artificial Sequence
  chemically synthesized
gaaggcttttctctaagatc

SEQ ID NO: 128601 - DNA, 20 bp, Artificial Sequence
  chemically synthesized
ttgtcttgctcctgatctta

SEQ ID NO: 128602 - DNA, 20 bp, Artificial Sequence
  chemically synthesized
aggcttttctctaagatcag

SEQ ID NO: 128603 - DNA, 20 bp, Artificial Sequence
  chemically synthesized
ctttgtcttgctcctgatct

SEQ ID NO: 128604 - DNA, 20 bp, Artificial Sequence
  chemically synthesized
ttttctctaagatcaggagc

SEQ ID NO: 128605 - DNA, 20 bp, Artificial Sequence
  chemically synthesized
ctaagatcaggagcaagaca

SEQ ID NO: 128606 - DNA, 20 bp, Artificial Sequence
  chemically synthesized
taaacaagggtggggagagt

SEQ ID NO: 128607 - DNA, 20 bp, Artificial Sequence
  chemically synthesized
ttaaacaagggtggggagag

SEQ ID NO: 128608 - DNA, 20 bp, Artificial Sequence
  chemically synthesized
aagttaaacaagggtgggga

SEQ ID NO: 128609 - DNA, 20 bp, Artificial Sequence
  chemically synthesized
ctaagttaaacaagggtggg

SEQ ID NO: 128610 - DNA, 20 bp, Artificial Sequence
  chemically synthesized
tactaagttaaacaagggtg

SEQ ID NO: 128611 - DNA, 20 bp, Artificial Sequence
  chemically synthesized
gtactaagttaaacaagggt

SEQ ID NO: 128612 - DNA, 20 bp, Artificial Sequence
  chemically synthesized
agtactaagttaaacaaggg

SEQ ID NO: 128613 - DNA, 20 bp, Artificial Sequence
  chemically synthesized
cccagtactaagttaaacaa

SEQ ID NO: 128614 - DNA, 20 bp, Artificial Sequence
  chemically synthesized
tcccagtactaagttaaaca

SEQ ID NO: 128615 - DNA, 20 bp, Artificial Sequence
  chemically synthesized
ctcccagtactaagttaaac

SEQ ID NO: 128616 - DNA, 20 bp, Artificial Sequence
  chemically synthesized
ctccccacccttgtttaact

SEQ ID NO: 128617 - DNA, 20 bp, Artificial Sequence
  chemically synthesized
acccttgtttaacttagtac

SEQ ID NO: 128618 - DNA, 20 bp, Artificial Sequence
  chemically synthesized
cccttgtttaacttagtact

SEQ ID NO: 128619 - DNA, 20 bp, Artificial Sequence
  chemically synthesized
tggctaggactcccagtact

SEQ ID NO: 128620 - DNA, 20 bp, Artificial Sequence
  chemically synthesized
cttgtttaacttagtactgg

SEQ ID NO: 128621 - DNA, 20 bp, Artificial Sequence
  chemically synthesized
taacttagtactgggagtcc

SEQ ID NO: 128622 - DNA, 20 bp, Artificial Sequence
  chemically synthesized
attgctctggctaggactcc

SEQ ID NO: 128623 - DNA, 20 bp, Artificial Sequence
  chemically synthesized
ttagtactgggagtcctagc

SEQ ID NO: 128624 - DNA, 20 bp, Artificial Sequence
  chemically synthesized
agtactgggagtcctagcca

SEQ ID NO: 128625 - DNA, 20 bp, Artificial Sequence
  chemically synthesized
cctgcctaattgctctggct

SEQ ID NO: 128626 - DNA, 20 bp, Artificial Sequence
  chemically synthesized
tcctgcctaattgctctggc

SEQ ID NO: 128627 - DNA, 20 bp, Artificial Sequence
  chemically synthesized
ggagtcctagccagagcaat

SEQ ID NO: 128628 - DNA, 20 bp, Artificial Sequence
  chemically synthesized
tttctcctgcctaattgctc

SEQ ID NO: 128629 - DNA, 20 bp, Artificial Sequence
  chemically synthesized
gagtcctagccagagcaatt

SEQ ID NO: 128630 - DNA, 20 bp, Artificial Sequence
  chemically synthesized
tcctagccagagcaattagg

SEQ ID NO: 128631 - DNA, 20 bp, Artificial Sequence
  chemically synthesized
cctagccagagcaattaggc

SEQ ID NO: 128632 - DNA, 20 bp, Artificial Sequence
  chemically synthesized
tagccagagcaattaggcag

SEQ ID NO: 128633 - DNA, 20 bp, Artificial Sequence
  chemically synthesized
cagagcaattaggcaggaga

SEQ ID NO: 128634 - DNA, 20 bp, Artificial Sequence
  chemically synthesized
taggcaggagaaagaaataa

SEQ ID NO: 128635 - DNA, 20 bp, Artificial Sequence
  chemically synthesized
aggcaggagaaagaaataaa

SEQ ID NO: 128636 - DNA, 20 bp, Artificial Sequence
  chemically synthesized
taaaaggcaaccaaactgaa

SEQ ID NO: 128637 - DNA, 20 bp, Artificial Sequence
  chemically synthesized
ttacttcatccttttcagtt

SEQ ID NO: 128638 - DNA, 20 bp, Artificial Sequence
  chemically synthesized
aaaaggcaaccaaactgaaa

SEQ ID NO: 128639 - DNA, 20 bp, Artificial Sequence
  chemically synthesized
caattttacttcatcctttt

SEQ ID NO: 128640 - DNA, 20 bp, Artificial Sequence
  chemically synthesized
caaccaaactgaaaaggatg

SEQ ID NO: 128641 - DNA, 20 bp, Artificial Sequence
  chemically synthesized
attatgtcatcagcaagaag

SEQ ID NO: 128642 - DNA, 20 bp, Artificial Sequence
  chemically synthesized
gattatgtcatcagcaagaa

SEQ ID NO: 128643 - DNA, 20 bp, Artificial Sequence
  chemically synthesized
agattatgtcatcagcaaga

SEQ ID NO: 128644 - DNA, 20 bp, Artificial Sequence
  chemically synthesized
aagattatgtcatcagcaag

SEQ ID NO: 128645 - DNA, 20 bp, Artificial Sequence
  chemically synthesized
tataagattatgtcatcagc

SEQ ID NO: 128646 - DNA, 20 bp, Artificial Sequence
  chemically synthesized
gctgtataagattatgtcat

SEQ ID NO: 128647 - DNA, 20 bp, Artificial Sequence
  chemically synthesized
gctgatgacataatcttata

SEQ ID NO: 128648 - DNA, 20 bp, Artificial Sequence
  chemically synthesized
gtccttaggatttgctgtat

SEQ ID NO: 128649 - DNA, 20 bp, Artificial Sequence
  chemically synthesized
aatcttatacagcaaatcct

SEQ ID NO: 128650 - DNA, 20 bp, Artificial Sequence
  chemically synthesized
atcttatacagcaaatccta

SEQ ID NO: 128651 - DNA, 20 bp, Artificial Sequence
  chemically synthesized
cagttttcagtggagtcctt

SEQ ID NO: 128652 - DNA, 20 bp, Artificial Sequence
  chemically synthesized
acagttttcagtggagtcct

SEQ ID NO: 128653 - DNA, 20 bp, Artificial Sequence
  chemically synthesized
aattctaacagttttcagtg

SEQ ID NO: 128654 - DNA, 20 bp, Artificial Sequence
  chemically synthesized
tgaattctaacagttttcag

SEQ ID NO: 128655 - DNA, 20 bp, Artificial Sequence
  chemically synthesized
gtatgaattctaacagtttt

SEQ ID NO: 128656 - DNA, 20 bp, Artificial Sequence
  chemically synthesized
aggactccactgaaaactgt

SEQ ID NO: 128657 - DNA, 20 bp, Artificial Sequence
  chemically synthesized
aacttgtgtatgaattctaa

SEQ ID NO: 128658 - DNA, 20 bp, Artificial Sequence
  chemically synthesized
aactgttagaattcatacac

SEQ ID NO: 128659 - DNA, 20 bp, Artificial Sequence
  chemically synthesized
ttagaattcatacacaagtt

SEQ ID NO: 128660 - DNA, 20 bp, Artificial Sequence
  chemically synthesized
attcatacacaagtttagta

SEQ ID NO: 128661 - DNA, 20 bp, Artificial Sequence
  chemically synthesized
acacaagtttagtaaagttg

SEQ ID NO: 128662 - DNA, 20 bp, Artificial Sequence
  chemically synthesized
cacaagtttagtaaagttgc

SEQ ID NO: 128663 - DNA, 20 bp, Artificial Sequence
  chemically synthesized
acaagtttagtaaagttgca

SEQ ID NO: 128664 - DNA, 20 bp, Artificial Sequence
  chemically synthesized
ttatcgctactgatttttgt

SEQ ID NO: 128665 - DNA, 20 bp, Artificial Sequence
  chemically synthesized
caaaatcaacttacaaaaat

SEQ ID NO: 128666 - DNA, 20 bp, Artificial Sequence
  chemically synthesized
aatcaacttacaaaaatcag

SEQ ID NO: 128667 - DNA, 20 bp, Artificial Sequence
  chemically synthesized
taacaacaaactgtctaaaa

SEQ ID NO: 128668 - DNA, 20 bp, Artificial Sequence
  chemically synthesized
tccttaatttctattttaga

SEQ ID NO: 128669 - DNA, 20 bp, Artificial Sequence
  chemically synthesized
tgtttccttaatttctattt

SEQ ID NO: 128670 - DNA, 20 bp, Artificial Sequence
  chemically synthesized
aactgtctaaaatagaaatt

SEQ ID NO: 128671 - DNA, 20 bp, Artificial Sequence
  chemically synthesized
actgtctaaaatagaaatta

SEQ ID NO: 128672 - DNA, 20 bp, Artificial Sequence
  chemically synthesized
tttttcatgctattataagt

SEQ ID NO: 128673 - DNA, 20 bp, Artificial Sequence
  chemically synthesized
ggaaacaatctcacttataa

SEQ ID NO: 128674 - DNA, 20 bp, Artificial Sequence
  chemically synthesized
atattttttcatgctattat

SEQ ID NO: 128675 - DNA, 20 bp, Artificial Sequence
  chemically synthesized
taatagcatgaaaaaatatt

SEQ ID NO: 128676 - DNA, 20 bp, Artificial Sequence
  chemically synthesized
atagcatgaaaaaatatttg

SEQ ID NO: 128677 - DNA, 20 bp, Artificial Sequence
  chemically synthesized
tatttggagtgaatttaacc

SEQ ID NO: 128678 - DNA, 20 bp, Artificial Sequence
  chemically synthesized
tggagtgaatttaaccaaga

SEQ ID NO: 128679 - DNA, 20 bp, Artificial Sequence
  chemically synthesized
acgcagatctttcactttct

SEQ ID NO: 128680 - DNA, 20 bp, Artificial Sequence
  chemically synthesized
gaatttaaccaagaaagtga

SEQ ID NO: 128681 - DNA, 20 bp, Artificial Sequence
  chemically synthesized
tgtcttatagtttcaacacg

SEQ ID NO: 128682 - DNA, 20 bp, Artificial Sequence
  chemically synthesized
gatctgcgtgttgaaactat

SEQ ID NO: 128683 - DNA, 20 bp, Artificial Sequence
  chemically synthesized
tttctttcgtcagtgtctta

SEQ ID NO: 128684 - DNA, 20 bp, Artificial Sequence
  chemically synthesized
aaactataagacactgacga

SEQ ID NO: 128685 - DNA, 20 bp, Artificial Sequence
  chemically synthesized
tcatcttcaatttctttcgt

SEQ ID NO: 128686 - DNA, 20 bp, Artificial Sequence
  chemically synthesized
gacactgacgaaagaaattg

SEQ ID NO: 128687 - DNA, 20 bp, Artificial Sequence
  chemically synthesized
ttgaagatgacacaaataaa

SEQ ID NO: 128688 - DNA, 20 bp, Artificial Sequence
  chemically synthesized
agatgacacaaataaatgga

SEQ ID NO: 128689 - DNA, 20 bp, Artificial Sequence
  chemically synthesized
atttttccaatttatgaaca

SEQ ID NO: 128690 - DNA, 20 bp, Artificial Sequence
  chemically synthesized
agatttctgtgttcataaat

SEQ ID NO: 128691 - DNA, 20 bp, Artificial Sequence
  chemically synthesized
aattaatattgttaaacata

SEQ ID NO: 128692 - DNA, 20 bp, Artificial Sequence
  chemically synthesized
gttaaacataaagcaatcta

SEQ ID NO: 128693 - DNA, 20 bp, Artificial Sequence
  chemically synthesized
ttagtattgtgtcgaatctt

SEQ ID NO: 128694 - DNA, 20 bp, Artificial Sequence
  chemically synthesized
gaacaatatgcagattttgt

SEQ ID NO: 128695 - DNA, 20 bp, Artificial Sequence
  chemically synthesized
attctataaagaacaatatg

SEQ ID NO: 128696 - DNA, 20 bp, Artificial Sequence
  chemically synthesized
aatctgcatattgttcttta

SEQ ID NO: 128697 - DNA, 20 bp, Artificial Sequence
  chemically synthesized
tttttaaaaaaaattctata

SEQ ID NO: 128698 - DNA, 20 bp, Artificial Sequence
  chemically synthesized
tgtggttccatgcaaatttt

SEQ ID NO: 128699 - DNA, 20 bp, Artificial Sequence
  chemically synthesized
ttgtggttccatgcaaattt

SEQ ID NO: 128700 - DNA, 20 bp, Artificial Sequence
  chemically synthesized
aaaaaatcctaaaatttgca

SEQ ID NO: 128701 - DNA, 20 bp, Artificial Sequence
  chemically synthesized
aaatttgcatggaaccacaa

SEQ ID NO: 128702 - DNA, 20 bp, Artificial Sequence
  chemically synthesized
tggctatccagggtcttttg

SEQ ID NO: 128703 - DNA, 20 bp, Artificial Sequence
  chemically synthesized
catggaaccacaaaagaccc

SEQ ID NO: 128704 - DNA, 20 bp, Artificial Sequence
  chemically synthesized
gaaccacaaaagaccctgga

SEQ ID NO: 128705 - DNA, 20 bp, Artificial Sequence
  chemically synthesized
aagacagctttggctatcca

SEQ ID NO: 128706 - DNA, 20 bp, Artificial Sequence
  chemically synthesized
aaagacagctttggctatcc

SEQ ID NO: 128707 - DNA, 20 bp, Artificial Sequence
  chemically synthesized
taaagacagctttggctatc

SEQ ID NO: 128708 - DNA, 20 bp, Artificial Sequence
  chemically synthesized
caaaagaccctggatagcca

SEQ ID NO: 128709 - DNA, 20 bp, Artificial Sequence
  chemically synthesized
ctttttagtaaagacagctt

SEQ ID NO: 128710 - DNA, 20 bp, Artificial Sequence
  chemically synthesized
tttattctttttagtaaaga

SEQ ID NO: 128711 - DNA, 20 bp, Artificial Sequence
  chemically synthesized
ccaaagctgtctttactaaa

SEQ ID NO: 128712 - DNA, 20 bp, Artificial Sequence
  chemically synthesized
caattttattctttttagta

SEQ ID NO: 128713 - DNA, 20 bp, Artificial Sequence
  chemically synthesized
acttccaattttattctttt

SEQ ID NO: 128714 - DNA, 20 bp, Artificial Sequence
  chemically synthesized
tttactaaaaagaataaaat

SEQ ID NO: 128715 - DNA, 20 bp, Artificial Sequence
  chemically synthesized
actaaaaagaataaaattgg

SEQ ID NO: 128716 - DNA, 20 bp, Artificial Sequence
  chemically synthesized
aattggaagtatgtcactac

SEQ ID NO: 128717 - DNA, 20 bp, Artificial Sequence
  chemically synthesized
taatacattttgaaatccag

SEQ ID NO: 128718 - DNA, 20 bp, Artificial Sequence
  chemically synthesized
ttgtaatacattttgaaatc

SEQ ID NO: 128719 - DNA, 20 bp, Artificial Sequence
  chemically synthesized
ggatttcaaaatgtattaca

SEQ ID NO: 128720 - DNA, 20 bp, Artificial Sequence
  chemically synthesized
ccatgctgttttgattatta

SEQ ID NO: 128721 - DNA, 20 bp, Artificial Sequence
  chemically synthesized
caaagctataataatcaaaa

SEQ ID NO: 128722 - DNA, 20 bp, Artificial Sequence
  chemically synthesized
ctataataatcaaaacagca

SEQ ID NO: 128723 - DNA, 20 bp, Artificial Sequence
  chemically synthesized
aataatcaaaacagcatggc

SEQ ID NO: 128724 - DNA, 20 bp, Artificial Sequence
  chemically synthesized
gcatggcaagtacataaaaa

SEQ ID NO: 128725 - DNA, 20 bp, Artificial Sequence
  chemically synthesized
agtacataaaaacagaccaa

SEQ ID NO: 128726 - DNA, 20 bp, Artificial Sequence
  chemically synthesized
taaaaacagaccaatggaat

SEQ ID NO: 128727 - DNA, 20 bp, Artificial Sequence
  chemically synthesized
tcctctttgtcttattccat

SEQ ID NO: 128728 - DNA, 20 bp, Artificial Sequence
  chemically synthesized
cagaccaatggaataagaca

SEQ ID NO: 128729 - DNA, 20 bp, Artificial Sequence
  chemically synthesized
gaccaatggaataagacaaa

SEQ ID NO: 128730 - DNA, 20 bp, Artificial Sequence
  chemically synthesized
accaatggaataagacaaag

SEQ ID NO: 128731 - DNA, 20 bp, Artificial Sequence
  chemically synthesized
aaaggtgtgtaggtttattt

SEQ ID NO: 128732 - DNA, 20 bp, Artificial Sequence
  chemically synthesized
tcaattgatcaaaggtgtgt

SEQ ID NO: 128733 - DNA, 20 bp, Artificial Sequence
  chemically synthesized
atcaattgatcaaaggtgtg

SEQ ID NO: 128734 - DNA, 20 bp, Artificial Sequence
  chemically synthesized
gtcaaaaatcaattgatcaa

SEQ ID NO: 128735 - DNA, 20 bp, Artificial Sequence
  chemically synthesized
tgtcaaaaatcaattgatca

SEQ ID NO: 128736 - DNA, 20 bp, Artificial Sequence
  chemically synthesized
tgatcaattgatttttgaca

SEQ ID NO: 128737 - DNA, 20 bp, Artificial Sequence
  chemically synthesized
gatcaattgatttttgacaa

SEQ ID NO: 128738 - DNA, 20 bp, Artificial Sequence
  chemically synthesized
caattgatttttgacaaagg

SEQ ID NO: 128739 - DNA, 20 bp, Artificial Sequence
  chemically synthesized
tgatttttgacaaaggtagc

SEQ ID NO: 128740 - DNA, 20 bp, Artificial Sequence
  chemically synthesized
aaggtagcaagaacacacaa

SEQ ID NO: 128741 - DNA, 20 bp, Artificial Sequence
  chemically synthesized
aggtagcaagaacacacaat

SEQ ID NO: 128742 - DNA, 20 bp, Artificial Sequence
  chemically synthesized
ggtagcaagaacacacaata

SEQ ID NO: 128743 - DNA, 20 bp, Artificial Sequence
  chemically synthesized
tagcaagaacacacaatagg

SEQ ID NO: 128744 - DNA, 20 bp, Artificial Sequence
  chemically synthesized
gcaagaacacacaataggga

SEQ ID NO: 128745 - DNA, 20 bp, Artificial Sequence
  chemically synthesized
caagaacacacaatagggag

SEQ ID NO: 128746 - DNA, 20 bp, Artificial Sequence
  chemically synthesized
aacacacaatagggagagga

SEQ ID NO: 128747 - DNA, 20 bp, Artificial Sequence
  chemically synthesized
tcccaataccatttattgaa

SEQ ID NO: 128748 - DNA, 20 bp, Artificial Sequence
  chemically synthesized
aggacagtctcttcaataaa

SEQ ID NO: 128749 - DNA, 20 bp, Artificial Sequence
  chemically synthesized
tttcccaataccatttattg

SEQ ID NO: 128750 - DNA, 20 bp, Artificial Sequence
  chemically synthesized
gtctcttcaataaatggtat

SEQ ID NO: 128751 - DNA, 20 bp, Artificial Sequence
  chemically synthesized
tctcttcaataaatggtatt

SEQ ID NO: 128752 - DNA, 20 bp, Artificial Sequence
  chemically synthesized
ttattctgtatgtgaacatt

SEQ ID NO: 128753 - DNA, 20 bp, Artificial Sequence
  chemically synthesized
gaaaactgaatgttcacata

SEQ ID NO: 128754 - DNA, 20 bp, Artificial Sequence
  chemically synthesized
gttcacatacagaataaaac

SEQ ID NO: 128755 - DNA, 20 bp, Artificial Sequence
  chemically synthesized
taaggggtgagataagggtc

SEQ ID NO: 128756 - DNA, 20 bp, Artificial Sequence
  chemically synthesized
ttgtataaggggtgagataa

SEQ ID NO: 128757 - DNA, 20 bp, Artificial Sequence
  chemically synthesized
cttgtataaggggtgagata

SEQ ID NO: 128758 - DNA, 20 bp, Artificial Sequence
  chemically synthesized
tcttgtataaggggtgagat

SEQ ID NO: 128759 - DNA, 20 bp, Artificial Sequence
  chemically synthesized
ttgattcttgtataaggggt

SEQ ID NO: 128760 - DNA, 20 bp, Artificial Sequence
  chemically synthesized
ccttatctcaccccttatac

SEQ ID NO: 128761 - DNA, 20 bp, Artificial Sequence
  chemically synthesized
tgagttgattcttgtataag

SEQ ID NO: 128762 - DNA, 20 bp, Artificial Sequence
  chemically synthesized
ttgagttgattcttgtataa

SEQ ID NO: 128763 - DNA, 20 bp, Artificial Sequence
  chemically synthesized
tttgagttgattcttgtata

SEQ ID NO: 128764 - DNA, 20 bp, Artificial Sequence
  chemically synthesized
ttttgagttgattcttgtat

SEQ ID NO: 128765 - DNA, 20 bp, Artificial Sequence
  chemically synthesized
atacaagaatcaactcaaaa

SEQ ID NO: 128766 - DNA, 20 bp, Artificial Sequence
  chemically synthesized
ttaaggctttaatccatttt

SEQ ID NO: 128767 - DNA, 20 bp, Artificial Sequence
  chemically synthesized
aatcaactcaaaatggatta

SEQ ID NO: 128768 - DNA, 20 bp, Artificial Sequence
  chemically synthesized
agtttcaggtattacattta

SEQ ID NO: 128769 - DNA, 20 bp, Artificial Sequence
  chemically synthesized
tagtttcaggtattacattt

SEQ ID NO: 128770 - DNA, 20 bp, Artificial Sequence
  chemically synthesized
tttttgtagtttttagtttc

SEQ ID NO: 128771 - DNA, 20 bp, Artificial Sequence
  chemically synthesized
gtttttgtagtttttagttt

SEQ ID NO: 128772 - DNA, 20 bp, Artificial Sequence
  chemically synthesized
tcttatgtttttgtagtttt

SEQ ID NO: 128773 - DNA, 20 bp, Artificial Sequence
  chemically synthesized
gctcttctcttatgtttttg

SEQ ID NO: 128774 - DNA, 20 bp, Artificial Sequence
  chemically synthesized
actaaaaactacaaaaacat

SEQ ID NO: 128775 - DNA, 20 bp, Artificial Sequence
  chemically synthesized
taaaaactacaaaaacataa

SEQ ID NO: 128776 - DNA, 20 bp, Artificial Sequence
  chemically synthesized
aaactacaaaaacataagag

SEQ ID NO: 128777 - DNA, 20 bp, Artificial Sequence
  chemically synthesized
actacaaaaacataagagaa

SEQ ID NO: 128778 - DNA, 20 bp, Artificial Sequence
  chemically synthesized
ctgcccagaccaatgtcatg

SEQ ID NO: 128779 - DNA, 20 bp, Artificial Sequence
  chemically synthesized
agagaagagctccatgacat

SEQ ID NO: 128780 - DNA, 20 bp, Artificial Sequence
  chemically synthesized
cactgcccagaccaatgtca

SEQ ID NO: 128781 - DNA, 20 bp, Artificial Sequence
  chemically synthesized
agagctccatgacattggtc

SEQ ID NO: 128782 - DNA, 20 bp, Artificial Sequence
  chemically synthesized
gagctccatgacattggtct

SEQ ID NO: 128783 - DNA, 20 bp, Artificial Sequence
  chemically synthesized
ctccatgacattggtctggg

SEQ ID NO: 128784 - DNA, 20 bp, Artificial Sequence
  chemically synthesized
catgacattggtctgggcag

SEQ ID NO: 128785 - DNA, 20 bp, Artificial Sequence
  chemically synthesized
atatgcaagaaaccactgcc

SEQ ID NO: 128786 - DNA, 20 bp, Artificial Sequence
  chemically synthesized
tgtgtttgggggtcatatgc

SEQ ID NO: 128787 - DNA, 20 bp, Artificial Sequence
  chemically synthesized
tttgtgttgattgtgtttgg

SEQ ID NO: 128788 - DNA, 20 bp, Artificial Sequence
  chemically synthesized
ttttgtgttgattgtgtttg

SEQ ID NO: 128789 - DNA, 20 bp, Artificial Sequence
  chemically synthesized
tttttgtgttgattgtgttt

SEQ ID NO: 128790 - DNA, 20 bp, Artificial Sequence
  chemically synthesized
atttttgtgttgattgtgtt

SEQ ID NO: 128791 - DNA, 20 bp, Artificial Sequence
  chemically synthesized
aaacacaatcaacacaaaaa

SEQ ID NO: 128792 - DNA, 20 bp, Artificial Sequence
  chemically synthesized
aacacaatcaacacaaaaat

SEQ ID NO: 128793 - DNA, 20 bp, Artificial Sequence
  chemically synthesized
caatcaacacaaaaataggt

SEQ ID NO: 128794 - DNA, 20 bp, Artificial Sequence
  chemically synthesized
caacacaaaaataggtaagt

SEQ ID NO: 128795 - DNA, 20 bp, Artificial Sequence
  chemically synthesized
taagattgcatcaaactaaa

SEQ ID NO: 128796 - DNA, 20 bp, Artificial Sequence
  chemically synthesized
ctttgctgtgcaaagctttt

SEQ ID NO: 128797 - DNA, 20 bp, Artificial Sequence
  chemically synthesized
tcaaactaaaaagctttgca

SEQ ID NO: 128798 - DNA, 20 bp, Artificial Sequence
  chemically synthesized
attgtttcctttgctgtgca

SEQ ID NO: 128799 - DNA, 20 bp, Artificial Sequence
  chemically synthesized
ctaaaaagctttgcacagca

SEQ ID NO: 128800 - DNA, 20 bp, Artificial Sequence
  chemically synthesized
taaaaagctttgcacagcaa

SEQ ID NO: 128801 - DNA, 20 bp, Artificial Sequence
  chemically synthesized
acagcaaaggaaacaattaa

SEQ ID NO: 128802 - DNA, 20 bp, Artificial Sequence
  chemically synthesized
aggaaacaattaatggaata

SEQ ID NO: 128803 - DNA, 20 bp, Artificial Sequence
  chemically synthesized
gaaacaattaatggaataaa

SEQ ID NO: 128804 - DNA, 20 bp, Artificial Sequence
  chemically synthesized
tggaataaagagacaaccca

SEQ ID NO: 128805 - DNA, 20 bp, Artificial Sequence
  chemically synthesized
taaagagacaacccacagat

SEQ ID NO: 128806 - DNA, 20 bp, Artificial Sequence
  chemically synthesized
aaagagacaacccacagatt

SEQ ID NO: 128807 - DNA, 20 bp, Artificial Sequence
  chemically synthesized
aatatcttctcccaatctgt

SEQ ID NO: 128808 - DNA, 20 bp, Artificial Sequence
  chemically synthesized
aaatatcttctcccaatctg

SEQ ID NO: 128809 - DNA, 20 bp, Artificial Sequence
  chemically synthesized
agagacaacccacagattgg

SEQ ID NO: 128810 - DNA, 20 bp, Artificial Sequence
  chemically synthesized
gacaacccacagattgggag

SEQ ID NO: 128811 - DNA, 20 bp, Artificial Sequence
  chemically synthesized
gatatttgcaaatcatacat

SEQ ID NO: 128812 - DNA, 20 bp, Artificial Sequence
  chemically synthesized
ttgcaaatcatacattagat

SEQ ID NO: 128813 - DNA, 20 bp, Artificial Sequence
  chemically synthesized
tgcaaatcatacattagata

SEQ ID NO: 128814 - DNA, 20 bp, Artificial Sequence
  chemically synthesized
tccttgtatattttggatat

SEQ ID NO: 128815 - DNA, 20 bp, Artificial Sequence
  chemically synthesized
cttgagttccttgtatattt

SEQ ID NO: 128816 - DNA, 20 bp, Artificial Sequence
  chemically synthesized
tgctaatatccaaaatatac

SEQ ID NO: 128817 - DNA, 20 bp, Artificial Sequence
  chemically synthesized
gctaatatccaaaatataca

SEQ ID NO: 128818 - DNA, 20 bp, Artificial Sequence
  chemically synthesized
ccaaaatatacaaggaactc

SEQ ID NO: 128819 - DNA, 20 bp, Artificial Sequence
  chemically synthesized
ttcttgttattgagtagctt

SEQ ID NO: 128820 - DNA, 20 bp, Artificial Sequence
  chemically synthesized
tttgttttcttgttattgag

SEQ ID NO: 128821 - DNA, 20 bp, Artificial Sequence
  chemically synthesized
aactcaagctactcaataac

SEQ ID NO: 128822 - DNA, 20 bp, Artificial Sequence
  chemically synthesized
ttatttgttttcttgttatt

SEQ ID NO: 128823 - DNA, 20 bp, Artificial Sequence
  chemically synthesized
atttgcccatttttttatta

SEQ ID NO: 128824 - DNA, 20 bp, Artificial Sequence
  chemically synthesized
tatttgcccatttttttatt

SEQ ID NO: 128825 - DNA, 20 bp, Artificial Sequence
  chemically synthesized
atatttgcccatttttttat

SEQ ID NO: 128826 - DNA, 20 bp, Artificial Sequence
  chemically synthesized
aaataaccctaataaaaaaa

SEQ ID NO: 128827 - DNA, 20 bp, Artificial Sequence
  chemically synthesized
aataaccctaataaaaaaat

SEQ ID NO: 128828 - DNA, 20 bp, Artificial Sequence
  chemically synthesized
aaaatgggcaaatatatgaa

SEQ ID NO: 128829 - DNA, 20 bp, Artificial Sequence
  chemically synthesized
atatgaatagacattctcaa

SEQ ID NO: 128830 - DNA, 20 bp, Artificial Sequence
  chemically synthesized
tatgctgtttgtcatctttt

SEQ ID NO: 128831 - DNA, 20 bp, Artificial Sequence
  chemically synthesized
cattctcaaaagatgacaaa

SEQ ID NO: 128832 - DNA, 20 bp, Artificial Sequence
  chemically synthesized
ttttgatgattagagatgtt

SEQ ID NO: 128833 - DNA, 20 bp, Artificial Sequence
  chemically synthesized
tttgcattttttgatgatta

SEQ ID NO: 128834 - DNA, 20 bp, Artificial Sequence
  chemically synthesized
aatttgcattttttgatgat

SEQ ID NO: 128835 - DNA, 20 bp, Artificial Sequence
  chemically synthesized
atgcaaattaaaatcacaat

SEQ ID NO: 128836 - DNA, 20 bp, Artificial Sequence
  chemically synthesized
tagccaatccaaaagatatg

SEQ ID NO: 128837 - DNA, 20 bp, Artificial Sequence
  chemically synthesized
atagccaatccaaaagatat

SEQ ID NO: 128838 - DNA, 20 bp, Artificial Sequence
  chemically synthesized
agatatcacctcatatcttt

SEQ ID NO: 128839 - DNA, 20 bp, Artificial Sequence
  chemically synthesized
tcacctcatatcttttggat

SEQ ID NO: 128840 - DNA, 20 bp, Artificial Sequence
  chemically synthesized
tttgataatagccaatccaa

SEQ ID NO: 128841 - DNA, 20 bp, Artificial Sequence
  chemically synthesized
atctttcaactttttgataa

SEQ ID NO: 128842 - DNA, 20 bp, Artificial Sequence
  chemically synthesized
ttggattggctattatcaaa

SEQ ID NO: 128843 - DNA, 20 bp, Artificial Sequence
  chemically synthesized
ggctattatcaaaaagttga

SEQ ID NO: 128844 - DNA, 20 bp, Artificial Sequence
  chemically synthesized
tcaaaaagttgaaagataac

SEQ ID NO: 128845 - DNA, 20 bp, Artificial Sequence
  chemically synthesized
gaaagataacaagtgttcat

SEQ ID NO: 128846 - DNA, 20 bp, Artificial Sequence
  chemically synthesized
aaagataacaagtgttcatg

SEQ ID NO: 128847 - DNA, 20 bp, Artificial Sequence
  chemically synthesized
aacaagtgttcatgaggata

SEQ ID NO: 128848 - DNA, 20 bp, Artificial Sequence
  chemically synthesized
caagtgttcatgaggataca

SEQ ID NO: 128849 - DNA, 20 bp, Artificial Sequence
  chemically synthesized
ttcatgaggatacagagaat

SEQ ID NO: 128850 - DNA, 20 bp, Artificial Sequence
  chemically synthesized
tcatgaggatacagagaata

SEQ ID NO: 128851 - DNA, 20 bp, Artificial Sequence
  chemically synthesized
aatactaccaatagtggata

SEQ ID NO: 128852 - DNA, 20 bp, Artificial Sequence
  chemically synthesized
caatactaccaatagtggat

SEQ ID NO: 128853 - DNA, 20 bp, Artificial Sequence
  chemically synthesized
aaggaaaccttatccactat

SEQ ID NO: 128854 - DNA, 20 bp, Artificial Sequence
  chemically synthesized
gaaaccttatccactattgg

SEQ ID NO: 128855 - DNA, 20 bp, Artificial Sequence
  chemically synthesized
attcacaatactaccaatag

SEQ ID NO: 128856 - DNA, 20 bp, Artificial Sequence
  chemically synthesized
ctaattcacaatactaccaa

SEQ ID NO: 128857 - DNA, 20 bp, Artificial Sequence
  chemically synthesized
ctattggtagtattgtgaat

SEQ ID NO: 128858 - DNA, 20 bp, Artificial Sequence
  chemically synthesized
gtagtattgtgaattagtaa

SEQ ID NO: 128859 - DNA, 20 bp, Artificial Sequence
  chemically synthesized
aattagtaacggcctccata

SEQ ID NO: 128860 - DNA, 20 bp, Artificial Sequence
  chemically synthesized
cattcatactgtctttatgg

SEQ ID NO: 128861 - DNA, 20 bp, Artificial Sequence
  chemically synthesized
acattcatactgtctttatg

SEQ ID NO: 128862 - DNA, 20 bp, Artificial Sequence
  chemically synthesized
agtaacggcctccataaaga

SEQ ID NO: 128863 - DNA, 20 bp, Artificial Sequence
  chemically synthesized
aaacattcatactgtcttta

SEQ ID NO: 128864 - DNA, 20 bp, Artificial Sequence
  chemically synthesized
cattctctttttattatttt

SEQ ID NO: 128865 - DNA, 20 bp, Artificial Sequence
  chemically synthesized
atgtttctcaaaataataaa

SEQ ID NO: 128866 - DNA, 20 bp, Artificial Sequence
  chemically synthesized
gtttctcaaaataataaaaa

SEQ ID NO: 128867 - DNA, 20 bp, Artificial Sequence
  chemically synthesized
aagagaatgaccatatgttc

SEQ ID NO: 128868 - DNA, 20 bp, Artificial Sequence
  chemically synthesized
agtgggatttctggaacata

SEQ ID NO: 128869 - DNA, 20 bp, Artificial Sequence
  chemically synthesized
gtacccagaagtgggatttc

SEQ ID NO: 128870 - DNA, 20 bp, Artificial Sequence
  chemically synthesized
tgttccagaaatcccacttc

SEQ ID NO: 128871 - DNA, 20 bp, Artificial Sequence
  chemically synthesized
gttccagaaatcccacttct

SEQ ID NO: 128872 - DNA, 20 bp, Artificial Sequence
  chemically synthesized
ttgagtatgtacccagaagt

SEQ ID NO: 128873 - DNA, 20 bp, Artificial Sequence
  chemically synthesized
tttgagtatgtacccagaag

SEQ ID NO: 128874 - DNA, 20 bp, Artificial Sequence
  chemically synthesized
tcttttgagtatgtacccag

SEQ ID NO: 128875 - DNA, 20 bp, Artificial Sequence
  chemically synthesized
ttttcttttgagtatgtacc

SEQ ID NO: 128876 - DNA, 20 bp, Artificial Sequence
  chemically synthesized
acttctgggtacatactcaa

SEQ ID NO: 128877 - DNA, 20 bp, Artificial Sequence
  chemically synthesized
tgggtacatactcaaaagaa

SEQ ID NO: 128878 - DNA, 20 bp, Artificial Sequence
  chemically synthesized
acactccctccttttctttt

SEQ ID NO: 128879 - DNA, 20 bp, Artificial Sequence
  chemically synthesized
gggtacatactcaaaagaaa

SEQ ID NO: 128880 - DNA, 20 bp, Artificial Sequence
  chemically synthesized
gtacatactcaaaagaaaag

SEQ ID NO: 128881 - DNA, 20 bp, Artificial Sequence
  chemically synthesized
tacatactcaaaagaaaagg

SEQ ID NO: 128882 - DNA, 20 bp, Artificial Sequence
  chemically synthesized
acatactcaaaagaaaagga

SEQ ID NO: 128883 - DNA, 20 bp, Artificial Sequence
  chemically synthesized
atactcaaaagaaaaggagg

SEQ ID NO: 128884 - DNA, 20 bp, Artificial Sequence
  chemically synthesized
gaaaaggagggagtgtattg

SEQ ID NO: 128885 - DNA, 20 bp, Artificial Sequence
  chemically synthesized
aaaggagggagtgtattgaa

SEQ ID NO: 128886 - DNA, 20 bp, Artificial Sequence
  chemically synthesized
caacaatgtgagagtgcaga

SEQ ID NO: 128887 - DNA, 20 bp, Artificial Sequence
  chemically synthesized
gctacaacaatgtgagagtg

SEQ ID NO: 128888 - DNA, 20 bp, Artificial Sequence
  chemically synthesized
acagtgctacaacaatgtga

SEQ ID NO: 128889 - DNA, 20 bp, Artificial Sequence
  chemically synthesized
gaacagtgctacaacaatgt

SEQ ID NO: 128890 - DNA, 20 bp, Artificial Sequence
  chemically synthesized
tctgcactctcacattgttg

SEQ ID NO: 128891 - DNA, 20 bp, Artificial Sequence
  chemically synthesized
tgttgtagcactgttcacaa

SEQ ID NO: 128892 - DNA, 20 bp, Artificial Sequence
  chemically synthesized
caaatcttgcctgttgtgaa

SEQ ID NO: 128893 - DNA, 20 bp, Artificial Sequence
  chemically synthesized
gttgtagcactgttcacaac

SEQ ID NO: 128894 - DNA, 20 bp, Artificial Sequence
  chemically synthesized
tagcactgttcacaacaggc

SEQ ID NO: 128895 - DNA, 20 bp, Artificial Sequence
  chemically synthesized
tgttcacaacaggcaagatt

SEQ ID NO: 128896 - DNA, 20 bp, Artificial Sequence
  chemically synthesized
tcacaacaggcaagatttgg

SEQ ID NO: 128897 - DNA, 20 bp, Artificial Sequence
  chemically synthesized
aacaggcaagatttggaagc

SEQ ID NO: 128898 - DNA, 20 bp, Artificial Sequence
  chemically synthesized
ttcgcatgttgatggacagt

SEQ ID NO: 128899 - DNA, 20 bp, Artificial Sequence
  chemically synthesized
tccattcgcatgttgatgga

SEQ ID NO: 128900 - DNA, 20 bp, Artificial Sequence
  chemically synthesized
tgtatccattcgcatgttga

SEQ ID NO: 128901 - DNA, 20 bp, Artificial Sequence
  chemically synthesized
actgtccatcaacatgcgaa

SEQ ID NO: 128902 - DNA, 20 bp, Artificial Sequence
  chemically synthesized
catcaacatgcgaatggata

SEQ ID NO: 128903 - DNA, 20 bp, Artificial Sequence
  chemically synthesized
gcgaatggatacagaaaatg

SEQ ID NO: 128904 - DNA, 20 bp, Artificial Sequence
  chemically synthesized
tagtaccgcatcatttatat

SEQ ID NO: 128905 - DNA, 20 bp, Artificial Sequence
  chemically synthesized
tgtggctcatataaatgatg

SEQ ID NO: 128906 - DNA, 20 bp, Artificial Sequence
  chemically synthesized
ataaatgatgcggtactatt

SEQ ID NO: 128907 - DNA, 20 bp, Artificial Sequence
  chemically synthesized
aattcttttttattgctaaa

SEQ ID NO: 128908 - DNA, 20 bp, Artificial Sequence
  chemically synthesized
ggtactatttagcaataaaa

SEQ ID NO: 128909 - DNA, 20 bp, Artificial Sequence
  chemically synthesized
tccaagatgttgcaaatgac

SEQ ID NO: 128910 - DNA, 20 bp, Artificial Sequence
  chemically synthesized
atccaagatgttgcaaatga

SEQ ID NO: 128911 - DNA, 20 bp, Artificial Sequence
  chemically synthesized
tcctgtcatttgcaacatct

SEQ ID NO: 128912 - DNA, 20 bp, Artificial Sequence
  chemically synthesized
gtcatttgcaacatcttgga

SEQ ID NO: 128913 - DNA, 20 bp, Artificial Sequence
  chemically synthesized
aatgacctccagttccatcc

SEQ ID NO: 128914 - DNA, 20 bp, Artificial Sequence
  chemically synthesized
tgcaacatcttggatggaac

SEQ ID NO: 128915 - DNA, 20 bp, Artificial Sequence
  chemically synthesized
caacatcttggatggaactg

SEQ ID NO: 128916 - DNA, 20 bp, Artificial Sequence
  chemically synthesized
aacatcttggatggaactgg

SEQ ID NO: 128917 - DNA, 20 bp, Artificial Sequence
  chemically synthesized
tcatttaatgtaatgacctc

SEQ ID NO: 128918 - DNA, 20 bp, Artificial Sequence
  chemically synthesized
gtcattacattaaatgaaat

SEQ ID NO: 128919 - DNA, 20 bp, Artificial Sequence
  chemically synthesized
ttacattaaatgaaataagc

SEQ ID NO: 128920 - DNA, 20 bp, Artificial Sequence
  chemically synthesized
taaatgaaataagccagtca

SEQ ID NO: 128921 - DNA, 20 bp, Artificial Sequence
  chemically synthesized
agtgattttcgttctgtgac

SEQ ID NO: 128922 - DNA, 20 bp, Artificial Sequence
  chemically synthesized
cacaaataagtgagaacatg

SEQ ID NO: 128923 - DNA, 20 bp, Artificial Sequence
  chemically synthesized
tttagatcccacaaataagt

SEQ ID NO: 128924 - DNA, 20 bp, Artificial Sequence
  chemically synthesized
tgcatgttctcacttatttg

SEQ ID NO: 128925 - DNA, 20 bp, Artificial Sequence
  chemically synthesized
gcatgttctcacttatttgt

SEQ ID NO: 128926 - DNA, 20 bp, Artificial Sequence
  chemically synthesized
aatttttagatcccacaaat

SEQ ID NO: 128927 - DNA, 20 bp, Artificial Sequence
  chemically synthesized
agttcaatagttttaatttt

SEQ ID NO: 128928 - DNA, 20 bp, Artificial Sequence
  chemically synthesized
ttctgtctccatgagttcaa

SEQ ID NO: 128929 - DNA, 20 bp, Artificial Sequence
  chemically synthesized
aattaaaactattgaactca

SEQ ID NO: 128930 - DNA, 20 bp, Artificial Sequence
  chemically synthesized
ttaaaactattgaactcatg

SEQ ID NO: 128931 - DNA, 20 bp, Artificial Sequence
  chemically synthesized
aactattgaactcatggaga

SEQ ID NO: 128932 - DNA, 20 bp, Artificial Sequence
  chemically synthesized
tccttttattctgtctccat

SEQ ID NO: 128933 - DNA, 20 bp, Artificial Sequence
  chemically synthesized
aactcatggagacagaataa

SEQ ID NO: 128934 - DNA, 20 bp, Artificial Sequence
  chemically synthesized
actcatggagacagaataaa

SEQ ID NO: 128935 - DNA, 20 bp, Artificial Sequence
  chemically synthesized
atggagacagaataaaagga

SEQ ID NO: 128936 - DNA, 20 bp, Artificial Sequence
  chemically synthesized
cagaataaaaggatggttac

SEQ ID NO: 128937 - DNA, 20 bp, Artificial Sequence
  chemically synthesized
gaataaaaggatggttacca

SEQ ID NO: 128938 - DNA, 20 bp, Artificial Sequence
  chemically synthesized
aataaaaggatggttaccag

SEQ ID NO: 128939 - DNA, 20 bp, Artificial Sequence
  chemically synthesized
acactaccctttgtagcctc

SEQ ID NO: 128940 - DNA, 20 bp, Artificial Sequence
  chemically synthesized
gatggttaccagaggctaca

SEQ ID NO: 128941 - DNA, 20 bp, Artificial Sequence
  chemically synthesized
atggttaccagaggctacaa

SEQ ID NO: 128942 - DNA, 20 bp, Artificial Sequence
  chemically synthesized
tggttaccagaggctacaaa

SEQ ID NO: 128943 - DNA, 20 bp, Artificial Sequence
  chemically synthesized
ttaccagaggctacaaaggg

SEQ ID NO: 128944 - DNA, 20 bp, Artificial Sequence
  chemically synthesized
tacctccacactaccctttg

SEQ ID NO: 128945 - DNA, 20 bp, Artificial Sequence
  chemically synthesized
agaggctacaaagggtagtg

SEQ ID NO: 128946 - DNA, 20 bp, Artificial Sequence
  chemically synthesized
aggctacaaagggtagtgtg

SEQ ID NO: 128947 - DNA, 20 bp, Artificial Sequence
  chemically synthesized
ggctacaaagggtagtgtgg

SEQ ID NO: 128948 - DNA, 20 bp, Artificial Sequence
  chemically synthesized
tacaaagggtagtgtggagg

SEQ ID NO: 128949 - DNA, 20 bp, Artificial Sequence
  chemically synthesized
acaaagggtagtgtggaggt

SEQ ID NO: 128950 - DNA, 20 bp, Artificial Sequence
  chemically synthesized
caaagggtagtgtggaggta

SEQ ID NO: 128951 - DNA, 20 bp, Artificial Sequence
  chemically synthesized
aaagggtagtgtggaggtag

SEQ ID NO: 128952 - DNA, 20 bp, Artificial Sequence
  chemically synthesized
ggtagtgtggaggtagggga

SEQ ID NO: 128953 - DNA, 20 bp, Artificial Sequence
  chemically synthesized
gtagtgtggaggtaggggat

SEQ ID NO: 128954 - DNA, 20 bp, Artificial Sequence
  chemically synthesized
gtgtggaggtaggggatagg

SEQ ID NO: 128955 - DNA, 20 bp, Artificial Sequence
  chemically synthesized
tgtggaggtaggggataggt

SEQ ID NO: 128956 - DNA, 20 bp, Artificial Sequence
  chemically synthesized
gtggaggtaggggataggtg

SEQ ID NO: 128957 - DNA, 20 bp, Artificial Sequence
  chemically synthesized
aggggataggtggggattgt

SEQ ID NO: 128958 - DNA, 20 bp, Artificial Sequence
  chemically synthesized
ggataggtggggattgttag

SEQ ID NO: 128959 - DNA, 20 bp, Artificial Sequence
  chemically synthesized
ttgttagcggctacaaaaaa

SEQ ID NO: 128960 - DNA, 20 bp, Artificial Sequence
  chemically synthesized
ttctttctaactattttttg

SEQ ID NO: 128961 - DNA, 20 bp, Artificial Sequence
  chemically synthesized
tagcggctacaaaaaatagt

SEQ ID NO: 128962 - DNA, 20 bp, Artificial Sequence
  chemically synthesized
ggctacaaaaaatagttaga

SEQ ID NO: 128963 - DNA, 20 bp, Artificial Sequence
  chemically synthesized
aaaaaatagttagaaagaat

SEQ ID NO: 128964 - DNA, 20 bp, Artificial Sequence
  chemically synthesized
aatagttagaaagaatgagt

SEQ ID NO: 128965 - DNA, 20 bp, Artificial Sequence
  chemically synthesized
tagaaagaatgagtaagacc

SEQ ID NO: 128966 - DNA, 20 bp, Artificial Sequence
  chemically synthesized
ctgttgcactatcaaatact

SEQ ID NO: 128967 - DNA, 20 bp, Artificial Sequence
  chemically synthesized
cctgttgcactatcaaatac

SEQ ID NO: 128968 - DNA, 20 bp, Artificial Sequence
  chemically synthesized
gagtaagacctagtatttga

SEQ ID NO: 128969 - DNA, 20 bp, Artificial Sequence
  chemically synthesized
cctagtatttgatagtgcaa

SEQ ID NO: 128970 - DNA, 20 bp, Artificial Sequence
  chemically synthesized
ctagtatttgatagtgcaac

SEQ ID NO: 128971 - DNA, 20 bp, Artificial Sequence
  chemically synthesized
tagtatttgatagtgcaaca

SEQ ID NO: 128972 - DNA, 20 bp, Artificial Sequence
  chemically synthesized
agtatttgatagtgcaacag

SEQ ID NO: 128973 - DNA, 20 bp, Artificial Sequence
  chemically synthesized
gtatttgatagtgcaacagg

SEQ ID NO: 128974 - DNA, 20 bp, Artificial Sequence
  chemically synthesized
atagtgcaacagggggacta

SEQ ID NO: 128975 - DNA, 20 bp, Artificial Sequence
  chemically synthesized
aattaaattattattgacta

SEQ ID NO: 128976 - DNA, 20 bp, Artificial Sequence
  chemically synthesized
gtacattaaaaaataactaa

SEQ ID NO: 128977 - DNA, 20 bp, Artificial Sequence
  chemically synthesized
aaacaatgtaattgtacttt

SEQ ID NO: 128978 - DNA, 20 bp, Artificial Sequence
  chemically synthesized
aagtacaattacattgtttg

SEQ ID NO: 128979 - DNA, 20 bp, Artificial Sequence
  chemically synthesized
attacattgtttgtagcaca

SEQ ID NO: 128980 - DNA, 20 bp, Artificial Sequence
  chemically synthesized
ttacattgtttgtagcacaa

SEQ ID NO: 128981 - DNA, 20 bp, Artificial Sequence
  chemically synthesized
cacaaaggataaatgcttga

SEQ ID NO: 128982 - DNA, 20 bp, Artificial Sequence
  chemically synthesized
acaaaggataaatgcttgac

SEQ ID NO: 128983 - DNA, 20 bp, Artificial Sequence
  chemically synthesized
aggataaatgcttgacagga

SEQ ID NO: 128984 - DNA, 20 bp, Artificial Sequence
  chemically synthesized
aatgaggcatccatcctgtc

SEQ ID NO: 128985 - DNA, 20 bp, Artificial Sequence
  chemically synthesized
caagcacatcatggagaatg

SEQ ID NO: 128986 - DNA, 20 bp, Artificial Sequence
  chemically synthesized
acaagcacatcatggagaat

SEQ ID NO: 128987 - DNA, 20 bp, Artificial Sequence
  chemically synthesized
tgtgaaacaagcacatcatg

SEQ ID NO: 128988 - DNA, 20 bp, Artificial Sequence
  chemically synthesized
aatgtgaaacaagcacatca

SEQ ID NO: 128989 - DNA, 20 bp, Artificial Sequence
  chemically synthesized
ataggcatgtaatgtgaaac

SEQ ID NO: 128990 - DNA, 20 bp, Artificial Sequence
  chemically synthesized
tacatgaggtgttttgatat

SEQ ID NO: 128991 - DNA, 20 bp, Artificial Sequence
  chemically synthesized
gtacatgaggtgttttgata

SEQ ID NO: 128992 - DNA, 20 bp, Artificial Sequence
  chemically synthesized
atatatttacggggtacatg

SEQ ID NO: 128993 - DNA, 20 bp, Artificial Sequence
  chemically synthesized
tatatatttacggggtacat

SEQ ID NO: 128994 - DNA, 20 bp, Artificial Sequence
  chemically synthesized
agtaggtatatatatttacg

SEQ ID NO: 128995 - DNA, 20 bp, Artificial Sequence
  chemically synthesized
tagtaggtatatatatttac

SEQ ID NO: 128996 - DNA, 20 bp, Artificial Sequence
  chemically synthesized
atagtaggtatatatattta

SEQ ID NO: 128997 - DNA, 20 bp, Artificial Sequence
  chemically synthesized
aattttttggggtacatagt

SEQ ID NO: 128998 - DNA, 20 bp, Artificial Sequence
  chemically synthesized
taattttttggggtacatag

SEQ ID NO: 128999 - DNA, 20 bp, Artificial Sequence
  chemically synthesized
ttttaattttttggggtaca

SEQ ID NO: 129000 - DNA, 20 bp, Artificial Sequence
  chemically synthesized
tttttatttttaattttttg

SEQ ID NO: 129001 - DNA, 20 bp, Artificial Sequence
  chemically synthesized
ttttttatttttaatttttt

SEQ ID NO: 129002 - DNA, 20 bp, Artificial Sequence
  chemically synthesized
tttttttatttttaattttt

SEQ ID NO: 129003 - DNA, 20 bp, Artificial Sequence
  chemically synthesized
aaaaaaaaattttaaaaacc

SEQ ID NO: 129004 - DNA, 20 bp, Artificial Sequence
  chemically synthesized
aaaaaaaattttaaaaacct

SEQ ID NO: 129005 - DNA, 20 bp, Artificial Sequence
  chemically synthesized
tccaaatgacagaatttcct

SEQ ID NO: 129006 - DNA, 20 bp, Artificial Sequence
  chemically synthesized
ttccaaatgacagaatttcc

SEQ ID NO: 129007 - DNA, 20 bp, Artificial Sequence
  chemically synthesized
acctaggaaattctgtcatt

SEQ ID NO: 129008 - DNA, 20 bp, Artificial Sequence
  chemically synthesized
atccttattattccaaatga

SEQ ID NO: 129009 - DNA, 20 bp, Artificial Sequence
  chemically synthesized
attctgtcatttggaataat

SEQ ID NO: 129010 - DNA, 20 bp, Artificial Sequence
  chemically synthesized
ttctgtcatttggaataata

SEQ ID NO: 129011 - DNA, 20 bp, Artificial Sequence
  chemically synthesized
tcatttggaataataaggat

SEQ ID NO: 129012 - DNA, 20 bp, Artificial Sequence
  chemically synthesized
tggaataataaggatgagcc

SEQ ID NO: 129013 - DNA, 20 bp, Artificial Sequence
  chemically synthesized
gaataataaggatgagcctg

SEQ ID NO: 129014 - DNA, 20 bp, Artificial Sequence
  chemically synthesized
aataataaggatgagcctgg

SEQ ID NO: 129015 - DNA, 20 bp, Artificial Sequence
  chemically synthesized
cacttaacctaatgtcctcc

SEQ ID NO: 129016 - DNA, 20 bp, Artificial Sequence
  chemically synthesized
tcacttaacctaatgtcctc

SEQ ID NO: 129017 - DNA, 20 bp, Artificial Sequence
  chemically synthesized
aggatgagcctggaggacat

SEQ ID NO: 129018 - DNA, 20 bp, Artificial Sequence
  chemically synthesized
ggatgagcctggaggacatt

SEQ ID NO: 129019 - DNA, 20 bp, Artificial Sequence
  chemically synthesized
agcctggaggacattaggtt

SEQ ID NO: 129020 - DNA, 20 bp, Artificial Sequence
  chemically synthesized
taggttaagtgaaataaact

SEQ ID NO: 129021 - DNA, 20 bp, Artificial Sequence
  chemically synthesized
taagtgaaataaacttggca

SEQ ID NO: 129022 - DNA, 20 bp, Artificial Sequence
  chemically synthesized
agtgaaataaacttggcaca

SEQ ID NO: 129023 - DNA, 20 bp, Artificial Sequence
  chemically synthesized
gatatgtgtctctctgtgcc

SEQ ID NO: 129024 - DNA, 20 bp, Artificial Sequence
  chemically synthesized
tgaaataaacttggcacaga

SEQ ID NO: 129025 - DNA, 20 bp, Artificial Sequence
  chemically synthesized
tttaaactgcacatacaaat

SEQ ID NO: 129026 - DNA, 20 bp, Artificial Sequence
  chemically synthesized
tataatctcatttgtatgtg

SEQ ID NO: 129027 - DNA, 20 bp, Artificial Sequence
  chemically synthesized
ttgtatgtgcagtttaaaaa

SEQ ID NO: 129028 - DNA, 20 bp, Artificial Sequence
  chemically synthesized
tttaaaaaaagttgaactca

SEQ ID NO: 129029 - DNA, 20 bp, Artificial Sequence
  chemically synthesized
aaaagttgaactcatagaaa

SEQ ID NO: 129030 - DNA, 20 bp, Artificial Sequence
  chemically synthesized
ataatactctccatttctat

SEQ ID NO: 129031 - DNA, 20 bp, Artificial Sequence
  chemically synthesized
aagttgaactcatagaaatg

SEQ ID NO: 129032 - DNA, 20 bp, Artificial Sequence
  chemically synthesized
gttgaactcatagaaatgga

SEQ ID NO: 129033 - DNA, 20 bp, Artificial Sequence
  chemically synthesized
catagaaatggagagtatta

SEQ ID NO: 129034 - DNA, 20 bp, Artificial Sequence
  chemically synthesized
agaaatggagagtattatgg

SEQ ID NO: 129035 - DNA, 20 bp, Artificial Sequence
  chemically synthesized
agtattatggtggtgatcaa

SEQ ID NO: 129036 - DNA, 20 bp, Artificial Sequence
  chemically synthesized
atggtggtgatcaaaagctg

SEQ ID NO: 129037 - DNA, 20 bp, Artificial Sequence
  chemically synthesized
gtggtgatcaaaagctgcag

SEQ ID NO: 129038 - DNA, 20 bp, Artificial Sequence
  chemically synthesized
gtgatcaaaagctgcagtgg

SEQ ID NO: 129039 - DNA, 20 bp, Artificial Sequence
  chemically synthesized
tgatcaaaagctgcagtggt

SEQ ID NO: 129040 - DNA, 20 bp, Artificial Sequence
  chemically synthesized
tttccatccacccaccactg

SEQ ID NO: 129041 - DNA, 20 bp, Artificial Sequence
  chemically synthesized
tcaaaagctgcagtggtggg

SEQ ID NO: 129042 - DNA, 20 bp, Artificial Sequence
  chemically synthesized
aagctgcagtggtgggtgga

SEQ ID NO: 129043 - DNA, 20 bp, Artificial Sequence
  chemically synthesized
tggtgggtggatggaaaaat

SEQ ID NO: 129044 - DNA, 20 bp, Artificial Sequence
  chemically synthesized
gtgggtggatggaaaaatga

SEQ ID NO: 129045 - DNA, 20 bp, Artificial Sequence
  chemically synthesized
aaatgagagacgtttatcaa

SEQ ID NO: 129046 - DNA, 20 bp, Artificial Sequence
  chemically synthesized
aatgagagacgtttatcaat

SEQ ID NO: 129047 - DNA, 20 bp, Artificial Sequence
  chemically synthesized
gacgtttatcaatgggtaca

SEQ ID NO: 129048 - DNA, 20 bp, Artificial Sequence
  chemically synthesized
tatcaatgggtacaaagttc

SEQ ID NO: 129049 - DNA, 20 bp, Artificial Sequence
  chemically synthesized
aatgggtacaaagttccagt

SEQ ID NO: 129050 - DNA, 20 bp, Artificial Sequence
  chemically synthesized
ggtacaaagttccagttaga

SEQ ID NO: 129051 - DNA, 20 bp, Artificial Sequence
  chemically synthesized
gtacaaagttccagttagac

SEQ ID NO: 129052 - DNA, 20 bp, Artificial Sequence
  chemically synthesized
acttattcctcctgtctaac

SEQ ID NO: 129053 - DNA, 20 bp, Artificial Sequence
  chemically synthesized
acaaagttccagttagacag

SEQ ID NO: 129054 - DNA, 20 bp, Artificial Sequence
  chemically synthesized
caaagttccagttagacagg

SEQ ID NO: 129055 - DNA, 20 bp, Artificial Sequence
  chemically synthesized
tccagttagacaggaggaat

SEQ ID NO: 129056 - DNA, 20 bp, Artificial Sequence
  chemically synthesized
tagacaggaggaataagttc

SEQ ID NO: 129057 - DNA, 20 bp, Artificial Sequence
  chemically synthesized
tgtgctgtgcaaaagaacac

SEQ ID NO: 129058 - DNA, 20 bp, Artificial Sequence
  chemically synthesized
agttctggtgttcttttgca

SEQ ID NO: 129059 - DNA, 20 bp, Artificial Sequence
  chemically synthesized
atagttcctgtgctgtgcaa

SEQ ID NO: 129060 - DNA, 20 bp, Artificial Sequence
  chemically synthesized
tggtgttcttttgcacagca

SEQ ID NO: 129061 - DNA, 20 bp, Artificial Sequence
  chemically synthesized
ggtgttcttttgcacagcac

SEQ ID NO: 129062 - DNA, 20 bp, Artificial Sequence
  chemically synthesized
tttgcacagcacaggaacta

SEQ ID NO: 129063 - DNA, 20 bp, Artificial Sequence
  chemically synthesized
caatatgacaatattagcta

SEQ ID NO: 129064 - DNA, 20 bp, Artificial Sequence
  chemically synthesized
aatatacaatatgacaatat

SEQ ID NO: 129065 - DNA, 20 bp, Artificial Sequence
  chemically synthesized
tcatattgtatatttccaaa

SEQ ID NO: 129066 - DNA, 20 bp, Artificial Sequence
  chemically synthesized
aatcctcctttttagctatt

SEQ ID NO: 129067 - DNA, 20 bp, Artificial Sequence
  chemically synthesized
tatatttccaaatagctaaa

SEQ ID NO: 129068 - DNA, 20 bp, Artificial Sequence
  chemically synthesized
atatttccaaatagctaaaa

SEQ ID NO: 129069 - DNA, 20 bp, Artificial Sequence
  chemically synthesized
atttccaaatagctaaaaag

SEQ ID NO: 129070 - DNA, 20 bp, Artificial Sequence
  chemically synthesized
tttccaaatagctaaaaagg

SEQ ID NO: 129071 - DNA, 20 bp, Artificial Sequence
  chemically synthesized
atatttaaaatcctcctttt

SEQ ID NO: 129072 - DNA, 20 bp, Artificial Sequence
  chemically synthesized
atacttctcatttttgtggt

SEQ ID NO: 129073 - DNA, 20 bp, Artificial Sequence
  chemically synthesized
aatattctcaccacaaaaat

SEQ ID NO: 129074 - DNA, 20 bp, Artificial Sequence
  chemically synthesized
tcaaatacttctcatttttg

SEQ ID NO: 129075 - DNA, 20 bp, Artificial Sequence
  chemically synthesized
attctcaccacaaaaatgag

SEQ ID NO: 129076 - DNA, 20 bp, Artificial Sequence
  chemically synthesized
cacaaaaatgagaagtattt

SEQ ID NO: 129077 - DNA, 20 bp, Artificial Sequence
  chemically synthesized
acaaaaatgagaagtatttg

SEQ ID NO: 129078 - DNA, 20 bp, Artificial Sequence
  chemically synthesized
atgagaagtatttgaggtga

SEQ ID NO: 129079 - DNA, 20 bp, Artificial Sequence
  chemically synthesized
tgaggtgatagatatgctat

SEQ ID NO: 129080 - DNA, 20 bp, Artificial Sequence
  chemically synthesized
gaataatcaaatcaggctaa

SEQ ID NO: 129081 - DNA, 20 bp, Artificial Sequence
  chemically synthesized
cattgtggaataatcaaatc

SEQ ID NO: 129082 - DNA, 20 bp, Artificial Sequence
  chemically synthesized
acattgtggaataatcaaat

SEQ ID NO: 129083 - DNA, 20 bp, Artificial Sequence
  chemically synthesized
caatccatatatatacattg

SEQ ID NO: 129084 - DNA, 20 bp, Artificial Sequence
  chemically synthesized
tattccacaatgtatatata

SEQ ID NO: 129085 - DNA, 20 bp, Artificial Sequence
  chemically synthesized
tcacaatgtaccccataata

SEQ ID NO: 129086 - DNA, 20 bp, Artificial Sequence
  chemically synthesized
tagtcgacaactatattatg

SEQ ID NO: 129087 - DNA, 20 bp, Artificial Sequence
  chemically synthesized
ttagtcgacaactatattat

SEQ ID NO: 129088 - DNA, 20 bp, Artificial Sequence
  chemically synthesized
tttagtcgacaactatatta

SEQ ID NO: 129089 - DNA, 20 bp, Artificial Sequence
  chemically synthesized
taaaaattttatttcgtttt

SEQ ID NO: 129090 - DNA, 20 bp, Artificial Sequence
  chemically synthesized
ttttaaaatgaatattattt

SEQ ID NO: 129091 - DNA, 20 bp, Artificial Sequence
  chemically synthesized
ttgagttgtaattccactcc

SEQ ID NO: 129092 - DNA, 20 bp, Artificial Sequence
  chemically synthesized
tgagttgtaattccactccc

SEQ ID NO: 129093 - DNA, 20 bp, Artificial Sequence
  chemically synthesized
gttggatatacacctgggag

SEQ ID NO: 129094 - DNA, 20 bp, Artificial Sequence
  chemically synthesized
tctgttggatatacacctgg

SEQ ID NO: 129095 - DNA, 20 bp, Artificial Sequence
  chemically synthesized
tttctgttggatatacacct

SEQ ID NO: 129096 - DNA, 20 bp, Artificial Sequence
  chemically synthesized
atttctgttggatatacacc

SEQ ID NO: 129097 - DNA, 20 bp, Artificial Sequence
  chemically synthesized
actcccaggtgtatatccaa

SEQ ID NO: 129098 - DNA, 20 bp, Artificial Sequence
  chemically synthesized
taataactatgcatttctgt

SEQ ID NO: 129099 - DNA, 20 bp, Artificial Sequence
  chemically synthesized
gtatatccaacagaaatgca

SEQ ID NO: 129100 - DNA, 20 bp, Artificial Sequence
  chemically synthesized
acagtctagtacatggtttt

SEQ ID NO: 129101 - DNA, 20 bp, Artificial Sequence
  chemically synthesized
attcaccaaaaaccatgtac

SEQ ID NO: 129102 - DNA, 20 bp, Artificial Sequence
  chemically synthesized
gctatcaacagtctagtaca

SEQ ID NO: 129103 - DNA, 20 bp, Artificial Sequence
  chemically synthesized
tagccatgctatcaacagtc

SEQ ID NO: 129104 - DNA, 20 bp, Artificial Sequence
  chemically synthesized
accatgtactagactgttga

SEQ ID NO: 129105 - DNA, 20 bp, Artificial Sequence
  chemically synthesized
atccatagccatgctatcaa

SEQ ID NO: 129106 - DNA, 20 bp, Artificial Sequence
  chemically synthesized
gtactagactgttgatagca

SEQ ID NO: 129107 - DNA, 20 bp, Artificial Sequence
  chemically synthesized
gactgttgatagcatggcta

SEQ ID NO: 129108 - DNA, 20 bp, Artificial Sequence
  chemically synthesized
gatagcatggctatggattg

SEQ ID NO: 129109 - DNA, 20 bp, Artificial Sequence
  chemically synthesized
gtcaacaattctgcaatcca

SEQ ID NO: 129110 - DNA, 20 bp, Artificial Sequence
  chemically synthesized
atggattgcagaattgttga

SEQ ID NO: 129111 - DNA, 20 bp, Artificial Sequence
  chemically synthesized
tgacagcaatttcctcatgt

SEQ ID NO: 129112 - DNA, 20 bp, Artificial Sequence
  chemically synthesized
attgagtagtttccaacatg

SEQ ID NO: 129113 - DNA, 20 bp, Artificial Sequence
  chemically synthesized
aattgagtagtttccaacat

SEQ ID NO: 129114 - DNA, 20 bp, Artificial Sequence
  chemically synthesized
gatatagatgagaaattgag

SEQ ID NO: 129115 - DNA, 20 bp, Artificial Sequence
  chemically synthesized
gttgatatagatgagaaatt

SEQ ID NO: 129116 - DNA, 20 bp, Artificial Sequence
  chemically synthesized
ttacacatgttgatatagat

SEQ ID NO: 129117 - DNA, 20 bp, Artificial Sequence
  chemically synthesized
tgtatttacacatgttgata

SEQ ID NO: 129118 - DNA, 20 bp, Artificial Sequence
  chemically synthesized
caacatgtgtaaatacactg

SEQ ID NO: 129119 - DNA, 20 bp, Artificial Sequence
  chemically synthesized
ataatattctattgatacca

SEQ ID NO: 129120 - DNA, 20 bp, Artificial Sequence
  chemically synthesized
taaatacactgtggtatcaa

SEQ ID NO: 129121 - DNA, 20 bp, Artificial Sequence
  chemically synthesized
ggtatcaatagaatattatt

SEQ ID NO: 129122 - DNA, 20 bp, Artificial Sequence
  chemically synthesized
tcaatagaatattattcagt

SEQ ID NO: 129123 - DNA, 20 bp, Artificial Sequence
  chemically synthesized
agaatattattcagtaagaa

SEQ ID NO: 129124 - DNA, 20 bp, Artificial Sequence
  chemically synthesized
catattattgtatgtagttg

SEQ ID NO: 129125 - DNA, 20 bp, Artificial Sequence
  chemically synthesized
ttcatccatattattgtatg

SEQ ID NO: 129126 - DNA, 20 bp, Artificial Sequence
  chemically synthesized
cacaactacatacaataata

SEQ ID NO: 129127 - DNA, 20 bp, Artificial Sequence
  chemically synthesized
ccccccaacaatatgtttgt

SEQ ID NO: 129128 - DNA, 20 bp, Artificial Sequence
  chemically synthesized
gaatctcacaaacatattgt

SEQ ID NO: 129129 - DNA, 20 bp, Artificial Sequence
  chemically synthesized
aatctcacaaacatattgtt

SEQ ID NO: 129130 - DNA, 20 bp, Artificial Sequence
  chemically synthesized
atctcacaaacatattgttg

SEQ ID NO: 129131 - DNA, 20 bp, Artificial Sequence
  chemically synthesized
tctcacaaacatattgttgg

SEQ ID NO: 129132 - DNA, 20 bp, Artificial Sequence
  chemically synthesized
ctcacaaacatattgttggg

SEQ ID NO: 129133 - DNA, 20 bp, Artificial Sequence
  chemically synthesized
tattgttggggggaaaaata

SEQ ID NO: 129134 - DNA, 20 bp, Artificial Sequence
  chemically synthesized
tggggggaaaaatacagcca

SEQ ID NO: 129135 - DNA, 20 bp, Artificial Sequence
  chemically synthesized
ggaaaaatacagccacagac

SEQ ID NO: 129136 - DNA, 20 bp, Artificial Sequence
  chemically synthesized
cagtcatatctacttgtctg

SEQ ID NO: 129137 - DNA, 20 bp, Artificial Sequence
  chemically synthesized
aaaatacagccacagacaag

SEQ ID NO: 129138 - DNA, 20 bp, Artificial Sequence
  chemically synthesized
tattatatgaaggaatcgaa

SEQ ID NO: 129139 - DNA, 20 bp, Artificial Sequence
  chemically synthesized
tgtttttgtgtattatatga

SEQ ID NO: 129140 - DNA, 20 bp, Artificial Sequence
  chemically synthesized
ctgtttttgtgtattatatg

SEQ ID NO: 129141 - DNA, 20 bp, Artificial Sequence
  chemically synthesized
cttcatataatacacaaaaa

SEQ ID NO: 129142 - DNA, 20 bp, Artificial Sequence
  chemically synthesized
ttcatataatacacaaaaac

SEQ ID NO: 129143 - DNA, 20 bp, Artificial Sequence
  chemically synthesized
taatacacaaaaacaggaaa

SEQ ID NO: 129144 - DNA, 20 bp, Artificial Sequence
  chemically synthesized
acaaaaacaggaaaaagtaa

SEQ ID NO: 129145 - DNA, 20 bp, Artificial Sequence
  chemically synthesized
aaagtaatagaaaacttttg

SEQ ID NO: 129146 - DNA, 20 bp, Artificial Sequence
  chemically synthesized
taatagaaaacttttgaagt

SEQ ID NO: 129147 - DNA, 20 bp, Artificial Sequence
  chemically synthesized
gactactatccttacttcaa

SEQ ID NO: 129148 - DNA, 20 bp, Artificial Sequence
  chemically synthesized
aatagaaaacttttgaagta

SEQ ID NO: 129149 - DNA, 20 bp, Artificial Sequence
  chemically synthesized
gaaaacttttgaagtaagga

SEQ ID NO: 129150 - DNA, 20 bp, Artificial Sequence
  chemically synthesized
aacttttgaagtaaggatag

SEQ ID NO: 129151 - DNA, 20 bp, Artificial Sequence
  chemically synthesized
cagtcatgaacatttcacaa

SEQ ID NO: 129152 - DNA, 20 bp, Artificial Sequence
  chemically synthesized
ccagtcatgaacatttcaca

SEQ ID NO: 129153 - DNA, 20 bp, Artificial Sequence
  chemically synthesized
tccagtcatgaacatttcac

SEQ ID NO: 129154 - DNA, 20 bp, Artificial Sequence
  chemically synthesized
ccttgtgaaatgttcatgac

SEQ ID NO: 129155 - DNA, 20 bp, Artificial Sequence
  chemically synthesized
ttgtgaaatgttcatgactg

SEQ ID NO: 129156 - DNA, 20 bp, Artificial Sequence
  chemically synthesized
tgaaatgttcatgactggag

SEQ ID NO: 129157 - DNA, 20 bp, Artificial Sequence
  chemically synthesized
atcccccttcatgtcttctc

SEQ ID NO: 129158 - DNA, 20 bp, Artificial Sequence
  chemically synthesized
tcatgactggagaagacatg

SEQ ID NO: 129159 - DNA, 20 bp, Artificial Sequence
  chemically synthesized
catgactggagaagacatga

SEQ ID NO: 129160 - DNA, 20 bp, Artificial Sequence
  chemically synthesized
atgactggagaagacatgaa

SEQ ID NO: 129161 - DNA, 20 bp, Artificial Sequence
  chemically synthesized
tgactggagaagacatgaag

SEQ ID NO: 129162 - DNA, 20 bp, Artificial Sequence
  chemically synthesized
gactggagaagacatgaagg

SEQ ID NO: 129163 - DNA, 20 bp, Artificial Sequence
  chemically synthesized
aagacatgaagggggatcct

SEQ ID NO: 129164 - DNA, 20 bp, Artificial Sequence
  chemically synthesized
gaagggggatcctgagcttc

SEQ ID NO: 129165 - DNA, 20 bp, Artificial Sequence
  chemically synthesized
tataatatagccagaagctc

SEQ ID NO: 129166 - DNA, 20 bp, Artificial Sequence
  chemically synthesized
atataatatagccagaagct

SEQ ID NO: 129167 - DNA, 20 bp, Artificial Sequence
  chemically synthesized
acataatataatatagccag

SEQ ID NO: 129168 - DNA, 20 bp, Artificial Sequence
  chemically synthesized
gaaacataatataatatagc

SEQ ID NO: 129169 - DNA, 20 bp, Artificial Sequence
  chemically synthesized
tcaagaaacataatataata

SEQ ID NO: 129170 - DNA, 20 bp, Artificial Sequence
  chemically synthesized
ttatattatgtttcttgatt

SEQ ID NO: 129171 - DNA, 20 bp, Artificial Sequence
  chemically synthesized
gtgtaaatagcatccaaatc

SEQ ID NO: 129172 - DNA, 20 bp, Artificial Sequence
  chemically synthesized
tgatttggatgctatttaca

SEQ ID NO: 129173 - DNA, 20 bp, Artificial Sequence
  chemically synthesized
atagaatgcaactgtgtaaa

SEQ ID NO: 129174 - DNA, 20 bp, Artificial Sequence
  chemically synthesized
acacagttgcattctattta

SEQ ID NO: 129175 - DNA, 20 bp, Artificial Sequence
  chemically synthesized
gaagagtgaatttctataaa

SEQ ID NO: 129176 - DNA, 20 bp, Artificial Sequence
  chemically synthesized
ctggctagccatatgcagaa

SEQ ID NO: 129177 - DNA, 20 bp, Artificial Sequence
  chemically synthesized
gaaattcactcttctgcata

SEQ ID NO: 129178 - DNA, 20 bp, Artificial Sequence
  chemically synthesized
aactggctagccatatgcag

SEQ ID NO: 129179 - DNA, 20 bp, Artificial Sequence
  chemically synthesized
gagaactggctagccatatg

SEQ ID NO: 129180 - DNA, 20 bp, Artificial Sequence
  chemically synthesized
ttcactcttctgcatatggc

SEQ ID NO: 129181 - DNA, 20 bp, Artificial Sequence
  chemically synthesized
ctcttctgcatatggctagc

SEQ ID NO: 129182 - DNA, 20 bp, Artificial Sequence
  chemically synthesized
atggtgctgggagaactggc

SEQ ID NO: 129183 - DNA, 20 bp, Artificial Sequence
  chemically synthesized
atatggctagccagttctcc

SEQ ID NO: 129184 - DNA, 20 bp, Artificial Sequence
  chemically synthesized
ataaatggtgctgggagaac

SEQ ID NO: 129185 - DNA, 20 bp, Artificial Sequence
  chemically synthesized
tatttaataaatggtgctgg

SEQ ID NO: 129186 - DNA, 20 bp, Artificial Sequence
  chemically synthesized
cctatttaataaatggtgct

SEQ ID NO: 129187 - DNA, 20 bp, Artificial Sequence
  chemically synthesized
ccctatttaataaatggtgc

SEQ ID NO: 129188 - DNA, 20 bp, Artificial Sequence
  chemically synthesized
caaattccctatttaataaa

SEQ ID NO: 129189 - DNA, 20 bp, Artificial Sequence
  chemically synthesized
tcccagcaccatttattaaa

SEQ ID NO: 129190 - DNA, 20 bp, Artificial Sequence
  chemically synthesized
cccagcaccatttattaaat

SEQ ID NO: 129191 - DNA, 20 bp, Artificial Sequence
  chemically synthesized
ccagcaccatttattaaata

SEQ ID NO: 129192 - DNA, 20 bp, Artificial Sequence
  chemically synthesized
gaattgtccaaagttgtatg

SEQ ID NO: 129193 - DNA, 20 bp, Artificial Sequence
  chemically synthesized
atatattctacatacaactt

SEQ ID NO: 129194 - DNA, 20 bp, Artificial Sequence
  chemically synthesized
taaaaaagatgaattgtcca

SEQ ID NO: 129195 - DNA, 20 bp, Artificial Sequence
  chemically synthesized
acgtgacaccttttttaaaa

SEQ ID NO: 129196 - DNA, 20 bp, Artificial Sequence
  chemically synthesized
acaattcatcttttttaaaa

SEQ ID NO: 129197 - DNA, 20 bp, Artificial Sequence
  chemically synthesized
caattcatcttttttaaaaa

SEQ ID NO: 129198 - DNA, 20 bp, Artificial Sequence
  chemically synthesized
gtgtgaaatatgtgtcattt

SEQ ID NO: 129199 - DNA, 20 bp, Artificial Sequence
  chemically synthesized
gcatcttttattattcacag

SEQ ID NO: 129200 - DNA, 20 bp, Artificial Sequence
  chemically synthesized
attgcatcttttattattca

SEQ ID NO: 129201 - DNA, 20 bp, Artificial Sequence
  chemically synthesized
ttggctgctgtgaataataa

SEQ ID NO: 129202 - DNA, 20 bp, Artificial Sequence
  chemically synthesized
aaatcgtattgtgtttgtag

SEQ ID NO: 129203 - DNA, 20 bp, Artificial Sequence
  chemically synthesized
tcaaaatcgtattgtgtttg

SEQ ID NO: 129204 - DNA, 20 bp, Artificial Sequence
  chemically synthesized
ttctttgtcacatcaatgta

SEQ ID NO: 129205 - DNA, 20 bp, Artificial Sequence
  chemically synthesized
gactgtacattgatgtgaca

SEQ ID NO: 129206 - DNA, 20 bp, Artificial Sequence
  chemically synthesized
tgatgtgacaaagaacattt

SEQ ID NO: 129207 - DNA, 20 bp, Artificial Sequence
  chemically synthesized
aacatttcagaaattcttat

SEQ ID NO: 129208 - DNA, 20 bp, Artificial Sequence
  chemically synthesized
tttcagaaattcttattgga

SEQ ID NO: 129209 - DNA, 20 bp, Artificial Sequence
  chemically synthesized
agtccagttcactgtccaat

SEQ ID NO: 129210 - DNA, 20 bp, Artificial Sequence
  chemically synthesized
attcttattggacagtgaac

SEQ ID NO: 129211 - DNA, 20 bp, Artificial Sequence
  chemically synthesized
tattggacagtgaactggac

SEQ ID NO: 129212 - DNA, 20 bp, Artificial Sequence
  chemically synthesized
gtgtgtctgtgaatctagtc

SEQ ID NO: 129213 - DNA, 20 bp, Artificial Sequence
  chemically synthesized
agtgaactggactagattca

SEQ ID NO: 129214 - DNA, 20 bp, Artificial Sequence
  chemically synthesized
ctgatgtgtgtctgtgaatc

SEQ ID NO: 129215 - DNA, 20 bp, Artificial Sequence
  chemically synthesized
ctagattcacagacacacat

SEQ ID NO: 129216 - DNA, 20 bp, Artificial Sequence
  chemically synthesized
cagacacacatcagcacata

SEQ ID NO: 129217 - DNA, 20 bp, Artificial Sequence
  chemically synthesized
tcagcacatacagacgaatc

SEQ ID NO: 129218 - DNA, 20 bp, Artificial Sequence
  chemically synthesized
gcacatacagacgaatcaag

SEQ ID NO: 129219 - DNA, 20 bp, Artificial Sequence
  chemically synthesized
tcttttattaaatagcagaa

SEQ ID NO: 129220 - DNA, 20 bp, Artificial Sequence
  chemically synthesized
ttgtttcttttattaaatag

SEQ ID NO: 129221 - DNA, 20 bp, Artificial Sequence
  chemically synthesized
gctttgtttcttttattaaa

SEQ ID NO: 129222 - DNA, 20 bp, Artificial Sequence
  chemically synthesized
gctattctgctatttaataa

SEQ ID NO: 129223 - DNA, 20 bp, Artificial Sequence
  chemically synthesized
gctatttaataaaagaaaca

SEQ ID NO: 129224 - DNA, 20 bp, Artificial Sequence
  chemically synthesized
atttaataaaagaaacaaag

SEQ ID NO: 129225 - DNA, 20 bp, Artificial Sequence
  chemically synthesized
agcagtacaattgattgtta

SEQ ID NO: 129226 - DNA, 20 bp, Artificial Sequence
  chemically synthesized
agtacaattgattgttatag

SEQ ID NO: 129227 - DNA, 20 bp, Artificial Sequence
  chemically synthesized
ttgattgttatagtagtccc

SEQ ID NO: 129228 - DNA, 20 bp, Artificial Sequence
  chemically synthesized
gattgttatagtagtcccaa

SEQ ID NO: 129229 - DNA, 20 bp, Artificial Sequence
  chemically synthesized
tgttatagtagtcccaagag

SEQ ID NO: 129230 - DNA, 20 bp, Artificial Sequence
  chemically synthesized
tttctgcagggtctactctt

SEQ ID NO: 129231 - DNA, 20 bp, Artificial Sequence
  chemically synthesized
atttctgcagggtctactct

SEQ ID NO: 129232 - DNA, 20 bp, Artificial Sequence
  chemically synthesized
agtcccaagagtagaccctg

SEQ ID NO: 129233 - DNA, 20 bp, Artificial Sequence
  chemically synthesized
cttttgtatatatttctgca

SEQ ID NO: 129234 - DNA, 20 bp, Artificial Sequence
  chemically synthesized
tcttttgtatatatttctgc

SEQ ID NO: 129235 - DNA, 20 bp, Artificial Sequence
  chemically synthesized
gtcttttgtatatatttctg

SEQ ID NO: 129236 - DNA, 20 bp, Artificial Sequence
  chemically synthesized
ccctgcagaaatatatacaa

SEQ ID NO: 129237 - DNA, 20 bp, Artificial Sequence
  chemically synthesized
atatatacaaaagacaattt

SEQ ID NO: 129238 - DNA, 20 bp, Artificial Sequence
  chemically synthesized
tatacaaaagacaattttag

SEQ ID NO: 129239 - DNA, 20 bp, Artificial Sequence
  chemically synthesized
taaatgtatttcattttgtc

SEQ ID NO: 129240 - DNA, 20 bp, Artificial Sequence
  chemically synthesized
aaatgtatttcattttgtca

SEQ ID NO: 129241 - DNA, 20 bp, Artificial Sequence
  chemically synthesized
ttcattttgtcaaggaatga

SEQ ID NO: 129242 - DNA, 20 bp, Artificial Sequence
  chemically synthesized
gaaagcaaatctaaaatctg

SEQ ID NO: 129243 - DNA, 20 bp, Artificial Sequence
  chemically synthesized
ctctgatgatcttcagattt

SEQ ID NO: 129244 - DNA, 20 bp, Artificial Sequence
  chemically synthesized
agcttcgctctgatgatctt

SEQ ID NO: 129245 - DNA, 20 bp, Artificial Sequence
  chemically synthesized
atctaaaatctgaagatcat

SEQ ID NO: 129246 - DNA, 20 bp, Artificial Sequence
  chemically synthesized
ctaaaatctgaagatcatca

SEQ ID NO: 129247 - DNA, 20 bp, Artificial Sequence
  chemically synthesized
atctgaagatcatcagagcg

SEQ ID NO: 129248 - DNA, 20 bp, Artificial Sequence
  chemically synthesized
ctgatccacttttaggataa

SEQ ID NO: 129249 - DNA, 20 bp, Artificial Sequence
  chemically synthesized
gagcgaagctgttatcctaa

SEQ ID NO: 129250 - DNA, 20 bp, Artificial Sequence
  chemically synthesized
cgaagctgttatcctaaaag

SEQ ID NO: 129251 - DNA, 20 bp, Artificial Sequence
  chemically synthesized
taccacactgatccactttt

SEQ ID NO: 129252 - DNA, 20 bp, Artificial Sequence
  chemically synthesized
ctaccacactgatccacttt

SEQ ID NO: 129253 - DNA, 20 bp, Artificial Sequence
  chemically synthesized
ctgttatcctaaaagtggat

SEQ ID NO: 129254 - DNA, 20 bp, Artificial Sequence
  chemically synthesized
atcctaaaagtggatcagtg

SEQ ID NO: 129255 - DNA, 20 bp, Artificial Sequence
  chemically synthesized
ctaaaagtggatcagtgtgg

SEQ ID NO: 129256 - DNA, 20 bp, Artificial Sequence
  chemically synthesized
ttaccaggtctatatgatgt

SEQ ID NO: 129257 - DNA, 20 bp, Artificial Sequence
  chemically synthesized
tgtggtagtctgacatcata

SEQ ID NO: 129258 - DNA, 20 bp, Artificial Sequence
  chemically synthesized
agtctgacatcatatagacc

SEQ ID NO: 129259 - DNA, 20 bp, Artificial Sequence
  chemically synthesized
ctcagttatggacaattacc

SEQ ID NO: 129260 - DNA, 20 bp, Artificial Sequence
  chemically synthesized
gctcagttatggacaattac

SEQ ID NO: 129261 - DNA, 20 bp, Artificial Sequence
  chemically synthesized
cctggtaattgtccataact

SEQ ID NO: 129262 - DNA, 20 bp, Artificial Sequence
  chemically synthesized
tataaattgatgctcagtta

SEQ ID NO: 129263 - DNA, 20 bp, Artificial Sequence
  chemically synthesized
ctgtagtataaattgatgct

SEQ ID NO: 129264 - DNA, 20 bp, Artificial Sequence
  chemically synthesized
ctgagcatcaatttatacta

SEQ ID NO: 129265 - DNA, 20 bp, Artificial Sequence
  chemically synthesized
gcaagtgtggtaaaattctg

SEQ ID NO: 129266 - DNA, 20 bp, Artificial Sequence
  chemically synthesized
tgggtgaagtgtcgcaagtg

SEQ ID NO: 129267 - DNA, 20 bp, Artificial Sequence
  chemically synthesized
tctcctgggtgaagtgtcgc

SEQ ID NO: 129268 - DNA, 20 bp, Artificial Sequence
  chemically synthesized
cacacttgcgacacttcacc

SEQ ID NO: 129269 - DNA, 20 bp, Artificial Sequence
  chemically synthesized
acacttgcgacacttcaccc

SEQ ID NO: 129270 - DNA, 20 bp, Artificial Sequence
  chemically synthesized
acttgcgacacttcacccag

SEQ ID NO: 129271 - DNA, 20 bp, Artificial Sequence
  chemically synthesized
atctgtcagtctcctgggtg

SEQ ID NO: 129272 - DNA, 20 bp, Artificial Sequence
  chemically synthesized
ttttgatctgtcagtctcct

SEQ ID NO: 129273 - DNA, 20 bp, Artificial Sequence
  chemically synthesized
tttttgatctgtcagtctcc

SEQ ID NO: 129274 - DNA, 20 bp, Artificial Sequence
  chemically synthesized
cacttcacccaggagactga

SEQ ID NO: 129275 - DNA, 20 bp, Artificial Sequence
  chemically synthesized
ataatatgtttttgatctgt

SEQ ID NO: 129276 - DNA, 20 bp, Artificial Sequence
  chemically synthesized
gacagatcaaaaacatatta

SEQ ID NO: 129277 - DNA, 20 bp, Artificial Sequence
  chemically synthesized
acatattatggcaatgtatt

SEQ ID NO: 129278 - DNA, 20 bp, Artificial Sequence
  chemically synthesized
atggcaatgtatttggccac

SEQ ID NO: 129279 - DNA, 20 bp, Artificial Sequence
  chemically synthesized
ggcaatgtatttggccacta

SEQ ID NO: 129280 - DNA, 20 bp, Artificial Sequence
  chemically synthesized
tctaacaatatgggctctag

SEQ ID NO: 129281 - DNA, 20 bp, Artificial Sequence
  chemically synthesized
aaatctaacaatatgggctc

SEQ ID NO: 129282 - DNA, 20 bp, Artificial Sequence
  chemically synthesized
gccactagagcccatattgt

SEQ ID NO: 129283 - DNA, 20 bp, Artificial Sequence
  chemically synthesized
aaatgtaaatctaacaatat

SEQ ID NO: 129284 - DNA, 20 bp, Artificial Sequence
  chemically synthesized
taaatgtaaatctaacaata

SEQ ID NO: 129285 - DNA, 20 bp, Artificial Sequence
  chemically synthesized
ttttgtatgtcagatgaatt

SEQ ID NO: 129286 - DNA, 20 bp, Artificial Sequence
  chemically synthesized
attatttcacttttgtatgt

SEQ ID NO: 129287 - DNA, 20 bp, Artificial Sequence
  chemically synthesized
caaattcatctgacatacaa

SEQ ID NO: 129288 - DNA, 20 bp, Artificial Sequence
  chemically synthesized
acaaaagtgaaataataata

SEQ ID NO: 129289 - DNA, 20 bp, Artificial Sequence
  chemically synthesized
aaagtatatgcacataaacc

SEQ ID NO: 129290 - DNA, 20 bp, Artificial Sequence
  chemically synthesized
caaacatgcacagattgtct

SEQ ID NO: 129291 - DNA, 20 bp, Artificial Sequence
  chemically synthesized
acaaacatgcacagattgtc

SEQ ID NO: 129292 - DNA, 20 bp, Artificial Sequence
  chemically synthesized
tcttcaattacaaacatgca

SEQ ID NO: 129293 - DNA, 20 bp, Artificial Sequence
  chemically synthesized
tctgtgcatgtttgtaattg

SEQ ID NO: 129294 - DNA, 20 bp, Artificial Sequence
  chemically synthesized
tgtgcatgtttgtaattgaa

SEQ ID NO: 129295 - DNA, 20 bp, Artificial Sequence
  chemically synthesized
aaaaaaatgtgtacattggg

SEQ ID NO: 129296 - DNA, 20 bp, Artificial Sequence
  chemically synthesized
aaaaaaaaaatgtgtacatt

SEQ ID NO: 129297 - DNA, 20 bp, Artificial Sequence
  chemically synthesized
gaaaaaaaaaatgtgtacat

SEQ ID NO: 129298 - DNA, 20 bp, Artificial Sequence
  chemically synthesized
cacattttttttttctcaca

SEQ ID NO: 129299 - DNA, 20 bp, Artificial Sequence
  chemically synthesized
acattttttttttctcacaa

SEQ ID NO: 129300 - DNA, 20 bp, Artificial Sequence
  chemically synthesized
tttccatgacggacctttgt

SEQ ID NO: 129301 - DNA, 20 bp, Artificial Sequence
  chemically synthesized
tttctcacaaaggtccgtca

SEQ ID NO: 129302 - DNA, 20 bp, Artificial Sequence
  chemically synthesized
tcacaaaggtccgtcatgga

SEQ ID NO: 129303 - DNA, 20 bp, Artificial Sequence
  chemically synthesized
agtcgagaagctttccatga

SEQ ID NO: 129304 - DNA, 20 bp, Artificial Sequence
  chemically synthesized
tactgcacaaattagtcgag

SEQ ID NO: 129305 - DNA, 20 bp, Artificial Sequence
  chemically synthesized
atttactgcacaaattagtc

SEQ ID NO: 129306 - DNA, 20 bp, Artificial Sequence
  chemically synthesized
agcttctcgactaatttgtg

SEQ ID NO: 129307 - DNA, 20 bp, Artificial Sequence
  chemically synthesized
catctatttactgcacaaat

SEQ ID NO: 129308 - DNA, 20 bp, Artificial Sequence
  chemically synthesized
cgactaatttgtgcagtaaa

SEQ ID NO: 129309 - DNA, 20 bp, Artificial Sequence
  chemically synthesized
tttgtgcagtaaatagatgt

SEQ ID NO: 129310 - DNA, 20 bp, Artificial Sequence
  chemically synthesized
ttgtgcagtaaatagatgtt

SEQ ID NO: 129311 - DNA, 20 bp, Artificial Sequence
  chemically synthesized
taaatagatgttgggtaata

SEQ ID NO: 129312 - DNA, 20 bp, Artificial Sequence
  chemically synthesized
aaatagatgttgggtaataa

SEQ ID NO: 129313 - DNA, 20 bp, Artificial Sequence
  chemically synthesized
aatagatgttgggtaataaa

SEQ ID NO: 129314 - DNA, 20 bp, Artificial Sequence
  chemically synthesized
ggaaataaataaccaatgct

SEQ ID NO: 129315 - DNA, 20 bp, Artificial Sequence
  chemically synthesized
gtcatcctgagtcttagcat

SEQ ID NO: 129316 - DNA, 20 bp, Artificial Sequence
  chemically synthesized
aaataaccaatgctaagact

SEQ ID NO: 129317 - DNA, 20 bp, Artificial Sequence
  chemically synthesized
aataaccaatgctaagactc

SEQ ID NO: 129318 - DNA, 20 bp, Artificial Sequence
  chemically synthesized
cagtctgtcatcctgagtct

SEQ ID NO: 129319 - DNA, 20 bp, Artificial Sequence
  chemically synthesized
aatgctaagactcaggatga

SEQ ID NO: 129320 - DNA, 20 bp, Artificial Sequence
  chemically synthesized
gggtctcagtctgtcatcct

SEQ ID NO: 129321 - DNA, 20 bp, Artificial Sequence
  chemically synthesized
aagactcaggatgacagact

SEQ ID NO: 129322 - DNA, 20 bp, Artificial Sequence
  chemically synthesized
caggatgacagactgagacc

SEQ ID NO: 129323 - DNA, 20 bp, Artificial Sequence
  chemically synthesized
tcaggacacatgctgggtct

SEQ ID NO: 129324 - DNA, 20 bp, Artificial Sequence
  chemically synthesized
cgtaaatcaggacacatgct

SEQ ID NO: 129325 - DNA, 20 bp, Artificial Sequence
  chemically synthesized
tcgtaaatcaggacacatgc

SEQ ID NO: 129326 - DNA, 20 bp, Artificial Sequence
  chemically synthesized
cttctggaggttcgtaaatc

SEQ ID NO: 129327 - DNA, 20 bp, Artificial Sequence
  chemically synthesized
acttctggaggttcgtaaat

SEQ ID NO: 129328 - DNA, 20 bp, Artificial Sequence
  chemically synthesized
tgtcctgatttacgaacctc

SEQ ID NO: 129329 - DNA, 20 bp, Artificial Sequence
  chemically synthesized
cctgatttacgaacctccag

SEQ ID NO: 129330 - DNA, 20 bp, Artificial Sequence
  chemically synthesized
ttccaatttgacacttctgg

SEQ ID NO: 129331 - DNA, 20 bp, Artificial Sequence
  chemically synthesized
tttccaatttgacacttctg

SEQ ID NO: 129332 - DNA, 20 bp, Artificial Sequence
  chemically synthesized
agtttccaatttgacacttc

SEQ ID NO: 129333 - DNA, 20 bp, Artificial Sequence
  chemically synthesized
aacctccagaagtgtcaaat

SEQ ID NO: 129334 - DNA, 20 bp, Artificial Sequence
  chemically synthesized
gaagtgtcaaattggaaact

SEQ ID NO: 129335 - DNA, 20 bp, Artificial Sequence
  chemically synthesized
tggttcttgacatgattgct

SEQ ID NO: 129336 - DNA, 20 bp, Artificial Sequence
  chemically synthesized
ggaaactcagcaatcatgtc

SEQ ID NO: 129337 - DNA, 20 bp, Artificial Sequence
  chemically synthesized
tttctttctctgcaatattg

SEQ ID NO: 129338 - DNA, 20 bp, Artificial Sequence
  chemically synthesized
tgtcaagaaccacaatattg

SEQ ID NO: 129339 - DNA, 20 bp, Artificial Sequence
  chemically synthesized
tcaagaaccacaatattgca

SEQ ID NO: 129340 - DNA, 20 bp, Artificial Sequence
  chemically synthesized
gaaccacaatattgcagaga

SEQ ID NO: 129341 - DNA, 20 bp, Artificial Sequence
  chemically synthesized
caatattgcagagaaagaaa

SEQ ID NO: 129342 - DNA, 20 bp, Artificial Sequence
  chemically synthesized
ttgcagagaaagaaacagtt

SEQ ID NO: 129343 - DNA, 20 bp, Artificial Sequence
  chemically synthesized
aaaaacttgaagtgaaagat

SEQ ID NO: 129344 - DNA, 20 bp, Artificial Sequence
  chemically synthesized
acgaaccaatctttcacttc

SEQ ID NO: 129345 - DNA, 20 bp, Artificial Sequence
  chemically synthesized
gtctaaaaaacttgaagtga

SEQ ID NO: 129346 - DNA, 20 bp, Artificial Sequence
  chemically synthesized
tagctagtctaaaaaacttg

SEQ ID NO: 129347 - DNA, 20 bp, Artificial Sequence
  chemically synthesized
atctttcacttcaagttttt

SEQ ID NO: 129348 - DNA, 20 bp, Artificial Sequence
  chemically synthesized
tcacttcaagttttttagac

SEQ ID NO: 129349 - DNA, 20 bp, Artificial Sequence
  chemically synthesized
tatcgataattaaacatagc

SEQ ID NO: 129350 - DNA, 20 bp, Artificial Sequence
  chemically synthesized
tgtatatcgataattaaaca

SEQ ID NO: 129351 - DNA, 20 bp, Artificial Sequence
  chemically synthesized
tgtgggaatttatatcagtc

SEQ ID NO: 129352 - DNA, 20 bp, Artificial Sequence
  chemically synthesized
gatgttgtgggaatttatat

SEQ ID NO: 129353 - DNA, 20 bp, Artificial Sequence
  chemically synthesized
ctccctaagagagatgttgt

SEQ ID NO: 129354 - DNA, 20 bp, Artificial Sequence
  chemically synthesized
cctccctaagagagatgttg

SEQ ID NO: 129355 - DNA, 20 bp, Artificial Sequence
  chemically synthesized
aattcccacaacatctctct

SEQ ID NO: 129356 - DNA, 20 bp, Artificial Sequence
  chemically synthesized
attcccacaacatctctctt

SEQ ID NO: 129357 - DNA, 20 bp, Artificial Sequence
  chemically synthesized
ttcccacaacatctctctta

SEQ ID NO: 129358 - DNA, 20 bp, Artificial Sequence
  chemically synthesized
cccacaacatctctcttagg

SEQ ID NO: 129359 - DNA, 20 bp, Artificial Sequence
  chemically synthesized
aataacattcctccctaaga

SEQ ID NO: 129360 - DNA, 20 bp, Artificial Sequence
  chemically synthesized
ccacaacatctctcttaggg

SEQ ID NO: 129361 - DNA, 20 bp, Artificial Sequence
  chemically synthesized
taaataacattcctccctaa

SEQ ID NO: 129362 - DNA, 20 bp, Artificial Sequence
  chemically synthesized
tataaataacattcctccct

SEQ ID NO: 129363 - DNA, 20 bp, Artificial Sequence
  chemically synthesized
gaggaatgttatttatacac

SEQ ID NO: 129364 - DNA, 20 bp, Artificial Sequence
  chemically synthesized
tgtagcaatgtgtattcaaa

SEQ ID NO: 129365 - DNA, 20 bp, Artificial Sequence
  chemically synthesized
ctgtagcaatgtgtattcaa

SEQ ID NO: 129366 - DNA, 20 bp, Artificial Sequence
  chemically synthesized
cttttgaatacacattgcta

SEQ ID NO: 129367 - DNA, 20 bp, Artificial Sequence
  chemically synthesized
atacacattgctacagaaca

SEQ ID NO: 129368 - DNA, 20 bp, Artificial Sequence
  chemically synthesized
cagaactgttctttgttctg

SEQ ID NO: 129369 - DNA, 20 bp, Artificial Sequence
  chemically synthesized
cattgctacagaacaaagaa

SEQ ID NO: 129370 - DNA, 20 bp, Artificial Sequence
  chemically synthesized
agtcagtgcagaaattgcaa

SEQ ID NO: 129371 - DNA, 20 bp, Artificial Sequence
  chemically synthesized
ctcgtgctgtacagtcagtg

SEQ ID NO: 129372 - DNA, 20 bp, Artificial Sequence
  chemically synthesized
caatttctgcactgactgta

SEQ ID NO: 129373 - DNA, 20 bp, Artificial Sequence
  chemically synthesized
taattctcgtgctgtacagt

SEQ ID NO: 129374 - DNA, 20 bp, Artificial Sequence
  chemically synthesized
cttctaattctcgtgctgta

SEQ ID NO: 129375 - DNA, 20 bp, Artificial Sequence
  chemically synthesized
ctgcactgactgtacagcac

SEQ ID NO: 129376 - DNA, 20 bp, Artificial Sequence
  chemically synthesized
tgactgtacagcacgagaat

SEQ ID NO: 129377 - DNA, 20 bp, Artificial Sequence
  chemically synthesized
ctgtacagcacgagaattag

SEQ ID NO: 129378 - DNA, 20 bp, Artificial Sequence
  chemically synthesized
ctttctaaaaatcagttaca

SEQ ID NO: 129379 - DNA, 20 bp, Artificial Sequence
  chemically synthesized
aagtctgtgtaactgatttt

SEQ ID NO: 129380 - DNA, 20 bp, Artificial Sequence
  chemically synthesized
caaagttgctttctaaaaat

SEQ ID NO: 129381 - DNA, 20 bp, Artificial Sequence
  chemically synthesized
ctgtgtaactgatttttaga

SEQ ID NO: 129382 - DNA, 20 bp, Artificial Sequence
  chemically synthesized
ttttagaaagcaactttgac

SEQ ID NO: 129383 - DNA, 20 bp, Artificial Sequence
  chemically synthesized
tagaaagcaactttgactag

SEQ ID NO: 129384 - DNA, 20 bp, Artificial Sequence
  chemically synthesized
ccaagactaactgctagtca

SEQ ID NO: 129385 - DNA, 20 bp, Artificial Sequence
  chemically synthesized
aagcaactttgactagcagt

SEQ ID NO: 129386 - DNA, 20 bp, Artificial Sequence
  chemically synthesized
tataacccaagactaactgc

SEQ ID NO: 129387 - DNA, 20 bp, Artificial Sequence
  chemically synthesized
ctttgactagcagttagtct

SEQ ID NO: 129388 - DNA, 20 bp, Artificial Sequence
  chemically synthesized
tttgactagcagttagtctt

SEQ ID NO: 129389 - DNA, 20 bp, Artificial Sequence
  chemically synthesized
ctaatccagggttataaccc

SEQ ID NO: 129390 - DNA, 20 bp, Artificial Sequence
  chemically synthesized
ttagtcttgggttataaccc

SEQ ID NO: 129391 - DNA, 20 bp, Artificial Sequence
  chemically synthesized
cttgggttataaccctggat

SEQ ID NO: 129392 - DNA, 20 bp, Artificial Sequence
  chemically synthesized
actatttcatcgctaatcca

SEQ ID NO: 129393 - DNA, 20 bp, Artificial Sequence
  chemically synthesized
cactatttcatcgctaatcc

SEQ ID NO: 129394 - DNA, 20 bp, Artificial Sequence
  chemically synthesized
ccactatttcatcgctaatc

SEQ ID NO: 129395 - DNA, 20 bp, Artificial Sequence
  chemically synthesized
accctggattagcgatgaaa

SEQ ID NO: 129396 - DNA, 20 bp, Artificial Sequence
  chemically synthesized
ctggattagcgatgaaatag

SEQ ID NO: 129397 - DNA, 20 bp, Artificial Sequence
  chemically synthesized
gatgaaatagtggatttaaa

SEQ ID NO: 129398 - DNA, 20 bp, Artificial Sequence
  chemically synthesized
atgaaatagtggatttaaat

SEQ ID NO: 129399 - DNA, 20 bp, Artificial Sequence
  chemically synthesized
atagtggatttaaatgggaa

SEQ ID NO: 129400 - DNA, 20 bp, Artificial Sequence
  chemically synthesized
aagttgatttgccacgatct

SEQ ID NO: 129401 - DNA, 20 bp, Artificial Sequence
  chemically synthesized
agttgaggaaactgagatcg

SEQ ID NO: 129402 - DNA, 20 bp, Artificial Sequence
  chemically synthesized
gtttgggagttgaggaaact

SEQ ID NO: 129403 - DNA, 20 bp, Artificial Sequence
  chemically synthesized
ttatttcagtttgggagttg

SEQ ID NO: 129404 - DNA, 20 bp, Artificial Sequence
  chemically synthesized
attatttcagtttgggagtt

SEQ ID NO: 129405 - DNA, 20 bp, Artificial Sequence
  chemically synthesized
ttgtcattatttcagtttgg

SEQ ID NO: 129406 - DNA, 20 bp, Artificial Sequence
  chemically synthesized
agttgtcattatttcagttt

SEQ ID NO: 129407 - DNA, 20 bp, Artificial Sequence
  chemically synthesized
cagttgtcattatttcagtt

SEQ ID NO: 129408 - DNA, 20 bp, Artificial Sequence
  chemically synthesized
ttctgcagttgtcattattt

SEQ ID NO: 129409 - DNA, 20 bp, Artificial Sequence
  chemically synthesized
aactgaaataatgacaactg

SEQ ID NO: 129410 - DNA, 20 bp, Artificial Sequence
  chemically synthesized
acaataattctgtggttctg

SEQ ID NO: 129411 - DNA, 20 bp, Artificial Sequence
  chemically synthesized
taatgacaactgcagaacca

SEQ ID NO: 129412 - DNA, 20 bp, Artificial Sequence
  chemically synthesized
ttatcttcacaataattctg

SEQ ID NO: 129413 - DNA, 20 bp, Artificial Sequence
  chemically synthesized
agaaccacagaattattgtg

SEQ ID NO: 129414 - DNA, 20 bp, Artificial Sequence
  chemically synthesized
taaaattcaataatgaataa

SEQ ID NO: 129415 - DNA, 20 bp, Artificial Sequence
  chemically synthesized
caataatgaataaaagcata

SEQ ID NO: 129416 - DNA, 20 bp, Artificial Sequence
  chemically synthesized
aataatgaataaaagcataa

SEQ ID NO: 129417 - DNA, 20 bp, Artificial Sequence
  chemically synthesized
aagcataaaggatcctacta

SEQ ID NO: 129418 - DNA, 20 bp, Artificial Sequence
  chemically synthesized
cagtagcaccttgctttagt

SEQ ID NO: 129419 - DNA, 20 bp, Artificial Sequence
  chemically synthesized
ataaaggatcctactaaagc

SEQ ID NO: 129420 - DNA, 20 bp, Artificial Sequence
  chemically synthesized
gcagtagcaccttgctttag

SEQ ID NO: 129421 - DNA, 20 bp, Artificial Sequence
  chemically synthesized
taaaggatcctactaaagca

SEQ ID NO: 129422 - DNA, 20 bp, Artificial Sequence
  chemically synthesized
gaagcagtagcaccttgctt

SEQ ID NO: 129423 - DNA, 20 bp, Artificial Sequence
  chemically synthesized
ttgtctatacagagaagcag

SEQ ID NO: 129424 - DNA, 20 bp, Artificial Sequence
  chemically synthesized
gtcttgtctatacagagaag

SEQ ID NO: 129425 - DNA, 20 bp, Artificial Sequence
  chemically synthesized
ggtgctactgcttctctgta

SEQ ID NO: 129426 - DNA, 20 bp, Artificial Sequence
  chemically synthesized
ttagtcttgtctatacagag

SEQ ID NO: 129427 - DNA, 20 bp, Artificial Sequence
  chemically synthesized
tgtttagtcttgtctataca

SEQ ID NO: 129428 - DNA, 20 bp, Artificial Sequence
  chemically synthesized
tactgcttctctgtatagac

SEQ ID NO: 129429 - DNA, 20 bp, Artificial Sequence
  chemically synthesized
attgtttagtcttgtctata

SEQ ID NO: 129430 - DNA, 20 bp, Artificial Sequence
  chemically synthesized
gataactataattcattgtt

SEQ ID NO: 129431 - DNA, 20 bp, Artificial Sequence
  chemically synthesized
caagactaaacaatgaatta

SEQ ID NO: 129432 - DNA, 20 bp, Artificial Sequence
  chemically synthesized
aacaaacattcacgatctgc

SEQ ID NO: 129433 - DNA, 20 bp, Artificial Sequence
  chemically synthesized
acaaacattcacgatctgct

SEQ ID NO: 129434 - DNA, 20 bp, Artificial Sequence
  chemically synthesized
caaacattcacgatctgcta

SEQ ID NO: 129435 - DNA, 20 bp, Artificial Sequence
  chemically synthesized
aacattcacgatctgctagg

SEQ ID NO: 129436 - DNA, 20 bp, Artificial Sequence
  chemically synthesized
ccatagtgtgcactccctag

SEQ ID NO: 129437 - DNA, 20 bp, Artificial Sequence
  chemically synthesized
gatccatagtgtgcactccc

SEQ ID NO: 129438 - DNA, 20 bp, Artificial Sequence
  chemically synthesized
ctgctagggagtgcacacta

SEQ ID NO: 129439 - DNA, 20 bp, Artificial Sequence
  chemically synthesized
tgtgggatcagtgagatcca

SEQ ID NO: 129440 - DNA, 20 bp, Artificial Sequence
  chemically synthesized
gcgtactctgtgggatcagt

SEQ ID NO: 129441 - DNA, 20 bp, Artificial Sequence
  chemically synthesized
tatggatctcactgatccca

SEQ ID NO: 129442 - DNA, 20 bp, Artificial Sequence
  chemically synthesized
tctggcgtactctgtgggat

SEQ ID NO: 129443 - DNA, 20 bp, Artificial Sequence
  chemically synthesized
tggatctcactgatcccaca

SEQ ID NO: 129444 - DNA, 20 bp, Artificial Sequence
  chemically synthesized
ggaactctggcgtactctgt

SEQ ID NO: 129445 - DNA, 20 bp, Artificial Sequence
  chemically synthesized
tggaactctggcgtactctg

SEQ ID NO: 129446 - DNA, 20 bp, Artificial Sequence
  chemically synthesized
actgatcccacagagtacgc

SEQ ID NO: 129447 - DNA, 20 bp, Artificial Sequence
  chemically synthesized
tgatcccacagagtacgcca

SEQ ID NO: 129448 - DNA, 20 bp, Artificial Sequence
  chemically synthesized
cacagagtacgccagagttc

SEQ ID NO: 129449 - DNA, 20 bp, Artificial Sequence
  chemically synthesized
acagagtacgccagagttcc

SEQ ID NO: 129450 - DNA, 20 bp, Artificial Sequence
  chemically synthesized
gcattttctacctggaactc

SEQ ID NO: 129451 - DNA, 20 bp, Artificial Sequence
  chemically synthesized
gagtacgccagagttccagg

SEQ ID NO: 129452 - DNA, 20 bp, Artificial Sequence
  chemically synthesized
tcaccttggcattttctacc

SEQ ID NO: 129453 - DNA, 20 bp, Artificial Sequence
  chemically synthesized
agttccaggtagaaaatgcc

SEQ ID NO: 129454 - DNA, 20 bp, Artificial Sequence
  chemically synthesized
gttccaggtagaaaatgcca

SEQ ID NO: 129455 - DNA, 20 bp, Artificial Sequence
  chemically synthesized
ggtagaaaatgccaaggtga

SEQ ID NO: 129456 - DNA, 20 bp, Artificial Sequence
  chemically synthesized
gtagaaaatgccaaggtgaa

SEQ ID NO: 129457 - DNA, 20 bp, Artificial Sequence
  chemically synthesized
gcaatttaagcctttcacct

SEQ ID NO: 129458 - DNA, 20 bp, Artificial Sequence
  chemically synthesized
aaggtgaaaggcttaaattg

SEQ ID NO: 129459 - DNA, 20 bp, Artificial Sequence
  chemically synthesized
aggtgaaaggcttaaattgc

SEQ ID NO: 129460 - DNA, 20 bp, Artificial Sequence
  chemically synthesized
aaaagatttacctgcaattt

SEQ ID NO: 129461 - DNA, 20 bp, Artificial Sequence
  chemically synthesized
aaattgcaggtaaatctttt

SEQ ID NO: 129462 - DNA, 20 bp, Artificial Sequence
  chemically synthesized
aattgcaggtaaatcttttg

SEQ ID NO: 129463 - DNA, 20 bp, Artificial Sequence
  chemically synthesized
actcactcaaatgacctcaa

SEQ ID NO: 129464 - DNA, 20 bp, Artificial Sequence
  chemically synthesized
taaatcttttgaggtcattt

SEQ ID NO: 129465 - DNA, 20 bp, Artificial Sequence
  chemically synthesized
tcttttgaggtcatttgagt

SEQ ID NO: 129466 - DNA, 20 bp, Artificial Sequence
  chemically synthesized
tgaggtcatttgagtgagtg

SEQ ID NO: 129467 - DNA, 20 bp, Artificial Sequence
  chemically synthesized
aggtcatttgagtgagtgaa

SEQ ID NO: 129468 - DNA, 20 bp, Artificial Sequence
  chemically synthesized
tttgagtgagtgaagagtga

SEQ ID NO: 129469 - DNA, 20 bp, Artificial Sequence
  chemically synthesized
gtgacggacatgactaactg

SEQ ID NO: 129470 - DNA, 20 bp, Artificial Sequence
  chemically synthesized
tgacggacatgactaactgt

SEQ ID NO: 129471 - DNA, 20 bp, Artificial Sequence
  chemically synthesized
cctttagagttgcccacagt

SEQ ID NO: 129472 - DNA, 20 bp, Artificial Sequence
  chemically synthesized
ttttcctttagagttgccca

SEQ ID NO: 129473 - DNA, 20 bp, Artificial Sequence
  chemically synthesized
actaactgtgggcaactcta

SEQ ID NO: 129474 - DNA, 20 bp, Artificial Sequence
  chemically synthesized
ctaactgtgggcaactctaa

SEQ ID NO: 129475 - DNA, 20 bp, Artificial Sequence
  chemically synthesized
ttgggatcatttttccttta

SEQ ID NO: 129476 - DNA, 20 bp, Artificial Sequence
  chemically synthesized
aattgggatcatttttcctt

SEQ ID NO: 129477 - DNA, 20 bp, Artificial Sequence
  chemically synthesized
aggaaaaatgatcccaattg

SEQ ID NO: 129478 - DNA, 20 bp, Artificial Sequence
  chemically synthesized
tctttgtcttaactgcaatt

SEQ ID NO: 129479 - DNA, 20 bp, Artificial Sequence
  chemically synthesized
atctttgtcttaactgcaat

SEQ ID NO: 129480 - DNA, 20 bp, Artificial Sequence
  chemically synthesized
aaatgatcccaattgcagtt

SEQ ID NO: 129481 - DNA, 20 bp, Artificial Sequence
  chemically synthesized
tcccaattgcagttaagaca

SEQ ID NO: 129482 - DNA, 20 bp, Artificial Sequence
  chemically synthesized
cctgatcccaacaaatagtt

SEQ ID NO: 129483 - DNA, 20 bp, Artificial Sequence
  chemically synthesized
aagatttctaaactatttgt

SEQ ID NO: 129484 - DNA, 20 bp, Artificial Sequence
  chemically synthesized
agatttctaaactatttgtt

SEQ ID NO: 129485 - DNA, 20 bp, Artificial Sequence
  chemically synthesized
tttttcctgatcccaacaaa

SEQ ID NO: 129486 - DNA, 20 bp, Artificial Sequence
  chemically synthesized
tctaaactatttgttgggat

SEQ ID NO: 129487 - DNA, 20 bp, Artificial Sequence
  chemically synthesized
ctaaactatttgttgggatc

SEQ ID NO: 129488 - DNA, 20 bp, Artificial Sequence
  chemically synthesized
tatttgttgggatcaggaaa

SEQ ID NO: 129489 - DNA, 20 bp, Artificial Sequence
  chemically synthesized
atttgttgggatcaggaaaa

SEQ ID NO: 129490 - DNA, 20 bp, Artificial Sequence
  chemically synthesized
tttgttgggatcaggaaaaa

SEQ ID NO: 129491 - DNA, 20 bp, Artificial Sequence
  chemically synthesized
tgttgggatcaggaaaaagg

SEQ ID NO: 129492 - DNA, 20 bp, Artificial Sequence
  chemically synthesized
gatcaggaaaaagggagaaa

SEQ ID NO: 129493 - DNA, 20 bp, Artificial Sequence
  chemically synthesized
caggaaaaagggagaaatag

SEQ ID NO: 129494 - DNA, 20 bp, Artificial Sequence
  chemically synthesized
gaaaaagggagaaatagcag

SEQ ID NO: 129495 - DNA, 20 bp, Artificial Sequence
  chemically synthesized
atagcagtagactgttctcc

SEQ ID NO: 129496 - DNA, 20 bp, Artificial Sequence
  chemically synthesized
tagcagtagactgttctccg

SEQ ID NO: 129497 - DNA, 20 bp, Artificial Sequence
  chemically synthesized
atggttttagcctcggagaa

SEQ ID NO: 129498 - DNA, 20 bp, Artificial Sequence
  chemically synthesized
ttttgatggttttagcctcg

SEQ ID NO: 129499 - DNA, 20 bp, Artificial Sequence
  chemically synthesized
ttttttgatggttttagcct

SEQ ID NO: 129500 - DNA, 20 bp, Artificial Sequence
  chemically synthesized
ctaacattttttgatggttt

SEQ ID NO: 129501 - DNA, 20 bp, Artificial Sequence
  chemically synthesized
tcatgcctaacattttttga

SEQ ID NO: 129502 - DNA, 20 bp, Artificial Sequence
  chemically synthesized
ctaaaaccatcaaaaaatgt

SEQ ID NO: 129503 - DNA, 20 bp, Artificial Sequence
  chemically synthesized
taaaaccatcaaaaaatgtt

SEQ ID NO: 129504 - DNA, 20 bp, Artificial Sequence
  chemically synthesized
aaaaaatgttaggcatgatc

SEQ ID NO: 129505 - DNA, 20 bp, Artificial Sequence
  chemically synthesized
gttaggcatgatcaagaatg

SEQ ID NO: 129506 - DNA, 20 bp, Artificial Sequence
  chemically synthesized
tcaagaatgaagctgaaaac

SEQ ID NO: 129507 - DNA, 20 bp, Artificial Sequence
  chemically synthesized
caagaatgaagctgaaaaca

SEQ ID NO: 129508 - DNA, 20 bp, Artificial Sequence
  chemically synthesized
aatggtggtttccttgtttt

SEQ ID NO: 129509 - DNA, 20 bp, Artificial Sequence
  chemically synthesized
gtacaaggttacaataatgg

SEQ ID NO: 129510 - DNA, 20 bp, Artificial Sequence
  chemically synthesized
tttgtacaaggttacaataa

SEQ ID NO: 129511 - DNA, 20 bp, Artificial Sequence
  chemically synthesized
cattattgtaaccttgtaca

SEQ ID NO: 129512 - DNA, 20 bp, Artificial Sequence
  chemically synthesized
ttgtgtcctagctttgtaca

SEQ ID NO: 129513 - DNA, 20 bp, Artificial Sequence
  chemically synthesized
gttgtgtcctagctttgtac

SEQ ID NO: 129514 - DNA, 20 bp, Artificial Sequence
  chemically synthesized
attgtaaccttgtacaaagc

SEQ ID NO: 129515 - DNA, 20 bp, Artificial Sequence
  chemically synthesized
ttgtaaccttgtacaaagct

SEQ ID NO: 129516 - DNA, 20 bp, Artificial Sequence
  chemically synthesized
ctctaggtatagttgtgtcc

SEQ ID NO: 129517 - DNA, 20 bp, Artificial Sequence
  chemically synthesized
agctaggacacaactatacc

SEQ ID NO: 129518 - DNA, 20 bp, Artificial Sequence
  chemically synthesized
ctaggacacaactataccta

SEQ ID NO: 129519 - DNA, 20 bp, Artificial Sequence
  chemically synthesized
tgcttacattactctaggta

SEQ ID NO: 129520 - DNA, 20 bp, Artificial Sequence
  chemically synthesized
agttatgcttacattactct

SEQ ID NO: 129521 - DNA, 20 bp, Artificial Sequence
  chemically synthesized
gagttatgcttacattactc

SEQ ID NO: 129522 - DNA, 20 bp, Artificial Sequence
  chemically synthesized
aactatacctagagtaatgt

SEQ ID NO: 129523 - DNA, 20 bp, Artificial Sequence
  chemically synthesized
gtctttgtatgtcaaacatt

SEQ ID NO: 129524 - DNA, 20 bp, Artificial Sequence
  chemically synthesized
aactcaatgtttgacataca

SEQ ID NO: 129525 - DNA, 20 bp, Artificial Sequence
  chemically synthesized
tttgacatacaaagacatat

SEQ ID NO: 129526 - DNA, 20 bp, Artificial Sequence
  chemically synthesized
ttgacatacaaagacatata

SEQ ID NO: 129527 - DNA, 20 bp, Artificial Sequence
  chemically synthesized
acaaagacatataaggaact

SEQ ID NO: 129528 - DNA, 20 bp, Artificial Sequence
  chemically synthesized
caaagacatataaggaactg

SEQ ID NO: 129529 - DNA, 20 bp, Artificial Sequence
  chemically synthesized
gacatataaggaactgagga

SEQ ID NO: 129530 - DNA, 20 bp, Artificial Sequence
  chemically synthesized
gttattatttggactttcct

SEQ ID NO: 129531 - DNA, 20 bp, Artificial Sequence
  chemically synthesized
ttataatctgtgttattatt

SEQ ID NO: 129532 - DNA, 20 bp, Artificial Sequence
  chemically synthesized
ggaaagtccaaataataaca

SEQ ID NO: 129533 - DNA, 20 bp, Artificial Sequence
  chemically synthesized
caaataataacacagattat

SEQ ID NO: 129534 - DNA, 20 bp, Artificial Sequence
  chemically synthesized
aaataataacacagattata

SEQ ID NO: 129535 - DNA, 20 bp, Artificial Sequence
  chemically synthesized
cacagattataaggaatatt

SEQ ID NO: 129536 - DNA, 20 bp, Artificial Sequence
  chemically synthesized
aatgccttgtggaagtagaa

SEQ ID NO: 129537 - DNA, 20 bp, Artificial Sequence
  chemically synthesized
aaatgccttgtggaagtaga

SEQ ID NO: 129538 - DNA, 20 bp, Artificial Sequence
  chemically synthesized
taaatgccttgtggaagtag

SEQ ID NO: 129539 - DNA, 20 bp, Artificial Sequence
  chemically synthesized
tatgtcccttctacttccac

SEQ ID NO: 129540 - DNA, 20 bp, Artificial Sequence
  chemically synthesized
gtttaaatgccttgtggaag

SEQ ID NO: 129541 - DNA, 20 bp, Artificial Sequence
  chemically synthesized
atgtcccttctacttccaca

SEQ ID NO: 129542 - DNA, 20 bp, Artificial Sequence
  chemically synthesized
cctgtttaaatgccttgtgg

SEQ ID NO: 129543 - DNA, 20 bp, Artificial Sequence
  chemically synthesized
aaccctgtttaaatgccttg

SEQ ID NO: 129544 - DNA, 20 bp, Artificial Sequence
  chemically synthesized
acttccacaaggcatttaaa

SEQ ID NO: 129545 - DNA, 20 bp, Artificial Sequence
  chemically synthesized
cttccacaaggcatttaaac

SEQ ID NO: 129546 - DNA, 20 bp, Artificial Sequence
  chemically synthesized
ttccacaaggcatttaaaca

SEQ ID NO: 129547 - DNA, 20 bp, Artificial Sequence
  chemically synthesized
ggcatttaaacagggttctg

SEQ ID NO: 129548 - DNA, 20 bp, Artificial Sequence
  chemically synthesized
atttaaacagggttctgtgg

SEQ ID NO: 129549 - DNA, 20 bp, Artificial Sequence
  chemically synthesized
aactatagataggtcttcca

SEQ ID NO: 129550 - DNA, 20 bp, Artificial Sequence
  chemically synthesized
ttctgtggaagacctatcta

SEQ ID NO: 129551 - DNA, 20 bp, Artificial Sequence
  chemically synthesized
tgcaaagcttaactatagat

SEQ ID NO: 129552 - DNA, 20 bp, Artificial Sequence
  chemically synthesized
ttgcaaagcttaactataga

SEQ ID NO: 129553 - DNA, 20 bp, Artificial Sequence
  chemically synthesized
tggaagacctatctatagtt

SEQ ID NO: 129554 - DNA, 20 bp, Artificial Sequence
  chemically synthesized
tcttttgcaaagcttaacta

SEQ ID NO: 129555 - DNA, 20 bp, Artificial Sequence
  chemically synthesized
tctatagttaagctttgcaa

SEQ ID NO: 129556 - DNA, 20 bp, Artificial Sequence
  chemically synthesized
gagttgaaacttcttttgca

SEQ ID NO: 129557 - DNA, 20 bp, Artificial Sequence
  chemically synthesized
atagttaagctttgcaaaag

SEQ ID NO: 129558 - DNA, 20 bp, Artificial Sequence
  chemically synthesized
ttcttcctctttgtgggttt

SEQ ID NO: 129559 - DNA, 20 bp, Artificial Sequence
  chemically synthesized
agtttcaactcaaacccaca

SEQ ID NO: 129560 - DNA, 20 bp, Artificial Sequence
  chemically synthesized
tttcaactcaaacccacaaa

SEQ ID NO: 129561 - DNA, 20 bp, Artificial Sequence
  chemically synthesized
ttcaactcaaacccacaaag

SEQ ID NO: 129562 - DNA, 20 bp, Artificial Sequence
  chemically synthesized
atatgtttcttcctctttgt

SEQ ID NO: 129563 - DNA, 20 bp, Artificial Sequence
  chemically synthesized
tatatgtttcttcctctttg

SEQ ID NO: 129564 - DNA, 20 bp, Artificial Sequence
  chemically synthesized
aactcaaacccacaaagagg

SEQ ID NO: 129565 - DNA, 20 bp, Artificial Sequence
  chemically synthesized
aaacatatatgctaaccatg

SEQ ID NO: 129566 - DNA, 20 bp, Artificial Sequence
  chemically synthesized
gttcatactagctacatggt

SEQ ID NO: 129567 - DNA, 20 bp, Artificial Sequence
  chemically synthesized
atatatgctaaccatgtagc

SEQ ID NO: 129568 - DNA, 20 bp, Artificial Sequence
  chemically synthesized
gcccgttcatactagctaca

SEQ ID NO: 129569 - DNA, 20 bp, Artificial Sequence
  chemically synthesized
aaccatgtagctagtatgaa

SEQ ID NO: 129570 - DNA, 20 bp, Artificial Sequence
  chemically synthesized
aaaaaaatgcccgttcatac

SEQ ID NO: 129571 - DNA, 20 bp, Artificial Sequence
  chemically synthesized
accatgtagctagtatgaac

SEQ ID NO: 129572 - DNA, 20 bp, Artificial Sequence
  chemically synthesized
aacgggcattttttttcact

SEQ ID NO: 129573 - DNA, 20 bp, Artificial Sequence
  chemically synthesized
cattttttttcacttagata

SEQ ID NO: 129574 - DNA, 20 bp, Artificial Sequence
  chemically synthesized
attcctccttttctatatct

SEQ ID NO: 129575 - DNA, 20 bp, Artificial Sequence
  chemically synthesized
tttttcacttagatatagaa

SEQ ID NO: 129576 - DNA, 20 bp, Artificial Sequence
  chemically synthesized
ttttcacttagatatagaaa

SEQ ID NO: 129577 - DNA, 20 bp, Artificial Sequence
  chemically synthesized
ttcacttagatatagaaaag

SEQ ID NO: 129578 - DNA, 20 bp, Artificial Sequence
  chemically synthesized
tcacttagatatagaaaagg

SEQ ID NO: 129579 - DNA, 20 bp, Artificial Sequence
  chemically synthesized
gatatagaaaaggaggaatg

SEQ ID NO: 129580 - DNA, 20 bp, Artificial Sequence
  chemically synthesized
gaatgtggttgttttacaaa

SEQ ID NO: 129581 - DNA, 20 bp, Artificial Sequence
  chemically synthesized
atgtggttgttttacaaata

SEQ ID NO: 129582 - DNA, 20 bp, Artificial Sequence
  chemically synthesized
tgttttacaaatagagaata

SEQ ID NO: 129583 - DNA, 20 bp, Artificial Sequence
  chemically synthesized
aaatagagaataaagtatct

SEQ ID NO: 129584 - DNA, 20 bp, Artificial Sequence
  chemically synthesized
ctttttgatctgttacatct

SEQ ID NO: 129585 - DNA, 20 bp, Artificial Sequence
  chemically synthesized
ataaagtatctgagatgtaa

SEQ ID NO: 129586 - DNA, 20 bp, Artificial Sequence
  chemically synthesized
ctgagatgtaacagatcaaa

SEQ ID NO: 129587 - DNA, 20 bp, Artificial Sequence
  chemically synthesized
acagatcaaaaagctaaaaa

SEQ ID NO: 129588 - DNA, 20 bp, Artificial Sequence
  chemically synthesized
agatcaaaaagctaaaaaca

SEQ ID NO: 129589 - DNA, 20 bp, Artificial Sequence
  chemically synthesized
gatcaaaaagctaaaaacag

SEQ ID NO: 129590 - DNA, 20 bp, Artificial Sequence
  chemically synthesized
caataactcccctctgtttt

SEQ ID NO: 129591 - DNA, 20 bp, Artificial Sequence
  chemically synthesized
atcaaaaagctaaaaacaga

SEQ ID NO: 129592 - DNA, 20 bp, Artificial Sequence
  chemically synthesized
tcaaaaagctaaaaacagag

SEQ ID NO: 129593 - DNA, 20 bp, Artificial Sequence
  chemically synthesized
aaaaagctaaaaacagaggg

SEQ ID NO: 129594 - DNA, 20 bp, Artificial Sequence
  chemically synthesized
taaaaacagaggggagttat

SEQ ID NO: 129595 - DNA, 20 bp, Artificial Sequence
  chemically synthesized
attggcacataaataaatcc

SEQ ID NO: 129596 - DNA, 20 bp, Artificial Sequence
  chemically synthesized
acttggtcatcatagtggcc

SEQ ID NO: 129597 - DNA, 20 bp, Artificial Sequence
  chemically synthesized
aacttggtcatcatagtggc

SEQ ID NO: 129598 - DNA, 20 bp, Artificial Sequence
  chemically synthesized
aagcaacttggtcatcatag

SEQ ID NO: 129599 - DNA, 20 bp, Artificial Sequence
  chemically synthesized
aaaaagcaacttggtcatca

SEQ ID NO: 129600 - DNA, 20 bp, Artificial Sequence
  chemically synthesized
tcctggccactatgatgacc

SEQ ID NO: 129601 - DNA, 20 bp, Artificial Sequence
  chemically synthesized
gatttagagaaaaagcaact

SEQ ID NO: 129602 - DNA, 20 bp, Artificial Sequence
  chemically synthesized
ctttttgggatttagagaaa

SEQ ID NO: 129603 - DNA, 20 bp, Artificial Sequence
  chemically synthesized
ttctagctttttgggattta

SEQ ID NO: 129604 - DNA, 20 bp, Artificial Sequence
  chemically synthesized
cattctagctttttgggatt

SEQ ID NO: 129605 - DNA, 20 bp, Artificial Sequence
  chemically synthesized
ctttttctctaaatcccaaa

SEQ ID NO: 129606 - DNA, 20 bp, Artificial Sequence
  chemically synthesized
ttctctaaatcccaaaaagc

SEQ ID NO: 129607 - DNA, 20 bp, Artificial Sequence
  chemically synthesized
tttctgcattctagcttttt

SEQ ID NO: 129608 - DNA, 20 bp, Artificial Sequence
  chemically synthesized
gtttctgcattctagctttt

SEQ ID NO: 129609 - DNA, 20 bp, Artificial Sequence
  chemically synthesized
aatcccaaaaagctagaatg

SEQ ID NO: 129610 - DNA, 20 bp, Artificial Sequence
  chemically synthesized
gcttggctgtttctgcattc

SEQ ID NO: 129611 - DNA, 20 bp, Artificial Sequence
  chemically synthesized
aaaaagctagaatgcagaaa

SEQ ID NO: 129612 - DNA, 20 bp, Artificial Sequence
  chemically synthesized
gctagaatgcagaaacagcc

SEQ ID NO: 129613 - DNA, 20 bp, Artificial Sequence
  chemically synthesized
gcagaaacagccaagcattt

SEQ ID NO: 129614 - DNA, 20 bp, Artificial Sequence
  chemically synthesized
atgaacttaaccaaaatgct

SEQ ID NO: 129615 - DNA, 20 bp, Artificial Sequence
  chemically synthesized
aacagccaagcattttggtt

SEQ ID NO: 129616 - DNA, 20 bp, Artificial Sequence
  chemically synthesized
aagcattttggttaagttca

SEQ ID NO: 129617 - DNA, 20 bp, Artificial Sequence
  chemically synthesized
cattttggttaagttcatgg

SEQ ID NO: 129618 - DNA, 20 bp, Artificial Sequence
  chemically synthesized
ttggttaagttcatggaagc

SEQ ID NO: 129619 - DNA, 20 bp, Artificial Sequence
  chemically synthesized
aagttcatggaagccagacc

SEQ ID NO: 129620 - DNA, 20 bp, Artificial Sequence
  chemically synthesized
ttagtcatttgttctgggtc

SEQ ID NO: 129621 - DNA, 20 bp, Artificial Sequence
  chemically synthesized
aaaatttagtcatttgttct

SEQ ID NO: 129622 - DNA, 20 bp, Artificial Sequence
  chemically synthesized
taaaatttagtcatttgttc

SEQ ID NO: 129623 - DNA, 20 bp, Artificial Sequence
  chemically synthesized
tattataaaattttaaaatt

SEQ ID NO: 129624 - DNA, 20 bp, Artificial Sequence
  chemically synthesized
attttaaaattttataatat

SEQ ID NO: 129625 - DNA, 20 bp, Artificial Sequence
  chemically synthesized
ataatattagcctaacattt

SEQ ID NO: 129626 - DNA, 20 bp, Artificial Sequence
  chemically synthesized
ccaaactaaccttaaatgtt

SEQ ID NO: 129627 - DNA, 20 bp, Artificial Sequence
  chemically synthesized
taatattagcctaacattta

SEQ ID NO: 129628 - DNA, 20 bp, Artificial Sequence
  chemically synthesized
tccaaactaaccttaaatgt

SEQ ID NO: 129629 - DNA, 20 bp, Artificial Sequence
  chemically synthesized
attagcctaacatttaaggt

SEQ ID NO: 129630 - DNA, 20 bp, Artificial Sequence
  chemically synthesized
cctaacatttaaggttagtt

SEQ ID NO: 129631 - DNA, 20 bp, Artificial Sequence
  chemically synthesized
tttaaggttagtttggaaca

SEQ ID NO: 129632 - DNA, 20 bp, Artificial Sequence
  chemically synthesized
ggttagtttggaacatggaa

SEQ ID NO: 129633 - DNA, 20 bp, Artificial Sequence
  chemically synthesized
tggaacatggaaaagatcaa

SEQ ID NO: 129634 - DNA, 20 bp, Artificial Sequence
  chemically synthesized
catggaaaagatcaacagtt

SEQ ID NO: 129635 - DNA, 20 bp, Artificial Sequence
  chemically synthesized
aggagtaaacagtgtgaaaa

SEQ ID NO: 129636 - DNA, 20 bp, Artificial Sequence
  chemically synthesized
ccatataatagaggagtaaa

SEQ ID NO: 129637 - DNA, 20 bp, Artificial Sequence
  chemically synthesized
attatccccatataatagag

SEQ ID NO: 129638 - DNA, 20 bp, Artificial Sequence
  chemically synthesized
ttattatccccatataatag

SEQ ID NO: 129639 - DNA, 20 bp, Artificial Sequence
  chemically synthesized
ctgtttactcctctattata

SEQ ID NO: 129640 - DNA, 20 bp, Artificial Sequence
  chemically synthesized
gttattatccccatataata

SEQ ID NO: 129641 - DNA, 20 bp, Artificial Sequence
  chemically synthesized
tgtttactcctctattatat

SEQ ID NO: 129642 - DNA, 20 bp, Artificial Sequence
  chemically synthesized
gtttactcctctattatatg

SEQ ID NO: 129643 - DNA, 20 bp, Artificial Sequence
  chemically synthesized
ttgttattatccccatataa

SEQ ID NO: 129644 - DNA, 20 bp, Artificial Sequence
  chemically synthesized
tattatatggggataataac

SEQ ID NO: 129645 - DNA, 20 bp, Artificial Sequence
  chemically synthesized
taacaagaaaattaataatc

SEQ ID NO: 129646 - DNA, 20 bp, Artificial Sequence
  chemically synthesized
aagaaaattaataatctaga

SEQ ID NO: 129647 - DNA, 20 bp, Artificial Sequence
  chemically synthesized
attatttccttttatctttc

SEQ ID NO: 129648 - DNA, 20 bp, Artificial Sequence
  chemically synthesized
ttaataatctagaaagataa

SEQ ID NO: 129649 - DNA, 20 bp, Artificial Sequence
  chemically synthesized
taataatctagaaagataaa

SEQ ID NO: 129650 - DNA, 20 bp, Artificial Sequence
  chemically synthesized
taaaaggaaataatgtacac

SEQ ID NO: 129651 - DNA, 20 bp, Artificial Sequence
  chemically synthesized
aaaaggaaataatgtacaca

SEQ ID NO: 129652 - DNA, 20 bp, Artificial Sequence
  chemically synthesized
aataatgtacacaaggcact

SEQ ID NO: 129653 - DNA, 20 bp, Artificial Sequence
  chemically synthesized
tgtacacaaggcactgagaa

SEQ ID NO: 129654 - DNA, 20 bp, Artificial Sequence
  chemically synthesized
taggggtcaggtacttttct

SEQ ID NO: 129655 - DNA, 20 bp, Artificial Sequence
  chemically synthesized
tgagaaaagtacctgacccc

SEQ ID NO: 129656 - DNA, 20 bp, Artificial Sequence
  chemically synthesized
ttgagagctgtctaggggtc

SEQ ID NO: 129657 - DNA, 20 bp, Artificial Sequence
  chemically synthesized
attgagagctgtctaggggt

SEQ ID NO: 129658 - DNA, 20 bp, Artificial Sequence
  chemically synthesized
aaaagtacctgacccctaga

SEQ ID NO: 129659 - DNA, 20 bp, Artificial Sequence
  chemically synthesized
tataattgagagctgtctag

SEQ ID NO: 129660 - DNA, 20 bp, Artificial Sequence
  chemically synthesized
ctataattgagagctgtcta

SEQ ID NO: 129661 - DNA, 20 bp, Artificial Sequence
  chemically synthesized
cctataattgagagctgtct

SEQ ID NO: 129662 - DNA, 20 bp, Artificial Sequence
  chemically synthesized
ccctataattgagagctgtc

SEQ ID NO: 129663 - DNA, 20 bp, Artificial Sequence
  chemically synthesized
ccctagacagctctcaatta

SEQ ID NO: 129664 - DNA, 20 bp, Artificial Sequence
  chemically synthesized
atttacgcccctataattga

SEQ ID NO: 129665 - DNA, 20 bp, Artificial Sequence
  chemically synthesized
cctagacagctctcaattat

SEQ ID NO: 129666 - DNA, 20 bp, Artificial Sequence
  chemically synthesized
ctagacagctctcaattata

SEQ ID NO: 129667 - DNA, 20 bp, Artificial Sequence
  chemically synthesized
ctatttacgcccctataatt

SEQ ID NO: 129668 - DNA, 20 bp, Artificial Sequence
  chemically synthesized
tagacagctctcaattatag

SEQ ID NO: 129669 - DNA, 20 bp, Artificial Sequence
  chemically synthesized
ctcaattataggggcgtaaa

SEQ ID NO: 129670 - DNA, 20 bp, Artificial Sequence
  chemically synthesized
tcaattataggggcgtaaat

SEQ ID NO: 129671 - DNA, 20 bp, Artificial Sequence
  chemically synthesized
aaataggcaatcgtgtactt

SEQ ID NO: 129672 - DNA, 20 bp, Artificial Sequence
  chemically synthesized
aaagtccaacagtgttacca

SEQ ID NO: 129673 - DNA, 20 bp, Artificial Sequence
  chemically synthesized
gtgtactttggtaacactgt

SEQ ID NO: 129674 - DNA, 20 bp, Artificial Sequence
  chemically synthesized
gaagccccagaaaagtccaa

SEQ ID NO: 129675 - DNA, 20 bp, Artificial Sequence
  chemically synthesized
gtaacactgttggacttttc

SEQ ID NO: 129676 - DNA, 20 bp, Artificial Sequence
  chemically synthesized
taacactgttggacttttct

SEQ ID NO: 129677 - DNA, 20 bp, Artificial Sequence
  chemically synthesized
aacactgttggacttttctg

SEQ ID NO: 129678 - DNA, 20 bp, Artificial Sequence
  chemically synthesized
ggatttaagaagccccagaa

SEQ ID NO: 129679 - DNA, 20 bp, Artificial Sequence
  chemically synthesized
actcaggatttaagaagccc

SEQ ID NO: 129680 - DNA, 20 bp, Artificial Sequence
  chemically synthesized
tttatgactcaggatttaag

SEQ ID NO: 129681 - DNA, 20 bp, Artificial Sequence
  chemically synthesized
tctggggcttcttaaatcct

SEQ ID NO: 129682 - DNA, 20 bp, Artificial Sequence
  chemically synthesized
tgctttatgactcaggattt

SEQ ID NO: 129683 - DNA, 20 bp, Artificial Sequence
  chemically synthesized
cctcctttgctttatgactc

SEQ ID NO: 129684 - DNA, 20 bp, Artificial Sequence
  chemically synthesized
ttcttaaatcctgagtcata

SEQ ID NO: 129685 - DNA, 20 bp, Artificial Sequence
  chemically synthesized
tcctcctttgctttatgact

SEQ ID NO: 129686 - DNA, 20 bp, Artificial Sequence
  chemically synthesized
aaatcctgagtcataaagca

SEQ ID NO: 129687 - DNA, 20 bp, Artificial Sequence
  chemically synthesized
aatcctgagtcataaagcaa

SEQ ID NO: 129688 - DNA, 20 bp, Artificial Sequence
  chemically synthesized
tcctgagtcataaagcaaag

SEQ ID NO: 129689 - DNA, 20 bp, Artificial Sequence
  chemically synthesized
cctgagtcataaagcaaagg

SEQ ID NO: 129690 - DNA, 20 bp, Artificial Sequence
  chemically synthesized
agtcataaagcaaaggagga

SEQ ID NO: 129691 - DNA, 20 bp, Artificial Sequence
  chemically synthesized
taaagcaaaggaggatagat

SEQ ID NO: 129692 - DNA, 20 bp, Artificial Sequence
  chemically synthesized
aggatagattggatgatccc

SEQ ID NO: 129693 - DNA, 20 bp, Artificial Sequence
  chemically synthesized
gatagattggatgatccctg

SEQ ID NO: 129694 - DNA, 20 bp, Artificial Sequence
  chemically synthesized
tagagctgaaaacatctcca

SEQ ID NO: 129695 - DNA, 20 bp, Artificial Sequence
  chemically synthesized
ttagagctgaaaacatctcc

SEQ ID NO: 129696 - DNA, 20 bp, Artificial Sequence
  chemically synthesized
gttagagctgaaaacatctc

SEQ ID NO: 129697 - DNA, 20 bp, Artificial Sequence
  chemically synthesized
atgatccctggagatgtttt

SEQ ID NO: 129698 - DNA, 20 bp, Artificial Sequence
  chemically synthesized
ggagatgttttcagctctaa

SEQ ID NO: 129699 - DNA, 20 bp, Artificial Sequence
  chemically synthesized
acgtatttcacaaactgtta

SEQ ID NO: 129700 - DNA, 20 bp, Artificial Sequence
  chemically synthesized
aaacgtatttcacaaactgt

SEQ ID NO: 129701 - DNA, 20 bp, Artificial Sequence
  chemically synthesized
tcagctctgacagaggcatc

SEQ ID NO: 129702 - DNA, 20 bp, Artificial Sequence
  chemically synthesized
acgtttcttgatgcctctgt

SEQ ID NO: 129703 - DNA, 20 bp, Artificial Sequence
  chemically synthesized
gtttcttgatgcctctgtca

SEQ ID NO: 129704 - DNA, 20 bp, Artificial Sequence
  chemically synthesized
tgagctttcagctctgacag

SEQ ID NO: 129705 - DNA, 20 bp, Artificial Sequence
  chemically synthesized
gtgagctttcagctctgaca

SEQ ID NO: 129706 - DNA, 20 bp, Artificial Sequence
  chemically synthesized
aggtgagctttcagctctga

SEQ ID NO: 129707 - DNA, 20 bp, Artificial Sequence
  chemically synthesized
gatgcctctgtcagagctga

SEQ ID NO: 129708 - DNA, 20 bp, Artificial Sequence
  chemically synthesized
aaccttgtaaggtgagcttt

SEQ ID NO: 129709 - DNA, 20 bp, Artificial Sequence
  chemically synthesized
gagctgaaagctcaccttac

SEQ ID NO: 129710 - DNA, 20 bp, Artificial Sequence
  chemically synthesized
tcacaaaaaccttgtaaggt

SEQ ID NO: 129711 - DNA, 20 bp, Artificial Sequence
  chemically synthesized
agctgaaagctcaccttaca

SEQ ID NO: 129712 - DNA, 20 bp, Artificial Sequence
  chemically synthesized
ttcttcacaaaaaccttgta

SEQ ID NO: 129713 - DNA, 20 bp, Artificial Sequence
  chemically synthesized
gttcttcacaaaaaccttgt

SEQ ID NO: 129714 - DNA, 20 bp, Artificial Sequence
  chemically synthesized
caccttacaaggtttttgtg

SEQ ID NO: 129715 - DNA, 20 bp, Artificial Sequence
  chemically synthesized
gtttttgtgaagaactcacc

SEQ ID NO: 129716 - DNA, 20 bp, Artificial Sequence
  chemically synthesized
atctaggcactgggctgggt

SEQ ID NO: 129717 - DNA, 20 bp, Artificial Sequence
  chemically synthesized
tgtgaagaactcacccagcc

SEQ ID NO: 129718 - DNA, 20 bp, Artificial Sequence
  chemically synthesized
gttcatctaggcactgggct

SEQ ID NO: 129719 - DNA, 20 bp, Artificial Sequence
  chemically synthesized
tgttcatctaggcactgggc

SEQ ID NO: 129720 - DNA, 20 bp, Artificial Sequence
  chemically synthesized
aactcacccagcccagtgcc

SEQ ID NO: 129721 - DNA, 20 bp, Artificial Sequence
  chemically synthesized
catttgttcatctaggcact

SEQ ID NO: 129722 - DNA, 20 bp, Artificial Sequence
  chemically synthesized
tcatttgttcatctaggcac

SEQ ID NO: 129723 - DNA, 20 bp, Artificial Sequence
  chemically synthesized
gatacgtcatttgttcatct

SEQ ID NO: 129724 - DNA, 20 bp, Artificial Sequence
  chemically synthesized
tgatacgtcatttgttcatc

SEQ ID NO: 129725 - DNA, 20 bp, Artificial Sequence
  chemically synthesized
atgaacaaatgacgtatcaa

SEQ ID NO: 129726 - DNA, 20 bp, Artificial Sequence
  chemically synthesized
gtccatccaggggaacagta

SEQ ID NO: 129727 - DNA, 20 bp, Artificial Sequence
  chemically synthesized
caatagccatactgttcccc

SEQ ID NO: 129728 - DNA, 20 bp, Artificial Sequence
  chemically synthesized
caaaggtccatccaggggaa

SEQ ID NO: 129729 - DNA, 20 bp, Artificial Sequence
  chemically synthesized
agccatactgttcccctgga

SEQ ID NO: 129730 - DNA, 20 bp, Artificial Sequence
  chemically synthesized
tttaccaaaggtccatccag

SEQ ID NO: 129731 - DNA, 20 bp, Artificial Sequence
  chemically synthesized
atttaccaaaggtccatcca

SEQ ID NO: 129732 - DNA, 20 bp, Artificial Sequence
  chemically synthesized
aatttaccaaaggtccatcc

SEQ ID NO: 129733 - DNA, 20 bp, Artificial Sequence
  chemically synthesized
aaatttaccaaaggtccatc

SEQ ID NO: 129734 - DNA, 20 bp, Artificial Sequence
  chemically synthesized
tgttcccctggatggacctt

SEQ ID NO: 129735 - DNA, 20 bp, Artificial Sequence
  chemically synthesized
gccaagttgaaatttaccaa

SEQ ID NO: 129736 - DNA, 20 bp, Artificial Sequence
  chemically synthesized
tgccaagttgaaatttacca

SEQ ID NO: 129737 - DNA, 20 bp, Artificial Sequence
  chemically synthesized
acctttggtaaatttcaact

SEQ ID NO: 129738 - DNA, 20 bp, Artificial Sequence
  chemically synthesized
tatatgaccataagattgcc

SEQ ID NO: 129739 - DNA, 20 bp, Artificial Sequence
  chemically synthesized
atttcaacttggcaatctta

SEQ ID NO: 129740 - DNA, 20 bp, Artificial Sequence
  chemically synthesized
atgactgaatatatgaccat

SEQ ID NO: 129741 - DNA, 20 bp, Artificial Sequence
  chemically synthesized
caatcttatggtcatatatt

SEQ ID NO: 129742 - DNA, 20 bp, Artificial Sequence
  chemically synthesized
tattcagtcatgctacatgt

SEQ ID NO: 129743 - DNA, 20 bp, Artificial Sequence
  chemically synthesized
agtttcctttaactgacatg

SEQ ID NO: 129744 - DNA, 20 bp, Artificial Sequence
  chemically synthesized
gtcatgctacatgtcagtta

SEQ ID NO: 129745 - DNA, 20 bp, Artificial Sequence
  chemically synthesized
tcatgctacatgtcagttaa

SEQ ID NO: 129746 - DNA, 20 bp, Artificial Sequence
  chemically synthesized
atgtcagttaaaggaaactc

SEQ ID NO: 129747 - DNA, 20 bp, Artificial Sequence
  chemically synthesized
aacattttttaggttggctt

SEQ ID NO: 129748 - DNA, 20 bp, Artificial Sequence
  chemically synthesized
ggagggaacattttttaggt

SEQ ID NO: 129749 - DNA, 20 bp, Artificial Sequence
  chemically synthesized
gacaggagggaacatttttt

SEQ ID NO: 129750 - DNA, 20 bp, Artificial Sequence
  chemically synthesized
agacaggagggaacattttt

SEQ ID NO: 129751 - DNA, 20 bp, Artificial Sequence
  chemically synthesized
aaaaaatgttccctcctgtc

SEQ ID NO: 129752 - DNA, 20 bp, Artificial Sequence
  chemically synthesized
tagccttggcccagacagga

SEQ ID NO: 129753 - DNA, 20 bp, Artificial Sequence
  chemically synthesized
aaaaatgttccctcctgtct

SEQ ID NO: 129754 - DNA, 20 bp, Artificial Sequence
  chemically synthesized
atagccttggcccagacagg

SEQ ID NO: 129755 - DNA, 20 bp, Artificial Sequence
  chemically synthesized
aatagccttggcccagacag

SEQ ID NO: 129756 - DNA, 20 bp, Artificial Sequence
  chemically synthesized
aaaatagccttggcccagac

SEQ ID NO: 129757 - DNA, 20 bp, Artificial Sequence
  chemically synthesized
aaaaatagccttggcccaga

SEQ ID NO: 129758 - DNA, 20 bp, Artificial Sequence
  chemically synthesized
tgttccctcctgtctgggcc

SEQ ID NO: 129759 - DNA, 20 bp, Artificial Sequence
  chemically synthesized
gttccctcctgtctgggcca

SEQ ID NO: 129760 - DNA, 20 bp, Artificial Sequence
  chemically synthesized
acaaaaaaatagccttggcc

SEQ ID NO: 129761 - DNA, 20 bp, Artificial Sequence
  chemically synthesized
aagatacaaaaaaatagcct

SEQ ID NO: 129762 - DNA, 20 bp, Artificial Sequence
  chemically synthesized
tctcttaagatacaaaaaaa

SEQ ID NO: 129763 - DNA, 20 bp, Artificial Sequence
  chemically synthesized
aggctatttttttgtatctt

SEQ ID NO: 129764 - DNA, 20 bp, Artificial Sequence
  chemically synthesized
gctatttttttgtatcttaa

SEQ ID NO: 129765 - DNA, 20 bp, Artificial Sequence
  chemically synthesized
tatttttttgtatcttaaga

SEQ ID NO: 129766 - DNA, 20 bp, Artificial Sequence
  chemically synthesized
atttttttgtatcttaagag

SEQ ID NO: 129767 - DNA, 20 bp, Artificial Sequence
  chemically synthesized
gtgtgacacatgcctctctt

SEQ ID NO: 129768 - DNA, 20 bp, Artificial Sequence
  chemically synthesized
taagagaggcatgtgtcaca

SEQ ID NO: 129769 - DNA, 20 bp, Artificial Sequence
  chemically synthesized
aagagaggcatgtgtcacac

SEQ ID NO: 129770 - DNA, 20 bp, Artificial Sequence
  chemically synthesized
tgaaatgagttttgatgaat

SEQ ID NO: 129771 - DNA, 20 bp, Artificial Sequence
  chemically synthesized
atgaaatgagttttgatgaa

SEQ ID NO: 129772 - DNA, 20 bp, Artificial Sequence
  chemically synthesized
tctcatgtgtattatgaaat

SEQ ID NO: 129773 - DNA, 20 bp, Artificial Sequence
  chemically synthesized
actcatttcataatacacat

SEQ ID NO: 129774 - DNA, 20 bp, Artificial Sequence
  chemically synthesized
cacatgagatttacacattc

SEQ ID NO: 129775 - DNA, 20 bp, Artificial Sequence
  chemically synthesized
gtggcaaaatttgtatagac

SEQ ID NO: 129776 - DNA, 20 bp, Artificial Sequence
  chemically synthesized
tgtttgtggcaaaatttgta

SEQ ID NO: 129777 - DNA, 20 bp, Artificial Sequence
  chemically synthesized
ttcttttgtttgtttgtttg

SEQ ID NO: 129778 - DNA, 20 bp, Artificial Sequence
  chemically synthesized
tgccacaaacaaacaaacaa

SEQ ID NO: 129779 - DNA, 20 bp, Artificial Sequence
  chemically synthesized
aagaaatgtgaacaaatatt

SEQ ID NO: 129780 - DNA, 20 bp, Artificial Sequence
  chemically synthesized
tgtgaacaaatattgagctc

SEQ ID NO: 129781 - DNA, 20 bp, Artificial Sequence
  chemically synthesized
aacatgcatgtcattaacca

SEQ ID NO: 129782 - DNA, 20 bp, Artificial Sequence
  chemically synthesized
tcaacatgcatgtcattaac

SEQ ID NO: 129783 - DNA, 20 bp, Artificial Sequence
  chemically synthesized
ggttaatgacatgcatgttg

SEQ ID NO: 129784 - DNA, 20 bp, Artificial Sequence
  chemically synthesized
gacatgcatgttgaagaact

SEQ ID NO: 129785 - DNA, 20 bp, Artificial Sequence
  chemically synthesized
acatgcatgttgaagaactt

SEQ ID NO: 129786 - DNA, 20 bp, Artificial Sequence
  chemically synthesized
catgcatgttgaagaactta

SEQ ID NO: 129787 - DNA, 20 bp, Artificial Sequence
  chemically synthesized
atgcatgttgaagaacttag

SEQ ID NO: 129788 - DNA, 20 bp, Artificial Sequence
  chemically synthesized
tgttgaagaacttaggggta

SEQ ID NO: 129789 - DNA, 20 bp, Artificial Sequence
  chemically synthesized
catcggttccctttacccct

SEQ ID NO: 129790 - DNA, 20 bp, Artificial Sequence
  chemically synthesized
gttgaagaacttaggggtaa

SEQ ID NO: 129791 - DNA, 20 bp, Artificial Sequence
  chemically synthesized
ttgaagaacttaggggtaaa

SEQ ID NO: 129792 - DNA, 20 bp, Artificial Sequence
  chemically synthesized
tcaaagtaagttggtgacat

SEQ ID NO: 129793 - DNA, 20 bp, Artificial Sequence
  chemically synthesized
tgatgcccttcaaagtaagt

SEQ ID NO: 129794 - DNA, 20 bp, Artificial Sequence
  chemically synthesized
gatgtcaccaacttactttg

SEQ ID NO: 129795 - DNA, 20 bp, Artificial Sequence
  chemically synthesized
atgtcaccaacttactttga

SEQ ID NO: 129796 - DNA, 20 bp, Artificial Sequence
  chemically synthesized
tttctgatgcccttcaaagt

SEQ ID NO: 129797 - DNA, 20 bp, Artificial Sequence
  chemically synthesized
tgtcaccaacttactttgaa

SEQ ID NO: 129798 - DNA, 20 bp, Artificial Sequence
  chemically synthesized
ttattttctgatgcccttca

SEQ ID NO: 129799 - DNA, 20 bp, Artificial Sequence
  chemically synthesized
caacttactttgaagggcat

SEQ ID NO: 129800 - DNA, 20 bp, Artificial Sequence
  chemically synthesized
tgaagggcatcagaaaataa

SEQ ID NO: 129801 - DNA, 20 bp, Artificial Sequence
  chemically synthesized
gaagggcatcagaaaataat

SEQ ID NO: 129802 - DNA, 20 bp, Artificial Sequence
  chemically synthesized
aagggcatcagaaaataata

SEQ ID NO: 129803 - DNA, 20 bp, Artificial Sequence
  chemically synthesized
agggcatcagaaaataatag

SEQ ID NO: 129804 - DNA, 20 bp, Artificial Sequence
  chemically synthesized
catcagaaaataataggggt

SEQ ID NO: 129805 - DNA, 20 bp, Artificial Sequence
  chemically synthesized
cagaaaataataggggttgg

SEQ ID NO: 129806 - DNA, 20 bp, Artificial Sequence
  chemically synthesized
agaaaataataggggttggc

SEQ ID NO: 129807 - DNA, 20 bp, Artificial Sequence
  chemically synthesized
aaataataggggttggcggg

SEQ ID NO: 129808 - DNA, 20 bp, Artificial Sequence
  chemically synthesized
ataataggggttggcgggta

SEQ ID NO: 129809 - DNA, 20 bp, Artificial Sequence
  chemically synthesized
taggggttggcgggtagaga

SEQ ID NO: 129810 - DNA, 20 bp, Artificial Sequence
  chemically synthesized
gggttggcgggtagagaaag

SEQ ID NO: 129811 - DNA, 20 bp, Artificial Sequence
  chemically synthesized
ggcgggtagagaaagaagta

SEQ ID NO: 129812 - DNA, 20 bp, Artificial Sequence
  chemically synthesized
taaagtgatacaacaaaatc

SEQ ID NO: 129813 - DNA, 20 bp, Artificial Sequence
  chemically synthesized
aagtgatacaacaaaatcta

SEQ ID NO: 129814 - DNA, 20 bp, Artificial Sequence
  chemically synthesized
gtgatacaacaaaatctaga

SEQ ID NO: 129815 - DNA, 20 bp, Artificial Sequence
  chemically synthesized
atacaacaaaatctagagag

SEQ ID NO: 129816 - DNA, 20 bp, Artificial Sequence
  chemically synthesized
tacaacaaaatctagagagt

SEQ ID NO: 129817 - DNA, 20 bp, Artificial Sequence
  chemically synthesized
gtgctcatgaacccactctc

SEQ ID NO: 129818 - DNA, 20 bp, Artificial Sequence
  chemically synthesized
aatctagagagtgggttcat

SEQ ID NO: 129819 - DNA, 20 bp, Artificial Sequence
  chemically synthesized
agctgaaagaattgtacagt

SEQ ID NO: 129820 - DNA, 20 bp, Artificial Sequence
  chemically synthesized
agaaagctgaaagaattgta

SEQ ID NO: 129821 - DNA, 20 bp, Artificial Sequence
  chemically synthesized
cactcactgtacaattcttt

SEQ ID NO: 129822 - DNA, 20 bp, Artificial Sequence
  chemically synthesized
tcaaatacacagaaagctga

SEQ ID NO: 129823 - DNA, 20 bp, Artificial Sequence
  chemically synthesized
aaatttttcaaatacacaga

SEQ ID NO: 129824 - DNA, 20 bp, Artificial Sequence
  chemically synthesized
tttaaaatttttcaaataca

SEQ ID NO: 129825 - DNA, 20 bp, Artificial Sequence
  chemically synthesized
gtatttgaaaaattttaaaa

SEQ ID NO: 129826 - DNA, 20 bp, Artificial Sequence
  chemically synthesized
aaaattttaaaatagaatgt

SEQ ID NO: 129827 - DNA, 20 bp, Artificial Sequence
  chemically synthesized
tgttagataaaatgttctct

SEQ ID NO: 129828 - DNA, 20 bp, Artificial Sequence
  chemically synthesized
agataaaatgttctctcggc

SEQ ID NO: 129829 - DNA, 20 bp, Artificial Sequence
  chemically synthesized
gataaaatgttctctcggct

SEQ ID NO: 129830 - DNA, 20 bp, Artificial Sequence
  chemically synthesized
gagccaccgtgcccagccga

SEQ ID NO: 129831 - DNA, 20 bp, Artificial Sequence
  chemically synthesized
gtgagccaccgtgcccagcc

SEQ ID NO: 129832 - DNA, 20 bp, Artificial Sequence
  chemically synthesized
aatgttctctcggctgggca

SEQ ID NO: 129833 - DNA, 20 bp, Artificial Sequence
  chemically synthesized
gttctctcggctgggcacgg

SEQ ID NO: 129834 - DNA, 20 bp, Artificial Sequence
  chemically synthesized
caggtgtgagccaccgtgcc

SEQ ID NO: 129835 - DNA, 20 bp, Artificial Sequence
  chemically synthesized
agtgctgggattacaggtgt

SEQ ID NO: 129836 - DNA, 20 bp, Artificial Sequence
  chemically synthesized
gtggctcacacctgtaatcc

SEQ ID NO: 129837 - DNA, 20 bp, Artificial Sequence
  chemically synthesized
tcccaaagtgctgggattac

SEQ ID NO: 129838 - DNA, 20 bp, Artificial Sequence
  chemically synthesized
ctcccaaagtgctgggatta

SEQ ID NO: 129839 - DNA, 20 bp, Artificial Sequence
  chemically synthesized
cacctgtaatcccagcactt

SEQ ID NO: 129840 - DNA, 20 bp, Artificial Sequence
  chemically synthesized
cctcggcctcccaaagtgct

SEQ ID NO: 129841 - DNA, 20 bp, Artificial Sequence
  chemically synthesized
acctgtaatcccagcacttt

SEQ ID NO: 129842 - DNA, 20 bp, Artificial Sequence
  chemically synthesized
acctcggcctcccaaagtgc

SEQ ID NO: 129843 - DNA, 20 bp, Artificial Sequence
  chemically synthesized
ctgtaatcccagcactttgg

SEQ ID NO: 129844 - DNA, 20 bp, Artificial Sequence
  chemically synthesized
tgtaatcccagcactttggg

SEQ ID NO: 129845 - DNA, 20 bp, Artificial Sequence
  chemically synthesized
ccgttcacctcggcctccca

SEQ ID NO: 129846 - DNA, 20 bp, Artificial Sequence
  chemically synthesized
tcccagcactttgggaggcc

SEQ ID NO: 129847 - DNA, 20 bp, Artificial Sequence
  chemically synthesized
cccagcactttgggaggccg

SEQ ID NO: 129848 - DNA, 20 bp, Artificial Sequence
  chemically synthesized
ctttgggaggccgaggtgaa

SEQ ID NO: 129849 - DNA, 20 bp, Artificial Sequence
  chemically synthesized
atctcatgatccgttcacct

SEQ ID NO: 129850 - DNA, 20 bp, Artificial Sequence
  chemically synthesized
ggccgaggtgaacggatcat

SEQ ID NO: 129851 - DNA, 20 bp, Artificial Sequence
  chemically synthesized
aggtgaacggatcatgagat

SEQ ID NO: 129852 - DNA, 20 bp, Artificial Sequence
  chemically synthesized
ggtgaacggatcatgagatc

SEQ ID NO: 129853 - DNA, 20 bp, Artificial Sequence
  chemically synthesized
tgaacggatcatgagatcag

SEQ ID NO: 129854 - DNA, 20 bp, Artificial Sequence
  chemically synthesized
gatcatgagatcaggagctt

SEQ ID NO: 129855 - DNA, 20 bp, Artificial Sequence
  chemically synthesized
atcttggccaggttgatctt

SEQ ID NO: 129856 - DNA, 20 bp, Artificial Sequence
  chemically synthesized
tcaggagcttaagatcaacc

SEQ ID NO: 129857 - DNA, 20 bp, Artificial Sequence
  chemically synthesized
agcttaagatcaacctggcc

SEQ ID NO: 129858 - DNA, 20 bp, Artificial Sequence
  chemically synthesized
agggtttcaccatcttggcc

SEQ ID NO: 129859 - DNA, 20 bp, Artificial Sequence
  chemically synthesized
taagatcaacctggccaaga

SEQ ID NO: 129860 - DNA, 20 bp, Artificial Sequence
  chemically synthesized
cagggtttcaccatcttggc

SEQ ID NO: 129861 - DNA, 20 bp, Artificial Sequence
  chemically synthesized
cagacagggtttcaccatct

SEQ ID NO: 129862 - DNA, 20 bp, Artificial Sequence
  chemically synthesized
ttgtatttttagtacagaca

SEQ ID NO: 129863 - DNA, 20 bp, Artificial Sequence
  chemically synthesized
tttgtatttttagtacagac

SEQ ID NO: 129864 - DNA, 20 bp, Artificial Sequence
  chemically synthesized
ttttgtatttttagtacaga

SEQ ID NO: 129865 - DNA, 20 bp, Artificial Sequence
  chemically synthesized
taatttttgtatttttagta

SEQ ID NO: 129866 - DNA, 20 bp, Artificial Sequence
  chemically synthesized
ctggctaatttttgtatttt

SEQ ID NO: 129867 - DNA, 20 bp, Artificial Sequence
  chemically synthesized
tgtactaaaaatacaaaaat

SEQ ID NO: 129868 - DNA, 20 bp, Artificial Sequence
  chemically synthesized
ctaaaaatacaaaaattagc

SEQ ID NO: 129869 - DNA, 20 bp, Artificial Sequence
  chemically synthesized
taaaaatacaaaaattagcc

SEQ ID NO: 129870 - DNA, 20 bp, Artificial Sequence
  chemically synthesized
atacaaaaattagccaggcg

SEQ ID NO: 129871 - DNA, 20 bp, Artificial Sequence
  chemically synthesized
caaaaattagccaggcgcag

SEQ ID NO: 129872 - DNA, 20 bp, Artificial Sequence
  chemically synthesized
caggtgcctgccactgcgcc

SEQ ID NO: 129873 - DNA, 20 bp, Artificial Sequence
  chemically synthesized
aaattagccaggcgcagtgg

SEQ ID NO: 129874 - DNA, 20 bp, Artificial Sequence
  chemically synthesized
aattagccaggcgcagtggc

SEQ ID NO: 129875 - DNA, 20 bp, Artificial Sequence
  chemically synthesized
gtggcaggcacctgtaatcc

SEQ ID NO: 129876 - DNA, 20 bp, Artificial Sequence
  chemically synthesized
tcccgagtagctgggattac

SEQ ID NO: 129877 - DNA, 20 bp, Artificial Sequence
  chemically synthesized
ctcccgagtagctgggatta

SEQ ID NO: 129878 - DNA, 20 bp, Artificial Sequence
  chemically synthesized
cacctgtaatcccagctact

SEQ ID NO: 129879 - DNA, 20 bp, Artificial Sequence
  chemically synthesized
cctcagcctcccgagtagct

SEQ ID NO: 129880 - DNA, 20 bp, Artificial Sequence
  chemically synthesized
acctgtaatcccagctactc

SEQ ID NO: 129881 - DNA, 20 bp, Artificial Sequence
  chemically synthesized
gcctcagcctcccgagtagc

SEQ ID NO: 129882 - DNA, 20 bp, Artificial Sequence
  chemically synthesized
ctgtaatcccagctactcgg

SEQ ID NO: 129883 - DNA, 20 bp, Artificial Sequence
  chemically synthesized
tgtaatcccagctactcggg

SEQ ID NO: 129884 - DNA, 20 bp, Artificial Sequence
  chemically synthesized
tcctgcctcagcctcccgag

SEQ ID NO: 129885 - DNA, 20 bp, Artificial Sequence
  chemically synthesized
ttctcctgcctcagcctccc

SEQ ID NO: 129886 - DNA, 20 bp, Artificial Sequence
  chemically synthesized
tcccagctactcgggaggct

SEQ ID NO: 129887 - DNA, 20 bp, Artificial Sequence
  chemically synthesized
cccagctactcgggaggctg

SEQ ID NO: 129888 - DNA, 20 bp, Artificial Sequence
  chemically synthesized
agctactcgggaggctgagg

SEQ ID NO: 129889 - DNA, 20 bp, Artificial Sequence
  chemically synthesized
gctactcgggaggctgaggc

SEQ ID NO: 129890 - DNA, 20 bp, Artificial Sequence
  chemically synthesized
tactcgggaggctgaggcag

SEQ ID NO: 129891 - DNA, 20 bp, Artificial Sequence
  chemically synthesized
ttcaagcgattctcctgcct

SEQ ID NO: 129892 - DNA, 20 bp, Artificial Sequence
  chemically synthesized
gcaggagaatcgcttgaacc

SEQ ID NO: 129893 - DNA, 20 bp, Artificial Sequence
  chemically synthesized
caggagaatcgcttgaaccc

SEQ ID NO: 129894 - DNA, 20 bp, Artificial Sequence
  chemically synthesized
aacctctgccgcccgggttc

SEQ ID NO: 129895 - DNA, 20 bp, Artificial Sequence
  chemically synthesized
gagaatcgcttgaacccggg

SEQ ID NO: 129896 - DNA, 20 bp, Artificial Sequence
  chemically synthesized
aatcgcttgaacccgggcgg

SEQ ID NO: 129897 - DNA, 20 bp, Artificial Sequence
  chemically synthesized
cactgcaacctctgccgccc

SEQ ID NO: 129898 - DNA, 20 bp, Artificial Sequence
  chemically synthesized
tcgcttgaacccgggcggca

SEQ ID NO: 129899 - DNA, 20 bp, Artificial Sequence
  chemically synthesized
tcactgcaacctctgccgcc

SEQ ID NO: 129900 - DNA, 20 bp, Artificial Sequence
  chemically synthesized
cgcttgaacccgggcggcag

SEQ ID NO: 129901 - DNA, 20 bp, Artificial Sequence
  chemically synthesized
aacccgggcggcagaggttg

SEQ ID NO: 129902 - DNA, 20 bp, Artificial Sequence
  chemically synthesized
cgggcggcagaggttgcagt

SEQ ID NO: 129903 - DNA, 20 bp, Artificial Sequence
  chemically synthesized
ggcagaggttgcagtgagcc

SEQ ID NO: 129904 - DNA, 20 bp, Artificial Sequence
  chemically synthesized
ggagtgcagtggcgcaatct

SEQ ID NO: 129905 - DNA, 20 bp, Artificial Sequence
  chemically synthesized
ttgcctaggctggagtgcag

SEQ ID NO: 129906 - DNA, 20 bp, Artificial Sequence
  chemically synthesized
gagattgcgccactgcactc

SEQ ID NO: 129907 - DNA, 20 bp, Artificial Sequence
  chemically synthesized
atgttgcctaggctggagtg

SEQ ID NO: 129908 - DNA, 20 bp, Artificial Sequence
  chemically synthesized
tgcgccactgcactccagcc

SEQ ID NO: 129909 - DNA, 20 bp, Artificial Sequence
  chemically synthesized
gcgccactgcactccagcct

SEQ ID NO: 129910 - DNA, 20 bp, Artificial Sequence
  chemically synthesized
tcactatgttgcctaggctg

SEQ ID NO: 129911 - DNA, 20 bp, Artificial Sequence
  chemically synthesized
tctcactatgttgcctaggc

SEQ ID NO: 129912 - DNA, 20 bp, Artificial Sequence
  chemically synthesized
agagtctcactatgttgcct

SEQ ID NO: 129913 - DNA, 20 bp, Artificial Sequence
  chemically synthesized
gcactccagcctaggcaaca

SEQ ID NO: 129914 - DNA, 20 bp, Artificial Sequence
  chemically synthesized
cagagtctcactatgttgcc

SEQ ID NO: 129915 - DNA, 20 bp, Artificial Sequence
  chemically synthesized
tccagcctaggcaacatagt

SEQ ID NO: 129916 - DNA, 20 bp, Artificial Sequence
  chemically synthesized
ttttttttttttttgagaca

SEQ ID NO: 129917 - DNA, 20 bp, Artificial Sequence
  chemically synthesized
atttttttttttttttgaga

SEQ ID NO: 129918 - DNA, 20 bp, Artificial Sequence
  chemically synthesized
gagaattttttttttttttt

SEQ ID NO: 129919 - DNA, 20 bp, Artificial Sequence
  chemically synthesized
aaaaaaaaaaaattctctca

SEQ ID NO: 129920 - DNA, 20 bp, Artificial Sequence
  chemically synthesized
ctgctttgtgttttctgtga

SEQ ID NO: 129921 - DNA, 20 bp, Artificial Sequence
  chemically synthesized
cactgctttgtgttttctgt

SEQ ID NO: 129922 - DNA, 20 bp, Artificial Sequence
  chemically synthesized
attctctcacagaaaacaca

SEQ ID NO: 129923 - DNA, 20 bp, Artificial Sequence
  chemically synthesized
ctctcacagaaaacacaaag

SEQ ID NO: 129924 - DNA, 20 bp, Artificial Sequence
  chemically synthesized
cacaaagcagtgtattattt

SEQ ID NO: 129925 - DNA, 20 bp, Artificial Sequence
  chemically synthesized
aaagcagtgtattatttaag

SEQ ID NO: 129926 - DNA, 20 bp, Artificial Sequence
  chemically synthesized
ggaaagtggtgttagtgatt

SEQ ID NO: 129927 - DNA, 20 bp, Artificial Sequence
  chemically synthesized
tcttcattggaaagtggtgt

SEQ ID NO: 129928 - DNA, 20 bp, Artificial Sequence
  chemically synthesized
tttttttcttcattggaaag

SEQ ID NO: 129929 - DNA, 20 bp, Artificial Sequence
  chemically synthesized
actaacaccactttccaatg

SEQ ID NO: 129930 - DNA, 20 bp, Artificial Sequence
  chemically synthesized
gtatttttttcttcattgga

SEQ ID NO: 129931 - DNA, 20 bp, Artificial Sequence
  chemically synthesized
gatggtatttttttcttcat

SEQ ID NO: 129932 - DNA, 20 bp, Artificial Sequence
  chemically synthesized
gaagaaaaaaataccatctg

SEQ ID NO: 129933 - DNA, 20 bp, Artificial Sequence
  chemically synthesized
aagaaaaaaataccatctgt

SEQ ID NO: 129934 - DNA, 20 bp, Artificial Sequence
  chemically synthesized
aaacttccatatcccacaga

SEQ ID NO: 129935 - DNA, 20 bp, Artificial Sequence
  chemically synthesized
aaaataccatctgtgggata

SEQ ID NO: 129936 - DNA, 20 bp, Artificial Sequence
  chemically synthesized
ctttaaacttccatatccca

SEQ ID NO: 129937 - DNA, 20 bp, Artificial Sequence
  chemically synthesized
ataccatctgtgggatatgg

SEQ ID NO: 129938 - DNA, 20 bp, Artificial Sequence
  chemically synthesized
ctgtgggatatggaagttta

SEQ ID NO: 129939 - DNA, 20 bp, Artificial Sequence
  chemically synthesized
ggaagtttaaagatactaaa

SEQ ID NO: 129940 - DNA, 20 bp, Artificial Sequence
  chemically synthesized
ccactcgtataagttctgtt

SEQ ID NO: 129941 - DNA, 20 bp, Artificial Sequence
  chemically synthesized
atactaaacagaacttatac

SEQ ID NO: 129942 - DNA, 20 bp, Artificial Sequence
  chemically synthesized
ctaaacagaacttatacgag

SEQ ID NO: 129943 - DNA, 20 bp, Artificial Sequence
  chemically synthesized
tttgccatttccactcgtat

SEQ ID NO: 129944 - DNA, 20 bp, Artificial Sequence
  chemically synthesized
agaacttatacgagtggaaa

SEQ ID NO: 129945 - DNA, 20 bp, Artificial Sequence
  chemically synthesized
atggcaaaacgttttgctca

SEQ ID NO: 129946 - DNA, 20 bp, Artificial Sequence
  chemically synthesized
tccatacacattgtgacttt

SEQ ID NO: 129947 - DNA, 20 bp, Artificial Sequence
  chemically synthesized
gctcaaagtcacaatgtgta

SEQ ID NO: 129948 - DNA, 20 bp, Artificial Sequence
  chemically synthesized
tcaaagtcacaatgtgtatg

SEQ ID NO: 129949 - DNA, 20 bp, Artificial Sequence
  chemically synthesized
aaagtcacaatgtgtatgga

SEQ ID NO: 129950 - DNA, 20 bp, Artificial Sequence
  chemically synthesized
aagtcacaatgtgtatggag

SEQ ID NO: 129951 - DNA, 20 bp, Artificial Sequence
  chemically synthesized
gtcacaatgtgtatggagag

SEQ ID NO: 129952 - DNA, 20 bp, Artificial Sequence
  chemically synthesized
caatgtgtatggagaggagt

SEQ ID NO: 129953 - DNA, 20 bp, Artificial Sequence
  chemically synthesized
gtatggagaggagttggaaa

SEQ ID NO: 129954 - DNA, 20 bp, Artificial Sequence
  chemically synthesized
gaggagttggaaatggaatt

SEQ ID NO: 129955 - DNA, 20 bp, Artificial Sequence
  chemically synthesized
aggagttggaaatggaattt

SEQ ID NO: 129956 - DNA, 20 bp, Artificial Sequence
  chemically synthesized
agttggaaatggaatttagg

SEQ ID NO: 129957 - DNA, 20 bp, Artificial Sequence
  chemically synthesized
gttggaaatggaatttaggc

SEQ ID NO: 129958 - DNA, 20 bp, Artificial Sequence
  chemically synthesized
tctgttgattagaaaattaa

SEQ ID NO: 129959 - DNA, 20 bp, Artificial Sequence
  chemically synthesized
agtctgttgattagaaaatt

SEQ ID NO: 129960 - DNA, 20 bp, Artificial Sequence
  chemically synthesized
tctcttaattttctaatcaa

SEQ ID NO: 129961 - DNA, 20 bp, Artificial Sequence
  chemically synthesized
gtctttgacagtctgttgat

SEQ ID NO: 129962 - DNA, 20 bp, Artificial Sequence
  chemically synthesized
ttctaatcaacagactgtca

SEQ ID NO: 129963 - DNA, 20 bp, Artificial Sequence
  chemically synthesized
ggaggtaatctggtctttga

SEQ ID NO: 129964 - DNA, 20 bp, Artificial Sequence
  chemically synthesized
atcaacagactgtcaaagac

SEQ ID NO: 129965 - DNA, 20 bp, Artificial Sequence
  chemically synthesized
atacttttaaggaggtaatc

SEQ ID NO: 129966 - DNA, 20 bp, Artificial Sequence
  chemically synthesized
agaccagattacctccttaa

SEQ ID NO: 129967 - DNA, 20 bp, Artificial Sequence
  chemically synthesized
tattcagcatacttttaagg

SEQ ID NO: 129968 - DNA, 20 bp, Artificial Sequence
  chemically synthesized
atattcagcatacttttaag

SEQ ID NO: 129969 - DNA, 20 bp, Artificial Sequence
  chemically synthesized
gaatattcagcatactttta

SEQ ID NO: 129970 - DNA, 20 bp, Artificial Sequence
  chemically synthesized
agaatattcagcatactttt

SEQ ID NO: 129971 - DNA, 20 bp, Artificial Sequence
  chemically synthesized
attttctctattagaatatt

SEQ ID NO: 129972 - DNA, 20 bp, Artificial Sequence
  chemically synthesized
aagtatgctgaatattctaa

SEQ ID NO: 129973 - DNA, 20 bp, Artificial Sequence
  chemically synthesized
gtatgctgaatattctaata

SEQ ID NO: 129974 - DNA, 20 bp, Artificial Sequence
  chemically synthesized
ggttaactcattttctctat

SEQ ID NO: 129975 - DNA, 20 bp, Artificial Sequence
  chemically synthesized
aatattctaatagagaaaat

SEQ ID NO: 129976 - DNA, 20 bp, Artificial Sequence
  chemically synthesized
gaaaatgagttaaccttcta

SEQ ID NO: 129977 - DNA, 20 bp, Artificial Sequence
  chemically synthesized
gagaatgagctttctttaga

SEQ ID NO: 129978 - DNA, 20 bp, Artificial Sequence
  chemically synthesized
atgagttaaccttctaaaga

SEQ ID NO: 129979 - DNA, 20 bp, Artificial Sequence
  chemically synthesized
ggagaatgagctttctttag

SEQ ID NO: 129980 - DNA, 20 bp, Artificial Sequence
  chemically synthesized
acaggagaatgagctttctt

SEQ ID NO: 129981 - DNA, 20 bp, Artificial Sequence
  chemically synthesized
tattaccaaaacaggagaat

SEQ ID NO: 129982 - DNA, 20 bp, Artificial Sequence
  chemically synthesized
gaaagctcattctcctgttt

SEQ ID NO: 129983 - DNA, 20 bp, Artificial Sequence
  chemically synthesized
atgttttattaccaaaacag

SEQ ID NO: 129984 - DNA, 20 bp, Artificial Sequence
  chemically synthesized
ctatgttttattaccaaaac

SEQ ID NO: 129985 - DNA, 20 bp, Artificial Sequence
  chemically synthesized
cctatgttttattaccaaaa

SEQ ID NO: 129986 - DNA, 20 bp, Artificial Sequence
  chemically synthesized
cctgttttggtaataaaaca

SEQ ID NO: 129987 - DNA, 20 bp, Artificial Sequence
  chemically synthesized
ctgttttggtaataaaacat

SEQ ID NO: 129988 - DNA, 20 bp, Artificial Sequence
  chemically synthesized
tgttttggtaataaaacata

SEQ ID NO: 129989 - DNA, 20 bp, Artificial Sequence
  chemically synthesized
tttggtaataaaacataggg

SEQ ID NO: 129990 - DNA, 20 bp, Artificial Sequence
  chemically synthesized
agtatgtattgcttcccata

SEQ ID NO: 129991 - DNA, 20 bp, Artificial Sequence
  chemically synthesized
agctcatctttccgtatggg

SEQ ID NO: 129992 - DNA, 20 bp, Artificial Sequence
  chemically synthesized
tgtattgcttcccatacgga

SEQ ID NO: 129993 - DNA, 20 bp, Artificial Sequence
  chemically synthesized
cccagctcatctttccgtat

SEQ ID NO: 129994 - DNA, 20 bp, Artificial Sequence
  chemically synthesized
acccagctcatctttccgta

SEQ ID NO: 129995 - DNA, 20 bp, Artificial Sequence
  chemically synthesized
tgcttcccatacggaaagat

SEQ ID NO: 129996 - DNA, 20 bp, Artificial Sequence
  chemically synthesized
tcccatacggaaagatgagc

SEQ ID NO: 129997 - DNA, 20 bp, Artificial Sequence
  chemically synthesized
cccatacggaaagatgagct

SEQ ID NO: 129998 - DNA, 20 bp, Artificial Sequence
  chemically synthesized
tacggaaagatgagctgggt

SEQ ID NO: 129999 - DNA, 20 bp, Artificial Sequence
  chemically synthesized
cggaaagatgagctgggtga

SEQ ID NO: 130000 - DNA, 20 bp, Artificial Sequence
  chemically synthesized
ggaaagatgagctgggtgag

SEQ ID NO: 130001 - DNA, 20 bp, Artificial Sequence
  chemically synthesized
aacccaatcctcctctcacc

SEQ ID NO: 130002 - DNA, 20 bp, Artificial Sequence
  chemically synthesized
aaagatgagctgggtgagag

SEQ ID NO: 130003 - DNA, 20 bp, Artificial Sequence
  chemically synthesized
aagatgagctgggtgagagg

SEQ ID NO: 130004 - DNA, 20 bp, Artificial Sequence
  chemically synthesized
gagctgggtgagaggaggat

SEQ ID NO: 130005 - DNA, 20 bp, Artificial Sequence
  chemically synthesized
agctgggtgagaggaggatt

SEQ ID NO: 130006 - DNA, 20 bp, Artificial Sequence
  chemically synthesized
gaggattgggtttttaccac

SEQ ID NO: 130007 - DNA, 20 bp, Artificial Sequence
  chemically synthesized
attgggtttttaccactggt

SEQ ID NO: 130008 - DNA, 20 bp, Artificial Sequence
  chemically synthesized
tgggtttttaccactggttg

SEQ ID NO: 130009 - DNA, 20 bp, Artificial Sequence
  chemically synthesized
atctattatcctccaaccag

SEQ ID NO: 130010 - DNA, 20 bp, Artificial Sequence
  chemically synthesized
gggtttttaccactggttgg

SEQ ID NO: 130011 - DNA, 20 bp, Artificial Sequence
  chemically synthesized
ataatctattatcctccaac

SEQ ID NO: 130012 - DNA, 20 bp, Artificial Sequence
  chemically synthesized
taccactggttggaggataa

SEQ ID NO: 130013 - DNA, 20 bp, Artificial Sequence
  chemically synthesized
tatgaaaaaatatcaacatc

SEQ ID NO: 130014 - DNA, 20 bp, Artificial Sequence
  chemically synthesized
cttacatgtttcattatgac

SEQ ID NO: 130015 - DNA, 20 bp, Artificial Sequence
  chemically synthesized
ccagtcataatgaaacatgt

SEQ ID NO: 130016 - DNA, 20 bp, Artificial Sequence
  chemically synthesized
aagttgttttattaattaaa

SEQ ID NO: 130017 - DNA, 20 bp, Artificial Sequence
  chemically synthesized
agttgttttattaattaaat

SEQ ID NO: 130018 - DNA, 20 bp, Artificial Sequence
  chemically synthesized
gatcaaataatatcacattt

SEQ ID NO: 130019 - DNA, 20 bp, Artificial Sequence
  chemically synthesized
aaacataatgacttctcttt

SEQ ID NO: 130020 - DNA, 20 bp, Artificial Sequence
  chemically synthesized
aacataatgacttctctttt

SEQ ID NO: 130021 - DNA, 20 bp, Artificial Sequence
  chemically synthesized
ttccaacacccccaaaagag

SEQ ID NO: 130022 - DNA, 20 bp, Artificial Sequence
  chemically synthesized
acataatgacttctcttttg

SEQ ID NO: 130023 - DNA, 20 bp, Artificial Sequence
  chemically synthesized
cataatgacttctcttttgg

SEQ ID NO: 130024 - DNA, 20 bp, Artificial Sequence
  chemically synthesized
agtttccaacacccccaaaa

SEQ ID NO: 130025 - DNA, 20 bp, Artificial Sequence
  chemically synthesized
atagtttccaacacccccaa

SEQ ID NO: 130026 - DNA, 20 bp, Artificial Sequence
  chemically synthesized
gacttctcttttgggggtgt

SEQ ID NO: 130027 - DNA, 20 bp, Artificial Sequence
  chemically synthesized
ggtgttggaaactattgctt

SEQ ID NO: 130028 - DNA, 20 bp, Artificial Sequence
  chemically synthesized
caggctttcatcttaagcaa

SEQ ID NO: 130029 - DNA, 20 bp, Artificial Sequence
  chemically synthesized
gaaactattgcttaagatga

SEQ ID NO: 130030 - DNA, 20 bp, Artificial Sequence
  chemically synthesized
taacttcaggctttcatctt

SEQ ID NO: 130031 - DNA, 20 bp, Artificial Sequence
  chemically synthesized
ttgcttaagatgaaagcctg

SEQ ID NO: 130032 - DNA, 20 bp, Artificial Sequence
  chemically synthesized
ttaagatgaaagcctgaagt

SEQ ID NO: 130033 - DNA, 20 bp, Artificial Sequence
  chemically synthesized
taagatgaaagcctgaagtt

SEQ ID NO: 130034 - DNA, 20 bp, Artificial Sequence
  chemically synthesized
caagcttttctcctaacttc

SEQ ID NO: 130035 - DNA, 20 bp, Artificial Sequence
  chemically synthesized
agatgaaagcctgaagttag

SEQ ID NO: 130036 - DNA, 20 bp, Artificial Sequence
  chemically synthesized
tcaagcttttctcctaactt

SEQ ID NO: 130037 - DNA, 20 bp, Artificial Sequence
  chemically synthesized
aaagcctgaagttaggagaa

SEQ ID NO: 130038 - DNA, 20 bp, Artificial Sequence
  chemically synthesized
tttttgcatagatatacatc

SEQ ID NO: 130039 - DNA, 20 bp, Artificial Sequence
  chemically synthesized
taaactgaaatatttttgca

SEQ ID NO: 130040 - DNA, 20 bp, Artificial Sequence
  chemically synthesized
atatctatgcaaaaatattt

SEQ ID NO: 130041 - DNA, 20 bp, Artificial Sequence
  chemically synthesized
aatatttcagtttatcatct

SEQ ID NO: 130042 - DNA, 20 bp, Artificial Sequence
  chemically synthesized
atatttcagtttatcatctt

SEQ ID NO: 130043 - DNA, 20 bp, Artificial Sequence
  chemically synthesized
ctgtgacttgtaagtgacct

SEQ ID NO: 130044 - DNA, 20 bp, Artificial Sequence
  chemically synthesized
tatcatcttaggtcacttac

SEQ ID NO: 130045 - DNA, 20 bp, Artificial Sequence
  chemically synthesized
gtttcttttctgtgacttgt

SEQ ID NO: 130046 - DNA, 20 bp, Artificial Sequence
  chemically synthesized
cttaggtcacttacaagtca

SEQ ID NO: 130047 - DNA, 20 bp, Artificial Sequence
  chemically synthesized
gtcacttacaagtcacagaa

SEQ ID NO: 130048 - DNA, 20 bp, Artificial Sequence
  chemically synthesized
gtcacagaaaagaaactatc

SEQ ID NO: 130049 - DNA, 20 bp, Artificial Sequence
  chemically synthesized
ggcctattatcacatctaga

SEQ ID NO: 130050 - DNA, 20 bp, Artificial Sequence
  chemically synthesized
gttaggcctattatcacatc

SEQ ID NO: 130051 - DNA, 20 bp, Artificial Sequence
  chemically synthesized
aaactatctagatgtgataa

SEQ ID NO: 130052 - DNA, 20 bp, Artificial Sequence
  chemically synthesized
aactatctagatgtgataat

SEQ ID NO: 130053 - DNA, 20 bp, Artificial Sequence
  chemically synthesized
ggatcatctaatgatatgtt

SEQ ID NO: 130054 - DNA, 20 bp, Artificial Sequence
  chemically synthesized
tggatcatctaatgatatgt

SEQ ID NO: 130055 - DNA, 20 bp, Artificial Sequence
  chemically synthesized
taataggcctaacatatcat

SEQ ID NO: 130056 - DNA, 20 bp, Artificial Sequence
  chemically synthesized
catatcattagatgatccat

SEQ ID NO: 130057 - DNA, 20 bp, Artificial Sequence
  chemically synthesized
cattagatgatccatcggtc

SEQ ID NO: 130058 - DNA, 20 bp, Artificial Sequence
  chemically synthesized
tgactgagatgctggaccga

SEQ ID NO: 130059 - DNA, 20 bp, Artificial Sequence
  chemically synthesized
gatccatcggtccagcatct

SEQ ID NO: 130060 - DNA, 20 bp, Artificial Sequence
  chemically synthesized
ttagttaatgactgagatgc

SEQ ID NO: 130061 - DNA, 20 bp, Artificial Sequence
  chemically synthesized
cacttaattagttaatgact

SEQ ID NO: 130062 - DNA, 20 bp, Artificial Sequence
  chemically synthesized
atctcagtcattaactaatt

SEQ ID NO: 130063 - DNA, 20 bp, Artificial Sequence
  chemically synthesized
tgctacatttggcacttaat

SEQ ID NO: 130064 - DNA, 20 bp, Artificial Sequence
  chemically synthesized
aactaattaagtgccaaatg

SEQ ID NO: 130065 - DNA, 20 bp, Artificial Sequence
  chemically synthesized
agtactttatttgctacatt

SEQ ID NO: 130066 - DNA, 20 bp, Artificial Sequence
  chemically synthesized
agtgccaaatgtagcaaata

SEQ ID NO: 130067 - DNA, 20 bp, Artificial Sequence
  chemically synthesized
gctgaacacttttgagttgt

SEQ ID NO: 130068 - DNA, 20 bp, Artificial Sequence
  chemically synthesized
ataaagtactaacaactcaa

SEQ ID NO: 130069 - DNA, 20 bp, Artificial Sequence
  chemically synthesized
aactcttgctgaacactttt

SEQ ID NO: 130070 - DNA, 20 bp, Artificial Sequence
  chemically synthesized
actaacaactcaaaagtgtt

SEQ ID NO: 130071 - DNA, 20 bp, Artificial Sequence
  chemically synthesized
acaactcaaaagtgttcagc

SEQ ID NO: 130072 - DNA, 20 bp, Artificial Sequence
  chemically synthesized
aactcaaaagtgttcagcaa

SEQ ID NO: 130073 - DNA, 20 bp, Artificial Sequence
  chemically synthesized
tgttcagcaagagttcatta

SEQ ID NO: 130074 - DNA, 20 bp, Artificial Sequence
  chemically synthesized
agcaagagttcattaaagcg

SEQ ID NO: 130075 - DNA, 20 bp, Artificial Sequence
  chemically synthesized
agttcattaaagcgaagcta

SEQ ID NO: 130076 - DNA, 20 bp, Artificial Sequence
  chemically synthesized
gttcattaaagcgaagctaa

SEQ ID NO: 130077 - DNA, 20 bp, Artificial Sequence
  chemically synthesized
ttcattaaagcgaagctaaa

SEQ ID NO: 130078 - DNA, 20 bp, Artificial Sequence
  chemically synthesized
tcattaaagcgaagctaaag

SEQ ID NO: 130079 - DNA, 20 bp, Artificial Sequence
  chemically synthesized
agaattataatggtcccctt

SEQ ID NO: 130080 - DNA, 20 bp, Artificial Sequence
  chemically synthesized
ctgtggtgctagaattataa

SEQ ID NO: 130081 - DNA, 20 bp, Artificial Sequence
  chemically synthesized
aaaggggaccattataattc

SEQ ID NO: 130082 - DNA, 20 bp, Artificial Sequence
  chemically synthesized
ccattataattctagcacca

SEQ ID NO: 130083 - DNA, 20 bp, Artificial Sequence
  chemically synthesized
tggtaataaatctgtggtgc

SEQ ID NO: 130084 - DNA, 20 bp, Artificial Sequence
  chemically synthesized
gtgacatggtaataaatctg

SEQ ID NO: 130085 - DNA, 20 bp, Artificial Sequence
  chemically synthesized
cagatttattaccatgtcac

SEQ ID NO: 130086 - DNA, 20 bp, Artificial Sequence
  chemically synthesized
tgcattgcatgctggtgaca

SEQ ID NO: 130087 - DNA, 20 bp, Artificial Sequence
  chemically synthesized
ttattgtgtgcattgcatgc

SEQ ID NO: 130088 - DNA, 20 bp, Artificial Sequence
  chemically synthesized
gcaaatttacagtgatgaat

SEQ ID NO: 130089 - DNA, 20 bp, Artificial Sequence
  chemically synthesized
aaatttgatgtgcaaattta

SEQ ID NO: 130090 - DNA, 20 bp, Artificial Sequence
  chemically synthesized
atcaaatttgatgcatttgt

SEQ ID NO: 130091 - DNA, 20 bp, Artificial Sequence
  chemically synthesized
taaatatttttaaaatcatg

SEQ ID NO: 130092 - DNA, 20 bp, Artificial Sequence
  chemically synthesized
ttaaaatcatgtagaataaa

SEQ ID NO: 130093 - DNA, 20 bp, Artificial Sequence
  chemically synthesized
aaaagcatttttttctccct

SEQ ID NO: 130094 - DNA, 20 bp, Artificial Sequence
  chemically synthesized
aaattcagtgtgtgctaagg

SEQ ID NO: 130095 - DNA, 20 bp, Artificial Sequence
  chemically synthesized
tgaaattcagtgtgtgctaa

SEQ ID NO: 130096 - DNA, 20 bp, Artificial Sequence
  chemically synthesized
atgaaattcagtgtgtgcta

SEQ ID NO: 130097 - DNA, 20 bp, Artificial Sequence
  chemically synthesized
tatgaaattcagtgtgtgct

SEQ ID NO: 130098 - DNA, 20 bp, Artificial Sequence
  chemically synthesized
caaggtgtagatatgaaatt

SEQ ID NO: 130099 - DNA, 20 bp, Artificial Sequence
  chemically synthesized
aaagttgaagtggcaaggtg

SEQ ID NO: 130100 - DNA, 20 bp, Artificial Sequence
  chemically synthesized
aagtaaaagttgaagtggca

SEQ ID NO: 130101 - DNA, 20 bp, Artificial Sequence
  chemically synthesized
caagtaaaagttgaagtggc

SEQ ID NO: 130102 - DNA, 20 bp, Artificial Sequence
  chemically synthesized
tcatcaagtaaaagttgaag

SEQ ID NO: 130103 - DNA, 20 bp, Artificial Sequence
  chemically synthesized
cactcatcaagtaaaagttg

SEQ ID NO: 130104 - DNA, 20 bp, Artificial Sequence
  chemically synthesized
tttctgcactcatcaagtaa

SEQ ID NO: 130105 - DNA, 20 bp, Artificial Sequence
  chemically synthesized
cacttcaacttttacttgat

SEQ ID NO: 130106 - DNA, 20 bp, Artificial Sequence
  chemically synthesized
ttccgttttctgcactcatc

SEQ ID NO: 130107 - DNA, 20 bp, Artificial Sequence
  chemically synthesized
caacttttacttgatgagtg

SEQ ID NO: 130108 - DNA, 20 bp, Artificial Sequence
  chemically synthesized
tacttgatgagtgcagaaaa

SEQ ID NO: 130109 - DNA, 20 bp, Artificial Sequence
  chemically synthesized
tgaggccactttgtttttcg

SEQ ID NO: 130110 - DNA, 20 bp, Artificial Sequence
  chemically synthesized
gtgaggccactttgtttttc

SEQ ID NO: 130111 - DNA, 20 bp, Artificial Sequence
  chemically synthesized
gaaattaaccccgaaaaaca

SEQ ID NO: 130112 - DNA, 20 bp, Artificial Sequence
  chemically synthesized
agtgaggccactttgttttt

SEQ ID NO: 130113 - DNA, 20 bp, Artificial Sequence
  chemically synthesized
attaaccccgaaaaacaaag

SEQ ID NO: 130114 - DNA, 20 bp, Artificial Sequence
  chemically synthesized
tgcttgtaaaaataagagtg

SEQ ID NO: 130115 - DNA, 20 bp, Artificial Sequence
  chemically synthesized
atgcttgtaaaaataagagt

SEQ ID NO: 130116 - DNA, 20 bp, Artificial Sequence
  chemically synthesized
gagtatgcttgtaaaaataa

SEQ ID NO: 130117 - DNA, 20 bp, Artificial Sequence
  chemically synthesized
tggagtatgcttgtaaaaat

SEQ ID NO: 130118 - DNA, 20 bp, Artificial Sequence
  chemically synthesized
ggcctcactcttatttttac

SEQ ID NO: 130119 - DNA, 20 bp, Artificial Sequence
  chemically synthesized
acttgaatagttggatggtg

SEQ ID NO: 130120 - DNA, 20 bp, Artificial Sequence
  chemically synthesized
taacttgaatagttggatgg

SEQ ID NO: 130121 - DNA, 20 bp, Artificial Sequence
  chemically synthesized
tcttaacttgaatagttgga

SEQ ID NO: 130122 - DNA, 20 bp, Artificial Sequence
  chemically synthesized
actccaccatccaactattc

SEQ ID NO: 130123 - DNA, 20 bp, Artificial Sequence
  chemically synthesized
tatttcttaacttgaatagt

SEQ ID NO: 130124 - DNA, 20 bp, Artificial Sequence
  chemically synthesized
tttttatttcttaacttgaa

SEQ ID NO: 130125 - DNA, 20 bp, Artificial Sequence
  chemically synthesized
accatccaactattcaagtt

SEQ ID NO: 130126 - DNA, 20 bp, Artificial Sequence
  chemically synthesized
agttaagaaataaaaataaa

SEQ ID NO: 130127 - DNA, 20 bp, Artificial Sequence
  chemically synthesized
atggaaaacaatttcttgaa

SEQ ID NO: 130128 - DNA, 20 bp, Artificial Sequence
  chemically synthesized
tttagccatagtttctgttc

SEQ ID NO: 130129 - DNA, 20 bp, Artificial Sequence
  chemically synthesized
aatttcttgaacagaaacta

SEQ ID NO: 130130 - DNA, 20 bp, Artificial Sequence
  chemically synthesized
ggaattgtgctttttagcca

SEQ ID NO: 130131 - DNA, 20 bp, Artificial Sequence
  chemically synthesized
gaacagaaactatggctaaa

SEQ ID NO: 130132 - DNA, 20 bp, Artificial Sequence
  chemically synthesized
atgtatggaattgtgctttt

SEQ ID NO: 130133 - DNA, 20 bp, Artificial Sequence
  chemically synthesized
ttctgtcagtaagcaatgta

SEQ ID NO: 130134 - DNA, 20 bp, Artificial Sequence
  chemically synthesized
ttccatacattgcttactga

SEQ ID NO: 130135 - DNA, 20 bp, Artificial Sequence
  chemically synthesized
tacagaaaagttctgtcagt

SEQ ID NO: 130136 - DNA, 20 bp, Artificial Sequence
  chemically synthesized
gaaatacagaaaagttctgt

SEQ ID NO: 130137 - DNA, 20 bp, Artificial Sequence
  chemically synthesized
ggaagaattgaaatacagaa

SEQ ID NO: 130138 - DNA, 20 bp, Artificial Sequence
  chemically synthesized
ggtaaggaagaattgaaata

SEQ ID NO: 130139 - DNA, 20 bp, Artificial Sequence
  chemically synthesized
ctgaagagaaggaggtaagg

SEQ ID NO: 130140 - DNA, 20 bp, Artificial Sequence
  chemically synthesized
aatctgaagagaaggaggta

SEQ ID NO: 130141 - DNA, 20 bp, Artificial Sequence
  chemically synthesized
aaatctgaagagaaggaggt

SEQ ID NO: 130142 - DNA, 20 bp, Artificial Sequence
  chemically synthesized
acctaaatctgaagagaagg

SEQ ID NO: 130143 - DNA, 20 bp, Artificial Sequence
  chemically synthesized
cacctaaatctgaagagaag

SEQ ID NO: 130144 - DNA, 20 bp, Artificial Sequence
  chemically synthesized
cttccttacctccttctctt

SEQ ID NO: 130145 - DNA, 20 bp, Artificial Sequence
  chemically synthesized
gacacctaaatctgaagaga

SEQ ID NO: 130146 - DNA, 20 bp, Artificial Sequence
  chemically synthesized
ggacacctaaatctgaagag

SEQ ID NO: 130147 - DNA, 20 bp, Artificial Sequence
  chemically synthesized
gagggacacctaaatctgaa

SEQ ID NO: 130148 - DNA, 20 bp, Artificial Sequence
  chemically synthesized
tacctccttctcttcagatt

SEQ ID NO: 130149 - DNA, 20 bp, Artificial Sequence
  chemically synthesized
acctccttctcttcagattt

SEQ ID NO: 130150 - DNA, 20 bp, Artificial Sequence
  chemically synthesized
aggagggacacctaaatctg

SEQ ID NO: 130151 - DNA, 20 bp, Artificial Sequence
  chemically synthesized
ggaattaggcatgggtagga

SEQ ID NO: 130152 - DNA, 20 bp, Artificial Sequence
  chemically synthesized
gggaattaggcatgggtagg

SEQ ID NO: 130153 - DNA, 20 bp, Artificial Sequence
  chemically synthesized
agggaattaggcatgggtag

SEQ ID NO: 130154 - DNA, 20 bp, Artificial Sequence
  chemically synthesized
cgagggaattaggcatgggt

SEQ ID NO: 130155 - DNA, 20 bp, Artificial Sequence
  chemically synthesized
gcgagggaattaggcatggg

SEQ ID NO: 130156 - DNA, 20 bp, Artificial Sequence
  chemically synthesized
acagcgagggaattaggcat

SEQ ID NO: 130157 - DNA, 20 bp, Artificial Sequence
  chemically synthesized
tacagcgagggaattaggca

SEQ ID NO: 130158 - DNA, 20 bp, Artificial Sequence
  chemically synthesized
ttgagtacagcgagggaatt

SEQ ID NO: 130159 - DNA, 20 bp, Artificial Sequence
  chemically synthesized
attgagtacagcgagggaat

SEQ ID NO: 130160 - DNA, 20 bp, Artificial Sequence
  chemically synthesized
tggaacattgagtacagcga

SEQ ID NO: 130161 - DNA, 20 bp, Artificial Sequence
  chemically synthesized
ctggaacattgagtacagcg

SEQ ID NO: 130162 - DNA, 20 bp, Artificial Sequence
  chemically synthesized
actggaacattgagtacagc

SEQ ID NO: 130163 - DNA, 20 bp, Artificial Sequence
  chemically synthesized
agagactggaacattgagta

SEQ ID NO: 130164 - DNA, 20 bp, Artificial Sequence
  chemically synthesized
cctcgctgtactcaatgttc

SEQ ID NO: 130165 - DNA, 20 bp, Artificial Sequence
  chemically synthesized
atggaagagactggaacatt

SEQ ID NO: 130166 - DNA, 20 bp, Artificial Sequence
  chemically synthesized
tcatagaagatggaagagac

SEQ ID NO: 130167 - DNA, 20 bp, Artificial Sequence
  chemically synthesized
acttctcatagaagatggaa

SEQ ID NO: 130168 - DNA, 20 bp, Artificial Sequence
  chemically synthesized
tcacttctcatagaagatgg

SEQ ID NO: 130169 - DNA, 20 bp, Artificial Sequence
  chemically synthesized
gaatcacttctcatagaaga

SEQ ID NO: 130170 - DNA, 20 bp, Artificial Sequence
  chemically synthesized
cagtctcttccatcttctat

SEQ ID NO: 130171 - DNA, 20 bp, Artificial Sequence
  chemically synthesized
tctcttccatcttctatgag

SEQ ID NO: 130172 - DNA, 20 bp, Artificial Sequence
  chemically synthesized
gatggaatcacttctcatag

SEQ ID NO: 130173 - DNA, 20 bp, Artificial Sequence
  chemically synthesized
aaagatggaatcacttctca

SEQ ID NO: 130174 - DNA, 20 bp, Artificial Sequence
  chemically synthesized
gacataggaggggtaaaaga

SEQ ID NO: 130175 - DNA, 20 bp, Artificial Sequence
  chemically synthesized
tgaagacataggaggggtaa

SEQ ID NO: 130176 - DNA, 20 bp, Artificial Sequence
  chemically synthesized
ggagattgaagacataggag

SEQ ID NO: 130177 - DNA, 20 bp, Artificial Sequence
  chemically synthesized
cggagattgaagacatagga

SEQ ID NO: 130178 - DNA, 20 bp, Artificial Sequence
  chemically synthesized
acggagattgaagacatagg

SEQ ID NO: 130179 - DNA, 20 bp, Artificial Sequence
  chemically synthesized
gacggagattgaagacatag

SEQ ID NO: 130180 - DNA, 20 bp, Artificial Sequence
  chemically synthesized
tagacggagattgaagacat

SEQ ID NO: 130181 - DNA, 20 bp, Artificial Sequence
  chemically synthesized
gtagacggagattgaagaca

SEQ ID NO: 130182 - DNA, 20 bp, Artificial Sequence
  chemically synthesized
atggttgtagacggagattg

SEQ ID NO: 130183 - DNA, 20 bp, Artificial Sequence
  chemically synthesized
aataaacatggttgtagacg

SEQ ID NO: 130184 - DNA, 20 bp, Artificial Sequence
  chemically synthesized
aaaataaacatggttgtaga

SEQ ID NO: 130185 - DNA, 20 bp, Artificial Sequence
  chemically synthesized
tcttaaaataaacatggttg

SEQ ID NO: 130186 - DNA, 20 bp, Artificial Sequence
  chemically synthesized
ttttcttcttaaaataaaca

SEQ ID NO: 130187 - DNA, 20 bp, Artificial Sequence
  chemically synthesized
tctacaaccatgtttatttt

SEQ ID NO: 130188 - DNA, 20 bp, Artificial Sequence
  chemically synthesized
acaaccatgtttattttaag

SEQ ID NO: 130189 - DNA, 20 bp, Artificial Sequence
  chemically synthesized
gtcttttgtttggttggttt

SEQ ID NO: 130190 - DNA, 20 bp, Artificial Sequence
  chemically synthesized
tcttttgtcttttgtttggt

SEQ ID NO: 130191 - DNA, 20 bp, Artificial Sequence
  chemically synthesized
aaccaaaaccaaccaaacaa

SEQ ID NO: 130192 - DNA, 20 bp, Artificial Sequence
  chemically synthesized
atactcttttgtcttttgtt

SEQ ID NO: 130193 - DNA, 20 bp, Artificial Sequence
  chemically synthesized
accaaccaaacaaaagacaa

SEQ ID NO: 130194 - DNA, 20 bp, Artificial Sequence
  chemically synthesized
caaccaaacaaaagacaaaa

SEQ ID NO: 130195 - DNA, 20 bp, Artificial Sequence
  chemically synthesized
caaaagagtattatttcctt

SEQ ID NO: 130196 - DNA, 20 bp, Artificial Sequence
  chemically synthesized
caggtggggtgtaggaccaa

SEQ ID NO: 130197 - DNA, 20 bp, Artificial Sequence
  chemically synthesized
gcaggtggggtgtaggacca

SEQ ID NO: 130198 - DNA, 20 bp, Artificial Sequence
  chemically synthesized
aggggacgcaggtggggtgt

SEQ ID NO: 130199 - DNA, 20 bp, Artificial Sequence
  chemically synthesized
caggggacgcaggtggggtg

SEQ ID NO: 130200 - DNA, 20 bp, Artificial Sequence
  chemically synthesized
tccatcaggggacgcaggtg

SEQ ID NO: 130201 - DNA, 20 bp, Artificial Sequence
  chemically synthesized
ttccatcaggggacgcaggt

SEQ ID NO: 130202 - DNA, 20 bp, Artificial Sequence
  chemically synthesized
tttccatcaggggacgcagg

SEQ ID NO: 130203 - DNA, 20 bp, Artificial Sequence
  chemically synthesized
gggtttccatcaggggacgc

SEQ ID NO: 130204 - DNA, 20 bp, Artificial Sequence
  chemically synthesized
agggtttccatcaggggacg

SEQ ID NO: 130205 - DNA, 20 bp, Artificial Sequence
  chemically synthesized
accccacctgcgtcccctga

SEQ ID NO: 130206 - DNA, 20 bp, Artificial Sequence
  chemically synthesized
agacatagggtttccatcag

SEQ ID NO: 130207 - DNA, 20 bp, Artificial Sequence
  chemically synthesized
aagacatagggtttccatca

SEQ ID NO: 130208 - DNA, 20 bp, Artificial Sequence
  chemically synthesized
gaagacatagggtttccatc

SEQ ID NO: 130209 - DNA, 20 bp, Artificial Sequence
  chemically synthesized
ggaagacatagggtttccat

SEQ ID NO: 130210 - DNA, 20 bp, Artificial Sequence
  chemically synthesized
ccacaaaggaggaagacata

SEQ ID NO: 130211 - DNA, 20 bp, Artificial Sequence
  chemically synthesized
cccacaaaggaggaagacat

SEQ ID NO: 130212 - DNA, 20 bp, Artificial Sequence
  chemically synthesized
tcccacaaaggaggaagaca

SEQ ID NO: 130213 - DNA, 20 bp, Artificial Sequence
  chemically synthesized
ccactctcccacaaaggagg

SEQ ID NO: 130214 - DNA, 20 bp, Artificial Sequence
  chemically synthesized
ccctatgtcttcctcctttg

SEQ ID NO: 130215 - DNA, 20 bp, Artificial Sequence
  chemically synthesized
cctatgtcttcctcctttgt

SEQ ID NO: 130216 - DNA, 20 bp, Artificial Sequence
  chemically synthesized
aagccactctcccacaaagg

SEQ ID NO: 130217 - DNA, 20 bp, Artificial Sequence
  chemically synthesized
taagccactctcccacaaag

SEQ ID NO: 130218 - DNA, 20 bp, Artificial Sequence
  chemically synthesized
tatgtcttcctcctttgtgg

SEQ ID NO: 130219 - DNA, 20 bp, Artificial Sequence
  chemically synthesized
tgtaagccactctcccacaa

SEQ ID NO: 130220 - DNA, 20 bp, Artificial Sequence
  chemically synthesized
tgtcttcctcctttgtggga

SEQ ID NO: 130221 - DNA, 20 bp, Artificial Sequence
  chemically synthesized
gtgtaagccactctcccaca

SEQ ID NO: 130222 - DNA, 20 bp, Artificial Sequence
  chemically synthesized
cttcctcctttgtgggagag

SEQ ID NO: 130223 - DNA, 20 bp, Artificial Sequence
  chemically synthesized
tgtgggagagtggcttacac

SEQ ID NO: 130224 - DNA, 20 bp, Artificial Sequence
  chemically synthesized
cctttaagtagcactggtgt

SEQ ID NO: 130225 - DNA, 20 bp, Artificial Sequence
  chemically synthesized
aaccatcctttaagtagcac

SEQ ID NO: 130226 - DNA, 20 bp, Artificial Sequence
  chemically synthesized
gcttacaccagtgctactta

SEQ ID NO: 130227 - DNA, 20 bp, Artificial Sequence
  chemically synthesized
cttacaccagtgctacttaa

SEQ ID NO: 130228 - DNA, 20 bp, Artificial Sequence
  chemically synthesized
tacacaaaccatcctttaag

SEQ ID NO: 130229 - DNA, 20 bp, Artificial Sequence
  chemically synthesized
caccagtgctacttaaagga

SEQ ID NO: 130230 - DNA, 20 bp, Artificial Sequence
  chemically synthesized
tcatacacaaaccatccttt

SEQ ID NO: 130231 - DNA, 20 bp, Artificial Sequence
  chemically synthesized
ttaaaggatggtttgtgtat

SEQ ID NO: 130232 - DNA, 20 bp, Artificial Sequence
  chemically synthesized
aaggatggtttgtgtatgag

SEQ ID NO: 130233 - DNA, 20 bp, Artificial Sequence
  chemically synthesized
ggtttgtgtatgagcagcat

SEQ ID NO: 130234 - DNA, 20 bp, Artificial Sequence
  chemically synthesized
tgcatttctaacaagttatc

SEQ ID NO: 130235 - DNA, 20 bp, Artificial Sequence
  chemically synthesized
ctgcatttctaacaagttat

SEQ ID NO: 130236 - DNA, 20 bp, Artificial Sequence
  chemically synthesized
agcatcacctgataacttgt

SEQ ID NO: 130237 - DNA, 20 bp, Artificial Sequence
  chemically synthesized
tgagattctgcatttctaac

SEQ ID NO: 130238 - DNA, 20 bp, Artificial Sequence
  chemically synthesized
ctgataacttgttagaaatg

SEQ ID NO: 130239 - DNA, 20 bp, Artificial Sequence
  chemically synthesized
ttgttagaaatgcagaatct

SEQ ID NO: 130240 - DNA, 20 bp, Artificial Sequence
  chemically synthesized
tgttagaaatgcagaatctc

SEQ ID NO: 130241 - DNA, 20 bp, Artificial Sequence
  chemically synthesized
ttagctctagagtggagcct

SEQ ID NO: 130242 - DNA, 20 bp, Artificial Sequence
  chemically synthesized
cagaatctcaggctccactc

SEQ ID NO: 130243 - DNA, 20 bp, Artificial Sequence
  chemically synthesized
gaatctcaggctccactcta

SEQ ID NO: 130244 - DNA, 20 bp, Artificial Sequence
  chemically synthesized
gattcattagctctagagtg

SEQ ID NO: 130245 - DNA, 20 bp, Artificial Sequence
  chemically synthesized
ttgattcattagctctagag

SEQ ID NO: 130246 - DNA, 20 bp, Artificial Sequence
  chemically synthesized
attttgattcattagctcta

SEQ ID NO: 130247 - DNA, 20 bp, Artificial Sequence
  chemically synthesized
agattttgattcattagctc

SEQ ID NO: 130248 - DNA, 20 bp, Artificial Sequence
  chemically synthesized
aaatgcagattttgattcat

SEQ ID NO: 130249 - DNA, 20 bp, Artificial Sequence
  chemically synthesized
aaaaatcttattttaaaatg

SEQ ID NO: 130250 - DNA, 20 bp, Artificial Sequence
  chemically synthesized
caaaatctgcattttaaaat

SEQ ID NO: 130251 - DNA, 20 bp, Artificial Sequence
  chemically synthesized
cattttaaaataagattttt

SEQ ID NO: 130252 - DNA, 20 bp, Artificial Sequence
  chemically synthesized
attttaaaataagatttttc

SEQ ID NO: 130253 - DNA, 20 bp, Artificial Sequence
  chemically synthesized
ttttcaggtgattacatttt

SEQ ID NO: 130254 - DNA, 20 bp, Artificial Sequence
  chemically synthesized
tcaggtgattacattttgag

SEQ ID NO: 130255 - DNA, 20 bp, Artificial Sequence
  chemically synthesized
gattacattttgagaagcaa

SEQ ID NO: 130256 - DNA, 20 bp, Artificial Sequence
  chemically synthesized
ggatgtggaaatagtgggta

SEQ ID NO: 130257 - DNA, 20 bp, Artificial Sequence
  chemically synthesized
ggtgtggatgtggaaatagt

SEQ ID NO: 130258 - DNA, 20 bp, Artificial Sequence
  chemically synthesized
aggtgtggatgtggaaatag

SEQ ID NO: 130259 - DNA, 20 bp, Artificial Sequence
  chemically synthesized
gtgaggtgtggatgtggaaa

SEQ ID NO: 130260 - DNA, 20 bp, Artificial Sequence
  chemically synthesized
gggtatgtgaggtgtggatg

SEQ ID NO: 130261 - DNA, 20 bp, Artificial Sequence
  chemically synthesized
ttagaagggtatgtgaggtg

SEQ ID NO: 130262 - DNA, 20 bp, Artificial Sequence
  chemically synthesized
atggtttagaagggtatgtg

SEQ ID NO: 130263 - DNA, 20 bp, Artificial Sequence
  chemically synthesized
aatggtttagaagggtatgt

SEQ ID NO: 130264 - DNA, 20 bp, Artificial Sequence
  chemically synthesized
caaaacgtaatggtttagaa

SEQ ID NO: 130265 - DNA, 20 bp, Artificial Sequence
  chemically synthesized
ccaaaacgtaatggtttaga

SEQ ID NO: 130266 - DNA, 20 bp, Artificial Sequence
  chemically synthesized
gccaaaacgtaatggtttag

SEQ ID NO: 130267 - DNA, 20 bp, Artificial Sequence
  chemically synthesized
aaagccaaaacgtaatggtt

SEQ ID NO: 130268 - DNA, 20 bp, Artificial Sequence
  chemically synthesized
tggcaaaagccaaaacgtaa

SEQ ID NO: 130269 - DNA, 20 bp, Artificial Sequence
  chemically synthesized
ccttctaaaccattacgttt

SEQ ID NO: 130270 - DNA, 20 bp, Artificial Sequence
  chemically synthesized
aaaagtaatttcagtggcaa

SEQ ID NO: 130271 - DNA, 20 bp, Artificial Sequence
  chemically synthesized
acctacaaaagtaatttcag

SEQ ID NO: 130272 - DNA, 20 bp, Artificial Sequence
  chemically synthesized
atcacctacaaaagtaattt

SEQ ID NO: 130273 - DNA, 20 bp, Artificial Sequence
  chemically synthesized
tgccactgaaattacttttg

SEQ ID NO: 130274 - DNA, 20 bp, Artificial Sequence
  chemically synthesized
gccactgaaattacttttgt

SEQ ID NO: 130275 - DNA, 20 bp, Artificial Sequence
  chemically synthesized
gtcactgctatcacctacaa

SEQ ID NO: 130276 - DNA, 20 bp, Artificial Sequence
  chemically synthesized
gaaattacttttgtaggtga

SEQ ID NO: 130277 - DNA, 20 bp, Artificial Sequence
  chemically synthesized
attacttttgtaggtgatag

SEQ ID NO: 130278 - DNA, 20 bp, Artificial Sequence
  chemically synthesized
aggtgatagcagtgacctta

SEQ ID NO: 130279 - DNA, 20 bp, Artificial Sequence
  chemically synthesized
ctaatactgtagcaacttta

SEQ ID NO: 130280 - DNA, 20 bp, Artificial Sequence
  chemically synthesized
tctaatactgtagcaacttt

SEQ ID NO: 130281 - DNA, 20 bp, Artificial Sequence
  chemically synthesized
cagtgaccttaaagttgcta

SEQ ID NO: 130282 - DNA, 20 bp, Artificial Sequence
  chemically synthesized
ccttaaagttgctacagtat

SEQ ID NO: 130283 - DNA, 20 bp, Artificial Sequence
  chemically synthesized
ctttagactctctaatactg

SEQ ID NO: 130284 - DNA, 20 bp, Artificial Sequence
  chemically synthesized
ttaaagttgctacagtatta

SEQ ID NO: 130285 - DNA, 20 bp, Artificial Sequence
  chemically synthesized
aaagttgctacagtattaga

SEQ ID NO: 130286 - DNA, 20 bp, Artificial Sequence
  chemically synthesized
ctacagtattagagagtcta

SEQ ID NO: 130287 - DNA, 20 bp, Artificial Sequence
  chemically synthesized
atctgaaaacataaagactt

SEQ ID NO: 130288 - DNA, 20 bp, Artificial Sequence
  chemically synthesized
aagggatatctgaaaacata

SEQ ID NO: 130289 - DNA, 20 bp, Artificial Sequence
  chemically synthesized
gtctaaagtctttatgtttt

SEQ ID NO: 130290 - DNA, 20 bp, Artificial Sequence
  chemically synthesized
tatgttttcagatatccctt

SEQ ID NO: 130291 - DNA, 20 bp, Artificial Sequence
  chemically synthesized
gtcaattggcaggtactgaa

SEQ ID NO: 130292 - DNA, 20 bp, Artificial Sequence
  chemically synthesized
cgtcaattggcaggtactga

SEQ ID NO: 130293 - DNA, 20 bp, Artificial Sequence
  chemically synthesized
tcgtcaattggcaggtactg

SEQ ID NO: 130294 - DNA, 20 bp, Artificial Sequence
  chemically synthesized
aagagggttcgtcaattggc

SEQ ID NO: 130295 - DNA, 20 bp, Artificial Sequence
  chemically synthesized
aaagagggttcgtcaattgg

SEQ ID NO: 130296 - DNA, 20 bp, Artificial Sequence
  chemically synthesized
ttcaaagagggttcgtcaat

SEQ ID NO: 130297 - DNA, 20 bp, Artificial Sequence
  chemically synthesized
aaaagagaaggtttcaaaga

SEQ ID NO: 130298 - DNA, 20 bp, Artificial Sequence
  chemically synthesized
caaaagagaaggtttcaaag

SEQ ID NO: 130299 - DNA, 20 bp, Artificial Sequence
  chemically synthesized
tcaaaagagaaggtttcaaa

SEQ ID NO: 130300 - DNA, 20 bp, Artificial Sequence
  chemically synthesized
aatcaaaagagaaggtttca

SEQ ID NO: 130301 - DNA, 20 bp, Artificial Sequence
  chemically synthesized
tccatattaatcaaaagaga

SEQ ID NO: 130302 - DNA, 20 bp, Artificial Sequence
  chemically synthesized
ttccatattaatcaaaagag

SEQ ID NO: 130303 - DNA, 20 bp, Artificial Sequence
  chemically synthesized
atcttccatattaatcaaaa

SEQ ID NO: 130304 - DNA, 20 bp, Artificial Sequence
  chemically synthesized
gaatcttccatattaatcaa

SEQ ID NO: 130305 - DNA, 20 bp, Artificial Sequence
  chemically synthesized
accttctcttttgattaata

SEQ ID NO: 130306 - DNA, 20 bp, Artificial Sequence
  chemically synthesized
ttctcttttgattaatatgg

SEQ ID NO: 130307 - DNA, 20 bp, Artificial Sequence
  chemically synthesized
taatatggaagattccttct

SEQ ID NO: 130308 - DNA, 20 bp, Artificial Sequence
  chemically synthesized
aggcagaataaaatccaaga

SEQ ID NO: 130309 - DNA, 20 bp, Artificial Sequence
  chemically synthesized
taggcagaataaaatccaag

SEQ ID NO: 130310 - DNA, 20 bp, Artificial Sequence
  chemically synthesized
aaataggcagaataaaatcc

SEQ ID NO: 130311 - DNA, 20 bp, Artificial Sequence
  chemically synthesized
tggattttattctgcctatt

SEQ ID NO: 130312 - DNA, 20 bp, Artificial Sequence
  chemically synthesized
gtgaggagtggccaaatagg

SEQ ID NO: 130313 - DNA, 20 bp, Artificial Sequence
  chemically synthesized
agagtgaggagtggccaaat

SEQ ID NO: 130314 - DNA, 20 bp, Artificial Sequence
  chemically synthesized
gagagtgaggagtggccaaa

SEQ ID NO: 130315 - DNA, 20 bp, Artificial Sequence
  chemically synthesized
gggcctaagagagtgaggag

SEQ ID NO: 130316 - DNA, 20 bp, Artificial Sequence
  chemically synthesized
aatgggcctaagagagtgag

SEQ ID NO: 130317 - DNA, 20 bp, Artificial Sequence
  chemically synthesized
ggaatgggcctaagagagtg

SEQ ID NO: 130318 - DNA, 20 bp, Artificial Sequence
  chemically synthesized
ttggccactcctcactctct

SEQ ID NO: 130319 - DNA, 20 bp, Artificial Sequence
  chemically synthesized
aggaatgggcctaagagagt

SEQ ID NO: 130320 - DNA, 20 bp, Artificial Sequence
  chemically synthesized
tggccactcctcactctctt

SEQ ID NO: 130321 - DNA, 20 bp, Artificial Sequence
  chemically synthesized
tttaaggaatgggcctaaga

SEQ ID NO: 130322 - DNA, 20 bp, Artificial Sequence
  chemically synthesized
catttaaggaatgggcctaa

SEQ ID NO: 130323 - DNA, 20 bp, Artificial Sequence
  chemically synthesized
aacatttaaggaatgggcct

SEQ ID NO: 130324 - DNA, 20 bp, Artificial Sequence
  chemically synthesized
aatagcaacatttaaggaat

SEQ ID NO: 130325 - DNA, 20 bp, Artificial Sequence
  chemically synthesized
gaatagcaacatttaaggaa

SEQ ID NO: 130326 - DNA, 20 bp, Artificial Sequence
  chemically synthesized
ctagggaatagcaacattta

SEQ ID NO: 130327 - DNA, 20 bp, Artificial Sequence
  chemically synthesized
cctagggaatagcaacattt

SEQ ID NO: 130328 - DNA, 20 bp, Artificial Sequence
  chemically synthesized
ccttaaatgttgctattccc

SEQ ID NO: 130329 - DNA, 20 bp, Artificial Sequence
  chemically synthesized
cttaaatgttgctattccct

SEQ ID NO: 130330 - DNA, 20 bp, Artificial Sequence
  chemically synthesized
ttaaatgttgctattcccta

SEQ ID NO: 130331 - DNA, 20 bp, Artificial Sequence
  chemically synthesized
aaagggagacccctagggaa

SEQ ID NO: 130332 - DNA, 20 bp, Artificial Sequence
  chemically synthesized
taaatgttgctattccctag

SEQ ID NO: 130333 - DNA, 20 bp, Artificial Sequence
  chemically synthesized
agatcaaagggagaccccta

SEQ ID NO: 130334 - DNA, 20 bp, Artificial Sequence
  chemically synthesized
aagatcaaagggagacccct

SEQ ID NO: 130335 - DNA, 20 bp, Artificial Sequence
  chemically synthesized
aaagatcaaagggagacccc

SEQ ID NO: 130336 - DNA, 20 bp, Artificial Sequence
  chemically synthesized
gaaaacaaaaagatcaaagg

SEQ ID NO: 130337 - DNA, 20 bp, Artificial Sequence
  chemically synthesized
gtgaaaacaaaaagatcaaa

SEQ ID NO: 130338 - DNA, 20 bp, Artificial Sequence
  chemically synthesized
agtgaaaacaaaaagatcaa

SEQ ID NO: 130339 - DNA, 20 bp, Artificial Sequence
  chemically synthesized
aagtgaaaacaaaaagatca

SEQ ID NO: 130340 - DNA, 20 bp, Artificial Sequence
  chemically synthesized
atatgtaaagtgaaaacaaa

SEQ ID NO: 130341 - DNA, 20 bp, Artificial Sequence
  chemically synthesized
ctcaccagagagaatatgta

SEQ ID NO: 130342 - DNA, 20 bp, Artificial Sequence
  chemically synthesized
ttcactttacatattctctc

SEQ ID NO: 130343 - DNA, 20 bp, Artificial Sequence
  chemically synthesized
ctttacatattctctctggt

SEQ ID NO: 130344 - DNA, 20 bp, Artificial Sequence
  chemically synthesized
acatacatgaactcaccaga

SEQ ID NO: 130345 - DNA, 20 bp, Artificial Sequence
  chemically synthesized
atacatacatgaactcacca

SEQ ID NO: 130346 - DNA, 20 bp, Artificial Sequence
  chemically synthesized
atatacatacatgaactcac

SEQ ID NO: 130347 - DNA, 20 bp, Artificial Sequence
  chemically synthesized
tattttagagatagtaaatg

SEQ ID NO: 130348 - DNA, 20 bp, Artificial Sequence
  chemically synthesized
tactctgattattttagaga

SEQ ID NO: 130349 - DNA, 20 bp, Artificial Sequence
  chemically synthesized
attttactctgattatttta

SEQ ID NO: 130350 - DNA, 20 bp, Artificial Sequence
  chemically synthesized
tttactatctctaaaataat

SEQ ID NO: 130351 - DNA, 20 bp, Artificial Sequence
  chemically synthesized
agattttactctgattattt

SEQ ID NO: 130352 - DNA, 20 bp, Artificial Sequence
  chemically synthesized
tactatctctaaaataatca

SEQ ID NO: 130353 - DNA, 20 bp, Artificial Sequence
  chemically synthesized
cagagtaaaatctgtgtttt

SEQ ID NO: 130354 - DNA, 20 bp, Artificial Sequence
  chemically synthesized
acaattcttagcttaaaaca

SEQ ID NO: 130355 - DNA, 20 bp, Artificial Sequence
  chemically synthesized
taaaatctgtgttttaagct

SEQ ID NO: 130356 - DNA, 20 bp, Artificial Sequence
  chemically synthesized
agagttcaagagacaattct

SEQ ID NO: 130357 - DNA, 20 bp, Artificial Sequence
  chemically synthesized
tctatggatacagagttcaa

SEQ ID NO: 130358 - DNA, 20 bp, Artificial Sequence
  chemically synthesized
gctctatggatacagagttc

SEQ ID NO: 130359 - DNA, 20 bp, Artificial Sequence
  chemically synthesized
cgtttggctctatggataca

SEQ ID NO: 130360 - DNA, 20 bp, Artificial Sequence
  chemically synthesized
tctcttgaactctgtatcca

SEQ ID NO: 130361 - DNA, 20 bp, Artificial Sequence
  chemically synthesized
ggcgtttggctctatggata

SEQ ID NO: 130362 - DNA, 20 bp, Artificial Sequence
  chemically synthesized
tcttgaactctgtatccata

SEQ ID NO: 130363 - DNA, 20 bp, Artificial Sequence
  chemically synthesized
ttagtaggcgtttggctcta

SEQ ID NO: 130364 - DNA, 20 bp, Artificial Sequence
  chemically synthesized
atagagatttagtaggcgtt

SEQ ID NO: 130365 - DNA, 20 bp, Artificial Sequence
  chemically synthesized
ctatttcatagagatttagt

SEQ ID NO: 130366 - DNA, 20 bp, Artificial Sequence
  chemically synthesized
gctatttcatagagatttag

SEQ ID NO: 130367 - DNA, 20 bp, Artificial Sequence
  chemically synthesized
ttggctatttcatagagatt

SEQ ID NO: 130368 - DNA, 20 bp, Artificial Sequence
  chemically synthesized
cctactaaatctctatgaaa

SEQ ID NO: 130369 - DNA, 20 bp, Artificial Sequence
  chemically synthesized
gatatgttggctatttcata

SEQ ID NO: 130370 - DNA, 20 bp, Artificial Sequence
  chemically synthesized
tggatatgttggctatttca

SEQ ID NO: 130371 - DNA, 20 bp, Artificial Sequence
  chemically synthesized
gtaatccagtttggatatgt

SEQ ID NO: 130372 - DNA, 20 bp, Artificial Sequence
  chemically synthesized
aatagccaacatatccaaac

SEQ ID NO: 130373 - DNA, 20 bp, Artificial Sequence
  chemically synthesized
gaagatgatgtaatccagtt

SEQ ID NO: 130374 - DNA, 20 bp, Artificial Sequence
  chemically synthesized
agaatgaagatgatgtaatc

SEQ ID NO: 130375 - DNA, 20 bp, Artificial Sequence
  chemically synthesized
attaggggagaggaagaatg

SEQ ID NO: 130376 - DNA, 20 bp, Artificial Sequence
  chemically synthesized
atcagtgattaggggagagg

SEQ ID NO: 130377 - DNA, 20 bp, Artificial Sequence
  chemically synthesized
tgtatcagtgattaggggag

SEQ ID NO: 130378 - DNA, 20 bp, Artificial Sequence
  chemically synthesized
gtgtatcagtgattagggga

SEQ ID NO: 130379 - DNA, 20 bp, Artificial Sequence
  chemically synthesized
atgtgtatcagtgattaggg

SEQ ID NO: 130380 - DNA, 20 bp, Artificial Sequence
  chemically synthesized
agatgtgtatcagtgattag

SEQ ID NO: 130381 - DNA, 20 bp, Artificial Sequence
  chemically synthesized
cagatgtgtatcagtgatta

SEQ ID NO: 130382 - DNA, 20 bp, Artificial Sequence
  chemically synthesized
acagatgtgtatcagtgatt

SEQ ID NO: 130383 - DNA, 20 bp, Artificial Sequence
  chemically synthesized
aacagatgtgtatcagtgat

SEQ ID NO: 130384 - DNA, 20 bp, Artificial Sequence
  chemically synthesized
gtagaggaacagatgtgtat

SEQ ID NO: 130385 - DNA, 20 bp, Artificial Sequence
  chemically synthesized
tcagtgactaagtagaggaa

SEQ ID NO: 130386 - DNA, 20 bp, Artificial Sequence
  chemically synthesized
tacacatctgttcctctact

SEQ ID NO: 130387 - DNA, 20 bp, Artificial Sequence
  chemically synthesized
ctccttcagtgactaagtag

SEQ ID NO: 130388 - DNA, 20 bp, Artificial Sequence
  chemically synthesized
tctccttcagtgactaagta

SEQ ID NO: 130389 - DNA, 20 bp, Artificial Sequence
  chemically synthesized
tttctccttcagtgactaag

SEQ ID NO: 130390 - DNA, 20 bp, Artificial Sequence
  chemically synthesized
atgtttctccttcagtgact

SEQ ID NO: 130391 - DNA, 20 bp, Artificial Sequence
  chemically synthesized
gttcctctacttagtcactg

SEQ ID NO: 130392 - DNA, 20 bp, Artificial Sequence
  chemically synthesized
ttcctctacttagtcactga

SEQ ID NO: 130393 - DNA, 20 bp, Artificial Sequence
  chemically synthesized
cctctacttagtcactgaag

SEQ ID NO: 130394 - DNA, 20 bp, Artificial Sequence
  chemically synthesized
taatttgcatgtttctcctt

SEQ ID NO: 130395 - DNA, 20 bp, Artificial Sequence
  chemically synthesized
taaggaagaaagaagaatga

SEQ ID NO: 130396 - DNA, 20 bp, Artificial Sequence
  chemically synthesized
ataaggaagaaagaagaatg

SEQ ID NO: 130397 - DNA, 20 bp, Artificial Sequence
  chemically synthesized
ttaaagtataaggaagaaag

SEQ ID NO: 130398 - DNA, 20 bp, Artificial Sequence
  chemically synthesized
tggttaaagtataaggaaga

SEQ ID NO: 130399 - DNA, 20 bp, Artificial Sequence
  chemically synthesized
ttcttggttaaagtataagg

SEQ ID NO: 130400 - DNA, 20 bp, Artificial Sequence
  chemically synthesized
atcttcttggttaaagtata

SEQ ID NO: 130401 - DNA, 20 bp, Artificial Sequence
  chemically synthesized
catcttcttggttaaagtat

SEQ ID NO: 130402 - DNA, 20 bp, Artificial Sequence
  chemically synthesized
ttcttccttatactttaacc

SEQ ID NO: 130403 - DNA, 20 bp, Artificial Sequence
  chemically synthesized
actcggcatcttcttggtta

SEQ ID NO: 130404 - DNA, 20 bp, Artificial Sequence
  chemically synthesized
ttccttatactttaaccaag

SEQ ID NO: 130405 - DNA, 20 bp, Artificial Sequence
  chemically synthesized
gaagtgactcggcatcttct

SEQ ID NO: 130406 - DNA, 20 bp, Artificial Sequence
  chemically synthesized
actttaaccaagaagatgcc

SEQ ID NO: 130407 - DNA, 20 bp, Artificial Sequence
  chemically synthesized
gctattaaggagaagtgact

SEQ ID NO: 130408 - DNA, 20 bp, Artificial Sequence
  chemically synthesized
ccagaagagctattaaggag

SEQ ID NO: 130409 - DNA, 20 bp, Artificial Sequence
  chemically synthesized
gccgagtcacttctccttaa

SEQ ID NO: 130410 - DNA, 20 bp, Artificial Sequence
  chemically synthesized
aggccagaagagctattaag

SEQ ID NO: 130411 - DNA, 20 bp, Artificial Sequence
  chemically synthesized
agaggccagaagagctatta

SEQ ID NO: 130412 - DNA, 20 bp, Artificial Sequence
  chemically synthesized
tagaggccagaagagctatt

SEQ ID NO: 130413 - DNA, 20 bp, Artificial Sequence
  chemically synthesized
cttctccttaatagctcttc

SEQ ID NO: 130414 - DNA, 20 bp, Artificial Sequence
  chemically synthesized
gaatgatatagaggccagaa

SEQ ID NO: 130415 - DNA, 20 bp, Artificial Sequence
  chemically synthesized
atgaatgatatagaggccag

SEQ ID NO: 130416 - DNA, 20 bp, Artificial Sequence
  chemically synthesized
gagatgaatgatatagaggc

SEQ ID NO: 130417 - DNA, 20 bp, Artificial Sequence
  chemically synthesized
gagagagatgaatgatatag

SEQ ID NO: 130418 - DNA, 20 bp, Artificial Sequence
  chemically synthesized
agagagagatgaatgatata

SEQ ID NO: 130419 - DNA, 20 bp, Artificial Sequence
  chemically synthesized
gaagagagagatgaatgata

SEQ ID NO: 130420 - DNA, 20 bp, Artificial Sequence
  chemically synthesized
aaagcaatctagggaagaga

SEQ ID NO: 130421 - DNA, 20 bp, Artificial Sequence
  chemically synthesized
tcattcatctctctcttccc

SEQ ID NO: 130422 - DNA, 20 bp, Artificial Sequence
  chemically synthesized
ctaaagcaatctagggaaga

SEQ ID NO: 130423 - DNA, 20 bp, Artificial Sequence
  chemically synthesized
aactaaagcaatctagggaa

SEQ ID NO: 130424 - DNA, 20 bp, Artificial Sequence
  chemically synthesized
ttaactaaagcaatctaggg

SEQ ID NO: 130425 - DNA, 20 bp, Artificial Sequence
  chemically synthesized
cttttaactaaagcaatcta

SEQ ID NO: 130426 - DNA, 20 bp, Artificial Sequence
  chemically synthesized
gcttttaactaaagcaatct

SEQ ID NO: 130427 - DNA, 20 bp, Artificial Sequence
  chemically synthesized
ggcttttaactaaagcaatc

SEQ ID NO: 130428 - DNA, 20 bp, Artificial Sequence
  chemically synthesized
ctctcttccctagattgctt

SEQ ID NO: 130429 - DNA, 20 bp, Artificial Sequence
  chemically synthesized
ccctagattgctttagttaa

SEQ ID NO: 130430 - DNA, 20 bp, Artificial Sequence
  chemically synthesized
catcaggaggcttttaacta

SEQ ID NO: 130431 - DNA, 20 bp, Artificial Sequence
  chemically synthesized
tttagttaaaagcctcctga

SEQ ID NO: 130432 - DNA, 20 bp, Artificial Sequence
  chemically synthesized
gaactagagagaccatcagg

SEQ ID NO: 130433 - DNA, 20 bp, Artificial Sequence
  chemically synthesized
tgaactagagagaccatcag

SEQ ID NO: 130434 - DNA, 20 bp, Artificial Sequence
  chemically synthesized
gctgaactagagagaccatc

SEQ ID NO: 130435 - DNA, 20 bp, Artificial Sequence
  chemically synthesized
cgctgaactagagagaccat

SEQ ID NO: 130436 - DNA, 20 bp, Artificial Sequence
  chemically synthesized
aagcctcctgatggtctctc

SEQ ID NO: 130437 - DNA, 20 bp, Artificial Sequence
  chemically synthesized
tcctgatggtctctctagtt

SEQ ID NO: 130438 - DNA, 20 bp, Artificial Sequence
  chemically synthesized
ttgtgttccgctgaactaga

SEQ ID NO: 130439 - DNA, 20 bp, Artificial Sequence
  chemically synthesized
ggttgtgttccgctgaacta

SEQ ID NO: 130440 - DNA, 20 bp, Artificial Sequence
  chemically synthesized
tgatggtctctctagttcag

SEQ ID NO: 130441 - DNA, 20 bp, Artificial Sequence
  chemically synthesized
aaggttgtgttccgctgaac

SEQ ID NO: 130442 - DNA, 20 bp, Artificial Sequence
  chemically synthesized
ttgattcaaatgcacagaca

SEQ ID NO: 130443 - DNA, 20 bp, Artificial Sequence
  chemically synthesized
cttgattcaaatgcacagac

SEQ ID NO: 130444 - DNA, 20 bp, Artificial Sequence
  chemically synthesized
gccctcttgattcaaatgca

SEQ ID NO: 130445 - DNA, 20 bp, Artificial Sequence
  chemically synthesized
cttgtctgtgcatttgaatc

SEQ ID NO: 130446 - DNA, 20 bp, Artificial Sequence
  chemically synthesized
tgtctgtgcatttgaatcaa

SEQ ID NO: 130447 - DNA, 20 bp, Artificial Sequence
  chemically synthesized
gtctgtgcatttgaatcaag

SEQ ID NO: 130448 - DNA, 20 bp, Artificial Sequence
  chemically synthesized
tctgtgcatttgaatcaaga

SEQ ID NO: 130449 - DNA, 20 bp, Artificial Sequence
  chemically synthesized
gacattcgtagtttttaaag

SEQ ID NO: 130450 - DNA, 20 bp, Artificial Sequence
  chemically synthesized
ccagacattcgtagttttta

SEQ ID NO: 130451 - DNA, 20 bp, Artificial Sequence
  chemically synthesized
taatagggcccagacattcg

SEQ ID NO: 130452 - DNA, 20 bp, Artificial Sequence
  chemically synthesized
ctttaaaaactacgaatgtc

SEQ ID NO: 130453 - DNA, 20 bp, Artificial Sequence
  chemically synthesized
tttaaaaactacgaatgtct

SEQ ID NO: 130454 - DNA, 20 bp, Artificial Sequence
  chemically synthesized
atcagagccttaatagggcc

SEQ ID NO: 130455 - DNA, 20 bp, Artificial Sequence
  chemically synthesized
acgaatgtctgggccctatt

SEQ ID NO: 130456 - DNA, 20 bp, Artificial Sequence
  chemically synthesized
cgaatgtctgggccctatta

SEQ ID NO: 130457 - DNA, 20 bp, Artificial Sequence
  chemically synthesized
gttaaatcagagccttaata

SEQ ID NO: 130458 - DNA, 20 bp, Artificial Sequence
  chemically synthesized
agttaaatcagagccttaat

SEQ ID NO: 130459 - DNA, 20 bp, Artificial Sequence
  chemically synthesized
cagttaaatcagagccttaa

SEQ ID NO: 130460 - DNA, 20 bp, Artificial Sequence
  chemically synthesized
accccaaaccagttaaatca

SEQ ID NO: 130461 - DNA, 20 bp, Artificial Sequence
  chemically synthesized
tattaaggctctgatttaac

SEQ ID NO: 130462 - DNA, 20 bp, Artificial Sequence
  chemically synthesized
ccaccccaaaccagttaaat

SEQ ID NO: 130463 - DNA, 20 bp, Artificial Sequence
  chemically synthesized
aggctctgatttaactggtt

SEQ ID NO: 130464 - DNA, 20 bp, Artificial Sequence
  chemically synthesized
ggctctgatttaactggttt

SEQ ID NO: 130465 - DNA, 20 bp, Artificial Sequence
  chemically synthesized
gctctgatttaactggtttg

SEQ ID NO: 130466 - DNA, 20 bp, Artificial Sequence
  chemically synthesized
acttggactccaccccaaac

SEQ ID NO: 130467 - DNA, 20 bp, Artificial Sequence
  chemically synthesized
ctgatttaactggtttgggg

SEQ ID NO: 130468 - DNA, 20 bp, Artificial Sequence
  chemically synthesized
gatttaactggtttggggtg

SEQ ID NO: 130469 - DNA, 20 bp, Artificial Sequence
  chemically synthesized
actggtttggggtggagtcc

SEQ ID NO: 130470 - DNA, 20 bp, Artificial Sequence
  chemically synthesized
ttggggtggagtccaagtat

SEQ ID NO: 130471 - DNA, 20 bp, Artificial Sequence
  chemically synthesized
ttaaaaaaaatgccaatact

SEQ ID NO: 130472 - DNA, 20 bp, Artificial Sequence
  chemically synthesized
cattttttttaaactccccc

SEQ ID NO: 130473 - DNA, 20 bp, Artificial Sequence
  chemically synthesized
cacgttagaatcactagggg

SEQ ID NO: 130474 - DNA, 20 bp, Artificial Sequence
  chemically synthesized
tgcacgttagaatcactagg

SEQ ID NO: 130475 - DNA, 20 bp, Artificial Sequence
  chemically synthesized
ctgcacgttagaatcactag

SEQ ID NO: 130476 - DNA, 20 bp, Artificial Sequence
  chemically synthesized
gctgcacgttagaatcacta

SEQ ID NO: 130477 - DNA, 20 bp, Artificial Sequence
  chemically synthesized
ggctgcacgttagaatcact

SEQ ID NO: 130478 - DNA, 20 bp, Artificial Sequence
  chemically synthesized
tggctgcacgttagaatcac

SEQ ID NO: 130479 - DNA, 20 bp, Artificial Sequence
  chemically synthesized
cccctagtgattctaacgtg

SEQ ID NO: 130480 - DNA, 20 bp, Artificial Sequence
  chemically synthesized
tctcatccctggctgcacgt

SEQ ID NO: 130481 - DNA, 20 bp, Artificial Sequence
  chemically synthesized
tagtgattctaacgtgcagc

SEQ ID NO: 130482 - DNA, 20 bp, Artificial Sequence
  chemically synthesized
agtgattctaacgtgcagcc

SEQ ID NO: 130483 - DNA, 20 bp, Artificial Sequence
  chemically synthesized
gtgattctaacgtgcagcca

SEQ ID NO: 130484 - DNA, 20 bp, Artificial Sequence
  chemically synthesized
tctaacgtgcagccagggat

SEQ ID NO: 130485 - DNA, 20 bp, Artificial Sequence
  chemically synthesized
aaatcagtggttctcatccc

SEQ ID NO: 130486 - DNA, 20 bp, Artificial Sequence
  chemically synthesized
aaaggctaacattaaatcag

SEQ ID NO: 130487 - DNA, 20 bp, Artificial Sequence
  chemically synthesized
gcaaaaggctaacattaaat

SEQ ID NO: 130488 - DNA, 20 bp, Artificial Sequence
  chemically synthesized
gagaaccactgatttaatgt

SEQ ID NO: 130489 - DNA, 20 bp, Artificial Sequence
  chemically synthesized
agaaggatggggagtgcaaa

SEQ ID NO: 130490 - DNA, 20 bp, Artificial Sequence
  chemically synthesized
aagaaggatggggagtgcaa

SEQ ID NO: 130491 - DNA, 20 bp, Artificial Sequence
  chemically synthesized
gagttttaaagaaggatggg

SEQ ID NO: 130492 - DNA, 20 bp, Artificial Sequence
  chemically synthesized
tagagttttaaagaaggatg

SEQ ID NO: 130493 - DNA, 20 bp, Artificial Sequence
  chemically synthesized
ctagagttttaaagaaggat

SEQ ID NO: 130494 - DNA, 20 bp, Artificial Sequence
  chemically synthesized
actagagttttaaagaagga

SEQ ID NO: 130495 - DNA, 20 bp, Artificial Sequence
  chemically synthesized
tctgactagagttttaaaga

SEQ ID NO: 130496 - DNA, 20 bp, Artificial Sequence
  chemically synthesized
ctctgactagagttttaaag

SEQ ID NO: 130497 - DNA, 20 bp, Artificial Sequence
  chemically synthesized
cttctctgactagagtttta

SEQ ID NO: 130498 - DNA, 20 bp, Artificial Sequence
  chemically synthesized
cccatccttctttaaaactc

SEQ ID NO: 130499 - DNA, 20 bp, Artificial Sequence
  chemically synthesized
tccttctttaaaactctagt

SEQ ID NO: 130500 - DNA, 20 bp, Artificial Sequence
  chemically synthesized
cttctttaaaactctagtca

SEQ ID NO: 130501 - DNA, 20 bp, Artificial Sequence
  chemically synthesized
aaaaaagacttctctgacta

SEQ ID NO: 130502 - DNA, 20 bp, Artificial Sequence
  chemically synthesized
ctttaaaactctagtcagag

SEQ ID NO: 130503 - DNA, 20 bp, Artificial Sequence
  chemically synthesized
aaaaaaaagacttctctgac

SEQ ID NO: 130504 - DNA, 20 bp, Artificial Sequence
  chemically synthesized
tattaaaaaaaaaaaaaaaa

SEQ ID NO: 130505 - DNA, 20 bp, Artificial Sequence
  chemically synthesized
ttttttttttttttttttaa

SEQ ID NO: 130506 - DNA, 20 bp, Artificial Sequence
  chemically synthesized
tttttttttttttttttaat

SEQ ID NO: 130507 - DNA, 20 bp, Artificial Sequence
  chemically synthesized
ttttttttttttttttaata

SEQ ID NO: 130508 - DNA, 20 bp, Artificial Sequence
  chemically synthesized
ttttttttttttttaatagg

SEQ ID NO: 130509 - DNA, 20 bp, Artificial Sequence
  chemically synthesized
ttcagcctggatgacagagg

SEQ ID NO: 130510 - DNA, 20 bp, Artificial Sequence
  chemically synthesized
acttcagcctggatgacaga

SEQ ID NO: 130511 - DNA, 20 bp, Artificial Sequence
  chemically synthesized
cacttcagcctggatgacag

SEQ ID NO: 130512 - DNA, 20 bp, Artificial Sequence
  chemically synthesized
gggagtctccctctgtcatc

SEQ ID NO: 130513 - DNA, 20 bp, Artificial Sequence
  chemically synthesized
gcacttcagcctggatgaca

SEQ ID NO: 130514 - DNA, 20 bp, Artificial Sequence
  chemically synthesized
ggagtctccctctgtcatcc

SEQ ID NO: 130515 - DNA, 20 bp, Artificial Sequence
  chemically synthesized
ctgcacttcagcctggatga

SEQ ID NO: 130516 - DNA, 20 bp, Artificial Sequence
  chemically synthesized
tccctctgtcatccaggctg

SEQ ID NO: 130517 - DNA, 20 bp, Artificial Sequence
  chemically synthesized
ggtgccactgcacttcagcc

SEQ ID NO: 130518 - DNA, 20 bp, Artificial Sequence
  chemically synthesized
ctgtcatccaggctgaagtg

SEQ ID NO: 130519 - DNA, 20 bp, Artificial Sequence
  chemically synthesized
aagatggtgccactgcactt

SEQ ID NO: 130520 - DNA, 20 bp, Artificial Sequence
  chemically synthesized
tcatccaggctgaagtgcag

SEQ ID NO: 130521 - DNA, 20 bp, Artificial Sequence
  chemically synthesized
gaagtgcagtggcaccatct

SEQ ID NO: 130522 - DNA, 20 bp, Artificial Sequence
  chemically synthesized
gaggtggcagtgagccaaga

SEQ ID NO: 130523 - DNA, 20 bp, Artificial Sequence
  chemically synthesized
ggcagaggtggcagtgagcc

SEQ ID NO: 130524 - DNA, 20 bp, Artificial Sequence
  chemically synthesized
caagaggcagaggtggcagt

SEQ ID NO: 130525 - DNA, 20 bp, Artificial Sequence
  chemically synthesized
aacccaagaggcagaggtgg

SEQ ID NO: 130526 - DNA, 20 bp, Artificial Sequence
  chemically synthesized
ttgaacccaagaggcagagg

SEQ ID NO: 130527 - DNA, 20 bp, Artificial Sequence
  chemically synthesized
agcttgaacccaagaggcag

SEQ ID NO: 130528 - DNA, 20 bp, Artificial Sequence
  chemically synthesized
tcactgccacctctgcctct

SEQ ID NO: 130529 - DNA, 20 bp, Artificial Sequence
  chemically synthesized
tagcttgaacccaagaggca

SEQ ID NO: 130530 - DNA, 20 bp, Artificial Sequence
  chemically synthesized
cactgccacctctgcctctt

SEQ ID NO: 130531 - DNA, 20 bp, Artificial Sequence
  chemically synthesized
aatagcttgaacccaagagg

SEQ ID NO: 130532 - DNA, 20 bp, Artificial Sequence
  chemically synthesized
gagaatagcttgaacccaag

SEQ ID NO: 130533 - DNA, 20 bp, Artificial Sequence
  chemically synthesized
ggagaatagcttgaacccaa

SEQ ID NO: 130534 - DNA, 20 bp, Artificial Sequence
  chemically synthesized
cacctctgcctcttgggttc

SEQ ID NO: 130535 - DNA, 20 bp, Artificial Sequence
  chemically synthesized
caggagaatagcttgaaccc

SEQ ID NO: 130536 - DNA, 20 bp, Artificial Sequence
  chemically synthesized
aggaggctgaggcaggagaa

SEQ ID NO: 130537 - DNA, 20 bp, Artificial Sequence
  chemically synthesized
ttcaagctattctcctgcct

SEQ ID NO: 130538 - DNA, 20 bp, Artificial Sequence
  chemically synthesized
tactcaggaggctgaggcag

SEQ ID NO: 130539 - DNA, 20 bp, Artificial Sequence
  chemically synthesized
gctactcaggaggctgaggc

SEQ ID NO: 130540 - DNA, 20 bp, Artificial Sequence
  chemically synthesized
agctactcaggaggctgagg

SEQ ID NO: 130541 - DNA, 20 bp, Artificial Sequence
  chemically synthesized
cccagctactcaggaggctg

SEQ ID NO: 130542 - DNA, 20 bp, Artificial Sequence
  chemically synthesized
tcccagctactcaggaggct

SEQ ID NO: 130543 - DNA, 20 bp, Artificial Sequence
  chemically synthesized
ttctcctgcctcagcctcct

SEQ ID NO: 130544 - DNA, 20 bp, Artificial Sequence
  chemically synthesized
tcctgcctcagcctcctgag

SEQ ID NO: 130545 - DNA, 20 bp, Artificial Sequence
  chemically synthesized
tgtaatcccagctactcagg

SEQ ID NO: 130546 - DNA, 20 bp, Artificial Sequence
  chemically synthesized
ctgtaatcccagctactcag

SEQ ID NO: 130547 - DNA, 20 bp, Artificial Sequence
  chemically synthesized
gcctcagcctcctgagtagc

SEQ ID NO: 130548 - DNA, 20 bp, Artificial Sequence
  chemically synthesized
gcctgtaatcccagctactc

SEQ ID NO: 130549 - DNA, 20 bp, Artificial Sequence
  chemically synthesized
cctcagcctcctgagtagct

SEQ ID NO: 130550 - DNA, 20 bp, Artificial Sequence
  chemically synthesized
tgcctgtaatcccagctact

SEQ ID NO: 130551 - DNA, 20 bp, Artificial Sequence
  chemically synthesized
ctcctgagtagctgggatta

SEQ ID NO: 130552 - DNA, 20 bp, Artificial Sequence
  chemically synthesized
tcctgagtagctgggattac

SEQ ID NO: 130553 - DNA, 20 bp, Artificial Sequence
  chemically synthesized
gtggtgcatgcctgtaatcc

SEQ ID NO: 130554 - DNA, 20 bp, Artificial Sequence
  chemically synthesized
caggcatgcaccaccatgcc

SEQ ID NO: 130555 - DNA, 20 bp, Artificial Sequence
  chemically synthesized
aaaaaaatagctgggcatgg

SEQ ID NO: 130556 - DNA, 20 bp, Artificial Sequence
  chemically synthesized
tacaaaaaaatagctgggca

SEQ ID NO: 130557 - DNA, 20 bp, Artificial Sequence
  chemically synthesized
aaaaatacaaaaaaatagct

SEQ ID NO: 130558 - DNA, 20 bp, Artificial Sequence
  chemically synthesized
taaaaatacaaaaaaatagc

SEQ ID NO: 130559 - DNA, 20 bp, Artificial Sequence
  chemically synthesized
ctactaaaaatacaaaaaaa

SEQ ID NO: 130560 - DNA, 20 bp, Artificial Sequence
  chemically synthesized
cagctatttttttgtatttt

SEQ ID NO: 130561 - DNA, 20 bp, Artificial Sequence
  chemically synthesized
ctatttttttgtatttttag

SEQ ID NO: 130562 - DNA, 20 bp, Artificial Sequence
  chemically synthesized
atttttttgtatttttagta

SEQ ID NO: 130563 - DNA, 20 bp, Artificial Sequence
  chemically synthesized
ttttgtatttttagtagaga

SEQ ID NO: 130564 - DNA, 20 bp, Artificial Sequence
  chemically synthesized
tttgtatttttagtagagat

SEQ ID NO: 130565 - DNA, 20 bp, Artificial Sequence
  chemically synthesized
ttgtatttttagtagagatg

SEQ ID NO: 130566 - DNA, 20 bp, Artificial Sequence
  chemically synthesized
agtagagatggggtttcatc

SEQ ID NO: 130567 - DNA, 20 bp, Artificial Sequence
  chemically synthesized
tggggtttcatcaagttgac

SEQ ID NO: 130568 - DNA, 20 bp, Artificial Sequence
  chemically synthesized
ggggtttcatcaagttgacc

SEQ ID NO: 130569 - DNA, 20 bp, Artificial Sequence
  chemically synthesized
tttcatcaagttgaccaggc

SEQ ID NO: 130570 - DNA, 20 bp, Artificial Sequence
  chemically synthesized
tcaggagttcaagaccagcc

SEQ ID NO: 130571 - DNA, 20 bp, Artificial Sequence
  chemically synthesized
tgatgtcaggagttcaagac

SEQ ID NO: 130572 - DNA, 20 bp, Artificial Sequence
  chemically synthesized
ccacttgatgtcaggagttc

SEQ ID NO: 130573 - DNA, 20 bp, Artificial Sequence
  chemically synthesized
ggtggaccacttgatgtcag

SEQ ID NO: 130574 - DNA, 20 bp, Artificial Sequence
  chemically synthesized
ggtcttgaactcctgacatc

SEQ ID NO: 130575 - DNA, 20 bp, Artificial Sequence
  chemically synthesized
tgggtggaccacttgatgtc

SEQ ID NO: 130576 - DNA, 20 bp, Artificial Sequence
  chemically synthesized
gtgggtggaccacttgatgt

SEQ ID NO: 130577 - DNA, 20 bp, Artificial Sequence
  chemically synthesized
cttgaactcctgacatcaag

SEQ ID NO: 130578 - DNA, 20 bp, Artificial Sequence
  chemically synthesized
aagacttctctggaggtggg

SEQ ID NO: 130579 - DNA, 20 bp, Artificial Sequence
  chemically synthesized
tcaagtggtccacccacctc

SEQ ID NO: 130580 - DNA, 20 bp, Artificial Sequence
  chemically synthesized
aagtggtccacccacctcca

SEQ ID NO: 130581 - DNA, 20 bp, Artificial Sequence
  chemically synthesized
cagaagacttctctggaggt

SEQ ID NO: 130582 - DNA, 20 bp, Artificial Sequence
  chemically synthesized
tcagaagacttctctggagg

SEQ ID NO: 130583 - DNA, 20 bp, Artificial Sequence
  chemically synthesized
tggtccacccacctccagag

SEQ ID NO: 130584 - DNA, 20 bp, Artificial Sequence
  chemically synthesized
tcttcagaagacttctctgg

SEQ ID NO: 130585 - DNA, 20 bp, Artificial Sequence
  chemically synthesized
atcttcagaagacttctctg

SEQ ID NO: 130586 - DNA, 20 bp, Artificial Sequence
  chemically synthesized
tcatcttcagaagacttctc

SEQ ID NO: 130587 - DNA, 20 bp, Artificial Sequence
  chemically synthesized
acctccagagaagtcttctg

SEQ ID NO: 130588 - DNA, 20 bp, Artificial Sequence
  chemically synthesized
accaagattttcatcttcag

SEQ ID NO: 130589 - DNA, 20 bp, Artificial Sequence
  chemically synthesized
aagaccaagattttcatctt

SEQ ID NO: 130590 - DNA, 20 bp, Artificial Sequence
  chemically synthesized
tcttctgaagatgaaaatct

SEQ ID NO: 130591 - DNA, 20 bp, Artificial Sequence
  chemically synthesized
ttaataagtgatgaaagacc

SEQ ID NO: 130592 - DNA, 20 bp, Artificial Sequence
  chemically synthesized
ggaaatttaataagtgatga

SEQ ID NO: 130593 - DNA, 20 bp, Artificial Sequence
  chemically synthesized
tgacattaaggaaatttaat

SEQ ID NO: 130594 - DNA, 20 bp, Artificial Sequence
  chemically synthesized
gggtgggaggcatgacatta

SEQ ID NO: 130595 - DNA, 20 bp, Artificial Sequence
  chemically synthesized
ggggtgggaggcatgacatt

SEQ ID NO: 130596 - DNA, 20 bp, Artificial Sequence
  chemically synthesized
tgaaagcagtgtggggtggg

SEQ ID NO: 130597 - DNA, 20 bp, Artificial Sequence
  chemically synthesized
ctgaaagcagtgtggggtgg

SEQ ID NO: 130598 - DNA, 20 bp, Artificial Sequence
  chemically synthesized
tcctgaaagcagtgtggggt

SEQ ID NO: 130599 - DNA, 20 bp, Artificial Sequence
  chemically synthesized
atcctgaaagcagtgtgggg

SEQ ID NO: 130600 - DNA, 20 bp, Artificial Sequence
  chemically synthesized
actatcctgaaagcagtgtg

SEQ ID NO: 130601 - DNA, 20 bp, Artificial Sequence
  chemically synthesized
tactatcctgaaagcagtgt

SEQ ID NO: 130602 - DNA, 20 bp, Artificial Sequence
  chemically synthesized
atactatcctgaaagcagtg

SEQ ID NO: 130603 - DNA, 20 bp, Artificial Sequence
  chemically synthesized
ctcccaccccacactgcttt

SEQ ID NO: 130604 - DNA, 20 bp, Artificial Sequence
  chemically synthesized
tcccaccccacactgctttc

SEQ ID NO: 130605 - DNA, 20 bp, Artificial Sequence
  chemically synthesized
ttttaatactatcctgaaag

SEQ ID NO: 130606 - DNA, 20 bp, Artificial Sequence
  chemically synthesized
accccacactgctttcagga

SEQ ID NO: 130607 - DNA, 20 bp, Artificial Sequence
  chemically synthesized
gagttttaatactatcctga

SEQ ID NO: 130608 - DNA, 20 bp, Artificial Sequence
  chemically synthesized
gatcttgtaggataggtaaa

SEQ ID NO: 130609 - DNA, 20 bp, Artificial Sequence
  chemically synthesized
aagatcttgtaggataggta

SEQ ID NO: 130610 - DNA, 20 bp, Artificial Sequence
  chemically synthesized
aaactctttacctatcctac

SEQ ID NO: 130611 - DNA, 20 bp, Artificial Sequence
  chemically synthesized
tataaaagatcttgtaggat

SEQ ID NO: 130612 - DNA, 20 bp, Artificial Sequence
  chemically synthesized
ttataaaagatcttgtagga

SEQ ID NO: 130613 - DNA, 20 bp, Artificial Sequence
  chemically synthesized
cacgttataaaagatcttgt

SEQ ID NO: 130614 - DNA, 20 bp, Artificial Sequence
  chemically synthesized
ccacgttataaaagatcttg

SEQ ID NO: 130615 - DNA, 20 bp, Artificial Sequence
  chemically synthesized
agacaaaggccacgttataa

SEQ ID NO: 130616 - DNA, 20 bp, Artificial Sequence
  chemically synthesized
ctacaagatcttttataacg

SEQ ID NO: 130617 - DNA, 20 bp, Artificial Sequence
  chemically synthesized
gaaactagaaaagtagacaa

SEQ ID NO: 130618 - DNA, 20 bp, Artificial Sequence
  chemically synthesized
agaaactagaaaagtagaca

SEQ ID NO: 130619 - DNA, 20 bp, Artificial Sequence
  chemically synthesized
gtggcctttgtctacttttc

SEQ ID NO: 130620 - DNA, 20 bp, Artificial Sequence
  chemically synthesized
aagccaagaaactagaaaag

SEQ ID NO: 130621 - DNA, 20 bp, Artificial Sequence
  chemically synthesized
cagaagccaagaaactagaa

SEQ ID NO: 130622 - DNA, 20 bp, Artificial Sequence
  chemically synthesized
tgtctacttttctagtttct

SEQ ID NO: 130623 - DNA, 20 bp, Artificial Sequence
  chemically synthesized
ggcagcagaagccaagaaac

SEQ ID NO: 130624 - DNA, 20 bp, Artificial Sequence
  chemically synthesized
cacaacaggcagcagaagcc

SEQ ID NO: 130625 - DNA, 20 bp, Artificial Sequence
  chemically synthesized
ggcatcacaacaggcagcag

SEQ ID NO: 130626 - DNA, 20 bp, Artificial Sequence
  chemically synthesized
ataggcatcacaacaggcag

SEQ ID NO: 130627 - DNA, 20 bp, Artificial Sequence
  chemically synthesized
agtataggcatcacaacagg

SEQ ID NO: 130628 - DNA, 20 bp, Artificial Sequence
  chemically synthesized
tggagtataggcatcacaac

SEQ ID NO: 130629 - DNA, 20 bp, Artificial Sequence
  chemically synthesized
ctggagtataggcatcacaa

SEQ ID NO: 130630 - DNA, 20 bp, Artificial Sequence
  chemically synthesized
ctgttgtgatgcctatactc

SEQ ID NO: 130631 - DNA, 20 bp, Artificial Sequence
  chemically synthesized
tagctgtaaagctggagtat

SEQ ID NO: 130632 - DNA, 20 bp, Artificial Sequence
  chemically synthesized
gtagctgtaaagctggagta

SEQ ID NO: 130633 - DNA, 20 bp, Artificial Sequence
  chemically synthesized
cctgtgtagctgtaaagctg

SEQ ID NO: 130634 - DNA, 20 bp, Artificial Sequence
  chemically synthesized
atgcctatactccagcttta

SEQ ID NO: 130635 - DNA, 20 bp, Artificial Sequence
  chemically synthesized
ttcctgtgtagctgtaaagc

SEQ ID NO: 130636 - DNA, 20 bp, Artificial Sequence
  chemically synthesized
ctccttcctgtgtagctgta

SEQ ID NO: 130637 - DNA, 20 bp, Artificial Sequence
  chemically synthesized
actccagctttacagctaca

SEQ ID NO: 130638 - DNA, 20 bp, Artificial Sequence
  chemically synthesized
ctccagctttacagctacac

SEQ ID NO: 130639 - DNA, 20 bp, Artificial Sequence
  chemically synthesized
cagctttacagctacacagg

SEQ ID NO: 130640 - DNA, 20 bp, Artificial Sequence
  chemically synthesized
agctttacagctacacagga

SEQ ID NO: 130641 - DNA, 20 bp, Artificial Sequence
  chemically synthesized
acctagggctccttcctgtg

SEQ ID NO: 130642 - DNA, 20 bp, Artificial Sequence
  chemically synthesized
ctttacagctacacaggaag

SEQ ID NO: 130643 - DNA, 20 bp, Artificial Sequence
  chemically synthesized
agctacacaggaaggagccc

SEQ ID NO: 130644 - DNA, 20 bp, Artificial Sequence
  chemically synthesized
gctacacaggaaggagccct

SEQ ID NO: 130645 - DNA, 20 bp, Artificial Sequence
  chemically synthesized
ggtaacattgtacataccta

SEQ ID NO: 130646 - DNA, 20 bp, Artificial Sequence
  chemically synthesized
tggtaacattgtacatacct

SEQ ID NO: 130647 - DNA, 20 bp, Artificial Sequence
  chemically synthesized
gtggtaacattgtacatacc

SEQ ID NO: 130648 - DNA, 20 bp, Artificial Sequence
  chemically synthesized
ttagacaaatgtgaggtgtg

SEQ ID NO: 130649 - DNA, 20 bp, Artificial Sequence
  chemically synthesized
gaaatacttagacaaatgtg

SEQ ID NO: 130650 - DNA, 20 bp, Artificial Sequence
  chemically synthesized
tgaaatacttagacaaatgt

SEQ ID NO: 130651 - DNA, 20 bp, Artificial Sequence
  chemically synthesized
cacacacctcacatttgtct

SEQ ID NO: 130652 - DNA, 20 bp, Artificial Sequence
  chemically synthesized
tgagatacatgtgaaatact

SEQ ID NO: 130653 - DNA, 20 bp, Artificial Sequence
  chemically synthesized
gagaaagcatagacacatgt

SEQ ID NO: 130654 - DNA, 20 bp, Artificial Sequence
  chemically synthesized
ttgtaggcagagagaaagca

SEQ ID NO: 130655 - DNA, 20 bp, Artificial Sequence
  chemically synthesized
gagcattgtaggcagagaga

SEQ ID NO: 130656 - DNA, 20 bp, Artificial Sequence
  chemically synthesized
cagagagcattgtaggcaga

SEQ ID NO: 130657 - DNA, 20 bp, Artificial Sequence
  chemically synthesized
ggcagagagcattgtaggca

SEQ ID NO: 130658 - DNA, 20 bp, Artificial Sequence
  chemically synthesized
aaggcagagagcattgtagg

SEQ ID NO: 130659 - DNA, 20 bp, Artificial Sequence
  chemically synthesized
gaaaaggcagagagcattgt

SEQ ID NO: 130660 - DNA, 20 bp, Artificial Sequence
  chemically synthesized
tgaaaaggcagagagcattg

SEQ ID NO: 130661 - DNA, 20 bp, Artificial Sequence
  chemically synthesized
ctgcaaactgaaaaggcaga

SEQ ID NO: 130662 - DNA, 20 bp, Artificial Sequence
  chemically synthesized
tgctgcaaactgaaaaggca

SEQ ID NO: 130663 - DNA, 20 bp, Artificial Sequence
  chemically synthesized
tacaatgctctctgcctttt

SEQ ID NO: 130664 - DNA, 20 bp, Artificial Sequence
  chemically synthesized
agtgctgcaaactgaaaagg

SEQ ID NO: 130665 - DNA, 20 bp, Artificial Sequence
  chemically synthesized
cagagtgctgcaaactgaaa

SEQ ID NO: 130666 - DNA, 20 bp, Artificial Sequence
  chemically synthesized
gcagagtgctgcaaactgaa

SEQ ID NO: 130667 - DNA, 20 bp, Artificial Sequence
  chemically synthesized
ctctctgccttttcagtttg

SEQ ID NO: 130668 - DNA, 20 bp, Artificial Sequence
  chemically synthesized
gtttgcagcactctgctcaa

SEQ ID NO: 130669 - DNA, 20 bp, Artificial Sequence
  chemically synthesized
gtggcagtgacttttgagca

SEQ ID NO: 130670 - DNA, 20 bp, Artificial Sequence
  chemically synthesized
tagtggcagtgacttttgag

SEQ ID NO: 130671 - DNA, 20 bp, Artificial Sequence
  chemically synthesized
gactagtggcagtgactttt

SEQ ID NO: 130672 - DNA, 20 bp, Artificial Sequence
  chemically synthesized
tgctcaaaagtcactgccac

SEQ ID NO: 130673 - DNA, 20 bp, Artificial Sequence
  chemically synthesized
aggacaaaactgactagtgg

SEQ ID NO: 130674 - DNA, 20 bp, Artificial Sequence
  chemically synthesized
caaaagtcactgccactagt

SEQ ID NO: 130675 - DNA, 20 bp, Artificial Sequence
  chemically synthesized
atcaggacaaaactgactag

SEQ ID NO: 130676 - DNA, 20 bp, Artificial Sequence
  chemically synthesized
attatcaggacaaaactgac

SEQ ID NO: 130677 - DNA, 20 bp, Artificial Sequence
  chemically synthesized
tagggtgaaagggaattatc

SEQ ID NO: 130678 - DNA, 20 bp, Artificial Sequence
  chemically synthesized
atagggtgaaagggaattat

SEQ ID NO: 130679 - DNA, 20 bp, Artificial Sequence
  chemically synthesized
aaggctttgatagggtgaaa

SEQ ID NO: 130680 - DNA, 20 bp, Artificial Sequence
  chemically synthesized
caaggctttgatagggtgaa

SEQ ID NO: 130681 - DNA, 20 bp, Artificial Sequence
  chemically synthesized
acaaggctttgatagggtga

SEQ ID NO: 130682 - DNA, 20 bp, Artificial Sequence
  chemically synthesized
aattccctttcaccctatca

SEQ ID NO: 130683 - DNA, 20 bp, Artificial Sequence
  chemically synthesized
acgtaaacaaggctttgata

SEQ ID NO: 130684 - DNA, 20 bp, Artificial Sequence
  chemically synthesized
cacgtaaacaaggctttgat

SEQ ID NO: 130685 - DNA, 20 bp, Artificial Sequence
  chemically synthesized
gcacgtaaacaaggctttga

SEQ ID NO: 130686 - DNA, 20 bp, Artificial Sequence
  chemically synthesized
catggaatggcacgtaaaca

SEQ ID NO: 130687 - DNA, 20 bp, Artificial Sequence
  chemically synthesized
gcatggaatggcacgtaaac

SEQ ID NO: 130688 - DNA, 20 bp, Artificial Sequence
  chemically synthesized
actcacaaggtagcatggaa

SEQ ID NO: 130689 - DNA, 20 bp, Artificial Sequence
  chemically synthesized
gagaaactcacaaggtagca

SEQ ID NO: 130690 - DNA, 20 bp, Artificial Sequence
  chemically synthesized
gccattccatgctaccttgt

SEQ ID NO: 130691 - DNA, 20 bp, Artificial Sequence
  chemically synthesized
gacttgagaaactcacaagg

SEQ ID NO: 130692 - DNA, 20 bp, Artificial Sequence
  chemically synthesized
tatgacttgagaaactcaca

SEQ ID NO: 130693 - DNA, 20 bp, Artificial Sequence
  chemically synthesized
ttatgacttgagaaactcac

SEQ ID NO: 130694 - DNA, 20 bp, Artificial Sequence
  chemically synthesized
tgctaccttgtgagtttctc

SEQ ID NO: 130695 - DNA, 20 bp, Artificial Sequence
  chemically synthesized
taagttcttggttatgactt

SEQ ID NO: 130696 - DNA, 20 bp, Artificial Sequence
  chemically synthesized
gagtttctcaagtcataacc

SEQ ID NO: 130697 - DNA, 20 bp, Artificial Sequence
  chemically synthesized
caagtcataaccaagaactt

SEQ ID NO: 130698 - DNA, 20 bp, Artificial Sequence
  chemically synthesized
tacatgagtacttaagttct

SEQ ID NO: 130699 - DNA, 20 bp, Artificial Sequence
  chemically synthesized
ggacacttacatgagtactt

SEQ ID NO: 130700 - DNA, 20 bp, Artificial Sequence
  chemically synthesized
aagaacttaagtactcatgt

SEQ ID NO: 130701 - DNA, 20 bp, Artificial Sequence
  chemically synthesized
ggtaggaaggacacttacat

SEQ ID NO: 130702 - DNA, 20 bp, Artificial Sequence
  chemically synthesized
cagtttaggcatgggtagga

SEQ ID NO: 130703 - DNA, 20 bp, Artificial Sequence
  chemically synthesized
acagtttaggcatgggtagg

SEQ ID NO: 130704 - DNA, 20 bp, Artificial Sequence
  chemically synthesized
tttacagtttaggcatgggt

SEQ ID NO: 130705 - DNA, 20 bp, Artificial Sequence
  chemically synthesized
ttttacagtttaggcatggg

SEQ ID NO: 130706 - DNA, 20 bp, Artificial Sequence
  chemically synthesized
cacttttacagtttaggcat

SEQ ID NO: 130707 - DNA, 20 bp, Artificial Sequence
  chemically synthesized
tcacttttacagtttaggca

SEQ ID NO: 130708 - DNA, 20 bp, Artificial Sequence
  chemically synthesized
gattttcacttttacagttt

SEQ ID NO: 130709 - DNA, 20 bp, Artificial Sequence
  chemically synthesized
tgattttcacttttacagtt

SEQ ID NO: 130710 - DNA, 20 bp, Artificial Sequence
  chemically synthesized
tacccatgcctaaactgtaa

SEQ ID NO: 130711 - DNA, 20 bp, Artificial Sequence
  chemically synthesized
tgtgatgattttcactttta

SEQ ID NO: 130712 - DNA, 20 bp, Artificial Sequence
  chemically synthesized
acaaaataaacacatacatt

SEQ ID NO: 130713 - DNA, 20 bp, Artificial Sequence
  chemically synthesized
gatcacatacttaattttca

SEQ ID NO: 130714 - DNA, 20 bp, Artificial Sequence
  chemically synthesized
tagtcaatgctatgaaaatt

SEQ ID NO: 130715 - DNA, 20 bp, Artificial Sequence
  chemically synthesized
gtatgtgatcaaatgttttg

SEQ ID NO: 130716 - DNA, 20 bp, Artificial Sequence
  chemically synthesized
atgtgatcaaatgttttgaa

SEQ ID NO: 130717 - DNA, 20 bp, Artificial Sequence
  chemically synthesized
aatgttttgaagagtgaaaa

SEQ ID NO: 130718 - DNA, 20 bp, Artificial Sequence
  chemically synthesized
atgttttgaagagtgaaaat

SEQ ID NO: 130719 - DNA, 20 bp, Artificial Sequence
  chemically synthesized
tgttttgaagagtgaaaatg

SEQ ID NO: 130720 - DNA, 20 bp, Artificial Sequence
  chemically synthesized
gaaaatggggcttttgtatt

SEQ ID NO: 130721 - DNA, 20 bp, Artificial Sequence
  chemically synthesized
tcatcttccccttaatacaa

SEQ ID NO: 130722 - DNA, 20 bp, Artificial Sequence
  chemically synthesized
aaaatggggcttttgtatta

SEQ ID NO: 130723 - DNA, 20 bp, Artificial Sequence
  chemically synthesized
aaatggggcttttgtattaa

SEQ ID NO: 130724 - DNA, 20 bp, Artificial Sequence
  chemically synthesized
aatggggcttttgtattaag

SEQ ID NO: 130725 - DNA, 20 bp, Artificial Sequence
  chemically synthesized
ggggcttttgtattaagggg

SEQ ID NO: 130726 - DNA, 20 bp, Artificial Sequence
  chemically synthesized
ttttgtattaaggggaagat

SEQ ID NO: 130727 - DNA, 20 bp, Artificial Sequence
  chemically synthesized
tttgtattaaggggaagatg

SEQ ID NO: 130728 - DNA, 20 bp, Artificial Sequence
  chemically synthesized
gatgaggaaatgaattgatg

SEQ ID NO: 130729 - DNA, 20 bp, Artificial Sequence
  chemically synthesized
ggaaatgaattgatgaagtg

SEQ ID NO: 130730 - DNA, 20 bp, Artificial Sequence
  chemically synthesized
gcatttgaagaaatcagttc

SEQ ID NO: 130731 - DNA, 20 bp, Artificial Sequence
  chemically synthesized
agcatttgaagaaatcagtt

SEQ ID NO: 130732 - DNA, 20 bp, Artificial Sequence
  chemically synthesized
ggagaagcatttgaagaaat

SEQ ID NO: 130733 - DNA, 20 bp, Artificial Sequence
  chemically synthesized
cttttctggagaagcatttg

SEQ ID NO: 130734 - DNA, 20 bp, Artificial Sequence
  chemically synthesized
gatttcttcaaatgcttctc

SEQ ID NO: 130735 - DNA, 20 bp, Artificial Sequence
  chemically synthesized
ctctttttgcttttctggag

SEQ ID NO: 130736 - DNA, 20 bp, Artificial Sequence
  chemically synthesized
cttcaaatgcttctccagaa

SEQ ID NO: 130737 - DNA, 20 bp, Artificial Sequence
  chemically synthesized
ttcctctttttgcttttctg

SEQ ID NO: 130738 - DNA, 20 bp, Artificial Sequence
  chemically synthesized
tattcctctttttgcttttc

SEQ ID NO: 130739 - DNA, 20 bp, Artificial Sequence
  chemically synthesized
tgcttctccagaaaagcaaa

SEQ ID NO: 130740 - DNA, 20 bp, Artificial Sequence
  chemically synthesized
cttctccagaaaagcaaaaa

SEQ ID NO: 130741 - DNA, 20 bp, Artificial Sequence
  chemically synthesized
ttctccagaaaagcaaaaag

SEQ ID NO: 130742 - DNA, 20 bp, Artificial Sequence
  chemically synthesized
aaagaggaataataaaaaaa

SEQ ID NO: 130743 - DNA, 20 bp, Artificial Sequence
  chemically synthesized
aaaaaaagatcaatgaattc

SEQ ID NO: 130744 - DNA, 20 bp, Artificial Sequence
  chemically synthesized
agtatgtatgttaaatgaac

SEQ ID NO: 130745 - DNA, 20 bp, Artificial Sequence
  chemically synthesized
aacatacatactatattatt

SEQ ID NO: 130746 - DNA, 20 bp, Artificial Sequence
  chemically synthesized
ctgtgtttgtcttaataata

SEQ ID NO: 130747 - DNA, 20 bp, Artificial Sequence
  chemically synthesized
ctatattattaagacaaaca

SEQ ID NO: 130748 - DNA, 20 bp, Artificial Sequence
  chemically synthesized
tatattattaagacaaacac

SEQ ID NO: 130749 - DNA, 20 bp, Artificial Sequence
  chemically synthesized
tattaagacaaacacaggat

SEQ ID NO: 130750 - DNA, 20 bp, Artificial Sequence
  chemically synthesized
agtgaaaataaaatatattt

SEQ ID NO: 130751 - DNA, 20 bp, Artificial Sequence
  chemically synthesized
tatattttagactaaaatgc

SEQ ID NO: 130752 - DNA, 20 bp, Artificial Sequence
  chemically synthesized
tggtttttctaccagcattt

SEQ ID NO: 130753 - DNA, 20 bp, Artificial Sequence
  chemically synthesized
attttagactaaaatgctgg

SEQ ID NO: 130754 - DNA, 20 bp, Artificial Sequence
  chemically synthesized
ttcctttttggtttttctac

SEQ ID NO: 130755 - DNA, 20 bp, Artificial Sequence
  chemically synthesized
atgctggtagaaaaaccaaa

SEQ ID NO: 130756 - DNA, 20 bp, Artificial Sequence
  chemically synthesized
tgctggtagaaaaaccaaaa

SEQ ID NO: 130757 - DNA, 20 bp, Artificial Sequence
  chemically synthesized
tggtagaaaaaccaaaaagg

SEQ ID NO: 130758 - DNA, 20 bp, Artificial Sequence
  chemically synthesized
ggtagaaaaaccaaaaagga

SEQ ID NO: 130759 - DNA, 20 bp, Artificial Sequence
  chemically synthesized
ctttcatactccttcctttt

SEQ ID NO: 130760 - DNA, 20 bp, Artificial Sequence
  chemically synthesized
tagaaaaaccaaaaaggaag

SEQ ID NO: 130761 - DNA, 20 bp, Artificial Sequence
  chemically synthesized
ccaaaaaggaaggagtatga

SEQ ID NO: 130762 - DNA, 20 bp, Artificial Sequence
  chemically synthesized
ggaaggagtatgaaagacat

SEQ ID NO: 130763 - DNA, 20 bp, Artificial Sequence
  chemically synthesized
aagacataagttacccttcc

SEQ ID NO: 130764 - DNA, 20 bp, Artificial Sequence
  chemically synthesized
agacataagttacccttcct

SEQ ID NO: 130765 - DNA, 20 bp, Artificial Sequence
  chemically synthesized
ctgaaaatggagcctaggaa

SEQ ID NO: 130766 - DNA, 20 bp, Artificial Sequence
  chemically synthesized
tctgaaaatggagcctagga

SEQ ID NO: 130767 - DNA, 20 bp, Artificial Sequence
  chemically synthesized
atctgaaaatggagcctagg

SEQ ID NO: 130768 - DNA, 20 bp, Artificial Sequence
  chemically synthesized
aatatctgaaaatggagcct

SEQ ID NO: 130769 - DNA, 20 bp, Artificial Sequence
  chemically synthesized
aaatatctgaaaatggagcc

SEQ ID NO: 130770 - DNA, 20 bp, Artificial Sequence
  chemically synthesized
cccttcctaggctccatttt

SEQ ID NO: 130771 - DNA, 20 bp, Artificial Sequence
  chemically synthesized
atcaaaaatatctgaaaatg

SEQ ID NO: 130772 - DNA, 20 bp, Artificial Sequence
  chemically synthesized
caatcaaaaatatctgaaaa

SEQ ID NO: 130773 - DNA, 20 bp, Artificial Sequence
  chemically synthesized
atttttgattgtttaaactt

SEQ ID NO: 130774 - DNA, 20 bp, Artificial Sequence
  chemically synthesized
ataacattcatgaattgctg

SEQ ID NO: 130775 - DNA, 20 bp, Artificial Sequence
  chemically synthesized
tcagcaattcatgaatgtta

SEQ ID NO: 130776 - DNA, 20 bp, Artificial Sequence
  chemically synthesized
atagtaaatgatttgaaaaa

SEQ ID NO: 130777 - DNA, 20 bp, Artificial Sequence
  chemically synthesized
tagtaaatgatttgaaaaat

SEQ ID NO: 130778 - DNA, 20 bp, Artificial Sequence
  chemically synthesized
agtaaatgatttgaaaaatg

SEQ ID NO: 130779 - DNA, 20 bp, Artificial Sequence
  chemically synthesized
taaatgatttgaaaaatggg

SEQ ID NO: 130780 - DNA, 20 bp, Artificial Sequence
  chemically synthesized
tttgaaaaatggggagataa

SEQ ID NO: 130781 - DNA, 20 bp, Artificial Sequence
  chemically synthesized
ggggattattggaacgagga

SEQ ID NO: 130782 - DNA, 20 bp, Artificial Sequence
  chemically synthesized
gaatggggattattggaacg

SEQ ID NO: 130783 - DNA, 20 bp, Artificial Sequence
  chemically synthesized
tgaatggggattattggaac

SEQ ID NO: 130784 - DNA, 20 bp, Artificial Sequence
  chemically synthesized
gttacttgaatggggattat

SEQ ID NO: 130785 - DNA, 20 bp, Artificial Sequence
  chemically synthesized
cgttccaataatccccattc

SEQ ID NO: 130786 - DNA, 20 bp, Artificial Sequence
  chemically synthesized
gctgttttgttacttgaatg

SEQ ID NO: 130787 - DNA, 20 bp, Artificial Sequence
  chemically synthesized
agctgttttgttacttgaat

SEQ ID NO: 130788 - DNA, 20 bp, Artificial Sequence
  chemically synthesized
aagctgttttgttacttgaa

SEQ ID NO: 130789 - DNA, 20 bp, Artificial Sequence
  chemically synthesized
tccccattcaagtaacaaaa

SEQ ID NO: 130790 - DNA, 20 bp, Artificial Sequence
  chemically synthesized
aaatttacatattttgtatt

SEQ ID NO: 130791 - DNA, 20 bp, Artificial Sequence
  chemically synthesized
agatttttaggataagtcat

SEQ ID NO: 130792 - DNA, 20 bp, Artificial Sequence
  chemically synthesized
attttgtagatttttaggat

SEQ ID NO: 130793 - DNA, 20 bp, Artificial Sequence
  chemically synthesized
tacatattttgtagattttt

SEQ ID NO: 130794 - DNA, 20 bp, Artificial Sequence
  chemically synthesized
ttacatattttgtagatttt

SEQ ID NO: 130795 - DNA, 20 bp, Artificial Sequence
  chemically synthesized
aagttcatttacatattttg

SEQ ID NO: 130796 - DNA, 20 bp, Artificial Sequence
  chemically synthesized
tgtaaatgaacttttaaaat

SEQ ID NO: 130797 - DNA, 20 bp, Artificial Sequence
  chemically synthesized
agttcctatactaattttaa

SEQ ID NO: 130798 - DNA, 20 bp, Artificial Sequence
  chemically synthesized
atgaacttttaaaattagta

SEQ ID NO: 130799 - DNA, 20 bp, Artificial Sequence
  chemically synthesized
tgaacttttaaaattagtat

SEQ ID NO: 130800 - DNA, 20 bp, Artificial Sequence
  chemically synthesized
tagtataggaactcttacaa

SEQ ID NO: 130801 - DNA, 20 bp, Artificial Sequence
  chemically synthesized
gagctgctgtactattgtaa

SEQ ID NO: 130802 - DNA, 20 bp, Artificial Sequence
  chemically synthesized
aggagctgctgtactattgt

SEQ ID NO: 130803 - DNA, 20 bp, Artificial Sequence
  chemically synthesized
taggaactcttacaatagta

SEQ ID NO: 130804 - DNA, 20 bp, Artificial Sequence
  chemically synthesized
gaactcttacaatagtacag

SEQ ID NO: 130805 - DNA, 20 bp, Artificial Sequence
  chemically synthesized
acccaagcattgcatttaag

SEQ ID NO: 130806 - DNA, 20 bp, Artificial Sequence
  chemically synthesized
aaacccaagcattgcattta

SEQ ID NO: 130807 - DNA, 20 bp, Artificial Sequence
  chemically synthesized
taaacccaagcattgcattt

SEQ ID NO: 130808 - DNA, 20 bp, Artificial Sequence
  chemically synthesized
agctccttaaatgcaatgct

SEQ ID NO: 130809 - DNA, 20 bp, Artificial Sequence
  chemically synthesized
gctccttaaatgcaatgctt

SEQ ID NO: 130810 - DNA, 20 bp, Artificial Sequence
  chemically synthesized
aaatgcaatgcttgggttta

SEQ ID NO: 130811 - DNA, 20 bp, Artificial Sequence
  chemically synthesized
tttttgtttcccataaaccc

SEQ ID NO: 130812 - DNA, 20 bp, Artificial Sequence
  chemically synthesized
aatgcaatgcttgggtttat

SEQ ID NO: 130813 - DNA, 20 bp, Artificial Sequence
  chemically synthesized
aacagtgggagcaattgaca

SEQ ID NO: 130814 - DNA, 20 bp, Artificial Sequence
  chemically synthesized
aaaacagtgggagcaattga

SEQ ID NO: 130815 - DNA, 20 bp, Artificial Sequence
  chemically synthesized
gaggtaaatgaaaacagtgg

SEQ ID NO: 130816 - DNA, 20 bp, Artificial Sequence
  chemically synthesized
aggaggtaaatgaaaacagt

SEQ ID NO: 130817 - DNA, 20 bp, Artificial Sequence
  chemically synthesized
caggaggtaaatgaaaacag

SEQ ID NO: 130818 - DNA, 20 bp, Artificial Sequence
  chemically synthesized
ttccaggaggtaaatgaaaa

SEQ ID NO: 130819 - DNA, 20 bp, Artificial Sequence
  chemically synthesized
cactgttttcatttacctcc

SEQ ID NO: 130820 - DNA, 20 bp, Artificial Sequence
  chemically synthesized
tatagttatgattttccagg

SEQ ID NO: 130821 - DNA, 20 bp, Artificial Sequence
  chemically synthesized
gtatagttatgattttccag

SEQ ID NO: 130822 - DNA, 20 bp, Artificial Sequence
  chemically synthesized
atgtatagttatgattttcc

SEQ ID NO: 130823 - DNA, 20 bp, Artificial Sequence
  chemically synthesized
gatgtatagttatgattttc

SEQ ID NO: 130824 - DNA, 20 bp, Artificial Sequence
  chemically synthesized
gaaaatcataactatacatc

SEQ ID NO: 130825 - DNA, 20 bp, Artificial Sequence
  chemically synthesized
gtctttcttctctggatgta

SEQ ID NO: 130826 - DNA, 20 bp, Artificial Sequence
  chemically synthesized
aaatcataactatacatcca

SEQ ID NO: 130827 - DNA, 20 bp, Artificial Sequence
  chemically synthesized
tcataactatacatccagag

SEQ ID NO: 130828 - DNA, 20 bp, Artificial Sequence
  chemically synthesized
aactatacatccagagaaga

SEQ ID NO: 130829 - DNA, 20 bp, Artificial Sequence
  chemically synthesized
ctctccaggtctttcttctc

SEQ ID NO: 130830 - DNA, 20 bp, Artificial Sequence
  chemically synthesized
acatccagagaagaaagacc

SEQ ID NO: 130831 - DNA, 20 bp, Artificial Sequence
  chemically synthesized
atccagagaagaaagacctg

SEQ ID NO: 130832 - DNA, 20 bp, Artificial Sequence
  chemically synthesized
ccagagaagaaagacctgga

SEQ ID NO: 130833 - DNA, 20 bp, Artificial Sequence
  chemically synthesized
agagaagaaagacctggaga

SEQ ID NO: 130834 - DNA, 20 bp, Artificial Sequence
  chemically synthesized
ccaaggtattgtctctctcc

SEQ ID NO: 130835 - DNA, 20 bp, Artificial Sequence
  chemically synthesized
accaaggtattgtctctctc

SEQ ID NO: 130836 - DNA, 20 bp, Artificial Sequence
  chemically synthesized
cctggagagagacaatacct

SEQ ID NO: 130837 - DNA, 20 bp, Artificial Sequence
  chemically synthesized
cgtagccatatgtttcacca

SEQ ID NO: 130838 - DNA, 20 bp, Artificial Sequence
  chemically synthesized
tcgtagccatatgtttcacc

SEQ ID NO: 130839 - DNA, 20 bp, Artificial Sequence
  chemically synthesized
caataccttggtgaaacata

SEQ ID NO: 130840 - DNA, 20 bp, Artificial Sequence
  chemically synthesized
aaacatatggctacgaaata

SEQ ID NO: 130841 - DNA, 20 bp, Artificial Sequence
  chemically synthesized
tattctgttcctgtatttcg

SEQ ID NO: 130842 - DNA, 20 bp, Artificial Sequence
  chemically synthesized
aacatatggctacgaaatac

SEQ ID NO: 130843 - DNA, 20 bp, Artificial Sequence
  chemically synthesized
atggctacgaaatacaggaa

SEQ ID NO: 130844 - DNA, 20 bp, Artificial Sequence
  chemically synthesized
tacgaaatacaggaacagaa

SEQ ID NO: 130845 - DNA, 20 bp, Artificial Sequence
  chemically synthesized
agaatttccctttaaaatta

SEQ ID NO: 130846 - DNA, 20 bp, Artificial Sequence
  chemically synthesized
gtataatcaccttaatttta

SEQ ID NO: 130847 - DNA, 20 bp, Artificial Sequence
  chemically synthesized
gagaatttccctttaaaatt

SEQ ID NO: 130848 - DNA, 20 bp, Artificial Sequence
  chemically synthesized
tataatcaccttaattttaa

SEQ ID NO: 130849 - DNA, 20 bp, Artificial Sequence
  chemically synthesized
ataatcaccttaattttaaa

SEQ ID NO: 130850 - DNA, 20 bp, Artificial Sequence
  chemically synthesized
aaagggaaattctcctgaaa

SEQ ID NO: 130851 - DNA, 20 bp, Artificial Sequence
  chemically synthesized
ctatgggaattctgtttcag

SEQ ID NO: 130852 - DNA, 20 bp, Artificial Sequence
  chemically synthesized
tactatgggaattctgtttc

SEQ ID NO: 130853 - DNA, 20 bp, Artificial Sequence
  chemically synthesized
ttactatgggaattctgttt

SEQ ID NO: 130854 - DNA, 20 bp, Artificial Sequence
  chemically synthesized
ctcctgaaacagaattccca

SEQ ID NO: 130855 - DNA, 20 bp, Artificial Sequence
  chemically synthesized
aaacagaattcccatagtaa

SEQ ID NO: 130856 - DNA, 20 bp, Artificial Sequence
  chemically synthesized
attttttttccttttactat

SEQ ID NO: 130857 - DNA, 20 bp, Artificial Sequence
  chemically synthesized
aacagaattcccatagtaaa

SEQ ID NO: 130858 - DNA, 20 bp, Artificial Sequence
  chemically synthesized
aattttttttccttttacta

SEQ ID NO: 130859 - DNA, 20 bp, Artificial Sequence
  chemically synthesized
tagtaaaaggaaaaaaaatt

SEQ ID NO: 130860 - DNA, 20 bp, Artificial Sequence
  chemically synthesized
agtaaaaggaaaaaaaattg

SEQ ID NO: 130861 - DNA, 20 bp, Artificial Sequence
  chemically synthesized
aaaattgaggaatttaaaat

SEQ ID NO: 130862 - DNA, 20 bp, Artificial Sequence
  chemically synthesized
aaattgaggaatttaaaata

SEQ ID NO: 130863 - DNA, 20 bp, Artificial Sequence
  chemically synthesized
aataaggtaatccatgtgaa

SEQ ID NO: 130864 - DNA, 20 bp, Artificial Sequence
  chemically synthesized
tttacaaagcactgttcaca

SEQ ID NO: 130865 - DNA, 20 bp, Artificial Sequence
  chemically synthesized
tgacagttttgcagtttaca

SEQ ID NO: 130866 - DNA, 20 bp, Artificial Sequence
  chemically synthesized
attatttgctgacagttttg

SEQ ID NO: 130867 - DNA, 20 bp, Artificial Sequence
  chemically synthesized
tttgtaaactgcaaaactgt

SEQ ID NO: 130868 - DNA, 20 bp, Artificial Sequence
  chemically synthesized
cataccttattatttgctga

SEQ ID NO: 130869 - DNA, 20 bp, Artificial Sequence
  chemically synthesized
caaaactgtcagcaaataat

SEQ ID NO: 130870 - DNA, 20 bp, Artificial Sequence
  chemically synthesized
aaaactgtcagcaaataata

SEQ ID NO: 130871 - DNA, 20 bp, Artificial Sequence
  chemically synthesized
attgttattttctttaaaat

SEQ ID NO: 130872 - DNA, 20 bp, Artificial Sequence
  chemically synthesized
ctattctgtatcttatttta

SEQ ID NO: 130873 - DNA, 20 bp, Artificial Sequence
  chemically synthesized
attttctttaaaataagata

SEQ ID NO: 130874 - DNA, 20 bp, Artificial Sequence
  chemically synthesized
ctttaaaataagatacagaa

SEQ ID NO: 130875 - DNA, 20 bp, Artificial Sequence
  chemically synthesized
cccttggctgcaaatagtat

SEQ ID NO: 130876 - DNA, 20 bp, Artificial Sequence
  chemically synthesized
tcccttggctgcaaatagta

SEQ ID NO: 130877 - DNA, 20 bp, Artificial Sequence
  chemically synthesized
cattttgcctatactatttg

SEQ ID NO: 130878 - DNA, 20 bp, Artificial Sequence
  chemically synthesized
gatcttcccttggctgcaaa

SEQ ID NO: 130879 - DNA, 20 bp, Artificial Sequence
  chemically synthesized
tgcctatactatttgcagcc

SEQ ID NO: 130880 - DNA, 20 bp, Artificial Sequence
  chemically synthesized
gcctatactatttgcagcca

SEQ ID NO: 130881 - DNA, 20 bp, Artificial Sequence
  chemically synthesized
cctatactatttgcagccaa

SEQ ID NO: 130882 - DNA, 20 bp, Artificial Sequence
  chemically synthesized
atactatttgcagccaaggg

SEQ ID NO: 130883 - DNA, 20 bp, Artificial Sequence
  chemically synthesized
aaaaggataggatcttccct

SEQ ID NO: 130884 - DNA, 20 bp, Artificial Sequence
  chemically synthesized
tttatatgttttaaaaggat

SEQ ID NO: 130885 - DNA, 20 bp, Artificial Sequence
  chemically synthesized
ttttatatgttttaaaagga

SEQ ID NO: 130886 - DNA, 20 bp, Artificial Sequence
  chemically synthesized
ttagttttatatgttttaaa

SEQ ID NO: 130887 - DNA, 20 bp, Artificial Sequence
  chemically synthesized
attagttttatatgttttaa

SEQ ID NO: 130888 - DNA, 20 bp, Artificial Sequence
  chemically synthesized
ttgtttgggttaaaaagcat

SEQ ID NO: 130889 - DNA, 20 bp, Artificial Sequence
  chemically synthesized
gtctttttgtttgggttaaa

SEQ ID NO: 130890 - DNA, 20 bp, Artificial Sequence
  chemically synthesized
tgctttttaacccaaacaaa

SEQ ID NO: 130891 - DNA, 20 bp, Artificial Sequence
  chemically synthesized
gtatgtgtgtctttttgttt

SEQ ID NO: 130892 - DNA, 20 bp, Artificial Sequence
  chemically synthesized
cgtatgtgtgtctttttgtt

SEQ ID NO: 130893 - DNA, 20 bp, Artificial Sequence
  chemically synthesized
aaaagacacacatacgttgc

SEQ ID NO: 130894 - DNA, 20 bp, Artificial Sequence
  chemically synthesized
acacatacgttgccagaact

SEQ ID NO: 130895 - DNA, 20 bp, Artificial Sequence
  chemically synthesized
tcttgcttgagaccaagttc

SEQ ID NO: 130896 - DNA, 20 bp, Artificial Sequence
  chemically synthesized
cgttgccagaacttggtctc

SEQ ID NO: 130897 - DNA, 20 bp, Artificial Sequence
  chemically synthesized
atatagtcttgcttgagacc

SEQ ID NO: 130898 - DNA, 20 bp, Artificial Sequence
  chemically synthesized
gccagaacttggtctcaagc

SEQ ID NO: 130899 - DNA, 20 bp, Artificial Sequence
  chemically synthesized
agaaaaatatagtcttgctt

SEQ ID NO: 130900 - DNA, 20 bp, Artificial Sequence
  chemically synthesized
ttaaagaacttagaaaaata

SEQ ID NO: 130901 - DNA, 20 bp, Artificial Sequence
  chemically synthesized
aagcaagactatatttttct

SEQ ID NO: 130902 - DNA, 20 bp, Artificial Sequence
  chemically synthesized
tctttatttattaaagaact

SEQ ID NO: 130903 - DNA, 20 bp, Artificial Sequence
  chemically synthesized
aaatggctctttatttatta

SEQ ID NO: 130904 - DNA, 20 bp, Artificial Sequence
  chemically synthesized
tctaagttctttaataaata

SEQ ID NO: 130905 - DNA, 20 bp, Artificial Sequence
  chemically synthesized
taagttctttaataaataaa

SEQ ID NO: 130906 - DNA, 20 bp, Artificial Sequence
  chemically synthesized
ttaataaataaagagccatt

SEQ ID NO: 130907 - DNA, 20 bp, Artificial Sequence
  chemically synthesized
atcagtattgaatgaccaaa

SEQ ID NO: 130908 - DNA, 20 bp, Artificial Sequence
  chemically synthesized
acaaatatataaagacaaat

SEQ ID NO: 130909 - DNA, 20 bp, Artificial Sequence
  chemically synthesized
aaataattaacaaatatata

SEQ ID NO: 130910 - DNA, 20 bp, Artificial Sequence
  chemically synthesized
tgtgatgaatgcatacataa

SEQ ID NO: 130911 - DNA, 20 bp, Artificial Sequence
  chemically synthesized
ttgtgatgaatgcatacata

SEQ ID NO: 130912 - DNA, 20 bp, Artificial Sequence
  chemically synthesized
ttatataagagattataaaa

SEQ ID NO: 130913 - DNA, 20 bp, Artificial Sequence
  chemically synthesized
actcaatctcagttatataa

SEQ ID NO: 130914 - DNA, 20 bp, Artificial Sequence
  chemically synthesized
taactcaatctcagttatat

SEQ ID NO: 130915 - DNA, 20 bp, Artificial Sequence
  chemically synthesized
ttataatctcttatataact

SEQ ID NO: 130916 - DNA, 20 bp, Artificial Sequence
  chemically synthesized
tctcttatataactgagatt

SEQ ID NO: 130917 - DNA, 20 bp, Artificial Sequence
  chemically synthesized
tatacatcctaactcaatct

SEQ ID NO: 130918 - DNA, 20 bp, Artificial Sequence
  chemically synthesized
ttatataactgagattgagt

SEQ ID NO: 130919 - DNA, 20 bp, Artificial Sequence
  chemically synthesized
tatataactgagattgagtt

SEQ ID NO: 130920 - DNA, 20 bp, Artificial Sequence
  chemically synthesized
ttaggatgtatacaaaatca

SEQ ID NO: 130921 - DNA, 20 bp, Artificial Sequence
  chemically synthesized
atacaaaatcaaagctaaaa

SEQ ID NO: 130922 - DNA, 20 bp, Artificial Sequence
  chemically synthesized
caaaatcaaagctaaaaaag

SEQ ID NO: 130923 - DNA, 20 bp, Artificial Sequence
  chemically synthesized
aatgtttattacttcttttt

SEQ ID NO: 130924 - DNA, 20 bp, Artificial Sequence
  chemically synthesized
agaagtaataaacattctgt

SEQ ID NO: 130925 - DNA, 20 bp, Artificial Sequence
  chemically synthesized
tcaattatgtaatttactta

SEQ ID NO: 130926 - DNA, 20 bp, Artificial Sequence
  chemically synthesized
tgtaagtaaattacataatt

SEQ ID NO: 130927 - DNA, 20 bp, Artificial Sequence
  chemically synthesized
attgagtattcacatgcctt

SEQ ID NO: 130928 - DNA, 20 bp, Artificial Sequence
  chemically synthesized
cgtgaaagcatagattccaa

SEQ ID NO: 130929 - DNA, 20 bp, Artificial Sequence
  chemically synthesized
tcgtgaaagcatagattcca

SEQ ID NO: 130930 - DNA, 20 bp, Artificial Sequence
  chemically synthesized
tggagtctatcgtgaaagca

SEQ ID NO: 130931 - DNA, 20 bp, Artificial Sequence
  chemically synthesized
tggaatctatgctttcacga

SEQ ID NO: 130932 - DNA, 20 bp, Artificial Sequence
  chemically synthesized
ataagtggagtctatcgtga

SEQ ID NO: 130933 - DNA, 20 bp, Artificial Sequence
  chemically synthesized
agtgatgcattcaataagtg

SEQ ID NO: 130934 - DNA, 20 bp, Artificial Sequence
  chemically synthesized
ttagtgatgcattcaataag

SEQ ID NO: 130935 - DNA, 20 bp, Artificial Sequence
  chemically synthesized
taattagtgatgcattcaat

SEQ ID NO: 130936 - DNA, 20 bp, Artificial Sequence
  chemically synthesized
ttgaatgcatcactaattaa

SEQ ID NO: 130937 - DNA, 20 bp, Artificial Sequence
  chemically synthesized
tgaatgcatcactaattaaa

SEQ ID NO: 130938 - DNA, 20 bp, Artificial Sequence
  chemically synthesized
ttttagtttttccttttaat

SEQ ID NO: 130939 - DNA, 20 bp, Artificial Sequence
  chemically synthesized
attaaaaggaaaaactaaaa

SEQ ID NO: 130940 - DNA, 20 bp, Artificial Sequence
  chemically synthesized
gctatgaaaattttcttttt

SEQ ID NO: 130941 - DNA, 20 bp, Artificial Sequence
  chemically synthesized
actaaaaaagaaaattttca

SEQ ID NO: 130942 - DNA, 20 bp, Artificial Sequence
  chemically synthesized
aagaaaattttcatagctcc

SEQ ID NO: 130943 - DNA, 20 bp, Artificial Sequence
  chemically synthesized
aaaattttcatagctcccag

SEQ ID NO: 130944 - DNA, 20 bp, Artificial Sequence
  chemically synthesized
ataactcacaaggccactgg

SEQ ID NO: 130945 - DNA, 20 bp, Artificial Sequence
  chemically synthesized
ccataactcacaaggccact

SEQ ID NO: 130946 - DNA, 20 bp, Artificial Sequence
  chemically synthesized
accataactcacaaggccac

SEQ ID NO: 130947 - DNA, 20 bp, Artificial Sequence
  chemically synthesized
atagctcccagtggccttgt

SEQ ID NO: 130948 - DNA, 20 bp, Artificial Sequence
  chemically synthesized
aatctttaccataactcaca

SEQ ID NO: 130949 - DNA, 20 bp, Artificial Sequence
  chemically synthesized
aaatctttaccataactcac

SEQ ID NO: 130950 - DNA, 20 bp, Artificial Sequence
  chemically synthesized
cccagtggccttgtgagtta

SEQ ID NO: 130951 - DNA, 20 bp, Artificial Sequence
  chemically synthesized
tggccttgtgagttatggta

SEQ ID NO: 130952 - DNA, 20 bp, Artificial Sequence
  chemically synthesized
gtgagttatggtaaagattt

SEQ ID NO: 130953 - DNA, 20 bp, Artificial Sequence
  chemically synthesized
aagattttggtcttcaacct

SEQ ID NO: 130954 - DNA, 20 bp, Artificial Sequence
  chemically synthesized
ttcccattgcactgaggttg

SEQ ID NO: 130955 - DNA, 20 bp, Artificial Sequence
  chemically synthesized
agtggattcccattgcactg

SEQ ID NO: 130956 - DNA, 20 bp, Artificial Sequence
  chemically synthesized
ggtcttcaacctcagtgcaa

SEQ ID NO: 130957 - DNA, 20 bp, Artificial Sequence
  chemically synthesized
cagtggattcccattgcact

SEQ ID NO: 130958 - DNA, 20 bp, Artificial Sequence
  chemically synthesized
gtcttcaacctcagtgcaat

SEQ ID NO: 130959 - DNA, 20 bp, Artificial Sequence
  chemically synthesized
gtgcaatgggaatccactga

SEQ ID NO: 130960 - DNA, 20 bp, Artificial Sequence
  chemically synthesized
tgcaatgggaatccactgaa

SEQ ID NO: 130961 - DNA, 20 bp, Artificial Sequence
  chemically synthesized
ccctgctttaaacctttcag

SEQ ID NO: 130962 - DNA, 20 bp, Artificial Sequence
  chemically synthesized
cttccctgctttaaaccttt

SEQ ID NO: 130963 - DNA, 20 bp, Artificial Sequence
  chemically synthesized
ggaatccactgaaaggttta

SEQ ID NO: 130964 - DNA, 20 bp, Artificial Sequence
  chemically synthesized
atccactgaaaggtttaaag

SEQ ID NO: 130965 - DNA, 20 bp, Artificial Sequence
  chemically synthesized
tccactgaaaggtttaaagc

SEQ ID NO: 130966 - DNA, 20 bp, Artificial Sequence
  chemically synthesized
ccactgaaaggtttaaagca

SEQ ID NO: 130967 - DNA, 20 bp, Artificial Sequence
  chemically synthesized
ctgaaaggtttaaagcaggg

SEQ ID NO: 130968 - DNA, 20 bp, Artificial Sequence
  chemically synthesized
ggaagtgacaccgtctaatc

SEQ ID NO: 130969 - DNA, 20 bp, Artificial Sequence
  chemically synthesized
gttttcaagcccagattaga

SEQ ID NO: 130970 - DNA, 20 bp, Artificial Sequence
  chemically synthesized
gaagtgacaccgtctaatct

SEQ ID NO: 130971 - DNA, 20 bp, Artificial Sequence
  chemically synthesized
taatgttttcaagcccagat

SEQ ID NO: 130972 - DNA, 20 bp, Artificial Sequence
  chemically synthesized
atgactaatgttttcaagcc

SEQ ID NO: 130973 - DNA, 20 bp, Artificial Sequence
  chemically synthesized
gcaacatgactaatgttttc

SEQ ID NO: 130974 - DNA, 20 bp, Artificial Sequence
  chemically synthesized
taatctgggcttgaaaacat

SEQ ID NO: 130975 - DNA, 20 bp, Artificial Sequence
  chemically synthesized
acattagtcatgttgctaat

SEQ ID NO: 130976 - DNA, 20 bp, Artificial Sequence
  chemically synthesized
attagtcatgttgctaattg

SEQ ID NO: 130977 - DNA, 20 bp, Artificial Sequence
  chemically synthesized
tagtcatgttgctaattgga

SEQ ID NO: 130978 - DNA, 20 bp, Artificial Sequence
  chemically synthesized
cctccaatctactctccaat

SEQ ID NO: 130979 - DNA, 20 bp, Artificial Sequence
  chemically synthesized
tcatgttgctaattggagag

SEQ ID NO: 130980 - DNA, 20 bp, Artificial Sequence
  chemically synthesized
ttgctaattggagagtagat

SEQ ID NO: 130981 - DNA, 20 bp, Artificial Sequence
  chemically synthesized
gctaattggagagtagattg

SEQ ID NO: 130982 - DNA, 20 bp, Artificial Sequence
  chemically synthesized
ctaattggagagtagattgg

SEQ ID NO: 130983 - DNA, 20 bp, Artificial Sequence
  chemically synthesized
taattggagagtagattgga

SEQ ID NO: 130984 - DNA, 20 bp, Artificial Sequence
  chemically synthesized
aattggagagtagattggag

SEQ ID NO: 130985 - DNA, 20 bp, Artificial Sequence
  chemically synthesized
ttggagagtagattggaggg

SEQ ID NO: 130986 - DNA, 20 bp, Artificial Sequence
  chemically synthesized
tggagagtagattggagggg

SEQ ID NO: 130987 - DNA, 20 bp, Artificial Sequence
  chemically synthesized
ggagagtagattggagggga

SEQ ID NO: 130988 - DNA, 20 bp, Artificial Sequence
  chemically synthesized
gattggaggggagggcaaaa

SEQ ID NO: 130989 - DNA, 20 bp, Artificial Sequence
  chemically synthesized
aggggagggcaaaaaagatg

SEQ ID NO: 130990 - DNA, 20 bp, Artificial Sequence
  chemically synthesized
gcaaaaaagatgcagaaaaa

SEQ ID NO: 130991 - DNA, 20 bp, Artificial Sequence
  chemically synthesized
aaaaaagatgcagaaaaaca

SEQ ID NO: 130992 - DNA, 20 bp, Artificial Sequence
  chemically synthesized
aagatgcagaaaaacagagt

SEQ ID NO: 130993 - DNA, 20 bp, Artificial Sequence
  chemically synthesized
agaaaaacagagtaagatgt

SEQ ID NO: 130994 - DNA, 20 bp, Artificial Sequence
  chemically synthesized
aacagagtaagatgttagca

SEQ ID NO: 130995 - DNA, 20 bp, Artificial Sequence
  chemically synthesized
acagagtaagatgttagcat

SEQ ID NO: 130996 - DNA, 20 bp, Artificial Sequence
  chemically synthesized
agagtaagatgttagcatag

SEQ ID NO: 130997 - DNA, 20 bp, Artificial Sequence
  chemically synthesized
aagatgttagcataggagtc

SEQ ID NO: 130998 - DNA, 20 bp, Artificial Sequence
  chemically synthesized
agatgttagcataggagtcc

SEQ ID NO: 130999 - DNA, 20 bp, Artificial Sequence
  chemically synthesized
ttagcataggagtccaggca

SEQ ID NO: 131000 - DNA, 20 bp, Artificial Sequence
  chemically synthesized
acccaccatcaggctgtgcc

SEQ ID NO: 131001 - DNA, 20 bp, Artificial Sequence
  chemically synthesized
ggagtccaggcacagcctga

SEQ ID NO: 131002 - DNA, 20 bp, Artificial Sequence
  chemically synthesized
gtccaggcacagcctgatgg

SEQ ID NO: 131003 - DNA, 20 bp, Artificial Sequence
  chemically synthesized
tccaggcacagcctgatggt

SEQ ID NO: 131004 - DNA, 20 bp, Artificial Sequence
  chemically synthesized
tccatctaccacccaccatc

SEQ ID NO: 131005 - DNA, 20 bp, Artificial Sequence
  chemically synthesized
ttccatctaccacccaccat

SEQ ID NO: 131006 - DNA, 20 bp, Artificial Sequence
  chemically synthesized
aggcacagcctgatggtggg

SEQ ID NO: 131007 - DNA, 20 bp, Artificial Sequence
  chemically synthesized
cacagcctgatggtgggtgg

SEQ ID NO: 131008 - DNA, 20 bp, Artificial Sequence
  chemically synthesized
gcctgatggtgggtggtaga

SEQ ID NO: 131009 - DNA, 20 bp, Artificial Sequence
  chemically synthesized
gatggtgggtggtagatgga

SEQ ID NO: 131010 - DNA, 20 bp, Artificial Sequence
  chemically synthesized
tgggtggtagatggaaagat

SEQ ID NO: 131011 - DNA, 20 bp, Artificial Sequence
  chemically synthesized
ggtagatggaaagataagaa

SEQ ID NO: 131012 - DNA, 20 bp, Artificial Sequence
  chemically synthesized
atggaaagataagaaaagat

SEQ ID NO: 131013 - DNA, 20 bp, Artificial Sequence
  chemically synthesized
aaagataagaaaagattagt

SEQ ID NO: 131014 - DNA, 20 bp, Artificial Sequence
  chemically synthesized
aagaaaagattagtaagatt

SEQ ID NO: 131015 - DNA, 20 bp, Artificial Sequence
  chemically synthesized
aaaagattagtaagatttag

SEQ ID NO: 131016 - DNA, 20 bp, Artificial Sequence
  chemically synthesized
gatttagaagataaaatgta

SEQ ID NO: 131017 - DNA, 20 bp, Artificial Sequence
  chemically synthesized
atttagaagataaaatgtac

SEQ ID NO: 131018 - DNA, 20 bp, Artificial Sequence
  chemically synthesized
aaatgtacaggactttgccc

SEQ ID NO: 131019 - DNA, 20 bp, Artificial Sequence
  chemically synthesized
cagagggaagaacttgggca

SEQ ID NO: 131020 - DNA, 20 bp, Artificial Sequence
  chemically synthesized
ctaggcagagggaagaactt

SEQ ID NO: 131021 - DNA, 20 bp, Artificial Sequence
  chemically synthesized
tctaggcagagggaagaact

SEQ ID NO: 131022 - DNA, 20 bp, Artificial Sequence
  chemically synthesized
gatgcattctaggcagaggg

SEQ ID NO: 131023 - DNA, 20 bp, Artificial Sequence
  chemically synthesized
cccaagttcttccctctgcc

SEQ ID NO: 131024 - DNA, 20 bp, Artificial Sequence
  chemically synthesized
gatgatgcattctaggcaga

SEQ ID NO: 131025 - DNA, 20 bp, Artificial Sequence
  chemically synthesized
agatgatgcattctaggcag

SEQ ID NO: 131026 - DNA, 20 bp, Artificial Sequence
  chemically synthesized
cagatgatgcattctaggca

SEQ ID NO: 131027 - DNA, 20 bp, Artificial Sequence
  chemically synthesized
accagatgatgcattctagg

SEQ ID NO: 131028 - DNA, 20 bp, Artificial Sequence
  chemically synthesized
tgtaccagatgatgcattct

SEQ ID NO: 131029 - DNA, 20 bp, Artificial Sequence
  chemically synthesized
atgtaccagatgatgcattc

SEQ ID NO: 131030 - DNA, 20 bp, Artificial Sequence
  chemically synthesized
tctgcctagaatgcatcatc

SEQ ID NO: 131031 - DNA, 20 bp, Artificial Sequence
  chemically synthesized
agaatgcatcatctggtaca

SEQ ID NO: 131032 - DNA, 20 bp, Artificial Sequence
  chemically synthesized
atgaagcacctgccatgtac

SEQ ID NO: 131033 - DNA, 20 bp, Artificial Sequence
  chemically synthesized
atgcatcatctggtacatgg

SEQ ID NO: 131034 - DNA, 20 bp, Artificial Sequence
  chemically synthesized
tgcatcatctggtacatggc

SEQ ID NO: 131035 - DNA, 20 bp, Artificial Sequence
  chemically synthesized
tcccatcaaaagcattcatg

SEQ ID NO: 131036 - DNA, 20 bp, Artificial Sequence
  chemically synthesized
tgcttcatgaatgcttttga

SEQ ID NO: 131037 - DNA, 20 bp, Artificial Sequence
  chemically synthesized
gcttcatgaatgcttttgat

SEQ ID NO: 131038 - DNA, 20 bp, Artificial Sequence
  chemically synthesized
ccctgttcatttcccatcaa

SEQ ID NO: 131039 - DNA, 20 bp, Artificial Sequence
  chemically synthesized
tgcttttgatgggaaatgaa

SEQ ID NO: 131040 - DNA, 20 bp, Artificial Sequence
  chemically synthesized
gcttttgatgggaaatgaac

SEQ ID NO: 131041 - DNA, 20 bp, Artificial Sequence
  chemically synthesized
cttttgatgggaaatgaaca

SEQ ID NO: 131042 - DNA, 20 bp, Artificial Sequence
  chemically synthesized
agaccccttaaaaaattgtg

SEQ ID NO: 131043 - DNA, 20 bp, Artificial Sequence
  chemically synthesized
aagaccccttaaaaaattgt

SEQ ID NO: 131044 - DNA, 20 bp, Artificial Sequence
  chemically synthesized
taaaaacctcacaatttttt

SEQ ID NO: 131045 - DNA, 20 bp, Artificial Sequence
  chemically synthesized
aaaaacctcacaatttttta

SEQ ID NO: 131046 - DNA, 20 bp, Artificial Sequence
  chemically synthesized
aaaacctcacaattttttaa

SEQ ID NO: 131047 - DNA, 20 bp, Artificial Sequence
  chemically synthesized
aaacctcacaattttttaag

SEQ ID NO: 131048 - DNA, 20 bp, Artificial Sequence
  chemically synthesized
cacaattttttaaggggtct

SEQ ID NO: 131049 - DNA, 20 bp, Artificial Sequence
  chemically synthesized
acaattttttaaggggtctt

SEQ ID NO: 131050 - DNA, 20 bp, Artificial Sequence
  chemically synthesized
aattttttaaggggtcttag

SEQ ID NO: 131051 - DNA, 20 bp, Artificial Sequence
  chemically synthesized
atggcagggccaagactcct

SEQ ID NO: 131052 - DNA, 20 bp, Artificial Sequence
  chemically synthesized
ttaaggggtcttaggagtct

SEQ ID NO: 131053 - DNA, 20 bp, Artificial Sequence
  chemically synthesized
gagaaaagtatggcagggcc

SEQ ID NO: 131054 - DNA, 20 bp, Artificial Sequence
  chemically synthesized
caagagagaaaagtatggca

SEQ ID NO: 131055 - DNA, 20 bp, Artificial Sequence
  chemically synthesized
gcaagagagaaaagtatggc

SEQ ID NO: 131056 - DNA, 20 bp, Artificial Sequence
  chemically synthesized
tgcaagagagaaaagtatgg

SEQ ID NO: 131057 - DNA, 20 bp, Artificial Sequence
  chemically synthesized
tcctgcaagagagaaaagta

SEQ ID NO: 131058 - DNA, 20 bp, Artificial Sequence
  chemically synthesized
ctttttcctgcaagagagaa

SEQ ID NO: 131059 - DNA, 20 bp, Artificial Sequence
  chemically synthesized
tgccatacttttctctcttg

SEQ ID NO: 131060 - DNA, 20 bp, Artificial Sequence
  chemically synthesized
gccatacttttctctcttgc

SEQ ID NO: 131061 - DNA, 20 bp, Artificial Sequence
  chemically synthesized
ttcatctttttcctgcaaga

SEQ ID NO: 131062 - DNA, 20 bp, Artificial Sequence
  chemically synthesized
gtttcatctttttcctgcaa

SEQ ID NO: 131063 - DNA, 20 bp, Artificial Sequence
  chemically synthesized
tagtttcatctttttcctgc

SEQ ID NO: 131064 - DNA, 20 bp, Artificial Sequence
  chemically synthesized
cttttctctcttgcaggaaa

SEQ ID NO: 131065 - DNA, 20 bp, Artificial Sequence
  chemically synthesized
caggaaaaagatgaaactaa

SEQ ID NO: 131066 - DNA, 20 bp, Artificial Sequence
  chemically synthesized
aagcagtggtcacagtccat

SEQ ID NO: 131067 - DNA, 20 bp, Artificial Sequence
  chemically synthesized
ttgctgaaaagcagtggtca

SEQ ID NO: 131068 - DNA, 20 bp, Artificial Sequence
  chemically synthesized
tgtactttgctgaaaagcag

SEQ ID NO: 131069 - DNA, 20 bp, Artificial Sequence
  chemically synthesized
ggactgtgaccactgctttt

SEQ ID NO: 131070 - DNA, 20 bp, Artificial Sequence
  chemically synthesized
aggtgtactttgctgaaaag

SEQ ID NO: 131071 - DNA, 20 bp, Artificial Sequence
  chemically synthesized
gtgaccactgcttttcagca

SEQ ID NO: 131072 - DNA, 20 bp, Artificial Sequence
  chemically synthesized
cctaggtgtactttgctgaa

SEQ ID NO: 131073 - DNA, 20 bp, Artificial Sequence
  chemically synthesized
gcttttcagcaaagtacacc

SEQ ID NO: 131074 - DNA, 20 bp, Artificial Sequence
  chemically synthesized
cttttcagcaaagtacacct

SEQ ID NO: 131075 - DNA, 20 bp, Artificial Sequence
  chemically synthesized
tggaagaagcacagtgacct

SEQ ID NO: 131076 - DNA, 20 bp, Artificial Sequence
  chemically synthesized
gtggaagaagcacagtgacc

SEQ ID NO: 131077 - DNA, 20 bp, Artificial Sequence
  chemically synthesized
cctgtattgtggaagaagca

SEQ ID NO: 131078 - DNA, 20 bp, Artificial Sequence
  chemically synthesized
tgcagcctgtattgtggaag

SEQ ID NO: 131079 - DNA, 20 bp, Artificial Sequence
  chemically synthesized
acatgcagcctgtattgtgg

SEQ ID NO: 131080 - DNA, 20 bp, Artificial Sequence
  chemically synthesized
actgtgcttcttccacaata

SEQ ID NO: 131081 - DNA, 20 bp, Artificial Sequence
  chemically synthesized
ctgtgcttcttccacaatac

SEQ ID NO: 131082 - DNA, 20 bp, Artificial Sequence
  chemically synthesized
acgacatgcagcctgtattg

SEQ ID NO: 131083 - DNA, 20 bp, Artificial Sequence
  chemically synthesized
tgattttcagacacgacatg

SEQ ID NO: 131084 - DNA, 20 bp, Artificial Sequence
  chemically synthesized
gctttaagcaaaatgatttt

SEQ ID NO: 131085 - DNA, 20 bp, Artificial Sequence
  chemically synthesized
tctgaaaatcattttgctta

SEQ ID NO: 131086 - DNA, 20 bp, Artificial Sequence
  chemically synthesized
tttcccaacaaagcagcttt

SEQ ID NO: 131087 - DNA, 20 bp, Artificial Sequence
  chemically synthesized
tttgcttaaagctgctttgt

SEQ ID NO: 131088 - DNA, 20 bp, Artificial Sequence
  chemically synthesized
ttgcttaaagctgctttgtt

SEQ ID NO: 131089 - DNA, 20 bp, Artificial Sequence
  chemically synthesized
agtaatatttcccaacaaag

SEQ ID NO: 131090 - DNA, 20 bp, Artificial Sequence
  chemically synthesized
gcaagtaatatttcccaaca

SEQ ID NO: 131091 - DNA, 20 bp, Artificial Sequence
  chemically synthesized
gttgggaaatattacttgct

SEQ ID NO: 131092 - DNA, 20 bp, Artificial Sequence
  chemically synthesized
tcaagctagaaaagccaagc

SEQ ID NO: 131093 - DNA, 20 bp, Artificial Sequence
  chemically synthesized
aaagtcaagctagaaaagcc

SEQ ID NO: 131094 - DNA, 20 bp, Artificial Sequence
  chemically synthesized
tattacttgcttggcttttc

SEQ ID NO: 131095 - DNA, 20 bp, Artificial Sequence
  chemically synthesized
aactcaaagtcaagctagaa

SEQ ID NO: 131096 - DNA, 20 bp, Artificial Sequence
  chemically synthesized
caaataactcaaagtcaagc

SEQ ID NO: 131097 - DNA, 20 bp, Artificial Sequence
  chemically synthesized
ggcttttctagcttgacttt

SEQ ID NO: 131098 - DNA, 20 bp, Artificial Sequence
  chemically synthesized
atctcaaataactcaaagtc

SEQ ID NO: 131099 - DNA, 20 bp, Artificial Sequence
  chemically synthesized
tatttatctcaaataactca

SEQ ID NO: 131100 - DNA, 20 bp, Artificial Sequence
  chemically synthesized
agcttgactttgagttattt

SEQ ID NO: 131101 - DNA, 20 bp, Artificial Sequence
  chemically synthesized
ttgagttatttgagataaat

SEQ ID NO: 131102 - DNA, 20 bp, Artificial Sequence
  chemically synthesized
gttatttgagataaataagt

SEQ ID NO: 131103 - DNA, 20 bp, Artificial Sequence
  chemically synthesized
tatttgagataaataagtaa

SEQ ID NO: 131104 - DNA, 20 bp, Artificial Sequence
  chemically synthesized
tttgagataaataagtaaga

SEQ ID NO: 131105 - DNA, 20 bp, Artificial Sequence
  chemically synthesized
agataaataagtaagagaga

SEQ ID NO: 131106 - DNA, 20 bp, Artificial Sequence
  chemically synthesized
tttagactatgatagagaaa

SEQ ID NO: 131107 - DNA, 20 bp, Artificial Sequence
  chemically synthesized
ttttagactatgatagagaa

SEQ ID NO: 131108 - DNA, 20 bp, Artificial Sequence
  chemically synthesized
tttttagactatgatagaga

SEQ ID NO: 131109 - DNA, 20 bp, Artificial Sequence
  chemically synthesized
agttgaccctttctctatca

SEQ ID NO: 131110 - DNA, 20 bp, Artificial Sequence
  chemically synthesized
ttattttttagactatgata

SEQ ID NO: 131111 - DNA, 20 bp, Artificial Sequence
  chemically synthesized
ctttattttttagactatga

SEQ ID NO: 131112 - DNA, 20 bp, Artificial Sequence
  chemically synthesized
ctatcatagtctaaaaaata

SEQ ID NO: 131113 - DNA, 20 bp, Artificial Sequence
  chemically synthesized
caacagcaacctttattttt

SEQ ID NO: 131114 - DNA, 20 bp, Artificial Sequence
  chemically synthesized
tatcatagtctaaaaaataa

SEQ ID NO: 131115 - DNA, 20 bp, Artificial Sequence
  chemically synthesized
taaaaaataaaggttgctgt

SEQ ID NO: 131116 - DNA, 20 bp, Artificial Sequence
  chemically synthesized
gggtccgtgttgatttccaa

SEQ ID NO: 131117 - DNA, 20 bp, Artificial Sequence
  chemically synthesized
gttgctgttggaaatcaaca

SEQ ID NO: 131118 - DNA, 20 bp, Artificial Sequence
  chemically synthesized
cacattcaacaagaaattgt

SEQ ID NO: 131119 - DNA, 20 bp, Artificial Sequence
  chemically synthesized
ccacattcaacaagaaattg

SEQ ID NO: 131120 - DNA, 20 bp, Artificial Sequence
  chemically synthesized
attataattccacattcaac

SEQ ID NO: 131121 - DNA, 20 bp, Artificial Sequence
  chemically synthesized
ccacaatttcttgttgaatg

SEQ ID NO: 131122 - DNA, 20 bp, Artificial Sequence
  chemically synthesized
tatattacatttcatcatga

SEQ ID NO: 131123 - DNA, 20 bp, Artificial Sequence
  chemically synthesized
ctatattacatttcatcatg

SEQ ID NO: 131124 - DNA, 20 bp, Artificial Sequence
  chemically synthesized
tctatattacatttcatcat

SEQ ID NO: 131125 - DNA, 20 bp, Artificial Sequence
  chemically synthesized
cctcatgatgaaatgtaata

SEQ ID NO: 131126 - DNA, 20 bp, Artificial Sequence
  chemically synthesized
atgatgaaatgtaatataga

SEQ ID NO: 131127 - DNA, 20 bp, Artificial Sequence
  chemically synthesized
aatatagacagtttgccata

SEQ ID NO: 131128 - DNA, 20 bp, Artificial Sequence
  chemically synthesized
agacagtttgccatatggaa

SEQ ID NO: 131129 - DNA, 20 bp, Artificial Sequence
  chemically synthesized
cctatttcatctattccata

SEQ ID NO: 131130 - DNA, 20 bp, Artificial Sequence
  chemically synthesized
gccatatggaatagatgaaa

SEQ ID NO: 131131 - DNA, 20 bp, Artificial Sequence
  chemically synthesized
ccatatggaatagatgaaat

SEQ ID NO: 131132 - DNA, 20 bp, Artificial Sequence
  chemically synthesized
atggaatagatgaaataggt

SEQ ID NO: 131133 - DNA, 20 bp, Artificial Sequence
  chemically synthesized
ggaatagatgaaataggtga

SEQ ID NO: 131134 - DNA, 20 bp, Artificial Sequence
  chemically synthesized
gaatagatgaaataggtgag

SEQ ID NO: 131135 - DNA, 20 bp, Artificial Sequence
  chemically synthesized
agatgaaataggtgagaggc

SEQ ID NO: 131136 - DNA, 20 bp, Artificial Sequence
  chemically synthesized
atgaaataggtgagaggcca

SEQ ID NO: 131137 - DNA, 20 bp, Artificial Sequence
  chemically synthesized
aggtgagaggccagagctgt

SEQ ID NO: 131138 - DNA, 20 bp, Artificial Sequence
  chemically synthesized
agctctcaaactgacagctc

SEQ ID NO: 131139 - DNA, 20 bp, Artificial Sequence
  chemically synthesized
gaggccagagctgtcagttt

SEQ ID NO: 131140 - DNA, 20 bp, Artificial Sequence
  chemically synthesized
aatgacagctctcaaactga

SEQ ID NO: 131141 - DNA, 20 bp, Artificial Sequence
  chemically synthesized
ggccagagctgtcagtttga

SEQ ID NO: 131142 - DNA, 20 bp, Artificial Sequence
  chemically synthesized
attcatcactatatgaatga

SEQ ID NO: 131143 - DNA, 20 bp, Artificial Sequence
  chemically synthesized
tttgagagctgtcattcata

SEQ ID NO: 131144 - DNA, 20 bp, Artificial Sequence
  chemically synthesized
catatagtgatgaataactg

SEQ ID NO: 131145 - DNA, 20 bp, Artificial Sequence
  chemically synthesized
tgatgaataactgaagccat

SEQ ID NO: 131146 - DNA, 20 bp, Artificial Sequence
  chemically synthesized
gttctttaccctcatggctt

SEQ ID NO: 131147 - DNA, 20 bp, Artificial Sequence
  chemically synthesized
gatgaataactgaagccatg

SEQ ID NO: 131148 - DNA, 20 bp, Artificial Sequence
  chemically synthesized
atgaataactgaagccatga

SEQ ID NO: 131149 - DNA, 20 bp, Artificial Sequence
  chemically synthesized
gcccttgttctttaccctca

SEQ ID NO: 131150 - DNA, 20 bp, Artificial Sequence
  chemically synthesized
taactgaagccatgagggta

SEQ ID NO: 131151 - DNA, 20 bp, Artificial Sequence
  chemically synthesized
aagccatgagggtaaagaac

SEQ ID NO: 131152 - DNA, 20 bp, Artificial Sequence
  chemically synthesized
agccatgagggtaaagaaca

SEQ ID NO: 131153 - DNA, 20 bp, Artificial Sequence
  chemically synthesized
gccatgagggtaaagaacaa

SEQ ID NO: 131154 - DNA, 20 bp, Artificial Sequence
  chemically synthesized
gagggtaaagaacaagggca

SEQ ID NO: 131155 - DNA, 20 bp, Artificial Sequence
  chemically synthesized
aaagaacaagggcaaagcct

SEQ ID NO: 131156 - DNA, 20 bp, Artificial Sequence
  chemically synthesized
aagaacaagggcaaagcctt

SEQ ID NO: 131157 - DNA, 20 bp, Artificial Sequence
  chemically synthesized
caagggcaaagccttgggaa

SEQ ID NO: 131158 - DNA, 20 bp, Artificial Sequence
  chemically synthesized
gcctcttcagaccattccca

SEQ ID NO: 131159 - DNA, 20 bp, Artificial Sequence
  chemically synthesized
tgcctcttcagaccattccc

SEQ ID NO: 131160 - DNA, 20 bp, Artificial Sequence
  chemically synthesized
aaagccttgggaatggtctg

SEQ ID NO: 131161 - DNA, 20 bp, Artificial Sequence
  chemically synthesized
agccttgggaatggtctgaa

SEQ ID NO: 131162 - DNA, 20 bp, Artificial Sequence
  chemically synthesized
gccttgggaatggtctgaag

SEQ ID NO: 131163 - DNA, 20 bp, Artificial Sequence
  chemically synthesized
ttgggaatggtctgaagagg

SEQ ID NO: 131164 - DNA, 20 bp, Artificial Sequence
  chemically synthesized
atgcatttgatctgcctctt

SEQ ID NO: 131165 - DNA, 20 bp, Artificial Sequence
  chemically synthesized
caaatgcatgaaattgaaat

SEQ ID NO: 131166 - DNA, 20 bp, Artificial Sequence
  chemically synthesized
tgaaattgaaataagacatt

SEQ ID NO: 131167 - DNA, 20 bp, Artificial Sequence
  chemically synthesized
gaaattgaaataagacattc

SEQ ID NO: 131168 - DNA, 20 bp, Artificial Sequence
  chemically synthesized
ttgaaataagacattcagga

SEQ ID NO: 131169 - DNA, 20 bp, Artificial Sequence
  chemically synthesized
tgaaataagacattcaggaa

SEQ ID NO: 131170 - DNA, 20 bp, Artificial Sequence
  chemically synthesized
gttatattattcttactttc

SEQ ID NO: 131171 - DNA, 20 bp, Artificial Sequence
  chemically synthesized
ttatattattcttactttca

SEQ ID NO: 131172 - DNA, 20 bp, Artificial Sequence
  chemically synthesized
agagcttctgccttgaaagt

SEQ ID NO: 131173 - DNA, 20 bp, Artificial Sequence
  chemically synthesized
tattattcttactttcaagg

SEQ ID NO: 131174 - DNA, 20 bp, Artificial Sequence
  chemically synthesized
ctccagagcttctgccttga

SEQ ID NO: 131175 - DNA, 20 bp, Artificial Sequence
  chemically synthesized
tattcttactttcaaggcag

SEQ ID NO: 131176 - DNA, 20 bp, Artificial Sequence
  chemically synthesized
tactttcaaggcagaagctc

SEQ ID NO: 131177 - DNA, 20 bp, Artificial Sequence
  chemically synthesized
ctttcaaggcagaagctctg

SEQ ID NO: 131178 - DNA, 20 bp, Artificial Sequence
  chemically synthesized
cctgtcatgctttatctcca

SEQ ID NO: 131179 - DNA, 20 bp, Artificial Sequence
  chemically synthesized
aggcagaagctctggagata

SEQ ID NO: 131180 - DNA, 20 bp, Artificial Sequence
  chemically synthesized
cacctgtcatgctttatctc

SEQ ID NO: 131181 - DNA, 20 bp, Artificial Sequence
  chemically synthesized
gctctggagataaagcatga

SEQ ID NO: 131182 - DNA, 20 bp, Artificial Sequence
  chemically synthesized
ctctggagataaagcatgac

SEQ ID NO: 131183 - DNA, 20 bp, Artificial Sequence
  chemically synthesized
tggagataaagcatgacagg

SEQ ID NO: 131184 - DNA, 20 bp, Artificial Sequence
  chemically synthesized
tgacaggtggtcctttgacg

SEQ ID NO: 131185 - DNA, 20 bp, Artificial Sequence
  chemically synthesized
ggttcactttgcttcgtcaa

SEQ ID NO: 131186 - DNA, 20 bp, Artificial Sequence
  chemically synthesized
aggttcactttgcttcgtca

SEQ ID NO: 131187 - DNA, 20 bp, Artificial Sequence
  chemically synthesized
ggtggtcctttgacgaagca

SEQ ID NO: 131188 - DNA, 20 bp, Artificial Sequence
  chemically synthesized
acgaagcaaagtgaacctct

SEQ ID NO: 131189 - DNA, 20 bp, Artificial Sequence
  chemically synthesized
cgaagcaaagtgaacctctt

SEQ ID NO: 131190 - DNA, 20 bp, Artificial Sequence
  chemically synthesized
agcaaagtgaacctcttggg

SEQ ID NO: 131191 - DNA, 20 bp, Artificial Sequence
  chemically synthesized
agtatcagtgaccacccaag

SEQ ID NO: 131192 - DNA, 20 bp, Artificial Sequence
  chemically synthesized
aagtatcagtgaccacccaa

SEQ ID NO: 131193 - DNA, 20 bp, Artificial Sequence
  chemically synthesized
taaagtatcagtgaccaccc

SEQ ID NO: 131194 - DNA, 20 bp, Artificial Sequence
  chemically synthesized
taatcactttggtaaagtat

SEQ ID NO: 131195 - DNA, 20 bp, Artificial Sequence
  chemically synthesized
tggtcactgatactttacca

SEQ ID NO: 131196 - DNA, 20 bp, Artificial Sequence
  chemically synthesized
atgtcctaatcactttggta

SEQ ID NO: 131197 - DNA, 20 bp, Artificial Sequence
  chemically synthesized
tgatactttaccaaagtgat

SEQ ID NO: 131198 - DNA, 20 bp, Artificial Sequence
  chemically synthesized
cagccatgtcctaatcactt

SEQ ID NO: 131199 - DNA, 20 bp, Artificial Sequence
  chemically synthesized
gatactttaccaaagtgatt

SEQ ID NO: 131200 - DNA, 20 bp, Artificial Sequence
  chemically synthesized
ttaccaaagtgattaggaca

SEQ ID NO: 131201 - DNA, 20 bp, Artificial Sequence
  chemically synthesized
gtgattaggacatggctgac

SEQ ID NO: 131202 - DNA, 20 bp, Artificial Sequence
  chemically synthesized
gattaggacatggctgacaa

SEQ ID NO: 131203 - DNA, 20 bp, Artificial Sequence
  chemically synthesized
ctttacatccaatctcttgt

SEQ ID NO: 131204 - DNA, 20 bp, Artificial Sequence
  chemically synthesized
ggacatggctgacaagagat

SEQ ID NO: 131205 - DNA, 20 bp, Artificial Sequence
  chemically synthesized
ctgacaagagattggatgta

SEQ ID NO: 131206 - DNA, 20 bp, Artificial Sequence
  chemically synthesized
attggatgtaaagaaaatga

SEQ ID NO: 131207 - DNA, 20 bp, Artificial Sequence
  chemically synthesized
gaaaatgatagaaatgcttg

SEQ ID NO: 131208 - DNA, 20 bp, Artificial Sequence
  chemically synthesized
aaatgatagaaatgcttgta

SEQ ID NO: 131209 - DNA, 20 bp, Artificial Sequence
  chemically synthesized
acagctaaaataaactctac

SEQ ID NO: 131210 - DNA, 20 bp, Artificial Sequence
  chemically synthesized
aatgcttgtagagtttattt

SEQ ID NO: 131211 - DNA, 20 bp, Artificial Sequence
  chemically synthesized
gcttttttttttttttttaa

SEQ ID NO: 131212 - DNA, 20 bp, Artificial Sequence
  chemically synthesized
gctgttaaaaaaaaaaaaaa

SEQ ID NO: 131213 - DNA, 20 bp, Artificial Sequence
  chemically synthesized
aaaaaaaaaaaaagcaaaac

SEQ ID NO: 131214 - DNA, 20 bp, Artificial Sequence
  chemically synthesized
aaaaaaaaagcaaaaccaga

SEQ ID NO: 131215 - DNA, 20 bp, Artificial Sequence
  chemically synthesized
aaaaaaaagcaaaaccagac

SEQ ID NO: 131216 - DNA, 20 bp, Artificial Sequence
  chemically synthesized
tattccttaagtttcctgtc

SEQ ID NO: 131217 - DNA, 20 bp, Artificial Sequence
  chemically synthesized
caaaaccagacaggaaactt

SEQ ID NO: 131218 - DNA, 20 bp, Artificial Sequence
  chemically synthesized
aaaaccagacaggaaactta

SEQ ID NO: 131219 - DNA, 20 bp, Artificial Sequence
  chemically synthesized
tgaggtagctcatattcctt

SEQ ID NO: 131220 - DNA, 20 bp, Artificial Sequence
  chemically synthesized
acaggaaacttaaggaatat

SEQ ID NO: 131221 - DNA, 20 bp, Artificial Sequence
  chemically synthesized
tctttgcttccacaatgagg

SEQ ID NO: 131222 - DNA, 20 bp, Artificial Sequence
  chemically synthesized
gaatatgagctacctcattg

SEQ ID NO: 131223 - DNA, 20 bp, Artificial Sequence
  chemically synthesized
gagtctttgcttccacaatg

SEQ ID NO: 131224 - DNA, 20 bp, Artificial Sequence
  chemically synthesized
tatgagctacctcattgtgg

SEQ ID NO: 131225 - DNA, 20 bp, Artificial Sequence
  chemically synthesized
tgagtctttgcttccacaat

SEQ ID NO: 131226 - DNA, 20 bp, Artificial Sequence
  chemically synthesized
gctacctcattgtggaagca

SEQ ID NO: 131227 - DNA, 20 bp, Artificial Sequence
  chemically synthesized
tcattgtggaagcaaagact

SEQ ID NO: 131228 - DNA, 20 bp, Artificial Sequence
  chemically synthesized
ttgtggaagcaaagactcag

SEQ ID NO: 131229 - DNA, 20 bp, Artificial Sequence
  chemically synthesized
tggaagcaaagactcagaag

SEQ ID NO: 131230 - DNA, 20 bp, Artificial Sequence
  chemically synthesized
tcttgttctctacttcttct

SEQ ID NO: 131231 - DNA, 20 bp, Artificial Sequence
  chemically synthesized
aagcaaagactcagaagaag

SEQ ID NO: 131232 - DNA, 20 bp, Artificial Sequence
  chemically synthesized
gcaaagactcagaagaagta

SEQ ID NO: 131233 - DNA, 20 bp, Artificial Sequence
  chemically synthesized
actcagaagaagtagagaac

SEQ ID NO: 131234 - DNA, 20 bp, Artificial Sequence
  chemically synthesized
agaagaagtagagaacaaga

SEQ ID NO: 131235 - DNA, 20 bp, Artificial Sequence
  chemically synthesized
agaagtagagaacaagaaag

SEQ ID NO: 131236 - DNA, 20 bp, Artificial Sequence
  chemically synthesized
gaagtagagaacaagaaagt

SEQ ID NO: 131237 - DNA, 20 bp, Artificial Sequence
  chemically synthesized
agtagagaacaagaaagtag

SEQ ID NO: 131238 - DNA, 20 bp, Artificial Sequence
  chemically synthesized
gtagagaacaagaaagtagg

SEQ ID NO: 131239 - DNA, 20 bp, Artificial Sequence
  chemically synthesized
gaacaagaaagtaggaggtt

SEQ ID NO: 131240 - DNA, 20 bp, Artificial Sequence
  chemically synthesized
taggaggttgagtaaaatat

SEQ ID NO: 131241 - DNA, 20 bp, Artificial Sequence
  chemically synthesized
aggaggttgagtaaaatatc

SEQ ID NO: 131242 - DNA, 20 bp, Artificial Sequence
  chemically synthesized
aggttgagtaaaatatcagg

SEQ ID NO: 131243 - DNA, 20 bp, Artificial Sequence
  chemically synthesized
gagtaaaatatcaggtagcc

SEQ ID NO: 131244 - DNA, 20 bp, Artificial Sequence
  chemically synthesized
aaaatatcaggtagccaagt

SEQ ID NO: 131245 - DNA, 20 bp, Artificial Sequence
  chemically synthesized
tccacttttgttgactaact

SEQ ID NO: 131246 - DNA, 20 bp, Artificial Sequence
  chemically synthesized
gtagccaagttagtcaacaa

SEQ ID NO: 131247 - DNA, 20 bp, Artificial Sequence
  chemically synthesized
gccaagttagtcaacaaaag

SEQ ID NO: 131248 - DNA, 20 bp, Artificial Sequence
  chemically synthesized
aagttagtcaacaaaagtgg

SEQ ID NO: 131249 - DNA, 20 bp, Artificial Sequence
  chemically synthesized
ttttttttgtaaattttaag

SEQ ID NO: 131250 - DNA, 20 bp, Artificial Sequence
  chemically synthesized
attttttttttgtaaatttt

SEQ ID NO: 131251 - DNA, 20 bp, Artificial Sequence
  chemically synthesized
ttacaaaaaaaaaatgctaa

SEQ ID NO: 131252 - DNA, 20 bp, Artificial Sequence
  chemically synthesized
aaaaaaaaaatgctaaaagt

SEQ ID NO: 131253 - DNA, 20 bp, Artificial Sequence
  chemically synthesized
ttttccaaaattctaacttt

SEQ ID NO: 131254 - DNA, 20 bp, Artificial Sequence
  chemically synthesized
aatgctaaaagttagaattt

SEQ ID NO: 131255 - DNA, 20 bp, Artificial Sequence
  chemically synthesized
ttggaaaacgactgaacttg

SEQ ID NO: 131256 - DNA, 20 bp, Artificial Sequence
  chemically synthesized
atatgtacaatcttcaagtt

SEQ ID NO: 131257 - DNA, 20 bp, Artificial Sequence
  chemically synthesized
ggctaatatgtacaatcttc

SEQ ID NO: 131258 - DNA, 20 bp, Artificial Sequence
  chemically synthesized
aacttgaagattgtacatat

SEQ ID NO: 131259 - DNA, 20 bp, Artificial Sequence
  chemically synthesized
tgaagattgtacatattagc

SEQ ID NO: 131260 - DNA, 20 bp, Artificial Sequence
  chemically synthesized
gaagattgtacatattagcc

SEQ ID NO: 131261 - DNA, 20 bp, Artificial Sequence
  chemically synthesized
gattgtacatattagccagg

SEQ ID NO: 131262 - DNA, 20 bp, Artificial Sequence
  chemically synthesized
atgagtttagagtaactgcc

SEQ ID NO: 131263 - DNA, 20 bp, Artificial Sequence
  chemically synthesized
tatataagagtatgagttta

SEQ ID NO: 131264 - DNA, 20 bp, Artificial Sequence
  chemically synthesized
attatataagagtatgagtt

SEQ ID NO: 131265 - DNA, 20 bp, Artificial Sequence
  chemically synthesized
taataattatataagagtat

SEQ ID NO: 131266 - DNA, 20 bp, Artificial Sequence
  chemically synthesized
tccttttaataattatataa

SEQ ID NO: 131267 - DNA, 20 bp, Artificial Sequence
  chemically synthesized
gctccttttaataattatat

SEQ ID NO: 131268 - DNA, 20 bp, Artificial Sequence
  chemically synthesized
tactcttatataattattaa

SEQ ID NO: 131269 - DNA, 20 bp, Artificial Sequence
  chemically synthesized
actcttatataattattaaa

SEQ ID NO: 131270 - DNA, 20 bp, Artificial Sequence
  chemically synthesized
tcttatataattattaaaag

SEQ ID NO: 131271 - DNA, 20 bp, Artificial Sequence
  chemically synthesized
tagagatttaattagtaaag

SEQ ID NO: 131272 - DNA, 20 bp, Artificial Sequence
  chemically synthesized
gttagagatttaattagtaa

SEQ ID NO: 131273 - DNA, 20 bp, Artificial Sequence
  chemically synthesized
ggttagagatttaattagta

SEQ ID NO: 131274 - DNA, 20 bp, Artificial Sequence
  chemically synthesized
aatcaggttagagatttaat

SEQ ID NO: 131275 - DNA, 20 bp, Artificial Sequence
  chemically synthesized
gaaaaaagaaaatcaggtta

SEQ ID NO: 131276 - DNA, 20 bp, Artificial Sequence
  chemically synthesized
tggaaaaaagaaaatcaggt

SEQ ID NO: 131277 - DNA, 20 bp, Artificial Sequence
  chemically synthesized
gatttggaaaaaagaaaatc

SEQ ID NO: 131278 - DNA, 20 bp, Artificial Sequence
  chemically synthesized
ggatttggaaaaaagaaaat

SEQ ID NO: 131279 - DNA, 20 bp, Artificial Sequence
  chemically synthesized
agatggcaggatttggaaaa

SEQ ID NO: 131280 - DNA, 20 bp, Artificial Sequence
  chemically synthesized
caaaaaaagatggcaggatt

SEQ ID NO: 131281 - DNA, 20 bp, Artificial Sequence
  chemically synthesized
gaaaagcaaaaaaagatggc

SEQ ID NO: 131282 - DNA, 20 bp, Artificial Sequence
  chemically synthesized
agaaaagcaaaaaaagatgg

SEQ ID NO: 131283 - DNA, 20 bp, Artificial Sequence
  chemically synthesized
gatagaaaagcaaaaaaaga

SEQ ID NO: 131284 - DNA, 20 bp, Artificial Sequence
  chemically synthesized
aaatgatagaaaagcaaaaa

SEQ ID NO: 131285 - DNA, 20 bp, Artificial Sequence
  chemically synthesized
tttttgtggaaatgatagaa

SEQ ID NO: 131286 - DNA, 20 bp, Artificial Sequence
  chemically synthesized
agtggtttttgtggaaatga

SEQ ID NO: 131287 - DNA, 20 bp, Artificial Sequence
  chemically synthesized
gaggagaggagtggtttttg

SEQ ID NO: 131288 - DNA, 20 bp, Artificial Sequence
  chemically synthesized
tatgaaagagaggagaggag

SEQ ID NO: 131289 - DNA, 20 bp, Artificial Sequence
  chemically synthesized
gattatgaaagagaggagag

SEQ ID NO: 131290 - DNA, 20 bp, Artificial Sequence
  chemically synthesized
gagattatgaaagagaggag

SEQ ID NO: 131291 - DNA, 20 bp, Artificial Sequence
  chemically synthesized
agagattatgaaagagagga

SEQ ID NO: 131292 - DNA, 20 bp, Artificial Sequence
  chemically synthesized
tcagagattatgaaagagag

SEQ ID NO: 131293 - DNA, 20 bp, Artificial Sequence
  chemically synthesized
actcagagattatgaaagag

SEQ ID NO: 131294 - DNA, 20 bp, Artificial Sequence
  chemically synthesized
aactcagagattatgaaaga

SEQ ID NO: 131295 - DNA, 20 bp, Artificial Sequence
  chemically synthesized
taaactcagagattatgaaa

SEQ ID NO: 131296 - DNA, 20 bp, Artificial Sequence
  chemically synthesized
gataaactcagagattatga

SEQ ID NO: 131297 - DNA, 20 bp, Artificial Sequence
  chemically synthesized
tcctctctttcataatctct

SEQ ID NO: 131298 - DNA, 20 bp, Artificial Sequence
  chemically synthesized
aaaaaatgttgataaactca

SEQ ID NO: 131299 - DNA, 20 bp, Artificial Sequence
  chemically synthesized
aaaaaaaatgttgataaact

SEQ ID NO: 131300 - DNA, 20 bp, Artificial Sequence
  chemically synthesized
agtttatcaacatttttttt

SEQ ID NO: 131301 - DNA, 20 bp, Artificial Sequence
  chemically synthesized
acatttttttttggttacgt

SEQ ID NO: 131302 - DNA, 20 bp, Artificial Sequence
  chemically synthesized
tttttggttacgtcagactc

SEQ ID NO: 131303 - DNA, 20 bp, Artificial Sequence
  chemically synthesized
cgtggaatataggaaaacta

SEQ ID NO: 131304 - DNA, 20 bp, Artificial Sequence
  chemically synthesized
accgtggaatataggaaaac

SEQ ID NO: 131305 - DNA, 20 bp, Artificial Sequence
  chemically synthesized
tcaaatggaccgtggaatat

SEQ ID NO: 131306 - DNA, 20 bp, Artificial Sequence
  chemically synthesized
tctagttttcctatattcca

SEQ ID NO: 131307 - DNA, 20 bp, Artificial Sequence
  chemically synthesized
ttcaaatggaccgtggaata

SEQ ID NO: 131308 - DNA, 20 bp, Artificial Sequence
  chemically synthesized
tagtgctttcaaatggaccg

SEQ ID NO: 131309 - DNA, 20 bp, Artificial Sequence
  chemically synthesized
atattccacggtccatttga

SEQ ID NO: 131310 - DNA, 20 bp, Artificial Sequence
  chemically synthesized
aataagttagtgctttcaaa

SEQ ID NO: 131311 - DNA, 20 bp, Artificial Sequence
  chemically synthesized
actagttacatgtaataagt

SEQ ID NO: 131312 - DNA, 20 bp, Artificial Sequence
  chemically synthesized
tggcactagttacatgtaat

SEQ ID NO: 131313 - DNA, 20 bp, Artificial Sequence
  chemically synthesized
actaacttattacatgtaac

SEQ ID NO: 131314 - DNA, 20 bp, Artificial Sequence
  chemically synthesized
ttacatgtaactagtgccaa

SEQ ID NO: 131315 - DNA, 20 bp, Artificial Sequence
  chemically synthesized
ctggaattttccattggcac

SEQ ID NO: 131316 - DNA, 20 bp, Artificial Sequence
  chemically synthesized
tgctagctggaattttccat

SEQ ID NO: 131317 - DNA, 20 bp, Artificial Sequence
  chemically synthesized
ctagtgccaatggaaaattc

SEQ ID NO: 131318 - DNA, 20 bp, Artificial Sequence
  chemically synthesized
tgccaatggaaaattccagc

SEQ ID NO: 131319 - DNA, 20 bp, Artificial Sequence
  chemically synthesized
tagatgcgtttattgctagc

SEQ ID NO: 131320 - DNA, 20 bp, Artificial Sequence
  chemically synthesized
aacatagatgcgtttattgc

SEQ ID NO: 131321 - DNA, 20 bp, Artificial Sequence
  chemically synthesized
agcaataaacgcatctatgt

SEQ ID NO: 131322 - DNA, 20 bp, Artificial Sequence
  chemically synthesized
tctgcctacagtgactaaca

SEQ ID NO: 131323 - DNA, 20 bp, Artificial Sequence
  chemically synthesized
cgcatctatgttagtcactg

SEQ ID NO: 131324 - DNA, 20 bp, Artificial Sequence
  chemically synthesized
gcatctatgttagtcactgt

SEQ ID NO: 131325 - DNA, 20 bp, Artificial Sequence
  chemically synthesized
tctatgttagtcactgtagg

SEQ ID NO: 131326 - DNA, 20 bp, Artificial Sequence
  chemically synthesized
gccaacattagttctgccta

SEQ ID NO: 131327 - DNA, 20 bp, Artificial Sequence
  chemically synthesized
actgtaggcagaactaatgt

SEQ ID NO: 131328 - DNA, 20 bp, Artificial Sequence
  chemically synthesized
cttatcattggagccaacat

SEQ ID NO: 131329 - DNA, 20 bp, Artificial Sequence
  chemically synthesized
ctaatgttggctccaatgat

SEQ ID NO: 131330 - DNA, 20 bp, Artificial Sequence
  chemically synthesized
taggagcattcttatcattg

SEQ ID NO: 131331 - DNA, 20 bp, Artificial Sequence
  chemically synthesized
cataggagcattcttatcat

SEQ ID NO: 131332 - DNA, 20 bp, Artificial Sequence
  chemically synthesized
caatgataagaatgctccta

SEQ ID NO: 131333 - DNA, 20 bp, Artificial Sequence
  chemically synthesized
cagccaagagaaaaccatag

SEQ ID NO: 131334 - DNA, 20 bp, Artificial Sequence
  chemically synthesized
gccagccaagagaaaaccat

SEQ ID NO: 131335 - DNA, 20 bp, Artificial Sequence
  chemically synthesized
tgccagccaagagaaaacca

SEQ ID NO: 131336 - DNA, 20 bp, Artificial Sequence
  chemically synthesized
atgctcctatggttttctct

SEQ ID NO: 131337 - DNA, 20 bp, Artificial Sequence
  chemically synthesized
tcctatggttttctcttggc

SEQ ID NO: 131338 - DNA, 20 bp, Artificial Sequence
  chemically synthesized
agcaactgcttgccagccaa

SEQ ID NO: 131339 - DNA, 20 bp, Artificial Sequence
  chemically synthesized
atggttttctcttggctggc

SEQ ID NO: 131340 - DNA, 20 bp, Artificial Sequence
  chemically synthesized
atagcaactgcttgccagcc

SEQ ID NO: 131341 - DNA, 20 bp, Artificial Sequence
  chemically synthesized
gttttctcttggctggcaag

SEQ ID NO: 131342 - DNA, 20 bp, Artificial Sequence
  chemically synthesized
gcaatatagcaactgcttgc

SEQ ID NO: 131343 - DNA, 20 bp, Artificial Sequence
  chemically synthesized
tctaattttcaggagcaata

SEQ ID NO: 131344 - DNA, 20 bp, Artificial Sequence
  chemically synthesized
caactctttctaattttcag

SEQ ID NO: 131345 - DNA, 20 bp, Artificial Sequence
  chemically synthesized
gctatattgctcctgaaaat

SEQ ID NO: 131346 - DNA, 20 bp, Artificial Sequence
  chemically synthesized
cacaactctttctaattttc

SEQ ID NO: 131347 - DNA, 20 bp, Artificial Sequence
  chemically synthesized
gcacaactctttctaatttt

SEQ ID NO: 131348 - DNA, 20 bp, Artificial Sequence
  chemically synthesized
tattgctcctgaaaattaga

SEQ ID NO: 131349 - DNA, 20 bp, Artificial Sequence
  chemically synthesized
ttgctcctgaaaattagaaa

SEQ ID NO: 131350 - DNA, 20 bp, Artificial Sequence
  chemically synthesized
ttagaaagagttgtgctgtg

SEQ ID NO: 131351 - DNA, 20 bp, Artificial Sequence
  chemically synthesized
gaaagagttgtgctgtgaag

SEQ ID NO: 131352 - DNA, 20 bp, Artificial Sequence
  chemically synthesized
atgtaatttctactgcttca

SEQ ID NO: 131353 - DNA, 20 bp, Artificial Sequence
  chemically synthesized
agagttgtgctgtgaagcag

SEQ ID NO: 131354 - DNA, 20 bp, Artificial Sequence
  chemically synthesized
tttgcagctaacgtattagt

SEQ ID NO: 131355 - DNA, 20 bp, Artificial Sequence
  chemically synthesized
acatacactgactaatacgt

SEQ ID NO: 131356 - DNA, 20 bp, Artificial Sequence
  chemically synthesized
gaaatttgcagctaacgtat

SEQ ID NO: 131357 - DNA, 20 bp, Artificial Sequence
  chemically synthesized
agaatccatatagaaatttg

SEQ ID NO: 131358 - DNA, 20 bp, Artificial Sequence
  chemically synthesized
gttagctgcaaatttctata

SEQ ID NO: 131359 - DNA, 20 bp, Artificial Sequence
  chemically synthesized
tcagattgaaagaatccata

SEQ ID NO: 131360 - DNA, 20 bp, Artificial Sequence
  chemically synthesized
ccaaactgtattcagattga

SEQ ID NO: 131361 - DNA, 20 bp, Artificial Sequence
  chemically synthesized
ggattctttcaatctgaata

SEQ ID NO: 131362 - DNA, 20 bp, Artificial Sequence
  chemically synthesized
gctattacccaaactgtatt

SEQ ID NO: 131363 - DNA, 20 bp, Artificial Sequence
  chemically synthesized
ctttcaatctgaatacagtt

SEQ ID NO: 131364 - DNA, 20 bp, Artificial Sequence
  chemically synthesized
tttcaatctgaatacagttt

SEQ ID NO: 131365 - DNA, 20 bp, Artificial Sequence
  chemically synthesized
tctgaatacagtttgggtaa

SEQ ID NO: 131366 - DNA, 20 bp, Artificial Sequence
  chemically synthesized
ttgggtaatagctttgtcct

SEQ ID NO: 131367 - DNA, 20 bp, Artificial Sequence
  chemically synthesized
tgggtaatagctttgtcctt

SEQ ID NO: 131368 - DNA, 20 bp, Artificial Sequence
  chemically synthesized
tacaaaaatacctaaggaca

SEQ ID NO: 131369 - DNA, 20 bp, Artificial Sequence
  chemically synthesized
tgtgtgtacaaaaataccta

SEQ ID NO: 131370 - DNA, 20 bp, Artificial Sequence
  chemically synthesized
ctgtgtgtacaaaaatacct

SEQ ID NO: 131371 - DNA, 20 bp, Artificial Sequence
  chemically synthesized
cttaggtatttttgtacaca

SEQ ID NO: 131372 - DNA, 20 bp, Artificial Sequence
  chemically synthesized
tatttttgtacacacagata

SEQ ID NO: 131373 - DNA, 20 bp, Artificial Sequence
  chemically synthesized
aaagtatgttaaattttctt

SEQ ID NO: 131374 - DNA, 20 bp, Artificial Sequence
  chemically synthesized
tatgttaaattttcttgaga

SEQ ID NO: 131375 - DNA, 20 bp, Artificial Sequence
  chemically synthesized
atgttaaattttcttgagac

SEQ ID NO: 131376 - DNA, 20 bp, Artificial Sequence
  chemically synthesized
ctcttgctaatgcctgtctc

SEQ ID NO: 131377 - DNA, 20 bp, Artificial Sequence
  chemically synthesized
aattttcttgagacaggcat

SEQ ID NO: 131378 - DNA, 20 bp, Artificial Sequence
  chemically synthesized
ttcttgagacaggcattagc

SEQ ID NO: 131379 - DNA, 20 bp, Artificial Sequence
  chemically synthesized
cttgagacaggcattagcaa

SEQ ID NO: 131380 - DNA, 20 bp, Artificial Sequence
  chemically synthesized
ttgagacaggcattagcaag

SEQ ID NO: 131381 - DNA, 20 bp, Artificial Sequence
  chemically synthesized
acaggcattagcaagaggtt

SEQ ID NO: 131382 - DNA, 20 bp, Artificial Sequence
  chemically synthesized
cattagcaagaggttcagaa

SEQ ID NO: 131383 - DNA, 20 bp, Artificial Sequence
  chemically synthesized
caagaggttcagaacagaat

SEQ ID NO: 131384 - DNA, 20 bp, Artificial Sequence
  chemically synthesized
ggttcagaacagaattagca

SEQ ID NO: 131385 - DNA, 20 bp, Artificial Sequence
  chemically synthesized
atagttgtgttccaaaacaa

SEQ ID NO: 131386 - DNA, 20 bp, Artificial Sequence
  chemically synthesized
atatcagctatcttttgttt

SEQ ID NO: 131387 - DNA, 20 bp, Artificial Sequence
  chemically synthesized
ttgtgttccaaaacaaaaga

SEQ ID NO: 131388 - DNA, 20 bp, Artificial Sequence
  chemically synthesized
gcagcatggcaagtttatat

SEQ ID NO: 131389 - DNA, 20 bp, Artificial Sequence
  chemically synthesized
attggaactggcagcatggc

SEQ ID NO: 131390 - DNA, 20 bp, Artificial Sequence
  chemically synthesized
atataaacttgccatgctgc

SEQ ID NO: 131391 - DNA, 20 bp, Artificial Sequence
  chemically synthesized
taccattggaactggcagca

SEQ ID NO: 131392 - DNA, 20 bp, Artificial Sequence
  chemically synthesized
agtaataccattggaactgg

SEQ ID NO: 131393 - DNA, 20 bp, Artificial Sequence
  chemically synthesized
tgccatgctgccagttccaa

SEQ ID NO: 131394 - DNA, 20 bp, Artificial Sequence
  chemically synthesized
gtcagtaataccattggaac

SEQ ID NO: 131395 - DNA, 20 bp, Artificial Sequence
  chemically synthesized
taaaaggtcagtaataccat

SEQ ID NO: 131396 - DNA, 20 bp, Artificial Sequence
  chemically synthesized
aaacaacgagattaaaaggt

SEQ ID NO: 131397 - DNA, 20 bp, Artificial Sequence
  chemically synthesized
aaaaaaacaacgagattaaa

SEQ ID NO: 131398 - DNA, 20 bp, Artificial Sequence
  chemically synthesized
aaaaaaaacaacgagattaa

SEQ ID NO: 131399 - DNA, 20 bp, Artificial Sequence
  chemically synthesized
aagatttaaaaaaaaacaac

SEQ ID NO: 131400 - DNA, 20 bp, Artificial Sequence
  chemically synthesized
tttagcagagaaaaaataaa

SEQ ID NO: 131401 - DNA, 20 bp, Artificial Sequence
  chemically synthesized
caagaggcagagatttagca

SEQ ID NO: 131402 - DNA, 20 bp, Artificial Sequence
  chemically synthesized
agcaagaggcagagatttag

SEQ ID NO: 131403 - DNA, 20 bp, Artificial Sequence
  chemically synthesized
aacagcaagaggcagagatt

SEQ ID NO: 131404 - DNA, 20 bp, Artificial Sequence
  chemically synthesized
ttattaaacagcaagaggca

SEQ ID NO: 131405 - DNA, 20 bp, Artificial Sequence
  chemically synthesized
gcttattaaacagcaagagg

SEQ ID NO: 131406 - DNA, 20 bp, Artificial Sequence
  chemically synthesized
ttagcttattaaacagcaag

SEQ ID NO: 131407 - DNA, 20 bp, Artificial Sequence
  chemically synthesized
gttagcttattaaacagcaa

SEQ ID NO: 131408 - DNA, 20 bp, Artificial Sequence
  chemically synthesized
cggttagcttattaaacagc

SEQ ID NO: 131409 - DNA, 20 bp, Artificial Sequence
  chemically synthesized
tctgcctcttgctgtttaat

SEQ ID NO: 131410 - DNA, 20 bp, Artificial Sequence
  chemically synthesized
ataacggttagcttattaaa

SEQ ID NO: 131411 - DNA, 20 bp, Artificial Sequence
  chemically synthesized
attaggttccaaataacggt

SEQ ID NO: 131412 - DNA, 20 bp, Artificial Sequence
  chemically synthesized
ttaataagctaaccgttatt

SEQ ID NO: 131413 - DNA, 20 bp, Artificial Sequence
  chemically synthesized
tttcattaggttccaaataa

SEQ ID NO: 131414 - DNA, 20 bp, Artificial Sequence
  chemically synthesized
cgttatttggaacctaatga

SEQ ID NO: 131415 - DNA, 20 bp, Artificial Sequence
  chemically synthesized
gttatttggaacctaatgaa

SEQ ID NO: 131416 - DNA, 20 bp, Artificial Sequence
  chemically synthesized
gggaaaaaaatcctttcatt

SEQ ID NO: 131417 - DNA, 20 bp, Artificial Sequence
  chemically synthesized
agggaaaaaaatcctttcat

SEQ ID NO: 131418 - DNA, 20 bp, Artificial Sequence
  chemically synthesized
atgaaaggatttttttccct

SEQ ID NO: 131419 - DNA, 20 bp, Artificial Sequence
  chemically synthesized
tttaggaaggtttagactga

SEQ ID NO: 131420 - DNA, 20 bp, Artificial Sequence
  chemically synthesized
atttaggaaggtttagactg

SEQ ID NO: 131421 - DNA, 20 bp, Artificial Sequence
  chemically synthesized
tatttaggaaggtttagact

SEQ ID NO: 131422 - DNA, 20 bp, Artificial Sequence
  chemically synthesized
agaggctatttaggaaggtt

SEQ ID NO: 131423 - DNA, 20 bp, Artificial Sequence
  chemically synthesized
tcagtctaaaccttcctaaa

SEQ ID NO: 131424 - DNA, 20 bp, Artificial Sequence
  chemically synthesized
aatgaagaggctatttagga

SEQ ID NO: 131425 - DNA, 20 bp, Artificial Sequence
  chemically synthesized
taatgaagaggctatttagg

SEQ ID NO: 131426 - DNA, 20 bp, Artificial Sequence
  chemically synthesized
gaataatgaagaggctattt

SEQ ID NO: 131427 - DNA, 20 bp, Artificial Sequence
  chemically synthesized
agaataatgaagaggctatt

SEQ ID NO: 131428 - DNA, 20 bp, Artificial Sequence
  chemically synthesized
aagtaaatagaataatgaag

SEQ ID NO: 131429 - DNA, 20 bp, Artificial Sequence
  chemically synthesized
aaagtaaatagaataatgaa

SEQ ID NO: 131430 - DNA, 20 bp, Artificial Sequence
  chemically synthesized
tcaaagtaaatagaataatg

SEQ ID NO: 131431 - DNA, 20 bp, Artificial Sequence
  chemically synthesized
tttttaatgttcaaagtaaa

SEQ ID NO: 131432 - DNA, 20 bp, Artificial Sequence
  chemically synthesized
tttggtttttttaatgttca

SEQ ID NO: 131433 - DNA, 20 bp, Artificial Sequence
  chemically synthesized
tttgaacattaaaaaaacca

SEQ ID NO: 131434 - DNA, 20 bp, Artificial Sequence
  chemically synthesized
catattagctatttcagctt

SEQ ID NO: 131435 - DNA, 20 bp, Artificial Sequence
  chemically synthesized
taaaaaaaccaaagctgaaa

SEQ ID NO: 131436 - DNA, 20 bp, Artificial Sequence
  chemically synthesized
acatctcatattagctattt

SEQ ID NO: 131437 - DNA, 20 bp, Artificial Sequence
  chemically synthesized
aaagctgaaatagctaatat

SEQ ID NO: 131438 - DNA, 20 bp, Artificial Sequence
  chemically synthesized
ttttcatgaacatctcatat

SEQ ID NO: 131439 - DNA, 20 bp, Artificial Sequence
  chemically synthesized
tgttcatgaaaatctccatt

SEQ ID NO: 131440 - DNA, 20 bp, Artificial Sequence
  chemically synthesized
gttcatgaaaatctccattc

SEQ ID NO: 131441 - DNA, 20 bp, Artificial Sequence
  chemically synthesized
ttcatgaaaatctccattca

SEQ ID NO: 131442 - DNA, 20 bp, Artificial Sequence
  chemically synthesized
ggatgatgacgccctgaatg

SEQ ID NO: 131443 - DNA, 20 bp, Artificial Sequence
  chemically synthesized
taggatgatgacgccctgaa

SEQ ID NO: 131444 - DNA, 20 bp, Artificial Sequence
  chemically synthesized
cagggcgtcatcatcctaat

SEQ ID NO: 131445 - DNA, 20 bp, Artificial Sequence
  chemically synthesized
cagcaggttataaaccaatt

SEQ ID NO: 131446 - DNA, 20 bp, Artificial Sequence
  chemically synthesized
acagcaggttataaaccaat

SEQ ID NO: 131447 - DNA, 20 bp, Artificial Sequence
  chemically synthesized
gaagaactattcagcacagc

SEQ ID NO: 131448 - DNA, 20 bp, Artificial Sequence
  chemically synthesized
ggaagaactattcagcacag

SEQ ID NO: 131449 - DNA, 20 bp, Artificial Sequence
  chemically synthesized
ttataacctgctgtgctgaa

SEQ ID NO: 131450 - DNA, 20 bp, Artificial Sequence
  chemically synthesized
agtggaagaactattcagca

SEQ ID NO: 131451 - DNA, 20 bp, Artificial Sequence
  chemically synthesized
ggatgagtggaagaactatt

SEQ ID NO: 131452 - DNA, 20 bp, Artificial Sequence
  chemically synthesized
aacaaaatgaggatgagtgg

SEQ ID NO: 131453 - DNA, 20 bp, Artificial Sequence
  chemically synthesized
caaaacaaaatgaggatgag

SEQ ID NO: 131454 - DNA, 20 bp, Artificial Sequence
  chemically synthesized
aaacaaaacaaaatgaggat

SEQ ID NO: 131455 - DNA, 20 bp, Artificial Sequence
  chemically synthesized
ttaaaaaacaaaacaaaatg

SEQ ID NO: 131456 - DNA, 20 bp, Artificial Sequence
  chemically synthesized
gttaaaaaacaaaacaaaat

SEQ ID NO: 131457 - DNA, 20 bp, Artificial Sequence
  chemically synthesized
tggtagaacttttcattttt

SEQ ID NO: 131458 - DNA, 20 bp, Artificial Sequence
  chemically synthesized
ttttttaacttaaaaatgaa

SEQ ID NO: 131459 - DNA, 20 bp, Artificial Sequence
  chemically synthesized
tgagaacatgtgatatttgg

SEQ ID NO: 131460 - DNA, 20 bp, Artificial Sequence
  chemically synthesized
aagtgagaacatgtgatatt

SEQ ID NO: 131461 - DNA, 20 bp, Artificial Sequence
  chemically synthesized
gctcccacttataagtaagt

SEQ ID NO: 131462 - DNA, 20 bp, Artificial Sequence
  chemically synthesized
acatgttctcacttacttat

SEQ ID NO: 131463 - DNA, 20 bp, Artificial Sequence
  chemically synthesized
cttagctcccacttataagt

SEQ ID NO: 131464 - DNA, 20 bp, Artificial Sequence
  chemically synthesized
tgttctcacttacttataag

SEQ ID NO: 131465 - DNA, 20 bp, Artificial Sequence
  chemically synthesized
gttctcacttacttataagt

SEQ ID NO: 131466 - DNA, 20 bp, Artificial Sequence
  chemically synthesized
agtgcttagctcccacttat

SEQ ID NO: 131467 - DNA, 20 bp, Artificial Sequence
  chemically synthesized
tctcacttacttataagtgg

SEQ ID NO: 131468 - DNA, 20 bp, Artificial Sequence
  chemically synthesized
cttacttataagtgggagct

SEQ ID NO: 131469 - DNA, 20 bp, Artificial Sequence
  chemically synthesized
ataagtgggagctaagcact

SEQ ID NO: 131470 - DNA, 20 bp, Artificial Sequence
  chemically synthesized
gtccatgtgtgctcagtgct

SEQ ID NO: 131471 - DNA, 20 bp, Artificial Sequence
  chemically synthesized
tatttatgtccatgtgtgct

SEQ ID NO: 131472 - DNA, 20 bp, Artificial Sequence
  chemically synthesized
agctaagcactgagcacaca

SEQ ID NO: 131473 - DNA, 20 bp, Artificial Sequence
  chemically synthesized
agcacacatggacataaata

SEQ ID NO: 131474 - DNA, 20 bp, Artificial Sequence
  chemically synthesized
gcacacatggacataaatac

SEQ ID NO: 131475 - DNA, 20 bp, Artificial Sequence
  chemically synthesized
ggacataaatacgggaacaa

SEQ ID NO: 131476 - DNA, 20 bp, Artificial Sequence
  chemically synthesized
aatacgggaacaatagaccc

SEQ ID NO: 131477 - DNA, 20 bp, Artificial Sequence
  chemically synthesized
atacgggaacaatagaccct

SEQ ID NO: 131478 - DNA, 20 bp, Artificial Sequence
  chemically synthesized
tacgggaacaatagaccctg

SEQ ID NO: 131479 - DNA, 20 bp, Artificial Sequence
  chemically synthesized
cctccctctagtagtcccca

SEQ ID NO: 131480 - DNA, 20 bp, Artificial Sequence
  chemically synthesized
tcctccctctagtagtcccc

SEQ ID NO: 131481 - DNA, 20 bp, Artificial Sequence
  chemically synthesized
ctcctccctctagtagtccc

SEQ ID NO: 131482 - DNA, 20 bp, Artificial Sequence
  chemically synthesized
caatagaccctggggactac

SEQ ID NO: 131483 - DNA, 20 bp, Artificial Sequence
  chemically synthesized
atagaccctggggactacta

SEQ ID NO: 131484 - DNA, 20 bp, Artificial Sequence
  chemically synthesized
tagaccctggggactactag

SEQ ID NO: 131485 - DNA, 20 bp, Artificial Sequence
  chemically synthesized
agaccctggggactactaga

SEQ ID NO: 131486 - DNA, 20 bp, Artificial Sequence
  chemically synthesized
accctggggactactagagg

SEQ ID NO: 131487 - DNA, 20 bp, Artificial Sequence
  chemically synthesized
cccctccctcctccctctag

SEQ ID NO: 131488 - DNA, 20 bp, Artificial Sequence
  chemically synthesized
ccctggggactactagaggg

SEQ ID NO: 131489 - DNA, 20 bp, Artificial Sequence
  chemically synthesized
ctggggactactagagggag

SEQ ID NO: 131490 - DNA, 20 bp, Artificial Sequence
  chemically synthesized
actcccctccctcctccctc

SEQ ID NO: 131491 - DNA, 20 bp, Artificial Sequence
  chemically synthesized
tggggactactagagggagg

SEQ ID NO: 131492 - DNA, 20 bp, Artificial Sequence
  chemically synthesized
ggggactactagagggagga

SEQ ID NO: 131493 - DNA, 20 bp, Artificial Sequence
  chemically synthesized
ggactactagagggaggagg

SEQ ID NO: 131494 - DNA, 20 bp, Artificial Sequence
  chemically synthesized
gactactagagggaggaggg

SEQ ID NO: 131495 - DNA, 20 bp, Artificial Sequence
  chemically synthesized
actactagagggaggaggga

SEQ ID NO: 131496 - DNA, 20 bp, Artificial Sequence
  chemically synthesized
ctactagagggaggagggag

SEQ ID NO: 131497 - DNA, 20 bp, Artificial Sequence
  chemically synthesized
actagagggaggagggaggg

SEQ ID NO: 131498 - DNA, 20 bp, Artificial Sequence
  chemically synthesized
agagggaggagggaggggag

SEQ ID NO: 131499 - DNA, 20 bp, Artificial Sequence
  chemically synthesized
gagggaggagggaggggagt

SEQ ID NO: 131500 - DNA, 20 bp, Artificial Sequence
  chemically synthesized
gggttaaaaaaacgacctat

SEQ ID NO: 131501 - DNA, 20 bp, Artificial Sequence
  chemically synthesized
tagtgagcatagtaactgat

SEQ ID NO: 131502 - DNA, 20 bp, Artificial Sequence
  chemically synthesized
ttagtgagcatagtaactga

SEQ ID NO: 131503 - DNA, 20 bp, Artificial Sequence
  chemically synthesized
catcgccatgttagtgagca

SEQ ID NO: 131504 - DNA, 20 bp, Artificial Sequence
  chemically synthesized
agttactatgctcactaaca

SEQ ID NO: 131505 - DNA, 20 bp, Artificial Sequence
  chemically synthesized
gatcccatcgccatgttagt

SEQ ID NO: 131506 - DNA, 20 bp, Artificial Sequence
  chemically synthesized
tacggatcccatcgccatgt

SEQ ID NO: 131507 - DNA, 20 bp, Artificial Sequence
  chemically synthesized
tatgctcactaacatggcga

SEQ ID NO: 131508 - DNA, 20 bp, Artificial Sequence
  chemically synthesized
atgctcactaacatggcgat

SEQ ID NO: 131509 - DNA, 20 bp, Artificial Sequence
  chemically synthesized
tgatgctgaggtttggagta

SEQ ID NO: 131510 - DNA, 20 bp, Artificial Sequence
  chemically synthesized
gggatccgtactccaaacct

SEQ ID NO: 131511 - DNA, 20 bp, Artificial Sequence
  chemically synthesized
ttgcatgatgctgaggtttg

SEQ ID NO: 131512 - DNA, 20 bp, Artificial Sequence
  chemically synthesized
tattgcatgatgctgaggtt

SEQ ID NO: 131513 - DNA, 20 bp, Artificial Sequence
  chemically synthesized
gggagtattgcatgatgctg

SEQ ID NO: 131514 - DNA, 20 bp, Artificial Sequence
  chemically synthesized
tgggagtattgcatgatgct

SEQ ID NO: 131515 - DNA, 20 bp, Artificial Sequence
  chemically synthesized
tgtgcagatttgtcacgtgg

SEQ ID NO: 131516 - DNA, 20 bp, Artificial Sequence
  chemically synthesized
catgtgcagatttgtcacgt

SEQ ID NO: 131517 - DNA, 20 bp, Artificial Sequence
  chemically synthesized
gcatgtgcagatttgtcacg

SEQ ID NO: 131518 - DNA, 20 bp, Artificial Sequence
  chemically synthesized
agatacagaaggtgcatgtg

SEQ ID NO: 131519 - DNA, 20 bp, Artificial Sequence
  chemically synthesized
tttcaacttttagatacaga

SEQ ID NO: 131520 - DNA, 20 bp, Artificial Sequence
  chemically synthesized
atttcaacttttagatacag

SEQ ID NO: 131521 - DNA, 20 bp, Artificial Sequence
  chemically synthesized
catgcaccttctgtatctaa

SEQ ID NO: 131522 - DNA, 20 bp, Artificial Sequence
  chemically synthesized
ttaatttcaacttttagata

SEQ ID NO: 131523 - DNA, 20 bp, Artificial Sequence
  chemically synthesized
ttttttttaatttcaacttt

SEQ ID NO: 131524 - DNA, 20 bp, Artificial Sequence
  chemically synthesized
taaaagttgaaattaaaaaa

SEQ ID NO: 131525 - DNA, 20 bp, Artificial Sequence
  chemically synthesized
ggttccttttcacaacacag

SEQ ID NO: 131526 - DNA, 20 bp, Artificial Sequence
  chemically synthesized
gttggttccttttcacaaca

SEQ ID NO: 131527 - DNA, 20 bp, Artificial Sequence
  chemically synthesized
gaaaacttctgtgttgtgaa

SEQ ID NO: 131528 - DNA, 20 bp, Artificial Sequence
  chemically synthesized
aaaacttctgtgttgtgaaa

SEQ ID NO: 131529 - DNA, 20 bp, Artificial Sequence
  chemically synthesized
tgtgaaaaggaaccaacaat

SEQ ID NO: 131530 - DNA, 20 bp, Artificial Sequence
  chemically synthesized
tgaaaaggaaccaacaatga

SEQ ID NO: 131531 - DNA, 20 bp, Artificial Sequence
  chemically synthesized
ctatatccttctctcattgt

SEQ ID NO: 131532 - DNA, 20 bp, Artificial Sequence
  chemically synthesized
aaaggaaccaacaatgagag

SEQ ID NO: 131533 - DNA, 20 bp, Artificial Sequence
  chemically synthesized
aaggaaccaacaatgagaga

SEQ ID NO: 131534 - DNA, 20 bp, Artificial Sequence
  chemically synthesized
ccaacaatgagagaaggata

SEQ ID NO: 131535 - DNA, 20 bp, Artificial Sequence
  chemically synthesized
caacaatgagagaaggatat

SEQ ID NO: 131536 - DNA, 20 bp, Artificial Sequence
  chemically synthesized
ggatataggattttaaaaca

SEQ ID NO: 131537 - DNA, 20 bp, Artificial Sequence
  chemically synthesized
ggtttctggggtcattgttg

SEQ ID NO: 131538 - DNA, 20 bp, Artificial Sequence
  chemically synthesized
catagcttcaacaatgaccc

SEQ ID NO: 131539 - DNA, 20 bp, Artificial Sequence
  chemically synthesized
aaaggcctctgaggtttctg

SEQ ID NO: 131540 - DNA, 20 bp, Artificial Sequence
  chemically synthesized
taaaggcctctgaggtttct

SEQ ID NO: 131541 - DNA, 20 bp, Artificial Sequence
  chemically synthesized
aacaatgaccccagaaacct

SEQ ID NO: 131542 - DNA, 20 bp, Artificial Sequence
  chemically synthesized
ataaaggcctctgaggtttc

SEQ ID NO: 131543 - DNA, 20 bp, Artificial Sequence
  chemically synthesized
caatgaccccagaaacctca

SEQ ID NO: 131544 - DNA, 20 bp, Artificial Sequence
  chemically synthesized
aatgaccccagaaacctcag

SEQ ID NO: 131545 - DNA, 20 bp, Artificial Sequence
  chemically synthesized
cagttagataaaggcctctg

SEQ ID NO: 131546 - DNA, 20 bp, Artificial Sequence
  chemically synthesized
acagttagataaaggcctct

SEQ ID NO: 131547 - DNA, 20 bp, Artificial Sequence
  chemically synthesized
ccagtcagacagttagataa

SEQ ID NO: 131548 - DNA, 20 bp, Artificial Sequence
  chemically synthesized
tccagtcagacagttagata

SEQ ID NO: 131549 - DNA, 20 bp, Artificial Sequence
  chemically synthesized
attttctccagtcagacagt

SEQ ID NO: 131550 - DNA, 20 bp, Artificial Sequence
  chemically synthesized
cctttatctaactgtctgac

SEQ ID NO: 131551 - DNA, 20 bp, Artificial Sequence
  chemically synthesized
gataattttctccagtcaga

SEQ ID NO: 131552 - DNA, 20 bp, Artificial Sequence
  chemically synthesized
tttatctaactgtctgactg

SEQ ID NO: 131553 - DNA, 20 bp, Artificial Sequence
  chemically synthesized
tgtagataattttctccagt

SEQ ID NO: 131554 - DNA, 20 bp, Artificial Sequence
  chemically synthesized
accttgtagataattttctc

SEQ ID NO: 131555 - DNA, 20 bp, Artificial Sequence
  chemically synthesized
gactggagaaaattatctac

SEQ ID NO: 131556 - DNA, 20 bp, Artificial Sequence
  chemically synthesized
actggagaaaattatctaca

SEQ ID NO: 131557 - DNA, 20 bp, Artificial Sequence
  chemically synthesized
tgcaaacacgtggtaccttg

SEQ ID NO: 131558 - DNA, 20 bp, Artificial Sequence
  chemically synthesized
actgaaagcttgcaaacacg

SEQ ID NO: 131559 - DNA, 20 bp, Artificial Sequence
  chemically synthesized
acaaggtaccacgtgtttgc

SEQ ID NO: 131560 - DNA, 20 bp, Artificial Sequence
  chemically synthesized
accacgtgtttgcaagcttt

SEQ ID NO: 131561 - DNA, 20 bp, Artificial Sequence
  chemically synthesized
gctattaaaaggtgaactga

SEQ ID NO: 131562 - DNA, 20 bp, Artificial Sequence
  chemically synthesized
gctttcagttcaccttttaa

SEQ ID NO: 131563 - DNA, 20 bp, Artificial Sequence
  chemically synthesized
gttccattgtggctattaaa

SEQ ID NO: 131564 - DNA, 20 bp, Artificial Sequence
  chemically synthesized
agttccattgtggctattaa

SEQ ID NO: 131565 - DNA, 20 bp, Artificial Sequence
  chemically synthesized
tcaccttttaatagccacaa

SEQ ID NO: 131566 - DNA, 20 bp, Artificial Sequence
  chemically synthesized
cttaattcatagttccattg

SEQ ID NO: 131567 - DNA, 20 bp, Artificial Sequence
  chemically synthesized
ccacaatggaactatgaatt

SEQ ID NO: 131568 - DNA, 20 bp, Artificial Sequence
  chemically synthesized
cacaatggaactatgaatta

SEQ ID NO: 131569 - DNA, 20 bp, Artificial Sequence
  chemically synthesized
ggcttagtgtccttaattca

SEQ ID NO: 131570 - DNA, 20 bp, Artificial Sequence
  chemically synthesized
aactatgaattaaggacact

SEQ ID NO: 131571 - DNA, 20 bp, Artificial Sequence
  chemically synthesized
attaaagggagattcgggct

SEQ ID NO: 131572 - DNA, 20 bp, Artificial Sequence
  chemically synthesized
atagaattaaagggagattc

SEQ ID NO: 131573 - DNA, 20 bp, Artificial Sequence
  chemically synthesized
catagaattaaagggagatt

SEQ ID NO: 131574 - DNA, 20 bp, Artificial Sequence
  chemically synthesized
cttccacatagaattaaagg

SEQ ID NO: 131575 - DNA, 20 bp, Artificial Sequence
  chemically synthesized
tccttccacatagaattaaa

SEQ ID NO: 131576 - DNA, 20 bp, Artificial Sequence
  chemically synthesized
ttccttccacatagaattaa

SEQ ID NO: 131577 - DNA, 20 bp, Artificial Sequence
  chemically synthesized
tttccttccacatagaatta

SEQ ID NO: 131578 - DNA, 20 bp, Artificial Sequence
  chemically synthesized
aatctccctttaattctatg

SEQ ID NO: 131579 - DNA, 20 bp, Artificial Sequence
  chemically synthesized
ctccctttaattctatgtgg

SEQ ID NO: 131580 - DNA, 20 bp, Artificial Sequence
  chemically synthesized
tccctttaattctatgtgga

SEQ ID NO: 131581 - DNA, 20 bp, Artificial Sequence
  chemically synthesized
tctttacttttccttccaca

SEQ ID NO: 131582 - DNA, 20 bp, Artificial Sequence
  chemically synthesized
ttaattctatgtggaaggaa

SEQ ID NO: 131583 - DNA, 20 bp, Artificial Sequence
  chemically synthesized
tctatgtggaaggaaaagta

SEQ ID NO: 131584 - DNA, 20 bp, Artificial Sequence
  chemically synthesized
ataaacaatgattgaaaaaa

SEQ ID NO: 131585 - DNA, 20 bp, Artificial Sequence
  chemically synthesized
gaaaaaaaagacttacataa

SEQ ID NO: 131586 - DNA, 20 bp, Artificial Sequence
  chemically synthesized
tttaccatctacttttatgt

SEQ ID NO: 131587 - DNA, 20 bp, Artificial Sequence
  chemically synthesized
aaaaaagacttacataaaag

SEQ ID NO: 131588 - DNA, 20 bp, Artificial Sequence
  chemically synthesized
aagacttacataaaagtaga

SEQ ID NO: 131589 - DNA, 20 bp, Artificial Sequence
  chemically synthesized
tagatggtaaaaataaaata

SEQ ID NO: 131590 - DNA, 20 bp, Artificial Sequence
  chemically synthesized
agatggtaaaaataaaataa

SEQ ID NO: 131591 - DNA, 20 bp, Artificial Sequence
  chemically synthesized
gtaaaaataaaataaaggtc

SEQ ID NO: 131592 - DNA, 20 bp, Artificial Sequence
  chemically synthesized
aaaataaaataaaggtcaag

SEQ ID NO: 131593 - DNA, 20 bp, Artificial Sequence
  chemically synthesized
aaataaaataaaggtcaaga

SEQ ID NO: 131594 - DNA, 20 bp, Artificial Sequence
  chemically synthesized
cacaatttagaacaacattc

SEQ ID NO: 131595 - DNA, 20 bp, Artificial Sequence
  chemically synthesized
acacaatttagaacaacatt

SEQ ID NO: 131596 - DNA, 20 bp, Artificial Sequence
  chemically synthesized
atataaatttgaacacaatt

SEQ ID NO: 131597 - DNA, 20 bp, Artificial Sequence
  chemically synthesized
gtgttcaaatttatatgttc

SEQ ID NO: 131598 - DNA, 20 bp, Artificial Sequence
  chemically synthesized
tcaaatttatatgttccaga

SEQ ID NO: 131599 - DNA, 20 bp, Artificial Sequence
  chemically synthesized
aatttatatgttccagacag

SEQ ID NO: 131600 - DNA, 20 bp, Artificial Sequence
  chemically synthesized
tgctttttgtttctactgtc

SEQ ID NO: 131601 - DNA, 20 bp, Artificial Sequence
  chemically synthesized
ttccagacagtagaaacaaa

SEQ ID NO: 131602 - DNA, 20 bp, Artificial Sequence
  chemically synthesized
tacatatttataaatcatta

SEQ ID NO: 131603 - DNA, 20 bp, Artificial Sequence
  chemically synthesized
ttacatatttataaatcatt

SEQ ID NO: 131604 - DNA, 20 bp, Artificial Sequence
  chemically synthesized
aatgatttataaatatgtaa

SEQ ID NO: 131605 - DNA, 20 bp, Artificial Sequence
  chemically synthesized
tttagtaataacacaaatga

SEQ ID NO: 131606 - DNA, 20 bp, Artificial Sequence
  chemically synthesized
atttgtgttattactaaaaa

SEQ ID NO: 131607 - DNA, 20 bp, Artificial Sequence
  chemically synthesized
gaaatataaacatctatttt

SEQ ID NO: 131608 - DNA, 20 bp, Artificial Sequence
  chemically synthesized
aaaaatagatgtttatattt

SEQ ID NO: 131609 - DNA, 20 bp, Artificial Sequence
  chemically synthesized
ttattctaattttttcagga

SEQ ID NO: 131610 - DNA, 20 bp, Artificial Sequence
  chemically synthesized
aatattattctaattttttc

SEQ ID NO: 131611 - DNA, 20 bp, Artificial Sequence
  chemically synthesized
ttcagctatcctgaaaaaat

SEQ ID NO: 131612 - DNA, 20 bp, Artificial Sequence
  chemically synthesized
taatattattctaatttttt

SEQ ID NO: 131613 - DNA, 20 bp, Artificial Sequence
  chemically synthesized
gaaaaaattagaataatatt

SEQ ID NO: 131614 - DNA, 20 bp, Artificial Sequence
  chemically synthesized
aaaattagaataatattaag

SEQ ID NO: 131615 - DNA, 20 bp, Artificial Sequence
  chemically synthesized
aaattagaataatattaagt

SEQ ID NO: 131616 - DNA, 20 bp, Artificial Sequence
  chemically synthesized
atagagctctggtgtttcaa

SEQ ID NO: 131617 - DNA, 20 bp, Artificial Sequence
  chemically synthesized
aatagagctctggtgtttca

SEQ ID NO: 131618 - DNA, 20 bp, Artificial Sequence
  chemically synthesized
gcacattgcctttgaaacac

SEQ ID NO: 131619 - DNA, 20 bp, Artificial Sequence
  chemically synthesized
acattgcctttgaaacacca

SEQ ID NO: 131620 - DNA, 20 bp, Artificial Sequence
  chemically synthesized
acatttttaaaatagagctc

SEQ ID NO: 131621 - DNA, 20 bp, Artificial Sequence
  chemically synthesized
ttaagtacatttttaaaata

SEQ ID NO: 131622 - DNA, 20 bp, Artificial Sequence
  chemically synthesized
aattaagtacatttttaaaa

SEQ ID NO: 131623 - DNA, 20 bp, Artificial Sequence
  chemically synthesized
gtttagggtagaaaaaaatt

SEQ ID NO: 131624 - DNA, 20 bp, Artificial Sequence
  chemically synthesized
ctgattcagtaagtttaggg

SEQ ID NO: 131625 - DNA, 20 bp, Artificial Sequence
  chemically synthesized
actctgattcagtaagttta

SEQ ID NO: 131626 - DNA, 20 bp, Artificial Sequence
  chemically synthesized
gactctgattcagtaagttt

SEQ ID NO: 131627 - DNA, 20 bp, Artificial Sequence
  chemically synthesized
agactctgattcagtaagtt

SEQ ID NO: 131628 - DNA, 20 bp, Artificial Sequence
  chemically synthesized
ctaccctaaacttactgaat

SEQ ID NO: 131629 - DNA, 20 bp, Artificial Sequence
  chemically synthesized
ccaaaagactctgattcagt

SEQ ID NO: 131630 - DNA, 20 bp, Artificial Sequence
  chemically synthesized
accctaaacttactgaatca

SEQ ID NO: 131631 - DNA, 20 bp, Artificial Sequence
  chemically synthesized
agagccaaaagactctgatt

SEQ ID NO: 131632 - DNA, 20 bp, Artificial Sequence
  chemically synthesized
cttactgaatcagagtcttt

SEQ ID NO: 131633 - DNA, 20 bp, Artificial Sequence
  chemically synthesized
tgcaatagttcaagagccaa

SEQ ID NO: 131634 - DNA, 20 bp, Artificial Sequence
  chemically synthesized
gaatgcatgcaatagttcaa

SEQ ID NO: 131635 - DNA, 20 bp, Artificial Sequence
  chemically synthesized
gagaatgcatgcaatagttc

SEQ ID NO: 131636 - DNA, 20 bp, Artificial Sequence
  chemically synthesized
tctgttgagaatgcatgcaa

SEQ ID NO: 131637 - DNA, 20 bp, Artificial Sequence
  chemically synthesized
actattgcatgcattctcaa

SEQ ID NO: 131638 - DNA, 20 bp, Artificial Sequence
  chemically synthesized
ttggggtgtcattatctgtt

SEQ ID NO: 131639 - DNA, 20 bp, Artificial Sequence
  chemically synthesized
tcaacagataatgacacccc

SEQ ID NO: 131640 - DNA, 20 bp, Artificial Sequence
  chemically synthesized
caacagataatgacacccca

SEQ ID NO: 131641 - DNA, 20 bp, Artificial Sequence
  chemically synthesized
aacagataatgacaccccaa

SEQ ID NO: 131642 - DNA, 20 bp, Artificial Sequence
  chemically synthesized
cagataatgacaccccaagg

SEQ ID NO: 131643 - DNA, 20 bp, Artificial Sequence
  chemically synthesized
aacaaattttcactcccttg

SEQ ID NO: 131644 - DNA, 20 bp, Artificial Sequence
  chemically synthesized
gaacaaattttcactccctt

SEQ ID NO: 131645 - DNA, 20 bp, Artificial Sequence
  chemically synthesized
agaacaaattttcactccct

SEQ ID NO: 131646 - DNA, 20 bp, Artificial Sequence
  chemically synthesized
gggagtgaaaatttgttctt

SEQ ID NO: 131647 - DNA, 20 bp, Artificial Sequence
  chemically synthesized
gagtgaaaatttgttcttga

SEQ ID NO: 131648 - DNA, 20 bp, Artificial Sequence
  chemically synthesized
gctaagaatttttatctctc

SEQ ID NO: 131649 - DNA, 20 bp, Artificial Sequence
  chemically synthesized
tcttgagagataaaaattct

SEQ ID NO: 131650 - DNA, 20 bp, Artificial Sequence
  chemically synthesized
attgtgactcagaaatagct

SEQ ID NO: 131651 - DNA, 20 bp, Artificial Sequence
  chemically synthesized
aaaaattcttagctatttct

SEQ ID NO: 131652 - DNA, 20 bp, Artificial Sequence
  chemically synthesized
aaaccattgtgactcagaaa

SEQ ID NO: 131653 - DNA, 20 bp, Artificial Sequence
  chemically synthesized
ggtaataaaccattgtgact

SEQ ID NO: 131654 - DNA, 20 bp, Artificial Sequence
  chemically synthesized
tagctatttctgagtcacaa

SEQ ID NO: 131655 - DNA, 20 bp, Artificial Sequence
  chemically synthesized
aatggtttattaccctctga

SEQ ID NO: 131656 - DNA, 20 bp, Artificial Sequence
  chemically synthesized
cgtatattgtggctttcaga

SEQ ID NO: 131657 - DNA, 20 bp, Artificial Sequence
  chemically synthesized
ccgtatattgtggctttcag

SEQ ID NO: 131658 - DNA, 20 bp, Artificial Sequence
  chemically synthesized
cccgtatattgtggctttca

SEQ ID NO: 131659 - DNA, 20 bp, Artificial Sequence
  chemically synthesized
tgcccgtatattgtggcttt

SEQ ID NO: 131660 - DNA, 20 bp, Artificial Sequence
  chemically synthesized
cctctgaaagccacaatata

SEQ ID NO: 131661 - DNA, 20 bp, Artificial Sequence
  chemically synthesized
ttagatctgcccgtatattg

SEQ ID NO: 131662 - DNA, 20 bp, Artificial Sequence
  chemically synthesized
ctctgaaagccacaatatac

SEQ ID NO: 131663 - DNA, 20 bp, Artificial Sequence
  chemically synthesized
tgaaagccacaatatacggg

SEQ ID NO: 131664 - DNA, 20 bp, Artificial Sequence
  chemically synthesized
acaatatacgggcagatcta

SEQ ID NO: 131665 - DNA, 20 bp, Artificial Sequence
  chemically synthesized
ttaataccacagacatgctt

SEQ ID NO: 131666 - DNA, 20 bp, Artificial Sequence
  chemically synthesized
gcagatctaaagcatgtctg

SEQ ID NO: 131667 - DNA, 20 bp, Artificial Sequence
  chemically synthesized
ccatccgtgttttaatacca

SEQ ID NO: 131668 - DNA, 20 bp, Artificial Sequence
  chemically synthesized
atgtctgtggtattaaaaca

SEQ ID NO: 131669 - DNA, 20 bp, Artificial Sequence
  chemically synthesized
ctgtggtattaaaacacgga

SEQ ID NO: 131670 - DNA, 20 bp, Artificial Sequence
  chemically synthesized
taaaacacggatggatataa

SEQ ID NO: 131671 - DNA, 20 bp, Artificial Sequence
  chemically synthesized
aaaacacggatggatataaa

SEQ ID NO: 131672 - DNA, 20 bp, Artificial Sequence
  chemically synthesized
gatataaaaggaaaaaaatc

SEQ ID NO: 131673 - DNA, 20 bp, Artificial Sequence
  chemically synthesized
agttatcactcatgaaattg

SEQ ID NO: 131674 - DNA, 20 bp, Artificial Sequence
  chemically synthesized
cagttatcactcatgaaatt

SEQ ID NO: 131675 - DNA, 20 bp, Artificial Sequence
  chemically synthesized
caagttcacctcaatttcat

SEQ ID NO: 131676 - DNA, 20 bp, Artificial Sequence
  chemically synthesized
aaatacatcaaagtggtttg

SEQ ID NO: 131677 - DNA, 20 bp, Artificial Sequence
  chemically synthesized
tggaaggaaatacatcaaag

SEQ ID NO: 131678 - DNA, 20 bp, Artificial Sequence
  chemically synthesized
aactggaaggaaatacatca

SEQ ID NO: 131679 - DNA, 20 bp, Artificial Sequence
  chemically synthesized
cactttgatgtatttccttc

SEQ ID NO: 131680 - DNA, 20 bp, Artificial Sequence
  chemically synthesized
caaaagaaattataactgga

SEQ ID NO: 131681 - DNA, 20 bp, Artificial Sequence
  chemically synthesized
gcaaaagaaattataactgg

SEQ ID NO: 131682 - DNA, 20 bp, Artificial Sequence
  chemically synthesized
ccagcaaaagaaattataac

SEQ ID NO: 131683 - DNA, 20 bp, Artificial Sequence
  chemically synthesized
ccagttataatttcttttgc

SEQ ID NO: 131684 - DNA, 20 bp, Artificial Sequence
  chemically synthesized
aaaacagagaaaaccagcaa

SEQ ID NO: 131685 - DNA, 20 bp, Artificial Sequence
  chemically synthesized
ttgtaaaaaacagagaaaac

SEQ ID NO: 131686 - DNA, 20 bp, Artificial Sequence
  chemically synthesized
tcctaattttgtaaaaaaca

SEQ ID NO: 131687 - DNA, 20 bp, Artificial Sequence
  chemically synthesized
gatcctaattttgtaaaaaa

SEQ ID NO: 131688 - DNA, 20 bp, Artificial Sequence
  chemically synthesized
ttctctgttttttacaaaat

SEQ ID NO: 131689 - DNA, 20 bp, Artificial Sequence
  chemically synthesized
tctctgttttttacaaaatt

SEQ ID NO: 131690 - DNA, 20 bp, Artificial Sequence
  chemically synthesized
tttacaaaattaggatccta

SEQ ID NO: 131691 - DNA, 20 bp, Artificial Sequence
  chemically synthesized
tatggaattatttatgccat

SEQ ID NO: 131692 - DNA, 20 bp, Artificial Sequence
  chemically synthesized
atatggaattatttatgcca

SEQ ID NO: 131693 - DNA, 20 bp, Artificial Sequence
  chemically synthesized
tcaggaaaaaaagtaggata

SEQ ID NO: 131694 - DNA, 20 bp, Artificial Sequence
  chemically synthesized
taatgctcaggaaaaaaagt

SEQ ID NO: 131695 - DNA, 20 bp, Artificial Sequence
  chemically synthesized
ttaatgctcaggaaaaaaag

SEQ ID NO: 131696 - DNA, 20 bp, Artificial Sequence
  chemically synthesized
acattaatgctcaggaaaaa

SEQ ID NO: 131697 - DNA, 20 bp, Artificial Sequence
  chemically synthesized
catatcctactttttttcct

SEQ ID NO: 131698 - DNA, 20 bp, Artificial Sequence
  chemically synthesized
ttattacaacattaatgctc

SEQ ID NO: 131699 - DNA, 20 bp, Artificial Sequence
  chemically synthesized
attattacaacattaatgct

SEQ ID NO: 131700 - DNA, 20 bp, Artificial Sequence
  chemically synthesized
aaatagtatttaatgatata

SEQ ID NO: 131701 - DNA, 20 bp, Artificial Sequence
  chemically synthesized
caaatagtatttaatgatat

SEQ ID NO: 131702 - DNA, 20 bp, Artificial Sequence
  chemically synthesized
tcaaatagtatttaatgata

SEQ ID NO: 131703 - DNA, 20 bp, Artificial Sequence
  chemically synthesized
ttaatggaagtagtttcaaa

SEQ ID NO: 131704 - DNA, 20 bp, Artificial Sequence
  chemically synthesized
attaaaatgtttaatggaag

SEQ ID NO: 131705 - DNA, 20 bp, Artificial Sequence
  chemically synthesized
aatattaaaatgtttaatgg

SEQ ID NO: 131706 - DNA, 20 bp, Artificial Sequence
  chemically synthesized
ctgaatattaaaatgtttaa

SEQ ID NO: 131707 - DNA, 20 bp, Artificial Sequence
  chemically synthesized
ccattaaacattttaatatt

SEQ ID NO: 131708 - DNA, 20 bp, Artificial Sequence
  chemically synthesized
ttaaacattttaatattcag

SEQ ID NO: 131709 - DNA, 20 bp, Artificial Sequence
  chemically synthesized
acattttaatattcagtggt

SEQ ID NO: 131710 - DNA, 20 bp, Artificial Sequence
  chemically synthesized
tttttggagaaagtttatta

SEQ ID NO: 131711 - DNA, 20 bp, Artificial Sequence
  chemically synthesized
aaaacattaatttttggaga

SEQ ID NO: 131712 - DNA, 20 bp, Artificial Sequence
  chemically synthesized
tattaaaacattaatttttg

SEQ ID NO: 131713 - DNA, 20 bp, Artificial Sequence
  chemically synthesized
actattaaaacattaatttt

SEQ ID NO: 131714 - DNA, 20 bp, Artificial Sequence
  chemically synthesized
tccaaaaattaatgttttaa

SEQ ID NO: 131715 - DNA, 20 bp, Artificial Sequence
  chemically synthesized
aattaatgttttaatagtat

SEQ ID NO: 131716 - DNA, 20 bp, Artificial Sequence
  chemically synthesized
tagtattataaaatgcattt

SEQ ID NO: 131717 - DNA, 20 bp, Artificial Sequence
  chemically synthesized
ttagattattaatcactttc

SEQ ID NO: 131718 - DNA, 20 bp, Artificial Sequence
  chemically synthesized
tttggttatttatcactgga

SEQ ID NO: 131719 - DNA, 20 bp, Artificial Sequence
  chemically synthesized
gtaatttggttatttatcac

SEQ ID NO: 131720 - DNA, 20 bp, Artificial Sequence
  chemically synthesized
tatcatttaagattgtaatt

SEQ ID NO: 131721 - DNA, 20 bp, Artificial Sequence
  chemically synthesized
caaattacaatcttaaatga

SEQ ID NO: 131722 - DNA, 20 bp, Artificial Sequence
  chemically synthesized
cactttagtgtctatcattt

SEQ ID NO: 131723 - DNA, 20 bp, Artificial Sequence
  chemically synthesized
atcttaaatgatagacacta

SEQ ID NO: 131724 - DNA, 20 bp, Artificial Sequence
  chemically synthesized
atgatagacactaaagtgtt

SEQ ID NO: 131725 - DNA, 20 bp, Artificial Sequence
  chemically synthesized
aatttggtcactaaacactt

SEQ ID NO: 131726 - DNA, 20 bp, Artificial Sequence
  chemically synthesized
tggaaactgagtaagaaatt

SEQ ID NO: 131727 - DNA, 20 bp, Artificial Sequence
  chemically synthesized
tagtgaccaaatttcttact

SEQ ID NO: 131728 - DNA, 20 bp, Artificial Sequence
  chemically synthesized
aacagggatggaaactgagt

SEQ ID NO: 131729 - DNA, 20 bp, Artificial Sequence
  chemically synthesized
tttgaacagggatggaaact

SEQ ID NO: 131730 - DNA, 20 bp, Artificial Sequence
  chemically synthesized
tggcattgtttgaacaggga

SEQ ID NO: 131731 - DNA, 20 bp, Artificial Sequence
  chemically synthesized
aaaatggcattgtttgaaca

SEQ ID NO: 131732 - DNA, 20 bp, Artificial Sequence
  chemically synthesized
taaaatggcattgtttgaac

SEQ ID NO: 131733 - DNA, 20 bp, Artificial Sequence
  chemically synthesized
ataaaatggcattgtttgaa

SEQ ID NO: 131734 - DNA, 20 bp, Artificial Sequence
  chemically synthesized
agagaaagcagaagataaaa

SEQ ID NO: 131735 - DNA, 20 bp, Artificial Sequence
  chemically synthesized
aaagcagagagagaaagcag

SEQ ID NO: 131736 - DNA, 20 bp, Artificial Sequence
  chemically synthesized
aagaaagcagagagagaaag

SEQ ID NO: 131737 - DNA, 20 bp, Artificial Sequence
  chemically synthesized
agaaagaaagcagagagaga

SEQ ID NO: 131738 - DNA, 20 bp, Artificial Sequence
  chemically synthesized
agcaagaaagaaagcagaga

SEQ ID NO: 131739 - DNA, 20 bp, Artificial Sequence
  chemically synthesized
agagcaagaaagaaagcaga

SEQ ID NO: 131740 - DNA, 20 bp, Artificial Sequence
  chemically synthesized
caagagcaagaaagaaagca

SEQ ID NO: 131741 - DNA, 20 bp, Artificial Sequence
  chemically synthesized
agcaagagcaagaaagaaag

SEQ ID NO: 131742 - DNA, 20 bp, Artificial Sequence
  chemically synthesized
gagagcaagagcaagaaaga

SEQ ID NO: 131743 - DNA, 20 bp, Artificial Sequence
  chemically synthesized
gaaagagagcaagagcaaga

SEQ ID NO: 131744 - DNA, 20 bp, Artificial Sequence
  chemically synthesized
aaaagaaagagagcaagagc

SEQ ID NO: 131745 - DNA, 20 bp, Artificial Sequence
  chemically synthesized
tctcaaaagaaagagagcaa

SEQ ID NO: 131746 - DNA, 20 bp, Artificial Sequence
  chemically synthesized
cttctcaaaagaaagagagc

SEQ ID NO: 131747 - DNA, 20 bp, Artificial Sequence
  chemically synthesized
aagtcttctcaaaagaaaga

SEQ ID NO: 131748 - DNA, 20 bp, Artificial Sequence
  chemically synthesized
aaaagtcttctcaaaagaaa

SEQ ID NO: 131749 - DNA, 20 bp, Artificial Sequence
  chemically synthesized
gctcttgctctctttctttt

SEQ ID NO: 131750 - DNA, 20 bp, Artificial Sequence
  chemically synthesized
tcaaaagtcttctcaaaaga

SEQ ID NO: 131751 - DNA, 20 bp, Artificial Sequence
  chemically synthesized
cttgctctctttcttttgag

SEQ ID NO: 131752 - DNA, 20 bp, Artificial Sequence
  chemically synthesized
gatttcaaaagtcttctcaa

SEQ ID NO: 131753 - DNA, 20 bp, Artificial Sequence
  chemically synthesized
tctagaaagtttgatttcaa

SEQ ID NO: 131754 - DNA, 20 bp, Artificial Sequence
  chemically synthesized
acttttgaaatcaaactttc

SEQ ID NO: 131755 - DNA, 20 bp, Artificial Sequence
  chemically synthesized
tcatatgcagacattctaga

SEQ ID NO: 131756 - DNA, 20 bp, Artificial Sequence
  chemically synthesized
tagctcatatgcagacattc

SEQ ID NO: 131757 - DNA, 20 bp, Artificial Sequence
  chemically synthesized
tttctagaatgtctgcatat

SEQ ID NO: 131758 - DNA, 20 bp, Artificial Sequence
  chemically synthesized
gtaggaatctagctcatatg

SEQ ID NO: 131759 - DNA, 20 bp, Artificial Sequence
  chemically synthesized
tagaatgtctgcatatgagc

SEQ ID NO: 131760 - DNA, 20 bp, Artificial Sequence
  chemically synthesized
gaactgcaaaagtaggaatc

SEQ ID NO: 131761 - DNA, 20 bp, Artificial Sequence
  chemically synthesized
gagctagattcctacttttg

SEQ ID NO: 131762 - DNA, 20 bp, Artificial Sequence
  chemically synthesized
ctctttagaactgcaaaagt

SEQ ID NO: 131763 - DNA, 20 bp, Artificial Sequence
  chemically synthesized
tctctttagaactgcaaaag

SEQ ID NO: 131764 - DNA, 20 bp, Artificial Sequence
  chemically synthesized
tactctctttagaactgcaa

SEQ ID NO: 131765 - DNA, 20 bp, Artificial Sequence
  chemically synthesized
ttcctacttttgcagttcta

SEQ ID NO: 131766 - DNA, 20 bp, Artificial Sequence
  chemically synthesized
cctacttttgcagttctaaa

SEQ ID NO: 131767 - DNA, 20 bp, Artificial Sequence
  chemically synthesized
tacttttgcagttctaaaga

SEQ ID NO: 131768 - DNA, 20 bp, Artificial Sequence
  chemically synthesized
ccagccgattttactctctt

SEQ ID NO: 131769 - DNA, 20 bp, Artificial Sequence
  chemically synthesized
agttctaaagagagtaaaat

SEQ ID NO: 131770 - DNA, 20 bp, Artificial Sequence
  chemically synthesized
ctaaagagagtaaaatcggc

SEQ ID NO: 131771 - DNA, 20 bp, Artificial Sequence
  chemically synthesized
taaagagagtaaaatcggct

SEQ ID NO: 131772 - DNA, 20 bp, Artificial Sequence
  chemically synthesized
agagtaaaatcggctgggcg

SEQ ID NO: 131773 - DNA, 20 bp, Artificial Sequence
  chemically synthesized
gtaaaatcggctgggcgtgg

SEQ ID NO: 131774 - DNA, 20 bp, Artificial Sequence
  chemically synthesized
caggtgtgagccaccacgcc

SEQ ID NO: 131775 - DNA, 20 bp, Artificial Sequence
  chemically synthesized
agagctgggattacaggtgt

SEQ ID NO: 131776 - DNA, 20 bp, Artificial Sequence
  chemically synthesized
gtggctcacacctgtaatcc

SEQ ID NO: 131777 - DNA, 20 bp, Artificial Sequence
  chemically synthesized
ccccaaagagctgggattac

SEQ ID NO: 131778 - DNA, 20 bp, Artificial Sequence
  chemically synthesized
cccccaaagagctgggatta

SEQ ID NO: 131779 - DNA, 20 bp, Artificial Sequence
  chemically synthesized
cacctgtaatcccagctctt

SEQ ID NO: 131780 - DNA, 20 bp, Artificial Sequence
  chemically synthesized
ccttgttcccccaaagagct

SEQ ID NO: 131781 - DNA, 20 bp, Artificial Sequence
  chemically synthesized
acctgtaatcccagctcttt

SEQ ID NO: 131782 - DNA, 20 bp, Artificial Sequence
  chemically synthesized
gccttgttcccccaaagagc

SEQ ID NO: 131783 - DNA, 20 bp, Artificial Sequence
  chemically synthesized
cctgtaatcccagctctttg

SEQ ID NO: 131784 - DNA, 20 bp, Artificial Sequence
  chemically synthesized
ctgtaatcccagctctttgg

SEQ ID NO: 131785 - DNA, 20 bp, Artificial Sequence
  chemically synthesized
gtctgccttgttcccccaaa

SEQ ID NO: 131786 - DNA, 20 bp, Artificial Sequence
  chemically synthesized
ctgtctgccttgttccccca

SEQ ID NO: 131787 - DNA, 20 bp, Artificial Sequence
  chemically synthesized
tcccagctctttgggggaac

SEQ ID NO: 131788 - DNA, 20 bp, Artificial Sequence
  chemically synthesized
cccagctctttgggggaaca

SEQ ID NO: 131789 - DNA, 20 bp, Artificial Sequence
  chemically synthesized
agctctttgggggaacaagg

SEQ ID NO: 131790 - DNA, 20 bp, Artificial Sequence
  chemically synthesized
ctttgggggaacaaggcaga

SEQ ID NO: 131791 - DNA, 20 bp, Artificial Sequence
  chemically synthesized
gcagacagatcacttgaatt

SEQ ID NO: 131792 - DNA, 20 bp, Artificial Sequence
  chemically synthesized
cagacagatcacttgaattc

SEQ ID NO: 131793 - DNA, 20 bp, Artificial Sequence
  chemically synthesized
ggtcctgaactcctgaattc

SEQ ID NO: 131794 - DNA, 20 bp, Artificial Sequence
  chemically synthesized
gacagatcacttgaattcag

SEQ ID NO: 131795 - DNA, 20 bp, Artificial Sequence
  chemically synthesized
atcacttgaattcaggagtt

SEQ ID NO: 131796 - DNA, 20 bp, Artificial Sequence
  chemically synthesized
tcacttgaattcaggagttc

SEQ ID NO: 131797 - DNA, 20 bp, Artificial Sequence
  chemically synthesized
tgaattcaggagttcaggac

SEQ ID NO: 131798 - DNA, 20 bp, Artificial Sequence
  chemically synthesized
cttcaccatgttggtcaggc

SEQ ID NO: 131799 - DNA, 20 bp, Artificial Sequence
  chemically synthesized
gggacttcaccatgttggtc

SEQ ID NO: 131800 - DNA, 20 bp, Artificial Sequence
  chemically synthesized
caggaccagcctgaccaaca

SEQ ID NO: 131801 - DNA, 20 bp, Artificial Sequence
  chemically synthesized
tgggacttcaccatgttggt

SEQ ID NO: 131802 - DNA, 20 bp, Artificial Sequence
  chemically synthesized
gagatgggacttcaccatgt

SEQ ID NO: 131803 - DNA, 20 bp, Artificial Sequence
  chemically synthesized
ccagcctgaccaacatggtg

SEQ ID NO: 131804 - DNA, 20 bp, Artificial Sequence
  chemically synthesized
tttgtatttttagtagagat

SEQ ID NO: 131805 - DNA, 20 bp, Artificial Sequence
  chemically synthesized
ttttgtatttttagtagaga

SEQ ID NO: 131806 - DNA, 20 bp, Artificial Sequence
  chemically synthesized
taatttttgtatttttagta

SEQ ID NO: 131807 - DNA, 20 bp, Artificial Sequence
  chemically synthesized
gctaatttttgtatttttag

SEQ ID NO: 131808 - DNA, 20 bp, Artificial Sequence
  chemically synthesized
ccagctaatttttgtatttt

SEQ ID NO: 131809 - DNA, 20 bp, Artificial Sequence
  chemically synthesized
tctactaaaaatacaaaaat

SEQ ID NO: 131810 - DNA, 20 bp, Artificial Sequence
  chemically synthesized
ctaaaaatacaaaaattagc

SEQ ID NO: 131811 - DNA, 20 bp, Artificial Sequence
  chemically synthesized
taaaaatacaaaaattagct

SEQ ID NO: 131812 - DNA, 20 bp, Artificial Sequence
  chemically synthesized
atacaaaaattagctgggca

SEQ ID NO: 131813 - DNA, 20 bp, Artificial Sequence
  chemically synthesized
caaaaattagctgggcatgg

SEQ ID NO: 131814 - DNA, 20 bp, Artificial Sequence
  chemically synthesized
cagacatgtaccaccatgcc

SEQ ID NO: 131815 - DNA, 20 bp, Artificial Sequence
  chemically synthesized
ggcatggtggtacatgtctg

SEQ ID NO: 131816 - DNA, 20 bp, Artificial Sequence
  chemically synthesized
gtggtacatgtctgtagtct

SEQ ID NO: 131817 - DNA, 20 bp, Artificial Sequence
  chemically synthesized
ctcctgagtagctgagacta

SEQ ID NO: 131818 - DNA, 20 bp, Artificial Sequence
  chemically synthesized
tgtctgtagtctcagctact

SEQ ID NO: 131819 - DNA, 20 bp, Artificial Sequence
  chemically synthesized
cctcagcctcctgagtagct

SEQ ID NO: 131820 - DNA, 20 bp, Artificial Sequence
  chemically synthesized
gtctgtagtctcagctactc

SEQ ID NO: 131821 - DNA, 20 bp, Artificial Sequence
  chemically synthesized
ctgtagtctcagctactcag

SEQ ID NO: 131822 - DNA, 20 bp, Artificial Sequence
  chemically synthesized
tgtagtctcagctactcagg

SEQ ID NO: 131823 - DNA, 20 bp, Artificial Sequence
  chemically synthesized
tcctgcctcagcctcctgag

SEQ ID NO: 131824 - DNA, 20 bp, Artificial Sequence
  chemically synthesized
ttctcctgcctcagcctcct

SEQ ID NO: 131825 - DNA, 20 bp, Artificial Sequence
  chemically synthesized
tctcagctactcaggaggct

SEQ ID NO: 131826 - DNA, 20 bp, Artificial Sequence
  chemically synthesized
ctcagctactcaggaggctg

SEQ ID NO: 131827 - DNA, 20 bp, Artificial Sequence
  chemically synthesized
agctactcaggaggctgagg

SEQ ID NO: 131828 - DNA, 20 bp, Artificial Sequence
  chemically synthesized
gctactcaggaggctgaggc

SEQ ID NO: 131829 - DNA, 20 bp, Artificial Sequence
  chemically synthesized
tactcaggaggctgaggcag

SEQ ID NO: 131830 - DNA, 20 bp, Artificial Sequence
  chemically synthesized
ttcgagtgattctcctgcct

SEQ ID NO: 131831 - DNA, 20 bp, Artificial Sequence
  chemically synthesized
ggcaggagaatcactcgaaa

SEQ ID NO: 131832 - DNA, 20 bp, Artificial Sequence
  chemically synthesized
gcaggagaatcactcgaaac

SEQ ID NO: 131833 - DNA, 20 bp, Artificial Sequence
  chemically synthesized
aggagaatcactcgaaacag

SEQ ID NO: 131834 - DNA, 20 bp, Artificial Sequence
  chemically synthesized
caacctccacctcctgtttc

SEQ ID NO: 131835 - DNA, 20 bp, Artificial Sequence
  chemically synthesized
ggagaatcactcgaaacagg

SEQ ID NO: 131836 - DNA, 20 bp, Artificial Sequence
  chemically synthesized
gaatcactcgaaacaggagg

SEQ ID NO: 131837 - DNA, 20 bp, Artificial Sequence
  chemically synthesized
atcactcgaaacaggaggtg

SEQ ID NO: 131838 - DNA, 20 bp, Artificial Sequence
  chemically synthesized
tcactcgaaacaggaggtgg

SEQ ID NO: 131839 - DNA, 20 bp, Artificial Sequence
  chemically synthesized
gaaacaggaggtggaggttg

SEQ ID NO: 131840 - DNA, 20 bp, Artificial Sequence
  chemically synthesized
caggaggtggaggttgcagt

SEQ ID NO: 131841 - DNA, 20 bp, Artificial Sequence
  chemically synthesized
ggtggaggttgcagtgagcc

SEQ ID NO: 131842 - DNA, 20 bp, Artificial Sequence
  chemically synthesized
ggttgcagtgagccgagatt

SEQ ID NO: 131843 - DNA, 20 bp, Artificial Sequence
  chemically synthesized
agagtgtagtggctcaatct

SEQ ID NO: 131844 - DNA, 20 bp, Artificial Sequence
  chemically synthesized
tcacccaggctagagtgtag

SEQ ID NO: 131845 - DNA, 20 bp, Artificial Sequence
  chemically synthesized
gagattgagccactacactc

SEQ ID NO: 131846 - DNA, 20 bp, Artificial Sequence
  chemically synthesized
ctgtcacccaggctagagtg

SEQ ID NO: 131847 - DNA, 20 bp, Artificial Sequence
  chemically synthesized
tgagccactacactctagcc

SEQ ID NO: 131848 - DNA, 20 bp, Artificial Sequence
  chemically synthesized
gagccactacactctagcct

SEQ ID NO: 131849 - DNA, 20 bp, Artificial Sequence
  chemically synthesized
tcactctgtcacccaggcta

SEQ ID NO: 131850 - DNA, 20 bp, Artificial Sequence
  chemically synthesized
tctcactctgtcacccaggc

SEQ ID NO: 131851 - DNA, 20 bp, Artificial Sequence
  chemically synthesized
ctacactctagcctgggtga

SEQ ID NO: 131852 - DNA, 20 bp, Artificial Sequence
  chemically synthesized
agagtctcactctgtcaccc

SEQ ID NO: 131853 - DNA, 20 bp, Artificial Sequence
  chemically synthesized
acactctagcctgggtgaca

SEQ ID NO: 131854 - DNA, 20 bp, Artificial Sequence
  chemically synthesized
cagagtctcactctgtcacc

SEQ ID NO: 131855 - DNA, 20 bp, Artificial Sequence
  chemically synthesized
tctagcctgggtgacagagt

SEQ ID NO: 131856 - DNA, 20 bp, Artificial Sequence
  chemically synthesized
ttgattgattgattgagtca

SEQ ID NO: 131857 - DNA, 20 bp, Artificial Sequence
  chemically synthesized
gattgattgattgattgagt

SEQ ID NO: 131858 - DNA, 20 bp, Artificial Sequence
  chemically synthesized
gattgattgattgattgatt

SEQ ID NO: 131859 - DNA, 20 bp, Artificial Sequence
  chemically synthesized
aatcaatcaatcaatcaatc

SEQ ID NO: 131860 - DNA, 20 bp, Artificial Sequence
  chemically synthesized
tcaatcaatcgagtcaaatc

SEQ ID NO: 131861 - DNA, 20 bp, Artificial Sequence
  chemically synthesized
caatcgagtcaaatcaagaa

SEQ ID NO: 131862 - DNA, 20 bp, Artificial Sequence
  chemically synthesized
atcgagtcaaatcaagaaaa

SEQ ID NO: 131863 - DNA, 20 bp, Artificial Sequence
  chemically synthesized
gtcaaatcaagaaaagagtg

SEQ ID NO: 131864 - DNA, 20 bp, Artificial Sequence
  chemically synthesized
caaatcaagaaaagagtgca

SEQ ID NO: 131865 - DNA, 20 bp, Artificial Sequence
  chemically synthesized
agaaaagagtgcagagtaca

SEQ ID NO: 131866 - DNA, 20 bp, Artificial Sequence
  chemically synthesized
aaaagagtgcagagtacaaa

SEQ ID NO: 131867 - DNA, 20 bp, Artificial Sequence
  chemically synthesized
gtgcagagtacaaagagttt

SEQ ID NO: 131868 - DNA, 20 bp, Artificial Sequence
  chemically synthesized
agtacaaagagtttgagact

SEQ ID NO: 131869 - DNA, 20 bp, Artificial Sequence
  chemically synthesized
agagtttgagactaagctct

SEQ ID NO: 131870 - DNA, 20 bp, Artificial Sequence
  chemically synthesized
aagacccagttcttagagct

SEQ ID NO: 131871 - DNA, 20 bp, Artificial Sequence
  chemically synthesized
tgagactaagctctaagaac

SEQ ID NO: 131872 - DNA, 20 bp, Artificial Sequence
  chemically synthesized
cgttaaagacccagttctta

SEQ ID NO: 131873 - DNA, 20 bp, Artificial Sequence
  chemically synthesized
gagactaagctctaagaact

SEQ ID NO: 131874 - DNA, 20 bp, Artificial Sequence
  chemically synthesized
ttcgttaaagacccagttct

SEQ ID NO: 131875 - DNA, 20 bp, Artificial Sequence
  chemically synthesized
gtacagcttcgttaaagacc

SEQ ID NO: 131876 - DNA, 20 bp, Artificial Sequence
  chemically synthesized
taagaactgggtctttaacg

SEQ ID NO: 131877 - DNA, 20 bp, Artificial Sequence
  chemically synthesized
taaaaggtacagcttcgtta

SEQ ID NO: 131878 - DNA, 20 bp, Artificial Sequence
  chemically synthesized
ttaagtgaaaataaaaggta

SEQ ID NO: 131879 - DNA, 20 bp, Artificial Sequence
  chemically synthesized
gaaaattaagtgaaaataaa

SEQ ID NO: 131880 - DNA, 20 bp, Artificial Sequence
  chemically synthesized
tgaaaattaagtgaaaataa

SEQ ID NO: 131881 - DNA, 20 bp, Artificial Sequence
  chemically synthesized
aaaggaatcaattgaaaatt

SEQ ID NO: 131882 - DNA, 20 bp, Artificial Sequence
  chemically synthesized
ccatataaacaatgcaacaa

SEQ ID NO: 131883 - DNA, 20 bp, Artificial Sequence
  chemically synthesized
gccatataaacaatgcaaca

SEQ ID NO: 131884 - DNA, 20 bp, Artificial Sequence
  chemically synthesized
cctttgttgcattgtttata

SEQ ID NO: 131885 - DNA, 20 bp, Artificial Sequence
  chemically synthesized
tggtaattatgtgtaagaac

SEQ ID NO: 131886 - DNA, 20 bp, Artificial Sequence
  chemically synthesized
ttaaaatggtaattatgtgt

SEQ ID NO: 131887 - DNA, 20 bp, Artificial Sequence
  chemically synthesized
ttttctagattaaattaaaa

SEQ ID NO: 131888 - DNA, 20 bp, Artificial Sequence
  chemically synthesized
attaccattttaatttaatc

SEQ ID NO: 131889 - DNA, 20 bp, Artificial Sequence
  chemically synthesized
cattctattattattttttc

SEQ ID NO: 131890 - DNA, 20 bp, Artificial Sequence
  chemically synthesized
taatctagaaaaaataataa

SEQ ID NO: 131891 - DNA, 20 bp, Artificial Sequence
  chemically synthesized
agaaaaaataataatagaat

SEQ ID NO: 131892 - DNA, 20 bp, Artificial Sequence
  chemically synthesized
aaaataataatagaatgaga

SEQ ID NO: 131893 - DNA, 20 bp, Artificial Sequence
  chemically synthesized
ataataatagaatgagaaag

SEQ ID NO: 131894 - DNA, 20 bp, Artificial Sequence
  chemically synthesized
ataaaaattttttctttatc

SEQ ID NO: 131895 - DNA, 20 bp, Artificial Sequence
  chemically synthesized
taaaaattttttctttatct

SEQ ID NO: 131896 - DNA, 20 bp, Artificial Sequence
  chemically synthesized
accaattcctgacccagata

SEQ ID NO: 131897 - DNA, 20 bp, Artificial Sequence
  chemically synthesized
aattttttctttatctgggt

SEQ ID NO: 131898 - DNA, 20 bp, Artificial Sequence
  chemically synthesized
attttttctttatctgggtc

SEQ ID NO: 131899 - DNA, 20 bp, Artificial Sequence
  chemically synthesized
ataacaaccaattcctgacc

SEQ ID NO: 131900 - DNA, 20 bp, Artificial Sequence
  chemically synthesized
tctttatctgggtcaggaat

SEQ ID NO: 131901 - DNA, 20 bp, Artificial Sequence
  chemically synthesized
aggaattggttgttattgta

SEQ ID NO: 131902 - DNA, 20 bp, Artificial Sequence
  chemically synthesized
gagagagagagagagagaga

SEQ ID NO: 131903 - DNA, 20 bp, Artificial Sequence
  chemically synthesized
gagagagagagagagagaga

SEQ ID NO: 131904 - DNA, 20 bp, Artificial Sequence
  chemically synthesized
cagagagagagagagagaga

SEQ ID NO: 131905 - DNA, 20 bp, Artificial Sequence
  chemically synthesized
gacagagagagagagagaga

SEQ ID NO: 131906 - DNA, 20 bp, Artificial Sequence
  chemically synthesized
cagacagagagagagagaga

SEQ ID NO: 131907 - DNA, 20 bp, Artificial Sequence
  chemically synthesized
cacagacagagagagagaga

SEQ ID NO: 131908 - DNA, 20 bp, Artificial Sequence
  chemically synthesized
cacacagacagagagagaga

SEQ ID NO: 131909 - DNA, 20 bp, Artificial Sequence
  chemically synthesized
cacacacagacagagagaga

SEQ ID NO: 131910 - DNA, 20 bp, Artificial Sequence
  chemically synthesized
cacacacacagacagagaga

SEQ ID NO: 131911 - DNA, 20 bp, Artificial Sequence
  chemically synthesized
cacacacacacagacagaga

SEQ ID NO: 131912 - DNA, 20 bp, Artificial Sequence
  chemically synthesized
cacacacacacacagacaga

SEQ ID NO: 131913 - DNA, 20 bp, Artificial Sequence
  chemically synthesized
cacacacacacacacagaca

SEQ ID NO: 131914 - DNA, 20 bp, Artificial Sequence
  chemically synthesized
cacacacacacacacacaga

SEQ ID NO: 131915 - DNA, 20 bp, Artificial Sequence
  chemically synthesized
cacacacacacacacacaca

SEQ ID NO: 131916 - DNA, 20 bp, Artificial Sequence
  chemically synthesized
tgtgtgtgtgtgtgtgtgtg

SEQ ID NO: 131917 - DNA, 20 bp, Artificial Sequence
  chemically synthesized
tgtgtgtgtgtgtggtgtgt

SEQ ID NO: 131918 - DNA, 20 bp, Artificial Sequence
  chemically synthesized
tgtgtgtgtgtggtgtgtca

SEQ ID NO: 131919 - DNA, 20 bp, Artificial Sequence
  chemically synthesized
tgtgtgtgtggtgtgtcaga

SEQ ID NO: 131920 - DNA, 20 bp, Artificial Sequence
  chemically synthesized
cagagagaaatatttgcgtt

SEQ ID NO: 131921 - DNA, 20 bp, Artificial Sequence
  chemically synthesized
agagagaaatatttgcgttt

SEQ ID NO: 131922 - DNA, 20 bp, Artificial Sequence
  chemically synthesized
gagagaaatatttgcgtttg

SEQ ID NO: 131923 - DNA, 20 bp, Artificial Sequence
  chemically synthesized
taataaacttaaatgaaata

SEQ ID NO: 131924 - DNA, 20 bp, Artificial Sequence
  chemically synthesized
ataataaacttaaatgaaat

SEQ ID NO: 131925 - DNA, 20 bp, Artificial Sequence
  chemically synthesized
ttggggtccttatttcattt

SEQ ID NO: 131926 - DNA, 20 bp, Artificial Sequence
  chemically synthesized
aacttgctattaattgaaaa

SEQ ID NO: 131927 - DNA, 20 bp, Artificial Sequence
  chemically synthesized
attatgctattttcaattaa

SEQ ID NO: 131928 - DNA, 20 bp, Artificial Sequence
  chemically synthesized
tgctattttcaattaatagc

SEQ ID NO: 131929 - DNA, 20 bp, Artificial Sequence
  chemically synthesized
aaatatagtttaaaaatgta

SEQ ID NO: 131930 - DNA, 20 bp, Artificial Sequence
  chemically synthesized
acatttttaaactatatttt

SEQ ID NO: 131931 - DNA, 20 bp, Artificial Sequence
  chemically synthesized
atatgtgcactcttaaaata

SEQ ID NO: 131932 - DNA, 20 bp, Artificial Sequence
  chemically synthesized
atttttaaactatattttaa

SEQ ID NO: 131933 - DNA, 20 bp, Artificial Sequence
  chemically synthesized
taagagtgcacatatttctt

SEQ ID NO: 131934 - DNA, 20 bp, Artificial Sequence
  chemically synthesized
agagtgcacatatttcttaa

SEQ ID NO: 131935 - DNA, 20 bp, Artificial Sequence
  chemically synthesized
atatgccatttagaactctt

SEQ ID NO: 131936 - DNA, 20 bp, Artificial Sequence
  chemically synthesized
tatttcttaagagttctaaa

SEQ ID NO: 131937 - DNA, 20 bp, Artificial Sequence
  chemically synthesized
agaaatagaaatatgccatt

SEQ ID NO: 131938 - DNA, 20 bp, Artificial Sequence
  chemically synthesized
catatatgtatacatagaaa

SEQ ID NO: 131939 - DNA, 20 bp, Artificial Sequence
  chemically synthesized
tagaaacatatatgtataca

SEQ ID NO: 131940 - DNA, 20 bp, Artificial Sequence
  chemically synthesized
atagaagtagacatatataa

SEQ ID NO: 131941 - DNA, 20 bp, Artificial Sequence
  chemically synthesized
taagtgcatagacatagaag

SEQ ID NO: 131942 - DNA, 20 bp, Artificial Sequence
  chemically synthesized
agataagtgcatagacatag

SEQ ID NO: 131943 - DNA, 20 bp, Artificial Sequence
  chemically synthesized
tacagataagtgcatagaca

SEQ ID NO: 131944 - DNA, 20 bp, Artificial Sequence
  chemically synthesized
gatagatacagataagtgca

SEQ ID NO: 131945 - DNA, 20 bp, Artificial Sequence
  chemically synthesized
agatagagatagatacagat

SEQ ID NO: 131946 - DNA, 20 bp, Artificial Sequence
  chemically synthesized
agtagagatagagatagata

SEQ ID NO: 131947 - DNA, 20 bp, Artificial Sequence
  chemically synthesized
tatcaaagtagagatagaga

SEQ ID NO: 131948 - DNA, 20 bp, Artificial Sequence
  chemically synthesized
gagatatcaaagtagagata

SEQ ID NO: 131949 - DNA, 20 bp, Artificial Sequence
  chemically synthesized
aagagatatcaaagtagaga

SEQ ID NO: 131950 - DNA, 20 bp, Artificial Sequence
  chemically synthesized
cttaaagagatatcaaagta

SEQ ID NO: 131951 - DNA, 20 bp, Artificial Sequence
  chemically synthesized
gacttaaagagatatcaaag

SEQ ID NO: 131952 - DNA, 20 bp, Artificial Sequence
  chemically synthesized
agagacttaaagagatatca

SEQ ID NO: 131953 - DNA, 20 bp, Artificial Sequence
  chemically synthesized
ctctactttgatatctcttt

SEQ ID NO: 131954 - DNA, 20 bp, Artificial Sequence
  chemically synthesized
cataaaaagagagacttaaa

SEQ ID NO: 131955 - DNA, 20 bp, Artificial Sequence
  chemically synthesized
tacataaaaagagagactta

SEQ ID NO: 131956 - DNA, 20 bp, Artificial Sequence
  chemically synthesized
ggaacttgtacataaaaaga

SEQ ID NO: 131957 - DNA, 20 bp, Artificial Sequence
  chemically synthesized
taggaacttgtacataaaaa

SEQ ID NO: 131958 - DNA, 20 bp, Artificial Sequence
  chemically synthesized
tctaggaacttgtacataaa

SEQ ID NO: 131959 - DNA, 20 bp, Artificial Sequence
  chemically synthesized
aagtctctctttttatgtac

SEQ ID NO: 131960 - DNA, 20 bp, Artificial Sequence
  chemically synthesized
tctttttatgtacaagttcc

SEQ ID NO: 131961 - DNA, 20 bp, Artificial Sequence
  chemically synthesized
tttttatgtacaagttccta

SEQ ID NO: 131962 - DNA, 20 bp, Artificial Sequence
  chemically synthesized
ttttatgtacaagttcctag

SEQ ID NO: 131963 - DNA, 20 bp, Artificial Sequence
  chemically synthesized
tgttaggacttagagcctct

SEQ ID NO: 131964 - DNA, 20 bp, Artificial Sequence
  chemically synthesized
atgttaggacttagagcctc

SEQ ID NO: 131965 - DNA, 20 bp, Artificial Sequence
  chemically synthesized
tacaagttcctagaggctct

SEQ ID NO: 131966 - DNA, 20 bp, Artificial Sequence
  chemically synthesized
ttctggaatgttaggactta

SEQ ID NO: 131967 - DNA, 20 bp, Artificial Sequence
  chemically synthesized
atttctggaatgttaggact

SEQ ID NO: 131968 - DNA, 20 bp, Artificial Sequence
  chemically synthesized
ggctctaagtcctaacattc

SEQ ID NO: 131969 - DNA, 20 bp, Artificial Sequence
  chemically synthesized
tttgaaatttctggaatgtt

SEQ ID NO: 131970 - DNA, 20 bp, Artificial Sequence
  chemically synthesized
ctttgaaatttctggaatgt

SEQ ID NO: 131971 - DNA, 20 bp, Artificial Sequence
  chemically synthesized
tctagtttctttgaaatttc

SEQ ID NO: 131972 - DNA, 20 bp, Artificial Sequence
  chemically synthesized
ctaacattccagaaatttca

SEQ ID NO: 131973 - DNA, 20 bp, Artificial Sequence
  chemically synthesized
tccagaaatttcaaagaaac

SEQ ID NO: 131974 - DNA, 20 bp, Artificial Sequence
  chemically synthesized
gaaatttcaaagaaactaga

SEQ ID NO: 131975 - DNA, 20 bp, Artificial Sequence
  chemically synthesized
tttcaaagaaactagaaaga

SEQ ID NO: 131976 - DNA, 20 bp, Artificial Sequence
  chemically synthesized
cagaagaaaatctttctttc

SEQ ID NO: 131977 - DNA, 20 bp, Artificial Sequence
  chemically synthesized
ttatcctattgtaattgcag

SEQ ID NO: 131978 - DNA, 20 bp, Artificial Sequence
  chemically synthesized
cttttatcctattgtaattg

SEQ ID NO: 131979 - DNA, 20 bp, Artificial Sequence
  chemically synthesized
attttcttctgcaattacaa

SEQ ID NO: 131980 - DNA, 20 bp, Artificial Sequence
  chemically synthesized
ttttcttctgcaattacaat

SEQ ID NO: 131981 - DNA, 20 bp, Artificial Sequence
  chemically synthesized
ctgcaattacaataggataa

SEQ ID NO: 131982 - DNA, 20 bp, Artificial Sequence
  chemically synthesized
gcaattacaataggataaaa

SEQ ID NO: 131983 - DNA, 20 bp, Artificial Sequence
  chemically synthesized
caataggataaaagagattg

SEQ ID NO: 131984 - DNA, 20 bp, Artificial Sequence
  chemically synthesized
aggataaaagagattgtgga

SEQ ID NO: 131985 - DNA, 20 bp, Artificial Sequence
  chemically synthesized
aaagagattgtggatagtaa

SEQ ID NO: 131986 - DNA, 20 bp, Artificial Sequence
  chemically synthesized
agccagtttatttttgcaga

SEQ ID NO: 131987 - DNA, 20 bp, Artificial Sequence
  chemically synthesized
gctcagccagtttatttttg

SEQ ID NO: 131988 - DNA, 20 bp, Artificial Sequence
  chemically synthesized
agctatctgcaaaaataaac

SEQ ID NO: 131989 - DNA, 20 bp, Artificial Sequence
  chemically synthesized
tctgcaaaaataaactggct

SEQ ID NO: 131990 - DNA, 20 bp, Artificial Sequence
  chemically synthesized
caggctatctgaggctcagc

SEQ ID NO: 131991 - DNA, 20 bp, Artificial Sequence
  chemically synthesized
aaaataaactggctgagcct

SEQ ID NO: 131992 - DNA, 20 bp, Artificial Sequence
  chemically synthesized
tccccaggctatctgaggct

SEQ ID NO: 131993 - DNA, 20 bp, Artificial Sequence
  chemically synthesized
taaactggctgagcctcaga

SEQ ID NO: 131994 - DNA, 20 bp, Artificial Sequence
  chemically synthesized
caagctccccaggctatctg

SEQ ID NO: 131995 - DNA, 20 bp, Artificial Sequence
  chemically synthesized
acaagctccccaggctatct

SEQ ID NO: 131996 - DNA, 20 bp, Artificial Sequence
  chemically synthesized
tggctgagcctcagatagcc

SEQ ID NO: 131997 - DNA, 20 bp, Artificial Sequence
  chemically synthesized
ggctgagcctcagatagcct

SEQ ID NO: 131998 - DNA, 20 bp, Artificial Sequence
  chemically synthesized
gctgagcctcagatagcctg

SEQ ID NO: 131999 - DNA, 20 bp, Artificial Sequence
  chemically synthesized
tgagcctcagatagcctggg

SEQ ID NO: 132000 - DNA, 20 bp, Artificial Sequence
  chemically synthesized
gtatttataacaagctcccc

SEQ ID NO: 132001 - DNA, 20 bp, Artificial Sequence
  chemically synthesized
tgtatttataacaagctccc

SEQ ID NO: 132002 - DNA, 20 bp, Artificial Sequence
  chemically synthesized
tgggaatctgtatttataac

SEQ ID NO: 132003 - DNA, 20 bp, Artificial Sequence
  chemically synthesized
tggggagcttgttataaata

SEQ ID NO: 132004 - DNA, 20 bp, Artificial Sequence
  chemically synthesized
tgttataaatacagattccc

SEQ ID NO: 132005 - DNA, 20 bp, Artificial Sequence
  chemically synthesized
gttataaatacagattccca

SEQ ID NO: 132006 - DNA, 20 bp, Artificial Sequence
  chemically synthesized
tagggatataagaaggcctt

SEQ ID NO: 132007 - DNA, 20 bp, Artificial Sequence
  chemically synthesized
atagggatataagaaggcct

SEQ ID NO: 132008 - DNA, 20 bp, Artificial Sequence
  chemically synthesized
gacataatagggatataaga

SEQ ID NO: 132009 - DNA, 20 bp, Artificial Sequence
  chemically synthesized
tgacataatagggatataag

SEQ ID NO: 132010 - DNA, 20 bp, Artificial Sequence
  chemically synthesized
ttctgacataatagggatat

SEQ ID NO: 132011 - DNA, 20 bp, Artificial Sequence
  chemically synthesized
taagaaattctgacataata

SEQ ID NO: 132012 - DNA, 20 bp, Artificial Sequence
  chemically synthesized
ttcttatatccctattatgt

SEQ ID NO: 132013 - DNA, 20 bp, Artificial Sequence
  chemically synthesized
ataagaaattctgacataat

SEQ ID NO: 132014 - DNA, 20 bp, Artificial Sequence
  chemically synthesized
cataagaaattctgacataa

SEQ ID NO: 132015 - DNA, 20 bp, Artificial Sequence
  chemically synthesized
tatgtcagaatttcttatgt

SEQ ID NO: 132016 - DNA, 20 bp, Artificial Sequence
  chemically synthesized
gtcagaatttcttatgttgg

SEQ ID NO: 132017 - DNA, 20 bp, Artificial Sequence
  chemically synthesized
ggacatcttgcttccaacat

SEQ ID NO: 132018 - DNA, 20 bp, Artificial Sequence
  chemically synthesized
gaatttcttatgttggaagc

SEQ ID NO: 132019 - DNA, 20 bp, Artificial Sequence
  chemically synthesized
tatgttggaagcaagatgtc

SEQ ID NO: 132020 - DNA, 20 bp, Artificial Sequence
  chemically synthesized
atgttggaagcaagatgtcc

SEQ ID NO: 132021 - DNA, 20 bp, Artificial Sequence
  chemically synthesized
ggaagcaagatgtccgggaa

SEQ ID NO: 132022 - DNA, 20 bp, Artificial Sequence
  chemically synthesized
ctagtattactggccattcc

SEQ ID NO: 132023 - DNA, 20 bp, Artificial Sequence
  chemically synthesized
gcaagatgtccgggaatggc

SEQ ID NO: 132024 - DNA, 20 bp, Artificial Sequence
  chemically synthesized
ccgggaatggccagtaatac

SEQ ID NO: 132025 - DNA, 20 bp, Artificial Sequence
  chemically synthesized
acaaagatttctagtattac

SEQ ID NO: 132026 - DNA, 20 bp, Artificial Sequence
  chemically synthesized
acatttcccacaaagatttc

SEQ ID NO: 132027 - DNA, 20 bp, Artificial Sequence
  chemically synthesized
agtaatactagaaatctttg

SEQ ID NO: 132028 - DNA, 20 bp, Artificial Sequence
  chemically synthesized
gtaatactagaaatctttgt

SEQ ID NO: 132029 - DNA, 20 bp, Artificial Sequence
  chemically synthesized
tcaaaacgacatttcccaca

SEQ ID NO: 132030 - DNA, 20 bp, Artificial Sequence
  chemically synthesized
tgtgggaaatgtcgttttga

SEQ ID NO: 132031 - DNA, 20 bp, Artificial Sequence
  chemically synthesized
gtgggaaatgtcgttttgaa

SEQ ID NO: 132032 - DNA, 20 bp, Artificial Sequence
  chemically synthesized
tgggaaatgtcgttttgaaa

SEQ ID NO: 132033 - DNA, 20 bp, Artificial Sequence
  chemically synthesized
atgtcgttttgaaagggttt

SEQ ID NO: 132034 - DNA, 20 bp, Artificial Sequence
  chemically synthesized
tgtcgttttgaaagggtttt

SEQ ID NO: 132035 - DNA, 20 bp, Artificial Sequence
  chemically synthesized
gtcgttttgaaagggttttg

SEQ ID NO: 132036 - DNA, 20 bp, Artificial Sequence
  chemically synthesized
ttgaaagggttttggggatg

SEQ ID NO: 132037 - DNA, 20 bp, Artificial Sequence
  chemically synthesized
gttttggggatgaagtaacc

SEQ ID NO: 132038 - DNA, 20 bp, Artificial Sequence
  chemically synthesized
tgttacccccagattcatct

SEQ ID NO: 132039 - DNA, 20 bp, Artificial Sequence
  chemically synthesized
ctgttacccccagattcatc

SEQ ID NO: 132040 - DNA, 20 bp, Artificial Sequence
  chemically synthesized
tgaagtaacccagatgaatc

SEQ ID NO: 132041 - DNA, 20 bp, Artificial Sequence
  chemically synthesized
gaagtaacccagatgaatct

SEQ ID NO: 132042 - DNA, 20 bp, Artificial Sequence
  chemically synthesized
aagtaacccagatgaatctg

SEQ ID NO: 132043 - DNA, 20 bp, Artificial Sequence
  chemically synthesized
agtaacccagatgaatctgg

SEQ ID NO: 132044 - DNA, 20 bp, Artificial Sequence
  chemically synthesized
ccagatgaatctgggggtaa

SEQ ID NO: 132045 - DNA, 20 bp, Artificial Sequence
  chemically synthesized
acattgctacctgttacccc

SEQ ID NO: 132046 - DNA, 20 bp, Artificial Sequence
  chemically synthesized
cagatgaatctgggggtaac

SEQ ID NO: 132047 - DNA, 20 bp, Artificial Sequence
  chemically synthesized
atgaatctgggggtaacagg

SEQ ID NO: 132048 - DNA, 20 bp, Artificial Sequence
  chemically synthesized
gtagcaatgtcattaacata

SEQ ID NO: 132049 - DNA, 20 bp, Artificial Sequence
  chemically synthesized
tagtataagttaatagttgg

SEQ ID NO: 132050 - DNA, 20 bp, Artificial Sequence
  chemically synthesized
tgttagtataagttaatagt

SEQ ID NO: 132051 - DNA, 20 bp, Artificial Sequence
  chemically synthesized
gatatgttagtataagttaa

SEQ ID NO: 132052 - DNA, 20 bp, Artificial Sequence
  chemically synthesized
aaactcagatatgttagtat

SEQ ID NO: 132053 - DNA, 20 bp, Artificial Sequence
  chemically synthesized
aatataaaactcagatatgt

SEQ ID NO: 132054 - DNA, 20 bp, Artificial Sequence
  chemically synthesized
taacttatactaacatatct

SEQ ID NO: 132055 - DNA, 20 bp, Artificial Sequence
  chemically synthesized
tcacagaacaatataaaact

SEQ ID NO: 132056 - DNA, 20 bp, Artificial Sequence
  chemically synthesized
agttttatattgttctgtga

SEQ ID NO: 132057 - DNA, 20 bp, Artificial Sequence
  chemically synthesized
cactctcctattatctgtca

SEQ ID NO: 132058 - DNA, 20 bp, Artificial Sequence
  chemically synthesized
tattgttctgtgacagataa

SEQ ID NO: 132059 - DNA, 20 bp, Artificial Sequence
  chemically synthesized
attgttctgtgacagataat

SEQ ID NO: 132060 - DNA, 20 bp, Artificial Sequence
  chemically synthesized
tgttctgtgacagataatag

SEQ ID NO: 132061 - DNA, 20 bp, Artificial Sequence
  chemically synthesized
ttctgtgacagataatagga

SEQ ID NO: 132062 - DNA, 20 bp, Artificial Sequence
  chemically synthesized
tgacagataataggagagtg

SEQ ID NO: 132063 - DNA, 20 bp, Artificial Sequence
  chemically synthesized
gacagataataggagagtga

SEQ ID NO: 132064 - DNA, 20 bp, Artificial Sequence
  chemically synthesized
ataataggagagtgaaggta

SEQ ID NO: 132065 - DNA, 20 bp, Artificial Sequence
  chemically synthesized
caccaccatatacagatata

SEQ ID NO: 132066 - DNA, 20 bp, Artificial Sequence
  chemically synthesized
taaagctgtatatctgtata

SEQ ID NO: 132067 - DNA, 20 bp, Artificial Sequence
  chemically synthesized
agctgtatatctgtatatgg

SEQ ID NO: 132068 - DNA, 20 bp, Artificial Sequence
  chemically synthesized
cccccaaccaccaccatata

SEQ ID NO: 132069 - DNA, 20 bp, Artificial Sequence
  chemically synthesized
tgtatatctgtatatggtgg

SEQ ID NO: 132070 - DNA, 20 bp, Artificial Sequence
  chemically synthesized
tatctgtatatggtggtggt

SEQ ID NO: 132071 - DNA, 20 bp, Artificial Sequence
  chemically synthesized
atctgtatatggtggtggtt

SEQ ID NO: 132072 - DNA, 20 bp, Artificial Sequence
  chemically synthesized
tctgtatatggtggtggttg

SEQ ID NO: 132073 - DNA, 20 bp, Artificial Sequence
  chemically synthesized
ctgtatatggtggtggttgg

SEQ ID NO: 132074 - DNA, 20 bp, Artificial Sequence
  chemically synthesized
ggttgggggaaaacctcttg

SEQ ID NO: 132075 - DNA, 20 bp, Artificial Sequence
  chemically synthesized
gttgggggaaaacctcttgc

SEQ ID NO: 132076 - DNA, 20 bp, Artificial Sequence
  chemically synthesized
ttgggggaaaacctcttgca

SEQ ID NO: 132077 - DNA, 20 bp, Artificial Sequence
  chemically synthesized
ccttttagattccctgcaag

SEQ ID NO: 132078 - DNA, 20 bp, Artificial Sequence
  chemically synthesized
tccttttagattccctgcaa

SEQ ID NO: 132079 - DNA, 20 bp, Artificial Sequence
  chemically synthesized
cttccttttagattccctgc

SEQ ID NO: 132080 - DNA, 20 bp, Artificial Sequence
  chemically synthesized
acctcttgcagggaatctaa

SEQ ID NO: 132081 - DNA, 20 bp, Artificial Sequence
  chemically synthesized
cctcttgcagggaatctaaa

SEQ ID NO: 132082 - DNA, 20 bp, Artificial Sequence
  chemically synthesized
cttgcagggaatctaaaagg

SEQ ID NO: 132083 - DNA, 20 bp, Artificial Sequence
  chemically synthesized
tttgctccctggcttccttt

SEQ ID NO: 132084 - DNA, 20 bp, Artificial Sequence
  chemically synthesized
cagggaatctaaaaggaagc

SEQ ID NO: 132085 - DNA, 20 bp, Artificial Sequence
  chemically synthesized
agggaatctaaaaggaagcc

SEQ ID NO: 132086 - DNA, 20 bp, Artificial Sequence
  chemically synthesized
gggaatctaaaaggaagcca

SEQ ID NO: 132087 - DNA, 20 bp, Artificial Sequence
  chemically synthesized
gaatctaaaaggaagccagg

SEQ ID NO: 132088 - DNA, 20 bp, Artificial Sequence
  chemically synthesized
aatagcacatgtttgctccc

SEQ ID NO: 132089 - DNA, 20 bp, Artificial Sequence
  chemically synthesized
agatggtacaaaaaacataa

SEQ ID NO: 132090 - DNA, 20 bp, Artificial Sequence
  chemically synthesized
ttatgttttttgtaccatct

SEQ ID NO: 132091 - DNA, 20 bp, Artificial Sequence
  chemically synthesized
aacagacaattcatctcaga

SEQ ID NO: 132092 - DNA, 20 bp, Artificial Sequence
  chemically synthesized
gagaaacagacaattcatct

SEQ ID NO: 132093 - DNA, 20 bp, Artificial Sequence
  chemically synthesized
tattaatagaaacagagaaa

SEQ ID NO: 132094 - DNA, 20 bp, Artificial Sequence
  chemically synthesized
taaaaatattaatagaaaca

SEQ ID NO: 132095 - DNA, 20 bp, Artificial Sequence
  chemically synthesized
cttaaaaatattaatagaaa

SEQ ID NO: 132096 - DNA, 20 bp, Artificial Sequence
  chemically synthesized
gatgaccttaaaaatattaa

SEQ ID NO: 132097 - DNA, 20 bp, Artificial Sequence
  chemically synthesized
ctgtttctattaatattttt

SEQ ID NO: 132098 - DNA, 20 bp, Artificial Sequence
  chemically synthesized
tgtttctattaatattttta

SEQ ID NO: 132099 - DNA, 20 bp, Artificial Sequence
  chemically synthesized
ttaatatttttaaggtcatc

SEQ ID NO: 132100 - DNA, 20 bp, Artificial Sequence
  chemically synthesized
atttttaaggtcatctagaa

SEQ ID NO: 132101 - DNA, 20 bp, Artificial Sequence
  chemically synthesized
actacccatctttactattc

SEQ ID NO: 132102 - DNA, 20 bp, Artificial Sequence
  chemically synthesized
taaggtcatctagaatagta

SEQ ID NO: 132103 - DNA, 20 bp, Artificial Sequence
  chemically synthesized
gtcatctagaatagtaaaga

SEQ ID NO: 132104 - DNA, 20 bp, Artificial Sequence
  chemically synthesized
tcatctagaatagtaaagat

SEQ ID NO: 132105 - DNA, 20 bp, Artificial Sequence
  chemically synthesized
tctagaatagtaaagatggg

SEQ ID NO: 132106 - DNA, 20 bp, Artificial Sequence
  chemically synthesized
gtaaagatgggtagtttatg

SEQ ID NO: 132107 - DNA, 20 bp, Artificial Sequence
  chemically synthesized
gatgcttccttaagtgagaa

SEQ ID NO: 132108 - DNA, 20 bp, Artificial Sequence
  chemically synthesized
ttatgtagcttttctcactt

SEQ ID NO: 132109 - DNA, 20 bp, Artificial Sequence
  chemically synthesized
tatgtagcttttctcactta

SEQ ID NO: 132110 - DNA, 20 bp, Artificial Sequence
  chemically synthesized
gaaaggatgcttccttaagt

SEQ ID NO: 132111 - DNA, 20 bp, Artificial Sequence
  chemically synthesized
gtagcttttctcacttaagg

SEQ ID NO: 132112 - DNA, 20 bp, Artificial Sequence
  chemically synthesized
ttatgaaaggatgcttcctt

SEQ ID NO: 132113 - DNA, 20 bp, Artificial Sequence
  chemically synthesized
gggtaataaagcattatgaa

SEQ ID NO: 132114 - DNA, 20 bp, Artificial Sequence
  chemically synthesized
agggtaataaagcattatga

SEQ ID NO: 132115 - DNA, 20 bp, Artificial Sequence
  chemically synthesized
gaattgggagaagggtaata

SEQ ID NO: 132116 - DNA, 20 bp, Artificial Sequence
  chemically synthesized
aagtgatagaattgggagaa

SEQ ID NO: 132117 - DNA, 20 bp, Artificial Sequence
  chemically synthesized
aaagtgatagaattgggaga

SEQ ID NO: 132118 - DNA, 20 bp, Artificial Sequence
  chemically synthesized
caaagtgatagaattgggag

SEQ ID NO: 132119 - DNA, 20 bp, Artificial Sequence
  chemically synthesized
gttcaaagtgatagaattgg

SEQ ID NO: 132120 - DNA, 20 bp, Artificial Sequence
  chemically synthesized
ttgttcaaagtgatagaatt

SEQ ID NO: 132121 - DNA, 20 bp, Artificial Sequence
  chemically synthesized
attgttcaaagtgatagaat

SEQ ID NO: 132122 - DNA, 20 bp, Artificial Sequence
  chemically synthesized
tagattattgttcaaagtga

SEQ ID NO: 132123 - DNA, 20 bp, Artificial Sequence
  chemically synthesized
aaatgatagattattgttca

SEQ ID NO: 132124 - DNA, 20 bp, Artificial Sequence
  chemically synthesized
ttgaacaataatctatcatt

SEQ ID NO: 132125 - DNA, 20 bp, Artificial Sequence
  chemically synthesized
ctatccagaagaccaaatga

SEQ ID NO: 132126 - DNA, 20 bp, Artificial Sequence
  chemically synthesized
taatctatcatttggtcttc

SEQ ID NO: 132127 - DNA, 20 bp, Artificial Sequence
  chemically synthesized
ctatcatttggtcttctgga

SEQ ID NO: 132128 - DNA, 20 bp, Artificial Sequence
  chemically synthesized
ccccagtgaggactatccag

SEQ ID NO: 132129 - DNA, 20 bp, Artificial Sequence
  chemically synthesized
cctccccagtgaggactatc

SEQ ID NO: 132130 - DNA, 20 bp, Artificial Sequence
  chemically synthesized
gtcttctggatagtcctcac

SEQ ID NO: 132131 - DNA, 20 bp, Artificial Sequence
  chemically synthesized
tcttctggatagtcctcact

SEQ ID NO: 132132 - DNA, 20 bp, Artificial Sequence
  chemically synthesized
cttctggatagtcctcactg

SEQ ID NO: 132133 - DNA, 20 bp, Artificial Sequence
  chemically synthesized
tctggatagtcctcactggg

SEQ ID NO: 132134 - DNA, 20 bp, Artificial Sequence
  chemically synthesized
tcggggtgtcctccccagtg

SEQ ID NO: 132135 - DNA, 20 bp, Artificial Sequence
  chemically synthesized
ctggatagtcctcactgggg

SEQ ID NO: 132136 - DNA, 20 bp, Artificial Sequence
  chemically synthesized
ttcggggtgtcctccccagt

SEQ ID NO: 132137 - DNA, 20 bp, Artificial Sequence
  chemically synthesized
tgtgttcggggtgtcctccc

SEQ ID NO: 132138 - DNA, 20 bp, Artificial Sequence
  chemically synthesized
caataatggtaatgtgttcg

SEQ ID NO: 132139 - DNA, 20 bp, Artificial Sequence
  chemically synthesized
tcaataatggtaatgtgttc

SEQ ID NO: 132140 - DNA, 20 bp, Artificial Sequence
  chemically synthesized
atcaataatggtaatgtgtt

SEQ ID NO: 132141 - DNA, 20 bp, Artificial Sequence
  chemically synthesized
actggcaggaaaatcaataa

SEQ ID NO: 132142 - DNA, 20 bp, Artificial Sequence
  chemically synthesized
accattattgattttcctgc

SEQ ID NO: 132143 - DNA, 20 bp, Artificial Sequence
  chemically synthesized
tattttacaacaagactggc

SEQ ID NO: 132144 - DNA, 20 bp, Artificial Sequence
  chemically synthesized
ttattttacaacaagactgg

SEQ ID NO: 132145 - DNA, 20 bp, Artificial Sequence
  chemically synthesized
ctattattttacaacaagac

SEQ ID NO: 132146 - DNA, 20 bp, Artificial Sequence
  chemically synthesized
tcaaactattattttacaac

SEQ ID NO: 132147 - DNA, 20 bp, Artificial Sequence
  chemically synthesized
ccagtcttgttgtaaaataa

SEQ ID NO: 132148 - DNA, 20 bp, Artificial Sequence
  chemically synthesized
gtttataaaccatttgaaag

SEQ ID NO: 132149 - DNA, 20 bp, Artificial Sequence
  chemically synthesized
ttattatttcttctttcaaa

SEQ ID NO: 132150 - DNA, 20 bp, Artificial Sequence
  chemically synthesized
ctggtttataaaccatttga

SEQ ID NO: 132151 - DNA, 20 bp, Artificial Sequence
  chemically synthesized
ctttcaaatggtttataaac

SEQ ID NO: 132152 - DNA, 20 bp, Artificial Sequence
  chemically synthesized
tacacaaactcacaaggcac

SEQ ID NO: 132153 - DNA, 20 bp, Artificial Sequence
  chemically synthesized
tttataaaccagtgccttgt

SEQ ID NO: 132154 - DNA, 20 bp, Artificial Sequence
  chemically synthesized
tcatgctacacaaactcaca

SEQ ID NO: 132155 - DNA, 20 bp, Artificial Sequence
  chemically synthesized
ttcatgctacacaaactcac

SEQ ID NO: 132156 - DNA, 20 bp, Artificial Sequence
  chemically synthesized
cagtgccttgtgagtttgtg

SEQ ID NO: 132157 - DNA, 20 bp, Artificial Sequence
  chemically synthesized
tgagtttgtgtagcatgaat

SEQ ID NO: 132158 - DNA, 20 bp, Artificial Sequence
  chemically synthesized
tgtagcatgaatcagtctcc

SEQ ID NO: 132159 - DNA, 20 bp, Artificial Sequence
  chemically synthesized
tagcatgaatcagtctccca

SEQ ID NO: 132160 - DNA, 20 bp, Artificial Sequence
  chemically synthesized
tagagatgatcaggctctgg

SEQ ID NO: 132161 - DNA, 20 bp, Artificial Sequence
  chemically synthesized
cctagagatgatcaggctct

SEQ ID NO: 132162 - DNA, 20 bp, Artificial Sequence
  chemically synthesized
acctagagatgatcaggctc

SEQ ID NO: 132163 - DNA, 20 bp, Artificial Sequence
  chemically synthesized
tagtttacctagagatgatc

SEQ ID NO: 132164 - DNA, 20 bp, Artificial Sequence
  chemically synthesized
gtagtttacctagagatgat

SEQ ID NO: 132165 - DNA, 20 bp, Artificial Sequence
  chemically synthesized
tcccagagcctgatcatctc

SEQ ID NO: 132166 - DNA, 20 bp, Artificial Sequence
  chemically synthesized
cccagagcctgatcatctct

SEQ ID NO: 132167 - DNA, 20 bp, Artificial Sequence
  chemically synthesized
aaattttagtagtttaccta

SEQ ID NO: 132168 - DNA, 20 bp, Artificial Sequence
  chemically synthesized
ctaaattttagtagtttacc

SEQ ID NO: 132169 - DNA, 20 bp, Artificial Sequence
  chemically synthesized
agccaacaactaaattttag

SEQ ID NO: 132170 - DNA, 20 bp, Artificial Sequence
  chemically synthesized
ctaggtaaactactaaaatt

SEQ ID NO: 132171 - DNA, 20 bp, Artificial Sequence
  chemically synthesized
catagccaacaactaaattt

SEQ ID NO: 132172 - DNA, 20 bp, Artificial Sequence
  chemically synthesized
aactactaaaatttagttgt

SEQ ID NO: 132173 - DNA, 20 bp, Artificial Sequence
  chemically synthesized
gtccaatcctcagttttgca

SEQ ID NO: 132174 - DNA, 20 bp, Artificial Sequence
  chemically synthesized
gttgttggctatgcaaaact

SEQ ID NO: 132175 - DNA, 20 bp, Artificial Sequence
  chemically synthesized
ttgttggctatgcaaaactg

SEQ ID NO: 132176 - DNA, 20 bp, Artificial Sequence
  chemically synthesized
ggctatgcaaaactgaggat

SEQ ID NO: 132177 - DNA, 20 bp, Artificial Sequence
  chemically synthesized
tagatttaatgtccaatcct

SEQ ID NO: 132178 - DNA, 20 bp, Artificial Sequence
  chemically synthesized
atcatatagcagagttgtcg

SEQ ID NO: 132179 - DNA, 20 bp, Artificial Sequence
  chemically synthesized
agagttcatatcatatagca

SEQ ID NO: 132180 - DNA, 20 bp, Artificial Sequence
  chemically synthesized
atagagttcatatcatatag

SEQ ID NO: 132181 - DNA, 20 bp, Artificial Sequence
  chemically synthesized
ttgatagagttcatatcata

SEQ ID NO: 132182 - DNA, 20 bp, Artificial Sequence
  chemically synthesized
gcataaagaggtcattgata

SEQ ID NO: 132183 - DNA, 20 bp, Artificial Sequence
  chemically synthesized
ctgcataaagaggtcattga

SEQ ID NO: 132184 - DNA, 20 bp, Artificial Sequence
  chemically synthesized
ctatcaatgacctctttatg

SEQ ID NO: 132185 - DNA, 20 bp, Artificial Sequence
  chemically synthesized
tcaggaaggactgcataaag

SEQ ID NO: 132186 - DNA, 20 bp, Artificial Sequence
  chemically synthesized
ttcaggaaggactgcataaa

SEQ ID NO: 132187 - DNA, 20 bp, Artificial Sequence
  chemically synthesized
atttcaggaaggactgcata

SEQ ID NO: 132188 - DNA, 20 bp, Artificial Sequence
  chemically synthesized
tgatataaatcatttcagga

SEQ ID NO: 132189 - DNA, 20 bp, Artificial Sequence
  chemically synthesized
atgatataaatcatttcagg

SEQ ID NO: 132190 - DNA, 20 bp, Artificial Sequence
  chemically synthesized
atgatgatataaatcatttc

SEQ ID NO: 132191 - DNA, 20 bp, Artificial Sequence
  chemically synthesized
aatgatgatataaatcattt

SEQ ID NO: 132192 - DNA, 20 bp, Artificial Sequence
  chemically synthesized
taaaaataatcattaacctg

SEQ ID NO: 132193 - DNA, 20 bp, Artificial Sequence
  chemically synthesized
aataatcattaacctgaaga

SEQ ID NO: 132194 - DNA, 20 bp, Artificial Sequence
  chemically synthesized
taatcattaacctgaagaaa

SEQ ID NO: 132195 - DNA, 20 bp, Artificial Sequence
  chemically synthesized
tcttaatatactctttcttc

SEQ ID NO: 132196 - DNA, 20 bp, Artificial Sequence
  chemically synthesized
atcttaatatactctttctt

SEQ ID NO: 132197 - DNA, 20 bp, Artificial Sequence
  chemically synthesized
acctgaagaaagagtatatt

SEQ ID NO: 132198 - DNA, 20 bp, Artificial Sequence
  chemically synthesized
ttaagatattccaaatccat

SEQ ID NO: 132199 - DNA, 20 bp, Artificial Sequence
  chemically synthesized
tgctatgtatctcatggatt

SEQ ID NO: 132200 - DNA, 20 bp, Artificial Sequence
  chemically synthesized
aaaaagtgctatgtatctca

SEQ ID NO: 132201 - DNA, 20 bp, Artificial Sequence
  chemically synthesized
ttccaaatccatgagataca

SEQ ID NO: 132202 - DNA, 20 bp, Artificial Sequence
  chemically synthesized
tatgggtaaaatcaaggaaa

SEQ ID NO: 132203 - DNA, 20 bp, Artificial Sequence
  chemically synthesized
ttagaatatgggtaaaatca

SEQ ID NO: 132204 - DNA, 20 bp, Artificial Sequence
  chemically synthesized
tttagaatatgggtaaaatc

SEQ ID NO: 132205 - DNA, 20 bp, Artificial Sequence
  chemically synthesized
atattgaatgtttagaatat

SEQ ID NO: 132206 - DNA, 20 bp, Artificial Sequence
  chemically synthesized
aatattgaatgtttagaata

SEQ ID NO: 132207 - DNA, 20 bp, Artificial Sequence
  chemically synthesized
gcctgttaatattgaatgtt

SEQ ID NO: 132208 - DNA, 20 bp, Artificial Sequence
  chemically synthesized
ttctaaacattcaatattaa

SEQ ID NO: 132209 - DNA, 20 bp, Artificial Sequence
  chemically synthesized
tctaaacattcaatattaac

SEQ ID NO: 132210 - DNA, 20 bp, Artificial Sequence
  chemically synthesized
attcaatattaacaggcatt

SEQ ID NO: 132211 - DNA, 20 bp, Artificial Sequence
  chemically synthesized
attaacaggcattaagaatc

SEQ ID NO: 132212 - DNA, 20 bp, Artificial Sequence
  chemically synthesized
atgacctatcaatagtcaaa

SEQ ID NO: 132213 - DNA, 20 bp, Artificial Sequence
  chemically synthesized
gtatgacctatcaatagtca

SEQ ID NO: 132214 - DNA, 20 bp, Artificial Sequence
  chemically synthesized
aagaactctttgactattga

SEQ ID NO: 132215 - DNA, 20 bp, Artificial Sequence
  chemically synthesized
agaactctttgactattgat

SEQ ID NO: 132216 - DNA, 20 bp, Artificial Sequence
  chemically synthesized
tattgagtatgacctatcaa

SEQ ID NO: 132217 - DNA, 20 bp, Artificial Sequence
  chemically synthesized
atcaaacagtattttatatt

SEQ ID NO: 132218 - DNA, 20 bp, Artificial Sequence
  chemically synthesized
aatataaaatactgtttgat

SEQ ID NO: 132219 - DNA, 20 bp, Artificial Sequence
  chemically synthesized
ttggtctggagccaatcaaa

SEQ ID NO: 132220 - DNA, 20 bp, Artificial Sequence
  chemically synthesized
aaatactgtttgattggctc

SEQ ID NO: 132221 - DNA, 20 bp, Artificial Sequence
  chemically synthesized
acctttttttttttggtctg

SEQ ID NO: 132222 - DNA, 20 bp, Artificial Sequence
  chemically synthesized
aaacctttttttttttggtc

SEQ ID NO: 132223 - DNA, 20 bp, Artificial Sequence
  chemically synthesized
ttacaaaacctttttttttt

SEQ ID NO: 132224 - DNA, 20 bp, Artificial Sequence
  chemically synthesized
ggctccagaccaaaaaaaaa

SEQ ID NO: 132225 - DNA, 20 bp, Artificial Sequence
  chemically synthesized
gctccagaccaaaaaaaaaa

SEQ ID NO: 132226 - DNA, 20 bp, Artificial Sequence
  chemically synthesized
actttataaagacatgaaaa

SEQ ID NO: 132227 - DNA, 20 bp, Artificial Sequence
  chemically synthesized
aactttataaagacatgaaa

SEQ ID NO: 132228 - DNA, 20 bp, Artificial Sequence
  chemically synthesized
gaactttataaagacatgaa

SEQ ID NO: 132229 - DNA, 20 bp, Artificial Sequence
  chemically synthesized
gcccttttcatgtctttata

SEQ ID NO: 132230 - DNA, 20 bp, Artificial Sequence
  chemically synthesized
taaactctaggaactttata

SEQ ID NO: 132231 - DNA, 20 bp, Artificial Sequence
  chemically synthesized
tcatgtctttataaagttcc

SEQ ID NO: 132232 - DNA, 20 bp, Artificial Sequence
  chemically synthesized
atgtctttataaagttccta

SEQ ID NO: 132233 - DNA, 20 bp, Artificial Sequence
  chemically synthesized
gaataacagaaataaactct

SEQ ID NO: 132234 - DNA, 20 bp, Artificial Sequence
  chemically synthesized
agaataacagaaataaactc

SEQ ID NO: 132235 - DNA, 20 bp, Artificial Sequence
  chemically synthesized
aggaaacattttgagaataa

SEQ ID NO: 132236 - DNA, 20 bp, Artificial Sequence
  chemically synthesized
ttctcctgaggaaacatttt

SEQ ID NO: 132237 - DNA, 20 bp, Artificial Sequence
  chemically synthesized
ttattctcaaaatgtttcct

SEQ ID NO: 132238 - DNA, 20 bp, Artificial Sequence
  chemically synthesized
tattctcaaaatgtttcctc

SEQ ID NO: 132239 - DNA, 20 bp, Artificial Sequence
  chemically synthesized
ttctcaaaatgtttcctcag

SEQ ID NO: 132240 - DNA, 20 bp, Artificial Sequence
  chemically synthesized
aatattactaaattctcctg

SEQ ID NO: 132241 - DNA, 20 bp, Artificial Sequence
  chemically synthesized
aaatattactaaattctcct

SEQ ID NO: 132242 - DNA, 20 bp, Artificial Sequence
  chemically synthesized
aatgtttcctcaggagaatt

SEQ ID NO: 132243 - DNA, 20 bp, Artificial Sequence
  chemically synthesized
caggagaatttagtaatatt

SEQ ID NO: 132244 - DNA, 20 bp, Artificial Sequence
  chemically synthesized
taactagtgattgttttaag

SEQ ID NO: 132245 - DNA, 20 bp, Artificial Sequence
  chemically synthesized
acttaactagtgattgtttt

SEQ ID NO: 132246 - DNA, 20 bp, Artificial Sequence
  chemically synthesized
gatccacttaaaacaatcac

SEQ ID NO: 132247 - DNA, 20 bp, Artificial Sequence
  chemically synthesized
acttaaaacaatcactagtt

SEQ ID NO: 132248 - DNA, 20 bp, Artificial Sequence
  chemically synthesized
gaagctaatttgtacttaac

SEQ ID NO: 132249 - DNA, 20 bp, Artificial Sequence
  chemically synthesized
atcactagttaagtacaaat

SEQ ID NO: 132250 - DNA, 20 bp, Artificial Sequence
  chemically synthesized
tgttttcagattgattttgg

SEQ ID NO: 132251 - DNA, 20 bp, Artificial Sequence
  chemically synthesized
gcatgttttcagattgattt

SEQ ID NO: 132252 - DNA, 20 bp, Artificial Sequence
  chemically synthesized
gtatgttttcagcatgtttt

SEQ ID NO: 132253 - DNA, 20 bp, Artificial Sequence
  chemically synthesized
ttttagcagatgtatgtttt

SEQ ID NO: 132254 - DNA, 20 bp, Artificial Sequence
  chemically synthesized
tgaaaacatacatctgctaa

SEQ ID NO: 132255 - DNA, 20 bp, Artificial Sequence
  chemically synthesized
aagagaaaaccatcttttag

SEQ ID NO: 132256 - DNA, 20 bp, Artificial Sequence
  chemically synthesized
aacatacatctgctaaaaga

SEQ ID NO: 132257 - DNA, 20 bp, Artificial Sequence
  chemically synthesized
taaaagagaaaaccatcttt

SEQ ID NO: 132258 - DNA, 20 bp, Artificial Sequence
  chemically synthesized
atgggagggggtacataaaa

SEQ ID NO: 132259 - DNA, 20 bp, Artificial Sequence
  chemically synthesized
agatgggagggggtacataa

SEQ ID NO: 132260 - DNA, 20 bp, Artificial Sequence
  chemically synthesized
aataacttttagatgggagg

SEQ ID NO: 132261 - DNA, 20 bp, Artificial Sequence
  chemically synthesized
taataacttttagatgggag

SEQ ID NO: 132262 - DNA, 20 bp, Artificial Sequence
  chemically synthesized
ttaataacttttagatggga

SEQ ID NO: 132263 - DNA, 20 bp, Artificial Sequence
  chemically synthesized
cttaataacttttagatggg

SEQ ID NO: 132264 - DNA, 20 bp, Artificial Sequence
  chemically synthesized
ccttaataacttttagatgg

SEQ ID NO: 132265 - DNA, 20 bp, Artificial Sequence
  chemically synthesized
atgtaccccctcccatctaa

SEQ ID NO: 132266 - DNA, 20 bp, Artificial Sequence
  chemically synthesized
ttccttaataacttttagat

SEQ ID NO: 132267 - DNA, 20 bp, Artificial Sequence
  chemically synthesized
cttccttaataacttttaga

SEQ ID NO: 132268 - DNA, 20 bp, Artificial Sequence
  chemically synthesized
gactcttccttaataacttt

SEQ ID NO: 132269 - DNA, 20 bp, Artificial Sequence
  chemically synthesized
cctcccatctaaaagttatt

SEQ ID NO: 132270 - DNA, 20 bp, Artificial Sequence
  chemically synthesized
ctcccatctaaaagttatta

SEQ ID NO: 132271 - DNA, 20 bp, Artificial Sequence
  chemically synthesized
ccatctaaaagttattaagg

SEQ ID NO: 132272 - DNA, 20 bp, Artificial Sequence
  chemically synthesized
atctaaaagttattaaggaa

SEQ ID NO: 132273 - DNA, 20 bp, Artificial Sequence
  chemically synthesized
taaggaagagtctgttgcta

SEQ ID NO: 132274 - DNA, 20 bp, Artificial Sequence
  chemically synthesized
atcgagtgtttccatagcaa

SEQ ID NO: 132275 - DNA, 20 bp, Artificial Sequence
  chemically synthesized
tgtcaaatcgagtgtttcca

SEQ ID NO: 132276 - DNA, 20 bp, Artificial Sequence
  chemically synthesized
aatacagatggtgtcaaatc

SEQ ID NO: 132277 - DNA, 20 bp, Artificial Sequence
  chemically synthesized
aattgaattttgaatacaga

SEQ ID NO: 132278 - DNA, 20 bp, Artificial Sequence
  chemically synthesized
cagcaattgaattttgaata

SEQ ID NO: 132279 - DNA, 20 bp, Artificial Sequence
  chemically synthesized
attcaaaattcaattgctgc

SEQ ID NO: 132280 - DNA, 20 bp, Artificial Sequence
  chemically synthesized
ggagattggctgaaggcttg

SEQ ID NO: 132281 - DNA, 20 bp, Artificial Sequence
  chemically synthesized
attcaattgctgcaagcctt

SEQ ID NO: 132282 - DNA, 20 bp, Artificial Sequence
  chemically synthesized
aaaaaccggagattggctga

SEQ ID NO: 132283 - DNA, 20 bp, Artificial Sequence
  chemically synthesized
taaaaaccggagattggctg

SEQ ID NO: 132284 - DNA, 20 bp, Artificial Sequence
  chemically synthesized
gcaagccttcagccaatctc

SEQ ID NO: 132285 - DNA, 20 bp, Artificial Sequence
  chemically synthesized
gccaattaaaaaccggagat

SEQ ID NO: 132286 - DNA, 20 bp, Artificial Sequence
  chemically synthesized
gtcttgccaattaaaaaccg

SEQ ID NO: 132287 - DNA, 20 bp, Artificial Sequence
  chemically synthesized
aggtcttgccaattaaaaac

SEQ ID NO: 132288 - DNA, 20 bp, Artificial Sequence
  chemically synthesized
gccaatctccggtttttaat

SEQ ID NO: 132289 - DNA, 20 bp, Artificial Sequence
  chemically synthesized
atctccggtttttaattggc

SEQ ID NO: 132290 - DNA, 20 bp, Artificial Sequence
  chemically synthesized
tttaattggcaagaccttcc

SEQ ID NO: 132291 - DNA, 20 bp, Artificial Sequence
  chemically synthesized
atttgtagagcatactggga

SEQ ID NO: 132292 - DNA, 20 bp, Artificial Sequence
  chemically synthesized
gatttgtagagcatactggg

SEQ ID NO: 132293 - DNA, 20 bp, Artificial Sequence
  chemically synthesized
aaagatttgtagagcatact

SEQ ID NO: 132294 - DNA, 20 bp, Artificial Sequence
  chemically synthesized
aaaagatttgtagagcatac

SEQ ID NO: 132295 - DNA, 20 bp, Artificial Sequence
  chemically synthesized
aataaaaaaaaagatttgta

SEQ ID NO: 132296 - DNA, 20 bp, Artificial Sequence
  chemically synthesized
aaaataaaaaaaaagatttg

SEQ ID NO: 132297 - DNA, 20 bp, Artificial Sequence
  chemically synthesized
aaaaataaaaaataaaaaaa

SEQ ID NO: 132298 - DNA, 20 bp, Artificial Sequence
  chemically synthesized
ttttttttattttttatttt

SEQ ID NO: 132299 - DNA, 20 bp, Artificial Sequence
  chemically synthesized
tttttttattttttattttt

SEQ ID NO: 132300 - DNA, 20 bp, Artificial Sequence
  chemically synthesized
ttttattttttatttttagg

SEQ ID NO: 132301 - DNA, 20 bp, Artificial Sequence
  chemically synthesized
ttttaggaagtcaatctata

SEQ ID NO: 132302 - DNA, 20 bp, Artificial Sequence
  chemically synthesized
ttacattgcaatatgctgta

SEQ ID NO: 132303 - DNA, 20 bp, Artificial Sequence
  chemically synthesized
atacagcatattgcaatgta

SEQ ID NO: 132304 - DNA, 20 bp, Artificial Sequence
  chemically synthesized
atattgcaatgtaaagcatc

SEQ ID NO: 132305 - DNA, 20 bp, Artificial Sequence
  chemically synthesized
tgcaatgtaaagcatcaaga

SEQ ID NO: 132306 - DNA, 20 bp, Artificial Sequence
  chemically synthesized
atcaagaaagttcacaatgc

SEQ ID NO: 132307 - DNA, 20 bp, Artificial Sequence
  chemically synthesized
gattttaagataatggaatg

SEQ ID NO: 132308 - DNA, 20 bp, Artificial Sequence
  chemically synthesized
tgattttaagataatggaat

SEQ ID NO: 132309 - DNA, 20 bp, Artificial Sequence
  chemically synthesized
caagtctgattttaagataa

SEQ ID NO: 132310 - DNA, 20 bp, Artificial Sequence
  chemically synthesized
tcattccattatcttaaaat

SEQ ID NO: 132311 - DNA, 20 bp, Artificial Sequence
  chemically synthesized
aacttcacaagtctgatttt

SEQ ID NO: 132312 - DNA, 20 bp, Artificial Sequence
  chemically synthesized
atcttaaaatcagacttgtg

SEQ ID NO: 132313 - DNA, 20 bp, Artificial Sequence
  chemically synthesized
gtaatgctttgaaacttcac

SEQ ID NO: 132314 - DNA, 20 bp, Artificial Sequence
  chemically synthesized
atcagacttgtgaagtttca

SEQ ID NO: 132315 - DNA, 20 bp, Artificial Sequence
  chemically synthesized
tgtgaagtttcaaagcatta

SEQ ID NO: 132316 - DNA, 20 bp, Artificial Sequence
  chemically synthesized
catgccaagtaattatcaga

SEQ ID NO: 132317 - DNA, 20 bp, Artificial Sequence
  chemically synthesized
tcatgccaagtaattatcag

SEQ ID NO: 132318 - DNA, 20 bp, Artificial Sequence
  chemically synthesized
acctcatgccaagtaattat

SEQ ID NO: 132319 - DNA, 20 bp, Artificial Sequence
  chemically synthesized
acagccttctgataattact

SEQ ID NO: 132320 - DNA, 20 bp, Artificial Sequence
  chemically synthesized
ttctgataattacttggcat

SEQ ID NO: 132321 - DNA, 20 bp, Artificial Sequence
  chemically synthesized
tctgataattacttggcatg

SEQ ID NO: 132322 - DNA, 20 bp, Artificial Sequence
  chemically synthesized
ttaggcattaacctcatgcc

SEQ ID NO: 132323 - DNA, 20 bp, Artificial Sequence
  chemically synthesized
aaaacttggcaataaatttt

SEQ ID NO: 132324 - DNA, 20 bp, Artificial Sequence
  chemically synthesized
aaaaacttggcaataaattt

SEQ ID NO: 132325 - DNA, 20 bp, Artificial Sequence
  chemically synthesized
aatgcctaaaatttattgcc

SEQ ID NO: 132326 - DNA, 20 bp, Artificial Sequence
  chemically synthesized
aataggcaaaaaaaaaaact

SEQ ID NO: 132327 - DNA, 20 bp, Artificial Sequence
  chemically synthesized
aagtttttttttttgcctat

SEQ ID NO: 132328 - DNA, 20 bp, Artificial Sequence
  chemically synthesized
ctttacgtgtgaaatccaat

SEQ ID NO: 132329 - DNA, 20 bp, Artificial Sequence
  chemically synthesized
tctttacgtgtgaaatccaa

SEQ ID NO: 132330 - DNA, 20 bp, Artificial Sequence
  chemically synthesized
cctattggatttcacacgta

SEQ ID NO: 132331 - DNA, 20 bp, Artificial Sequence
  chemically synthesized
gtaaagaaaatactcattgt

SEQ ID NO: 132332 - DNA, 20 bp, Artificial Sequence
  chemically synthesized
aaagaaaatactcattgtaa

SEQ ID NO: 132333 - DNA, 20 bp, Artificial Sequence
  chemically synthesized
actaaagtcactcttacaat

SEQ ID NO: 132334 - DNA, 20 bp, Artificial Sequence
  chemically synthesized
actcattgtaagagtgactt

SEQ ID NO: 132335 - DNA, 20 bp, Artificial Sequence
  chemically synthesized
tgtaagagtgactttagtat

SEQ ID NO: 132336 - DNA, 20 bp, Artificial Sequence
  chemically synthesized
gtaagagtgactttagtatt

SEQ ID NO: 132337 - DNA, 20 bp, Artificial Sequence
  chemically synthesized
tcagggtcttcctaatacta

SEQ ID NO: 132338 - DNA, 20 bp, Artificial Sequence
  chemically synthesized
agagtgactttagtattagg

SEQ ID NO: 132339 - DNA, 20 bp, Artificial Sequence
  chemically synthesized
gtattaggaagaccctgaaa

SEQ ID NO: 132340 - DNA, 20 bp, Artificial Sequence
  chemically synthesized
attaggaagaccctgaaaaa

SEQ ID NO: 132341 - DNA, 20 bp, Artificial Sequence
  chemically synthesized
ctcactaaggctctttttca

SEQ ID NO: 132342 - DNA, 20 bp, Artificial Sequence
  chemically synthesized
cctcactaaggctctttttc

SEQ ID NO: 132343 - DNA, 20 bp, Artificial Sequence
  chemically synthesized
tcctcactaaggctcttttt

SEQ ID NO: 132344 - DNA, 20 bp, Artificial Sequence
  chemically synthesized
aagaccctgaaaaagagcct

SEQ ID NO: 132345 - DNA, 20 bp, Artificial Sequence
  chemically synthesized
ccctgaaaaagagccttagt

SEQ ID NO: 132346 - DNA, 20 bp, Artificial Sequence
  chemically synthesized
cctgaaaaagagccttagtg

SEQ ID NO: 132347 - DNA, 20 bp, Artificial Sequence
  chemically synthesized
gtgatataagttcctcacta

SEQ ID NO: 132348 - DNA, 20 bp, Artificial Sequence
  chemically synthesized
tgtgatataagttcctcact

SEQ ID NO: 132349 - DNA, 20 bp, Artificial Sequence
  chemically synthesized
taaactgtgtattgtgatat

SEQ ID NO: 132350 - DNA, 20 bp, Artificial Sequence
  chemically synthesized
ggaacttatatcacaataca

SEQ ID NO: 132351 - DNA, 20 bp, Artificial Sequence
  chemically synthesized
ttatatcacaatacacagtt

SEQ ID NO: 132352 - DNA, 20 bp, Artificial Sequence
  chemically synthesized
tcacaatacacagtttagaa

SEQ ID NO: 132353 - DNA, 20 bp, Artificial Sequence
  chemically synthesized
tttagaatggaaaacaaata

SEQ ID NO: 132354 - DNA, 20 bp, Artificial Sequence
  chemically synthesized
tggaaaacaaatatagaaat

SEQ ID NO: 132355 - DNA, 20 bp, Artificial Sequence
  chemically synthesized
gaaaacaaatatagaaatca

SEQ ID NO: 132356 - DNA, 20 bp, Artificial Sequence
  chemically synthesized
caaatatagaaatcagagtt

SEQ ID NO: 132357 - DNA, 20 bp, Artificial Sequence
  chemically synthesized
cagagttaagaatgcaattt

SEQ ID NO: 132358 - DNA, 20 bp, Artificial Sequence
  chemically synthesized
ttaagaatgcaattttggaa

SEQ ID NO: 132359 - DNA, 20 bp, Artificial Sequence
  chemically synthesized
gaatgcaattttggaatagt

SEQ ID NO: 132360 - DNA, 20 bp, Artificial Sequence
  chemically synthesized
attttggaatagtcagactg

SEQ ID NO: 132361 - DNA, 20 bp, Artificial Sequence
  chemically synthesized
ttccaaataatattgaactt

SEQ ID NO: 132362 - DNA, 20 bp, Artificial Sequence
  chemically synthesized
gactgaagttcaatattatt

SEQ ID NO: 132363 - DNA, 20 bp, Artificial Sequence
  chemically synthesized
atattatttggaatacttgt

SEQ ID NO: 132364 - DNA, 20 bp, Artificial Sequence
  chemically synthesized
ggttacataaagtagctaac

SEQ ID NO: 132365 - DNA, 20 bp, Artificial Sequence
  chemically synthesized
tgtagaaaggttacataaag

SEQ ID NO: 132366 - DNA, 20 bp, Artificial Sequence
  chemically synthesized
agatgtagaaaggttacata

SEQ ID NO: 132367 - DNA, 20 bp, Artificial Sequence
  chemically synthesized
gaggaaaagaagatgtagaa

SEQ ID NO: 132368 - DNA, 20 bp, Artificial Sequence
  chemically synthesized
tgaggaaaagaagatgtaga

SEQ ID NO: 132369 - DNA, 20 bp, Artificial Sequence
  chemically synthesized
cagatgaggaaaagaagatg

SEQ ID NO: 132370 - DNA, 20 bp, Artificial Sequence
  chemically synthesized
ctcttacagatgaggaaaag

SEQ ID NO: 132371 - DNA, 20 bp, Artificial Sequence
  chemically synthesized
gatctcttacagatgaggaa

SEQ ID NO: 132372 - DNA, 20 bp, Artificial Sequence
  chemically synthesized
atcttcttttcctcatctgt

SEQ ID NO: 132373 - DNA, 20 bp, Artificial Sequence
  chemically synthesized
taatagatctcttacagatg

SEQ ID NO: 132374 - DNA, 20 bp, Artificial Sequence
  chemically synthesized
ataatagatctcttacagat

SEQ ID NO: 132375 - DNA, 20 bp, Artificial Sequence
  chemically synthesized
cttcttttcctcatctgtaa

SEQ ID NO: 132376 - DNA, 20 bp, Artificial Sequence
  chemically synthesized
tcctcataatagatctctta

SEQ ID NO: 132377 - DNA, 20 bp, Artificial Sequence
  chemically synthesized
atctgtaagagatctattat

SEQ ID NO: 132378 - DNA, 20 bp, Artificial Sequence
  chemically synthesized
tctgtaagagatctattatg

SEQ ID NO: 132379 - DNA, 20 bp, Artificial Sequence
  chemically synthesized
gtactttaaaatcctcataa

SEQ ID NO: 132380 - DNA, 20 bp, Artificial Sequence
  chemically synthesized
gatctattatgaggatttta

SEQ ID NO: 132381 - DNA, 20 bp, Artificial Sequence
  chemically synthesized
ggattttaaagtacgcattt

SEQ ID NO: 132382 - DNA, 20 bp, Artificial Sequence
  chemically synthesized
gattttaaagtacgcatttt

SEQ ID NO: 132383 - DNA, 20 bp, Artificial Sequence
  chemically synthesized
attttaaagtacgcattttg

SEQ ID NO: 132384 - DNA, 20 bp, Artificial Sequence
  chemically synthesized
tatatatgtataagtatgtg

SEQ ID NO: 132385 - DNA, 20 bp, Artificial Sequence
  chemically synthesized
tgtatatactatatatgtat

SEQ ID NO: 132386 - DNA, 20 bp, Artificial Sequence
  chemically synthesized
tacacatacttatacatata

SEQ ID NO: 132387 - DNA, 20 bp, Artificial Sequence
  chemically synthesized
agtatatacatatactataa

SEQ ID NO: 132388 - DNA, 20 bp, Artificial Sequence
  chemically synthesized
cagattttcaaatgccgtta

SEQ ID NO: 132389 - DNA, 20 bp, Artificial Sequence
  chemically synthesized
ttcaagaccatgtggattaa

SEQ ID NO: 132390 - DNA, 20 bp, Artificial Sequence
  chemically synthesized
tgaaaatctgttaatccaca

SEQ ID NO: 132391 - DNA, 20 bp, Artificial Sequence
  chemically synthesized
aaatatgcttcaagaccatg

SEQ ID NO: 132392 - DNA, 20 bp, Artificial Sequence
  chemically synthesized
tgttaatccacatggtcttg

SEQ ID NO: 132393 - DNA, 20 bp, Artificial Sequence
  chemically synthesized
attctggagaaatatgcttc

SEQ ID NO: 132394 - DNA, 20 bp, Artificial Sequence
  chemically synthesized
ggtcttgaagcatatttctc

SEQ ID NO: 132395 - DNA, 20 bp, Artificial Sequence
  chemically synthesized
tacagatacttgatattctg

SEQ ID NO: 132396 - DNA, 20 bp, Artificial Sequence
  chemically synthesized
gcatatttctccagaatatc

SEQ ID NO: 132397 - DNA, 20 bp, Artificial Sequence
  chemically synthesized
tatacagatacttgatattc

SEQ ID NO: 132398 - DNA, 20 bp, Artificial Sequence
  chemically synthesized
aatatcaagtatctgtatat

SEQ ID NO: 132399 - DNA, 20 bp, Artificial Sequence
  chemically synthesized
attttagcaacacttatata

SEQ ID NO: 132400 - DNA, 20 bp, Artificial Sequence
  chemically synthesized
ataagtgttgctaaaattca

SEQ ID NO: 132401 - DNA, 20 bp, Artificial Sequence
  chemically synthesized
atcctctcttctatgaattt

SEQ ID NO: 132402 - DNA, 20 bp, Artificial Sequence
  chemically synthesized
agtgttgctaaaattcatag

SEQ ID NO: 132403 - DNA, 20 bp, Artificial Sequence
  chemically synthesized
tgttgctaaaattcatagaa

SEQ ID NO: 132404 - DNA, 20 bp, Artificial Sequence
  chemically synthesized
ttgctaaaattcatagaaga

SEQ ID NO: 132405 - DNA, 20 bp, Artificial Sequence
  chemically synthesized
tgctaaaattcatagaagag

SEQ ID NO: 132406 - DNA, 20 bp, Artificial Sequence
  chemically synthesized
aagagaggattacaaaaaac

SEQ ID NO: 132407 - DNA, 20 bp, Artificial Sequence
  chemically synthesized
aataattattcagagaattc

SEQ ID NO: 132408 - DNA, 20 bp, Artificial Sequence
  chemically synthesized
tatttaaaaataattattca

SEQ ID NO: 132409 - DNA, 20 bp, Artificial Sequence
  chemically synthesized
cttatttaaaaataattatt

SEQ ID NO: 132410 - DNA, 20 bp, Artificial Sequence
  chemically synthesized
ctgaataattatttttaaat

SEQ ID NO: 132411 - DNA, 20 bp, Artificial Sequence
  chemically synthesized
tgaataattatttttaaata

SEQ ID NO: 132412 - DNA, 20 bp, Artificial Sequence
  chemically synthesized
gaataattatttttaaataa

SEQ ID NO: 132413 - DNA, 20 bp, Artificial Sequence
  chemically synthesized
taattatttttaaataaggg

SEQ ID NO: 132414 - DNA, 20 bp, Artificial Sequence
  chemically synthesized
aattatttttaaataaggga

SEQ ID NO: 132415 - DNA, 20 bp, Artificial Sequence
  chemically synthesized
aaataagggaaggatatgac

SEQ ID NO: 132416 - DNA, 20 bp, Artificial Sequence
  chemically synthesized
aaggatatgactggatatta

SEQ ID NO: 132417 - DNA, 20 bp, Artificial Sequence
  chemically synthesized
atttacatttctttaatatc

SEQ ID NO: 132418 - DNA, 20 bp, Artificial Sequence
  chemically synthesized
aagaaatgtaaatatgcttc

SEQ ID NO: 132419 - DNA, 20 bp, Artificial Sequence
  chemically synthesized
aaatgtaaatatgcttctgg

SEQ ID NO: 132420 - DNA, 20 bp, Artificial Sequence
  chemically synthesized
aatgtaaatatgcttctggc

SEQ ID NO: 132421 - DNA, 20 bp, Artificial Sequence
  chemically synthesized
ttttggcattttcctgccag

SEQ ID NO: 132422 - DNA, 20 bp, Artificial Sequence
  chemically synthesized
tttttttggcattttcctgc

SEQ ID NO: 132423 - DNA, 20 bp, Artificial Sequence
  chemically synthesized
caactgtgcatacatttttt

SEQ ID NO: 132424 - DNA, 20 bp, Artificial Sequence
  chemically synthesized
atgccaaaaaaatgtatgca

SEQ ID NO: 132425 - DNA, 20 bp, Artificial Sequence
  chemically synthesized
aaaaaatgtatgcacagttg

SEQ ID NO: 132426 - DNA, 20 bp, Artificial Sequence
  chemically synthesized
aaaaatgtatgcacagttgt

SEQ ID NO: 132427 - DNA, 20 bp, Artificial Sequence
  chemically synthesized
tcccatcaaaatgtcgtgat

SEQ ID NO: 132428 - DNA, 20 bp, Artificial Sequence
  chemically synthesized
gtccaatcacgacattttga

SEQ ID NO: 132429 - DNA, 20 bp, Artificial Sequence
  chemically synthesized
tccaatcacgacattttgat

SEQ ID NO: 132430 - DNA, 20 bp, Artificial Sequence
  chemically synthesized
atcacgacattttgatggga

SEQ ID NO: 132431 - DNA, 20 bp, Artificial Sequence
  chemically synthesized
cacgacattttgatgggata

SEQ ID NO: 132432 - DNA, 20 bp, Artificial Sequence
  chemically synthesized
gacattttgatgggatagag

SEQ ID NO: 132433 - DNA, 20 bp, Artificial Sequence
  chemically synthesized
agaagtaattcgccacaatt

SEQ ID NO: 132434 - DNA, 20 bp, Artificial Sequence
  chemically synthesized
accacagcagtgctcaattg

SEQ ID NO: 132435 - DNA, 20 bp, Artificial Sequence
  chemically synthesized
gccacaattgagcactgctg

SEQ ID NO: 132436 - DNA, 20 bp, Artificial Sequence
  chemically synthesized
agcctcccaagaaaccacag

SEQ ID NO: 132437 - DNA, 20 bp, Artificial Sequence
  chemically synthesized
cagagcctcccaagaaacca

SEQ ID NO: 132438 - DNA, 20 bp, Artificial Sequence
  chemically synthesized
tgagcactgctgtggtttct

SEQ ID NO: 132439 - DNA, 20 bp, Artificial Sequence
  chemically synthesized
gagcactgctgtggtttctt

SEQ ID NO: 132440 - DNA, 20 bp, Artificial Sequence
  chemically synthesized
gcactgctgtggtttcttgg

SEQ ID NO: 132441 - DNA, 20 bp, Artificial Sequence
  chemically synthesized
cactgctgtggtttcttggg

SEQ ID NO: 132442 - DNA, 20 bp, Artificial Sequence
  chemically synthesized
gtaggttgacagagcctccc

SEQ ID NO: 132443 - DNA, 20 bp, Artificial Sequence
  chemically synthesized
tataacttagtaggttgaca

SEQ ID NO: 132444 - DNA, 20 bp, Artificial Sequence
  chemically synthesized
actataacttagtaggttga

SEQ ID NO: 132445 - DNA, 20 bp, Artificial Sequence
  chemically synthesized
ggaggctctgtcaacctact

SEQ ID NO: 132446 - DNA, 20 bp, Artificial Sequence
  chemically synthesized
taggataactataacttagt

SEQ ID NO: 132447 - DNA, 20 bp, Artificial Sequence
  chemically synthesized
ataggataactataacttag

SEQ ID NO: 132448 - DNA, 20 bp, Artificial Sequence
  chemically synthesized
tctgtcaacctactaagtta

SEQ ID NO: 132449 - DNA, 20 bp, Artificial Sequence
  chemically synthesized
cccataggataactataact

SEQ ID NO: 132450 - DNA, 20 bp, Artificial Sequence
  chemically synthesized
actaagttatagttatccta

SEQ ID NO: 132451 - DNA, 20 bp, Artificial Sequence
  chemically synthesized
ctaagttatagttatcctat

SEQ ID NO: 132452 - DNA, 20 bp, Artificial Sequence
  chemically synthesized
ttatagttatcctatgggaa

SEQ ID NO: 132453 - DNA, 20 bp, Artificial Sequence
  chemically synthesized
gctatggggtctgttcccat

SEQ ID NO: 132454 - DNA, 20 bp, Artificial Sequence
  chemically synthesized
agctatggggtctgttccca

SEQ ID NO: 132455 - DNA, 20 bp, Artificial Sequence
  chemically synthesized
tcctatgggaacagacccca

SEQ ID NO: 132456 - DNA, 20 bp, Artificial Sequence
  chemically synthesized
tctaattatctttagctatg

SEQ ID NO: 132457 - DNA, 20 bp, Artificial Sequence
  chemically synthesized
gggaacagaccccatagcta

SEQ ID NO: 132458 - DNA, 20 bp, Artificial Sequence
  chemically synthesized
ttctaattatctttagctat

SEQ ID NO: 132459 - DNA, 20 bp, Artificial Sequence
  chemically synthesized
attctaattatctttagcta

SEQ ID NO: 132460 - DNA, 20 bp, Artificial Sequence
  chemically synthesized
ggcaacattctaattatctt

SEQ ID NO: 132461 - DNA, 20 bp, Artificial Sequence
  chemically synthesized
accccatagctaaagataat

SEQ ID NO: 132462 - DNA, 20 bp, Artificial Sequence
  chemically synthesized
ataattagaatgttgccctc

SEQ ID NO: 132463 - DNA, 20 bp, Artificial Sequence
  chemically synthesized
aattagaatgttgccctctg

SEQ ID NO: 132464 - DNA, 20 bp, Artificial Sequence
  chemically synthesized
ctacattgcagaactccaga

SEQ ID NO: 132465 - DNA, 20 bp, Artificial Sequence
  chemically synthesized
gctacattgcagaactccag

SEQ ID NO: 132466 - DNA, 20 bp, Artificial Sequence
  chemically synthesized
tgctacattgcagaactcca

SEQ ID NO: 132467 - DNA, 20 bp, Artificial Sequence
  chemically synthesized
cttgctacattgcagaactc

SEQ ID NO: 132468 - DNA, 20 bp, Artificial Sequence
  chemically synthesized
ccctctggagttctgcaatg

SEQ ID NO: 132469 - DNA, 20 bp, Artificial Sequence
  chemically synthesized
aaagcaagcttgctacattg

SEQ ID NO: 132470 - DNA, 20 bp, Artificial Sequence
  chemically synthesized
ctggagttctgcaatgtagc

SEQ ID NO: 132471 - DNA, 20 bp, Artificial Sequence
  chemically synthesized
ggacagtggtatggtaaagc

SEQ ID NO: 132472 - DNA, 20 bp, Artificial Sequence
  chemically synthesized
agtaggacagtggtatggta

SEQ ID NO: 132473 - DNA, 20 bp, Artificial Sequence
  chemically synthesized
tgttcagtaggacagtggta

SEQ ID NO: 132474 - DNA, 20 bp, Artificial Sequence
  chemically synthesized
ctggctgttcagtaggacag

SEQ ID NO: 132475 - DNA, 20 bp, Artificial Sequence
  chemically synthesized
aggctggctgttcagtagga

SEQ ID NO: 132476 - DNA, 20 bp, Artificial Sequence
  chemically synthesized
cataccactgtcctactgaa

SEQ ID NO: 132477 - DNA, 20 bp, Artificial Sequence
  chemically synthesized
aaagaggctggctgttcagt

SEQ ID NO: 132478 - DNA, 20 bp, Artificial Sequence
  chemically synthesized
caaagaggctggctgttcag

SEQ ID NO: 132479 - DNA, 20 bp, Artificial Sequence
  chemically synthesized
ccactgtcctactgaacagc

SEQ ID NO: 132480 - DNA, 20 bp, Artificial Sequence
  chemically synthesized
tatcaaagaggctggctgtt

SEQ ID NO: 132481 - DNA, 20 bp, Artificial Sequence
  chemically synthesized
ttaaggattatcaaagaggc

SEQ ID NO: 132482 - DNA, 20 bp, Artificial Sequence
  chemically synthesized
cctcttaaggattatcaaag

SEQ ID NO: 132483 - DNA, 20 bp, Artificial Sequence
  chemically synthesized
acctcttaaggattatcaaa

SEQ ID NO: 132484 - DNA, 20 bp, Artificial Sequence
  chemically synthesized
ttacctcttaaggattatca

SEQ ID NO: 132485 - DNA, 20 bp, Artificial Sequence
  chemically synthesized
cagcctctttgataatcctt

SEQ ID NO: 132486 - DNA, 20 bp, Artificial Sequence
  chemically synthesized
gcctctttgataatccttaa

SEQ ID NO: 132487 - DNA, 20 bp, Artificial Sequence
  chemically synthesized
cctctttgataatccttaag

SEQ ID NO: 132488 - DNA, 20 bp, Artificial Sequence
  chemically synthesized
agttggaatgttacctctta

SEQ ID NO: 132489 - DNA, 20 bp, Artificial Sequence
  chemically synthesized
tagttggaatgttacctctt

SEQ ID NO: 132490 - DNA, 20 bp, Artificial Sequence
  chemically synthesized
ggagcaataagcagtgtagt

SEQ ID NO: 132491 - DNA, 20 bp, Artificial Sequence
  chemically synthesized
acctggagcaataagcagtg

SEQ ID NO: 132492 - DNA, 20 bp, Artificial Sequence
  chemically synthesized
tggtaacctggagcaataag

SEQ ID NO: 132493 - DNA, 20 bp, Artificial Sequence
  chemically synthesized
aactacactgcttattgctc

SEQ ID NO: 132494 - DNA, 20 bp, Artificial Sequence
  chemically synthesized
gtgtggtaacctggagcaat

SEQ ID NO: 132495 - DNA, 20 bp, Artificial Sequence
  chemically synthesized
actacactgcttattgctcc

SEQ ID NO: 132496 - DNA, 20 bp, Artificial Sequence
  chemically synthesized
tcaaagtgtgtggtaacctg

SEQ ID NO: 132497 - DNA, 20 bp, Artificial Sequence
  chemically synthesized
tttcaaagtgtgtggtaacc

SEQ ID NO: 132498 - DNA, 20 bp, Artificial Sequence
  chemically synthesized
catgagcttttcaaagtgtg

SEQ ID NO: 132499 - DNA, 20 bp, Artificial Sequence
  chemically synthesized
aggttaccacacactttgaa

SEQ ID NO: 132500 - DNA, 20 bp, Artificial Sequence
  chemically synthesized
acaaagacatgagcttttca

SEQ ID NO: 132501 - DNA, 20 bp, Artificial Sequence
  chemically synthesized
aataaaattaacaaagacat

SEQ ID NO: 132502 - DNA, 20 bp, Artificial Sequence
  chemically synthesized
tatattaaataaaattaaca

SEQ ID NO: 132503 - DNA, 20 bp, Artificial Sequence
  chemically synthesized
tttaatttattcacttaatc

SEQ ID NO: 132504 - DNA, 20 bp, Artificial Sequence
  chemically synthesized
attacatcattcactagatt

SEQ ID NO: 132505 - DNA, 20 bp, Artificial Sequence
  chemically synthesized
acaatcattacatcattcac

SEQ ID NO: 132506 - DNA, 20 bp, Artificial Sequence
  chemically synthesized
atgattgtaatattttcgtt

SEQ ID NO: 132507 - DNA, 20 bp, Artificial Sequence
  chemically synthesized
ttagtggaaccaaaatatta

SEQ ID NO: 132508 - DNA, 20 bp, Artificial Sequence
  chemically synthesized
cagtgatgactgtaatattt

SEQ ID NO: 132509 - DNA, 20 bp, Artificial Sequence
  chemically synthesized
taatgtagtcagttttttag

SEQ ID NO: 132510 - DNA, 20 bp, Artificial Sequence
  chemically synthesized
aggtaatgtagtcagttttt

SEQ ID NO: 132511 - DNA, 20 bp, Artificial Sequence
  chemically synthesized
acacatgaaggtaatgtagt

SEQ ID NO: 132512 - DNA, 20 bp, Artificial Sequence
  chemically synthesized
ggatacacatgaaggtaatg

SEQ ID NO: 132513 - DNA, 20 bp, Artificial Sequence
  chemically synthesized
tcatatcaggatacacatga

SEQ ID NO: 132514 - DNA, 20 bp, Artificial Sequence
  chemically synthesized
ttcatatcaggatacacatg

SEQ ID NO: 132515 - DNA, 20 bp, Artificial Sequence
  chemically synthesized
actataaagggattcatatc

SEQ ID NO: 132516 - DNA, 20 bp, Artificial Sequence
  chemically synthesized
gactataaagggattcatat

SEQ ID NO: 132517 - DNA, 20 bp, Artificial Sequence
  chemically synthesized
tcctgatatgaatcccttta

SEQ ID NO: 132518 - DNA, 20 bp, Artificial Sequence
  chemically synthesized
aaggaaaggaagactataaa

SEQ ID NO: 132519 - DNA, 20 bp, Artificial Sequence
  chemically synthesized
aaaggaaaggaagactataa

SEQ ID NO: 132520 - DNA, 20 bp, Artificial Sequence
  chemically synthesized
aaaaggaaaggaagactata

SEQ ID NO: 132521 - DNA, 20 bp, Artificial Sequence
  chemically synthesized
atttaagaaaaaaggaaagg

SEQ ID NO: 132522 - DNA, 20 bp, Artificial Sequence
  chemically synthesized
tgaatttaagaaaaaaggaa

SEQ ID NO: 132523 - DNA, 20 bp, Artificial Sequence
  chemically synthesized
atgaatttaagaaaaaagga

SEQ ID NO: 132524 - DNA, 20 bp, Artificial Sequence
  chemically synthesized
ttttatgaatttaagaaaaa

SEQ ID NO: 132525 - DNA, 20 bp, Artificial Sequence
  chemically synthesized
attttatgaatttaagaaaa

SEQ ID NO: 132526 - DNA, 20 bp, Artificial Sequence
  chemically synthesized
tttatacattttatgaattt

SEQ ID NO: 132527 - DNA, 20 bp, Artificial Sequence
  chemically synthesized
tgtataaattgatgaataat

SEQ ID NO: 132528 - DNA, 20 bp, Artificial Sequence
  chemically synthesized
gtataaattgatgaataatc

SEQ ID NO: 132529 - DNA, 20 bp, Artificial Sequence
  chemically synthesized
tctttattcttacacagcat

SEQ ID NO: 132530 - DNA, 20 bp, Artificial Sequence
  chemically synthesized
aatcaggacttatgctgtgt

SEQ ID NO: 132531 - DNA, 20 bp, Artificial Sequence
  chemically synthesized
aagttgtctttattcttaca

SEQ ID NO: 132532 - DNA, 20 bp, Artificial Sequence
  chemically synthesized
acttatgctgtgtaagaata

SEQ ID NO: 132533 - DNA, 20 bp, Artificial Sequence
  chemically synthesized
gggagaaccaaaggcagata

SEQ ID NO: 132534 - DNA, 20 bp, Artificial Sequence
  chemically synthesized
aagacaactttatctgcctt

SEQ ID NO: 132535 - DNA, 20 bp, Artificial Sequence
  chemically synthesized
tttaaagggagaaccaaagg

SEQ ID NO: 132536 - DNA, 20 bp, Artificial Sequence
  chemically synthesized
agatttaaagggagaaccaa

SEQ ID NO: 132537 - DNA, 20 bp, Artificial Sequence
  chemically synthesized
cagatttaaagggagaacca

SEQ ID NO: 132538 - DNA, 20 bp, Artificial Sequence
  chemically synthesized
tacttgaacagatttaaagg

SEQ ID NO: 132539 - DNA, 20 bp, Artificial Sequence
  chemically synthesized
cctacttgaacagatttaaa

SEQ ID NO: 132540 - DNA, 20 bp, Artificial Sequence
  chemically synthesized
acctacttgaacagatttaa

SEQ ID NO: 132541 - DNA, 20 bp, Artificial Sequence
  chemically synthesized
aacctacttgaacagattta

SEQ ID NO: 132542 - DNA, 20 bp, Artificial Sequence
  chemically synthesized
ttctccctttaaatctgttc

SEQ ID NO: 132543 - DNA, 20 bp, Artificial Sequence
  chemically synthesized
tccctttaaatctgttcaag

SEQ ID NO: 132544 - DNA, 20 bp, Artificial Sequence
  chemically synthesized
ccctttaaatctgttcaagt

SEQ ID NO: 132545 - DNA, 20 bp, Artificial Sequence
  chemically synthesized
aacagaacaacctacttgaa

SEQ ID NO: 132546 - DNA, 20 bp, Artificial Sequence
  chemically synthesized
attttcacccaagaacagaa

SEQ ID NO: 132547 - DNA, 20 bp, Artificial Sequence
  chemically synthesized
aggttgttctgttctgttct

SEQ ID NO: 132548 - DNA, 20 bp, Artificial Sequence
  chemically synthesized
ggttgttctgttctgttctt

SEQ ID NO: 132549 - DNA, 20 bp, Artificial Sequence
  chemically synthesized
cccatattttcacccaagaa

SEQ ID NO: 132550 - DNA, 20 bp, Artificial Sequence
  chemically synthesized
acttacccatattttcaccc

SEQ ID NO: 132551 - DNA, 20 bp, Artificial Sequence
  chemically synthesized
tctgttcttgggtgaaaata

SEQ ID NO: 132552 - DNA, 20 bp, Artificial Sequence
  chemically synthesized
ctgttcttgggtgaaaatat

SEQ ID NO: 132553 - DNA, 20 bp, Artificial Sequence
  chemically synthesized
tcttgggtgaaaatatgggt

SEQ ID NO: 132554 - DNA, 20 bp, Artificial Sequence
  chemically synthesized
ggtaagtttcatgtcttttc

SEQ ID NO: 132555 - DNA, 20 bp, Artificial Sequence
  chemically synthesized
ttccttaatgatgaccagaa

SEQ ID NO: 132556 - DNA, 20 bp, Artificial Sequence
  chemically synthesized
tttgtttccttaatgatgac

SEQ ID NO: 132557 - DNA, 20 bp, Artificial Sequence
  chemically synthesized
tgtcttttctggtcatcatt

SEQ ID NO: 132558 - DNA, 20 bp, Artificial Sequence
  chemically synthesized
gtcttttctggtcatcatta

SEQ ID NO: 132559 - DNA, 20 bp, Artificial Sequence
  chemically synthesized
tggtcatcattaaggaaaca

SEQ ID NO: 132560 - DNA, 20 bp, Artificial Sequence
  chemically synthesized
ttaatgtctcgatatggagc

SEQ ID NO: 132561 - DNA, 20 bp, Artificial Sequence
  chemically synthesized
tttaatgtctcgatatggag

SEQ ID NO: 132562 - DNA, 20 bp, Artificial Sequence
  chemically synthesized
acaaagtcctgctccatatc

SEQ ID NO: 132563 - DNA, 20 bp, Artificial Sequence
  chemically synthesized
aattttaatgtctcgatatg

SEQ ID NO: 132564 - DNA, 20 bp, Artificial Sequence
  chemically synthesized
ctaattttaatgtctcgata

SEQ ID NO: 132565 - DNA, 20 bp, Artificial Sequence
  chemically synthesized
ccatatcgagacattaaaat

SEQ ID NO: 132566 - DNA, 20 bp, Artificial Sequence
  chemically synthesized
gacattaaaattagaatatc

SEQ ID NO: 132567 - DNA, 20 bp, Artificial Sequence
  chemically synthesized
tattgattaatatattgagc

SEQ ID NO: 132568 - DNA, 20 bp, Artificial Sequence
  chemically synthesized
gaagtattgattaatatatt

SEQ ID NO: 132569 - DNA, 20 bp, Artificial Sequence
  chemically synthesized
atatatgtgagttcagattg

SEQ ID NO: 132570 - DNA, 20 bp, Artificial Sequence
  chemically synthesized
agaaatcatatatgtgagtt

SEQ ID NO: 132571 - DNA, 20 bp, Artificial Sequence
  chemically synthesized
gaggaagaaatcatatatgt

SEQ ID NO: 132572 - DNA, 20 bp, Artificial Sequence
  chemically synthesized
tatatgatttcttcctcaat

SEQ ID NO: 132573 - DNA, 20 bp, Artificial Sequence
  chemically synthesized
ccatcctcttctaattgagg

SEQ ID NO: 132574 - DNA, 20 bp, Artificial Sequence
  chemically synthesized
atgatttcttcctcaattag

SEQ ID NO: 132575 - DNA, 20 bp, Artificial Sequence
  chemically synthesized
cttccatcctcttctaattg

SEQ ID NO: 132576 - DNA, 20 bp, Artificial Sequence
  chemically synthesized
acttccatcctcttctaatt

SEQ ID NO: 132577 - DNA, 20 bp, Artificial Sequence
  chemically synthesized
gatttcttcctcaattagaa

SEQ ID NO: 132578 - DNA, 20 bp, Artificial Sequence
  chemically synthesized
atttcttcctcaattagaag

SEQ ID NO: 132579 - DNA, 20 bp, Artificial Sequence
  chemically synthesized
cttcctcaattagaagagga

SEQ ID NO: 132580 - DNA, 20 bp, Artificial Sequence
  chemically synthesized
cctcaattagaagaggatgg

SEQ ID NO: 132581 - DNA, 20 bp, Artificial Sequence
  chemically synthesized
caattagaagaggatggaag

SEQ ID NO: 132582 - DNA, 20 bp, Artificial Sequence
  chemically synthesized
tagaagaggatggaagtgga

SEQ ID NO: 132583 - DNA, 20 bp, Artificial Sequence
  chemically synthesized
agaagaggatggaagtggac

SEQ ID NO: 132584 - DNA, 20 bp, Artificial Sequence
  chemically synthesized
cccactaccccaggtagtaa

SEQ ID NO: 132585 - DNA, 20 bp, Artificial Sequence
  chemically synthesized
tggacaggtcctttactacc

SEQ ID NO: 132586 - DNA, 20 bp, Artificial Sequence
  chemically synthesized
gcccactaccccaggtagta

SEQ ID NO: 132587 - DNA, 20 bp, Artificial Sequence
  chemically synthesized
ggacaggtcctttactacct

SEQ ID NO: 132588 - DNA, 20 bp, Artificial Sequence
  chemically synthesized
gacaggtcctttactacctg

SEQ ID NO: 132589 - DNA, 20 bp, Artificial Sequence
  chemically synthesized
aggtcctttactacctgggg

SEQ ID NO: 132590 - DNA, 20 bp, Artificial Sequence
  chemically synthesized
accatgcccactaccccagg

SEQ ID NO: 132591 - DNA, 20 bp, Artificial Sequence
  chemically synthesized
tcctttactacctggggtag

SEQ ID NO: 132592 - DNA, 20 bp, Artificial Sequence
  chemically synthesized
cccaccatgcccactacccc

SEQ ID NO: 132593 - DNA, 20 bp, Artificial Sequence
  chemically synthesized
cctttactacctggggtagt

SEQ ID NO: 132594 - DNA, 20 bp, Artificial Sequence
  chemically synthesized
gcccaccatgcccactaccc

SEQ ID NO: 132595 - DNA, 20 bp, Artificial Sequence
  chemically synthesized
actacctggggtagtgggca

SEQ ID NO: 132596 - DNA, 20 bp, Artificial Sequence
  chemically synthesized
acctggggtagtgggcatgg

SEQ ID NO: 132597 - DNA, 20 bp, Artificial Sequence
  chemically synthesized
cctggggtagtgggcatggt

SEQ ID NO: 132598 - DNA, 20 bp, Artificial Sequence
  chemically synthesized
actagcaagacagaaagagg

SEQ ID NO: 132599 - DNA, 20 bp, Artificial Sequence
  chemically synthesized
aagactagcaagacagaaag

SEQ ID NO: 132600 - DNA, 20 bp, Artificial Sequence
  chemically synthesized
gaagactagcaagacagaaa

SEQ ID NO: 132601 - DNA, 20 bp, Artificial Sequence
  chemically synthesized
gagaagactagcaagacaga

SEQ ID NO: 132602 - DNA, 20 bp, Artificial Sequence
  chemically synthesized
gcttcctctttctgtcttgc

SEQ ID NO: 132603 - DNA, 20 bp, Artificial Sequence
  chemically synthesized
ggtagagaagactagcaaga

SEQ ID NO: 132604 - DNA, 20 bp, Artificial Sequence
  chemically synthesized
gaatggtagagaagactagc

SEQ ID NO: 132605 - DNA, 20 bp, Artificial Sequence
  chemically synthesized
tggtgaatggtagagaagac

SEQ ID NO: 132606 - DNA, 20 bp, Artificial Sequence
  chemically synthesized
gcagctggtgaatggtagag

SEQ ID NO: 132607 - DNA, 20 bp, Artificial Sequence
  chemically synthesized
atagcagctggtgaatggta

SEQ ID NO: 132608 - DNA, 20 bp, Artificial Sequence
  chemically synthesized
aaatagcagctggtgaatgg

SEQ ID NO: 132609 - DNA, 20 bp, Artificial Sequence
  chemically synthesized
tagtcttctctaccattcac

SEQ ID NO: 132610 - DNA, 20 bp, Artificial Sequence
  chemically synthesized
gagaaatagcagctggtgaa

SEQ ID NO: 132611 - DNA, 20 bp, Artificial Sequence
  chemically synthesized
ttagggtgagaaatagcagc

SEQ ID NO: 132612 - DNA, 20 bp, Artificial Sequence
  chemically synthesized
cttgttagggtgagaaatag

SEQ ID NO: 132613 - DNA, 20 bp, Artificial Sequence
  chemically synthesized
acccttgttagggtgagaaa

SEQ ID NO: 132614 - DNA, 20 bp, Artificial Sequence
  chemically synthesized
ccattaacccttgttagggt

SEQ ID NO: 132615 - DNA, 20 bp, Artificial Sequence
  chemically synthesized
ctgctatttctcaccctaac

SEQ ID NO: 132616 - DNA, 20 bp, Artificial Sequence
  chemically synthesized
tgctatttctcaccctaaca

SEQ ID NO: 132617 - DNA, 20 bp, Artificial Sequence
  chemically synthesized
gctatttctcaccctaacaa

SEQ ID NO: 132618 - DNA, 20 bp, Artificial Sequence
  chemically synthesized
actcccattaacccttgtta

SEQ ID NO: 132619 - DNA, 20 bp, Artificial Sequence
  chemically synthesized
cactcccattaacccttgtt

SEQ ID NO: 132620 - DNA, 20 bp, Artificial Sequence
  chemically synthesized
ccactcccattaacccttgt

SEQ ID NO: 132621 - DNA, 20 bp, Artificial Sequence
  chemically synthesized
ctcaccctaacaagggttaa

SEQ ID NO: 132622 - DNA, 20 bp, Artificial Sequence
  chemically synthesized
tcaccctaacaagggttaat

SEQ ID NO: 132623 - DNA, 20 bp, Artificial Sequence
  chemically synthesized
accctaacaagggttaatgg

SEQ ID NO: 132624 - DNA, 20 bp, Artificial Sequence
  chemically synthesized
ctaacaagggttaatgggag

SEQ ID NO: 132625 - DNA, 20 bp, Artificial Sequence
  chemically synthesized
acaagggttaatgggagtgg

SEQ ID NO: 132626 - DNA, 20 bp, Artificial Sequence
  chemically synthesized
agggttaatgggagtggaag

SEQ ID NO: 132627 - DNA, 20 bp, Artificial Sequence
  chemically synthesized
gttaatgggagtggaagaag

SEQ ID NO: 132628 - DNA, 20 bp, Artificial Sequence
  chemically synthesized
aatgggagtggaagaagaag

SEQ ID NO: 132629 - DNA, 20 bp, Artificial Sequence
  chemically synthesized
atgggagtggaagaagaaga

SEQ ID NO: 132630 - DNA, 20 bp, Artificial Sequence
  chemically synthesized
tgggagtggaagaagaagaa

SEQ ID NO: 132631 - DNA, 20 bp, Artificial Sequence
  chemically synthesized
gggagtggaagaagaagaag

SEQ ID NO: 132632 - DNA, 20 bp, Artificial Sequence
  chemically synthesized
tggaagaagaagaaggggtg

SEQ ID NO: 132633 - DNA, 20 bp, Artificial Sequence
  chemically synthesized
gtgacagtactgagtgaagt

SEQ ID NO: 132634 - DNA, 20 bp, Artificial Sequence
  chemically synthesized
cagaaaattcttacttcact

SEQ ID NO: 132635 - DNA, 20 bp, Artificial Sequence
  chemically synthesized
aacagtgacagtactgagtg

SEQ ID NO: 132636 - DNA, 20 bp, Artificial Sequence
  chemically synthesized
actctaacagtgacagtact

SEQ ID NO: 132637 - DNA, 20 bp, Artificial Sequence
  chemically synthesized
tcactcagtactgtcactgt

SEQ ID NO: 132638 - DNA, 20 bp, Artificial Sequence
  chemically synthesized
aagtcacactctaacagtga

SEQ ID NO: 132639 - DNA, 20 bp, Artificial Sequence
  chemically synthesized
actcagtactgtcactgtta

SEQ ID NO: 132640 - DNA, 20 bp, Artificial Sequence
  chemically synthesized
agcacaaagtcacactctaa

SEQ ID NO: 132641 - DNA, 20 bp, Artificial Sequence
  chemically synthesized
atttgacattagaaagcaca

SEQ ID NO: 132642 - DNA, 20 bp, Artificial Sequence
  chemically synthesized
aagtgatatttgacattaga

SEQ ID NO: 132643 - DNA, 20 bp, Artificial Sequence
  chemically synthesized
ccagaagtgatatttgacat

SEQ ID NO: 132644 - DNA, 20 bp, Artificial Sequence
  chemically synthesized
ctaatgtcaaatatcacttc

SEQ ID NO: 132645 - DNA, 20 bp, Artificial Sequence
  chemically synthesized
taatgtcaaatatcacttct

SEQ ID NO: 132646 - DNA, 20 bp, Artificial Sequence
  chemically synthesized
aatgtcaaatatcacttctg

SEQ ID NO: 132647 - DNA, 20 bp, Artificial Sequence
  chemically synthesized
tcagctccgtgaaaccccag

SEQ ID NO: 132648 - DNA, 20 bp, Artificial Sequence
  chemically synthesized
atttcagctccgtgaaaccc

SEQ ID NO: 132649 - DNA, 20 bp, Artificial Sequence
  chemically synthesized
atatcacttctggggtttca

SEQ ID NO: 132650 - DNA, 20 bp, Artificial Sequence
  chemically synthesized
atcacttctggggtttcacg

SEQ ID NO: 132651 - DNA, 20 bp, Artificial Sequence
  chemically synthesized
aaactgggagaaatacattt

SEQ ID NO: 132652 - DNA, 20 bp, Artificial Sequence
  chemically synthesized
gagctgaaatgtatttctcc

SEQ ID NO: 132653 - DNA, 20 bp, Artificial Sequence
  chemically synthesized
aggctggatcttaaaactgg

SEQ ID NO: 132654 - DNA, 20 bp, Artificial Sequence
  chemically synthesized
aatgtatttctcccagtttt

SEQ ID NO: 132655 - DNA, 20 bp, Artificial Sequence
  chemically synthesized
agaggctggatcttaaaact

SEQ ID NO: 132656 - DNA, 20 bp, Artificial Sequence
  chemically synthesized
cagaggctggatcttaaaac

SEQ ID NO: 132657 - DNA, 20 bp, Artificial Sequence
  chemically synthesized
tttctcccagttttaagatc

SEQ ID NO: 132658 - DNA, 20 bp, Artificial Sequence
  chemically synthesized
agaagaagtagatcagaggc

SEQ ID NO: 132659 - DNA, 20 bp, Artificial Sequence
  chemically synthesized
tcatagaagaagtagatcag

SEQ ID NO: 132660 - DNA, 20 bp, Artificial Sequence
  chemically synthesized
atcatagaagaagtagatca

SEQ ID NO: 132661 - DNA, 20 bp, Artificial Sequence
  chemically synthesized
atatcatagaagaagtagat

SEQ ID NO: 132662 - DNA, 20 bp, Artificial Sequence
  chemically synthesized
ggaacatatcatagaagaag

SEQ ID NO: 132663 - DNA, 20 bp, Artificial Sequence
  chemically synthesized
tgtggaacatatcatagaag

SEQ ID NO: 132664 - DNA, 20 bp, Artificial Sequence
  chemically synthesized
aattgtggaacatatcatag

SEQ ID NO: 132665 - DNA, 20 bp, Artificial Sequence
  chemically synthesized
agtaattgtggaacatatca

SEQ ID NO: 132666 - DNA, 20 bp, Artificial Sequence
  chemically synthesized
actgtctactgaagtaattg

SEQ ID NO: 132667 - DNA, 20 bp, Artificial Sequence
  chemically synthesized
gatatgttccacaattactt

SEQ ID NO: 132668 - DNA, 20 bp, Artificial Sequence
  chemically synthesized
atgttccacaattacttcag

SEQ ID NO: 132669 - DNA, 20 bp, Artificial Sequence
  chemically synthesized
tccacaattacttcagtaga

SEQ ID NO: 132670 - DNA, 20 bp, Artificial Sequence
  chemically synthesized
tgttgactgactgtctactg

SEQ ID NO: 132671 - DNA, 20 bp, Artificial Sequence
  chemically synthesized
caattacttcagtagacagt

SEQ ID NO: 132672 - DNA, 20 bp, Artificial Sequence
  chemically synthesized
ggcacaaagtaggttcagat

SEQ ID NO: 132673 - DNA, 20 bp, Artificial Sequence
  chemically synthesized
tgtttggcacaaagtaggtt

SEQ ID NO: 132674 - DNA, 20 bp, Artificial Sequence
  chemically synthesized
atcagtgtttggcacaaagt

SEQ ID NO: 132675 - DNA, 20 bp, Artificial Sequence
  chemically synthesized
gatcagtgtttggcacaaag

SEQ ID NO: 132676 - DNA, 20 bp, Artificial Sequence
  chemically synthesized
ctagatcagtgtttggcaca

SEQ ID NO: 132677 - DNA, 20 bp, Artificial Sequence
  chemically synthesized
ccagaacctagatcagtgtt

SEQ ID NO: 132678 - DNA, 20 bp, Artificial Sequence
  chemically synthesized
ctttgtgccaaacactgatc

SEQ ID NO: 132679 - DNA, 20 bp, Artificial Sequence
  chemically synthesized
tttgtgccaaacactgatct

SEQ ID NO: 132680 - DNA, 20 bp, Artificial Sequence
  chemically synthesized
agattttccagaacctagat

SEQ ID NO: 132681 - DNA, 20 bp, Artificial Sequence
  chemically synthesized
ccaaacactgatctaggttc

SEQ ID NO: 132682 - DNA, 20 bp, Artificial Sequence
  chemically synthesized
atcatagattttccagaacc

SEQ ID NO: 132683 - DNA, 20 bp, Artificial Sequence
  chemically synthesized
ttgtttcatcatagattttc

SEQ ID NO: 132684 - DNA, 20 bp, Artificial Sequence
  chemically synthesized
gactgtgtcttgtttcatca

SEQ ID NO: 132685 - DNA, 20 bp, Artificial Sequence
  chemically synthesized
tggaaaatctatgatgaaac

SEQ ID NO: 132686 - DNA, 20 bp, Artificial Sequence
  chemically synthesized
atctatgatgaaacaagaca

SEQ ID NO: 132687 - DNA, 20 bp, Artificial Sequence
  chemically synthesized
tatttggctgcatgagagca

SEQ ID NO: 132688 - DNA, 20 bp, Artificial Sequence
  chemically synthesized
atatttggctgcatgagagc

SEQ ID NO: 132689 - DNA, 20 bp, Artificial Sequence
  chemically synthesized
aatatttggctgcatgagag

SEQ ID NO: 132690 - DNA, 20 bp, Artificial Sequence
  chemically synthesized
acacagtccctgctctcatg

SEQ ID NO: 132691 - DNA, 20 bp, Artificial Sequence
  chemically synthesized
aaaaatatttggctgcatga

SEQ ID NO: 132692 - DNA, 20 bp, Artificial Sequence
  chemically synthesized
agaaaaatatttggctgcat

SEQ ID NO: 132693 - DNA, 20 bp, Artificial Sequence
  chemically synthesized
gtacaaaggagaaaaatatt

SEQ ID NO: 132694 - DNA, 20 bp, Artificial Sequence
  chemically synthesized
agaaaaatgaaagtacaaag

SEQ ID NO: 132695 - DNA, 20 bp, Artificial Sequence
  chemically synthesized
aaagaaaaatgaaagtacaa

SEQ ID NO: 132696 - DNA, 20 bp, Artificial Sequence
  chemically synthesized
caaagaaaaatgaaagtaca

SEQ ID NO: 132697 - DNA, 20 bp, Artificial Sequence
  chemically synthesized
gtacaagcaaagaaaaatga

SEQ ID NO: 132698 - DNA, 20 bp, Artificial Sequence
  chemically synthesized
ataaattagaggtacaagca

SEQ ID NO: 132699 - DNA, 20 bp, Artificial Sequence
  chemically synthesized
aaagcataaattagaggtac

SEQ ID NO: 132700 - DNA, 20 bp, Artificial Sequence
  chemically synthesized
ggatataaagcataaattag

SEQ ID NO: 132701 - DNA, 20 bp, Artificial Sequence
  chemically synthesized
tggatataaagcataaatta

SEQ ID NO: 132702 - DNA, 20 bp, Artificial Sequence
  chemically synthesized
cttggatataaagcataaat

SEQ ID NO: 132703 - DNA, 20 bp, Artificial Sequence
  chemically synthesized
ctaatttatgctttatatcc

SEQ ID NO: 132704 - DNA, 20 bp, Artificial Sequence
  chemically synthesized
ccaacaataacttggatata

SEQ ID NO: 132705 - DNA, 20 bp, Artificial Sequence
  chemically synthesized
aatgtgtaccaacaataact

SEQ ID NO: 132706 - DNA, 20 bp, Artificial Sequence
  chemically synthesized
ctttatatccaagttattgt

SEQ ID NO: 132707 - DNA, 20 bp, Artificial Sequence
  chemically synthesized
ggtacacatttgtctttccc

SEQ ID NO: 132708 - DNA, 20 bp, Artificial Sequence
  chemically synthesized
agaagttgataatctaggga

SEQ ID NO: 132709 - DNA, 20 bp, Artificial Sequence
  chemically synthesized
ctaaagaagttgataatcta

SEQ ID NO: 132710 - DNA, 20 bp, Artificial Sequence
  chemically synthesized
tctaaagaagttgataatct

SEQ ID NO: 132711 - DNA, 20 bp, Artificial Sequence
  chemically synthesized
ttctaaagaagttgataatc

SEQ ID NO: 132712 - DNA, 20 bp, Artificial Sequence
  chemically synthesized
ccctagattatcaacttctt

SEQ ID NO: 132713 - DNA, 20 bp, Artificial Sequence
  chemically synthesized
atgttaatcattttctaaag

SEQ ID NO: 132714 - DNA, 20 bp, Artificial Sequence
  chemically synthesized
aaaatgttaatcattttcta

SEQ ID NO: 132715 - DNA, 20 bp, Artificial Sequence
  chemically synthesized
gaaaagggatttataaaagt

SEQ ID NO: 132716 - DNA, 20 bp, Artificial Sequence
  chemically synthesized
attggaaaagggatttataa

SEQ ID NO: 132717 - DNA, 20 bp, Artificial Sequence
  chemically synthesized
ctttagtgaccattggaaaa

SEQ ID NO: 132718 - DNA, 20 bp, Artificial Sequence
  chemically synthesized
tttataaatcccttttccaa

SEQ ID NO: 132719 - DNA, 20 bp, Artificial Sequence
  chemically synthesized
actttagtgaccattggaaa

SEQ ID NO: 132720 - DNA, 20 bp, Artificial Sequence
  chemically synthesized
tactttagtgaccattggaa

SEQ ID NO: 132721 - DNA, 20 bp, Artificial Sequence
  chemically synthesized
aataatactttagtgaccat

SEQ ID NO: 132722 - DNA, 20 bp, Artificial Sequence
  chemically synthesized
cccttttccaatggtcacta

SEQ ID NO: 132723 - DNA, 20 bp, Artificial Sequence
  chemically synthesized
tacttcatttaataatactt

SEQ ID NO: 132724 - DNA, 20 bp, Artificial Sequence
  chemically synthesized
cactaaagtattattaaatg

SEQ ID NO: 132725 - DNA, 20 bp, Artificial Sequence
  chemically synthesized
agtaatgaacaatgaataaa

SEQ ID NO: 132726 - DNA, 20 bp, Artificial Sequence
  chemically synthesized
atgaacaatgaataaacgga

SEQ ID NO: 132727 - DNA, 20 bp, Artificial Sequence
  chemically synthesized
tgaataaacggatggatgta

SEQ ID NO: 132728 - DNA, 20 bp, Artificial Sequence
  chemically synthesized
aataaacggatggatgtaca

SEQ ID NO: 132729 - DNA, 20 bp, Artificial Sequence
  chemically synthesized
tggatgtacagagcgataaa

SEQ ID NO: 132730 - DNA, 20 bp, Artificial Sequence
  chemically synthesized
attttatgaacaatgtatga

SEQ ID NO: 132731 - DNA, 20 bp, Artificial Sequence
  chemically synthesized
tattttatgaacaatgtatg

SEQ ID NO: 132732 - DNA, 20 bp, Artificial Sequence
  chemically synthesized
ataggatatatgtgtcatag

SEQ ID NO: 132733 - DNA, 20 bp, Artificial Sequence
  chemically synthesized
agataggatatatgtgtcat

SEQ ID NO: 132734 - DNA, 20 bp, Artificial Sequence
  chemically synthesized
tagataggatatatgtgtca

SEQ ID NO: 132735 - DNA, 20 bp, Artificial Sequence
  chemically synthesized
aaattagtataatattagat

SEQ ID NO: 132736 - DNA, 20 bp, Artificial Sequence
  chemically synthesized
aaaattagtataatattaga

SEQ ID NO: 132737 - DNA, 20 bp, Artificial Sequence
  chemically synthesized
aagtaaaattagtataatat

SEQ ID NO: 132738 - DNA, 20 bp, Artificial Sequence
  chemically synthesized
ttaggtagaaaaagtaaaat

SEQ ID NO: 132739 - DNA, 20 bp, Artificial Sequence
  chemically synthesized
tgtttattattaggtagaaa

SEQ ID NO: 132740 - DNA, 20 bp, Artificial Sequence
  chemically synthesized
ttacagtgtttattattagg

SEQ ID NO: 132741 - DNA, 20 bp, Artificial Sequence
  chemically synthesized
tcattacagtgtttattatt

SEQ ID NO: 132742 - DNA, 20 bp, Artificial Sequence
  chemically synthesized
ttcattacagtgtttattat

SEQ ID NO: 132743 - DNA, 20 bp, Artificial Sequence
  chemically synthesized
aataataaacactgtaatga

SEQ ID NO: 132744 - DNA, 20 bp, Artificial Sequence
  chemically synthesized
tgatacagcctctttcatta

SEQ ID NO: 132745 - DNA, 20 bp, Artificial Sequence
  chemically synthesized
taataaacactgtaatgaaa

SEQ ID NO: 132746 - DNA, 20 bp, Artificial Sequence
  chemically synthesized
aataaacactgtaatgaaag

SEQ ID NO: 132747 - DNA, 20 bp, Artificial Sequence
  chemically synthesized
taatgaaagaggctgtatca

SEQ ID NO: 132748 - DNA, 20 bp, Artificial Sequence
  chemically synthesized
gttccaaggaaaccatgata

SEQ ID NO: 132749 - DNA, 20 bp, Artificial Sequence
  chemically synthesized
aggctgtatcatggtttcct

SEQ ID NO: 132750 - DNA, 20 bp, Artificial Sequence
  chemically synthesized
aggaattatgtggtgttcca

SEQ ID NO: 132751 - DNA, 20 bp, Artificial Sequence
  chemically synthesized
taggaattatgtggtgttcc

SEQ ID NO: 132752 - DNA, 20 bp, Artificial Sequence
  chemically synthesized
tattggggctaggaattatg

SEQ ID NO: 132753 - DNA, 20 bp, Artificial Sequence
  chemically synthesized
ttggaacaccacataattcc

SEQ ID NO: 132754 - DNA, 20 bp, Artificial Sequence
  chemically synthesized
gtgtgcaaggtattggggct

SEQ ID NO: 132755 - DNA, 20 bp, Artificial Sequence
  chemically synthesized
agtgtgcaaggtattggggc

SEQ ID NO: 132756 - DNA, 20 bp, Artificial Sequence
  chemically synthesized
ttacagtgtgcaaggtattg

SEQ ID NO: 132757 - DNA, 20 bp, Artificial Sequence
  chemically synthesized
cttacagtgtgcaaggtatt

SEQ ID NO: 132758 - DNA, 20 bp, Artificial Sequence
  chemically synthesized
gcttacagtgtgcaaggtat

SEQ ID NO: 132759 - DNA, 20 bp, Artificial Sequence
  chemically synthesized
ttatgtgcttacagtgtgca

SEQ ID NO: 132760 - DNA, 20 bp, Artificial Sequence
  chemically synthesized
attatgtgcttacagtgtgc

SEQ ID NO: 132761 - DNA, 20 bp, Artificial Sequence
  chemically synthesized
cccaataccttgcacactgt

SEQ ID NO: 132762 - DNA, 20 bp, Artificial Sequence
  chemically synthesized
aaatgttgattatgtgctta

SEQ ID NO: 132763 - DNA, 20 bp, Artificial Sequence
  chemically synthesized
gaatgtgtgaatatactttt

SEQ ID NO: 132764 - DNA, 20 bp, Artificial Sequence
  chemically synthesized
tataagtttaaaatactgaa

SEQ ID NO: 132765 - DNA, 20 bp, Artificial Sequence
  chemically synthesized
attatgtgaaggaaaaatat

SEQ ID NO: 132766 - DNA, 20 bp, Artificial Sequence
  chemically synthesized
ttagtatttaaattatgtga

SEQ ID NO: 132767 - DNA, 20 bp, Artificial Sequence
  chemically synthesized
attagtatttaaattatgtg

SEQ ID NO: 132768 - DNA, 20 bp, Artificial Sequence
  chemically synthesized
ttatacttaataatttgcat

SEQ ID NO: 132769 - DNA, 20 bp, Artificial Sequence
  chemically synthesized
aaatactaatgcaaattatt

SEQ ID NO: 132770 - DNA, 20 bp, Artificial Sequence
  chemically synthesized
aaattattaagtataaaaat

SEQ ID NO: 132771 - DNA, 20 bp, Artificial Sequence
  chemically synthesized
aattattaagtataaaaatt

SEQ ID NO: 132772 - DNA, 20 bp, Artificial Sequence
  chemically synthesized
attattaagtataaaaatta

SEQ ID NO: 132773 - DNA, 20 bp, Artificial Sequence
  chemically synthesized
ttaagtataaaaattagggc

SEQ ID NO: 132774 - DNA, 20 bp, Artificial Sequence
  chemically synthesized
ggcaagttgcaaatataatt

SEQ ID NO: 132775 - DNA, 20 bp, Artificial Sequence
  chemically synthesized
ttgcaaatataattcagtca

SEQ ID NO: 132776 - DNA, 20 bp, Artificial Sequence
  chemically synthesized
tataattcagtcacagcctc

SEQ ID NO: 132777 - DNA, 20 bp, Artificial Sequence
  chemically synthesized
ataattcagtcacagcctcc

SEQ ID NO: 132778 - DNA, 20 bp, Artificial Sequence
  chemically synthesized
ttattttattcatttcccgg

SEQ ID NO: 132779 - DNA, 20 bp, Artificial Sequence
  chemically synthesized
attattttattcatttcccg

SEQ ID NO: 132780 - DNA, 20 bp, Artificial Sequence
  chemically synthesized
agattattttattcatttcc

SEQ ID NO: 132781 - DNA, 20 bp, Artificial Sequence
  chemically synthesized
tgaataaaataatctcactc

SEQ ID NO: 132782 - DNA, 20 bp, Artificial Sequence
  chemically synthesized
gaataaaataatctcactct

SEQ ID NO: 132783 - DNA, 20 bp, Artificial Sequence
  chemically synthesized
caaagaaatcaacctagagt

SEQ ID NO: 132784 - DNA, 20 bp, Artificial Sequence
  chemically synthesized
tacacaaagaaatcaaccta

SEQ ID NO: 132785 - DNA, 20 bp, Artificial Sequence
  chemically synthesized
tttacacaaagaaatcaacc

SEQ ID NO: 132786 - DNA, 20 bp, Artificial Sequence
  chemically synthesized
gtaaggatctaatttacaca

SEQ ID NO: 132787 - DNA, 20 bp, Artificial Sequence
  chemically synthesized
gttgatttctttgtgtaaat

SEQ ID NO: 132788 - DNA, 20 bp, Artificial Sequence
  chemically synthesized
aagtctgcaaatatttagta

SEQ ID NO: 132789 - DNA, 20 bp, Artificial Sequence
  chemically synthesized
taagtctgcaaatatttagt

SEQ ID NO: 132790 - DNA, 20 bp, Artificial Sequence
  chemically synthesized
tgtgtaagtctgcaaatatt

SEQ ID NO: 132791 - DNA, 20 bp, Artificial Sequence
  chemically synthesized
agatccttactaaatatttg

SEQ ID NO: 132792 - DNA, 20 bp, Artificial Sequence
  chemically synthesized
acttttttttataaatgtgt

SEQ ID NO: 132793 - DNA, 20 bp, Artificial Sequence
  chemically synthesized
acttacacatttataaaaaa

SEQ ID NO: 132794 - DNA, 20 bp, Artificial Sequence
  chemically synthesized
catttataaaaaaaagtcat

SEQ ID NO: 132795 - DNA, 20 bp, Artificial Sequence
  chemically synthesized
ctaatagagacagaatagat

SEQ ID NO: 132796 - DNA, 20 bp, Artificial Sequence
  chemically synthesized
cttttctaatagagacagaa

SEQ ID NO: 132797 - DNA, 20 bp, Artificial Sequence
  chemically synthesized
ctcatctattctgtctctat

SEQ ID NO: 132798 - DNA, 20 bp, Artificial Sequence
  chemically synthesized
tgacccttttctaatagaga

SEQ ID NO: 132799 - DNA, 20 bp, Artificial Sequence
  chemically synthesized
agattgacccttttctaata

SEQ ID NO: 132800 - DNA, 20 bp, Artificial Sequence
  chemically synthesized
ctattctgtctctattagaa

SEQ ID NO: 132801 - DNA, 20 bp, Artificial Sequence
  chemically synthesized
tattctgtctctattagaaa

SEQ ID NO: 132802 - DNA, 20 bp, Artificial Sequence
  chemically synthesized
atagattgacccttttctaa

SEQ ID NO: 132803 - DNA, 20 bp, Artificial Sequence
  chemically synthesized
attctgtctctattagaaaa

SEQ ID NO: 132804 - DNA, 20 bp, Artificial Sequence
  chemically synthesized
ttatggcagcaaattaaaca

SEQ ID NO: 132805 - DNA, 20 bp, Artificial Sequence
  chemically synthesized
tatgtttaatttgctgccat

SEQ ID NO: 132806 - DNA, 20 bp, Artificial Sequence
  chemically synthesized
tttcaccttcaagcttatgg

SEQ ID NO: 132807 - DNA, 20 bp, Artificial Sequence
  chemically synthesized
aattttcaccttcaagctta

SEQ ID NO: 132808 - DNA, 20 bp, Artificial Sequence
  chemically synthesized
aatttgctgccataagcttg

SEQ ID NO: 132809 - DNA, 20 bp, Artificial Sequence
  chemically synthesized
atttgctgccataagcttga

SEQ ID NO: 132810 - DNA, 20 bp, Artificial Sequence
  chemically synthesized
ctaaataaattttcaccttc

SEQ ID NO: 132811 - DNA, 20 bp, Artificial Sequence
  chemically synthesized
cttgaaggtgaaaatttatt

SEQ ID NO: 132812 - DNA, 20 bp, Artificial Sequence
  chemically synthesized
ttgaaggtgaaaatttattt

SEQ ID NO: 132813 - DNA, 20 bp, Artificial Sequence
  chemically synthesized
aaggtgaaaatttatttagg

SEQ ID NO: 132814 - DNA, 20 bp, Artificial Sequence
  chemically synthesized
agcatttgatgactgttttc

SEQ ID NO: 132815 - DNA, 20 bp, Artificial Sequence
  chemically synthesized
gcatttgatgactgttttct

SEQ ID NO: 132816 - DNA, 20 bp, Artificial Sequence
  chemically synthesized
taagaacagtacctagaaaa

SEQ ID NO: 132817 - DNA, 20 bp, Artificial Sequence
  chemically synthesized
cctagattaagaacagtacc

SEQ ID NO: 132818 - DNA, 20 bp, Artificial Sequence
  chemically synthesized
taacatacctagattaagaa

SEQ ID NO: 132819 - DNA, 20 bp, Artificial Sequence
  chemically synthesized
tctaggtactgttcttaatc

SEQ ID NO: 132820 - DNA, 20 bp, Artificial Sequence
  chemically synthesized
ctaggtactgttcttaatct

SEQ ID NO: 132821 - DNA, 20 bp, Artificial Sequence
  chemically synthesized
tcccttaacatacctagatt

SEQ ID NO: 132822 - DNA, 20 bp, Artificial Sequence
  chemically synthesized
gcaccatcccttaacatacc

SEQ ID NO: 132823 - DNA, 20 bp, Artificial Sequence
  chemically synthesized
gttcttaatctaggtatgtt

SEQ ID NO: 132824 - DNA, 20 bp, Artificial Sequence
  chemically synthesized
ttcttaatctaggtatgtta

SEQ ID NO: 132825 - DNA, 20 bp, Artificial Sequence
  chemically synthesized
tcttaatctaggtatgttaa

SEQ ID NO: 132826 - DNA, 20 bp, Artificial Sequence
  chemically synthesized
aatctaggtatgttaaggga

SEQ ID NO: 132827 - DNA, 20 bp, Artificial Sequence
  chemically synthesized
aagggatggtgcctatcctt

SEQ ID NO: 132828 - DNA, 20 bp, Artificial Sequence
  chemically synthesized
gttgtgagcaacttaaggat

SEQ ID NO: 132829 - DNA, 20 bp, Artificial Sequence
  chemically synthesized
agttgtgagcaacttaagga

SEQ ID NO: 132830 - DNA, 20 bp, Artificial Sequence
  chemically synthesized
tataagttgtgagcaactta

SEQ ID NO: 132831 - DNA, 20 bp, Artificial Sequence
  chemically synthesized
atataagttgtgagcaactt

SEQ ID NO: 132832 - DNA, 20 bp, Artificial Sequence
  chemically synthesized
ttatctctcatataagttgt

SEQ ID NO: 132833 - DNA, 20 bp, Artificial Sequence
  chemically synthesized
aagttgctcacaacttatat

SEQ ID NO: 132834 - DNA, 20 bp, Artificial Sequence
  chemically synthesized
gttgctcacaacttatatga

SEQ ID NO: 132835 - DNA, 20 bp, Artificial Sequence
  chemically synthesized
tccaaatttatctctcatat

SEQ ID NO: 132836 - DNA, 20 bp, Artificial Sequence
  chemically synthesized
acttatatgagagataaatt

SEQ ID NO: 132837 - DNA, 20 bp, Artificial Sequence
  chemically synthesized
aaatccttcaatatgtacag

SEQ ID NO: 132838 - DNA, 20 bp, Artificial Sequence
  chemically synthesized
aataaatccttcaatatgta

SEQ ID NO: 132839 - DNA, 20 bp, Artificial Sequence
  chemically synthesized
attcactgctgtacatattg

SEQ ID NO: 132840 - DNA, 20 bp, Artificial Sequence
  chemically synthesized
ttcactgctgtacatattga

SEQ ID NO: 132841 - DNA, 20 bp, Artificial Sequence
  chemically synthesized
tatgtccatatgtgatttgg

SEQ ID NO: 132842 - DNA, 20 bp, Artificial Sequence
  chemically synthesized
aattatgtccatatgtgatt

SEQ ID NO: 132843 - DNA, 20 bp, Artificial Sequence
  chemically synthesized
aaattctaccaaatcacata

SEQ ID NO: 132844 - DNA, 20 bp, Artificial Sequence
  chemically synthesized
cactgtgctaataacacaag

SEQ ID NO: 132845 - DNA, 20 bp, Artificial Sequence
  chemically synthesized
atttaatcttcttgtgttat

SEQ ID NO: 132846 - DNA, 20 bp, Artificial Sequence
  chemically synthesized
gtgcactgtgctaataacac

SEQ ID NO: 132847 - DNA, 20 bp, Artificial Sequence
  chemically synthesized
atcttcttgtgttattagca

SEQ ID NO: 132848 - DNA, 20 bp, Artificial Sequence
  chemically synthesized
aattagattcttcagtatat

SEQ ID NO: 132849 - DNA, 20 bp, Artificial Sequence
  chemically synthesized
cacagtgcactgatatactg

SEQ ID NO: 132850 - DNA, 20 bp, Artificial Sequence
  chemically synthesized
cattgaaaaattagattctt

SEQ ID NO: 132851 - DNA, 20 bp, Artificial Sequence
  chemically synthesized
tccttatttcattgaaaaat

SEQ ID NO: 132852 - DNA, 20 bp, Artificial Sequence
  chemically synthesized
atctaatttttcaatgaaat

SEQ ID NO: 132853 - DNA, 20 bp, Artificial Sequence
  chemically synthesized
tctaatttttcaatgaaata

SEQ ID NO: 132854 - DNA, 20 bp, Artificial Sequence
  chemically synthesized
aaataaggatctgtccaatt

SEQ ID NO: 132855 - DNA, 20 bp, Artificial Sequence
  chemically synthesized
ttttagtatgctaaattgga

SEQ ID NO: 132856 - DNA, 20 bp, Artificial Sequence
  chemically synthesized
tctattttagtatgctaaat

SEQ ID NO: 132857 - DNA, 20 bp, Artificial Sequence
  chemically synthesized
tccaatttagcatactaaaa

SEQ ID NO: 132858 - DNA, 20 bp, Artificial Sequence
  chemically synthesized
ataaaattgttattctattt

SEQ ID NO: 132859 - DNA, 20 bp, Artificial Sequence
  chemically synthesized
tattaattttcatttcaaat

SEQ ID NO: 132860 - DNA, 20 bp, Artificial Sequence
  chemically synthesized
cagcattattatattatctt

SEQ ID NO: 132861 - DNA, 20 bp, Artificial Sequence
  chemically synthesized
atacaaataaagggaatctt

SEQ ID NO: 132862 - DNA, 20 bp, Artificial Sequence
  chemically synthesized
ccttaaggaatacaaataaa

SEQ ID NO: 132863 - DNA, 20 bp, Artificial Sequence
  chemically synthesized
tccttaaggaatacaaataa

SEQ ID NO: 132864 - DNA, 20 bp, Artificial Sequence
  chemically synthesized
atccttaaggaatacaaata

SEQ ID NO: 132865 - DNA, 20 bp, Artificial Sequence
  chemically synthesized
tccctttatttgtattcctt

SEQ ID NO: 132866 - DNA, 20 bp, Artificial Sequence
  chemically synthesized
ccctttatttgtattcctta

SEQ ID NO: 132867 - DNA, 20 bp, Artificial Sequence
  chemically synthesized
aaccagaattggcatcctta

SEQ ID NO: 132868 - DNA, 20 bp, Artificial Sequence
  chemically synthesized
aaaccagaattggcatcctt

SEQ ID NO: 132869 - DNA, 20 bp, Artificial Sequence
  chemically synthesized
ttccttaaggatgccaattc

SEQ ID NO: 132870 - DNA, 20 bp, Artificial Sequence
  chemically synthesized
tgattttgtaaaaccagaat

SEQ ID NO: 132871 - DNA, 20 bp, Artificial Sequence
  chemically synthesized
taaagttgattttgtaaaac

SEQ ID NO: 132872 - DNA, 20 bp, Artificial Sequence
  chemically synthesized
acaaaaaagtattgaatata

SEQ ID NO: 132873 - DNA, 20 bp, Artificial Sequence
  chemically synthesized
gttgtctagttcagacaaaa

SEQ ID NO: 132874 - DNA, 20 bp, Artificial Sequence
  chemically synthesized
caatacttttttgtctgaac

SEQ ID NO: 132875 - DNA, 20 bp, Artificial Sequence
  chemically synthesized
atgtatacagttgtctagtt

SEQ ID NO: 132876 - DNA, 20 bp, Artificial Sequence
  chemically synthesized
ggcatatgtatacagttgtc

SEQ ID NO: 132877 - DNA, 20 bp, Artificial Sequence
  chemically synthesized
aaatacttggcatatgtata

SEQ ID NO: 132878 - DNA, 20 bp, Artificial Sequence
  chemically synthesized
gacaactgtatacatatgcc

SEQ ID NO: 132879 - DNA, 20 bp, Artificial Sequence
  chemically synthesized
tatacatatgccaagtattt

SEQ ID NO: 132880 - DNA, 20 bp, Artificial Sequence
  chemically synthesized
atttcatcctctaaaatact

SEQ ID NO: 132881 - DNA, 20 bp, Artificial Sequence
  chemically synthesized
tacatatgccaagtatttta

SEQ ID NO: 132882 - DNA, 20 bp, Artificial Sequence
  chemically synthesized
acatatgccaagtattttag

SEQ ID NO: 132883 - DNA, 20 bp, Artificial Sequence
  chemically synthesized
tagaggatgaaattttcaat

SEQ ID NO: 132884 - DNA, 20 bp, Artificial Sequence
  chemically synthesized
ttcatcatgagtataggagt

SEQ ID NO: 132885 - DNA, 20 bp, Artificial Sequence
  chemically synthesized
agtcttcatcatgagtatag

SEQ ID NO: 132886 - DNA, 20 bp, Artificial Sequence
  chemically synthesized
acagtcttcatcatgagtat

SEQ ID NO: 132887 - DNA, 20 bp, Artificial Sequence
  chemically synthesized
aacagtcttcatcatgagta

SEQ ID NO: 132888 - DNA, 20 bp, Artificial Sequence
  chemically synthesized
tgactcctatactcatgatg

SEQ ID NO: 132889 - DNA, 20 bp, Artificial Sequence
  chemically synthesized
tatgtaacagtcttcatcat

SEQ ID NO: 132890 - DNA, 20 bp, Artificial Sequence
  chemically synthesized
ttgacatagaaattatgtaa

SEQ ID NO: 132891 - DNA, 20 bp, Artificial Sequence
  chemically synthesized
ctttaaatatgtttttgaca

SEQ ID NO: 132892 - DNA, 20 bp, Artificial Sequence
  chemically synthesized
ctatgtcaaaaacatattta

SEQ ID NO: 132893 - DNA, 20 bp, Artificial Sequence
  chemically synthesized
gctatatggccattcaaaac

SEQ ID NO: 132894 - DNA, 20 bp, Artificial Sequence
  chemically synthesized
taaagtttacctgttttgaa

SEQ ID NO: 132895 - DNA, 20 bp, Artificial Sequence
  chemically synthesized
agctatatggccattcaaaa

SEQ ID NO: 132896 - DNA, 20 bp, Artificial Sequence
  chemically synthesized
acctgttttgaatggccata

SEQ ID NO: 132897 - DNA, 20 bp, Artificial Sequence
  chemically synthesized
atatacgtcaacaagctata

SEQ ID NO: 132898 - DNA, 20 bp, Artificial Sequence
  chemically synthesized
ttctaaatatatacgtcaac

SEQ ID NO: 132899 - DNA, 20 bp, Artificial Sequence
  chemically synthesized
agcttgttgacgtatatatt

SEQ ID NO: 132900 - DNA, 20 bp, Artificial Sequence
  chemically synthesized
ttgacgtatatatttagaat

SEQ ID NO: 132901 - DNA, 20 bp, Artificial Sequence
  chemically synthesized
tgacgtatatatttagaatc

SEQ ID NO: 132902 - DNA, 20 bp, Artificial Sequence
  chemically synthesized
attatcaatattattaaatt

SEQ ID NO: 132903 - DNA, 20 bp, Artificial Sequence
  chemically synthesized
ttatcaatattattaaatta

SEQ ID NO: 132904 - DNA, 20 bp, Artificial Sequence
  chemically synthesized
tattaaattaaggaactccg

SEQ ID NO: 132905 - DNA, 20 bp, Artificial Sequence
  chemically synthesized
atctacgatagggcacttcg

SEQ ID NO: 132906 - DNA, 20 bp, Artificial Sequence
  chemically synthesized
aaatctacgatagggcactt

SEQ ID NO: 132907 - DNA, 20 bp, Artificial Sequence
  chemically synthesized
aactccgaagtgccctatcg

SEQ ID NO: 132908 - DNA, 20 bp, Artificial Sequence
  chemically synthesized
aagtaccaaaatctacgata

SEQ ID NO: 132909 - DNA, 20 bp, Artificial Sequence
  chemically synthesized
taagtaccaaaatctacgat

SEQ ID NO: 132910 - DNA, 20 bp, Artificial Sequence
  chemically synthesized
gtaagtaccaaaatctacga

SEQ ID NO: 132911 - DNA, 20 bp, Artificial Sequence
  chemically synthesized
aagtgccctatcgtagattt

SEQ ID NO: 132912 - DNA, 20 bp, Artificial Sequence
  chemically synthesized
ccataatactttgcatcagt

SEQ ID NO: 132913 - DNA, 20 bp, Artificial Sequence
  chemically synthesized
ttttggtacttactgatgca

SEQ ID NO: 132914 - DNA, 20 bp, Artificial Sequence
  chemically synthesized
ctgtccataatactttgcat

SEQ ID NO: 132915 - DNA, 20 bp, Artificial Sequence
  chemically synthesized
cttactgatgcaaagtatta

SEQ ID NO: 132916 - DNA, 20 bp, Artificial Sequence
  chemically synthesized
ctgatgcaaagtattatgga

SEQ ID NO: 132917 - DNA, 20 bp, Artificial Sequence
  chemically synthesized
gcaaagtattatggacagcc

SEQ ID NO: 132918 - DNA, 20 bp, Artificial Sequence
  chemically synthesized
gtattatggacagcctggtt

SEQ ID NO: 132919 - DNA, 20 bp, Artificial Sequence
  chemically synthesized
acaaattttaggacttaacc

SEQ ID NO: 132920 - DNA, 20 bp, Artificial Sequence
  chemically synthesized
tacaaattttaggacttaac

SEQ ID NO: 132921 - DNA, 20 bp, Artificial Sequence
  chemically synthesized
taacgaattttacaaatttt

SEQ ID NO: 132922 - DNA, 20 bp, Artificial Sequence
  chemically synthesized
gtaacgaattttacaaattt

SEQ ID NO: 132923 - DNA, 20 bp, Artificial Sequence
  chemically synthesized
gactttacacttcattaagt

SEQ ID NO: 132924 - DNA, 20 bp, Artificial Sequence
  chemically synthesized
aattcgttacctacttaatg

SEQ ID NO: 132925 - DNA, 20 bp, Artificial Sequence
  chemically synthesized
tgactttacacttcattaag

SEQ ID NO: 132926 - DNA, 20 bp, Artificial Sequence
  chemically synthesized
cattgactttacacttcatt

SEQ ID NO: 132927 - DNA, 20 bp, Artificial Sequence
  chemically synthesized
tacctacttaatgaagtgta

SEQ ID NO: 132928 - DNA, 20 bp, Artificial Sequence
  chemically synthesized
agtcaatgaatgtgctgctt

SEQ ID NO: 132929 - DNA, 20 bp, Artificial Sequence
  chemically synthesized
atgtgttgtgatcactaaag

SEQ ID NO: 132930 - DNA, 20 bp, Artificial Sequence
  chemically synthesized
agaatgtgttgtgatcacta

SEQ ID NO: 132931 - DNA, 20 bp, Artificial Sequence
  chemically synthesized
gtgatcacaacacattctgt

SEQ ID NO: 132932 - DNA, 20 bp, Artificial Sequence
  chemically synthesized
tatcaacatgtggcaactaa

SEQ ID NO: 132933 - DNA, 20 bp, Artificial Sequence
  chemically synthesized
gtagaataaatatcaacatg

SEQ ID NO: 132934 - DNA, 20 bp, Artificial Sequence
  chemically synthesized
gatatttattctacttctcc

SEQ ID NO: 132935 - DNA, 20 bp, Artificial Sequence
  chemically synthesized
cctgttgtccctaggagaag

SEQ ID NO: 132936 - DNA, 20 bp, Artificial Sequence
  chemically synthesized
atatttattctacttctcct

SEQ ID NO: 132937 - DNA, 20 bp, Artificial Sequence
  chemically synthesized
tatttattctacttctccta

SEQ ID NO: 132938 - DNA, 20 bp, Artificial Sequence
  chemically synthesized
taacctgttgtccctaggag

SEQ ID NO: 132939 - DNA, 20 bp, Artificial Sequence
  chemically synthesized
aagtaacctgttgtccctag

SEQ ID NO: 132940 - DNA, 20 bp, Artificial Sequence
  chemically synthesized
ctaagtaacctgttgtccct

SEQ ID NO: 132941 - DNA, 20 bp, Artificial Sequence
  chemically synthesized
tctacttctcctagggacaa

SEQ ID NO: 132942 - DNA, 20 bp, Artificial Sequence
  chemically synthesized
actaagtaacctgttgtccc

SEQ ID NO: 132943 - DNA, 20 bp, Artificial Sequence
  chemically synthesized
ctacttctcctagggacaac

SEQ ID NO: 132944 - DNA, 20 bp, Artificial Sequence
  chemically synthesized
cctagggacaacaggttact

SEQ ID NO: 132945 - DNA, 20 bp, Artificial Sequence
  chemically synthesized
tacatataaagtgtttgact

SEQ ID NO: 132946 - DNA, 20 bp, Artificial Sequence
  chemically synthesized
taagtaacctgttacatata

SEQ ID NO: 132947 - DNA, 20 bp, Artificial Sequence
  chemically synthesized
gtcaaacactttatatgtaa

SEQ ID NO: 132948 - DNA, 20 bp, Artificial Sequence
  chemically synthesized
tcaaacactttatatgtaac

SEQ ID NO: 132949 - DNA, 20 bp, Artificial Sequence
  chemically synthesized
tttatatgtaacaggttact

SEQ ID NO: 132950 - DNA, 20 bp, Artificial Sequence
  chemically synthesized
tataaacaaagtgtatgact

SEQ ID NO: 132951 - DNA, 20 bp, Artificial Sequence
  chemically synthesized
gaatttgcattatataaaca

SEQ ID NO: 132952 - DNA, 20 bp, Artificial Sequence
  chemically synthesized
acttaagacaaaatgggaat

SEQ ID NO: 132953 - DNA, 20 bp, Artificial Sequence
  chemically synthesized
gttataacttaagacaaaat

SEQ ID NO: 132954 - DNA, 20 bp, Artificial Sequence
  chemically synthesized
tgttataacttaagacaaaa

SEQ ID NO: 132955 - DNA, 20 bp, Artificial Sequence
  chemically synthesized
tctcattcccattttgtctt

SEQ ID NO: 132956 - DNA, 20 bp, Artificial Sequence
  chemically synthesized
aaaatgttatgttataactt

SEQ ID NO: 132957 - DNA, 20 bp, Artificial Sequence
  chemically synthesized
ttataacataacattttaat

SEQ ID NO: 132958 - DNA, 20 bp, Artificial Sequence
  chemically synthesized
atgttttttgagagggtaca

SEQ ID NO: 132959 - DNA, 20 bp, Artificial Sequence
  chemically synthesized
tgatgttttttgagagggta

SEQ ID NO: 132960 - DNA, 20 bp, Artificial Sequence
  chemically synthesized
taccatgatgttttttgaga

SEQ ID NO: 132961 - DNA, 20 bp, Artificial Sequence
  chemically synthesized
ttaccatgatgttttttgag

SEQ ID NO: 132962 - DNA, 20 bp, Artificial Sequence
  chemically synthesized
attaccatgatgttttttga

SEQ ID NO: 132963 - DNA, 20 bp, Artificial Sequence
  chemically synthesized
ttattaccatgatgtttttt

SEQ ID NO: 132964 - DNA, 20 bp, Artificial Sequence
  chemically synthesized
taccctctcaaaaaacatca

SEQ ID NO: 132965 - DNA, 20 bp, Artificial Sequence
  chemically synthesized
tcaaaaaacatcatggtaat

SEQ ID NO: 132966 - DNA, 20 bp, Artificial Sequence
  chemically synthesized
aacatcatggtaataagaaa

SEQ ID NO: 132967 - DNA, 20 bp, Artificial Sequence
  chemically synthesized
tcatggtaataagaaaaaga

SEQ ID NO: 132968 - DNA, 20 bp, Artificial Sequence
  chemically synthesized
gaaagcaggaatttggatta

SEQ ID NO: 132969 - DNA, 20 bp, Artificial Sequence
  chemically synthesized
tgaaagcaggaatttggatt

SEQ ID NO: 132970 - DNA, 20 bp, Artificial Sequence
  chemically synthesized
ttgaaagcaggaatttggat

SEQ ID NO: 132971 - DNA, 20 bp, Artificial Sequence
  chemically synthesized
caatcttgaaagcaggaatt

SEQ ID NO: 132972 - DNA, 20 bp, Artificial Sequence
  chemically synthesized
taatccaaattcctgctttc

SEQ ID NO: 132973 - DNA, 20 bp, Artificial Sequence
  chemically synthesized
caacccccaatcttgaaagc

SEQ ID NO: 132974 - DNA, 20 bp, Artificial Sequence
  chemically synthesized
ccaacccccaatcttgaaag

SEQ ID NO: 132975 - DNA, 20 bp, Artificial Sequence
  chemically synthesized
caaattcctgctttcaagat

SEQ ID NO: 132976 - DNA, 20 bp, Artificial Sequence
  chemically synthesized
ccaccaacccccaatcttga

SEQ ID NO: 132977 - DNA, 20 bp, Artificial Sequence
  chemically synthesized
aaattcctgctttcaagatt

SEQ ID NO: 132978 - DNA, 20 bp, Artificial Sequence
  chemically synthesized
aattcctgctttcaagattg

SEQ ID NO: 132979 - DNA, 20 bp, Artificial Sequence
  chemically synthesized
attcctgctttcaagattgg

SEQ ID NO: 132980 - DNA, 20 bp, Artificial Sequence
  chemically synthesized
ctgctttcaagattgggggt

SEQ ID NO: 132981 - DNA, 20 bp, Artificial Sequence
  chemically synthesized
ctttcaagattgggggttgg

SEQ ID NO: 132982 - DNA, 20 bp, Artificial Sequence
  chemically synthesized
tttcaagattgggggttggt

SEQ ID NO: 132983 - DNA, 20 bp, Artificial Sequence
  chemically synthesized
ttcaagattgggggttggtg

SEQ ID NO: 132984 - DNA, 20 bp, Artificial Sequence
  chemically synthesized
tcaagattgggggttggtgg

SEQ ID NO: 132985 - DNA, 20 bp, Artificial Sequence
  chemically synthesized
caagattgggggttggtggg

SEQ ID NO: 132986 - DNA, 20 bp, Artificial Sequence
  chemically synthesized
aagattgggggttggtgggg

SEQ ID NO: 132987 - DNA, 20 bp, Artificial Sequence
  chemically synthesized
agattgggggttggtggggg

SEQ ID NO: 132988 - DNA, 20 bp, Artificial Sequence
  chemically synthesized
attgggggttggtggggggg

SEQ ID NO: 132989 - DNA, 20 bp, Artificial Sequence
  chemically synthesized
tcttaagaagttcagtttcg

SEQ ID NO: 132990 - DNA, 20 bp, Artificial Sequence
  chemically synthesized
gctcttaatcttaagaagtt

SEQ ID NO: 132991 - DNA, 20 bp, Artificial Sequence
  chemically synthesized
gctgcgaaactgaacttctt

SEQ ID NO: 132992 - DNA, 20 bp, Artificial Sequence
  chemically synthesized
ggccagctcttaatcttaag

SEQ ID NO: 132993 - DNA, 20 bp, Artificial Sequence
  chemically synthesized
aaactgaacttcttaagatt

SEQ ID NO: 132994 - DNA, 20 bp, Artificial Sequence
  chemically synthesized
cccggccagctcttaatctt

SEQ ID NO: 132995 - DNA, 20 bp, Artificial Sequence
  chemically synthesized
actgaacttcttaagattaa

SEQ ID NO: 132996 - DNA, 20 bp, Artificial Sequence
  chemically synthesized
aacttcttaagattaagagc

SEQ ID NO: 132997 - DNA, 20 bp, Artificial Sequence
  chemically synthesized
tcttaagattaagagctggc

SEQ ID NO: 132998 - DNA, 20 bp, Artificial Sequence
  chemically synthesized
cttaagattaagagctggcc

SEQ ID NO: 132999 - DNA, 20 bp, Artificial Sequence
  chemically synthesized
cgtgagccaccgcgcccggc

SEQ ID NO: 133000 - DNA, 20 bp, Artificial Sequence
  chemically synthesized
gattaagagctggccgggcg

SEQ ID NO: 133001 - DNA, 20 bp, Artificial Sequence
  chemically synthesized
taagagctggccgggcgcgg

SEQ ID NO: 133002 - DNA, 20 bp, Artificial Sequence
  chemically synthesized
caggcgtgagccaccgcgcc

SEQ ID NO: 133003 - DNA, 20 bp, Artificial Sequence
  chemically synthesized
agtgctgggattacaggcgt

SEQ ID NO: 133004 - DNA, 20 bp, Artificial Sequence
  chemically synthesized
gtggctcacgcctgtaatcc

SEQ ID NO: 133005 - DNA, 20 bp, Artificial Sequence
  chemically synthesized
tcccaaagtgctgggattac

SEQ ID NO: 133006 - DNA, 20 bp, Artificial Sequence
  chemically synthesized
ctcccaaagtgctgggatta

SEQ ID NO: 133007 - DNA, 20 bp, Artificial Sequence
  chemically synthesized
cgcctgtaatcccagcactt

SEQ ID NO: 133008 - DNA, 20 bp, Artificial Sequence
  chemically synthesized
tctcggcctcccaaagtgct

SEQ ID NO: 133009 - DNA, 20 bp, Artificial Sequence
  chemically synthesized
gcctgtaatcccagcacttt

SEQ ID NO: 133010 - DNA, 20 bp, Artificial Sequence
  chemically synthesized
gtctcggcctcccaaagtgc

SEQ ID NO: 133011 - DNA, 20 bp, Artificial Sequence
  chemically synthesized
ctgtaatcccagcactttgg

SEQ ID NO: 133012 - DNA, 20 bp, Artificial Sequence
  chemically synthesized
tgtaatcccagcactttggg

SEQ ID NO: 133013 - DNA, 20 bp, Artificial Sequence
  chemically synthesized
ccgcccgtctcggcctccca

SEQ ID NO: 133014 - DNA, 20 bp, Artificial Sequence
  chemically synthesized
tcccagcactttgggaggcc

SEQ ID NO: 133015 - DNA, 20 bp, Artificial Sequence
  chemically synthesized
agcactttgggaggccgaga

SEQ ID NO: 133016 - DNA, 20 bp, Artificial Sequence
  chemically synthesized
gcactttgggaggccgagac

SEQ ID NO: 133017 - DNA, 20 bp, Artificial Sequence
  chemically synthesized
ctttgggaggccgagacggg

SEQ ID NO: 133018 - DNA, 20 bp, Artificial Sequence
  chemically synthesized
acctcgtgatccgcccgtct

SEQ ID NO: 133019 - DNA, 20 bp, Artificial Sequence
  chemically synthesized
ggccgagacgggcggatcac

SEQ ID NO: 133020 - DNA, 20 bp, Artificial Sequence
  chemically synthesized
gccgagacgggcggatcacg

SEQ ID NO: 133021 - DNA, 20 bp, Artificial Sequence
  chemically synthesized
agacgggcggatcacgaggt

SEQ ID NO: 133022 - DNA, 20 bp, Artificial Sequence
  chemically synthesized
gacgggcggatcacgaggtc

SEQ ID NO: 133023 - DNA, 20 bp, Artificial Sequence
  chemically synthesized
cgggcggatcacgaggtcag

SEQ ID NO: 133024 - DNA, 20 bp, Artificial Sequence
  chemically synthesized
gatcacgaggtcaggagatc

SEQ ID NO: 133025 - DNA, 20 bp, Artificial Sequence
  chemically synthesized
tcaggagatcgagaccatcc

SEQ ID NO: 133026 - DNA, 20 bp, Artificial Sequence
  chemically synthesized
tttcaccgtgttagccagga

SEQ ID NO: 133027 - DNA, 20 bp, Artificial Sequence
  chemically synthesized
ggggtttcaccgtgttagcc

SEQ ID NO: 133028 - DNA, 20 bp, Artificial Sequence
  chemically synthesized
cgagaccatcctggctaaca

SEQ ID NO: 133029 - DNA, 20 bp, Artificial Sequence
  chemically synthesized
cggggtttcaccgtgttagc

SEQ ID NO: 133030 - DNA, 20 bp, Artificial Sequence
  chemically synthesized
gagacggggtttcaccgtgt

SEQ ID NO: 133031 - DNA, 20 bp, Artificial Sequence
  chemically synthesized
ttgtatttttagtagagacg

SEQ ID NO: 133032 - DNA, 20 bp, Artificial Sequence
  chemically synthesized
tttgtatttttagtagagac

SEQ ID NO: 133033 - DNA, 20 bp, Artificial Sequence
  chemically synthesized
ttttgtatttttagtagaga

SEQ ID NO: 133034 - DNA, 20 bp, Artificial Sequence
  chemically synthesized
taatttttgtatttttagta

SEQ ID NO: 133035 - DNA, 20 bp, Artificial Sequence
  chemically synthesized
gctaatttttgtatttttag

SEQ ID NO: 133036 - DNA, 20 bp, Artificial Sequence
  chemically synthesized
ccggctaatttttgtatttt

SEQ ID NO: 133037 - DNA, 20 bp, Artificial Sequence
  chemically synthesized
tctactaaaaatacaaaaat

SEQ ID NO: 133038 - DNA, 20 bp, Artificial Sequence
  chemically synthesized
ctaaaaatacaaaaattagc

SEQ ID NO: 133039 - DNA, 20 bp, Artificial Sequence
  chemically synthesized
taaaaatacaaaaattagcc

SEQ ID NO: 133040 - DNA, 20 bp, Artificial Sequence
  chemically synthesized
atacaaaaattagccgggca

SEQ ID NO: 133041 - DNA, 20 bp, Artificial Sequence
  chemically synthesized
caaaaattagccgggcatgg

SEQ ID NO: 133042 - DNA, 20 bp, Artificial Sequence
  chemically synthesized
caggcgcgcgccaccatgcc

SEQ ID NO: 133043 - DNA, 20 bp, Artificial Sequence
  chemically synthesized
ggcatggtggcgcgcgcctg

SEQ ID NO: 133044 - DNA, 20 bp, Artificial Sequence
  chemically synthesized
gtggcgcgcgcctgtagtcc

SEQ ID NO: 133045 - DNA, 20 bp, Artificial Sequence
  chemically synthesized
tcccgtgtagctgggactac

SEQ ID NO: 133046 - DNA, 20 bp, Artificial Sequence
  chemically synthesized
ctcccgtgtagctgggacta

SEQ ID NO: 133047 - DNA, 20 bp, Artificial Sequence
  chemically synthesized
cgcctgtagtcccagctaca

SEQ ID NO: 133048 - DNA, 20 bp, Artificial Sequence
  chemically synthesized
cctcagcctcccgtgtagct

SEQ ID NO: 133049 - DNA, 20 bp, Artificial Sequence
  chemically synthesized
gcctgtagtcccagctacac

SEQ ID NO: 133050 - DNA, 20 bp, Artificial Sequence
  chemically synthesized
gcctcagcctcccgtgtagc

SEQ ID NO: 133051 - DNA, 20 bp, Artificial Sequence
  chemically synthesized
ctgtagtcccagctacacgg

SEQ ID NO: 133052 - DNA, 20 bp, Artificial Sequence
  chemically synthesized
tgtagtcccagctacacggg

SEQ ID NO: 133053 - DNA, 20 bp, Artificial Sequence
  chemically synthesized
tcctgcctcagcctcccgtg

SEQ ID NO: 133054 - DNA, 20 bp, Artificial Sequence
  chemically synthesized
tcccagctacacgggaggct

SEQ ID NO: 133055 - DNA, 20 bp, Artificial Sequence
  chemically synthesized
cccagctacacgggaggctg

SEQ ID NO: 133056 - DNA, 20 bp, Artificial Sequence
  chemically synthesized
agctacacgggaggctgagg

SEQ ID NO: 133057 - DNA, 20 bp, Artificial Sequence
  chemically synthesized
gctacacgggaggctgaggc

SEQ ID NO: 133058 - DNA, 20 bp, Artificial Sequence
  chemically synthesized
tacacgggaggctgaggcag

SEQ ID NO: 133059 - DNA, 20 bp, Artificial Sequence
  chemically synthesized
ttcacgccattctcctgcct

SEQ ID NO: 133060 - DNA, 20 bp, Artificial Sequence
  chemically synthesized
gggaggctgaggcaggagaa

SEQ ID NO: 133061 - DNA, 20 bp, Artificial Sequence
  chemically synthesized
gcaggagaatggcgtgaacc

SEQ ID NO: 133062 - DNA, 20 bp, Artificial Sequence
  chemically synthesized
caggagaatggcgtgaaccc

SEQ ID NO: 133063 - DNA, 20 bp, Artificial Sequence
  chemically synthesized
ggagaatggcgtgaacccgg

SEQ ID NO: 133064 - DNA, 20 bp, Artificial Sequence
  chemically synthesized
gagaatggcgtgaacccggg

SEQ ID NO: 133065 - DNA, 20 bp, Artificial Sequence
  chemically synthesized
aatggcgtgaacccgggagg

SEQ ID NO: 133066 - DNA, 20 bp, Artificial Sequence
  chemically synthesized
cactgcaagctccgcctccc

SEQ ID NO: 133067 - DNA, 20 bp, Artificial Sequence
  chemically synthesized
tggcgtgaacccgggaggcg

SEQ ID NO: 133068 - DNA, 20 bp, Artificial Sequence
  chemically synthesized
tcactgcaagctccgcctcc

SEQ ID NO: 133069 - DNA, 20 bp, Artificial Sequence
  chemically synthesized
aacccgggaggcggagcttg

SEQ ID NO: 133070 - DNA, 20 bp, Artificial Sequence
  chemically synthesized
cgggaggcggagcttgcagt

SEQ ID NO: 133071 - DNA, 20 bp, Artificial Sequence
  chemically synthesized
gcgggatctcggctcactgc

SEQ ID NO: 133072 - DNA, 20 bp, Artificial Sequence
  chemically synthesized
ggcggagcttgcagtgagcc

SEQ ID NO: 133073 - DNA, 20 bp, Artificial Sequence
  chemically synthesized
ggagtgcagtggcgggatct

SEQ ID NO: 133074 - DNA, 20 bp, Artificial Sequence
  chemically synthesized
ccaggctggagtgcagtggc

SEQ ID NO: 133075 - DNA, 20 bp, Artificial Sequence
  chemically synthesized
cccaggctggagtgcagtgg

SEQ ID NO: 133076 - DNA, 20 bp, Artificial Sequence
  chemically synthesized
tcgcccaggctggagtgcag

SEQ ID NO: 133077 - DNA, 20 bp, Artificial Sequence
  chemically synthesized
gagatcccgccactgcactc

SEQ ID NO: 133078 - DNA, 20 bp, Artificial Sequence
  chemically synthesized
ctgtcgcccaggctggagtg

SEQ ID NO: 133079 - DNA, 20 bp, Artificial Sequence
  chemically synthesized
cccgccactgcactccagcc

SEQ ID NO: 133080 - DNA, 20 bp, Artificial Sequence
  chemically synthesized
ccgccactgcactccagcct

SEQ ID NO: 133081 - DNA, 20 bp, Artificial Sequence
  chemically synthesized
tcgctctgtcgcccaggctg

SEQ ID NO: 133082 - DNA, 20 bp, Artificial Sequence
  chemically synthesized
tttcgctctgtcgcccaggc

SEQ ID NO: 133083 - DNA, 20 bp, Artificial Sequence
  chemically synthesized
ctgcactccagcctgggcga

SEQ ID NO: 133084 - DNA, 20 bp, Artificial Sequence
  chemically synthesized
ggagtttcgctctgtcgccc

SEQ ID NO: 133085 - DNA, 20 bp, Artificial Sequence
  chemically synthesized
gcactccagcctgggcgaca

SEQ ID NO: 133086 - DNA, 20 bp, Artificial Sequence
  chemically synthesized
cggagtttcgctctgtcgcc

SEQ ID NO: 133087 - DNA, 20 bp, Artificial Sequence
  chemically synthesized
ttttttttttttttgagacg

SEQ ID NO: 133088 - DNA, 20 bp, Artificial Sequence
  chemically synthesized
ttttttttttttttttgaga

SEQ ID NO: 133089 - DNA, 20 bp, Artificial Sequence
  chemically synthesized
tttttttttttttttttttt

SEQ ID NO: 133090 - DNA, 20 bp, Artificial Sequence
  chemically synthesized
aaaaaaaaaaaaaaaaaatt

SEQ ID NO: 133091 - DNA, 20 bp, Artificial Sequence
  chemically synthesized
aaaaaaaaaaaaaaaattaa

SEQ ID NO: 133092 - DNA, 20 bp, Artificial Sequence
  chemically synthesized
ggaaatgaaatgtatataga

SEQ ID NO: 133093 - DNA, 20 bp, Artificial Sequence
  chemically synthesized
aaatggaaatgaaatgtata

SEQ ID NO: 133094 - DNA, 20 bp, Artificial Sequence
  chemically synthesized
atctgctgatttgagcaaaa

SEQ ID NO: 133095 - DNA, 20 bp, Artificial Sequence
  chemically synthesized
catttccattttgctcaaat

SEQ ID NO: 133096 - DNA, 20 bp, Artificial Sequence
  chemically synthesized
ttccattttgctcaaatcag

SEQ ID NO: 133097 - DNA, 20 bp, Artificial Sequence
  chemically synthesized
tttggaggatctgctgattt

SEQ ID NO: 133098 - DNA, 20 bp, Artificial Sequence
  chemically synthesized
caaatcagcagatcctccaa

SEQ ID NO: 133099 - DNA, 20 bp, Artificial Sequence
  chemically synthesized
gttcctcagtttacttttgg

SEQ ID NO: 133100 - DNA, 20 bp, Artificial Sequence
  chemically synthesized
tgttcctcagtttacttttg

SEQ ID NO: 133101 - DNA, 20 bp, Artificial Sequence
  chemically synthesized
aatgttcctcagtttacttt

SEQ ID NO: 133102 - DNA, 20 bp, Artificial Sequence
  chemically synthesized
agatcctccaaaagtaaact

SEQ ID NO: 133103 - DNA, 20 bp, Artificial Sequence
  chemically synthesized
gatcctccaaaagtaaactg

SEQ ID NO: 133104 - DNA, 20 bp, Artificial Sequence
  chemically synthesized
aggccatttgaaatgttcct

SEQ ID NO: 133105 - DNA, 20 bp, Artificial Sequence
  chemically synthesized
aaactgaggaacatttcaaa

SEQ ID NO: 133106 - DNA, 20 bp, Artificial Sequence
  chemically synthesized
gaggaacatttcaaatggcc

SEQ ID NO: 133107 - DNA, 20 bp, Artificial Sequence
  chemically synthesized
cttgcagaatacaacatact

SEQ ID NO: 133108 - DNA, 20 bp, Artificial Sequence
  chemically synthesized
ccttgcagaatacaacatac

SEQ ID NO: 133109 - DNA, 20 bp, Artificial Sequence
  chemically synthesized
cctagtatgttgtattctgc

SEQ ID NO: 133110 - DNA, 20 bp, Artificial Sequence
  chemically synthesized
ctagtatgttgtattctgca

SEQ ID NO: 133111 - DNA, 20 bp, Artificial Sequence
  chemically synthesized
atgttgtattctgcaaggat

SEQ ID NO: 133112 - DNA, 20 bp, Artificial Sequence
  chemically synthesized
gttcacatacctcatccttg

SEQ ID NO: 133113 - DNA, 20 bp, Artificial Sequence
  chemically synthesized
tgttgtattctgcaaggatg

SEQ ID NO: 133114 - DNA, 20 bp, Artificial Sequence
  chemically synthesized
caaggatgaggtatgtgaac

SEQ ID NO: 133115 - DNA, 20 bp, Artificial Sequence
  chemically synthesized
tgaggtatgtgaactggaat

SEQ ID NO: 133116 - DNA, 20 bp, Artificial Sequence
  chemically synthesized
aaagcaccttggtctgattc

SEQ ID NO: 133117 - DNA, 20 bp, Artificial Sequence
  chemically synthesized
atgtgaactggaatcagacc

SEQ ID NO: 133118 - DNA, 20 bp, Artificial Sequence
  chemically synthesized
tgtgaactggaatcagacca

SEQ ID NO: 133119 - DNA, 20 bp, Artificial Sequence
  chemically synthesized
aacagattttaaaagcacct

SEQ ID NO: 133120 - DNA, 20 bp, Artificial Sequence
  chemically synthesized
aaacatataacagattttaa

SEQ ID NO: 133121 - DNA, 20 bp, Artificial Sequence
  chemically synthesized
aatctctcataaacatataa

SEQ ID NO: 133122 - DNA, 20 bp, Artificial Sequence
  chemically synthesized
aaaatctgttatatgtttat

SEQ ID NO: 133123 - DNA, 20 bp, Artificial Sequence
  chemically synthesized
aatctgttatatgtttatga

SEQ ID NO: 133124 - DNA, 20 bp, Artificial Sequence
  chemically synthesized
tttatgagagattgtactaa

SEQ ID NO: 133125 - DNA, 20 bp, Artificial Sequence
  chemically synthesized
ttatgagagattgtactaaa

SEQ ID NO: 133126 - DNA, 20 bp, Artificial Sequence
  chemically synthesized
taagggattgagagtccttt

SEQ ID NO: 133127 - DNA, 20 bp, Artificial Sequence
  chemically synthesized
tttcagtcttaagggattga

SEQ ID NO: 133128 - DNA, 20 bp, Artificial Sequence
  chemically synthesized
attttcagtcttaagggatt

SEQ ID NO: 133129 - DNA, 20 bp, Artificial Sequence
  chemically synthesized
aaaaggactctcaatccctt

SEQ ID NO: 133130 - DNA, 20 bp, Artificial Sequence
  chemically synthesized
tagtgaattttcagtcttaa

SEQ ID NO: 133131 - DNA, 20 bp, Artificial Sequence
  chemically synthesized
gtagtgaattttcagtctta

SEQ ID NO: 133132 - DNA, 20 bp, Artificial Sequence
  chemically synthesized
ggtagtgaattttcagtctt

SEQ ID NO: 133133 - DNA, 20 bp, Artificial Sequence
  chemically synthesized
tgcaatgggtagtgaatttt

SEQ ID NO: 133134 - DNA, 20 bp, Artificial Sequence
  chemically synthesized
gacccagactttgcaatggg

SEQ ID NO: 133135 - DNA, 20 bp, Artificial Sequence
  chemically synthesized
aaaattcactacccattgca

SEQ ID NO: 133136 - DNA, 20 bp, Artificial Sequence
  chemically synthesized
acagacccagactttgcaat

SEQ ID NO: 133137 - DNA, 20 bp, Artificial Sequence
  chemically synthesized
aacagacccagactttgcaa

SEQ ID NO: 133138 - DNA, 20 bp, Artificial Sequence
  chemically synthesized
tcactacccattgcaaagtc

SEQ ID NO: 133139 - DNA, 20 bp, Artificial Sequence
  chemically synthesized
cactacccattgcaaagtct

SEQ ID NO: 133140 - DNA, 20 bp, Artificial Sequence
  chemically synthesized
aaacccaaagcaaacagacc

SEQ ID NO: 133141 - DNA, 20 bp, Artificial Sequence
  chemically synthesized
aagtctgggtctgtttgctt

SEQ ID NO: 133142 - DNA, 20 bp, Artificial Sequence
  chemically synthesized
cagaagaaacccaaagcaaa

SEQ ID NO: 133143 - DNA, 20 bp, Artificial Sequence
  chemically synthesized
agtctgggtctgtttgcttt

SEQ ID NO: 133144 - DNA, 20 bp, Artificial Sequence
  chemically synthesized
aaaaagccagaagaaaccca

SEQ ID NO: 133145 - DNA, 20 bp, Artificial Sequence
  chemically synthesized
tgtttgctttgggtttcttc

SEQ ID NO: 133146 - DNA, 20 bp, Artificial Sequence
  chemically synthesized
aaaagcaaacaaaaagccag

SEQ ID NO: 133147 - DNA, 20 bp, Artificial Sequence
  chemically synthesized
ttgaaaagcaaacaaaaagc

SEQ ID NO: 133148 - DNA, 20 bp, Artificial Sequence
  chemically synthesized
ttgtttgaaaagcaaacaaa

SEQ ID NO: 133149 - DNA, 20 bp, Artificial Sequence
  chemically synthesized
tttttgtttgcttttcaaac

SEQ ID NO: 133150 - DNA, 20 bp, Artificial Sequence
  chemically synthesized
aataaaacgccttgtttgaa

SEQ ID NO: 133151 - DNA, 20 bp, Artificial Sequence
  chemically synthesized
ttttgtttgcttttcaaaca

SEQ ID NO: 133152 - DNA, 20 bp, Artificial Sequence
  chemically synthesized
aggcgttttattaacctctt

SEQ ID NO: 133153 - DNA, 20 bp, Artificial Sequence
  chemically synthesized
ggcgttttattaacctcttt

SEQ ID NO: 133154 - DNA, 20 bp, Artificial Sequence
  chemically synthesized
gcgttttattaacctcttta

SEQ ID NO: 133155 - DNA, 20 bp, Artificial Sequence
  chemically synthesized
tcactggaattaccctaaag

SEQ ID NO: 133156 - DNA, 20 bp, Artificial Sequence
  chemically synthesized
atcactggaattaccctaaa

SEQ ID NO: 133157 - DNA, 20 bp, Artificial Sequence
  chemically synthesized
tcatcactggaattacccta

SEQ ID NO: 133158 - DNA, 20 bp, Artificial Sequence
  chemically synthesized
taacctctttagggtaattc

SEQ ID NO: 133159 - DNA, 20 bp, Artificial Sequence
  chemically synthesized
ccatgaccatgagtcatcac

SEQ ID NO: 133160 - DNA, 20 bp, Artificial Sequence
  chemically synthesized
gtaattccagtgatgactca

SEQ ID NO: 133161 - DNA, 20 bp, Artificial Sequence
  chemically synthesized
ccagtgatgactcatggtca

SEQ ID NO: 133162 - DNA, 20 bp, Artificial Sequence
  chemically synthesized
atcatcatctccatgaccat

SEQ ID NO: 133163 - DNA, 20 bp, Artificial Sequence
  chemically synthesized
agtgatgactcatggtcatg

SEQ ID NO: 133164 - DNA, 20 bp, Artificial Sequence
  chemically synthesized
catggtcatggagatgatga

SEQ ID NO: 133165 - DNA, 20 bp, Artificial Sequence
  chemically synthesized
ggtcatggagatgatgatgg

SEQ ID NO: 133166 - DNA, 20 bp, Artificial Sequence
  chemically synthesized
gagatgatgatggcagcttg

SEQ ID NO: 133167 - DNA, 20 bp, Artificial Sequence
  chemically synthesized
tggcagctagtgtaggctac

SEQ ID NO: 133168 - DNA, 20 bp, Artificial Sequence
  chemically synthesized
tggcagcttgtagcctacac

SEQ ID NO: 133169 - DNA, 20 bp, Artificial Sequence
  chemically synthesized
ggggagctggcagctagtgt

SEQ ID NO: 133170 - DNA, 20 bp, Artificial Sequence
  chemically synthesized
aggggagctggcagctagtg

SEQ ID NO: 133171 - DNA, 20 bp, Artificial Sequence
  chemically synthesized
ttgtagcctacactagctgc

SEQ ID NO: 133172 - DNA, 20 bp, Artificial Sequence
  chemically synthesized
ctcgcaggggagctggcagc

SEQ ID NO: 133173 - DNA, 20 bp, Artificial Sequence
  chemically synthesized
ctgtctcgcaggggagctgg

SEQ ID NO: 133174 - DNA, 20 bp, Artificial Sequence
  chemically synthesized
ggactgtctcgcaggggagc

SEQ ID NO: 133175 - DNA, 20 bp, Artificial Sequence
  chemically synthesized
ctagctgccagctcccctgc

SEQ ID NO: 133176 - DNA, 20 bp, Artificial Sequence
  chemically synthesized
gattggactgtctcgcaggg

SEQ ID NO: 133177 - DNA, 20 bp, Artificial Sequence
  chemically synthesized
ttgattggactgtctcgcag

SEQ ID NO: 133178 - DNA, 20 bp, Artificial Sequence
  chemically synthesized
ctgccagctcccctgcgaga

SEQ ID NO: 133179 - DNA, 20 bp, Artificial Sequence
  chemically synthesized
attgattggactgtctcgca

SEQ ID NO: 133180 - DNA, 20 bp, Artificial Sequence
  chemically synthesized
gattgattggactgtctcgc

SEQ ID NO: 133181 - DNA, 20 bp, Artificial Sequence
  chemically synthesized
tgattgattggactgtctcg

SEQ ID NO: 133182 - DNA, 20 bp, Artificial Sequence
  chemically synthesized
tgcgagacagtccaatcaat

SEQ ID NO: 133183 - DNA, 20 bp, Artificial Sequence
  chemically synthesized
ataaatacttactgattgat

SEQ ID NO: 133184 - DNA, 20 bp, Artificial Sequence
  chemically synthesized
agacagtccaatcaatcagt

SEQ ID NO: 133185 - DNA, 20 bp, Artificial Sequence
  chemically synthesized
aatcaatcagtaagtattta

SEQ ID NO: 133186 - DNA, 20 bp, Artificial Sequence
  chemically synthesized
catcttgttctgaaaataac

SEQ ID NO: 133187 - DNA, 20 bp, Artificial Sequence
  chemically synthesized
tatggcattcccgttatttt

SEQ ID NO: 133188 - DNA, 20 bp, Artificial Sequence
  chemically synthesized
acatcttgttctgaaaataa

SEQ ID NO: 133189 - DNA, 20 bp, Artificial Sequence
  chemically synthesized
attcccgttattttcagaac

SEQ ID NO: 133190 - DNA, 20 bp, Artificial Sequence
  chemically synthesized
ttattttcagaacaagatgt

SEQ ID NO: 133191 - DNA, 20 bp, Artificial Sequence
  chemically synthesized
attaaaataattcaaatata

SEQ ID NO: 133192 - DNA, 20 bp, Artificial Sequence
  chemically synthesized
ttaaaataattcaaatataa

SEQ ID NO: 133193 - DNA, 20 bp, Artificial Sequence
  chemically synthesized
aaaataattcaaatataaag

SEQ ID NO: 133194 - DNA, 20 bp, Artificial Sequence
  chemically synthesized
gatggacagtaagcatcaaa

SEQ ID NO: 133195 - DNA, 20 bp, Artificial Sequence
  chemically synthesized
tcgcctccctgatggacagt

SEQ ID NO: 133196 - DNA, 20 bp, Artificial Sequence
  chemically synthesized
gtttgatgcttactgtccat

SEQ ID NO: 133197 - DNA, 20 bp, Artificial Sequence
  chemically synthesized
tttgatgcttactgtccatc

SEQ ID NO: 133198 - DNA, 20 bp, Artificial Sequence
  chemically synthesized
ttgatgcttactgtccatca

SEQ ID NO: 133199 - DNA, 20 bp, Artificial Sequence
  chemically synthesized
tgtttcgcctccctgatgga

SEQ ID NO: 133200 - DNA, 20 bp, Artificial Sequence
  chemically synthesized
gatgcttactgtccatcagg

SEQ ID NO: 133201 - DNA, 20 bp, Artificial Sequence
  chemically synthesized
atgcttactgtccatcaggg

SEQ ID NO: 133202 - DNA, 20 bp, Artificial Sequence
  chemically synthesized
tatatgtttcgcctccctga

SEQ ID NO: 133203 - DNA, 20 bp, Artificial Sequence
  chemically synthesized
gaggcgaaacatatactaca

SEQ ID NO: 133204 - DNA, 20 bp, Artificial Sequence
  chemically synthesized
ggcgaaacatatactacatg

SEQ ID NO: 133205 - DNA, 20 bp, Artificial Sequence
  chemically synthesized
ctctgaggacattctccatg

SEQ ID NO: 133206 - DNA, 20 bp, Artificial Sequence
  chemically synthesized
tactacatggagaatgtcct

SEQ ID NO: 133207 - DNA, 20 bp, Artificial Sequence
  chemically synthesized
ctacatggagaatgtcctca

SEQ ID NO: 133208 - DNA, 20 bp, Artificial Sequence
  chemically synthesized
acatggagaatgtcctcaga

SEQ ID NO: 133209 - DNA, 20 bp, Artificial Sequence
  chemically synthesized
aacgttgttgtgtctctctg

SEQ ID NO: 133210 - DNA, 20 bp, Artificial Sequence
  chemically synthesized
caacgttgttgtgtctctct

SEQ ID NO: 133211 - DNA, 20 bp, Artificial Sequence
  chemically synthesized
acgttgaaattcctaatcta

SEQ ID NO: 133212 - DNA, 20 bp, Artificial Sequence
  chemically synthesized
agttacaaatgccatagatt

SEQ ID NO: 133213 - DNA, 20 bp, Artificial Sequence
  chemically synthesized
aagttacaaatgccatagat

SEQ ID NO: 133214 - DNA, 20 bp, Artificial Sequence
  chemically synthesized
tctgtaagttacaaatgcca

SEQ ID NO: 133215 - DNA, 20 bp, Artificial Sequence
  chemically synthesized
tctatggcatttgtaactta

SEQ ID NO: 133216 - DNA, 20 bp, Artificial Sequence
  chemically synthesized
gcatttgtaacttacagatg

SEQ ID NO: 133217 - DNA, 20 bp, Artificial Sequence
  chemically synthesized
tctcatgttgccacatctgt

SEQ ID NO: 133218 - DNA, 20 bp, Artificial Sequence
  chemically synthesized
acttacagatgtggcaacat

SEQ ID NO: 133219 - DNA, 20 bp, Artificial Sequence
  chemically synthesized
acagatgtggcaacatgaga

SEQ ID NO: 133220 - DNA, 20 bp, Artificial Sequence
  chemically synthesized
agatacggagatgggagggc

SEQ ID NO: 133221 - DNA, 20 bp, Artificial Sequence
  chemically synthesized
ctagagatacggagatggga

SEQ ID NO: 133222 - DNA, 20 bp, Artificial Sequence
  chemically synthesized
gctagagatacggagatggg

SEQ ID NO: 133223 - DNA, 20 bp, Artificial Sequence
  chemically synthesized
agctagagatacggagatgg

SEQ ID NO: 133224 - DNA, 20 bp, Artificial Sequence
  chemically synthesized
tcagctagagatacggagat

SEQ ID NO: 133225 - DNA, 20 bp, Artificial Sequence
  chemically synthesized
ttcagctagagatacggaga

SEQ ID NO: 133226 - DNA, 20 bp, Artificial Sequence
  chemically synthesized
gtggttcagctagagatacg

SEQ ID NO: 133227 - DNA, 20 bp, Artificial Sequence
  chemically synthesized
ccctcccatctccgtatctc

SEQ ID NO: 133228 - DNA, 20 bp, Artificial Sequence
  chemically synthesized
tggtggttcagctagagata

SEQ ID NO: 133229 - DNA, 20 bp, Artificial Sequence
  chemically synthesized
gagaactggtggttcagcta

SEQ ID NO: 133230 - DNA, 20 bp, Artificial Sequence
  chemically synthesized
gggagaactggtggttcagc

SEQ ID NO: 133231 - DNA, 20 bp, Artificial Sequence
  chemically synthesized
cgtatctctagctgaaccac

SEQ ID NO: 133232 - DNA, 20 bp, Artificial Sequence
  chemically synthesized
aagtgggagaactggtggtt

SEQ ID NO: 133233 - DNA, 20 bp, Artificial Sequence
  chemically synthesized
aggaaaagtgggagaactgg

SEQ ID NO: 133234 - DNA, 20 bp, Artificial Sequence
  chemically synthesized
agtaggaaaagtgggagaac

SEQ ID NO: 133235 - DNA, 20 bp, Artificial Sequence
  chemically synthesized
cattcgagtaggaaaagtgg

SEQ ID NO: 133236 - DNA, 20 bp, Artificial Sequence
  chemically synthesized
accattcgagtaggaaaagt

SEQ ID NO: 133237 - DNA, 20 bp, Artificial Sequence
  chemically synthesized
caccattcgagtaggaaaag

SEQ ID NO: 133238 - DNA, 20 bp, Artificial Sequence
  chemically synthesized
aaacaccattcgagtaggaa

SEQ ID NO: 133239 - DNA, 20 bp, Artificial Sequence
  chemically synthesized
tcccacttttcctactcgaa

SEQ ID NO: 133240 - DNA, 20 bp, Artificial Sequence
  chemically synthesized
aaaataaacaccattcgagt

SEQ ID NO: 133241 - DNA, 20 bp, Artificial Sequence
  chemically synthesized
aaaaataaacaccattcgag

SEQ ID NO: 133242 - DNA, 20 bp, Artificial Sequence
  chemically synthesized
ttaaaaaataaacaccattc

SEQ ID NO: 133243 - DNA, 20 bp, Artificial Sequence
  chemically synthesized
tattttttaaaaacatgtgt

SEQ ID NO: 133244 - DNA, 20 bp, Artificial Sequence
  chemically synthesized
tttttaaaaacatgtgttag

SEQ ID NO: 133245 - DNA, 20 bp, Artificial Sequence
  chemically synthesized
taaaaacatgtgttagcggc

SEQ ID NO: 133246 - DNA, 20 bp, Artificial Sequence
  chemically synthesized
aaaaacatgtgttagcggcc

SEQ ID NO: 133247 - DNA, 20 bp, Artificial Sequence
  chemically synthesized
aaacatgtgttagcggccag

SEQ ID NO: 133248 - DNA, 20 bp, Artificial Sequence
  chemically synthesized
gtgttagcggccaggagccg

SEQ ID NO: 133249 - DNA, 20 bp, Artificial Sequence
  chemically synthesized
caggcgtgagccacggctcc

SEQ ID NO: 133250 - DNA, 20 bp, Artificial Sequence
  chemically synthesized
gggattacaggcgtgagcca

SEQ ID NO: 133251 - DNA, 20 bp, Artificial Sequence
  chemically synthesized
agtgctgggattacaggcgt

SEQ ID NO: 133252 - DNA, 20 bp, Artificial Sequence
  chemically synthesized
gtggctcacgcctgtaatcc

SEQ ID NO: 133253 - DNA, 20 bp, Artificial Sequence
  chemically synthesized
tcccaaagtgctgggattac

SEQ ID NO: 133254 - DNA, 20 bp, Artificial Sequence
  chemically synthesized
ctcccaaagtgctgggatta

SEQ ID NO: 133255 - DNA, 20 bp, Artificial Sequence
  chemically synthesized
cgcctgtaatcccagcactt

SEQ ID NO: 133256 - DNA, 20 bp, Artificial Sequence
  chemically synthesized
cctcggcctcccaaagtgct

SEQ ID NO: 133257 - DNA, 20 bp, Artificial Sequence
  chemically synthesized
gcctgtaatcccagcacttt

SEQ ID NO: 133258 - DNA, 20 bp, Artificial Sequence
  chemically synthesized
gcctcggcctcccaaagtgc

SEQ ID NO: 133259 - DNA, 20 bp, Artificial Sequence
  chemically synthesized
ctgtaatcccagcactttgg

SEQ ID NO: 133260 - DNA, 20 bp, Artificial Sequence
  chemically synthesized
tgtaatcccagcactttggg

SEQ ID NO: 133261 - DNA, 20 bp, Artificial Sequence
  chemically synthesized
ccacccgcctcggcctccca

SEQ ID NO: 133262 - DNA, 20 bp, Artificial Sequence
  chemically synthesized
tcccagcactttgggaggcc

SEQ ID NO: 133263 - DNA, 20 bp, Artificial Sequence
  chemically synthesized
cccagcactttgggaggccg

SEQ ID NO: 133264 - DNA, 20 bp, Artificial Sequence
  chemically synthesized
agcactttgggaggccgagg

SEQ ID NO: 133265 - DNA, 20 bp, Artificial Sequence
  chemically synthesized
gcactttgggaggccgaggc

SEQ ID NO: 133266 - DNA, 20 bp, Artificial Sequence
  chemically synthesized
ctttgggaggccgaggcggg

SEQ ID NO: 133267 - DNA, 20 bp, Artificial Sequence
  chemically synthesized
ctcaggtgatccacccgcct

SEQ ID NO: 133268 - DNA, 20 bp, Artificial Sequence
  chemically synthesized
ccgaggcgggtggatcacct

SEQ ID NO: 133269 - DNA, 20 bp, Artificial Sequence
  chemically synthesized
cgaggcgggtggatcacctg

SEQ ID NO: 133270 - DNA, 20 bp, Artificial Sequence
  chemically synthesized
gcgggtggatcacctgaggt

SEQ ID NO: 133271 - DNA, 20 bp, Artificial Sequence
  chemically synthesized
cgggtggatcacctgaggtt

SEQ ID NO: 133272 - DNA, 20 bp, Artificial Sequence
  chemically synthesized
ggtctcgagctcccaacctc

SEQ ID NO: 133273 - DNA, 20 bp, Artificial Sequence
  chemically synthesized
ggtggatcacctgaggttgg

SEQ ID NO: 133274 - DNA, 20 bp, Artificial Sequence
  chemically synthesized
tggtctcgagctcccaacct

SEQ ID NO: 133275 - DNA, 20 bp, Artificial Sequence
  chemically synthesized
tcacctgaggttgggagctc

SEQ ID NO: 133276 - DNA, 20 bp, Artificial Sequence
  chemically synthesized
tgaggttgggagctcgagac

SEQ ID NO: 133277 - DNA, 20 bp, Artificial Sequence
  chemically synthesized
atgttggtcaggctggtctc

SEQ ID NO: 133278 - DNA, 20 bp, Artificial Sequence
  chemically synthesized
tttctccatgttggtcaggc

SEQ ID NO: 133279 - DNA, 20 bp, Artificial Sequence
  chemically synthesized
agagtttctccatgttggtc

SEQ ID NO: 133280 - DNA, 20 bp, Artificial Sequence
  chemically synthesized
cgagaccagcctgaccaaca

SEQ ID NO: 133281 - DNA, 20 bp, Artificial Sequence
  chemically synthesized
cagagtttctccatgttggt

SEQ ID NO: 133282 - DNA, 20 bp, Artificial Sequence
  chemically synthesized
agaccagcctgaccaacatg

SEQ ID NO: 133283 - DNA, 20 bp, Artificial Sequence
  chemically synthesized
gagacagagtttctccatgt

SEQ ID NO: 133284 - DNA, 20 bp, Artificial Sequence
  chemically synthesized
ttgtatttttagtagagaca

SEQ ID NO: 133285 - DNA, 20 bp, Artificial Sequence
  chemically synthesized
ttttgtatttttagtagaga

SEQ ID NO: 133286 - DNA, 20 bp, Artificial Sequence
  chemically synthesized
ctaattttgtatttttagta

SEQ ID NO: 133287 - DNA, 20 bp, Artificial Sequence
  chemically synthesized
ggctaattttgtatttttag

SEQ ID NO: 133288 - DNA, 20 bp, Artificial Sequence
  chemically synthesized
cccggctaattttgtatttt

SEQ ID NO: 133289 - DNA, 20 bp, Artificial Sequence
  chemically synthesized
ctctactaaaaatacaaaat

SEQ ID NO: 133290 - DNA, 20 bp, Artificial Sequence
  chemically synthesized
actaaaaatacaaaattagc

SEQ ID NO: 133291 - DNA, 20 bp, Artificial Sequence
  chemically synthesized
ctaaaaatacaaaattagcc

SEQ ID NO: 133292 - DNA, 20 bp, Artificial Sequence
  chemically synthesized
aatacaaaattagccgggca

SEQ ID NO: 133293 - DNA, 20 bp, Artificial Sequence
  chemically synthesized
acaaaattagccgggcatgg

SEQ ID NO: 133294 - DNA, 20 bp, Artificial Sequence
  chemically synthesized
cagacacgtgccaccatgcc

SEQ ID NO: 133295 - DNA, 20 bp, Artificial Sequence
  chemically synthesized
gtggcacgtgtctgtaatcc

SEQ ID NO: 133296 - DNA, 20 bp, Artificial Sequence
  chemically synthesized
catctgagtagctgggatta

SEQ ID NO: 133297 - DNA, 20 bp, Artificial Sequence
  chemically synthesized
tgtctgtaatcccagctact

SEQ ID NO: 133298 - DNA, 20 bp, Artificial Sequence
  chemically synthesized
cctcagccatctgagtagct

SEQ ID NO: 133299 - DNA, 20 bp, Artificial Sequence
  chemically synthesized
gcctcagccatctgagtagc

SEQ ID NO: 133300 - DNA, 20 bp, Artificial Sequence
  chemically synthesized
tgtaatcccagctactcaga

SEQ ID NO: 133301 - DNA, 20 bp, Artificial Sequence
  chemically synthesized
tcctgcctcagccatctgag

SEQ ID NO: 133302 - DNA, 20 bp, Artificial Sequence
  chemically synthesized
ttctcctgcctcagccatct

SEQ ID NO: 133303 - DNA, 20 bp, Artificial Sequence
  chemically synthesized
tcccagctactcagatggct

SEQ ID NO: 133304 - DNA, 20 bp, Artificial Sequence
  chemically synthesized
cccagctactcagatggctg

SEQ ID NO: 133305 - DNA, 20 bp, Artificial Sequence
  chemically synthesized
agctactcagatggctgagg

SEQ ID NO: 133306 - DNA, 20 bp, Artificial Sequence
  chemically synthesized
gctactcagatggctgaggc

SEQ ID NO: 133307 - DNA, 20 bp, Artificial Sequence
  chemically synthesized
tactcagatggctgaggcag

SEQ ID NO: 133308 - DNA, 20 bp, Artificial Sequence
  chemically synthesized
ttcaagcgattctcctgcct

SEQ ID NO: 133309 - DNA, 20 bp, Artificial Sequence
  chemically synthesized
gcaggagaatcgcttgaacc

SEQ ID NO: 133310 - DNA, 20 bp, Artificial Sequence
  chemically synthesized
caggagaatcgcttgaaccc

SEQ ID NO: 133311 - DNA, 20 bp, Artificial Sequence
  chemically synthesized
aacctccgcctcctgggttc

SEQ ID NO: 133312 - DNA, 20 bp, Artificial Sequence
  chemically synthesized
ggagaatcgcttgaacccag

SEQ ID NO: 133313 - DNA, 20 bp, Artificial Sequence
  chemically synthesized
gagaatcgcttgaacccagg

SEQ ID NO: 133314 - DNA, 20 bp, Artificial Sequence
  chemically synthesized
aatcgcttgaacccaggagg

SEQ ID NO: 133315 - DNA, 20 bp, Artificial Sequence
  chemically synthesized
cacagcaacctccgcctcct

SEQ ID NO: 133316 - DNA, 20 bp, Artificial Sequence
  chemically synthesized
tcgcttgaacccaggaggcg

SEQ ID NO: 133317 - DNA, 20 bp, Artificial Sequence
  chemically synthesized
tcacagcaacctccgcctcc

SEQ ID NO: 133318 - DNA, 20 bp, Artificial Sequence
  chemically synthesized
cgcttgaacccaggaggcgg

SEQ ID NO: 133319 - DNA, 20 bp, Artificial Sequence
  chemically synthesized
caggaggcggaggttgctgt

SEQ ID NO: 133320 - DNA, 20 bp, Artificial Sequence
  chemically synthesized
ggcggaggttgctgtgagcc

SEQ ID NO: 133321 - DNA, 20 bp, Artificial Sequence
  chemically synthesized
aatggtgcgatcttggctca

SEQ ID NO: 133322 - DNA, 20 bp, Artificial Sequence
  chemically synthesized
ggagtgcaatggtgcgatct

SEQ ID NO: 133323 - DNA, 20 bp, Artificial Sequence
  chemically synthesized
ttgcccaggctggagtgcaa

SEQ ID NO: 133324 - DNA, 20 bp, Artificial Sequence
  chemically synthesized
aagatcgcaccattgcactc

SEQ ID NO: 133325 - DNA, 20 bp, Artificial Sequence
  chemically synthesized
cgcaccattgcactccagcc

SEQ ID NO: 133326 - DNA, 20 bp, Artificial Sequence
  chemically synthesized
gcaccattgcactccagcct

SEQ ID NO: 133327 - DNA, 20 bp, Artificial Sequence
  chemically synthesized
tgctcttgttgcccaggctg

SEQ ID NO: 133328 - DNA, 20 bp, Artificial Sequence
  chemically synthesized
tttgctcttgttgcccaggc

SEQ ID NO: 133329 - DNA, 20 bp, Artificial Sequence
  chemically synthesized
tgcactccagcctgggcaac

SEQ ID NO: 133330 - DNA, 20 bp, Artificial Sequence
  chemically synthesized
gagttttgctcttgttgccc

SEQ ID NO: 133331 - DNA, 20 bp, Artificial Sequence
  chemically synthesized
ggagttttgctcttgttgcc

SEQ ID NO: 133332 - DNA, 20 bp, Artificial Sequence
  chemically synthesized
cactccagcctgggcaacaa

SEQ ID NO: 133333 - DNA, 20 bp, Artificial Sequence
  chemically synthesized
tgttttgttttgttgagatg

SEQ ID NO: 133334 - DNA, 20 bp, Artificial Sequence
  chemically synthesized
tttgttttgttttgttgaga

SEQ ID NO: 133335 - DNA, 20 bp, Artificial Sequence
  chemically synthesized
ttgttttgttttgttttgtt

SEQ ID NO: 133336 - DNA, 20 bp, Artificial Sequence
  chemically synthesized
aacaaaaacaaaacatatgt

SEQ ID NO: 133337 - DNA, 20 bp, Artificial Sequence
  chemically synthesized
gcccgttttagaaagataaa

SEQ ID NO: 133338 - DNA, 20 bp, Artificial Sequence
  chemically synthesized
agcccgttttagaaagataa

SEQ ID NO: 133339 - DNA, 20 bp, Artificial Sequence
  chemically synthesized
agccttttatctttctaaaa

SEQ ID NO: 133340 - DNA, 20 bp, Artificial Sequence
  chemically synthesized
aatgtttagcccgttttaga

SEQ ID NO: 133341 - DNA, 20 bp, Artificial Sequence
  chemically synthesized
gccttttatctttctaaaac

SEQ ID NO: 133342 - DNA, 20 bp, Artificial Sequence
  chemically synthesized
aaataatgtttagcccgttt

SEQ ID NO: 133343 - DNA, 20 bp, Artificial Sequence
  chemically synthesized
cctttaagcaaaataatgtt

SEQ ID NO: 133344 - DNA, 20 bp, Artificial Sequence
  chemically synthesized
gctaaacattattttgctta

SEQ ID NO: 133345 - DNA, 20 bp, Artificial Sequence
  chemically synthesized
ctaaacattattttgcttaa

SEQ ID NO: 133346 - DNA, 20 bp, Artificial Sequence
  chemically synthesized
cattattttgcttaaaggca

SEQ ID NO: 133347 - DNA, 20 bp, Artificial Sequence
  chemically synthesized
gcattaatttctatgccttt

SEQ ID NO: 133348 - DNA, 20 bp, Artificial Sequence
  chemically synthesized
gcatagaaattaatgcctct

SEQ ID NO: 133349 - DNA, 20 bp, Artificial Sequence
  chemically synthesized
tgggacttaaaatttctcag

SEQ ID NO: 133350 - DNA, 20 bp, Artificial Sequence
  chemically synthesized
atgggacttaaaatttctca

SEQ ID NO: 133351 - DNA, 20 bp, Artificial Sequence
  chemically synthesized
tcatgggacttaaaatttct

SEQ ID NO: 133352 - DNA, 20 bp, Artificial Sequence
  chemically synthesized
taatgcctctgagaaatttt

SEQ ID NO: 133353 - DNA, 20 bp, Artificial Sequence
  chemically synthesized
tgagaaattttaagtcccat

SEQ ID NO: 133354 - DNA, 20 bp, Artificial Sequence
  chemically synthesized
ttgggtatttattgactcat

SEQ ID NO: 133355 - DNA, 20 bp, Artificial Sequence
  chemically synthesized
attgggtatttattgactca

SEQ ID NO: 133356 - DNA, 20 bp, Artificial Sequence
  chemically synthesized
caattaagttcaaacatatt

SEQ ID NO: 133357 - DNA, 20 bp, Artificial Sequence
  chemically synthesized
tcaattaagttcaaacatat

SEQ ID NO: 133358 - DNA, 20 bp, Artificial Sequence
  chemically synthesized
tgtgatagtttatttcaatt

SEQ ID NO: 133359 - DNA, 20 bp, Artificial Sequence
  chemically synthesized
tataaactatcaatttgtga

SEQ ID NO: 133360 - DNA, 20 bp, Artificial Sequence
  chemically synthesized
aataaactatcacaaattga

SEQ ID NO: 133361 - DNA, 20 bp, Artificial Sequence
  chemically synthesized
caaattgatagtttatatat

SEQ ID NO: 133362 - DNA, 20 bp, Artificial Sequence
  chemically synthesized
tatatataaaattgacatat

SEQ ID NO: 133363 - DNA, 20 bp, Artificial Sequence
  chemically synthesized
catgcatgtagatagttata

SEQ ID NO: 133364 - DNA, 20 bp, Artificial Sequence
  chemically synthesized
tatatactcatgcatgtaga

SEQ ID NO: 133365 - DNA, 20 bp, Artificial Sequence
  chemically synthesized
ttataactatctacatgcat

SEQ ID NO: 133366 - DNA, 20 bp, Artificial Sequence
  chemically synthesized
ttcttatatactcatgcatg

SEQ ID NO: 133367 - DNA, 20 bp, Artificial Sequence
  chemically synthesized
atctacatgcatgagtatat

SEQ ID NO: 133368 - DNA, 20 bp, Artificial Sequence
  chemically synthesized
catttggagtcagttattga

SEQ ID NO: 133369 - DNA, 20 bp, Artificial Sequence
  chemically synthesized
aaggaggctacatttggagt

SEQ ID NO: 133370 - DNA, 20 bp, Artificial Sequence
  chemically synthesized
tcaataactgactccaaatg

SEQ ID NO: 133371 - DNA, 20 bp, Artificial Sequence
  chemically synthesized
ctgaaaggaggctacatttg

SEQ ID NO: 133372 - DNA, 20 bp, Artificial Sequence
  chemically synthesized
tgctgaaaggaggctacatt

SEQ ID NO: 133373 - DNA, 20 bp, Artificial Sequence
  chemically synthesized
ctccaaatgtagcctccttt

SEQ ID NO: 133374 - DNA, 20 bp, Artificial Sequence
  chemically synthesized
cccaaacctatgctgaaagg

SEQ ID NO: 133375 - DNA, 20 bp, Artificial Sequence
  chemically synthesized
ccccaaacctatgctgaaag

SEQ ID NO: 133376 - DNA, 20 bp, Artificial Sequence
  chemically synthesized
aatgtagcctcctttcagca

SEQ ID NO: 133377 - DNA, 20 bp, Artificial Sequence
  chemically synthesized
ttccccaaacctatgctgaa

SEQ ID NO: 133378 - DNA, 20 bp, Artificial Sequence
  chemically synthesized
atgtagcctcctttcagcat

SEQ ID NO: 133379 - DNA, 20 bp, Artificial Sequence
  chemically synthesized
tttccccaaacctatgctga

SEQ ID NO: 133380 - DNA, 20 bp, Artificial Sequence
  chemically synthesized
gcctcctttcagcataggtt

SEQ ID NO: 133381 - DNA, 20 bp, Artificial Sequence
  chemically synthesized
cctcctttcagcataggttt

SEQ ID NO: 133382 - DNA, 20 bp, Artificial Sequence
  chemically synthesized
ctcctttcagcataggtttg

SEQ ID NO: 133383 - DNA, 20 bp, Artificial Sequence
  chemically synthesized
tttcagcataggtttgggga

SEQ ID NO: 133384 - DNA, 20 bp, Artificial Sequence
  chemically synthesized
tctaaaaataggtgttagat

SEQ ID NO: 133385 - DNA, 20 bp, Artificial Sequence
  chemically synthesized
ttctaaaaataggtgttaga

SEQ ID NO: 133386 - DNA, 20 bp, Artificial Sequence
  chemically synthesized
ctgattctaaaaataggtgt

SEQ ID NO: 133387 - DNA, 20 bp, Artificial Sequence
  chemically synthesized
acccatctaacacctatttt

SEQ ID NO: 133388 - DNA, 20 bp, Artificial Sequence
  chemically synthesized
actcctctgattctaaaaat

SEQ ID NO: 133389 - DNA, 20 bp, Artificial Sequence
  chemically synthesized
aactcctctgattctaaaaa

SEQ ID NO: 133390 - DNA, 20 bp, Artificial Sequence
  chemically synthesized
ctaacacctatttttagaat

SEQ ID NO: 133391 - DNA, 20 bp, Artificial Sequence
  chemically synthesized
aacacctatttttagaatca

SEQ ID NO: 133392 - DNA, 20 bp, Artificial Sequence
  chemically synthesized
acacctatttttagaatcag

SEQ ID NO: 133393 - DNA, 20 bp, Artificial Sequence
  chemically synthesized
acctatttttagaatcagag

SEQ ID NO: 133394 - DNA, 20 bp, Artificial Sequence
  chemically synthesized
atttttagaatcagaggagt

SEQ ID NO: 133395 - DNA, 20 bp, Artificial Sequence
  chemically synthesized
agaggagttggattaaatcc

SEQ ID NO: 133396 - DNA, 20 bp, Artificial Sequence
  chemically synthesized
atcacacagatagcggaacc

SEQ ID NO: 133397 - DNA, 20 bp, Artificial Sequence
  chemically synthesized
gatcacacagatagcggaac

SEQ ID NO: 133398 - DNA, 20 bp, Artificial Sequence
  chemically synthesized
gcataagatcacacagatag

SEQ ID NO: 133399 - DNA, 20 bp, Artificial Sequence
  chemically synthesized
tttgcataagatcacacaga

SEQ ID NO: 133400 - DNA, 20 bp, Artificial Sequence
  chemically synthesized
atattttgcataagatcaca

SEQ ID NO: 133401 - DNA, 20 bp, Artificial Sequence
  chemically synthesized
aagatattaatattttgcat

SEQ ID NO: 133402 - DNA, 20 bp, Artificial Sequence
  chemically synthesized
caaaatattaatatctttga

SEQ ID NO: 133403 - DNA, 20 bp, Artificial Sequence
  chemically synthesized
atattaatatctttgatagt

SEQ ID NO: 133404 - DNA, 20 bp, Artificial Sequence
  chemically synthesized
aatgagagaaccaactatca

SEQ ID NO: 133405 - DNA, 20 bp, Artificial Sequence
  chemically synthesized
tgtccttattaagtaaatga

SEQ ID NO: 133406 - DNA, 20 bp, Artificial Sequence
  chemically synthesized
attgtccttattaagtaaat

SEQ ID NO: 133407 - DNA, 20 bp, Artificial Sequence
  chemically synthesized
ggttctctcatttacttaat

SEQ ID NO: 133408 - DNA, 20 bp, Artificial Sequence
  chemically synthesized
gttctctcatttacttaata

SEQ ID NO: 133409 - DNA, 20 bp, Artificial Sequence
  chemically synthesized
tggtagatattgtccttatt

SEQ ID NO: 133410 - DNA, 20 bp, Artificial Sequence
  chemically synthesized
aataaggacaatatctacca

SEQ ID NO: 133411 - DNA, 20 bp, Artificial Sequence
  chemically synthesized
ataaggacaatatctaccat

SEQ ID NO: 133412 - DNA, 20 bp, Artificial Sequence
  chemically synthesized
taaggacaatatctaccata

SEQ ID NO: 133413 - DNA, 20 bp, Artificial Sequence
  chemically synthesized
tttcacaacagtccctatgg

SEQ ID NO: 133414 - DNA, 20 bp, Artificial Sequence
  chemically synthesized
tattttcacaacagtcccta

SEQ ID NO: 133415 - DNA, 20 bp, Artificial Sequence
  chemically synthesized
agtggattttattttcacaa

SEQ ID NO: 133416 - DNA, 20 bp, Artificial Sequence
  chemically synthesized
aactcttatacatatataag

SEQ ID NO: 133417 - DNA, 20 bp, Artificial Sequence
  chemically synthesized
aggaactcttatacatatat

SEQ ID NO: 133418 - DNA, 20 bp, Artificial Sequence
  chemically synthesized
aaatccacttatatatgtat

SEQ ID NO: 133419 - DNA, 20 bp, Artificial Sequence
  chemically synthesized
atccacttatatatgtataa

SEQ ID NO: 133420 - DNA, 20 bp, Artificial Sequence
  chemically synthesized
tgctttatacgaattggatg

SEQ ID NO: 133421 - DNA, 20 bp, Artificial Sequence
  chemically synthesized
gtgctttatacgaattggat

SEQ ID NO: 133422 - DNA, 20 bp, Artificial Sequence
  chemically synthesized
gtgctgtgctttatacgaat

SEQ ID NO: 133423 - DNA, 20 bp, Artificial Sequence
  chemically synthesized
ttcctcatccaattcgtata

SEQ ID NO: 133424 - DNA, 20 bp, Artificial Sequence
  chemically synthesized
catccaattcgtataaagca

SEQ ID NO: 133425 - DNA, 20 bp, Artificial Sequence
  chemically synthesized
taaagcacagcacaaatcta

SEQ ID NO: 133426 - DNA, 20 bp, Artificial Sequence
  chemically synthesized
ctcataaaagagtaatactt

SEQ ID NO: 133427 - DNA, 20 bp, Artificial Sequence
  chemically synthesized
ctaaagtattactcttttat

SEQ ID NO: 133428 - DNA, 20 bp, Artificial Sequence
  chemically synthesized
ttttaaagtatctcataaaa

SEQ ID NO: 133429 - DNA, 20 bp, Artificial Sequence
  chemically synthesized
gattttaaagtatctcataa

SEQ ID NO: 133430 - DNA, 20 bp, Artificial Sequence
  chemically synthesized
ctaactttattcagatttta

SEQ ID NO: 133431 - DNA, 20 bp, Artificial Sequence
  chemically synthesized
gatactttaaaatctgaata

SEQ ID NO: 133432 - DNA, 20 bp, Artificial Sequence
  chemically synthesized
aaataaaatctaactttatt

SEQ ID NO: 133433 - DNA, 20 bp, Artificial Sequence
  chemically synthesized
ctttaaaatctgaataaagt

SEQ ID NO: 133434 - DNA, 20 bp, Artificial Sequence
  chemically synthesized
tagattttatttgtcccata

SEQ ID NO: 133435 - DNA, 20 bp, Artificial Sequence
  chemically synthesized
attttatttgtcccataaag

SEQ ID NO: 133436 - DNA, 20 bp, Artificial Sequence
  chemically synthesized
caaaattttcacttctttat

SEQ ID NO: 133437 - DNA, 20 bp, Artificial Sequence
  chemically synthesized
tcaaaattttcacttcttta

SEQ ID NO: 133438 - DNA, 20 bp, Artificial Sequence
  chemically synthesized
taaagaagtgaaaattttga

SEQ ID NO: 133439 - DNA, 20 bp, Artificial Sequence
  chemically synthesized
ctccagaatatgaaacattt

SEQ ID NO: 133440 - DNA, 20 bp, Artificial Sequence
  chemically synthesized
gtctgaaatgtttcatattc

SEQ ID NO: 133441 - DNA, 20 bp, Artificial Sequence
  chemically synthesized
ctgaaatgtttcatattctg

SEQ ID NO: 133442 - DNA, 20 bp, Artificial Sequence
  chemically synthesized
aaacatgttccagggaactc

SEQ ID NO: 133443 - DNA, 20 bp, Artificial Sequence
  chemically synthesized
tttcatattctggagttccc

SEQ ID NO: 133444 - DNA, 20 bp, Artificial Sequence
  chemically synthesized
gtaactaaaaacatgttcca

SEQ ID NO: 133445 - DNA, 20 bp, Artificial Sequence
  chemically synthesized
ggtaactaaaaacatgttcc

SEQ ID NO: 133446 - DNA, 20 bp, Artificial Sequence
  chemically synthesized
tggtaactaaaaacatgttc

SEQ ID NO: 133447 - DNA, 20 bp, Artificial Sequence
  chemically synthesized
agttccctggaacatgtttt

SEQ ID NO: 133448 - DNA, 20 bp, Artificial Sequence
  chemically synthesized
tttttagttaccaaaatacc

SEQ ID NO: 133449 - DNA, 20 bp, Artificial Sequence
  chemically synthesized
ccttcagtagcttggtattt

SEQ ID NO: 133450 - DNA, 20 bp, Artificial Sequence
  chemically synthesized
cacgtttcccttcagtagct

SEQ ID NO: 133451 - DNA, 20 bp, Artificial Sequence
  chemically synthesized
accaaaataccaagctactg

SEQ ID NO: 133452 - DNA, 20 bp, Artificial Sequence
  chemically synthesized
ccaaaataccaagctactga

SEQ ID NO: 133453 - DNA, 20 bp, Artificial Sequence
  chemically synthesized
caaaataccaagctactgaa

SEQ ID NO: 133454 - DNA, 20 bp, Artificial Sequence
  chemically synthesized
atgcccacgtttcccttcag

SEQ ID NO: 133455 - DNA, 20 bp, Artificial Sequence
  chemically synthesized
aaaatgcccacgtttccctt

SEQ ID NO: 133456 - DNA, 20 bp, Artificial Sequence
  chemically synthesized
caagctactgaagggaaacg

SEQ ID NO: 133457 - DNA, 20 bp, Artificial Sequence
  chemically synthesized
aagctactgaagggaaacgt

SEQ ID NO: 133458 - DNA, 20 bp, Artificial Sequence
  chemically synthesized
gaagggaaacgtgggcattt

SEQ ID NO: 133459 - DNA, 20 bp, Artificial Sequence
  chemically synthesized
gggcattttggttgccctgc

SEQ ID NO: 133460 - DNA, 20 bp, Artificial Sequence
  chemically synthesized
ttttttcttaatgtctggca

SEQ ID NO: 133461 - DNA, 20 bp, Artificial Sequence
  chemically synthesized
tttttttcttaatgtctggc

SEQ ID NO: 133462 - DNA, 20 bp, Artificial Sequence
  chemically synthesized
atttttttcttaatgtctgg

SEQ ID NO: 133463 - DNA, 20 bp, Artificial Sequence
  chemically synthesized
tggttgccctgccagacatt

SEQ ID NO: 133464 - DNA, 20 bp, Artificial Sequence
  chemically synthesized
ttcatttttttcttaatgtc

SEQ ID NO: 133465 - DNA, 20 bp, Artificial Sequence
  chemically synthesized
gacatagcaataaatagaat

SEQ ID NO: 133466 - DNA, 20 bp, Artificial Sequence
  chemically synthesized
agacatagcaataaatagaa

SEQ ID NO: 133467 - DNA, 20 bp, Artificial Sequence
  chemically synthesized
ttaagagacatagcaataaa

SEQ ID NO: 133468 - DNA, 20 bp, Artificial Sequence
  chemically synthesized
caaacgtactttaagagaca

SEQ ID NO: 133469 - DNA, 20 bp, Artificial Sequence
  chemically synthesized
atttattgctatgtctctta

SEQ ID NO: 133470 - DNA, 20 bp, Artificial Sequence
  chemically synthesized
ccatgccaaacgtactttaa

SEQ ID NO: 133471 - DNA, 20 bp, Artificial Sequence
  chemically synthesized
taccatgccaaacgtacttt

SEQ ID NO: 133472 - DNA, 20 bp, Artificial Sequence
  chemically synthesized
tatgtctcttaaagtacgtt

SEQ ID NO: 133473 - DNA, 20 bp, Artificial Sequence
  chemically synthesized
ctcttaaagtacgtttggca

SEQ ID NO: 133474 - DNA, 20 bp, Artificial Sequence
  chemically synthesized
ttggcatggtacccaacatt

SEQ ID NO: 133475 - DNA, 20 bp, Artificial Sequence
  chemically synthesized
gttatgtgtctctcaatgtt

SEQ ID NO: 133476 - DNA, 20 bp, Artificial Sequence
  chemically synthesized
ggcatggtacccaacattga

SEQ ID NO: 133477 - DNA, 20 bp, Artificial Sequence
  chemically synthesized
ggttatgtgtctctcaatgt

SEQ ID NO: 133478 - DNA, 20 bp, Artificial Sequence
  chemically synthesized
gctcagagttttaggacagc

SEQ ID NO: 133479 - DNA, 20 bp, Artificial Sequence
  chemically synthesized
tgctcagagttttaggacag

SEQ ID NO: 133480 - DNA, 20 bp, Artificial Sequence
  chemically synthesized
aattgctcagagttttagga

SEQ ID NO: 133481 - DNA, 20 bp, Artificial Sequence
  chemically synthesized
tgtaaattgctcagagtttt

SEQ ID NO: 133482 - DNA, 20 bp, Artificial Sequence
  chemically synthesized
acctgctgtcctaaaactct

SEQ ID NO: 133483 - DNA, 20 bp, Artificial Sequence
  chemically synthesized
ttgtaaattgctcagagttt

SEQ ID NO: 133484 - DNA, 20 bp, Artificial Sequence
  chemically synthesized
aagaatttgtaaattgctca

SEQ ID NO: 133485 - DNA, 20 bp, Artificial Sequence
  chemically synthesized
acaagaatttgtaaattgct

SEQ ID NO: 133486 - DNA, 20 bp, Artificial Sequence
  chemically synthesized
tttacaaattcttgtaatca

SEQ ID NO: 133487 - DNA, 20 bp, Artificial Sequence
  chemically synthesized
ggaattctttctatgattac

SEQ ID NO: 133488 - DNA, 20 bp, Artificial Sequence
  chemically synthesized
caaattcttgtaatcataga

SEQ ID NO: 133489 - DNA, 20 bp, Artificial Sequence
  chemically synthesized
tccttttgggatgtaaaatg

SEQ ID NO: 133490 - DNA, 20 bp, Artificial Sequence
  chemically synthesized
gtccttttgggatgtaaaat

SEQ ID NO: 133491 - DNA, 20 bp, Artificial Sequence
  chemically synthesized
agtccttttgggatgtaaaa

SEQ ID NO: 133492 - DNA, 20 bp, Artificial Sequence
  chemically synthesized
ttccccattttacatcccaa

SEQ ID NO: 133493 - DNA, 20 bp, Artificial Sequence
  chemically synthesized
tccccattttacatcccaaa

SEQ ID NO: 133494 - DNA, 20 bp, Artificial Sequence
  chemically synthesized
ggagaaggcacagtcctttt

SEQ ID NO: 133495 - DNA, 20 bp, Artificial Sequence
  chemically synthesized
aggagaaggcacagtccttt

SEQ ID NO: 133496 - DNA, 20 bp, Artificial Sequence
  chemically synthesized
gccactaagaggagaaggca

SEQ ID NO: 133497 - DNA, 20 bp, Artificial Sequence
  chemically synthesized
taggagccactaagaggaga

SEQ ID NO: 133498 - DNA, 20 bp, Artificial Sequence
  chemically synthesized
aggactgtgccttctcctct

SEQ ID NO: 133499 - DNA, 20 bp, Artificial Sequence
  chemically synthesized
gtaggagccactaagaggag

SEQ ID NO: 133500 - DNA, 20 bp, Artificial Sequence
  chemically synthesized
actgtgccttctcctcttag

SEQ ID NO: 133501 - DNA, 20 bp, Artificial Sequence
  chemically synthesized
cttgtaggagccactaagag

SEQ ID NO: 133502 - DNA, 20 bp, Artificial Sequence
  chemically synthesized
cccttgtaggagccactaag

SEQ ID NO: 133503 - DNA, 20 bp, Artificial Sequence
  chemically synthesized
tcccttgtaggagccactaa

SEQ ID NO: 133504 - DNA, 20 bp, Artificial Sequence
  chemically synthesized
aatcccttgtaggagccact

SEQ ID NO: 133505 - DNA, 20 bp, Artificial Sequence
  chemically synthesized
ctcctcttagtggctcctac

SEQ ID NO: 133506 - DNA, 20 bp, Artificial Sequence
  chemically synthesized
tcctcttagtggctcctaca

SEQ ID NO: 133507 - DNA, 20 bp, Artificial Sequence
  chemically synthesized
cctcttagtggctcctacaa

SEQ ID NO: 133508 - DNA, 20 bp, Artificial Sequence
  chemically synthesized
tttagtctaatcccttgtag

SEQ ID NO: 133509 - DNA, 20 bp, Artificial Sequence
  chemically synthesized
ggtttagtctaatcccttgt

SEQ ID NO: 133510 - DNA, 20 bp, Artificial Sequence
  chemically synthesized
tggtttagtctaatcccttg

SEQ ID NO: 133511 - DNA, 20 bp, Artificial Sequence
  chemically synthesized
tagtggctcctacaagggat

SEQ ID NO: 133512 - DNA, 20 bp, Artificial Sequence
  chemically synthesized
tcctcatgaaggatttggtt

SEQ ID NO: 133513 - DNA, 20 bp, Artificial Sequence
  chemically synthesized
cctgttcctcatgaaggatt

SEQ ID NO: 133514 - DNA, 20 bp, Artificial Sequence
  chemically synthesized
gactaaaccaaatccttcat

SEQ ID NO: 133515 - DNA, 20 bp, Artificial Sequence
  chemically synthesized
actaaaccaaatccttcatg

SEQ ID NO: 133516 - DNA, 20 bp, Artificial Sequence
  chemically synthesized
actttacctgttcctcatga

SEQ ID NO: 133517 - DNA, 20 bp, Artificial Sequence
  chemically synthesized
cactttacctgttcctcatg

SEQ ID NO: 133518 - DNA, 20 bp, Artificial Sequence
  chemically synthesized
accaaatccttcatgaggaa

SEQ ID NO: 133519 - DNA, 20 bp, Artificial Sequence
  chemically synthesized
ccaaatccttcatgaggaac

SEQ ID NO: 133520 - DNA, 20 bp, Artificial Sequence
  chemically synthesized
tccttcatgaggaacaggta

SEQ ID NO: 133521 - DNA, 20 bp, Artificial Sequence
  chemically synthesized
acgttggcattttaaagcaa

SEQ ID NO: 133522 - DNA, 20 bp, Artificial Sequence
  chemically synthesized
aggctcacgttggcatttta

SEQ ID NO: 133523 - DNA, 20 bp, Artificial Sequence
  chemically synthesized
ttgctttaaaatgccaacgt

SEQ ID NO: 133524 - DNA, 20 bp, Artificial Sequence
  chemically synthesized
aggaatatataggctcacgt

SEQ ID NO: 133525 - DNA, 20 bp, Artificial Sequence
  chemically synthesized
tgaacagcacaggaatatat

SEQ ID NO: 133526 - DNA, 20 bp, Artificial Sequence
  chemically synthesized
atgaacagcacaggaatata

SEQ ID NO: 133527 - DNA, 20 bp, Artificial Sequence
  chemically synthesized
taaggtaatatgaacagcac

SEQ ID NO: 133528 - DNA, 20 bp, Artificial Sequence
  chemically synthesized
ataaggtaatatgaacagca

SEQ ID NO: 133529 - DNA, 20 bp, Artificial Sequence
  chemically synthesized
gaacgataaggtaatatgaa

SEQ ID NO: 133530 - DNA, 20 bp, Artificial Sequence
  chemically synthesized
tgtaattgtgcagaacgata

SEQ ID NO: 133531 - DNA, 20 bp, Artificial Sequence
  chemically synthesized
gtgtaattgtgcagaacgat

SEQ ID NO: 133532 - DNA, 20 bp, Artificial Sequence
  chemically synthesized
gaacatcaagtgtaattgtg

SEQ ID NO: 133533 - DNA, 20 bp, Artificial Sequence
  chemically synthesized
aacctgaaaatgtgaacatc

SEQ ID NO: 133534 - DNA, 20 bp, Artificial Sequence
  chemically synthesized
acacttgatgttcacatttt

SEQ ID NO: 133535 - DNA, 20 bp, Artificial Sequence
  chemically synthesized
cacttgatgttcacattttc

SEQ ID NO: 133536 - DNA, 20 bp, Artificial Sequence
  chemically synthesized
gttcacattttcaggttgac

SEQ ID NO: 133537 - DNA, 20 bp, Artificial Sequence
  chemically synthesized
ttcacattttcaggttgact

SEQ ID NO: 133538 - DNA, 20 bp, Artificial Sequence
  chemically synthesized
tgccatgaagtgataaaacc

SEQ ID NO: 133539 - DNA, 20 bp, Artificial Sequence
  chemically synthesized
gactgggttttatcacttca

SEQ ID NO: 133540 - DNA, 20 bp, Artificial Sequence
  chemically synthesized
aaacagaaaagtgtgccatg

SEQ ID NO: 133541 - DNA, 20 bp, Artificial Sequence
  chemically synthesized
ttctctgtaattaaacagaa

SEQ ID NO: 133542 - DNA, 20 bp, Artificial Sequence
  chemically synthesized
cacctttctctgtaattaaa

SEQ ID NO: 133543 - DNA, 20 bp, Artificial Sequence
  chemically synthesized
cacacttttctgtttaatta

SEQ ID NO: 133544 - DNA, 20 bp, Artificial Sequence
  chemically synthesized
cacttttctgtttaattaca

SEQ ID NO: 133545 - DNA, 20 bp, Artificial Sequence
  chemically synthesized
tttctgtttaattacagaga

SEQ ID NO: 133546 - DNA, 20 bp, Artificial Sequence
  chemically synthesized
ttctgtttaattacagagaa

SEQ ID NO: 133547 - DNA, 20 bp, Artificial Sequence
  chemically synthesized
atgcacagaataagaatgag

SEQ ID NO: 133548 - DNA, 20 bp, Artificial Sequence
  chemically synthesized
aatgcacagaataagaatga

SEQ ID NO: 133549 - DNA, 20 bp, Artificial Sequence
  chemically synthesized
aaatgcacagaataagaatg

SEQ ID NO: 133550 - DNA, 20 bp, Artificial Sequence
  chemically synthesized
caaatgcacagaataagaat

SEQ ID NO: 133551 - DNA, 20 bp, Artificial Sequence
  chemically synthesized
aagtctcaaatgcacagaat

SEQ ID NO: 133552 - DNA, 20 bp, Artificial Sequence
  chemically synthesized
cattcttattctgtgcattt

SEQ ID NO: 133553 - DNA, 20 bp, Artificial Sequence
  chemically synthesized
aaaatcaagtctcaaatgca

SEQ ID NO: 133554 - DNA, 20 bp, Artificial Sequence
  chemically synthesized
atgtttgaaaagataaaatc

SEQ ID NO: 133555 - DNA, 20 bp, Artificial Sequence
  chemically synthesized
caaacaacagaatgtttgaa

SEQ ID NO: 133556 - DNA, 20 bp, Artificial Sequence
  chemically synthesized
aaaattgtctgttcaaacaa

SEQ ID NO: 133557 - DNA, 20 bp, Artificial Sequence
  chemically synthesized
caaacattctgttgtttgaa

SEQ ID NO: 133558 - DNA, 20 bp, Artificial Sequence
  chemically synthesized
acagacaattttctgataac

SEQ ID NO: 133559 - DNA, 20 bp, Artificial Sequence
  chemically synthesized
gtccttgattcacttgttat

SEQ ID NO: 133560 - DNA, 20 bp, Artificial Sequence
  chemically synthesized
tttctgataacaagtgaatc

SEQ ID NO: 133561 - DNA, 20 bp, Artificial Sequence
  chemically synthesized
ttctgataacaagtgaatca

SEQ ID NO: 133562 - DNA, 20 bp, Artificial Sequence
  chemically synthesized
tcgaggaaaggaaaggcagg

SEQ ID NO: 133563 - DNA, 20 bp, Artificial Sequence
  chemically synthesized
ggtcgaggaaaggaaaggca

SEQ ID NO: 133564 - DNA, 20 bp, Artificial Sequence
  chemically synthesized
tggtcgaggaaaggaaaggc

SEQ ID NO: 133565 - DNA, 20 bp, Artificial Sequence
  chemically synthesized
ctggtcgaggaaaggaaagg

SEQ ID NO: 133566 - DNA, 20 bp, Artificial Sequence
  chemically synthesized
gaactggtcgaggaaaggaa

SEQ ID NO: 133567 - DNA, 20 bp, Artificial Sequence
  chemically synthesized
agaactggtcgaggaaagga

SEQ ID NO: 133568 - DNA, 20 bp, Artificial Sequence
  chemically synthesized
acgtagaactggtcgaggaa

SEQ ID NO: 133569 - DNA, 20 bp, Artificial Sequence
  chemically synthesized
aacgtagaactggtcgagga

SEQ ID NO: 133570 - DNA, 20 bp, Artificial Sequence
  chemically synthesized
ctgcctttcctttcctcgac

SEQ ID NO: 133571 - DNA, 20 bp, Artificial Sequence
  chemically synthesized
gaaaaacgtagaactggtcg

SEQ ID NO: 133572 - DNA, 20 bp, Artificial Sequence
  chemically synthesized
agaaaaacgtagaactggtc

SEQ ID NO: 133573 - DNA, 20 bp, Artificial Sequence
  chemically synthesized
ctctcagaaaaacgtagaac

SEQ ID NO: 133574 - DNA, 20 bp, Artificial Sequence
  chemically synthesized
agctggctctcagaaaaacg

SEQ ID NO: 133575 - DNA, 20 bp, Artificial Sequence
  chemically synthesized
gaccagttctacgtttttct

SEQ ID NO: 133576 - DNA, 20 bp, Artificial Sequence
  chemically synthesized
ccagttctacgtttttctga

SEQ ID NO: 133577 - DNA, 20 bp, Artificial Sequence
  chemically synthesized
ttctacgtttttctgagagc

SEQ ID NO: 133578 - DNA, 20 bp, Artificial Sequence
  chemically synthesized
cctgggccacagctggctct

SEQ ID NO: 133579 - DNA, 20 bp, Artificial Sequence
  chemically synthesized
gtttttctgagagccagctg

SEQ ID NO: 133580 - DNA, 20 bp, Artificial Sequence
  chemically synthesized
ctgttgccctgggccacagc

SEQ ID NO: 133581 - DNA, 20 bp, Artificial Sequence
  chemically synthesized
tctgagagccagctgtggcc

SEQ ID NO: 133582 - DNA, 20 bp, Artificial Sequence
  chemically synthesized
ctgagagccagctgtggccc

SEQ ID NO: 133583 - DNA, 20 bp, Artificial Sequence
  chemically synthesized
tgagagccagctgtggccca

SEQ ID NO: 133584 - DNA, 20 bp, Artificial Sequence
  chemically synthesized
ggaactgttgccctgggcca

SEQ ID NO: 133585 - DNA, 20 bp, Artificial Sequence
  chemically synthesized
ccagctgtggcccagggcaa

SEQ ID NO: 133586 - DNA, 20 bp, Artificial Sequence
  chemically synthesized
aaccatggaactgttgccct

SEQ ID NO: 133587 - DNA, 20 bp, Artificial Sequence
  chemically synthesized
gaaccatggaactgttgccc

SEQ ID NO: 133588 - DNA, 20 bp, Artificial Sequence
  chemically synthesized
ggcccagggcaacagttcca

SEQ ID NO: 133589 - DNA, 20 bp, Artificial Sequence
  chemically synthesized
tctctttcatacaggaacca

SEQ ID NO: 133590 - DNA, 20 bp, Artificial Sequence
  chemically synthesized
gttccatggttcctgtatga

SEQ ID NO: 133591 - DNA, 20 bp, Artificial Sequence
  chemically synthesized
cagatttttctctttcatac

SEQ ID NO: 133592 - DNA, 20 bp, Artificial Sequence
  chemically synthesized
tccatggttcctgtatgaaa

SEQ ID NO: 133593 - DNA, 20 bp, Artificial Sequence
  chemically synthesized
tcagatttttctctttcata

SEQ ID NO: 133594 - DNA, 20 bp, Artificial Sequence
  chemically synthesized
ataagcctgacaattggagt

SEQ ID NO: 133595 - DNA, 20 bp, Artificial Sequence
  chemically synthesized
aaaaatctgactccaattgt

SEQ ID NO: 133596 - DNA, 20 bp, Artificial Sequence
  chemically synthesized
tacaataagcctgacaattg

SEQ ID NO: 133597 - DNA, 20 bp, Artificial Sequence
  chemically synthesized
aaaatctgactccaattgtc

SEQ ID NO: 133598 - DNA, 20 bp, Artificial Sequence
  chemically synthesized
gatacaataagcctgacaat

SEQ ID NO: 133599 - DNA, 20 bp, Artificial Sequence
  chemically synthesized
aaggcagtggtagatacaat

SEQ ID NO: 133600 - DNA, 20 bp, Artificial Sequence
  chemically synthesized
caaaggatacaaggcagtgg

SEQ ID NO: 133601 - DNA, 20 bp, Artificial Sequence
  chemically synthesized
ctacaaaggatacaaggcag

SEQ ID NO: 133602 - DNA, 20 bp, Artificial Sequence
  chemically synthesized
cccctacaaaggatacaagg

SEQ ID NO: 133603 - DNA, 20 bp, Artificial Sequence
  chemically synthesized
ggtcccctacaaaggataca

SEQ ID NO: 133604 - DNA, 20 bp, Artificial Sequence
  chemically synthesized
gggtcccctacaaaggatac

SEQ ID NO: 133605 - DNA, 20 bp, Artificial Sequence
  chemically synthesized
ccactgccttgtatcctttg

SEQ ID NO: 133606 - DNA, 20 bp, Artificial Sequence
  chemically synthesized
cactgccttgtatcctttgt

SEQ ID NO: 133607 - DNA, 20 bp, Artificial Sequence
  chemically synthesized
actgccttgtatcctttgta

SEQ ID NO: 133608 - DNA, 20 bp, Artificial Sequence
  chemically synthesized
ctgccttgtatcctttgtag

SEQ ID NO: 133609 - DNA, 20 bp, Artificial Sequence
  chemically synthesized
ccattgggggtcccctacaa

SEQ ID NO: 133610 - DNA, 20 bp, Artificial Sequence
  chemically synthesized
gccattgggggtcccctaca

SEQ ID NO: 133611 - DNA, 20 bp, Artificial Sequence
  chemically synthesized
cctttgtaggggacccccaa

SEQ ID NO: 133612 - DNA, 20 bp, Artificial Sequence
  chemically synthesized
cataggagtaaagccattgg

SEQ ID NO: 133613 - DNA, 20 bp, Artificial Sequence
  chemically synthesized
tcataggagtaaagccattg

SEQ ID NO: 133614 - DNA, 20 bp, Artificial Sequence
  chemically synthesized
gtcataggagtaaagccatt

SEQ ID NO: 133615 - DNA, 20 bp, Artificial Sequence
  chemically synthesized
ggtcataggagtaaagccat

SEQ ID NO: 133616 - DNA, 20 bp, Artificial Sequence
  chemically synthesized
aaccctgggtcataggagta

SEQ ID NO: 133617 - DNA, 20 bp, Artificial Sequence
  chemically synthesized
agtctaaccctgggtcatag

SEQ ID NO: 133618 - DNA, 20 bp, Artificial Sequence
  chemically synthesized
atggctttactcctatgacc

SEQ ID NO: 133619 - DNA, 20 bp, Artificial Sequence
  chemically synthesized
tggctttactcctatgaccc

SEQ ID NO: 133620 - DNA, 20 bp, Artificial Sequence
  chemically synthesized
taagtctaaccctgggtcat

SEQ ID NO: 133621 - DNA, 20 bp, Artificial Sequence
  chemically synthesized
ggctttactcctatgaccca

SEQ ID NO: 133622 - DNA, 20 bp, Artificial Sequence
  chemically synthesized
ctaagtctaaccctgggtca

SEQ ID NO: 133623 - DNA, 20 bp, Artificial Sequence
  chemically synthesized
ttactcctatgacccagggt

SEQ ID NO: 133624 - DNA, 20 bp, Artificial Sequence
  chemically synthesized
ccatctctaagtctaaccct

SEQ ID NO: 133625 - DNA, 20 bp, Artificial Sequence
  chemically synthesized
accatctctaagtctaaccc

SEQ ID NO: 133626 - DNA, 20 bp, Artificial Sequence
  chemically synthesized
ctatgacccagggttagact

SEQ ID NO: 133627 - DNA, 20 bp, Artificial Sequence
  chemically synthesized
atgacccagggttagactta

SEQ ID NO: 133628 - DNA, 20 bp, Artificial Sequence
  chemically synthesized
cccagggttagacttagaga

SEQ ID NO: 133629 - DNA, 20 bp, Artificial Sequence
  chemically synthesized
tttggcttattaccatctct

SEQ ID NO: 133630 - DNA, 20 bp, Artificial Sequence
  chemically synthesized
ttagacttagagatggtaat

SEQ ID NO: 133631 - DNA, 20 bp, Artificial Sequence
  chemically synthesized
tggtaataagccaaaccatg

SEQ ID NO: 133632 - DNA, 20 bp, Artificial Sequence
  chemically synthesized
tttccaattactgcatggtt

SEQ ID NO: 133633 - DNA, 20 bp, Artificial Sequence
  chemically synthesized
cagtgtttccaattactgca

SEQ ID NO: 133634 - DNA, 20 bp, Artificial Sequence
  chemically synthesized
aagccaaaccatgcagtaat

SEQ ID NO: 133635 - DNA, 20 bp, Artificial Sequence
  chemically synthesized
gtaattggaaacactgaaaa

SEQ ID NO: 133636 - DNA, 20 bp, Artificial Sequence
  chemically synthesized
tatacagaattttctatttt

SEQ ID NO: 133637 - DNA, 20 bp, Artificial Sequence
  chemically synthesized
aagataaagcaaaatgtata

SEQ ID NO: 133638 - DNA, 20 bp, Artificial Sequence
  chemically synthesized
tttctttcaatattaagata

SEQ ID NO: 133639 - DNA, 20 bp, Artificial Sequence
  chemically synthesized
tgatattttctttcaatatt

SEQ ID NO: 133640 - DNA, 20 bp, Artificial Sequence
  chemically synthesized
ttgctttatcttaatattga

SEQ ID NO: 133641 - DNA, 20 bp, Artificial Sequence
  chemically synthesized
ttaatattgaaagaaaatat

SEQ ID NO: 133642 - DNA, 20 bp, Artificial Sequence
  chemically synthesized
aatattgaaagaaaatatca

SEQ ID NO: 133643 - DNA, 20 bp, Artificial Sequence
  chemically synthesized
gagcatttcatttattcatt

SEQ ID NO: 133644 - DNA, 20 bp, Artificial Sequence
  chemically synthesized
gcatttcatttattcattca

SEQ ID NO: 133645 - DNA, 20 bp, Artificial Sequence
  chemically synthesized
attcattcagagaatcttga

SEQ ID NO: 133646 - DNA, 20 bp, Artificial Sequence
  chemically synthesized
aaaaaaataggttttccatc

SEQ ID NO: 133647 - DNA, 20 bp, Artificial Sequence
  chemically synthesized
tcgagggccttgaaaaaaat

SEQ ID NO: 133648 - DNA, 20 bp, Artificial Sequence
  chemically synthesized
gtcgagggccttgaaaaaaa

SEQ ID NO: 133649 - DNA, 20 bp, Artificial Sequence
  chemically synthesized
atggaaaacctatttttttc

SEQ ID NO: 133650 - DNA, 20 bp, Artificial Sequence
  chemically synthesized
tggaaaacctatttttttca

SEQ ID NO: 133651 - DNA, 20 bp, Artificial Sequence
  chemically synthesized
tttttttcaaggccctcgac

SEQ ID NO: 133652 - DNA, 20 bp, Artificial Sequence
  chemically synthesized
ttctcttaaattccagtcga

SEQ ID NO: 133653 - DNA, 20 bp, Artificial Sequence
  chemically synthesized
cttctcttaaattccagtcg

SEQ ID NO: 133654 - DNA, 20 bp, Artificial Sequence
  chemically synthesized
gcttctcttaaattccagtc

SEQ ID NO: 133655 - DNA, 20 bp, Artificial Sequence
  chemically synthesized
aaggccctcgactggaattt

SEQ ID NO: 133656 - DNA, 20 bp, Artificial Sequence
  chemically synthesized
gtgttgcttctcttaaattc

SEQ ID NO: 133657 - DNA, 20 bp, Artificial Sequence
  chemically synthesized
ggccctcgactggaatttaa

SEQ ID NO: 133658 - DNA, 20 bp, Artificial Sequence
  chemically synthesized
cctcgactggaatttaagag

SEQ ID NO: 133659 - DNA, 20 bp, Artificial Sequence
  chemically synthesized
tttaagagaagcaacactgt

SEQ ID NO: 133660 - DNA, 20 bp, Artificial Sequence
  chemically synthesized
ttaagagaagcaacactgtc

SEQ ID NO: 133661 - DNA, 20 bp, Artificial Sequence
  chemically synthesized
gagaagcaacactgtcagga

SEQ ID NO: 133662 - DNA, 20 bp, Artificial Sequence
  chemically synthesized
gagaaatttgtctttcctga

SEQ ID NO: 133663 - DNA, 20 bp, Artificial Sequence
  chemically synthesized
tcaggaaagacaaatttctc

SEQ ID NO: 133664 - DNA, 20 bp, Artificial Sequence
  chemically synthesized
gaaagacaaatttctcgagc

SEQ ID NO: 133665 - DNA, 20 bp, Artificial Sequence
  chemically synthesized
agaatttttagaacttgctc

SEQ ID NO: 133666 - DNA, 20 bp, Artificial Sequence
  chemically synthesized
atgtctatgcacagaatttt

SEQ ID NO: 133667 - DNA, 20 bp, Artificial Sequence
  chemically synthesized
agttctaaaaattctgtgca

SEQ ID NO: 133668 - DNA, 20 bp, Artificial Sequence
  chemically synthesized
actgttctaatgtctatgca

SEQ ID NO: 133669 - DNA, 20 bp, Artificial Sequence
  chemically synthesized
aaaattctgtgcatagacat

SEQ ID NO: 133670 - DNA, 20 bp, Artificial Sequence
  chemically synthesized
tctgtgcatagacattagaa

SEQ ID NO: 133671 - DNA, 20 bp, Artificial Sequence
  chemically synthesized
gaaaatgggtgcacgaatat

SEQ ID NO: 133672 - DNA, 20 bp, Artificial Sequence
  chemically synthesized
atattcgtgcacccattttc

SEQ ID NO: 133673 - DNA, 20 bp, Artificial Sequence
  chemically synthesized
aattttcacatctagaaaat

SEQ ID NO: 133674 - DNA, 20 bp, Artificial Sequence
  chemically synthesized
aaattttcacatctagaaaa

SEQ ID NO: 133675 - DNA, 20 bp, Artificial Sequence
  chemically synthesized
agtaaaaaaattttcacatc

SEQ ID NO: 133676 - DNA, 20 bp, Artificial Sequence
  chemically synthesized
tgaaaatttttttactctta

SEQ ID NO: 133677 - DNA, 20 bp, Artificial Sequence
  chemically synthesized
aatttttttactcttatagc

SEQ ID NO: 133678 - DNA, 20 bp, Artificial Sequence
  chemically synthesized
tagtgccctgctagctataa

SEQ ID NO: 133679 - DNA, 20 bp, Artificial Sequence
  chemically synthesized
gatagtgccctgctagctat

SEQ ID NO: 133680 - DNA, 20 bp, Artificial Sequence
  chemically synthesized
ttttttactcttatagctag

SEQ ID NO: 133681 - DNA, 20 bp, Artificial Sequence
  chemically synthesized
tttttactcttatagctagc

SEQ ID NO: 133682 - DNA, 20 bp, Artificial Sequence
  chemically synthesized
ttttactcttatagctagca

SEQ ID NO: 133683 - DNA, 20 bp, Artificial Sequence
  chemically synthesized
tgacaatgatagtgccctgc

SEQ ID NO: 133684 - DNA, 20 bp, Artificial Sequence
  chemically synthesized
ttctcaagggttgacaatga

SEQ ID NO: 133685 - DNA, 20 bp, Artificial Sequence
  chemically synthesized
cactatcattgtcaaccctt

SEQ ID NO: 133686 - DNA, 20 bp, Artificial Sequence
  chemically synthesized
tatcattgtcaacccttgag

SEQ ID NO: 133687 - DNA, 20 bp, Artificial Sequence
  chemically synthesized
atcattgtcaacccttgaga

SEQ ID NO: 133688 - DNA, 20 bp, Artificial Sequence
  chemically synthesized
gttccactaggccttctcaa

SEQ ID NO: 133689 - DNA, 20 bp, Artificial Sequence
  chemically synthesized
agttccactaggccttctca

SEQ ID NO: 133690 - DNA, 20 bp, Artificial Sequence
  chemically synthesized
gagttccactaggccttctc

SEQ ID NO: 133691 - DNA, 20 bp, Artificial Sequence
  chemically synthesized
tgtcaacccttgagaaggcc

SEQ ID NO: 133692 - DNA, 20 bp, Artificial Sequence
  chemically synthesized
caacccttgagaaggcctag

SEQ ID NO: 133693 - DNA, 20 bp, Artificial Sequence
  chemically synthesized
tcattattgagagttccact

SEQ ID NO: 133694 - DNA, 20 bp, Artificial Sequence
  chemically synthesized
ctcattattgagagttccac

SEQ ID NO: 133695 - DNA, 20 bp, Artificial Sequence
  chemically synthesized
tcaactatcctcattattga

SEQ ID NO: 133696 - DNA, 20 bp, Artificial Sequence
  chemically synthesized
ctagtggaactctcaataat

SEQ ID NO: 133697 - DNA, 20 bp, Artificial Sequence
  chemically synthesized
tagtggaactctcaataatg

SEQ ID NO: 133698 - DNA, 20 bp, Artificial Sequence
  chemically synthesized
aatcaactatcctcattatt

SEQ ID NO: 133699 - DNA, 20 bp, Artificial Sequence
  chemically synthesized
ggaactctcaataatgagga

SEQ ID NO: 133700 - DNA, 20 bp, Artificial Sequence
  chemically synthesized
atgaggatagttgattgtta

SEQ ID NO: 133701 - DNA, 20 bp, Artificial Sequence
  chemically synthesized
gattgttatggactgaatgc

SEQ ID NO: 133702 - DNA, 20 bp, Artificial Sequence
  chemically synthesized
gcgggggggatgccagcatt

SEQ ID NO: 133703 - DNA, 20 bp, Artificial Sequence
  chemically synthesized
ttagccggcgggggggatgc

SEQ ID NO: 133704 - DNA, 20 bp, Artificial Sequence
  chemically synthesized
aatgctggcatcccccccgc

SEQ ID NO: 133705 - DNA, 20 bp, Artificial Sequence
  chemically synthesized
acaaattttagccggcgggg

SEQ ID NO: 133706 - DNA, 20 bp, Artificial Sequence
  chemically synthesized
tacaaattttagccggcggg

SEQ ID NO: 133707 - DNA, 20 bp, Artificial Sequence
  chemically synthesized
atacaaattttagccggcgg

SEQ ID NO: 133708 - DNA, 20 bp, Artificial Sequence
  chemically synthesized
catacaaattttagccggcg

SEQ ID NO: 133709 - DNA, 20 bp, Artificial Sequence
  chemically synthesized
acatacaaattttagccggc

SEQ ID NO: 133710 - DNA, 20 bp, Artificial Sequence
  chemically synthesized
aacatacaaattttagccgg

SEQ ID NO: 133711 - DNA, 20 bp, Artificial Sequence
  chemically synthesized
ttcaacatacaaattttagc

SEQ ID NO: 133712 - DNA, 20 bp, Artificial Sequence
  chemically synthesized
gcacttcaacatacaaattt

SEQ ID NO: 133713 - DNA, 20 bp, Artificial Sequence
  chemically synthesized
cggctaaaatttgtatgttg

SEQ ID NO: 133714 - DNA, 20 bp, Artificial Sequence
  chemically synthesized
tccaaatatccattgggggt

SEQ ID NO: 133715 - DNA, 20 bp, Artificial Sequence
  chemically synthesized
gttgaagtgctaacccccaa

SEQ ID NO: 133716 - DNA, 20 bp, Artificial Sequence
  chemically synthesized
cacctccaaatatccattgg

SEQ ID NO: 133717 - DNA, 20 bp, Artificial Sequence
  chemically synthesized
ccacctccaaatatccattg

SEQ ID NO: 133718 - DNA, 20 bp, Artificial Sequence
  chemically synthesized
cccacctccaaatatccatt

SEQ ID NO: 133719 - DNA, 20 bp, Artificial Sequence
  chemically synthesized
ccccacctccaaatatccat

SEQ ID NO: 133720 - DNA, 20 bp, Artificial Sequence
  chemically synthesized
gctaacccccaatggatatt

SEQ ID NO: 133721 - DNA, 20 bp, Artificial Sequence
  chemically synthesized
taacccccaatggatatttg

SEQ ID NO: 133722 - DNA, 20 bp, Artificial Sequence
  chemically synthesized
aacccccaatggatatttgg

SEQ ID NO: 133723 - DNA, 20 bp, Artificial Sequence
  chemically synthesized
ccccaatggatatttggagg

SEQ ID NO: 133724 - DNA, 20 bp, Artificial Sequence
  chemically synthesized
cccaatggatatttggaggt

SEQ ID NO: 133725 - DNA, 20 bp, Artificial Sequence
  chemically synthesized
ccaatggatatttggaggtg

SEQ ID NO: 133726 - DNA, 20 bp, Artificial Sequence
  chemically synthesized
tatttggaggtggggccttt

SEQ ID NO: 133727 - DNA, 20 bp, Artificial Sequence
  chemically synthesized
taacccttattatttctcaa

SEQ ID NO: 133728 - DNA, 20 bp, Artificial Sequence
  chemically synthesized
ctaacccttattatttctca

SEQ ID NO: 133729 - DNA, 20 bp, Artificial Sequence
  chemically synthesized
tggggcctttgagaaataat

SEQ ID NO: 133730 - DNA, 20 bp, Artificial Sequence
  chemically synthesized
ggggcctttgagaaataata

SEQ ID NO: 133731 - DNA, 20 bp, Artificial Sequence
  chemically synthesized
gggcctttgagaaataataa

SEQ ID NO: 133732 - DNA, 20 bp, Artificial Sequence
  chemically synthesized
ctttgagaaataataagggt

SEQ ID NO: 133733 - DNA, 20 bp, Artificial Sequence
  chemically synthesized
agaaataataagggttagat

SEQ ID NO: 133734 - DNA, 20 bp, Artificial Sequence
  chemically synthesized
gaaataataagggttagatg

SEQ ID NO: 133735 - DNA, 20 bp, Artificial Sequence
  chemically synthesized
ataagggttagatgaggtca

SEQ ID NO: 133736 - DNA, 20 bp, Artificial Sequence
  chemically synthesized
taagggttagatgaggtcat

SEQ ID NO: 133737 - DNA, 20 bp, Artificial Sequence
  chemically synthesized
gttagatgaggtcataggtt

SEQ ID NO: 133738 - DNA, 20 bp, Artificial Sequence
  chemically synthesized
ttagatgaggtcataggttg

SEQ ID NO: 133739 - DNA, 20 bp, Artificial Sequence
  chemically synthesized
taggttgaggcctccataat

SEQ ID NO: 133740 - DNA, 20 bp, Artificial Sequence
  chemically synthesized
ggacactaatccaattatgg

SEQ ID NO: 133741 - DNA, 20 bp, Artificial Sequence
  chemically synthesized
aggacactaatccaattatg

SEQ ID NO: 133742 - DNA, 20 bp, Artificial Sequence
  chemically synthesized
aaaggacactaatccaatta

SEQ ID NO: 133743 - DNA, 20 bp, Artificial Sequence
  chemically synthesized
tgaggcctccataattggat

SEQ ID NO: 133744 - DNA, 20 bp, Artificial Sequence
  chemically synthesized
aattggattagtgtcctttt

SEQ ID NO: 133745 - DNA, 20 bp, Artificial Sequence
  chemically synthesized
tggattagtgtccttttaag

SEQ ID NO: 133746 - DNA, 20 bp, Artificial Sequence
  chemically synthesized
ctcttcttgctcttcttaaa

SEQ ID NO: 133747 - DNA, 20 bp, Artificial Sequence
  chemically synthesized
gattagtgtccttttaagaa

SEQ ID NO: 133748 - DNA, 20 bp, Artificial Sequence
  chemically synthesized
tctcttcttgctcttcttaa

SEQ ID NO: 133749 - DNA, 20 bp, Artificial Sequence
  chemically synthesized
agtgtccttttaagaagagc

SEQ ID NO: 133750 - DNA, 20 bp, Artificial Sequence
  chemically synthesized
gtccttttaagaagagcaag

SEQ ID NO: 133751 - DNA, 20 bp, Artificial Sequence
  chemically synthesized
ccttttaagaagagcaagaa

SEQ ID NO: 133752 - DNA, 20 bp, Artificial Sequence
  chemically synthesized
ttttaagaagagcaagaaga

SEQ ID NO: 133753 - DNA, 20 bp, Artificial Sequence
  chemically synthesized
agaagagcaagaagagagac

SEQ ID NO: 133754 - DNA, 20 bp, Artificial Sequence
  chemically synthesized
aagagcaagaagagagacta

SEQ ID NO: 133755 - DNA, 20 bp, Artificial Sequence
  chemically synthesized
ggtggtgcagagaggtactc

SEQ ID NO: 133756 - DNA, 20 bp, Artificial Sequence
  chemically synthesized
gggagagaggtggtgcagag

SEQ ID NO: 133757 - DNA, 20 bp, Artificial Sequence
  chemically synthesized
ggggagagaggtggtgcaga

SEQ ID NO: 133758 - DNA, 20 bp, Artificial Sequence
  chemically synthesized
ttggggagagaggtggtgca

SEQ ID NO: 133759 - DNA, 20 bp, Artificial Sequence
  chemically synthesized
tgttggggagagaggtggtg

SEQ ID NO: 133760 - DNA, 20 bp, Artificial Sequence
  chemically synthesized
tcgtatgttggggagagagg

SEQ ID NO: 133761 - DNA, 20 bp, Artificial Sequence
  chemically synthesized
tcctcgtatgttggggagag

SEQ ID NO: 133762 - DNA, 20 bp, Artificial Sequence
  chemically synthesized
atcctcgtatgttggggaga

SEQ ID NO: 133763 - DNA, 20 bp, Artificial Sequence
  chemically synthesized
gtatcctcgtatgttgggga

SEQ ID NO: 133764 - DNA, 20 bp, Artificial Sequence
  chemically synthesized
ctgtatcctcgtatgttggg

SEQ ID NO: 133765 - DNA, 20 bp, Artificial Sequence
  chemically synthesized
tgctgtatcctcgtatgttg

SEQ ID NO: 133766 - DNA, 20 bp, Artificial Sequence
  chemically synthesized
cacctctctccccaacatac

SEQ ID NO: 133767 - DNA, 20 bp, Artificial Sequence
  chemically synthesized
ttgctgtatcctcgtatgtt

SEQ ID NO: 133768 - DNA, 20 bp, Artificial Sequence
  chemically synthesized
acctctctccccaacatacg

SEQ ID NO: 133769 - DNA, 20 bp, Artificial Sequence
  chemically synthesized
cttgctgtatcctcgtatgt

SEQ ID NO: 133770 - DNA, 20 bp, Artificial Sequence
  chemically synthesized
ctccccaacatacgaggata

SEQ ID NO: 133771 - DNA, 20 bp, Artificial Sequence
  chemically synthesized
ccaacatacgaggatacagc

SEQ ID NO: 133772 - DNA, 20 bp, Artificial Sequence
  chemically synthesized
acatacgaggatacagcaag

SEQ ID NO: 133773 - DNA, 20 bp, Artificial Sequence
  chemically synthesized
tacgaggatacagcaagaag

SEQ ID NO: 133774 - DNA, 20 bp, Artificial Sequence
  chemically synthesized
acgaggatacagcaagaaga

SEQ ID NO: 133775 - DNA, 20 bp, Artificial Sequence
  chemically synthesized
agcaagaagaaggttctcac

SEQ ID NO: 133776 - DNA, 20 bp, Artificial Sequence
  chemically synthesized
gcaagaagaaggttctcacc

SEQ ID NO: 133777 - DNA, 20 bp, Artificial Sequence
  chemically synthesized
tgacagatgtggttcctggt

SEQ ID NO: 133778 - DNA, 20 bp, Artificial Sequence
  chemically synthesized
gtgctgacagatgtggttcc

SEQ ID NO: 133779 - DNA, 20 bp, Artificial Sequence
  chemically synthesized
tcaccaggaaccacatctgt

SEQ ID NO: 133780 - DNA, 20 bp, Artificial Sequence
  chemically synthesized
gatcatggtgctgacagatg

SEQ ID NO: 133781 - DNA, 20 bp, Artificial Sequence
  chemically synthesized
gtacaagatcatggtgctga

SEQ ID NO: 133782 - DNA, 20 bp, Artificial Sequence
  chemically synthesized
ggttgagaagtacaagatca

SEQ ID NO: 133783 - DNA, 20 bp, Artificial Sequence
  chemically synthesized
ttctggaggttgagaagtac

SEQ ID NO: 133784 - DNA, 20 bp, Artificial Sequence
  chemically synthesized
tcacggttctggaggttgag

SEQ ID NO: 133785 - DNA, 20 bp, Artificial Sequence
  chemically synthesized
atcttgtacttctcaacctc

SEQ ID NO: 133786 - DNA, 20 bp, Artificial Sequence
  chemically synthesized
ttttcacggttctggaggtt

SEQ ID NO: 133787 - DNA, 20 bp, Artificial Sequence
  chemically synthesized
gttgtttttcacggttctgg

SEQ ID NO: 133788 - DNA, 20 bp, Artificial Sequence
  chemically synthesized
agttgtttttcacggttctg

SEQ ID NO: 133789 - DNA, 20 bp, Artificial Sequence
  chemically synthesized
gcagttgtttttcacggttc

SEQ ID NO: 133790 - DNA, 20 bp, Artificial Sequence
  chemically synthesized
caacaggcagttgtttttca

SEQ ID NO: 133791 - DNA, 20 bp, Artificial Sequence
  chemically synthesized
tgggtggcttaaacaacagg

SEQ ID NO: 133792 - DNA, 20 bp, Artificial Sequence
  chemically synthesized
aaaacaactgcctgttgttt

SEQ ID NO: 133793 - DNA, 20 bp, Artificial Sequence
  chemically synthesized
gactgggtggcttaaacaac

SEQ ID NO: 133794 - DNA, 20 bp, Artificial Sequence
  chemically synthesized
agactgggtggcttaaacaa

SEQ ID NO: 133795 - DNA, 20 bp, Artificial Sequence
  chemically synthesized
tgcctgttgtttaagccacc

SEQ ID NO: 133796 - DNA, 20 bp, Artificial Sequence
  chemically synthesized
aaataatgccatagactggg

SEQ ID NO: 133797 - DNA, 20 bp, Artificial Sequence
  chemically synthesized
tgtttaagccacccagtcta

SEQ ID NO: 133798 - DNA, 20 bp, Artificial Sequence
  chemically synthesized
ataaaataatgccatagact

SEQ ID NO: 133799 - DNA, 20 bp, Artificial Sequence
  chemically synthesized
tataaaataatgccatagac

SEQ ID NO: 133800 - DNA, 20 bp, Artificial Sequence
  chemically synthesized
gctgctataaaataatgcca

SEQ ID NO: 133801 - DNA, 20 bp, Artificial Sequence
  chemically synthesized
cagtctatggcattatttta

SEQ ID NO: 133802 - DNA, 20 bp, Artificial Sequence
  chemically synthesized
tctatggcattattttatag

SEQ ID NO: 133803 - DNA, 20 bp, Artificial Sequence
  chemically synthesized
gcattattttatagcagcct

SEQ ID NO: 133804 - DNA, 20 bp, Artificial Sequence
  chemically synthesized
attaatgtcttagtaagctc

SEQ ID NO: 133805 - DNA, 20 bp, Artificial Sequence
  chemically synthesized
tattaatgtcttagtaagct

SEQ ID NO: 133806 - DNA, 20 bp, Artificial Sequence
  chemically synthesized
tatagcagcctgagcttact

SEQ ID NO: 133807 - DNA, 20 bp, Artificial Sequence
  chemically synthesized
acaaatattaatgtcttagt

SEQ ID NO: 133808 - DNA, 20 bp, Artificial Sequence
  chemically synthesized
ctatacaaatattaatgtct

SEQ ID NO: 133809 - DNA, 20 bp, Artificial Sequence
  chemically synthesized
ctaagacattaatatttgta

SEQ ID NO: 133810 - DNA, 20 bp, Artificial Sequence
  chemically synthesized
gacattaatatttgtatagt

SEQ ID NO: 133811 - DNA, 20 bp, Artificial Sequence
  chemically synthesized
attaatatttgtatagtgag

SEQ ID NO: 133812 - DNA, 20 bp, Artificial Sequence
  chemically synthesized
atagtgagtagccatttgaa

SEQ ID NO: 133813 - DNA, 20 bp, Artificial Sequence
  chemically synthesized
tagtgagtagccatttgaaa

SEQ ID NO: 133814 - DNA, 20 bp, Artificial Sequence
  chemically synthesized
atggaaaagtccttttcaaa

SEQ ID NO: 133815 - DNA, 20 bp, Artificial Sequence
  chemically synthesized
caatgaaatgacgcatggaa

SEQ ID NO: 133816 - DNA, 20 bp, Artificial Sequence
  chemically synthesized
ggattcaatgaaatgacgca

SEQ ID NO: 133817 - DNA, 20 bp, Artificial Sequence
  chemically synthesized
ttccatactagtttggtgtt

SEQ ID NO: 133818 - DNA, 20 bp, Artificial Sequence
  chemically synthesized
cttccatactagtttggtgt

SEQ ID NO: 133819 - DNA, 20 bp, Artificial Sequence
  chemically synthesized
attgaatcctaacaccaaac

SEQ ID NO: 133820 - DNA, 20 bp, Artificial Sequence
  chemically synthesized
tgataacttccatactagtt

SEQ ID NO: 133821 - DNA, 20 bp, Artificial Sequence
  chemically synthesized
atcctaacaccaaactagta

SEQ ID NO: 133822 - DNA, 20 bp, Artificial Sequence
  chemically synthesized
ctaacaccaaactagtatgg

SEQ ID NO: 133823 - DNA, 20 bp, Artificial Sequence
  chemically synthesized
gatcctgataacttccatac

SEQ ID NO: 133824 - DNA, 20 bp, Artificial Sequence
  chemically synthesized
caaactagtatggaagttat

SEQ ID NO: 133825 - DNA, 20 bp, Artificial Sequence
  chemically synthesized
aaactagtatggaagttatc

SEQ ID NO: 133826 - DNA, 20 bp, Artificial Sequence
  chemically synthesized
tatggaagttatcaggatcc

SEQ ID NO: 133827 - DNA, 20 bp, Artificial Sequence
  chemically synthesized
ttatcaggatcccagtttta

SEQ ID NO: 133828 - DNA, 20 bp, Artificial Sequence
  chemically synthesized
attttctcatctgtaaaact

SEQ ID NO: 133829 - DNA, 20 bp, Artificial Sequence
  chemically synthesized
aattttctcatctgtaaaac

SEQ ID NO: 133830 - DNA, 20 bp, Artificial Sequence
  chemically synthesized
aggatcccagttttacagat

SEQ ID NO: 133831 - DNA, 20 bp, Artificial Sequence
  chemically synthesized
cagatgagaaaattaactgt

SEQ ID NO: 133832 - DNA, 20 bp, Artificial Sequence
  chemically synthesized
gatgagaaaattaactgttg

SEQ ID NO: 133833 - DNA, 20 bp, Artificial Sequence
  chemically synthesized
tgagaaaattaactgttgga

SEQ ID NO: 133834 - DNA, 20 bp, Artificial Sequence
  chemically synthesized
aaattatttaatctctccaa

SEQ ID NO: 133835 - DNA, 20 bp, Artificial Sequence
  chemically synthesized
agagattaaataatttgcca

SEQ ID NO: 133836 - DNA, 20 bp, Artificial Sequence
  chemically synthesized
gagattaaataatttgccat

SEQ ID NO: 133837 - DNA, 20 bp, Artificial Sequence
  chemically synthesized
cttagtgacagtgggaccca

SEQ ID NO: 133838 - DNA, 20 bp, Artificial Sequence
  chemically synthesized
tctgcccccttagtgacagt

SEQ ID NO: 133839 - DNA, 20 bp, Artificial Sequence
  chemically synthesized
ctctgcccccttagtgacag

SEQ ID NO: 133840 - DNA, 20 bp, Artificial Sequence
  chemically synthesized
ccatgggtcccactgtcact

SEQ ID NO: 133841 - DNA, 20 bp, Artificial Sequence
  chemically synthesized
catgggtcccactgtcacta

SEQ ID NO: 133842 - DNA, 20 bp, Artificial Sequence
  chemically synthesized
atgggtcccactgtcactaa

SEQ ID NO: 133843 - DNA, 20 bp, Artificial Sequence
  chemically synthesized
tggctctgcccccttagtga

SEQ ID NO: 133844 - DNA, 20 bp, Artificial Sequence
  chemically synthesized
tgggtcccactgtcactaag

SEQ ID NO: 133845 - DNA, 20 bp, Artificial Sequence
  chemically synthesized
gggtcccactgtcactaagg

SEQ ID NO: 133846 - DNA, 20 bp, Artificial Sequence
  chemically synthesized
tcccactgtcactaaggggg

SEQ ID NO: 133847 - DNA, 20 bp, Artificial Sequence
  chemically synthesized
aagcactggctctgccccct

SEQ ID NO: 133848 - DNA, 20 bp, Artificial Sequence
  chemically synthesized
ccactgtcactaagggggca

SEQ ID NO: 133849 - DNA, 20 bp, Artificial Sequence
  chemically synthesized
tgtcactaagggggcagagc

SEQ ID NO: 133850 - DNA, 20 bp, Artificial Sequence
  chemically synthesized
aagggggcagagccagtgct

SEQ ID NO: 133851 - DNA, 20 bp, Artificial Sequence
  chemically synthesized
agagcacttggtccaagcac

SEQ ID NO: 133852 - DNA, 20 bp, Artificial Sequence
  chemically synthesized
gcagagccagtgcttggacc

SEQ ID NO: 133853 - DNA, 20 bp, Artificial Sequence
  chemically synthesized
aaaataagagcacttggtcc

SEQ ID NO: 133854 - DNA, 20 bp, Artificial Sequence
  chemically synthesized
gaatctaaaataagagcact

SEQ ID NO: 133855 - DNA, 20 bp, Artificial Sequence
  chemically synthesized
tggaccaagtgctcttattt

SEQ ID NO: 133856 - DNA, 20 bp, Artificial Sequence
  chemically synthesized
cagcactgaatctaaaataa

SEQ ID NO: 133857 - DNA, 20 bp, Artificial Sequence
  chemically synthesized
aacagcactgaatctaaaat

SEQ ID NO: 133858 - DNA, 20 bp, Artificial Sequence
  chemically synthesized
aagtgctcttattttagatt

SEQ ID NO: 133859 - DNA, 20 bp, Artificial Sequence
  chemically synthesized
ctttagtaatatagtagtaa

SEQ ID NO: 133860 - DNA, 20 bp, Artificial Sequence
  chemically synthesized
ttatttctttagtaatatag

SEQ ID NO: 133861 - DNA, 20 bp, Artificial Sequence
  chemically synthesized
cctttatttctttagtaata

SEQ ID NO: 133862 - DNA, 20 bp, Artificial Sequence
  chemically synthesized
ctgttactactatattacta

SEQ ID NO: 133863 - DNA, 20 bp, Artificial Sequence
  chemically synthesized
ttctttggcctttatttctt

SEQ ID NO: 133864 - DNA, 20 bp, Artificial Sequence
  chemically synthesized
actatattactaaagaaata

SEQ ID NO: 133865 - DNA, 20 bp, Artificial Sequence
  chemically synthesized
ctatattactaaagaaataa

SEQ ID NO: 133866 - DNA, 20 bp, Artificial Sequence
  chemically synthesized
tactaaagaaataaaggcca

SEQ ID NO: 133867 - DNA, 20 bp, Artificial Sequence
  chemically synthesized
cctttatcctggagattctt

SEQ ID NO: 133868 - DNA, 20 bp, Artificial Sequence
  chemically synthesized
aataaaggccaaagaatctc

SEQ ID NO: 133869 - DNA, 20 bp, Artificial Sequence
  chemically synthesized
ataaaggccaaagaatctcc

SEQ ID NO: 133870 - DNA, 20 bp, Artificial Sequence
  chemically synthesized
gccaaagaatctccaggata

SEQ ID NO: 133871 - DNA, 20 bp, Artificial Sequence
  chemically synthesized
caggttctacctttatcctg

SEQ ID NO: 133872 - DNA, 20 bp, Artificial Sequence
  chemically synthesized
ccaaagaatctccaggataa

SEQ ID NO: 133873 - DNA, 20 bp, Artificial Sequence
  chemically synthesized
gacaggttctacctttatcc

SEQ ID NO: 133874 - DNA, 20 bp, Artificial Sequence
  chemically synthesized
aagaatctccaggataaagg

SEQ ID NO: 133875 - DNA, 20 bp, Artificial Sequence
  chemically synthesized
taaaggtagaacctgtcaaa

SEQ ID NO: 133876 - DNA, 20 bp, Artificial Sequence
  chemically synthesized
tgttggtttatccgtttgac

SEQ ID NO: 133877 - DNA, 20 bp, Artificial Sequence
  chemically synthesized
atgttggtttatccgtttga

SEQ ID NO: 133878 - DNA, 20 bp, Artificial Sequence
  chemically synthesized
tcaaacggataaaccaacat

SEQ ID NO: 133879 - DNA, 20 bp, Artificial Sequence
  chemically synthesized
aaacaaatggttgctgatgt

SEQ ID NO: 133880 - DNA, 20 bp, Artificial Sequence
  chemically synthesized
actagaagtcaggaaacaaa

SEQ ID NO: 133881 - DNA, 20 bp, Artificial Sequence
  chemically synthesized
accatttgtttcctgacttc

SEQ ID NO: 133882 - DNA, 20 bp, Artificial Sequence
  chemically synthesized
ctcatataaaactagaagtc

SEQ ID NO: 133883 - DNA, 20 bp, Artificial Sequence
  chemically synthesized
tctcatataaaactagaagt

SEQ ID NO: 133884 - DNA, 20 bp, Artificial Sequence
  chemically synthesized
tttttctcatataaaactag

SEQ ID NO: 133885 - DNA, 20 bp, Artificial Sequence
  chemically synthesized
gcttttttctcatataaaac

SEQ ID NO: 133886 - DNA, 20 bp, Artificial Sequence
  chemically synthesized
cctgacttctagttttatat

SEQ ID NO: 133887 - DNA, 20 bp, Artificial Sequence
  chemically synthesized
tctagttttatatgagaaaa

SEQ ID NO: 133888 - DNA, 20 bp, Artificial Sequence
  chemically synthesized
tcagtggctaaaacaaacag

SEQ ID NO: 133889 - DNA, 20 bp, Artificial Sequence
  chemically synthesized
cttcagtggctaaaacaaac

SEQ ID NO: 133890 - DNA, 20 bp, Artificial Sequence
  chemically synthesized
aaaaaagctcctgtttgttt

SEQ ID NO: 133891 - DNA, 20 bp, Artificial Sequence
  chemically synthesized
acttcagtggctaaaacaaa

SEQ ID NO: 133892 - DNA, 20 bp, Artificial Sequence
  chemically synthesized
cctgtttgttttagccactg

SEQ ID NO: 133893 - DNA, 20 bp, Artificial Sequence
  chemically synthesized
aataaactatattacttcag

SEQ ID NO: 133894 - DNA, 20 bp, Artificial Sequence
  chemically synthesized
ggtaataaactatattactt

SEQ ID NO: 133895 - DNA, 20 bp, Artificial Sequence
  chemically synthesized
ttttagccactgaagtaata

SEQ ID NO: 133896 - DNA, 20 bp, Artificial Sequence
  chemically synthesized
ttaggactcttgttagttga

SEQ ID NO: 133897 - DNA, 20 bp, Artificial Sequence
  chemically synthesized
attaggactcttgttagttg

SEQ ID NO: 133898 - DNA, 20 bp, Artificial Sequence
  chemically synthesized
gtttattaccttcaactaac

SEQ ID NO: 133899 - DNA, 20 bp, Artificial Sequence
  chemically synthesized
ttattaccttcaactaacaa

SEQ ID NO: 133900 - DNA, 20 bp, Artificial Sequence
  chemically synthesized
gtaaccattaggactcttgt

SEQ ID NO: 133901 - DNA, 20 bp, Artificial Sequence
  chemically synthesized
tcaactaacaagagtcctaa

SEQ ID NO: 133902 - DNA, 20 bp, Artificial Sequence
  chemically synthesized
tggactgaggggtaaccatt

SEQ ID NO: 133903 - DNA, 20 bp, Artificial Sequence
  chemically synthesized
ctggactgaggggtaaccat

SEQ ID NO: 133904 - DNA, 20 bp, Artificial Sequence
  chemically synthesized
gagtcctaatggttacccct

SEQ ID NO: 133905 - DNA, 20 bp, Artificial Sequence
  chemically synthesized
ctaatggttacccctcagtc

SEQ ID NO: 133906 - DNA, 20 bp, Artificial Sequence
  chemically synthesized
cacaaaaagactggactgag

SEQ ID NO: 133907 - DNA, 20 bp, Artificial Sequence
  chemically synthesized
acacaaaaagactggactga

SEQ ID NO: 133908 - DNA, 20 bp, Artificial Sequence
  chemically synthesized
tacacaaaaagactggactg

SEQ ID NO: 133909 - DNA, 20 bp, Artificial Sequence
  chemically synthesized
ttacacaaaaagactggact

SEQ ID NO: 133910 - DNA, 20 bp, Artificial Sequence
  chemically synthesized
acctgattacacaaaaagac

SEQ ID NO: 133911 - DNA, 20 bp, Artificial Sequence
  chemically synthesized
tatctacctgattacacaaa

SEQ ID NO: 133912 - DNA, 20 bp, Artificial Sequence
  chemically synthesized
gtccagtctttttgtgtaat

SEQ ID NO: 133913 - DNA, 20 bp, Artificial Sequence
  chemically synthesized
tccagtctttttgtgtaatc

SEQ ID NO: 133914 - DNA, 20 bp, Artificial Sequence
  chemically synthesized
agtctttttgtgtaatcagg

SEQ ID NO: 133915 - DNA, 20 bp, Artificial Sequence
  chemically synthesized
tttttgtgtaatcaggtaga

SEQ ID NO: 133916 - DNA, 20 bp, Artificial Sequence
  chemically synthesized
gtgtaatcaggtagatagta

SEQ ID NO: 133917 - DNA, 20 bp, Artificial Sequence
  chemically synthesized
ttgatttctggattagagga

SEQ ID NO: 133918 - DNA, 20 bp, Artificial Sequence
  chemically synthesized
agtatagctttcctctaatc

SEQ ID NO: 133919 - DNA, 20 bp, Artificial Sequence
  chemically synthesized
attcttgatttctggattag

SEQ ID NO: 133920 - DNA, 20 bp, Artificial Sequence
  chemically synthesized
cattcttgatttctggatta

SEQ ID NO: 133921 - DNA, 20 bp, Artificial Sequence
  chemically synthesized
cccattcttgatttctggat

SEQ ID NO: 133922 - DNA, 20 bp, Artificial Sequence
  chemically synthesized
tttcctctaatccagaaatc

SEQ ID NO: 133923 - DNA, 20 bp, Artificial Sequence
  chemically synthesized
taatccccattcttgatttc

SEQ ID NO: 133924 - DNA, 20 bp, Artificial Sequence
  chemically synthesized
tctaatccagaaatcaagaa

SEQ ID NO: 133925 - DNA, 20 bp, Artificial Sequence
  chemically synthesized
ctaatccagaaatcaagaat

SEQ ID NO: 133926 - DNA, 20 bp, Artificial Sequence
  chemically synthesized
taatccagaaatcaagaatg

SEQ ID NO: 133927 - DNA, 20 bp, Artificial Sequence
  chemically synthesized
agaaatcaagaatggggatt

SEQ ID NO: 133928 - DNA, 20 bp, Artificial Sequence
  chemically synthesized
gaaatcaagaatggggatta

SEQ ID NO: 133929 - DNA, 20 bp, Artificial Sequence
  chemically synthesized
gaatggggattaaggaaatt

SEQ ID NO: 133930 - DNA, 20 bp, Artificial Sequence
  chemically synthesized
aatggggattaaggaaatta

SEQ ID NO: 133931 - DNA, 20 bp, Artificial Sequence
  chemically synthesized
gaaattaaggaatgaaatta

SEQ ID NO: 133932 - DNA, 20 bp, Artificial Sequence
  chemically synthesized
attaaggaatgaaattaaag

SEQ ID NO: 133933 - DNA, 20 bp, Artificial Sequence
  chemically synthesized
ttaaggaatgaaattaaaga

SEQ ID NO: 133934 - DNA, 20 bp, Artificial Sequence
  chemically synthesized
tgttagtgagataaatacat

SEQ ID NO: 133935 - DNA, 20 bp, Artificial Sequence
  chemically synthesized
attattacttttatgttagt

SEQ ID NO: 133936 - DNA, 20 bp, Artificial Sequence
  chemically synthesized
tatttatctcactaacataa

SEQ ID NO: 133937 - DNA, 20 bp, Artificial Sequence
  chemically synthesized
tgcgattattacttttatgt

SEQ ID NO: 133938 - DNA, 20 bp, Artificial Sequence
  chemically synthesized
aattataacaatggtgatga

SEQ ID NO: 133939 - DNA, 20 bp, Artificial Sequence
  chemically synthesized
ttatgagataattataacaa

SEQ ID NO: 133940 - DNA, 20 bp, Artificial Sequence
  chemically synthesized
ggaagctaatagttggttat

SEQ ID NO: 133941 - DNA, 20 bp, Artificial Sequence
  chemically synthesized
attatctcataaccaactat

SEQ ID NO: 133942 - DNA, 20 bp, Artificial Sequence
  chemically synthesized
agacctaggaagctaatagt

SEQ ID NO: 133943 - DNA, 20 bp, Artificial Sequence
  chemically synthesized
aaaaagacctaggaagctaa

SEQ ID NO: 133944 - DNA, 20 bp, Artificial Sequence
  chemically synthesized
ataaccaactattagcttcc

SEQ ID NO: 133945 - DNA, 20 bp, Artificial Sequence
  chemically synthesized
taaccaactattagcttcct

SEQ ID NO: 133946 - DNA, 20 bp, Artificial Sequence
  chemically synthesized
gcctaacaaaaagacctagg

SEQ ID NO: 133947 - DNA, 20 bp, Artificial Sequence
  chemically synthesized
gaggcctaacaaaaagacct

SEQ ID NO: 133948 - DNA, 20 bp, Artificial Sequence
  chemically synthesized
ggaggcctaacaaaaagacc

SEQ ID NO: 133949 - DNA, 20 bp, Artificial Sequence
  chemically synthesized
agcttcctaggtctttttgt

SEQ ID NO: 133950 - DNA, 20 bp, Artificial Sequence
  chemically synthesized
gcttcctaggtctttttgtt

SEQ ID NO: 133951 - DNA, 20 bp, Artificial Sequence
  chemically synthesized
aattttggaggcctaacaaa

SEQ ID NO: 133952 - DNA, 20 bp, Artificial Sequence
  chemically synthesized
agaaagcttttgaattttgg

SEQ ID NO: 133953 - DNA, 20 bp, Artificial Sequence
  chemically synthesized
aagaaagcttttgaattttg

SEQ ID NO: 133954 - DNA, 20 bp, Artificial Sequence
  chemically synthesized
taaagaaagcttttgaattt

SEQ ID NO: 133955 - DNA, 20 bp, Artificial Sequence
  chemically synthesized
gttaggcctccaaaattcaa

SEQ ID NO: 133956 - DNA, 20 bp, Artificial Sequence
  chemically synthesized
aaatatgggtattgtaaaga

SEQ ID NO: 133957 - DNA, 20 bp, Artificial Sequence
  chemically synthesized
tggaaaatatgggtattgta

SEQ ID NO: 133958 - DNA, 20 bp, Artificial Sequence
  chemically synthesized
tggctccacatggaaaatat

SEQ ID NO: 133959 - DNA, 20 bp, Artificial Sequence
  chemically synthesized
ctggctccacatggaaaata

SEQ ID NO: 133960 - DNA, 20 bp, Artificial Sequence
  chemically synthesized
caatacccatattttccatg

SEQ ID NO: 133961 - DNA, 20 bp, Artificial Sequence
  chemically synthesized
atacccatattttccatgtg

SEQ ID NO: 133962 - DNA, 20 bp, Artificial Sequence
  chemically synthesized
ccactcagcctggctccaca

SEQ ID NO: 133963 - DNA, 20 bp, Artificial Sequence
  chemically synthesized
ccatattttccatgtggagc

SEQ ID NO: 133964 - DNA, 20 bp, Artificial Sequence
  chemically synthesized
catattttccatgtggagcc

SEQ ID NO: 133965 - DNA, 20 bp, Artificial Sequence
  chemically synthesized
tttccatgtggagccaggct

SEQ ID NO: 133966 - DNA, 20 bp, Artificial Sequence
  chemically synthesized
ccatgtggagccaggctgag

SEQ ID NO: 133967 - DNA, 20 bp, Artificial Sequence
  chemically synthesized
tatctcaggtccactcagcc

SEQ ID NO: 133968 - DNA, 20 bp, Artificial Sequence
  chemically synthesized
ataattatctcaggtccact

SEQ ID NO: 133969 - DNA, 20 bp, Artificial Sequence
  chemically synthesized
gagccaggctgagtggacct

SEQ ID NO: 133970 - DNA, 20 bp, Artificial Sequence
  chemically synthesized
gacatgatgataattatctc

SEQ ID NO: 133971 - DNA, 20 bp, Artificial Sequence
  chemically synthesized
ggacatgatgataattatct

SEQ ID NO: 133972 - DNA, 20 bp, Artificial Sequence
  chemically synthesized
agataattatcatcatgtcc

SEQ ID NO: 133973 - DNA, 20 bp, Artificial Sequence
  chemically synthesized
ataattatcatcatgtcccg

SEQ ID NO: 133974 - DNA, 20 bp, Artificial Sequence
  chemically synthesized
caccaaaactttatagctcc

SEQ ID NO: 133975 - DNA, 20 bp, Artificial Sequence
  chemically synthesized
ccaccaaaactttatagctc

SEQ ID NO: 133976 - DNA, 20 bp, Artificial Sequence
  chemically synthesized
catcatgtcccggagctata

SEQ ID NO: 133977 - DNA, 20 bp, Artificial Sequence
  chemically synthesized
aagaacccaccaaaacttta

SEQ ID NO: 133978 - DNA, 20 bp, Artificial Sequence
  chemically synthesized
gtcccggagctataaagttt

SEQ ID NO: 133979 - DNA, 20 bp, Artificial Sequence
  chemically synthesized
ccggagctataaagttttgg

SEQ ID NO: 133980 - DNA, 20 bp, Artificial Sequence
  chemically synthesized
cggagctataaagttttggt

SEQ ID NO: 133981 - DNA, 20 bp, Artificial Sequence
  chemically synthesized
ttttgtttcttgaaagaaac

SEQ ID NO: 133982 - DNA, 20 bp, Artificial Sequence
  chemically synthesized
ggtgggttcttgtttctttc

SEQ ID NO: 133983 - DNA, 20 bp, Artificial Sequence
  chemically synthesized
catgtgtttttgtttcttga

SEQ ID NO: 133984 - DNA, 20 bp, Artificial Sequence
  chemically synthesized
atgtgtacaggaaacacgtg

SEQ ID NO: 133985 - DNA, 20 bp, Artificial Sequence
  chemically synthesized
cctttatcctacatgtgtac

SEQ ID NO: 133986 - DNA, 20 bp, Artificial Sequence
  chemically synthesized
tcctttatcctacatgtgta

SEQ ID NO: 133987 - DNA, 20 bp, Artificial Sequence
  chemically synthesized
acgtgtttcctgtacacatg

SEQ ID NO: 133988 - DNA, 20 bp, Artificial Sequence
  chemically synthesized
cgtgtttcctgtacacatgt

SEQ ID NO: 133989 - DNA, 20 bp, Artificial Sequence
  chemically synthesized
tcctgtacacatgtaggata

SEQ ID NO: 133990 - DNA, 20 bp, Artificial Sequence
  chemically synthesized
cctgtacacatgtaggataa

SEQ ID NO: 133991 - DNA, 20 bp, Artificial Sequence
  chemically synthesized
gtaggataaaggacatgtac

SEQ ID NO: 133992 - DNA, 20 bp, Artificial Sequence
  chemically synthesized
ggataaaggacatgtacaag

SEQ ID NO: 133993 - DNA, 20 bp, Artificial Sequence
  chemically synthesized
tacaagtagtctgcaacttt

SEQ ID NO: 133994 - DNA, 20 bp, Artificial Sequence
  chemically synthesized
actctttgccctaaaagttg

SEQ ID NO: 133995 - DNA, 20 bp, Artificial Sequence
  chemically synthesized
acaagtagtctgcaactttt

SEQ ID NO: 133996 - DNA, 20 bp, Artificial Sequence
  chemically synthesized
caagtagtctgcaactttta

SEQ ID NO: 133997 - DNA, 20 bp, Artificial Sequence
  chemically synthesized
aatcatactctttgccctaa

SEQ ID NO: 133998 - DNA, 20 bp, Artificial Sequence
  chemically synthesized
agtctgcaacttttagggca

SEQ ID NO: 133999 - DNA, 20 bp, Artificial Sequence
  chemically synthesized
tctgcaacttttagggcaaa

SEQ ID NO: 134000 - DNA, 20 bp, Artificial Sequence
  chemically synthesized
aagagtatgattgacatttg

SEQ ID NO: 134001 - DNA, 20 bp, Artificial Sequence
  chemically synthesized
agagtatgattgacatttgt

SEQ ID NO: 134002 - DNA, 20 bp, Artificial Sequence
  chemically synthesized
agtatgattgacatttgtgg

SEQ ID NO: 134003 - DNA, 20 bp, Artificial Sequence
  chemically synthesized
acatttgtgggagtgtctaa

SEQ ID NO: 134004 - DNA, 20 bp, Artificial Sequence
  chemically synthesized
catttgtgggagtgtctaat

SEQ ID NO: 134005 - DNA, 20 bp, Artificial Sequence
  chemically synthesized
atttgtgggagtgtctaatg

SEQ ID NO: 134006 - DNA, 20 bp, Artificial Sequence
  chemically synthesized
gttgctttgaatatccccat

SEQ ID NO: 134007 - DNA, 20 bp, Artificial Sequence
  chemically synthesized
gtgtctaatggggatattca

SEQ ID NO: 134008 - DNA, 20 bp, Artificial Sequence
  chemically synthesized
tggggatattcaaagcaaca

SEQ ID NO: 134009 - DNA, 20 bp, Artificial Sequence
  chemically synthesized
ggggatattcaaagcaacat

SEQ ID NO: 134010 - DNA, 20 bp, Artificial Sequence
  chemically synthesized
agcaacatgggatcatgttt

SEQ ID NO: 134011 - DNA, 20 bp, Artificial Sequence
  chemically synthesized
ggatcatgtttcagaaaact

SEQ ID NO: 134012 - DNA, 20 bp, Artificial Sequence
  chemically synthesized
gatcatgtttcagaaaactc

SEQ ID NO: 134013 - DNA, 20 bp, Artificial Sequence
  chemically synthesized
atcatgtttcagaaaactca

SEQ ID NO: 134014 - DNA, 20 bp, Artificial Sequence
  chemically synthesized
caacctatgagttttgccct

SEQ ID NO: 134015 - DNA, 20 bp, Artificial Sequence
  chemically synthesized
aaaactcagggcaaaactca

SEQ ID NO: 134016 - DNA, 20 bp, Artificial Sequence
  chemically synthesized
aaactcagggcaaaactcat

SEQ ID NO: 134017 - DNA, 20 bp, Artificial Sequence
  chemically synthesized
ccccaggacaagcaacctat

SEQ ID NO: 134018 - DNA, 20 bp, Artificial Sequence
  chemically synthesized
aactcataggttgcttgtcc

SEQ ID NO: 134019 - DNA, 20 bp, Artificial Sequence
  chemically synthesized
actcataggttgcttgtcct

SEQ ID NO: 134020 - DNA, 20 bp, Artificial Sequence
  chemically synthesized
ctcataggttgcttgtcctg

SEQ ID NO: 134021 - DNA, 20 bp, Artificial Sequence
  chemically synthesized
tggctggcttaccccaggac

SEQ ID NO: 134022 - DNA, 20 bp, Artificial Sequence
  chemically synthesized
taggttgcttgtcctggggt

SEQ ID NO: 134023 - DNA, 20 bp, Artificial Sequence
  chemically synthesized
tgtggtggctggcttacccc

SEQ ID NO: 134024 - DNA, 20 bp, Artificial Sequence
  chemically synthesized
atgtggtggctggcttaccc

SEQ ID NO: 134025 - DNA, 20 bp, Artificial Sequence
  chemically synthesized
ttgcttgtcctggggtaagc

SEQ ID NO: 134026 - DNA, 20 bp, Artificial Sequence
  chemically synthesized
tgttcttatgatgtggtggc

SEQ ID NO: 134027 - DNA, 20 bp, Artificial Sequence
  chemically synthesized
tgagtgttcttatgatgtgg

SEQ ID NO: 134028 - DNA, 20 bp, Artificial Sequence
  chemically synthesized
taagccagccaccacatcat

SEQ ID NO: 134029 - DNA, 20 bp, Artificial Sequence
  chemically synthesized
acttgagtgttcttatgatg

SEQ ID NO: 134030 - DNA, 20 bp, Artificial Sequence
  chemically synthesized
accacatcataagaacactc

SEQ ID NO: 134031 - DNA, 20 bp, Artificial Sequence
  chemically synthesized
acatcataagaacactcaag

SEQ ID NO: 134032 - DNA, 20 bp, Artificial Sequence
  chemically synthesized
gttcctccatgggactactt

SEQ ID NO: 134033 - DNA, 20 bp, Artificial Sequence
  chemically synthesized
agaacactcaagtagtccca

SEQ ID NO: 134034 - DNA, 20 bp, Artificial Sequence
  chemically synthesized
aacactcaagtagtcccatg

SEQ ID NO: 134035 - DNA, 20 bp, Artificial Sequence
  chemically synthesized
acactcaagtagtcccatgg

SEQ ID NO: 134036 - DNA, 20 bp, Artificial Sequence
  chemically synthesized
ctctaaacgagttcctccat

SEQ ID NO: 134037 - DNA, 20 bp, Artificial Sequence
  chemically synthesized
cctctaaacgagttcctcca

SEQ ID NO: 134038 - DNA, 20 bp, Artificial Sequence
  chemically synthesized
gtcccatggaggaactcgtt

SEQ ID NO: 134039 - DNA, 20 bp, Artificial Sequence
  chemically synthesized
cccatggaggaactcgttta

SEQ ID NO: 134040 - DNA, 20 bp, Artificial Sequence
  chemically synthesized
ccatggaggaactcgtttag

SEQ ID NO: 134041 - DNA, 20 bp, Artificial Sequence
  chemically synthesized
catggaggaactcgtttaga

SEQ ID NO: 134042 - DNA, 20 bp, Artificial Sequence
  chemically synthesized
tagttggtttccctctaaac

SEQ ID NO: 134043 - DNA, 20 bp, Artificial Sequence
  chemically synthesized
tcgtttagagggaaaccaac

SEQ ID NO: 134044 - DNA, 20 bp, Artificial Sequence
  chemically synthesized
ttagagggaaaccaactaga

SEQ ID NO: 134045 - DNA, 20 bp, Artificial Sequence
  chemically synthesized
gtgagttggtgctgtctagt

SEQ ID NO: 134046 - DNA, 20 bp, Artificial Sequence
  chemically synthesized
gcttgtgagttggtgctgtc

SEQ ID NO: 134047 - DNA, 20 bp, Artificial Sequence
  chemically synthesized
actagacagcaccaactcac

SEQ ID NO: 134048 - DNA, 20 bp, Artificial Sequence
  chemically synthesized
tacttgtatagcttgtgagt

SEQ ID NO: 134049 - DNA, 20 bp, Artificial Sequence
  chemically synthesized
gagttacttgtatagcttgt

SEQ ID NO: 134050 - DNA, 20 bp, Artificial Sequence
  chemically synthesized
caccaactcacaagctatac

SEQ ID NO: 134051 - DNA, 20 bp, Artificial Sequence
  chemically synthesized
ttcacagtgagttacttgta

SEQ ID NO: 134052 - DNA, 20 bp, Artificial Sequence
  chemically synthesized
atacaagtaactcactgtga

SEQ ID NO: 134053 - DNA, 20 bp, Artificial Sequence
  chemically synthesized
gaaggattcactttcacagt

SEQ ID NO: 134054 - DNA, 20 bp, Artificial Sequence
  chemically synthesized
ggctgaaggattcactttca

SEQ ID NO: 134055 - DNA, 20 bp, Artificial Sequence
  chemically synthesized
cactgtgaaagtgaatcctt

SEQ ID NO: 134056 - DNA, 20 bp, Artificial Sequence
  chemically synthesized
gaaagtgaatccttcagccc

SEQ ID NO: 134057 - DNA, 20 bp, Artificial Sequence
  chemically synthesized
gatggcttgactggggctga

SEQ ID NO: 134058 - DNA, 20 bp, Artificial Sequence
  chemically synthesized
tgatggcttgactggggctg

SEQ ID NO: 134059 - DNA, 20 bp, Artificial Sequence
  chemically synthesized
tgaatccttcagccccagtc

SEQ ID NO: 134060 - DNA, 20 bp, Artificial Sequence
  chemically synthesized
gtcatatgatggcttgactg

SEQ ID NO: 134061 - DNA, 20 bp, Artificial Sequence
  chemically synthesized
agtcatatgatggcttgact

SEQ ID NO: 134062 - DNA, 20 bp, Artificial Sequence
  chemically synthesized
cagtcatatgatggcttgac

SEQ ID NO: 134063 - DNA, 20 bp, Artificial Sequence
  chemically synthesized
attaggctgcagtcatatga

SEQ ID NO: 134064 - DNA, 20 bp, Artificial Sequence
  chemically synthesized
gtcaagccatcatatgactg

SEQ ID NO: 134065 - DNA, 20 bp, Artificial Sequence
  chemically synthesized
ctcagatgtcaattaggctg

SEQ ID NO: 134066 - DNA, 20 bp, Artificial Sequence
  chemically synthesized
gttgcactcagatgtcaatt

SEQ ID NO: 134067 - DNA, 20 bp, Artificial Sequence
  chemically synthesized
tgttgcactcagatgtcaat

SEQ ID NO: 134068 - DNA, 20 bp, Artificial Sequence
  chemically synthesized
ctgcagcctaattgacatct

SEQ ID NO: 134069 - DNA, 20 bp, Artificial Sequence
  chemically synthesized
atcactcatgatgttgcact

SEQ ID NO: 134070 - DNA, 20 bp, Artificial Sequence
  chemically synthesized
acatctgagtgcaacatcat

SEQ ID NO: 134071 - DNA, 20 bp, Artificial Sequence
  chemically synthesized
gcaacatcatgagtgatcgt

SEQ ID NO: 134072 - DNA, 20 bp, Artificial Sequence
  chemically synthesized
catcatgagtgatcgtgaga

SEQ ID NO: 134073 - DNA, 20 bp, Artificial Sequence
  chemically synthesized
tgagacagaacccctcaacc

SEQ ID NO: 134074 - DNA, 20 bp, Artificial Sequence
  chemically synthesized
tcatgcattgcttggttgag

SEQ ID NO: 134075 - DNA, 20 bp, Artificial Sequence
  chemically synthesized
ttcatgcattgcttggttga

SEQ ID NO: 134076 - DNA, 20 bp, Artificial Sequence
  chemically synthesized
attcatgcattgcttggttg

SEQ ID NO: 134077 - DNA, 20 bp, Artificial Sequence
  chemically synthesized
gattcatgcattgcttggtt

SEQ ID NO: 134078 - DNA, 20 bp, Artificial Sequence
  chemically synthesized
gtcaggattcatgcattgct

SEQ ID NO: 134079 - DNA, 20 bp, Artificial Sequence
  chemically synthesized
aatgcatgaatcctgaccta

SEQ ID NO: 134080 - DNA, 20 bp, Artificial Sequence
  chemically synthesized
actcataggttctgtaggtc

SEQ ID NO: 134081 - DNA, 20 bp, Artificial Sequence
  chemically synthesized
cactcataggttctgtaggt

SEQ ID NO: 134082 - DNA, 20 bp, Artificial Sequence
  chemically synthesized
ttatcactcataggttctgt

SEQ ID NO: 134083 - DNA, 20 bp, Artificial Sequence
  chemically synthesized
attatcactcataggttctg

SEQ ID NO: 134084 - DNA, 20 bp, Artificial Sequence
  chemically synthesized
tcctgacctacagaacctat

SEQ ID NO: 134085 - DNA, 20 bp, Artificial Sequence
  chemically synthesized
aatcatttattatcactcat

SEQ ID NO: 134086 - DNA, 20 bp, Artificial Sequence
  chemically synthesized
taatcatttattatcactca

SEQ ID NO: 134087 - DNA, 20 bp, Artificial Sequence
  chemically synthesized
ataaatgattattgctactt

SEQ ID NO: 134088 - DNA, 20 bp, Artificial Sequence
  chemically synthesized
taaatgattattgctacttt

SEQ ID NO: 134089 - DNA, 20 bp, Artificial Sequence
  chemically synthesized
ccaaacttagtgtcctaaag

SEQ ID NO: 134090 - DNA, 20 bp, Artificial Sequence
  chemically synthesized
accccaaacttagtgtccta

SEQ ID NO: 134091 - DNA, 20 bp, Artificial Sequence
  chemically synthesized
tattgctactttaggacact

SEQ ID NO: 134092 - DNA, 20 bp, Artificial Sequence
  chemically synthesized
ctactttaggacactaagtt

SEQ ID NO: 134093 - DNA, 20 bp, Artificial Sequence
  chemically synthesized
tactttaggacactaagttt

SEQ ID NO: 134094 - DNA, 20 bp, Artificial Sequence
  chemically synthesized
actttaggacactaagtttg

SEQ ID NO: 134095 - DNA, 20 bp, Artificial Sequence
  chemically synthesized
taaaacaatcaccccaaact

SEQ ID NO: 134096 - DNA, 20 bp, Artificial Sequence
  chemically synthesized
agtttggggtgattgtttta

SEQ ID NO: 134097 - DNA, 20 bp, Artificial Sequence
  chemically synthesized
gggtgattgttttacagtaa

SEQ ID NO: 134098 - DNA, 20 bp, Artificial Sequence
  chemically synthesized
ggtgattgttttacagtaac

SEQ ID NO: 134099 - DNA, 20 bp, Artificial Sequence
  chemically synthesized
ttgtcaggaaagagtttgaa

SEQ ID NO: 134100 - DNA, 20 bp, Artificial Sequence
  chemically synthesized
gttctacttttgtcaggaaa

SEQ ID NO: 134101 - DNA, 20 bp, Artificial Sequence
  chemically synthesized
ttgttctacttttgtcagga

SEQ ID NO: 134102 - DNA, 20 bp, Artificial Sequence
  chemically synthesized
ttcaaactctttcctgacaa

SEQ ID NO: 134103 - DNA, 20 bp, Artificial Sequence
  chemically synthesized
gagcttgttctacttttgtc

SEQ ID NO: 134104 - DNA, 20 bp, Artificial Sequence
  chemically synthesized
aaactctttcctgacaaaag

SEQ ID NO: 134105 - DNA, 20 bp, Artificial Sequence
  chemically synthesized
cgagcttgttctacttttgt

SEQ ID NO: 134106 - DNA, 20 bp, Artificial Sequence
  chemically synthesized
tttcctgacaaaagtagaac

SEQ ID NO: 134107 - DNA, 20 bp, Artificial Sequence
  chemically synthesized
tgacaaaagtagaacaagct

SEQ ID NO: 134108 - DNA, 20 bp, Artificial Sequence
  chemically synthesized
tacatgaaaaggggaaagcc

SEQ ID NO: 134109 - DNA, 20 bp, Artificial Sequence
  chemically synthesized
ctttctacatgaaaagggga

SEQ ID NO: 134110 - DNA, 20 bp, Artificial Sequence
  chemically synthesized
tgacctttctacatgaaaag

SEQ ID NO: 134111 - DNA, 20 bp, Artificial Sequence
  chemically synthesized
gtgacctttctacatgaaaa

SEQ ID NO: 134112 - DNA, 20 bp, Artificial Sequence
  chemically synthesized
tcggctttccccttttcatg

SEQ ID NO: 134113 - DNA, 20 bp, Artificial Sequence
  chemically synthesized
tgtgacctttctacatgaaa

SEQ ID NO: 134114 - DNA, 20 bp, Artificial Sequence
  chemically synthesized
ttgtgacctttctacatgaa

SEQ ID NO: 134115 - DNA, 20 bp, Artificial Sequence
  chemically synthesized
ctttccccttttcatgtaga

SEQ ID NO: 134116 - DNA, 20 bp, Artificial Sequence
  chemically synthesized
tttccccttttcatgtagaa

SEQ ID NO: 134117 - DNA, 20 bp, Artificial Sequence
  chemically synthesized
aagtaagtaggaaggattaa

SEQ ID NO: 134118 - DNA, 20 bp, Artificial Sequence
  chemically synthesized
catttataaagtaagtagga

SEQ ID NO: 134119 - DNA, 20 bp, Artificial Sequence
  chemically synthesized
acatttataaagtaagtagg

SEQ ID NO: 134120 - DNA, 20 bp, Artificial Sequence
  chemically synthesized
aaaacatttataaagtaagt

SEQ ID NO: 134121 - DNA, 20 bp, Artificial Sequence
  chemically synthesized
taaaacatttataaagtaag

SEQ ID NO: 134122 - DNA, 20 bp, Artificial Sequence
  chemically synthesized
aagtaaaacatttataaagt

SEQ ID NO: 134123 - DNA, 20 bp, Artificial Sequence
  chemically synthesized
tcttaagtaaaacatttata

SEQ ID NO: 134124 - DNA, 20 bp, Artificial Sequence
  chemically synthesized
actttataaatgttttactt

SEQ ID NO: 134125 - DNA, 20 bp, Artificial Sequence
  chemically synthesized
ataaatgttttacttaagac

SEQ ID NO: 134126 - DNA, 20 bp, Artificial Sequence
  chemically synthesized
tattctgttgtacttgtctt

SEQ ID NO: 134127 - DNA, 20 bp, Artificial Sequence
  chemically synthesized
tttacttaagacaagtacaa

SEQ ID NO: 134128 - DNA, 20 bp, Artificial Sequence
  chemically synthesized
aagacaagtacaacagaata

SEQ ID NO: 134129 - DNA, 20 bp, Artificial Sequence
  chemically synthesized
caagtacaacagaataaaga

SEQ ID NO: 134130 - DNA, 20 bp, Artificial Sequence
  chemically synthesized
aagtacaacagaataaagac

SEQ ID NO: 134131 - DNA, 20 bp, Artificial Sequence
  chemically synthesized
tacaacagaataaagacagg

SEQ ID NO: 134132 - DNA, 20 bp, Artificial Sequence
  chemically synthesized
acagaataaagacaggtggc

SEQ ID NO: 134133 - DNA, 20 bp, Artificial Sequence
  chemically synthesized
gcaattttcaaatcatgtat

SEQ ID NO: 134134 - DNA, 20 bp, Artificial Sequence
  chemically synthesized
aatcatgtataagtaaattt

SEQ ID NO: 134135 - DNA, 20 bp, Artificial Sequence
  chemically synthesized
tgtataagtaaattttggta

SEQ ID NO: 134136 - DNA, 20 bp, Artificial Sequence
  chemically synthesized
taagtaaattttggtaaaga

SEQ ID NO: 134137 - DNA, 20 bp, Artificial Sequence
  chemically synthesized
gtaaattttggtaaagaaag

SEQ ID NO: 134138 - DNA, 20 bp, Artificial Sequence
  chemically synthesized
aattttggtaaagaaagaag

SEQ ID NO: 134139 - DNA, 20 bp, Artificial Sequence
  chemically synthesized
tttggtaaagaaagaagtag

SEQ ID NO: 134140 - DNA, 20 bp, Artificial Sequence
  chemically synthesized
ttggtaaagaaagaagtagt

SEQ ID NO: 134141 - DNA, 20 bp, Artificial Sequence
  chemically synthesized
tcaagttatagaaaattgta

SEQ ID NO: 134142 - DNA, 20 bp, Artificial Sequence
  chemically synthesized
ctcaagttatagaaaattgt

SEQ ID NO: 134143 - DNA, 20 bp, Artificial Sequence
  chemically synthesized
tctcaagttatagaaaattg

SEQ ID NO: 134144 - DNA, 20 bp, Artificial Sequence
  chemically synthesized
cctacaattttctataactt

SEQ ID NO: 134145 - DNA, 20 bp, Artificial Sequence
  chemically synthesized
tgctctcagctctcaagtta

SEQ ID NO: 134146 - DNA, 20 bp, Artificial Sequence
  chemically synthesized
tacaattttctataacttga

SEQ ID NO: 134147 - DNA, 20 bp, Artificial Sequence
  chemically synthesized
ttttctataacttgagagct

SEQ ID NO: 134148 - DNA, 20 bp, Artificial Sequence
  chemically synthesized
aaaaaatgctctcagctctc

SEQ ID NO: 134149 - DNA, 20 bp, Artificial Sequence
  chemically synthesized
ttctataacttgagagctga

SEQ ID NO: 134150 - DNA, 20 bp, Artificial Sequence
  chemically synthesized
ctgttcctaaaaaatgctct

SEQ ID NO: 134151 - DNA, 20 bp, Artificial Sequence
  chemically synthesized
tgagagctgagagcattttt

SEQ ID NO: 134152 - DNA, 20 bp, Artificial Sequence
  chemically synthesized
gagagctgagagcatttttt

SEQ ID NO: 134153 - DNA, 20 bp, Artificial Sequence
  chemically synthesized
ctgagagcattttttaggaa

SEQ ID NO: 134154 - DNA, 20 bp, Artificial Sequence
  chemically synthesized
cattttttaggaacagtcca

SEQ ID NO: 134155 - DNA, 20 bp, Artificial Sequence
  chemically synthesized
caagggttaaacacgtgcca

SEQ ID NO: 134156 - DNA, 20 bp, Artificial Sequence
  chemically synthesized
catggcacgtgtttaaccct

SEQ ID NO: 134157 - DNA, 20 bp, Artificial Sequence
  chemically synthesized
cacgtgtttaacccttggct

SEQ ID NO: 134158 - DNA, 20 bp, Artificial Sequence
  chemically synthesized
tttagataaaactaagccaa

SEQ ID NO: 134159 - DNA, 20 bp, Artificial Sequence
  chemically synthesized
ttttagataaaactaagcca

SEQ ID NO: 134160 - DNA, 20 bp, Artificial Sequence
  chemically synthesized
attttagataaaactaagcc

SEQ ID NO: 134161 - DNA, 20 bp, Artificial Sequence
  chemically synthesized
catgcattttagataaaact

SEQ ID NO: 134162 - DNA, 20 bp, Artificial Sequence
  chemically synthesized
cctgatggcatcatgcattt

SEQ ID NO: 134163 - DNA, 20 bp, Artificial Sequence
  chemically synthesized
tctaaaatgcatgatgccat

SEQ ID NO: 134164 - DNA, 20 bp, Artificial Sequence
  chemically synthesized
ctaaaatgcatgatgccatc

SEQ ID NO: 134165 - DNA, 20 bp, Artificial Sequence
  chemically synthesized
taaaatgcatgatgccatca

SEQ ID NO: 134166 - DNA, 20 bp, Artificial Sequence
  chemically synthesized
aaatgcatgatgccatcagg

SEQ ID NO: 134167 - DNA, 20 bp, Artificial Sequence
  chemically synthesized
ataggaatattactccctga

SEQ ID NO: 134168 - DNA, 20 bp, Artificial Sequence
  chemically synthesized
tggtacctgtgggcataaat

SEQ ID NO: 134169 - DNA, 20 bp, Artificial Sequence
  chemically synthesized
ttggtacctgtgggcataaa

SEQ ID NO: 134170 - DNA, 20 bp, Artificial Sequence
  chemically synthesized
aatattcctatttatgccca

SEQ ID NO: 134171 - DNA, 20 bp, Artificial Sequence
  chemically synthesized
atattcctatttatgcccac

SEQ ID NO: 134172 - DNA, 20 bp, Artificial Sequence
  chemically synthesized
tgttatattttggtacctgt

SEQ ID NO: 134173 - DNA, 20 bp, Artificial Sequence
  chemically synthesized
ctgttatattttggtacctg

SEQ ID NO: 134174 - DNA, 20 bp, Artificial Sequence
  chemically synthesized
cttgaatttctgttatattt

SEQ ID NO: 134175 - DNA, 20 bp, Artificial Sequence
  chemically synthesized
ccacaggtaccaaaatataa

SEQ ID NO: 134176 - DNA, 20 bp, Artificial Sequence
  chemically synthesized
ccaaaatataacagaaattc

SEQ ID NO: 134177 - DNA, 20 bp, Artificial Sequence
  chemically synthesized
ataacagaaattcaagactt

SEQ ID NO: 134178 - DNA, 20 bp, Artificial Sequence
  chemically synthesized
ctacagggtcattgtaacta

SEQ ID NO: 134179 - DNA, 20 bp, Artificial Sequence
  chemically synthesized
ctttagttacaatgaccctg

SEQ ID NO: 134180 - DNA, 20 bp, Artificial Sequence
  chemically synthesized
tttagttacaatgaccctgt

SEQ ID NO: 134181 - DNA, 20 bp, Artificial Sequence
  chemically synthesized
tttttatcttatgacctaca

SEQ ID NO: 134182 - DNA, 20 bp, Artificial Sequence
  chemically synthesized
atttttatcttatgacctac

SEQ ID NO: 134183 - DNA, 20 bp, Artificial Sequence
  chemically synthesized
catttttatcttatgaccta

SEQ ID NO: 134184 - DNA, 20 bp, Artificial Sequence
  chemically synthesized
acaatgaccctgtaggtcat

SEQ ID NO: 134185 - DNA, 20 bp, Artificial Sequence
  chemically synthesized
aggtcataagataaaaatgc

SEQ ID NO: 134186 - DNA, 20 bp, Artificial Sequence
  chemically synthesized
tactctacatgtttataggc

SEQ ID NO: 134187 - DNA, 20 bp, Artificial Sequence
  chemically synthesized
gagatactctacatgtttat

SEQ ID NO: 134188 - DNA, 20 bp, Artificial Sequence
  chemically synthesized
agagatactctacatgttta

SEQ ID NO: 134189 - DNA, 20 bp, Artificial Sequence
  chemically synthesized
aatgctagcctataaacatg

SEQ ID NO: 134190 - DNA, 20 bp, Artificial Sequence
  chemically synthesized
tgctagcctataaacatgta

SEQ ID NO: 134191 - DNA, 20 bp, Artificial Sequence
  chemically synthesized
acatgtagagtatctctttc

SEQ ID NO: 134192 - DNA, 20 bp, Artificial Sequence
  chemically synthesized
catgtagagtatctctttct

SEQ ID NO: 134193 - DNA, 20 bp, Artificial Sequence
  chemically synthesized
aacagagatgagcccagaaa

SEQ ID NO: 134194 - DNA, 20 bp, Artificial Sequence
  chemically synthesized
caaacagagatgagcccaga

SEQ ID NO: 134195 - DNA, 20 bp, Artificial Sequence
  chemically synthesized
aatacaaacagagatgagcc

SEQ ID NO: 134196 - DNA, 20 bp, Artificial Sequence
  chemically synthesized
agacaaatacaaacagagat

SEQ ID NO: 134197 - DNA, 20 bp, Artificial Sequence
  chemically synthesized
taataagacaaatacaaaca

SEQ ID NO: 134198 - DNA, 20 bp, Artificial Sequence
  chemically synthesized
gctaataagacaaatacaaa

SEQ ID NO: 134199 - DNA, 20 bp, Artificial Sequence
  chemically synthesized
tctgtttgtatttgtcttat

SEQ ID NO: 134200 - DNA, 20 bp, Artificial Sequence
  chemically synthesized
ctcagacaaagtgagctaat

SEQ ID NO: 134201 - DNA, 20 bp, Artificial Sequence
  chemically synthesized
attttatactcagacaaagt

SEQ ID NO: 134202 - DNA, 20 bp, Artificial Sequence
  chemically synthesized
cttattagctcactttgtct

SEQ ID NO: 134203 - DNA, 20 bp, Artificial Sequence
  chemically synthesized
aagaattttatactcagaca

SEQ ID NO: 134204 - DNA, 20 bp, Artificial Sequence
  chemically synthesized
atattaaagaattttatact

SEQ ID NO: 134205 - DNA, 20 bp, Artificial Sequence
  chemically synthesized
gattatgagtaaatatatta

SEQ ID NO: 134206 - DNA, 20 bp, Artificial Sequence
  chemically synthesized
tttgtgataaagatgattat

SEQ ID NO: 134207 - DNA, 20 bp, Artificial Sequence
  chemically synthesized
tttcttccttttttgtgata

SEQ ID NO: 134208 - DNA, 20 bp, Artificial Sequence
  chemically synthesized
taatcatctttatcacaaaa

SEQ ID NO: 134209 - DNA, 20 bp, Artificial Sequence
  chemically synthesized
aatcatctttatcacaaaaa

SEQ ID NO: 134210 - DNA, 20 bp, Artificial Sequence
  chemically synthesized
catctttatcacaaaaaagg

SEQ ID NO: 134211 - DNA, 20 bp, Artificial Sequence
  chemically synthesized
aataaaccaattaaagaaaa

SEQ ID NO: 134212 - DNA, 20 bp, Artificial Sequence
  chemically synthesized
gaaaaactattttctttaat

SEQ ID NO: 134213 - DNA, 20 bp, Artificial Sequence
  chemically synthesized
ttaaataaataaaccaatta

SEQ ID NO: 134214 - DNA, 20 bp, Artificial Sequence
  chemically synthesized
taattggtttatttatttaa

SEQ ID NO: 134215 - DNA, 20 bp, Artificial Sequence
  chemically synthesized
gtttattatgtttaattttc

SEQ ID NO: 134216 - DNA, 20 bp, Artificial Sequence
  chemically synthesized
tttattatgtttaattttca

SEQ ID NO: 134217 - DNA, 20 bp, Artificial Sequence
  chemically synthesized
attatgtttaattttcaagg

SEQ ID NO: 134218 - DNA, 20 bp, Artificial Sequence
  chemically synthesized
gaataaaacatttgttaacc

SEQ ID NO: 134219 - DNA, 20 bp, Artificial Sequence
  chemically synthesized
ctttttaaggggaaagatct

SEQ ID NO: 134220 - DNA, 20 bp, Artificial Sequence
  chemically synthesized
tctttttaaggggaaagatc

SEQ ID NO: 134221 - DNA, 20 bp, Artificial Sequence
  chemically synthesized
tatgtttctttttaagggga

SEQ ID NO: 134222 - DNA, 20 bp, Artificial Sequence
  chemically synthesized
cccagatctttccccttaaa

SEQ ID NO: 134223 - DNA, 20 bp, Artificial Sequence
  chemically synthesized
tcattatgtttctttttaag

SEQ ID NO: 134224 - DNA, 20 bp, Artificial Sequence
  chemically synthesized
ttcattatgtttctttttaa

SEQ ID NO: 134225 - DNA, 20 bp, Artificial Sequence
  chemically synthesized
cttcattatgtttcttttta

SEQ ID NO: 134226 - DNA, 20 bp, Artificial Sequence
  chemically synthesized
tcttcattatgtttcttttt

SEQ ID NO: 134227 - DNA, 20 bp, Artificial Sequence
  chemically synthesized
ccttaaaaagaaacataatg

SEQ ID NO: 134228 - DNA, 20 bp, Artificial Sequence
  chemically synthesized
ataatgaagacaaaaacaat

SEQ ID NO: 134229 - DNA, 20 bp, Artificial Sequence
  chemically synthesized
atgaagacaaaaacaattag

SEQ ID NO: 134230 - DNA, 20 bp, Artificial Sequence
  chemically synthesized
accataattatgaacataaa

SEQ ID NO: 134231 - DNA, 20 bp, Artificial Sequence
  chemically synthesized
actatttatgttcataatta

SEQ ID NO: 134232 - DNA, 20 bp, Artificial Sequence
  chemically synthesized
aggaaaaatattttttatta

SEQ ID NO: 134233 - DNA, 20 bp, Artificial Sequence
  chemically synthesized
ctttcaagtgagtttataat

SEQ ID NO: 134234 - DNA, 20 bp, Artificial Sequence
  chemically synthesized
tctttcaagtgagtttataa

SEQ ID NO: 134235 - DNA, 20 bp, Artificial Sequence
  chemically synthesized
cctattataaactcacttga

SEQ ID NO: 134236 - DNA, 20 bp, Artificial Sequence
  chemically synthesized
taattataaatctttcaagt

SEQ ID NO: 134237 - DNA, 20 bp, Artificial Sequence
  chemically synthesized
tatttaattataaatctttc

SEQ ID NO: 134238 - DNA, 20 bp, Artificial Sequence
  chemically synthesized
ataattaaatataatcgcaa

SEQ ID NO: 134239 - DNA, 20 bp, Artificial Sequence
  chemically synthesized
taattaaatataatcgcaac

SEQ ID NO: 134240 - DNA, 20 bp, Artificial Sequence
  chemically synthesized
tataatcgcaacaggtaatt

SEQ ID NO: 134241 - DNA, 20 bp, Artificial Sequence
  chemically synthesized
atatcaaaacatatttgaat

SEQ ID NO: 134242 - DNA, 20 bp, Artificial Sequence
  chemically synthesized
aatatcaaaacatatttgaa

SEQ ID NO: 134243 - DNA, 20 bp, Artificial Sequence
  chemically synthesized
tatttcatttttaaattaag

SEQ ID NO: 134244 - DNA, 20 bp, Artificial Sequence
  chemically synthesized
gtatttcatttttaaattaa

SEQ ID NO: 134245 - DNA, 20 bp, Artificial Sequence
  chemically synthesized
atgtatttcatttttaaatt

SEQ ID NO: 134246 - DNA, 20 bp, Artificial Sequence
  chemically synthesized
tgaaatacatttatgaaaaa

SEQ ID NO: 134247 - DNA, 20 bp, Artificial Sequence
  chemically synthesized
ggaaaacattcatttcatga

SEQ ID NO: 134248 - DNA, 20 bp, Artificial Sequence
  chemically synthesized
gaaaacattcatttcatgat

SEQ ID NO: 134249 - DNA, 20 bp, Artificial Sequence
  chemically synthesized
ttcatttcatgataggtaat

SEQ ID NO: 134250 - DNA, 20 bp, Artificial Sequence
  chemically synthesized
tattaatttaacacaacgta

SEQ ID NO: 134251 - DNA, 20 bp, Artificial Sequence
  chemically synthesized
attaatttaacacaacgtat

SEQ ID NO: 134252 - DNA, 20 bp, Artificial Sequence
  chemically synthesized
aatttaacacaacgtatagg

SEQ ID NO: 134253 - DNA, 20 bp, Artificial Sequence
  chemically synthesized
aaaactgatatataaaaaac

SEQ ID NO: 134254 - DNA, 20 bp, Artificial Sequence
  chemically synthesized
catacttgttttttatatat

SEQ ID NO: 134255 - DNA, 20 bp, Artificial Sequence
  chemically synthesized
atatatcagtttttatatac

SEQ ID NO: 134256 - DNA, 20 bp, Artificial Sequence
  chemically synthesized
acaagttacaattactctga

SEQ ID NO: 134257 - DNA, 20 bp, Artificial Sequence
  chemically synthesized
tgaatttcagagttctatca

SEQ ID NO: 134258 - DNA, 20 bp, Artificial Sequence
  chemically synthesized
aatgaatttcagagttctat

SEQ ID NO: 134259 - DNA, 20 bp, Artificial Sequence
  chemically synthesized
taatatcttaatgaatttca

SEQ ID NO: 134260 - DNA, 20 bp, Artificial Sequence
  chemically synthesized
tttaatatcttaatgaattt

SEQ ID NO: 134261 - DNA, 20 bp, Artificial Sequence
  chemically synthesized
atagaactctgaaattcatt

SEQ ID NO: 134262 - DNA, 20 bp, Artificial Sequence
  chemically synthesized
tgaaattcattaagatatta

SEQ ID NO: 134263 - DNA, 20 bp, Artificial Sequence
  chemically synthesized
tatacgttaaataatagaaa

SEQ ID NO: 134264 - DNA, 20 bp, Artificial Sequence
  chemically synthesized
tggaaatatacgttaaataa

SEQ ID NO: 134265 - DNA, 20 bp, Artificial Sequence
  chemically synthesized
tattatttaacgtatatttc

SEQ ID NO: 134266 - DNA, 20 bp, Artificial Sequence
  chemically synthesized
attatttaacgtatatttcc

SEQ ID NO: 134267 - DNA, 20 bp, Artificial Sequence
  chemically synthesized
tacctagttaataaggtacc

SEQ ID NO: 134268 - DNA, 20 bp, Artificial Sequence
  chemically synthesized
tttccaggtaccttattaac

SEQ ID NO: 134269 - DNA, 20 bp, Artificial Sequence
  chemically synthesized
ttagtagtacctagttaata

SEQ ID NO: 134270 - DNA, 20 bp, Artificial Sequence
  chemically synthesized
ttccaggtaccttattaact

SEQ ID NO: 134271 - DNA, 20 bp, Artificial Sequence
  chemically synthesized
tttagtagtacctagttaat

SEQ ID NO: 134272 - DNA, 20 bp, Artificial Sequence
  chemically synthesized
tttatttttttagtagtacc

SEQ ID NO: 134273 - DNA, 20 bp, Artificial Sequence
  chemically synthesized
tggttcttttatttttttag

SEQ ID NO: 134274 - DNA, 20 bp, Artificial Sequence
  chemically synthesized
tcgtggttcttttatttttt

SEQ ID NO: 134275 - DNA, 20 bp, Artificial Sequence
  chemically synthesized
aggtactactaaaaaaataa

SEQ ID NO: 134276 - DNA, 20 bp, Artificial Sequence
  chemically synthesized
taaaaaaataaaagaaccac

SEQ ID NO: 134277 - DNA, 20 bp, Artificial Sequence
  chemically synthesized
ttcttcacatataaatctcg

SEQ ID NO: 134278 - DNA, 20 bp, Artificial Sequence
  chemically synthesized
aaccacgagatttatatgtg

SEQ ID NO: 134279 - DNA, 20 bp, Artificial Sequence
  chemically synthesized
catcatcagccatcatcatg

SEQ ID NO: 134280 - DNA, 20 bp, Artificial Sequence
  chemically synthesized
cattatgaacctcatgatga

SEQ ID NO: 134281 - DNA, 20 bp, Artificial Sequence
  chemically synthesized
ccatcatcagccatcatcat

SEQ ID NO: 134282 - DNA, 20 bp, Artificial Sequence
  chemically synthesized
ctcatgatgatggctgatga

SEQ ID NO: 134283 - DNA, 20 bp, Artificial Sequence
  chemically synthesized
cacataaaatttaccatcat

SEQ ID NO: 134284 - DNA, 20 bp, Artificial Sequence
  chemically synthesized
gtaaattttatgtgttaact

SEQ ID NO: 134285 - DNA, 20 bp, Artificial Sequence
  chemically synthesized
attttatgtgttaacttggc

SEQ ID NO: 134286 - DNA, 20 bp, Artificial Sequence
  chemically synthesized
ttttatgtgttaacttggct

SEQ ID NO: 134287 - DNA, 20 bp, Artificial Sequence
  chemically synthesized
ctgggaaccatagcccagcc

SEQ ID NO: 134288 - DNA, 20 bp, Artificial Sequence
  chemically synthesized
gtgttaacttggctgggcta

SEQ ID NO: 134289 - DNA, 20 bp, Artificial Sequence
  chemically synthesized
aacaactgggaaccatagcc

SEQ ID NO: 134290 - DNA, 20 bp, Artificial Sequence
  chemically synthesized
cttggctgggctatggttcc

SEQ ID NO: 134291 - DNA, 20 bp, Artificial Sequence
  chemically synthesized
gaccaaacaactgggaacca

SEQ ID NO: 134292 - DNA, 20 bp, Artificial Sequence
  chemically synthesized
ggctatggttcccagttgtt

SEQ ID NO: 134293 - DNA, 20 bp, Artificial Sequence
  chemically synthesized
tggtgtttgaccaaacaact

SEQ ID NO: 134294 - DNA, 20 bp, Artificial Sequence
  chemically synthesized
ttggtgtttgaccaaacaac

SEQ ID NO: 134295 - DNA, 20 bp, Artificial Sequence
  chemically synthesized
tgtttggtcaaacaccaatc

SEQ ID NO: 134296 - DNA, 20 bp, Artificial Sequence
  chemically synthesized
cttcacagcaacatctagat

SEQ ID NO: 134297 - DNA, 20 bp, Artificial Sequence
  chemically synthesized
aataccttcacagcaacatc

SEQ ID NO: 134298 - DNA, 20 bp, Artificial Sequence
  chemically synthesized
ccaatctagatgttgctgtg

SEQ ID NO: 134299 - DNA, 20 bp, Artificial Sequence
  chemically synthesized
caatctagatgttgctgtga

SEQ ID NO: 134300 - DNA, 20 bp, Artificial Sequence
  chemically synthesized
acatctaaaaaataccttca

SEQ ID NO: 134301 - DNA, 20 bp, Artificial Sequence
  chemically synthesized
gttgctgtgaaggtattttt

SEQ ID NO: 134302 - DNA, 20 bp, Artificial Sequence
  chemically synthesized
gatgtgattaacatttcaat

SEQ ID NO: 134303 - DNA, 20 bp, Artificial Sequence
  chemically synthesized
gtgattaacatttcaatcag
